United States Patent 7,341,835 (METHODS OF ANALYSIS OF ALTERNATIVE SPLICING IN MOUSE) - sequence listing, part 4

SEQ ID NO: 119343 - DNA, 25 bp, Mus musculus
ggctccaacaccaagtggctcaggt

SEQ ID NO: 119344 - DNA, 25 bp, Mus musculus
ggctccaatccggttccatccggtt

SEQ ID NO: 119345 - DNA, 25 bp, Mus musculus
ggctccacacaagaagctgtactgt

SEQ ID NO: 119346 - DNA, 25 bp, Mus musculus
ggctccaccttgtacacgaaggcta

SEQ ID NO: 119347 - DNA, 25 bp, Mus musculus
ggctccagcctcaatggctgtcaga

SEQ ID NO: 119348 - DNA, 25 bp, Mus musculus
ggctcccaaagctataccaccagga

SEQ ID NO: 119349 - DNA, 25 bp, Mus musculus
ggctcccaatgcactcggaagtcag

SEQ ID NO: 119350 - DNA, 25 bp, Mus musculus
ggctcccaccaaaaagctctggtga

SEQ ID NO: 119351 - DNA, 25 bp, Mus musculus
ggctcccagaaggtagtcactcagg

SEQ ID NO: 119352 - DNA, 25 bp, Mus musculus
ggctcccagactcagcggcgacagt

SEQ ID NO: 119353 - DNA, 25 bp, Mus musculus
ggctcccagcgctataaaaacttta

SEQ ID NO: 119354 - DNA, 25 bp, Mus musculus
ggctcccatgattaccctgaagcgg

SEQ ID NO: 119355 - DNA, 25 bp, Mus musculus
ggctcccgaatgaccccaaagtttg

SEQ ID NO: 119356 - DNA, 25 bp, Mus musculus
ggctcccgagttcccaagttacaga

SEQ ID NO: 119357 - DNA, 25 bp, Mus musculus
ggctccctagcagctgttggcgtct

SEQ ID NO: 119358 - DNA, 25 bp, Mus musculus
ggctccctcattttccatagacctc

SEQ ID NO: 119359 - DNA, 25 bp, Mus musculus
ggctccctggcagtacttctgatga

SEQ ID NO: 119360 - DNA, 25 bp, Mus musculus
ggctccctgtctaagtggtaaggtg

SEQ ID NO: 119361 - DNA, 25 bp, Mus musculus
ggctcccttcagtttggctataaca

SEQ ID NO: 119362 - DNA, 25 bp, Mus musculus
ggctccgaccacctttgtaataacg

SEQ ID NO: 119363 - DNA, 25 bp, Mus musculus
ggctccggaacctggcccagatatt

SEQ ID NO: 119364 - DNA, 25 bp, Mus musculus
ggctcctatgtagtggccatggaaa

SEQ ID NO: 119365 - DNA, 25 bp, Mus musculus
ggctcctccatcctgtctcccagct

SEQ ID NO: 119366 - DNA, 25 bp, Mus musculus
ggctcctccggaaaggcttgggcca

SEQ ID NO: 119367 - DNA, 25 bp, Mus musculus
ggctcctgaaatcctccggtgtgaa

SEQ ID NO: 119368 - DNA, 25 bp, Mus musculus
ggctcctgcagccattcaccaagta

SEQ ID NO: 119369 - DNA, 25 bp, Mus musculus
ggctcctgtatgttgatgaccccaa

SEQ ID NO: 119370 - DNA, 25 bp, Mus musculus
ggctccttcggagacatctatctcg

SEQ ID NO: 119371 - DNA, 25 bp, Mus musculus
ggctcgaacccatcagttggaagat

SEQ ID NO: 119372 - DNA, 25 bp, Mus musculus
ggctcgaatactacggaatgagtag

SEQ ID NO: 119373 - DNA, 25 bp, Mus musculus
ggctcgactgccaagaagtatccac

SEQ ID NO: 119374 - DNA, 25 bp, Mus musculus
ggctcgagtccagtaagaggcatcc

SEQ ID NO: 119375 - DNA, 25 bp, Mus musculus
ggctcgcagtcagtggacgacttct

SEQ ID NO: 119376 - DNA, 25 bp, Mus musculus
ggctcgccgccttcgggaaaatcga

SEQ ID NO: 119377 - DNA, 25 bp, Mus musculus
ggctcgctgtaactacctgaagggt

SEQ ID NO: 119378 - DNA, 25 bp, Mus musculus
ggctcgcttcggctcaaatgcagga

SEQ ID NO: 119379 - DNA, 25 bp, Mus musculus
ggctcgggccaccacaaagaaaatt

SEQ ID NO: 119380 - DNA, 25 bp, Mus musculus
ggctcgggccttgtgacatcgtcta

SEQ ID NO: 119381 - DNA, 25 bp, Mus musculus
ggctcgtcatgatatttgcgcatgg

SEQ ID NO: 119382 - DNA, 25 bp, Mus musculus
ggctcgtcgagcacatgaggacaga

SEQ ID NO: 119383 - DNA, 25 bp, Mus musculus
ggctctaatcgaactctccacggat

SEQ ID NO: 119384 - DNA, 25 bp, Mus musculus
ggctctacctgctcgagggaagtat

SEQ ID NO: 119385 - DNA, 25 bp, Mus musculus
ggctctacgcttatgaaccttctga

SEQ ID NO: 119386 - DNA, 25 bp, Mus musculus
ggctctagcatcaacccagggatag

SEQ ID NO: 119387 - DNA, 25 bp, Mus musculus
ggctctagtggagaatactattccc

SEQ ID NO: 119388 - DNA, 25 bp, Mus musculus
ggctctatatgaaaaggaactccct

SEQ ID NO: 119389 - DNA, 25 bp, Mus musculus
ggctctattcgcagttcctgagaga

SEQ ID NO: 119390 - DNA, 25 bp, Mus musculus
ggctctatttgagcgcatgcgcaaa

SEQ ID NO: 119391 - DNA, 25 bp, Mus musculus
ggctctcaagacactaggaacagga

SEQ ID NO: 119392 - DNA, 25 bp, Mus musculus
ggctctcgaagtatcccagcgaaaa

SEQ ID NO: 119393 - DNA, 25 bp, Mus musculus
ggctctcgcgtctgtggcaatggca

SEQ ID NO: 119394 - DNA, 25 bp, Mus musculus
ggctctcggccgaggtcaagaaccg

SEQ ID NO: 119395 - DNA, 25 bp, Mus musculus
ggctctcggctgaacatcatcatca

SEQ ID NO: 119396 - DNA, 25 bp, Mus musculus
ggctctctagtatgaccaagtagca

SEQ ID NO: 119397 - DNA, 25 bp, Mus musculus
ggctctctccttgggttacgcggca

SEQ ID NO: 119398 - DNA, 25 bp, Mus musculus
ggctctgaaaagatacaagactcaa

SEQ ID NO: 119399 - DNA, 25 bp, Mus musculus
ggctctgaaattaccaccagggaaa

SEQ ID NO: 119400 - DNA, 25 bp, Mus musculus
ggctctgaaggtagcagccaccgtg

SEQ ID NO: 119401 - DNA, 25 bp, Mus musculus
ggctctgaccacaaggacactgcaa

SEQ ID NO: 119402 - DNA, 25 bp, Mus musculus
ggctctgacctgaattaaaagtagc

SEQ ID NO: 119403 - DNA, 25 bp, Mus musculus
ggctctgcccgatgagcttcatcca

SEQ ID NO: 119404 - DNA, 25 bp, Mus musculus
ggctctgctacgactcactggttca

SEQ ID NO: 119405 - DNA, 25 bp, Mus musculus
ggctctggaagctgtcactgggcaa

SEQ ID NO: 119406 - DNA, 25 bp, Mus musculus
ggctctggatgcactggtctactca

SEQ ID NO: 119407 - DNA, 25 bp, Mus musculus
ggctctggcccatgaaattgtagta

SEQ ID NO: 119408 - DNA, 25 bp, Mus musculus
ggctctggcctctttgtctggatca

SEQ ID NO: 119409 - DNA, 25 bp, Mus musculus
ggctctggcgccatcagtggttacc

SEQ ID NO: 119410 - DNA, 25 bp, Mus musculus
ggctctgggactccctcatttgcca

SEQ ID NO: 119411 - DNA, 25 bp, Mus musculus
ggctctgggagcaagtgccctttcc

SEQ ID NO: 119412 - DNA, 25 bp, Mus musculus
ggctctgggatctgcaagctgcaac

SEQ ID NO: 119413 - DNA, 25 bp, Mus musculus
ggctctgtagtgttgttgcgctcca

SEQ ID NO: 119414 - DNA, 25 bp, Mus musculus
ggctcttactcatggcacttgcagg

SEQ ID NO: 119415 - DNA, 25 bp, Mus musculus
ggctcttccttagccagcggcggtg

SEQ ID NO: 119416 - DNA, 25 bp, Mus musculus
ggctcttgtacacctggcatcctgg

SEQ ID NO: 119417 - DNA, 25 bp, Mus musculus
ggctcttgtgaaactctgcttgcag

SEQ ID NO: 119418 - DNA, 25 bp, Mus musculus
ggctctttgactggtggcatccgca

SEQ ID NO: 119419 - DNA, 25 bp, Mus musculus
ggctctttgatgaacgtgactgcag

SEQ ID NO: 119420 - DNA, 25 bp, Mus musculus
ggctgaaaaagctggtacacaccgg

SEQ ID NO: 119421 - DNA, 25 bp, Mus musculus
ggctgaaaattcacaggctgctcga

SEQ ID NO: 119422 - DNA, 25 bp, Mus musculus
ggctgaaatcgccaaagctgagctt

SEQ ID NO: 119423 - DNA, 25 bp, Mus musculus
ggctgaacctgaagatgcgcggcca

SEQ ID NO: 119424 - DNA, 25 bp, Mus musculus
ggctgaactaaactccaccatgaag

SEQ ID NO: 119425 - DNA, 25 bp, Mus musculus
ggctgaactcaacactcatgtgaac

SEQ ID NO: 119426 - DNA, 25 bp, Mus musculus
ggctgaagatatccattcccggttc

SEQ ID NO: 119427 - DNA, 25 bp, Mus musculus
ggctgaagctccagcagtcagagga

SEQ ID NO: 119428 - DNA, 25 bp, Mus musculus
ggctgaatggactaaacatgaagag

SEQ ID NO: 119429 - DNA, 25 bp, Mus musculus
ggctgacaaccaaacctcgagggaa

SEQ ID NO: 119430 - DNA, 25 bp, Mus musculus
ggctgacagctccacttctgggaaa

SEQ ID NO: 119431 - DNA, 25 bp, Mus musculus
ggctgacagtgcgatggacctgact

SEQ ID NO: 119432 - DNA, 25 bp, Mus musculus
ggctgaccaggtgctaagttcccgc

SEQ ID NO: 119433 - DNA, 25 bp, Mus musculus
ggctgaccccagcttgaatgacaac

SEQ ID NO: 119434 - DNA, 25 bp, Mus musculus
ggctgaccgagagcacatagtgaat

SEQ ID NO: 119435 - DNA, 25 bp, Mus musculus
ggctgacctggcactcatagtatac

SEQ ID NO: 119436 - DNA, 25 bp, Mus musculus
ggctgacgatcatcccacatggcgt

SEQ ID NO: 119437 - DNA, 25 bp, Mus musculus
ggctgacggcagaagatggtcactt

SEQ ID NO: 119438 - DNA, 25 bp, Mus musculus
ggctgactcagatctccggcgaatt

SEQ ID NO: 119439 - DNA, 25 bp, Mus musculus
ggctgactgcagctggattcatcca

SEQ ID NO: 119440 - DNA, 25 bp, Mus musculus
ggctgagctcgtgtgcggcagcaga

SEQ ID NO: 119441 - DNA, 25 bp, Mus musculus
ggctgaggaagggtgcggtctgggt

SEQ ID NO: 119442 - DNA, 25 bp, Mus musculus
ggctgaggaatttcgcgaccgcatg

SEQ ID NO: 119443 - DNA, 25 bp, Mus musculus
ggctgaggcagccatgttccaccgt

SEQ ID NO: 119444 - DNA, 25 bp, Mus musculus
ggctgagggcaccacactcatatat

SEQ ID NO: 119445 - DNA, 25 bp, Mus musculus
ggctgatcgcagaccttccttcaaa

SEQ ID NO: 119446 - DNA, 25 bp, Mus musculus
ggctgatgaccctgaacaattgtgc

SEQ ID NO: 119447 - DNA, 25 bp, Mus musculus
ggctgatgagctgcgaattacttat

SEQ ID NO: 119448 - DNA, 25 bp, Mus musculus
ggctgatgtcatcccgtgcacagga

SEQ ID NO: 119449 - DNA, 25 bp, Mus musculus
ggctgatgttagaaaccaggtgata

SEQ ID NO: 119450 - DNA, 25 bp, Mus musculus
ggctgattgcctcccaaaagactat

SEQ ID NO: 119451 - DNA, 25 bp, Mus musculus
ggctgcaaaggacccatatggcttc

SEQ ID NO: 119452 - DNA, 25 bp, Mus musculus
ggctgcaagcagtatttacaacaga

SEQ ID NO: 119453 - DNA, 25 bp, Mus musculus
ggctgcaattccatttaagtcacgg

SEQ ID NO: 119454 - DNA, 25 bp, Mus musculus
ggctgcacagccattgtccgaaata

SEQ ID NO: 119455 - DNA, 25 bp, Mus musculus
ggctgcacccagcaagacctgttgg

SEQ ID NO: 119456 - DNA, 25 bp, Mus musculus
ggctgcagacaggagcatctctcca

SEQ ID NO: 119457 - DNA, 25 bp, Mus musculus
ggctgcagccttgcactcgcgctgg

SEQ ID NO: 119458 - DNA, 25 bp, Mus musculus
ggctgcaggctgacattgagaacca

SEQ ID NO: 119459 - DNA, 25 bp, Mus musculus
ggctgcatgccaacgacaaggacta

SEQ ID NO: 119460 - DNA, 25 bp, Mus musculus
ggctgcatggcgttcctctggaata

SEQ ID NO: 119461 - DNA, 25 bp, Mus musculus
ggctgccaaaatgatcaagggatac

SEQ ID NO: 119462 - DNA, 25 bp, Mus musculus
ggctgccaacaacaacctagaactg

SEQ ID NO: 119463 - DNA, 25 bp, Mus musculus
ggctgccaagtgaagtgctgagaca

SEQ ID NO: 119464 - DNA, 25 bp, Mus musculus
ggctgccaccaatgaggtccccagt

SEQ ID NO: 119465 - DNA, 25 bp, Mus musculus
ggctgccacccacgagttcaagcag

SEQ ID NO: 119466 - DNA, 25 bp, Mus musculus
ggctgccacttaccatgaccatgac

SEQ ID NO: 119467 - DNA, 25 bp, Mus musculus
ggctgccattcctgtgaccaatttg

SEQ ID NO: 119468 - DNA, 25 bp, Mus musculus
ggctgcccctagcatgtcagttcga

SEQ ID NO: 119469 - DNA, 25 bp, Mus musculus
ggctgcccgacctctgagaagtagg

SEQ ID NO: 119470 - DNA, 25 bp, Mus musculus
ggctgcccgcctcttgcatctaagg

SEQ ID NO: 119471 - DNA, 25 bp, Mus musculus
ggctgcccttgtgccaatgagcctt

SEQ ID NO: 119472 - DNA, 25 bp, Mus musculus
ggctgccgcacttcgacctgcggtg

SEQ ID NO: 119473 - DNA, 25 bp, Mus musculus
ggctgccgtaataaggtacctcaag

SEQ ID NO: 119474 - DNA, 25 bp, Mus musculus
ggctgcctcagtgctgctatcagaa

SEQ ID NO: 119475 - DNA, 25 bp, Mus musculus
ggctgcctgactccacagattgtga

SEQ ID NO: 119476 - DNA, 25 bp, Mus musculus
ggctgcctggaatatttaaaacatg

SEQ ID NO: 119477 - DNA, 25 bp, Mus musculus
ggctgcctttgaacccacatacata

SEQ ID NO: 119478 - DNA, 25 bp, Mus musculus
ggctgcgactcctgtcacggcgctg

SEQ ID NO: 119479 - DNA, 25 bp, Mus musculus
ggctgcgctccaacagaaggaactt

SEQ ID NO: 119480 - DNA, 25 bp, Mus musculus
ggctgcggcgccatattgcggccct

SEQ ID NO: 119481 - DNA, 25 bp, Mus musculus
ggctgctaaagcaccccaatgtcat

SEQ ID NO: 119482 - DNA, 25 bp, Mus musculus
ggctgctaccccttggatggacaca

SEQ ID NO: 119483 - DNA, 25 bp, Mus musculus
ggctgctctgaaaaacccccctatt

SEQ ID NO: 119484 - DNA, 25 bp, Mus musculus
ggctgctgagccaactcctgcgcgt

SEQ ID NO: 119485 - DNA, 25 bp, Mus musculus
ggctgctgcagtcgtcctcttctgg

SEQ ID NO: 119486 - DNA, 25 bp, Mus musculus
ggctgctgccctcactaaaaatggt

SEQ ID NO: 119487 - DNA, 25 bp, Mus musculus
ggctgctgctatcccatgggtccaa

SEQ ID NO: 119488 - DNA, 25 bp, Mus musculus
ggctgctggtctacttcccgtacga

SEQ ID NO: 119489 - DNA, 25 bp, Mus musculus
ggctgctgtgctacaatccgggaga

SEQ ID NO: 119490 - DNA, 25 bp, Mus musculus
ggctgctgtgtaagcgcctgctaca

SEQ ID NO: 119491 - DNA, 25 bp, Mus musculus
ggctgcttagcctggagctcctgaa

SEQ ID NO: 119492 - DNA, 25 bp, Mus musculus
ggctgcttgacactgggaactgaca

SEQ ID NO: 119493 - DNA, 25 bp, Mus musculus
ggctggaaagctggactctgtcaca

SEQ ID NO: 119494 - DNA, 25 bp, Mus musculus
ggctggaacatgtacagggcccctg

SEQ ID NO: 119495 - DNA, 25 bp, Mus musculus
ggctggaagccctgatactgaatct

SEQ ID NO: 119496 - DNA, 25 bp, Mus musculus
ggctggaaggcaaaatcgtgtcccc

SEQ ID NO: 119497 - DNA, 25 bp, Mus musculus
ggctggaagttaccacctctcctca

SEQ ID NO: 119498 - DNA, 25 bp, Mus musculus
ggctggagaccagaggaagtcccaa

SEQ ID NO: 119499 - DNA, 25 bp, Mus musculus
ggctggagatcctgacgaactacac

SEQ ID NO: 119500 - DNA, 25 bp, Mus musculus
ggctggagggtcctcgccgagccgt

SEQ ID NO: 119501 - DNA, 25 bp, Mus musculus
ggctggagttgctctacctcgggat

SEQ ID NO: 119502 - DNA, 25 bp, Mus musculus
ggctggatctgaagtctgaatggca

SEQ ID NO: 119503 - DNA, 25 bp, Mus musculus
ggctggattctctggtacaccggca

SEQ ID NO: 119504 - DNA, 25 bp, Mus musculus
ggctggcaacacacaacagaaagtc

SEQ ID NO: 119505 - DNA, 25 bp, Mus musculus
ggctggcaacgctgaaattcggaaa

SEQ ID NO: 119506 - DNA, 25 bp, Mus musculus
ggctggcaagcatgtcctcgtggaa

SEQ ID NO: 119507 - DNA, 25 bp, Mus musculus
ggctggcacccctgtgactgacaga

SEQ ID NO: 119508 - DNA, 25 bp, Mus musculus
ggctggcactcagatcgagaatatc

SEQ ID NO: 119509 - DNA, 25 bp, Mus musculus
ggctggcacttttggacctgggtca

SEQ ID NO: 119510 - DNA, 25 bp, Mus musculus
ggctggccatagtggtacagtcttt

SEQ ID NO: 119511 - DNA, 25 bp, Mus musculus
ggctggccctcatgaagcaagattc

SEQ ID NO: 119512 - DNA, 25 bp, Mus musculus
ggctggccgaccactactactggta

SEQ ID NO: 119513 - DNA, 25 bp, Mus musculus
ggctggccgagaaccaggcacagcc

SEQ ID NO: 119514 - DNA, 25 bp, Mus musculus
ggctggcctgaggagtcggcggcca

SEQ ID NO: 119515 - DNA, 25 bp, Mus musculus
ggctggccttaaccttccgtgtgag

SEQ ID NO: 119516 - DNA, 25 bp, Mus musculus
ggctggcggcactgatgtacacaga

SEQ ID NO: 119517 - DNA, 25 bp, Mus musculus
ggctggcgggtagactacaccctga

SEQ ID NO: 119518 - DNA, 25 bp, Mus musculus
ggctggctatctgagtgaatcggac

SEQ ID NO: 119519 - DNA, 25 bp, Mus musculus
ggctggctcggcacactgatgatga

SEQ ID NO: 119520 - DNA, 25 bp, Mus musculus
ggctggctgatcatgtcctccctga

SEQ ID NO: 119521 - DNA, 25 bp, Mus musculus
ggctgggcacatgcggctcatcatg

SEQ ID NO: 119522 - DNA, 25 bp, Mus musculus
ggctgggccagagtttatgcgcaca

SEQ ID NO: 119523 - DNA, 25 bp, Mus musculus
ggctgggccctctcattgacatgta

SEQ ID NO: 119524 - DNA, 25 bp, Mus musculus
ggctgggtcagccactacaactgga

SEQ ID NO: 119525 - DNA, 25 bp, Mus musculus
ggctgggtgtatgtgctgcacccca

SEQ ID NO: 119526 - DNA, 25 bp, Mus musculus
ggctggtcctcatgccatggtctgt

SEQ ID NO: 119527 - DNA, 25 bp, Mus musculus
ggctggtcttctccctcgtcaagca

SEQ ID NO: 119528 - DNA, 25 bp, Mus musculus
ggctggttaaacaatctactgcggc

SEQ ID NO: 119529 - DNA, 25 bp, Mus musculus
ggctggttggaaacaagcttgtcac

SEQ ID NO: 119530 - DNA, 25 bp, Mus musculus
ggctggttgtccttccactggagct

SEQ ID NO: 119531 - DNA, 25 bp, Mus musculus
ggctgtaagtccatcaccactgagg

SEQ ID NO: 119532 - DNA, 25 bp, Mus musculus
ggctgtatcatgagcaattgcttgc

SEQ ID NO: 119533 - DNA, 25 bp, Mus musculus
ggctgtatcgtcacccctgggatga

SEQ ID NO: 119534 - DNA, 25 bp, Mus musculus
ggctgtcaaggcacactccaacata

SEQ ID NO: 119535 - DNA, 25 bp, Mus musculus
ggctgtcagcaccaactcagagggc

SEQ ID NO: 119536 - DNA, 25 bp, Mus musculus
ggctgtcatcagcatcaaggactta

SEQ ID NO: 119537 - DNA, 25 bp, Mus musculus
ggctgtcatgtaccccaggatggat

SEQ ID NO: 119538 - DNA, 25 bp, Mus musculus
ggctgtcattcctaggcgctcggga

SEQ ID NO: 119539 - DNA, 25 bp, Mus musculus
ggctgtccgagagtgtgaccctgac

SEQ ID NO: 119540 - DNA, 25 bp, Mus musculus
ggctgtcctctatggaaaacgtgga

SEQ ID NO: 119541 - DNA, 25 bp, Mus musculus
ggctgtcgaggtcccattgagataa

SEQ ID NO: 119542 - DNA, 25 bp, Mus musculus
ggctgtctacttccggcacaacatg

SEQ ID NO: 119543 - DNA, 25 bp, Mus musculus
ggctgtctctgccaggaagtcacgc

SEQ ID NO: 119544 - DNA, 25 bp, Mus musculus
ggctgtctcttcatctagggcagaa

SEQ ID NO: 119545 - DNA, 25 bp, Mus musculus
ggctgtctggctggtcatcaaccta

SEQ ID NO: 119546 - DNA, 25 bp, Mus musculus
ggctgtcttccctcacctgactgtg

SEQ ID NO: 119547 - DNA, 25 bp, Mus musculus
ggctgtgaacaatgggtctcccctg

SEQ ID NO: 119548 - DNA, 25 bp, Mus musculus
ggctgtgaagccactcaaagagatg

SEQ ID NO: 119549 - DNA, 25 bp, Mus musculus
ggctgtgaccttatgctcctgtgca

SEQ ID NO: 119550 - DNA, 25 bp, Mus musculus
ggctgtgactactgccagaatcctg

SEQ ID NO: 119551 - DNA, 25 bp, Mus musculus
ggctgtgatcctctagccatcccga

SEQ ID NO: 119552 - DNA, 25 bp, Mus musculus
ggctgtgcactcatgaatcgctccg

SEQ ID NO: 119553 - DNA, 25 bp, Mus musculus
ggctgtgcgctttacccaagaagag

SEQ ID NO: 119554 - DNA, 25 bp, Mus musculus
ggctgtgctgactgactacccatct

SEQ ID NO: 119555 - DNA, 25 bp, Mus musculus
ggctgtggagcgaacccggaccatc

SEQ ID NO: 119556 - DNA, 25 bp, Mus musculus
ggctgtggccgacggcgcgtctgac

SEQ ID NO: 119557 - DNA, 25 bp, Mus musculus
ggctgtggcggaacctgtctcgcat

SEQ ID NO: 119558 - DNA, 25 bp, Mus musculus
ggctgtgggcacacctgaggaaaca

SEQ ID NO: 119559 - DNA, 25 bp, Mus musculus
ggctgtggtctctgtccgctttcag

SEQ ID NO: 119560 - DNA, 25 bp, Mus musculus
ggctgtgtacaaactcgcggagtca

SEQ ID NO: 119561 - DNA, 25 bp, Mus musculus
ggctgtgtacttcacccagacggaa

SEQ ID NO: 119562 - DNA, 25 bp, Mus musculus
ggctgtgtcacgataccaatgaaga

SEQ ID NO: 119563 - DNA, 25 bp, Mus musculus
ggctgtgtggtattccagagaatct

SEQ ID NO: 119564 - DNA, 25 bp, Mus musculus
ggctgttcaaagtgaccctacccaa

SEQ ID NO: 119565 - DNA, 25 bp, Mus musculus
ggctgttcacagagataagatcaat

SEQ ID NO: 119566 - DNA, 25 bp, Mus musculus
ggctgttcccaaggacatggagcaa

SEQ ID NO: 119567 - DNA, 25 bp, Mus musculus
ggctgttctcctgaacctggtgcga

SEQ ID NO: 119568 - DNA, 25 bp, Mus musculus
ggctgtttcaccacctgcaaggctg

SEQ ID NO: 119569 - DNA, 25 bp, Mus musculus
ggctgtttcatcaccagatgtgtcg

SEQ ID NO: 119570 - DNA, 25 bp, Mus musculus
ggcttaacagagaaacaccaccatt

SEQ ID NO: 119571 - DNA, 25 bp, Mus musculus
ggcttaactgctgtcataaaatttg

SEQ ID NO: 119572 - DNA, 25 bp, Mus musculus
ggcttaatagacacgaacacacttg

SEQ ID NO: 119573 - DNA, 25 bp, Mus musculus
ggcttacaaaaaggagctggaggaa

SEQ ID NO: 119574 - DNA, 25 bp, Mus musculus
ggcttacaaacgtgaccctagagac

SEQ ID NO: 119575 - DNA, 25 bp, Mus musculus
ggcttacactacctaaagctgtgct

SEQ ID NO: 119576 - DNA, 25 bp, Mus musculus
ggcttacatgatcctgagacaccag

SEQ ID NO: 119577 - DNA, 25 bp, Mus musculus
ggcttacccacagagctcaagagaa

SEQ ID NO: 119578 - DNA, 25 bp, Mus musculus
ggcttacggctcaaaaggctcagat

SEQ ID NO: 119579 - DNA, 25 bp, Mus musculus
ggcttactacccaaatctgtccttg

SEQ ID NO: 119580 - DNA, 25 bp, Mus musculus
ggcttacttcagtgtcgggctccaa

SEQ ID NO: 119581 - DNA, 25 bp, Mus musculus
ggcttagaccttgagttcccacgga

SEQ ID NO: 119582 - DNA, 25 bp, Mus musculus
ggcttagccaagcaatgtcactgga

SEQ ID NO: 119583 - DNA, 25 bp, Mus musculus
ggcttagctccttcccactgggaga

SEQ ID NO: 119584 - DNA, 25 bp, Mus musculus
ggcttagtgggcaattctctggtca

SEQ ID NO: 119585 - DNA, 25 bp, Mus musculus
ggcttatatcacatcgaccaggaga

SEQ ID NO: 119586 - DNA, 25 bp, Mus musculus
ggcttatgaccactgctgactggga

SEQ ID NO: 119587 - DNA, 25 bp, Mus musculus
ggcttcagaaagcatcctacttctc

SEQ ID NO: 119588 - DNA, 25 bp, Mus musculus
ggcttcagacatgcttatacgacag

SEQ ID NO: 119589 - DNA, 25 bp, Mus musculus
ggcttcagcaagatgataactgggt

SEQ ID NO: 119590 - DNA, 25 bp, Mus musculus
ggcttcaggctgataggagcgtctt

SEQ ID NO: 119591 - DNA, 25 bp, Mus musculus
ggcttcatcactgtaaatggttgca

SEQ ID NO: 119592 - DNA, 25 bp, Mus musculus
ggcttcatcatggaagcgtccagat

SEQ ID NO: 119593 - DNA, 25 bp, Mus musculus
ggcttcatcctgttcagaccttcat

SEQ ID NO: 119594 - DNA, 25 bp, Mus musculus
ggcttcattgaagtcctgaccaaga

SEQ ID NO: 119595 - DNA, 25 bp, Mus musculus
ggcttcattgcctcatggtgccatg

SEQ ID NO: 119596 - DNA, 25 bp, Mus musculus
ggcttccaaggcgatgatccgaaaa

SEQ ID NO: 119597 - DNA, 25 bp, Mus musculus
ggcttcccgggatttgcatacttgc

SEQ ID NO: 119598 - DNA, 25 bp, Mus musculus
ggcttccgaggcttcttggtccgac

SEQ ID NO: 119599 - DNA, 25 bp, Mus musculus
ggcttccgctgaccttgtcgttcga

SEQ ID NO: 119600 - DNA, 25 bp, Mus musculus
ggcttccggagctctttgaaacaag

SEQ ID NO: 119601 - DNA, 25 bp, Mus musculus
ggcttccgttatgagtgcgctccga

SEQ ID NO: 119602 - DNA, 25 bp, Mus musculus
ggcttcctgtactgggtgggcgcga

SEQ ID NO: 119603 - DNA, 25 bp, Mus musculus
ggcttctcggtatgacagggcaatc

SEQ ID NO: 119604 - DNA, 25 bp, Mus musculus
ggcttctctggacccatactgtgga

SEQ ID NO: 119605 - DNA, 25 bp, Mus musculus
ggcttctgcaacctaccatagtgaa

SEQ ID NO: 119606 - DNA, 25 bp, Mus musculus
ggcttctgctgagatcctgagtggc

SEQ ID NO: 119607 - DNA, 25 bp, Mus musculus
ggcttctgctggcaatgatgacatc

SEQ ID NO: 119608 - DNA, 25 bp, Mus musculus
ggcttctggaccacaaccagcggca

SEQ ID NO: 119609 - DNA, 25 bp, Mus musculus
ggcttctggatctatgtacggctca

SEQ ID NO: 119610 - DNA, 25 bp, Mus musculus
ggcttctggtgaccttgactgcaaa

SEQ ID NO: 119611 - DNA, 25 bp, Mus musculus
ggcttcttcaaaaggaccatcagga

SEQ ID NO: 119612 - DNA, 25 bp, Mus musculus
ggcttcttcgagttccttcacctat

SEQ ID NO: 119613 - DNA, 25 bp, Mus musculus
ggcttcttggcagagcagtttacaa

SEQ ID NO: 119614 - DNA, 25 bp, Mus musculus
ggcttcttggtaatgcccaggctaa

SEQ ID NO: 119615 - DNA, 25 bp, Mus musculus
ggcttgaactccgagctggctgttc

SEQ ID NO: 119616 - DNA, 25 bp, Mus musculus
ggcttgaatcgtacccagctggtca

SEQ ID NO: 119617 - DNA, 25 bp, Mus musculus
ggcttgactaaccaactccatgtgg

SEQ ID NO: 119618 - DNA, 25 bp, Mus musculus
ggcttgagacatttttcaatgaagg

SEQ ID NO: 119619 - DNA, 25 bp, Mus musculus
ggcttgagtgttccggaatacctaa

SEQ ID NO: 119620 - DNA, 25 bp, Mus musculus
ggcttgcccaatgtatcattgattt

SEQ ID NO: 119621 - DNA, 25 bp, Mus musculus
ggcttgccgccatcagtaattccgg

SEQ ID NO: 119622 - DNA, 25 bp, Mus musculus
ggcttgccgggagtcgcgcgctgct

SEQ ID NO: 119623 - DNA, 25 bp, Mus musculus
ggcttggaccagctacaagctcaga

SEQ ID NO: 119624 - DNA, 25 bp, Mus musculus
ggcttggacctcaggacatcgtctg

SEQ ID NO: 119625 - DNA, 25 bp, Mus musculus
ggcttggaggtctcaaaagacccag

SEQ ID NO: 119626 - DNA, 25 bp, Mus musculus
ggcttgggactcagacctcatcata

SEQ ID NO: 119627 - DNA, 25 bp, Mus musculus
ggcttgggccaacgagagttcttca

SEQ ID NO: 119628 - DNA, 25 bp, Mus musculus
ggcttgggccttcgatctgcatcca

SEQ ID NO: 119629 - DNA, 25 bp, Mus musculus
ggcttgggctgatcgaatcggacac

SEQ ID NO: 119630 - DNA, 25 bp, Mus musculus
ggcttggttttcatgggttgttgta

SEQ ID NO: 119631 - DNA, 25 bp, Mus musculus
ggcttgtagcattcctcctctctgg

SEQ ID NO: 119632 - DNA, 25 bp, Mus musculus
ggcttgtcaccaaagcaccgtgtca

SEQ ID NO: 119633 - DNA, 25 bp, Mus musculus
ggcttgtccacccagatttcttcag

SEQ ID NO: 119634 - DNA, 25 bp, Mus musculus
ggcttgtctcctcactcctttaaaa

SEQ ID NO: 119635 - DNA, 25 bp, Mus musculus
ggcttgtgaccttccggcaccattt

SEQ ID NO: 119636 - DNA, 25 bp, Mus musculus
ggctttaagcatctgtccccgtcat

SEQ ID NO: 119637 - DNA, 25 bp, Mus musculus
ggctttacctgtctaagaaccaact

SEQ ID NO: 119638 - DNA, 25 bp, Mus musculus
ggctttactgtacgcctgcgctttg

SEQ ID NO: 119639 - DNA, 25 bp, Mus musculus
ggctttattaggcacccagcatggt

SEQ ID NO: 119640 - DNA, 25 bp, Mus musculus
ggctttcagaagaggccatgaggct

SEQ ID NO: 119641 - DNA, 25 bp, Mus musculus
ggctttcaggcccatctcggtcgta

SEQ ID NO: 119642 - DNA, 25 bp, Mus musculus
ggctttcattctctgtcttccgcct

SEQ ID NO: 119643 - DNA, 25 bp, Mus musculus
ggctttccaacttcagctacagtgt

SEQ ID NO: 119644 - DNA, 25 bp, Mus musculus
ggctttcccatgtatgcacatgtgg

SEQ ID NO: 119645 - DNA, 25 bp, Mus musculus
ggctttcctcccagatcccaatgat

SEQ ID NO: 119646 - DNA, 25 bp, Mus musculus
ggctttcctggtgcacaatcctgag

SEQ ID NO: 119647 - DNA, 25 bp, Mus musculus
ggctttcgaagagcaagaccaaaat

SEQ ID NO: 119648 - DNA, 25 bp, Mus musculus
ggctttcgccaatatgaggtctcca

SEQ ID NO: 119649 - DNA, 25 bp, Mus musculus
ggctttgacaaacttgacctttgga

SEQ ID NO: 119650 - DNA, 25 bp, Mus musculus
ggctttgacaagatgggccacccat

SEQ ID NO: 119651 - DNA, 25 bp, Mus musculus
ggctttgaccacaagatcacaggga

SEQ ID NO: 119652 - DNA, 25 bp, Mus musculus
ggctttgactacgactacacgctgg

SEQ ID NO: 119653 - DNA, 25 bp, Mus musculus
ggctttgatccctgtagaccctgca

SEQ ID NO: 119654 - DNA, 25 bp, Mus musculus
ggctttgcagaatgacccacctcct

SEQ ID NO: 119655 - DNA, 25 bp, Mus musculus
ggctttgccaacctcccaaatcaag

SEQ ID NO: 119656 - DNA, 25 bp, Mus musculus
ggctttgccctacccaggttgacga

SEQ ID NO: 119657 - DNA, 25 bp, Mus musculus
ggctttggacagttcatggccggac

SEQ ID NO: 119658 - DNA, 25 bp, Mus musculus
ggctttggatatagccccttcctga

SEQ ID NO: 119659 - DNA, 25 bp, Mus musculus
ggctttggatctacagctgccccaa

SEQ ID NO: 119660 - DNA, 25 bp, Mus musculus
ggctttgttccaggcattccggtga

SEQ ID NO: 119661 - DNA, 25 bp, Mus musculus
ggctttgtttttgggatggagaaat

SEQ ID NO: 119662 - DNA, 25 bp, Mus musculus
ggcttttacagagatctccagttgg

SEQ ID NO: 119663 - DNA, 25 bp, Mus musculus
ggcttttacatgtcggtggctggca

SEQ ID NO: 119664 - DNA, 25 bp, Mus musculus
ggcttttagaagctgggcccacaca

SEQ ID NO: 119665 - DNA, 25 bp, Mus musculus
ggcttttcagctagcaccacctaaa

SEQ ID NO: 119666 - DNA, 25 bp, Mus musculus
ggcttttcatgtgtacccctacctg

SEQ ID NO: 119667 - DNA, 25 bp, Mus musculus
ggcttttctcggttcagtctccgtg

SEQ ID NO: 119668 - DNA, 25 bp, Mus musculus
ggcttttgaagactggatccacgac

SEQ ID NO: 119669 - DNA, 25 bp, Mus musculus
ggctttttacttcatagaccatgtg

SEQ ID NO: 119670 - DNA, 25 bp, Mus musculus
ggctttttatcagttgcagcaggac

SEQ ID NO: 119671 - DNA, 25 bp, Mus musculus
ggctttttcaacagaggccacggcg

SEQ ID NO: 119672 - DNA, 25 bp, Mus musculus
ggctttttcctctatctgagaaatc

SEQ ID NO: 119673 - DNA, 25 bp, Mus musculus
ggctttttgcacatccctcatgcag

SEQ ID NO: 119674 - DNA, 25 bp, Mus musculus
gggaaaacccgaaactgatgctgtg

SEQ ID NO: 119675 - DNA, 25 bp, Mus musculus
gggaaaagctccagatgaccacgag

SEQ ID NO: 119676 - DNA, 25 bp, Mus musculus
gggaaaagtcattacacattgccag

SEQ ID NO: 119677 - DNA, 25 bp, Mus musculus
gggaaaatcccacttgacgtcaatg

SEQ ID NO: 119678 - DNA, 25 bp, Mus musculus
gggaaacatattcgacagtaccatg

SEQ ID NO: 119679 - DNA, 25 bp, Mus musculus
gggaaacatcgacacaccaacttaa

SEQ ID NO: 119680 - DNA, 25 bp, Mus musculus
gggaaaccacagtcaggagctccat

SEQ ID NO: 119681 - DNA, 25 bp, Mus musculus
gggaaacccagccaatacgaactgc

SEQ ID NO: 119682 - DNA, 25 bp, Mus musculus
gggaaacctggtggcgtattcgatc

SEQ ID NO: 119683 - DNA, 25 bp, Mus musculus
gggaaacctggttctttggactgca

SEQ ID NO: 119684 - DNA, 25 bp, Mus musculus
gggaaacggaggcaaataaagctga

SEQ ID NO: 119685 - DNA, 25 bp, Mus musculus
gggaaactagaacaacggatcaact

SEQ ID NO: 119686 - DNA, 25 bp, Mus musculus
gggaaactcctagttgccgcttcgc

SEQ ID NO: 119687 - DNA, 25 bp, Mus musculus
gggaaactttcgttaatcagctaga

SEQ ID NO: 119688 - DNA, 25 bp, Mus musculus
gggaaagaaccgtgagtacagtctc

SEQ ID NO: 119689 - DNA, 25 bp, Mus musculus
gggaaagataccaactacatgacag

SEQ ID NO: 119690 - DNA, 25 bp, Mus musculus
gggaaagccttccagcgcagttcat

SEQ ID NO: 119691 - DNA, 25 bp, Mus musculus
gggaaagctcaatgcctctcagtaa

SEQ ID NO: 119692 - DNA, 25 bp, Mus musculus
gggaaagggcaggagcgagctagct

SEQ ID NO: 119693 - DNA, 25 bp, Mus musculus
gggaaagtaccacctgctactcata

SEQ ID NO: 119694 - DNA, 25 bp, Mus musculus
gggaaagtgcccaatctgaatgaag

SEQ ID NO: 119695 - DNA, 25 bp, Mus musculus
gggaaatactatcaagaaactgaac

SEQ ID NO: 119696 - DNA, 25 bp, Mus musculus
gggaaatatgatgaataaagacttc

SEQ ID NO: 119697 - DNA, 25 bp, Mus musculus
gggaaatcatttctcctggacttca

SEQ ID NO: 119698 - DNA, 25 bp, Mus musculus
gggaaatccaaaagacgtcacaggt

SEQ ID NO: 119699 - DNA, 25 bp, Mus musculus
gggaaatcctggaggcaagaccctg

SEQ ID NO: 119700 - DNA, 25 bp, Mus musculus
gggaaattcattcaacagggactca

SEQ ID NO: 119701 - DNA, 25 bp, Mus musculus
gggaaattcccatgagccgcttgaa

SEQ ID NO: 119702 - DNA, 25 bp, Mus musculus
gggaacaactcaataccgtaggact

SEQ ID NO: 119703 - DNA, 25 bp, Mus musculus
gggaacaagcgcctgaaagaagcca

SEQ ID NO: 119704 - DNA, 25 bp, Mus musculus
gggaacacacggaattcaccgacca

SEQ ID NO: 119705 - DNA, 25 bp, Mus musculus
gggaacacccaaggttgctcatgtg

SEQ ID NO: 119706 - DNA, 25 bp, Mus musculus
gggaacaccctgaagaacattgaga

SEQ ID NO: 119707 - DNA, 25 bp, Mus musculus
gggaacacctacttactgaaccatg

SEQ ID NO: 119708 - DNA, 25 bp, Mus musculus
gggaacacgtaattgaccaaggtga

SEQ ID NO: 119709 - DNA, 25 bp, Mus musculus
gggaacagaatcacatgatccgcac

SEQ ID NO: 119710 - DNA, 25 bp, Mus musculus
gggaacatgactacacacctctgtg

SEQ ID NO: 119711 - DNA, 25 bp, Mus musculus
gggaacatgccgctagaagacctgt

SEQ ID NO: 119712 - DNA, 25 bp, Mus musculus
gggaacattcacttacctcgcttgg

SEQ ID NO: 119713 - DNA, 25 bp, Mus musculus
gggaacccacctcaagctgaaagaa

SEQ ID NO: 119714 - DNA, 25 bp, Mus musculus
gggaaccccagtatctcagtgtcaa

SEQ ID NO: 119715 - DNA, 25 bp, Mus musculus
gggaacccgacactcgctggaaatt

SEQ ID NO: 119716 - DNA, 25 bp, Mus musculus
gggaacccttgcatgccatcgtcaa

SEQ ID NO: 119717 - DNA, 25 bp, Mus musculus
gggaacctcttcctacgggagctga

SEQ ID NO: 119718 - DNA, 25 bp, Mus musculus
gggaaccttcgagactcctttgata

SEQ ID NO: 119719 - DNA, 25 bp, Mus musculus
gggaacgcgagaaggagacggacgt

SEQ ID NO: 119720 - DNA, 25 bp, Mus musculus
gggaacgcgttcatcgtgtctgcca

SEQ ID NO: 119721 - DNA, 25 bp, Mus musculus
gggaacgtcttggacatcaaatgga

SEQ ID NO: 119722 - DNA, 25 bp, Mus musculus
gggaactacctggaactggctaaca

SEQ ID NO: 119723 - DNA, 25 bp, Mus musculus
gggaactcctgctcgtgtaaaatca

SEQ ID NO: 119724 - DNA, 25 bp, Mus musculus
gggaactcggcttgatcaacgcgca

SEQ ID NO: 119725 - DNA, 25 bp, Mus musculus
gggaactcttccgatagctcagcac

SEQ ID NO: 119726 - DNA, 25 bp, Mus musculus
gggaactgagaagaagcgctcctct

SEQ ID NO: 119727 - DNA, 25 bp, Mus musculus
gggaactgcccatgcggaacttaca

SEQ ID NO: 119728 - DNA, 25 bp, Mus musculus
gggaactgccgattcacaatgggaa

SEQ ID NO: 119729 - DNA, 25 bp, Mus musculus
gggaactgcctatttaacaaaatgt

SEQ ID NO: 119730 - DNA, 25 bp, Mus musculus
gggaactgctggatatgcctaatgt

SEQ ID NO: 119731 - DNA, 25 bp, Mus musculus
gggaactggcgtatttcttcaccac

SEQ ID NO: 119732 - DNA, 25 bp, Mus musculus
gggaacttagctcaacgcccaaggt

SEQ ID NO: 119733 - DNA, 25 bp, Mus musculus
gggaacttcaatggctttgcccagg

SEQ ID NO: 119734 - DNA, 25 bp, Mus musculus
gggaacttctttcagaacatcggtt

SEQ ID NO: 119735 - DNA, 25 bp, Mus musculus
gggaagaagtctaccaatagccgct

SEQ ID NO: 119736 - DNA, 25 bp, Mus musculus
gggaagagcaacgtgaacagcgcaa

SEQ ID NO: 119737 - DNA, 25 bp, Mus musculus
gggaagagtcctatgcagctggcac

SEQ ID NO: 119738 - DNA, 25 bp, Mus musculus
gggaagatgaagctacatgcagaca

SEQ ID NO: 119739 - DNA, 25 bp, Mus musculus
gggaagatttttgcccgctctgaga

SEQ ID NO: 119740 - DNA, 25 bp, Mus musculus
gggaagccaaactgtttcctaagca

SEQ ID NO: 119741 - DNA, 25 bp, Mus musculus
gggaagccagagaacaatactatga

SEQ ID NO: 119742 - DNA, 25 bp, Mus musculus
gggaagccattcgcggcctctggtt

SEQ ID NO: 119743 - DNA, 25 bp, Mus musculus
gggaagcccacaactactcagcgtt

SEQ ID NO: 119744 - DNA, 25 bp, Mus musculus
gggaagccgcagctgtatgtacaca

SEQ ID NO: 119745 - DNA, 25 bp, Mus musculus
gggaagctcatctcagacaccatca

SEQ ID NO: 119746 - DNA, 25 bp, Mus musculus
gggaagctcggcactttccgccttc

SEQ ID NO: 119747 - DNA, 25 bp, Mus musculus
gggaagctctgaataatttccagaa

SEQ ID NO: 119748 - DNA, 25 bp, Mus musculus
gggaagcttgccaaacagctatgca

SEQ ID NO: 119749 - DNA, 25 bp, Mus musculus
gggaaggagctcaatggaaaacaga

SEQ ID NO: 119750 - DNA, 25 bp, Mus musculus
gggaaggatacaaatggctctcagt

SEQ ID NO: 119751 - DNA, 25 bp, Mus musculus
gggaaggccctggacaatgtctgtt

SEQ ID NO: 119752 - DNA, 25 bp, Mus musculus
gggaagggcttctcacataggtgat

SEQ ID NO: 119753 - DNA, 25 bp, Mus musculus
gggaaggtcttacacagtctagcca

SEQ ID NO: 119754 - DNA, 25 bp, Mus musculus
gggaagtagcagtgtcaccacccag

SEQ ID NO: 119755 - DNA, 25 bp, Mus musculus
gggaagtcacccaaaaagtcagcag

SEQ ID NO: 119756 - DNA, 25 bp, Mus musculus
gggaagtccactctgctgaagctgc

SEQ ID NO: 119757 - DNA, 25 bp, Mus musculus
gggaagtcctacctcatgaatcgtc

SEQ ID NO: 119758 - DNA, 25 bp, Mus musculus
gggaagtggacgaggaaggcgagcg

SEQ ID NO: 119759 - DNA, 25 bp, Mus musculus
gggaataacacaccggagacttttg

SEQ ID NO: 119760 - DNA, 25 bp, Mus musculus
gggaataccagccaacagatgaaag

SEQ ID NO: 119761 - DNA, 25 bp, Mus musculus
gggaatagcatgaaatccacatctc

SEQ ID NO: 119762 - DNA, 25 bp, Mus musculus
gggaatccacattgggccgcaggaa

SEQ ID NO: 119763 - DNA, 25 bp, Mus musculus
gggaatctaagacgcgcctggaaat

SEQ ID NO: 119764 - DNA, 25 bp, Mus musculus
gggaatctctgtcacccttctggga

SEQ ID NO: 119765 - DNA, 25 bp, Mus musculus
gggaatcttgccacaggaccatgta

SEQ ID NO: 119766 - DNA, 25 bp, Mus musculus
gggaatgacgacaaacacacgcttc

SEQ ID NO: 119767 - DNA, 25 bp, Mus musculus
gggaatgcatacctaccaagtgggc

SEQ ID NO: 119768 - DNA, 25 bp, Mus musculus
gggaatgccatacacctctgggaca

SEQ ID NO: 119769 - DNA, 25 bp, Mus musculus
gggaatggcctactccaactgtcag

SEQ ID NO: 119770 - DNA, 25 bp, Mus musculus
gggaattaaacacatacttgtatgc

SEQ ID NO: 119771 - DNA, 25 bp, Mus musculus
gggaattacctcaaccgatctctgt

SEQ ID NO: 119772 - DNA, 25 bp, Mus musculus
gggaattcaccactgcaccgtttta

SEQ ID NO: 119773 - DNA, 25 bp, Mus musculus
gggaattcaccattatcacctcttg

SEQ ID NO: 119774 - DNA, 25 bp, Mus musculus
gggaattctggctgaaatcatcatc

SEQ ID NO: 119775 - DNA, 25 bp, Mus musculus
gggacaaaacccacctagcatacga

SEQ ID NO: 119776 - DNA, 25 bp, Mus musculus
gggacaaacaagtgactcctgtcac

SEQ ID NO: 119777 - DNA, 25 bp, Mus musculus
gggacaaccctgatgtgaactggaa

SEQ ID NO: 119778 - DNA, 25 bp, Mus musculus
gggacaacctgagcgctggcagctt

SEQ ID NO: 119779 - DNA, 25 bp, Mus musculus
gggacaagaccatcccctacgatgg

SEQ ID NO: 119780 - DNA, 25 bp, Mus musculus
gggacaagctgagcccaattgtgct

SEQ ID NO: 119781 - DNA, 25 bp, Mus musculus
gggacaaggaccgaaaaagatccag

SEQ ID NO: 119782 - DNA, 25 bp, Mus musculus
gggacaaggccaccggttatcacta

SEQ ID NO: 119783 - DNA, 25 bp, Mus musculus
gggacaagtaccctcagacctggaa

SEQ ID NO: 119784 - DNA, 25 bp, Mus musculus
gggacaagtactctaaccatgaaga

SEQ ID NO: 119785 - DNA, 25 bp, Mus musculus
gggacaagttccagatcaacgcgga

SEQ ID NO: 119786 - DNA, 25 bp, Mus musculus
gggacaatccggtcacactgagagg

SEQ ID NO: 119787 - DNA, 25 bp, Mus musculus
gggacaatgccccgacgatcagaag

SEQ ID NO: 119788 - DNA, 25 bp, Mus musculus
gggacaatggtgtgcattccttgca

SEQ ID NO: 119789 - DNA, 25 bp, Mus musculus
gggacacaactgagccaaactggaa

SEQ ID NO: 119790 - DNA, 25 bp, Mus musculus
gggacacagccattgggacatcatg

SEQ ID NO: 119791 - DNA, 25 bp, Mus musculus
gggacacagtaaagcaatacctgct

SEQ ID NO: 119792 - DNA, 25 bp, Mus musculus
gggacacatttttctcgggaccatc

SEQ ID NO: 119793 - DNA, 25 bp, Mus musculus
gggacaccagactctcatgaccatg

SEQ ID NO: 119794 - DNA, 25 bp, Mus musculus
gggacaccgtgcttatggtctgaac

SEQ ID NO: 119795 - DNA, 25 bp, Mus musculus
gggacacgtttggagatcaccacaa

SEQ ID NO: 119796 - DNA, 25 bp, Mus musculus
gggacactgtgtgctaaaagctgaa

SEQ ID NO: 119797 - DNA, 25 bp, Mus musculus
gggacagaacagacctactcaacgt

SEQ ID NO: 119798 - DNA, 25 bp, Mus musculus
gggacagcaccttctgcgcagtcaa

SEQ ID NO: 119799 - DNA, 25 bp, Mus musculus
gggacagcagagtgcctaggcctat

SEQ ID NO: 119800 - DNA, 25 bp, Mus musculus
gggacagcctcagacagacttcttg

SEQ ID NO: 119801 - DNA, 25 bp, Mus musculus
gggacagccttcgagacactaaaaa

SEQ ID NO: 119802 - DNA, 25 bp, Mus musculus
gggacagcggcaaccatgagtgact

SEQ ID NO: 119803 - DNA, 25 bp, Mus musculus
gggacaggactaccagcaagaagat

SEQ ID NO: 119804 - DNA, 25 bp, Mus musculus
gggacaggacttggaaacatctttg

SEQ ID NO: 119805 - DNA, 25 bp, Mus musculus
gggacaggagccaacaaatgtgcct

SEQ ID NO: 119806 - DNA, 25 bp, Mus musculus
gggacaggcattgcagctgcctcca

SEQ ID NO: 119807 - DNA, 25 bp, Mus musculus
gggacaggcccaagatcctcatgga

SEQ ID NO: 119808 - DNA, 25 bp, Mus musculus
gggacaggctaacgactactgcttc

SEQ ID NO: 119809 - DNA, 25 bp, Mus musculus
gggacagtatgaccgctcaggaaac

SEQ ID NO: 119810 - DNA, 25 bp, Mus musculus
gggacagtttgcactctggcagaaa

SEQ ID NO: 119811 - DNA, 25 bp, Mus musculus
gggacataatgaacgccagggtcat

SEQ ID NO: 119812 - DNA, 25 bp, Mus musculus
gggacatcaccctacagcagttcag

SEQ ID NO: 119813 - DNA, 25 bp, Mus musculus
gggacatcccataagtagtttcaag

SEQ ID NO: 119814 - DNA, 25 bp, Mus musculus
gggacatcgggctgctcgaagaccc

SEQ ID NO: 119815 - DNA, 25 bp, Mus musculus
gggacatcttcaccgaatacatctg

SEQ ID NO: 119816 - DNA, 25 bp, Mus musculus
gggacatcttttctcaatatggcaa

SEQ ID NO: 119817 - DNA, 25 bp, Mus musculus
gggacatgttatcacagccatcagc

SEQ ID NO: 119818 - DNA, 25 bp, Mus musculus
gggacattatccgactcaccaaagg

SEQ ID NO: 119819 - DNA, 25 bp, Mus musculus
gggacattgccagctccagaaaata

SEQ ID NO: 119820 - DNA, 25 bp, Mus musculus
gggaccaaggcaaagagacaagttc

SEQ ID NO: 119821 - DNA, 25 bp, Mus musculus
gggaccaaggctactccaaaggctt

SEQ ID NO: 119822 - DNA, 25 bp, Mus musculus
gggaccacagcaaagagtctgcctt

SEQ ID NO: 119823 - DNA, 25 bp, Mus musculus
gggaccagccagcaacgagtagaat

SEQ ID NO: 119824 - DNA, 25 bp, Mus musculus
gggaccagccatctcataaagtgtg

SEQ ID NO: 119825 - DNA, 25 bp, Mus musculus
gggaccagctttgagtttgcactag

SEQ ID NO: 119826 - DNA, 25 bp, Mus musculus
gggaccaggcaacatagctactcgg

SEQ ID NO: 119827 - DNA, 25 bp, Mus musculus
gggaccataaaaggctagaattcag

SEQ ID NO: 119828 - DNA, 25 bp, Mus musculus
gggaccatagaaccaagatgcactt

SEQ ID NO: 119829 - DNA, 25 bp, Mus musculus
gggaccattcctatcgcttagcgag

SEQ ID NO: 119830 - DNA, 25 bp, Mus musculus
gggaccattctctaacaccgggcac

SEQ ID NO: 119831 - DNA, 25 bp, Mus musculus
gggacccaaacaccgctgctgactt

SEQ ID NO: 119832 - DNA, 25 bp, Mus musculus
gggacccaagactagagcaaataag

SEQ ID NO: 119833 - DNA, 25 bp, Mus musculus
gggacccattcctggagggaccagt

SEQ ID NO: 119834 - DNA, 25 bp, Mus musculus
gggacccatttccagaagaactaca

SEQ ID NO: 119835 - DNA, 25 bp, Mus musculus
gggaccccaaacctatgacagcaag

SEQ ID NO: 119836 - DNA, 25 bp, Mus musculus
gggaccccaagatcctcatcgacag

SEQ ID NO: 119837 - DNA, 25 bp, Mus musculus
gggacccctcctcatggacagtgga

SEQ ID NO: 119838 - DNA, 25 bp, Mus musculus
gggaccctacagtcacctaatctct

SEQ ID NO: 119839 - DNA, 25 bp, Mus musculus
gggaccctctgactatcgcaatgga

SEQ ID NO: 119840 - DNA, 25 bp, Mus musculus
gggaccctctgtttccaaggactct

SEQ ID NO: 119841 - DNA, 25 bp, Mus musculus
gggaccctgcccctatatttggagc

SEQ ID NO: 119842 - DNA, 25 bp, Mus musculus
gggacccttatcatcgtcaatagcg

SEQ ID NO: 119843 - DNA, 25 bp, Mus musculus
gggaccgcccatacaggtgtgactt

SEQ ID NO: 119844 - DNA, 25 bp, Mus musculus
gggaccgcttgtctgcaccacagat

SEQ ID NO: 119845 - DNA, 25 bp, Mus musculus
gggaccgtcatccaatatggcaacg

SEQ ID NO: 119846 - DNA, 25 bp, Mus musculus
gggaccgtggttcgttccagcacaa

SEQ ID NO: 119847 - DNA, 25 bp, Mus musculus
gggacctaattccagcagtctgtat

SEQ ID NO: 119848 - DNA, 25 bp, Mus musculus
gggacctacctctcccaagatgaga

SEQ ID NO: 119849 - DNA, 25 bp, Mus musculus
gggacctactacagcgactccatct

SEQ ID NO: 119850 - DNA, 25 bp, Mus musculus
gggacctgaaccttctggctccaga

SEQ ID NO: 119851 - DNA, 25 bp, Mus musculus
gggacctggatctgtttactgagca

SEQ ID NO: 119852 - DNA, 25 bp, Mus musculus
gggacctggctgtacatatgtgaat

SEQ ID NO: 119853 - DNA, 25 bp, Mus musculus
gggaccttacagaaattgcctcttc

SEQ ID NO: 119854 - DNA, 25 bp, Mus musculus
gggaccttggtaggactctcagcta

SEQ ID NO: 119855 - DNA, 25 bp, Mus musculus
gggacgaaccctcctttcatgactt

SEQ ID NO: 119856 - DNA, 25 bp, Mus musculus
gggacgactcaagcctacctagaag

SEQ ID NO: 119857 - DNA, 25 bp, Mus musculus
gggacgccctcattcagctttcaga

SEQ ID NO: 119858 - DNA, 25 bp, Mus musculus
gggacgccctcctgcagatgatcac

SEQ ID NO: 119859 - DNA, 25 bp, Mus musculus
gggacgcctaacctacaactttatg

SEQ ID NO: 119860 - DNA, 25 bp, Mus musculus
gggacgcggtgaacaactctgaatg

SEQ ID NO: 119861 - DNA, 25 bp, Mus musculus
gggacggacacaaatggagacatct

SEQ ID NO: 119862 - DNA, 25 bp, Mus musculus
gggacggcgaggaccctgcttttct

SEQ ID NO: 119863 - DNA, 25 bp, Mus musculus
gggacggcttttacctagcgcctga

SEQ ID NO: 119864 - DNA, 25 bp, Mus musculus
gggacggtcctcaccttttctgccg

SEQ ID NO: 119865 - DNA, 25 bp, Mus musculus
gggacgtctgccgaagatccttgga

SEQ ID NO: 119866 - DNA, 25 bp, Mus musculus
gggacgtgcttcgattgtagttcag

SEQ ID NO: 119867 - DNA, 25 bp, Mus musculus
gggactactgtgaccatgacaggca

SEQ ID NO: 119868 - DNA, 25 bp, Mus musculus
gggactagactttgccctgactctg

SEQ ID NO: 119869 - DNA, 25 bp, Mus musculus
gggactatacgatcttgctgggcat

SEQ ID NO: 119870 - DNA, 25 bp, Mus musculus
gggactatctctgtgtcactcagac

SEQ ID NO: 119871 - DNA, 25 bp, Mus musculus
gggactatggcgtcaaacagcctct

SEQ ID NO: 119872 - DNA, 25 bp, Mus musculus
gggactatgtatggatggacctgaa

SEQ ID NO: 119873 - DNA, 25 bp, Mus musculus
gggactattaccgttacctggcaga

SEQ ID NO: 119874 - DNA, 25 bp, Mus musculus
gggactcaatgcatgaccaagtgtg

SEQ ID NO: 119875 - DNA, 25 bp, Mus musculus
gggactcacgcgcatgaacatcagt

SEQ ID NO: 119876 - DNA, 25 bp, Mus musculus
gggactcactcgaaaagctctaaga

SEQ ID NO: 119877 - DNA, 25 bp, Mus musculus
gggactccaggcattaacaatgaca

SEQ ID NO: 119878 - DNA, 25 bp, Mus musculus
gggactccatgtacagctctgcgct

SEQ ID NO: 119879 - DNA, 25 bp, Mus musculus
gggactccgcgctaacatctctact

SEQ ID NO: 119880 - DNA, 25 bp, Mus musculus
gggactccgctttcgagaagcagca

SEQ ID NO: 119881 - DNA, 25 bp, Mus musculus
gggactcctaccaattcttccgaga

SEQ ID NO: 119882 - DNA, 25 bp, Mus musculus
gggactcctttccttggccctgagg

SEQ ID NO: 119883 - DNA, 25 bp, Mus musculus
gggactctctccattactctccgga

SEQ ID NO: 119884 - DNA, 25 bp, Mus musculus
gggactcttcttcttgggcactgaa

SEQ ID NO: 119885 - DNA, 25 bp, Mus musculus
gggactgaccaggctatagatgcct

SEQ ID NO: 119886 - DNA, 25 bp, Mus musculus
gggactgactcaccctgatgactct

SEQ ID NO: 119887 - DNA, 25 bp, Mus musculus
gggactgagcaacaagaaacccaac

SEQ ID NO: 119888 - DNA, 25 bp, Mus musculus
gggactgcagattctctacgacaca

SEQ ID NO: 119889 - DNA, 25 bp, Mus musculus
gggactgctcccttgtgaacgaact

SEQ ID NO: 119890 - DNA, 25 bp, Mus musculus
gggactgctttctacaccatttgcc

SEQ ID NO: 119891 - DNA, 25 bp, Mus musculus
gggactggatctgccctgacaagaa

SEQ ID NO: 119892 - DNA, 25 bp, Mus musculus
gggactgtgatacaacgctttgaga

SEQ ID NO: 119893 - DNA, 25 bp, Mus musculus
gggacttaaatgacctgcccgagta

SEQ ID NO: 119894 - DNA, 25 bp, Mus musculus
gggacttaactctccactgtccaaa

SEQ ID NO: 119895 - DNA, 25 bp, Mus musculus
gggacttaccacaaggagccggatt

SEQ ID NO: 119896 - DNA, 25 bp, Mus musculus
gggacttactccatgaccttgactc

SEQ ID NO: 119897 - DNA, 25 bp, Mus musculus
gggacttcacttcagagccagagga

SEQ ID NO: 119898 - DNA, 25 bp, Mus musculus
gggacttccggctcctgtatcctga

SEQ ID NO: 119899 - DNA, 25 bp, Mus musculus
gggacttctgcctcgggattccacc

SEQ ID NO: 119900 - DNA, 25 bp, Mus musculus
gggacttgtcctgctacttgtgata

SEQ ID NO: 119901 - DNA, 25 bp, Mus musculus
gggactttcctcgacggccagaagt

SEQ ID NO: 119902 - DNA, 25 bp, Mus musculus
gggactttctcttcagcagtgacca

SEQ ID NO: 119903 - DNA, 25 bp, Mus musculus
gggactttgtatctcgactatggct

SEQ ID NO: 119904 - DNA, 25 bp, Mus musculus
gggagaaaagtggtgtcctcgccca

SEQ ID NO: 119905 - DNA, 25 bp, Mus musculus
gggagaactttcttcagcagctgta

SEQ ID NO: 119906 - DNA, 25 bp, Mus musculus
gggagaagctgccacaacctgtgta

SEQ ID NO: 119907 - DNA, 25 bp, Mus musculus
gggagaaggctcgtgcaaacagtcc

SEQ ID NO: 119908 - DNA, 25 bp, Mus musculus
gggagaatgctcctagtcctgatag

SEQ ID NO: 119909 - DNA, 25 bp, Mus musculus
gggagacagcagaatggcctgcaaa

SEQ ID NO: 119910 - DNA, 25 bp, Mus musculus
gggagacagtgatggttacatcaac

SEQ ID NO: 119911 - DNA, 25 bp, Mus musculus
gggagacattcctgtacttcgccta

SEQ ID NO: 119912 - DNA, 25 bp, Mus musculus
gggagaccagtttggacatgtgaac

SEQ ID NO: 119913 - DNA, 25 bp, Mus musculus
gggagaccgtgatgagcgtcaaaat

SEQ ID NO: 119914 - DNA, 25 bp, Mus musculus
gggagacctccttgatgagaacctt

SEQ ID NO: 119915 - DNA, 25 bp, Mus musculus
gggagaccttttacctgtgatcgct

SEQ ID NO: 119916 - DNA, 25 bp, Mus musculus
gggagacgccaagtaacgtcgagcc

SEQ ID NO: 119917 - DNA, 25 bp, Mus musculus
gggagacggtccacctgacagagat

SEQ ID NO: 119918 - DNA, 25 bp, Mus musculus
gggagactcgcctcactactgtgga

SEQ ID NO: 119919 - DNA, 25 bp, Mus musculus
gggagacttccaacgcatgacagca

SEQ ID NO: 119920 - DNA, 25 bp, Mus musculus
gggagactttgcctttcctgatgag

SEQ ID NO: 119921 - DNA, 25 bp, Mus musculus
gggagagaactaccagcagaactgt

SEQ ID NO: 119922 - DNA, 25 bp, Mus musculus
gggagagaccgaaacaaaagtgatg

SEQ ID NO: 119923 - DNA, 25 bp, Mus musculus
gggagagataccaataccgtcagga

SEQ ID NO: 119924 - DNA, 25 bp, Mus musculus
gggagagccctaagttaaccacctg

SEQ ID NO: 119925 - DNA, 25 bp, Mus musculus
gggagatacattgtctatttagagt

SEQ ID NO: 119926 - DNA, 25 bp, Mus musculus
gggagatatcccagcaactacaatg

SEQ ID NO: 119927 - DNA, 25 bp, Mus musculus
gggagatcatgaaacgaggtcgcct

SEQ ID NO: 119928 - DNA, 25 bp, Mus musculus
gggagatcctcagctttgggaagca

SEQ ID NO: 119929 - DNA, 25 bp, Mus musculus
gggagatctcactgaaaaccgggat

SEQ ID NO: 119930 - DNA, 25 bp, Mus musculus
gggagatgatgaagccccgacaact

SEQ ID NO: 119931 - DNA, 25 bp, Mus musculus
gggagattcccaggctgttaacgcg

SEQ ID NO: 119932 - DNA, 25 bp, Mus musculus
gggagattcgtttcacagtgggcac

SEQ ID NO: 119933 - DNA, 25 bp, Mus musculus
gggagcacgactgcttcaagcaaac

SEQ ID NO: 119934 - DNA, 25 bp, Mus musculus
gggagcactacaaacgcaacgagac

SEQ ID NO: 119935 - DNA, 25 bp, Mus musculus
gggagcagaagttttccagccttcc

SEQ ID NO: 119936 - DNA, 25 bp, Mus musculus
gggagcagctatctatcacttgagg

SEQ ID NO: 119937 - DNA, 25 bp, Mus musculus
gggagccaacctcttccgaaaggag

SEQ ID NO: 119938 - DNA, 25 bp, Mus musculus
gggagccagtctgtaactcgccggc

SEQ ID NO: 119939 - DNA, 25 bp, Mus musculus
gggagccataaatgactagagtcac

SEQ ID NO: 119940 - DNA, 25 bp, Mus musculus
gggagcccaatgtgtcctacatctg

SEQ ID NO: 119941 - DNA, 25 bp, Mus musculus
gggagcccacgtaccagctcaacat

SEQ ID NO: 119942 - DNA, 25 bp, Mus musculus
gggagccccagatcctttgaaagcc

SEQ ID NO: 119943 - DNA, 25 bp, Mus musculus
gggagccccatcctcactactgtga

SEQ ID NO: 119944 - DNA, 25 bp, Mus musculus
gggagccccgactagagcagctatt

SEQ ID NO: 119945 - DNA, 25 bp, Mus musculus
gggagcccctcagcaataggtggcc

SEQ ID NO: 119946 - DNA, 25 bp, Mus musculus
gggagccgctccaaagatcgtggcc

SEQ ID NO: 119947 - DNA, 25 bp, Mus musculus
gggagccggcaccttatttatgtaa

SEQ ID NO: 119948 - DNA, 25 bp, Mus musculus
gggagcctactattctgccagaaag

SEQ ID NO: 119949 - DNA, 25 bp, Mus musculus
gggagcctgccgtgaagctgcaata

SEQ ID NO: 119950 - DNA, 25 bp, Mus musculus
gggagcctgctttggtactacagaa

SEQ ID NO: 119951 - DNA, 25 bp, Mus musculus
gggagccttgactagtacgccatac

SEQ ID NO: 119952 - DNA, 25 bp, Mus musculus
gggagcgatggagcaaaccccatgt

SEQ ID NO: 119953 - DNA, 25 bp, Mus musculus
gggagcgctgccctcttatgagcat

SEQ ID NO: 119954 - DNA, 25 bp, Mus musculus
gggagcgcttcctaggtcactttga

SEQ ID NO: 119955 - DNA, 25 bp, Mus musculus
gggagcggccatacagctgccctgc

SEQ ID NO: 119956 - DNA, 25 bp, Mus musculus
gggagctctttctgtcgcgccagta

SEQ ID NO: 119957 - DNA, 25 bp, Mus musculus
gggagctgagtctgctgcaatgaca

SEQ ID NO: 119958 - DNA, 25 bp, Mus musculus
gggagctgcaccgatgacctttaag

SEQ ID NO: 119959 - DNA, 25 bp, Mus musculus
gggagctgccctttgaaaaccgtgg

SEQ ID NO: 119960 - DNA, 25 bp, Mus musculus
gggagctggagcacatccggcccaa

SEQ ID NO: 119961 - DNA, 25 bp, Mus musculus
gggagcttgttgacacgcttcagtt

SEQ ID NO: 119962 - DNA, 25 bp, Mus musculus
gggaggaaccattcaaagccactgg

SEQ ID NO: 119963 - DNA, 25 bp, Mus musculus
gggaggaccacgaagaatctgagac

SEQ ID NO: 119964 - DNA, 25 bp, Mus musculus
gggaggatatccatcagccatttca

SEQ ID NO: 119965 - DNA, 25 bp, Mus musculus
gggaggatgtgatccaagacctgat

SEQ ID NO: 119966 - DNA, 25 bp, Mus musculus
gggaggccatcccttatccaagatc

SEQ ID NO: 119967 - DNA, 25 bp, Mus musculus
gggaggcctttttgacatggtgaaa

SEQ ID NO: 119968 - DNA, 25 bp, Mus musculus
gggaggcgcttccatcatgctcact

SEQ ID NO: 119969 - DNA, 25 bp, Mus musculus
gggaggctctattcatgaagtgcca

SEQ ID NO: 119970 - DNA, 25 bp, Mus musculus
gggaggctgcgctcgagctgcggcg

SEQ ID NO: 119971 - DNA, 25 bp, Mus musculus
gggagggagctcttccaactggaaa

SEQ ID NO: 119972 - DNA, 25 bp, Mus musculus
gggaggtcaattcccataccctggg

SEQ ID NO: 119973 - DNA, 25 bp, Mus musculus
gggaggtctgttctccaccatcgac

SEQ ID NO: 119974 - DNA, 25 bp, Mus musculus
gggagtaatcctccacagaggaact

SEQ ID NO: 119975 - DNA, 25 bp, Mus musculus
gggagtacgccatgatgtacacagg

SEQ ID NO: 119976 - DNA, 25 bp, Mus musculus
gggagtacttccacagccgacagta

SEQ ID NO: 119977 - DNA, 25 bp, Mus musculus
gggagtagccattaccctaggttct

SEQ ID NO: 119978 - DNA, 25 bp, Mus musculus
gggagtatcacgtcccctcctcttt

SEQ ID NO: 119979 - DNA, 25 bp, Mus musculus
gggagtcagaaaacggcacagtgca

SEQ ID NO: 119980 - DNA, 25 bp, Mus musculus
gggagtccacccctctgtcatagtg

SEQ ID NO: 119981 - DNA, 25 bp, Mus musculus
gggagtccggaagtcaacaccatgt

SEQ ID NO: 119982 - DNA, 25 bp, Mus musculus
gggagtctactccaaacggaagcca

SEQ ID NO: 119983 - DNA, 25 bp, Mus musculus
gggagtgacccacatcagagtcgta

SEQ ID NO: 119984 - DNA, 25 bp, Mus musculus
gggagtgatcccctgaaggattaca

SEQ ID NO: 119985 - DNA, 25 bp, Mus musculus
gggagttagcagagccattctcaaa

SEQ ID NO: 119986 - DNA, 25 bp, Mus musculus
gggagttcaacaaatacctcgcata

SEQ ID NO: 119987 - DNA, 25 bp, Mus musculus
gggagttcagccagtttccggccca

SEQ ID NO: 119988 - DNA, 25 bp, Mus musculus
gggagttccagctgatccggcagac

SEQ ID NO: 119989 - DNA, 25 bp, Mus musculus
gggagttcctctgcaaagttctcag

SEQ ID NO: 119990 - DNA, 25 bp, Mus musculus
gggagttcgtgcaccgcggctacct

SEQ ID NO: 119991 - DNA, 25 bp, Mus musculus
gggagttctgcctggctcacttgtt

SEQ ID NO: 119992 - DNA, 25 bp, Mus musculus
gggagttgtgccgatacctcgtcaa

SEQ ID NO: 119993 - DNA, 25 bp, Mus musculus
gggagtttgaaaacgccctgcagga

SEQ ID NO: 119994 - DNA, 25 bp, Mus musculus
gggataaaataacctggccagggca

SEQ ID NO: 119995 - DNA, 25 bp, Mus musculus
gggataagcctcgactccttcctgg

SEQ ID NO: 119996 - DNA, 25 bp, Mus musculus
gggataatcgtctttattttagtca

SEQ ID NO: 119997 - DNA, 25 bp, Mus musculus
gggataatgtttcccagcccaagga

SEQ ID NO: 119998 - DNA, 25 bp, Mus musculus
gggatacagttcacgtcaaggcagt

SEQ ID NO: 119999 - DNA, 25 bp, Mus musculus
gggataccagaatacccactgtgat

SEQ ID NO: 120000 - DNA, 25 bp, Mus musculus
gggatacccacccttctgggatgaa

SEQ ID NO: 120001 - DNA, 25 bp, Mus musculus
gggatacgtacactcctggcttcga

SEQ ID NO: 120002 - DNA, 25 bp, Mus musculus
gggatacgtctgtgcgcctctacga

SEQ ID NO: 120003 - DNA, 25 bp, Mus musculus
gggatacttgccttgtttgtggcag

SEQ ID NO: 120004 - DNA, 25 bp, Mus musculus
gggatagaaacccatgaagcctaca

SEQ ID NO: 120005 - DNA, 25 bp, Mus musculus
gggataggtcatggctgctcacttc

SEQ ID NO: 120006 - DNA, 25 bp, Mus musculus
gggatatcatcttccatatggcaga

SEQ ID NO: 120007 - DNA, 25 bp, Mus musculus
gggatattccgagttggaagctcaa

SEQ ID NO: 120008 - DNA, 25 bp, Mus musculus
gggatattctctcgactgcatggaa

SEQ ID NO: 120009 - DNA, 25 bp, Mus musculus
gggatattggtctacccagggctgc

SEQ ID NO: 120010 - DNA, 25 bp, Mus musculus
gggatcaaacagtgctcattcttca

SEQ ID NO: 120011 - DNA, 25 bp, Mus musculus
gggatcaataatggtgtcttctggc

SEQ ID NO: 120012 - DNA, 25 bp, Mus musculus
gggatcacgatccagtcagcagcta

SEQ ID NO: 120013 - DNA, 25 bp, Mus musculus
gggatcactgtcaaccacctggtgg

SEQ ID NO: 120014 - DNA, 25 bp, Mus musculus
gggatccagctgagttccttagaac

SEQ ID NO: 120015 - DNA, 25 bp, Mus musculus
gggatccattgaacagaccctgaca

SEQ ID NO: 120016 - DNA, 25 bp, Mus musculus
gggatcccagaaccaacaagtcatt

SEQ ID NO: 120017 - DNA, 25 bp, Mus musculus
gggatcccagtcttcacacagtagg

SEQ ID NO: 120018 - DNA, 25 bp, Mus musculus
gggatcccttccattgtcatagaag

SEQ ID NO: 120019 - DNA, 25 bp, Mus musculus
gggatcctcggataaccacaggcgg

SEQ ID NO: 120020 - DNA, 25 bp, Mus musculus
gggatcctcttgctgcagcttccac

SEQ ID NO: 120021 - DNA, 25 bp, Mus musculus
gggatcctgctgaaaagaagcggca

SEQ ID NO: 120022 - DNA, 25 bp, Mus musculus
gggatcgcaacaccaagaaaacctg

SEQ ID NO: 120023 - DNA, 25 bp, Mus musculus
gggatcggaattacgccatcggcta

SEQ ID NO: 120024 - DNA, 25 bp, Mus musculus
gggatcgtccccaaaattgccttct

SEQ ID NO: 120025 - DNA, 25 bp, Mus musculus
gggatctgggtgatatggaaccatt

SEQ ID NO: 120026 - DNA, 25 bp, Mus musculus
gggatcttccagtcagccatctaca

SEQ ID NO: 120027 - DNA, 25 bp, Mus musculus
gggatgagatggatcatttcaagat

SEQ ID NO: 120028 - DNA, 25 bp, Mus musculus
gggatgagccccttcgtcggccagt

SEQ ID NO: 120029 - DNA, 25 bp, Mus musculus
gggatgaggtctttgacaccgtcaa

SEQ ID NO: 120030 - DNA, 25 bp, Mus musculus
gggatgatctaccactctctgaaag

SEQ ID NO: 120031 - DNA, 25 bp, Mus musculus
gggatgatctcttgctcaactcgga

SEQ ID NO: 120032 - DNA, 25 bp, Mus musculus
gggatgcagctgacctaaaaactct

SEQ ID NO: 120033 - DNA, 25 bp, Mus musculus
gggatgcagtcaacaacacagagtg

SEQ ID NO: 120034 - DNA, 25 bp, Mus musculus
gggatgccccatccactgtatggct

SEQ ID NO: 120035 - DNA, 25 bp, Mus musculus
gggatgctagacctcctcaagtgca

SEQ ID NO: 120036 - DNA, 25 bp, Mus musculus
gggatgctctcaataacgggactga

SEQ ID NO: 120037 - DNA, 25 bp, Mus musculus
gggatgctgcccaaatcactggaag

SEQ ID NO: 120038 - DNA, 25 bp, Mus musculus
gggatggcggatccggccggagcat

SEQ ID NO: 120039 - DNA, 25 bp, Mus musculus
gggatgtaccccatgtagccctcag

SEQ ID NO: 120040 - DNA, 25 bp, Mus musculus
gggatgtactgacaacaccacccca

SEQ ID NO: 120041 - DNA, 25 bp, Mus musculus
gggatgtcatccaagttctggaagc

SEQ ID NO: 120042 - DNA, 25 bp, Mus musculus
gggatgtccacgagtgactgtttca

SEQ ID NO: 120043 - DNA, 25 bp, Mus musculus
gggatgtccgtcataagctcttctt

SEQ ID NO: 120044 - DNA, 25 bp, Mus musculus
gggatgtcctcattcccaagggctg

SEQ ID NO: 120045 - DNA, 25 bp, Mus musculus
gggatgttagcttgcctatgcacgg

SEQ ID NO: 120046 - DNA, 25 bp, Mus musculus
gggatgttgcactacctctacttgg

SEQ ID NO: 120047 - DNA, 25 bp, Mus musculus
gggattaccaaagcctctgtttcaa

SEQ ID NO: 120048 - DNA, 25 bp, Mus musculus
gggattactcaccaagcagggcctg

SEQ ID NO: 120049 - DNA, 25 bp, Mus musculus
gggattactgcctgcccgatcttca

SEQ ID NO: 120050 - DNA, 25 bp, Mus musculus
gggattatggctcctccaaagcctg

SEQ ID NO: 120051 - DNA, 25 bp, Mus musculus
gggattcagcaaccggacctttcag

SEQ ID NO: 120052 - DNA, 25 bp, Mus musculus
gggattccgacctaacttgtctgca

SEQ ID NO: 120053 - DNA, 25 bp, Mus musculus
gggattccttctcctcctcgccctg

SEQ ID NO: 120054 - DNA, 25 bp, Mus musculus
gggattctgggatccaccacgctag

SEQ ID NO: 120055 - DNA, 25 bp, Mus musculus
gggattctggtctggattacctgca

SEQ ID NO: 120056 - DNA, 25 bp, Mus musculus
gggattgcactgctgaactgtgtca

SEQ ID NO: 120057 - DNA, 25 bp, Mus musculus
gggattgcatgacaccacgtaacct

SEQ ID NO: 120058 - DNA, 25 bp, Mus musculus
gggattggcagaacccgaggccaaa

SEQ ID NO: 120059 - DNA, 25 bp, Mus musculus
gggatttcccagagtcgccaggtcc

SEQ ID NO: 120060 - DNA, 25 bp, Mus musculus
gggcaaacaccccagactcagatgt

SEQ ID NO: 120061 - DNA, 25 bp, Mus musculus
gggcaacaaatcctacagcagccac

SEQ ID NO: 120062 - DNA, 25 bp, Mus musculus
gggcaacaacccatagcagtcaaaa

SEQ ID NO: 120063 - DNA, 25 bp, Mus musculus
gggcaacaactacctttcctatgag

SEQ ID NO: 120064 - DNA, 25 bp, Mus musculus
gggcaacaactgtatccagctctga

SEQ ID NO: 120065 - DNA, 25 bp, Mus musculus
gggcaacctgcctgacacattgtga

SEQ ID NO: 120066 - DNA, 25 bp, Mus musculus
gggcaacggtctctcccagtgtctg

SEQ ID NO: 120067 - DNA, 25 bp, Mus musculus
gggcaactcaaagtaccattactat

SEQ ID NO: 120068 - DNA, 25 bp, Mus musculus
gggcaactcccgaagcaatacagaa

SEQ ID NO: 120069 - DNA, 25 bp, Mus musculus
gggcaactggacagctttcaccatg

SEQ ID NO: 120070 - DNA, 25 bp, Mus musculus
gggcaagaaacaccatcgcaagcgt

SEQ ID NO: 120071 - DNA, 25 bp, Mus musculus
gggcaagaacaccttccaggaagag

SEQ ID NO: 120072 - DNA, 25 bp, Mus musculus
gggcaagagccctcagcaaatgctg

SEQ ID NO: 120073 - DNA, 25 bp, Mus musculus
gggcaagcaaaactgcccccgtgca

SEQ ID NO: 120074 - DNA, 25 bp, Mus musculus
gggcaagcacttcacctctcatgag

SEQ ID NO: 120075 - DNA, 25 bp, Mus musculus
gggcaaggtcttcccgctttactag

SEQ ID NO: 120076 - DNA, 25 bp, Mus musculus
gggcaatatcctcttttacttcgag

SEQ ID NO: 120077 - DNA, 25 bp, Mus musculus
gggcaatcatcaggagcccacttag

SEQ ID NO: 120078 - DNA, 25 bp, Mus musculus
gggcaatgtgactcgctggtttaac

SEQ ID NO: 120079 - DNA, 25 bp, Mus musculus
gggcacaatagtacccatcaagggc

SEQ ID NO: 120080 - DNA, 25 bp, Mus musculus
gggcacacgttccacgctatttaat

SEQ ID NO: 120081 - DNA, 25 bp, Mus musculus
gggcacagacccagacccggcatgg

SEQ ID NO: 120082 - DNA, 25 bp, Mus musculus
gggcacagcgcatcgaaaaatggat

SEQ ID NO: 120083 - DNA, 25 bp, Mus musculus
gggcacatattaagatcgggaacca

SEQ ID NO: 120084 - DNA, 25 bp, Mus musculus
gggcacatgggacttactctcctga

SEQ ID NO: 120085 - DNA, 25 bp, Mus musculus
gggcaccactaccttatcttcgatc

SEQ ID NO: 120086 - DNA, 25 bp, Mus musculus
gggcaccactgctctaaatgatgaa

SEQ ID NO: 120087 - DNA, 25 bp, Mus musculus
gggcaccagtaaaacctctaacaag

SEQ ID NO: 120088 - DNA, 25 bp, Mus musculus
gggcacccggagttttaatcattgt

SEQ ID NO: 120089 - DNA, 25 bp, Mus musculus
gggcacctgaggagtattttggacc

SEQ ID NO: 120090 - DNA, 25 bp, Mus musculus
gggcacggcagctcagcaagcttaa

SEQ ID NO: 120091 - DNA, 25 bp, Mus musculus
gggcactcatgcgttctccgattca

SEQ ID NO: 120092 - DNA, 25 bp, Mus musculus
gggcactctgaaacagcacttcttg

SEQ ID NO: 120093 - DNA, 25 bp, Mus musculus
gggcactgaagttccaccgaacaac

SEQ ID NO: 120094 - DNA, 25 bp, Mus musculus
gggcactgcttcagatccgagccat

SEQ ID NO: 120095 - DNA, 25 bp, Mus musculus
gggcactgttattacaccgactgag

SEQ ID NO: 120096 - DNA, 25 bp, Mus musculus
gggcagacactgctgttaatagaca

SEQ ID NO: 120097 - DNA, 25 bp, Mus musculus
gggcagagatgcttcacacacactt

SEQ ID NO: 120098 - DNA, 25 bp, Mus musculus
gggcagccaccaacagtcatcatgg

SEQ ID NO: 120099 - DNA, 25 bp, Mus musculus
gggcagcccaaaccatggaagcctt

SEQ ID NO: 120100 - DNA, 25 bp, Mus musculus
gggcagcccatgtccgttactataa

SEQ ID NO: 120101 - DNA, 25 bp, Mus musculus
gggcagccctgctaatgtcacggag

SEQ ID NO: 120102 - DNA, 25 bp, Mus musculus
gggcagccctgtgtcttcatcaaaa

SEQ ID NO: 120103 - DNA, 25 bp, Mus musculus
gggcagcccttccacatgatccttt

SEQ ID NO: 120104 - DNA, 25 bp, Mus musculus
gggcagcggttcttaccaaggacat

SEQ ID NO: 120105 - DNA, 25 bp, Mus musculus
gggcagctcccaatgtcttcaaaga

SEQ ID NO: 120106 - DNA, 25 bp, Mus musculus
gggcagctctgactactgccgttcc

SEQ ID NO: 120107 - DNA, 25 bp, Mus musculus
gggcagcttagatgcgccacggctt

SEQ ID NO: 120108 - DNA, 25 bp, Mus musculus
gggcaggagaccgactggcgtagcg

SEQ ID NO: 120109 - DNA, 25 bp, Mus musculus
gggcaggaggaaaagcagatttgcc

SEQ ID NO: 120110 - DNA, 25 bp, Mus musculus
gggcaggccatgttgcatgtgacct

SEQ ID NO: 120111 - DNA, 25 bp, Mus musculus
gggcaggctataggacagacgacaa

SEQ ID NO: 120112 - DNA, 25 bp, Mus musculus
gggcaggtaccacattctctagaga

SEQ ID NO: 120113 - DNA, 25 bp, Mus musculus
gggcagtaaatctgacatggtacaa

SEQ ID NO: 120114 - DNA, 25 bp, Mus musculus
gggcagtagagtttgctccggtctc

SEQ ID NO: 120115 - DNA, 25 bp, Mus musculus
gggcagtcctctgtccaggtcaaaa

SEQ ID NO: 120116 - DNA, 25 bp, Mus musculus
gggcagtcctgtggttcaacctaca

SEQ ID NO: 120117 - DNA, 25 bp, Mus musculus
gggcagtgaccggtatgtgaataaa

SEQ ID NO: 120118 - DNA, 25 bp, Mus musculus
gggcagtgccactagcagttccaat

SEQ ID NO: 120119 - DNA, 25 bp, Mus musculus
gggcagtgctaccaaaccgataacc

SEQ ID NO: 120120 - DNA, 25 bp, Mus musculus
gggcagtgctgtacagtcctacaat

SEQ ID NO: 120121 - DNA, 25 bp, Mus musculus
gggcagttacctttcgatcctaagt

SEQ ID NO: 120122 - DNA, 25 bp, Mus musculus
gggcatacctcttaggcagaagtca

SEQ ID NO: 120123 - DNA, 25 bp, Mus musculus
gggcatagcctcagatatacctaag

SEQ ID NO: 120124 - DNA, 25 bp, Mus musculus
gggcatcaaaagaccaaagcaaaaa

SEQ ID NO: 120125 - DNA, 25 bp, Mus musculus
gggcatccagttgtgatggctgcaa

SEQ ID NO: 120126 - DNA, 25 bp, Mus musculus
gggcatcccatcaacccacgagttg

SEQ ID NO: 120127 - DNA, 25 bp, Mus musculus
gggcatcctggatcctgaaacgaca

SEQ ID NO: 120128 - DNA, 25 bp, Mus musculus
gggcatctacagtcagaaggtatct

SEQ ID NO: 120129 - DNA, 25 bp, Mus musculus
gggcatcttgctttggaaccgtcgg

SEQ ID NO: 120130 - DNA, 25 bp, Mus musculus
gggcatgaatggagcctccccacca

SEQ ID NO: 120131 - DNA, 25 bp, Mus musculus
gggcatgatcagagatgctcaccac

SEQ ID NO: 120132 - DNA, 25 bp, Mus musculus
gggcatggccaaacctttcttcaga

SEQ ID NO: 120133 - DNA, 25 bp, Mus musculus
gggcatgtccaaaggatgccacatg

SEQ ID NO: 120134 - DNA, 25 bp, Mus musculus
gggcatgttgaacgcaaactgctca

SEQ ID NO: 120135 - DNA, 25 bp, Mus musculus
gggcattccaggctcacaaagagga

SEQ ID NO: 120136 - DNA, 25 bp, Mus musculus
gggcattctggaccgtaaccctcgc

SEQ ID NO: 120137 - DNA, 25 bp, Mus musculus
gggcattggcctagcaatttctctg

SEQ ID NO: 120138 - DNA, 25 bp, Mus musculus
gggcatttgacttacctgacacaga

SEQ ID NO: 120139 - DNA, 25 bp, Mus musculus
gggccaaacctgtctaacctcagtc

SEQ ID NO: 120140 - DNA, 25 bp, Mus musculus
gggccaaataaaacaccggtagcag

SEQ ID NO: 120141 - DNA, 25 bp, Mus musculus
gggccaacagcactacagatgcagt

SEQ ID NO: 120142 - DNA, 25 bp, Mus musculus
gggccaagaaccacaactgaagagc

SEQ ID NO: 120143 - DNA, 25 bp, Mus musculus
gggccaaggcaccactctcacagtc

SEQ ID NO: 120144 - DNA, 25 bp, Mus musculus
gggccaagtggcttctccgactaga

SEQ ID NO: 120145 - DNA, 25 bp, Mus musculus
gggccacaatgtagcagaggttcaa

SEQ ID NO: 120146 - DNA, 25 bp, Mus musculus
gggccacagccaataaggtcatgtt

SEQ ID NO: 120147 - DNA, 25 bp, Mus musculus
gggccacctctgtgacgggcaataa

SEQ ID NO: 120148 - DNA, 25 bp, Mus musculus
gggccaccttgagacgaccagaagt

SEQ ID NO: 120149 - DNA, 25 bp, Mus musculus
gggccacgggtccagccggcagcgg

SEQ ID NO: 120150 - DNA, 25 bp, Mus musculus
gggccacgtccccttctaacaatgt

SEQ ID NO: 120151 - DNA, 25 bp, Mus musculus
gggccactagcttttcacataggag

SEQ ID NO: 120152 - DNA, 25 bp, Mus musculus
gggccactctggtcgtgtacaagga

SEQ ID NO: 120153 - DNA, 25 bp, Mus musculus
gggccagaaagaagtaagtacagtg

SEQ ID NO: 120154 - DNA, 25 bp, Mus musculus
gggccagagaatgagaggctacata

SEQ ID NO: 120155 - DNA, 25 bp, Mus musculus
gggccagcacttttgtttctcatga

SEQ ID NO: 120156 - DNA, 25 bp, Mus musculus
gggccagcaggtcttcctcaagccg

SEQ ID NO: 120157 - DNA, 25 bp, Mus musculus
gggccagccttcttggaccatagag

SEQ ID NO: 120158 - DNA, 25 bp, Mus musculus
gggccaggtccttgcaataatgaaa

SEQ ID NO: 120159 - DNA, 25 bp, Mus musculus
gggccagtaccaacagcagctctgg

SEQ ID NO: 120160 - DNA, 25 bp, Mus musculus
gggccagtcagcactctctgcgggc

SEQ ID NO: 120161 - DNA, 25 bp, Mus musculus
gggccataggtactcttttcacgga

SEQ ID NO: 120162 - DNA, 25 bp, Mus musculus
gggccatcatcctaagactgcagaa

SEQ ID NO: 120163 - DNA, 25 bp, Mus musculus
gggccatccaggagtcccagtgtct

SEQ ID NO: 120164 - DNA, 25 bp, Mus musculus
gggccatccccttgggttctcagtg

SEQ ID NO: 120165 - DNA, 25 bp, Mus musculus
gggccatcggccatacttcctgaag

SEQ ID NO: 120166 - DNA, 25 bp, Mus musculus
gggccatgagcctgaaggagatcat

SEQ ID NO: 120167 - DNA, 25 bp, Mus musculus
gggccatgatgctgtccagaccgaa

SEQ ID NO: 120168 - DNA, 25 bp, Mus musculus
gggccatgcccacgcatccgcagaa

SEQ ID NO: 120169 - DNA, 25 bp, Mus musculus
gggccatgtccggagagctgacttt

SEQ ID NO: 120170 - DNA, 25 bp, Mus musculus
gggccattagtccagccatgcttca

SEQ ID NO: 120171 - DNA, 25 bp, Mus musculus
gggcccaaagtaccaagctgacatt

SEQ ID NO: 120172 - DNA, 25 bp, Mus musculus
gggcccaacaataggacagtgctta

SEQ ID NO: 120173 - DNA, 25 bp, Mus musculus
gggcccaactcagaaaagtcttcgt

SEQ ID NO: 120174 - DNA, 25 bp, Mus musculus
gggcccaggttcaatgccaggtcca

SEQ ID NO: 120175 - DNA, 25 bp, Mus musculus
gggcccatgtctatgttccaggaat

SEQ ID NO: 120176 - DNA, 25 bp, Mus musculus
gggccccaggcaagccaaatcttta

SEQ ID NO: 120177 - DNA, 25 bp, Mus musculus
gggccccagggactggaagaaatca

SEQ ID NO: 120178 - DNA, 25 bp, Mus musculus
gggccccagtacacgtggaatccag

SEQ ID NO: 120179 - DNA, 25 bp, Mus musculus
gggccccggtgaagatcatcgactt

SEQ ID NO: 120180 - DNA, 25 bp, Mus musculus
gggcccctgtacatccaagagactg

SEQ ID NO: 120181 - DNA, 25 bp, Mus musculus
gggcccgacttacgccttgtggtca

SEQ ID NO: 120182 - DNA, 25 bp, Mus musculus
gggcccgcaactggacagatgcaga

SEQ ID NO: 120183 - DNA, 25 bp, Mus musculus
gggcccgcgttgtctgcgcgtctac

SEQ ID NO: 120184 - DNA, 25 bp, Mus musculus
gggcccgctatccacaggaaccttt

SEQ ID NO: 120185 - DNA, 25 bp, Mus musculus
gggcccggaacaagaaaacagctga

SEQ ID NO: 120186 - DNA, 25 bp, Mus musculus
gggcccgtatctctgaccacaattg

SEQ ID NO: 120187 - DNA, 25 bp, Mus musculus
gggccctcaagcacgaaggaaatga

SEQ ID NO: 120188 - DNA, 25 bp, Mus musculus
gggccctcggatgaagaactcttgg

SEQ ID NO: 120189 - DNA, 25 bp, Mus musculus
gggccctgacatctcttcctaacta

SEQ ID NO: 120190 - DNA, 25 bp, Mus musculus
gggccctgattgctgacaccccata

SEQ ID NO: 120191 - DNA, 25 bp, Mus musculus
gggccctgtggcatcagttataaaa

SEQ ID NO: 120192 - DNA, 25 bp, Mus musculus
gggccgaacattacagaacaccatg

SEQ ID NO: 120193 - DNA, 25 bp, Mus musculus
gggccgacgcatctcagtgatttgc

SEQ ID NO: 120194 - DNA, 25 bp, Mus musculus
gggccgactgcgctaagtttcagaa

SEQ ID NO: 120195 - DNA, 25 bp, Mus musculus
gggccgaggcatagataagaccaat

SEQ ID NO: 120196 - DNA, 25 bp, Mus musculus
gggccgcatgcgaccaacgggcctg

SEQ ID NO: 120197 - DNA, 25 bp, Mus musculus
gggccgctgctaagtaaaaagtctt

SEQ ID NO: 120198 - DNA, 25 bp, Mus musculus
gggccgcttacgtgaataccttcca

SEQ ID NO: 120199 - DNA, 25 bp, Mus musculus
gggccggagtcatcactgtcttcaa

SEQ ID NO: 120200 - DNA, 25 bp, Mus musculus
gggccgggaaaaccatccgatctcg

SEQ ID NO: 120201 - DNA, 25 bp, Mus musculus
gggccgggcaccgtggcggcaggag

SEQ ID NO: 120202 - DNA, 25 bp, Mus musculus
gggccgggtacaacaagatgcagct

SEQ ID NO: 120203 - DNA, 25 bp, Mus musculus
gggccgtccagaagtcatttacaat

SEQ ID NO: 120204 - DNA, 25 bp, Mus musculus
gggccgtgctgtgtataatacattt

SEQ ID NO: 120205 - DNA, 25 bp, Mus musculus
gggccgtggcacacgcattgcagct

SEQ ID NO: 120206 - DNA, 25 bp, Mus musculus
gggcctatcgcatctctctgtcgag

SEQ ID NO: 120207 - DNA, 25 bp, Mus musculus
gggcctatctaaactgcgaacggta

SEQ ID NO: 120208 - DNA, 25 bp, Mus musculus
gggcctatgcaatgaaaccttgacc

SEQ ID NO: 120209 - DNA, 25 bp, Mus musculus
gggcctcacgtcgtcggcttactga

SEQ ID NO: 120210 - DNA, 25 bp, Mus musculus
gggcctccactctacggaggaccga

SEQ ID NO: 120211 - DNA, 25 bp, Mus musculus
gggcctccctgctgatcatgctcaa

SEQ ID NO: 120212 - DNA, 25 bp, Mus musculus
gggcctccgtcatgctaaccaacgg

SEQ ID NO: 120213 - DNA, 25 bp, Mus musculus
gggcctcctacaagacggtcagatt

SEQ ID NO: 120214 - DNA, 25 bp, Mus musculus
gggcctcgatgacttgccgctgaca

SEQ ID NO: 120215 - DNA, 25 bp, Mus musculus
gggcctcggcagaaatattgcacaa

SEQ ID NO: 120216 - DNA, 25 bp, Mus musculus
gggcctctcaacctgtgtgagacct

SEQ ID NO: 120217 - DNA, 25 bp, Mus musculus
gggcctgagtctgccacctggaaga

SEQ ID NO: 120218 - DNA, 25 bp, Mus musculus
gggcctgatgcctacgaagaagtaa

SEQ ID NO: 120219 - DNA, 25 bp, Mus musculus
gggcctgctgactcgctgggactca

SEQ ID NO: 120220 - DNA, 25 bp, Mus musculus
gggcctgctgggaaaactgacgtca

SEQ ID NO: 120221 - DNA, 25 bp, Mus musculus
gggcctgctgggacaaccttgttta

SEQ ID NO: 120222 - DNA, 25 bp, Mus musculus
gggcctggcaaagcacgtgacactg

SEQ ID NO: 120223 - DNA, 25 bp, Mus musculus
gggcctggcaactgtcactttgatt

SEQ ID NO: 120224 - DNA, 25 bp, Mus musculus
gggcctggccttatcgaacagagac

SEQ ID NO: 120225 - DNA, 25 bp, Mus musculus
gggcctggttctccccgctcccgcg

SEQ ID NO: 120226 - DNA, 25 bp, Mus musculus
gggccttaacctcgaagagtgactg

SEQ ID NO: 120227 - DNA, 25 bp, Mus musculus
gggccttaatgaccaccatagggag

SEQ ID NO: 120228 - DNA, 25 bp, Mus musculus
gggccttatatccttttggaacgag

SEQ ID NO: 120229 - DNA, 25 bp, Mus musculus
gggccttcgtgataccagcaattcc

SEQ ID NO: 120230 - DNA, 25 bp, Mus musculus
gggccttcgtgctagtgcattcaag

SEQ ID NO: 120231 - DNA, 25 bp, Mus musculus
gggccttgaatactaccacttggga

SEQ ID NO: 120232 - DNA, 25 bp, Mus musculus
gggccttgagcgcacttcattttta

SEQ ID NO: 120233 - DNA, 25 bp, Mus musculus
gggccttgatctttggctactggag

SEQ ID NO: 120234 - DNA, 25 bp, Mus musculus
gggccttgcgcgagttcaaaacgtt

SEQ ID NO: 120235 - DNA, 25 bp, Mus musculus
gggcctttagtcctcaaagctggaa

SEQ ID NO: 120236 - DNA, 25 bp, Mus musculus
gggcctttcatcaaggcatgactat

SEQ ID NO: 120237 - DNA, 25 bp, Mus musculus
gggcgaatcatcaactccagggtcc

SEQ ID NO: 120238 - DNA, 25 bp, Mus musculus
gggcgacgcgagacggccgggcacg

SEQ ID NO: 120239 - DNA, 25 bp, Mus musculus
gggcgatgtaccaaagcctggccat

SEQ ID NO: 120240 - DNA, 25 bp, Mus musculus
gggcgcacatatttagacagactga

SEQ ID NO: 120241 - DNA, 25 bp, Mus musculus
gggcgcatcaccaagtggaagtatc

SEQ ID NO: 120242 - DNA, 25 bp, Mus musculus
gggcgccacaccgagtccaagcgcg

SEQ ID NO: 120243 - DNA, 25 bp, Mus musculus
gggcgcgcagttcagtttaacttct

SEQ ID NO: 120244 - DNA, 25 bp, Mus musculus
gggcgcgtagaactcttcctaggac

SEQ ID NO: 120245 - DNA, 25 bp, Mus musculus
gggcgctcacctgagtcccgaaatg

SEQ ID NO: 120246 - DNA, 25 bp, Mus musculus
gggcgctttccagaagaacaatgac

SEQ ID NO: 120247 - DNA, 25 bp, Mus musculus
gggcggactgaaaaatgcctcaagg

SEQ ID NO: 120248 - DNA, 25 bp, Mus musculus
gggcggagactaaccagatcattcc

SEQ ID NO: 120249 - DNA, 25 bp, Mus musculus
gggcggagggaagagcggacgggcg

SEQ ID NO: 120250 - DNA, 25 bp, Mus musculus
gggcggccacccaggaactattttg

SEQ ID NO: 120251 - DNA, 25 bp, Mus musculus
gggcggccctgcagagatacctgtt

SEQ ID NO: 120252 - DNA, 25 bp, Mus musculus
gggcggcctggcaaatttaaccaca

SEQ ID NO: 120253 - DNA, 25 bp, Mus musculus
gggcggcggcgtctcggggtctgga

SEQ ID NO: 120254 - DNA, 25 bp, Mus musculus
gggcggctactattgctcctgcaga

SEQ ID NO: 120255 - DNA, 25 bp, Mus musculus
gggcggctcgccattactactactt

SEQ ID NO: 120256 - DNA, 25 bp, Mus musculus
gggcggctgtgtccttcggccggca

SEQ ID NO: 120257 - DNA, 25 bp, Mus musculus
gggcgggcgtttcccggcaggagcg

SEQ ID NO: 120258 - DNA, 25 bp, Mus musculus
gggcgggctccaatccggttccatc

SEQ ID NO: 120259 - DNA, 25 bp, Mus musculus
gggcggtactctgccctgtcttact

SEQ ID NO: 120260 - DNA, 25 bp, Mus musculus
gggcgtaggctaaagacaaccaata

SEQ ID NO: 120261 - DNA, 25 bp, Mus musculus
gggcgtcacatacccaaagggcatg

SEQ ID NO: 120262 - DNA, 25 bp, Mus musculus
gggcgtctagatctcatggtgtcaa

SEQ ID NO: 120263 - DNA, 25 bp, Mus musculus
gggcgtctgcttcaaagcacacaag

SEQ ID NO: 120264 - DNA, 25 bp, Mus musculus
gggcgtggcctcgaagactatgaca

SEQ ID NO: 120265 - DNA, 25 bp, Mus musculus
gggctaacccttatgctcgtaaccg

SEQ ID NO: 120266 - DNA, 25 bp, Mus musculus
gggctaactacctgccggagagtga

SEQ ID NO: 120267 - DNA, 25 bp, Mus musculus
gggctaaggacatcagcagctcctg

SEQ ID NO: 120268 - DNA, 25 bp, Mus musculus
gggctaaggccgtttcgatctgtcg

SEQ ID NO: 120269 - DNA, 25 bp, Mus musculus
gggctacaaaatcctcaaggcggga

SEQ ID NO: 120270 - DNA, 25 bp, Mus musculus
gggctacaactacagagcagaggta

SEQ ID NO: 120271 - DNA, 25 bp, Mus musculus
gggctacatcaaccctgagatgcag

SEQ ID NO: 120272 - DNA, 25 bp, Mus musculus
gggctacatcttcaacacggaggct

SEQ ID NO: 120273 - DNA, 25 bp, Mus musculus
gggctaccagccgtacaatatgcag

SEQ ID NO: 120274 - DNA, 25 bp, Mus musculus
gggctaccgtgtggcctaaccgtga

SEQ ID NO: 120275 - DNA, 25 bp, Mus musculus
gggctagccaactccttaccaggtt

SEQ ID NO: 120276 - DNA, 25 bp, Mus musculus
gggctagccccttgcatgtggatct

SEQ ID NO: 120277 - DNA, 25 bp, Mus musculus
gggctaggcaagtccaccatggtga

SEQ ID NO: 120278 - DNA, 25 bp, Mus musculus
gggctatagcatttcatttctgaag

SEQ ID NO: 120279 - DNA, 25 bp, Mus musculus
gggctatcaccaggcaactcttaag

SEQ ID NO: 120280 - DNA, 25 bp, Mus musculus
gggctatcgggctctacactgttca

SEQ ID NO: 120281 - DNA, 25 bp, Mus musculus
gggctatgacgtgagacccatctca

SEQ ID NO: 120282 - DNA, 25 bp, Mus musculus
gggctatgggaccaacactcccagc

SEQ ID NO: 120283 - DNA, 25 bp, Mus musculus
gggctattctatgctactgaccggg

SEQ ID NO: 120284 - DNA, 25 bp, Mus musculus
gggctattcttctctggagcagtga

SEQ ID NO: 120285 - DNA, 25 bp, Mus musculus
gggctcaaggtattcgtttcatcta

SEQ ID NO: 120286 - DNA, 25 bp, Mus musculus
gggctcaccataatgcactggaacg

SEQ ID NO: 120287 - DNA, 25 bp, Mus musculus
gggctcacgaagttaacctccagga

SEQ ID NO: 120288 - DNA, 25 bp, Mus musculus
gggctcactttaccacgcgcttgtc

SEQ ID NO: 120289 - DNA, 25 bp, Mus musculus
gggctcagaaccaccctgctgttgg

SEQ ID NO: 120290 - DNA, 25 bp, Mus musculus
gggctcagatagaattttatcagaa

SEQ ID NO: 120291 - DNA, 25 bp, Mus musculus
gggctcagcaattccaccgtaaaag

SEQ ID NO: 120292 - DNA, 25 bp, Mus musculus
gggctcagcaccatagaccatgttt

SEQ ID NO: 120293 - DNA, 25 bp, Mus musculus
gggctccagtcaggccgagccgctc

SEQ ID NO: 120294 - DNA, 25 bp, Mus musculus
gggctccatctacaccaaaggctgt

SEQ ID NO: 120295 - DNA, 25 bp, Mus musculus
gggctcccaagaggtgaacttgcca

SEQ ID NO: 120296 - DNA, 25 bp, Mus musculus
gggctcccagcgctataaaaacttt

SEQ ID NO: 120297 - DNA, 25 bp, Mus musculus
gggctccgggcatggacgtttcggg

SEQ ID NO: 120298 - DNA, 25 bp, Mus musculus
gggctcctagcaacgggcctgggcg

SEQ ID NO: 120299 - DNA, 25 bp, Mus musculus
gggctcgtccggaccacgtgcagca

SEQ ID NO: 120300 - DNA, 25 bp, Mus musculus
gggctcgtgttattttccttgtaag

SEQ ID NO: 120301 - DNA, 25 bp, Mus musculus
gggctctactacatgcagaaaaacg

SEQ ID NO: 120302 - DNA, 25 bp, Mus musculus
gggctctctgcagaaggactgggaa

SEQ ID NO: 120303 - DNA, 25 bp, Mus musculus
gggctctgagcctatcgtcttggaa

SEQ ID NO: 120304 - DNA, 25 bp, Mus musculus
gggctctttctaaactgagaagaga

SEQ ID NO: 120305 - DNA, 25 bp, Mus musculus
gggctgaactgtggcccatagccat

SEQ ID NO: 120306 - DNA, 25 bp, Mus musculus
gggctgaatccgagaaacctaaccg

SEQ ID NO: 120307 - DNA, 25 bp, Mus musculus
gggctgacaaccatcgaagcatcga

SEQ ID NO: 120308 - DNA, 25 bp, Mus musculus
gggctgacttctgctatgctatcga

SEQ ID NO: 120309 - DNA, 25 bp, Mus musculus
gggctgagacgtgactaacacattt

SEQ ID NO: 120310 - DNA, 25 bp, Mus musculus
gggctgagctatccaccggctgtaa

SEQ ID NO: 120311 - DNA, 25 bp, Mus musculus
gggctgcaaacacctgggacactgt

SEQ ID NO: 120312 - DNA, 25 bp, Mus musculus
gggctgcacgcggtaaacctggata

SEQ ID NO: 120313 - DNA, 25 bp, Mus musculus
gggctgcatccactccagacaagct

SEQ ID NO: 120314 - DNA, 25 bp, Mus musculus
gggctgccattttccgcgttcacgc

SEQ ID NO: 120315 - DNA, 25 bp, Mus musculus
gggctgccggcatctgaactctttg

SEQ ID NO: 120316 - DNA, 25 bp, Mus musculus
gggctgcctctacctcaaggactgg

SEQ ID NO: 120317 - DNA, 25 bp, Mus musculus
gggctgcgagattttcattgggaaa

SEQ ID NO: 120318 - DNA, 25 bp, Mus musculus
gggctgcgcagcctgacaatctgaa

SEQ ID NO: 120319 - DNA, 25 bp, Mus musculus
gggctgcgctactgaagagctccga

SEQ ID NO: 120320 - DNA, 25 bp, Mus musculus
gggctgcgtgtcttccccatgctct

SEQ ID NO: 120321 - DNA, 25 bp, Mus musculus
gggctgctaggaacttggttcagaa

SEQ ID NO: 120322 - DNA, 25 bp, Mus musculus
gggctgctcacataataattcggat

SEQ ID NO: 120323 - DNA, 25 bp, Mus musculus
gggctgctggagaaacccgtcttct

SEQ ID NO: 120324 - DNA, 25 bp, Mus musculus
gggctgctgttgacttcctgtttaa

SEQ ID NO: 120325 - DNA, 25 bp, Mus musculus
gggctgcttttgagagctccgatct

SEQ ID NO: 120326 - DNA, 25 bp, Mus musculus
gggctggagccattatggcacgcat

SEQ ID NO: 120327 - DNA, 25 bp, Mus musculus
gggctggagtcatccaagaatctga

SEQ ID NO: 120328 - DNA, 25 bp, Mus musculus
gggctggatcgaatcatcagggtct

SEQ ID NO: 120329 - DNA, 25 bp, Mus musculus
gggctggcccttcacaagaatttaa

SEQ ID NO: 120330 - DNA, 25 bp, Mus musculus
gggctggctccgaacacattgacaa

SEQ ID NO: 120331 - DNA, 25 bp, Mus musculus
gggctgggcggctgtgtccttcggc

SEQ ID NO: 120332 - DNA, 25 bp, Mus musculus
gggctggtccttccataataaagct

SEQ ID NO: 120333 - DNA, 25 bp, Mus musculus
gggctgtattactcttacttcaaga

SEQ ID NO: 120334 - DNA, 25 bp, Mus musculus
gggctgtccgcaccgagaagatcat

SEQ ID NO: 120335 - DNA, 25 bp, Mus musculus
gggctgtcctcctgatcttgctact

SEQ ID NO: 120336 - DNA, 25 bp, Mus musculus
gggctgtcgtctccaaacccagaga

SEQ ID NO: 120337 - DNA, 25 bp, Mus musculus
gggctgtgaccaaactcggctttaa

SEQ ID NO: 120338 - DNA, 25 bp, Mus musculus
gggctgtgcctcaaagtgagactgt

SEQ ID NO: 120339 - DNA, 25 bp, Mus musculus
gggctgtgcctcagtcatcaaggct

SEQ ID NO: 120340 - DNA, 25 bp, Mus musculus
gggctgttagcattcaggcttagtt

SEQ ID NO: 120341 - DNA, 25 bp, Mus musculus
gggcttaagacccacgggctacact

SEQ ID NO: 120342 - DNA, 25 bp, Mus musculus
gggcttacagcattacctcatcatg

SEQ ID NO: 120343 - DNA, 25 bp, Mus musculus
gggcttactaatgaccactacagtg

SEQ ID NO: 120344 - DNA, 25 bp, Mus musculus
gggcttcaaactttcctctcattaa

SEQ ID NO: 120345 - DNA, 25 bp, Mus musculus
gggcttcaagcaataacaggcaggg

SEQ ID NO: 120346 - DNA, 25 bp, Mus musculus
gggcttcagcccatagactttgtcg

SEQ ID NO: 120347 - DNA, 25 bp, Mus musculus
gggcttcataatcaccttctgttca

SEQ ID NO: 120348 - DNA, 25 bp, Mus musculus
gggcttccgcgatgcctttgtccgg

SEQ ID NO: 120349 - DNA, 25 bp, Mus musculus
gggcttcggtgactatataaagaga

SEQ ID NO: 120350 - DNA, 25 bp, Mus musculus
gggcttctcgtgctccaagaactgc

SEQ ID NO: 120351 - DNA, 25 bp, Mus musculus
gggcttctcttggactacctgcgca

SEQ ID NO: 120352 - DNA, 25 bp, Mus musculus
gggcttgggtttcagtcacacttgc

SEQ ID NO: 120353 - DNA, 25 bp, Mus musculus
gggctttgagactcctgttgggaca

SEQ ID NO: 120354 - DNA, 25 bp, Mus musculus
gggctttgcatccatccgtactaca

SEQ ID NO: 120355 - DNA, 25 bp, Mus musculus
ggggacaaccacctgctcctctatg

SEQ ID NO: 120356 - DNA, 25 bp, Mus musculus
ggggcagagacccatcaccttcttc

SEQ ID NO: 120357 - DNA, 25 bp, Mus musculus
ggggccaaggcaccactctcacagt

SEQ ID NO: 120358 - DNA, 25 bp, Mus musculus
ggggccttgggagttgcctacttca

SEQ ID NO: 120359 - DNA, 25 bp, Mus musculus
ggggtgctgatacatggggttctgt

SEQ ID NO: 120360 - DNA, 25 bp, Mus musculus
ggggttccaccctcctctaggtgct

SEQ ID NO: 120361 - DNA, 25 bp, Mus musculus
gggtaaaccataaccaagctttgcg

SEQ ID NO: 120362 - DNA, 25 bp, Mus musculus
gggtaaacccaccaatgtcagcgtg

SEQ ID NO: 120363 - DNA, 25 bp, Mus musculus
gggtaacatatccagtagaatgcaa

SEQ ID NO: 120364 - DNA, 25 bp, Mus musculus
gggtaacctcctgcaggacatcgtc

SEQ ID NO: 120365 - DNA, 25 bp, Mus musculus
gggtaactatccatcatggcacaga

SEQ ID NO: 120366 - DNA, 25 bp, Mus musculus
gggtaactcgtcctcttcagatgca

SEQ ID NO: 120367 - DNA, 25 bp, Mus musculus
gggtaatacacttcgatccttagac

SEQ ID NO: 120368 - DNA, 25 bp, Mus musculus
gggtaatcactcactggctctcagc

SEQ ID NO: 120369 - DNA, 25 bp, Mus musculus
gggtaatgccatccttcgcgactta

SEQ ID NO: 120370 - DNA, 25 bp, Mus musculus
gggtaatgctgcagaccgtctctga

SEQ ID NO: 120371 - DNA, 25 bp, Mus musculus
gggtaattccacagaaatcccaggg

SEQ ID NO: 120372 - DNA, 25 bp, Mus musculus
gggtacacaccctcgcttatttgaa

SEQ ID NO: 120373 - DNA, 25 bp, Mus musculus
gggtaccaggtatccaatcagtgca

SEQ ID NO: 120374 - DNA, 25 bp, Mus musculus
gggtaccattcccacagaacgaggc

SEQ ID NO: 120375 - DNA, 25 bp, Mus musculus
gggtacccacgccatatttctatgg

SEQ ID NO: 120376 - DNA, 25 bp, Mus musculus
gggtacccgcttggactttgcagga

SEQ ID NO: 120377 - DNA, 25 bp, Mus musculus
gggtaccgtgctacctgcaactgct

SEQ ID NO: 120378 - DNA, 25 bp, Mus musculus
gggtacctcactgctctcagctggg

SEQ ID NO: 120379 - DNA, 25 bp, Mus musculus
gggtacctccaggactctgttggga

SEQ ID NO: 120380 - DNA, 25 bp, Mus musculus
gggtacctgtgtgtgcctgcacctg

SEQ ID NO: 120381 - DNA, 25 bp, Mus musculus
gggtacgaaacaacctctcactggg

SEQ ID NO: 120382 - DNA, 25 bp, Mus musculus
gggtacgctccagaacactgacgca

SEQ ID NO: 120383 - DNA, 25 bp, Mus musculus
gggtagagaccaacaaatgcagcag

SEQ ID NO: 120384 - DNA, 25 bp, Mus musculus
gggtagatctcctcacactagagtg

SEQ ID NO: 120385 - DNA, 25 bp, Mus musculus
gggtagcaagcagattcctgaacga

SEQ ID NO: 120386 - DNA, 25 bp, Mus musculus
gggtagcccgtaaatccaagttcat

SEQ ID NO: 120387 - DNA, 25 bp, Mus musculus
gggtagcttcctgccttgtgctcag

SEQ ID NO: 120388 - DNA, 25 bp, Mus musculus
gggtaggatttaccggcaccatgcc

SEQ ID NO: 120389 - DNA, 25 bp, Mus musculus
gggtagtccacaacagaagcccaag

SEQ ID NO: 120390 - DNA, 25 bp, Mus musculus
gggtagtctgaccatgaaatctcaa

SEQ ID NO: 120391 - DNA, 25 bp, Mus musculus
gggtatacagcatctcagcccttgt

SEQ ID NO: 120392 - DNA, 25 bp, Mus musculus
gggtatatccttccgcgagcttgca

SEQ ID NO: 120393 - DNA, 25 bp, Mus musculus
gggtatctaaatcacctggaggtca

SEQ ID NO: 120394 - DNA, 25 bp, Mus musculus
gggtatctacaccagagttttaaat

SEQ ID NO: 120395 - DNA, 25 bp, Mus musculus
gggtatctctcccatcatgacgggc

SEQ ID NO: 120396 - DNA, 25 bp, Mus musculus
gggtatgcccaacctggacctggtt

SEQ ID NO: 120397 - DNA, 25 bp, Mus musculus
gggtatgcctcagttcctcagtgcg

SEQ ID NO: 120398 - DNA, 25 bp, Mus musculus
gggtcaaagccatcagccaaagaag

SEQ ID NO: 120399 - DNA, 25 bp, Mus musculus
gggtcaacaactgtgtcggcgagaa

SEQ ID NO: 120400 - DNA, 25 bp, Mus musculus
gggtcaagacggtactggtctcccg

SEQ ID NO: 120401 - DNA, 25 bp, Mus musculus
gggtcaatggcaagtcaatcaaagg

SEQ ID NO: 120402 - DNA, 25 bp, Mus musculus
gggtcacaggcaccaacaaaggcat

SEQ ID NO: 120403 - DNA, 25 bp, Mus musculus
gggtcacatagctctgccaatcggg

SEQ ID NO: 120404 - DNA, 25 bp, Mus musculus
gggtcaccgcattagaaaggctaca

SEQ ID NO: 120405 - DNA, 25 bp, Mus musculus
gggtcacggcagcagtcataacaga

SEQ ID NO: 120406 - DNA, 25 bp, Mus musculus
gggtcactcgattctttggacagac

SEQ ID NO: 120407 - DNA, 25 bp, Mus musculus
gggtcactggcgagtctctacaagg

SEQ ID NO: 120408 - DNA, 25 bp, Mus musculus
gggtcagaaacctcatcaaggcgct

SEQ ID NO: 120409 - DNA, 25 bp, Mus musculus
gggtcagcaagtcatcacgatagtt

SEQ ID NO: 120410 - DNA, 25 bp, Mus musculus
gggtcagctgaggtccggaaccaat

SEQ ID NO: 120411 - DNA, 25 bp, Mus musculus
gggtcatacccactgaggaacatgt

SEQ ID NO: 120412 - DNA, 25 bp, Mus musculus
gggtcatcacctttgcaaaccagga

SEQ ID NO: 120413 - DNA, 25 bp, Mus musculus
gggtcatcatggagcgaatcggtct

SEQ ID NO: 120414 - DNA, 25 bp, Mus musculus
gggtcatccggatttcccaccagag

SEQ ID NO: 120415 - DNA, 25 bp, Mus musculus
gggtcatctccatgccatctgttga

SEQ ID NO: 120416 - DNA, 25 bp, Mus musculus
gggtcatgaaacttagtccacaaca

SEQ ID NO: 120417 - DNA, 25 bp, Mus musculus
gggtcatggcggctatcgagaaagt

SEQ ID NO: 120418 - DNA, 25 bp, Mus musculus
gggtcattccccatctaggcgaaga

SEQ ID NO: 120419 - DNA, 25 bp, Mus musculus
gggtccacttggaaagccagacgat

SEQ ID NO: 120420 - DNA, 25 bp, Mus musculus
gggtccagaatccagctctcactag

SEQ ID NO: 120421 - DNA, 25 bp, Mus musculus
gggtccagtggaacagcgaacattt

SEQ ID NO: 120422 - DNA, 25 bp, Mus musculus
gggtcccagcgaaagaaaagctatg

SEQ ID NO: 120423 - DNA, 25 bp, Mus musculus
gggtcccagctactctctgcgggat

SEQ ID NO: 120424 - DNA, 25 bp, Mus musculus
gggtccccacaaacagtagcgtaat

SEQ ID NO: 120425 - DNA, 25 bp, Mus musculus
gggtcccgagtgagccatacatagt

SEQ ID NO: 120426 - DNA, 25 bp, Mus musculus
gggtccctaccacaagaagtcggct

SEQ ID NO: 120427 - DNA, 25 bp, Mus musculus
gggtccctcgtgaaactccagtgtc

SEQ ID NO: 120428 - DNA, 25 bp, Mus musculus
gggtccctgcacatcaccagagttc

SEQ ID NO: 120429 - DNA, 25 bp, Mus musculus
gggtccctgcacctgtgtgaaataa

SEQ ID NO: 120430 - DNA, 25 bp, Mus musculus
gggtcccttgcaccacaaagctaaa

SEQ ID NO: 120431 - DNA, 25 bp, Mus musculus
gggtccggtacaaagccaagctgat

SEQ ID NO: 120432 - DNA, 25 bp, Mus musculus
gggtccgtgcaagagttcatacaag

SEQ ID NO: 120433 - DNA, 25 bp, Mus musculus
gggtcctcgtgcacccacagtgtag

SEQ ID NO: 120434 - DNA, 25 bp, Mus musculus
gggtcctgcagattccaaagaagta

SEQ ID NO: 120435 - DNA, 25 bp, Mus musculus
gggtcctgcctgtaagtcctggtgc

SEQ ID NO: 120436 - DNA, 25 bp, Mus musculus
gggtcctgcgtggtccttgataaca

SEQ ID NO: 120437 - DNA, 25 bp, Mus musculus
gggtcgaatgctgaaccttttgcaa

SEQ ID NO: 120438 - DNA, 25 bp, Mus musculus
gggtcgactcctgctgtcactagag

SEQ ID NO: 120439 - DNA, 25 bp, Mus musculus
gggtcgaggaccctgtgtcctgaga

SEQ ID NO: 120440 - DNA, 25 bp, Mus musculus
gggtcgagggaggagggcggcgacg

SEQ ID NO: 120441 - DNA, 25 bp, Mus musculus
gggtcgatgggcttcctgctcccag

SEQ ID NO: 120442 - DNA, 25 bp, Mus musculus
gggtcgcattgtcaatgacgacttc

SEQ ID NO: 120443 - DNA, 25 bp, Mus musculus
gggtcgcctgcctcgtttgtctagc

SEQ ID NO: 120444 - DNA, 25 bp, Mus musculus
gggtcgctgagaaaacggaaggtcg

SEQ ID NO: 120445 - DNA, 25 bp, Mus musculus
gggtcggagagacaactctcagttt

SEQ ID NO: 120446 - DNA, 25 bp, Mus musculus
gggtcgggcctgcaacaagttatca

SEQ ID NO: 120447 - DNA, 25 bp, Mus musculus
gggtcgtacgaccttgcctgtgtct

SEQ ID NO: 120448 - DNA, 25 bp, Mus musculus
gggtcgtccaccaaatccgagagtg

SEQ ID NO: 120449 - DNA, 25 bp, Mus musculus
gggtcgttctccgaaaactgcgtga

SEQ ID NO: 120450 - DNA, 25 bp, Mus musculus
gggtctaaagattctacatacagtg

SEQ ID NO: 120451 - DNA, 25 bp, Mus musculus
gggtctacaccaatcctagcggcat

SEQ ID NO: 120452 - DNA, 25 bp, Mus musculus
gggtctcagataagcaggtaaaata

SEQ ID NO: 120453 - DNA, 25 bp, Mus musculus
gggtctccagaaaacgtcatccagc

SEQ ID NO: 120454 - DNA, 25 bp, Mus musculus
gggtctccttggtgtcctcatctgt

SEQ ID NO: 120455 - DNA, 25 bp, Mus musculus
gggtctcgggcctccacgttattgc

SEQ ID NO: 120456 - DNA, 25 bp, Mus musculus
gggtctctgaagattggcgccgtca

SEQ ID NO: 120457 - DNA, 25 bp, Mus musculus
gggtctctgtatggctggttctcaa

SEQ ID NO: 120458 - DNA, 25 bp, Mus musculus
gggtctcttgcagctccattaggtt

SEQ ID NO: 120459 - DNA, 25 bp, Mus musculus
gggtctgagccagcatctgtgacag

SEQ ID NO: 120460 - DNA, 25 bp, Mus musculus
gggtctgagctactgccaaaggcca

SEQ ID NO: 120461 - DNA, 25 bp, Mus musculus
gggtctgcaacaacacaaggaagca

SEQ ID NO: 120462 - DNA, 25 bp, Mus musculus
gggtctgggactgcacactgtcagt

SEQ ID NO: 120463 - DNA, 25 bp, Mus musculus
gggtctggttccttggtttcatcta

SEQ ID NO: 120464 - DNA, 25 bp, Mus musculus
gggtcttctccaaatgtctagcccc

SEQ ID NO: 120465 - DNA, 25 bp, Mus musculus
gggtcttctttatgaagtcgaagaa

SEQ ID NO: 120466 - DNA, 25 bp, Mus musculus
gggtctttttacgacttggccatgc

SEQ ID NO: 120467 - DNA, 25 bp, Mus musculus
gggtgaagccttccattggccaaag

SEQ ID NO: 120468 - DNA, 25 bp, Mus musculus
gggtgaaggccgtgccaacccctat

SEQ ID NO: 120469 - DNA, 25 bp, Mus musculus
gggtgaatactttactctgcctgca

SEQ ID NO: 120470 - DNA, 25 bp, Mus musculus
gggtgacaacctactgacaaactgc

SEQ ID NO: 120471 - DNA, 25 bp, Mus musculus
gggtgacaagaaaaccatcactgtg

SEQ ID NO: 120472 - DNA, 25 bp, Mus musculus
gggtgacagatgactacagcagctg

SEQ ID NO: 120473 - DNA, 25 bp, Mus musculus
gggtgaccctgctgcaaagacagat

SEQ ID NO: 120474 - DNA, 25 bp, Mus musculus
gggtgaccctgtagcaattctgaaa

SEQ ID NO: 120475 - DNA, 25 bp, Mus musculus
gggtgacgccaagcaaaagtacaag

SEQ ID NO: 120476 - DNA, 25 bp, Mus musculus
gggtgactccctgctactgctgaat

SEQ ID NO: 120477 - DNA, 25 bp, Mus musculus
gggtgacttcaagccctacaagcct

SEQ ID NO: 120478 - DNA, 25 bp, Mus musculus
gggtgagcaggacccagtaccaacc

SEQ ID NO: 120479 - DNA, 25 bp, Mus musculus
gggtgagcggccctggcggctcgag

SEQ ID NO: 120480 - DNA, 25 bp, Mus musculus
gggtgatagctcacatcagaagcca

SEQ ID NO: 120481 - DNA, 25 bp, Mus musculus
gggtgatatacgtgcctttaacaga

SEQ ID NO: 120482 - DNA, 25 bp, Mus musculus
gggtgatcatggacaagaagctttg

SEQ ID NO: 120483 - DNA, 25 bp, Mus musculus
gggtgatcccaactgtgtcactatc

SEQ ID NO: 120484 - DNA, 25 bp, Mus musculus
gggtgatgtcaatgccaaggctagc

SEQ ID NO: 120485 - DNA, 25 bp, Mus musculus
gggtgcacaagaaccctctgggttt

SEQ ID NO: 120486 - DNA, 25 bp, Mus musculus
gggtgccagcaactccaagctatat

SEQ ID NO: 120487 - DNA, 25 bp, Mus musculus
gggtgccagccaaagtgacaagaca

SEQ ID NO: 120488 - DNA, 25 bp, Mus musculus
gggtgccatccagtataagatagag

SEQ ID NO: 120489 - DNA, 25 bp, Mus musculus
gggtgccatgcgcttctgctcagaa

SEQ ID NO: 120490 - DNA, 25 bp, Mus musculus
gggtgcccaggacatacaaatcttc

SEQ ID NO: 120491 - DNA, 25 bp, Mus musculus
gggtgccccgggaatctgaacccat

SEQ ID NO: 120492 - DNA, 25 bp, Mus musculus
gggtgccgccggagcaaagccagcc

SEQ ID NO: 120493 - DNA, 25 bp, Mus musculus
gggtgctacactgcgacctgtgctc

SEQ ID NO: 120494 - DNA, 25 bp, Mus musculus
gggtgctccaaggtcaataaagcag

SEQ ID NO: 120495 - DNA, 25 bp, Mus musculus
gggtgctgcctgagacaaagatcct

SEQ ID NO: 120496 - DNA, 25 bp, Mus musculus
gggtgctttgttccctcgccgtaag

SEQ ID NO: 120497 - DNA, 25 bp, Mus musculus
gggtggacatcctgcaatggcttca

SEQ ID NO: 120498 - DNA, 25 bp, Mus musculus
gggtggatcctgtcaccagccaaaa

SEQ ID NO: 120499 - DNA, 25 bp, Mus musculus
gggtggcatcctatacctgcagaca

SEQ ID NO: 120500 - DNA, 25 bp, Mus musculus
gggtggccatgcagaccaagcgaat

SEQ ID NO: 120501 - DNA, 25 bp, Mus musculus
gggtggccgcacttcagaacaactt

SEQ ID NO: 120502 - DNA, 25 bp, Mus musculus
gggtggcggcgcactgctcttttta

SEQ ID NO: 120503 - DNA, 25 bp, Mus musculus
gggtggctcacatagcaacaagaag

SEQ ID NO: 120504 - DNA, 25 bp, Mus musculus
gggtgggaccacagatacaactata

SEQ ID NO: 120505 - DNA, 25 bp, Mus musculus
gggtgggcaccaacaaccatagcca

SEQ ID NO: 120506 - DNA, 25 bp, Mus musculus
gggtgggtcttaaccctctgacaat

SEQ ID NO: 120507 - DNA, 25 bp, Mus musculus
gggtggtggttcctcccaatatgaa

SEQ ID NO: 120508 - DNA, 25 bp, Mus musculus
gggtgtattacctctctctggaatt

SEQ ID NO: 120509 - DNA, 25 bp, Mus musculus
gggtgtccatggttccagcctcctc

SEQ ID NO: 120510 - DNA, 25 bp, Mus musculus
gggtgtccgccgtcaatcagcccgg

SEQ ID NO: 120511 - DNA, 25 bp, Mus musculus
gggtgtcgccatccccaagtctggt

SEQ ID NO: 120512 - DNA, 25 bp, Mus musculus
gggtgtcgctccctttcgctgatgc

SEQ ID NO: 120513 - DNA, 25 bp, Mus musculus
gggtgtggagaaaccttccagccac

SEQ ID NO: 120514 - DNA, 25 bp, Mus musculus
gggtgtggccagcaacttcacgttc

SEQ ID NO: 120515 - DNA, 25 bp, Mus musculus
gggttaaagccactatcctctgcaa

SEQ ID NO: 120516 - DNA, 25 bp, Mus musculus
gggttaacaccctcgacattgagcc

SEQ ID NO: 120517 - DNA, 25 bp, Mus musculus
gggttaatccagcagttcaccgcca

SEQ ID NO: 120518 - DNA, 25 bp, Mus musculus
gggttaatgccagcgtctctaagac

SEQ ID NO: 120519 - DNA, 25 bp, Mus musculus
gggttacaaagatccattcctcagt

SEQ ID NO: 120520 - DNA, 25 bp, Mus musculus
gggttacctgcagcctaagcctgaa

SEQ ID NO: 120521 - DNA, 25 bp, Mus musculus
gggttacggagagaacaagcctgtc

SEQ ID NO: 120522 - DNA, 25 bp, Mus musculus
gggttactagaaactcccagcaaca

SEQ ID NO: 120523 - DNA, 25 bp, Mus musculus
gggttactatgggtgctgtgcccta

SEQ ID NO: 120524 - DNA, 25 bp, Mus musculus
gggttactatgtgacgctggccgcc

SEQ ID NO: 120525 - DNA, 25 bp, Mus musculus
gggttactgggcattctggaccgta

SEQ ID NO: 120526 - DNA, 25 bp, Mus musculus
gggttacttcaaccaagttcctgat

SEQ ID NO: 120527 - DNA, 25 bp, Mus musculus
gggttagccaagttccagcttttgg

SEQ ID NO: 120528 - DNA, 25 bp, Mus musculus
gggttagctttgaaccacaggcagc

SEQ ID NO: 120529 - DNA, 25 bp, Mus musculus
gggttattagcactggcacactgat

SEQ ID NO: 120530 - DNA, 25 bp, Mus musculus
gggttattcgacaccgccatgacta

SEQ ID NO: 120531 - DNA, 25 bp, Mus musculus
gggttattgactctctttgctacca

SEQ ID NO: 120532 - DNA, 25 bp, Mus musculus
gggttcacgaactttcctggcacaa

SEQ ID NO: 120533 - DNA, 25 bp, Mus musculus
gggttcagcccgatatgacttctcc

SEQ ID NO: 120534 - DNA, 25 bp, Mus musculus
gggttcaggcaccttgaagagactt

SEQ ID NO: 120535 - DNA, 25 bp, Mus musculus
gggttcagtccagccagagaagaaa

SEQ ID NO: 120536 - DNA, 25 bp, Mus musculus
gggttcattttatcaacagtattcc

SEQ ID NO: 120537 - DNA, 25 bp, Mus musculus
gggttccaggccagttctcttccat

SEQ ID NO: 120538 - DNA, 25 bp, Mus musculus
gggttccccatcaccagttccgttg

SEQ ID NO: 120539 - DNA, 25 bp, Mus musculus
gggttccctgaaggctctgctgtca

SEQ ID NO: 120540 - DNA, 25 bp, Mus musculus
gggttccgcaatggcggactgtaac

SEQ ID NO: 120541 - DNA, 25 bp, Mus musculus
gggttccgggccttctgaaatcagg

SEQ ID NO: 120542 - DNA, 25 bp, Mus musculus
gggttcctattcctacacacaggtg

SEQ ID NO: 120543 - DNA, 25 bp, Mus musculus
gggttcgaactcaggcctttatgtg

SEQ ID NO: 120544 - DNA, 25 bp, Mus musculus
gggttcgctatgtcggatgacgatt

SEQ ID NO: 120545 - DNA, 25 bp, Mus musculus
gggttctaaacacctgctgcagggc

SEQ ID NO: 120546 - DNA, 25 bp, Mus musculus
gggttctagcacacacctggacaac

SEQ ID NO: 120547 - DNA, 25 bp, Mus musculus
gggttctattacagccagcgaggcc

SEQ ID NO: 120548 - DNA, 25 bp, Mus musculus
gggttctcattcctacagagctaag

SEQ ID NO: 120549 - DNA, 25 bp, Mus musculus
gggttctctttatgcctggtgtgga

SEQ ID NO: 120550 - DNA, 25 bp, Mus musculus
gggttgacatatatacaggcctcct

SEQ ID NO: 120551 - DNA, 25 bp, Mus musculus
gggttgaccagatcgccaatggctt

SEQ ID NO: 120552 - DNA, 25 bp, Mus musculus
gggttgacccaatatactgcagaga

SEQ ID NO: 120553 - DNA, 25 bp, Mus musculus
gggttgaccccttagatggcaccaa

SEQ ID NO: 120554 - DNA, 25 bp, Mus musculus
gggttggaaagtcctgccttctcct

SEQ ID NO: 120555 - DNA, 25 bp, Mus musculus
gggttggacctaactcctctgaaga

SEQ ID NO: 120556 - DNA, 25 bp, Mus musculus
gggttggcaaaacaaccttgatcca

SEQ ID NO: 120557 - DNA, 25 bp, Mus musculus
gggttgtaactcacatggctgcagc

SEQ ID NO: 120558 - DNA, 25 bp, Mus musculus
gggttgtcccttccgggatgcgcgc

SEQ ID NO: 120559 - DNA, 25 bp, Mus musculus
gggttgtgccacgtggagcaccatt

SEQ ID NO: 120560 - DNA, 25 bp, Mus musculus
gggtttaaatctctctcgggcttgc

SEQ ID NO: 120561 - DNA, 25 bp, Mus musculus
gggtttacagcacgtcccctgcctt

SEQ ID NO: 120562 - DNA, 25 bp, Mus musculus
gggtttatcatctaaggcaggtgcc

SEQ ID NO: 120563 - DNA, 25 bp, Mus musculus
gggtttcaaacctgcgccaaagaag

SEQ ID NO: 120564 - DNA, 25 bp, Mus musculus
gggtttccacaagatcagattcgat

SEQ ID NO: 120565 - DNA, 25 bp, Mus musculus
gggtttccatgctatgccctcggag

SEQ ID NO: 120566 - DNA, 25 bp, Mus musculus
gggtttcccagctcacattcaagtg

SEQ ID NO: 120567 - DNA, 25 bp, Mus musculus
gggtttcccaggataccaggcccat

SEQ ID NO: 120568 - DNA, 25 bp, Mus musculus
gggtttcctgaccttcatctgggtg

SEQ ID NO: 120569 - DNA, 25 bp, Mus musculus
gggtttctctcattaaccatagtac

SEQ ID NO: 120570 - DNA, 25 bp, Mus musculus
gggtttctgaagtgccacacgtgaa

SEQ ID NO: 120571 - DNA, 25 bp, Mus musculus
gggtttgaaccataaagccctgtca

SEQ ID NO: 120572 - DNA, 25 bp, Mus musculus
gggtttgacagaggagacagccaca

SEQ ID NO: 120573 - DNA, 25 bp, Mus musculus
gggtttgcaccacgagatgtcactc

SEQ ID NO: 120574 - DNA, 25 bp, Mus musculus
gggtttgcgagttcccagcccatag

SEQ ID NO: 120575 - DNA, 25 bp, Mus musculus
gggtttggcagctcagatcctgtaa

SEQ ID NO: 120576 - DNA, 25 bp, Mus musculus
gggttttacagaacgtggccaagct

SEQ ID NO: 120577 - DNA, 25 bp, Mus musculus
ggtaaaaagctacggagcactgttc

SEQ ID NO: 120578 - DNA, 25 bp, Mus musculus
ggtaaaactctcttggctcgacaga

SEQ ID NO: 120579 - DNA, 25 bp, Mus musculus
ggtaaaagtaccatcgtgaaacaga

SEQ ID NO: 120580 - DNA, 25 bp, Mus musculus
ggtaaaatggatagagccctgcaga

SEQ ID NO: 120581 - DNA, 25 bp, Mus musculus
ggtaaacatctgagtggcccaaggc

SEQ ID NO: 120582 - DNA, 25 bp, Mus musculus
ggtaaaccagtgtccatagcttggg

SEQ ID NO: 120583 - DNA, 25 bp, Mus musculus
ggtaaaccgtagcattcttcagcag

SEQ ID NO: 120584 - DNA, 25 bp, Mus musculus
ggtaaacctaggctcaactcccact

SEQ ID NO: 120585 - DNA, 25 bp, Mus musculus
ggtaaagccatccagtcagccattg

SEQ ID NO: 120586 - DNA, 25 bp, Mus musculus
ggtaaagcccacgatacacattgat

SEQ ID NO: 120587 - DNA, 25 bp, Mus musculus
ggtaaaggcattccacagactcagc

SEQ ID NO: 120588 - DNA, 25 bp, Mus musculus
ggtaaagtcacgtgccatcaagccc

SEQ ID NO: 120589 - DNA, 25 bp, Mus musculus
ggtaaatcaccacggtgctgctagt

SEQ ID NO: 120590 - DNA, 25 bp, Mus musculus
ggtaaatccctcgatctggctgtgg

SEQ ID NO: 120591 - DNA, 25 bp, Mus musculus
ggtaaatcctagctgccctgtcaac

SEQ ID NO: 120592 - DNA, 25 bp, Mus musculus
ggtaaatcctgcaagccaatcccag

SEQ ID NO: 120593 - DNA, 25 bp, Mus musculus
ggtaaatggcaaaaatacggtcgcg

SEQ ID NO: 120594 - DNA, 25 bp, Mus musculus
ggtaaattctatatcaggctcggtg

SEQ ID NO: 120595 - DNA, 25 bp, Mus musculus
ggtaacaagaaaccctgagcagagg

SEQ ID NO: 120596 - DNA, 25 bp, Mus musculus
ggtaacagtgctctccgtgctcatg

SEQ ID NO: 120597 - DNA, 25 bp, Mus musculus
ggtaaccaaaccgactatagaatat

SEQ ID NO: 120598 - DNA, 25 bp, Mus musculus
ggtaaccaagctgactccatcctaa

SEQ ID NO: 120599 - DNA, 25 bp, Mus musculus
ggtaaccacggcctcgagctgctgt

SEQ ID NO: 120600 - DNA, 25 bp, Mus musculus
ggtaaccatggccaaagcttagtcc

SEQ ID NO: 120601 - DNA, 25 bp, Mus musculus
ggtaacccacccttgcaaagcagaa

SEQ ID NO: 120602 - DNA, 25 bp, Mus musculus
ggtaacccgttccagtgcgactgca

SEQ ID NO: 120603 - DNA, 25 bp, Mus musculus
ggtaacctcaggtccttcgctcgga

SEQ ID NO: 120604 - DNA, 25 bp, Mus musculus
ggtaaccttcgacctgtacaagctg

SEQ ID NO: 120605 - DNA, 25 bp, Mus musculus
ggtaacgttaccacatggctcagca

SEQ ID NO: 120606 - DNA, 25 bp, Mus musculus
ggtaacgttgcacacgagggacctc

SEQ ID NO: 120607 - DNA, 25 bp, Mus musculus
ggtaactctggccaacatcttggag

SEQ ID NO: 120608 - DNA, 25 bp, Mus musculus
ggtaactgccatgatagcccgagag

SEQ ID NO: 120609 - DNA, 25 bp, Mus musculus
ggtaagaataaagtcgccgcccaga

SEQ ID NO: 120610 - DNA, 25 bp, Mus musculus
ggtaagacgagcatcatcaagcgct

SEQ ID NO: 120611 - DNA, 25 bp, Mus musculus
ggtaagatggattcactacagatga

SEQ ID NO: 120612 - DNA, 25 bp, Mus musculus
ggtaagcagtgcatcctgagagagc

SEQ ID NO: 120613 - DNA, 25 bp, Mus musculus
ggtaagccagcccatttcaactatg

SEQ ID NO: 120614 - DNA, 25 bp, Mus musculus
ggtaaggcctttcgtattcgctcaa

SEQ ID NO: 120615 - DNA, 25 bp, Mus musculus
ggtaaggcttttaatagtcattcaa

SEQ ID NO: 120616 - DNA, 25 bp, Mus musculus
ggtaataaccaacttgtaatcaaag

SEQ ID NO: 120617 - DNA, 25 bp, Mus musculus
ggtaatacggcacttccctgtcagg

SEQ ID NO: 120618 - DNA, 25 bp, Mus musculus
ggtaatgccaatcctcacaagtggg

SEQ ID NO: 120619 - DNA, 25 bp, Mus musculus
ggtaatggcgactccggatcagaag

SEQ ID NO: 120620 - DNA, 25 bp, Mus musculus
ggtaattccagctactgtcccgaag

SEQ ID NO: 120621 - DNA, 25 bp, Mus musculus
ggtaattcccagtgaagacagcctc

SEQ ID NO: 120622 - DNA, 25 bp, Mus musculus
ggtaatttcaccctcagccatggct

SEQ ID NO: 120623 - DNA, 25 bp, Mus musculus
ggtaattttgagactcctgaagctg

SEQ ID NO: 120624 - DNA, 25 bp, Mus musculus
ggtacaaacataacttctggcagga

SEQ ID NO: 120625 - DNA, 25 bp, Mus musculus
ggtacaaaccaaggagccatctgcc

SEQ ID NO: 120626 - DNA, 25 bp, Mus musculus
ggtacaaaggtctcactccgcagtc

SEQ ID NO: 120627 - DNA, 25 bp, Mus musculus
ggtacaacctgaaggaccagcatca

SEQ ID NO: 120628 - DNA, 25 bp, Mus musculus
ggtacaacctgggacgctatgctgg

SEQ ID NO: 120629 - DNA, 25 bp, Mus musculus
ggtacaagctcatcttctgcacgag

SEQ ID NO: 120630 - DNA, 25 bp, Mus musculus
ggtacaagttcccatgctacgtgca

SEQ ID NO: 120631 - DNA, 25 bp, Mus musculus
ggtacaatgccaagatctccttcgg

SEQ ID NO: 120632 - DNA, 25 bp, Mus musculus
ggtacacaacttcgctgacgggctc

SEQ ID NO: 120633 - DNA, 25 bp, Mus musculus
ggtacacagggctaatgggaacact

SEQ ID NO: 120634 - DNA, 25 bp, Mus musculus
ggtacacggtgtcctactgtcgagt

SEQ ID NO: 120635 - DNA, 25 bp, Mus musculus
ggtacacgtgcatagagaaccagaa

SEQ ID NO: 120636 - DNA, 25 bp, Mus musculus
ggtacactgatcttgggactggcca

SEQ ID NO: 120637 - DNA, 25 bp, Mus musculus
ggtacactgtgagcgcgtctgcaaa

SEQ ID NO: 120638 - DNA, 25 bp, Mus musculus
ggtacagagcaatgggaacagccct

SEQ ID NO: 120639 - DNA, 25 bp, Mus musculus
ggtacagatcagcaaggccaagagc

SEQ ID NO: 120640 - DNA, 25 bp, Mus musculus
ggtacagtcatctgggtggccccgt

SEQ ID NO: 120641 - DNA, 25 bp, Mus musculus
ggtacagtgccctcctgtctggaga

SEQ ID NO: 120642 - DNA, 25 bp, Mus musculus
ggtacagttgccaaatcccggttgc

SEQ ID NO: 120643 - DNA, 25 bp, Mus musculus
ggtacatgacaaaggacaacctggc

SEQ ID NO: 120644 - DNA, 25 bp, Mus musculus
ggtacatggcctttacccgcaaggg

SEQ ID NO: 120645 - DNA, 25 bp, Mus musculus
ggtacatgtcaacagcaacgtgcag

SEQ ID NO: 120646 - DNA, 25 bp, Mus musculus
ggtacattccacaaagccttcgagg

SEQ ID NO: 120647 - DNA, 25 bp, Mus musculus
ggtacattgctgcttacttagcact

SEQ ID NO: 120648 - DNA, 25 bp, Mus musculus
ggtacattgtttgtaggcggcaaaa

SEQ ID NO: 120649 - DNA, 25 bp, Mus musculus
ggtaccaagcgatgagacagcacag

SEQ ID NO: 120650 - DNA, 25 bp, Mus musculus
ggtaccaggacaccacatcgtttct

SEQ ID NO: 120651 - DNA, 25 bp, Mus musculus
ggtaccagggcaaatcagctcagcc

SEQ ID NO: 120652 - DNA, 25 bp, Mus musculus
ggtaccaggtcttccttaagcagca

SEQ ID NO: 120653 - DNA, 25 bp, Mus musculus
ggtaccatccatctgtcctctagaa

SEQ ID NO: 120654 - DNA, 25 bp, Mus musculus
ggtaccatcgggttgatccacgcag

SEQ ID NO: 120655 - DNA, 25 bp, Mus musculus
ggtaccatgtgttccgtggtggcaa

SEQ ID NO: 120656 - DNA, 25 bp, Mus musculus
ggtacccatctgaggccaaagtgct

SEQ ID NO: 120657 - DNA, 25 bp, Mus musculus
ggtaccccaggttcttccaggtcat

SEQ ID NO: 120658 - DNA, 25 bp, Mus musculus
ggtacccgatggcaccctgttgtgc

SEQ ID NO: 120659 - DNA, 25 bp, Mus musculus
ggtacccggcaattcaggatgagag

SEQ ID NO: 120660 - DNA, 25 bp, Mus musculus
ggtacccgtggctgagctgagcttc

SEQ ID NO: 120661 - DNA, 25 bp, Mus musculus
ggtaccctccgatcgtggcaactat

SEQ ID NO: 120662 - DNA, 25 bp, Mus musculus
ggtaccgcatagagcagaagggcct

SEQ ID NO: 120663 - DNA, 25 bp, Mus musculus
ggtaccgggcactacctttgcaatg

SEQ ID NO: 120664 - DNA, 25 bp, Mus musculus
ggtacctgtgcatattaagggccac

SEQ ID NO: 120665 - DNA, 25 bp, Mus musculus
ggtaccttctaccacctggccaaga

SEQ ID NO: 120666 - DNA, 25 bp, Mus musculus
ggtaccttggccaaagacaccacag

SEQ ID NO: 120667 - DNA, 25 bp, Mus musculus
ggtacctttccaggacatgcatagg

SEQ ID NO: 120668 - DNA, 25 bp, Mus musculus
ggtacgagcaggacttcgcagtgct

SEQ ID NO: 120669 - DNA, 25 bp, Mus musculus
ggtacgaggaagtaaaccatgccac

SEQ ID NO: 120670 - DNA, 25 bp, Mus musculus
ggtacgcagctggaatcggttccaa

SEQ ID NO: 120671 - DNA, 25 bp, Mus musculus
ggtacgccctcttatctggaacatg

SEQ ID NO: 120672 - DNA, 25 bp, Mus musculus
ggtactacatgtgaaggacctgtca

SEQ ID NO: 120673 - DNA, 25 bp, Mus musculus
ggtactaccactgtgaacagcattg

SEQ ID NO: 120674 - DNA, 25 bp, Mus musculus
ggtactaccccagttatgggacttg

SEQ ID NO: 120675 - DNA, 25 bp, Mus musculus
ggtactaccgtgctccagaactcat

SEQ ID NO: 120676 - DNA, 25 bp, Mus musculus
ggtactatggcaacgtgacacggca

SEQ ID NO: 120677 - DNA, 25 bp, Mus musculus
ggtactccgcaagtaaaaagcactg

SEQ ID NO: 120678 - DNA, 25 bp, Mus musculus
ggtactgacagattaatggctcgcc

SEQ ID NO: 120679 - DNA, 25 bp, Mus musculus
ggtactgatcaagttcagtgcgcag

SEQ ID NO: 120680 - DNA, 25 bp, Mus musculus
ggtactgtggcaaaaggatccttca

SEQ ID NO: 120681 - DNA, 25 bp, Mus musculus
ggtactgttaccacgtgggccgcga

SEQ ID NO: 120682 - DNA, 25 bp, Mus musculus
ggtactgtttctcattcactattaa

SEQ ID NO: 120683 - DNA, 25 bp, Mus musculus
ggtacttacccggagaaggccgctg

SEQ ID NO: 120684 - DNA, 25 bp, Mus musculus
ggtacttccttctgaagagtgatgg

SEQ ID NO: 120685 - DNA, 25 bp, Mus musculus
ggtacttcttcaactcctttcagga

SEQ ID NO: 120686 - DNA, 25 bp, Mus musculus
ggtagaacccctttgcattctggac

SEQ ID NO: 120687 - DNA, 25 bp, Mus musculus
ggtagaatcctcttcatcggctgca

SEQ ID NO: 120688 - DNA, 25 bp, Mus musculus
ggtagactagccaaacatctgcttg

SEQ ID NO: 120689 - DNA, 25 bp, Mus musculus
ggtagactctcgtttcttccgacaa

SEQ ID NO: 120690 - DNA, 25 bp, Mus musculus
ggtagactgcaagtccaatgctcca

SEQ ID NO: 120691 - DNA, 25 bp, Mus musculus
ggtagagaactttcaggcagatccc

SEQ ID NO: 120692 - DNA, 25 bp, Mus musculus
ggtagagaccaattccaggctggac

SEQ ID NO: 120693 - DNA, 25 bp, Mus musculus
ggtagagatgctgcaccgatccaac

SEQ ID NO: 120694 - DNA, 25 bp, Mus musculus
ggtagagattctgcccttcgccaac

SEQ ID NO: 120695 - DNA, 25 bp, Mus musculus
ggtagagccagactatagcacccgg

SEQ ID NO: 120696 - DNA, 25 bp, Mus musculus
ggtagagcgcaagaaggcagccatt

SEQ ID NO: 120697 - DNA, 25 bp, Mus musculus
ggtagagttctactatttccagaga

SEQ ID NO: 120698 - DNA, 25 bp, Mus musculus
ggtagatattccctcatccgcagct

SEQ ID NO: 120699 - DNA, 25 bp, Mus musculus
ggtagatccaacaaaacacattcga

SEQ ID NO: 120700 - DNA, 25 bp, Mus musculus
ggtagattctccagatcacaaacga

SEQ ID NO: 120701 - DNA, 25 bp, Mus musculus
ggtagatttgaggacccgagccttc

SEQ ID NO: 120702 - DNA, 25 bp, Mus musculus
ggtagcaaaactcctcacagtcctg

SEQ ID NO: 120703 - DNA, 25 bp, Mus musculus
ggtagcaagaccatccagtgtgaac

SEQ ID NO: 120704 - DNA, 25 bp, Mus musculus
ggtagcacattgtcccaacggagaa

SEQ ID NO: 120705 - DNA, 25 bp, Mus musculus
ggtagcagccatctgcctgaccagc

SEQ ID NO: 120706 - DNA, 25 bp, Mus musculus
ggtagcagccttcaaggtcaccact

SEQ ID NO: 120707 - DNA, 25 bp, Mus musculus
ggtagcaggctctttgttcagtttt

SEQ ID NO: 120708 - DNA, 25 bp, Mus musculus
ggtagcagtccaaaatggactcatg

SEQ ID NO: 120709 - DNA, 25 bp, Mus musculus
ggtagccagtgtccccatgaaaaca

SEQ ID NO: 120710 - DNA, 25 bp, Mus musculus
ggtagccatcttaggacagcttaga

SEQ ID NO: 120711 - DNA, 25 bp, Mus musculus
ggtagccatggctcgaaaactccag

SEQ ID NO: 120712 - DNA, 25 bp, Mus musculus
ggtagcccttgttggcagcaccaga

SEQ ID NO: 120713 - DNA, 25 bp, Mus musculus
ggtagcctgtatttctcaagttaag

SEQ ID NO: 120714 - DNA, 25 bp, Mus musculus
ggtagcggctgactccaagatctgc

SEQ ID NO: 120715 - DNA, 25 bp, Mus musculus
ggtagctacagttggcaagcccact

SEQ ID NO: 120716 - DNA, 25 bp, Mus musculus
ggtagctgcacaaatgcccactgtg

SEQ ID NO: 120717 - DNA, 25 bp, Mus musculus
ggtagctgttctgcgcttcatccag

SEQ ID NO: 120718 - DNA, 25 bp, Mus musculus
ggtaggaacgctgcaacctgggtat

SEQ ID NO: 120719 - DNA, 25 bp, Mus musculus
ggtagggttcctcagtccaccaaag

SEQ ID NO: 120720 - DNA, 25 bp, Mus musculus
ggtaggtactccaccctctgatgtg

SEQ ID NO: 120721 - DNA, 25 bp, Mus musculus
ggtaggttagggagtaaactctgat

SEQ ID NO: 120722 - DNA, 25 bp, Mus musculus
ggtagtaccactaaccaaatcgcta

SEQ ID NO: 120723 - DNA, 25 bp, Mus musculus
ggtagtaccgaactgcactcaaggt

SEQ ID NO: 120724 - DNA, 25 bp, Mus musculus
ggtagtacgccatcgcctgctgctt

SEQ ID NO: 120725 - DNA, 25 bp, Mus musculus
ggtagtactctcaggcaaggtggac

SEQ ID NO: 120726 - DNA, 25 bp, Mus musculus
ggtagtccgtatcaccatggaagct

SEQ ID NO: 120727 - DNA, 25 bp, Mus musculus
ggtagtcctctacacaggtggcaga

SEQ ID NO: 120728 - DNA, 25 bp, Mus musculus
ggtagtgcgcagtcccaccttataa

SEQ ID NO: 120729 - DNA, 25 bp, Mus musculus
ggtataaagtcctccaaagcgtctc

SEQ ID NO: 120730 - DNA, 25 bp, Mus musculus
ggtataactcctttcgagcctggaa

SEQ ID NO: 120731 - DNA, 25 bp, Mus musculus
ggtatagtacgattgctgcccttca

SEQ ID NO: 120732 - DNA, 25 bp, Mus musculus
ggtatataggtacttgcaagagtca

SEQ ID NO: 120733 - DNA, 25 bp, Mus musculus
ggtatatcaccatcggagaactggg

SEQ ID NO: 120734 - DNA, 25 bp, Mus musculus
ggtatatctcccatgtgcctatgat

SEQ ID NO: 120735 - DNA, 25 bp, Mus musculus
ggtatatgaacccagccattgtggc

SEQ ID NO: 120736 - DNA, 25 bp, Mus musculus
ggtatatgacctagcctcacagctc

SEQ ID NO: 120737 - DNA, 25 bp, Mus musculus
ggtatcaaaagtccccacatcaaat

SEQ ID NO: 120738 - DNA, 25 bp, Mus musculus
ggtatcaacatccttccgaagaaga

SEQ ID NO: 120739 - DNA, 25 bp, Mus musculus
ggtatcaacatgtcaagtcaagact

SEQ ID NO: 120740 - DNA, 25 bp, Mus musculus
ggtatcaagtctccaagccagaggt

SEQ ID NO: 120741 - DNA, 25 bp, Mus musculus
ggtatcaatcttgccctggagccat

SEQ ID NO: 120742 - DNA, 25 bp, Mus musculus
ggtatcagtggattggccgcaagtt

SEQ ID NO: 120743 - DNA, 25 bp, Mus musculus
ggtatcatggccctgtatctcggaa

SEQ ID NO: 120744 - DNA, 25 bp, Mus musculus
ggtatccgatctcaagcagtttctg

SEQ ID NO: 120745 - DNA, 25 bp, Mus musculus
ggtatccggccaccatgctcagtct

SEQ ID NO: 120746 - DNA, 25 bp, Mus musculus
ggtatcctctactccatgctactag

SEQ ID NO: 120747 - DNA, 25 bp, Mus musculus
ggtatcgaagaaactctgcacggag

SEQ ID NO: 120748 - DNA, 25 bp, Mus musculus
ggtatcgcgctcctgaagcagagct

SEQ ID NO: 120749 - DNA, 25 bp, Mus musculus
ggtatcgctggctcaaccaatgtga

SEQ ID NO: 120750 - DNA, 25 bp, Mus musculus
ggtatctattctgatctgacactgg

SEQ ID NO: 120751 - DNA, 25 bp, Mus musculus
ggtatctcggacaggtgaccactat

SEQ ID NO: 120752 - DNA, 25 bp, Mus musculus
ggtatctcggccctaattgtgggtt

SEQ ID NO: 120753 - DNA, 25 bp, Mus musculus
ggtatctgagaatatccccgtcgtg

SEQ ID NO: 120754 - DNA, 25 bp, Mus musculus
ggtatgaatctgctcctcaagaaga

SEQ ID NO: 120755 - DNA, 25 bp, Mus musculus
ggtatgcagcccagaacttcaccct

SEQ ID NO: 120756 - DNA, 25 bp, Mus musculus
ggtatgccaaccacatcgagagatg

SEQ ID NO: 120757 - DNA, 25 bp, Mus musculus
ggtatgccgagcacaaaacgcctgt

SEQ ID NO: 120758 - DNA, 25 bp, Mus musculus
ggtatgccgtcagaagaccctttca

SEQ ID NO: 120759 - DNA, 25 bp, Mus musculus
ggtatgcggcacagggagaatctaa

SEQ ID NO: 120760 - DNA, 25 bp, Mus musculus
ggtatgcggctccaacaaactgaag

SEQ ID NO: 120761 - DNA, 25 bp, Mus musculus
ggtatggacccaattaatgaacgga

SEQ ID NO: 120762 - DNA, 25 bp, Mus musculus
ggtatggaccctatataaggcttag

SEQ ID NO: 120763 - DNA, 25 bp, Mus musculus
ggtatggcctcctgcatcctgtaga

SEQ ID NO: 120764 - DNA, 25 bp, Mus musculus
ggtatgggcataagcgcatctcact

SEQ ID NO: 120765 - DNA, 25 bp, Mus musculus
ggtatggtccttagcatcaggtcct

SEQ ID NO: 120766 - DNA, 25 bp, Mus musculus
ggtatggtgtgtatttgaagattca

SEQ ID NO: 120767 - DNA, 25 bp, Mus musculus
ggtatgtctgacagtggaccacagc

SEQ ID NO: 120768 - DNA, 25 bp, Mus musculus
ggtatgtctggtcatccaccggagc

SEQ ID NO: 120769 - DNA, 25 bp, Mus musculus
ggtatgtgcccctgtcattgaagaa

SEQ ID NO: 120770 - DNA, 25 bp, Mus musculus
ggtatgtgtgccagtttccagccca

SEQ ID NO: 120771 - DNA, 25 bp, Mus musculus
ggtattaagtcctcaacgcctggag

SEQ ID NO: 120772 - DNA, 25 bp, Mus musculus
ggtattactacaacggcgcttccat

SEQ ID NO: 120773 - DNA, 25 bp, Mus musculus
ggtattactgaccatattgcccaag

SEQ ID NO: 120774 - DNA, 25 bp, Mus musculus
ggtattatggcaaagtcaccaggca

SEQ ID NO: 120775 - DNA, 25 bp, Mus musculus
ggtattcacaattgttattcaggga

SEQ ID NO: 120776 - DNA, 25 bp, Mus musculus
ggtattcccgtgatcaactgtcgtg

SEQ ID NO: 120777 - DNA, 25 bp, Mus musculus
ggtattctctgctcgcacaactagt

SEQ ID NO: 120778 - DNA, 25 bp, Mus musculus
ggtattgagacccacttcgacgaac

SEQ ID NO: 120779 - DNA, 25 bp, Mus musculus
ggtattgatcttgacacacgagtgg

SEQ ID NO: 120780 - DNA, 25 bp, Mus musculus
ggtattgcccgtcttgccaacagtg

SEQ ID NO: 120781 - DNA, 25 bp, Mus musculus
ggtattgccgatgtaaagaagtctc

SEQ ID NO: 120782 - DNA, 25 bp, Mus musculus
ggtatttccccaattgtaacgtctg

SEQ ID NO: 120783 - DNA, 25 bp, Mus musculus
ggtatttgaacaggccaaggtgcac

SEQ ID NO: 120784 - DNA, 25 bp, Mus musculus
ggtatttgctactaagatggcccac

SEQ ID NO: 120785 - DNA, 25 bp, Mus musculus
ggtcaaacaactagtgcccagctgt

SEQ ID NO: 120786 - DNA, 25 bp, Mus musculus
ggtcaaaccagaggaaagactcaca

SEQ ID NO: 120787 - DNA, 25 bp, Mus musculus
ggtcaaagccctcgagatcttcgct

SEQ ID NO: 120788 - DNA, 25 bp, Mus musculus
ggtcaacaacacttcaacatattat

SEQ ID NO: 120789 - DNA, 25 bp, Mus musculus
ggtcaacaacatcgagagaaatgtg

SEQ ID NO: 120790 - DNA, 25 bp, Mus musculus
ggtcaacaatcggaaccacgggctg

SEQ ID NO: 120791 - DNA, 25 bp, Mus musculus
ggtcaacagaatacacagtgctgga

SEQ ID NO: 120792 - DNA, 25 bp, Mus musculus
ggtcaacatctggactcacttcctg

SEQ ID NO: 120793 - DNA, 25 bp, Mus musculus
ggtcaagctgtttcctctatcctgg

SEQ ID NO: 120794 - DNA, 25 bp, Mus musculus
ggtcaagttcaagtgaggactcttt

SEQ ID NO: 120795 - DNA, 25 bp, Mus musculus
ggtcaagttcgcaaacaacccaagt

SEQ ID NO: 120796 - DNA, 25 bp, Mus musculus
ggtcaagttctctgtgggaacccca

SEQ ID NO: 120797 - DNA, 25 bp, Mus musculus
ggtcaatcaagagacaatccagcgg

SEQ ID NO: 120798 - DNA, 25 bp, Mus musculus
ggtcaatgaaccagccaaacgtggg

SEQ ID NO: 120799 - DNA, 25 bp, Mus musculus
ggtcaattcattctgcctggcctgg

SEQ ID NO: 120800 - DNA, 25 bp, Mus musculus
ggtcacaaactctatggccctaaag

SEQ ID NO: 120801 - DNA, 25 bp, Mus musculus
ggtcacaacactcatcattcacagg

SEQ ID NO: 120802 - DNA, 25 bp, Mus musculus
ggtcacaatgcctctccaagcacag

SEQ ID NO: 120803 - DNA, 25 bp, Mus musculus
ggtcacaatggcaggtgaagaaatg

SEQ ID NO: 120804 - DNA, 25 bp, Mus musculus
ggtcacacacctcttatggaagctg

SEQ ID NO: 120805 - DNA, 25 bp, Mus musculus
ggtcacagactgaagagcggcatct

SEQ ID NO: 120806 - DNA, 25 bp, Mus musculus
ggtcacagtgaagctagtgccccga

SEQ ID NO: 120807 - DNA, 25 bp, Mus musculus
ggtcaccagggttcaaggcttgtac

SEQ ID NO: 120808 - DNA, 25 bp, Mus musculus
ggtcacccaagagtcccctttgaga

SEQ ID NO: 120809 - DNA, 25 bp, Mus musculus
ggtcacccattcatcgtgcagttca

SEQ ID NO: 120810 - DNA, 25 bp, Mus musculus
ggtcacccctgaaacatacacatac

SEQ ID NO: 120811 - DNA, 25 bp, Mus musculus
ggtcaccgcattcccatgaagacag

SEQ ID NO: 120812 - DNA, 25 bp, Mus musculus
ggtcacctccgaacccatataggct

SEQ ID NO: 120813 - DNA, 25 bp, Mus musculus
ggtcacctgtgcagatgatatcgaa

SEQ ID NO: 120814 - DNA, 25 bp, Mus musculus
ggtcacctttggaggcatccccact

SEQ ID NO: 120815 - DNA, 25 bp, Mus musculus
ggtcacgtggttccctcctatggag

SEQ ID NO: 120816 - DNA, 25 bp, Mus musculus
ggtcactaggatgcaaggacacctc

SEQ ID NO: 120817 - DNA, 25 bp, Mus musculus
ggtcactctggacaaccaagatgtt

SEQ ID NO: 120818 - DNA, 25 bp, Mus musculus
ggtcactggagaacaactagggccc

SEQ ID NO: 120819 - DNA, 25 bp, Mus musculus
ggtcacttcagggactgtcagcaag

SEQ ID NO: 120820 - DNA, 25 bp, Mus musculus
ggtcacttcattccagcagctgcat

SEQ ID NO: 120821 - DNA, 25 bp, Mus musculus
ggtcagaactggacggccacacatt

SEQ ID NO: 120822 - DNA, 25 bp, Mus musculus
ggtcagaatgtattgcagccgccaa

SEQ ID NO: 120823 - DNA, 25 bp, Mus musculus
ggtcagaccggcacatgattagttt

SEQ ID NO: 120824 - DNA, 25 bp, Mus musculus
ggtcagagccgctgaagacaagcac

SEQ ID NO: 120825 - DNA, 25 bp, Mus musculus
ggtcagagtatcattcccatgctta

SEQ ID NO: 120826 - DNA, 25 bp, Mus musculus
ggtcagatcaactccaaccaaagga

SEQ ID NO: 120827 - DNA, 25 bp, Mus musculus
ggtcagatgaacttacacagggcta

SEQ ID NO: 120828 - DNA, 25 bp, Mus musculus
ggtcagcaggtcaggcacatctagt

SEQ ID NO: 120829 - DNA, 25 bp, Mus musculus
ggtcagcatcctgaaaccagctgct

SEQ ID NO: 120830 - DNA, 25 bp, Mus musculus
ggtcagcattccagtacctgtctaa

SEQ ID NO: 120831 - DNA, 25 bp, Mus musculus
ggtcagccacgacagcacagtgtct

SEQ ID NO: 120832 - DNA, 25 bp, Mus musculus
ggtcagcgccaacttctcagagatt

SEQ ID NO: 120833 - DNA, 25 bp, Mus musculus
ggtcagctgacgttctgcattgcag

SEQ ID NO: 120834 - DNA, 25 bp, Mus musculus
ggtcagctgtgagaagtgtcgccat

SEQ ID NO: 120835 - DNA, 25 bp, Mus musculus
ggtcagcttgttgcgcgtcttggaa

SEQ ID NO: 120836 - DNA, 25 bp, Mus musculus
ggtcagcttttacctcttgcgtata

SEQ ID NO: 120837 - DNA, 25 bp, Mus musculus
ggtcaggcctccatcgaccacttaa

SEQ ID NO: 120838 - DNA, 25 bp, Mus musculus
ggtcaggtctacgtccaaggtcagg

SEQ ID NO: 120839 - DNA, 25 bp, Mus musculus
ggtcagtacccgtaccctagtggct

SEQ ID NO: 120840 - DNA, 25 bp, Mus musculus
ggtcagtcctgaagagtcgaaagct

SEQ ID NO: 120841 - DNA, 25 bp, Mus musculus
ggtcagtgagccagtcaactttagc

SEQ ID NO: 120842 - DNA, 25 bp, Mus musculus
ggtcagtgccctgatcaagtgccag

SEQ ID NO: 120843 - DNA, 25 bp, Mus musculus
ggtcataccacaagcttcctcaagg

SEQ ID NO: 120844 - DNA, 25 bp, Mus musculus
ggtcatactagagagccaggcaagc

SEQ ID NO: 120845 - DNA, 25 bp, Mus musculus
ggtcatatcctaggaccccagagga

SEQ ID NO: 120846 - DNA, 25 bp, Mus musculus
ggtcatcaggaaagtggcagtcccg

SEQ ID NO: 120847 - DNA, 25 bp, Mus musculus
ggtcatcagtgatcagtcagtcaac

SEQ ID NO: 120848 - DNA, 25 bp, Mus musculus
ggtcatccgcaagaacatcgtcaag

SEQ ID NO: 120849 - DNA, 25 bp, Mus musculus
ggtcatcgagagataccacatccct

SEQ ID NO: 120850 - DNA, 25 bp, Mus musculus
ggtcatctgagcacagcgctagggc

SEQ ID NO: 120851 - DNA, 25 bp, Mus musculus
ggtcatctgcacaggagcccagtag

SEQ ID NO: 120852 - DNA, 25 bp, Mus musculus
ggtcatctgttccagccgggctact

SEQ ID NO: 120853 - DNA, 25 bp, Mus musculus
ggtcatgtcgctgcccaagctgcag

SEQ ID NO: 120854 - DNA, 25 bp, Mus musculus
ggtcatgtctgttttttatataata

SEQ ID NO: 120855 - DNA, 25 bp, Mus musculus
ggtcatgtgccttctctgatgccaa

SEQ ID NO: 120856 - DNA, 25 bp, Mus musculus
ggtcattaaccctgcagctgcctgg

SEQ ID NO: 120857 - DNA, 25 bp, Mus musculus
ggtcattaatgaagcctgtcccgga

SEQ ID NO: 120858 - DNA, 25 bp, Mus musculus
ggtcattagcccacaaagtagcagt

SEQ ID NO: 120859 - DNA, 25 bp, Mus musculus
ggtcattgacaacttccataacgcc

SEQ ID NO: 120860 - DNA, 25 bp, Mus musculus
ggtcattggcatgcagtacgcaggc

SEQ ID NO: 120861 - DNA, 25 bp, Mus musculus
ggtcatttttccagacgatggggga

SEQ ID NO: 120862 - DNA, 25 bp, Mus musculus
ggtccaagaaggattacctacacgg

SEQ ID NO: 120863 - DNA, 25 bp, Mus musculus
ggtccaagacgccatgaagcatctg

SEQ ID NO: 120864 - DNA, 25 bp, Mus musculus
ggtccaagcgttggcctgaagtcaa

SEQ ID NO: 120865 - DNA, 25 bp, Mus musculus
ggtccaaggaccagcgtatcagcat

SEQ ID NO: 120866 - DNA, 25 bp, Mus musculus
ggtccaaggagggtaaaagccaatg

SEQ ID NO: 120867 - DNA, 25 bp, Mus musculus
ggtccaatccagtttcaggcgagaa

SEQ ID NO: 120868 - DNA, 25 bp, Mus musculus
ggtccacaaggctctccaggtttgc

SEQ ID NO: 120869 - DNA, 25 bp, Mus musculus
ggtccacagtgcagcgaatctctag

SEQ ID NO: 120870 - DNA, 25 bp, Mus musculus
ggtccaccattagagtcagcttttg

SEQ ID NO: 120871 - DNA, 25 bp, Mus musculus
ggtccagagcacgaggccaataatt

SEQ ID NO: 120872 - DNA, 25 bp, Mus musculus
ggtccagatgccaccaatagccagg

SEQ ID NO: 120873 - DNA, 25 bp, Mus musculus
ggtccagcccttcaggcaacgtctt

SEQ ID NO: 120874 - DNA, 25 bp, Mus musculus
ggtccagccgcttaagtgcacagtg

SEQ ID NO: 120875 - DNA, 25 bp, Mus musculus
ggtccagccggcagcgggccgtaca

SEQ ID NO: 120876 - DNA, 25 bp, Mus musculus
ggtccagctgcgcagagttcatcag

SEQ ID NO: 120877 - DNA, 25 bp, Mus musculus
ggtccaggccgatgagaagttccca

SEQ ID NO: 120878 - DNA, 25 bp, Mus musculus
ggtccaggttttgagctcgccagct

SEQ ID NO: 120879 - DNA, 25 bp, Mus musculus
ggtccagtggccacatttgcagcgt

SEQ ID NO: 120880 - DNA, 25 bp, Mus musculus
ggtccagttgttcgatgcctcctga

SEQ ID NO: 120881 - DNA, 25 bp, Mus musculus
ggtccatccaccatgcacttgctgt

SEQ ID NO: 120882 - DNA, 25 bp, Mus musculus
ggtccatgcggcaggccacggtcca

SEQ ID NO: 120883 - DNA, 25 bp, Mus musculus
ggtcccaacagccagcacgtactgt

SEQ ID NO: 120884 - DNA, 25 bp, Mus musculus
ggtcccaagatcacgtcggcaggtt

SEQ ID NO: 120885 - DNA, 25 bp, Mus musculus
ggtcccagagatgagagcccaactg

SEQ ID NO: 120886 - DNA, 25 bp, Mus musculus
ggtcccagcttccagtcacagcata

SEQ ID NO: 120887 - DNA, 25 bp, Mus musculus
ggtcccaggctctcaaaatagtgca

SEQ ID NO: 120888 - DNA, 25 bp, Mus musculus
ggtcccatgtacaaagctgatgcag

SEQ ID NO: 120889 - DNA, 25 bp, Mus musculus
ggtcccatttgtgcagaccggagtg

SEQ ID NO: 120890 - DNA, 25 bp, Mus musculus
ggtccccgaggacgccgcgtgggcg

SEQ ID NO: 120891 - DNA, 25 bp, Mus musculus
ggtcccgaaacaggatacccattgc

SEQ ID NO: 120892 - DNA, 25 bp, Mus musculus
ggtcccgagtgagccatacatagtc

SEQ ID NO: 120893 - DNA, 25 bp, Mus musculus
ggtcccgcctctgtttgtcattgaa

SEQ ID NO: 120894 - DNA, 25 bp, Mus musculus
ggtcccgcggagatatcgatataag

SEQ ID NO: 120895 - DNA, 25 bp, Mus musculus
ggtccctaccatcgagtggcaaaga

SEQ ID NO: 120896 - DNA, 25 bp, Mus musculus
ggtccctacgggagacctcgctgca

SEQ ID NO: 120897 - DNA, 25 bp, Mus musculus
ggtccctgccgctcaataaacatga

SEQ ID NO: 120898 - DNA, 25 bp, Mus musculus
ggtccctgcgtagcgtgggcccggg

SEQ ID NO: 120899 - DNA, 25 bp, Mus musculus
ggtccctggctgagtgaatgagaaa

SEQ ID NO: 120900 - DNA, 25 bp, Mus musculus
ggtccgaaaggagaaccctgtccag

SEQ ID NO: 120901 - DNA, 25 bp, Mus musculus
ggtccgaatctccaggtccaaagct

SEQ ID NO: 120902 - DNA, 25 bp, Mus musculus
ggtccgacgtcaattccagagcctt

SEQ ID NO: 120903 - DNA, 25 bp, Mus musculus
ggtccgactgtaaaggccacttgaa

SEQ ID NO: 120904 - DNA, 25 bp, Mus musculus
ggtccgagattagaggctttacaaa

SEQ ID NO: 120905 - DNA, 25 bp, Mus musculus
ggtccgagccagagcacttgttcag

SEQ ID NO: 120906 - DNA, 25 bp, Mus musculus
ggtccgcacgccggcgcagtctacg

SEQ ID NO: 120907 - DNA, 25 bp, Mus musculus
ggtccgcatcggtgacagggacccc

SEQ ID NO: 120908 - DNA, 25 bp, Mus musculus
ggtccgctggagcaaatcgcataag

SEQ ID NO: 120909 - DNA, 25 bp, Mus musculus
ggtccgctgtgctgccgccgcagta

SEQ ID NO: 120910 - DNA, 25 bp, Mus musculus
ggtccggaatcccaaagccagttcg

SEQ ID NO: 120911 - DNA, 25 bp, Mus musculus
ggtccggcacccgtgtttgctgcag

SEQ ID NO: 120912 - DNA, 25 bp, Mus musculus
ggtccggcgtctccagatctgatga

SEQ ID NO: 120913 - DNA, 25 bp, Mus musculus
ggtccggctcctacagaatatccag

SEQ ID NO: 120914 - DNA, 25 bp, Mus musculus
ggtccgtctgaatcgagctcttgaa

SEQ ID NO: 120915 - DNA, 25 bp, Mus musculus
ggtccgtggcgcatctctttatcga

SEQ ID NO: 120916 - DNA, 25 bp, Mus musculus
ggtccgttacatcacgcagagtggt

SEQ ID NO: 120917 - DNA, 25 bp, Mus musculus
ggtcctacctctacacaggacggtg

SEQ ID NO: 120918 - DNA, 25 bp, Mus musculus
ggtcctagctacagcctgagcggga

SEQ ID NO: 120919 - DNA, 25 bp, Mus musculus
ggtcctaggccgattcgatgaggca

SEQ ID NO: 120920 - DNA, 25 bp, Mus musculus
ggtcctatggcgcattctcgagtct

SEQ ID NO: 120921 - DNA, 25 bp, Mus musculus
ggtcctatgtgtgtgcctcagctca

SEQ ID NO: 120922 - DNA, 25 bp, Mus musculus
ggtcctcaaggaagatgctccccga

SEQ ID NO: 120923 - DNA, 25 bp, Mus musculus
ggtcctccgcggctgccatttgtcg

SEQ ID NO: 120924 - DNA, 25 bp, Mus musculus
ggtcctcgcagctccatttcagtca

SEQ ID NO: 120925 - DNA, 25 bp, Mus musculus
ggtcctcgccgagccgtgatgagcg

SEQ ID NO: 120926 - DNA, 25 bp, Mus musculus
ggtcctcgctggctttacattaaag

SEQ ID NO: 120927 - DNA, 25 bp, Mus musculus
ggtcctctgggaactttgcactgca

SEQ ID NO: 120928 - DNA, 25 bp, Mus musculus
ggtcctgacactgagcgcatctatg

SEQ ID NO: 120929 - DNA, 25 bp, Mus musculus
ggtcctgagcatgcacctaagcagc

SEQ ID NO: 120930 - DNA, 25 bp, Mus musculus
ggtcctgcaccctctggatgattcg

SEQ ID NO: 120931 - DNA, 25 bp, Mus musculus
ggtcctgcgacagaggcttcacaag

SEQ ID NO: 120932 - DNA, 25 bp, Mus musculus
ggtcctgctgccaccggatgtgcat

SEQ ID NO: 120933 - DNA, 25 bp, Mus musculus
ggtcctggaacacggcctatatgct

SEQ ID NO: 120934 - DNA, 25 bp, Mus musculus
ggtcctggaccttctacttcatctg

SEQ ID NO: 120935 - DNA, 25 bp, Mus musculus
ggtcctggaggcacttcaagttcta

SEQ ID NO: 120936 - DNA, 25 bp, Mus musculus
ggtcctggcacacgcaattcttggg

SEQ ID NO: 120937 - DNA, 25 bp, Mus musculus
ggtcctggttcggtagctagctcaa

SEQ ID NO: 120938 - DNA, 25 bp, Mus musculus
ggtccttatttcatgcacgcgggaa

SEQ ID NO: 120939 - DNA, 25 bp, Mus musculus
ggtccttcgttgagctgccgtggtc

SEQ ID NO: 120940 - DNA, 25 bp, Mus musculus
ggtccttgcccatatattcgccgga

SEQ ID NO: 120941 - DNA, 25 bp, Mus musculus
ggtccttgctggtgaggtccttaag

SEQ ID NO: 120942 - DNA, 25 bp, Mus musculus
ggtcctttcagtttccagccatgca

SEQ ID NO: 120943 - DNA, 25 bp, Mus musculus
ggtcctttcgcggagctacccaagg

SEQ ID NO: 120944 - DNA, 25 bp, Mus musculus
ggtccttttagacccgctgccaagg

SEQ ID NO: 120945 - DNA, 25 bp, Mus musculus
ggtcgacccgagatcagaatgtggc

SEQ ID NO: 120946 - DNA, 25 bp, Mus musculus
ggtcgaccctggagaaacctcagtt

SEQ ID NO: 120947 - DNA, 25 bp, Mus musculus
ggtcgacgtttgctctaccggaaca

SEQ ID NO: 120948 - DNA, 25 bp, Mus musculus
ggtcgactctttccctagacgctgg

SEQ ID NO: 120949 - DNA, 25 bp, Mus musculus
ggtcgactgaaaagctcccattggc

SEQ ID NO: 120950 - DNA, 25 bp, Mus musculus
ggtcgaggcctctgtctacttttac

SEQ ID NO: 120951 - DNA, 25 bp, Mus musculus
ggtcgagtatgaaacactgcctgga

SEQ ID NO: 120952 - DNA, 25 bp, Mus musculus
ggtcgatctcatcggagtctcaaca

SEQ ID NO: 120953 - DNA, 25 bp, Mus musculus
ggtcgatttcacgtacctctcggga

SEQ ID NO: 120954 - DNA, 25 bp, Mus musculus
ggtcgcaacacggaatagcatagct

SEQ ID NO: 120955 - DNA, 25 bp, Mus musculus
ggtcgccctggctatagagtgagtt

SEQ ID NO: 120956 - DNA, 25 bp, Mus musculus
ggtcgccggcatcttcttccacgaa

SEQ ID NO: 120957 - DNA, 25 bp, Mus musculus
ggtcgcctgactgccatcgagtggt

SEQ ID NO: 120958 - DNA, 25 bp, Mus musculus
ggtcgctgcgcgtgcgatcgtctca

SEQ ID NO: 120959 - DNA, 25 bp, Mus musculus
ggtcgctgcttttcctcactcagag

SEQ ID NO: 120960 - DNA, 25 bp, Mus musculus
ggtcgcttcaggcacttcttggaca

SEQ ID NO: 120961 - DNA, 25 bp, Mus musculus
ggtcgcttcatcctgagcagactag

SEQ ID NO: 120962 - DNA, 25 bp, Mus musculus
ggtcgcttcctgagccgctgctggc

SEQ ID NO: 120963 - DNA, 25 bp, Mus musculus
ggtcggaagccaacaccagtggtct

SEQ ID NO: 120964 - DNA, 25 bp, Mus musculus
ggtcggacccagctcttcatcaaag

SEQ ID NO: 120965 - DNA, 25 bp, Mus musculus
ggtcggcctagatcctggttctgca

SEQ ID NO: 120966 - DNA, 25 bp, Mus musculus
ggtcggctgaattccaaagatgctg

SEQ ID NO: 120967 - DNA, 25 bp, Mus musculus
ggtcggcttaccatggctccagatg

SEQ ID NO: 120968 - DNA, 25 bp, Mus musculus
ggtcgggagcacagccactttattg

SEQ ID NO: 120969 - DNA, 25 bp, Mus musculus
ggtcggtggaggcactctcccttca

SEQ ID NO: 120970 - DNA, 25 bp, Mus musculus
ggtcggttgccttgagtccctacag

SEQ ID NO: 120971 - DNA, 25 bp, Mus musculus
ggtcgtccagtgtaccctgatgtgg

SEQ ID NO: 120972 - DNA, 25 bp, Mus musculus
ggtcgtcttggttgatgcagcctag

SEQ ID NO: 120973 - DNA, 25 bp, Mus musculus
ggtcgtgcaaacatgatacccaact

SEQ ID NO: 120974 - DNA, 25 bp, Mus musculus
ggtcgtgcctcacccatcaatgaag

SEQ ID NO: 120975 - DNA, 25 bp, Mus musculus
ggtcgtgtatcaggatggattttat

SEQ ID NO: 120976 - DNA, 25 bp, Mus musculus
ggtcgtgtatccagtccgccttagc

SEQ ID NO: 120977 - DNA, 25 bp, Mus musculus
ggtcgttacctaagctagcgtgggc

SEQ ID NO: 120978 - DNA, 25 bp, Mus musculus
ggtcgtttcagccacagaagtgggc

SEQ ID NO: 120979 - DNA, 25 bp, Mus musculus
ggtcgtttggtcaagcaacatgcat

SEQ ID NO: 120980 - DNA, 25 bp, Mus musculus
ggtctaaggcgtccagcagcaccat

SEQ ID NO: 120981 - DNA, 25 bp, Mus musculus
ggtctacagcatcaccaacaacttc

SEQ ID NO: 120982 - DNA, 25 bp, Mus musculus
ggtctaccatttcaccttggagaag

SEQ ID NO: 120983 - DNA, 25 bp, Mus musculus
ggtctacctgcttcacatcctgctg

SEQ ID NO: 120984 - DNA, 25 bp, Mus musculus
ggtctacggagtgcaccttgggcca

SEQ ID NO: 120985 - DNA, 25 bp, Mus musculus
ggtctacttggtgaatctttctgaa

SEQ ID NO: 120986 - DNA, 25 bp, Mus musculus
ggtctagaatctaatcacattatta

SEQ ID NO: 120987 - DNA, 25 bp, Mus musculus
ggtctagagcagtgcagggcttcct

SEQ ID NO: 120988 - DNA, 25 bp, Mus musculus
ggtctatctgtgcatcctgagaggc

SEQ ID NO: 120989 - DNA, 25 bp, Mus musculus
ggtctcaaacatgattgaaattaaa

SEQ ID NO: 120990 - DNA, 25 bp, Mus musculus
ggtctcaagggagccacattcactg

SEQ ID NO: 120991 - DNA, 25 bp, Mus musculus
ggtctcacctcggaagcagtggctt

SEQ ID NO: 120992 - DNA, 25 bp, Mus musculus
ggtctcacggatgctccttgtccaa

SEQ ID NO: 120993 - DNA, 25 bp, Mus musculus
ggtctcagacatggagttcctgcca

SEQ ID NO: 120994 - DNA, 25 bp, Mus musculus
ggtctcagcaactgccggacagaaa

SEQ ID NO: 120995 - DNA, 25 bp, Mus musculus
ggtctcataagatctggcatatcca

SEQ ID NO: 120996 - DNA, 25 bp, Mus musculus
ggtctccgaggaaaaatggaagtgt

SEQ ID NO: 120997 - DNA, 25 bp, Mus musculus
ggtctccgctgcctcaactggttgg

SEQ ID NO: 120998 - DNA, 25 bp, Mus musculus
ggtctcctcacgtgcgaaagctgca

SEQ ID NO: 120999 - DNA, 25 bp, Mus musculus
ggtctcctggaagagcggaagctca

SEQ ID NO: 121000 - DNA, 25 bp, Mus musculus
ggtctccttcctgcagatcacttgg

SEQ ID NO: 121001 - DNA, 25 bp, Mus musculus
ggtctcgcggaagtactcgtcccga

SEQ ID NO: 121002 - DNA, 25 bp, Mus musculus
ggtctcgtcttgaagggcctgccaa

SEQ ID NO: 121003 - DNA, 25 bp, Mus musculus
ggtctcgttctttcttcattgcagg

SEQ ID NO: 121004 - DNA, 25 bp, Mus musculus
ggtctctaatgtctctcaagcggaa

SEQ ID NO: 121005 - DNA, 25 bp, Mus musculus
ggtctctcaaaggaaactcatgcgg

SEQ ID NO: 121006 - DNA, 25 bp, Mus musculus
ggtctctcaaagtctcttccaaagg

SEQ ID NO: 121007 - DNA, 25 bp, Mus musculus
ggtctctgccagctgaagtgcccta

SEQ ID NO: 121008 - DNA, 25 bp, Mus musculus
ggtctctgtcagaatcccactcaca

SEQ ID NO: 121009 - DNA, 25 bp, Mus musculus
ggtctctgtggccactacactcata

SEQ ID NO: 121010 - DNA, 25 bp, Mus musculus
ggtctcttgtgtgatagcccaggca

SEQ ID NO: 121011 - DNA, 25 bp, Mus musculus
ggtctgacgacgacatcactggctg

SEQ ID NO: 121012 - DNA, 25 bp, Mus musculus
ggtctgacgggactattattactcc

SEQ ID NO: 121013 - DNA, 25 bp, Mus musculus
ggtctgactgtgaaaccctggctaa

SEQ ID NO: 121014 - DNA, 25 bp, Mus musculus
ggtctgatagaaactgctggtccca

SEQ ID NO: 121015 - DNA, 25 bp, Mus musculus
ggtctgattcaggtggtcttcccca

SEQ ID NO: 121016 - DNA, 25 bp, Mus musculus
ggtctgcatcattcctcgctaaaga

SEQ ID NO: 121017 - DNA, 25 bp, Mus musculus
ggtctgcatggaaaatggctgttca

SEQ ID NO: 121018 - DNA, 25 bp, Mus musculus
ggtctgcgagctttaccgacgggaa

SEQ ID NO: 121019 - DNA, 25 bp, Mus musculus
ggtctgctcccagccgtgatgatga

SEQ ID NO: 121020 - DNA, 25 bp, Mus musculus
ggtctgctgttactggctctcatca

SEQ ID NO: 121021 - DNA, 25 bp, Mus musculus
ggtctgcttggaacagtcattgaag

SEQ ID NO: 121022 - DNA, 25 bp, Mus musculus
ggtctggacgctgatgccaccggtc

SEQ ID NO: 121023 - DNA, 25 bp, Mus musculus
ggtctgtaaaacgtcaggcgccgca

SEQ ID NO: 121024 - DNA, 25 bp, Mus musculus
ggtctgtaccctgccaattacgtag

SEQ ID NO: 121025 - DNA, 25 bp, Mus musculus
ggtctgtgcgcgacacctcaaactt

SEQ ID NO: 121026 - DNA, 25 bp, Mus musculus
ggtctgtgctacacgacaaacggta

SEQ ID NO: 121027 - DNA, 25 bp, Mus musculus
ggtctgtgtcttgaaaggcccgcaa

SEQ ID NO: 121028 - DNA, 25 bp, Mus musculus
ggtcttcagcaacctgaggccgtca

SEQ ID NO: 121029 - DNA, 25 bp, Mus musculus
ggtcttccacccctaaatatgcata

SEQ ID NO: 121030 - DNA, 25 bp, Mus musculus
ggtcttcccaactctcatcggcagg

SEQ ID NO: 121031 - DNA, 25 bp, Mus musculus
ggtcttccctactacaacggcgtgg

SEQ ID NO: 121032 - DNA, 25 bp, Mus musculus
ggtcttcggaggcaccttctcgccg

SEQ ID NO: 121033 - DNA, 25 bp, Mus musculus
ggtcttctgtgcctcgggtctccag

SEQ ID NO: 121034 - DNA, 25 bp, Mus musculus
ggtcttgaaaacaacccagtctggg

SEQ ID NO: 121035 - DNA, 25 bp, Mus musculus
ggtcttgatctatagcccagccagc

SEQ ID NO: 121036 - DNA, 25 bp, Mus musculus
ggtcttgctcagtactcggtttgca

SEQ ID NO: 121037 - DNA, 25 bp, Mus musculus
ggtcttgtctctcatcctgccgagg

SEQ ID NO: 121038 - DNA, 25 bp, Mus musculus
ggtctttaacgaaactcccatcaat

SEQ ID NO: 121039 - DNA, 25 bp, Mus musculus
ggtctttctggtcctcagctgtctc

SEQ ID NO: 121040 - DNA, 25 bp, Mus musculus
ggtctttgaaaccagaggccatcca

SEQ ID NO: 121041 - DNA, 25 bp, Mus musculus
ggtctttgattacctgcatgcgaca

SEQ ID NO: 121042 - DNA, 25 bp, Mus musculus
ggtctttgccaagtaccagcatttg

SEQ ID NO: 121043 - DNA, 25 bp, Mus musculus
ggtctttgtgctgtatgagctctca

SEQ ID NO: 121044 - DNA, 25 bp, Mus musculus
ggtcttttctaagcctgggtcctga

SEQ ID NO: 121045 - DNA, 25 bp, Mus musculus
ggtgaaaacttgtgcccctctgtgg

SEQ ID NO: 121046 - DNA, 25 bp, Mus musculus
ggtgaaaccaaaggtgcccctgtcg

SEQ ID NO: 121047 - DNA, 25 bp, Mus musculus
ggtgaaaccccacgacatctttgag

SEQ ID NO: 121048 - DNA, 25 bp, Mus musculus
ggtgaaagacaaatcaggcaacttc

SEQ ID NO: 121049 - DNA, 25 bp, Mus musculus
ggtgaaatctcgaaaggcccagagt

SEQ ID NO: 121050 - DNA, 25 bp, Mus musculus
ggtgaacaccccaaactagaggtca

SEQ ID NO: 121051 - DNA, 25 bp, Mus musculus
ggtgaacacgtctacactgcagaaa

SEQ ID NO: 121052 - DNA, 25 bp, Mus musculus
ggtgaacagcatattacactaagtg

SEQ ID NO: 121053 - DNA, 25 bp, Mus musculus
ggtgaacaggcctcattcagcctga

SEQ ID NO: 121054 - DNA, 25 bp, Mus musculus
ggtgaaccaggcacttcgcgatgct

SEQ ID NO: 121055 - DNA, 25 bp, Mus musculus
ggtgaaccagtgaccagctctgatg

SEQ ID NO: 121056 - DNA, 25 bp, Mus musculus
ggtgaacccgattgatgagccagaa

SEQ ID NO: 121057 - DNA, 25 bp, Mus musculus
ggtgaaccctctggatccacggaat

SEQ ID NO: 121058 - DNA, 25 bp, Mus musculus
ggtgaaccgacaaacagtcctggag

SEQ ID NO: 121059 - DNA, 25 bp, Mus musculus
ggtgaacctgccctaccgtatggtg

SEQ ID NO: 121060 - DNA, 25 bp, Mus musculus
ggtgaacctgcgagatgaccttctt

SEQ ID NO: 121061 - DNA, 25 bp, Mus musculus
ggtgaacctttttcccgcctgagcg

SEQ ID NO: 121062 - DNA, 25 bp, Mus musculus
ggtgaacgacgactactgcgactgt

SEQ ID NO: 121063 - DNA, 25 bp, Mus musculus
ggtgaacgcctctgctctgttcctg

SEQ ID NO: 121064 - DNA, 25 bp, Mus musculus
ggtgaactccctgaagaacgtcttg

SEQ ID NO: 121065 - DNA, 25 bp, Mus musculus
ggtgaagaactacctggcatctact

SEQ ID NO: 121066 - DNA, 25 bp, Mus musculus
ggtgaagactctacaggtccaggct

SEQ ID NO: 121067 - DNA, 25 bp, Mus musculus
ggtgaagagacctgcactttccgaa

SEQ ID NO: 121068 - DNA, 25 bp, Mus musculus
ggtgaagatgcagacctttccagac

SEQ ID NO: 121069 - DNA, 25 bp, Mus musculus
ggtgaagattttgaacagcttgcta

SEQ ID NO: 121070 - DNA, 25 bp, Mus musculus
ggtgaagccaaacagagcaacgtct

SEQ ID NO: 121071 - DNA, 25 bp, Mus musculus
ggtgaagccacatccatcttatcgg

SEQ ID NO: 121072 - DNA, 25 bp, Mus musculus
ggtgaagcctgtgttaatagacccc

SEQ ID NO: 121073 - DNA, 25 bp, Mus musculus
ggtgaaggagatgagctacgaccca

SEQ ID NO: 121074 - DNA, 25 bp, Mus musculus
ggtgaagttcattcccggagccgca

SEQ ID NO: 121075 - DNA, 25 bp, Mus musculus
ggtgaataaacacacttctctgaag

SEQ ID NO: 121076 - DNA, 25 bp, Mus musculus
ggtgaataaccttccagacagaggg

SEQ ID NO: 121077 - DNA, 25 bp, Mus musculus
ggtgaataccagtctaatgatgtct

SEQ ID NO: 121078 - DNA, 25 bp, Mus musculus
ggtgaatgatacactgacttctgaa

SEQ ID NO: 121079 - DNA, 25 bp, Mus musculus
ggtgaatgcaatggccatcggctgt

SEQ ID NO: 121080 - DNA, 25 bp, Mus musculus
ggtgacaaccggacctataaaggct

SEQ ID NO: 121081 - DNA, 25 bp, Mus musculus
ggtgacaacttttacgtcattgaca

SEQ ID NO: 121082 - DNA, 25 bp, Mus musculus
ggtgacaaggtgtcgggctaccact

SEQ ID NO: 121083 - DNA, 25 bp, Mus musculus
ggtgacacccagaatgagccctctg

SEQ ID NO: 121084 - DNA, 25 bp, Mus musculus
ggtgacagaccggaaactacatttc

SEQ ID NO: 121085 - DNA, 25 bp, Mus musculus
ggtgacagtcatgaatctgaagaca

SEQ ID NO: 121086 - DNA, 25 bp, Mus musculus
ggtgacatcactggctgcagctgaa

SEQ ID NO: 121087 - DNA, 25 bp, Mus musculus
ggtgacatggagctgtcccctagaa

SEQ ID NO: 121088 - DNA, 25 bp, Mus musculus
ggtgacattcttgctgccggacagg

SEQ ID NO: 121089 - DNA, 25 bp, Mus musculus
ggtgaccacacacgatgcaagactg

SEQ ID NO: 121090 - DNA, 25 bp, Mus musculus
ggtgaccaccatttattcctcagtg

SEQ ID NO: 121091 - DNA, 25 bp, Mus musculus
ggtgaccacggctttgataacaagg

SEQ ID NO: 121092 - DNA, 25 bp, Mus musculus
ggtgaccagtcagcgaccagtgttt

SEQ ID NO: 121093 - DNA, 25 bp, Mus musculus
ggtgaccatctcaggctgaccatgg

SEQ ID NO: 121094 - DNA, 25 bp, Mus musculus
ggtgacccacgatctgctctacgag

SEQ ID NO: 121095 - DNA, 25 bp, Mus musculus
ggtgaccccttaacctggagccact

SEQ ID NO: 121096 - DNA, 25 bp, Mus musculus
ggtgacccttctgttatttaaagat

SEQ ID NO: 121097 - DNA, 25 bp, Mus musculus
ggtgaccggaatcccaactgctgtg

SEQ ID NO: 121098 - DNA, 25 bp, Mus musculus
ggtgacctaaatcctcggacggacg

SEQ ID NO: 121099 - DNA, 25 bp, Mus musculus
ggtgacctcgttcatgccatgccag

SEQ ID NO: 121100 - DNA, 25 bp, Mus musculus
ggtgacggtcctcgatctgaacaga

SEQ ID NO: 121101 - DNA, 25 bp, Mus musculus
ggtgacgtcacgaccgagttgccat

SEQ ID NO: 121102 - DNA, 25 bp, Mus musculus
ggtgactatcacttccgcatctgca

SEQ ID NO: 121103 - DNA, 25 bp, Mus musculus
ggtgactcggccatggcatctgcaa

SEQ ID NO: 121104 - DNA, 25 bp, Mus musculus
ggtgactctgtcactagcgccggaa

SEQ ID NO: 121105 - DNA, 25 bp, Mus musculus
ggtgactgtgataagccctggctac

SEQ ID NO: 121106 - DNA, 25 bp, Mus musculus
ggtgactgtgggtgatacctccctg

SEQ ID NO: 121107 - DNA, 25 bp, Mus musculus
ggtgacttgccgtgtcgtgctaaca

SEQ ID NO: 121108 - DNA, 25 bp, Mus musculus
ggtgagaaacagaaacccagggtct

SEQ ID NO: 121109 - DNA, 25 bp, Mus musculus
ggtgagacccttgtacaaagtgacg

SEQ ID NO: 121110 - DNA, 25 bp, Mus musculus
ggtgagacttcctacatccgagtgt

SEQ ID NO: 121111 - DNA, 25 bp, Mus musculus
ggtgagagcaactgttcttggaaca

SEQ ID NO: 121112 - DNA, 25 bp, Mus musculus
ggtgagattgccagcatccctctac

SEQ ID NO: 121113 - DNA, 25 bp, Mus musculus
ggtgagcaaagtatgatcctcgtgc

SEQ ID NO: 121114 - DNA, 25 bp, Mus musculus
ggtgagcacacccaagcgtttacag

SEQ ID NO: 121115 - DNA, 25 bp, Mus musculus
ggtgagcaccccagtcacgtgctgt

SEQ ID NO: 121116 - DNA, 25 bp, Mus musculus
ggtgagccaaagtactacccggtgg

SEQ ID NO: 121117 - DNA, 25 bp, Mus musculus
ggtgagccgctgtgatcataccagg

SEQ ID NO: 121118 - DNA, 25 bp, Mus musculus
ggtgagctggattttatcctccaag

SEQ ID NO: 121119 - DNA, 25 bp, Mus musculus
ggtgaggctgcaacggccccttgta

SEQ ID NO: 121120 - DNA, 25 bp, Mus musculus
ggtgaggtccttaagaacacagaaa

SEQ ID NO: 121121 - DNA, 25 bp, Mus musculus
ggtgagtaactgtgcccagcggcta

SEQ ID NO: 121122 - DNA, 25 bp, Mus musculus
ggtgagtatataggccacaggctta

SEQ ID NO: 121123 - DNA, 25 bp, Mus musculus
ggtgagtctagctagtgaagtccag

SEQ ID NO: 121124 - DNA, 25 bp, Mus musculus
ggtgagtgggaaagcattacccttg

SEQ ID NO: 121125 - DNA, 25 bp, Mus musculus
ggtgatacctccctgaggatattca

SEQ ID NO: 121126 - DNA, 25 bp, Mus musculus
ggtgatactgtaaaaggccatggca

SEQ ID NO: 121127 - DNA, 25 bp, Mus musculus
ggtgatatccagctgacccacgtgc

SEQ ID NO: 121128 - DNA, 25 bp, Mus musculus
ggtgatcatcaattccggcctggag

SEQ ID NO: 121129 - DNA, 25 bp, Mus musculus
ggtgatccaaagacacccggaggct

SEQ ID NO: 121130 - DNA, 25 bp, Mus musculus
ggtgatcgtcatggagaaatgcagt

SEQ ID NO: 121131 - DNA, 25 bp, Mus musculus
ggtgatcgtcctccaatacgtgtgc

SEQ ID NO: 121132 - DNA, 25 bp, Mus musculus
ggtgatctaatcaagcacgagagga

SEQ ID NO: 121133 - DNA, 25 bp, Mus musculus
ggtgatctaccaacgtccattgcgg

SEQ ID NO: 121134 - DNA, 25 bp, Mus musculus
ggtgatctaccccactgatagccgg

SEQ ID NO: 121135 - DNA, 25 bp, Mus musculus
ggtgatctgtgaagagcccctgtcc

SEQ ID NO: 121136 - DNA, 25 bp, Mus musculus
ggtgatgacatttgccttacaggaa

SEQ ID NO: 121137 - DNA, 25 bp, Mus musculus
ggtgatgaccttgaagctgtagcca

SEQ ID NO: 121138 - DNA, 25 bp, Mus musculus
ggtgatgctcattcccacggtcatg

SEQ ID NO: 121139 - DNA, 25 bp, Mus musculus
ggtgatgctgcttaagctcctgcag

SEQ ID NO: 121140 - DNA, 25 bp, Mus musculus
ggtgatgcttccagcccaagagacg

SEQ ID NO: 121141 - DNA, 25 bp, Mus musculus
ggtgatggcctcttggaagaacaca

SEQ ID NO: 121142 - DNA, 25 bp, Mus musculus
ggtgatgtcattgcagctgctaaga

SEQ ID NO: 121143 - DNA, 25 bp, Mus musculus
ggtgatgtccagattacctgtgaga

SEQ ID NO: 121144 - DNA, 25 bp, Mus musculus
ggtgattatccatgacgccgtgaga

SEQ ID NO: 121145 - DNA, 25 bp, Mus musculus
ggtgattcctaccagcctgcagtga

SEQ ID NO: 121146 - DNA, 25 bp, Mus musculus
ggtgattctgctatggaaatggcca

SEQ ID NO: 121147 - DNA, 25 bp, Mus musculus
ggtgattctgctgctgaccaattct

SEQ ID NO: 121148 - DNA, 25 bp, Mus musculus
ggtgattgacctggaacgggcctac

SEQ ID NO: 121149 - DNA, 25 bp, Mus musculus
ggtgatttcagccttcgccggtgac

SEQ ID NO: 121150 - DNA, 25 bp, Mus musculus
ggtgcaaaagtcagcccatgtaggc

SEQ ID NO: 121151 - DNA, 25 bp, Mus musculus
ggtgcaaatccggatctcagagatg

SEQ ID NO: 121152 - DNA, 25 bp, Mus musculus
ggtgcaacaccgacaccaggcttga

SEQ ID NO: 121153 - DNA, 25 bp, Mus musculus
ggtgcaactctcatcttcggaaggc

SEQ ID NO: 121154 - DNA, 25 bp, Mus musculus
ggtgcaagaaatccaaagccccaag

SEQ ID NO: 121155 - DNA, 25 bp, Mus musculus
ggtgcacaattaccagcgcatcgag

SEQ ID NO: 121156 - DNA, 25 bp, Mus musculus
ggtgcacaatttcttccctgaggct

SEQ ID NO: 121157 - DNA, 25 bp, Mus musculus
ggtgcacacaggtcaaccaagagca

SEQ ID NO: 121158 - DNA, 25 bp, Mus musculus
ggtgcacagcagagagaagcccttt

SEQ ID NO: 121159 - DNA, 25 bp, Mus musculus
ggtgcacagcccaagtcaaagaaga

SEQ ID NO: 121160 - DNA, 25 bp, Mus musculus
ggtgcacatgcatggacttcctgag

SEQ ID NO: 121161 - DNA, 25 bp, Mus musculus
ggtgcaccattccagataatccgta

SEQ ID NO: 121162 - DNA, 25 bp, Mus musculus
ggtgcaccccagctctgaaaagaaa

SEQ ID NO: 121163 - DNA, 25 bp, Mus musculus
ggtgcacgccgaagagaaactggac

SEQ ID NO: 121164 - DNA, 25 bp, Mus musculus
ggtgcacgcgagcttggaagccacg

SEQ ID NO: 121165 - DNA, 25 bp, Mus musculus
ggtgcacggagacttcgtctctcag

SEQ ID NO: 121166 - DNA, 25 bp, Mus musculus
ggtgcacgggctctttgacagttca

SEQ ID NO: 121167 - DNA, 25 bp, Mus musculus
ggtgcactgcctgcacaagcggtgt

SEQ ID NO: 121168 - DNA, 25 bp, Mus musculus
ggtgcagtcaaagccatagcctcgg

SEQ ID NO: 121169 - DNA, 25 bp, Mus musculus
ggtgcagtgtccttatgggcccaaa

SEQ ID NO: 121170 - DNA, 25 bp, Mus musculus
ggtgcagttgcagccagtagtaatc

SEQ ID NO: 121171 - DNA, 25 bp, Mus musculus
ggtgcatagcaaatcccaggaatct

SEQ ID NO: 121172 - DNA, 25 bp, Mus musculus
ggtgcatcagccttcgacttccaag

SEQ ID NO: 121173 - DNA, 25 bp, Mus musculus
ggtgcatccacgtctataacaagag

SEQ ID NO: 121174 - DNA, 25 bp, Mus musculus
ggtgcatccccttctaactaaaatt

SEQ ID NO: 121175 - DNA, 25 bp, Mus musculus
ggtgcatccttgttcgccagcaatg

SEQ ID NO: 121176 - DNA, 25 bp, Mus musculus
ggtgcatttaatgagcgaacaggtc

SEQ ID NO: 121177 - DNA, 25 bp, Mus musculus
ggtgccaccactgggactgtagctg

SEQ ID NO: 121178 - DNA, 25 bp, Mus musculus
ggtgccaggagcagaaagccaagct

SEQ ID NO: 121179 - DNA, 25 bp, Mus musculus
ggtgccaggcctgccaacctgagtt

SEQ ID NO: 121180 - DNA, 25 bp, Mus musculus
ggtgccagtcacttctaaccccagg

SEQ ID NO: 121181 - DNA, 25 bp, Mus musculus
ggtgccatcctcacaaccatgcttg

SEQ ID NO: 121182 - DNA, 25 bp, Mus musculus
ggtgccatgaaatctagtaaggaag

SEQ ID NO: 121183 - DNA, 25 bp, Mus musculus
ggtgcccaaacctctgtttcctgtg

SEQ ID NO: 121184 - DNA, 25 bp, Mus musculus
ggtgcccacgggaactgtatcagct

SEQ ID NO: 121185 - DNA, 25 bp, Mus musculus
ggtgcccatccattgtagaccatgt

SEQ ID NO: 121186 - DNA, 25 bp, Mus musculus
ggtgccccgtaatctgtgctcagaa

SEQ ID NO: 121187 - DNA, 25 bp, Mus musculus
ggtgccccttctcggacattttcaa

SEQ ID NO: 121188 - DNA, 25 bp, Mus musculus
ggtgcccgcgcagaagttctcagcg

SEQ ID NO: 121189 - DNA, 25 bp, Mus musculus
ggtgccctgtgcgttcaatagccta

SEQ ID NO: 121190 - DNA, 25 bp, Mus musculus
ggtgcccttcccttggacacagtca

SEQ ID NO: 121191 - DNA, 25 bp, Mus musculus
ggtgcccttggtcatcattctaacg

SEQ ID NO: 121192 - DNA, 25 bp, Mus musculus
ggtgccctttcagcatgacctgtcg

SEQ ID NO: 121193 - DNA, 25 bp, Mus musculus
ggtgccgacattttctactcgcggt

SEQ ID NO: 121194 - DNA, 25 bp, Mus musculus
ggtgccgacccaagtcttcagcaag

SEQ ID NO: 121195 - DNA, 25 bp, Mus musculus
ggtgccgactctctgctgctgaatg

SEQ ID NO: 121196 - DNA, 25 bp, Mus musculus
ggtgcctacctatgagtcgtgcttg

SEQ ID NO: 121197 - DNA, 25 bp, Mus musculus
ggtgcctaggcagcggaatccaatt

SEQ ID NO: 121198 - DNA, 25 bp, Mus musculus
ggtgcctcctgctcagaacagatgt

SEQ ID NO: 121199 - DNA, 25 bp, Mus musculus
ggtgcctcgaggaaacagtcggtct

SEQ ID NO: 121200 - DNA, 25 bp, Mus musculus
ggtgcctgagcgcttccttgctgca

SEQ ID NO: 121201 - DNA, 25 bp, Mus musculus
ggtgcctgccaggaaaccgatacag

SEQ ID NO: 121202 - DNA, 25 bp, Mus musculus
ggtgcctgtgacagatagcaaggag

SEQ ID NO: 121203 - DNA, 25 bp, Mus musculus
ggtgcctgtgtattgcctctgtcga

SEQ ID NO: 121204 - DNA, 25 bp, Mus musculus
ggtgccttaactctgggacgtgtac

SEQ ID NO: 121205 - DNA, 25 bp, Mus musculus
ggtgcgaggcgtgcgggttgtcgga

SEQ ID NO: 121206 - DNA, 25 bp, Mus musculus
ggtgcgcaggaagtaactcttccgc

SEQ ID NO: 121207 - DNA, 25 bp, Mus musculus
ggtgcgcaggttcttctccgtgtac

SEQ ID NO: 121208 - DNA, 25 bp, Mus musculus
ggtgcgccctgagacacttaagcca

SEQ ID NO: 121209 - DNA, 25 bp, Mus musculus
ggtgcggcagttactaagctgtttc

SEQ ID NO: 121210 - DNA, 25 bp, Mus musculus
ggtgcgggccctaagccgagataaa

SEQ ID NO: 121211 - DNA, 25 bp, Mus musculus
ggtgcggttgtccatgaagatctac

SEQ ID NO: 121212 - DNA, 25 bp, Mus musculus
ggtgctaggtccagaactggtccat

SEQ ID NO: 121213 - DNA, 25 bp, Mus musculus
ggtgctagtatccagaaggcccagt

SEQ ID NO: 121214 - DNA, 25 bp, Mus musculus
ggtgctatctatatccgccgtaggc

SEQ ID NO: 121215 - DNA, 25 bp, Mus musculus
ggtgctcagaagttgcttgctgcca

SEQ ID NO: 121216 - DNA, 25 bp, Mus musculus
ggtgctcagcatgtgtttcaacacg

SEQ ID NO: 121217 - DNA, 25 bp, Mus musculus
ggtgctcaggcaatgtgtccatcga

SEQ ID NO: 121218 - DNA, 25 bp, Mus musculus
ggtgctccaggaacagaatcaagat

SEQ ID NO: 121219 - DNA, 25 bp, Mus musculus
ggtgctcctcggtctgatgctgtca

SEQ ID NO: 121220 - DNA, 25 bp, Mus musculus
ggtgctcctgcgatcagcttctgaa

SEQ ID NO: 121221 - DNA, 25 bp, Mus musculus
ggtgctcgtgtatttctgcatctgg

SEQ ID NO: 121222 - DNA, 25 bp, Mus musculus
ggtgctctagaaacttcaaaatgcg

SEQ ID NO: 121223 - DNA, 25 bp, Mus musculus
ggtgctctgactaaccttggataga

SEQ ID NO: 121224 - DNA, 25 bp, Mus musculus
ggtgctctgactgcggcagccgttg

SEQ ID NO: 121225 - DNA, 25 bp, Mus musculus
ggtgctctgagaattccccgacagt

SEQ ID NO: 121226 - DNA, 25 bp, Mus musculus
ggtgctctgggtcatccgcaaacaa

SEQ ID NO: 121227 - DNA, 25 bp, Mus musculus
ggtgctctgtgtacttaaccccagg

SEQ ID NO: 121228 - DNA, 25 bp, Mus musculus
ggtgctgaatcaagccaaacctggg

SEQ ID NO: 121229 - DNA, 25 bp, Mus musculus
ggtgctgatcctaagcagttggaga

SEQ ID NO: 121230 - DNA, 25 bp, Mus musculus
ggtgctgcccattcagacgggctct

SEQ ID NO: 121231 - DNA, 25 bp, Mus musculus
ggtgctgcctccaaaatcaccagtg

SEQ ID NO: 121232 - DNA, 25 bp, Mus musculus
ggtgctgccttccttacatgaaagt

SEQ ID NO: 121233 - DNA, 25 bp, Mus musculus
ggtgctgctcacacgaccaggagag

SEQ ID NO: 121234 - DNA, 25 bp, Mus musculus
ggtgctggacgccaataactgcgac

SEQ ID NO: 121235 - DNA, 25 bp, Mus musculus
ggtgctggatccatcgggctataaa

SEQ ID NO: 121236 - DNA, 25 bp, Mus musculus
ggtgctgggctcgtgttattttcct

SEQ ID NO: 121237 - DNA, 25 bp, Mus musculus
ggtgctggtacccactactatgcca

SEQ ID NO: 121238 - DNA, 25 bp, Mus musculus
ggtgctggtgttgaactgtatcctg

SEQ ID NO: 121239 - DNA, 25 bp, Mus musculus
ggtgctgtgcaatctgaaaccccag

SEQ ID NO: 121240 - DNA, 25 bp, Mus musculus
ggtgctgtgtacctgtgtcccctca

SEQ ID NO: 121241 - DNA, 25 bp, Mus musculus
ggtgcttaccaaccaagaccaggtt

SEQ ID NO: 121242 - DNA, 25 bp, Mus musculus
ggtgcttactgtaccctgtggtcca

SEQ ID NO: 121243 - DNA, 25 bp, Mus musculus
ggtgcttccagagacctaagaacca

SEQ ID NO: 121244 - DNA, 25 bp, Mus musculus
ggtgcttcgccaggtgacaaaaagt

SEQ ID NO: 121245 - DNA, 25 bp, Mus musculus
ggtgcttggacctcaataaacacgt

SEQ ID NO: 121246 - DNA, 25 bp, Mus musculus
ggtgctttcactctgcggcagcgaa

SEQ ID NO: 121247 - DNA, 25 bp, Mus musculus
ggtggaaatcatcagcctcaaagct

SEQ ID NO: 121248 - DNA, 25 bp, Mus musculus
ggtggaacaacctcgtgcagcagtt

SEQ ID NO: 121249 - DNA, 25 bp, Mus musculus
ggtggaacactacaaattcagctag

SEQ ID NO: 121250 - DNA, 25 bp, Mus musculus
ggtggaagacacaaagctcctcgtg

SEQ ID NO: 121251 - DNA, 25 bp, Mus musculus
ggtggaaggctggaatcgccatgag

SEQ ID NO: 121252 - DNA, 25 bp, Mus musculus
ggtggaatacatcgccctgtcaagg

SEQ ID NO: 121253 - DNA, 25 bp, Mus musculus
ggtggaataccgaagcgacgtcaac

SEQ ID NO: 121254 - DNA, 25 bp, Mus musculus
ggtggaatgctggtcccttcggaaa

SEQ ID NO: 121255 - DNA, 25 bp, Mus musculus
ggtggacaagctgacattaacatct

SEQ ID NO: 121256 - DNA, 25 bp, Mus musculus
ggtggacacatcagtctccaccact

SEQ ID NO: 121257 - DNA, 25 bp, Mus musculus
ggtggacactactcagctccagtgg

SEQ ID NO: 121258 - DNA, 25 bp, Mus musculus
ggtggacactgacatagaacttcga

SEQ ID NO: 121259 - DNA, 25 bp, Mus musculus
ggtggacatctcactctgccagcag

SEQ ID NO: 121260 - DNA, 25 bp, Mus musculus
ggtggacattcaagccgcctaggat

SEQ ID NO: 121261 - DNA, 25 bp, Mus musculus
ggtggacatttctatacaagcagca

SEQ ID NO: 121262 - DNA, 25 bp, Mus musculus
ggtggaccaacatctcatcagcgag

SEQ ID NO: 121263 - DNA, 25 bp, Mus musculus
ggtggaccacatgaacctcctgaag

SEQ ID NO: 121264 - DNA, 25 bp, Mus musculus
ggtggaccctagctaagaacaacag

SEQ ID NO: 121265 - DNA, 25 bp, Mus musculus
ggtggaccggcttcgccatcatctg

SEQ ID NO: 121266 - DNA, 25 bp, Mus musculus
ggtggactctcccagccatgaactg

SEQ ID NO: 121267 - DNA, 25 bp, Mus musculus
ggtggactgcaaccaccccagctga

SEQ ID NO: 121268 - DNA, 25 bp, Mus musculus
ggtggacttctatgcgcgcttctcg

SEQ ID NO: 121269 - DNA, 25 bp, Mus musculus
ggtggagactccaagactgcgcctt

SEQ ID NO: 121270 - DNA, 25 bp, Mus musculus
ggtggagcaccgcatcatagcctgc

SEQ ID NO: 121271 - DNA, 25 bp, Mus musculus
ggtggagccttatatccctgtcaaa

SEQ ID NO: 121272 - DNA, 25 bp, Mus musculus
ggtggagtaaacctcctggctccca

SEQ ID NO: 121273 - DNA, 25 bp, Mus musculus
ggtggagtccatgaccctgtcccag

SEQ ID NO: 121274 - DNA, 25 bp, Mus musculus
ggtggagtcccctgccaaagtgcat

SEQ ID NO: 121275 - DNA, 25 bp, Mus musculus
ggtggatatccatgtcactctgaca

SEQ ID NO: 121276 - DNA, 25 bp, Mus musculus
ggtggattcaaccaaagccaagaag

SEQ ID NO: 121277 - DNA, 25 bp, Mus musculus
ggtggcaacctcctcatcgtcatca

SEQ ID NO: 121278 - DNA, 25 bp, Mus musculus
ggtggcagagccgaaagtagcatcc

SEQ ID NO: 121279 - DNA, 25 bp, Mus musculus
ggtggcagctaatgatggccccatg

SEQ ID NO: 121280 - DNA, 25 bp, Mus musculus
ggtggcaggtcctaccgctgtgtca

SEQ ID NO: 121281 - DNA, 25 bp, Mus musculus
ggtggcatcatcacaccccttgtga

SEQ ID NO: 121282 - DNA, 25 bp, Mus musculus
ggtggcatccagtagcctgcacctg

SEQ ID NO: 121283 - DNA, 25 bp, Mus musculus
ggtggcatgccagatgatgaactgc

SEQ ID NO: 121284 - DNA, 25 bp, Mus musculus
ggtggccaaagacaggcagcttcct

SEQ ID NO: 121285 - DNA, 25 bp, Mus musculus
ggtggccacactgcattacaaaaag

SEQ ID NO: 121286 - DNA, 25 bp, Mus musculus
ggtggccaccaaacagggcaatgct

SEQ ID NO: 121287 - DNA, 25 bp, Mus musculus
ggtggccacccagataacaataagt

SEQ ID NO: 121288 - DNA, 25 bp, Mus musculus
ggtggccaggtgtacataactcgct

SEQ ID NO: 121289 - DNA, 25 bp, Mus musculus
ggtggcccatcccagtcatgtgctc

SEQ ID NO: 121290 - DNA, 25 bp, Mus musculus
ggtggcccctgaatgctgtatgtct

SEQ ID NO: 121291 - DNA, 25 bp, Mus musculus
ggtggccctcttcgagctcctgctt

SEQ ID NO: 121292 - DNA, 25 bp, Mus musculus
ggtggcccttacgaaatcacgggtg

SEQ ID NO: 121293 - DNA, 25 bp, Mus musculus
ggtggccgcagaagctccagcacca

SEQ ID NO: 121294 - DNA, 25 bp, Mus musculus
ggtggccgcgtcatgaaaatcaaca

SEQ ID NO: 121295 - DNA, 25 bp, Mus musculus
ggtggcctagtggttattccctgta

SEQ ID NO: 121296 - DNA, 25 bp, Mus musculus
ggtggcctcgtcctgaaaagtaatg

SEQ ID NO: 121297 - DNA, 25 bp, Mus musculus
ggtggcctgtatcccagagcaagat

SEQ ID NO: 121298 - DNA, 25 bp, Mus musculus
ggtggcgatctttgaaccttcagga

SEQ ID NO: 121299 - DNA, 25 bp, Mus musculus
ggtggcgctaccaacctaaaggtct

SEQ ID NO: 121300 - DNA, 25 bp, Mus musculus
ggtggcggcgaccaatcatctaaag

SEQ ID NO: 121301 - DNA, 25 bp, Mus musculus
ggtggcgttccagctgtttgacaaa

SEQ ID NO: 121302 - DNA, 25 bp, Mus musculus
ggtggcgtttcttccctgcagtgct

SEQ ID NO: 121303 - DNA, 25 bp, Mus musculus
ggtggctataaagccctggccggct

SEQ ID NO: 121304 - DNA, 25 bp, Mus musculus
ggtggctcatgtcgctcttctcaga

SEQ ID NO: 121305 - DNA, 25 bp, Mus musculus
ggtggctcctcaggtgccttcagga

SEQ ID NO: 121306 - DNA, 25 bp, Mus musculus
ggtggctccttaggatcccggcaga

SEQ ID NO: 121307 - DNA, 25 bp, Mus musculus
ggtggctgattctactgagccgaga

SEQ ID NO: 121308 - DNA, 25 bp, Mus musculus
ggtggctgcatcaaccactcgctga

SEQ ID NO: 121309 - DNA, 25 bp, Mus musculus
ggtggctgcctttcccagacttggt

SEQ ID NO: 121310 - DNA, 25 bp, Mus musculus
ggtggctgcttaggtattactgatg

SEQ ID NO: 121311 - DNA, 25 bp, Mus musculus
ggtggcttccattgtctccaagatg

SEQ ID NO: 121312 - DNA, 25 bp, Mus musculus
ggtgggacagtagccagcctttgcc

SEQ ID NO: 121313 - DNA, 25 bp, Mus musculus
ggtgggatccattgaacagaccctg

SEQ ID NO: 121314 - DNA, 25 bp, Mus musculus
ggtgggattgatggagaagccccag

SEQ ID NO: 121315 - DNA, 25 bp, Mus musculus
ggtgggcagaaaagctggcctttca

SEQ ID NO: 121316 - DNA, 25 bp, Mus musculus
ggtgggcgaccttcgagagtccaaa

SEQ ID NO: 121317 - DNA, 25 bp, Mus musculus
ggtgggctactgtttgccattgaca

SEQ ID NO: 121318 - DNA, 25 bp, Mus musculus
ggtgggcttctcctactcggatgac

SEQ ID NO: 121319 - DNA, 25 bp, Mus musculus
ggtggggaacctcagaaattgctca

SEQ ID NO: 121320 - DNA, 25 bp, Mus musculus
ggtggtaaaccatccagactcctcg

SEQ ID NO: 121321 - DNA, 25 bp, Mus musculus
ggtggtaaaccatgacgcatccagc

SEQ ID NO: 121322 - DNA, 25 bp, Mus musculus
ggtggtaaagtactgataaaatgga

SEQ ID NO: 121323 - DNA, 25 bp, Mus musculus
ggtggtaatccccttcctgacagaa

SEQ ID NO: 121324 - DNA, 25 bp, Mus musculus
ggtggtactgcgcaagaagttctcc

SEQ ID NO: 121325 - DNA, 25 bp, Mus musculus
ggtggtatgctcactcatcacaatg

SEQ ID NO: 121326 - DNA, 25 bp, Mus musculus
ggtggtcaaaaacctcgtcctgatc

SEQ ID NO: 121327 - DNA, 25 bp, Mus musculus
ggtggtcaccttcctatgccgggaa

SEQ ID NO: 121328 - DNA, 25 bp, Mus musculus
ggtggtcctggactacatcatccgc

SEQ ID NO: 121329 - DNA, 25 bp, Mus musculus
ggtggtctgcaagccctttggcaat

SEQ ID NO: 121330 - DNA, 25 bp, Mus musculus
ggtggtctggaaatgaagcccctca

SEQ ID NO: 121331 - DNA, 25 bp, Mus musculus
ggtggtcttacagcatcactggcac

SEQ ID NO: 121332 - DNA, 25 bp, Mus musculus
ggtggtctttcacccacgtcccaga

SEQ ID NO: 121333 - DNA, 25 bp, Mus musculus
ggtggtgagagacaatcctgacttc

SEQ ID NO: 121334 - DNA, 25 bp, Mus musculus
ggtggtgcccatcgtccatcaaaag

SEQ ID NO: 121335 - DNA, 25 bp, Mus musculus
ggtggtgcccgccaaaatgtctcac

SEQ ID NO: 121336 - DNA, 25 bp, Mus musculus
ggtggtgcctgctatcgaaaaagac

SEQ ID NO: 121337 - DNA, 25 bp, Mus musculus
ggtggtggaggatgcgcacagagaa

SEQ ID NO: 121338 - DNA, 25 bp, Mus musculus
ggtggtggccacgatgtaatcaaac

SEQ ID NO: 121339 - DNA, 25 bp, Mus musculus
ggtggtggtcaagaaacctcatcca

SEQ ID NO: 121340 - DNA, 25 bp, Mus musculus
ggtggtgtactgagccatctgctgc

SEQ ID NO: 121341 - DNA, 25 bp, Mus musculus
ggtggttaaccaacatctgagtgtc

SEQ ID NO: 121342 - DNA, 25 bp, Mus musculus
ggtggttccctatcggacctcagat

SEQ ID NO: 121343 - DNA, 25 bp, Mus musculus
ggtggttctgaggttatagcaaagc

SEQ ID NO: 121344 - DNA, 25 bp, Mus musculus
ggtgtaatgaatctcaacccagcca

SEQ ID NO: 121345 - DNA, 25 bp, Mus musculus
ggtgtacactcagctcataatggtc

SEQ ID NO: 121346 - DNA, 25 bp, Mus musculus
ggtgtaccaggaaccccaatgctgc

SEQ ID NO: 121347 - DNA, 25 bp, Mus musculus
ggtgtaccctctagtgcaacagcga

SEQ ID NO: 121348 - DNA, 25 bp, Mus musculus
ggtgtactgatcctagcaatactgg

SEQ ID NO: 121349 - DNA, 25 bp, Mus musculus
ggtgtagaatcacagctcccttaag

SEQ ID NO: 121350 - DNA, 25 bp, Mus musculus
ggtgtagactccaacatgtgctgtg

SEQ ID NO: 121351 - DNA, 25 bp, Mus musculus
ggtgtagcctcctttctccagcgag

SEQ ID NO: 121352 - DNA, 25 bp, Mus musculus
ggtgtagtaccctaggcggcttcct

SEQ ID NO: 121353 - DNA, 25 bp, Mus musculus
ggtgtatggaccgaactgcaggaca

SEQ ID NO: 121354 - DNA, 25 bp, Mus musculus
ggtgtatttacctagtggccctcat

SEQ ID NO: 121355 - DNA, 25 bp, Mus musculus
ggtgtcaaacgctgcacaggctcgg

SEQ ID NO: 121356 - DNA, 25 bp, Mus musculus
ggtgtcacacgtgcttccacggaga

SEQ ID NO: 121357 - DNA, 25 bp, Mus musculus
ggtgtcacccgatgttattcctcaa

SEQ ID NO: 121358 - DNA, 25 bp, Mus musculus
ggtgtcagaattcctgcaggaccag

SEQ ID NO: 121359 - DNA, 25 bp, Mus musculus
ggtgtcaggctgaatgtatcctcca

SEQ ID NO: 121360 - DNA, 25 bp, Mus musculus
ggtgtcatacacagtggtatttact

SEQ ID NO: 121361 - DNA, 25 bp, Mus musculus
ggtgtcatcaagctccgttccgtgg

SEQ ID NO: 121362 - DNA, 25 bp, Mus musculus
ggtgtcatcagacagcccagcatgg

SEQ ID NO: 121363 - DNA, 25 bp, Mus musculus
ggtgtccacgcaggcacaattaaca

SEQ ID NO: 121364 - DNA, 25 bp, Mus musculus
ggtgtccatccctctgaacaaggtg

SEQ ID NO: 121365 - DNA, 25 bp, Mus musculus
ggtgtcccaaccatgcgtgagagct

SEQ ID NO: 121366 - DNA, 25 bp, Mus musculus
ggtgtccccgacctggactctgtca

SEQ ID NO: 121367 - DNA, 25 bp, Mus musculus
ggtgtcccctcctaaagcttgtgag

SEQ ID NO: 121368 - DNA, 25 bp, Mus musculus
ggtgtccctaaatgctggctaccac

SEQ ID NO: 121369 - DNA, 25 bp, Mus musculus
ggtgtccctaatggtacagctccag

SEQ ID NO: 121370 - DNA, 25 bp, Mus musculus
ggtgtccctatggtaggtcccactg

SEQ ID NO: 121371 - DNA, 25 bp, Mus musculus
ggtgtccctcccactggcatttgag

SEQ ID NO: 121372 - DNA, 25 bp, Mus musculus
ggtgtccggcctctactacaatggg

SEQ ID NO: 121373 - DNA, 25 bp, Mus musculus
ggtgtctaggaacatcgacgtcccg

SEQ ID NO: 121374 - DNA, 25 bp, Mus musculus
ggtgtctcacccacgggctgtgatg

SEQ ID NO: 121375 - DNA, 25 bp, Mus musculus
ggtgtctccagacaagggctgacaa

SEQ ID NO: 121376 - DNA, 25 bp, Mus musculus
ggtgtctgcacctcatttggcaaga

SEQ ID NO: 121377 - DNA, 25 bp, Mus musculus
ggtgtctgccaagagaagcccttct

SEQ ID NO: 121378 - DNA, 25 bp, Mus musculus
ggtgtctgtgccagatttgcacctg

SEQ ID NO: 121379 - DNA, 25 bp, Mus musculus
ggtgtcttacaccttacagcgccag

SEQ ID NO: 121380 - DNA, 25 bp, Mus musculus
ggtgtcttcttcactgatctgcagc

SEQ ID NO: 121381 - DNA, 25 bp, Mus musculus
ggtgtcttggatcccacagctggca

SEQ ID NO: 121382 - DNA, 25 bp, Mus musculus
ggtgtcttgtacctcagattccaga

SEQ ID NO: 121383 - DNA, 25 bp, Mus musculus
ggtgtctttgtcaacgggcggccac

SEQ ID NO: 121384 - DNA, 25 bp, Mus musculus
ggtgtgaaaagccaaacatcagcca

SEQ ID NO: 121385 - DNA, 25 bp, Mus musculus
ggtgtgaacctccagaaacttctag

SEQ ID NO: 121386 - DNA, 25 bp, Mus musculus
ggtgtgaacttctcccagggctgtt

SEQ ID NO: 121387 - DNA, 25 bp, Mus musculus
ggtgtgacacaaatcctggccatga

SEQ ID NO: 121388 - DNA, 25 bp, Mus musculus
ggtgtgactaaagcccagtgaccct

SEQ ID NO: 121389 - DNA, 25 bp, Mus musculus
ggtgtgagcacgcacattctccttc

SEQ ID NO: 121390 - DNA, 25 bp, Mus musculus
ggtgtgattgtcacgggcctcccat

SEQ ID NO: 121391 - DNA, 25 bp, Mus musculus
ggtgtgcactgcgacttccaccaag

SEQ ID NO: 121392 - DNA, 25 bp, Mus musculus
ggtgtgcggctctactacatcggag

SEQ ID NO: 121393 - DNA, 25 bp, Mus musculus
ggtgtggacaacaaagaccttcagg

SEQ ID NO: 121394 - DNA, 25 bp, Mus musculus
ggtgtggccgctgtctacttgttcg

SEQ ID NO: 121395 - DNA, 25 bp, Mus musculus
ggtgtgggatccaccataaactggg

SEQ ID NO: 121396 - DNA, 25 bp, Mus musculus
ggtgtggtccaaactagtcctatgc

SEQ ID NO: 121397 - DNA, 25 bp, Mus musculus
ggtgtgtatacctgttacgccatgg

SEQ ID NO: 121398 - DNA, 25 bp, Mus musculus
ggtgtgtatatgagccagccagccc

SEQ ID NO: 121399 - DNA, 25 bp, Mus musculus
ggtgtgtccaccacagacctcgtgg

SEQ ID NO: 121400 - DNA, 25 bp, Mus musculus
ggtgtgttactaagctggagagcat

SEQ ID NO: 121401 - DNA, 25 bp, Mus musculus
ggtgtgttcagctcagacttccagg

SEQ ID NO: 121402 - DNA, 25 bp, Mus musculus
ggtgttaaaatatactgtccctgag

SEQ ID NO: 121403 - DNA, 25 bp, Mus musculus
ggtgttaaacccatgaagagcaagc

SEQ ID NO: 121404 - DNA, 25 bp, Mus musculus
ggtgttactctaaaagccatccttc

SEQ ID NO: 121405 - DNA, 25 bp, Mus musculus
ggtgttatccttccacgacagcctc

SEQ ID NO: 121406 - DNA, 25 bp, Mus musculus
ggtgttatttcaccaggactggctg

SEQ ID NO: 121407 - DNA, 25 bp, Mus musculus
ggtgttcatagttcccagccctggg

SEQ ID NO: 121408 - DNA, 25 bp, Mus musculus
ggtgttcattcatgcctaccagctg

SEQ ID NO: 121409 - DNA, 25 bp, Mus musculus
ggtgttccatcaggccacaagagat

SEQ ID NO: 121410 - DNA, 25 bp, Mus musculus
ggtgttctaggcatgggctttcccg

SEQ ID NO: 121411 - DNA, 25 bp, Mus musculus
ggtgttctccccttcatttggctaa

SEQ ID NO: 121412 - DNA, 25 bp, Mus musculus
ggtgttctctacttcactgggagtg

SEQ ID NO: 121413 - DNA, 25 bp, Mus musculus
ggtgttctgtaatggcgccgtgccc

SEQ ID NO: 121414 - DNA, 25 bp, Mus musculus
ggtgttcttggagcgcttccgcaca

SEQ ID NO: 121415 - DNA, 25 bp, Mus musculus
ggtgttgagcgacctgactaccaag

SEQ ID NO: 121416 - DNA, 25 bp, Mus musculus
ggtgttgcccaacctagaatgcatg

SEQ ID NO: 121417 - DNA, 25 bp, Mus musculus
ggtgttgccgggacatggcatttct

SEQ ID NO: 121418 - DNA, 25 bp, Mus musculus
ggtgttggctacgaacctggcagct

SEQ ID NO: 121419 - DNA, 25 bp, Mus musculus
ggtgtttaaaccaagcgacgttctg

SEQ ID NO: 121420 - DNA, 25 bp, Mus musculus
ggtgtttggcatctaccttctacga

SEQ ID NO: 121421 - DNA, 25 bp, Mus musculus
ggtgttttgaaactcactaaaatgg

SEQ ID NO: 121422 - DNA, 25 bp, Mus musculus
ggtgttttgaatatgttcaggtcca

SEQ ID NO: 121423 - DNA, 25 bp, Mus musculus
ggtgtttttacaggccaccgacgtg

SEQ ID NO: 121424 - DNA, 25 bp, Mus musculus
ggttaaaccccaagcatcctactgg

SEQ ID NO: 121425 - DNA, 25 bp, Mus musculus
ggttaaaggcgcaaagctcatcctg

SEQ ID NO: 121426 - DNA, 25 bp, Mus musculus
ggttaacactacagcgccttttgca

SEQ ID NO: 121427 - DNA, 25 bp, Mus musculus
ggttaaccaaactcagcagcagatg

SEQ ID NO: 121428 - DNA, 25 bp, Mus musculus
ggttaaccctagcaaggtctccagg

SEQ ID NO: 121429 - DNA, 25 bp, Mus musculus
ggttaactggttcccatcctccgag

SEQ ID NO: 121430 - DNA, 25 bp, Mus musculus
ggttaagaccaccaagactaaatga

SEQ ID NO: 121431 - DNA, 25 bp, Mus musculus
ggttaagcagtacagccccaaaatg

SEQ ID NO: 121432 - DNA, 25 bp, Mus musculus
ggttaaggaggtctgtctgcacccc

SEQ ID NO: 121433 - DNA, 25 bp, Mus musculus
ggttaagtcggtttgagcctcctca

SEQ ID NO: 121434 - DNA, 25 bp, Mus musculus
ggttaagtctaagaacagaagggtg

SEQ ID NO: 121435 - DNA, 25 bp, Mus musculus
ggttaagtgactcatggcagtgctc

SEQ ID NO: 121436 - DNA, 25 bp, Mus musculus
ggttaatacctgagtcggccgctga

SEQ ID NO: 121437 - DNA, 25 bp, Mus musculus
ggttaatatgtccacgatgagtgca

SEQ ID NO: 121438 - DNA, 25 bp, Mus musculus
ggttaatccacacccggagttccag

SEQ ID NO: 121439 - DNA, 25 bp, Mus musculus
ggttacaagtcagtccagcctgggc

SEQ ID NO: 121440 - DNA, 25 bp, Mus musculus
ggttacagagggaagcagctcagcc

SEQ ID NO: 121441 - DNA, 25 bp, Mus musculus
ggttacatcaactgccgggacctgg

SEQ ID NO: 121442 - DNA, 25 bp, Mus musculus
ggttacatgccctacctcaacaagt

SEQ ID NO: 121443 - DNA, 25 bp, Mus musculus
ggttacatgttatctcagggctctg

SEQ ID NO: 121444 - DNA, 25 bp, Mus musculus
ggttaccacatggaacaccacgact

SEQ ID NO: 121445 - DNA, 25 bp, Mus musculus
ggttaccacggaagagcaggtcctg

SEQ ID NO: 121446 - DNA, 25 bp, Mus musculus
ggttaccaggaagcacagtacttac

SEQ ID NO: 121447 - DNA, 25 bp, Mus musculus
ggttaccctgacaagcctcctctat

SEQ ID NO: 121448 - DNA, 25 bp, Mus musculus
ggttaccctgccactcagtctatga

SEQ ID NO: 121449 - DNA, 25 bp, Mus musculus
ggttaccgtgagtgttggccttacg

SEQ ID NO: 121450 - DNA, 25 bp, Mus musculus
ggttacctctacatctgtcaatggg

SEQ ID NO: 121451 - DNA, 25 bp, Mus musculus
ggttacctggacgactgtacctgtg

SEQ ID NO: 121452 - DNA, 25 bp, Mus musculus
ggttactagcaatcacacatgtttg

SEQ ID NO: 121453 - DNA, 25 bp, Mus musculus
ggttactgcagctgatccaggcggc

SEQ ID NO: 121454 - DNA, 25 bp, Mus musculus
ggttagaacacccattcagcggctt

SEQ ID NO: 121455 - DNA, 25 bp, Mus musculus
ggttagagccctggcgaaggcacta

SEQ ID NO: 121456 - DNA, 25 bp, Mus musculus
ggttagagccgatgacacacctgag

SEQ ID NO: 121457 - DNA, 25 bp, Mus musculus
ggttagatccccatgctctggctgg

SEQ ID NO: 121458 - DNA, 25 bp, Mus musculus
ggttagatccttgcacagtcataga

SEQ ID NO: 121459 - DNA, 25 bp, Mus musculus
ggttagatggcgagaaccctcagca

SEQ ID NO: 121460 - DNA, 25 bp, Mus musculus
ggttagcaatcagtggtcccctgtt

SEQ ID NO: 121461 - DNA, 25 bp, Mus musculus
ggttagcagaatgactcgacactcg

SEQ ID NO: 121462 - DNA, 25 bp, Mus musculus
ggttagccaaactgcagcacaggtg

SEQ ID NO: 121463 - DNA, 25 bp, Mus musculus
ggttaggaatctacacatcagggaa

SEQ ID NO: 121464 - DNA, 25 bp, Mus musculus
ggttaggacactccagagctccagt

SEQ ID NO: 121465 - DNA, 25 bp, Mus musculus
ggttagtctactccatatggcccag

SEQ ID NO: 121466 - DNA, 25 bp, Mus musculus
ggttataccaacctttgacatggct

SEQ ID NO: 121467 - DNA, 25 bp, Mus musculus
ggttatagcaaagctcaaattctga

SEQ ID NO: 121468 - DNA, 25 bp, Mus musculus
ggttatagttcatgcacagccagcc

SEQ ID NO: 121469 - DNA, 25 bp, Mus musculus
ggttatcaaccaacccctggatgtg

SEQ ID NO: 121470 - DNA, 25 bp, Mus musculus
ggttatcacagaactcgctcctcag

SEQ ID NO: 121471 - DNA, 25 bp, Mus musculus
ggttatcatgccagaagccagcatt

SEQ ID NO: 121472 - DNA, 25 bp, Mus musculus
ggttatccccgaaacatctccgaag

SEQ ID NO: 121473 - DNA, 25 bp, Mus musculus
ggttatctcggacaccacgaagctg

SEQ ID NO: 121474 - DNA, 25 bp, Mus musculus
ggttatctctactgctcaaggccca

SEQ ID NO: 121475 - DNA, 25 bp, Mus musculus
ggttatctgcatgcaactcaagaga

SEQ ID NO: 121476 - DNA, 25 bp, Mus musculus
ggttatgaagactaccggcacgcgc

SEQ ID NO: 121477 - DNA, 25 bp, Mus musculus
ggttatgaccccatccaccagtgac

SEQ ID NO: 121478 - DNA, 25 bp, Mus musculus
ggttatggacactacccagtgggca

SEQ ID NO: 121479 - DNA, 25 bp, Mus musculus
ggttatggctcctcagcacctgcct

SEQ ID NO: 121480 - DNA, 25 bp, Mus musculus
ggttattcccaattgtcagttcaga

SEQ ID NO: 121481 - DNA, 25 bp, Mus musculus
ggttcaaaaccacgtgaccatgtaa

SEQ ID NO: 121482 - DNA, 25 bp, Mus musculus
ggttcaaaactatggataataatgg

SEQ ID NO: 121483 - DNA, 25 bp, Mus musculus
ggttcaaccgttagtcagctgcagg

SEQ ID NO: 121484 - DNA, 25 bp, Mus musculus
ggttcaacgtcagaaatggatatgg

SEQ ID NO: 121485 - DNA, 25 bp, Mus musculus
ggttcaactgtattcgcgcggccat

SEQ ID NO: 121486 - DNA, 25 bp, Mus musculus
ggttcaagcgccacagtattgctat

SEQ ID NO: 121487 - DNA, 25 bp, Mus musculus
ggttcaagctaccagataagccggc

SEQ ID NO: 121488 - DNA, 25 bp, Mus musculus
ggttcaataggagatggctggccac

SEQ ID NO: 121489 - DNA, 25 bp, Mus musculus
ggttcaatatgagcacgccagctgt

SEQ ID NO: 121490 - DNA, 25 bp, Mus musculus
ggttcaatcagaaactgttccggca

SEQ ID NO: 121491 - DNA, 25 bp, Mus musculus
ggttcaatcccagtatcagcatgat

SEQ ID NO: 121492 - DNA, 25 bp, Mus musculus
ggttcacaagtgcacacttggagca

SEQ ID NO: 121493 - DNA, 25 bp, Mus musculus
ggttcacacagcgatgcagacagga

SEQ ID NO: 121494 - DNA, 25 bp, Mus musculus
ggttcacagacagacttaatcggga

SEQ ID NO: 121495 - DNA, 25 bp, Mus musculus
ggttcacagtgttggagcgctatca

SEQ ID NO: 121496 - DNA, 25 bp, Mus musculus
ggttcaccatggatgaccgaaggct

SEQ ID NO: 121497 - DNA, 25 bp, Mus musculus
ggttcacccacagcagataaaaagg

SEQ ID NO: 121498 - DNA, 25 bp, Mus musculus
ggttcacctctaccgaaatggcaag

SEQ ID NO: 121499 - DNA, 25 bp, Mus musculus
ggttcactggaacaccaaatatggg

SEQ ID NO: 121500 - DNA, 25 bp, Mus musculus
ggttcagcaattctcggtttactcc

SEQ ID NO: 121501 - DNA, 25 bp, Mus musculus
ggttcagccaaacactgagggacat

SEQ ID NO: 121502 - DNA, 25 bp, Mus musculus
ggttcagcccctaccatcgtagacg

SEQ ID NO: 121503 - DNA, 25 bp, Mus musculus
ggttcagctgaaactagtgcgtcct

SEQ ID NO: 121504 - DNA, 25 bp, Mus musculus
ggttcaggaaaagaagcggcatcac

SEQ ID NO: 121505 - DNA, 25 bp, Mus musculus
ggttcaggataagacagaagtgctg

SEQ ID NO: 121506 - DNA, 25 bp, Mus musculus
ggttcaggtccctccaggactctgg

SEQ ID NO: 121507 - DNA, 25 bp, Mus musculus
ggttcagtctccgtgaagcgtttgc

SEQ ID NO: 121508 - DNA, 25 bp, Mus musculus
ggttcagtctttatctttacccaga

SEQ ID NO: 121509 - DNA, 25 bp, Mus musculus
ggttcatatatccagagtcaagtca

SEQ ID NO: 121510 - DNA, 25 bp, Mus musculus
ggttcatccttgagactcatctgct

SEQ ID NO: 121511 - DNA, 25 bp, Mus musculus
ggttcatgaaataagcctgtgcttc

SEQ ID NO: 121512 - DNA, 25 bp, Mus musculus
ggttcatgcactgattcatccagct

SEQ ID NO: 121513 - DNA, 25 bp, Mus musculus
ggttcatggaccgagcgcccagctt

SEQ ID NO: 121514 - DNA, 25 bp, Mus musculus
ggttcattcccacacaagactgatt

SEQ ID NO: 121515 - DNA, 25 bp, Mus musculus
ggttcattgatagacacgctccaca

SEQ ID NO: 121516 - DNA, 25 bp, Mus musculus
ggttcattgtacacatctcaggctg

SEQ ID NO: 121517 - DNA, 25 bp, Mus musculus
ggttcatttacctgctgcatggcgg

SEQ ID NO: 121518 - DNA, 25 bp, Mus musculus
ggttccaagccttcagcatcgcact

SEQ ID NO: 121519 - DNA, 25 bp, Mus musculus
ggttccacgcggactctgtgtgcaa

SEQ ID NO: 121520 - DNA, 25 bp, Mus musculus
ggttccacggccgttgagtacgcgt

SEQ ID NO: 121521 - DNA, 25 bp, Mus musculus
ggttccactcccagaaggcaaaatt

SEQ ID NO: 121522 - DNA, 25 bp, Mus musculus
ggttccagaaaaacgagcctcagct

SEQ ID NO: 121523 - DNA, 25 bp, Mus musculus
ggttccaggatgcatcgcgttcagc

SEQ ID NO: 121524 - DNA, 25 bp, Mus musculus
ggttccaggcatcatcacagtcata

SEQ ID NO: 121525 - DNA, 25 bp, Mus musculus
ggttccaggttctcaacgccattga

SEQ ID NO: 121526 - DNA, 25 bp, Mus musculus
ggttccagtcccagttatccgagtt

SEQ ID NO: 121527 - DNA, 25 bp, Mus musculus
ggttcccaccagaaagagatcatga

SEQ ID NO: 121528 - DNA, 25 bp, Mus musculus
ggttcccagaaaagtctacgacgtg

SEQ ID NO: 121529 - DNA, 25 bp, Mus musculus
ggttcccaggaaatgtttgcccaga

SEQ ID NO: 121530 - DNA, 25 bp, Mus musculus
ggttccccattagttatttgaagtg

SEQ ID NO: 121531 - DNA, 25 bp, Mus musculus
ggttcccctcaacatacccaaggat

SEQ ID NO: 121532 - DNA, 25 bp, Mus musculus
ggttcccctgcagaccagacttggt

SEQ ID NO: 121533 - DNA, 25 bp, Mus musculus
ggttcccgacattcacccacattta

SEQ ID NO: 121534 - DNA, 25 bp, Mus musculus
ggttccctgaaacgtgaccatgtgg

SEQ ID NO: 121535 - DNA, 25 bp, Mus musculus
ggttccctgatgtcattaaacatct

SEQ ID NO: 121536 - DNA, 25 bp, Mus musculus
ggttccctgctctacctgacactgg

SEQ ID NO: 121537 - DNA, 25 bp, Mus musculus
ggttcctaaacatacttgtgagtag

SEQ ID NO: 121538 - DNA, 25 bp, Mus musculus
ggttcctacaattcccatcacaaag

SEQ ID NO: 121539 - DNA, 25 bp, Mus musculus
ggttcctactttgcgtggtcacaag

SEQ ID NO: 121540 - DNA, 25 bp, Mus musculus
ggttcctctttacataacggcgtgg

SEQ ID NO: 121541 - DNA, 25 bp, Mus musculus
ggttcctgaaatgacagaaatactg

SEQ ID NO: 121542 - DNA, 25 bp, Mus musculus
ggttcctgaacccatgacataatca

SEQ ID NO: 121543 - DNA, 25 bp, Mus musculus
ggttcctgagtgtgtcgccttgagc

SEQ ID NO: 121544 - DNA, 25 bp, Mus musculus
ggttcctgcaccaacctggaagggt

SEQ ID NO: 121545 - DNA, 25 bp, Mus musculus
ggttcctgcacctaaaacacctggg

SEQ ID NO: 121546 - DNA, 25 bp, Mus musculus
ggttcctgccggacaggtccagtct

SEQ ID NO: 121547 - DNA, 25 bp, Mus musculus
ggttcctgctggacttcatctcctg

SEQ ID NO: 121548 - DNA, 25 bp, Mus musculus
ggttcctggaaaacatgccgtagtt

SEQ ID NO: 121549 - DNA, 25 bp, Mus musculus
ggttccttgaaaagcatcaggtaca

SEQ ID NO: 121550 - DNA, 25 bp, Mus musculus
ggttccttgcttttgacggatgcaa

SEQ ID NO: 121551 - DNA, 25 bp, Mus musculus
ggttcgactcagagcgtctcaggca

SEQ ID NO: 121552 - DNA, 25 bp, Mus musculus
ggttcgagagcatcacccagagaat

SEQ ID NO: 121553 - DNA, 25 bp, Mus musculus
ggttcgcacgctttgtgagcgcaca

SEQ ID NO: 121554 - DNA, 25 bp, Mus musculus
ggttcgctatgtcggatgacgattc

SEQ ID NO: 121555 - DNA, 25 bp, Mus musculus
ggttcggatgtaagtcgaggcccaa

SEQ ID NO: 121556 - DNA, 25 bp, Mus musculus
ggttcggcctatgtctcactacacg

SEQ ID NO: 121557 - DNA, 25 bp, Mus musculus
ggttcggcgcctttcctcttcctgg

SEQ ID NO: 121558 - DNA, 25 bp, Mus musculus
ggttcgtgactgtaacaagccctcg

SEQ ID NO: 121559 - DNA, 25 bp, Mus musculus
ggttcgtggatatccctcagcaaga

SEQ ID NO: 121560 - DNA, 25 bp, Mus musculus
ggttctacctggataacgccatcgg

SEQ ID NO: 121561 - DNA, 25 bp, Mus musculus
ggttctatagatggtaataaccaac

SEQ ID NO: 121562 - DNA, 25 bp, Mus musculus
ggttctcagaggtctgttttctccc

SEQ ID NO: 121563 - DNA, 25 bp, Mus musculus
ggttctcaggccacctatccagatg

SEQ ID NO: 121564 - DNA, 25 bp, Mus musculus
ggttctcattccttgcgccataggg

SEQ ID NO: 121565 - DNA, 25 bp, Mus musculus
ggttctccaagcaaataagcacggg

SEQ ID NO: 121566 - DNA, 25 bp, Mus musculus
ggttctccacatgcggatcagttgg

SEQ ID NO: 121567 - DNA, 25 bp, Mus musculus
ggttctccaggaaaagcttcaagct

SEQ ID NO: 121568 - DNA, 25 bp, Mus musculus
ggttctcccagaccaaagaatttca

SEQ ID NO: 121569 - DNA, 25 bp, Mus musculus
ggttctcctcaccatggttcccgga

SEQ ID NO: 121570 - DNA, 25 bp, Mus musculus
ggttctcctgtggacactgctatag

SEQ ID NO: 121571 - DNA, 25 bp, Mus musculus
ggttctcggagcttgaaaagccaca

SEQ ID NO: 121572 - DNA, 25 bp, Mus musculus
ggttctctcgcctctggacacagtg

SEQ ID NO: 121573 - DNA, 25 bp, Mus musculus
ggttctctgccttctggacatctgg

SEQ ID NO: 121574 - DNA, 25 bp, Mus musculus
ggttctctgtccaaatcctgcggaa

SEQ ID NO: 121575 - DNA, 25 bp, Mus musculus
ggttctcttacatcgaccgcctaag

SEQ ID NO: 121576 - DNA, 25 bp, Mus musculus
ggttctgaaagcaacggccggactc

SEQ ID NO: 121577 - DNA, 25 bp, Mus musculus
ggttctgaaccagcaggcctacgtg

SEQ ID NO: 121578 - DNA, 25 bp, Mus musculus
ggttctgaagtacttgtgccctgca

SEQ ID NO: 121579 - DNA, 25 bp, Mus musculus
ggttctgcaatcgacgccaaaagga

SEQ ID NO: 121580 - DNA, 25 bp, Mus musculus
ggttctgccctatttgtcacaggag

SEQ ID NO: 121581 - DNA, 25 bp, Mus musculus
ggttctgcgacccaaagagtccagg

SEQ ID NO: 121582 - DNA, 25 bp, Mus musculus
ggttctgtacagcatcgccgaaaag

SEQ ID NO: 121583 - DNA, 25 bp, Mus musculus
ggttctgtcatctcggaagcccaca

SEQ ID NO: 121584 - DNA, 25 bp, Mus musculus
ggttcttacagacatcgagcagttc

SEQ ID NO: 121585 - DNA, 25 bp, Mus musculus
ggttcttcaaccagctcttctcagg

SEQ ID NO: 121586 - DNA, 25 bp, Mus musculus
ggttcttcgagcctcaaagggtcag

SEQ ID NO: 121587 - DNA, 25 bp, Mus musculus
ggttcttctccgtgtacctgcgcaa

SEQ ID NO: 121588 - DNA, 25 bp, Mus musculus
ggttcttgacattggcactggcaca

SEQ ID NO: 121589 - DNA, 25 bp, Mus musculus
ggttctttcacagtctactcctgga

SEQ ID NO: 121590 - DNA, 25 bp, Mus musculus
ggttctttggccaagctctgagcat

SEQ ID NO: 121591 - DNA, 25 bp, Mus musculus
ggttgaaaactagctgaatccagag

SEQ ID NO: 121592 - DNA, 25 bp, Mus musculus
ggttgaacagcttcgcctggagaga

SEQ ID NO: 121593 - DNA, 25 bp, Mus musculus
ggttgaactcctctaccatgtggaa

SEQ ID NO: 121594 - DNA, 25 bp, Mus musculus
ggttgaactgtccaaatcccaggat

SEQ ID NO: 121595 - DNA, 25 bp, Mus musculus
ggttgaagaccatcccgtcagagat

SEQ ID NO: 121596 - DNA, 25 bp, Mus musculus
ggttgacaagacaggagcctcctac

SEQ ID NO: 121597 - DNA, 25 bp, Mus musculus
ggttgacaatagctcctgggccagc

SEQ ID NO: 121598 - DNA, 25 bp, Mus musculus
ggttgacaccccatctctgcaagaa

SEQ ID NO: 121599 - DNA, 25 bp, Mus musculus
ggttgactcctatcgacagcagcag

SEQ ID NO: 121600 - DNA, 25 bp, Mus musculus
ggttgagaaactaaagccctgcaca

SEQ ID NO: 121601 - DNA, 25 bp, Mus musculus
ggttgagaggcagctactcccctca

SEQ ID NO: 121602 - DNA, 25 bp, Mus musculus
ggttgagatcaaacagaaactcggc

SEQ ID NO: 121603 - DNA, 25 bp, Mus musculus
ggttgagcattcaccctgtggcttc

SEQ ID NO: 121604 - DNA, 25 bp, Mus musculus
ggttgaggtcttcacacagttcagt

SEQ ID NO: 121605 - DNA, 25 bp, Mus musculus
ggttgatgctggaaaagagcctcca

SEQ ID NO: 121606 - DNA, 25 bp, Mus musculus
ggttgcaaatgtctcagaaccagag

SEQ ID NO: 121607 - DNA, 25 bp, Mus musculus
ggttgcaagagaagaacggctgcca

SEQ ID NO: 121608 - DNA, 25 bp, Mus musculus
ggttgcacacaaggatgagtctgac

SEQ ID NO: 121609 - DNA, 25 bp, Mus musculus
ggttgcactgtttgaggctatgaaa

SEQ ID NO: 121610 - DNA, 25 bp, Mus musculus
ggttgcagaacgagatgaggctcaa

SEQ ID NO: 121611 - DNA, 25 bp, Mus musculus
ggttgcagaagaggtagaccacgct

SEQ ID NO: 121612 - DNA, 25 bp, Mus musculus
ggttgcatgttggaaaagttaccac

SEQ ID NO: 121613 - DNA, 25 bp, Mus musculus
ggttgcattcccatcccactgtgtg

SEQ ID NO: 121614 - DNA, 25 bp, Mus musculus
ggttgccatctattgacccatcagg

SEQ ID NO: 121615 - DNA, 25 bp, Mus musculus
ggttgccgcaccgtacatcgagaaa

SEQ ID NO: 121616 - DNA, 25 bp, Mus musculus
ggttgccttagctccgatccacgag

SEQ ID NO: 121617 - DNA, 25 bp, Mus musculus
ggttgcggtcaacgatgctcaccta

SEQ ID NO: 121618 - DNA, 25 bp, Mus musculus
ggttgctaagagaccaagatcccct

SEQ ID NO: 121619 - DNA, 25 bp, Mus musculus
ggttgctgctgaagagtcccgatag

SEQ ID NO: 121620 - DNA, 25 bp, Mus musculus
ggttgctgtcggaggcctttgtcat

SEQ ID NO: 121621 - DNA, 25 bp, Mus musculus
ggttggaaacagagcctacagagtc

SEQ ID NO: 121622 - DNA, 25 bp, Mus musculus
ggttggaaataaataacggtgatgg

SEQ ID NO: 121623 - DNA, 25 bp, Mus musculus
ggttggaagtggatccacgagccca

SEQ ID NO: 121624 - DNA, 25 bp, Mus musculus
ggttggaccccgctgagccttactt

SEQ ID NO: 121625 - DNA, 25 bp, Mus musculus
ggttggcaccacttaagtgaccgaa

SEQ ID NO: 121626 - DNA, 25 bp, Mus musculus
ggttggccccagatttgagtctcgc

SEQ ID NO: 121627 - DNA, 25 bp, Mus musculus
ggttggcctctacaccatgaactga

SEQ ID NO: 121628 - DNA, 25 bp, Mus musculus
ggttgggagctatcttaaccctcca

SEQ ID NO: 121629 - DNA, 25 bp, Mus musculus
ggttgggatttttctggagatacgg

SEQ ID NO: 121630 - DNA, 25 bp, Mus musculus
ggttgggtcccagccacatgatgaa

SEQ ID NO: 121631 - DNA, 25 bp, Mus musculus
ggttgggttacaactcagtctccag

SEQ ID NO: 121632 - DNA, 25 bp, Mus musculus
ggttggtaaaggcttctccctagtg

SEQ ID NO: 121633 - DNA, 25 bp, Mus musculus
ggttgtatcccctgcagaaaaagct

SEQ ID NO: 121634 - DNA, 25 bp, Mus musculus
ggttgtcaccataccagcatacggt

SEQ ID NO: 121635 - DNA, 25 bp, Mus musculus
ggttgtcagcataggtgatcttttt

SEQ ID NO: 121636 - DNA, 25 bp, Mus musculus
ggttgtcaggagacactcgggtccc

SEQ ID NO: 121637 - DNA, 25 bp, Mus musculus
ggttgtcatccaaagttgccctggc

SEQ ID NO: 121638 - DNA, 25 bp, Mus musculus
ggttgtccagtcgtcaccagtagtg

SEQ ID NO: 121639 - DNA, 25 bp, Mus musculus
ggttgtctgcctgatcgccttcaca

SEQ ID NO: 121640 - DNA, 25 bp, Mus musculus
ggttgtgaccagtgaacaccttgaa

SEQ ID NO: 121641 - DNA, 25 bp, Mus musculus
ggttgtgacttgtgggcgctttcaa

SEQ ID NO: 121642 - DNA, 25 bp, Mus musculus
ggttgtggccacagctaagattata

SEQ ID NO: 121643 - DNA, 25 bp, Mus musculus
ggttgtggccttaccccaggtgaag

SEQ ID NO: 121644 - DNA, 25 bp, Mus musculus
ggttgttcagttacttccaaaggag

SEQ ID NO: 121645 - DNA, 25 bp, Mus musculus
ggttgttgatgacacagcctgccca

SEQ ID NO: 121646 - DNA, 25 bp, Mus musculus
ggttgttgctgtcccagagtcgcca

SEQ ID NO: 121647 - DNA, 25 bp, Mus musculus
ggtttaaacccatcgagcagctgct

SEQ ID NO: 121648 - DNA, 25 bp, Mus musculus
ggtttaagccacactgcagatggcg

SEQ ID NO: 121649 - DNA, 25 bp, Mus musculus
ggtttacaagcaagccacgattgag

SEQ ID NO: 121650 - DNA, 25 bp, Mus musculus
ggtttaccacccaagtggagtcgca

SEQ ID NO: 121651 - DNA, 25 bp, Mus musculus
ggtttacccacctacaccgactgtg

SEQ ID NO: 121652 - DNA, 25 bp, Mus musculus
ggtttactcaaagggccaaaggcat

SEQ ID NO: 121653 - DNA, 25 bp, Mus musculus
ggtttactcctcacgcagagatgga

SEQ ID NO: 121654 - DNA, 25 bp, Mus musculus
ggtttagacgcctctgctagctgga

SEQ ID NO: 121655 - DNA, 25 bp, Mus musculus
ggtttagactggttggaccccacat

SEQ ID NO: 121656 - DNA, 25 bp, Mus musculus
ggtttataaaatcgacatgccgtcc

SEQ ID NO: 121657 - DNA, 25 bp, Mus musculus
ggtttatctgttagcggcccctgtg

SEQ ID NO: 121658 - DNA, 25 bp, Mus musculus
ggtttatgcgtacaccagacccgat

SEQ ID NO: 121659 - DNA, 25 bp, Mus musculus
ggtttattataaggcggagctccgc

SEQ ID NO: 121660 - DNA, 25 bp, Mus musculus
ggtttcaaaactgccgagcgcgtca

SEQ ID NO: 121661 - DNA, 25 bp, Mus musculus
ggtttcaaagataacctccatgctg

SEQ ID NO: 121662 - DNA, 25 bp, Mus musculus
ggtttcacaccagcctgtagcaggg

SEQ ID NO: 121663 - DNA, 25 bp, Mus musculus
ggtttcacagaggacgctatggttc

SEQ ID NO: 121664 - DNA, 25 bp, Mus musculus
ggtttcaccccgtcagaagctagca

SEQ ID NO: 121665 - DNA, 25 bp, Mus musculus
ggtttcaggcccacttgcaggaggt

SEQ ID NO: 121666 - DNA, 25 bp, Mus musculus
ggtttcatcttaaatagcccagcat

SEQ ID NO: 121667 - DNA, 25 bp, Mus musculus
ggtttccaccagaacgcaaggcagt

SEQ ID NO: 121668 - DNA, 25 bp, Mus musculus
ggtttccagaccagaaagagattaa

SEQ ID NO: 121669 - DNA, 25 bp, Mus musculus
ggtttcccaaaactatgctctatgg

SEQ ID NO: 121670 - DNA, 25 bp, Mus musculus
ggtttcccatcaggctacaggctgg

SEQ ID NO: 121671 - DNA, 25 bp, Mus musculus
ggtttcccatttcctaagcaagcat

SEQ ID NO: 121672 - DNA, 25 bp, Mus musculus
ggtttccccgctgatacctgagcag

SEQ ID NO: 121673 - DNA, 25 bp, Mus musculus
ggtttcccgagagccagacaaattg

SEQ ID NO: 121674 - DNA, 25 bp, Mus musculus
ggtttccctacataacagtcctgac

SEQ ID NO: 121675 - DNA, 25 bp, Mus musculus
ggtttccctacgagaaagtggtgca

SEQ ID NO: 121676 - DNA, 25 bp, Mus musculus
ggtttccgttcagacagaggccagt

SEQ ID NO: 121677 - DNA, 25 bp, Mus musculus
ggtttcctaccctcctcagagtgag

SEQ ID NO: 121678 - DNA, 25 bp, Mus musculus
ggtttcctgtattgagttatcccag

SEQ ID NO: 121679 - DNA, 25 bp, Mus musculus
ggtttcctgtgaggctcgtacctga

SEQ ID NO: 121680 - DNA, 25 bp, Mus musculus
ggtttcctttgcaccactagtacag

SEQ ID NO: 121681 - DNA, 25 bp, Mus musculus
ggtttcctttgtgcctctcagtctc

SEQ ID NO: 121682 - DNA, 25 bp, Mus musculus
ggtttcggcatctccccagtcttga

SEQ ID NO: 121683 - DNA, 25 bp, Mus musculus
ggtttcgtgttgacttgcccattaa

SEQ ID NO: 121684 - DNA, 25 bp, Mus musculus
ggtttctaacgacacctactgggag

SEQ ID NO: 121685 - DNA, 25 bp, Mus musculus
ggtttctcgagtgggtcattcccca

SEQ ID NO: 121686 - DNA, 25 bp, Mus musculus
ggtttctgagccagctatgggccac

SEQ ID NO: 121687 - DNA, 25 bp, Mus musculus
ggtttctgggagatctgcaccttca

SEQ ID NO: 121688 - DNA, 25 bp, Mus musculus
ggtttcttagtcctgtactgcccga

SEQ ID NO: 121689 - DNA, 25 bp, Mus musculus
ggtttgaacaccagtcacgagtccg

SEQ ID NO: 121690 - DNA, 25 bp, Mus musculus
ggtttgaacgctacgcccgtgcccg

SEQ ID NO: 121691 - DNA, 25 bp, Mus musculus
ggtttgaacgctttggaccagacaa

SEQ ID NO: 121692 - DNA, 25 bp, Mus musculus
ggtttgaatctccagactcgcaggc

SEQ ID NO: 121693 - DNA, 25 bp, Mus musculus
ggtttgagccgcttcaagagacaaa

SEQ ID NO: 121694 - DNA, 25 bp, Mus musculus
ggtttgataaagacgccccagagga

SEQ ID NO: 121695 - DNA, 25 bp, Mus musculus
ggtttgcagaaagcacctaccccaa

SEQ ID NO: 121696 - DNA, 25 bp, Mus musculus
ggtttgccacaggaatatcaagaga

SEQ ID NO: 121697 - DNA, 25 bp, Mus musculus
ggtttgccgcagttctaagtcccac

SEQ ID NO: 121698 - DNA, 25 bp, Mus musculus
ggtttgctatcttctgactacgtgg

SEQ ID NO: 121699 - DNA, 25 bp, Mus musculus
ggtttgctgatgaaacagccatgct

SEQ ID NO: 121700 - DNA, 25 bp, Mus musculus
ggtttggacctcctgttaacagctt

SEQ ID NO: 121701 - DNA, 25 bp, Mus musculus
ggtttggctaccatcgaacacacag

SEQ ID NO: 121702 - DNA, 25 bp, Mus musculus
ggtttgggccacatgaacatcacac

SEQ ID NO: 121703 - DNA, 25 bp, Mus musculus
ggtttgggcgcctctcgcattgcag

SEQ ID NO: 121704 - DNA, 25 bp, Mus musculus
ggtttgtcagcatcggatcccggga

SEQ ID NO: 121705 - DNA, 25 bp, Mus musculus
ggttttaaacccatggctgaatatc

SEQ ID NO: 121706 - DNA, 25 bp, Mus musculus
ggttttacgccatctcctgcaagta

SEQ ID NO: 121707 - DNA, 25 bp, Mus musculus
ggttttatggacaccagcttcacga

SEQ ID NO: 121708 - DNA, 25 bp, Mus musculus
ggttttcagaacacgagccactggg

SEQ ID NO: 121709 - DNA, 25 bp, Mus musculus
ggttttcagccgcagatgttctgga

SEQ ID NO: 121710 - DNA, 25 bp, Mus musculus
ggttttccccagacaggctacagca

SEQ ID NO: 121711 - DNA, 25 bp, Mus musculus
ggttttccctttcggagcagcgcga

SEQ ID NO: 121712 - DNA, 25 bp, Mus musculus
ggttttccgcagatcttcactgtat

SEQ ID NO: 121713 - DNA, 25 bp, Mus musculus
ggttttcctggagaaaccgatcagg

SEQ ID NO: 121714 - DNA, 25 bp, Mus musculus
ggttttcgctcagactacatcagtg

SEQ ID NO: 121715 - DNA, 25 bp, Mus musculus
ggttttctactctcgggacgccaag

SEQ ID NO: 121716 - DNA, 25 bp, Mus musculus
ggttttgactttgatggcactccca

SEQ ID NO: 121717 - DNA, 25 bp, Mus musculus
ggttttgaggacaagcaccccagaa

SEQ ID NO: 121718 - DNA, 25 bp, Mus musculus
ggttttgcaacacaacgtgcttggg

SEQ ID NO: 121719 - DNA, 25 bp, Mus musculus
ggttttgcaccataacttcctcagc

SEQ ID NO: 121720 - DNA, 25 bp, Mus musculus
ggttttgcagactaccagtacttag

SEQ ID NO: 121721 - DNA, 25 bp, Mus musculus
ggttttgctgcacacctgaagtaca

SEQ ID NO: 121722 - DNA, 25 bp, Mus musculus
ggttttggtgccttcgaacgctcga

SEQ ID NO: 121723 - DNA, 25 bp, Mus musculus
ggttttgtcaccatagccattcatg

SEQ ID NO: 121724 - DNA, 25 bp, Mus musculus
ggtttttaaaccaaatcagcagacg

SEQ ID NO: 121725 - DNA, 25 bp, Mus musculus
ggtttttatttcttggctccacatg

SEQ ID NO: 121726 - DNA, 25 bp, Mus musculus
ggtttttccgcgtgtagcgttgcta

SEQ ID NO: 121727 - DNA, 25 bp, Mus musculus
ggttttttgatcacaggcagtccag

SEQ ID NO: 121728 - DNA, 25 bp, Mus musculus
gtaaaaaatactcttccgtcgaatg

SEQ ID NO: 121729 - DNA, 25 bp, Mus musculus
gtaaacaggccacattccagaatgg

SEQ ID NO: 121730 - DNA, 25 bp, Mus musculus
gtaaacgaggtggtcttcagccccg

SEQ ID NO: 121731 - DNA, 25 bp, Mus musculus
gtaaacgtgtccaaaataacgagat

SEQ ID NO: 121732 - DNA, 25 bp, Mus musculus
gtaaactactactgctacatacact

SEQ ID NO: 121733 - DNA, 25 bp, Mus musculus
gtaaagaagactctgaacatctgat

SEQ ID NO: 121734 - DNA, 25 bp, Mus musculus
gtaaagaagccgacctcctctccag

SEQ ID NO: 121735 - DNA, 25 bp, Mus musculus
gtaaagacctttttgccatgcacgg

SEQ ID NO: 121736 - DNA, 25 bp, Mus musculus
gtaaagagtactacctccgcctggc

SEQ ID NO: 121737 - DNA, 25 bp, Mus musculus
gtaaagatccaaacgccccaaagag

SEQ ID NO: 121738 - DNA, 25 bp, Mus musculus
gtaaagcaggcgtgtcacctcactg

SEQ ID NO: 121739 - DNA, 25 bp, Mus musculus
gtaaagccggcttcacacagctggg

SEQ ID NO: 121740 - DNA, 25 bp, Mus musculus
gtaaagctgcgctgccggaaaggaa

SEQ ID NO: 121741 - DNA, 25 bp, Mus musculus
gtaaaggcgctaggtgagccgctca

SEQ ID NO: 121742 - DNA, 25 bp, Mus musculus
gtaaagtttgccgacacccagaagg

SEQ ID NO: 121743 - DNA, 25 bp, Mus musculus
gtaaataaggccatactcagctgct

SEQ ID NO: 121744 - DNA, 25 bp, Mus musculus
gtaaatggatggaaaatctgatata

SEQ ID NO: 121745 - DNA, 25 bp, Mus musculus
gtaaattatggcagacctcatggct

SEQ ID NO: 121746 - DNA, 25 bp, Mus musculus
gtaaattggctgcacgaacccagga

SEQ ID NO: 121747 - DNA, 25 bp, Mus musculus
gtaacaaatgttccatcctgatgct

SEQ ID NO: 121748 - DNA, 25 bp, Mus musculus
gtaacaagatgctgacgaccggcga

SEQ ID NO: 121749 - DNA, 25 bp, Mus musculus
gtaacaagggagcacttgacagcaa

SEQ ID NO: 121750 - DNA, 25 bp, Mus musculus
gtaacactggccaggatctgaaagg

SEQ ID NO: 121751 - DNA, 25 bp, Mus musculus
gtaacagcatctccaagtctccggg

SEQ ID NO: 121752 - DNA, 25 bp, Mus musculus
gtaaccactcccaaagactcgaact

SEQ ID NO: 121753 - DNA, 25 bp, Mus musculus
gtaaccctgtacggcaccgctctct

SEQ ID NO: 121754 - DNA, 25 bp, Mus musculus
gtaacctgtcccaccatcgaaggcg

SEQ ID NO: 121755 - DNA, 25 bp, Mus musculus
gtaaccttagcctctgtagcccgtg

SEQ ID NO: 121756 - DNA, 25 bp, Mus musculus
gtaacgggcaactctcgcgagaacg

SEQ ID NO: 121757 - DNA, 25 bp, Mus musculus
gtaacgtcgagcctggaagtcgcca

SEQ ID NO: 121758 - DNA, 25 bp, Mus musculus
gtaacgtctgtgttggagaagccat

SEQ ID NO: 121759 - DNA, 25 bp, Mus musculus
gtaacgtttaaagcctccagacact

SEQ ID NO: 121760 - DNA, 25 bp, Mus musculus
gtaactagtgatgtttgtacaacca

SEQ ID NO: 121761 - DNA, 25 bp, Mus musculus
gtaacttctcttctggatctaacaa

SEQ ID NO: 121762 - DNA, 25 bp, Mus musculus
gtaacttgcacacctgggatggccc

SEQ ID NO: 121763 - DNA, 25 bp, Mus musculus
gtaacttggatacctctcctggcag

SEQ ID NO: 121764 - DNA, 25 bp, Mus musculus
gtaactttcatcatcaggccgcttg

SEQ ID NO: 121765 - DNA, 25 bp, Mus musculus
gtaagaagcctgctactgcctgacc

SEQ ID NO: 121766 - DNA, 25 bp, Mus musculus
gtaagaataaggaaccagcacctgc

SEQ ID NO: 121767 - DNA, 25 bp, Mus musculus
gtaagaatgaactctggcggtggca

SEQ ID NO: 121768 - DNA, 25 bp, Mus musculus
gtaagacctggatgcccagaccgct

SEQ ID NO: 121769 - DNA, 25 bp, Mus musculus
gtaagactccaacaaagctcaatgg

SEQ ID NO: 121770 - DNA, 25 bp, Mus musculus
gtaagatcatctgtgccaacccctg

SEQ ID NO: 121771 - DNA, 25 bp, Mus musculus
gtaagcagcaattttcacaccatgt

SEQ ID NO: 121772 - DNA, 25 bp, Mus musculus
gtaagcagtcttcattaggcctcaa

SEQ ID NO: 121773 - DNA, 25 bp, Mus musculus
gtaagcatcaggcaaggtaacaatc

SEQ ID NO: 121774 - DNA, 25 bp, Mus musculus
gtaagccgtggttcctgcccactgt

SEQ ID NO: 121775 - DNA, 25 bp, Mus musculus
gtaagcggcttctgtggcacgagtc

SEQ ID NO: 121776 - DNA, 25 bp, Mus musculus
gtaagctctcattttcagttccagg

SEQ ID NO: 121777 - DNA, 25 bp, Mus musculus
gtaagctgactgagagcaactccgc

SEQ ID NO: 121778 - DNA, 25 bp, Mus musculus
gtaagctgcggggtctggccaccac

SEQ ID NO: 121779 - DNA, 25 bp, Mus musculus
gtaaggaattcctgcccggagcctg

SEQ ID NO: 121780 - DNA, 25 bp, Mus musculus
gtaaggttctgatttacagtaaata

SEQ ID NO: 121781 - DNA, 25 bp, Mus musculus
gtaagtaccgtctctttgtcacgct

SEQ ID NO: 121782 - DNA, 25 bp, Mus musculus
gtaagtcagtgatgctatatgtagc

SEQ ID NO: 121783 - DNA, 25 bp, Mus musculus
gtaagtccttttcaagagtcctcgg

SEQ ID NO: 121784 - DNA, 25 bp, Mus musculus
gtaatacattcctctaacgagcacg

SEQ ID NO: 121785 - DNA, 25 bp, Mus musculus
gtaatactcgctacctcttcctggg

SEQ ID NO: 121786 - DNA, 25 bp, Mus musculus
gtaatcattgttccggctctcctgg

SEQ ID NO: 121787 - DNA, 25 bp, Mus musculus
gtaatctctagaagacagcctggga

SEQ ID NO: 121788 - DNA, 25 bp, Mus musculus
gtaatctttgctcagtccaacgtgg

SEQ ID NO: 121789 - DNA, 25 bp, Mus musculus
gtaatgctgctctgttcgccctggg

SEQ ID NO: 121790 - DNA, 25 bp, Mus musculus
gtaatggtgtgcttccacttcagtg

SEQ ID NO: 121791 - DNA, 25 bp, Mus musculus
gtaatgtggcgtcccctcaagtgca

SEQ ID NO: 121792 - DNA, 25 bp, Mus musculus
gtaattacagaagggaacatttccg

SEQ ID NO: 121793 - DNA, 25 bp, Mus musculus
gtaattctttgaagtcgatctgtcc

SEQ ID NO: 121794 - DNA, 25 bp, Mus musculus
gtaattgcaaattccacttggcctg

SEQ ID NO: 121795 - DNA, 25 bp, Mus musculus
gtaatttgatccctagtacacactg

SEQ ID NO: 121796 - DNA, 25 bp, Mus musculus
gtacaaagcaccttgtaatcctgct

SEQ ID NO: 121797 - DNA, 25 bp, Mus musculus
gtacaacaccaacgctctgcaaagg

SEQ ID NO: 121798 - DNA, 25 bp, Mus musculus
gtacaacataagagatatgatgcaa

SEQ ID NO: 121799 - DNA, 25 bp, Mus musculus
gtacaacccaaaaatggtgagtttg

SEQ ID NO: 121800 - DNA, 25 bp, Mus musculus
gtacaacgatgactcacggaccctg

SEQ ID NO: 121801 - DNA, 25 bp, Mus musculus
gtacaactcaatcaagaacgagaag

SEQ ID NO: 121802 - DNA, 25 bp, Mus musculus
gtacaacttccatggcactgctgag

SEQ ID NO: 121803 - DNA, 25 bp, Mus musculus
gtacaagatgctcattcacatccgg

SEQ ID NO: 121804 - DNA, 25 bp, Mus musculus
gtacaagcgccattccagccatgag

SEQ ID NO: 121805 - DNA, 25 bp, Mus musculus
gtacaagtcctgtcccgtcacaagg

SEQ ID NO: 121806 - DNA, 25 bp, Mus musculus
gtacagaaacactctgaaagaatca

SEQ ID NO: 121807 - DNA, 25 bp, Mus musculus
gtacagagctatcgtgaaccccatg

SEQ ID NO: 121808 - DNA, 25 bp, Mus musculus
gtacagaggcaattccgggacaacc

SEQ ID NO: 121809 - DNA, 25 bp, Mus musculus
gtacagccgttcttctcagcccagt

SEQ ID NO: 121810 - DNA, 25 bp, Mus musculus
gtacagcctttactaactcgtgaag

SEQ ID NO: 121811 - DNA, 25 bp, Mus musculus
gtacaggcgaaagcatcagattggc

SEQ ID NO: 121812 - DNA, 25 bp, Mus musculus
gtacagtaacgatgtgccctaccct

SEQ ID NO: 121813 - DNA, 25 bp, Mus musculus
gtacatcctggaaacactgctaaag

SEQ ID NO: 121814 - DNA, 25 bp, Mus musculus
gtacatgcggaacggagacttcctt

SEQ ID NO: 121815 - DNA, 25 bp, Mus musculus
gtaccaagccggctgtagacgagcc

SEQ ID NO: 121816 - DNA, 25 bp, Mus musculus
gtaccaagcctacaacttgctggca

SEQ ID NO: 121817 - DNA, 25 bp, Mus musculus
gtaccaagcgacagaagacatccca

SEQ ID NO: 121818 - DNA, 25 bp, Mus musculus
gtaccagcagaaacagcgtccagag

SEQ ID NO: 121819 - DNA, 25 bp, Mus musculus
gtaccagtttgaatgtatgatacag

SEQ ID NO: 121820 - DNA, 25 bp, Mus musculus
gtacccactagaggatcacccagag

SEQ ID NO: 121821 - DNA, 25 bp, Mus musculus
gtacccactggctttgaacaaacgg

SEQ ID NO: 121822 - DNA, 25 bp, Mus musculus
gtacccagaggtcaacaggcgcatt

SEQ ID NO: 121823 - DNA, 25 bp, Mus musculus
gtacccgacgtagagagaggcctga

SEQ ID NO: 121824 - DNA, 25 bp, Mus musculus
gtacccgggtccagcaggaactcgt

SEQ ID NO: 121825 - DNA, 25 bp, Mus musculus
gtacccgggtgaccagcattgccat

SEQ ID NO: 121826 - DNA, 25 bp, Mus musculus
gtaccgaacacaccgctcagtgctg

SEQ ID NO: 121827 - DNA, 25 bp, Mus musculus
gtaccgcctcctcatccggcggcag

SEQ ID NO: 121828 - DNA, 25 bp, Mus musculus
gtaccggccacacctgaagtgccaa

SEQ ID NO: 121829 - DNA, 25 bp, Mus musculus
gtacctccaggagtgtaccggccag

SEQ ID NO: 121830 - DNA, 25 bp, Mus musculus
gtacctccttcaggcaaacaagaaa

SEQ ID NO: 121831 - DNA, 25 bp, Mus musculus
gtacctggaggcttgctcttctggg

SEQ ID NO: 121832 - DNA, 25 bp, Mus musculus
gtacctggccacctcagacaaggag

SEQ ID NO: 121833 - DNA, 25 bp, Mus musculus
gtaccttagacttcagcatcatcca

SEQ ID NO: 121834 - DNA, 25 bp, Mus musculus
gtaccttgagacagcacgacgtgga

SEQ ID NO: 121835 - DNA, 25 bp, Mus musculus
gtacgaatttgccaaccccagccgt

SEQ ID NO: 121836 - DNA, 25 bp, Mus musculus
gtacgacagattgaaagggagccac

SEQ ID NO: 121837 - DNA, 25 bp, Mus musculus
gtacgaccctcgaagcaacaagtgg

SEQ ID NO: 121838 - DNA, 25 bp, Mus musculus
gtacgactacatctacccggagcag

SEQ ID NO: 121839 - DNA, 25 bp, Mus musculus
gtacgcaacggaagaggccctgaag

SEQ ID NO: 121840 - DNA, 25 bp, Mus musculus
gtacggacccctcgtgcagtggctt

SEQ ID NO: 121841 - DNA, 25 bp, Mus musculus
gtacggagccgccttcttcacagga

SEQ ID NO: 121842 - DNA, 25 bp, Mus musculus
gtacggcggcgagttcatacagcag

SEQ ID NO: 121843 - DNA, 25 bp, Mus musculus
gtacgtatatgccacctccgaaggg

SEQ ID NO: 121844 - DNA, 25 bp, Mus musculus
gtacgtcttccgaactgagaatggg

SEQ ID NO: 121845 - DNA, 25 bp, Mus musculus
gtacgttttctatgctcacagtcgg

SEQ ID NO: 121846 - DNA, 25 bp, Mus musculus
gtactacaaaggctggaccgacttg

SEQ ID NO: 121847 - DNA, 25 bp, Mus musculus
gtactacatcgtcatcctggcctgg

SEQ ID NO: 121848 - DNA, 25 bp, Mus musculus
gtactagcaaagatgatttaatact

SEQ ID NO: 121849 - DNA, 25 bp, Mus musculus
gtactaggaccacggatgtgcaccc

SEQ ID NO: 121850 - DNA, 25 bp, Mus musculus
gtactccatgtcagctttctcaaga

SEQ ID NO: 121851 - DNA, 25 bp, Mus musculus
gtactcctgagcactaacacataca

SEQ ID NO: 121852 - DNA, 25 bp, Mus musculus
gtactcctggcacagaaagatctgt

SEQ ID NO: 121853 - DNA, 25 bp, Mus musculus
gtactgcgacagagaccaaggccat

SEQ ID NO: 121854 - DNA, 25 bp, Mus musculus
gtactgcggcaccttagaaaaacat

SEQ ID NO: 121855 - DNA, 25 bp, Mus musculus
gtactggaacactacctggctgcgg

SEQ ID NO: 121856 - DNA, 25 bp, Mus musculus
gtactggaactgaaggcctgggcca

SEQ ID NO: 121857 - DNA, 25 bp, Mus musculus
gtactggagtgctaccatcggcgct

SEQ ID NO: 121858 - DNA, 25 bp, Mus musculus
gtactgggtagctgccatggcctcc

SEQ ID NO: 121859 - DNA, 25 bp, Mus musculus
gtactgtgttgagagaccctcggcc

SEQ ID NO: 121860 - DNA, 25 bp, Mus musculus
gtacttcagggatccaggtgcacca

SEQ ID NO: 121861 - DNA, 25 bp, Mus musculus
gtacttccggcaacagaattccttg

SEQ ID NO: 121862 - DNA, 25 bp, Mus musculus
gtacttcctgccacaatgtcacaga

SEQ ID NO: 121863 - DNA, 25 bp, Mus musculus
gtacttctagcaagtgcgcccacgg

SEQ ID NO: 121864 - DNA, 25 bp, Mus musculus
gtacttggctagcaccagggacacg

SEQ ID NO: 121865 - DNA, 25 bp, Mus musculus
gtactttaactgcagctctcccggg

SEQ ID NO: 121866 - DNA, 25 bp, Mus musculus
gtactttgtctcatcccaggcctgg

SEQ ID NO: 121867 - DNA, 25 bp, Mus musculus
gtagaaaaggcaaaccaagcaactc

SEQ ID NO: 121868 - DNA, 25 bp, Mus musculus
gtagaaacaagcacaaccaatggcc

SEQ ID NO: 121869 - DNA, 25 bp, Mus musculus
gtagaaatggttatccctgccggcc

SEQ ID NO: 121870 - DNA, 25 bp, Mus musculus
gtagaataccgcacaaccacaggaa

SEQ ID NO: 121871 - DNA, 25 bp, Mus musculus
gtagacatgacctccaggcactggg

SEQ ID NO: 121872 - DNA, 25 bp, Mus musculus
gtagacccgatgatggctgatgcca

SEQ ID NO: 121873 - DNA, 25 bp, Mus musculus
gtagaccggcgcatcttgcagaatg

SEQ ID NO: 121874 - DNA, 25 bp, Mus musculus
gtagactcaagccaagagcacaccg

SEQ ID NO: 121875 - DNA, 25 bp, Mus musculus
gtagacttcgacaacaacttccagt

SEQ ID NO: 121876 - DNA, 25 bp, Mus musculus
gtagagaactctccccaacacaagg

SEQ ID NO: 121877 - DNA, 25 bp, Mus musculus
gtagagaagcttggcgatcaccggc

SEQ ID NO: 121878 - DNA, 25 bp, Mus musculus
gtagagacaaggtgcacccaagcct

SEQ ID NO: 121879 - DNA, 25 bp, Mus musculus
gtagagcccagacacattcagaaag

SEQ ID NO: 121880 - DNA, 25 bp, Mus musculus
gtagagccccagcagaacatcgaat

SEQ ID NO: 121881 - DNA, 25 bp, Mus musculus
gtagagggggattccttctcctcct

SEQ ID NO: 121882 - DNA, 25 bp, Mus musculus
gtagagggtctctcagcccagggat

SEQ ID NO: 121883 - DNA, 25 bp, Mus musculus
gtagagtacaccttcgaccgcaatg

SEQ ID NO: 121884 - DNA, 25 bp, Mus musculus
gtagagttcagtgctcgcttcggca

SEQ ID NO: 121885 - DNA, 25 bp, Mus musculus
gtagataacacagggcgacgttcca

SEQ ID NO: 121886 - DNA, 25 bp, Mus musculus
gtagatgctttatcccacctgccag

SEQ ID NO: 121887 - DNA, 25 bp, Mus musculus
gtagcaccaccaaatgctgacctgg

SEQ ID NO: 121888 - DNA, 25 bp, Mus musculus
gtagcaccaccgcactgcagaaaga

SEQ ID NO: 121889 - DNA, 25 bp, Mus musculus
gtagcacctgctcccaaatcatggg

SEQ ID NO: 121890 - DNA, 25 bp, Mus musculus
gtagcagaccctcgttcacctagtg

SEQ ID NO: 121891 - DNA, 25 bp, Mus musculus
gtagcagcaagaacctcgaccatgg

SEQ ID NO: 121892 - DNA, 25 bp, Mus musculus
gtagcatcaccaagcagactctgta

SEQ ID NO: 121893 - DNA, 25 bp, Mus musculus
gtagccaacaggtctcagaggagtt

SEQ ID NO: 121894 - DNA, 25 bp, Mus musculus
gtagccaacctgactaggcgctttg

SEQ ID NO: 121895 - DNA, 25 bp, Mus musculus
gtagcccggatcctaacccatgagg

SEQ ID NO: 121896 - DNA, 25 bp, Mus musculus
gtagcctgggactttggacaaacgg

SEQ ID NO: 121897 - DNA, 25 bp, Mus musculus
gtagcctggtctgccctcgtgaagt

SEQ ID NO: 121898 - DNA, 25 bp, Mus musculus
gtagccttcgcgtacaagaatgtaa

SEQ ID NO: 121899 - DNA, 25 bp, Mus musculus
gtagcgctccaagaggttcctccag

SEQ ID NO: 121900 - DNA, 25 bp, Mus musculus
gtagctatgtcttctctccacacca

SEQ ID NO: 121901 - DNA, 25 bp, Mus musculus
gtagctgagacctatttccaggaag

SEQ ID NO: 121902 - DNA, 25 bp, Mus musculus
gtagctttaacactagtgacccctg

SEQ ID NO: 121903 - DNA, 25 bp, Mus musculus
gtaggaactttggtagccctggccg

SEQ ID NO: 121904 - DNA, 25 bp, Mus musculus
gtaggacagtcctcatcaagtgccc

SEQ ID NO: 121905 - DNA, 25 bp, Mus musculus
gtaggaccatcctgagaccagaagt

SEQ ID NO: 121906 - DNA, 25 bp, Mus musculus
gtaggagccacacagatcgcacatg

SEQ ID NO: 121907 - DNA, 25 bp, Mus musculus
gtaggaggctccgtcccaaacctgg

SEQ ID NO: 121908 - DNA, 25 bp, Mus musculus
gtaggcggtctctgcagcttccgag

SEQ ID NO: 121909 - DNA, 25 bp, Mus musculus
gtagtacatatcatccaagccaggg

SEQ ID NO: 121910 - DNA, 25 bp, Mus musculus
gtagtagagctctcctggctgaaga

SEQ ID NO: 121911 - DNA, 25 bp, Mus musculus
gtagtagcaattctccagtctccag

SEQ ID NO: 121912 - DNA, 25 bp, Mus musculus
gtagtcatgaccatcttcctcgtgg

SEQ ID NO: 121913 - DNA, 25 bp, Mus musculus
gtagtcatgccaccgcttgtcaggg

SEQ ID NO: 121914 - DNA, 25 bp, Mus musculus
gtagtccatacgtcatcggccggct

SEQ ID NO: 121915 - DNA, 25 bp, Mus musculus
gtagtccatgcagaacacgcccatg

SEQ ID NO: 121916 - DNA, 25 bp, Mus musculus
gtagtgctgccccaagatgcggtct

SEQ ID NO: 121917 - DNA, 25 bp, Mus musculus
gtagttggcctagctgacctcctga

SEQ ID NO: 121918 - DNA, 25 bp, Mus musculus
gtagtttggacttcacccgacggat

SEQ ID NO: 121919 - DNA, 25 bp, Mus musculus
gtataaattcccacataggctcatg

SEQ ID NO: 121920 - DNA, 25 bp, Mus musculus
gtataactaaggaaggacctgtggg

SEQ ID NO: 121921 - DNA, 25 bp, Mus musculus
gtataactgcaacccagggagggct

SEQ ID NO: 121922 - DNA, 25 bp, Mus musculus
gtataaggagaggcccgaggcccct

SEQ ID NO: 121923 - DNA, 25 bp, Mus musculus
gtataccatctttgccatcctggag

SEQ ID NO: 121924 - DNA, 25 bp, Mus musculus
gtatagactcacaggagaggcccag

SEQ ID NO: 121925 - DNA, 25 bp, Mus musculus
gtatatccacagtcagctcaaaggg

SEQ ID NO: 121926 - DNA, 25 bp, Mus musculus
gtatatccgagacaaccacagcaag

SEQ ID NO: 121927 - DNA, 25 bp, Mus musculus
gtatatctcccatgtgcctatgatg

SEQ ID NO: 121928 - DNA, 25 bp, Mus musculus
gtatatgaagccatcgacaccagag

SEQ ID NO: 121929 - DNA, 25 bp, Mus musculus
gtatatgcgaaggaaaaaccatacg

SEQ ID NO: 121930 - DNA, 25 bp, Mus musculus
gtatcaagaccttctggagcccaga

SEQ ID NO: 121931 - DNA, 25 bp, Mus musculus
gtatcaattgcaactccaccaggac

SEQ ID NO: 121932 - DNA, 25 bp, Mus musculus
gtatcagaataagggccgagcgaac

SEQ ID NO: 121933 - DNA, 25 bp, Mus musculus
gtatcagagtctgcaaaggttactg

SEQ ID NO: 121934 - DNA, 25 bp, Mus musculus
gtatcaggccaaccagcacatcatg

SEQ ID NO: 121935 - DNA, 25 bp, Mus musculus
gtatcatgacttgggccttacctgg

SEQ ID NO: 121936 - DNA, 25 bp, Mus musculus
gtatcatgccaaagagaggtctcga

SEQ ID NO: 121937 - DNA, 25 bp, Mus musculus
gtatccaaagagaagctacctacag

SEQ ID NO: 121938 - DNA, 25 bp, Mus musculus
gtatccacgggagaagaactgagtg

SEQ ID NO: 121939 - DNA, 25 bp, Mus musculus
gtatcgccgcaaactggaccgtgaa

SEQ ID NO: 121940 - DNA, 25 bp, Mus musculus
gtatcggtcccggtatctcatcctg

SEQ ID NO: 121941 - DNA, 25 bp, Mus musculus
gtatctaacaacagacaccttagag

SEQ ID NO: 121942 - DNA, 25 bp, Mus musculus
gtatctatgctggtcgcctgttggg

SEQ ID NO: 121943 - DNA, 25 bp, Mus musculus
gtatctccagataaaaggtgccaca

SEQ ID NO: 121944 - DNA, 25 bp, Mus musculus
gtatctgacctacaacagcctgcgg

SEQ ID NO: 121945 - DNA, 25 bp, Mus musculus
gtatctgagacagaagacctgcaag

SEQ ID NO: 121946 - DNA, 25 bp, Mus musculus
gtatctgctgatggccgctatcctg

SEQ ID NO: 121947 - DNA, 25 bp, Mus musculus
gtatgacacacctgataccagaggg

SEQ ID NO: 121948 - DNA, 25 bp, Mus musculus
gtatgacacattcccacgctgcggg

SEQ ID NO: 121949 - DNA, 25 bp, Mus musculus
gtatgacgtctcctatgacaccggg

SEQ ID NO: 121950 - DNA, 25 bp, Mus musculus
gtatgactatgaccccagctttgcc

SEQ ID NO: 121951 - DNA, 25 bp, Mus musculus
gtatgactcagactcccgaacagct

SEQ ID NO: 121952 - DNA, 25 bp, Mus musculus
gtatgagaacaaggatgcgcatgtg

SEQ ID NO: 121953 - DNA, 25 bp, Mus musculus
gtatgagacgcgtagacacggcacc

SEQ ID NO: 121954 - DNA, 25 bp, Mus musculus
gtatgagccgcagactgacatccct

SEQ ID NO: 121955 - DNA, 25 bp, Mus musculus
gtatgaggaccatcggcaagggacc

SEQ ID NO: 121956 - DNA, 25 bp, Mus musculus
gtatgagtttgatgaccagagcgtc

SEQ ID NO: 121957 - DNA, 25 bp, Mus musculus
gtatgatactgaccacagcggcttc

SEQ ID NO: 121958 - DNA, 25 bp, Mus musculus
gtatgcacatcctaatgccgccctg

SEQ ID NO: 121959 - DNA, 25 bp, Mus musculus
gtatgccaacaacgtcatgtcaggg

SEQ ID NO: 121960 - DNA, 25 bp, Mus musculus
gtatgcctcctacattggacacgat

SEQ ID NO: 121961 - DNA, 25 bp, Mus musculus
gtatgccttttatgccgtcctcgct

SEQ ID NO: 121962 - DNA, 25 bp, Mus musculus
gtatgcgccggagagcacactgaat

SEQ ID NO: 121963 - DNA, 25 bp, Mus musculus
gtatgcgggtcttctccaccagctg

SEQ ID NO: 121964 - DNA, 25 bp, Mus musculus
gtatggaccctgttgctgttcacag

SEQ ID NO: 121965 - DNA, 25 bp, Mus musculus
gtatggatttcacacagccagctcc

SEQ ID NO: 121966 - DNA, 25 bp, Mus musculus
gtatggcccctatgaaacgtatgag

SEQ ID NO: 121967 - DNA, 25 bp, Mus musculus
gtatggtggccctccaccaggctgg

SEQ ID NO: 121968 - DNA, 25 bp, Mus musculus
gtatgtaccccgtggaatacggcaa

SEQ ID NO: 121969 - DNA, 25 bp, Mus musculus
gtatgtaggctttgtcagactgtcc

SEQ ID NO: 121970 - DNA, 25 bp, Mus musculus
gtatgtcgcgaaggcagccagtgcc

SEQ ID NO: 121971 - DNA, 25 bp, Mus musculus
gtatgtgcccaatgttccagaagga

SEQ ID NO: 121972 - DNA, 25 bp, Mus musculus
gtatgttggccctagtggagtctcc

SEQ ID NO: 121973 - DNA, 25 bp, Mus musculus
gtattaaagagccacagtcacgact

SEQ ID NO: 121974 - DNA, 25 bp, Mus musculus
gtattaagtcatgatgcaggaatct

SEQ ID NO: 121975 - DNA, 25 bp, Mus musculus
gtattaataaaaccgtgctggccga

SEQ ID NO: 121976 - DNA, 25 bp, Mus musculus
gtattactgtgtgacgcctgctgcc

SEQ ID NO: 121977 - DNA, 25 bp, Mus musculus
gtattatgaagaggccgaacacgaa

SEQ ID NO: 121978 - DNA, 25 bp, Mus musculus
gtattatgcccagacaagtccccag

SEQ ID NO: 121979 - DNA, 25 bp, Mus musculus
gtattcccgacggacgctgcaaatg

SEQ ID NO: 121980 - DNA, 25 bp, Mus musculus
gtattccgggcattcctgcgcacag

SEQ ID NO: 121981 - DNA, 25 bp, Mus musculus
gtattcctatcagcattcctttcaa

SEQ ID NO: 121982 - DNA, 25 bp, Mus musculus
gtattcctcggctgcccttgtcaga

SEQ ID NO: 121983 - DNA, 25 bp, Mus musculus
gtattcctggaacgaaatggccgca

SEQ ID NO: 121984 - DNA, 25 bp, Mus musculus
gtattccttttttgtagccatgggc

SEQ ID NO: 121985 - DNA, 25 bp, Mus musculus
gtattcgatcaccacgtccagacgg

SEQ ID NO: 121986 - DNA, 25 bp, Mus musculus
gtattctggcagcatctcacctatg

SEQ ID NO: 121987 - DNA, 25 bp, Mus musculus
gtattgacaaatctcccaggacttt

SEQ ID NO: 121988 - DNA, 25 bp, Mus musculus
gtattgagcctccacaacccaggca

SEQ ID NO: 121989 - DNA, 25 bp, Mus musculus
gtattgcctggaaaaagacgtcctt

SEQ ID NO: 121990 - DNA, 25 bp, Mus musculus
gtattggatcccctgccactgaagt

SEQ ID NO: 121991 - DNA, 25 bp, Mus musculus
gtatttatctgaagcccctcgtccg

SEQ ID NO: 121992 - DNA, 25 bp, Mus musculus
gtatttcaagagagtggcaggtccg

SEQ ID NO: 121993 - DNA, 25 bp, Mus musculus
gtatttcaaggctcttggacttggg

SEQ ID NO: 121994 - DNA, 25 bp, Mus musculus
gtatttgagcgcacacactaccctg

SEQ ID NO: 121995 - DNA, 25 bp, Mus musculus
gtatttggccccagcaggtgtacca

SEQ ID NO: 121996 - DNA, 25 bp, Mus musculus
gtatttttgagagcaggtccccagg

SEQ ID NO: 121997 - DNA, 25 bp, Mus musculus
gtcaaaaccgctttcctggatgtcg

SEQ ID NO: 121998 - DNA, 25 bp, Mus musculus
gtcaaacacaacctggaggtgcacc

SEQ ID NO: 121999 - DNA, 25 bp, Mus musculus
gtcaaacagcggatggtacccatgg

SEQ ID NO: 122000 - DNA, 25 bp, Mus musculus
gtcaaagaacaagtccatgcgaggg

SEQ ID NO: 122001 - DNA, 25 bp, Mus musculus
gtcaaagttttacagaagaaagcca

SEQ ID NO: 122002 - DNA, 25 bp, Mus musculus
gtcaacaatatgctgctgactgcag

SEQ ID NO: 122003 - DNA, 25 bp, Mus musculus
gtcaacacgcctcaggagaaaatct

SEQ ID NO: 122004 - DNA, 25 bp, Mus musculus
gtcaacattctaacaaccacggagg

SEQ ID NO: 122005 - DNA, 25 bp, Mus musculus
gtcaaccgactgagggccggcacta

SEQ ID NO: 122006 - DNA, 25 bp, Mus musculus
gtcaacctagaccaatggacaccag

SEQ ID NO: 122007 - DNA, 25 bp, Mus musculus
gtcaacgtcctgcatagcatgaacc

SEQ ID NO: 122008 - DNA, 25 bp, Mus musculus
gtcaacgtggaggtatccggccacc

SEQ ID NO: 122009 - DNA, 25 bp, Mus musculus
gtcaactcttcttcggttactgtca

SEQ ID NO: 122010 - DNA, 25 bp, Mus musculus
gtcaactgccatgagcaaacctatg

SEQ ID NO: 122011 - DNA, 25 bp, Mus musculus
gtcaagaccttagagtgcaccagtg

SEQ ID NO: 122012 - DNA, 25 bp, Mus musculus
gtcaagatctcggaacagcaggcgg

SEQ ID NO: 122013 - DNA, 25 bp, Mus musculus
gtcaagcctgaaggagagcccatct

SEQ ID NO: 122014 - DNA, 25 bp, Mus musculus
gtcaagcgagtcacactgctcttcc

SEQ ID NO: 122015 - DNA, 25 bp, Mus musculus
gtcaaggaagtactgcgctccccgt

SEQ ID NO: 122016 - DNA, 25 bp, Mus musculus
gtcaagggagaggtgttacaccctc

SEQ ID NO: 122017 - DNA, 25 bp, Mus musculus
gtcaagtgtggtgcgctaagtctaa

SEQ ID NO: 122018 - DNA, 25 bp, Mus musculus
gtcaagttccgaactggccgcgcct

SEQ ID NO: 122019 - DNA, 25 bp, Mus musculus
gtcaatccacaagaacaatgcaaag

SEQ ID NO: 122020 - DNA, 25 bp, Mus musculus
gtcaatctgcgcaactacctgggtg

SEQ ID NO: 122021 - DNA, 25 bp, Mus musculus
gtcaatgaaacctcaccccagcatg

SEQ ID NO: 122022 - DNA, 25 bp, Mus musculus
gtcacaattgtcaccgggtacttag

SEQ ID NO: 122023 - DNA, 25 bp, Mus musculus
gtcacacagagtggtgcgaaccctc

SEQ ID NO: 122024 - DNA, 25 bp, Mus musculus
gtcacactgtgtaatggaacctatg

SEQ ID NO: 122025 - DNA, 25 bp, Mus musculus
gtcacagatggcaggtcaccagcac

SEQ ID NO: 122026 - DNA, 25 bp, Mus musculus
gtcacatggccaggtacacagccat

SEQ ID NO: 122027 - DNA, 25 bp, Mus musculus
gtcacattaagacggagactccagc

SEQ ID NO: 122028 - DNA, 25 bp, Mus musculus
gtcacattgaagtaacgctactccg

SEQ ID NO: 122029 - DNA, 25 bp, Mus musculus
gtcaccacagccctcataaacagtg

SEQ ID NO: 122030 - DNA, 25 bp, Mus musculus
gtcaccacctactgggtcaccaggg

SEQ ID NO: 122031 - DNA, 25 bp, Mus musculus
gtcaccagaagacgaagagcctcct

SEQ ID NO: 122032 - DNA, 25 bp, Mus musculus
gtcaccagagagaaatgccgaagag

SEQ ID NO: 122033 - DNA, 25 bp, Mus musculus
gtcaccatggccaaccgggagttgg

SEQ ID NO: 122034 - DNA, 25 bp, Mus musculus
gtcacccggaccatgcactttggga

SEQ ID NO: 122035 - DNA, 25 bp, Mus musculus
gtcacctacccctgtgtcctgggat

SEQ ID NO: 122036 - DNA, 25 bp, Mus musculus
gtcacgccggtgtcagtctgatgaa

SEQ ID NO: 122037 - DNA, 25 bp, Mus musculus
gtcactagatgcaaagacgccttag

SEQ ID NO: 122038 - DNA, 25 bp, Mus musculus
gtcactatcgtcctctgcggcctgt

SEQ ID NO: 122039 - DNA, 25 bp, Mus musculus
gtcactcagtgtgtggatatgccta

SEQ ID NO: 122040 - DNA, 25 bp, Mus musculus
gtcactcgtgcagaaggaaaccctg

SEQ ID NO: 122041 - DNA, 25 bp, Mus musculus
gtcactggatgttcaagctgcagaa

SEQ ID NO: 122042 - DNA, 25 bp, Mus musculus
gtcactgggattgctgtcgcagcca

SEQ ID NO: 122043 - DNA, 25 bp, Mus musculus
gtcacttcagagcaccggaacagag

SEQ ID NO: 122044 - DNA, 25 bp, Mus musculus
gtcactttgcttgcctgccacggaa

SEQ ID NO: 122045 - DNA, 25 bp, Mus musculus
gtcagaaaacgggtggctcccacaa

SEQ ID NO: 122046 - DNA, 25 bp, Mus musculus
gtcagaaggatcgtcgcccaactgg

SEQ ID NO: 122047 - DNA, 25 bp, Mus musculus
gtcagaagtccccttaccagagata

SEQ ID NO: 122048 - DNA, 25 bp, Mus musculus
gtcagacaatggctgtgtgcaacac

SEQ ID NO: 122049 - DNA, 25 bp, Mus musculus
gtcagacatgacagagaaggcccct

SEQ ID NO: 122050 - DNA, 25 bp, Mus musculus
gtcagaccaaaggaagaacccagca

SEQ ID NO: 122051 - DNA, 25 bp, Mus musculus
gtcagaccctgatggttaaccagct

SEQ ID NO: 122052 - DNA, 25 bp, Mus musculus
gtcagagccttggtttgagagtctc

SEQ ID NO: 122053 - DNA, 25 bp, Mus musculus
gtcagagtgccacagaggtccgtct

SEQ ID NO: 122054 - DNA, 25 bp, Mus musculus
gtcagataaagattttcagtgtcta

SEQ ID NO: 122055 - DNA, 25 bp, Mus musculus
gtcagatccacgaccagtttatcct

SEQ ID NO: 122056 - DNA, 25 bp, Mus musculus
gtcagatcgtaacaggatcccaaaa

SEQ ID NO: 122057 - DNA, 25 bp, Mus musculus
gtcagatctactcaccaagcagcag

SEQ ID NO: 122058 - DNA, 25 bp, Mus musculus
gtcagcactgacacaacaccagagg

SEQ ID NO: 122059 - DNA, 25 bp, Mus musculus
gtcagcagcctctctgtgaacgagc

SEQ ID NO: 122060 - DNA, 25 bp, Mus musculus
gtcagcatcacagccaaacgagaag

SEQ ID NO: 122061 - DNA, 25 bp, Mus musculus
gtcagcatttgctatgaatcattaa

SEQ ID NO: 122062 - DNA, 25 bp, Mus musculus
gtcagccacagaacaaagccagcag

SEQ ID NO: 122063 - DNA, 25 bp, Mus musculus
gtcagccataagacggaccggcagt

SEQ ID NO: 122064 - DNA, 25 bp, Mus musculus
gtcagcctgggatttttcggttcca

SEQ ID NO: 122065 - DNA, 25 bp, Mus musculus
gtcagcctgggctctacgggataga

SEQ ID NO: 122066 - DNA, 25 bp, Mus musculus
gtcagcgactctctcaggcatacag

SEQ ID NO: 122067 - DNA, 25 bp, Mus musculus
gtcagctggaaaggagccgccttaa

SEQ ID NO: 122068 - DNA, 25 bp, Mus musculus
gtcaggacggtaccggcggcactgc

SEQ ID NO: 122069 - DNA, 25 bp, Mus musculus
gtcaggacttaactcgtggatccgg

SEQ ID NO: 122070 - DNA, 25 bp, Mus musculus
gtcaggcttgagttgtctttacggg

SEQ ID NO: 122071 - DNA, 25 bp, Mus musculus
gtcagggaggacgtccgcaagctcc

SEQ ID NO: 122072 - DNA, 25 bp, Mus musculus
gtcagggcaacacccactgagagtg

SEQ ID NO: 122073 - DNA, 25 bp, Mus musculus
gtcagggccctttcttctacattgg

SEQ ID NO: 122074 - DNA, 25 bp, Mus musculus
gtcagggctccacatattctacaga

SEQ ID NO: 122075 - DNA, 25 bp, Mus musculus
gtcaggtacttcttgcacacgggcc

SEQ ID NO: 122076 - DNA, 25 bp, Mus musculus
gtcaggttcaccatctctagccgca

SEQ ID NO: 122077 - DNA, 25 bp, Mus musculus
gtcagtaaagatcctccgggactgg

SEQ ID NO: 122078 - DNA, 25 bp, Mus musculus
gtcagtactcgtcaccacaccaaat

SEQ ID NO: 122079 - DNA, 25 bp, Mus musculus
gtcagtactgtgatgaatccaagca

SEQ ID NO: 122080 - DNA, 25 bp, Mus musculus
gtcagtctggaatcaccccgtaagg

SEQ ID NO: 122081 - DNA, 25 bp, Mus musculus
gtcagtctgtcggagtcagtcttcc

SEQ ID NO: 122082 - DNA, 25 bp, Mus musculus
gtcagtggacgaaagcgcacgagct

SEQ ID NO: 122083 - DNA, 25 bp, Mus musculus
gtcatagacacccaacgcacctttg

SEQ ID NO: 122084 - DNA, 25 bp, Mus musculus
gtcatagagaagaaccctgaccctg

SEQ ID NO: 122085 - DNA, 25 bp, Mus musculus
gtcatatgggaaaaagtccagcccc

SEQ ID NO: 122086 - DNA, 25 bp, Mus musculus
gtcatcaaggacaacatggcccagg

SEQ ID NO: 122087 - DNA, 25 bp, Mus musculus
gtcatccttgtcatctgctctctga

SEQ ID NO: 122088 - DNA, 25 bp, Mus musculus
gtcatcctttaagattactatcaga

SEQ ID NO: 122089 - DNA, 25 bp, Mus musculus
gtcatcgagcgaggcagaggacatc

SEQ ID NO: 122090 - DNA, 25 bp, Mus musculus
gtcatcgagctgtctgacaaccccg

SEQ ID NO: 122091 - DNA, 25 bp, Mus musculus
gtcatcggtaaagcagacgccctga

SEQ ID NO: 122092 - DNA, 25 bp, Mus musculus
gtcatgatatttgcgcatggtgtgg

SEQ ID NO: 122093 - DNA, 25 bp, Mus musculus
gtcatggattgctttttaagaccaa

SEQ ID NO: 122094 - DNA, 25 bp, Mus musculus
gtcatggctggcacggcgcgcggct

SEQ ID NO: 122095 - DNA, 25 bp, Mus musculus
gtcatggtagtatcaataagaagcc

SEQ ID NO: 122096 - DNA, 25 bp, Mus musculus
gtcatgtggtgaagcgtacgccccg

SEQ ID NO: 122097 - DNA, 25 bp, Mus musculus
gtcattcagtgatgtagccatagag

SEQ ID NO: 122098 - DNA, 25 bp, Mus musculus
gtcattcccagaccgtgagctcagg

SEQ ID NO: 122099 - DNA, 25 bp, Mus musculus
gtcatttccctgttaccacagccag

SEQ ID NO: 122100 - DNA, 25 bp, Mus musculus
gtccaaagaatacacgcacagccgg

SEQ ID NO: 122101 - DNA, 25 bp, Mus musculus
gtccaaccggcttaacattctaggg

SEQ ID NO: 122102 - DNA, 25 bp, Mus musculus
gtccaaggacagatgtgacatttgt

SEQ ID NO: 122103 - DNA, 25 bp, Mus musculus
gtccaaggccttagtgactcccaag

SEQ ID NO: 122104 - DNA, 25 bp, Mus musculus
gtccaattaacttcaccgtgttcct

SEQ ID NO: 122105 - DNA, 25 bp, Mus musculus
gtccacaggcactacaaacgcggtg

SEQ ID NO: 122106 - DNA, 25 bp, Mus musculus
gtccaccagggagaatcgaactata

SEQ ID NO: 122107 - DNA, 25 bp, Mus musculus
gtccactgggaagctgacaacagcc

SEQ ID NO: 122108 - DNA, 25 bp, Mus musculus
gtccagaatgcctgcgaaacgctgt

SEQ ID NO: 122109 - DNA, 25 bp, Mus musculus
gtccagatgtgcagtcccagcagag

SEQ ID NO: 122110 - DNA, 25 bp, Mus musculus
gtccagcaaacaggccaaagatgtc

SEQ ID NO: 122111 - DNA, 25 bp, Mus musculus
gtccagcaggcaagtctccagtcct

SEQ ID NO: 122112 - DNA, 25 bp, Mus musculus
gtccagcagtgtgtatttgacagtg

SEQ ID NO: 122113 - DNA, 25 bp, Mus musculus
gtccagcgaagtaggccgtgcaact

SEQ ID NO: 122114 - DNA, 25 bp, Mus musculus
gtccaggagacccatgcctgccatg

SEQ ID NO: 122115 - DNA, 25 bp, Mus musculus
gtccagtcggaaagccaacactcca

SEQ ID NO: 122116 - DNA, 25 bp, Mus musculus
gtccagtggacatgggcaacagcct

SEQ ID NO: 122117 - DNA, 25 bp, Mus musculus
gtccatatgattacaaagcagaagc

SEQ ID NO: 122118 - DNA, 25 bp, Mus musculus
gtccatatggcaggcccctggaaag

SEQ ID NO: 122119 - DNA, 25 bp, Mus musculus
gtccatgacagggaactgacaaatg

SEQ ID NO: 122120 - DNA, 25 bp, Mus musculus
gtccatgagagtttccagggccgca

SEQ ID NO: 122121 - DNA, 25 bp, Mus musculus
gtccatggcgttatccaggcggccc

SEQ ID NO: 122122 - DNA, 25 bp, Mus musculus
gtccatgtgggtgtgccgagctcta

SEQ ID NO: 122123 - DNA, 25 bp, Mus musculus
gtccatgttctacggccggcagttg

SEQ ID NO: 122124 - DNA, 25 bp, Mus musculus
gtcccacaccagtcacaattaagat

SEQ ID NO: 122125 - DNA, 25 bp, Mus musculus
gtcccacctgctcgctcccatgacc

SEQ ID NO: 122126 - DNA, 25 bp, Mus musculus
gtcccagatgggatggtcggattta

SEQ ID NO: 122127 - DNA, 25 bp, Mus musculus
gtcccagcagagcaggcatgtacca

SEQ ID NO: 122128 - DNA, 25 bp, Mus musculus
gtcccaggaacgtggcagacactgc

SEQ ID NO: 122129 - DNA, 25 bp, Mus musculus
gtcccaggagaagccgaaggagctc

SEQ ID NO: 122130 - DNA, 25 bp, Mus musculus
gtcccatcactagctgaagagttgt

SEQ ID NO: 122131 - DNA, 25 bp, Mus musculus
gtcccattaaacacaagcctccagg

SEQ ID NO: 122132 - DNA, 25 bp, Mus musculus
gtcccatttaaatacacccacgcag

SEQ ID NO: 122133 - DNA, 25 bp, Mus musculus
gtccccacgtgattctgccatgtag

SEQ ID NO: 122134 - DNA, 25 bp, Mus musculus
gtccccgaaatagctgacacactgg

SEQ ID NO: 122135 - DNA, 25 bp, Mus musculus
gtccccggctggcacctctgctggt

SEQ ID NO: 122136 - DNA, 25 bp, Mus musculus
gtcccctcagagaagaatgaagccc

SEQ ID NO: 122137 - DNA, 25 bp, Mus musculus
gtcccctcctaaagcttgtgaggtt

SEQ ID NO: 122138 - DNA, 25 bp, Mus musculus
gtcccctggaaatcagccgctctaa

SEQ ID NO: 122139 - DNA, 25 bp, Mus musculus
gtcccgagggacagaatgccaccct

SEQ ID NO: 122140 - DNA, 25 bp, Mus musculus
gtcccgcatccgagtcatcatgaag

SEQ ID NO: 122141 - DNA, 25 bp, Mus musculus
gtcccgttggttacgtcgccggctg

SEQ ID NO: 122142 - DNA, 25 bp, Mus musculus
gtccctaaatgctggctaccacttc

SEQ ID NO: 122143 - DNA, 25 bp, Mus musculus
gtccctacccaagatgtgactactg

SEQ ID NO: 122144 - DNA, 25 bp, Mus musculus
gtccctcaaggcctggtcttagaaa

SEQ ID NO: 122145 - DNA, 25 bp, Mus musculus
gtccctctcggcagacaagttccag

SEQ ID NO: 122146 - DNA, 25 bp, Mus musculus
gtccctgagagtaagaacggcggca

SEQ ID NO: 122147 - DNA, 25 bp, Mus musculus
gtccctgagggtatgcaagcacaaa

SEQ ID NO: 122148 - DNA, 25 bp, Mus musculus
gtccctggccttagatgagtccctg

SEQ ID NO: 122149 - DNA, 25 bp, Mus musculus
gtcccttatctgaagaattcttaca

SEQ ID NO: 122150 - DNA, 25 bp, Mus musculus
gtccgaaagtcctacagccggcgga

SEQ ID NO: 122151 - DNA, 25 bp, Mus musculus
gtccgaattgagcaccgtgggaggc

SEQ ID NO: 122152 - DNA, 25 bp, Mus musculus
gtccgacagagaatgtaaatacccc

SEQ ID NO: 122153 - DNA, 25 bp, Mus musculus
gtccgcacgccggcgcagtctacgg

SEQ ID NO: 122154 - DNA, 25 bp, Mus musculus
gtccgcatggctctaaaaaaggccg

SEQ ID NO: 122155 - DNA, 25 bp, Mus musculus
gtccgccgtgcagctcgttcaggtg

SEQ ID NO: 122156 - DNA, 25 bp, Mus musculus
gtccgctgcgtctccggcatttgaa

SEQ ID NO: 122157 - DNA, 25 bp, Mus musculus
gtccggaccacgtgcagcagcggcg

SEQ ID NO: 122158 - DNA, 25 bp, Mus musculus
gtccggcctggctcgtaagtctcag

SEQ ID NO: 122159 - DNA, 25 bp, Mus musculus
gtccgggaccccaggattcagaagg

SEQ ID NO: 122160 - DNA, 25 bp, Mus musculus
gtccggggctcccagcgctataaaa

SEQ ID NO: 122161 - DNA, 25 bp, Mus musculus
gtccgtcttcctggagcgggcagaa

SEQ ID NO: 122162 - DNA, 25 bp, Mus musculus
gtcctaacacacctgctctactaga

SEQ ID NO: 122163 - DNA, 25 bp, Mus musculus
gtcctaaggaacatctgggcaacag

SEQ ID NO: 122164 - DNA, 25 bp, Mus musculus
gtcctacagcgaggcccagtgttct

SEQ ID NO: 122165 - DNA, 25 bp, Mus musculus
gtcctaccacgccatggaaggttac

SEQ ID NO: 122166 - DNA, 25 bp, Mus musculus
gtcctatgaatctcttggcaagcca

SEQ ID NO: 122167 - DNA, 25 bp, Mus musculus
gtcctcaaagtgagtctgtggctca

SEQ ID NO: 122168 - DNA, 25 bp, Mus musculus
gtcctcagggtacggagccaccttg

SEQ ID NO: 122169 - DNA, 25 bp, Mus musculus
gtcctcctgtttccctgcgatcgtg

SEQ ID NO: 122170 - DNA, 25 bp, Mus musculus
gtcctcgccttctgtcgattatcag

SEQ ID NO: 122171 - DNA, 25 bp, Mus musculus
gtcctctgcggcctgtgccactggt

SEQ ID NO: 122172 - DNA, 25 bp, Mus musculus
gtcctcttagtccagatcccagcag

SEQ ID NO: 122173 - DNA, 25 bp, Mus musculus
gtcctgaagccatcatatgccacac

SEQ ID NO: 122174 - DNA, 25 bp, Mus musculus
gtcctgcatcggacatactcggcgc

SEQ ID NO: 122175 - DNA, 25 bp, Mus musculus
gtcctgccagatcgttgtgtgccca

SEQ ID NO: 122176 - DNA, 25 bp, Mus musculus
gtcctgcctgcggaaccatggagag

SEQ ID NO: 122177 - DNA, 25 bp, Mus musculus
gtcctgcgggcttgcgccccgggcc

SEQ ID NO: 122178 - DNA, 25 bp, Mus musculus
gtcctgctgccccaaagagaagtag

SEQ ID NO: 122179 - DNA, 25 bp, Mus musculus
gtcctgctggaatttcactgtccca

SEQ ID NO: 122180 - DNA, 25 bp, Mus musculus
gtcctgtagcccgtagcccgggcgc

SEQ ID NO: 122181 - DNA, 25 bp, Mus musculus
gtcctgtataccaaccgggcagcag

SEQ ID NO: 122182 - DNA, 25 bp, Mus musculus
gtcctgtgacttgaatcggatggag

SEQ ID NO: 122183 - DNA, 25 bp, Mus musculus
gtccttaagaacacagaaacccatg

SEQ ID NO: 122184 - DNA, 25 bp, Mus musculus
gtccttaagaacgagaatgacgcca

SEQ ID NO: 122185 - DNA, 25 bp, Mus musculus
gtccttacttcttgtcgtcacctac

SEQ ID NO: 122186 - DNA, 25 bp, Mus musculus
gtccttcacccactttctgacaggt

SEQ ID NO: 122187 - DNA, 25 bp, Mus musculus
gtccttccggcgtcgccggagtgaa

SEQ ID NO: 122188 - DNA, 25 bp, Mus musculus
gtccttcgtcaccaatttctcttag

SEQ ID NO: 122189 - DNA, 25 bp, Mus musculus
gtccttgacgaggtgcccactacat

SEQ ID NO: 122190 - DNA, 25 bp, Mus musculus
gtccttgccgagagtgagcctggcc

SEQ ID NO: 122191 - DNA, 25 bp, Mus musculus
gtccttgcttctcttgaatgtcaca

SEQ ID NO: 122192 - DNA, 25 bp, Mus musculus
gtcgaaatggttcctgtactgccca

SEQ ID NO: 122193 - DNA, 25 bp, Mus musculus
gtcgaacacgacctaaaagcccaag

SEQ ID NO: 122194 - DNA, 25 bp, Mus musculus
gtcgaaggatctcataaaggaggct

SEQ ID NO: 122195 - DNA, 25 bp, Mus musculus
gtcgacatcacctgctaggctggct

SEQ ID NO: 122196 - DNA, 25 bp, Mus musculus
gtcgacgtggcacttcctatgccag

SEQ ID NO: 122197 - DNA, 25 bp, Mus musculus
gtcgagagcctactgtggacatatc

SEQ ID NO: 122198 - DNA, 25 bp, Mus musculus
gtcgagcagaacgtgtggccgcatc

SEQ ID NO: 122199 - DNA, 25 bp, Mus musculus
gtcgagtactcaaccccaactgctg

SEQ ID NO: 122200 - DNA, 25 bp, Mus musculus
gtcgatagccccagcacaaaaggag

SEQ ID NO: 122201 - DNA, 25 bp, Mus musculus
gtcgatgtctacacggatgtgagaa

SEQ ID NO: 122202 - DNA, 25 bp, Mus musculus
gtcgattgaacatgcactccagtgg

SEQ ID NO: 122203 - DNA, 25 bp, Mus musculus
gtcgcagaaggagcgcaagagcctc

SEQ ID NO: 122204 - DNA, 25 bp, Mus musculus
gtcgcagcagtactagcccaagcat

SEQ ID NO: 122205 - DNA, 25 bp, Mus musculus
gtcgcagcatgagtcgccatacgga

SEQ ID NO: 122206 - DNA, 25 bp, Mus musculus
gtcgcagttggagccctacaggaga

SEQ ID NO: 122207 - DNA, 25 bp, Mus musculus
gtcgcccctttcaccttggatcatg

SEQ ID NO: 122208 - DNA, 25 bp, Mus musculus
gtcgccgaggccttctctccgcgac

SEQ ID NO: 122209 - DNA, 25 bp, Mus musculus
gtcgccgaggtcgacgcagctcaag

SEQ ID NO: 122210 - DNA, 25 bp, Mus musculus
gtcgccgctgtagcctccagagaag

SEQ ID NO: 122211 - DNA, 25 bp, Mus musculus
gtcgccgtccatttctctgagcagg

SEQ ID NO: 122212 - DNA, 25 bp, Mus musculus
gtcgccgtgttccagttcatcatga

SEQ ID NO: 122213 - DNA, 25 bp, Mus musculus
gtcgcctcatgctcaggcttcgtgg

SEQ ID NO: 122214 - DNA, 25 bp, Mus musculus
gtcgcgaatgaaccgcgcggcggag

SEQ ID NO: 122215 - DNA, 25 bp, Mus musculus
gtcgcgcaggcgcagacggcgttgg

SEQ ID NO: 122216 - DNA, 25 bp, Mus musculus
gtcgcgcgctgctgcatccacggag

SEQ ID NO: 122217 - DNA, 25 bp, Mus musculus
gtcgcgcgggcgaggaactcattga

SEQ ID NO: 122218 - DNA, 25 bp, Mus musculus
gtcgcgggaacctcggagctcaacc

SEQ ID NO: 122219 - DNA, 25 bp, Mus musculus
gtcgcgggctcctttaatcccattg

SEQ ID NO: 122220 - DNA, 25 bp, Mus musculus
gtcgctagtctctattgccttgctg

SEQ ID NO: 122221 - DNA, 25 bp, Mus musculus
gtcgctcctgctaccaaaagaaaat

SEQ ID NO: 122222 - DNA, 25 bp, Mus musculus
gtcgctctgaagacgattgccatca

SEQ ID NO: 122223 - DNA, 25 bp, Mus musculus
gtcggaaggagtcggaggcatggct

SEQ ID NO: 122224 - DNA, 25 bp, Mus musculus
gtcggacccgttcgacatcatgcgg

SEQ ID NO: 122225 - DNA, 25 bp, Mus musculus
gtcggactcagaaatggcggcgtcc

SEQ ID NO: 122226 - DNA, 25 bp, Mus musculus
gtcggatcagatccgattgaagtgt

SEQ ID NO: 122227 - DNA, 25 bp, Mus musculus
gtcggccaccaacatgctgcggcat

SEQ ID NO: 122228 - DNA, 25 bp, Mus musculus
gtcggcggcagaggaaaccctttca

SEQ ID NO: 122229 - DNA, 25 bp, Mus musculus
gtcggcgttcgctgctcctggaaaa

SEQ ID NO: 122230 - DNA, 25 bp, Mus musculus
gtcgggacacacaacacagcaaatg

SEQ ID NO: 122231 - DNA, 25 bp, Mus musculus
gtcgggcacagctgccgacgagcct

SEQ ID NO: 122232 - DNA, 25 bp, Mus musculus
gtcgggctttgtcagtccctgcagc

SEQ ID NO: 122233 - DNA, 25 bp, Mus musculus
gtcggtacccagaccaatggattgt

SEQ ID NO: 122234 - DNA, 25 bp, Mus musculus
gtcggtcacactggagaacagccca

SEQ ID NO: 122235 - DNA, 25 bp, Mus musculus
gtcggtcagacaacactctccagag

SEQ ID NO: 122236 - DNA, 25 bp, Mus musculus
gtcgtcaatcgcacagcctcaaagt

SEQ ID NO: 122237 - DNA, 25 bp, Mus musculus
gtcgtcagatctacaaggaactgtg

SEQ ID NO: 122238 - DNA, 25 bp, Mus musculus
gtcgtcgctggagaaaatatcttca

SEQ ID NO: 122239 - DNA, 25 bp, Mus musculus
gtcgtcggacagcagcaccaaaagg

SEQ ID NO: 122240 - DNA, 25 bp, Mus musculus
gtcgtgagaaacagtgctccctcta

SEQ ID NO: 122241 - DNA, 25 bp, Mus musculus
gtcgtgatcacaactgagcctacag

SEQ ID NO: 122242 - DNA, 25 bp, Mus musculus
gtcgtgtatccagtccgccttagcg

SEQ ID NO: 122243 - DNA, 25 bp, Mus musculus
gtcgtgtctgagatcccggtgctga

SEQ ID NO: 122244 - DNA, 25 bp, Mus musculus
gtcgttatcgtccatggcagccagg

SEQ ID NO: 122245 - DNA, 25 bp, Mus musculus
gtcgttccgccgctccagcgtcgcc

SEQ ID NO: 122246 - DNA, 25 bp, Mus musculus
gtctaaaaatctggaggactctgat

SEQ ID NO: 122247 - DNA, 25 bp, Mus musculus
gtctaagaaaccacaatcaagtgag

SEQ ID NO: 122248 - DNA, 25 bp, Mus musculus
gtctacacggatgtgagaagccagt

SEQ ID NO: 122249 - DNA, 25 bp, Mus musculus
gtctacagttcaaacaaaaaccctg

SEQ ID NO: 122250 - DNA, 25 bp, Mus musculus
gtctacgcgtcaggctgggcagcta

SEQ ID NO: 122251 - DNA, 25 bp, Mus musculus
gtctacggccagtcgggcatcgcct

SEQ ID NO: 122252 - DNA, 25 bp, Mus musculus
gtctagctaaggcaacaactgttca

SEQ ID NO: 122253 - DNA, 25 bp, Mus musculus
gtctagtcccaacaactgcactgtg

SEQ ID NO: 122254 - DNA, 25 bp, Mus musculus
gtctatgagcccgtcttcctcatgg

SEQ ID NO: 122255 - DNA, 25 bp, Mus musculus
gtctatgcgaatctgctgctggtgc

SEQ ID NO: 122256 - DNA, 25 bp, Mus musculus
gtctatggaaatgcaagacctagca

SEQ ID NO: 122257 - DNA, 25 bp, Mus musculus
gtctattacaatggctaccatggag

SEQ ID NO: 122258 - DNA, 25 bp, Mus musculus
gtctattccccgtggcgcggaccga

SEQ ID NO: 122259 - DNA, 25 bp, Mus musculus
gtctcaaatggacatgcaaggcttg

SEQ ID NO: 122260 - DNA, 25 bp, Mus musculus
gtctcacaggctacgggatctcgga

SEQ ID NO: 122261 - DNA, 25 bp, Mus musculus
gtctcacggtgtagctctggttggc

SEQ ID NO: 122262 - DNA, 25 bp, Mus musculus
gtctcactatcaacagataagggtg

SEQ ID NO: 122263 - DNA, 25 bp, Mus musculus
gtctcagctcaagaccggttcctga

SEQ ID NO: 122264 - DNA, 25 bp, Mus musculus
gtctcaggagatgcgcaatacgggc

SEQ ID NO: 122265 - DNA, 25 bp, Mus musculus
gtctcaggagctatggggacctccc

SEQ ID NO: 122266 - DNA, 25 bp, Mus musculus
gtctcatcgcccacaacttggtcca

SEQ ID NO: 122267 - DNA, 25 bp, Mus musculus
gtctcatcgggagtcctgccactag

SEQ ID NO: 122268 - DNA, 25 bp, Mus musculus
gtctcatttcaactaccctggtggg

SEQ ID NO: 122269 - DNA, 25 bp, Mus musculus
gtctccaaaggaagctaaccgctgg

SEQ ID NO: 122270 - DNA, 25 bp, Mus musculus
gtctccacaagtccaaacagttcag

SEQ ID NO: 122271 - DNA, 25 bp, Mus musculus
gtctccagcagtcccaactaagcag

SEQ ID NO: 122272 - DNA, 25 bp, Mus musculus
gtctccatagaaacctccacctgtt

SEQ ID NO: 122273 - DNA, 25 bp, Mus musculus
gtctccggcatttgaatcgcgcttc

SEQ ID NO: 122274 - DNA, 25 bp, Mus musculus
gtctccggccgaagaatgcagctgg

SEQ ID NO: 122275 - DNA, 25 bp, Mus musculus
gtctcctcacactggcttggttcct

SEQ ID NO: 122276 - DNA, 25 bp, Mus musculus
gtctcctgccacgtgcaaaatggta

SEQ ID NO: 122277 - DNA, 25 bp, Mus musculus
gtctcctgtgggattcctgacttca

SEQ ID NO: 122278 - DNA, 25 bp, Mus musculus
gtctcgaagtcctcggaagccaata

SEQ ID NO: 122279 - DNA, 25 bp, Mus musculus
gtctcggaacagctggaacttagtg

SEQ ID NO: 122280 - DNA, 25 bp, Mus musculus
gtctcgggccgctgggcgcatccgg

SEQ ID NO: 122281 - DNA, 25 bp, Mus musculus
gtctctagcatcaacacactggtca

SEQ ID NO: 122282 - DNA, 25 bp, Mus musculus
gtctctctactcaagccatctggcg

SEQ ID NO: 122283 - DNA, 25 bp, Mus musculus
gtctctgcccagtgaccggcaggct

SEQ ID NO: 122284 - DNA, 25 bp, Mus musculus
gtctctgctatggaagtttattaat

SEQ ID NO: 122285 - DNA, 25 bp, Mus musculus
gtctctggaactcgaggttcctgaa

SEQ ID NO: 122286 - DNA, 25 bp, Mus musculus
gtctctggtgcggtctcgagcccga

SEQ ID NO: 122287 - DNA, 25 bp, Mus musculus
gtctcttctgctgaagaccctgtag

SEQ ID NO: 122288 - DNA, 25 bp, Mus musculus
gtctcttgacttggtgccatagcta

SEQ ID NO: 122289 - DNA, 25 bp, Mus musculus
gtctgaaactaactgggaatctcca

SEQ ID NO: 122290 - DNA, 25 bp, Mus musculus
gtctgaacggcgttcccgggagcat

SEQ ID NO: 122291 - DNA, 25 bp, Mus musculus
gtctgacaccccacgagaagcagtg

SEQ ID NO: 122292 - DNA, 25 bp, Mus musculus
gtctgacgagacagtggcactgacc

SEQ ID NO: 122293 - DNA, 25 bp, Mus musculus
gtctgagacgcctcgggacatggaa

SEQ ID NO: 122294 - DNA, 25 bp, Mus musculus
gtctgcaagaaatggctcaggagca

SEQ ID NO: 122295 - DNA, 25 bp, Mus musculus
gtctgcacagctgttcattctcctg

SEQ ID NO: 122296 - DNA, 25 bp, Mus musculus
gtctgcaccagggtcagagactcgc

SEQ ID NO: 122297 - DNA, 25 bp, Mus musculus
gtctgcatcagaacccctacagttg

SEQ ID NO: 122298 - DNA, 25 bp, Mus musculus
gtctgcgccgctccgccagatcaca

SEQ ID NO: 122299 - DNA, 25 bp, Mus musculus
gtctgcgtaggaggcacctgccgct

SEQ ID NO: 122300 - DNA, 25 bp, Mus musculus
gtctgctacctgctgatcatccgga

SEQ ID NO: 122301 - DNA, 25 bp, Mus musculus
gtctgctctgagttcttccgcgcgc

SEQ ID NO: 122302 - DNA, 25 bp, Mus musculus
gtctggaaaacaaagcggccggcga

SEQ ID NO: 122303 - DNA, 25 bp, Mus musculus
gtctggaccccaccaaggataccat

SEQ ID NO: 122304 - DNA, 25 bp, Mus musculus
gtctggacgctgatgccaccggtcg

SEQ ID NO: 122305 - DNA, 25 bp, Mus musculus
gtctggagactctgacaaaggagca

SEQ ID NO: 122306 - DNA, 25 bp, Mus musculus
gtctggagatgaggaagctagtcct

SEQ ID NO: 122307 - DNA, 25 bp, Mus musculus
gtctggccacagataaaggaccaaa

SEQ ID NO: 122308 - DNA, 25 bp, Mus musculus
gtctggcggagacagcatggcggcg

SEQ ID NO: 122309 - DNA, 25 bp, Mus musculus
gtctgggccctgtgcagcaagctgt

SEQ ID NO: 122310 - DNA, 25 bp, Mus musculus
gtctgggctggaaccaactgaggct

SEQ ID NO: 122311 - DNA, 25 bp, Mus musculus
gtctggtacctttcggccgcgtcgg

SEQ ID NO: 122312 - DNA, 25 bp, Mus musculus
gtctggtcgcgtctcggaaacccgt

SEQ ID NO: 122313 - DNA, 25 bp, Mus musculus
gtctggtgggcaagagtgctctcca

SEQ ID NO: 122314 - DNA, 25 bp, Mus musculus
gtctggttacaaaggaagctactcg

SEQ ID NO: 122315 - DNA, 25 bp, Mus musculus
gtctggttagcaactcggagggcca

SEQ ID NO: 122316 - DNA, 25 bp, Mus musculus
gtctgtaccgcccactaggcagagc

SEQ ID NO: 122317 - DNA, 25 bp, Mus musculus
gtctgtcatggcagcgcccaggcct

SEQ ID NO: 122318 - DNA, 25 bp, Mus musculus
gtctgtcctgacacaagcagcggga

SEQ ID NO: 122319 - DNA, 25 bp, Mus musculus
gtctgtgacggctgctgaggctgct

SEQ ID NO: 122320 - DNA, 25 bp, Mus musculus
gtctgtgccagatttgcacctgcgg

SEQ ID NO: 122321 - DNA, 25 bp, Mus musculus
gtctgtgccggcagtgtgctgccct

SEQ ID NO: 122322 - DNA, 25 bp, Mus musculus
gtctgtggacatgcgccccagagag

SEQ ID NO: 122323 - DNA, 25 bp, Mus musculus
gtctgtggcgttcgcagccccgagg

SEQ ID NO: 122324 - DNA, 25 bp, Mus musculus
gtctgttcctgtgggcgcagtggcc

SEQ ID NO: 122325 - DNA, 25 bp, Mus musculus
gtctgttgcttaccacttaggccca

SEQ ID NO: 122326 - DNA, 25 bp, Mus musculus
gtctgttttggatctcagaaaaaag

SEQ ID NO: 122327 - DNA, 25 bp, Mus musculus
gtcttactcgtccatgcccagatgt

SEQ ID NO: 122328 - DNA, 25 bp, Mus musculus
gtcttcacatacgactgcagtactg

SEQ ID NO: 122329 - DNA, 25 bp, Mus musculus
gtcttcagaatgtccgccccgtttg

SEQ ID NO: 122330 - DNA, 25 bp, Mus musculus
gtcttcagaggacgaaccaacgcag

SEQ ID NO: 122331 - DNA, 25 bp, Mus musculus
gtcttcagaggtgaccggcagcctt

SEQ ID NO: 122332 - DNA, 25 bp, Mus musculus
gtcttcagtgccaaacacgtctcag

SEQ ID NO: 122333 - DNA, 25 bp, Mus musculus
gtcttcatggtctcagctaggcctc

SEQ ID NO: 122334 - DNA, 25 bp, Mus musculus
gtcttcctcatggtgttcagctcag

SEQ ID NO: 122335 - DNA, 25 bp, Mus musculus
gtcttcgccgtcaaccacttctggt

SEQ ID NO: 122336 - DNA, 25 bp, Mus musculus
gtcttctggacccattaccaaagca

SEQ ID NO: 122337 - DNA, 25 bp, Mus musculus
gtcttgatcatgaacgcccctggag

SEQ ID NO: 122338 - DNA, 25 bp, Mus musculus
gtcttgcactaccagcaggctctga

SEQ ID NO: 122339 - DNA, 25 bp, Mus musculus
gtcttgcatgccgacgttgcgccta

SEQ ID NO: 122340 - DNA, 25 bp, Mus musculus
gtcttgccacttcttagctgcgcag

SEQ ID NO: 122341 - DNA, 25 bp, Mus musculus
gtcttggcgaaacccaggctctgag

SEQ ID NO: 122342 - DNA, 25 bp, Mus musculus
gtctttagacttggccctggaggga

SEQ ID NO: 122343 - DNA, 25 bp, Mus musculus
gtctttagttgtgctatcaaagcta

SEQ ID NO: 122344 - DNA, 25 bp, Mus musculus
gtctttatcatttctgcctgtacag

SEQ ID NO: 122345 - DNA, 25 bp, Mus musculus
gtctttattatctggccaagacaca

SEQ ID NO: 122346 - DNA, 25 bp, Mus musculus
gtctttcctattgcatacgagggct

SEQ ID NO: 122347 - DNA, 25 bp, Mus musculus
gtctttctcaagcacagcaaatggg

SEQ ID NO: 122348 - DNA, 25 bp, Mus musculus
gtctttgacacacaaacctgcaggg

SEQ ID NO: 122349 - DNA, 25 bp, Mus musculus
gtctttgacccctttgttggaacag

SEQ ID NO: 122350 - DNA, 25 bp, Mus musculus
gtctttgctgcacgttcttcccaca

SEQ ID NO: 122351 - DNA, 25 bp, Mus musculus
gtctttggaagtgtgatgtgcctca

SEQ ID NO: 122352 - DNA, 25 bp, Mus musculus
gtctttgggccttatgacaacttca

SEQ ID NO: 122353 - DNA, 25 bp, Mus musculus
gtcttttacctcacacatcgatgag

SEQ ID NO: 122354 - DNA, 25 bp, Mus musculus
gtcttttgcaaaggccaccctggca

SEQ ID NO: 122355 - DNA, 25 bp, Mus musculus
gtgaaaaatctctcatattggcaag

SEQ ID NO: 122356 - DNA, 25 bp, Mus musculus
gtgaaaacagctacccttgccactg

SEQ ID NO: 122357 - DNA, 25 bp, Mus musculus
gtgaaaactcgggtacagcggccag

SEQ ID NO: 122358 - DNA, 25 bp, Mus musculus
gtgaaaagatgtaccacacccaggg

SEQ ID NO: 122359 - DNA, 25 bp, Mus musculus
gtgaaaagcaccaccgaaaggcctt

SEQ ID NO: 122360 - DNA, 25 bp, Mus musculus
gtgaaaagcagatagcaaagcgcct

SEQ ID NO: 122361 - DNA, 25 bp, Mus musculus
gtgaaaatgtcagcgccagagggtc

SEQ ID NO: 122362 - DNA, 25 bp, Mus musculus
gtgaaaatgtggtgccccgagagcc

SEQ ID NO: 122363 - DNA, 25 bp, Mus musculus
gtgaaacagctacagcacagcgggc

SEQ ID NO: 122364 - DNA, 25 bp, Mus musculus
gtgaaacccaaacctagagccctgt

SEQ ID NO: 122365 - DNA, 25 bp, Mus musculus
gtgaaacccggtagagacaagcctg

SEQ ID NO: 122366 - DNA, 25 bp, Mus musculus
gtgaaactcatatcctttccacagg

SEQ ID NO: 122367 - DNA, 25 bp, Mus musculus
gtgaaagatggccaaacccactcgg

SEQ ID NO: 122368 - DNA, 25 bp, Mus musculus
gtgaaagcacaacgctgccctgtag

SEQ ID NO: 122369 - DNA, 25 bp, Mus musculus
gtgaaatgtcaggaacaagccccgg

SEQ ID NO: 122370 - DNA, 25 bp, Mus musculus
gtgaaattctttgtggcagtcccag

SEQ ID NO: 122371 - DNA, 25 bp, Mus musculus
gtgaaattgacaaatcaccgcactg

SEQ ID NO: 122372 - DNA, 25 bp, Mus musculus
gtgaaattgctgaaggaccagctcc

SEQ ID NO: 122373 - DNA, 25 bp, Mus musculus
gtgaacaagaactacctctacctct

SEQ ID NO: 122374 - DNA, 25 bp, Mus musculus
gtgaacatctccgtttagggttgtt

SEQ ID NO: 122375 - DNA, 25 bp, Mus musculus
gtgaaccacggctccactttcagaa

SEQ ID NO: 122376 - DNA, 25 bp, Mus musculus
gtgaacggcctttccagtgcaacca

SEQ ID NO: 122377 - DNA, 25 bp, Mus musculus
gtgaacttcaccgacttcatcagca

SEQ ID NO: 122378 - DNA, 25 bp, Mus musculus
gtgaagaagagtctcaaatggacat

SEQ ID NO: 122379 - DNA, 25 bp, Mus musculus
gtgaagacgtgtaaacctgccctgg

SEQ ID NO: 122380 - DNA, 25 bp, Mus musculus
gtgaagagagaagcgcccgttgtac

SEQ ID NO: 122381 - DNA, 25 bp, Mus musculus
gtgaagcaagatcgccctctcagtg

SEQ ID NO: 122382 - DNA, 25 bp, Mus musculus
gtgaagctcctgtccacctggctga

SEQ ID NO: 122383 - DNA, 25 bp, Mus musculus
gtgaagctgccatgactgtcctgag

SEQ ID NO: 122384 - DNA, 25 bp, Mus musculus
gtgaagctggccctgactcctagga

SEQ ID NO: 122385 - DNA, 25 bp, Mus musculus
gtgaaggactccatgctggtgctcc

SEQ ID NO: 122386 - DNA, 25 bp, Mus musculus
gtgaaggctcacaaggattcctggc

SEQ ID NO: 122387 - DNA, 25 bp, Mus musculus
gtgaaggtcccctggagagcacaag

SEQ ID NO: 122388 - DNA, 25 bp, Mus musculus
gtgaatatcagtccagaagcccatg

SEQ ID NO: 122389 - DNA, 25 bp, Mus musculus
gtgaatatcatcaccccgtccagag

SEQ ID NO: 122390 - DNA, 25 bp, Mus musculus
gtgaatcccggcagagagtgcgcct

SEQ ID NO: 122391 - DNA, 25 bp, Mus musculus
gtgaatccgcccctgtcagaagtgg

SEQ ID NO: 122392 - DNA, 25 bp, Mus musculus
gtgaatttggaaggcaaagccagtc

SEQ ID NO: 122393 - DNA, 25 bp, Mus musculus
gtgacaacgagaagctgcccaggac

SEQ ID NO: 122394 - DNA, 25 bp, Mus musculus
gtgacaagggtaatggcgacgcctc

SEQ ID NO: 122395 - DNA, 25 bp, Mus musculus
gtgacaagtcctttagccgcctcag

SEQ ID NO: 122396 - DNA, 25 bp, Mus musculus
gtgacaatgccacatacgccagcga

SEQ ID NO: 122397 - DNA, 25 bp, Mus musculus
gtgacacacagccattatcccaggg

SEQ ID NO: 122398 - DNA, 25 bp, Mus musculus
gtgacaccgcttggctcctctatga

SEQ ID NO: 122399 - DNA, 25 bp, Mus musculus
gtgacactatgcaaccccagcgtga

SEQ ID NO: 122400 - DNA, 25 bp, Mus musculus
gtgacactggattcgaaccccgtcg

SEQ ID NO: 122401 - DNA, 25 bp, Mus musculus
gtgacatcactcagaaaggatatga

SEQ ID NO: 122402 - DNA, 25 bp, Mus musculus
gtgaccagaactgcagtcaaggaga

SEQ ID NO: 122403 - DNA, 25 bp, Mus musculus
gtgaccagcagcaagtaccgatcca

SEQ ID NO: 122404 - DNA, 25 bp, Mus musculus
gtgaccagggcccacattctgctct

SEQ ID NO: 122405 - DNA, 25 bp, Mus musculus
gtgaccatccacaaccgctgtaaag

SEQ ID NO: 122406 - DNA, 25 bp, Mus musculus
gtgaccatgtcggagtctgggcaca

SEQ ID NO: 122407 - DNA, 25 bp, Mus musculus
gtgaccccagactcctaaataaact

SEQ ID NO: 122408 - DNA, 25 bp, Mus musculus
gtgaccccagcttcccgctgataga

SEQ ID NO: 122409 - DNA, 25 bp, Mus musculus
gtgaccccaggcgtcaggctgctgt

SEQ ID NO: 122410 - DNA, 25 bp, Mus musculus
gtgacccctgtgaagtgtgcccaac

SEQ ID NO: 122411 - DNA, 25 bp, Mus musculus
gtgacccgaccggactgacggattc

SEQ ID NO: 122412 - DNA, 25 bp, Mus musculus
gtgacccggtttggagaagtcgcca

SEQ ID NO: 122413 - DNA, 25 bp, Mus musculus
gtgaccctgcgtgtggaccctaatg

SEQ ID NO: 122414 - DNA, 25 bp, Mus musculus
gtgaccgcaacaagcccggagtcta

SEQ ID NO: 122415 - DNA, 25 bp, Mus musculus
gtgaccggcaggctttggtcaaaaa

SEQ ID NO: 122416 - DNA, 25 bp, Mus musculus
gtgaccttaaaaacagtgacccatg

SEQ ID NO: 122417 - DNA, 25 bp, Mus musculus
gtgaccttatgctcctgtgcagcaa

SEQ ID NO: 122418 - DNA, 25 bp, Mus musculus
gtgacgactcactatggcttccctg

SEQ ID NO: 122419 - DNA, 25 bp, Mus musculus
gtgacgcgctcgctggactcactag

SEQ ID NO: 122420 - DNA, 25 bp, Mus musculus
gtgacgtgcacagaccaagacaccg

SEQ ID NO: 122421 - DNA, 25 bp, Mus musculus
gtgacgtgtgctcggcgcgcggcgc

SEQ ID NO: 122422 - DNA, 25 bp, Mus musculus
gtgacgtttgcagacagccactcgg

SEQ ID NO: 122423 - DNA, 25 bp, Mus musculus
gtgactactgccagaatcctgcagc

SEQ ID NO: 122424 - DNA, 25 bp, Mus musculus
gtgactataacatgaccccagaccg

SEQ ID NO: 122425 - DNA, 25 bp, Mus musculus
gtgactcacgagaagggatgcccaa

SEQ ID NO: 122426 - DNA, 25 bp, Mus musculus
gtgactcagatgaaagcctctctag

SEQ ID NO: 122427 - DNA, 25 bp, Mus musculus
gtgactctgactgggcctgggccct

SEQ ID NO: 122428 - DNA, 25 bp, Mus musculus
gtgactgacccagattcaggcctgt

SEQ ID NO: 122429 - DNA, 25 bp, Mus musculus
gtgactgatcctgtgtcccctgggc

SEQ ID NO: 122430 - DNA, 25 bp, Mus musculus
gtgactgcggccgaagaacgcgccc

SEQ ID NO: 122431 - DNA, 25 bp, Mus musculus
gtgacttcttttggacaactcatga

SEQ ID NO: 122432 - DNA, 25 bp, Mus musculus
gtgagaaacccttccgctgtgcccg

SEQ ID NO: 122433 - DNA, 25 bp, Mus musculus
gtgagaagggtgacaaacattcccc

SEQ ID NO: 122434 - DNA, 25 bp, Mus musculus
gtgagaattacatcaagtgggcctc

SEQ ID NO: 122435 - DNA, 25 bp, Mus musculus
gtgagacaccgcttctgtacccaga

SEQ ID NO: 122436 - DNA, 25 bp, Mus musculus
gtgagacgctctccctcaccatgag

SEQ ID NO: 122437 - DNA, 25 bp, Mus musculus
gtgagactcccacagtggcctctga

SEQ ID NO: 122438 - DNA, 25 bp, Mus musculus
gtgagagagctcacccatggccact

SEQ ID NO: 122439 - DNA, 25 bp, Mus musculus
gtgagatccccccatcctgttgcaa

SEQ ID NO: 122440 - DNA, 25 bp, Mus musculus
gtgagcaaaatgagatccggaacct

SEQ ID NO: 122441 - DNA, 25 bp, Mus musculus
gtgagcaggccgtgcttgctgcctt

SEQ ID NO: 122442 - DNA, 25 bp, Mus musculus
gtgagccaatcaccgttcccagatg

SEQ ID NO: 122443 - DNA, 25 bp, Mus musculus
gtgagcccagcttagtgtccttgaa

SEQ ID NO: 122444 - DNA, 25 bp, Mus musculus
gtgagcccttctctaaccctttggc

SEQ ID NO: 122445 - DNA, 25 bp, Mus musculus
gtgagcttgatttttctcccctgga

SEQ ID NO: 122446 - DNA, 25 bp, Mus musculus
gtgaggccacgcatgagccgaagct

SEQ ID NO: 122447 - DNA, 25 bp, Mus musculus
gtgagggacccatagctacagctgc

SEQ ID NO: 122448 - DNA, 25 bp, Mus musculus
gtgagggcctctcggactcctgtat

SEQ ID NO: 122449 - DNA, 25 bp, Mus musculus
gtgagggtcactcctttgccaccta

SEQ ID NO: 122450 - DNA, 25 bp, Mus musculus
gtgaggtcatcttctgcagggagcc

SEQ ID NO: 122451 - DNA, 25 bp, Mus musculus
gtgaggtgctttaacatggagaagc

SEQ ID NO: 122452 - DNA, 25 bp, Mus musculus
gtgagtagatgctttcagggaaaga

SEQ ID NO: 122453 - DNA, 25 bp, Mus musculus
gtgagtccctccaggctccgaatag

SEQ ID NO: 122454 - DNA, 25 bp, Mus musculus
gtgagtgacacttggtccccacggg

SEQ ID NO: 122455 - DNA, 25 bp, Mus musculus
gtgatagcaagttccacagcaccct

SEQ ID NO: 122456 - DNA, 25 bp, Mus musculus
gtgatcaatcgcttacgtgagcaga

SEQ ID NO: 122457 - DNA, 25 bp, Mus musculus
gtgatcaggcgtgtgtcccagctct

SEQ ID NO: 122458 - DNA, 25 bp, Mus musculus
gtgatcatcgtgctcttcctcggcc

SEQ ID NO: 122459 - DNA, 25 bp, Mus musculus
gtgatgaaaccaagagagctcctgc

SEQ ID NO: 122460 - DNA, 25 bp, Mus musculus
gtgatgacacacttaaacagcttgg

SEQ ID NO: 122461 - DNA, 25 bp, Mus musculus
gtgatgacctcctcctgatccctga

SEQ ID NO: 122462 - DNA, 25 bp, Mus musculus
gtgatgatgaagagcctagtacctc

SEQ ID NO: 122463 - DNA, 25 bp, Mus musculus
gtgatgatgcttcgccacatgggac

SEQ ID NO: 122464 - DNA, 25 bp, Mus musculus
gtgatgcaaataagccccttgggca

SEQ ID NO: 122465 - DNA, 25 bp, Mus musculus
gtgatgtctgccttgcctgccgaag

SEQ ID NO: 122466 - DNA, 25 bp, Mus musculus
gtgattacacacaacagaaggccta

SEQ ID NO: 122467 - DNA, 25 bp, Mus musculus
gtgattcacaagatgctgctctcca

SEQ ID NO: 122468 - DNA, 25 bp, Mus musculus
gtgattcacctgcatactggaaaag

SEQ ID NO: 122469 - DNA, 25 bp, Mus musculus
gtgattcggacagcgaagttgaaaa

SEQ ID NO: 122470 - DNA, 25 bp, Mus musculus
gtgcaaccactgtaggcagccggtg

SEQ ID NO: 122471 - DNA, 25 bp, Mus musculus
gtgcaaccaggcctacaatcagaag

SEQ ID NO: 122472 - DNA, 25 bp, Mus musculus
gtgcaacccagaaccaactcttatt

SEQ ID NO: 122473 - DNA, 25 bp, Mus musculus
gtgcaacctaaaactcaccatagag

SEQ ID NO: 122474 - DNA, 25 bp, Mus musculus
gtgcaagaagccgtgctccctgagg

SEQ ID NO: 122475 - DNA, 25 bp, Mus musculus
gtgcaagagagagccaactcctgaa

SEQ ID NO: 122476 - DNA, 25 bp, Mus musculus
gtgcacacaatcttcctggagaata

SEQ ID NO: 122477 - DNA, 25 bp, Mus musculus
gtgcactctacttgcaggggtgctt

SEQ ID NO: 122478 - DNA, 25 bp, Mus musculus
gtgcactgcagcagagaccatcaac

SEQ ID NO: 122479 - DNA, 25 bp, Mus musculus
gtgcacttctgatcctagcccttgt

SEQ ID NO: 122480 - DNA, 25 bp, Mus musculus
gtgcagaacttagcggcggactgac

SEQ ID NO: 122481 - DNA, 25 bp, Mus musculus
gtgcagaatgctgcaaaacgctggg

SEQ ID NO: 122482 - DNA, 25 bp, Mus musculus
gtgcaggacagtgggcaaaccattc

SEQ ID NO: 122483 - DNA, 25 bp, Mus musculus
gtgcaggttccagaggctcgctgct

SEQ ID NO: 122484 - DNA, 25 bp, Mus musculus
gtgcaggttccgtcgccagcaaatg

SEQ ID NO: 122485 - DNA, 25 bp, Mus musculus
gtgcagtcagaagacgaccgcgagc

SEQ ID NO: 122486 - DNA, 25 bp, Mus musculus
gtgcatctcagcatctagctcattg

SEQ ID NO: 122487 - DNA, 25 bp, Mus musculus
gtgcatctgtgtcctccagcggaaa

SEQ ID NO: 122488 - DNA, 25 bp, Mus musculus
gtgcatctgtttcatgggcagctga

SEQ ID NO: 122489 - DNA, 25 bp, Mus musculus
gtgcattgctgctgctcccaggcag

SEQ ID NO: 122490 - DNA, 25 bp, Mus musculus
gtgcattttctcaaacgctacaacc

SEQ ID NO: 122491 - DNA, 25 bp, Mus musculus
gtgccaaacagggacgcagacatgt

SEQ ID NO: 122492 - DNA, 25 bp, Mus musculus
gtgccaacgttgcaggaagaccctg

SEQ ID NO: 122493 - DNA, 25 bp, Mus musculus
gtgccaagaccaccgaacagaagct

SEQ ID NO: 122494 - DNA, 25 bp, Mus musculus
gtgccaccgggttactccatcaagg

SEQ ID NO: 122495 - DNA, 25 bp, Mus musculus
gtgccacctaagcatgtataccgag

SEQ ID NO: 122496 - DNA, 25 bp, Mus musculus
gtgccactggtgtcagcgcaaactg

SEQ ID NO: 122497 - DNA, 25 bp, Mus musculus
gtgccagggaatccccatggtgtct

SEQ ID NO: 122498 - DNA, 25 bp, Mus musculus
gtgccagggcgacaccgtcatctcg

SEQ ID NO: 122499 - DNA, 25 bp, Mus musculus
gtgccaggtccctcttcatcacaga

SEQ ID NO: 122500 - DNA, 25 bp, Mus musculus
gtgccatgcctatgttccaattagc

SEQ ID NO: 122501 - DNA, 25 bp, Mus musculus
gtgccatttccaaagcagtgtctgg

SEQ ID NO: 122502 - DNA, 25 bp, Mus musculus
gtgcccaaatctgcggatgaccgag

SEQ ID NO: 122503 - DNA, 25 bp, Mus musculus
gtgcccaggctgaggagcccaagat

SEQ ID NO: 122504 - DNA, 25 bp, Mus musculus
gtgcccatatttgagtacctaggtt

SEQ ID NO: 122505 - DNA, 25 bp, Mus musculus
gtgcccgaacgataccagaacctgt

SEQ ID NO: 122506 - DNA, 25 bp, Mus musculus
gtgcccggactaccaactacaacag

SEQ ID NO: 122507 - DNA, 25 bp, Mus musculus
gtgccctcagatgggaatactgcct

SEQ ID NO: 122508 - DNA, 25 bp, Mus musculus
gtgccctctgtgacgctcatcgtgg

SEQ ID NO: 122509 - DNA, 25 bp, Mus musculus
gtgccctgctttatggaactctgag

SEQ ID NO: 122510 - DNA, 25 bp, Mus musculus
gtgccgaactagaagaaagccctcc

SEQ ID NO: 122511 - DNA, 25 bp, Mus musculus
gtgccgcccttcttgagacgctcta

SEQ ID NO: 122512 - DNA, 25 bp, Mus musculus
gtgccgggtatctacaccagagttt

SEQ ID NO: 122513 - DNA, 25 bp, Mus musculus
gtgccgtgacccctatttagctgtg

SEQ ID NO: 122514 - DNA, 25 bp, Mus musculus
gtgcctatggccaccactgaaacct

SEQ ID NO: 122515 - DNA, 25 bp, Mus musculus
gtgcctccacgagtttcatcgaacg

SEQ ID NO: 122516 - DNA, 25 bp, Mus musculus
gtgcctcctgagaagtgccgctgtg

SEQ ID NO: 122517 - DNA, 25 bp, Mus musculus
gtgcctctcgggataggagacgacg

SEQ ID NO: 122518 - DNA, 25 bp, Mus musculus
gtgcctgaaaaagcccttggagaca

SEQ ID NO: 122519 - DNA, 25 bp, Mus musculus
gtgcctggagcacaccctgtaccag

SEQ ID NO: 122520 - DNA, 25 bp, Mus musculus
gtgccttcctccacaattgggattc

SEQ ID NO: 122521 - DNA, 25 bp, Mus musculus
gtgccttgcccatggatggctccca

SEQ ID NO: 122522 - DNA, 25 bp, Mus musculus
gtgcgattggactgaaacttggcaa

SEQ ID NO: 122523 - DNA, 25 bp, Mus musculus
gtgcgcatgcacagtttcgggaccc

SEQ ID NO: 122524 - DNA, 25 bp, Mus musculus
gtgcgctcgggcttcgctagcctag

SEQ ID NO: 122525 - DNA, 25 bp, Mus musculus
gtgcggagcacagtccagcgtcgca

SEQ ID NO: 122526 - DNA, 25 bp, Mus musculus
gtgcgggccctctttgactttaatg

SEQ ID NO: 122527 - DNA, 25 bp, Mus musculus
gtgcggtcttaagggcggccgcggc

SEQ ID NO: 122528 - DNA, 25 bp, Mus musculus
gtgcgtaaccctgtacggcaccgct

SEQ ID NO: 122529 - DNA, 25 bp, Mus musculus
gtgcgtcatcgcaggccacgagagc

SEQ ID NO: 122530 - DNA, 25 bp, Mus musculus
gtgcgtcgccggtgctgctagcgca

SEQ ID NO: 122531 - DNA, 25 bp, Mus musculus
gtgctaaagtcatcgcccaggctct

SEQ ID NO: 122532 - DNA, 25 bp, Mus musculus
gtgctaaagtgtgcctgacagatgt

SEQ ID NO: 122533 - DNA, 25 bp, Mus musculus
gtgctaaccacctgaggctccatgt

SEQ ID NO: 122534 - DNA, 25 bp, Mus musculus
gtgctaacccgcagctggaatggca

SEQ ID NO: 122535 - DNA, 25 bp, Mus musculus
gtgctaagttcatccattccatgtg

SEQ ID NO: 122536 - DNA, 25 bp, Mus musculus
gtgctatgcctgtaacaagagcatc

SEQ ID NO: 122537 - DNA, 25 bp, Mus musculus
gtgctcatgactcccttggccctgt

SEQ ID NO: 122538 - DNA, 25 bp, Mus musculus
gtgctcatgcatcccactgggcaag

SEQ ID NO: 122539 - DNA, 25 bp, Mus musculus
gtgctccaagaactgcctgtgcgcg

SEQ ID NO: 122540 - DNA, 25 bp, Mus musculus
gtgctccaaggcagcggtttcctcc

SEQ ID NO: 122541 - DNA, 25 bp, Mus musculus
gtgctccctcggacggaagcggcca

SEQ ID NO: 122542 - DNA, 25 bp, Mus musculus
gtgctcttcgtgtccatgctggaca

SEQ ID NO: 122543 - DNA, 25 bp, Mus musculus
gtgctgaagaacatgtcgcagcgca

SEQ ID NO: 122544 - DNA, 25 bp, Mus musculus
gtgctgacgtcaggcgcgtgcccct

SEQ ID NO: 122545 - DNA, 25 bp, Mus musculus
gtgctgactatagcgggaccaccat

SEQ ID NO: 122546 - DNA, 25 bp, Mus musculus
gtgctgactgactacccatctcctg

SEQ ID NO: 122547 - DNA, 25 bp, Mus musculus
gtgctgaggactaaccagttctccg

SEQ ID NO: 122548 - DNA, 25 bp, Mus musculus
gtgctgcacacactcacaggagcca

SEQ ID NO: 122549 - DNA, 25 bp, Mus musculus
gtgctgcagttcaccaccgggaggt

SEQ ID NO: 122550 - DNA, 25 bp, Mus musculus
gtgctgccacgggtggagtaaacct

SEQ ID NO: 122551 - DNA, 25 bp, Mus musculus
gtgctgctggccaaaccgagggatt

SEQ ID NO: 122552 - DNA, 25 bp, Mus musculus
gtgctgggtcccgagtgagccatac

SEQ ID NO: 122553 - DNA, 25 bp, Mus musculus
gtgctgtagacatcgatgacaatgg

SEQ ID NO: 122554 - DNA, 25 bp, Mus musculus
gtgctgtgcacgctatttaccagag

SEQ ID NO: 122555 - DNA, 25 bp, Mus musculus
gtgctgtgtctaccgcccgctcaag

SEQ ID NO: 122556 - DNA, 25 bp, Mus musculus
gtgcttattttacgcatggtccata

SEQ ID NO: 122557 - DNA, 25 bp, Mus musculus
gtgcttcagccgagccaccactatt

SEQ ID NO: 122558 - DNA, 25 bp, Mus musculus
gtgcttcccggacaacagtatgtgt

SEQ ID NO: 122559 - DNA, 25 bp, Mus musculus
gtgcttctaaagtaaatacagctgc

SEQ ID NO: 122560 - DNA, 25 bp, Mus musculus
gtgcttctcaggcaacatcatcagc

SEQ ID NO: 122561 - DNA, 25 bp, Mus musculus
gtgcttgaccattggacatagtctg

SEQ ID NO: 122562 - DNA, 25 bp, Mus musculus
gtgcttgctgccttcatcctgacat

SEQ ID NO: 122563 - DNA, 25 bp, Mus musculus
gtgcttgggcctctccctcctggtg

SEQ ID NO: 122564 - DNA, 25 bp, Mus musculus
gtgcttgggctcacaactctcatgg

SEQ ID NO: 122565 - DNA, 25 bp, Mus musculus
gtgctttcgctttcccttcccgctg

SEQ ID NO: 122566 - DNA, 25 bp, Mus musculus
gtggaaaagcacacggagcagagcc

SEQ ID NO: 122567 - DNA, 25 bp, Mus musculus
gtggaacaatgatatctacctgcag

SEQ ID NO: 122568 - DNA, 25 bp, Mus musculus
gtggaacattccgtggactacgtgg

SEQ ID NO: 122569 - DNA, 25 bp, Mus musculus
gtggaacctaccgaccaaggctgct

SEQ ID NO: 122570 - DNA, 25 bp, Mus musculus
gtggaacctagggtcagcacctctg

SEQ ID NO: 122571 - DNA, 25 bp, Mus musculus
gtggaactcagagcctcgtccggtg

SEQ ID NO: 122572 - DNA, 25 bp, Mus musculus
gtggaactcttctctagccgggaaa

SEQ ID NO: 122573 - DNA, 25 bp, Mus musculus
gtggaatgagccagcagcatgccga

SEQ ID NO: 122574 - DNA, 25 bp, Mus musculus
gtggaattcattggagagaccgctc

SEQ ID NO: 122575 - DNA, 25 bp, Mus musculus
gtggacaacaacctactgcccgtgg

SEQ ID NO: 122576 - DNA, 25 bp, Mus musculus
gtggacacatacaggaagaccccgt

SEQ ID NO: 122577 - DNA, 25 bp, Mus musculus
gtggacacgtcacctacccctgtgt

SEQ ID NO: 122578 - DNA, 25 bp, Mus musculus
gtggacagcgccctcacaggacagt

SEQ ID NO: 122579 - DNA, 25 bp, Mus musculus
gtggacatggcagagtatagataag

SEQ ID NO: 122580 - DNA, 25 bp, Mus musculus
gtggaccaacccacagtggcacctt

SEQ ID NO: 122581 - DNA, 25 bp, Mus musculus
gtggacctacgcagcgacacggtga

SEQ ID NO: 122582 - DNA, 25 bp, Mus musculus
gtggacctcctgcaaacgcgatttg

SEQ ID NO: 122583 - DNA, 25 bp, Mus musculus
gtggacgaatatgacgagaacagtt

SEQ ID NO: 122584 - DNA, 25 bp, Mus musculus
gtggacgcggccgaggcgtgtacag

SEQ ID NO: 122585 - DNA, 25 bp, Mus musculus
gtggactagtgatggcagcgccatt

SEQ ID NO: 122586 - DNA, 25 bp, Mus musculus
gtggactcactctccgagggcgatg

SEQ ID NO: 122587 - DNA, 25 bp, Mus musculus
gtggactcgccaggaagtttcccga

SEQ ID NO: 122588 - DNA, 25 bp, Mus musculus
gtggactctgagtacattgctacag

SEQ ID NO: 122589 - DNA, 25 bp, Mus musculus
gtggactggcaagggactagaataa

SEQ ID NO: 122590 - DNA, 25 bp, Mus musculus
gtggacttcaccaacacgcaggagg

SEQ ID NO: 122591 - DNA, 25 bp, Mus musculus
gtggacttcccacgcactgcagatg

SEQ ID NO: 122592 - DNA, 25 bp, Mus musculus
gtggacttcttcgagcccagcacgt

SEQ ID NO: 122593 - DNA, 25 bp, Mus musculus
gtggagaatccagtacctcaaagga

SEQ ID NO: 122594 - DNA, 25 bp, Mus musculus
gtggagccccaccaactggccattg

SEQ ID NO: 122595 - DNA, 25 bp, Mus musculus
gtggaggcgcttgactaagacacct

SEQ ID NO: 122596 - DNA, 25 bp, Mus musculus
gtggagtacatgaacttatctgtat

SEQ ID NO: 122597 - DNA, 25 bp, Mus musculus
gtggagttgagcagatcttccagct

SEQ ID NO: 122598 - DNA, 25 bp, Mus musculus
gtggataaagaagcagagccccggt

SEQ ID NO: 122599 - DNA, 25 bp, Mus musculus
gtggataccccaccaagactctcga

SEQ ID NO: 122600 - DNA, 25 bp, Mus musculus
gtggatctcattcttgcgtcagcta

SEQ ID NO: 122601 - DNA, 25 bp, Mus musculus
gtggatgaaactgcagatggagccc

SEQ ID NO: 122602 - DNA, 25 bp, Mus musculus
gtggatgcagcccacaacgcctgta

SEQ ID NO: 122603 - DNA, 25 bp, Mus musculus
gtggatgcctgtgtgatcactgcag

SEQ ID NO: 122604 - DNA, 25 bp, Mus musculus
gtggatggaaacagccccgtcaggt

SEQ ID NO: 122605 - DNA, 25 bp, Mus musculus
gtggatggtggccttacatcctcag

SEQ ID NO: 122606 - DNA, 25 bp, Mus musculus
gtggatgtcccatgttcccggcctc

SEQ ID NO: 122607 - DNA, 25 bp, Mus musculus
gtggcaaacccatagcagctgtgat

SEQ ID NO: 122608 - DNA, 25 bp, Mus musculus
gtggcacagtggtcaaacaaggcta

SEQ ID NO: 122609 - DNA, 25 bp, Mus musculus
gtggcactgagcaagctggcttctt

SEQ ID NO: 122610 - DNA, 25 bp, Mus musculus
gtggcactgcatactgaatctaaag

SEQ ID NO: 122611 - DNA, 25 bp, Mus musculus
gtggcacttcctccgcaactgatgg

SEQ ID NO: 122612 - DNA, 25 bp, Mus musculus
gtggcagaaaataacgtgattcacc

SEQ ID NO: 122613 - DNA, 25 bp, Mus musculus
gtggcagccaccttgccggtgcagt

SEQ ID NO: 122614 - DNA, 25 bp, Mus musculus
gtggcagctaatgatggccccatgc

SEQ ID NO: 122615 - DNA, 25 bp, Mus musculus
gtggcagttccgcaatatgatcaag

SEQ ID NO: 122616 - DNA, 25 bp, Mus musculus
gtggcattccatcagcgcagagctg

SEQ ID NO: 122617 - DNA, 25 bp, Mus musculus
gtggccaccctaacagctgacgata

SEQ ID NO: 122618 - DNA, 25 bp, Mus musculus
gtggccactgccagcctgagatctc

SEQ ID NO: 122619 - DNA, 25 bp, Mus musculus
gtggccagagaccacctacaccaaa

SEQ ID NO: 122620 - DNA, 25 bp, Mus musculus
gtggccagcaacttcacgttcctca

SEQ ID NO: 122621 - DNA, 25 bp, Mus musculus
gtggccatggccaagcagtacgact

SEQ ID NO: 122622 - DNA, 25 bp, Mus musculus
gtggcccagagtggtgagatccccc

SEQ ID NO: 122623 - DNA, 25 bp, Mus musculus
gtggccctcgtctccttctgtgtaa

SEQ ID NO: 122624 - DNA, 25 bp, Mus musculus
gtggccggtagggactcgggctaca

SEQ ID NO: 122625 - DNA, 25 bp, Mus musculus
gtggccgtacgatggtgcagttgtt

SEQ ID NO: 122626 - DNA, 25 bp, Mus musculus
gtggcctcagctccattcatgaaag

SEQ ID NO: 122627 - DNA, 25 bp, Mus musculus
gtggcctcgcgtacctcctgggaaa

SEQ ID NO: 122628 - DNA, 25 bp, Mus musculus
gtggcctcttcctgtgtgatgctgg

SEQ ID NO: 122629 - DNA, 25 bp, Mus musculus
gtggcctgaagctggagacccatca

SEQ ID NO: 122630 - DNA, 25 bp, Mus musculus
gtggccttccaacctacgtagcaga

SEQ ID NO: 122631 - DNA, 25 bp, Mus musculus
gtggcgcctaccctctgcctgtggg

SEQ ID NO: 122632 - DNA, 25 bp, Mus musculus
gtggcgcgatcatgctccgggtccc

SEQ ID NO: 122633 - DNA, 25 bp, Mus musculus
gtggcgtgctgggaacacaacgcct

SEQ ID NO: 122634 - DNA, 25 bp, Mus musculus
gtggctagcctaaaaatattatctg

SEQ ID NO: 122635 - DNA, 25 bp, Mus musculus
gtggctccatgaccgtcgtacacaa

SEQ ID NO: 122636 - DNA, 25 bp, Mus musculus
gtggctcccgcctcagactgaatta

SEQ ID NO: 122637 - DNA, 25 bp, Mus musculus
gtggctcctaaatttactcccgtgg

SEQ ID NO: 122638 - DNA, 25 bp, Mus musculus
gtggctcttagagcagaagacgctg

SEQ ID NO: 122639 - DNA, 25 bp, Mus musculus
gtggctggaaacatctctgaccctg

SEQ ID NO: 122640 - DNA, 25 bp, Mus musculus
gtggctggcaacagttcctgtcctg

SEQ ID NO: 122641 - DNA, 25 bp, Mus musculus
gtggcttacttcaacatcgagttca

SEQ ID NO: 122642 - DNA, 25 bp, Mus musculus
gtggcttcccggaaccgagcaccaa

SEQ ID NO: 122643 - DNA, 25 bp, Mus musculus
gtggcttctggacaattacgagaca

SEQ ID NO: 122644 - DNA, 25 bp, Mus musculus
gtggcttgctgggcccagtcctcga

SEQ ID NO: 122645 - DNA, 25 bp, Mus musculus
gtggctttgtcccacctgaagtgac

SEQ ID NO: 122646 - DNA, 25 bp, Mus musculus
gtgggaaatcttttaagagacagag

SEQ ID NO: 122647 - DNA, 25 bp, Mus musculus
gtgggactcgtggaacaagctgaaa

SEQ ID NO: 122648 - DNA, 25 bp, Mus musculus
gtgggactctgctaggcttcatctc

SEQ ID NO: 122649 - DNA, 25 bp, Mus musculus
gtgggactgagcggcccagccgctg

SEQ ID NO: 122650 - DNA, 25 bp, Mus musculus
gtgggactgcagacggaagccatgg

SEQ ID NO: 122651 - DNA, 25 bp, Mus musculus
gtgggataacctgggctctctgaca

SEQ ID NO: 122652 - DNA, 25 bp, Mus musculus
gtgggatagcccgaatagatttcct

SEQ ID NO: 122653 - DNA, 25 bp, Mus musculus
gtgggatcccctcgctgagtcctaa

SEQ ID NO: 122654 - DNA, 25 bp, Mus musculus
gtgggatgtcggtaaaagcacagcc

SEQ ID NO: 122655 - DNA, 25 bp, Mus musculus
gtgggcacgcgcaaccaagatgtct

SEQ ID NO: 122656 - DNA, 25 bp, Mus musculus
gtgggcctaaccaacacgagctgca

SEQ ID NO: 122657 - DNA, 25 bp, Mus musculus
gtgggctatcacaactcagttacag

SEQ ID NO: 122658 - DNA, 25 bp, Mus musculus
gtgggctccactctctacaccaagg

SEQ ID NO: 122659 - DNA, 25 bp, Mus musculus
gtgggctcctcaaccggctgcagaa

SEQ ID NO: 122660 - DNA, 25 bp, Mus musculus
gtggggactctagaccgcagctgca

SEQ ID NO: 122661 - DNA, 25 bp, Mus musculus
gtgggtgagcctcctgcaccggctg

SEQ ID NO: 122662 - DNA, 25 bp, Mus musculus
gtgggtgcatgaatccgggtactcc

SEQ ID NO: 122663 - DNA, 25 bp, Mus musculus
gtgggtgccagcaggacaggccatt

SEQ ID NO: 122664 - DNA, 25 bp, Mus musculus
gtgggtggcgagtgtggctgccccg

SEQ ID NO: 122665 - DNA, 25 bp, Mus musculus
gtgggttcttccgctcagacctggg

SEQ ID NO: 122666 - DNA, 25 bp, Mus musculus
gtggtacaaactgaacagggcccct

SEQ ID NO: 122667 - DNA, 25 bp, Mus musculus
gtggtagaaccactgaaggacatag

SEQ ID NO: 122668 - DNA, 25 bp, Mus musculus
gtggtcaacttcttcctggcgcgca

SEQ ID NO: 122669 - DNA, 25 bp, Mus musculus
gtggtcaagtttgccgacacggata

SEQ ID NO: 122670 - DNA, 25 bp, Mus musculus
gtggtcccaggatacggtcatgcag

SEQ ID NO: 122671 - DNA, 25 bp, Mus musculus
gtggtcgagtcctgctggttctccc

SEQ ID NO: 122672 - DNA, 25 bp, Mus musculus
gtggtcgtccgatctggatggaaaa

SEQ ID NO: 122673 - DNA, 25 bp, Mus musculus
gtggtgacccggactgtctcctgcc

SEQ ID NO: 122674 - DNA, 25 bp, Mus musculus
gtggtgagcttcatagccctgtgca

SEQ ID NO: 122675 - DNA, 25 bp, Mus musculus
gtggtgatgtcttaacttcaaatgt

SEQ ID NO: 122676 - DNA, 25 bp, Mus musculus
gtggtgcacacgaggcgctatctca

SEQ ID NO: 122677 - DNA, 25 bp, Mus musculus
gtggtgctagccgagaccaccaacg

SEQ ID NO: 122678 - DNA, 25 bp, Mus musculus
gtggtgctcaacaggactcagattc

SEQ ID NO: 122679 - DNA, 25 bp, Mus musculus
gtggtgctggccgacctctggaact

SEQ ID NO: 122680 - DNA, 25 bp, Mus musculus
gtggtggcagctaatgatggcccca

SEQ ID NO: 122681 - DNA, 25 bp, Mus musculus
gtggtggctcaagcggcgcggagct

SEQ ID NO: 122682 - DNA, 25 bp, Mus musculus
gtggtgtcgcattccctcagagagg

SEQ ID NO: 122683 - DNA, 25 bp, Mus musculus
gtggttaattaaaacatttggtgtg

SEQ ID NO: 122684 - DNA, 25 bp, Mus musculus
gtggttacagctgcgggccaacgct

SEQ ID NO: 122685 - DNA, 25 bp, Mus musculus
gtggttatcatcgttcgggcgccgc

SEQ ID NO: 122686 - DNA, 25 bp, Mus musculus
gtggttattaccaatctgaatggcc

SEQ ID NO: 122687 - DNA, 25 bp, Mus musculus
gtggttcccagtggcgagaggagga

SEQ ID NO: 122688 - DNA, 25 bp, Mus musculus
gtggttctcagcatcgatgggatca

SEQ ID NO: 122689 - DNA, 25 bp, Mus musculus
gtggttgctcgtgtcatccgccaga

SEQ ID NO: 122690 - DNA, 25 bp, Mus musculus
gtgtaaaaacgtcctgccattgggc

SEQ ID NO: 122691 - DNA, 25 bp, Mus musculus
gtgtaaagcacagaaccgcaagctc

SEQ ID NO: 122692 - DNA, 25 bp, Mus musculus
gtgtaacagacccacaaagttatag

SEQ ID NO: 122693 - DNA, 25 bp, Mus musculus
gtgtaacttctcttctggatctaac

SEQ ID NO: 122694 - DNA, 25 bp, Mus musculus
gtgtaatcacgtccacaatgaggct

SEQ ID NO: 122695 - DNA, 25 bp, Mus musculus
gtgtaatgctgatgcaaaccctcca

SEQ ID NO: 122696 - DNA, 25 bp, Mus musculus
gtgtacacggtggtttgtctccaga

SEQ ID NO: 122697 - DNA, 25 bp, Mus musculus
gtgtacccaatggacttcactgatg

SEQ ID NO: 122698 - DNA, 25 bp, Mus musculus
gtgtaccgcaagatgtggaacccca

SEQ ID NO: 122699 - DNA, 25 bp, Mus musculus
gtgtactaccccagcatcacgtacg

SEQ ID NO: 122700 - DNA, 25 bp, Mus musculus
gtgtactcctgtgggacttccatgg

SEQ ID NO: 122701 - DNA, 25 bp, Mus musculus
gtgtactgagccatctgctgccttt

SEQ ID NO: 122702 - DNA, 25 bp, Mus musculus
gtgtagaaaagcactggtgacctgg

SEQ ID NO: 122703 - DNA, 25 bp, Mus musculus
gtgtagcgcccttgggtacttggaa

SEQ ID NO: 122704 - DNA, 25 bp, Mus musculus
gtgtaggttcactccatctggcaga

SEQ ID NO: 122705 - DNA, 25 bp, Mus musculus
gtgtatccagtccgccttagcgccg

SEQ ID NO: 122706 - DNA, 25 bp, Mus musculus
gtgtatgatgctgctcctgcctctc

SEQ ID NO: 122707 - DNA, 25 bp, Mus musculus
gtgtattggagctcagcacaagtgg

SEQ ID NO: 122708 - DNA, 25 bp, Mus musculus
gtgtcaaaatagtagctcccagagg

SEQ ID NO: 122709 - DNA, 25 bp, Mus musculus
gtgtcaaacgctgcacaggctcggg

SEQ ID NO: 122710 - DNA, 25 bp, Mus musculus
gtgtcaacgatgctagaagaatacg

SEQ ID NO: 122711 - DNA, 25 bp, Mus musculus
gtgtcaactgtttatgtgccatctg

SEQ ID NO: 122712 - DNA, 25 bp, Mus musculus
gtgtcaccaaaatctacaactacta

SEQ ID NO: 122713 - DNA, 25 bp, Mus musculus
gtgtcaccaaacagatccaagcctg

SEQ ID NO: 122714 - DNA, 25 bp, Mus musculus
gtgtcagaggaaggtgacgcggaag

SEQ ID NO: 122715 - DNA, 25 bp, Mus musculus
gtgtcaggaggtcaaagataaccct

SEQ ID NO: 122716 - DNA, 25 bp, Mus musculus
gtgtcagtaccactttgctgagcag

SEQ ID NO: 122717 - DNA, 25 bp, Mus musculus
gtgtcataagccgaataagtatttt

SEQ ID NO: 122718 - DNA, 25 bp, Mus musculus
gtgtcatatcatctgcctgccaagg

SEQ ID NO: 122719 - DNA, 25 bp, Mus musculus
gtgtccaaaataacgagattaaaca

SEQ ID NO: 122720 - DNA, 25 bp, Mus musculus
gtgtccatcctgcatccgcaagagc

SEQ ID NO: 122721 - DNA, 25 bp, Mus musculus
gtgtcccaaggaccctactcaagcg

SEQ ID NO: 122722 - DNA, 25 bp, Mus musculus
gtgtcccggcattcagccaccttct

SEQ ID NO: 122723 - DNA, 25 bp, Mus musculus
gtgtccgccgatgccttagaagtgg

SEQ ID NO: 122724 - DNA, 25 bp, Mus musculus
gtgtccgcctgaacctggtgcggaa

SEQ ID NO: 122725 - DNA, 25 bp, Mus musculus
gtgtcctgagaaggcttagcgcctg

SEQ ID NO: 122726 - DNA, 25 bp, Mus musculus
gtgtcctttgcgaggctgaaacccg

SEQ ID NO: 122727 - DNA, 25 bp, Mus musculus
gtgtctaccagcagccttaacctca

SEQ ID NO: 122728 - DNA, 25 bp, Mus musculus
gtgtctcactgaccattcgccgcgt

SEQ ID NO: 122729 - DNA, 25 bp, Mus musculus
gtgtctctcagccagtttaagctgg

SEQ ID NO: 122730 - DNA, 25 bp, Mus musculus
gtgtctcttgagcatcccttcgcgc

SEQ ID NO: 122731 - DNA, 25 bp, Mus musculus
gtgtctgcaaccctaaactatgaga

SEQ ID NO: 122732 - DNA, 25 bp, Mus musculus
gtgtctgcggtgtgcgcctctcgcc

SEQ ID NO: 122733 - DNA, 25 bp, Mus musculus
gtgtctggcctccaaagagcccatc

SEQ ID NO: 122734 - DNA, 25 bp, Mus musculus
gtgtctggctctggagaagaggctt

SEQ ID NO: 122735 - DNA, 25 bp, Mus musculus
gtgtcttcacatacgactgcagtac

SEQ ID NO: 122736 - DNA, 25 bp, Mus musculus
gtgtgaccaagtaaccaaggatggc

SEQ ID NO: 122737 - DNA, 25 bp, Mus musculus
gtgtgacctagcagagtggacccag

SEQ ID NO: 122738 - DNA, 25 bp, Mus musculus
gtgtgatcccaaacttcatccaaag

SEQ ID NO: 122739 - DNA, 25 bp, Mus musculus
gtgtgccaacagaatctcggcctgg

SEQ ID NO: 122740 - DNA, 25 bp, Mus musculus
gtgtgcctgcgtggcgtcttcagaa

SEQ ID NO: 122741 - DNA, 25 bp, Mus musculus
gtgtgcggcagcagaggtgttagcg

SEQ ID NO: 122742 - DNA, 25 bp, Mus musculus
gtgtgctatccatcccatacctggg

SEQ ID NO: 122743 - DNA, 25 bp, Mus musculus
gtgtgctccagcaacaagatccgcc

SEQ ID NO: 122744 - DNA, 25 bp, Mus musculus
gtgtgcttcagcgtgaccccagctt

SEQ ID NO: 122745 - DNA, 25 bp, Mus musculus
gtgtgcttcatatcctcactcctga

SEQ ID NO: 122746 - DNA, 25 bp, Mus musculus
gtgtgcttcgcacccaatatgatgt

SEQ ID NO: 122747 - DNA, 25 bp, Mus musculus
gtgtggaaccaaagcgacctagccg

SEQ ID NO: 122748 - DNA, 25 bp, Mus musculus
gtgtggattatctctctggaccgcg

SEQ ID NO: 122749 - DNA, 25 bp, Mus musculus
gtgtggcaactgagtgacagctccc

SEQ ID NO: 122750 - DNA, 25 bp, Mus musculus
gtgtggccagcaacttcacgttcct

SEQ ID NO: 122751 - DNA, 25 bp, Mus musculus
gtgtggcccctgcaagatcctagga

SEQ ID NO: 122752 - DNA, 25 bp, Mus musculus
gtgtggctgtaagggaccaccagac

SEQ ID NO: 122753 - DNA, 25 bp, Mus musculus
gtgtggcttacatcaacatggtccc

SEQ ID NO: 122754 - DNA, 25 bp, Mus musculus
gtgtggttcttgacgcgccgcgaac

SEQ ID NO: 122755 - DNA, 25 bp, Mus musculus
gtgtggtttcatgttaaacctcaaa

SEQ ID NO: 122756 - DNA, 25 bp, Mus musculus
gtgtgtacaacacccggcacgtgtg

SEQ ID NO: 122757 - DNA, 25 bp, Mus musculus
gtgtgtagaggatcttttccccact

SEQ ID NO: 122758 - DNA, 25 bp, Mus musculus
gtgtgtatcataccctcaagtgaca

SEQ ID NO: 122759 - DNA, 25 bp, Mus musculus
gtgtgtcgtgcaaggcccatctggt

SEQ ID NO: 122760 - DNA, 25 bp, Mus musculus
gtgtgtgaagaagaccaaactccca

SEQ ID NO: 122761 - DNA, 25 bp, Mus musculus
gtgtgttactaagctggagagcatg

SEQ ID NO: 122762 - DNA, 25 bp, Mus musculus
gtgttaaacatacctaccccagtgg

SEQ ID NO: 122763 - DNA, 25 bp, Mus musculus
gtgttaagcgcatcccatccaaggg

SEQ ID NO: 122764 - DNA, 25 bp, Mus musculus
gtgttaatgatgcttctgcggcctc

SEQ ID NO: 122765 - DNA, 25 bp, Mus musculus
gtgttaattatctttgctttctggg

SEQ ID NO: 122766 - DNA, 25 bp, Mus musculus
gtgttacccgaatgcgatgctggcg

SEQ ID NO: 122767 - DNA, 25 bp, Mus musculus
gtgttactgggtgtggcacgtcctc

SEQ ID NO: 122768 - DNA, 25 bp, Mus musculus
gtgttcacacagctggtcatcacag

SEQ ID NO: 122769 - DNA, 25 bp, Mus musculus
gtgttcatgggcctgcgcacacgac

SEQ ID NO: 122770 - DNA, 25 bp, Mus musculus
gtgttcccaggagctatgttcagag

SEQ ID NO: 122771 - DNA, 25 bp, Mus musculus
gtgttcgctcctgggaggatgtgga

SEQ ID NO: 122772 - DNA, 25 bp, Mus musculus
gtgttctgtgtgaccctgaaggcca

SEQ ID NO: 122773 - DNA, 25 bp, Mus musculus
gtgttctttgctgtgcgacccgggc

SEQ ID NO: 122774 - DNA, 25 bp, Mus musculus
gtgttgctatcctgggacccacatt

SEQ ID NO: 122775 - DNA, 25 bp, Mus musculus
gtgttggccttacggcatccgatga

SEQ ID NO: 122776 - DNA, 25 bp, Mus musculus
gtgtttccatcccatcacagaagag

SEQ ID NO: 122777 - DNA, 25 bp, Mus musculus
gtgtttctcaactgctggctggcca

SEQ ID NO: 122778 - DNA, 25 bp, Mus musculus
gtgtttctcagcgaacatttcgaga

SEQ ID NO: 122779 - DNA, 25 bp, Mus musculus
gtgtttgcacgcagccacctaggaa

SEQ ID NO: 122780 - DNA, 25 bp, Mus musculus
gtgtttggaccaaccctcatgagat

SEQ ID NO: 122781 - DNA, 25 bp, Mus musculus
gtgttttctctgtcaagtactgcag

SEQ ID NO: 122782 - DNA, 25 bp, Mus musculus
gtgtttttgacctctactaccgaga

SEQ ID NO: 122783 - DNA, 25 bp, Mus musculus
gttaaaaagcaccattcagaggagt

SEQ ID NO: 122784 - DNA, 25 bp, Mus musculus
gttaaaacgaacagcaccttgggtg

SEQ ID NO: 122785 - DNA, 25 bp, Mus musculus
gttaaaagactcctgaataaactgc

SEQ ID NO: 122786 - DNA, 25 bp, Mus musculus
gttaaacatgtgaaagactctgcct

SEQ ID NO: 122787 - DNA, 25 bp, Mus musculus
gttaaagaaacactcaacagccagt

SEQ ID NO: 122788 - DNA, 25 bp, Mus musculus
gttaaagtctgacacggccgctgca

SEQ ID NO: 122789 - DNA, 25 bp, Mus musculus
gttaaagtggctgtgctgcaccgca

SEQ ID NO: 122790 - DNA, 25 bp, Mus musculus
gttaacccagctgcactattgtgag

SEQ ID NO: 122791 - DNA, 25 bp, Mus musculus
gttaaccgcctctttgaagcccaag

SEQ ID NO: 122792 - DNA, 25 bp, Mus musculus
gttaaccttggaacagccttgcctg

SEQ ID NO: 122793 - DNA, 25 bp, Mus musculus
gttaacgagtccgaaatcatcccag

SEQ ID NO: 122794 - DNA, 25 bp, Mus musculus
gttaactactatgtcgacacagctg

SEQ ID NO: 122795 - DNA, 25 bp, Mus musculus
gttaagcacccatgaccagccatca

SEQ ID NO: 122796 - DNA, 25 bp, Mus musculus
gttaaggccattgacagcctcccag

SEQ ID NO: 122797 - DNA, 25 bp, Mus musculus
gttaaggctctgttgacgcggaccg

SEQ ID NO: 122798 - DNA, 25 bp, Mus musculus
gttaatatcttcaaggctggagctg

SEQ ID NO: 122799 - DNA, 25 bp, Mus musculus
gttaatctctgcaggtcactaccag

SEQ ID NO: 122800 - DNA, 25 bp, Mus musculus
gttaatgatccctcagcaggccctg

SEQ ID NO: 122801 - DNA, 25 bp, Mus musculus
gttaatgctgcttgtctttggagta

SEQ ID NO: 122802 - DNA, 25 bp, Mus musculus
gttacaaaatggcacattctactgg

SEQ ID NO: 122803 - DNA, 25 bp, Mus musculus
gttacaaaggctgcgtgtgccccac

SEQ ID NO: 122804 - DNA, 25 bp, Mus musculus
gttacaaggacagcaaaccgcccaa

SEQ ID NO: 122805 - DNA, 25 bp, Mus musculus
gttacaatatgaaagacagcacctc

SEQ ID NO: 122806 - DNA, 25 bp, Mus musculus
gttacaccaggtttagccagtcgcc

SEQ ID NO: 122807 - DNA, 25 bp, Mus musculus
gttacaccctgcagccaatatccag

SEQ ID NO: 122808 - DNA, 25 bp, Mus musculus
gttacactacataaaggtgcccagt

SEQ ID NO: 122809 - DNA, 25 bp, Mus musculus
gttacactcccgagcagagaccact

SEQ ID NO: 122810 - DNA, 25 bp, Mus musculus
gttacagacctgttgggccgacgac

SEQ ID NO: 122811 - DNA, 25 bp, Mus musculus
gttacagatcccagtaagaagcctg

SEQ ID NO: 122812 - DNA, 25 bp, Mus musculus
gttacagcacaccatcatccacaag

SEQ ID NO: 122813 - DNA, 25 bp, Mus musculus
gttacaggttgacacattgcttgac

SEQ ID NO: 122814 - DNA, 25 bp, Mus musculus
gttacatttcctagaagggccccag

SEQ ID NO: 122815 - DNA, 25 bp, Mus musculus
gttaccacggaaaccagcagagcta

SEQ ID NO: 122816 - DNA, 25 bp, Mus musculus
gttaccacgtattacaagtatgatg

SEQ ID NO: 122817 - DNA, 25 bp, Mus musculus
gttaccatagtaactcgtgtggcgt

SEQ ID NO: 122818 - DNA, 25 bp, Mus musculus
gttaccgaagagacatgcactatcc

SEQ ID NO: 122819 - DNA, 25 bp, Mus musculus
gttacctcttcgtccagaaattggg

SEQ ID NO: 122820 - DNA, 25 bp, Mus musculus
gttacgtctggaccggactcagcct

SEQ ID NO: 122821 - DNA, 25 bp, Mus musculus
gttactaacacgtgtgagggcccca

SEQ ID NO: 122822 - DNA, 25 bp, Mus musculus
gttactatgcaacccatcatgagct

SEQ ID NO: 122823 - DNA, 25 bp, Mus musculus
gttactccaacctctatggcccggg

SEQ ID NO: 122824 - DNA, 25 bp, Mus musculus
gttactccgccatgtggaagccaga

SEQ ID NO: 122825 - DNA, 25 bp, Mus musculus
gttactcctagaactgctggaactg

SEQ ID NO: 122826 - DNA, 25 bp, Mus musculus
gttactcttactgtccggtgtccgg

SEQ ID NO: 122827 - DNA, 25 bp, Mus musculus
gttacttctgattggcgattctggg

SEQ ID NO: 122828 - DNA, 25 bp, Mus musculus
gttacttgacgaggttgaggccagc

SEQ ID NO: 122829 - DNA, 25 bp, Mus musculus
gttacttgggaaacacgcctgctgc

SEQ ID NO: 122830 - DNA, 25 bp, Mus musculus
gttagaacgagagatggcactggcc

SEQ ID NO: 122831 - DNA, 25 bp, Mus musculus
gttagaccgctacccatggaagtgc

SEQ ID NO: 122832 - DNA, 25 bp, Mus musculus
gttagagacctacggagtggaccct

SEQ ID NO: 122833 - DNA, 25 bp, Mus musculus
gttagcagaccatgcagctcgtcag

SEQ ID NO: 122834 - DNA, 25 bp, Mus musculus
gttagccgacgttatcatccatgag

SEQ ID NO: 122835 - DNA, 25 bp, Mus musculus
gttagctacgaggaccccagattca

SEQ ID NO: 122836 - DNA, 25 bp, Mus musculus
gttagctgcaacaacaccccagtgg

SEQ ID NO: 122837 - DNA, 25 bp, Mus musculus
gttagcttcagcctcctacagagag

SEQ ID NO: 122838 - DNA, 25 bp, Mus musculus
gttaggactgaaagaaccaccgagt

SEQ ID NO: 122839 - DNA, 25 bp, Mus musculus
gttaggccccgcttaaccatctatg

SEQ ID NO: 122840 - DNA, 25 bp, Mus musculus
gttaggcctccccgcacctaagaat

SEQ ID NO: 122841 - DNA, 25 bp, Mus musculus
gttagtaccgcatgagaacccagtc

SEQ ID NO: 122842 - DNA, 25 bp, Mus musculus
gttagtccaggcgtcggtccgcacg

SEQ ID NO: 122843 - DNA, 25 bp, Mus musculus
gttagtgagaaagagcccacccgat

SEQ ID NO: 122844 - DNA, 25 bp, Mus musculus
gttagtgccaacaataaagtcttgg

SEQ ID NO: 122845 - DNA, 25 bp, Mus musculus
gttatattatttggtaaagcaacag

SEQ ID NO: 122846 - DNA, 25 bp, Mus musculus
gttatcaaggccgagcgcggcgacc

SEQ ID NO: 122847 - DNA, 25 bp, Mus musculus
gttatcatctgatccgaggccccag

SEQ ID NO: 122848 - DNA, 25 bp, Mus musculus
gttatccacctcatgaatcactggc

SEQ ID NO: 122849 - DNA, 25 bp, Mus musculus
gttatccaggattctaccatccatc

SEQ ID NO: 122850 - DNA, 25 bp, Mus musculus
gttatcccctcatgatgtcctggag

SEQ ID NO: 122851 - DNA, 25 bp, Mus musculus
gttatcgctgcctatttcctgctgg

SEQ ID NO: 122852 - DNA, 25 bp, Mus musculus
gttatcgttgcttctgagaaacggg

SEQ ID NO: 122853 - DNA, 25 bp, Mus musculus
gttatcttcttcaactgctttctta

SEQ ID NO: 122854 - DNA, 25 bp, Mus musculus
gttatcttggcgctcacaccactgt

SEQ ID NO: 122855 - DNA, 25 bp, Mus musculus
gttatgaactacctgcccaccatgg

SEQ ID NO: 122856 - DNA, 25 bp, Mus musculus
gttatgcatgacgttggagggccca

SEQ ID NO: 122857 - DNA, 25 bp, Mus musculus
gttatggcttaaaacagatgtggca

SEQ ID NO: 122858 - DNA, 25 bp, Mus musculus
gttatgtaccgcacagatgggccca

SEQ ID NO: 122859 - DNA, 25 bp, Mus musculus
gttattcatgaagacgcacccacca

SEQ ID NO: 122860 - DNA, 25 bp, Mus musculus
gttatttcctgatgaaccgtcgcag

SEQ ID NO: 122861 - DNA, 25 bp, Mus musculus
gttcaaactctgaagcacccacaga

SEQ ID NO: 122862 - DNA, 25 bp, Mus musculus
gttcaacaagttcacggctgccggt

SEQ ID NO: 122863 - DNA, 25 bp, Mus musculus
gttcaacaccgcttccaggtgccgg

SEQ ID NO: 122864 - DNA, 25 bp, Mus musculus
gttcaagcccagcatgattacacgg

SEQ ID NO: 122865 - DNA, 25 bp, Mus musculus
gttcaaggctttgcagacagccccg

SEQ ID NO: 122866 - DNA, 25 bp, Mus musculus
gttcaatcaagacgagctggcgctc

SEQ ID NO: 122867 - DNA, 25 bp, Mus musculus
gttcaatggcctcacacctcggagt

SEQ ID NO: 122868 - DNA, 25 bp, Mus musculus
gttcaattacacaggacggcagggt

SEQ ID NO: 122869 - DNA, 25 bp, Mus musculus
gttcacagtcgcctctgccagtggg

SEQ ID NO: 122870 - DNA, 25 bp, Mus musculus
gttcacatcataccgagcaccaaag

SEQ ID NO: 122871 - DNA, 25 bp, Mus musculus
gttcacgagggcagcaggctcagct

SEQ ID NO: 122872 - DNA, 25 bp, Mus musculus
gttcacgcccggaataaactgcagg

SEQ ID NO: 122873 - DNA, 25 bp, Mus musculus
gttcagaaaccacctaaaagtaatg

SEQ ID NO: 122874 - DNA, 25 bp, Mus musculus
gttcagactgctcccaaagacctga

SEQ ID NO: 122875 - DNA, 25 bp, Mus musculus
gttcagagcctcaccaaggaagatg

SEQ ID NO: 122876 - DNA, 25 bp, Mus musculus
gttcagaggaacattggcggcacta

SEQ ID NO: 122877 - DNA, 25 bp, Mus musculus
gttcagcagtcaagccgcaggtgca

SEQ ID NO: 122878 - DNA, 25 bp, Mus musculus
gttcagcccgaataaagcaccagcg

SEQ ID NO: 122879 - DNA, 25 bp, Mus musculus
gttcagcctgtgcaagtcggactcc

SEQ ID NO: 122880 - DNA, 25 bp, Mus musculus
gttcagcttcgaccagacgttccag

SEQ ID NO: 122881 - DNA, 25 bp, Mus musculus
gttcaggacttattgttcaccgaag

SEQ ID NO: 122882 - DNA, 25 bp, Mus musculus
gttcaggtttaacagcaagctccaa

SEQ ID NO: 122883 - DNA, 25 bp, Mus musculus
gttcagtaaacagcagagacaggcc

SEQ ID NO: 122884 - DNA, 25 bp, Mus musculus
gttcagtacctctcgccagacgctt

SEQ ID NO: 122885 - DNA, 25 bp, Mus musculus
gttcagtcagaagatcagatacgtc

SEQ ID NO: 122886 - DNA, 25 bp, Mus musculus
gttcagtctccgtgaagcgtttgca

SEQ ID NO: 122887 - DNA, 25 bp, Mus musculus
gttcagttactgattaaaacccagg

SEQ ID NO: 122888 - DNA, 25 bp, Mus musculus
gttcataccccggaaaccagcgtgt

SEQ ID NO: 122889 - DNA, 25 bp, Mus musculus
gttcatcagccaccgattcccagaa

SEQ ID NO: 122890 - DNA, 25 bp, Mus musculus
gttcatcatttggaaacaaaagatc

SEQ ID NO: 122891 - DNA, 25 bp, Mus musculus
gttcatccgtccacgccaaatgggt

SEQ ID NO: 122892 - DNA, 25 bp, Mus musculus
gttcatcttagcaacgagagggctg

SEQ ID NO: 122893 - DNA, 25 bp, Mus musculus
gttcatgaacaactggctgccctgt

SEQ ID NO: 122894 - DNA, 25 bp, Mus musculus
gttcatgacagcctccgagcggagt

SEQ ID NO: 122895 - DNA, 25 bp, Mus musculus
gttcattgttcaccttttagccttg

SEQ ID NO: 122896 - DNA, 25 bp, Mus musculus
gttccaaaggcctgtctcatcacca

SEQ ID NO: 122897 - DNA, 25 bp, Mus musculus
gttccaaggagcagggacctcgaca

SEQ ID NO: 122898 - DNA, 25 bp, Mus musculus
gttccaatgtgattcaaaaaggcag

SEQ ID NO: 122899 - DNA, 25 bp, Mus musculus
gttccacatgttgggctgagccagg

SEQ ID NO: 122900 - DNA, 25 bp, Mus musculus
gttccaccggatcctgcagtatgcg

SEQ ID NO: 122901 - DNA, 25 bp, Mus musculus
gttccaccgtctgctgtttgaagag

SEQ ID NO: 122902 - DNA, 25 bp, Mus musculus
gttccagaattggaaatgcccagct

SEQ ID NO: 122903 - DNA, 25 bp, Mus musculus
gttccagaggctcgctgcttctatg

SEQ ID NO: 122904 - DNA, 25 bp, Mus musculus
gttccagcgacccttggccacttag

SEQ ID NO: 122905 - DNA, 25 bp, Mus musculus
gttccagcgggccaagtgcaaagat

SEQ ID NO: 122906 - DNA, 25 bp, Mus musculus
gttccaggcctacaaactacgggtg

SEQ ID NO: 122907 - DNA, 25 bp, Mus musculus
gttccaggtttacaggacgccgcca

SEQ ID NO: 122908 - DNA, 25 bp, Mus musculus
gttccagtacctctagcagtgacag

SEQ ID NO: 122909 - DNA, 25 bp, Mus musculus
gttccagtcccgagacggtctgctg

SEQ ID NO: 122910 - DNA, 25 bp, Mus musculus
gttccatctgtcctacttgctccaa

SEQ ID NO: 122911 - DNA, 25 bp, Mus musculus
gttcccagaaggactcttttatgag

SEQ ID NO: 122912 - DNA, 25 bp, Mus musculus
gttcccagcagtgggccacgagaga

SEQ ID NO: 122913 - DNA, 25 bp, Mus musculus
gttcccatcgtgttcaaggcttagg

SEQ ID NO: 122914 - DNA, 25 bp, Mus musculus
gttccccggaaactggtgcagcagc

SEQ ID NO: 122915 - DNA, 25 bp, Mus musculus
gttcccgagtttcagctatcatcag

SEQ ID NO: 122916 - DNA, 25 bp, Mus musculus
gttcccggtgcagtccgagtctctg

SEQ ID NO: 122917 - DNA, 25 bp, Mus musculus
gttcccggtgggataacctgccatg

SEQ ID NO: 122918 - DNA, 25 bp, Mus musculus
gttccctgaacaaaagatgccatgg

SEQ ID NO: 122919 - DNA, 25 bp, Mus musculus
gttcccttcgtgtgtcctacggccg

SEQ ID NO: 122920 - DNA, 25 bp, Mus musculus
gttccctttgaaccgtttctgcagc

SEQ ID NO: 122921 - DNA, 25 bp, Mus musculus
gttccgactcgctggtcccaggtac

SEQ ID NO: 122922 - DNA, 25 bp, Mus musculus
gttccgagagaacgccatgctgcag

SEQ ID NO: 122923 - DNA, 25 bp, Mus musculus
gttccgagcgctacgaagccatgag

SEQ ID NO: 122924 - DNA, 25 bp, Mus musculus
gttccgcgacgaggaagacttgcgc

SEQ ID NO: 122925 - DNA, 25 bp, Mus musculus
gttccgctttgagcgctggaactgc

SEQ ID NO: 122926 - DNA, 25 bp, Mus musculus
gttccggaattcacgcctggtacag

SEQ ID NO: 122927 - DNA, 25 bp, Mus musculus
gttccgtgaacgatgcagggctgta

SEQ ID NO: 122928 - DNA, 25 bp, Mus musculus
gttcctaatttagaattcgacgtca

SEQ ID NO: 122929 - DNA, 25 bp, Mus musculus
gttcctacactcttacgaagttcct

SEQ ID NO: 122930 - DNA, 25 bp, Mus musculus
gttcctagccctgcgggaccaggtt

SEQ ID NO: 122931 - DNA, 25 bp, Mus musculus
gttcctccagggattctggcccgca

SEQ ID NO: 122932 - DNA, 25 bp, Mus musculus
gttcctgaagcaacctgactgggca

SEQ ID NO: 122933 - DNA, 25 bp, Mus musculus
gttcctgctgcgctcccgggttgtt

SEQ ID NO: 122934 - DNA, 25 bp, Mus musculus
gttcctggcattcctgatactcttc

SEQ ID NO: 122935 - DNA, 25 bp, Mus musculus
gttcctgggaacctaagtgctgctc

SEQ ID NO: 122936 - DNA, 25 bp, Mus musculus
gttcctggttcatccttgagactca

SEQ ID NO: 122937 - DNA, 25 bp, Mus musculus
gttcctgtcaagcacctgccgggtt

SEQ ID NO: 122938 - DNA, 25 bp, Mus musculus
gttcctgtgcggatgactgtctaca

SEQ ID NO: 122939 - DNA, 25 bp, Mus musculus
gttccttcattgagcacctcccagg

SEQ ID NO: 122940 - DNA, 25 bp, Mus musculus
gttccttgatcctcacggcctacat

SEQ ID NO: 122941 - DNA, 25 bp, Mus musculus
gttcgagcagcagcggtaccgctac

SEQ ID NO: 122942 - DNA, 25 bp, Mus musculus
gttcgcaacgttctcaatgatgccg

SEQ ID NO: 122943 - DNA, 25 bp, Mus musculus
gttcgcgacatccaagcactcaagg

SEQ ID NO: 122944 - DNA, 25 bp, Mus musculus
gttcggacatccagtaaagcccagg

SEQ ID NO: 122945 - DNA, 25 bp, Mus musculus
gttcggagttccagtcgcggtcgcc

SEQ ID NO: 122946 - DNA, 25 bp, Mus musculus
gttcggcatccgagctgagagaccc

SEQ ID NO: 122947 - DNA, 25 bp, Mus musculus
gttcgggacgtagttgaagcaacga

SEQ ID NO: 122948 - DNA, 25 bp, Mus musculus
gttcggtgtccgtcgcgtctcctcg

SEQ ID NO: 122949 - DNA, 25 bp, Mus musculus
gttcgtggccaacactatgacttgg

SEQ ID NO: 122950 - DNA, 25 bp, Mus musculus
gttctaaacgctccaagggtcaact

SEQ ID NO: 122951 - DNA, 25 bp, Mus musculus
gttctacaagaagcccagcctatcg

SEQ ID NO: 122952 - DNA, 25 bp, Mus musculus
gttctacgtggctagccgagggcac

SEQ ID NO: 122953 - DNA, 25 bp, Mus musculus
gttctactggcaaaacctgtgggaa

SEQ ID NO: 122954 - DNA, 25 bp, Mus musculus
gttctcagcaccacaaatgattctg

SEQ ID NO: 122955 - DNA, 25 bp, Mus musculus
gttctcagcttttccggccctggac

SEQ ID NO: 122956 - DNA, 25 bp, Mus musculus
gttctcagtgaaggaccgtgcggcc

SEQ ID NO: 122957 - DNA, 25 bp, Mus musculus
gttctcatgctacaaggacctgtgt

SEQ ID NO: 122958 - DNA, 25 bp, Mus musculus
gttctccacatacgattctacgtgt

SEQ ID NO: 122959 - DNA, 25 bp, Mus musculus
gttctccacgtgcagctaaaccggc

SEQ ID NO: 122960 - DNA, 25 bp, Mus musculus
gttctccggaagtgccaggctagcc

SEQ ID NO: 122961 - DNA, 25 bp, Mus musculus
gttctcctataaaaggcacacgcgg

SEQ ID NO: 122962 - DNA, 25 bp, Mus musculus
gttctcctgccccggtgcggacaag

SEQ ID NO: 122963 - DNA, 25 bp, Mus musculus
gttctcgagaacaaggacaatggcc

SEQ ID NO: 122964 - DNA, 25 bp, Mus musculus
gttctcgcccagagtcgccgcggtt

SEQ ID NO: 122965 - DNA, 25 bp, Mus musculus
gttctcggcggctcttctggtgctg

SEQ ID NO: 122966 - DNA, 25 bp, Mus musculus
gttctctgccccacggagcttgtga

SEQ ID NO: 122967 - DNA, 25 bp, Mus musculus
gttctcttcccgaaggtggctccca

SEQ ID NO: 122968 - DNA, 25 bp, Mus musculus
gttctgaacctaaaatgagcgccca

SEQ ID NO: 122969 - DNA, 25 bp, Mus musculus
gttctgaagcagaaacagttggatg

SEQ ID NO: 122970 - DNA, 25 bp, Mus musculus
gttctgacaccagggatggaccacc

SEQ ID NO: 122971 - DNA, 25 bp, Mus musculus
gttctgagccgacaccaccagatgg

SEQ ID NO: 122972 - DNA, 25 bp, Mus musculus
gttctgcagactcgaccccttgagg

SEQ ID NO: 122973 - DNA, 25 bp, Mus musculus
gttctgcagcaacggctccggaact

SEQ ID NO: 122974 - DNA, 25 bp, Mus musculus
gttctgccgatcttgcattgcgacc

SEQ ID NO: 122975 - DNA, 25 bp, Mus musculus
gttctgcgcaaggtccccgaaatgt

SEQ ID NO: 122976 - DNA, 25 bp, Mus musculus
gttctgctctgggtgaaaccaatca

SEQ ID NO: 122977 - DNA, 25 bp, Mus musculus
gttctggactctacacttggcggtg

SEQ ID NO: 122978 - DNA, 25 bp, Mus musculus
gttctggctaaaaatcctaagggca

SEQ ID NO: 122979 - DNA, 25 bp, Mus musculus
gttctgggcattgcacttattgcta

SEQ ID NO: 122980 - DNA, 25 bp, Mus musculus
gttcttcatatacgaggaccctgtg

SEQ ID NO: 122981 - DNA, 25 bp, Mus musculus
gttcttcgagaaccgcaagggccta

SEQ ID NO: 122982 - DNA, 25 bp, Mus musculus
gttcttctggcctagctcggctgca

SEQ ID NO: 122983 - DNA, 25 bp, Mus musculus
gttcttctggctaggcacaaggcag

SEQ ID NO: 122984 - DNA, 25 bp, Mus musculus
gttcttgaatccgacgatgatgaag

SEQ ID NO: 122985 - DNA, 25 bp, Mus musculus
gttcttgcagcagataagccagcag

SEQ ID NO: 122986 - DNA, 25 bp, Mus musculus
gttcttgctggccacactgggcacc

SEQ ID NO: 122987 - DNA, 25 bp, Mus musculus
gttcttggtgcctgagtcgactccg

SEQ ID NO: 122988 - DNA, 25 bp, Mus musculus
gttctttaacgaagcaccactgact

SEQ ID NO: 122989 - DNA, 25 bp, Mus musculus
gttctttgcaaagcaggccacggag

SEQ ID NO: 122990 - DNA, 25 bp, Mus musculus
gttctttggcactgggtggagctca

SEQ ID NO: 122991 - DNA, 25 bp, Mus musculus
gttgaaaccccagaaacagtccagg

SEQ ID NO: 122992 - DNA, 25 bp, Mus musculus
gttgaacaactcctgcactcccata

SEQ ID NO: 122993 - DNA, 25 bp, Mus musculus
gttgaacatccctagctacgccgga

SEQ ID NO: 122994 - DNA, 25 bp, Mus musculus
gttgaactctgtgcgccctgtgaga

SEQ ID NO: 122995 - DNA, 25 bp, Mus musculus
gttgaacttgccacccacttcaggg

SEQ ID NO: 122996 - DNA, 25 bp, Mus musculus
gttgaacttgctttccgctgcgggc

SEQ ID NO: 122997 - DNA, 25 bp, Mus musculus
gttgaacttggacctacgcccaggg

SEQ ID NO: 122998 - DNA, 25 bp, Mus musculus
gttgaagagtacaaatttccaagcc

SEQ ID NO: 122999 - DNA, 25 bp, Mus musculus
gttgaagctagacgacaaacccatc

SEQ ID NO: 123000 - DNA, 25 bp, Mus musculus
gttgaatccatagagctccctatgg

SEQ ID NO: 123001 - DNA, 25 bp, Mus musculus
gttgaatcgctggaggaagagatcc

SEQ ID NO: 123002 - DNA, 25 bp, Mus musculus
gttgacaactactccatccacgatg

SEQ ID NO: 123003 - DNA, 25 bp, Mus musculus
gttgacatacgtgccttacaaagga

SEQ ID NO: 123004 - DNA, 25 bp, Mus musculus
gttgacctaccatggcctgtgcgag

SEQ ID NO: 123005 - DNA, 25 bp, Mus musculus
gttgacgatttgctcctaccaagag

SEQ ID NO: 123006 - DNA, 25 bp, Mus musculus
gttgactatgaatgttttctggaag

SEQ ID NO: 123007 - DNA, 25 bp, Mus musculus
gttgagaacatcgtccgagattggc

SEQ ID NO: 123008 - DNA, 25 bp, Mus musculus
gttgagagcataaagaggtctctcc

SEQ ID NO: 123009 - DNA, 25 bp, Mus musculus
gttgagcacggatagcctgtcgcgt

SEQ ID NO: 123010 - DNA, 25 bp, Mus musculus
gttgagccaaccacatttacctcgg

SEQ ID NO: 123011 - DNA, 25 bp, Mus musculus
gttgagtactgcacagccagcggga

SEQ ID NO: 123012 - DNA, 25 bp, Mus musculus
gttgatagaatgtccccaataaatg

SEQ ID NO: 123013 - DNA, 25 bp, Mus musculus
gttgatagtccagccacagctccag

SEQ ID NO: 123014 - DNA, 25 bp, Mus musculus
gttgatatgccaagcagagggcaga

SEQ ID NO: 123015 - DNA, 25 bp, Mus musculus
gttgatcagcctaaaaaagcctttg

SEQ ID NO: 123016 - DNA, 25 bp, Mus musculus
gttgatcgccttagaaatggctaag

SEQ ID NO: 123017 - DNA, 25 bp, Mus musculus
gttgatctaaacaatgctgcacctg

SEQ ID NO: 123018 - DNA, 25 bp, Mus musculus
gttgatgaaggctgctgaaagaggg

SEQ ID NO: 123019 - DNA, 25 bp, Mus musculus
gttgatgaattttgagagcgccaca

SEQ ID NO: 123020 - DNA, 25 bp, Mus musculus
gttgatgatagatggtcatgacacc

SEQ ID NO: 123021 - DNA, 25 bp, Mus musculus
gttgatgcgcacacgcagcgatgtt

SEQ ID NO: 123022 - DNA, 25 bp, Mus musculus
gttgattgtgatggaaaaggagcca

SEQ ID NO: 123023 - DNA, 25 bp, Mus musculus
gttgcaaactacgtagcaggctgtc

SEQ ID NO: 123024 - DNA, 25 bp, Mus musculus
gttgcaacagcttatagacctccag

SEQ ID NO: 123025 - DNA, 25 bp, Mus musculus
gttgcaagtgttgatcaccaggtgg

SEQ ID NO: 123026 - DNA, 25 bp, Mus musculus
gttgcacaccaaataaaaaccaggg

SEQ ID NO: 123027 - DNA, 25 bp, Mus musculus
gttgcaccaagcttagccaccagtg

SEQ ID NO: 123028 - DNA, 25 bp, Mus musculus
gttgcactggacaagaccctctctc

SEQ ID NO: 123029 - DNA, 25 bp, Mus musculus
gttgcagaagagagcatatccctgt

SEQ ID NO: 123030 - DNA, 25 bp, Mus musculus
gttgcagcatgtgtcccggcgttat

SEQ ID NO: 123031 - DNA, 25 bp, Mus musculus
gttgcagcggaaaggaaatgtgtca

SEQ ID NO: 123032 - DNA, 25 bp, Mus musculus
gttgcagctcctcgtgaccatgaag

SEQ ID NO: 123033 - DNA, 25 bp, Mus musculus
gttgcagttggaaaaggctacccag

SEQ ID NO: 123034 - DNA, 25 bp, Mus musculus
gttgcatacaacatattccagaaga

SEQ ID NO: 123035 - DNA, 25 bp, Mus musculus
gttgcatccagcaccggaaacggct

SEQ ID NO: 123036 - DNA, 25 bp, Mus musculus
gttgcattgaagaagaaacctcggg

SEQ ID NO: 123037 - DNA, 25 bp, Mus musculus
gttgccaagtgagtacccgggtaca

SEQ ID NO: 123038 - DNA, 25 bp, Mus musculus
gttgccatagtggaccctttgccag

SEQ ID NO: 123039 - DNA, 25 bp, Mus musculus
gttgccatggctctgctgaaccgtc

SEQ ID NO: 123040 - DNA, 25 bp, Mus musculus
gttgcccggttctcacgcacagatc

SEQ ID NO: 123041 - DNA, 25 bp, Mus musculus
gttgccctcttattggtccagccgg

SEQ ID NO: 123042 - DNA, 25 bp, Mus musculus
gttgcctactcccaataccagtggt

SEQ ID NO: 123043 - DNA, 25 bp, Mus musculus
gttgcctggcattcgtgagttctgc

SEQ ID NO: 123044 - DNA, 25 bp, Mus musculus
gttgccttccttcacaagaaacggg

SEQ ID NO: 123045 - DNA, 25 bp, Mus musculus
gttgcgcctacccacatactgtatg

SEQ ID NO: 123046 - DNA, 25 bp, Mus musculus
gttgcgcggcgctagtggaagtggc

SEQ ID NO: 123047 - DNA, 25 bp, Mus musculus
gttgcggtgaagaccaagactcccg

SEQ ID NO: 123048 - DNA, 25 bp, Mus musculus
gttgctacaacacccacgagaagag

SEQ ID NO: 123049 - DNA, 25 bp, Mus musculus
gttgctaggcacagaacacctggct

SEQ ID NO: 123050 - DNA, 25 bp, Mus musculus
gttgctgagctgaccccattctgaa

SEQ ID NO: 123051 - DNA, 25 bp, Mus musculus
gttgctgagggcagaggtccatcat

SEQ ID NO: 123052 - DNA, 25 bp, Mus musculus
gttgctgatgcctcaaaaagtgtgc

SEQ ID NO: 123053 - DNA, 25 bp, Mus musculus
gttgctgcacttccgcttctctccc

SEQ ID NO: 123054 - DNA, 25 bp, Mus musculus
gttgctgcccaacatggtcgctgcg

SEQ ID NO: 123055 - DNA, 25 bp, Mus musculus
gttgctgcggctacgaaaactacgg

SEQ ID NO: 123056 - DNA, 25 bp, Mus musculus
gttgctgctactgtcgctgtccggt

SEQ ID NO: 123057 - DNA, 25 bp, Mus musculus
gttgctgttgctgcacttccgcttc

SEQ ID NO: 123058 - DNA, 25 bp, Mus musculus
gttgcttctataactggatcacgag

SEQ ID NO: 123059 - DNA, 25 bp, Mus musculus
gttgctttccggcagcgaacgctga

SEQ ID NO: 123060 - DNA, 25 bp, Mus musculus
gttggaaaatgtgagcgtgttttcc

SEQ ID NO: 123061 - DNA, 25 bp, Mus musculus
gttggaattcaatgacggcgcctac

SEQ ID NO: 123062 - DNA, 25 bp, Mus musculus
gttggacagcgctgatgtatgcctc

SEQ ID NO: 123063 - DNA, 25 bp, Mus musculus
gttggactcaaacacagaggcccgg

SEQ ID NO: 123064 - DNA, 25 bp, Mus musculus
gttggacttcctcgctgctgcaagg

SEQ ID NO: 123065 - DNA, 25 bp, Mus musculus
gttggagccgcttggaaacctggca

SEQ ID NO: 123066 - DNA, 25 bp, Mus musculus
gttggagtcagcagagcctacagcc

SEQ ID NO: 123067 - DNA, 25 bp, Mus musculus
gttggatcagaaccacgacggtcgc

SEQ ID NO: 123068 - DNA, 25 bp, Mus musculus
gttggcattgcctggacagcgaccc

SEQ ID NO: 123069 - DNA, 25 bp, Mus musculus
gttggccacaatgagcactctgcag

SEQ ID NO: 123070 - DNA, 25 bp, Mus musculus
gttggccgccttgagaatgcaatcg

SEQ ID NO: 123071 - DNA, 25 bp, Mus musculus
gttggcctcaagctcctagaccttt

SEQ ID NO: 123072 - DNA, 25 bp, Mus musculus
gttggctacgttcatactgggacag

SEQ ID NO: 123073 - DNA, 25 bp, Mus musculus
gttggcttagtggtggagatcatct

SEQ ID NO: 123074 - DNA, 25 bp, Mus musculus
gttggcttcaaaaatatgcagaatg

SEQ ID NO: 123075 - DNA, 25 bp, Mus musculus
gttgggaactccttgaccttagcag

SEQ ID NO: 123076 - DNA, 25 bp, Mus musculus
gttgggactgctgcggcgggtggca

SEQ ID NO: 123077 - DNA, 25 bp, Mus musculus
gttgggagccaagagcagaactcgc

SEQ ID NO: 123078 - DNA, 25 bp, Mus musculus
gttgggagtatcactttaccagcag

SEQ ID NO: 123079 - DNA, 25 bp, Mus musculus
gttgggatatctaaagaggaagcct

SEQ ID NO: 123080 - DNA, 25 bp, Mus musculus
gttgggctctgcatatattaaataa

SEQ ID NO: 123081 - DNA, 25 bp, Mus musculus
gttgggctgactggctacggctaca

SEQ ID NO: 123082 - DNA, 25 bp, Mus musculus
gttgggtgaacagggaccagagcca

SEQ ID NO: 123083 - DNA, 25 bp, Mus musculus
gttggtaagccacactagaaaggta

SEQ ID NO: 123084 - DNA, 25 bp, Mus musculus
gttggtacctttccgacactgcagc

SEQ ID NO: 123085 - DNA, 25 bp, Mus musculus
gttggtatttcacggcgaatgcccc

SEQ ID NO: 123086 - DNA, 25 bp, Mus musculus
gttggtctgctccttgcacgccagt

SEQ ID NO: 123087 - DNA, 25 bp, Mus musculus
gttggtgaaaagacggaagcttcct

SEQ ID NO: 123088 - DNA, 25 bp, Mus musculus
gttggtgtattccagcaacttccag

SEQ ID NO: 123089 - DNA, 25 bp, Mus musculus
gttggttacgtcgccggctgtgccc

SEQ ID NO: 123090 - DNA, 25 bp, Mus musculus
gttgtacaaccgactgctgcagcgc

SEQ ID NO: 123091 - DNA, 25 bp, Mus musculus
gttgtaggaaccgaaagactggcca

SEQ ID NO: 123092 - DNA, 25 bp, Mus musculus
gttgtatcggccctaaccgctgtgc

SEQ ID NO: 123093 - DNA, 25 bp, Mus musculus
gttgtcaaaacttggtgccaacatg

SEQ ID NO: 123094 - DNA, 25 bp, Mus musculus
gttgtcaaagagaaggccgaagccc

SEQ ID NO: 123095 - DNA, 25 bp, Mus musculus
gttgtcaagaccctagagctcgcag

SEQ ID NO: 123096 - DNA, 25 bp, Mus musculus
gttgtcaccagagcttcaccgatgg

SEQ ID NO: 123097 - DNA, 25 bp, Mus musculus
gttgtcaccattaatcacacctgag

SEQ ID NO: 123098 - DNA, 25 bp, Mus musculus
gttgtccagcagtttcacagcgatg

SEQ ID NO: 123099 - DNA, 25 bp, Mus musculus
gttgtccataaacattccacagttc

SEQ ID NO: 123100 - DNA, 25 bp, Mus musculus
gttgtcccagcagccagtcggtatc

SEQ ID NO: 123101 - DNA, 25 bp, Mus musculus
gttgtcggaagctcaccgggtctct

SEQ ID NO: 123102 - DNA, 25 bp, Mus musculus
gttgtcggtgcctgcaggcttcctc

SEQ ID NO: 123103 - DNA, 25 bp, Mus musculus
gttgtctaactgagccccgaggagc

SEQ ID NO: 123104 - DNA, 25 bp, Mus musculus
gttgtgaactcgaacctgccgctgt

SEQ ID NO: 123105 - DNA, 25 bp, Mus musculus
gttgtgcacacaatttgaactagca

SEQ ID NO: 123106 - DNA, 25 bp, Mus musculus
gttgtgccatgaaccctgctcgaga

SEQ ID NO: 123107 - DNA, 25 bp, Mus musculus
gttgtgcggagcttctcggccgtcc

SEQ ID NO: 123108 - DNA, 25 bp, Mus musculus
gttgtggcccatgatctgatccgga

SEQ ID NO: 123109 - DNA, 25 bp, Mus musculus
gttgtgtgagatagtgagatttatg

SEQ ID NO: 123110 - DNA, 25 bp, Mus musculus
gttgttaataggctcctcatgaacc

SEQ ID NO: 123111 - DNA, 25 bp, Mus musculus
gttgttcacagtgctccaggttcca

SEQ ID NO: 123112 - DNA, 25 bp, Mus musculus
gttgttcagggaacggctcagccag

SEQ ID NO: 123113 - DNA, 25 bp, Mus musculus
gttgttccctcttcggcttccgtag

SEQ ID NO: 123114 - DNA, 25 bp, Mus musculus
gttgttccgaacaaaagcaataatg

SEQ ID NO: 123115 - DNA, 25 bp, Mus musculus
gttgttcgagtatccacaccctctg

SEQ ID NO: 123116 - DNA, 25 bp, Mus musculus
gttgtttcctgaagcccacctaggg

SEQ ID NO: 123117 - DNA, 25 bp, Mus musculus
gttgtttgcatcctaccccaagtga

SEQ ID NO: 123118 - DNA, 25 bp, Mus musculus
gttgtttggacaagaagaagccgaa

SEQ ID NO: 123119 - DNA, 25 bp, Mus musculus
gttgtttgtagaagacctcactggg

SEQ ID NO: 123120 - DNA, 25 bp, Mus musculus
gtttaaaactgaaccaactgatgag

SEQ ID NO: 123121 - DNA, 25 bp, Mus musculus
gtttaaacgcatctcctgcccattg

SEQ ID NO: 123122 - DNA, 25 bp, Mus musculus
gtttaacatcgaccacccaggtggg

SEQ ID NO: 123123 - DNA, 25 bp, Mus musculus
gtttaaccctgagaacagactgaga

SEQ ID NO: 123124 - DNA, 25 bp, Mus musculus
gtttaacggctcagggtcacatgca

SEQ ID NO: 123125 - DNA, 25 bp, Mus musculus
gtttaacgggccaagccgagctctg

SEQ ID NO: 123126 - DNA, 25 bp, Mus musculus
gtttaactctctgcctcagctgtca

SEQ ID NO: 123127 - DNA, 25 bp, Mus musculus
gtttaagccacatcacgcctcgaga

SEQ ID NO: 123128 - DNA, 25 bp, Mus musculus
gtttaagtaaaagcggcggcagaga

SEQ ID NO: 123129 - DNA, 25 bp, Mus musculus
gtttaatccagatactggactccag

SEQ ID NO: 123130 - DNA, 25 bp, Mus musculus
gtttacaaagacgaccaggtggtgg

SEQ ID NO: 123131 - DNA, 25 bp, Mus musculus
gtttacaagcccttacctggactgg

SEQ ID NO: 123132 - DNA, 25 bp, Mus musculus
gtttacataagcaaggcatcctggg

SEQ ID NO: 123133 - DNA, 25 bp, Mus musculus
gtttagaagtacacatgcatgtcac

SEQ ID NO: 123134 - DNA, 25 bp, Mus musculus
gtttagcaaagtagacagccccgtt

SEQ ID NO: 123135 - DNA, 25 bp, Mus musculus
gtttagctcaggtcccaccgatccg

SEQ ID NO: 123136 - DNA, 25 bp, Mus musculus
gtttagtatcttgtgccaacctcca

SEQ ID NO: 123137 - DNA, 25 bp, Mus musculus
gtttataggaacaagatgacccctc

SEQ ID NO: 123138 - DNA, 25 bp, Mus musculus
gtttatatgccataccatctaccag

SEQ ID NO: 123139 - DNA, 25 bp, Mus musculus
gtttatcgtggctcccggaagctca

SEQ ID NO: 123140 - DNA, 25 bp, Mus musculus
gtttatctgaaaggtgtgcacccca

SEQ ID NO: 123141 - DNA, 25 bp, Mus musculus
gtttatgcagagaatggtaccgtcc

SEQ ID NO: 123142 - DNA, 25 bp, Mus musculus
gtttatggttgcacggacttctccc

SEQ ID NO: 123143 - DNA, 25 bp, Mus musculus
gtttatttccacgacttgacccaga

SEQ ID NO: 123144 - DNA, 25 bp, Mus musculus
gtttcaaatgcacacaacccggaag

SEQ ID NO: 123145 - DNA, 25 bp, Mus musculus
gtttcactgcacatgcgaaggcctg

SEQ ID NO: 123146 - DNA, 25 bp, Mus musculus
gtttcagagctgtcctaccgggtcc

SEQ ID NO: 123147 - DNA, 25 bp, Mus musculus
gtttcagcgcaagacccagtacctg

SEQ ID NO: 123148 - DNA, 25 bp, Mus musculus
gtttcagtcacagtggcctgctgga

SEQ ID NO: 123149 - DNA, 25 bp, Mus musculus
gtttcatactggcaaatggttcccc

SEQ ID NO: 123150 - DNA, 25 bp, Mus musculus
gtttcatctagcctcagcaagccag

SEQ ID NO: 123151 - DNA, 25 bp, Mus musculus
gtttcattatgaagccgggaagggc

SEQ ID NO: 123152 - DNA, 25 bp, Mus musculus
gtttccacttttccgcgcaggtgcg

SEQ ID NO: 123153 - DNA, 25 bp, Mus musculus
gtttcccatgatcaaggtctccgag

SEQ ID NO: 123154 - DNA, 25 bp, Mus musculus
gtttcccggcaggttctcggcggct

SEQ ID NO: 123155 - DNA, 25 bp, Mus musculus
gtttccctgcgatcgtggcctggag

SEQ ID NO: 123156 - DNA, 25 bp, Mus musculus
gtttccgagtgtctgagctccaggt

SEQ ID NO: 123157 - DNA, 25 bp, Mus musculus
gtttccgtgaaactcttgccgcgag

SEQ ID NO: 123158 - DNA, 25 bp, Mus musculus
gtttcctctcgggaggtccgccatg

SEQ ID NO: 123159 - DNA, 25 bp, Mus musculus
gtttcctgcctgagcgccgagaggc

SEQ ID NO: 123160 - DNA, 25 bp, Mus musculus
gtttcctgtcgccaaatgcagatct

SEQ ID NO: 123161 - DNA, 25 bp, Mus musculus
gtttccttcaacaaagatctgctgg

SEQ ID NO: 123162 - DNA, 25 bp, Mus musculus
gtttccttcatgagaccgggctggc

SEQ ID NO: 123163 - DNA, 25 bp, Mus musculus
gtttccttccatcctgggagccatg

SEQ ID NO: 123164 - DNA, 25 bp, Mus musculus
gtttcgacgctagaggtaacctcag

SEQ ID NO: 123165 - DNA, 25 bp, Mus musculus
gtttcgatctgtcgtgtgaccgccc

SEQ ID NO: 123166 - DNA, 25 bp, Mus musculus
gtttcgcctacaacgagcagtcggg

SEQ ID NO: 123167 - DNA, 25 bp, Mus musculus
gtttcggcctgctcaacgcttggag

SEQ ID NO: 123168 - DNA, 25 bp, Mus musculus
gtttcgggaacgtcagtctgtacca

SEQ ID NO: 123169 - DNA, 25 bp, Mus musculus
gtttctaaaattaaagctcctagtg

SEQ ID NO: 123170 - DNA, 25 bp, Mus musculus
gtttctacagacatggggtatccat

SEQ ID NO: 123171 - DNA, 25 bp, Mus musculus
gtttctaccccaggcatggacctat

SEQ ID NO: 123172 - DNA, 25 bp, Mus musculus
gtttctcagggcgagtgaagccata

SEQ ID NO: 123173 - DNA, 25 bp, Mus musculus
gtttctcagtggctgtttcatcacc

SEQ ID NO: 123174 - DNA, 25 bp, Mus musculus
gtttctcattctcatatctcaccaa

SEQ ID NO: 123175 - DNA, 25 bp, Mus musculus
gtttctcccaccagagcccggaaca

SEQ ID NO: 123176 - DNA, 25 bp, Mus musculus
gtttctctcaaaagccctctaggca

SEQ ID NO: 123177 - DNA, 25 bp, Mus musculus
gtttctgaacatgggagcacccctg

SEQ ID NO: 123178 - DNA, 25 bp, Mus musculus
gtttctgaacctcaggctcctgcct

SEQ ID NO: 123179 - DNA, 25 bp, Mus musculus
gtttctgatcaagtaaacaccagca

SEQ ID NO: 123180 - DNA, 25 bp, Mus musculus
gtttctgatggcatatgccttgaat

SEQ ID NO: 123181 - DNA, 25 bp, Mus musculus
gtttctgcagcgtcaaggactccca

SEQ ID NO: 123182 - DNA, 25 bp, Mus musculus
gtttctgcgtcttcaccctcagtgg

SEQ ID NO: 123183 - DNA, 25 bp, Mus musculus
gtttctgtccagaaggtacccgcga

SEQ ID NO: 123184 - DNA, 25 bp, Mus musculus
gtttcttgaactccagaagccccgg

SEQ ID NO: 123185 - DNA, 25 bp, Mus musculus
gtttctttgcttcactcctcccaag

SEQ ID NO: 123186 - DNA, 25 bp, Mus musculus
gtttgaaagacaacaggaggcaagc

SEQ ID NO: 123187 - DNA, 25 bp, Mus musculus
gtttgaacaggccattcaggcagcc

SEQ ID NO: 123188 - DNA, 25 bp, Mus musculus
gtttgaacccaaagcacagacgtta

SEQ ID NO: 123189 - DNA, 25 bp, Mus musculus
gtttgaacgctacctacatgatgag

SEQ ID NO: 123190 - DNA, 25 bp, Mus musculus
gtttgaacgtgcagaggtggtacca

SEQ ID NO: 123191 - DNA, 25 bp, Mus musculus
gtttgaagatatcaggcccagttgc

SEQ ID NO: 123192 - DNA, 25 bp, Mus musculus
gtttgaagctgaggctgctccaccc

SEQ ID NO: 123193 - DNA, 25 bp, Mus musculus
gtttgacaaactggctgactggata

SEQ ID NO: 123194 - DNA, 25 bp, Mus musculus
gtttgacaccaaaggcatcgagagc

SEQ ID NO: 123195 - DNA, 25 bp, Mus musculus
gtttgacagccacacccgtgcaagt

SEQ ID NO: 123196 - DNA, 25 bp, Mus musculus
gtttgacaggcacaagccagattga

SEQ ID NO: 123197 - DNA, 25 bp, Mus musculus
gtttgaccctgccataagccttgcc

SEQ ID NO: 123198 - DNA, 25 bp, Mus musculus
gtttgacccttgcaactcagtggga

SEQ ID NO: 123199 - DNA, 25 bp, Mus musculus
gtttgacctgaacaagcctgtgcgg

SEQ ID NO: 123200 - DNA, 25 bp, Mus musculus
gtttgacggctcacacacctacgtg

SEQ ID NO: 123201 - DNA, 25 bp, Mus musculus
gtttgagaggatgcaacaacacccc

SEQ ID NO: 123202 - DNA, 25 bp, Mus musculus
gtttgataagggtctagccactctg

SEQ ID NO: 123203 - DNA, 25 bp, Mus musculus
gtttgattacctagtggcccatggc

SEQ ID NO: 123204 - DNA, 25 bp, Mus musculus
gtttgattcactggagcctgctggg

SEQ ID NO: 123205 - DNA, 25 bp, Mus musculus
gtttgcaacaatttacagcattgcc

SEQ ID NO: 123206 - DNA, 25 bp, Mus musculus
gtttgcaagccttcccagaaacatg

SEQ ID NO: 123207 - DNA, 25 bp, Mus musculus
gtttgcacccacgtcatcatgaagg

SEQ ID NO: 123208 - DNA, 25 bp, Mus musculus
gtttgcagcctgcaagcccaagtcg

SEQ ID NO: 123209 - DNA, 25 bp, Mus musculus
gtttgcatgcgctctctcgcgtggg

SEQ ID NO: 123210 - DNA, 25 bp, Mus musculus
gtttgccaaatgaggatacggttcc

SEQ ID NO: 123211 - DNA, 25 bp, Mus musculus
gtttgccacagaggcggcagtcctg

SEQ ID NO: 123212 - DNA, 25 bp, Mus musculus
gtttgcctgcaatgagactttactc

SEQ ID NO: 123213 - DNA, 25 bp, Mus musculus
gtttgcctgcactgaagattcggga

SEQ ID NO: 123214 - DNA, 25 bp, Mus musculus
gtttgccttgagctttggaccccag

SEQ ID NO: 123215 - DNA, 25 bp, Mus musculus
gtttgcgtgttcatcatgttggcca

SEQ ID NO: 123216 - DNA, 25 bp, Mus musculus
gtttgctattgcgaatactgacccc

SEQ ID NO: 123217 - DNA, 25 bp, Mus musculus
gtttgctccggatcgcagaggccag

SEQ ID NO: 123218 - DNA, 25 bp, Mus musculus
gtttgcttactcacaggagcccagg

SEQ ID NO: 123219 - DNA, 25 bp, Mus musculus
gtttggacgcagagaaattgaaatt

SEQ ID NO: 123220 - DNA, 25 bp, Mus musculus
gtttggcatccagaacgcctacggg

SEQ ID NO: 123221 - DNA, 25 bp, Mus musculus
gtttgggacacatacagcggcctgg

SEQ ID NO: 123222 - DNA, 25 bp, Mus musculus
gtttgggactgctgacacaccacac

SEQ ID NO: 123223 - DNA, 25 bp, Mus musculus
gtttgggatcatgcgttcttcacag

SEQ ID NO: 123224 - DNA, 25 bp, Mus musculus
gtttgggattctcctccgagctgca

SEQ ID NO: 123225 - DNA, 25 bp, Mus musculus
gtttggtacctaacaagaacatagc

SEQ ID NO: 123226 - DNA, 25 bp, Mus musculus
gtttggtagcctcactggactgcag

SEQ ID NO: 123227 - DNA, 25 bp, Mus musculus
gtttggtctcgacatcaaaggcaga

SEQ ID NO: 123228 - DNA, 25 bp, Mus musculus
gtttggtgccctgagtagtttccgg

SEQ ID NO: 123229 - DNA, 25 bp, Mus musculus
gtttggtggttcttctccgccgccg

SEQ ID NO: 123230 - DNA, 25 bp, Mus musculus
gtttgtagggactatgggcatgctc

SEQ ID NO: 123231 - DNA, 25 bp, Mus musculus
gtttgtatttacacgatgctccaca

SEQ ID NO: 123232 - DNA, 25 bp, Mus musculus
gtttgtcttggagataatagtgaag

SEQ ID NO: 123233 - DNA, 25 bp, Mus musculus
gtttgtgacccaggcagacgagctg

SEQ ID NO: 123234 - DNA, 25 bp, Mus musculus
gtttgtgccctttcagctgaccctc

SEQ ID NO: 123235 - DNA, 25 bp, Mus musculus
gtttgttcaaagcagaagtcagtgc

SEQ ID NO: 123236 - DNA, 25 bp, Mus musculus
gtttgttgccatcctacccaaggag

SEQ ID NO: 123237 - DNA, 25 bp, Mus musculus
gttttaaattcctcaaagcacccag

SEQ ID NO: 123238 - DNA, 25 bp, Mus musculus
gttttaaccaaaaggcgtcacagca

SEQ ID NO: 123239 - DNA, 25 bp, Mus musculus
gttttaagggaagacatagtcagcc

SEQ ID NO: 123240 - DNA, 25 bp, Mus musculus
gttttacaagcattaccctcctggg

SEQ ID NO: 123241 - DNA, 25 bp, Mus musculus
gttttacagaagatgctcagaccag

SEQ ID NO: 123242 - DNA, 25 bp, Mus musculus
gttttaccccactgatcctggcggc

SEQ ID NO: 123243 - DNA, 25 bp, Mus musculus
gttttactggaaagccctgctggcc

SEQ ID NO: 123244 - DNA, 25 bp, Mus musculus
gttttattccggaacccagcgccat

SEQ ID NO: 123245 - DNA, 25 bp, Mus musculus
gttttattgtcacccacggcggagg

SEQ ID NO: 123246 - DNA, 25 bp, Mus musculus
gttttatttcataccagtggctacg

SEQ ID NO: 123247 - DNA, 25 bp, Mus musculus
gttttcaccaagtactcggaggcca

SEQ ID NO: 123248 - DNA, 25 bp, Mus musculus
gttttcatgcgtaccccaccgaggt

SEQ ID NO: 123249 - DNA, 25 bp, Mus musculus
gttttccaccatcaaggagtacgag

SEQ ID NO: 123250 - DNA, 25 bp, Mus musculus
gttttccagactgctagtgagcgag

SEQ ID NO: 123251 - DNA, 25 bp, Mus musculus
gttttccgacgaagacgcaaccagg

SEQ ID NO: 123252 - DNA, 25 bp, Mus musculus
gttttccggaagcagcagccctttc

SEQ ID NO: 123253 - DNA, 25 bp, Mus musculus
gttttctagttgactttctacagta

SEQ ID NO: 123254 - DNA, 25 bp, Mus musculus
gttttctcaaaacctggcagcttgt

SEQ ID NO: 123255 - DNA, 25 bp, Mus musculus
gttttctccctcacgtgggccaggg

SEQ ID NO: 123256 - DNA, 25 bp, Mus musculus
gttttctctgtcaagtactgcagtc

SEQ ID NO: 123257 - DNA, 25 bp, Mus musculus
gttttcttagaatgtcaatgcagca

SEQ ID NO: 123258 - DNA, 25 bp, Mus musculus
gttttctttaggagacaatgcccct

SEQ ID NO: 123259 - DNA, 25 bp, Mus musculus
gttttgacgacaactcccctttgag

SEQ ID NO: 123260 - DNA, 25 bp, Mus musculus
gttttgatgatgacggcaccagctc

SEQ ID NO: 123261 - DNA, 25 bp, Mus musculus
gttttgcaagaagcctccagtcctg

SEQ ID NO: 123262 - DNA, 25 bp, Mus musculus
gttttgcagcaaagagaagtttcct

SEQ ID NO: 123263 - DNA, 25 bp, Mus musculus
gttttgccaaaccagtgtatccagg

SEQ ID NO: 123264 - DNA, 25 bp, Mus musculus
gttttgcccagaacatcagtccagc

SEQ ID NO: 123265 - DNA, 25 bp, Mus musculus
gttttgccgaattgacaagcccctg

SEQ ID NO: 123266 - DNA, 25 bp, Mus musculus
gttttggagcaaagacagcagcatt

SEQ ID NO: 123267 - DNA, 25 bp, Mus musculus
gttttggccacttgaccaggcagct

SEQ ID NO: 123268 - DNA, 25 bp, Mus musculus
gttttggtccatttctcccgcgaag

SEQ ID NO: 123269 - DNA, 25 bp, Mus musculus
gttttgtcaggtcctccagcgcgtc

SEQ ID NO: 123270 - DNA, 25 bp, Mus musculus
gtttttaatactcaggcaggaggag

SEQ ID NO: 123271 - DNA, 25 bp, Mus musculus
gtttttagcaggctgtcctgcctgc

SEQ ID NO: 123272 - DNA, 25 bp, Mus musculus
gtttttagctcatggaactttaggc

SEQ ID NO: 123273 - DNA, 25 bp, Mus musculus
gtttttcagaatcgagagcccagtg

SEQ ID NO: 123274 - DNA, 25 bp, Mus musculus
gtttttctgaagatgaggcgtctga

SEQ ID NO: 123275 - DNA, 25 bp, Mus musculus
gtttttggcgaagtcaacacctgcc

SEQ ID NO: 123276 - DNA, 25 bp, Mus musculus
taaaaaaattctgttccagttgcag

SEQ ID NO: 123277 - DNA, 25 bp, Mus musculus
taaaaaacacaacaaggtcctggag

SEQ ID NO: 123278 - DNA, 25 bp, Mus musculus
taaaaaacctgaggacgctgcacct

SEQ ID NO: 123279 - DNA, 25 bp, Mus musculus
taaaaaacgtggaaatctgggctga

SEQ ID NO: 123280 - DNA, 25 bp, Mus musculus
taaaaaagaagactcctctgacagt

SEQ ID NO: 123281 - DNA, 25 bp, Mus musculus
taaaaaagcactgaagacccaggga

SEQ ID NO: 123282 - DNA, 25 bp, Mus musculus
taaaaaagcggatcagagagaagga

SEQ ID NO: 123283 - DNA, 25 bp, Mus musculus
taaaaaatatgacctcgtggaggcg

SEQ ID NO: 123284 - DNA, 25 bp, Mus musculus
taaaaaatcgagatacctgggcact

SEQ ID NO: 123285 - DNA, 25 bp, Mus musculus
taaaaacaacttgatctcgtccctg

SEQ ID NO: 123286 - DNA, 25 bp, Mus musculus
taaaaacaaggatgtggaggaccca

SEQ ID NO: 123287 - DNA, 25 bp, Mus musculus
taaaaacaccaaccatcggaggcct

SEQ ID NO: 123288 - DNA, 25 bp, Mus musculus
taaaaacacggacacagaaatcagg

SEQ ID NO: 123289 - DNA, 25 bp, Mus musculus
taaaaacagaacacacaagcgcgag

SEQ ID NO: 123290 - DNA, 25 bp, Mus musculus
taaaaacagggaggacttgacatac

SEQ ID NO: 123291 - DNA, 25 bp, Mus musculus
taaaaacgacaacgagcaccaacca

SEQ ID NO: 123292 - DNA, 25 bp, Mus musculus
taaaaacggaacttgaagcgtctca

SEQ ID NO: 123293 - DNA, 25 bp, Mus musculus
taaaaactcgggaacatcagccttg

SEQ ID NO: 123294 - DNA, 25 bp, Mus musculus
taaaaactctggcactctgactagc

SEQ ID NO: 123295 - DNA, 25 bp, Mus musculus
taaaaactgttggtgtccgcatcgc

SEQ ID NO: 123296 - DNA, 25 bp, Mus musculus
taaaaacttgtggacttggctgaca

SEQ ID NO: 123297 - DNA, 25 bp, Mus musculus
taaaaagacgggatctcgcagagat

SEQ ID NO: 123298 - DNA, 25 bp, Mus musculus
taaaaagcacggcatcacggaactg

SEQ ID NO: 123299 - DNA, 25 bp, Mus musculus
taaaaagcccctgaagatcaccatg

SEQ ID NO: 123300 - DNA, 25 bp, Mus musculus
taaaaagcttttcaacatcgttatt

SEQ ID NO: 123301 - DNA, 25 bp, Mus musculus
taaaaagggatttcagacatctatg

SEQ ID NO: 123302 - DNA, 25 bp, Mus musculus
taaaaagggtcacagaattctcagc

SEQ ID NO: 123303 - DNA, 25 bp, Mus musculus
taaaaagtgacagtcccagcaggat

SEQ ID NO: 123304 - DNA, 25 bp, Mus musculus
taaaaagtgcccaagttccaaatgg

SEQ ID NO: 123305 - DNA, 25 bp, Mus musculus
taaaaagttagtggaggttgccagg

SEQ ID NO: 123306 - DNA, 25 bp, Mus musculus
taaaaagttgcaaaggccgctgctt

SEQ ID NO: 123307 - DNA, 25 bp, Mus musculus
taaaaataaaggatgaccagtatgt

SEQ ID NO: 123308 - DNA, 25 bp, Mus musculus
taaaaataacataggatgcctggcc

SEQ ID NO: 123309 - DNA, 25 bp, Mus musculus
taaaaataatccactcgccggctgc

SEQ ID NO: 123310 - DNA, 25 bp, Mus musculus
taaaaatacgggattcgcctccgag

SEQ ID NO: 123311 - DNA, 25 bp, Mus musculus
taaaaatcagtgatcgcacgccgtc

SEQ ID NO: 123312 - DNA, 25 bp, Mus musculus
taaaaatccaggtggctgccaggac

SEQ ID NO: 123313 - DNA, 25 bp, Mus musculus
taaaaatgacacagaggatatccgt

SEQ ID NO: 123314 - DNA, 25 bp, Mus musculus
taaaaatgaccgagtagctgggtgt

SEQ ID NO: 123315 - DNA, 25 bp, Mus musculus
taaaaatgccggagtcacgaaagcc

SEQ ID NO: 123316 - DNA, 25 bp, Mus musculus
taaaaatgctaacccacaggagagg

SEQ ID NO: 123317 - DNA, 25 bp, Mus musculus
taaaaatggacaggctgggattacc

SEQ ID NO: 123318 - DNA, 25 bp, Mus musculus
taaaaatggctccacccagaaaagg

SEQ ID NO: 123319 - DNA, 25 bp, Mus musculus
taaaaattcacgcaggccccaagtt

SEQ ID NO: 123320 - DNA, 25 bp, Mus musculus
taaaaattcctggatggctgcagat

SEQ ID NO: 123321 - DNA, 25 bp, Mus musculus
taaaaattgtgagcagaggtcgcct

SEQ ID NO: 123322 - DNA, 25 bp, Mus musculus
taaaaatttcactacgtacatgtgg

SEQ ID NO: 123323 - DNA, 25 bp, Mus musculus
taaaacaacagagtcagtaccaggc

SEQ ID NO: 123324 - DNA, 25 bp, Mus musculus
taaaacaccctgtggccaagagcag

SEQ ID NO: 123325 - DNA, 25 bp, Mus musculus
taaaacactgccgatctgagctgcc

SEQ ID NO: 123326 - DNA, 25 bp, Mus musculus
taaaacagaacctcagtcatcactc

SEQ ID NO: 123327 - DNA, 25 bp, Mus musculus
taaaacagacatccaaaagcgacag

SEQ ID NO: 123328 - DNA, 25 bp, Mus musculus
taaaacagagcgctttcatgccttg

SEQ ID NO: 123329 - DNA, 25 bp, Mus musculus
taaaacagttgaggctcgatccccg

SEQ ID NO: 123330 - DNA, 25 bp, Mus musculus
taaaacatctagctggatctcgcag

SEQ ID NO: 123331 - DNA, 25 bp, Mus musculus
taaaacattgtttctgcttcgagga

SEQ ID NO: 123332 - DNA, 25 bp, Mus musculus
taaaaccaaatgtgtgccggtcctg

SEQ ID NO: 123333 - DNA, 25 bp, Mus musculus
taaaaccaaggacgcgacgatggag

SEQ ID NO: 123334 - DNA, 25 bp, Mus musculus
taaaaccactgtaaagtcatgacgt

SEQ ID NO: 123335 - DNA, 25 bp, Mus musculus
taaaaccagagatgtgaccttcccc

SEQ ID NO: 123336 - DNA, 25 bp, Mus musculus
taaaaccaggagtcaataaagctga

SEQ ID NO: 123337 - DNA, 25 bp, Mus musculus
taaaaccaggttccaagacactgcc

SEQ ID NO: 123338 - DNA, 25 bp, Mus musculus
taaaacccctgtcccgagatgaaca

SEQ ID NO: 123339 - DNA, 25 bp, Mus musculus
taaaacctgagacatagctgcagcc

SEQ ID NO: 123340 - DNA, 25 bp, Mus musculus
taaaacctgggactactgagagtgg

SEQ ID NO: 123341 - DNA, 25 bp, Mus musculus
taaaacgctcttgtctgtggaggaa

SEQ ID NO: 123342 - DNA, 25 bp, Mus musculus
taaaacggatgcatgccggacagga

SEQ ID NO: 123343 - DNA, 25 bp, Mus musculus
taaaacgtacagcttagagccaatg

SEQ ID NO: 123344 - DNA, 25 bp, Mus musculus
taaaactaactagcaacaaggtggt

SEQ ID NO: 123345 - DNA, 25 bp, Mus musculus
taaaactactgatgcggaggagaca

SEQ ID NO: 123346 - DNA, 25 bp, Mus musculus
taaaactaggaagccctgatgcagt

SEQ ID NO: 123347 - DNA, 25 bp, Mus musculus
taaaactaggcgtgacaacacatgc

SEQ ID NO: 123348 - DNA, 25 bp, Mus musculus
taaaactagtttgagccgtagagga

SEQ ID NO: 123349 - DNA, 25 bp, Mus musculus
taaaactatggaacctcctctggcc

SEQ ID NO: 123350 - DNA, 25 bp, Mus musculus
taaaactcaggtagccggagggcag

SEQ ID NO: 123351 - DNA, 25 bp, Mus musculus
taaaactcattcatgggtcccagtg

SEQ ID NO: 123352 - DNA, 25 bp, Mus musculus
taaaactcgttgacagcgcatgtga

SEQ ID NO: 123353 - DNA, 25 bp, Mus musculus
taaaactctactgcaacggagatgg

SEQ ID NO: 123354 - DNA, 25 bp, Mus musculus
taaaactgacaaccaggtgggacca

SEQ ID NO: 123355 - DNA, 25 bp, Mus musculus
taaaactgaccaaacccttattgag

SEQ ID NO: 123356 - DNA, 25 bp, Mus musculus
taaaactgctgcgtgtgcgatccac

SEQ ID NO: 123357 - DNA, 25 bp, Mus musculus
taaaactgtccaagctggaggtgcc

SEQ ID NO: 123358 - DNA, 25 bp, Mus musculus
taaaacttccctgcagggcactgac

SEQ ID NO: 123359 - DNA, 25 bp, Mus musculus
taaaagaaacctgctggatcaccag

SEQ ID NO: 123360 - DNA, 25 bp, Mus musculus
taaaagaaatgtgtcgggatgccgc

SEQ ID NO: 123361 - DNA, 25 bp, Mus musculus
taaaagaagacgttcggcgcagtgc

SEQ ID NO: 123362 - DNA, 25 bp, Mus musculus
taaaagaagcccatgaacctctggc

SEQ ID NO: 123363 - DNA, 25 bp, Mus musculus
taaaagacaggtctcctcacaccgg

SEQ ID NO: 123364 - DNA, 25 bp, Mus musculus
taaaagactagtggccttagtgccc

SEQ ID NO: 123365 - DNA, 25 bp, Mus musculus
taaaagactcttctgggatgttgcc

SEQ ID NO: 123366 - DNA, 25 bp, Mus musculus
taaaagagaagcatgccatcaggca

SEQ ID NO: 123367 - DNA, 25 bp, Mus musculus
taaaagagcagagaggtgcactgca

SEQ ID NO: 123368 - DNA, 25 bp, Mus musculus
taaaagagcgttcttgtccctggcg

SEQ ID NO: 123369 - DNA, 25 bp, Mus musculus
taaaagagggaagaggacccatgcc

SEQ ID NO: 123370 - DNA, 25 bp, Mus musculus
taaaagagtggatgacatgcttgct

SEQ ID NO: 123371 - DNA, 25 bp, Mus musculus
taaaagatagaaacgagccctgcca

SEQ ID NO: 123372 - DNA, 25 bp, Mus musculus
taaaagatcactaaggccagacccg

SEQ ID NO: 123373 - DNA, 25 bp, Mus musculus
taaaagattctcaagtggtgcaggt

SEQ ID NO: 123374 - DNA, 25 bp, Mus musculus
taaaagcaaacatgtatcgggccgg

SEQ ID NO: 123375 - DNA, 25 bp, Mus musculus
taaaagcactagaccccatgatgga

SEQ ID NO: 123376 - DNA, 25 bp, Mus musculus
taaaagcagcagctcgagatggcaa

SEQ ID NO: 123377 - DNA, 25 bp, Mus musculus
taaaagcagccattcgaagagccgg

SEQ ID NO: 123378 - DNA, 25 bp, Mus musculus
taaaagcagtcaaaacaccgatgta

SEQ ID NO: 123379 - DNA, 25 bp, Mus musculus
taaaagcagtttgatacagtaccgg

SEQ ID NO: 123380 - DNA, 25 bp, Mus musculus
taaaagccaagggttatccagcaca

SEQ ID NO: 123381 - DNA, 25 bp, Mus musculus
taaaagccacgctgacccatcaagt

SEQ ID NO: 123382 - DNA, 25 bp, Mus musculus
taaaagccagcgtcaagtcagccgc

SEQ ID NO: 123383 - DNA, 25 bp, Mus musculus
taaaagcccagaggaagtcccgaag

SEQ ID NO: 123384 - DNA, 25 bp, Mus musculus
taaaagcccggcgatctgaatgtaa

SEQ ID NO: 123385 - DNA, 25 bp, Mus musculus
taaaagccctagaaacctacgagat

SEQ ID NO: 123386 - DNA, 25 bp, Mus musculus
taaaagccctagttgacaagtggcc

SEQ ID NO: 123387 - DNA, 25 bp, Mus musculus
taaaagccgagaaagcagcaagtgc

SEQ ID NO: 123388 - DNA, 25 bp, Mus musculus
taaaagccttgactgtgcgatggcc

SEQ ID NO: 123389 - DNA, 25 bp, Mus musculus
taaaagctagtggactctacctggt

SEQ ID NO: 123390 - DNA, 25 bp, Mus musculus
taaaagctgtacagagtaatcccac

SEQ ID NO: 123391 - DNA, 25 bp, Mus musculus
taaaagctgtcaacaccgctgtgga

SEQ ID NO: 123392 - DNA, 25 bp, Mus musculus
taaaaggaaaaggtgcatctggcag

SEQ ID NO: 123393 - DNA, 25 bp, Mus musculus
taaaaggaaatcaatgccccggacg

SEQ ID NO: 123394 - DNA, 25 bp, Mus musculus
taaaaggaacttgtctgggacccag

SEQ ID NO: 123395 - DNA, 25 bp, Mus musculus
taaaaggacgcagagggaaagtgac

SEQ ID NO: 123396 - DNA, 25 bp, Mus musculus
taaaaggagatggtaaaaaagcaga

SEQ ID NO: 123397 - DNA, 25 bp, Mus musculus
taaaaggagcccgatctgtgagcat

SEQ ID NO: 123398 - DNA, 25 bp, Mus musculus
taaaaggaggaacctgcttgctgcc

SEQ ID NO: 123399 - DNA, 25 bp, Mus musculus
taaaaggcacacgcgggcatgcggc

SEQ ID NO: 123400 - DNA, 25 bp, Mus musculus
taaaaggcacccagaacagtgaggt

SEQ ID NO: 123401 - DNA, 25 bp, Mus musculus
taaaaggcaccgtcttgccacttct

SEQ ID NO: 123402 - DNA, 25 bp, Mus musculus
taaaaggcactctctctgtcacttc

SEQ ID NO: 123403 - DNA, 25 bp, Mus musculus
taaaaggcacttgttaggccgcagt

SEQ ID NO: 123404 - DNA, 25 bp, Mus musculus
taaaaggcaggagaacgtgcagctg

SEQ ID NO: 123405 - DNA, 25 bp, Mus musculus
taaaaggcggattgagatttgactc

SEQ ID NO: 123406 - DNA, 25 bp, Mus musculus
taaaagggaacctccagagggctgt

SEQ ID NO: 123407 - DNA, 25 bp, Mus musculus
taaaagggatcctgagacagatggc

SEQ ID NO: 123408 - DNA, 25 bp, Mus musculus
taaaagggcagcagtgtccatcaca

SEQ ID NO: 123409 - DNA, 25 bp, Mus musculus
taaaagggccggtgaatcttgcgga

SEQ ID NO: 123410 - DNA, 25 bp, Mus musculus
taaaaggtcaggtccccgagtcatt

SEQ ID NO: 123411 - DNA, 25 bp, Mus musculus
taaaaggtcccaaaggcagtgtcca

SEQ ID NO: 123412 - DNA, 25 bp, Mus musculus
taaaaggtctctctgtgaaaaccgg

SEQ ID NO: 123413 - DNA, 25 bp, Mus musculus
taaaaggttcaaccaccaggagtcg

SEQ ID NO: 123414 - DNA, 25 bp, Mus musculus
taaaaggttgcgtctcagtgagctg

SEQ ID NO: 123415 - DNA, 25 bp, Mus musculus
taaaagtagtgagttccccgagtcg

SEQ ID NO: 123416 - DNA, 25 bp, Mus musculus
taaaagtcaaagatccaccaaaggg

SEQ ID NO: 123417 - DNA, 25 bp, Mus musculus
taaaagtccagtgtggtggtgcgca

SEQ ID NO: 123418 - DNA, 25 bp, Mus musculus
taaaagtcctgctggctcgggaatc

SEQ ID NO: 123419 - DNA, 25 bp, Mus musculus
taaaagtcgcagcagactgtagcct

SEQ ID NO: 123420 - DNA, 25 bp, Mus musculus
taaaagtcgtcaatggagcagcagc

SEQ ID NO: 123421 - DNA, 25 bp, Mus musculus
taaaagtgaccggattgagcccctg

SEQ ID NO: 123422 - DNA, 25 bp, Mus musculus
taaaagtgatcaagtcgagtcttcc

SEQ ID NO: 123423 - DNA, 25 bp, Mus musculus
taaaagtggctctcaccctagcaca

SEQ ID NO: 123424 - DNA, 25 bp, Mus musculus
taaaagtgtcccgagtgtctgcagc

SEQ ID NO: 123425 - DNA, 25 bp, Mus musculus
taaaagttccagaaggcacaagtgc

SEQ ID NO: 123426 - DNA, 25 bp, Mus musculus
taaaataaagctctgtgggaacaac

SEQ ID NO: 123427 - DNA, 25 bp, Mus musculus
taaaataacccggtgaagcagccga

SEQ ID NO: 123428 - DNA, 25 bp, Mus musculus
taaaataacctggagctctcacggg

SEQ ID NO: 123429 - DNA, 25 bp, Mus musculus
taaaataagaacgtccctgagtgga

SEQ ID NO: 123430 - DNA, 25 bp, Mus musculus
taaaatacaacttcagctggtcctg

SEQ ID NO: 123431 - DNA, 25 bp, Mus musculus
taaaatacctccgtgactggacagg

SEQ ID NO: 123432 - DNA, 25 bp, Mus musculus
taaaatactccgaagttggcaacca

SEQ ID NO: 123433 - DNA, 25 bp, Mus musculus
taaaatagagcaagcctagggctgg

SEQ ID NO: 123434 - DNA, 25 bp, Mus musculus
taaaatagctgcagcgggatgctgg

SEQ ID NO: 123435 - DNA, 25 bp, Mus musculus
taaaatcaggctcaaataggtcaca

SEQ ID NO: 123436 - DNA, 25 bp, Mus musculus
taaaatcattccaccgaacagtgca

SEQ ID NO: 123437 - DNA, 25 bp, Mus musculus
taaaatcattgtgggcagcttcatg

SEQ ID NO: 123438 - DNA, 25 bp, Mus musculus
taaaatccagctgtgatgggctaca

SEQ ID NO: 123439 - DNA, 25 bp, Mus musculus
taaaatccatcgctgccaagtactc

SEQ ID NO: 123440 - DNA, 25 bp, Mus musculus
taaaatcctcaatacagaacactgg

SEQ ID NO: 123441 - DNA, 25 bp, Mus musculus
taaaatcgatgtcgcttcatggcac

SEQ ID NO: 123442 - DNA, 25 bp, Mus musculus
taaaatcgcctggaaaacagcagcc

SEQ ID NO: 123443 - DNA, 25 bp, Mus musculus
taaaatcgtgagagatatccgccca

SEQ ID NO: 123444 - DNA, 25 bp, Mus musculus
taaaatctgaaggacgtcgggtact

SEQ ID NO: 123445 - DNA, 25 bp, Mus musculus
taaaatgaaaatatcccggcccaag

SEQ ID NO: 123446 - DNA, 25 bp, Mus musculus
taaaatgatcgacaagaacctgcgg

SEQ ID NO: 123447 - DNA, 25 bp, Mus musculus
taaaatgatcgatgaagctgagccc

SEQ ID NO: 123448 - DNA, 25 bp, Mus musculus
taaaatgatctacatggaaggaccg

SEQ ID NO: 123449 - DNA, 25 bp, Mus musculus
taaaatgatgcgttgcttgcccgct

SEQ ID NO: 123450 - DNA, 25 bp, Mus musculus
taaaatgattgtcttcggtggctcc

SEQ ID NO: 123451 - DNA, 25 bp, Mus musculus
taaaatgctatctaccctgagtccg

SEQ ID NO: 123452 - DNA, 25 bp, Mus musculus
taaaatgctccaactgactgctcgc

SEQ ID NO: 123453 - DNA, 25 bp, Mus musculus
taaaatgctttcagagcgtgacgcg

SEQ ID NO: 123454 - DNA, 25 bp, Mus musculus
taaaatggaccccactaagcagtac

SEQ ID NO: 123455 - DNA, 25 bp, Mus musculus
taaaatggacctgccttacaagtgt

SEQ ID NO: 123456 - DNA, 25 bp, Mus musculus
taaaatggagttaccgtctcgtggg

SEQ ID NO: 123457 - DNA, 25 bp, Mus musculus
taaaatggctccacaggagttgccg

SEQ ID NO: 123458 - DNA, 25 bp, Mus musculus
taaaatgggtcgactttgccagagg

SEQ ID NO: 123459 - DNA, 25 bp, Mus musculus
taaaatggtcatcaatcgcctggag

SEQ ID NO: 123460 - DNA, 25 bp, Mus musculus
taaaatggtggagaaacgcttccct

SEQ ID NO: 123461 - DNA, 25 bp, Mus musculus
taaaatggtttatctgccctgctaa

SEQ ID NO: 123462 - DNA, 25 bp, Mus musculus
taaaatgtatgcctgggtcaaagcg

SEQ ID NO: 123463 - DNA, 25 bp, Mus musculus
taaaatgtccgggtgtctgcagtct

SEQ ID NO: 123464 - DNA, 25 bp, Mus musculus
taaaatgtcggctccaggaccttac

SEQ ID NO: 123465 - DNA, 25 bp, Mus musculus
taaaatgtctccctccaagtggaag

SEQ ID NO: 123466 - DNA, 25 bp, Mus musculus
taaaatgtgagtaggtggtgaccac

SEQ ID NO: 123467 - DNA, 25 bp, Mus musculus
taaaattacctggtctgcagcactc

SEQ ID NO: 123468 - DNA, 25 bp, Mus musculus
taaaattcacgtggatgaggaccct

SEQ ID NO: 123469 - DNA, 25 bp, Mus musculus
taaaattcactggttgatggccgcc

SEQ ID NO: 123470 - DNA, 25 bp, Mus musculus
taaaattcagacaaaagggccccag

SEQ ID NO: 123471 - DNA, 25 bp, Mus musculus
taaaattctgctctcatgaacaagg

SEQ ID NO: 123472 - DNA, 25 bp, Mus musculus
taaaattgaaagcagtccactgtgg

SEQ ID NO: 123473 - DNA, 25 bp, Mus musculus
taaaattgagtttgtgccacctagg

SEQ ID NO: 123474 - DNA, 25 bp, Mus musculus
taaaatttaacatccagaagcggcc

SEQ ID NO: 123475 - DNA, 25 bp, Mus musculus
taaaatttctgaggagtgcatcgca

SEQ ID NO: 123476 - DNA, 25 bp, Mus musculus
taaaatttgacagccaggaagacct

SEQ ID NO: 123477 - DNA, 25 bp, Mus musculus
taaacaaacacagttgccgggtggc

SEQ ID NO: 123478 - DNA, 25 bp, Mus musculus
taaacaaataaaggtggtggcactc

SEQ ID NO: 123479 - DNA, 25 bp, Mus musculus
taaacaacccagacatgcgagtgca

SEQ ID NO: 123480 - DNA, 25 bp, Mus musculus
taaacaacctgagcgttaggactgc

SEQ ID NO: 123481 - DNA, 25 bp, Mus musculus
taaacaagagcgagtggaccatgcg

SEQ ID NO: 123482 - DNA, 25 bp, Mus musculus
taaacaagagggtttggcaccaatc

SEQ ID NO: 123483 - DNA, 25 bp, Mus musculus
taaacaagatgatattcctcgccac

SEQ ID NO: 123484 - DNA, 25 bp, Mus musculus
taaacaagcagagacaagcatccgc

SEQ ID NO: 123485 - DNA, 25 bp, Mus musculus
taaacaagccgctcttggccaggac

SEQ ID NO: 123486 - DNA, 25 bp, Mus musculus
taaacaagctacatctggtgacagt

SEQ ID NO: 123487 - DNA, 25 bp, Mus musculus
taaacaaggagcagacagagaatgc

SEQ ID NO: 123488 - DNA, 25 bp, Mus musculus
taaacaagttccgtccaagtgcaac

SEQ ID NO: 123489 - DNA, 25 bp, Mus musculus
taaacaatcattggaccccagtcct

SEQ ID NO: 123490 - DNA, 25 bp, Mus musculus
taaacaatgcagacactgggatagc

SEQ ID NO: 123491 - DNA, 25 bp, Mus musculus
taaacaatggtaatgggcaggcctt

SEQ ID NO: 123492 - DNA, 25 bp, Mus musculus
taaacaattcgataccgaaaatgcc

SEQ ID NO: 123493 - DNA, 25 bp, Mus musculus
taaacacaagactgggctacaaaag

SEQ ID NO: 123494 - DNA, 25 bp, Mus musculus
taaacacaggcggacaggtcaagct

SEQ ID NO: 123495 - DNA, 25 bp, Mus musculus
taaacacagtcgtggccaatgcagc

SEQ ID NO: 123496 - DNA, 25 bp, Mus musculus
taaacaccagcagttgtcattcagt

SEQ ID NO: 123497 - DNA, 25 bp, Mus musculus
taaacaccagcgagcagagctcagc

SEQ ID NO: 123498 - DNA, 25 bp, Mus musculus
taaacaccgaaggttccacagcaga

SEQ ID NO: 123499 - DNA, 25 bp, Mus musculus
taaacaccttcgagggcagtggcct

SEQ ID NO: 123500 - DNA, 25 bp, Mus musculus
taaacacgtttggtgagagccatgg

SEQ ID NO: 123501 - DNA, 25 bp, Mus musculus
taaacactaccggtacttgtccagt

SEQ ID NO: 123502 - DNA, 25 bp, Mus musculus
taaacactcgagagccttaggagca

SEQ ID NO: 123503 - DNA, 25 bp, Mus musculus
taaacactgatctggaaattggtcc

SEQ ID NO: 123504 - DNA, 25 bp, Mus musculus
taaacactggctctggcgatgagtc

SEQ ID NO: 123505 - DNA, 25 bp, Mus musculus
taaacactgtggagtattggatccc

SEQ ID NO: 123506 - DNA, 25 bp, Mus musculus
taaacagaacagaagtcaggacctc

SEQ ID NO: 123507 - DNA, 25 bp, Mus musculus
taaacagaaggtcgagcacatagag

SEQ ID NO: 123508 - DNA, 25 bp, Mus musculus
taaacagaggctgaaggtgatccag

SEQ ID NO: 123509 - DNA, 25 bp, Mus musculus
taaacagagttcttcgcaacctggc

SEQ ID NO: 123510 - DNA, 25 bp, Mus musculus
taaacagcactggatcatggccact

SEQ ID NO: 123511 - DNA, 25 bp, Mus musculus
taaacagcagggtcacaagggatac

SEQ ID NO: 123512 - DNA, 25 bp, Mus musculus
taaacagcagggtttgagcacaatc

SEQ ID NO: 123513 - DNA, 25 bp, Mus musculus
taaacagctccagcaaggcgagcct

SEQ ID NO: 123514 - DNA, 25 bp, Mus musculus
taaacagggtcaattgctaaaggag

SEQ ID NO: 123515 - DNA, 25 bp, Mus musculus
taaacaggtcaactacaatgatggc

SEQ ID NO: 123516 - DNA, 25 bp, Mus musculus
taaacagtaccaacactgtcatgtg

SEQ ID NO: 123517 - DNA, 25 bp, Mus musculus
taaacagtcagccagtgggaccaag

SEQ ID NO: 123518 - DNA, 25 bp, Mus musculus
taaacagtctacagagacagcggct

SEQ ID NO: 123519 - DNA, 25 bp, Mus musculus
taaacagtggccttacagtatcaaa

SEQ ID NO: 123520 - DNA, 25 bp, Mus musculus
taaacagttttggaccaagaccaag

SEQ ID NO: 123521 - DNA, 25 bp, Mus musculus
taaacataagtgctgactggctcca

SEQ ID NO: 123522 - DNA, 25 bp, Mus musculus
taaacatcacgtcagccctggatag

SEQ ID NO: 123523 - DNA, 25 bp, Mus musculus
taaacatcatcactggagccctgaa

SEQ ID NO: 123524 - DNA, 25 bp, Mus musculus
taaacatcctgtatgctgagctggt

SEQ ID NO: 123525 - DNA, 25 bp, Mus musculus
taaacatgacccgtgactgtgcctc

SEQ ID NO: 123526 - DNA, 25 bp, Mus musculus
taaacatgcacaatgtccccgagga

SEQ ID NO: 123527 - DNA, 25 bp, Mus musculus
taaacatggcctctttagtgggcag

SEQ ID NO: 123528 - DNA, 25 bp, Mus musculus
taaacatgggccagcgatgctctga

SEQ ID NO: 123529 - DNA, 25 bp, Mus musculus
taaacattacctgacgacaaggacg

SEQ ID NO: 123530 - DNA, 25 bp, Mus musculus
taaacattctgtagccacttgagtg

SEQ ID NO: 123531 - DNA, 25 bp, Mus musculus
taaaccacagcaggtgccgtcatgg

SEQ ID NO: 123532 - DNA, 25 bp, Mus musculus
taaaccactatgcttaccgagatgc

SEQ ID NO: 123533 - DNA, 25 bp, Mus musculus
taaaccacttggataagacgtctca

SEQ ID NO: 123534 - DNA, 25 bp, Mus musculus
taaaccagaaaccttcgaaggccag

SEQ ID NO: 123535 - DNA, 25 bp, Mus musculus
taaaccagatgtcggcagataacct

SEQ ID NO: 123536 - DNA, 25 bp, Mus musculus
taaaccagtatcctgagcgaatcct

SEQ ID NO: 123537 - DNA, 25 bp, Mus musculus
taaaccatcacttgagtggactcgc

SEQ ID NO: 123538 - DNA, 25 bp, Mus musculus
taaaccatgagggtgatgcaaacac

SEQ ID NO: 123539 - DNA, 25 bp, Mus musculus
taaaccatggcgaagatgctgtgcc

SEQ ID NO: 123540 - DNA, 25 bp, Mus musculus
taaaccatttacttcgggagctgag

SEQ ID NO: 123541 - DNA, 25 bp, Mus musculus
taaacccaaccaggtgggcgagacg

SEQ ID NO: 123542 - DNA, 25 bp, Mus musculus
taaacccacaagcaggaccgagaat

SEQ ID NO: 123543 - DNA, 25 bp, Mus musculus
taaacccactaagggacggatgcgg

SEQ ID NO: 123544 - DNA, 25 bp, Mus musculus
taaacccagtgaaggcagacaatgt

SEQ ID NO: 123545 - DNA, 25 bp, Mus musculus
taaacccatcgcctagaccttcagg

SEQ ID NO: 123546 - DNA, 25 bp, Mus musculus
taaaccccccggagcccgagcagtg

SEQ ID NO: 123547 - DNA, 25 bp, Mus musculus
taaacccctggttgataatagccat

SEQ ID NO: 123548 - DNA, 25 bp, Mus musculus
taaacccgaaacctcactatggatg

SEQ ID NO: 123549 - DNA, 25 bp, Mus musculus
taaaccctgggctgtgaacttcgcg

SEQ ID NO: 123550 - DNA, 25 bp, Mus musculus
taaaccctgtgctaaggaaggcctg

SEQ ID NO: 123551 - DNA, 25 bp, Mus musculus
taaaccctgtggtaggaacagtcta

SEQ ID NO: 123552 - DNA, 25 bp, Mus musculus
taaacccttcaggagcatagcggcg

SEQ ID NO: 123553 - DNA, 25 bp, Mus musculus
taaaccgaaggaaggctcagctgct

SEQ ID NO: 123554 - DNA, 25 bp, Mus musculus
taaaccgaatagagcgagccactgg

SEQ ID NO: 123555 - DNA, 25 bp, Mus musculus
taaaccgagttatgaagtcctgacg

SEQ ID NO: 123556 - DNA, 25 bp, Mus musculus
taaaccgagttcgttgggcacaggg

SEQ ID NO: 123557 - DNA, 25 bp, Mus musculus
taaaccgcaagtgcatatccagatg

SEQ ID NO: 123558 - DNA, 25 bp, Mus musculus
taaaccgcgatgaatgagcagaagc

SEQ ID NO: 123559 - DNA, 25 bp, Mus musculus
taaaccggccagagaagaggaatgc

SEQ ID NO: 123560 - DNA, 25 bp, Mus musculus
taaaccggcggaagtcattggctcc

SEQ ID NO: 123561 - DNA, 25 bp, Mus musculus
taaaccggctgctagcagaactgcc

SEQ ID NO: 123562 - DNA, 25 bp, Mus musculus
taaacctaaccataggctgcaggcg

SEQ ID NO: 123563 - DNA, 25 bp, Mus musculus
taaacctaagggagaaagacacata

SEQ ID NO: 123564 - DNA, 25 bp, Mus musculus
taaacctagaatagagctgtctgcc

SEQ ID NO: 123565 - DNA, 25 bp, Mus musculus
taaacctaggaggagcagatcatcg

SEQ ID NO: 123566 - DNA, 25 bp, Mus musculus
taaacctatcatcatggaaggagcc

SEQ ID NO: 123567 - DNA, 25 bp, Mus musculus
taaacctcaagaggaacaagtccag

SEQ ID NO: 123568 - DNA, 25 bp, Mus musculus
taaacctcagctcggatatctggct

SEQ ID NO: 123569 - DNA, 25 bp, Mus musculus
taaacctcggtggagacaagagctc

SEQ ID NO: 123570 - DNA, 25 bp, Mus musculus
taaacctgccttgattctaagcccg

SEQ ID NO: 123571 - DNA, 25 bp, Mus musculus
taaacctggagacgcttgctctgcc

SEQ ID NO: 123572 - DNA, 25 bp, Mus musculus
taaacctggatgctactgtaaaact

SEQ ID NO: 123573 - DNA, 25 bp, Mus musculus
taaacctggtctgtggcctcgtgtg

SEQ ID NO: 123574 - DNA, 25 bp, Mus musculus
taaacctgtgaagagcatcatggct

SEQ ID NO: 123575 - DNA, 25 bp, Mus musculus
taaaccttacctgttgcctggagac

SEQ ID NO: 123576 - DNA, 25 bp, Mus musculus
taaaccttgtctgagtagtgttccg

SEQ ID NO: 123577 - DNA, 25 bp, Mus musculus
taaacctttgcacagcagtggaatc

SEQ ID NO: 123578 - DNA, 25 bp, Mus musculus
taaacgaaacaacaggtggagccac

SEQ ID NO: 123579 - DNA, 25 bp, Mus musculus
taaacgaagtcggaagaagccacgc

SEQ ID NO: 123580 - DNA, 25 bp, Mus musculus
taaacgaccgagtaaggtccagtgg

SEQ ID NO: 123581 - DNA, 25 bp, Mus musculus
taaacgaccgcattaaggagctagg

SEQ ID NO: 123582 - DNA, 25 bp, Mus musculus
taaacgagcccataggagaaacagc

SEQ ID NO: 123583 - DNA, 25 bp, Mus musculus
taaacgagtggccaaaagggtctgc

SEQ ID NO: 123584 - DNA, 25 bp, Mus musculus
taaacgcagtgggtccaaagacggc

SEQ ID NO: 123585 - DNA, 25 bp, Mus musculus
taaacgctaatcttccacggactgg

SEQ ID NO: 123586 - DNA, 25 bp, Mus musculus
taaacgctgtctgcaaaccaaatgg

SEQ ID NO: 123587 - DNA, 25 bp, Mus musculus
taaacggaggcaagtatggaaccac

SEQ ID NO: 123588 - DNA, 25 bp, Mus musculus
taaacggctcagtgactatgcgctc

SEQ ID NO: 123589 - DNA, 25 bp, Mus musculus
taaacgggaaggctgctcagagtcc

SEQ ID NO: 123590 - DNA, 25 bp, Mus musculus
taaacgggatgtctactaccgcctg

SEQ ID NO: 123591 - DNA, 25 bp, Mus musculus
taaacgggcaatacgtgaggcagcc

SEQ ID NO: 123592 - DNA, 25 bp, Mus musculus
taaacgggcaatgtggctacgtcct

SEQ ID NO: 123593 - DNA, 25 bp, Mus musculus
taaacggtctcagagcggagctatc

SEQ ID NO: 123594 - DNA, 25 bp, Mus musculus
taaacggtctgtgtgcaaagtccag

SEQ ID NO: 123595 - DNA, 25 bp, Mus musculus
taaacggtgtccattctgcagagct

SEQ ID NO: 123596 - DNA, 25 bp, Mus musculus
taaacgtaagggaggcagtagcatt

SEQ ID NO: 123597 - DNA, 25 bp, Mus musculus
taaacgtcacagaggcaatgcttgc

SEQ ID NO: 123598 - DNA, 25 bp, Mus musculus
taaacgtcatcacggaaacacagtg

SEQ ID NO: 123599 - DNA, 25 bp, Mus musculus
taaacgtcccaacacgacagatggg

SEQ ID NO: 123600 - DNA, 25 bp, Mus musculus
taaacgtctgtgtggccaactcagc

SEQ ID NO: 123601 - DNA, 25 bp, Mus musculus
taaacgtgaaggtgatggaagctct

SEQ ID NO: 123602 - DNA, 25 bp, Mus musculus
taaacgtgacatgggtggctcacct

SEQ ID NO: 123603 - DNA, 25 bp, Mus musculus
taaacgtgcgcttctggagactgag

SEQ ID NO: 123604 - DNA, 25 bp, Mus musculus
taaacgtggccctgaattccgctgt

SEQ ID NO: 123605 - DNA, 25 bp, Mus musculus
taaacgtgggtgaactgatcttggt

SEQ ID NO: 123606 - DNA, 25 bp, Mus musculus
taaacgtgtccaaaataacgagatt

SEQ ID NO: 123607 - DNA, 25 bp, Mus musculus
taaacgtgtgcctcttaatggcggt

SEQ ID NO: 123608 - DNA, 25 bp, Mus musculus
taaactactaagtctggccagcact

SEQ ID NO: 123609 - DNA, 25 bp, Mus musculus
taaactactcaaggaaccctctgga

SEQ ID NO: 123610 - DNA, 25 bp, Mus musculus
taaactagaagaaagaggagccaac

SEQ ID NO: 123611 - DNA, 25 bp, Mus musculus
taaactagactacaggagtgtccgg

SEQ ID NO: 123612 - DNA, 25 bp, Mus musculus
taaactagccctgttagtgacccag

SEQ ID NO: 123613 - DNA, 25 bp, Mus musculus
taaactagtgaagcaactcagagaa

SEQ ID NO: 123614 - DNA, 25 bp, Mus musculus
taaactatactgcactacaggaggg

SEQ ID NO: 123615 - DNA, 25 bp, Mus musculus
taaactatcatgaactggccaggag

SEQ ID NO: 123616 - DNA, 25 bp, Mus musculus
taaactatgtatctaggaccccaag

SEQ ID NO: 123617 - DNA, 25 bp, Mus musculus
taaactcactaagccagaagtggtg

SEQ ID NO: 123618 - DNA, 25 bp, Mus musculus
taaactcagagagcgcattcagccg

SEQ ID NO: 123619 - DNA, 25 bp, Mus musculus
taaactcaggctctacttggagcag

SEQ ID NO: 123620 - DNA, 25 bp, Mus musculus
taaactcatttgtctggcctgactg

SEQ ID NO: 123621 - DNA, 25 bp, Mus musculus
taaactccggagcaagcacctcctg

SEQ ID NO: 123622 - DNA, 25 bp, Mus musculus
taaactccttcagtgtcgtttgttg

SEQ ID NO: 123623 - DNA, 25 bp, Mus musculus
taaactcgtgggtgtctcacaggat

SEQ ID NO: 123624 - DNA, 25 bp, Mus musculus
taaactctaggcagcaacttcaaga

SEQ ID NO: 123625 - DNA, 25 bp, Mus musculus
taaactctagtgtggtgctcatcag

SEQ ID NO: 123626 - DNA, 25 bp, Mus musculus
taaactctgccctaaagaccagcag

SEQ ID NO: 123627 - DNA, 25 bp, Mus musculus
taaactcttgggagccaagagtgca

SEQ ID NO: 123628 - DNA, 25 bp, Mus musculus
taaactgaaaagtaaggcgcctcac

SEQ ID NO: 123629 - DNA, 25 bp, Mus musculus
taaactgaacctgacttcctggaag

SEQ ID NO: 123630 - DNA, 25 bp, Mus musculus
taaactgacacgaatgcgcagcgat

SEQ ID NO: 123631 - DNA, 25 bp, Mus musculus
taaactgaccaatcatggcaagaca

SEQ ID NO: 123632 - DNA, 25 bp, Mus musculus
taaactgacctgtcgagactgccag

SEQ ID NO: 123633 - DNA, 25 bp, Mus musculus
taaactgagcaaaaacgccacgcct

SEQ ID NO: 123634 - DNA, 25 bp, Mus musculus
taaactgaggcacttggtaactgca

SEQ ID NO: 123635 - DNA, 25 bp, Mus musculus
taaactgcagccacgagctctggaa

SEQ ID NO: 123636 - DNA, 25 bp, Mus musculus
taaactgccgcatcctgactctagt

SEQ ID NO: 123637 - DNA, 25 bp, Mus musculus
taaactgcctgaatcacaatcgcgc

SEQ ID NO: 123638 - DNA, 25 bp, Mus musculus
taaactgctggtgctcaccggacag

SEQ ID NO: 123639 - DNA, 25 bp, Mus musculus
taaactgcttcggtccagagaggca

SEQ ID NO: 123640 - DNA, 25 bp, Mus musculus
taaactgctttacgatggagaactt

SEQ ID NO: 123641 - DNA, 25 bp, Mus musculus
taaactggaagacattgcgaatgca

SEQ ID NO: 123642 - DNA, 25 bp, Mus musculus
taaactggaagtccccaggattgag

SEQ ID NO: 123643 - DNA, 25 bp, Mus musculus
taaactggtggcctcggaacagttg

SEQ ID NO: 123644 - DNA, 25 bp, Mus musculus
taaactgtacttcagggatctgcca

SEQ ID NO: 123645 - DNA, 25 bp, Mus musculus
taaactgtactttacttaaggccag

SEQ ID NO: 123646 - DNA, 25 bp, Mus musculus
taaactgtgctctaaatgggagaac

SEQ ID NO: 123647 - DNA, 25 bp, Mus musculus
taaacttattaatagtggctagcct

SEQ ID NO: 123648 - DNA, 25 bp, Mus musculus
taaacttcaggatggctcgcttcgg

SEQ ID NO: 123649 - DNA, 25 bp, Mus musculus
taaacttccaggttcattagaggct

SEQ ID NO: 123650 - DNA, 25 bp, Mus musculus
taaacttcctggttcctctgggcta

SEQ ID NO: 123651 - DNA, 25 bp, Mus musculus
taaacttcgtgtggtgggaggccat

SEQ ID NO: 123652 - DNA, 25 bp, Mus musculus
taaacttctgtgaccgagtcagcgg

SEQ ID NO: 123653 - DNA, 25 bp, Mus musculus
taaacttgaaccagttgcccctgtg

SEQ ID NO: 123654 - DNA, 25 bp, Mus musculus
taaacttgactcgaccagtgggcag

SEQ ID NO: 123655 - DNA, 25 bp, Mus musculus
taaacttgagaggtgcagagctcca

SEQ ID NO: 123656 - DNA, 25 bp, Mus musculus
taaacttgagtggaacttgcagcag

SEQ ID NO: 123657 - DNA, 25 bp, Mus musculus
taaacttggtgaccagacagtcgaa

SEQ ID NO: 123658 - DNA, 25 bp, Mus musculus
taaactttccttggcactgagctgg

SEQ ID NO: 123659 - DNA, 25 bp, Mus musculus
taaagaaaaccctggatcctgatcc

SEQ ID NO: 123660 - DNA, 25 bp, Mus musculus
taaagaaactcctgcttgatcccga

SEQ ID NO: 123661 - DNA, 25 bp, Mus musculus
taaagaaaggaactaacggagctgc

SEQ ID NO: 123662 - DNA, 25 bp, Mus musculus
taaagaaagggatcatgagactact

SEQ ID NO: 123663 - DNA, 25 bp, Mus musculus
taaagaaattgtatctgggcacggc

SEQ ID NO: 123664 - DNA, 25 bp, Mus musculus
taaagaacagtatctcggctacaga

SEQ ID NO: 123665 - DNA, 25 bp, Mus musculus
taaagaaccaccaggcgctgttaag

SEQ ID NO: 123666 - DNA, 25 bp, Mus musculus
taaagaacgtgactcaagctgagcc

SEQ ID NO: 123667 - DNA, 25 bp, Mus musculus
taaagaactctacaggaggcggttc

SEQ ID NO: 123668 - DNA, 25 bp, Mus musculus
taaagaactgtatgccctccggtat

SEQ ID NO: 123669 - DNA, 25 bp, Mus musculus
taaagaagaagccttacctggagcc

SEQ ID NO: 123670 - DNA, 25 bp, Mus musculus
taaagaagacggtcaccaatgacag

SEQ ID NO: 123671 - DNA, 25 bp, Mus musculus
taaagaagactctgaacatctgatt

SEQ ID NO: 123672 - DNA, 25 bp, Mus musculus
taaagaagcagatccggtgtcagag

SEQ ID NO: 123673 - DNA, 25 bp, Mus musculus
taaagaagccactgacgtgtcccca

SEQ ID NO: 123674 - DNA, 25 bp, Mus musculus
taaagaagccagactacgtgacgac

SEQ ID NO: 123675 - DNA, 25 bp, Mus musculus
taaagaagctgaggcacagagtctt

SEQ ID NO: 123676 - DNA, 25 bp, Mus musculus
taaagaaggcccaacaagctgttgc

SEQ ID NO: 123677 - DNA, 25 bp, Mus musculus
taaagaagggaacagacttccagct

SEQ ID NO: 123678 - DNA, 25 bp, Mus musculus
taaagaagggtgagcagcagaaccg

SEQ ID NO: 123679 - DNA, 25 bp, Mus musculus
taaagaaggtcaacagtggcagtgc

SEQ ID NO: 123680 - DNA, 25 bp, Mus musculus
taaagaagtgtttgggtgaaggcca

SEQ ID NO: 123681 - DNA, 25 bp, Mus musculus
taaagaatgccactccatgttggac

SEQ ID NO: 123682 - DNA, 25 bp, Mus musculus
taaagaatggtccacgtgcctgcat

SEQ ID NO: 123683 - DNA, 25 bp, Mus musculus
taaagaattcaaagtggagtaccgc

SEQ ID NO: 123684 - DNA, 25 bp, Mus musculus
taaagacaaccaataggagagaagg

SEQ ID NO: 123685 - DNA, 25 bp, Mus musculus
taaagacaagtacctggctaagcac

SEQ ID NO: 123686 - DNA, 25 bp, Mus musculus
taaagacaggatgaagtcggaccac

SEQ ID NO: 123687 - DNA, 25 bp, Mus musculus
taaagacaggctacttgctagcacg

SEQ ID NO: 123688 - DNA, 25 bp, Mus musculus
taaagacagtagagtagttcctgcc

SEQ ID NO: 123689 - DNA, 25 bp, Mus musculus
taaagaccaaatgatgctgggcagt

SEQ ID NO: 123690 - DNA, 25 bp, Mus musculus
taaagaccagcatggccaagttccg

SEQ ID NO: 123691 - DNA, 25 bp, Mus musculus
taaagaccagtatcttggctcttgc

SEQ ID NO: 123692 - DNA, 25 bp, Mus musculus
taaagaccccgaagcagtcagagct

SEQ ID NO: 123693 - DNA, 25 bp, Mus musculus
taaagaccgtgcagaaaaaatcagg

SEQ ID NO: 123694 - DNA, 25 bp, Mus musculus
taaagaccgtgcatcagggcaaggc

SEQ ID NO: 123695 - DNA, 25 bp, Mus musculus
taaagacctaccagaccgaggtgga

SEQ ID NO: 123696 - DNA, 25 bp, Mus musculus
taaagacctgtgagcagttgaagat

SEQ ID NO: 123697 - DNA, 25 bp, Mus musculus
taaagacgaacctgacaatgctcaa

SEQ ID NO: 123698 - DNA, 25 bp, Mus musculus
taaagacgcgtgcaagaagtcccca

SEQ ID NO: 123699 - DNA, 25 bp, Mus musculus
taaagacgtctgttgcaagaactgt

SEQ ID NO: 123700 - DNA, 25 bp, Mus musculus
taaagactacgatcggatgacggcc

SEQ ID NO: 123701 - DNA, 25 bp, Mus musculus
taaagactcggctgactctacgcag

SEQ ID NO: 123702 - DNA, 25 bp, Mus musculus
taaagactgaaagcaaggatcctcg

SEQ ID NO: 123703 - DNA, 25 bp, Mus musculus
taaagactgagttcctgcaatgcca

SEQ ID NO: 123704 - DNA, 25 bp, Mus musculus
taaagactgcccctgaaaactatgg

SEQ ID NO: 123705 - DNA, 25 bp, Mus musculus
taaagactgcctgtcaagaggccgg

SEQ ID NO: 123706 - DNA, 25 bp, Mus musculus
taaagactgcgcctgcactggctct

SEQ ID NO: 123707 - DNA, 25 bp, Mus musculus
taaagactgttcatactggccttcc

SEQ ID NO: 123708 - DNA, 25 bp, Mus musculus
taaagacttagaagaacaggacctt

SEQ ID NO: 123709 - DNA, 25 bp, Mus musculus
taaagacttcacaacaagagaggtg

SEQ ID NO: 123710 - DNA, 25 bp, Mus musculus
taaagacttgaagtagcccttccag

SEQ ID NO: 123711 - DNA, 25 bp, Mus musculus
taaagagacgtttggagcagctatc

SEQ ID NO: 123712 - DNA, 25 bp, Mus musculus
taaagagagaccacgaggctatacg

SEQ ID NO: 123713 - DNA, 25 bp, Mus musculus
taaagagatagatgagctggtcgat

SEQ ID NO: 123714 - DNA, 25 bp, Mus musculus
taaagagattcacaaaccaggctat

SEQ ID NO: 123715 - DNA, 25 bp, Mus musculus
taaagagcactgttgaccctctggg

SEQ ID NO: 123716 - DNA, 25 bp, Mus musculus
taaagagcagctaactccaagtcag

SEQ ID NO: 123717 - DNA, 25 bp, Mus musculus
taaagagcagggtgccattagtgaa

SEQ ID NO: 123718 - DNA, 25 bp, Mus musculus
taaagagccattctggagcaaccca

SEQ ID NO: 123719 - DNA, 25 bp, Mus musculus
taaagagccccgatcctgctgggat

SEQ ID NO: 123720 - DNA, 25 bp, Mus musculus
taaagagccgctctgcacagaaaac

SEQ ID NO: 123721 - DNA, 25 bp, Mus musculus
taaagagccggatcagtgagcgtgc

SEQ ID NO: 123722 - DNA, 25 bp, Mus musculus
taaagagccttacgatcgagcagtg

SEQ ID NO: 123723 - DNA, 25 bp, Mus musculus
taaagagccttaggtagcttccagt

SEQ ID NO: 123724 - DNA, 25 bp, Mus musculus
taaagagcgcagagaaggagatcag

SEQ ID NO: 123725 - DNA, 25 bp, Mus musculus
taaagagcgtttcctggatgtgccc

SEQ ID NO: 123726 - DNA, 25 bp, Mus musculus
taaagagcttgtggaatgatcctgg

SEQ ID NO: 123727 - DNA, 25 bp, Mus musculus
taaagagctttctggcatccagcag

SEQ ID NO: 123728 - DNA, 25 bp, Mus musculus
taaagaggaagtgccttaagcgtgc

SEQ ID NO: 123729 - DNA, 25 bp, Mus musculus
taaagaggacggatccagatgggcc

SEQ ID NO: 123730 - DNA, 25 bp, Mus musculus
taaagaggagttacagagtctgatc

SEQ ID NO: 123731 - DNA, 25 bp, Mus musculus
taaagaggttatcatcatggccacc

SEQ ID NO: 123732 - DNA, 25 bp, Mus musculus
taaagagtagctgacatcaccgaca

SEQ ID NO: 123733 - DNA, 25 bp, Mus musculus
taaagagtcaccagctttccacatg

SEQ ID NO: 123734 - DNA, 25 bp, Mus musculus
taaagagtcatactctggccccagc

SEQ ID NO: 123735 - DNA, 25 bp, Mus musculus
taaagagtctctatcctgagctgtc

SEQ ID NO: 123736 - DNA, 25 bp, Mus musculus
taaagagtgccatgaaccaagtgat

SEQ ID NO: 123737 - DNA, 25 bp, Mus musculus
taaagagttagaccccaagttggct

SEQ ID NO: 123738 - DNA, 25 bp, Mus musculus
taaagagttggcgttcgagggctga

SEQ ID NO: 123739 - DNA, 25 bp, Mus musculus
taaagataatccagctcggactgac

SEQ ID NO: 123740 - DNA, 25 bp, Mus musculus
taaagatattgagctctcagtggtc

SEQ ID NO: 123741 - DNA, 25 bp, Mus musculus
taaagatcctgtgtaccgggcgaga

SEQ ID NO: 123742 - DNA, 25 bp, Mus musculus
taaagatcgaccataaccccttcgc

SEQ ID NO: 123743 - DNA, 25 bp, Mus musculus
taaagatcgaggtccagaagccact

SEQ ID NO: 123744 - DNA, 25 bp, Mus musculus
taaagatctcagacttcggcatggc

SEQ ID NO: 123745 - DNA, 25 bp, Mus musculus
taaagatcttccctgactctgagca

SEQ ID NO: 123746 - DNA, 25 bp, Mus musculus
taaagatgaaacagctgtaagctac

SEQ ID NO: 123747 - DNA, 25 bp, Mus musculus
taaagatgaccgagaagcctggcct

SEQ ID NO: 123748 - DNA, 25 bp, Mus musculus
taaagatgattacttagaaacactc

SEQ ID NO: 123749 - DNA, 25 bp, Mus musculus
taaagatgcagggtccatatcgtgc

SEQ ID NO: 123750 - DNA, 25 bp, Mus musculus
taaagatgcccgctataccaacggc

SEQ ID NO: 123751 - DNA, 25 bp, Mus musculus
taaagatgccgtcattgcacctgct

SEQ ID NO: 123752 - DNA, 25 bp, Mus musculus
taaagatgctacaagaggccgtgct

SEQ ID NO: 123753 - DNA, 25 bp, Mus musculus
taaagatgcttcaggccgatcgaca

SEQ ID NO: 123754 - DNA, 25 bp, Mus musculus
taaagatggcaagccaagagtgtcc

SEQ ID NO: 123755 - DNA, 25 bp, Mus musculus
taaagatggcgaaaggggtaccact

SEQ ID NO: 123756 - DNA, 25 bp, Mus musculus
taaagatgggcgttgggtcccgaat

SEQ ID NO: 123757 - DNA, 25 bp, Mus musculus
taaagatgtggaggacacctgtctg

SEQ ID NO: 123758 - DNA, 25 bp, Mus musculus
taaagattatgatggctggacacct

SEQ ID NO: 123759 - DNA, 25 bp, Mus musculus
taaagattcttcatcaagctcacaa

SEQ ID NO: 123760 - DNA, 25 bp, Mus musculus
taaagattgtgctcatctccgttgc

SEQ ID NO: 123761 - DNA, 25 bp, Mus musculus
taaagatttgctcgcacaagcccgg

SEQ ID NO: 123762 - DNA, 25 bp, Mus musculus
taaagattttctacaggcagtctcc

SEQ ID NO: 123763 - DNA, 25 bp, Mus musculus
taaagcaaatgggaggcctaaacct

SEQ ID NO: 123764 - DNA, 25 bp, Mus musculus
taaagcaagaaccagaatccgagga

SEQ ID NO: 123765 - DNA, 25 bp, Mus musculus
taaagcaagcagagaccgtgagaac

SEQ ID NO: 123766 - DNA, 25 bp, Mus musculus
taaagcaagtggatgactttctggc

SEQ ID NO: 123767 - DNA, 25 bp, Mus musculus
taaagcaccgtggaggaaagagtgt

SEQ ID NO: 123768 - DNA, 25 bp, Mus musculus
taaagcacgacagcatcaagtcagc

SEQ ID NO: 123769 - DNA, 25 bp, Mus musculus
taaagcactcagcatcccgttggaa

SEQ ID NO: 123770 - DNA, 25 bp, Mus musculus
taaagcagacggaacactggactct

SEQ ID NO: 123771 - DNA, 25 bp, Mus musculus
taaagcagactacccagagaacaga

SEQ ID NO: 123772 - DNA, 25 bp, Mus musculus
taaagcagagacacccggagaagtc

SEQ ID NO: 123773 - DNA, 25 bp, Mus musculus
taaagcagatcactctagtccaggg

SEQ ID NO: 123774 - DNA, 25 bp, Mus musculus
taaagcagcgattacagaatggccc

SEQ ID NO: 123775 - DNA, 25 bp, Mus musculus
taaagcagcgtcctaccagttgtgt

SEQ ID NO: 123776 - DNA, 25 bp, Mus musculus
taaagcaggaaaaatggcggaatca

SEQ ID NO: 123777 - DNA, 25 bp, Mus musculus
taaagcaggcttctgtaaacttcca

SEQ ID NO: 123778 - DNA, 25 bp, Mus musculus
taaagcaggtctcaagtactcagtg

SEQ ID NO: 123779 - DNA, 25 bp, Mus musculus
taaagcaggtggtcgaagagccctc

SEQ ID NO: 123780 - DNA, 25 bp, Mus musculus
taaagcaggtggtctttcccagctg

SEQ ID NO: 123781 - DNA, 25 bp, Mus musculus
taaagcagtcatacgtgcaggtggc

SEQ ID NO: 123782 - DNA, 25 bp, Mus musculus
taaagcatttcaacatgggcctgga

SEQ ID NO: 123783 - DNA, 25 bp, Mus musculus
taaagcatttgtcccatccatccag

SEQ ID NO: 123784 - DNA, 25 bp, Mus musculus
taaagccaaagagtccttgccaagg

SEQ ID NO: 123785 - DNA, 25 bp, Mus musculus
taaagccaagctaatctcagagacc

SEQ ID NO: 123786 - DNA, 25 bp, Mus musculus
taaagccaggagaccttgatgccaa

SEQ ID NO: 123787 - DNA, 25 bp, Mus musculus
taaagccatcaggtacatgtccgcc

SEQ ID NO: 123788 - DNA, 25 bp, Mus musculus
taaagccatgtacttgggtaccacc

SEQ ID NO: 123789 - DNA, 25 bp, Mus musculus
taaagcccaggatcaggtcagaatc

SEQ ID NO: 123790 - DNA, 25 bp, Mus musculus
taaagccccatgtgtagtatagagc

SEQ ID NO: 123791 - DNA, 25 bp, Mus musculus
taaagccccgctggaaatgcctgat

SEQ ID NO: 123792 - DNA, 25 bp, Mus musculus
taaagcccctggaatctgggtaagg

SEQ ID NO: 123793 - DNA, 25 bp, Mus musculus
taaagcccgaacaggcctcaaatgt

SEQ ID NO: 123794 - DNA, 25 bp, Mus musculus
taaagcccgtgactggtggtctact

SEQ ID NO: 123795 - DNA, 25 bp, Mus musculus
taaagccctcggtatcccagagcat

SEQ ID NO: 123796 - DNA, 25 bp, Mus musculus
taaagccctgcaccgaagacagtga

SEQ ID NO: 123797 - DNA, 25 bp, Mus musculus
taaagccggacaagtctggagtggt

SEQ ID NO: 123798 - DNA, 25 bp, Mus musculus
taaagccgtacaggcctttgtggat

SEQ ID NO: 123799 - DNA, 25 bp, Mus musculus
taaagcctccctgatgagaaaactg

SEQ ID NO: 123800 - DNA, 25 bp, Mus musculus
taaagcctgggctacttcctgctgg

SEQ ID NO: 123801 - DNA, 25 bp, Mus musculus
taaagccttaagtggtacgcaactc

SEQ ID NO: 123802 - DNA, 25 bp, Mus musculus
taaagccttggagtattccaatggg

SEQ ID NO: 123803 - DNA, 25 bp, Mus musculus
taaagccttggataaccaaaagagt

SEQ ID NO: 123804 - DNA, 25 bp, Mus musculus
taaagcctttgacgctgaggagctg

SEQ ID NO: 123805 - DNA, 25 bp, Mus musculus
taaagcgactagcaccggtatgaat

SEQ ID NO: 123806 - DNA, 25 bp, Mus musculus
taaagcgcatgtgcccaaagtcagc

SEQ ID NO: 123807 - DNA, 25 bp, Mus musculus
taaagcgcgtggtgcaggaacacct

SEQ ID NO: 123808 - DNA, 25 bp, Mus musculus
taaagcgctcatccatccggaaagg

SEQ ID NO: 123809 - DNA, 25 bp, Mus musculus
taaagcgctcgaccctgagatgatt

SEQ ID NO: 123810 - DNA, 25 bp, Mus musculus
taaagcgcttcagccagaccttgca

SEQ ID NO: 123811 - DNA, 25 bp, Mus musculus
taaagcggaacttcagtagcggcac

SEQ ID NO: 123812 - DNA, 25 bp, Mus musculus
taaagctagaatcaccagggagaag

SEQ ID NO: 123813 - DNA, 25 bp, Mus musculus
taaagctcagctccgtgtgacctgc

SEQ ID NO: 123814 - DNA, 25 bp, Mus musculus
taaagctcaggaacttcaggccatg

SEQ ID NO: 123815 - DNA, 25 bp, Mus musculus
taaagctcctagtgtttttgtgggc

SEQ ID NO: 123816 - DNA, 25 bp, Mus musculus
taaagctcgagaaagaggccacagt

SEQ ID NO: 123817 - DNA, 25 bp, Mus musculus
taaagctctacaagaatgctcggga

SEQ ID NO: 123818 - DNA, 25 bp, Mus musculus
taaagctgagccgatggatactgat

SEQ ID NO: 123819 - DNA, 25 bp, Mus musculus
taaagctgcacaggatttccggaag

SEQ ID NO: 123820 - DNA, 25 bp, Mus musculus
taaagctgcagttccggtcagcagt

SEQ ID NO: 123821 - DNA, 25 bp, Mus musculus
taaagctgcggtcagtctagcgaga

SEQ ID NO: 123822 - DNA, 25 bp, Mus musculus
taaagctgctgtctgagttggacca

SEQ ID NO: 123823 - DNA, 25 bp, Mus musculus
taaagctgcttcgacatgagaaccg

SEQ ID NO: 123824 - DNA, 25 bp, Mus musculus
taaagctggatgacaaacgcacgcc

SEQ ID NO: 123825 - DNA, 25 bp, Mus musculus
taaagctggcagtcgcgaatgtttc

SEQ ID NO: 123826 - DNA, 25 bp, Mus musculus
taaagctgggctgttctccgaccaa

SEQ ID NO: 123827 - DNA, 25 bp, Mus musculus
taaagctggttctatctggcaggcc

SEQ ID NO: 123828 - DNA, 25 bp, Mus musculus
taaagctgtgagcaacgtgatcgcc

SEQ ID NO: 123829 - DNA, 25 bp, Mus musculus
taaagcttcaagttaaacgtgctcg

SEQ ID NO: 123830 - DNA, 25 bp, Mus musculus
taaagcttcagctcagcaaagggcg

SEQ ID NO: 123831 - DNA, 25 bp, Mus musculus
taaagcttcctggtgcctgtctgcc

SEQ ID NO: 123832 - DNA, 25 bp, Mus musculus
taaagcttgcaagagacaacaggcc

SEQ ID NO: 123833 - DNA, 25 bp, Mus musculus
taaagctttccgtgttgcccataag

SEQ ID NO: 123834 - DNA, 25 bp, Mus musculus
taaagctttggcgtctgtctggcac

SEQ ID NO: 123835 - DNA, 25 bp, Mus musculus
taaaggaacgcttggccaacgagct

SEQ ID NO: 123836 - DNA, 25 bp, Mus musculus
taaaggaagacagcctaggcctgga

SEQ ID NO: 123837 - DNA, 25 bp, Mus musculus
taaaggaagaccacgtaacaggatc

SEQ ID NO: 123838 - DNA, 25 bp, Mus musculus
taaaggaagaggactacaaggagcc

SEQ ID NO: 123839 - DNA, 25 bp, Mus musculus
taaaggaatcacagacgtccaggcc

SEQ ID NO: 123840 - DNA, 25 bp, Mus musculus
taaaggacagacatacggctcagag

SEQ ID NO: 123841 - DNA, 25 bp, Mus musculus
taaaggaccaaaatgactgactcaa

SEQ ID NO: 123842 - DNA, 25 bp, Mus musculus
taaaggacctgtgaagatgccgtca

SEQ ID NO: 123843 - DNA, 25 bp, Mus musculus
taaaggacgcctgctcatgaagacc

SEQ ID NO: 123844 - DNA, 25 bp, Mus musculus
taaaggagaacaagctcttcgagca

SEQ ID NO: 123845 - DNA, 25 bp, Mus musculus
taaaggagaacctcgtgagcagcac

SEQ ID NO: 123846 - DNA, 25 bp, Mus musculus
taaaggagccgcaccaaacgttgtg

SEQ ID NO: 123847 - DNA, 25 bp, Mus musculus
taaaggagcgtgagagatccctggc

SEQ ID NO: 123848 - DNA, 25 bp, Mus musculus
taaaggagctgcaagcccaggtcta

SEQ ID NO: 123849 - DNA, 25 bp, Mus musculus
taaaggagctgtatgaccatgccga

SEQ ID NO: 123850 - DNA, 25 bp, Mus musculus
taaaggagcttcaaggtctgtcggc

SEQ ID NO: 123851 - DNA, 25 bp, Mus musculus
taaaggaggcgctgccaaacttcag

SEQ ID NO: 123852 - DNA, 25 bp, Mus musculus
taaaggaggctatccttgacaatga

SEQ ID NO: 123853 - DNA, 25 bp, Mus musculus
taaaggaggttgctggaatcagcca

SEQ ID NO: 123854 - DNA, 25 bp, Mus musculus
taaaggagtcaagtatttccgcctg

SEQ ID NO: 123855 - DNA, 25 bp, Mus musculus
taaaggagtccgagatagccatggg

SEQ ID NO: 123856 - DNA, 25 bp, Mus musculus
taaaggatggcttctaaccacagat

SEQ ID NO: 123857 - DNA, 25 bp, Mus musculus
taaaggattccagtgccagcgtacg

SEQ ID NO: 123858 - DNA, 25 bp, Mus musculus
taaaggcaccttgtaaactgtacgc

SEQ ID NO: 123859 - DNA, 25 bp, Mus musculus
taaaggcacggaagtcgagatcccc

SEQ ID NO: 123860 - DNA, 25 bp, Mus musculus
taaaggcagcaaatctccagcaaag

SEQ ID NO: 123861 - DNA, 25 bp, Mus musculus
taaaggcagcagcaaggcggagagt

SEQ ID NO: 123862 - DNA, 25 bp, Mus musculus
taaaggcagcggagcacaatggtgc

SEQ ID NO: 123863 - DNA, 25 bp, Mus musculus
taaaggcagcttgagatgtcggtcc

SEQ ID NO: 123864 - DNA, 25 bp, Mus musculus
taaaggcataacctcaaactcgtcc

SEQ ID NO: 123865 - DNA, 25 bp, Mus musculus
taaaggcatcctgttatacggaccc

SEQ ID NO: 123866 - DNA, 25 bp, Mus musculus
taaaggccaccatcaaaaccatctg

SEQ ID NO: 123867 - DNA, 25 bp, Mus musculus
taaaggccaggtggtgatccgactg

SEQ ID NO: 123868 - DNA, 25 bp, Mus musculus
taaaggcccagatgataggaatccc

SEQ ID NO: 123869 - DNA, 25 bp, Mus musculus
taaaggccctccgagatcgagtgca

SEQ ID NO: 123870 - DNA, 25 bp, Mus musculus
taaaggccggacaatagcagggatc

SEQ ID NO: 123871 - DNA, 25 bp, Mus musculus
taaaggccgtccgacatttgctgag

SEQ ID NO: 123872 - DNA, 25 bp, Mus musculus
taaaggcctccaggtagacgtgggc

SEQ ID NO: 123873 - DNA, 25 bp, Mus musculus
taaaggcctctttgtcctgccaact

SEQ ID NO: 123874 - DNA, 25 bp, Mus musculus
taaaggcctgctggttcatttcagg

SEQ ID NO: 123875 - DNA, 25 bp, Mus musculus
taaaggcctgtgaatactgctgagc

SEQ ID NO: 123876 - DNA, 25 bp, Mus musculus
taaaggcctgtgatgtccctgagga

SEQ ID NO: 123877 - DNA, 25 bp, Mus musculus
taaaggccttacctatctgtggagt

SEQ ID NO: 123878 - DNA, 25 bp, Mus musculus
taaaggcgcactctgatgtgaggaa

SEQ ID NO: 123879 - DNA, 25 bp, Mus musculus
taaaggcggagctctccatgcagat

SEQ ID NO: 123880 - DNA, 25 bp, Mus musculus
taaaggcggccgtgaagaagcacat

SEQ ID NO: 123881 - DNA, 25 bp, Mus musculus
taaaggcgttttacagacgggctca

SEQ ID NO: 123882 - DNA, 25 bp, Mus musculus
taaaggctagccgaatgacaacagc

SEQ ID NO: 123883 - DNA, 25 bp, Mus musculus
taaaggctctcaaggacttcctggc

SEQ ID NO: 123884 - DNA, 25 bp, Mus musculus
taaaggctggtcctgccactgggac

SEQ ID NO: 123885 - DNA, 25 bp, Mus musculus
taaaggctgttctgactggccccac

SEQ ID NO: 123886 - DNA, 25 bp, Mus musculus
taaaggcttacaaaaaggagctgga

SEQ ID NO: 123887 - DNA, 25 bp, Mus musculus
taaaggcttctggtgtcagctgctg

SEQ ID NO: 123888 - DNA, 25 bp, Mus musculus
taaaggcttgactgctattttagag

SEQ ID NO: 123889 - DNA, 25 bp, Mus musculus
taaaggcttggcagtgtttctccga

SEQ ID NO: 123890 - DNA, 25 bp, Mus musculus
taaaggcttttcaaaggcgtcggcg

SEQ ID NO: 123891 - DNA, 25 bp, Mus musculus
taaagggacagagcatttggcccaa

SEQ ID NO: 123892 - DNA, 25 bp, Mus musculus
taaagggatcaatcaccacagcccg

SEQ ID NO: 123893 - DNA, 25 bp, Mus musculus
taaagggcatattccagagttaggg

SEQ ID NO: 123894 - DNA, 25 bp, Mus musculus
taaagggccccaattcaagcaagtt

SEQ ID NO: 123895 - DNA, 25 bp, Mus musculus
taaagggccgaaacagcttctacac

SEQ ID NO: 123896 - DNA, 25 bp, Mus musculus
taaagggcctcatgtaccagtggat

SEQ ID NO: 123897 - DNA, 25 bp, Mus musculus
taaagggctcgcttacagccggtgg

SEQ ID NO: 123898 - DNA, 25 bp, Mus musculus
taaagggctgtcaagtgggaaccaa

SEQ ID NO: 123899 - DNA, 25 bp, Mus musculus
taaagggtgccacagtagacagcgc

SEQ ID NO: 123900 - DNA, 25 bp, Mus musculus
taaagggtgttatattcaatgtgac

SEQ ID NO: 123901 - DNA, 25 bp, Mus musculus
taaagggtttgtctcggacctcaca

SEQ ID NO: 123902 - DNA, 25 bp, Mus musculus
taaaggtaactgattgcttagatgc

SEQ ID NO: 123903 - DNA, 25 bp, Mus musculus
taaaggtcgtccaccaagagtgcca

SEQ ID NO: 123904 - DNA, 25 bp, Mus musculus
taaaggtctcaaacaaaggtctcaa

SEQ ID NO: 123905 - DNA, 25 bp, Mus musculus
taaaggtctccttgtggcacagagg

SEQ ID NO: 123906 - DNA, 25 bp, Mus musculus
taaaggtctctatcgggcattgtgt

SEQ ID NO: 123907 - DNA, 25 bp, Mus musculus
taaaggtctgcgttcagaacatcgg

SEQ ID NO: 123908 - DNA, 25 bp, Mus musculus
taaaggtgcaggcataaagcagatc

SEQ ID NO: 123909 - DNA, 25 bp, Mus musculus
taaaggtgctctcagacagccgaca

SEQ ID NO: 123910 - DNA, 25 bp, Mus musculus
taaaggtgctcttggaatccggtgc

SEQ ID NO: 123911 - DNA, 25 bp, Mus musculus
taaaggtgctgaatccaggtagcag

SEQ ID NO: 123912 - DNA, 25 bp, Mus musculus
taaaggtggcgccttatagtgtcaa

SEQ ID NO: 123913 - DNA, 25 bp, Mus musculus
taaaggtggttgacccaactccaga

SEQ ID NO: 123914 - DNA, 25 bp, Mus musculus
taaaggtgtaactgggctgcatggc

SEQ ID NO: 123915 - DNA, 25 bp, Mus musculus
taaaggttccatcggagtcgctctg

SEQ ID NO: 123916 - DNA, 25 bp, Mus musculus
taaaggttcccacctcgaaggcaga

SEQ ID NO: 123917 - DNA, 25 bp, Mus musculus
taaaggttcctataatggcccagat

SEQ ID NO: 123918 - DNA, 25 bp, Mus musculus
taaaggttcctgaatgccggttggc

SEQ ID NO: 123919 - DNA, 25 bp, Mus musculus
taaaggttcgcatcgctgtgagcaa

SEQ ID NO: 123920 - DNA, 25 bp, Mus musculus
taaaggttcgtgtctactctgtgaa

SEQ ID NO: 123921 - DNA, 25 bp, Mus musculus
taaaggttgtgaactccaccaccgg

SEQ ID NO: 123922 - DNA, 25 bp, Mus musculus
taaaggtttgagcaacgcatgcgca

SEQ ID NO: 123923 - DNA, 25 bp, Mus musculus
taaagtaaagacaggctgcttggcc

SEQ ID NO: 123924 - DNA, 25 bp, Mus musculus
taaagtaagtataaagccccgtgat

SEQ ID NO: 123925 - DNA, 25 bp, Mus musculus
taaagtacagcagctcatggccaag

SEQ ID NO: 123926 - DNA, 25 bp, Mus musculus
taaagtaccaagcagttccaagtga

SEQ ID NO: 123927 - DNA, 25 bp, Mus musculus
taaagtacgatcagctaggaggcag

SEQ ID NO: 123928 - DNA, 25 bp, Mus musculus
taaagtagatctgctcctgagtgct

SEQ ID NO: 123929 - DNA, 25 bp, Mus musculus
taaagtaggaagaatgagggaccgt

SEQ ID NO: 123930 - DNA, 25 bp, Mus musculus
taaagtagtactccgagaatcgtgc

SEQ ID NO: 123931 - DNA, 25 bp, Mus musculus
taaagtatcccaaaggcattgccct

SEQ ID NO: 123932 - DNA, 25 bp, Mus musculus
taaagtcaaagtccagatcccggag

SEQ ID NO: 123933 - DNA, 25 bp, Mus musculus
taaagtcaaggcttccggagtggga

SEQ ID NO: 123934 - DNA, 25 bp, Mus musculus
taaagtcaagttcaccagctctagc

SEQ ID NO: 123935 - DNA, 25 bp, Mus musculus
taaagtcagaagatgagttacggcc

SEQ ID NO: 123936 - DNA, 25 bp, Mus musculus
taaagtccaagacggatgctcggtc

SEQ ID NO: 123937 - DNA, 25 bp, Mus musculus
taaagtccagaaaacaatgccgagc

SEQ ID NO: 123938 - DNA, 25 bp, Mus musculus
taaagtccaggaagacatcaaggcc

SEQ ID NO: 123939 - DNA, 25 bp, Mus musculus
taaagtccatcccttacggaccagg

SEQ ID NO: 123940 - DNA, 25 bp, Mus musculus
taaagtccatctcaacaccttcggg

SEQ ID NO: 123941 - DNA, 25 bp, Mus musculus
taaagtccggtgttgccagcttcag

SEQ ID NO: 123942 - DNA, 25 bp, Mus musculus
taaagtcctgaaacatgacggatcc

SEQ ID NO: 123943 - DNA, 25 bp, Mus musculus
taaagtcctgccagctcaatgagac

SEQ ID NO: 123944 - DNA, 25 bp, Mus musculus
taaagtcctgggtaaccgctgggct

SEQ ID NO: 123945 - DNA, 25 bp, Mus musculus
taaagtccttagtcacagcaccatg

SEQ ID NO: 123946 - DNA, 25 bp, Mus musculus
taaagtcgaattacaagcccttaag

SEQ ID NO: 123947 - DNA, 25 bp, Mus musculus
taaagtcggccgtgagtgaaatcgc

SEQ ID NO: 123948 - DNA, 25 bp, Mus musculus
taaagtcggcgtgagaagaatccca

SEQ ID NO: 123949 - DNA, 25 bp, Mus musculus
taaagtctaccctgaattctggcaa

SEQ ID NO: 123950 - DNA, 25 bp, Mus musculus
taaagtctgaggatgaaagcgagcg

SEQ ID NO: 123951 - DNA, 25 bp, Mus musculus
taaagtcttatcacctggacgacag

SEQ ID NO: 123952 - DNA, 25 bp, Mus musculus
taaagtcttggatggtgtccaggca

SEQ ID NO: 123953 - DNA, 25 bp, Mus musculus
taaagtgaaaccgaagtagactgcg

SEQ ID NO: 123954 - DNA, 25 bp, Mus musculus
taaagtgacacaagcacgggacacg

SEQ ID NO: 123955 - DNA, 25 bp, Mus musculus
taaagtgacactgttgataagctgc

SEQ ID NO: 123956 - DNA, 25 bp, Mus musculus
taaagtgaccccagcgcttagtgct

SEQ ID NO: 123957 - DNA, 25 bp, Mus musculus
taaagtgccaaagctcaagaccgtg

SEQ ID NO: 123958 - DNA, 25 bp, Mus musculus
taaagtggaatccaccccagagcct

SEQ ID NO: 123959 - DNA, 25 bp, Mus musculus
taaagtggcatcctctgcaggagtc

SEQ ID NO: 123960 - DNA, 25 bp, Mus musculus
taaagtgtagccaagcccttcaaga

SEQ ID NO: 123961 - DNA, 25 bp, Mus musculus
taaagtgtccaatgtctcctgcgag

SEQ ID NO: 123962 - DNA, 25 bp, Mus musculus
taaagtgtccctaatggatgtcaca

SEQ ID NO: 123963 - DNA, 25 bp, Mus musculus
taaagtgtgcggagaaggagaaaac

SEQ ID NO: 123964 - DNA, 25 bp, Mus musculus
taaagttaaccctggaagctcggtg

SEQ ID NO: 123965 - DNA, 25 bp, Mus musculus
taaagttaggtttcatgccagcagc

SEQ ID NO: 123966 - DNA, 25 bp, Mus musculus
taaagttatggtcccggaagctcct

SEQ ID NO: 123967 - DNA, 25 bp, Mus musculus
taaagttattttggcgacattcctc

SEQ ID NO: 123968 - DNA, 25 bp, Mus musculus
taaagttcagacctaccaagaagcc

SEQ ID NO: 123969 - DNA, 25 bp, Mus musculus
taaagttccagttcaccacacgtgg

SEQ ID NO: 123970 - DNA, 25 bp, Mus musculus
taaagttgaacttctccctagagcc

SEQ ID NO: 123971 - DNA, 25 bp, Mus musculus
taaagttgccatgccctgtagctcc

SEQ ID NO: 123972 - DNA, 25 bp, Mus musculus
taaagttgcgtcctccttaacctct

SEQ ID NO: 123973 - DNA, 25 bp, Mus musculus
taaagttgtggctgaaccgcaggca

SEQ ID NO: 123974 - DNA, 25 bp, Mus musculus
taaagtttatgaccccagagaagga

SEQ ID NO: 123975 - DNA, 25 bp, Mus musculus
taaagtttccacaaaggaccgcatg

SEQ ID NO: 123976 - DNA, 25 bp, Mus musculus
taaagtttgaccagaatcgtgtgcg

SEQ ID NO: 123977 - DNA, 25 bp, Mus musculus
taaagtttgcgttcccctcagagag

SEQ ID NO: 123978 - DNA, 25 bp, Mus musculus
taaagtttgctgtgcgggagcctct

SEQ ID NO: 123979 - DNA, 25 bp, Mus musculus
taaataaactgctgcgtgactccca

SEQ ID NO: 123980 - DNA, 25 bp, Mus musculus
taaataacctccttcctccaaggca

SEQ ID NO: 123981 - DNA, 25 bp, Mus musculus
taaataacgattcacctgggaggga

SEQ ID NO: 123982 - DNA, 25 bp, Mus musculus
taaataagcaccgagccgacaatcg

SEQ ID NO: 123983 - DNA, 25 bp, Mus musculus
taaataagctgaaggcataactgct

SEQ ID NO: 123984 - DNA, 25 bp, Mus musculus
taaataagggcagttcagggccctg

SEQ ID NO: 123985 - DNA, 25 bp, Mus musculus
taaatacactggcatccttgggcta

SEQ ID NO: 123986 - DNA, 25 bp, Mus musculus
taaatacagcacaggcaggaggcat

SEQ ID NO: 123987 - DNA, 25 bp, Mus musculus
taaataccccagttggcaaggatcc

SEQ ID NO: 123988 - DNA, 25 bp, Mus musculus
taaataccgttgatgtgttagccac

SEQ ID NO: 123989 - DNA, 25 bp, Mus musculus
taaatactaggcgtgagtcaggcct

SEQ ID NO: 123990 - DNA, 25 bp, Mus musculus
taaatactcggtcccgcggatgctc

SEQ ID NO: 123991 - DNA, 25 bp, Mus musculus
taaatactctgtatctgacgccgtg

SEQ ID NO: 123992 - DNA, 25 bp, Mus musculus
taaatactgcatagaaacctcaggc

SEQ ID NO: 123993 - DNA, 25 bp, Mus musculus
taaatactgttttgccgacacattc

SEQ ID NO: 123994 - DNA, 25 bp, Mus musculus
taaatagaggtatgtcgtgcgtcac

SEQ ID NO: 123995 - DNA, 25 bp, Mus musculus
taaatagccccgtggttccagtgcc

SEQ ID NO: 123996 - DNA, 25 bp, Mus musculus
taaataggatggctgttcacgaacc

SEQ ID NO: 123997 - DNA, 25 bp, Mus musculus
taaataggttcctcctttatgtggc

SEQ ID NO: 123998 - DNA, 25 bp, Mus musculus
taaatagttgcagaagggatacgtc

SEQ ID NO: 123999 - DNA, 25 bp, Mus musculus
taaatataaaagacatccaggcggg

SEQ ID NO: 124000 - DNA, 25 bp, Mus musculus
taaatataagctctccgttcctggg

SEQ ID NO: 124001 - DNA, 25 bp, Mus musculus
taaatatcacggacatcaaggctgc

SEQ ID NO: 124002 - DNA, 25 bp, Mus musculus
taaatatctgaagacccacgtggga

SEQ ID NO: 124003 - DNA, 25 bp, Mus musculus
taaatatgaatatggctatgccttc

SEQ ID NO: 124004 - DNA, 25 bp, Mus musculus
taaatatgcttgtctgttcacggaa

SEQ ID NO: 124005 - DNA, 25 bp, Mus musculus
taaatatggcaacgactcctaccgg

SEQ ID NO: 124006 - DNA, 25 bp, Mus musculus
taaatattccaatccggtggccgtc

SEQ ID NO: 124007 - DNA, 25 bp, Mus musculus
taaatattctctgaagagccaggct

SEQ ID NO: 124008 - DNA, 25 bp, Mus musculus
taaatcaaaattctggctgccagcc

SEQ ID NO: 124009 - DNA, 25 bp, Mus musculus
taaatcaccctgagctgcacatggt

SEQ ID NO: 124010 - DNA, 25 bp, Mus musculus
taaatcactatcgacggctcaggcg

SEQ ID NO: 124011 - DNA, 25 bp, Mus musculus
taaatcagcctgagttggttgcgca

SEQ ID NO: 124012 - DNA, 25 bp, Mus musculus
taaatcagcgagattcccttccggc

SEQ ID NO: 124013 - DNA, 25 bp, Mus musculus
taaatcaggacgagtggcacagtcg

SEQ ID NO: 124014 - DNA, 25 bp, Mus musculus
taaatcagggcagttactaggcgtg

SEQ ID NO: 124015 - DNA, 25 bp, Mus musculus
taaatcagtgactatagccccgcct

SEQ ID NO: 124016 - DNA, 25 bp, Mus musculus
taaatcattaccaggcagtaccgag

SEQ ID NO: 124017 - DNA, 25 bp, Mus musculus
taaatccaaatgagaccgtgcaggc

SEQ ID NO: 124018 - DNA, 25 bp, Mus musculus
taaatccagcaatgccagttggcct

SEQ ID NO: 124019 - DNA, 25 bp, Mus musculus
taaatccaggtccagatctgagcgg

SEQ ID NO: 124020 - DNA, 25 bp, Mus musculus
taaatccatcttgaagacgttgggc

SEQ ID NO: 124021 - DNA, 25 bp, Mus musculus
taaatccatggacagtctggtcagg

SEQ ID NO: 124022 - DNA, 25 bp, Mus musculus
taaatccattctgatgagacccggg

SEQ ID NO: 124023 - DNA, 25 bp, Mus musculus
taaatcccaaggcactctgaaagag

SEQ ID NO: 124024 - DNA, 25 bp, Mus musculus
taaatcccagatgaggtaccctagc

SEQ ID NO: 124025 - DNA, 25 bp, Mus musculus
taaatcccattcttagagaaaacct

SEQ ID NO: 124026 - DNA, 25 bp, Mus musculus
taaatccctccctgaagccttgagg

SEQ ID NO: 124027 - DNA, 25 bp, Mus musculus
taaatccgaggtgctgtgtggccac

SEQ ID NO: 124028 - DNA, 25 bp, Mus musculus
taaatcctacttggaacctggccag

SEQ ID NO: 124029 - DNA, 25 bp, Mus musculus
taaatcctgctaggcgtgaccgagg

SEQ ID NO: 124030 - DNA, 25 bp, Mus musculus
taaatcctgtcaagcaaacgggcgg

SEQ ID NO: 124031 - DNA, 25 bp, Mus musculus
taaatcgatggagcattgctgccgg

SEQ ID NO: 124032 - DNA, 25 bp, Mus musculus
taaatcgcaggctgcagtggagacc

SEQ ID NO: 124033 - DNA, 25 bp, Mus musculus
taaatcgcctccgtgagaccgagat

SEQ ID NO: 124034 - DNA, 25 bp, Mus musculus
taaatcggcccctgcgtatgtggat

SEQ ID NO: 124035 - DNA, 25 bp, Mus musculus
taaatctatccctgtggaccctgag

SEQ ID NO: 124036 - DNA, 25 bp, Mus musculus
taaatctcggagtgatcctgctgac

SEQ ID NO: 124037 - DNA, 25 bp, Mus musculus
taaatctctggcctcaacaggcaag

SEQ ID NO: 124038 - DNA, 25 bp, Mus musculus
taaatctgcctttccagggtgctga

SEQ ID NO: 124039 - DNA, 25 bp, Mus musculus
taaatcttagttggcagagagcctg

SEQ ID NO: 124040 - DNA, 25 bp, Mus musculus
taaatcttatcccagagcagggcgc

SEQ ID NO: 124041 - DNA, 25 bp, Mus musculus
taaatcttttccagtatacgtaata

SEQ ID NO: 124042 - DNA, 25 bp, Mus musculus
taaatgaaatcgtggagaccaacag

SEQ ID NO: 124043 - DNA, 25 bp, Mus musculus
taaatgaagacattccaccccgtcg

SEQ ID NO: 124044 - DNA, 25 bp, Mus musculus
taaatgaaggtgagcctcgcctagg

SEQ ID NO: 124045 - DNA, 25 bp, Mus musculus
taaatgaagtacaggcaagcgagca

SEQ ID NO: 124046 - DNA, 25 bp, Mus musculus
taaatgaatatcgaccccaccaagc

SEQ ID NO: 124047 - DNA, 25 bp, Mus musculus
taaatgaatgcgatgaggaccccaa

SEQ ID NO: 124048 - DNA, 25 bp, Mus musculus
taaatgaatgtgatgccagcaacca

SEQ ID NO: 124049 - DNA, 25 bp, Mus musculus
taaatgaccacaatgggaacccctc

SEQ ID NO: 124050 - DNA, 25 bp, Mus musculus
taaatgaccctcagcgcatggacag

SEQ ID NO: 124051 - DNA, 25 bp, Mus musculus
taaatgacggccactggtaggaacc

SEQ ID NO: 124052 - DNA, 25 bp, Mus musculus
taaatgacgttttcagccaccaagg

SEQ ID NO: 124053 - DNA, 25 bp, Mus musculus
taaatgactattaccctgaggagga

SEQ ID NO: 124054 - DNA, 25 bp, Mus musculus
taaatgactggttgggatagagacc

SEQ ID NO: 124055 - DNA, 25 bp, Mus musculus
taaatgacttgttcaaggccgcctg

SEQ ID NO: 124056 - DNA, 25 bp, Mus musculus
taaatgagaacagtgacacggtcgg

SEQ ID NO: 124057 - DNA, 25 bp, Mus musculus
taaatgagaccaagcgatcaggagt

SEQ ID NO: 124058 - DNA, 25 bp, Mus musculus
taaatgagctagttgtgggagacac

SEQ ID NO: 124059 - DNA, 25 bp, Mus musculus
taaatgaggatccagttagatgccc

SEQ ID NO: 124060 - DNA, 25 bp, Mus musculus
taaatgatgtgcactgccctgagcc

SEQ ID NO: 124061 - DNA, 25 bp, Mus musculus
taaatgcaaaaatcacagctgggct

SEQ ID NO: 124062 - DNA, 25 bp, Mus musculus
taaatgcaaaggtggttggaggtcc

SEQ ID NO: 124063 - DNA, 25 bp, Mus musculus
taaatgcaacggctacaggaactga

SEQ ID NO: 124064 - DNA, 25 bp, Mus musculus
taaatgcaaggtaactggaggccgt

SEQ ID NO: 124065 - DNA, 25 bp, Mus musculus
taaatgcaatgcctgcatcgggaca

SEQ ID NO: 124066 - DNA, 25 bp, Mus musculus
taaatgcacagagagcaggatacaa

SEQ ID NO: 124067 - DNA, 25 bp, Mus musculus
taaatgcaggcagagtgacctatct

SEQ ID NO: 124068 - DNA, 25 bp, Mus musculus
taaatgcagtgccagctcgcaggtg

SEQ ID NO: 124069 - DNA, 25 bp, Mus musculus
taaatgccaacctcacctagcagtg

SEQ ID NO: 124070 - DNA, 25 bp, Mus musculus
taaatgcccagacgtaatggtgatg

SEQ ID NO: 124071 - DNA, 25 bp, Mus musculus
taaatgccctgcctggtcacaccag

SEQ ID NO: 124072 - DNA, 25 bp, Mus musculus
taaatgccgatgtactgaagacagc

SEQ ID NO: 124073 - DNA, 25 bp, Mus musculus
taaatgccgtgcaaagtgtgtgatg

SEQ ID NO: 124074 - DNA, 25 bp, Mus musculus
taaatgcctcccacgaagatgcagg

SEQ ID NO: 124075 - DNA, 25 bp, Mus musculus
taaatgccttgagggacttgctccc

SEQ ID NO: 124076 - DNA, 25 bp, Mus musculus
taaatgcgctgttagaactgtgccc

SEQ ID NO: 124077 - DNA, 25 bp, Mus musculus
taaatgctccatggatgaaacccac

SEQ ID NO: 124078 - DNA, 25 bp, Mus musculus
taaatgctctctcatagagtcaggc

SEQ ID NO: 124079 - DNA, 25 bp, Mus musculus
taaatgctgctcagaacaccacgga

SEQ ID NO: 124080 - DNA, 25 bp, Mus musculus
taaatgctgctccaagaatcgctct

SEQ ID NO: 124081 - DNA, 25 bp, Mus musculus
taaatggaatccacccttgggagct

SEQ ID NO: 124082 - DNA, 25 bp, Mus musculus
taaatggacaactaatgccctctga

SEQ ID NO: 124083 - DNA, 25 bp, Mus musculus
taaatggacatgtccatactgccgg

SEQ ID NO: 124084 - DNA, 25 bp, Mus musculus
taaatggacatttaatcggacagcg

SEQ ID NO: 124085 - DNA, 25 bp, Mus musculus
taaatggaccggtgtgatagcgctt

SEQ ID NO: 124086 - DNA, 25 bp, Mus musculus
taaatggactctgacatggactacg

SEQ ID NO: 124087 - DNA, 25 bp, Mus musculus
taaatggagaatcatcagccctacg

SEQ ID NO: 124088 - DNA, 25 bp, Mus musculus
taaatggagggctgaagttgaaccc

SEQ ID NO: 124089 - DNA, 25 bp, Mus musculus
taaatggatgacttgacctgtgacc

SEQ ID NO: 124090 - DNA, 25 bp, Mus musculus
taaatggcacagcagttcctcagca

SEQ ID NO: 124091 - DNA, 25 bp, Mus musculus
taaatggcagatctacaaagaaacc

SEQ ID NO: 124092 - DNA, 25 bp, Mus musculus
taaatggcgcaactagaggctatca

SEQ ID NO: 124093 - DNA, 25 bp, Mus musculus
taaatggctacctgtatgtgcacct

SEQ ID NO: 124094 - DNA, 25 bp, Mus musculus
taaatggctcatcccagacagtgcg

SEQ ID NO: 124095 - DNA, 25 bp, Mus musculus
taaatggctcctgggcagaatcgag

SEQ ID NO: 124096 - DNA, 25 bp, Mus musculus
taaatgggtcccgagccttatgtcc

SEQ ID NO: 124097 - DNA, 25 bp, Mus musculus
taaatgggtcctaactcaggtggcc

SEQ ID NO: 124098 - DNA, 25 bp, Mus musculus
taaatggtacattccgctcacggac

SEQ ID NO: 124099 - DNA, 25 bp, Mus musculus
taaatggtccaactagcgcttctgg

SEQ ID NO: 124100 - DNA, 25 bp, Mus musculus
taaatggtccattgcagagcctgag

SEQ ID NO: 124101 - DNA, 25 bp, Mus musculus
taaatggtgtcactgcagcactggc

SEQ ID NO: 124102 - DNA, 25 bp, Mus musculus
taaatggttaatctctgcaggtcac

SEQ ID NO: 124103 - DNA, 25 bp, Mus musculus
taaatggttcatctgcagcacatgg

SEQ ID NO: 124104 - DNA, 25 bp, Mus musculus
taaatggttgcaagccgacaaagct

SEQ ID NO: 124105 - DNA, 25 bp, Mus musculus
taaatggttgtctggcaacgtgccc

SEQ ID NO: 124106 - DNA, 25 bp, Mus musculus
taaatgtaaaagtccagagctgccc

SEQ ID NO: 124107 - DNA, 25 bp, Mus musculus
taaatgtaacggacatgccagcgag

SEQ ID NO: 124108 - DNA, 25 bp, Mus musculus
taaatgtagtacctgtgagaagacc

SEQ ID NO: 124109 - DNA, 25 bp, Mus musculus
taaatgtagtacttgcgaaaaagcc

SEQ ID NO: 124110 - DNA, 25 bp, Mus musculus
taaatgtatgcctgaatagtatgcc

SEQ ID NO: 124111 - DNA, 25 bp, Mus musculus
taaatgtcaacagtgtactaaggcc

SEQ ID NO: 124112 - DNA, 25 bp, Mus musculus
taaatgtcagcctaattacacgaga

SEQ ID NO: 124113 - DNA, 25 bp, Mus musculus
taaatgtccaagaaacacttttgtc

SEQ ID NO: 124114 - DNA, 25 bp, Mus musculus
taaatgtccccgtaggctcatgcct

SEQ ID NO: 124115 - DNA, 25 bp, Mus musculus
taaatgtcgtttggctcctgggcag

SEQ ID NO: 124116 - DNA, 25 bp, Mus musculus
taaatgtctgcagagttgctgccct

SEQ ID NO: 124117 - DNA, 25 bp, Mus musculus
taaatgtgaaagacatcctccgagc

SEQ ID NO: 124118 - DNA, 25 bp, Mus musculus
taaatgtgaagtgtgcttgcggacc

SEQ ID NO: 124119 - DNA, 25 bp, Mus musculus
taaatgtgaattcaagggctccctg

SEQ ID NO: 124120 - DNA, 25 bp, Mus musculus
taaatgtgcacatctgcgatagccc

SEQ ID NO: 124121 - DNA, 25 bp, Mus musculus
taaatgtgcgactgaaacctaggcc

SEQ ID NO: 124122 - DNA, 25 bp, Mus musculus
taaatgtggtcaacagtgtcagcag

SEQ ID NO: 124123 - DNA, 25 bp, Mus musculus
taaatgtgttgcctcgaatccacgg

SEQ ID NO: 124124 - DNA, 25 bp, Mus musculus
taaatgttactatgtccccaactgg

SEQ ID NO: 124125 - DNA, 25 bp, Mus musculus
taaatgttaggaggctctggcagcc

SEQ ID NO: 124126 - DNA, 25 bp, Mus musculus
taaatgttcatagctagatggccag

SEQ ID NO: 124127 - DNA, 25 bp, Mus musculus
taaatgttcattttaccttgataac

SEQ ID NO: 124128 - DNA, 25 bp, Mus musculus
taaatgttcgcaagagcgtgctgct

SEQ ID NO: 124129 - DNA, 25 bp, Mus musculus
taaatgttgatgacggtctggctgc

SEQ ID NO: 124130 - DNA, 25 bp, Mus musculus
taaatgttggtcctgaccgaaccag

SEQ ID NO: 124131 - DNA, 25 bp, Mus musculus
taaatgtttcaacctcaagctggga

SEQ ID NO: 124132 - DNA, 25 bp, Mus musculus
taaatgtttctaggatgcagtacac

SEQ ID NO: 124133 - DNA, 25 bp, Mus musculus
taaattaatgcttcgcgcttgaggg

SEQ ID NO: 124134 - DNA, 25 bp, Mus musculus
taaattaccaggtgctctacagggc

SEQ ID NO: 124135 - DNA, 25 bp, Mus musculus
taaattatgaagacctggcagcccg

SEQ ID NO: 124136 - DNA, 25 bp, Mus musculus
taaattatgactagtaagccacgga

SEQ ID NO: 124137 - DNA, 25 bp, Mus musculus
taaattcaagatggaggcgctttcc

SEQ ID NO: 124138 - DNA, 25 bp, Mus musculus
taaattcacctgcatcgaggcccga

SEQ ID NO: 124139 - DNA, 25 bp, Mus musculus
taaattcactgggtcagagctggcc

SEQ ID NO: 124140 - DNA, 25 bp, Mus musculus
taaattcattcatgagtgccgactc

SEQ ID NO: 124141 - DNA, 25 bp, Mus musculus
taaattccagcgaaacaagactagc

SEQ ID NO: 124142 - DNA, 25 bp, Mus musculus
taaattcccaaagctcacgatcatg

SEQ ID NO: 124143 - DNA, 25 bp, Mus musculus
taaattcggttactggcacgagcgc

SEQ ID NO: 124144 - DNA, 25 bp, Mus musculus
taaattcgtcattcgaacgcctagg

SEQ ID NO: 124145 - DNA, 25 bp, Mus musculus
taaattctctgaaccaggctgtggt

SEQ ID NO: 124146 - DNA, 25 bp, Mus musculus
taaattctggaaaagaagcggcacc

SEQ ID NO: 124147 - DNA, 25 bp, Mus musculus
taaattctgtggtagaacgccagga

SEQ ID NO: 124148 - DNA, 25 bp, Mus musculus
taaattgagacaagtccccagtgct

SEQ ID NO: 124149 - DNA, 25 bp, Mus musculus
taaattgcaccacacaagtagcagt

SEQ ID NO: 124150 - DNA, 25 bp, Mus musculus
taaattgcagcatcaccggatagca

SEQ ID NO: 124151 - DNA, 25 bp, Mus musculus
taaattgcctactgaccagcgattg

SEQ ID NO: 124152 - DNA, 25 bp, Mus musculus
taaattggtctccagacagcctggc

SEQ ID NO: 124153 - DNA, 25 bp, Mus musculus
taaattgtggccatggaagaaccct

SEQ ID NO: 124154 - DNA, 25 bp, Mus musculus
taaattgttgctgaaatccgtgaag

SEQ ID NO: 124155 - DNA, 25 bp, Mus musculus
taaatttaatgtgaaccgagtggac

SEQ ID NO: 124156 - DNA, 25 bp, Mus musculus
taaatttagtagttgccggagcacc

SEQ ID NO: 124157 - DNA, 25 bp, Mus musculus
taaatttattcatggccaacacagc

SEQ ID NO: 124158 - DNA, 25 bp, Mus musculus
taaatttcaacacctggataagaga

SEQ ID NO: 124159 - DNA, 25 bp, Mus musculus
taaatttggaggttataaagccttg

SEQ ID NO: 124160 - DNA, 25 bp, Mus musculus
taaattttccatcgtttgctgtccg

SEQ ID NO: 124161 - DNA, 25 bp, Mus musculus
taacaaaaggatagtgagcggagcc

SEQ ID NO: 124162 - DNA, 25 bp, Mus musculus
taacaaacggctacagaactggaca

SEQ ID NO: 124163 - DNA, 25 bp, Mus musculus
taacaaactgcgaaacctcctgaag

SEQ ID NO: 124164 - DNA, 25 bp, Mus musculus
taacaaactggaccgaatgggctct

SEQ ID NO: 124165 - DNA, 25 bp, Mus musculus
taacaaagcacatggaatcttgcag

SEQ ID NO: 124166 - DNA, 25 bp, Mus musculus
taacaaagtacgagtggccctggag

SEQ ID NO: 124167 - DNA, 25 bp, Mus musculus
taacaaatacaacttctcctttgat

SEQ ID NO: 124168 - DNA, 25 bp, Mus musculus
taacaaatctaagcggcccagaggg

SEQ ID NO: 124169 - DNA, 25 bp, Mus musculus
taacaacaaagccatgcaggaccgt

SEQ ID NO: 124170 - DNA, 25 bp, Mus musculus
taacaacagccgcttctggaacggt

SEQ ID NO: 124171 - DNA, 25 bp, Mus musculus
taacaacaggactgccaatcagggc

SEQ ID NO: 124172 - DNA, 25 bp, Mus musculus
taacaacatgcacactctgggagcc

SEQ ID NO: 124173 - DNA, 25 bp, Mus musculus
taacaacatgttgaggcggatccag

SEQ ID NO: 124174 - DNA, 25 bp, Mus musculus
taacaaccattctgtagccgaagcc

SEQ ID NO: 124175 - DNA, 25 bp, Mus musculus
taacaaccccagctatgttcggagt

SEQ ID NO: 124176 - DNA, 25 bp, Mus musculus
taacaaccccttggagtgcgactgc

SEQ ID NO: 124177 - DNA, 25 bp, Mus musculus
taacaacggcaagaagctcatgact

SEQ ID NO: 124178 - DNA, 25 bp, Mus musculus
taacaactgcaggtgctcagaccac

SEQ ID NO: 124179 - DNA, 25 bp, Mus musculus
taacaactgtatcacggtccgggct

SEQ ID NO: 124180 - DNA, 25 bp, Mus musculus
taacaagaaatgctggccccgagat

SEQ ID NO: 124181 - DNA, 25 bp, Mus musculus
taacaagagttgcataggaccaggg

SEQ ID NO: 124182 - DNA, 25 bp, Mus musculus
taacaagatcctcaaagccctgcag

SEQ ID NO: 124183 - DNA, 25 bp, Mus musculus
taacaagcaggtggccacaagctct

SEQ ID NO: 124184 - DNA, 25 bp, Mus musculus
taacaagcccgagtgtgtacgcgct

SEQ ID NO: 124185 - DNA, 25 bp, Mus musculus
taacaagccgcccatctggaatgaa

SEQ ID NO: 124186 - DNA, 25 bp, Mus musculus
taacaagctcaccatacaaacctgt

SEQ ID NO: 124187 - DNA, 25 bp, Mus musculus
taacaagcttagtgccagtggaacc

SEQ ID NO: 124188 - DNA, 25 bp, Mus musculus
taacaaggacaacctcttcggtggc

SEQ ID NO: 124189 - DNA, 25 bp, Mus musculus
taacaaggccgtcaggaaacaatgg

SEQ ID NO: 124190 - DNA, 25 bp, Mus musculus
taacaaggttgatgtgcatgcccaa

SEQ ID NO: 124191 - DNA, 25 bp, Mus musculus
taacaagtataaagtttccagcccg

SEQ ID NO: 124192 - DNA, 25 bp, Mus musculus
taacaagtatcaagaccagcgtcag

SEQ ID NO: 124193 - DNA, 25 bp, Mus musculus
taacaagtcccgactccggaagatg

SEQ ID NO: 124194 - DNA, 25 bp, Mus musculus
taacaagtgacaaagtaggccaggc

SEQ ID NO: 124195 - DNA, 25 bp, Mus musculus
taacaagttgacacatacggacctc

SEQ ID NO: 124196 - DNA, 25 bp, Mus musculus
taacaagttggcgacgtctctgggc

SEQ ID NO: 124197 - DNA, 25 bp, Mus musculus
taacaagtttacaggacaaagcagc

SEQ ID NO: 124198 - DNA, 25 bp, Mus musculus
taacaatacagaggagcgagctagt

SEQ ID NO: 124199 - DNA, 25 bp, Mus musculus
taacaataggaagtgctggcaagac

SEQ ID NO: 124200 - DNA, 25 bp, Mus musculus
taacaatcaagagaattattggcca

SEQ ID NO: 124201 - DNA, 25 bp, Mus musculus
taacaatcacttcctgccatgggct

SEQ ID NO: 124202 - DNA, 25 bp, Mus musculus
taacaatgcaaaggcctactataag

SEQ ID NO: 124203 - DNA, 25 bp, Mus musculus
taacaatgtcatagtccctgagtcc

SEQ ID NO: 124204 - DNA, 25 bp, Mus musculus
taacaatgtccttggtgaatacgag

SEQ ID NO: 124205 - DNA, 25 bp, Mus musculus
taacaatgttgccatcgtgaggaca

SEQ ID NO: 124206 - DNA, 25 bp, Mus musculus
taacaattttggtgaactccaggag

SEQ ID NO: 124207 - DNA, 25 bp, Mus musculus
taacacacattgagaagcgctacgg

SEQ ID NO: 124208 - DNA, 25 bp, Mus musculus
taacacaccggcctgtggagaaaga

SEQ ID NO: 124209 - DNA, 25 bp, Mus musculus
taacacactggatgcgtggcttgcc

SEQ ID NO: 124210 - DNA, 25 bp, Mus musculus
taacacagatgctgcaacaagcggc

SEQ ID NO: 124211 - DNA, 25 bp, Mus musculus
taacacagcaggtgcatgggagtcg

SEQ ID NO: 124212 - DNA, 25 bp, Mus musculus
taacacagcagtagtgaaaaccgtc

SEQ ID NO: 124213 - DNA, 25 bp, Mus musculus
taacacatacacacaaggatttgga

SEQ ID NO: 124214 - DNA, 25 bp, Mus musculus
taacacatagacctccaagtgcagg

SEQ ID NO: 124215 - DNA, 25 bp, Mus musculus
taacacatcattgtctccttgtaga

SEQ ID NO: 124216 - DNA, 25 bp, Mus musculus
taacacatgtgtcagagctcccatg

SEQ ID NO: 124217 - DNA, 25 bp, Mus musculus
taacaccaagccagtgagcctgtcg

SEQ ID NO: 124218 - DNA, 25 bp, Mus musculus
taacaccagagcgtatcatcagagt

SEQ ID NO: 124219 - DNA, 25 bp, Mus musculus
taacaccagggtggcgttttccagc

SEQ ID NO: 124220 - DNA, 25 bp, Mus musculus
taacacctcttagggaaggaatcac

SEQ ID NO: 124221 - DNA, 25 bp, Mus musculus
taacacctgtaaggcctgctgcagc

SEQ ID NO: 124222 - DNA, 25 bp, Mus musculus
taacacctgtgacatcacgtgtgcg

SEQ ID NO: 124223 - DNA, 25 bp, Mus musculus
taacacggaggtagcccaatggctc

SEQ ID NO: 124224 - DNA, 25 bp, Mus musculus
taacacggcccgatactgtggctct

SEQ ID NO: 124225 - DNA, 25 bp, Mus musculus
taacacggctggtttctactgcgac

SEQ ID NO: 124226 - DNA, 25 bp, Mus musculus
taacacggtagcacagtccatggaa

SEQ ID NO: 124227 - DNA, 25 bp, Mus musculus
taacacgtacggaaggatcaccaag

SEQ ID NO: 124228 - DNA, 25 bp, Mus musculus
taacacgtggttactacagagacag

SEQ ID NO: 124229 - DNA, 25 bp, Mus musculus
taacacgttcccaatactcctgcga

SEQ ID NO: 124230 - DNA, 25 bp, Mus musculus
taacactaaacataggccagcaagt

SEQ ID NO: 124231 - DNA, 25 bp, Mus musculus
taacactaaagacttgaagaccggc

SEQ ID NO: 124232 - DNA, 25 bp, Mus musculus
taacactgtacctggcagctacggg

SEQ ID NO: 124233 - DNA, 25 bp, Mus musculus
taacacttcttatcaggaaccctga

SEQ ID NO: 124234 - DNA, 25 bp, Mus musculus
taacacttggatggctacagagaac

SEQ ID NO: 124235 - DNA, 25 bp, Mus musculus
taacagaaaccaaattgggagcttg

SEQ ID NO: 124236 - DNA, 25 bp, Mus musculus
taacagaagacagcgaggtggactt

SEQ ID NO: 124237 - DNA, 25 bp, Mus musculus
taacagacaacagagtgggtcacct

SEQ ID NO: 124238 - DNA, 25 bp, Mus musculus
taacagacagccacaaccgaagtgt

SEQ ID NO: 124239 - DNA, 25 bp, Mus musculus
taacagacgccctggaaaatatcag

SEQ ID NO: 124240 - DNA, 25 bp, Mus musculus
taacagacgctagtgctgcatctct

SEQ ID NO: 124241 - DNA, 25 bp, Mus musculus
taacagaggcgaacatacaagtggc

SEQ ID NO: 124242 - DNA, 25 bp, Mus musculus
taacagagtcagctggtcgacaaca

SEQ ID NO: 124243 - DNA, 25 bp, Mus musculus
taacagagttgctgggacttcgaca

SEQ ID NO: 124244 - DNA, 25 bp, Mus musculus
taacagatcgggtgaaccgtggccg

SEQ ID NO: 124245 - DNA, 25 bp, Mus musculus
taacagatgaaccagagactccaag

SEQ ID NO: 124246 - DNA, 25 bp, Mus musculus
taacagatgcgggtaaaagatccat

SEQ ID NO: 124247 - DNA, 25 bp, Mus musculus
taacagcacctctagtcgggaagcc

SEQ ID NO: 124248 - DNA, 25 bp, Mus musculus
taacagcagcatctctagcaagctg

SEQ ID NO: 124249 - DNA, 25 bp, Mus musculus
taacagcatagggtcatttcaagca

SEQ ID NO: 124250 - DNA, 25 bp, Mus musculus
taacagcatccaaattccgagcagc

SEQ ID NO: 124251 - DNA, 25 bp, Mus musculus
taacagccttaactgagcagcagca

SEQ ID NO: 124252 - DNA, 25 bp, Mus musculus
taacagcgtcttgggcctaactcag

SEQ ID NO: 124253 - DNA, 25 bp, Mus musculus
taacagcgttgacccggagaacatc

SEQ ID NO: 124254 - DNA, 25 bp, Mus musculus
taacagctactggtttcagccacgt

SEQ ID NO: 124255 - DNA, 25 bp, Mus musculus
taacagctcactcggagatgggccg

SEQ ID NO: 124256 - DNA, 25 bp, Mus musculus
taacagctgaaatagcaagtcttga

SEQ ID NO: 124257 - DNA, 25 bp, Mus musculus
taacagctgcattgggtagcctgct

SEQ ID NO: 124258 - DNA, 25 bp, Mus musculus
taacagctggctctggtttcgacgc

SEQ ID NO: 124259 - DNA, 25 bp, Mus musculus
taacaggaagcgtgaatcggacagg

SEQ ID NO: 124260 - DNA, 25 bp, Mus musculus
taacaggacctgatggatcccctgg

SEQ ID NO: 124261 - DNA, 25 bp, Mus musculus
taacaggagtgtgctgtacagccac

SEQ ID NO: 124262 - DNA, 25 bp, Mus musculus
taacaggcagttagatcaggcggtg

SEQ ID NO: 124263 - DNA, 25 bp, Mus musculus
taacaggcatctctccaaatgaagg

SEQ ID NO: 124264 - DNA, 25 bp, Mus musculus
taacaggccactgattagcctcaca

SEQ ID NO: 124265 - DNA, 25 bp, Mus musculus
taacaggctcgtaccatatatgcaa

SEQ ID NO: 124266 - DNA, 25 bp, Mus musculus
taacaggctgttcaagctcgccagt

SEQ ID NO: 124267 - DNA, 25 bp, Mus musculus
taacagggagctaaatgcagttctg

SEQ ID NO: 124268 - DNA, 25 bp, Mus musculus
taacagggcaagatattcacggaac

SEQ ID NO: 124269 - DNA, 25 bp, Mus musculus
taacagggcttcagagtctagagcc

SEQ ID NO: 124270 - DNA, 25 bp, Mus musculus
taacaggtttccttaggcccagcac

SEQ ID NO: 124271 - DNA, 25 bp, Mus musculus
taacagtagcatgttctcaagggca

SEQ ID NO: 124272 - DNA, 25 bp, Mus musculus
taacagtcacagtttctaagtggca

SEQ ID NO: 124273 - DNA, 25 bp, Mus musculus
taacagtccagattgtgtgctcact

SEQ ID NO: 124274 - DNA, 25 bp, Mus musculus
taacagtgagccagttgtccaagac

SEQ ID NO: 124275 - DNA, 25 bp, Mus musculus
taacagtgatgtcatggccagcgac

SEQ ID NO: 124276 - DNA, 25 bp, Mus musculus
taacagtgatttcagacccggaagg

SEQ ID NO: 124277 - DNA, 25 bp, Mus musculus
taacagtgcccaccaatgagtgtct

SEQ ID NO: 124278 - DNA, 25 bp, Mus musculus
taacagtggacagcctgagaggaag

SEQ ID NO: 124279 - DNA, 25 bp, Mus musculus
taacagtgtctagtgttgctccgcc

SEQ ID NO: 124280 - DNA, 25 bp, Mus musculus
taacagttacccctcgatgagtgat

SEQ ID NO: 124281 - DNA, 25 bp, Mus musculus
taacagttagtttctgcctgtgggc

SEQ ID NO: 124282 - DNA, 25 bp, Mus musculus
taacagttggaggataatgcaaagg

SEQ ID NO: 124283 - DNA, 25 bp, Mus musculus
taacagtttgcatcgaccacgcagc

SEQ ID NO: 124284 - DNA, 25 bp, Mus musculus
taacagtttgtgtgagcctgagcag

SEQ ID NO: 124285 - DNA, 25 bp, Mus musculus
taacatacagctgcttaccgacagg

SEQ ID NO: 124286 - DNA, 25 bp, Mus musculus
taacataccttcgtgtggaccaaaa

SEQ ID NO: 124287 - DNA, 25 bp, Mus musculus
taacatagaagaactggtgggccca

SEQ ID NO: 124288 - DNA, 25 bp, Mus musculus
taacatagcagtatacagcccagtg

SEQ ID NO: 124289 - DNA, 25 bp, Mus musculus
taacataggcttctcagattctgga

SEQ ID NO: 124290 - DNA, 25 bp, Mus musculus
taacatagtcattccctcggtggga

SEQ ID NO: 124291 - DNA, 25 bp, Mus musculus
taacatatgtattccagacctctgg

SEQ ID NO: 124292 - DNA, 25 bp, Mus musculus
taacatcaaactggccaagtgtctg

SEQ ID NO: 124293 - DNA, 25 bp, Mus musculus
taacatcagcattacgctcattgag

SEQ ID NO: 124294 - DNA, 25 bp, Mus musculus
taacatcaggcagatcaaccaggag

SEQ ID NO: 124295 - DNA, 25 bp, Mus musculus
taacatccggaatcaggcgcacatg

SEQ ID NO: 124296 - DNA, 25 bp, Mus musculus
taacatcgtcaagtgtcaggccctg

SEQ ID NO: 124297 - DNA, 25 bp, Mus musculus
taacatcgtggtctgggacctgcag

SEQ ID NO: 124298 - DNA, 25 bp, Mus musculus
taacatctctgcaacaggagggtga

SEQ ID NO: 124299 - DNA, 25 bp, Mus musculus
taacatctgatgctaacgttctgac

SEQ ID NO: 124300 - DNA, 25 bp, Mus musculus
taacatcttcagaggcatcttggag

SEQ ID NO: 124301 - DNA, 25 bp, Mus musculus
taacatcttctttgactacagtggg

SEQ ID NO: 124302 - DNA, 25 bp, Mus musculus
taacatctttgcgtgcatcgagggc

SEQ ID NO: 124303 - DNA, 25 bp, Mus musculus
taacatgaaacagtacgcaagcccc

SEQ ID NO: 124304 - DNA, 25 bp, Mus musculus
taacatgaccaataagcgtgaggct

SEQ ID NO: 124305 - DNA, 25 bp, Mus musculus
taacatgacggtgaatgagtgcttc

SEQ ID NO: 124306 - DNA, 25 bp, Mus musculus
taacatgatggcactgcctggaggc

SEQ ID NO: 124307 - DNA, 25 bp, Mus musculus
taacatgattgtgtctggcagtgcc

SEQ ID NO: 124308 - DNA, 25 bp, Mus musculus
taacatgcagaaagcccgagagctc

SEQ ID NO: 124309 - DNA, 25 bp, Mus musculus
taacatgcctttgctccccttaaaa

SEQ ID NO: 124310 - DNA, 25 bp, Mus musculus
taacatggagatggtcaaagccctc

SEQ ID NO: 124311 - DNA, 25 bp, Mus musculus
taacatggagggagggtcaaaacct

SEQ ID NO: 124312 - DNA, 25 bp, Mus musculus
taacatggccactaggagggtttgg

SEQ ID NO: 124313 - DNA, 25 bp, Mus musculus
taacatgggcatctcctaaggaaat

SEQ ID NO: 124314 - DNA, 25 bp, Mus musculus
taacatggtcctgaggagtgccagc

SEQ ID NO: 124315 - DNA, 25 bp, Mus musculus
taacatggtgtagatgctgcggcct

SEQ ID NO: 124316 - DNA, 25 bp, Mus musculus
taacatgtatagcatgagccccgag

SEQ ID NO: 124317 - DNA, 25 bp, Mus musculus
taacatgtgctggaatggcccgtga

SEQ ID NO: 124318 - DNA, 25 bp, Mus musculus
taacattagctagtccgtggcctga

SEQ ID NO: 124319 - DNA, 25 bp, Mus musculus
taacattagggccatgctgaacagc

SEQ ID NO: 124320 - DNA, 25 bp, Mus musculus
taacattcagtacaaagtctccaga

SEQ ID NO: 124321 - DNA, 25 bp, Mus musculus
taacattcctcagatgtctgcggcg

SEQ ID NO: 124322 - DNA, 25 bp, Mus musculus
taacattccttactgggccatcaag

SEQ ID NO: 124323 - DNA, 25 bp, Mus musculus
taacattcttcccaaggacgtggcc

SEQ ID NO: 124324 - DNA, 25 bp, Mus musculus
taacattgacccgtgtgctaagggc

SEQ ID NO: 124325 - DNA, 25 bp, Mus musculus
taacatttggagaagctgccgcaag

SEQ ID NO: 124326 - DNA, 25 bp, Mus musculus
taacatttgggtagtgcgttgccca

SEQ ID NO: 124327 - DNA, 25 bp, Mus musculus
taaccaaaagaaagaagccctgctg

SEQ ID NO: 124328 - DNA, 25 bp, Mus musculus
taaccaaacaggaggaccgactcaa

SEQ ID NO: 124329 - DNA, 25 bp, Mus musculus
taaccaaagtggcatgctgaattcg

SEQ ID NO: 124330 - DNA, 25 bp, Mus musculus
taaccaaattctggagaggcagacg

SEQ ID NO: 124331 - DNA, 25 bp, Mus musculus
taaccaacgccgctcctggatgaaa

SEQ ID NO: 124332 - DNA, 25 bp, Mus musculus
taaccaacggaagtaggaagcatgt

SEQ ID NO: 124333 - DNA, 25 bp, Mus musculus
taaccaacgggaaagagcaggtgat

SEQ ID NO: 124334 - DNA, 25 bp, Mus musculus
taaccaactgaacgtggaagacgct

SEQ ID NO: 124335 - DNA, 25 bp, Mus musculus
taaccaagacagaagcgaagcaaga

SEQ ID NO: 124336 - DNA, 25 bp, Mus musculus
taaccaagctgtggaccctcgtgag

SEQ ID NO: 124337 - DNA, 25 bp, Mus musculus
taaccaatctgtgcgtgatcggcgg

SEQ ID NO: 124338 - DNA, 25 bp, Mus musculus
taaccacagaagaactgcgagacag

SEQ ID NO: 124339 - DNA, 25 bp, Mus musculus
taaccaccacggctgtagagcgagt

SEQ ID NO: 124340 - DNA, 25 bp, Mus musculus
taaccacctgatgagtttaccggag

SEQ ID NO: 124341 - DNA, 25 bp, Mus musculus
taaccacgcaggttgtacaggacgc

SEQ ID NO: 124342 - DNA, 25 bp, Mus musculus
taaccacgggaacctgtatcggagc

SEQ ID NO: 124343 - DNA, 25 bp, Mus musculus
taaccacgggaggtacagcggagat

SEQ ID NO: 124344 - DNA, 25 bp, Mus musculus
taaccacgggtttcagtcgcatgag

SEQ ID NO: 124345 - DNA, 25 bp, Mus musculus
taaccactgcattcttcagggacgc

SEQ ID NO: 124346 - DNA, 25 bp, Mus musculus
taaccagagatggaagacccggcta

SEQ ID NO: 124347 - DNA, 25 bp, Mus musculus
taaccagagtttttccagtcagcct

SEQ ID NO: 124348 - DNA, 25 bp, Mus musculus
taaccagatccagcagttacagcag

SEQ ID NO: 124349 - DNA, 25 bp, Mus musculus
taaccagattgcagaaattccccag

SEQ ID NO: 124350 - DNA, 25 bp, Mus musculus
taaccagccgttttgtgatgccgtg

SEQ ID NO: 124351 - DNA, 25 bp, Mus musculus
taaccagcgaatgtggaagacctcg

SEQ ID NO: 124352 - DNA, 25 bp, Mus musculus
taaccagctatagtgagaagaggcc

SEQ ID NO: 124353 - DNA, 25 bp, Mus musculus
taaccagctggctctagtggaggag

SEQ ID NO: 124354 - DNA, 25 bp, Mus musculus
taaccaggaggcatacgttggcggt

SEQ ID NO: 124355 - DNA, 25 bp, Mus musculus
taaccaggtcgtatttgtcggcaat

SEQ ID NO: 124356 - DNA, 25 bp, Mus musculus
taaccagtctgggactcagcaaaag

SEQ ID NO: 124357 - DNA, 25 bp, Mus musculus
taaccagtggctgtttgagttccca

SEQ ID NO: 124358 - DNA, 25 bp, Mus musculus
taaccatcagccgagtggaaggaag

SEQ ID NO: 124359 - DNA, 25 bp, Mus musculus
taaccatcctctgtgtgagacggga

SEQ ID NO: 124360 - DNA, 25 bp, Mus musculus
taaccatctatgtctgccaggagca

SEQ ID NO: 124361 - DNA, 25 bp, Mus musculus
taaccatgataagctgaagtcgcgt

SEQ ID NO: 124362 - DNA, 25 bp, Mus musculus
taaccatgatggatgaggcctacgt

SEQ ID NO: 124363 - DNA, 25 bp, Mus musculus
taaccatggaggactggtctggccg

SEQ ID NO: 124364 - DNA, 25 bp, Mus musculus
taaccatggcagattcccccggctg

SEQ ID NO: 124365 - DNA, 25 bp, Mus musculus
taaccatggtaggtgcccgaagcat

SEQ ID NO: 124366 - DNA, 25 bp, Mus musculus
taaccattacagcaagcccactaat

SEQ ID NO: 124367 - DNA, 25 bp, Mus musculus
taaccattactaacgatggtgccac

SEQ ID NO: 124368 - DNA, 25 bp, Mus musculus
taaccattgcagtacctgacaaggc

SEQ ID NO: 124369 - DNA, 25 bp, Mus musculus
taacccaaatgcaggtccttgccgc

SEQ ID NO: 124370 - DNA, 25 bp, Mus musculus
taacccagaataaggcaagctatgc

SEQ ID NO: 124371 - DNA, 25 bp, Mus musculus
taacccagaggcacttcaggctgag

SEQ ID NO: 124372 - DNA, 25 bp, Mus musculus
taacccagatatggaacatgctgcc

SEQ ID NO: 124373 - DNA, 25 bp, Mus musculus
taacccagctcaactcggtgcagag

SEQ ID NO: 124374 - DNA, 25 bp, Mus musculus
taacccagctgattatgcagagcca

SEQ ID NO: 124375 - DNA, 25 bp, Mus musculus
taacccagctttactatgaaggcgt

SEQ ID NO: 124376 - DNA, 25 bp, Mus musculus
taacccagggaggaaggcatctact

SEQ ID NO: 124377 - DNA, 25 bp, Mus musculus
taacccagggcacttataaaggacg

SEQ ID NO: 124378 - DNA, 25 bp, Mus musculus
taacccatccttttaatcaaaatgg

SEQ ID NO: 124379 - DNA, 25 bp, Mus musculus
taacccatgaggctggaatcactga

SEQ ID NO: 124380 - DNA, 25 bp, Mus musculus
taacccatgataaaactgaggagag

SEQ ID NO: 124381 - DNA, 25 bp, Mus musculus
taacccatgcgagaacgatggcgtc

SEQ ID NO: 124382 - DNA, 25 bp, Mus musculus
taacccatggtagcgtgtgtgtgtg

SEQ ID NO: 124383 - DNA, 25 bp, Mus musculus
taacccattatatccgtggcggaga

SEQ ID NO: 124384 - DNA, 25 bp, Mus musculus
taacccatttctatatcgtcaaagg

SEQ ID NO: 124385 - DNA, 25 bp, Mus musculus
taaccccaatcgtgagagagtacca

SEQ ID NO: 124386 - DNA, 25 bp, Mus musculus
taaccccaattctgctgcatgggaa

SEQ ID NO: 124387 - DNA, 25 bp, Mus musculus
taaccccacgggaaatctgtgacaa

SEQ ID NO: 124388 - DNA, 25 bp, Mus musculus
taaccccagaggacgtgaaagacgc

SEQ ID NO: 124389 - DNA, 25 bp, Mus musculus
taaccccagtccgtggatctctgga

SEQ ID NO: 124390 - DNA, 25 bp, Mus musculus
taaccccggagatgattgatggcaa

SEQ ID NO: 124391 - DNA, 25 bp, Mus musculus
taacccctacagtggagcacaggac

SEQ ID NO: 124392 - DNA, 25 bp, Mus musculus
taacccctgaggtgctttggaatcc

SEQ ID NO: 124393 - DNA, 25 bp, Mus musculus
taaccccttgcgaagaagaatgaga

SEQ ID NO: 124394 - DNA, 25 bp, Mus musculus
taacccctttaatgagtactccaag

SEQ ID NO: 124395 - DNA, 25 bp, Mus musculus
taacccctttcggtcaagtagcagc

SEQ ID NO: 124396 - DNA, 25 bp, Mus musculus
taacccgtagacaaccgtcagcatg

SEQ ID NO: 124397 - DNA, 25 bp, Mus musculus
taacccgtggatgtagcctcaaaga

SEQ ID NO: 124398 - DNA, 25 bp, Mus musculus
taacccgtgtcagtgaatatgtgcc

SEQ ID NO: 124399 - DNA, 25 bp, Mus musculus
taaccctaaggtttcctagctgtgg

SEQ ID NO: 124400 - DNA, 25 bp, Mus musculus
taaccctatcatcgatggtcgcaag

SEQ ID NO: 124401 - DNA, 25 bp, Mus musculus
taaccctatgcaatatatagacatg

SEQ ID NO: 124402 - DNA, 25 bp, Mus musculus
taaccctattccagaccatgtccgg

SEQ ID NO: 124403 - DNA, 25 bp, Mus musculus
taaccctccaggagcgtggcttcag

SEQ ID NO: 124404 - DNA, 25 bp, Mus musculus
taaccctgagtgatgggcacagcaa

SEQ ID NO: 124405 - DNA, 25 bp, Mus musculus
taaccctgctgctaagctagacacc

SEQ ID NO: 124406 - DNA, 25 bp, Mus musculus
taaccctggacatgctatcctgaag

SEQ ID NO: 124407 - DNA, 25 bp, Mus musculus
taaccctggcggctattttattggc

SEQ ID NO: 124408 - DNA, 25 bp, Mus musculus
taaccctgtacggcaccgctctctt

SEQ ID NO: 124409 - DNA, 25 bp, Mus musculus
taacccttgatacttgtaatccgtg

SEQ ID NO: 124410 - DNA, 25 bp, Mus musculus
taacccttgggttcaacaaagcatg

SEQ ID NO: 124411 - DNA, 25 bp, Mus musculus
taaccgaattactctgaatgctgca

SEQ ID NO: 124412 - DNA, 25 bp, Mus musculus
taaccgagatgctccagctttccat

SEQ ID NO: 124413 - DNA, 25 bp, Mus musculus
taaccgagcaaagccaaggaaactg

SEQ ID NO: 124414 - DNA, 25 bp, Mus musculus
taaccgataaggacaccggagtcac

SEQ ID NO: 124415 - DNA, 25 bp, Mus musculus
taaccgatggtcctatggagctgcc

SEQ ID NO: 124416 - DNA, 25 bp, Mus musculus
taaccgattcttcagagggtgagca

SEQ ID NO: 124417 - DNA, 25 bp, Mus musculus
taaccgccgcttcgtttctcaagag

SEQ ID NO: 124418 - DNA, 25 bp, Mus musculus
taaccgcgagtctggaacgatggcg

SEQ ID NO: 124419 - DNA, 25 bp, Mus musculus
taaccgctgcatcagtcctgggctc

SEQ ID NO: 124420 - DNA, 25 bp, Mus musculus
taaccgctgtgcttgcgtttatgga

SEQ ID NO: 124421 - DNA, 25 bp, Mus musculus
taaccggagagcttcaaaactgacg

SEQ ID NO: 124422 - DNA, 25 bp, Mus musculus
taaccggagtgggaaatatctagcc

SEQ ID NO: 124423 - DNA, 25 bp, Mus musculus
taaccggccgcccagtcttccgccg

SEQ ID NO: 124424 - DNA, 25 bp, Mus musculus
taaccggcgttatgctgccctgcgt

SEQ ID NO: 124425 - DNA, 25 bp, Mus musculus
taaccggctctaagcacctagtagg

SEQ ID NO: 124426 - DNA, 25 bp, Mus musculus
taaccgggtggatcctaatggctcg

SEQ ID NO: 124427 - DNA, 25 bp, Mus musculus
taaccggtcagtgggactcaaggcc

SEQ ID NO: 124428 - DNA, 25 bp, Mus musculus
taaccgtatgtgtagccagggcaac

SEQ ID NO: 124429 - DNA, 25 bp, Mus musculus
taaccgtccgcagagctgagaaggc

SEQ ID NO: 124430 - DNA, 25 bp, Mus musculus
taaccgtgctaactgtcaagtgctg

SEQ ID NO: 124431 - DNA, 25 bp, Mus musculus
taaccgtggcttcatcaggaccgga

SEQ ID NO: 124432 - DNA, 25 bp, Mus musculus
taacctacaggtgcttgaagacaag

SEQ ID NO: 124433 - DNA, 25 bp, Mus musculus
taacctaccatgcaaacgaactggg

SEQ ID NO: 124434 - DNA, 25 bp, Mus musculus
taacctatcaagctgggcagggctg

SEQ ID NO: 124435 - DNA, 25 bp, Mus musculus
taacctcacggaaagcattaaagct

SEQ ID NO: 124436 - DNA, 25 bp, Mus musculus
taacctccacagatggccatggtgc

SEQ ID NO: 124437 - DNA, 25 bp, Mus musculus
taacctccagtatgttgccatcagc

SEQ ID NO: 124438 - DNA, 25 bp, Mus musculus
taacctcccagtgaccatgtctgag

SEQ ID NO: 124439 - DNA, 25 bp, Mus musculus
taacctcccgtgttgtgacgactgt

SEQ ID NO: 124440 - DNA, 25 bp, Mus musculus
taacctccgtgctttcaatgtgaca

SEQ ID NO: 124441 - DNA, 25 bp, Mus musculus
taacctcgtggctgagaaccctggt

SEQ ID NO: 124442 - DNA, 25 bp, Mus musculus
taacctcgtggctgggaaagccctg

SEQ ID NO: 124443 - DNA, 25 bp, Mus musculus
taacctctcagacaaataccaggag

SEQ ID NO: 124444 - DNA, 25 bp, Mus musculus
taacctctctgtggagaacgctgca

SEQ ID NO: 124445 - DNA, 25 bp, Mus musculus
taacctctgcctcaagtacgtaggg

SEQ ID NO: 124446 - DNA, 25 bp, Mus musculus
taacctctggatctacgagctgagg

SEQ ID NO: 124447 - DNA, 25 bp, Mus musculus
taacctgaaaagcaagcctgactgg

SEQ ID NO: 124448 - DNA, 25 bp, Mus musculus
taacctgaagtttgctggaatgcca

SEQ ID NO: 124449 - DNA, 25 bp, Mus musculus
taacctgcccatggaataacccgtt

SEQ ID NO: 124450 - DNA, 25 bp, Mus musculus
taacctgctgcacgcttgtgggctg

SEQ ID NO: 124451 - DNA, 25 bp, Mus musculus
taacctggagtatgcttgtggcagc

SEQ ID NO: 124452 - DNA, 25 bp, Mus musculus
taacctggatgcacgttcagacaag

SEQ ID NO: 124453 - DNA, 25 bp, Mus musculus
taacctggcctacagtgggaagctg

SEQ ID NO: 124454 - DNA, 25 bp, Mus musculus
taacctgggctgatctagaagacaa

SEQ ID NO: 124455 - DNA, 25 bp, Mus musculus
taacctggtgggtgagccctcctta

SEQ ID NO: 124456 - DNA, 25 bp, Mus musculus
taacctgtccaaaaacggcatcgag

SEQ ID NO: 124457 - DNA, 25 bp, Mus musculus
taacctgtgtgaacgcattgcaatc

SEQ ID NO: 124458 - DNA, 25 bp, Mus musculus
taaccttcaccaacaccaacaaatt

SEQ ID NO: 124459 - DNA, 25 bp, Mus musculus
taaccttccaagtctcaaagcagag

SEQ ID NO: 124460 - DNA, 25 bp, Mus musculus
taaccttcgaagaggccatcgctgg

SEQ ID NO: 124461 - DNA, 25 bp, Mus musculus
taaccttgaagtccgggaagacagc

SEQ ID NO: 124462 - DNA, 25 bp, Mus musculus
taaccttgacgaatatgaacactat

SEQ ID NO: 124463 - DNA, 25 bp, Mus musculus
taaccttggcagtgatgatcccgaa

SEQ ID NO: 124464 - DNA, 25 bp, Mus musculus
taaccttgtgggaaaagcacacacc

SEQ ID NO: 124465 - DNA, 25 bp, Mus musculus
taacgaaggcagtcaaagcaggtga

SEQ ID NO: 124466 - DNA, 25 bp, Mus musculus
taacgaagggttgaagaaacacagc

SEQ ID NO: 124467 - DNA, 25 bp, Mus musculus
taacgaaggtagtgtacccgctgcg

SEQ ID NO: 124468 - DNA, 25 bp, Mus musculus
taacgaatggagcttcggcacctcc

SEQ ID NO: 124469 - DNA, 25 bp, Mus musculus
taacgacaaggaatcaacaccgcag

SEQ ID NO: 124470 - DNA, 25 bp, Mus musculus
taacgacagcagctccgactgtcag

SEQ ID NO: 124471 - DNA, 25 bp, Mus musculus
taacgacggactgccttacgagtgt

SEQ ID NO: 124472 - DNA, 25 bp, Mus musculus
taacgagaaccgtatccgcagcgtg

SEQ ID NO: 124473 - DNA, 25 bp, Mus musculus
taacgagaacgatgctgaacacctg

SEQ ID NO: 124474 - DNA, 25 bp, Mus musculus
taacgagagcttcgccgagatgaac

SEQ ID NO: 124475 - DNA, 25 bp, Mus musculus
taacgaggacaatggagctcaagtc

SEQ ID NO: 124476 - DNA, 25 bp, Mus musculus
taacgaggagacagcaaactatttc

SEQ ID NO: 124477 - DNA, 25 bp, Mus musculus
taacgaggcagtgctagtggccacc

SEQ ID NO: 124478 - DNA, 25 bp, Mus musculus
taacgaggccaagatgctacagacc

SEQ ID NO: 124479 - DNA, 25 bp, Mus musculus
taacgagggcgtgtataatggaagc

SEQ ID NO: 124480 - DNA, 25 bp, Mus musculus
taacgagtatgatcgcccgagagga

SEQ ID NO: 124481 - DNA, 25 bp, Mus musculus
taacgagtcaggacgcagaggatga

SEQ ID NO: 124482 - DNA, 25 bp, Mus musculus
taacgagtctgtgtgacaccgtggg

SEQ ID NO: 124483 - DNA, 25 bp, Mus musculus
taacgagtgtcctgtgggagcctcc

SEQ ID NO: 124484 - DNA, 25 bp, Mus musculus
taacgatgctgagttgtcaaatgcc

SEQ ID NO: 124485 - DNA, 25 bp, Mus musculus
taacgatggccacgtcgtgaccctg

SEQ ID NO: 124486 - DNA, 25 bp, Mus musculus
taacgatggcctgaatcacttggac

SEQ ID NO: 124487 - DNA, 25 bp, Mus musculus
taacgatgtcatagaggagctgctc

SEQ ID NO: 124488 - DNA, 25 bp, Mus musculus
taacgattgctacggatattatctg

SEQ ID NO: 124489 - DNA, 25 bp, Mus musculus
taacgcaccaggcacgatggctgat

SEQ ID NO: 124490 - DNA, 25 bp, Mus musculus
taacgcagtatcgaacgggcaagtg

SEQ ID NO: 124491 - DNA, 25 bp, Mus musculus
taacgccaagaccagtgatgacggc

SEQ ID NO: 124492 - DNA, 25 bp, Mus musculus
taacgcccacgagtttgctacgctg

SEQ ID NO: 124493 - DNA, 25 bp, Mus musculus
taacgccgaagggtaagctgaactg

SEQ ID NO: 124494 - DNA, 25 bp, Mus musculus
taacgctagtgcaggttttggccag

SEQ ID NO: 124495 - DNA, 25 bp, Mus musculus
taacgcttcagaacctagccaaagc

SEQ ID NO: 124496 - DNA, 25 bp, Mus musculus
taacggaagacctgaccaacaaggc

SEQ ID NO: 124497 - DNA, 25 bp, Mus musculus
taacggacgtgctaggatctggatc

SEQ ID NO: 124498 - DNA, 25 bp, Mus musculus
taacggagaccaagatccactgcga

SEQ ID NO: 124499 - DNA, 25 bp, Mus musculus
taacggagaccgagctttgcggaca

SEQ ID NO: 124500 - DNA, 25 bp, Mus musculus
taacggagatgatgttcaatgggct

SEQ ID NO: 124501 - DNA, 25 bp, Mus musculus
taacggagcgccaaaaagtgcactg

SEQ ID NO: 124502 - DNA, 25 bp, Mus musculus
taacggcaatgaaaagcggcagtcc

SEQ ID NO: 124503 - DNA, 25 bp, Mus musculus
taacggcacaggctgctagctggac

SEQ ID NO: 124504 - DNA, 25 bp, Mus musculus
taacggccacgtgtctgtctttgag

SEQ ID NO: 124505 - DNA, 25 bp, Mus musculus
taacggcgcgtcttgccggaaagat

SEQ ID NO: 124506 - DNA, 25 bp, Mus musculus
taacggcgtgtgacggcgtgtatca

SEQ ID NO: 124507 - DNA, 25 bp, Mus musculus
taacggctagcagaggaactgtgtc

SEQ ID NO: 124508 - DNA, 25 bp, Mus musculus
taacggctgcagtgtcctttttgac

SEQ ID NO: 124509 - DNA, 25 bp, Mus musculus
taacgggaacccagaagagactctg

SEQ ID NO: 124510 - DNA, 25 bp, Mus musculus
taacgggccatccatttttgtagca

SEQ ID NO: 124511 - DNA, 25 bp, Mus musculus
taacgggtcctcagcgctttacgag

SEQ ID NO: 124512 - DNA, 25 bp, Mus musculus
taacgggtgacgagcaaatatggaa

SEQ ID NO: 124513 - DNA, 25 bp, Mus musculus
taacggtaagtatgtcgcagcagaa

SEQ ID NO: 124514 - DNA, 25 bp, Mus musculus
taacggtacccaaatcagacatgca

SEQ ID NO: 124515 - DNA, 25 bp, Mus musculus
taacggtcacttgatgtgcgctggc

SEQ ID NO: 124516 - DNA, 25 bp, Mus musculus
taacggtcgcgtgaggccaaatctc

SEQ ID NO: 124517 - DNA, 25 bp, Mus musculus
taacggtctggacttctctgccaag

SEQ ID NO: 124518 - DNA, 25 bp, Mus musculus
taacggtgaaacgtcatgctccgag

SEQ ID NO: 124519 - DNA, 25 bp, Mus musculus
taacggtgttgcttcaagggaggca

SEQ ID NO: 124520 - DNA, 25 bp, Mus musculus
taacgtaacggagtatgcagaggag

SEQ ID NO: 124521 - DNA, 25 bp, Mus musculus
taacgtacgcagtcaatcatggagc

SEQ ID NO: 124522 - DNA, 25 bp, Mus musculus
taacgtagcgtccatctcagagaat

SEQ ID NO: 124523 - DNA, 25 bp, Mus musculus
taacgtagtgctgttcgagcagcgc

SEQ ID NO: 124524 - DNA, 25 bp, Mus musculus
taacgtcatcctgttcccctgggaa

SEQ ID NO: 124525 - DNA, 25 bp, Mus musculus
taacgtcatgcaccatggcgctggg

SEQ ID NO: 124526 - DNA, 25 bp, Mus musculus
taacgtgaaggcatatctgagccaa

SEQ ID NO: 124527 - DNA, 25 bp, Mus musculus
taacgtgacaaccaggaaaggtgcc

SEQ ID NO: 124528 - DNA, 25 bp, Mus musculus
taacgtgcacggagacgccattctc

SEQ ID NO: 124529 - DNA, 25 bp, Mus musculus
taacgtgctggtgctttactcggaa

SEQ ID NO: 124530 - DNA, 25 bp, Mus musculus
taacgtgggaactgccatcagcaag

SEQ ID NO: 124531 - DNA, 25 bp, Mus musculus
taacgtgggcctgatcacactggcc

SEQ ID NO: 124532 - DNA, 25 bp, Mus musculus
taacgtgtaaatccacagggtagat

SEQ ID NO: 124533 - DNA, 25 bp, Mus musculus
taacgttgggcctccgtgtcagtgg

SEQ ID NO: 124534 - DNA, 25 bp, Mus musculus
taacgtttgcgaacaggagtctgga

SEQ ID NO: 124535 - DNA, 25 bp, Mus musculus
taactaacctacaagtgaccaagca

SEQ ID NO: 124536 - DNA, 25 bp, Mus musculus
taactaactgggttcagggctggaa

SEQ ID NO: 124537 - DNA, 25 bp, Mus musculus
taactaagagttccgagcctgtccc

SEQ ID NO: 124538 - DNA, 25 bp, Mus musculus
taactaagcctccagtctgagcaag

SEQ ID NO: 124539 - DNA, 25 bp, Mus musculus
taactaagtacacgaagctcaccag

SEQ ID NO: 124540 - DNA, 25 bp, Mus musculus
taactacaatacttaccggtcacgg

SEQ ID NO: 124541 - DNA, 25 bp, Mus musculus
taactacacactctgccggaatggg

SEQ ID NO: 124542 - DNA, 25 bp, Mus musculus
taactacaccgacttcacttgcatg

SEQ ID NO: 124543 - DNA, 25 bp, Mus musculus
taactacatcatgcaaagaggaagg

SEQ ID NO: 124544 - DNA, 25 bp, Mus musculus
taactaccacctttagcgacgaggg

SEQ ID NO: 124545 - DNA, 25 bp, Mus musculus
taactacctagtggacgtggacggc

SEQ ID NO: 124546 - DNA, 25 bp, Mus musculus
taactacgtgggagacgacagagag

SEQ ID NO: 124547 - DNA, 25 bp, Mus musculus
taactacgttctctgggattgctgg

SEQ ID NO: 124548 - DNA, 25 bp, Mus musculus
taactactgctgctcaccgttgaga

SEQ ID NO: 124549 - DNA, 25 bp, Mus musculus
taactactgctttgacgtggactgg

SEQ ID NO: 124550 - DNA, 25 bp, Mus musculus
taactacttctagaggagcagagtc

SEQ ID NO: 124551 - DNA, 25 bp, Mus musculus
taactagagcccgaaagtgtgtgtg

SEQ ID NO: 124552 - DNA, 25 bp, Mus musculus
taactagcgaggagcgaactcggtg

SEQ ID NO: 124553 - DNA, 25 bp, Mus musculus
taactaggacttcagagctcacaac

SEQ ID NO: 124554 - DNA, 25 bp, Mus musculus
taactagggaccgttcagctgccca

SEQ ID NO: 124555 - DNA, 25 bp, Mus musculus
taactagggcccagtcaggtctgct

SEQ ID NO: 124556 - DNA, 25 bp, Mus musculus
taactatattggaaggcgtactggc

SEQ ID NO: 124557 - DNA, 25 bp, Mus musculus
taactatgaaggcagagggtctccg

SEQ ID NO: 124558 - DNA, 25 bp, Mus musculus
taactatgcggttgaaagcatccgg

SEQ ID NO: 124559 - DNA, 25 bp, Mus musculus
taactatggaaacgaccgactggga

SEQ ID NO: 124560 - DNA, 25 bp, Mus musculus
taactatgtgactcgctactgccaa

SEQ ID NO: 124561 - DNA, 25 bp, Mus musculus
taactattcagaaggcaggaagtcc

SEQ ID NO: 124562 - DNA, 25 bp, Mus musculus
taactatttcttccgtcgctttgga

SEQ ID NO: 124563 - DNA, 25 bp, Mus musculus
taactcaagagttccacctgctgtg

SEQ ID NO: 124564 - DNA, 25 bp, Mus musculus
taactcaattgtgaagtactttccc

SEQ ID NO: 124565 - DNA, 25 bp, Mus musculus
taactcacatcacctcattcctgat

SEQ ID NO: 124566 - DNA, 25 bp, Mus musculus
taactcacctggaaatgcgccgagc

SEQ ID NO: 124567 - DNA, 25 bp, Mus musculus
taactcagacgggaaagacgtggct

SEQ ID NO: 124568 - DNA, 25 bp, Mus musculus
taactcagactccatgcgggatgac

SEQ ID NO: 124569 - DNA, 25 bp, Mus musculus
taactcagatcgtggtggagcccga

SEQ ID NO: 124570 - DNA, 25 bp, Mus musculus
taactcagccattggtgtgcactca

SEQ ID NO: 124571 - DNA, 25 bp, Mus musculus
taactcaggccgaaacttggcggcg

SEQ ID NO: 124572 - DNA, 25 bp, Mus musculus
taactcaggcgaggatggcaagcct

SEQ ID NO: 124573 - DNA, 25 bp, Mus musculus
taactcccatgatgccgggtttggg

SEQ ID NO: 124574 - DNA, 25 bp, Mus musculus
taactcccgagtgtgagcactgtgg

SEQ ID NO: 124575 - DNA, 25 bp, Mus musculus
taactccgcagagggtagcgacaga

SEQ ID NO: 124576 - DNA, 25 bp, Mus musculus
taactccgccggaagtagtgattgc

SEQ ID NO: 124577 - DNA, 25 bp, Mus musculus
taactccgtttcaaaagactggcct

SEQ ID NO: 124578 - DNA, 25 bp, Mus musculus
taactcgagcctcagattcacagtg

SEQ ID NO: 124579 - DNA, 25 bp, Mus musculus
taactcggcaggttatgtgggcgac

SEQ ID NO: 124580 - DNA, 25 bp, Mus musculus
taactcggtgtccatcactggctca

SEQ ID NO: 124581 - DNA, 25 bp, Mus musculus
taactcgtctcacagagatgggcct

SEQ ID NO: 124582 - DNA, 25 bp, Mus musculus
taactctagggcagtacatgcagcc

SEQ ID NO: 124583 - DNA, 25 bp, Mus musculus
taactctgagagctcggtgcacatc

SEQ ID NO: 124584 - DNA, 25 bp, Mus musculus
taactctgaggttcaaaaccaagag

SEQ ID NO: 124585 - DNA, 25 bp, Mus musculus
taactctgatccctctgatgtggca

SEQ ID NO: 124586 - DNA, 25 bp, Mus musculus
taactctgcctggaaggattgtgga

SEQ ID NO: 124587 - DNA, 25 bp, Mus musculus
taactctttcgggaagcagacaagg

SEQ ID NO: 124588 - DNA, 25 bp, Mus musculus
taactgaaagactgactgggctggg

SEQ ID NO: 124589 - DNA, 25 bp, Mus musculus
taactgaactttgaagacccgctgc

SEQ ID NO: 124590 - DNA, 25 bp, Mus musculus
taactgaagcggttgagcctgtggc

SEQ ID NO: 124591 - DNA, 25 bp, Mus musculus
taactgaatgcggactgaacctccc

SEQ ID NO: 124592 - DNA, 25 bp, Mus musculus
taactgagaagactccccatgcgtg

SEQ ID NO: 124593 - DNA, 25 bp, Mus musculus
taactgagagaaccaagaagcacct

SEQ ID NO: 124594 - DNA, 25 bp, Mus musculus
taactgatcacatacgcaggagtgg

SEQ ID NO: 124595 - DNA, 25 bp, Mus musculus
taactgatcctggaagactccctga

SEQ ID NO: 124596 - DNA, 25 bp, Mus musculus
taactgatctgcatactcgggagga

SEQ ID NO: 124597 - DNA, 25 bp, Mus musculus
taactgatgaattccgggagctgcg

SEQ ID NO: 124598 - DNA, 25 bp, Mus musculus
taactgatgcgagtctcacagagtc

SEQ ID NO: 124599 - DNA, 25 bp, Mus musculus
taactgattgcttagatgctgagta

SEQ ID NO: 124600 - DNA, 25 bp, Mus musculus
taactgatttgaggaagatagctgc

SEQ ID NO: 124601 - DNA, 25 bp, Mus musculus
taactgcaaatacgacgggcatcgc

SEQ ID NO: 124602 - DNA, 25 bp, Mus musculus
taactgcaaatcctcaagctgtggg

SEQ ID NO: 124603 - DNA, 25 bp, Mus musculus
taactgcaagggaactgaactcgga

SEQ ID NO: 124604 - DNA, 25 bp, Mus musculus
taactgcagcgttggaaccttaaag

SEQ ID NO: 124605 - DNA, 25 bp, Mus musculus
taactgcagtgcttttccacagggc

SEQ ID NO: 124606 - DNA, 25 bp, Mus musculus
taactgccatggaaggatgctcctc

SEQ ID NO: 124607 - DNA, 25 bp, Mus musculus
taactgcgctcatcgctgctgcaaa

SEQ ID NO: 124608 - DNA, 25 bp, Mus musculus
taactgcggcagaaaagtccttcgg

SEQ ID NO: 124609 - DNA, 25 bp, Mus musculus
taactgcgtgttcttcgatgaggcc

SEQ ID NO: 124610 - DNA, 25 bp, Mus musculus
taactgctacgagatcggccacact

SEQ ID NO: 124611 - DNA, 25 bp, Mus musculus
taactgctagcatcgagaccttgtg

SEQ ID NO: 124612 - DNA, 25 bp, Mus musculus
taactgctctcaggatgaagggcgg

SEQ ID NO: 124613 - DNA, 25 bp, Mus musculus
taactgctgaaaactgttcactgta

SEQ ID NO: 124614 - DNA, 25 bp, Mus musculus
taactgctgctaccatggagatcct

SEQ ID NO: 124615 - DNA, 25 bp, Mus musculus
taactgctgggcctatgagactggc

SEQ ID NO: 124616 - DNA, 25 bp, Mus musculus
taactgctggtctaatgtagggtcc

SEQ ID NO: 124617 - DNA, 25 bp, Mus musculus
taactgcttgcaggtcctcggcgtc

SEQ ID NO: 124618 - DNA, 25 bp, Mus musculus
taactggaggaaactgcggctgatc

SEQ ID NO: 124619 - DNA, 25 bp, Mus musculus
taactggaggatctaactggcaacc

SEQ ID NO: 124620 - DNA, 25 bp, Mus musculus
taactggatctgaactggcacctgc

SEQ ID NO: 124621 - DNA, 25 bp, Mus musculus
taactggatggacggactggaacct

SEQ ID NO: 124622 - DNA, 25 bp, Mus musculus
taactggcagtcaaggcgatacctc

SEQ ID NO: 124623 - DNA, 25 bp, Mus musculus
taactggctgggttcagtagcacgc

SEQ ID NO: 124624 - DNA, 25 bp, Mus musculus
taactgggcttccaacgcttgacca

SEQ ID NO: 124625 - DNA, 25 bp, Mus musculus
taactgggtcacagaagacttgctg

SEQ ID NO: 124626 - DNA, 25 bp, Mus musculus
taactggtaaccacaaataaagtgt

SEQ ID NO: 124627 - DNA, 25 bp, Mus musculus
taactggtccaagtactaccgacag

SEQ ID NO: 124628 - DNA, 25 bp, Mus musculus
taactggttctgagggtctacccct

SEQ ID NO: 124629 - DNA, 25 bp, Mus musculus
taactgtatcaactgaagagcaagc

SEQ ID NO: 124630 - DNA, 25 bp, Mus musculus
taactgtccgggtcatggcgtcaaa

SEQ ID NO: 124631 - DNA, 25 bp, Mus musculus
taactgtcgccattctgaggatgca

SEQ ID NO: 124632 - DNA, 25 bp, Mus musculus
taactgtcgttcagaacctggcttc

SEQ ID NO: 124633 - DNA, 25 bp, Mus musculus
taactgtgcatatgaggaacgattg

SEQ ID NO: 124634 - DNA, 25 bp, Mus musculus
taactgtgcctgcaaaataaactcc

SEQ ID NO: 124635 - DNA, 25 bp, Mus musculus
taactgtgctggtccagatggcgta

SEQ ID NO: 124636 - DNA, 25 bp, Mus musculus
taactgtgtcctacattgccgtcgc

SEQ ID NO: 124637 - DNA, 25 bp, Mus musculus
taactgtgtggctgaagtcgtgacc

SEQ ID NO: 124638 - DNA, 25 bp, Mus musculus
taactgttagcgtcctcttggcaca

SEQ ID NO: 124639 - DNA, 25 bp, Mus musculus
taactgttagggacttgggagatgc

SEQ ID NO: 124640 - DNA, 25 bp, Mus musculus
taactgttctatacgtaacactggc

SEQ ID NO: 124641 - DNA, 25 bp, Mus musculus
taactgttggttcaggccattgagc

SEQ ID NO: 124642 - DNA, 25 bp, Mus musculus
taacttaagtggctgcagaaccagc

SEQ ID NO: 124643 - DNA, 25 bp, Mus musculus
taacttaatcctgaaatgggacagc

SEQ ID NO: 124644 - DNA, 25 bp, Mus musculus
taacttaatggtgctgactcccgca

SEQ ID NO: 124645 - DNA, 25 bp, Mus musculus
taacttagatgtccgctgtcacctg

SEQ ID NO: 124646 - DNA, 25 bp, Mus musculus
taacttagttcccttgcccatgtgc

SEQ ID NO: 124647 - DNA, 25 bp, Mus musculus
taacttatgttgtgtgggtcccagg

SEQ ID NO: 124648 - DNA, 25 bp, Mus musculus
taacttcaagagcagagctgcggcc

SEQ ID NO: 124649 - DNA, 25 bp, Mus musculus
taacttcacagacctgcctgagagg

SEQ ID NO: 124650 - DNA, 25 bp, Mus musculus
taacttcacgccctttccggatgag

SEQ ID NO: 124651 - DNA, 25 bp, Mus musculus
taacttccagagcttggagccgtgc

SEQ ID NO: 124652 - DNA, 25 bp, Mus musculus
taacttccgggataccctgaagaag

SEQ ID NO: 124653 - DNA, 25 bp, Mus musculus
taacttcctgaaatggaggcgccag

SEQ ID NO: 124654 - DNA, 25 bp, Mus musculus
taacttcctgcgctgtgaagaccgg

SEQ ID NO: 124655 - DNA, 25 bp, Mus musculus
taacttcttagcaatggacggaggc

SEQ ID NO: 124656 - DNA, 25 bp, Mus musculus
taacttgaaccctgtcgtatgctgg

SEQ ID NO: 124657 - DNA, 25 bp, Mus musculus
taacttgacaggactaggcacccct

SEQ ID NO: 124658 - DNA, 25 bp, Mus musculus
taacttgaccgttgatccagccacg

SEQ ID NO: 124659 - DNA, 25 bp, Mus musculus
taacttgagtgttctgtgtgagacc

SEQ ID NO: 124660 - DNA, 25 bp, Mus musculus
taacttgatgaggtcagcagagcca

SEQ ID NO: 124661 - DNA, 25 bp, Mus musculus
taacttgcagaaattcccgacctgg

SEQ ID NO: 124662 - DNA, 25 bp, Mus musculus
taacttgcccttggcatgggtcctg

SEQ ID NO: 124663 - DNA, 25 bp, Mus musculus
taacttgccggtcttggccttccaa

SEQ ID NO: 124664 - DNA, 25 bp, Mus musculus
taacttgcctgtgccgtgtgacggt

SEQ ID NO: 124665 - DNA, 25 bp, Mus musculus
taacttgcgtgtgcgtgaacacccg

SEQ ID NO: 124666 - DNA, 25 bp, Mus musculus
taacttgctacaagtgaaaatgaga

SEQ ID NO: 124667 - DNA, 25 bp, Mus musculus
taacttgctttcgtccttcccaggg

SEQ ID NO: 124668 - DNA, 25 bp, Mus musculus
taacttggccctggaaccttaatgc

SEQ ID NO: 124669 - DNA, 25 bp, Mus musculus
taacttggctaggaggcagtacacg

SEQ ID NO: 124670 - DNA, 25 bp, Mus musculus
taacttgggcaagactgtttacaaa

SEQ ID NO: 124671 - DNA, 25 bp, Mus musculus
taacttgggccggtactggacaatg

SEQ ID NO: 124672 - DNA, 25 bp, Mus musculus
taacttgggttccagtgtgccgagc

SEQ ID NO: 124673 - DNA, 25 bp, Mus musculus
taacttgtcgtactgaactagcgga

SEQ ID NO: 124674 - DNA, 25 bp, Mus musculus
taacttgtgtctggcatgggaccct

SEQ ID NO: 124675 - DNA, 25 bp, Mus musculus
taactttgatcctaggccggaggga

SEQ ID NO: 124676 - DNA, 25 bp, Mus musculus
taactttgcggcagagccacagtca

SEQ ID NO: 124677 - DNA, 25 bp, Mus musculus
taactttgttgaagcttctggacag

SEQ ID NO: 124678 - DNA, 25 bp, Mus musculus
taacttttaagtggtgcggacgcca

SEQ ID NO: 124679 - DNA, 25 bp, Mus musculus
taagaaaaatgaagagcgaatgttt

SEQ ID NO: 124680 - DNA, 25 bp, Mus musculus
taagaaaacactggctgagccctgt

SEQ ID NO: 124681 - DNA, 25 bp, Mus musculus
taagaaacagctacgtgaatgggat

SEQ ID NO: 124682 - DNA, 25 bp, Mus musculus
taagaaaccactggtggatgaccct

SEQ ID NO: 124683 - DNA, 25 bp, Mus musculus
taagaaacgtttgctcagaagcggc

SEQ ID NO: 124684 - DNA, 25 bp, Mus musculus
taagaaactgctgaaaaggaagccg

SEQ ID NO: 124685 - DNA, 25 bp, Mus musculus
taagaaacttgaatatggccaacgc

SEQ ID NO: 124686 - DNA, 25 bp, Mus musculus
taagaaagcacaacgcaaagcccag

SEQ ID NO: 124687 - DNA, 25 bp, Mus musculus
taagaaagcataccagtctcatcgc

SEQ ID NO: 124688 - DNA, 25 bp, Mus musculus
taagaaagccaagttacagctagaa

SEQ ID NO: 124689 - DNA, 25 bp, Mus musculus
taagaaaggcccagacgttagagac

SEQ ID NO: 124690 - DNA, 25 bp, Mus musculus
taagaaaggctacctgaccctgtcg

SEQ ID NO: 124691 - DNA, 25 bp, Mus musculus
taagaaagtgggtcatcgccaagcc

SEQ ID NO: 124692 - DNA, 25 bp, Mus musculus
taagaaataccacacggaccaccat

SEQ ID NO: 124693 - DNA, 25 bp, Mus musculus
taagaaatatatcacagcaacccag

SEQ ID NO: 124694 - DNA, 25 bp, Mus musculus
taagaaatcgacaaacccttatggg

SEQ ID NO: 124695 - DNA, 25 bp, Mus musculus
taagaaatctgaggacatgctccga

SEQ ID NO: 124696 - DNA, 25 bp, Mus musculus
taagaaatttatgacggagtgccca

SEQ ID NO: 124697 - DNA, 25 bp, Mus musculus
taagaacacagaaacccatgtcagc

SEQ ID NO: 124698 - DNA, 25 bp, Mus musculus
taagaacagcactggctcactgacc

SEQ ID NO: 124699 - DNA, 25 bp, Mus musculus
taagaacagcatgaaccacggcaag

SEQ ID NO: 124700 - DNA, 25 bp, Mus musculus
taagaacatcctacacccaagacgg

SEQ ID NO: 124701 - DNA, 25 bp, Mus musculus
taagaacatgagagcgcacgccctg

SEQ ID NO: 124702 - DNA, 25 bp, Mus musculus
taagaaccaaaatatctctcgccaa

SEQ ID NO: 124703 - DNA, 25 bp, Mus musculus
taagaaccactctgagagctgggtg

SEQ ID NO: 124704 - DNA, 25 bp, Mus musculus
taagaacccaggagctgagggcaat

SEQ ID NO: 124705 - DNA, 25 bp, Mus musculus
taagaacccctgaaccctggtcagt

SEQ ID NO: 124706 - DNA, 25 bp, Mus musculus
taagaaccctgtgtcagagagcatc

SEQ ID NO: 124707 - DNA, 25 bp, Mus musculus
taagaacgactttatcggccagagt

SEQ ID NO: 124708 - DNA, 25 bp, Mus musculus
taagaacgagtgactggcatcaagt

SEQ ID NO: 124709 - DNA, 25 bp, Mus musculus
taagaacgatgacactcctgaagac

SEQ ID NO: 124710 - DNA, 25 bp, Mus musculus
taagaactaaggagagacacagcgc

SEQ ID NO: 124711 - DNA, 25 bp, Mus musculus
taagaactacccctgcgacagtgat

SEQ ID NO: 124712 - DNA, 25 bp, Mus musculus
taagaactattgaggagctggctcg

SEQ ID NO: 124713 - DNA, 25 bp, Mus musculus
taagaactccatggatggcgtgaac

SEQ ID NO: 124714 - DNA, 25 bp, Mus musculus
taagaactgcatctcttccggccat

SEQ ID NO: 124715 - DNA, 25 bp, Mus musculus
taagaactgtcatcgtgtcaacctg

SEQ ID NO: 124716 - DNA, 25 bp, Mus musculus
taagaactgtggagagtgaagccgc

SEQ ID NO: 124717 - DNA, 25 bp, Mus musculus
taagaacttgatcaaccagatgctg

SEQ ID NO: 124718 - DNA, 25 bp, Mus musculus
taagaagacaagatgcccatggtca

SEQ ID NO: 124719 - DNA, 25 bp, Mus musculus
taagaagatggctttcaggccctgc

SEQ ID NO: 124720 - DNA, 25 bp, Mus musculus
taagaagatgtagccctctggatgg

SEQ ID NO: 124721 - DNA, 25 bp, Mus musculus
taagaagcacatcccatatcgcgag

SEQ ID NO: 124722 - DNA, 25 bp, Mus musculus
taagaagcatcagttccaggatcgg

SEQ ID NO: 124723 - DNA, 25 bp, Mus musculus
taagaagcgcttcatgcagtgttcg

SEQ ID NO: 124724 - DNA, 25 bp, Mus musculus
taagaagctaaaacagggcaggagt

SEQ ID NO: 124725 - DNA, 25 bp, Mus musculus
taagaagctcactgaccaggtactg

SEQ ID NO: 124726 - DNA, 25 bp, Mus musculus
taagaagctctgctccttccgagcc

SEQ ID NO: 124727 - DNA, 25 bp, Mus musculus
taagaagctcttactggcaccagcc

SEQ ID NO: 124728 - DNA, 25 bp, Mus musculus
taagaagctgtcgagaccgtttcag

SEQ ID NO: 124729 - DNA, 25 bp, Mus musculus
taagaaggatgcagttgggctacac

SEQ ID NO: 124730 - DNA, 25 bp, Mus musculus
taagaaggcccatgttttggctgca

SEQ ID NO: 124731 - DNA, 25 bp, Mus musculus
taagaagggcagctgacaatgcaga

SEQ ID NO: 124732 - DNA, 25 bp, Mus musculus
taagaagggtcatgccaaagccaag

SEQ ID NO: 124733 - DNA, 25 bp, Mus musculus
taagaaggtcgtgtctgccactctc

SEQ ID NO: 124734 - DNA, 25 bp, Mus musculus
taagaagtccagaagttgtccagtt

SEQ ID NO: 124735 - DNA, 25 bp, Mus musculus
taagaagtcgcaggagacctcagga

SEQ ID NO: 124736 - DNA, 25 bp, Mus musculus
taagaagtgcagacgctacaacagg

SEQ ID NO: 124737 - DNA, 25 bp, Mus musculus
taagaagtgggtaccgatcaagcct

SEQ ID NO: 124738 - DNA, 25 bp, Mus musculus
taagaagtttgtgaagtcgacgggc

SEQ ID NO: 124739 - DNA, 25 bp, Mus musculus
taagaatcatggctgcgggaaagtt

SEQ ID NO: 124740 - DNA, 25 bp, Mus musculus
taagaatcgctaggatgcctatcct

SEQ ID NO: 124741 - DNA, 25 bp, Mus musculus
taagaatgaaaaggatgctgtcggc

SEQ ID NO: 124742 - DNA, 25 bp, Mus musculus
taagaatgagatcgcctccgtcgct

SEQ ID NO: 124743 - DNA, 25 bp, Mus musculus
taagaatgagcccagaagaactagc

SEQ ID NO: 124744 - DNA, 25 bp, Mus musculus
taagaatgaggtgcaacaagacccc

SEQ ID NO: 124745 - DNA, 25 bp, Mus musculus
taagaatgcactattgagagacccc

SEQ ID NO: 124746 - DNA, 25 bp, Mus musculus
taagaatgcagggacatacactggc

SEQ ID NO: 124747 - DNA, 25 bp, Mus musculus
taagaatgccattgtgcggagcctg

SEQ ID NO: 124748 - DNA, 25 bp, Mus musculus
taagaatgcccttcagcgagctgaa

SEQ ID NO: 124749 - DNA, 25 bp, Mus musculus
taagaattctatcgtggaccccaag

SEQ ID NO: 124750 - DNA, 25 bp, Mus musculus
taagacaaacctatacatccgagga

SEQ ID NO: 124751 - DNA, 25 bp, Mus musculus
taagacaactctccacgttgcctgg

SEQ ID NO: 124752 - DNA, 25 bp, Mus musculus
taagacaatttcaacggcagccctg

SEQ ID NO: 124753 - DNA, 25 bp, Mus musculus
taagacaccaagctaccggagaact

SEQ ID NO: 124754 - DNA, 25 bp, Mus musculus
taagacactggagcatatcaatgcc

SEQ ID NO: 124755 - DNA, 25 bp, Mus musculus
taagacagagacaaaggtcacaccc

SEQ ID NO: 124756 - DNA, 25 bp, Mus musculus
taagacagagaggttccaacacatc

SEQ ID NO: 124757 - DNA, 25 bp, Mus musculus
taagacagttgaagctcaggcggag

SEQ ID NO: 124758 - DNA, 25 bp, Mus musculus
taagacatgggttcggtatcaagaa

SEQ ID NO: 124759 - DNA, 25 bp, Mus musculus
taagacatttctgcccatcgcgctg

SEQ ID NO: 124760 - DNA, 25 bp, Mus musculus
taagaccaatggtgtccctgagcag

SEQ ID NO: 124761 - DNA, 25 bp, Mus musculus
taagaccaatgtgatccagcacgac

SEQ ID NO: 124762 - DNA, 25 bp, Mus musculus
taagaccacacttcctgtgagaggg

SEQ ID NO: 124763 - DNA, 25 bp, Mus musculus
taagaccagaggagtgtcccaaacc

SEQ ID NO: 124764 - DNA, 25 bp, Mus musculus
taagaccatgcatggagtgccggtg

SEQ ID NO: 124765 - DNA, 25 bp, Mus musculus
taagacccaggtcaaggaattagtg

SEQ ID NO: 124766 - DNA, 25 bp, Mus musculus
taagacccctttcccatagatgaga

SEQ ID NO: 124767 - DNA, 25 bp, Mus musculus
taagacccgaggaggttcaccatac

SEQ ID NO: 124768 - DNA, 25 bp, Mus musculus
taagacccgttttggaatacattga

SEQ ID NO: 124769 - DNA, 25 bp, Mus musculus
taagaccctacgcttttccactggt

SEQ ID NO: 124770 - DNA, 25 bp, Mus musculus
taagaccgattcctccaacgaacct

SEQ ID NO: 124771 - DNA, 25 bp, Mus musculus
taagacctatagcagccacagggtg

SEQ ID NO: 124772 - DNA, 25 bp, Mus musculus
taagacctcagcaagtaccaggacg

SEQ ID NO: 124773 - DNA, 25 bp, Mus musculus
taagacctcttagcttgtgccttgg

SEQ ID NO: 124774 - DNA, 25 bp, Mus musculus
taagacctgagtggcatgaacttcc

SEQ ID NO: 124775 - DNA, 25 bp, Mus musculus
taagacctggtggagggctaccttg

SEQ ID NO: 124776 - DNA, 25 bp, Mus musculus
taagacctgtcttcagaggtggcgg

SEQ ID NO: 124777 - DNA, 25 bp, Mus musculus
taagacctttgctgaacctggccct

SEQ ID NO: 124778 - DNA, 25 bp, Mus musculus
taagacgcagtagctgtcctgagcc

SEQ ID NO: 124779 - DNA, 25 bp, Mus musculus
taagacgcgtgctgcagagtgtatc

SEQ ID NO: 124780 - DNA, 25 bp, Mus musculus
taagacgctaattctgccaaggctg

SEQ ID NO: 124781 - DNA, 25 bp, Mus musculus
taagacggaagaactacctggagac

SEQ ID NO: 124782 - DNA, 25 bp, Mus musculus
taagacgggctgctgtctgctaccc

SEQ ID NO: 124783 - DNA, 25 bp, Mus musculus
taagacgtgacactatagaaacctc

SEQ ID NO: 124784 - DNA, 25 bp, Mus musculus
taagactcaaattcagcagggaggc

SEQ ID NO: 124785 - DNA, 25 bp, Mus musculus
taagactcctgttggcctagctaca

SEQ ID NO: 124786 - DNA, 25 bp, Mus musculus
taagactcggtcatctcatcgcctg

SEQ ID NO: 124787 - DNA, 25 bp, Mus musculus
taagactctgctgcaactggaggcc

SEQ ID NO: 124788 - DNA, 25 bp, Mus musculus
taagactgaagacgtaaacgcactg

SEQ ID NO: 124789 - DNA, 25 bp, Mus musculus
taagactgattggaaatcctcccag

SEQ ID NO: 124790 - DNA, 25 bp, Mus musculus
taagactgattttctgcccctaggc

SEQ ID NO: 124791 - DNA, 25 bp, Mus musculus
taagactgctacagcatctgggaca

SEQ ID NO: 124792 - DNA, 25 bp, Mus musculus
taagactgtacctagtgctgctgag

SEQ ID NO: 124793 - DNA, 25 bp, Mus musculus
taagactgtcaacggagactgccgc

SEQ ID NO: 124794 - DNA, 25 bp, Mus musculus
taagactgttggtcctggcgaggcc

SEQ ID NO: 124795 - DNA, 25 bp, Mus musculus
taagacttattccatggctaccaag

SEQ ID NO: 124796 - DNA, 25 bp, Mus musculus
taagacttctagacccctggagagg

SEQ ID NO: 124797 - DNA, 25 bp, Mus musculus
taagacttgtctgcctgggttccca

SEQ ID NO: 124798 - DNA, 25 bp, Mus musculus
taagagaaaaccaggcagcttccag

SEQ ID NO: 124799 - DNA, 25 bp, Mus musculus
taagagaacgaagctcagtaacaca

SEQ ID NO: 124800 - DNA, 25 bp, Mus musculus
taagagaactcaaaaacacaccaac

SEQ ID NO: 124801 - DNA, 25 bp, Mus musculus
taagagaagcctacctaggagctgg

SEQ ID NO: 124802 - DNA, 25 bp, Mus musculus
taagagaaggaaacaccagcatggc

SEQ ID NO: 124803 - DNA, 25 bp, Mus musculus
taagagaaggcgagacaggattgtc

SEQ ID NO: 124804 - DNA, 25 bp, Mus musculus
taagagaaggtcacccccagaagat

SEQ ID NO: 124805 - DNA, 25 bp, Mus musculus
taagagaatcagcacctacagtacg

SEQ ID NO: 124806 - DNA, 25 bp, Mus musculus
taagagaatccatttgaacagccgg

SEQ ID NO: 124807 - DNA, 25 bp, Mus musculus
taagagacccgcctctacactggtg

SEQ ID NO: 124808 - DNA, 25 bp, Mus musculus
taagagagacgctcgagtacctgct

SEQ ID NO: 124809 - DNA, 25 bp, Mus musculus
taagagagcatctataaggcagcgg

SEQ ID NO: 124810 - DNA, 25 bp, Mus musculus
taagagagcccctaaacagaagaag

SEQ ID NO: 124811 - DNA, 25 bp, Mus musculus
taagagagtacaaatcaaagcgaca

SEQ ID NO: 124812 - DNA, 25 bp, Mus musculus
taagagagtctgtcttccgcctgac

SEQ ID NO: 124813 - DNA, 25 bp, Mus musculus
taagagcaacctggacagagctctg

SEQ ID NO: 124814 - DNA, 25 bp, Mus musculus
taagagcaacgagtgtgtgcggacc

SEQ ID NO: 124815 - DNA, 25 bp, Mus musculus
taagagcaccaagtaggtcctagtc

SEQ ID NO: 124816 - DNA, 25 bp, Mus musculus
taagagcacgtgtcatgtggccacc

SEQ ID NO: 124817 - DNA, 25 bp, Mus musculus
taagagcagagttacagccaggtgg

SEQ ID NO: 124818 - DNA, 25 bp, Mus musculus
taagagcataaggatctgcacacct

SEQ ID NO: 124819 - DNA, 25 bp, Mus musculus
taagagcatcggctactcggacctg

SEQ ID NO: 124820 - DNA, 25 bp, Mus musculus
taagagcccagtgtcgttgtgaaga

SEQ ID NO: 124821 - DNA, 25 bp, Mus musculus
taagagccccaaaacaatgaagaag

SEQ ID NO: 124822 - DNA, 25 bp, Mus musculus
taagagcccttctctgcaaacctgg

SEQ ID NO: 124823 - DNA, 25 bp, Mus musculus
taagagccgctgtcaagggtactgg

SEQ ID NO: 124824 - DNA, 25 bp, Mus musculus
taagagccgtgattatcgtggtgca

SEQ ID NO: 124825 - DNA, 25 bp, Mus musculus
taagagccgtgtctatccaggtacc

SEQ ID NO: 124826 - DNA, 25 bp, Mus musculus
taagagcctcgttggagtagaccct

SEQ ID NO: 124827 - DNA, 25 bp, Mus musculus
taagagcctgcacggacttgaacag

SEQ ID NO: 124828 - DNA, 25 bp, Mus musculus
taagagccttcagtagttccacatg

SEQ ID NO: 124829 - DNA, 25 bp, Mus musculus
taagagcggatgcttcagaacagac

SEQ ID NO: 124830 - DNA, 25 bp, Mus musculus
taagagcggttacaactgcgcggcc

SEQ ID NO: 124831 - DNA, 25 bp, Mus musculus
taagagctatggaagccatcgggct

SEQ ID NO: 124832 - DNA, 25 bp, Mus musculus
taagagcttcctgtggtggacaagc

SEQ ID NO: 124833 - DNA, 25 bp, Mus musculus
taagaggatagagcctgcagacgcg

SEQ ID NO: 124834 - DNA, 25 bp, Mus musculus
taagaggcactactacaagcagaag

SEQ ID NO: 124835 - DNA, 25 bp, Mus musculus
taagaggccccagttaatgtctgca

SEQ ID NO: 124836 - DNA, 25 bp, Mus musculus
taagaggcgagttcaggagtctaca

SEQ ID NO: 124837 - DNA, 25 bp, Mus musculus
taagaggcgcagagccaagaacaga

SEQ ID NO: 124838 - DNA, 25 bp, Mus musculus
taagaggctcagcagtaaaccatgg

SEQ ID NO: 124839 - DNA, 25 bp, Mus musculus
taagaggctgcctgactccagggtg

SEQ ID NO: 124840 - DNA, 25 bp, Mus musculus
taagaggcttgcactgctgaaggga

SEQ ID NO: 124841 - DNA, 25 bp, Mus musculus
taagagggaagggattgaccccgct

SEQ ID NO: 124842 - DNA, 25 bp, Mus musculus
taagagggatgcattcctaggaggc

SEQ ID NO: 124843 - DNA, 25 bp, Mus musculus
taagagggccaagctcctcagcagt

SEQ ID NO: 124844 - DNA, 25 bp, Mus musculus
taagagggctatccagactggtgaa

SEQ ID NO: 124845 - DNA, 25 bp, Mus musculus
taagagggctttgatcgacggattc

SEQ ID NO: 124846 - DNA, 25 bp, Mus musculus
taagagggcttttccactagactga

SEQ ID NO: 124847 - DNA, 25 bp, Mus musculus
taagaggtcgcctgtgtgacgacag

SEQ ID NO: 124848 - DNA, 25 bp, Mus musculus
taagaggtggctataaagccctggc

SEQ ID NO: 124849 - DNA, 25 bp, Mus musculus
taagagtccatggtgaccctgcagt

SEQ ID NO: 124850 - DNA, 25 bp, Mus musculus
taagagtcgccagcgtgtgcgctat

SEQ ID NO: 124851 - DNA, 25 bp, Mus musculus
taagagtcgtttccatcagcgctac

SEQ ID NO: 124852 - DNA, 25 bp, Mus musculus
taagagtgaccttggccggaagatc

SEQ ID NO: 124853 - DNA, 25 bp, Mus musculus
taagagtgatgaagccgactgtcca

SEQ ID NO: 124854 - DNA, 25 bp, Mus musculus
taagagtgatgagattcagaacttc

SEQ ID NO: 124855 - DNA, 25 bp, Mus musculus
taagagtgcaggattgggctcagcc

SEQ ID NO: 124856 - DNA, 25 bp, Mus musculus
taagagtgccttcctagaaaaatgg

SEQ ID NO: 124857 - DNA, 25 bp, Mus musculus
taagagtggtccatccggatgttcc

SEQ ID NO: 124858 - DNA, 25 bp, Mus musculus
taagagtgtcacgagttccagtacc

SEQ ID NO: 124859 - DNA, 25 bp, Mus musculus
taagagtgtcttggccactggctcc

SEQ ID NO: 124860 - DNA, 25 bp, Mus musculus
taagagttacctgtttcggaatgcc

SEQ ID NO: 124861 - DNA, 25 bp, Mus musculus
taagagtttacgtccatcacactgg

SEQ ID NO: 124862 - DNA, 25 bp, Mus musculus
taagataccacgaggcagtgctgcg

SEQ ID NO: 124863 - DNA, 25 bp, Mus musculus
taagatacggaggaggcagctcact

SEQ ID NO: 124864 - DNA, 25 bp, Mus musculus
taagatatccaaggtcatcgttgtg

SEQ ID NO: 124865 - DNA, 25 bp, Mus musculus
taagatatggagtgaatcctggtcc

SEQ ID NO: 124866 - DNA, 25 bp, Mus musculus
taagatcaatcttttctcgccgtta

SEQ ID NO: 124867 - DNA, 25 bp, Mus musculus
taagatcactacagccatgaggcag

SEQ ID NO: 124868 - DNA, 25 bp, Mus musculus
taagatcactagcttcgaggaggcc

SEQ ID NO: 124869 - DNA, 25 bp, Mus musculus
taagatcagcggcttgagagagccc

SEQ ID NO: 124870 - DNA, 25 bp, Mus musculus
taagatcagcttggtggacctcgcc

SEQ ID NO: 124871 - DNA, 25 bp, Mus musculus
taagatccatttcctcgctctgccg

SEQ ID NO: 124872 - DNA, 25 bp, Mus musculus
taagatcctcaagcagctacaggtg

SEQ ID NO: 124873 - DNA, 25 bp, Mus musculus
taagatcctcctagaccttgaggtg

SEQ ID NO: 124874 - DNA, 25 bp, Mus musculus
taagatcctgtcagggccatagatc

SEQ ID NO: 124875 - DNA, 25 bp, Mus musculus
taagatcgtcgacccagaatactcc

SEQ ID NO: 124876 - DNA, 25 bp, Mus musculus
taagatcgtggtgcatacccaatgc

SEQ ID NO: 124877 - DNA, 25 bp, Mus musculus
taagatctctgcaacctggacaatg

SEQ ID NO: 124878 - DNA, 25 bp, Mus musculus
taagatctttctgataacgcagaga

SEQ ID NO: 124879 - DNA, 25 bp, Mus musculus
taagatctttcttcccgccgcttgg

SEQ ID NO: 124880 - DNA, 25 bp, Mus musculus
taagatgaaatctaccacccaggcc

SEQ ID NO: 124881 - DNA, 25 bp, Mus musculus
taagatgagcattaccagcgacgag

SEQ ID NO: 124882 - DNA, 25 bp, Mus musculus
taagatgaggctgccatgccgagac

SEQ ID NO: 124883 - DNA, 25 bp, Mus musculus
taagatgcaataacatttgtttcac

SEQ ID NO: 124884 - DNA, 25 bp, Mus musculus
taagatgcatcgttatttcacgctg

SEQ ID NO: 124885 - DNA, 25 bp, Mus musculus
taagatgccagagatgaccatgccc

SEQ ID NO: 124886 - DNA, 25 bp, Mus musculus
taagatgccggatattcctgatgca

SEQ ID NO: 124887 - DNA, 25 bp, Mus musculus
taagatgcgaatggagcgccagagc

SEQ ID NO: 124888 - DNA, 25 bp, Mus musculus
taagatgctgcattctcaactgaca

SEQ ID NO: 124889 - DNA, 25 bp, Mus musculus
taagatgctgcttcagaacgactcc

SEQ ID NO: 124890 - DNA, 25 bp, Mus musculus
taagatggaagtgacctgaggcctc

SEQ ID NO: 124891 - DNA, 25 bp, Mus musculus
taagatggagctactgaccgcactg

SEQ ID NO: 124892 - DNA, 25 bp, Mus musculus
taagatggcagagcataatctcttg

SEQ ID NO: 124893 - DNA, 25 bp, Mus musculus
taagatggccttctacaacggctgg

SEQ ID NO: 124894 - DNA, 25 bp, Mus musculus
taagatggcgtcgtcctgttcgcgg

SEQ ID NO: 124895 - DNA, 25 bp, Mus musculus
taagatggctctctcaagtggtgca

SEQ ID NO: 124896 - DNA, 25 bp, Mus musculus
taagatggtgtggaaccgaactacc

SEQ ID NO: 124897 - DNA, 25 bp, Mus musculus
taagatgtcccgaaaattgggtggc

SEQ ID NO: 124898 - DNA, 25 bp, Mus musculus
taagatgtctggaatggagcacacc

SEQ ID NO: 124899 - DNA, 25 bp, Mus musculus
taagatgttagtgattgacccagcg

SEQ ID NO: 124900 - DNA, 25 bp, Mus musculus
taagatgttcgtgttctcaggacag

SEQ ID NO: 124901 - DNA, 25 bp, Mus musculus
taagatgttctcatccaccgaccgg

SEQ ID NO: 124902 - DNA, 25 bp, Mus musculus
taagattatcccctgactacaagag

SEQ ID NO: 124903 - DNA, 25 bp, Mus musculus
taagattattcacacagaggcacgt

SEQ ID NO: 124904 - DNA, 25 bp, Mus musculus
taagattcgtctgcgtggtcaccgt

SEQ ID NO: 124905 - DNA, 25 bp, Mus musculus
taagattgactgtcgtgccccaggg

SEQ ID NO: 124906 - DNA, 25 bp, Mus musculus
taagattgaggaagcacccgaagca

SEQ ID NO: 124907 - DNA, 25 bp, Mus musculus
taagatttggccatgagcagcgccc

SEQ ID NO: 124908 - DNA, 25 bp, Mus musculus
taagatttgtgaccccagtgaactg

SEQ ID NO: 124909 - DNA, 25 bp, Mus musculus
taagcaaacacttagacgccagagg

SEQ ID NO: 124910 - DNA, 25 bp, Mus musculus
taagcaaagaatagctctgcagaga

SEQ ID NO: 124911 - DNA, 25 bp, Mus musculus
taagcaaagagtcaggaccacaggc

SEQ ID NO: 124912 - DNA, 25 bp, Mus musculus
taagcaaagctaaggacagcggctc

SEQ ID NO: 124913 - DNA, 25 bp, Mus musculus
taagcaaaggtatccggacggcatc

SEQ ID NO: 124914 - DNA, 25 bp, Mus musculus
taagcaaatctgtacagccatgcag

SEQ ID NO: 124915 - DNA, 25 bp, Mus musculus
taagcaaatgtaccaccaatgagcc

SEQ ID NO: 124916 - DNA, 25 bp, Mus musculus
taagcaactactggctgatgaagtc

SEQ ID NO: 124917 - DNA, 25 bp, Mus musculus
taagcaactgaagtgcggctgggca

SEQ ID NO: 124918 - DNA, 25 bp, Mus musculus
taagcaacttgaagcaggagtgagg

SEQ ID NO: 124919 - DNA, 25 bp, Mus musculus
taagcaagagaagtgcccagaggct

SEQ ID NO: 124920 - DNA, 25 bp, Mus musculus
taagcaagaggctgtagccatcaag

SEQ ID NO: 124921 - DNA, 25 bp, Mus musculus
taagcaagatctcccgaatgccgag

SEQ ID NO: 124922 - DNA, 25 bp, Mus musculus
taagcaagtcgtgagtgtggaaacc

SEQ ID NO: 124923 - DNA, 25 bp, Mus musculus
taagcaatccgtgtgggagaagccc

SEQ ID NO: 124924 - DNA, 25 bp, Mus musculus
taagcaatggcttcggtttccctcc

SEQ ID NO: 124925 - DNA, 25 bp, Mus musculus
taagcaatgtgggacccgtggacct

SEQ ID NO: 124926 - DNA, 25 bp, Mus musculus
taagcaatgtttgcagcctacaccg

SEQ ID NO: 124927 - DNA, 25 bp, Mus musculus
taagcacaccgatgaagagttcctg

SEQ ID NO: 124928 - DNA, 25 bp, Mus musculus
taagcacccatgaccagccatcagc

SEQ ID NO: 124929 - DNA, 25 bp, Mus musculus
taagcaccggcaaattaaaatgtcg

SEQ ID NO: 124930 - DNA, 25 bp, Mus musculus
taagcaccgtggattctggaacgag

SEQ ID NO: 124931 - DNA, 25 bp, Mus musculus
taagcaccttctgagctatgacgga

SEQ ID NO: 124932 - DNA, 25 bp, Mus musculus
taagcacgtctgaagttcacactgg

SEQ ID NO: 124933 - DNA, 25 bp, Mus musculus
taagcactacggcaaaggatacgaa

SEQ ID NO: 124934 - DNA, 25 bp, Mus musculus
taagcactccttctggaacaaccga

SEQ ID NO: 124935 - DNA, 25 bp, Mus musculus
taagcactgctaggcattcaagcgt

SEQ ID NO: 124936 - DNA, 25 bp, Mus musculus
taagcactgtggcttgaagctggcc

SEQ ID NO: 124937 - DNA, 25 bp, Mus musculus
taagcacttacgattttgccaggaa

SEQ ID NO: 124938 - DNA, 25 bp, Mus musculus
taagcacttgcttgggatggccctg

SEQ ID NO: 124939 - DNA, 25 bp, Mus musculus
taagcagagggtgactaagcattgg

SEQ ID NO: 124940 - DNA, 25 bp, Mus musculus
taagcagcagacagtgcgtctaagt

SEQ ID NO: 124941 - DNA, 25 bp, Mus musculus
taagcagcagcgttcgaggtaagcg

SEQ ID NO: 124942 - DNA, 25 bp, Mus musculus
taagcagccatgactacaagcacct

SEQ ID NO: 124943 - DNA, 25 bp, Mus musculus
taagcagccccaggtatgcaagtgg

SEQ ID NO: 124944 - DNA, 25 bp, Mus musculus
taagcagccccgagaagtgtgtctc

SEQ ID NO: 124945 - DNA, 25 bp, Mus musculus
taagcagccgaaccccatatcgtct

SEQ ID NO: 124946 - DNA, 25 bp, Mus musculus
taagcagccggtgtttggtgcgaac

SEQ ID NO: 124947 - DNA, 25 bp, Mus musculus
taagcagcgaaagggtgatccgttc

SEQ ID NO: 124948 - DNA, 25 bp, Mus musculus
taagcagcttaaagatgactccttg

SEQ ID NO: 124949 - DNA, 25 bp, Mus musculus
taagcagcttgtccacctacggaaa

SEQ ID NO: 124950 - DNA, 25 bp, Mus musculus
taagcaggaaagcaaccagatcggt

SEQ ID NO: 124951 - DNA, 25 bp, Mus musculus
taagcaggaagaggatccagcacca

SEQ ID NO: 124952 - DNA, 25 bp, Mus musculus
taagcagtacgctaatggacataga

SEQ ID NO: 124953 - DNA, 25 bp, Mus musculus
taagcagtatcaagagccaacaccc

SEQ ID NO: 124954 - DNA, 25 bp, Mus musculus
taagcagtcccacttctgtgccagg

SEQ ID NO: 124955 - DNA, 25 bp, Mus musculus
taagcagtgactgccatgcgggaac

SEQ ID NO: 124956 - DNA, 25 bp, Mus musculus
taagcagttagcctcggtagctgac

SEQ ID NO: 124957 - DNA, 25 bp, Mus musculus
taagcagttcatcgcggcgcagaac

SEQ ID NO: 124958 - DNA, 25 bp, Mus musculus
taagcatcaggagctagacactctg

SEQ ID NO: 124959 - DNA, 25 bp, Mus musculus
taagcatcattatcaggcagccagt

SEQ ID NO: 124960 - DNA, 25 bp, Mus musculus
taagcatcccatagagcaggctgcc

SEQ ID NO: 124961 - DNA, 25 bp, Mus musculus
taagcatcctaatccctatgaagtc

SEQ ID NO: 124962 - DNA, 25 bp, Mus musculus
taagcatcctgatgaatggcgagca

SEQ ID NO: 124963 - DNA, 25 bp, Mus musculus
taagcatctcagtgcgctcaaaggt

SEQ ID NO: 124964 - DNA, 25 bp, Mus musculus
taagcatgatcctgcctcagagcca

SEQ ID NO: 124965 - DNA, 25 bp, Mus musculus
taagcatgattccatcgggcaggat

SEQ ID NO: 124966 - DNA, 25 bp, Mus musculus
taagcatgctattgggacctgtaca

SEQ ID NO: 124967 - DNA, 25 bp, Mus musculus
taagcatgctccaaaatccactggg

SEQ ID NO: 124968 - DNA, 25 bp, Mus musculus
taagcatttgaacatttgtgccccg

SEQ ID NO: 124969 - DNA, 25 bp, Mus musculus
taagccaaaaccttctacacagtcg

SEQ ID NO: 124970 - DNA, 25 bp, Mus musculus
taagccaaccagttagcagggccag

SEQ ID NO: 124971 - DNA, 25 bp, Mus musculus
taagccaacgtctcagggcaacaag

SEQ ID NO: 124972 - DNA, 25 bp, Mus musculus
taagccaagaaatcagcctgccaag

SEQ ID NO: 124973 - DNA, 25 bp, Mus musculus
taagccaagccaacactggaggagt

SEQ ID NO: 124974 - DNA, 25 bp, Mus musculus
taagccaagtgatccctgcagtgtg

SEQ ID NO: 124975 - DNA, 25 bp, Mus musculus
taagccaagtggatgcctaagcatc

SEQ ID NO: 124976 - DNA, 25 bp, Mus musculus
taagccacacgagcagtagtttcta

SEQ ID NO: 124977 - DNA, 25 bp, Mus musculus
taagccacctctgcctgagggtgaa

SEQ ID NO: 124978 - DNA, 25 bp, Mus musculus
taagccacctgggtcaattgtaaga

SEQ ID NO: 124979 - DNA, 25 bp, Mus musculus
taagccagctatgatgtgacctcgc

SEQ ID NO: 124980 - DNA, 25 bp, Mus musculus
taagccaggactgagcacttctgcc

SEQ ID NO: 124981 - DNA, 25 bp, Mus musculus
taagccaggcttgagagtgaacgac

SEQ ID NO: 124982 - DNA, 25 bp, Mus musculus
taagccaggtttacctaagaggcca

SEQ ID NO: 124983 - DNA, 25 bp, Mus musculus
taagccagtcatggtaatgcacgcc

SEQ ID NO: 124984 - DNA, 25 bp, Mus musculus
taagccagtccattctcagagccag

SEQ ID NO: 124985 - DNA, 25 bp, Mus musculus
taagccagtcggacaacatccagtc

SEQ ID NO: 124986 - DNA, 25 bp, Mus musculus
taagccatcttattcggcatgaagc

SEQ ID NO: 124987 - DNA, 25 bp, Mus musculus
taagccatgccagattcttgggaca

SEQ ID NO: 124988 - DNA, 25 bp, Mus musculus
taagcccaaatcagaacgcgaggcc

SEQ ID NO: 124989 - DNA, 25 bp, Mus musculus
taagcccacgctctggcataagatg

SEQ ID NO: 124990 - DNA, 25 bp, Mus musculus
taagcccacggtgatgctgaagaag

SEQ ID NO: 124991 - DNA, 25 bp, Mus musculus
taagcccagatagcctgtaagccag

SEQ ID NO: 124992 - DNA, 25 bp, Mus musculus
taagccccgaagtgaatgtacaaag

SEQ ID NO: 124993 - DNA, 25 bp, Mus musculus
taagcccgaggaaatactcatcaag

SEQ ID NO: 124994 - DNA, 25 bp, Mus musculus
taagcccgtgctgttgaaaatttgc

SEQ ID NO: 124995 - DNA, 25 bp, Mus musculus
taagccctagtgttcaaaatgcagc

SEQ ID NO: 124996 - DNA, 25 bp, Mus musculus
taagccctcagggttctggtcttag

SEQ ID NO: 124997 - DNA, 25 bp, Mus musculus
taagccctgcttctaaagtgccatg

SEQ ID NO: 124998 - DNA, 25 bp, Mus musculus
taagccctggtatgctggcgcctgt

SEQ ID NO: 124999 - DNA, 25 bp, Mus musculus
taagccctgtcaggactggcaccaa

SEQ ID NO: 125000 - DNA, 25 bp, Mus musculus
taagccgaagctgtggcactccatg

SEQ ID NO: 125001 - DNA, 25 bp, Mus musculus
taagccgatctctccaaggtgcctg

SEQ ID NO: 125002 - DNA, 25 bp, Mus musculus
taagccgccagccaaaatgtgtaag

SEQ ID NO: 125003 - DNA, 25 bp, Mus musculus
taagccgcgatcagtacctggagct

SEQ ID NO: 125004 - DNA, 25 bp, Mus musculus
taagccggctcctagttctgaacgg

SEQ ID NO: 125005 - DNA, 25 bp, Mus musculus
taagcctaagatgccactgccagag

SEQ ID NO: 125006 - DNA, 25 bp, Mus musculus
taagcctatctgactgtatgtggac

SEQ ID NO: 125007 - DNA, 25 bp, Mus musculus
taagcctatggataagaccacaccg

SEQ ID NO: 125008 - DNA, 25 bp, Mus musculus
taagcctattgccaaggtcactgcc

SEQ ID NO: 125009 - DNA, 25 bp, Mus musculus
taagcctcagcaaagagcacaaccc

SEQ ID NO: 125010 - DNA, 25 bp, Mus musculus
taagcctcagttcctacagacctgt

SEQ ID NO: 125011 - DNA, 25 bp, Mus musculus
taagcctcccatggttctcttgtaa

SEQ ID NO: 125012 - DNA, 25 bp, Mus musculus
taagcctccggttttggtgtctcca

SEQ ID NO: 125013 - DNA, 25 bp, Mus musculus
taagcctcctgttccagaccatatt

SEQ ID NO: 125014 - DNA, 25 bp, Mus musculus
taagcctcgaatttgcagcctgggc

SEQ ID NO: 125015 - DNA, 25 bp, Mus musculus
taagcctgactgatgtgggatacgg

SEQ ID NO: 125016 - DNA, 25 bp, Mus musculus
taagcctgcagagcaaccggataga

SEQ ID NO: 125017 - DNA, 25 bp, Mus musculus
taagcctggccctcaggcattaccc

SEQ ID NO: 125018 - DNA, 25 bp, Mus musculus
taagcctgtccacgcagagtatctg

SEQ ID NO: 125019 - DNA, 25 bp, Mus musculus
taagccttaacaacaagagccccag

SEQ ID NO: 125020 - DNA, 25 bp, Mus musculus
taagccttaggaatatagcactgga

SEQ ID NO: 125021 - DNA, 25 bp, Mus musculus
taagccttcagacggtagttttaca

SEQ ID NO: 125022 - DNA, 25 bp, Mus musculus
taagccttttacatacactggtcag

SEQ ID NO: 125023 - DNA, 25 bp, Mus musculus
taagcgaaaaagctcgatgcctcag

SEQ ID NO: 125024 - DNA, 25 bp, Mus musculus
taagcgacacgtctccagatgaagg

SEQ ID NO: 125025 - DNA, 25 bp, Mus musculus
taagcgagctaaagggagcacctgc

SEQ ID NO: 125026 - DNA, 25 bp, Mus musculus
taagcgattctgaaagaccaacccc

SEQ ID NO: 125027 - DNA, 25 bp, Mus musculus
taagcgcacgcagtgagtcgatgct

SEQ ID NO: 125028 - DNA, 25 bp, Mus musculus
taagcgcagcagaaggaagcgtgca

SEQ ID NO: 125029 - DNA, 25 bp, Mus musculus
taagcgcatttggagcactaggaga

SEQ ID NO: 125030 - DNA, 25 bp, Mus musculus
taagcgcctcgaggagacaaatgcc

SEQ ID NO: 125031 - DNA, 25 bp, Mus musculus
taagcgcgctagttaatactctgaa

SEQ ID NO: 125032 - DNA, 25 bp, Mus musculus
taagcgcttcctgggagaaaactgg

SEQ ID NO: 125033 - DNA, 25 bp, Mus musculus
taagcggaaagtgtccagaccaggc

SEQ ID NO: 125034 - DNA, 25 bp, Mus musculus
taagcggacctacgccagtggtgtc

SEQ ID NO: 125035 - DNA, 25 bp, Mus musculus
taagcggatgttcaggcccatggaa

SEQ ID NO: 125036 - DNA, 25 bp, Mus musculus
taagcggcctggattttcttcatgc

SEQ ID NO: 125037 - DNA, 25 bp, Mus musculus
taagcggcgtagaacgaggagctca

SEQ ID NO: 125038 - DNA, 25 bp, Mus musculus
taagcggctgaccttaggtgaagcc

SEQ ID NO: 125039 - DNA, 25 bp, Mus musculus
taagcgggacatgcccaaggtggct

SEQ ID NO: 125040 - DNA, 25 bp, Mus musculus
taagcggtctcctaaagaaaatctg

SEQ ID NO: 125041 - DNA, 25 bp, Mus musculus
taagcgtagcaactacgaaatcggg

SEQ ID NO: 125042 - DNA, 25 bp, Mus musculus
taagcgtcccgtgaatgttcccagg

SEQ ID NO: 125043 - DNA, 25 bp, Mus musculus
taagcgtccgcttctgggagtgcga

SEQ ID NO: 125044 - DNA, 25 bp, Mus musculus
taagcgtctgacagaggaacaagcc

SEQ ID NO: 125045 - DNA, 25 bp, Mus musculus
taagcgtgccggttcagagtctcct

SEQ ID NO: 125046 - DNA, 25 bp, Mus musculus
taagcgtgctgctagccatggctgc

SEQ ID NO: 125047 - DNA, 25 bp, Mus musculus
taagcgtgtacaccagctactttgg

SEQ ID NO: 125048 - DNA, 25 bp, Mus musculus
taagcgtgtactcatctttgcttca

SEQ ID NO: 125049 - DNA, 25 bp, Mus musculus
taagcgtgtgctcttctcccgaatg

SEQ ID NO: 125050 - DNA, 25 bp, Mus musculus
taagcgttacctcttcgtccagaaa

SEQ ID NO: 125051 - DNA, 25 bp, Mus musculus
taagcgtttgcattgtcagatgaac

SEQ ID NO: 125052 - DNA, 25 bp, Mus musculus
taagctaaagctggtgccggagctc

SEQ ID NO: 125053 - DNA, 25 bp, Mus musculus
taagctaaaggcgaagcccgtcagg

SEQ ID NO: 125054 - DNA, 25 bp, Mus musculus
taagctaacctttcctagacagatt

SEQ ID NO: 125055 - DNA, 25 bp, Mus musculus
taagctacagcatcatcggattgcc

SEQ ID NO: 125056 - DNA, 25 bp, Mus musculus
taagctacagcgtatccggcatgaa

SEQ ID NO: 125057 - DNA, 25 bp, Mus musculus
taagctactggaagctgggacagcc

SEQ ID NO: 125058 - DNA, 25 bp, Mus musculus
taagctagagctacagggcatccag

SEQ ID NO: 125059 - DNA, 25 bp, Mus musculus
taagctagtggatactgactcagtg

SEQ ID NO: 125060 - DNA, 25 bp, Mus musculus
taagctataggcagcgtgaatctcc

SEQ ID NO: 125061 - DNA, 25 bp, Mus musculus
taagctatgctccagaggctgccga

SEQ ID NO: 125062 - DNA, 25 bp, Mus musculus
taagctcatcgactttggcatcgcg

SEQ ID NO: 125063 - DNA, 25 bp, Mus musculus
taagctccctgaagctgtgatcagt

SEQ ID NO: 125064 - DNA, 25 bp, Mus musculus
taagctccgcaactggcaatggtgg

SEQ ID NO: 125065 - DNA, 25 bp, Mus musculus
taagctccgggaatccatcaggcga

SEQ ID NO: 125066 - DNA, 25 bp, Mus musculus
taagctcggtgaagacgtagtactc

SEQ ID NO: 125067 - DNA, 25 bp, Mus musculus
taagctcgtctagagcagggacaat

SEQ ID NO: 125068 - DNA, 25 bp, Mus musculus
taagctctctccttttagcctctaa

SEQ ID NO: 125069 - DNA, 25 bp, Mus musculus
taagctctgtcccagcagtggaaag

SEQ ID NO: 125070 - DNA, 25 bp, Mus musculus
taagctgaaattctcatttgagcct

SEQ ID NO: 125071 - DNA, 25 bp, Mus musculus
taagctgaaggagaaccgagagccg

SEQ ID NO: 125072 - DNA, 25 bp, Mus musculus
taagctgagtgtgcatgaccgctcg

SEQ ID NO: 125073 - DNA, 25 bp, Mus musculus
taagctgccatcgaaggtcatcgag

SEQ ID NO: 125074 - DNA, 25 bp, Mus musculus
taagctgcccgaccaaacatttatg

SEQ ID NO: 125075 - DNA, 25 bp, Mus musculus
taagctgcccgagaactatgaggag

SEQ ID NO: 125076 - DNA, 25 bp, Mus musculus
taagctgcccttgtcaggattgact

SEQ ID NO: 125077 - DNA, 25 bp, Mus musculus
taagctgcgcagtgtagtgttccac

SEQ ID NO: 125078 - DNA, 25 bp, Mus musculus
taagctgcggcaggatctggctgac

SEQ ID NO: 125079 - DNA, 25 bp, Mus musculus
taagctgctactaaatggagcccgc

SEQ ID NO: 125080 - DNA, 25 bp, Mus musculus
taagctgctgatgccgttgtctggc

SEQ ID NO: 125081 - DNA, 25 bp, Mus musculus
taagctgctgtactgcaactggaca

SEQ ID NO: 125082 - DNA, 25 bp, Mus musculus
taagctggaaaccatgctgggctca

SEQ ID NO: 125083 - DNA, 25 bp, Mus musculus
taagctggagagaattcgtccccgc

SEQ ID NO: 125084 - DNA, 25 bp, Mus musculus
taagctggaggacttcatcaacaac

SEQ ID NO: 125085 - DNA, 25 bp, Mus musculus
taagctggatcaccgtgactgtgga

SEQ ID NO: 125086 - DNA, 25 bp, Mus musculus
taagctggcacctaatgaatttcct

SEQ ID NO: 125087 - DNA, 25 bp, Mus musculus
taagctggctttcacacaactagac

SEQ ID NO: 125088 - DNA, 25 bp, Mus musculus
taagctgggtctgaatgatctgccc

SEQ ID NO: 125089 - DNA, 25 bp, Mus musculus
taagctggtcctgggataacctgac

SEQ ID NO: 125090 - DNA, 25 bp, Mus musculus
taagctggtggactactaccggaca

SEQ ID NO: 125091 - DNA, 25 bp, Mus musculus
taagctgtctctcaacaggagggag

SEQ ID NO: 125092 - DNA, 25 bp, Mus musculus
taagctgtgcctcttttggtcgagc

SEQ ID NO: 125093 - DNA, 25 bp, Mus musculus
taagcttatctatctggtccctgag

SEQ ID NO: 125094 - DNA, 25 bp, Mus musculus
taagcttcgcgataaggagacacca

SEQ ID NO: 125095 - DNA, 25 bp, Mus musculus
taagcttctggttgctgagaggaca

SEQ ID NO: 125096 - DNA, 25 bp, Mus musculus
taagcttgaacacaccctgcagaag

SEQ ID NO: 125097 - DNA, 25 bp, Mus musculus
taagcttggatatcccagctctcgg

SEQ ID NO: 125098 - DNA, 25 bp, Mus musculus
taagcttggatttttgcgattgtcc

SEQ ID NO: 125099 - DNA, 25 bp, Mus musculus
taagcttggtttctgccgctgcagc

SEQ ID NO: 125100 - DNA, 25 bp, Mus musculus
taagcttgtctaaaatctgtgccga

SEQ ID NO: 125101 - DNA, 25 bp, Mus musculus
taagctttggacacaggtttgccct

SEQ ID NO: 125102 - DNA, 25 bp, Mus musculus
taagcttttcttcaactcagggcca

SEQ ID NO: 125103 - DNA, 25 bp, Mus musculus
taaggaaaatgtctcaccctgagtg

SEQ ID NO: 125104 - DNA, 25 bp, Mus musculus
taaggaaacaccacgcattggctag

SEQ ID NO: 125105 - DNA, 25 bp, Mus musculus
taaggaaacattgccctcacctggc

SEQ ID NO: 125106 - DNA, 25 bp, Mus musculus
taaggaaaccccagagtatcgctgc

SEQ ID NO: 125107 - DNA, 25 bp, Mus musculus
taaggaaacctcagctactggagtc

SEQ ID NO: 125108 - DNA, 25 bp, Mus musculus
taaggaaagctgacgctaccgacag

SEQ ID NO: 125109 - DNA, 25 bp, Mus musculus
taaggaaatgtgctgacgtcatcac

SEQ ID NO: 125110 - DNA, 25 bp, Mus musculus
taaggaaccacatattcgggagatg

SEQ ID NO: 125111 - DNA, 25 bp, Mus musculus
taaggaacctatcttgcagagcccc

SEQ ID NO: 125112 - DNA, 25 bp, Mus musculus
taaggaacctgtccagcttagacct

SEQ ID NO: 125113 - DNA, 25 bp, Mus musculus
taaggaactgagcaaactctctagc

SEQ ID NO: 125114 - DNA, 25 bp, Mus musculus
taaggaactttctccgtgagatcaa

SEQ ID NO: 125115 - DNA, 25 bp, Mus musculus
taaggaactttgactacactgctcg

SEQ ID NO: 125116 - DNA, 25 bp, Mus musculus
taaggaagaaaaaatcgatctgtct

SEQ ID NO: 125117 - DNA, 25 bp, Mus musculus
taaggaagaatgtctcatgttcgag

SEQ ID NO: 125118 - DNA, 25 bp, Mus musculus
taaggaagaccagggagtctccact

SEQ ID NO: 125119 - DNA, 25 bp, Mus musculus
taaggaagactgtcagaaaccaaac

SEQ ID NO: 125120 - DNA, 25 bp, Mus musculus
taaggaagccaagctggaccgttcg

SEQ ID NO: 125121 - DNA, 25 bp, Mus musculus
taaggaagcgctttgaggccacagc

SEQ ID NO: 125122 - DNA, 25 bp, Mus musculus
taaggaagctccaggtagtacacca

SEQ ID NO: 125123 - DNA, 25 bp, Mus musculus
taaggaaggttcgagccaaggagac

SEQ ID NO: 125124 - DNA, 25 bp, Mus musculus
taaggaatcaaggtccaacaaggat

SEQ ID NO: 125125 - DNA, 25 bp, Mus musculus
taaggaatcagcaatggccagtcag

SEQ ID NO: 125126 - DNA, 25 bp, Mus musculus
taaggaatgccatgcacacaggcct

SEQ ID NO: 125127 - DNA, 25 bp, Mus musculus
taaggaattgcaagcggaggctctc

SEQ ID NO: 125128 - DNA, 25 bp, Mus musculus
taaggacaacaccagtgacatcatg

SEQ ID NO: 125129 - DNA, 25 bp, Mus musculus
taaggacaatgacctggacctgctg

SEQ ID NO: 125130 - DNA, 25 bp, Mus musculus
taaggacaggtattggacaccatcc

SEQ ID NO: 125131 - DNA, 25 bp, Mus musculus
taaggacaggtcacggatgagcatc

SEQ ID NO: 125132 - DNA, 25 bp, Mus musculus
taaggaccagcatcgtagaaggttc

SEQ ID NO: 125133 - DNA, 25 bp, Mus musculus
taaggaccatgctagaaaacggaca

SEQ ID NO: 125134 - DNA, 25 bp, Mus musculus
taaggacctagactactcacagggc

SEQ ID NO: 125135 - DNA, 25 bp, Mus musculus
taaggacctcctgactgctgcagaa

SEQ ID NO: 125136 - DNA, 25 bp, Mus musculus
taaggacgtcaaaggctccagaggc

SEQ ID NO: 125137 - DNA, 25 bp, Mus musculus
taaggactaattctggcaccccttg

SEQ ID NO: 125138 - DNA, 25 bp, Mus musculus
taaggactcagactgcagatgccgt

SEQ ID NO: 125139 - DNA, 25 bp, Mus musculus
taaggactctgacagaaccgagccg

SEQ ID NO: 125140 - DNA, 25 bp, Mus musculus
taaggagaaacggacccatctgcgt

SEQ ID NO: 125141 - DNA, 25 bp, Mus musculus
taaggagaacacacttggcccatgg

SEQ ID NO: 125142 - DNA, 25 bp, Mus musculus
taaggagaacattccaccaagcagc

SEQ ID NO: 125143 - DNA, 25 bp, Mus musculus
taaggagaactacgcagactgcctc

SEQ ID NO: 125144 - DNA, 25 bp, Mus musculus
taaggagacacgaagccgctcatgt

SEQ ID NO: 125145 - DNA, 25 bp, Mus musculus
taaggagagaagtggaaatcaatac

SEQ ID NO: 125146 - DNA, 25 bp, Mus musculus
taaggagagactctttgcgcccggt

SEQ ID NO: 125147 - DNA, 25 bp, Mus musculus
taaggagagcctacggctgcatcct

SEQ ID NO: 125148 - DNA, 25 bp, Mus musculus
taaggagatgctgcccagcggcaga

SEQ ID NO: 125149 - DNA, 25 bp, Mus musculus
taaggagattaacaacgcacacgcc

SEQ ID NO: 125150 - DNA, 25 bp, Mus musculus
taaggagcaattctggcacaacacc

SEQ ID NO: 125151 - DNA, 25 bp, Mus musculus
taaggagccctctttacacctggac

SEQ ID NO: 125152 - DNA, 25 bp, Mus musculus
taaggagcctgcctatatccggtgc

SEQ ID NO: 125153 - DNA, 25 bp, Mus musculus
taaggagccttgaatccagccagga

SEQ ID NO: 125154 - DNA, 25 bp, Mus musculus
taaggagcgacctatggagcgaaga

SEQ ID NO: 125155 - DNA, 25 bp, Mus musculus
taaggagctccgagaaaaggccgaa

SEQ ID NO: 125156 - DNA, 25 bp, Mus musculus
taaggagctgtgttgaccaagagcc

SEQ ID NO: 125157 - DNA, 25 bp, Mus musculus
taaggaggacttagactcggccagt

SEQ ID NO: 125158 - DNA, 25 bp, Mus musculus
taaggaggctcggaaatgggccaca

SEQ ID NO: 125159 - DNA, 25 bp, Mus musculus
taaggagtccctcgatgtcatccct

SEQ ID NO: 125160 - DNA, 25 bp, Mus musculus
taaggagtgaacttgccaaaggccc

SEQ ID NO: 125161 - DNA, 25 bp, Mus musculus
taaggagtgcagctaccttgtccgg

SEQ ID NO: 125162 - DNA, 25 bp, Mus musculus
taaggagtgtgagctgccatagaca

SEQ ID NO: 125163 - DNA, 25 bp, Mus musculus
taaggatagtactcgcagttgcccg

SEQ ID NO: 125164 - DNA, 25 bp, Mus musculus
taaggatagtttcattgacagcagc

SEQ ID NO: 125165 - DNA, 25 bp, Mus musculus
taaggatatcgacctcagccctgtt

SEQ ID NO: 125166 - DNA, 25 bp, Mus musculus
taaggatccccatctccgaggtgta

SEQ ID NO: 125167 - DNA, 25 bp, Mus musculus
taaggatcgcttgacacagtggaat

SEQ ID NO: 125168 - DNA, 25 bp, Mus musculus
taaggatctgcatctgggaaaactg

SEQ ID NO: 125169 - DNA, 25 bp, Mus musculus
taaggatgaacgaacagtaacgcca

SEQ ID NO: 125170 - DNA, 25 bp, Mus musculus
taaggatgacaactgacgagggcac

SEQ ID NO: 125171 - DNA, 25 bp, Mus musculus
taaggatgacttacccagagggtgc

SEQ ID NO: 125172 - DNA, 25 bp, Mus musculus
taaggatgacttgcaagactggctc

SEQ ID NO: 125173 - DNA, 25 bp, Mus musculus
taaggatgagcaccgcggatctgat

SEQ ID NO: 125174 - DNA, 25 bp, Mus musculus
taaggatgatcccaaagccaaggag

SEQ ID NO: 125175 - DNA, 25 bp, Mus musculus
taaggatgattacaacgagaccgtc

SEQ ID NO: 125176 - DNA, 25 bp, Mus musculus
taaggatgcagtgatcaccgtgcca

SEQ ID NO: 125177 - DNA, 25 bp, Mus musculus
taaggatggactctaaccagagctg

SEQ ID NO: 125178 - DNA, 25 bp, Mus musculus
taaggatgtcagttttggcccacac

SEQ ID NO: 125179 - DNA, 25 bp, Mus musculus
taaggatgtggaaaaccagctctcc

SEQ ID NO: 125180 - DNA, 25 bp, Mus musculus
taaggatgttcgtcagcaggcggaa

SEQ ID NO: 125181 - DNA, 25 bp, Mus musculus
taaggatgttctgcaccgacactgc

SEQ ID NO: 125182 - DNA, 25 bp, Mus musculus
taaggattacagtgaggccgatggc

SEQ ID NO: 125183 - DNA, 25 bp, Mus musculus
taaggattcacagttccagataatt

SEQ ID NO: 125184 - DNA, 25 bp, Mus musculus
taaggattctaacagggacctgcac

SEQ ID NO: 125185 - DNA, 25 bp, Mus musculus
taaggatttccaactgcagcgagcc

SEQ ID NO: 125186 - DNA, 25 bp, Mus musculus
taaggatttggtccaggtcaggcca

SEQ ID NO: 125187 - DNA, 25 bp, Mus musculus
taaggcaaaccgaactagagaccca

SEQ ID NO: 125188 - DNA, 25 bp, Mus musculus
taaggcaagtgattggcctcagtgc

SEQ ID NO: 125189 - DNA, 25 bp, Mus musculus
taaggcaccttctgacgatggcagc

SEQ ID NO: 125190 - DNA, 25 bp, Mus musculus
taaggcagacttcgacgccaaagcg

SEQ ID NO: 125191 - DNA, 25 bp, Mus musculus
taaggcaggatttgacaggtccagg

SEQ ID NO: 125192 - DNA, 25 bp, Mus musculus
taaggcatatgcttgttcccagagg

SEQ ID NO: 125193 - DNA, 25 bp, Mus musculus
taaggccaacatcattgaggcgatt

SEQ ID NO: 125194 - DNA, 25 bp, Mus musculus
taaggccaagcatttatttgctgtc

SEQ ID NO: 125195 - DNA, 25 bp, Mus musculus
taaggccacatatagtccagctgat

SEQ ID NO: 125196 - DNA, 25 bp, Mus musculus
taaggccagcagagacccttcttca

SEQ ID NO: 125197 - DNA, 25 bp, Mus musculus
taaggccagctgttatatatcgatt

SEQ ID NO: 125198 - DNA, 25 bp, Mus musculus
taaggccagggtattctagccagct

SEQ ID NO: 125199 - DNA, 25 bp, Mus musculus
taaggccagtgcttccttcagggtg

SEQ ID NO: 125200 - DNA, 25 bp, Mus musculus
taaggccatgctggatcgtatccca

SEQ ID NO: 125201 - DNA, 25 bp, Mus musculus
taaggccatgtttcgcagagcgctg

SEQ ID NO: 125202 - DNA, 25 bp, Mus musculus
taaggccatttattaacgggtcagc

SEQ ID NO: 125203 - DNA, 25 bp, Mus musculus
taaggccccgtgttcaattgctggc

SEQ ID NO: 125204 - DNA, 25 bp, Mus musculus
taaggcccgattgcttcgagaaaag

SEQ ID NO: 125205 - DNA, 25 bp, Mus musculus
taaggccctgggtgtcatggatgac

SEQ ID NO: 125206 - DNA, 25 bp, Mus musculus
taaggccgaagtcaccaacggagag

SEQ ID NO: 125207 - DNA, 25 bp, Mus musculus
taaggccgtcatgaagattgagcac

SEQ ID NO: 125208 - DNA, 25 bp, Mus musculus
taaggcctatcatgcatatcgtgag

SEQ ID NO: 125209 - DNA, 25 bp, Mus musculus
taaggcctgagcatcagacgtgtgc

SEQ ID NO: 125210 - DNA, 25 bp, Mus musculus
taaggcctgatgaccttcagcgtgc

SEQ ID NO: 125211 - DNA, 25 bp, Mus musculus
taaggcctgcttgggtagcttggca

SEQ ID NO: 125212 - DNA, 25 bp, Mus musculus
taaggcctgttgtccaccagggtga

SEQ ID NO: 125213 - DNA, 25 bp, Mus musculus
taaggccttgctagaaaacggtgca

SEQ ID NO: 125214 - DNA, 25 bp, Mus musculus
taaggcgacttgtcccgcctcctgg

SEQ ID NO: 125215 - DNA, 25 bp, Mus musculus
taaggcggttaaaccacagcgtggc

SEQ ID NO: 125216 - DNA, 25 bp, Mus musculus
taaggcgtctcttcccctagaaggc

SEQ ID NO: 125217 - DNA, 25 bp, Mus musculus
taaggctatatcatacctgacagca

SEQ ID NO: 125218 - DNA, 25 bp, Mus musculus
taaggctccgttaagttcacaccag

SEQ ID NO: 125219 - DNA, 25 bp, Mus musculus
taaggctctatctgattgccagagt

SEQ ID NO: 125220 - DNA, 25 bp, Mus musculus
taaggctctgagcttgccctcttcg

SEQ ID NO: 125221 - DNA, 25 bp, Mus musculus
taaggctctggaccgacattggcac

SEQ ID NO: 125222 - DNA, 25 bp, Mus musculus
taaggctctggagacaacggtgctg

SEQ ID NO: 125223 - DNA, 25 bp, Mus musculus
taaggctctgttcgccagccaagag

SEQ ID NO: 125224 - DNA, 25 bp, Mus musculus
taaggctgcatttgggactcaggcc

SEQ ID NO: 125225 - DNA, 25 bp, Mus musculus
taaggctgctgacgcacatgtggat

SEQ ID NO: 125226 - DNA, 25 bp, Mus musculus
taaggctgctgcatgcatcaaacac

SEQ ID NO: 125227 - DNA, 25 bp, Mus musculus
taaggctgggttccaaaatacttgc

SEQ ID NO: 125228 - DNA, 25 bp, Mus musculus
taaggctgtagaagaacctccacaa

SEQ ID NO: 125229 - DNA, 25 bp, Mus musculus
taagggaacccctaagctacgctgg

SEQ ID NO: 125230 - DNA, 25 bp, Mus musculus
taagggaactacactggatctggct

SEQ ID NO: 125231 - DNA, 25 bp, Mus musculus
taagggaactcaattcccgactgga

SEQ ID NO: 125232 - DNA, 25 bp, Mus musculus
taagggaactgctgacggcgatgct

SEQ ID NO: 125233 - DNA, 25 bp, Mus musculus
taagggaattcagtgccgactgcag

SEQ ID NO: 125234 - DNA, 25 bp, Mus musculus
taagggacaccacatagaaattgcc

SEQ ID NO: 125235 - DNA, 25 bp, Mus musculus
taagggacctgcttctaatctgtgg

SEQ ID NO: 125236 - DNA, 25 bp, Mus musculus
taagggacgcatctaccatcagaga

SEQ ID NO: 125237 - DNA, 25 bp, Mus musculus
taagggacttgaaggatccacactc

SEQ ID NO: 125238 - DNA, 25 bp, Mus musculus
taagggagctgttttaggcagagcc

SEQ ID NO: 125239 - DNA, 25 bp, Mus musculus
taagggatacggtactgctgcgcaa

SEQ ID NO: 125240 - DNA, 25 bp, Mus musculus
taagggatcttgcagctatggatgc

SEQ ID NO: 125241 - DNA, 25 bp, Mus musculus
taagggatggcgtgatgtcactact

SEQ ID NO: 125242 - DNA, 25 bp, Mus musculus
taagggcacatgtcccatcagttgg

SEQ ID NO: 125243 - DNA, 25 bp, Mus musculus
taagggcagtgccagctaaactctg

SEQ ID NO: 125244 - DNA, 25 bp, Mus musculus
taagggcatcgcattgactcaggca

SEQ ID NO: 125245 - DNA, 25 bp, Mus musculus
taagggcatgtccaaaggatgccac

SEQ ID NO: 125246 - DNA, 25 bp, Mus musculus
taagggcattctcgtaggcatcaag

SEQ ID NO: 125247 - DNA, 25 bp, Mus musculus
taagggccgtccattccgtggcatg

SEQ ID NO: 125248 - DNA, 25 bp, Mus musculus
taagggccttggcatagatgtttct

SEQ ID NO: 125249 - DNA, 25 bp, Mus musculus
taagggcctttgaggacgatgccat

SEQ ID NO: 125250 - DNA, 25 bp, Mus musculus
taagggctacggcaggtttctcatc

SEQ ID NO: 125251 - DNA, 25 bp, Mus musculus
taagggctaggtgacagatggcacc

SEQ ID NO: 125252 - DNA, 25 bp, Mus musculus
taagggctcgtgcagaaatactgat

SEQ ID NO: 125253 - DNA, 25 bp, Mus musculus
taagggctctctccaaagtgcttcc

SEQ ID NO: 125254 - DNA, 25 bp, Mus musculus
taagggctgagctcgcggattcgct

SEQ ID NO: 125255 - DNA, 25 bp, Mus musculus
taagggtaggaaacaaacacagctc

SEQ ID NO: 125256 - DNA, 25 bp, Mus musculus
taagggtcatgtctctcacagcagg

SEQ ID NO: 125257 - DNA, 25 bp, Mus musculus
taagggtccctcgaaagatagacat

SEQ ID NO: 125258 - DNA, 25 bp, Mus musculus
taagggtccctctgagactaggcat

SEQ ID NO: 125259 - DNA, 25 bp, Mus musculus
taagggtgtttcacagacgatctgc

SEQ ID NO: 125260 - DNA, 25 bp, Mus musculus
taagggttcaaatgcccacgagcaa

SEQ ID NO: 125261 - DNA, 25 bp, Mus musculus
taaggtagatccagtgaagtgcccc

SEQ ID NO: 125262 - DNA, 25 bp, Mus musculus
taaggtataaccaaactgagtgccc

SEQ ID NO: 125263 - DNA, 25 bp, Mus musculus
taaggtattcagttgcccctactgg

SEQ ID NO: 125264 - DNA, 25 bp, Mus musculus
taaggtcaatcccttgatcctcgtg

SEQ ID NO: 125265 - DNA, 25 bp, Mus musculus
taaggtcgaagaagcggccaaagtc

SEQ ID NO: 125266 - DNA, 25 bp, Mus musculus
taaggtcggagtaggcaaggttatc

SEQ ID NO: 125267 - DNA, 25 bp, Mus musculus
taaggtgaagaagacccagcaggaa

SEQ ID NO: 125268 - DNA, 25 bp, Mus musculus
taaggtgaagtttcctaaggcccag

SEQ ID NO: 125269 - DNA, 25 bp, Mus musculus
taaggtgcatcggaagacgctgaac

SEQ ID NO: 125270 - DNA, 25 bp, Mus musculus
taaggtgcctaatctgcggagtggc

SEQ ID NO: 125271 - DNA, 25 bp, Mus musculus
taaggtgcctctaggcagcgtcagg

SEQ ID NO: 125272 - DNA, 25 bp, Mus musculus
taaggtggacgctcacacaagcaag

SEQ ID NO: 125273 - DNA, 25 bp, Mus musculus
taaggtggcagtgatcgcctccatt

SEQ ID NO: 125274 - DNA, 25 bp, Mus musculus
taaggtgtaatccagcggcagtcac

SEQ ID NO: 125275 - DNA, 25 bp, Mus musculus
taaggttaaatggacccacgaggag

SEQ ID NO: 125276 - DNA, 25 bp, Mus musculus
taaggttaatgtcacacggctgtgc

SEQ ID NO: 125277 - DNA, 25 bp, Mus musculus
taaggttataagctccatcttggca

SEQ ID NO: 125278 - DNA, 25 bp, Mus musculus
taaggttcaacctgtcgaggaggca

SEQ ID NO: 125279 - DNA, 25 bp, Mus musculus
taaggttcatctcttcatggccggt

SEQ ID NO: 125280 - DNA, 25 bp, Mus musculus
taaggttcctgaggtcaaactcccg

SEQ ID NO: 125281 - DNA, 25 bp, Mus musculus
taaggttcctgtcaatgtgttaaga

SEQ ID NO: 125282 - DNA, 25 bp, Mus musculus
taaggttctagcatgcaggaccgcc

SEQ ID NO: 125283 - DNA, 25 bp, Mus musculus
taaggttctcggcaccattcttcgc

SEQ ID NO: 125284 - DNA, 25 bp, Mus musculus
taaggttgaccaactgtcaggagaa

SEQ ID NO: 125285 - DNA, 25 bp, Mus musculus
taaggttgcctgaggtcaaagatgc

SEQ ID NO: 125286 - DNA, 25 bp, Mus musculus
taaggttggctttactgtacgcctg

SEQ ID NO: 125287 - DNA, 25 bp, Mus musculus
taaggttggtaacctgcaccaggta

SEQ ID NO: 125288 - DNA, 25 bp, Mus musculus
taaggttgtagcgtcaggaccagga

SEQ ID NO: 125289 - DNA, 25 bp, Mus musculus
taagtaaatcaggagcttccagccc

SEQ ID NO: 125290 - DNA, 25 bp, Mus musculus
taagtaacgccagagatccgaggag

SEQ ID NO: 125291 - DNA, 25 bp, Mus musculus
taagtaagagcccatagcacagcac

SEQ ID NO: 125292 - DNA, 25 bp, Mus musculus
taagtaagcacttctcaggtcccag

SEQ ID NO: 125293 - DNA, 25 bp, Mus musculus
taagtaagcctcagtaaaatctgcc

SEQ ID NO: 125294 - DNA, 25 bp, Mus musculus
taagtacaatcaacgtaggcctcac

SEQ ID NO: 125295 - DNA, 25 bp, Mus musculus
taagtacagcatggcctctcagtgg

SEQ ID NO: 125296 - DNA, 25 bp, Mus musculus
taagtacaggactaaagtgcctcca

SEQ ID NO: 125297 - DNA, 25 bp, Mus musculus
taagtacagtgagtgagtcagttca

SEQ ID NO: 125298 - DNA, 25 bp, Mus musculus
taagtacatcgtgacaggctcaggg

SEQ ID NO: 125299 - DNA, 25 bp, Mus musculus
taagtacatctctttgctgggcaag

SEQ ID NO: 125300 - DNA, 25 bp, Mus musculus
taagtaccaagcaaccatggcaggc

SEQ ID NO: 125301 - DNA, 25 bp, Mus musculus
taagtaccactattacggcctgcgg

SEQ ID NO: 125302 - DNA, 25 bp, Mus musculus
taagtaccgtgccaaggttgaccgg

SEQ ID NO: 125303 - DNA, 25 bp, Mus musculus
taagtacctggaggagtccgatgac

SEQ ID NO: 125304 - DNA, 25 bp, Mus musculus
taagtacgaatgcagtcttctggac

SEQ ID NO: 125305 - DNA, 25 bp, Mus musculus
taagtacgagcgagcttcgagaggc

SEQ ID NO: 125306 - DNA, 25 bp, Mus musculus
taagtacgatgaccggttgatgaag

SEQ ID NO: 125307 - DNA, 25 bp, Mus musculus
taagtacgcttggaaaccctcttgg

SEQ ID NO: 125308 - DNA, 25 bp, Mus musculus
taagtacggcagctctcacacagat

SEQ ID NO: 125309 - DNA, 25 bp, Mus musculus
taagtactaccggtctccatgggag

SEQ ID NO: 125310 - DNA, 25 bp, Mus musculus
taagtagaccctagatcacactggg

SEQ ID NO: 125311 - DNA, 25 bp, Mus musculus
taagtagctcagactcgggtgcaca

SEQ ID NO: 125312 - DNA, 25 bp, Mus musculus
taagtagctcttcccgctgtgtccg

SEQ ID NO: 125313 - DNA, 25 bp, Mus musculus
taagtagtaaccagtcaggcccttg

SEQ ID NO: 125314 - DNA, 25 bp, Mus musculus
taagtataattcacactccttggag

SEQ ID NO: 125315 - DNA, 25 bp, Mus musculus
taagtatagcatcgacctcagagca

SEQ ID NO: 125316 - DNA, 25 bp, Mus musculus
taagtatggattgtctgcacatccg

SEQ ID NO: 125317 - DNA, 25 bp, Mus musculus
taagtatggccaacagactctatgg

SEQ ID NO: 125318 - DNA, 25 bp, Mus musculus
taagtattttgtaccgcaagcccaa

SEQ ID NO: 125319 - DNA, 25 bp, Mus musculus
taagtcaagaaaacgatgctactgg

SEQ ID NO: 125320 - DNA, 25 bp, Mus musculus
taagtcaatcagagaacgacggcga

SEQ ID NO: 125321 - DNA, 25 bp, Mus musculus
taagtcactacgctgagaatcaagg

SEQ ID NO: 125322 - DNA, 25 bp, Mus musculus
taagtcaggacgactgcagctgcct

SEQ ID NO: 125323 - DNA, 25 bp, Mus musculus
taagtcaggctggacctccattgga

SEQ ID NO: 125324 - DNA, 25 bp, Mus musculus
taagtcatctcaagcacgtaaagtg

SEQ ID NO: 125325 - DNA, 25 bp, Mus musculus
taagtcattccctaggcaaaagcca

SEQ ID NO: 125326 - DNA, 25 bp, Mus musculus
taagtcccagtgctcagacacggag

SEQ ID NO: 125327 - DNA, 25 bp, Mus musculus
taagtccgcggcaccgctggaagct

SEQ ID NO: 125328 - DNA, 25 bp, Mus musculus
taagtccgggtcttccaaaatgtgc

SEQ ID NO: 125329 - DNA, 25 bp, Mus musculus
taagtcctcaaggtcacacaattag

SEQ ID NO: 125330 - DNA, 25 bp, Mus musculus
taagtcctgcaaggtcccagggcta

SEQ ID NO: 125331 - DNA, 25 bp, Mus musculus
taagtcgcacgtgttcagaagctgg

SEQ ID NO: 125332 - DNA, 25 bp, Mus musculus
taagtcggagaagccggaaagctgc

SEQ ID NO: 125333 - DNA, 25 bp, Mus musculus
taagtcgggccctgttgcctcagta

SEQ ID NO: 125334 - DNA, 25 bp, Mus musculus
taagtcggttctcttctcacagggc

SEQ ID NO: 125335 - DNA, 25 bp, Mus musculus
taagtctagaaacccatgtcctgtg

SEQ ID NO: 125336 - DNA, 25 bp, Mus musculus
taagtctcagcgatattccagcgtt

SEQ ID NO: 125337 - DNA, 25 bp, Mus musculus
taagtctcagctccgagatgacagc

SEQ ID NO: 125338 - DNA, 25 bp, Mus musculus
taagtctgacgctgtgtggagccag

SEQ ID NO: 125339 - DNA, 25 bp, Mus musculus
taagtctgcagacaggttgacgcca

SEQ ID NO: 125340 - DNA, 25 bp, Mus musculus
taagtctttaagctctgtgccaatg

SEQ ID NO: 125341 - DNA, 25 bp, Mus musculus
taagtgaagaggaattttactcgca

SEQ ID NO: 125342 - DNA, 25 bp, Mus musculus
taagtgaggccgacattgctgcctt

SEQ ID NO: 125343 - DNA, 25 bp, Mus musculus
taagtgatccggaattaagactcct

SEQ ID NO: 125344 - DNA, 25 bp, Mus musculus
taagtgatgaatatacccgcgcgtc

SEQ ID NO: 125345 - DNA, 25 bp, Mus musculus
taagtgcagaccgttgcctacaaga

SEQ ID NO: 125346 - DNA, 25 bp, Mus musculus
taagtgcagggaacatcactgcctg

SEQ ID NO: 125347 - DNA, 25 bp, Mus musculus
taagtgccccagtggcctagaatag

SEQ ID NO: 125348 - DNA, 25 bp, Mus musculus
taagtgcccctgaggcttggctggc

SEQ ID NO: 125349 - DNA, 25 bp, Mus musculus
taagtgcctgacaacaagggctgcc

SEQ ID NO: 125350 - DNA, 25 bp, Mus musculus
taagtgccttaagagagggtcgcca

SEQ ID NO: 125351 - DNA, 25 bp, Mus musculus
taagtgctatcaccatgaggaccgg

SEQ ID NO: 125352 - DNA, 25 bp, Mus musculus
taagtgctcgaatccgaaggagact

SEQ ID NO: 125353 - DNA, 25 bp, Mus musculus
taagtgctttgcagggctcctcaac

SEQ ID NO: 125354 - DNA, 25 bp, Mus musculus
taagtggaacagcaataaagaactg

SEQ ID NO: 125355 - DNA, 25 bp, Mus musculus
taagtggaatgcctctccaggacca

SEQ ID NO: 125356 - DNA, 25 bp, Mus musculus
taagtggatatacttgccttctgaa

SEQ ID NO: 125357 - DNA, 25 bp, Mus musculus
taagtggcaatgaagtgtactctct

SEQ ID NO: 125358 - DNA, 25 bp, Mus musculus
taagtggcattagcaatcctccagg

SEQ ID NO: 125359 - DNA, 25 bp, Mus musculus
taagtggccagattgctctacagtg

SEQ ID NO: 125360 - DNA, 25 bp, Mus musculus
taagtggccgctaagcaaaaactgc

SEQ ID NO: 125361 - DNA, 25 bp, Mus musculus
taagtggtgccgaaggaacgaagct

SEQ ID NO: 125362 - DNA, 25 bp, Mus musculus
taagtgtacagagccggaactgcct

SEQ ID NO: 125363 - DNA, 25 bp, Mus musculus
taagtgtagtcgaaagaaaaagcca

SEQ ID NO: 125364 - DNA, 25 bp, Mus musculus
taagtgtcagtgtccggcgtctggc

SEQ ID NO: 125365 - DNA, 25 bp, Mus musculus
taagtgtcccctgtgcagtcgtgtc

SEQ ID NO: 125366 - DNA, 25 bp, Mus musculus
taagtgtctggattgatacacacag

SEQ ID NO: 125367 - DNA, 25 bp, Mus musculus
taagtgtgaacgttctggctgccgg

SEQ ID NO: 125368 - DNA, 25 bp, Mus musculus
taagtgtgctgtctgcacctgcaag

SEQ ID NO: 125369 - DNA, 25 bp, Mus musculus
taagtgtgggcgacaagaaccctgg

SEQ ID NO: 125370 - DNA, 25 bp, Mus musculus
taagtgtgtgtatcggcccgagctg

SEQ ID NO: 125371 - DNA, 25 bp, Mus musculus
taagtgttaacatgccaggatcctc

SEQ ID NO: 125372 - DNA, 25 bp, Mus musculus
taagtgtttagcagcagctttgata

SEQ ID NO: 125373 - DNA, 25 bp, Mus musculus
taagttaacctcactcccactgtga

SEQ ID NO: 125374 - DNA, 25 bp, Mus musculus
taagttacaggtggtgtcaaacgca

SEQ ID NO: 125375 - DNA, 25 bp, Mus musculus
taagttacatctggccaaggtggga

SEQ ID NO: 125376 - DNA, 25 bp, Mus musculus
taagttacctctttcgagagcctgc

SEQ ID NO: 125377 - DNA, 25 bp, Mus musculus
taagttagtccaaggtgattccctc

SEQ ID NO: 125378 - DNA, 25 bp, Mus musculus
taagttatacaaaagcaagggtgcc

SEQ ID NO: 125379 - DNA, 25 bp, Mus musculus
taagttatgggttcctcacgccacc

SEQ ID NO: 125380 - DNA, 25 bp, Mus musculus
taagttcccagtcaagtggtgccca

SEQ ID NO: 125381 - DNA, 25 bp, Mus musculus
taagttccccattgaggacgccagc

SEQ ID NO: 125382 - DNA, 25 bp, Mus musculus
taagttccctcggtggcgggctcga

SEQ ID NO: 125383 - DNA, 25 bp, Mus musculus
taagttcctaccacaagagcaagcg

SEQ ID NO: 125384 - DNA, 25 bp, Mus musculus
taagttcctcaggagagttgctggc

SEQ ID NO: 125385 - DNA, 25 bp, Mus musculus
taagttcctgagcatccagtgccgg

SEQ ID NO: 125386 - DNA, 25 bp, Mus musculus
taagttcctgcacccacttctgggc

SEQ ID NO: 125387 - DNA, 25 bp, Mus musculus
taagttctccgctgtgccagatccc

SEQ ID NO: 125388 - DNA, 25 bp, Mus musculus
taagttctgtcagccacgggagtcg

SEQ ID NO: 125389 - DNA, 25 bp, Mus musculus
taagttgctaaaattccttggcggg

SEQ ID NO: 125390 - DNA, 25 bp, Mus musculus
taagttggaagtttcaattacgcta

SEQ ID NO: 125391 - DNA, 25 bp, Mus musculus
taagttggccctctagttatggaga

SEQ ID NO: 125392 - DNA, 25 bp, Mus musculus
taagtttaatccaagatgctggacg

SEQ ID NO: 125393 - DNA, 25 bp, Mus musculus
taagtttcagaagagcgagttggag

SEQ ID NO: 125394 - DNA, 25 bp, Mus musculus
taagtttgacttctcagtgatgtct

SEQ ID NO: 125395 - DNA, 25 bp, Mus musculus
taagtttgcgccaagtgcgcggcag

SEQ ID NO: 125396 - DNA, 25 bp, Mus musculus
taagtttgctccagtggctcctaaa

SEQ ID NO: 125397 - DNA, 25 bp, Mus musculus
taataaaaaggaccgcagtgactct

SEQ ID NO: 125398 - DNA, 25 bp, Mus musculus
taataaaatgaaatccatggccgcc

SEQ ID NO: 125399 - DNA, 25 bp, Mus musculus
taataaacacaggtagtgagcctgc

SEQ ID NO: 125400 - DNA, 25 bp, Mus musculus
taataaaccccttggctggaagagc

SEQ ID NO: 125401 - DNA, 25 bp, Mus musculus
taataaagcaaggaggtccactcgg

SEQ ID NO: 125402 - DNA, 25 bp, Mus musculus
taataaagctttagtgcgttcaccg

SEQ ID NO: 125403 - DNA, 25 bp, Mus musculus
taataaaggctactcctcgctggac

SEQ ID NO: 125404 - DNA, 25 bp, Mus musculus
taataaaggtaacacagcaggaagc

SEQ ID NO: 125405 - DNA, 25 bp, Mus musculus
taataaaggtctaggctgcagcagc

SEQ ID NO: 125406 - DNA, 25 bp, Mus musculus
taataaagttaaggcacagttgctc

SEQ ID NO: 125407 - DNA, 25 bp, Mus musculus
taataaatccatggacagtctggtc

SEQ ID NO: 125408 - DNA, 25 bp, Mus musculus
taataacagactggagaaccgcatg

SEQ ID NO: 125409 - DNA, 25 bp, Mus musculus
taataacagcctcattaggacaatg

SEQ ID NO: 125410 - DNA, 25 bp, Mus musculus
taataacagttacatgtttaaaagg

SEQ ID NO: 125411 - DNA, 25 bp, Mus musculus
taataacataattcacagggacgtg

SEQ ID NO: 125412 - DNA, 25 bp, Mus musculus
taataaccacacagcaaacgcctag

SEQ ID NO: 125413 - DNA, 25 bp, Mus musculus
taataaccgcttgggctcagcactc

SEQ ID NO: 125414 - DNA, 25 bp, Mus musculus
taataacctcagaaccagtgacagc

SEQ ID NO: 125415 - DNA, 25 bp, Mus musculus
taataacgccactggtcagtcccga

SEQ ID NO: 125416 - DNA, 25 bp, Mus musculus
taataactttggaactgtccgccgg

SEQ ID NO: 125417 - DNA, 25 bp, Mus musculus
taataagatccgaacaccagagaag

SEQ ID NO: 125418 - DNA, 25 bp, Mus musculus
taataagattgtggctgccttcagc

SEQ ID NO: 125419 - DNA, 25 bp, Mus musculus
taataagcagaaaagccatgacgac

SEQ ID NO: 125420 - DNA, 25 bp, Mus musculus
taataaggaacttgatcctgtacag

SEQ ID NO: 125421 - DNA, 25 bp, Mus musculus
taataagtgggagagcatgcctacc

SEQ ID NO: 125422 - DNA, 25 bp, Mus musculus
taataataaggctgcaaccggagag

SEQ ID NO: 125423 - DNA, 25 bp, Mus musculus
taataatggaatacctaggtggagg

SEQ ID NO: 125424 - DNA, 25 bp, Mus musculus
taataatggtcaaagccgagaccca

SEQ ID NO: 125425 - DNA, 25 bp, Mus musculus
taataatgtcaatgttggagcccgg

SEQ ID NO: 125426 - DNA, 25 bp, Mus musculus
taataattgacatacgacctgctcg

SEQ ID NO: 125427 - DNA, 25 bp, Mus musculus
taataattggaacatcctgcccctc

SEQ ID NO: 125428 - DNA, 25 bp, Mus musculus
taatacaaacagtcccaagtggaag

SEQ ID NO: 125429 - DNA, 25 bp, Mus musculus
taatacagcagttttcctaggccca

SEQ ID NO: 125430 - DNA, 25 bp, Mus musculus
taatacagtggttgtccgtcctcgg

SEQ ID NO: 125431 - DNA, 25 bp, Mus musculus
taatacagttcactgccgagaagct

SEQ ID NO: 125432 - DNA, 25 bp, Mus musculus
taatacatgctcttccctgtgagga

SEQ ID NO: 125433 - DNA, 25 bp, Mus musculus
taatacatttcgagctgcaccacct

SEQ ID NO: 125434 - DNA, 25 bp, Mus musculus
taataccaaagctacccatgcaagg

SEQ ID NO: 125435 - DNA, 25 bp, Mus musculus
taataccacggatagacagccagct

SEQ ID NO: 125436 - DNA, 25 bp, Mus musculus
taataccatggctgactgaacacct

SEQ ID NO: 125437 - DNA, 25 bp, Mus musculus
taatacctgctctgtgtttgggcct

SEQ ID NO: 125438 - DNA, 25 bp, Mus musculus
taatacgcagttgaaggtgccagtc

SEQ ID NO: 125439 - DNA, 25 bp, Mus musculus
taatactcgaactactacatgggag

SEQ ID NO: 125440 - DNA, 25 bp, Mus musculus
taatacttaatgcaaccctctagga

SEQ ID NO: 125441 - DNA, 25 bp, Mus musculus
taatagaaaagaagagacgagaccg

SEQ ID NO: 125442 - DNA, 25 bp, Mus musculus
taatagaaacaagttagccgggtgg

SEQ ID NO: 125443 - DNA, 25 bp, Mus musculus
taatagaaattctcacaggccaggc

SEQ ID NO: 125444 - DNA, 25 bp, Mus musculus
taatagacctcgtgtgccttactgg

SEQ ID NO: 125445 - DNA, 25 bp, Mus musculus
taatagagagtaagccagctcctgg

SEQ ID NO: 125446 - DNA, 25 bp, Mus musculus
taatagcaaagcagttacaggacag

SEQ ID NO: 125447 - DNA, 25 bp, Mus musculus
taatagcagcaatatccagtgacca

SEQ ID NO: 125448 - DNA, 25 bp, Mus musculus
taatagcagctttccagccaatggc

SEQ ID NO: 125449 - DNA, 25 bp, Mus musculus
taatagcattggattgggaaggagc

SEQ ID NO: 125450 - DNA, 25 bp, Mus musculus
taatagcgctcatcatgctcaaagc

SEQ ID NO: 125451 - DNA, 25 bp, Mus musculus
taatagctaggtcaaaggctccaga

SEQ ID NO: 125452 - DNA, 25 bp, Mus musculus
taatagctcccgtgagatctgggtc

SEQ ID NO: 125453 - DNA, 25 bp, Mus musculus
taatagctgtgtgcttccgaggtca

SEQ ID NO: 125454 - DNA, 25 bp, Mus musculus
taataggcacgaggctaagcagaga

SEQ ID NO: 125455 - DNA, 25 bp, Mus musculus
taataggttacagtgcgggccgtat

SEQ ID NO: 125456 - DNA, 25 bp, Mus musculus
taatagttccttttaggatctagac

SEQ ID NO: 125457 - DNA, 25 bp, Mus musculus
taatataaatacagtcatcgggctc

SEQ ID NO: 125458 - DNA, 25 bp, Mus musculus
taatataatgcctcagggcgtggcc

SEQ ID NO: 125459 - DNA, 25 bp, Mus musculus
taatatacccaagtgatgccatcgg

SEQ ID NO: 125460 - DNA, 25 bp, Mus musculus
taatatattacagcctgtgggcctg

SEQ ID NO: 125461 - DNA, 25 bp, Mus musculus
taatatcagggataaagaggctccg

SEQ ID NO: 125462 - DNA, 25 bp, Mus musculus
taatatgctgcgaaggtcaaaccca

SEQ ID NO: 125463 - DNA, 25 bp, Mus musculus
taatatggctccctcgcagcagagc

SEQ ID NO: 125464 - DNA, 25 bp, Mus musculus
taatattaacaactggaggaacggg

SEQ ID NO: 125465 - DNA, 25 bp, Mus musculus
taatattagtccatgggcggcagac

SEQ ID NO: 125466 - DNA, 25 bp, Mus musculus
taatatttcctggagttcgcgtggg

SEQ ID NO: 125467 - DNA, 25 bp, Mus musculus
taatatttgctggtgagactcatgc

SEQ ID NO: 125468 - DNA, 25 bp, Mus musculus
taatcaaaaatatcgcccgggtatc

SEQ ID NO: 125469 - DNA, 25 bp, Mus musculus
taatcaaaatggcaccaaagaaaga

SEQ ID NO: 125470 - DNA, 25 bp, Mus musculus
taatcaaaattatggacggatcttt

SEQ ID NO: 125471 - DNA, 25 bp, Mus musculus
taatcaaacttctttatgaaggtgg

SEQ ID NO: 125472 - DNA, 25 bp, Mus musculus
taatcaaagtccacgcctgcggtgt

SEQ ID NO: 125473 - DNA, 25 bp, Mus musculus
taatcaacccagtgatggaatgtcc

SEQ ID NO: 125474 - DNA, 25 bp, Mus musculus
taatcaagaacctcctaggcaagag

SEQ ID NO: 125475 - DNA, 25 bp, Mus musculus
taatcaagactgtcaccctcgtgct

SEQ ID NO: 125476 - DNA, 25 bp, Mus musculus
taatcaagatggtacgatgacggtc

SEQ ID NO: 125477 - DNA, 25 bp, Mus musculus
taatcaagctgtggcgacagacctg

SEQ ID NO: 125478 - DNA, 25 bp, Mus musculus
taatcaatatcaccatgggcatgcc

SEQ ID NO: 125479 - DNA, 25 bp, Mus musculus
taatcaatttggtgttggagcagca

SEQ ID NO: 125480 - DNA, 25 bp, Mus musculus
taatcaccacggatgcagcaggttc

SEQ ID NO: 125481 - DNA, 25 bp, Mus musculus
taatcactgggaagccgtctggtgc

SEQ ID NO: 125482 - DNA, 25 bp, Mus musculus
taatcagaaggtctacatgccccgc

SEQ ID NO: 125483 - DNA, 25 bp, Mus musculus
taatcagagtggaggaagtacagca

SEQ ID NO: 125484 - DNA, 25 bp, Mus musculus
taatcagatgtattgtgagacacca

SEQ ID NO: 125485 - DNA, 25 bp, Mus musculus
taatcagcagagtcgccttcctgcg

SEQ ID NO: 125486 - DNA, 25 bp, Mus musculus
taatcagcgaaaccacgtacagtgg

SEQ ID NO: 125487 - DNA, 25 bp, Mus musculus
taatcagctcatacctcctttggga

SEQ ID NO: 125488 - DNA, 25 bp, Mus musculus
taatcagcttgatttgcccagcaaa

SEQ ID NO: 125489 - DNA, 25 bp, Mus musculus
taatcaggactattggcttcagatg

SEQ ID NO: 125490 - DNA, 25 bp, Mus musculus
taatcaggaggtgatctctcgggcc

SEQ ID NO: 125491 - DNA, 25 bp, Mus musculus
taatcaggtgtatgtggctacagcc

SEQ ID NO: 125492 - DNA, 25 bp, Mus musculus
taatcataggtggtcgggatcagca

SEQ ID NO: 125493 - DNA, 25 bp, Mus musculus
taatcatcaggaggtcaagtccggc

SEQ ID NO: 125494 - DNA, 25 bp, Mus musculus
taatcatcggtgaaggaaacctgat

SEQ ID NO: 125495 - DNA, 25 bp, Mus musculus
taatcatctgcagactcgtgaggct

SEQ ID NO: 125496 - DNA, 25 bp, Mus musculus
taatcatgcatatactcccaaggag

SEQ ID NO: 125497 - DNA, 25 bp, Mus musculus
taatcatgtacacaagtgggtccac

SEQ ID NO: 125498 - DNA, 25 bp, Mus musculus
taatcattgcagtgttcagcccagt

SEQ ID NO: 125499 - DNA, 25 bp, Mus musculus
taatcattgtcaggcaccgagctgg

SEQ ID NO: 125500 - DNA, 25 bp, Mus musculus
taatcattgtcgtccaggctgtcga

SEQ ID NO: 125501 - DNA, 25 bp, Mus musculus
taatcattgtgtggtggctccgacc

SEQ ID NO: 125502 - DNA, 25 bp, Mus musculus
taatcatttcctacaagggtcccag

SEQ ID NO: 125503 - DNA, 25 bp, Mus musculus
taatcatttgtaacagctggaccag

SEQ ID NO: 125504 - DNA, 25 bp, Mus musculus
taatccaacagaatacggttcctgg

SEQ ID NO: 125505 - DNA, 25 bp, Mus musculus
taatccaagcaaaaaagtcctccgg

SEQ ID NO: 125506 - DNA, 25 bp, Mus musculus
taatccacacggtgcttcatggaga

SEQ ID NO: 125507 - DNA, 25 bp, Mus musculus
taatccagcaggctcgagagatgcc

SEQ ID NO: 125508 - DNA, 25 bp, Mus musculus
taatccagtgcctgtttgggccact

SEQ ID NO: 125509 - DNA, 25 bp, Mus musculus
taatccatagttgcccttgtgggcc

SEQ ID NO: 125510 - DNA, 25 bp, Mus musculus
taatccatttgcagagtacatgtgg

SEQ ID NO: 125511 - DNA, 25 bp, Mus musculus
taatcccaatgatcacgggtgagga

SEQ ID NO: 125512 - DNA, 25 bp, Mus musculus
taatcccagggactatggtagagac

SEQ ID NO: 125513 - DNA, 25 bp, Mus musculus
taatcccatggttctgagagctgcc

SEQ ID NO: 125514 - DNA, 25 bp, Mus musculus
taatcccctgttagacctgggtgcc

SEQ ID NO: 125515 - DNA, 25 bp, Mus musculus
taatcccggccgtcatctgggaaca

SEQ ID NO: 125516 - DNA, 25 bp, Mus musculus
taatccctatgaagtcactatgcca

SEQ ID NO: 125517 - DNA, 25 bp, Mus musculus
taatccgctttgctttcgaagaggg

SEQ ID NO: 125518 - DNA, 25 bp, Mus musculus
taatccggaagaggatccacctgag

SEQ ID NO: 125519 - DNA, 25 bp, Mus musculus
taatccggactggaaaacccataga

SEQ ID NO: 125520 - DNA, 25 bp, Mus musculus
taatccgggcaaaatcgagccccag

SEQ ID NO: 125521 - DNA, 25 bp, Mus musculus
taatccgttcagtgcttacaaggcc

SEQ ID NO: 125522 - DNA, 25 bp, Mus musculus
taatcctagatgttgggatgccggg

SEQ ID NO: 125523 - DNA, 25 bp, Mus musculus
taatcctattgtctgcagctctgtg

SEQ ID NO: 125524 - DNA, 25 bp, Mus musculus
taatcctgaggaaagcggtacattc

SEQ ID NO: 125525 - DNA, 25 bp, Mus musculus
taatcctgcccagtcatgccgaaga

SEQ ID NO: 125526 - DNA, 25 bp, Mus musculus
taatcctggccagtgcaggctccag

SEQ ID NO: 125527 - DNA, 25 bp, Mus musculus
taatcctgtgatcaaagcaactggt

SEQ ID NO: 125528 - DNA, 25 bp, Mus musculus
taatccttgccagagggtctccaaa

SEQ ID NO: 125529 - DNA, 25 bp, Mus musculus
taatcgaatttaccagaggcgaacg

SEQ ID NO: 125530 - DNA, 25 bp, Mus musculus
taatcgcacccgcaaatatggagcg

SEQ ID NO: 125531 - DNA, 25 bp, Mus musculus
taatcgcaggagtagttctaggccg

SEQ ID NO: 125532 - DNA, 25 bp, Mus musculus
taatcgccagcacaaaagttctgga

SEQ ID NO: 125533 - DNA, 25 bp, Mus musculus
taatcgcgcatcaacggagacgtac

SEQ ID NO: 125534 - DNA, 25 bp, Mus musculus
taatcgctcctaggactttggctac

SEQ ID NO: 125535 - DNA, 25 bp, Mus musculus
taatcgctcctgtaagccctgggca

SEQ ID NO: 125536 - DNA, 25 bp, Mus musculus
taatcgctgggatcatgaaagacag

SEQ ID NO: 125537 - DNA, 25 bp, Mus musculus
taatcggaaggagacggcgagcttc

SEQ ID NO: 125538 - DNA, 25 bp, Mus musculus
taatcggacattgcctgacactgtg

SEQ ID NO: 125539 - DNA, 25 bp, Mus musculus
taatcgggagctttctcagaagacc

SEQ ID NO: 125540 - DNA, 25 bp, Mus musculus
taatcgtaaagtactggctgccgcc

SEQ ID NO: 125541 - DNA, 25 bp, Mus musculus
taatcgtaagaacagtgaaggagct

SEQ ID NO: 125542 - DNA, 25 bp, Mus musculus
taatcgtaagccagatctccgcgtt

SEQ ID NO: 125543 - DNA, 25 bp, Mus musculus
taatcgtccttccagggaaaagcag

SEQ ID NO: 125544 - DNA, 25 bp, Mus musculus
taatcgtctgggtataaattgtctg

SEQ ID NO: 125545 - DNA, 25 bp, Mus musculus
taatcgtggcttagtatcaaacctg

SEQ ID NO: 125546 - DNA, 25 bp, Mus musculus
taatctacaccatcctcatctggga

SEQ ID NO: 125547 - DNA, 25 bp, Mus musculus
taatctacagtggtactcgacagga

SEQ ID NO: 125548 - DNA, 25 bp, Mus musculus
taatctactgactgctgacttccag

SEQ ID NO: 125549 - DNA, 25 bp, Mus musculus
taatctagggacgtcagaaggtcgc

SEQ ID NO: 125550 - DNA, 25 bp, Mus musculus
taatctatattgatgcccttggccg

SEQ ID NO: 125551 - DNA, 25 bp, Mus musculus
taatctatggaggacagtacaggct

SEQ ID NO: 125552 - DNA, 25 bp, Mus musculus
taatctcaaagcgaggtcaccggct

SEQ ID NO: 125553 - DNA, 25 bp, Mus musculus
taatctcacaaaagagcatcgctgt

SEQ ID NO: 125554 - DNA, 25 bp, Mus musculus
taatctcagacgaagcatcagcgac

SEQ ID NO: 125555 - DNA, 25 bp, Mus musculus
taatctcatagctaacacaaacgga

SEQ ID NO: 125556 - DNA, 25 bp, Mus musculus
taatctccaggtgttagaagccgag

SEQ ID NO: 125557 - DNA, 25 bp, Mus musculus
taatctccatgtggaccgggagcag

SEQ ID NO: 125558 - DNA, 25 bp, Mus musculus
taatctctgtagagggaagagccca

SEQ ID NO: 125559 - DNA, 25 bp, Mus musculus
taatctcttcattccgaggagcacc

SEQ ID NO: 125560 - DNA, 25 bp, Mus musculus
taatctcttgaagggaccgggagac

SEQ ID NO: 125561 - DNA, 25 bp, Mus musculus
taatctgaagcctgctggacgctgg

SEQ ID NO: 125562 - DNA, 25 bp, Mus musculus
taatctgagcatagaactgcgaggg

SEQ ID NO: 125563 - DNA, 25 bp, Mus musculus
taatctgatgtcgaaggataacctg

SEQ ID NO: 125564 - DNA, 25 bp, Mus musculus
taatctgccggagaatcttcaaggc

SEQ ID NO: 125565 - DNA, 25 bp, Mus musculus
taatctgccttctgatcagtccggg

SEQ ID NO: 125566 - DNA, 25 bp, Mus musculus
taatctgggctgtgtcgaggcctgc

SEQ ID NO: 125567 - DNA, 25 bp, Mus musculus
taatctgtaagtgcggcgcggcctc

SEQ ID NO: 125568 - DNA, 25 bp, Mus musculus
taatctgtcactgtggactcaggct

SEQ ID NO: 125569 - DNA, 25 bp, Mus musculus
taatctgtgccgtggctgctgcaag

SEQ ID NO: 125570 - DNA, 25 bp, Mus musculus
taatctgttcgacacaggaacctcc

SEQ ID NO: 125571 - DNA, 25 bp, Mus musculus
taatcttccaccttcccggactgga

SEQ ID NO: 125572 - DNA, 25 bp, Mus musculus
taatcttccagtgtgagcttgccta

SEQ ID NO: 125573 - DNA, 25 bp, Mus musculus
taatcttcggagatacagcctatat

SEQ ID NO: 125574 - DNA, 25 bp, Mus musculus
taatcttctgccaacgtcaggcctg

SEQ ID NO: 125575 - DNA, 25 bp, Mus musculus
taatcttggaatggctccactggga

SEQ ID NO: 125576 - DNA, 25 bp, Mus musculus
taatgaaacagaggtgcagccacag

SEQ ID NO: 125577 - DNA, 25 bp, Mus musculus
taatgaaaccgtgatggaaatcgtc

SEQ ID NO: 125578 - DNA, 25 bp, Mus musculus
taatgaaacctaccaggaacgcctg

SEQ ID NO: 125579 - DNA, 25 bp, Mus musculus
taatgaaagcaagtacacgtggagc

SEQ ID NO: 125580 - DNA, 25 bp, Mus musculus
taatgaaagctctctgaagtcctgt

SEQ ID NO: 125581 - DNA, 25 bp, Mus musculus
taatgaaatatggtgcagacccctc

SEQ ID NO: 125582 - DNA, 25 bp, Mus musculus
taatgaaattgaaagcctgggatcc

SEQ ID NO: 125583 - DNA, 25 bp, Mus musculus
taatgaacaactctcaaggccgggc

SEQ ID NO: 125584 - DNA, 25 bp, Mus musculus
taatgaacagagctctttcctcggg

SEQ ID NO: 125585 - DNA, 25 bp, Mus musculus
taatgaaccctgaagtctcctgatg

SEQ ID NO: 125586 - DNA, 25 bp, Mus musculus
taatgaaccttgaggagaaaccggc

SEQ ID NO: 125587 - DNA, 25 bp, Mus musculus
taatgaactcaacggacaggtgcct

SEQ ID NO: 125588 - DNA, 25 bp, Mus musculus
taatgaagagcctgcaggtcaagcc

SEQ ID NO: 125589 - DNA, 25 bp, Mus musculus
taatgaagccaagtatacagagcga

SEQ ID NO: 125590 - DNA, 25 bp, Mus musculus
taatgaagccacatggcactgggtg

SEQ ID NO: 125591 - DNA, 25 bp, Mus musculus
taatgaagccctgaagaggtaccgg

SEQ ID NO: 125592 - DNA, 25 bp, Mus musculus
taatgaagccgctcggagagtgact

SEQ ID NO: 125593 - DNA, 25 bp, Mus musculus
taatgaagctttgcaccgagaaagg

SEQ ID NO: 125594 - DNA, 25 bp, Mus musculus
taatgaaggccaaagcacaggctgc

SEQ ID NO: 125595 - DNA, 25 bp, Mus musculus
taatgaaggtgaccacataccgtgt

SEQ ID NO: 125596 - DNA, 25 bp, Mus musculus
taatgaatcaggctcaacaagggca

SEQ ID NO: 125597 - DNA, 25 bp, Mus musculus
taatgaatttcctgtacctgcttgg

SEQ ID NO: 125598 - DNA, 25 bp, Mus musculus
taatgacagattcagccggcggtcg

SEQ ID NO: 125599 - DNA, 25 bp, Mus musculus
taatgacagcagtgagacccgctct

SEQ ID NO: 125600 - DNA, 25 bp, Mus musculus
taatgacatgttccatgtgactggc

SEQ ID NO: 125601 - DNA, 25 bp, Mus musculus
taatgaccaggtagcaatcagctcc

SEQ ID NO: 125602 - DNA, 25 bp, Mus musculus
taatgacctgcctagtgtggagctg

SEQ ID NO: 125603 - DNA, 25 bp, Mus musculus
taatgacctggtattcctgcagcag

SEQ ID NO: 125604 - DNA, 25 bp, Mus musculus
taatgacgcagaaaagaggagtcct

SEQ ID NO: 125605 - DNA, 25 bp, Mus musculus
taatgacggtgcagactttccagag

SEQ ID NO: 125606 - DNA, 25 bp, Mus musculus
taatgactccttggttcaagtccag

SEQ ID NO: 125607 - DNA, 25 bp, Mus musculus
taatgactgtgatgactggagcgac

SEQ ID NO: 125608 - DNA, 25 bp, Mus musculus
taatgagaaacaacctatgccaaag

SEQ ID NO: 125609 - DNA, 25 bp, Mus musculus
taatgagaagcacgtctgtgacagc

SEQ ID NO: 125610 - DNA, 25 bp, Mus musculus
taatgagagcattggccaaggcgac

SEQ ID NO: 125611 - DNA, 25 bp, Mus musculus
taatgagagctacgatgcttgccag

SEQ ID NO: 125612 - DNA, 25 bp, Mus musculus
taatgagagggcaaagccggcttga

SEQ ID NO: 125613 - DNA, 25 bp, Mus musculus
taatgagcactgttcccagcggcaa

SEQ ID NO: 125614 - DNA, 25 bp, Mus musculus
taatgagcccacaagtttgctggaa

SEQ ID NO: 125615 - DNA, 25 bp, Mus musculus
taatgagcggctatacaagctcacg

SEQ ID NO: 125616 - DNA, 25 bp, Mus musculus
taatgagctatgaagttccggaatt

SEQ ID NO: 125617 - DNA, 25 bp, Mus musculus
taatgaggacatgcctcctgcagca

SEQ ID NO: 125618 - DNA, 25 bp, Mus musculus
taatgaggctagagcacagggttcc

SEQ ID NO: 125619 - DNA, 25 bp, Mus musculus
taatgaggtcaatccagaacttctg

SEQ ID NO: 125620 - DNA, 25 bp, Mus musculus
taatgagtgtgatgcgagtacccct

SEQ ID NO: 125621 - DNA, 25 bp, Mus musculus
taatgataaaggattctccacccca

SEQ ID NO: 125622 - DNA, 25 bp, Mus musculus
taatgataggtggacagagtagccc

SEQ ID NO: 125623 - DNA, 25 bp, Mus musculus
taatgatcgggaaacatggcggtcc

SEQ ID NO: 125624 - DNA, 25 bp, Mus musculus
taatgatctgtgtccgcagtagccg

SEQ ID NO: 125625 - DNA, 25 bp, Mus musculus
taatgatgaagaccccaagacactc

SEQ ID NO: 125626 - DNA, 25 bp, Mus musculus
taatgatgacctcaagacctgctcc

SEQ ID NO: 125627 - DNA, 25 bp, Mus musculus
taatgatgagcacccagcttacctg

SEQ ID NO: 125628 - DNA, 25 bp, Mus musculus
taatgatgccaattggttcaggaaa

SEQ ID NO: 125629 - DNA, 25 bp, Mus musculus
taatgatgctaagtgggcagacgac

SEQ ID NO: 125630 - DNA, 25 bp, Mus musculus
taatgatggatctacagaggactca

SEQ ID NO: 125631 - DNA, 25 bp, Mus musculus
taatgattagctgagccctcggagg

SEQ ID NO: 125632 - DNA, 25 bp, Mus musculus
taatgatttttatagcacctggact

SEQ ID NO: 125633 - DNA, 25 bp, Mus musculus
taatgcaaaggaagacgctgcttgg

SEQ ID NO: 125634 - DNA, 25 bp, Mus musculus
taatgcaaggctggaacaacatcgg

SEQ ID NO: 125635 - DNA, 25 bp, Mus musculus
taatgcacgccatcctcagaatgga

SEQ ID NO: 125636 - DNA, 25 bp, Mus musculus
taatgcacggtgtcctactgaaaca

SEQ ID NO: 125637 - DNA, 25 bp, Mus musculus
taatgcagcccatgggtaagtgtgg

SEQ ID NO: 125638 - DNA, 25 bp, Mus musculus
taatgcagcctagaagcaatggttc

SEQ ID NO: 125639 - DNA, 25 bp, Mus musculus
taatgcaggatacccacaagcagct

SEQ ID NO: 125640 - DNA, 25 bp, Mus musculus
taatgcaggcccgatgctgcctgaa

SEQ ID NO: 125641 - DNA, 25 bp, Mus musculus
taatgcaggcctcagacagcctggt

SEQ ID NO: 125642 - DNA, 25 bp, Mus musculus
taatgcatgcaggactacggaacct

SEQ ID NO: 125643 - DNA, 25 bp, Mus musculus
taatgcattgttccactgagggaca

SEQ ID NO: 125644 - DNA, 25 bp, Mus musculus
taatgccaagtaccaggtagtaccc

SEQ ID NO: 125645 - DNA, 25 bp, Mus musculus
taatgccacttgcttcaggagtgcc

SEQ ID NO: 125646 - DNA, 25 bp, Mus musculus
taatgccaggaagagtacagcggcc

SEQ ID NO: 125647 - DNA, 25 bp, Mus musculus
taatgccatatgtgctctacgtgga

SEQ ID NO: 125648 - DNA, 25 bp, Mus musculus
taatgccgccttcaatgtgaccgtg

SEQ ID NO: 125649 - DNA, 25 bp, Mus musculus
taatgcctcacgtttcgtcaaagag

SEQ ID NO: 125650 - DNA, 25 bp, Mus musculus
taatgcctctgacaatgctgggcgc

SEQ ID NO: 125651 - DNA, 25 bp, Mus musculus
taatgcctgctaactctggaccaca

SEQ ID NO: 125652 - DNA, 25 bp, Mus musculus
taatgcctggtaggatcccatgggc

SEQ ID NO: 125653 - DNA, 25 bp, Mus musculus
taatgcgattctttggctctggact

SEQ ID NO: 125654 - DNA, 25 bp, Mus musculus
taatgcgctaaccagacgagagagg

SEQ ID NO: 125655 - DNA, 25 bp, Mus musculus
taatgcgcttctacaagccccggat

SEQ ID NO: 125656 - DNA, 25 bp, Mus musculus
taatgcggctcaatatttccaccag

SEQ ID NO: 125657 - DNA, 25 bp, Mus musculus
taatgcgtcagtttctaagcggcct

SEQ ID NO: 125658 - DNA, 25 bp, Mus musculus
taatgcgtcgaagcactgtgagcct

SEQ ID NO: 125659 - DNA, 25 bp, Mus musculus
taatgcgtgaactaaccaacctgtg

SEQ ID NO: 125660 - DNA, 25 bp, Mus musculus
taatgctactatcttctacagtgac

SEQ ID NO: 125661 - DNA, 25 bp, Mus musculus
taatgctcactgtacggataagacc

SEQ ID NO: 125662 - DNA, 25 bp, Mus musculus
taatgctcatactccaagaacgatc

SEQ ID NO: 125663 - DNA, 25 bp, Mus musculus
taatgctgaaatgctgggcttggct

SEQ ID NO: 125664 - DNA, 25 bp, Mus musculus
taatgctgacctgataatgctccca

SEQ ID NO: 125665 - DNA, 25 bp, Mus musculus
taatgctgccactgactgagggctc

SEQ ID NO: 125666 - DNA, 25 bp, Mus musculus
taatgctggagctagtggcactgac

SEQ ID NO: 125667 - DNA, 25 bp, Mus musculus
taatgctggtctacgtgtggagccg

SEQ ID NO: 125668 - DNA, 25 bp, Mus musculus
taatgctggtctcacggatgctcct

SEQ ID NO: 125669 - DNA, 25 bp, Mus musculus
taatgctgtgtctcacgtaaccaga

SEQ ID NO: 125670 - DNA, 25 bp, Mus musculus
taatgcttacaaggctcagcgggag

SEQ ID NO: 125671 - DNA, 25 bp, Mus musculus
taatgcttatggatcccagagtgac

SEQ ID NO: 125672 - DNA, 25 bp, Mus musculus
taatgcttccgctcagaaaagtgac

SEQ ID NO: 125673 - DNA, 25 bp, Mus musculus
taatggaaaaatcgcagccctgaca

SEQ ID NO: 125674 - DNA, 25 bp, Mus musculus
taatggaaacggaagggctctcagc

SEQ ID NO: 125675 - DNA, 25 bp, Mus musculus
taatggaaccatcagaaaccggagg

SEQ ID NO: 125676 - DNA, 25 bp, Mus musculus
taatggaactgcacctgaagagaag

SEQ ID NO: 125677 - DNA, 25 bp, Mus musculus
taatggaagccatccaacaagcgtc

SEQ ID NO: 125678 - DNA, 25 bp, Mus musculus
taatggaatacctaggtggaggttc

SEQ ID NO: 125679 - DNA, 25 bp, Mus musculus
taatggaattctcagtctatcaaga

SEQ ID NO: 125680 - DNA, 25 bp, Mus musculus
taatggacaacctctggatggactg

SEQ ID NO: 125681 - DNA, 25 bp, Mus musculus
taatggacttcgatgcactggtgca

SEQ ID NO: 125682 - DNA, 25 bp, Mus musculus
taatggagaagaatcacagcggcgt

SEQ ID NO: 125683 - DNA, 25 bp, Mus musculus
taatggagaccaacaaggactggac

SEQ ID NO: 125684 - DNA, 25 bp, Mus musculus
taatggagccagagtgacatgcatc

SEQ ID NO: 125685 - DNA, 25 bp, Mus musculus
taatggagcccacagaatattcaga

SEQ ID NO: 125686 - DNA, 25 bp, Mus musculus
taatggaggccgtggtgaacaacca

SEQ ID NO: 125687 - DNA, 25 bp, Mus musculus
taatggagtccactagaccagggtg

SEQ ID NO: 125688 - DNA, 25 bp, Mus musculus
taatggagtccttcgtacagcgcac

SEQ ID NO: 125689 - DNA, 25 bp, Mus musculus
taatggatacaaggacagagcagac

SEQ ID NO: 125690 - DNA, 25 bp, Mus musculus
taatggatgcaacctgagacctggg

SEQ ID NO: 125691 - DNA, 25 bp, Mus musculus
taatggattgactggagatctagaa

SEQ ID NO: 125692 - DNA, 25 bp, Mus musculus
taatggatttgacaagcaactaccc

SEQ ID NO: 125693 - DNA, 25 bp, Mus musculus
taatggcaaagctactacaacttgg

SEQ ID NO: 125694 - DNA, 25 bp, Mus musculus
taatggcaaatttcccctctgagag

SEQ ID NO: 125695 - DNA, 25 bp, Mus musculus
taatggcaagtcatacgggtgggtc

SEQ ID NO: 125696 - DNA, 25 bp, Mus musculus
taatggcacccaggcgattgggacc

SEQ ID NO: 125697 - DNA, 25 bp, Mus musculus
taatggcagctccttaatggttctg

SEQ ID NO: 125698 - DNA, 25 bp, Mus musculus
taatggcagtccagggttcgactac

SEQ ID NO: 125699 - DNA, 25 bp, Mus musculus
taatggcagtggctatggaagccca

SEQ ID NO: 125700 - DNA, 25 bp, Mus musculus
taatggccagcttctacagtacgtc

SEQ ID NO: 125701 - DNA, 25 bp, Mus musculus
taatggcccaaataccaatggatct

SEQ ID NO: 125702 - DNA, 25 bp, Mus musculus
taatggccggtggattggaaagcca

SEQ ID NO: 125703 - DNA, 25 bp, Mus musculus
taatggccttgctctggttcagtcg

SEQ ID NO: 125704 - DNA, 25 bp, Mus musculus
taatggcgacgatgggacccatgac

SEQ ID NO: 125705 - DNA, 25 bp, Mus musculus
taatggctcgcagcctactggacct

SEQ ID NO: 125706 - DNA, 25 bp, Mus musculus
taatggctcgcggtaccttctggga

SEQ ID NO: 125707 - DNA, 25 bp, Mus musculus
taatggctgagaatcccaggaacag

SEQ ID NO: 125708 - DNA, 25 bp, Mus musculus
taatggcttagccactcctgggcag

SEQ ID NO: 125709 - DNA, 25 bp, Mus musculus
taatggctttagcaacgggccttct

SEQ ID NO: 125710 - DNA, 25 bp, Mus musculus
taatgggacataaggcagcgccctc

SEQ ID NO: 125711 - DNA, 25 bp, Mus musculus
taatgggaccgtcaagctggctgac

SEQ ID NO: 125712 - DNA, 25 bp, Mus musculus
taatgggatgaagctgacagaaccc

SEQ ID NO: 125713 - DNA, 25 bp, Mus musculus
taatgggccagtatcatctcacggt

SEQ ID NO: 125714 - DNA, 25 bp, Mus musculus
taatgggcccctggatttggtgttc

SEQ ID NO: 125715 - DNA, 25 bp, Mus musculus
taatgggcctgcctaccacaggcaa

SEQ ID NO: 125716 - DNA, 25 bp, Mus musculus
taatgggcgtatctcagggctaact

SEQ ID NO: 125717 - DNA, 25 bp, Mus musculus
taatgggctacccagatagacctgg

SEQ ID NO: 125718 - DNA, 25 bp, Mus musculus
taatgggctttcaagaggcagtcca

SEQ ID NO: 125719 - DNA, 25 bp, Mus musculus
taatgggtaacctcgatctggtcca

SEQ ID NO: 125720 - DNA, 25 bp, Mus musculus
taatgggtggaactacaaatcagcg

SEQ ID NO: 125721 - DNA, 25 bp, Mus musculus
taatgggttcagtgaggtggctacc

SEQ ID NO: 125722 - DNA, 25 bp, Mus musculus
taatggtacacgatgcctcaaagag

SEQ ID NO: 125723 - DNA, 25 bp, Mus musculus
taatggtacctgctttacagccggc

SEQ ID NO: 125724 - DNA, 25 bp, Mus musculus
taatggtcagcaagacccagaaagc

SEQ ID NO: 125725 - DNA, 25 bp, Mus musculus
taatggtcctaacagtcttcactgc

SEQ ID NO: 125726 - DNA, 25 bp, Mus musculus
taatggtgacatcgctttgaagaag

SEQ ID NO: 125727 - DNA, 25 bp, Mus musculus
taatggtgaccacaggataggcatc

SEQ ID NO: 125728 - DNA, 25 bp, Mus musculus
taatggtgagctgtaccacgaacag

SEQ ID NO: 125729 - DNA, 25 bp, Mus musculus
taatggtgatgcaggtgtcatgaag

SEQ ID NO: 125730 - DNA, 25 bp, Mus musculus
taatggtgcagtcatccctgtgcgc

SEQ ID NO: 125731 - DNA, 25 bp, Mus musculus
taatggtggcactgtatgctccgag

SEQ ID NO: 125732 - DNA, 25 bp, Mus musculus
taatggtggctcataagaagtcgga

SEQ ID NO: 125733 - DNA, 25 bp, Mus musculus
taatggtggtgggtcatgtagcccc

SEQ ID NO: 125734 - DNA, 25 bp, Mus musculus
taatggtgtacctcagcaactgcct

SEQ ID NO: 125735 - DNA, 25 bp, Mus musculus
taatgtacaatagctcctcgagtgc

SEQ ID NO: 125736 - DNA, 25 bp, Mus musculus
taatgtacctgcaaatggcgcttcc

SEQ ID NO: 125737 - DNA, 25 bp, Mus musculus
taatgtagtgctctcctaggaaccc

SEQ ID NO: 125738 - DNA, 25 bp, Mus musculus
taatgtatagtctcctgatgtctgc

SEQ ID NO: 125739 - DNA, 25 bp, Mus musculus
taatgtcaagttcaggttaccctcc

SEQ ID NO: 125740 - DNA, 25 bp, Mus musculus
taatgtcagatgttccagagtgcct

SEQ ID NO: 125741 - DNA, 25 bp, Mus musculus
taatgtcatcgtttgggatccgtcc

SEQ ID NO: 125742 - DNA, 25 bp, Mus musculus
taatgtccataagatccaacccagc

SEQ ID NO: 125743 - DNA, 25 bp, Mus musculus
taatgtcccgcactgactccaagtc

SEQ ID NO: 125744 - DNA, 25 bp, Mus musculus
taatgtccgagtgtcaagtctcacg

SEQ ID NO: 125745 - DNA, 25 bp, Mus musculus
taatgtcctgtacagccgttcttct

SEQ ID NO: 125746 - DNA, 25 bp, Mus musculus
taatgtcgcctagcaagcgtagctc

SEQ ID NO: 125747 - DNA, 25 bp, Mus musculus
taatgtcggctgtgagtctaaggag

SEQ ID NO: 125748 - DNA, 25 bp, Mus musculus
taatgtctcccaagaggctatcgcc

SEQ ID NO: 125749 - DNA, 25 bp, Mus musculus
taatgtgaagggaacaacactcccc

SEQ ID NO: 125750 - DNA, 25 bp, Mus musculus
taatgtgagacctcactcaccggct

SEQ ID NO: 125751 - DNA, 25 bp, Mus musculus
taatgtgagcttctcagatactgtc

SEQ ID NO: 125752 - DNA, 25 bp, Mus musculus
taatgtgcacaagcatgagcccctc

SEQ ID NO: 125753 - DNA, 25 bp, Mus musculus
taatgtgcaccaacaactagggcgc

SEQ ID NO: 125754 - DNA, 25 bp, Mus musculus
taatgtgcagatcaaccgaagcccc

SEQ ID NO: 125755 - DNA, 25 bp, Mus musculus
taatgtgcagggtcaaagtccctca

SEQ ID NO: 125756 - DNA, 25 bp, Mus musculus
taatgtgccgatatccccggtggag

SEQ ID NO: 125757 - DNA, 25 bp, Mus musculus
taatgtgcgtgagtcgagccagaac

SEQ ID NO: 125758 - DNA, 25 bp, Mus musculus
taatgtggatctttttctctggaga

SEQ ID NO: 125759 - DNA, 25 bp, Mus musculus
taatgtggcaactgtaccccaagga

SEQ ID NO: 125760 - DNA, 25 bp, Mus musculus
taatgtggcccagagtagctgacgc

SEQ ID NO: 125761 - DNA, 25 bp, Mus musculus
taatgtggctgcttatgactaagga

SEQ ID NO: 125762 - DNA, 25 bp, Mus musculus
taatgtgggcctgaacatgagagcc

SEQ ID NO: 125763 - DNA, 25 bp, Mus musculus
taatgtgttccagacggtgtcacgc

SEQ ID NO: 125764 - DNA, 25 bp, Mus musculus
taatgttaaaccctaggacagtgtc

SEQ ID NO: 125765 - DNA, 25 bp, Mus musculus
taatgttaaggagcatcagccagtg

SEQ ID NO: 125766 - DNA, 25 bp, Mus musculus
taatgttcccagaaaaaaggcgaag

SEQ ID NO: 125767 - DNA, 25 bp, Mus musculus
taatgttcggaacgcggctctctct

SEQ ID NO: 125768 - DNA, 25 bp, Mus musculus
taatgttctcgagaaactcagactc

SEQ ID NO: 125769 - DNA, 25 bp, Mus musculus
taatgttcttatggaggccgtcagc

SEQ ID NO: 125770 - DNA, 25 bp, Mus musculus
taatgttggccttcagtggtagcag

SEQ ID NO: 125771 - DNA, 25 bp, Mus musculus
taatgtttcacaagctccaatcggt

SEQ ID NO: 125772 - DNA, 25 bp, Mus musculus
taattaaagcatggcaggtggaggc

SEQ ID NO: 125773 - DNA, 25 bp, Mus musculus
taattaacgatgtgcctcttctggc

SEQ ID NO: 125774 - DNA, 25 bp, Mus musculus
taattaagaaggaacattacctgcc

SEQ ID NO: 125775 - DNA, 25 bp, Mus musculus
taattaaggcgaagttgaaccaggg

SEQ ID NO: 125776 - DNA, 25 bp, Mus musculus
taattaagtcaaggagcccctcggc

SEQ ID NO: 125777 - DNA, 25 bp, Mus musculus
taattaagtgcccaaagagcacgaa

SEQ ID NO: 125778 - DNA, 25 bp, Mus musculus
taattaatacttggctgaactggag

SEQ ID NO: 125779 - DNA, 25 bp, Mus musculus
taattacaagagcttccttggtggg

SEQ ID NO: 125780 - DNA, 25 bp, Mus musculus
taattacactgggatcgcagatgcc

SEQ ID NO: 125781 - DNA, 25 bp, Mus musculus
taattacggagaagtcagactctct

SEQ ID NO: 125782 - DNA, 25 bp, Mus musculus
taattacgtggaagtcattgtgcct

SEQ ID NO: 125783 - DNA, 25 bp, Mus musculus
taattactaccactacaggccatct

SEQ ID NO: 125784 - DNA, 25 bp, Mus musculus
taattactgtccagcggcagctacc

SEQ ID NO: 125785 - DNA, 25 bp, Mus musculus
taattagatacctctgtgtgccagc

SEQ ID NO: 125786 - DNA, 25 bp, Mus musculus
taattagcctagagtggtggcacac

SEQ ID NO: 125787 - DNA, 25 bp, Mus musculus
taattataatgaaagtcgggatccc

SEQ ID NO: 125788 - DNA, 25 bp, Mus musculus
taattatcctgaggagactccaggg

SEQ ID NO: 125789 - DNA, 25 bp, Mus musculus
taattatgaaaaacggcagcaccgc

SEQ ID NO: 125790 - DNA, 25 bp, Mus musculus
taattatgaatcctccctttgggac

SEQ ID NO: 125791 - DNA, 25 bp, Mus musculus
taattatgggaccactcagaggcat

SEQ ID NO: 125792 - DNA, 25 bp, Mus musculus
taattatgggagatacattgtctat

SEQ ID NO: 125793 - DNA, 25 bp, Mus musculus
taattcaagaaaagtgccagaggtg

SEQ ID NO: 125794 - DNA, 25 bp, Mus musculus
taattcagaggaaaagcaagccctt

SEQ ID NO: 125795 - DNA, 25 bp, Mus musculus
taattcagctgctagttcgtccaga

SEQ ID NO: 125796 - DNA, 25 bp, Mus musculus
taattcaggactgttgtgacctacc

SEQ ID NO: 125797 - DNA, 25 bp, Mus musculus
taattcagtgaccttgtaggcccag

SEQ ID NO: 125798 - DNA, 25 bp, Mus musculus
taattccaactggagcagtggaccc

SEQ ID NO: 125799 - DNA, 25 bp, Mus musculus
taattccacctactgaagacaactg

SEQ ID NO: 125800 - DNA, 25 bp, Mus musculus
taattccacggaacaccagtgcatg

SEQ ID NO: 125801 - DNA, 25 bp, Mus musculus
taattccagtgcttctggattggac

SEQ ID NO: 125802 - DNA, 25 bp, Mus musculus
taattccgacatcatccctacagac

SEQ ID NO: 125803 - DNA, 25 bp, Mus musculus
taattcctcgcagaagagggagccg

SEQ ID NO: 125804 - DNA, 25 bp, Mus musculus
taattcgcacgaaacaccttttggc

SEQ ID NO: 125805 - DNA, 25 bp, Mus musculus
taattcgttcggttttccaggccag

SEQ ID NO: 125806 - DNA, 25 bp, Mus musculus
taattctcacggtgggccttgctgc

SEQ ID NO: 125807 - DNA, 25 bp, Mus musculus
taattctgacttgcgagagcctgcc

SEQ ID NO: 125808 - DNA, 25 bp, Mus musculus
taattcttacacatggagcatcagg

SEQ ID NO: 125809 - DNA, 25 bp, Mus musculus
taattgaacactcagaagatccagc

SEQ ID NO: 125810 - DNA, 25 bp, Mus musculus
taattgacaatctggctgctggcct

SEQ ID NO: 125811 - DNA, 25 bp, Mus musculus
taattgacagctcggttccagcagc

SEQ ID NO: 125812 - DNA, 25 bp, Mus musculus
taattgacccagaataggaagatgg

SEQ ID NO: 125813 - DNA, 25 bp, Mus musculus
taattgacgaaagctcccagactgg

SEQ ID NO: 125814 - DNA, 25 bp, Mus musculus
taattgagaaactggaggttgtcac

SEQ ID NO: 125815 - DNA, 25 bp, Mus musculus
taattgagaacgacctgctgcagag

SEQ ID NO: 125816 - DNA, 25 bp, Mus musculus
taattgagaccactcgaggacttct

SEQ ID NO: 125817 - DNA, 25 bp, Mus musculus
taattgagaccctttgtgccctggg

SEQ ID NO: 125818 - DNA, 25 bp, Mus musculus
taattgagactacagcccaggcctg

SEQ ID NO: 125819 - DNA, 25 bp, Mus musculus
taattgagcacgactcgacctggga

SEQ ID NO: 125820 - DNA, 25 bp, Mus musculus
taattgatgggcaaacactctccaa

SEQ ID NO: 125821 - DNA, 25 bp, Mus musculus
taattgatgtggcacccaccggagc

SEQ ID NO: 125822 - DNA, 25 bp, Mus musculus
taattgcacggattaccaagctcgc

SEQ ID NO: 125823 - DNA, 25 bp, Mus musculus
taattgcagcatgggtacacgtggg

SEQ ID NO: 125824 - DNA, 25 bp, Mus musculus
taattgcctggatctggtaaacaga

SEQ ID NO: 125825 - DNA, 25 bp, Mus musculus
taattgctaccccttcatcatcagc

SEQ ID NO: 125826 - DNA, 25 bp, Mus musculus
taattggacacaaacaggaggctgc

SEQ ID NO: 125827 - DNA, 25 bp, Mus musculus
taattggacccagtggttgctgcca

SEQ ID NO: 125828 - DNA, 25 bp, Mus musculus
taattggagagaacatgacttgaag

SEQ ID NO: 125829 - DNA, 25 bp, Mus musculus
taattggagtcatctgtttagcaac

SEQ ID NO: 125830 - DNA, 25 bp, Mus musculus
taattggcaacaaggcagacctgcc

SEQ ID NO: 125831 - DNA, 25 bp, Mus musculus
taattggccctgcttttgcccgagg

SEQ ID NO: 125832 - DNA, 25 bp, Mus musculus
taattggctgcttcgtatatccgca

SEQ ID NO: 125833 - DNA, 25 bp, Mus musculus
taattggcttgaagatgcacccggt

SEQ ID NO: 125834 - DNA, 25 bp, Mus musculus
taattgggccagtttctcgcagacc

SEQ ID NO: 125835 - DNA, 25 bp, Mus musculus
taattgggccccagcaacagtttct

SEQ ID NO: 125836 - DNA, 25 bp, Mus musculus
taattgggtcttcactgttcctcag

SEQ ID NO: 125837 - DNA, 25 bp, Mus musculus
taattggtctccactgctcaggcca

SEQ ID NO: 125838 - DNA, 25 bp, Mus musculus
taattggtctcgctggacacgtgca

SEQ ID NO: 125839 - DNA, 25 bp, Mus musculus
taattggtgcccttcaaaatgccga

SEQ ID NO: 125840 - DNA, 25 bp, Mus musculus
taattggtggctacgatggccgttc

SEQ ID NO: 125841 - DNA, 25 bp, Mus musculus
taattggtgggcgacaacccttctg

SEQ ID NO: 125842 - DNA, 25 bp, Mus musculus
taattggtttgctaatcgacggaag

SEQ ID NO: 125843 - DNA, 25 bp, Mus musculus
taattgtacaagcagttggtcaccc

SEQ ID NO: 125844 - DNA, 25 bp, Mus musculus
taattgtcaccaaagccttaactcg

SEQ ID NO: 125845 - DNA, 25 bp, Mus musculus
taattgtctcaaaggaatgcttgat

SEQ ID NO: 125846 - DNA, 25 bp, Mus musculus
taattgtgcctttgaagaagtcgcg

SEQ ID NO: 125847 - DNA, 25 bp, Mus musculus
taattgtggcatctcagaagcgacc

SEQ ID NO: 125848 - DNA, 25 bp, Mus musculus
taattgtggtgagttccgtgacccc

SEQ ID NO: 125849 - DNA, 25 bp, Mus musculus
taattgttaaggaagacagcccact

SEQ ID NO: 125850 - DNA, 25 bp, Mus musculus
taattgttcaggacttattgttcac

SEQ ID NO: 125851 - DNA, 25 bp, Mus musculus
taattgttcatcatcaagccggcga

SEQ ID NO: 125852 - DNA, 25 bp, Mus musculus
taattgttgacccacagaggcagac

SEQ ID NO: 125853 - DNA, 25 bp, Mus musculus
taattgttgattgtaacagtcatca

SEQ ID NO: 125854 - DNA, 25 bp, Mus musculus
taatttaaagcgagctgcagttccc

SEQ ID NO: 125855 - DNA, 25 bp, Mus musculus
taatttaccgttggaagactggatg

SEQ ID NO: 125856 - DNA, 25 bp, Mus musculus
taatttactaagtgccctagagacc

SEQ ID NO: 125857 - DNA, 25 bp, Mus musculus
taatttaggcaaaggctcccgtctg

SEQ ID NO: 125858 - DNA, 25 bp, Mus musculus
taatttagtgtgttccacccgcctg

SEQ ID NO: 125859 - DNA, 25 bp, Mus musculus
taatttcaacaaccgaggaagcctg

SEQ ID NO: 125860 - DNA, 25 bp, Mus musculus
taatttcaatggacacggtggacca

SEQ ID NO: 125861 - DNA, 25 bp, Mus musculus
taatttcagtgagcccaatccagag

SEQ ID NO: 125862 - DNA, 25 bp, Mus musculus
taatttccaagtgctgacgcgggtc

SEQ ID NO: 125863 - DNA, 25 bp, Mus musculus
taatttccactgcttccggaaggcc

SEQ ID NO: 125864 - DNA, 25 bp, Mus musculus
taatttccagaagatagccttgaag

SEQ ID NO: 125865 - DNA, 25 bp, Mus musculus
taatttccccagagcgtcttgatcc

SEQ ID NO: 125866 - DNA, 25 bp, Mus musculus
taatttccgaaatcccagtgtgctg

SEQ ID NO: 125867 - DNA, 25 bp, Mus musculus
taatttcgcagagaagggcaccaag

SEQ ID NO: 125868 - DNA, 25 bp, Mus musculus
taatttcggtatccagtgaaggcca

SEQ ID NO: 125869 - DNA, 25 bp, Mus musculus
taatttctgaaaagcccagagaggg

SEQ ID NO: 125870 - DNA, 25 bp, Mus musculus
taatttctgatttgcagcagtcctg

SEQ ID NO: 125871 - DNA, 25 bp, Mus musculus
taatttgacacgtgcctgggctgag

SEQ ID NO: 125872 - DNA, 25 bp, Mus musculus
taatttgcagagtcagtttaacctg

SEQ ID NO: 125873 - DNA, 25 bp, Mus musculus
taatttgttgtccatactccgcgcc

SEQ ID NO: 125874 - DNA, 25 bp, Mus musculus
taattttaattacctctcacggcgc

SEQ ID NO: 125875 - DNA, 25 bp, Mus musculus
taattttagcgtagatctgggcagg

SEQ ID NO: 125876 - DNA, 25 bp, Mus musculus
taattttggagtcgtgcccagcaac

SEQ ID NO: 125877 - DNA, 25 bp, Mus musculus
tacaaaaaatgtgacctgaggctct

SEQ ID NO: 125878 - DNA, 25 bp, Mus musculus
tacaaaacagaaccgaaggtctgcc

SEQ ID NO: 125879 - DNA, 25 bp, Mus musculus
tacaaaactgcttctgccggcaaac

SEQ ID NO: 125880 - DNA, 25 bp, Mus musculus
tacaaaagagatggcagtgtgtggc

SEQ ID NO: 125881 - DNA, 25 bp, Mus musculus
tacaaaagagcgttgatgccggctg

SEQ ID NO: 125882 - DNA, 25 bp, Mus musculus
tacaaaagcggcaacacccatatgg

SEQ ID NO: 125883 - DNA, 25 bp, Mus musculus
tacaaaaggaattcggagctgcagg

SEQ ID NO: 125884 - DNA, 25 bp, Mus musculus
tacaaaaggcaatgggtctctaagg

SEQ ID NO: 125885 - DNA, 25 bp, Mus musculus
tacaaaaggctcgtgaatggacagc

SEQ ID NO: 125886 - DNA, 25 bp, Mus musculus
tacaaaagggcttaactccaggagc

SEQ ID NO: 125887 - DNA, 25 bp, Mus musculus
tacaaaagtgtatatggctcgcatt

SEQ ID NO: 125888 - DNA, 25 bp, Mus musculus
tacaaaatatcatagccagccgggc

SEQ ID NO: 125889 - DNA, 25 bp, Mus musculus
tacaaaatccttttccttgatgtcc

SEQ ID NO: 125890 - DNA, 25 bp, Mus musculus
tacaaaatgcctgcgatgaggccat

SEQ ID NO: 125891 - DNA, 25 bp, Mus musculus
tacaaaatgttacagcacgagcccg

SEQ ID NO: 125892 - DNA, 25 bp, Mus musculus
tacaaacaacgcaacgaggacttcc

SEQ ID NO: 125893 - DNA, 25 bp, Mus musculus
tacaaacagaggtggaaggctacgc

SEQ ID NO: 125894 - DNA, 25 bp, Mus musculus
tacaaacatctgctacaacgtgctg

SEQ ID NO: 125895 - DNA, 25 bp, Mus musculus
tacaaacatggaacggagcaaggtc

SEQ ID NO: 125896 - DNA, 25 bp, Mus musculus
tacaaaccacatagcgcttcctggg

SEQ ID NO: 125897 - DNA, 25 bp, Mus musculus
tacaaaccactgacttaagccaagt

SEQ ID NO: 125898 - DNA, 25 bp, Mus musculus
tacaaaccccagatgtggaaacccg

SEQ ID NO: 125899 - DNA, 25 bp, Mus musculus
tacaaacggtctgcagcacttggcc

SEQ ID NO: 125900 - DNA, 25 bp, Mus musculus
tacaaactagtatgggaatggctgc

SEQ ID NO: 125901 - DNA, 25 bp, Mus musculus
tacaaactcaggacagaagccacgg

SEQ ID NO: 125902 - DNA, 25 bp, Mus musculus
tacaaactccttggagggcttgcgg

SEQ ID NO: 125903 - DNA, 25 bp, Mus musculus
tacaaactgatcctgaagagctgag

SEQ ID NO: 125904 - DNA, 25 bp, Mus musculus
tacaaactgctcagcactgaaggag

SEQ ID NO: 125905 - DNA, 25 bp, Mus musculus
tacaaactggcccttactgaccgtg

SEQ ID NO: 125906 - DNA, 25 bp, Mus musculus
tacaaactgtccttgaaagtggcag

SEQ ID NO: 125907 - DNA, 25 bp, Mus musculus
tacaaactttgccaatctgcctgga

SEQ ID NO: 125908 - DNA, 25 bp, Mus musculus
tacaaagaagtctgcagaggaaagc

SEQ ID NO: 125909 - DNA, 25 bp, Mus musculus
tacaaagaagtttcgcagcgctggc

SEQ ID NO: 125910 - DNA, 25 bp, Mus musculus
tacaaagacaacaatcgacacggag

SEQ ID NO: 125911 - DNA, 25 bp, Mus musculus
tacaaagacagatgagtgtggcccc

SEQ ID NO: 125912 - DNA, 25 bp, Mus musculus
tacaaagactgctgaaggctatcgc

SEQ ID NO: 125913 - DNA, 25 bp, Mus musculus
tacaaagatgtgctgaagacgcccc

SEQ ID NO: 125914 - DNA, 25 bp, Mus musculus
tacaaagatgtgtctgaggacttca

SEQ ID NO: 125915 - DNA, 25 bp, Mus musculus
tacaaagcctaagatgagcgcaagt

SEQ ID NO: 125916 - DNA, 25 bp, Mus musculus
tacaaagcggaactggatccccgcc

SEQ ID NO: 125917 - DNA, 25 bp, Mus musculus
tacaaagcgggagacctggtcttcg

SEQ ID NO: 125918 - DNA, 25 bp, Mus musculus
tacaaagctgaatgcgacccagacc

SEQ ID NO: 125919 - DNA, 25 bp, Mus musculus
tacaaaggagaggacaactgctgct

SEQ ID NO: 125920 - DNA, 25 bp, Mus musculus
tacaaaggcaccatgcgggaagctg

SEQ ID NO: 125921 - DNA, 25 bp, Mus musculus
tacaaaggccttatctccatggagg

SEQ ID NO: 125922 - DNA, 25 bp, Mus musculus
tacaaaggcgcaagaaagggctcct

SEQ ID NO: 125923 - DNA, 25 bp, Mus musculus
tacaaaggcgtctatagcactcagg

SEQ ID NO: 125924 - DNA, 25 bp, Mus musculus
tacaaagggaatctctggtccagac

SEQ ID NO: 125925 - DNA, 25 bp, Mus musculus
tacaaaggtagattgccaggcagcc

SEQ ID NO: 125926 - DNA, 25 bp, Mus musculus
tacaaagtatcagcagaagtccagt

SEQ ID NO: 125927 - DNA, 25 bp, Mus musculus
tacaaagtcctcattggtaaccggg

SEQ ID NO: 125928 - DNA, 25 bp, Mus musculus
tacaaagtgacgtacaagacagtga

SEQ ID NO: 125929 - DNA, 25 bp, Mus musculus
tacaaagtgagctggaagccccagg

SEQ ID NO: 125930 - DNA, 25 bp, Mus musculus
tacaaagtggttgcttcgagggcaa

SEQ ID NO: 125931 - DNA, 25 bp, Mus musculus
tacaaagttccagatcgcaacctgg

SEQ ID NO: 125932 - DNA, 25 bp, Mus musculus
tacaaataagatgacgacctcctgg

SEQ ID NO: 125933 - DNA, 25 bp, Mus musculus
tacaaatccaactatcggcccctgg

SEQ ID NO: 125934 - DNA, 25 bp, Mus musculus
tacaaatctgattccgggaagcctt

SEQ ID NO: 125935 - DNA, 25 bp, Mus musculus
tacaaatgaccatcaattgcttggc

SEQ ID NO: 125936 - DNA, 25 bp, Mus musculus
tacaaatgactaggcgcctgtccgc

SEQ ID NO: 125937 - DNA, 25 bp, Mus musculus
tacaaatgactgaagcagaagtccg

SEQ ID NO: 125938 - DNA, 25 bp, Mus musculus
tacaaatgggagaatttcaagctcg

SEQ ID NO: 125939 - DNA, 25 bp, Mus musculus
tacaaattacggaaagagccagcga

SEQ ID NO: 125940 - DNA, 25 bp, Mus musculus
tacaaattatgagttggtcagagcc

SEQ ID NO: 125941 - DNA, 25 bp, Mus musculus
tacaaattcacctgcacacaatggg

SEQ ID NO: 125942 - DNA, 25 bp, Mus musculus
tacaaattgggagctgttccgaccc

SEQ ID NO: 125943 - DNA, 25 bp, Mus musculus
tacaacaaagtcatcggctgcaacg

SEQ ID NO: 125944 - DNA, 25 bp, Mus musculus
tacaacaacatctcggacctgagcc

SEQ ID NO: 125945 - DNA, 25 bp, Mus musculus
tacaacaacggcgacatctacgagg

SEQ ID NO: 125946 - DNA, 25 bp, Mus musculus
tacaacaagagcaaggctggctggc

SEQ ID NO: 125947 - DNA, 25 bp, Mus musculus
tacaacaagtggtctcggccagtag

SEQ ID NO: 125948 - DNA, 25 bp, Mus musculus
tacaacagtgctgtgatggagtctc

SEQ ID NO: 125949 - DNA, 25 bp, Mus musculus
tacaacatcaagtcgcgcttcacag

SEQ ID NO: 125950 - DNA, 25 bp, Mus musculus
tacaacatcgtagaagcagaggtcc

SEQ ID NO: 125951 - DNA, 25 bp, Mus musculus
tacaacatgctacgcctgacagaag

SEQ ID NO: 125952 - DNA, 25 bp, Mus musculus
tacaacatggtctttcccgaatggg

SEQ ID NO: 125953 - DNA, 25 bp, Mus musculus
tacaacattaatgcggtgcctgaag

SEQ ID NO: 125954 - DNA, 25 bp, Mus musculus
tacaacattgaggaaggtgactgcc

SEQ ID NO: 125955 - DNA, 25 bp, Mus musculus
tacaacattgatagaaccagtggcc

SEQ ID NO: 125956 - DNA, 25 bp, Mus musculus
tacaaccaaagatgtccaaaaggct

SEQ ID NO: 125957 - DNA, 25 bp, Mus musculus
tacaaccaacgagtcaagcatctct

SEQ ID NO: 125958 - DNA, 25 bp, Mus musculus
tacaaccacgttgacaaggacacac

SEQ ID NO: 125959 - DNA, 25 bp, Mus musculus
tacaaccaggatcatgagaaactct

SEQ ID NO: 125960 - DNA, 25 bp, Mus musculus
tacaaccagggaagacaagagaact

SEQ ID NO: 125961 - DNA, 25 bp, Mus musculus
tacaaccccaaaacagagatgcttt

SEQ ID NO: 125962 - DNA, 25 bp, Mus musculus
tacaacccctatgtggagtgccagg

SEQ ID NO: 125963 - DNA, 25 bp, Mus musculus
tacaacccgtggatggtaccatgtc

SEQ ID NO: 125964 - DNA, 25 bp, Mus musculus
tacaaccgtgaagccagaagacgcg

SEQ ID NO: 125965 - DNA, 25 bp, Mus musculus
tacaaccgtgtattatattggctgg

SEQ ID NO: 125966 - DNA, 25 bp, Mus musculus
tacaacctacagcagtggagaatcc

SEQ ID NO: 125967 - DNA, 25 bp, Mus musculus
tacaacctcaagaagagcatcgggc

SEQ ID NO: 125968 - DNA, 25 bp, Mus musculus
tacaacctgaaagatgaggagggcc

SEQ ID NO: 125969 - DNA, 25 bp, Mus musculus
tacaacctggaagtgatcggaggac

SEQ ID NO: 125970 - DNA, 25 bp, Mus musculus
tacaacctgggttgggaagctccct

SEQ ID NO: 125971 - DNA, 25 bp, Mus musculus
tacaaccttcaggaggccaaagtct

SEQ ID NO: 125972 - DNA, 25 bp, Mus musculus
tacaacgcctctaagtgggaactca

SEQ ID NO: 125973 - DNA, 25 bp, Mus musculus
tacaacgcgctcacctgtgagggct

SEQ ID NO: 125974 - DNA, 25 bp, Mus musculus
tacaacgcggtggtacccacgggtg

SEQ ID NO: 125975 - DNA, 25 bp, Mus musculus
tacaacgctcgggttaaggccttca

SEQ ID NO: 125976 - DNA, 25 bp, Mus musculus
tacaacgctgctaggctcgtagaag

SEQ ID NO: 125977 - DNA, 25 bp, Mus musculus
tacaacgctttactcacctggatgg

SEQ ID NO: 125978 - DNA, 25 bp, Mus musculus
tacaacggacaaccagcaagaggag

SEQ ID NO: 125979 - DNA, 25 bp, Mus musculus
tacaacggatcactacacaggtggc

SEQ ID NO: 125980 - DNA, 25 bp, Mus musculus
tacaacggctgtgtagacaggacag

SEQ ID NO: 125981 - DNA, 25 bp, Mus musculus
tacaacggctgtgtgtttcatagaa

SEQ ID NO: 125982 - DNA, 25 bp, Mus musculus
tacaacggcttcctggagatcatga

SEQ ID NO: 125983 - DNA, 25 bp, Mus musculus
tacaactacacatatgcacccgagg

SEQ ID NO: 125984 - DNA, 25 bp, Mus musculus
tacaactacgtcgtaacggcgcaga

SEQ ID NO: 125985 - DNA, 25 bp, Mus musculus
tacaactagagctagccggagctgg

SEQ ID NO: 125986 - DNA, 25 bp, Mus musculus
tacaactagtgagatggacccgtcc

SEQ ID NO: 125987 - DNA, 25 bp, Mus musculus
tacaactatactggaggctgatgca

SEQ ID NO: 125988 - DNA, 25 bp, Mus musculus
tacaactcaaaaggacagcagctgc

SEQ ID NO: 125989 - DNA, 25 bp, Mus musculus
tacaactcggatcgcaaacggttca

SEQ ID NO: 125990 - DNA, 25 bp, Mus musculus
tacaactctaggctctgggcatggg

SEQ ID NO: 125991 - DNA, 25 bp, Mus musculus
tacaactcttctgatccttggcggg

SEQ ID NO: 125992 - DNA, 25 bp, Mus musculus
tacaactgctacaagggctacctgc

SEQ ID NO: 125993 - DNA, 25 bp, Mus musculus
tacaactgctatggaagccctggcc

SEQ ID NO: 125994 - DNA, 25 bp, Mus musculus
tacaactgggaacgtctcggatctt

SEQ ID NO: 125995 - DNA, 25 bp, Mus musculus
tacaacttagcatgggaccctcaag

SEQ ID NO: 125996 - DNA, 25 bp, Mus musculus
tacaacttggactgtagcccaacca

SEQ ID NO: 125997 - DNA, 25 bp, Mus musculus
tacaactttcccgagctggacgtgc

SEQ ID NO: 125998 - DNA, 25 bp, Mus musculus
tacaactttgatgtgactaaaggga

SEQ ID NO: 125999 - DNA, 25 bp, Mus musculus
tacaagaaaatcaaggactttgccc

SEQ ID NO: 126000 - DNA, 25 bp, Mus musculus
tacaagaaaattgcttcacgaaggg

SEQ ID NO: 126001 - DNA, 25 bp, Mus musculus
tacaagaaatgctgcgtacaccgtg

SEQ ID NO: 126002 - DNA, 25 bp, Mus musculus
tacaagaaccatggcacagacagct

SEQ ID NO: 126003 - DNA, 25 bp, Mus musculus
tacaagaacgtgaagacatggaggc

SEQ ID NO: 126004 - DNA, 25 bp, Mus musculus
tacaagaacgtgaggaaacagccca

SEQ ID NO: 126005 - DNA, 25 bp, Mus musculus
tacaagaagaaagctctgaccagtg

SEQ ID NO: 126006 - DNA, 25 bp, Mus musculus
tacaagaagaagaacccctgcagga

SEQ ID NO: 126007 - DNA, 25 bp, Mus musculus
tacaagaagaaggactacacgcagg

SEQ ID NO: 126008 - DNA, 25 bp, Mus musculus
tacaagaagcaagtgatatggccct

SEQ ID NO: 126009 - DNA, 25 bp, Mus musculus
tacaagaaggctccgagaacagcag

SEQ ID NO: 126010 - DNA, 25 bp, Mus musculus
tacaagaagtggagctcagaaggcc

SEQ ID NO: 126011 - DNA, 25 bp, Mus musculus
tacaagaatattatgaaacaggtgc

SEQ ID NO: 126012 - DNA, 25 bp, Mus musculus
tacaagaatcatgtgcgcatccata

SEQ ID NO: 126013 - DNA, 25 bp, Mus musculus
tacaagaatgtagggagcgctcagc

SEQ ID NO: 126014 - DNA, 25 bp, Mus musculus
tacaagacaagatacagcagccctg

SEQ ID NO: 126015 - DNA, 25 bp, Mus musculus
tacaagacctatgtgggcggcattc

SEQ ID NO: 126016 - DNA, 25 bp, Mus musculus
tacaagactaccacaagctggccct

SEQ ID NO: 126017 - DNA, 25 bp, Mus musculus
tacaagactcaagtgagctgctgcc

SEQ ID NO: 126018 - DNA, 25 bp, Mus musculus
tacaagagactagaagggcttcagg

SEQ ID NO: 126019 - DNA, 25 bp, Mus musculus
tacaagagcatgatcctggaagacc

SEQ ID NO: 126020 - DNA, 25 bp, Mus musculus
tacaagagcccatggcaatgtccag

SEQ ID NO: 126021 - DNA, 25 bp, Mus musculus
tacaagagccgagaagagtccagtg

SEQ ID NO: 126022 - DNA, 25 bp, Mus musculus
tacaagagctgtgcgcagaactgga

SEQ ID NO: 126023 - DNA, 25 bp, Mus musculus
tacaagagctttccaaggcagaagg

SEQ ID NO: 126024 - DNA, 25 bp, Mus musculus
tacaagaggacactaggacatcatg

SEQ ID NO: 126025 - DNA, 25 bp, Mus musculus
tacaagaggacctaccagaccttcc

SEQ ID NO: 126026 - DNA, 25 bp, Mus musculus
tacaagatcgtgattgcgggcaacc

SEQ ID NO: 126027 - DNA, 25 bp, Mus musculus
tacaagatctgccagtcggagctca

SEQ ID NO: 126028 - DNA, 25 bp, Mus musculus
tacaagatgaactagaaacccgctc

SEQ ID NO: 126029 - DNA, 25 bp, Mus musculus
tacaagatggtcaagctggctgcac

SEQ ID NO: 126030 - DNA, 25 bp, Mus musculus
tacaagatgtaagagctctcctcgg

SEQ ID NO: 126031 - DNA, 25 bp, Mus musculus
tacaagattctaggtggttccgtcc

SEQ ID NO: 126032 - DNA, 25 bp, Mus musculus
tacaagcaaggcaaagcacctggct

SEQ ID NO: 126033 - DNA, 25 bp, Mus musculus
tacaagcaagttaggctccgacgtc

SEQ ID NO: 126034 - DNA, 25 bp, Mus musculus
tacaagcacatctttggaagcaaga

SEQ ID NO: 126035 - DNA, 25 bp, Mus musculus
tacaagcagactcaaaggagaagcc

SEQ ID NO: 126036 - DNA, 25 bp, Mus musculus
tacaagcagtcagttctcagcaggg

SEQ ID NO: 126037 - DNA, 25 bp, Mus musculus
tacaagcagttctgtgtgcctggct

SEQ ID NO: 126038 - DNA, 25 bp, Mus musculus
tacaagcattcccacgaaggagact

SEQ ID NO: 126039 - DNA, 25 bp, Mus musculus
tacaagccagtgactttgacggtgc

SEQ ID NO: 126040 - DNA, 25 bp, Mus musculus
tacaagcccaacaacaaggccatgg

SEQ ID NO: 126041 - DNA, 25 bp, Mus musculus
tacaagcctcaggaggagtacccag

SEQ ID NO: 126042 - DNA, 25 bp, Mus musculus
tacaagcgaatcagggatgtgacca

SEQ ID NO: 126043 - DNA, 25 bp, Mus musculus
tacaagcgcgacttgttctgcctca

SEQ ID NO: 126044 - DNA, 25 bp, Mus musculus
tacaagcgctcgaaagtgaagagtc

SEQ ID NO: 126045 - DNA, 25 bp, Mus musculus
tacaagcgggccacgctggacgaag

SEQ ID NO: 126046 - DNA, 25 bp, Mus musculus
tacaagcgtattggctgcccgtggc

SEQ ID NO: 126047 - DNA, 25 bp, Mus musculus
tacaagctccggtacttactgcaga

SEQ ID NO: 126048 - DNA, 25 bp, Mus musculus
tacaagctccttgcactgtggacag

SEQ ID NO: 126049 - DNA, 25 bp, Mus musculus
tacaagctgaaccttcggtctccgg

SEQ ID NO: 126050 - DNA, 25 bp, Mus musculus
tacaagctgatgtcacggctgggct

SEQ ID NO: 126051 - DNA, 25 bp, Mus musculus
tacaagctggtaaagtcacggctgg

SEQ ID NO: 126052 - DNA, 25 bp, Mus musculus
tacaagctgtcgctactgaagccct

SEQ ID NO: 126053 - DNA, 25 bp, Mus musculus
tacaagctgtctgagatgacggagc

SEQ ID NO: 126054 - DNA, 25 bp, Mus musculus
tacaagcttcgagacagagccgagc

SEQ ID NO: 126055 - DNA, 25 bp, Mus musculus
tacaaggaaagtgcctgggaggctc

SEQ ID NO: 126056 - DNA, 25 bp, Mus musculus
tacaaggacaaaccacctgacttcg

SEQ ID NO: 126057 - DNA, 25 bp, Mus musculus
tacaaggagacttccaaggcttcag

SEQ ID NO: 126058 - DNA, 25 bp, Mus musculus
tacaaggagatcacacacggcaacc

SEQ ID NO: 126059 - DNA, 25 bp, Mus musculus
tacaaggagatcctcagccaggagg

SEQ ID NO: 126060 - DNA, 25 bp, Mus musculus
tacaaggagctaggcttccagggct

SEQ ID NO: 126061 - DNA, 25 bp, Mus musculus
tacaaggatcatggaaacccacctc

SEQ ID NO: 126062 - DNA, 25 bp, Mus musculus
tacaaggatccatgtgaactcgtcc

SEQ ID NO: 126063 - DNA, 25 bp, Mus musculus
tacaaggatggcttcggagatcccc

SEQ ID NO: 126064 - DNA, 25 bp, Mus musculus
tacaaggcactgagcagccagattc

SEQ ID NO: 126065 - DNA, 25 bp, Mus musculus
tacaaggcattaacaaggaccggcc

SEQ ID NO: 126066 - DNA, 25 bp, Mus musculus
tacaaggccaagctaatcggtattg

SEQ ID NO: 126067 - DNA, 25 bp, Mus musculus
tacaaggccagcgtggtatcctgcc

SEQ ID NO: 126068 - DNA, 25 bp, Mus musculus
tacaaggccgtgtgtcatgctgcca

SEQ ID NO: 126069 - DNA, 25 bp, Mus musculus
tacaaggcctcgttgtcctggaccc

SEQ ID NO: 126070 - DNA, 25 bp, Mus musculus
tacaaggccttgatgaggacacggc

SEQ ID NO: 126071 - DNA, 25 bp, Mus musculus
tacaaggctatccatggagactggc

SEQ ID NO: 126072 - DNA, 25 bp, Mus musculus
tacaagggaatgaccacagtggacg

SEQ ID NO: 126073 - DNA, 25 bp, Mus musculus
tacaagggaccaggatttgcatcct

SEQ ID NO: 126074 - DNA, 25 bp, Mus musculus
tacaagggactccaagcagtgcctg

SEQ ID NO: 126075 - DNA, 25 bp, Mus musculus
tacaagggcaccgtctggcataaag

SEQ ID NO: 126076 - DNA, 25 bp, Mus musculus
tacaagggctgtggtcgtctctaca

SEQ ID NO: 126077 - DNA, 25 bp, Mus musculus
tacaagggtcctacgtgattccagt

SEQ ID NO: 126078 - DNA, 25 bp, Mus musculus
tacaaggtaagctaggttgcccact

SEQ ID NO: 126079 - DNA, 25 bp, Mus musculus
tacaaggtcacggtggcggaagtac

SEQ ID NO: 126080 - DNA, 25 bp, Mus musculus
tacaaggtctgcactgagaagattc

SEQ ID NO: 126081 - DNA, 25 bp, Mus musculus
tacaaggtgatcctggctcgcagaa

SEQ ID NO: 126082 - DNA, 25 bp, Mus musculus
tacaaggtggactgtgcatgcctca

SEQ ID NO: 126083 - DNA, 25 bp, Mus musculus
tacaaggtgtattcaagtggagatc

SEQ ID NO: 126084 - DNA, 25 bp, Mus musculus
tacaaggttgccgagatgaaaatcc

SEQ ID NO: 126085 - DNA, 25 bp, Mus musculus
tacaaggttgtgaggccctctcccc

SEQ ID NO: 126086 - DNA, 25 bp, Mus musculus
tacaagtacaaggaaggctaccgca

SEQ ID NO: 126087 - DNA, 25 bp, Mus musculus
tacaagtactacttagagagcatcc

SEQ ID NO: 126088 - DNA, 25 bp, Mus musculus
tacaagtatgaattctgccctttcc

SEQ ID NO: 126089 - DNA, 25 bp, Mus musculus
tacaagtcaaggtgtggcccaaggt

SEQ ID NO: 126090 - DNA, 25 bp, Mus musculus
tacaagtccatcctgagtgagctca

SEQ ID NO: 126091 - DNA, 25 bp, Mus musculus
tacaagtcccatgatcaagagcaac

SEQ ID NO: 126092 - DNA, 25 bp, Mus musculus
tacaagtccctgaagctgtcgggcc

SEQ ID NO: 126093 - DNA, 25 bp, Mus musculus
tacaagtctaatggctgcagcggct

SEQ ID NO: 126094 - DNA, 25 bp, Mus musculus
tacaagtgacatttgagagcctggc

SEQ ID NO: 126095 - DNA, 25 bp, Mus musculus
tacaagtggaacagcggcaaaatcc

SEQ ID NO: 126096 - DNA, 25 bp, Mus musculus
tacaagtggcacttcaatgagaccg

SEQ ID NO: 126097 - DNA, 25 bp, Mus musculus
tacaagtggccgtcgaagaagagca

SEQ ID NO: 126098 - DNA, 25 bp, Mus musculus
tacaagtgggccaagatcagtgggc

SEQ ID NO: 126099 - DNA, 25 bp, Mus musculus
tacaagtgtccttaccagggctgca

SEQ ID NO: 126100 - DNA, 25 bp, Mus musculus
tacaagtgtctctctaccaaggtca

SEQ ID NO: 126101 - DNA, 25 bp, Mus musculus
tacaagtgtggagccacagaagttc

SEQ ID NO: 126102 - DNA, 25 bp, Mus musculus
tacaagttcaagctgactcggaagg

SEQ ID NO: 126103 - DNA, 25 bp, Mus musculus
tacaagttcatccatcaatttcctg

SEQ ID NO: 126104 - DNA, 25 bp, Mus musculus
tacaagttcgtctaccaagtcctcg

SEQ ID NO: 126105 - DNA, 25 bp, Mus musculus
tacaagttcgtgaacagccggctgg

SEQ ID NO: 126106 - DNA, 25 bp, Mus musculus
tacaagttgacctccacggtgatgc

SEQ ID NO: 126107 - DNA, 25 bp, Mus musculus
tacaagttgaggttcatgagccctg

SEQ ID NO: 126108 - DNA, 25 bp, Mus musculus
tacaagtttggcacctgcacaggca

SEQ ID NO: 126109 - DNA, 25 bp, Mus musculus
tacaagttttacaccgacagcatcg

SEQ ID NO: 126110 - DNA, 25 bp, Mus musculus
tacaataaaggcagctctgtccggc

SEQ ID NO: 126111 - DNA, 25 bp, Mus musculus
tacaatacttggtgcagtaccggag

SEQ ID NO: 126112 - DNA, 25 bp, Mus musculus
tacaatagcaacaagactcagggtg

SEQ ID NO: 126113 - DNA, 25 bp, Mus musculus
tacaatagcacccagacgctggagg

SEQ ID NO: 126114 - DNA, 25 bp, Mus musculus
tacaatagcacctgtgatggccagg

SEQ ID NO: 126115 - DNA, 25 bp, Mus musculus
tacaatagtccccaagaagtgatcg

SEQ ID NO: 126116 - DNA, 25 bp, Mus musculus
tacaatatttgttagtcgctgagga

SEQ ID NO: 126117 - DNA, 25 bp, Mus musculus
tacaatcagggcacctgtgagccca

SEQ ID NO: 126118 - DNA, 25 bp, Mus musculus
tacaatccagtctgcaagagctgcc

SEQ ID NO: 126119 - DNA, 25 bp, Mus musculus
tacaatcctctcaagctcctaatgg

SEQ ID NO: 126120 - DNA, 25 bp, Mus musculus
tacaatcgtcacctcttacaacagg

SEQ ID NO: 126121 - DNA, 25 bp, Mus musculus
tacaatctctgtggatcggccagtg

SEQ ID NO: 126122 - DNA, 25 bp, Mus musculus
tacaatctgaggtggtcaggccttc

SEQ ID NO: 126123 - DNA, 25 bp, Mus musculus
tacaatgaccaaggccaggtgcgac

SEQ ID NO: 126124 - DNA, 25 bp, Mus musculus
tacaatgagccatactgcatatgtg

SEQ ID NO: 126125 - DNA, 25 bp, Mus musculus
tacaatgaggcattcgcatggcgcc

SEQ ID NO: 126126 - DNA, 25 bp, Mus musculus
tacaatgagtgcttcagccgagcca

SEQ ID NO: 126127 - DNA, 25 bp, Mus musculus
tacaatgctcttctggccgtgcaga

SEQ ID NO: 126128 - DNA, 25 bp, Mus musculus
tacaatgctgcgaactaaggatctc

SEQ ID NO: 126129 - DNA, 25 bp, Mus musculus
tacaatggactctgggcctacgatg

SEQ ID NO: 126130 - DNA, 25 bp, Mus musculus
tacaatggagaggtcggagacattg

SEQ ID NO: 126131 - DNA, 25 bp, Mus musculus
tacaatggattttaaggactcagac

SEQ ID NO: 126132 - DNA, 25 bp, Mus musculus
tacaatggcactctgctggatggca

SEQ ID NO: 126133 - DNA, 25 bp, Mus musculus
tacaatggcactttcgaagacggga

SEQ ID NO: 126134 - DNA, 25 bp, Mus musculus
tacaatggcattcgctcccagggtg

SEQ ID NO: 126135 - DNA, 25 bp, Mus musculus
tacaatggctgtgcctatgcctgcc

SEQ ID NO: 126136 - DNA, 25 bp, Mus musculus
tacaatgggcagaagacggatggca

SEQ ID NO: 126137 - DNA, 25 bp, Mus musculus
tacaatgggctcaaggtactggcgc

SEQ ID NO: 126138 - DNA, 25 bp, Mus musculus
tacaatggtgctttacctaatggtg

SEQ ID NO: 126139 - DNA, 25 bp, Mus musculus
tacaatggttcgctctgggcaggac

SEQ ID NO: 126140 - DNA, 25 bp, Mus musculus
tacaatgtccctgcggtggctgagg

SEQ ID NO: 126141 - DNA, 25 bp, Mus musculus
tacaatgtgacaagaggaaccgcag

SEQ ID NO: 126142 - DNA, 25 bp, Mus musculus
tacaatgtgagcttggatgtgcaca

SEQ ID NO: 126143 - DNA, 25 bp, Mus musculus
tacaatgtggccatggactatccca

SEQ ID NO: 126144 - DNA, 25 bp, Mus musculus
tacaatgttccgctgtgtgtcacag

SEQ ID NO: 126145 - DNA, 25 bp, Mus musculus
tacaatgttctacatgaaggcacca

SEQ ID NO: 126146 - DNA, 25 bp, Mus musculus
tacaatgtttgtcacctggtctgcc

SEQ ID NO: 126147 - DNA, 25 bp, Mus musculus
tacaattatcaaagaagccggcgga

SEQ ID NO: 126148 - DNA, 25 bp, Mus musculus
tacaattgagctccgagatacaggc

SEQ ID NO: 126149 - DNA, 25 bp, Mus musculus
tacaattgcccagatggaggccggc

SEQ ID NO: 126150 - DNA, 25 bp, Mus musculus
tacaattttgacttcaggcctgaga

SEQ ID NO: 126151 - DNA, 25 bp, Mus musculus
tacacaaaagtaattgcctcccttg

SEQ ID NO: 126152 - DNA, 25 bp, Mus musculus
tacacaaacaagttccagagagagg

SEQ ID NO: 126153 - DNA, 25 bp, Mus musculus
tacacaaacctggacggtcgctgtc

SEQ ID NO: 126154 - DNA, 25 bp, Mus musculus
tacacaaacgcggtcattcatgagg

SEQ ID NO: 126155 - DNA, 25 bp, Mus musculus
tacacaaataccttagagcgactag

SEQ ID NO: 126156 - DNA, 25 bp, Mus musculus
tacacaaatggagatagcgtgccag

SEQ ID NO: 126157 - DNA, 25 bp, Mus musculus
tacacaaccctcagcaagaagacgg

SEQ ID NO: 126158 - DNA, 25 bp, Mus musculus
tacacaaccgaaagctcaagagaag

SEQ ID NO: 126159 - DNA, 25 bp, Mus musculus
tacacaacgggacacatacatggag

SEQ ID NO: 126160 - DNA, 25 bp, Mus musculus
tacacaactttgaggccacacactg

SEQ ID NO: 126161 - DNA, 25 bp, Mus musculus
tacacaagcgctgccatgagttcgt

SEQ ID NO: 126162 - DNA, 25 bp, Mus musculus
tacacaaggaatggcggctgtcagg

SEQ ID NO: 126163 - DNA, 25 bp, Mus musculus
tacacaatcagtacctcgtgggccc

SEQ ID NO: 126164 - DNA, 25 bp, Mus musculus
tacacacacttgcagagagctcagc

SEQ ID NO: 126165 - DNA, 25 bp, Mus musculus
tacacacagagctttcagagtcgga

SEQ ID NO: 126166 - DNA, 25 bp, Mus musculus
tacacacaggccctgagtctcggcg

SEQ ID NO: 126167 - DNA, 25 bp, Mus musculus
tacacacagggctggaagcaggatc

SEQ ID NO: 126168 - DNA, 25 bp, Mus musculus
tacacacaggtgttccaggtcaccg

SEQ ID NO: 126169 - DNA, 25 bp, Mus musculus
tacacacatgacatggaggccgcac

SEQ ID NO: 126170 - DNA, 25 bp, Mus musculus
tacacacatgcgtaacagctgacag

SEQ ID NO: 126171 - DNA, 25 bp, Mus musculus
tacacaccatggctgcagtgcaggc

SEQ ID NO: 126172 - DNA, 25 bp, Mus musculus
tacacaccggaaaatcttacagagc

SEQ ID NO: 126173 - DNA, 25 bp, Mus musculus
tacacaccggaagcttgaacatcaa

SEQ ID NO: 126174 - DNA, 25 bp, Mus musculus
tacacacgggaagagatccaggact

SEQ ID NO: 126175 - DNA, 25 bp, Mus musculus
tacacactaagtttcccactagcag

SEQ ID NO: 126176 - DNA, 25 bp, Mus musculus
tacacactcaaacaacctgtgaggg

SEQ ID NO: 126177 - DNA, 25 bp, Mus musculus
tacacactgatcgatgagcaagaca

SEQ ID NO: 126178 - DNA, 25 bp, Mus musculus
tacacactggaatactgccaagcct

SEQ ID NO: 126179 - DNA, 25 bp, Mus musculus
tacacacttggaggcaagaacaacg

SEQ ID NO: 126180 - DNA, 25 bp, Mus musculus
tacacagacacctgggaaattctac

SEQ ID NO: 126181 - DNA, 25 bp, Mus musculus
tacacagagggagaacggctgtacc

SEQ ID NO: 126182 - DNA, 25 bp, Mus musculus
tacacagattcttcggtgcgcaggg

SEQ ID NO: 126183 - DNA, 25 bp, Mus musculus
tacacagcacgcatattcgcggcag

SEQ ID NO: 126184 - DNA, 25 bp, Mus musculus
tacacagcaggactcatcaacggca

SEQ ID NO: 126185 - DNA, 25 bp, Mus musculus
tacacagcatgggtgtgcgactgcc

SEQ ID NO: 126186 - DNA, 25 bp, Mus musculus
tacacagcgtatcttcctcaggaaa

SEQ ID NO: 126187 - DNA, 25 bp, Mus musculus
tacacaggaacctttgctggccaac

SEQ ID NO: 126188 - DNA, 25 bp, Mus musculus
tacacaggagcaccatattttgcag

SEQ ID NO: 126189 - DNA, 25 bp, Mus musculus
tacacaggagccacttgtcacagct

SEQ ID NO: 126190 - DNA, 25 bp, Mus musculus
tacacagggacaatcaagaccaatc

SEQ ID NO: 126191 - DNA, 25 bp, Mus musculus
tacacagggacagcaaacttgacag

SEQ ID NO: 126192 - DNA, 25 bp, Mus musculus
tacacagggcaagcttggagtcggc

SEQ ID NO: 126193 - DNA, 25 bp, Mus musculus
tacacaggtggtacagcaagtgcca

SEQ ID NO: 126194 - DNA, 25 bp, Mus musculus
tacacagtaaccagggcagaagcca

SEQ ID NO: 126195 - DNA, 25 bp, Mus musculus
tacacagtgaccctggatggacgag

SEQ ID NO: 126196 - DNA, 25 bp, Mus musculus
tacacagtggcagaggaaatacaca

SEQ ID NO: 126197 - DNA, 25 bp, Mus musculus
tacacagtggtgacggagaggacca

SEQ ID NO: 126198 - DNA, 25 bp, Mus musculus
tacacagtttgctgggaccatccca

SEQ ID NO: 126199 - DNA, 25 bp, Mus musculus
tacacatagaccacactgcggggcg

SEQ ID NO: 126200 - DNA, 25 bp, Mus musculus
tacacatatacaagtcctgaggatc

SEQ ID NO: 126201 - DNA, 25 bp, Mus musculus
tacacatccatccatcatggcgtgg

SEQ ID NO: 126202 - DNA, 25 bp, Mus musculus
tacacatccctgaggaaggcgttca

SEQ ID NO: 126203 - DNA, 25 bp, Mus musculus
tacacatccgtttggttgggagact

SEQ ID NO: 126204 - DNA, 25 bp, Mus musculus
tacacatgcgccatccagaggtata

SEQ ID NO: 126205 - DNA, 25 bp, Mus musculus
tacacatggatcgtgccgagtctgg

SEQ ID NO: 126206 - DNA, 25 bp, Mus musculus
tacacatgtgtagcactcagagcct

SEQ ID NO: 126207 - DNA, 25 bp, Mus musculus
tacacattccttacccacgagtggc

SEQ ID NO: 126208 - DNA, 25 bp, Mus musculus
tacacatttcgggttcggagccgct

SEQ ID NO: 126209 - DNA, 25 bp, Mus musculus
tacaccaagggtcagaggttgccca

SEQ ID NO: 126210 - DNA, 25 bp, Mus musculus
tacaccagagaagcaggagtccgtt

SEQ ID NO: 126211 - DNA, 25 bp, Mus musculus
tacaccaggatgtgaaagtccagcg

SEQ ID NO: 126212 - DNA, 25 bp, Mus musculus
tacaccagtaagatcataagcagcg

SEQ ID NO: 126213 - DNA, 25 bp, Mus musculus
tacaccagttccctgttcctgtgcg

SEQ ID NO: 126214 - DNA, 25 bp, Mus musculus
tacaccatcctgaagcctcggaaag

SEQ ID NO: 126215 - DNA, 25 bp, Mus musculus
tacaccatgatgaagttcgcctgct

SEQ ID NO: 126216 - DNA, 25 bp, Mus musculus
tacaccattgtaccagcatgagaaa

SEQ ID NO: 126217 - DNA, 25 bp, Mus musculus
tacacccaatggcttcagcaacggc

SEQ ID NO: 126218 - DNA, 25 bp, Mus musculus
tacacccactgcaatggtggcccag

SEQ ID NO: 126219 - DNA, 25 bp, Mus musculus
tacacccctgtgtcgagcgatgatg

SEQ ID NO: 126220 - DNA, 25 bp, Mus musculus
tacacccgaggctgtggcagtcttc

SEQ ID NO: 126221 - DNA, 25 bp, Mus musculus
tacacccgcaagtttgagtccacgg

SEQ ID NO: 126222 - DNA, 25 bp, Mus musculus
tacacccggaaagatgtgcgtcgcc

SEQ ID NO: 126223 - DNA, 25 bp, Mus musculus
tacacccggcaaaaggacaatgagc

SEQ ID NO: 126224 - DNA, 25 bp, Mus musculus
tacacccgtaaagctgcattagaag

SEQ ID NO: 126225 - DNA, 25 bp, Mus musculus
tacaccctcaacttccagggccgcg

SEQ ID NO: 126226 - DNA, 25 bp, Mus musculus
tacaccctcctgagtagctactggg

SEQ ID NO: 126227 - DNA, 25 bp, Mus musculus
tacaccctgattggagctagtggcc

SEQ ID NO: 126228 - DNA, 25 bp, Mus musculus
tacacccttggaatcagccctgatg

SEQ ID NO: 126229 - DNA, 25 bp, Mus musculus
tacaccgacgtttttggagaggcga

SEQ ID NO: 126230 - DNA, 25 bp, Mus musculus
tacaccgactgagtacactggaaaa

SEQ ID NO: 126231 - DNA, 25 bp, Mus musculus
tacaccgagcaggaggtgacctcat

SEQ ID NO: 126232 - DNA, 25 bp, Mus musculus
tacaccgaggagctgaaagtggccc

SEQ ID NO: 126233 - DNA, 25 bp, Mus musculus
tacaccgctggtattgtgggaggcc

SEQ ID NO: 126234 - DNA, 25 bp, Mus musculus
tacaccgtggattgcgaagattatg

SEQ ID NO: 126235 - DNA, 25 bp, Mus musculus
tacaccgtgtgggtctgcatcagag

SEQ ID NO: 126236 - DNA, 25 bp, Mus musculus
tacaccgttgtcgatgggaagctga

SEQ ID NO: 126237 - DNA, 25 bp, Mus musculus
tacacctaagacaggagcagtgcgg

SEQ ID NO: 126238 - DNA, 25 bp, Mus musculus
tacacctagtgacggtagcagcagg

SEQ ID NO: 126239 - DNA, 25 bp, Mus musculus
tacacctcacgcttagtatgtctgg

SEQ ID NO: 126240 - DNA, 25 bp, Mus musculus
tacacctctagtagggtcttggaga

SEQ ID NO: 126241 - DNA, 25 bp, Mus musculus
tacacctctggacgtggctaagaca

SEQ ID NO: 126242 - DNA, 25 bp, Mus musculus
tacacctgaagatgatggcaccgca

SEQ ID NO: 126243 - DNA, 25 bp, Mus musculus
tacacctgaccaaggatcccctaaa

SEQ ID NO: 126244 - DNA, 25 bp, Mus musculus
tacaccttcctaggatgggccagga

SEQ ID NO: 126245 - DNA, 25 bp, Mus musculus
tacaccttggcgattgagcatgacc

SEQ ID NO: 126246 - DNA, 25 bp, Mus musculus
tacacctttgcgaatcttggagagc

SEQ ID NO: 126247 - DNA, 25 bp, Mus musculus
tacacgaagatgaagaccgcaacca

SEQ ID NO: 126248 - DNA, 25 bp, Mus musculus
tacacgcaggctgccaacaatgtgc

SEQ ID NO: 126249 - DNA, 25 bp, Mus musculus
tacacgcggccagtgattatcctgg

SEQ ID NO: 126250 - DNA, 25 bp, Mus musculus
tacacgctaatgcatttgagaaaac

SEQ ID NO: 126251 - DNA, 25 bp, Mus musculus
tacacggaccctttgctactgagca

SEQ ID NO: 126252 - DNA, 25 bp, Mus musculus
tacacggacttctaagagggtacca

SEQ ID NO: 126253 - DNA, 25 bp, Mus musculus
tacacggagtgcgaaaagcaatggg

SEQ ID NO: 126254 - DNA, 25 bp, Mus musculus
tacacggagtggattttggaggcca

SEQ ID NO: 126255 - DNA, 25 bp, Mus musculus
tacacggagtttctgacaggcctgg

SEQ ID NO: 126256 - DNA, 25 bp, Mus musculus
tacacggattgacttaaacccaggg

SEQ ID NO: 126257 - DNA, 25 bp, Mus musculus
tacacggccaaaaaagtcggtggtg

SEQ ID NO: 126258 - DNA, 25 bp, Mus musculus
tacacggccaagaagtacgcagtgc

SEQ ID NO: 126259 - DNA, 25 bp, Mus musculus
tacacggctctgctgtcaacagatg

SEQ ID NO: 126260 - DNA, 25 bp, Mus musculus
tacacgggccgtgagtttgatgacc

SEQ ID NO: 126261 - DNA, 25 bp, Mus musculus
tacacggtgcaagtgctggaagcca

SEQ ID NO: 126262 - DNA, 25 bp, Mus musculus
tacacggtggtagatgagatgttcc

SEQ ID NO: 126263 - DNA, 25 bp, Mus musculus
tacacggtggtgtcaacaaactgcc

SEQ ID NO: 126264 - DNA, 25 bp, Mus musculus
tacacgtccctgagcacttgatcgc

SEQ ID NO: 126265 - DNA, 25 bp, Mus musculus
tacacgtgcaccgagagtcagagct

SEQ ID NO: 126266 - DNA, 25 bp, Mus musculus
tacacgtgcagcataagagagcgga

SEQ ID NO: 126267 - DNA, 25 bp, Mus musculus
tacacgtgcattcgctaagggatct

SEQ ID NO: 126268 - DNA, 25 bp, Mus musculus
tacacgtgcgtcctgaggttgcgaa

SEQ ID NO: 126269 - DNA, 25 bp, Mus musculus
tacacgtggctaaagaatggtcaac

SEQ ID NO: 126270 - DNA, 25 bp, Mus musculus
tacacgtgtggatcacgaaacagcc

SEQ ID NO: 126271 - DNA, 25 bp, Mus musculus
tacacgttgataagtaaatggcaga

SEQ ID NO: 126272 - DNA, 25 bp, Mus musculus
tacactaagatgactcggaagaggc

SEQ ID NO: 126273 - DNA, 25 bp, Mus musculus
tacactaccctggtgggctgtatcc

SEQ ID NO: 126274 - DNA, 25 bp, Mus musculus
tacactactggaagagttggagctc

SEQ ID NO: 126275 - DNA, 25 bp, Mus musculus
tacactcacttgctcctgggaaggc

SEQ ID NO: 126276 - DNA, 25 bp, Mus musculus
tacactcctgtgactagagggactg

SEQ ID NO: 126277 - DNA, 25 bp, Mus musculus
tacactcgttaggaaaggctcgcac

SEQ ID NO: 126278 - DNA, 25 bp, Mus musculus
tacactctacggatacttgatgcaa

SEQ ID NO: 126279 - DNA, 25 bp, Mus musculus
tacactctagtggttgcacggctgc

SEQ ID NO: 126280 - DNA, 25 bp, Mus musculus
tacactctgcgagagaagcctcaga

SEQ ID NO: 126281 - DNA, 25 bp, Mus musculus
tacactcttgccagcattagccaca

SEQ ID NO: 126282 - DNA, 25 bp, Mus musculus
tacactcttttactcggacacgagg

SEQ ID NO: 126283 - DNA, 25 bp, Mus musculus
tacactgaccctaccaagaggctcg

SEQ ID NO: 126284 - DNA, 25 bp, Mus musculus
tacactgaccttctaaagctgctgg

SEQ ID NO: 126285 - DNA, 25 bp, Mus musculus
tacactgagcagagaggctgtgcct

SEQ ID NO: 126286 - DNA, 25 bp, Mus musculus
tacactgccagctgagttacaggag

SEQ ID NO: 126287 - DNA, 25 bp, Mus musculus
tacactgcgctagataaatggacca

SEQ ID NO: 126288 - DNA, 25 bp, Mus musculus
tacactgctcgaagctggactggca

SEQ ID NO: 126289 - DNA, 25 bp, Mus musculus
tacactggaaaagttcgctgcaagc

SEQ ID NO: 126290 - DNA, 25 bp, Mus musculus
tacactggacagaccaatgggacag

SEQ ID NO: 126291 - DNA, 25 bp, Mus musculus
tacactggatcctgctttgctgcgc

SEQ ID NO: 126292 - DNA, 25 bp, Mus musculus
tacactggattgtgtgcttggcaca

SEQ ID NO: 126293 - DNA, 25 bp, Mus musculus
tacactggccaatagctgtggcacc

SEQ ID NO: 126294 - DNA, 25 bp, Mus musculus
tacactggcccttgcttgcgctatg

SEQ ID NO: 126295 - DNA, 25 bp, Mus musculus
tacactggcttcatctacaatgagt

SEQ ID NO: 126296 - DNA, 25 bp, Mus musculus
tacactgggaagcagagactccagc

SEQ ID NO: 126297 - DNA, 25 bp, Mus musculus
tacactgggcccaaaaggaatatgg

SEQ ID NO: 126298 - DNA, 25 bp, Mus musculus
tacactgggcttgctacggcaggaa

SEQ ID NO: 126299 - DNA, 25 bp, Mus musculus
tacactggtacggagctagggccgt

SEQ ID NO: 126300 - DNA, 25 bp, Mus musculus
tacactggtgtggtatccctgcagc

SEQ ID NO: 126301 - DNA, 25 bp, Mus musculus
tacactggtgtggtgacgacttcga

SEQ ID NO: 126302 - DNA, 25 bp, Mus musculus
tacactggttggtgcaaatgcctcc

SEQ ID NO: 126303 - DNA, 25 bp, Mus musculus
tacactgtctataaggttaccgcac

SEQ ID NO: 126304 - DNA, 25 bp, Mus musculus
tacactgtgacctctgcatcttgaa

SEQ ID NO: 126305 - DNA, 25 bp, Mus musculus
tacactgtggagaaagcggataact

SEQ ID NO: 126306 - DNA, 25 bp, Mus musculus
tacactgtggttacggctctgtcgc

SEQ ID NO: 126307 - DNA, 25 bp, Mus musculus
tacactgttgcacttgtatgcccac

SEQ ID NO: 126308 - DNA, 25 bp, Mus musculus
tacacttactcgagaatcactatgg

SEQ ID NO: 126309 - DNA, 25 bp, Mus musculus
tacacttagcagaagccggaaggcc

SEQ ID NO: 126310 - DNA, 25 bp, Mus musculus
tacacttgcgcagactgtgggctga

SEQ ID NO: 126311 - DNA, 25 bp, Mus musculus
tacacttgggctgctactgggctgc

SEQ ID NO: 126312 - DNA, 25 bp, Mus musculus
tacacttgggtcacaggacgagagc

SEQ ID NO: 126313 - DNA, 25 bp, Mus musculus
tacacttggtacgtcagaaagcaac

SEQ ID NO: 126314 - DNA, 25 bp, Mus musculus
tacactttctggtcccataagagcc

SEQ ID NO: 126315 - DNA, 25 bp, Mus musculus
tacactttgacttgccctggagaca

SEQ ID NO: 126316 - DNA, 25 bp, Mus musculus
tacacttttacacagcctaggccta

SEQ ID NO: 126317 - DNA, 25 bp, Mus musculus
tacacttttggcgtcatggatcggt

SEQ ID NO: 126318 - DNA, 25 bp, Mus musculus
tacagaaaaaaggccgtggacgccg

SEQ ID NO: 126319 - DNA, 25 bp, Mus musculus
tacagaaaacccacctggaagaagc

SEQ ID NO: 126320 - DNA, 25 bp, Mus musculus
tacagaaacactctgaaagaatcaa

SEQ ID NO: 126321 - DNA, 25 bp, Mus musculus
tacagaaacccttgtgctgcaggca

SEQ ID NO: 126322 - DNA, 25 bp, Mus musculus
tacagaaaccggtcatgcgtcatca

SEQ ID NO: 126323 - DNA, 25 bp, Mus musculus
tacagaaacctcattgcagatgtgg

SEQ ID NO: 126324 - DNA, 25 bp, Mus musculus
tacagaaacgtgcttcagctggcaa

SEQ ID NO: 126325 - DNA, 25 bp, Mus musculus
tacagaaagatcttcactgcagctc

SEQ ID NO: 126326 - DNA, 25 bp, Mus musculus
tacagaaagtagtcgggagagaccc

SEQ ID NO: 126327 - DNA, 25 bp, Mus musculus
tacagaacagagttccaggcactga

SEQ ID NO: 126328 - DNA, 25 bp, Mus musculus
tacagaacaggctatacgtaccgcc

SEQ ID NO: 126329 - DNA, 25 bp, Mus musculus
tacagaacaggctatgcgtacaggc

SEQ ID NO: 126330 - DNA, 25 bp, Mus musculus
tacagaacccactgctgcctagaag

SEQ ID NO: 126331 - DNA, 25 bp, Mus musculus
tacagaaccgcctagtggatgcagc

SEQ ID NO: 126332 - DNA, 25 bp, Mus musculus
tacagaacgagatggattagcccta

SEQ ID NO: 126333 - DNA, 25 bp, Mus musculus
tacagaacgaggtcttccacgtcgc

SEQ ID NO: 126334 - DNA, 25 bp, Mus musculus
tacagaacggatgtgctcctgccaa

SEQ ID NO: 126335 - DNA, 25 bp, Mus musculus
tacagaacggtaggtgttgctcaca

SEQ ID NO: 126336 - DNA, 25 bp, Mus musculus
tacagaagaaagtcttccgccgctg

SEQ ID NO: 126337 - DNA, 25 bp, Mus musculus
tacagaagagcttcggcagatggca

SEQ ID NO: 126338 - DNA, 25 bp, Mus musculus
tacagaagctaaaagctgcgggcca

SEQ ID NO: 126339 - DNA, 25 bp, Mus musculus
tacagaagtgtgctttcataccaac

SEQ ID NO: 126340 - DNA, 25 bp, Mus musculus
tacagaagtgtgtaggagctgaccc

SEQ ID NO: 126341 - DNA, 25 bp, Mus musculus
tacagaatccctggaaagcgtgcgc

SEQ ID NO: 126342 - DNA, 25 bp, Mus musculus
tacagaatgactgggctactatggc

SEQ ID NO: 126343 - DNA, 25 bp, Mus musculus
tacagaatgcagcagatgtgcctgc

SEQ ID NO: 126344 - DNA, 25 bp, Mus musculus
tacagaatgtggctcagacactggc

SEQ ID NO: 126345 - DNA, 25 bp, Mus musculus
tacagacagaagatcacggcctggc

SEQ ID NO: 126346 - DNA, 25 bp, Mus musculus
tacagacagccctcattacagtgat

SEQ ID NO: 126347 - DNA, 25 bp, Mus musculus
tacagacagttcagcaggtccaaca

SEQ ID NO: 126348 - DNA, 25 bp, Mus musculus
tacagacatgcgtttgattccacag

SEQ ID NO: 126349 - DNA, 25 bp, Mus musculus
tacagacatggggtatccatcgagg

SEQ ID NO: 126350 - DNA, 25 bp, Mus musculus
tacagaccagcttgatgacgtgaca

SEQ ID NO: 126351 - DNA, 25 bp, Mus musculus
tacagacccttcagtttgcaatggc

SEQ ID NO: 126352 - DNA, 25 bp, Mus musculus
tacagaccgctgtcatgccaaacgg

SEQ ID NO: 126353 - DNA, 25 bp, Mus musculus
tacagacctaggaaggggagtgcct

SEQ ID NO: 126354 - DNA, 25 bp, Mus musculus
tacagacctggtgtgttggaaggac

SEQ ID NO: 126355 - DNA, 25 bp, Mus musculus
tacagaccttaatgagagtcgccgt

SEQ ID NO: 126356 - DNA, 25 bp, Mus musculus
tacagacgcggctactatggcaggc

SEQ ID NO: 126357 - DNA, 25 bp, Mus musculus
tacagacggagacggaagtgactac

SEQ ID NO: 126358 - DNA, 25 bp, Mus musculus
tacagacgtcacatgggctctttgg

SEQ ID NO: 126359 - DNA, 25 bp, Mus musculus
tacagacgttacttggaagcttttc

SEQ ID NO: 126360 - DNA, 25 bp, Mus musculus
tacagacgttggtccccgggctggc

SEQ ID NO: 126361 - DNA, 25 bp, Mus musculus
tacagactacaagagaggttcctgg

SEQ ID NO: 126362 - DNA, 25 bp, Mus musculus
tacagactgcattctcctggaaatc

SEQ ID NO: 126363 - DNA, 25 bp, Mus musculus
tacagactgcgagagcattctgcgg

SEQ ID NO: 126364 - DNA, 25 bp, Mus musculus
tacagactgcttctttgacaagtgt

SEQ ID NO: 126365 - DNA, 25 bp, Mus musculus
tacagacttcgtgaactatttaagc

SEQ ID NO: 126366 - DNA, 25 bp, Mus musculus
tacagactttctggccagcaggcac

SEQ ID NO: 126367 - DNA, 25 bp, Mus musculus
tacagagaaaacactgggtggcaat

SEQ ID NO: 126368 - DNA, 25 bp, Mus musculus
tacagagaaagggttacacagggca

SEQ ID NO: 126369 - DNA, 25 bp, Mus musculus
tacagagactactgagggacgaggc

SEQ ID NO: 126370 - DNA, 25 bp, Mus musculus
tacagagactatagcaagaccccag

SEQ ID NO: 126371 - DNA, 25 bp, Mus musculus
tacagagactgcaaggatgctgact

SEQ ID NO: 126372 - DNA, 25 bp, Mus musculus
tacagagagctgatatgcgttccct

SEQ ID NO: 126373 - DNA, 25 bp, Mus musculus
tacagagaggatcactgggccatgt

SEQ ID NO: 126374 - DNA, 25 bp, Mus musculus
tacagagcacctggccacattctag

SEQ ID NO: 126375 - DNA, 25 bp, Mus musculus
tacagagcagcgagtccttgaagct

SEQ ID NO: 126376 - DNA, 25 bp, Mus musculus
tacagagcatagttcgtgccctccg

SEQ ID NO: 126377 - DNA, 25 bp, Mus musculus
tacagagccaagcatcgcaaggaag

SEQ ID NO: 126378 - DNA, 25 bp, Mus musculus
tacagagcctcctgaaaacggcccg

SEQ ID NO: 126379 - DNA, 25 bp, Mus musculus
tacagagcctgcttatatgaacgag

SEQ ID NO: 126380 - DNA, 25 bp, Mus musculus
tacagagcctgttgaaggatcggga

SEQ ID NO: 126381 - DNA, 25 bp, Mus musculus
tacagagcgggatgaacctccagat

SEQ ID NO: 126382 - DNA, 25 bp, Mus musculus
tacagagcgggttttaggctagccc

SEQ ID NO: 126383 - DNA, 25 bp, Mus musculus
tacagagctacagacgctgcgggat

SEQ ID NO: 126384 - DNA, 25 bp, Mus musculus
tacagaggagtgtgcaaggatccca

SEQ ID NO: 126385 - DNA, 25 bp, Mus musculus
tacagaggatgctagcactgggcac

SEQ ID NO: 126386 - DNA, 25 bp, Mus musculus
tacagagggctattaagcgacggtc

SEQ ID NO: 126387 - DNA, 25 bp, Mus musculus
tacagaggtcattccgaagagaagc

SEQ ID NO: 126388 - DNA, 25 bp, Mus musculus
tacagaggttaggaccactgccaca

SEQ ID NO: 126389 - DNA, 25 bp, Mus musculus
tacagagtcatcacggtgcgtaagt

SEQ ID NO: 126390 - DNA, 25 bp, Mus musculus
tacagagtgcttcacgacctttgga

SEQ ID NO: 126391 - DNA, 25 bp, Mus musculus
tacagagtggtctagaagcaaatag

SEQ ID NO: 126392 - DNA, 25 bp, Mus musculus
tacagagttttagccactgagtacc

SEQ ID NO: 126393 - DNA, 25 bp, Mus musculus
tacagataccagacattttctttac

SEQ ID NO: 126394 - DNA, 25 bp, Mus musculus
tacagatacggagaacggcacatgg

SEQ ID NO: 126395 - DNA, 25 bp, Mus musculus
tacagatactataacgaggtgggcc

SEQ ID NO: 126396 - DNA, 25 bp, Mus musculus
tacagatagctctgacgatgagaca

SEQ ID NO: 126397 - DNA, 25 bp, Mus musculus
tacagataggtatcaaggctcagct

SEQ ID NO: 126398 - DNA, 25 bp, Mus musculus
tacagatatatggagcaggccccaa

SEQ ID NO: 126399 - DNA, 25 bp, Mus musculus
tacagatatggtccagaagtcggcc

SEQ ID NO: 126400 - DNA, 25 bp, Mus musculus
tacagatcgaccaagaatgggttcc

SEQ ID NO: 126401 - DNA, 25 bp, Mus musculus
tacagatcgggcacttcctgtgtct

SEQ ID NO: 126402 - DNA, 25 bp, Mus musculus
tacagatgacctggatgctcccaag

SEQ ID NO: 126403 - DNA, 25 bp, Mus musculus
tacagatgatgataaacggcgcgag

SEQ ID NO: 126404 - DNA, 25 bp, Mus musculus
tacagatgctacaccacttttgggc

SEQ ID NO: 126405 - DNA, 25 bp, Mus musculus
tacagatggctgatgggaaccagtc

SEQ ID NO: 126406 - DNA, 25 bp, Mus musculus
tacagatgggaggagtcaaggccca

SEQ ID NO: 126407 - DNA, 25 bp, Mus musculus
tacagatgttacaacgggcaggagc

SEQ ID NO: 126408 - DNA, 25 bp, Mus musculus
tacagatgttttgtggagcaggagc

SEQ ID NO: 126409 - DNA, 25 bp, Mus musculus
tacagattaaacaccagctcattgg

SEQ ID NO: 126410 - DNA, 25 bp, Mus musculus
tacagattacatttgccccatggag

SEQ ID NO: 126411 - DNA, 25 bp, Mus musculus
tacagattcatggtaatggaaagac

SEQ ID NO: 126412 - DNA, 25 bp, Mus musculus
tacagattcctccaggtgcacatgc

SEQ ID NO: 126413 - DNA, 25 bp, Mus musculus
tacagattgtctcagggaagccttg

SEQ ID NO: 126414 - DNA, 25 bp, Mus musculus
tacagattgttctcgcccatgaaga

SEQ ID NO: 126415 - DNA, 25 bp, Mus musculus
tacagcaaagcagaatcagaggcgt

SEQ ID NO: 126416 - DNA, 25 bp, Mus musculus
tacagcaacccggtgtttgagagca

SEQ ID NO: 126417 - DNA, 25 bp, Mus musculus
tacagcaagaatccatccaacaagg

SEQ ID NO: 126418 - DNA, 25 bp, Mus musculus
tacagcaagacagtgactcttggca

SEQ ID NO: 126419 - DNA, 25 bp, Mus musculus
tacagcaagcactggctcttcggcg

SEQ ID NO: 126420 - DNA, 25 bp, Mus musculus
tacagcaaggccagatatcacattg

SEQ ID NO: 126421 - DNA, 25 bp, Mus musculus
tacagcacctcccattgtgagcgga

SEQ ID NO: 126422 - DNA, 25 bp, Mus musculus
tacagcagagatctaaagaggcagc

SEQ ID NO: 126423 - DNA, 25 bp, Mus musculus
tacagcagatcaaatggcacaggaa

SEQ ID NO: 126424 - DNA, 25 bp, Mus musculus
tacagcagcaattcggccacagcag

SEQ ID NO: 126425 - DNA, 25 bp, Mus musculus
tacagcagcaccttcagggtttagc

SEQ ID NO: 126426 - DNA, 25 bp, Mus musculus
tacagcagctggtacatcgaggaac

SEQ ID NO: 126427 - DNA, 25 bp, Mus musculus
tacagcaggaagtcccagttccagg

SEQ ID NO: 126428 - DNA, 25 bp, Mus musculus
tacagcagtagtggaggacgtgtcc

SEQ ID NO: 126429 - DNA, 25 bp, Mus musculus
tacagcagtcggagaacttctggca

SEQ ID NO: 126430 - DNA, 25 bp, Mus musculus
tacagcagtgatcctccctttgaag

SEQ ID NO: 126431 - DNA, 25 bp, Mus musculus
tacagcagtggtaaacacccgaggt

SEQ ID NO: 126432 - DNA, 25 bp, Mus musculus
tacagcagttctgagaccagcacag

SEQ ID NO: 126433 - DNA, 25 bp, Mus musculus
tacagcatcagacctgaggaaccag

SEQ ID NO: 126434 - DNA, 25 bp, Mus musculus
tacagcatcgagatcccggatcagc

SEQ ID NO: 126435 - DNA, 25 bp, Mus musculus
tacagcatcggaagcattgcaggca

SEQ ID NO: 126436 - DNA, 25 bp, Mus musculus
tacagcatgatcatccggcgctacg

SEQ ID NO: 126437 - DNA, 25 bp, Mus musculus
tacagcattacctcatcatgacctg

SEQ ID NO: 126438 - DNA, 25 bp, Mus musculus
tacagcattctctccttcatgggtg

SEQ ID NO: 126439 - DNA, 25 bp, Mus musculus
tacagcattgctccggaagaacact

SEQ ID NO: 126440 - DNA, 25 bp, Mus musculus
tacagccagcttagacggagagtcg

SEQ ID NO: 126441 - DNA, 25 bp, Mus musculus
tacagccagtctccctcggtgtgag

SEQ ID NO: 126442 - DNA, 25 bp, Mus musculus
tacagcccctaaagctaagagagcc

SEQ ID NO: 126443 - DNA, 25 bp, Mus musculus
tacagcccctgtgatccagcgtgtg

SEQ ID NO: 126444 - DNA, 25 bp, Mus musculus
tacagcccggaatgagcaacttgac

SEQ ID NO: 126445 - DNA, 25 bp, Mus musculus
tacagcccgtatcaggactactatg

SEQ ID NO: 126446 - DNA, 25 bp, Mus musculus
tacagccctggtgtgacttactcgc

SEQ ID NO: 126447 - DNA, 25 bp, Mus musculus
tacagcctacgaaccatacctgtgg

SEQ ID NO: 126448 - DNA, 25 bp, Mus musculus
tacagcctagtaagaatgataatgg

SEQ ID NO: 126449 - DNA, 25 bp, Mus musculus
tacagcctcagcgagttctcctggg

SEQ ID NO: 126450 - DNA, 25 bp, Mus musculus
tacagcctccagcagagaggacact

SEQ ID NO: 126451 - DNA, 25 bp, Mus musculus
tacagcctgctcaacgagtacggcg

SEQ ID NO: 126452 - DNA, 25 bp, Mus musculus
tacagccttgtctgtggcccaagaa

SEQ ID NO: 126453 - DNA, 25 bp, Mus musculus
tacagcgacagtctgaaggaggccc

SEQ ID NO: 126454 - DNA, 25 bp, Mus musculus
tacagcgacctcagcaagggagtgc

SEQ ID NO: 126455 - DNA, 25 bp, Mus musculus
tacagcgagcttccctacttggaca

SEQ ID NO: 126456 - DNA, 25 bp, Mus musculus
tacagcgaggatgaaaccagcagag

SEQ ID NO: 126457 - DNA, 25 bp, Mus musculus
tacagcgattcggaagagctcttgc

SEQ ID NO: 126458 - DNA, 25 bp, Mus musculus
tacagcgattctgagttcagcagcc

SEQ ID NO: 126459 - DNA, 25 bp, Mus musculus
tacagcgccaaattcagaagaggga

SEQ ID NO: 126460 - DNA, 25 bp, Mus musculus
tacagcgccagactatcttcaacat

SEQ ID NO: 126461 - DNA, 25 bp, Mus musculus
tacagcgcgtttacctgggctggcc

SEQ ID NO: 126462 - DNA, 25 bp, Mus musculus
tacagcgggcccaagcttgaggatg

SEQ ID NO: 126463 - DNA, 25 bp, Mus musculus
tacagcgtagtcagcttcagggagc

SEQ ID NO: 126464 - DNA, 25 bp, Mus musculus
tacagcgtattgacgcaatactctt

SEQ ID NO: 126465 - DNA, 25 bp, Mus musculus
tacagcgtgagaaagacacctcttg

SEQ ID NO: 126466 - DNA, 25 bp, Mus musculus
tacagcgtggaattctcagaggaac

SEQ ID NO: 126467 - DNA, 25 bp, Mus musculus
tacagcgtggacttcatggtggaca

SEQ ID NO: 126468 - DNA, 25 bp, Mus musculus
tacagcgtgggtacttgtggcagcc

SEQ ID NO: 126469 - DNA, 25 bp, Mus musculus
tacagcgtgtagcaatagagagccc

SEQ ID NO: 126470 - DNA, 25 bp, Mus musculus
tacagcgttctaccagcttcggagt

SEQ ID NO: 126471 - DNA, 25 bp, Mus musculus
tacagcgtttccgtttgcagcacgg

SEQ ID NO: 126472 - DNA, 25 bp, Mus musculus
tacagctacaatgagatccacaacc

SEQ ID NO: 126473 - DNA, 25 bp, Mus musculus
tacagctacagaggttcagtcagaa

SEQ ID NO: 126474 - DNA, 25 bp, Mus musculus
tacagctagaaatgatgagagagat

SEQ ID NO: 126475 - DNA, 25 bp, Mus musculus
tacagctatgaaacctacactgtgg

SEQ ID NO: 126476 - DNA, 25 bp, Mus musculus
tacagctatgtctcgggatcggttc

SEQ ID NO: 126477 - DNA, 25 bp, Mus musculus
tacagctctgagtgaccgggagaca

SEQ ID NO: 126478 - DNA, 25 bp, Mus musculus
tacagctctgtgcataagaaggatc

SEQ ID NO: 126479 - DNA, 25 bp, Mus musculus
tacagctcttgcctctacaggagag

SEQ ID NO: 126480 - DNA, 25 bp, Mus musculus
tacagctgacaagcaacacagtgag

SEQ ID NO: 126481 - DNA, 25 bp, Mus musculus
tacagctgcatgtcgcctggtagag

SEQ ID NO: 126482 - DNA, 25 bp, Mus musculus
tacagctgctgaatgccgtcgcaag

SEQ ID NO: 126483 - DNA, 25 bp, Mus musculus
tacagctgctgtgtggcgagcacaa

SEQ ID NO: 126484 - DNA, 25 bp, Mus musculus
tacagctggaaacagcggctcttcg

SEQ ID NO: 126485 - DNA, 25 bp, Mus musculus
tacagctggaggagtgttgcaccca

SEQ ID NO: 126486 - DNA, 25 bp, Mus musculus
tacagctgtagcatatacactcagg

SEQ ID NO: 126487 - DNA, 25 bp, Mus musculus
tacagctgtagtgtctgaacgtgca

SEQ ID NO: 126488 - DNA, 25 bp, Mus musculus
tacagctgtattccaccgagggaca

SEQ ID NO: 126489 - DNA, 25 bp, Mus musculus
tacagctgtggcctttaataaggaa

SEQ ID NO: 126490 - DNA, 25 bp, Mus musculus
tacagctgtgtcgttcaaaagaagg

SEQ ID NO: 126491 - DNA, 25 bp, Mus musculus
tacagctgtgttaccttggaaagca

SEQ ID NO: 126492 - DNA, 25 bp, Mus musculus
tacagcttagatcgcagccactagc

SEQ ID NO: 126493 - DNA, 25 bp, Mus musculus
tacagcttctctaaagtagaggcag

SEQ ID NO: 126494 - DNA, 25 bp, Mus musculus
tacagcttgggatggccacagttca

SEQ ID NO: 126495 - DNA, 25 bp, Mus musculus
tacagctttattgtggactgcagtg

SEQ ID NO: 126496 - DNA, 25 bp, Mus musculus
tacagctttcagactgcagtaggga

SEQ ID NO: 126497 - DNA, 25 bp, Mus musculus
tacaggaagaaatgcacagttgtcg

SEQ ID NO: 126498 - DNA, 25 bp, Mus musculus
tacaggaagagacaccacctagtcg

SEQ ID NO: 126499 - DNA, 25 bp, Mus musculus
tacaggaagagtgcaatgaaaggtt

SEQ ID NO: 126500 - DNA, 25 bp, Mus musculus
tacaggaagcactgccttgaacagg

SEQ ID NO: 126501 - DNA, 25 bp, Mus musculus
tacaggaaggtcaagagtggtcatc

SEQ ID NO: 126502 - DNA, 25 bp, Mus musculus
tacaggaattggtctccaaatatgg

SEQ ID NO: 126503 - DNA, 25 bp, Mus musculus
tacaggacacgagtctgacatcaat

SEQ ID NO: 126504 - DNA, 25 bp, Mus musculus
tacaggacactggactaacgttacg

SEQ ID NO: 126505 - DNA, 25 bp, Mus musculus
tacaggacagaatacagaggagcgt

SEQ ID NO: 126506 - DNA, 25 bp, Mus musculus
tacaggacagacaactcaagcatct

SEQ ID NO: 126507 - DNA, 25 bp, Mus musculus
tacaggacattaagacggcaggacc

SEQ ID NO: 126508 - DNA, 25 bp, Mus musculus
tacaggacccagatgtcagggagtt

SEQ ID NO: 126509 - DNA, 25 bp, Mus musculus
tacaggaccctggagtggccattgc

SEQ ID NO: 126510 - DNA, 25 bp, Mus musculus
tacaggactgcagaatgggtcttcg

SEQ ID NO: 126511 - DNA, 25 bp, Mus musculus
tacaggactgtggtgctggagaact

SEQ ID NO: 126512 - DNA, 25 bp, Mus musculus
tacaggagaagcatcaaacctggtt

SEQ ID NO: 126513 - DNA, 25 bp, Mus musculus
tacaggagcaaaacccctcaggaag

SEQ ID NO: 126514 - DNA, 25 bp, Mus musculus
tacaggagccgtcgccattatgact

SEQ ID NO: 126515 - DNA, 25 bp, Mus musculus
tacaggagctgaagcaactggcacg

SEQ ID NO: 126516 - DNA, 25 bp, Mus musculus
tacaggaggaacgacctgagctctc

SEQ ID NO: 126517 - DNA, 25 bp, Mus musculus
tacaggaggatctggacaagaggca

SEQ ID NO: 126518 - DNA, 25 bp, Mus musculus
tacaggaggtggagccagtaatctc

SEQ ID NO: 126519 - DNA, 25 bp, Mus musculus
tacaggagtagatgggtcgcctctc

SEQ ID NO: 126520 - DNA, 25 bp, Mus musculus
tacaggagtgattctgccaaccagg

SEQ ID NO: 126521 - DNA, 25 bp, Mus musculus
tacaggagtggtcgttaaaggccca

SEQ ID NO: 126522 - DNA, 25 bp, Mus musculus
tacaggataccagtgataaagagcc

SEQ ID NO: 126523 - DNA, 25 bp, Mus musculus
tacaggatcgtcaatgtggactcca

SEQ ID NO: 126524 - DNA, 25 bp, Mus musculus
tacaggatgtcaccaggagtcagag

SEQ ID NO: 126525 - DNA, 25 bp, Mus musculus
tacaggattgactattgcagcccca

SEQ ID NO: 126526 - DNA, 25 bp, Mus musculus
tacaggcaagactgactgcatggca

SEQ ID NO: 126527 - DNA, 25 bp, Mus musculus
tacaggcaggaacgcgaaggcttcc

SEQ ID NO: 126528 - DNA, 25 bp, Mus musculus
tacaggcagttattcaacagccacg

SEQ ID NO: 126529 - DNA, 25 bp, Mus musculus
tacaggcatgctttagcaggtccag

SEQ ID NO: 126530 - DNA, 25 bp, Mus musculus
tacaggcattgtggagacccacttc

SEQ ID NO: 126531 - DNA, 25 bp, Mus musculus
tacaggccattggtgtagcttgaag

SEQ ID NO: 126532 - DNA, 25 bp, Mus musculus
tacaggcccggagtctacgctttgt

SEQ ID NO: 126533 - DNA, 25 bp, Mus musculus
tacaggcccggttagcattctctgc

SEQ ID NO: 126534 - DNA, 25 bp, Mus musculus
tacaggcccttcagcaaagtgggtc

SEQ ID NO: 126535 - DNA, 25 bp, Mus musculus
tacaggccttggaacagagtgatcg

SEQ ID NO: 126536 - DNA, 25 bp, Mus musculus
tacaggccttggacggagagaccaa

SEQ ID NO: 126537 - DNA, 25 bp, Mus musculus
tacaggcgccttgtggagcaaatag

SEQ ID NO: 126538 - DNA, 25 bp, Mus musculus
tacaggcgtgaacaacaaaactgaa

SEQ ID NO: 126539 - DNA, 25 bp, Mus musculus
tacaggcgtgttccagttcagcagg

SEQ ID NO: 126540 - DNA, 25 bp, Mus musculus
tacaggctgagtctgggaaacctcg

SEQ ID NO: 126541 - DNA, 25 bp, Mus musculus
tacaggctggtgtccctagagggcc

SEQ ID NO: 126542 - DNA, 25 bp, Mus musculus
tacagggaaagccactcgtgcagtg

SEQ ID NO: 126543 - DNA, 25 bp, Mus musculus
tacagggaacggaagcttgagaagc

SEQ ID NO: 126544 - DNA, 25 bp, Mus musculus
tacagggacttgctgtgcttgccaa

SEQ ID NO: 126545 - DNA, 25 bp, Mus musculus
tacagggagccaggcaacagtgtcc

SEQ ID NO: 126546 - DNA, 25 bp, Mus musculus
tacagggattctaacaggagaggcc

SEQ ID NO: 126547 - DNA, 25 bp, Mus musculus
tacagggcagaaacggataatggtg

SEQ ID NO: 126548 - DNA, 25 bp, Mus musculus
tacagggcagcagtttcagcaggca

SEQ ID NO: 126549 - DNA, 25 bp, Mus musculus
tacagggcatccgaattgactcaga

SEQ ID NO: 126550 - DNA, 25 bp, Mus musculus
tacagggtatccaacagaagtccag

SEQ ID NO: 126551 - DNA, 25 bp, Mus musculus
tacagggtcctagtgaagagccgat

SEQ ID NO: 126552 - DNA, 25 bp, Mus musculus
tacagggtgataggctggctaccag

SEQ ID NO: 126553 - DNA, 25 bp, Mus musculus
tacagggtgccatcgaagactggaa

SEQ ID NO: 126554 - DNA, 25 bp, Mus musculus
tacagggtggtctccagccaccgat

SEQ ID NO: 126555 - DNA, 25 bp, Mus musculus
tacagggttccagtatgatgtcatc

SEQ ID NO: 126556 - DNA, 25 bp, Mus musculus
tacaggtcagcgtcagcagttggca

SEQ ID NO: 126557 - DNA, 25 bp, Mus musculus
tacaggtcatcgctatgtccaaggc

SEQ ID NO: 126558 - DNA, 25 bp, Mus musculus
tacaggtccaccaggttgcggaaaa

SEQ ID NO: 126559 - DNA, 25 bp, Mus musculus
tacaggtccaggctgcccagtttgc

SEQ ID NO: 126560 - DNA, 25 bp, Mus musculus
tacaggtccatgaagtccacagggc

SEQ ID NO: 126561 - DNA, 25 bp, Mus musculus
tacaggtccggaagaataagcgccg

SEQ ID NO: 126562 - DNA, 25 bp, Mus musculus
tacaggtgactctatgcacagccca

SEQ ID NO: 126563 - DNA, 25 bp, Mus musculus
tacaggtgcctaattcaaggtggcg

SEQ ID NO: 126564 - DNA, 25 bp, Mus musculus
tacaggtggatgacagctacgccag

SEQ ID NO: 126565 - DNA, 25 bp, Mus musculus
tacaggtgtccaaagactctgcgag

SEQ ID NO: 126566 - DNA, 25 bp, Mus musculus
tacaggttgcgcgatggttcaggaa

SEQ ID NO: 126567 - DNA, 25 bp, Mus musculus
tacaggttgtccatgacgatcccag

SEQ ID NO: 126568 - DNA, 25 bp, Mus musculus
tacagtaaataaaagacatattgac

SEQ ID NO: 126569 - DNA, 25 bp, Mus musculus
tacagtacatcgagtcaggcttcct

SEQ ID NO: 126570 - DNA, 25 bp, Mus musculus
tacagtactgaagaaagcccagccc

SEQ ID NO: 126571 - DNA, 25 bp, Mus musculus
tacagtagagaaccacccaagggtg

SEQ ID NO: 126572 - DNA, 25 bp, Mus musculus
tacagtagcatggaacggctttccc

SEQ ID NO: 126573 - DNA, 25 bp, Mus musculus
tacagtagctttccccattcattgg

SEQ ID NO: 126574 - DNA, 25 bp, Mus musculus
tacagtaggatccaaagagcagccc

SEQ ID NO: 126575 - DNA, 25 bp, Mus musculus
tacagtataaggtggccgagcccta

SEQ ID NO: 126576 - DNA, 25 bp, Mus musculus
tacagtatatgtcctggccagacca

SEQ ID NO: 126577 - DNA, 25 bp, Mus musculus
tacagtatcctttgggaaggccacc

SEQ ID NO: 126578 - DNA, 25 bp, Mus musculus
tacagtatgtgttgtgtgccgccac

SEQ ID NO: 126579 - DNA, 25 bp, Mus musculus
tacagtatttttgcagctatcttgc

SEQ ID NO: 126580 - DNA, 25 bp, Mus musculus
tacagtcaagacctctagccggaga

SEQ ID NO: 126581 - DNA, 25 bp, Mus musculus
tacagtcagaccaagaggctcatgc

SEQ ID NO: 126582 - DNA, 25 bp, Mus musculus
tacagtcagcagttgttcctggcat

SEQ ID NO: 126583 - DNA, 25 bp, Mus musculus
tacagtcagcgtcattgtcaagaac

SEQ ID NO: 126584 - DNA, 25 bp, Mus musculus
tacagtcatcgccagaaggagcagg

SEQ ID NO: 126585 - DNA, 25 bp, Mus musculus
tacagtccactcacaacaaacagcg

SEQ ID NO: 126586 - DNA, 25 bp, Mus musculus
tacagtcccatgtgcaaggcgagac

SEQ ID NO: 126587 - DNA, 25 bp, Mus musculus
tacagtcgcaacaggagctgatggc

SEQ ID NO: 126588 - DNA, 25 bp, Mus musculus
tacagtcgcgagacgatctcctgag

SEQ ID NO: 126589 - DNA, 25 bp, Mus musculus
tacagtcgctttgaatccaagatcc

SEQ ID NO: 126590 - DNA, 25 bp, Mus musculus
tacagtcggccaaaagttctgctgg

SEQ ID NO: 126591 - DNA, 25 bp, Mus musculus
tacagtcggcgcttctggcaaggta

SEQ ID NO: 126592 - DNA, 25 bp, Mus musculus
tacagtcgggactgaaggattccga

SEQ ID NO: 126593 - DNA, 25 bp, Mus musculus
tacagtcgtggtatataaaaccaac

SEQ ID NO: 126594 - DNA, 25 bp, Mus musculus
tacagtctccagtgacagtcatggc

SEQ ID NO: 126595 - DNA, 25 bp, Mus musculus
tacagtctctatggtgggaacgcag

SEQ ID NO: 126596 - DNA, 25 bp, Mus musculus
tacagtctgaagcttcttaggcacc

SEQ ID NO: 126597 - DNA, 25 bp, Mus musculus
tacagtctgtcgctagatcccaagg

SEQ ID NO: 126598 - DNA, 25 bp, Mus musculus
tacagtctttgtgcagcccctggac

SEQ ID NO: 126599 - DNA, 25 bp, Mus musculus
tacagtgaagagaccctaagagccc

SEQ ID NO: 126600 - DNA, 25 bp, Mus musculus
tacagtgaatatagagccagccttg

SEQ ID NO: 126601 - DNA, 25 bp, Mus musculus
tacagtgacctaaaacgctgctttg

SEQ ID NO: 126602 - DNA, 25 bp, Mus musculus
tacagtgacgaaagcgactctgcca

SEQ ID NO: 126603 - DNA, 25 bp, Mus musculus
tacagtgacgcctctgagaaattca

SEQ ID NO: 126604 - DNA, 25 bp, Mus musculus
tacagtgacggccttggagcaaact

SEQ ID NO: 126605 - DNA, 25 bp, Mus musculus
tacagtgactgcacttgggacagac

SEQ ID NO: 126606 - DNA, 25 bp, Mus musculus
tacagtgagccttcgaaacgcgggc

SEQ ID NO: 126607 - DNA, 25 bp, Mus musculus
tacagtgagtaacctgattatgatc

SEQ ID NO: 126608 - DNA, 25 bp, Mus musculus
tacagtgagttcttcaccggcagca

SEQ ID NO: 126609 - DNA, 25 bp, Mus musculus
tacagtgatcatatgaccttcagct

SEQ ID NO: 126610 - DNA, 25 bp, Mus musculus
tacagtgatccttggtctgctggcc

SEQ ID NO: 126611 - DNA, 25 bp, Mus musculus
tacagtgattagaaacatggaggcc

SEQ ID NO: 126612 - DNA, 25 bp, Mus musculus
tacagtgcaaagaacaccagcgagc

SEQ ID NO: 126613 - DNA, 25 bp, Mus musculus
tacagtgcagatggcggaaatggac

SEQ ID NO: 126614 - DNA, 25 bp, Mus musculus
tacagtgccaagtctggaagcaagc

SEQ ID NO: 126615 - DNA, 25 bp, Mus musculus
tacagtgcccggatccgcagcactg

SEQ ID NO: 126616 - DNA, 25 bp, Mus musculus
tacagtgccgacatggagactttgc

SEQ ID NO: 126617 - DNA, 25 bp, Mus musculus
tacagtgcgcagatggcagtgtccc

SEQ ID NO: 126618 - DNA, 25 bp, Mus musculus
tacagtgctacagccagctaggcag

SEQ ID NO: 126619 - DNA, 25 bp, Mus musculus
tacagtgctctacgccggaagttct

SEQ ID NO: 126620 - DNA, 25 bp, Mus musculus
tacagtggaaacagaggcatccccg

SEQ ID NO: 126621 - DNA, 25 bp, Mus musculus
tacagtggaacctgagaaccagaca

SEQ ID NO: 126622 - DNA, 25 bp, Mus musculus
tacagtggactacttgagcgacatc

SEQ ID NO: 126623 - DNA, 25 bp, Mus musculus
tacagtggcattcgaaggaagacct

SEQ ID NO: 126624 - DNA, 25 bp, Mus musculus
tacagtggccaaaagcattcgtagc

SEQ ID NO: 126625 - DNA, 25 bp, Mus musculus
tacagtggccccatagcacaaagga

SEQ ID NO: 126626 - DNA, 25 bp, Mus musculus
tacagtggccgggaaagggtctact

SEQ ID NO: 126627 - DNA, 25 bp, Mus musculus
tacagtggctacaatggacagctgc

SEQ ID NO: 126628 - DNA, 25 bp, Mus musculus
tacagtgggtgaaaccagagcctaa

SEQ ID NO: 126629 - DNA, 25 bp, Mus musculus
tacagtggtgtggaccccataacaa

SEQ ID NO: 126630 - DNA, 25 bp, Mus musculus
tacagtgtaagtcctcaaacgccat

SEQ ID NO: 126631 - DNA, 25 bp, Mus musculus
tacagtgtcactagaggaacctgcc

SEQ ID NO: 126632 - DNA, 25 bp, Mus musculus
tacagtgtgatgaccttagtaagca

SEQ ID NO: 126633 - DNA, 25 bp, Mus musculus
tacagtgttagtggtcccggtgcca

SEQ ID NO: 126634 - DNA, 25 bp, Mus musculus
tacagttactgccaatcgacagggc

SEQ ID NO: 126635 - DNA, 25 bp, Mus musculus
tacagttagtgtatggagtccggct

SEQ ID NO: 126636 - DNA, 25 bp, Mus musculus
tacagttatgtatgggtgcgctcaa

SEQ ID NO: 126637 - DNA, 25 bp, Mus musculus
tacagttcagagatgaggcctacct

SEQ ID NO: 126638 - DNA, 25 bp, Mus musculus
tacagttcatgtccctgcagaggca

SEQ ID NO: 126639 - DNA, 25 bp, Mus musculus
tacagttccaggatgagggcggtca

SEQ ID NO: 126640 - DNA, 25 bp, Mus musculus
tacagttccgcttgtaactcaggcc

SEQ ID NO: 126641 - DNA, 25 bp, Mus musculus
tacagttcctagactgggtccttcg

SEQ ID NO: 126642 - DNA, 25 bp, Mus musculus
tacagttcgagcaggagatcgagcg

SEQ ID NO: 126643 - DNA, 25 bp, Mus musculus
tacagttgaaccatgcaccgaggag

SEQ ID NO: 126644 - DNA, 25 bp, Mus musculus
tacagttgaatatttggccccatgg

SEQ ID NO: 126645 - DNA, 25 bp, Mus musculus
tacagttgatgaaggaaacagtgcc

SEQ ID NO: 126646 - DNA, 25 bp, Mus musculus
tacagttgctggtcctaggccggaa

SEQ ID NO: 126647 - DNA, 25 bp, Mus musculus
tacagttggaccacccatttgggag

SEQ ID NO: 126648 - DNA, 25 bp, Mus musculus
tacagttggatgcttctttaggaaa

SEQ ID NO: 126649 - DNA, 25 bp, Mus musculus
tacagttggtgcctcctggacagat

SEQ ID NO: 126650 - DNA, 25 bp, Mus musculus
tacagtttacgtttaaaatgtcaag

SEQ ID NO: 126651 - DNA, 25 bp, Mus musculus
tacagtttattatgagaacacaggg

SEQ ID NO: 126652 - DNA, 25 bp, Mus musculus
tacagtttccatacaaggagccaga

SEQ ID NO: 126653 - DNA, 25 bp, Mus musculus
tacagttttgagttcccggctggtc

SEQ ID NO: 126654 - DNA, 25 bp, Mus musculus
tacataaggctgagcgattgggacc

SEQ ID NO: 126655 - DNA, 25 bp, Mus musculus
tacataagtacgagggcgagccaga

SEQ ID NO: 126656 - DNA, 25 bp, Mus musculus
tacataatgggagtgaacccgacgg

SEQ ID NO: 126657 - DNA, 25 bp, Mus musculus
tacatacacacctattctgtggctg

SEQ ID NO: 126658 - DNA, 25 bp, Mus musculus
tacatacagctgaaaggtggcaggg

SEQ ID NO: 126659 - DNA, 25 bp, Mus musculus
tacatacatgggaatagaggccctg

SEQ ID NO: 126660 - DNA, 25 bp, Mus musculus
tacatacattcaatagagaccggga

SEQ ID NO: 126661 - DNA, 25 bp, Mus musculus
tacataccagaacgccctaagtggg

SEQ ID NO: 126662 - DNA, 25 bp, Mus musculus
tacatacgggtgtggtagctagtac

SEQ ID NO: 126663 - DNA, 25 bp, Mus musculus
tacatagaatcgatgaagcccaaca

SEQ ID NO: 126664 - DNA, 25 bp, Mus musculus
tacatagaccacctgaaggcctggc

SEQ ID NO: 126665 - DNA, 25 bp, Mus musculus
tacatagactatgaaggacgctccg

SEQ ID NO: 126666 - DNA, 25 bp, Mus musculus
tacatagcccagtcagttctgagtg

SEQ ID NO: 126667 - DNA, 25 bp, Mus musculus
tacatagcgcctgcaagttcggcgt

SEQ ID NO: 126668 - DNA, 25 bp, Mus musculus
tacatagctatagtcatgttgcagt

SEQ ID NO: 126669 - DNA, 25 bp, Mus musculus
tacataggcactgaaggtggcggca

SEQ ID NO: 126670 - DNA, 25 bp, Mus musculus
tacataggccgacatctagtcctcc

SEQ ID NO: 126671 - DNA, 25 bp, Mus musculus
tacatagggagcgtagagacatggc

SEQ ID NO: 126672 - DNA, 25 bp, Mus musculus
tacatagtacgcaggaggacaccag

SEQ ID NO: 126673 - DNA, 25 bp, Mus musculus
tacatagtcgaaaggcctagcactg

SEQ ID NO: 126674 - DNA, 25 bp, Mus musculus
tacatagttggctcacggtggctcc

SEQ ID NO: 126675 - DNA, 25 bp, Mus musculus
tacatataccctgtggtcagtcgca

SEQ ID NO: 126676 - DNA, 25 bp, Mus musculus
tacatatggaagtggtatgaccagc

SEQ ID NO: 126677 - DNA, 25 bp, Mus musculus
tacatatggaggttttcaaccagcg

SEQ ID NO: 126678 - DNA, 25 bp, Mus musculus
tacatatgtcgtgatggcaccactc

SEQ ID NO: 126679 - DNA, 25 bp, Mus musculus
tacatatgtggttcccgacattcac

SEQ ID NO: 126680 - DNA, 25 bp, Mus musculus
tacatattcactgtttgcagctgag

SEQ ID NO: 126681 - DNA, 25 bp, Mus musculus
tacatatttaatctggcactggctg

SEQ ID NO: 126682 - DNA, 25 bp, Mus musculus
tacatatttacgctgaggacccatc

SEQ ID NO: 126683 - DNA, 25 bp, Mus musculus
tacatcaaaatagccaaagaccggg

SEQ ID NO: 126684 - DNA, 25 bp, Mus musculus
tacatcaacatctgggacaaacaag

SEQ ID NO: 126685 - DNA, 25 bp, Mus musculus
tacatcaaccatgccctggacgttg

SEQ ID NO: 126686 - DNA, 25 bp, Mus musculus
tacatcaacccagagcctatgcgga

SEQ ID NO: 126687 - DNA, 25 bp, Mus musculus
tacatcaacgtttggtacgacccgg

SEQ ID NO: 126688 - DNA, 25 bp, Mus musculus
tacatcaactgacactgggaattcg

SEQ ID NO: 126689 - DNA, 25 bp, Mus musculus
tacatcaacttggtagcctatcctt

SEQ ID NO: 126690 - DNA, 25 bp, Mus musculus
tacatcaagaccgtggtgttcgccc

SEQ ID NO: 126691 - DNA, 25 bp, Mus musculus
tacatcaaggaattactgtcccgga

SEQ ID NO: 126692 - DNA, 25 bp, Mus musculus
tacatcacgaccagagctcagtttg

SEQ ID NO: 126693 - DNA, 25 bp, Mus musculus
tacatcagcaccaagaaggaagacg

SEQ ID NO: 126694 - DNA, 25 bp, Mus musculus
tacatcagcatggtctactagcatc

SEQ ID NO: 126695 - DNA, 25 bp, Mus musculus
tacatcagctggacagagggcacta

SEQ ID NO: 126696 - DNA, 25 bp, Mus musculus
tacatcaggtggacgagaccttccg

SEQ ID NO: 126697 - DNA, 25 bp, Mus musculus
tacatcagtcaagctagagaactcc

SEQ ID NO: 126698 - DNA, 25 bp, Mus musculus
tacatcagtccaaggctcaccatgg

SEQ ID NO: 126699 - DNA, 25 bp, Mus musculus
tacatcataaatggctcaaggcagg

SEQ ID NO: 126700 - DNA, 25 bp, Mus musculus
tacatcatgtccaagctaagccggg

SEQ ID NO: 126701 - DNA, 25 bp, Mus musculus
tacatcatgtgctttcggcgtgaag

SEQ ID NO: 126702 - DNA, 25 bp, Mus musculus
tacatccagaagtacgcaacggaag

SEQ ID NO: 126703 - DNA, 25 bp, Mus musculus
tacatccaggccttccaggtggtca

SEQ ID NO: 126704 - DNA, 25 bp, Mus musculus
tacatcccgccaacaagatacaagg

SEQ ID NO: 126705 - DNA, 25 bp, Mus musculus
tacatcccgtctcaatcagcattgc

SEQ ID NO: 126706 - DNA, 25 bp, Mus musculus
tacatccgatccaagaagctggagc

SEQ ID NO: 126707 - DNA, 25 bp, Mus musculus
tacatccgcaaaagatgcgcacaca

SEQ ID NO: 126708 - DNA, 25 bp, Mus musculus
tacatccgggaagccattaaacacc

SEQ ID NO: 126709 - DNA, 25 bp, Mus musculus
tacatcctaaggtcagagcaagact

SEQ ID NO: 126710 - DNA, 25 bp, Mus musculus
tacatcctcatctttcttactgggc

SEQ ID NO: 126711 - DNA, 25 bp, Mus musculus
tacatcctgctcaacttggccgtgg

SEQ ID NO: 126712 - DNA, 25 bp, Mus musculus
tacatcctggaatcacgagcgagca

SEQ ID NO: 126713 - DNA, 25 bp, Mus musculus
tacatccttacaaagaggcagctgg

SEQ ID NO: 126714 - DNA, 25 bp, Mus musculus
tacatccttctgctggtggtcggct

SEQ ID NO: 126715 - DNA, 25 bp, Mus musculus
tacatcgaccctgagactaagaagc

SEQ ID NO: 126716 - DNA, 25 bp, Mus musculus
tacatcgaggaacctctaggagctg

SEQ ID NO: 126717 - DNA, 25 bp, Mus musculus
tacatcgagtacatggagagcaccc

SEQ ID NO: 126718 - DNA, 25 bp, Mus musculus
tacatcgagtcagatgcctggcagg

SEQ ID NO: 126719 - DNA, 25 bp, Mus musculus
tacatcgctagtccttgtgaatgcc

SEQ ID NO: 126720 - DNA, 25 bp, Mus musculus
tacatcggaacttactgtggacaac

SEQ ID NO: 126721 - DNA, 25 bp, Mus musculus
tacatcgggctcatccttctcaatg

SEQ ID NO: 126722 - DNA, 25 bp, Mus musculus
tacatcgtacatacagccaggactg

SEQ ID NO: 126723 - DNA, 25 bp, Mus musculus
tacatcgtcatggagctcgttcaag

SEQ ID NO: 126724 - DNA, 25 bp, Mus musculus
tacatcgtgaaggtcaacatccagg

SEQ ID NO: 126725 - DNA, 25 bp, Mus musculus
tacatcgtgatgcacagggttgcac

SEQ ID NO: 126726 - DNA, 25 bp, Mus musculus
tacatcgttgtaagcatggccactg

SEQ ID NO: 126727 - DNA, 25 bp, Mus musculus
tacatctaccagctgccgtcctggg

SEQ ID NO: 126728 - DNA, 25 bp, Mus musculus
tacatctaccctgatgaagcggcag

SEQ ID NO: 126729 - DNA, 25 bp, Mus musculus
tacatctaccgcctgatgagcgagc

SEQ ID NO: 126730 - DNA, 25 bp, Mus musculus
tacatctccaagaagctgactcgct

SEQ ID NO: 126731 - DNA, 25 bp, Mus musculus
tacatctccagtgtacagaggctcc

SEQ ID NO: 126732 - DNA, 25 bp, Mus musculus
tacatctcggccaaagcgggcttgg

SEQ ID NO: 126733 - DNA, 25 bp, Mus musculus
tacatctgcccagtgaatgtgtatc

SEQ ID NO: 126734 - DNA, 25 bp, Mus musculus
tacatctgcctcaagggttcctcgc

SEQ ID NO: 126735 - DNA, 25 bp, Mus musculus
tacatctggcttaagattttagtct

SEQ ID NO: 126736 - DNA, 25 bp, Mus musculus
tacatctgggactcgaaactatcgg

SEQ ID NO: 126737 - DNA, 25 bp, Mus musculus
tacatctgtcagtccagggcttgac

SEQ ID NO: 126738 - DNA, 25 bp, Mus musculus
tacatctgtggagaagagacggcac

SEQ ID NO: 126739 - DNA, 25 bp, Mus musculus
tacatcttacagagggctaatgcac

SEQ ID NO: 126740 - DNA, 25 bp, Mus musculus
tacatcttcagacggtgggcaggct

SEQ ID NO: 126741 - DNA, 25 bp, Mus musculus
tacatcttgctggtgggatacccac

SEQ ID NO: 126742 - DNA, 25 bp, Mus musculus
tacatcttggacgtgctgagcacag

SEQ ID NO: 126743 - DNA, 25 bp, Mus musculus
tacatcttgtgggaggcttcagtga

SEQ ID NO: 126744 - DNA, 25 bp, Mus musculus
tacatgaagaaagactcagcagcca

SEQ ID NO: 126745 - DNA, 25 bp, Mus musculus
tacatgaaggatcctgtccacaagc

SEQ ID NO: 126746 - DNA, 25 bp, Mus musculus
tacatgacaaaatgtggccacagct

SEQ ID NO: 126747 - DNA, 25 bp, Mus musculus
tacatgacgtggacctcgctgaggt

SEQ ID NO: 126748 - DNA, 25 bp, Mus musculus
tacatgacttcggtccctgaaaacg

SEQ ID NO: 126749 - DNA, 25 bp, Mus musculus
tacatgagcaggatacaggtgggcc

SEQ ID NO: 126750 - DNA, 25 bp, Mus musculus
tacatgagcatggagaacaaccaac

SEQ ID NO: 126751 - DNA, 25 bp, Mus musculus
tacatgaggccacagctcggctgat

SEQ ID NO: 126752 - DNA, 25 bp, Mus musculus
tacatgatacgtctgggagcccagg

SEQ ID NO: 126753 - DNA, 25 bp, Mus musculus
tacatgatactgtggctcaaaagag

SEQ ID NO: 126754 - DNA, 25 bp, Mus musculus
tacatgatgccaacagagggcgatg

SEQ ID NO: 126755 - DNA, 25 bp, Mus musculus
tacatgatggagctgctcacggccc

SEQ ID NO: 126756 - DNA, 25 bp, Mus musculus
tacatgcaactaaggaaaagctgag

SEQ ID NO: 126757 - DNA, 25 bp, Mus musculus
tacatgcacgctttccaaggctgaa

SEQ ID NO: 126758 - DNA, 25 bp, Mus musculus
tacatgcacggtctgtcgaaggtcc

SEQ ID NO: 126759 - DNA, 25 bp, Mus musculus
tacatgcactcaggaccagtggttg

SEQ ID NO: 126760 - DNA, 25 bp, Mus musculus
tacatgcagagtgccacagtggagc

SEQ ID NO: 126761 - DNA, 25 bp, Mus musculus
tacatgcagcttcttcagcaggccc

SEQ ID NO: 126762 - DNA, 25 bp, Mus musculus
tacatgcagcttggaggaagggtcc

SEQ ID NO: 126763 - DNA, 25 bp, Mus musculus
tacatgcattaggaaaaaactgccc

SEQ ID NO: 126764 - DNA, 25 bp, Mus musculus
tacatgccaaagacccagatgctgc

SEQ ID NO: 126765 - DNA, 25 bp, Mus musculus
tacatgcccaaacgtggcctggaag

SEQ ID NO: 126766 - DNA, 25 bp, Mus musculus
tacatgccccagaacgtctactgtg

SEQ ID NO: 126767 - DNA, 25 bp, Mus musculus
tacatgcccctgtcagaagcagagg

SEQ ID NO: 126768 - DNA, 25 bp, Mus musculus
tacatgccctgtctgatgctcgatg

SEQ ID NO: 126769 - DNA, 25 bp, Mus musculus
tacatgccgaaaaacggaggtcagg

SEQ ID NO: 126770 - DNA, 25 bp, Mus musculus
tacatgcgccagatcgaccagatgg

SEQ ID NO: 126771 - DNA, 25 bp, Mus musculus
tacatgcggagcagaacgctttgac

SEQ ID NO: 126772 - DNA, 25 bp, Mus musculus
tacatgcgggctctcagcaacattg

SEQ ID NO: 126773 - DNA, 25 bp, Mus musculus
tacatgctagaagtgtgcctgagcc

SEQ ID NO: 126774 - DNA, 25 bp, Mus musculus
tacatgctcagtgaagacaggcggc

SEQ ID NO: 126775 - DNA, 25 bp, Mus musculus
tacatgctgcttcagagagggtgct

SEQ ID NO: 126776 - DNA, 25 bp, Mus musculus
tacatgcttttgtgccacccttggg

SEQ ID NO: 126777 - DNA, 25 bp, Mus musculus
tacatggaaccccagaccaaaagcg

SEQ ID NO: 126778 - DNA, 25 bp, Mus musculus
tacatggaccattcccagaaggagg

SEQ ID NO: 126779 - DNA, 25 bp, Mus musculus
tacatggacctcctagcatttgaga

SEQ ID NO: 126780 - DNA, 25 bp, Mus musculus
tacatggacctgcttatggactgga

SEQ ID NO: 126781 - DNA, 25 bp, Mus musculus
tacatggacctggtgctaggcactc

SEQ ID NO: 126782 - DNA, 25 bp, Mus musculus
tacatggacgaccagtactggcccg

SEQ ID NO: 126783 - DNA, 25 bp, Mus musculus
tacatggagcggctacagctgctgt

SEQ ID NO: 126784 - DNA, 25 bp, Mus musculus
tacatggcagattctgaaactttca

SEQ ID NO: 126785 - DNA, 25 bp, Mus musculus
tacatggccccggaagttctagaat

SEQ ID NO: 126786 - DNA, 25 bp, Mus musculus
tacatggcgcaggtgatggccccgg

SEQ ID NO: 126787 - DNA, 25 bp, Mus musculus
tacatggctttcatgatcagccgcg

SEQ ID NO: 126788 - DNA, 25 bp, Mus musculus
tacatgggagagaccacagcctttg

SEQ ID NO: 126789 - DNA, 25 bp, Mus musculus
tacatgggctaaacctgtcttggca

SEQ ID NO: 126790 - DNA, 25 bp, Mus musculus
tacatgggctacgagccagggcatc

SEQ ID NO: 126791 - DNA, 25 bp, Mus musculus
tacatgggctgtgtggaggtcttac

SEQ ID NO: 126792 - DNA, 25 bp, Mus musculus
tacatgggtccgaagcggtttcgcc

SEQ ID NO: 126793 - DNA, 25 bp, Mus musculus
tacatgggttcaagaaagggcaggc

SEQ ID NO: 126794 - DNA, 25 bp, Mus musculus
tacatggtaggagagagctggcttc

SEQ ID NO: 126795 - DNA, 25 bp, Mus musculus
tacatggtcacaacaggcagtggcc

SEQ ID NO: 126796 - DNA, 25 bp, Mus musculus
tacatggtcagctggtatggcttaa

SEQ ID NO: 126797 - DNA, 25 bp, Mus musculus
tacatggtgcacacgtctctggatg

SEQ ID NO: 126798 - DNA, 25 bp, Mus musculus
tacatggtggccgacaagttcacag

SEQ ID NO: 126799 - DNA, 25 bp, Mus musculus
tacatggtggtcaacgtcagcagcc

SEQ ID NO: 126800 - DNA, 25 bp, Mus musculus
tacatggtggtgctccggtttgcaa

SEQ ID NO: 126801 - DNA, 25 bp, Mus musculus
tacatggttatggtcagaaggcctc

SEQ ID NO: 126802 - DNA, 25 bp, Mus musculus
tacatgtaagatcctgtcagggcca

SEQ ID NO: 126803 - DNA, 25 bp, Mus musculus
tacatgtagtcaaagaagtccgttt

SEQ ID NO: 126804 - DNA, 25 bp, Mus musculus
tacatgtatcagctgtgcaaatcgc

SEQ ID NO: 126805 - DNA, 25 bp, Mus musculus
tacatgtccaagatgggcaacccct

SEQ ID NO: 126806 - DNA, 25 bp, Mus musculus
tacatgtcgcagagcagcggtgatc

SEQ ID NO: 126807 - DNA, 25 bp, Mus musculus
tacatgtctgcggtgtgctggctct

SEQ ID NO: 126808 - DNA, 25 bp, Mus musculus
tacatgtgagcgaggctttgccgcc

SEQ ID NO: 126809 - DNA, 25 bp, Mus musculus
tacatgtggccacacctggaacact

SEQ ID NO: 126810 - DNA, 25 bp, Mus musculus
tacatgtgggacaagatgactctgg

SEQ ID NO: 126811 - DNA, 25 bp, Mus musculus
tacatgtgtatagagcctggctggt

SEQ ID NO: 126812 - DNA, 25 bp, Mus musculus
tacatgtgtgaagccatgctgatcc

SEQ ID NO: 126813 - DNA, 25 bp, Mus musculus
tacatgttcctgctcatcgtgctgg

SEQ ID NO: 126814 - DNA, 25 bp, Mus musculus
tacattaaccagctggaagctctgt

SEQ ID NO: 126815 - DNA, 25 bp, Mus musculus
tacattaacgagtacaggccagctc

SEQ ID NO: 126816 - DNA, 25 bp, Mus musculus
tacattagggccagcgttaacctct

SEQ ID NO: 126817 - DNA, 25 bp, Mus musculus
tacattatgagcagggttcccctcg

SEQ ID NO: 126818 - DNA, 25 bp, Mus musculus
tacattatggacaaaggcttcaaag

SEQ ID NO: 126819 - DNA, 25 bp, Mus musculus
tacattcaacagaaggtccgcgtgc

SEQ ID NO: 126820 - DNA, 25 bp, Mus musculus
tacattcacgaagatgcgctccaac

SEQ ID NO: 126821 - DNA, 25 bp, Mus musculus
tacattcactgggaaagggcttgcc

SEQ ID NO: 126822 - DNA, 25 bp, Mus musculus
tacattcagaaggatctccgcctgg

SEQ ID NO: 126823 - DNA, 25 bp, Mus musculus
tacattccaagtcaggaccagcaca

SEQ ID NO: 126824 - DNA, 25 bp, Mus musculus
tacattcgatacattcagcagggac

SEQ ID NO: 126825 - DNA, 25 bp, Mus musculus
tacattcgggcggtggatacctcag

SEQ ID NO: 126826 - DNA, 25 bp, Mus musculus
tacattctcattgctgtgggagctg

SEQ ID NO: 126827 - DNA, 25 bp, Mus musculus
tacattcttcgccatgacggagccc

SEQ ID NO: 126828 - DNA, 25 bp, Mus musculus
tacattgaagccctcagtagtgccc

SEQ ID NO: 126829 - DNA, 25 bp, Mus musculus
tacattgaccgagtagatgaacccg

SEQ ID NO: 126830 - DNA, 25 bp, Mus musculus
tacattgactgtgacctgaatcgtg

SEQ ID NO: 126831 - DNA, 25 bp, Mus musculus
tacattgagaagtttgtccgccggg

SEQ ID NO: 126832 - DNA, 25 bp, Mus musculus
tacattgagatgaaaagagttgcag

SEQ ID NO: 126833 - DNA, 25 bp, Mus musculus
tacattgagcatcaataacagactc

SEQ ID NO: 126834 - DNA, 25 bp, Mus musculus
tacattgatctgatggagacaaccc

SEQ ID NO: 126835 - DNA, 25 bp, Mus musculus
tacattgatgagctgtacggaggcc

SEQ ID NO: 126836 - DNA, 25 bp, Mus musculus
tacattgcagagttgaccctggcca

SEQ ID NO: 126837 - DNA, 25 bp, Mus musculus
tacattgccacgagcagtgaccact

SEQ ID NO: 126838 - DNA, 25 bp, Mus musculus
tacattgcctcaacacagagacccg

SEQ ID NO: 126839 - DNA, 25 bp, Mus musculus
tacattgcgaaggacatcacagatc

SEQ ID NO: 126840 - DNA, 25 bp, Mus musculus
tacattgcggtcatagaaggcttgg

SEQ ID NO: 126841 - DNA, 25 bp, Mus musculus
tacattgctggcactatggaagaca

SEQ ID NO: 126842 - DNA, 25 bp, Mus musculus
tacattggaggcaccaacggagcat

SEQ ID NO: 126843 - DNA, 25 bp, Mus musculus
tacattggagtgatgatgctgaccc

SEQ ID NO: 126844 - DNA, 25 bp, Mus musculus
tacattggctaagggtacagggaag

SEQ ID NO: 126845 - DNA, 25 bp, Mus musculus
tacattgggaatagcttctgtgccg

SEQ ID NO: 126846 - DNA, 25 bp, Mus musculus
tacattgtatccacaccgcctggag

SEQ ID NO: 126847 - DNA, 25 bp, Mus musculus
tacattgtgacctacgccttgggaa

SEQ ID NO: 126848 - DNA, 25 bp, Mus musculus
tacattgtgctacatgagggagccc

SEQ ID NO: 126849 - DNA, 25 bp, Mus musculus
tacattgtggttccccaaacagctc

SEQ ID NO: 126850 - DNA, 25 bp, Mus musculus
tacatttatatgcagagggcgtcag

SEQ ID NO: 126851 - DNA, 25 bp, Mus musculus
tacatttcaccctgtgtggcgggcc

SEQ ID NO: 126852 - DNA, 25 bp, Mus musculus
tacatttccgtctcatagccaggag

SEQ ID NO: 126853 - DNA, 25 bp, Mus musculus
tacatttgctaatccagaggctgag

SEQ ID NO: 126854 - DNA, 25 bp, Mus musculus
tacatttggagtatgccaagcgggc

SEQ ID NO: 126855 - DNA, 25 bp, Mus musculus
taccaaaatccgcatgcacgcaagg

SEQ ID NO: 126856 - DNA, 25 bp, Mus musculus
taccaaactatacagccgacaaggc

SEQ ID NO: 126857 - DNA, 25 bp, Mus musculus
taccaaactgggactgttcgacact

SEQ ID NO: 126858 - DNA, 25 bp, Mus musculus
taccaaagaagactgacggtggcca

SEQ ID NO: 126859 - DNA, 25 bp, Mus musculus
taccaaagaagccaagacagagact

SEQ ID NO: 126860 - DNA, 25 bp, Mus musculus
taccaaagaaggaactgatgaggcc

SEQ ID NO: 126861 - DNA, 25 bp, Mus musculus
taccaaaggcaataagcggtcccgg

SEQ ID NO: 126862 - DNA, 25 bp, Mus musculus
taccaaagggaaaatgcggttgcct

SEQ ID NO: 126863 - DNA, 25 bp, Mus musculus
taccaaataaggaacacagcaggct

SEQ ID NO: 126864 - DNA, 25 bp, Mus musculus
taccaaatccgccaagaaagtcagg

SEQ ID NO: 126865 - DNA, 25 bp, Mus musculus
taccaaatggtcctggcctgagcac

SEQ ID NO: 126866 - DNA, 25 bp, Mus musculus
taccaaattcaggagcatcagccca

SEQ ID NO: 126867 - DNA, 25 bp, Mus musculus
taccaacatgcggatagccaggaca

SEQ ID NO: 126868 - DNA, 25 bp, Mus musculus
taccaaccatgtcactccagaagag

SEQ ID NO: 126869 - DNA, 25 bp, Mus musculus
taccaacctgtttggccgaggcatg

SEQ ID NO: 126870 - DNA, 25 bp, Mus musculus
taccaacgcgtgctacatggaggag

SEQ ID NO: 126871 - DNA, 25 bp, Mus musculus
taccaacgctattaaagctgcggtc

SEQ ID NO: 126872 - DNA, 25 bp, Mus musculus
taccaacggtaccttcctgagtgcg

SEQ ID NO: 126873 - DNA, 25 bp, Mus musculus
taccaactccatttgatgggactcc

SEQ ID NO: 126874 - DNA, 25 bp, Mus musculus
taccaagaaggatgagcagtggcca

SEQ ID NO: 126875 - DNA, 25 bp, Mus musculus
taccaagaagtaaatgcccagacgt

SEQ ID NO: 126876 - DNA, 25 bp, Mus musculus
taccaagacttcgaggcagacatcc

SEQ ID NO: 126877 - DNA, 25 bp, Mus musculus
taccaagatgctgtcaaagtttagg

SEQ ID NO: 126878 - DNA, 25 bp, Mus musculus
taccaagcacctctcaaacagcgtg

SEQ ID NO: 126879 - DNA, 25 bp, Mus musculus
taccaagccagggactcagtttctc

SEQ ID NO: 126880 - DNA, 25 bp, Mus musculus
taccaagcgacagagattcctagtg

SEQ ID NO: 126881 - DNA, 25 bp, Mus musculus
taccaagcgcgtgggcattatcacc

SEQ ID NO: 126882 - DNA, 25 bp, Mus musculus
taccaaggaagacccattactgaag

SEQ ID NO: 126883 - DNA, 25 bp, Mus musculus
taccaaggacaaggtggcagcagct

SEQ ID NO: 126884 - DNA, 25 bp, Mus musculus
taccaaggagctagaaaacgccctg

SEQ ID NO: 126885 - DNA, 25 bp, Mus musculus
taccaaggagcttcgagacatgtcc

SEQ ID NO: 126886 - DNA, 25 bp, Mus musculus
taccaaggcgtctctctgacctggg

SEQ ID NO: 126887 - DNA, 25 bp, Mus musculus
taccaaggtggaaatggctcgagtc

SEQ ID NO: 126888 - DNA, 25 bp, Mus musculus
taccaagtacctacggagggcagag

SEQ ID NO: 126889 - DNA, 25 bp, Mus musculus
taccaagtctcaggactctaaagag

SEQ ID NO: 126890 - DNA, 25 bp, Mus musculus
taccaatatcgtctggccacaggct

SEQ ID NO: 126891 - DNA, 25 bp, Mus musculus
taccaatctgaatggccacaccgct

SEQ ID NO: 126892 - DNA, 25 bp, Mus musculus
taccaatgagcgcttcctgagtcag

SEQ ID NO: 126893 - DNA, 25 bp, Mus musculus
taccaatggatatgcctcagagctc

SEQ ID NO: 126894 - DNA, 25 bp, Mus musculus
taccaatggcatcgtcatagagccg

SEQ ID NO: 126895 - DNA, 25 bp, Mus musculus
taccaatttcacatcggagctgcgt

SEQ ID NO: 126896 - DNA, 25 bp, Mus musculus
taccacaccctgcagtgagcatgga

SEQ ID NO: 126897 - DNA, 25 bp, Mus musculus
taccacaccctgttgaagggaactt

SEQ ID NO: 126898 - DNA, 25 bp, Mus musculus
taccacacgtggaatgtcaactaca

SEQ ID NO: 126899 - DNA, 25 bp, Mus musculus
taccacagacagtggtgtcaactgt

SEQ ID NO: 126900 - DNA, 25 bp, Mus musculus
taccacagcatggagagtatcctgc

SEQ ID NO: 126901 - DNA, 25 bp, Mus musculus
taccacatgaggtcagagcatgggc

SEQ ID NO: 126902 - DNA, 25 bp, Mus musculus
taccacatgtatgccctgcagaggc

SEQ ID NO: 126903 - DNA, 25 bp, Mus musculus
taccaccaagaaatagaggagtttg

SEQ ID NO: 126904 - DNA, 25 bp, Mus musculus
taccaccagagtcaagacccgtact

SEQ ID NO: 126905 - DNA, 25 bp, Mus musculus
taccaccagtgatgcctagatcctg

SEQ ID NO: 126906 - DNA, 25 bp, Mus musculus
taccacccgatgcttgctaatggtg

SEQ ID NO: 126907 - DNA, 25 bp, Mus musculus
taccacccggagttaagttcagaga

SEQ ID NO: 126908 - DNA, 25 bp, Mus musculus
taccacccggcctcaaagctggttt

SEQ ID NO: 126909 - DNA, 25 bp, Mus musculus
taccaccgagtgtagacgcggcttc

SEQ ID NO: 126910 - DNA, 25 bp, Mus musculus
taccaccgcatgaagccctatctat

SEQ ID NO: 126911 - DNA, 25 bp, Mus musculus
taccaccgcgtgacagactgtgttc

SEQ ID NO: 126912 - DNA, 25 bp, Mus musculus
taccaccgctgtgttcttcgaggtt

SEQ ID NO: 126913 - DNA, 25 bp, Mus musculus
taccaccgtggctacagaagacatc

SEQ ID NO: 126914 - DNA, 25 bp, Mus musculus
taccacgccatggaaggttaccata

SEQ ID NO: 126915 - DNA, 25 bp, Mus musculus
taccacgcggccatttttggaggaa

SEQ ID NO: 126916 - DNA, 25 bp, Mus musculus
taccacggaagcatcagaggcgtca

SEQ ID NO: 126917 - DNA, 25 bp, Mus musculus
taccacggatgaaaacgaagatgac

SEQ ID NO: 126918 - DNA, 25 bp, Mus musculus
taccacggtgtggatgatctacagc

SEQ ID NO: 126919 - DNA, 25 bp, Mus musculus
taccacggttcgtgcgtgtgaacac

SEQ ID NO: 126920 - DNA, 25 bp, Mus musculus
taccacgtagagaggatacggacag

SEQ ID NO: 126921 - DNA, 25 bp, Mus musculus
taccacgtgcacaaagaagttccag

SEQ ID NO: 126922 - DNA, 25 bp, Mus musculus
taccacgtggatgagagtcgaaact

SEQ ID NO: 126923 - DNA, 25 bp, Mus musculus
taccactactttgagaagggccggc

SEQ ID NO: 126924 - DNA, 25 bp, Mus musculus
taccactccgaggagaatcggataa

SEQ ID NO: 126925 - DNA, 25 bp, Mus musculus
taccactgagctggatagtctggga

SEQ ID NO: 126926 - DNA, 25 bp, Mus musculus
taccactggtgtacgaggccttcaa

SEQ ID NO: 126927 - DNA, 25 bp, Mus musculus
taccacttgcaactgcaggcagatg

SEQ ID NO: 126928 - DNA, 25 bp, Mus musculus
taccagaaaaatggcttacatcatg

SEQ ID NO: 126929 - DNA, 25 bp, Mus musculus
taccagaaaacaagtggctgtctcc

SEQ ID NO: 126930 - DNA, 25 bp, Mus musculus
taccagaacagcagtggagacaact

SEQ ID NO: 126931 - DNA, 25 bp, Mus musculus
taccagaaccagcagacctgtgtgg

SEQ ID NO: 126932 - DNA, 25 bp, Mus musculus
taccagaatccgagaacttgcatgc

SEQ ID NO: 126933 - DNA, 25 bp, Mus musculus
taccagaatgaacgaggaccagagt

SEQ ID NO: 126934 - DNA, 25 bp, Mus musculus
taccagacggaattcccagagggac

SEQ ID NO: 126935 - DNA, 25 bp, Mus musculus
taccagactacaaggacggtgccag

SEQ ID NO: 126936 - DNA, 25 bp, Mus musculus
taccagagacttcatgggcagctgt

SEQ ID NO: 126937 - DNA, 25 bp, Mus musculus
taccagagaggcacgttcaagaggc

SEQ ID NO: 126938 - DNA, 25 bp, Mus musculus
taccagagggtgtccttgagccatg

SEQ ID NO: 126939 - DNA, 25 bp, Mus musculus
taccagagtttgtgggacggttgcc

SEQ ID NO: 126940 - DNA, 25 bp, Mus musculus
taccagatagcgctagaggaagtgc

SEQ ID NO: 126941 - DNA, 25 bp, Mus musculus
taccagatctgcagaggtccaagcg

SEQ ID NO: 126942 - DNA, 25 bp, Mus musculus
taccagatctgcaggaatgatcggg

SEQ ID NO: 126943 - DNA, 25 bp, Mus musculus
taccagatgtaggaagaacactgcc

SEQ ID NO: 126944 - DNA, 25 bp, Mus musculus
taccagatttggcactgtagctgtc

SEQ ID NO: 126945 - DNA, 25 bp, Mus musculus
taccagcagcataaatggagacctg

SEQ ID NO: 126946 - DNA, 25 bp, Mus musculus
taccagccaaacatggcagccctgg

SEQ ID NO: 126947 - DNA, 25 bp, Mus musculus
taccagccagaaaccaactcttctt

SEQ ID NO: 126948 - DNA, 25 bp, Mus musculus
taccagcccactgagtatgaacacg

SEQ ID NO: 126949 - DNA, 25 bp, Mus musculus
taccagccggaacagaggaacaaag

SEQ ID NO: 126950 - DNA, 25 bp, Mus musculus
taccagcgaggtttgaccggcttcc

SEQ ID NO: 126951 - DNA, 25 bp, Mus musculus
taccagcgccagtacttcaaggagg

SEQ ID NO: 126952 - DNA, 25 bp, Mus musculus
taccagcgctgaaggaatctacaaa

SEQ ID NO: 126953 - DNA, 25 bp, Mus musculus
taccagcgtggatgccatgacaaca

SEQ ID NO: 126954 - DNA, 25 bp, Mus musculus
taccagcgtgtcaggatcagaagca

SEQ ID NO: 126955 - DNA, 25 bp, Mus musculus
taccagctctgtcatgcccttagat

SEQ ID NO: 126956 - DNA, 25 bp, Mus musculus
taccagctcttcagccgggtgaaag

SEQ ID NO: 126957 - DNA, 25 bp, Mus musculus
taccagctgattgactgtgcccagt

SEQ ID NO: 126958 - DNA, 25 bp, Mus musculus
taccagctgctgtatgcctaccgag

SEQ ID NO: 126959 - DNA, 25 bp, Mus musculus
taccagctgcttaagaaaatgacac

SEQ ID NO: 126960 - DNA, 25 bp, Mus musculus
taccagctgctttcagcatgcgagg

SEQ ID NO: 126961 - DNA, 25 bp, Mus musculus
taccagctggttcggagtttcctaa

SEQ ID NO: 126962 - DNA, 25 bp, Mus musculus
taccagcttatgttgccagaggcca

SEQ ID NO: 126963 - DNA, 25 bp, Mus musculus
taccaggaacgatgggacagtgtcg

SEQ ID NO: 126964 - DNA, 25 bp, Mus musculus
taccaggaagactttgacccgcttg

SEQ ID NO: 126965 - DNA, 25 bp, Mus musculus
taccaggaagagatcaagaggctaa

SEQ ID NO: 126966 - DNA, 25 bp, Mus musculus
taccaggaagcctaacacgaggtgg

SEQ ID NO: 126967 - DNA, 25 bp, Mus musculus
taccaggacccagaatgtgaccgtg

SEQ ID NO: 126968 - DNA, 25 bp, Mus musculus
taccaggagctcatgcaactgaagg

SEQ ID NO: 126969 - DNA, 25 bp, Mus musculus
taccaggagttaggaggcaagaccc

SEQ ID NO: 126970 - DNA, 25 bp, Mus musculus
taccaggagtttgttcggacactgc

SEQ ID NO: 126971 - DNA, 25 bp, Mus musculus
taccaggatacgaatatgcagggag

SEQ ID NO: 126972 - DNA, 25 bp, Mus musculus
taccaggatgggaacagaagccggt

SEQ ID NO: 126973 - DNA, 25 bp, Mus musculus
taccaggatgtggatggcagagacc

SEQ ID NO: 126974 - DNA, 25 bp, Mus musculus
taccaggcaccaagataacagtggg

SEQ ID NO: 126975 - DNA, 25 bp, Mus musculus
taccaggccaaaggtgagggttcct

SEQ ID NO: 126976 - DNA, 25 bp, Mus musculus
taccaggccagttccaggtgtacac

SEQ ID NO: 126977 - DNA, 25 bp, Mus musculus
taccaggccgaggtgatggagaact

SEQ ID NO: 126978 - DNA, 25 bp, Mus musculus
taccaggctaatgctgatgagactg

SEQ ID NO: 126979 - DNA, 25 bp, Mus musculus
taccaggctgatgactatgaggacg

SEQ ID NO: 126980 - DNA, 25 bp, Mus musculus
taccaggcttcggtctgtcacggag

SEQ ID NO: 126981 - DNA, 25 bp, Mus musculus
taccagggacgccatgagatcttcc

SEQ ID NO: 126982 - DNA, 25 bp, Mus musculus
taccagggcagaagatctcgaggct

SEQ ID NO: 126983 - DNA, 25 bp, Mus musculus
taccagggcaggagaatcaccatca

SEQ ID NO: 126984 - DNA, 25 bp, Mus musculus
taccagggtccaaaggtgaacgagg

SEQ ID NO: 126985 - DNA, 25 bp, Mus musculus
taccaggtagatgctgagagccgac

SEQ ID NO: 126986 - DNA, 25 bp, Mus musculus
taccaggtctgtgctataatgcgtg

SEQ ID NO: 126987 - DNA, 25 bp, Mus musculus
taccaggtgccagagaccatcgagt

SEQ ID NO: 126988 - DNA, 25 bp, Mus musculus
taccagtaccagtaccacggcgtga

SEQ ID NO: 126989 - DNA, 25 bp, Mus musculus
taccagtagcagtggcgaggcaagt

SEQ ID NO: 126990 - DNA, 25 bp, Mus musculus
taccagtcagcacctatacagaatg

SEQ ID NO: 126991 - DNA, 25 bp, Mus musculus
taccagtccttcaacaaccagagtg

SEQ ID NO: 126992 - DNA, 25 bp, Mus musculus
taccagtcgggtatgaaccagaccc

SEQ ID NO: 126993 - DNA, 25 bp, Mus musculus
taccagtctggttctaacgatgcgg

SEQ ID NO: 126994 - DNA, 25 bp, Mus musculus
taccagtgaactccctgaaggatgg

SEQ ID NO: 126995 - DNA, 25 bp, Mus musculus
taccagtgacaccaatgacatcgac

SEQ ID NO: 126996 - DNA, 25 bp, Mus musculus
taccagtgagtttttgcaataatgc

SEQ ID NO: 126997 - DNA, 25 bp, Mus musculus
taccagtgatgatgttgaagaccga

SEQ ID NO: 126998 - DNA, 25 bp, Mus musculus
taccagtgcctgacagctgttgcgg

SEQ ID NO: 126999 - DNA, 25 bp, Mus musculus
taccagtggagacggataaaaagcc

SEQ ID NO: 127000 - DNA, 25 bp, Mus musculus
taccagtggccataccaggtgtggg

SEQ ID NO: 127001 - DNA, 25 bp, Mus musculus
taccagtggttttaagagtcaagag

SEQ ID NO: 127002 - DNA, 25 bp, Mus musculus
taccagtgttcagcatggcagtcgt

SEQ ID NO: 127003 - DNA, 25 bp, Mus musculus
taccagttagcgcacctgcatgaaa

SEQ ID NO: 127004 - DNA, 25 bp, Mus musculus
taccagttcagggagagactacaaa

SEQ ID NO: 127005 - DNA, 25 bp, Mus musculus
taccagtttaccaagcaagggccac

SEQ ID NO: 127006 - DNA, 25 bp, Mus musculus
taccagtttgtgcagcggatgttcg

SEQ ID NO: 127007 - DNA, 25 bp, Mus musculus
taccatataaggagaggcagctgct

SEQ ID NO: 127008 - DNA, 25 bp, Mus musculus
taccatattccgcttctttgaacag

SEQ ID NO: 127009 - DNA, 25 bp, Mus musculus
taccatcagcgatggctgcaccgag

SEQ ID NO: 127010 - DNA, 25 bp, Mus musculus
taccatcaggactggtcgcatgcag

SEQ ID NO: 127011 - DNA, 25 bp, Mus musculus
taccatcagggtcccctggtacctg

SEQ ID NO: 127012 - DNA, 25 bp, Mus musculus
taccatcattggtggagacgagccg

SEQ ID NO: 127013 - DNA, 25 bp, Mus musculus
taccatcctggccaacaaagtggga

SEQ ID NO: 127014 - DNA, 25 bp, Mus musculus
taccatcgactgctcgagggcgaga

SEQ ID NO: 127015 - DNA, 25 bp, Mus musculus
taccatcgaggtggctatagacctg

SEQ ID NO: 127016 - DNA, 25 bp, Mus musculus
taccatcgatgtgcaggacaaagag

SEQ ID NO: 127017 - DNA, 25 bp, Mus musculus
taccatcgggttgtcagcctggagg

SEQ ID NO: 127018 - DNA, 25 bp, Mus musculus
taccatctgaagtcacctccctagg

SEQ ID NO: 127019 - DNA, 25 bp, Mus musculus
taccatgaagctcagtcccagccag

SEQ ID NO: 127020 - DNA, 25 bp, Mus musculus
taccatgacgagaccaaacggacct

SEQ ID NO: 127021 - DNA, 25 bp, Mus musculus
taccatgactccctggcttgggctt

SEQ ID NO: 127022 - DNA, 25 bp, Mus musculus
taccatgagcaagcggaaccaagtg

SEQ ID NO: 127023 - DNA, 25 bp, Mus musculus
taccatgatcgatcccacctctaga

SEQ ID NO: 127024 - DNA, 25 bp, Mus musculus
taccatgatggcagaagactaacag

SEQ ID NO: 127025 - DNA, 25 bp, Mus musculus
taccatgcaggtctagcgtctggcc

SEQ ID NO: 127026 - DNA, 25 bp, Mus musculus
taccatggacatgtgcaaggagatg

SEQ ID NO: 127027 - DNA, 25 bp, Mus musculus
taccatggaggactcgggaaagacc

SEQ ID NO: 127028 - DNA, 25 bp, Mus musculus
taccatggcattccggaggactgag

SEQ ID NO: 127029 - DNA, 25 bp, Mus musculus
taccatggccgaaaacctgtaccga

SEQ ID NO: 127030 - DNA, 25 bp, Mus musculus
taccatggccgaagacgcagacatg

SEQ ID NO: 127031 - DNA, 25 bp, Mus musculus
taccatgggatagtcaccgagaacg

SEQ ID NO: 127032 - DNA, 25 bp, Mus musculus
taccatgtagatgagcacgtcgctg

SEQ ID NO: 127033 - DNA, 25 bp, Mus musculus
taccatgtagtgtaccgggacggtc

SEQ ID NO: 127034 - DNA, 25 bp, Mus musculus
taccatgtcgcttgcaccaatcacc

SEQ ID NO: 127035 - DNA, 25 bp, Mus musculus
taccatgtctgctttgaagatgctc

SEQ ID NO: 127036 - DNA, 25 bp, Mus musculus
taccatgtggaagagctggacccgg

SEQ ID NO: 127037 - DNA, 25 bp, Mus musculus
taccatgtggtttggagagaggacc

SEQ ID NO: 127038 - DNA, 25 bp, Mus musculus
taccatgttcctcgaacaagacgag

SEQ ID NO: 127039 - DNA, 25 bp, Mus musculus
taccattcagaagccaaccggaagc

SEQ ID NO: 127040 - DNA, 25 bp, Mus musculus
taccattcgattgcccaaggaaact

SEQ ID NO: 127041 - DNA, 25 bp, Mus musculus
taccattcgggttagttagacgaga

SEQ ID NO: 127042 - DNA, 25 bp, Mus musculus
taccattgtcatgatgcccgcgctg

SEQ ID NO: 127043 - DNA, 25 bp, Mus musculus
taccattgtcctggcagctagagag

SEQ ID NO: 127044 - DNA, 25 bp, Mus musculus
taccatttagagtgtgtgaagccgc

SEQ ID NO: 127045 - DNA, 25 bp, Mus musculus
taccatttggcaaagtaactaatct

SEQ ID NO: 127046 - DNA, 25 bp, Mus musculus
taccattttcgggaccagatcctgg

SEQ ID NO: 127047 - DNA, 25 bp, Mus musculus
tacccaaagcataggaaagcgttcc

SEQ ID NO: 127048 - DNA, 25 bp, Mus musculus
tacccaagtctgtgagtctccgatg

SEQ ID NO: 127049 - DNA, 25 bp, Mus musculus
tacccaataaaggaggccaatggcc

SEQ ID NO: 127050 - DNA, 25 bp, Mus musculus
tacccacagaagcagaatccaggct

SEQ ID NO: 127051 - DNA, 25 bp, Mus musculus
tacccacagaagtgtttcgacgagg

SEQ ID NO: 127052 - DNA, 25 bp, Mus musculus
tacccaccgggtactggaaacagat

SEQ ID NO: 127053 - DNA, 25 bp, Mus musculus
tacccacggaagaagttctggattg

SEQ ID NO: 127054 - DNA, 25 bp, Mus musculus
tacccactcgttgtgtaccaaggag

SEQ ID NO: 127055 - DNA, 25 bp, Mus musculus
tacccactgaagagtggcttgaaat

SEQ ID NO: 127056 - DNA, 25 bp, Mus musculus
tacccagaaacctcacggaagtgcc

SEQ ID NO: 127057 - DNA, 25 bp, Mus musculus
tacccagaacatggatatgcctcag

SEQ ID NO: 127058 - DNA, 25 bp, Mus musculus
tacccagaaggcctaggagaagtgc

SEQ ID NO: 127059 - DNA, 25 bp, Mus musculus
tacccagaccgctagtagaggcagg

SEQ ID NO: 127060 - DNA, 25 bp, Mus musculus
tacccagacggttcaactcagttaa

SEQ ID NO: 127061 - DNA, 25 bp, Mus musculus
tacccagactgccatgtggacagca

SEQ ID NO: 127062 - DNA, 25 bp, Mus musculus
tacccagagacttgatgagaccttg

SEQ ID NO: 127063 - DNA, 25 bp, Mus musculus
tacccagagggctagtgagcaggaa

SEQ ID NO: 127064 - DNA, 25 bp, Mus musculus
tacccagagtcagaagcagctacac

SEQ ID NO: 127065 - DNA, 25 bp, Mus musculus
tacccagagttattccaaaagtgcg

SEQ ID NO: 127066 - DNA, 25 bp, Mus musculus
tacccagatggcgagagtccttcat

SEQ ID NO: 127067 - DNA, 25 bp, Mus musculus
tacccagattcctgttccgaggctt

SEQ ID NO: 127068 - DNA, 25 bp, Mus musculus
tacccagcaggagacgtgtttcaga

SEQ ID NO: 127069 - DNA, 25 bp, Mus musculus
tacccagcatgccacaatctgattg

SEQ ID NO: 127070 - DNA, 25 bp, Mus musculus
tacccagcctagaccgatcagattt

SEQ ID NO: 127071 - DNA, 25 bp, Mus musculus
tacccagcctggcaattgtctgctc

SEQ ID NO: 127072 - DNA, 25 bp, Mus musculus
tacccagcggtgcactttggtggca

SEQ ID NO: 127073 - DNA, 25 bp, Mus musculus
tacccagctatgcttgcagacatgc

SEQ ID NO: 127074 - DNA, 25 bp, Mus musculus
tacccagcttgcaagaccagttgaa

SEQ ID NO: 127075 - DNA, 25 bp, Mus musculus
tacccagctttgtaagtcaccggag

SEQ ID NO: 127076 - DNA, 25 bp, Mus musculus
tacccaggctttatgcgagtggcac

SEQ ID NO: 127077 - DNA, 25 bp, Mus musculus
tacccaggctttgcatgactgtcgc

SEQ ID NO: 127078 - DNA, 25 bp, Mus musculus
tacccagggattatgtaccttcagt

SEQ ID NO: 127079 - DNA, 25 bp, Mus musculus
tacccagggcagcttgctagcatgc

SEQ ID NO: 127080 - DNA, 25 bp, Mus musculus
tacccaggttgacgactgaagaatc

SEQ ID NO: 127081 - DNA, 25 bp, Mus musculus
tacccagtatttatggaaggagttg

SEQ ID NO: 127082 - DNA, 25 bp, Mus musculus
tacccagtcgctgtgatgaactcaa

SEQ ID NO: 127083 - DNA, 25 bp, Mus musculus
tacccagtcggcagaagatatactg

SEQ ID NO: 127084 - DNA, 25 bp, Mus musculus
tacccagtggtggtgaagagcacac

SEQ ID NO: 127085 - DNA, 25 bp, Mus musculus
tacccagtgtggctatgacatccga

SEQ ID NO: 127086 - DNA, 25 bp, Mus musculus
tacccagttctgaggagccttgtga

SEQ ID NO: 127087 - DNA, 25 bp, Mus musculus
tacccagttgtggatgtgaagggcc

SEQ ID NO: 127088 - DNA, 25 bp, Mus musculus
tacccatacgacagaggacaggaat

SEQ ID NO: 127089 - DNA, 25 bp, Mus musculus
tacccatatgatgagacacggagcg

SEQ ID NO: 127090 - DNA, 25 bp, Mus musculus
tacccatcagctgagtgaaacactg

SEQ ID NO: 127091 - DNA, 25 bp, Mus musculus
tacccatcgtgtcgctggtcattga

SEQ ID NO: 127092 - DNA, 25 bp, Mus musculus
tacccatgaatcagaactcagaaca

SEQ ID NO: 127093 - DNA, 25 bp, Mus musculus
tacccatgtatttgtgagaagagac

SEQ ID NO: 127094 - DNA, 25 bp, Mus musculus
tacccatgtggctgcagtgacgatg

SEQ ID NO: 127095 - DNA, 25 bp, Mus musculus
tacccattcctgagcaacactggtt

SEQ ID NO: 127096 - DNA, 25 bp, Mus musculus
tacccattgcgtggtcatgtggaca

SEQ ID NO: 127097 - DNA, 25 bp, Mus musculus
tacccattgggagctggcaacttca

SEQ ID NO: 127098 - DNA, 25 bp, Mus musculus
taccccaaagtctgtgggcacagag

SEQ ID NO: 127099 - DNA, 25 bp, Mus musculus
taccccaatcttctgagcagtccgg

SEQ ID NO: 127100 - DNA, 25 bp, Mus musculus
taccccaatgaggtggattatgtcg

SEQ ID NO: 127101 - DNA, 25 bp, Mus musculus
taccccaatggactcagtgaaagcg

SEQ ID NO: 127102 - DNA, 25 bp, Mus musculus
taccccaatgggtgcagcttcgatg

SEQ ID NO: 127103 - DNA, 25 bp, Mus musculus
taccccacactgctaaaggagctgg

SEQ ID NO: 127104 - DNA, 25 bp, Mus musculus
taccccacagaagggctagtgagct

SEQ ID NO: 127105 - DNA, 25 bp, Mus musculus
taccccaccatggatgagctagctg

SEQ ID NO: 127106 - DNA, 25 bp, Mus musculus
taccccagcagagccaggttggaag

SEQ ID NO: 127107 - DNA, 25 bp, Mus musculus
taccccagctgaatgtgtaagccag

SEQ ID NO: 127108 - DNA, 25 bp, Mus musculus
taccccaggaggaggatcattaacc

SEQ ID NO: 127109 - DNA, 25 bp, Mus musculus
taccccagtaggatgtgttgaagac

SEQ ID NO: 127110 - DNA, 25 bp, Mus musculus
taccccagtggtcacaagtgctgtc

SEQ ID NO: 127111 - DNA, 25 bp, Mus musculus
taccccatatttcagggctggaggg

SEQ ID NO: 127112 - DNA, 25 bp, Mus musculus
taccccatggcctctctgtacgtgg

SEQ ID NO: 127113 - DNA, 25 bp, Mus musculus
taccccatgttggatggcccctgaa

SEQ ID NO: 127114 - DNA, 25 bp, Mus musculus
taccccatttggaggccaagatccg

SEQ ID NO: 127115 - DNA, 25 bp, Mus musculus
taccccgatctatggattttgagga

SEQ ID NO: 127116 - DNA, 25 bp, Mus musculus
taccccgctggagggcttagagcag

SEQ ID NO: 127117 - DNA, 25 bp, Mus musculus
taccccgctgggaagcaatatgtct

SEQ ID NO: 127118 - DNA, 25 bp, Mus musculus
taccccggtggctgtgaagtcttgc

SEQ ID NO: 127119 - DNA, 25 bp, Mus musculus
tacccctacctggatgggacagtct

SEQ ID NO: 127120 - DNA, 25 bp, Mus musculus
tacccctaggctccggaaggtgatg

SEQ ID NO: 127121 - DNA, 25 bp, Mus musculus
tacccctgaaggtgaaaccaacgct

SEQ ID NO: 127122 - DNA, 25 bp, Mus musculus
tacccctgaatgcaagtttaaagag

SEQ ID NO: 127123 - DNA, 25 bp, Mus musculus
tacccctgcccatgacttagctgtg

SEQ ID NO: 127124 - DNA, 25 bp, Mus musculus
taccccttgagtgccagtgaagatg

SEQ ID NO: 127125 - DNA, 25 bp, Mus musculus
tacccgaccaacagccctagttatg

SEQ ID NO: 127126 - DNA, 25 bp, Mus musculus
tacccgaccgctttgattgcaagaa

SEQ ID NO: 127127 - DNA, 25 bp, Mus musculus
tacccgacggcacagcatgagaaaa

SEQ ID NO: 127128 - DNA, 25 bp, Mus musculus
tacccgacgtggctgaagtgctctg

SEQ ID NO: 127129 - DNA, 25 bp, Mus musculus
tacccgaggctgcatgatttataga

SEQ ID NO: 127130 - DNA, 25 bp, Mus musculus
tacccgagtcccaggcttacatgga

SEQ ID NO: 127131 - DNA, 25 bp, Mus musculus
tacccgagtgtgtgttgagcctatc

SEQ ID NO: 127132 - DNA, 25 bp, Mus musculus
tacccgccgctgatatggcagaaga

SEQ ID NO: 127133 - DNA, 25 bp, Mus musculus
tacccgccgggtagccatgttaaga

SEQ ID NO: 127134 - DNA, 25 bp, Mus musculus
tacccgccgtcgatgattgcaactg

SEQ ID NO: 127135 - DNA, 25 bp, Mus musculus
tacccgcgatgtcctgctggtctct

SEQ ID NO: 127136 - DNA, 25 bp, Mus musculus
tacccgcgtctgcagttggaactac

SEQ ID NO: 127137 - DNA, 25 bp, Mus musculus
tacccgctgaacaaccaactgaatg

SEQ ID NO: 127138 - DNA, 25 bp, Mus musculus
tacccgcttcccagctgaaaaggtg

SEQ ID NO: 127139 - DNA, 25 bp, Mus musculus
tacccggacaccatagaggagtggc

SEQ ID NO: 127140 - DNA, 25 bp, Mus musculus
tacccggatggcaaagtcaatggct

SEQ ID NO: 127141 - DNA, 25 bp, Mus musculus
tacccggcctcatccataaggtgca

SEQ ID NO: 127142 - DNA, 25 bp, Mus musculus
tacccgggaagatggttctcgcacc

SEQ ID NO: 127143 - DNA, 25 bp, Mus musculus
tacccgggaatatactctgcagagc

SEQ ID NO: 127144 - DNA, 25 bp, Mus musculus
tacccgggaggatgatggagcaaac

SEQ ID NO: 127145 - DNA, 25 bp, Mus musculus
tacccgggatcactggaccaaagtc

SEQ ID NO: 127146 - DNA, 25 bp, Mus musculus
tacccggtggaagttctgctgaaag

SEQ ID NO: 127147 - DNA, 25 bp, Mus musculus
tacccgtacgtggaagtgaatagca

SEQ ID NO: 127148 - DNA, 25 bp, Mus musculus
tacccgtagatgtggaggaccaggc

SEQ ID NO: 127149 - DNA, 25 bp, Mus musculus
tacccgtattctggacagtttgctg

SEQ ID NO: 127150 - DNA, 25 bp, Mus musculus
tacccgtcagtcaattgagcagctg

SEQ ID NO: 127151 - DNA, 25 bp, Mus musculus
tacccgtctctggaaacttgatcga

SEQ ID NO: 127152 - DNA, 25 bp, Mus musculus
tacccgtggtgtgtgattcaagcca

SEQ ID NO: 127153 - DNA, 25 bp, Mus musculus
tacccgtgtggatgagctggacgcc

SEQ ID NO: 127154 - DNA, 25 bp, Mus musculus
tacccgtttatcctcatgcacaagg

SEQ ID NO: 127155 - DNA, 25 bp, Mus musculus
taccctaagcgagaaagtgcaacct

SEQ ID NO: 127156 - DNA, 25 bp, Mus musculus
taccctaatgaagacgagatgccca

SEQ ID NO: 127157 - DNA, 25 bp, Mus musculus
taccctacccacaaacagatgagtt

SEQ ID NO: 127158 - DNA, 25 bp, Mus musculus
taccctagaggaagagatgaccaag

SEQ ID NO: 127159 - DNA, 25 bp, Mus musculus
taccctaggattgtagagcagctgg

SEQ ID NO: 127160 - DNA, 25 bp, Mus musculus
taccctatctgggacctaggattgc

SEQ ID NO: 127161 - DNA, 25 bp, Mus musculus
taccctcagaaatggagtccagtgg

SEQ ID NO: 127162 - DNA, 25 bp, Mus musculus
taccctccaggaacgtcaacttggc

SEQ ID NO: 127163 - DNA, 25 bp, Mus musculus
taccctcctcaaggtgccagagtga

SEQ ID NO: 127164 - DNA, 25 bp, Mus musculus
taccctcgaagttggagctgccatt

SEQ ID NO: 127165 - DNA, 25 bp, Mus musculus
taccctcgtgtggagttggacaccc

SEQ ID NO: 127166 - DNA, 25 bp, Mus musculus
taccctctgagattggaaacctgcg

SEQ ID NO: 127167 - DNA, 25 bp, Mus musculus
taccctcttaccgtggaatgcctgg

SEQ ID NO: 127168 - DNA, 25 bp, Mus musculus
taccctgaagaggactactctcctg

SEQ ID NO: 127169 - DNA, 25 bp, Mus musculus
taccctgacgcctttgtgcgtgaag

SEQ ID NO: 127170 - DNA, 25 bp, Mus musculus
taccctgagctggaagaaacctttc

SEQ ID NO: 127171 - DNA, 25 bp, Mus musculus
taccctgaggactgcaatagctgct

SEQ ID NO: 127172 - DNA, 25 bp, Mus musculus
taccctggaacaactcaacgagctg

SEQ ID NO: 127173 - DNA, 25 bp, Mus musculus
taccctggataccttggacctgctg

SEQ ID NO: 127174 - DNA, 25 bp, Mus musculus
taccctggatcacggaggcttgacg

SEQ ID NO: 127175 - DNA, 25 bp, Mus musculus
taccctgggcattcgtgaggttcgg

SEQ ID NO: 127176 - DNA, 25 bp, Mus musculus
taccctgggtatctgcggatcgtgc

SEQ ID NO: 127177 - DNA, 25 bp, Mus musculus
taccctggtcataagcaggatggcg

SEQ ID NO: 127178 - DNA, 25 bp, Mus musculus
taccctggtccctaggggaggtctg

SEQ ID NO: 127179 - DNA, 25 bp, Mus musculus
taccctgtaaagctggcctgagcct

SEQ ID NO: 127180 - DNA, 25 bp, Mus musculus
taccctgtgcccgacgtgttcccac

SEQ ID NO: 127181 - DNA, 25 bp, Mus musculus
taccctgtgcgccttggatgaagca

SEQ ID NO: 127182 - DNA, 25 bp, Mus musculus
taccctgtggattgagaaaatagcc

SEQ ID NO: 127183 - DNA, 25 bp, Mus musculus
taccctgtgggtacaactgtggagt

SEQ ID NO: 127184 - DNA, 25 bp, Mus musculus
taccctgtgggtagcaacgtgagct

SEQ ID NO: 127185 - DNA, 25 bp, Mus musculus
taccctgtgtgaagacgccatctgg

SEQ ID NO: 127186 - DNA, 25 bp, Mus musculus
taccctgtgtgatcagcgtagaggc

SEQ ID NO: 127187 - DNA, 25 bp, Mus musculus
tacccttactgaagtggccaatggc

SEQ ID NO: 127188 - DNA, 25 bp, Mus musculus
tacccttcagggtagagcagacttg

SEQ ID NO: 127189 - DNA, 25 bp, Mus musculus
tacccttgctttccagacaggacag

SEQ ID NO: 127190 - DNA, 25 bp, Mus musculus
tacccttgggacacatgtgcagcag

SEQ ID NO: 127191 - DNA, 25 bp, Mus musculus
tacccttgggagaagagcctctggc

SEQ ID NO: 127192 - DNA, 25 bp, Mus musculus
tacccttgggtaccggcaatgacct

SEQ ID NO: 127193 - DNA, 25 bp, Mus musculus
taccgaaaagaagcacccatgttgt

SEQ ID NO: 127194 - DNA, 25 bp, Mus musculus
taccgaaaagtgagggaaatctacg

SEQ ID NO: 127195 - DNA, 25 bp, Mus musculus
taccgaaagatgctaggcaacccca

SEQ ID NO: 127196 - DNA, 25 bp, Mus musculus
taccgaagctacatccagggtggcc

SEQ ID NO: 127197 - DNA, 25 bp, Mus musculus
taccgaaggatgcagtattgccgct

SEQ ID NO: 127198 - DNA, 25 bp, Mus musculus
taccgaatcatgacccagtgttggc

SEQ ID NO: 127199 - DNA, 25 bp, Mus musculus
taccgacagtagtttgaaagccagc

SEQ ID NO: 127200 - DNA, 25 bp, Mus musculus
taccgaccggtgcattatttcagac

SEQ ID NO: 127201 - DNA, 25 bp, Mus musculus
taccgacctctgaagcaggaactcc

SEQ ID NO: 127202 - DNA, 25 bp, Mus musculus
taccgagaaagtgctgaagaggctt

SEQ ID NO: 127203 - DNA, 25 bp, Mus musculus
taccgagacaaaacaggaggctctt

SEQ ID NO: 127204 - DNA, 25 bp, Mus musculus
taccgagacttcctatgtgtgcacc

SEQ ID NO: 127205 - DNA, 25 bp, Mus musculus
taccgagcagctggataattgcaga

SEQ ID NO: 127206 - DNA, 25 bp, Mus musculus
taccgagcaggagcatacattcaga

SEQ ID NO: 127207 - DNA, 25 bp, Mus musculus
taccgagctgacgtggcttcgattg

SEQ ID NO: 127208 - DNA, 25 bp, Mus musculus
taccgagctgcccagattgtcttga

SEQ ID NO: 127209 - DNA, 25 bp, Mus musculus
taccgaggccagagataatggatga

SEQ ID NO: 127210 - DNA, 25 bp, Mus musculus
taccgaggccttgcggtgctagtgc

SEQ ID NO: 127211 - DNA, 25 bp, Mus musculus
taccgaggctacgtgtcagacattg

SEQ ID NO: 127212 - DNA, 25 bp, Mus musculus
taccgagggattgacctagtcttgc

SEQ ID NO: 127213 - DNA, 25 bp, Mus musculus
taccgagttcttggcaaaccggagc

SEQ ID NO: 127214 - DNA, 25 bp, Mus musculus
taccgatagactgcagaatgagccc

SEQ ID NO: 127215 - DNA, 25 bp, Mus musculus
taccgatctagagtccgtccttgcg

SEQ ID NO: 127216 - DNA, 25 bp, Mus musculus
taccgatgatactttggccccagca

SEQ ID NO: 127217 - DNA, 25 bp, Mus musculus
taccgatggatctcggagcggtacc

SEQ ID NO: 127218 - DNA, 25 bp, Mus musculus
taccgcaccgtgagcaatctgattc

SEQ ID NO: 127219 - DNA, 25 bp, Mus musculus
taccgcagccacatggagtacactg

SEQ ID NO: 127220 - DNA, 25 bp, Mus musculus
taccgcagctgaaagtcacgattag

SEQ ID NO: 127221 - DNA, 25 bp, Mus musculus
taccgcatgtacaggaaaagccaaa

SEQ ID NO: 127222 - DNA, 25 bp, Mus musculus
taccgccaggaggacctgttggaca

SEQ ID NO: 127223 - DNA, 25 bp, Mus musculus
taccgccagttttccgagggctgag

SEQ ID NO: 127224 - DNA, 25 bp, Mus musculus
taccgcccaggaaaactcaaactca

SEQ ID NO: 127225 - DNA, 25 bp, Mus musculus
taccgccgactctcagaagttctgg

SEQ ID NO: 127226 - DNA, 25 bp, Mus musculus
taccgcctacggattgctatggaaa

SEQ ID NO: 127227 - DNA, 25 bp, Mus musculus
taccgcctggccaaggagaatggct

SEQ ID NO: 127228 - DNA, 25 bp, Mus musculus
taccgcctgggctactctgaagcaa

SEQ ID NO: 127229 - DNA, 25 bp, Mus musculus
taccgcgagctaggtgactgcatgc

SEQ ID NO: 127230 - DNA, 25 bp, Mus musculus
taccgcgtactctgggagaagaaaa

SEQ ID NO: 127231 - DNA, 25 bp, Mus musculus
taccgcgtcaatctcctctgtggct

SEQ ID NO: 127232 - DNA, 25 bp, Mus musculus
taccgcttggagaagattatgaaca

SEQ ID NO: 127233 - DNA, 25 bp, Mus musculus
taccggaaaccatctgcaccaatgg

SEQ ID NO: 127234 - DNA, 25 bp, Mus musculus
taccggaaccttgggctctactggc

SEQ ID NO: 127235 - DNA, 25 bp, Mus musculus
taccggaacttcattcagcaggagt

SEQ ID NO: 127236 - DNA, 25 bp, Mus musculus
taccggaagcaaacaaaggaccagt

SEQ ID NO: 127237 - DNA, 25 bp, Mus musculus
taccggaagtcgtgtgcatcgtcag

SEQ ID NO: 127238 - DNA, 25 bp, Mus musculus
taccggacagcgattaaacacagga

SEQ ID NO: 127239 - DNA, 25 bp, Mus musculus
taccggagaccttttgagcattgaa

SEQ ID NO: 127240 - DNA, 25 bp, Mus musculus
taccggataggaaagcagcaatgga

SEQ ID NO: 127241 - DNA, 25 bp, Mus musculus
taccggatcccccaaggagctttga

SEQ ID NO: 127242 - DNA, 25 bp, Mus musculus
taccggatgctctcaatgaaggtca

SEQ ID NO: 127243 - DNA, 25 bp, Mus musculus
taccggatgctctttcaggacctgg

SEQ ID NO: 127244 - DNA, 25 bp, Mus musculus
taccggatgtcacggagaggctact

SEQ ID NO: 127245 - DNA, 25 bp, Mus musculus
taccggattcacaaggagctggacc

SEQ ID NO: 127246 - DNA, 25 bp, Mus musculus
taccggattcggagagtgagcctga

SEQ ID NO: 127247 - DNA, 25 bp, Mus musculus
taccggcaatatgcagctctctttg

SEQ ID NO: 127248 - DNA, 25 bp, Mus musculus
taccggcattaccttttctacaagg

SEQ ID NO: 127249 - DNA, 25 bp, Mus musculus
taccggcccaaggatttcgacagtg

SEQ ID NO: 127250 - DNA, 25 bp, Mus musculus
taccggccctgaatgtcttcctgga

SEQ ID NO: 127251 - DNA, 25 bp, Mus musculus
taccgggaaaatggatttaacatct

SEQ ID NO: 127252 - DNA, 25 bp, Mus musculus
taccgggaggcaactaaaagataca

SEQ ID NO: 127253 - DNA, 25 bp, Mus musculus
taccgggagttccacagactgtacg

SEQ ID NO: 127254 - DNA, 25 bp, Mus musculus
taccgggatgtcaacctgtggtgcc

SEQ ID NO: 127255 - DNA, 25 bp, Mus musculus
taccgggcagaaggaagtagcactg

SEQ ID NO: 127256 - DNA, 25 bp, Mus musculus
taccgggccgatgatgctaacgtgg

SEQ ID NO: 127257 - DNA, 25 bp, Mus musculus
taccgggctggactgcaacacattt

SEQ ID NO: 127258 - DNA, 25 bp, Mus musculus
taccgggtgttgacctcagacgtgg

SEQ ID NO: 127259 - DNA, 25 bp, Mus musculus
taccggtgccaagccttttaaatgc

SEQ ID NO: 127260 - DNA, 25 bp, Mus musculus
taccggttccctaagtgagagctcc

SEQ ID NO: 127261 - DNA, 25 bp, Mus musculus
taccgtaacggaacttaggacaatg

SEQ ID NO: 127262 - DNA, 25 bp, Mus musculus
taccgtagtttggtgcacacagccc

SEQ ID NO: 127263 - DNA, 25 bp, Mus musculus
taccgtcagttccacacagcggaag

SEQ ID NO: 127264 - DNA, 25 bp, Mus musculus
taccgtccccatcgtagaatcaaaa

SEQ ID NO: 127265 - DNA, 25 bp, Mus musculus
taccgtcggcgcctgaaggaaatcg

SEQ ID NO: 127266 - DNA, 25 bp, Mus musculus
taccgtctgcatccactgcggaaga

SEQ ID NO: 127267 - DNA, 25 bp, Mus musculus
taccgtgagtgttggccttacggca

SEQ ID NO: 127268 - DNA, 25 bp, Mus musculus
taccgtgggcacttttgaaatggct

SEQ ID NO: 127269 - DNA, 25 bp, Mus musculus
taccgtgtacatgtggctcagcaac

SEQ ID NO: 127270 - DNA, 25 bp, Mus musculus
taccgtgtccacaaagagcaagatg

SEQ ID NO: 127271 - DNA, 25 bp, Mus musculus
taccgtgtcctatttctatgatgca

SEQ ID NO: 127272 - DNA, 25 bp, Mus musculus
taccgtgttttgcatcgagatgggc

SEQ ID NO: 127273 - DNA, 25 bp, Mus musculus
taccgttagggaaaaggtcatcagc

SEQ ID NO: 127274 - DNA, 25 bp, Mus musculus
taccgttcagtcatacgggcctgta

SEQ ID NO: 127275 - DNA, 25 bp, Mus musculus
taccgttggtgaactgctgatggca

SEQ ID NO: 127276 - DNA, 25 bp, Mus musculus
taccgtttgcatgagcaggctccaa

SEQ ID NO: 127277 - DNA, 25 bp, Mus musculus
tacctaaagcaccatgaacagagcc

SEQ ID NO: 127278 - DNA, 25 bp, Mus musculus
tacctaaagctcttcggcagcccaa

SEQ ID NO: 127279 - DNA, 25 bp, Mus musculus
tacctaacaaatacaacttctcctt

SEQ ID NO: 127280 - DNA, 25 bp, Mus musculus
tacctaagtgaggtggagaccccgg

SEQ ID NO: 127281 - DNA, 25 bp, Mus musculus
tacctaatcacaaagcggcaagagg

SEQ ID NO: 127282 - DNA, 25 bp, Mus musculus
tacctacacatggagcgatgcagca

SEQ ID NO: 127283 - DNA, 25 bp, Mus musculus
tacctacacggtgataattccgaca

SEQ ID NO: 127284 - DNA, 25 bp, Mus musculus
tacctacagaacatctctggagaca

SEQ ID NO: 127285 - DNA, 25 bp, Mus musculus
tacctacaggctccagtggtgggac

SEQ ID NO: 127286 - DNA, 25 bp, Mus musculus
tacctacatgctacgaactggccag

SEQ ID NO: 127287 - DNA, 25 bp, Mus musculus
tacctacatggcactagaagagcgc

SEQ ID NO: 127288 - DNA, 25 bp, Mus musculus
tacctacgatgttcaaagagcccag

SEQ ID NO: 127289 - DNA, 25 bp, Mus musculus
tacctacgttatgacgacacaaggc

SEQ ID NO: 127290 - DNA, 25 bp, Mus musculus
tacctacgtttggtagcagggccca

SEQ ID NO: 127291 - DNA, 25 bp, Mus musculus
tacctactctgtgccctctgtaagg

SEQ ID NO: 127292 - DNA, 25 bp, Mus musculus
tacctacttggttcgaagatcccgc

SEQ ID NO: 127293 - DNA, 25 bp, Mus musculus
tacctagaaacttggcagagcagct

SEQ ID NO: 127294 - DNA, 25 bp, Mus musculus
tacctagactgggactacgtgcgag

SEQ ID NO: 127295 - DNA, 25 bp, Mus musculus
tacctagagatgctgatcgggaccc

SEQ ID NO: 127296 - DNA, 25 bp, Mus musculus
tacctagcggcgacatggatgctgc

SEQ ID NO: 127297 - DNA, 25 bp, Mus musculus
tacctaggatgttgcaagtcaccac

SEQ ID NO: 127298 - DNA, 25 bp, Mus musculus
tacctagggtcaggaaggcaaagac

SEQ ID NO: 127299 - DNA, 25 bp, Mus musculus
tacctaggtggaggttcagcattgg

SEQ ID NO: 127300 - DNA, 25 bp, Mus musculus
tacctagtgcttcacaatggcccag

SEQ ID NO: 127301 - DNA, 25 bp, Mus musculus
tacctatcccgagtgaagaaagagg

SEQ ID NO: 127302 - DNA, 25 bp, Mus musculus
tacctatgtcaatgaggacttccgg

SEQ ID NO: 127303 - DNA, 25 bp, Mus musculus
tacctatgtgaacgttgtcagccca

SEQ ID NO: 127304 - DNA, 25 bp, Mus musculus
tacctcaacatgctaaggacctgcg

SEQ ID NO: 127305 - DNA, 25 bp, Mus musculus
tacctcaaggacaagatgcgaaaag

SEQ ID NO: 127306 - DNA, 25 bp, Mus musculus
tacctcaccaagcaggatgtggaaa

SEQ ID NO: 127307 - DNA, 25 bp, Mus musculus
tacctcactcctgttagggacgaag

SEQ ID NO: 127308 - DNA, 25 bp, Mus musculus
tacctcacttgactgggagatcaga

SEQ ID NO: 127309 - DNA, 25 bp, Mus musculus
tacctcagacagtcagtgttctgca

SEQ ID NO: 127310 - DNA, 25 bp, Mus musculus
tacctcagctgcaagtggtctccag

SEQ ID NO: 127311 - DNA, 25 bp, Mus musculus
tacctcaggagcattactggctaag

SEQ ID NO: 127312 - DNA, 25 bp, Mus musculus
tacctcatagcagggatccagcatg

SEQ ID NO: 127313 - DNA, 25 bp, Mus musculus
tacctcatcggagggaagggatgcc

SEQ ID NO: 127314 - DNA, 25 bp, Mus musculus
tacctccaagagcaaatagtgacag

SEQ ID NO: 127315 - DNA, 25 bp, Mus musculus
tacctccaatgcatcagcagcaaag

SEQ ID NO: 127316 - DNA, 25 bp, Mus musculus
tacctccagcgagtgctacagaact

SEQ ID NO: 127317 - DNA, 25 bp, Mus musculus
tacctccaggaaagcctggagttgg

SEQ ID NO: 127318 - DNA, 25 bp, Mus musculus
tacctccatgagagctaccgacagg

SEQ ID NO: 127319 - DNA, 25 bp, Mus musculus
tacctcccagagaaccaagtgttac

SEQ ID NO: 127320 - DNA, 25 bp, Mus musculus
tacctcctaggtgcagtgactatga

SEQ ID NO: 127321 - DNA, 25 bp, Mus musculus
tacctcctgagtgtttaccggcaca

SEQ ID NO: 127322 - DNA, 25 bp, Mus musculus
tacctcctgcagtgggaataggccg

SEQ ID NO: 127323 - DNA, 25 bp, Mus musculus
tacctcctggaacggctaaatgaca

SEQ ID NO: 127324 - DNA, 25 bp, Mus musculus
tacctcctggacaaagagaccctgc

SEQ ID NO: 127325 - DNA, 25 bp, Mus musculus
tacctcctggcagcggaagatgaag

SEQ ID NO: 127326 - DNA, 25 bp, Mus musculus
tacctcctggctttactattggagc

SEQ ID NO: 127327 - DNA, 25 bp, Mus musculus
tacctcctgggaaacaactcctggc

SEQ ID NO: 127328 - DNA, 25 bp, Mus musculus
tacctcgaggttctggagttcccgg

SEQ ID NO: 127329 - DNA, 25 bp, Mus musculus
tacctcgcgcgctttgagagctgga

SEQ ID NO: 127330 - DNA, 25 bp, Mus musculus
tacctcggttgtacagtgatgacct

SEQ ID NO: 127331 - DNA, 25 bp, Mus musculus
tacctcgtgtatggacagtgcctca

SEQ ID NO: 127332 - DNA, 25 bp, Mus musculus
tacctctaacgagaagcttatgctg

SEQ ID NO: 127333 - DNA, 25 bp, Mus musculus
tacctctacagctacgtgacggtgg

SEQ ID NO: 127334 - DNA, 25 bp, Mus musculus
tacctctcaagaggcaagcgggaca

SEQ ID NO: 127335 - DNA, 25 bp, Mus musculus
tacctctcagcataattggtttgcc

SEQ ID NO: 127336 - DNA, 25 bp, Mus musculus
tacctctcaggatggctaagaccaa

SEQ ID NO: 127337 - DNA, 25 bp, Mus musculus
tacctctctcaagctgccgatggag

SEQ ID NO: 127338 - DNA, 25 bp, Mus musculus
tacctctgctgataagactgccaag

SEQ ID NO: 127339 - DNA, 25 bp, Mus musculus
tacctctgtgcctccgggacgggaa

SEQ ID NO: 127340 - DNA, 25 bp, Mus musculus
tacctcttcaggaaccacaggctct

SEQ ID NO: 127341 - DNA, 25 bp, Mus musculus
tacctcttcaggattgcagtttata

SEQ ID NO: 127342 - DNA, 25 bp, Mus musculus
tacctgaacacaaccaagatgcggg

SEQ ID NO: 127343 - DNA, 25 bp, Mus musculus
tacctgaacacttggagaggaacct

SEQ ID NO: 127344 - DNA, 25 bp, Mus musculus
tacctgaacctgtcacaggagccgg

SEQ ID NO: 127345 - DNA, 25 bp, Mus musculus
tacctgaagagagattggcctggaa

SEQ ID NO: 127346 - DNA, 25 bp, Mus musculus
tacctgaagcatgtgtgccagccag

SEQ ID NO: 127347 - DNA, 25 bp, Mus musculus
tacctgaagcccatgttgcagcggg

SEQ ID NO: 127348 - DNA, 25 bp, Mus musculus
tacctgaagcctggtaccacgaagg

SEQ ID NO: 127349 - DNA, 25 bp, Mus musculus
tacctgaagctactgggcaagggca

SEQ ID NO: 127350 - DNA, 25 bp, Mus musculus
tacctgaagttacggtgtgacctgc

SEQ ID NO: 127351 - DNA, 25 bp, Mus musculus
tacctgaattggaatgggccacctg

SEQ ID NO: 127352 - DNA, 25 bp, Mus musculus
tacctgacagctatagacaacgatg

SEQ ID NO: 127353 - DNA, 25 bp, Mus musculus
tacctgaccaactgcgagaagctgt

SEQ ID NO: 127354 - DNA, 25 bp, Mus musculus
tacctgactgtcagtgtgagagcag

SEQ ID NO: 127355 - DNA, 25 bp, Mus musculus
tacctgagctggagaaacgaatgca

SEQ ID NO: 127356 - DNA, 25 bp, Mus musculus
tacctgaggacctggcagaagctct

SEQ ID NO: 127357 - DNA, 25 bp, Mus musculus
tacctgaggcggtccccaaacagaa

SEQ ID NO: 127358 - DNA, 25 bp, Mus musculus
tacctgagggatttacccgaatgca

SEQ ID NO: 127359 - DNA, 25 bp, Mus musculus
tacctgagggtcaagtacctacgag

SEQ ID NO: 127360 - DNA, 25 bp, Mus musculus
tacctgaggtcagtaggagcaccga

SEQ ID NO: 127361 - DNA, 25 bp, Mus musculus
tacctgagtgtatccatttccacgt

SEQ ID NO: 127362 - DNA, 25 bp, Mus musculus
tacctgataagacaactggtgcctc

SEQ ID NO: 127363 - DNA, 25 bp, Mus musculus
tacctgatcgagcacagagtggccc

SEQ ID NO: 127364 - DNA, 25 bp, Mus musculus
tacctgatgcgccactttggtgtga

SEQ ID NO: 127365 - DNA, 25 bp, Mus musculus
tacctgattggaggagccatgctaa

SEQ ID NO: 127366 - DNA, 25 bp, Mus musculus
tacctgcaacatgggaacgaattag

SEQ ID NO: 127367 - DNA, 25 bp, Mus musculus
tacctgcaactcttcctactggatg

SEQ ID NO: 127368 - DNA, 25 bp, Mus musculus
tacctgcaccttcaggaagagaagc

SEQ ID NO: 127369 - DNA, 25 bp, Mus musculus
tacctgcagaaaggagggactcagc

SEQ ID NO: 127370 - DNA, 25 bp, Mus musculus
tacctgcagctactacgagtgcgca

SEQ ID NO: 127371 - DNA, 25 bp, Mus musculus
tacctgcaggacttctctggctatg

SEQ ID NO: 127372 - DNA, 25 bp, Mus musculus
tacctgcaggtagtgccttcagcag

SEQ ID NO: 127373 - DNA, 25 bp, Mus musculus
tacctgccacccctaggaaacgtgg

SEQ ID NO: 127374 - DNA, 25 bp, Mus musculus
tacctgccagagacgtgaagccaaa

SEQ ID NO: 127375 - DNA, 25 bp, Mus musculus
tacctgcccaacttcatccagagtg

SEQ ID NO: 127376 - DNA, 25 bp, Mus musculus
tacctgcctgggagatgatagcaca

SEQ ID NO: 127377 - DNA, 25 bp, Mus musculus
tacctgcgcagaatggcacaaggaa

SEQ ID NO: 127378 - DNA, 25 bp, Mus musculus
tacctgcggcaggtcatctcggaat

SEQ ID NO: 127379 - DNA, 25 bp, Mus musculus
tacctgcggctgtatgtgcacacgc

SEQ ID NO: 127380 - DNA, 25 bp, Mus musculus
tacctgcggcttaagcgcgagcctg

SEQ ID NO: 127381 - DNA, 25 bp, Mus musculus
tacctgcgggtgaacaggcttcaca

SEQ ID NO: 127382 - DNA, 25 bp, Mus musculus
tacctgctacaatcaggagctgaca

SEQ ID NO: 127383 - DNA, 25 bp, Mus musculus
tacctgctctgaacggatcttcggc

SEQ ID NO: 127384 - DNA, 25 bp, Mus musculus
tacctgctgcagaatgtcgttcggc

SEQ ID NO: 127385 - DNA, 25 bp, Mus musculus
tacctgctgcttcgaggctcctgtt

SEQ ID NO: 127386 - DNA, 25 bp, Mus musculus
tacctgctggatgcttggaaggccg

SEQ ID NO: 127387 - DNA, 25 bp, Mus musculus
tacctgctgggtgctattgctgcct

SEQ ID NO: 127388 - DNA, 25 bp, Mus musculus
tacctgctggtagtatccacgggag

SEQ ID NO: 127389 - DNA, 25 bp, Mus musculus
tacctgctgtgaaaactgtggaggc

SEQ ID NO: 127390 - DNA, 25 bp, Mus musculus
tacctgctgtgacctttgagggcaa

SEQ ID NO: 127391 - DNA, 25 bp, Mus musculus
tacctggaagagactcggcctatcc

SEQ ID NO: 127392 - DNA, 25 bp, Mus musculus
tacctggaagttggacagctatccc

SEQ ID NO: 127393 - DNA, 25 bp, Mus musculus
tacctggaatacctggaggacggca

SEQ ID NO: 127394 - DNA, 25 bp, Mus musculus
tacctggaatgggaggacaatcctc

SEQ ID NO: 127395 - DNA, 25 bp, Mus musculus
tacctggaccgtttcttggctggag

SEQ ID NO: 127396 - DNA, 25 bp, Mus musculus
tacctggacctggaagatattgcca

SEQ ID NO: 127397 - DNA, 25 bp, Mus musculus
tacctggacgagacgtgcacgtgct

SEQ ID NO: 127398 - DNA, 25 bp, Mus musculus
tacctggactttcatgttgccaaga

SEQ ID NO: 127399 - DNA, 25 bp, Mus musculus
tacctggagcacatggacaagcctt

SEQ ID NO: 127400 - DNA, 25 bp, Mus musculus
tacctggagccaaggacgttagacc

SEQ ID NO: 127401 - DNA, 25 bp, Mus musculus
tacctggaggaggtgcacatctccc

SEQ ID NO: 127402 - DNA, 25 bp, Mus musculus
tacctggaggtcatcggcttcacca

SEQ ID NO: 127403 - DNA, 25 bp, Mus musculus
tacctggagtctgtgaggccactga

SEQ ID NO: 127404 - DNA, 25 bp, Mus musculus
tacctggagttgaagagcacttgct

SEQ ID NO: 127405 - DNA, 25 bp, Mus musculus
tacctggagttgagggtgacaccca

SEQ ID NO: 127406 - DNA, 25 bp, Mus musculus
tacctggataacgtaaaagctctgg

SEQ ID NO: 127407 - DNA, 25 bp, Mus musculus
tacctggcaatatcgtgtggcaaag

SEQ ID NO: 127408 - DNA, 25 bp, Mus musculus
tacctggcatcttgggacgagtgaa

SEQ ID NO: 127409 - DNA, 25 bp, Mus musculus
tacctggcattgtatcgtgggccgg

SEQ ID NO: 127410 - DNA, 25 bp, Mus musculus
tacctggccaagctgtcatcggtgg

SEQ ID NO: 127411 - DNA, 25 bp, Mus musculus
tacctggcccagtggatcgagagcc

SEQ ID NO: 127412 - DNA, 25 bp, Mus musculus
tacctggcccagttgtttggtctat

SEQ ID NO: 127413 - DNA, 25 bp, Mus musculus
tacctggccggctctatcatagacg

SEQ ID NO: 127414 - DNA, 25 bp, Mus musculus
tacctggcgctcgatgtgtacttcc

SEQ ID NO: 127415 - DNA, 25 bp, Mus musculus
tacctggcggacaagagctacattg

SEQ ID NO: 127416 - DNA, 25 bp, Mus musculus
tacctggcggatgaacgagacgact

SEQ ID NO: 127417 - DNA, 25 bp, Mus musculus
tacctggctgccaagtcgagccgaa

SEQ ID NO: 127418 - DNA, 25 bp, Mus musculus
tacctggctgtcatcgagggcgcca

SEQ ID NO: 127419 - DNA, 25 bp, Mus musculus
tacctgggaagtatggccaaaatcc

SEQ ID NO: 127420 - DNA, 25 bp, Mus musculus
tacctgggacaggtgctaaacacaa

SEQ ID NO: 127421 - DNA, 25 bp, Mus musculus
tacctgggcaggcaaatcaaaggag

SEQ ID NO: 127422 - DNA, 25 bp, Mus musculus
tacctgggcatgaagcccactgtgg

SEQ ID NO: 127423 - DNA, 25 bp, Mus musculus
tacctgggtatctcacaagggagct

SEQ ID NO: 127424 - DNA, 25 bp, Mus musculus
tacctgggtccagttccaaggcagc

SEQ ID NO: 127425 - DNA, 25 bp, Mus musculus
tacctgggtgccaagcctaggagct

SEQ ID NO: 127426 - DNA, 25 bp, Mus musculus
tacctggtcagagcacgatatcctg

SEQ ID NO: 127427 - DNA, 25 bp, Mus musculus
tacctggtgaaggagggcaacagct

SEQ ID NO: 127428 - DNA, 25 bp, Mus musculus
tacctggtgcctgtcttgagactgc

SEQ ID NO: 127429 - DNA, 25 bp, Mus musculus
tacctggtggaaacaggacacacct

SEQ ID NO: 127430 - DNA, 25 bp, Mus musculus
tacctgtacttgatgaactatgcca

SEQ ID NO: 127431 - DNA, 25 bp, Mus musculus
tacctgtcctggaagagcggaccag

SEQ ID NO: 127432 - DNA, 25 bp, Mus musculus
tacctgtcggttgaccagctggacc

SEQ ID NO: 127433 - DNA, 25 bp, Mus musculus
tacctgtgagggagattgtgatccg

SEQ ID NO: 127434 - DNA, 25 bp, Mus musculus
tacctgtggccgttctggcttttca

SEQ ID NO: 127435 - DNA, 25 bp, Mus musculus
tacctgtgggataccatggccgagc

SEQ ID NO: 127436 - DNA, 25 bp, Mus musculus
tacctgtggtagactcacagctgcc

SEQ ID NO: 127437 - DNA, 25 bp, Mus musculus
tacctgtgtaccagatgtggcgtcg

SEQ ID NO: 127438 - DNA, 25 bp, Mus musculus
tacctgtgtctttcgctgtttcccg

SEQ ID NO: 127439 - DNA, 25 bp, Mus musculus
tacctgttccccaacagactggagt

SEQ ID NO: 127440 - DNA, 25 bp, Mus musculus
tacctgttccggaggagactgagcc

SEQ ID NO: 127441 - DNA, 25 bp, Mus musculus
tacctgttcggtttggagccctgac

SEQ ID NO: 127442 - DNA, 25 bp, Mus musculus
tacctgttctctatagcagaggatg

SEQ ID NO: 127443 - DNA, 25 bp, Mus musculus
tacctgtttcaactgcacatgaagt

SEQ ID NO: 127444 - DNA, 25 bp, Mus musculus
tacctgtttcctaggcaactgctag

SEQ ID NO: 127445 - DNA, 25 bp, Mus musculus
taccttacagagtagtagaccagcc

SEQ ID NO: 127446 - DNA, 25 bp, Mus musculus
taccttactatgaattgtgcactgc

SEQ ID NO: 127447 - DNA, 25 bp, Mus musculus
taccttaggaagctggaactggcac

SEQ ID NO: 127448 - DNA, 25 bp, Mus musculus
taccttatggcgtagaaatgctgag

SEQ ID NO: 127449 - DNA, 25 bp, Mus musculus
taccttatgttgactgggatcccag

SEQ ID NO: 127450 - DNA, 25 bp, Mus musculus
taccttcagaatgatgaaagcacag

SEQ ID NO: 127451 - DNA, 25 bp, Mus musculus
taccttcatctgtgatcacccacag

SEQ ID NO: 127452 - DNA, 25 bp, Mus musculus
taccttccttgggtgaggagacacg

SEQ ID NO: 127453 - DNA, 25 bp, Mus musculus
taccttcgagactggatcctagagc

SEQ ID NO: 127454 - DNA, 25 bp, Mus musculus
taccttcgagtcaggtccggatgag

SEQ ID NO: 127455 - DNA, 25 bp, Mus musculus
taccttcggatcatactgggagcca

SEQ ID NO: 127456 - DNA, 25 bp, Mus musculus
taccttctgggttcaagagggccca

SEQ ID NO: 127457 - DNA, 25 bp, Mus musculus
taccttgacaatcagaacgttgttg

SEQ ID NO: 127458 - DNA, 25 bp, Mus musculus
taccttgaccttaagcgagagcacg

SEQ ID NO: 127459 - DNA, 25 bp, Mus musculus
taccttgataacattttgaccttta

SEQ ID NO: 127460 - DNA, 25 bp, Mus musculus
taccttgcatcagaagatcatggac

SEQ ID NO: 127461 - DNA, 25 bp, Mus musculus
taccttgccaagtaatatgtaccag

SEQ ID NO: 127462 - DNA, 25 bp, Mus musculus
taccttgcggatagagaagaacgac

SEQ ID NO: 127463 - DNA, 25 bp, Mus musculus
taccttggagccatcgagagctggg

SEQ ID NO: 127464 - DNA, 25 bp, Mus musculus
taccttggcgatggcttgctgtggc

SEQ ID NO: 127465 - DNA, 25 bp, Mus musculus
taccttggctcctgctactgatctg

SEQ ID NO: 127466 - DNA, 25 bp, Mus musculus
taccttggctggagtcatcgatctc

SEQ ID NO: 127467 - DNA, 25 bp, Mus musculus
taccttggtagatagtggctgctca

SEQ ID NO: 127468 - DNA, 25 bp, Mus musculus
taccttggttgggaatacctctgca

SEQ ID NO: 127469 - DNA, 25 bp, Mus musculus
taccttgtaaggatgcccctgagct

SEQ ID NO: 127470 - DNA, 25 bp, Mus musculus
taccttgtcaactactatgggaacc

SEQ ID NO: 127471 - DNA, 25 bp, Mus musculus
taccttgttagggatcagctctcca

SEQ ID NO: 127472 - DNA, 25 bp, Mus musculus
tacctttcgaccgtgtgctgctaaa

SEQ ID NO: 127473 - DNA, 25 bp, Mus musculus
tacctttgacctacagagctctgtt

SEQ ID NO: 127474 - DNA, 25 bp, Mus musculus
tacctttgaggagaccaatcgcacc

SEQ ID NO: 127475 - DNA, 25 bp, Mus musculus
tacctttggagaatctgtggcctcc

SEQ ID NO: 127476 - DNA, 25 bp, Mus musculus
tacctttggatggtctgtggcagca

SEQ ID NO: 127477 - DNA, 25 bp, Mus musculus
taccttttatgaagaagtgaccagc

SEQ ID NO: 127478 - DNA, 25 bp, Mus musculus
tacgaaaaggaaccttgccgcggcg

SEQ ID NO: 127479 - DNA, 25 bp, Mus musculus
tacgaaacactacggcagatagatg

SEQ ID NO: 127480 - DNA, 25 bp, Mus musculus
tacgaaagcaaataacaacctcagg

SEQ ID NO: 127481 - DNA, 25 bp, Mus musculus
tacgaaagcgcagggagcttgaaag

SEQ ID NO: 127482 - DNA, 25 bp, Mus musculus
tacgaaagctcgtcttaaggagggc

SEQ ID NO: 127483 - DNA, 25 bp, Mus musculus
tacgaaatggcactggtgtgattcg

SEQ ID NO: 127484 - DNA, 25 bp, Mus musculus
tacgaacaccatctcgtactgtgca

SEQ ID NO: 127485 - DNA, 25 bp, Mus musculus
tacgaacacgtgaagagagacctga

SEQ ID NO: 127486 - DNA, 25 bp, Mus musculus
tacgaacaggtcatgcactacccag

SEQ ID NO: 127487 - DNA, 25 bp, Mus musculus
tacgaacattgcctggactcaccat

SEQ ID NO: 127488 - DNA, 25 bp, Mus musculus
tacgaacggctgcaggaacagaaag

SEQ ID NO: 127489 - DNA, 25 bp, Mus musculus
tacgaacgtgtactgtgaacatcca

SEQ ID NO: 127490 - DNA, 25 bp, Mus musculus
tacgaagactactatgacatgccag

SEQ ID NO: 127491 - DNA, 25 bp, Mus musculus
tacgaagatgatgaagcaggacaga

SEQ ID NO: 127492 - DNA, 25 bp, Mus musculus
tacgaagcagggtacagatcggcgt

SEQ ID NO: 127493 - DNA, 25 bp, Mus musculus
tacgaagcagtagaccaagcgaagt

SEQ ID NO: 127494 - DNA, 25 bp, Mus musculus
tacgaagcctcagttgcaccacatt

SEQ ID NO: 127495 - DNA, 25 bp, Mus musculus
tacgaagccttttatgcccgggcga

SEQ ID NO: 127496 - DNA, 25 bp, Mus musculus
tacgaaggctctgtaaacctggaca

SEQ ID NO: 127497 - DNA, 25 bp, Mus musculus
tacgaaggtgccaaggtgaaggtcc

SEQ ID NO: 127498 - DNA, 25 bp, Mus musculus
tacgaagtggctacaggatccaggc

SEQ ID NO: 127499 - DNA, 25 bp, Mus musculus
tacgaagtggtcagatgatgctggc

SEQ ID NO: 127500 - DNA, 25 bp, Mus musculus
tacgaagttaccattgaagaggaac

SEQ ID NO: 127501 - DNA, 25 bp, Mus musculus
tacgaagtttgtggcgttggcctgc

SEQ ID NO: 127502 - DNA, 25 bp, Mus musculus
tacgaatgcagtcttctggacccat

SEQ ID NO: 127503 - DNA, 25 bp, Mus musculus
tacgaatgggactggaagttatacc

SEQ ID NO: 127504 - DNA, 25 bp, Mus musculus
tacgaatgggatgaacaggcgtcac

SEQ ID NO: 127505 - DNA, 25 bp, Mus musculus
tacgaatgtccagaaaggagggcag

SEQ ID NO: 127506 - DNA, 25 bp, Mus musculus
tacgacaaatcttccttgcctcagt

SEQ ID NO: 127507 - DNA, 25 bp, Mus musculus
tacgacaaggacaagcccgtctcct

SEQ ID NO: 127508 - DNA, 25 bp, Mus musculus
tacgacagaggaaatggagtaccat

SEQ ID NO: 127509 - DNA, 25 bp, Mus musculus
tacgacagtcgcaggacggattttg

SEQ ID NO: 127510 - DNA, 25 bp, Mus musculus
tacgacagtttcatacagggttgcc

SEQ ID NO: 127511 - DNA, 25 bp, Mus musculus
tacgaccagtcagacgaggagagca

SEQ ID NO: 127512 - DNA, 25 bp, Mus musculus
tacgaccccgagaagaagtgggaca

SEQ ID NO: 127513 - DNA, 25 bp, Mus musculus
tacgaccgctaagttatccacagac

SEQ ID NO: 127514 - DNA, 25 bp, Mus musculus
tacgacctccgcgtgaagatgaacg

SEQ ID NO: 127515 - DNA, 25 bp, Mus musculus
tacgacctgtttcgccggcttggag

SEQ ID NO: 127516 - DNA, 25 bp, Mus musculus
tacgacctgtttctcaacctggagg

SEQ ID NO: 127517 - DNA, 25 bp, Mus musculus
tacgaccttctctaccagcagtgtg

SEQ ID NO: 127518 - DNA, 25 bp, Mus musculus
tacgacgactactatgaggacggcg

SEQ ID NO: 127519 - DNA, 25 bp, Mus musculus
tacgacgaggatgacatggttctgg

SEQ ID NO: 127520 - DNA, 25 bp, Mus musculus
tacgacgggcctgtgcatgaagtga

SEQ ID NO: 127521 - DNA, 25 bp, Mus musculus
tacgacggtgaaattcgagttctat

SEQ ID NO: 127522 - DNA, 25 bp, Mus musculus
tacgacgtgattctggcaagcagcc

SEQ ID NO: 127523 - DNA, 25 bp, Mus musculus
tacgacgtggtaaagaaatcaggcg

SEQ ID NO: 127524 - DNA, 25 bp, Mus musculus
tacgactacctgacggatgaggagg

SEQ ID NO: 127525 - DNA, 25 bp, Mus musculus
tacgactatggctatgtctgcgtgg

SEQ ID NO: 127526 - DNA, 25 bp, Mus musculus
tacgactcggtcaagtacacactgg

SEQ ID NO: 127527 - DNA, 25 bp, Mus musculus
tacgactctgaggtcttcgggaacc

SEQ ID NO: 127528 - DNA, 25 bp, Mus musculus
tacgactgccacctcacgagaatgg

SEQ ID NO: 127529 - DNA, 25 bp, Mus musculus
tacgacttcaagatggctgacctgc

SEQ ID NO: 127530 - DNA, 25 bp, Mus musculus
tacgactttacgtccagtcggcata

SEQ ID NO: 127531 - DNA, 25 bp, Mus musculus
tacgagaaaattggcgcaaagcccg

SEQ ID NO: 127532 - DNA, 25 bp, Mus musculus
tacgagaagaagtacggccaagtcc

SEQ ID NO: 127533 - DNA, 25 bp, Mus musculus
tacgagaagcttggctccactgacc

SEQ ID NO: 127534 - DNA, 25 bp, Mus musculus
tacgagaattgtagaaagagccctt

SEQ ID NO: 127535 - DNA, 25 bp, Mus musculus
tacgagaccaagtgtaatcccatgg

SEQ ID NO: 127536 - DNA, 25 bp, Mus musculus
tacgagaccttcatccagcagggag

SEQ ID NO: 127537 - DNA, 25 bp, Mus musculus
tacgagacgtcatggtagatcggca

SEQ ID NO: 127538 - DNA, 25 bp, Mus musculus
tacgagactcccactggaatcaagg

SEQ ID NO: 127539 - DNA, 25 bp, Mus musculus
tacgagagagatgagggcaacaacc

SEQ ID NO: 127540 - DNA, 25 bp, Mus musculus
tacgagagcaaggatagcagcagcg

SEQ ID NO: 127541 - DNA, 25 bp, Mus musculus
tacgagagctttcctgatcgggacc

SEQ ID NO: 127542 - DNA, 25 bp, Mus musculus
tacgagatccgctttcgggagaatg

SEQ ID NO: 127543 - DNA, 25 bp, Mus musculus
tacgagatcctcctcctggtcttgg

SEQ ID NO: 127544 - DNA, 25 bp, Mus musculus
tacgagatggctgctggttacccac

SEQ ID NO: 127545 - DNA, 25 bp, Mus musculus
tacgagatgtcctcaaggtgcagga

SEQ ID NO: 127546 - DNA, 25 bp, Mus musculus
tacgagatgttctcctggctactgc

SEQ ID NO: 127547 - DNA, 25 bp, Mus musculus
tacgagcacacatcagtgggcgcct

SEQ ID NO: 127548 - DNA, 25 bp, Mus musculus
tacgagcactatttgggcacagaga

SEQ ID NO: 127549 - DNA, 25 bp, Mus musculus
tacgagcagatagagaaggaccttg

SEQ ID NO: 127550 - DNA, 25 bp, Mus musculus
tacgagcatagcatcagcgtgcgcc

SEQ ID NO: 127551 - DNA, 25 bp, Mus musculus
tacgagccctttttgtctacgagaa

SEQ ID NO: 127552 - DNA, 25 bp, Mus musculus
tacgagcgctccaatgagtaccagc

SEQ ID NO: 127553 - DNA, 25 bp, Mus musculus
tacgagcgtatcacagtcggcacac

SEQ ID NO: 127554 - DNA, 25 bp, Mus musculus
tacgagctatgcgaggtgatcggca

SEQ ID NO: 127555 - DNA, 25 bp, Mus musculus
tacgagctgacggatagactggcct

SEQ ID NO: 127556 - DNA, 25 bp, Mus musculus
tacgagctgctctgcatggacaaca

SEQ ID NO: 127557 - DNA, 25 bp, Mus musculus
tacgagctttcttatgcccgggaac

SEQ ID NO: 127558 - DNA, 25 bp, Mus musculus
tacgaggaagattctgacagcgaca

SEQ ID NO: 127559 - DNA, 25 bp, Mus musculus
tacgaggacaaaagcaacgacttcg

SEQ ID NO: 127560 - DNA, 25 bp, Mus musculus
tacgaggacaaagaagtggaacccg

SEQ ID NO: 127561 - DNA, 25 bp, Mus musculus
tacgaggacagcaacgtgtggcacg

SEQ ID NO: 127562 - DNA, 25 bp, Mus musculus
tacgaggacagctatgtgcaccctg

SEQ ID NO: 127563 - DNA, 25 bp, Mus musculus
tacgaggacagcttctacaaacgga

SEQ ID NO: 127564 - DNA, 25 bp, Mus musculus
tacgaggactctgtagctgactggc

SEQ ID NO: 127565 - DNA, 25 bp, Mus musculus
tacgaggagtacaaagaccgcaagc

SEQ ID NO: 127566 - DNA, 25 bp, Mus musculus
tacgaggagtacatcaccaagcttt

SEQ ID NO: 127567 - DNA, 25 bp, Mus musculus
tacgaggagttcaaggctgacgcac

SEQ ID NO: 127568 - DNA, 25 bp, Mus musculus
tacgaggccttcactgtagtgcagc

SEQ ID NO: 127569 - DNA, 25 bp, Mus musculus
tacgaggctgatagcgatgtggcct

SEQ ID NO: 127570 - DNA, 25 bp, Mus musculus
tacgaggctgtacagttgcacctgc

SEQ ID NO: 127571 - DNA, 25 bp, Mus musculus
tacgagggctacaagttcagtgaac

SEQ ID NO: 127572 - DNA, 25 bp, Mus musculus
tacgagggtgagtggtgtaacaacc

SEQ ID NO: 127573 - DNA, 25 bp, Mus musculus
tacgaggtcacaggtggaaaagaca

SEQ ID NO: 127574 - DNA, 25 bp, Mus musculus
tacgaggtcgctttcgctagcaggg

SEQ ID NO: 127575 - DNA, 25 bp, Mus musculus
tacgaggttccttcacatgtcagtg

SEQ ID NO: 127576 - DNA, 25 bp, Mus musculus
tacgagtacacgctggaaattgatg

SEQ ID NO: 127577 - DNA, 25 bp, Mus musculus
tacgagtagacatcatggagaacca

SEQ ID NO: 127578 - DNA, 25 bp, Mus musculus
tacgagtcacgtggctgggacatgc

SEQ ID NO: 127579 - DNA, 25 bp, Mus musculus
tacgagtcagtcgaaagccaccctt

SEQ ID NO: 127580 - DNA, 25 bp, Mus musculus
tacgagtccctctgtgaaaatccca

SEQ ID NO: 127581 - DNA, 25 bp, Mus musculus
tacgagtccgatgtgctgtggagac

SEQ ID NO: 127582 - DNA, 25 bp, Mus musculus
tacgagtcctgctttatgaccctga

SEQ ID NO: 127583 - DNA, 25 bp, Mus musculus
tacgagtcgatccaggactacaagc

SEQ ID NO: 127584 - DNA, 25 bp, Mus musculus
tacgagtgctactgcaagcagggct

SEQ ID NO: 127585 - DNA, 25 bp, Mus musculus
tacgagtgggttctatcagatcccc

SEQ ID NO: 127586 - DNA, 25 bp, Mus musculus
tacgagtgtgccatttgccagagga

SEQ ID NO: 127587 - DNA, 25 bp, Mus musculus
tacgagttcaacgtgtggacccggc

SEQ ID NO: 127588 - DNA, 25 bp, Mus musculus
tacgagttcatggaactggcctgcc

SEQ ID NO: 127589 - DNA, 25 bp, Mus musculus
tacgagttctcatgccgaatgtccc

SEQ ID NO: 127590 - DNA, 25 bp, Mus musculus
tacgagtttgaagcaaggaatgccc

SEQ ID NO: 127591 - DNA, 25 bp, Mus musculus
tacgataatacatgaggtgaaccag

SEQ ID NO: 127592 - DNA, 25 bp, Mus musculus
tacgatactggctctgacgactggg

SEQ ID NO: 127593 - DNA, 25 bp, Mus musculus
tacgatacttgcattgagccgtggc

SEQ ID NO: 127594 - DNA, 25 bp, Mus musculus
tacgatatcgctcacacacctggtg

SEQ ID NO: 127595 - DNA, 25 bp, Mus musculus
tacgatatgccacatcagccgcatt

SEQ ID NO: 127596 - DNA, 25 bp, Mus musculus
tacgatcatgccgtggacctggtgg

SEQ ID NO: 127597 - DNA, 25 bp, Mus musculus
tacgatcccgaaccctggtgaaaag

SEQ ID NO: 127598 - DNA, 25 bp, Mus musculus
tacgatctgtcagctcgccaaggag

SEQ ID NO: 127599 - DNA, 25 bp, Mus musculus
tacgatgaccacgagagtgacgacg

SEQ ID NO: 127600 - DNA, 25 bp, Mus musculus
tacgatgaccggttgatgaaggctg

SEQ ID NO: 127601 - DNA, 25 bp, Mus musculus
tacgatgacgtaaggagatgctgca

SEQ ID NO: 127602 - DNA, 25 bp, Mus musculus
tacgatgagcatgccaaattagtgc

SEQ ID NO: 127603 - DNA, 25 bp, Mus musculus
tacgatgagcctttactgaagcgtc

SEQ ID NO: 127604 - DNA, 25 bp, Mus musculus
tacgatgatcccacttatgagaagc

SEQ ID NO: 127605 - DNA, 25 bp, Mus musculus
tacgatgccccacaatatctgagga

SEQ ID NO: 127606 - DNA, 25 bp, Mus musculus
tacgatgctaactatgacgggaagg

SEQ ID NO: 127607 - DNA, 25 bp, Mus musculus
tacgatgctacagcaatgcaccggg

SEQ ID NO: 127608 - DNA, 25 bp, Mus musculus
tacgatgcttagaaatgcctgcggg

SEQ ID NO: 127609 - DNA, 25 bp, Mus musculus
tacgatggaaagcaattactgaccg

SEQ ID NO: 127610 - DNA, 25 bp, Mus musculus
tacgatggaagacttgctggagaca

SEQ ID NO: 127611 - DNA, 25 bp, Mus musculus
tacgatgggatacaggacgagcccc

SEQ ID NO: 127612 - DNA, 25 bp, Mus musculus
tacgatggtgggaactgcgtcatgc

SEQ ID NO: 127613 - DNA, 25 bp, Mus musculus
tacgatgtacaagaacggcagaagt

SEQ ID NO: 127614 - DNA, 25 bp, Mus musculus
tacgatgtctgcgtgtgccacagtg

SEQ ID NO: 127615 - DNA, 25 bp, Mus musculus
tacgatgtctttgcaagtgtcctga

SEQ ID NO: 127616 - DNA, 25 bp, Mus musculus
tacgatgttctgagtgtggctgaca

SEQ ID NO: 127617 - DNA, 25 bp, Mus musculus
tacgattctacgtgtcagatagccc

SEQ ID NO: 127618 - DNA, 25 bp, Mus musculus
tacgattggcaaagatgagggaggc

SEQ ID NO: 127619 - DNA, 25 bp, Mus musculus
tacgatttccatggagtctggcgcc

SEQ ID NO: 127620 - DNA, 25 bp, Mus musculus
tacgatttccgctgatgacaccaca

SEQ ID NO: 127621 - DNA, 25 bp, Mus musculus
tacgatttgtgcttaacctgactcc

SEQ ID NO: 127622 - DNA, 25 bp, Mus musculus
tacgcaagctacacgttggagactt

SEQ ID NO: 127623 - DNA, 25 bp, Mus musculus
tacgcacccttacgagaggaggcag

SEQ ID NO: 127624 - DNA, 25 bp, Mus musculus
tacgcacggcagctgacattggaac

SEQ ID NO: 127625 - DNA, 25 bp, Mus musculus
tacgcactgagagaactgtaaacca

SEQ ID NO: 127626 - DNA, 25 bp, Mus musculus
tacgcactgtcagggtggtggccac

SEQ ID NO: 127627 - DNA, 25 bp, Mus musculus
tacgcagaagaggaacactatcggc

SEQ ID NO: 127628 - DNA, 25 bp, Mus musculus
tacgcagagtgctgcggacccatcg

SEQ ID NO: 127629 - DNA, 25 bp, Mus musculus
tacgcagagtttttcccactgggac

SEQ ID NO: 127630 - DNA, 25 bp, Mus musculus
tacgcaggagctgctaaggaagctc

SEQ ID NO: 127631 - DNA, 25 bp, Mus musculus
tacgcagtatgtggcacccctgatg

SEQ ID NO: 127632 - DNA, 25 bp, Mus musculus
tacgcagtgatggtaccaagtccac

SEQ ID NO: 127633 - DNA, 25 bp, Mus musculus
tacgcagtgcaggataccaagggct

SEQ ID NO: 127634 - DNA, 25 bp, Mus musculus
tacgcatctgctcagtggagaaggc

SEQ ID NO: 127635 - DNA, 25 bp, Mus musculus
tacgccaaggagtgggacttctaca

SEQ ID NO: 127636 - DNA, 25 bp, Mus musculus
tacgccaccataggagctggtgtgg

SEQ ID NO: 127637 - DNA, 25 bp, Mus musculus
tacgccactgagctttctgaaacaa

SEQ ID NO: 127638 - DNA, 25 bp, Mus musculus
tacgccagccgcaacgggcactatg

SEQ ID NO: 127639 - DNA, 25 bp, Mus musculus
tacgccaggacctcactggaggatg

SEQ ID NO: 127640 - DNA, 25 bp, Mus musculus
tacgccatcggctattacctcaagg

SEQ ID NO: 127641 - DNA, 25 bp, Mus musculus
tacgccatggactttagccacaggg

SEQ ID NO: 127642 - DNA, 25 bp, Mus musculus
tacgccatggcagacaagcgcttca

SEQ ID NO: 127643 - DNA, 25 bp, Mus musculus
tacgccatgtataaagccgggcccg

SEQ ID NO: 127644 - DNA, 25 bp, Mus musculus
tacgcccggcaagataaaaaggaca

SEQ ID NO: 127645 - DNA, 25 bp, Mus musculus
tacgcccttagtagctatgtcttct

SEQ ID NO: 127646 - DNA, 25 bp, Mus musculus
tacgccgtacacaggagcaggtgga

SEQ ID NO: 127647 - DNA, 25 bp, Mus musculus
tacgcctgcctgaagctagtgaact

SEQ ID NO: 127648 - DNA, 25 bp, Mus musculus
tacgcctgcgctttggcgagctctg

SEQ ID NO: 127649 - DNA, 25 bp, Mus musculus
tacgcctggtggactaacagactcc

SEQ ID NO: 127650 - DNA, 25 bp, Mus musculus
tacgccttcactgcactggacgtgg

SEQ ID NO: 127651 - DNA, 25 bp, Mus musculus
tacgcgaatcggctcaaaagttatg

SEQ ID NO: 127652 - DNA, 25 bp, Mus musculus
tacgcgaattcttaaaagccttggc

SEQ ID NO: 127653 - DNA, 25 bp, Mus musculus
tacgcgacctttgtgttggaaaatg

SEQ ID NO: 127654 - DNA, 25 bp, Mus musculus
tacgcgatcggcaacatggaacagc

SEQ ID NO: 127655 - DNA, 25 bp, Mus musculus
tacgcgcactggatggcagcttgca

SEQ ID NO: 127656 - DNA, 25 bp, Mus musculus
tacgcgcatcgatgaaaataccagc

SEQ ID NO: 127657 - DNA, 25 bp, Mus musculus
tacgcggacatgtacccagtggagt

SEQ ID NO: 127658 - DNA, 25 bp, Mus musculus
tacgcgtacgtgaacttccagcagc

SEQ ID NO: 127659 - DNA, 25 bp, Mus musculus
tacgcgttcccttcctacggagtgt

SEQ ID NO: 127660 - DNA, 25 bp, Mus musculus
tacgctagcactgacatggacaaag

SEQ ID NO: 127661 - DNA, 25 bp, Mus musculus
tacgctaggcttggtaggaaggcct

SEQ ID NO: 127662 - DNA, 25 bp, Mus musculus
tacgctcaatcacaaagcttgcagc

SEQ ID NO: 127663 - DNA, 25 bp, Mus musculus
tacgctcagcttggcccgagatatg

SEQ ID NO: 127664 - DNA, 25 bp, Mus musculus
tacgctccgcgcctttgtacaggag

SEQ ID NO: 127665 - DNA, 25 bp, Mus musculus
tacgctctatctagctctccgtgat

SEQ ID NO: 127666 - DNA, 25 bp, Mus musculus
tacgctgaatccataggtgccatcg

SEQ ID NO: 127667 - DNA, 25 bp, Mus musculus
tacgctgcgaactgacgccgttgaa

SEQ ID NO: 127668 - DNA, 25 bp, Mus musculus
tacgctgcgctatgctaacagggcc

SEQ ID NO: 127669 - DNA, 25 bp, Mus musculus
tacgctggacatgagtagcctgggc

SEQ ID NO: 127670 - DNA, 25 bp, Mus musculus
tacgctggctgcataaagatgtggc

SEQ ID NO: 127671 - DNA, 25 bp, Mus musculus
tacgctgtggaaagagctgtcaccc

SEQ ID NO: 127672 - DNA, 25 bp, Mus musculus
tacgctgtggtctgagaaactcggg

SEQ ID NO: 127673 - DNA, 25 bp, Mus musculus
tacgctgtttgaatgtggaagaacc

SEQ ID NO: 127674 - DNA, 25 bp, Mus musculus
tacgcttcccaaaccagttcagaaa

SEQ ID NO: 127675 - DNA, 25 bp, Mus musculus
tacgcttcggtcatcgctctcttgg

SEQ ID NO: 127676 - DNA, 25 bp, Mus musculus
tacgcttcttactgccatggaaggg

SEQ ID NO: 127677 - DNA, 25 bp, Mus musculus
tacgctttgacgaatatggaggcac

SEQ ID NO: 127678 - DNA, 25 bp, Mus musculus
tacgctttgctgtgtgcgctcgcac

SEQ ID NO: 127679 - DNA, 25 bp, Mus musculus
tacggaaccatggaggcctaagccg

SEQ ID NO: 127680 - DNA, 25 bp, Mus musculus
tacggaagattgacaggaagggttc

SEQ ID NO: 127681 - DNA, 25 bp, Mus musculus
tacggaagccacgtgcaacctgtgg

SEQ ID NO: 127682 - DNA, 25 bp, Mus musculus
tacggaagttgcagctgacacctgg

SEQ ID NO: 127683 - DNA, 25 bp, Mus musculus
tacggaatcgaacatgcacagctcc

SEQ ID NO: 127684 - DNA, 25 bp, Mus musculus
tacggaatggatgccttcatgctgg

SEQ ID NO: 127685 - DNA, 25 bp, Mus musculus
tacggaattcaaagctctaatggac

SEQ ID NO: 127686 - DNA, 25 bp, Mus musculus
tacggacaaagcttcatcctccagg

SEQ ID NO: 127687 - DNA, 25 bp, Mus musculus
tacggacacggtgccttcagagttc

SEQ ID NO: 127688 - DNA, 25 bp, Mus musculus
tacggacctaccagggcattctgac

SEQ ID NO: 127689 - DNA, 25 bp, Mus musculus
tacggacctgctgcttaaggctgca

SEQ ID NO: 127690 - DNA, 25 bp, Mus musculus
tacggacgagtttatgctgccgacc

SEQ ID NO: 127691 - DNA, 25 bp, Mus musculus
tacggactctgacgaagacgaagac

SEQ ID NO: 127692 - DNA, 25 bp, Mus musculus
tacggagaaagataaaaggccagct

SEQ ID NO: 127693 - DNA, 25 bp, Mus musculus
tacggagagaatcaccagagactgg

SEQ ID NO: 127694 - DNA, 25 bp, Mus musculus
tacggagcattcgatccaatccagg

SEQ ID NO: 127695 - DNA, 25 bp, Mus musculus
tacggagcctcccaagttgaagaca

SEQ ID NO: 127696 - DNA, 25 bp, Mus musculus
tacggaggaagcacaaatcagcgcc

SEQ ID NO: 127697 - DNA, 25 bp, Mus musculus
tacggaggagcagcggccgccattt

SEQ ID NO: 127698 - DNA, 25 bp, Mus musculus
tacggaggatcaccaatgaagggca

SEQ ID NO: 127699 - DNA, 25 bp, Mus musculus
tacggaggtggtctaagtcctgaca

SEQ ID NO: 127700 - DNA, 25 bp, Mus musculus
tacggagtggcctcctgcgaggctt

SEQ ID NO: 127701 - DNA, 25 bp, Mus musculus
tacggataagaccattgaagctgct

SEQ ID NO: 127702 - DNA, 25 bp, Mus musculus
tacggatatccatggccggagacgc

SEQ ID NO: 127703 - DNA, 25 bp, Mus musculus
tacggatgatgggtgtggccaaact

SEQ ID NO: 127704 - DNA, 25 bp, Mus musculus
tacggcaaatccataggtctgaatc

SEQ ID NO: 127705 - DNA, 25 bp, Mus musculus
tacggcaaggcaacaccaagaatgt

SEQ ID NO: 127706 - DNA, 25 bp, Mus musculus
tacggcaagtccttcagaaagttac

SEQ ID NO: 127707 - DNA, 25 bp, Mus musculus
tacggcacagtgaacgagacatgag

SEQ ID NO: 127708 - DNA, 25 bp, Mus musculus
tacggcagaagaacacgatgcggcg

SEQ ID NO: 127709 - DNA, 25 bp, Mus musculus
tacggcagacatggaagactgtggc

SEQ ID NO: 127710 - DNA, 25 bp, Mus musculus
tacggcagactgcatccatcttcta

SEQ ID NO: 127711 - DNA, 25 bp, Mus musculus
tacggcagagttgttacagttggca

SEQ ID NO: 127712 - DNA, 25 bp, Mus musculus
tacggcatcatgaccgacggttaca

SEQ ID NO: 127713 - DNA, 25 bp, Mus musculus
tacggcatccgatgacatccgtgac

SEQ ID NO: 127714 - DNA, 25 bp, Mus musculus
tacggcatcgagaacaagaacaacc

SEQ ID NO: 127715 - DNA, 25 bp, Mus musculus
tacggcatggtgcaaatccggatct

SEQ ID NO: 127716 - DNA, 25 bp, Mus musculus
tacggccaagtacagcgtgttgaca

SEQ ID NO: 127717 - DNA, 25 bp, Mus musculus
tacggccagaatgagagctttgctc

SEQ ID NO: 127718 - DNA, 25 bp, Mus musculus
tacggccagagtgacgagtacagct

SEQ ID NO: 127719 - DNA, 25 bp, Mus musculus
tacggcccctggtatcgcatctggg

SEQ ID NO: 127720 - DNA, 25 bp, Mus musculus
tacggccgatcggtgaatttcgaag

SEQ ID NO: 127721 - DNA, 25 bp, Mus musculus
tacggccgcgagagttaaaggccac

SEQ ID NO: 127722 - DNA, 25 bp, Mus musculus
tacggccggtcaagctggttcgagt

SEQ ID NO: 127723 - DNA, 25 bp, Mus musculus
tacggcctgccaatttttaagactg

SEQ ID NO: 127724 - DNA, 25 bp, Mus musculus
tacggcgagattggcatcggtaccc

SEQ ID NO: 127725 - DNA, 25 bp, Mus musculus
tacggcgagtttggtgcccgtgtcc

SEQ ID NO: 127726 - DNA, 25 bp, Mus musculus
tacggcgatgtgctgatccacgctg

SEQ ID NO: 127727 - DNA, 25 bp, Mus musculus
tacggcgcaggtaaaacgaacacat

SEQ ID NO: 127728 - DNA, 25 bp, Mus musculus
tacggcgcgggcaacatgaatgcca

SEQ ID NO: 127729 - DNA, 25 bp, Mus musculus
tacggcgctgcgagctgatcaaaga

SEQ ID NO: 127730 - DNA, 25 bp, Mus musculus
tacggctccgcggtgtatcgccagg

SEQ ID NO: 127731 - DNA, 25 bp, Mus musculus
tacggctcgtgacagttcttgaaca

SEQ ID NO: 127732 - DNA, 25 bp, Mus musculus
tacggctgagcacttcctgggcttt

SEQ ID NO: 127733 - DNA, 25 bp, Mus musculus
tacggctggagagcgaagagaccat

SEQ ID NO: 127734 - DNA, 25 bp, Mus musculus
tacggctggctcaaatgcatctgga

SEQ ID NO: 127735 - DNA, 25 bp, Mus musculus
tacgggaacttaaacgcagcgctgc

SEQ ID NO: 127736 - DNA, 25 bp, Mus musculus
tacgggaaggaaaacgccatcgtgg

SEQ ID NO: 127737 - DNA, 25 bp, Mus musculus
tacgggaatataatctggagcagca

SEQ ID NO: 127738 - DNA, 25 bp, Mus musculus
tacgggacaaaactggagaccattc

SEQ ID NO: 127739 - DNA, 25 bp, Mus musculus
tacgggaccccattgacctaagagc

SEQ ID NO: 127740 - DNA, 25 bp, Mus musculus
tacgggacctatgagaatgccaagg

SEQ ID NO: 127741 - DNA, 25 bp, Mus musculus
tacgggacctccaataagactgagc

SEQ ID NO: 127742 - DNA, 25 bp, Mus musculus
tacgggagccagaacttaaagcacg

SEQ ID NO: 127743 - DNA, 25 bp, Mus musculus
tacgggagtgtctggcgtctctacc

SEQ ID NO: 127744 - DNA, 25 bp, Mus musculus
tacgggatatctcctccatggcgat

SEQ ID NO: 127745 - DNA, 25 bp, Mus musculus
tacgggatgcacagggtggaaacca

SEQ ID NO: 127746 - DNA, 25 bp, Mus musculus
tacgggcagcattgcgagcagagtc

SEQ ID NO: 127747 - DNA, 25 bp, Mus musculus
tacgggcatggtgacagctgttaca

SEQ ID NO: 127748 - DNA, 25 bp, Mus musculus
tacgggcattccttcgctgtggaga

SEQ ID NO: 127749 - DNA, 25 bp, Mus musculus
tacgggcccggaactatgaatacct

SEQ ID NO: 127750 - DNA, 25 bp, Mus musculus
tacgggcctgctcggacattaatct

SEQ ID NO: 127751 - DNA, 25 bp, Mus musculus
tacgggctactgaagaagggctacg

SEQ ID NO: 127752 - DNA, 25 bp, Mus musculus
tacgggctccagactcagactggtg

SEQ ID NO: 127753 - DNA, 25 bp, Mus musculus
tacgggctgctcacgtgcgagagct

SEQ ID NO: 127754 - DNA, 25 bp, Mus musculus
tacgggtagacctctatgaagcagc

SEQ ID NO: 127755 - DNA, 25 bp, Mus musculus
tacgggtgcagaccaagcatttcca

SEQ ID NO: 127756 - DNA, 25 bp, Mus musculus
tacgggttcaacctgcatagtgaca

SEQ ID NO: 127757 - DNA, 25 bp, Mus musculus
tacgggttcattcagaacacatcca

SEQ ID NO: 127758 - DNA, 25 bp, Mus musculus
tacggtaacttgaaggagccctgtc

SEQ ID NO: 127759 - DNA, 25 bp, Mus musculus
tacggtacccacagttattgcagag

SEQ ID NO: 127760 - DNA, 25 bp, Mus musculus
tacggtacgatatctccagaggaag

SEQ ID NO: 127761 - DNA, 25 bp, Mus musculus
tacggtagaattcaaccacacggga

SEQ ID NO: 127762 - DNA, 25 bp, Mus musculus
tacggtatgtgcctatgaaaatatg

SEQ ID NO: 127763 - DNA, 25 bp, Mus musculus
tacggtcacttatctggaccaatgg

SEQ ID NO: 127764 - DNA, 25 bp, Mus musculus
tacggtcagaatgcaaaaatcaggg

SEQ ID NO: 127765 - DNA, 25 bp, Mus musculus
tacggtccaaagttctctgaggcac

SEQ ID NO: 127766 - DNA, 25 bp, Mus musculus
tacggtcctgcctggatagcctacg

SEQ ID NO: 127767 - DNA, 25 bp, Mus musculus
tacggtcgcgctaacggaagacaca

SEQ ID NO: 127768 - DNA, 25 bp, Mus musculus
tacggtcgcttcaggcacttcttgg

SEQ ID NO: 127769 - DNA, 25 bp, Mus musculus
tacggtgataccacacctcatggca

SEQ ID NO: 127770 - DNA, 25 bp, Mus musculus
tacggtgcaggtatcatgctaatcc

SEQ ID NO: 127771 - DNA, 25 bp, Mus musculus
tacggtgccctgaaagaagcgattc

SEQ ID NO: 127772 - DNA, 25 bp, Mus musculus
tacggtgctacctcacaggagaatg

SEQ ID NO: 127773 - DNA, 25 bp, Mus musculus
tacggtgctccatgtcttgctgcag

SEQ ID NO: 127774 - DNA, 25 bp, Mus musculus
tacggtggatttgtgcagcgcgcct

SEQ ID NO: 127775 - DNA, 25 bp, Mus musculus
tacggtgggaccaaagagcatctgc

SEQ ID NO: 127776 - DNA, 25 bp, Mus musculus
tacggttatgatgagctccagatgc

SEQ ID NO: 127777 - DNA, 25 bp, Mus musculus
tacggttcttaatcctggtgccagg

SEQ ID NO: 127778 - DNA, 25 bp, Mus musculus
tacggttggacttgctgccagagaa

SEQ ID NO: 127779 - DNA, 25 bp, Mus musculus
tacggtttggatcctaggacccgag

SEQ ID NO: 127780 - DNA, 25 bp, Mus musculus
tacggtttgggaacccagctgagct

SEQ ID NO: 127781 - DNA, 25 bp, Mus musculus
tacgtaaacgtcaaggtcagcctga

SEQ ID NO: 127782 - DNA, 25 bp, Mus musculus
tacgtaagggcatgtctagaggcac

SEQ ID NO: 127783 - DNA, 25 bp, Mus musculus
tacgtactgttgagcgccagggctg

SEQ ID NO: 127784 - DNA, 25 bp, Mus musculus
tacgtagccgaactcctaatggaat

SEQ ID NO: 127785 - DNA, 25 bp, Mus musculus
tacgtagctcgagataagctgaccc

SEQ ID NO: 127786 - DNA, 25 bp, Mus musculus
tacgtaggtgaagctacgggcccca

SEQ ID NO: 127787 - DNA, 25 bp, Mus musculus
tacgtagtaaaggagacgatcggcg

SEQ ID NO: 127788 - DNA, 25 bp, Mus musculus
tacgtagtgtccatcttgtgaagcc

SEQ ID NO: 127789 - DNA, 25 bp, Mus musculus
tacgtatcccctgaagacttggagg

SEQ ID NO: 127790 - DNA, 25 bp, Mus musculus
tacgtattgagaaaaacccggctcg

SEQ ID NO: 127791 - DNA, 25 bp, Mus musculus
tacgtattgatgagcgggctggacc

SEQ ID NO: 127792 - DNA, 25 bp, Mus musculus
tacgtcaacaacatggtgcgagtgg

SEQ ID NO: 127793 - DNA, 25 bp, Mus musculus
tacgtcaagctcactgtaggcaaga

SEQ ID NO: 127794 - DNA, 25 bp, Mus musculus
tacgtcaccacactgagctgctttg

SEQ ID NO: 127795 - DNA, 25 bp, Mus musculus
tacgtcagtgataaaatctccctga

SEQ ID NO: 127796 - DNA, 25 bp, Mus musculus
tacgtccacggcaagcggccggatt

SEQ ID NO: 127797 - DNA, 25 bp, Mus musculus
tacgtccagatattgaacctccaag

SEQ ID NO: 127798 - DNA, 25 bp, Mus musculus
tacgtcccaaggtcatcggtggcag

SEQ ID NO: 127799 - DNA, 25 bp, Mus musculus
tacgtcccgaagtatgctcccttgg

SEQ ID NO: 127800 - DNA, 25 bp, Mus musculus
tacgtccggtgtgcgtcaagatggc

SEQ ID NO: 127801 - DNA, 25 bp, Mus musculus
tacgtcctacaaggttacgccgagg

SEQ ID NO: 127802 - DNA, 25 bp, Mus musculus
tacgtcctagaccagcgactgaggg

SEQ ID NO: 127803 - DNA, 25 bp, Mus musculus
tacgtcctcaacgagcttcacgaag

SEQ ID NO: 127804 - DNA, 25 bp, Mus musculus
tacgtcgagccgtgaattctacccg

SEQ ID NO: 127805 - DNA, 25 bp, Mus musculus
tacgtcgccgtggattgagcctgct

SEQ ID NO: 127806 - DNA, 25 bp, Mus musculus
tacgtctacgaagcaaacatagagg

SEQ ID NO: 127807 - DNA, 25 bp, Mus musculus
tacgtctgatgcaattagggccact

SEQ ID NO: 127808 - DNA, 25 bp, Mus musculus
tacgtctggacgctgagtgacccag

SEQ ID NO: 127809 - DNA, 25 bp, Mus musculus
tacgtctgggccaagcatgaggaag

SEQ ID NO: 127810 - DNA, 25 bp, Mus musculus
tacgtctttaaccagggagtctcag

SEQ ID NO: 127811 - DNA, 25 bp, Mus musculus
tacgtctttaacttggccgagctgg

SEQ ID NO: 127812 - DNA, 25 bp, Mus musculus
tacgtgaaaacgtgccaagagaagt

SEQ ID NO: 127813 - DNA, 25 bp, Mus musculus
tacgtgaaagagatcgatgctgcca

SEQ ID NO: 127814 - DNA, 25 bp, Mus musculus
tacgtgaaggagagcaccctatggc

SEQ ID NO: 127815 - DNA, 25 bp, Mus musculus
tacgtgaagggattctactgcgcag

SEQ ID NO: 127816 - DNA, 25 bp, Mus musculus
tacgtgacgacaggcattgtgccgg

SEQ ID NO: 127817 - DNA, 25 bp, Mus musculus
tacgtgaggcatgttgacaatcccc

SEQ ID NO: 127818 - DNA, 25 bp, Mus musculus
tacgtgaggtcgatgaggctcttgc

SEQ ID NO: 127819 - DNA, 25 bp, Mus musculus
tacgtgaggtctaagtcagccaagc

SEQ ID NO: 127820 - DNA, 25 bp, Mus musculus
tacgtgatcaacattgcacctatag

SEQ ID NO: 127821 - DNA, 25 bp, Mus musculus
tacgtgatccaaggcggctacatgc

SEQ ID NO: 127822 - DNA, 25 bp, Mus musculus
tacgtgcactctacttgcaggggtg

SEQ ID NO: 127823 - DNA, 25 bp, Mus musculus
tacgtgcagaaacatggcatccagc

SEQ ID NO: 127824 - DNA, 25 bp, Mus musculus
tacgtgcagaaggatggccgtcact

SEQ ID NO: 127825 - DNA, 25 bp, Mus musculus
tacgtgcagaatgaggtgccccatg

SEQ ID NO: 127826 - DNA, 25 bp, Mus musculus
tacgtgcagcttaaatcaggaggat

SEQ ID NO: 127827 - DNA, 25 bp, Mus musculus
tacgtgcagggtctcacataggcca

SEQ ID NO: 127828 - DNA, 25 bp, Mus musculus
tacgtgccaccaaagtaaccaaggg

SEQ ID NO: 127829 - DNA, 25 bp, Mus musculus
tacgtgcccgtcagggatcttctga

SEQ ID NO: 127830 - DNA, 25 bp, Mus musculus
tacgtgcgtgtccttccagtgtcct

SEQ ID NO: 127831 - DNA, 25 bp, Mus musculus
tacgtgctactatggaggcccaagg

SEQ ID NO: 127832 - DNA, 25 bp, Mus musculus
tacgtgctgcgaagcatctgccaac

SEQ ID NO: 127833 - DNA, 25 bp, Mus musculus
tacgtgctgcgtgtccgtggctgca

SEQ ID NO: 127834 - DNA, 25 bp, Mus musculus
tacgtgctgtaccatcgtgcgcaaa

SEQ ID NO: 127835 - DNA, 25 bp, Mus musculus
tacgtgctgtttctctccggcgagg

SEQ ID NO: 127836 - DNA, 25 bp, Mus musculus
tacgtggactataagatattcctcc

SEQ ID NO: 127837 - DNA, 25 bp, Mus musculus
tacgtggagacatctgcaaagaccc

SEQ ID NO: 127838 - DNA, 25 bp, Mus musculus
tacgtggagcacttcactcaggaac

SEQ ID NO: 127839 - DNA, 25 bp, Mus musculus
tacgtggatcaagcatgtgaggcca

SEQ ID NO: 127840 - DNA, 25 bp, Mus musculus
tacgtggcccagaatgacattgaag

SEQ ID NO: 127841 - DNA, 25 bp, Mus musculus
tacgtggccctcgatgtgatttgcg

SEQ ID NO: 127842 - DNA, 25 bp, Mus musculus
tacgtggcctttcgagggtcctgcc

SEQ ID NO: 127843 - DNA, 25 bp, Mus musculus
tacgtggctcatcgaaaatggtgaa

SEQ ID NO: 127844 - DNA, 25 bp, Mus musculus
tacgtggtctatgagcccgtcttcc

SEQ ID NO: 127845 - DNA, 25 bp, Mus musculus
tacgtgtaagcgtattctgcctgcg

SEQ ID NO: 127846 - DNA, 25 bp, Mus musculus
tacgtgtacattgagtcccaggaca

SEQ ID NO: 127847 - DNA, 25 bp, Mus musculus
tacgtgtacctatggaaaccgggcg

SEQ ID NO: 127848 - DNA, 25 bp, Mus musculus
tacgtgtacgacctgtccaagggcc

SEQ ID NO: 127849 - DNA, 25 bp, Mus musculus
tacgtgtccctgaaccaggagggca

SEQ ID NO: 127850 - DNA, 25 bp, Mus musculus
tacgtgtccgcctgaacctggtgcg

SEQ ID NO: 127851 - DNA, 25 bp, Mus musculus
tacgtgtcctatagcgactgcccag

SEQ ID NO: 127852 - DNA, 25 bp, Mus musculus
tacgtgtctgattcggtcactcctg

SEQ ID NO: 127853 - DNA, 25 bp, Mus musculus
tacgtgtgaggacatttttatgcac

SEQ ID NO: 127854 - DNA, 25 bp, Mus musculus
tacgtgtgctaacagcctagtgtcc

SEQ ID NO: 127855 - DNA, 25 bp, Mus musculus
tacgtgtgttcgcaccgtatgcctg

SEQ ID NO: 127856 - DNA, 25 bp, Mus musculus
tacgtgttcgtgtttctcggcctca

SEQ ID NO: 127857 - DNA, 25 bp, Mus musculus
tacgttaggtggtcattagacagcc

SEQ ID NO: 127858 - DNA, 25 bp, Mus musculus
tacgttatagaaccgaagtctgtgc

SEQ ID NO: 127859 - DNA, 25 bp, Mus musculus
tacgttattacgacaggaaaacagt

SEQ ID NO: 127860 - DNA, 25 bp, Mus musculus
tacgttcaggaagcatggacctact

SEQ ID NO: 127861 - DNA, 25 bp, Mus musculus
tacgttcgagagatcaagccaagtg

SEQ ID NO: 127862 - DNA, 25 bp, Mus musculus
tacgttcggaagtaccagagtcagc

SEQ ID NO: 127863 - DNA, 25 bp, Mus musculus
tacgttctagaaaagagcctacgct

SEQ ID NO: 127864 - DNA, 25 bp, Mus musculus
tacgttctgatgatcctgaccagca

SEQ ID NO: 127865 - DNA, 25 bp, Mus musculus
tacgttgctgacatactggcccatg

SEQ ID NO: 127866 - DNA, 25 bp, Mus musculus
tacgttggaacgtgccccggaatgt

SEQ ID NO: 127867 - DNA, 25 bp, Mus musculus
tacgttgggatcatccaagtggacc

SEQ ID NO: 127868 - DNA, 25 bp, Mus musculus
tacgttgtaaatgccaccaccactg

SEQ ID NO: 127869 - DNA, 25 bp, Mus musculus
tacgttgtacgaaatcagtggtccc

SEQ ID NO: 127870 - DNA, 25 bp, Mus musculus
tacgtttcccagctgaagtcgctag

SEQ ID NO: 127871 - DNA, 25 bp, Mus musculus
tacgtttctagctacggaggtggag

SEQ ID NO: 127872 - DNA, 25 bp, Mus musculus
tactaaagaaataacagcgggtgct

SEQ ID NO: 127873 - DNA, 25 bp, Mus musculus
tactaaagacaacgacaatgaggag

SEQ ID NO: 127874 - DNA, 25 bp, Mus musculus
tactaagaaacctattccggaggag

SEQ ID NO: 127875 - DNA, 25 bp, Mus musculus
tactaagaggtgtgtgaggctccag

SEQ ID NO: 127876 - DNA, 25 bp, Mus musculus
tactaagcaaccaggaggagtggct

SEQ ID NO: 127877 - DNA, 25 bp, Mus musculus
tactaagcagcagaggcgaattcca

SEQ ID NO: 127878 - DNA, 25 bp, Mus musculus
tactaagctgtttccccaatgcctt

SEQ ID NO: 127879 - DNA, 25 bp, Mus musculus
tactaaggaatctcagggcacctcc

SEQ ID NO: 127880 - DNA, 25 bp, Mus musculus
tactaaggccttcagatgtctcaac

SEQ ID NO: 127881 - DNA, 25 bp, Mus musculus
tactaagtccgaagacccatgggca

SEQ ID NO: 127882 - DNA, 25 bp, Mus musculus
tactaatgaatcctttgatgtgccc

SEQ ID NO: 127883 - DNA, 25 bp, Mus musculus
tactacaaagaagtgggctcggtct

SEQ ID NO: 127884 - DNA, 25 bp, Mus musculus
tactacaaatcaagccaagggaggg

SEQ ID NO: 127885 - DNA, 25 bp, Mus musculus
tactacaactacttccatggccggt

SEQ ID NO: 127886 - DNA, 25 bp, Mus musculus
tactacaagaagtgctggtccattg

SEQ ID NO: 127887 - DNA, 25 bp, Mus musculus
tactacaagagggtctgacgaggct

SEQ ID NO: 127888 - DNA, 25 bp, Mus musculus
tactacaatgcccagaacaccagtg

SEQ ID NO: 127889 - DNA, 25 bp, Mus musculus
tactacaccaaagccctgcgtggag

SEQ ID NO: 127890 - DNA, 25 bp, Mus musculus
tactacacggagtctggtgcctgcc

SEQ ID NO: 127891 - DNA, 25 bp, Mus musculus
tactacactggtgccaatgacaagg

SEQ ID NO: 127892 - DNA, 25 bp, Mus musculus
tactacagaagtgatgggcccatgc

SEQ ID NO: 127893 - DNA, 25 bp, Mus musculus
tactacagaattcatgtgagggcca

SEQ ID NO: 127894 - DNA, 25 bp, Mus musculus
tactacagatgtcgtggccaaaagc

SEQ ID NO: 127895 - DNA, 25 bp, Mus musculus
tactacagcaccagcgaggatgagg

SEQ ID NO: 127896 - DNA, 25 bp, Mus musculus
tactacagggtctatgtcacagtgc

SEQ ID NO: 127897 - DNA, 25 bp, Mus musculus
tactacagtcacaactacgacgggc

SEQ ID NO: 127898 - DNA, 25 bp, Mus musculus
tactacatatcaagatggcacggcc

SEQ ID NO: 127899 - DNA, 25 bp, Mus musculus
tactacatgaagtgatggcagacct

SEQ ID NO: 127900 - DNA, 25 bp, Mus musculus
tactacatgacaaacagcgaggacc

SEQ ID NO: 127901 - DNA, 25 bp, Mus musculus
tactacatggcttgggctggaccct

SEQ ID NO: 127902 - DNA, 25 bp, Mus musculus
tactaccacggaagcatcagaggcg

SEQ ID NO: 127903 - DNA, 25 bp, Mus musculus
tactaccaggaatttgaagacacag

SEQ ID NO: 127904 - DNA, 25 bp, Mus musculus
tactaccagtgtgtggctaccaacg

SEQ ID NO: 127905 - DNA, 25 bp, Mus musculus
tactaccctggtgaattgtccgcag

SEQ ID NO: 127906 - DNA, 25 bp, Mus musculus
tactaccgagacctggaaagatggg

SEQ ID NO: 127907 - DNA, 25 bp, Mus musculus
tactaccgtggttcatgccccttac

SEQ ID NO: 127908 - DNA, 25 bp, Mus musculus
tactacctatatggttggaaccggg

SEQ ID NO: 127909 - DNA, 25 bp, Mus musculus
tactacctggatgagtgagatcatg

SEQ ID NO: 127910 - DNA, 25 bp, Mus musculus
tactacctggcgctaattgaaaggg

SEQ ID NO: 127911 - DNA, 25 bp, Mus musculus
tactacctggcggaaccatggcagt

SEQ ID NO: 127912 - DNA, 25 bp, Mus musculus
tactacgaggccaaagcgtgactac

SEQ ID NO: 127913 - DNA, 25 bp, Mus musculus
tactacgcatatgtaacggagcgcc

SEQ ID NO: 127914 - DNA, 25 bp, Mus musculus
tactacgggaaggagctcaagatcg

SEQ ID NO: 127915 - DNA, 25 bp, Mus musculus
tactactaccaagccagtgctgcga

SEQ ID NO: 127916 - DNA, 25 bp, Mus musculus
tactactaccccatggtgaggacct

SEQ ID NO: 127917 - DNA, 25 bp, Mus musculus
tactactcttgagagcgcgctcaga

SEQ ID NO: 127918 - DNA, 25 bp, Mus musculus
tactactgatccacgtgtaagtctg

SEQ ID NO: 127919 - DNA, 25 bp, Mus musculus
tactactgccgagaaacagagccag

SEQ ID NO: 127920 - DNA, 25 bp, Mus musculus
tactactgtcaataaacaagaaagg

SEQ ID NO: 127921 - DNA, 25 bp, Mus musculus
tactacttcatcaacagccagggcc

SEQ ID NO: 127922 - DNA, 25 bp, Mus musculus
tactagacacgctggccatgttgac

SEQ ID NO: 127923 - DNA, 25 bp, Mus musculus
tactagacagagttaaagacgaacc

SEQ ID NO: 127924 - DNA, 25 bp, Mus musculus
tactagagagtcaggacatgggcac

SEQ ID NO: 127925 - DNA, 25 bp, Mus musculus
tactagagcatatgtctccagtgcg

SEQ ID NO: 127926 - DNA, 25 bp, Mus musculus
tactagatacactggaacaagagat

SEQ ID NO: 127927 - DNA, 25 bp, Mus musculus
tactagcaactttcatcctttggaa

SEQ ID NO: 127928 - DNA, 25 bp, Mus musculus
tactagcaatgggactagtgcccac

SEQ ID NO: 127929 - DNA, 25 bp, Mus musculus
tactagcagagataggactcacgga

SEQ ID NO: 127930 - DNA, 25 bp, Mus musculus
tactagcatattcggatccttggaa

SEQ ID NO: 127931 - DNA, 25 bp, Mus musculus
tactagcccctagctcgggttaggt

SEQ ID NO: 127932 - DNA, 25 bp, Mus musculus
tactaggctcacatcggaattacag

SEQ ID NO: 127933 - DNA, 25 bp, Mus musculus
tactagggagcccaccctcgcaggg

SEQ ID NO: 127934 - DNA, 25 bp, Mus musculus
tactaggtattgaaccagtttctgc

SEQ ID NO: 127935 - DNA, 25 bp, Mus musculus
tactaggttctgagtgacaggacac

SEQ ID NO: 127936 - DNA, 25 bp, Mus musculus
tactagtcacgcataggtgcatttg

SEQ ID NO: 127937 - DNA, 25 bp, Mus musculus
tactagtggtatcatggaggactcc

SEQ ID NO: 127938 - DNA, 25 bp, Mus musculus
tactagtgttaaccatgatgcgaag

SEQ ID NO: 127939 - DNA, 25 bp, Mus musculus
tactataaaatgactcgggccaagc

SEQ ID NO: 127940 - DNA, 25 bp, Mus musculus
tactatacgtgtggcaagcaccagc

SEQ ID NO: 127941 - DNA, 25 bp, Mus musculus
tactatatggagaaggagctagcca

SEQ ID NO: 127942 - DNA, 25 bp, Mus musculus
tactatcagaaacatgcctagcttc

SEQ ID NO: 127943 - DNA, 25 bp, Mus musculus
tactatcaggatttggtcagtcccg

SEQ ID NO: 127944 - DNA, 25 bp, Mus musculus
tactatcatggagtccagtcctgga

SEQ ID NO: 127945 - DNA, 25 bp, Mus musculus
tactatcctaggagatgtgtgggcc

SEQ ID NO: 127946 - DNA, 25 bp, Mus musculus
tactatcctgtagtcaagacccagg

SEQ ID NO: 127947 - DNA, 25 bp, Mus musculus
tactatcgcggagctatgggtttcc

SEQ ID NO: 127948 - DNA, 25 bp, Mus musculus
tactatcgctggctcaactatggcg

SEQ ID NO: 127949 - DNA, 25 bp, Mus musculus
tactatctaggtaaacagaccagga

SEQ ID NO: 127950 - DNA, 25 bp, Mus musculus
tactatctgtaggaccactgtctgg

SEQ ID NO: 127951 - DNA, 25 bp, Mus musculus
tactatgacgagtacctgggccact

SEQ ID NO: 127952 - DNA, 25 bp, Mus musculus
tactatgactaccatcggctctggg

SEQ ID NO: 127953 - DNA, 25 bp, Mus musculus
tactatgagctcaacaaccgtgtgg

SEQ ID NO: 127954 - DNA, 25 bp, Mus musculus
tactatgattgagcacggtgacacg

SEQ ID NO: 127955 - DNA, 25 bp, Mus musculus
tactatgcacaagccacgtctttgg

SEQ ID NO: 127956 - DNA, 25 bp, Mus musculus
tactatgccatctggaggtacctct

SEQ ID NO: 127957 - DNA, 25 bp, Mus musculus
tactatgccattgaggtcaccaagg

SEQ ID NO: 127958 - DNA, 25 bp, Mus musculus
tactatgcgctgctcactttcaagg

SEQ ID NO: 127959 - DNA, 25 bp, Mus musculus
tactatggaactgtcaatctgtgct

SEQ ID NO: 127960 - DNA, 25 bp, Mus musculus
tactatggaatggaatcgatggccc

SEQ ID NO: 127961 - DNA, 25 bp, Mus musculus
tactatggataacctggttgtcagc

SEQ ID NO: 127962 - DNA, 25 bp, Mus musculus
tactatggattgtctgcccttggcc

SEQ ID NO: 127963 - DNA, 25 bp, Mus musculus
tactatggcatgacggagatgaact

SEQ ID NO: 127964 - DNA, 25 bp, Mus musculus
tactatgggccaggaggatcccctg

SEQ ID NO: 127965 - DNA, 25 bp, Mus musculus
tactatggtggcaaaagagaggact

SEQ ID NO: 127966 - DNA, 25 bp, Mus musculus
tactatgtatgagcgagcatctcca

SEQ ID NO: 127967 - DNA, 25 bp, Mus musculus
tactatgtgccactcctgagagcag

SEQ ID NO: 127968 - DNA, 25 bp, Mus musculus
tactatgtgccctgatacttgcaag

SEQ ID NO: 127969 - DNA, 25 bp, Mus musculus
tactatgttatccaagaccctggaa

SEQ ID NO: 127970 - DNA, 25 bp, Mus musculus
tactattaacattccctaagatgct

SEQ ID NO: 127971 - DNA, 25 bp, Mus musculus
tactattactaatgcatgcggtgcc

SEQ ID NO: 127972 - DNA, 25 bp, Mus musculus
tactattcaacgtgtcatggattcc

SEQ ID NO: 127973 - DNA, 25 bp, Mus musculus
tactattcaaggtgtgctccggagg

SEQ ID NO: 127974 - DNA, 25 bp, Mus musculus
tactattcactggacactgctctcg

SEQ ID NO: 127975 - DNA, 25 bp, Mus musculus
tactattctcgaggccgtcggctac

SEQ ID NO: 127976 - DNA, 25 bp, Mus musculus
tactattgaggaaggcacaatgccc

SEQ ID NO: 127977 - DNA, 25 bp, Mus musculus
tactattgttgtatccttcccaggg

SEQ ID NO: 127978 - DNA, 25 bp, Mus musculus
tactattttggcaagggctccaagc

SEQ ID NO: 127979 - DNA, 25 bp, Mus musculus
tactcaaatgacagagcagcaggct

SEQ ID NO: 127980 - DNA, 25 bp, Mus musculus
tactcaaccagagaagtggcttggc

SEQ ID NO: 127981 - DNA, 25 bp, Mus musculus
tactcaacgcctgtaatgggctgcg

SEQ ID NO: 127982 - DNA, 25 bp, Mus musculus
tactcaagacagctttccagccggt

SEQ ID NO: 127983 - DNA, 25 bp, Mus musculus
tactcaaggaatgcagggaccacct

SEQ ID NO: 127984 - DNA, 25 bp, Mus musculus
tactcaatgccctgccaagtgtggg

SEQ ID NO: 127985 - DNA, 25 bp, Mus musculus
tactcaatggacaacgctatcgtgc

SEQ ID NO: 127986 - DNA, 25 bp, Mus musculus
tactcacagttctttccacagggag

SEQ ID NO: 127987 - DNA, 25 bp, Mus musculus
tactcacatcgtggaaaacagtcca

SEQ ID NO: 127988 - DNA, 25 bp, Mus musculus
tactcacatggttcttaagggagcc

SEQ ID NO: 127989 - DNA, 25 bp, Mus musculus
tactcacattttgtgtggaacatca

SEQ ID NO: 127990 - DNA, 25 bp, Mus musculus
tactcaccagaagatgtcatcggca

SEQ ID NO: 127991 - DNA, 25 bp, Mus musculus
tactcacctgtggtcattgacaact

SEQ ID NO: 127992 - DNA, 25 bp, Mus musculus
tactcacggctttcgtacatctggg

SEQ ID NO: 127993 - DNA, 25 bp, Mus musculus
tactcacgggcagtttgatgagcgc

SEQ ID NO: 127994 - DNA, 25 bp, Mus musculus
tactcacggttgacgaggcaccttt

SEQ ID NO: 127995 - DNA, 25 bp, Mus musculus
tactcactggctaaggaatggcact

SEQ ID NO: 127996 - DNA, 25 bp, Mus musculus
tactcacttggctgaggcgctgcac

SEQ ID NO: 127997 - DNA, 25 bp, Mus musculus
tactcactttctgcttgaagccggg

SEQ ID NO: 127998 - DNA, 25 bp, Mus musculus
tactcagaaacttgcagactcgccc

SEQ ID NO: 127999 - DNA, 25 bp, Mus musculus
tactcagaagctgataaggtccttg

SEQ ID NO: 128000 - DNA, 25 bp, Mus musculus
tactcagaagtctaacagagaccct

SEQ ID NO: 128001 - DNA, 25 bp, Mus musculus
tactcagacaagaggtccaagacct

SEQ ID NO: 128002 - DNA, 25 bp, Mus musculus
tactcagagcgcgaacttaaccggt

SEQ ID NO: 128003 - DNA, 25 bp, Mus musculus
tactcagagcttcgttagccaccgg

SEQ ID NO: 128004 - DNA, 25 bp, Mus musculus
tactcagaggccacttaggaacctt

SEQ ID NO: 128005 - DNA, 25 bp, Mus musculus
tactcagagtgacacatgcccgctg

SEQ ID NO: 128006 - DNA, 25 bp, Mus musculus
tactcagatgaagtgcagatcgggc

SEQ ID NO: 128007 - DNA, 25 bp, Mus musculus
tactcagccagacagagatgttccg

SEQ ID NO: 128008 - DNA, 25 bp, Mus musculus
tactcagccgaagaaggtccggaag

SEQ ID NO: 128009 - DNA, 25 bp, Mus musculus
tactcagccgggtgcaaaatctcag

SEQ ID NO: 128010 - DNA, 25 bp, Mus musculus
tactcagcctaaagaccatggatcg

SEQ ID NO: 128011 - DNA, 25 bp, Mus musculus
tactcagcggaacctatataggaat

SEQ ID NO: 128012 - DNA, 25 bp, Mus musculus
tactcagctgacctgttgtaatcgt

SEQ ID NO: 128013 - DNA, 25 bp, Mus musculus
tactcagcttctacgagcagcagga

SEQ ID NO: 128014 - DNA, 25 bp, Mus musculus
tactcaggaccccaagattcagaag

SEQ ID NO: 128015 - DNA, 25 bp, Mus musculus
tactcaggacgtagataacattggc

SEQ ID NO: 128016 - DNA, 25 bp, Mus musculus
tactcaggcatctcggacggtcttt

SEQ ID NO: 128017 - DNA, 25 bp, Mus musculus
tactcaggctgcactaccgagagcc

SEQ ID NO: 128018 - DNA, 25 bp, Mus musculus
tactcaggtctagctactggcggct

SEQ ID NO: 128019 - DNA, 25 bp, Mus musculus
tactcaggtgcaagctaggatgaaa

SEQ ID NO: 128020 - DNA, 25 bp, Mus musculus
tactcagtagaaccagccaaggctt

SEQ ID NO: 128021 - DNA, 25 bp, Mus musculus
tactcagtcacttaggaccaggcag

SEQ ID NO: 128022 - DNA, 25 bp, Mus musculus
tactcagtctttaacttggtggtgg

SEQ ID NO: 128023 - DNA, 25 bp, Mus musculus
tactcatagagaggagggcacagga

SEQ ID NO: 128024 - DNA, 25 bp, Mus musculus
tactcatatactcatggcggctgtg

SEQ ID NO: 128025 - DNA, 25 bp, Mus musculus
tactcatcatccacgagcttgctcg

SEQ ID NO: 128026 - DNA, 25 bp, Mus musculus
tactcatctgaggactgggacaaga

SEQ ID NO: 128027 - DNA, 25 bp, Mus musculus
tactcatggacgttggacggaccag

SEQ ID NO: 128028 - DNA, 25 bp, Mus musculus
tactcatgtcggatagaaacaacag

SEQ ID NO: 128029 - DNA, 25 bp, Mus musculus
tactccaaggatgcaaccagatgtg

SEQ ID NO: 128030 - DNA, 25 bp, Mus musculus
tactccaatgagaagccgttcacag

SEQ ID NO: 128031 - DNA, 25 bp, Mus musculus
tactccagagagaaaagatgctcaa

SEQ ID NO: 128032 - DNA, 25 bp, Mus musculus
tactccagctaaagagaagcagccg

SEQ ID NO: 128033 - DNA, 25 bp, Mus musculus
tactccaggacttagataaaaaaga

SEQ ID NO: 128034 - DNA, 25 bp, Mus musculus
tactccagggaagcagagacatcag

SEQ ID NO: 128035 - DNA, 25 bp, Mus musculus
tactccagtagtgaaaggaaattct

SEQ ID NO: 128036 - DNA, 25 bp, Mus musculus
tactccagtgactgctgaaccagag

SEQ ID NO: 128037 - DNA, 25 bp, Mus musculus
tactccatcagtggcatcctgggca

SEQ ID NO: 128038 - DNA, 25 bp, Mus musculus
tactccatccccatctcagaagatg

SEQ ID NO: 128039 - DNA, 25 bp, Mus musculus
tactccatgagcagatgaaggaggc

SEQ ID NO: 128040 - DNA, 25 bp, Mus musculus
tactccatgcagttctggctgtcct

SEQ ID NO: 128041 - DNA, 25 bp, Mus musculus
tactccatggagcacttccgctggg

SEQ ID NO: 128042 - DNA, 25 bp, Mus musculus
tactcccagagacgatccagctgtg

SEQ ID NO: 128043 - DNA, 25 bp, Mus musculus
tactcccagaggactcacaggttga

SEQ ID NO: 128044 - DNA, 25 bp, Mus musculus
tactcccctcggcaagagtcaaggc

SEQ ID NO: 128045 - DNA, 25 bp, Mus musculus
tactcccctgacgaaagtggctgct

SEQ ID NO: 128046 - DNA, 25 bp, Mus musculus
tactcccgctctgaccagtggaggg

SEQ ID NO: 128047 - DNA, 25 bp, Mus musculus
tactcccgtttggtgcatgagacag

SEQ ID NO: 128048 - DNA, 25 bp, Mus musculus
tactcccttgctgatgcgtccaatg

SEQ ID NO: 128049 - DNA, 25 bp, Mus musculus
tactccgacagctggtgatagccgc

SEQ ID NO: 128050 - DNA, 25 bp, Mus musculus
tactccgacatgaagcgtgctttgg

SEQ ID NO: 128051 - DNA, 25 bp, Mus musculus
tactccgaccgtgaagttgaggtga

SEQ ID NO: 128052 - DNA, 25 bp, Mus musculus
tactccgactgcgaagagaccagaa

SEQ ID NO: 128053 - DNA, 25 bp, Mus musculus
tactccgatgatgctctagccagag

SEQ ID NO: 128054 - DNA, 25 bp, Mus musculus
tactccgcgggaagtacagaatccc

SEQ ID NO: 128055 - DNA, 25 bp, Mus musculus
tactccggactaaggcaggcttcca

SEQ ID NO: 128056 - DNA, 25 bp, Mus musculus
tactccgtgtcaatggcaaatcagg

SEQ ID NO: 128057 - DNA, 25 bp, Mus musculus
tactcctacatgcagtgagcccagg

SEQ ID NO: 128058 - DNA, 25 bp, Mus musculus
tactcctacgactataagctgcccg

SEQ ID NO: 128059 - DNA, 25 bp, Mus musculus
tactcctactggacgctagcctatg

SEQ ID NO: 128060 - DNA, 25 bp, Mus musculus
tactcctcaagcacctgaaggtagg

SEQ ID NO: 128061 - DNA, 25 bp, Mus musculus
tactcctccataactacgtgggaga

SEQ ID NO: 128062 - DNA, 25 bp, Mus musculus
tactcctgggatatcatggagccag

SEQ ID NO: 128063 - DNA, 25 bp, Mus musculus
tactccttcaactgtcccgatggtg

SEQ ID NO: 128064 - DNA, 25 bp, Mus musculus
tactccttcaggtggatcaacaggc

SEQ ID NO: 128065 - DNA, 25 bp, Mus musculus
tactccttctggcaggcagggctcc

SEQ ID NO: 128066 - DNA, 25 bp, Mus musculus
tactccttggagattaactagagaa

SEQ ID NO: 128067 - DNA, 25 bp, Mus musculus
tactcctttgagtcccaggtgcagg

SEQ ID NO: 128068 - DNA, 25 bp, Mus musculus
tactcctttgagtgcattggcaacg

SEQ ID NO: 128069 - DNA, 25 bp, Mus musculus
tactcgatggtgttcttgaatccga

SEQ ID NO: 128070 - DNA, 25 bp, Mus musculus
tactcgcagtgcattgaaggaccca

SEQ ID NO: 128071 - DNA, 25 bp, Mus musculus
tactcgcgcaagcttggaggccaag

SEQ ID NO: 128072 - DNA, 25 bp, Mus musculus
tactcgcgcaagtacgggctcaaga

SEQ ID NO: 128073 - DNA, 25 bp, Mus musculus
tactcgctgcgagaggtggactcat

SEQ ID NO: 128074 - DNA, 25 bp, Mus musculus
tactcggaagaaggcaacattgaac

SEQ ID NO: 128075 - DNA, 25 bp, Mus musculus
tactcggaagggttgagcgtccaca

SEQ ID NO: 128076 - DNA, 25 bp, Mus musculus
tactcggactcagctaatgtgactc

SEQ ID NO: 128077 - DNA, 25 bp, Mus musculus
tactcggatggtcgctttagagacc

SEQ ID NO: 128078 - DNA, 25 bp, Mus musculus
tactcggcatagaacaagaacattg

SEQ ID NO: 128079 - DNA, 25 bp, Mus musculus
tactcggcgctacaggacaaagaat

SEQ ID NO: 128080 - DNA, 25 bp, Mus musculus
tactcggctctgtgaacctaaagaa

SEQ ID NO: 128081 - DNA, 25 bp, Mus musculus
tactcggctgacgtcggaaacaaaa

SEQ ID NO: 128082 - DNA, 25 bp, Mus musculus
tactcggctgcctcgcgctgctggg

SEQ ID NO: 128083 - DNA, 25 bp, Mus musculus
tactcggctgttccaagattcaacc

SEQ ID NO: 128084 - DNA, 25 bp, Mus musculus
tactcgggactacttgggacctctg

SEQ ID NO: 128085 - DNA, 25 bp, Mus musculus
tactcgggcatccactgtgaaaccg

SEQ ID NO: 128086 - DNA, 25 bp, Mus musculus
tactcgggccgatatgcccaatggg

SEQ ID NO: 128087 - DNA, 25 bp, Mus musculus
tactcgggctcacaggaaatgacct

SEQ ID NO: 128088 - DNA, 25 bp, Mus musculus
tactcgggtgtgcagcctgggattg

SEQ ID NO: 128089 - DNA, 25 bp, Mus musculus
tactcggtaaatcagatgggctgcc

SEQ ID NO: 128090 - DNA, 25 bp, Mus musculus
tactcggttgttcgtggctgtgacc

SEQ ID NO: 128091 - DNA, 25 bp, Mus musculus
tactcgtgctcggatatgctgtgac

SEQ ID NO: 128092 - DNA, 25 bp, Mus musculus
tactcgtgtaatgaacagccgtggt

SEQ ID NO: 128093 - DNA, 25 bp, Mus musculus
tactcgttctcgtctcatgagcagg

SEQ ID NO: 128094 - DNA, 25 bp, Mus musculus
tactcgttggctctgcgttcgtcgc

SEQ ID NO: 128095 - DNA, 25 bp, Mus musculus
tactctaagccaaatcaccgggcag

SEQ ID NO: 128096 - DNA, 25 bp, Mus musculus
tactctacagatcaccagtgttgtg

SEQ ID NO: 128097 - DNA, 25 bp, Mus musculus
tactctagaagaggtcaactcccag

SEQ ID NO: 128098 - DNA, 25 bp, Mus musculus
tactctattctaatcaaaagtgagg

SEQ ID NO: 128099 - DNA, 25 bp, Mus musculus
tactctcaaagaagccctaaagcat

SEQ ID NO: 128100 - DNA, 25 bp, Mus musculus
tactctcaacattaaagcgtccggg

SEQ ID NO: 128101 - DNA, 25 bp, Mus musculus
tactctcaagtttacatacagtgaa

SEQ ID NO: 128102 - DNA, 25 bp, Mus musculus
tactctcaccttagtcgccagggag

SEQ ID NO: 128103 - DNA, 25 bp, Mus musculus
tactctcagaacgaggaatgcctcg

SEQ ID NO: 128104 - DNA, 25 bp, Mus musculus
tactctcaggcagtgttctcagcag

SEQ ID NO: 128105 - DNA, 25 bp, Mus musculus
tactctccaagtggctgctgtcggc

SEQ ID NO: 128106 - DNA, 25 bp, Mus musculus
tactctccgtctggaagatgggcca

SEQ ID NO: 128107 - DNA, 25 bp, Mus musculus
tactctccttgtctcgcattgggcg

SEQ ID NO: 128108 - DNA, 25 bp, Mus musculus
tactctctgaaagacggacgccgtc

SEQ ID NO: 128109 - DNA, 25 bp, Mus musculus
tactctctgcgggatgatgccaagg

SEQ ID NO: 128110 - DNA, 25 bp, Mus musculus
tactctctgctggacggaggaacct

SEQ ID NO: 128111 - DNA, 25 bp, Mus musculus
tactctgaagattccccacgtggag

SEQ ID NO: 128112 - DNA, 25 bp, Mus musculus
tactctgaagcaggcaaatgggtct

SEQ ID NO: 128113 - DNA, 25 bp, Mus musculus
tactctgacgctcactcggctggtg

SEQ ID NO: 128114 - DNA, 25 bp, Mus musculus
tactctgagaacaaacccaggttgg

SEQ ID NO: 128115 - DNA, 25 bp, Mus musculus
tactctgaggaggtgatgccccttc

SEQ ID NO: 128116 - DNA, 25 bp, Mus musculus
tactctgaggccgagatcaaggtgc

SEQ ID NO: 128117 - DNA, 25 bp, Mus musculus
tactctgcaagcaaggtggctgtca

SEQ ID NO: 128118 - DNA, 25 bp, Mus musculus
tactctgcacttgccggagaaaggg

SEQ ID NO: 128119 - DNA, 25 bp, Mus musculus
tactctgccgtggatgatgcgtccc

SEQ ID NO: 128120 - DNA, 25 bp, Mus musculus
tactctgctggaatgtgactctgcc

SEQ ID NO: 128121 - DNA, 25 bp, Mus musculus
tactctggaagaactataccctgaa

SEQ ID NO: 128122 - DNA, 25 bp, Mus musculus
tactctggaaggagagcgggacatc

SEQ ID NO: 128123 - DNA, 25 bp, Mus musculus
tactctggagcctaggaacgtgcgt

SEQ ID NO: 128124 - DNA, 25 bp, Mus musculus
tactctggatcttgggactctactg

SEQ ID NO: 128125 - DNA, 25 bp, Mus musculus
tactctggcagaaacggagccctct

SEQ ID NO: 128126 - DNA, 25 bp, Mus musculus
tactctggctactggtggtgtcccc

SEQ ID NO: 128127 - DNA, 25 bp, Mus musculus
tactctgggcttaactctggctcgg

SEQ ID NO: 128128 - DNA, 25 bp, Mus musculus
tactctgggtgtctgcaagtacacg

SEQ ID NO: 128129 - DNA, 25 bp, Mus musculus
tactctggtggttgccttggcctaa

SEQ ID NO: 128130 - DNA, 25 bp, Mus musculus
tactctgtatgcctaaggatgcggc

SEQ ID NO: 128131 - DNA, 25 bp, Mus musculus
tactctgtgtggatgggtgctctgc

SEQ ID NO: 128132 - DNA, 25 bp, Mus musculus
tactctgtgttcaacccgggctgtg

SEQ ID NO: 128133 - DNA, 25 bp, Mus musculus
tactctgttgggaatggaaggccag

SEQ ID NO: 128134 - DNA, 25 bp, Mus musculus
tactcttcccctctagttatggtgg

SEQ ID NO: 128135 - DNA, 25 bp, Mus musculus
tactcttctcatgcgagggtcccaa

SEQ ID NO: 128136 - DNA, 25 bp, Mus musculus
tactcttctctcttcgtggtccctg

SEQ ID NO: 128137 - DNA, 25 bp, Mus musculus
tactcttgatgtcaccgtacacgcg

SEQ ID NO: 128138 - DNA, 25 bp, Mus musculus
tactcttggcaatgacacagcagct

SEQ ID NO: 128139 - DNA, 25 bp, Mus musculus
tactcttggctgtgtaggactaggg

SEQ ID NO: 128140 - DNA, 25 bp, Mus musculus
tactcttgtagttaccaagtgccgg

SEQ ID NO: 128141 - DNA, 25 bp, Mus musculus
tactcttgtgaaacatcgaccccag

SEQ ID NO: 128142 - DNA, 25 bp, Mus musculus
tactgaaaaacctgggcatagactg

SEQ ID NO: 128143 - DNA, 25 bp, Mus musculus
tactgaaaaggagccgacaaaagcg

SEQ ID NO: 128144 - DNA, 25 bp, Mus musculus
tactgaaatcctggaattgagtcct

SEQ ID NO: 128145 - DNA, 25 bp, Mus musculus
tactgaaatgtgaacctctgcctgg

SEQ ID NO: 128146 - DNA, 25 bp, Mus musculus
tactgaaccaccagggtttactctg

SEQ ID NO: 128147 - DNA, 25 bp, Mus musculus
tactgaagagatgctgcctggacct

SEQ ID NO: 128148 - DNA, 25 bp, Mus musculus
tactgaaggaaatctctgttggcga

SEQ ID NO: 128149 - DNA, 25 bp, Mus musculus
tactgaaggacaccaggttgcatgc

SEQ ID NO: 128150 - DNA, 25 bp, Mus musculus
tactgaaggagaacttgtgagggcc

SEQ ID NO: 128151 - DNA, 25 bp, Mus musculus
tactgaaggctgtgcagtggctcca

SEQ ID NO: 128152 - DNA, 25 bp, Mus musculus
tactgaagggcttttatacagctcc

SEQ ID NO: 128153 - DNA, 25 bp, Mus musculus
tactgaagtacagcacgcaattgac

SEQ ID NO: 128154 - DNA, 25 bp, Mus musculus
tactgaagtcattaggaaaggctcg

SEQ ID NO: 128155 - DNA, 25 bp, Mus musculus
tactgaatgttgtctgccaggacca

SEQ ID NO: 128156 - DNA, 25 bp, Mus musculus
tactgacaagtctactctccggagg

SEQ ID NO: 128157 - DNA, 25 bp, Mus musculus
tactgacacatttaaaggagcatcc

SEQ ID NO: 128158 - DNA, 25 bp, Mus musculus
tactgaccaccgagcggctctctgg

SEQ ID NO: 128159 - DNA, 25 bp, Mus musculus
tactgaccagaaatgcagccttttg

SEQ ID NO: 128160 - DNA, 25 bp, Mus musculus
tactgaccgtgtccaaagggttctt

SEQ ID NO: 128161 - DNA, 25 bp, Mus musculus
tactgaccgtgtgagatatgaagaa

SEQ ID NO: 128162 - DNA, 25 bp, Mus musculus
tactgacctagtgtaaagatggcca

SEQ ID NO: 128163 - DNA, 25 bp, Mus musculus
tactgacctcgcagagggcgtggcc

SEQ ID NO: 128164 - DNA, 25 bp, Mus musculus
tactgacggccattcagcctggact

SEQ ID NO: 128165 - DNA, 25 bp, Mus musculus
tactgacgggatgaagtggactagc

SEQ ID NO: 128166 - DNA, 25 bp, Mus musculus
tactgacggtttcagcaaagtccgg

SEQ ID NO: 128167 - DNA, 25 bp, Mus musculus
tactgactaggcttgtgacacatct

SEQ ID NO: 128168 - DNA, 25 bp, Mus musculus
tactgactgagaatggccaccacta

SEQ ID NO: 128169 - DNA, 25 bp, Mus musculus
tactgactgctgacttccagctgct

SEQ ID NO: 128170 - DNA, 25 bp, Mus musculus
tactgacttgtcactagcctggtgc

SEQ ID NO: 128171 - DNA, 25 bp, Mus musculus
tactgagaacatgtccaggcgacca

SEQ ID NO: 128172 - DNA, 25 bp, Mus musculus
tactgagaatgtactgagcagcagc

SEQ ID NO: 128173 - DNA, 25 bp, Mus musculus
tactgagacatcaccaacctctgct

SEQ ID NO: 128174 - DNA, 25 bp, Mus musculus
tactgagacctttgttgcctgggac

SEQ ID NO: 128175 - DNA, 25 bp, Mus musculus
tactgagacttgtttggccttcacc

SEQ ID NO: 128176 - DNA, 25 bp, Mus musculus
tactgagagcaacctgcagactagc

SEQ ID NO: 128177 - DNA, 25 bp, Mus musculus
tactgagatcgtggtgcagatggct

SEQ ID NO: 128178 - DNA, 25 bp, Mus musculus
tactgagatgggtcaaggccttcac

SEQ ID NO: 128179 - DNA, 25 bp, Mus musculus
tactgagcaagctgaatcgcgcagt

SEQ ID NO: 128180 - DNA, 25 bp, Mus musculus
tactgagctctggaagtgacacacc

SEQ ID NO: 128181 - DNA, 25 bp, Mus musculus
tactgagctgagaacaactcatttc

SEQ ID NO: 128182 - DNA, 25 bp, Mus musculus
tactgaggaattggcaactcctggc

SEQ ID NO: 128183 - DNA, 25 bp, Mus musculus
tactgaggacatgtacaccaatggg

SEQ ID NO: 128184 - DNA, 25 bp, Mus musculus
tactgaggaccgtgaaacctgagtt

SEQ ID NO: 128185 - DNA, 25 bp, Mus musculus
tactgaggacggcaccagagttttg

SEQ ID NO: 128186 - DNA, 25 bp, Mus musculus
tactgaggtagcacagactcccatg

SEQ ID NO: 128187 - DNA, 25 bp, Mus musculus
tactgagtgtgtgctggacctgacg

SEQ ID NO: 128188 - DNA, 25 bp, Mus musculus
tactgataatgaggtgaccgatgcc

SEQ ID NO: 128189 - DNA, 25 bp, Mus musculus
tactgatcaagactccactggtgac

SEQ ID NO: 128190 - DNA, 25 bp, Mus musculus
tactgatccccatggagagcaactg

SEQ ID NO: 128191 - DNA, 25 bp, Mus musculus
tactgatctaaccttggtcttggaa

SEQ ID NO: 128192 - DNA, 25 bp, Mus musculus
tactgatgactgtgggatgggccct

SEQ ID NO: 128193 - DNA, 25 bp, Mus musculus
tactgatggaacgaagaatccggcc

SEQ ID NO: 128194 - DNA, 25 bp, Mus musculus
tactgatggatatgggcttagctcc

SEQ ID NO: 128195 - DNA, 25 bp, Mus musculus
tactgatggtgcaaaggaggccact

SEQ ID NO: 128196 - DNA, 25 bp, Mus musculus
tactgatgtaggtgccttcaccacc

SEQ ID NO: 128197 - DNA, 25 bp, Mus musculus
tactgatgtccactgcgttttgaga

SEQ ID NO: 128198 - DNA, 25 bp, Mus musculus
tactgatgtgcttttccgacctgct

SEQ ID NO: 128199 - DNA, 25 bp, Mus musculus
tactgattctggaaccacagacctg

SEQ ID NO: 128200 - DNA, 25 bp, Mus musculus
tactgattgcccatggaagcctgca

SEQ ID NO: 128201 - DNA, 25 bp, Mus musculus
tactgcaaaccttcgggagaatggg

SEQ ID NO: 128202 - DNA, 25 bp, Mus musculus
tactgcaaataaatggaccctgagc

SEQ ID NO: 128203 - DNA, 25 bp, Mus musculus
tactgcaacattccaagcgtagcgg

SEQ ID NO: 128204 - DNA, 25 bp, Mus musculus
tactgcaacgcagtggctgaggccg

SEQ ID NO: 128205 - DNA, 25 bp, Mus musculus
tactgcaagagcagaccactggtgt

SEQ ID NO: 128206 - DNA, 25 bp, Mus musculus
tactgcaagcgtgtgccttaccgaa

SEQ ID NO: 128207 - DNA, 25 bp, Mus musculus
tactgcacatctagttggctccaaa

SEQ ID NO: 128208 - DNA, 25 bp, Mus musculus
tactgcacccacatgtcaagaactg

SEQ ID NO: 128209 - DNA, 25 bp, Mus musculus
tactgcaccttgaccattcgagaga

SEQ ID NO: 128210 - DNA, 25 bp, Mus musculus
tactgcacgagctctccaacgatgg

SEQ ID NO: 128211 - DNA, 25 bp, Mus musculus
tactgcacgtatcgtgggacggacc

SEQ ID NO: 128212 - DNA, 25 bp, Mus musculus
tactgcactgcctacggatgggcca

SEQ ID NO: 128213 - DNA, 25 bp, Mus musculus
tactgcaggatactagaaaggttcc

SEQ ID NO: 128214 - DNA, 25 bp, Mus musculus
tactgcaggcgaagaaagacattga

SEQ ID NO: 128215 - DNA, 25 bp, Mus musculus
tactgcaggcttaagaagtgcttcc

SEQ ID NO: 128216 - DNA, 25 bp, Mus musculus
tactgcagtacaaccatcggatgaa

SEQ ID NO: 128217 - DNA, 25 bp, Mus musculus
tactgcagtaccagaacgaggttcc

SEQ ID NO: 128218 - DNA, 25 bp, Mus musculus
tactgcagtacctatggccctggag

SEQ ID NO: 128219 - DNA, 25 bp, Mus musculus
tactgcagtcctgtagagacctccg

SEQ ID NO: 128220 - DNA, 25 bp, Mus musculus
tactgcagtgaacggctgtgtgacc

SEQ ID NO: 128221 - DNA, 25 bp, Mus musculus
tactgcagtgagcttcgatcgctgg

SEQ ID NO: 128222 - DNA, 25 bp, Mus musculus
tactgcatatgcttaggcgaggaat

SEQ ID NO: 128223 - DNA, 25 bp, Mus musculus
tactgcatctggctgctgatcccta

SEQ ID NO: 128224 - DNA, 25 bp, Mus musculus
tactgcatgagaaagatgaccctcc

SEQ ID NO: 128225 - DNA, 25 bp, Mus musculus
tactgcatgagactccgttctggcc

SEQ ID NO: 128226 - DNA, 25 bp, Mus musculus
tactgcatgcactccaagaagctgc

SEQ ID NO: 128227 - DNA, 25 bp, Mus musculus
tactgccaagagcaggacatgtgct

SEQ ID NO: 128228 - DNA, 25 bp, Mus musculus
tactgccaccggtgagagttccagg

SEQ ID NO: 128229 - DNA, 25 bp, Mus musculus
tactgccagagttgccatcggtgcc

SEQ ID NO: 128230 - DNA, 25 bp, Mus musculus
tactgccagctaaggaaggagggcc

SEQ ID NO: 128231 - DNA, 25 bp, Mus musculus
tactgccagggtgggttccttcaca

SEQ ID NO: 128232 - DNA, 25 bp, Mus musculus
tactgccatctttcagccctcggaa

SEQ ID NO: 128233 - DNA, 25 bp, Mus musculus
tactgcccaagatcccagagtggtg

SEQ ID NO: 128234 - DNA, 25 bp, Mus musculus
tactgcccaaggtctggatttactg

SEQ ID NO: 128235 - DNA, 25 bp, Mus musculus
tactgcccagtatgtggctctgcct

SEQ ID NO: 128236 - DNA, 25 bp, Mus musculus
tactgcccatgctgtggctggatta

SEQ ID NO: 128237 - DNA, 25 bp, Mus musculus
tactgccccaagtgcatggacgtgt

SEQ ID NO: 128238 - DNA, 25 bp, Mus musculus
tactgcccctgacatctgcatagca

SEQ ID NO: 128239 - DNA, 25 bp, Mus musculus
tactgcccgaggcttccgaagtgag

SEQ ID NO: 128240 - DNA, 25 bp, Mus musculus
tactgccctggaggatattaagcca

SEQ ID NO: 128241 - DNA, 25 bp, Mus musculus
tactgccggcaagctgactgttgtc

SEQ ID NO: 128242 - DNA, 25 bp, Mus musculus
tactgcctaacctgccgagtcaaag

SEQ ID NO: 128243 - DNA, 25 bp, Mus musculus
tactgcctcaatggtggcgtgtgca

SEQ ID NO: 128244 - DNA, 25 bp, Mus musculus
tactgcctggcggtaaaggagctct

SEQ ID NO: 128245 - DNA, 25 bp, Mus musculus
tactgcctgggcagcagagactttg

SEQ ID NO: 128246 - DNA, 25 bp, Mus musculus
tactgcctgtgtgaaggtgctacgg

SEQ ID NO: 128247 - DNA, 25 bp, Mus musculus
tactgcgaagttttgctcctggacg

SEQ ID NO: 128248 - DNA, 25 bp, Mus musculus
tactgcgacgccaaatacgtctggg

SEQ ID NO: 128249 - DNA, 25 bp, Mus musculus
tactgcgcctggatgaaacgtcggg

SEQ ID NO: 128250 - DNA, 25 bp, Mus musculus
tactgcgcggaaagaaataggctgg

SEQ ID NO: 128251 - DNA, 25 bp, Mus musculus
tactgcgggataaagagcaacgcca

SEQ ID NO: 128252 - DNA, 25 bp, Mus musculus
tactgcgggcaaagccgatgtggcc

SEQ ID NO: 128253 - DNA, 25 bp, Mus musculus
tactgcggtgctcaacagtgatgct

SEQ ID NO: 128254 - DNA, 25 bp, Mus musculus
tactgcgtgtgactcagaagacctg

SEQ ID NO: 128255 - DNA, 25 bp, Mus musculus
tactgctaatcctggatgaggttgc

SEQ ID NO: 128256 - DNA, 25 bp, Mus musculus
tactgctagagcctggtggccagaa

SEQ ID NO: 128257 - DNA, 25 bp, Mus musculus
tactgctagggtcaggaagacactt

SEQ ID NO: 128258 - DNA, 25 bp, Mus musculus
tactgctatgcgtggctagtgccgc

SEQ ID NO: 128259 - DNA, 25 bp, Mus musculus
tactgctcacaagtggcctgatctg

SEQ ID NO: 128260 - DNA, 25 bp, Mus musculus
tactgctcaggcacagacaggctgt

SEQ ID NO: 128261 - DNA, 25 bp, Mus musculus
tactgctcgggagcacgggctgata

SEQ ID NO: 128262 - DNA, 25 bp, Mus musculus
tactgctctgtgctataaactctgg

SEQ ID NO: 128263 - DNA, 25 bp, Mus musculus
tactgctgcctgacgtccattgctg

SEQ ID NO: 128264 - DNA, 25 bp, Mus musculus
tactgctgcgatacagggagtgcca

SEQ ID NO: 128265 - DNA, 25 bp, Mus musculus
tactgctgctcgaaatggacacgtg

SEQ ID NO: 128266 - DNA, 25 bp, Mus musculus
tactgctggacgtttcacacagtgg

SEQ ID NO: 128267 - DNA, 25 bp, Mus musculus
tactgcttcagacagaatgggaggc

SEQ ID NO: 128268 - DNA, 25 bp, Mus musculus
tactgcttctgaagcgggaccgggc

SEQ ID NO: 128269 - DNA, 25 bp, Mus musculus
tactgcttctgagcgagggccaaat

SEQ ID NO: 128270 - DNA, 25 bp, Mus musculus
tactggaaacagatgtacctgctgg

SEQ ID NO: 128271 - DNA, 25 bp, Mus musculus
tactggaaagacagttgctactgca

SEQ ID NO: 128272 - DNA, 25 bp, Mus musculus
tactggaagactggagccagcctgg

SEQ ID NO: 128273 - DNA, 25 bp, Mus musculus
tactggaagatgatcctgaggcagc

SEQ ID NO: 128274 - DNA, 25 bp, Mus musculus
tactggaagattacccttatgagga

SEQ ID NO: 128275 - DNA, 25 bp, Mus musculus
tactggaaggacaccaggacgtcgg

SEQ ID NO: 128276 - DNA, 25 bp, Mus musculus
tactggaagtccaaggcaatgtgcc

SEQ ID NO: 128277 - DNA, 25 bp, Mus musculus
tactggaatctcagcctggtgtgcc

SEQ ID NO: 128278 - DNA, 25 bp, Mus musculus
tactggacaacataggaactgactt

SEQ ID NO: 128279 - DNA, 25 bp, Mus musculus
tactggacacagcaaacagcatctg

SEQ ID NO: 128280 - DNA, 25 bp, Mus musculus
tactggacacagctgtccatgtgtg

SEQ ID NO: 128281 - DNA, 25 bp, Mus musculus
tactggacacgttgataatggcatg

SEQ ID NO: 128282 - DNA, 25 bp, Mus musculus
tactggacatcttagacacagcagg

SEQ ID NO: 128283 - DNA, 25 bp, Mus musculus
tactggaccaaataccaggtgtggg

SEQ ID NO: 128284 - DNA, 25 bp, Mus musculus
tactggacggatgcttacctggact

SEQ ID NO: 128285 - DNA, 25 bp, Mus musculus
tactggagaatctagcctcggaacg

SEQ ID NO: 128286 - DNA, 25 bp, Mus musculus
tactggagaatgatgaggtggaacc

SEQ ID NO: 128287 - DNA, 25 bp, Mus musculus
tactggagagactgaaaaaactgga

SEQ ID NO: 128288 - DNA, 25 bp, Mus musculus
tactggagattcaagcggcaacatc

SEQ ID NO: 128289 - DNA, 25 bp, Mus musculus
tactggagcactgagacaaatcttc

SEQ ID NO: 128290 - DNA, 25 bp, Mus musculus
tactggagccaccaaaactgagcgg

SEQ ID NO: 128291 - DNA, 25 bp, Mus musculus
tactggagccaggttacgtctacga

SEQ ID NO: 128292 - DNA, 25 bp, Mus musculus
tactggagccggaggtacaagaaca

SEQ ID NO: 128293 - DNA, 25 bp, Mus musculus
tactggaggtagaacatcccgcagc

SEQ ID NO: 128294 - DNA, 25 bp, Mus musculus
tactggagtacacgccatcctcaag

SEQ ID NO: 128295 - DNA, 25 bp, Mus musculus
tactggagtgattgtgcccgaggac

SEQ ID NO: 128296 - DNA, 25 bp, Mus musculus
tactggataaggtgaagctggactc

SEQ ID NO: 128297 - DNA, 25 bp, Mus musculus
tactggatgccgtttgtttggtacc

SEQ ID NO: 128298 - DNA, 25 bp, Mus musculus
tactggatggaattccgtgtctcgc

SEQ ID NO: 128299 - DNA, 25 bp, Mus musculus
tactggatgtctgagaacttcccgc

SEQ ID NO: 128300 - DNA, 25 bp, Mus musculus
tactggattctcagggagccctctg

SEQ ID NO: 128301 - DNA, 25 bp, Mus musculus
tactggattgcacaccaagctgtga

SEQ ID NO: 128302 - DNA, 25 bp, Mus musculus
tactggcaccaacgagagaattggc

SEQ ID NO: 128303 - DNA, 25 bp, Mus musculus
tactggcaccggcagccatgacgag

SEQ ID NO: 128304 - DNA, 25 bp, Mus musculus
tactggcagatgtcccatgaccgaa

SEQ ID NO: 128305 - DNA, 25 bp, Mus musculus
tactggcagtagagttctcatttac

SEQ ID NO: 128306 - DNA, 25 bp, Mus musculus
tactggcatgcaaagatgggtctcc

SEQ ID NO: 128307 - DNA, 25 bp, Mus musculus
tactggccaacattcaactgaaaag

SEQ ID NO: 128308 - DNA, 25 bp, Mus musculus
tactggccaagcatggaggaaggca

SEQ ID NO: 128309 - DNA, 25 bp, Mus musculus
tactggccactccaaaggctacggg

SEQ ID NO: 128310 - DNA, 25 bp, Mus musculus
tactggccagcatcctactaaagat

SEQ ID NO: 128311 - DNA, 25 bp, Mus musculus
tactggccagttaccctgaagagga

SEQ ID NO: 128312 - DNA, 25 bp, Mus musculus
tactggcccatttctctgaaggagc

SEQ ID NO: 128313 - DNA, 25 bp, Mus musculus
tactggccgtagcagagaatagctt

SEQ ID NO: 128314 - DNA, 25 bp, Mus musculus
tactggcctggtctggctgaacact

SEQ ID NO: 128315 - DNA, 25 bp, Mus musculus
tactggcctggtgaaatacatgcac

SEQ ID NO: 128316 - DNA, 25 bp, Mus musculus
tactggcgcaggtggaatcgattct

SEQ ID NO: 128317 - DNA, 25 bp, Mus musculus
tactggcgcagtctgtgaaccacgg

SEQ ID NO: 128318 - DNA, 25 bp, Mus musculus
tactggcgggacatcaagcagactg

SEQ ID NO: 128319 - DNA, 25 bp, Mus musculus
tactggcgggattactttgaggacc

SEQ ID NO: 128320 - DNA, 25 bp, Mus musculus
tactggctagctacgtggacatccg

SEQ ID NO: 128321 - DNA, 25 bp, Mus musculus
tactggctcgaatactacggaatga

SEQ ID NO: 128322 - DNA, 25 bp, Mus musculus
tactggctctcatcactgtggcgct

SEQ ID NO: 128323 - DNA, 25 bp, Mus musculus
tactggctgacgaaccaaggcaact

SEQ ID NO: 128324 - DNA, 25 bp, Mus musculus
tactggctgctctgattggaatcgt

SEQ ID NO: 128325 - DNA, 25 bp, Mus musculus
tactggctgggtgtctcgtccttca

SEQ ID NO: 128326 - DNA, 25 bp, Mus musculus
tactgggaagaacccgatgacacgg

SEQ ID NO: 128327 - DNA, 25 bp, Mus musculus
tactgggaccctgatctctcgggca

SEQ ID NO: 128328 - DNA, 25 bp, Mus musculus
tactgggagaaattgctgcggcacc

SEQ ID NO: 128329 - DNA, 25 bp, Mus musculus
tactgggagaggaaactgcagactt

SEQ ID NO: 128330 - DNA, 25 bp, Mus musculus
tactgggagccacgtaaatggaacc

SEQ ID NO: 128331 - DNA, 25 bp, Mus musculus
tactgggattcttgctggtgccaac

SEQ ID NO: 128332 - DNA, 25 bp, Mus musculus
tactgggcattctggaccgtaaccc

SEQ ID NO: 128333 - DNA, 25 bp, Mus musculus
tactgggccatgttaggagaatcac

SEQ ID NO: 128334 - DNA, 25 bp, Mus musculus
tactgggcgttaccaaggagatgca

SEQ ID NO: 128335 - DNA, 25 bp, Mus musculus
tactgggtaccgtatgactcttggc

SEQ ID NO: 128336 - DNA, 25 bp, Mus musculus
tactgggtagcctctgaaaacttgt

SEQ ID NO: 128337 - DNA, 25 bp, Mus musculus
tactgggtccagaagagcctcttcc

SEQ ID NO: 128338 - DNA, 25 bp, Mus musculus
tactgggtgatggaaggcctgcttc

SEQ ID NO: 128339 - DNA, 25 bp, Mus musculus
tactgggtggaaataggctagctct

SEQ ID NO: 128340 - DNA, 25 bp, Mus musculus
tactgggtggtcagcaacatggtcc

SEQ ID NO: 128341 - DNA, 25 bp, Mus musculus
tactgggtggtcctgcaaaatcccc

SEQ ID NO: 128342 - DNA, 25 bp, Mus musculus
tactgggtgtggcacgtcctcttca

SEQ ID NO: 128343 - DNA, 25 bp, Mus musculus
tactgggttgaatctagggcatcaa

SEQ ID NO: 128344 - DNA, 25 bp, Mus musculus
tactggtacacttcatggccggatc

SEQ ID NO: 128345 - DNA, 25 bp, Mus musculus
tactggtacggaagcgtcctgacac

SEQ ID NO: 128346 - DNA, 25 bp, Mus musculus
tactggtataaacagagcgctgaga

SEQ ID NO: 128347 - DNA, 25 bp, Mus musculus
tactggtataccatcattggctggg

SEQ ID NO: 128348 - DNA, 25 bp, Mus musculus
tactggtcagccttttgatgcttcc

SEQ ID NO: 128349 - DNA, 25 bp, Mus musculus
tactggtcattcgtgcacaagggct

SEQ ID NO: 128350 - DNA, 25 bp, Mus musculus
tactggtctaggtagatggtcacac

SEQ ID NO: 128351 - DNA, 25 bp, Mus musculus
tactggtgaggtttgtccaatggcg

SEQ ID NO: 128352 - DNA, 25 bp, Mus musculus
tactggtgcatatcccggcagagag

SEQ ID NO: 128353 - DNA, 25 bp, Mus musculus
tactggtgctaaagaagaactccaa

SEQ ID NO: 128354 - DNA, 25 bp, Mus musculus
tactggtggaaggactggttcttca

SEQ ID NO: 128355 - DNA, 25 bp, Mus musculus
tactggtggactcagttccctccca

SEQ ID NO: 128356 - DNA, 25 bp, Mus musculus
tactggtggccatcctgttgtgaag

SEQ ID NO: 128357 - DNA, 25 bp, Mus musculus
tactggtgtaacagacaaaggtccc

SEQ ID NO: 128358 - DNA, 25 bp, Mus musculus
tactggttccccatcttcacggagg

SEQ ID NO: 128359 - DNA, 25 bp, Mus musculus
tactggttccgcctctctggaaggc

SEQ ID NO: 128360 - DNA, 25 bp, Mus musculus
tactggttgcagtccacagaagcca

SEQ ID NO: 128361 - DNA, 25 bp, Mus musculus
tactgtaagagttggtggcaaaccc

SEQ ID NO: 128362 - DNA, 25 bp, Mus musculus
tactgtaagccaagtcatcctgagg

SEQ ID NO: 128363 - DNA, 25 bp, Mus musculus
tactgtaagtatgtaagtcaagcac

SEQ ID NO: 128364 - DNA, 25 bp, Mus musculus
tactgtacctgcagccattgcttgg

SEQ ID NO: 128365 - DNA, 25 bp, Mus musculus
tactgtacgcacacttcgaagagtc

SEQ ID NO: 128366 - DNA, 25 bp, Mus musculus
tactgtacgcctgcgctttggcgag

SEQ ID NO: 128367 - DNA, 25 bp, Mus musculus
tactgtactgccgaaagggagcatc

SEQ ID NO: 128368 - DNA, 25 bp, Mus musculus
tactgtacttcctgccacaatgtca

SEQ ID NO: 128369 - DNA, 25 bp, Mus musculus
tactgtagctcaaaccgattgggcc

SEQ ID NO: 128370 - DNA, 25 bp, Mus musculus
tactgtaggaagaccatccggcaca

SEQ ID NO: 128371 - DNA, 25 bp, Mus musculus
tactgtatacctgggcatgaagccc

SEQ ID NO: 128372 - DNA, 25 bp, Mus musculus
tactgtatccggatgttcctgcccg

SEQ ID NO: 128373 - DNA, 25 bp, Mus musculus
tactgtatctcaggttgagggtccc

SEQ ID NO: 128374 - DNA, 25 bp, Mus musculus
tactgtcacaatgagttcaggcctg

SEQ ID NO: 128375 - DNA, 25 bp, Mus musculus
tactgtcacgggtgcacggaagttc

SEQ ID NO: 128376 - DNA, 25 bp, Mus musculus
tactgtcacttcttctaatttcagg

SEQ ID NO: 128377 - DNA, 25 bp, Mus musculus
tactgtcagatagcatgtggtgcct

SEQ ID NO: 128378 - DNA, 25 bp, Mus musculus
tactgtcataggaccagctgagccc

SEQ ID NO: 128379 - DNA, 25 bp, Mus musculus
tactgtccagaagtgaacgtgatgg

SEQ ID NO: 128380 - DNA, 25 bp, Mus musculus
tactgtcccagtacaaacagaggtg

SEQ ID NO: 128381 - DNA, 25 bp, Mus musculus
tactgtccctgagctatgacggcac

SEQ ID NO: 128382 - DNA, 25 bp, Mus musculus
tactgtccgacaacggatgccaggg

SEQ ID NO: 128383 - DNA, 25 bp, Mus musculus
tactgtcctggagcctacgaagctg

SEQ ID NO: 128384 - DNA, 25 bp, Mus musculus
tactgtcggctcaagaagtgcttcc

SEQ ID NO: 128385 - DNA, 25 bp, Mus musculus
tactgtctgagcatagagaacccgg

SEQ ID NO: 128386 - DNA, 25 bp, Mus musculus
tactgtctgagctacattgcaaaca

SEQ ID NO: 128387 - DNA, 25 bp, Mus musculus
tactgtctgagtgcttaagcaggca

SEQ ID NO: 128388 - DNA, 25 bp, Mus musculus
tactgtctgatgagcgtgaagggct

SEQ ID NO: 128389 - DNA, 25 bp, Mus musculus
tactgtgaaacagccagcacttggc

SEQ ID NO: 128390 - DNA, 25 bp, Mus musculus
tactgtgaaactatgaggccctacc

SEQ ID NO: 128391 - DNA, 25 bp, Mus musculus
tactgtgaacaagaccatcgcctat

SEQ ID NO: 128392 - DNA, 25 bp, Mus musculus
tactgtgaactgtccaaaagtccct

SEQ ID NO: 128393 - DNA, 25 bp, Mus musculus
tactgtgaagtcagcatgggctccc

SEQ ID NO: 128394 - DNA, 25 bp, Mus musculus
tactgtgaccatgaaaatgcagcct

SEQ ID NO: 128395 - DNA, 25 bp, Mus musculus
tactgtgacctcttctgcaaccgca

SEQ ID NO: 128396 - DNA, 25 bp, Mus musculus
tactgtgactctcttgaccccgtga

SEQ ID NO: 128397 - DNA, 25 bp, Mus musculus
tactgtgactgtgggattaagctgc

SEQ ID NO: 128398 - DNA, 25 bp, Mus musculus
tactgtgagattgcccggtgcagca

SEQ ID NO: 128399 - DNA, 25 bp, Mus musculus
tactgtgagtggcactgtgtctcca

SEQ ID NO: 128400 - DNA, 25 bp, Mus musculus
tactgtgcaactggatgactacctg

SEQ ID NO: 128401 - DNA, 25 bp, Mus musculus
tactgtgcacggactgtcgcatcca

SEQ ID NO: 128402 - DNA, 25 bp, Mus musculus
tactgtgcaggcttggataactaac

SEQ ID NO: 128403 - DNA, 25 bp, Mus musculus
tactgtgcccaaagtcagaacatgg

SEQ ID NO: 128404 - DNA, 25 bp, Mus musculus
tactgtgcctggttggagaatccca

SEQ ID NO: 128405 - DNA, 25 bp, Mus musculus
tactgtgcggagctttgccaacgag

SEQ ID NO: 128406 - DNA, 25 bp, Mus musculus
tactgtgcggctaacgatggccacg

SEQ ID NO: 128407 - DNA, 25 bp, Mus musculus
tactgtgctcacaaagcctcggatc

SEQ ID NO: 128408 - DNA, 25 bp, Mus musculus
tactgtgctcacgaggaaaactgcc

SEQ ID NO: 128409 - DNA, 25 bp, Mus musculus
tactgtgctcattggcagacttacg

SEQ ID NO: 128410 - DNA, 25 bp, Mus musculus
tactgtgcttggagaggagctcacc

SEQ ID NO: 128411 - DNA, 25 bp, Mus musculus
tactgtggaactggctgatccggac

SEQ ID NO: 128412 - DNA, 25 bp, Mus musculus
tactgtggaccctgagaaatctgtg

SEQ ID NO: 128413 - DNA, 25 bp, Mus musculus
tactgtggaggaataagaggccctg

SEQ ID NO: 128414 - DNA, 25 bp, Mus musculus
tactgtggagttacaacccgcatgc

SEQ ID NO: 128415 - DNA, 25 bp, Mus musculus
tactgtggattatgatcggcttggc

SEQ ID NO: 128416 - DNA, 25 bp, Mus musculus
tactgtggcaagctgtactcgcgca

SEQ ID NO: 128417 - DNA, 25 bp, Mus musculus
tactgtgggaacaagagctatacaa

SEQ ID NO: 128418 - DNA, 25 bp, Mus musculus
tactgtgggacgaaaacaccctcca

SEQ ID NO: 128419 - DNA, 25 bp, Mus musculus
tactgtgggactaggatgctgacat

SEQ ID NO: 128420 - DNA, 25 bp, Mus musculus
tactgtgggcaatttagaaaacgga

SEQ ID NO: 128421 - DNA, 25 bp, Mus musculus
tactgtgggccatgaaggcaggcca

SEQ ID NO: 128422 - DNA, 25 bp, Mus musculus
tactgtgtcaagtggatcccctgga

SEQ ID NO: 128423 - DNA, 25 bp, Mus musculus
tactgtgtcatagtggaccctgact

SEQ ID NO: 128424 - DNA, 25 bp, Mus musculus
tactgtgtgacaggcaagagtctcg

SEQ ID NO: 128425 - DNA, 25 bp, Mus musculus
tactgtgtgacttgccatgagacca

SEQ ID NO: 128426 - DNA, 25 bp, Mus musculus
tactgtgtgactttccggtggttgg

SEQ ID NO: 128427 - DNA, 25 bp, Mus musculus
tactgtgttgtttgagcgcctgact

SEQ ID NO: 128428 - DNA, 25 bp, Mus musculus
tactgttaccgtatcaaccgccggc

SEQ ID NO: 128429 - DNA, 25 bp, Mus musculus
tactgttcatgagcaggtgactccc

SEQ ID NO: 128430 - DNA, 25 bp, Mus musculus
tactgttcccagagggaagcgacgc

SEQ ID NO: 128431 - DNA, 25 bp, Mus musculus
tactgttgccgagatcctgggtgca

SEQ ID NO: 128432 - DNA, 25 bp, Mus musculus
tactgttgcctccatgatgcacagg

SEQ ID NO: 128433 - DNA, 25 bp, Mus musculus
tactgttggagctgacagaatggcc

SEQ ID NO: 128434 - DNA, 25 bp, Mus musculus
tactgttggccagaacgtcgtcgtg

SEQ ID NO: 128435 - DNA, 25 bp, Mus musculus
tactgttttgcacagggtcctggct

SEQ ID NO: 128436 - DNA, 25 bp, Mus musculus
tactgttttggtgtgggagttgtca

SEQ ID NO: 128437 - DNA, 25 bp, Mus musculus
tacttaaaaaagctgtcaggccccg

SEQ ID NO: 128438 - DNA, 25 bp, Mus musculus
tacttaaaagtagacgcccagttcg

SEQ ID NO: 128439 - DNA, 25 bp, Mus musculus
tacttaaaatgaccccagatggacc

SEQ ID NO: 128440 - DNA, 25 bp, Mus musculus
tacttaaatggtgcgacaactcgaa

SEQ ID NO: 128441 - DNA, 25 bp, Mus musculus
tacttaagagcagctcgggcagggc

SEQ ID NO: 128442 - DNA, 25 bp, Mus musculus
tacttaatgtgccacagtgcaccga

SEQ ID NO: 128443 - DNA, 25 bp, Mus musculus
tacttacacgaaaaacagagccgag

SEQ ID NO: 128444 - DNA, 25 bp, Mus musculus
tacttacatccagtcagggcccatg

SEQ ID NO: 128445 - DNA, 25 bp, Mus musculus
tacttaccccagacaggaaaggcaa

SEQ ID NO: 128446 - DNA, 25 bp, Mus musculus
tacttaccccatagctgtgtgtaga

SEQ ID NO: 128447 - DNA, 25 bp, Mus musculus
tacttacgtcacctccaggattatc

SEQ ID NO: 128448 - DNA, 25 bp, Mus musculus
tacttactgaggaacaccagggtcg

SEQ ID NO: 128449 - DNA, 25 bp, Mus musculus
tacttacttgggaaaatactgggct

SEQ ID NO: 128450 - DNA, 25 bp, Mus musculus
tacttactttgaatacagccatgct

SEQ ID NO: 128451 - DNA, 25 bp, Mus musculus
tacttagaaacaaacctggaggcat

SEQ ID NO: 128452 - DNA, 25 bp, Mus musculus
tacttagacaagcatgtggaggccc

SEQ ID NO: 128453 - DNA, 25 bp, Mus musculus
tacttagacaccacagaagacgcgg

SEQ ID NO: 128454 - DNA, 25 bp, Mus musculus
tacttagacacctgtgtacgatggg

SEQ ID NO: 128455 - DNA, 25 bp, Mus musculus
tacttaggaacaccaaaggccgagt

SEQ ID NO: 128456 - DNA, 25 bp, Mus musculus
tacttaggacagaatcagacacagc

SEQ ID NO: 128457 - DNA, 25 bp, Mus musculus
tacttagtatggacccaaatcaaga

SEQ ID NO: 128458 - DNA, 25 bp, Mus musculus
tacttataacttcagagaggagctc

SEQ ID NO: 128459 - DNA, 25 bp, Mus musculus
tacttataagaaacgcgaggccgca

SEQ ID NO: 128460 - DNA, 25 bp, Mus musculus
tacttcaaagaggagggtcccactc

SEQ ID NO: 128461 - DNA, 25 bp, Mus musculus
tacttcaaagcccacagagcagtgc

SEQ ID NO: 128462 - DNA, 25 bp, Mus musculus
tacttcaactgggatcactgtggca

SEQ ID NO: 128463 - DNA, 25 bp, Mus musculus
tacttcaagaccaagacatggtggc

SEQ ID NO: 128464 - DNA, 25 bp, Mus musculus
tacttcaagcccctggaaaggatgg

SEQ ID NO: 128465 - DNA, 25 bp, Mus musculus
tacttcaaggaccatggcttctagc

SEQ ID NO: 128466 - DNA, 25 bp, Mus musculus
tacttcacaaaaagaggatgggctt

SEQ ID NO: 128467 - DNA, 25 bp, Mus musculus
tacttcacaatgacccaaactgagc

SEQ ID NO: 128468 - DNA, 25 bp, Mus musculus
tacttcacggagcaggaattggcca

SEQ ID NO: 128469 - DNA, 25 bp, Mus musculus
tacttcagccattccgagacatgcg

SEQ ID NO: 128470 - DNA, 25 bp, Mus musculus
tacttcagcgttgggagccaggtgt

SEQ ID NO: 128471 - DNA, 25 bp, Mus musculus
tacttcagtaccaaggagggcggtg

SEQ ID NO: 128472 - DNA, 25 bp, Mus musculus
tacttcatcacgtacggaagcgcca

SEQ ID NO: 128473 - DNA, 25 bp, Mus musculus
tacttcatgcaacagaaccaaaggg

SEQ ID NO: 128474 - DNA, 25 bp, Mus musculus
tacttcattgatcgagacggaccgc

SEQ ID NO: 128475 - DNA, 25 bp, Mus musculus
tacttcatttaagaggacgcctgtc

SEQ ID NO: 128476 - DNA, 25 bp, Mus musculus
tacttcatttacaccacaggaaccg

SEQ ID NO: 128477 - DNA, 25 bp, Mus musculus
tacttcattttatcagcagccagcc

SEQ ID NO: 128478 - DNA, 25 bp, Mus musculus
tacttccagagagaatggcgatttc

SEQ ID NO: 128479 - DNA, 25 bp, Mus musculus
tacttcccactttagactatagcag

SEQ ID NO: 128480 - DNA, 25 bp, Mus musculus
tacttcccagtgacaatgtggcacc

SEQ ID NO: 128481 - DNA, 25 bp, Mus musculus
tacttcccctacagcaagcaaagca

SEQ ID NO: 128482 - DNA, 25 bp, Mus musculus
tacttccctggctgagtacaaccag

SEQ ID NO: 128483 - DNA, 25 bp, Mus musculus
tacttccgagcatccagcactatga

SEQ ID NO: 128484 - DNA, 25 bp, Mus musculus
tacttccgcccggcctagtgtggtg

SEQ ID NO: 128485 - DNA, 25 bp, Mus musculus
tacttccgggaccacaacattgagc

SEQ ID NO: 128486 - DNA, 25 bp, Mus musculus
tacttccgtggccacaatgagagca

SEQ ID NO: 128487 - DNA, 25 bp, Mus musculus
tacttcctccagataaatacggcca

SEQ ID NO: 128488 - DNA, 25 bp, Mus musculus
tacttcctgccacaatgtcacagat

SEQ ID NO: 128489 - DNA, 25 bp, Mus musculus
tacttcctgtccgatgacgactggg

SEQ ID NO: 128490 - DNA, 25 bp, Mus musculus
tacttccttctgaagagtgatggat

SEQ ID NO: 128491 - DNA, 25 bp, Mus musculus
tacttccttgaacataatgaagcca

SEQ ID NO: 128492 - DNA, 25 bp, Mus musculus
tacttcgaaggcaggatctgagcgg

SEQ ID NO: 128493 - DNA, 25 bp, Mus musculus
tacttcgacgaatccctggtgctgc

SEQ ID NO: 128494 - DNA, 25 bp, Mus musculus
tacttcgagaaaatggacgctgaca

SEQ ID NO: 128495 - DNA, 25 bp, Mus musculus
tacttcgagaccatggccaaaggag

SEQ ID NO: 128496 - DNA, 25 bp, Mus musculus
tacttcgagtgattgaaagtggtcc

SEQ ID NO: 128497 - DNA, 25 bp, Mus musculus
tacttcgagttccatggcgtgcggc

SEQ ID NO: 128498 - DNA, 25 bp, Mus musculus
tacttcgatacatgagcaatgaaaa

SEQ ID NO: 128499 - DNA, 25 bp, Mus musculus
tacttcgatgaaccaaagttggctc

SEQ ID NO: 128500 - DNA, 25 bp, Mus musculus
tacttcgcgccgagtaacgaggctt

SEQ ID NO: 128501 - DNA, 25 bp, Mus musculus
tacttcgcggatgatgacaacacgt

SEQ ID NO: 128502 - DNA, 25 bp, Mus musculus
tacttcggcaagagagaacctaact

SEQ ID NO: 128503 - DNA, 25 bp, Mus musculus
tacttcgggcccatcctgaatttcc

SEQ ID NO: 128504 - DNA, 25 bp, Mus musculus
tacttcggtgctggaacatctatgg

SEQ ID NO: 128505 - DNA, 25 bp, Mus musculus
tacttcggttgcatgaaggcggcgc

SEQ ID NO: 128506 - DNA, 25 bp, Mus musculus
tacttcgtactctccagctggtggg

SEQ ID NO: 128507 - DNA, 25 bp, Mus musculus
tacttcgtattgcaaggcagtctct

SEQ ID NO: 128508 - DNA, 25 bp, Mus musculus
tacttcgtgaacatggccgtggcgg

SEQ ID NO: 128509 - DNA, 25 bp, Mus musculus
tacttcgtgagcgaggactccatct

SEQ ID NO: 128510 - DNA, 25 bp, Mus musculus
tacttcgtgcttggcgtctgcttcg

SEQ ID NO: 128511 - DNA, 25 bp, Mus musculus
tacttcgtggctctggtgatcctgg

SEQ ID NO: 128512 - DNA, 25 bp, Mus musculus
tacttctacagacggcagacacagc

SEQ ID NO: 128513 - DNA, 25 bp, Mus musculus
tacttctatcaccaaggacacccgg

SEQ ID NO: 128514 - DNA, 25 bp, Mus musculus
tacttctcaaaaagaccctgttgtg

SEQ ID NO: 128515 - DNA, 25 bp, Mus musculus
tacttctcagacatgcgctttgcca

SEQ ID NO: 128516 - DNA, 25 bp, Mus musculus
tacttctctgcttccgcaggctcgg

SEQ ID NO: 128517 - DNA, 25 bp, Mus musculus
tacttctctgttgtcataatccgca

SEQ ID NO: 128518 - DNA, 25 bp, Mus musculus
tacttctgacggctgaggagcacac

SEQ ID NO: 128519 - DNA, 25 bp, Mus musculus
tacttctgaggaacacgtggtctag

SEQ ID NO: 128520 - DNA, 25 bp, Mus musculus
tacttctgccgctactgcagtgagc

SEQ ID NO: 128521 - DNA, 25 bp, Mus musculus
tacttctgggagtatagtgagcagc

SEQ ID NO: 128522 - DNA, 25 bp, Mus musculus
tacttctggtacaggaaaacactca

SEQ ID NO: 128523 - DNA, 25 bp, Mus musculus
tacttcttggacagcagcggcgctt

SEQ ID NO: 128524 - DNA, 25 bp, Mus musculus
tacttgaaacctgggcgacagagca

SEQ ID NO: 128525 - DNA, 25 bp, Mus musculus
tacttgaaacgggagcactcgctgt

SEQ ID NO: 128526 - DNA, 25 bp, Mus musculus
tacttgaagcttgccaacagtgcag

SEQ ID NO: 128527 - DNA, 25 bp, Mus musculus
tacttgaatgaagacgtgaacggct

SEQ ID NO: 128528 - DNA, 25 bp, Mus musculus
tacttgaatgttttagctgagcctg

SEQ ID NO: 128529 - DNA, 25 bp, Mus musculus
tacttgaccgtggatctcgtggaga

SEQ ID NO: 128530 - DNA, 25 bp, Mus musculus
tacttgacctagttgaccagtgccc

SEQ ID NO: 128531 - DNA, 25 bp, Mus musculus
tacttgactaacagacttcggccca

SEQ ID NO: 128532 - DNA, 25 bp, Mus musculus
tacttgactgttggagccggagctc

SEQ ID NO: 128533 - DNA, 25 bp, Mus musculus
tacttgaggactgccaaatccctgg

SEQ ID NO: 128534 - DNA, 25 bp, Mus musculus
tacttgatccttcgagagctgcaca

SEQ ID NO: 128535 - DNA, 25 bp, Mus musculus
tacttgatgctatgaaacactcagg

SEQ ID NO: 128536 - DNA, 25 bp, Mus musculus
tacttgatgtgtgcgggctgggcgc

SEQ ID NO: 128537 - DNA, 25 bp, Mus musculus
tacttgattggcaatgctgatcgcc

SEQ ID NO: 128538 - DNA, 25 bp, Mus musculus
tacttgcagaagaaggtccgagacc

SEQ ID NO: 128539 - DNA, 25 bp, Mus musculus
tacttgcagatcaaggcccggaatg

SEQ ID NO: 128540 - DNA, 25 bp, Mus musculus
tacttgcagatgcaccccgatggag

SEQ ID NO: 128541 - DNA, 25 bp, Mus musculus
tacttgccaagaccagcagacagtg

SEQ ID NO: 128542 - DNA, 25 bp, Mus musculus
tacttgccagaggtgacggacctac

SEQ ID NO: 128543 - DNA, 25 bp, Mus musculus
tacttgccctccatgctgggaccag

SEQ ID NO: 128544 - DNA, 25 bp, Mus musculus
tacttgcctgctcagttggccagag

SEQ ID NO: 128545 - DNA, 25 bp, Mus musculus
tacttgcgagattaccaaagggagg

SEQ ID NO: 128546 - DNA, 25 bp, Mus musculus
tacttgctaagtgtgtggctctacc

SEQ ID NO: 128547 - DNA, 25 bp, Mus musculus
tacttgctccaagtcatctgatggc

SEQ ID NO: 128548 - DNA, 25 bp, Mus musculus
tacttgctgagctacttctcggcca

SEQ ID NO: 128549 - DNA, 25 bp, Mus musculus
tacttggaacagctacctgcacagc

SEQ ID NO: 128550 - DNA, 25 bp, Mus musculus
tacttggaaggagggacttaccaca

SEQ ID NO: 128551 - DNA, 25 bp, Mus musculus
tacttggaaggcacttccccggagc

SEQ ID NO: 128552 - DNA, 25 bp, Mus musculus
tacttggaagtgcatcagcaggagc

SEQ ID NO: 128553 - DNA, 25 bp, Mus musculus
tacttggaataggaatacggccacc

SEQ ID NO: 128554 - DNA, 25 bp, Mus musculus
tacttggaatctcctgccttcacag

SEQ ID NO: 128555 - DNA, 25 bp, Mus musculus
tacttggaccccatggccgtggttg

SEQ ID NO: 128556 - DNA, 25 bp, Mus musculus
tacttggagcaaccttaaatggctg

SEQ ID NO: 128557 - DNA, 25 bp, Mus musculus
tacttggataaggagctggccggca

SEQ ID NO: 128558 - DNA, 25 bp, Mus musculus
tacttggcaaattgaggcaggaagc

SEQ ID NO: 128559 - DNA, 25 bp, Mus musculus
tacttggccaccttgttgactggac

SEQ ID NO: 128560 - DNA, 25 bp, Mus musculus
tacttggccatggacaccgaagggc

SEQ ID NO: 128561 - DNA, 25 bp, Mus musculus
tacttggccctgactacagcgatga

SEQ ID NO: 128562 - DNA, 25 bp, Mus musculus
tacttggccctggaggactacttga

SEQ ID NO: 128563 - DNA, 25 bp, Mus musculus
tacttggccttggtttcagcgactg

SEQ ID NO: 128564 - DNA, 25 bp, Mus musculus
tacttggctatcctcgttggcgcag

SEQ ID NO: 128565 - DNA, 25 bp, Mus musculus
tacttggcttttgaggttgacgcac

SEQ ID NO: 128566 - DNA, 25 bp, Mus musculus
tacttgggaggcttaaccatggccc

SEQ ID NO: 128567 - DNA, 25 bp, Mus musculus
tacttgggaggtcgtcaccctgaaa

SEQ ID NO: 128568 - DNA, 25 bp, Mus musculus
tacttgggcaactcgctgatggcgc

SEQ ID NO: 128569 - DNA, 25 bp, Mus musculus
tacttgggtcaagttgcaatcctcc

SEQ ID NO: 128570 - DNA, 25 bp, Mus musculus
tacttggtaagggactgcatgacac

SEQ ID NO: 128571 - DNA, 25 bp, Mus musculus
tacttggtctgatgattccctgagg

SEQ ID NO: 128572 - DNA, 25 bp, Mus musculus
tacttggtgctggaggctacagagc

SEQ ID NO: 128573 - DNA, 25 bp, Mus musculus
tacttggtgtacagcgctctgtggg

SEQ ID NO: 128574 - DNA, 25 bp, Mus musculus
tacttggttcgtggtataagcgcgc

SEQ ID NO: 128575 - DNA, 25 bp, Mus musculus
tacttggtttgaggcctagaggctc

SEQ ID NO: 128576 - DNA, 25 bp, Mus musculus
tacttgtaccagagaaacacccagg

SEQ ID NO: 128577 - DNA, 25 bp, Mus musculus
tacttgtaccgtggatctggagcct

SEQ ID NO: 128578 - DNA, 25 bp, Mus musculus
tacttgtagctttctgaggtgcaca

SEQ ID NO: 128579 - DNA, 25 bp, Mus musculus
tacttgtatgctccaaaagatgact

SEQ ID NO: 128580 - DNA, 25 bp, Mus musculus
tacttgtcaattcctgtcccctggg

SEQ ID NO: 128581 - DNA, 25 bp, Mus musculus
tacttgtgaggagctctgtggccgc

SEQ ID NO: 128582 - DNA, 25 bp, Mus musculus
tacttgttcggaaagttgctgggca

SEQ ID NO: 128583 - DNA, 25 bp, Mus musculus
tacttgttgctgtgggactatcccc

SEQ ID NO: 128584 - DNA, 25 bp, Mus musculus
tactttaaagcatggaacacacagg

SEQ ID NO: 128585 - DNA, 25 bp, Mus musculus
tactttaactatgaccgtggacagg

SEQ ID NO: 128586 - DNA, 25 bp, Mus musculus
tactttaagctgtggaggagaatcc

SEQ ID NO: 128587 - DNA, 25 bp, Mus musculus
tactttaccaggacaaggaatggga

SEQ ID NO: 128588 - DNA, 25 bp, Mus musculus
tactttagcctggatgctgatgccg

SEQ ID NO: 128589 - DNA, 25 bp, Mus musculus
tactttaggagagacacaccgcttg

SEQ ID NO: 128590 - DNA, 25 bp, Mus musculus
tactttagtgcatgcttggagccgc

SEQ ID NO: 128591 - DNA, 25 bp, Mus musculus
tactttatagccgtggaagatgaca

SEQ ID NO: 128592 - DNA, 25 bp, Mus musculus
tactttcaagcctatggtggcgccc

SEQ ID NO: 128593 - DNA, 25 bp, Mus musculus
tactttcccattctgaacttgtgtg

SEQ ID NO: 128594 - DNA, 25 bp, Mus musculus
tactttcgatcgtgactgggtggcc

SEQ ID NO: 128595 - DNA, 25 bp, Mus musculus
tactttcggactagacacggagctg

SEQ ID NO: 128596 - DNA, 25 bp, Mus musculus
tactttctaggaagctcaacagccc

SEQ ID NO: 128597 - DNA, 25 bp, Mus musculus
tactttctgcacctagaccgtgagg

SEQ ID NO: 128598 - DNA, 25 bp, Mus musculus
tactttctggccagggtcgcatgtg

SEQ ID NO: 128599 - DNA, 25 bp, Mus musculus
tactttgacaagtgggagctgccca

SEQ ID NO: 128600 - DNA, 25 bp, Mus musculus
tactttgactactataggctgcaca

SEQ ID NO: 128601 - DNA, 25 bp, Mus musculus
tactttgagaagacacacgagcagc

SEQ ID NO: 128602 - DNA, 25 bp, Mus musculus
tactttgagactgaacagatggctc

SEQ ID NO: 128603 - DNA, 25 bp, Mus musculus
tactttgctcatcgacgcacatggg

SEQ ID NO: 128604 - DNA, 25 bp, Mus musculus
tactttgctggagtgtccgtcctgg

SEQ ID NO: 128605 - DNA, 25 bp, Mus musculus
tactttggatccgtggtgccgctca

SEQ ID NO: 128606 - DNA, 25 bp, Mus musculus
tactttggccgtgatccagctgatg

SEQ ID NO: 128607 - DNA, 25 bp, Mus musculus
tactttggcctcaccacaattgcag

SEQ ID NO: 128608 - DNA, 25 bp, Mus musculus
tactttggctggatggcgaccttag

SEQ ID NO: 128609 - DNA, 25 bp, Mus musculus
tactttggttgctacagtggatgcc

SEQ ID NO: 128610 - DNA, 25 bp, Mus musculus
tactttggtttagccctgtgggaca

SEQ ID NO: 128611 - DNA, 25 bp, Mus musculus
tactttgtacgtggcgagggcctcc

SEQ ID NO: 128612 - DNA, 25 bp, Mus musculus
tactttgttcgtcgctctcggatgc

SEQ ID NO: 128613 - DNA, 25 bp, Mus musculus
tactttgttctgcattagcatggca

SEQ ID NO: 128614 - DNA, 25 bp, Mus musculus
tactttgtttacttcagctggcttg

SEQ ID NO: 128615 - DNA, 25 bp, Mus musculus
tacttttacatatatctgccgtgga

SEQ ID NO: 128616 - DNA, 25 bp, Mus musculus
tacttttcgttcagccactggcgcc

SEQ ID NO: 128617 - DNA, 25 bp, Mus musculus
tacttttctcgacaatgggccgaca

SEQ ID NO: 128618 - DNA, 25 bp, Mus musculus
tacttttggcacaacatttggaagg

SEQ ID NO: 128619 - DNA, 25 bp, Mus musculus
tacttttggcttctggtgccggacc

SEQ ID NO: 128620 - DNA, 25 bp, Mus musculus
tacttttgtccatcctggtccaggg

SEQ ID NO: 128621 - DNA, 25 bp, Mus musculus
tactttttcctcagggactgcacag

SEQ ID NO: 128622 - DNA, 25 bp, Mus musculus
tagaaaaatgctatgtgcttattca

SEQ ID NO: 128623 - DNA, 25 bp, Mus musculus
tagaaaacagcgtggccatatgacc

SEQ ID NO: 128624 - DNA, 25 bp, Mus musculus
tagaaaacagtggaacgccgcatga

SEQ ID NO: 128625 - DNA, 25 bp, Mus musculus
tagaaaagacatcaccggatagaga

SEQ ID NO: 128626 - DNA, 25 bp, Mus musculus
tagaaaagattgaccgccaaggagc

SEQ ID NO: 128627 - DNA, 25 bp, Mus musculus
tagaaaagcccgagtcctctggtgg

SEQ ID NO: 128628 - DNA, 25 bp, Mus musculus
tagaaaagctcctgattgacagtgt

SEQ ID NO: 128629 - DNA, 25 bp, Mus musculus
tagaaaaggaagtcccagcgctcgg

SEQ ID NO: 128630 - DNA, 25 bp, Mus musculus
tagaaaaggacatactgcgcgtgcg

SEQ ID NO: 128631 - DNA, 25 bp, Mus musculus
tagaaaagtgcctggcgtcactgct

SEQ ID NO: 128632 - DNA, 25 bp, Mus musculus
tagaaaatggccttagcagagccag

SEQ ID NO: 128633 - DNA, 25 bp, Mus musculus
tagaaaatgggtatcaggcagcact

SEQ ID NO: 128634 - DNA, 25 bp, Mus musculus
tagaaacacagtcatagcacccagt

SEQ ID NO: 128635 - DNA, 25 bp, Mus musculus
tagaaacacttcacaatgccctgtt

SEQ ID NO: 128636 - DNA, 25 bp, Mus musculus
tagaaacagacagactccgtgcagg

SEQ ID NO: 128637 - DNA, 25 bp, Mus musculus
tagaaacatcctaccagcagcggga

SEQ ID NO: 128638 - DNA, 25 bp, Mus musculus
tagaaaccagttcccatcagcctca

SEQ ID NO: 128639 - DNA, 25 bp, Mus musculus
tagaaaccctgagaaacagcagccc

SEQ ID NO: 128640 - DNA, 25 bp, Mus musculus
tagaaaccctgtggaacctaggaga

SEQ ID NO: 128641 - DNA, 25 bp, Mus musculus
tagaaacctaggaactccagggagc

SEQ ID NO: 128642 - DNA, 25 bp, Mus musculus
tagaaacctccgagacaaccaaagt

SEQ ID NO: 128643 - DNA, 25 bp, Mus musculus
tagaaactccctgaccaatagaagg

SEQ ID NO: 128644 - DNA, 25 bp, Mus musculus
tagaaactgcatgagccaccagtgc

SEQ ID NO: 128645 - DNA, 25 bp, Mus musculus
tagaaacttggaagcacaatgaccc

SEQ ID NO: 128646 - DNA, 25 bp, Mus musculus
tagaaagaattccagaaagggagaa

SEQ ID NO: 128647 - DNA, 25 bp, Mus musculus
tagaaagaggactcagacacagcgg

SEQ ID NO: 128648 - DNA, 25 bp, Mus musculus
tagaaagcaagtccaagcagcgtac

SEQ ID NO: 128649 - DNA, 25 bp, Mus musculus
tagaaagcatggacgtcctgcatcg

SEQ ID NO: 128650 - DNA, 25 bp, Mus musculus
tagaaagcattctagtaccggagac

SEQ ID NO: 128651 - DNA, 25 bp, Mus musculus
tagaaagccgcttaccagcatctgt

SEQ ID NO: 128652 - DNA, 25 bp, Mus musculus
tagaaagcggcgtcagaagtgagtc

SEQ ID NO: 128653 - DNA, 25 bp, Mus musculus
tagaaaggaatcacccagacctggc

SEQ ID NO: 128654 - DNA, 25 bp, Mus musculus
tagaaaggccattctgaattggaga

SEQ ID NO: 128655 - DNA, 25 bp, Mus musculus
tagaaagggcgtctcgtctctgcgt

SEQ ID NO: 128656 - DNA, 25 bp, Mus musculus
tagaaagtgccctcatagaacatcc

SEQ ID NO: 128657 - DNA, 25 bp, Mus musculus
tagaaatagtcacggcactctgctc

SEQ ID NO: 128658 - DNA, 25 bp, Mus musculus
tagaaatatccaagggacgctccgg

SEQ ID NO: 128659 - DNA, 25 bp, Mus musculus
tagaaatcagttcttgccgaatgca

SEQ ID NO: 128660 - DNA, 25 bp, Mus musculus
tagaaatcatgttggatgccagctg

SEQ ID NO: 128661 - DNA, 25 bp, Mus musculus
tagaaatcgggcaatctcaagcagt

SEQ ID NO: 128662 - DNA, 25 bp, Mus musculus
tagaaatcggtagccaagagcagcc

SEQ ID NO: 128663 - DNA, 25 bp, Mus musculus
tagaaatgaccagagtgaagggcgc

SEQ ID NO: 128664 - DNA, 25 bp, Mus musculus
tagaaatgctgaagtctctgcccat

SEQ ID NO: 128665 - DNA, 25 bp, Mus musculus
tagaaatgctttaagttcgctctgg

SEQ ID NO: 128666 - DNA, 25 bp, Mus musculus
tagaaatggctaagattcacaccat

SEQ ID NO: 128667 - DNA, 25 bp, Mus musculus
tagaaatgggtgacacgcaggcact

SEQ ID NO: 128668 - DNA, 25 bp, Mus musculus
tagaaattgaacctgagccagagcc

SEQ ID NO: 128669 - DNA, 25 bp, Mus musculus
tagaaatttgcgagaggtcacccag

SEQ ID NO: 128670 - DNA, 25 bp, Mus musculus
tagaacaaatgccacagcgacgaag

SEQ ID NO: 128671 - DNA, 25 bp, Mus musculus
tagaacaagtaatcacggcaacagc

SEQ ID NO: 128672 - DNA, 25 bp, Mus musculus
tagaacacgcctgaaagggctggag

SEQ ID NO: 128673 - DNA, 25 bp, Mus musculus
tagaacagcttctggatccaagtcg

SEQ ID NO: 128674 - DNA, 25 bp, Mus musculus
tagaacaggcaagatacaacagctg

SEQ ID NO: 128675 - DNA, 25 bp, Mus musculus
tagaacatatgtaccacgaccttgg

SEQ ID NO: 128676 - DNA, 25 bp, Mus musculus
tagaacatgctggagaggccattcc

SEQ ID NO: 128677 - DNA, 25 bp, Mus musculus
tagaacattgtttcccacaatccac

SEQ ID NO: 128678 - DNA, 25 bp, Mus musculus
tagaaccaagattcgagaactgcgg

SEQ ID NO: 128679 - DNA, 25 bp, Mus musculus
tagaaccacgtgagatggcagccat

SEQ ID NO: 128680 - DNA, 25 bp, Mus musculus
tagaaccactccagttcccgaagaa

SEQ ID NO: 128681 - DNA, 25 bp, Mus musculus
tagaaccaggttgccaagcggaggt

SEQ ID NO: 128682 - DNA, 25 bp, Mus musculus
tagaaccagttccaggtcaaaaggg

SEQ ID NO: 128683 - DNA, 25 bp, Mus musculus
tagaaccatcttgcagggatcccag

SEQ ID NO: 128684 - DNA, 25 bp, Mus musculus
tagaacccaggaatttgacaagcac

SEQ ID NO: 128685 - DNA, 25 bp, Mus musculus
tagaacctaggtgcttgcagccagg

SEQ ID NO: 128686 - DNA, 25 bp, Mus musculus
tagaacctccacctgactccaggaa

SEQ ID NO: 128687 - DNA, 25 bp, Mus musculus
tagaacctcttctagccaacctagg

SEQ ID NO: 128688 - DNA, 25 bp, Mus musculus
tagaactacttttggctcatggagc

SEQ ID NO: 128689 - DNA, 25 bp, Mus musculus
tagaactagacctgggagtttccag

SEQ ID NO: 128690 - DNA, 25 bp, Mus musculus
tagaactccgttatctgctggaaat

SEQ ID NO: 128691 - DNA, 25 bp, Mus musculus
tagaactgaaagcaagccaaactcc

SEQ ID NO: 128692 - DNA, 25 bp, Mus musculus
tagaactgaggagcatctctcaccg

SEQ ID NO: 128693 - DNA, 25 bp, Mus musculus
tagaactggaaaacatacctgctgg

SEQ ID NO: 128694 - DNA, 25 bp, Mus musculus
tagaacttccacgttgcccacgagt

SEQ ID NO: 128695 - DNA, 25 bp, Mus musculus
tagaactttagggaagggagattgg

SEQ ID NO: 128696 - DNA, 25 bp, Mus musculus
tagaagaaaaccaccgtcctgacag

SEQ ID NO: 128697 - DNA, 25 bp, Mus musculus
tagaagaaccaaaatgtcctgagcc

SEQ ID NO: 128698 - DNA, 25 bp, Mus musculus
tagaagaaccaaacccaagaagcgg

SEQ ID NO: 128699 - DNA, 25 bp, Mus musculus
tagaagacaagaacccagctggtgg

SEQ ID NO: 128700 - DNA, 25 bp, Mus musculus
tagaagacagcttcccaagtgtgaa

SEQ ID NO: 128701 - DNA, 25 bp, Mus musculus
tagaagacaggaaacctcccagcaa

SEQ ID NO: 128702 - DNA, 25 bp, Mus musculus
tagaagacattctgaccatggcctc

SEQ ID NO: 128703 - DNA, 25 bp, Mus musculus
tagaagaccagattgcacagcatcc

SEQ ID NO: 128704 - DNA, 25 bp, Mus musculus
tagaagacgaccacttgcaaatggc

SEQ ID NO: 128705 - DNA, 25 bp, Mus musculus
tagaagacgcacctaaaccctgtgt

SEQ ID NO: 128706 - DNA, 25 bp, Mus musculus
tagaagacgccaagtcctccgattc

SEQ ID NO: 128707 - DNA, 25 bp, Mus musculus
tagaagacggacaagaaagcgcctt

SEQ ID NO: 128708 - DNA, 25 bp, Mus musculus
tagaagacggacctgaagcagaagc

SEQ ID NO: 128709 - DNA, 25 bp, Mus musculus
tagaagacgtcctgaaaacccctgt

SEQ ID NO: 128710 - DNA, 25 bp, Mus musculus
tagaagactacatcactgctggctg

SEQ ID NO: 128711 - DNA, 25 bp, Mus musculus
tagaagactgcttggcccatcttgg

SEQ ID NO: 128712 - DNA, 25 bp, Mus musculus
tagaagagccatcgtccaggatcag

SEQ ID NO: 128713 - DNA, 25 bp, Mus musculus
tagaagagtttctcatggagcagga

SEQ ID NO: 128714 - DNA, 25 bp, Mus musculus
tagaagatcaccaagcagaccactc

SEQ ID NO: 128715 - DNA, 25 bp, Mus musculus
tagaagatcagaagaatccatcgaa

SEQ ID NO: 128716 - DNA, 25 bp, Mus musculus
tagaagatcctatcacgggaaggca

SEQ ID NO: 128717 - DNA, 25 bp, Mus musculus
tagaagatgagctgcgcatggagcc

SEQ ID NO: 128718 - DNA, 25 bp, Mus musculus
tagaagatgcctgtgagcacctggc

SEQ ID NO: 128719 - DNA, 25 bp, Mus musculus
tagaagcaccaaagaaccatgggcg

SEQ ID NO: 128720 - DNA, 25 bp, Mus musculus
tagaagcaccgagttcagcagactt

SEQ ID NO: 128721 - DNA, 25 bp, Mus musculus
tagaagcacgcgaagagatgaccag

SEQ ID NO: 128722 - DNA, 25 bp, Mus musculus
tagaagcactctatcgacaggaccc

SEQ ID NO: 128723 - DNA, 25 bp, Mus musculus
tagaagcagacactttcccagacga

SEQ ID NO: 128724 - DNA, 25 bp, Mus musculus
tagaagcatcagctggacctctggg

SEQ ID NO: 128725 - DNA, 25 bp, Mus musculus
tagaagccaagacgagagagctcct

SEQ ID NO: 128726 - DNA, 25 bp, Mus musculus
tagaagccaagatgagcacactggg

SEQ ID NO: 128727 - DNA, 25 bp, Mus musculus
tagaagccaccgtgcagcagggatt

SEQ ID NO: 128728 - DNA, 25 bp, Mus musculus
tagaagccagtttgttacacgcaac

SEQ ID NO: 128729 - DNA, 25 bp, Mus musculus
tagaagcccagaacctctacgtggg

SEQ ID NO: 128730 - DNA, 25 bp, Mus musculus
tagaagccgaacttgctgtggaacc

SEQ ID NO: 128731 - DNA, 25 bp, Mus musculus
tagaagcgtacaagtgccagacggt

SEQ ID NO: 128732 - DNA, 25 bp, Mus musculus
tagaagcgtttagcccatcccagat

SEQ ID NO: 128733 - DNA, 25 bp, Mus musculus
tagaagctaggactaagcccagagg

SEQ ID NO: 128734 - DNA, 25 bp, Mus musculus
tagaagctagtatcacccattggga

SEQ ID NO: 128735 - DNA, 25 bp, Mus musculus
tagaagctgaggttgttactaacgg

SEQ ID NO: 128736 - DNA, 25 bp, Mus musculus
tagaagctgcagtggatgctgaccc

SEQ ID NO: 128737 - DNA, 25 bp, Mus musculus
tagaagcttgcatttgggccacacc

SEQ ID NO: 128738 - DNA, 25 bp, Mus musculus
tagaaggaccatgttgttgacggac

SEQ ID NO: 128739 - DNA, 25 bp, Mus musculus
tagaaggaggcgaccgactgatctc

SEQ ID NO: 128740 - DNA, 25 bp, Mus musculus
tagaaggatgactgccgccctttcc

SEQ ID NO: 128741 - DNA, 25 bp, Mus musculus
tagaaggcaaagtagaccaggtccg

SEQ ID NO: 128742 - DNA, 25 bp, Mus musculus
tagaaggcccgtttctgtagcagat

SEQ ID NO: 128743 - DNA, 25 bp, Mus musculus
tagaaggcgccactttaacgagctg

SEQ ID NO: 128744 - DNA, 25 bp, Mus musculus
tagaaggcgctcaaggagtcgaagc

SEQ ID NO: 128745 - DNA, 25 bp, Mus musculus
tagaaggctgcatcgctgaaatcca

SEQ ID NO: 128746 - DNA, 25 bp, Mus musculus
tagaagggagcctggaacagaccaa

SEQ ID NO: 128747 - DNA, 25 bp, Mus musculus
tagaagggtcagattttcaatgtcg

SEQ ID NO: 128748 - DNA, 25 bp, Mus musculus
tagaaggtctaacatcagatacggc

SEQ ID NO: 128749 - DNA, 25 bp, Mus musculus
tagaaggtgcttaactgggattaaa

SEQ ID NO: 128750 - DNA, 25 bp, Mus musculus
tagaaggttccaccagctgcagtgc

SEQ ID NO: 128751 - DNA, 25 bp, Mus musculus
tagaagtaatcagggaggctgcctc

SEQ ID NO: 128752 - DNA, 25 bp, Mus musculus
tagaagtacacatgcatgtcactaa

SEQ ID NO: 128753 - DNA, 25 bp, Mus musculus
tagaagtacacgttctgggcacagg

SEQ ID NO: 128754 - DNA, 25 bp, Mus musculus
tagaagtacccgttatcccaggtgg

SEQ ID NO: 128755 - DNA, 25 bp, Mus musculus
tagaagtaccctcggagacagaagc

SEQ ID NO: 128756 - DNA, 25 bp, Mus musculus
tagaagtcgtgtcaaagcattttgc

SEQ ID NO: 128757 - DNA, 25 bp, Mus musculus
tagaagtcttctattcccaacatga

SEQ ID NO: 128758 - DNA, 25 bp, Mus musculus
tagaagtcttgtgaaaccattgcag

SEQ ID NO: 128759 - DNA, 25 bp, Mus musculus
tagaagtgcccgatggtaaacaacc

SEQ ID NO: 128760 - DNA, 25 bp, Mus musculus
tagaagtggaccttcatggccgtgt

SEQ ID NO: 128761 - DNA, 25 bp, Mus musculus
tagaagtgtgcaaaaggcctcacct

SEQ ID NO: 128762 - DNA, 25 bp, Mus musculus
tagaagtgtgcatcccagcctttct

SEQ ID NO: 128763 - DNA, 25 bp, Mus musculus
tagaagttcttaggcatctccaaag

SEQ ID NO: 128764 - DNA, 25 bp, Mus musculus
tagaagttgagcgtgtactaccgca

SEQ ID NO: 128765 - DNA, 25 bp, Mus musculus
tagaagttgggaagatgattggccc

SEQ ID NO: 128766 - DNA, 25 bp, Mus musculus
tagaataccgagtccgtacgctggg

SEQ ID NO: 128767 - DNA, 25 bp, Mus musculus
tagaataggcacttaactgcgtatg

SEQ ID NO: 128768 - DNA, 25 bp, Mus musculus
tagaatatgtactcgcagctgacgc

SEQ ID NO: 128769 - DNA, 25 bp, Mus musculus
tagaatcaaggaaaaggagggagca

SEQ ID NO: 128770 - DNA, 25 bp, Mus musculus
tagaatcaaggacgatggatccgtg

SEQ ID NO: 128771 - DNA, 25 bp, Mus musculus
tagaatcagacttgcgtgtacgact

SEQ ID NO: 128772 - DNA, 25 bp, Mus musculus
tagaatcagatgatcgacgccagct

SEQ ID NO: 128773 - DNA, 25 bp, Mus musculus
tagaatcagtgagaaacccggtgcc

SEQ ID NO: 128774 - DNA, 25 bp, Mus musculus
tagaatcagttaccctgaatggaaa

SEQ ID NO: 128775 - DNA, 25 bp, Mus musculus
tagaatccaggtagacgaaagcccc

SEQ ID NO: 128776 - DNA, 25 bp, Mus musculus
tagaatccatggtggacgcagccga

SEQ ID NO: 128777 - DNA, 25 bp, Mus musculus
tagaatccctgatggaccgaggagc

SEQ ID NO: 128778 - DNA, 25 bp, Mus musculus
tagaatcctgaaggttgccaagccc

SEQ ID NO: 128779 - DNA, 25 bp, Mus musculus
tagaatcctgcaaactcgtgagaga

SEQ ID NO: 128780 - DNA, 25 bp, Mus musculus
tagaatcggtgaaggaaaaccctgc

SEQ ID NO: 128781 - DNA, 25 bp, Mus musculus
tagaatctacacactggctggaaca

SEQ ID NO: 128782 - DNA, 25 bp, Mus musculus
tagaatctcgtgcttgacttagcgg

SEQ ID NO: 128783 - DNA, 25 bp, Mus musculus
tagaatctgtccactttgaattgac

SEQ ID NO: 128784 - DNA, 25 bp, Mus musculus
tagaatgcaagtactgccaagcccc

SEQ ID NO: 128785 - DNA, 25 bp, Mus musculus
tagaatgcagtaacaccctggagga

SEQ ID NO: 128786 - DNA, 25 bp, Mus musculus
tagaatggtggttgcctgggttccc

SEQ ID NO: 128787 - DNA, 25 bp, Mus musculus
tagaatgtctgcctagcacttggga

SEQ ID NO: 128788 - DNA, 25 bp, Mus musculus
tagaattaaaacgtgcacctgggcc

SEQ ID NO: 128789 - DNA, 25 bp, Mus musculus
tagaattcatatcgaagaggacgcc

SEQ ID NO: 128790 - DNA, 25 bp, Mus musculus
tagaattcgtaactgggcctagaga

SEQ ID NO: 128791 - DNA, 25 bp, Mus musculus
tagaattgaattcaggccctcgtgt

SEQ ID NO: 128792 - DNA, 25 bp, Mus musculus
tagaattgcaactacgtctgggctg

SEQ ID NO: 128793 - DNA, 25 bp, Mus musculus
tagaatttagccctctgagagcgac

SEQ ID NO: 128794 - DNA, 25 bp, Mus musculus
tagaatttgttgtacgtgaagggcc

SEQ ID NO: 128795 - DNA, 25 bp, Mus musculus
tagacaaaaggcactggaactcgca

SEQ ID NO: 128796 - DNA, 25 bp, Mus musculus
tagacaaagagagattcacagccct

SEQ ID NO: 128797 - DNA, 25 bp, Mus musculus
tagacaaattcacaacattgcatgg

SEQ ID NO: 128798 - DNA, 25 bp, Mus musculus
tagacaacagccatgccttcaggtg

SEQ ID NO: 128799 - DNA, 25 bp, Mus musculus
tagacaacctgtgggaagaacaccg

SEQ ID NO: 128800 - DNA, 25 bp, Mus musculus
tagacaactcaaacaaagcccatgg

SEQ ID NO: 128801 - DNA, 25 bp, Mus musculus
tagacaactcagtgcgtcctcggag

SEQ ID NO: 128802 - DNA, 25 bp, Mus musculus
tagacaagaaagaactccaggcaac

SEQ ID NO: 128803 - DNA, 25 bp, Mus musculus
tagacaagcagactggttaagacca

SEQ ID NO: 128804 - DNA, 25 bp, Mus musculus
tagacaagcatgtggaggcccagag

SEQ ID NO: 128805 - DNA, 25 bp, Mus musculus
tagacaataaggtgctgctggctgc

SEQ ID NO: 128806 - DNA, 25 bp, Mus musculus
tagacaatgataaaatgcgctggcc

SEQ ID NO: 128807 - DNA, 25 bp, Mus musculus
tagacacctactttgactcagagag

SEQ ID NO: 128808 - DNA, 25 bp, Mus musculus
tagacacctggcacctatagcttgg

SEQ ID NO: 128809 - DNA, 25 bp, Mus musculus
tagacacgcaggataacttcaacca

SEQ ID NO: 128810 - DNA, 25 bp, Mus musculus
tagacacggagaaaacgacttcagt

SEQ ID NO: 128811 - DNA, 25 bp, Mus musculus
tagacactttattcagagccgttgg

SEQ ID NO: 128812 - DNA, 25 bp, Mus musculus
tagacagagagaacccttggctttg

SEQ ID NO: 128813 - DNA, 25 bp, Mus musculus
tagacagagctgcgtactccctctc

SEQ ID NO: 128814 - DNA, 25 bp, Mus musculus
tagacagcaggcgtcaaaaagccct

SEQ ID NO: 128815 - DNA, 25 bp, Mus musculus
tagacagcttctcgatcacatggat

SEQ ID NO: 128816 - DNA, 25 bp, Mus musculus
tagacaggttcacaatttgcgggaa

SEQ ID NO: 128817 - DNA, 25 bp, Mus musculus
tagacagtatagagacaagcctggc

SEQ ID NO: 128818 - DNA, 25 bp, Mus musculus
tagacagtgcctttccgctgctgca

SEQ ID NO: 128819 - DNA, 25 bp, Mus musculus
tagacagttggactgcatggcctgc

SEQ ID NO: 128820 - DNA, 25 bp, Mus musculus
tagacatatatgtaccgtaaggaga

SEQ ID NO: 128821 - DNA, 25 bp, Mus musculus
tagacatcaacatgcgcacggtcga

SEQ ID NO: 128822 - DNA, 25 bp, Mus musculus
tagacatccccgaggctcttgtgga

SEQ ID NO: 128823 - DNA, 25 bp, Mus musculus
tagacatccgcaggctggaggtaga

SEQ ID NO: 128824 - DNA, 25 bp, Mus musculus
tagacatgactgacgaggaacggcc

SEQ ID NO: 128825 - DNA, 25 bp, Mus musculus
tagacatgctcaggatccttgtccc

SEQ ID NO: 128826 - DNA, 25 bp, Mus musculus
tagacatgctggtccctcgacagtg

SEQ ID NO: 128827 - DNA, 25 bp, Mus musculus
tagacatggctttggctcttcaaga

SEQ ID NO: 128828 - DNA, 25 bp, Mus musculus
tagacatgggtttgcaccggcttcc

SEQ ID NO: 128829 - DNA, 25 bp, Mus musculus
tagacatggtctctcagcatctctc

SEQ ID NO: 128830 - DNA, 25 bp, Mus musculus
tagacattgagttcctgaggcggct

SEQ ID NO: 128831 - DNA, 25 bp, Mus musculus
tagacattgcgaaccagacaggcag

SEQ ID NO: 128832 - DNA, 25 bp, Mus musculus
tagacattggtagacacagcgcttc

SEQ ID NO: 128833 - DNA, 25 bp, Mus musculus
tagaccactgtcacgaagccataga

SEQ ID NO: 128834 - DNA, 25 bp, Mus musculus
tagaccagcccctgaaacttatgcc

SEQ ID NO: 128835 - DNA, 25 bp, Mus musculus
tagaccagggttcctagaccattgg

SEQ ID NO: 128836 - DNA, 25 bp, Mus musculus
tagaccatctacagaaagggacgcc

SEQ ID NO: 128837 - DNA, 25 bp, Mus musculus
tagaccatgattatttggaaaacat

SEQ ID NO: 128838 - DNA, 25 bp, Mus musculus
tagaccatggctcgtgcaaagagaa

SEQ ID NO: 128839 - DNA, 25 bp, Mus musculus
tagaccatgtgaccctacactgtgt

SEQ ID NO: 128840 - DNA, 25 bp, Mus musculus
tagacccaagtcagaaagaaccatt

SEQ ID NO: 128841 - DNA, 25 bp, Mus musculus
tagacccaagtgcatcaagacaagg

SEQ ID NO: 128842 - DNA, 25 bp, Mus musculus
tagacccagcgtgatcatgccaact

SEQ ID NO: 128843 - DNA, 25 bp, Mus musculus
tagaccccaaagctttcccttgagg

SEQ ID NO: 128844 - DNA, 25 bp, Mus musculus
tagaccccaagtcacagtggcgaag

SEQ ID NO: 128845 - DNA, 25 bp, Mus musculus
tagaccccatgcagggaagcagtgt

SEQ ID NO: 128846 - DNA, 25 bp, Mus musculus
tagaccccggcgtaccgttagcctg

SEQ ID NO: 128847 - DNA, 25 bp, Mus musculus
tagacccgtccttggccaggaagtg

SEQ ID NO: 128848 - DNA, 25 bp, Mus musculus
tagacccttgggactagcgagttcc

SEQ ID NO: 128849 - DNA, 25 bp, Mus musculus
tagaccgaaggcaggacaaatggac

SEQ ID NO: 128850 - DNA, 25 bp, Mus musculus
tagaccgactgctgctgagttagag

SEQ ID NO: 128851 - DNA, 25 bp, Mus musculus
tagaccgggactggcttcttcagaa

SEQ ID NO: 128852 - DNA, 25 bp, Mus musculus
tagaccggttaaccagacagccaga

SEQ ID NO: 128853 - DNA, 25 bp, Mus musculus
tagaccgtttctaagtcctaatttg

SEQ ID NO: 128854 - DNA, 25 bp, Mus musculus
tagacctaaaaaactgtgccagctg

SEQ ID NO: 128855 - DNA, 25 bp, Mus musculus
tagacctaatggacatggcggacca

SEQ ID NO: 128856 - DNA, 25 bp, Mus musculus
tagacctcaagtgtagaagacacgg

SEQ ID NO: 128857 - DNA, 25 bp, Mus musculus
tagacctcagtaggcatgtcggcgg

SEQ ID NO: 128858 - DNA, 25 bp, Mus musculus
tagacctccaaagcttcagggaagg

SEQ ID NO: 128859 - DNA, 25 bp, Mus musculus
tagacctgagccacaacagcatctg

SEQ ID NO: 128860 - DNA, 25 bp, Mus musculus
tagacctgagtcaaagaggctgcgc

SEQ ID NO: 128861 - DNA, 25 bp, Mus musculus
tagacctgagtgtcttccgagaccg

SEQ ID NO: 128862 - DNA, 25 bp, Mus musculus
tagacctggcaagcatggctctggc

SEQ ID NO: 128863 - DNA, 25 bp, Mus musculus
tagacctgtttctcgaccccgactt

SEQ ID NO: 128864 - DNA, 25 bp, Mus musculus
tagacctttgtcgaccgtttgctgc

SEQ ID NO: 128865 - DNA, 25 bp, Mus musculus
tagacgaagggctgactacgaagca

SEQ ID NO: 128866 - DNA, 25 bp, Mus musculus
tagacgacatattaccagaggcttc

SEQ ID NO: 128867 - DNA, 25 bp, Mus musculus
tagacgacctcactaacctggtggt

SEQ ID NO: 128868 - DNA, 25 bp, Mus musculus
tagacgacggtggagacacacagat

SEQ ID NO: 128869 - DNA, 25 bp, Mus musculus
tagacgagaagatctctgccatggg

SEQ ID NO: 128870 - DNA, 25 bp, Mus musculus
tagacgagcccgagccgagtggcca

SEQ ID NO: 128871 - DNA, 25 bp, Mus musculus
tagacgagctaaagaagaaatacgg

SEQ ID NO: 128872 - DNA, 25 bp, Mus musculus
tagacgagctttaccgcgtgtccaa

SEQ ID NO: 128873 - DNA, 25 bp, Mus musculus
tagacgccaccagttgaagatgctc

SEQ ID NO: 128874 - DNA, 25 bp, Mus musculus
tagacgccctacaggatgtggacca

SEQ ID NO: 128875 - DNA, 25 bp, Mus musculus
tagacgccctcatcagattccgagc

SEQ ID NO: 128876 - DNA, 25 bp, Mus musculus
tagacgctcagtccgggccgagtct

SEQ ID NO: 128877 - DNA, 25 bp, Mus musculus
tagacgctcatattcgcctctggga

SEQ ID NO: 128878 - DNA, 25 bp, Mus musculus
tagacgcttctgagcaggcggacct

SEQ ID NO: 128879 - DNA, 25 bp, Mus musculus
tagacggaactgtcgtgcgtatgcc

SEQ ID NO: 128880 - DNA, 25 bp, Mus musculus
tagacggagccaagaggaagttcct

SEQ ID NO: 128881 - DNA, 25 bp, Mus musculus
tagacggcatcaaagtgagaataca

SEQ ID NO: 128882 - DNA, 25 bp, Mus musculus
tagacggccgcgattaccactttgt

SEQ ID NO: 128883 - DNA, 25 bp, Mus musculus
tagacggctgcaacaagatgacttg

SEQ ID NO: 128884 - DNA, 25 bp, Mus musculus
tagacgggacttgactgctaaagcg

SEQ ID NO: 128885 - DNA, 25 bp, Mus musculus
tagacgggttaagagagggcccaat

SEQ ID NO: 128886 - DNA, 25 bp, Mus musculus
tagacggtgttctggtgagcacagc

SEQ ID NO: 128887 - DNA, 25 bp, Mus musculus
tagacgtgttatggttgaagcaagc

SEQ ID NO: 128888 - DNA, 25 bp, Mus musculus
tagacgtttatgcacgtgccacatg

SEQ ID NO: 128889 - DNA, 25 bp, Mus musculus
tagactacagaggactcggcatcag

SEQ ID NO: 128890 - DNA, 25 bp, Mus musculus
tagactagaacccaaagaatgagcc

SEQ ID NO: 128891 - DNA, 25 bp, Mus musculus
tagactagcgtcaaaccagatgtgg

SEQ ID NO: 128892 - DNA, 25 bp, Mus musculus
tagactagttaacacaaggagggct

SEQ ID NO: 128893 - DNA, 25 bp, Mus musculus
tagactatgacttaagccccacgga

SEQ ID NO: 128894 - DNA, 25 bp, Mus musculus
tagactatgagaccacccgggagtt

SEQ ID NO: 128895 - DNA, 25 bp, Mus musculus
tagactatgtcttcaacctgtgcga

SEQ ID NO: 128896 - DNA, 25 bp, Mus musculus
tagactcaatacacaggctgctggc

SEQ ID NO: 128897 - DNA, 25 bp, Mus musculus
tagactcctcatagggagcatgggc

SEQ ID NO: 128898 - DNA, 25 bp, Mus musculus
tagactccttgtggctcttgggaca

SEQ ID NO: 128899 - DNA, 25 bp, Mus musculus
tagactcgatcatgaaggacctggt

SEQ ID NO: 128900 - DNA, 25 bp, Mus musculus
tagactctataaggtaccggatgga

SEQ ID NO: 128901 - DNA, 25 bp, Mus musculus
tagactctccggctaagttgggaag

SEQ ID NO: 128902 - DNA, 25 bp, Mus musculus
tagactctgagcgactcttggaggc

SEQ ID NO: 128903 - DNA, 25 bp, Mus musculus
tagactctggctaccgagttcacga

SEQ ID NO: 128904 - DNA, 25 bp, Mus musculus
tagactgaaaacctgggcccatata

SEQ ID NO: 128905 - DNA, 25 bp, Mus musculus
tagactgagtatgcctcggagacaa

SEQ ID NO: 128906 - DNA, 25 bp, Mus musculus
tagactgcaagatgatacgcctggc

SEQ ID NO: 128907 - DNA, 25 bp, Mus musculus
tagactgcagagaaaacatgtccct

SEQ ID NO: 128908 - DNA, 25 bp, Mus musculus
tagactgccctcttcgctgacaagg

SEQ ID NO: 128909 - DNA, 25 bp, Mus musculus
tagactgctctgcttacaacacggg

SEQ ID NO: 128910 - DNA, 25 bp, Mus musculus
tagactgctgaccagtgctgccctg

SEQ ID NO: 128911 - DNA, 25 bp, Mus musculus
tagactgctgtagtgaacggctgct

SEQ ID NO: 128912 - DNA, 25 bp, Mus musculus
tagactggtcagcaattcagagccc

SEQ ID NO: 128913 - DNA, 25 bp, Mus musculus
tagactggtttgcttcagccatcgg

SEQ ID NO: 128914 - DNA, 25 bp, Mus musculus
tagactgtccaggatgctcaccaga

SEQ ID NO: 128915 - DNA, 25 bp, Mus musculus
tagactgttacagcatgacctggag

SEQ ID NO: 128916 - DNA, 25 bp, Mus musculus
tagacttagagatccgcatgcgaga

SEQ ID NO: 128917 - DNA, 25 bp, Mus musculus
tagacttatgctggagacacatgcc

SEQ ID NO: 128918 - DNA, 25 bp, Mus musculus
tagacttcaatgctacctgcctcgg

SEQ ID NO: 128919 - DNA, 25 bp, Mus musculus
tagacttcactctggaggtcgagcg

SEQ ID NO: 128920 - DNA, 25 bp, Mus musculus
tagacttcctactttccaggaactg

SEQ ID NO: 128921 - DNA, 25 bp, Mus musculus
tagacttctgagtactgagcctccc

SEQ ID NO: 128922 - DNA, 25 bp, Mus musculus
tagacttgcacagatccagcaggca

SEQ ID NO: 128923 - DNA, 25 bp, Mus musculus
tagacttggctttcccacatcacga

SEQ ID NO: 128924 - DNA, 25 bp, Mus musculus
tagacttgggtatcacaggcccaga

SEQ ID NO: 128925 - DNA, 25 bp, Mus musculus
tagacttggtcaacgtcaagctggt

SEQ ID NO: 128926 - DNA, 25 bp, Mus musculus
tagacttgtcagcacttccgccttg

SEQ ID NO: 128927 - DNA, 25 bp, Mus musculus
tagacttgtccacgcggatctcagt

SEQ ID NO: 128928 - DNA, 25 bp, Mus musculus
tagactttgatgatctttcccggag

SEQ ID NO: 128929 - DNA, 25 bp, Mus musculus
tagacttttcctgtgggacctgaac

SEQ ID NO: 128930 - DNA, 25 bp, Mus musculus
tagagaaaacgaatcccacagagcc

SEQ ID NO: 128931 - DNA, 25 bp, Mus musculus
tagagaaaagagttccgggccgcgt

SEQ ID NO: 128932 - DNA, 25 bp, Mus musculus
tagagaacagtcctaaagctagccc

SEQ ID NO: 128933 - DNA, 25 bp, Mus musculus
tagagaacgctttctcgtgagccaa

SEQ ID NO: 128934 - DNA, 25 bp, Mus musculus
tagagaactacagcaggctccacag

SEQ ID NO: 128935 - DNA, 25 bp, Mus musculus
tagagaagaagccacgcatagcacc

SEQ ID NO: 128936 - DNA, 25 bp, Mus musculus
tagagaagacacaggttccggacac

SEQ ID NO: 128937 - DNA, 25 bp, Mus musculus
tagagaagaccccaagttcaaggag

SEQ ID NO: 128938 - DNA, 25 bp, Mus musculus
tagagaagatccagctgaggaaaga

SEQ ID NO: 128939 - DNA, 25 bp, Mus musculus
tagagaagcagctgatggatccccg

SEQ ID NO: 128940 - DNA, 25 bp, Mus musculus
tagagaagctacacaaccgggaaga

SEQ ID NO: 128941 - DNA, 25 bp, Mus musculus
tagagaaggccaccctgtgatcctc

SEQ ID NO: 128942 - DNA, 25 bp, Mus musculus
tagagaaggcgcttgttgctgcctt

SEQ ID NO: 128943 - DNA, 25 bp, Mus musculus
tagagaagggttttgacatccagac

SEQ ID NO: 128944 - DNA, 25 bp, Mus musculus
tagagaagtctttggcctggaaagg

SEQ ID NO: 128945 - DNA, 25 bp, Mus musculus
tagagaagtggccaattgtccaggc

SEQ ID NO: 128946 - DNA, 25 bp, Mus musculus
tagagaatctaaatgccccttcggc

SEQ ID NO: 128947 - DNA, 25 bp, Mus musculus
tagagaatggcgctgtcattacagg

SEQ ID NO: 128948 - DNA, 25 bp, Mus musculus
tagagacaatcctgggcttgcctgg

SEQ ID NO: 128949 - DNA, 25 bp, Mus musculus
tagagacacacatggccagagttga

SEQ ID NO: 128950 - DNA, 25 bp, Mus musculus
tagagaccatacgagtgaccagttg

SEQ ID NO: 128951 - DNA, 25 bp, Mus musculus
tagagaccctgaagatggagcacca

SEQ ID NO: 128952 - DNA, 25 bp, Mus musculus
tagagaccctgtaccagtcagctgg

SEQ ID NO: 128953 - DNA, 25 bp, Mus musculus
tagagaccctttgcagtagcccaga

SEQ ID NO: 128954 - DNA, 25 bp, Mus musculus
tagagacctggctgaaccatgaggg

SEQ ID NO: 128955 - DNA, 25 bp, Mus musculus
tagagaccttgcgtgccatgcacaa

SEQ ID NO: 128956 - DNA, 25 bp, Mus musculus
tagagacgcatcataacgcaacgcc

SEQ ID NO: 128957 - DNA, 25 bp, Mus musculus
tagagactcacactgttcccaggga

SEQ ID NO: 128958 - DNA, 25 bp, Mus musculus
tagagactccagagacatgcgggac

SEQ ID NO: 128959 - DNA, 25 bp, Mus musculus
tagagacttgcgaacgagcctggca

SEQ ID NO: 128960 - DNA, 25 bp, Mus musculus
tagagagaccattgttgccccagtg

SEQ ID NO: 128961 - DNA, 25 bp, Mus musculus
tagagagagaggctagactccaccg

SEQ ID NO: 128962 - DNA, 25 bp, Mus musculus
tagagagatctcgtgctgccaagtg

SEQ ID NO: 128963 - DNA, 25 bp, Mus musculus
tagagagatgtgtaccagagccggt

SEQ ID NO: 128964 - DNA, 25 bp, Mus musculus
tagagagcctcaagtaccaactggc

SEQ ID NO: 128965 - DNA, 25 bp, Mus musculus
tagagagcggcaagcaagaaaagct

SEQ ID NO: 128966 - DNA, 25 bp, Mus musculus
tagagagctcagaaggcgaagccac

SEQ ID NO: 128967 - DNA, 25 bp, Mus musculus
tagagagctcagatcctggcatgcc

SEQ ID NO: 128968 - DNA, 25 bp, Mus musculus
tagagagcttgatcttctaccacgg

SEQ ID NO: 128969 - DNA, 25 bp, Mus musculus
tagagagcttgtcacaaccttgggt

SEQ ID NO: 128970 - DNA, 25 bp, Mus musculus
tagagagggccattgctttcacaca

SEQ ID NO: 128971 - DNA, 25 bp, Mus musculus
tagagaggtcataggtacgtatccg

SEQ ID NO: 128972 - DNA, 25 bp, Mus musculus
tagagagtccagtcgttcacatagc

SEQ ID NO: 128973 - DNA, 25 bp, Mus musculus
tagagagtcctccttctgcagacat

SEQ ID NO: 128974 - DNA, 25 bp, Mus musculus
tagagagtcgcctgcaagaagtgga

SEQ ID NO: 128975 - DNA, 25 bp, Mus musculus
tagagagtgaccttgcccaatggga

SEQ ID NO: 128976 - DNA, 25 bp, Mus musculus
tagagagtggccctgtgtcgtacca

SEQ ID NO: 128977 - DNA, 25 bp, Mus musculus
tagagagttaccagaacctgacccg

SEQ ID NO: 128978 - DNA, 25 bp, Mus musculus
tagagagttctctgtcaccgatgca

SEQ ID NO: 128979 - DNA, 25 bp, Mus musculus
tagagataagaaaggtgacaagggt

SEQ ID NO: 128980 - DNA, 25 bp, Mus musculus
tagagatcatcaatgcacgggagac

SEQ ID NO: 128981 - DNA, 25 bp, Mus musculus
tagagatcccctctgagacagagag

SEQ ID NO: 128982 - DNA, 25 bp, Mus musculus
tagagatcctagtcacagaagcctg

SEQ ID NO: 128983 - DNA, 25 bp, Mus musculus
tagagatcgtgaattctgccacagc

SEQ ID NO: 128984 - DNA, 25 bp, Mus musculus
tagagatgaagcgattgcagcctgc

SEQ ID NO: 128985 - DNA, 25 bp, Mus musculus
tagagatgccccaagtaggcaaggc

SEQ ID NO: 128986 - DNA, 25 bp, Mus musculus
tagagatgccctcccatgtttgaag

SEQ ID NO: 128987 - DNA, 25 bp, Mus musculus
tagagatgtaaacagcgccgtgagc

SEQ ID NO: 128988 - DNA, 25 bp, Mus musculus
tagagattagccacacagccaagca

SEQ ID NO: 128989 - DNA, 25 bp, Mus musculus
tagagcaaagctacaccgggtcttg

SEQ ID NO: 128990 - DNA, 25 bp, Mus musculus
tagagcaactaaggaacacggtggc

SEQ ID NO: 128991 - DNA, 25 bp, Mus musculus
tagagcaagtgcacataccggaagt

SEQ ID NO: 128992 - DNA, 25 bp, Mus musculus
tagagcacaccacgttcctgagggt

SEQ ID NO: 128993 - DNA, 25 bp, Mus musculus
tagagcaccatgcttgggattccgg

SEQ ID NO: 128994 - DNA, 25 bp, Mus musculus
tagagcacctatgacaggacatggc

SEQ ID NO: 128995 - DNA, 25 bp, Mus musculus
tagagcagataagcacagtcttcgg

SEQ ID NO: 128996 - DNA, 25 bp, Mus musculus
tagagcagcgaattccgtaccgagg

SEQ ID NO: 128997 - DNA, 25 bp, Mus musculus
tagagcagctgctgccggagctgaa

SEQ ID NO: 128998 - DNA, 25 bp, Mus musculus
tagagcagtcgctttttcccgcgcg

SEQ ID NO: 128999 - DNA, 25 bp, Mus musculus
tagagcatatgaagccttccgacag

SEQ ID NO: 129000 - DNA, 25 bp, Mus musculus
tagagcatgctgtcagtatcaccgg

SEQ ID NO: 129001 - DNA, 25 bp, Mus musculus
tagagccaatgagagaggtcaccaa

SEQ ID NO: 129002 - DNA, 25 bp, Mus musculus
tagagccaatgtgctacgggccctc

SEQ ID NO: 129003 - DNA, 25 bp, Mus musculus
tagagccatggatgaccaacgcgac

SEQ ID NO: 129004 - DNA, 25 bp, Mus musculus
tagagcccctggagcatgagcagat

SEQ ID NO: 129005 - DNA, 25 bp, Mus musculus
tagagccctctgagaagatgactag

SEQ ID NO: 129006 - DNA, 25 bp, Mus musculus
tagagcccttgttagccagactgag

SEQ ID NO: 129007 - DNA, 25 bp, Mus musculus
tagagccgagactgggacaggactc

SEQ ID NO: 129008 - DNA, 25 bp, Mus musculus
tagagccgctctcctggtctgagga

SEQ ID NO: 129009 - DNA, 25 bp, Mus musculus
tagagccggaggactctgctgtgta

SEQ ID NO: 129010 - DNA, 25 bp, Mus musculus
tagagccggcaagatggcatccagt

SEQ ID NO: 129011 - DNA, 25 bp, Mus musculus
tagagcctattcatctgagtccaga

SEQ ID NO: 129012 - DNA, 25 bp, Mus musculus
tagagcctggcaaagtggcacatgc

SEQ ID NO: 129013 - DNA, 25 bp, Mus musculus
tagagcgacgtgtttgccagctgga

SEQ ID NO: 129014 - DNA, 25 bp, Mus musculus
tagagcgagtgttgccatggaaccg

SEQ ID NO: 129015 - DNA, 25 bp, Mus musculus
tagagcgatgctgaacaacctggtg

SEQ ID NO: 129016 - DNA, 25 bp, Mus musculus
tagagcgctgcgacaaagagaacaa

SEQ ID NO: 129017 - DNA, 25 bp, Mus musculus
tagagcggtgtttccatcgggccat

SEQ ID NO: 129018 - DNA, 25 bp, Mus musculus
tagagcgtatccagcacagcttgcg

SEQ ID NO: 129019 - DNA, 25 bp, Mus musculus
tagagcgtcgtcttatctagctccg

SEQ ID NO: 129020 - DNA, 25 bp, Mus musculus
tagagctaccctcagagtgctggag

SEQ ID NO: 129021 - DNA, 25 bp, Mus musculus
tagagctagagccttctaccaggtc

SEQ ID NO: 129022 - DNA, 25 bp, Mus musculus
tagagctcgaccagtttaagggaca

SEQ ID NO: 129023 - DNA, 25 bp, Mus musculus
tagagctctgttcaatggagcccag

SEQ ID NO: 129024 - DNA, 25 bp, Mus musculus
tagagctgacggatgacacctttga

SEQ ID NO: 129025 - DNA, 25 bp, Mus musculus
tagagctgcagaagcgatacttggt

SEQ ID NO: 129026 - DNA, 25 bp, Mus musculus
tagagctgcgcctcaaggactgtct

SEQ ID NO: 129027 - DNA, 25 bp, Mus musculus
tagagctggacttccggatgcggct

SEQ ID NO: 129028 - DNA, 25 bp, Mus musculus
tagagctggctctgtactaggagac

SEQ ID NO: 129029 - DNA, 25 bp, Mus musculus
tagagctggctgcatatttcacgga

SEQ ID NO: 129030 - DNA, 25 bp, Mus musculus
tagagctgtgcagaaggtccatggc

SEQ ID NO: 129031 - DNA, 25 bp, Mus musculus
tagagctgttgactgcatcctgaca

SEQ ID NO: 129032 - DNA, 25 bp, Mus musculus
tagagcttcaccaagagaattcaac

SEQ ID NO: 129033 - DNA, 25 bp, Mus musculus
tagagcttgagatggccatcgacac

SEQ ID NO: 129034 - DNA, 25 bp, Mus musculus
tagaggaaactgacatgccagagcc

SEQ ID NO: 129035 - DNA, 25 bp, Mus musculus
tagaggaaattatcgctgtacagcc

SEQ ID NO: 129036 - DNA, 25 bp, Mus musculus
tagaggaaccctcactgactggtgc

SEQ ID NO: 129037 - DNA, 25 bp, Mus musculus
tagaggaagctgtctcgggtccaca

SEQ ID NO: 129038 - DNA, 25 bp, Mus musculus
tagaggaatatgctcggaactccgg

SEQ ID NO: 129039 - DNA, 25 bp, Mus musculus
tagaggacaaaggacagcttgcagg

SEQ ID NO: 129040 - DNA, 25 bp, Mus musculus
tagaggacacagtgcaccatgagcg

SEQ ID NO: 129041 - DNA, 25 bp, Mus musculus
tagaggacagcagatacaactggtc

SEQ ID NO: 129042 - DNA, 25 bp, Mus musculus
tagaggacatgcaaggcaccaagtg

SEQ ID NO: 129043 - DNA, 25 bp, Mus musculus
tagaggacatgggacagcctacagt

SEQ ID NO: 129044 - DNA, 25 bp, Mus musculus
tagaggactaacctaggaccaacgg

SEQ ID NO: 129045 - DNA, 25 bp, Mus musculus
tagaggactataaagccacagcacg

SEQ ID NO: 129046 - DNA, 25 bp, Mus musculus
tagaggactatgacagcgaggagac

SEQ ID NO: 129047 - DNA, 25 bp, Mus musculus
tagaggactcccttttggatgtagc

SEQ ID NO: 129048 - DNA, 25 bp, Mus musculus
tagaggacttccgtcgggcacagga

SEQ ID NO: 129049 - DNA, 25 bp, Mus musculus
tagaggacttgaaggagatgacgtc

SEQ ID NO: 129050 - DNA, 25 bp, Mus musculus
tagaggagattttcacaacgaacac

SEQ ID NO: 129051 - DNA, 25 bp, Mus musculus
tagaggagcaaatcctccggaccgg

SEQ ID NO: 129052 - DNA, 25 bp, Mus musculus
tagaggagcacaatgccaagcagcc

SEQ ID NO: 129053 - DNA, 25 bp, Mus musculus
tagaggagctaggaggccatatgcc

SEQ ID NO: 129054 - DNA, 25 bp, Mus musculus
tagaggatggacgtcaacccgagtt

SEQ ID NO: 129055 - DNA, 25 bp, Mus musculus
tagaggcacacaagcatcttcgagg

SEQ ID NO: 129056 - DNA, 25 bp, Mus musculus
tagaggcagcctttgctcagcagcg

SEQ ID NO: 129057 - DNA, 25 bp, Mus musculus
tagaggcatggattcaacaagttgc

SEQ ID NO: 129058 - DNA, 25 bp, Mus musculus
tagaggcattcctgactgctcaaac

SEQ ID NO: 129059 - DNA, 25 bp, Mus musculus
tagaggcattgctcaacaagaccat

SEQ ID NO: 129060 - DNA, 25 bp, Mus musculus
tagaggccgaatctaacgtcccgga

SEQ ID NO: 129061 - DNA, 25 bp, Mus musculus
tagaggccggtcagtcactagtcat

SEQ ID NO: 129062 - DNA, 25 bp, Mus musculus
tagaggccttttcttgggactccaa

SEQ ID NO: 129063 - DNA, 25 bp, Mus musculus
tagaggccttttgctgttcagaccg

SEQ ID NO: 129064 - DNA, 25 bp, Mus musculus
tagaggcgaggagaaaaatcccacg

SEQ ID NO: 129065 - DNA, 25 bp, Mus musculus
tagaggcgcaaaccatcgaagagct

SEQ ID NO: 129066 - DNA, 25 bp, Mus musculus
tagaggcggcattagactatcacag

SEQ ID NO: 129067 - DNA, 25 bp, Mus musculus
tagaggcgtcacagccaaagttgcc

SEQ ID NO: 129068 - DNA, 25 bp, Mus musculus
tagaggctaccagagaggcagtgca

SEQ ID NO: 129069 - DNA, 25 bp, Mus musculus
tagaggctgcaaagcttaggcatcc

SEQ ID NO: 129070 - DNA, 25 bp, Mus musculus
tagaggcttaaccacaacagaaatg

SEQ ID NO: 129071 - DNA, 25 bp, Mus musculus
tagagggaacaacaactcgcaagcc

SEQ ID NO: 129072 - DNA, 25 bp, Mus musculus
tagagggacaagacatcagacagga

SEQ ID NO: 129073 - DNA, 25 bp, Mus musculus
tagagggattctgcacccctggcct

SEQ ID NO: 129074 - DNA, 25 bp, Mus musculus
tagagggcaccaaaagctccgagtc

SEQ ID NO: 129075 - DNA, 25 bp, Mus musculus
tagagggcactacttcggcaagacc

SEQ ID NO: 129076 - DNA, 25 bp, Mus musculus
tagagggcccatcagacagtggtac

SEQ ID NO: 129077 - DNA, 25 bp, Mus musculus
tagagggcctactgttcctgatgct

SEQ ID NO: 129078 - DNA, 25 bp, Mus musculus
tagagggcgcctattccagaagatc

SEQ ID NO: 129079 - DNA, 25 bp, Mus musculus
tagagggctctcctagtccttgagg

SEQ ID NO: 129080 - DNA, 25 bp, Mus musculus
tagaggtaaaagacgtccagctgca

SEQ ID NO: 129081 - DNA, 25 bp, Mus musculus
tagaggtcatcagaagccaacagca

SEQ ID NO: 129082 - DNA, 25 bp, Mus musculus
tagaggtcccctccagatagcaaga

SEQ ID NO: 129083 - DNA, 25 bp, Mus musculus
tagaggtcgtgcagaacgagccctt

SEQ ID NO: 129084 - DNA, 25 bp, Mus musculus
tagaggtgcaaagttaccagccgcc

SEQ ID NO: 129085 - DNA, 25 bp, Mus musculus
tagaggtgccccacagttggacact

SEQ ID NO: 129086 - DNA, 25 bp, Mus musculus
tagaggtggctttctcagaggccgc

SEQ ID NO: 129087 - DNA, 25 bp, Mus musculus
tagaggttctagagtgccgtatcca

SEQ ID NO: 129088 - DNA, 25 bp, Mus musculus
tagaggttggcgagctagcaaaact

SEQ ID NO: 129089 - DNA, 25 bp, Mus musculus
tagagtaacgaaaagtcccagagct

SEQ ID NO: 129090 - DNA, 25 bp, Mus musculus
tagagtaccaggcaacagtgttcga

SEQ ID NO: 129091 - DNA, 25 bp, Mus musculus
tagagtacgacaagtgtgccagcag

SEQ ID NO: 129092 - DNA, 25 bp, Mus musculus
tagagtagccctttccctggataga

SEQ ID NO: 129093 - DNA, 25 bp, Mus musculus
tagagtatccacagtatgtgcccag

SEQ ID NO: 129094 - DNA, 25 bp, Mus musculus
tagagtatgagcctgctaagcggct

SEQ ID NO: 129095 - DNA, 25 bp, Mus musculus
tagagtcaccatgtaacggacggat

SEQ ID NO: 129096 - DNA, 25 bp, Mus musculus
tagagtcatcctccggtccagttcg

SEQ ID NO: 129097 - DNA, 25 bp, Mus musculus
tagagtccaagctcagtggccagga

SEQ ID NO: 129098 - DNA, 25 bp, Mus musculus
tagagtccgaatcgtcctcagctgg

SEQ ID NO: 129099 - DNA, 25 bp, Mus musculus
tagagtcgagatcttccgaaggctg

SEQ ID NO: 129100 - DNA, 25 bp, Mus musculus
tagagtcggcatttcacaagacaac

SEQ ID NO: 129101 - DNA, 25 bp, Mus musculus
tagagtctctgcaacgcctatggcc

SEQ ID NO: 129102 - DNA, 25 bp, Mus musculus
tagagtgcagcagaagtgtcagaac

SEQ ID NO: 129103 - DNA, 25 bp, Mus musculus
tagagtgctgtactccagatactcc

SEQ ID NO: 129104 - DNA, 25 bp, Mus musculus
tagagtggacttgacttgcgcttgc

SEQ ID NO: 129105 - DNA, 25 bp, Mus musculus
tagagtggagttgctggctaaatgt

SEQ ID NO: 129106 - DNA, 25 bp, Mus musculus
tagagtggattgtgcctttgcagca

SEQ ID NO: 129107 - DNA, 25 bp, Mus musculus
tagagtgtctgcctgccataaggat

SEQ ID NO: 129108 - DNA, 25 bp, Mus musculus
tagagttcacttggtgcacacgtgg

SEQ ID NO: 129109 - DNA, 25 bp, Mus musculus
tagagttcagcctcaggattcagga

SEQ ID NO: 129110 - DNA, 25 bp, Mus musculus
tagagttcatgtagtcctgtggcaa

SEQ ID NO: 129111 - DNA, 25 bp, Mus musculus
tagagttccgattgtcactgcgccc

SEQ ID NO: 129112 - DNA, 25 bp, Mus musculus
tagagttccgctatgaccttggcaa

SEQ ID NO: 129113 - DNA, 25 bp, Mus musculus
tagagttcgaggaagtggacatcac

SEQ ID NO: 129114 - DNA, 25 bp, Mus musculus
tagagttctactggacaaggaagag

SEQ ID NO: 129115 - DNA, 25 bp, Mus musculus
tagagttctcggacaaagagtcagt

SEQ ID NO: 129116 - DNA, 25 bp, Mus musculus
tagataaaacaccatatagaggcca

SEQ ID NO: 129117 - DNA, 25 bp, Mus musculus
tagataacatctggactgcccggct

SEQ ID NO: 129118 - DNA, 25 bp, Mus musculus
tagataactggacctacagcacgga

SEQ ID NO: 129119 - DNA, 25 bp, Mus musculus
tagataagacgtgctccagcttgtc

SEQ ID NO: 129120 - DNA, 25 bp, Mus musculus
tagataagttctccgctgtgccaga

SEQ ID NO: 129121 - DNA, 25 bp, Mus musculus
tagatacagatatttgggaaacccc

SEQ ID NO: 129122 - DNA, 25 bp, Mus musculus
tagatacagcaatggcgagcacgtt

SEQ ID NO: 129123 - DNA, 25 bp, Mus musculus
tagatagagcgttgcagcataggcc

SEQ ID NO: 129124 - DNA, 25 bp, Mus musculus
tagatagccattgacttgaccaggg

SEQ ID NO: 129125 - DNA, 25 bp, Mus musculus
tagatagcctctttgaccccacagt

SEQ ID NO: 129126 - DNA, 25 bp, Mus musculus
tagataggcatccaagagaccgaca

SEQ ID NO: 129127 - DNA, 25 bp, Mus musculus
tagatagtcaggagaaagtggccac

SEQ ID NO: 129128 - DNA, 25 bp, Mus musculus
tagatatagtaggttgctctgccca

SEQ ID NO: 129129 - DNA, 25 bp, Mus musculus
tagatatcatcttggcatccgtggg

SEQ ID NO: 129130 - DNA, 25 bp, Mus musculus
tagatatccctcgaagtcgcctcgt

SEQ ID NO: 129131 - DNA, 25 bp, Mus musculus
tagatatggataagacccagacggg

SEQ ID NO: 129132 - DNA, 25 bp, Mus musculus
tagatcaaggtcaagaaccaggtcc

SEQ ID NO: 129133 - DNA, 25 bp, Mus musculus
tagatcagctgtgggctctgggcca

SEQ ID NO: 129134 - DNA, 25 bp, Mus musculus
tagatcaggccaactcaggctcatg

SEQ ID NO: 129135 - DNA, 25 bp, Mus musculus
tagatcatccagagaaccaaggtac

SEQ ID NO: 129136 - DNA, 25 bp, Mus musculus
tagatcatcttgaggcacacactgc

SEQ ID NO: 129137 - DNA, 25 bp, Mus musculus
tagatccaagcagagtgccagatgg

SEQ ID NO: 129138 - DNA, 25 bp, Mus musculus
tagatcccctgtgcttcgagtgcgg

SEQ ID NO: 129139 - DNA, 25 bp, Mus musculus
tagatcctaagtgcgagtaggtttg

SEQ ID NO: 129140 - DNA, 25 bp, Mus musculus
tagatcctcttgcacgatgcctgcc

SEQ ID NO: 129141 - DNA, 25 bp, Mus musculus
tagatcctgaacaattgccagttag

SEQ ID NO: 129142 - DNA, 25 bp, Mus musculus
tagatccttctgcaaccacaacgtg

SEQ ID NO: 129143 - DNA, 25 bp, Mus musculus
tagatcgcagccactagcgcttctg

SEQ ID NO: 129144 - DNA, 25 bp, Mus musculus
tagatcgcagtaagcaaggaccaca

SEQ ID NO: 129145 - DNA, 25 bp, Mus musculus
tagatcggccatctgaaactaaggc

SEQ ID NO: 129146 - DNA, 25 bp, Mus musculus
tagatctcacctaaacatgctgtcc

SEQ ID NO: 129147 - DNA, 25 bp, Mus musculus
tagatcttgagtccatgtacggcca

SEQ ID NO: 129148 - DNA, 25 bp, Mus musculus
tagatctttaaccttgcagctgccc

SEQ ID NO: 129149 - DNA, 25 bp, Mus musculus
tagatgacaaccacatagagaggct

SEQ ID NO: 129150 - DNA, 25 bp, Mus musculus
tagatgacatcacaacccggaaaat

SEQ ID NO: 129151 - DNA, 25 bp, Mus musculus
tagatgacccgcagagtggagagct

SEQ ID NO: 129152 - DNA, 25 bp, Mus musculus
tagatgacctcaccgaagcagtggc

SEQ ID NO: 129153 - DNA, 25 bp, Mus musculus
tagatgactacttgggccttgggtg

SEQ ID NO: 129154 - DNA, 25 bp, Mus musculus
tagatgagaccatccagccgtgtca

SEQ ID NO: 129155 - DNA, 25 bp, Mus musculus
tagatgagcacgtcgctgaatgtca

SEQ ID NO: 129156 - DNA, 25 bp, Mus musculus
tagatgagtactgtgcccgctacgg

SEQ ID NO: 129157 - DNA, 25 bp, Mus musculus
tagatgatgcagcacaacagaccct

SEQ ID NO: 129158 - DNA, 25 bp, Mus musculus
tagatgcaaagagcctggagcgagc

SEQ ID NO: 129159 - DNA, 25 bp, Mus musculus
tagatgcagccattgaaggagcttc

SEQ ID NO: 129160 - DNA, 25 bp, Mus musculus
tagatgccccatggaacagatcctg

SEQ ID NO: 129161 - DNA, 25 bp, Mus musculus
tagatgccctactccctgtgggtga

SEQ ID NO: 129162 - DNA, 25 bp, Mus musculus
tagatgccctgatgcgagtggccaa

SEQ ID NO: 129163 - DNA, 25 bp, Mus musculus
tagatgcgccacggcttcggtagcg

SEQ ID NO: 129164 - DNA, 25 bp, Mus musculus
tagatgctcagccacaagacagcct

SEQ ID NO: 129165 - DNA, 25 bp, Mus musculus
tagatgctgcgtctaaggaagcgaa

SEQ ID NO: 129166 - DNA, 25 bp, Mus musculus
tagatgctgcttcttcaatgcaagg

SEQ ID NO: 129167 - DNA, 25 bp, Mus musculus
tagatgcttttgatcaagtacaaac

SEQ ID NO: 129168 - DNA, 25 bp, Mus musculus
tagatggcatcattctcccaggagt

SEQ ID NO: 129169 - DNA, 25 bp, Mus musculus
tagatggcatttccctcctaaaagg

SEQ ID NO: 129170 - DNA, 25 bp, Mus musculus
tagatggctctcactcacggaggag

SEQ ID NO: 129171 - DNA, 25 bp, Mus musculus
tagatgggaaacaggccagaagaac

SEQ ID NO: 129172 - DNA, 25 bp, Mus musculus
tagatgggctcctggcgttggtcct

SEQ ID NO: 129173 - DNA, 25 bp, Mus musculus
tagatggttcaaaaccacgtgacca

SEQ ID NO: 129174 - DNA, 25 bp, Mus musculus
tagatgtccctgtaatggcagtgaa

SEQ ID NO: 129175 - DNA, 25 bp, Mus musculus
tagatgtgccatgtaccacggaccg

SEQ ID NO: 129176 - DNA, 25 bp, Mus musculus
tagatgtggactcaagtggaaagaa

SEQ ID NO: 129177 - DNA, 25 bp, Mus musculus
tagatgtggatctcagcctgtcagc

SEQ ID NO: 129178 - DNA, 25 bp, Mus musculus
tagatgtggcaaccaaacggaggca

SEQ ID NO: 129179 - DNA, 25 bp, Mus musculus
tagatgtggccatctgggtcggcac

SEQ ID NO: 129180 - DNA, 25 bp, Mus musculus
tagatgtggctttcctccgggcagt

SEQ ID NO: 129181 - DNA, 25 bp, Mus musculus
tagatgtgttcaccgagaagctgcc

SEQ ID NO: 129182 - DNA, 25 bp, Mus musculus
tagatgttgacaaggctaatacttt

SEQ ID NO: 129183 - DNA, 25 bp, Mus musculus
tagattacgtggaacatgccaagga

SEQ ID NO: 129184 - DNA, 25 bp, Mus musculus
tagattcacaatcagccacagagga

SEQ ID NO: 129185 - DNA, 25 bp, Mus musculus
tagattccctctgtgggtcacggaa

SEQ ID NO: 129186 - DNA, 25 bp, Mus musculus
tagattctgctgcaatgacgctgcc

SEQ ID NO: 129187 - DNA, 25 bp, Mus musculus
tagattgttcggagcttggcacccc

SEQ ID NO: 129188 - DNA, 25 bp, Mus musculus
tagatttacatgattacgaggcagc

SEQ ID NO: 129189 - DNA, 25 bp, Mus musculus
tagatttgctgtatcccgccatccg

SEQ ID NO: 129190 - DNA, 25 bp, Mus musculus
tagatttggcttctgccgcctgcga

SEQ ID NO: 129191 - DNA, 25 bp, Mus musculus
tagatttttccaagcaacacactgc

SEQ ID NO: 129192 - DNA, 25 bp, Mus musculus
tagcaaaaactcatgcaagggaggg

SEQ ID NO: 129193 - DNA, 25 bp, Mus musculus
tagcaaaaatctgtatagacagctc

SEQ ID NO: 129194 - DNA, 25 bp, Mus musculus
tagcaaaaatgaaagcagtccagtt

SEQ ID NO: 129195 - DNA, 25 bp, Mus musculus
tagcaaaactaggatcagtgtgccg

SEQ ID NO: 129196 - DNA, 25 bp, Mus musculus
tagcaaaagccgtagcctcttcgtg

SEQ ID NO: 129197 - DNA, 25 bp, Mus musculus
tagcaaaataaaccgccgctgggtc

SEQ ID NO: 129198 - DNA, 25 bp, Mus musculus
tagcaaacacatctggtttctggag

SEQ ID NO: 129199 - DNA, 25 bp, Mus musculus
tagcaaacatcgatggcctacaggg

SEQ ID NO: 129200 - DNA, 25 bp, Mus musculus
tagcaaacttttcaccgatgcctcg

SEQ ID NO: 129201 - DNA, 25 bp, Mus musculus
tagcaaccatgaccggatacagcgt

SEQ ID NO: 129202 - DNA, 25 bp, Mus musculus
tagcaactaggatcgctgtctacct

SEQ ID NO: 129203 - DNA, 25 bp, Mus musculus
tagcaagagtgcattcgagctgccg

SEQ ID NO: 129204 - DNA, 25 bp, Mus musculus
tagcaagatcgcagtggacgtccat

SEQ ID NO: 129205 - DNA, 25 bp, Mus musculus
tagcaaggaacgtgtccgcatggcc

SEQ ID NO: 129206 - DNA, 25 bp, Mus musculus
tagcaagtccctcagcgtgaagcac

SEQ ID NO: 129207 - DNA, 25 bp, Mus musculus
tagcaagtcttgattcagagaatat

SEQ ID NO: 129208 - DNA, 25 bp, Mus musculus
tagcaagttgctaattcgcgacatg

SEQ ID NO: 129209 - DNA, 25 bp, Mus musculus
tagcaatgcttggtcgatacccaga

SEQ ID NO: 129210 - DNA, 25 bp, Mus musculus
tagcaatggtagaataagcccacct

SEQ ID NO: 129211 - DNA, 25 bp, Mus musculus
tagcaatgtttacagaccagcctgc

SEQ ID NO: 129212 - DNA, 25 bp, Mus musculus
tagcaattacccatccctgccaggg

SEQ ID NO: 129213 - DNA, 25 bp, Mus musculus
tagcaatttccatgaggcgggtgaa

SEQ ID NO: 129214 - DNA, 25 bp, Mus musculus
tagcacaacatcttttaccactggg

SEQ ID NO: 129215 - DNA, 25 bp, Mus musculus
tagcacaataaagcagggactcctt

SEQ ID NO: 129216 - DNA, 25 bp, Mus musculus
tagcacacaggtcctcgcaaggttg

SEQ ID NO: 129217 - DNA, 25 bp, Mus musculus
tagcacagagccagctatccaggag

SEQ ID NO: 129218 - DNA, 25 bp, Mus musculus
tagcacagcgacacattttgcagag

SEQ ID NO: 129219 - DNA, 25 bp, Mus musculus
tagcacagcgggaggcagagtatgc

SEQ ID NO: 129220 - DNA, 25 bp, Mus musculus
tagcacatgctcacaaggatttaga

SEQ ID NO: 129221 - DNA, 25 bp, Mus musculus
tagcacattcggataaacctggatc

SEQ ID NO: 129222 - DNA, 25 bp, Mus musculus
tagcaccatggaagccaccaagcaa

SEQ ID NO: 129223 - DNA, 25 bp, Mus musculus
tagcaccattgcaaatatggcggcg

SEQ ID NO: 129224 - DNA, 25 bp, Mus musculus
tagcacggcttcgtcaggaaaacaa

SEQ ID NO: 129225 - DNA, 25 bp, Mus musculus
tagcacgtctagtactggcagtcga

SEQ ID NO: 129226 - DNA, 25 bp, Mus musculus
tagcactactaggagcccagctgag

SEQ ID NO: 129227 - DNA, 25 bp, Mus musculus
tagcactgctggtcctcgggctgct

SEQ ID NO: 129228 - DNA, 25 bp, Mus musculus
tagcacttccgtgttcaagcagcga

SEQ ID NO: 129229 - DNA, 25 bp, Mus musculus
tagcactttacaaatggccatggcg

SEQ ID NO: 129230 - DNA, 25 bp, Mus musculus
tagcactttaggcagagcaggctga

SEQ ID NO: 129231 - DNA, 25 bp, Mus musculus
tagcagaaaccctgcagaccctgga

SEQ ID NO: 129232 - DNA, 25 bp, Mus musculus
tagcagaccttacaatagcaccgac

SEQ ID NO: 129233 - DNA, 25 bp, Mus musculus
tagcagcaaacacaacgccacattt

SEQ ID NO: 129234 - DNA, 25 bp, Mus musculus
tagcagcagcagacctccatatgga

SEQ ID NO: 129235 - DNA, 25 bp, Mus musculus
tagcagcagcgttggcaaaatgaac

SEQ ID NO: 129236 - DNA, 25 bp, Mus musculus
tagcagcagctaacgcacatcagga

SEQ ID NO: 129237 - DNA, 25 bp, Mus musculus
tagcagcagtagcaactcaggatgg

SEQ ID NO: 129238 - DNA, 25 bp, Mus musculus
tagcagccaaacatgccaagcagaa

SEQ ID NO: 129239 - DNA, 25 bp, Mus musculus
tagcagccatgattcccttggtagg

SEQ ID NO: 129240 - DNA, 25 bp, Mus musculus
tagcagccatgattggaccacgggc

SEQ ID NO: 129241 - DNA, 25 bp, Mus musculus
tagcagcccgccttggtgttcagac

SEQ ID NO: 129242 - DNA, 25 bp, Mus musculus
tagcagcctttgaaagaagagcctg

SEQ ID NO: 129243 - DNA, 25 bp, Mus musculus
tagcagcgcccgtgagcaaaagcgc

SEQ ID NO: 129244 - DNA, 25 bp, Mus musculus
tagcagcgggtgtggtgatcaaatc

SEQ ID NO: 129245 - DNA, 25 bp, Mus musculus
tagcagctacaacataccagacgga

SEQ ID NO: 129246 - DNA, 25 bp, Mus musculus
tagcagctccgtgtcctttaaggaa

SEQ ID NO: 129247 - DNA, 25 bp, Mus musculus
tagcagctgaaggtccgtggtttcc

SEQ ID NO: 129248 - DNA, 25 bp, Mus musculus
tagcagcttctaccagagcagggat

SEQ ID NO: 129249 - DNA, 25 bp, Mus musculus
tagcagcttcttggacagcagagac

SEQ ID NO: 129250 - DNA, 25 bp, Mus musculus
tagcagctttgagatgacatcaccc

SEQ ID NO: 129251 - DNA, 25 bp, Mus musculus
tagcaggacttttctaggagagact

SEQ ID NO: 129252 - DNA, 25 bp, Mus musculus
tagcaggatctaccaccagaatcag

SEQ ID NO: 129253 - DNA, 25 bp, Mus musculus
tagcaggctgcaagatgtccaagtc

SEQ ID NO: 129254 - DNA, 25 bp, Mus musculus
tagcagggagccagataccttgtgc

SEQ ID NO: 129255 - DNA, 25 bp, Mus musculus
tagcagggctgatcgagctatgccc

SEQ ID NO: 129256 - DNA, 25 bp, Mus musculus
tagcagtaactacaacggcctggtg

SEQ ID NO: 129257 - DNA, 25 bp, Mus musculus
tagcagtcaaaagaaggatacgagc

SEQ ID NO: 129258 - DNA, 25 bp, Mus musculus
tagcagtcagtgaggttgcaggcct

SEQ ID NO: 129259 - DNA, 25 bp, Mus musculus
tagcagtctagggacactccagggt

SEQ ID NO: 129260 - DNA, 25 bp, Mus musculus
tagcagtctctaggaagtgtgggca

SEQ ID NO: 129261 - DNA, 25 bp, Mus musculus
tagcagtctgcaaggaggcggctct

SEQ ID NO: 129262 - DNA, 25 bp, Mus musculus
tagcagtgaaagtgaccagtaccaa

SEQ ID NO: 129263 - DNA, 25 bp, Mus musculus
tagcagtgacagttcggccagtgag

SEQ ID NO: 129264 - DNA, 25 bp, Mus musculus
tagcagtgagtgtatccatcgcagc

SEQ ID NO: 129265 - DNA, 25 bp, Mus musculus
tagcagtgccttcagatgtatccca

SEQ ID NO: 129266 - DNA, 25 bp, Mus musculus
tagcagtggcatggaagacccatcg

SEQ ID NO: 129267 - DNA, 25 bp, Mus musculus
tagcagtggccaaaatcgatggagc

SEQ ID NO: 129268 - DNA, 25 bp, Mus musculus
tagcagtggccacgtgatcacaggc

SEQ ID NO: 129269 - DNA, 25 bp, Mus musculus
tagcatacgactagacacagtgggc

SEQ ID NO: 129270 - DNA, 25 bp, Mus musculus
tagcataggaggtcattaacaaccc

SEQ ID NO: 129271 - DNA, 25 bp, Mus musculus
tagcatcactggcagaagccgcagt

SEQ ID NO: 129272 - DNA, 25 bp, Mus musculus
tagcatcagaaagctgcgtggtggc

SEQ ID NO: 129273 - DNA, 25 bp, Mus musculus
tagcatcatgcagaaagccatccgg

SEQ ID NO: 129274 - DNA, 25 bp, Mus musculus
tagcatcctggctgcagctgtctcc

SEQ ID NO: 129275 - DNA, 25 bp, Mus musculus
tagcatcggccttgcacgagagagg

SEQ ID NO: 129276 - DNA, 25 bp, Mus musculus
tagcatcgggctgaatgggccactg

SEQ ID NO: 129277 - DNA, 25 bp, Mus musculus
tagcatcgtgaacatcctgggtcag

SEQ ID NO: 129278 - DNA, 25 bp, Mus musculus
tagcatcgtgctcgacagacgggac

SEQ ID NO: 129279 - DNA, 25 bp, Mus musculus
tagcatctagcaaaagaatggcagc

SEQ ID NO: 129280 - DNA, 25 bp, Mus musculus
tagcatctcccttcccttgagtcgg

SEQ ID NO: 129281 - DNA, 25 bp, Mus musculus
tagcatctgctgtttccaaatggag

SEQ ID NO: 129282 - DNA, 25 bp, Mus musculus
tagcatgattagtcacgggcagcgg

SEQ ID NO: 129283 - DNA, 25 bp, Mus musculus
tagcatggacctacgtgtgagaagg

SEQ ID NO: 129284 - DNA, 25 bp, Mus musculus
tagcatggtaccaagaccagtatgc

SEQ ID NO: 129285 - DNA, 25 bp, Mus musculus
tagcatgtacgacctggacggcaat

SEQ ID NO: 129286 - DNA, 25 bp, Mus musculus
tagcattagcgacccttgttggcca

SEQ ID NO: 129287 - DNA, 25 bp, Mus musculus
tagcattcctgggattctcgctctg

SEQ ID NO: 129288 - DNA, 25 bp, Mus musculus
tagcattgtgctgttgggaaagtcc

SEQ ID NO: 129289 - DNA, 25 bp, Mus musculus
tagccaaaaagaacctgcacgtcat

SEQ ID NO: 129290 - DNA, 25 bp, Mus musculus
tagccaaagccatcaccgaaactgc

SEQ ID NO: 129291 - DNA, 25 bp, Mus musculus
tagccaaagctagagaacctgaaga

SEQ ID NO: 129292 - DNA, 25 bp, Mus musculus
tagccaactcccacttcatcgagga

SEQ ID NO: 129293 - DNA, 25 bp, Mus musculus
tagccaacttcgtgctggccctagg

SEQ ID NO: 129294 - DNA, 25 bp, Mus musculus
tagccaagatgttccggctggcccg

SEQ ID NO: 129295 - DNA, 25 bp, Mus musculus
tagccaagcgggagcaggatgtctt

SEQ ID NO: 129296 - DNA, 25 bp, Mus musculus
tagccaaggtgctcatgtcgcctac

SEQ ID NO: 129297 - DNA, 25 bp, Mus musculus
tagccaatatgagtgtgtgcccaga

SEQ ID NO: 129298 - DNA, 25 bp, Mus musculus
tagccaccagcttggttcagcagga

SEQ ID NO: 129299 - DNA, 25 bp, Mus musculus
tagccaccagtactcagggcagtgt

SEQ ID NO: 129300 - DNA, 25 bp, Mus musculus
tagccaccatttacaaagccgtcgg

SEQ ID NO: 129301 - DNA, 25 bp, Mus musculus
tagccaccgacagcaataagtaccg

SEQ ID NO: 129302 - DNA, 25 bp, Mus musculus
tagccacctgggacgtttgatttac

SEQ ID NO: 129303 - DNA, 25 bp, Mus musculus
tagccacgcagggacgttgcgagtc

SEQ ID NO: 129304 - DNA, 25 bp, Mus musculus
tagccacgggcatgtttcagttctg

SEQ ID NO: 129305 - DNA, 25 bp, Mus musculus
tagccacggtggatgagaccattcc

SEQ ID NO: 129306 - DNA, 25 bp, Mus musculus
tagccactctggagcgacatgactc

SEQ ID NO: 129307 - DNA, 25 bp, Mus musculus
tagccactgagtttaggatacaccc

SEQ ID NO: 129308 - DNA, 25 bp, Mus musculus
tagccactttgtgctgaagccccag

SEQ ID NO: 129309 - DNA, 25 bp, Mus musculus
tagccagacgcccttgaagtccatg

SEQ ID NO: 129310 - DNA, 25 bp, Mus musculus
tagccagagacaagtcccaggagaa

SEQ ID NO: 129311 - DNA, 25 bp, Mus musculus
tagccagccagtgacaagtgaatcc

SEQ ID NO: 129312 - DNA, 25 bp, Mus musculus
tagccagcgacacggagaagatcat

SEQ ID NO: 129313 - DNA, 25 bp, Mus musculus
tagccaggacagttcagagctgaga

SEQ ID NO: 129314 - DNA, 25 bp, Mus musculus
tagccaggaggattttatgctgaaa

SEQ ID NO: 129315 - DNA, 25 bp, Mus musculus
tagccagggtgcagcccgtaggtca

SEQ ID NO: 129316 - DNA, 25 bp, Mus musculus
tagccatagagttctctcaagagga

SEQ ID NO: 129317 - DNA, 25 bp, Mus musculus
tagccatcgactgggacaaaaccat

SEQ ID NO: 129318 - DNA, 25 bp, Mus musculus
tagccatgaacatcctgaacagtgg

SEQ ID NO: 129319 - DNA, 25 bp, Mus musculus
tagccatgaagcctaccagaagtct

SEQ ID NO: 129320 - DNA, 25 bp, Mus musculus
tagccatgcgccttgtcaatgatgc

SEQ ID NO: 129321 - DNA, 25 bp, Mus musculus
tagccatgggctaccttacgatatg

SEQ ID NO: 129322 - DNA, 25 bp, Mus musculus
tagccatgtacgtggatttcccctc

SEQ ID NO: 129323 - DNA, 25 bp, Mus musculus
tagccatgtattccgaaggcgcccc

SEQ ID NO: 129324 - DNA, 25 bp, Mus musculus
tagccattgagcttctcgcggcctg

SEQ ID NO: 129325 - DNA, 25 bp, Mus musculus
tagccattgccactctgattagagt

SEQ ID NO: 129326 - DNA, 25 bp, Mus musculus
tagcccaagactgtatcgaaatgcc

SEQ ID NO: 129327 - DNA, 25 bp, Mus musculus
tagcccaagcatcatcaatgacgat

SEQ ID NO: 129328 - DNA, 25 bp, Mus musculus
tagcccaattgtcacggtagagccg

SEQ ID NO: 129329 - DNA, 25 bp, Mus musculus
tagcccacgcgccacgatggtgtgc

SEQ ID NO: 129330 - DNA, 25 bp, Mus musculus
tagcccagggacatctaataaacgc

SEQ ID NO: 129331 - DNA, 25 bp, Mus musculus
tagcccagtacttggtcgagcccag

SEQ ID NO: 129332 - DNA, 25 bp, Mus musculus
tagcccagtataaacgggagtgccc

SEQ ID NO: 129333 - DNA, 25 bp, Mus musculus
tagcccagtctgaggttaggcctga

SEQ ID NO: 129334 - DNA, 25 bp, Mus musculus
tagcccagttcaatacggtgaccgg

SEQ ID NO: 129335 - DNA, 25 bp, Mus musculus
tagcccctccgtgtttgcgcatgga

SEQ ID NO: 129336 - DNA, 25 bp, Mus musculus
tagcccctggaactttgccttcaca

SEQ ID NO: 129337 - DNA, 25 bp, Mus musculus
tagcccgaagaagaaactcggagaa

SEQ ID NO: 129338 - DNA, 25 bp, Mus musculus
tagcccgaagggtagcgatgattga

SEQ ID NO: 129339 - DNA, 25 bp, Mus musculus
tagcccgctcgagtttcaatgcgcg

SEQ ID NO: 129340 - DNA, 25 bp, Mus musculus
tagcccggagttgacaaagaacagt

SEQ ID NO: 129341 - DNA, 25 bp, Mus musculus
tagcccggattgaaggtctgcagcc

SEQ ID NO: 129342 - DNA, 25 bp, Mus musculus
tagcccggctaatcatggaagtacg

SEQ ID NO: 129343 - DNA, 25 bp, Mus musculus
tagcccgtgagttttgagacagcag

SEQ ID NO: 129344 - DNA, 25 bp, Mus musculus
tagcccgtgtggaattgagcctcag

SEQ ID NO: 129345 - DNA, 25 bp, Mus musculus
tagccctatatctggaggaggccca

SEQ ID NO: 129346 - DNA, 25 bp, Mus musculus
tagccctgagaattagcaatgttcg

SEQ ID NO: 129347 - DNA, 25 bp, Mus musculus
tagccctgcagctggcatactacag

SEQ ID NO: 129348 - DNA, 25 bp, Mus musculus
tagccctgtgccatcctttggagaa

SEQ ID NO: 129349 - DNA, 25 bp, Mus musculus
tagccctgtggtagttgagaaatcc

SEQ ID NO: 129350 - DNA, 25 bp, Mus musculus
tagcccttgtgtttactccctgcga

SEQ ID NO: 129351 - DNA, 25 bp, Mus musculus
tagccctttgggtgtcgtttgtgaa

SEQ ID NO: 129352 - DNA, 25 bp, Mus musculus
tagccgaagggaagggcaacgtcat

SEQ ID NO: 129353 - DNA, 25 bp, Mus musculus
tagccgacaatgtgtggtagacaaa

SEQ ID NO: 129354 - DNA, 25 bp, Mus musculus
tagccgaccgattgcagaggcaaga

SEQ ID NO: 129355 - DNA, 25 bp, Mus musculus
tagccgagaacagagggaagaaccg

SEQ ID NO: 129356 - DNA, 25 bp, Mus musculus
tagccgagcgctttctagccaagac

SEQ ID NO: 129357 - DNA, 25 bp, Mus musculus
tagccgaggctaggcagaaacttct

SEQ ID NO: 129358 - DNA, 25 bp, Mus musculus
tagccgagggcaccacgcggacatt

SEQ ID NO: 129359 - DNA, 25 bp, Mus musculus
tagccgagtaagtagcggctccctc

SEQ ID NO: 129360 - DNA, 25 bp, Mus musculus
tagccgatgaatgggcaaggccaga

SEQ ID NO: 129361 - DNA, 25 bp, Mus musculus
tagccgcactgaaggatgaagtcca

SEQ ID NO: 129362 - DNA, 25 bp, Mus musculus
tagccgccctgaagtctggcagcat

SEQ ID NO: 129363 - DNA, 25 bp, Mus musculus
tagccgccctgatcagcagtagtgt

SEQ ID NO: 129364 - DNA, 25 bp, Mus musculus
tagccgccttgaagccacaagaatg

SEQ ID NO: 129365 - DNA, 25 bp, Mus musculus
tagccgcggctgtgacgcaaatgtg

SEQ ID NO: 129366 - DNA, 25 bp, Mus musculus
tagccgctggccatccatctatgaa

SEQ ID NO: 129367 - DNA, 25 bp, Mus musculus
tagccggcagcgattgcaagagatt

SEQ ID NO: 129368 - DNA, 25 bp, Mus musculus
tagccggcccttgcaacaatttcaa

SEQ ID NO: 129369 - DNA, 25 bp, Mus musculus
tagccgggagacctttccacgtttg

SEQ ID NO: 129370 - DNA, 25 bp, Mus musculus
tagccgggcgagtgtagtcaagaaa

SEQ ID NO: 129371 - DNA, 25 bp, Mus musculus
tagccgggtggtacagcgtaacaag

SEQ ID NO: 129372 - DNA, 25 bp, Mus musculus
tagccgtaaaactgtgccgtgaact

SEQ ID NO: 129373 - DNA, 25 bp, Mus musculus
tagccgtcccaaagttgttccagag

SEQ ID NO: 129374 - DNA, 25 bp, Mus musculus
tagccgtgtagaatggagctcccag

SEQ ID NO: 129375 - DNA, 25 bp, Mus musculus
tagcctactggtcaccctggaagat

SEQ ID NO: 129376 - DNA, 25 bp, Mus musculus
tagcctacttgggagactgctgctc

SEQ ID NO: 129377 - DNA, 25 bp, Mus musculus
tagcctagaggtcactgtagcctgc

SEQ ID NO: 129378 - DNA, 25 bp, Mus musculus
tagcctagcccagcatgttcggatc

SEQ ID NO: 129379 - DNA, 25 bp, Mus musculus
tagcctagtcactggagctcgtcca

SEQ ID NO: 129380 - DNA, 25 bp, Mus musculus
tagcctatactatccgcagccagga

SEQ ID NO: 129381 - DNA, 25 bp, Mus musculus
tagcctatttccacctggaggagat

SEQ ID NO: 129382 - DNA, 25 bp, Mus musculus
tagcctcaagatgtcacaaggtggt

SEQ ID NO: 129383 - DNA, 25 bp, Mus musculus
tagcctcatctccagaagagctgtg

SEQ ID NO: 129384 - DNA, 25 bp, Mus musculus
tagcctcgtggaactagactcttgg

SEQ ID NO: 129385 - DNA, 25 bp, Mus musculus
tagcctgagcctccagcatagactg

SEQ ID NO: 129386 - DNA, 25 bp, Mus musculus
tagcctgagctaccttatccaagtg

SEQ ID NO: 129387 - DNA, 25 bp, Mus musculus
tagcctgcatggacgagaatggacc

SEQ ID NO: 129388 - DNA, 25 bp, Mus musculus
tagcctgctctagggactcttctgg

SEQ ID NO: 129389 - DNA, 25 bp, Mus musculus
tagcctggaaaaaatgacggatctc

SEQ ID NO: 129390 - DNA, 25 bp, Mus musculus
tagcctgggcagtggagtaagacct

SEQ ID NO: 129391 - DNA, 25 bp, Mus musculus
tagcctgtacaacatccacctgagg

SEQ ID NO: 129392 - DNA, 25 bp, Mus musculus
tagcctgtgaatgtccacctggacc

SEQ ID NO: 129393 - DNA, 25 bp, Mus musculus
tagcctgttggaacggcaagacttt

SEQ ID NO: 129394 - DNA, 25 bp, Mus musculus
tagcctgttggcatgtgagtagccc

SEQ ID NO: 129395 - DNA, 25 bp, Mus musculus
tagccttaagcagctcagtgggccc

SEQ ID NO: 129396 - DNA, 25 bp, Mus musculus
tagccttaataaatcaatgtgcgca

SEQ ID NO: 129397 - DNA, 25 bp, Mus musculus
tagccttcatagttagcattcagaa

SEQ ID NO: 129398 - DNA, 25 bp, Mus musculus
tagccttggtgcaaatggaccgact

SEQ ID NO: 129399 - DNA, 25 bp, Mus musculus
tagccttgttcgaagtctccagaaa

SEQ ID NO: 129400 - DNA, 25 bp, Mus musculus
tagccttttgtcacccgagttgtgg

SEQ ID NO: 129401 - DNA, 25 bp, Mus musculus
tagcgaaagcgtatgccatgtctgg

SEQ ID NO: 129402 - DNA, 25 bp, Mus musculus
tagcgaaagtttctaccgaggcctt

SEQ ID NO: 129403 - DNA, 25 bp, Mus musculus
tagcgaagtgctttaaacctgccct

SEQ ID NO: 129404 - DNA, 25 bp, Mus musculus
tagcgacatgagtgaacggctgacc

SEQ ID NO: 129405 - DNA, 25 bp, Mus musculus
tagcgacttctgtgtcaagaacatc

SEQ ID NO: 129406 - DNA, 25 bp, Mus musculus
tagcgagattcaacgacctcaggtt

SEQ ID NO: 129407 - DNA, 25 bp, Mus musculus
tagcgatagagaacagtggctcact

SEQ ID NO: 129408 - DNA, 25 bp, Mus musculus
tagcgatgtatgacttccaagcgac

SEQ ID NO: 129409 - DNA, 25 bp, Mus musculus
tagcgccaagggtagacgtgaattc

SEQ ID NO: 129410 - DNA, 25 bp, Mus musculus
tagcgccatttcactaaggagcctt

SEQ ID NO: 129411 - DNA, 25 bp, Mus musculus
tagcgccctacacggaatcgaggag

SEQ ID NO: 129412 - DNA, 25 bp, Mus musculus
tagcgccgcctttcggcagaagctg

SEQ ID NO: 129413 - DNA, 25 bp, Mus musculus
tagcgccgttccttccctcagaacg

SEQ ID NO: 129414 - DNA, 25 bp, Mus musculus
tagcgctggctgatatctttggttc

SEQ ID NO: 129415 - DNA, 25 bp, Mus musculus
tagcggaagtccttgagcacccttg

SEQ ID NO: 129416 - DNA, 25 bp, Mus musculus
tagcggagaatccaagggcttccag

SEQ ID NO: 129417 - DNA, 25 bp, Mus musculus
tagcggaggcgtatgttaatctggc

SEQ ID NO: 129418 - DNA, 25 bp, Mus musculus
tagcggatctcatgtctctggagga

SEQ ID NO: 129419 - DNA, 25 bp, Mus musculus
tagcggcacggcattttctcggcgg

SEQ ID NO: 129420 - DNA, 25 bp, Mus musculus
tagcggccgggttgctgaagaacca

SEQ ID NO: 129421 - DNA, 25 bp, Mus musculus
tagcggctgggatgcttattcctca

SEQ ID NO: 129422 - DNA, 25 bp, Mus musculus
tagcgggcgatactgccagcctgaa

SEQ ID NO: 129423 - DNA, 25 bp, Mus musculus
tagcggtcgacgaggaacagctgct

SEQ ID NO: 129424 - DNA, 25 bp, Mus musculus
tagcgtaaccggaactagccgttgc

SEQ ID NO: 129425 - DNA, 25 bp, Mus musculus
tagcgtacatttaaaagggccctgg

SEQ ID NO: 129426 - DNA, 25 bp, Mus musculus
tagcgtccggatccaacacaagtgg

SEQ ID NO: 129427 - DNA, 25 bp, Mus musculus
tagcgtctccgaaaactcgcgcgtc

SEQ ID NO: 129428 - DNA, 25 bp, Mus musculus
tagcgtgatcttgcgttctccaggg

SEQ ID NO: 129429 - DNA, 25 bp, Mus musculus
tagcgtgcagcattttgccgaagca

SEQ ID NO: 129430 - DNA, 25 bp, Mus musculus
tagcgtgggtgtttggaatccgaac

SEQ ID NO: 129431 - DNA, 25 bp, Mus musculus
tagcgtgttccaatttgccagcagc

SEQ ID NO: 129432 - DNA, 25 bp, Mus musculus
tagcgttgctaacgccgccagtgaa

SEQ ID NO: 129433 - DNA, 25 bp, Mus musculus
tagcgtttgtgcttgggaaccgaca

SEQ ID NO: 129434 - DNA, 25 bp, Mus musculus
tagctaagttgtagagagcttgcct

SEQ ID NO: 129435 - DNA, 25 bp, Mus musculus
tagctacactgggtaccaaggtgcg

SEQ ID NO: 129436 - DNA, 25 bp, Mus musculus
tagctacatatacacaagggcaggt

SEQ ID NO: 129437 - DNA, 25 bp, Mus musculus
tagctacatgctctttgaccccaag

SEQ ID NO: 129438 - DNA, 25 bp, Mus musculus
tagctaccagtgtcaggaatcttcc

SEQ ID NO: 129439 - DNA, 25 bp, Mus musculus
tagctacctctaaggctcccattgg

SEQ ID NO: 129440 - DNA, 25 bp, Mus musculus
tagctacgtgttttgctcaagagac

SEQ ID NO: 129441 - DNA, 25 bp, Mus musculus
tagctagagacagaggcggaaacca

SEQ ID NO: 129442 - DNA, 25 bp, Mus musculus
tagctagcagttattcacgacttgc

SEQ ID NO: 129443 - DNA, 25 bp, Mus musculus
tagctagcagttgttggcacgtgga

SEQ ID NO: 129444 - DNA, 25 bp, Mus musculus
tagctagtccagcaaagatgcaggc

SEQ ID NO: 129445 - DNA, 25 bp, Mus musculus
tagctatagccacaggaatggcccg

SEQ ID NO: 129446 - DNA, 25 bp, Mus musculus
tagctattgagtatgccccgcatgg

SEQ ID NO: 129447 - DNA, 25 bp, Mus musculus
tagctcacacccttagcactgggag

SEQ ID NO: 129448 - DNA, 25 bp, Mus musculus
tagctcacggtaccagcaatggacc

SEQ ID NO: 129449 - DNA, 25 bp, Mus musculus
tagctcagcaggtcaatggcaccag

SEQ ID NO: 129450 - DNA, 25 bp, Mus musculus
tagctcagctgaggagtccgtgaac

SEQ ID NO: 129451 - DNA, 25 bp, Mus musculus
tagctcagtggatgcatgcgcgtgc

SEQ ID NO: 129452 - DNA, 25 bp, Mus musculus
tagctccagcggacaagaacaagcg

SEQ ID NO: 129453 - DNA, 25 bp, Mus musculus
tagctccgctcttgaccgtgcgcaa

SEQ ID NO: 129454 - DNA, 25 bp, Mus musculus
tagctcctcagaagccctgctgtgt

SEQ ID NO: 129455 - DNA, 25 bp, Mus musculus
tagctcctgcagacgcttccggcga

SEQ ID NO: 129456 - DNA, 25 bp, Mus musculus
tagctccttgcacggacatatgcag

SEQ ID NO: 129457 - DNA, 25 bp, Mus musculus
tagctcgctctcctcggaaagggcg

SEQ ID NO: 129458 - DNA, 25 bp, Mus musculus
tagctcgggagagcagccatcagcc

SEQ ID NO: 129459 - DNA, 25 bp, Mus musculus
tagctctcaggcctaggatggaaga

SEQ ID NO: 129460 - DNA, 25 bp, Mus musculus
tagctctggagacctctttgcggcg

SEQ ID NO: 129461 - DNA, 25 bp, Mus musculus
tagctctgggcttcacatctttggg

SEQ ID NO: 129462 - DNA, 25 bp, Mus musculus
tagctctgtgctgaactggatcctg

SEQ ID NO: 129463 - DNA, 25 bp, Mus musculus
tagctctgtggttgcgtcatgatcc

SEQ ID NO: 129464 - DNA, 25 bp, Mus musculus
tagctcttctcgtggactaggtggc

SEQ ID NO: 129465 - DNA, 25 bp, Mus musculus
tagctgaatgtctcttaactggccc

SEQ ID NO: 129466 - DNA, 25 bp, Mus musculus
tagctgaccagctcctagagggcag

SEQ ID NO: 129467 - DNA, 25 bp, Mus musculus
tagctgacctgaagcagaatgacca

SEQ ID NO: 129468 - DNA, 25 bp, Mus musculus
tagctgacgctcagaacactggcca

SEQ ID NO: 129469 - DNA, 25 bp, Mus musculus
tagctgagcacgtgcagtacatggc

SEQ ID NO: 129470 - DNA, 25 bp, Mus musculus
tagctgagccacaagtactgcttgg

SEQ ID NO: 129471 - DNA, 25 bp, Mus musculus
tagctgatacagtgctcaatgatga

SEQ ID NO: 129472 - DNA, 25 bp, Mus musculus
tagctgatctccctgtgaaggccca

SEQ ID NO: 129473 - DNA, 25 bp, Mus musculus
tagctgatgcttgccctggaaagcg

SEQ ID NO: 129474 - DNA, 25 bp, Mus musculus
tagctgcaaagaacaggcggacttg

SEQ ID NO: 129475 - DNA, 25 bp, Mus musculus
tagctgcacaaataggatgcgcggc

SEQ ID NO: 129476 - DNA, 25 bp, Mus musculus
tagctgcagaaatggcacggaccag

SEQ ID NO: 129477 - DNA, 25 bp, Mus musculus
tagctgcagctgtttagaaaggccc

SEQ ID NO: 129478 - DNA, 25 bp, Mus musculus
tagctgcatgcgtcgtgatacgaag

SEQ ID NO: 129479 - DNA, 25 bp, Mus musculus
tagctgccatgccttttacccacgg

SEQ ID NO: 129480 - DNA, 25 bp, Mus musculus
tagctgccgaaagcccaggatgtac

SEQ ID NO: 129481 - DNA, 25 bp, Mus musculus
tagctgcgcaggctttctgtgcatg

SEQ ID NO: 129482 - DNA, 25 bp, Mus musculus
tagctgcgcagtttccccgaagtaa

SEQ ID NO: 129483 - DNA, 25 bp, Mus musculus
tagctgcgcatgagtctgagttcca

SEQ ID NO: 129484 - DNA, 25 bp, Mus musculus
tagctgcgggaaacactaaagtcca

SEQ ID NO: 129485 - DNA, 25 bp, Mus musculus
tagctgctgaggctccaacgagatc

SEQ ID NO: 129486 - DNA, 25 bp, Mus musculus
tagctgctgcttgaacaccttgaag

SEQ ID NO: 129487 - DNA, 25 bp, Mus musculus
tagctgctggagtcaaaccaagcca

SEQ ID NO: 129488 - DNA, 25 bp, Mus musculus
tagctgcttatgtaccaagaggtcc

SEQ ID NO: 129489 - DNA, 25 bp, Mus musculus
tagctggatcagagaatgacttcct

SEQ ID NO: 129490 - DNA, 25 bp, Mus musculus
tagctggccaggaagccagactctg

SEQ ID NO: 129491 - DNA, 25 bp, Mus musculus
tagctggcgaagaggacacagactc

SEQ ID NO: 129492 - DNA, 25 bp, Mus musculus
tagctggttcaaagcctaggcggct

SEQ ID NO: 129493 - DNA, 25 bp, Mus musculus
tagctggtttacagaaagcatggca

SEQ ID NO: 129494 - DNA, 25 bp, Mus musculus
tagctgtccagggttatttatttcc

SEQ ID NO: 129495 - DNA, 25 bp, Mus musculus
tagctgtccatgcagagaacttcca

SEQ ID NO: 129496 - DNA, 25 bp, Mus musculus
tagctgtgacgtataaccgcgatgg

SEQ ID NO: 129497 - DNA, 25 bp, Mus musculus
tagctgtgagaagttcccaccggaa

SEQ ID NO: 129498 - DNA, 25 bp, Mus musculus
tagctgtgatgtttgaccgctgccg

SEQ ID NO: 129499 - DNA, 25 bp, Mus musculus
tagctgtgcccaacaagagagatga

SEQ ID NO: 129500 - DNA, 25 bp, Mus musculus
tagctgtggaattcacctggcagga

SEQ ID NO: 129501 - DNA, 25 bp, Mus musculus
tagctgtggccttgccagaagagcc

SEQ ID NO: 129502 - DNA, 25 bp, Mus musculus
tagctgtggcttctgaccgctgctc

SEQ ID NO: 129503 - DNA, 25 bp, Mus musculus
tagctgtgtcagcaagacggcagcc

SEQ ID NO: 129504 - DNA, 25 bp, Mus musculus
tagctgtgtcctgcatcgttctggg

SEQ ID NO: 129505 - DNA, 25 bp, Mus musculus
tagctgtgtcgccttctggtaaccg

SEQ ID NO: 129506 - DNA, 25 bp, Mus musculus
tagctgtgtcgtcccacgtggtgac

SEQ ID NO: 129507 - DNA, 25 bp, Mus musculus
tagcttaagctttgatgtccccaga

SEQ ID NO: 129508 - DNA, 25 bp, Mus musculus
tagcttagccctgctgcagaggcag

SEQ ID NO: 129509 - DNA, 25 bp, Mus musculus
tagcttcacctatgctcagcagaag

SEQ ID NO: 129510 - DNA, 25 bp, Mus musculus
tagcttcagatggaacacctgctgc

SEQ ID NO: 129511 - DNA, 25 bp, Mus musculus
tagcttccggaaacaaatacaaggg

SEQ ID NO: 129512 - DNA, 25 bp, Mus musculus
tagcttcctgtctggagcgagccct

SEQ ID NO: 129513 - DNA, 25 bp, Mus musculus
tagcttctggtgcattggtgacacc

SEQ ID NO: 129514 - DNA, 25 bp, Mus musculus
tagcttcttcttcaccagatctggg

SEQ ID NO: 129515 - DNA, 25 bp, Mus musculus
tagcttctttgagtgcgcagtgcca

SEQ ID NO: 129516 - DNA, 25 bp, Mus musculus
tagcttgacaggagagacagctccg

SEQ ID NO: 129517 - DNA, 25 bp, Mus musculus
tagcttgcctatgcacggtgctgtg

SEQ ID NO: 129518 - DNA, 25 bp, Mus musculus
tagcttgctgcatatcgttggacac

SEQ ID NO: 129519 - DNA, 25 bp, Mus musculus
tagcttggaactgagtgaagacaca

SEQ ID NO: 129520 - DNA, 25 bp, Mus musculus
tagcttggacaaaaggaagttctcc

SEQ ID NO: 129521 - DNA, 25 bp, Mus musculus
tagcttggagggttccacacagccc

SEQ ID NO: 129522 - DNA, 25 bp, Mus musculus
tagcttggcttatggactgaggtca

SEQ ID NO: 129523 - DNA, 25 bp, Mus musculus
tagcttgggtctagcctactggcac

SEQ ID NO: 129524 - DNA, 25 bp, Mus musculus
tagcttggtagatcatttcctctcg

SEQ ID NO: 129525 - DNA, 25 bp, Mus musculus
tagcttgtggagcatcctgcgcaac

SEQ ID NO: 129526 - DNA, 25 bp, Mus musculus
tagctttagggtagtgccagacaaa

SEQ ID NO: 129527 - DNA, 25 bp, Mus musculus
tagctttagtatttgtggacctgca

SEQ ID NO: 129528 - DNA, 25 bp, Mus musculus
tagctttcccaccattggagcagag

SEQ ID NO: 129529 - DNA, 25 bp, Mus musculus
tagctttggtggcagagtcctcgtc

SEQ ID NO: 129530 - DNA, 25 bp, Mus musculus
tagctttggtgggacattcaacgac

SEQ ID NO: 129531 - DNA, 25 bp, Mus musculus
tagcttttcctggtaaggcagaccc

SEQ ID NO: 129532 - DNA, 25 bp, Mus musculus
tagcttttggttgctcgccctggaa

SEQ ID NO: 129533 - DNA, 25 bp, Mus musculus
taggaaaagaacaccctgagctggg

SEQ ID NO: 129534 - DNA, 25 bp, Mus musculus
taggaaaccaaagcaagtctgtgag

SEQ ID NO: 129535 - DNA, 25 bp, Mus musculus
taggaaaccaagctacgcaggcgta

SEQ ID NO: 129536 - DNA, 25 bp, Mus musculus
taggaaaccttcagccctggatgca

SEQ ID NO: 129537 - DNA, 25 bp, Mus musculus
taggaaacggagagaacacagcttg

SEQ ID NO: 129538 - DNA, 25 bp, Mus musculus
taggaaagtgcatgacccctctgtc

SEQ ID NO: 129539 - DNA, 25 bp, Mus musculus
taggaacactgagagataagcaatc

SEQ ID NO: 129540 - DNA, 25 bp, Mus musculus
taggaacagtctatgggcctgaatt

SEQ ID NO: 129541 - DNA, 25 bp, Mus musculus
taggaaccttaagcagcccctttga

SEQ ID NO: 129542 - DNA, 25 bp, Mus musculus
taggaacgcacccatacaaaaggct

SEQ ID NO: 129543 - DNA, 25 bp, Mus musculus
taggaacgtcaaagaaagtgccgcc

SEQ ID NO: 129544 - DNA, 25 bp, Mus musculus
taggaactcctaacgatggcactgc

SEQ ID NO: 129545 - DNA, 25 bp, Mus musculus
taggaactgcaactttcaccatggc

SEQ ID NO: 129546 - DNA, 25 bp, Mus musculus
taggaactgttagcctgcacttggg

SEQ ID NO: 129547 - DNA, 25 bp, Mus musculus
taggaacttagagtcccagcttggg

SEQ ID NO: 129548 - DNA, 25 bp, Mus musculus
taggaacttgaaatgcgaccctccg

SEQ ID NO: 129549 - DNA, 25 bp, Mus musculus
taggaagactgactcgtgtggaacc

SEQ ID NO: 129550 - DNA, 25 bp, Mus musculus
taggaagactgcacataacggtacc

SEQ ID NO: 129551 - DNA, 25 bp, Mus musculus
taggaagccaccatcccgcttgtgg

SEQ ID NO: 129552 - DNA, 25 bp, Mus musculus
taggaagctgcttaacccaacgacg

SEQ ID NO: 129553 - DNA, 25 bp, Mus musculus
taggaaggccagttccaaagcaccg

SEQ ID NO: 129554 - DNA, 25 bp, Mus musculus
taggaagtcactatgcagaagcaga

SEQ ID NO: 129555 - DNA, 25 bp, Mus musculus
taggaagtcttggagccgctggaca

SEQ ID NO: 129556 - DNA, 25 bp, Mus musculus
taggaatatgagtgacatgctagct

SEQ ID NO: 129557 - DNA, 25 bp, Mus musculus
taggaatcgatttgacagccccaag

SEQ ID NO: 129558 - DNA, 25 bp, Mus musculus
taggaatgagagttcccgcgaaagc

SEQ ID NO: 129559 - DNA, 25 bp, Mus musculus
taggaatggtgctcccctgttgcgg

SEQ ID NO: 129560 - DNA, 25 bp, Mus musculus
taggaattgcttgctacggcctggc

SEQ ID NO: 129561 - DNA, 25 bp, Mus musculus
taggaattggctgccctgtgaccac

SEQ ID NO: 129562 - DNA, 25 bp, Mus musculus
taggacaaaggtgaaccccagactg

SEQ ID NO: 129563 - DNA, 25 bp, Mus musculus
taggacagacgacaaaactcaactc

SEQ ID NO: 129564 - DNA, 25 bp, Mus musculus
taggacaggtatcatgccccaggtt

SEQ ID NO: 129565 - DNA, 25 bp, Mus musculus
taggaccactaactccagacagtga

SEQ ID NO: 129566 - DNA, 25 bp, Mus musculus
taggaccagaaaccacaagacacgt

SEQ ID NO: 129567 - DNA, 25 bp, Mus musculus
taggaccagcgtgtctaatcattct

SEQ ID NO: 129568 - DNA, 25 bp, Mus musculus
taggacccagcatggcctaacagtg

SEQ ID NO: 129569 - DNA, 25 bp, Mus musculus
taggacccctcctgagaaattgaag

SEQ ID NO: 129570 - DNA, 25 bp, Mus musculus
taggacccctttgccaacggtgaat

SEQ ID NO: 129571 - DNA, 25 bp, Mus musculus
taggaccgtgcagtatccagcagga

SEQ ID NO: 129572 - DNA, 25 bp, Mus musculus
taggacctgccttgtgggcacactg

SEQ ID NO: 129573 - DNA, 25 bp, Mus musculus
taggactacagctgggaaagatggt

SEQ ID NO: 129574 - DNA, 25 bp, Mus musculus
taggactcacattggacagcagcgt

SEQ ID NO: 129575 - DNA, 25 bp, Mus musculus
taggactcagagcacaaaccggttc

SEQ ID NO: 129576 - DNA, 25 bp, Mus musculus
taggactccaagagatcagggactc

SEQ ID NO: 129577 - DNA, 25 bp, Mus musculus
taggactgccgaggacttcgtaggc

SEQ ID NO: 129578 - DNA, 25 bp, Mus musculus
taggactgctttagtggatggccac

SEQ ID NO: 129579 - DNA, 25 bp, Mus musculus
taggactgtcctcatcgtgaccaag

SEQ ID NO: 129580 - DNA, 25 bp, Mus musculus
taggactgttcctccagttcagaag

SEQ ID NO: 129581 - DNA, 25 bp, Mus musculus
taggacttgggcactcccgatatac

SEQ ID NO: 129582 - DNA, 25 bp, Mus musculus
taggagaagccaagtcagcatgggc

SEQ ID NO: 129583 - DNA, 25 bp, Mus musculus
taggagacaagtgccagacctgagc

SEQ ID NO: 129584 - DNA, 25 bp, Mus musculus
taggagagaattcaaccatggcccc

SEQ ID NO: 129585 - DNA, 25 bp, Mus musculus
taggagagacgaacaagaggaacac

SEQ ID NO: 129586 - DNA, 25 bp, Mus musculus
taggagagactgaccccgaggctca

SEQ ID NO: 129587 - DNA, 25 bp, Mus musculus
taggagagctctacgtggtacacca

SEQ ID NO: 129588 - DNA, 25 bp, Mus musculus
taggagagctgctaacgccttcttc

SEQ ID NO: 129589 - DNA, 25 bp, Mus musculus
taggagatctgcacattccgcaccg

SEQ ID NO: 129590 - DNA, 25 bp, Mus musculus
taggagcaaggcctttccggttctc

SEQ ID NO: 129591 - DNA, 25 bp, Mus musculus
taggagcacacaggcgcactcactg

SEQ ID NO: 129592 - DNA, 25 bp, Mus musculus
taggagcagttacttccagactgtg

SEQ ID NO: 129593 - DNA, 25 bp, Mus musculus
taggagcataccttcacatcagatg

SEQ ID NO: 129594 - DNA, 25 bp, Mus musculus
taggagccaagtgtaaaaacctgcg

SEQ ID NO: 129595 - DNA, 25 bp, Mus musculus
taggagcccacacaagcggttatag

SEQ ID NO: 129596 - DNA, 25 bp, Mus musculus
taggagccctgttggtgagaaaccc

SEQ ID NO: 129597 - DNA, 25 bp, Mus musculus
taggagccgcaagctaaaagccagg

SEQ ID NO: 129598 - DNA, 25 bp, Mus musculus
taggagccgctagccagtttgaagc

SEQ ID NO: 129599 - DNA, 25 bp, Mus musculus
taggagcctttttgagggaccgcct

SEQ ID NO: 129600 - DNA, 25 bp, Mus musculus
taggagctatagtgtccactcacgc

SEQ ID NO: 129601 - DNA, 25 bp, Mus musculus
taggaggctcatcatctgggaagaa

SEQ ID NO: 129602 - DNA, 25 bp, Mus musculus
taggaggtgcctaagctccattggc

SEQ ID NO: 129603 - DNA, 25 bp, Mus musculus
taggaggtggttctgtccgaatcca

SEQ ID NO: 129604 - DNA, 25 bp, Mus musculus
taggaggttcctaggacttgggcat

SEQ ID NO: 129605 - DNA, 25 bp, Mus musculus
taggagtaaatgacgtgccactgca

SEQ ID NO: 129606 - DNA, 25 bp, Mus musculus
taggagtcacagaacagcaacctgg

SEQ ID NO: 129607 - DNA, 25 bp, Mus musculus
taggagtcccattagcccagaacta

SEQ ID NO: 129608 - DNA, 25 bp, Mus musculus
taggagtcctagacgaggtcggtca

SEQ ID NO: 129609 - DNA, 25 bp, Mus musculus
taggagtcgccttgcagccataaag

SEQ ID NO: 129610 - DNA, 25 bp, Mus musculus
taggagtggacaacccagctgctgt

SEQ ID NO: 129611 - DNA, 25 bp, Mus musculus
taggagtggtgcaccttacgccctt

SEQ ID NO: 129612 - DNA, 25 bp, Mus musculus
taggagtgttcgtgcagctgatgcc

SEQ ID NO: 129613 - DNA, 25 bp, Mus musculus
taggagttttgggacctccagggca

SEQ ID NO: 129614 - DNA, 25 bp, Mus musculus
taggataacctgtctggcgcagcag

SEQ ID NO: 129615 - DNA, 25 bp, Mus musculus
taggatacacagaccgtgtggtgcg

SEQ ID NO: 129616 - DNA, 25 bp, Mus musculus
taggatcagcatgtggttcccagca

SEQ ID NO: 129617 - DNA, 25 bp, Mus musculus
taggatccagaatagcccgaagaag

SEQ ID NO: 129618 - DNA, 25 bp, Mus musculus
taggatccgggagtttgtgccacct

SEQ ID NO: 129619 - DNA, 25 bp, Mus musculus
taggatcctctgcagatttccactg

SEQ ID NO: 129620 - DNA, 25 bp, Mus musculus
taggatctcgcctggaaacagaggg

SEQ ID NO: 129621 - DNA, 25 bp, Mus musculus
taggatgaaacagttgcctgcagca

SEQ ID NO: 129622 - DNA, 25 bp, Mus musculus
taggatgaacctggaatggacgccc

SEQ ID NO: 129623 - DNA, 25 bp, Mus musculus
taggatgacggctctgcgagcagca

SEQ ID NO: 129624 - DNA, 25 bp, Mus musculus
taggatgcagtacactgctacaaag

SEQ ID NO: 129625 - DNA, 25 bp, Mus musculus
taggatgccttgcaccttaccgaag

SEQ ID NO: 129626 - DNA, 25 bp, Mus musculus
taggatgctgctcaggaccagtcca

SEQ ID NO: 129627 - DNA, 25 bp, Mus musculus
taggatgcttattctaccacggaga

SEQ ID NO: 129628 - DNA, 25 bp, Mus musculus
taggattccttgagtggtctgacca

SEQ ID NO: 129629 - DNA, 25 bp, Mus musculus
taggattgcagctccgttgaaggcg

SEQ ID NO: 129630 - DNA, 25 bp, Mus musculus
taggcaacaggcaactacagcattg

SEQ ID NO: 129631 - DNA, 25 bp, Mus musculus
taggcaagaagacctttacaagtaa

SEQ ID NO: 129632 - DNA, 25 bp, Mus musculus
taggcaagcctcaaccagagctagt

SEQ ID NO: 129633 - DNA, 25 bp, Mus musculus
taggcaagctgatgcggtgccgacc

SEQ ID NO: 129634 - DNA, 25 bp, Mus musculus
taggcaatgtcaccgcctggcagca

SEQ ID NO: 129635 - DNA, 25 bp, Mus musculus
taggcaatgtcaggcactgctgggt

SEQ ID NO: 129636 - DNA, 25 bp, Mus musculus
taggcacacagctgttaacatctgg

SEQ ID NO: 129637 - DNA, 25 bp, Mus musculus
taggcacacgttgtgagctctcctg

SEQ ID NO: 129638 - DNA, 25 bp, Mus musculus
taggcaccagttctgcatgcagtca

SEQ ID NO: 129639 - DNA, 25 bp, Mus musculus
taggcaccatgacacagactctgga

SEQ ID NO: 129640 - DNA, 25 bp, Mus musculus
taggcaccgtctacagcatcatcat

SEQ ID NO: 129641 - DNA, 25 bp, Mus musculus
taggcactgaggatataaacaccct

SEQ ID NO: 129642 - DNA, 25 bp, Mus musculus
taggcactggtgaaagactgggact

SEQ ID NO: 129643 - DNA, 25 bp, Mus musculus
taggcagagaaaccaccagctgtgt

SEQ ID NO: 129644 - DNA, 25 bp, Mus musculus
taggcagatcttgcatcccgaggct

SEQ ID NO: 129645 - DNA, 25 bp, Mus musculus
taggcagcccgttcaggaagtggac

SEQ ID NO: 129646 - DNA, 25 bp, Mus musculus
taggcagcttattgttccgaacgag

SEQ ID NO: 129647 - DNA, 25 bp, Mus musculus
taggcaggagtgtcctacacaaggc

SEQ ID NO: 129648 - DNA, 25 bp, Mus musculus
taggcaggatttccacaggttcgtg

SEQ ID NO: 129649 - DNA, 25 bp, Mus musculus
taggcaggtaagtccaaagggcaga

SEQ ID NO: 129650 - DNA, 25 bp, Mus musculus
taggcatccactcaggtctagctgg

SEQ ID NO: 129651 - DNA, 25 bp, Mus musculus
taggcatccgcaaacagaaacaggg

SEQ ID NO: 129652 - DNA, 25 bp, Mus musculus
taggcatgcccgtcaaagcagatgg

SEQ ID NO: 129653 - DNA, 25 bp, Mus musculus
taggcattccaaactcgaggctccg

SEQ ID NO: 129654 - DNA, 25 bp, Mus musculus
taggcattcgtccactagacctgtg

SEQ ID NO: 129655 - DNA, 25 bp, Mus musculus
taggccacaggcttaattttgattg

SEQ ID NO: 129656 - DNA, 25 bp, Mus musculus
taggccacggcgtgacaaaagcgtg

SEQ ID NO: 129657 - DNA, 25 bp, Mus musculus
taggccacgtggctaagcaaacagc

SEQ ID NO: 129658 - DNA, 25 bp, Mus musculus
taggccagcatgttggactcactcc

SEQ ID NO: 129659 - DNA, 25 bp, Mus musculus
taggccaggcctttacaataatgct

SEQ ID NO: 129660 - DNA, 25 bp, Mus musculus
taggccagtctcgtagagcataaga

SEQ ID NO: 129661 - DNA, 25 bp, Mus musculus
taggccatagtctgccatcatgaag

SEQ ID NO: 129662 - DNA, 25 bp, Mus musculus
taggcccacacctggaaagcttgtg

SEQ ID NO: 129663 - DNA, 25 bp, Mus musculus
taggcccagcgctgtagtatacgcg

SEQ ID NO: 129664 - DNA, 25 bp, Mus musculus
taggcccaggttatttccggaagcg

SEQ ID NO: 129665 - DNA, 25 bp, Mus musculus
taggccccaacatgtttccctggta

SEQ ID NO: 129666 - DNA, 25 bp, Mus musculus
taggccccagcttttacatcgtgat

SEQ ID NO: 129667 - DNA, 25 bp, Mus musculus
taggcccgtacaatgaagaactccg

SEQ ID NO: 129668 - DNA, 25 bp, Mus musculus
taggccctcaccaggcaagtaacag

SEQ ID NO: 129669 - DNA, 25 bp, Mus musculus
taggccctgttgtgcaataaactgt

SEQ ID NO: 129670 - DNA, 25 bp, Mus musculus
taggccgctgagcacggcgtgcggt

SEQ ID NO: 129671 - DNA, 25 bp, Mus musculus
taggccgctttttcctgtaccacat

SEQ ID NO: 129672 - DNA, 25 bp, Mus musculus
taggcctacgcaagatcaacatatc

SEQ ID NO: 129673 - DNA, 25 bp, Mus musculus
taggcctccaaaatgttttgtgctc

SEQ ID NO: 129674 - DNA, 25 bp, Mus musculus
taggcctcctattcacaaggttctg

SEQ ID NO: 129675 - DNA, 25 bp, Mus musculus
taggcctctgcattggaactggaac

SEQ ID NO: 129676 - DNA, 25 bp, Mus musculus
taggcctggcttttgttagcccaga

SEQ ID NO: 129677 - DNA, 25 bp, Mus musculus
taggcctgtgcagaaacatagtagt

SEQ ID NO: 129678 - DNA, 25 bp, Mus musculus
taggcgaagtcgatctggaacatac

SEQ ID NO: 129679 - DNA, 25 bp, Mus musculus
taggcgccgttatcgacattgctgg

SEQ ID NO: 129680 - DNA, 25 bp, Mus musculus
taggcgctttgaccggaatgagatt

SEQ ID NO: 129681 - DNA, 25 bp, Mus musculus
taggcggcgaacaaggagaactgcc

SEQ ID NO: 129682 - DNA, 25 bp, Mus musculus
taggcggcgctctttagggaatatc

SEQ ID NO: 129683 - DNA, 25 bp, Mus musculus
taggcggtcactctgctcaagggat

SEQ ID NO: 129684 - DNA, 25 bp, Mus musculus
taggcgtaaaattcagcattccaag

SEQ ID NO: 129685 - DNA, 25 bp, Mus musculus
taggcgttgttctctacactggcag

SEQ ID NO: 129686 - DNA, 25 bp, Mus musculus
taggctaactgcagaccacagaggc

SEQ ID NO: 129687 - DNA, 25 bp, Mus musculus
taggctaccatctggcaatgcagga

SEQ ID NO: 129688 - DNA, 25 bp, Mus musculus
taggctacgggcatcagcttcaagg

SEQ ID NO: 129689 - DNA, 25 bp, Mus musculus
taggctactgctgtatggactcagg

SEQ ID NO: 129690 - DNA, 25 bp, Mus musculus
taggctagctttgaaggactcccag

SEQ ID NO: 129691 - DNA, 25 bp, Mus musculus
taggctattcacacagctctgctgc

SEQ ID NO: 129692 - DNA, 25 bp, Mus musculus
taggctcaagcagataacgtttctg

SEQ ID NO: 129693 - DNA, 25 bp, Mus musculus
taggctctgtggtagatctgagtcc

SEQ ID NO: 129694 - DNA, 25 bp, Mus musculus
taggctctttctggactttcacaca

SEQ ID NO: 129695 - DNA, 25 bp, Mus musculus
taggctgacttctgcaatcaacgag

SEQ ID NO: 129696 - DNA, 25 bp, Mus musculus
taggctgagaggtgtaagcccgccc

SEQ ID NO: 129697 - DNA, 25 bp, Mus musculus
taggctgaggtcagaagtgcccgcc

SEQ ID NO: 129698 - DNA, 25 bp, Mus musculus
taggctgcaagccatacctggacag

SEQ ID NO: 129699 - DNA, 25 bp, Mus musculus
taggctgccccttagaaatgactca

SEQ ID NO: 129700 - DNA, 25 bp, Mus musculus
taggctgcgctaccggaatgtcatc

SEQ ID NO: 129701 - DNA, 25 bp, Mus musculus
taggctgctgcatgaagaacctcat

SEQ ID NO: 129702 - DNA, 25 bp, Mus musculus
taggctgcttcacacctcagagtcg

SEQ ID NO: 129703 - DNA, 25 bp, Mus musculus
taggctgcttcaggactttcgccgg

SEQ ID NO: 129704 - DNA, 25 bp, Mus musculus
taggctggcctctgcggagattcca

SEQ ID NO: 129705 - DNA, 25 bp, Mus musculus
taggctgtcatgcttcatttgctga

SEQ ID NO: 129706 - DNA, 25 bp, Mus musculus
taggctgtgaatgccgcatcgaacc

SEQ ID NO: 129707 - DNA, 25 bp, Mus musculus
taggcttaccgagtccagtttgcaa

SEQ ID NO: 129708 - DNA, 25 bp, Mus musculus
taggcttcagcaagaacgacttcgt

SEQ ID NO: 129709 - DNA, 25 bp, Mus musculus
taggcttcatctctgacgtactgca

SEQ ID NO: 129710 - DNA, 25 bp, Mus musculus
taggcttcgcagagaactcagcagt

SEQ ID NO: 129711 - DNA, 25 bp, Mus musculus
taggcttcggtcgatttcaccaggg

SEQ ID NO: 129712 - DNA, 25 bp, Mus musculus
taggcttgaagccagctcccaataa

SEQ ID NO: 129713 - DNA, 25 bp, Mus musculus
taggctttccctggatgatgacggc

SEQ ID NO: 129714 - DNA, 25 bp, Mus musculus
tagggaactgtcagcttcagtgctc

SEQ ID NO: 129715 - DNA, 25 bp, Mus musculus
tagggaagctagaagcacactcctg

SEQ ID NO: 129716 - DNA, 25 bp, Mus musculus
tagggaaggaggactagagtcttta

SEQ ID NO: 129717 - DNA, 25 bp, Mus musculus
tagggaagtcctgacccgtggtgca

SEQ ID NO: 129718 - DNA, 25 bp, Mus musculus
tagggaattactctctgactctggt

SEQ ID NO: 129719 - DNA, 25 bp, Mus musculus
tagggaccaactacagcctgcaagg

SEQ ID NO: 129720 - DNA, 25 bp, Mus musculus
tagggaccagtatctcacatcaatg

SEQ ID NO: 129721 - DNA, 25 bp, Mus musculus
tagggacccgagacaacactctgat

SEQ ID NO: 129722 - DNA, 25 bp, Mus musculus
tagggacccgataggagcagtctcc

SEQ ID NO: 129723 - DNA, 25 bp, Mus musculus
tagggacctcaatgtgtggactgct

SEQ ID NO: 129724 - DNA, 25 bp, Mus musculus
tagggaccttgagcctggttcaacg

SEQ ID NO: 129725 - DNA, 25 bp, Mus musculus
tagggaccttggctttccacactga

SEQ ID NO: 129726 - DNA, 25 bp, Mus musculus
tagggactccaagacgacaggtagt

SEQ ID NO: 129727 - DNA, 25 bp, Mus musculus
tagggactccacagcttctggcaag

SEQ ID NO: 129728 - DNA, 25 bp, Mus musculus
tagggagcttgaaccccaacatcgg

SEQ ID NO: 129729 - DNA, 25 bp, Mus musculus
tagggaggagttagatgccctcaag

SEQ ID NO: 129730 - DNA, 25 bp, Mus musculus
tagggagggctttacgtcagcactg

SEQ ID NO: 129731 - DNA, 25 bp, Mus musculus
tagggatcagtgcaaaactcaggga

SEQ ID NO: 129732 - DNA, 25 bp, Mus musculus
tagggatcccgtgcctgtcaaagag

SEQ ID NO: 129733 - DNA, 25 bp, Mus musculus
tagggatcgtgaccgcacaaaagag

SEQ ID NO: 129734 - DNA, 25 bp, Mus musculus
tagggatgcacgaagctccagtcga

SEQ ID NO: 129735 - DNA, 25 bp, Mus musculus
tagggatgcccaatctacaacaatc

SEQ ID NO: 129736 - DNA, 25 bp, Mus musculus
tagggcaaccaaggcatcactgtga

SEQ ID NO: 129737 - DNA, 25 bp, Mus musculus
tagggcactgaattctgtaggagct

SEQ ID NO: 129738 - DNA, 25 bp, Mus musculus
tagggcagcctgatgttttaataga

SEQ ID NO: 129739 - DNA, 25 bp, Mus musculus
tagggccagcgttaacctctgctcc

SEQ ID NO: 129740 - DNA, 25 bp, Mus musculus
tagggccgtgcttcgaaaatccaaa

SEQ ID NO: 129741 - DNA, 25 bp, Mus musculus
tagggcgaagataaaggatgtccac

SEQ ID NO: 129742 - DNA, 25 bp, Mus musculus
tagggcgcccgtactagcaggtgtt

SEQ ID NO: 129743 - DNA, 25 bp, Mus musculus
tagggcgtgctagacaaggaaccac

SEQ ID NO: 129744 - DNA, 25 bp, Mus musculus
tagggctacatactccaaggtgacc

SEQ ID NO: 129745 - DNA, 25 bp, Mus musculus
tagggctacctactcggatctgtgt

SEQ ID NO: 129746 - DNA, 25 bp, Mus musculus
tagggctagccctaataccagagga

SEQ ID NO: 129747 - DNA, 25 bp, Mus musculus
tagggctaggattgctaacaaccca

SEQ ID NO: 129748 - DNA, 25 bp, Mus musculus
tagggctccgtgtggacctggacct

SEQ ID NO: 129749 - DNA, 25 bp, Mus musculus
tagggctcctcccagtgatacagac

SEQ ID NO: 129750 - DNA, 25 bp, Mus musculus
tagggctgcagctgcttgaactgcc

SEQ ID NO: 129751 - DNA, 25 bp, Mus musculus
tagggctgcctcaagacagggcatc

SEQ ID NO: 129752 - DNA, 25 bp, Mus musculus
tagggcttccgaaaccagagatgag

SEQ ID NO: 129753 - DNA, 25 bp, Mus musculus
tagggcttgtcccaaagaatccatg

SEQ ID NO: 129754 - DNA, 25 bp, Mus musculus
tagggtaatcgactagtctggctgc

SEQ ID NO: 129755 - DNA, 25 bp, Mus musculus
tagggtacaaagacactggaagact

SEQ ID NO: 129756 - DNA, 25 bp, Mus musculus
tagggtcccagacagaacagagttc

SEQ ID NO: 129757 - DNA, 25 bp, Mus musculus
tagggtccctactgatgaaagtgag

SEQ ID NO: 129758 - DNA, 25 bp, Mus musculus
tagggtcctctctcagcaggtctgt

SEQ ID NO: 129759 - DNA, 25 bp, Mus musculus
tagggtccttactgttctccgaggg

SEQ ID NO: 129760 - DNA, 25 bp, Mus musculus
tagggtgcgggtacaatgcctttcc

SEQ ID NO: 129761 - DNA, 25 bp, Mus musculus
tagggtgctccttctcagccaggac

SEQ ID NO: 129762 - DNA, 25 bp, Mus musculus
tagggttccgcgtgggacttcagac

SEQ ID NO: 129763 - DNA, 25 bp, Mus musculus
tagggttgactgatcccgatcccaa

SEQ ID NO: 129764 - DNA, 25 bp, Mus musculus
tagggttgtccaagacaggaggagg

SEQ ID NO: 129765 - DNA, 25 bp, Mus musculus
tagggtttcccctgtcagacgatga

SEQ ID NO: 129766 - DNA, 25 bp, Mus musculus
taggtaaaagtcctggaacctgcca

SEQ ID NO: 129767 - DNA, 25 bp, Mus musculus
taggtaatttatcgtggcccagacg

SEQ ID NO: 129768 - DNA, 25 bp, Mus musculus
taggtacatctgacccaggagcatc

SEQ ID NO: 129769 - DNA, 25 bp, Mus musculus
taggtacgatgacagcattccccga

SEQ ID NO: 129770 - DNA, 25 bp, Mus musculus
taggtacgatgtgctgtccgggaac

SEQ ID NO: 129771 - DNA, 25 bp, Mus musculus
taggtagaagcccatacaggctcta

SEQ ID NO: 129772 - DNA, 25 bp, Mus musculus
taggtagcctcaaaccagggagcgt

SEQ ID NO: 129773 - DNA, 25 bp, Mus musculus
taggtatgccactataggcttgggc

SEQ ID NO: 129774 - DNA, 25 bp, Mus musculus
taggtatgggctgacacacgtttcc

SEQ ID NO: 129775 - DNA, 25 bp, Mus musculus
taggtcaccacccttaattggcagg

SEQ ID NO: 129776 - DNA, 25 bp, Mus musculus
taggtcaccagcacaaatccagatg

SEQ ID NO: 129777 - DNA, 25 bp, Mus musculus
taggtcagcctatgctcggcgagag

SEQ ID NO: 129778 - DNA, 25 bp, Mus musculus
taggtcagcgcaaccaaaggatgga

SEQ ID NO: 129779 - DNA, 25 bp, Mus musculus
taggtcagctctgaggccgcagatc

SEQ ID NO: 129780 - DNA, 25 bp, Mus musculus
taggtcagtacccatgggcagcttc

SEQ ID NO: 129781 - DNA, 25 bp, Mus musculus
taggtcatttccctgttaccacagc

SEQ ID NO: 129782 - DNA, 25 bp, Mus musculus
taggtccacccgaagatagccaagt

SEQ ID NO: 129783 - DNA, 25 bp, Mus musculus
taggtcccctgtgtaaataccgcca

SEQ ID NO: 129784 - DNA, 25 bp, Mus musculus
taggtccctatgtgacccacactgg

SEQ ID NO: 129785 - DNA, 25 bp, Mus musculus
taggtcgctcccgagaactgcagta

SEQ ID NO: 129786 - DNA, 25 bp, Mus musculus
taggtcgtcgagaatactgcaggag

SEQ ID NO: 129787 - DNA, 25 bp, Mus musculus
taggtctcctcacgtaagcacaggg

SEQ ID NO: 129788 - DNA, 25 bp, Mus musculus
taggtctcggagcaaaggtcgatcc

SEQ ID NO: 129789 - DNA, 25 bp, Mus musculus
taggtctgaaactaagggcatctgg

SEQ ID NO: 129790 - DNA, 25 bp, Mus musculus
taggtctgcagggtatagcacagcc

SEQ ID NO: 129791 - DNA, 25 bp, Mus musculus
taggtctgcggcatctggaagtccc

SEQ ID NO: 129792 - DNA, 25 bp, Mus musculus
taggtcttaccgacagggatggctc

SEQ ID NO: 129793 - DNA, 25 bp, Mus musculus
taggtgaactgtactgagcgcctcg

SEQ ID NO: 129794 - DNA, 25 bp, Mus musculus
taggtgatacctcaaacacagagct

SEQ ID NO: 129795 - DNA, 25 bp, Mus musculus
taggtgcaagagaagtccagtcttg

SEQ ID NO: 129796 - DNA, 25 bp, Mus musculus
taggtgcccgaagaacgtcatgatg

SEQ ID NO: 129797 - DNA, 25 bp, Mus musculus
taggtgccggcctctcaatgagaga

SEQ ID NO: 129798 - DNA, 25 bp, Mus musculus
taggtgccttttctccagcaaggag

SEQ ID NO: 129799 - DNA, 25 bp, Mus musculus
taggtgctacaggaaacagcgtccc

SEQ ID NO: 129800 - DNA, 25 bp, Mus musculus
taggtgctcataactctctgttgcc

SEQ ID NO: 129801 - DNA, 25 bp, Mus musculus
taggtgctctaatcctctctagggc

SEQ ID NO: 129802 - DNA, 25 bp, Mus musculus
taggtgctgcacagacttgtcaagg

SEQ ID NO: 129803 - DNA, 25 bp, Mus musculus
taggtggacatgaagatactaacag

SEQ ID NO: 129804 - DNA, 25 bp, Mus musculus
taggtgggactgttccaagacactc

SEQ ID NO: 129805 - DNA, 25 bp, Mus musculus
taggtggttctctaacccaagccgg

SEQ ID NO: 129806 - DNA, 25 bp, Mus musculus
taggtgtagctctgtggttgcgtca

SEQ ID NO: 129807 - DNA, 25 bp, Mus musculus
taggtgtatggctaacccaagatgg

SEQ ID NO: 129808 - DNA, 25 bp, Mus musculus
taggtgtcgcctaaactcttctgct

SEQ ID NO: 129809 - DNA, 25 bp, Mus musculus
taggtgtgattgaaggccagactcc

SEQ ID NO: 129810 - DNA, 25 bp, Mus musculus
taggtgtgcctcagctggacttgac

SEQ ID NO: 129811 - DNA, 25 bp, Mus musculus
taggtgtgttgaccacggtagccaa

SEQ ID NO: 129812 - DNA, 25 bp, Mus musculus
taggtgtttacagtagggtcaggcc

SEQ ID NO: 129813 - DNA, 25 bp, Mus musculus
taggttacctatgactccaaagctt

SEQ ID NO: 129814 - DNA, 25 bp, Mus musculus
taggttactgccagtgaccgctctg

SEQ ID NO: 129815 - DNA, 25 bp, Mus musculus
taggttcaagcccacgtatctctga

SEQ ID NO: 129816 - DNA, 25 bp, Mus musculus
taggttccacaatggtacaggcagc

SEQ ID NO: 129817 - DNA, 25 bp, Mus musculus
taggttccgcgactgtgaccatggc

SEQ ID NO: 129818 - DNA, 25 bp, Mus musculus
taggttcgccagtcctgcctatttc

SEQ ID NO: 129819 - DNA, 25 bp, Mus musculus
taggttcgtggttgagctacagcag

SEQ ID NO: 129820 - DNA, 25 bp, Mus musculus
taggttctcggaagccaaaccagcc

SEQ ID NO: 129821 - DNA, 25 bp, Mus musculus
taggttgatatccagcctgctccaa

SEQ ID NO: 129822 - DNA, 25 bp, Mus musculus
taggtttaggaacgctctagtggca

SEQ ID NO: 129823 - DNA, 25 bp, Mus musculus
taggtttcgccctggtgttggacac

SEQ ID NO: 129824 - DNA, 25 bp, Mus musculus
taggtttgcagacccgaaccactgg

SEQ ID NO: 129825 - DNA, 25 bp, Mus musculus
taggtttggcctatggttacaactc

SEQ ID NO: 129826 - DNA, 25 bp, Mus musculus
taggttttatagcactcgcccaggg

SEQ ID NO: 129827 - DNA, 25 bp, Mus musculus
taggttttggatgcaaggtcacaac

SEQ ID NO: 129828 - DNA, 25 bp, Mus musculus
tagtaaagctggctccataatgcgg

SEQ ID NO: 129829 - DNA, 25 bp, Mus musculus
tagtaaatccgacaaagcctgcaga

SEQ ID NO: 129830 - DNA, 25 bp, Mus musculus
tagtaacaatcgacagcaatgcgaa

SEQ ID NO: 129831 - DNA, 25 bp, Mus musculus
tagtaacacaatggcagcgacactg

SEQ ID NO: 129832 - DNA, 25 bp, Mus musculus
tagtaagcactttcagcaggcaaaa

SEQ ID NO: 129833 - DNA, 25 bp, Mus musculus
tagtaagccctgatcttggaagaga

SEQ ID NO: 129834 - DNA, 25 bp, Mus musculus
tagtaagctctaaggacagtggtca

SEQ ID NO: 129835 - DNA, 25 bp, Mus musculus
tagtaaggacagtggaaagttgccc

SEQ ID NO: 129836 - DNA, 25 bp, Mus musculus
tagtaaggtagaagaccgagcaatt

SEQ ID NO: 129837 - DNA, 25 bp, Mus musculus
tagtaagtctacatcctgccgctgc

SEQ ID NO: 129838 - DNA, 25 bp, Mus musculus
tagtaagtgtcctgccagaggtggt

SEQ ID NO: 129839 - DNA, 25 bp, Mus musculus
tagtaataatacagggacccactgc

SEQ ID NO: 129840 - DNA, 25 bp, Mus musculus
tagtaatccagggaggacgcgactg

SEQ ID NO: 129841 - DNA, 25 bp, Mus musculus
tagtaatctgtgatcgacacccgag

SEQ ID NO: 129842 - DNA, 25 bp, Mus musculus
tagtaatgcggagtagtgattgccc

SEQ ID NO: 129843 - DNA, 25 bp, Mus musculus
tagtaatgggagctaccaatcgccc

SEQ ID NO: 129844 - DNA, 25 bp, Mus musculus
tagtaatgtgtgtccaccctggagc

SEQ ID NO: 129845 - DNA, 25 bp, Mus musculus
tagtaattacacgtggaaagtcccg

SEQ ID NO: 129846 - DNA, 25 bp, Mus musculus
tagtaatttactgcaggccctgaga

SEQ ID NO: 129847 - DNA, 25 bp, Mus musculus
tagtacaacatctgctgacaccaag

SEQ ID NO: 129848 - DNA, 25 bp, Mus musculus
tagtacaagcacgtagataccactt

SEQ ID NO: 129849 - DNA, 25 bp, Mus musculus
tagtacagaatgtgggcacctgcgg

SEQ ID NO: 129850 - DNA, 25 bp, Mus musculus
tagtaccaagtaggcagaagctcac

SEQ ID NO: 129851 - DNA, 25 bp, Mus musculus
tagtaccagtgagctcgacaacatg

SEQ ID NO: 129852 - DNA, 25 bp, Mus musculus
tagtaccccaagtggcaaatgctga

SEQ ID NO: 129853 - DNA, 25 bp, Mus musculus
tagtacccgcataagagaagaatcg

SEQ ID NO: 129854 - DNA, 25 bp, Mus musculus
tagtacctaccgtgtccatggttgg

SEQ ID NO: 129855 - DNA, 25 bp, Mus musculus
tagtaccttttcagtcttgccacag

SEQ ID NO: 129856 - DNA, 25 bp, Mus musculus
tagtacggcagctttcctgggcgca

SEQ ID NO: 129857 - DNA, 25 bp, Mus musculus
tagtacgtacagtttccggctttgg

SEQ ID NO: 129858 - DNA, 25 bp, Mus musculus
tagtacgtgggcctcacaagatgcc

SEQ ID NO: 129859 - DNA, 25 bp, Mus musculus
tagtactaaacttggctgcaggtgc

SEQ ID NO: 129860 - DNA, 25 bp, Mus musculus
tagtactacagcgacagaaggccac

SEQ ID NO: 129861 - DNA, 25 bp, Mus musculus
tagtactatagtggccctttgggac

SEQ ID NO: 129862 - DNA, 25 bp, Mus musculus
tagtactcaagagccatgactgccc

SEQ ID NO: 129863 - DNA, 25 bp, Mus musculus
tagtactcagagacgtcagtcggtc

SEQ ID NO: 129864 - DNA, 25 bp, Mus musculus
tagtactgaagagcagctaaggcgc

SEQ ID NO: 129865 - DNA, 25 bp, Mus musculus
tagtactggctgaatcccatcagga

SEQ ID NO: 129866 - DNA, 25 bp, Mus musculus
tagtactttcccgaagcgatggtgg

SEQ ID NO: 129867 - DNA, 25 bp, Mus musculus
tagtagaaatgcagttagcagtcaa

SEQ ID NO: 129868 - DNA, 25 bp, Mus musculus
tagtagaatacacacttccagagcc

SEQ ID NO: 129869 - DNA, 25 bp, Mus musculus
tagtagaatgtatggacccagagcg

SEQ ID NO: 129870 - DNA, 25 bp, Mus musculus
tagtagagaaggctcgcacacgact

SEQ ID NO: 129871 - DNA, 25 bp, Mus musculus
tagtagatgtccttccatgtccaga

SEQ ID NO: 129872 - DNA, 25 bp, Mus musculus
tagtagcactattcccaagattggc

SEQ ID NO: 129873 - DNA, 25 bp, Mus musculus
tagtagcagttggtggcttcagccc

SEQ ID NO: 129874 - DNA, 25 bp, Mus musculus
tagtagcagtttttcgggacaaccg

SEQ ID NO: 129875 - DNA, 25 bp, Mus musculus
tagtagccactttgtttcagccaag

SEQ ID NO: 129876 - DNA, 25 bp, Mus musculus
tagtagctcagacaccgaatcggat

SEQ ID NO: 129877 - DNA, 25 bp, Mus musculus
tagtagctgccctgaggcctacaag

SEQ ID NO: 129878 - DNA, 25 bp, Mus musculus
tagtaggaagaggaccccagattgt

SEQ ID NO: 129879 - DNA, 25 bp, Mus musculus
tagtaggcacacagccccaatctga

SEQ ID NO: 129880 - DNA, 25 bp, Mus musculus
tagtaggcgtatccacagtctggag

SEQ ID NO: 129881 - DNA, 25 bp, Mus musculus
tagtagggccttggctttagacaac

SEQ ID NO: 129882 - DNA, 25 bp, Mus musculus
tagtagtcactcaacctgggaggcc

SEQ ID NO: 129883 - DNA, 25 bp, Mus musculus
tagtagtgaggcctagtcacgagcc

SEQ ID NO: 129884 - DNA, 25 bp, Mus musculus
tagtagtggcagcagtaaaacaggc

SEQ ID NO: 129885 - DNA, 25 bp, Mus musculus
tagtataatcactacacacgggctc

SEQ ID NO: 129886 - DNA, 25 bp, Mus musculus
tagtatacaagcgttcctctctgcg

SEQ ID NO: 129887 - DNA, 25 bp, Mus musculus
tagtatcccagcagtccttgtgtcc

SEQ ID NO: 129888 - DNA, 25 bp, Mus musculus
tagtatgcgtgtttggagatgccca

SEQ ID NO: 129889 - DNA, 25 bp, Mus musculus
tagtatggaccctgttgctgttcac

SEQ ID NO: 129890 - DNA, 25 bp, Mus musculus
tagtatgggcagaatgggcctatct

SEQ ID NO: 129891 - DNA, 25 bp, Mus musculus
tagtatgtggccagcttatcaaagt

SEQ ID NO: 129892 - DNA, 25 bp, Mus musculus
tagtattgctcctgaggaccctggt

SEQ ID NO: 129893 - DNA, 25 bp, Mus musculus
tagtattggcaattaaatgcccagc

SEQ ID NO: 129894 - DNA, 25 bp, Mus musculus
tagtattttgcccatgctcgaacag

SEQ ID NO: 129895 - DNA, 25 bp, Mus musculus
tagtcaaaacagaagcccacgcctt

SEQ ID NO: 129896 - DNA, 25 bp, Mus musculus
tagtcaaacaggagcagaggcacct

SEQ ID NO: 129897 - DNA, 25 bp, Mus musculus
tagtcaaagatctggagctgccctg

SEQ ID NO: 129898 - DNA, 25 bp, Mus musculus
tagtcaaagcacacgtacactggtg

SEQ ID NO: 129899 - DNA, 25 bp, Mus musculus
tagtcaaaggagcaacagaacattc

SEQ ID NO: 129900 - DNA, 25 bp, Mus musculus
tagtcaaccgggaaggatcctgctg

SEQ ID NO: 129901 - DNA, 25 bp, Mus musculus
tagtcaactctgcattcgccgctgg

SEQ ID NO: 129902 - DNA, 25 bp, Mus musculus
tagtcaagatgcatggcaaagaccc

SEQ ID NO: 129903 - DNA, 25 bp, Mus musculus
tagtcaagttccacacggctttgga

SEQ ID NO: 129904 - DNA, 25 bp, Mus musculus
tagtcaatcatacagcactggaggg

SEQ ID NO: 129905 - DNA, 25 bp, Mus musculus
tagtcaatctcttgccactgtgtgg

SEQ ID NO: 129906 - DNA, 25 bp, Mus musculus
tagtcacaccgaggctacaggagcc

SEQ ID NO: 129907 - DNA, 25 bp, Mus musculus
tagtcacagttagttggcagcagag

SEQ ID NO: 129908 - DNA, 25 bp, Mus musculus
tagtcacatccgtttgggcttgggc

SEQ ID NO: 129909 - DNA, 25 bp, Mus musculus
tagtcacatgctggattcaaaaaga

SEQ ID NO: 129910 - DNA, 25 bp, Mus musculus
tagtcacattcaggttcttgccaga

SEQ ID NO: 129911 - DNA, 25 bp, Mus musculus
tagtcaccattaaacgcacagaagc

SEQ ID NO: 129912 - DNA, 25 bp, Mus musculus
tagtcaccctcttcaagcttttggg

SEQ ID NO: 129913 - DNA, 25 bp, Mus musculus
tagtcacgagccatggagtgcgctc

SEQ ID NO: 129914 - DNA, 25 bp, Mus musculus
tagtcactaggtttttgaatgccac

SEQ ID NO: 129915 - DNA, 25 bp, Mus musculus
tagtcactatacttgattccttgga

SEQ ID NO: 129916 - DNA, 25 bp, Mus musculus
tagtcactcccgagaatccacagga

SEQ ID NO: 129917 - DNA, 25 bp, Mus musculus
tagtcactcgtttcctccagctgtc

SEQ ID NO: 129918 - DNA, 25 bp, Mus musculus
tagtcactgtgaagtctggccggcc

SEQ ID NO: 129919 - DNA, 25 bp, Mus musculus
tagtcactgtgtggtccttcacgga

SEQ ID NO: 129920 - DNA, 25 bp, Mus musculus
tagtcacttgagtaacttggccgct

SEQ ID NO: 129921 - DNA, 25 bp, Mus musculus
tagtcagaaggatgttcaactccag

SEQ ID NO: 129922 - DNA, 25 bp, Mus musculus
tagtcagactctacagcttccaagc

SEQ ID NO: 129923 - DNA, 25 bp, Mus musculus
tagtcagcatccacagccaaaagga

SEQ ID NO: 129924 - DNA, 25 bp, Mus musculus
tagtcagccacgtcatcaagcaagg

SEQ ID NO: 129925 - DNA, 25 bp, Mus musculus
tagtcaggactcctgaacaacgaca

SEQ ID NO: 129926 - DNA, 25 bp, Mus musculus
tagtcaggcaggacaaaagctcatg

SEQ ID NO: 129927 - DNA, 25 bp, Mus musculus
tagtcaggtaccgtgtccgaaagtc

SEQ ID NO: 129928 - DNA, 25 bp, Mus musculus
tagtcagtgtcctagaccaccagga

SEQ ID NO: 129929 - DNA, 25 bp, Mus musculus
tagtcatagtgaagcccaccctaag

SEQ ID NO: 129930 - DNA, 25 bp, Mus musculus
tagtcatcaattccatgggccgccg

SEQ ID NO: 129931 - DNA, 25 bp, Mus musculus
tagtcatcagctggattctcaaagg

SEQ ID NO: 129932 - DNA, 25 bp, Mus musculus
tagtcatcagtgaaaagtcagtcaa

SEQ ID NO: 129933 - DNA, 25 bp, Mus musculus
tagtcatcgttggaggtggaattgt

SEQ ID NO: 129934 - DNA, 25 bp, Mus musculus
tagtcatgtgtccaaagctgtctgc

SEQ ID NO: 129935 - DNA, 25 bp, Mus musculus
tagtcatgttactcgcgctggagaa

SEQ ID NO: 129936 - DNA, 25 bp, Mus musculus
tagtcattcactgtagatcttactg

SEQ ID NO: 129937 - DNA, 25 bp, Mus musculus
tagtcattgacattgtgccgcccaa

SEQ ID NO: 129938 - DNA, 25 bp, Mus musculus
tagtccacctcgtgttatgtcccgg

SEQ ID NO: 129939 - DNA, 25 bp, Mus musculus
tagtccagagaatacggctgcccga

SEQ ID NO: 129940 - DNA, 25 bp, Mus musculus
tagtccagagaatgggcctttaccc

SEQ ID NO: 129941 - DNA, 25 bp, Mus musculus
tagtccagagctgcaacaacagatt

SEQ ID NO: 129942 - DNA, 25 bp, Mus musculus
tagtccagccaaacaccaaacggtt

SEQ ID NO: 129943 - DNA, 25 bp, Mus musculus
tagtccagccgtgaagcgattgttg

SEQ ID NO: 129944 - DNA, 25 bp, Mus musculus
tagtccctaagcacacgacgaatgc

SEQ ID NO: 129945 - DNA, 25 bp, Mus musculus
tagtccctgcagaagctacggaccc

SEQ ID NO: 129946 - DNA, 25 bp, Mus musculus
tagtcccttggtgtctaatctgtgc

SEQ ID NO: 129947 - DNA, 25 bp, Mus musculus
tagtccgcgggaaaccaaaatggcg

SEQ ID NO: 129948 - DNA, 25 bp, Mus musculus
tagtcctcccctcgtggtaagatag

SEQ ID NO: 129949 - DNA, 25 bp, Mus musculus
tagtcctcgtgcacctaggaccagc

SEQ ID NO: 129950 - DNA, 25 bp, Mus musculus
tagtcctctgaacaatcccgtagtg

SEQ ID NO: 129951 - DNA, 25 bp, Mus musculus
tagtcctcttaagtatctggctctg

SEQ ID NO: 129952 - DNA, 25 bp, Mus musculus
tagtcctgacacagccaatgatggc

SEQ ID NO: 129953 - DNA, 25 bp, Mus musculus
tagtcctgcccgtgatgagtgcttc

SEQ ID NO: 129954 - DNA, 25 bp, Mus musculus
tagtcctggacgctacacagaaggt

SEQ ID NO: 129955 - DNA, 25 bp, Mus musculus
tagtcctggctacacgatatcgtca

SEQ ID NO: 129956 - DNA, 25 bp, Mus musculus
tagtcctgggctgaattgagctgca

SEQ ID NO: 129957 - DNA, 25 bp, Mus musculus
tagtcctgtgtgtgagctccctcaa

SEQ ID NO: 129958 - DNA, 25 bp, Mus musculus
tagtcgacgctatgttgatgaatac

SEQ ID NO: 129959 - DNA, 25 bp, Mus musculus
tagtcgatctctgttgggcacggaa

SEQ ID NO: 129960 - DNA, 25 bp, Mus musculus
tagtcgcaacagcagtcatgtcggg

SEQ ID NO: 129961 - DNA, 25 bp, Mus musculus
tagtcgcgttggagacgttgctctg

SEQ ID NO: 129962 - DNA, 25 bp, Mus musculus
tagtcgctcggcagagatgttgctg

SEQ ID NO: 129963 - DNA, 25 bp, Mus musculus
tagtcggcatagtaaagagaaggac

SEQ ID NO: 129964 - DNA, 25 bp, Mus musculus
tagtcggcccctaggcccaggttat

SEQ ID NO: 129965 - DNA, 25 bp, Mus musculus
tagtcggcccttaagtgctgtctcg

SEQ ID NO: 129966 - DNA, 25 bp, Mus musculus
tagtcgtcataacccatgtggtctg

SEQ ID NO: 129967 - DNA, 25 bp, Mus musculus
tagtcgtgagtatgcaggaccctga

SEQ ID NO: 129968 - DNA, 25 bp, Mus musculus
tagtctagctcgtctctgaacaggc

SEQ ID NO: 129969 - DNA, 25 bp, Mus musculus
tagtctaggatgtgttagggaccat

SEQ ID NO: 129970 - DNA, 25 bp, Mus musculus
tagtctatctggaatggtaccgtgg

SEQ ID NO: 129971 - DNA, 25 bp, Mus musculus
tagtctcaagaccaaagacgggtgc

SEQ ID NO: 129972 - DNA, 25 bp, Mus musculus
tagtctcataggatcgtcacagtgg

SEQ ID NO: 129973 - DNA, 25 bp, Mus musculus
tagtctccaagattgacagccggct

SEQ ID NO: 129974 - DNA, 25 bp, Mus musculus
tagtctcgctttgggttccggctgc

SEQ ID NO: 129975 - DNA, 25 bp, Mus musculus
tagtctcgtcgcagaatttcttcag

SEQ ID NO: 129976 - DNA, 25 bp, Mus musculus
tagtctctcactgtccgcggcttta

SEQ ID NO: 129977 - DNA, 25 bp, Mus musculus
tagtctctgctatggaagtttatta

SEQ ID NO: 129978 - DNA, 25 bp, Mus musculus
tagtctctggagatggccctcgtgg

SEQ ID NO: 129979 - DNA, 25 bp, Mus musculus
tagtctgaatgcttgtggccctgac

SEQ ID NO: 129980 - DNA, 25 bp, Mus musculus
tagtctgcaatgtgccgaccactgg

SEQ ID NO: 129981 - DNA, 25 bp, Mus musculus
tagtctgcggtatgctgggcttccc

SEQ ID NO: 129982 - DNA, 25 bp, Mus musculus
tagtctgctgccacgctttgggagc

SEQ ID NO: 129983 - DNA, 25 bp, Mus musculus
tagtctgggacttgcaagtccacca

SEQ ID NO: 129984 - DNA, 25 bp, Mus musculus
tagtctgggcacaggtcttgctcag

SEQ ID NO: 129985 - DNA, 25 bp, Mus musculus
tagtctgtgcatgaaacagggcttg

SEQ ID NO: 129986 - DNA, 25 bp, Mus musculus
tagtcttcagccatgtatgtaggtc

SEQ ID NO: 129987 - DNA, 25 bp, Mus musculus
tagtcttccatgacgtctatggtca

SEQ ID NO: 129988 - DNA, 25 bp, Mus musculus
tagtcttccgcaagcgcgggagtct

SEQ ID NO: 129989 - DNA, 25 bp, Mus musculus
tagtcttctgcatggccacatacgg

SEQ ID NO: 129990 - DNA, 25 bp, Mus musculus
tagtctttgaaaggagcagttgttc

SEQ ID NO: 129991 - DNA, 25 bp, Mus musculus
tagtctttgggcatgttgaacgcaa

SEQ ID NO: 129992 - DNA, 25 bp, Mus musculus
tagtgaaaagcctgacctgcgtgca

SEQ ID NO: 129993 - DNA, 25 bp, Mus musculus
tagtgaaaatgagcctcgccgtgcc

SEQ ID NO: 129994 - DNA, 25 bp, Mus musculus
tagtgaaactgcagctcagccatgc

SEQ ID NO: 129995 - DNA, 25 bp, Mus musculus
tagtgaaagtgaaacagatccttgg

SEQ ID NO: 129996 - DNA, 25 bp, Mus musculus
tagtgaacagggtgtgcaagtcgtc

SEQ ID NO: 129997 - DNA, 25 bp, Mus musculus
tagtgaaccggagcaaagacttccg

SEQ ID NO: 129998 - DNA, 25 bp, Mus musculus
tagtgaacctgccaaagctcgggaa

SEQ ID NO: 129999 - DNA, 25 bp, Mus musculus
tagtgaagaccaaccaacatctggg

SEQ ID NO: 130000 - DNA, 25 bp, Mus musculus
tagtgaagactgaggaccaggcctg

SEQ ID NO: 130001 - DNA, 25 bp, Mus musculus
tagtgaagatttggagcctgaggcc

SEQ ID NO: 130002 - DNA, 25 bp, Mus musculus
tagtgaagcagaacaccgacgtggc

SEQ ID NO: 130003 - DNA, 25 bp, Mus musculus
tagtgacaagagtgaggctgccctg

SEQ ID NO: 130004 - DNA, 25 bp, Mus musculus
tagtgacaccacttggcgttgggac

SEQ ID NO: 130005 - DNA, 25 bp, Mus musculus
tagtgacacctacgatccgcatgga

SEQ ID NO: 130006 - DNA, 25 bp, Mus musculus
tagtgacactgtaccgaagcctgat

SEQ ID NO: 130007 - DNA, 25 bp, Mus musculus
tagtgacagccctatcatcaagcgt

SEQ ID NO: 130008 - DNA, 25 bp, Mus musculus
tagtgacaggagaacgcaaagcttg

SEQ ID NO: 130009 - DNA, 25 bp, Mus musculus
tagtgaccaaagagttcagcagcgt

SEQ ID NO: 130010 - DNA, 25 bp, Mus musculus
tagtgaccacaaacgggctttcacg

SEQ ID NO: 130011 - DNA, 25 bp, Mus musculus
tagtgaccagtcctgtgaccagtcc

SEQ ID NO: 130012 - DNA, 25 bp, Mus musculus
tagtgaccatgagcacctactatgc

SEQ ID NO: 130013 - DNA, 25 bp, Mus musculus
tagtgacccagctgaagtactcatc

SEQ ID NO: 130014 - DNA, 25 bp, Mus musculus
tagtgacccaggcagtgttcgtttg

SEQ ID NO: 130015 - DNA, 25 bp, Mus musculus
tagtgaccccactgctagcacaaag

SEQ ID NO: 130016 - DNA, 25 bp, Mus musculus
tagtgacgaggatgacaaagacccc

SEQ ID NO: 130017 - DNA, 25 bp, Mus musculus
tagtgacgctgtggtaccgatctcc

SEQ ID NO: 130018 - DNA, 25 bp, Mus musculus
tagtgacgggcagtctgaccaatgg

SEQ ID NO: 130019 - DNA, 25 bp, Mus musculus
tagtgactacaaccccaattgccgc

SEQ ID NO: 130020 - DNA, 25 bp, Mus musculus
tagtgactgtgactctgctcgtggc

SEQ ID NO: 130021 - DNA, 25 bp, Mus musculus
tagtgactgtgctatcgagaaggcc

SEQ ID NO: 130022 - DNA, 25 bp, Mus musculus
tagtgacttctgatctaagaacctc

SEQ ID NO: 130023 - DNA, 25 bp, Mus musculus
tagtgagaccaagaaccagctttgc

SEQ ID NO: 130024 - DNA, 25 bp, Mus musculus
tagtgagagacctcttacaggaccg

SEQ ID NO: 130025 - DNA, 25 bp, Mus musculus
tagtgagagtgtggcctgcctccta

SEQ ID NO: 130026 - DNA, 25 bp, Mus musculus
tagtgagagttccaaccccatgggt

SEQ ID NO: 130027 - DNA, 25 bp, Mus musculus
tagtgagcccactgataagcatgac

SEQ ID NO: 130028 - DNA, 25 bp, Mus musculus
tagtgagcggcaacaccagtggagt

SEQ ID NO: 130029 - DNA, 25 bp, Mus musculus
tagtgagggcctccttaactgatcc

SEQ ID NO: 130030 - DNA, 25 bp, Mus musculus
tagtgataaaagctcaacctgtgcc

SEQ ID NO: 130031 - DNA, 25 bp, Mus musculus
tagtgataaagatgcctcagtggtg

SEQ ID NO: 130032 - DNA, 25 bp, Mus musculus
tagtgatcagcggttacggccaaga

SEQ ID NO: 130033 - DNA, 25 bp, Mus musculus
tagtgatcctgttccagccagtgac

SEQ ID NO: 130034 - DNA, 25 bp, Mus musculus
tagtgatgagaaccgcacctaccag

SEQ ID NO: 130035 - DNA, 25 bp, Mus musculus
tagtgatgcccaccttgcgacaggc

SEQ ID NO: 130036 - DNA, 25 bp, Mus musculus
tagtgatgccttcgatacgtgcagc

SEQ ID NO: 130037 - DNA, 25 bp, Mus musculus
tagtgatgctacaggacaaagagga

SEQ ID NO: 130038 - DNA, 25 bp, Mus musculus
tagtgatggacttccccgtgtggcc

SEQ ID NO: 130039 - DNA, 25 bp, Mus musculus
tagtgatggcctctcatatgcaaga

SEQ ID NO: 130040 - DNA, 25 bp, Mus musculus
tagtgattcattccgcagcgacgtg

SEQ ID NO: 130041 - DNA, 25 bp, Mus musculus
tagtgcacgatcgtctacagcgcca

SEQ ID NO: 130042 - DNA, 25 bp, Mus musculus
tagtgcagcagagaaaacagttgcc

SEQ ID NO: 130043 - DNA, 25 bp, Mus musculus
tagtgcagcgacgtcccgcgtgtgc

SEQ ID NO: 130044 - DNA, 25 bp, Mus musculus
tagtgcagctacacacaggatgagc

SEQ ID NO: 130045 - DNA, 25 bp, Mus musculus
tagtgcatctctagaggccgcatgt

SEQ ID NO: 130046 - DNA, 25 bp, Mus musculus
tagtgcattagaaggatacagaggc

SEQ ID NO: 130047 - DNA, 25 bp, Mus musculus
tagtgccaaatagcaagcctgttgt

SEQ ID NO: 130048 - DNA, 25 bp, Mus musculus
tagtgccatgttttccctggtgaga

SEQ ID NO: 130049 - DNA, 25 bp, Mus musculus
tagtgcccatgtatgcagcaggatt

SEQ ID NO: 130050 - DNA, 25 bp, Mus musculus
tagtgccccagcaggcatgggcatc

SEQ ID NO: 130051 - DNA, 25 bp, Mus musculus
tagtgccctgcatgtaaatggcgag

SEQ ID NO: 130052 - DNA, 25 bp, Mus musculus
tagtgccctgtttggtcgagatccg

SEQ ID NO: 130053 - DNA, 25 bp, Mus musculus
tagtgccgaaagctctcaccaaagc

SEQ ID NO: 130054 - DNA, 25 bp, Mus musculus
tagtgccgcacatagtgactatgga

SEQ ID NO: 130055 - DNA, 25 bp, Mus musculus
tagtgcctgggcgtcgggataatct

SEQ ID NO: 130056 - DNA, 25 bp, Mus musculus
tagtgcctgtcacccctggtagaga

SEQ ID NO: 130057 - DNA, 25 bp, Mus musculus
tagtgcgggcttcctatctggagat

SEQ ID NO: 130058 - DNA, 25 bp, Mus musculus
tagtgctaggaagatggcgcacccg

SEQ ID NO: 130059 - DNA, 25 bp, Mus musculus
tagtgctatggtcacggatggcttc

SEQ ID NO: 130060 - DNA, 25 bp, Mus musculus
tagtgctcaggaacaaggtctttgc

SEQ ID NO: 130061 - DNA, 25 bp, Mus musculus
tagtgctcccatcaattggcgtcgg

SEQ ID NO: 130062 - DNA, 25 bp, Mus musculus
tagtgctccctcagatctccaagga

SEQ ID NO: 130063 - DNA, 25 bp, Mus musculus
tagtgctcctggacctgaaaagccg

SEQ ID NO: 130064 - DNA, 25 bp, Mus musculus
tagtgctgaggcagtatgggatcac

SEQ ID NO: 130065 - DNA, 25 bp, Mus musculus
tagtgctgcggagcaatgagctcac

SEQ ID NO: 130066 - DNA, 25 bp, Mus musculus
tagtgctgcggaggcacgagctact

SEQ ID NO: 130067 - DNA, 25 bp, Mus musculus
tagtgctggacttcggtgacgttct

SEQ ID NO: 130068 - DNA, 25 bp, Mus musculus
tagtgctggatgtgaaacccgttgc

SEQ ID NO: 130069 - DNA, 25 bp, Mus musculus
tagtgctgtataagtacgaatgcag

SEQ ID NO: 130070 - DNA, 25 bp, Mus musculus
tagtgcttcagaggaacaaaccagt

SEQ ID NO: 130071 - DNA, 25 bp, Mus musculus
tagtggaaaactggacatctgagac

SEQ ID NO: 130072 - DNA, 25 bp, Mus musculus
tagtggaaatcacggagcgagccat

SEQ ID NO: 130073 - DNA, 25 bp, Mus musculus
tagtggaagctaaaatcagaataca

SEQ ID NO: 130074 - DNA, 25 bp, Mus musculus
tagtggaccagaacagagcctgttg

SEQ ID NO: 130075 - DNA, 25 bp, Mus musculus
tagtggaccagcagaacgtgtacga

SEQ ID NO: 130076 - DNA, 25 bp, Mus musculus
tagtggacctcatcgtggacatcat

SEQ ID NO: 130077 - DNA, 25 bp, Mus musculus
tagtggacctccagagcctgaaaga

SEQ ID NO: 130078 - DNA, 25 bp, Mus musculus
tagtggactgtggtggcattgacct

SEQ ID NO: 130079 - DNA, 25 bp, Mus musculus
tagtggacttcctcatccagaatgg

SEQ ID NO: 130080 - DNA, 25 bp, Mus musculus
tagtggagacacctgccttggcttc

SEQ ID NO: 130081 - DNA, 25 bp, Mus musculus
tagtggagctggtgcctcagtatcc

SEQ ID NO: 130082 - DNA, 25 bp, Mus musculus
tagtggagtaaagctacgcccaggc

SEQ ID NO: 130083 - DNA, 25 bp, Mus musculus
tagtggagtcagattccacaatagt

SEQ ID NO: 130084 - DNA, 25 bp, Mus musculus
tagtggatccaccacccagatgctg

SEQ ID NO: 130085 - DNA, 25 bp, Mus musculus
tagtggatggccagagttacctgct

SEQ ID NO: 130086 - DNA, 25 bp, Mus musculus
tagtggcaacttcttagtaaactta

SEQ ID NO: 130087 - DNA, 25 bp, Mus musculus
tagtggcacagctacgtaaacgtca

SEQ ID NO: 130088 - DNA, 25 bp, Mus musculus
tagtggcagccaacatcagatagtc

SEQ ID NO: 130089 - DNA, 25 bp, Mus musculus
tagtggcagctaagaccctacagga

SEQ ID NO: 130090 - DNA, 25 bp, Mus musculus
tagtggcagggacaactacataccc

SEQ ID NO: 130091 - DNA, 25 bp, Mus musculus
tagtggcaggtgtatcccaaggcct

SEQ ID NO: 130092 - DNA, 25 bp, Mus musculus
tagtggcagtctgaaaaggttcccc

SEQ ID NO: 130093 - DNA, 25 bp, Mus musculus
tagtggcagttaccaaggcatccgg

SEQ ID NO: 130094 - DNA, 25 bp, Mus musculus
tagtggcccattccagtgtattccg

SEQ ID NO: 130095 - DNA, 25 bp, Mus musculus
tagtggccctaatgaagagctgtgc

SEQ ID NO: 130096 - DNA, 25 bp, Mus musculus
tagtggccctgattcggagagctcc

SEQ ID NO: 130097 - DNA, 25 bp, Mus musculus
tagtggccgtgaggaacatcttcgt

SEQ ID NO: 130098 - DNA, 25 bp, Mus musculus
tagtggcctcggagcagagtcgaca

SEQ ID NO: 130099 - DNA, 25 bp, Mus musculus
tagtggcctgctcaaactgtctgct

SEQ ID NO: 130100 - DNA, 25 bp, Mus musculus
tagtggcgccgctgtccaaatggaa

SEQ ID NO: 130101 - DNA, 25 bp, Mus musculus
tagtggctttccaccaatgggagga

SEQ ID NO: 130102 - DNA, 25 bp, Mus musculus
tagtgggaccagaaattactaagcc

SEQ ID NO: 130103 - DNA, 25 bp, Mus musculus
tagtgggcaccttgaaaatctcagg

SEQ ID NO: 130104 - DNA, 25 bp, Mus musculus
tagtgggccacttcatcaagaagag

SEQ ID NO: 130105 - DNA, 25 bp, Mus musculus
tagtgggcccagttggcaggcctca

SEQ ID NO: 130106 - DNA, 25 bp, Mus musculus
tagtgggctccatgccaagaaggga

SEQ ID NO: 130107 - DNA, 25 bp, Mus musculus
tagtgggtcccaatgataaacgctg

SEQ ID NO: 130108 - DNA, 25 bp, Mus musculus
tagtggtacaccttaagaagttgga

SEQ ID NO: 130109 - DNA, 25 bp, Mus musculus
tagtggtacaggtcatgggcttgct

SEQ ID NO: 130110 - DNA, 25 bp, Mus musculus
tagtggtcacaaagcagacagagcc

SEQ ID NO: 130111 - DNA, 25 bp, Mus musculus
tagtggtcacctccctggtagtgcg

SEQ ID NO: 130112 - DNA, 25 bp, Mus musculus
tagtggtgttccaaaagtcctgccc

SEQ ID NO: 130113 - DNA, 25 bp, Mus musculus
tagtgtaaacacgtcctgtcgctga

SEQ ID NO: 130114 - DNA, 25 bp, Mus musculus
tagtgtaaaccacagaatgtagccc

SEQ ID NO: 130115 - DNA, 25 bp, Mus musculus
tagtgtacaacattctgagcagtgg

SEQ ID NO: 130116 - DNA, 25 bp, Mus musculus
tagtgtacgatgagcaaagagtcct

SEQ ID NO: 130117 - DNA, 25 bp, Mus musculus
tagtgtactacctgaagaaccgcga

SEQ ID NO: 130118 - DNA, 25 bp, Mus musculus
tagtgtagctatcgccagcatccag

SEQ ID NO: 130119 - DNA, 25 bp, Mus musculus
tagtgtatcatggagtaaacttgca

SEQ ID NO: 130120 - DNA, 25 bp, Mus musculus
tagtgtatttgaccaagtccagccc

SEQ ID NO: 130121 - DNA, 25 bp, Mus musculus
tagtgtcagaacttggcccaatagt

SEQ ID NO: 130122 - DNA, 25 bp, Mus musculus
tagtgtcaggcatccgtctctttgg

SEQ ID NO: 130123 - DNA, 25 bp, Mus musculus
tagtgtccacaacaagacgggtgcc

SEQ ID NO: 130124 - DNA, 25 bp, Mus musculus
tagtgtccctctgaatattcccagg

SEQ ID NO: 130125 - DNA, 25 bp, Mus musculus
tagtgtctcgctgccttgaactcgg

SEQ ID NO: 130126 - DNA, 25 bp, Mus musculus
tagtgtctgatggaacagccaggcc

SEQ ID NO: 130127 - DNA, 25 bp, Mus musculus
tagtgtgcaaactcctcagtagccc

SEQ ID NO: 130128 - DNA, 25 bp, Mus musculus
tagtgtgcaacgaacgcttctggga

SEQ ID NO: 130129 - DNA, 25 bp, Mus musculus
tagtgtggcgctgtgttcctggtcc

SEQ ID NO: 130130 - DNA, 25 bp, Mus musculus
tagtgtgtgaaataccatgttttgc

SEQ ID NO: 130131 - DNA, 25 bp, Mus musculus
tagtgtgtgcccatttctaataaaa

SEQ ID NO: 130132 - DNA, 25 bp, Mus musculus
tagtgtgttctctcttgccattgaa

SEQ ID NO: 130133 - DNA, 25 bp, Mus musculus
tagtgtgttcttgggcatccacggg

SEQ ID NO: 130134 - DNA, 25 bp, Mus musculus
tagtgttcagcctcattggtctaca

SEQ ID NO: 130135 - DNA, 25 bp, Mus musculus
tagtgttccgaggtcttgccgttcc

SEQ ID NO: 130136 - DNA, 25 bp, Mus musculus
tagtgttcggaggtacaggcatccc

SEQ ID NO: 130137 - DNA, 25 bp, Mus musculus
tagtgtttacactcaaatttggaga

SEQ ID NO: 130138 - DNA, 25 bp, Mus musculus
tagtgtttcacacaggcaccaggga

SEQ ID NO: 130139 - DNA, 25 bp, Mus musculus
tagtgtttcctggatcgtggaccca

SEQ ID NO: 130140 - DNA, 25 bp, Mus musculus
tagttaaccatagcaagacgggacg

SEQ ID NO: 130141 - DNA, 25 bp, Mus musculus
tagttaaccggcatggatgtgaccg

SEQ ID NO: 130142 - DNA, 25 bp, Mus musculus
tagttaacttaagggatatctctgc

SEQ ID NO: 130143 - DNA, 25 bp, Mus musculus
tagttaatctctgttggcaaggcga

SEQ ID NO: 130144 - DNA, 25 bp, Mus musculus
tagttacaataaagaagccgccctg

SEQ ID NO: 130145 - DNA, 25 bp, Mus musculus
tagttacagccagcagactggaccc

SEQ ID NO: 130146 - DNA, 25 bp, Mus musculus
tagttaccaaactatacagccgaca

SEQ ID NO: 130147 - DNA, 25 bp, Mus musculus
tagttaccaagtcgcagtggtacgc

SEQ ID NO: 130148 - DNA, 25 bp, Mus musculus
tagttaccactctaaatggccatgg

SEQ ID NO: 130149 - DNA, 25 bp, Mus musculus
tagttaccccgacacaaggagctct

SEQ ID NO: 130150 - DNA, 25 bp, Mus musculus
tagttacccgggaagcgtgagtcat

SEQ ID NO: 130151 - DNA, 25 bp, Mus musculus
tagttacctgcggatctctctcaca

SEQ ID NO: 130152 - DNA, 25 bp, Mus musculus
tagttactgagctgatgtcctgcca

SEQ ID NO: 130153 - DNA, 25 bp, Mus musculus
tagttagaccacacagactctgcct

SEQ ID NO: 130154 - DNA, 25 bp, Mus musculus
tagttagccttgatgtagccccgag

SEQ ID NO: 130155 - DNA, 25 bp, Mus musculus
tagttaggccacatgaagaatcgag

SEQ ID NO: 130156 - DNA, 25 bp, Mus musculus
tagttaggcctctgcagatgaccgt

SEQ ID NO: 130157 - DNA, 25 bp, Mus musculus
tagttataggcacagcttgcacatg

SEQ ID NO: 130158 - DNA, 25 bp, Mus musculus
tagttatcagccacctaaaccaggg

SEQ ID NO: 130159 - DNA, 25 bp, Mus musculus
tagttatccctgtctgcctaagaga

SEQ ID NO: 130160 - DNA, 25 bp, Mus musculus
tagttcacccatcgcaagaagaaga

SEQ ID NO: 130161 - DNA, 25 bp, Mus musculus
tagttcacggttactgcctagggct

SEQ ID NO: 130162 - DNA, 25 bp, Mus musculus
tagttcagagacagcttccagtggg

SEQ ID NO: 130163 - DNA, 25 bp, Mus musculus
tagttcagccacagttgccagggaa

SEQ ID NO: 130164 - DNA, 25 bp, Mus musculus
tagttcagcgggttaactgcctggt

SEQ ID NO: 130165 - DNA, 25 bp, Mus musculus
tagttcaggcagttcgagaccacct

SEQ ID NO: 130166 - DNA, 25 bp, Mus musculus
tagttcagtacagcctaattgaggg

SEQ ID NO: 130167 - DNA, 25 bp, Mus musculus
tagttcattctaccatggacccagc

SEQ ID NO: 130168 - DNA, 25 bp, Mus musculus
tagttcattgaaagctgtcagcccc

SEQ ID NO: 130169 - DNA, 25 bp, Mus musculus
tagttccaaatgcagtcagactgtg

SEQ ID NO: 130170 - DNA, 25 bp, Mus musculus
tagttccagctttgtgacttgtcct

SEQ ID NO: 130171 - DNA, 25 bp, Mus musculus
tagttcccagcggagttttcatcgc

SEQ ID NO: 130172 - DNA, 25 bp, Mus musculus
tagttcccggatagcagatgtgttc

SEQ ID NO: 130173 - DNA, 25 bp, Mus musculus
tagttccgggtccttgagacaccga

SEQ ID NO: 130174 - DNA, 25 bp, Mus musculus
tagttccgtggagactgcgagttcc

SEQ ID NO: 130175 - DNA, 25 bp, Mus musculus
tagttcctggccatgtcaagcaagc

SEQ ID NO: 130176 - DNA, 25 bp, Mus musculus
tagttccttggaaggccagcacggt

SEQ ID NO: 130177 - DNA, 25 bp, Mus musculus
tagttcgccacgaacgcatcgaggc

SEQ ID NO: 130178 - DNA, 25 bp, Mus musculus
tagttcggaagcacaaatgccgtcg

SEQ ID NO: 130179 - DNA, 25 bp, Mus musculus
tagttcgggattagcgtaggagccc

SEQ ID NO: 130180 - DNA, 25 bp, Mus musculus
tagttctagactattcccatcccag

SEQ ID NO: 130181 - DNA, 25 bp, Mus musculus
tagttctctcacaagtattcaagga

SEQ ID NO: 130182 - DNA, 25 bp, Mus musculus
tagttctgacagctacgcacgagga

SEQ ID NO: 130183 - DNA, 25 bp, Mus musculus
tagttctgcgttttctgaagtttcc

SEQ ID NO: 130184 - DNA, 25 bp, Mus musculus
tagttctgtatgctacgcaccagga

SEQ ID NO: 130185 - DNA, 25 bp, Mus musculus
tagttcttgccaacatctgtcgcca

SEQ ID NO: 130186 - DNA, 25 bp, Mus musculus
tagttcttgtcaacttgagtcaccc

SEQ ID NO: 130187 - DNA, 25 bp, Mus musculus
tagttctttgcttctccgaggcgag

SEQ ID NO: 130188 - DNA, 25 bp, Mus musculus
tagttgaagcaacgacaagccggat

SEQ ID NO: 130189 - DNA, 25 bp, Mus musculus
tagttgccactcaagctcgcctgga

SEQ ID NO: 130190 - DNA, 25 bp, Mus musculus
tagttgccagcccaaactttccggg

SEQ ID NO: 130191 - DNA, 25 bp, Mus musculus
tagttgccgacaacaacaaagatgg

SEQ ID NO: 130192 - DNA, 25 bp, Mus musculus
tagttgccgcgagcactggagttcg

SEQ ID NO: 130193 - DNA, 25 bp, Mus musculus
tagttgcctgcataggagccggtcc

SEQ ID NO: 130194 - DNA, 25 bp, Mus musculus
tagttgcctgtgagacctgcatctg

SEQ ID NO: 130195 - DNA, 25 bp, Mus musculus
tagttgcgactagcatgggccacct

SEQ ID NO: 130196 - DNA, 25 bp, Mus musculus
tagttgcggctccttcatcaagacg

SEQ ID NO: 130197 - DNA, 25 bp, Mus musculus
tagttgctagggacacaagacctgg

SEQ ID NO: 130198 - DNA, 25 bp, Mus musculus
tagttgctcatggtacactgctaga

SEQ ID NO: 130199 - DNA, 25 bp, Mus musculus
tagttgctcttatgatcagaaggcc

SEQ ID NO: 130200 - DNA, 25 bp, Mus musculus
tagttggcaccatgctacgctgttc

SEQ ID NO: 130201 - DNA, 25 bp, Mus musculus
tagttggccctgaccagaaccagga

SEQ ID NO: 130202 - DNA, 25 bp, Mus musculus
tagttgggcaactgaaagactgctc

SEQ ID NO: 130203 - DNA, 25 bp, Mus musculus
tagttgggccagagctgttgttccc

SEQ ID NO: 130204 - DNA, 25 bp, Mus musculus
tagttgggctctaaggaacctgctg

SEQ ID NO: 130205 - DNA, 25 bp, Mus musculus
tagttggtgtggagactagccctcg

SEQ ID NO: 130206 - DNA, 25 bp, Mus musculus
tagttgtactgagagccaaagcctg

SEQ ID NO: 130207 - DNA, 25 bp, Mus musculus
tagttgtcttagtcatccacccagg

SEQ ID NO: 130208 - DNA, 25 bp, Mus musculus
tagttgtggaccagatcagccagct

SEQ ID NO: 130209 - DNA, 25 bp, Mus musculus
tagttgttctctccacgattgtgtc

SEQ ID NO: 130210 - DNA, 25 bp, Mus musculus
tagtttaagggccaaagcagcctgg

SEQ ID NO: 130211 - DNA, 25 bp, Mus musculus
tagtttacagagaatccactgccgg

SEQ ID NO: 130212 - DNA, 25 bp, Mus musculus
tagtttaccgagtgcctaggcttcg

SEQ ID NO: 130213 - DNA, 25 bp, Mus musculus
tagtttatgactgacccttgtttct

SEQ ID NO: 130214 - DNA, 25 bp, Mus musculus
tagtttcgtcctgtcttcccttggc

SEQ ID NO: 130215 - DNA, 25 bp, Mus musculus
tagtttctgatgctcagtcccctgg

SEQ ID NO: 130216 - DNA, 25 bp, Mus musculus
tagtttgaccagttgcgtgttagca

SEQ ID NO: 130217 - DNA, 25 bp, Mus musculus
tagtttgcgaacagaagttaaggcc

SEQ ID NO: 130218 - DNA, 25 bp, Mus musculus
tagtttggagccacctgtcagacag

SEQ ID NO: 130219 - DNA, 25 bp, Mus musculus
tagtttggatatcacagggcctgtc

SEQ ID NO: 130220 - DNA, 25 bp, Mus musculus
tagttttgagatagcagcaccctcg

SEQ ID NO: 130221 - DNA, 25 bp, Mus musculus
tagtttttacgcagttccccaccag

SEQ ID NO: 130222 - DNA, 25 bp, Mus musculus
tataaaaaagtcactggcaaggaga

SEQ ID NO: 130223 - DNA, 25 bp, Mus musculus
tataaaaaagttccgagatgaggcc

SEQ ID NO: 130224 - DNA, 25 bp, Mus musculus
tataaaaatatttcccgccaggcag

SEQ ID NO: 130225 - DNA, 25 bp, Mus musculus
tataaaacacatgcctgctacgagc

SEQ ID NO: 130226 - DNA, 25 bp, Mus musculus
tataaaaccagaagaacgcagcatg

SEQ ID NO: 130227 - DNA, 25 bp, Mus musculus
tataaaaccctggtgtccgagggca

SEQ ID NO: 130228 - DNA, 25 bp, Mus musculus
tataaaacgttctcgtcactccagg

SEQ ID NO: 130229 - DNA, 25 bp, Mus musculus
tataaaactttggaccctgctgacc

SEQ ID NO: 130230 - DNA, 25 bp, Mus musculus
tataaaaggcacacgcgggcatgcg

SEQ ID NO: 130231 - DNA, 25 bp, Mus musculus
tataaaaggcttcccatgtgaaggc

SEQ ID NO: 130232 - DNA, 25 bp, Mus musculus
tataaaatgagctaccgggaggtga

SEQ ID NO: 130233 - DNA, 25 bp, Mus musculus
tataaaattttggagtgctgagcac

SEQ ID NO: 130234 - DNA, 25 bp, Mus musculus
tataaacacaaagctccctcagacg

SEQ ID NO: 130235 - DNA, 25 bp, Mus musculus
tataaacacggacggctactctcca

SEQ ID NO: 130236 - DNA, 25 bp, Mus musculus
tataaacatgtggacaccggaagga

SEQ ID NO: 130237 - DNA, 25 bp, Mus musculus
tataaaccccgtgtggaatgagacc

SEQ ID NO: 130238 - DNA, 25 bp, Mus musculus
tataaaccggttcacaaggcgtgcc

SEQ ID NO: 130239 - DNA, 25 bp, Mus musculus
tataaacctagagggactctccacc

SEQ ID NO: 130240 - DNA, 25 bp, Mus musculus
tataaacgatgctgtgctctgtgcg

SEQ ID NO: 130241 - DNA, 25 bp, Mus musculus
tataaactgatcacaaccaaaagcc

SEQ ID NO: 130242 - DNA, 25 bp, Mus musculus
tataaagacaagtggacttgggccc

SEQ ID NO: 130243 - DNA, 25 bp, Mus musculus
tataaagaggatagccctgcgcacg

SEQ ID NO: 130244 - DNA, 25 bp, Mus musculus
tataaagagtcagctttcacgggac

SEQ ID NO: 130245 - DNA, 25 bp, Mus musculus
tataaagccgacgatccaacaatgg

SEQ ID NO: 130246 - DNA, 25 bp, Mus musculus
tataaagcgtccaccagtcttcagg

SEQ ID NO: 130247 - DNA, 25 bp, Mus musculus
tataaagctgcagttgcggcccact

SEQ ID NO: 130248 - DNA, 25 bp, Mus musculus
tataaagctggagcttggacccggg

SEQ ID NO: 130249 - DNA, 25 bp, Mus musculus
tataaaggaataggtggtggcaccg

SEQ ID NO: 130250 - DNA, 25 bp, Mus musculus
tataaaggaggtgaatgtgagccca

SEQ ID NO: 130251 - DNA, 25 bp, Mus musculus
tataaaggcatatggtgctgggctc

SEQ ID NO: 130252 - DNA, 25 bp, Mus musculus
tataaaggcatggtgggctccatcg

SEQ ID NO: 130253 - DNA, 25 bp, Mus musculus
tataaaggcttagtccccaaacctg

SEQ ID NO: 130254 - DNA, 25 bp, Mus musculus
tataaagtgatcatacgcccaggga

SEQ ID NO: 130255 - DNA, 25 bp, Mus musculus
tataaagttgttccaaggatagcag

SEQ ID NO: 130256 - DNA, 25 bp, Mus musculus
tataaataactcattgggcgaccag

SEQ ID NO: 130257 - DNA, 25 bp, Mus musculus
tataaataatacagaaagcacggtg

SEQ ID NO: 130258 - DNA, 25 bp, Mus musculus
tataaatacgatgggcagcgagcac

SEQ ID NO: 130259 - DNA, 25 bp, Mus musculus
tataaatcaaggagagaggcaccag

SEQ ID NO: 130260 - DNA, 25 bp, Mus musculus
tataaatcaagtcaagttgtactct

SEQ ID NO: 130261 - DNA, 25 bp, Mus musculus
tataaatcctcactcatagccctga

SEQ ID NO: 130262 - DNA, 25 bp, Mus musculus
tataaatgagaaccgtggccagcct

SEQ ID NO: 130263 - DNA, 25 bp, Mus musculus
tataaatggcgagcagaatgcccag

SEQ ID NO: 130264 - DNA, 25 bp, Mus musculus
tataaatggtgacgaaatgacatcc

SEQ ID NO: 130265 - DNA, 25 bp, Mus musculus
tataaatggtgtgcacagcctggag

SEQ ID NO: 130266 - DNA, 25 bp, Mus musculus
tataaatgtaatgcagtcacggtcc

SEQ ID NO: 130267 - DNA, 25 bp, Mus musculus
tataaatgtgccgtctgccgcagag

SEQ ID NO: 130268 - DNA, 25 bp, Mus musculus
tataaattctaatcgaggtatcctg

SEQ ID NO: 130269 - DNA, 25 bp, Mus musculus
tataaatttgtgtcccgatcagaga

SEQ ID NO: 130270 - DNA, 25 bp, Mus musculus
tataacaaatggtttgcaggagcac

SEQ ID NO: 130271 - DNA, 25 bp, Mus musculus
tataacaacacgtccatagtccagg

SEQ ID NO: 130272 - DNA, 25 bp, Mus musculus
tataacaatgtcaatgcctgcgtgc

SEQ ID NO: 130273 - DNA, 25 bp, Mus musculus
tataacaccccgtcaaccagtcaga

SEQ ID NO: 130274 - DNA, 25 bp, Mus musculus
tataacagcagggagaagcactgcc

SEQ ID NO: 130275 - DNA, 25 bp, Mus musculus
tataacagcgcctggatggagactg

SEQ ID NO: 130276 - DNA, 25 bp, Mus musculus
tataacaggccatcagcgtcactgc

SEQ ID NO: 130277 - DNA, 25 bp, Mus musculus
tataacagtggtacctgccaaatca

SEQ ID NO: 130278 - DNA, 25 bp, Mus musculus
tataacatacatagatgacctcctg

SEQ ID NO: 130279 - DNA, 25 bp, Mus musculus
tataacatgaccgtgtatcaggcag

SEQ ID NO: 130280 - DNA, 25 bp, Mus musculus
tataacatgcgagtggaagactacg

SEQ ID NO: 130281 - DNA, 25 bp, Mus musculus
tataacattgaaactgaaaactgac

SEQ ID NO: 130282 - DNA, 25 bp, Mus musculus
tataacattgactcggatctaccgg

SEQ ID NO: 130283 - DNA, 25 bp, Mus musculus
tataaccaccaaggacaaagacgga

SEQ ID NO: 130284 - DNA, 25 bp, Mus musculus
tataaccaggccttgagaacagcaa

SEQ ID NO: 130285 - DNA, 25 bp, Mus musculus
tataaccatcttcctgaactgagag

SEQ ID NO: 130286 - DNA, 25 bp, Mus musculus
tataacccaatggtctcatgcctgg

SEQ ID NO: 130287 - DNA, 25 bp, Mus musculus
tataacccacaaaatgcagaggacg

SEQ ID NO: 130288 - DNA, 25 bp, Mus musculus
tataacccaggttcccatgaagagc

SEQ ID NO: 130289 - DNA, 25 bp, Mus musculus
tataacccggtgcaggaattcaacc

SEQ ID NO: 130290 - DNA, 25 bp, Mus musculus
tataaccgctgcaagggcagcatct

SEQ ID NO: 130291 - DNA, 25 bp, Mus musculus
tataaccggctcatccattattggg

SEQ ID NO: 130292 - DNA, 25 bp, Mus musculus
tataaccgtgacacagaggcagctg

SEQ ID NO: 130293 - DNA, 25 bp, Mus musculus
tataacctgtttgagggacggcctc

SEQ ID NO: 130294 - DNA, 25 bp, Mus musculus
tataacgctctagatgaatacccag

SEQ ID NO: 130295 - DNA, 25 bp, Mus musculus
tataacgggcgctttggtgaatgca

SEQ ID NO: 130296 - DNA, 25 bp, Mus musculus
tataactccaataatgaagccaatg

SEQ ID NO: 130297 - DNA, 25 bp, Mus musculus
tataactccatagagaaggctcctg

SEQ ID NO: 130298 - DNA, 25 bp, Mus musculus
tataactggcgggagaacctagacc

SEQ ID NO: 130299 - DNA, 25 bp, Mus musculus
tataactgggagataccaccctcca

SEQ ID NO: 130300 - DNA, 25 bp, Mus musculus
tataactttaatggcagccgggacc

SEQ ID NO: 130301 - DNA, 25 bp, Mus musculus
tataagaaagcccacaagaatgccc

SEQ ID NO: 130302 - DNA, 25 bp, Mus musculus
tataagaaggccatagccagtctgc

SEQ ID NO: 130303 - DNA, 25 bp, Mus musculus
tataagaatgcctatagaccacccg

SEQ ID NO: 130304 - DNA, 25 bp, Mus musculus
tataagaattatcagcaggcccagt

SEQ ID NO: 130305 - DNA, 25 bp, Mus musculus
tataagacattacggcaaagcttcc

SEQ ID NO: 130306 - DNA, 25 bp, Mus musculus
tataagaccgcgtataggcgcggcc

SEQ ID NO: 130307 - DNA, 25 bp, Mus musculus
tataagaccgtgtgggaaatctctc

SEQ ID NO: 130308 - DNA, 25 bp, Mus musculus
tataagacctacaacgggaccaact

SEQ ID NO: 130309 - DNA, 25 bp, Mus musculus
tataagactcttcaggctcccctga

SEQ ID NO: 130310 - DNA, 25 bp, Mus musculus
tataagagccattgctgaaaccctc

SEQ ID NO: 130311 - DNA, 25 bp, Mus musculus
tataagagccttcagactcagcccc

SEQ ID NO: 130312 - DNA, 25 bp, Mus musculus
tataagagcgtaactggctgtcagg

SEQ ID NO: 130313 - DNA, 25 bp, Mus musculus
tataagaggatgcacactgcactgc

SEQ ID NO: 130314 - DNA, 25 bp, Mus musculus
tataagagggcctgaactctgctgc

SEQ ID NO: 130315 - DNA, 25 bp, Mus musculus
tataagagtctccatgccctacagt

SEQ ID NO: 130316 - DNA, 25 bp, Mus musculus
tataagatccccaacattcgcggca

SEQ ID NO: 130317 - DNA, 25 bp, Mus musculus
tataagatctttgggctccccacag

SEQ ID NO: 130318 - DNA, 25 bp, Mus musculus
tataagattgggtaatcgctgccac

SEQ ID NO: 130319 - DNA, 25 bp, Mus musculus
tataagcaacatgggcgggaggatc

SEQ ID NO: 130320 - DNA, 25 bp, Mus musculus
tataagcaaccaccttgagcctgaa

SEQ ID NO: 130321 - DNA, 25 bp, Mus musculus
tataagcagtgatgaggtcaacttc

SEQ ID NO: 130322 - DNA, 25 bp, Mus musculus
tataagcagtgttcgtggagttcgc

SEQ ID NO: 130323 - DNA, 25 bp, Mus musculus
tataagccaagtttccccaagtggg

SEQ ID NO: 130324 - DNA, 25 bp, Mus musculus
tataagcccctagagttcacggtgg

SEQ ID NO: 130325 - DNA, 25 bp, Mus musculus
tataagcggcgtcttcgaacgcgcc

SEQ ID NO: 130326 - DNA, 25 bp, Mus musculus
tataagcgttgtcaccgggaagacc

SEQ ID NO: 130327 - DNA, 25 bp, Mus musculus
tataagcttaccaaagtcggcgaca

SEQ ID NO: 130328 - DNA, 25 bp, Mus musculus
tataaggaagaggatttgctctgag

SEQ ID NO: 130329 - DNA, 25 bp, Mus musculus
tataaggaatcttggagccggcttc

SEQ ID NO: 130330 - DNA, 25 bp, Mus musculus
tataaggagcttcggaagccactgg

SEQ ID NO: 130331 - DNA, 25 bp, Mus musculus
tataaggagttgtgtggccctcggc

SEQ ID NO: 130332 - DNA, 25 bp, Mus musculus
tataaggagttttccggacgctctg

SEQ ID NO: 130333 - DNA, 25 bp, Mus musculus
tataaggcgcgttcgctctaccgcg

SEQ ID NO: 130334 - DNA, 25 bp, Mus musculus
tataaggctgttgctgatcgactcc

SEQ ID NO: 130335 - DNA, 25 bp, Mus musculus
tataagggcgcagaagacgctctct

SEQ ID NO: 130336 - DNA, 25 bp, Mus musculus
tataagggtgacctagccaggtaca

SEQ ID NO: 130337 - DNA, 25 bp, Mus musculus
tataagggtgtgatccaagctatcc

SEQ ID NO: 130338 - DNA, 25 bp, Mus musculus
tataaggtcgatgggcagtcatgcc

SEQ ID NO: 130339 - DNA, 25 bp, Mus musculus
tataaggtgacctgccaaagctcag

SEQ ID NO: 130340 - DNA, 25 bp, Mus musculus
tataaggtgtgcgtcagcgtggtca

SEQ ID NO: 130341 - DNA, 25 bp, Mus musculus
tataagtacgaagtcaacaccagga

SEQ ID NO: 130342 - DNA, 25 bp, Mus musculus
tataagtcaagaggaaagcggcaca

SEQ ID NO: 130343 - DNA, 25 bp, Mus musculus
tataagtcaagagtccacagaagca

SEQ ID NO: 130344 - DNA, 25 bp, Mus musculus
tataagtcgttctgtcgggaccgtg

SEQ ID NO: 130345 - DNA, 25 bp, Mus musculus
tataagtgatgtttctgccgtcccc

SEQ ID NO: 130346 - DNA, 25 bp, Mus musculus
tataagtggaatgtctcccggccct

SEQ ID NO: 130347 - DNA, 25 bp, Mus musculus
tataagtggccccactggcttcatc

SEQ ID NO: 130348 - DNA, 25 bp, Mus musculus
tataataaagcgctttgatggaaag

SEQ ID NO: 130349 - DNA, 25 bp, Mus musculus
tataataacaatgaagaggctcctc

SEQ ID NO: 130350 - DNA, 25 bp, Mus musculus
tataataagctaaaggagcgcctgc

SEQ ID NO: 130351 - DNA, 25 bp, Mus musculus
tataatacaactctcctggatcgga

SEQ ID NO: 130352 - DNA, 25 bp, Mus musculus
tataataggacctgccagtgctcag

SEQ ID NO: 130353 - DNA, 25 bp, Mus musculus
tataatccatgggtacccaggctgg

SEQ ID NO: 130354 - DNA, 25 bp, Mus musculus
tataatcgttgtgctaagttcatcc

SEQ ID NO: 130355 - DNA, 25 bp, Mus musculus
tataatctattgaagagggatctgc

SEQ ID NO: 130356 - DNA, 25 bp, Mus musculus
tataatctgatagcgtgtggcacaa

SEQ ID NO: 130357 - DNA, 25 bp, Mus musculus
tataatcttcctgcttcgccagagg

SEQ ID NO: 130358 - DNA, 25 bp, Mus musculus
tataatgagctgcaggagttcccct

SEQ ID NO: 130359 - DNA, 25 bp, Mus musculus
tataatgagcttcaggaagttggcc

SEQ ID NO: 130360 - DNA, 25 bp, Mus musculus
tataatgcaccggaatgttcgctac

SEQ ID NO: 130361 - DNA, 25 bp, Mus musculus
tataatgcgaagaatgcctacacga

SEQ ID NO: 130362 - DNA, 25 bp, Mus musculus
tataatggctatacacgggaggctt

SEQ ID NO: 130363 - DNA, 25 bp, Mus musculus
tataatgggctactatgctgtcgac

SEQ ID NO: 130364 - DNA, 25 bp, Mus musculus
tataattatcaaacatccagctttc

SEQ ID NO: 130365 - DNA, 25 bp, Mus musculus
tataattatcactgacgtcacggcg

SEQ ID NO: 130366 - DNA, 25 bp, Mus musculus
tataattcgtggcaatgctcccatg

SEQ ID NO: 130367 - DNA, 25 bp, Mus musculus
tataattggcataacactggtgaac

SEQ ID NO: 130368 - DNA, 25 bp, Mus musculus
tatacaaagaaatatgtgatgaaac

SEQ ID NO: 130369 - DNA, 25 bp, Mus musculus
tatacaacacatttgcaggcaggca

SEQ ID NO: 130370 - DNA, 25 bp, Mus musculus
tatacaacctaaagacccgagaggg

SEQ ID NO: 130371 - DNA, 25 bp, Mus musculus
tatacaacgtgggactctgcatctg

SEQ ID NO: 130372 - DNA, 25 bp, Mus musculus
tatacaactggatggtagatgtggg

SEQ ID NO: 130373 - DNA, 25 bp, Mus musculus
tatacaaggagagccagtgtcgcct

SEQ ID NO: 130374 - DNA, 25 bp, Mus musculus
tatacaagtatttgggtgagaccca

SEQ ID NO: 130375 - DNA, 25 bp, Mus musculus
tatacaagtgctgtccctgagccag

SEQ ID NO: 130376 - DNA, 25 bp, Mus musculus
tatacaatcaaggacacggtggcct

SEQ ID NO: 130377 - DNA, 25 bp, Mus musculus
tatacaatgacaaatggaggcagca

SEQ ID NO: 130378 - DNA, 25 bp, Mus musculus
tatacacaaacctgtggagtggact

SEQ ID NO: 130379 - DNA, 25 bp, Mus musculus
tatacacactgattgtgcggccaga

SEQ ID NO: 130380 - DNA, 25 bp, Mus musculus
tatacacagaacatcgacgggcttg

SEQ ID NO: 130381 - DNA, 25 bp, Mus musculus
tatacacagagcaatgggcgcaggc

SEQ ID NO: 130382 - DNA, 25 bp, Mus musculus
tatacaccaatccaggagatcctca

SEQ ID NO: 130383 - DNA, 25 bp, Mus musculus
tatacacccgagtataggcggcgga

SEQ ID NO: 130384 - DNA, 25 bp, Mus musculus
tatacaccgactcatgctgcagggt

SEQ ID NO: 130385 - DNA, 25 bp, Mus musculus
tatacacctgcttacccggaagagg

SEQ ID NO: 130386 - DNA, 25 bp, Mus musculus
tatacacttctgacctcactgagag

SEQ ID NO: 130387 - DNA, 25 bp, Mus musculus
tatacagaaactcctagcaactagg

SEQ ID NO: 130388 - DNA, 25 bp, Mus musculus
tatacagaatgcctacgatcggcgc

SEQ ID NO: 130389 - DNA, 25 bp, Mus musculus
tatacagagttgaaggaccggctgg

SEQ ID NO: 130390 - DNA, 25 bp, Mus musculus
tatacagccgacaaggctaccactt

SEQ ID NO: 130391 - DNA, 25 bp, Mus musculus
tatacagcgcctgggacaagcagtt

SEQ ID NO: 130392 - DNA, 25 bp, Mus musculus
tatacaggaccagcaggaacaaatc

SEQ ID NO: 130393 - DNA, 25 bp, Mus musculus
tatacaggatgaacaccaacgcgca

SEQ ID NO: 130394 - DNA, 25 bp, Mus musculus
tatacaggcccaagccgtgcaaact

SEQ ID NO: 130395 - DNA, 25 bp, Mus musculus
tatacagtagcggtacagactgcct

SEQ ID NO: 130396 - DNA, 25 bp, Mus musculus
tatacagtcagcatgctcgaggtcc

SEQ ID NO: 130397 - DNA, 25 bp, Mus musculus
tatacatagagaacaaccgactgga

SEQ ID NO: 130398 - DNA, 25 bp, Mus musculus
tatacatcatgtggaggaccctcag

SEQ ID NO: 130399 - DNA, 25 bp, Mus musculus
tatacatccgaggacttccaccagg

SEQ ID NO: 130400 - DNA, 25 bp, Mus musculus
tatacatggcactcttccacggaag

SEQ ID NO: 130401 - DNA, 25 bp, Mus musculus
tatacattggagatttgccctccca

SEQ ID NO: 130402 - DNA, 25 bp, Mus musculus
tatacatttgaggactgccagctgg

SEQ ID NO: 130403 - DNA, 25 bp, Mus musculus
tataccaaaacctaggcgaatcctg

SEQ ID NO: 130404 - DNA, 25 bp, Mus musculus
tataccaaataccatgagcggctgc

SEQ ID NO: 130405 - DNA, 25 bp, Mus musculus
tataccaagaaggtgctccctgcag

SEQ ID NO: 130406 - DNA, 25 bp, Mus musculus
tataccagacaaagcatggcaaagt

SEQ ID NO: 130407 - DNA, 25 bp, Mus musculus
tataccagacttctgaggcacgtgg

SEQ ID NO: 130408 - DNA, 25 bp, Mus musculus
tataccagaggtggccgaatcatct

SEQ ID NO: 130409 - DNA, 25 bp, Mus musculus
tataccagattcatcagtatgggag

SEQ ID NO: 130410 - DNA, 25 bp, Mus musculus
tataccagctccgaggtcaaagtct

SEQ ID NO: 130411 - DNA, 25 bp, Mus musculus
tataccagctgtgcagggcagcgtc

SEQ ID NO: 130412 - DNA, 25 bp, Mus musculus
tataccaggaactgctccaaaggcg

SEQ ID NO: 130413 - DNA, 25 bp, Mus musculus
tataccaggttctagctgccaaggg

SEQ ID NO: 130414 - DNA, 25 bp, Mus musculus
tataccagtccccaacgatgctgat

SEQ ID NO: 130415 - DNA, 25 bp, Mus musculus
tataccatccattaagctagccaaa

SEQ ID NO: 130416 - DNA, 25 bp, Mus musculus
tataccatcggaagaccatgctgaa

SEQ ID NO: 130417 - DNA, 25 bp, Mus musculus
tataccatctgttgcggacatgaag

SEQ ID NO: 130418 - DNA, 25 bp, Mus musculus
tataccatggtgtctcacaagaccc

SEQ ID NO: 130419 - DNA, 25 bp, Mus musculus
tatacccacaacactgtccgaggct

SEQ ID NO: 130420 - DNA, 25 bp, Mus musculus
tatacccatggtgggaaccatgctg

SEQ ID NO: 130421 - DNA, 25 bp, Mus musculus
tataccccagtggttgacaaatgcc

SEQ ID NO: 130422 - DNA, 25 bp, Mus musculus
tatacccctgggaatcagcttagtg

SEQ ID NO: 130423 - DNA, 25 bp, Mus musculus
tatacccgagtgtctgaccacaagc

SEQ ID NO: 130424 - DNA, 25 bp, Mus musculus
tatacccggatgagcacaagtgagc

SEQ ID NO: 130425 - DNA, 25 bp, Mus musculus
tatacccgtcaatgggggccttgct

SEQ ID NO: 130426 - DNA, 25 bp, Mus musculus
tatacccgtgcccaggaacttgatg

SEQ ID NO: 130427 - DNA, 25 bp, Mus musculus
tataccctgctaaggaactgggctg

SEQ ID NO: 130428 - DNA, 25 bp, Mus musculus
tataccctggaatggcttggatggc

SEQ ID NO: 130429 - DNA, 25 bp, Mus musculus
tataccctggaggagcaagatgcca

SEQ ID NO: 130430 - DNA, 25 bp, Mus musculus
tatacccttgatatgacctgtgtgg

SEQ ID NO: 130431 - DNA, 25 bp, Mus musculus
tatacccttgtcatgagaaaagagg

SEQ ID NO: 130432 - DNA, 25 bp, Mus musculus
tataccgaaaatgccagggagatgc

SEQ ID NO: 130433 - DNA, 25 bp, Mus musculus
tataccgagtgctgcagtgccaaga

SEQ ID NO: 130434 - DNA, 25 bp, Mus musculus
tataccggagacttcttctcacaaa

SEQ ID NO: 130435 - DNA, 25 bp, Mus musculus
tataccgggcacttcgtactgagcg

SEQ ID NO: 130436 - DNA, 25 bp, Mus musculus
tataccgtggcgctgatggcatgaa

SEQ ID NO: 130437 - DNA, 25 bp, Mus musculus
tataccgttggatggaaaacctcag

SEQ ID NO: 130438 - DNA, 25 bp, Mus musculus
tatacctgcaccttgggattccacg

SEQ ID NO: 130439 - DNA, 25 bp, Mus musculus
tatacctgcatatgctacgagggct

SEQ ID NO: 130440 - DNA, 25 bp, Mus musculus
tatacctggaggatgacgatcccgt

SEQ ID NO: 130441 - DNA, 25 bp, Mus musculus
tatacctgtgtagccctttggattc

SEQ ID NO: 130442 - DNA, 25 bp, Mus musculus
tataccttgggctacagtgtttctc

SEQ ID NO: 130443 - DNA, 25 bp, Mus musculus
tatacgaaaacctccagaactcaag

SEQ ID NO: 130444 - DNA, 25 bp, Mus musculus
tatacgacccggaaagaaatacgct

SEQ ID NO: 130445 - DNA, 25 bp, Mus musculus
tatacgagcatcaacagcgaaggtg

SEQ ID NO: 130446 - DNA, 25 bp, Mus musculus
tatacgatagggagacaggaaaacc

SEQ ID NO: 130447 - DNA, 25 bp, Mus musculus
tatacgcagctaacagacattgggc

SEQ ID NO: 130448 - DNA, 25 bp, Mus musculus
tatacgcccgtcacaagtatttctg

SEQ ID NO: 130449 - DNA, 25 bp, Mus musculus
tatacgctgctgagaaggtcatggg

SEQ ID NO: 130450 - DNA, 25 bp, Mus musculus
tatacggacggtacacagagcacaa

SEQ ID NO: 130451 - DNA, 25 bp, Mus musculus
tatacgggaaaatgtacatacgtgt

SEQ ID NO: 130452 - DNA, 25 bp, Mus musculus
tatacggtcacacatcagaggaaca

SEQ ID NO: 130453 - DNA, 25 bp, Mus musculus
tatacgtcgccagtcatgagtgagc

SEQ ID NO: 130454 - DNA, 25 bp, Mus musculus
tatacgtgcaccaatggaatgctgc

SEQ ID NO: 130455 - DNA, 25 bp, Mus musculus
tatactacaggtcgcaaggcacgtg

SEQ ID NO: 130456 - DNA, 25 bp, Mus musculus
tatactactcgtccagctaggcctg

SEQ ID NO: 130457 - DNA, 25 bp, Mus musculus
tatactataggcagtttgcggccgc

SEQ ID NO: 130458 - DNA, 25 bp, Mus musculus
tatactatgctagcacacccagtgg

SEQ ID NO: 130459 - DNA, 25 bp, Mus musculus
tatactatgggcaccggctttgaca

SEQ ID NO: 130460 - DNA, 25 bp, Mus musculus
tatactcagatccacattaccgagc

SEQ ID NO: 130461 - DNA, 25 bp, Mus musculus
tatactcgaggctgttgcgggaacg

SEQ ID NO: 130462 - DNA, 25 bp, Mus musculus
tatactcggcacacaggtttcaaga

SEQ ID NO: 130463 - DNA, 25 bp, Mus musculus
tatactctaaatcgcagggagggtc

SEQ ID NO: 130464 - DNA, 25 bp, Mus musculus
tatactctgggatgcaaccgacatg

SEQ ID NO: 130465 - DNA, 25 bp, Mus musculus
tatactcttcagaataagaggcggc

SEQ ID NO: 130466 - DNA, 25 bp, Mus musculus
tatactgagccctacaagctggaag

SEQ ID NO: 130467 - DNA, 25 bp, Mus musculus
tatactgcagactatgacaaggccc

SEQ ID NO: 130468 - DNA, 25 bp, Mus musculus
tatactgcagattggctggtgggcc

SEQ ID NO: 130469 - DNA, 25 bp, Mus musculus
tatactgcatgtagagagctcgcca

SEQ ID NO: 130470 - DNA, 25 bp, Mus musculus
tatactggaagcatgcgcccaagac

SEQ ID NO: 130471 - DNA, 25 bp, Mus musculus
tatactggagtcgtggtctacgccc

SEQ ID NO: 130472 - DNA, 25 bp, Mus musculus
tatactggcatatgaaacgtctaca

SEQ ID NO: 130473 - DNA, 25 bp, Mus musculus
tatactgggaatcttcatgagaagc

SEQ ID NO: 130474 - DNA, 25 bp, Mus musculus
tatactggtgctatcttcggttcct

SEQ ID NO: 130475 - DNA, 25 bp, Mus musculus
tatactgtgagaaccagccaatgct

SEQ ID NO: 130476 - DNA, 25 bp, Mus musculus
tatacttaatgcaaacctgggcgag

SEQ ID NO: 130477 - DNA, 25 bp, Mus musculus
tatacttccatggtcccagagtgcc

SEQ ID NO: 130478 - DNA, 25 bp, Mus musculus
tatacttcctacagtacccttcgag

SEQ ID NO: 130479 - DNA, 25 bp, Mus musculus
tatacttctgacgaaggcagagcct

SEQ ID NO: 130480 - DNA, 25 bp, Mus musculus
tatacttgatccaagcgaacctcgg

SEQ ID NO: 130481 - DNA, 25 bp, Mus musculus
tatacttggtcgaagcctgtgacac

SEQ ID NO: 130482 - DNA, 25 bp, Mus musculus
tatagaaactttcactaccggaagc

SEQ ID NO: 130483 - DNA, 25 bp, Mus musculus
tatagaaagcccagggaagttcctc

SEQ ID NO: 130484 - DNA, 25 bp, Mus musculus
tatagaaatagtttccagggcagtc

SEQ ID NO: 130485 - DNA, 25 bp, Mus musculus
tatagaaccacaaaagcaccagcga

SEQ ID NO: 130486 - DNA, 25 bp, Mus musculus
tatagaactgttaggagcgccactc

SEQ ID NO: 130487 - DNA, 25 bp, Mus musculus
tatagaagacaatggcaggtggatg

SEQ ID NO: 130488 - DNA, 25 bp, Mus musculus
tatagaagccaattcaccaggaggt

SEQ ID NO: 130489 - DNA, 25 bp, Mus musculus
tatagaagcggagaagttgagccca

SEQ ID NO: 130490 - DNA, 25 bp, Mus musculus
tatagaagtggccagcgatcaccag

SEQ ID NO: 130491 - DNA, 25 bp, Mus musculus
tatagaatctccacagctgcagcct

SEQ ID NO: 130492 - DNA, 25 bp, Mus musculus
tatagacacgtgcttcatctctggg

SEQ ID NO: 130493 - DNA, 25 bp, Mus musculus
tatagacaggccgtcagcgtggatg

SEQ ID NO: 130494 - DNA, 25 bp, Mus musculus
tatagaccaggtgagcgaggacgat

SEQ ID NO: 130495 - DNA, 25 bp, Mus musculus
tatagaccctgatgccttgacagag

SEQ ID NO: 130496 - DNA, 25 bp, Mus musculus
tatagacgagtgcactgtgctccgg

SEQ ID NO: 130497 - DNA, 25 bp, Mus musculus
tatagagacctaaccatccctgtga

SEQ ID NO: 130498 - DNA, 25 bp, Mus musculus
tatagagaggatctgccaagagagt

SEQ ID NO: 130499 - DNA, 25 bp, Mus musculus
tatagagcaaagttcctgagcccag

SEQ ID NO: 130500 - DNA, 25 bp, Mus musculus
tatagagcacaaaggaggcttcctg

SEQ ID NO: 130501 - DNA, 25 bp, Mus musculus
tatagagcagcaattgaaggcggcc

SEQ ID NO: 130502 - DNA, 25 bp, Mus musculus
tatagaggaccagttccgtggcaca

SEQ ID NO: 130503 - DNA, 25 bp, Mus musculus
tatagaggcacaatctgaacgaact

SEQ ID NO: 130504 - DNA, 25 bp, Mus musculus
tatagaggtcccaatgtcatcgtcg

SEQ ID NO: 130505 - DNA, 25 bp, Mus musculus
tatagagtgggcctgctagccaact

SEQ ID NO: 130506 - DNA, 25 bp, Mus musculus
tatagataggcccagtgtcttggca

SEQ ID NO: 130507 - DNA, 25 bp, Mus musculus
tatagatcaaaagaaacctgttcgc

SEQ ID NO: 130508 - DNA, 25 bp, Mus musculus
tatagatcctgtattaatggcgcct

SEQ ID NO: 130509 - DNA, 25 bp, Mus musculus
tatagatgaccctgacgtgaggcgc

SEQ ID NO: 130510 - DNA, 25 bp, Mus musculus
tatagatggcttacacacgcttgga

SEQ ID NO: 130511 - DNA, 25 bp, Mus musculus
tatagatggtttacgctggagcagg

SEQ ID NO: 130512 - DNA, 25 bp, Mus musculus
tatagattaccgtgcattagcacag

SEQ ID NO: 130513 - DNA, 25 bp, Mus musculus
tatagattagctgtaacccgactgt

SEQ ID NO: 130514 - DNA, 25 bp, Mus musculus
tatagcaacagcattgtccgcagca

SEQ ID NO: 130515 - DNA, 25 bp, Mus musculus
tatagcaacgaaggtcaaggaggca

SEQ ID NO: 130516 - DNA, 25 bp, Mus musculus
tatagcacatgatggcttccagcag

SEQ ID NO: 130517 - DNA, 25 bp, Mus musculus
tatagcagagcttggtgtcccactg

SEQ ID NO: 130518 - DNA, 25 bp, Mus musculus
tatagcagcccggtatggccatgag

SEQ ID NO: 130519 - DNA, 25 bp, Mus musculus
tatagcaggcagataggttccccag

SEQ ID NO: 130520 - DNA, 25 bp, Mus musculus
tatagcatctgctcactttggtgca

SEQ ID NO: 130521 - DNA, 25 bp, Mus musculus
tatagcatggaccttaccgggcaga

SEQ ID NO: 130522 - DNA, 25 bp, Mus musculus
tatagccaaagtactgaagaactcg

SEQ ID NO: 130523 - DNA, 25 bp, Mus musculus
tatagccagaaagatgagggccctt

SEQ ID NO: 130524 - DNA, 25 bp, Mus musculus
tatagccagccccatcataaggact

SEQ ID NO: 130525 - DNA, 25 bp, Mus musculus
tatagcccagaagagatcgccatgg

SEQ ID NO: 130526 - DNA, 25 bp, Mus musculus
tatagccctccagaattaagaaatg

SEQ ID NO: 130527 - DNA, 25 bp, Mus musculus
tatagcctggacactcgttctgagc

SEQ ID NO: 130528 - DNA, 25 bp, Mus musculus
tatagcgctctagttggcccagact

SEQ ID NO: 130529 - DNA, 25 bp, Mus musculus
tatagcggcattaactagcgaggag

SEQ ID NO: 130530 - DNA, 25 bp, Mus musculus
tatagctcatctctgataccccgga

SEQ ID NO: 130531 - DNA, 25 bp, Mus musculus
tatagctgatgcagaaagtccagac

SEQ ID NO: 130532 - DNA, 25 bp, Mus musculus
tatagctgccaattagttcctctgt

SEQ ID NO: 130533 - DNA, 25 bp, Mus musculus
tatagctggcctgactaatcactga

SEQ ID NO: 130534 - DNA, 25 bp, Mus musculus
tatagctggcgcacagaaaaggacc

SEQ ID NO: 130535 - DNA, 25 bp, Mus musculus
tatagcttacaaactaattcggcgg

SEQ ID NO: 130536 - DNA, 25 bp, Mus musculus
tatagcttagcacaccacaactggt

SEQ ID NO: 130537 - DNA, 25 bp, Mus musculus
tatagcttagccgtgtcagcctgtc

SEQ ID NO: 130538 - DNA, 25 bp, Mus musculus
tatagcttggtgtggatcggagccc

SEQ ID NO: 130539 - DNA, 25 bp, Mus musculus
tatagctttgagaaactgttccccg

SEQ ID NO: 130540 - DNA, 25 bp, Mus musculus
tataggaactacactggttggccag

SEQ ID NO: 130541 - DNA, 25 bp, Mus musculus
tataggaagagaggtccgaaaccca

SEQ ID NO: 130542 - DNA, 25 bp, Mus musculus
tataggaagcaaacaagccatgggt

SEQ ID NO: 130543 - DNA, 25 bp, Mus musculus
tataggacagtacatccaagaccgt

SEQ ID NO: 130544 - DNA, 25 bp, Mus musculus
tataggactatgcagccgccttgtg

SEQ ID NO: 130545 - DNA, 25 bp, Mus musculus
tataggactcacctggatggaaccg

SEQ ID NO: 130546 - DNA, 25 bp, Mus musculus
tataggactgcgttcgtaggcatcc

SEQ ID NO: 130547 - DNA, 25 bp, Mus musculus
tataggagacatcaaaacaggagca

SEQ ID NO: 130548 - DNA, 25 bp, Mus musculus
tataggagacgttatcaagcagctg

SEQ ID NO: 130549 - DNA, 25 bp, Mus musculus
tataggagagcgttgtcaataccac

SEQ ID NO: 130550 - DNA, 25 bp, Mus musculus
tataggatacatgctgaaccacacc

SEQ ID NO: 130551 - DNA, 25 bp, Mus musculus
tataggatgaaacgcctgcaagcag

SEQ ID NO: 130552 - DNA, 25 bp, Mus musculus
tataggatgttggagaaccaagacc

SEQ ID NO: 130553 - DNA, 25 bp, Mus musculus
tataggcagcgtgaatctccgccga

SEQ ID NO: 130554 - DNA, 25 bp, Mus musculus
tataggcataagaatgacagaaccc

SEQ ID NO: 130555 - DNA, 25 bp, Mus musculus
tataggccagcctaccctctggtag

SEQ ID NO: 130556 - DNA, 25 bp, Mus musculus
tataggcccacagctcgttgagtct

SEQ ID NO: 130557 - DNA, 25 bp, Mus musculus
tataggcggcacgaaaggtttatct

SEQ ID NO: 130558 - DNA, 25 bp, Mus musculus
tataggctccgacacctttgaaaga

SEQ ID NO: 130559 - DNA, 25 bp, Mus musculus
tataggctgcatgcaaacacgggcc

SEQ ID NO: 130560 - DNA, 25 bp, Mus musculus
tataggctggtgagcacacgttggc

SEQ ID NO: 130561 - DNA, 25 bp, Mus musculus
tatagggacacatgtaactcgagcc

SEQ ID NO: 130562 - DNA, 25 bp, Mus musculus
tataggtgacctgcaaaaagcagac

SEQ ID NO: 130563 - DNA, 25 bp, Mus musculus
tataggtgcccctaagactgtggat

SEQ ID NO: 130564 - DNA, 25 bp, Mus musculus
tataggtgggtctaactgggacaac

SEQ ID NO: 130565 - DNA, 25 bp, Mus musculus
tataggttctgactcatgggcccgc

SEQ ID NO: 130566 - DNA, 25 bp, Mus musculus
tataggttgaacacagggccacttt

SEQ ID NO: 130567 - DNA, 25 bp, Mus musculus
tataggtttgcaccatgacacccga

SEQ ID NO: 130568 - DNA, 25 bp, Mus musculus
tatagtaacctcagtcacctgcccg

SEQ ID NO: 130569 - DNA, 25 bp, Mus musculus
tatagtaagggtctacgaggctccc

SEQ ID NO: 130570 - DNA, 25 bp, Mus musculus
tatagtaccgtatcgagccaccttc

SEQ ID NO: 130571 - DNA, 25 bp, Mus musculus
tatagtaggagtcaagagaacgtcc

SEQ ID NO: 130572 - DNA, 25 bp, Mus musculus
tatagtagttctctcccacctgtca

SEQ ID NO: 130573 - DNA, 25 bp, Mus musculus
tatagtatggctccctgcaccagtc

SEQ ID NO: 130574 - DNA, 25 bp, Mus musculus
tatagtcaaagcagggtcatgtggt

SEQ ID NO: 130575 - DNA, 25 bp, Mus musculus
tatagtccagaacgaggcaaagctg

SEQ ID NO: 130576 - DNA, 25 bp, Mus musculus
tatagtccatttcccaggtctgaga

SEQ ID NO: 130577 - DNA, 25 bp, Mus musculus
tatagtcctgatggacatcgtcccg

SEQ ID NO: 130578 - DNA, 25 bp, Mus musculus
tatagtctccctaccagctttagtg

SEQ ID NO: 130579 - DNA, 25 bp, Mus musculus
tatagtgacgagttgcaagcatgtc

SEQ ID NO: 130580 - DNA, 25 bp, Mus musculus
tatagtgactccaaagagaagcgct

SEQ ID NO: 130581 - DNA, 25 bp, Mus musculus
tatagtgagcattacagaattaggt

SEQ ID NO: 130582 - DNA, 25 bp, Mus musculus
tatagtgcaaagctagggtcctcag

SEQ ID NO: 130583 - DNA, 25 bp, Mus musculus
tatagttacgatgctcaaagagaag

SEQ ID NO: 130584 - DNA, 25 bp, Mus musculus
tatagttggtcctatcagacgcctc

SEQ ID NO: 130585 - DNA, 25 bp, Mus musculus
tatataaaacgggaggccagtggac

SEQ ID NO: 130586 - DNA, 25 bp, Mus musculus
tatataaaataacctgccctgctgg

SEQ ID NO: 130587 - DNA, 25 bp, Mus musculus
tatataaagagacgccgggcgtgcc

SEQ ID NO: 130588 - DNA, 25 bp, Mus musculus
tatataaagtcctagcatggcagca

SEQ ID NO: 130589 - DNA, 25 bp, Mus musculus
tatataacatatagcttcaaaaggg

SEQ ID NO: 130590 - DNA, 25 bp, Mus musculus
tatataactctgcagctttcaaagc

SEQ ID NO: 130591 - DNA, 25 bp, Mus musculus
tatataagcgagtgatgcccaaggg

SEQ ID NO: 130592 - DNA, 25 bp, Mus musculus
tatatacaagtgtccctgaatgtgc

SEQ ID NO: 130593 - DNA, 25 bp, Mus musculus
tatatacgaacaaaacatgcgcgca

SEQ ID NO: 130594 - DNA, 25 bp, Mus musculus
tatatacgtgttctgctcatgggac

SEQ ID NO: 130595 - DNA, 25 bp, Mus musculus
tatatactctggaaagacatctgcc

SEQ ID NO: 130596 - DNA, 25 bp, Mus musculus
tatatactgagggaagtgaccctcc

SEQ ID NO: 130597 - DNA, 25 bp, Mus musculus
tatatagacatgttaggcagctcct

SEQ ID NO: 130598 - DNA, 25 bp, Mus musculus
tatatagactcctcagtccctgcag

SEQ ID NO: 130599 - DNA, 25 bp, Mus musculus
tatatagagcctaccaacattgtca

SEQ ID NO: 130600 - DNA, 25 bp, Mus musculus
tatatagctgactatctggatggca

SEQ ID NO: 130601 - DNA, 25 bp, Mus musculus
tatataggatcgacagtctcccagc

SEQ ID NO: 130602 - DNA, 25 bp, Mus musculus
tatataggcgaatcttgctgctaca

SEQ ID NO: 130603 - DNA, 25 bp, Mus musculus
tatataggcttcctggtgcggctgc

SEQ ID NO: 130604 - DNA, 25 bp, Mus musculus
tatatagggccctgtagctggccag

SEQ ID NO: 130605 - DNA, 25 bp, Mus musculus
tatatatagcctctgtgagtctggc

SEQ ID NO: 130606 - DNA, 25 bp, Mus musculus
tatatatatcacgtggtgagcgcca

SEQ ID NO: 130607 - DNA, 25 bp, Mus musculus
tatatatattgagaccacctatctc

SEQ ID NO: 130608 - DNA, 25 bp, Mus musculus
tatatatcctgcttctgagatgccc

SEQ ID NO: 130609 - DNA, 25 bp, Mus musculus
tatatatggatggacagaactgtcg

SEQ ID NO: 130610 - DNA, 25 bp, Mus musculus
tatatattacttggagaggattgag

SEQ ID NO: 130611 - DNA, 25 bp, Mus musculus
tatatattcttcatgcaagggcagc

SEQ ID NO: 130612 - DNA, 25 bp, Mus musculus
tatatcaacacagagcatggcggca

SEQ ID NO: 130613 - DNA, 25 bp, Mus musculus
tatatcaaggcaactgtggacaccg

SEQ ID NO: 130614 - DNA, 25 bp, Mus musculus
tatatcagaaatacctcccagggca

SEQ ID NO: 130615 - DNA, 25 bp, Mus musculus
tatatcagcgatagtccttggaggc

SEQ ID NO: 130616 - DNA, 25 bp, Mus musculus
tatatcagctggtgttgtgtctcgg

SEQ ID NO: 130617 - DNA, 25 bp, Mus musculus
tatatcagtccaccatgagctccag

SEQ ID NO: 130618 - DNA, 25 bp, Mus musculus
tatatcagtgatgctctccggcggt

SEQ ID NO: 130619 - DNA, 25 bp, Mus musculus
tatatcagtggtggaggcttcagca

SEQ ID NO: 130620 - DNA, 25 bp, Mus musculus
tatatccaaagccttcaggagttgc

SEQ ID NO: 130621 - DNA, 25 bp, Mus musculus
tatatccaagaagctagtgggcccc

SEQ ID NO: 130622 - DNA, 25 bp, Mus musculus
tatatccagatgtaccggcgtaacc

SEQ ID NO: 130623 - DNA, 25 bp, Mus musculus
tatatccagcccaacatgtacggcc

SEQ ID NO: 130624 - DNA, 25 bp, Mus musculus
tatatccatagcaacagacccaagg

SEQ ID NO: 130625 - DNA, 25 bp, Mus musculus
tatatccatcccagagaaagcagcc

SEQ ID NO: 130626 - DNA, 25 bp, Mus musculus
tatatcccatagagtagagctctcg

SEQ ID NO: 130627 - DNA, 25 bp, Mus musculus
tatatccctgcgctcaagtgggacc

SEQ ID NO: 130628 - DNA, 25 bp, Mus musculus
tatatccctggaaaaccagtctaaa

SEQ ID NO: 130629 - DNA, 25 bp, Mus musculus
tatatccgatgaaccctgaactctg

SEQ ID NO: 130630 - DNA, 25 bp, Mus musculus
tatatccgcatcactcagtacctgg

SEQ ID NO: 130631 - DNA, 25 bp, Mus musculus
tatatccggtgtaaagtgggcagca

SEQ ID NO: 130632 - DNA, 25 bp, Mus musculus
tatatcctgagcttcctgcctctgt

SEQ ID NO: 130633 - DNA, 25 bp, Mus musculus
tatatcgacaccacctggagctgtg

SEQ ID NO: 130634 - DNA, 25 bp, Mus musculus
tatatcgcggcagttaaaaaactag

SEQ ID NO: 130635 - DNA, 25 bp, Mus musculus
tatatcggcgtggttaaccgaagcc

SEQ ID NO: 130636 - DNA, 25 bp, Mus musculus
tatatctacagctctaccgttgtgg

SEQ ID NO: 130637 - DNA, 25 bp, Mus musculus
tatatctcagtgttcaagggcagtg

SEQ ID NO: 130638 - DNA, 25 bp, Mus musculus
tatatctgaaaacgaccccttctgg

SEQ ID NO: 130639 - DNA, 25 bp, Mus musculus
tatatctggagaataggcacggacg

SEQ ID NO: 130640 - DNA, 25 bp, Mus musculus
tatatctggcttcagggcccatgag

SEQ ID NO: 130641 - DNA, 25 bp, Mus musculus
tatatctggtgcctgtctcgaggag

SEQ ID NO: 130642 - DNA, 25 bp, Mus musculus
tatatcttagtgctgccgctagacc

SEQ ID NO: 130643 - DNA, 25 bp, Mus musculus
tatatcttgctggttgggtatcccc

SEQ ID NO: 130644 - DNA, 25 bp, Mus musculus
tatatgaaacgagttcccaaaaggg

SEQ ID NO: 130645 - DNA, 25 bp, Mus musculus
tatatgaaagattgtcaccccaggg

SEQ ID NO: 130646 - DNA, 25 bp, Mus musculus
tatatgaagatgacaggagcaggca

SEQ ID NO: 130647 - DNA, 25 bp, Mus musculus
tatatgaggtgctcagagccggccg

SEQ ID NO: 130648 - DNA, 25 bp, Mus musculus
tatatgatgttgtcagcccagtgcc

SEQ ID NO: 130649 - DNA, 25 bp, Mus musculus
tatatgattcgcctgggcacactgg

SEQ ID NO: 130650 - DNA, 25 bp, Mus musculus
tatatgcaggttctggtctgtcagc

SEQ ID NO: 130651 - DNA, 25 bp, Mus musculus
tatatgccacagagcaccagacagt

SEQ ID NO: 130652 - DNA, 25 bp, Mus musculus
tatatgcctggaacggtacaagaac

SEQ ID NO: 130653 - DNA, 25 bp, Mus musculus
tatatgcgccaccttggagtccgga

SEQ ID NO: 130654 - DNA, 25 bp, Mus musculus
tatatgcggatcctgattgcctgcc

SEQ ID NO: 130655 - DNA, 25 bp, Mus musculus
tatatgctactctggcggctgctcg

SEQ ID NO: 130656 - DNA, 25 bp, Mus musculus
tatatggaaccatgggagggatgct

SEQ ID NO: 130657 - DNA, 25 bp, Mus musculus
tatatggacccagctaccggctatg

SEQ ID NO: 130658 - DNA, 25 bp, Mus musculus
tatatggaccgcatggcaagccatc

SEQ ID NO: 130659 - DNA, 25 bp, Mus musculus
tatatggagagaacgggacactgac

SEQ ID NO: 130660 - DNA, 25 bp, Mus musculus
tatatggatcccactggtaaaacca

SEQ ID NO: 130661 - DNA, 25 bp, Mus musculus
tatatggccccttagaaaatccagg

SEQ ID NO: 130662 - DNA, 25 bp, Mus musculus
tatatgggaacgctggcttatggca

SEQ ID NO: 130663 - DNA, 25 bp, Mus musculus
tatatgggactgtggagagcgctca

SEQ ID NO: 130664 - DNA, 25 bp, Mus musculus
tatatgggcctgtattcaaagttta

SEQ ID NO: 130665 - DNA, 25 bp, Mus musculus
tatatgggctctccttgctctagtc

SEQ ID NO: 130666 - DNA, 25 bp, Mus musculus
tatatgtatgtacttgcgaggcaga

SEQ ID NO: 130667 - DNA, 25 bp, Mus musculus
tatatgtcccagatgtgactcaggc

SEQ ID NO: 130668 - DNA, 25 bp, Mus musculus
tatatgtgacagaaagtggagcgcc

SEQ ID NO: 130669 - DNA, 25 bp, Mus musculus
tatatgtgaccatggcagtgccggc

SEQ ID NO: 130670 - DNA, 25 bp, Mus musculus
tatatgtgcaacaaagagcaggtgc

SEQ ID NO: 130671 - DNA, 25 bp, Mus musculus
tatatgtgcgccttgtcaccgagcc

SEQ ID NO: 130672 - DNA, 25 bp, Mus musculus
tatatgtgtcgctcgctcaagtgaa

SEQ ID NO: 130673 - DNA, 25 bp, Mus musculus
tatattaaaacctggcggccacgct

SEQ ID NO: 130674 - DNA, 25 bp, Mus musculus
tatattaaaacttcagacatctctg

SEQ ID NO: 130675 - DNA, 25 bp, Mus musculus
tatattaaattagccaccttttggc

SEQ ID NO: 130676 - DNA, 25 bp, Mus musculus
tatattacaggctgtgtgcaccctg

SEQ ID NO: 130677 - DNA, 25 bp, Mus musculus
tatattacctgcaacggagccagcc

SEQ ID NO: 130678 - DNA, 25 bp, Mus musculus
tatattacgtgaggatgctaagccc

SEQ ID NO: 130679 - DNA, 25 bp, Mus musculus
tatattactgtctacatgctccctg

SEQ ID NO: 130680 - DNA, 25 bp, Mus musculus
tatattagaacgctgtccggaagcg

SEQ ID NO: 130681 - DNA, 25 bp, Mus musculus
tatattagacatcgttcccaccgag

SEQ ID NO: 130682 - DNA, 25 bp, Mus musculus
tatattagcgctgccgagctgcgtc

SEQ ID NO: 130683 - DNA, 25 bp, Mus musculus
tatattaggcacgtgggccagctgg

SEQ ID NO: 130684 - DNA, 25 bp, Mus musculus
tatattcaccgagatctccgagctg

SEQ ID NO: 130685 - DNA, 25 bp, Mus musculus
tatattcagacagacctgcgtggca

SEQ ID NO: 130686 - DNA, 25 bp, Mus musculus
tatattcagacagacgggtatcgcg

SEQ ID NO: 130687 - DNA, 25 bp, Mus musculus
tatattcagcctaggacacaaggaa

SEQ ID NO: 130688 - DNA, 25 bp, Mus musculus
tatattcagcggctctccagtggct

SEQ ID NO: 130689 - DNA, 25 bp, Mus musculus
tatattccagtcatcagggctgctc

SEQ ID NO: 130690 - DNA, 25 bp, Mus musculus
tatattcggaagaacacagacagcg

SEQ ID NO: 130691 - DNA, 25 bp, Mus musculus
tatattcggagtgcagtcaccagga

SEQ ID NO: 130692 - DNA, 25 bp, Mus musculus
tatattgaggctggtcaggccgtac

SEQ ID NO: 130693 - DNA, 25 bp, Mus musculus
tatattgattgtccttttaataccc

SEQ ID NO: 130694 - DNA, 25 bp, Mus musculus
tatattgccaccatcttgcgggaga

SEQ ID NO: 130695 - DNA, 25 bp, Mus musculus
tatattgccagagccggatggactc

SEQ ID NO: 130696 - DNA, 25 bp, Mus musculus
tatattggatgatgtaaaggaaagc

SEQ ID NO: 130697 - DNA, 25 bp, Mus musculus
tatattggcgcaagtgagcaagctg

SEQ ID NO: 130698 - DNA, 25 bp, Mus musculus
tatattgggaccgaagaggacacag

SEQ ID NO: 130699 - DNA, 25 bp, Mus musculus
tatattggtactgagccatggaaac

SEQ ID NO: 130700 - DNA, 25 bp, Mus musculus
tatattgtacccctgatggcagctg

SEQ ID NO: 130701 - DNA, 25 bp, Mus musculus
tatattgtctctacggtgtgggcag

SEQ ID NO: 130702 - DNA, 25 bp, Mus musculus
tatattgttggacgagaccctgctg

SEQ ID NO: 130703 - DNA, 25 bp, Mus musculus
tatatttacaacttgacagcgcccc

SEQ ID NO: 130704 - DNA, 25 bp, Mus musculus
tatatttaccacaagctgctgggcc

SEQ ID NO: 130705 - DNA, 25 bp, Mus musculus
tatatttattgcgatgatgcaccca

SEQ ID NO: 130706 - DNA, 25 bp, Mus musculus
tatatttccgaccacatgaaggtgc

SEQ ID NO: 130707 - DNA, 25 bp, Mus musculus
tatatttcggagcaggcaggtgtcc

SEQ ID NO: 130708 - DNA, 25 bp, Mus musculus
tatatttgcggaaaactttgggcca

SEQ ID NO: 130709 - DNA, 25 bp, Mus musculus
tatatttggctacaaacagcgaggg

SEQ ID NO: 130710 - DNA, 25 bp, Mus musculus
tatattttctgctaggtgggcggcc

SEQ ID NO: 130711 - DNA, 25 bp, Mus musculus
tatcaaaaatccacaaagaccagcc

SEQ ID NO: 130712 - DNA, 25 bp, Mus musculus
tatcaaaaggaaagtcgacacggga

SEQ ID NO: 130713 - DNA, 25 bp, Mus musculus
tatcaaactgaatagaaaggaggga

SEQ ID NO: 130714 - DNA, 25 bp, Mus musculus
tatcaaagacgacaagggcaatctc

SEQ ID NO: 130715 - DNA, 25 bp, Mus musculus
tatcaaagatgtccacgaagactcc

SEQ ID NO: 130716 - DNA, 25 bp, Mus musculus
tatcaaagcaggtacatccacaagg

SEQ ID NO: 130717 - DNA, 25 bp, Mus musculus
tatcaaagccctgagcaaccagaag

SEQ ID NO: 130718 - DNA, 25 bp, Mus musculus
tatcaaagcgcagagtaggccctgt

SEQ ID NO: 130719 - DNA, 25 bp, Mus musculus
tatcaaagcgtgaaggccaagcagg

SEQ ID NO: 130720 - DNA, 25 bp, Mus musculus
tatcaaatgacgtcaatggccagct

SEQ ID NO: 130721 - DNA, 25 bp, Mus musculus
tatcaacaaaggcaaagggttcggg

SEQ ID NO: 130722 - DNA, 25 bp, Mus musculus
tatcaacaacgggtctgtcctccag

SEQ ID NO: 130723 - DNA, 25 bp, Mus musculus
tatcaacactctagaagtggcgggt

SEQ ID NO: 130724 - DNA, 25 bp, Mus musculus
tatcaaccattccatgagcaggagc

SEQ ID NO: 130725 - DNA, 25 bp, Mus musculus
tatcaaccctgatggctccgagagt

SEQ ID NO: 130726 - DNA, 25 bp, Mus musculus
tatcaacgagctggataaactgcag

SEQ ID NO: 130727 - DNA, 25 bp, Mus musculus
tatcaacgcaaaaccggatctgcgg

SEQ ID NO: 130728 - DNA, 25 bp, Mus musculus
tatcaacgctgtggaagcctcctgc

SEQ ID NO: 130729 - DNA, 25 bp, Mus musculus
tatcaacggcactctcagttcaggc

SEQ ID NO: 130730 - DNA, 25 bp, Mus musculus
tatcaactagcagaagccaatggcc

SEQ ID NO: 130731 - DNA, 25 bp, Mus musculus
tatcaactgggtgaagcatgccaag

SEQ ID NO: 130732 - DNA, 25 bp, Mus musculus
tatcaacttcggcatctacaagagg

SEQ ID NO: 130733 - DNA, 25 bp, Mus musculus
tatcaacttctggtaggccgctgag

SEQ ID NO: 130734 - DNA, 25 bp, Mus musculus
tatcaagaacctgtggaaccggaaa

SEQ ID NO: 130735 - DNA, 25 bp, Mus musculus
tatcaagaacgcactgagacaggtg

SEQ ID NO: 130736 - DNA, 25 bp, Mus musculus
tatcaagaatgcaaaacccgtgtcg

SEQ ID NO: 130737 - DNA, 25 bp, Mus musculus
tatcaagacaaagagggtccgggtt

SEQ ID NO: 130738 - DNA, 25 bp, Mus musculus
tatcaagaccttggtgcaggcccag

SEQ ID NO: 130739 - DNA, 25 bp, Mus musculus
tatcaagagatggaagctagccgcc

SEQ ID NO: 130740 - DNA, 25 bp, Mus musculus
tatcaagagggtcatggcggctatc

SEQ ID NO: 130741 - DNA, 25 bp, Mus musculus
tatcaagatacatggatgaagtacg

SEQ ID NO: 130742 - DNA, 25 bp, Mus musculus
tatcaagcactgaagtgaaattcac

SEQ ID NO: 130743 - DNA, 25 bp, Mus musculus
tatcaagcaggcaacatctcacgag

SEQ ID NO: 130744 - DNA, 25 bp, Mus musculus
tatcaagcggcacaagtggaacgac

SEQ ID NO: 130745 - DNA, 25 bp, Mus musculus
tatcaagctgttggcagtagccgcc

SEQ ID NO: 130746 - DNA, 25 bp, Mus musculus
tatcaaggctggctgacattggccg

SEQ ID NO: 130747 - DNA, 25 bp, Mus musculus
tatcaagggcttcatggttcaaaca

SEQ ID NO: 130748 - DNA, 25 bp, Mus musculus
tatcaaggtgctatctgcgggaaga

SEQ ID NO: 130749 - DNA, 25 bp, Mus musculus
tatcaagtccctagatggctccgtg

SEQ ID NO: 130750 - DNA, 25 bp, Mus musculus
tatcaagtcctattgttgccggtgg

SEQ ID NO: 130751 - DNA, 25 bp, Mus musculus
tatcaagtccttttacaccagtggc

SEQ ID NO: 130752 - DNA, 25 bp, Mus musculus
tatcaagtgtcttcctccacgcgga

SEQ ID NO: 130753 - DNA, 25 bp, Mus musculus
tatcaataacttgctacaagtgaaa

SEQ ID NO: 130754 - DNA, 25 bp, Mus musculus
tatcaatgaagtcacaaccctctgg

SEQ ID NO: 130755 - DNA, 25 bp, Mus musculus
tatcaatgccatcctactgggtgcc

SEQ ID NO: 130756 - DNA, 25 bp, Mus musculus
tatcaatgcccgtgaggtagctccc

SEQ ID NO: 130757 - DNA, 25 bp, Mus musculus
tatcaatgtggacgtggcagtgacc

SEQ ID NO: 130758 - DNA, 25 bp, Mus musculus
tatcaattaatgttaattaccaacg

SEQ ID NO: 130759 - DNA, 25 bp, Mus musculus
tatcacaaagcagtactatcggcga

SEQ ID NO: 130760 - DNA, 25 bp, Mus musculus
tatcacaagaagagtggtacaacct

SEQ ID NO: 130761 - DNA, 25 bp, Mus musculus
tatcacaagctacaactctgggagc

SEQ ID NO: 130762 - DNA, 25 bp, Mus musculus
tatcacaagtaaccaccagagagct

SEQ ID NO: 130763 - DNA, 25 bp, Mus musculus
tatcacaatttgaaaataaatttcc

SEQ ID NO: 130764 - DNA, 25 bp, Mus musculus
tatcacagagaagaaccctaacagc

SEQ ID NO: 130765 - DNA, 25 bp, Mus musculus
tatcacagatcggattcccacagag

SEQ ID NO: 130766 - DNA, 25 bp, Mus musculus
tatcacaggcagtccacagagatcc

SEQ ID NO: 130767 - DNA, 25 bp, Mus musculus
tatcacatcatcaccaggcgagcag

SEQ ID NO: 130768 - DNA, 25 bp, Mus musculus
tatcaccaaagacctgttgcgggac

SEQ ID NO: 130769 - DNA, 25 bp, Mus musculus
tatcaccattgttcagggccagacg

SEQ ID NO: 130770 - DNA, 25 bp, Mus musculus
tatcaccccggatttcagcagagga

SEQ ID NO: 130771 - DNA, 25 bp, Mus musculus
tatcaccccgggttctatgcctcct

SEQ ID NO: 130772 - DNA, 25 bp, Mus musculus
tatcacccctgaagctgtaaacgtc

SEQ ID NO: 130773 - DNA, 25 bp, Mus musculus
tatcacccgcatctggacaagtgga

SEQ ID NO: 130774 - DNA, 25 bp, Mus musculus
tatcacccgctcaccatattgggac

SEQ ID NO: 130775 - DNA, 25 bp, Mus musculus
tatcaccctgaaagagctggacggc

SEQ ID NO: 130776 - DNA, 25 bp, Mus musculus
tatcaccctgttgtacatcctctgg

SEQ ID NO: 130777 - DNA, 25 bp, Mus musculus
tatcaccggaagctatgatcggacc

SEQ ID NO: 130778 - DNA, 25 bp, Mus musculus
tatcaccgtatcgtggaggcctttc

SEQ ID NO: 130779 - DNA, 25 bp, Mus musculus
tatcaccgtctgtgggatcgagcct

SEQ ID NO: 130780 - DNA, 25 bp, Mus musculus
tatcaccgtgggagagacttcccat

SEQ ID NO: 130781 - DNA, 25 bp, Mus musculus
tatcacctcaggttggctggttaga

SEQ ID NO: 130782 - DNA, 25 bp, Mus musculus
tatcacctcgatgggattccagcga

SEQ ID NO: 130783 - DNA, 25 bp, Mus musculus
tatcacctctccaaaatgggatggc

SEQ ID NO: 130784 - DNA, 25 bp, Mus musculus
tatcacctgcaagaacggtcggaag

SEQ ID NO: 130785 - DNA, 25 bp, Mus musculus
tatcacctgtgacaacccagtggac

SEQ ID NO: 130786 - DNA, 25 bp, Mus musculus
tatcacgctcatcagtatgtggcca

SEQ ID NO: 130787 - DNA, 25 bp, Mus musculus
tatcacggagtatcagagcattctg

SEQ ID NO: 130788 - DNA, 25 bp, Mus musculus
tatcacgggaatcaaaggactggcc

SEQ ID NO: 130789 - DNA, 25 bp, Mus musculus
tatcactcgcctagagaagggcaag

SEQ ID NO: 130790 - DNA, 25 bp, Mus musculus
tatcactgagaaccacgcactctgg

SEQ ID NO: 130791 - DNA, 25 bp, Mus musculus
tatcactgggtggatctgttggacc

SEQ ID NO: 130792 - DNA, 25 bp, Mus musculus
tatcacttcgttcagttctctccct

SEQ ID NO: 130793 - DNA, 25 bp, Mus musculus
tatcacttgtctcaggaagacagag

SEQ ID NO: 130794 - DNA, 25 bp, Mus musculus
tatcactttaaacatcaagccccgg

SEQ ID NO: 130795 - DNA, 25 bp, Mus musculus
tatcactttcgggacctgtctccgg

SEQ ID NO: 130796 - DNA, 25 bp, Mus musculus
tatcactttggctggaccgactaat

SEQ ID NO: 130797 - DNA, 25 bp, Mus musculus
tatcagaaatggacaaagagggcca

SEQ ID NO: 130798 - DNA, 25 bp, Mus musculus
tatcagaacatcttcacggccatgc

SEQ ID NO: 130799 - DNA, 25 bp, Mus musculus
tatcagaagagctcacagacacctg

SEQ ID NO: 130800 - DNA, 25 bp, Mus musculus
tatcagaagccaaaggaggtcatgg

SEQ ID NO: 130801 - DNA, 25 bp, Mus musculus
tatcagaagccttcggaaagccaga

SEQ ID NO: 130802 - DNA, 25 bp, Mus musculus
tatcagaaggagcttccgggacacc

SEQ ID NO: 130803 - DNA, 25 bp, Mus musculus
tatcagaaggctgccaaagatgccc

SEQ ID NO: 130804 - DNA, 25 bp, Mus musculus
tatcagaatagggacagaagtcttc

SEQ ID NO: 130805 - DNA, 25 bp, Mus musculus
tatcagacagaagttggcactcgga

SEQ ID NO: 130806 - DNA, 25 bp, Mus musculus
tatcagaccatctagcctggtgggc

SEQ ID NO: 130807 - DNA, 25 bp, Mus musculus
tatcagaccgagtatgaggaggaac

SEQ ID NO: 130808 - DNA, 25 bp, Mus musculus
tatcagagatcaacactacggtgcc

SEQ ID NO: 130809 - DNA, 25 bp, Mus musculus
tatcagagatgccttcaagggagga

SEQ ID NO: 130810 - DNA, 25 bp, Mus musculus
tatcagagctacgtgtggaacacca

SEQ ID NO: 130811 - DNA, 25 bp, Mus musculus
tatcagagtgctggacggtcccttc

SEQ ID NO: 130812 - DNA, 25 bp, Mus musculus
tatcagcaaacacactcagctcagc

SEQ ID NO: 130813 - DNA, 25 bp, Mus musculus
tatcagcaacagcagtatggctctg

SEQ ID NO: 130814 - DNA, 25 bp, Mus musculus
tatcagcagcaccaccacggttagt

SEQ ID NO: 130815 - DNA, 25 bp, Mus musculus
tatcagcatggaccggtacattgcc

SEQ ID NO: 130816 - DNA, 25 bp, Mus musculus
tatcagccagagagaggagacggct

SEQ ID NO: 130817 - DNA, 25 bp, Mus musculus
tatcagccagtgtgaggagcttcga

SEQ ID NO: 130818 - DNA, 25 bp, Mus musculus
tatcagccatatgagatcccagcgg

SEQ ID NO: 130819 - DNA, 25 bp, Mus musculus
tatcagcggctcaagtttgaacgag

SEQ ID NO: 130820 - DNA, 25 bp, Mus musculus
tatcagctaaaccaggagtcctgcg

SEQ ID NO: 130821 - DNA, 25 bp, Mus musculus
tatcagctacactgccagaactcgg

SEQ ID NO: 130822 - DNA, 25 bp, Mus musculus
tatcagctcacctgtagtgggcggc

SEQ ID NO: 130823 - DNA, 25 bp, Mus musculus
tatcagctgacattggaatggcccc

SEQ ID NO: 130824 - DNA, 25 bp, Mus musculus
tatcagctgagaacataccctgcca

SEQ ID NO: 130825 - DNA, 25 bp, Mus musculus
tatcagctgagcaacatgcttcccc

SEQ ID NO: 130826 - DNA, 25 bp, Mus musculus
tatcagctgtgcaaatcgctggacc

SEQ ID NO: 130827 - DNA, 25 bp, Mus musculus
tatcagcttcagtagccaagccccg

SEQ ID NO: 130828 - DNA, 25 bp, Mus musculus
tatcagcttgttctgcgcactggcc

SEQ ID NO: 130829 - DNA, 25 bp, Mus musculus
tatcagctttggtgtgattgcagca

SEQ ID NO: 130830 - DNA, 25 bp, Mus musculus
tatcaggaactcaagatcgtgccag

SEQ ID NO: 130831 - DNA, 25 bp, Mus musculus
tatcaggaccgagaccagtttgcca

SEQ ID NO: 130832 - DNA, 25 bp, Mus musculus
tatcaggacggactacccacttggt

SEQ ID NO: 130833 - DNA, 25 bp, Mus musculus
tatcaggactcagacaaatgtggtg

SEQ ID NO: 130834 - DNA, 25 bp, Mus musculus
tatcaggagtgcgactctcaccagc

SEQ ID NO: 130835 - DNA, 25 bp, Mus musculus
tatcaggcaagacacggagtttatc

SEQ ID NO: 130836 - DNA, 25 bp, Mus musculus
tatcaggctgcatagggaggagact

SEQ ID NO: 130837 - DNA, 25 bp, Mus musculus
tatcagggacctgaccctaagagaa

SEQ ID NO: 130838 - DNA, 25 bp, Mus musculus
tatcagggccagtccttgaggccta

SEQ ID NO: 130839 - DNA, 25 bp, Mus musculus
tatcagggcccatattcttaaagac

SEQ ID NO: 130840 - DNA, 25 bp, Mus musculus
tatcaggtaccaacgactatgtgca

SEQ ID NO: 130841 - DNA, 25 bp, Mus musculus
tatcaggtgggactggacagtttcc

SEQ ID NO: 130842 - DNA, 25 bp, Mus musculus
tatcaggtgtccctaaatgctggct

SEQ ID NO: 130843 - DNA, 25 bp, Mus musculus
tatcagtagttaaccagctacggga

SEQ ID NO: 130844 - DNA, 25 bp, Mus musculus
tatcagtccacagctaccaggaaca

SEQ ID NO: 130845 - DNA, 25 bp, Mus musculus
tatcagtcctggtcatgtgccacac

SEQ ID NO: 130846 - DNA, 25 bp, Mus musculus
tatcagtgagcaaagtcaagcaatt

SEQ ID NO: 130847 - DNA, 25 bp, Mus musculus
tatcagtgcaaactctaatggctcc

SEQ ID NO: 130848 - DNA, 25 bp, Mus musculus
tatcagtgcacagtggccaaccatg

SEQ ID NO: 130849 - DNA, 25 bp, Mus musculus
tatcagtgccaccaaggtctgggtc

SEQ ID NO: 130850 - DNA, 25 bp, Mus musculus
tatcagtgcccatcactatctggcg

SEQ ID NO: 130851 - DNA, 25 bp, Mus musculus
tatcagtgctactgccgtcagggct

SEQ ID NO: 130852 - DNA, 25 bp, Mus musculus
tatcagtggagaggaggactcagcc

SEQ ID NO: 130853 - DNA, 25 bp, Mus musculus
tatcagtggagctcttagtgacgac

SEQ ID NO: 130854 - DNA, 25 bp, Mus musculus
tatcagtggtcacagaggtttccag

SEQ ID NO: 130855 - DNA, 25 bp, Mus musculus
tatcagtgtcagtaggtggtccaga

SEQ ID NO: 130856 - DNA, 25 bp, Mus musculus
tatcagtgtgcacaagggacacccc

SEQ ID NO: 130857 - DNA, 25 bp, Mus musculus
tatcagttactggaaggactacatc

SEQ ID NO: 130858 - DNA, 25 bp, Mus musculus
tatcagttgaagaaaatgtgcagcc

SEQ ID NO: 130859 - DNA, 25 bp, Mus musculus
tatcagttgtacagggctgccctag

SEQ ID NO: 130860 - DNA, 25 bp, Mus musculus
tatcatactgcttgtcacggtcggc

SEQ ID NO: 130861 - DNA, 25 bp, Mus musculus
tatcatagtgcctacgcagcagcag

SEQ ID NO: 130862 - DNA, 25 bp, Mus musculus
tatcatcaaattaaacaaggctggc

SEQ ID NO: 130863 - DNA, 25 bp, Mus musculus
tatcatcaaccttctgggagcgtgc

SEQ ID NO: 130864 - DNA, 25 bp, Mus musculus
tatcatcaagcgctatgaggacggc

SEQ ID NO: 130865 - DNA, 25 bp, Mus musculus
tatcatcaattcatcctccatgagc

SEQ ID NO: 130866 - DNA, 25 bp, Mus musculus
tatcatcagccatgtgggtacagtc

SEQ ID NO: 130867 - DNA, 25 bp, Mus musculus
tatcatccatgtgcagacgctaacc

SEQ ID NO: 130868 - DNA, 25 bp, Mus musculus
tatcatcgaaggcagtcaggcaggc

SEQ ID NO: 130869 - DNA, 25 bp, Mus musculus
tatcatcggaatcttagacgccctg

SEQ ID NO: 130870 - DNA, 25 bp, Mus musculus
tatcatctacaaagttgggaacggg

SEQ ID NO: 130871 - DNA, 25 bp, Mus musculus
tatcatctcatgaaggacgccacag

SEQ ID NO: 130872 - DNA, 25 bp, Mus musculus
tatcatctcttcagcgacgtggccg

SEQ ID NO: 130873 - DNA, 25 bp, Mus musculus
tatcatctgtcaaaaatgggagccc

SEQ ID NO: 130874 - DNA, 25 bp, Mus musculus
tatcatctgtttccaggaagcatgg

SEQ ID NO: 130875 - DNA, 25 bp, Mus musculus
tatcatctttcagaggcgtaggcag

SEQ ID NO: 130876 - DNA, 25 bp, Mus musculus
tatcatgaaccaaaagatgtcttcc

SEQ ID NO: 130877 - DNA, 25 bp, Mus musculus
tatcatgagctcagcgatgcagcag

SEQ ID NO: 130878 - DNA, 25 bp, Mus musculus
tatcatgaggaaggatcgacctggg

SEQ ID NO: 130879 - DNA, 25 bp, Mus musculus
tatcatgcatgaggcccagggtgct

SEQ ID NO: 130880 - DNA, 25 bp, Mus musculus
tatcatgccccgagccagggcctgg

SEQ ID NO: 130881 - DNA, 25 bp, Mus musculus
tatcatggctgtcatcctgggcatc

SEQ ID NO: 130882 - DNA, 25 bp, Mus musculus
tatcatgggtaatgccaaagtgaag

SEQ ID NO: 130883 - DNA, 25 bp, Mus musculus
tatcatgtacatttgcaggctccga

SEQ ID NO: 130884 - DNA, 25 bp, Mus musculus
tatcatgtggcagagtttcagctac

SEQ ID NO: 130885 - DNA, 25 bp, Mus musculus
tatcattcatatcaggacccgctgg

SEQ ID NO: 130886 - DNA, 25 bp, Mus musculus
tatcattcattaccgacaccaggag

SEQ ID NO: 130887 - DNA, 25 bp, Mus musculus
tatcattcggctacggaacaagacg

SEQ ID NO: 130888 - DNA, 25 bp, Mus musculus
tatcattcttctggttgtgattcag

SEQ ID NO: 130889 - DNA, 25 bp, Mus musculus
tatcattgagcatgttcgagacggc

SEQ ID NO: 130890 - DNA, 25 bp, Mus musculus
tatcattgagccctttgacgacagg

SEQ ID NO: 130891 - DNA, 25 bp, Mus musculus
tatcattgccttgcagaggttcccc

SEQ ID NO: 130892 - DNA, 25 bp, Mus musculus
tatcattgtatgtggcctggactct

SEQ ID NO: 130893 - DNA, 25 bp, Mus musculus
tatcattgttcgaaggctcctggac

SEQ ID NO: 130894 - DNA, 25 bp, Mus musculus
tatcattgttttctcccgtcccagg

SEQ ID NO: 130895 - DNA, 25 bp, Mus musculus
tatcattttgagtaatagcaccatg

SEQ ID NO: 130896 - DNA, 25 bp, Mus musculus
tatcattttgcaacaggcgtgtggc

SEQ ID NO: 130897 - DNA, 25 bp, Mus musculus
tatcattttgtgaagttgtgtctcg

SEQ ID NO: 130898 - DNA, 25 bp, Mus musculus
tatccaaaatgccatccgtgacctg

SEQ ID NO: 130899 - DNA, 25 bp, Mus musculus
tatccaaacatgactgcagtgctgc

SEQ ID NO: 130900 - DNA, 25 bp, Mus musculus
tatccaaactagagccttcagagag

SEQ ID NO: 130901 - DNA, 25 bp, Mus musculus
tatccaaagagatgagtcacccatg

SEQ ID NO: 130902 - DNA, 25 bp, Mus musculus
tatccaaaggaggttggctcggagc

SEQ ID NO: 130903 - DNA, 25 bp, Mus musculus
tatccaaagggtgctccaaggtcaa

SEQ ID NO: 130904 - DNA, 25 bp, Mus musculus
tatccaaatgtaggcaagagctctg

SEQ ID NO: 130905 - DNA, 25 bp, Mus musculus
tatccaacacgagtgggcacgcttc

SEQ ID NO: 130906 - DNA, 25 bp, Mus musculus
tatccaagagagaacggcagtacca

SEQ ID NO: 130907 - DNA, 25 bp, Mus musculus
tatccaagaggtcagagactcccac

SEQ ID NO: 130908 - DNA, 25 bp, Mus musculus
tatccaagcctcagtacaaagagcg

SEQ ID NO: 130909 - DNA, 25 bp, Mus musculus
tatccaagcgagaagcgaagtgacc

SEQ ID NO: 130910 - DNA, 25 bp, Mus musculus
tatccaagggatccagagcatcgca

SEQ ID NO: 130911 - DNA, 25 bp, Mus musculus
tatccaaggtcacatgggacagcgc

SEQ ID NO: 130912 - DNA, 25 bp, Mus musculus
tatccaaggtctcctccaagtgtgg

SEQ ID NO: 130913 - DNA, 25 bp, Mus musculus
tatccaatcacagcttgcagcaaga

SEQ ID NO: 130914 - DNA, 25 bp, Mus musculus
tatccaatgaggactgcagggccag

SEQ ID NO: 130915 - DNA, 25 bp, Mus musculus
tatccaatttcgatcagcagcagct

SEQ ID NO: 130916 - DNA, 25 bp, Mus musculus
tatccacctactagcagatgcccgg

SEQ ID NO: 130917 - DNA, 25 bp, Mus musculus
tatccacgatgcgttttctggccgc

SEQ ID NO: 130918 - DNA, 25 bp, Mus musculus
tatccacgcctgagaagtcacagct

SEQ ID NO: 130919 - DNA, 25 bp, Mus musculus
tatccacggatgcttcgcaacgttg

SEQ ID NO: 130920 - DNA, 25 bp, Mus musculus
tatccacgtcttgtggccagcagac

SEQ ID NO: 130921 - DNA, 25 bp, Mus musculus
tatccacgtgtccaagttctagcgg

SEQ ID NO: 130922 - DNA, 25 bp, Mus musculus
tatccactatgtccgacggctggcg

SEQ ID NO: 130923 - DNA, 25 bp, Mus musculus
tatccagaaatcaggttaaaccggc

SEQ ID NO: 130924 - DNA, 25 bp, Mus musculus
tatccagaacaacgtgcgggaagcc

SEQ ID NO: 130925 - DNA, 25 bp, Mus musculus
tatccagaacccaggaatcccaagg

SEQ ID NO: 130926 - DNA, 25 bp, Mus musculus
tatccagaaggaagtggctacaagc

SEQ ID NO: 130927 - DNA, 25 bp, Mus musculus
tatccagacgctttcatgcgcgagg

SEQ ID NO: 130928 - DNA, 25 bp, Mus musculus
tatccagagggatcttacggtaacc

SEQ ID NO: 130929 - DNA, 25 bp, Mus musculus
tatccagagtaattaacatgtaaag

SEQ ID NO: 130930 - DNA, 25 bp, Mus musculus
tatccagatcagactacagctgagg

SEQ ID NO: 130931 - DNA, 25 bp, Mus musculus
tatccagattgtgctgatgcgggca

SEQ ID NO: 130932 - DNA, 25 bp, Mus musculus
tatccagcagatcttggaggctgtg

SEQ ID NO: 130933 - DNA, 25 bp, Mus musculus
tatccagccgttcaggagaatgcag

SEQ ID NO: 130934 - DNA, 25 bp, Mus musculus
tatccagcctactcgggtgtcagaa

SEQ ID NO: 130935 - DNA, 25 bp, Mus musculus
tatccagcgtcctaggtgagggaac

SEQ ID NO: 130936 - DNA, 25 bp, Mus musculus
tatccagctcatattgaagacattg

SEQ ID NO: 130937 - DNA, 25 bp, Mus musculus
tatccagctcttgctaggtgctagg

SEQ ID NO: 130938 - DNA, 25 bp, Mus musculus
tatccaggagggtgatctcattgaa

SEQ ID NO: 130939 - DNA, 25 bp, Mus musculus
tatccaggatgctgggctgtaccag

SEQ ID NO: 130940 - DNA, 25 bp, Mus musculus
tatccaggatggagaagccacatgc

SEQ ID NO: 130941 - DNA, 25 bp, Mus musculus
tatccaggattctaccatccatcca

SEQ ID NO: 130942 - DNA, 25 bp, Mus musculus
tatccaggcaatgggctcgggtacg

SEQ ID NO: 130943 - DNA, 25 bp, Mus musculus
tatccagtaccaaataaagtcatgc

SEQ ID NO: 130944 - DNA, 25 bp, Mus musculus
tatccagtcagtaagagacccagca

SEQ ID NO: 130945 - DNA, 25 bp, Mus musculus
tatccagtccttcagtgccatggcg

SEQ ID NO: 130946 - DNA, 25 bp, Mus musculus
tatccagtgctgtttccaaggtctc

SEQ ID NO: 130947 - DNA, 25 bp, Mus musculus
tatccagtggagcaaaccaggtagt

SEQ ID NO: 130948 - DNA, 25 bp, Mus musculus
tatccatacaaaaaagacctccctc

SEQ ID NO: 130949 - DNA, 25 bp, Mus musculus
tatccatcggccaagtgttcaagac

SEQ ID NO: 130950 - DNA, 25 bp, Mus musculus
tatccatcgtggaatgccccaggag

SEQ ID NO: 130951 - DNA, 25 bp, Mus musculus
tatccatgaagccagacgacaagta

SEQ ID NO: 130952 - DNA, 25 bp, Mus musculus
tatccatgcgtttgtggctgccata

SEQ ID NO: 130953 - DNA, 25 bp, Mus musculus
tatccattccccaaggagacagagg

SEQ ID NO: 130954 - DNA, 25 bp, Mus musculus
tatccattgcatcgtatgggccaag

SEQ ID NO: 130955 - DNA, 25 bp, Mus musculus
tatcccaaggcactgaagaggtgga

SEQ ID NO: 130956 - DNA, 25 bp, Mus musculus
tatcccaagggttactttgtccagg

SEQ ID NO: 130957 - DNA, 25 bp, Mus musculus
tatcccaatataacctctaccgatt

SEQ ID NO: 130958 - DNA, 25 bp, Mus musculus
tatcccacagggttaaagagtcaca

SEQ ID NO: 130959 - DNA, 25 bp, Mus musculus
tatcccacaggtatgggctctacgt

SEQ ID NO: 130960 - DNA, 25 bp, Mus musculus
tatcccaccaattttagctgaaaca

SEQ ID NO: 130961 - DNA, 25 bp, Mus musculus
tatcccagaacaacacaacagtggc

SEQ ID NO: 130962 - DNA, 25 bp, Mus musculus
tatcccagagatgcataggcgtttg

SEQ ID NO: 130963 - DNA, 25 bp, Mus musculus
tatcccagcgtctcagagttcaggt

SEQ ID NO: 130964 - DNA, 25 bp, Mus musculus
tatcccaggaagagggcacaagtac

SEQ ID NO: 130965 - DNA, 25 bp, Mus musculus
tatcccaggtggtgtttgtcagcaa

SEQ ID NO: 130966 - DNA, 25 bp, Mus musculus
tatcccatcagcattaaagttgccc

SEQ ID NO: 130967 - DNA, 25 bp, Mus musculus
tatcccatggccaagggtatcgtcc

SEQ ID NO: 130968 - DNA, 25 bp, Mus musculus
tatcccattgagtgaggtcacgtgc

SEQ ID NO: 130969 - DNA, 25 bp, Mus musculus
tatcccattttttccactattattg

SEQ ID NO: 130970 - DNA, 25 bp, Mus musculus
tatccccaagaggtaggagccactg

SEQ ID NO: 130971 - DNA, 25 bp, Mus musculus
tatccccgacagtgaagaagcaatg

SEQ ID NO: 130972 - DNA, 25 bp, Mus musculus
tatccccggagaccctctgcgatgg

SEQ ID NO: 130973 - DNA, 25 bp, Mus musculus
tatcccctccagctcaagagagctg

SEQ ID NO: 130974 - DNA, 25 bp, Mus musculus
tatcccctgcgctttgaacgtgcca

SEQ ID NO: 130975 - DNA, 25 bp, Mus musculus
tatcccgacatgaaattggagctcc

SEQ ID NO: 130976 - DNA, 25 bp, Mus musculus
tatcccggactcctagtagcaggca

SEQ ID NO: 130977 - DNA, 25 bp, Mus musculus
tatcccgggactctgacgactgtgt

SEQ ID NO: 130978 - DNA, 25 bp, Mus musculus
tatcccgggacttcagtaccagggc

SEQ ID NO: 130979 - DNA, 25 bp, Mus musculus
tatccctgaacgtttgaaaagccga

SEQ ID NO: 130980 - DNA, 25 bp, Mus musculus
tatccctgatggagaatggttctgc

SEQ ID NO: 130981 - DNA, 25 bp, Mus musculus
tatccctgcacatgtggtggctgct

SEQ ID NO: 130982 - DNA, 25 bp, Mus musculus
tatccctgcccctctggaacaagag

SEQ ID NO: 130983 - DNA, 25 bp, Mus musculus
tatccctggcggtagctgatgtggc

SEQ ID NO: 130984 - DNA, 25 bp, Mus musculus
tatccctggtgtttctgcagtgccg

SEQ ID NO: 130985 - DNA, 25 bp, Mus musculus
tatcccttgggatcatatccgtctg

SEQ ID NO: 130986 - DNA, 25 bp, Mus musculus
tatccctttgtctgcagcctcgtgc

SEQ ID NO: 130987 - DNA, 25 bp, Mus musculus
tatccgaaacctgaaagaagagctt

SEQ ID NO: 130988 - DNA, 25 bp, Mus musculus
tatccgaaatgctctgcagcactgg

SEQ ID NO: 130989 - DNA, 25 bp, Mus musculus
tatccgaattcaagaccgggcccgt

SEQ ID NO: 130990 - DNA, 25 bp, Mus musculus
tatccgacagggtagcgtaagctgg

SEQ ID NO: 130991 - DNA, 25 bp, Mus musculus
tatccgacgtctgcgaggacttcga

SEQ ID NO: 130992 - DNA, 25 bp, Mus musculus
tatccgagaacacgagctgctctac

SEQ ID NO: 130993 - DNA, 25 bp, Mus musculus
tatccgaggtgctgtagaggctgct

SEQ ID NO: 130994 - DNA, 25 bp, Mus musculus
tatccgagttccaggtgagcctcca

SEQ ID NO: 130995 - DNA, 25 bp, Mus musculus
tatccgatcaaatattgggaccgag

SEQ ID NO: 130996 - DNA, 25 bp, Mus musculus
tatccgatgagctctacagtggctg

SEQ ID NO: 130997 - DNA, 25 bp, Mus musculus
tatccgcaaggtacatgtgcgcacc

SEQ ID NO: 130998 - DNA, 25 bp, Mus musculus
tatccgccgggagaaacttatccag

SEQ ID NO: 130999 - DNA, 25 bp, Mus musculus
tatccgcggtgtggttgactccgag

SEQ ID NO: 131000 - DNA, 25 bp, Mus musculus
tatccgcgtggtcctcagtttgggc

SEQ ID NO: 131001 - DNA, 25 bp, Mus musculus
tatccgctaacggagagccagctgg

SEQ ID NO: 131002 - DNA, 25 bp, Mus musculus
tatccgctcctactgatgaaacctg

SEQ ID NO: 131003 - DNA, 25 bp, Mus musculus
tatccggaaggaggacatcagtggc

SEQ ID NO: 131004 - DNA, 25 bp, Mus musculus
tatccggaaggattatgaagcttgc

SEQ ID NO: 131005 - DNA, 25 bp, Mus musculus
tatccggaagtgtcaacgtggtcga

SEQ ID NO: 131006 - DNA, 25 bp, Mus musculus
tatccggagggcgtgcataagcatt

SEQ ID NO: 131007 - DNA, 25 bp, Mus musculus
tatccggaggtccacatcatcaggg

SEQ ID NO: 131008 - DNA, 25 bp, Mus musculus
tatccggcagagcaatcagatgctg

SEQ ID NO: 131009 - DNA, 25 bp, Mus musculus
tatccggcattatattaccctgagc

SEQ ID NO: 131010 - DNA, 25 bp, Mus musculus
tatccggccccagtggataagtttt

SEQ ID NO: 131011 - DNA, 25 bp, Mus musculus
tatccggcggttggcttgccgacct

SEQ ID NO: 131012 - DNA, 25 bp, Mus musculus
tatccgggaaaagacactgggcaag

SEQ ID NO: 131013 - DNA, 25 bp, Mus musculus
tatccgggcctctgtggctgctcaa

SEQ ID NO: 131014 - DNA, 25 bp, Mus musculus
tatccgggctgctcctgacatttgc

SEQ ID NO: 131015 - DNA, 25 bp, Mus musculus
tatccggtcgaatcagacaatgggc

SEQ ID NO: 131016 - DNA, 25 bp, Mus musculus
tatccggtgaacgaagagctgtact

SEQ ID NO: 131017 - DNA, 25 bp, Mus musculus
tatccggtggatgaaagagcagacg

SEQ ID NO: 131018 - DNA, 25 bp, Mus musculus
tatccgtagggaaaagctggctctg

SEQ ID NO: 131019 - DNA, 25 bp, Mus musculus
tatccgtcgtaacaagacgccggcg

SEQ ID NO: 131020 - DNA, 25 bp, Mus musculus
tatccgtgagattgggacccacaag

SEQ ID NO: 131021 - DNA, 25 bp, Mus musculus
tatccgtggcatcgagaccactggg

SEQ ID NO: 131022 - DNA, 25 bp, Mus musculus
tatcctaagcattctcattgagctg

SEQ ID NO: 131023 - DNA, 25 bp, Mus musculus
tatcctacctgataacccagccatg

SEQ ID NO: 131024 - DNA, 25 bp, Mus musculus
tatcctagcaacatctcggcgttcg

SEQ ID NO: 131025 - DNA, 25 bp, Mus musculus
tatcctagcaggtcagatgtcagac

SEQ ID NO: 131026 - DNA, 25 bp, Mus musculus
tatcctataagaacactcgtgaagc

SEQ ID NO: 131027 - DNA, 25 bp, Mus musculus
tatcctatgccttctggatcatggc

SEQ ID NO: 131028 - DNA, 25 bp, Mus musculus
tatcctcagagcacatatcgtgtct

SEQ ID NO: 131029 - DNA, 25 bp, Mus musculus
tatcctcagttgatagaatgtcccc

SEQ ID NO: 131030 - DNA, 25 bp, Mus musculus
tatcctccagatgggtatggccgac

SEQ ID NO: 131031 - DNA, 25 bp, Mus musculus
tatcctccagttagcagaagtgtgt

SEQ ID NO: 131032 - DNA, 25 bp, Mus musculus
tatcctccgtgtggatcccaagggc

SEQ ID NO: 131033 - DNA, 25 bp, Mus musculus
tatcctcggcgttaagacaagagca

SEQ ID NO: 131034 - DNA, 25 bp, Mus musculus
tatcctctggcatctcaggtgagcc

SEQ ID NO: 131035 - DNA, 25 bp, Mus musculus
tatcctctggcctgagccttggcaa

SEQ ID NO: 131036 - DNA, 25 bp, Mus musculus
tatcctctgggctggaaacatttgg

SEQ ID NO: 131037 - DNA, 25 bp, Mus musculus
tatcctctttaaaaaaccctgcaga

SEQ ID NO: 131038 - DNA, 25 bp, Mus musculus
tatcctgaaggtgaaagggcgccga

SEQ ID NO: 131039 - DNA, 25 bp, Mus musculus
tatcctgacagagcgggtgagccat

SEQ ID NO: 131040 - DNA, 25 bp, Mus musculus
tatcctgacataccacgacattggg

SEQ ID NO: 131041 - DNA, 25 bp, Mus musculus
tatcctgatgtatctgcctgggcca

SEQ ID NO: 131042 - DNA, 25 bp, Mus musculus
tatcctggaaaatggtatggccacc

SEQ ID NO: 131043 - DNA, 25 bp, Mus musculus
tatcctggcatgtaagcagtaacag

SEQ ID NO: 131044 - DNA, 25 bp, Mus musculus
tatcctggccctgaatggactgagc

SEQ ID NO: 131045 - DNA, 25 bp, Mus musculus
tatcctggcgccagagaagctgacc

SEQ ID NO: 131046 - DNA, 25 bp, Mus musculus
tatcctggctgagccttagagctcc

SEQ ID NO: 131047 - DNA, 25 bp, Mus musculus
tatcctgggacaatggcggtggccc

SEQ ID NO: 131048 - DNA, 25 bp, Mus musculus
tatcctgggtgtgggcttctacgcc

SEQ ID NO: 131049 - DNA, 25 bp, Mus musculus
tatcctggtgataggcaaactcgac

SEQ ID NO: 131050 - DNA, 25 bp, Mus musculus
tatcctggtggctggcagtatgctt

SEQ ID NO: 131051 - DNA, 25 bp, Mus musculus
tatcctggtttcctctgcaagtggc

SEQ ID NO: 131052 - DNA, 25 bp, Mus musculus
tatcctgtcagtgccaaggcctgga

SEQ ID NO: 131053 - DNA, 25 bp, Mus musculus
tatcctgtgcgtaggcacggctgcc

SEQ ID NO: 131054 - DNA, 25 bp, Mus musculus
tatcctgtggagaacttgctgaacc

SEQ ID NO: 131055 - DNA, 25 bp, Mus musculus
tatcctgtggatgacggctgtcgca

SEQ ID NO: 131056 - DNA, 25 bp, Mus musculus
tatcctgtggcatgtgggactctca

SEQ ID NO: 131057 - DNA, 25 bp, Mus musculus
tatcctgtggcgaaaacgacaaccc

SEQ ID NO: 131058 - DNA, 25 bp, Mus musculus
tatccttcggttgacattgatgcac

SEQ ID NO: 131059 - DNA, 25 bp, Mus musculus
tatccttgtgagcatatcgcctggg

SEQ ID NO: 131060 - DNA, 25 bp, Mus musculus
tatccttgtgatgggcgacatggcc

SEQ ID NO: 131061 - DNA, 25 bp, Mus musculus
tatccttgtgctcatcggctacgtg

SEQ ID NO: 131062 - DNA, 25 bp, Mus musculus
tatcctttcagaaccaccaaagcgg

SEQ ID NO: 131063 - DNA, 25 bp, Mus musculus
tatcgaaactgtgagactgacacgc

SEQ ID NO: 131064 - DNA, 25 bp, Mus musculus
tatcgaaagtgtggtcagacctcca

SEQ ID NO: 131065 - DNA, 25 bp, Mus musculus
tatcgaagctgtgactctaggaact

SEQ ID NO: 131066 - DNA, 25 bp, Mus musculus
tatcgaatatgctggaagagagacc

SEQ ID NO: 131067 - DNA, 25 bp, Mus musculus
tatcgacatggagatcggtcaccag

SEQ ID NO: 131068 - DNA, 25 bp, Mus musculus
tatcgacattgctggcctgcgacag

SEQ ID NO: 131069 - DNA, 25 bp, Mus musculus
tatcgaccttggctcaggcaatgga

SEQ ID NO: 131070 - DNA, 25 bp, Mus musculus
tatcgacggcggatggtaaagcctt

SEQ ID NO: 131071 - DNA, 25 bp, Mus musculus
tatcgacgtggtgctgtctcaacac

SEQ ID NO: 131072 - DNA, 25 bp, Mus musculus
tatcgactctggtgatcgctagcac

SEQ ID NO: 131073 - DNA, 25 bp, Mus musculus
tatcgactttgagagtgtgacccca

SEQ ID NO: 131074 - DNA, 25 bp, Mus musculus
tatcgagaatctgcagagcgggaaa

SEQ ID NO: 131075 - DNA, 25 bp, Mus musculus
tatcgagagctcttggtgcatctgc

SEQ ID NO: 131076 - DNA, 25 bp, Mus musculus
tatcgagatggacaactggacatgc

SEQ ID NO: 131077 - DNA, 25 bp, Mus musculus
tatcgagccgcactagaatacctgg

SEQ ID NO: 131078 - DNA, 25 bp, Mus musculus
tatcgaggaccgtatcagcctgctg

SEQ ID NO: 131079 - DNA, 25 bp, Mus musculus
tatcgaggccggataccctggtgtc

SEQ ID NO: 131080 - DNA, 25 bp, Mus musculus
tatcgagtcggtgttatgtccttcc

SEQ ID NO: 131081 - DNA, 25 bp, Mus musculus
tatcgagtggcccagaagccagtgt

SEQ ID NO: 131082 - DNA, 25 bp, Mus musculus
tatcgagttccttctcggccagcgt

SEQ ID NO: 131083 - DNA, 25 bp, Mus musculus
tatcgataaggaggttcagccacac

SEQ ID NO: 131084 - DNA, 25 bp, Mus musculus
tatcgatcccggtgggaaagcagca

SEQ ID NO: 131085 - DNA, 25 bp, Mus musculus
tatcgattgttctcagcagaccgga

SEQ ID NO: 131086 - DNA, 25 bp, Mus musculus
tatcgatttcttccgagactgggac

SEQ ID NO: 131087 - DNA, 25 bp, Mus musculus
tatcgcaggcctctgcaatgccact

SEQ ID NO: 131088 - DNA, 25 bp, Mus musculus
tatcgcagggtggaaagacaatctg

SEQ ID NO: 131089 - DNA, 25 bp, Mus musculus
tatcgcatgtgttactcaagctgac

SEQ ID NO: 131090 - DNA, 25 bp, Mus musculus
tatcgccaaccttggagatagtcgg

SEQ ID NO: 131091 - DNA, 25 bp, Mus musculus
tatcgccagcaggaatcaggccgtg

SEQ ID NO: 131092 - DNA, 25 bp, Mus musculus
tatcgccatcaagcggatgctagag

SEQ ID NO: 131093 - DNA, 25 bp, Mus musculus
tatcgccctcatgggtgagaccgtg

SEQ ID NO: 131094 - DNA, 25 bp, Mus musculus
tatcgccctttggatttgctacaac

SEQ ID NO: 131095 - DNA, 25 bp, Mus musculus
tatcgcctgagctcatcaatgctgc

SEQ ID NO: 131096 - DNA, 25 bp, Mus musculus
tatcgccttcttttataaccggagt

SEQ ID NO: 131097 - DNA, 25 bp, Mus musculus
tatcgccttgggatctttggcttcc

SEQ ID NO: 131098 - DNA, 25 bp, Mus musculus
tatcgcgtccgtgctcatggtgtgc

SEQ ID NO: 131099 - DNA, 25 bp, Mus musculus
tatcgctattcaccgaggcatggcc

SEQ ID NO: 131100 - DNA, 25 bp, Mus musculus
tatcgctcactgttgccaatggtgg

SEQ ID NO: 131101 - DNA, 25 bp, Mus musculus
tatcgctcagaaagttcgaggtgtg

SEQ ID NO: 131102 - DNA, 25 bp, Mus musculus
tatcgctcataggaaaagggaggct

SEQ ID NO: 131103 - DNA, 25 bp, Mus musculus
tatcgctgaccgcatgcagaaggag

SEQ ID NO: 131104 - DNA, 25 bp, Mus musculus
tatcgctgatgtgaaaccactgccc

SEQ ID NO: 131105 - DNA, 25 bp, Mus musculus
tatcgctgcgaggtccagcacggta

SEQ ID NO: 131106 - DNA, 25 bp, Mus musculus
tatcgctgcgctggtcgtcgacaac

SEQ ID NO: 131107 - DNA, 25 bp, Mus musculus
tatcggaaacgtgggatgagtggag

SEQ ID NO: 131108 - DNA, 25 bp, Mus musculus
tatcggaagcagttgggtcaccaca

SEQ ID NO: 131109 - DNA, 25 bp, Mus musculus
tatcggaagccactgctagagtctg

SEQ ID NO: 131110 - DNA, 25 bp, Mus musculus
tatcggaatcatcagtggagtcacc

SEQ ID NO: 131111 - DNA, 25 bp, Mus musculus
tatcggaattggcacaccaggtccc

SEQ ID NO: 131112 - DNA, 25 bp, Mus musculus
tatcggacagcgcaaagaacggcga

SEQ ID NO: 131113 - DNA, 25 bp, Mus musculus
tatcggacttaactctgggacctgg

SEQ ID NO: 131114 - DNA, 25 bp, Mus musculus
tatcggagacgcagcaatggaacca

SEQ ID NO: 131115 - DNA, 25 bp, Mus musculus
tatcggagatggaatgagaaccaga

SEQ ID NO: 131116 - DNA, 25 bp, Mus musculus
tatcggagtcgtgccaacctaggac

SEQ ID NO: 131117 - DNA, 25 bp, Mus musculus
tatcggattacttagaggacttcgg

SEQ ID NO: 131118 - DNA, 25 bp, Mus musculus
tatcggcatcttttcagggcaccag

SEQ ID NO: 131119 - DNA, 25 bp, Mus musculus
tatcggccactagtcagtcctgaca

SEQ ID NO: 131120 - DNA, 25 bp, Mus musculus
tatcggccccaaggtaggtgatgtc

SEQ ID NO: 131121 - DNA, 25 bp, Mus musculus
tatcggccctaaccgctgtgcttgc

SEQ ID NO: 131122 - DNA, 25 bp, Mus musculus
tatcggcctggagctcttcatggga

SEQ ID NO: 131123 - DNA, 25 bp, Mus musculus
tatcggcgatttgtagctgcacagg

SEQ ID NO: 131124 - DNA, 25 bp, Mus musculus
tatcggctcactccgagggcttgag

SEQ ID NO: 131125 - DNA, 25 bp, Mus musculus
tatcggctgattatgcgcggtgccc

SEQ ID NO: 131126 - DNA, 25 bp, Mus musculus
tatcggctgcatgtacaagtcagga

SEQ ID NO: 131127 - DNA, 25 bp, Mus musculus
tatcgggaaggtcagcagtgtcccc

SEQ ID NO: 131128 - DNA, 25 bp, Mus musculus
tatcgggatgatcctcttcaggacc

SEQ ID NO: 131129 - DNA, 25 bp, Mus musculus
tatcgggtagacaactctgagggca

SEQ ID NO: 131130 - DNA, 25 bp, Mus musculus
tatcgggtctggaactgggatcctg

SEQ ID NO: 131131 - DNA, 25 bp, Mus musculus
tatcgggtgcagatgaaccatgctc

SEQ ID NO: 131132 - DNA, 25 bp, Mus musculus
tatcggtatattcttgctgagcccg

SEQ ID NO: 131133 - DNA, 25 bp, Mus musculus
tatcggtcacatcgtaccgctgggt

SEQ ID NO: 131134 - DNA, 25 bp, Mus musculus
tatcggtgagtggaagcaaaaatcc

SEQ ID NO: 131135 - DNA, 25 bp, Mus musculus
tatcggtgccatcgccattggagac

SEQ ID NO: 131136 - DNA, 25 bp, Mus musculus
tatcggttccggaagcgggacaaag

SEQ ID NO: 131137 - DNA, 25 bp, Mus musculus
tatcgtacacgttgtcacggagcca

SEQ ID NO: 131138 - DNA, 25 bp, Mus musculus
tatcgtcagagctacccatggacag

SEQ ID NO: 131139 - DNA, 25 bp, Mus musculus
tatcgtcatgtttcggccagtaggc

SEQ ID NO: 131140 - DNA, 25 bp, Mus musculus
tatcgtcgatatagggaaagcagag

SEQ ID NO: 131141 - DNA, 25 bp, Mus musculus
tatcgtcggtgagatctgcattggg

SEQ ID NO: 131142 - DNA, 25 bp, Mus musculus
tatcgtgaagcccacgtccagaagg

SEQ ID NO: 131143 - DNA, 25 bp, Mus musculus
tatcgtgacctagagggtgtgccac

SEQ ID NO: 131144 - DNA, 25 bp, Mus musculus
tatcgtggccctcactgccaaggtg

SEQ ID NO: 131145 - DNA, 25 bp, Mus musculus
tatcgtgggcactcagaagttctcc

SEQ ID NO: 131146 - DNA, 25 bp, Mus musculus
tatcgttcactttgggatccgcccc

SEQ ID NO: 131147 - DNA, 25 bp, Mus musculus
tatcgttccactccacccgaagtga

SEQ ID NO: 131148 - DNA, 25 bp, Mus musculus
tatcgttcgatactttcgggcgcac

SEQ ID NO: 131149 - DNA, 25 bp, Mus musculus
tatcgttgcagaattacggcagcgg

SEQ ID NO: 131150 - DNA, 25 bp, Mus musculus
tatcgttgggtctacatttcacaga

SEQ ID NO: 131151 - DNA, 25 bp, Mus musculus
tatcgtttcttggtgcaggtccggc

SEQ ID NO: 131152 - DNA, 25 bp, Mus musculus
tatcgttttgtctatgcaggcccca

SEQ ID NO: 131153 - DNA, 25 bp, Mus musculus
tatctaaacggcaactgaagaagct

SEQ ID NO: 131154 - DNA, 25 bp, Mus musculus
tatctaacccaggaggacgtggtgg

SEQ ID NO: 131155 - DNA, 25 bp, Mus musculus
tatctaagcccaagcggaagagaga

SEQ ID NO: 131156 - DNA, 25 bp, Mus musculus
tatctaattcctgttagtgagggct

SEQ ID NO: 131157 - DNA, 25 bp, Mus musculus
tatctaattggccagaggtggcgcc

SEQ ID NO: 131158 - DNA, 25 bp, Mus musculus
tatctacaccagagttttaaatttc

SEQ ID NO: 131159 - DNA, 25 bp, Mus musculus
tatctacagacgacgcaaagctggg

SEQ ID NO: 131160 - DNA, 25 bp, Mus musculus
tatctacagtggctttgaggtgctc

SEQ ID NO: 131161 - DNA, 25 bp, Mus musculus
tatctacagtgttgtcagagccttg

SEQ ID NO: 131162 - DNA, 25 bp, Mus musculus
tatctaccacgggtacaggagaccc

SEQ ID NO: 131163 - DNA, 25 bp, Mus musculus
tatctaccatgggagcagccttggg

SEQ ID NO: 131164 - DNA, 25 bp, Mus musculus
tatctacctggaagctagctctgga

SEQ ID NO: 131165 - DNA, 25 bp, Mus musculus
tatctactacccagggtcccgcaga

SEQ ID NO: 131166 - DNA, 25 bp, Mus musculus
tatctactcctccataactacgtgg

SEQ ID NO: 131167 - DNA, 25 bp, Mus musculus
tatctactcttcgatcccaggagga

SEQ ID NO: 131168 - DNA, 25 bp, Mus musculus
tatctactgacctttgcctggaacg

SEQ ID NO: 131169 - DNA, 25 bp, Mus musculus
tatctagaaagagaaacttggcggc

SEQ ID NO: 131170 - DNA, 25 bp, Mus musculus
tatctagagagccacatcctgttga

SEQ ID NO: 131171 - DNA, 25 bp, Mus musculus
tatctagctccgctcttgaccgtgc

SEQ ID NO: 131172 - DNA, 25 bp, Mus musculus
tatctaggacttgcaaacaagagcg

SEQ ID NO: 131173 - DNA, 25 bp, Mus musculus
tatctagttgacagacctcgccgag

SEQ ID NO: 131174 - DNA, 25 bp, Mus musculus
tatctatctcgaggagctgacagct

SEQ ID NO: 131175 - DNA, 25 bp, Mus musculus
tatctatgaagcactggaactccga

SEQ ID NO: 131176 - DNA, 25 bp, Mus musculus
tatctatgctgaggtggaagggcca

SEQ ID NO: 131177 - DNA, 25 bp, Mus musculus
tatctatggaaacggagacttgcag

SEQ ID NO: 131178 - DNA, 25 bp, Mus musculus
tatctattcgaggtgcacttcgggc

SEQ ID NO: 131179 - DNA, 25 bp, Mus musculus
tatctattgatccttcctcgggcga

SEQ ID NO: 131180 - DNA, 25 bp, Mus musculus
tatctcaacgagatctcacccaagg

SEQ ID NO: 131181 - DNA, 25 bp, Mus musculus
tatctcaagaacatagtggtggctg

SEQ ID NO: 131182 - DNA, 25 bp, Mus musculus
tatctcaagactctggctggcgacg

SEQ ID NO: 131183 - DNA, 25 bp, Mus musculus
tatctcaagagcagcagtactggcg

SEQ ID NO: 131184 - DNA, 25 bp, Mus musculus
tatctcaagagtgccctggaggtcc

SEQ ID NO: 131185 - DNA, 25 bp, Mus musculus
tatctcaagtctggatggacaacgg

SEQ ID NO: 131186 - DNA, 25 bp, Mus musculus
tatctcacccttctgagtgcgcgca

SEQ ID NO: 131187 - DNA, 25 bp, Mus musculus
tatctcactgttggttccttcggaa

SEQ ID NO: 131188 - DNA, 25 bp, Mus musculus
tatctcagaccgagactgtgacgcc

SEQ ID NO: 131189 - DNA, 25 bp, Mus musculus
tatctcagatgtggtccttgtccgc

SEQ ID NO: 131190 - DNA, 25 bp, Mus musculus
tatctcagctaaaagtgcaagccag

SEQ ID NO: 131191 - DNA, 25 bp, Mus musculus
tatctcaggcaatggaagtggacgg

SEQ ID NO: 131192 - DNA, 25 bp, Mus musculus
tatctcagtcctatgaactccgagc

SEQ ID NO: 131193 - DNA, 25 bp, Mus musculus
tatctcatatgtccaggctgcaggg

SEQ ID NO: 131194 - DNA, 25 bp, Mus musculus
tatctcatccccaggaaacgaagag

SEQ ID NO: 131195 - DNA, 25 bp, Mus musculus
tatctcattattcggcggaagcctc

SEQ ID NO: 131196 - DNA, 25 bp, Mus musculus
tatctccaacattggcgggaacgca

SEQ ID NO: 131197 - DNA, 25 bp, Mus musculus
tatctccaccaagcgtgtcaaagtg

SEQ ID NO: 131198 - DNA, 25 bp, Mus musculus
tatctccacgttgggaacgcgttgc

SEQ ID NO: 131199 - DNA, 25 bp, Mus musculus
tatctccctgtcaaagtaatcccat

SEQ ID NO: 131200 - DNA, 25 bp, Mus musculus
tatctccggagaatcatatgtctga

SEQ ID NO: 131201 - DNA, 25 bp, Mus musculus
tatctccgttacgtacgaaggctgg

SEQ ID NO: 131202 - DNA, 25 bp, Mus musculus
tatctcctagttctccgctgctcgg

SEQ ID NO: 131203 - DNA, 25 bp, Mus musculus
tatctcctatgaccggcatctgtgg

SEQ ID NO: 131204 - DNA, 25 bp, Mus musculus
tatctcctgacatggaaactcttgg

SEQ ID NO: 131205 - DNA, 25 bp, Mus musculus
tatctcctgagcctatggcagcggc

SEQ ID NO: 131206 - DNA, 25 bp, Mus musculus
tatctcgagcatcatgggaagccag

SEQ ID NO: 131207 - DNA, 25 bp, Mus musculus
tatctcgctacggtggcagatgaca

SEQ ID NO: 131208 - DNA, 25 bp, Mus musculus
tatctcggtgggtcatctgaggctc

SEQ ID NO: 131209 - DNA, 25 bp, Mus musculus
tatctcgtcatggaagctctgttac

SEQ ID NO: 131210 - DNA, 25 bp, Mus musculus
tatctctaagcgagaagggccgctg

SEQ ID NO: 131211 - DNA, 25 bp, Mus musculus
tatctctcaggactgggctggcctt

SEQ ID NO: 131212 - DNA, 25 bp, Mus musculus
tatctctcatatggctcctgcaggg

SEQ ID NO: 131213 - DNA, 25 bp, Mus musculus
tatctctccttagtggtgaaacggt

SEQ ID NO: 131214 - DNA, 25 bp, Mus musculus
tatctctcgccaagacattaaagtt

SEQ ID NO: 131215 - DNA, 25 bp, Mus musculus
tatctctgagtctatggctgcctgc

SEQ ID NO: 131216 - DNA, 25 bp, Mus musculus
tatctcttagatggcaaaatgcagc

SEQ ID NO: 131217 - DNA, 25 bp, Mus musculus
tatctgaaaccctagcggatgcttg

SEQ ID NO: 131218 - DNA, 25 bp, Mus musculus
tatctgaaccttctgagacccggag

SEQ ID NO: 131219 - DNA, 25 bp, Mus musculus
tatctgaagaagctgtgtggcactg

SEQ ID NO: 131220 - DNA, 25 bp, Mus musculus
tatctgaagacacaaacctggcagg

SEQ ID NO: 131221 - DNA, 25 bp, Mus musculus
tatctgacattcataaggtcctgag

SEQ ID NO: 131222 - DNA, 25 bp, Mus musculus
tatctgaccagacggataccacaga

SEQ ID NO: 131223 - DNA, 25 bp, Mus musculus
tatctgacccatgaggccagtggct

SEQ ID NO: 131224 - DNA, 25 bp, Mus musculus
tatctgaccgtgaaagtctgggacc

SEQ ID NO: 131225 - DNA, 25 bp, Mus musculus
tatctgacctatatgctgcggcagg

SEQ ID NO: 131226 - DNA, 25 bp, Mus musculus
tatctgactggagccgcaggtacag

SEQ ID NO: 131227 - DNA, 25 bp, Mus musculus
tatctgaggctgctgctacgcaagg

SEQ ID NO: 131228 - DNA, 25 bp, Mus musculus
tatctgagggtagacaggcggcctc

SEQ ID NO: 131229 - DNA, 25 bp, Mus musculus
tatctgagggttcctgctaacttcc

SEQ ID NO: 131230 - DNA, 25 bp, Mus musculus
tatctgagtaacaacttcgggtgga

SEQ ID NO: 131231 - DNA, 25 bp, Mus musculus
tatctgagtgaatcggactttgtga

SEQ ID NO: 131232 - DNA, 25 bp, Mus musculus
tatctgagtggatcacaatgcccgg

SEQ ID NO: 131233 - DNA, 25 bp, Mus musculus
tatctgataactccagtgggccaag

SEQ ID NO: 131234 - DNA, 25 bp, Mus musculus
tatctgatcaaacaggtggcagtcc

SEQ ID NO: 131235 - DNA, 25 bp, Mus musculus
tatctgatggaatcgagcgggccct

SEQ ID NO: 131236 - DNA, 25 bp, Mus musculus
tatctgatgtccacaaggctctggg

SEQ ID NO: 131237 - DNA, 25 bp, Mus musculus
tatctgcagatgaaggcgaagcgac

SEQ ID NO: 131238 - DNA, 25 bp, Mus musculus
tatctgcagcgagcccttctggtgc

SEQ ID NO: 131239 - DNA, 25 bp, Mus musculus
tatctgccaagaatgtgacgctggg

SEQ ID NO: 131240 - DNA, 25 bp, Mus musculus
tatctgccaagactgtaagactgac

SEQ ID NO: 131241 - DNA, 25 bp, Mus musculus
tatctgccacaatggcacggctgtg

SEQ ID NO: 131242 - DNA, 25 bp, Mus musculus
tatctgccacgtggtgggcatcacg

SEQ ID NO: 131243 - DNA, 25 bp, Mus musculus
tatctgccaggcagtacagtcaaag

SEQ ID NO: 131244 - DNA, 25 bp, Mus musculus
tatctgcccggctctgatctataag

SEQ ID NO: 131245 - DNA, 25 bp, Mus musculus
tatctgcgagtcctcatggccatct

SEQ ID NO: 131246 - DNA, 25 bp, Mus musculus
tatctgctttagctagcctcaggcc

SEQ ID NO: 131247 - DNA, 25 bp, Mus musculus
tatctggaaaccatgttcacactgc

SEQ ID NO: 131248 - DNA, 25 bp, Mus musculus
tatctggacaggtgcagacacacac

SEQ ID NO: 131249 - DNA, 25 bp, Mus musculus
tatctggaccaaggaagccctgagt

SEQ ID NO: 131250 - DNA, 25 bp, Mus musculus
tatctggaggacaggttactgatct

SEQ ID NO: 131251 - DNA, 25 bp, Mus musculus
tatctggcaccaattctggccccat

SEQ ID NO: 131252 - DNA, 25 bp, Mus musculus
tatctggcatgaaggtaccgtggct

SEQ ID NO: 131253 - DNA, 25 bp, Mus musculus
tatctggccaggataacctagaggc

SEQ ID NO: 131254 - DNA, 25 bp, Mus musculus
tatctggcctaggacaggtaggaca

SEQ ID NO: 131255 - DNA, 25 bp, Mus musculus
tatctggcctctaaaagctctggac

SEQ ID NO: 131256 - DNA, 25 bp, Mus musculus
tatctgggaggcaattacattgcgg

SEQ ID NO: 131257 - DNA, 25 bp, Mus musculus
tatctgggcaccctggacaaagagg

SEQ ID NO: 131258 - DNA, 25 bp, Mus musculus
tatctggtcctgatcaccctgctaa

SEQ ID NO: 131259 - DNA, 25 bp, Mus musculus
tatctggtctccgtccctgatggga

SEQ ID NO: 131260 - DNA, 25 bp, Mus musculus
tatctggtgaatggacttgttctag

SEQ ID NO: 131261 - DNA, 25 bp, Mus musculus
tatctggtgcaaaggttcagagagc

SEQ ID NO: 131262 - DNA, 25 bp, Mus musculus
tatctggtgtggaactgagtgctgc

SEQ ID NO: 131263 - DNA, 25 bp, Mus musculus
tatctggttcgtgtttgctctcaag

SEQ ID NO: 131264 - DNA, 25 bp, Mus musculus
tatctggttgccctacacctctggg

SEQ ID NO: 131265 - DNA, 25 bp, Mus musculus
tatctgtaaagtgtgcgacaagtcc

SEQ ID NO: 131266 - DNA, 25 bp, Mus musculus
tatctgtaataagcgacacctcagg

SEQ ID NO: 131267 - DNA, 25 bp, Mus musculus
tatctgtataagcatcagcgaatcc

SEQ ID NO: 131268 - DNA, 25 bp, Mus musculus
tatctgtcacggaaaccctgtggac

SEQ ID NO: 131269 - DNA, 25 bp, Mus musculus
tatctgtcggtgaaggtctgggacc

SEQ ID NO: 131270 - DNA, 25 bp, Mus musculus
tatctgtgaccagcctgctcgtctg

SEQ ID NO: 131271 - DNA, 25 bp, Mus musculus
tatctgtgagaacaaccgctatggc

SEQ ID NO: 131272 - DNA, 25 bp, Mus musculus
tatctgtgctcaaggacgaggtcct

SEQ ID NO: 131273 - DNA, 25 bp, Mus musculus
tatctgtggacaaacgtcttcggga

SEQ ID NO: 131274 - DNA, 25 bp, Mus musculus
tatctgtggatacagctcaatgcca

SEQ ID NO: 131275 - DNA, 25 bp, Mus musculus
tatctgtgggtcatcgctgacacac

SEQ ID NO: 131276 - DNA, 25 bp, Mus musculus
tatcttagagcactgcacggcagag

SEQ ID NO: 131277 - DNA, 25 bp, Mus musculus
tatcttagtgctgtataagtacgaa

SEQ ID NO: 131278 - DNA, 25 bp, Mus musculus
tatcttcacaatgagcgcccagcaa

SEQ ID NO: 131279 - DNA, 25 bp, Mus musculus
tatcttcagcaaccgagctgtggtg

SEQ ID NO: 131280 - DNA, 25 bp, Mus musculus
tatcttcaggacgagaacggtgtgg

SEQ ID NO: 131281 - DNA, 25 bp, Mus musculus
tatcttcaggttaaaacggccctag

SEQ ID NO: 131282 - DNA, 25 bp, Mus musculus
tatcttccaaacactcggcaaatgg

SEQ ID NO: 131283 - DNA, 25 bp, Mus musculus
tatcttccgagtccatcagtttgag

SEQ ID NO: 131284 - DNA, 25 bp, Mus musculus
tatcttcggtaactctgctggaggc

SEQ ID NO: 131285 - DNA, 25 bp, Mus musculus
tatcttcggttgtggaaagcctaca

SEQ ID NO: 131286 - DNA, 25 bp, Mus musculus
tatcttctcagttggtgggctgaga

SEQ ID NO: 131287 - DNA, 25 bp, Mus musculus
tatcttctctcctggcaagcggcag

SEQ ID NO: 131288 - DNA, 25 bp, Mus musculus
tatcttctgcagtgctgatggccgg

SEQ ID NO: 131289 - DNA, 25 bp, Mus musculus
tatcttgaacagagacgctgcagcc

SEQ ID NO: 131290 - DNA, 25 bp, Mus musculus
tatcttgaaccgcttctccctgagc

SEQ ID NO: 131291 - DNA, 25 bp, Mus musculus
tatcttggagcatctgcagtggaca

SEQ ID NO: 131292 - DNA, 25 bp, Mus musculus
tatcttgtcacaaactggtgctggc

SEQ ID NO: 131293 - DNA, 25 bp, Mus musculus
tatcttgtgcgtccgagaggcaaca

SEQ ID NO: 131294 - DNA, 25 bp, Mus musculus
tatctttcgggatggagacgtcctt

SEQ ID NO: 131295 - DNA, 25 bp, Mus musculus
tatctttgaagtagtctgggctgcc

SEQ ID NO: 131296 - DNA, 25 bp, Mus musculus
tatcttttctaagcgccaggtcctg

SEQ ID NO: 131297 - DNA, 25 bp, Mus musculus
tatgaaaaccttgcacatgtcccac

SEQ ID NO: 131298 - DNA, 25 bp, Mus musculus
tatgaaaacgatgagcgagtgccgc

SEQ ID NO: 131299 - DNA, 25 bp, Mus musculus
tatgaaaactcagatcgcatcagcc

SEQ ID NO: 131300 - DNA, 25 bp, Mus musculus
tatgaaaatgactctgtagaggact

SEQ ID NO: 131301 - DNA, 25 bp, Mus musculus
tatgaaacacacacttggaggtctc

SEQ ID NO: 131302 - DNA, 25 bp, Mus musculus
tatgaaacaggtgctttctatcttg

SEQ ID NO: 131303 - DNA, 25 bp, Mus musculus
tatgaaaccgtcattgaagaacttg

SEQ ID NO: 131304 - DNA, 25 bp, Mus musculus
tatgaaagaccatagggctccttgg

SEQ ID NO: 131305 - DNA, 25 bp, Mus musculus
tatgaaagcatcaaggagatgggcc

SEQ ID NO: 131306 - DNA, 25 bp, Mus musculus
tatgaaaggctgtgccacccattgg

SEQ ID NO: 131307 - DNA, 25 bp, Mus musculus
tatgaaagggcgcgaaccctcggtt

SEQ ID NO: 131308 - DNA, 25 bp, Mus musculus
tatgaaagtcctcagaactgtagcc

SEQ ID NO: 131309 - DNA, 25 bp, Mus musculus
tatgaaagtgacaatcagattactg

SEQ ID NO: 131310 - DNA, 25 bp, Mus musculus
tatgaaatgcacacagcaaggcttg

SEQ ID NO: 131311 - DNA, 25 bp, Mus musculus
tatgaaatggagatcgatcactctg

SEQ ID NO: 131312 - DNA, 25 bp, Mus musculus
tatgaaatgtacaagtggccagcct

SEQ ID NO: 131313 - DNA, 25 bp, Mus musculus
tatgaaattggaagcccgtgaccct

SEQ ID NO: 131314 - DNA, 25 bp, Mus musculus
tatgaacacgcagcaaactgtgcca

SEQ ID NO: 131315 - DNA, 25 bp, Mus musculus
tatgaacacttggatgctgctgacg

SEQ ID NO: 131316 - DNA, 25 bp, Mus musculus
tatgaacagcaccaagctctcggct

SEQ ID NO: 131317 - DNA, 25 bp, Mus musculus
tatgaacaggacagagatcagcggt

SEQ ID NO: 131318 - DNA, 25 bp, Mus musculus
tatgaacaggcctccaaggtggacc

SEQ ID NO: 131319 - DNA, 25 bp, Mus musculus
tatgaacagtggcagctacagcgta

SEQ ID NO: 131320 - DNA, 25 bp, Mus musculus
tatgaacatttgtcgggctggcctc

SEQ ID NO: 131321 - DNA, 25 bp, Mus musculus
tatgaaccacatgcagagtctacgc

SEQ ID NO: 131322 - DNA, 25 bp, Mus musculus
tatgaaccagatcaccttcgagcgg

SEQ ID NO: 131323 - DNA, 25 bp, Mus musculus
tatgaacccaatgaagacggcacag

SEQ ID NO: 131324 - DNA, 25 bp, Mus musculus
tatgaaccgaaaaggcaagctcgtg

SEQ ID NO: 131325 - DNA, 25 bp, Mus musculus
tatgaacctcagttgcagcaccatg

SEQ ID NO: 131326 - DNA, 25 bp, Mus musculus
tatgaacctgctgactccttagagg

SEQ ID NO: 131327 - DNA, 25 bp, Mus musculus
tatgaaccttgatggcaacaaagag

SEQ ID NO: 131328 - DNA, 25 bp, Mus musculus
tatgaacgaggcgtcaaagtgcgcc

SEQ ID NO: 131329 - DNA, 25 bp, Mus musculus
tatgaacgagtccactcccactggt

SEQ ID NO: 131330 - DNA, 25 bp, Mus musculus
tatgaacgggaagcaatcctgccac

SEQ ID NO: 131331 - DNA, 25 bp, Mus musculus
tatgaactgccacgtcagtgcaggc

SEQ ID NO: 131332 - DNA, 25 bp, Mus musculus
tatgaactggagaacgcactaggga

SEQ ID NO: 131333 - DNA, 25 bp, Mus musculus
tatgaacttcactattgggcgcgtg

SEQ ID NO: 131334 - DNA, 25 bp, Mus musculus
tatgaacttggaaagacaggagtcc

SEQ ID NO: 131335 - DNA, 25 bp, Mus musculus
tatgaagaacggcaacaggtgaccc

SEQ ID NO: 131336 - DNA, 25 bp, Mus musculus
tatgaagaagagtgccgagttctca

SEQ ID NO: 131337 - DNA, 25 bp, Mus musculus
tatgaagaagcaccgacgaaatggc

SEQ ID NO: 131338 - DNA, 25 bp, Mus musculus
tatgaagaaggacatattcctggca

SEQ ID NO: 131339 - DNA, 25 bp, Mus musculus
tatgaagaatacacacggacctccc

SEQ ID NO: 131340 - DNA, 25 bp, Mus musculus
tatgaagaatcaacctcatcttgga

SEQ ID NO: 131341 - DNA, 25 bp, Mus musculus
tatgaagacattctgcggaacgccg

SEQ ID NO: 131342 - DNA, 25 bp, Mus musculus
tatgaagaccacatggcggaagact

SEQ ID NO: 131343 - DNA, 25 bp, Mus musculus
tatgaagaccattcctggcacagca

SEQ ID NO: 131344 - DNA, 25 bp, Mus musculus
tatgaagacgagagtggacaccgct

SEQ ID NO: 131345 - DNA, 25 bp, Mus musculus
tatgaagagagcagaggtaactacc

SEQ ID NO: 131346 - DNA, 25 bp, Mus musculus
tatgaagagctagcccgtcagtgca

SEQ ID NO: 131347 - DNA, 25 bp, Mus musculus
tatgaagaggcatttcactcaagcc

SEQ ID NO: 131348 - DNA, 25 bp, Mus musculus
tatgaagagttcacccacaaggacg

SEQ ID NO: 131349 - DNA, 25 bp, Mus musculus
tatgaagatcatcatgcagactggc

SEQ ID NO: 131350 - DNA, 25 bp, Mus musculus
tatgaagatgcacagatacccttac

SEQ ID NO: 131351 - DNA, 25 bp, Mus musculus
tatgaagcactgaatcacccatggc

SEQ ID NO: 131352 - DNA, 25 bp, Mus musculus
tatgaagcagcaatccagcggtcag

SEQ ID NO: 131353 - DNA, 25 bp, Mus musculus
tatgaagcatactgtgtccagcggc

SEQ ID NO: 131354 - DNA, 25 bp, Mus musculus
tatgaagcccaaactgatgtaccag

SEQ ID NO: 131355 - DNA, 25 bp, Mus musculus
tatgaagccttgtgtaaatccctcg

SEQ ID NO: 131356 - DNA, 25 bp, Mus musculus
tatgaagcgcatcaggaaagggtct

SEQ ID NO: 131357 - DNA, 25 bp, Mus musculus
tatgaaggaaggtaccatcggcgat

SEQ ID NO: 131358 - DNA, 25 bp, Mus musculus
tatgaaggagcttccaacatccagc

SEQ ID NO: 131359 - DNA, 25 bp, Mus musculus
tatgaaggccgacttgagccagcac

SEQ ID NO: 131360 - DNA, 25 bp, Mus musculus
tatgaagggagggtgtaccactaca

SEQ ID NO: 131361 - DNA, 25 bp, Mus musculus
tatgaaggtgcctatcacgtcctcc

SEQ ID NO: 131362 - DNA, 25 bp, Mus musculus
tatgaagtcaaagcgtccgagccag

SEQ ID NO: 131363 - DNA, 25 bp, Mus musculus
tatgaagtcgacaccagcatgctca

SEQ ID NO: 131364 - DNA, 25 bp, Mus musculus
tatgaagtgatctctgctgggccca

SEQ ID NO: 131365 - DNA, 25 bp, Mus musculus
tatgaagtgctgtatgacaccagcc

SEQ ID NO: 131366 - DNA, 25 bp, Mus musculus
tatgaagttatattccgggaacccg

SEQ ID NO: 131367 - DNA, 25 bp, Mus musculus
tatgaagttccggaatttgtgtttt

SEQ ID NO: 131368 - DNA, 25 bp, Mus musculus
tatgaagtttacaaagtctccagag

SEQ ID NO: 131369 - DNA, 25 bp, Mus musculus
tatgaataacggagactacaccctg

SEQ ID NO: 131370 - DNA, 25 bp, Mus musculus
tatgaatacccctacacattggcac

SEQ ID NO: 131371 - DNA, 25 bp, Mus musculus
tatgaatatctagcagaggccagcg

SEQ ID NO: 131372 - DNA, 25 bp, Mus musculus
tatgaatcaaatacagcgtgtggag

SEQ ID NO: 131373 - DNA, 25 bp, Mus musculus
tatgaatcacgagaccagtaactgc

SEQ ID NO: 131374 - DNA, 25 bp, Mus musculus
tatgaatcgatactccgcacagaaa

SEQ ID NO: 131375 - DNA, 25 bp, Mus musculus
tatgaatctactgccacacgccatt

SEQ ID NO: 131376 - DNA, 25 bp, Mus musculus
tatgaatgacagcacagctctgtgg

SEQ ID NO: 131377 - DNA, 25 bp, Mus musculus
tatgaatgcatctctgcctacgacg

SEQ ID NO: 131378 - DNA, 25 bp, Mus musculus
tatgaatgcttgcacatccaggaac

SEQ ID NO: 131379 - DNA, 25 bp, Mus musculus
tatgaatggagtacccagagagccc

SEQ ID NO: 131380 - DNA, 25 bp, Mus musculus
tatgaatgtcatctgcggtactgcg

SEQ ID NO: 131381 - DNA, 25 bp, Mus musculus
tatgaatgtgctgaccacaatcggg

SEQ ID NO: 131382 - DNA, 25 bp, Mus musculus
tatgaattccagagcagggctgggc

SEQ ID NO: 131383 - DNA, 25 bp, Mus musculus
tatgaattggacaagagcttccggc

SEQ ID NO: 131384 - DNA, 25 bp, Mus musculus
tatgacaaaacctacgccggcggta

SEQ ID NO: 131385 - DNA, 25 bp, Mus musculus
tatgacaaaccgcacatgttggtgg

SEQ ID NO: 131386 - DNA, 25 bp, Mus musculus
tatgacaaagagaccgagaagtact

SEQ ID NO: 131387 - DNA, 25 bp, Mus musculus
tatgacaaccgtctacggccaggat

SEQ ID NO: 131388 - DNA, 25 bp, Mus musculus
tatgacaactacatggcgcacgcct

SEQ ID NO: 131389 - DNA, 25 bp, Mus musculus
tatgacaagcatttcacgcagcccc

SEQ ID NO: 131390 - DNA, 25 bp, Mus musculus
tatgacaagcgtggcattgtgcgca

SEQ ID NO: 131391 - DNA, 25 bp, Mus musculus
tatgacaatgaagctggtcgcagca

SEQ ID NO: 131392 - DNA, 25 bp, Mus musculus
tatgacacaccctatgagccagaag

SEQ ID NO: 131393 - DNA, 25 bp, Mus musculus
tatgacaccagtcagaaacagcagg

SEQ ID NO: 131394 - DNA, 25 bp, Mus musculus
tatgacaccatcagccagaactttg

SEQ ID NO: 131395 - DNA, 25 bp, Mus musculus
tatgacacccctgacatccgaaggt

SEQ ID NO: 131396 - DNA, 25 bp, Mus musculus
tatgacaccgaactatgtggactcc

SEQ ID NO: 131397 - DNA, 25 bp, Mus musculus
tatgacacggtgcttctgcttgcga

SEQ ID NO: 131398 - DNA, 25 bp, Mus musculus
tatgacagattgacagtacgcaacg

SEQ ID NO: 131399 - DNA, 25 bp, Mus musculus
tatgacagcaacaacggaaccctgg

SEQ ID NO: 131400 - DNA, 25 bp, Mus musculus
tatgacagcagtgcaacttgtgacc

SEQ ID NO: 131401 - DNA, 25 bp, Mus musculus
tatgacagccatgagctttttccgg

SEQ ID NO: 131402 - DNA, 25 bp, Mus musculus
tatgacagccgtgatgactttcccc

SEQ ID NO: 131403 - DNA, 25 bp, Mus musculus
tatgacaggaagtccagaagcgctg

SEQ ID NO: 131404 - DNA, 25 bp, Mus musculus
tatgacagtaacgtctggcgccatt

SEQ ID NO: 131405 - DNA, 25 bp, Mus musculus
tatgacagttcccaaggacgacggc

SEQ ID NO: 131406 - DNA, 25 bp, Mus musculus
tatgacagttctgatcagactgcgt

SEQ ID NO: 131407 - DNA, 25 bp, Mus musculus
tatgacatcgctgttatccaagagg

SEQ ID NO: 131408 - DNA, 25 bp, Mus musculus
tatgacatcggaatgcaaacggcac

SEQ ID NO: 131409 - DNA, 25 bp, Mus musculus
tatgacatggcagccgaagctagcc

SEQ ID NO: 131410 - DNA, 25 bp, Mus musculus
tatgacatggtgtctccgagtaccc

SEQ ID NO: 131411 - DNA, 25 bp, Mus musculus
tatgacattcgtcgtagcctgggct

SEQ ID NO: 131412 - DNA, 25 bp, Mus musculus
tatgaccaagagaagcgtgacctcc

SEQ ID NO: 131413 - DNA, 25 bp, Mus musculus
tatgaccaatgtctgaactccagag

SEQ ID NO: 131414 - DNA, 25 bp, Mus musculus
tatgaccacgagagaaactgtaaga

SEQ ID NO: 131415 - DNA, 25 bp, Mus musculus
tatgaccagagaagttgtcctcgga

SEQ ID NO: 131416 - DNA, 25 bp, Mus musculus
tatgaccatgagatccgcagtgttc

SEQ ID NO: 131417 - DNA, 25 bp, Mus musculus
tatgaccatggctcagaaatccttg

SEQ ID NO: 131418 - DNA, 25 bp, Mus musculus
tatgacccaaactgtgaggaagagg

SEQ ID NO: 131419 - DNA, 25 bp, Mus musculus
tatgacccaagaggtgtcaggctgg

SEQ ID NO: 131420 - DNA, 25 bp, Mus musculus
tatgacccagtggacataagatcca

SEQ ID NO: 131421 - DNA, 25 bp, Mus musculus
tatgacccattagagagctgagacc

SEQ ID NO: 131422 - DNA, 25 bp, Mus musculus
tatgaccccaaaacagacgtgtgga

SEQ ID NO: 131423 - DNA, 25 bp, Mus musculus
tatgaccccgataagcgtagcctga

SEQ ID NO: 131424 - DNA, 25 bp, Mus musculus
tatgacccgtatgaacgagctcgcc

SEQ ID NO: 131425 - DNA, 25 bp, Mus musculus
tatgaccctgactatgtgaaggtgg

SEQ ID NO: 131426 - DNA, 25 bp, Mus musculus
tatgaccgaatgaggctggaactgt

SEQ ID NO: 131427 - DNA, 25 bp, Mus musculus
tatgaccgacagatccgcctgtggg

SEQ ID NO: 131428 - DNA, 25 bp, Mus musculus
tatgaccgcgctgcatgtgcatacg

SEQ ID NO: 131429 - DNA, 25 bp, Mus musculus
tatgaccgggccatgagctggaagt

SEQ ID NO: 131430 - DNA, 25 bp, Mus musculus
tatgaccgtagcaccctggtggcca

SEQ ID NO: 131431 - DNA, 25 bp, Mus musculus
tatgaccgtttcagccgcaatgacc

SEQ ID NO: 131432 - DNA, 25 bp, Mus musculus
tatgacctacgaggtatgccagcca

SEQ ID NO: 131433 - DNA, 25 bp, Mus musculus
tatgacctactgtcccaagaccaag

SEQ ID NO: 131434 - DNA, 25 bp, Mus musculus
tatgacctagtcaataaacttggac

SEQ ID NO: 131435 - DNA, 25 bp, Mus musculus
tatgacctcccggttacgtgcgttg

SEQ ID NO: 131436 - DNA, 25 bp, Mus musculus
tatgacctcttgagcggccacattg

SEQ ID NO: 131437 - DNA, 25 bp, Mus musculus
tatgacctgcactgctacaaggcca

SEQ ID NO: 131438 - DNA, 25 bp, Mus musculus
tatgacctgctcgacaagcttctgg

SEQ ID NO: 131439 - DNA, 25 bp, Mus musculus
tatgaccttcggatgcacaggcctc

SEQ ID NO: 131440 - DNA, 25 bp, Mus musculus
tatgaccttgtgtgtagctttaccc

SEQ ID NO: 131441 - DNA, 25 bp, Mus musculus
tatgacgaatgggactatggccttc

SEQ ID NO: 131442 - DNA, 25 bp, Mus musculus
tatgacgacttgtatgacgacgaca

SEQ ID NO: 131443 - DNA, 25 bp, Mus musculus
tatgacgaggaaccatcacagctgg

SEQ ID NO: 131444 - DNA, 25 bp, Mus musculus
tatgacgaggcctatagaaagaacc

SEQ ID NO: 131445 - DNA, 25 bp, Mus musculus
tatgacgaggtgagtatataggcca

SEQ ID NO: 131446 - DNA, 25 bp, Mus musculus
tatgacgccaaagcagatgtcagga

SEQ ID NO: 131447 - DNA, 25 bp, Mus musculus
tatgacgcctgtatggatgccttcg

SEQ ID NO: 131448 - DNA, 25 bp, Mus musculus
tatgacgcgcacaccaaggagattg

SEQ ID NO: 131449 - DNA, 25 bp, Mus musculus
tatgacgcttctaacagcgagtggc

SEQ ID NO: 131450 - DNA, 25 bp, Mus musculus
tatgacggaggactttgtatgctgc

SEQ ID NO: 131451 - DNA, 25 bp, Mus musculus
tatgacggatacactggctccagga

SEQ ID NO: 131452 - DNA, 25 bp, Mus musculus
tatgacggcgagagcatcggaaact

SEQ ID NO: 131453 - DNA, 25 bp, Mus musculus
tatgacgggccagaagtcgacgtgt

SEQ ID NO: 131454 - DNA, 25 bp, Mus musculus
tatgacgtgaccctgaacttcagag

SEQ ID NO: 131455 - DNA, 25 bp, Mus musculus
tatgactaaggattctgggaccaca

SEQ ID NO: 131456 - DNA, 25 bp, Mus musculus
tatgactacatgctggatcacccag

SEQ ID NO: 131457 - DNA, 25 bp, Mus musculus
tatgactatgctggccaggaggctg

SEQ ID NO: 131458 - DNA, 25 bp, Mus musculus
tatgactcatttgaccgggaggcca

SEQ ID NO: 131459 - DNA, 25 bp, Mus musculus
tatgactcggaacagagcgattggc

SEQ ID NO: 131460 - DNA, 25 bp, Mus musculus
tatgactgcattcaacaagctagtg

SEQ ID NO: 131461 - DNA, 25 bp, Mus musculus
tatgactgcggagaggatttctacc

SEQ ID NO: 131462 - DNA, 25 bp, Mus musculus
tatgactggaacgagagcatctgca

SEQ ID NO: 131463 - DNA, 25 bp, Mus musculus
tatgactgtaccctacgggaggccc

SEQ ID NO: 131464 - DNA, 25 bp, Mus musculus
tatgactgtgcagttcaacaggcca

SEQ ID NO: 131465 - DNA, 25 bp, Mus musculus
tatgacttcacctcgtgcatgggcg

SEQ ID NO: 131466 - DNA, 25 bp, Mus musculus
tatgacttccggaggatgacagcac

SEQ ID NO: 131467 - DNA, 25 bp, Mus musculus
tatgacttgaggaagcctccgggca

SEQ ID NO: 131468 - DNA, 25 bp, Mus musculus
tatgacttggtcacccatcaggaca

SEQ ID NO: 131469 - DNA, 25 bp, Mus musculus
tatgagaaaaccgtggaagtccttg

SEQ ID NO: 131470 - DNA, 25 bp, Mus musculus
tatgagaacacccagatctagccag

SEQ ID NO: 131471 - DNA, 25 bp, Mus musculus
tatgagaacctgaggccacgcacgc

SEQ ID NO: 131472 - DNA, 25 bp, Mus musculus
tatgagaacgaaagactccgaagcg

SEQ ID NO: 131473 - DNA, 25 bp, Mus musculus
tatgagaagacatgcgcgctccttg

SEQ ID NO: 131474 - DNA, 25 bp, Mus musculus
tatgagaagcagaatccgttgccca

SEQ ID NO: 131475 - DNA, 25 bp, Mus musculus
tatgagaagtacagggaacggaagc

SEQ ID NO: 131476 - DNA, 25 bp, Mus musculus
tatgagaagtgcaacgacagcagtg

SEQ ID NO: 131477 - DNA, 25 bp, Mus musculus
tatgagaagtgtgaccgtgacctgg

SEQ ID NO: 131478 - DNA, 25 bp, Mus musculus
tatgagaatgtacccatcccctgtg

SEQ ID NO: 131479 - DNA, 25 bp, Mus musculus
tatgagaccagagcaagaacatgac

SEQ ID NO: 131480 - DNA, 25 bp, Mus musculus
tatgagacccactgacgtacctgat

SEQ ID NO: 131481 - DNA, 25 bp, Mus musculus
tatgagacccattggccagacacag

SEQ ID NO: 131482 - DNA, 25 bp, Mus musculus
tatgagactgtggaacttgccccgg

SEQ ID NO: 131483 - DNA, 25 bp, Mus musculus
tatgagagagaactgagaacattcc

SEQ ID NO: 131484 - DNA, 25 bp, Mus musculus
tatgagagcgcttacaaccaagcct

SEQ ID NO: 131485 - DNA, 25 bp, Mus musculus
tatgagagctaagagcaggtttccc

SEQ ID NO: 131486 - DNA, 25 bp, Mus musculus
tatgagagtgacaacaggaaggcca

SEQ ID NO: 131487 - DNA, 25 bp, Mus musculus
tatgagagtgaggagcagctacagc

SEQ ID NO: 131488 - DNA, 25 bp, Mus musculus
tatgagagtgcttctatcacaagag

SEQ ID NO: 131489 - DNA, 25 bp, Mus musculus
tatgagatagaggagcagataccct

SEQ ID NO: 131490 - DNA, 25 bp, Mus musculus
tatgagatccagagggtcacttcca

SEQ ID NO: 131491 - DNA, 25 bp, Mus musculus
tatgagatcccagctcgtctgcgga

SEQ ID NO: 131492 - DNA, 25 bp, Mus musculus
tatgagatcccctcgctgaagaagc

SEQ ID NO: 131493 - DNA, 25 bp, Mus musculus
tatgagatccggcactacggaccgg

SEQ ID NO: 131494 - DNA, 25 bp, Mus musculus
tatgagatccgggtgctgctcacac

SEQ ID NO: 131495 - DNA, 25 bp, Mus musculus
tatgagatcctcaaccagctgggct

SEQ ID NO: 131496 - DNA, 25 bp, Mus musculus
tatgagatcctccactggctgggcg

SEQ ID NO: 131497 - DNA, 25 bp, Mus musculus
tatgagatcggagtccttatctgcg

SEQ ID NO: 131498 - DNA, 25 bp, Mus musculus
tatgagatcttcacctgcctgggag

SEQ ID NO: 131499 - DNA, 25 bp, Mus musculus
tatgagatgcacgttcgagcagcca

SEQ ID NO: 131500 - DNA, 25 bp, Mus musculus
tatgagatgcccgactttgacgtgg

SEQ ID NO: 131501 - DNA, 25 bp, Mus musculus
tatgagatgctgattggccagtccc

SEQ ID NO: 131502 - DNA, 25 bp, Mus musculus
tatgagcaacgggacgcttttcgac

SEQ ID NO: 131503 - DNA, 25 bp, Mus musculus
tatgagcaagtgttgtacccgcctg

SEQ ID NO: 131504 - DNA, 25 bp, Mus musculus
tatgagcacctgaaccaaaacctgg

SEQ ID NO: 131505 - DNA, 25 bp, Mus musculus
tatgagcacttcaacgccatgggca

SEQ ID NO: 131506 - DNA, 25 bp, Mus musculus
tatgagcagaacgacaactccctgg

SEQ ID NO: 131507 - DNA, 25 bp, Mus musculus
tatgagcagagtcctgatacccctg

SEQ ID NO: 131508 - DNA, 25 bp, Mus musculus
tatgagcagcagtgagaaggactac

SEQ ID NO: 131509 - DNA, 25 bp, Mus musculus
tatgagcaggatgggctacctcacc

SEQ ID NO: 131510 - DNA, 25 bp, Mus musculus
tatgagcaggcgcatttggaaatcc

SEQ ID NO: 131511 - DNA, 25 bp, Mus musculus
tatgagcagtatctacaagaggagc

SEQ ID NO: 131512 - DNA, 25 bp, Mus musculus
tatgagcattttccctcacggtgga

SEQ ID NO: 131513 - DNA, 25 bp, Mus musculus
tatgagccagaggagcgtttgttac

SEQ ID NO: 131514 - DNA, 25 bp, Mus musculus
tatgagcccaccaaagctgacagtt

SEQ ID NO: 131515 - DNA, 25 bp, Mus musculus
tatgagcccatctccttgcttgagg

SEQ ID NO: 131516 - DNA, 25 bp, Mus musculus
tatgagcccttgctattggagatcc

SEQ ID NO: 131517 - DNA, 25 bp, Mus musculus
tatgagccgaggagactacaaggcc

SEQ ID NO: 131518 - DNA, 25 bp, Mus musculus
tatgagccggccaagaggttctcca

SEQ ID NO: 131519 - DNA, 25 bp, Mus musculus
tatgagccgtccattctacagttgg

SEQ ID NO: 131520 - DNA, 25 bp, Mus musculus
tatgagcctgtcgagccagtggact

SEQ ID NO: 131521 - DNA, 25 bp, Mus musculus
tatgagccttcgatgttgcaaggac

SEQ ID NO: 131522 - DNA, 25 bp, Mus musculus
tatgagcgcatgaagaccgagacag

SEQ ID NO: 131523 - DNA, 25 bp, Mus musculus
tatgagcggaccttcatggcatccg

SEQ ID NO: 131524 - DNA, 25 bp, Mus musculus
tatgagcggctggatgccattcgct

SEQ ID NO: 131525 - DNA, 25 bp, Mus musculus
tatgagcgggagaatgttgacacct

SEQ ID NO: 131526 - DNA, 25 bp, Mus musculus
tatgagcgtctgaaagcaagccagg

SEQ ID NO: 131527 - DNA, 25 bp, Mus musculus
tatgagctacagatgctgcggcacc

SEQ ID NO: 131528 - DNA, 25 bp, Mus musculus
tatgagctagctgtctaggcaggcc

SEQ ID NO: 131529 - DNA, 25 bp, Mus musculus
tatgagctcagcctttgccacgtgg

SEQ ID NO: 131530 - DNA, 25 bp, Mus musculus
tatgagctcatccatgcgcagcagc

SEQ ID NO: 131531 - DNA, 25 bp, Mus musculus
tatgagctccgagagacaaagaggc

SEQ ID NO: 131532 - DNA, 25 bp, Mus musculus
tatgagctcctcatcactggcggaa

SEQ ID NO: 131533 - DNA, 25 bp, Mus musculus
tatgagctcgatggctcgggcatcc

SEQ ID NO: 131534 - DNA, 25 bp, Mus musculus
tatgagcttggatatacagattaac

SEQ ID NO: 131535 - DNA, 25 bp, Mus musculus
tatgaggaactgaagacttccacgg

SEQ ID NO: 131536 - DNA, 25 bp, Mus musculus
tatgaggaagtttggcagcgaccac

SEQ ID NO: 131537 - DNA, 25 bp, Mus musculus
tatgaggaattgttctggaggcacc

SEQ ID NO: 131538 - DNA, 25 bp, Mus musculus
tatgaggaatttgtagagggcaccg

SEQ ID NO: 131539 - DNA, 25 bp, Mus musculus
tatgaggaccaaagtcagaagctgc

SEQ ID NO: 131540 - DNA, 25 bp, Mus musculus
tatgaggagagagcacggtacctgc

SEQ ID NO: 131541 - DNA, 25 bp, Mus musculus
tatgaggatgagatgggtagccacc

SEQ ID NO: 131542 - DNA, 25 bp, Mus musculus
tatgaggcagtacctggtcctgagc

SEQ ID NO: 131543 - DNA, 25 bp, Mus musculus
tatgaggcatccagtctctatggca

SEQ ID NO: 131544 - DNA, 25 bp, Mus musculus
tatgaggccaatgacccctgggtac

SEQ ID NO: 131545 - DNA, 25 bp, Mus musculus
tatgaggcccacatgagagacatcc

SEQ ID NO: 131546 - DNA, 25 bp, Mus musculus
tatgaggccgcactaaccatctatg

SEQ ID NO: 131547 - DNA, 25 bp, Mus musculus
tatgaggcctcactagagcactgcc

SEQ ID NO: 131548 - DNA, 25 bp, Mus musculus
tatgaggctcatccagacagattgc

SEQ ID NO: 131549 - DNA, 25 bp, Mus musculus
tatgaggcttccctagttgccgcga

SEQ ID NO: 131550 - DNA, 25 bp, Mus musculus
tatgagggctttgccatgccacact

SEQ ID NO: 131551 - DNA, 25 bp, Mus musculus
tatgaggtaggcagcatgggccaac

SEQ ID NO: 131552 - DNA, 25 bp, Mus musculus
tatgaggtgcacaacaggtacaggc

SEQ ID NO: 131553 - DNA, 25 bp, Mus musculus
tatgaggtggactacgccagcttcc

SEQ ID NO: 131554 - DNA, 25 bp, Mus musculus
tatgagtaccgccagaagcagatcc

SEQ ID NO: 131555 - DNA, 25 bp, Mus musculus
tatgagtaccgttgcccaagatgga

SEQ ID NO: 131556 - DNA, 25 bp, Mus musculus
tatgagtacctcacgagattgccac

SEQ ID NO: 131557 - DNA, 25 bp, Mus musculus
tatgagtacttctggattagagacc

SEQ ID NO: 131558 - DNA, 25 bp, Mus musculus
tatgagtatcaacagccacaaagcc

SEQ ID NO: 131559 - DNA, 25 bp, Mus musculus
tatgagtattttgaggtgggcgacc

SEQ ID NO: 131560 - DNA, 25 bp, Mus musculus
tatgagtccaaaggcatcaaggccc

SEQ ID NO: 131561 - DNA, 25 bp, Mus musculus
tatgagtccctctaacttcagcagc

SEQ ID NO: 131562 - DNA, 25 bp, Mus musculus
tatgagtcctctgatcgcattgccc

SEQ ID NO: 131563 - DNA, 25 bp, Mus musculus
tatgagtgagttccggtatttcagg

SEQ ID NO: 131564 - DNA, 25 bp, Mus musculus
tatgagtgccatatcctgcagccag

SEQ ID NO: 131565 - DNA, 25 bp, Mus musculus
tatgagtgccatccagagtcgatgc

SEQ ID NO: 131566 - DNA, 25 bp, Mus musculus
tatgagtggaacaaagtggacccct

SEQ ID NO: 131567 - DNA, 25 bp, Mus musculus
tatgagtgggtggtcatcaaacacc

SEQ ID NO: 131568 - DNA, 25 bp, Mus musculus
tatgagttagctccagtgcacgaac

SEQ ID NO: 131569 - DNA, 25 bp, Mus musculus
tatgagtttgacactaaggacctgg

SEQ ID NO: 131570 - DNA, 25 bp, Mus musculus
tatgagtttgctactgaagacagcc

SEQ ID NO: 131571 - DNA, 25 bp, Mus musculus
tatgataaagctgcgtccaagagca

SEQ ID NO: 131572 - DNA, 25 bp, Mus musculus
tatgataaatcagcggacccaatgg

SEQ ID NO: 131573 - DNA, 25 bp, Mus musculus
tatgatacaatcacaagaaaagcca

SEQ ID NO: 131574 - DNA, 25 bp, Mus musculus
tatgatacctctgcaatccagctgt

SEQ ID NO: 131575 - DNA, 25 bp, Mus musculus
tatgatacgccatctcagctgagga

SEQ ID NO: 131576 - DNA, 25 bp, Mus musculus
tatgatagagaacctgcagccagag

SEQ ID NO: 131577 - DNA, 25 bp, Mus musculus
tatgatagaggccacagattttccc

SEQ ID NO: 131578 - DNA, 25 bp, Mus musculus
tatgatagctgtcccagtaggagat

SEQ ID NO: 131579 - DNA, 25 bp, Mus musculus
tatgatcacgtgcatttggaactcc

SEQ ID NO: 131580 - DNA, 25 bp, Mus musculus
tatgatcagagacttcagagggagc

SEQ ID NO: 131581 - DNA, 25 bp, Mus musculus
tatgatcattgaggacccaaccacg

SEQ ID NO: 131582 - DNA, 25 bp, Mus musculus
tatgatccagcacatacagccggag

SEQ ID NO: 131583 - DNA, 25 bp, Mus musculus
tatgatcccgttcggagaagggtcc

SEQ ID NO: 131584 - DNA, 25 bp, Mus musculus
tatgatcctcgtgctcaaaacgctg

SEQ ID NO: 131585 - DNA, 25 bp, Mus musculus
tatgatcctgtattgcctcccgtgc

SEQ ID NO: 131586 - DNA, 25 bp, Mus musculus
tatgatcggactcgtgacagctgtc

SEQ ID NO: 131587 - DNA, 25 bp, Mus musculus
tatgatcggcatcgctagcactctg

SEQ ID NO: 131588 - DNA, 25 bp, Mus musculus
tatgatcgtgtattcagagccctgg

SEQ ID NO: 131589 - DNA, 25 bp, Mus musculus
tatgatctatcagggtggcaagcta

SEQ ID NO: 131590 - DNA, 25 bp, Mus musculus
tatgatctatgatgcggagaagcag

SEQ ID NO: 131591 - DNA, 25 bp, Mus musculus
tatgatctcatgtaccagtgctgga

SEQ ID NO: 131592 - DNA, 25 bp, Mus musculus
tatgatgaaccggtatgacgcctcc

SEQ ID NO: 131593 - DNA, 25 bp, Mus musculus
tatgatgaaggataaactgcccggg

SEQ ID NO: 131594 - DNA, 25 bp, Mus musculus
tatgatgaatatgcccagctagtgg

SEQ ID NO: 131595 - DNA, 25 bp, Mus musculus
tatgatgaatcaggaagcccaagac

SEQ ID NO: 131596 - DNA, 25 bp, Mus musculus
tatgatgacagcaacaagcgatggc

SEQ ID NO: 131597 - DNA, 25 bp, Mus musculus
tatgatgactcaatgtggatttgtg

SEQ ID NO: 131598 - DNA, 25 bp, Mus musculus
tatgatgagcgcactagtcgggagc

SEQ ID NO: 131599 - DNA, 25 bp, Mus musculus
tatgatgatggagcttccacccggc

SEQ ID NO: 131600 - DNA, 25 bp, Mus musculus
tatgatgattctactgctgcaggca

SEQ ID NO: 131601 - DNA, 25 bp, Mus musculus
tatgatgcaattcttaagcgtttgc

SEQ ID NO: 131602 - DNA, 25 bp, Mus musculus
tatgatgccgatgattaccactccg

SEQ ID NO: 131603 - DNA, 25 bp, Mus musculus
tatgatgcctataaactgtcccgcc

SEQ ID NO: 131604 - DNA, 25 bp, Mus musculus
tatgatgcgcagtgccagagtgaca

SEQ ID NO: 131605 - DNA, 25 bp, Mus musculus
tatgatgcttttcgaggccaaggcg

SEQ ID NO: 131606 - DNA, 25 bp, Mus musculus
tatgatggaccacatggatgcctcc

SEQ ID NO: 131607 - DNA, 25 bp, Mus musculus
tatgatggcgttacatcgacagaca

SEQ ID NO: 131608 - DNA, 25 bp, Mus musculus
tatgatggcttcctgacgctcgtgg

SEQ ID NO: 131609 - DNA, 25 bp, Mus musculus
tatgatggtcccaacagcaatgtgg

SEQ ID NO: 131610 - DNA, 25 bp, Mus musculus
tatgatgtatgaggccctagtttcc

SEQ ID NO: 131611 - DNA, 25 bp, Mus musculus
tatgatgtatgctgggccaaccgag

SEQ ID NO: 131612 - DNA, 25 bp, Mus musculus
tatgatgtcgtgaacttgggccagg

SEQ ID NO: 131613 - DNA, 25 bp, Mus musculus
tatgatgtctacacagcgggcctga

SEQ ID NO: 131614 - DNA, 25 bp, Mus musculus
tatgatgtgaagtccttgggaggcc

SEQ ID NO: 131615 - DNA, 25 bp, Mus musculus
tatgatgtgtatgcaagacggaacc

SEQ ID NO: 131616 - DNA, 25 bp, Mus musculus
tatgattaaccagacaacacgacca

SEQ ID NO: 131617 - DNA, 25 bp, Mus musculus
tatgattaccaccaggagattgcca

SEQ ID NO: 131618 - DNA, 25 bp, Mus musculus
tatgattccttcagataccaaggac

SEQ ID NO: 131619 - DNA, 25 bp, Mus musculus
tatgattcggacagtgacggccgca

SEQ ID NO: 131620 - DNA, 25 bp, Mus musculus
tatgattcggagtacaacctggaga

SEQ ID NO: 131621 - DNA, 25 bp, Mus musculus
tatgattcttccctgggccgggaca

SEQ ID NO: 131622 - DNA, 25 bp, Mus musculus
tatgattgacttgggccccatgggc

SEQ ID NO: 131623 - DNA, 25 bp, Mus musculus
tatgattgagcgagggctgatcccc

SEQ ID NO: 131624 - DNA, 25 bp, Mus musculus
tatgattgaggaggcatacatgaca

SEQ ID NO: 131625 - DNA, 25 bp, Mus musculus
tatgattgctctatggcgaagaaga

SEQ ID NO: 131626 - DNA, 25 bp, Mus musculus
tatgatttcacagcgcgaaacgcca

SEQ ID NO: 131627 - DNA, 25 bp, Mus musculus
tatgatttcactacccatagccgga

SEQ ID NO: 131628 - DNA, 25 bp, Mus musculus
tatgatttctcacccaatggtaaag

SEQ ID NO: 131629 - DNA, 25 bp, Mus musculus
tatgatttctggaaggctacccctc

SEQ ID NO: 131630 - DNA, 25 bp, Mus musculus
tatgatttggttcatgggtccagcc

SEQ ID NO: 131631 - DNA, 25 bp, Mus musculus
tatgatttttatttccgagcctccc

SEQ ID NO: 131632 - DNA, 25 bp, Mus musculus
tatgcaaaagctggtcctctggccc

SEQ ID NO: 131633 - DNA, 25 bp, Mus musculus
tatgcaaacatgtcccctgtggagc

SEQ ID NO: 131634 - DNA, 25 bp, Mus musculus
tatgcaaacctatgacccggagatc

SEQ ID NO: 131635 - DNA, 25 bp, Mus musculus
tatgcaaactgcaaagcaaggccgc

SEQ ID NO: 131636 - DNA, 25 bp, Mus musculus
tatgcaaagagtacctgtgctccgt

SEQ ID NO: 131637 - DNA, 25 bp, Mus musculus
tatgcaaagctgatgggcctgctgg

SEQ ID NO: 131638 - DNA, 25 bp, Mus musculus
tatgcaaatacatgcaggtcccgcc

SEQ ID NO: 131639 - DNA, 25 bp, Mus musculus
tatgcaacaagctgccaagcaaggc

SEQ ID NO: 131640 - DNA, 25 bp, Mus musculus
tatgcaacaatgagaaagccacctg

SEQ ID NO: 131641 - DNA, 25 bp, Mus musculus
tatgcaaccacttcttcacccgagg

SEQ ID NO: 131642 - DNA, 25 bp, Mus musculus
tatgcaagagatcacccagcacttt

SEQ ID NO: 131643 - DNA, 25 bp, Mus musculus
tatgcaagcgtcaagaagtctctgg

SEQ ID NO: 131644 - DNA, 25 bp, Mus musculus
tatgcaagctgcgagatgccctact

SEQ ID NO: 131645 - DNA, 25 bp, Mus musculus
tatgcaagggacctacattccccag

SEQ ID NO: 131646 - DNA, 25 bp, Mus musculus
tatgcaagtcacgtgtaaaccggct

SEQ ID NO: 131647 - DNA, 25 bp, Mus musculus
tatgcaataagaactaacgacactg

SEQ ID NO: 131648 - DNA, 25 bp, Mus musculus
tatgcaatctcggaatggctcagtg

SEQ ID NO: 131649 - DNA, 25 bp, Mus musculus
tatgcacaaaatatgggccttcccc

SEQ ID NO: 131650 - DNA, 25 bp, Mus musculus
tatgcacaaaatcccagtgggcctg

SEQ ID NO: 131651 - DNA, 25 bp, Mus musculus
tatgcacacccctttgatcagatct

SEQ ID NO: 131652 - DNA, 25 bp, Mus musculus
tatgcacagagctacaagcaggtct

SEQ ID NO: 131653 - DNA, 25 bp, Mus musculus
tatgcacagcccctcgtgggaggaa

SEQ ID NO: 131654 - DNA, 25 bp, Mus musculus
tatgcacagctttctgcgcaaggca

SEQ ID NO: 131655 - DNA, 25 bp, Mus musculus
tatgcaccaaagtcatggccagtgg

SEQ ID NO: 131656 - DNA, 25 bp, Mus musculus
tatgcacgccatgtggtcttcctgg

SEQ ID NO: 131657 - DNA, 25 bp, Mus musculus
tatgcacggaggatcaatgagctaa

SEQ ID NO: 131658 - DNA, 25 bp, Mus musculus
tatgcacggatccacatcgcagaag

SEQ ID NO: 131659 - DNA, 25 bp, Mus musculus
tatgcactgtaatggagccagccac

SEQ ID NO: 131660 - DNA, 25 bp, Mus musculus
tatgcactgttcacccagtcagcag

SEQ ID NO: 131661 - DNA, 25 bp, Mus musculus
tatgcagaactgctgtgaggacctg

SEQ ID NO: 131662 - DNA, 25 bp, Mus musculus
tatgcagaactggagcctgaggtcg

SEQ ID NO: 131663 - DNA, 25 bp, Mus musculus
tatgcagaagaataaatgggatgcc

SEQ ID NO: 131664 - DNA, 25 bp, Mus musculus
tatgcagaagcagtctgagggcctt

SEQ ID NO: 131665 - DNA, 25 bp, Mus musculus
tatgcagaatgtagagcacgtcccc

SEQ ID NO: 131666 - DNA, 25 bp, Mus musculus
tatgcagacaccatcaaagatctcc

SEQ ID NO: 131667 - DNA, 25 bp, Mus musculus
tatgcagacattgccgacctcatgg

SEQ ID NO: 131668 - DNA, 25 bp, Mus musculus
tatgcagactgacctatcacgggct

SEQ ID NO: 131669 - DNA, 25 bp, Mus musculus
tatgcagagaccttaaccgaaggtg

SEQ ID NO: 131670 - DNA, 25 bp, Mus musculus
tatgcagaggagtatgcaaaggccc

SEQ ID NO: 131671 - DNA, 25 bp, Mus musculus
tatgcagagtctgagtgcccaggct

SEQ ID NO: 131672 - DNA, 25 bp, Mus musculus
tatgcagagtgtcagagcaaggctc

SEQ ID NO: 131673 - DNA, 25 bp, Mus musculus
tatgcagatctctatgcggcctcgt

SEQ ID NO: 131674 - DNA, 25 bp, Mus musculus
tatgcagatgaagaccaagcgtgcc

SEQ ID NO: 131675 - DNA, 25 bp, Mus musculus
tatgcagatggcagaccagtgacct

SEQ ID NO: 131676 - DNA, 25 bp, Mus musculus
tatgcagcagcatcattgacggccg

SEQ ID NO: 131677 - DNA, 25 bp, Mus musculus
tatgcagcattggaaacctgaagac

SEQ ID NO: 131678 - DNA, 25 bp, Mus musculus
tatgcagccaaagtgtaccgtgatg

SEQ ID NO: 131679 - DNA, 25 bp, Mus musculus
tatgcagccagagtgggcaaacctc

SEQ ID NO: 131680 - DNA, 25 bp, Mus musculus
tatgcagccatctcctatgaagagt

SEQ ID NO: 131681 - DNA, 25 bp, Mus musculus
tatgcagcctggcttgtactctggg

SEQ ID NO: 131682 - DNA, 25 bp, Mus musculus
tatgcagctaactggagagtcagcc

SEQ ID NO: 131683 - DNA, 25 bp, Mus musculus
tatgcagctggcaacaaacctgacc

SEQ ID NO: 131684 - DNA, 25 bp, Mus musculus
tatgcaggaaacctacacgagagtg

SEQ ID NO: 131685 - DNA, 25 bp, Mus musculus
tatgcaggaccctgaccaaggcgtg

SEQ ID NO: 131686 - DNA, 25 bp, Mus musculus
tatgcaggcaggagattaccagagc

SEQ ID NO: 131687 - DNA, 25 bp, Mus musculus
tatgcaggcagtcctttagggctcc

SEQ ID NO: 131688 - DNA, 25 bp, Mus musculus
tatgcagggcaaatggccgtgctcg

SEQ ID NO: 131689 - DNA, 25 bp, Mus musculus
tatgcagtacgcacaagtggaggcc

SEQ ID NO: 131690 - DNA, 25 bp, Mus musculus
tatgcagtagcacttgaccttcgga

SEQ ID NO: 131691 - DNA, 25 bp, Mus musculus
tatgcagtcatcaaaggcagaccca

SEQ ID NO: 131692 - DNA, 25 bp, Mus musculus
tatgcagtctcttcttggccagggc

SEQ ID NO: 131693 - DNA, 25 bp, Mus musculus
tatgcagtgtatcttctcacagtcc

SEQ ID NO: 131694 - DNA, 25 bp, Mus musculus
tatgcagtgtcctgtggccaagctg

SEQ ID NO: 131695 - DNA, 25 bp, Mus musculus
tatgcagttatacagccacaaaggg

SEQ ID NO: 131696 - DNA, 25 bp, Mus musculus
tatgcagttgttagctggagccaaa

SEQ ID NO: 131697 - DNA, 25 bp, Mus musculus
tatgcataagggaggcagcagtcct

SEQ ID NO: 131698 - DNA, 25 bp, Mus musculus
tatgcatatcctgaagcctggctgt

SEQ ID NO: 131699 - DNA, 25 bp, Mus musculus
tatgcatatgccaactccgagatct

SEQ ID NO: 131700 - DNA, 25 bp, Mus musculus
tatgcatattcctcttcaaccagga

SEQ ID NO: 131701 - DNA, 25 bp, Mus musculus
tatgcatcacctgagacagagacgc

SEQ ID NO: 131702 - DNA, 25 bp, Mus musculus
tatgcatccaaggtatcggccaagc

SEQ ID NO: 131703 - DNA, 25 bp, Mus musculus
tatgcatgctgcttttgatgtctga

SEQ ID NO: 131704 - DNA, 25 bp, Mus musculus
tatgcatggcgtgtcctggtcgtac

SEQ ID NO: 131705 - DNA, 25 bp, Mus musculus
tatgcattcacgttgtagcccagat

SEQ ID NO: 131706 - DNA, 25 bp, Mus musculus
tatgccaacaacctaatagagagcg

SEQ ID NO: 131707 - DNA, 25 bp, Mus musculus
tatgccaacaatcggagaatcgagg

SEQ ID NO: 131708 - DNA, 25 bp, Mus musculus
tatgccaagaggaccatgctcggtg

SEQ ID NO: 131709 - DNA, 25 bp, Mus musculus
tatgccaagcagagggcagaatgaa

SEQ ID NO: 131710 - DNA, 25 bp, Mus musculus
tatgccaaggtagcagagttcctgg

SEQ ID NO: 131711 - DNA, 25 bp, Mus musculus
tatgccaaggtcattaaagagcacg

SEQ ID NO: 131712 - DNA, 25 bp, Mus musculus
tatgccaagtacgtgctgcgaagca

SEQ ID NO: 131713 - DNA, 25 bp, Mus musculus
tatgccaagtggatgaacctgactc

SEQ ID NO: 131714 - DNA, 25 bp, Mus musculus
tatgccacaggccatgacatcacag

SEQ ID NO: 131715 - DNA, 25 bp, Mus musculus
tatgccaccaccgttcaagtgaaag

SEQ ID NO: 131716 - DNA, 25 bp, Mus musculus
tatgccacctttgggagagacacca

SEQ ID NO: 131717 - DNA, 25 bp, Mus musculus
tatgccacgtacagcagagacccta

SEQ ID NO: 131718 - DNA, 25 bp, Mus musculus
tatgccactccagtcttcaaggaga

SEQ ID NO: 131719 - DNA, 25 bp, Mus musculus
tatgccagagcggaaggtccatgtt

SEQ ID NO: 131720 - DNA, 25 bp, Mus musculus
tatgccaggagaatcagtggctccg

SEQ ID NO: 131721 - DNA, 25 bp, Mus musculus
tatgccagtgttgcaggttccgcta

SEQ ID NO: 131722 - DNA, 25 bp, Mus musculus
tatgccatatgaatccacaagggtg

SEQ ID NO: 131723 - DNA, 25 bp, Mus musculus
tatgccatggtggtggttctgtcca

SEQ ID NO: 131724 - DNA, 25 bp, Mus musculus
tatgccattggcaggaatagcacgg

SEQ ID NO: 131725 - DNA, 25 bp, Mus musculus
tatgccattggtcgctctgacacgg

SEQ ID NO: 131726 - DNA, 25 bp, Mus musculus
tatgcccaacctggatgctgtggcg

SEQ ID NO: 131727 - DNA, 25 bp, Mus musculus
tatgcccaacttcatcttctaggcc

SEQ ID NO: 131728 - DNA, 25 bp, Mus musculus
tatgcccacgtgacaatccgggtcg

SEQ ID NO: 131729 - DNA, 25 bp, Mus musculus
tatgcccagacgtgacagggaatcg

SEQ ID NO: 131730 - DNA, 25 bp, Mus musculus
tatgcccagccagttaaggcccgtt

SEQ ID NO: 131731 - DNA, 25 bp, Mus musculus
tatgcccatcgctccctggtgcagg

SEQ ID NO: 131732 - DNA, 25 bp, Mus musculus
tatgccccagctttcatgatggtgg

SEQ ID NO: 131733 - DNA, 25 bp, Mus musculus
tatgccccgtgtgggaagaagctga

SEQ ID NO: 131734 - DNA, 25 bp, Mus musculus
tatgcccgagacagttagcagcaag

SEQ ID NO: 131735 - DNA, 25 bp, Mus musculus
tatgcccgcaacgtgcatgaagagt

SEQ ID NO: 131736 - DNA, 25 bp, Mus musculus
tatgcccgcactatgccagcaataa

SEQ ID NO: 131737 - DNA, 25 bp, Mus musculus
tatgcccggaaagtgatccaggaca

SEQ ID NO: 131738 - DNA, 25 bp, Mus musculus
tatgcccggcaaggccagattgaag

SEQ ID NO: 131739 - DNA, 25 bp, Mus musculus
tatgcccgggttactgcctatgtaa

SEQ ID NO: 131740 - DNA, 25 bp, Mus musculus
tatgcccgtttcctctaatgctagg

SEQ ID NO: 131741 - DNA, 25 bp, Mus musculus
tatgccctccggtatgagtctaagg

SEQ ID NO: 131742 - DNA, 25 bp, Mus musculus
tatgccctgaagtacgttctggtcc

SEQ ID NO: 131743 - DNA, 25 bp, Mus musculus
tatgccgacaaagctctcgggcagc

SEQ ID NO: 131744 - DNA, 25 bp, Mus musculus
tatgccgacgatggtgagaagacac

SEQ ID NO: 131745 - DNA, 25 bp, Mus musculus
tatgccgacgattcctttacatctg

SEQ ID NO: 131746 - DNA, 25 bp, Mus musculus
tatgccgcacatgctctcgaaaggc

SEQ ID NO: 131747 - DNA, 25 bp, Mus musculus
tatgccgctggactgaagaacgttg

SEQ ID NO: 131748 - DNA, 25 bp, Mus musculus
tatgccgggaacacaacgtgtgcac

SEQ ID NO: 131749 - DNA, 25 bp, Mus musculus
tatgccgtcaatgggaagatctctc

SEQ ID NO: 131750 - DNA, 25 bp, Mus musculus
tatgcctacagctttaccaaggagc

SEQ ID NO: 131751 - DNA, 25 bp, Mus musculus
tatgcctacagtgacaacagcctgg

SEQ ID NO: 131752 - DNA, 25 bp, Mus musculus
tatgcctaccactaccgctttaacg

SEQ ID NO: 131753 - DNA, 25 bp, Mus musculus
tatgcctaccagaacaattgtggcc

SEQ ID NO: 131754 - DNA, 25 bp, Mus musculus
tatgcctagcgttcagagacttccc

SEQ ID NO: 131755 - DNA, 25 bp, Mus musculus
tatgcctataggtggatccgcaacc

SEQ ID NO: 131756 - DNA, 25 bp, Mus musculus
tatgcctcagacctggagcaggcgc

SEQ ID NO: 131757 - DNA, 25 bp, Mus musculus
tatgcctcctcgaagatggtgtcgc

SEQ ID NO: 131758 - DNA, 25 bp, Mus musculus
tatgcctctgtcaaacatatcagtg

SEQ ID NO: 131759 - DNA, 25 bp, Mus musculus
tatgcctcttcttcatggaactgag

SEQ ID NO: 131760 - DNA, 25 bp, Mus musculus
tatgcctgaccggagagctgaacgg

SEQ ID NO: 131761 - DNA, 25 bp, Mus musculus
tatgcctgagtaagcagaggacccg

SEQ ID NO: 131762 - DNA, 25 bp, Mus musculus
tatgcctgagtgtcttctacagaag

SEQ ID NO: 131763 - DNA, 25 bp, Mus musculus
tatgcctggaaacgaacgatgagcg

SEQ ID NO: 131764 - DNA, 25 bp, Mus musculus
tatgcctggaccttcaatgatagcc

SEQ ID NO: 131765 - DNA, 25 bp, Mus musculus
tatgcctggcccacagctgagattg

SEQ ID NO: 131766 - DNA, 25 bp, Mus musculus
tatgcctgggcttctgtgacaatca

SEQ ID NO: 131767 - DNA, 25 bp, Mus musculus
tatgcctggtgtgagttccatcggg

SEQ ID NO: 131768 - DNA, 25 bp, Mus musculus
tatgcctgtaacaagagcatcacag

SEQ ID NO: 131769 - DNA, 25 bp, Mus musculus
tatgccttacgggtgaacctgagtg

SEQ ID NO: 131770 - DNA, 25 bp, Mus musculus
tatgccttcaacatagccagccggg

SEQ ID NO: 131771 - DNA, 25 bp, Mus musculus
tatgccttctcctaacagttctctg

SEQ ID NO: 131772 - DNA, 25 bp, Mus musculus
tatgccttttcaatgcaaggcccca

SEQ ID NO: 131773 - DNA, 25 bp, Mus musculus
tatgcgaaggcactcaggaacttcc

SEQ ID NO: 131774 - DNA, 25 bp, Mus musculus
tatgcgactcgatgatcccgcggaa

SEQ ID NO: 131775 - DNA, 25 bp, Mus musculus
tatgcgactgtcgtctggaagcctg

SEQ ID NO: 131776 - DNA, 25 bp, Mus musculus
tatgcgactttccacatacagcggg

SEQ ID NO: 131777 - DNA, 25 bp, Mus musculus
tatgcgatggaacacctgagggacc

SEQ ID NO: 131778 - DNA, 25 bp, Mus musculus
tatgcgattcatgaggtcacacaag

SEQ ID NO: 131779 - DNA, 25 bp, Mus musculus
tatgcgcagctacgtagagaagatc

SEQ ID NO: 131780 - DNA, 25 bp, Mus musculus
tatgcgcaggagatcggcatcttct

SEQ ID NO: 131781 - DNA, 25 bp, Mus musculus
tatgcgcatgcttctagctgaccag

SEQ ID NO: 131782 - DNA, 25 bp, Mus musculus
tatgcgcgaggagagaagaagcctc

SEQ ID NO: 131783 - DNA, 25 bp, Mus musculus
tatgcgcgtcgctgggtctttctgc

SEQ ID NO: 131784 - DNA, 25 bp, Mus musculus
tatgcggaagcctgatgatatgcct

SEQ ID NO: 131785 - DNA, 25 bp, Mus musculus
tatgcggactggacaaaacacttgg

SEQ ID NO: 131786 - DNA, 25 bp, Mus musculus
tatgcggatgattgatgggaagcca

SEQ ID NO: 131787 - DNA, 25 bp, Mus musculus
tatgcggcaggtgcaacttgcccag

SEQ ID NO: 131788 - DNA, 25 bp, Mus musculus
tatgcggcagtaacatgttcccggc

SEQ ID NO: 131789 - DNA, 25 bp, Mus musculus
tatgcggcgcttttgggcagcaaca

SEQ ID NO: 131790 - DNA, 25 bp, Mus musculus
tatgcggctccagttgtgagcaccg

SEQ ID NO: 131791 - DNA, 25 bp, Mus musculus
tatgcgggataacggccgccttgca

SEQ ID NO: 131792 - DNA, 25 bp, Mus musculus
tatgcgggtcccgagggaagttact

SEQ ID NO: 131793 - DNA, 25 bp, Mus musculus
tatgcggtagcagtcgtgaagaaca

SEQ ID NO: 131794 - DNA, 25 bp, Mus musculus
tatgcggtagctgttgccaactatg

SEQ ID NO: 131795 - DNA, 25 bp, Mus musculus
tatgcggtgtacgaccaggctgtca

SEQ ID NO: 131796 - DNA, 25 bp, Mus musculus
tatgcggtttttccatgaaacagaa

SEQ ID NO: 131797 - DNA, 25 bp, Mus musculus
tatgcgtcactagaagcgtactgca

SEQ ID NO: 131798 - DNA, 25 bp, Mus musculus
tatgcgtgcagactctgaaccagcc

SEQ ID NO: 131799 - DNA, 25 bp, Mus musculus
tatgctaacaagatacgctcggacc

SEQ ID NO: 131800 - DNA, 25 bp, Mus musculus
tatgctaacaccaagaccagggctg

SEQ ID NO: 131801 - DNA, 25 bp, Mus musculus
tatgctaacagaacacgcggcaggc

SEQ ID NO: 131802 - DNA, 25 bp, Mus musculus
tatgctaacctccatgccagagttg

SEQ ID NO: 131803 - DNA, 25 bp, Mus musculus
tatgctaacctctctgatgagaagg

SEQ ID NO: 131804 - DNA, 25 bp, Mus musculus
tatgctaaggatatgggtgtacccg

SEQ ID NO: 131805 - DNA, 25 bp, Mus musculus
tatgctaagttcacggagactcgaa

SEQ ID NO: 131806 - DNA, 25 bp, Mus musculus
tatgctaatgaagactcgggtgaaa

SEQ ID NO: 131807 - DNA, 25 bp, Mus musculus
tatgctaccttttgtaggccacggg

SEQ ID NO: 131808 - DNA, 25 bp, Mus musculus
tatgctacgaagtaagcgtggcacc

SEQ ID NO: 131809 - DNA, 25 bp, Mus musculus
tatgctactcatgggaactgtccac

SEQ ID NO: 131810 - DNA, 25 bp, Mus musculus
tatgctactgcaaccacaggtcatg

SEQ ID NO: 131811 - DNA, 25 bp, Mus musculus
tatgctagagagatagttgacagcc

SEQ ID NO: 131812 - DNA, 25 bp, Mus musculus
tatgctagcactggagacccaagga

SEQ ID NO: 131813 - DNA, 25 bp, Mus musculus
tatgctaggaggctatgtccccagc

SEQ ID NO: 131814 - DNA, 25 bp, Mus musculus
tatgctatcacatagtgccatggtg

SEQ ID NO: 131815 - DNA, 25 bp, Mus musculus
tatgctatgctctgcgagtggctca

SEQ ID NO: 131816 - DNA, 25 bp, Mus musculus
tatgctcactattaccagcagcagg

SEQ ID NO: 131817 - DNA, 25 bp, Mus musculus
tatgctcagtgctgtcgtcatgacc

SEQ ID NO: 131818 - DNA, 25 bp, Mus musculus
tatgctccgcgatgtctgaggcgac

SEQ ID NO: 131819 - DNA, 25 bp, Mus musculus
tatgctcctactttatgtcctcaga

SEQ ID NO: 131820 - DNA, 25 bp, Mus musculus
tatgctcgccttgcggtggacttcc

SEQ ID NO: 131821 - DNA, 25 bp, Mus musculus
tatgctcggatagctacaggagccc

SEQ ID NO: 131822 - DNA, 25 bp, Mus musculus
tatgctcggatgaagaaatgaacgt

SEQ ID NO: 131823 - DNA, 25 bp, Mus musculus
tatgctcggcctgccgagccggaga

SEQ ID NO: 131824 - DNA, 25 bp, Mus musculus
tatgctctacatgtatcagctgtgc

SEQ ID NO: 131825 - DNA, 25 bp, Mus musculus
tatgctctggcacggaacaagggct

SEQ ID NO: 131826 - DNA, 25 bp, Mus musculus
tatgctgaaactgcgttcaaccggg

SEQ ID NO: 131827 - DNA, 25 bp, Mus musculus
tatgctgacttccagagcactggga

SEQ ID NO: 131828 - DNA, 25 bp, Mus musculus
tatgctgagaacatcccagcgggag

SEQ ID NO: 131829 - DNA, 25 bp, Mus musculus
tatgctgagaatacgcagggttccc

SEQ ID NO: 131830 - DNA, 25 bp, Mus musculus
tatgctgagcagaagcaatccgtca

SEQ ID NO: 131831 - DNA, 25 bp, Mus musculus
tatgctgatggcctgttcccacaga

SEQ ID NO: 131832 - DNA, 25 bp, Mus musculus
tatgctgatggtccaggagaagctc

SEQ ID NO: 131833 - DNA, 25 bp, Mus musculus
tatgctgcaagaccaagtccaagga

SEQ ID NO: 131834 - DNA, 25 bp, Mus musculus
tatgctgcagagtgtaccaggagac

SEQ ID NO: 131835 - DNA, 25 bp, Mus musculus
tatgctgccaaaacggctgtcacag

SEQ ID NO: 131836 - DNA, 25 bp, Mus musculus
tatgctgccccagaacttttccagg

SEQ ID NO: 131837 - DNA, 25 bp, Mus musculus
tatgctgcccgttttcctccagaaa

SEQ ID NO: 131838 - DNA, 25 bp, Mus musculus
tatgctgccgagaacaacagggtct

SEQ ID NO: 131839 - DNA, 25 bp, Mus musculus
tatgctgccttatcgttgccaggga

SEQ ID NO: 131840 - DNA, 25 bp, Mus musculus
tatgctgctaagtgccgtgcgaacc

SEQ ID NO: 131841 - DNA, 25 bp, Mus musculus
tatgctgctagggaagctgttgctc

SEQ ID NO: 131842 - DNA, 25 bp, Mus musculus
tatgctgctgggtttggagaccgca

SEQ ID NO: 131843 - DNA, 25 bp, Mus musculus
tatgctggaccagttaatgggcacc

SEQ ID NO: 131844 - DNA, 25 bp, Mus musculus
tatgctggcagatcctaatggagac

SEQ ID NO: 131845 - DNA, 25 bp, Mus musculus
tatgctggccacacggaatttctca

SEQ ID NO: 131846 - DNA, 25 bp, Mus musculus
tatgctggcccaatggaaagattgc

SEQ ID NO: 131847 - DNA, 25 bp, Mus musculus
tatgctggcgcacatgttcaaggac

SEQ ID NO: 131848 - DNA, 25 bp, Mus musculus
tatgctggctggagctgttgccttc

SEQ ID NO: 131849 - DNA, 25 bp, Mus musculus
tatgctgggagttctggcaagctac

SEQ ID NO: 131850 - DNA, 25 bp, Mus musculus
tatgctgtccaagccaagtatggag

SEQ ID NO: 131851 - DNA, 25 bp, Mus musculus
tatgctgtccacctagccaagagag

SEQ ID NO: 131852 - DNA, 25 bp, Mus musculus
tatgctgtgactggcactggaccac

SEQ ID NO: 131853 - DNA, 25 bp, Mus musculus
tatgctgtgctgctgtataaccagg

SEQ ID NO: 131854 - DNA, 25 bp, Mus musculus
tatgctgtgggcaatcagagctcgt

SEQ ID NO: 131855 - DNA, 25 bp, Mus musculus
tatgctgtgggtggtcggtctcaca

SEQ ID NO: 131856 - DNA, 25 bp, Mus musculus
tatgctgtgtgtagcccctgagaac

SEQ ID NO: 131857 - DNA, 25 bp, Mus musculus
tatgcttcggcgtgaagaaaggaga

SEQ ID NO: 131858 - DNA, 25 bp, Mus musculus
tatgcttcgggcagataacacaagt

SEQ ID NO: 131859 - DNA, 25 bp, Mus musculus
tatgcttgagcacttccgggtgcac

SEQ ID NO: 131860 - DNA, 25 bp, Mus musculus
tatgcttggctgatgtggacaacag

SEQ ID NO: 131861 - DNA, 25 bp, Mus musculus
tatgctttggtctatcgccgctttc

SEQ ID NO: 131862 - DNA, 25 bp, Mus musculus
tatgcttttgcactcaattgggaaa

SEQ ID NO: 131863 - DNA, 25 bp, Mus musculus
tatggaaaagtttttgagtggtcca

SEQ ID NO: 131864 - DNA, 25 bp, Mus musculus
tatggaaacaccagtttgcgtggcc

SEQ ID NO: 131865 - DNA, 25 bp, Mus musculus
tatggaaacagccttctcttgacag

SEQ ID NO: 131866 - DNA, 25 bp, Mus musculus
tatggaaacatcgaaaccctgcctc

SEQ ID NO: 131867 - DNA, 25 bp, Mus musculus
tatggaaaccctcgtacaaatggca

SEQ ID NO: 131868 - DNA, 25 bp, Mus musculus
tatggaaactggttcccgggcagca

SEQ ID NO: 131869 - DNA, 25 bp, Mus musculus
tatggaaatagcatcccagaggacc

SEQ ID NO: 131870 - DNA, 25 bp, Mus musculus
tatggaaatccacaggagacagctc

SEQ ID NO: 131871 - DNA, 25 bp, Mus musculus
tatggaaatgcacaacagattggcc

SEQ ID NO: 131872 - DNA, 25 bp, Mus musculus
tatggaaattaacacgcgaagccgg

SEQ ID NO: 131873 - DNA, 25 bp, Mus musculus
tatggaacaagagaaggcctttcaa

SEQ ID NO: 131874 - DNA, 25 bp, Mus musculus
tatggaacagcaataagcatccggc

SEQ ID NO: 131875 - DNA, 25 bp, Mus musculus
tatggaaccattgaagggagcaccc

SEQ ID NO: 131876 - DNA, 25 bp, Mus musculus
tatggaacccatagtgtctacggat

SEQ ID NO: 131877 - DNA, 25 bp, Mus musculus
tatggaacgcccatctcgactgtga

SEQ ID NO: 131878 - DNA, 25 bp, Mus musculus
tatggaagaacctgagatgcagctg

SEQ ID NO: 131879 - DNA, 25 bp, Mus musculus
tatggaagaccttgggttatggagc

SEQ ID NO: 131880 - DNA, 25 bp, Mus musculus
tatggaagagacgtgaatgtctgcc

SEQ ID NO: 131881 - DNA, 25 bp, Mus musculus
tatggaagatgcaacctaaaacgag

SEQ ID NO: 131882 - DNA, 25 bp, Mus musculus
tatggaagcacgcaaaataattctt

SEQ ID NO: 131883 - DNA, 25 bp, Mus musculus
tatggaagcccgattccgagtgtct

SEQ ID NO: 131884 - DNA, 25 bp, Mus musculus
tatggaaggaggttcaagagtcgct

SEQ ID NO: 131885 - DNA, 25 bp, Mus musculus
tatggaaggattcaacaccactggt

SEQ ID NO: 131886 - DNA, 25 bp, Mus musculus
tatggaatatatgaacgctgccgag

SEQ ID NO: 131887 - DNA, 25 bp, Mus musculus
tatggaatctcctacctgcttgagg

SEQ ID NO: 131888 - DNA, 25 bp, Mus musculus
tatggaatgcgagaaagcgttcagc

SEQ ID NO: 131889 - DNA, 25 bp, Mus musculus
tatggaatggcaagcttcccgacac

SEQ ID NO: 131890 - DNA, 25 bp, Mus musculus
tatggaattttgtctgcccgctccc

SEQ ID NO: 131891 - DNA, 25 bp, Mus musculus
tatggacaaccagcaagtagaagag

SEQ ID NO: 131892 - DNA, 25 bp, Mus musculus
tatggacacaaaggcaggaaaactg

SEQ ID NO: 131893 - DNA, 25 bp, Mus musculus
tatggacacacatggaactttttgc

SEQ ID NO: 131894 - DNA, 25 bp, Mus musculus
tatggacaccggtgaaaacccagag

SEQ ID NO: 131895 - DNA, 25 bp, Mus musculus
tatggacactgactcagacggagga

SEQ ID NO: 131896 - DNA, 25 bp, Mus musculus
tatggacagcaatgtgagcaggcag

SEQ ID NO: 131897 - DNA, 25 bp, Mus musculus
tatggacagggagtgcttgcttcag

SEQ ID NO: 131898 - DNA, 25 bp, Mus musculus
tatggacagtctattgcggcaatca

SEQ ID NO: 131899 - DNA, 25 bp, Mus musculus
tatggacagttccacagagacccct

SEQ ID NO: 131900 - DNA, 25 bp, Mus musculus
tatggacagttgtcgatctctccca

SEQ ID NO: 131901 - DNA, 25 bp, Mus musculus
tatggacatcgaggctaccaaccga

SEQ ID NO: 131902 - DNA, 25 bp, Mus musculus
tatggacatggttactaccgggaac

SEQ ID NO: 131903 - DNA, 25 bp, Mus musculus
tatggacattgttggagctaccagg

SEQ ID NO: 131904 - DNA, 25 bp, Mus musculus
tatggaccaaccaaagcacttgctg

SEQ ID NO: 131905 - DNA, 25 bp, Mus musculus
tatggacccagctaccggctatgtg

SEQ ID NO: 131906 - DNA, 25 bp, Mus musculus
tatggacccctcaattggatcacct

SEQ ID NO: 131907 - DNA, 25 bp, Mus musculus
tatggaccctgtctgctgatgccaa

SEQ ID NO: 131908 - DNA, 25 bp, Mus musculus
tatggaccgaactgcaggacatcca

SEQ ID NO: 131909 - DNA, 25 bp, Mus musculus
tatggaccgagagcccatggaacac

SEQ ID NO: 131910 - DNA, 25 bp, Mus musculus
tatggacctcgcatgcagcaggctt

SEQ ID NO: 131911 - DNA, 25 bp, Mus musculus
tatggaccttcggacagtaaagcac

SEQ ID NO: 131912 - DNA, 25 bp, Mus musculus
tatggacgcctccttggccatcaag

SEQ ID NO: 131913 - DNA, 25 bp, Mus musculus
tatggacgctctttcaccttggcct

SEQ ID NO: 131914 - DNA, 25 bp, Mus musculus
tatggacggatctttgtttaggatg

SEQ ID NO: 131915 - DNA, 25 bp, Mus musculus
tatggacggttccttcgtgcagcac

SEQ ID NO: 131916 - DNA, 25 bp, Mus musculus
tatggacgtcatatccagcagtacc

SEQ ID NO: 131917 - DNA, 25 bp, Mus musculus
tatggactccaagtcgaaggaccgc

SEQ ID NO: 131918 - DNA, 25 bp, Mus musculus
tatggactggcttgtacctgccacc

SEQ ID NO: 131919 - DNA, 25 bp, Mus musculus
tatggacttgtacatgatgaactgt

SEQ ID NO: 131920 - DNA, 25 bp, Mus musculus
tatggactttgactgtacgcagaat

SEQ ID NO: 131921 - DNA, 25 bp, Mus musculus
tatggagaaacaagaaagacgcact

SEQ ID NO: 131922 - DNA, 25 bp, Mus musculus
tatggagaattcacgtggagcaatc

SEQ ID NO: 131923 - DNA, 25 bp, Mus musculus
tatggagagcgaagtacgcgtacga

SEQ ID NO: 131924 - DNA, 25 bp, Mus musculus
tatggagatgtaccctgcctagacc

SEQ ID NO: 131925 - DNA, 25 bp, Mus musculus
tatggagatttgagccccacagagc

SEQ ID NO: 131926 - DNA, 25 bp, Mus musculus
tatggagcatcagtacgaggcaacg

SEQ ID NO: 131927 - DNA, 25 bp, Mus musculus
tatggagccagtttcggataccact

SEQ ID NO: 131928 - DNA, 25 bp, Mus musculus
tatggagccctggtcctcacagtgt

SEQ ID NO: 131929 - DNA, 25 bp, Mus musculus
tatggagccgaactggatgcagacc

SEQ ID NO: 131930 - DNA, 25 bp, Mus musculus
tatggagccgtacatctttgggaac

SEQ ID NO: 131931 - DNA, 25 bp, Mus musculus
tatggagcctctgttttacctaaag

SEQ ID NO: 131932 - DNA, 25 bp, Mus musculus
tatggagcttgtccgcgagttacac

SEQ ID NO: 131933 - DNA, 25 bp, Mus musculus
tatggaggaagaggtacagcagcac

SEQ ID NO: 131934 - DNA, 25 bp, Mus musculus
tatggaggacaagctcaaccaggct

SEQ ID NO: 131935 - DNA, 25 bp, Mus musculus
tatggaggaccaactgatagctacc

SEQ ID NO: 131936 - DNA, 25 bp, Mus musculus
tatggaggactattcacaggaggac

SEQ ID NO: 131937 - DNA, 25 bp, Mus musculus
tatggaggactgaaaaccgcctgga

SEQ ID NO: 131938 - DNA, 25 bp, Mus musculus
tatggaggagtatgcggaccttacc

SEQ ID NO: 131939 - DNA, 25 bp, Mus musculus
tatggaggcttcacggtacagaacg

SEQ ID NO: 131940 - DNA, 25 bp, Mus musculus
tatggaggttctgccagccaagaaa

SEQ ID NO: 131941 - DNA, 25 bp, Mus musculus
tatggagtcagcaatgtcactgccg

SEQ ID NO: 131942 - DNA, 25 bp, Mus musculus
tatggagtgccttgtagatgcccgg

SEQ ID NO: 131943 - DNA, 25 bp, Mus musculus
tatggagttttaacctatgggctaa

SEQ ID NO: 131944 - DNA, 25 bp, Mus musculus
tatggataataatggaatacctagg

SEQ ID NO: 131945 - DNA, 25 bp, Mus musculus
tatggatacctgtttggccccaaag

SEQ ID NO: 131946 - DNA, 25 bp, Mus musculus
tatggataggctggaagactgcaac

SEQ ID NO: 131947 - DNA, 25 bp, Mus musculus
tatggatcacaaaccagagggcagg

SEQ ID NO: 131948 - DNA, 25 bp, Mus musculus
tatggatcacaggacaagaagaccc

SEQ ID NO: 131949 - DNA, 25 bp, Mus musculus
tatggatcatttgaacgaggcaact

SEQ ID NO: 131950 - DNA, 25 bp, Mus musculus
tatggatccacggaggctctctgct

SEQ ID NO: 131951 - DNA, 25 bp, Mus musculus
tatggatcctcctgtagccgactgg

SEQ ID NO: 131952 - DNA, 25 bp, Mus musculus
tatggatctgaggactccctgggcg

SEQ ID NO: 131953 - DNA, 25 bp, Mus musculus
tatggatgacattcaggagctgcag

SEQ ID NO: 131954 - DNA, 25 bp, Mus musculus
tatggatgataatgaatgacaagct

SEQ ID NO: 131955 - DNA, 25 bp, Mus musculus
tatggatgccaacaagcctgccaag

SEQ ID NO: 131956 - DNA, 25 bp, Mus musculus
tatggatgcgcagacggtgtaaacg

SEQ ID NO: 131957 - DNA, 25 bp, Mus musculus
tatggatggactccagtaccacagc

SEQ ID NO: 131958 - DNA, 25 bp, Mus musculus
tatggatggcaaccagctgattctg

SEQ ID NO: 131959 - DNA, 25 bp, Mus musculus
tatggatgggaaggagacccacacc

SEQ ID NO: 131960 - DNA, 25 bp, Mus musculus
tatggattggcaacctggatcccaa

SEQ ID NO: 131961 - DNA, 25 bp, Mus musculus
tatggatttatacccttgttctgca

SEQ ID NO: 131962 - DNA, 25 bp, Mus musculus
tatggatttcgcctcagtcacctgc

SEQ ID NO: 131963 - DNA, 25 bp, Mus musculus
tatggatttggaaacctgcgggccg

SEQ ID NO: 131964 - DNA, 25 bp, Mus musculus
tatggcaaagaccaacaagaggcag

SEQ ID NO: 131965 - DNA, 25 bp, Mus musculus
tatggcaaatgcaaatcgaggtccc

SEQ ID NO: 131966 - DNA, 25 bp, Mus musculus
tatggcaacatatgacacagactgg

SEQ ID NO: 131967 - DNA, 25 bp, Mus musculus
tatggcaacccttactcagcacagg

SEQ ID NO: 131968 - DNA, 25 bp, Mus musculus
tatggcaactacacaaactacggga

SEQ ID NO: 131969 - DNA, 25 bp, Mus musculus
tatggcaagaagaccgcagttcacg

SEQ ID NO: 131970 - DNA, 25 bp, Mus musculus
tatggcaagaatgggctgcccacca

SEQ ID NO: 131971 - DNA, 25 bp, Mus musculus
tatggcaaggctgacacaagatggc

SEQ ID NO: 131972 - DNA, 25 bp, Mus musculus
tatggcaatggcctatggcacctcc

SEQ ID NO: 131973 - DNA, 25 bp, Mus musculus
tatggcaccgaggatacctagaggc

SEQ ID NO: 131974 - DNA, 25 bp, Mus musculus
tatggcaccttggacctgaatgagc

SEQ ID NO: 131975 - DNA, 25 bp, Mus musculus
tatggcactgagatgtaacctggcc

SEQ ID NO: 131976 - DNA, 25 bp, Mus musculus
tatggcactgtgcagagaactggca

SEQ ID NO: 131977 - DNA, 25 bp, Mus musculus
tatggcagcaagaagcatcaaccgc

SEQ ID NO: 131978 - DNA, 25 bp, Mus musculus
tatggcagcacggtcaagaacgagt

SEQ ID NO: 131979 - DNA, 25 bp, Mus musculus
tatggcagcatgaatccaagagccc

SEQ ID NO: 131980 - DNA, 25 bp, Mus musculus
tatggcagccactttcaagggaacc

SEQ ID NO: 131981 - DNA, 25 bp, Mus musculus
tatggcaggtaactattggtacccg

SEQ ID NO: 131982 - DNA, 25 bp, Mus musculus
tatggcagtgccaccatgttggtcc

SEQ ID NO: 131983 - DNA, 25 bp, Mus musculus
tatggcagtgtctgcagtacccaga

SEQ ID NO: 131984 - DNA, 25 bp, Mus musculus
tatggcatagctctgacggcctacg

SEQ ID NO: 131985 - DNA, 25 bp, Mus musculus
tatggcatcagcgatggccggagca

SEQ ID NO: 131986 - DNA, 25 bp, Mus musculus
tatggcatctgcctcgactccaggc

SEQ ID NO: 131987 - DNA, 25 bp, Mus musculus
tatggcatgcggcaaacacacagtg

SEQ ID NO: 131988 - DNA, 25 bp, Mus musculus
tatggccaacgcttgcttttttctg

SEQ ID NO: 131989 - DNA, 25 bp, Mus musculus
tatggccacctcctccgtgtctaag

SEQ ID NO: 131990 - DNA, 25 bp, Mus musculus
tatggccacctgaaagtcattgaca

SEQ ID NO: 131991 - DNA, 25 bp, Mus musculus
tatggccacgctgtatctgagaatg

SEQ ID NO: 131992 - DNA, 25 bp, Mus musculus
tatggccactcaggcaagacgctgt

SEQ ID NO: 131993 - DNA, 25 bp, Mus musculus
tatggccaggcgatgactgtccgtg

SEQ ID NO: 131994 - DNA, 25 bp, Mus musculus
tatggccatgctatgacagccgtcc

SEQ ID NO: 131995 - DNA, 25 bp, Mus musculus
tatggccatttaccagactcgggca

SEQ ID NO: 131996 - DNA, 25 bp, Mus musculus
tatggcccagacatgagtggtcccc

SEQ ID NO: 131997 - DNA, 25 bp, Mus musculus
tatggccccagctaataccgtaaat

SEQ ID NO: 131998 - DNA, 25 bp, Mus musculus
tatggccccgaggtaaaaatcgaga

SEQ ID NO: 131999 - DNA, 25 bp, Mus musculus
tatggcccggaaagcagttagcagg

SEQ ID NO: 132000 - DNA, 25 bp, Mus musculus
tatggcccgggaactctctggtgtc

SEQ ID NO: 132001 - DNA, 25 bp, Mus musculus
tatggccctagcagtgtagaagaca

SEQ ID NO: 132002 - DNA, 25 bp, Mus musculus
tatggccctgtgtttactgtatacc

SEQ ID NO: 132003 - DNA, 25 bp, Mus musculus
tatggccgagaagaaatgttagcac

SEQ ID NO: 132004 - DNA, 25 bp, Mus musculus
tatggccgcaaatacgactttacgt

SEQ ID NO: 132005 - DNA, 25 bp, Mus musculus
tatggccggcctctgttaacactga

SEQ ID NO: 132006 - DNA, 25 bp, Mus musculus
tatggccgggatactgacaacaagg

SEQ ID NO: 132007 - DNA, 25 bp, Mus musculus
tatggccggttcaggaaattgttcc

SEQ ID NO: 132008 - DNA, 25 bp, Mus musculus
tatggccgtagcctcaagtgtctgc

SEQ ID NO: 132009 - DNA, 25 bp, Mus musculus
tatggcctcggaagaaaacccggtg

SEQ ID NO: 132010 - DNA, 25 bp, Mus musculus
tatggcctggtttgtcacggtcccc

SEQ ID NO: 132011 - DNA, 25 bp, Mus musculus
tatggcgaagacctacgattacctg

SEQ ID NO: 132012 - DNA, 25 bp, Mus musculus
tatggcgcccagaatccatcaggag

SEQ ID NO: 132013 - DNA, 25 bp, Mus musculus
tatggcgcgtcttccaactctgagc

SEQ ID NO: 132014 - DNA, 25 bp, Mus musculus
tatggcgcttgagtttgcacaaaca

SEQ ID NO: 132015 - DNA, 25 bp, Mus musculus
tatggcggtggcctatggactcatc

SEQ ID NO: 132016 - DNA, 25 bp, Mus musculus
tatggcgtgataactctggccggcg

SEQ ID NO: 132017 - DNA, 25 bp, Mus musculus
tatggcgtgctaaccaacagtctag

SEQ ID NO: 132018 - DNA, 25 bp, Mus musculus
tatggcgtttgtgagaacctgcgga

SEQ ID NO: 132019 - DNA, 25 bp, Mus musculus
tatggctaaaataagaacggccagg

SEQ ID NO: 132020 - DNA, 25 bp, Mus musculus
tatggctaacaatgcatctcttgag

SEQ ID NO: 132021 - DNA, 25 bp, Mus musculus
tatggctacagtaaccgagtggtcg

SEQ ID NO: 132022 - DNA, 25 bp, Mus musculus
tatggctattgctaccaggacagtg

SEQ ID NO: 132023 - DNA, 25 bp, Mus musculus
tatggctcaacctgcctcactgtgg

SEQ ID NO: 132024 - DNA, 25 bp, Mus musculus
tatggctcacacagcttaaaagtag

SEQ ID NO: 132025 - DNA, 25 bp, Mus musculus
tatggctcacctacctacttctacg

SEQ ID NO: 132026 - DNA, 25 bp, Mus musculus
tatggctcaggccagcaatgctgct

SEQ ID NO: 132027 - DNA, 25 bp, Mus musculus
tatggctcagttggagcaccaggcg

SEQ ID NO: 132028 - DNA, 25 bp, Mus musculus
tatggctccattgcaggcctagcag

SEQ ID NO: 132029 - DNA, 25 bp, Mus musculus
tatggctcgagaacccagtatcaga

SEQ ID NO: 132030 - DNA, 25 bp, Mus musculus
tatggctcgggctagtgatagtcac

SEQ ID NO: 132031 - DNA, 25 bp, Mus musculus
tatggctcttcggtttctcctgggc

SEQ ID NO: 132032 - DNA, 25 bp, Mus musculus
tatggctgaaggtttcagacacccg

SEQ ID NO: 132033 - DNA, 25 bp, Mus musculus
tatggctgacgtcactgaacgcctg

SEQ ID NO: 132034 - DNA, 25 bp, Mus musculus
tatggctgcaaaccaacaaatccgg

SEQ ID NO: 132035 - DNA, 25 bp, Mus musculus
tatggctgcctgtgaacttaacctg

SEQ ID NO: 132036 - DNA, 25 bp, Mus musculus
tatggctgctgatgaaggttccaca

SEQ ID NO: 132037 - DNA, 25 bp, Mus musculus
tatggctgggaaaaaatcgatgatc

SEQ ID NO: 132038 - DNA, 25 bp, Mus musculus
tatggctgggtatactctccttagg

SEQ ID NO: 132039 - DNA, 25 bp, Mus musculus
tatggctgtgccagttgcccaaagc

SEQ ID NO: 132040 - DNA, 25 bp, Mus musculus
tatggcttaatggatggccagccac

SEQ ID NO: 132041 - DNA, 25 bp, Mus musculus
tatggcttcctatagactggcccag

SEQ ID NO: 132042 - DNA, 25 bp, Mus musculus
tatggcttctgactcacccaggtgg

SEQ ID NO: 132043 - DNA, 25 bp, Mus musculus
tatggcttgccaagaaggaacacag

SEQ ID NO: 132044 - DNA, 25 bp, Mus musculus
tatggcttgggcttggaacgatttc

SEQ ID NO: 132045 - DNA, 25 bp, Mus musculus
tatgggaaccctcattctcggactc

SEQ ID NO: 132046 - DNA, 25 bp, Mus musculus
tatgggaataccttccaggcctaag

SEQ ID NO: 132047 - DNA, 25 bp, Mus musculus
tatgggaatattgctccgagcactg

SEQ ID NO: 132048 - DNA, 25 bp, Mus musculus
tatgggacccagaacattcgactga

SEQ ID NO: 132049 - DNA, 25 bp, Mus musculus
tatgggacccgcataggaagcttgt

SEQ ID NO: 132050 - DNA, 25 bp, Mus musculus
tatgggaccgtctatcacatgatcc

SEQ ID NO: 132051 - DNA, 25 bp, Mus musculus
tatgggactggttatgccaaactgc

SEQ ID NO: 132052 - DNA, 25 bp, Mus musculus
tatgggagactcgtgtgcactgact

SEQ ID NO: 132053 - DNA, 25 bp, Mus musculus
tatgggagccctacatggatgtgtc

SEQ ID NO: 132054 - DNA, 25 bp, Mus musculus
tatgggagctccaactgggtgacca

SEQ ID NO: 132055 - DNA, 25 bp, Mus musculus
tatgggagttgctggctctcaacct

SEQ ID NO: 132056 - DNA, 25 bp, Mus musculus
tatgggatcacgtcaccatggccaa

SEQ ID NO: 132057 - DNA, 25 bp, Mus musculus
tatgggatcactatattctgtctgc

SEQ ID NO: 132058 - DNA, 25 bp, Mus musculus
tatgggatcagggaaggcttcagct

SEQ ID NO: 132059 - DNA, 25 bp, Mus musculus
tatgggatccattctgacgtgtgga

SEQ ID NO: 132060 - DNA, 25 bp, Mus musculus
tatgggatccctgagcatgctgaca

SEQ ID NO: 132061 - DNA, 25 bp, Mus musculus
tatgggatgcccactgacttcggct

SEQ ID NO: 132062 - DNA, 25 bp, Mus musculus
tatgggatgcgcaggcgcagaactc

SEQ ID NO: 132063 - DNA, 25 bp, Mus musculus
tatgggattggcatcaaagaaagca

SEQ ID NO: 132064 - DNA, 25 bp, Mus musculus
tatgggcaagaaaagatggacctgg

SEQ ID NO: 132065 - DNA, 25 bp, Mus musculus
tatgggcagtgaccctaaagacctg

SEQ ID NO: 132066 - DNA, 25 bp, Mus musculus
tatgggcatattaccagctttagaa

SEQ ID NO: 132067 - DNA, 25 bp, Mus musculus
tatgggcatcatggacaagaccgcc

SEQ ID NO: 132068 - DNA, 25 bp, Mus musculus
tatgggcatttctctaccacagagg

SEQ ID NO: 132069 - DNA, 25 bp, Mus musculus
tatgggccaagtgggcgacagctgc

SEQ ID NO: 132070 - DNA, 25 bp, Mus musculus
tatgggccatgaccaaaacgcatct

SEQ ID NO: 132071 - DNA, 25 bp, Mus musculus
tatgggcccttatttgagatctaca

SEQ ID NO: 132072 - DNA, 25 bp, Mus musculus
tatgggcgcacatcctagacatctg

SEQ ID NO: 132073 - DNA, 25 bp, Mus musculus
tatgggcgccttcttctctggtatc

SEQ ID NO: 132074 - DNA, 25 bp, Mus musculus
tatgggctaaacaggacaatcggtc

SEQ ID NO: 132075 - DNA, 25 bp, Mus musculus
tatgggctacacaacccagacgtgg

SEQ ID NO: 132076 - DNA, 25 bp, Mus musculus
tatgggctacacacgggaagaaatc

SEQ ID NO: 132077 - DNA, 25 bp, Mus musculus
tatgggctcagaaacaaggtcaggt

SEQ ID NO: 132078 - DNA, 25 bp, Mus musculus
tatgggctccaacaacaacgggatt

SEQ ID NO: 132079 - DNA, 25 bp, Mus musculus
tatgggctctacgtctgcttcgtgg

SEQ ID NO: 132080 - DNA, 25 bp, Mus musculus
tatgggctcttcaggatggattctc

SEQ ID NO: 132081 - DNA, 25 bp, Mus musculus
tatgggcttcctcgccaggtgtacg

SEQ ID NO: 132082 - DNA, 25 bp, Mus musculus
tatgggcttctccaaactgggcaag

SEQ ID NO: 132083 - DNA, 25 bp, Mus musculus
tatgggtaattcctgcatctgccga

SEQ ID NO: 132084 - DNA, 25 bp, Mus musculus
tatgggtacgagtcgtcagacccca

SEQ ID NO: 132085 - DNA, 25 bp, Mus musculus
tatgggtcacgaactgtcacgtcgg

SEQ ID NO: 132086 - DNA, 25 bp, Mus musculus
tatgggtcacggtcagaaaggcagt

SEQ ID NO: 132087 - DNA, 25 bp, Mus musculus
tatgggtccctcatctggaaggtgg

SEQ ID NO: 132088 - DNA, 25 bp, Mus musculus
tatgggtccgagtacatcaacctgg

SEQ ID NO: 132089 - DNA, 25 bp, Mus musculus
tatgggtcgcctattgagcatgcgc

SEQ ID NO: 132090 - DNA, 25 bp, Mus musculus
tatgggtctacactgtgaaatcttg

SEQ ID NO: 132091 - DNA, 25 bp, Mus musculus
tatgggtctccaacagctgaaaatg

SEQ ID NO: 132092 - DNA, 25 bp, Mus musculus
tatgggtctcggcacttagctcaga

SEQ ID NO: 132093 - DNA, 25 bp, Mus musculus
tatgggtgagcagacctctcctgca

SEQ ID NO: 132094 - DNA, 25 bp, Mus musculus
tatgggtgccaagggatagtctctc

SEQ ID NO: 132095 - DNA, 25 bp, Mus musculus
tatgggtggctgtcaaaggacaaga

SEQ ID NO: 132096 - DNA, 25 bp, Mus musculus
tatgggttgactgctctggccctca

SEQ ID NO: 132097 - DNA, 25 bp, Mus musculus
tatgggttgtccgtttggttccctg

SEQ ID NO: 132098 - DNA, 25 bp, Mus musculus
tatgggtttccccacctatggacgt

SEQ ID NO: 132099 - DNA, 25 bp, Mus musculus
tatggtaaaaacaccagcttagtta

SEQ ID NO: 132100 - DNA, 25 bp, Mus musculus
tatggtaacctcacagaaccccgtg

SEQ ID NO: 132101 - DNA, 25 bp, Mus musculus
tatggtaagtatcgagccagtgcct

SEQ ID NO: 132102 - DNA, 25 bp, Mus musculus
tatggtacaggagcacagcaaagca

SEQ ID NO: 132103 - DNA, 25 bp, Mus musculus
tatggtacctggctacctcctggtg

SEQ ID NO: 132104 - DNA, 25 bp, Mus musculus
tatggtagagtctatgccgctgctg

SEQ ID NO: 132105 - DNA, 25 bp, Mus musculus
tatggtagtctggagccgaatcgag

SEQ ID NO: 132106 - DNA, 25 bp, Mus musculus
tatggtatgacaatcctaggactcg

SEQ ID NO: 132107 - DNA, 25 bp, Mus musculus
tatggtcaactgaaagcttcccagg

SEQ ID NO: 132108 - DNA, 25 bp, Mus musculus
tatggtcacaacaaaacactctgcg

SEQ ID NO: 132109 - DNA, 25 bp, Mus musculus
tatggtcagattagccaggcctttc

SEQ ID NO: 132110 - DNA, 25 bp, Mus musculus
tatggtccccgcaggtgtctgaaga

SEQ ID NO: 132111 - DNA, 25 bp, Mus musculus
tatggtccctctctccctggaaaca

SEQ ID NO: 132112 - DNA, 25 bp, Mus musculus
tatggtccctgatgcatgcacagtc

SEQ ID NO: 132113 - DNA, 25 bp, Mus musculus
tatggtcgacagtactccctggagc

SEQ ID NO: 132114 - DNA, 25 bp, Mus musculus
tatggtcggaggaaaccttgttatc

SEQ ID NO: 132115 - DNA, 25 bp, Mus musculus
tatggtctaccaggaggtgatccgg

SEQ ID NO: 132116 - DNA, 25 bp, Mus musculus
tatggtctgcacatgatactcagcc

SEQ ID NO: 132117 - DNA, 25 bp, Mus musculus
tatggtgacccgactaatggaggca

SEQ ID NO: 132118 - DNA, 25 bp, Mus musculus
tatggtgactcacatgcatccgaca

SEQ ID NO: 132119 - DNA, 25 bp, Mus musculus
tatggtgagcagaggagtactaacg

SEQ ID NO: 132120 - DNA, 25 bp, Mus musculus
tatggtgatacctcatggacatcgc

SEQ ID NO: 132121 - DNA, 25 bp, Mus musculus
tatggtgatgccttcctgctgcaag

SEQ ID NO: 132122 - DNA, 25 bp, Mus musculus
tatggtgcaccatctcctgagtgtg

SEQ ID NO: 132123 - DNA, 25 bp, Mus musculus
tatggtgcccctggaaatctggaca

SEQ ID NO: 132124 - DNA, 25 bp, Mus musculus
tatggtgcgattgaacagtataacg

SEQ ID NO: 132125 - DNA, 25 bp, Mus musculus
tatggtgctgtcaatccgagaaggc

SEQ ID NO: 132126 - DNA, 25 bp, Mus musculus
tatggtgggctgaattctggacgtc

SEQ ID NO: 132127 - DNA, 25 bp, Mus musculus
tatggtggtccatcctgcagactct

SEQ ID NO: 132128 - DNA, 25 bp, Mus musculus
tatggtgtaactggatcccgctcgg

SEQ ID NO: 132129 - DNA, 25 bp, Mus musculus
tatggtgtgaaccaagcccaggtgc

SEQ ID NO: 132130 - DNA, 25 bp, Mus musculus
tatggttatcctcggcctcgttcgg

SEQ ID NO: 132131 - DNA, 25 bp, Mus musculus
tatggttcccaacatgagcaggcac

SEQ ID NO: 132132 - DNA, 25 bp, Mus musculus
tatggttgctacgtggtcagcgtgc

SEQ ID NO: 132133 - DNA, 25 bp, Mus musculus
tatggtttgtcacctgatcggcaat

SEQ ID NO: 132134 - DNA, 25 bp, Mus musculus
tatggttttcttggctattgcagca

SEQ ID NO: 132135 - DNA, 25 bp, Mus musculus
tatgtaaagtattccagagagctgc

SEQ ID NO: 132136 - DNA, 25 bp, Mus musculus
tatgtaaagttgctgctccctccct

SEQ ID NO: 132137 - DNA, 25 bp, Mus musculus
tatgtaacctgcataggaccctggg

SEQ ID NO: 132138 - DNA, 25 bp, Mus musculus
tatgtaaggcggagcaagactgacg

SEQ ID NO: 132139 - DNA, 25 bp, Mus musculus
tatgtaatctccctgcaaggtgctc

SEQ ID NO: 132140 - DNA, 25 bp, Mus musculus
tatgtacaagctgtgaagacaatgc

SEQ ID NO: 132141 - DNA, 25 bp, Mus musculus
tatgtacatctagctggtccaccag

SEQ ID NO: 132142 - DNA, 25 bp, Mus musculus
tatgtacatgccgtcagtcctctgg

SEQ ID NO: 132143 - DNA, 25 bp, Mus musculus
tatgtacattgcctctccgtgtggt

SEQ ID NO: 132144 - DNA, 25 bp, Mus musculus
tatgtacatttctcaggccagggcc

SEQ ID NO: 132145 - DNA, 25 bp, Mus musculus
tatgtaccccaagtctcaacctgaa

SEQ ID NO: 132146 - DNA, 25 bp, Mus musculus
tatgtacctatgctgagaatcgtgc

SEQ ID NO: 132147 - DNA, 25 bp, Mus musculus
tatgtactgaaggactataccgtgt

SEQ ID NO: 132148 - DNA, 25 bp, Mus musculus
tatgtactgcaacaggctgctgatg

SEQ ID NO: 132149 - DNA, 25 bp, Mus musculus
tatgtacttaacttccacggccgtg

SEQ ID NO: 132150 - DNA, 25 bp, Mus musculus
tatgtagaacacaagttcgcacgcc

SEQ ID NO: 132151 - DNA, 25 bp, Mus musculus
tatgtagacaacttccaggccacag

SEQ ID NO: 132152 - DNA, 25 bp, Mus musculus
tatgtagacgctacttccaagagca

SEQ ID NO: 132153 - DNA, 25 bp, Mus musculus
tatgtagcccaagcataaatctatg

SEQ ID NO: 132154 - DNA, 25 bp, Mus musculus
tatgtagctttaatgcccatgccca

SEQ ID NO: 132155 - DNA, 25 bp, Mus musculus
tatgtaggctacctgcagaacgacg

SEQ ID NO: 132156 - DNA, 25 bp, Mus musculus
tatgtagtcagtgagccgctgggcc

SEQ ID NO: 132157 - DNA, 25 bp, Mus musculus
tatgtagtcgcttcgtgagggaccg

SEQ ID NO: 132158 - DNA, 25 bp, Mus musculus
tatgtagtgggaacgatccatgcac

SEQ ID NO: 132159 - DNA, 25 bp, Mus musculus
tatgtatatccagccacgtggcccg

SEQ ID NO: 132160 - DNA, 25 bp, Mus musculus
tatgtatctactaccggcaagcagt

SEQ ID NO: 132161 - DNA, 25 bp, Mus musculus
tatgtatcttgagtggcctttaaac

SEQ ID NO: 132162 - DNA, 25 bp, Mus musculus
tatgtatgtggctgatccagaatcc

SEQ ID NO: 132163 - DNA, 25 bp, Mus musculus
tatgtattaagagcctaggcccacg

SEQ ID NO: 132164 - DNA, 25 bp, Mus musculus
tatgtcaaaaactacggcttgcggg

SEQ ID NO: 132165 - DNA, 25 bp, Mus musculus
tatgtcaacaaagtgggaccctacc

SEQ ID NO: 132166 - DNA, 25 bp, Mus musculus
tatgtcaacacatgccttagccagg

SEQ ID NO: 132167 - DNA, 25 bp, Mus musculus
tatgtcaacggcaagaaagtcactg

SEQ ID NO: 132168 - DNA, 25 bp, Mus musculus
tatgtcaactacgacactaatctgg

SEQ ID NO: 132169 - DNA, 25 bp, Mus musculus
tatgtcacctggatcgccttgatgg

SEQ ID NO: 132170 - DNA, 25 bp, Mus musculus
tatgtcacgacagttgaagttccag

SEQ ID NO: 132171 - DNA, 25 bp, Mus musculus
tatgtcacgctacacaaaggctgct

SEQ ID NO: 132172 - DNA, 25 bp, Mus musculus
tatgtcactcacttaggaggcggag

SEQ ID NO: 132173 - DNA, 25 bp, Mus musculus
tatgtcagcacacacttacagagca

SEQ ID NO: 132174 - DNA, 25 bp, Mus musculus
tatgtcaggcaagatggaaccagat

SEQ ID NO: 132175 - DNA, 25 bp, Mus musculus
tatgtcagtagctcagaggcgatgt

SEQ ID NO: 132176 - DNA, 25 bp, Mus musculus
tatgtcatcctaaagactgtgcagc

SEQ ID NO: 132177 - DNA, 25 bp, Mus musculus
tatgtcatcgccctgcgcagctaca

SEQ ID NO: 132178 - DNA, 25 bp, Mus musculus
tatgtcatctgaaatgctgccagca

SEQ ID NO: 132179 - DNA, 25 bp, Mus musculus
tatgtcatgtatgcgcctggagccc

SEQ ID NO: 132180 - DNA, 25 bp, Mus musculus
tatgtcattgaaaaccaggcggccg

SEQ ID NO: 132181 - DNA, 25 bp, Mus musculus
tatgtcattgagtacgctgcctgtg

SEQ ID NO: 132182 - DNA, 25 bp, Mus musculus
tatgtccaaaacagtcaaagtaggc

SEQ ID NO: 132183 - DNA, 25 bp, Mus musculus
tatgtccaaggcaacgagcgtgccc

SEQ ID NO: 132184 - DNA, 25 bp, Mus musculus
tatgtccacctgcagaagttgaatc

SEQ ID NO: 132185 - DNA, 25 bp, Mus musculus
tatgtccacgatgagtgcaagagga

SEQ ID NO: 132186 - DNA, 25 bp, Mus musculus
tatgtcccaggaagtaaaggtgccc

SEQ ID NO: 132187 - DNA, 25 bp, Mus musculus
tatgtccccagtgttgtcccaaagg

SEQ ID NO: 132188 - DNA, 25 bp, Mus musculus
tatgtccccatcacagagtttggaa

SEQ ID NO: 132189 - DNA, 25 bp, Mus musculus
tatgtcccttgtgaatggctgggaa

SEQ ID NO: 132190 - DNA, 25 bp, Mus musculus
tatgtccgcacagtctccagtatca

SEQ ID NO: 132191 - DNA, 25 bp, Mus musculus
tatgtccgcagctactatgggccac

SEQ ID NO: 132192 - DNA, 25 bp, Mus musculus
tatgtccgcctcatagattcaatga

SEQ ID NO: 132193 - DNA, 25 bp, Mus musculus
tatgtcctcaacacctgcgggcagg

SEQ ID NO: 132194 - DNA, 25 bp, Mus musculus
tatgtcctctacatcaatggcggcc

SEQ ID NO: 132195 - DNA, 25 bp, Mus musculus
tatgtcctgtgttgtgacctcatgg

SEQ ID NO: 132196 - DNA, 25 bp, Mus musculus
tatgtcgactgataccgctgctaca

SEQ ID NO: 132197 - DNA, 25 bp, Mus musculus
tatgtcgagcttggagatcagcaac

SEQ ID NO: 132198 - DNA, 25 bp, Mus musculus
tatgtcgaggctatccagtgacagc

SEQ ID NO: 132199 - DNA, 25 bp, Mus musculus
tatgtcgcagccaagtttcatgagg

SEQ ID NO: 132200 - DNA, 25 bp, Mus musculus
tatgtcgcccatacacctgctggaa

SEQ ID NO: 132201 - DNA, 25 bp, Mus musculus
tatgtcggcataccagagtgcatca

SEQ ID NO: 132202 - DNA, 25 bp, Mus musculus
tatgtcgtaatggactttagtggcg

SEQ ID NO: 132203 - DNA, 25 bp, Mus musculus
tatgtcgtcgatgctaaaatggtct

SEQ ID NO: 132204 - DNA, 25 bp, Mus musculus
tatgtcgttcaaggagctagaggca

SEQ ID NO: 132205 - DNA, 25 bp, Mus musculus
tatgtctacagcttgggccagttcc

SEQ ID NO: 132206 - DNA, 25 bp, Mus musculus
tatgtctccatcctccaagtcggtg

SEQ ID NO: 132207 - DNA, 25 bp, Mus musculus
tatgtctgaaaaccagctgggctcc

SEQ ID NO: 132208 - DNA, 25 bp, Mus musculus
tatgtctgaatgaggctcggtcacc

SEQ ID NO: 132209 - DNA, 25 bp, Mus musculus
tatgtctgacctgtactataagatc

SEQ ID NO: 132210 - DNA, 25 bp, Mus musculus
tatgtctgcaaacatgggcagagcc

SEQ ID NO: 132211 - DNA, 25 bp, Mus musculus
tatgtctgcaatggagtctggtcca

SEQ ID NO: 132212 - DNA, 25 bp, Mus musculus
tatgtctgcccggaggcacattggg

SEQ ID NO: 132213 - DNA, 25 bp, Mus musculus
tatgtctggccaagagcctggatcc

SEQ ID NO: 132214 - DNA, 25 bp, Mus musculus
tatgtcttcgaagtttcagccagcg

SEQ ID NO: 132215 - DNA, 25 bp, Mus musculus
tatgtcttggctgtcggcagctccg

SEQ ID NO: 132216 - DNA, 25 bp, Mus musculus
tatgtctttgacaaaaggctcaggt

SEQ ID NO: 132217 - DNA, 25 bp, Mus musculus
tatgtgacagtacgaaggatcaacc

SEQ ID NO: 132218 - DNA, 25 bp, Mus musculus
tatgtgaccccagttcttatccaag

SEQ ID NO: 132219 - DNA, 25 bp, Mus musculus
tatgtgaccctagcagctatgctcc

SEQ ID NO: 132220 - DNA, 25 bp, Mus musculus
tatgtgacggagattgcccaggacg

SEQ ID NO: 132221 - DNA, 25 bp, Mus musculus
tatgtgagccaagtctccctgagct

SEQ ID NO: 132222 - DNA, 25 bp, Mus musculus
tatgtgagcgccagcccattgggcg

SEQ ID NO: 132223 - DNA, 25 bp, Mus musculus
tatgtgagctgcaaatcctctggga

SEQ ID NO: 132224 - DNA, 25 bp, Mus musculus
tatgtgaggagagttcagccgagcc

SEQ ID NO: 132225 - DNA, 25 bp, Mus musculus
tatgtgaggagtcaccaagcctgtc

SEQ ID NO: 132226 - DNA, 25 bp, Mus musculus
tatgtgaggccaaagagtcccctcc

SEQ ID NO: 132227 - DNA, 25 bp, Mus musculus
tatgtgatagcagcgcaagcggtgc

SEQ ID NO: 132228 - DNA, 25 bp, Mus musculus
tatgtgatgctcaagtggacctgcc

SEQ ID NO: 132229 - DNA, 25 bp, Mus musculus
tatgtgatgctgtgcggatatcctc

SEQ ID NO: 132230 - DNA, 25 bp, Mus musculus
tatgtgatggctaacacgggtatcc

SEQ ID NO: 132231 - DNA, 25 bp, Mus musculus
tatgtgcaacttaccttcagagccc

SEQ ID NO: 132232 - DNA, 25 bp, Mus musculus
tatgtgcaatgggaccagcctacca

SEQ ID NO: 132233 - DNA, 25 bp, Mus musculus
tatgtgcacacgaaagttggagacc

SEQ ID NO: 132234 - DNA, 25 bp, Mus musculus
tatgtgcacacgaatggaccgaaga

SEQ ID NO: 132235 - DNA, 25 bp, Mus musculus
tatgtgcacccacacgccatagttg

SEQ ID NO: 132236 - DNA, 25 bp, Mus musculus
tatgtgcagaaaacctactctgaag

SEQ ID NO: 132237 - DNA, 25 bp, Mus musculus
tatgtgcagcacgagattgacttgc

SEQ ID NO: 132238 - DNA, 25 bp, Mus musculus
tatgtgcagcactatgccctggcca

SEQ ID NO: 132239 - DNA, 25 bp, Mus musculus
tatgtgcaggacaggattcgggccc

SEQ ID NO: 132240 - DNA, 25 bp, Mus musculus
tatgtgcatagaaaatcccaaaaga

SEQ ID NO: 132241 - DNA, 25 bp, Mus musculus
tatgtgcatcgcctttgagctcctg

SEQ ID NO: 132242 - DNA, 25 bp, Mus musculus
tatgtgccacaggaagccatcagca

SEQ ID NO: 132243 - DNA, 25 bp, Mus musculus
tatgtgcccatcaaagacgacgacg

SEQ ID NO: 132244 - DNA, 25 bp, Mus musculus
tatgtgcccctggtactgttctaag

SEQ ID NO: 132245 - DNA, 25 bp, Mus musculus
tatgtgccccttctctcttgcagct

SEQ ID NO: 132246 - DNA, 25 bp, Mus musculus
tatgtgcccgagtacagctctggac

SEQ ID NO: 132247 - DNA, 25 bp, Mus musculus
tatgtgccctgcaacatcctggctg

SEQ ID NO: 132248 - DNA, 25 bp, Mus musculus
tatgtgccgtcctctggaatgtccg

SEQ ID NO: 132249 - DNA, 25 bp, Mus musculus
tatgtgccttccttatgcttcaaag

SEQ ID NO: 132250 - DNA, 25 bp, Mus musculus
tatgtgccttggaactaccatgagc

SEQ ID NO: 132251 - DNA, 25 bp, Mus musculus
tatgtgcgcgtctcctcagaggagc

SEQ ID NO: 132252 - DNA, 25 bp, Mus musculus
tatgtgcgggccatcgaaaagggct

SEQ ID NO: 132253 - DNA, 25 bp, Mus musculus
tatgtgcgtggcaatgacctacagc

SEQ ID NO: 132254 - DNA, 25 bp, Mus musculus
tatgtgctgaaaccggccttcctga

SEQ ID NO: 132255 - DNA, 25 bp, Mus musculus
tatgtgcttcatcctgtggtggcca

SEQ ID NO: 132256 - DNA, 25 bp, Mus musculus
tatgtggacacactcaagcttgcgg

SEQ ID NO: 132257 - DNA, 25 bp, Mus musculus
tatgtggacagctggtcagacgcct

SEQ ID NO: 132258 - DNA, 25 bp, Mus musculus
tatgtggacatcaccgtgggcagct

SEQ ID NO: 132259 - DNA, 25 bp, Mus musculus
tatgtggaccgtgatggcaaggacc

SEQ ID NO: 132260 - DNA, 25 bp, Mus musculus
tatgtggacgacaacagctggaccc

SEQ ID NO: 132261 - DNA, 25 bp, Mus musculus
tatgtggactccctccagatgcagg

SEQ ID NO: 132262 - DNA, 25 bp, Mus musculus
tatgtggagactatgacccaagacc

SEQ ID NO: 132263 - DNA, 25 bp, Mus musculus
tatgtggagccacataagatccggg

SEQ ID NO: 132264 - DNA, 25 bp, Mus musculus
tatgtggagctacctgaattgcccc

SEQ ID NO: 132265 - DNA, 25 bp, Mus musculus
tatgtggagtcccatgttagcaggc

SEQ ID NO: 132266 - DNA, 25 bp, Mus musculus
tatgtggagtgcttcagtgcccaga

SEQ ID NO: 132267 - DNA, 25 bp, Mus musculus
tatgtggatgcggtcaaagacagcg

SEQ ID NO: 132268 - DNA, 25 bp, Mus musculus
tatgtggatgctgaaggcaaccccg

SEQ ID NO: 132269 - DNA, 25 bp, Mus musculus
tatgtggcactgaaacgaactgggc

SEQ ID NO: 132270 - DNA, 25 bp, Mus musculus
tatgtggcactggtcttctcaaagg

SEQ ID NO: 132271 - DNA, 25 bp, Mus musculus
tatgtggcagtacccgcctgtgaac

SEQ ID NO: 132272 - DNA, 25 bp, Mus musculus
tatgtggcccttgagaatatatccc

SEQ ID NO: 132273 - DNA, 25 bp, Mus musculus
tatgtggcctaccagaagcaggtca

SEQ ID NO: 132274 - DNA, 25 bp, Mus musculus
tatgtggcctcagccgtgggtgtca

SEQ ID NO: 132275 - DNA, 25 bp, Mus musculus
tatgtggcctcgctgctaacgtaca

SEQ ID NO: 132276 - DNA, 25 bp, Mus musculus
tatgtggcctgtacataccagagag

SEQ ID NO: 132277 - DNA, 25 bp, Mus musculus
tatgtggccttggaacgagtttccc

SEQ ID NO: 132278 - DNA, 25 bp, Mus musculus
tatgtggctcccaggattggcagaa

SEQ ID NO: 132279 - DNA, 25 bp, Mus musculus
tatgtgggaccagcggatggctctt

SEQ ID NO: 132280 - DNA, 25 bp, Mus musculus
tatgtgggctttgccaacctcccaa

SEQ ID NO: 132281 - DNA, 25 bp, Mus musculus
tatgtgggtcattctcaaggctgca

SEQ ID NO: 132282 - DNA, 25 bp, Mus musculus
tatgtgggtgccatggtctccagca

SEQ ID NO: 132283 - DNA, 25 bp, Mus musculus
tatgtggtaggcatccagtggaacc

SEQ ID NO: 132284 - DNA, 25 bp, Mus musculus
tatgtggtcactgcggagggtcttc

SEQ ID NO: 132285 - DNA, 25 bp, Mus musculus
tatgtggtcagctacgagtcagcag

SEQ ID NO: 132286 - DNA, 25 bp, Mus musculus
tatgtggtcgcgaatgaaccgcgcg

SEQ ID NO: 132287 - DNA, 25 bp, Mus musculus
tatgtggttctcacaaggctggccc

SEQ ID NO: 132288 - DNA, 25 bp, Mus musculus
tatgtgtaaacccaaaaggagcttg

SEQ ID NO: 132289 - DNA, 25 bp, Mus musculus
tatgtgtacatgaaccagggtggcc

SEQ ID NO: 132290 - DNA, 25 bp, Mus musculus
tatgtgtacattaacgagctctgca

SEQ ID NO: 132291 - DNA, 25 bp, Mus musculus
tatgtgtacgctgaagagcccaaca

SEQ ID NO: 132292 - DNA, 25 bp, Mus musculus
tatgtgtagtgctctaagacccgcc

SEQ ID NO: 132293 - DNA, 25 bp, Mus musculus
tatgtgtattaaccagctatgtgta

SEQ ID NO: 132294 - DNA, 25 bp, Mus musculus
tatgtgtcacaaagatgtctacccg

SEQ ID NO: 132295 - DNA, 25 bp, Mus musculus
tatgtgtcaccagaggaccttgagg

SEQ ID NO: 132296 - DNA, 25 bp, Mus musculus
tatgtgtgcacaagtgactcacccc

SEQ ID NO: 132297 - DNA, 25 bp, Mus musculus
tatgtgtgggcaaagagctcctcgg

SEQ ID NO: 132298 - DNA, 25 bp, Mus musculus
tatgtgttacccaatatgcgaccgc

SEQ ID NO: 132299 - DNA, 25 bp, Mus musculus
tatgtgttgatagatcggacagcgg

SEQ ID NO: 132300 - DNA, 25 bp, Mus musculus
tatgtgttgtcctctcgggtacgca

SEQ ID NO: 132301 - DNA, 25 bp, Mus musculus
tatgtgttgtgcttgcctcgcacac

SEQ ID NO: 132302 - DNA, 25 bp, Mus musculus
tatgttaaaagcttctgttgtggat

SEQ ID NO: 132303 - DNA, 25 bp, Mus musculus
tatgttaaacattccacctccgggt

SEQ ID NO: 132304 - DNA, 25 bp, Mus musculus
tatgttaacaccaggcaaaagcggg

SEQ ID NO: 132305 - DNA, 25 bp, Mus musculus
tatgttaagactagctgccccaaac

SEQ ID NO: 132306 - DNA, 25 bp, Mus musculus
tatgttaagatctacctcctgcctg

SEQ ID NO: 132307 - DNA, 25 bp, Mus musculus
tatgttaattgatgaaagggtacgc

SEQ ID NO: 132308 - DNA, 25 bp, Mus musculus
tatgttagctctgctgcttgggaga

SEQ ID NO: 132309 - DNA, 25 bp, Mus musculus
tatgttagctgcctctccttctcac

SEQ ID NO: 132310 - DNA, 25 bp, Mus musculus
tatgttatctgccatccggtcctgg

SEQ ID NO: 132311 - DNA, 25 bp, Mus musculus
tatgttcagtgcaaggtgtacctac

SEQ ID NO: 132312 - DNA, 25 bp, Mus musculus
tatgttcatccgtgaatgccacaga

SEQ ID NO: 132313 - DNA, 25 bp, Mus musculus
tatgttccatgtcgagagttagggc

SEQ ID NO: 132314 - DNA, 25 bp, Mus musculus
tatgttccgaactgtggaggtcacg

SEQ ID NO: 132315 - DNA, 25 bp, Mus musculus
tatgttcctgtacctgaagatggcc

SEQ ID NO: 132316 - DNA, 25 bp, Mus musculus
tatgttcgagaaaatgggcagctac

SEQ ID NO: 132317 - DNA, 25 bp, Mus musculus
tatgttcgctattgggacctccgca

SEQ ID NO: 132318 - DNA, 25 bp, Mus musculus
tatgttctctaatcgcacatcccgg

SEQ ID NO: 132319 - DNA, 25 bp, Mus musculus
tatgttgaaaatccggcgtgaaggc

SEQ ID NO: 132320 - DNA, 25 bp, Mus musculus
tatgttgacatgagagccctgagac

SEQ ID NO: 132321 - DNA, 25 bp, Mus musculus
tatgttgcccagatagagtacacca

SEQ ID NO: 132322 - DNA, 25 bp, Mus musculus
tatgttgccctgaaattgattgctg

SEQ ID NO: 132323 - DNA, 25 bp, Mus musculus
tatgttggcttcatgggttgttcag

SEQ ID NO: 132324 - DNA, 25 bp, Mus musculus
tatgttgtacgctgaaagggccgag

SEQ ID NO: 132325 - DNA, 25 bp, Mus musculus
tatgttgtgtgagccctgcgtgaac

SEQ ID NO: 132326 - DNA, 25 bp, Mus musculus
tatgtttatggttacccaagcccac

SEQ ID NO: 132327 - DNA, 25 bp, Mus musculus
tatgtttatgttcaccgcctttcag

SEQ ID NO: 132328 - DNA, 25 bp, Mus musculus
tatgtttcaggttcacgttcagctc

SEQ ID NO: 132329 - DNA, 25 bp, Mus musculus
tatgtttggaaaacctccgccagga

SEQ ID NO: 132330 - DNA, 25 bp, Mus musculus
tatgtttttcacgtgcgagccagga

SEQ ID NO: 132331 - DNA, 25 bp, Mus musculus
tatgtttttgagctccctggtgacc

SEQ ID NO: 132332 - DNA, 25 bp, Mus musculus
tattaaaaactcatcccatggccgc

SEQ ID NO: 132333 - DNA, 25 bp, Mus musculus
tattaaacacgtgggcttccatgct

SEQ ID NO: 132334 - DNA, 25 bp, Mus musculus
tattaaagaggtctgtgcccattgc

SEQ ID NO: 132335 - DNA, 25 bp, Mus musculus
tattaaagctgcagttacaaccgga

SEQ ID NO: 132336 - DNA, 25 bp, Mus musculus
tattaaatgctgctagaaaaggctc

SEQ ID NO: 132337 - DNA, 25 bp, Mus musculus
tattaacaaagagaacgtccagcac

SEQ ID NO: 132338 - DNA, 25 bp, Mus musculus
tattaaccggcagatcacaaacgca

SEQ ID NO: 132339 - DNA, 25 bp, Mus musculus
tattaacctggacagcacgctggca

SEQ ID NO: 132340 - DNA, 25 bp, Mus musculus
tattaactctgcacatgaacgttgg

SEQ ID NO: 132341 - DNA, 25 bp, Mus musculus
tattaacttcccaaagaggaggagg

SEQ ID NO: 132342 - DNA, 25 bp, Mus musculus
tattaagaatgcctctcagtgcctg

SEQ ID NO: 132343 - DNA, 25 bp, Mus musculus
tattaagacatctctcaggaactcc

SEQ ID NO: 132344 - DNA, 25 bp, Mus musculus
tattaagatcgggaaccaagcggag

SEQ ID NO: 132345 - DNA, 25 bp, Mus musculus
tattaagcagggatcggcgacggaa

SEQ ID NO: 132346 - DNA, 25 bp, Mus musculus
tattaagcccaggtcgaaacgtgaa

SEQ ID NO: 132347 - DNA, 25 bp, Mus musculus
tattaagcccgggagtggctttggg

SEQ ID NO: 132348 - DNA, 25 bp, Mus musculus
tattaagcgaacagaaagccttggc

SEQ ID NO: 132349 - DNA, 25 bp, Mus musculus
tattaagcggttacaagtcgcccag

SEQ ID NO: 132350 - DNA, 25 bp, Mus musculus
tattaagctgcatagaagagtctct

SEQ ID NO: 132351 - DNA, 25 bp, Mus musculus
tattaaggaaggcaacgaagacatc

SEQ ID NO: 132352 - DNA, 25 bp, Mus musculus
tattaaggtacctgcggtcagctgg

SEQ ID NO: 132353 - DNA, 25 bp, Mus musculus
tattaagtacgtcagtcaccagcac

SEQ ID NO: 132354 - DNA, 25 bp, Mus musculus
tattaatataacctgtcctgctggc

SEQ ID NO: 132355 - DNA, 25 bp, Mus musculus
tattaatatcatcaccagccaggcg

SEQ ID NO: 132356 - DNA, 25 bp, Mus musculus
tattaatgagctcaagtcggaaatc

SEQ ID NO: 132357 - DNA, 25 bp, Mus musculus
tattaatgagtgtgagaccgggcag

SEQ ID NO: 132358 - DNA, 25 bp, Mus musculus
tattacaaaaggagaactttgacct

SEQ ID NO: 132359 - DNA, 25 bp, Mus musculus
tattacaacacagacgatgagcgag

SEQ ID NO: 132360 - DNA, 25 bp, Mus musculus
tattacacggagaatggtggaggcc

SEQ ID NO: 132361 - DNA, 25 bp, Mus musculus
tattacactgacctagaggccttcg

SEQ ID NO: 132362 - DNA, 25 bp, Mus musculus
tattacagaaactgaaaggtcctcc

SEQ ID NO: 132363 - DNA, 25 bp, Mus musculus
tattacaggagtaacacacagggcc

SEQ ID NO: 132364 - DNA, 25 bp, Mus musculus
tattacatgcgagatgtgaccgcca

SEQ ID NO: 132365 - DNA, 25 bp, Mus musculus
tattaccaagacaagactggcattc

SEQ ID NO: 132366 - DNA, 25 bp, Mus musculus
tattaccacagagccagactcggag

SEQ ID NO: 132367 - DNA, 25 bp, Mus musculus
tattaccagaatagagccctgagag

SEQ ID NO: 132368 - DNA, 25 bp, Mus musculus
tattaccagttcctagctgagaagg

SEQ ID NO: 132369 - DNA, 25 bp, Mus musculus
tattaccgcatggagacattggcca

SEQ ID NO: 132370 - DNA, 25 bp, Mus musculus
tattaccgttcctgctgaaacagca

SEQ ID NO: 132371 - DNA, 25 bp, Mus musculus
tattacctgactttcgggatgctgg

SEQ ID NO: 132372 - DNA, 25 bp, Mus musculus
tattacctgggctgcagacgcttcc

SEQ ID NO: 132373 - DNA, 25 bp, Mus musculus
tattacctgtacaaactgcttcctg

SEQ ID NO: 132374 - DNA, 25 bp, Mus musculus
tattacctttaaggaagaggagcca

SEQ ID NO: 132375 - DNA, 25 bp, Mus musculus
tattacgactaccatcgggaaggcg

SEQ ID NO: 132376 - DNA, 25 bp, Mus musculus
tattacgagactggctccatcagac

SEQ ID NO: 132377 - DNA, 25 bp, Mus musculus
tattacgaggagcaaaggaacgagt

SEQ ID NO: 132378 - DNA, 25 bp, Mus musculus
tattacgctgggaattcttgctgga

SEQ ID NO: 132379 - DNA, 25 bp, Mus musculus
tattacggaagtagctacaggatcg

SEQ ID NO: 132380 - DNA, 25 bp, Mus musculus
tattactacctgtcggtgaaggccc

SEQ ID NO: 132381 - DNA, 25 bp, Mus musculus
tattactcactgctgaacgtgcgca

SEQ ID NO: 132382 - DNA, 25 bp, Mus musculus
tattactcagcatccccttctgcag

SEQ ID NO: 132383 - DNA, 25 bp, Mus musculus
tattactccctggtcttgaaggtgc

SEQ ID NO: 132384 - DNA, 25 bp, Mus musculus
tattactctgggactgcgatgatcg

SEQ ID NO: 132385 - DNA, 25 bp, Mus musculus
tattactgcgggttctcaggagcca

SEQ ID NO: 132386 - DNA, 25 bp, Mus musculus
tattactggactcgaaagcacaaca

SEQ ID NO: 132387 - DNA, 25 bp, Mus musculus
tattacttaaggacgaggcctgccg

SEQ ID NO: 132388 - DNA, 25 bp, Mus musculus
tattacttagtcctctgacgcagga

SEQ ID NO: 132389 - DNA, 25 bp, Mus musculus
tattacttctcaaagggcgccctga

SEQ ID NO: 132390 - DNA, 25 bp, Mus musculus
tattagaagaagcaaaccgaggctc

SEQ ID NO: 132391 - DNA, 25 bp, Mus musculus
tattagagagaaatcttagtaactg

SEQ ID NO: 132392 - DNA, 25 bp, Mus musculus
tattagatagcatagcatccttcct

SEQ ID NO: 132393 - DNA, 25 bp, Mus musculus
tattagcaatggactggcgactaca

SEQ ID NO: 132394 - DNA, 25 bp, Mus musculus
tattagcacaaatacactgactggg

SEQ ID NO: 132395 - DNA, 25 bp, Mus musculus
tattagcatgggtgttatcccgacc

SEQ ID NO: 132396 - DNA, 25 bp, Mus musculus
tattagccaaaggtaccagtggctc

SEQ ID NO: 132397 - DNA, 25 bp, Mus musculus
tattagcctaccttcagcggattgc

SEQ ID NO: 132398 - DNA, 25 bp, Mus musculus
tattagcgaaccttagacacggtgg

SEQ ID NO: 132399 - DNA, 25 bp, Mus musculus
tattagcggccctccatgttgggca

SEQ ID NO: 132400 - DNA, 25 bp, Mus musculus
tattagctgcttggtgccttccaag

SEQ ID NO: 132401 - DNA, 25 bp, Mus musculus
tattagctgttcttactatgaaaag

SEQ ID NO: 132402 - DNA, 25 bp, Mus musculus
tattaggaagccctgagccactagc

SEQ ID NO: 132403 - DNA, 25 bp, Mus musculus
tattaggagagatctgaaagcagcg

SEQ ID NO: 132404 - DNA, 25 bp, Mus musculus
tattaggcgctgagagtgaggcctt

SEQ ID NO: 132405 - DNA, 25 bp, Mus musculus
tattagggaccttgcagtttgcaca

SEQ ID NO: 132406 - DNA, 25 bp, Mus musculus
tattagggcttcattctatccgggc

SEQ ID NO: 132407 - DNA, 25 bp, Mus musculus
tattaggtccgcctgcctcagggaa

SEQ ID NO: 132408 - DNA, 25 bp, Mus musculus
tattagtacataccaaactctgggc

SEQ ID NO: 132409 - DNA, 25 bp, Mus musculus
tattagtcagcgaatgagggtcccg

SEQ ID NO: 132410 - DNA, 25 bp, Mus musculus
tattagtcgggaacctcaactgtgc

SEQ ID NO: 132411 - DNA, 25 bp, Mus musculus
tattagttctgattcatccccgagg

SEQ ID NO: 132412 - DNA, 25 bp, Mus musculus
tattatacatcgctctaccagggcc

SEQ ID NO: 132413 - DNA, 25 bp, Mus musculus
tattatacatgagaggttgcccctt

SEQ ID NO: 132414 - DNA, 25 bp, Mus musculus
tattatatgtatttatgcgggtggc

SEQ ID NO: 132415 - DNA, 25 bp, Mus musculus
tattatcaaagcaactacgtgttcg

SEQ ID NO: 132416 - DNA, 25 bp, Mus musculus
tattatcaaagccagcaagcctccg

SEQ ID NO: 132417 - DNA, 25 bp, Mus musculus
tattatgacaaggatactaccagac

SEQ ID NO: 132418 - DNA, 25 bp, Mus musculus
tattatgacactgaacgcattggag

SEQ ID NO: 132419 - DNA, 25 bp, Mus musculus
tattatgacatacctggcccagcca

SEQ ID NO: 132420 - DNA, 25 bp, Mus musculus
tattatgagaaagacaacgtggact

SEQ ID NO: 132421 - DNA, 25 bp, Mus musculus
tattatgagaagcacgtggcattcc

SEQ ID NO: 132422 - DNA, 25 bp, Mus musculus
tattatgatccaaaaaccagagcga

SEQ ID NO: 132423 - DNA, 25 bp, Mus musculus
tattatgcacccaccaaggagcaca

SEQ ID NO: 132424 - DNA, 25 bp, Mus musculus
tattatgctaccaaagggaggctgg

SEQ ID NO: 132425 - DNA, 25 bp, Mus musculus
tattatggcacaggcgaaacgtttc

SEQ ID NO: 132426 - DNA, 25 bp, Mus musculus
tattatgggctggatacaaaatggg

SEQ ID NO: 132427 - DNA, 25 bp, Mus musculus
tattatgtacacaggaaaagggcca

SEQ ID NO: 132428 - DNA, 25 bp, Mus musculus
tattattaccagagggccctgggca

SEQ ID NO: 132429 - DNA, 25 bp, Mus musculus
tattattactccatgcagttctggc

SEQ ID NO: 132430 - DNA, 25 bp, Mus musculus
tattattaggcatacaagtggctcc

SEQ ID NO: 132431 - DNA, 25 bp, Mus musculus
tattattagtgctgctcctccaggg

SEQ ID NO: 132432 - DNA, 25 bp, Mus musculus
tattattgtgccaagtttctgcaaa

SEQ ID NO: 132433 - DNA, 25 bp, Mus musculus
tattatttctagaccagggcatcgc

SEQ ID NO: 132434 - DNA, 25 bp, Mus musculus
tattattttgcctactgttcacgag

SEQ ID NO: 132435 - DNA, 25 bp, Mus musculus
tattcaacagaacataagggcagac

SEQ ID NO: 132436 - DNA, 25 bp, Mus musculus
tattcaaccagcatcttcgagtcgg

SEQ ID NO: 132437 - DNA, 25 bp, Mus musculus
tattcaacctgtaccctcgaaaggg

SEQ ID NO: 132438 - DNA, 25 bp, Mus musculus
tattcaagcaagatacggtctcctg

SEQ ID NO: 132439 - DNA, 25 bp, Mus musculus
tattcaaggacacatgggagcgcac

SEQ ID NO: 132440 - DNA, 25 bp, Mus musculus
tattcaaggatgaagccacggatgg

SEQ ID NO: 132441 - DNA, 25 bp, Mus musculus
tattcaaggtgtggttagaaaagcc

SEQ ID NO: 132442 - DNA, 25 bp, Mus musculus
tattcaagtggagatcacaccaacc

SEQ ID NO: 132443 - DNA, 25 bp, Mus musculus
tattcaatacccgagaaggacgtgc

SEQ ID NO: 132444 - DNA, 25 bp, Mus musculus
tattcaataggcagaagaccagatt

SEQ ID NO: 132445 - DNA, 25 bp, Mus musculus
tattcaatcactgtagcgttctggc

SEQ ID NO: 132446 - DNA, 25 bp, Mus musculus
tattcacacccgtgcctatgtgggc

SEQ ID NO: 132447 - DNA, 25 bp, Mus musculus
tattcacatgggtcaaataggctgc

SEQ ID NO: 132448 - DNA, 25 bp, Mus musculus
tattcaccgaatccctcgtgggcgg

SEQ ID NO: 132449 - DNA, 25 bp, Mus musculus
tattcacgatcggtatgaccaccag

SEQ ID NO: 132450 - DNA, 25 bp, Mus musculus
tattcacgtgaacaacctccactgg

SEQ ID NO: 132451 - DNA, 25 bp, Mus musculus
tattcactggtgctgagcggtgccc

SEQ ID NO: 132452 - DNA, 25 bp, Mus musculus
tattcactgttgacctgggagaagc

SEQ ID NO: 132453 - DNA, 25 bp, Mus musculus
tattcagaaaatagccctgggccta

SEQ ID NO: 132454 - DNA, 25 bp, Mus musculus
tattcagaacagaagccctaagcct

SEQ ID NO: 132455 - DNA, 25 bp, Mus musculus
tattcagaagctggcgggtgtcacc

SEQ ID NO: 132456 - DNA, 25 bp, Mus musculus
tattcagacatatgtgcttggtgcc

SEQ ID NO: 132457 - DNA, 25 bp, Mus musculus
tattcagacgcattgcccggcagta

SEQ ID NO: 132458 - DNA, 25 bp, Mus musculus
tattcagagctctgccgtgggcacg

SEQ ID NO: 132459 - DNA, 25 bp, Mus musculus
tattcagatgtctccagggttcagg

SEQ ID NO: 132460 - DNA, 25 bp, Mus musculus
tattcagcaaagagctattatccct

SEQ ID NO: 132461 - DNA, 25 bp, Mus musculus
tattcagcacaagaggaaaccatgc

SEQ ID NO: 132462 - DNA, 25 bp, Mus musculus
tattcagcacagatatttctccaga

SEQ ID NO: 132463 - DNA, 25 bp, Mus musculus
tattcagcgaagatggtgtcactct

SEQ ID NO: 132464 - DNA, 25 bp, Mus musculus
tattcagcgggtggatgctccatca

SEQ ID NO: 132465 - DNA, 25 bp, Mus musculus
tattcagctgcgtgtgacagatgac

SEQ ID NO: 132466 - DNA, 25 bp, Mus musculus
tattcaggctcactacaagagtgcc

SEQ ID NO: 132467 - DNA, 25 bp, Mus musculus
tattcaggctgttcacaatggcacc

SEQ ID NO: 132468 - DNA, 25 bp, Mus musculus
tattcagggaggatgtgacctttga

SEQ ID NO: 132469 - DNA, 25 bp, Mus musculus
tattcagtcggctcgaacccgtgac

SEQ ID NO: 132470 - DNA, 25 bp, Mus musculus
tattcagtctcaccctggatctgag

SEQ ID NO: 132471 - DNA, 25 bp, Mus musculus
tattcagtgggtaggttatagggcc

SEQ ID NO: 132472 - DNA, 25 bp, Mus musculus
tattcatcaatacagggaggcttgg

SEQ ID NO: 132473 - DNA, 25 bp, Mus musculus
tattcatcctggtgggtgactcaaa

SEQ ID NO: 132474 - DNA, 25 bp, Mus musculus
tattcatgaaaaggagatgcagctg

SEQ ID NO: 132475 - DNA, 25 bp, Mus musculus
tattcatgaccgtatcaagagggag

SEQ ID NO: 132476 - DNA, 25 bp, Mus musculus
tattcatgacgtgtgtgacgacggc

SEQ ID NO: 132477 - DNA, 25 bp, Mus musculus
tattcatgcccctgaagagcgtggg

SEQ ID NO: 132478 - DNA, 25 bp, Mus musculus
tattcatggtttgtacacggacccc

SEQ ID NO: 132479 - DNA, 25 bp, Mus musculus
tattccaaagtgcaaggtcctcaga

SEQ ID NO: 132480 - DNA, 25 bp, Mus musculus
tattccaacaactaaacggacaggc

SEQ ID NO: 132481 - DNA, 25 bp, Mus musculus
tattccaacgatggagaatggcccc

SEQ ID NO: 132482 - DNA, 25 bp, Mus musculus
tattccaagaagaggctccgctacg

SEQ ID NO: 132483 - DNA, 25 bp, Mus musculus
tattccaagagctggccgacaagtg

SEQ ID NO: 132484 - DNA, 25 bp, Mus musculus
tattccaatggatcaaagggcagag

SEQ ID NO: 132485 - DNA, 25 bp, Mus musculus
tattccaccgaactgaagaagctgt

SEQ ID NO: 132486 - DNA, 25 bp, Mus musculus
tattccactgggatagaagcggcag

SEQ ID NO: 132487 - DNA, 25 bp, Mus musculus
tattccagaagcattcactgagggc

SEQ ID NO: 132488 - DNA, 25 bp, Mus musculus
tattccagataggtcagcgcaccag

SEQ ID NO: 132489 - DNA, 25 bp, Mus musculus
tattccagatctccaatgtcacagg

SEQ ID NO: 132490 - DNA, 25 bp, Mus musculus
tattccagcagaaacaggcagttcc

SEQ ID NO: 132491 - DNA, 25 bp, Mus musculus
tattccaggtgttaaaggtgatcgg

SEQ ID NO: 132492 - DNA, 25 bp, Mus musculus
tattccagtaaggaccaagctagac

SEQ ID NO: 132493 - DNA, 25 bp, Mus musculus
tattccatagaagatagcagtccac

SEQ ID NO: 132494 - DNA, 25 bp, Mus musculus
tattccatgaacaccaagacaatgg

SEQ ID NO: 132495 - DNA, 25 bp, Mus musculus
tattccatgagttcaactaagccag

SEQ ID NO: 132496 - DNA, 25 bp, Mus musculus
tattcccaatattaagcagagtgct

SEQ ID NO: 132497 - DNA, 25 bp, Mus musculus
tattcccaatgagccagtggcagcc

SEQ ID NO: 132498 - DNA, 25 bp, Mus musculus
tattcccaatgtgatcgtaccagcc

SEQ ID NO: 132499 - DNA, 25 bp, Mus musculus
tattcccacggacatctatgagggc

SEQ ID NO: 132500 - DNA, 25 bp, Mus musculus
tattccctaatggagaaggatgccc

SEQ ID NO: 132501 - DNA, 25 bp, Mus musculus
tattccgaactcagcgcattgacct

SEQ ID NO: 132502 - DNA, 25 bp, Mus musculus
tattccgatggaagacgattgacgc

SEQ ID NO: 132503 - DNA, 25 bp, Mus musculus
tattccggagaggagagaaactgcg

SEQ ID NO: 132504 - DNA, 25 bp, Mus musculus
tattccgtgtgctgcggaagcccca

SEQ ID NO: 132505 - DNA, 25 bp, Mus musculus
tattccgttattcccatggctgtgg

SEQ ID NO: 132506 - DNA, 25 bp, Mus musculus
tattcctacgaacttcgagggctgg

SEQ ID NO: 132507 - DNA, 25 bp, Mus musculus
tattcctatgactaggcctcctgtg

SEQ ID NO: 132508 - DNA, 25 bp, Mus musculus
tattcctcgatagaagccctgctga

SEQ ID NO: 132509 - DNA, 25 bp, Mus musculus
tattcctggcagtgatgctgtaccg

SEQ ID NO: 132510 - DNA, 25 bp, Mus musculus
tattccttaaggaggtacacaggga

SEQ ID NO: 132511 - DNA, 25 bp, Mus musculus
tattccttaccgtcaaagaagctag

SEQ ID NO: 132512 - DNA, 25 bp, Mus musculus
tattccttccaaagttgagcgggac

SEQ ID NO: 132513 - DNA, 25 bp, Mus musculus
tattccttggaaagttcgctagagc

SEQ ID NO: 132514 - DNA, 25 bp, Mus musculus
tattcgaatacttggaccggactcc

SEQ ID NO: 132515 - DNA, 25 bp, Mus musculus
tattcgagctgaacgggaagaactc

SEQ ID NO: 132516 - DNA, 25 bp, Mus musculus
tattcgatgacgctcaactgcagat

SEQ ID NO: 132517 - DNA, 25 bp, Mus musculus
tattcgatgcctggatacacgtgca

SEQ ID NO: 132518 - DNA, 25 bp, Mus musculus
tattcgcagggatcgcatcaggatg

SEQ ID NO: 132519 - DNA, 25 bp, Mus musculus
tattcgccgtgcactgagagactac

SEQ ID NO: 132520 - DNA, 25 bp, Mus musculus
tattcgctctacgtccacgggtgca

SEQ ID NO: 132521 - DNA, 25 bp, Mus musculus
tattcggacactttggagagcacac

SEQ ID NO: 132522 - DNA, 25 bp, Mus musculus
tattcggagaagcagtctacctagc

SEQ ID NO: 132523 - DNA, 25 bp, Mus musculus
tattcggatagagacacaactgagg

SEQ ID NO: 132524 - DNA, 25 bp, Mus musculus
tattcggatgcagaaggaggcatgc

SEQ ID NO: 132525 - DNA, 25 bp, Mus musculus
tattcggcaccaacgtgatggtgac

SEQ ID NO: 132526 - DNA, 25 bp, Mus musculus
tattcgggatgagcaccaacaggct

SEQ ID NO: 132527 - DNA, 25 bp, Mus musculus
tattcggggcggtagccgcctcgct

SEQ ID NO: 132528 - DNA, 25 bp, Mus musculus
tattcggttcaacgctgaggcaggc

SEQ ID NO: 132529 - DNA, 25 bp, Mus musculus
tattcgtacaacaattgggctgcca

SEQ ID NO: 132530 - DNA, 25 bp, Mus musculus
tattcgtactactgagacccatgtg

SEQ ID NO: 132531 - DNA, 25 bp, Mus musculus
tattcgtcaaggtcactgcgttccc

SEQ ID NO: 132532 - DNA, 25 bp, Mus musculus
tattcgtccccgagaatggcaaggg

SEQ ID NO: 132533 - DNA, 25 bp, Mus musculus
tattcgtcggaaacaaaacagcggc

SEQ ID NO: 132534 - DNA, 25 bp, Mus musculus
tattcgtgaagcaaatgaggaccag

SEQ ID NO: 132535 - DNA, 25 bp, Mus musculus
tattctacacgtcaacagcaagggc

SEQ ID NO: 132536 - DNA, 25 bp, Mus musculus
tattctacagatggcagcacatcgg

SEQ ID NO: 132537 - DNA, 25 bp, Mus musculus
tattctacatagttcctggcttgct

SEQ ID NO: 132538 - DNA, 25 bp, Mus musculus
tattctacatggacattgcacgggc

SEQ ID NO: 132539 - DNA, 25 bp, Mus musculus
tattctaccagaagggtgacccgta

SEQ ID NO: 132540 - DNA, 25 bp, Mus musculus
tattctacccagtggcgaggaagac

SEQ ID NO: 132541 - DNA, 25 bp, Mus musculus
tattctacccatgagaaaggaaatt

SEQ ID NO: 132542 - DNA, 25 bp, Mus musculus
tattctacctaccttgaggcactgg

SEQ ID NO: 132543 - DNA, 25 bp, Mus musculus
tattctacttaaaataagaagagca

SEQ ID NO: 132544 - DNA, 25 bp, Mus musculus
tattctagacgcaggcttccaagtg

SEQ ID NO: 132545 - DNA, 25 bp, Mus musculus
tattctagacggactgcacgaggac

SEQ ID NO: 132546 - DNA, 25 bp, Mus musculus
tattctagagaatgtcccgagtgcc

SEQ ID NO: 132547 - DNA, 25 bp, Mus musculus
tattctatcaccaagagagcgcaca

SEQ ID NO: 132548 - DNA, 25 bp, Mus musculus
tattctcaaacatgacagagcgttc

SEQ ID NO: 132549 - DNA, 25 bp, Mus musculus
tattctcagagccagctggtgtgct

SEQ ID NO: 132550 - DNA, 25 bp, Mus musculus
tattctcagattagtcacgcgcaag

SEQ ID NO: 132551 - DNA, 25 bp, Mus musculus
tattctccaagcagctatcacaggc

SEQ ID NO: 132552 - DNA, 25 bp, Mus musculus
tattctccagcgctcttctgaagag

SEQ ID NO: 132553 - DNA, 25 bp, Mus musculus
tattctccaggacgttccacgtttg

SEQ ID NO: 132554 - DNA, 25 bp, Mus musculus
tattctccctattatgacacagcca

SEQ ID NO: 132555 - DNA, 25 bp, Mus musculus
tattctccggacagtggtcaacacc

SEQ ID NO: 132556 - DNA, 25 bp, Mus musculus
tattctcctgggtcagattggctgc

SEQ ID NO: 132557 - DNA, 25 bp, Mus musculus
tattctcgagaggaagagctactca

SEQ ID NO: 132558 - DNA, 25 bp, Mus musculus
tattctcgaggttgtccagactggg

SEQ ID NO: 132559 - DNA, 25 bp, Mus musculus
tattctcgctgtggtcacgaggccg

SEQ ID NO: 132560 - DNA, 25 bp, Mus musculus
tattctctattctccggaaggtggc

SEQ ID NO: 132561 - DNA, 25 bp, Mus musculus
tattctctctatgtgtgtcccgagg

SEQ ID NO: 132562 - DNA, 25 bp, Mus musculus
tattctcttgaacatggcggcctgg

SEQ ID NO: 132563 - DNA, 25 bp, Mus musculus
tattctgaggaagccaaccgcattg

SEQ ID NO: 132564 - DNA, 25 bp, Mus musculus
tattctgcgctgaagaaggatgggc

SEQ ID NO: 132565 - DNA, 25 bp, Mus musculus
tattctggagtgcatgctgaacaca

SEQ ID NO: 132566 - DNA, 25 bp, Mus musculus
tattctgggaaaacaagttatggga

SEQ ID NO: 132567 - DNA, 25 bp, Mus musculus
tattctggtcaatgtatccctcggg

SEQ ID NO: 132568 - DNA, 25 bp, Mus musculus
tattctgtacctgagatcctgcgcg

SEQ ID NO: 132569 - DNA, 25 bp, Mus musculus
tattctgtcaatcactgccgggctc

SEQ ID NO: 132570 - DNA, 25 bp, Mus musculus
tattctgtggaaggacgtgtatctc

SEQ ID NO: 132571 - DNA, 25 bp, Mus musculus
tattctgtggagacgccctatggct

SEQ ID NO: 132572 - DNA, 25 bp, Mus musculus
tattctgtggcttcatcctctggac

SEQ ID NO: 132573 - DNA, 25 bp, Mus musculus
tattctgtgtaacttctcttctgga

SEQ ID NO: 132574 - DNA, 25 bp, Mus musculus
tattctgtttgtactgaaccaaaac

SEQ ID NO: 132575 - DNA, 25 bp, Mus musculus
tattcttaggattggacaatgcggg

SEQ ID NO: 132576 - DNA, 25 bp, Mus musculus
tattcttgccctggaacggcgactg

SEQ ID NO: 132577 - DNA, 25 bp, Mus musculus
tattcttgtggtttgtggcccggaa

SEQ ID NO: 132578 - DNA, 25 bp, Mus musculus
tattctttagatcctaagtgcgagt

SEQ ID NO: 132579 - DNA, 25 bp, Mus musculus
tattctttcaggatggcccatttga

SEQ ID NO: 132580 - DNA, 25 bp, Mus musculus
tattctttgatgaccccaaggacca

SEQ ID NO: 132581 - DNA, 25 bp, Mus musculus
tattgaaaaacgagacaccctggcc

SEQ ID NO: 132582 - DNA, 25 bp, Mus musculus
tattgaaagggtccagtccaactgc

SEQ ID NO: 132583 - DNA, 25 bp, Mus musculus
tattgaaagtctgatgccgattgtg

SEQ ID NO: 132584 - DNA, 25 bp, Mus musculus
tattgaaagtggctcgctatgctgc

SEQ ID NO: 132585 - DNA, 25 bp, Mus musculus
tattgaacaaagtaccaagggtggc

SEQ ID NO: 132586 - DNA, 25 bp, Mus musculus
tattgaacaagaaaccactgtgtgg

SEQ ID NO: 132587 - DNA, 25 bp, Mus musculus
tattgaactcaatgtaggtggccag

SEQ ID NO: 132588 - DNA, 25 bp, Mus musculus
tattgaagaccatcagttccaggcc

SEQ ID NO: 132589 - DNA, 25 bp, Mus musculus
tattgaagagaatgcccctctccgg

SEQ ID NO: 132590 - DNA, 25 bp, Mus musculus
tattgaagagctgccgaagactgtc

SEQ ID NO: 132591 - DNA, 25 bp, Mus musculus
tattgaaggacactccaagtgctcc

SEQ ID NO: 132592 - DNA, 25 bp, Mus musculus
tattgaaggctccacagtgcaagaa

SEQ ID NO: 132593 - DNA, 25 bp, Mus musculus
tattgaaggtccctggctccattgc

SEQ ID NO: 132594 - DNA, 25 bp, Mus musculus
tattgaagtccttgcaggcagcgct

SEQ ID NO: 132595 - DNA, 25 bp, Mus musculus
tattgaagtggtgaccctccagagc

SEQ ID NO: 132596 - DNA, 25 bp, Mus musculus
tattgaatcactggacagctacaca

SEQ ID NO: 132597 - DNA, 25 bp, Mus musculus
tattgaatccccaaactaccctggg

SEQ ID NO: 132598 - DNA, 25 bp, Mus musculus
tattgaatggaatctaacagcagca

SEQ ID NO: 132599 - DNA, 25 bp, Mus musculus
tattgaatggcggtcgcagatcctt

SEQ ID NO: 132600 - DNA, 25 bp, Mus musculus
tattgaattctcacagccccatcgg

SEQ ID NO: 132601 - DNA, 25 bp, Mus musculus
tattgacaaagagccatccactggt

SEQ ID NO: 132602 - DNA, 25 bp, Mus musculus
tattgacaccgtgattttgttgggc

SEQ ID NO: 132603 - DNA, 25 bp, Mus musculus
tattgacagcacctggagccagaca

SEQ ID NO: 132604 - DNA, 25 bp, Mus musculus
tattgacatggcacccttgcaggca

SEQ ID NO: 132605 - DNA, 25 bp, Mus musculus
tattgacatggccaccaagaaaagc

SEQ ID NO: 132606 - DNA, 25 bp, Mus musculus
tattgacattttcgtctcaacgctc

SEQ ID NO: 132607 - DNA, 25 bp, Mus musculus
tattgaccacgatggaaagctggac

SEQ ID NO: 132608 - DNA, 25 bp, Mus musculus
tattgacccggtggacaccaggctg

SEQ ID NO: 132609 - DNA, 25 bp, Mus musculus
tattgaccttctgtactggcgggac

SEQ ID NO: 132610 - DNA, 25 bp, Mus musculus
tattgacgagtactgcgtgcagcag

SEQ ID NO: 132611 - DNA, 25 bp, Mus musculus
tattgacgcaatactctttcttcta

SEQ ID NO: 132612 - DNA, 25 bp, Mus musculus
tattgactttcagatggcattgcca

SEQ ID NO: 132613 - DNA, 25 bp, Mus musculus
tattgagaacagtcagtacccagca

SEQ ID NO: 132614 - DNA, 25 bp, Mus musculus
tattgagaagctctgcaaaactgag

SEQ ID NO: 132615 - DNA, 25 bp, Mus musculus
tattgagacagcctagggtacacag

SEQ ID NO: 132616 - DNA, 25 bp, Mus musculus
tattgagatccacagcaagcgcatc

SEQ ID NO: 132617 - DNA, 25 bp, Mus musculus
tattgagccccattgagaaaacctg

SEQ ID NO: 132618 - DNA, 25 bp, Mus musculus
tattgagccccttttagaacccgag

SEQ ID NO: 132619 - DNA, 25 bp, Mus musculus
tattgagcctgtttgcacacactca

SEQ ID NO: 132620 - DNA, 25 bp, Mus musculus
tattgagctacttctgcgttacgga

SEQ ID NO: 132621 - DNA, 25 bp, Mus musculus
tattgagggcagctataaaggacct

SEQ ID NO: 132622 - DNA, 25 bp, Mus musculus
tattgagggtctaaccccagaagaa

SEQ ID NO: 132623 - DNA, 25 bp, Mus musculus
tattgaggttcctcagtgctgaact

SEQ ID NO: 132624 - DNA, 25 bp, Mus musculus
tattgagtcgcgtacagaagggcgc

SEQ ID NO: 132625 - DNA, 25 bp, Mus musculus
tattgagtgagatgcagaagtcccc

SEQ ID NO: 132626 - DNA, 25 bp, Mus musculus
tattgagtgcagcacttgtctggcc

SEQ ID NO: 132627 - DNA, 25 bp, Mus musculus
tattgagtgcggtaggatgacccac

SEQ ID NO: 132628 - DNA, 25 bp, Mus musculus
tattgatagcagaggcggacaacct

SEQ ID NO: 132629 - DNA, 25 bp, Mus musculus
tattgatagttggtgccgaagggac

SEQ ID NO: 132630 - DNA, 25 bp, Mus musculus
tattgatattgaagccatgcttgag

SEQ ID NO: 132631 - DNA, 25 bp, Mus musculus
tattgatcgagatgagaacatccca

SEQ ID NO: 132632 - DNA, 25 bp, Mus musculus
tattgatgaggatgggaagagccac

SEQ ID NO: 132633 - DNA, 25 bp, Mus musculus
tattgatgcaggctcgagagcagct

SEQ ID NO: 132634 - DNA, 25 bp, Mus musculus
tattgatggaaatctggtcagcgga

SEQ ID NO: 132635 - DNA, 25 bp, Mus musculus
tattgatgggaagcctcgtgtacct

SEQ ID NO: 132636 - DNA, 25 bp, Mus musculus
tattgattacacagtccatgaagcc

SEQ ID NO: 132637 - DNA, 25 bp, Mus musculus
tattgattagcagtgccgtcacctc

SEQ ID NO: 132638 - DNA, 25 bp, Mus musculus
tattgattgtccttttaatacccaa

SEQ ID NO: 132639 - DNA, 25 bp, Mus musculus
tattgcaaacagcagagttccggac

SEQ ID NO: 132640 - DNA, 25 bp, Mus musculus
tattgcaaatggtactctggacagc

SEQ ID NO: 132641 - DNA, 25 bp, Mus musculus
tattgcaccaaatatgagccctggc

SEQ ID NO: 132642 - DNA, 25 bp, Mus musculus
tattgcactaggacgatggctggaa

SEQ ID NO: 132643 - DNA, 25 bp, Mus musculus
tattgcactgtgtaccgaggagacg

SEQ ID NO: 132644 - DNA, 25 bp, Mus musculus
tattgcagcagtcatgaagaagggc

SEQ ID NO: 132645 - DNA, 25 bp, Mus musculus
tattgcagcatgtacggcaagccgg

SEQ ID NO: 132646 - DNA, 25 bp, Mus musculus
tattgcagccagaattgtgctcggc

SEQ ID NO: 132647 - DNA, 25 bp, Mus musculus
tattgcagctgggtacggtgctact

SEQ ID NO: 132648 - DNA, 25 bp, Mus musculus
tattgcagttagctatgaagcccga

SEQ ID NO: 132649 - DNA, 25 bp, Mus musculus
tattgcatcaggactcataggacct

SEQ ID NO: 132650 - DNA, 25 bp, Mus musculus
tattgccaaggatcatgggctggac

SEQ ID NO: 132651 - DNA, 25 bp, Mus musculus
tattgccacagtcgtgatcggccag

SEQ ID NO: 132652 - DNA, 25 bp, Mus musculus
tattgccaccaaaaacggattgttc

SEQ ID NO: 132653 - DNA, 25 bp, Mus musculus
tattgccaggacaccaagactacga

SEQ ID NO: 132654 - DNA, 25 bp, Mus musculus
tattgccctgggtcctggtaattcc

SEQ ID NO: 132655 - DNA, 25 bp, Mus musculus
tattgccgacgaggttaccagctca

SEQ ID NO: 132656 - DNA, 25 bp, Mus musculus
tattgcgaatactgacccctagctt

SEQ ID NO: 132657 - DNA, 25 bp, Mus musculus
tattgcgacacacagctacgcgtgg

SEQ ID NO: 132658 - DNA, 25 bp, Mus musculus
tattgcgagcgagtacgagacctct

SEQ ID NO: 132659 - DNA, 25 bp, Mus musculus
tattgcgccgccattaaaagcagcc

SEQ ID NO: 132660 - DNA, 25 bp, Mus musculus
tattgcgctatagcctggcggacga

SEQ ID NO: 132661 - DNA, 25 bp, Mus musculus
tattgcggatcacagtccaccatgg

SEQ ID NO: 132662 - DNA, 25 bp, Mus musculus
tattgcgggcacatcagaattgggt

SEQ ID NO: 132663 - DNA, 25 bp, Mus musculus
tattgctaattgtggctggcgtggc

SEQ ID NO: 132664 - DNA, 25 bp, Mus musculus
tattgctattggagaggtgccggca

SEQ ID NO: 132665 - DNA, 25 bp, Mus musculus
tattgctccaaaccacagagtaggc

SEQ ID NO: 132666 - DNA, 25 bp, Mus musculus
tattgctcccatgcaacagggttgc

SEQ ID NO: 132667 - DNA, 25 bp, Mus musculus
tattgctcggctttgtggaccatgc

SEQ ID NO: 132668 - DNA, 25 bp, Mus musculus
tattgctctgggtgacgactcctca

SEQ ID NO: 132669 - DNA, 25 bp, Mus musculus
tattgctgaccaactgagaccacca

SEQ ID NO: 132670 - DNA, 25 bp, Mus musculus
tattgctgctccagagctagagacc

SEQ ID NO: 132671 - DNA, 25 bp, Mus musculus
tattgctggcaagctccaggaatct

SEQ ID NO: 132672 - DNA, 25 bp, Mus musculus
tattgctgtccggaacatcctggtg

SEQ ID NO: 132673 - DNA, 25 bp, Mus musculus
tattgctgtggatcggtacctccga

SEQ ID NO: 132674 - DNA, 25 bp, Mus musculus
tattgcttctatgtctacggtgcca

SEQ ID NO: 132675 - DNA, 25 bp, Mus musculus
tattgcttgcgctgtctagtgggcc

SEQ ID NO: 132676 - DNA, 25 bp, Mus musculus
tattggaaagcttcagctgcgcacc

SEQ ID NO: 132677 - DNA, 25 bp, Mus musculus
tattggaacacatccgcaagaagcg

SEQ ID NO: 132678 - DNA, 25 bp, Mus musculus
tattggaactcacgacttggacact

SEQ ID NO: 132679 - DNA, 25 bp, Mus musculus
tattggaagactgggaagactccgt

SEQ ID NO: 132680 - DNA, 25 bp, Mus musculus
tattggaagcaattgcagtggttgc

SEQ ID NO: 132681 - DNA, 25 bp, Mus musculus
tattggaaggatcaccaagcgcctg

SEQ ID NO: 132682 - DNA, 25 bp, Mus musculus
tattggaaggcgtactggcaaagtt

SEQ ID NO: 132683 - DNA, 25 bp, Mus musculus
tattggacacagctgcagatagctt

SEQ ID NO: 132684 - DNA, 25 bp, Mus musculus
tattggacgactgtgccttgaccag

SEQ ID NO: 132685 - DNA, 25 bp, Mus musculus
tattggagcagtgttgggatttccc

SEQ ID NO: 132686 - DNA, 25 bp, Mus musculus
tattggagctactaacaggccagac

SEQ ID NO: 132687 - DNA, 25 bp, Mus musculus
tattggagtcgtgggcctcttcact

SEQ ID NO: 132688 - DNA, 25 bp, Mus musculus
tattggataaaatgagatgcttgcg

SEQ ID NO: 132689 - DNA, 25 bp, Mus musculus
tattggatccatccccagaggcagc

SEQ ID NO: 132690 - DNA, 25 bp, Mus musculus
tattggatgtacaacgggagagccg

SEQ ID NO: 132691 - DNA, 25 bp, Mus musculus
tattggcaagtaaaggcagcagcaa

SEQ ID NO: 132692 - DNA, 25 bp, Mus musculus
tattggcaccaacaacgtatttgaa

SEQ ID NO: 132693 - DNA, 25 bp, Mus musculus
tattggcagccaaggaatgtgtcca

SEQ ID NO: 132694 - DNA, 25 bp, Mus musculus
tattggcaggtttacacgggaagac

SEQ ID NO: 132695 - DNA, 25 bp, Mus musculus
tattggccaagctattgcgacatga

SEQ ID NO: 132696 - DNA, 25 bp, Mus musculus
tattggccacaagaggcaggtgagc

SEQ ID NO: 132697 - DNA, 25 bp, Mus musculus
tattggccacgtggttcgcgcagtg

SEQ ID NO: 132698 - DNA, 25 bp, Mus musculus
tattggccaggattcaagcacagct

SEQ ID NO: 132699 - DNA, 25 bp, Mus musculus
tattggccatatttatatgggcctg

SEQ ID NO: 132700 - DNA, 25 bp, Mus musculus
tattggcccactcaaatgtgctccg

SEQ ID NO: 132701 - DNA, 25 bp, Mus musculus
tattggccggaagctgacggtgtca

SEQ ID NO: 132702 - DNA, 25 bp, Mus musculus
tattggccgtgtgtcatcctctcag

SEQ ID NO: 132703 - DNA, 25 bp, Mus musculus
tattggctacaaggaacggcctcag

SEQ ID NO: 132704 - DNA, 25 bp, Mus musculus
tattggctcaggatccctagggccc

SEQ ID NO: 132705 - DNA, 25 bp, Mus musculus
tattggcttataggcatgaaacccc

SEQ ID NO: 132706 - DNA, 25 bp, Mus musculus
tattgggaaagctccaagccactgg

SEQ ID NO: 132707 - DNA, 25 bp, Mus musculus
tattgggaccattccactgatgcct

SEQ ID NO: 132708 - DNA, 25 bp, Mus musculus
tattgggactctgcctatgacgacg

SEQ ID NO: 132709 - DNA, 25 bp, Mus musculus
tattgggagaaggagaccacagacc

SEQ ID NO: 132710 - DNA, 25 bp, Mus musculus
tattgggagctacaaggaagtactc

SEQ ID NO: 132711 - DNA, 25 bp, Mus musculus
tattgggcacgaagagcaatcccga

SEQ ID NO: 132712 - DNA, 25 bp, Mus musculus
tattgggccctacccttcctggtgg

SEQ ID NO: 132713 - DNA, 25 bp, Mus musculus
tattgggcctaagatagccactgac

SEQ ID NO: 132714 - DNA, 25 bp, Mus musculus
tattgggttttggatcacaccaggg

SEQ ID NO: 132715 - DNA, 25 bp, Mus musculus
tattggtagtccacgaacacctgtc

SEQ ID NO: 132716 - DNA, 25 bp, Mus musculus
tattggtctgacctggcgctggaca

SEQ ID NO: 132717 - DNA, 25 bp, Mus musculus
tattggtgctagagaatgaacccag

SEQ ID NO: 132718 - DNA, 25 bp, Mus musculus
tattggtgctctggcccctctgagc

SEQ ID NO: 132719 - DNA, 25 bp, Mus musculus
tattggtgggatcattctgacagcc

SEQ ID NO: 132720 - DNA, 25 bp, Mus musculus
tattggtgtacagcctccatgctgc

SEQ ID NO: 132721 - DNA, 25 bp, Mus musculus
tattggttcagtaccaggaccctgc

SEQ ID NO: 132722 - DNA, 25 bp, Mus musculus
tattggtttctctatctcgccgagg

SEQ ID NO: 132723 - DNA, 25 bp, Mus musculus
tattggtttggtacgtcagcctgga

SEQ ID NO: 132724 - DNA, 25 bp, Mus musculus
tattgtaaccaaagactcggagaca

SEQ ID NO: 132725 - DNA, 25 bp, Mus musculus
tattgtacaaaccatgtgagcctgg

SEQ ID NO: 132726 - DNA, 25 bp, Mus musculus
tattgtacgtttacagtcgcagcac

SEQ ID NO: 132727 - DNA, 25 bp, Mus musculus
tattgtcaaccagggcttcttcgaa

SEQ ID NO: 132728 - DNA, 25 bp, Mus musculus
tattgtcaggacttcccgtgcggga

SEQ ID NO: 132729 - DNA, 25 bp, Mus musculus
tattgtcattgcaagcgctgttggc

SEQ ID NO: 132730 - DNA, 25 bp, Mus musculus
tattgtccagcaacccacagtgtga

SEQ ID NO: 132731 - DNA, 25 bp, Mus musculus
tattgtcgaaactctaacagtgggc

SEQ ID NO: 132732 - DNA, 25 bp, Mus musculus
tattgtctaccaccttgctcggcag

SEQ ID NO: 132733 - DNA, 25 bp, Mus musculus
tattgtcttatagtttcaaacaccc

SEQ ID NO: 132734 - DNA, 25 bp, Mus musculus
tattgtgaatgcatggctccagccc

SEQ ID NO: 132735 - DNA, 25 bp, Mus musculus
tattgtgagacaccacctactgtca

SEQ ID NO: 132736 - DNA, 25 bp, Mus musculus
tattgtgatgcctacctacgacctg

SEQ ID NO: 132737 - DNA, 25 bp, Mus musculus
tattgtgatgccttggtcagggccc

SEQ ID NO: 132738 - DNA, 25 bp, Mus musculus
tattgtgcatctagttccttggaag

SEQ ID NO: 132739 - DNA, 25 bp, Mus musculus
tattgtggaaactagtcggctgaga

SEQ ID NO: 132740 - DNA, 25 bp, Mus musculus
tattgtggacacagggacatctctt

SEQ ID NO: 132741 - DNA, 25 bp, Mus musculus
tattgtggacacatacggaggctgg

SEQ ID NO: 132742 - DNA, 25 bp, Mus musculus
tattgtggtccagatcgtagatgct

SEQ ID NO: 132743 - DNA, 25 bp, Mus musculus
tattgtggtcttccatgccaaggag

SEQ ID NO: 132744 - DNA, 25 bp, Mus musculus
tattgtgtgtctgcagcggcacgga

SEQ ID NO: 132745 - DNA, 25 bp, Mus musculus
tattgtgtgttcctctcccctaagc

SEQ ID NO: 132746 - DNA, 25 bp, Mus musculus
tattgtgttcatcatctggacgacc

SEQ ID NO: 132747 - DNA, 25 bp, Mus musculus
tattgttcccaaagcaacagccagc

SEQ ID NO: 132748 - DNA, 25 bp, Mus musculus
tattgttggcagacatcagtgaagc

SEQ ID NO: 132749 - DNA, 25 bp, Mus musculus
tattgtttgagctcagaaggcccga

SEQ ID NO: 132750 - DNA, 25 bp, Mus musculus
tatttaaacctagcgagccaaggcc

SEQ ID NO: 132751 - DNA, 25 bp, Mus musculus
tatttaagcggctccatctgggcac

SEQ ID NO: 132752 - DNA, 25 bp, Mus musculus
tatttaattgctctgccccggatac

SEQ ID NO: 132753 - DNA, 25 bp, Mus musculus
tatttacaaaggtgccggctggtgc

SEQ ID NO: 132754 - DNA, 25 bp, Mus musculus
tatttacaatgacgaggcagaccct

SEQ ID NO: 132755 - DNA, 25 bp, Mus musculus
tatttacagaactgcctggccaacc

SEQ ID NO: 132756 - DNA, 25 bp, Mus musculus
tatttaccacacgtcaccaagtcgg

SEQ ID NO: 132757 - DNA, 25 bp, Mus musculus
tatttaccactgaagatgcacccaa

SEQ ID NO: 132758 - DNA, 25 bp, Mus musculus
tatttaccctctgctgagaactttg

SEQ ID NO: 132759 - DNA, 25 bp, Mus musculus
tatttacgaaagtgcacctggaatc

SEQ ID NO: 132760 - DNA, 25 bp, Mus musculus
tatttacgaagtcgctgctctgcag

SEQ ID NO: 132761 - DNA, 25 bp, Mus musculus
tatttactaagctctgtcggcctca

SEQ ID NO: 132762 - DNA, 25 bp, Mus musculus
tatttactgaagtcccctagaggca

SEQ ID NO: 132763 - DNA, 25 bp, Mus musculus
tatttagccctacaaggtacttgga

SEQ ID NO: 132764 - DNA, 25 bp, Mus musculus
tatttaggacaaagtcagccagaca

SEQ ID NO: 132765 - DNA, 25 bp, Mus musculus
tatttaggagatgaaaaacctggcc

SEQ ID NO: 132766 - DNA, 25 bp, Mus musculus
tatttagggacttcaggaccccatg

SEQ ID NO: 132767 - DNA, 25 bp, Mus musculus
tatttaggtgatgcatccgcctggg

SEQ ID NO: 132768 - DNA, 25 bp, Mus musculus
tatttagtagatccgttgaaggacc

SEQ ID NO: 132769 - DNA, 25 bp, Mus musculus
tatttataaagtacacccaaggcgc

SEQ ID NO: 132770 - DNA, 25 bp, Mus musculus
tatttataccagcacttcgccgagg

SEQ ID NO: 132771 - DNA, 25 bp, Mus musculus
tatttatcaacaacgactggcacga

SEQ ID NO: 132772 - DNA, 25 bp, Mus musculus
tatttatcagcacgtggctgactgc

SEQ ID NO: 132773 - DNA, 25 bp, Mus musculus
tatttatgaaaaaagcgccatcaga

SEQ ID NO: 132774 - DNA, 25 bp, Mus musculus
tatttatgacggtctccagcagggc

SEQ ID NO: 132775 - DNA, 25 bp, Mus musculus
tatttatgctgtaactcgtgtcaag

SEQ ID NO: 132776 - DNA, 25 bp, Mus musculus
tatttatggacacactgccagtggg

SEQ ID NO: 132777 - DNA, 25 bp, Mus musculus
tatttatggcaaagctgcccaagga

SEQ ID NO: 132778 - DNA, 25 bp, Mus musculus
tatttattacaccagagccattgaa

SEQ ID NO: 132779 - DNA, 25 bp, Mus musculus
tatttattcgacacaccttggtgga

SEQ ID NO: 132780 - DNA, 25 bp, Mus musculus
tatttattcgtgacccatgagcccg

SEQ ID NO: 132781 - DNA, 25 bp, Mus musculus
tatttattgcatgcgccctaggtga

SEQ ID NO: 132782 - DNA, 25 bp, Mus musculus
tatttatttccagtgggcgccgcca

SEQ ID NO: 132783 - DNA, 25 bp, Mus musculus
tatttcaaaacggagccgggcctgc

SEQ ID NO: 132784 - DNA, 25 bp, Mus musculus
tatttcaaaggataagaccacgtga

SEQ ID NO: 132785 - DNA, 25 bp, Mus musculus
tatttcacaaacaggaccagctgag

SEQ ID NO: 132786 - DNA, 25 bp, Mus musculus
tatttcaccgttgacttgccacagc

SEQ ID NO: 132787 - DNA, 25 bp, Mus musculus
tatttcacctcggatgggttaccag

SEQ ID NO: 132788 - DNA, 25 bp, Mus musculus
tatttcacgcggttgtccagtactg

SEQ ID NO: 132789 - DNA, 25 bp, Mus musculus
tatttcagaagacactgccctaggg

SEQ ID NO: 132790 - DNA, 25 bp, Mus musculus
tatttcagaatggagagtctgcacc

SEQ ID NO: 132791 - DNA, 25 bp, Mus musculus
tatttcagagccaccggtactgcca

SEQ ID NO: 132792 - DNA, 25 bp, Mus musculus
tatttcagcaccagctttattggag

SEQ ID NO: 132793 - DNA, 25 bp, Mus musculus
tatttcaggaacgaggatgcgcaag

SEQ ID NO: 132794 - DNA, 25 bp, Mus musculus
tatttcagggaactgatcgtcactc

SEQ ID NO: 132795 - DNA, 25 bp, Mus musculus
tatttcagtgaaccttgtgcccatg

SEQ ID NO: 132796 - DNA, 25 bp, Mus musculus
tatttcatcagtgcatgcaagggcg

SEQ ID NO: 132797 - DNA, 25 bp, Mus musculus
tatttccaagcgatgagcagtgtgg

SEQ ID NO: 132798 - DNA, 25 bp, Mus musculus
tatttccataacagaatacccgagg

SEQ ID NO: 132799 - DNA, 25 bp, Mus musculus
tatttccatgttgggcacaggctca

SEQ ID NO: 132800 - DNA, 25 bp, Mus musculus
tatttccccagcaccgcagtgggag

SEQ ID NO: 132801 - DNA, 25 bp, Mus musculus
tatttccctaggatattaacacttc

SEQ ID NO: 132802 - DNA, 25 bp, Mus musculus
tatttccgaagccaaggttccacgc

SEQ ID NO: 132803 - DNA, 25 bp, Mus musculus
tatttccgagagacacaatcatcat

SEQ ID NO: 132804 - DNA, 25 bp, Mus musculus
tatttccgcatacagggctggacag

SEQ ID NO: 132805 - DNA, 25 bp, Mus musculus
tatttccgggatgtcagaaccattg

SEQ ID NO: 132806 - DNA, 25 bp, Mus musculus
tatttcctcaagtcagatctgccca

SEQ ID NO: 132807 - DNA, 25 bp, Mus musculus
tatttcctctgactatgagcgagcc

SEQ ID NO: 132808 - DNA, 25 bp, Mus musculus
tatttcctgattgtggatcccagtg

SEQ ID NO: 132809 - DNA, 25 bp, Mus musculus
tatttcctggtcaacctggtggaca

SEQ ID NO: 132810 - DNA, 25 bp, Mus musculus
tatttccttgcctacctgtgtaacg

SEQ ID NO: 132811 - DNA, 25 bp, Mus musculus
tatttcgagctacaacacttgcaag

SEQ ID NO: 132812 - DNA, 25 bp, Mus musculus
tatttcgccaactgcaccgtgcgtg

SEQ ID NO: 132813 - DNA, 25 bp, Mus musculus
tatttcgcctgccttggtacccggt

SEQ ID NO: 132814 - DNA, 25 bp, Mus musculus
tatttcgttgcacttccgtggagac

SEQ ID NO: 132815 - DNA, 25 bp, Mus musculus
tatttctacgactatgactgcggag

SEQ ID NO: 132816 - DNA, 25 bp, Mus musculus
tatttctagagcacaaggtctggct

SEQ ID NO: 132817 - DNA, 25 bp, Mus musculus
tatttctatggagaatttccgcaca

SEQ ID NO: 132818 - DNA, 25 bp, Mus musculus
tatttctccagagtgcagggaaggc

SEQ ID NO: 132819 - DNA, 25 bp, Mus musculus
tatttctccggagtcatcgccagga

SEQ ID NO: 132820 - DNA, 25 bp, Mus musculus
tatttctggagaccccgagatgtag

SEQ ID NO: 132821 - DNA, 25 bp, Mus musculus
tatttctggatcttagagactacgg

SEQ ID NO: 132822 - DNA, 25 bp, Mus musculus
tatttctgggattgctgatcctgga

SEQ ID NO: 132823 - DNA, 25 bp, Mus musculus
tatttcttactgtgccgagaagccg

SEQ ID NO: 132824 - DNA, 25 bp, Mus musculus
tatttcttcgcttacttccccacgg

SEQ ID NO: 132825 - DNA, 25 bp, Mus musculus
tatttgaaaaacactacatgggagg

SEQ ID NO: 132826 - DNA, 25 bp, Mus musculus
tatttgaaaacctcaacaagcatgc

SEQ ID NO: 132827 - DNA, 25 bp, Mus musculus
tatttgaacccatttgatgaaccag

SEQ ID NO: 132828 - DNA, 25 bp, Mus musculus
tatttgaacccattttgagcccaga

SEQ ID NO: 132829 - DNA, 25 bp, Mus musculus
tatttgaactgtgagccccaaaaca

SEQ ID NO: 132830 - DNA, 25 bp, Mus musculus
tatttgaagcctgaaatgcctgcgg

SEQ ID NO: 132831 - DNA, 25 bp, Mus musculus
tatttgaatatcatcagttgccacc

SEQ ID NO: 132832 - DNA, 25 bp, Mus musculus
tatttgacagtgttgggtgggaact

SEQ ID NO: 132833 - DNA, 25 bp, Mus musculus
tatttgacctcagccgccgatttga

SEQ ID NO: 132834 - DNA, 25 bp, Mus musculus
tatttgagagttggagctgaatcgg

SEQ ID NO: 132835 - DNA, 25 bp, Mus musculus
tatttgagatcgatccgcacctgca

SEQ ID NO: 132836 - DNA, 25 bp, Mus musculus
tatttgagcgcatgcgcaaagcgct

SEQ ID NO: 132837 - DNA, 25 bp, Mus musculus
tatttgaggactttgctcgccagcg

SEQ ID NO: 132838 - DNA, 25 bp, Mus musculus
tatttgatcagacaccccatctcgg

SEQ ID NO: 132839 - DNA, 25 bp, Mus musculus
tatttgatcgccatctgccatcgcc

SEQ ID NO: 132840 - DNA, 25 bp, Mus musculus
tatttgatggcaacgttcgtgcacg

SEQ ID NO: 132841 - DNA, 25 bp, Mus musculus
tatttgattgcctccagtactgtga

SEQ ID NO: 132842 - DNA, 25 bp, Mus musculus
tatttgcaaaatggcgtcccacggg

SEQ ID NO: 132843 - DNA, 25 bp, Mus musculus
tatttgcaagaaactccctcattgg

SEQ ID NO: 132844 - DNA, 25 bp, Mus musculus
tatttgcaatagctgactgctccag

SEQ ID NO: 132845 - DNA, 25 bp, Mus musculus
tatttgcgggagaggaacatggcac

SEQ ID NO: 132846 - DNA, 25 bp, Mus musculus
tatttgctcaacagagagaggcaca

SEQ ID NO: 132847 - DNA, 25 bp, Mus musculus
tatttgctcagggactaccccttgg

SEQ ID NO: 132848 - DNA, 25 bp, Mus musculus
tatttgctgagaaaactggccctcc

SEQ ID NO: 132849 - DNA, 25 bp, Mus musculus
tatttgctgtcctgtgaaagaagcc

SEQ ID NO: 132850 - DNA, 25 bp, Mus musculus
tatttgcttaggacgacccaggttg

SEQ ID NO: 132851 - DNA, 25 bp, Mus musculus
tatttggaagtcacccagcctttgg

SEQ ID NO: 132852 - DNA, 25 bp, Mus musculus
tatttggacgaccacacaatgtgca

SEQ ID NO: 132853 - DNA, 25 bp, Mus musculus
tatttggagcctggacacacagtac

SEQ ID NO: 132854 - DNA, 25 bp, Mus musculus
tatttggatgcgtgtgagcctcagc

SEQ ID NO: 132855 - DNA, 25 bp, Mus musculus
tatttggcacgaacacctgaggatc

SEQ ID NO: 132856 - DNA, 25 bp, Mus musculus
tatttggccacagcacagttgcaag

SEQ ID NO: 132857 - DNA, 25 bp, Mus musculus
tatttggccttacaggacctgatgc

SEQ ID NO: 132858 - DNA, 25 bp, Mus musculus
tatttggcgacaatgagaagcccct

SEQ ID NO: 132859 - DNA, 25 bp, Mus musculus
tatttggcgcagtgtcgcagttcgg

SEQ ID NO: 132860 - DNA, 25 bp, Mus musculus
tatttgggaaaagggccgcatgatc

SEQ ID NO: 132861 - DNA, 25 bp, Mus musculus
tatttgggccaattaaaccgaatct

SEQ ID NO: 132862 - DNA, 25 bp, Mus musculus
tatttggtcctcgtagctgaacatc

SEQ ID NO: 132863 - DNA, 25 bp, Mus musculus
tatttggtgcatttaacgcaactgg

SEQ ID NO: 132864 - DNA, 25 bp, Mus musculus
tatttgtcacacaaacttgagcccc

SEQ ID NO: 132865 - DNA, 25 bp, Mus musculus
tatttgtccatgtctcggacagagc

SEQ ID NO: 132866 - DNA, 25 bp, Mus musculus
tatttgtcgggtctcgcctaggtga

SEQ ID NO: 132867 - DNA, 25 bp, Mus musculus
tatttgtgctggtccatcgtgagta

SEQ ID NO: 132868 - DNA, 25 bp, Mus musculus
tatttgtggcatcccagctacgagc

SEQ ID NO: 132869 - DNA, 25 bp, Mus musculus
tatttgtgggtgcacctatgctctg

SEQ ID NO: 132870 - DNA, 25 bp, Mus musculus
tatttgtgtctgtcctcataggcgg

SEQ ID NO: 132871 - DNA, 25 bp, Mus musculus
tatttgttcatcagtcacaggccct

SEQ ID NO: 132872 - DNA, 25 bp, Mus musculus
tatttgttgctgatggcctgagagc

SEQ ID NO: 132873 - DNA, 25 bp, Mus musculus
tatttgttgtctactccacagcgcc

SEQ ID NO: 132874 - DNA, 25 bp, Mus musculus
tattttaaaggaacctgggagcatc

SEQ ID NO: 132875 - DNA, 25 bp, Mus musculus
tattttaacagaagtcagcatggcc

SEQ ID NO: 132876 - DNA, 25 bp, Mus musculus
tattttaacgtggacacatccctgc

SEQ ID NO: 132877 - DNA, 25 bp, Mus musculus
tattttacgtgttgatcggccccga

SEQ ID NO: 132878 - DNA, 25 bp, Mus musculus
tattttagaaaagacccaagaccat

SEQ ID NO: 132879 - DNA, 25 bp, Mus musculus
tattttagaacgaggcacagatcgc

SEQ ID NO: 132880 - DNA, 25 bp, Mus musculus
tattttatgcatggcgtatgtcgcg

SEQ ID NO: 132881 - DNA, 25 bp, Mus musculus
tattttcaaagactgccacgtgcct

SEQ ID NO: 132882 - DNA, 25 bp, Mus musculus
tattttcagaagatacagctccgtc

SEQ ID NO: 132883 - DNA, 25 bp, Mus musculus
tattttcagttgcaccaggatcaga

SEQ ID NO: 132884 - DNA, 25 bp, Mus musculus
tattttccagcatccagtgtgggcg

SEQ ID NO: 132885 - DNA, 25 bp, Mus musculus
tattttccagggtaagacacagtga

SEQ ID NO: 132886 - DNA, 25 bp, Mus musculus
tattttcccagctgtgtcatccggc

SEQ ID NO: 132887 - DNA, 25 bp, Mus musculus
tattttccgaagcatcacacctgtt

SEQ ID NO: 132888 - DNA, 25 bp, Mus musculus
tattttccgtgtcatgtcccgagga

SEQ ID NO: 132889 - DNA, 25 bp, Mus musculus
tattttcctcgatgggacagcagag

SEQ ID NO: 132890 - DNA, 25 bp, Mus musculus
tattttcctggagggtctgcagaca

SEQ ID NO: 132891 - DNA, 25 bp, Mus musculus
tattttcctggtgatcacgctgtgc

SEQ ID NO: 132892 - DNA, 25 bp, Mus musculus
tattttccttatccatcggcccgag

SEQ ID NO: 132893 - DNA, 25 bp, Mus musculus
tattttcgtgactgccttccagggc

SEQ ID NO: 132894 - DNA, 25 bp, Mus musculus
tattttctggacaagtcaaggcaag

SEQ ID NO: 132895 - DNA, 25 bp, Mus musculus
tattttgaacacagttgctgatcgc

SEQ ID NO: 132896 - DNA, 25 bp, Mus musculus
tattttgatgccaaggaacgggcag

SEQ ID NO: 132897 - DNA, 25 bp, Mus musculus
tattttgcaaagctgtactatgaag

SEQ ID NO: 132898 - DNA, 25 bp, Mus musculus
tattttgcataactcttgtgagcag

SEQ ID NO: 132899 - DNA, 25 bp, Mus musculus
tattttgcctggttgccttagtgag

SEQ ID NO: 132900 - DNA, 25 bp, Mus musculus
tattttgctgtctggagtgcccaca

SEQ ID NO: 132901 - DNA, 25 bp, Mus musculus
tattttggctccaggcactgcagga

SEQ ID NO: 132902 - DNA, 25 bp, Mus musculus
tattttgggtcgtgcactagcctcg

SEQ ID NO: 132903 - DNA, 25 bp, Mus musculus
tattttgtacaagcttcagatccca

SEQ ID NO: 132904 - DNA, 25 bp, Mus musculus
tattttgtggctttggtgccccagg

SEQ ID NO: 132905 - DNA, 25 bp, Mus musculus
tattttgttaaattggcctgggcct

SEQ ID NO: 132906 - DNA, 25 bp, Mus musculus
tatttttgcagagacggatggaccc

SEQ ID NO: 132907 - DNA, 25 bp, Mus musculus
tattttttcataacggctgcagcag

SEQ ID NO: 132908 - DNA, 25 bp, Mus musculus
tcaaaaaagaccgactggacttcca

SEQ ID NO: 132909 - DNA, 25 bp, Mus musculus
tcaaaaaagcgtagggctgcactgt

SEQ ID NO: 132910 - DNA, 25 bp, Mus musculus
tcaaaaaccgcctgtggaagctgct

SEQ ID NO: 132911 - DNA, 25 bp, Mus musculus
tcaaaaacctccttgaagcaggaaa

SEQ ID NO: 132912 - DNA, 25 bp, Mus musculus
tcaaaaactggctgagtgagctggt

SEQ ID NO: 132913 - DNA, 25 bp, Mus musculus
tcaaaaactgtgactcgagccctcg

SEQ ID NO: 132914 - DNA, 25 bp, Mus musculus
tcaaaaaggacgactatactgcccg

SEQ ID NO: 132915 - DNA, 25 bp, Mus musculus
tcaaaaaggcagttctctgggaact

SEQ ID NO: 132916 - DNA, 25 bp, Mus musculus
tcaaaaagtgcattgggcgggctct

SEQ ID NO: 132917 - DNA, 25 bp, Mus musculus
tcaaaaatgaacttgaagctttcaa

SEQ ID NO: 132918 - DNA, 25 bp, Mus musculus
tcaaaacaatggttggccaccgaac

SEQ ID NO: 132919 - DNA, 25 bp, Mus musculus
tcaaaacaggaagcgagagcagtgt

SEQ ID NO: 132920 - DNA, 25 bp, Mus musculus
tcaaaacagtgtcaagcgtcagcct

SEQ ID NO: 132921 - DNA, 25 bp, Mus musculus
tcaaaaccacgtgaccatgtaaata

SEQ ID NO: 132922 - DNA, 25 bp, Mus musculus
tcaaaaccagcaatgaacgcttgcc

SEQ ID NO: 132923 - DNA, 25 bp, Mus musculus
tcaaaaccccagttgtgcagaggtg

SEQ ID NO: 132924 - DNA, 25 bp, Mus musculus
tcaaaacctgatgccaagcgaggga

SEQ ID NO: 132925 - DNA, 25 bp, Mus musculus
tcaaaacgaaaacggcgctgggatc

SEQ ID NO: 132926 - DNA, 25 bp, Mus musculus
tcaaaacggccaggtaaagacccag

SEQ ID NO: 132927 - DNA, 25 bp, Mus musculus
tcaaaactacagacgttggtccccg

SEQ ID NO: 132928 - DNA, 25 bp, Mus musculus
tcaaaactcaaaggtctaggtggcc

SEQ ID NO: 132929 - DNA, 25 bp, Mus musculus
tcaaaagaattccacgaggaaatcc

SEQ ID NO: 132930 - DNA, 25 bp, Mus musculus
tcaaaagcagcgcaactggctcggt

SEQ ID NO: 132931 - DNA, 25 bp, Mus musculus
tcaaaagcagctgggatgacgtcag

SEQ ID NO: 132932 - DNA, 25 bp, Mus musculus
tcaaaagcatacagtggtggccagc

SEQ ID NO: 132933 - DNA, 25 bp, Mus musculus
tcaaaagcatgttacggagtctggt

SEQ ID NO: 132934 - DNA, 25 bp, Mus musculus
tcaaaagccctgctactgggttagg

SEQ ID NO: 132935 - DNA, 25 bp, Mus musculus
tcaaaagccgccaaggacgttctgg

SEQ ID NO: 132936 - DNA, 25 bp, Mus musculus
tcaaaagctggaacagtgcatggcc

SEQ ID NO: 132937 - DNA, 25 bp, Mus musculus
tcaaaagggaggctcttccacctgg

SEQ ID NO: 132938 - DNA, 25 bp, Mus musculus
tcaaaagggatgaggcctgggactt

SEQ ID NO: 132939 - DNA, 25 bp, Mus musculus
tcaaaagtcaggttggagtagcgcc

SEQ ID NO: 132940 - DNA, 25 bp, Mus musculus
tcaaaagtcttagttacgggagtgg

SEQ ID NO: 132941 - DNA, 25 bp, Mus musculus
tcaaaagtcttggaggacccctcgt

SEQ ID NO: 132942 - DNA, 25 bp, Mus musculus
tcaaaagtgcattagacaaggctcc

SEQ ID NO: 132943 - DNA, 25 bp, Mus musculus
tcaaaatcaagagaggagcaaccca

SEQ ID NO: 132944 - DNA, 25 bp, Mus musculus
tcaaaatcgctactatccatgagtg

SEQ ID NO: 132945 - DNA, 25 bp, Mus musculus
tcaaaatcggaagcgaggagcctcc

SEQ ID NO: 132946 - DNA, 25 bp, Mus musculus
tcaaaatctcaaaacaggtccaggg

SEQ ID NO: 132947 - DNA, 25 bp, Mus musculus
tcaaaatgacctcctcaggccacgt

SEQ ID NO: 132948 - DNA, 25 bp, Mus musculus
tcaaaatgccaatcatccaggacgc

SEQ ID NO: 132949 - DNA, 25 bp, Mus musculus
tcaaaatggatggaaactgggacgc

SEQ ID NO: 132950 - DNA, 25 bp, Mus musculus
tcaaaatggtgtcctctggcctcac

SEQ ID NO: 132951 - DNA, 25 bp, Mus musculus
tcaaaatggttaccgcagcacacag

SEQ ID NO: 132952 - DNA, 25 bp, Mus musculus
tcaaaattacagcagcactcgggca

SEQ ID NO: 132953 - DNA, 25 bp, Mus musculus
tcaaacaccagggagagaaccttct

SEQ ID NO: 132954 - DNA, 25 bp, Mus musculus
tcaaacacccatggagatgaggatg

SEQ ID NO: 132955 - DNA, 25 bp, Mus musculus
tcaaacactatgtgccgggagctgc

SEQ ID NO: 132956 - DNA, 25 bp, Mus musculus
tcaaacagaccgaaatcaccagtgc

SEQ ID NO: 132957 - DNA, 25 bp, Mus musculus
tcaaacagagcaggccaaagagagc

SEQ ID NO: 132958 - DNA, 25 bp, Mus musculus
tcaaacaggccatcagtatccggga

SEQ ID NO: 132959 - DNA, 25 bp, Mus musculus
tcaaacaggccgttcaaagacagcg

SEQ ID NO: 132960 - DNA, 25 bp, Mus musculus
tcaaacagggcattgggcaagctcc

SEQ ID NO: 132961 - DNA, 25 bp, Mus musculus
tcaaacagtaggtgacaaatggccg

SEQ ID NO: 132962 - DNA, 25 bp, Mus musculus
tcaaacagtgctcattcttcatgca

SEQ ID NO: 132963 - DNA, 25 bp, Mus musculus
tcaaacatccaggtgggagacctca

SEQ ID NO: 132964 - DNA, 25 bp, Mus musculus
tcaaaccagagcatagcgagaaact

SEQ ID NO: 132965 - DNA, 25 bp, Mus musculus
tcaaaccagcaaggacgaggaggag

SEQ ID NO: 132966 - DNA, 25 bp, Mus musculus
tcaaacccatcaggaaggatgctgt

SEQ ID NO: 132967 - DNA, 25 bp, Mus musculus
tcaaaccgaggctcaagagaatggc

SEQ ID NO: 132968 - DNA, 25 bp, Mus musculus
tcaaaccgccctggctgtgagatgt

SEQ ID NO: 132969 - DNA, 25 bp, Mus musculus
tcaaaccgccttgggttgacggaag

SEQ ID NO: 132970 - DNA, 25 bp, Mus musculus
tcaaaccggaggatttgttgtcgct

SEQ ID NO: 132971 - DNA, 25 bp, Mus musculus
tcaaaccggatgaagacatgagcag

SEQ ID NO: 132972 - DNA, 25 bp, Mus musculus
tcaaaccgggactggccctaagctt

SEQ ID NO: 132973 - DNA, 25 bp, Mus musculus
tcaaaccgtacaagaaaaagtcgtg

SEQ ID NO: 132974 - DNA, 25 bp, Mus musculus
tcaaacctgggaagagtacacacgg

SEQ ID NO: 132975 - DNA, 25 bp, Mus musculus
tcaaacctggttcgaatgagaaacc

SEQ ID NO: 132976 - DNA, 25 bp, Mus musculus
tcaaacctgtgctccagttcttggg

SEQ ID NO: 132977 - DNA, 25 bp, Mus musculus
tcaaacgaagcatcagtcagccagc

SEQ ID NO: 132978 - DNA, 25 bp, Mus musculus
tcaaacgcattgtcctggctggcct

SEQ ID NO: 132979 - DNA, 25 bp, Mus musculus
tcaaacgctgcacaggctcgggtcg

SEQ ID NO: 132980 - DNA, 25 bp, Mus musculus
tcaaacggaccttcgaggacagatt

SEQ ID NO: 132981 - DNA, 25 bp, Mus musculus
tcaaacggtgtgttggagtccaacc

SEQ ID NO: 132982 - DNA, 25 bp, Mus musculus
tcaaactactggactcagagcggcc

SEQ ID NO: 132983 - DNA, 25 bp, Mus musculus
tcaaactaggctgaacaaaaatgtt

SEQ ID NO: 132984 - DNA, 25 bp, Mus musculus
tcaaactcaagaggttcacttgcct

SEQ ID NO: 132985 - DNA, 25 bp, Mus musculus
tcaaactccgtggaaaagacgccct

SEQ ID NO: 132986 - DNA, 25 bp, Mus musculus
tcaaactcgtgagcctgtgcctagg

SEQ ID NO: 132987 - DNA, 25 bp, Mus musculus
tcaaactctgcatcaaccgtggcca

SEQ ID NO: 132988 - DNA, 25 bp, Mus musculus
tcaaactgaacgacacactgctgct

SEQ ID NO: 132989 - DNA, 25 bp, Mus musculus
tcaaactgaggatcgtcgggctagc

SEQ ID NO: 132990 - DNA, 25 bp, Mus musculus
tcaaactgaggtcaaggaagcagcg

SEQ ID NO: 132991 - DNA, 25 bp, Mus musculus
tcaaactgatatggactggaagagc

SEQ ID NO: 132992 - DNA, 25 bp, Mus musculus
tcaaactggcgatgtcaagggttcc

SEQ ID NO: 132993 - DNA, 25 bp, Mus musculus
tcaaacttggattgtagcagcaaca

SEQ ID NO: 132994 - DNA, 25 bp, Mus musculus
tcaaacttggttggttagtctccac

SEQ ID NO: 132995 - DNA, 25 bp, Mus musculus
tcaaagaaaatgaacggcaccctgg

SEQ ID NO: 132996 - DNA, 25 bp, Mus musculus
tcaaagaaatcagaagccaccatcc

SEQ ID NO: 132997 - DNA, 25 bp, Mus musculus
tcaaagaacttatcgcacgaggaga

SEQ ID NO: 132998 - DNA, 25 bp, Mus musculus
tcaaagaactttatcgcaggcgctt

SEQ ID NO: 132999 - DNA, 25 bp, Mus musculus
tcaaagaaggcaacgctgaaatgat

SEQ ID NO: 133000 - DNA, 25 bp, Mus musculus
tcaaagaagttaggccattcaccgc

SEQ ID NO: 133001 - DNA, 25 bp, Mus musculus
tcaaagaagttaggctccagcccaa

SEQ ID NO: 133002 - DNA, 25 bp, Mus musculus
tcaaagacaagcagacagaaccggg

SEQ ID NO: 133003 - DNA, 25 bp, Mus musculus
tcaaagacaatgtgggccgtggcct

SEQ ID NO: 133004 - DNA, 25 bp, Mus musculus
tcaaagacacccttgccctgtaggt

SEQ ID NO: 133005 - DNA, 25 bp, Mus musculus
tcaaagacagcgtaaaatgaatgtt

SEQ ID NO: 133006 - DNA, 25 bp, Mus musculus
tcaaagaccagctagaaggagcccg

SEQ ID NO: 133007 - DNA, 25 bp, Mus musculus
tcaaagacgggctggagttcatgca

SEQ ID NO: 133008 - DNA, 25 bp, Mus musculus
tcaaagagagcgaagtcaaggccct

SEQ ID NO: 133009 - DNA, 25 bp, Mus musculus
tcaaagaggcctctgtcaaggtggc

SEQ ID NO: 133010 - DNA, 25 bp, Mus musculus
tcaaagaggtggcaacttcggtcca

SEQ ID NO: 133011 - DNA, 25 bp, Mus musculus
tcaaagagtcctcagggtggcagca

SEQ ID NO: 133012 - DNA, 25 bp, Mus musculus
tcaaagagtgggagtactgtggcca

SEQ ID NO: 133013 - DNA, 25 bp, Mus musculus
tcaaagatagcctgggagcactgtc

SEQ ID NO: 133014 - DNA, 25 bp, Mus musculus
tcaaagatctagctcatgacctggc

SEQ ID NO: 133015 - DNA, 25 bp, Mus musculus
tcaaagatgcagaagcagagcctct

SEQ ID NO: 133016 - DNA, 25 bp, Mus musculus
tcaaagatgcgtggtgcggatccgt

SEQ ID NO: 133017 - DNA, 25 bp, Mus musculus
tcaaagatgtgacaaccgaggatgc

SEQ ID NO: 133018 - DNA, 25 bp, Mus musculus
tcaaagatgtgggacggaagcctcc

SEQ ID NO: 133019 - DNA, 25 bp, Mus musculus
tcaaagcaacgcagtactctaccca

SEQ ID NO: 133020 - DNA, 25 bp, Mus musculus
tcaaagcagcaaaagcatcccggga

SEQ ID NO: 133021 - DNA, 25 bp, Mus musculus
tcaaagcaggcctgactgaccaggt

SEQ ID NO: 133022 - DNA, 25 bp, Mus musculus
tcaaagcagggaggatgccagtcac

SEQ ID NO: 133023 - DNA, 25 bp, Mus musculus
tcaaagcatgggactaactacggac

SEQ ID NO: 133024 - DNA, 25 bp, Mus musculus
tcaaagcccatgtgtagacgtacag

SEQ ID NO: 133025 - DNA, 25 bp, Mus musculus
tcaaagcccggtgaagccatacaca

SEQ ID NO: 133026 - DNA, 25 bp, Mus musculus
tcaaagccctcgtgtgcgcgggacc

SEQ ID NO: 133027 - DNA, 25 bp, Mus musculus
tcaaagccggcaagaaatccaggag

SEQ ID NO: 133028 - DNA, 25 bp, Mus musculus
tcaaagccgttaaggacaagctccg

SEQ ID NO: 133029 - DNA, 25 bp, Mus musculus
tcaaagcctgtcagagaagtagcct

SEQ ID NO: 133030 - DNA, 25 bp, Mus musculus
tcaaagccttagagtggcgctacac

SEQ ID NO: 133031 - DNA, 25 bp, Mus musculus
tcaaagccttgttgctggaggccaa

SEQ ID NO: 133032 - DNA, 25 bp, Mus musculus
tcaaagctacatctgtgacacagga

SEQ ID NO: 133033 - DNA, 25 bp, Mus musculus
tcaaagctagatgctcggatccagc

SEQ ID NO: 133034 - DNA, 25 bp, Mus musculus
tcaaagctagcaacctacacggtgc

SEQ ID NO: 133035 - DNA, 25 bp, Mus musculus
tcaaagctagctaggtggcactccg

SEQ ID NO: 133036 - DNA, 25 bp, Mus musculus
tcaaagctattggtgggatcattct

SEQ ID NO: 133037 - DNA, 25 bp, Mus musculus
tcaaagctcgagtcagggagatgga

SEQ ID NO: 133038 - DNA, 25 bp, Mus musculus
tcaaagctgcaatagaagcccggtc

SEQ ID NO: 133039 - DNA, 25 bp, Mus musculus
tcaaagctgctacagagcccaggaa

SEQ ID NO: 133040 - DNA, 25 bp, Mus musculus
tcaaagcttgttccctgcaggtgcc

SEQ ID NO: 133041 - DNA, 25 bp, Mus musculus
tcaaaggacgagaaattgtgcccgg

SEQ ID NO: 133042 - DNA, 25 bp, Mus musculus
tcaaaggactccagaggctacatca

SEQ ID NO: 133043 - DNA, 25 bp, Mus musculus
tcaaaggaggtggtcaaacaaggcc

SEQ ID NO: 133044 - DNA, 25 bp, Mus musculus
tcaaaggagtggacctcgatgcacc

SEQ ID NO: 133045 - DNA, 25 bp, Mus musculus
tcaaaggcacatcaacaccgggagt

SEQ ID NO: 133046 - DNA, 25 bp, Mus musculus
tcaaaggcaccactagcctggagat

SEQ ID NO: 133047 - DNA, 25 bp, Mus musculus
tcaaaggcacgttacagaggaatgg

SEQ ID NO: 133048 - DNA, 25 bp, Mus musculus
tcaaaggcatgggaggttgacacct

SEQ ID NO: 133049 - DNA, 25 bp, Mus musculus
tcaaaggcatgggtgactccacagt

SEQ ID NO: 133050 - DNA, 25 bp, Mus musculus
tcaaaggcattatctcaccggtcgg

SEQ ID NO: 133051 - DNA, 25 bp, Mus musculus
tcaaaggcgcgaatatgaaggagat

SEQ ID NO: 133052 - DNA, 25 bp, Mus musculus
tcaaaggcgctctggcaacactctg

SEQ ID NO: 133053 - DNA, 25 bp, Mus musculus
tcaaaggctcttggtccaataaaag

SEQ ID NO: 133054 - DNA, 25 bp, Mus musculus
tcaaaggctgctgggattccatcca

SEQ ID NO: 133055 - DNA, 25 bp, Mus musculus
tcaaaggctttggaccagcaacagc

SEQ ID NO: 133056 - DNA, 25 bp, Mus musculus
tcaaagggactagcttgcatctcag

SEQ ID NO: 133057 - DNA, 25 bp, Mus musculus
tcaaagggagcatggagtactagga

SEQ ID NO: 133058 - DNA, 25 bp, Mus musculus
tcaaaggtcaccagagggtggtcac

SEQ ID NO: 133059 - DNA, 25 bp, Mus musculus
tcaaaggtggaacctatcccaggcg

SEQ ID NO: 133060 - DNA, 25 bp, Mus musculus
tcaaagtacttttggagccggttag

SEQ ID NO: 133061 - DNA, 25 bp, Mus musculus
tcaaagtagcgttttccggaagcag

SEQ ID NO: 133062 - DNA, 25 bp, Mus musculus
tcaaagtccgagagtcaggctcact

SEQ ID NO: 133063 - DNA, 25 bp, Mus musculus
tcaaagtgaacaaaaccctgccgta

SEQ ID NO: 133064 - DNA, 25 bp, Mus musculus
tcaaagtgccaggagtaagacccac

SEQ ID NO: 133065 - DNA, 25 bp, Mus musculus
tcaaagtgcggaacagctaccagac

SEQ ID NO: 133066 - DNA, 25 bp, Mus musculus
tcaaagtgctggacagccctgtgcc

SEQ ID NO: 133067 - DNA, 25 bp, Mus musculus
tcaaagtggctcagtatgtggtacg

SEQ ID NO: 133068 - DNA, 25 bp, Mus musculus
tcaaagtgtgggttaggaactacag

SEQ ID NO: 133069 - DNA, 25 bp, Mus musculus
tcaaagttagaacccaagacccctg

SEQ ID NO: 133070 - DNA, 25 bp, Mus musculus
tcaaagttctcaactgggacagcag

SEQ ID NO: 133071 - DNA, 25 bp, Mus musculus
tcaaagttgggcaccagaccctgtc

SEQ ID NO: 133072 - DNA, 25 bp, Mus musculus
tcaaagtttaaatatctgttccccg

SEQ ID NO: 133073 - DNA, 25 bp, Mus musculus
tcaaataccatctgtgctggcgctt

SEQ ID NO: 133074 - DNA, 25 bp, Mus musculus
tcaaatacggcaacttcagcagcag

SEQ ID NO: 133075 - DNA, 25 bp, Mus musculus
tcaaatactggccaaagactcacag

SEQ ID NO: 133076 - DNA, 25 bp, Mus musculus
tcaaatatctctacagaagcatgag

SEQ ID NO: 133077 - DNA, 25 bp, Mus musculus
tcaaatatgagtcgatgagagccat

SEQ ID NO: 133078 - DNA, 25 bp, Mus musculus
tcaaatatttctgtgagctgagacc

SEQ ID NO: 133079 - DNA, 25 bp, Mus musculus
tcaaatcacctgaggaccagcatgg

SEQ ID NO: 133080 - DNA, 25 bp, Mus musculus
tcaaatcactgcctagcttctcggt

SEQ ID NO: 133081 - DNA, 25 bp, Mus musculus
tcaaatcagggctgtgctggaggcc

SEQ ID NO: 133082 - DNA, 25 bp, Mus musculus
tcaaatccgtgtcggagtcctcaca

SEQ ID NO: 133083 - DNA, 25 bp, Mus musculus
tcaaatcctcttttgttggagtgtc

SEQ ID NO: 133084 - DNA, 25 bp, Mus musculus
tcaaatcctttgtggctggcctgca

SEQ ID NO: 133085 - DNA, 25 bp, Mus musculus
tcaaatcgtacaagctggaagtcag

SEQ ID NO: 133086 - DNA, 25 bp, Mus musculus
tcaaatctgtttctgtgcctttcca

SEQ ID NO: 133087 - DNA, 25 bp, Mus musculus
tcaaatcttcctgtgctggcggctg

SEQ ID NO: 133088 - DNA, 25 bp, Mus musculus
tcaaatgactgcagatccaggagca

SEQ ID NO: 133089 - DNA, 25 bp, Mus musculus
tcaaatgagacttttcaagaggccc

SEQ ID NO: 133090 - DNA, 25 bp, Mus musculus
tcaaatgcggctctgactggacccg

SEQ ID NO: 133091 - DNA, 25 bp, Mus musculus
tcaaatggacatgcaaggcttgtgg

SEQ ID NO: 133092 - DNA, 25 bp, Mus musculus
tcaaatggatcgaagagcgcaggtc

SEQ ID NO: 133093 - DNA, 25 bp, Mus musculus
tcaaatggcagtccctggaacggag

SEQ ID NO: 133094 - DNA, 25 bp, Mus musculus
tcaaatgtgtagtaagcggccagcc

SEQ ID NO: 133095 - DNA, 25 bp, Mus musculus
tcaaattaaacctcggtgtaagcgg

SEQ ID NO: 133096 - DNA, 25 bp, Mus musculus
tcaaattaaagtcctcgagggtcga

SEQ ID NO: 133097 - DNA, 25 bp, Mus musculus
tcaaattaccccagacaaacagatg

SEQ ID NO: 133098 - DNA, 25 bp, Mus musculus
tcaaattcactaggaaaccccagcg

SEQ ID NO: 133099 - DNA, 25 bp, Mus musculus
tcaaattgcacccaaggaaggacac

SEQ ID NO: 133100 - DNA, 25 bp, Mus musculus
tcaaattgccaacctgcaagagctg

SEQ ID NO: 133101 - DNA, 25 bp, Mus musculus
tcaaattggatgaaggctgggtacc

SEQ ID NO: 133102 - DNA, 25 bp, Mus musculus
tcaaattgtatgtccgccgtgtgtt

SEQ ID NO: 133103 - DNA, 25 bp, Mus musculus
tcaaattgttgctggagggccttcg

SEQ ID NO: 133104 - DNA, 25 bp, Mus musculus
tcaacaaaacctaattgacaggctg

SEQ ID NO: 133105 - DNA, 25 bp, Mus musculus
tcaacaaacccacacggcctgggtg

SEQ ID NO: 133106 - DNA, 25 bp, Mus musculus
tcaacaacagatagactagggccgg

SEQ ID NO: 133107 - DNA, 25 bp, Mus musculus
tcaacaacagtgagcgcaacctcgt

SEQ ID NO: 133108 - DNA, 25 bp, Mus musculus
tcaacaacatccgtccagagaggag

SEQ ID NO: 133109 - DNA, 25 bp, Mus musculus
tcaacaaccacagatagcaatgcgg

SEQ ID NO: 133110 - DNA, 25 bp, Mus musculus
tcaacaacgtcaagaagctgggcgg

SEQ ID NO: 133111 - DNA, 25 bp, Mus musculus
tcaacaactcggagcagctgtgcag

SEQ ID NO: 133112 - DNA, 25 bp, Mus musculus
tcaacaagaatcactcagagggcgg

SEQ ID NO: 133113 - DNA, 25 bp, Mus musculus
tcaacaagactgtgcgggacctcat

SEQ ID NO: 133114 - DNA, 25 bp, Mus musculus
tcaacaagagaccaaacaagcctgc

SEQ ID NO: 133115 - DNA, 25 bp, Mus musculus
tcaacaaggacttccatcaggaggt

SEQ ID NO: 133116 - DNA, 25 bp, Mus musculus
tcaacaaggaggacttcatggagct

SEQ ID NO: 133117 - DNA, 25 bp, Mus musculus
tcaacaaggatagcagggtgtccct

SEQ ID NO: 133118 - DNA, 25 bp, Mus musculus
tcaacaagggcaggagctaaaacgg

SEQ ID NO: 133119 - DNA, 25 bp, Mus musculus
tcaacaaggttctcatgctgcagga

SEQ ID NO: 133120 - DNA, 25 bp, Mus musculus
tcaacaagttgaagaagacacccct

SEQ ID NO: 133121 - DNA, 25 bp, Mus musculus
tcaacaatcagatcgaggaactgcc

SEQ ID NO: 133122 - DNA, 25 bp, Mus musculus
tcaacaatgtggctctagcagccaa

SEQ ID NO: 133123 - DNA, 25 bp, Mus musculus
tcaacacagtgaacttcggagaacc

SEQ ID NO: 133124 - DNA, 25 bp, Mus musculus
tcaacaccaaggtgcgcagcttcgg

SEQ ID NO: 133125 - DNA, 25 bp, Mus musculus
tcaacaccactctgcgaagcttggg

SEQ ID NO: 133126 - DNA, 25 bp, Mus musculus
tcaacaccagctgcagatgtcaagg

SEQ ID NO: 133127 - DNA, 25 bp, Mus musculus
tcaacaccagctggtcggagggaat

SEQ ID NO: 133128 - DNA, 25 bp, Mus musculus
tcaacaccgtgtggaccttgggctg

SEQ ID NO: 133129 - DNA, 25 bp, Mus musculus
tcaacacctctgactggcagggaca

SEQ ID NO: 133130 - DNA, 25 bp, Mus musculus
tcaacacctgaaccatgttgggaat

SEQ ID NO: 133131 - DNA, 25 bp, Mus musculus
tcaacaccttcaagtgcttctaaag

SEQ ID NO: 133132 - DNA, 25 bp, Mus musculus
tcaacacggaaaatgaggatcatct

SEQ ID NO: 133133 - DNA, 25 bp, Mus musculus
tcaacacggtgaagggaaaggctct

SEQ ID NO: 133134 - DNA, 25 bp, Mus musculus
tcaacacgttgtgcctcaggaaggc

SEQ ID NO: 133135 - DNA, 25 bp, Mus musculus
tcaacactgaggtgcgaagcttcgg

SEQ ID NO: 133136 - DNA, 25 bp, Mus musculus
tcaacactgagttcatgaaggctgc

SEQ ID NO: 133137 - DNA, 25 bp, Mus musculus
tcaacactggaggagttacaaaagg

SEQ ID NO: 133138 - DNA, 25 bp, Mus musculus
tcaacacttttctgcagaacgtgca

SEQ ID NO: 133139 - DNA, 25 bp, Mus musculus
tcaacagaacatggaaagccagggt

SEQ ID NO: 133140 - DNA, 25 bp, Mus musculus
tcaacagacagggtcgacagagtgt

SEQ ID NO: 133141 - DNA, 25 bp, Mus musculus
tcaacagactggagcgagaggacta

SEQ ID NO: 133142 - DNA, 25 bp, Mus musculus
tcaacagaggcgtcggcatcgaaga

SEQ ID NO: 133143 - DNA, 25 bp, Mus musculus
tcaacagattgatgcgagccctcag

SEQ ID NO: 133144 - DNA, 25 bp, Mus musculus
tcaacagccagttcgaacccaagtg

SEQ ID NO: 133145 - DNA, 25 bp, Mus musculus
tcaacagcgacaatcacagcacaat

SEQ ID NO: 133146 - DNA, 25 bp, Mus musculus
tcaacagcgtgattggaagagccct

SEQ ID NO: 133147 - DNA, 25 bp, Mus musculus
tcaacagctctagaaggcttggccc

SEQ ID NO: 133148 - DNA, 25 bp, Mus musculus
tcaacaggaaggatctcatagagag

SEQ ID NO: 133149 - DNA, 25 bp, Mus musculus
tcaacaggcaaatccgggaggaggt

SEQ ID NO: 133150 - DNA, 25 bp, Mus musculus
tcaacaggcacaccatggagagaga

SEQ ID NO: 133151 - DNA, 25 bp, Mus musculus
tcaacaggcacacgacatgggaaag

SEQ ID NO: 133152 - DNA, 25 bp, Mus musculus
tcaacaggtagccatgctgaaccag

SEQ ID NO: 133153 - DNA, 25 bp, Mus musculus
tcaacagtcacgtggtgcacaggtc

SEQ ID NO: 133154 - DNA, 25 bp, Mus musculus
tcaacagtccgcttgagtggccacc

SEQ ID NO: 133155 - DNA, 25 bp, Mus musculus
tcaacagtgaaaatgagtcatacag

SEQ ID NO: 133156 - DNA, 25 bp, Mus musculus
tcaacagtgcgggtgcctgatacgc

SEQ ID NO: 133157 - DNA, 25 bp, Mus musculus
tcaacagttatagctcagaaggaaa

SEQ ID NO: 133158 - DNA, 25 bp, Mus musculus
tcaacagttatggacgacgggcaaa

SEQ ID NO: 133159 - DNA, 25 bp, Mus musculus
tcaacatattggtcaagccagctag

SEQ ID NO: 133160 - DNA, 25 bp, Mus musculus
tcaacatcagcaccgacacagtggg

SEQ ID NO: 133161 - DNA, 25 bp, Mus musculus
tcaacatcgtgaagtgtgccaaccc

SEQ ID NO: 133162 - DNA, 25 bp, Mus musculus
tcaacatctgccagcttgccaacag

SEQ ID NO: 133163 - DNA, 25 bp, Mus musculus
tcaacatgaagtgtcctacgccggg

SEQ ID NO: 133164 - DNA, 25 bp, Mus musculus
tcaacatgatcaccccagaaggatg

SEQ ID NO: 133165 - DNA, 25 bp, Mus musculus
tcaacatggacgaccggtttgggca

SEQ ID NO: 133166 - DNA, 25 bp, Mus musculus
tcaacatgtagcagtgactcgaaag

SEQ ID NO: 133167 - DNA, 25 bp, Mus musculus
tcaacatgtccagctctggtggccg

SEQ ID NO: 133168 - DNA, 25 bp, Mus musculus
tcaacattccaaaggcgggatagcc

SEQ ID NO: 133169 - DNA, 25 bp, Mus musculus
tcaacattgatactctgaccgcaga

SEQ ID NO: 133170 - DNA, 25 bp, Mus musculus
tcaaccaaggtcatgaaagctcagc

SEQ ID NO: 133171 - DNA, 25 bp, Mus musculus
tcaaccaagtcgttcctggccgatg

SEQ ID NO: 133172 - DNA, 25 bp, Mus musculus
tcaaccacagagagaagtgtcaggc

SEQ ID NO: 133173 - DNA, 25 bp, Mus musculus
tcaaccactgtgagggtaagccgcc

SEQ ID NO: 133174 - DNA, 25 bp, Mus musculus
tcaaccagatcttcgaggagggcga

SEQ ID NO: 133175 - DNA, 25 bp, Mus musculus
tcaaccagatgtaggaagctggctc

SEQ ID NO: 133176 - DNA, 25 bp, Mus musculus
tcaaccagcgattagagcaagaata

SEQ ID NO: 133177 - DNA, 25 bp, Mus musculus
tcaaccaggcattgggcagtgcggc

SEQ ID NO: 133178 - DNA, 25 bp, Mus musculus
tcaaccagtgagtctgtgccaggac

SEQ ID NO: 133179 - DNA, 25 bp, Mus musculus
tcaaccagttctatccaagacccgg

SEQ ID NO: 133180 - DNA, 25 bp, Mus musculus
tcaaccatcatcgagggcctcaagg

SEQ ID NO: 133181 - DNA, 25 bp, Mus musculus
tcaaccatttagcaccagggaagga

SEQ ID NO: 133182 - DNA, 25 bp, Mus musculus
tcaaccatttcctggaggcagcggc

SEQ ID NO: 133183 - DNA, 25 bp, Mus musculus
tcaacccaaggtacagaagaacaga

SEQ ID NO: 133184 - DNA, 25 bp, Mus musculus
tcaacccaagtgttttccaagcaga

SEQ ID NO: 133185 - DNA, 25 bp, Mus musculus
tcaacccagggcaatccgaatgagg

SEQ ID NO: 133186 - DNA, 25 bp, Mus musculus
tcaacccggaagaagccagagcgct

SEQ ID NO: 133187 - DNA, 25 bp, Mus musculus
tcaaccctaaagaagtgctggtgcg

SEQ ID NO: 133188 - DNA, 25 bp, Mus musculus
tcaaccgcatcatggagaaaggctc

SEQ ID NO: 133189 - DNA, 25 bp, Mus musculus
tcaaccgcctgctgaagggacagaa

SEQ ID NO: 133190 - DNA, 25 bp, Mus musculus
tcaaccgcgcagacccataaattag

SEQ ID NO: 133191 - DNA, 25 bp, Mus musculus
tcaaccggaactactgggagaagaa

SEQ ID NO: 133192 - DNA, 25 bp, Mus musculus
tcaaccggtttatttgcttggcccg

SEQ ID NO: 133193 - DNA, 25 bp, Mus musculus
tcaacctcgagccagaggagatcca

SEQ ID NO: 133194 - DNA, 25 bp, Mus musculus
tcaacctggaaagcggagcgtgctg

SEQ ID NO: 133195 - DNA, 25 bp, Mus musculus
tcaacctggagcagcgcagtgagtc

SEQ ID NO: 133196 - DNA, 25 bp, Mus musculus
tcaacctggcgacttcgttgctgag

SEQ ID NO: 133197 - DNA, 25 bp, Mus musculus
tcaacctggcgttgctatggcaaca

SEQ ID NO: 133198 - DNA, 25 bp, Mus musculus
tcaacctgggtttcaccattggctc

SEQ ID NO: 133199 - DNA, 25 bp, Mus musculus
tcaaccttaggaaacggcgtgactc

SEQ ID NO: 133200 - DNA, 25 bp, Mus musculus
tcaaccttgccaccagagagctgga

SEQ ID NO: 133201 - DNA, 25 bp, Mus musculus
tcaacctttgggactcagacagcat

SEQ ID NO: 133202 - DNA, 25 bp, Mus musculus
tcaaccttttagacaacgtggtgaa

SEQ ID NO: 133203 - DNA, 25 bp, Mus musculus
tcaacgaaacatgggaaaactacga

SEQ ID NO: 133204 - DNA, 25 bp, Mus musculus
tcaacgaacatgctgaaggccaaaa

SEQ ID NO: 133205 - DNA, 25 bp, Mus musculus
tcaacgaaggcctcatgaagtggga

SEQ ID NO: 133206 - DNA, 25 bp, Mus musculus
tcaacgagcactcgatgcaggcgct

SEQ ID NO: 133207 - DNA, 25 bp, Mus musculus
tcaacgaggccctggcaggaagatt

SEQ ID NO: 133208 - DNA, 25 bp, Mus musculus
tcaacgaggtgcctaccatctggga

SEQ ID NO: 133209 - DNA, 25 bp, Mus musculus
tcaacgcagtgcagttcagtccagg

SEQ ID NO: 133210 - DNA, 25 bp, Mus musculus
tcaacgcatgttggacatctccggg

SEQ ID NO: 133211 - DNA, 25 bp, Mus musculus
tcaacgctcaataaaactacacttc

SEQ ID NO: 133212 - DNA, 25 bp, Mus musculus
tcaacgctgcctcgctggatgggca

SEQ ID NO: 133213 - DNA, 25 bp, Mus musculus
tcaacgctggaaagggagatggctt

SEQ ID NO: 133214 - DNA, 25 bp, Mus musculus
tcaacgctggcacactggctgtatt

SEQ ID NO: 133215 - DNA, 25 bp, Mus musculus
tcaacgctgttaaagagggagatac

SEQ ID NO: 133216 - DNA, 25 bp, Mus musculus
tcaacggaacgctgacgaagcaggg

SEQ ID NO: 133217 - DNA, 25 bp, Mus musculus
tcaacggaattgtgttcaacctgct

SEQ ID NO: 133218 - DNA, 25 bp, Mus musculus
tcaacggaccgtgcaagtgactctc

SEQ ID NO: 133219 - DNA, 25 bp, Mus musculus
tcaacggagaccacagtgagagcga

SEQ ID NO: 133220 - DNA, 25 bp, Mus musculus
tcaacggaggttctgcgcaaggtcc

SEQ ID NO: 133221 - DNA, 25 bp, Mus musculus
tcaacggatctgatgaaggtgccca

SEQ ID NO: 133222 - DNA, 25 bp, Mus musculus
tcaacgggacaaagacagtaagcct

SEQ ID NO: 133223 - DNA, 25 bp, Mus musculus
tcaacgggactcgaagatcttggcc

SEQ ID NO: 133224 - DNA, 25 bp, Mus musculus
tcaacgggcgctacttgtctggctc

SEQ ID NO: 133225 - DNA, 25 bp, Mus musculus
tcaacgggcttagagcaaagtccac

SEQ ID NO: 133226 - DNA, 25 bp, Mus musculus
tcaacggtatagaagagcgcatgtc

SEQ ID NO: 133227 - DNA, 25 bp, Mus musculus
tcaacggtttcgggagcgaagagcc

SEQ ID NO: 133228 - DNA, 25 bp, Mus musculus
tcaacgtaggtgctttaaggatgcc

SEQ ID NO: 133229 - DNA, 25 bp, Mus musculus
tcaacgtgcgctgccttgtgcggga

SEQ ID NO: 133230 - DNA, 25 bp, Mus musculus
tcaacgtggaggtgtctgctgaaga

SEQ ID NO: 133231 - DNA, 25 bp, Mus musculus
tcaacgtggcttccatgtggctgaa

SEQ ID NO: 133232 - DNA, 25 bp, Mus musculus
tcaacgtgggcggtacctacttcgt

SEQ ID NO: 133233 - DNA, 25 bp, Mus musculus
tcaacgtgtcaaagaggaaggagct

SEQ ID NO: 133234 - DNA, 25 bp, Mus musculus
tcaacgttctgcgaaaccggatcaa

SEQ ID NO: 133235 - DNA, 25 bp, Mus musculus
tcaactaaacaatccaatgcatcgt

SEQ ID NO: 133236 - DNA, 25 bp, Mus musculus
tcaactatcaagatggacctcggtc

SEQ ID NO: 133237 - DNA, 25 bp, Mus musculus
tcaactatgcattatcttagtgctg

SEQ ID NO: 133238 - DNA, 25 bp, Mus musculus
tcaactatgccaaggaggaggcctg

SEQ ID NO: 133239 - DNA, 25 bp, Mus musculus
tcaactcagaaagggcatccaagcg

SEQ ID NO: 133240 - DNA, 25 bp, Mus musculus
tcaactccagcagaaggacgaagct

SEQ ID NO: 133241 - DNA, 25 bp, Mus musculus
tcaactcctaaaagagctgacgggt

SEQ ID NO: 133242 - DNA, 25 bp, Mus musculus
tcaactccttcaccgtgcgtaatga

SEQ ID NO: 133243 - DNA, 25 bp, Mus musculus
tcaactcgacagaggccctggataa

SEQ ID NO: 133244 - DNA, 25 bp, Mus musculus
tcaactcggagacagacagcttcaa

SEQ ID NO: 133245 - DNA, 25 bp, Mus musculus
tcaactcggtgtctagtggtctggc

SEQ ID NO: 133246 - DNA, 25 bp, Mus musculus
tcaactctagagaagccggaagtgt

SEQ ID NO: 133247 - DNA, 25 bp, Mus musculus
tcaactctcgggtcttcatcggaaa

SEQ ID NO: 133248 - DNA, 25 bp, Mus musculus
tcaactctctgctagaccgggaggc

SEQ ID NO: 133249 - DNA, 25 bp, Mus musculus
tcaactctggcaaataagagtgatg

SEQ ID NO: 133250 - DNA, 25 bp, Mus musculus
tcaactctggcgaggaggtcctaag

SEQ ID NO: 133251 - DNA, 25 bp, Mus musculus
tcaactgagagtgcttaacctgtcc

SEQ ID NO: 133252 - DNA, 25 bp, Mus musculus
tcaactgagcatggcactttctggc

SEQ ID NO: 133253 - DNA, 25 bp, Mus musculus
tcaactgcagcataaaacactaagg

SEQ ID NO: 133254 - DNA, 25 bp, Mus musculus
tcaactgcccagtggagaacggtgc

SEQ ID NO: 133255 - DNA, 25 bp, Mus musculus
tcaactgccttgtagcctgggaagc

SEQ ID NO: 133256 - DNA, 25 bp, Mus musculus
tcaactgctctgtgatcgccgacgt

SEQ ID NO: 133257 - DNA, 25 bp, Mus musculus
tcaactgctgtattgcagagcagcc

SEQ ID NO: 133258 - DNA, 25 bp, Mus musculus
tcaactggatgtagtggcactgaca

SEQ ID NO: 133259 - DNA, 25 bp, Mus musculus
tcaactggcacttacagcagacgga

SEQ ID NO: 133260 - DNA, 25 bp, Mus musculus
tcaactggcatgttgggccgtatca

SEQ ID NO: 133261 - DNA, 25 bp, Mus musculus
tcaactgggaaagaaacaagacctc

SEQ ID NO: 133262 - DNA, 25 bp, Mus musculus
tcaactggtcgagatacagcatgcg

SEQ ID NO: 133263 - DNA, 25 bp, Mus musculus
tcaactggtcttggtggccgctgga

SEQ ID NO: 133264 - DNA, 25 bp, Mus musculus
tcaactgtaagaagaagggaaagct

SEQ ID NO: 133265 - DNA, 25 bp, Mus musculus
tcaactgtcgcatgctggtgaagcc

SEQ ID NO: 133266 - DNA, 25 bp, Mus musculus
tcaactgtgagaaatacgggcatgg

SEQ ID NO: 133267 - DNA, 25 bp, Mus musculus
tcaactgtggactgatattcagcag

SEQ ID NO: 133268 - DNA, 25 bp, Mus musculus
tcaactgttctgagggaagagagct

SEQ ID NO: 133269 - DNA, 25 bp, Mus musculus
tcaacttagccagaggagggaccag

SEQ ID NO: 133270 - DNA, 25 bp, Mus musculus
tcaacttcggttacactgagcacgg

SEQ ID NO: 133271 - DNA, 25 bp, Mus musculus
tcaacttctgagacaagcagtatga

SEQ ID NO: 133272 - DNA, 25 bp, Mus musculus
tcaacttgagtgtgagaccgaagca

SEQ ID NO: 133273 - DNA, 25 bp, Mus musculus
tcaacttgctggtgcgaagcctctc

SEQ ID NO: 133274 - DNA, 25 bp, Mus musculus
tcaactttaactgtgggatgctgct

SEQ ID NO: 133275 - DNA, 25 bp, Mus musculus
tcaactttgatgaagagaagcggcg

SEQ ID NO: 133276 - DNA, 25 bp, Mus musculus
tcaactttgtcctgaatgactgcag

SEQ ID NO: 133277 - DNA, 25 bp, Mus musculus
tcaagaaaaacaacccacgcaagta

SEQ ID NO: 133278 - DNA, 25 bp, Mus musculus
tcaagaaaacgatgagagtccactc

SEQ ID NO: 133279 - DNA, 25 bp, Mus musculus
tcaagaaaagcctgcgagacatggg

SEQ ID NO: 133280 - DNA, 25 bp, Mus musculus
tcaagaaaagggagccaggacctca

SEQ ID NO: 133281 - DNA, 25 bp, Mus musculus
tcaagaaacggcagcttctcccaag

SEQ ID NO: 133282 - DNA, 25 bp, Mus musculus
tcaagaaaggaatgcctgccagtca

SEQ ID NO: 133283 - DNA, 25 bp, Mus musculus
tcaagaaatgaacgctccaggaagc

SEQ ID NO: 133284 - DNA, 25 bp, Mus musculus
tcaagaacacagtgtgtccagagca

SEQ ID NO: 133285 - DNA, 25 bp, Mus musculus
tcaagaacactgtgcacgtcctggc

SEQ ID NO: 133286 - DNA, 25 bp, Mus musculus
tcaagaacccattggatgcgacctg

SEQ ID NO: 133287 - DNA, 25 bp, Mus musculus
tcaagaaccccagcatcggagaaag

SEQ ID NO: 133288 - DNA, 25 bp, Mus musculus
tcaagaacctcccagacacagagag

SEQ ID NO: 133289 - DNA, 25 bp, Mus musculus
tcaagaacgccactggtgcacaggt

SEQ ID NO: 133290 - DNA, 25 bp, Mus musculus
tcaagaacgtgtgcaaggctgacat

SEQ ID NO: 133291 - DNA, 25 bp, Mus musculus
tcaagaactggaggagtggtacaca

SEQ ID NO: 133292 - DNA, 25 bp, Mus musculus
tcaagaagaaaagtcagcccacctg

SEQ ID NO: 133293 - DNA, 25 bp, Mus musculus
tcaagaagactgatggaaaaccact

SEQ ID NO: 133294 - DNA, 25 bp, Mus musculus
tcaagaagatgctcagggattaccg

SEQ ID NO: 133295 - DNA, 25 bp, Mus musculus
tcaagaagcaggtctcgcagtcaca

SEQ ID NO: 133296 - DNA, 25 bp, Mus musculus
tcaagaagcctgtttaccgtaaggt

SEQ ID NO: 133297 - DNA, 25 bp, Mus musculus
tcaagaagctgttcacgtcgggagc

SEQ ID NO: 133298 - DNA, 25 bp, Mus musculus
tcaagaagtacatggagaacaggtc

SEQ ID NO: 133299 - DNA, 25 bp, Mus musculus
tcaagaagtgcattgctgtgggcat

SEQ ID NO: 133300 - DNA, 25 bp, Mus musculus
tcaagaagttacgaaagccggcgag

SEQ ID NO: 133301 - DNA, 25 bp, Mus musculus
tcaagaagttccgagctggcctcag

SEQ ID NO: 133302 - DNA, 25 bp, Mus musculus
tcaagaatgaagagggcagacgtct

SEQ ID NO: 133303 - DNA, 25 bp, Mus musculus
tcaagaatgagacccaactgctgga

SEQ ID NO: 133304 - DNA, 25 bp, Mus musculus
tcaagaatttactactcgggcgtca

SEQ ID NO: 133305 - DNA, 25 bp, Mus musculus
tcaagacaagactgcaagtggccgc

SEQ ID NO: 133306 - DNA, 25 bp, Mus musculus
tcaagacacaggttccaggaaaggg

SEQ ID NO: 133307 - DNA, 25 bp, Mus musculus
tcaagacatggagtgtgtgccctgc

SEQ ID NO: 133308 - DNA, 25 bp, Mus musculus
tcaagaccaaagagcgaatggccct

SEQ ID NO: 133309 - DNA, 25 bp, Mus musculus
tcaagaccagtgtgggcagtgccaa

SEQ ID NO: 133310 - DNA, 25 bp, Mus musculus
tcaagacccatctccacagcggagt

SEQ ID NO: 133311 - DNA, 25 bp, Mus musculus
tcaagaccggcggtggttcctcagg

SEQ ID NO: 133312 - DNA, 25 bp, Mus musculus
tcaagaccggtgtgctgaagtcact

SEQ ID NO: 133313 - DNA, 25 bp, Mus musculus
tcaagacctgggaaaaatctgggag

SEQ ID NO: 133314 - DNA, 25 bp, Mus musculus
tcaagaccttttccactgggcacag

SEQ ID NO: 133315 - DNA, 25 bp, Mus musculus
tcaagacgcagggactagtaccaaa

SEQ ID NO: 133316 - DNA, 25 bp, Mus musculus
tcaagacggaagagcaaacagtact

SEQ ID NO: 133317 - DNA, 25 bp, Mus musculus
tcaagacggacagggtgctaggtac

SEQ ID NO: 133318 - DNA, 25 bp, Mus musculus
tcaagacggcagtgtaatggaccaa

SEQ ID NO: 133319 - DNA, 25 bp, Mus musculus
tcaagactacaagctaagggcgcag

SEQ ID NO: 133320 - DNA, 25 bp, Mus musculus
tcaagactagacgagcgttcccagg

SEQ ID NO: 133321 - DNA, 25 bp, Mus musculus
tcaagactaggtttccaacctggac

SEQ ID NO: 133322 - DNA, 25 bp, Mus musculus
tcaagactcaccagaacaagaaggg

SEQ ID NO: 133323 - DNA, 25 bp, Mus musculus
tcaagactctttcccgagagcggcc

SEQ ID NO: 133324 - DNA, 25 bp, Mus musculus
tcaagactgtaaactcctcaaggcc

SEQ ID NO: 133325 - DNA, 25 bp, Mus musculus
tcaagagacagatgcaacaacgggc

SEQ ID NO: 133326 - DNA, 25 bp, Mus musculus
tcaagagacggtatctatgctcgcc

SEQ ID NO: 133327 - DNA, 25 bp, Mus musculus
tcaagagagaagcaatagacatcag

SEQ ID NO: 133328 - DNA, 25 bp, Mus musculus
tcaagagagagccttacggaaagcc

SEQ ID NO: 133329 - DNA, 25 bp, Mus musculus
tcaagagagagtctacagcacgaga

SEQ ID NO: 133330 - DNA, 25 bp, Mus musculus
tcaagagagctaacatccggactgt

SEQ ID NO: 133331 - DNA, 25 bp, Mus musculus
tcaagagagctttccatcagctggc

SEQ ID NO: 133332 - DNA, 25 bp, Mus musculus
tcaagagagtgatgcagatgctgct

SEQ ID NO: 133333 - DNA, 25 bp, Mus musculus
tcaagagataccaccagtcaggcca

SEQ ID NO: 133334 - DNA, 25 bp, Mus musculus
tcaagagatgggaatgtaaccggcc

SEQ ID NO: 133335 - DNA, 25 bp, Mus musculus
tcaagagctaacctacagtgcggca

SEQ ID NO: 133336 - DNA, 25 bp, Mus musculus
tcaagagctaagaggcaacggtgcc

SEQ ID NO: 133337 - DNA, 25 bp, Mus musculus
tcaagaggagacgtcccaagaggac

SEQ ID NO: 133338 - DNA, 25 bp, Mus musculus
tcaagaggagatcttgggcagcacc

SEQ ID NO: 133339 - DNA, 25 bp, Mus musculus
tcaagaggcggcaatctacctccag

SEQ ID NO: 133340 - DNA, 25 bp, Mus musculus
tcaagaggctaggtatcccggacag

SEQ ID NO: 133341 - DNA, 25 bp, Mus musculus
tcaagagggtcatcgacttcgctgt

SEQ ID NO: 133342 - DNA, 25 bp, Mus musculus
tcaagagggtcatggcggctatcga

SEQ ID NO: 133343 - DNA, 25 bp, Mus musculus
tcaagaggtatgtgactgctgccga

SEQ ID NO: 133344 - DNA, 25 bp, Mus musculus
tcaagagtgctaagattccccgggc

SEQ ID NO: 133345 - DNA, 25 bp, Mus musculus
tcaagagttcgggaaggtagaccct

SEQ ID NO: 133346 - DNA, 25 bp, Mus musculus
tcaagagtttcctcaagccgggcga

SEQ ID NO: 133347 - DNA, 25 bp, Mus musculus
tcaagatcacgtcctgggagccgaa

SEQ ID NO: 133348 - DNA, 25 bp, Mus musculus
tcaagatccccagagctgtgcgagg

SEQ ID NO: 133349 - DNA, 25 bp, Mus musculus
tcaagatccttgagattcaaccaag

SEQ ID NO: 133350 - DNA, 25 bp, Mus musculus
tcaagatcgggtcatgctcactggc

SEQ ID NO: 133351 - DNA, 25 bp, Mus musculus
tcaagatctgatcaaggtccccagt

SEQ ID NO: 133352 - DNA, 25 bp, Mus musculus
tcaagatgaaactccacaccacagg

SEQ ID NO: 133353 - DNA, 25 bp, Mus musculus
tcaagatgaagcagggagagaccct

SEQ ID NO: 133354 - DNA, 25 bp, Mus musculus
tcaagatgacgtctgtctgcggtca

SEQ ID NO: 133355 - DNA, 25 bp, Mus musculus
tcaagatgcagttgagcggcctcaa

SEQ ID NO: 133356 - DNA, 25 bp, Mus musculus
tcaagatgcctaacatacgaacacc

SEQ ID NO: 133357 - DNA, 25 bp, Mus musculus
tcaagatgcggtggccactgaactc

SEQ ID NO: 133358 - DNA, 25 bp, Mus musculus
tcaagatgctagagggcctaagtcc

SEQ ID NO: 133359 - DNA, 25 bp, Mus musculus
tcaagatggacgagaggacgctgct

SEQ ID NO: 133360 - DNA, 25 bp, Mus musculus
tcaagatggagcagcacactagtaa

SEQ ID NO: 133361 - DNA, 25 bp, Mus musculus
tcaagatgtccagccgaaggatgcg

SEQ ID NO: 133362 - DNA, 25 bp, Mus musculus
tcaagatgttctcccagcaagtgca

SEQ ID NO: 133363 - DNA, 25 bp, Mus musculus
tcaagattccatgatgaagctcaag

SEQ ID NO: 133364 - DNA, 25 bp, Mus musculus
tcaagattctacacaaacaaatgga

SEQ ID NO: 133365 - DNA, 25 bp, Mus musculus
tcaagcaagtgcagcctgagggacc

SEQ ID NO: 133366 - DNA, 25 bp, Mus musculus
tcaagcaatcagctgagaagtgcca

SEQ ID NO: 133367 - DNA, 25 bp, Mus musculus
tcaagcactgtgaagacccggtggt

SEQ ID NO: 133368 - DNA, 25 bp, Mus musculus
tcaagcagaaagacggacaggagct

SEQ ID NO: 133369 - DNA, 25 bp, Mus musculus
tcaagcagaagtccaaacaggctct

SEQ ID NO: 133370 - DNA, 25 bp, Mus musculus
tcaagcaggagaagccagagtggct

SEQ ID NO: 133371 - DNA, 25 bp, Mus musculus
tcaagcagggcgatggtatactccg

SEQ ID NO: 133372 - DNA, 25 bp, Mus musculus
tcaagcagttcctgctcctgctggg

SEQ ID NO: 133373 - DNA, 25 bp, Mus musculus
tcaagcatccgaccaccaaggttgg

SEQ ID NO: 133374 - DNA, 25 bp, Mus musculus
tcaagcatgccaaggtggtacaccg

SEQ ID NO: 133375 - DNA, 25 bp, Mus musculus
tcaagcatttatggcagctaccgga

SEQ ID NO: 133376 - DNA, 25 bp, Mus musculus
tcaagccaagagcacaccgagggct

SEQ ID NO: 133377 - DNA, 25 bp, Mus musculus
tcaagccactgtggacatcaaggac

SEQ ID NO: 133378 - DNA, 25 bp, Mus musculus
tcaagccagataccgtgagcttcag

SEQ ID NO: 133379 - DNA, 25 bp, Mus musculus
tcaagccaggcaacactctgccggt

SEQ ID NO: 133380 - DNA, 25 bp, Mus musculus
tcaagccagtgtgcaagtagagtct

SEQ ID NO: 133381 - DNA, 25 bp, Mus musculus
tcaagcccaagcgattcaggaaggg

SEQ ID NO: 133382 - DNA, 25 bp, Mus musculus
tcaagcccatgagagaaatcacact

SEQ ID NO: 133383 - DNA, 25 bp, Mus musculus
tcaagcccgagtggtgctaccggaa

SEQ ID NO: 133384 - DNA, 25 bp, Mus musculus
tcaagccctcgtccatggtgaagag

SEQ ID NO: 133385 - DNA, 25 bp, Mus musculus
tcaagccgtaccctagaagtcctag

SEQ ID NO: 133386 - DNA, 25 bp, Mus musculus
tcaagcctcacctgatggatgtggt

SEQ ID NO: 133387 - DNA, 25 bp, Mus musculus
tcaagcctcactgggatgcaaatgt

SEQ ID NO: 133388 - DNA, 25 bp, Mus musculus
tcaagcctgaacaacacaagcatct

SEQ ID NO: 133389 - DNA, 25 bp, Mus musculus
tcaagcctgcagtgataggagtcgg

SEQ ID NO: 133390 - DNA, 25 bp, Mus musculus
tcaagcctgccaacatcttcttggg

SEQ ID NO: 133391 - DNA, 25 bp, Mus musculus
tcaagcctggagatagcggatactg

SEQ ID NO: 133392 - DNA, 25 bp, Mus musculus
tcaagccttgggtgtgctgtgcacc

SEQ ID NO: 133393 - DNA, 25 bp, Mus musculus
tcaagcctttcggatatcagcagcc

SEQ ID NO: 133394 - DNA, 25 bp, Mus musculus
tcaagcgagctgcaaaggaatggct

SEQ ID NO: 133395 - DNA, 25 bp, Mus musculus
tcaagcgcaagagagaagtcagccc

SEQ ID NO: 133396 - DNA, 25 bp, Mus musculus
tcaagcgcaccattcggaaggacct

SEQ ID NO: 133397 - DNA, 25 bp, Mus musculus
tcaagcgcactgtgctcaccgagag

SEQ ID NO: 133398 - DNA, 25 bp, Mus musculus
tcaagcgccgcagggtattaagcag

SEQ ID NO: 133399 - DNA, 25 bp, Mus musculus
tcaagcgcctgtgagaagctagaaa

SEQ ID NO: 133400 - DNA, 25 bp, Mus musculus
tcaagcgcggacgaggctacaaatg

SEQ ID NO: 133401 - DNA, 25 bp, Mus musculus
tcaagcgcgtcttcttgctgcggtc

SEQ ID NO: 133402 - DNA, 25 bp, Mus musculus
tcaagcgggtatttggcactcacac

SEQ ID NO: 133403 - DNA, 25 bp, Mus musculus
tcaagcgggttcaagccgtgatccc

SEQ ID NO: 133404 - DNA, 25 bp, Mus musculus
tcaagcgtttaacaagagggtcggc

SEQ ID NO: 133405 - DNA, 25 bp, Mus musculus
tcaagctaaggcgacagaggtgtct

SEQ ID NO: 133406 - DNA, 25 bp, Mus musculus
tcaagctactaaacagggtgtgagg

SEQ ID NO: 133407 - DNA, 25 bp, Mus musculus
tcaagctcatgttagctcgggagac

SEQ ID NO: 133408 - DNA, 25 bp, Mus musculus
tcaagctcggcttgtacgacagcag

SEQ ID NO: 133409 - DNA, 25 bp, Mus musculus
tcaagctgaggactggaaaaaccag

SEQ ID NO: 133410 - DNA, 25 bp, Mus musculus
tcaagctgaggcctacgtagcccgt

SEQ ID NO: 133411 - DNA, 25 bp, Mus musculus
tcaagctgcaaacccagtaagtggc

SEQ ID NO: 133412 - DNA, 25 bp, Mus musculus
tcaagctgccccaggtatttaaact

SEQ ID NO: 133413 - DNA, 25 bp, Mus musculus
tcaagctgcgaaagcgtcctcactg

SEQ ID NO: 133414 - DNA, 25 bp, Mus musculus
tcaagctggaagacccataacaggt

SEQ ID NO: 133415 - DNA, 25 bp, Mus musculus
tcaagctggccatatttggaagagc

SEQ ID NO: 133416 - DNA, 25 bp, Mus musculus
tcaagctgtccacacctaccaagag

SEQ ID NO: 133417 - DNA, 25 bp, Mus musculus
tcaagctgtgggacaagaccagccg

SEQ ID NO: 133418 - DNA, 25 bp, Mus musculus
tcaagcttggttcagagagatctca

SEQ ID NO: 133419 - DNA, 25 bp, Mus musculus
tcaagcttttcagcggagaagacgt

SEQ ID NO: 133420 - DNA, 25 bp, Mus musculus
tcaaggaacggctatctaggcgggc

SEQ ID NO: 133421 - DNA, 25 bp, Mus musculus
tcaaggaactgctggctatcaaggc

SEQ ID NO: 133422 - DNA, 25 bp, Mus musculus
tcaaggaacttctggaccacatgag

SEQ ID NO: 133423 - DNA, 25 bp, Mus musculus
tcaaggaagaggacaaccagctcat

SEQ ID NO: 133424 - DNA, 25 bp, Mus musculus
tcaaggaagcccgaatgggtcatcc

SEQ ID NO: 133425 - DNA, 25 bp, Mus musculus
tcaaggacaagttcgatgggcgacc

SEQ ID NO: 133426 - DNA, 25 bp, Mus musculus
tcaaggacacggaaccagttgccag

SEQ ID NO: 133427 - DNA, 25 bp, Mus musculus
tcaaggacacggctccctgatgctt

SEQ ID NO: 133428 - DNA, 25 bp, Mus musculus
tcaaggacagcgtgctctactccag

SEQ ID NO: 133429 - DNA, 25 bp, Mus musculus
tcaaggaccaggatctcatgcgagc

SEQ ID NO: 133430 - DNA, 25 bp, Mus musculus
tcaaggaccattctgctagatgccc

SEQ ID NO: 133431 - DNA, 25 bp, Mus musculus
tcaaggaccctgatgtaaaagagct

SEQ ID NO: 133432 - DNA, 25 bp, Mus musculus
tcaaggaccggtacctgctgaaggc

SEQ ID NO: 133433 - DNA, 25 bp, Mus musculus
tcaaggacctctgtgaggaagtgcg

SEQ ID NO: 133434 - DNA, 25 bp, Mus musculus
tcaaggaccttctgcggaacctgct

SEQ ID NO: 133435 - DNA, 25 bp, Mus musculus
tcaaggacgatgttagcgctcagcc

SEQ ID NO: 133436 - DNA, 25 bp, Mus musculus
tcaaggacgctaagatcccggtggc

SEQ ID NO: 133437 - DNA, 25 bp, Mus musculus
tcaaggacgctacaaccaagagagt

SEQ ID NO: 133438 - DNA, 25 bp, Mus musculus
tcaaggacgtgcgactgatcagcgc

SEQ ID NO: 133439 - DNA, 25 bp, Mus musculus
tcaaggactatgaaggagcgacgct

SEQ ID NO: 133440 - DNA, 25 bp, Mus musculus
tcaaggagactcataagcccctggg

SEQ ID NO: 133441 - DNA, 25 bp, Mus musculus
tcaaggagattatcagggaagagtc

SEQ ID NO: 133442 - DNA, 25 bp, Mus musculus
tcaaggagcaaaagtacgaccggca

SEQ ID NO: 133443 - DNA, 25 bp, Mus musculus
tcaaggagctaaaccaatggcaagg

SEQ ID NO: 133444 - DNA, 25 bp, Mus musculus
tcaaggagctgctaaccaagaaggg

SEQ ID NO: 133445 - DNA, 25 bp, Mus musculus
tcaaggaggacaagctcttcaggcc

SEQ ID NO: 133446 - DNA, 25 bp, Mus musculus
tcaaggaggatctcatgctgccgca

SEQ ID NO: 133447 - DNA, 25 bp, Mus musculus
tcaaggaggcattcgcatagacgct

SEQ ID NO: 133448 - DNA, 25 bp, Mus musculus
tcaaggagtgctgcatcgagggcca

SEQ ID NO: 133449 - DNA, 25 bp, Mus musculus
tcaaggagtggtttgtgtaccccgg

SEQ ID NO: 133450 - DNA, 25 bp, Mus musculus
tcaaggataattaagcaggcacaca

SEQ ID NO: 133451 - DNA, 25 bp, Mus musculus
tcaaggatcgaggagaaaacccaag

SEQ ID NO: 133452 - DNA, 25 bp, Mus musculus
tcaaggatctaattcagcagcatgt

SEQ ID NO: 133453 - DNA, 25 bp, Mus musculus
tcaaggatgacggtgctgcaggaac

SEQ ID NO: 133454 - DNA, 25 bp, Mus musculus
tcaaggatgccctgaggtgcaaggc

SEQ ID NO: 133455 - DNA, 25 bp, Mus musculus
tcaaggatggcaaggaactcaaccg

SEQ ID NO: 133456 - DNA, 25 bp, Mus musculus
tcaaggatgtcctgttgaggcccaa

SEQ ID NO: 133457 - DNA, 25 bp, Mus musculus
tcaaggcaagcgtctactaacagtg

SEQ ID NO: 133458 - DNA, 25 bp, Mus musculus
tcaaggcaggaaagggactcacgat

SEQ ID NO: 133459 - DNA, 25 bp, Mus musculus
tcaaggcagtagaagaaggctaccg

SEQ ID NO: 133460 - DNA, 25 bp, Mus musculus
tcaaggcagtgatgtttctctcggg

SEQ ID NO: 133461 - DNA, 25 bp, Mus musculus
tcaaggcagtggtctgtggctacag

SEQ ID NO: 133462 - DNA, 25 bp, Mus musculus
tcaaggcattagagacagactggag

SEQ ID NO: 133463 - DNA, 25 bp, Mus musculus
tcaaggcattccaagtctagcagtg

SEQ ID NO: 133464 - DNA, 25 bp, Mus musculus
tcaaggccaaatcacagagggaagc

SEQ ID NO: 133465 - DNA, 25 bp, Mus musculus
tcaaggccaaggacagcacttacca

SEQ ID NO: 133466 - DNA, 25 bp, Mus musculus
tcaaggccaaggacgatgacaacat

SEQ ID NO: 133467 - DNA, 25 bp, Mus musculus
tcaaggccattgagcaggctgacct

SEQ ID NO: 133468 - DNA, 25 bp, Mus musculus
tcaaggcccgcaggatacacttcaa

SEQ ID NO: 133469 - DNA, 25 bp, Mus musculus
tcaaggccgactatgcacagcttct

SEQ ID NO: 133470 - DNA, 25 bp, Mus musculus
tcaaggccgtcgtcttcgtctgaag

SEQ ID NO: 133471 - DNA, 25 bp, Mus musculus
tcaaggcctagtagctccaagtcag

SEQ ID NO: 133472 - DNA, 25 bp, Mus musculus
tcaaggcctgagctctgggaactgc

SEQ ID NO: 133473 - DNA, 25 bp, Mus musculus
tcaaggccttcgtgtcccggcattc

SEQ ID NO: 133474 - DNA, 25 bp, Mus musculus
tcaaggccttgaaccagagcaacac

SEQ ID NO: 133475 - DNA, 25 bp, Mus musculus
tcaaggccttgaggaacgatccaca

SEQ ID NO: 133476 - DNA, 25 bp, Mus musculus
tcaaggcgacgagggtgctgttctc

SEQ ID NO: 133477 - DNA, 25 bp, Mus musculus
tcaaggcgctatgggtctgcagccc

SEQ ID NO: 133478 - DNA, 25 bp, Mus musculus
tcaaggcggataagaaggcagctca

SEQ ID NO: 133479 - DNA, 25 bp, Mus musculus
tcaaggcgggcactagttaccaaaa

SEQ ID NO: 133480 - DNA, 25 bp, Mus musculus
tcaaggctccggaaccagagtgtgt

SEQ ID NO: 133481 - DNA, 25 bp, Mus musculus
tcaaggctgagagggacatcctggc

SEQ ID NO: 133482 - DNA, 25 bp, Mus musculus
tcaaggctgcccaataccaggtcaa

SEQ ID NO: 133483 - DNA, 25 bp, Mus musculus
tcaaggctggaggagttctgccctc

SEQ ID NO: 133484 - DNA, 25 bp, Mus musculus
tcaaggctgtgatgcgccgctggct

SEQ ID NO: 133485 - DNA, 25 bp, Mus musculus
tcaagggagaggtccaggcaacttc

SEQ ID NO: 133486 - DNA, 25 bp, Mus musculus
tcaagggaggaagtaatgttaagag

SEQ ID NO: 133487 - DNA, 25 bp, Mus musculus
tcaagggagttctacgacagctggc

SEQ ID NO: 133488 - DNA, 25 bp, Mus musculus
tcaagggcagtatcgaccgcatgtt

SEQ ID NO: 133489 - DNA, 25 bp, Mus musculus
tcaagggccaggtggtgaccgttca

SEQ ID NO: 133490 - DNA, 25 bp, Mus musculus
tcaagggcttgttgggacttcccga

SEQ ID NO: 133491 - DNA, 25 bp, Mus musculus
tcaaggtactttcgcatcctgcaga

SEQ ID NO: 133492 - DNA, 25 bp, Mus musculus
tcaaggtagctgtgaatggtcaaca

SEQ ID NO: 133493 - DNA, 25 bp, Mus musculus
tcaaggtcaagagaacacagtgcat

SEQ ID NO: 133494 - DNA, 25 bp, Mus musculus
tcaaggtcaagatctggaagcaaga

SEQ ID NO: 133495 - DNA, 25 bp, Mus musculus
tcaaggtcatatgagcgcacaggcc

SEQ ID NO: 133496 - DNA, 25 bp, Mus musculus
tcaaggtcatatgggccctcagggc

SEQ ID NO: 133497 - DNA, 25 bp, Mus musculus
tcaaggtccctgagtgagggctacc

SEQ ID NO: 133498 - DNA, 25 bp, Mus musculus
tcaaggtccctgtgagtatcttagg

SEQ ID NO: 133499 - DNA, 25 bp, Mus musculus
tcaaggtcttggttacgaacggagc

SEQ ID NO: 133500 - DNA, 25 bp, Mus musculus
tcaaggtggcccgaagtgtgctgcc

SEQ ID NO: 133501 - DNA, 25 bp, Mus musculus
tcaaggtggccctagagactcgact

SEQ ID NO: 133502 - DNA, 25 bp, Mus musculus
tcaaggtggcttctccgtagacaga

SEQ ID NO: 133503 - DNA, 25 bp, Mus musculus
tcaaggtgtgctccggaggaaaacc

SEQ ID NO: 133504 - DNA, 25 bp, Mus musculus
tcaaggttcggttaagcccagagcc

SEQ ID NO: 133505 - DNA, 25 bp, Mus musculus
tcaaggttcttcagtgtcataagcc

SEQ ID NO: 133506 - DNA, 25 bp, Mus musculus
tcaaggttgtcctcagtcaggccag

SEQ ID NO: 133507 - DNA, 25 bp, Mus musculus
tcaaggtttgcagttaacatcaggg

SEQ ID NO: 133508 - DNA, 25 bp, Mus musculus
tcaagtacagtgtggtcggacacca

SEQ ID NO: 133509 - DNA, 25 bp, Mus musculus
tcaagtaccaaagcatccagaagag

SEQ ID NO: 133510 - DNA, 25 bp, Mus musculus
tcaagtaccccgagtggaagcagaa

SEQ ID NO: 133511 - DNA, 25 bp, Mus musculus
tcaagtacctggtggacaaccatgc

SEQ ID NO: 133512 - DNA, 25 bp, Mus musculus
tcaagtacctttctgctcacgccat

SEQ ID NO: 133513 - DNA, 25 bp, Mus musculus
tcaagtacgaaaagtaacaggagca

SEQ ID NO: 133514 - DNA, 25 bp, Mus musculus
tcaagtactacaggccatgaggcag

SEQ ID NO: 133515 - DNA, 25 bp, Mus musculus
tcaagtactgcagtcatagtatttc

SEQ ID NO: 133516 - DNA, 25 bp, Mus musculus
tcaagtatatgaagcacacagtggt

SEQ ID NO: 133517 - DNA, 25 bp, Mus musculus
tcaagtatgtgctgattcgagtcca

SEQ ID NO: 133518 - DNA, 25 bp, Mus musculus
tcaagtcaatggaacacgcaagggt

SEQ ID NO: 133519 - DNA, 25 bp, Mus musculus
tcaagtcacaagtgcccagaagcat

SEQ ID NO: 133520 - DNA, 25 bp, Mus musculus
tcaagtcacggcctcatgagaacgt

SEQ ID NO: 133521 - DNA, 25 bp, Mus musculus
tcaagtcactgatttacgttgtctc

SEQ ID NO: 133522 - DNA, 25 bp, Mus musculus
tcaagtcagaggcagtaactgcccg

SEQ ID NO: 133523 - DNA, 25 bp, Mus musculus
tcaagtcagagtgccacagaggtcc

SEQ ID NO: 133524 - DNA, 25 bp, Mus musculus
tcaagtcagcatcatcgagagaggc

SEQ ID NO: 133525 - DNA, 25 bp, Mus musculus
tcaagtcagctggatgaaccaagtc

SEQ ID NO: 133526 - DNA, 25 bp, Mus musculus
tcaagtcaggtggttcaggtcaggt

SEQ ID NO: 133527 - DNA, 25 bp, Mus musculus
tcaagtccaactaccgagtccgagt

SEQ ID NO: 133528 - DNA, 25 bp, Mus musculus
tcaagtccaaggtgtttctgctgca

SEQ ID NO: 133529 - DNA, 25 bp, Mus musculus
tcaagtccatcatctcccgaaccag

SEQ ID NO: 133530 - DNA, 25 bp, Mus musculus
tcaagtcccaagtgagccgaaaggc

SEQ ID NO: 133531 - DNA, 25 bp, Mus musculus
tcaagtccccttggcactgcaggtg

SEQ ID NO: 133532 - DNA, 25 bp, Mus musculus
tcaagtcctttaccgcctgaagaag

SEQ ID NO: 133533 - DNA, 25 bp, Mus musculus
tcaagtcgcagattcaaggccagga

SEQ ID NO: 133534 - DNA, 25 bp, Mus musculus
tcaagtcgcgcttcacagatgacga

SEQ ID NO: 133535 - DNA, 25 bp, Mus musculus
tcaagtctactactgttcatggcag

SEQ ID NO: 133536 - DNA, 25 bp, Mus musculus
tcaagtctccagtgctcatgactcc

SEQ ID NO: 133537 - DNA, 25 bp, Mus musculus
tcaagtctcgtgaaatctttctcag

SEQ ID NO: 133538 - DNA, 25 bp, Mus musculus
tcaagtctctgacaacacccgagga

SEQ ID NO: 133539 - DNA, 25 bp, Mus musculus
tcaagtctggtctcacgtgtacaaa

SEQ ID NO: 133540 - DNA, 25 bp, Mus musculus
tcaagtctgtccagctgaacccagg

SEQ ID NO: 133541 - DNA, 25 bp, Mus musculus
tcaagtctgtgcaacgctgcatggc

SEQ ID NO: 133542 - DNA, 25 bp, Mus musculus
tcaagtcttcggttgcagtcacagt

SEQ ID NO: 133543 - DNA, 25 bp, Mus musculus
tcaagtgaacctccatcgcggtaag

SEQ ID NO: 133544 - DNA, 25 bp, Mus musculus
tcaagtgaatgagccctggaaacgg

SEQ ID NO: 133545 - DNA, 25 bp, Mus musculus
tcaagtgacccagtgataatcggct

SEQ ID NO: 133546 - DNA, 25 bp, Mus musculus
tcaagtgagcatcttctggctggct

SEQ ID NO: 133547 - DNA, 25 bp, Mus musculus
tcaagtgattttcccttagggagtc

SEQ ID NO: 133548 - DNA, 25 bp, Mus musculus
tcaagtgcaagtccaaacagtgctg

SEQ ID NO: 133549 - DNA, 25 bp, Mus musculus
tcaagtgccatctgtgcaaccgctg

SEQ ID NO: 133550 - DNA, 25 bp, Mus musculus
tcaagtgcccaacagaggtgctgct

SEQ ID NO: 133551 - DNA, 25 bp, Mus musculus
tcaagtgcctaaagcagtgccatct

SEQ ID NO: 133552 - DNA, 25 bp, Mus musculus
tcaagtgcgcggagtgcagccagta

SEQ ID NO: 133553 - DNA, 25 bp, Mus musculus
tcaagtggaatcaggagacatcccc

SEQ ID NO: 133554 - DNA, 25 bp, Mus musculus
tcaagtggatcgtatccgctgggct

SEQ ID NO: 133555 - DNA, 25 bp, Mus musculus
tcaagtggcaggacttcaagtggct

SEQ ID NO: 133556 - DNA, 25 bp, Mus musculus
tcaagtggctgaatgcgcagcaggt

SEQ ID NO: 133557 - DNA, 25 bp, Mus musculus
tcaagtgggtccctgaaaacagtga

SEQ ID NO: 133558 - DNA, 25 bp, Mus musculus
tcaagtggtctgagcccagtgagcc

SEQ ID NO: 133559 - DNA, 25 bp, Mus musculus
tcaagtggtggcgtccttaaggacc

SEQ ID NO: 133560 - DNA, 25 bp, Mus musculus
tcaagtgtactgcaagtggcgctac

SEQ ID NO: 133561 - DNA, 25 bp, Mus musculus
tcaagtgtcctacctgccgtaagga

SEQ ID NO: 133562 - DNA, 25 bp, Mus musculus
tcaagtgtgacagaagagccaaagc

SEQ ID NO: 133563 - DNA, 25 bp, Mus musculus
tcaagtgtgaggagtagcccaggct

SEQ ID NO: 133564 - DNA, 25 bp, Mus musculus
tcaagttagtagaaaagaaacagta

SEQ ID NO: 133565 - DNA, 25 bp, Mus musculus
tcaagttcaccaaggatctgccgct

SEQ ID NO: 133566 - DNA, 25 bp, Mus musculus
tcaagttcagaggagaccactgtgc

SEQ ID NO: 133567 - DNA, 25 bp, Mus musculus
tcaagttcagtagctgctagagaag

SEQ ID NO: 133568 - DNA, 25 bp, Mus musculus
tcaagttccaagtttctagccgggt

SEQ ID NO: 133569 - DNA, 25 bp, Mus musculus
tcaagttccaggatcaggacacgat

SEQ ID NO: 133570 - DNA, 25 bp, Mus musculus
tcaagttccaggtgcccaaggtgtc

SEQ ID NO: 133571 - DNA, 25 bp, Mus musculus
tcaagttccagtgaagaagaccggg

SEQ ID NO: 133572 - DNA, 25 bp, Mus musculus
tcaagttcgcgtccaccatggtgca

SEQ ID NO: 133573 - DNA, 25 bp, Mus musculus
tcaagttcgggagcttcgtcctgaa

SEQ ID NO: 133574 - DNA, 25 bp, Mus musculus
tcaagttgaacctgtgggaagatgg

SEQ ID NO: 133575 - DNA, 25 bp, Mus musculus
tcaagttgaggatctaagccgccag

SEQ ID NO: 133576 - DNA, 25 bp, Mus musculus
tcaagttgctctgaccccagaggag

SEQ ID NO: 133577 - DNA, 25 bp, Mus musculus
tcaagttgtactggtggctgcccct

SEQ ID NO: 133578 - DNA, 25 bp, Mus musculus
tcaagtttaccccaggctcagctgg

SEQ ID NO: 133579 - DNA, 25 bp, Mus musculus
tcaagtttgacgtgggtaccaacaa

SEQ ID NO: 133580 - DNA, 25 bp, Mus musculus
tcaataaacccgaatcccatggagg

SEQ ID NO: 133581 - DNA, 25 bp, Mus musculus
tcaataaagccatccctgatacacg

SEQ ID NO: 133582 - DNA, 25 bp, Mus musculus
tcaataaccccacggaggactttag

SEQ ID NO: 133583 - DNA, 25 bp, Mus musculus
tcaataactccggtaaagaggacgc

SEQ ID NO: 133584 - DNA, 25 bp, Mus musculus
tcaataacttcatgggtctgggtca

SEQ ID NO: 133585 - DNA, 25 bp, Mus musculus
tcaataacttgctacaagtgaaaat

SEQ ID NO: 133586 - DNA, 25 bp, Mus musculus
tcaataagataagatggctccctca

SEQ ID NO: 133587 - DNA, 25 bp, Mus musculus
tcaataccaacatcgatgacgaggg

SEQ ID NO: 133588 - DNA, 25 bp, Mus musculus
tcaataccagcgacttccagaagct

SEQ ID NO: 133589 - DNA, 25 bp, Mus musculus
tcaatagagcagagtaccctgaggg

SEQ ID NO: 133590 - DNA, 25 bp, Mus musculus
tcaatagaggagaagacgaggacca

SEQ ID NO: 133591 - DNA, 25 bp, Mus musculus
tcaataggctgtttgccccatggct

SEQ ID NO: 133592 - DNA, 25 bp, Mus musculus
tcaatagtcttcctttgcctcgggc

SEQ ID NO: 133593 - DNA, 25 bp, Mus musculus
tcaatatagctgtccaggtgcgagg

SEQ ID NO: 133594 - DNA, 25 bp, Mus musculus
tcaatatattcccatggacctgcct

SEQ ID NO: 133595 - DNA, 25 bp, Mus musculus
tcaatatccctctcctggtactggg

SEQ ID NO: 133596 - DNA, 25 bp, Mus musculus
tcaatatgacgaggactcggagaca

SEQ ID NO: 133597 - DNA, 25 bp, Mus musculus
tcaatatggcctacggagtcaagag

SEQ ID NO: 133598 - DNA, 25 bp, Mus musculus
tcaatcaatcagagtagcagccgct

SEQ ID NO: 133599 - DNA, 25 bp, Mus musculus
tcaatcacaacgacttaggaggctg

SEQ ID NO: 133600 - DNA, 25 bp, Mus musculus
tcaatcacagctctactgcctgggt

SEQ ID NO: 133601 - DNA, 25 bp, Mus musculus
tcaatcagaagctaggcccgaggat

SEQ ID NO: 133602 - DNA, 25 bp, Mus musculus
tcaatcatcaaaggccagcgcctgg

SEQ ID NO: 133603 - DNA, 25 bp, Mus musculus
tcaatcatggatcaggacgacccag

SEQ ID NO: 133604 - DNA, 25 bp, Mus musculus
tcaatcattgaaaggttcccgtacc

SEQ ID NO: 133605 - DNA, 25 bp, Mus musculus
tcaatccccggaaatgtgctcacat

SEQ ID NO: 133606 - DNA, 25 bp, Mus musculus
tcaatcccgagtaccagaggaatgg

SEQ ID NO: 133607 - DNA, 25 bp, Mus musculus
tcaatccctgctagagagctgccag

SEQ ID NO: 133608 - DNA, 25 bp, Mus musculus
tcaatcccttcagagatgagtccag

SEQ ID NO: 133609 - DNA, 25 bp, Mus musculus
tcaatccgaggatcagatggtgcga

SEQ ID NO: 133610 - DNA, 25 bp, Mus musculus
tcaatcctatgggagacacactggc

SEQ ID NO: 133611 - DNA, 25 bp, Mus musculus
tcaatcctgccctacctgtggagga

SEQ ID NO: 133612 - DNA, 25 bp, Mus musculus
tcaatcgcttacgtgagcagaagta

SEQ ID NO: 133613 - DNA, 25 bp, Mus musculus
tcaatcggcctatgtcgctatggag

SEQ ID NO: 133614 - DNA, 25 bp, Mus musculus
tcaatcgtaacgaggagaaccgggc

SEQ ID NO: 133615 - DNA, 25 bp, Mus musculus
tcaatctagagagcaagggccctgc

SEQ ID NO: 133616 - DNA, 25 bp, Mus musculus
tcaatctcagagttttcatacgtca

SEQ ID NO: 133617 - DNA, 25 bp, Mus musculus
tcaatctcagcattcgaggacatgg

SEQ ID NO: 133618 - DNA, 25 bp, Mus musculus
tcaatctccctgtaggaggcctaag

SEQ ID NO: 133619 - DNA, 25 bp, Mus musculus
tcaatctcggaaaggaaacggccga

SEQ ID NO: 133620 - DNA, 25 bp, Mus musculus
tcaatctcggtttcctctactggga

SEQ ID NO: 133621 - DNA, 25 bp, Mus musculus
tcaatctgcgctagccccgtatctt

SEQ ID NO: 133622 - DNA, 25 bp, Mus musculus
tcaatctgggatagcatgtcctgcc

SEQ ID NO: 133623 - DNA, 25 bp, Mus musculus
tcaatctgggcaccacagttaggtc

SEQ ID NO: 133624 - DNA, 25 bp, Mus musculus
tcaatcttaagagcggaggcaagca

SEQ ID NO: 133625 - DNA, 25 bp, Mus musculus
tcaatcttagaaagtggaggaggca

SEQ ID NO: 133626 - DNA, 25 bp, Mus musculus
tcaatgaagacacccaggatgagct

SEQ ID NO: 133627 - DNA, 25 bp, Mus musculus
tcaatgaagcccactacccagatgt

SEQ ID NO: 133628 - DNA, 25 bp, Mus musculus
tcaatgaaggtataagctatgtttc

SEQ ID NO: 133629 - DNA, 25 bp, Mus musculus
tcaatgaattcaaagagctctgggc

SEQ ID NO: 133630 - DNA, 25 bp, Mus musculus
tcaatgacaagaattggcctggccc

SEQ ID NO: 133631 - DNA, 25 bp, Mus musculus
tcaatgacacaatccagctgctcgt

SEQ ID NO: 133632 - DNA, 25 bp, Mus musculus
tcaatgacagcggtaagaactggcg

SEQ ID NO: 133633 - DNA, 25 bp, Mus musculus
tcaatgacgacctggataaagccta

SEQ ID NO: 133634 - DNA, 25 bp, Mus musculus
tcaatgacgacttctcacaggtggc

SEQ ID NO: 133635 - DNA, 25 bp, Mus musculus
tcaatgactcagacgatggcgacgt

SEQ ID NO: 133636 - DNA, 25 bp, Mus musculus
tcaatgactcttccctagtggacct

SEQ ID NO: 133637 - DNA, 25 bp, Mus musculus
tcaatgactggcagagaggccgaat

SEQ ID NO: 133638 - DNA, 25 bp, Mus musculus
tcaatgagagggagtgctcgatcca

SEQ ID NO: 133639 - DNA, 25 bp, Mus musculus
tcaatgagcgagaagccagtagagt

SEQ ID NO: 133640 - DNA, 25 bp, Mus musculus
tcaatgatatggatgctgcgtggct

SEQ ID NO: 133641 - DNA, 25 bp, Mus musculus
tcaatgatctgcacaacttcaatga

SEQ ID NO: 133642 - DNA, 25 bp, Mus musculus
tcaatgattttgtggctggtgtgtc

SEQ ID NO: 133643 - DNA, 25 bp, Mus musculus
tcaatgcagacgaagctgtggccag

SEQ ID NO: 133644 - DNA, 25 bp, Mus musculus
tcaatgcagtccgaataccgagaga

SEQ ID NO: 133645 - DNA, 25 bp, Mus musculus
tcaatgcagtgctgagccagggagc

SEQ ID NO: 133646 - DNA, 25 bp, Mus musculus
tcaatgccaccacgaagatgtgcag

SEQ ID NO: 133647 - DNA, 25 bp, Mus musculus
tcaatgccactgtgcagcagcaagg

SEQ ID NO: 133648 - DNA, 25 bp, Mus musculus
tcaatgccagcaaaccaacagtcct

SEQ ID NO: 133649 - DNA, 25 bp, Mus musculus
tcaatgccagttgggtctgcagaac

SEQ ID NO: 133650 - DNA, 25 bp, Mus musculus
tcaatgccccgaaggtctgagactg

SEQ ID NO: 133651 - DNA, 25 bp, Mus musculus
tcaatgccctgctgaagtgcacatg

SEQ ID NO: 133652 - DNA, 25 bp, Mus musculus
tcaatgccgagagtcagaacagcgt

SEQ ID NO: 133653 - DNA, 25 bp, Mus musculus
tcaatgccgtgggaatgtccaggcc

SEQ ID NO: 133654 - DNA, 25 bp, Mus musculus
tcaatgcgatcactggtttaaatgg

SEQ ID NO: 133655 - DNA, 25 bp, Mus musculus
tcaatgcgcccatccagaggactga

SEQ ID NO: 133656 - DNA, 25 bp, Mus musculus
tcaatgcgttgatcggcctggctgg

SEQ ID NO: 133657 - DNA, 25 bp, Mus musculus
tcaatggactaaaggcgatgcagga

SEQ ID NO: 133658 - DNA, 25 bp, Mus musculus
tcaatggagcgaagtgcgggttatt

SEQ ID NO: 133659 - DNA, 25 bp, Mus musculus
tcaatggaggaaagcacgataccgg

SEQ ID NO: 133660 - DNA, 25 bp, Mus musculus
tcaatggatttggaagccctgtaga

SEQ ID NO: 133661 - DNA, 25 bp, Mus musculus
tcaatggcacagacgacgaaaaggc

SEQ ID NO: 133662 - DNA, 25 bp, Mus musculus
tcaatggcagacatcctgcttcggg

SEQ ID NO: 133663 - DNA, 25 bp, Mus musculus
tcaatggcaggagaaagagcaacca

SEQ ID NO: 133664 - DNA, 25 bp, Mus musculus
tcaatggccctcaagcatgatgggc

SEQ ID NO: 133665 - DNA, 25 bp, Mus musculus
tcaatggcgtcctctacgactgcgt

SEQ ID NO: 133666 - DNA, 25 bp, Mus musculus
tcaatgggaacaggaccacaggcag

SEQ ID NO: 133667 - DNA, 25 bp, Mus musculus
tcaatgggcagaaacaaagagaaga

SEQ ID NO: 133668 - DNA, 25 bp, Mus musculus
tcaatggtacactagtgccaccggc

SEQ ID NO: 133669 - DNA, 25 bp, Mus musculus
tcaatggtcaatgggagcctgcccc

SEQ ID NO: 133670 - DNA, 25 bp, Mus musculus
tcaatggtgagcaagcggctggtca

SEQ ID NO: 133671 - DNA, 25 bp, Mus musculus
tcaatggtggctttcagggctcggt

SEQ ID NO: 133672 - DNA, 25 bp, Mus musculus
tcaatgtaacaatgccctggagaac

SEQ ID NO: 133673 - DNA, 25 bp, Mus musculus
tcaatgtcaacctgaggcgggagcc

SEQ ID NO: 133674 - DNA, 25 bp, Mus musculus
tcaatgtcaacgtggcttgggctgg

SEQ ID NO: 133675 - DNA, 25 bp, Mus musculus
tcaatgtcacggagacaccagggac

SEQ ID NO: 133676 - DNA, 25 bp, Mus musculus
tcaatgtgaagcagcagttccagcc

SEQ ID NO: 133677 - DNA, 25 bp, Mus musculus
tcaatgtgacaacggtggacctaaa

SEQ ID NO: 133678 - DNA, 25 bp, Mus musculus
tcaatgtgatccatgcctgggagca

SEQ ID NO: 133679 - DNA, 25 bp, Mus musculus
tcaatgtgcctcatgttaaaaacag

SEQ ID NO: 133680 - DNA, 25 bp, Mus musculus
tcaatgtggagacccttgttgtggc

SEQ ID NO: 133681 - DNA, 25 bp, Mus musculus
tcaatgtgggtttctaaggacggcc

SEQ ID NO: 133682 - DNA, 25 bp, Mus musculus
tcaatgtggtatgtggccctgcctc

SEQ ID NO: 133683 - DNA, 25 bp, Mus musculus
tcaatgtgtcctataccaggcagcc

SEQ ID NO: 133684 - DNA, 25 bp, Mus musculus
tcaatgtgtctagtatctcagctgg

SEQ ID NO: 133685 - DNA, 25 bp, Mus musculus
tcaatgttgagcatagcagtcacct

SEQ ID NO: 133686 - DNA, 25 bp, Mus musculus
tcaatgttgtcgtgagcgcagctcc

SEQ ID NO: 133687 - DNA, 25 bp, Mus musculus
tcaattaagtggaaagatggaccct

SEQ ID NO: 133688 - DNA, 25 bp, Mus musculus
tcaattaggacagtggctgcggaat

SEQ ID NO: 133689 - DNA, 25 bp, Mus musculus
tcaattcaggatctaaccaggaggg

SEQ ID NO: 133690 - DNA, 25 bp, Mus musculus
tcaattcatccaacagcctgggcgt

SEQ ID NO: 133691 - DNA, 25 bp, Mus musculus
tcaattctcagcgacagaacggcct

SEQ ID NO: 133692 - DNA, 25 bp, Mus musculus
tcaattctggaaaggcaccacctgg

SEQ ID NO: 133693 - DNA, 25 bp, Mus musculus
tcaattgctgcaatcactgccaggg

SEQ ID NO: 133694 - DNA, 25 bp, Mus musculus
tcaattggaagagaacccgggagcc

SEQ ID NO: 133695 - DNA, 25 bp, Mus musculus
tcaattgggacgcttgccagaccct

SEQ ID NO: 133696 - DNA, 25 bp, Mus musculus
tcaattgtgggtggtgaggccatca

SEQ ID NO: 133697 - DNA, 25 bp, Mus musculus
tcaatttcagcagcaccgagcagtt

SEQ ID NO: 133698 - DNA, 25 bp, Mus musculus
tcaatttgccatgagccgggagctg

SEQ ID NO: 133699 - DNA, 25 bp, Mus musculus
tcaatttggatggtgcgccttacgg

SEQ ID NO: 133700 - DNA, 25 bp, Mus musculus
tcaattttgcttcaggcccgctact

SEQ ID NO: 133701 - DNA, 25 bp, Mus musculus
tcaattttggtagcgcgcacagaca

SEQ ID NO: 133702 - DNA, 25 bp, Mus musculus
tcacaaaagatagagcctgggcaag

SEQ ID NO: 133703 - DNA, 25 bp, Mus musculus
tcacaaaatgaaggaacacaggctg

SEQ ID NO: 133704 - DNA, 25 bp, Mus musculus
tcacaaacgggaagcaaaactcagc

SEQ ID NO: 133705 - DNA, 25 bp, Mus musculus
tcacaaactccttggcctgggtctc

SEQ ID NO: 133706 - DNA, 25 bp, Mus musculus
tcacaaagaagggaaattgctgcct

SEQ ID NO: 133707 - DNA, 25 bp, Mus musculus
tcacaaaggtcaagtcatcaaggcc

SEQ ID NO: 133708 - DNA, 25 bp, Mus musculus
tcacaaagtaaagcacgtggcctgc

SEQ ID NO: 133709 - DNA, 25 bp, Mus musculus
tcacaacatggacaacaccacaggg

SEQ ID NO: 133710 - DNA, 25 bp, Mus musculus
tcacaaccgagagggcgaggagttt

SEQ ID NO: 133711 - DNA, 25 bp, Mus musculus
tcacaacgggaagtgcaaggagctc

SEQ ID NO: 133712 - DNA, 25 bp, Mus musculus
tcacaacgggatattggcctactca

SEQ ID NO: 133713 - DNA, 25 bp, Mus musculus
tcacaactgctgaagatggaccagt

SEQ ID NO: 133714 - DNA, 25 bp, Mus musculus
tcacaactgtgcctcaaaacctgca

SEQ ID NO: 133715 - DNA, 25 bp, Mus musculus
tcacaacttgtactctcagcaggcc

SEQ ID NO: 133716 - DNA, 25 bp, Mus musculus
tcacaactttggtgggagggcctga

SEQ ID NO: 133717 - DNA, 25 bp, Mus musculus
tcacaagaagaagctgaggcgtcgc

SEQ ID NO: 133718 - DNA, 25 bp, Mus musculus
tcacaagatgaagatcgagaggcct

SEQ ID NO: 133719 - DNA, 25 bp, Mus musculus
tcacaagatgatcgacctgtctggg

SEQ ID NO: 133720 - DNA, 25 bp, Mus musculus
tcacaagccgagatagaggcacggc

SEQ ID NO: 133721 - DNA, 25 bp, Mus musculus
tcacaaggcgcagatgaagaatccg

SEQ ID NO: 133722 - DNA, 25 bp, Mus musculus
tcacaagggaggatctgcatacaga

SEQ ID NO: 133723 - DNA, 25 bp, Mus musculus
tcacaagggcaggatgtgtctgaca

SEQ ID NO: 133724 - DNA, 25 bp, Mus musculus
tcacaaggttgccaaggactcgggt

SEQ ID NO: 133725 - DNA, 25 bp, Mus musculus
tcacaagtcgggactcgcaggagac

SEQ ID NO: 133726 - DNA, 25 bp, Mus musculus
tcacaagtctgaacgcggagcaggg

SEQ ID NO: 133727 - DNA, 25 bp, Mus musculus
tcacaagtgcctgatttgagtccca

SEQ ID NO: 133728 - DNA, 25 bp, Mus musculus
tcacaagttcccgtaccgcatggtt

SEQ ID NO: 133729 - DNA, 25 bp, Mus musculus
tcacaatgacagaaccggagacact

SEQ ID NO: 133730 - DNA, 25 bp, Mus musculus
tcacaatggcccagaggaggcttcc

SEQ ID NO: 133731 - DNA, 25 bp, Mus musculus
tcacaatttacatctcagctggaag

SEQ ID NO: 133732 - DNA, 25 bp, Mus musculus
tcacaatttgagagcagtgctgcca

SEQ ID NO: 133733 - DNA, 25 bp, Mus musculus
tcacacaatgggtatcatgagcctc

SEQ ID NO: 133734 - DNA, 25 bp, Mus musculus
tcacacactcaggaggtgaagggct

SEQ ID NO: 133735 - DNA, 25 bp, Mus musculus
tcacacactgttggacttctggcgc

SEQ ID NO: 133736 - DNA, 25 bp, Mus musculus
tcacacagattctaggcggccagga

SEQ ID NO: 133737 - DNA, 25 bp, Mus musculus
tcacacagcagtccttggagaaggt

SEQ ID NO: 133738 - DNA, 25 bp, Mus musculus
tcacacagcattatgtcagtagctc

SEQ ID NO: 133739 - DNA, 25 bp, Mus musculus
tcacacaggagccatagacacagag

SEQ ID NO: 133740 - DNA, 25 bp, Mus musculus
tcacacaggcatgatggcaaagcac

SEQ ID NO: 133741 - DNA, 25 bp, Mus musculus
tcacacagtacatcgatggccaggg

SEQ ID NO: 133742 - DNA, 25 bp, Mus musculus
tcacacagttgcgagaagagctgct

SEQ ID NO: 133743 - DNA, 25 bp, Mus musculus
tcacacatctaagaagggccagcac

SEQ ID NO: 133744 - DNA, 25 bp, Mus musculus
tcacaccggcgctggcttatgggat

SEQ ID NO: 133745 - DNA, 25 bp, Mus musculus
tcacaccgtgcacaaggattctggc

SEQ ID NO: 133746 - DNA, 25 bp, Mus musculus
tcacacctgagtggctacaaggcat

SEQ ID NO: 133747 - DNA, 25 bp, Mus musculus
tcacacgaagaatgcgcagagatgg

SEQ ID NO: 133748 - DNA, 25 bp, Mus musculus
tcacacgtgcacagatcgaggactc

SEQ ID NO: 133749 - DNA, 25 bp, Mus musculus
tcacacgttatgacctgatcagccg

SEQ ID NO: 133750 - DNA, 25 bp, Mus musculus
tcacactaaagaggagctggacgcg

SEQ ID NO: 133751 - DNA, 25 bp, Mus musculus
tcacactggaacaagggaagactct

SEQ ID NO: 133752 - DNA, 25 bp, Mus musculus
tcacactggccattgcctgggtgct

SEQ ID NO: 133753 - DNA, 25 bp, Mus musculus
tcacactgtgaatgggccttctgag

SEQ ID NO: 133754 - DNA, 25 bp, Mus musculus
tcacacttatgggttcgaggaggct

SEQ ID NO: 133755 - DNA, 25 bp, Mus musculus
tcacagaaaaacaaagtcagggccg

SEQ ID NO: 133756 - DNA, 25 bp, Mus musculus
tcacagaacatggatcagcctgggc

SEQ ID NO: 133757 - DNA, 25 bp, Mus musculus
tcacagaatcgcagttggagcacgc

SEQ ID NO: 133758 - DNA, 25 bp, Mus musculus
tcacagaatttaagtgggcagcaaa

SEQ ID NO: 133759 - DNA, 25 bp, Mus musculus
tcacagacgccaggcatcagaacag

SEQ ID NO: 133760 - DNA, 25 bp, Mus musculus
tcacagactacatggagaacggcga

SEQ ID NO: 133761 - DNA, 25 bp, Mus musculus
tcacagagaacacgagagtacaacc

SEQ ID NO: 133762 - DNA, 25 bp, Mus musculus
tcacagagcacgagtctttcacagc

SEQ ID NO: 133763 - DNA, 25 bp, Mus musculus
tcacagagctgtaccctttattcag

SEQ ID NO: 133764 - DNA, 25 bp, Mus musculus
tcacagaggaacatgcaaggcagca

SEQ ID NO: 133765 - DNA, 25 bp, Mus musculus
tcacagaggtataagctacagatcg

SEQ ID NO: 133766 - DNA, 25 bp, Mus musculus
tcacagagtatggttgggagctatc

SEQ ID NO: 133767 - DNA, 25 bp, Mus musculus
tcacagagtcctatttcagcaccag

SEQ ID NO: 133768 - DNA, 25 bp, Mus musculus
tcacagataggacgtgggagctcat

SEQ ID NO: 133769 - DNA, 25 bp, Mus musculus
tcacagatgaagctacacgtgggct

SEQ ID NO: 133770 - DNA, 25 bp, Mus musculus
tcacagatggtataaaggaggctct

SEQ ID NO: 133771 - DNA, 25 bp, Mus musculus
tcacagcaaggtggacctggtgccg

SEQ ID NO: 133772 - DNA, 25 bp, Mus musculus
tcacagcagagatcgacaatgtcct

SEQ ID NO: 133773 - DNA, 25 bp, Mus musculus
tcacagcagcaatttcgggtactca

SEQ ID NO: 133774 - DNA, 25 bp, Mus musculus
tcacagcagccgaggaaagaaagga

SEQ ID NO: 133775 - DNA, 25 bp, Mus musculus
tcacagcagggatcctgagtgacct

SEQ ID NO: 133776 - DNA, 25 bp, Mus musculus
tcacagcaggtttacacaggcggct

SEQ ID NO: 133777 - DNA, 25 bp, Mus musculus
tcacagccagtcagaagacagcgag

SEQ ID NO: 133778 - DNA, 25 bp, Mus musculus
tcacagcccacggacaaggctatgg

SEQ ID NO: 133779 - DNA, 25 bp, Mus musculus
tcacagcccagatgtttccagagcg

SEQ ID NO: 133780 - DNA, 25 bp, Mus musculus
tcacagcccgagatgtttgccagct

SEQ ID NO: 133781 - DNA, 25 bp, Mus musculus
tcacagcctccatggtgggtgtcac

SEQ ID NO: 133782 - DNA, 25 bp, Mus musculus
tcacagcctctctgagctggagcgc

SEQ ID NO: 133783 - DNA, 25 bp, Mus musculus
tcacagcctctgaaatgggtccaag

SEQ ID NO: 133784 - DNA, 25 bp, Mus musculus
tcacagcgatccaagtacctggcca

SEQ ID NO: 133785 - DNA, 25 bp, Mus musculus
tcacagcggcgcgatgcagattgtt

SEQ ID NO: 133786 - DNA, 25 bp, Mus musculus
tcacagctagaggaacgaaaggatc

SEQ ID NO: 133787 - DNA, 25 bp, Mus musculus
tcacagctctgatggaaggcaaaat

SEQ ID NO: 133788 - DNA, 25 bp, Mus musculus
tcacagctgtggacgcaggcgctga

SEQ ID NO: 133789 - DNA, 25 bp, Mus musculus
tcacagcttcgtggtgaccgtccat

SEQ ID NO: 133790 - DNA, 25 bp, Mus musculus
tcacaggaagagcaatggaatcttg

SEQ ID NO: 133791 - DNA, 25 bp, Mus musculus
tcacaggaagattcaaagccacagg

SEQ ID NO: 133792 - DNA, 25 bp, Mus musculus
tcacaggaccttgcagataataggg

SEQ ID NO: 133793 - DNA, 25 bp, Mus musculus
tcacaggactccaggcaatgctagc

SEQ ID NO: 133794 - DNA, 25 bp, Mus musculus
tcacaggacttcaacgaaacatggg

SEQ ID NO: 133795 - DNA, 25 bp, Mus musculus
tcacaggagatccagcagttcgcag

SEQ ID NO: 133796 - DNA, 25 bp, Mus musculus
tcacaggaggactggggaaaccaca

SEQ ID NO: 133797 - DNA, 25 bp, Mus musculus
tcacaggaggtacaaagactgacga

SEQ ID NO: 133798 - DNA, 25 bp, Mus musculus
tcacaggcgccactggtagagcatt

SEQ ID NO: 133799 - DNA, 25 bp, Mus musculus
tcacaggcgggttcaactccaagaa

SEQ ID NO: 133800 - DNA, 25 bp, Mus musculus
tcacaggctctgctgacactgaagt

SEQ ID NO: 133801 - DNA, 25 bp, Mus musculus
tcacaggctctgttgtcatgaaggt

SEQ ID NO: 133802 - DNA, 25 bp, Mus musculus
tcacagggaaccgaggaagccaatt

SEQ ID NO: 133803 - DNA, 25 bp, Mus musculus
tcacagggaccgactaaatacagga

SEQ ID NO: 133804 - DNA, 25 bp, Mus musculus
tcacagggactacaggctgaaccag

SEQ ID NO: 133805 - DNA, 25 bp, Mus musculus
tcacagggtcagacagtgcagcaga

SEQ ID NO: 133806 - DNA, 25 bp, Mus musculus
tcacagggttggactggaggacaac

SEQ ID NO: 133807 - DNA, 25 bp, Mus musculus
tcacaggtagactaatggtcggcct

SEQ ID NO: 133808 - DNA, 25 bp, Mus musculus
tcacaggtcaccgtgggaaagacat

SEQ ID NO: 133809 - DNA, 25 bp, Mus musculus
tcacaggtcagtcacttacgtggct

SEQ ID NO: 133810 - DNA, 25 bp, Mus musculus
tcacagtaaagaaccccgtgggcga

SEQ ID NO: 133811 - DNA, 25 bp, Mus musculus
tcacagtacacatgagcaaggccag

SEQ ID NO: 133812 - DNA, 25 bp, Mus musculus
tcacagtatcggacaaggctcacat

SEQ ID NO: 133813 - DNA, 25 bp, Mus musculus
tcacagtccgggttctcacaacggg

SEQ ID NO: 133814 - DNA, 25 bp, Mus musculus
tcacagtcctagagaaagtcccggt

SEQ ID NO: 133815 - DNA, 25 bp, Mus musculus
tcacagtggtgtcaggagcatttcc

SEQ ID NO: 133816 - DNA, 25 bp, Mus musculus
tcacagtggttcgagcttcagcagc

SEQ ID NO: 133817 - DNA, 25 bp, Mus musculus
tcacagtgtaccgtctggaggagag

SEQ ID NO: 133818 - DNA, 25 bp, Mus musculus
tcacagtgtagacaggcataaatgc

SEQ ID NO: 133819 - DNA, 25 bp, Mus musculus
tcacagtgtggagacctcaggaaac

SEQ ID NO: 133820 - DNA, 25 bp, Mus musculus
tcacagttcgcctcatccgttcatt

SEQ ID NO: 133821 - DNA, 25 bp, Mus musculus
tcacagttctagtggtcgccgtgcc

SEQ ID NO: 133822 - DNA, 25 bp, Mus musculus
tcacagttgaggaggcaaaacgcag

SEQ ID NO: 133823 - DNA, 25 bp, Mus musculus
tcacagttggactcattcagggagc

SEQ ID NO: 133824 - DNA, 25 bp, Mus musculus
tcacagtttaatacaaggagccgct

SEQ ID NO: 133825 - DNA, 25 bp, Mus musculus
tcacatacgtactgaaaggccacat

SEQ ID NO: 133826 - DNA, 25 bp, Mus musculus
tcacatatcgactgccggagctgga

SEQ ID NO: 133827 - DNA, 25 bp, Mus musculus
tcacatatgtggagccagatgctgg

SEQ ID NO: 133828 - DNA, 25 bp, Mus musculus
tcacatcaaggaggtatctggcact

SEQ ID NO: 133829 - DNA, 25 bp, Mus musculus
tcacatcaggtggtgttacgacccc

SEQ ID NO: 133830 - DNA, 25 bp, Mus musculus
tcacatccaagaggttaacaagcct

SEQ ID NO: 133831 - DNA, 25 bp, Mus musculus
tcacatcctggagggaacacagtcc

SEQ ID NO: 133832 - DNA, 25 bp, Mus musculus
tcacatcgtccttacagactttggg

SEQ ID NO: 133833 - DNA, 25 bp, Mus musculus
tcacatgaataaaaacttggctgct

SEQ ID NO: 133834 - DNA, 25 bp, Mus musculus
tcacatgacaacacagagcctcggt

SEQ ID NO: 133835 - DNA, 25 bp, Mus musculus
tcacatgagtgctgaacggagccat

SEQ ID NO: 133836 - DNA, 25 bp, Mus musculus
tcacatgatcctagagaactgcagc

SEQ ID NO: 133837 - DNA, 25 bp, Mus musculus
tcacatgatgtaggagatcccagca

SEQ ID NO: 133838 - DNA, 25 bp, Mus musculus
tcacatgcaggtggagggaagctct

SEQ ID NO: 133839 - DNA, 25 bp, Mus musculus
tcacatggcatagtcctgaggctca

SEQ ID NO: 133840 - DNA, 25 bp, Mus musculus
tcacatggcgggatgtacagcacat

SEQ ID NO: 133841 - DNA, 25 bp, Mus musculus
tcacatgggccatgaggcaacgagg

SEQ ID NO: 133842 - DNA, 25 bp, Mus musculus
tcacatgggtataaagattcgggcg

SEQ ID NO: 133843 - DNA, 25 bp, Mus musculus
tcacatggtggagaatcccctgaca

SEQ ID NO: 133844 - DNA, 25 bp, Mus musculus
tcacatgtaagctgtgaggaatctg

SEQ ID NO: 133845 - DNA, 25 bp, Mus musculus
tcacatgtcaagtatccgggaagcc

SEQ ID NO: 133846 - DNA, 25 bp, Mus musculus
tcacattcggctggaacctcacaag

SEQ ID NO: 133847 - DNA, 25 bp, Mus musculus
tcacattgaatgcacagaccaggaa

SEQ ID NO: 133848 - DNA, 25 bp, Mus musculus
tcacattgacaacagagacctgggc

SEQ ID NO: 133849 - DNA, 25 bp, Mus musculus
tcacatttcccaagccagaggcctt

SEQ ID NO: 133850 - DNA, 25 bp, Mus musculus
tcaccaaaacctaataacagttaca

SEQ ID NO: 133851 - DNA, 25 bp, Mus musculus
tcaccaaactgaacgacaaggagct

SEQ ID NO: 133852 - DNA, 25 bp, Mus musculus
tcaccaaaggacaagtgggcggcac

SEQ ID NO: 133853 - DNA, 25 bp, Mus musculus
tcaccaaccgtgtgtgggaggaccg

SEQ ID NO: 133854 - DNA, 25 bp, Mus musculus
tcaccaagcttgaagaccctgcgga

SEQ ID NO: 133855 - DNA, 25 bp, Mus musculus
tcaccaaggacgtgggcaacatcaa

SEQ ID NO: 133856 - DNA, 25 bp, Mus musculus
tcaccaaggagacggaacttcagca

SEQ ID NO: 133857 - DNA, 25 bp, Mus musculus
tcaccaaggcaggtactagtgctcc

SEQ ID NO: 133858 - DNA, 25 bp, Mus musculus
tcaccaagggacctaaccacatggg

SEQ ID NO: 133859 - DNA, 25 bp, Mus musculus
tcaccacagctggaagacaatggcc

SEQ ID NO: 133860 - DNA, 25 bp, Mus musculus
tcaccacaggtggaaaccagcatcg

SEQ ID NO: 133861 - DNA, 25 bp, Mus musculus
tcaccaccccttttcgatacacagc

SEQ ID NO: 133862 - DNA, 25 bp, Mus musculus
tcaccaccgtgtcgaagaacaacat

SEQ ID NO: 133863 - DNA, 25 bp, Mus musculus
tcaccacggagcagaaattggcaag

SEQ ID NO: 133864 - DNA, 25 bp, Mus musculus
tcaccactgagagagggttcacagc

SEQ ID NO: 133865 - DNA, 25 bp, Mus musculus
tcaccagaaacaccttagacctcaa

SEQ ID NO: 133866 - DNA, 25 bp, Mus musculus
tcaccagagagattaaacgacgacg

SEQ ID NO: 133867 - DNA, 25 bp, Mus musculus
tcaccagagatagacacgggcatca

SEQ ID NO: 133868 - DNA, 25 bp, Mus musculus
tcaccagaggtttcgaggagttcaa

SEQ ID NO: 133869 - DNA, 25 bp, Mus musculus
tcaccagataaacaagcggcagcgc

SEQ ID NO: 133870 - DNA, 25 bp, Mus musculus
tcaccagatggcgtcatgagaggcc

SEQ ID NO: 133871 - DNA, 25 bp, Mus musculus
tcaccagcaacccagtaagcttggt

SEQ ID NO: 133872 - DNA, 25 bp, Mus musculus
tcaccagcggaagccggcagatttt

SEQ ID NO: 133873 - DNA, 25 bp, Mus musculus
tcaccaggaccccaggacaatagtg

SEQ ID NO: 133874 - DNA, 25 bp, Mus musculus
tcaccaggcctagggaaactgttgg

SEQ ID NO: 133875 - DNA, 25 bp, Mus musculus
tcaccaggtatggtagctcatgcct

SEQ ID NO: 133876 - DNA, 25 bp, Mus musculus
tcaccaggtgagtggatcagccctc

SEQ ID NO: 133877 - DNA, 25 bp, Mus musculus
tcaccagtgatccaaggcctcaggt

SEQ ID NO: 133878 - DNA, 25 bp, Mus musculus
tcaccagtggctcgaaggcaacttg

SEQ ID NO: 133879 - DNA, 25 bp, Mus musculus
tcaccagtgggatgcagcagatgac

SEQ ID NO: 133880 - DNA, 25 bp, Mus musculus
tcaccagttttggaggcagcgacga

SEQ ID NO: 133881 - DNA, 25 bp, Mus musculus
tcaccatagagaaggagtcgggctg

SEQ ID NO: 133882 - DNA, 25 bp, Mus musculus
tcaccatcagctaaagggaccagtc

SEQ ID NO: 133883 - DNA, 25 bp, Mus musculus
tcaccatccgtaccatttaaagcag

SEQ ID NO: 133884 - DNA, 25 bp, Mus musculus
tcaccatgaacccagactagctgtg

SEQ ID NO: 133885 - DNA, 25 bp, Mus musculus
tcaccatgagtagcgccgtgttagt

SEQ ID NO: 133886 - DNA, 25 bp, Mus musculus
tcaccatgccgaagctcagagtgct

SEQ ID NO: 133887 - DNA, 25 bp, Mus musculus
tcaccatggaccaggagacagcact

SEQ ID NO: 133888 - DNA, 25 bp, Mus musculus
tcaccatggctatcgagacagtgcg

SEQ ID NO: 133889 - DNA, 25 bp, Mus musculus
tcaccatgggtcagaagaggttcca

SEQ ID NO: 133890 - DNA, 25 bp, Mus musculus
tcaccatgggttggacgtcttccag

SEQ ID NO: 133891 - DNA, 25 bp, Mus musculus
tcaccatggtgcaaaagtcagacgg

SEQ ID NO: 133892 - DNA, 25 bp, Mus musculus
tcaccatgtcggaagaacagaggca

SEQ ID NO: 133893 - DNA, 25 bp, Mus musculus
tcaccattagcagagctggaggaca

SEQ ID NO: 133894 - DNA, 25 bp, Mus musculus
tcaccattcagtgtgcgggaagcga

SEQ ID NO: 133895 - DNA, 25 bp, Mus musculus
tcaccattcggtaggaacagcggct

SEQ ID NO: 133896 - DNA, 25 bp, Mus musculus
tcacccaaggaaaagctttgcgggc

SEQ ID NO: 133897 - DNA, 25 bp, Mus musculus
tcacccaggagttgaaatcgatccc

SEQ ID NO: 133898 - DNA, 25 bp, Mus musculus
tcacccagtgatgaaatggacagca

SEQ ID NO: 133899 - DNA, 25 bp, Mus musculus
tcacccatggcaagtgtcgcatatg

SEQ ID NO: 133900 - DNA, 25 bp, Mus musculus
tcaccccagtggcaatagtgctaag

SEQ ID NO: 133901 - DNA, 25 bp, Mus musculus
tcaccccgtgtgtttgccagacaag

SEQ ID NO: 133902 - DNA, 25 bp, Mus musculus
tcacccgccggggccgcaggcctgt

SEQ ID NO: 133903 - DNA, 25 bp, Mus musculus
tcacccgctccaaggcagaggagct

SEQ ID NO: 133904 - DNA, 25 bp, Mus musculus
tcaccctcaagtgggtggacagtga

SEQ ID NO: 133905 - DNA, 25 bp, Mus musculus
tcaccctgggttcagattgctgccc

SEQ ID NO: 133906 - DNA, 25 bp, Mus musculus
tcacccttgggtacagagtcttgga

SEQ ID NO: 133907 - DNA, 25 bp, Mus musculus
tcacccttgtggagccaaggctact

SEQ ID NO: 133908 - DNA, 25 bp, Mus musculus
tcaccgaagccagggaacctttagc

SEQ ID NO: 133909 - DNA, 25 bp, Mus musculus
tcaccgaaggctacaatgggaccat

SEQ ID NO: 133910 - DNA, 25 bp, Mus musculus
tcaccgaagtgaatttgaacaacat

SEQ ID NO: 133911 - DNA, 25 bp, Mus musculus
tcaccgaatagaggaacgtagccag

SEQ ID NO: 133912 - DNA, 25 bp, Mus musculus
tcaccgaatcggacagtgcagttct

SEQ ID NO: 133913 - DNA, 25 bp, Mus musculus
tcaccgaattccgagaagccgggag

SEQ ID NO: 133914 - DNA, 25 bp, Mus musculus
tcaccgacggcttagggtagcacgt

SEQ ID NO: 133915 - DNA, 25 bp, Mus musculus
tcaccgagagaagaactggaaccgg

SEQ ID NO: 133916 - DNA, 25 bp, Mus musculus
tcaccgagctgtatgacgtgcaggc

SEQ ID NO: 133917 - DNA, 25 bp, Mus musculus
tcaccgaggaagacagcaggattta

SEQ ID NO: 133918 - DNA, 25 bp, Mus musculus
tcaccgatgacaatagcctcctcag

SEQ ID NO: 133919 - DNA, 25 bp, Mus musculus
tcaccgatgacgacctgcatgtggc

SEQ ID NO: 133920 - DNA, 25 bp, Mus musculus
tcaccgatgcaggattgtgcagagc

SEQ ID NO: 133921 - DNA, 25 bp, Mus musculus
tcaccgcaggtggacatggtacttg

SEQ ID NO: 133922 - DNA, 25 bp, Mus musculus
tcaccgccatgggttagagaggcag

SEQ ID NO: 133923 - DNA, 25 bp, Mus musculus
tcaccgctgatgcaaggatagtcat

SEQ ID NO: 133924 - DNA, 25 bp, Mus musculus
tcaccgctgtggaggaccagtatta

SEQ ID NO: 133925 - DNA, 25 bp, Mus musculus
tcaccgctgtggctgcaggaaagcc

SEQ ID NO: 133926 - DNA, 25 bp, Mus musculus
tcaccggacagtgctttgagaacac

SEQ ID NO: 133927 - DNA, 25 bp, Mus musculus
tcaccggagacagatcgtagaggcg

SEQ ID NO: 133928 - DNA, 25 bp, Mus musculus
tcaccggaggccaagtgctaaagcc

SEQ ID NO: 133929 - DNA, 25 bp, Mus musculus
tcaccggcgcctcaagtatatatcc

SEQ ID NO: 133930 - DNA, 25 bp, Mus musculus
tcaccggtgtcaagaaggagagtca

SEQ ID NO: 133931 - DNA, 25 bp, Mus musculus
tcaccgtaagagactgtaacagcat

SEQ ID NO: 133932 - DNA, 25 bp, Mus musculus
tcaccgtacagcacaagaagctgcg

SEQ ID NO: 133933 - DNA, 25 bp, Mus musculus
tcaccgtaggtgaactctgggcctt

SEQ ID NO: 133934 - DNA, 25 bp, Mus musculus
tcaccgtcagccttagcgtcactat

SEQ ID NO: 133935 - DNA, 25 bp, Mus musculus
tcaccgtgaaggtcatgaaggccca

SEQ ID NO: 133936 - DNA, 25 bp, Mus musculus
tcaccgtgaggtcgaatttcagcac

SEQ ID NO: 133937 - DNA, 25 bp, Mus musculus
tcaccgtgctgattgggaagccctt

SEQ ID NO: 133938 - DNA, 25 bp, Mus musculus
tcaccgtggaatggatgggcctcac

SEQ ID NO: 133939 - DNA, 25 bp, Mus musculus
tcaccgtggaggaaggaaagtctgt

SEQ ID NO: 133940 - DNA, 25 bp, Mus musculus
tcaccgtggcccagaagagagtggc

SEQ ID NO: 133941 - DNA, 25 bp, Mus musculus
tcaccgtgggcagcataagcatctc

SEQ ID NO: 133942 - DNA, 25 bp, Mus musculus
tcacctacatcgagggcgtctgcgt

SEQ ID NO: 133943 - DNA, 25 bp, Mus musculus
tcacctactggagcgtcttcttcag

SEQ ID NO: 133944 - DNA, 25 bp, Mus musculus
tcacctagcaaagaggatggcgcca

SEQ ID NO: 133945 - DNA, 25 bp, Mus musculus
tcacctatagcctatgagagaggaa

SEQ ID NO: 133946 - DNA, 25 bp, Mus musculus
tcacctatgagaggcgggaactgtc

SEQ ID NO: 133947 - DNA, 25 bp, Mus musculus
tcacctatgggccagtcgaaaagca

SEQ ID NO: 133948 - DNA, 25 bp, Mus musculus
tcacctattgtctgatagccctggg

SEQ ID NO: 133949 - DNA, 25 bp, Mus musculus
tcacctcacacgtttgggcagtggg

SEQ ID NO: 133950 - DNA, 25 bp, Mus musculus
tcacctcagagcgaagtgtgcctgc

SEQ ID NO: 133951 - DNA, 25 bp, Mus musculus
tcacctcagggaacagggatcaggt

SEQ ID NO: 133952 - DNA, 25 bp, Mus musculus
tcacctccaaggactgggcttagag

SEQ ID NO: 133953 - DNA, 25 bp, Mus musculus
tcacctccgcggagcttgtgttgct

SEQ ID NO: 133954 - DNA, 25 bp, Mus musculus
tcacctccgggctaaattctggctt

SEQ ID NO: 133955 - DNA, 25 bp, Mus musculus
tcacctcgctgctggtggaaccacg

SEQ ID NO: 133956 - DNA, 25 bp, Mus musculus
tcacctcggataataaagacacatc

SEQ ID NO: 133957 - DNA, 25 bp, Mus musculus
tcacctctacagacattgccgacgt

SEQ ID NO: 133958 - DNA, 25 bp, Mus musculus
tcacctctacaggaatcagacttgg

SEQ ID NO: 133959 - DNA, 25 bp, Mus musculus
tcacctctgacgacaaagttgcgcc

SEQ ID NO: 133960 - DNA, 25 bp, Mus musculus
tcacctcttttcatgccgtttggca

SEQ ID NO: 133961 - DNA, 25 bp, Mus musculus
tcacctgattgcagttgacaaccag

SEQ ID NO: 133962 - DNA, 25 bp, Mus musculus
tcacctgcaagtggatgaagttccg

SEQ ID NO: 133963 - DNA, 25 bp, Mus musculus
tcacctgcaggtgctctagaaactt

SEQ ID NO: 133964 - DNA, 25 bp, Mus musculus
tcacctgccaaacggaaggagcatg

SEQ ID NO: 133965 - DNA, 25 bp, Mus musculus
tcacctggaaagactagaggctcaa

SEQ ID NO: 133966 - DNA, 25 bp, Mus musculus
tcacctggaccagcttgacttgggt

SEQ ID NO: 133967 - DNA, 25 bp, Mus musculus
tcacctggagcagaatcgggttaag

SEQ ID NO: 133968 - DNA, 25 bp, Mus musculus
tcacctggagcagagcgagtcgctc

SEQ ID NO: 133969 - DNA, 25 bp, Mus musculus
tcacctgggaaaatcgtctgtaatg

SEQ ID NO: 133970 - DNA, 25 bp, Mus musculus
tcacctgggcaaggatgacttcgca

SEQ ID NO: 133971 - DNA, 25 bp, Mus musculus
tcacctgggtactggcatggaacgg

SEQ ID NO: 133972 - DNA, 25 bp, Mus musculus
tcacctggtatatgtcctggagccc

SEQ ID NO: 133973 - DNA, 25 bp, Mus musculus
tcacctgtataaaatggaccccact

SEQ ID NO: 133974 - DNA, 25 bp, Mus musculus
tcaccttcaggtcgcttggatcaat

SEQ ID NO: 133975 - DNA, 25 bp, Mus musculus
tcaccttgaaggatggctctgtgct

SEQ ID NO: 133976 - DNA, 25 bp, Mus musculus
tcaccttggatgatgggctgctcat

SEQ ID NO: 133977 - DNA, 25 bp, Mus musculus
tcacctttcatctttcatggacact

SEQ ID NO: 133978 - DNA, 25 bp, Mus musculus
tcacgaaaatgaaatcgcgcagagt

SEQ ID NO: 133979 - DNA, 25 bp, Mus musculus
tcacgaaagcctgcaaagagctgtt

SEQ ID NO: 133980 - DNA, 25 bp, Mus musculus
tcacgaataaggagaacgaggcaca

SEQ ID NO: 133981 - DNA, 25 bp, Mus musculus
tcacgactagaagcgctctggctgc

SEQ ID NO: 133982 - DNA, 25 bp, Mus musculus
tcacgactgagttggagcggctcca

SEQ ID NO: 133983 - DNA, 25 bp, Mus musculus
tcacgactttgaaggacagccgtcc

SEQ ID NO: 133984 - DNA, 25 bp, Mus musculus
tcacgagaacgcaagaggaggactc

SEQ ID NO: 133985 - DNA, 25 bp, Mus musculus
tcacgagcagaaagaagtcgggcgt

SEQ ID NO: 133986 - DNA, 25 bp, Mus musculus
tcacgaggaccctagagtggtggct

SEQ ID NO: 133987 - DNA, 25 bp, Mus musculus
tcacgagggcggaaactgaatcctg

SEQ ID NO: 133988 - DNA, 25 bp, Mus musculus
tcacgatacgagaggagatgccctt

SEQ ID NO: 133989 - DNA, 25 bp, Mus musculus
tcacgatcccgagagccgaacggga

SEQ ID NO: 133990 - DNA, 25 bp, Mus musculus
tcacgatgtctgaccggaaggcagt

SEQ ID NO: 133991 - DNA, 25 bp, Mus musculus
tcacgcacatcgaagcccagaacaa

SEQ ID NO: 133992 - DNA, 25 bp, Mus musculus
tcacgcagagatggccccggacgag

SEQ ID NO: 133993 - DNA, 25 bp, Mus musculus
tcacgcagcctcaggtagacttggg

SEQ ID NO: 133994 - DNA, 25 bp, Mus musculus
tcacgcagttagctgggttatacct

SEQ ID NO: 133995 - DNA, 25 bp, Mus musculus
tcacgcatgcgctgctcttctgcgg

SEQ ID NO: 133996 - DNA, 25 bp, Mus musculus
tcacgcggctgaaaggagttaaagc

SEQ ID NO: 133997 - DNA, 25 bp, Mus musculus
tcacgcgggcttcagtcaagaactt

SEQ ID NO: 133998 - DNA, 25 bp, Mus musculus
tcacgctagagttactgcgggagcg

SEQ ID NO: 133999 - DNA, 25 bp, Mus musculus
tcacgctgcggtgacattgtctacg

SEQ ID NO: 134000 - DNA, 25 bp, Mus musculus
tcacgctgttcggtggcaagccaat

SEQ ID NO: 134001 - DNA, 25 bp, Mus musculus
tcacgcttcttgatgcccaccagaa

SEQ ID NO: 134002 - DNA, 25 bp, Mus musculus
tcacgcttgctattttagtgctgcg

SEQ ID NO: 134003 - DNA, 25 bp, Mus musculus
tcacggacagctttggccgacaaca

SEQ ID NO: 134004 - DNA, 25 bp, Mus musculus
tcacggagactgagaaactttgtct

SEQ ID NO: 134005 - DNA, 25 bp, Mus musculus
tcacggagattgagcctttggaccc

SEQ ID NO: 134006 - DNA, 25 bp, Mus musculus
tcacggagcaggtcttcaacgaggc

SEQ ID NO: 134007 - DNA, 25 bp, Mus musculus
tcacggatgctccttgtccaagtat

SEQ ID NO: 134008 - DNA, 25 bp, Mus musculus
tcacggatgtgtcactgaggacccc

SEQ ID NO: 134009 - DNA, 25 bp, Mus musculus
tcacggcaatggcaaggtactccca

SEQ ID NO: 134010 - DNA, 25 bp, Mus musculus
tcacggcagctccaagagttgcggc

SEQ ID NO: 134011 - DNA, 25 bp, Mus musculus
tcacggcctctcgaatcgatatctg

SEQ ID NO: 134012 - DNA, 25 bp, Mus musculus
tcacggctcagcaaggtctattccc

SEQ ID NO: 134013 - DNA, 25 bp, Mus musculus
tcacgggacacgtaaataagcggcg

SEQ ID NO: 134014 - DNA, 25 bp, Mus musculus
tcacgggactcacataagctttgct

SEQ ID NO: 134015 - DNA, 25 bp, Mus musculus
tcacgggagacgtagtccgagcgaa

SEQ ID NO: 134016 - DNA, 25 bp, Mus musculus
tcacgggccataagaagagaggttt

SEQ ID NO: 134017 - DNA, 25 bp, Mus musculus
tcacgggctggcactgtatgagcgc

SEQ ID NO: 134018 - DNA, 25 bp, Mus musculus
tcacgggtattctaaggtcaacagc

SEQ ID NO: 134019 - DNA, 25 bp, Mus musculus
tcacgggtgacatgaaggaattcgc

SEQ ID NO: 134020 - DNA, 25 bp, Mus musculus
tcacggtgctgattcgaaacaagag

SEQ ID NO: 134021 - DNA, 25 bp, Mus musculus
tcacggtggacagctttggaaacta

SEQ ID NO: 134022 - DNA, 25 bp, Mus musculus
tcacgtactccgaattcatgcagca

SEQ ID NO: 134023 - DNA, 25 bp, Mus musculus
tcacgtcagaaacgcaccagtggct

SEQ ID NO: 134024 - DNA, 25 bp, Mus musculus
tcacgtcagcagaggagctagagcg

SEQ ID NO: 134025 - DNA, 25 bp, Mus musculus
tcacgtcctttgtgggtgctgccct

SEQ ID NO: 134026 - DNA, 25 bp, Mus musculus
tcacgtctgttaactgctttggaaa

SEQ ID NO: 134027 - DNA, 25 bp, Mus musculus
tcacgtgatgttgaaaggcttcagc

SEQ ID NO: 134028 - DNA, 25 bp, Mus musculus
tcacgtgtagttctgcagccatccg

SEQ ID NO: 134029 - DNA, 25 bp, Mus musculus
tcactaaaagagttccagggatctg

SEQ ID NO: 134030 - DNA, 25 bp, Mus musculus
tcactaaaagttaccaaggctctgg

SEQ ID NO: 134031 - DNA, 25 bp, Mus musculus
tcactaaagcacagggtcgacagac

SEQ ID NO: 134032 - DNA, 25 bp, Mus musculus
tcactaacagccgttgccgagagat

SEQ ID NO: 134033 - DNA, 25 bp, Mus musculus
tcactaacgcaacagcagacagcag

SEQ ID NO: 134034 - DNA, 25 bp, Mus musculus
tcactaaggagtagctgccagcgct

SEQ ID NO: 134035 - DNA, 25 bp, Mus musculus
tcactagacgggagatgctgccaag

SEQ ID NO: 134036 - DNA, 25 bp, Mus musculus
tcactagcatgtctacggagagcgg

SEQ ID NO: 134037 - DNA, 25 bp, Mus musculus
tcactatagaagcagatcgggctcc

SEQ ID NO: 134038 - DNA, 25 bp, Mus musculus
tcactatcgactatggaccctttgg

SEQ ID NO: 134039 - DNA, 25 bp, Mus musculus
tcactatgctgcgacggaaaccgac

SEQ ID NO: 134040 - DNA, 25 bp, Mus musculus
tcactatggacttcaagcaccggca

SEQ ID NO: 134041 - DNA, 25 bp, Mus musculus
tcactcaaagaggaagttggtgccc

SEQ ID NO: 134042 - DNA, 25 bp, Mus musculus
tcactcaatggagtggttccacaga

SEQ ID NO: 134043 - DNA, 25 bp, Mus musculus
tcactcacaacacagtcagaggctg

SEQ ID NO: 134044 - DNA, 25 bp, Mus musculus
tcactcaccggccaaggcctggaga

SEQ ID NO: 134045 - DNA, 25 bp, Mus musculus
tcactcagtacatcgacgggcaggg

SEQ ID NO: 134046 - DNA, 25 bp, Mus musculus
tcactcattcttcatgggcattcga

SEQ ID NO: 134047 - DNA, 25 bp, Mus musculus
tcactcccgggatgtacactgctgg

SEQ ID NO: 134048 - DNA, 25 bp, Mus musculus
tcactccctcggcatgctggaagct

SEQ ID NO: 134049 - DNA, 25 bp, Mus musculus
tcactccgggcaggaacctttgaga

SEQ ID NO: 134050 - DNA, 25 bp, Mus musculus
tcactcctgtgtatgaggctcgggc

SEQ ID NO: 134051 - DNA, 25 bp, Mus musculus
tcactcgaaacagaaagaaggccat

SEQ ID NO: 134052 - DNA, 25 bp, Mus musculus
tcactcgacttctgcggcgatatag

SEQ ID NO: 134053 - DNA, 25 bp, Mus musculus
tcactcgagaactggctaagcggct

SEQ ID NO: 134054 - DNA, 25 bp, Mus musculus
tcactcgagtctacacaggattcta

SEQ ID NO: 134055 - DNA, 25 bp, Mus musculus
tcactctcactgtgtctaccagcag

SEQ ID NO: 134056 - DNA, 25 bp, Mus musculus
tcactctgcaaacctgaacggtgtt

SEQ ID NO: 134057 - DNA, 25 bp, Mus musculus
tcactctggccatgaaccgagatgg

SEQ ID NO: 134058 - DNA, 25 bp, Mus musculus
tcactctgggagtactagggccacc

SEQ ID NO: 134059 - DNA, 25 bp, Mus musculus
tcactctgtggagacaccttatggc

SEQ ID NO: 134060 - DNA, 25 bp, Mus musculus
tcactgaaaaccgtggacttgcaca

SEQ ID NO: 134061 - DNA, 25 bp, Mus musculus
tcactgaaaatagtgggatcgacac

SEQ ID NO: 134062 - DNA, 25 bp, Mus musculus
tcactgaatcgagtcgctgccctgg

SEQ ID NO: 134063 - DNA, 25 bp, Mus musculus
tcactgacaaaactgtgctggacat

SEQ ID NO: 134064 - DNA, 25 bp, Mus musculus
tcactgacaaacaagagggacctgc

SEQ ID NO: 134065 - DNA, 25 bp, Mus musculus
tcactgacagcaaagaggttggcca

SEQ ID NO: 134066 - DNA, 25 bp, Mus musculus
tcactgaccaggaagcgctgacgga

SEQ ID NO: 134067 - DNA, 25 bp, Mus musculus
tcactgaccctgtcctggtatggct

SEQ ID NO: 134068 - DNA, 25 bp, Mus musculus
tcactgacctgcaagaacagggtcc

SEQ ID NO: 134069 - DNA, 25 bp, Mus musculus
tcactgagaagatccggaaagccca

SEQ ID NO: 134070 - DNA, 25 bp, Mus musculus
tcactgagatgggaaggcagccgtc

SEQ ID NO: 134071 - DNA, 25 bp, Mus musculus
tcactgagcaaaaggtgagggtctc

SEQ ID NO: 134072 - DNA, 25 bp, Mus musculus
tcactgagcgacagctaccaggagg

SEQ ID NO: 134073 - DNA, 25 bp, Mus musculus
tcactgagctactgatggtggcgct

SEQ ID NO: 134074 - DNA, 25 bp, Mus musculus
tcactgaggagcaggtccggagctt

SEQ ID NO: 134075 - DNA, 25 bp, Mus musculus
tcactgaggcactgatgtaggcccc

SEQ ID NO: 134076 - DNA, 25 bp, Mus musculus
tcactgaggcctacgggagtctggt

SEQ ID NO: 134077 - DNA, 25 bp, Mus musculus
tcactgagggattagaacgagtcct

SEQ ID NO: 134078 - DNA, 25 bp, Mus musculus
tcactgagtggatgaaaggagcaac

SEQ ID NO: 134079 - DNA, 25 bp, Mus musculus
tcactgatggagagcccaagccctg

SEQ ID NO: 134080 - DNA, 25 bp, Mus musculus
tcactgcaaagtatgtcgaccaccg

SEQ ID NO: 134081 - DNA, 25 bp, Mus musculus
tcactgcaagctaaggattgtcccg

SEQ ID NO: 134082 - DNA, 25 bp, Mus musculus
tcactgcagcatgggtacagcctaa

SEQ ID NO: 134083 - DNA, 25 bp, Mus musculus
tcactgcaggcaggtgtcacacttg

SEQ ID NO: 134084 - DNA, 25 bp, Mus musculus
tcactgcagtcccaaggaaagagca

SEQ ID NO: 134085 - DNA, 25 bp, Mus musculus
tcactgcatacctggttcccctgct

SEQ ID NO: 134086 - DNA, 25 bp, Mus musculus
tcactgccagtgaatgactctgtcc

SEQ ID NO: 134087 - DNA, 25 bp, Mus musculus
tcactgccgccctggtgaaggtgga

SEQ ID NO: 134088 - DNA, 25 bp, Mus musculus
tcactgcctagaacattgtttccca

SEQ ID NO: 134089 - DNA, 25 bp, Mus musculus
tcactgcgctcgttctgatttggga

SEQ ID NO: 134090 - DNA, 25 bp, Mus musculus
tcactgctcctgcagacacaagggc

SEQ ID NO: 134091 - DNA, 25 bp, Mus musculus
tcactgctgcacagggaagccaaga

SEQ ID NO: 134092 - DNA, 25 bp, Mus musculus
tcactgctgcgttaccaagaggaga

SEQ ID NO: 134093 - DNA, 25 bp, Mus musculus
tcactgctggtggttgacattccgg

SEQ ID NO: 134094 - DNA, 25 bp, Mus musculus
tcactgctgtcacaaacggatcaca

SEQ ID NO: 134095 - DNA, 25 bp, Mus musculus
tcactggaccagatatttgagaccc

SEQ ID NO: 134096 - DNA, 25 bp, Mus musculus
tcactggacgatactcaaaccggct

SEQ ID NO: 134097 - DNA, 25 bp, Mus musculus
tcactggactctagggactgggatc

SEQ ID NO: 134098 - DNA, 25 bp, Mus musculus
tcactggagatctgctgagggccct

SEQ ID NO: 134099 - DNA, 25 bp, Mus musculus
tcactggcaataagaagcaacctgt

SEQ ID NO: 134100 - DNA, 25 bp, Mus musculus
tcactggcacactaacgtcggactg

SEQ ID NO: 134101 - DNA, 25 bp, Mus musculus
tcactggccgcagctgacttggtag

SEQ ID NO: 134102 - DNA, 25 bp, Mus musculus
tcactggccgccacatggttcgaga

SEQ ID NO: 134103 - DNA, 25 bp, Mus musculus
tcactggccggaatgaagtatcacg

SEQ ID NO: 134104 - DNA, 25 bp, Mus musculus
tcactggctatgttcgcttcctgaa

SEQ ID NO: 134105 - DNA, 25 bp, Mus musculus
tcactgggaactgccaataaagttt

SEQ ID NO: 134106 - DNA, 25 bp, Mus musculus
tcactgggagtgacatctttaataa

SEQ ID NO: 134107 - DNA, 25 bp, Mus musculus
tcactgggcacagaggctgaactgc

SEQ ID NO: 134108 - DNA, 25 bp, Mus musculus
tcactgggcctgcaggtcaaaagcc

SEQ ID NO: 134109 - DNA, 25 bp, Mus musculus
tcactgggcttggtagcagaccgac

SEQ ID NO: 134110 - DNA, 25 bp, Mus musculus
tcactgggtgccaaggagctgtgca

SEQ ID NO: 134111 - DNA, 25 bp, Mus musculus
tcactgggtgtgtcttcctgcacag

SEQ ID NO: 134112 - DNA, 25 bp, Mus musculus
tcactggtacaaagagggcagccgc

SEQ ID NO: 134113 - DNA, 25 bp, Mus musculus
tcactggtacctgggcttgcctgag

SEQ ID NO: 134114 - DNA, 25 bp, Mus musculus
tcactggtgcagtcgaaccggatcc

SEQ ID NO: 134115 - DNA, 25 bp, Mus musculus
tcactgtaacgaaggcatggccagc

SEQ ID NO: 134116 - DNA, 25 bp, Mus musculus
tcactgtacaagaggctgacctgcg

SEQ ID NO: 134117 - DNA, 25 bp, Mus musculus
tcactgtagcgagtgtgacgcagcc

SEQ ID NO: 134118 - DNA, 25 bp, Mus musculus
tcactgtcctcacaaagggcgagcc

SEQ ID NO: 134119 - DNA, 25 bp, Mus musculus
tcactgtgcctgtgactcgaggagg

SEQ ID NO: 134120 - DNA, 25 bp, Mus musculus
tcactgtgctggaggttttcctagc

SEQ ID NO: 134121 - DNA, 25 bp, Mus musculus
tcactgtgctgggtgcgaatacgca

SEQ ID NO: 134122 - DNA, 25 bp, Mus musculus
tcactgtggcagagattccgggact

SEQ ID NO: 134123 - DNA, 25 bp, Mus musculus
tcactgttacagaataagctggctc

SEQ ID NO: 134124 - DNA, 25 bp, Mus musculus
tcacttaagactataggccacaggg

SEQ ID NO: 134125 - DNA, 25 bp, Mus musculus
tcacttaagatagacgacaccccag

SEQ ID NO: 134126 - DNA, 25 bp, Mus musculus
tcacttacagcaacagaagggcggc

SEQ ID NO: 134127 - DNA, 25 bp, Mus musculus
tcacttatgaattggacttgagcaa

SEQ ID NO: 134128 - DNA, 25 bp, Mus musculus
tcacttcaataaggaatacgggacc

SEQ ID NO: 134129 - DNA, 25 bp, Mus musculus
tcacttcagagaaacgtgcctggag

SEQ ID NO: 134130 - DNA, 25 bp, Mus musculus
tcacttcagggactgtcagcaagaa

SEQ ID NO: 134131 - DNA, 25 bp, Mus musculus
tcacttcagttctaaaggatttgct

SEQ ID NO: 134132 - DNA, 25 bp, Mus musculus
tcacttccaagagacgtggctcgca

SEQ ID NO: 134133 - DNA, 25 bp, Mus musculus
tcacttccatgatgaactctctgag

SEQ ID NO: 134134 - DNA, 25 bp, Mus musculus
tcacttcctgctggagttcctgaga

SEQ ID NO: 134135 - DNA, 25 bp, Mus musculus
tcacttcctggatgcagggcagtac

SEQ ID NO: 134136 - DNA, 25 bp, Mus musculus
tcacttcgatgtgctggaggacgtg

SEQ ID NO: 134137 - DNA, 25 bp, Mus musculus
tcacttcgcggaggtatggctacgg

SEQ ID NO: 134138 - DNA, 25 bp, Mus musculus
tcacttcgtggtagatatgaagccc

SEQ ID NO: 134139 - DNA, 25 bp, Mus musculus
tcacttctctgaccgcggtgtccgg

SEQ ID NO: 134140 - DNA, 25 bp, Mus musculus
tcacttctttgacacgtacctgctc

SEQ ID NO: 134141 - DNA, 25 bp, Mus musculus
tcacttgccagcgtctcaaaggaag

SEQ ID NO: 134142 - DNA, 25 bp, Mus musculus
tcacttgcgtgggtagacttcagaa

SEQ ID NO: 134143 - DNA, 25 bp, Mus musculus
tcacttggcaatgatgagacagaca

SEQ ID NO: 134144 - DNA, 25 bp, Mus musculus
tcacttggccaatcacgacgaactc

SEQ ID NO: 134145 - DNA, 25 bp, Mus musculus
tcacttgggaggagtcaatgcagct

SEQ ID NO: 134146 - DNA, 25 bp, Mus musculus
tcacttgtctcaggaagacagagag

SEQ ID NO: 134147 - DNA, 25 bp, Mus musculus
tcactttaggctgcgggaacatggc

SEQ ID NO: 134148 - DNA, 25 bp, Mus musculus
tcactttccaaacggaggccagcgt

SEQ ID NO: 134149 - DNA, 25 bp, Mus musculus
tcactttggctggaccgactaatgc

SEQ ID NO: 134150 - DNA, 25 bp, Mus musculus
tcagaaaagatctccctgggcagga

SEQ ID NO: 134151 - DNA, 25 bp, Mus musculus
tcagaaaatcagagaccggctgcct

SEQ ID NO: 134152 - DNA, 25 bp, Mus musculus
tcagaaaattatgacgcctgcggac

SEQ ID NO: 134153 - DNA, 25 bp, Mus musculus
tcagaaacaaagatggcagagcacg

SEQ ID NO: 134154 - DNA, 25 bp, Mus musculus
tcagaaacagagttgggtcaggcct

SEQ ID NO: 134155 - DNA, 25 bp, Mus musculus
tcagaaacagggtccactggtgccc

SEQ ID NO: 134156 - DNA, 25 bp, Mus musculus
tcagaaaccagtatagtgtcaccct

SEQ ID NO: 134157 - DNA, 25 bp, Mus musculus
tcagaaactacgtggagaatcggcc

SEQ ID NO: 134158 - DNA, 25 bp, Mus musculus
tcagaaactgatggtccaggcggca

SEQ ID NO: 134159 - DNA, 25 bp, Mus musculus
tcagaaagaccggatgaggaagacc

SEQ ID NO: 134160 - DNA, 25 bp, Mus musculus
tcagaaagacctctgcgagagtagc

SEQ ID NO: 134161 - DNA, 25 bp, Mus musculus
tcagaaagcatcctagggagggacc

SEQ ID NO: 134162 - DNA, 25 bp, Mus musculus
tcagaaagcctcctagataagacgt

SEQ ID NO: 134163 - DNA, 25 bp, Mus musculus
tcagaaaggagtttgacccgaagct

SEQ ID NO: 134164 - DNA, 25 bp, Mus musculus
tcagaaaggtgtctcagtgcccaga

SEQ ID NO: 134165 - DNA, 25 bp, Mus musculus
tcagaaagtagccagatggagcccg

SEQ ID NO: 134166 - DNA, 25 bp, Mus musculus
tcagaaagtcacgaatgccatgcgg

SEQ ID NO: 134167 - DNA, 25 bp, Mus musculus
tcagaaagtggcgtttatatgcgat

SEQ ID NO: 134168 - DNA, 25 bp, Mus musculus
tcagaaagttcgaggtgtggacatc

SEQ ID NO: 134169 - DNA, 25 bp, Mus musculus
tcagaaataccttccagcctgtggc

SEQ ID NO: 134170 - DNA, 25 bp, Mus musculus
tcagaaatcctgatgatgggccacc

SEQ ID NO: 134171 - DNA, 25 bp, Mus musculus
tcagaaatttgtgccgcaggcggca

SEQ ID NO: 134172 - DNA, 25 bp, Mus musculus
tcagaacaataacaagaccagtggg

SEQ ID NO: 134173 - DNA, 25 bp, Mus musculus
tcagaacacacagccatctcaggag

SEQ ID NO: 134174 - DNA, 25 bp, Mus musculus
tcagaacacggtcctcacatgggtg

SEQ ID NO: 134175 - DNA, 25 bp, Mus musculus
tcagaacactgccacagatgtaagg

SEQ ID NO: 134176 - DNA, 25 bp, Mus musculus
tcagaacagacaataggtgccaagg

SEQ ID NO: 134177 - DNA, 25 bp, Mus musculus
tcagaacagagccacgggactggta

SEQ ID NO: 134178 - DNA, 25 bp, Mus musculus
tcagaacagcaacatagaccagagc

SEQ ID NO: 134179 - DNA, 25 bp, Mus musculus
tcagaacaggctcccaatgaggact

SEQ ID NO: 134180 - DNA, 25 bp, Mus musculus
tcagaaccagcacacgtttgaggct

SEQ ID NO: 134181 - DNA, 25 bp, Mus musculus
tcagaaccagtgacagctcaaagag

SEQ ID NO: 134182 - DNA, 25 bp, Mus musculus
tcagaaccccagtgcagaagcggtg

SEQ ID NO: 134183 - DNA, 25 bp, Mus musculus
tcagaacccgtatgtggcagctctc

SEQ ID NO: 134184 - DNA, 25 bp, Mus musculus
tcagaaccggcatgctgtcctgctt

SEQ ID NO: 134185 - DNA, 25 bp, Mus musculus
tcagaaccgtatatttgagcccaag

SEQ ID NO: 134186 - DNA, 25 bp, Mus musculus
tcagaaccgtctatgagtagtcagg

SEQ ID NO: 134187 - DNA, 25 bp, Mus musculus
tcagaaccgttacgatgggcaggta

SEQ ID NO: 134188 - DNA, 25 bp, Mus musculus
tcagaacctaggcaatgtccgaatc

SEQ ID NO: 134189 - DNA, 25 bp, Mus musculus
tcagaacctggctcctgggacgaac

SEQ ID NO: 134190 - DNA, 25 bp, Mus musculus
tcagaacgggacgtatgcaggcccg

SEQ ID NO: 134191 - DNA, 25 bp, Mus musculus
tcagaacggtaagcacgacgatctc

SEQ ID NO: 134192 - DNA, 25 bp, Mus musculus
tcagaactacactcgcggattgcag

SEQ ID NO: 134193 - DNA, 25 bp, Mus musculus
tcagaactgatgtatcagcccaagg

SEQ ID NO: 134194 - DNA, 25 bp, Mus musculus
tcagaactggcgatcaggatagtac

SEQ ID NO: 134195 - DNA, 25 bp, Mus musculus
tcagaactggcgtcttccagagagg

SEQ ID NO: 134196 - DNA, 25 bp, Mus musculus
tcagaagaaactgcaccggaagtgc

SEQ ID NO: 134197 - DNA, 25 bp, Mus musculus
tcagaagaatccatcgaatacccga

SEQ ID NO: 134198 - DNA, 25 bp, Mus musculus
tcagaagaatctataccgagaggtc

SEQ ID NO: 134199 - DNA, 25 bp, Mus musculus
tcagaagaatgctatggcccacagg

SEQ ID NO: 134200 - DNA, 25 bp, Mus musculus
tcagaagacacttaagtttttccaa

SEQ ID NO: 134201 - DNA, 25 bp, Mus musculus
tcagaagacagtggatgggccatca

SEQ ID NO: 134202 - DNA, 25 bp, Mus musculus
tcagaagacgttggaaatgaccctt

SEQ ID NO: 134203 - DNA, 25 bp, Mus musculus
tcagaagacgtttggagaaaagatc

SEQ ID NO: 134204 - DNA, 25 bp, Mus musculus
tcagaagactcctcggcagaagaca

SEQ ID NO: 134205 - DNA, 25 bp, Mus musculus
tcagaagactttccgaacagagcgt

SEQ ID NO: 134206 - DNA, 25 bp, Mus musculus
tcagaagaggcagcaactgtgtggc

SEQ ID NO: 134207 - DNA, 25 bp, Mus musculus
tcagaagatcatctggatgccccag

SEQ ID NO: 134208 - DNA, 25 bp, Mus musculus
tcagaagattccgtgcttaaagcag

SEQ ID NO: 134209 - DNA, 25 bp, Mus musculus
tcagaagcaccatgacctgtggatc

SEQ ID NO: 134210 - DNA, 25 bp, Mus musculus
tcagaagctacaagcgaaaaatggg

SEQ ID NO: 134211 - DNA, 25 bp, Mus musculus
tcagaagctacgtgcagaaggacct

SEQ ID NO: 134212 - DNA, 25 bp, Mus musculus
tcagaagctgccctaaccttagagg

SEQ ID NO: 134213 - DNA, 25 bp, Mus musculus
tcagaagctgcggatcatgggcacc

SEQ ID NO: 134214 - DNA, 25 bp, Mus musculus
tcagaaggaaactcagtatcggtac

SEQ ID NO: 134215 - DNA, 25 bp, Mus musculus
tcagaaggaggacttttggcactct

SEQ ID NO: 134216 - DNA, 25 bp, Mus musculus
tcagaaggcagcacccagtcctatt

SEQ ID NO: 134217 - DNA, 25 bp, Mus musculus
tcagaaggccaagtgcagacgctgt

SEQ ID NO: 134218 - DNA, 25 bp, Mus musculus
tcagaaggccgcatttggatctacg

SEQ ID NO: 134219 - DNA, 25 bp, Mus musculus
tcagaagggcactggctgcactgaa

SEQ ID NO: 134220 - DNA, 25 bp, Mus musculus
tcagaagggtccacatacaataaag

SEQ ID NO: 134221 - DNA, 25 bp, Mus musculus
tcagaagtaagtaaccgatccagcc

SEQ ID NO: 134222 - DNA, 25 bp, Mus musculus
tcagaagtactctcagcaagacgat

SEQ ID NO: 134223 - DNA, 25 bp, Mus musculus
tcagaagtagaacttggaagcccaa

SEQ ID NO: 134224 - DNA, 25 bp, Mus musculus
tcagaagtatgaccagagagccacc

SEQ ID NO: 134225 - DNA, 25 bp, Mus musculus
tcagaagtgcctctcctcacaggaa

SEQ ID NO: 134226 - DNA, 25 bp, Mus musculus
tcagaatatcaaaaggaccctccag

SEQ ID NO: 134227 - DNA, 25 bp, Mus musculus
tcagaatatcatgtagggcgaccta

SEQ ID NO: 134228 - DNA, 25 bp, Mus musculus
tcagaatatgaaagcgggccagact

SEQ ID NO: 134229 - DNA, 25 bp, Mus musculus
tcagaatcagaaaggagctgcttcc

SEQ ID NO: 134230 - DNA, 25 bp, Mus musculus
tcagaatccagaaacagcgccatgt

SEQ ID NO: 134231 - DNA, 25 bp, Mus musculus
tcagaatccagataagccttggact

SEQ ID NO: 134232 - DNA, 25 bp, Mus musculus
tcagaatccgtgaaatttgacgcac

SEQ ID NO: 134233 - DNA, 25 bp, Mus musculus
tcagaatctagttccgagtcccgct

SEQ ID NO: 134234 - DNA, 25 bp, Mus musculus
tcagaatctgtagcaccttcccaag

SEQ ID NO: 134235 - DNA, 25 bp, Mus musculus
tcagaatcttgcaccttcagggaga

SEQ ID NO: 134236 - DNA, 25 bp, Mus musculus
tcagaatgaacttccgtcggaggcg

SEQ ID NO: 134237 - DNA, 25 bp, Mus musculus
tcagaatgaggagggtaacgctgcc

SEQ ID NO: 134238 - DNA, 25 bp, Mus musculus
tcagaatggagaggacctgctaggc

SEQ ID NO: 134239 - DNA, 25 bp, Mus musculus
tcagaatgtaagaccggcatcggca

SEQ ID NO: 134240 - DNA, 25 bp, Mus musculus
tcagaatgtcagctccaaagtccag

SEQ ID NO: 134241 - DNA, 25 bp, Mus musculus
tcagaatgtttgagctccgcagagc

SEQ ID NO: 134242 - DNA, 25 bp, Mus musculus
tcagaattccacgagagagacactt

SEQ ID NO: 134243 - DNA, 25 bp, Mus musculus
tcagaattcctcaggctgcaagtag

SEQ ID NO: 134244 - DNA, 25 bp, Mus musculus
tcagaattctagaccccaggagcag

SEQ ID NO: 134245 - DNA, 25 bp, Mus musculus
tcagaattctggtgcccagagcagt

SEQ ID NO: 134246 - DNA, 25 bp, Mus musculus
tcagaattcttcgatgcccaagagg

SEQ ID NO: 134247 - DNA, 25 bp, Mus musculus
tcagaattgtccaaaagcccttccg

SEQ ID NO: 134248 - DNA, 25 bp, Mus musculus
tcagacaaagcaacatgggcctcag

SEQ ID NO: 134249 - DNA, 25 bp, Mus musculus
tcagacaagctgatggtgcacctgg

SEQ ID NO: 134250 - DNA, 25 bp, Mus musculus
tcagacaaggcacaggatggcacag

SEQ ID NO: 134251 - DNA, 25 bp, Mus musculus
tcagacaagggatgaacagagccag

SEQ ID NO: 134252 - DNA, 25 bp, Mus musculus
tcagacaagtgcactcaacagagcg

SEQ ID NO: 134253 - DNA, 25 bp, Mus musculus
tcagacaagtggaccaggagtcggc

SEQ ID NO: 134254 - DNA, 25 bp, Mus musculus
tcagacacacgatgctgtgagctct

SEQ ID NO: 134255 - DNA, 25 bp, Mus musculus
tcagacaccagcgattcagactcgg

SEQ ID NO: 134256 - DNA, 25 bp, Mus musculus
tcagacaccagctctctaaggatgg

SEQ ID NO: 134257 - DNA, 25 bp, Mus musculus
tcagacactggtatagagaggcatc

SEQ ID NO: 134258 - DNA, 25 bp, Mus musculus
tcagacagacgtgaaaatgacatgt

SEQ ID NO: 134259 - DNA, 25 bp, Mus musculus
tcagacagactgctttgtgaccctc

SEQ ID NO: 134260 - DNA, 25 bp, Mus musculus
tcagacagcaggaacgagtggcatc

SEQ ID NO: 134261 - DNA, 25 bp, Mus musculus
tcagacagcgtcctggagaagtgcc

SEQ ID NO: 134262 - DNA, 25 bp, Mus musculus
tcagacaggatcctgagacccctgg

SEQ ID NO: 134263 - DNA, 25 bp, Mus musculus
tcagacaggcacacagaggacaatt

SEQ ID NO: 134264 - DNA, 25 bp, Mus musculus
tcagacagtgacttgcgagcaaccc

SEQ ID NO: 134265 - DNA, 25 bp, Mus musculus
tcagacagtggcagcaacataggcg

SEQ ID NO: 134266 - DNA, 25 bp, Mus musculus
tcagacagtgggacctaccagtgct

SEQ ID NO: 134267 - DNA, 25 bp, Mus musculus
tcagacatctctgctcttggtgttc

SEQ ID NO: 134268 - DNA, 25 bp, Mus musculus
tcagacatggcagcagcaaatgggt

SEQ ID NO: 134269 - DNA, 25 bp, Mus musculus
tcagacattgcgagcgtcagtggcc

SEQ ID NO: 134270 - DNA, 25 bp, Mus musculus
tcagaccaaggtgccaatgcggaga

SEQ ID NO: 134271 - DNA, 25 bp, Mus musculus
tcagaccagtgtaatcagcagagac

SEQ ID NO: 134272 - DNA, 25 bp, Mus musculus
tcagacccatcaaaagaggcctgct

SEQ ID NO: 134273 - DNA, 25 bp, Mus musculus
tcagaccccagtttacctcaaggag

SEQ ID NO: 134274 - DNA, 25 bp, Mus musculus
tcagacccgaaatggaatcagtgcc

SEQ ID NO: 134275 - DNA, 25 bp, Mus musculus
tcagacccggaaggtgaagatgaag

SEQ ID NO: 134276 - DNA, 25 bp, Mus musculus
tcagaccctgctgcggaagaaggag

SEQ ID NO: 134277 - DNA, 25 bp, Mus musculus
tcagaccggctgtggtacatggcgt

SEQ ID NO: 134278 - DNA, 25 bp, Mus musculus
tcagacctggggaaacgcttccggg

SEQ ID NO: 134279 - DNA, 25 bp, Mus musculus
tcagacgaccctagcgaaggttgcg

SEQ ID NO: 134280 - DNA, 25 bp, Mus musculus
tcagacgagattcagaggctggcca

SEQ ID NO: 134281 - DNA, 25 bp, Mus musculus
tcagacgcaaagctcaaagagattg

SEQ ID NO: 134282 - DNA, 25 bp, Mus musculus
tcagacgctgcagcccatataggaa

SEQ ID NO: 134283 - DNA, 25 bp, Mus musculus
tcagacggacttcattggccacagc

SEQ ID NO: 134284 - DNA, 25 bp, Mus musculus
tcagacggtgaaggtgtccccgcta

SEQ ID NO: 134285 - DNA, 25 bp, Mus musculus
tcagacgtgctggtggaatatcaag

SEQ ID NO: 134286 - DNA, 25 bp, Mus musculus
tcagactaaagagatggacttgact

SEQ ID NO: 134287 - DNA, 25 bp, Mus musculus
tcagactcaagaaagctcaagctaa

SEQ ID NO: 134288 - DNA, 25 bp, Mus musculus
tcagactcaagtgtcaagggcctgt

SEQ ID NO: 134289 - DNA, 25 bp, Mus musculus
tcagactcaagttagaagtgagagt

SEQ ID NO: 134290 - DNA, 25 bp, Mus musculus
tcagactgatgaacagagggcgctc

SEQ ID NO: 134291 - DNA, 25 bp, Mus musculus
tcagactggcatctggcagtgaagc

SEQ ID NO: 134292 - DNA, 25 bp, Mus musculus
tcagactgggcaacgtgttccatgc

SEQ ID NO: 134293 - DNA, 25 bp, Mus musculus
tcagactgggtaactttgatgcgat

SEQ ID NO: 134294 - DNA, 25 bp, Mus musculus
tcagactgtgagctggaggaaccct

SEQ ID NO: 134295 - DNA, 25 bp, Mus musculus
tcagactgtgtccaaaaagcaagca

SEQ ID NO: 134296 - DNA, 25 bp, Mus musculus
tcagacttgggcaaagagaaagcca

SEQ ID NO: 134297 - DNA, 25 bp, Mus musculus
tcagacttgtcacctgctgtggccc

SEQ ID NO: 134298 - DNA, 25 bp, Mus musculus
tcagactttcactacgataaattca

SEQ ID NO: 134299 - DNA, 25 bp, Mus musculus
tcagagaaacagattgcaagaggct

SEQ ID NO: 134300 - DNA, 25 bp, Mus musculus
tcagagaaacagcaaaaaagacaca

SEQ ID NO: 134301 - DNA, 25 bp, Mus musculus
tcagagaaagaagagatcgaccgcc

SEQ ID NO: 134302 - DNA, 25 bp, Mus musculus
tcagagaaatgcctccccaaaggtc

SEQ ID NO: 134303 - DNA, 25 bp, Mus musculus
tcagagaacgagaaggatgatgcct

SEQ ID NO: 134304 - DNA, 25 bp, Mus musculus
tcagagaacgagaccccttagtggg

SEQ ID NO: 134305 - DNA, 25 bp, Mus musculus
tcagagaagacaggaagttgtggaa

SEQ ID NO: 134306 - DNA, 25 bp, Mus musculus
tcagagaagatcctcctaaggctgc

SEQ ID NO: 134307 - DNA, 25 bp, Mus musculus
tcagagacacttgaccagaactgca

SEQ ID NO: 134308 - DNA, 25 bp, Mus musculus
tcagagacattgatgcagcaacgga

SEQ ID NO: 134309 - DNA, 25 bp, Mus musculus
tcagagaccccgtcagtagatttct

SEQ ID NO: 134310 - DNA, 25 bp, Mus musculus
tcagagacccctgttgaaaggaaaa

SEQ ID NO: 134311 - DNA, 25 bp, Mus musculus
tcagagacgctgaccttcaagaggc

SEQ ID NO: 134312 - DNA, 25 bp, Mus musculus
tcagagacggtagcttggcacctgc

SEQ ID NO: 134313 - DNA, 25 bp, Mus musculus
tcagagactacaagatcacccaggt

SEQ ID NO: 134314 - DNA, 25 bp, Mus musculus
tcagagagcactgtgagccttcggc

SEQ ID NO: 134315 - DNA, 25 bp, Mus musculus
tcagagagcagataaacgcagggca

SEQ ID NO: 134316 - DNA, 25 bp, Mus musculus
tcagagagcgggaacaagccatttc

SEQ ID NO: 134317 - DNA, 25 bp, Mus musculus
tcagagaggctagctgtacccaggg

SEQ ID NO: 134318 - DNA, 25 bp, Mus musculus
tcagagagggagacacgcacccgga

SEQ ID NO: 134319 - DNA, 25 bp, Mus musculus
tcagagagtgagacatccgcctcat

SEQ ID NO: 134320 - DNA, 25 bp, Mus musculus
tcagagagtgatgagctccaggacc

SEQ ID NO: 134321 - DNA, 25 bp, Mus musculus
tcagagagttcctgggacaaacggc

SEQ ID NO: 134322 - DNA, 25 bp, Mus musculus
tcagagatgacaaggagcttcggca

SEQ ID NO: 134323 - DNA, 25 bp, Mus musculus
tcagagatggacaaacagagaccct

SEQ ID NO: 134324 - DNA, 25 bp, Mus musculus
tcagagatggatagccaggctcact

SEQ ID NO: 134325 - DNA, 25 bp, Mus musculus
tcagagatggtgtacgatgcgtgca

SEQ ID NO: 134326 - DNA, 25 bp, Mus musculus
tcagagattcccaacagggacggcc

SEQ ID NO: 134327 - DNA, 25 bp, Mus musculus
tcagagattcgtgtgccaccagtgg

SEQ ID NO: 134328 - DNA, 25 bp, Mus musculus
tcagagcaaacatgcagaggcccgg

SEQ ID NO: 134329 - DNA, 25 bp, Mus musculus
tcagagcaagggatgacctcatcac

SEQ ID NO: 134330 - DNA, 25 bp, Mus musculus
tcagagcaatgcaagcagagcaagg

SEQ ID NO: 134331 - DNA, 25 bp, Mus musculus
tcagagcacacagtggacggcaagt

SEQ ID NO: 134332 - DNA, 25 bp, Mus musculus
tcagagcacagtatatcccaagagg

SEQ ID NO: 134333 - DNA, 25 bp, Mus musculus
tcagagcagagccaccgaatgttgt

SEQ ID NO: 134334 - DNA, 25 bp, Mus musculus
tcagagcagatgtctcggagggtcc

SEQ ID NO: 134335 - DNA, 25 bp, Mus musculus
tcagagcataaagaggccatacccg

SEQ ID NO: 134336 - DNA, 25 bp, Mus musculus
tcagagcatcgtcatggcccagaag

SEQ ID NO: 134337 - DNA, 25 bp, Mus musculus
tcagagcatttacattgaggaggca

SEQ ID NO: 134338 - DNA, 25 bp, Mus musculus
tcagagccaaagtgaggacagtccc

SEQ ID NO: 134339 - DNA, 25 bp, Mus musculus
tcagagccactgttttccttcggag

SEQ ID NO: 134340 - DNA, 25 bp, Mus musculus
tcagagccagaaagccggctagaga

SEQ ID NO: 134341 - DNA, 25 bp, Mus musculus
tcagagccaggacaggaagatacac

SEQ ID NO: 134342 - DNA, 25 bp, Mus musculus
tcagagccccttgtaagaactggga

SEQ ID NO: 134343 - DNA, 25 bp, Mus musculus
tcagagcctcgtccggtgcaggact

SEQ ID NO: 134344 - DNA, 25 bp, Mus musculus
tcagagcctcgttcacaggagtcag

SEQ ID NO: 134345 - DNA, 25 bp, Mus musculus
tcagagcctgctcagggcccttttc

SEQ ID NO: 134346 - DNA, 25 bp, Mus musculus
tcagagccttatgtggaccaaccca

SEQ ID NO: 134347 - DNA, 25 bp, Mus musculus
tcagagccttcctaagccatggtgg

SEQ ID NO: 134348 - DNA, 25 bp, Mus musculus
tcagagcgcaagtttgtccaccggg

SEQ ID NO: 134349 - DNA, 25 bp, Mus musculus
tcagagctatcgacattggcccgag

SEQ ID NO: 134350 - DNA, 25 bp, Mus musculus
tcagagctccatgtccgtcacgtgg

SEQ ID NO: 134351 - DNA, 25 bp, Mus musculus
tcagagctcctcactgagtgggacc

SEQ ID NO: 134352 - DNA, 25 bp, Mus musculus
tcagagctgaaggtacgcaaaaccc

SEQ ID NO: 134353 - DNA, 25 bp, Mus musculus
tcagagctgcacacaattgggacac

SEQ ID NO: 134354 - DNA, 25 bp, Mus musculus
tcagagctgggactaacagcaggct

SEQ ID NO: 134355 - DNA, 25 bp, Mus musculus
tcagagctggtttagtcctgttgtc

SEQ ID NO: 134356 - DNA, 25 bp, Mus musculus
tcagagcttatgatgcgtcactggc

SEQ ID NO: 134357 - DNA, 25 bp, Mus musculus
tcagaggaaaggatctgcaatgccg

SEQ ID NO: 134358 - DNA, 25 bp, Mus musculus
tcagaggaagatggcgcctcgaaga

SEQ ID NO: 134359 - DNA, 25 bp, Mus musculus
tcagaggacacagacaagctgctgg

SEQ ID NO: 134360 - DNA, 25 bp, Mus musculus
tcagaggacacagaggacttcgtgg

SEQ ID NO: 134361 - DNA, 25 bp, Mus musculus
tcagaggacatgttgcctgtcggcc

SEQ ID NO: 134362 - DNA, 25 bp, Mus musculus
tcagaggagccggaagaagcagacc

SEQ ID NO: 134363 - DNA, 25 bp, Mus musculus
tcagaggagtccgaaatgcagaatt

SEQ ID NO: 134364 - DNA, 25 bp, Mus musculus
tcagaggagtgcatgaacgcaatca

SEQ ID NO: 134365 - DNA, 25 bp, Mus musculus
tcagaggcacatcagtgacctgtac

SEQ ID NO: 134366 - DNA, 25 bp, Mus musculus
tcagaggcacctactaagtcggagg

SEQ ID NO: 134367 - DNA, 25 bp, Mus musculus
tcagaggcagcatggtgagcagctt

SEQ ID NO: 134368 - DNA, 25 bp, Mus musculus
tcagaggcctgggtacaaataaggc

SEQ ID NO: 134369 - DNA, 25 bp, Mus musculus
tcagaggccttggtgaagacgccag

SEQ ID NO: 134370 - DNA, 25 bp, Mus musculus
tcagaggcgtcaaggattccagggt

SEQ ID NO: 134371 - DNA, 25 bp, Mus musculus
tcagaggctgcaagtgctaaatgcc

SEQ ID NO: 134372 - DNA, 25 bp, Mus musculus
tcagagggcagctgccaatggattc

SEQ ID NO: 134373 - DNA, 25 bp, Mus musculus
tcagagggccacattgcagaagagt

SEQ ID NO: 134374 - DNA, 25 bp, Mus musculus
tcagagggcctcagaacctaaaggg

SEQ ID NO: 134375 - DNA, 25 bp, Mus musculus
tcagagggtcagctttgccaaggac

SEQ ID NO: 134376 - DNA, 25 bp, Mus musculus
tcagagggtctctcactggaaagga

SEQ ID NO: 134377 - DNA, 25 bp, Mus musculus
tcagagggtggttcgtccatgatcg

SEQ ID NO: 134378 - DNA, 25 bp, Mus musculus
tcagagtacatttccaacacgttcc

SEQ ID NO: 134379 - DNA, 25 bp, Mus musculus
tcagagtcagctttggtgccaggca

SEQ ID NO: 134380 - DNA, 25 bp, Mus musculus
tcagagtcagttatccagagcacgg

SEQ ID NO: 134381 - DNA, 25 bp, Mus musculus
tcagagtcatggagctcagcgatgc

SEQ ID NO: 134382 - DNA, 25 bp, Mus musculus
tcagagtccgacgagcttcagacca

SEQ ID NO: 134383 - DNA, 25 bp, Mus musculus
tcagagtcctgaccttgctgggcgt

SEQ ID NO: 134384 - DNA, 25 bp, Mus musculus
tcagagtcctgcaattcacaggcag

SEQ ID NO: 134385 - DNA, 25 bp, Mus musculus
tcagagtcgccagaaagcagcggac

SEQ ID NO: 134386 - DNA, 25 bp, Mus musculus
tcagagtctgcaaggaagcctgggc

SEQ ID NO: 134387 - DNA, 25 bp, Mus musculus
tcagagtgaccttcagagggcagca

SEQ ID NO: 134388 - DNA, 25 bp, Mus musculus
tcagagtgagccctgctacgtgtca

SEQ ID NO: 134389 - DNA, 25 bp, Mus musculus
tcagagtgagtgatagagagcccac

SEQ ID NO: 134390 - DNA, 25 bp, Mus musculus
tcagagtggacactagagccggaca

SEQ ID NO: 134391 - DNA, 25 bp, Mus musculus
tcagagtggactgaaacaaccaggc

SEQ ID NO: 134392 - DNA, 25 bp, Mus musculus
tcagagtgtatccatgggcttgccc

SEQ ID NO: 134393 - DNA, 25 bp, Mus musculus
tcagagttaacagaggcaccaggtc

SEQ ID NO: 134394 - DNA, 25 bp, Mus musculus
tcagagttagatcccgctggaccct

SEQ ID NO: 134395 - DNA, 25 bp, Mus musculus
tcagagttggcctcatcgccctgaa

SEQ ID NO: 134396 - DNA, 25 bp, Mus musculus
tcagagtttcgagacttggcgccgg

SEQ ID NO: 134397 - DNA, 25 bp, Mus musculus
tcagataaaggctacccatgctacc

SEQ ID NO: 134398 - DNA, 25 bp, Mus musculus
tcagataaattgtcagcagccagtt

SEQ ID NO: 134399 - DNA, 25 bp, Mus musculus
tcagataacttgacccagggctatg

SEQ ID NO: 134400 - DNA, 25 bp, Mus musculus
tcagatacacctacctacgagagca

SEQ ID NO: 134401 - DNA, 25 bp, Mus musculus
tcagataccagctctgagagcagcg

SEQ ID NO: 134402 - DNA, 25 bp, Mus musculus
tcagatacttgtggcagcaaacaaa

SEQ ID NO: 134403 - DNA, 25 bp, Mus musculus
tcagatactttacatccaacccagc

SEQ ID NO: 134404 - DNA, 25 bp, Mus musculus
tcagatagtctctgcagccgcaggg

SEQ ID NO: 134405 - DNA, 25 bp, Mus musculus
tcagatagtgagctggacgagacca

SEQ ID NO: 134406 - DNA, 25 bp, Mus musculus
tcagatatctcggagcctgacaggg

SEQ ID NO: 134407 - DNA, 25 bp, Mus musculus
tcagatatgggacaagagcctcctt

SEQ ID NO: 134408 - DNA, 25 bp, Mus musculus
tcagatatggtttgcacaggaggca

SEQ ID NO: 134409 - DNA, 25 bp, Mus musculus
tcagatatgtcaaatgggatgcaac

SEQ ID NO: 134410 - DNA, 25 bp, Mus musculus
tcagatcaacttggaaggaaagacc

SEQ ID NO: 134411 - DNA, 25 bp, Mus musculus
tcagatcacttttggatgggcagcc

SEQ ID NO: 134412 - DNA, 25 bp, Mus musculus
tcagatcaggtcgaagtccctcggg

SEQ ID NO: 134413 - DNA, 25 bp, Mus musculus
tcagatcaggtttgcaccaaggtca

SEQ ID NO: 134414 - DNA, 25 bp, Mus musculus
tcagatccacttgtgagaaggcagc

SEQ ID NO: 134415 - DNA, 25 bp, Mus musculus
tcagatccagcagagcttcgtgcct

SEQ ID NO: 134416 - DNA, 25 bp, Mus musculus
tcagatcccattcctggagccaagc

SEQ ID NO: 134417 - DNA, 25 bp, Mus musculus
tcagatccgacaaggaaaactggcc

SEQ ID NO: 134418 - DNA, 25 bp, Mus musculus
tcagatccgcatttgcgaccggcgg

SEQ ID NO: 134419 - DNA, 25 bp, Mus musculus
tcagatcgacaaagtcaaggtgtgg

SEQ ID NO: 134420 - DNA, 25 bp, Mus musculus
tcagatcggatgacacactgcggtg

SEQ ID NO: 134421 - DNA, 25 bp, Mus musculus
tcagatctaccacatgataggatgg

SEQ ID NO: 134422 - DNA, 25 bp, Mus musculus
tcagatctccaagtgactcgacagg

SEQ ID NO: 134423 - DNA, 25 bp, Mus musculus
tcagatctgacttaagaggctcgag

SEQ ID NO: 134424 - DNA, 25 bp, Mus musculus
tcagatctgagtagctgaggagaag

SEQ ID NO: 134425 - DNA, 25 bp, Mus musculus
tcagatctggacaccctggctaaag

SEQ ID NO: 134426 - DNA, 25 bp, Mus musculus
tcagatgaaagtcacacagggatcc

SEQ ID NO: 134427 - DNA, 25 bp, Mus musculus
tcagatgacatgaaggctctccgcc

SEQ ID NO: 134428 - DNA, 25 bp, Mus musculus
tcagatgagaatgtacgcggcgtgt

SEQ ID NO: 134429 - DNA, 25 bp, Mus musculus
tcagatgagaccagggttttccgcc

SEQ ID NO: 134430 - DNA, 25 bp, Mus musculus
tcagatgagactaacagagggactc

SEQ ID NO: 134431 - DNA, 25 bp, Mus musculus
tcagatgaggacctaaagaaggcct

SEQ ID NO: 134432 - DNA, 25 bp, Mus musculus
tcagatgaggaggacaatacgagcc

SEQ ID NO: 134433 - DNA, 25 bp, Mus musculus
tcagatgagttgtcaaggcaccggc

SEQ ID NO: 134434 - DNA, 25 bp, Mus musculus
tcagatgatagaatggcacggccca

SEQ ID NO: 134435 - DNA, 25 bp, Mus musculus
tcagatgatccacaagtcttagctg

SEQ ID NO: 134436 - DNA, 25 bp, Mus musculus
tcagatgcctgcgaaggtacgagct

SEQ ID NO: 134437 - DNA, 25 bp, Mus musculus
tcagatgcggctgcaaaagctgctt

SEQ ID NO: 134438 - DNA, 25 bp, Mus musculus
tcagatgctggtcgctggagcaacc

SEQ ID NO: 134439 - DNA, 25 bp, Mus musculus
tcagatggaagcgtccagactccgg

SEQ ID NO: 134440 - DNA, 25 bp, Mus musculus
tcagatggacaatcggagcaagctc

SEQ ID NO: 134441 - DNA, 25 bp, Mus musculus
tcagatggactctccaaggtgtcag

SEQ ID NO: 134442 - DNA, 25 bp, Mus musculus
tcagatggagacacattaccgagtc

SEQ ID NO: 134443 - DNA, 25 bp, Mus musculus
tcagatggctgagggacttgcttca

SEQ ID NO: 134444 - DNA, 25 bp, Mus musculus
tcagatggctgggacattgtcaccc

SEQ ID NO: 134445 - DNA, 25 bp, Mus musculus
tcagatgtaagaggcttccagccgg

SEQ ID NO: 134446 - DNA, 25 bp, Mus musculus
tcagatgtacacaccatggacttgg

SEQ ID NO: 134447 - DNA, 25 bp, Mus musculus
tcagatgtaccatcgctgggtccca

SEQ ID NO: 134448 - DNA, 25 bp, Mus musculus
tcagatgttcaacccaggtgtggcc

SEQ ID NO: 134449 - DNA, 25 bp, Mus musculus
tcagattaccccaaaggagacgctt

SEQ ID NO: 134450 - DNA, 25 bp, Mus musculus
tcagattcatccgagagggttccag

SEQ ID NO: 134451 - DNA, 25 bp, Mus musculus
tcagattctgcttcgattcagcgcc

SEQ ID NO: 134452 - DNA, 25 bp, Mus musculus
tcagattgcccatacctggtgacat

SEQ ID NO: 134453 - DNA, 25 bp, Mus musculus
tcagattgctgcaggaaactccttt

SEQ ID NO: 134454 - DNA, 25 bp, Mus musculus
tcagatttcatagactggtaatacc

SEQ ID NO: 134455 - DNA, 25 bp, Mus musculus
tcagatttcccagcgttagctgacc

SEQ ID NO: 134456 - DNA, 25 bp, Mus musculus
tcagatttgctacagctgaagccag

SEQ ID NO: 134457 - DNA, 25 bp, Mus musculus
tcagcaaaaactactcttaccaagg

SEQ ID NO: 134458 - DNA, 25 bp, Mus musculus
tcagcaaatcaaaagcaccatagag

SEQ ID NO: 134459 - DNA, 25 bp, Mus musculus
tcagcaacaaacagaagaaactcct

SEQ ID NO: 134460 - DNA, 25 bp, Mus musculus
tcagcaacagagcatggtaacttag

SEQ ID NO: 134461 - DNA, 25 bp, Mus musculus
tcagcaacattcatagagactcggg

SEQ ID NO: 134462 - DNA, 25 bp, Mus musculus
tcagcaactacagtcgagggagcgg

SEQ ID NO: 134463 - DNA, 25 bp, Mus musculus
tcagcaagaagcaccgaacatggtt

SEQ ID NO: 134464 - DNA, 25 bp, Mus musculus
tcagcaagatgggttcaataaaggc

SEQ ID NO: 134465 - DNA, 25 bp, Mus musculus
tcagcaagcaggactttttcaaagg

SEQ ID NO: 134466 - DNA, 25 bp, Mus musculus
tcagcaagcgtagtgtctcatcagg

SEQ ID NO: 134467 - DNA, 25 bp, Mus musculus
tcagcaagcgtctctactgtcagac

SEQ ID NO: 134468 - DNA, 25 bp, Mus musculus
tcagcaagcgtggtgtgagttgcca

SEQ ID NO: 134469 - DNA, 25 bp, Mus musculus
tcagcaaggaggtccggaaagcact

SEQ ID NO: 134470 - DNA, 25 bp, Mus musculus
tcagcaaggtttccacgagtgcagc

SEQ ID NO: 134471 - DNA, 25 bp, Mus musculus
tcagcaataggaaggagacaacagg

SEQ ID NO: 134472 - DNA, 25 bp, Mus musculus
tcagcaatgagaccattgctggaga

SEQ ID NO: 134473 - DNA, 25 bp, Mus musculus
tcagcaatgagcgtggtgtacagca

SEQ ID NO: 134474 - DNA, 25 bp, Mus musculus
tcagcaatgcctgccacagggtggg

SEQ ID NO: 134475 - DNA, 25 bp, Mus musculus
tcagcaatgtgtcttccacgggcag

SEQ ID NO: 134476 - DNA, 25 bp, Mus musculus
tcagcaatgttgtgcgtgccaggga

SEQ ID NO: 134477 - DNA, 25 bp, Mus musculus
tcagcaattcgcatgaccgagcact

SEQ ID NO: 134478 - DNA, 25 bp, Mus musculus
tcagcacacgatcgaaacgtacagg

SEQ ID NO: 134479 - DNA, 25 bp, Mus musculus
tcagcacagacactggcgagcatct

SEQ ID NO: 134480 - DNA, 25 bp, Mus musculus
tcagcacaggtaccagcaactgcag

SEQ ID NO: 134481 - DNA, 25 bp, Mus musculus
tcagcacatgccaagctgtcagggc

SEQ ID NO: 134482 - DNA, 25 bp, Mus musculus
tcagcaccaaggatagccagttctc

SEQ ID NO: 134483 - DNA, 25 bp, Mus musculus
tcagcaccagagaggttctctaaga

SEQ ID NO: 134484 - DNA, 25 bp, Mus musculus
tcagcaccagctttattggagtcaa

SEQ ID NO: 134485 - DNA, 25 bp, Mus musculus
tcagcaccaggagcaacctaacagt

SEQ ID NO: 134486 - DNA, 25 bp, Mus musculus
tcagcaccagtgatgtggaatctct

SEQ ID NO: 134487 - DNA, 25 bp, Mus musculus
tcagcaccagtgtaccaaggcaaga

SEQ ID NO: 134488 - DNA, 25 bp, Mus musculus
tcagcaccatggagcgcagtgagct

SEQ ID NO: 134489 - DNA, 25 bp, Mus musculus
tcagcacccgatgagcagttcacga

SEQ ID NO: 134490 - DNA, 25 bp, Mus musculus
tcagcacccgggatctgctggagga

SEQ ID NO: 134491 - DNA, 25 bp, Mus musculus
tcagcaccgcacactggttctaagg

SEQ ID NO: 134492 - DNA, 25 bp, Mus musculus
tcagcacctcggtctacaagcgctt

SEQ ID NO: 134493 - DNA, 25 bp, Mus musculus
tcagcacctgccttcaactaggatg

SEQ ID NO: 134494 - DNA, 25 bp, Mus musculus
tcagcacctgtggaggaagtacggt

SEQ ID NO: 134495 - DNA, 25 bp, Mus musculus
tcagcacgctcttctgtaagggaaa

SEQ ID NO: 134496 - DNA, 25 bp, Mus musculus
tcagcacgggagaaagagcctgctc

SEQ ID NO: 134497 - DNA, 25 bp, Mus musculus
tcagcactccgaggcctgtgtgaag

SEQ ID NO: 134498 - DNA, 25 bp, Mus musculus
tcagcactgggcactgtacttgggt

SEQ ID NO: 134499 - DNA, 25 bp, Mus musculus
tcagcacttgaagaaaccatccagg

SEQ ID NO: 134500 - DNA, 25 bp, Mus musculus
tcagcacttgcgtggagtccctgga

SEQ ID NO: 134501 - DNA, 25 bp, Mus musculus
tcagcagaaaagaagccgagaagcg

SEQ ID NO: 134502 - DNA, 25 bp, Mus musculus
tcagcagacgccagaagtgatcaag

SEQ ID NO: 134503 - DNA, 25 bp, Mus musculus
tcagcagagcagatctggatcacag

SEQ ID NO: 134504 - DNA, 25 bp, Mus musculus
tcagcagagcatgatacgggagctc

SEQ ID NO: 134505 - DNA, 25 bp, Mus musculus
tcagcagatcctcaggcagtcgtgg

SEQ ID NO: 134506 - DNA, 25 bp, Mus musculus
tcagcagatgactgtggcaggagct

SEQ ID NO: 134507 - DNA, 25 bp, Mus musculus
tcagcagatgttcagcgatgcaggc

SEQ ID NO: 134508 - DNA, 25 bp, Mus musculus
tcagcagattgagaacatccgcagc

SEQ ID NO: 134509 - DNA, 25 bp, Mus musculus
tcagcagcaaatccaagaggcagag

SEQ ID NO: 134510 - DNA, 25 bp, Mus musculus
tcagcagcactgatgggaataaaag

SEQ ID NO: 134511 - DNA, 25 bp, Mus musculus
tcagcagcacttcagtcacaacaaa

SEQ ID NO: 134512 - DNA, 25 bp, Mus musculus
tcagcagcagtttgcagaaccgggc

SEQ ID NO: 134513 - DNA, 25 bp, Mus musculus
tcagcagcatccagggcaagatcag

SEQ ID NO: 134514 - DNA, 25 bp, Mus musculus
tcagcagccaacgaccctgtgtttg

SEQ ID NO: 134515 - DNA, 25 bp, Mus musculus
tcagcagccgatgcagaggatgaag

SEQ ID NO: 134516 - DNA, 25 bp, Mus musculus
tcagcagccgctttgaggatattcg

SEQ ID NO: 134517 - DNA, 25 bp, Mus musculus
tcagcagcctgacctgaaagtggtg

SEQ ID NO: 134518 - DNA, 25 bp, Mus musculus
tcagcagcgaaagcttccacgagga

SEQ ID NO: 134519 - DNA, 25 bp, Mus musculus
tcagcagctacaacatcatgggtcc

SEQ ID NO: 134520 - DNA, 25 bp, Mus musculus
tcagcagctgagcgcggaagcccca

SEQ ID NO: 134521 - DNA, 25 bp, Mus musculus
tcagcaggaactagtctggtgaact

SEQ ID NO: 134522 - DNA, 25 bp, Mus musculus
tcagcaggattcagggattcaacat

SEQ ID NO: 134523 - DNA, 25 bp, Mus musculus
tcagcaggtcgtggtccctagagac

SEQ ID NO: 134524 - DNA, 25 bp, Mus musculus
tcagcaggttcagactcagatccag

SEQ ID NO: 134525 - DNA, 25 bp, Mus musculus
tcagcagtacatacaccatgaggga

SEQ ID NO: 134526 - DNA, 25 bp, Mus musculus
tcagcagtacgctgtggagggacac

SEQ ID NO: 134527 - DNA, 25 bp, Mus musculus
tcagcagtatggtgtccgtggctac

SEQ ID NO: 134528 - DNA, 25 bp, Mus musculus
tcagcagtatgtgaggccagaagtc

SEQ ID NO: 134529 - DNA, 25 bp, Mus musculus
tcagcagtgtcaaggaccgcaagaa

SEQ ID NO: 134530 - DNA, 25 bp, Mus musculus
tcagcatagactgtatcagcagatc

SEQ ID NO: 134531 - DNA, 25 bp, Mus musculus
tcagcatagagaacagcactgacaa

SEQ ID NO: 134532 - DNA, 25 bp, Mus musculus
tcagcatcaactggctagggctcgt

SEQ ID NO: 134533 - DNA, 25 bp, Mus musculus
tcagcatcaagactaaacccaacgg

SEQ ID NO: 134534 - DNA, 25 bp, Mus musculus
tcagcatcaggagctcttccggaac

SEQ ID NO: 134535 - DNA, 25 bp, Mus musculus
tcagcatcatcgagagaggcgcctt

SEQ ID NO: 134536 - DNA, 25 bp, Mus musculus
tcagcatcgtgatcgcaatgggtgc

SEQ ID NO: 134537 - DNA, 25 bp, Mus musculus
tcagcatctgacagtgcttgcagaa

SEQ ID NO: 134538 - DNA, 25 bp, Mus musculus
tcagcatgagcttggacgtggccag

SEQ ID NO: 134539 - DNA, 25 bp, Mus musculus
tcagcatgatggacttggagttgcc

SEQ ID NO: 134540 - DNA, 25 bp, Mus musculus
tcagcatgcatagtttcttataggg

SEQ ID NO: 134541 - DNA, 25 bp, Mus musculus
tcagcatgctttccagctgcaaaga

SEQ ID NO: 134542 - DNA, 25 bp, Mus musculus
tcagcatggacgaagaggacggctc

SEQ ID NO: 134543 - DNA, 25 bp, Mus musculus
tcagcatgtcatcaggaatcagttc

SEQ ID NO: 134544 - DNA, 25 bp, Mus musculus
tcagcatgtggcttgcaccaggctc

SEQ ID NO: 134545 - DNA, 25 bp, Mus musculus
tcagcattgagcgtggagacaacaa

SEQ ID NO: 134546 - DNA, 25 bp, Mus musculus
tcagcattggcaaagacgagctcaa

SEQ ID NO: 134547 - DNA, 25 bp, Mus musculus
tcagccaaaggatgtgaatgacaca

SEQ ID NO: 134548 - DNA, 25 bp, Mus musculus
tcagccaatatgtgtgccagcagac

SEQ ID NO: 134549 - DNA, 25 bp, Mus musculus
tcagccacagcagtgaagaactcct

SEQ ID NO: 134550 - DNA, 25 bp, Mus musculus
tcagccacgaccagtacaaggagct

SEQ ID NO: 134551 - DNA, 25 bp, Mus musculus
tcagccacgagatcagaggcacaga

SEQ ID NO: 134552 - DNA, 25 bp, Mus musculus
tcagccacgcccaagtgtactggga

SEQ ID NO: 134553 - DNA, 25 bp, Mus musculus
tcagccacggaaacaatgaggagac

SEQ ID NO: 134554 - DNA, 25 bp, Mus musculus
tcagccacggcgtttcaaaacaagg

SEQ ID NO: 134555 - DNA, 25 bp, Mus musculus
tcagccagacaccaagccaaaaggt

SEQ ID NO: 134556 - DNA, 25 bp, Mus musculus
tcagccagcaggtcttcaaacaggt

SEQ ID NO: 134557 - DNA, 25 bp, Mus musculus
tcagccagcagtgaagtccaggagg

SEQ ID NO: 134558 - DNA, 25 bp, Mus musculus
tcagccagccagtatgtggaacaga

SEQ ID NO: 134559 - DNA, 25 bp, Mus musculus
tcagccaggcgtagtgtacttcgcg

SEQ ID NO: 134560 - DNA, 25 bp, Mus musculus
tcagccatacattgtctgcagacag

SEQ ID NO: 134561 - DNA, 25 bp, Mus musculus
tcagccatcacgaaggaaatccatg

SEQ ID NO: 134562 - DNA, 25 bp, Mus musculus
tcagccatgatgctcagtgatcgac

SEQ ID NO: 134563 - DNA, 25 bp, Mus musculus
tcagccatggcaagaaaccttcagg

SEQ ID NO: 134564 - DNA, 25 bp, Mus musculus
tcagccatggttctgcagaggatct

SEQ ID NO: 134565 - DNA, 25 bp, Mus musculus
tcagccattgacttccgggacatca

SEQ ID NO: 134566 - DNA, 25 bp, Mus musculus
tcagcccaaactgcagcaaactgga

SEQ ID NO: 134567 - DNA, 25 bp, Mus musculus
tcagcccaaggtgctgtcgcagacg

SEQ ID NO: 134568 - DNA, 25 bp, Mus musculus
tcagcccagacgctggcagagaagc

SEQ ID NO: 134569 - DNA, 25 bp, Mus musculus
tcagcccagtgaaccaccattgagg

SEQ ID NO: 134570 - DNA, 25 bp, Mus musculus
tcagcccagtggtccttggagcctg

SEQ ID NO: 134571 - DNA, 25 bp, Mus musculus
tcagccccaaggtgcgagaactttt

SEQ ID NO: 134572 - DNA, 25 bp, Mus musculus
tcagccccacgagaaggaagtgcat

SEQ ID NO: 134573 - DNA, 25 bp, Mus musculus
tcagccccagctggactcgccaggc

SEQ ID NO: 134574 - DNA, 25 bp, Mus musculus
tcagccccgacaagaagaagccggt

SEQ ID NO: 134575 - DNA, 25 bp, Mus musculus
tcagccccgctgtaatgaagaggac

SEQ ID NO: 134576 - DNA, 25 bp, Mus musculus
tcagcccgagtgaaggatggacgac

SEQ ID NO: 134577 - DNA, 25 bp, Mus musculus
tcagcccgatcggaaacagttgccg

SEQ ID NO: 134578 - DNA, 25 bp, Mus musculus
tcagcccgccgcagcttggatgtgg

SEQ ID NO: 134579 - DNA, 25 bp, Mus musculus
tcagcccggatgaggttaaagccct

SEQ ID NO: 134580 - DNA, 25 bp, Mus musculus
tcagccctagactctccggctaagt

SEQ ID NO: 134581 - DNA, 25 bp, Mus musculus
tcagccctgagtaagagagagacct

SEQ ID NO: 134582 - DNA, 25 bp, Mus musculus
tcagccctgagtccaagaagatcct

SEQ ID NO: 134583 - DNA, 25 bp, Mus musculus
tcagccctgtgaagatggtggaccg

SEQ ID NO: 134584 - DNA, 25 bp, Mus musculus
tcagccctgtggttctttgagtcgg

SEQ ID NO: 134585 - DNA, 25 bp, Mus musculus
tcagcccttctgactacaagatctt

SEQ ID NO: 134586 - DNA, 25 bp, Mus musculus
tcagccgaaagtccagaaatgagtg

SEQ ID NO: 134587 - DNA, 25 bp, Mus musculus
tcagccgacgaccactatgagtttg

SEQ ID NO: 134588 - DNA, 25 bp, Mus musculus
tcagccgagtatggtagtgcacacc

SEQ ID NO: 134589 - DNA, 25 bp, Mus musculus
tcagccgagtgaatgaaaggacctt

SEQ ID NO: 134590 - DNA, 25 bp, Mus musculus
tcagccgagtgtagttgaggagcct

SEQ ID NO: 134591 - DNA, 25 bp, Mus musculus
tcagccgatggtacacagcagttct

SEQ ID NO: 134592 - DNA, 25 bp, Mus musculus
tcagccgcaacccagaatagaggag

SEQ ID NO: 134593 - DNA, 25 bp, Mus musculus
tcagccgccgcctcggaaaattaag

SEQ ID NO: 134594 - DNA, 25 bp, Mus musculus
tcagccgcctgtgcgtgctgctgtg

SEQ ID NO: 134595 - DNA, 25 bp, Mus musculus
tcagccggcctgtgagatacgaaga

SEQ ID NO: 134596 - DNA, 25 bp, Mus musculus
tcagccgggatcagctgtcacagaa

SEQ ID NO: 134597 - DNA, 25 bp, Mus musculus
tcagccgggctaagctcaaagcctc

SEQ ID NO: 134598 - DNA, 25 bp, Mus musculus
tcagccgtggtgaactgagagttgc

SEQ ID NO: 134599 - DNA, 25 bp, Mus musculus
tcagccgtgtccttcagagataatg

SEQ ID NO: 134600 - DNA, 25 bp, Mus musculus
tcagcctaaccgaatgatgggcagc

SEQ ID NO: 134601 - DNA, 25 bp, Mus musculus
tcagcctagagagcgtgtgtactcg

SEQ ID NO: 134602 - DNA, 25 bp, Mus musculus
tcagcctagcagtaaaaccgaccag

SEQ ID NO: 134603 - DNA, 25 bp, Mus musculus
tcagcctaggcaccggatgatgagc

SEQ ID NO: 134604 - DNA, 25 bp, Mus musculus
tcagcctccgctatgactatgaaag

SEQ ID NO: 134605 - DNA, 25 bp, Mus musculus
tcagcctccgctggatgcgatggtg

SEQ ID NO: 134606 - DNA, 25 bp, Mus musculus
tcagcctgatcccaatcgtgtacag

SEQ ID NO: 134607 - DNA, 25 bp, Mus musculus
tcagcctgatccgtgtggactgcag

SEQ ID NO: 134608 - DNA, 25 bp, Mus musculus
tcagcctgctgtttcggaggcagaa

SEQ ID NO: 134609 - DNA, 25 bp, Mus musculus
tcagcctggaacaaaaggaggtcct

SEQ ID NO: 134610 - DNA, 25 bp, Mus musculus
tcagcctggattaccacgtcgatgg

SEQ ID NO: 134611 - DNA, 25 bp, Mus musculus
tcagcctggccaaaaatagagtggg

SEQ ID NO: 134612 - DNA, 25 bp, Mus musculus
tcagcctggctgacggtatcttggt

SEQ ID NO: 134613 - DNA, 25 bp, Mus musculus
tcagcctgggctctgcggaaatgct

SEQ ID NO: 134614 - DNA, 25 bp, Mus musculus
tcagccttagcgtcactatcgtcct

SEQ ID NO: 134615 - DNA, 25 bp, Mus musculus
tcagcctttgatcttcctagtccag

SEQ ID NO: 134616 - DNA, 25 bp, Mus musculus
tcagcctttgattggaagcgagaca

SEQ ID NO: 134617 - DNA, 25 bp, Mus musculus
tcagcctttgtctcgggccgctggg

SEQ ID NO: 134618 - DNA, 25 bp, Mus musculus
tcagcgaaagcgaaacaacctcatg

SEQ ID NO: 134619 - DNA, 25 bp, Mus musculus
tcagcgaatacacactggcgagaag

SEQ ID NO: 134620 - DNA, 25 bp, Mus musculus
tcagcgactacaccaatagcagggc

SEQ ID NO: 134621 - DNA, 25 bp, Mus musculus
tcagcgactctgcaacaattggcca

SEQ ID NO: 134622 - DNA, 25 bp, Mus musculus
tcagcgactcttccgaggaggactc

SEQ ID NO: 134623 - DNA, 25 bp, Mus musculus
tcagcgactgcccaatatggatgga

SEQ ID NO: 134624 - DNA, 25 bp, Mus musculus
tcagcgactggaagcattggagctc

SEQ ID NO: 134625 - DNA, 25 bp, Mus musculus
tcagcgagctggactgctcctttga

SEQ ID NO: 134626 - DNA, 25 bp, Mus musculus
tcagcgagtcaaggaacaatcggtt

SEQ ID NO: 134627 - DNA, 25 bp, Mus musculus
tcagcgagttctggatcctcagcac

SEQ ID NO: 134628 - DNA, 25 bp, Mus musculus
tcagcgatcagtcatcaaagaacac

SEQ ID NO: 134629 - DNA, 25 bp, Mus musculus
tcagcgcactagctgtgccctgctg

SEQ ID NO: 134630 - DNA, 25 bp, Mus musculus
tcagcgcatcacattggcagaagcc

SEQ ID NO: 134631 - DNA, 25 bp, Mus musculus
tcagcgccaaaagaaggctcgcgag

SEQ ID NO: 134632 - DNA, 25 bp, Mus musculus
tcagcgccacataaccctaggagta

SEQ ID NO: 134633 - DNA, 25 bp, Mus musculus
tcagcgcccagaaaaaagtgtgcag

SEQ ID NO: 134634 - DNA, 25 bp, Mus musculus
tcagcgcccattggtcctggtgagc

SEQ ID NO: 134635 - DNA, 25 bp, Mus musculus
tcagcgccgagatgagatgctccga

SEQ ID NO: 134636 - DNA, 25 bp, Mus musculus
tcagcgcgaggtgcacttcatgaag

SEQ ID NO: 134637 - DNA, 25 bp, Mus musculus
tcagcgcgttaatgacagttttggg

SEQ ID NO: 134638 - DNA, 25 bp, Mus musculus
tcagcgcttgcttcgagtatgggcc

SEQ ID NO: 134639 - DNA, 25 bp, Mus musculus
tcagcggagacatagagagccttag

SEQ ID NO: 134640 - DNA, 25 bp, Mus musculus
tcagcggatctgtatagagattacc

SEQ ID NO: 134641 - DNA, 25 bp, Mus musculus
tcagcggcaatacgaggagaagaac

SEQ ID NO: 134642 - DNA, 25 bp, Mus musculus
tcagcggcagcaggtattctattaa

SEQ ID NO: 134643 - DNA, 25 bp, Mus musculus
tcagcggccggctgagccagctgag

SEQ ID NO: 134644 - DNA, 25 bp, Mus musculus
tcagcggctgtctgaagaaattaca

SEQ ID NO: 134645 - DNA, 25 bp, Mus musculus
tcagcggctgtggatggcagaagcc

SEQ ID NO: 134646 - DNA, 25 bp, Mus musculus
tcagcgggaaagtgaggtcgtctcc

SEQ ID NO: 134647 - DNA, 25 bp, Mus musculus
tcagcgggctggtgaatcatgttcc

SEQ ID NO: 134648 - DNA, 25 bp, Mus musculus
tcagcggtacctggaatcttctcag

SEQ ID NO: 134649 - DNA, 25 bp, Mus musculus
tcagcggtggttctagcctcgtacg

SEQ ID NO: 134650 - DNA, 25 bp, Mus musculus
tcagcggttaataaaagggtccacg

SEQ ID NO: 134651 - DNA, 25 bp, Mus musculus
tcagcggttctatagcagctccaga

SEQ ID NO: 134652 - DNA, 25 bp, Mus musculus
tcagcgtaggatgggcaactgcgtc

SEQ ID NO: 134653 - DNA, 25 bp, Mus musculus
tcagcgtagggagctaactcaggcc

SEQ ID NO: 134654 - DNA, 25 bp, Mus musculus
tcagcgtattgataggaatagccaa

SEQ ID NO: 134655 - DNA, 25 bp, Mus musculus
tcagcgtcaaacacaacctggaggt

SEQ ID NO: 134656 - DNA, 25 bp, Mus musculus
tcagcgtcagttcagttgctcacag

SEQ ID NO: 134657 - DNA, 25 bp, Mus musculus
tcagcgtccccaaaggatgagcagg

SEQ ID NO: 134658 - DNA, 25 bp, Mus musculus
tcagcgtcttaggtgagtgcacagc

SEQ ID NO: 134659 - DNA, 25 bp, Mus musculus
tcagcgtgaatggaactgaccagtc

SEQ ID NO: 134660 - DNA, 25 bp, Mus musculus
tcagcgtggactggcctggccctag

SEQ ID NO: 134661 - DNA, 25 bp, Mus musculus
tcagcgtggagtgggataaagacca

SEQ ID NO: 134662 - DNA, 25 bp, Mus musculus
tcagcgtggtgagagaggattcccc

SEQ ID NO: 134663 - DNA, 25 bp, Mus musculus
tcagcgttcacaccgcagggttcag

SEQ ID NO: 134664 - DNA, 25 bp, Mus musculus
tcagcgttccagcaatcctaaaagg

SEQ ID NO: 134665 - DNA, 25 bp, Mus musculus
tcagcgttcccaagcagtgcaagac

SEQ ID NO: 134666 - DNA, 25 bp, Mus musculus
tcagctaaaaaggaaagccacaaat

SEQ ID NO: 134667 - DNA, 25 bp, Mus musculus
tcagctaaagtcacaacagacgggc

SEQ ID NO: 134668 - DNA, 25 bp, Mus musculus
tcagctaacaccagtgacacggtat

SEQ ID NO: 134669 - DNA, 25 bp, Mus musculus
tcagctaagttccagttacaccagg

SEQ ID NO: 134670 - DNA, 25 bp, Mus musculus
tcagctaatgctggtctcacggatg

SEQ ID NO: 134671 - DNA, 25 bp, Mus musculus
tcagctacgtggtcatgagcacagc

SEQ ID NO: 134672 - DNA, 25 bp, Mus musculus
tcagctagaaaggatcaccgaaggg

SEQ ID NO: 134673 - DNA, 25 bp, Mus musculus
tcagctagaacttcagacacatagt

SEQ ID NO: 134674 - DNA, 25 bp, Mus musculus
tcagctagacaaaagatctgtgccc

SEQ ID NO: 134675 - DNA, 25 bp, Mus musculus
tcagctagacttagatttcgtcaaa

SEQ ID NO: 134676 - DNA, 25 bp, Mus musculus
tcagctaggaaaatgagccctcact

SEQ ID NO: 134677 - DNA, 25 bp, Mus musculus
tcagctaggagatgccgggtctcag

SEQ ID NO: 134678 - DNA, 25 bp, Mus musculus
tcagctatgatcacgagcgggatgg

SEQ ID NO: 134679 - DNA, 25 bp, Mus musculus
tcagctatggcgatggcaacctggc

SEQ ID NO: 134680 - DNA, 25 bp, Mus musculus
tcagctattcagcaaagagctatta

SEQ ID NO: 134681 - DNA, 25 bp, Mus musculus
tcagctcaaggatgcaattgctcag

SEQ ID NO: 134682 - DNA, 25 bp, Mus musculus
tcagctcaatgagaaggaagccgcg

SEQ ID NO: 134683 - DNA, 25 bp, Mus musculus
tcagctcagaaactgttcctgatag

SEQ ID NO: 134684 - DNA, 25 bp, Mus musculus
tcagctcagagatcgaattgggtca

SEQ ID NO: 134685 - DNA, 25 bp, Mus musculus
tcagctcaggaccactgactgtaag

SEQ ID NO: 134686 - DNA, 25 bp, Mus musculus
tcagctcatcgtccagttgcggttc

SEQ ID NO: 134687 - DNA, 25 bp, Mus musculus
tcagctcatctatcaaaggaccatg

SEQ ID NO: 134688 - DNA, 25 bp, Mus musculus
tcagctccacattgagagcaagatc

SEQ ID NO: 134689 - DNA, 25 bp, Mus musculus
tcagctccagaggtatacaagtcag

SEQ ID NO: 134690 - DNA, 25 bp, Mus musculus
tcagctccagatcagctgagcttgg

SEQ ID NO: 134691 - DNA, 25 bp, Mus musculus
tcagctccatcagggacacaaggac

SEQ ID NO: 134692 - DNA, 25 bp, Mus musculus
tcagctcccggagctcagcgcgaag

SEQ ID NO: 134693 - DNA, 25 bp, Mus musculus
tcagctcgaggtaagctggatcacc

SEQ ID NO: 134694 - DNA, 25 bp, Mus musculus
tcagctcggccctcttcgttagcgg

SEQ ID NO: 134695 - DNA, 25 bp, Mus musculus
tcagctctaagcttgcagaatggcg

SEQ ID NO: 134696 - DNA, 25 bp, Mus musculus
tcagctctctgaatttgccaccagc

SEQ ID NO: 134697 - DNA, 25 bp, Mus musculus
tcagctctctggaggtcccgtaacg

SEQ ID NO: 134698 - DNA, 25 bp, Mus musculus
tcagctgaagaagatcgaggacctg

SEQ ID NO: 134699 - DNA, 25 bp, Mus musculus
tcagctgaagagcacaaggcgcatg

SEQ ID NO: 134700 - DNA, 25 bp, Mus musculus
tcagctgaatatctggtggccctgg

SEQ ID NO: 134701 - DNA, 25 bp, Mus musculus
tcagctgacagtaaatctggaagcc

SEQ ID NO: 134702 - DNA, 25 bp, Mus musculus
tcagctgactatgaaccctacgtgg

SEQ ID NO: 134703 - DNA, 25 bp, Mus musculus
tcagctgatcaaaaagaaggaggag

SEQ ID NO: 134704 - DNA, 25 bp, Mus musculus
tcagctgcacttttcgggacctgcg

SEQ ID NO: 134705 - DNA, 25 bp, Mus musculus
tcagctgccgagtgcatgccagcaa

SEQ ID NO: 134706 - DNA, 25 bp, Mus musculus
tcagctgcggaggatggagtcatcc

SEQ ID NO: 134707 - DNA, 25 bp, Mus musculus
tcagctgcggttcttgcgcgacgct

SEQ ID NO: 134708 - DNA, 25 bp, Mus musculus
tcagctgctaaccagagtctgcggg

SEQ ID NO: 134709 - DNA, 25 bp, Mus musculus
tcagctggacatgaagcacaaagag

SEQ ID NO: 134710 - DNA, 25 bp, Mus musculus
tcagctggagcgtggattgcacatc

SEQ ID NO: 134711 - DNA, 25 bp, Mus musculus
tcagctggccgctttacagagaagg

SEQ ID NO: 134712 - DNA, 25 bp, Mus musculus
tcagctggccggatacaaaggtcat

SEQ ID NO: 134713 - DNA, 25 bp, Mus musculus
tcagctgggatgaccagaaagttcg

SEQ ID NO: 134714 - DNA, 25 bp, Mus musculus
tcagctgggccggaataagatcaca

SEQ ID NO: 134715 - DNA, 25 bp, Mus musculus
tcagctgggctttgccctacccagg

SEQ ID NO: 134716 - DNA, 25 bp, Mus musculus
tcagctggtgcagtcagaaaaactc

SEQ ID NO: 134717 - DNA, 25 bp, Mus musculus
tcagctggtgtgagatgcagtgccc

SEQ ID NO: 134718 - DNA, 25 bp, Mus musculus
tcagctgtcaccgtaggagatttcc

SEQ ID NO: 134719 - DNA, 25 bp, Mus musculus
tcagctgtctatgaggacccacaag

SEQ ID NO: 134720 - DNA, 25 bp, Mus musculus
tcagctgtgggaaacgagctttgct

SEQ ID NO: 134721 - DNA, 25 bp, Mus musculus
tcagctgtgtaagaagggagccact

SEQ ID NO: 134722 - DNA, 25 bp, Mus musculus
tcagctgtgtgtggagtaaccgacg

SEQ ID NO: 134723 - DNA, 25 bp, Mus musculus
tcagctgttctggagatatggccca

SEQ ID NO: 134724 - DNA, 25 bp, Mus musculus
tcagctgttgagaggttcgtgctca

SEQ ID NO: 134725 - DNA, 25 bp, Mus musculus
tcagcttaagggtatagttaccaaa

SEQ ID NO: 134726 - DNA, 25 bp, Mus musculus
tcagcttaagtggtgcctgttagcc

SEQ ID NO: 134727 - DNA, 25 bp, Mus musculus
tcagcttacgacgaagcttcgtgcc

SEQ ID NO: 134728 - DNA, 25 bp, Mus musculus
tcagcttagtgtgggcaaggtccag

SEQ ID NO: 134729 - DNA, 25 bp, Mus musculus
tcagcttatgtgcaaggttgcgagc

SEQ ID NO: 134730 - DNA, 25 bp, Mus musculus
tcagcttattgaccagccagggttt

SEQ ID NO: 134731 - DNA, 25 bp, Mus musculus
tcagcttcaagtacaggcagagagt

SEQ ID NO: 134732 - DNA, 25 bp, Mus musculus
tcagcttcatgatcactcacctgcg

SEQ ID NO: 134733 - DNA, 25 bp, Mus musculus
tcagcttccaggagcctcacttcta

SEQ ID NO: 134734 - DNA, 25 bp, Mus musculus
tcagcttccgcatctacaagtccgt

SEQ ID NO: 134735 - DNA, 25 bp, Mus musculus
tcagcttcgaatgcagtgaggccct

SEQ ID NO: 134736 - DNA, 25 bp, Mus musculus
tcagcttcgacgtgtgcaatgccag

SEQ ID NO: 134737 - DNA, 25 bp, Mus musculus
tcagcttcggcctgtgcatcgcctt

SEQ ID NO: 134738 - DNA, 25 bp, Mus musculus
tcagcttctaaactccaagggtgga

SEQ ID NO: 134739 - DNA, 25 bp, Mus musculus
tcagcttctggaatgagccacagcc

SEQ ID NO: 134740 - DNA, 25 bp, Mus musculus
tcagcttggatgtctggcacccgac

SEQ ID NO: 134741 - DNA, 25 bp, Mus musculus
tcagcttgggcaagaagaagtcttc

SEQ ID NO: 134742 - DNA, 25 bp, Mus musculus
tcagcttgtggctcgtcagaggacc

SEQ ID NO: 134743 - DNA, 25 bp, Mus musculus
tcagctttaacggacaggcctggga

SEQ ID NO: 134744 - DNA, 25 bp, Mus musculus
tcagctttgagagttccatggatca

SEQ ID NO: 134745 - DNA, 25 bp, Mus musculus
tcagcttttacgtcgagtccaggtc

SEQ ID NO: 134746 - DNA, 25 bp, Mus musculus
tcaggaaaatcaagaccccagggat

SEQ ID NO: 134747 - DNA, 25 bp, Mus musculus
tcaggaaaccaaagtcccagtggcc

SEQ ID NO: 134748 - DNA, 25 bp, Mus musculus
tcaggaaagctacagatcgctcagc

SEQ ID NO: 134749 - DNA, 25 bp, Mus musculus
tcaggaaattgcaacatggtgacat

SEQ ID NO: 134750 - DNA, 25 bp, Mus musculus
tcaggaacaaactcagccaggcaga

SEQ ID NO: 134751 - DNA, 25 bp, Mus musculus
tcaggaacctctgccatggagtgaa

SEQ ID NO: 134752 - DNA, 25 bp, Mus musculus
tcaggaacgccagcgagaacgagaa

SEQ ID NO: 134753 - DNA, 25 bp, Mus musculus
tcaggaacgtagcaacttggaagaa

SEQ ID NO: 134754 - DNA, 25 bp, Mus musculus
tcaggaagaactgcagtgggtgcca

SEQ ID NO: 134755 - DNA, 25 bp, Mus musculus
tcaggaagacactaggtcacccagg

SEQ ID NO: 134756 - DNA, 25 bp, Mus musculus
tcaggaagcgatggagagcgagtct

SEQ ID NO: 134757 - DNA, 25 bp, Mus musculus
tcaggaagctacaactggaatggca

SEQ ID NO: 134758 - DNA, 25 bp, Mus musculus
tcaggaagtcctctccaatggctgt

SEQ ID NO: 134759 - DNA, 25 bp, Mus musculus
tcaggaagtttagagcatgccagcc

SEQ ID NO: 134760 - DNA, 25 bp, Mus musculus
tcaggaataaattacctagttaact

SEQ ID NO: 134761 - DNA, 25 bp, Mus musculus
tcaggaatctacctgtgggccgccg

SEQ ID NO: 134762 - DNA, 25 bp, Mus musculus
tcaggaatgactccccgtgtggtac

SEQ ID NO: 134763 - DNA, 25 bp, Mus musculus
tcaggaatgccacaagcccataggt

SEQ ID NO: 134764 - DNA, 25 bp, Mus musculus
tcaggaatgtatccacagcggcctt

SEQ ID NO: 134765 - DNA, 25 bp, Mus musculus
tcaggaatgtcgctgccacaacggt

SEQ ID NO: 134766 - DNA, 25 bp, Mus musculus
tcaggaattgcgcagcctcttcgag

SEQ ID NO: 134767 - DNA, 25 bp, Mus musculus
tcaggacaaggatggtgcagatgct

SEQ ID NO: 134768 - DNA, 25 bp, Mus musculus
tcaggacacacataagcccagagag

SEQ ID NO: 134769 - DNA, 25 bp, Mus musculus
tcaggacactgcgtttcagaagcca

SEQ ID NO: 134770 - DNA, 25 bp, Mus musculus
tcaggacactgtacagcgatgccgt

SEQ ID NO: 134771 - DNA, 25 bp, Mus musculus
tcaggacagtagatccagagacgca

SEQ ID NO: 134772 - DNA, 25 bp, Mus musculus
tcaggacatggcaggcataggcgct

SEQ ID NO: 134773 - DNA, 25 bp, Mus musculus
tcaggacattgcacatgccttggcc

SEQ ID NO: 134774 - DNA, 25 bp, Mus musculus
tcaggaccactgactgtaaggactc

SEQ ID NO: 134775 - DNA, 25 bp, Mus musculus
tcaggaccagccacgtcaagatgtg

SEQ ID NO: 134776 - DNA, 25 bp, Mus musculus
tcaggaccagcctatgagcataagg

SEQ ID NO: 134777 - DNA, 25 bp, Mus musculus
tcaggaccaggcaagagaagtagct

SEQ ID NO: 134778 - DNA, 25 bp, Mus musculus
tcaggaccatcagaggagaactttg

SEQ ID NO: 134779 - DNA, 25 bp, Mus musculus
tcaggacctggaacaagaacgaatg

SEQ ID NO: 134780 - DNA, 25 bp, Mus musculus
tcaggacgacaatcaccaggagttg

SEQ ID NO: 134781 - DNA, 25 bp, Mus musculus
tcaggacgacgcagaacctttcaac

SEQ ID NO: 134782 - DNA, 25 bp, Mus musculus
tcaggacgacttgcagacccaagac

SEQ ID NO: 134783 - DNA, 25 bp, Mus musculus
tcaggacgagagagtcataggctcc

SEQ ID NO: 134784 - DNA, 25 bp, Mus musculus
tcaggacggtctatcaagtaggcgg

SEQ ID NO: 134785 - DNA, 25 bp, Mus musculus
tcaggacgtgaacaaaagaagggct

SEQ ID NO: 134786 - DNA, 25 bp, Mus musculus
tcaggacgttaagcatgaggctacc

SEQ ID NO: 134787 - DNA, 25 bp, Mus musculus
tcaggactcaaaaaggactcgcggc

SEQ ID NO: 134788 - DNA, 25 bp, Mus musculus
tcaggactccggacgatactggtgt

SEQ ID NO: 134789 - DNA, 25 bp, Mus musculus
tcaggactcctataagggcaggaga

SEQ ID NO: 134790 - DNA, 25 bp, Mus musculus
tcaggactgagcagacacagggact

SEQ ID NO: 134791 - DNA, 25 bp, Mus musculus
tcaggactggcaacaaccatatggt

SEQ ID NO: 134792 - DNA, 25 bp, Mus musculus
tcaggactgtggaagacgtaccgac

SEQ ID NO: 134793 - DNA, 25 bp, Mus musculus
tcaggactttattgactacttcttg

SEQ ID NO: 134794 - DNA, 25 bp, Mus musculus
tcaggactttgaccatgacgtgaaa

SEQ ID NO: 134795 - DNA, 25 bp, Mus musculus
tcaggagaaccagagagatggtgcc

SEQ ID NO: 134796 - DNA, 25 bp, Mus musculus
tcaggagaaccaggatactcggccc

SEQ ID NO: 134797 - DNA, 25 bp, Mus musculus
tcaggagaccacgatataaaccagg

SEQ ID NO: 134798 - DNA, 25 bp, Mus musculus
tcaggagacgttcatccagatagct

SEQ ID NO: 134799 - DNA, 25 bp, Mus musculus
tcaggagactcaaacacggcagatc

SEQ ID NO: 134800 - DNA, 25 bp, Mus musculus
tcaggagcaaaaggcatggtcgaca

SEQ ID NO: 134801 - DNA, 25 bp, Mus musculus
tcaggagcacagctgccgaagttca

SEQ ID NO: 134802 - DNA, 25 bp, Mus musculus
tcaggagcagcatgccttgaagcac

SEQ ID NO: 134803 - DNA, 25 bp, Mus musculus
tcaggagcaggccaccatattcgag

SEQ ID NO: 134804 - DNA, 25 bp, Mus musculus
tcaggagcatcagacttgcagctgc

SEQ ID NO: 134805 - DNA, 25 bp, Mus musculus
tcaggagcccagagacactgagcag

SEQ ID NO: 134806 - DNA, 25 bp, Mus musculus
tcaggagccttccttacagcaggag

SEQ ID NO: 134807 - DNA, 25 bp, Mus musculus
tcaggaggagacgatgactggacac

SEQ ID NO: 134808 - DNA, 25 bp, Mus musculus
tcaggaggattaggacgctcagcct

SEQ ID NO: 134809 - DNA, 25 bp, Mus musculus
tcaggaggcagagtggaatcaaatc

SEQ ID NO: 134810 - DNA, 25 bp, Mus musculus
tcaggaggccctactatgtgtcaca

SEQ ID NO: 134811 - DNA, 25 bp, Mus musculus
tcaggagggaaaatacttgttcgga

SEQ ID NO: 134812 - DNA, 25 bp, Mus musculus
tcaggaggtgcaggttccagaggct

SEQ ID NO: 134813 - DNA, 25 bp, Mus musculus
tcaggagtcgatgtcttagggctgc

SEQ ID NO: 134814 - DNA, 25 bp, Mus musculus
tcaggagtcgggaagacaacatttc

SEQ ID NO: 134815 - DNA, 25 bp, Mus musculus
tcaggagtctccagtgccgaatggc

SEQ ID NO: 134816 - DNA, 25 bp, Mus musculus
tcaggagtgcagtacaaaggacatg

SEQ ID NO: 134817 - DNA, 25 bp, Mus musculus
tcaggagtggaccaggaactctcaa

SEQ ID NO: 134818 - DNA, 25 bp, Mus musculus
tcaggagttggtgcttcggactgcc

SEQ ID NO: 134819 - DNA, 25 bp, Mus musculus
tcaggagtttacatgagtactatgc

SEQ ID NO: 134820 - DNA, 25 bp, Mus musculus
tcaggataaagtgcgatgccacaag

SEQ ID NO: 134821 - DNA, 25 bp, Mus musculus
tcaggatactccataagaagtgctg

SEQ ID NO: 134822 - DNA, 25 bp, Mus musculus
tcaggatcatcccagagcagagtat

SEQ ID NO: 134823 - DNA, 25 bp, Mus musculus
tcaggatcctgctgcactcagcttc

SEQ ID NO: 134824 - DNA, 25 bp, Mus musculus
tcaggatcggtttccccagtgaaga

SEQ ID NO: 134825 - DNA, 25 bp, Mus musculus
tcaggatctcgtagtccatcacggg

SEQ ID NO: 134826 - DNA, 25 bp, Mus musculus
tcaggatgccatcgtagagagctca

SEQ ID NO: 134827 - DNA, 25 bp, Mus musculus
tcaggatgccgaacatgagcttctc

SEQ ID NO: 134828 - DNA, 25 bp, Mus musculus
tcaggatgcgccgaacgtctgcgac

SEQ ID NO: 134829 - DNA, 25 bp, Mus musculus
tcaggatgctgaggccttgtacaca

SEQ ID NO: 134830 - DNA, 25 bp, Mus musculus
tcaggatgctttccgtctatggtgc

SEQ ID NO: 134831 - DNA, 25 bp, Mus musculus
tcaggatgcttttaccactcagtgg

SEQ ID NO: 134832 - DNA, 25 bp, Mus musculus
tcaggatgtgcctctggtcttgtcc

SEQ ID NO: 134833 - DNA, 25 bp, Mus musculus
tcaggattcctaagaagtggatcag

SEQ ID NO: 134834 - DNA, 25 bp, Mus musculus
tcaggattccttcgatgacgagctc

SEQ ID NO: 134835 - DNA, 25 bp, Mus musculus
tcaggcaaagactgctgagacccat

SEQ ID NO: 134836 - DNA, 25 bp, Mus musculus
tcaggcaaatcagggacattggctc

SEQ ID NO: 134837 - DNA, 25 bp, Mus musculus
tcaggcaacatctacaggcaacggg

SEQ ID NO: 134838 - DNA, 25 bp, Mus musculus
tcaggcaagcagtccatattgtctg

SEQ ID NO: 134839 - DNA, 25 bp, Mus musculus
tcaggcaagcccagaagttccgaca

SEQ ID NO: 134840 - DNA, 25 bp, Mus musculus
tcaggcactcatcagcgcgtttgga

SEQ ID NO: 134841 - DNA, 25 bp, Mus musculus
tcaggcagagaatggacaacgttac

SEQ ID NO: 134842 - DNA, 25 bp, Mus musculus
tcaggcagccggcttttaatcccag

SEQ ID NO: 134843 - DNA, 25 bp, Mus musculus
tcaggcagctggacaagtgcaccat

SEQ ID NO: 134844 - DNA, 25 bp, Mus musculus
tcaggcagtcccaaggaggagaaga

SEQ ID NO: 134845 - DNA, 25 bp, Mus musculus
tcaggcagttggagtacagagagca

SEQ ID NO: 134846 - DNA, 25 bp, Mus musculus
tcaggcatccatagttcgggctcca

SEQ ID NO: 134847 - DNA, 25 bp, Mus musculus
tcaggcatgctgaatatggaaggca

SEQ ID NO: 134848 - DNA, 25 bp, Mus musculus
tcaggcatgcttggcttatttgacc

SEQ ID NO: 134849 - DNA, 25 bp, Mus musculus
tcaggcattacccaaacctgcaagc

SEQ ID NO: 134850 - DNA, 25 bp, Mus musculus
tcaggccaaaaggttgagcagtccc

SEQ ID NO: 134851 - DNA, 25 bp, Mus musculus
tcaggccaagtgcttaccaacgtgt

SEQ ID NO: 134852 - DNA, 25 bp, Mus musculus
tcaggccagaattcttcagtgaagg

SEQ ID NO: 134853 - DNA, 25 bp, Mus musculus
tcaggccagcagtacaccttcaagg

SEQ ID NO: 134854 - DNA, 25 bp, Mus musculus
tcaggccaggccgagagtatttcta

SEQ ID NO: 134855 - DNA, 25 bp, Mus musculus
tcaggccagggacttaacttcagca

SEQ ID NO: 134856 - DNA, 25 bp, Mus musculus
tcaggcccaagaagtacatcgcgtc

SEQ ID NO: 134857 - DNA, 25 bp, Mus musculus
tcaggcccgcttttccagagagagg

SEQ ID NO: 134858 - DNA, 25 bp, Mus musculus
tcaggcccggaagccacttgcaatt

SEQ ID NO: 134859 - DNA, 25 bp, Mus musculus
tcaggccgggagacgtctgtgcctc

SEQ ID NO: 134860 - DNA, 25 bp, Mus musculus
tcaggccgtggaccaagagcttttt

SEQ ID NO: 134861 - DNA, 25 bp, Mus musculus
tcaggccttgttcccatgtggtatc

SEQ ID NO: 134862 - DNA, 25 bp, Mus musculus
tcaggcctttgagttgggagataca

SEQ ID NO: 134863 - DNA, 25 bp, Mus musculus
tcaggcgagttcacaagcgcagact

SEQ ID NO: 134864 - DNA, 25 bp, Mus musculus
tcaggcgcacttcttcgagcatcca

SEQ ID NO: 134865 - DNA, 25 bp, Mus musculus
tcaggcggccacgtttgttaaggga

SEQ ID NO: 134866 - DNA, 25 bp, Mus musculus
tcaggctaaagtgcataaagagggc

SEQ ID NO: 134867 - DNA, 25 bp, Mus musculus
tcaggctaaataccagcgcttacgg

SEQ ID NO: 134868 - DNA, 25 bp, Mus musculus
tcaggctatacagtggatcttacac

SEQ ID NO: 134869 - DNA, 25 bp, Mus musculus
tcaggctatccttggttccacggca

SEQ ID NO: 134870 - DNA, 25 bp, Mus musculus
tcaggctcgaggaactatggcagca

SEQ ID NO: 134871 - DNA, 25 bp, Mus musculus
tcaggctgactcttagaaagggtag

SEQ ID NO: 134872 - DNA, 25 bp, Mus musculus
tcaggctgagcaaaatgaaaccttg

SEQ ID NO: 134873 - DNA, 25 bp, Mus musculus
tcaggctgcggattactttggcgat

SEQ ID NO: 134874 - DNA, 25 bp, Mus musculus
tcaggctgctgtgcgattcccagac

SEQ ID NO: 134875 - DNA, 25 bp, Mus musculus
tcaggctgctgtggttcatgccaca

SEQ ID NO: 134876 - DNA, 25 bp, Mus musculus
tcaggctggacatggagagcccaag

SEQ ID NO: 134877 - DNA, 25 bp, Mus musculus
tcaggctgggcactcagagcaaaat

SEQ ID NO: 134878 - DNA, 25 bp, Mus musculus
tcaggctggtgtgttgactgctcca

SEQ ID NO: 134879 - DNA, 25 bp, Mus musculus
tcaggctgtccagagagcgtcacag

SEQ ID NO: 134880 - DNA, 25 bp, Mus musculus
tcaggctgtgtcgttcgcaggaagc

SEQ ID NO: 134881 - DNA, 25 bp, Mus musculus
tcaggcttatcgacgggtggttcac

SEQ ID NO: 134882 - DNA, 25 bp, Mus musculus
tcaggcttggattctagtcacaggt

SEQ ID NO: 134883 - DNA, 25 bp, Mus musculus
tcaggcttgtgtcttcggcagtgct

SEQ ID NO: 134884 - DNA, 25 bp, Mus musculus
tcaggctttgggacacgtttggaga

SEQ ID NO: 134885 - DNA, 25 bp, Mus musculus
tcaggctttttaggcttgtcacaaa

SEQ ID NO: 134886 - DNA, 25 bp, Mus musculus
tcagggaaacaagagacacgtggct

SEQ ID NO: 134887 - DNA, 25 bp, Mus musculus
tcagggaagaacgagcatggctatt

SEQ ID NO: 134888 - DNA, 25 bp, Mus musculus
tcagggaagcccagacactgtgctg

SEQ ID NO: 134889 - DNA, 25 bp, Mus musculus
tcagggacactgtggacagcctgag

SEQ ID NO: 134890 - DNA, 25 bp, Mus musculus
tcagggaccaccataccctacctat

SEQ ID NO: 134891 - DNA, 25 bp, Mus musculus
tcagggaccccacggtgaatcaatt

SEQ ID NO: 134892 - DNA, 25 bp, Mus musculus
tcagggacccctggatgctcaagtt

SEQ ID NO: 134893 - DNA, 25 bp, Mus musculus
tcagggacccgggagttgatctcag

SEQ ID NO: 134894 - DNA, 25 bp, Mus musculus
tcagggaccgagcagccttagagaa

SEQ ID NO: 134895 - DNA, 25 bp, Mus musculus
tcagggactctactccgaatcagta

SEQ ID NO: 134896 - DNA, 25 bp, Mus musculus
tcagggactgtcacaacgtgtctgt

SEQ ID NO: 134897 - DNA, 25 bp, Mus musculus
tcagggagaatggagacctcactgc

SEQ ID NO: 134898 - DNA, 25 bp, Mus musculus
tcagggagacctgcctaatgataaa

SEQ ID NO: 134899 - DNA, 25 bp, Mus musculus
tcagggagacggaattgtacaacac

SEQ ID NO: 134900 - DNA, 25 bp, Mus musculus
tcagggaggaacacccagaaacagg

SEQ ID NO: 134901 - DNA, 25 bp, Mus musculus
tcagggagtcacacttggagcagaa

SEQ ID NO: 134902 - DNA, 25 bp, Mus musculus
tcagggatgaactgtgaccaaggcc

SEQ ID NO: 134903 - DNA, 25 bp, Mus musculus
tcagggatgctagaccaaccaggat

SEQ ID NO: 134904 - DNA, 25 bp, Mus musculus
tcagggatggcggatccggccggag

SEQ ID NO: 134905 - DNA, 25 bp, Mus musculus
tcagggatgggatcagcgattcgtc

SEQ ID NO: 134906 - DNA, 25 bp, Mus musculus
tcagggatgggctcaaacttatgct

SEQ ID NO: 134907 - DNA, 25 bp, Mus musculus
tcagggattcgttcaagctcacagc

SEQ ID NO: 134908 - DNA, 25 bp, Mus musculus
tcagggatttgaagagagccgccca

SEQ ID NO: 134909 - DNA, 25 bp, Mus musculus
tcagggcaaacaacgtcagtccgat

SEQ ID NO: 134910 - DNA, 25 bp, Mus musculus
tcagggcagctccagtatattccag

SEQ ID NO: 134911 - DNA, 25 bp, Mus musculus
tcagggcataaaagttggacaccac

SEQ ID NO: 134912 - DNA, 25 bp, Mus musculus
tcagggccaactgcgaattcttcgg

SEQ ID NO: 134913 - DNA, 25 bp, Mus musculus
tcagggccatacctggtcatcaagg

SEQ ID NO: 134914 - DNA, 25 bp, Mus musculus
tcagggccccagaaggttctgatat

SEQ ID NO: 134915 - DNA, 25 bp, Mus musculus
tcagggccccatgggaacaagcatg

SEQ ID NO: 134916 - DNA, 25 bp, Mus musculus
tcagggccgcgtcgtctacggtcct

SEQ ID NO: 134917 - DNA, 25 bp, Mus musculus
tcagggcctccagagtaaaatcagt

SEQ ID NO: 134918 - DNA, 25 bp, Mus musculus
tcagggctccagtcaggccgagccg

SEQ ID NO: 134919 - DNA, 25 bp, Mus musculus
tcagggctcttgataaaggatccaa

SEQ ID NO: 134920 - DNA, 25 bp, Mus musculus
tcagggcttcccagatagcgtcagc

SEQ ID NO: 134921 - DNA, 25 bp, Mus musculus
tcagggtacacatgcattcttggag

SEQ ID NO: 134922 - DNA, 25 bp, Mus musculus
tcagggtaggtgtctcaagccaaat

SEQ ID NO: 134923 - DNA, 25 bp, Mus musculus
tcagggtccccagctttacgtagaa

SEQ ID NO: 134924 - DNA, 25 bp, Mus musculus
tcagggtcgccactgtgagcaaagc

SEQ ID NO: 134925 - DNA, 25 bp, Mus musculus
tcagggtcggaaggagtcggaggca

SEQ ID NO: 134926 - DNA, 25 bp, Mus musculus
tcagggtctcaagatctacagtggg

SEQ ID NO: 134927 - DNA, 25 bp, Mus musculus
tcagggtgcaagtaaaacccgaggt

SEQ ID NO: 134928 - DNA, 25 bp, Mus musculus
tcagggtgcccaaaaaagcgtcctc

SEQ ID NO: 134929 - DNA, 25 bp, Mus musculus
tcagggtggaaaataaaaggccatc

SEQ ID NO: 134930 - DNA, 25 bp, Mus musculus
tcagggtggccttcgtgtcgtgaca

SEQ ID NO: 134931 - DNA, 25 bp, Mus musculus
tcagggtgggaccagcacaattctc

SEQ ID NO: 134932 - DNA, 25 bp, Mus musculus
tcagggtttcgggaaccagacctct

SEQ ID NO: 134933 - DNA, 25 bp, Mus musculus
tcaggtaaccctgcagtgaagctgt

SEQ ID NO: 134934 - DNA, 25 bp, Mus musculus
tcaggtagacttgggctgggacctc

SEQ ID NO: 134935 - DNA, 25 bp, Mus musculus
tcaggtagggatgttgccgctcaac

SEQ ID NO: 134936 - DNA, 25 bp, Mus musculus
tcaggtagtaaagacatcgaggctc

SEQ ID NO: 134937 - DNA, 25 bp, Mus musculus
tcaggtatggcagaactgtgccgca

SEQ ID NO: 134938 - DNA, 25 bp, Mus musculus
tcaggtatgggaagaagcgcttcac

SEQ ID NO: 134939 - DNA, 25 bp, Mus musculus
tcaggtatgggatctgcaactccag

SEQ ID NO: 134940 - DNA, 25 bp, Mus musculus
tcaggtcaccgagcacgagtatttg

SEQ ID NO: 134941 - DNA, 25 bp, Mus musculus
tcaggtcacgcaagggcacttatgc

SEQ ID NO: 134942 - DNA, 25 bp, Mus musculus
tcaggtcagacaactcaggaaggca

SEQ ID NO: 134943 - DNA, 25 bp, Mus musculus
tcaggtcgaagatcagaatacaggt

SEQ ID NO: 134944 - DNA, 25 bp, Mus musculus
tcaggtcgcttggatcaatttcctt

SEQ ID NO: 134945 - DNA, 25 bp, Mus musculus
tcaggtctataggaaaggcccctct

SEQ ID NO: 134946 - DNA, 25 bp, Mus musculus
tcaggtctctatgtgctcgggctca

SEQ ID NO: 134947 - DNA, 25 bp, Mus musculus
tcaggtgaatgttctggcgcccgtt

SEQ ID NO: 134948 - DNA, 25 bp, Mus musculus
tcaggtgacaagcaatggccatgtg

SEQ ID NO: 134949 - DNA, 25 bp, Mus musculus
tcaggtgacatagatggacttccaa

SEQ ID NO: 134950 - DNA, 25 bp, Mus musculus
tcaggtgacccaggcaggcagtcag

SEQ ID NO: 134951 - DNA, 25 bp, Mus musculus
tcaggtgatcaagtggaggccttcc

SEQ ID NO: 134952 - DNA, 25 bp, Mus musculus
tcaggtgcaacatcccagacatggg

SEQ ID NO: 134953 - DNA, 25 bp, Mus musculus
tcaggtgccagctaaccaagggtgg

SEQ ID NO: 134954 - DNA, 25 bp, Mus musculus
tcaggtgcctgacaatcccgtggtg

SEQ ID NO: 134955 - DNA, 25 bp, Mus musculus
tcaggtggaaaagccatagtgcctc

SEQ ID NO: 134956 - DNA, 25 bp, Mus musculus
tcaggtggaacaagtggattcgaag

SEQ ID NO: 134957 - DNA, 25 bp, Mus musculus
tcaggtggacttccgtgaacgcagc

SEQ ID NO: 134958 - DNA, 25 bp, Mus musculus
tcaggtggtcgagcagatggtcatc

SEQ ID NO: 134959 - DNA, 25 bp, Mus musculus
tcaggtgtaactcccagcttcggca

SEQ ID NO: 134960 - DNA, 25 bp, Mus musculus
tcaggtgtcacctaacattggcagg

SEQ ID NO: 134961 - DNA, 25 bp, Mus musculus
tcaggtgtccctaaatgctggctac

SEQ ID NO: 134962 - DNA, 25 bp, Mus musculus
tcaggtgtcgactggcaacccagag

SEQ ID NO: 134963 - DNA, 25 bp, Mus musculus
tcaggtgtgaccttcccgttcaggc

SEQ ID NO: 134964 - DNA, 25 bp, Mus musculus
tcaggtgtgggctccaggcttgaaa

SEQ ID NO: 134965 - DNA, 25 bp, Mus musculus
tcaggttacatgactcccggcttga

SEQ ID NO: 134966 - DNA, 25 bp, Mus musculus
tcaggttatcttctaccgagagggc

SEQ ID NO: 134967 - DNA, 25 bp, Mus musculus
tcaggttccagtaaagcccctgcgg

SEQ ID NO: 134968 - DNA, 25 bp, Mus musculus
tcaggttgaaagcacagatagcagc

SEQ ID NO: 134969 - DNA, 25 bp, Mus musculus
tcaggttggactagccctggccagg

SEQ ID NO: 134970 - DNA, 25 bp, Mus musculus
tcaggttggagttcaacagatgctc

SEQ ID NO: 134971 - DNA, 25 bp, Mus musculus
tcaggttggctgcaaaataatgtcc

SEQ ID NO: 134972 - DNA, 25 bp, Mus musculus
tcaggttgtgaagtgagaattccag

SEQ ID NO: 134973 - DNA, 25 bp, Mus musculus
tcaggtttacctgggacagcagaag

SEQ ID NO: 134974 - DNA, 25 bp, Mus musculus
tcaggtttctgcctccaggaaggtc

SEQ ID NO: 134975 - DNA, 25 bp, Mus musculus
tcaggttttggctcgaaggaaatcg

SEQ ID NO: 134976 - DNA, 25 bp, Mus musculus
tcagtaaaaagccatcacctccagg

SEQ ID NO: 134977 - DNA, 25 bp, Mus musculus
tcagtaaactggcttaacggagacc

SEQ ID NO: 134978 - DNA, 25 bp, Mus musculus
tcagtaaaggccacgaggctgccat

SEQ ID NO: 134979 - DNA, 25 bp, Mus musculus
tcagtaacaaaccactttcctcagc

SEQ ID NO: 134980 - DNA, 25 bp, Mus musculus
tcagtaacaactccagcctgactgc

SEQ ID NO: 134981 - DNA, 25 bp, Mus musculus
tcagtaacacaaactccactctgct

SEQ ID NO: 134982 - DNA, 25 bp, Mus musculus
tcagtaacacttccccaggagggcc

SEQ ID NO: 134983 - DNA, 25 bp, Mus musculus
tcagtaacctaccaagaaaagcccg

SEQ ID NO: 134984 - DNA, 25 bp, Mus musculus
tcagtaactatctccagagagaggt

SEQ ID NO: 134985 - DNA, 25 bp, Mus musculus
tcagtaagggagaccagctgtccac

SEQ ID NO: 134986 - DNA, 25 bp, Mus musculus
tcagtaaggtacagctatggccggg

SEQ ID NO: 134987 - DNA, 25 bp, Mus musculus
tcagtaatgtctccccagtgaaagg

SEQ ID NO: 134988 - DNA, 25 bp, Mus musculus
tcagtaattagtccacacggtcggt

SEQ ID NO: 134989 - DNA, 25 bp, Mus musculus
tcagtacaaagaacagaacccttgg

SEQ ID NO: 134990 - DNA, 25 bp, Mus musculus
tcagtacaaggagcagatgagccac

SEQ ID NO: 134991 - DNA, 25 bp, Mus musculus
tcagtacactggtggtgatggctat

SEQ ID NO: 134992 - DNA, 25 bp, Mus musculus
tcagtacagtaacgatgtgccctac

SEQ ID NO: 134993 - DNA, 25 bp, Mus musculus
tcagtaccacgtgaggaacaacagt

SEQ ID NO: 134994 - DNA, 25 bp, Mus musculus
tcagtacccacctggtcgtgggggt

SEQ ID NO: 134995 - DNA, 25 bp, Mus musculus
tcagtacccgtatttgagatccgtg

SEQ ID NO: 134996 - DNA, 25 bp, Mus musculus
tcagtaccggagatgcactggccag

SEQ ID NO: 134997 - DNA, 25 bp, Mus musculus
tcagtaccgggtgtccatgctcaag

SEQ ID NO: 134998 - DNA, 25 bp, Mus musculus
tcagtacctgtccaaaatggtgccc

SEQ ID NO: 134999 - DNA, 25 bp, Mus musculus
tcagtacgagcgagaaggattcacc

SEQ ID NO: 135000 - DNA, 25 bp, Mus musculus
tcagtactactgtggtgttctctac

SEQ ID NO: 135001 - DNA, 25 bp, Mus musculus
tcagtactgcctgcgaggagatcaa

SEQ ID NO: 135002 - DNA, 25 bp, Mus musculus
tcagtagaagatgccgatgagcctc

SEQ ID NO: 135003 - DNA, 25 bp, Mus musculus
tcagtagatcagttgcagaaggcaa

SEQ ID NO: 135004 - DNA, 25 bp, Mus musculus
tcagtagatgctaggagagaacccc

SEQ ID NO: 135005 - DNA, 25 bp, Mus musculus
tcagtagcatgtctctgggccaact

SEQ ID NO: 135006 - DNA, 25 bp, Mus musculus
tcagtagcatttggaaaacgagtgg

SEQ ID NO: 135007 - DNA, 25 bp, Mus musculus
tcagtagccctgtatgacatccgga

SEQ ID NO: 135008 - DNA, 25 bp, Mus musculus
tcagtagctaaaggtgctgccacca

SEQ ID NO: 135009 - DNA, 25 bp, Mus musculus
tcagtaggaacaccatcggagcgag

SEQ ID NO: 135010 - DNA, 25 bp, Mus musculus
tcagtaggacacatctgagcagtct

SEQ ID NO: 135011 - DNA, 25 bp, Mus musculus
tcagtataaagcagacagaaccaga

SEQ ID NO: 135012 - DNA, 25 bp, Mus musculus
tcagtataatcaacagcaggcccct

SEQ ID NO: 135013 - DNA, 25 bp, Mus musculus
tcagtatagctcagaaacaaggccc

SEQ ID NO: 135014 - DNA, 25 bp, Mus musculus
tcagtatatccagcctaccatgcgg

SEQ ID NO: 135015 - DNA, 25 bp, Mus musculus
tcagtatatccgacagaagcacggg

SEQ ID NO: 135016 - DNA, 25 bp, Mus musculus
tcagtatccacacataaacggcagt

SEQ ID NO: 135017 - DNA, 25 bp, Mus musculus
tcagtatccggcagtgacctaggtt

SEQ ID NO: 135018 - DNA, 25 bp, Mus musculus
tcagtatgacagcactatccaggag

SEQ ID NO: 135019 - DNA, 25 bp, Mus musculus
tcagtatgagaaacggccacgcagt

SEQ ID NO: 135020 - DNA, 25 bp, Mus musculus
tcagtatgatgaagcagtagcacag

SEQ ID NO: 135021 - DNA, 25 bp, Mus musculus
tcagtatggagattcagcccggcag

SEQ ID NO: 135022 - DNA, 25 bp, Mus musculus
tcagtatgggacgatgtgggcaacc

SEQ ID NO: 135023 - DNA, 25 bp, Mus musculus
tcagtatttccggttctggtgccag

SEQ ID NO: 135024 - DNA, 25 bp, Mus musculus
tcagtcaactggaagaatggctacg

SEQ ID NO: 135025 - DNA, 25 bp, Mus musculus
tcagtcacagaagccacaaaaaagg

SEQ ID NO: 135026 - DNA, 25 bp, Mus musculus
tcagtcacaggaggaagagttcgcc

SEQ ID NO: 135027 - DNA, 25 bp, Mus musculus
tcagtcacatccatcaacgagtggc

SEQ ID NO: 135028 - DNA, 25 bp, Mus musculus
tcagtcagacggttccctacagagg

SEQ ID NO: 135029 - DNA, 25 bp, Mus musculus
tcagtcagaggaagcggagatgcca

SEQ ID NO: 135030 - DNA, 25 bp, Mus musculus
tcagtcagcgggtttcctaggaagc

SEQ ID NO: 135031 - DNA, 25 bp, Mus musculus
tcagtcaggctgaagggagccagct

SEQ ID NO: 135032 - DNA, 25 bp, Mus musculus
tcagtcagtgcgtggaataagccct

SEQ ID NO: 135033 - DNA, 25 bp, Mus musculus
tcagtcagtgttcacgagacccgca

SEQ ID NO: 135034 - DNA, 25 bp, Mus musculus
tcagtcatccaatgaaaggccgcca

SEQ ID NO: 135035 - DNA, 25 bp, Mus musculus
tcagtcatcgagcaggaaatcatct

SEQ ID NO: 135036 - DNA, 25 bp, Mus musculus
tcagtcatcgtgtgtcagccttcca

SEQ ID NO: 135037 - DNA, 25 bp, Mus musculus
tcagtcatgacacgagcaaggcttc

SEQ ID NO: 135038 - DNA, 25 bp, Mus musculus
tcagtcatgggctcacgtgtgggac

SEQ ID NO: 135039 - DNA, 25 bp, Mus musculus
tcagtcatgtcagccttgtcggtgg

SEQ ID NO: 135040 - DNA, 25 bp, Mus musculus
tcagtcatgtgttggtgcagctccc

SEQ ID NO: 135041 - DNA, 25 bp, Mus musculus
tcagtccagacacatagtgagttcc

SEQ ID NO: 135042 - DNA, 25 bp, Mus musculus
tcagtccatcattcacgccaaaagg

SEQ ID NO: 135043 - DNA, 25 bp, Mus musculus
tcagtcccacggcacggtgacggtc

SEQ ID NO: 135044 - DNA, 25 bp, Mus musculus
tcagtcccagagtcatccgagtgtg

SEQ ID NO: 135045 - DNA, 25 bp, Mus musculus
tcagtcccgagccatgattgctgca

SEQ ID NO: 135046 - DNA, 25 bp, Mus musculus
tcagtccggcaagagaagcgaagct

SEQ ID NO: 135047 - DNA, 25 bp, Mus musculus
tcagtccgtgtcactggcaagaagc

SEQ ID NO: 135048 - DNA, 25 bp, Mus musculus
tcagtcctctgaacagtcatcttgt

SEQ ID NO: 135049 - DNA, 25 bp, Mus musculus
tcagtcgaggatcgtctggctgtcc

SEQ ID NO: 135050 - DNA, 25 bp, Mus musculus
tcagtcgaggcctgtgttctacgtg

SEQ ID NO: 135051 - DNA, 25 bp, Mus musculus
tcagtcgcatctatttgtcccgtgg

SEQ ID NO: 135052 - DNA, 25 bp, Mus musculus
tcagtcggattcttgacaacttgct

SEQ ID NO: 135053 - DNA, 25 bp, Mus musculus
tcagtcggcttctagacaacatggc

SEQ ID NO: 135054 - DNA, 25 bp, Mus musculus
tcagtcgggaggaagcaatgcgctt

SEQ ID NO: 135055 - DNA, 25 bp, Mus musculus
tcagtcgtgtctccctagagcggga

SEQ ID NO: 135056 - DNA, 25 bp, Mus musculus
tcagtctcaagatgcctcaactcct

SEQ ID NO: 135057 - DNA, 25 bp, Mus musculus
tcagtctcatcgcccacaacttggt

SEQ ID NO: 135058 - DNA, 25 bp, Mus musculus
tcagtctcccgtgcatcctcaatgc

SEQ ID NO: 135059 - DNA, 25 bp, Mus musculus
tcagtctggacaactggagcgtctg

SEQ ID NO: 135060 - DNA, 25 bp, Mus musculus
tcagtctgggatacggcatagtcaa

SEQ ID NO: 135061 - DNA, 25 bp, Mus musculus
tcagtctgtctcagcattatcagca

SEQ ID NO: 135062 - DNA, 25 bp, Mus musculus
tcagtcttggactttgaagccagga

SEQ ID NO: 135063 - DNA, 25 bp, Mus musculus
tcagtctttgcccaggttccgcaag

SEQ ID NO: 135064 - DNA, 25 bp, Mus musculus
tcagtgaaagtaaaagccgagacac

SEQ ID NO: 135065 - DNA, 25 bp, Mus musculus
tcagtgaacacaccccgggaagtca

SEQ ID NO: 135066 - DNA, 25 bp, Mus musculus
tcagtgacaacgcagcgaagattct

SEQ ID NO: 135067 - DNA, 25 bp, Mus musculus
tcagtgacactgcagacttggccct

SEQ ID NO: 135068 - DNA, 25 bp, Mus musculus
tcagtgacatgaagcagagcgatgc

SEQ ID NO: 135069 - DNA, 25 bp, Mus musculus
tcagtgaccataaaccacagctggc

SEQ ID NO: 135070 - DNA, 25 bp, Mus musculus
tcagtgaccgacaacagtgctttct

SEQ ID NO: 135071 - DNA, 25 bp, Mus musculus
tcagtgactacctctggagcctggt

SEQ ID NO: 135072 - DNA, 25 bp, Mus musculus
tcagtgactggttcagtgacagtgc

SEQ ID NO: 135073 - DNA, 25 bp, Mus musculus
tcagtgagccaaacccagattatag

SEQ ID NO: 135074 - DNA, 25 bp, Mus musculus
tcagtgagccctgcttgaaagagac

SEQ ID NO: 135075 - DNA, 25 bp, Mus musculus
tcagtgaggaacaggtacgcagctt

SEQ ID NO: 135076 - DNA, 25 bp, Mus musculus
tcagtgaggcccttctggactatca

SEQ ID NO: 135077 - DNA, 25 bp, Mus musculus
tcagtgagtgtttgtccagttgcca

SEQ ID NO: 135078 - DNA, 25 bp, Mus musculus
tcagtgatgggcacggtacctacgc

SEQ ID NO: 135079 - DNA, 25 bp, Mus musculus
tcagtgatgttagcaaaaccgcgac

SEQ ID NO: 135080 - DNA, 25 bp, Mus musculus
tcagtgattgcttatagttaggcca

SEQ ID NO: 135081 - DNA, 25 bp, Mus musculus
tcagtgatttccttgatggattggg

SEQ ID NO: 135082 - DNA, 25 bp, Mus musculus
tcagtgcaactgagaaagcaaggcc

SEQ ID NO: 135083 - DNA, 25 bp, Mus musculus
tcagtgcaatggctgcagcaagtcc

SEQ ID NO: 135084 - DNA, 25 bp, Mus musculus
tcagtgcaatgtttgccaagccggc

SEQ ID NO: 135085 - DNA, 25 bp, Mus musculus
tcagtgcacgagaaacagagtatca

SEQ ID NO: 135086 - DNA, 25 bp, Mus musculus
tcagtgcagagcagagaaccctatg

SEQ ID NO: 135087 - DNA, 25 bp, Mus musculus
tcagtgcagcttacacaaaggacct

SEQ ID NO: 135088 - DNA, 25 bp, Mus musculus
tcagtgcatcgatgaagctgcgctg

SEQ ID NO: 135089 - DNA, 25 bp, Mus musculus
tcagtgccaacaattcaggaccagg

SEQ ID NO: 135090 - DNA, 25 bp, Mus musculus
tcagtgccgtccagaagatgactcg

SEQ ID NO: 135091 - DNA, 25 bp, Mus musculus
tcagtgccgtcgctatccgggtctt

SEQ ID NO: 135092 - DNA, 25 bp, Mus musculus
tcagtgccgtgatcctgaaagcagt

SEQ ID NO: 135093 - DNA, 25 bp, Mus musculus
tcagtgcctgtgtccgaggagagcc

SEQ ID NO: 135094 - DNA, 25 bp, Mus musculus
tcagtgccttggaacgcagggtgct

SEQ ID NO: 135095 - DNA, 25 bp, Mus musculus
tcagtgcgagaaccaggaactcgag

SEQ ID NO: 135096 - DNA, 25 bp, Mus musculus
tcagtgcgaggaaacttaaggacaa

SEQ ID NO: 135097 - DNA, 25 bp, Mus musculus
tcagtgcgcagacgccaatgtgtcc

SEQ ID NO: 135098 - DNA, 25 bp, Mus musculus
tcagtgctctcaagtctcggaagaa

SEQ ID NO: 135099 - DNA, 25 bp, Mus musculus
tcagtgctgatggttgcacgggatc

SEQ ID NO: 135100 - DNA, 25 bp, Mus musculus
tcagtgctgccaagaaaattgcgga

SEQ ID NO: 135101 - DNA, 25 bp, Mus musculus
tcagtgctggaaagcctagtgggca

SEQ ID NO: 135102 - DNA, 25 bp, Mus musculus
tcagtgctgtcacttctgagggcag

SEQ ID NO: 135103 - DNA, 25 bp, Mus musculus
tcagtggaaaccaaatccgggcctg

SEQ ID NO: 135104 - DNA, 25 bp, Mus musculus
tcagtggaataaactaccctgtggt

SEQ ID NO: 135105 - DNA, 25 bp, Mus musculus
tcagtggaatgaactgcagccgcca

SEQ ID NO: 135106 - DNA, 25 bp, Mus musculus
tcagtggacacccaaagcagagagc

SEQ ID NO: 135107 - DNA, 25 bp, Mus musculus
tcagtggaccaagcatgatgattcg

SEQ ID NO: 135108 - DNA, 25 bp, Mus musculus
tcagtggacccaggcaaaaaggcca

SEQ ID NO: 135109 - DNA, 25 bp, Mus musculus
tcagtggagaacagtggagtcagtc

SEQ ID NO: 135110 - DNA, 25 bp, Mus musculus
tcagtggagacaataatcagcggct

SEQ ID NO: 135111 - DNA, 25 bp, Mus musculus
tcagtggcactttgtttctttcgga

SEQ ID NO: 135112 - DNA, 25 bp, Mus musculus
tcagtggctgacagagaaggcctcc

SEQ ID NO: 135113 - DNA, 25 bp, Mus musculus
tcagtggctgtattctaccgagaca

SEQ ID NO: 135114 - DNA, 25 bp, Mus musculus
tcagtgggtatgtctgccagcgcca

SEQ ID NO: 135115 - DNA, 25 bp, Mus musculus
tcagtgggttggccggtccacgggt

SEQ ID NO: 135116 - DNA, 25 bp, Mus musculus
tcagtggtcactgcaagaacatccc

SEQ ID NO: 135117 - DNA, 25 bp, Mus musculus
tcagtggtcggatgtgctagcccct

SEQ ID NO: 135118 - DNA, 25 bp, Mus musculus
tcagtggtgacagccgatctgcacg

SEQ ID NO: 135119 - DNA, 25 bp, Mus musculus
tcagtggtgagctcctagaagccag

SEQ ID NO: 135120 - DNA, 25 bp, Mus musculus
tcagtggtggtacctcaaggagcct

SEQ ID NO: 135121 - DNA, 25 bp, Mus musculus
tcagtgtacaaaccatgtgccccat

SEQ ID NO: 135122 - DNA, 25 bp, Mus musculus
tcagtgtacagaaatggaaccaaac

SEQ ID NO: 135123 - DNA, 25 bp, Mus musculus
tcagtgtatgtgactctccagcagg

SEQ ID NO: 135124 - DNA, 25 bp, Mus musculus
tcagtgtcacgaatggagctcaagc

SEQ ID NO: 135125 - DNA, 25 bp, Mus musculus
tcagtgtcatgtccgaggtggctca

SEQ ID NO: 135126 - DNA, 25 bp, Mus musculus
tcagtgtcattccaggttacccggg

SEQ ID NO: 135127 - DNA, 25 bp, Mus musculus
tcagtgtccggaagctgctgcaagg

SEQ ID NO: 135128 - DNA, 25 bp, Mus musculus
tcagtgtctactgcaccaggaggaa

SEQ ID NO: 135129 - DNA, 25 bp, Mus musculus
tcagtgtctcactccaagaggaaac

SEQ ID NO: 135130 - DNA, 25 bp, Mus musculus
tcagtgtcttgaccctagaaagcag

SEQ ID NO: 135131 - DNA, 25 bp, Mus musculus
tcagtgtgaaacatcggaagcagcc

SEQ ID NO: 135132 - DNA, 25 bp, Mus musculus
tcagtgtgaagttagcccagagcca

SEQ ID NO: 135133 - DNA, 25 bp, Mus musculus
tcagtgtgagcatcgcagtagccag

SEQ ID NO: 135134 - DNA, 25 bp, Mus musculus
tcagtgtgataattgtggcattaca

SEQ ID NO: 135135 - DNA, 25 bp, Mus musculus
tcagtgtgcatcgaatcatcgggcg

SEQ ID NO: 135136 - DNA, 25 bp, Mus musculus
tcagtgtgctcatgggagaccctca

SEQ ID NO: 135137 - DNA, 25 bp, Mus musculus
tcagtgtggttctccagaggtcacg

SEQ ID NO: 135138 - DNA, 25 bp, Mus musculus
tcagtgtgtcatgtcaatacgagga

SEQ ID NO: 135139 - DNA, 25 bp, Mus musculus
tcagtgtgtccacccagtctgggag

SEQ ID NO: 135140 - DNA, 25 bp, Mus musculus
tcagtgtgtgagtcccagagggacc

SEQ ID NO: 135141 - DNA, 25 bp, Mus musculus
tcagtgtgtgggacaccgagtcccg

SEQ ID NO: 135142 - DNA, 25 bp, Mus musculus
tcagtgttcccgtgtggcctggccg

SEQ ID NO: 135143 - DNA, 25 bp, Mus musculus
tcagttaagggcatcagacggtcag

SEQ ID NO: 135144 - DNA, 25 bp, Mus musculus
tcagttaaggtgacacaccagggtg

SEQ ID NO: 135145 - DNA, 25 bp, Mus musculus
tcagttacaaatcagagggcaggct

SEQ ID NO: 135146 - DNA, 25 bp, Mus musculus
tcagttacaggttactccagacagt

SEQ ID NO: 135147 - DNA, 25 bp, Mus musculus
tcagttagcagagcaatcaagccct

SEQ ID NO: 135148 - DNA, 25 bp, Mus musculus
tcagttagctcaaacccagaaggtg

SEQ ID NO: 135149 - DNA, 25 bp, Mus musculus
tcagttaggcaacgtcagtctgcgg

SEQ ID NO: 135150 - DNA, 25 bp, Mus musculus
tcagttatcattggcctcggtggca

SEQ ID NO: 135151 - DNA, 25 bp, Mus musculus
tcagttatccagtctccacaagtcc

SEQ ID NO: 135152 - DNA, 25 bp, Mus musculus
tcagttatgaagaacaacccgttgt

SEQ ID NO: 135153 - DNA, 25 bp, Mus musculus
tcagttcaatggagagctggaagct

SEQ ID NO: 135154 - DNA, 25 bp, Mus musculus
tcagttcaccatctcccgtcgtggg

SEQ ID NO: 135155 - DNA, 25 bp, Mus musculus
tcagttcacccatctagaccagagt

SEQ ID NO: 135156 - DNA, 25 bp, Mus musculus
tcagttcagatccaaaacagcacgt

SEQ ID NO: 135157 - DNA, 25 bp, Mus musculus
tcagttccaggaggccgcatttgcc

SEQ ID NO: 135158 - DNA, 25 bp, Mus musculus
tcagttccaggagtgaagcgcggac

SEQ ID NO: 135159 - DNA, 25 bp, Mus musculus
tcagttcccatgaaagtgcagcaca

SEQ ID NO: 135160 - DNA, 25 bp, Mus musculus
tcagttccgaaaagccacagcgtct

SEQ ID NO: 135161 - DNA, 25 bp, Mus musculus
tcagttccgaagagcggctaattcg

SEQ ID NO: 135162 - DNA, 25 bp, Mus musculus
tcagttcctggcattcctgatactc

SEQ ID NO: 135163 - DNA, 25 bp, Mus musculus
tcagttctaagagctggcagccagc

SEQ ID NO: 135164 - DNA, 25 bp, Mus musculus
tcagttctacatatctcgacagtgg

SEQ ID NO: 135165 - DNA, 25 bp, Mus musculus
tcagttctcagatgcttggtggacg

SEQ ID NO: 135166 - DNA, 25 bp, Mus musculus
tcagttctgacaccagggatggacc

SEQ ID NO: 135167 - DNA, 25 bp, Mus musculus
tcagttctgagtggtctgtgggcca

SEQ ID NO: 135168 - DNA, 25 bp, Mus musculus
tcagttctgctgaggacaacggtca

SEQ ID NO: 135169 - DNA, 25 bp, Mus musculus
tcagttcttgagttgtcagagggcc

SEQ ID NO: 135170 - DNA, 25 bp, Mus musculus
tcagttgacaattgctggcccatgc

SEQ ID NO: 135171 - DNA, 25 bp, Mus musculus
tcagttgccggtgtgggtcttccaa

SEQ ID NO: 135172 - DNA, 25 bp, Mus musculus
tcagttgcctgaatgtacaccacca

SEQ ID NO: 135173 - DNA, 25 bp, Mus musculus
tcagttggaccagccgatgaaccag

SEQ ID NO: 135174 - DNA, 25 bp, Mus musculus
tcagttggcagatcgactcgtgttc

SEQ ID NO: 135175 - DNA, 25 bp, Mus musculus
tcagttggccgtttgcaggaagtcc

SEQ ID NO: 135176 - DNA, 25 bp, Mus musculus
tcagttgtttaggtgtgcagccagc

SEQ ID NO: 135177 - DNA, 25 bp, Mus musculus
tcagtttaagaagcagtcggtggcc

SEQ ID NO: 135178 - DNA, 25 bp, Mus musculus
tcagtttagaagagatcaagcatgc

SEQ ID NO: 135179 - DNA, 25 bp, Mus musculus
tcagtttagaatggcccttggaggc

SEQ ID NO: 135180 - DNA, 25 bp, Mus musculus
tcagtttatcgttggtggagccaca

SEQ ID NO: 135181 - DNA, 25 bp, Mus musculus
tcagtttccacgctttagcccagta

SEQ ID NO: 135182 - DNA, 25 bp, Mus musculus
tcagtttcggccgtgacgtcatcca

SEQ ID NO: 135183 - DNA, 25 bp, Mus musculus
tcagtttgcagctgctctagaaccc

SEQ ID NO: 135184 - DNA, 25 bp, Mus musculus
tcagtttggtgagacgaaccttctc

SEQ ID NO: 135185 - DNA, 25 bp, Mus musculus
tcagtttgtctgttcggaccgcggc

SEQ ID NO: 135186 - DNA, 25 bp, Mus musculus
tcagtttttgatggagctgaggcag

SEQ ID NO: 135187 - DNA, 25 bp, Mus musculus
tcataaaatgcacaaaccgcgtctg

SEQ ID NO: 135188 - DNA, 25 bp, Mus musculus
tcataaagcagtgtgacaccgccgg

SEQ ID NO: 135189 - DNA, 25 bp, Mus musculus
tcataaatcactgggaatccgtggg

SEQ ID NO: 135190 - DNA, 25 bp, Mus musculus
tcataaccaaggatgcacagtgccc

SEQ ID NO: 135191 - DNA, 25 bp, Mus musculus
tcataagaaacgagaggacggctgg

SEQ ID NO: 135192 - DNA, 25 bp, Mus musculus
tcataagaagaggaccgaggctgtg

SEQ ID NO: 135193 - DNA, 25 bp, Mus musculus
tcataagagaaacagcgtgtgtggt

SEQ ID NO: 135194 - DNA, 25 bp, Mus musculus
tcataagatgtggtctatgccataa

SEQ ID NO: 135195 - DNA, 25 bp, Mus musculus
tcataagcatcgcagcactgagccg

SEQ ID NO: 135196 - DNA, 25 bp, Mus musculus
tcataaggacaagaaactgggcact

SEQ ID NO: 135197 - DNA, 25 bp, Mus musculus
tcataaggagaaaacagcgtctggc

SEQ ID NO: 135198 - DNA, 25 bp, Mus musculus
tcataatctgagacgccgaatgggt

SEQ ID NO: 135199 - DNA, 25 bp, Mus musculus
tcataattccttaagacagtgatgg

SEQ ID NO: 135200 - DNA, 25 bp, Mus musculus
tcatacactgtccacggcatcaggg

SEQ ID NO: 135201 - DNA, 25 bp, Mus musculus
tcatacagtaagcaaggcctgtgcc

SEQ ID NO: 135202 - DNA, 25 bp, Mus musculus
tcatacatcgggacttaaagccgga

SEQ ID NO: 135203 - DNA, 25 bp, Mus musculus
tcataccaggccaaggttcgccaag

SEQ ID NO: 135204 - DNA, 25 bp, Mus musculus
tcataccggcaaacgtgtggatgct

SEQ ID NO: 135205 - DNA, 25 bp, Mus musculus
tcatactccaagaacgatctttcca

SEQ ID NO: 135206 - DNA, 25 bp, Mus musculus
tcatactgcatgatggtctccgccg

SEQ ID NO: 135207 - DNA, 25 bp, Mus musculus
tcatactggcaaatggttccccact

SEQ ID NO: 135208 - DNA, 25 bp, Mus musculus
tcatacttggaacaaacccctttgg

SEQ ID NO: 135209 - DNA, 25 bp, Mus musculus
tcatagaagccatcgcagagtgtgc

SEQ ID NO: 135210 - DNA, 25 bp, Mus musculus
tcatagacgtgctcaccaagaggag

SEQ ID NO: 135211 - DNA, 25 bp, Mus musculus
tcatagagaggagcggaagaagacc

SEQ ID NO: 135212 - DNA, 25 bp, Mus musculus
tcatagagccgagcgaaaaggccaa

SEQ ID NO: 135213 - DNA, 25 bp, Mus musculus
tcatagagtgggaggaatgcttaca

SEQ ID NO: 135214 - DNA, 25 bp, Mus musculus
tcatagatcggcagctgccggtggt

SEQ ID NO: 135215 - DNA, 25 bp, Mus musculus
tcatagatctagtgtaggtagctcc

SEQ ID NO: 135216 - DNA, 25 bp, Mus musculus
tcatagatgttggactgggcacgga

SEQ ID NO: 135217 - DNA, 25 bp, Mus musculus
tcatagcacaccagttatgcagagg

SEQ ID NO: 135218 - DNA, 25 bp, Mus musculus
tcatagcagaagaggagaaattccc

SEQ ID NO: 135219 - DNA, 25 bp, Mus musculus
tcatagctggagacaccaagttccc

SEQ ID NO: 135220 - DNA, 25 bp, Mus musculus
tcatagctggatcttccgtgaagtg

SEQ ID NO: 135221 - DNA, 25 bp, Mus musculus
tcataggaaagtaagacggtggtta

SEQ ID NO: 135222 - DNA, 25 bp, Mus musculus
tcataggaccgatgagtcgcgctcc

SEQ ID NO: 135223 - DNA, 25 bp, Mus musculus
tcataggagtccagttactcgagtc

SEQ ID NO: 135224 - DNA, 25 bp, Mus musculus
tcataggcgaacagaacgcacggct

SEQ ID NO: 135225 - DNA, 25 bp, Mus musculus
tcataggctgcagcggagaccgtta

SEQ ID NO: 135226 - DNA, 25 bp, Mus musculus
tcatagggaaggacaacctggaggc

SEQ ID NO: 135227 - DNA, 25 bp, Mus musculus
tcatagggacacgtgcagttgccag

SEQ ID NO: 135228 - DNA, 25 bp, Mus musculus
tcatagggatttggcagctcgaaac

SEQ ID NO: 135229 - DNA, 25 bp, Mus musculus
tcataggtctaatgtgcgctgttgc

SEQ ID NO: 135230 - DNA, 25 bp, Mus musculus
tcataggtgttgttcgtgtgcccca

SEQ ID NO: 135231 - DNA, 25 bp, Mus musculus
tcatagtcacctgcgggaagtcaca

SEQ ID NO: 135232 - DNA, 25 bp, Mus musculus
tcatagtctaggagtgaagcaagca

SEQ ID NO: 135233 - DNA, 25 bp, Mus musculus
tcatagtctccaagatcggcctcgg

SEQ ID NO: 135234 - DNA, 25 bp, Mus musculus
tcatataaaggcaaagaggtcccag

SEQ ID NO: 135235 - DNA, 25 bp, Mus musculus
tcatataagatcaacactgtggtgt

SEQ ID NO: 135236 - DNA, 25 bp, Mus musculus
tcatatcactggaggcgggttgctg

SEQ ID NO: 135237 - DNA, 25 bp, Mus musculus
tcatatcactgggagttgtcaaacc

SEQ ID NO: 135238 - DNA, 25 bp, Mus musculus
tcatatgactcaaggattctgggca

SEQ ID NO: 135239 - DNA, 25 bp, Mus musculus
tcatatgcccacagggatgctggct

SEQ ID NO: 135240 - DNA, 25 bp, Mus musculus
tcatatgctggagccaaaccgatgg

SEQ ID NO: 135241 - DNA, 25 bp, Mus musculus
tcatatggagtttcatcgggcctgt

SEQ ID NO: 135242 - DNA, 25 bp, Mus musculus
tcatatggtcgaacagtctcctggt

SEQ ID NO: 135243 - DNA, 25 bp, Mus musculus
tcatatgtacaagatcaagacagac

SEQ ID NO: 135244 - DNA, 25 bp, Mus musculus
tcatattgccgagaagctgagcagg

SEQ ID NO: 135245 - DNA, 25 bp, Mus musculus
tcatcaaaaagggagagtcaaaact

SEQ ID NO: 135246 - DNA, 25 bp, Mus musculus
tcatcaaagatgtccagcaagacgg

SEQ ID NO: 135247 - DNA, 25 bp, Mus musculus
tcatcaaaggcatggccatggcggc

SEQ ID NO: 135248 - DNA, 25 bp, Mus musculus
tcatcaacaagagcagaaggacggg

SEQ ID NO: 135249 - DNA, 25 bp, Mus musculus
tcatcaacagagaagcataccctgc

SEQ ID NO: 135250 - DNA, 25 bp, Mus musculus
tcatcaacagtattcgccaagcagc

SEQ ID NO: 135251 - DNA, 25 bp, Mus musculus
tcatcaacgcagaaggcgggcagtc

SEQ ID NO: 135252 - DNA, 25 bp, Mus musculus
tcatcaagaagaccgagtccgacgc

SEQ ID NO: 135253 - DNA, 25 bp, Mus musculus
tcatcaagacggtcatcaagctggc

SEQ ID NO: 135254 - DNA, 25 bp, Mus musculus
tcatcaagcagagtggttccgacca

SEQ ID NO: 135255 - DNA, 25 bp, Mus musculus
tcatcaaggcctggactaaggactc

SEQ ID NO: 135256 - DNA, 25 bp, Mus musculus
tcatcaaggctgaaatacaggcagt

SEQ ID NO: 135257 - DNA, 25 bp, Mus musculus
tcatcaagggctgcaccgaggttga

SEQ ID NO: 135258 - DNA, 25 bp, Mus musculus
tcatcaaggtccaaaggagccctgg

SEQ ID NO: 135259 - DNA, 25 bp, Mus musculus
tcatcaagtagtgcaaacaatggct

SEQ ID NO: 135260 - DNA, 25 bp, Mus musculus
tcatcaagtatgtggctgcagagct

SEQ ID NO: 135261 - DNA, 25 bp, Mus musculus
tcatcaagtcgcctcccgagaggaa

SEQ ID NO: 135262 - DNA, 25 bp, Mus musculus
tcatcaagtggctgcgcaggtgtcg

SEQ ID NO: 135263 - DNA, 25 bp, Mus musculus
tcatcaagtggtatgaaggccctac

SEQ ID NO: 135264 - DNA, 25 bp, Mus musculus
tcatcaagtttttcagttcaccccg

SEQ ID NO: 135265 - DNA, 25 bp, Mus musculus
tcatcaatatgcactgaggcgacgt

SEQ ID NO: 135266 - DNA, 25 bp, Mus musculus
tcatcaatatgtggctgttcaacag

SEQ ID NO: 135267 - DNA, 25 bp, Mus musculus
tcatcaatgaggagaacgcggagtc

SEQ ID NO: 135268 - DNA, 25 bp, Mus musculus
tcatcaatggcagcaagccacggct

SEQ ID NO: 135269 - DNA, 25 bp, Mus musculus
tcatcacaaatacgccaatgcaggg

SEQ ID NO: 135270 - DNA, 25 bp, Mus musculus
tcatcacacccttggagaagtttcg

SEQ ID NO: 135271 - DNA, 25 bp, Mus musculus
tcatcacaggagtagcgctgcagga

SEQ ID NO: 135272 - DNA, 25 bp, Mus musculus
tcatcacagttgcaggaagcagatt

SEQ ID NO: 135273 - DNA, 25 bp, Mus musculus
tcatcaccccatctcctgaggtggt

SEQ ID NO: 135274 - DNA, 25 bp, Mus musculus
tcatcacccggctgtttgaaggaca

SEQ ID NO: 135275 - DNA, 25 bp, Mus musculus
tcatcaccgggctcaaacaaaggat

SEQ ID NO: 135276 - DNA, 25 bp, Mus musculus
tcatcacctcattcatgatttccag

SEQ ID NO: 135277 - DNA, 25 bp, Mus musculus
tcatcacgcccttggaggttaatca

SEQ ID NO: 135278 - DNA, 25 bp, Mus musculus
tcatcacgctgctagtgcctgaggc

SEQ ID NO: 135279 - DNA, 25 bp, Mus musculus
tcatcacgggagaaaatggaacggc

SEQ ID NO: 135280 - DNA, 25 bp, Mus musculus
tcatcacggttggtcgctgggcaaa

SEQ ID NO: 135281 - DNA, 25 bp, Mus musculus
tcatcacgtcggaagcaagcgaaag

SEQ ID NO: 135282 - DNA, 25 bp, Mus musculus
tcatcagacgaagcttgccattgct

SEQ ID NO: 135283 - DNA, 25 bp, Mus musculus
tcatcagagtaagggcctcgaggcc

SEQ ID NO: 135284 - DNA, 25 bp, Mus musculus
tcatcagccaaggtggatctcaaga

SEQ ID NO: 135285 - DNA, 25 bp, Mus musculus
tcatcagccagtggtgcggtggtct

SEQ ID NO: 135286 - DNA, 25 bp, Mus musculus
tcatcagccgatcgcagagtgtgag

SEQ ID NO: 135287 - DNA, 25 bp, Mus musculus
tcatcagccggcttcagtgggacgg

SEQ ID NO: 135288 - DNA, 25 bp, Mus musculus
tcatcagcctgagtacatgggtcat

SEQ ID NO: 135289 - DNA, 25 bp, Mus musculus
tcatcaggatgaaccaggactgctt

SEQ ID NO: 135290 - DNA, 25 bp, Mus musculus
tcatcaggattgtagagcaaggcca

SEQ ID NO: 135291 - DNA, 25 bp, Mus musculus
tcatcagggatagctgtcagccagg

SEQ ID NO: 135292 - DNA, 25 bp, Mus musculus
tcatcagggattacgggagaggctt

SEQ ID NO: 135293 - DNA, 25 bp, Mus musculus
tcatcagggcagtacacaggcttca

SEQ ID NO: 135294 - DNA, 25 bp, Mus musculus
tcatcagggcgtgcacaggtcgttt

SEQ ID NO: 135295 - DNA, 25 bp, Mus musculus
tcatcagggctgtgtcccaaaagtg

SEQ ID NO: 135296 - DNA, 25 bp, Mus musculus
tcatcaggtagcctttggacagcgt

SEQ ID NO: 135297 - DNA, 25 bp, Mus musculus
tcatcagtgacgagctcttccggca

SEQ ID NO: 135298 - DNA, 25 bp, Mus musculus
tcatcagtgcatgtcccagtcagac

SEQ ID NO: 135299 - DNA, 25 bp, Mus musculus
tcatcatagtgtccgaactcggcga

SEQ ID NO: 135300 - DNA, 25 bp, Mus musculus
tcatcatcatctgcctggtggtcct

SEQ ID NO: 135301 - DNA, 25 bp, Mus musculus
tcatcatccgatcccagatggaggg

SEQ ID NO: 135302 - DNA, 25 bp, Mus musculus
tcatcatcctgacgataacgcggtg

SEQ ID NO: 135303 - DNA, 25 bp, Mus musculus
tcatcatcctggtcgcaagctacgt

SEQ ID NO: 135304 - DNA, 25 bp, Mus musculus
tcatcatcggtgtgtactgcggcct

SEQ ID NO: 135305 - DNA, 25 bp, Mus musculus
tcatcatctacgtgtctgtgtggag

SEQ ID NO: 135306 - DNA, 25 bp, Mus musculus
tcatcatgagaataagagagccacg

SEQ ID NO: 135307 - DNA, 25 bp, Mus musculus
tcatcatggcaaaaccagctggtgg

SEQ ID NO: 135308 - DNA, 25 bp, Mus musculus
tcatcatgtcgtgcgtgggcttcgc

SEQ ID NO: 135309 - DNA, 25 bp, Mus musculus
tcatcattcaagacctgtcagaagc

SEQ ID NO: 135310 - DNA, 25 bp, Mus musculus
tcatcattcggacaccaaccgtggg

SEQ ID NO: 135311 - DNA, 25 bp, Mus musculus
tcatcattggcagggttatcaaagc

SEQ ID NO: 135312 - DNA, 25 bp, Mus musculus
tcatcattggcctcttgaccggctg

SEQ ID NO: 135313 - DNA, 25 bp, Mus musculus
tcatcattgggcaaccggtggctgt

SEQ ID NO: 135314 - DNA, 25 bp, Mus musculus
tcatccaaactatgaaggactgcct

SEQ ID NO: 135315 - DNA, 25 bp, Mus musculus
tcatccaaatactcagctggccggg

SEQ ID NO: 135316 - DNA, 25 bp, Mus musculus
tcatccaagagaatatttcatgtgc

SEQ ID NO: 135317 - DNA, 25 bp, Mus musculus
tcatccacgtgcaaagggctggctt

SEQ ID NO: 135318 - DNA, 25 bp, Mus musculus
tcatccactctctagcggaaggcgc

SEQ ID NO: 135319 - DNA, 25 bp, Mus musculus
tcatccactgtaagagcctgccagg

SEQ ID NO: 135320 - DNA, 25 bp, Mus musculus
tcatccagaggagtgtatgtgggcc

SEQ ID NO: 135321 - DNA, 25 bp, Mus musculus
tcatccagcagtcgagcccgtattt

SEQ ID NO: 135322 - DNA, 25 bp, Mus musculus
tcatccagctgaagcagcggaggcg

SEQ ID NO: 135323 - DNA, 25 bp, Mus musculus
tcatccaggagagactgaaggcttg

SEQ ID NO: 135324 - DNA, 25 bp, Mus musculus
tcatccaggcagtcaacgcagtagc

SEQ ID NO: 135325 - DNA, 25 bp, Mus musculus
tcatccagggttagaagctgccact

SEQ ID NO: 135326 - DNA, 25 bp, Mus musculus
tcatccatgatgtgcagcccagtga

SEQ ID NO: 135327 - DNA, 25 bp, Mus musculus
tcatcccagtctcagggtggaggca

SEQ ID NO: 135328 - DNA, 25 bp, Mus musculus
tcatccccagtatggctgtcggagc

SEQ ID NO: 135329 - DNA, 25 bp, Mus musculus
tcatccccatagtggtggagcagac

SEQ ID NO: 135330 - DNA, 25 bp, Mus musculus
tcatcccgaacagagtgtgtgcacg

SEQ ID NO: 135331 - DNA, 25 bp, Mus musculus
tcatcccgaagaggagggcgactta

SEQ ID NO: 135332 - DNA, 25 bp, Mus musculus
tcatcccggtttgagcatgcaggag

SEQ ID NO: 135333 - DNA, 25 bp, Mus musculus
tcatccgaaaaatcaaagctattgg

SEQ ID NO: 135334 - DNA, 25 bp, Mus musculus
tcatccgaaccaaaagacagagctc

SEQ ID NO: 135335 - DNA, 25 bp, Mus musculus
tcatccgatcctgccctgagagagg

SEQ ID NO: 135336 - DNA, 25 bp, Mus musculus
tcatccggaagacagaatacggctc

SEQ ID NO: 135337 - DNA, 25 bp, Mus musculus
tcatccgtcatcaatgggcaacaag

SEQ ID NO: 135338 - DNA, 25 bp, Mus musculus
tcatccgttcatttgagcatcggaa

SEQ ID NO: 135339 - DNA, 25 bp, Mus musculus
tcatcctccttgtcgtgaccctgat

SEQ ID NO: 135340 - DNA, 25 bp, Mus musculus
tcatcctcgtggaagactgggctgg

SEQ ID NO: 135341 - DNA, 25 bp, Mus musculus
tcatcctctggacgaacgtgagctc

SEQ ID NO: 135342 - DNA, 25 bp, Mus musculus
tcatcctgaacgtcactcggctgtg

SEQ ID NO: 135343 - DNA, 25 bp, Mus musculus
tcatcctgaaggtgaaggactgtcc

SEQ ID NO: 135344 - DNA, 25 bp, Mus musculus
tcatcctgcagtctggctctttctc

SEQ ID NO: 135345 - DNA, 25 bp, Mus musculus
tcatcctgcggtagtgacgggcagt

SEQ ID NO: 135346 - DNA, 25 bp, Mus musculus
tcatcctggccagatacggactgga

SEQ ID NO: 135347 - DNA, 25 bp, Mus musculus
tcatcctgggaatggagatctcggc

SEQ ID NO: 135348 - DNA, 25 bp, Mus musculus
tcatccttaccagtagagggcgctc

SEQ ID NO: 135349 - DNA, 25 bp, Mus musculus
tcatccttatccagaaccgggcagg

SEQ ID NO: 135350 - DNA, 25 bp, Mus musculus
tcatccttggtggttagtgctgcag

SEQ ID NO: 135351 - DNA, 25 bp, Mus musculus
tcatccttgtctagaattcctgcag

SEQ ID NO: 135352 - DNA, 25 bp, Mus musculus
tcatcctttcgattgctgactggtc

SEQ ID NO: 135353 - DNA, 25 bp, Mus musculus
tcatcgaaacgttgactggaacatg

SEQ ID NO: 135354 - DNA, 25 bp, Mus musculus
tcatcgaagggagacatatacacat

SEQ ID NO: 135355 - DNA, 25 bp, Mus musculus
tcatcgaatttaccccagcggctga

SEQ ID NO: 135356 - DNA, 25 bp, Mus musculus
tcatcgacggcgtggaatgcagcga

SEQ ID NO: 135357 - DNA, 25 bp, Mus musculus
tcatcgagagcaagacagagtcatc

SEQ ID NO: 135358 - DNA, 25 bp, Mus musculus
tcatcgaggagacgctcgcgctcaa

SEQ ID NO: 135359 - DNA, 25 bp, Mus musculus
tcatcgaggattcatctggagcttc

SEQ ID NO: 135360 - DNA, 25 bp, Mus musculus
tcatcgagtcccctacgctgagtgt

SEQ ID NO: 135361 - DNA, 25 bp, Mus musculus
tcatcgagtgcacacactgtggctg

SEQ ID NO: 135362 - DNA, 25 bp, Mus musculus
tcatcgatcctcgaacactctttgt

SEQ ID NO: 135363 - DNA, 25 bp, Mus musculus
tcatcgatgtggacctcgtttcggg

SEQ ID NO: 135364 - DNA, 25 bp, Mus musculus
tcatcgcactcaacaacatcctggt

SEQ ID NO: 135365 - DNA, 25 bp, Mus musculus
tcatcgcagagggtgccattgaccg

SEQ ID NO: 135366 - DNA, 25 bp, Mus musculus
tcatcgcaggccacgagagcggaga

SEQ ID NO: 135367 - DNA, 25 bp, Mus musculus
tcatcgccaaagctgactgcctggt

SEQ ID NO: 135368 - DNA, 25 bp, Mus musculus
tcatcgcccacaacttggtccacct

SEQ ID NO: 135369 - DNA, 25 bp, Mus musculus
tcatcgcccagggagtccggtgttc

SEQ ID NO: 135370 - DNA, 25 bp, Mus musculus
tcatcgccgctggtgctgtgctctt

SEQ ID NO: 135371 - DNA, 25 bp, Mus musculus
tcatcgccggcgtcatacgagtggt

SEQ ID NO: 135372 - DNA, 25 bp, Mus musculus
tcatcgcctggcattgactcatagc

SEQ ID NO: 135373 - DNA, 25 bp, Mus musculus
tcatcgctgcagtcagtgtacaggc

SEQ ID NO: 135374 - DNA, 25 bp, Mus musculus
tcatcgctgtctgctctaaagggag

SEQ ID NO: 135375 - DNA, 25 bp, Mus musculus
tcatcggagctttggtcggtgccct

SEQ ID NO: 135376 - DNA, 25 bp, Mus musculus
tcatcgggccagatacacaaattgg

SEQ ID NO: 135377 - DNA, 25 bp, Mus musculus
tcatcggtgagcaccgactccgcgg

SEQ ID NO: 135378 - DNA, 25 bp, Mus musculus
tcatcggtgggctcttaagggaaaa

SEQ ID NO: 135379 - DNA, 25 bp, Mus musculus
tcatcgtcaaagtcaatggccgccc

SEQ ID NO: 135380 - DNA, 25 bp, Mus musculus
tcatcgtcaggagaggagaacaccg

SEQ ID NO: 135381 - DNA, 25 bp, Mus musculus
tcatcgtcatcaccataaagttgag

SEQ ID NO: 135382 - DNA, 25 bp, Mus musculus
tcatcgtctgaaagagcagaaccag

SEQ ID NO: 135383 - DNA, 25 bp, Mus musculus
tcatcgtgcaagaagcccatgggtt

SEQ ID NO: 135384 - DNA, 25 bp, Mus musculus
tcatcgtgcacaagctgaaggagcc

SEQ ID NO: 135385 - DNA, 25 bp, Mus musculus
tcatcgtgcagtctctcaaggccgt

SEQ ID NO: 135386 - DNA, 25 bp, Mus musculus
tcatcgtgggctgtggcgtgtcttc

SEQ ID NO: 135387 - DNA, 25 bp, Mus musculus
tcatcgttcgtcagcgacaactgga

SEQ ID NO: 135388 - DNA, 25 bp, Mus musculus
tcatcgttctaggagcggttccaag

SEQ ID NO: 135389 - DNA, 25 bp, Mus musculus
tcatcgttggatgctgggcctgaca

SEQ ID NO: 135390 - DNA, 25 bp, Mus musculus
tcatcgttgtgggagacctatctgt

SEQ ID NO: 135391 - DNA, 25 bp, Mus musculus
tcatcgtttacatcggacagcggga

SEQ ID NO: 135392 - DNA, 25 bp, Mus musculus
tcatctacaaacacaccaggctggt

SEQ ID NO: 135393 - DNA, 25 bp, Mus musculus
tcatctacaatgagtgcttcagccg

SEQ ID NO: 135394 - DNA, 25 bp, Mus musculus
tcatctacagcagtggaggtcaagt

SEQ ID NO: 135395 - DNA, 25 bp, Mus musculus
tcatctacatcttgggaaaccgcag

SEQ ID NO: 135396 - DNA, 25 bp, Mus musculus
tcatctacggagtcatcatcacagc

SEQ ID NO: 135397 - DNA, 25 bp, Mus musculus
tcatctactggatacaggacaccca

SEQ ID NO: 135398 - DNA, 25 bp, Mus musculus
tcatctagagggtgtcaagccttac

SEQ ID NO: 135399 - DNA, 25 bp, Mus musculus
tcatctatctacacagagtctctcc

SEQ ID NO: 135400 - DNA, 25 bp, Mus musculus
tcatctatggcacgaggctggtagt

SEQ ID NO: 135401 - DNA, 25 bp, Mus musculus
tcatctcacccctcgtggtagcagg

SEQ ID NO: 135402 - DNA, 25 bp, Mus musculus
tcatctcagaaaacccgcagaaggg

SEQ ID NO: 135403 - DNA, 25 bp, Mus musculus
tcatctccgaagtccaagggtcctc

SEQ ID NO: 135404 - DNA, 25 bp, Mus musculus
tcatctccgagaactacagcgaggg

SEQ ID NO: 135405 - DNA, 25 bp, Mus musculus
tcatctcctgccctgtcattaaagg

SEQ ID NO: 135406 - DNA, 25 bp, Mus musculus
tcatctcggagaaccaaaggcggac

SEQ ID NO: 135407 - DNA, 25 bp, Mus musculus
tcatctctacctacggcgagggcga

SEQ ID NO: 135408 - DNA, 25 bp, Mus musculus
tcatctctcagaaggcacgtgggct

SEQ ID NO: 135409 - DNA, 25 bp, Mus musculus
tcatctctggagctgggatcctgcg

SEQ ID NO: 135410 - DNA, 25 bp, Mus musculus
tcatctctggtggacaaggctaccg

SEQ ID NO: 135411 - DNA, 25 bp, Mus musculus
tcatctgactccagagcgcagggca

SEQ ID NO: 135412 - DNA, 25 bp, Mus musculus
tcatctgagggctcaagggtcttcc

SEQ ID NO: 135413 - DNA, 25 bp, Mus musculus
tcatctgcccacattacgaggacga

SEQ ID NO: 135414 - DNA, 25 bp, Mus musculus
tcatctgcctcgcaagaagtctcag

SEQ ID NO: 135415 - DNA, 25 bp, Mus musculus
tcatctgctcccactgtaaccttag

SEQ ID NO: 135416 - DNA, 25 bp, Mus musculus
tcatctgctcggttgatagagtcac

SEQ ID NO: 135417 - DNA, 25 bp, Mus musculus
tcatctgctcgtgtggataagcccc

SEQ ID NO: 135418 - DNA, 25 bp, Mus musculus
tcatctgctctctgattgtcacctc

SEQ ID NO: 135419 - DNA, 25 bp, Mus musculus
tcatctgctgtactcggaggcgagc

SEQ ID NO: 135420 - DNA, 25 bp, Mus musculus
tcatctgcttggaaatactggtgtg

SEQ ID NO: 135421 - DNA, 25 bp, Mus musculus
tcatctggaacaaaggatatggctg

SEQ ID NO: 135422 - DNA, 25 bp, Mus musculus
tcatctggacaggaagcgataccca

SEQ ID NO: 135423 - DNA, 25 bp, Mus musculus
tcatctggactgactatggacaacg

SEQ ID NO: 135424 - DNA, 25 bp, Mus musculus
tcatctggcccaaaaggtggtaccc

SEQ ID NO: 135425 - DNA, 25 bp, Mus musculus
tcatctggcggagcaggaagtacag

SEQ ID NO: 135426 - DNA, 25 bp, Mus musculus
tcatctgggaatgtacctccctggg

SEQ ID NO: 135427 - DNA, 25 bp, Mus musculus
tcatctgggagatcgaggtgccaaa

SEQ ID NO: 135428 - DNA, 25 bp, Mus musculus
tcatctgggtagtaggcatcctgac

SEQ ID NO: 135429 - DNA, 25 bp, Mus musculus
tcatctggtgagcaatgaggacccc

SEQ ID NO: 135430 - DNA, 25 bp, Mus musculus
tcatctggtgtcctcagtggcctcg

SEQ ID NO: 135431 - DNA, 25 bp, Mus musculus
tcatctggttgtcagttcgcgtccg

SEQ ID NO: 135432 - DNA, 25 bp, Mus musculus
tcatctgtgatcttctgggctggcc

SEQ ID NO: 135433 - DNA, 25 bp, Mus musculus
tcatctgtggatactgccgtaccag

SEQ ID NO: 135434 - DNA, 25 bp, Mus musculus
tcatctgtggattccctgtcagaca

SEQ ID NO: 135435 - DNA, 25 bp, Mus musculus
tcatctgtttctatggatcaagagg

SEQ ID NO: 135436 - DNA, 25 bp, Mus musculus
tcatcttaaccatcgcaaatttcag

SEQ ID NO: 135437 - DNA, 25 bp, Mus musculus
tcatcttagaaggtccccacttaga

SEQ ID NO: 135438 - DNA, 25 bp, Mus musculus
tcatcttagaggatagcaggcatct

SEQ ID NO: 135439 - DNA, 25 bp, Mus musculus
tcatcttagcaacgagagggctgcg

SEQ ID NO: 135440 - DNA, 25 bp, Mus musculus
tcatcttatgagatgcgagtggtgg

SEQ ID NO: 135441 - DNA, 25 bp, Mus musculus
tcatcttcacaaggtcacgaggaac

SEQ ID NO: 135442 - DNA, 25 bp, Mus musculus
tcatcttcagcacggagaaagccca

SEQ ID NO: 135443 - DNA, 25 bp, Mus musculus
tcatcttcatgtgggtcaggcctcc

SEQ ID NO: 135444 - DNA, 25 bp, Mus musculus
tcatcttcggaaggctggcactcag

SEQ ID NO: 135445 - DNA, 25 bp, Mus musculus
tcatcttctccagggacgacgaggc

SEQ ID NO: 135446 - DNA, 25 bp, Mus musculus
tcatcttctgtactgagctgcgaca

SEQ ID NO: 135447 - DNA, 25 bp, Mus musculus
tcatcttcttcggtgcccaggatca

SEQ ID NO: 135448 - DNA, 25 bp, Mus musculus
tcatcttgaaaaagccgcggagcga

SEQ ID NO: 135449 - DNA, 25 bp, Mus musculus
tcatcttgaacaagccaggactcaa

SEQ ID NO: 135450 - DNA, 25 bp, Mus musculus
tcatcttgaagacttatgtaaggcg

SEQ ID NO: 135451 - DNA, 25 bp, Mus musculus
tcatcttgctggagaaactcgccgc

SEQ ID NO: 135452 - DNA, 25 bp, Mus musculus
tcatcttggatctgagccggtcgag

SEQ ID NO: 135453 - DNA, 25 bp, Mus musculus
tcatcttgtgaaccctgcaacgcag

SEQ ID NO: 135454 - DNA, 25 bp, Mus musculus
tcatcttgtggctggactgtcatca

SEQ ID NO: 135455 - DNA, 25 bp, Mus musculus
tcatctttcagaagcgtccgcggta

SEQ ID NO: 135456 - DNA, 25 bp, Mus musculus
tcatctttcttactgggctccctgc

SEQ ID NO: 135457 - DNA, 25 bp, Mus musculus
tcatctttgcggagagggcttattc

SEQ ID NO: 135458 - DNA, 25 bp, Mus musculus
tcatctttgggctccgagacagcgg

SEQ ID NO: 135459 - DNA, 25 bp, Mus musculus
tcatgaaacatggagacttgcacgc

SEQ ID NO: 135460 - DNA, 25 bp, Mus musculus
tcatgaaacgcagcaagctaggccc

SEQ ID NO: 135461 - DNA, 25 bp, Mus musculus
tcatgaaagacgagccagaagcggc

SEQ ID NO: 135462 - DNA, 25 bp, Mus musculus
tcatgaaagcaggacgaactcggat

SEQ ID NO: 135463 - DNA, 25 bp, Mus musculus
tcatgaaccacattgcagtagcggt

SEQ ID NO: 135464 - DNA, 25 bp, Mus musculus
tcatgaaccctcacatccgtgtagg

SEQ ID NO: 135465 - DNA, 25 bp, Mus musculus
tcatgaaccggacaacctgcaatct

SEQ ID NO: 135466 - DNA, 25 bp, Mus musculus
tcatgaacgagcttcgcctgagcca

SEQ ID NO: 135467 - DNA, 25 bp, Mus musculus
tcatgaactcttgggacatgtgccc

SEQ ID NO: 135468 - DNA, 25 bp, Mus musculus
tcatgaacttaactgacttgttaaa

SEQ ID NO: 135469 - DNA, 25 bp, Mus musculus
tcatgaagagctctcccgaggtgtc

SEQ ID NO: 135470 - DNA, 25 bp, Mus musculus
tcatgaagatcgaaactcctgcgcc

SEQ ID NO: 135471 - DNA, 25 bp, Mus musculus
tcatgaagcgttaccccaagggaca

SEQ ID NO: 135472 - DNA, 25 bp, Mus musculus
tcatgaagctgctcgcaatggtcgc

SEQ ID NO: 135473 - DNA, 25 bp, Mus musculus
tcatgaaggacgaatgagcatagcc

SEQ ID NO: 135474 - DNA, 25 bp, Mus musculus
tcatgaaggagctttgcgcaaacgt

SEQ ID NO: 135475 - DNA, 25 bp, Mus musculus
tcatgaaggccacctggatcaggct

SEQ ID NO: 135476 - DNA, 25 bp, Mus musculus
tcatgaaggttatcccatctgctgc

SEQ ID NO: 135477 - DNA, 25 bp, Mus musculus
tcatgaagtaagatgcagtatagca

SEQ ID NO: 135478 - DNA, 25 bp, Mus musculus
tcatgacaattcgaggatccaggga

SEQ ID NO: 135479 - DNA, 25 bp, Mus musculus
tcatgacaccggtgaagacccagtg

SEQ ID NO: 135480 - DNA, 25 bp, Mus musculus
tcatgacacctggtttctgatggca

SEQ ID NO: 135481 - DNA, 25 bp, Mus musculus
tcatgacatttgctgacgacggaag

SEQ ID NO: 135482 - DNA, 25 bp, Mus musculus
tcatgaccaacactgggaaggcacg

SEQ ID NO: 135483 - DNA, 25 bp, Mus musculus
tcatgaccaaggtgcacgggaagcg

SEQ ID NO: 135484 - DNA, 25 bp, Mus musculus
tcatgaccatgacccacgggaagct

SEQ ID NO: 135485 - DNA, 25 bp, Mus musculus
tcatgacccttggacagcaggacgt

SEQ ID NO: 135486 - DNA, 25 bp, Mus musculus
tcatgacctggagctactgagaaag

SEQ ID NO: 135487 - DNA, 25 bp, Mus musculus
tcatgacgaagatggacctgctgag

SEQ ID NO: 135488 - DNA, 25 bp, Mus musculus
tcatgacgggcaaggagatggcttc

SEQ ID NO: 135489 - DNA, 25 bp, Mus musculus
tcatgactataaataccgggtggtg

SEQ ID NO: 135490 - DNA, 25 bp, Mus musculus
tcatgactctgagacggcaggagcc

SEQ ID NO: 135491 - DNA, 25 bp, Mus musculus
tcatgactgagatcggaaaccgcct

SEQ ID NO: 135492 - DNA, 25 bp, Mus musculus
tcatgacttctggtgcaacttggga

SEQ ID NO: 135493 - DNA, 25 bp, Mus musculus
tcatgactttgctgaccggaaggac

SEQ ID NO: 135494 - DNA, 25 bp, Mus musculus
tcatgagacctgttgggccaagtcc

SEQ ID NO: 135495 - DNA, 25 bp, Mus musculus
tcatgagagagtctgtatccgcccc

SEQ ID NO: 135496 - DNA, 25 bp, Mus musculus
tcatgagcaacatatcagctgagtg

SEQ ID NO: 135497 - DNA, 25 bp, Mus musculus
tcatgagcaagagcgcggctgatct

SEQ ID NO: 135498 - DNA, 25 bp, Mus musculus
tcatgagcatgatctggaagcggct

SEQ ID NO: 135499 - DNA, 25 bp, Mus musculus
tcatgagccgtctgaaggtgcagct

SEQ ID NO: 135500 - DNA, 25 bp, Mus musculus
tcatgagccgttacctgaggagccc

SEQ ID NO: 135501 - DNA, 25 bp, Mus musculus
tcatgagcggaacaaggacggctcc

SEQ ID NO: 135502 - DNA, 25 bp, Mus musculus
tcatgagctgaagggccataatggc

SEQ ID NO: 135503 - DNA, 25 bp, Mus musculus
tcatgaggaagactgcaggcgcctt

SEQ ID NO: 135504 - DNA, 25 bp, Mus musculus
tcatgagggctatgctggacgcaca

SEQ ID NO: 135505 - DNA, 25 bp, Mus musculus
tcatgagggtacctggagtcaacct

SEQ ID NO: 135506 - DNA, 25 bp, Mus musculus
tcatgagtccgaaggcaatgtacca

SEQ ID NO: 135507 - DNA, 25 bp, Mus musculus
tcatgagtgccgactccagggtgag

SEQ ID NO: 135508 - DNA, 25 bp, Mus musculus
tcatgataaaactggtggaaggcct

SEQ ID NO: 135509 - DNA, 25 bp, Mus musculus
tcatgatattcaacacgcgcctaag

SEQ ID NO: 135510 - DNA, 25 bp, Mus musculus
tcatgatcactcacctgcgcaggaa

SEQ ID NO: 135511 - DNA, 25 bp, Mus musculus
tcatgatcagtgcagacatggccca

SEQ ID NO: 135512 - DNA, 25 bp, Mus musculus
tcatgatccagtacccgagcagtca

SEQ ID NO: 135513 - DNA, 25 bp, Mus musculus
tcatgatcgctgagtcagaaggcac

SEQ ID NO: 135514 - DNA, 25 bp, Mus musculus
tcatgatctaagagaggcgcacagc

SEQ ID NO: 135515 - DNA, 25 bp, Mus musculus
tcatgatctcaaggacaggaggtcc

SEQ ID NO: 135516 - DNA, 25 bp, Mus musculus
tcatgatgaactctagcgcgggtcc

SEQ ID NO: 135517 - DNA, 25 bp, Mus musculus
tcatgatgaatgatgaggaggcttc

SEQ ID NO: 135518 - DNA, 25 bp, Mus musculus
tcatgatgagtactggcacgcacac

SEQ ID NO: 135519 - DNA, 25 bp, Mus musculus
tcatgatgatgtttacagcttccaa

SEQ ID NO: 135520 - DNA, 25 bp, Mus musculus
tcatgatggaacctggaagtcggca

SEQ ID NO: 135521 - DNA, 25 bp, Mus musculus
tcatgatggaggtccagaaacgcca

SEQ ID NO: 135522 - DNA, 25 bp, Mus musculus
tcatgatggatagtgaaactggccg

SEQ ID NO: 135523 - DNA, 25 bp, Mus musculus
tcatgatggtagaaagcaaggcaca

SEQ ID NO: 135524 - DNA, 25 bp, Mus musculus
tcatgatggtcaacaaaagcggttt

SEQ ID NO: 135525 - DNA, 25 bp, Mus musculus
tcatgatgtcaccaaccgtggccag

SEQ ID NO: 135526 - DNA, 25 bp, Mus musculus
tcatgatgtggaggatgccgagacc

SEQ ID NO: 135527 - DNA, 25 bp, Mus musculus
tcatgattgagctggacgggaccga

SEQ ID NO: 135528 - DNA, 25 bp, Mus musculus
tcatgattgatagctcccgcagcgt

SEQ ID NO: 135529 - DNA, 25 bp, Mus musculus
tcatgattggcacaggcacagtcgc

SEQ ID NO: 135530 - DNA, 25 bp, Mus musculus
tcatgcaaagttaagaggcgagtcc

SEQ ID NO: 135531 - DNA, 25 bp, Mus musculus
tcatgcaagattgaggcccttaggg

SEQ ID NO: 135532 - DNA, 25 bp, Mus musculus
tcatgcaaggtgttcctaggaggcg

SEQ ID NO: 135533 - DNA, 25 bp, Mus musculus
tcatgcacaattggttcgagaggtt

SEQ ID NO: 135534 - DNA, 25 bp, Mus musculus
tcatgcacatgaagctgtcccggac

SEQ ID NO: 135535 - DNA, 25 bp, Mus musculus
tcatgcaccagggtgcactggcgca

SEQ ID NO: 135536 - DNA, 25 bp, Mus musculus
tcatgcactgaaccctgaagagaac

SEQ ID NO: 135537 - DNA, 25 bp, Mus musculus
tcatgcagaagagacggagtgtgcc

SEQ ID NO: 135538 - DNA, 25 bp, Mus musculus
tcatgcagaagatatccccaacacg

SEQ ID NO: 135539 - DNA, 25 bp, Mus musculus
tcatgcagattgacgagcggaagcg

SEQ ID NO: 135540 - DNA, 25 bp, Mus musculus
tcatgcatccacgagaggcttggct

SEQ ID NO: 135541 - DNA, 25 bp, Mus musculus
tcatgccaatggaggcctctgccgt

SEQ ID NO: 135542 - DNA, 25 bp, Mus musculus
tcatgccacccatctgggacaagac

SEQ ID NO: 135543 - DNA, 25 bp, Mus musculus
tcatgccacctaataagccatatgc

SEQ ID NO: 135544 - DNA, 25 bp, Mus musculus
tcatgccatgaataacctcgggaaa

SEQ ID NO: 135545 - DNA, 25 bp, Mus musculus
tcatgccattggatacaaactggcc

SEQ ID NO: 135546 - DNA, 25 bp, Mus musculus
tcatgcccacgtggcagacatggag

SEQ ID NO: 135547 - DNA, 25 bp, Mus musculus
tcatgccgcgcttcactgagcaggt

SEQ ID NO: 135548 - DNA, 25 bp, Mus musculus
tcatgccggctgtatccaaaggcga

SEQ ID NO: 135549 - DNA, 25 bp, Mus musculus
tcatgcctaagctgcagatccgggc

SEQ ID NO: 135550 - DNA, 25 bp, Mus musculus
tcatgccttgactcagaaagcctcc

SEQ ID NO: 135551 - DNA, 25 bp, Mus musculus
tcatgcgaaagcaccaaggccttgg

SEQ ID NO: 135552 - DNA, 25 bp, Mus musculus
tcatgcgcacaaggtggtcttggca

SEQ ID NO: 135553 - DNA, 25 bp, Mus musculus
tcatgcgcacagacatcagcaaggg

SEQ ID NO: 135554 - DNA, 25 bp, Mus musculus
tcatgcggcagtagcagccatgctg

SEQ ID NO: 135555 - DNA, 25 bp, Mus musculus
tcatgcgtgtcatccaaggaaggct

SEQ ID NO: 135556 - DNA, 25 bp, Mus musculus
tcatgcgtgtgatcggaactcaggt

SEQ ID NO: 135557 - DNA, 25 bp, Mus musculus
tcatgctactagtgctctgggccca

SEQ ID NO: 135558 - DNA, 25 bp, Mus musculus
tcatgctcagccgtcaggataaccg

SEQ ID NO: 135559 - DNA, 25 bp, Mus musculus
tcatgctgaagctctgcaccgaggt

SEQ ID NO: 135560 - DNA, 25 bp, Mus musculus
tcatgctggctaccctgcacttggg

SEQ ID NO: 135561 - DNA, 25 bp, Mus musculus
tcatgctggtccttgagcggcctat

SEQ ID NO: 135562 - DNA, 25 bp, Mus musculus
tcatgctggtcttcacactggtggc

SEQ ID NO: 135563 - DNA, 25 bp, Mus musculus
tcatgcttccactcggaggatgagg

SEQ ID NO: 135564 - DNA, 25 bp, Mus musculus
tcatgcttgtagtccttgccagggt

SEQ ID NO: 135565 - DNA, 25 bp, Mus musculus
tcatggaaagtgcagtagggacctc

SEQ ID NO: 135566 - DNA, 25 bp, Mus musculus
tcatggaagctgcagatgaagcctt

SEQ ID NO: 135567 - DNA, 25 bp, Mus musculus
tcatggaagtgaaaaggccttgacc

SEQ ID NO: 135568 - DNA, 25 bp, Mus musculus
tcatggaagtgcctacacgcctgga

SEQ ID NO: 135569 - DNA, 25 bp, Mus musculus
tcatggacaactccgggaagcaggc

SEQ ID NO: 135570 - DNA, 25 bp, Mus musculus
tcatggacaagtactaccaggaatt

SEQ ID NO: 135571 - DNA, 25 bp, Mus musculus
tcatggacacgaaatgggtgacgtc

SEQ ID NO: 135572 - DNA, 25 bp, Mus musculus
tcatggaccaacaagcactagtgcc

SEQ ID NO: 135573 - DNA, 25 bp, Mus musculus
tcatggaccagaacagagacggctt

SEQ ID NO: 135574 - DNA, 25 bp, Mus musculus
tcatggacctgggaccaatgcgcaa

SEQ ID NO: 135575 - DNA, 25 bp, Mus musculus
tcatggactacacagacttacagct

SEQ ID NO: 135576 - DNA, 25 bp, Mus musculus
tcatggactcagttcagctggacag

SEQ ID NO: 135577 - DNA, 25 bp, Mus musculus
tcatggactcctacggcagtgatct

SEQ ID NO: 135578 - DNA, 25 bp, Mus musculus
tcatggagaccaccgactacttcga

SEQ ID NO: 135579 - DNA, 25 bp, Mus musculus
tcatggagacctcgtcggtgctgac

SEQ ID NO: 135580 - DNA, 25 bp, Mus musculus
tcatggagacgattggtcggaaact

SEQ ID NO: 135581 - DNA, 25 bp, Mus musculus
tcatggagaggatccagtccatcaa

SEQ ID NO: 135582 - DNA, 25 bp, Mus musculus
tcatggagagtctgctgcaaaacca

SEQ ID NO: 135583 - DNA, 25 bp, Mus musculus
tcatggagcactggaaacggaagca

SEQ ID NO: 135584 - DNA, 25 bp, Mus musculus
tcatggaggcctgcagaaagtgagc

SEQ ID NO: 135585 - DNA, 25 bp, Mus musculus
tcatggatgaaaccctaggcacagc

SEQ ID NO: 135586 - DNA, 25 bp, Mus musculus
tcatggatgaacttcaggatgttca

SEQ ID NO: 135587 - DNA, 25 bp, Mus musculus
tcatggatgctcacagaccaaggtt

SEQ ID NO: 135588 - DNA, 25 bp, Mus musculus
tcatggattgtagaagcctcacacc

SEQ ID NO: 135589 - DNA, 25 bp, Mus musculus
tcatggcaaggcgtctttggttgtg

SEQ ID NO: 135590 - DNA, 25 bp, Mus musculus
tcatggcagccgagtttctgagaat

SEQ ID NO: 135591 - DNA, 25 bp, Mus musculus
tcatggcatctcatgggaacgaggc

SEQ ID NO: 135592 - DNA, 25 bp, Mus musculus
tcatggccagggatgggttacctcc

SEQ ID NO: 135593 - DNA, 25 bp, Mus musculus
tcatggccatgtggaacctggttcc

SEQ ID NO: 135594 - DNA, 25 bp, Mus musculus
tcatggcccaagtagtgatgtctgc

SEQ ID NO: 135595 - DNA, 25 bp, Mus musculus
tcatggcccttcatcttgtcctaca

SEQ ID NO: 135596 - DNA, 25 bp, Mus musculus
tcatggccgctagtagatccctggt

SEQ ID NO: 135597 - DNA, 25 bp, Mus musculus
tcatggcgcaactaccacaggagga

SEQ ID NO: 135598 - DNA, 25 bp, Mus musculus
tcatggcggccactctggccaatgg

SEQ ID NO: 135599 - DNA, 25 bp, Mus musculus
tcatggcggccctcagcaagtccat

SEQ ID NO: 135600 - DNA, 25 bp, Mus musculus
tcatggcggctgagtcagagttaca

SEQ ID NO: 135601 - DNA, 25 bp, Mus musculus
tcatggcgggcttggttgacttcca

SEQ ID NO: 135602 - DNA, 25 bp, Mus musculus
tcatggctagctaccttggactggc

SEQ ID NO: 135603 - DNA, 25 bp, Mus musculus
tcatggctagtgaagacaatcgtgc

SEQ ID NO: 135604 - DNA, 25 bp, Mus musculus
tcatggctcacagcttggaggacct

SEQ ID NO: 135605 - DNA, 25 bp, Mus musculus
tcatggctcataggcgctggatcca

SEQ ID NO: 135606 - DNA, 25 bp, Mus musculus
tcatggctgaatccttgtgaattgg

SEQ ID NO: 135607 - DNA, 25 bp, Mus musculus
tcatggctggcttcaacatgggagg

SEQ ID NO: 135608 - DNA, 25 bp, Mus musculus
tcatggctttctcctgtcctacagg

SEQ ID NO: 135609 - DNA, 25 bp, Mus musculus
tcatggcttttcctcacggctgggc

SEQ ID NO: 135610 - DNA, 25 bp, Mus musculus
tcatgggacaagacagaaagggcac

SEQ ID NO: 135611 - DNA, 25 bp, Mus musculus
tcatgggactacttaccaggctgtg

SEQ ID NO: 135612 - DNA, 25 bp, Mus musculus
tcatgggaggactagcgttgtgcac

SEQ ID NO: 135613 - DNA, 25 bp, Mus musculus
tcatgggcaactggaacttctgggt

SEQ ID NO: 135614 - DNA, 25 bp, Mus musculus
tcatgggcaatgcagacttgtggcc

SEQ ID NO: 135615 - DNA, 25 bp, Mus musculus
tcatgggccttgaccatatcataaa

SEQ ID NO: 135616 - DNA, 25 bp, Mus musculus
tcatgggcgagcacatacactacgg

SEQ ID NO: 135617 - DNA, 25 bp, Mus musculus
tcatgggcttcctgaagttctcccc

SEQ ID NO: 135618 - DNA, 25 bp, Mus musculus
tcatggtagcgcctatgaagggcca

SEQ ID NO: 135619 - DNA, 25 bp, Mus musculus
tcatggtagtggatggcaatcgcca

SEQ ID NO: 135620 - DNA, 25 bp, Mus musculus
tcatggtcacaatgtctacagtggg

SEQ ID NO: 135621 - DNA, 25 bp, Mus musculus
tcatggtctgcactggttttctaac

SEQ ID NO: 135622 - DNA, 25 bp, Mus musculus
tcatggtctgcagaaggacttccgg

SEQ ID NO: 135623 - DNA, 25 bp, Mus musculus
tcatggtgacagattcagggaagcc

SEQ ID NO: 135624 - DNA, 25 bp, Mus musculus
tcatggtgcatccagagtaccggcc

SEQ ID NO: 135625 - DNA, 25 bp, Mus musculus
tcatggtgccaggaagccaaagctt

SEQ ID NO: 135626 - DNA, 25 bp, Mus musculus
tcatggtgctggctcgagctaagcc

SEQ ID NO: 135627 - DNA, 25 bp, Mus musculus
tcatggtggaacttgctgctgggcc

SEQ ID NO: 135628 - DNA, 25 bp, Mus musculus
tcatggtggcaatctacgtcaaccg

SEQ ID NO: 135629 - DNA, 25 bp, Mus musculus
tcatggtgggcctgtactacaacac

SEQ ID NO: 135630 - DNA, 25 bp, Mus musculus
tcatggttacagagagcttgcagct

SEQ ID NO: 135631 - DNA, 25 bp, Mus musculus
tcatggttacgtgggacaggctgcc

SEQ ID NO: 135632 - DNA, 25 bp, Mus musculus
tcatggttggcagctatgggccccg

SEQ ID NO: 135633 - DNA, 25 bp, Mus musculus
tcatgtacaccatcgaagctgtggc

SEQ ID NO: 135634 - DNA, 25 bp, Mus musculus
tcatgtacacctacggcaacgagca

SEQ ID NO: 135635 - DNA, 25 bp, Mus musculus
tcatgtacttcacagaggagcctcc

SEQ ID NO: 135636 - DNA, 25 bp, Mus musculus
tcatgtatgaccctcagacggacca

SEQ ID NO: 135637 - DNA, 25 bp, Mus musculus
tcatgtcaagggaacaactgaacac

SEQ ID NO: 135638 - DNA, 25 bp, Mus musculus
tcatgtcaggagatcaggagcagct

SEQ ID NO: 135639 - DNA, 25 bp, Mus musculus
tcatgtcatggtaagggagaacccg

SEQ ID NO: 135640 - DNA, 25 bp, Mus musculus
tcatgtccaggagtttaaaaccagg

SEQ ID NO: 135641 - DNA, 25 bp, Mus musculus
tcatgtccgaagtgaccaaagagct

SEQ ID NO: 135642 - DNA, 25 bp, Mus musculus
tcatgtcctccaccgtgaacaacgg

SEQ ID NO: 135643 - DNA, 25 bp, Mus musculus
tcatgtcggacagcgatctaggcga

SEQ ID NO: 135644 - DNA, 25 bp, Mus musculus
tcatgtcggccactttcaatgagga

SEQ ID NO: 135645 - DNA, 25 bp, Mus musculus
tcatgtctaggctgagagttccaaa

SEQ ID NO: 135646 - DNA, 25 bp, Mus musculus
tcatgtgccgttaaaaacaacaagg

SEQ ID NO: 135647 - DNA, 25 bp, Mus musculus
tcatgtgcgacaagatgacctcacg

SEQ ID NO: 135648 - DNA, 25 bp, Mus musculus
tcatgtgcggaaccatctgcgtaca

SEQ ID NO: 135649 - DNA, 25 bp, Mus musculus
tcatgtggcagtggaaaatgcgctc

SEQ ID NO: 135650 - DNA, 25 bp, Mus musculus
tcatgtgggagagtccttgtatgcc

SEQ ID NO: 135651 - DNA, 25 bp, Mus musculus
tcatgtgggttttgatgcagtcacc

SEQ ID NO: 135652 - DNA, 25 bp, Mus musculus
tcatgtgttcacttccgggtccggt

SEQ ID NO: 135653 - DNA, 25 bp, Mus musculus
tcatgtgtttgcataccgtgtaaag

SEQ ID NO: 135654 - DNA, 25 bp, Mus musculus
tcatgttaagtccatcacccagtgg

SEQ ID NO: 135655 - DNA, 25 bp, Mus musculus
tcatgttatcaatcagacgggaggc

SEQ ID NO: 135656 - DNA, 25 bp, Mus musculus
tcatgttcaacagtcacggcagcgt

SEQ ID NO: 135657 - DNA, 25 bp, Mus musculus
tcatgttcacagcacctggtatggc

SEQ ID NO: 135658 - DNA, 25 bp, Mus musculus
tcatgttcgagaggacaggatcccc

SEQ ID NO: 135659 - DNA, 25 bp, Mus musculus
tcatgttggccaaggagctgtaccc

SEQ ID NO: 135660 - DNA, 25 bp, Mus musculus
tcatgtttatcttcagccgcaggaa

SEQ ID NO: 135661 - DNA, 25 bp, Mus musculus
tcatgtttcaggtccccgggttgag

SEQ ID NO: 135662 - DNA, 25 bp, Mus musculus
tcatgtttgtcgctgtcttcctctg

SEQ ID NO: 135663 - DNA, 25 bp, Mus musculus
tcattaaaaggtgtcgctgtcccca

SEQ ID NO: 135664 - DNA, 25 bp, Mus musculus
tcattaaaggcttcacctccgctgc

SEQ ID NO: 135665 - DNA, 25 bp, Mus musculus
tcattaacaatgagtggcacgacgc

SEQ ID NO: 135666 - DNA, 25 bp, Mus musculus
tcattaacggagtgtgggaggcctc

SEQ ID NO: 135667 - DNA, 25 bp, Mus musculus
tcattaagaacccagcagagcgagc

SEQ ID NO: 135668 - DNA, 25 bp, Mus musculus
tcattaagtgtatggtagagggaag

SEQ ID NO: 135669 - DNA, 25 bp, Mus musculus
tcattaatccgtgctaagaagagaa

SEQ ID NO: 135670 - DNA, 25 bp, Mus musculus
tcattaatggactggtgcagaccac

SEQ ID NO: 135671 - DNA, 25 bp, Mus musculus
tcattacagagatttggcacccaaa

SEQ ID NO: 135672 - DNA, 25 bp, Mus musculus
tcattaccgcctggcttctgagcag

SEQ ID NO: 135673 - DNA, 25 bp, Mus musculus
tcattaccggtctggagactcagct

SEQ ID NO: 135674 - DNA, 25 bp, Mus musculus
tcattaccgtgcttactgcataggg

SEQ ID NO: 135675 - DNA, 25 bp, Mus musculus
tcattacctggagaagacctgtgag

SEQ ID NO: 135676 - DNA, 25 bp, Mus musculus
tcattactgttgatgggaagcctcc

SEQ ID NO: 135677 - DNA, 25 bp, Mus musculus
tcattagaaacttcagtgggtctgg

SEQ ID NO: 135678 - DNA, 25 bp, Mus musculus
tcattagaaagcaaccccaggacct

SEQ ID NO: 135679 - DNA, 25 bp, Mus musculus
tcattagatattaaagaaccggaag

SEQ ID NO: 135680 - DNA, 25 bp, Mus musculus
tcattagcaccagaaacagggacgg

SEQ ID NO: 135681 - DNA, 25 bp, Mus musculus
tcattagccctaaatcactggagag

SEQ ID NO: 135682 - DNA, 25 bp, Mus musculus
tcattaggaagtttgcagttcacca

SEQ ID NO: 135683 - DNA, 25 bp, Mus musculus
tcattaggctcataggacagcacct

SEQ ID NO: 135684 - DNA, 25 bp, Mus musculus
tcattaggtctaccatttggcaaag

SEQ ID NO: 135685 - DNA, 25 bp, Mus musculus
tcattatcaagtgtagtcagccgtc

SEQ ID NO: 135686 - DNA, 25 bp, Mus musculus
tcattatcagccacaggacagccaa

SEQ ID NO: 135687 - DNA, 25 bp, Mus musculus
tcattatcctcatgcctctggtggg

SEQ ID NO: 135688 - DNA, 25 bp, Mus musculus
tcattcaaacctttctgaacacaag

SEQ ID NO: 135689 - DNA, 25 bp, Mus musculus
tcattcaagaaggtgctcacggaga

SEQ ID NO: 135690 - DNA, 25 bp, Mus musculus
tcattcacaaggagagagggtagct

SEQ ID NO: 135691 - DNA, 25 bp, Mus musculus
tcattcacacgggagatctggacct

SEQ ID NO: 135692 - DNA, 25 bp, Mus musculus
tcattcaccatgttaagaccaatgg

SEQ ID NO: 135693 - DNA, 25 bp, Mus musculus
tcattcacgcaaaatgaagcatttc

SEQ ID NO: 135694 - DNA, 25 bp, Mus musculus
tcattcagtacattgccagcgcagg

SEQ ID NO: 135695 - DNA, 25 bp, Mus musculus
tcattccacggctggtctggcacag

SEQ ID NO: 135696 - DNA, 25 bp, Mus musculus
tcattcgaaacctgcaggaacgccg

SEQ ID NO: 135697 - DNA, 25 bp, Mus musculus
tcattcgcaggtgcaggttgcctac

SEQ ID NO: 135698 - DNA, 25 bp, Mus musculus
tcattcgccctttagaaagtcaggg

SEQ ID NO: 135699 - DNA, 25 bp, Mus musculus
tcattcggacaaaagtacagcagcc

SEQ ID NO: 135700 - DNA, 25 bp, Mus musculus
tcattctaacgattgcaggcatcaa

SEQ ID NO: 135701 - DNA, 25 bp, Mus musculus
tcattctcctaaggtgggccagcct

SEQ ID NO: 135702 - DNA, 25 bp, Mus musculus
tcattctggagaggtgatccccacc

SEQ ID NO: 135703 - DNA, 25 bp, Mus musculus
tcattctggttcgtgctggccttgg

SEQ ID NO: 135704 - DNA, 25 bp, Mus musculus
tcattctgtacgaagggctcctggg

SEQ ID NO: 135705 - DNA, 25 bp, Mus musculus
tcattcttcatcaggccgtggcagt

SEQ ID NO: 135706 - DNA, 25 bp, Mus musculus
tcattgaaagtaagcccctgtatcc

SEQ ID NO: 135707 - DNA, 25 bp, Mus musculus
tcattgaacacgagatggagctagg

SEQ ID NO: 135708 - DNA, 25 bp, Mus musculus
tcattgacacgatcgcctcggagat

SEQ ID NO: 135709 - DNA, 25 bp, Mus musculus
tcattgacaggcagctgatggacac

SEQ ID NO: 135710 - DNA, 25 bp, Mus musculus
tcattgacatgacagccggaggtca

SEQ ID NO: 135711 - DNA, 25 bp, Mus musculus
tcattgacatgagcaaggagtctac

SEQ ID NO: 135712 - DNA, 25 bp, Mus musculus
tcattgaccgcacagcagaggaaat

SEQ ID NO: 135713 - DNA, 25 bp, Mus musculus
tcattgacctggacatcggtgggaa

SEQ ID NO: 135714 - DNA, 25 bp, Mus musculus
tcattgacggaggatgaggccacgc

SEQ ID NO: 135715 - DNA, 25 bp, Mus musculus
tcattgactgggtctctgggaccag

SEQ ID NO: 135716 - DNA, 25 bp, Mus musculus
tcattgagaacacggatgcagcctg

SEQ ID NO: 135717 - DNA, 25 bp, Mus musculus
tcattgagaacctccggcggcggtt

SEQ ID NO: 135718 - DNA, 25 bp, Mus musculus
tcattgagcgcttaggaaggagacc

SEQ ID NO: 135719 - DNA, 25 bp, Mus musculus
tcattgaggaccaccgcgtcgtgtt

SEQ ID NO: 135720 - DNA, 25 bp, Mus musculus
tcattgaggactggtgccgatgcga

SEQ ID NO: 135721 - DNA, 25 bp, Mus musculus
tcattgatctatggcctggcaacgg

SEQ ID NO: 135722 - DNA, 25 bp, Mus musculus
tcattgatgaagactgtgggcccac

SEQ ID NO: 135723 - DNA, 25 bp, Mus musculus
tcattgatgaagaggtccggtgcct

SEQ ID NO: 135724 - DNA, 25 bp, Mus musculus
tcattgattttggttccggcgccct

SEQ ID NO: 135725 - DNA, 25 bp, Mus musculus
tcattgcactggcttttgaggtgaa

SEQ ID NO: 135726 - DNA, 25 bp, Mus musculus
tcattgcagctttctagaggtcccc

SEQ ID NO: 135727 - DNA, 25 bp, Mus musculus
tcattgcatacgatcactcccgggt

SEQ ID NO: 135728 - DNA, 25 bp, Mus musculus
tcattgccaatgtgcgtgcggtctt

SEQ ID NO: 135729 - DNA, 25 bp, Mus musculus
tcattgccacggatgtagcctcccg

SEQ ID NO: 135730 - DNA, 25 bp, Mus musculus
tcattgcggctgttggtacgagaca

SEQ ID NO: 135731 - DNA, 25 bp, Mus musculus
tcattgctgtcttgggctctggcgg

SEQ ID NO: 135732 - DNA, 25 bp, Mus musculus
tcattgcttcagctgggtaccagtc

SEQ ID NO: 135733 - DNA, 25 bp, Mus musculus
tcattggaaagatgtcacacagcct

SEQ ID NO: 135734 - DNA, 25 bp, Mus musculus
tcattggaaccatggtcgaccgggc

SEQ ID NO: 135735 - DNA, 25 bp, Mus musculus
tcattggagcagatctccgagacct

SEQ ID NO: 135736 - DNA, 25 bp, Mus musculus
tcattggaggaaaccatgaagcctc

SEQ ID NO: 135737 - DNA, 25 bp, Mus musculus
tcattggatagtatatcaagtatct

SEQ ID NO: 135738 - DNA, 25 bp, Mus musculus
tcattggcaggaagaggagtcacgc

SEQ ID NO: 135739 - DNA, 25 bp, Mus musculus
tcattggcatgaaaaacgtccggca

SEQ ID NO: 135740 - DNA, 25 bp, Mus musculus
tcattggctctatgacgtcatcagc

SEQ ID NO: 135741 - DNA, 25 bp, Mus musculus
tcattgggaagaagcacgtgggtcc

SEQ ID NO: 135742 - DNA, 25 bp, Mus musculus
tcattgggcgtcctcggtggaaact

SEQ ID NO: 135743 - DNA, 25 bp, Mus musculus
tcattgggtataaggagaggcccga

SEQ ID NO: 135744 - DNA, 25 bp, Mus musculus
tcattggtacagcagtcatgtggca

SEQ ID NO: 135745 - DNA, 25 bp, Mus musculus
tcattggtcggagctgggctatgct

SEQ ID NO: 135746 - DNA, 25 bp, Mus musculus
tcattggtgaaaggaacactgcccc

SEQ ID NO: 135747 - DNA, 25 bp, Mus musculus
tcattggtggtagcagcaggttccc

SEQ ID NO: 135748 - DNA, 25 bp, Mus musculus
tcattgtatactctgacaaagcctg

SEQ ID NO: 135749 - DNA, 25 bp, Mus musculus
tcattgtcattccaagggcagtagg

SEQ ID NO: 135750 - DNA, 25 bp, Mus musculus
tcattgtgcagcaccctgagacggt

SEQ ID NO: 135751 - DNA, 25 bp, Mus musculus
tcattgtggacgcttgcatcagttt

SEQ ID NO: 135752 - DNA, 25 bp, Mus musculus
tcattgtggccgttctctctgctgt

SEQ ID NO: 135753 - DNA, 25 bp, Mus musculus
tcattgtgtgaattcctgcccagcc

SEQ ID NO: 135754 - DNA, 25 bp, Mus musculus
tcattgttctccaagtcagaagccc

SEQ ID NO: 135755 - DNA, 25 bp, Mus musculus
tcattgttgagcacgctcgaggccc

SEQ ID NO: 135756 - DNA, 25 bp, Mus musculus
tcatttacaagacacccaaggtggg

SEQ ID NO: 135757 - DNA, 25 bp, Mus musculus
tcatttatcatggactagcccgtgc

SEQ ID NO: 135758 - DNA, 25 bp, Mus musculus
tcatttcagcagagtagcaactgcc

SEQ ID NO: 135759 - DNA, 25 bp, Mus musculus
tcatttcccaagtgcaggtctccag

SEQ ID NO: 135760 - DNA, 25 bp, Mus musculus
tcatttcctcttggcttctattctg

SEQ ID NO: 135761 - DNA, 25 bp, Mus musculus
tcatttcgctgaaggaaggctacgt

SEQ ID NO: 135762 - DNA, 25 bp, Mus musculus
tcatttctacctccaaagtcatcag

SEQ ID NO: 135763 - DNA, 25 bp, Mus musculus
tcatttctgagaagtatgtgccaag

SEQ ID NO: 135764 - DNA, 25 bp, Mus musculus
tcatttctggttcccgctggtccca

SEQ ID NO: 135765 - DNA, 25 bp, Mus musculus
tcatttctgtgggacggtgccttca

SEQ ID NO: 135766 - DNA, 25 bp, Mus musculus
tcatttgctgcaggaggaaggactt

SEQ ID NO: 135767 - DNA, 25 bp, Mus musculus
tcatttgggcaagggtgagtcctac

SEQ ID NO: 135768 - DNA, 25 bp, Mus musculus
tcattttcaggagccaagatccgcc

SEQ ID NO: 135769 - DNA, 25 bp, Mus musculus
tcattttccagagtgtggccggctc

SEQ ID NO: 135770 - DNA, 25 bp, Mus musculus
tcattttggaagaagtacgggaaag

SEQ ID NO: 135771 - DNA, 25 bp, Mus musculus
tcattttgtgattggccacctgaag

SEQ ID NO: 135772 - DNA, 25 bp, Mus musculus
tcatttttcctggacagagcggccc

SEQ ID NO: 135773 - DNA, 25 bp, Mus musculus
tcatttttcggtagataaaccaagt

SEQ ID NO: 135774 - DNA, 25 bp, Mus musculus
tcatttttctagagcaagcaggcca

SEQ ID NO: 135775 - DNA, 25 bp, Mus musculus
tccaaaaagaggttcttacgagccg

SEQ ID NO: 135776 - DNA, 25 bp, Mus musculus
tccaaaaatgcagacccattttaat

SEQ ID NO: 135777 - DNA, 25 bp, Mus musculus
tccaaaaatggaactgcaggtctca

SEQ ID NO: 135778 - DNA, 25 bp, Mus musculus
tccaaaactcgtgggaaggccaaag

SEQ ID NO: 135779 - DNA, 25 bp, Mus musculus
tccaaaagagttcccatcgatcagg

SEQ ID NO: 135780 - DNA, 25 bp, Mus musculus
tccaaaagctttgaccggtgctgtc

SEQ ID NO: 135781 - DNA, 25 bp, Mus musculus
tccaaaaggagcagaactaccagcg

SEQ ID NO: 135782 - DNA, 25 bp, Mus musculus
tccaaaaggcggcaagatgcccggt

SEQ ID NO: 135783 - DNA, 25 bp, Mus musculus
tccaaaaggctctctgcgcagaatt

SEQ ID NO: 135784 - DNA, 25 bp, Mus musculus
tccaaaataacgagattaaacaact

SEQ ID NO: 135785 - DNA, 25 bp, Mus musculus
tccaaaccactgctagctgcttaag

SEQ ID NO: 135786 - DNA, 25 bp, Mus musculus
tccaaaccatgtgtcagctccaagg

SEQ ID NO: 135787 - DNA, 25 bp, Mus musculus
tccaaaccgaaaagagcgagaagca

SEQ ID NO: 135788 - DNA, 25 bp, Mus musculus
tccaaaccgcatgagagagagtaat

SEQ ID NO: 135789 - DNA, 25 bp, Mus musculus
tccaaacggtactgggagcttttca

SEQ ID NO: 135790 - DNA, 25 bp, Mus musculus
tccaaacgtggcaagacaggtggct

SEQ ID NO: 135791 - DNA, 25 bp, Mus musculus
tccaaactccgtgaagaagagcagg

SEQ ID NO: 135792 - DNA, 25 bp, Mus musculus
tccaaactggactgggagagcttca

SEQ ID NO: 135793 - DNA, 25 bp, Mus musculus
tccaaactggttctgctgacagcct

SEQ ID NO: 135794 - DNA, 25 bp, Mus musculus
tccaaactgttgaagaggtgcctga

SEQ ID NO: 135795 - DNA, 25 bp, Mus musculus
tccaaagaagtaaaggattgtccag

SEQ ID NO: 135796 - DNA, 25 bp, Mus musculus
tccaaagaccttgtcatcgcagggt

SEQ ID NO: 135797 - DNA, 25 bp, Mus musculus
tccaaagatcgtggccagagactgg

SEQ ID NO: 135798 - DNA, 25 bp, Mus musculus
tccaaagcaaagtctgagagcagcc

SEQ ID NO: 135799 - DNA, 25 bp, Mus musculus
tccaaagcagagagttagatcaggg

SEQ ID NO: 135800 - DNA, 25 bp, Mus musculus
tccaaaggagaatagttaccatagt

SEQ ID NO: 135801 - DNA, 25 bp, Mus musculus
tccaaaggatctgcagagatccctt

SEQ ID NO: 135802 - DNA, 25 bp, Mus musculus
tccaaaggatgagatgggagcagcc

SEQ ID NO: 135803 - DNA, 25 bp, Mus musculus
tccaaaggctgtggtcaaactcgag

SEQ ID NO: 135804 - DNA, 25 bp, Mus musculus
tccaaagggtgctccaaggtcaata

SEQ ID NO: 135805 - DNA, 25 bp, Mus musculus
tccaaagggttctttgaaggctcca

SEQ ID NO: 135806 - DNA, 25 bp, Mus musculus
tccaaaggtgtctacagcaggcgca

SEQ ID NO: 135807 - DNA, 25 bp, Mus musculus
tccaaagtggatctgcggtgaagcc

SEQ ID NO: 135808 - DNA, 25 bp, Mus musculus
tccaaagtgtctcggttcctgcggc

SEQ ID NO: 135809 - DNA, 25 bp, Mus musculus
tccaaatatggaaaaccgggtcaag

SEQ ID NO: 135810 - DNA, 25 bp, Mus musculus
tccaaatccacgagagaataacgcg

SEQ ID NO: 135811 - DNA, 25 bp, Mus musculus
tccaaatcgaaacggacagccattg

SEQ ID NO: 135812 - DNA, 25 bp, Mus musculus
tccaaatctgaatatgagctgagca

SEQ ID NO: 135813 - DNA, 25 bp, Mus musculus
tccaaatgcctcagctcagaaactg

SEQ ID NO: 135814 - DNA, 25 bp, Mus musculus
tccaaattcaggtgccatggagacg

SEQ ID NO: 135815 - DNA, 25 bp, Mus musculus
tccaaattctggacgaggagcattc

SEQ ID NO: 135816 - DNA, 25 bp, Mus musculus
tccaaatttaagtaccatgcaaggc

SEQ ID NO: 135817 - DNA, 25 bp, Mus musculus
tccaacaaatgccatggacgggctg

SEQ ID NO: 135818 - DNA, 25 bp, Mus musculus
tccaacaatgaagaaggcgtgaagc

SEQ ID NO: 135819 - DNA, 25 bp, Mus musculus
tccaacactgagagacgcactgctt

SEQ ID NO: 135820 - DNA, 25 bp, Mus musculus
tccaacagactctggaggccagggc

SEQ ID NO: 135821 - DNA, 25 bp, Mus musculus
tccaacagctctcgaggttctcggg

SEQ ID NO: 135822 - DNA, 25 bp, Mus musculus
tccaacaggatttacagagggtctc

SEQ ID NO: 135823 - DNA, 25 bp, Mus musculus
tccaacaggctgaagtttgccctag

SEQ ID NO: 135824 - DNA, 25 bp, Mus musculus
tccaacagtggagaaaacagcctgg

SEQ ID NO: 135825 - DNA, 25 bp, Mus musculus
tccaacatcctgctagatgagcggg

SEQ ID NO: 135826 - DNA, 25 bp, Mus musculus
tccaacatgcttgtaaacacaggcg

SEQ ID NO: 135827 - DNA, 25 bp, Mus musculus
tccaaccactgaaaaaacacagaaa

SEQ ID NO: 135828 - DNA, 25 bp, Mus musculus
tccaacccggtgacagagatgatcc

SEQ ID NO: 135829 - DNA, 25 bp, Mus musculus
tccaaccctgcacaacttggctttg

SEQ ID NO: 135830 - DNA, 25 bp, Mus musculus
tccaacctgggacaatggtgtgcat

SEQ ID NO: 135831 - DNA, 25 bp, Mus musculus
tccaacctgtgaagagcaaaacgag

SEQ ID NO: 135832 - DNA, 25 bp, Mus musculus
tccaaccttgaagctacgggtcagg

SEQ ID NO: 135833 - DNA, 25 bp, Mus musculus
tccaaccttgtaaactctgcagcag

SEQ ID NO: 135834 - DNA, 25 bp, Mus musculus
tccaacgaggtctatcaacagcgca

SEQ ID NO: 135835 - DNA, 25 bp, Mus musculus
tccaacgctgatgaggaggacatcc

SEQ ID NO: 135836 - DNA, 25 bp, Mus musculus
tccaactggagagacgctaacatca

SEQ ID NO: 135837 - DNA, 25 bp, Mus musculus
tccaactggcggtgtggacgacaca

SEQ ID NO: 135838 - DNA, 25 bp, Mus musculus
tccaagaacggcagaatgagtgagg

SEQ ID NO: 135839 - DNA, 25 bp, Mus musculus
tccaagaactgcctgtgcgcgctca

SEQ ID NO: 135840 - DNA, 25 bp, Mus musculus
tccaagaactggcagtgcagggacc

SEQ ID NO: 135841 - DNA, 25 bp, Mus musculus
tccaagaagcagagggacagtctac

SEQ ID NO: 135842 - DNA, 25 bp, Mus musculus
tccaagaagcctcgagacaagatag

SEQ ID NO: 135843 - DNA, 25 bp, Mus musculus
tccaagaagggatagaagtcaagca

SEQ ID NO: 135844 - DNA, 25 bp, Mus musculus
tccaagaccccgctttcttagggcg

SEQ ID NO: 135845 - DNA, 25 bp, Mus musculus
tccaagacccgaagacatgctctgg

SEQ ID NO: 135846 - DNA, 25 bp, Mus musculus
tccaagactacataggctgcagaaa

SEQ ID NO: 135847 - DNA, 25 bp, Mus musculus
tccaagagagccagtaccagtgtct

SEQ ID NO: 135848 - DNA, 25 bp, Mus musculus
tccaagaggcaattgctgaagtggc

SEQ ID NO: 135849 - DNA, 25 bp, Mus musculus
tccaagaggtatgagtgcgccaact

SEQ ID NO: 135850 - DNA, 25 bp, Mus musculus
tccaagagtaaggagcgagactcga

SEQ ID NO: 135851 - DNA, 25 bp, Mus musculus
tccaagagtggagtcgctctgcctc

SEQ ID NO: 135852 - DNA, 25 bp, Mus musculus
tccaagatcctgacaatccacagtg

SEQ ID NO: 135853 - DNA, 25 bp, Mus musculus
tccaagatgaaaccaacctgaggct

SEQ ID NO: 135854 - DNA, 25 bp, Mus musculus
tccaagatgaacctggctgggtgcc

SEQ ID NO: 135855 - DNA, 25 bp, Mus musculus
tccaagatgaatgtgcaggcctgct

SEQ ID NO: 135856 - DNA, 25 bp, Mus musculus
tccaagatgcagcagaacggatatg

SEQ ID NO: 135857 - DNA, 25 bp, Mus musculus
tccaagatggagtcgcccagttcat

SEQ ID NO: 135858 - DNA, 25 bp, Mus musculus
tccaagatggagttccaaatgccag

SEQ ID NO: 135859 - DNA, 25 bp, Mus musculus
tccaagatggctgcgtccatggcgc

SEQ ID NO: 135860 - DNA, 25 bp, Mus musculus
tccaagatgtgaagaacgctgccca

SEQ ID NO: 135861 - DNA, 25 bp, Mus musculus
tccaagcacggcacagatgatggtg

SEQ ID NO: 135862 - DNA, 25 bp, Mus musculus
tccaagcagaaagagaaggcagcct

SEQ ID NO: 135863 - DNA, 25 bp, Mus musculus
tccaagcagcagtccgaggaggacc

SEQ ID NO: 135864 - DNA, 25 bp, Mus musculus
tccaagccctgaggagaagctgcat

SEQ ID NO: 135865 - DNA, 25 bp, Mus musculus
tccaagccggcagaaggtacctggt

SEQ ID NO: 135866 - DNA, 25 bp, Mus musculus
tccaagccttcggaacaggatcggg

SEQ ID NO: 135867 - DNA, 25 bp, Mus musculus
tccaagctcatgtccgtatgcgtca

SEQ ID NO: 135868 - DNA, 25 bp, Mus musculus
tccaagctgactgaacaccacattt

SEQ ID NO: 135869 - DNA, 25 bp, Mus musculus
tccaagctgctgttgaataaaaccc

SEQ ID NO: 135870 - DNA, 25 bp, Mus musculus
tccaagctggataaatctggtctca

SEQ ID NO: 135871 - DNA, 25 bp, Mus musculus
tccaagctgtggaggagtttcaggc

SEQ ID NO: 135872 - DNA, 25 bp, Mus musculus
tccaaggacactgtttacagggcca

SEQ ID NO: 135873 - DNA, 25 bp, Mus musculus
tccaaggacccaggaatgtggcaga

SEQ ID NO: 135874 - DNA, 25 bp, Mus musculus
tccaaggacctgaatgacatgctgt

SEQ ID NO: 135875 - DNA, 25 bp, Mus musculus
tccaaggactgttatggccgacgtc

SEQ ID NO: 135876 - DNA, 25 bp, Mus musculus
tccaaggaggaagctgacatggcct

SEQ ID NO: 135877 - DNA, 25 bp, Mus musculus
tccaaggaggacaagaacggacacg

SEQ ID NO: 135878 - DNA, 25 bp, Mus musculus
tccaaggaggagttctacagcatgg

SEQ ID NO: 135879 - DNA, 25 bp, Mus musculus
tccaaggaggatgtttcagaaggct

SEQ ID NO: 135880 - DNA, 25 bp, Mus musculus
tccaaggagtattcaggcagagcca

SEQ ID NO: 135881 - DNA, 25 bp, Mus musculus
tccaaggagtgtttctggcccagag

SEQ ID NO: 135882 - DNA, 25 bp, Mus musculus
tccaaggatcatcactgggcctgcg

SEQ ID NO: 135883 - DNA, 25 bp, Mus musculus
tccaaggcaagagagagactatgtc

SEQ ID NO: 135884 - DNA, 25 bp, Mus musculus
tccaaggcacctgaacatgtgtggc

SEQ ID NO: 135885 - DNA, 25 bp, Mus musculus
tccaaggcacggtgtggacgcatct

SEQ ID NO: 135886 - DNA, 25 bp, Mus musculus
tccaaggcaggtacaccgaggtgct

SEQ ID NO: 135887 - DNA, 25 bp, Mus musculus
tccaaggccagagtatcgatgttcg

SEQ ID NO: 135888 - DNA, 25 bp, Mus musculus
tccaaggctctgtggcactcagaag

SEQ ID NO: 135889 - DNA, 25 bp, Mus musculus
tccaaggctgtgatccgagagatcc

SEQ ID NO: 135890 - DNA, 25 bp, Mus musculus
tccaagggaactatggcaatgcagc

SEQ ID NO: 135891 - DNA, 25 bp, Mus musculus
tccaagggacgcaggaagctctgct

SEQ ID NO: 135892 - DNA, 25 bp, Mus musculus
tccaagggctatggatttgtacact

SEQ ID NO: 135893 - DNA, 25 bp, Mus musculus
tccaagggtcccacagtaggtttgt

SEQ ID NO: 135894 - DNA, 25 bp, Mus musculus
tccaagggtttggaacttagcggct

SEQ ID NO: 135895 - DNA, 25 bp, Mus musculus
tccaaggtccgactatggtccctgg

SEQ ID NO: 135896 - DNA, 25 bp, Mus musculus
tccaaggtgatttgcagcagaggcg

SEQ ID NO: 135897 - DNA, 25 bp, Mus musculus
tccaaggttcatattgcaagcccta

SEQ ID NO: 135898 - DNA, 25 bp, Mus musculus
tccaaggttggcagaggtcgctgct

SEQ ID NO: 135899 - DNA, 25 bp, Mus musculus
tccaaggttgggaatgcatcggatc

SEQ ID NO: 135900 - DNA, 25 bp, Mus musculus
tccaagtatcaggacagcagccagt

SEQ ID NO: 135901 - DNA, 25 bp, Mus musculus
tccaagtccacggaagaaagtgtcc

SEQ ID NO: 135902 - DNA, 25 bp, Mus musculus
tccaagtctaccgtggcaggcagtg

SEQ ID NO: 135903 - DNA, 25 bp, Mus musculus
tccaagtctcggtgatgggcctctc

SEQ ID NO: 135904 - DNA, 25 bp, Mus musculus
tccaagtgcagagatgaagacggtt

SEQ ID NO: 135905 - DNA, 25 bp, Mus musculus
tccaagtggaactcgtcaagacaag

SEQ ID NO: 135906 - DNA, 25 bp, Mus musculus
tccaagtgtggctcgttagggaaca

SEQ ID NO: 135907 - DNA, 25 bp, Mus musculus
tccaagtgtgtgtcggagccaacct

SEQ ID NO: 135908 - DNA, 25 bp, Mus musculus
tccaagttagccaaagactctgcgg

SEQ ID NO: 135909 - DNA, 25 bp, Mus musculus
tccaagttcacacgaaagatccgct

SEQ ID NO: 135910 - DNA, 25 bp, Mus musculus
tccaagttgccgcagaatccaagca

SEQ ID NO: 135911 - DNA, 25 bp, Mus musculus
tccaagttgggaggaaatgaaatag

SEQ ID NO: 135912 - DNA, 25 bp, Mus musculus
tccaagttttggaagagccacaaga

SEQ ID NO: 135913 - DNA, 25 bp, Mus musculus
tccaatcagcaacaacgaaggcgag

SEQ ID NO: 135914 - DNA, 25 bp, Mus musculus
tccaatcatcagtgagccggcctgg

SEQ ID NO: 135915 - DNA, 25 bp, Mus musculus
tccaatccagggactgtgagggcaa

SEQ ID NO: 135916 - DNA, 25 bp, Mus musculus
tccaatcccgaaaactgagtcaagc

SEQ ID NO: 135917 - DNA, 25 bp, Mus musculus
tccaatccggttccatccggttctc

SEQ ID NO: 135918 - DNA, 25 bp, Mus musculus
tccaatcgacaagaatggcgagcct

SEQ ID NO: 135919 - DNA, 25 bp, Mus musculus
tccaatctggcttggtccggcacag

SEQ ID NO: 135920 - DNA, 25 bp, Mus musculus
tccaatgacagtgcgacatcggtgt

SEQ ID NO: 135921 - DNA, 25 bp, Mus musculus
tccaatgagaagcatctgacccagc

SEQ ID NO: 135922 - DNA, 25 bp, Mus musculus
tccaatgagatgtgagccagccaag

SEQ ID NO: 135923 - DNA, 25 bp, Mus musculus
tccaatgaggacatgacggtgcact

SEQ ID NO: 135924 - DNA, 25 bp, Mus musculus
tccaatgcaggaagtgtaccacgcc

SEQ ID NO: 135925 - DNA, 25 bp, Mus musculus
tccaatggattctctgatcccagag

SEQ ID NO: 135926 - DNA, 25 bp, Mus musculus
tccaatggcttcctgatcgacggct

SEQ ID NO: 135927 - DNA, 25 bp, Mus musculus
tccaatgtacacaacgaagggcaaa

SEQ ID NO: 135928 - DNA, 25 bp, Mus musculus
tccaatgtacctgccgtggtggtgg

SEQ ID NO: 135929 - DNA, 25 bp, Mus musculus
tccacaacggttcagtatgcgggtc

SEQ ID NO: 135930 - DNA, 25 bp, Mus musculus
tccacaactgtgagacacgcagagg

SEQ ID NO: 135931 - DNA, 25 bp, Mus musculus
tccacaacttcagtgagagccacag

SEQ ID NO: 135932 - DNA, 25 bp, Mus musculus
tccacaagatcgaagagggacactt

SEQ ID NO: 135933 - DNA, 25 bp, Mus musculus
tccacaagccgatgcaggagaagaa

SEQ ID NO: 135934 - DNA, 25 bp, Mus musculus
tccacaaggaatgcagaggcaccct

SEQ ID NO: 135935 - DNA, 25 bp, Mus musculus
tccacaaggagatcactgcaagggc

SEQ ID NO: 135936 - DNA, 25 bp, Mus musculus
tccacaaggagatgggtatagttcc

SEQ ID NO: 135937 - DNA, 25 bp, Mus musculus
tccacaaggaggtgtccagcgttcg

SEQ ID NO: 135938 - DNA, 25 bp, Mus musculus
tccacaagtacgtgggctgcagcgc

SEQ ID NO: 135939 - DNA, 25 bp, Mus musculus
tccacaagtcacaaatgaggtgcta

SEQ ID NO: 135940 - DNA, 25 bp, Mus musculus
tccacaagtggagaacgggcctttt

SEQ ID NO: 135941 - DNA, 25 bp, Mus musculus
tccacacaagatgaaagagtccagc

SEQ ID NO: 135942 - DNA, 25 bp, Mus musculus
tccacacaccctgtttgcccgtgag

SEQ ID NO: 135943 - DNA, 25 bp, Mus musculus
tccacacggagcagatgtacaaaca

SEQ ID NO: 135944 - DNA, 25 bp, Mus musculus
tccacacgtggagccggatttctct

SEQ ID NO: 135945 - DNA, 25 bp, Mus musculus
tccacactgcgtgagactggagcgg

SEQ ID NO: 135946 - DNA, 25 bp, Mus musculus
tccacacttagagagcttgagcgat

SEQ ID NO: 135947 - DNA, 25 bp, Mus musculus
tccacacttgccaaccgggaaaagt

SEQ ID NO: 135948 - DNA, 25 bp, Mus musculus
tccacagaactgaaaagacaggccg

SEQ ID NO: 135949 - DNA, 25 bp, Mus musculus
tccacagaaggagagcaggccgggc

SEQ ID NO: 135950 - DNA, 25 bp, Mus musculus
tccacagcacctttgtgaactcagg

SEQ ID NO: 135951 - DNA, 25 bp, Mus musculus
tccacagcccagcacagtgggtgag

SEQ ID NO: 135952 - DNA, 25 bp, Mus musculus
tccacagcctaggactaggccgagt

SEQ ID NO: 135953 - DNA, 25 bp, Mus musculus
tccacagcggctaggagttgacttc

SEQ ID NO: 135954 - DNA, 25 bp, Mus musculus
tccacagggaactctgcacctacag

SEQ ID NO: 135955 - DNA, 25 bp, Mus musculus
tccacagtatgtccacagggctcct

SEQ ID NO: 135956 - DNA, 25 bp, Mus musculus
tccacagttcaatgaagtcttctat

SEQ ID NO: 135957 - DNA, 25 bp, Mus musculus
tccacatcggagaaacagaaaagaa

SEQ ID NO: 135958 - DNA, 25 bp, Mus musculus
tccacatcgtatggtcagactgaag

SEQ ID NO: 135959 - DNA, 25 bp, Mus musculus
tccacatcgtgagaggagacttcga

SEQ ID NO: 135960 - DNA, 25 bp, Mus musculus
tccacatctgggtgaaggaatgcct

SEQ ID NO: 135961 - DNA, 25 bp, Mus musculus
tccacatgaaagatggctccaacag

SEQ ID NO: 135962 - DNA, 25 bp, Mus musculus
tccacatggtgaggaacgctaagct

SEQ ID NO: 135963 - DNA, 25 bp, Mus musculus
tccacattgtaccttagacgagcag

SEQ ID NO: 135964 - DNA, 25 bp, Mus musculus
tccaccaaagctgagatggacgcag

SEQ ID NO: 135965 - DNA, 25 bp, Mus musculus
tccaccaactccagcgagaatatgt

SEQ ID NO: 135966 - DNA, 25 bp, Mus musculus
tccaccaagcctgggaagctgtcag

SEQ ID NO: 135967 - DNA, 25 bp, Mus musculus
tccaccaatgcaaagtctaagactg

SEQ ID NO: 135968 - DNA, 25 bp, Mus musculus
tccaccaatggatcaagagctcaga

SEQ ID NO: 135969 - DNA, 25 bp, Mus musculus
tccaccacgggagacaagattcttg

SEQ ID NO: 135970 - DNA, 25 bp, Mus musculus
tccaccagacctcttgattccattt

SEQ ID NO: 135971 - DNA, 25 bp, Mus musculus
tccaccagagcgtagaggctgacgt

SEQ ID NO: 135972 - DNA, 25 bp, Mus musculus
tccaccagatttctgtaatcccagc

SEQ ID NO: 135973 - DNA, 25 bp, Mus musculus
tccaccaggaaggaagtctgcgcag

SEQ ID NO: 135974 - DNA, 25 bp, Mus musculus
tccaccagtggaggaatgagacccg

SEQ ID NO: 135975 - DNA, 25 bp, Mus musculus
tccaccatgtcagataaaaccagtg

SEQ ID NO: 135976 - DNA, 25 bp, Mus musculus
tccaccccgtgagcatgaacaatag

SEQ ID NO: 135977 - DNA, 25 bp, Mus musculus
tccacccggattccgccatgttgag

SEQ ID NO: 135978 - DNA, 25 bp, Mus musculus
tccacccggcagaagatcgtagagc

SEQ ID NO: 135979 - DNA, 25 bp, Mus musculus
tccaccgagacacacgaggagttgc

SEQ ID NO: 135980 - DNA, 25 bp, Mus musculus
tccacctgaaccaacaggagagggt

SEQ ID NO: 135981 - DNA, 25 bp, Mus musculus
tccacctgagaaatacgcattgagt

SEQ ID NO: 135982 - DNA, 25 bp, Mus musculus
tccacctgagcaccgtttgagacct

SEQ ID NO: 135983 - DNA, 25 bp, Mus musculus
tccacctgataactgatgccgtagc

SEQ ID NO: 135984 - DNA, 25 bp, Mus musculus
tccacctggaggagtgccttgcatc

SEQ ID NO: 135985 - DNA, 25 bp, Mus musculus
tccacctggcacagatgaaagggtt

SEQ ID NO: 135986 - DNA, 25 bp, Mus musculus
tccacctgggtcctcggaagaaaag

SEQ ID NO: 135987 - DNA, 25 bp, Mus musculus
tccaccttgacacatggccctctgg

SEQ ID NO: 135988 - DNA, 25 bp, Mus musculus
tccacctttaaagaggagggagcgg

SEQ ID NO: 135989 - DNA, 25 bp, Mus musculus
tccacgaaggataagatgagcagca

SEQ ID NO: 135990 - DNA, 25 bp, Mus musculus
tccacgaatgttgaccctacctaga

SEQ ID NO: 135991 - DNA, 25 bp, Mus musculus
tccacgacaggaaacaagagagcct

SEQ ID NO: 135992 - DNA, 25 bp, Mus musculus
tccacgagaaacagacggcggtgtc

SEQ ID NO: 135993 - DNA, 25 bp, Mus musculus
tccacgagagtgagttccacggacg

SEQ ID NO: 135994 - DNA, 25 bp, Mus musculus
tccacgaggaaagcagtagcagcag

SEQ ID NO: 135995 - DNA, 25 bp, Mus musculus
tccacgaggaatactgaggtccact

SEQ ID NO: 135996 - DNA, 25 bp, Mus musculus
tccacgagggaatggcatatcacac

SEQ ID NO: 135997 - DNA, 25 bp, Mus musculus
tccacgagtggaagtaaagcgccct

SEQ ID NO: 135998 - DNA, 25 bp, Mus musculus
tccacgatgagtgcaagaggagacg

SEQ ID NO: 135999 - DNA, 25 bp, Mus musculus
tccacgcacaagcaaagaagcatgt

SEQ ID NO: 136000 - DNA, 25 bp, Mus musculus
tccacgcggaggaaagaagagacgc

SEQ ID NO: 136001 - DNA, 25 bp, Mus musculus
tccacgctctagaacaagatgccag

SEQ ID NO: 136002 - DNA, 25 bp, Mus musculus
tccacggacagatttgagggcaact

SEQ ID NO: 136003 - DNA, 25 bp, Mus musculus
tccacggacggaagctgaagcttta

SEQ ID NO: 136004 - DNA, 25 bp, Mus musculus
tccacggactttgactgaagcaggc

SEQ ID NO: 136005 - DNA, 25 bp, Mus musculus
tccacggaggcggtgggctcgggca

SEQ ID NO: 136006 - DNA, 25 bp, Mus musculus
tccacggcacagaggacgaggtgat

SEQ ID NO: 136007 - DNA, 25 bp, Mus musculus
tccacggcagctgatgaggtaactg

SEQ ID NO: 136008 - DNA, 25 bp, Mus musculus
tccacgggcactgttatgggagccg

SEQ ID NO: 136009 - DNA, 25 bp, Mus musculus
tccacgggtcggtgggttcctgagt

SEQ ID NO: 136010 - DNA, 25 bp, Mus musculus
tccacggtgcgccatcagccagagg

SEQ ID NO: 136011 - DNA, 25 bp, Mus musculus
tccacgtcagttgttgagagccccg

SEQ ID NO: 136012 - DNA, 25 bp, Mus musculus
tccacgtgcccatagagaacagctt

SEQ ID NO: 136013 - DNA, 25 bp, Mus musculus
tccacgtgctgtgattataggcagg

SEQ ID NO: 136014 - DNA, 25 bp, Mus musculus
tccacgtggaggttgagatcatcgc

SEQ ID NO: 136015 - DNA, 25 bp, Mus musculus
tccacgttaggatcccgaagctcag

SEQ ID NO: 136016 - DNA, 25 bp, Mus musculus
tccactacctgtcttttcagaggca

SEQ ID NO: 136017 - DNA, 25 bp, Mus musculus
tccactacggatcagggagagtcaa

SEQ ID NO: 136018 - DNA, 25 bp, Mus musculus
tccactatgaggaagtgcgcgggct

SEQ ID NO: 136019 - DNA, 25 bp, Mus musculus
tccactcaaagcatgggtccctggc

SEQ ID NO: 136020 - DNA, 25 bp, Mus musculus
tccactcaagtagcaggagcagcga

SEQ ID NO: 136021 - DNA, 25 bp, Mus musculus
tccactcaggccaaggtgaaaagcc

SEQ ID NO: 136022 - DNA, 25 bp, Mus musculus
tccactcagtgtctaagatacccgc

SEQ ID NO: 136023 - DNA, 25 bp, Mus musculus
tccactccgacaaggtacagaaaaa

SEQ ID NO: 136024 - DNA, 25 bp, Mus musculus
tccactcctggaacaataacgaccg

SEQ ID NO: 136025 - DNA, 25 bp, Mus musculus
tccactcctggaagtgtagaaaagc

SEQ ID NO: 136026 - DNA, 25 bp, Mus musculus
tccactcgcgggacaaggtgtcaac

SEQ ID NO: 136027 - DNA, 25 bp, Mus musculus
tccactctaggctttgacagctacg

SEQ ID NO: 136028 - DNA, 25 bp, Mus musculus
tccactctggatgttgaattgccgc

SEQ ID NO: 136029 - DNA, 25 bp, Mus musculus
tccactgagaactcggaacacggca

SEQ ID NO: 136030 - DNA, 25 bp, Mus musculus
tccactgagtggaaatgagcggccg

SEQ ID NO: 136031 - DNA, 25 bp, Mus musculus
tccactgcataaggagggaagacag

SEQ ID NO: 136032 - DNA, 25 bp, Mus musculus
tccactgctaacaaagctaatgaag

SEQ ID NO: 136033 - DNA, 25 bp, Mus musculus
tccactggaccaagataatagagcc

SEQ ID NO: 136034 - DNA, 25 bp, Mus musculus
tccactggactaggacggaaggctg

SEQ ID NO: 136035 - DNA, 25 bp, Mus musculus
tccactggagtctcgggtttcgaag

SEQ ID NO: 136036 - DNA, 25 bp, Mus musculus
tccactggcttcttcagcggagtaa

SEQ ID NO: 136037 - DNA, 25 bp, Mus musculus
tccactgggagcgaatcaaagttct

SEQ ID NO: 136038 - DNA, 25 bp, Mus musculus
tccactggtggtgaaccttctgaca

SEQ ID NO: 136039 - DNA, 25 bp, Mus musculus
tccactgtacagaatgccgaggcct

SEQ ID NO: 136040 - DNA, 25 bp, Mus musculus
tccactgtgagctcggagttaagcc

SEQ ID NO: 136041 - DNA, 25 bp, Mus musculus
tccactgtgcctcagactttcacta

SEQ ID NO: 136042 - DNA, 25 bp, Mus musculus
tccactgtgctgtctgccgggtaga

SEQ ID NO: 136043 - DNA, 25 bp, Mus musculus
tccactgttgttatgcctggtaaag

SEQ ID NO: 136044 - DNA, 25 bp, Mus musculus
tccacttccgaaatgttgacttcaa

SEQ ID NO: 136045 - DNA, 25 bp, Mus musculus
tccacttgccctagccatgggacag

SEQ ID NO: 136046 - DNA, 25 bp, Mus musculus
tccacttgctgagcggtgaacagag

SEQ ID NO: 136047 - DNA, 25 bp, Mus musculus
tccagaaaagggtcgtgcagcacca

SEQ ID NO: 136048 - DNA, 25 bp, Mus musculus
tccagaaacgagagctacatgcgcg

SEQ ID NO: 136049 - DNA, 25 bp, Mus musculus
tccagaaactgggttggtaagcaca

SEQ ID NO: 136050 - DNA, 25 bp, Mus musculus
tccagaaacttcttccagtgggagc

SEQ ID NO: 136051 - DNA, 25 bp, Mus musculus
tccagaaatacccaggagggctccg

SEQ ID NO: 136052 - DNA, 25 bp, Mus musculus
tccagaaattgagctgtacgaggct

SEQ ID NO: 136053 - DNA, 25 bp, Mus musculus
tccagaacaggagctcagtagggca

SEQ ID NO: 136054 - DNA, 25 bp, Mus musculus
tccagaacatcatgggaagcccgat

SEQ ID NO: 136055 - DNA, 25 bp, Mus musculus
tccagaacggcgaacacgaggaggc

SEQ ID NO: 136056 - DNA, 25 bp, Mus musculus
tccagaacgtgcttatgggacaaga

SEQ ID NO: 136057 - DNA, 25 bp, Mus musculus
tccagaactcagcactgaaaggcat

SEQ ID NO: 136058 - DNA, 25 bp, Mus musculus
tccagaacttacaggtagccgccag

SEQ ID NO: 136059 - DNA, 25 bp, Mus musculus
tccagaagacttccgattgtaaacc

SEQ ID NO: 136060 - DNA, 25 bp, Mus musculus
tccagaagccattaaaactaacgcc

SEQ ID NO: 136061 - DNA, 25 bp, Mus musculus
tccagaagccctgttcatgtgtggg

SEQ ID NO: 136062 - DNA, 25 bp, Mus musculus
tccagaagcgtgagaatgaggtcct

SEQ ID NO: 136063 - DNA, 25 bp, Mus musculus
tccagaagcttgctagccgactgag

SEQ ID NO: 136064 - DNA, 25 bp, Mus musculus
tccagaaggagtggctgacacagca

SEQ ID NO: 136065 - DNA, 25 bp, Mus musculus
tccagaaggcggctataaagagcct

SEQ ID NO: 136066 - DNA, 25 bp, Mus musculus
tccagaaggtggtggacaggcccat

SEQ ID NO: 136067 - DNA, 25 bp, Mus musculus
tccagaagtacgcaacggaagaggc

SEQ ID NO: 136068 - DNA, 25 bp, Mus musculus
tccagaagtgcttcgtaaagagcct

SEQ ID NO: 136069 - DNA, 25 bp, Mus musculus
tccagaagttggctagtcaatacct

SEQ ID NO: 136070 - DNA, 25 bp, Mus musculus
tccagaagtttgacagccctccctt

SEQ ID NO: 136071 - DNA, 25 bp, Mus musculus
tccagaatgacaagatgcgcacggg

SEQ ID NO: 136072 - DNA, 25 bp, Mus musculus
tccagaatgagcacagctaccaagt

SEQ ID NO: 136073 - DNA, 25 bp, Mus musculus
tccagaatggcgagttgaaggccgc

SEQ ID NO: 136074 - DNA, 25 bp, Mus musculus
tccagaattttcaggccttcccgag

SEQ ID NO: 136075 - DNA, 25 bp, Mus musculus
tccagacaaacactactggactggg

SEQ ID NO: 136076 - DNA, 25 bp, Mus musculus
tccagacaaccgtaccgagtgaagg

SEQ ID NO: 136077 - DNA, 25 bp, Mus musculus
tccagacaagaaatcaacatgctat

SEQ ID NO: 136078 - DNA, 25 bp, Mus musculus
tccagacactgttgcagagggaaat

SEQ ID NO: 136079 - DNA, 25 bp, Mus musculus
tccagacaggagacgtgatagaact

SEQ ID NO: 136080 - DNA, 25 bp, Mus musculus
tccagaccaaacagaagcagaccat

SEQ ID NO: 136081 - DNA, 25 bp, Mus musculus
tccagaccatattatttatggcagt

SEQ ID NO: 136082 - DNA, 25 bp, Mus musculus
tccagaccccaggacattagcatgt

SEQ ID NO: 136083 - DNA, 25 bp, Mus musculus
tccagacctctgaggataagaccat

SEQ ID NO: 136084 - DNA, 25 bp, Mus musculus
tccagacgtccccagaggaaatctc

SEQ ID NO: 136085 - DNA, 25 bp, Mus musculus
tccagactcgggatgtgggctccaa

SEQ ID NO: 136086 - DNA, 25 bp, Mus musculus
tccagactgcactgaacgacttggc

SEQ ID NO: 136087 - DNA, 25 bp, Mus musculus
tccagactgtgagagtcggcagcgc

SEQ ID NO: 136088 - DNA, 25 bp, Mus musculus
tccagacttagtgggtaacgcgcca

SEQ ID NO: 136089 - DNA, 25 bp, Mus musculus
tccagagaaagagatgtagcaaagg

SEQ ID NO: 136090 - DNA, 25 bp, Mus musculus
tccagagaatgagtagttgggcaac

SEQ ID NO: 136091 - DNA, 25 bp, Mus musculus
tccagagaatgtccttgaagcggcc

SEQ ID NO: 136092 - DNA, 25 bp, Mus musculus
tccagagacacagacaaacaggcct

SEQ ID NO: 136093 - DNA, 25 bp, Mus musculus
tccagagaccatggacagtgcactc

SEQ ID NO: 136094 - DNA, 25 bp, Mus musculus
tccagagacgcttcgtggtagacgt

SEQ ID NO: 136095 - DNA, 25 bp, Mus musculus
tccagagagcaagtgagcctatgtc

SEQ ID NO: 136096 - DNA, 25 bp, Mus musculus
tccagagagtagcatgacaaggtga

SEQ ID NO: 136097 - DNA, 25 bp, Mus musculus
tccagagagtgacccggaagcagaa

SEQ ID NO: 136098 - DNA, 25 bp, Mus musculus
tccagagatccgtgcagagctaagt

SEQ ID NO: 136099 - DNA, 25 bp, Mus musculus
tccagagatctaggtcggagccttc

SEQ ID NO: 136100 - DNA, 25 bp, Mus musculus
tccagagcaatgtaacagggccttc

SEQ ID NO: 136101 - DNA, 25 bp, Mus musculus
tccagagcacagagatggaaaacct

SEQ ID NO: 136102 - DNA, 25 bp, Mus musculus
tccagagcagacagaggcaacactt

SEQ ID NO: 136103 - DNA, 25 bp, Mus musculus
tccagagcatgacccggctagtagt

SEQ ID NO: 136104 - DNA, 25 bp, Mus musculus
tccagagccagaagacggtgatcag

SEQ ID NO: 136105 - DNA, 25 bp, Mus musculus
tccagagcccacgtgggaagaacag

SEQ ID NO: 136106 - DNA, 25 bp, Mus musculus
tccagagcctagagcaagtgaagcg

SEQ ID NO: 136107 - DNA, 25 bp, Mus musculus
tccagagctctagttgtaggcagcg

SEQ ID NO: 136108 - DNA, 25 bp, Mus musculus
tccagagctctcttgagtgctgagg

SEQ ID NO: 136109 - DNA, 25 bp, Mus musculus
tccagagctgtgagtgacaagtgcc

SEQ ID NO: 136110 - DNA, 25 bp, Mus musculus
tccagaggatgaacagagcaaaagc

SEQ ID NO: 136111 - DNA, 25 bp, Mus musculus
tccagaggcaacatggcggataagc

SEQ ID NO: 136112 - DNA, 25 bp, Mus musculus
tccagaggcggttcatacaagaggt

SEQ ID NO: 136113 - DNA, 25 bp, Mus musculus
tccagaggctcgctgcttctatggc

SEQ ID NO: 136114 - DNA, 25 bp, Mus musculus
tccagaggctctgatcgggacactg

SEQ ID NO: 136115 - DNA, 25 bp, Mus musculus
tccagaggcttctttaactaccaag

SEQ ID NO: 136116 - DNA, 25 bp, Mus musculus
tccagaggtaccacttgttaaagcg

SEQ ID NO: 136117 - DNA, 25 bp, Mus musculus
tccagaggttacagaaggtcattcc

SEQ ID NO: 136118 - DNA, 25 bp, Mus musculus
tccagaggtttctacagcaaaagcc

SEQ ID NO: 136119 - DNA, 25 bp, Mus musculus
tccagagtaatgagccagagggcca

SEQ ID NO: 136120 - DNA, 25 bp, Mus musculus
tccagagtacgtccaaggcaagcct

SEQ ID NO: 136121 - DNA, 25 bp, Mus musculus
tccagagtataacacgcagcaggcg

SEQ ID NO: 136122 - DNA, 25 bp, Mus musculus
tccagagtctgtgatctcccaaagc

SEQ ID NO: 136123 - DNA, 25 bp, Mus musculus
tccagagtgacgtggagaacctgct

SEQ ID NO: 136124 - DNA, 25 bp, Mus musculus
tccagagtggcctataagcacagca

SEQ ID NO: 136125 - DNA, 25 bp, Mus musculus
tccagatagcatgctgagtgagccc

SEQ ID NO: 136126 - DNA, 25 bp, Mus musculus
tccagatcagcaatgagtcagcgat

SEQ ID NO: 136127 - DNA, 25 bp, Mus musculus
tccagatctgtcataggccacgaag

SEQ ID NO: 136128 - DNA, 25 bp, Mus musculus
tccagatgaacattcggactccgag

SEQ ID NO: 136129 - DNA, 25 bp, Mus musculus
tccagatgacgtcagaggagcttcc

SEQ ID NO: 136130 - DNA, 25 bp, Mus musculus
tccagatgactacttcctccttcga

SEQ ID NO: 136131 - DNA, 25 bp, Mus musculus
tccagatgatcttccgaacagaggg

SEQ ID NO: 136132 - DNA, 25 bp, Mus musculus
tccagatgggcaccttgagaaagcc

SEQ ID NO: 136133 - DNA, 25 bp, Mus musculus
tccagatgggcatagaccagacggt

SEQ ID NO: 136134 - DNA, 25 bp, Mus musculus
tccagatgggcatcctccagcagtg

SEQ ID NO: 136135 - DNA, 25 bp, Mus musculus
tccagatggttccttttccgtagct

SEQ ID NO: 136136 - DNA, 25 bp, Mus musculus
tccagatgtacagtcggagaccaca

SEQ ID NO: 136137 - DNA, 25 bp, Mus musculus
tccagatgtgggaaaaatagtcccc

SEQ ID NO: 136138 - DNA, 25 bp, Mus musculus
tccagatgttgaatgagcctcccgg

SEQ ID NO: 136139 - DNA, 25 bp, Mus musculus
tccagatgttgagatgcccagtccc

SEQ ID NO: 136140 - DNA, 25 bp, Mus musculus
tccagatttcaggaggatggtcccc

SEQ ID NO: 136141 - DNA, 25 bp, Mus musculus
tccagcaagacagccgcgaaactgt

SEQ ID NO: 136142 - DNA, 25 bp, Mus musculus
tccagcaaggcccaaacagaagttg

SEQ ID NO: 136143 - DNA, 25 bp, Mus musculus
tccagcaatgcatgaagactcgttc

SEQ ID NO: 136144 - DNA, 25 bp, Mus musculus
tccagcaatgcctgcgagaagacgt

SEQ ID NO: 136145 - DNA, 25 bp, Mus musculus
tccagcaatggagccggtttcaacg

SEQ ID NO: 136146 - DNA, 25 bp, Mus musculus
tccagcacaggctggcataaaccag

SEQ ID NO: 136147 - DNA, 25 bp, Mus musculus
tccagcaccgtagggatcatggtct

SEQ ID NO: 136148 - DNA, 25 bp, Mus musculus
tccagcactctgaaatctagccaaa

SEQ ID NO: 136149 - DNA, 25 bp, Mus musculus
tccagcactgcatgagcttcaaagt

SEQ ID NO: 136150 - DNA, 25 bp, Mus musculus
tccagcactttggtgggtataaaac

SEQ ID NO: 136151 - DNA, 25 bp, Mus musculus
tccagcagacgtgtgagatcctgca

SEQ ID NO: 136152 - DNA, 25 bp, Mus musculus
tccagcagccagtaagccacaagtt

SEQ ID NO: 136153 - DNA, 25 bp, Mus musculus
tccagcagctggtactcatgtcctt

SEQ ID NO: 136154 - DNA, 25 bp, Mus musculus
tccagcagcttgtgcgggctgcctt

SEQ ID NO: 136155 - DNA, 25 bp, Mus musculus
tccagcagggaggatgagacagtct

SEQ ID NO: 136156 - DNA, 25 bp, Mus musculus
tccagcaggtgctcaaagaatgcat

SEQ ID NO: 136157 - DNA, 25 bp, Mus musculus
tccagcaggttaggtgtgcatacca

SEQ ID NO: 136158 - DNA, 25 bp, Mus musculus
tccagcagtgacagtacatacttcc

SEQ ID NO: 136159 - DNA, 25 bp, Mus musculus
tccagcagttggagcgcagtatccg

SEQ ID NO: 136160 - DNA, 25 bp, Mus musculus
tccagcatatgtacaccaaagcaga

SEQ ID NO: 136161 - DNA, 25 bp, Mus musculus
tccagcatcacgttcggcgggaaga

SEQ ID NO: 136162 - DNA, 25 bp, Mus musculus
tccagcatcatgagaggcgtcttca

SEQ ID NO: 136163 - DNA, 25 bp, Mus musculus
tccagcatcctgtattttgacggcg

SEQ ID NO: 136164 - DNA, 25 bp, Mus musculus
tccagcatgagcttgagccagagcg

SEQ ID NO: 136165 - DNA, 25 bp, Mus musculus
tccagcatgagtgtattccccaggc

SEQ ID NO: 136166 - DNA, 25 bp, Mus musculus
tccagcatgctaagggagtccactc

SEQ ID NO: 136167 - DNA, 25 bp, Mus musculus
tccagcatggcccagggtgccatgc

SEQ ID NO: 136168 - DNA, 25 bp, Mus musculus
tccagcattagctcgggtgagctca

SEQ ID NO: 136169 - DNA, 25 bp, Mus musculus
tccagccatatcaagcaggactgag

SEQ ID NO: 136170 - DNA, 25 bp, Mus musculus
tccagccatctttgccaaccagtag

SEQ ID NO: 136171 - DNA, 25 bp, Mus musculus
tccagcccagatgagaagtaccctg

SEQ ID NO: 136172 - DNA, 25 bp, Mus musculus
tccagcccctaataaagcagtgggt

SEQ ID NO: 136173 - DNA, 25 bp, Mus musculus
tccagcccggaacaaacagagaact

SEQ ID NO: 136174 - DNA, 25 bp, Mus musculus
tccagcccttcgcttatttgggaaa

SEQ ID NO: 136175 - DNA, 25 bp, Mus musculus
tccagccgggagagtgaccattgag

SEQ ID NO: 136176 - DNA, 25 bp, Mus musculus
tccagccggtgtgtggacccgagat

SEQ ID NO: 136177 - DNA, 25 bp, Mus musculus
tccagcctcacacacaaaaagaacg

SEQ ID NO: 136178 - DNA, 25 bp, Mus musculus
tccagcctgcagacatccactgggc

SEQ ID NO: 136179 - DNA, 25 bp, Mus musculus
tccagcctgcctcagagagtcaaga

SEQ ID NO: 136180 - DNA, 25 bp, Mus musculus
tccagcctggatgctcacgaagaga

SEQ ID NO: 136181 - DNA, 25 bp, Mus musculus
tccagcgaaatcaggcagtgcaggc

SEQ ID NO: 136182 - DNA, 25 bp, Mus musculus
tccagcgaagatgagatggtggccc

SEQ ID NO: 136183 - DNA, 25 bp, Mus musculus
tccagcgcatctcattagcatctca

SEQ ID NO: 136184 - DNA, 25 bp, Mus musculus
tccagcgccgcaaagagaaacgtga

SEQ ID NO: 136185 - DNA, 25 bp, Mus musculus
tccagcgcgaacacgtgcgctctgg

SEQ ID NO: 136186 - DNA, 25 bp, Mus musculus
tccagcgctacatgacccagtttgc

SEQ ID NO: 136187 - DNA, 25 bp, Mus musculus
tccagcggcgcgagtccttcctgta

SEQ ID NO: 136188 - DNA, 25 bp, Mus musculus
tccagcgggtactgtgcgagaagct

SEQ ID NO: 136189 - DNA, 25 bp, Mus musculus
tccagcggtggcgaatcagaagttt

SEQ ID NO: 136190 - DNA, 25 bp, Mus musculus
tccagcgtgggatgccagagactga

SEQ ID NO: 136191 - DNA, 25 bp, Mus musculus
tccagctcaagggtgaatacgatgc

SEQ ID NO: 136192 - DNA, 25 bp, Mus musculus
tccagctcagcgagtacttgccaga

SEQ ID NO: 136193 - DNA, 25 bp, Mus musculus
tccagctccgtgtcaggcatcagat

SEQ ID NO: 136194 - DNA, 25 bp, Mus musculus
tccagctgatggagtcagagggccc

SEQ ID NO: 136195 - DNA, 25 bp, Mus musculus
tccagctgcgagaaataaagcacgt

SEQ ID NO: 136196 - DNA, 25 bp, Mus musculus
tccagctggacgcagtcaacaaaag

SEQ ID NO: 136197 - DNA, 25 bp, Mus musculus
tccagctggctatggagagggcatc

SEQ ID NO: 136198 - DNA, 25 bp, Mus musculus
tccagctgtcctaacaagacctctg

SEQ ID NO: 136199 - DNA, 25 bp, Mus musculus
tccagctgtggcaacgaaagcattg

SEQ ID NO: 136200 - DNA, 25 bp, Mus musculus
tccagctgtttaaggcaaagtccca

SEQ ID NO: 136201 - DNA, 25 bp, Mus musculus
tccagcttcagcatggcgctcagat

SEQ ID NO: 136202 - DNA, 25 bp, Mus musculus
tccagcttgggcagcttacatccaa

SEQ ID NO: 136203 - DNA, 25 bp, Mus musculus
tccagcttgtggtggacggcagcca

SEQ ID NO: 136204 - DNA, 25 bp, Mus musculus
tccagctttggaagtggcatcaatg

SEQ ID NO: 136205 - DNA, 25 bp, Mus musculus
tccagcttttggaagccccggtggc

SEQ ID NO: 136206 - DNA, 25 bp, Mus musculus
tccaggaaaagaagtgaatatgcta

SEQ ID NO: 136207 - DNA, 25 bp, Mus musculus
tccaggaaagactgaagatcactgc

SEQ ID NO: 136208 - DNA, 25 bp, Mus musculus
tccaggaaagccaagtgacgatcaa

SEQ ID NO: 136209 - DNA, 25 bp, Mus musculus
tccaggaaatggtccactcggaggt

SEQ ID NO: 136210 - DNA, 25 bp, Mus musculus
tccaggaacatcgagtgtggtcacc

SEQ ID NO: 136211 - DNA, 25 bp, Mus musculus
tccaggaagcggaaaaagatgggct

SEQ ID NO: 136212 - DNA, 25 bp, Mus musculus
tccaggaagtgtgtgaacgcagcaa

SEQ ID NO: 136213 - DNA, 25 bp, Mus musculus
tccaggacaccaaaagctaagtgct

SEQ ID NO: 136214 - DNA, 25 bp, Mus musculus
tccaggacagatcccgaagagaaag

SEQ ID NO: 136215 - DNA, 25 bp, Mus musculus
tccaggacagcaaaatgggatttgt

SEQ ID NO: 136216 - DNA, 25 bp, Mus musculus
tccaggacagcagtgatagtgacaa

SEQ ID NO: 136217 - DNA, 25 bp, Mus musculus
tccaggacaggacaggcaaattcat

SEQ ID NO: 136218 - DNA, 25 bp, Mus musculus
tccaggacccctgcgtgtagtagag

SEQ ID NO: 136219 - DNA, 25 bp, Mus musculus
tccaggacccggatgagaagtacct

SEQ ID NO: 136220 - DNA, 25 bp, Mus musculus
tccaggaccttgtagaacacggtgc

SEQ ID NO: 136221 - DNA, 25 bp, Mus musculus
tccaggacgccaacactaaggctgt

SEQ ID NO: 136222 - DNA, 25 bp, Mus musculus
tccaggacggacaagttttcgaggg

SEQ ID NO: 136223 - DNA, 25 bp, Mus musculus
tccaggactacgtggcccctgattg

SEQ ID NO: 136224 - DNA, 25 bp, Mus musculus
tccaggactatggtatgcaatacag

SEQ ID NO: 136225 - DNA, 25 bp, Mus musculus
tccaggactctgttgggacccagct

SEQ ID NO: 136226 - DNA, 25 bp, Mus musculus
tccaggactgcaagggcaggacagt

SEQ ID NO: 136227 - DNA, 25 bp, Mus musculus
tccaggacttacaaagacagcctgt

SEQ ID NO: 136228 - DNA, 25 bp, Mus musculus
tccaggacttgggactccgaattgt

SEQ ID NO: 136229 - DNA, 25 bp, Mus musculus
tccaggagagcgagcatatcaaggt

SEQ ID NO: 136230 - DNA, 25 bp, Mus musculus
tccaggagcacgtgaagaagactac

SEQ ID NO: 136231 - DNA, 25 bp, Mus musculus
tccaggagccacaaacagcatagtg

SEQ ID NO: 136232 - DNA, 25 bp, Mus musculus
tccaggagctaccaatatgataggc

SEQ ID NO: 136233 - DNA, 25 bp, Mus musculus
tccaggagctcaaggaagagtacgc

SEQ ID NO: 136234 - DNA, 25 bp, Mus musculus
tccaggagctctgactgatagacag

SEQ ID NO: 136235 - DNA, 25 bp, Mus musculus
tccaggagctgaagtacgacgagaa

SEQ ID NO: 136236 - DNA, 25 bp, Mus musculus
tccaggagctggaggctaccccgca

SEQ ID NO: 136237 - DNA, 25 bp, Mus musculus
tccaggaggacgtgcaggaaatgca

SEQ ID NO: 136238 - DNA, 25 bp, Mus musculus
tccaggaggcaacaagacacagtat

SEQ ID NO: 136239 - DNA, 25 bp, Mus musculus
tccaggaggccgtcaaggaaaacaa

SEQ ID NO: 136240 - DNA, 25 bp, Mus musculus
tccaggaggcctatggcaagtgcaa

SEQ ID NO: 136241 - DNA, 25 bp, Mus musculus
tccaggagtaccgagagttcgtgcc

SEQ ID NO: 136242 - DNA, 25 bp, Mus musculus
tccaggagtcaggaggcaagctaac

SEQ ID NO: 136243 - DNA, 25 bp, Mus musculus
tccaggagtgataccagctttagtc

SEQ ID NO: 136244 - DNA, 25 bp, Mus musculus
tccaggagttgaaggacatggctac

SEQ ID NO: 136245 - DNA, 25 bp, Mus musculus
tccaggatagtgaaaacagaacccc

SEQ ID NO: 136246 - DNA, 25 bp, Mus musculus
tccaggatccaccattatgtgagac

SEQ ID NO: 136247 - DNA, 25 bp, Mus musculus
tccaggatcccgttgtagttgttgc

SEQ ID NO: 136248 - DNA, 25 bp, Mus musculus
tccaggatgacgaactaagcctccg

SEQ ID NO: 136249 - DNA, 25 bp, Mus musculus
tccaggatgacgatgcgaagcagct

SEQ ID NO: 136250 - DNA, 25 bp, Mus musculus
tccaggatgactatgacccgtacgc

SEQ ID NO: 136251 - DNA, 25 bp, Mus musculus
tccaggatgaggtccggcaggccaa

SEQ ID NO: 136252 - DNA, 25 bp, Mus musculus
tccaggatggccgacagtttctgaa

SEQ ID NO: 136253 - DNA, 25 bp, Mus musculus
tccaggatgtccgtggcagagacta

SEQ ID NO: 136254 - DNA, 25 bp, Mus musculus
tccaggattgcttcaatgaggaacc

SEQ ID NO: 136255 - DNA, 25 bp, Mus musculus
tccaggcaatgggaaagacctcctt

SEQ ID NO: 136256 - DNA, 25 bp, Mus musculus
tccaggcactacagctcacaggttg

SEQ ID NO: 136257 - DNA, 25 bp, Mus musculus
tccaggcactgcagatggaggcgtg

SEQ ID NO: 136258 - DNA, 25 bp, Mus musculus
tccaggcactggaagctgtcaagcg

SEQ ID NO: 136259 - DNA, 25 bp, Mus musculus
tccaggcaggcagccacattatggg

SEQ ID NO: 136260 - DNA, 25 bp, Mus musculus
tccaggccactggaaatatctgagc

SEQ ID NO: 136261 - DNA, 25 bp, Mus musculus
tccaggcccaaagccaagtgagtgc

SEQ ID NO: 136262 - DNA, 25 bp, Mus musculus
tccaggcgaacgtgacttctataaa

SEQ ID NO: 136263 - DNA, 25 bp, Mus musculus
tccaggcggcagaggagaagttcac

SEQ ID NO: 136264 - DNA, 25 bp, Mus musculus
tccaggctgggaatatcatgaatgc

SEQ ID NO: 136265 - DNA, 25 bp, Mus musculus
tccaggctgggacaagtaaaccttt

SEQ ID NO: 136266 - DNA, 25 bp, Mus musculus
tccaggctgtggtcgaagtctgccg

SEQ ID NO: 136267 - DNA, 25 bp, Mus musculus
tccagggaaaagaattaccagacaa

SEQ ID NO: 136268 - DNA, 25 bp, Mus musculus
tccagggaaagataacaggtaaata

SEQ ID NO: 136269 - DNA, 25 bp, Mus musculus
tccagggaagttacagttgacacca

SEQ ID NO: 136270 - DNA, 25 bp, Mus musculus
tccagggaagttctgtggcgaccat

SEQ ID NO: 136271 - DNA, 25 bp, Mus musculus
tccagggaccaagtgtgagatcgca

SEQ ID NO: 136272 - DNA, 25 bp, Mus musculus
tccagggacctcaaggacgactttc

SEQ ID NO: 136273 - DNA, 25 bp, Mus musculus
tccagggacctcaggcttagcagaa

SEQ ID NO: 136274 - DNA, 25 bp, Mus musculus
tccagggactccaaaggctaatggc

SEQ ID NO: 136275 - DNA, 25 bp, Mus musculus
tccagggagcagaagacggaataaa

SEQ ID NO: 136276 - DNA, 25 bp, Mus musculus
tccagggagcttctgtcaagacgag

SEQ ID NO: 136277 - DNA, 25 bp, Mus musculus
tccagggaggttgtgacggtaccca

SEQ ID NO: 136278 - DNA, 25 bp, Mus musculus
tccagggagtcgaacataagcagca

SEQ ID NO: 136279 - DNA, 25 bp, Mus musculus
tccagggatcaaaatcgaagatacg

SEQ ID NO: 136280 - DNA, 25 bp, Mus musculus
tccagggatcaagtccagaggctcc

SEQ ID NO: 136281 - DNA, 25 bp, Mus musculus
tccagggatgaggagctgagaaccc

SEQ ID NO: 136282 - DNA, 25 bp, Mus musculus
tccagggcacaagcttgagggacag

SEQ ID NO: 136283 - DNA, 25 bp, Mus musculus
tccagggcagggaccacttgtgtcg

SEQ ID NO: 136284 - DNA, 25 bp, Mus musculus
tccagggccagaacaaggagatgct

SEQ ID NO: 136285 - DNA, 25 bp, Mus musculus
tccagggccgggaatgtagcctaca

SEQ ID NO: 136286 - DNA, 25 bp, Mus musculus
tccagggctctgtcccagaagggaa

SEQ ID NO: 136287 - DNA, 25 bp, Mus musculus
tccagggctttcacgcgcaagtgtg

SEQ ID NO: 136288 - DNA, 25 bp, Mus musculus
tccagggtgagagctgtcttgtaca

SEQ ID NO: 136289 - DNA, 25 bp, Mus musculus
tccagggtgctcatcatcgggaaca

SEQ ID NO: 136290 - DNA, 25 bp, Mus musculus
tccagggtggctacgaaaacgtgcc

SEQ ID NO: 136291 - DNA, 25 bp, Mus musculus
tccagggtggctctatcgacctgca

SEQ ID NO: 136292 - DNA, 25 bp, Mus musculus
tccagggtgtcagcaggatcctagc

SEQ ID NO: 136293 - DNA, 25 bp, Mus musculus
tccagggttagctcaccaggagact

SEQ ID NO: 136294 - DNA, 25 bp, Mus musculus
tccaggtaccaaaagtgagaggtca

SEQ ID NO: 136295 - DNA, 25 bp, Mus musculus
tccaggtacctcgtgagaccacaga

SEQ ID NO: 136296 - DNA, 25 bp, Mus musculus
tccaggtcagcaatgtggactacag

SEQ ID NO: 136297 - DNA, 25 bp, Mus musculus
tccaggtcagcgcactagctgtgcc

SEQ ID NO: 136298 - DNA, 25 bp, Mus musculus
tccaggtccaattaacttcaccgtg

SEQ ID NO: 136299 - DNA, 25 bp, Mus musculus
tccaggtccaccaaacagaagtcgg

SEQ ID NO: 136300 - DNA, 25 bp, Mus musculus
tccaggtccatcaacagaagggcag

SEQ ID NO: 136301 - DNA, 25 bp, Mus musculus
tccaggtgaaaacaggctagaggct

SEQ ID NO: 136302 - DNA, 25 bp, Mus musculus
tccaggtgatcttgcgccaggaaga

SEQ ID NO: 136303 - DNA, 25 bp, Mus musculus
tccaggtgcagagaagtgtaacaga

SEQ ID NO: 136304 - DNA, 25 bp, Mus musculus
tccaggtggaaaaggacggcagtcc

SEQ ID NO: 136305 - DNA, 25 bp, Mus musculus
tccaggtgtcagagcgagaactgcc

SEQ ID NO: 136306 - DNA, 25 bp, Mus musculus
tccaggtgttcctgaaacagatcaa

SEQ ID NO: 136307 - DNA, 25 bp, Mus musculus
tccaggttaaaaataatgtgggcca

SEQ ID NO: 136308 - DNA, 25 bp, Mus musculus
tccaggttcccgagacattttcagt

SEQ ID NO: 136309 - DNA, 25 bp, Mus musculus
tccaggttggatcaaggagagccat

SEQ ID NO: 136310 - DNA, 25 bp, Mus musculus
tccaggttgtagcagagatcccaga

SEQ ID NO: 136311 - DNA, 25 bp, Mus musculus
tccaggtttactcatctcagaggaa

SEQ ID NO: 136312 - DNA, 25 bp, Mus musculus
tccagtaattcaaaggacagccctg

SEQ ID NO: 136313 - DNA, 25 bp, Mus musculus
tccagtaccgtagaagccgttcagg

SEQ ID NO: 136314 - DNA, 25 bp, Mus musculus
tccagtagataagaggcagagccca

SEQ ID NO: 136315 - DNA, 25 bp, Mus musculus
tccagtagcggttgcattctcttgc

SEQ ID NO: 136316 - DNA, 25 bp, Mus musculus
tccagtatatagatgccgttccagc

SEQ ID NO: 136317 - DNA, 25 bp, Mus musculus
tccagtatcgggacttccagagggc

SEQ ID NO: 136318 - DNA, 25 bp, Mus musculus
tccagtatgagatggcctgacctgc

SEQ ID NO: 136319 - DNA, 25 bp, Mus musculus
tccagtatgagtgcacgagtgtcct

SEQ ID NO: 136320 - DNA, 25 bp, Mus musculus
tccagtatgccaatgagcgccatgc

SEQ ID NO: 136321 - DNA, 25 bp, Mus musculus
tccagtatggacaatctagacagct

SEQ ID NO: 136322 - DNA, 25 bp, Mus musculus
tccagtattccaggaggaagggctt

SEQ ID NO: 136323 - DNA, 25 bp, Mus musculus
tccagtatttcagtgacccgaggct

SEQ ID NO: 136324 - DNA, 25 bp, Mus musculus
tccagtcaggagaccgggagatagc

SEQ ID NO: 136325 - DNA, 25 bp, Mus musculus
tccagtcagtgagtagaggacttgg

SEQ ID NO: 136326 - DNA, 25 bp, Mus musculus
tccagtccaagggaagaggagatcc

SEQ ID NO: 136327 - DNA, 25 bp, Mus musculus
tccagtccacgctgtgaggaagaca

SEQ ID NO: 136328 - DNA, 25 bp, Mus musculus
tccagtccggcagtcagtaagatca

SEQ ID NO: 136329 - DNA, 25 bp, Mus musculus
tccagtccgtgtttgatatgctccg

SEQ ID NO: 136330 - DNA, 25 bp, Mus musculus
tccagtcctgacgaggagacggtgc

SEQ ID NO: 136331 - DNA, 25 bp, Mus musculus
tccagtctcgaggagctgaggagca

SEQ ID NO: 136332 - DNA, 25 bp, Mus musculus
tccagtcttcagctcggccatggct

SEQ ID NO: 136333 - DNA, 25 bp, Mus musculus
tccagtgaagagtcgggagattcgc

SEQ ID NO: 136334 - DNA, 25 bp, Mus musculus
tccagtgaatacctcaaaagcccga

SEQ ID NO: 136335 - DNA, 25 bp, Mus musculus
tccagtgacatgatccagagaggca

SEQ ID NO: 136336 - DNA, 25 bp, Mus musculus
tccagtgagggagagcttgcgaaac

SEQ ID NO: 136337 - DNA, 25 bp, Mus musculus
tccagtgcccgctttgtgtacgagg

SEQ ID NO: 136338 - DNA, 25 bp, Mus musculus
tccagtgccgaatggccactcactt

SEQ ID NO: 136339 - DNA, 25 bp, Mus musculus
tccagtggaaagcattacggcgtgt

SEQ ID NO: 136340 - DNA, 25 bp, Mus musculus
tccagtggacttagggacagagcac

SEQ ID NO: 136341 - DNA, 25 bp, Mus musculus
tccagtggagagctcatgttcctga

SEQ ID NO: 136342 - DNA, 25 bp, Mus musculus
tccagtggatccaaggagccagttc

SEQ ID NO: 136343 - DNA, 25 bp, Mus musculus
tccagtggcagtcaaccttgggaca

SEQ ID NO: 136344 - DNA, 25 bp, Mus musculus
tccagtggccagctgacttgagacg

SEQ ID NO: 136345 - DNA, 25 bp, Mus musculus
tccagtggctcaggtcgatcatggg

SEQ ID NO: 136346 - DNA, 25 bp, Mus musculus
tccagtggctcttccgacagtttcg

SEQ ID NO: 136347 - DNA, 25 bp, Mus musculus
tccagtgggcccctgtagactcaag

SEQ ID NO: 136348 - DNA, 25 bp, Mus musculus
tccagtggtaagtctttaataccag

SEQ ID NO: 136349 - DNA, 25 bp, Mus musculus
tccagtggtcaggatgctcggacaa

SEQ ID NO: 136350 - DNA, 25 bp, Mus musculus
tccagtgtcctttctgcggaacgcc

SEQ ID NO: 136351 - DNA, 25 bp, Mus musculus
tccagtgtggagaggtatcacccgc

SEQ ID NO: 136352 - DNA, 25 bp, Mus musculus
tccagtgtgttctgaagcgtgtaca

SEQ ID NO: 136353 - DNA, 25 bp, Mus musculus
tccagtgtttttgcgttgcattcca

SEQ ID NO: 136354 - DNA, 25 bp, Mus musculus
tccagttaccgaagtcagttacagc

SEQ ID NO: 136355 - DNA, 25 bp, Mus musculus
tccagttatctgtcgggcttgcctc

SEQ ID NO: 136356 - DNA, 25 bp, Mus musculus
tccagttcgaggacaccctggaagg

SEQ ID NO: 136357 - DNA, 25 bp, Mus musculus
tccagttctatagggaggaggctcc

SEQ ID NO: 136358 - DNA, 25 bp, Mus musculus
tccagttctgggactctgagctcgc

SEQ ID NO: 136359 - DNA, 25 bp, Mus musculus
tccagttgactccatccaggcagaa

SEQ ID NO: 136360 - DNA, 25 bp, Mus musculus
tccagttgagcaggacactagggcg

SEQ ID NO: 136361 - DNA, 25 bp, Mus musculus
tccagttgcagagaaggaaggcctg

SEQ ID NO: 136362 - DNA, 25 bp, Mus musculus
tccagttgcagagggaatgctatct

SEQ ID NO: 136363 - DNA, 25 bp, Mus musculus
tccagttggcaacggttacatcaaa

SEQ ID NO: 136364 - DNA, 25 bp, Mus musculus
tccagttgtagaaggcctgacagag

SEQ ID NO: 136365 - DNA, 25 bp, Mus musculus
tccagttgtagaggaagctccgccc

SEQ ID NO: 136366 - DNA, 25 bp, Mus musculus
tccagttgtgatggctgcaaaggct

SEQ ID NO: 136367 - DNA, 25 bp, Mus musculus
tccagtttgaggacgattcccagtt

SEQ ID NO: 136368 - DNA, 25 bp, Mus musculus
tccataacatgaaggtcctccctgg

SEQ ID NO: 136369 - DNA, 25 bp, Mus musculus
tccataacgcccaatgagaagcagc

SEQ ID NO: 136370 - DNA, 25 bp, Mus musculus
tccataactacgtgggagacgacag

SEQ ID NO: 136371 - DNA, 25 bp, Mus musculus
tccatacagacgttggtcggcggcg

SEQ ID NO: 136372 - DNA, 25 bp, Mus musculus
tccatacagcatccagtaagaagtt

SEQ ID NO: 136373 - DNA, 25 bp, Mus musculus
tccatacagggctgctaatgcagcc

SEQ ID NO: 136374 - DNA, 25 bp, Mus musculus
tccatactacactgcttgggaaggg

SEQ ID NO: 136375 - DNA, 25 bp, Mus musculus
tccatactattgactgggtgcgaga

SEQ ID NO: 136376 - DNA, 25 bp, Mus musculus
tccataggagttgcaggccgttccc

SEQ ID NO: 136377 - DNA, 25 bp, Mus musculus
tccataggccccaagaaagtgctgt

SEQ ID NO: 136378 - DNA, 25 bp, Mus musculus
tccatagtaactggcagagggccgc

SEQ ID NO: 136379 - DNA, 25 bp, Mus musculus
tccatagtctgctgtagtgaacaca

SEQ ID NO: 136380 - DNA, 25 bp, Mus musculus
tccatagtgcagtgctcagggcgac

SEQ ID NO: 136381 - DNA, 25 bp, Mus musculus
tccatagtggcctttctgaaagacc

SEQ ID NO: 136382 - DNA, 25 bp, Mus musculus
tccatataggactgaggacatccag

SEQ ID NO: 136383 - DNA, 25 bp, Mus musculus
tccatatcactactgggagccagga

SEQ ID NO: 136384 - DNA, 25 bp, Mus musculus
tccatatgattacaaagcagaagct

SEQ ID NO: 136385 - DNA, 25 bp, Mus musculus
tccatatgattgtgaacagctaaac

SEQ ID NO: 136386 - DNA, 25 bp, Mus musculus
tccatatgtagatgcaataaagagc

SEQ ID NO: 136387 - DNA, 25 bp, Mus musculus
tccatattgtggaagaagaaagtat

SEQ ID NO: 136388 - DNA, 25 bp, Mus musculus
tccatatttgcgattggtggcctgg

SEQ ID NO: 136389 - DNA, 25 bp, Mus musculus
tccatattttatcactgctgtgatc

SEQ ID NO: 136390 - DNA, 25 bp, Mus musculus
tccatcaagaaacggagatccccag

SEQ ID NO: 136391 - DNA, 25 bp, Mus musculus
tccatcaagacctgggatgtatccg

SEQ ID NO: 136392 - DNA, 25 bp, Mus musculus
tccatcaaggccatgcggatcctgg

SEQ ID NO: 136393 - DNA, 25 bp, Mus musculus
tccatcagcagtacggccgaaagtg

SEQ ID NO: 136394 - DNA, 25 bp, Mus musculus
tccatcaggaaaactgtcaagagct

SEQ ID NO: 136395 - DNA, 25 bp, Mus musculus
tccatcagtagagggaaccgacttg

SEQ ID NO: 136396 - DNA, 25 bp, Mus musculus
tccatcatcatgctgagcccgggag

SEQ ID NO: 136397 - DNA, 25 bp, Mus musculus
tccatcattaaacgccggatccgca

SEQ ID NO: 136398 - DNA, 25 bp, Mus musculus
tccatccaagctgggcctacgtgga

SEQ ID NO: 136399 - DNA, 25 bp, Mus musculus
tccatccactactgggtgtgaaggg

SEQ ID NO: 136400 - DNA, 25 bp, Mus musculus
tccatccagaaaacctatgacctca

SEQ ID NO: 136401 - DNA, 25 bp, Mus musculus
tccatccagatagagggtagcatag

SEQ ID NO: 136402 - DNA, 25 bp, Mus musculus
tccatccagccaagagagcaaatcg

SEQ ID NO: 136403 - DNA, 25 bp, Mus musculus
tccatccatagccaagagccgaagg

SEQ ID NO: 136404 - DNA, 25 bp, Mus musculus
tccatccgacagattaggcagcaca

SEQ ID NO: 136405 - DNA, 25 bp, Mus musculus
tccatccgagaagcctgaggttgag

SEQ ID NO: 136406 - DNA, 25 bp, Mus musculus
tccatccgtgatatgtggtacaagc

SEQ ID NO: 136407 - DNA, 25 bp, Mus musculus
tccatcctcaaggtcgctgtgaaga

SEQ ID NO: 136408 - DNA, 25 bp, Mus musculus
tccatcctgatgctagcagacagcg

SEQ ID NO: 136409 - DNA, 25 bp, Mus musculus
tccatccttgccaaaaagggcgtcc

SEQ ID NO: 136410 - DNA, 25 bp, Mus musculus
tccatcgcagagaagaaggtcctgg

SEQ ID NO: 136411 - DNA, 25 bp, Mus musculus
tccatcgctgccaagtactcgggct

SEQ ID NO: 136412 - DNA, 25 bp, Mus musculus
tccatcgctgtctactatgacaacc

SEQ ID NO: 136413 - DNA, 25 bp, Mus musculus
tccatcggtgaggagagctctggaa

SEQ ID NO: 136414 - DNA, 25 bp, Mus musculus
tccatcgtgggaaagggcaaacctt

SEQ ID NO: 136415 - DNA, 25 bp, Mus musculus
tccatcgtggtcttcggctctatcg

SEQ ID NO: 136416 - DNA, 25 bp, Mus musculus
tccatctactgaaaaggcggctcag

SEQ ID NO: 136417 - DNA, 25 bp, Mus musculus
tccatctcaagaaggagcgggcggc

SEQ ID NO: 136418 - DNA, 25 bp, Mus musculus
tccatctccacaacagacagaggca

SEQ ID NO: 136419 - DNA, 25 bp, Mus musculus
tccatctggaggtgggagaccaagt

SEQ ID NO: 136420 - DNA, 25 bp, Mus musculus
tccatctgggcgagtgcaggtccat

SEQ ID NO: 136421 - DNA, 25 bp, Mus musculus
tccatcttggccagagcgtaggaag

SEQ ID NO: 136422 - DNA, 25 bp, Mus musculus
tccatcttggctttgcacctgagag

SEQ ID NO: 136423 - DNA, 25 bp, Mus musculus
tccatctttgtaccccactggtgtg

SEQ ID NO: 136424 - DNA, 25 bp, Mus musculus
tccatcttttgagcagcgggtacaa

SEQ ID NO: 136425 - DNA, 25 bp, Mus musculus
tccatgaagagatgctgagcctgaa

SEQ ID NO: 136426 - DNA, 25 bp, Mus musculus
tccatgaagccagagaggagtgttc

SEQ ID NO: 136427 - DNA, 25 bp, Mus musculus
tccatgacagcgtggtgggcaagct

SEQ ID NO: 136428 - DNA, 25 bp, Mus musculus
tccatgacatgaacgaccgcaaacg

SEQ ID NO: 136429 - DNA, 25 bp, Mus musculus
tccatgacgacgtgctcggcgtata

SEQ ID NO: 136430 - DNA, 25 bp, Mus musculus
tccatgagaaaaaacttggcgacaa

SEQ ID NO: 136431 - DNA, 25 bp, Mus musculus
tccatgagaaagaagccagatctgg

SEQ ID NO: 136432 - DNA, 25 bp, Mus musculus
tccatgagacactaggttcgggccg

SEQ ID NO: 136433 - DNA, 25 bp, Mus musculus
tccatgagcgctacctgaggagggc

SEQ ID NO: 136434 - DNA, 25 bp, Mus musculus
tccatgagctgcgactggaagtctc

SEQ ID NO: 136435 - DNA, 25 bp, Mus musculus
tccatgaggatgcaagctgagctcc

SEQ ID NO: 136436 - DNA, 25 bp, Mus musculus
tccatgagtgtgagctgcagagtca

SEQ ID NO: 136437 - DNA, 25 bp, Mus musculus
tccatgatcggagatgcccatctga

SEQ ID NO: 136438 - DNA, 25 bp, Mus musculus
tccatgatggtgtggtccccagtgc

SEQ ID NO: 136439 - DNA, 25 bp, Mus musculus
tccatgatgttgctgtgctgacaga

SEQ ID NO: 136440 - DNA, 25 bp, Mus musculus
tccatgcactagagagtaaagttcc

SEQ ID NO: 136441 - DNA, 25 bp, Mus musculus
tccatgcaggcgaagatcactgagc

SEQ ID NO: 136442 - DNA, 25 bp, Mus musculus
tccatgcctgtcacattaaacccag

SEQ ID NO: 136443 - DNA, 25 bp, Mus musculus
tccatgctgaagtgggaaaccaggc

SEQ ID NO: 136444 - DNA, 25 bp, Mus musculus
tccatgctgctcactagaaaagaag

SEQ ID NO: 136445 - DNA, 25 bp, Mus musculus
tccatgctgggcagaatccaggcgc

SEQ ID NO: 136446 - DNA, 25 bp, Mus musculus
tccatgctgtacagtggctccgacg

SEQ ID NO: 136447 - DNA, 25 bp, Mus musculus
tccatggaaaggagacctaggccca

SEQ ID NO: 136448 - DNA, 25 bp, Mus musculus
tccatggaacagttgggtcgccctc

SEQ ID NO: 136449 - DNA, 25 bp, Mus musculus
tccatggacaactcgatatggctcc

SEQ ID NO: 136450 - DNA, 25 bp, Mus musculus
tccatggacctcctgagcagcaagt

SEQ ID NO: 136451 - DNA, 25 bp, Mus musculus
tccatggacgaagtgcagagtcaca

SEQ ID NO: 136452 - DNA, 25 bp, Mus musculus
tccatggacggtgcggacaagcagt

SEQ ID NO: 136453 - DNA, 25 bp, Mus musculus
tccatggagagaatgccaggtgcca

SEQ ID NO: 136454 - DNA, 25 bp, Mus musculus
tccatggcaaccacataacaatcag

SEQ ID NO: 136455 - DNA, 25 bp, Mus musculus
tccatggcatgttagagcgggcacc

SEQ ID NO: 136456 - DNA, 25 bp, Mus musculus
tccatggccccaggaaagattcagg

SEQ ID NO: 136457 - DNA, 25 bp, Mus musculus
tccatggcggcttcgattctgactg

SEQ ID NO: 136458 - DNA, 25 bp, Mus musculus
tccatgggaacctgacctgtgacac

SEQ ID NO: 136459 - DNA, 25 bp, Mus musculus
tccatgggaagatttgcgagacaac

SEQ ID NO: 136460 - DNA, 25 bp, Mus musculus
tccatgggcagtatctccagacagg

SEQ ID NO: 136461 - DNA, 25 bp, Mus musculus
tccatgggctgctagactcttgcgg

SEQ ID NO: 136462 - DNA, 25 bp, Mus musculus
tccatgggtgacaaggaggccttcc

SEQ ID NO: 136463 - DNA, 25 bp, Mus musculus
tccatggtacctggtgggaattctt

SEQ ID NO: 136464 - DNA, 25 bp, Mus musculus
tccatggtagcggaactggccctgt

SEQ ID NO: 136465 - DNA, 25 bp, Mus musculus
tccatggtgagactgagtacggcaa

SEQ ID NO: 136466 - DNA, 25 bp, Mus musculus
tccatggtggaaaggaagcaaggcc

SEQ ID NO: 136467 - DNA, 25 bp, Mus musculus
tccatggttgtaaataaaggtttct

SEQ ID NO: 136468 - DNA, 25 bp, Mus musculus
tccatgtccccgttatgagcagctg

SEQ ID NO: 136469 - DNA, 25 bp, Mus musculus
tccatgtggacaggcaagagctcag

SEQ ID NO: 136470 - DNA, 25 bp, Mus musculus
tccatgtggcagtgcgcatgggcca

SEQ ID NO: 136471 - DNA, 25 bp, Mus musculus
tccatgtgtgaattgatggctgccc

SEQ ID NO: 136472 - DNA, 25 bp, Mus musculus
tccatgttacgggagcagatccttg

SEQ ID NO: 136473 - DNA, 25 bp, Mus musculus
tccatgttaggagagattacccacc

SEQ ID NO: 136474 - DNA, 25 bp, Mus musculus
tccatgttgagaaacacagcgctgt

SEQ ID NO: 136475 - DNA, 25 bp, Mus musculus
tccattacaaaccacgcccttggag

SEQ ID NO: 136476 - DNA, 25 bp, Mus musculus
tccattacaacaagctgcaggcgga

SEQ ID NO: 136477 - DNA, 25 bp, Mus musculus
tccattacctgtggcgcggagagtt

SEQ ID NO: 136478 - DNA, 25 bp, Mus musculus
tccattagatggagatgaccctgaa

SEQ ID NO: 136479 - DNA, 25 bp, Mus musculus
tccattctggttcagcctgggcagc

SEQ ID NO: 136480 - DNA, 25 bp, Mus musculus
tccattcttccatcagctacctcgg

SEQ ID NO: 136481 - DNA, 25 bp, Mus musculus
tccattgacgattgagggctttgca

SEQ ID NO: 136482 - DNA, 25 bp, Mus musculus
tccattgagtctggcagcattgagt

SEQ ID NO: 136483 - DNA, 25 bp, Mus musculus
tccattgagttctacgaaggcgtca

SEQ ID NO: 136484 - DNA, 25 bp, Mus musculus
tccattgcttctccatcaacggagg

SEQ ID NO: 136485 - DNA, 25 bp, Mus musculus
tccattggaatcgttggtaaagact

SEQ ID NO: 136486 - DNA, 25 bp, Mus musculus
tccattgggatgctcatgctgtccg

SEQ ID NO: 136487 - DNA, 25 bp, Mus musculus
tccattgggcagctttccacaaccg

SEQ ID NO: 136488 - DNA, 25 bp, Mus musculus
tccattggttgattacgtattcagc

SEQ ID NO: 136489 - DNA, 25 bp, Mus musculus
tccattgtgatgagctgcgcctgac

SEQ ID NO: 136490 - DNA, 25 bp, Mus musculus
tccattgtgcattaggtgtgagccc

SEQ ID NO: 136491 - DNA, 25 bp, Mus musculus
tccattgtgtctggcgagagcatcc

SEQ ID NO: 136492 - DNA, 25 bp, Mus musculus
tccatttaatgacagggcctaggca

SEQ ID NO: 136493 - DNA, 25 bp, Mus musculus
tccatttgatgaacctgatgtaaca

SEQ ID NO: 136494 - DNA, 25 bp, Mus musculus
tccatttgatgtaaccgaggagagt

SEQ ID NO: 136495 - DNA, 25 bp, Mus musculus
tccattttgtgcacagctcggccga

SEQ ID NO: 136496 - DNA, 25 bp, Mus musculus
tcccaaaaccgatgatcagagaaac

SEQ ID NO: 136497 - DNA, 25 bp, Mus musculus
tcccaaagggttcgatacgactgcc

SEQ ID NO: 136498 - DNA, 25 bp, Mus musculus
tcccaaagtggctgagatctatgag

SEQ ID NO: 136499 - DNA, 25 bp, Mus musculus
tcccaaatgacgaggacgaaccagg

SEQ ID NO: 136500 - DNA, 25 bp, Mus musculus
tcccaacaggaaaagagtgccagtg

SEQ ID NO: 136501 - DNA, 25 bp, Mus musculus
tcccaacaggtcaagtggtccatgc

SEQ ID NO: 136502 - DNA, 25 bp, Mus musculus
tcccaacagttggaggacgcgtacg

SEQ ID NO: 136503 - DNA, 25 bp, Mus musculus
tcccaacatgaccagtaacaggcgg

SEQ ID NO: 136504 - DNA, 25 bp, Mus musculus
tcccaacgctgctagtagtctttgt

SEQ ID NO: 136505 - DNA, 25 bp, Mus musculus
tcccaacggtatgagaaactagaca

SEQ ID NO: 136506 - DNA, 25 bp, Mus musculus
tcccaacttcaatagtcaggactcc

SEQ ID NO: 136507 - DNA, 25 bp, Mus musculus
tcccaagaacaagcagacgcgtagc

SEQ ID NO: 136508 - DNA, 25 bp, Mus musculus
tcccaagagccaaatgtcagacaca

SEQ ID NO: 136509 - DNA, 25 bp, Mus musculus
tcccaagagggaaatagacaaagct

SEQ ID NO: 136510 - DNA, 25 bp, Mus musculus
tcccaagaggtttcagctgactgag

SEQ ID NO: 136511 - DNA, 25 bp, Mus musculus
tcccaagagtccaggtggcgcagat

SEQ ID NO: 136512 - DNA, 25 bp, Mus musculus
tcccaaggacctgccgatgttcagt

SEQ ID NO: 136513 - DNA, 25 bp, Mus musculus
tcccaaggagtaaaaggatggacac

SEQ ID NO: 136514 - DNA, 25 bp, Mus musculus
tcccaaggtggctgcaagaagagaa

SEQ ID NO: 136515 - DNA, 25 bp, Mus musculus
tcccaaggttttggaggctctacga

SEQ ID NO: 136516 - DNA, 25 bp, Mus musculus
tcccaatctgtctgtgaggcccaag

SEQ ID NO: 136517 - DNA, 25 bp, Mus musculus
tcccaatgatggcagtctgtacaca

SEQ ID NO: 136518 - DNA, 25 bp, Mus musculus
tcccaatggcgtggtgctgcagcta

SEQ ID NO: 136519 - DNA, 25 bp, Mus musculus
tcccaatgggctactggtctaccag

SEQ ID NO: 136520 - DNA, 25 bp, Mus musculus
tcccaatggtgctagaacggtgctg

SEQ ID NO: 136521 - DNA, 25 bp, Mus musculus
tcccacaaagagagtgaagaggctc

SEQ ID NO: 136522 - DNA, 25 bp, Mus musculus
tcccacaagtggagctggaatcccc

SEQ ID NO: 136523 - DNA, 25 bp, Mus musculus
tcccacattaggagatgcacgtgtt

SEQ ID NO: 136524 - DNA, 25 bp, Mus musculus
tcccaccaagaggatgagcaggttc

SEQ ID NO: 136525 - DNA, 25 bp, Mus musculus
tcccaccagagcccggaacatgaag

SEQ ID NO: 136526 - DNA, 25 bp, Mus musculus
tcccacctgagcgaagccagagtga

SEQ ID NO: 136527 - DNA, 25 bp, Mus musculus
tcccacctgctcgctcccatgacca

SEQ ID NO: 136528 - DNA, 25 bp, Mus musculus
tcccacggactggtcgggctaggaa

SEQ ID NO: 136529 - DNA, 25 bp, Mus musculus
tcccacgggcgaagtgaataccatg

SEQ ID NO: 136530 - DNA, 25 bp, Mus musculus
tcccactgctcatcctaatctgttt

SEQ ID NO: 136531 - DNA, 25 bp, Mus musculus
tcccactgctcatttgacctttaac

SEQ ID NO: 136532 - DNA, 25 bp, Mus musculus
tcccactggagtgctgtacgaaaag

SEQ ID NO: 136533 - DNA, 25 bp, Mus musculus
tcccactggcccctgaaaacaataa

SEQ ID NO: 136534 - DNA, 25 bp, Mus musculus
tcccactgggctttgatctcagagt

SEQ ID NO: 136535 - DNA, 25 bp, Mus musculus
tcccacttcatcgaggagcagcagg

SEQ ID NO: 136536 - DNA, 25 bp, Mus musculus
tcccacttggacttttgcaatcaga

SEQ ID NO: 136537 - DNA, 25 bp, Mus musculus
tcccacttggatgagagtcctgcct

SEQ ID NO: 136538 - DNA, 25 bp, Mus musculus
tcccagaaagtacaggagagcgaga

SEQ ID NO: 136539 - DNA, 25 bp, Mus musculus
tcccagaaagtggtgaaagaaccct

SEQ ID NO: 136540 - DNA, 25 bp, Mus musculus
tcccagaacttctgaagagctattc

SEQ ID NO: 136541 - DNA, 25 bp, Mus musculus
tcccagaagacgatgagcccctcaa

SEQ ID NO: 136542 - DNA, 25 bp, Mus musculus
tcccagaagccactctccagtatag

SEQ ID NO: 136543 - DNA, 25 bp, Mus musculus
tcccagaaggatccttgagagtgtc

SEQ ID NO: 136544 - DNA, 25 bp, Mus musculus
tcccagaatccgtgtacaagagctt

SEQ ID NO: 136545 - DNA, 25 bp, Mus musculus
tcccagacaacggaagaaggtcctg

SEQ ID NO: 136546 - DNA, 25 bp, Mus musculus
tcccagacctagtccagaggcagtg

SEQ ID NO: 136547 - DNA, 25 bp, Mus musculus
tcccagacctggagagaccactgtt

SEQ ID NO: 136548 - DNA, 25 bp, Mus musculus
tcccagagaggaggctaaaaagccc

SEQ ID NO: 136549 - DNA, 25 bp, Mus musculus
tcccagagcagcacgactgtacgtt

SEQ ID NO: 136550 - DNA, 25 bp, Mus musculus
tcccagagcgagagaaatgtgagaa

SEQ ID NO: 136551 - DNA, 25 bp, Mus musculus
tcccagagggaaaagagactaagcg

SEQ ID NO: 136552 - DNA, 25 bp, Mus musculus
tcccagagtggaggccctgttgaag

SEQ ID NO: 136553 - DNA, 25 bp, Mus musculus
tcccagatacaggagctgaatgcca

SEQ ID NO: 136554 - DNA, 25 bp, Mus musculus
tcccagatgccaagaagagaggccg

SEQ ID NO: 136555 - DNA, 25 bp, Mus musculus
tcccagatgctgaagaaaatgcccc

SEQ ID NO: 136556 - DNA, 25 bp, Mus musculus
tcccagattggctgttggaatgctt

SEQ ID NO: 136557 - DNA, 25 bp, Mus musculus
tcccagcaaaggtgatccaagtcgc

SEQ ID NO: 136558 - DNA, 25 bp, Mus musculus
tcccagcaacccaacatggaatggc

SEQ ID NO: 136559 - DNA, 25 bp, Mus musculus
tcccagcaccagaatgtgaaccaag

SEQ ID NO: 136560 - DNA, 25 bp, Mus musculus
tcccagcagatgaagggaattcacc

SEQ ID NO: 136561 - DNA, 25 bp, Mus musculus
tcccagcagcggacaaatggaactt

SEQ ID NO: 136562 - DNA, 25 bp, Mus musculus
tcccagcatgggaggagtagtacct

SEQ ID NO: 136563 - DNA, 25 bp, Mus musculus
tcccagcccggggtaagacttacat

SEQ ID NO: 136564 - DNA, 25 bp, Mus musculus
tcccagccctgctagacgctgagga

SEQ ID NO: 136565 - DNA, 25 bp, Mus musculus
tcccagccggcagtttacaatgctg

SEQ ID NO: 136566 - DNA, 25 bp, Mus musculus
tcccagccgtgatgatgaatgcagg

SEQ ID NO: 136567 - DNA, 25 bp, Mus musculus
tcccagcgccagaaagagctcagtg

SEQ ID NO: 136568 - DNA, 25 bp, Mus musculus
tcccagcgctataaaaactttataa

SEQ ID NO: 136569 - DNA, 25 bp, Mus musculus
tcccagcgtcagatgatgatggcct

SEQ ID NO: 136570 - DNA, 25 bp, Mus musculus
tcccagctagggatttctgcagact

SEQ ID NO: 136571 - DNA, 25 bp, Mus musculus
tcccagctaggtaggcaaggctcag

SEQ ID NO: 136572 - DNA, 25 bp, Mus musculus
tcccagctcacctctcggaaggatg

SEQ ID NO: 136573 - DNA, 25 bp, Mus musculus
tcccagctctgacgaacacagagag

SEQ ID NO: 136574 - DNA, 25 bp, Mus musculus
tcccagctggaaccggcttgaaacg

SEQ ID NO: 136575 - DNA, 25 bp, Mus musculus
tcccagctgtaagataatgaccttc

SEQ ID NO: 136576 - DNA, 25 bp, Mus musculus
tcccagctgtaccaagaatgcgtcc

SEQ ID NO: 136577 - DNA, 25 bp, Mus musculus
tcccagctgtgagggcttcaggcag

SEQ ID NO: 136578 - DNA, 25 bp, Mus musculus
tcccagcttagaggattccaaagag

SEQ ID NO: 136579 - DNA, 25 bp, Mus musculus
tcccaggaacctttaagaatgaagt

SEQ ID NO: 136580 - DNA, 25 bp, Mus musculus
tcccaggaagatgaatctggaatta

SEQ ID NO: 136581 - DNA, 25 bp, Mus musculus
tcccaggaatagcatgggcccagcc

SEQ ID NO: 136582 - DNA, 25 bp, Mus musculus
tcccaggaatataatacatgccagg

SEQ ID NO: 136583 - DNA, 25 bp, Mus musculus
tcccaggacagaggagcatcacatg

SEQ ID NO: 136584 - DNA, 25 bp, Mus musculus
tcccaggagccagtcaaggttgtct

SEQ ID NO: 136585 - DNA, 25 bp, Mus musculus
tcccaggcatctgagaatggaagcc

SEQ ID NO: 136586 - DNA, 25 bp, Mus musculus
tcccaggccataggacagtggtacc

SEQ ID NO: 136587 - DNA, 25 bp, Mus musculus
tcccaggcccaatacttcaaagcat

SEQ ID NO: 136588 - DNA, 25 bp, Mus musculus
tcccaggcccacttgagtagcaaag

SEQ ID NO: 136589 - DNA, 25 bp, Mus musculus
tcccaggccggaaaaagcaatttga

SEQ ID NO: 136590 - DNA, 25 bp, Mus musculus
tcccaggcttacatggacctcctag

SEQ ID NO: 136591 - DNA, 25 bp, Mus musculus
tcccagggaacagcaccgtagtgat

SEQ ID NO: 136592 - DNA, 25 bp, Mus musculus
tcccagggaactatgtggagcccag

SEQ ID NO: 136593 - DNA, 25 bp, Mus musculus
tcccagggaggcctgcaaacagtta

SEQ ID NO: 136594 - DNA, 25 bp, Mus musculus
tcccagggatcacaggcagacatgg

SEQ ID NO: 136595 - DNA, 25 bp, Mus musculus
tcccagggcctgattttccgcggct

SEQ ID NO: 136596 - DNA, 25 bp, Mus musculus
tcccagggtcgctgtgagaacacag

SEQ ID NO: 136597 - DNA, 25 bp, Mus musculus
tcccagggtctgctatatgataggc

SEQ ID NO: 136598 - DNA, 25 bp, Mus musculus
tcccaggtaaatcaccacggtgctg

SEQ ID NO: 136599 - DNA, 25 bp, Mus musculus
tcccaggtcctccttgggcaggaat

SEQ ID NO: 136600 - DNA, 25 bp, Mus musculus
tcccaggtcgggatggattcaaagg

SEQ ID NO: 136601 - DNA, 25 bp, Mus musculus
tcccagtcatgtgctcagttcacag

SEQ ID NO: 136602 - DNA, 25 bp, Mus musculus
tcccagtccacgatgatgagtcagg

SEQ ID NO: 136603 - DNA, 25 bp, Mus musculus
tcccagtcctggagtcatctttagg

SEQ ID NO: 136604 - DNA, 25 bp, Mus musculus
tcccagtgatcgagtctgtgaatcc

SEQ ID NO: 136605 - DNA, 25 bp, Mus musculus
tcccagtggactttctacagctatg

SEQ ID NO: 136606 - DNA, 25 bp, Mus musculus
tcccagtgggttgctaacagatgaa

SEQ ID NO: 136607 - DNA, 25 bp, Mus musculus
tcccagtgtacgaggaggagcgctc

SEQ ID NO: 136608 - DNA, 25 bp, Mus musculus
tcccagtgtgcaagaatagccccag

SEQ ID NO: 136609 - DNA, 25 bp, Mus musculus
tcccagtgtttgtgatgatccgccc

SEQ ID NO: 136610 - DNA, 25 bp, Mus musculus
tcccagttccaagatgaatacagct

SEQ ID NO: 136611 - DNA, 25 bp, Mus musculus
tcccataaacgagatgcagtgcaga

SEQ ID NO: 136612 - DNA, 25 bp, Mus musculus
tcccatagagcaggctgcctgtagt

SEQ ID NO: 136613 - DNA, 25 bp, Mus musculus
tcccatagctggctagtcttatgtc

SEQ ID NO: 136614 - DNA, 25 bp, Mus musculus
tcccatatatagagaccagtgccaa

SEQ ID NO: 136615 - DNA, 25 bp, Mus musculus
tcccatatggtgaagtcggcggctg

SEQ ID NO: 136616 - DNA, 25 bp, Mus musculus
tcccatcctcatctgacactggtgt

SEQ ID NO: 136617 - DNA, 25 bp, Mus musculus
tcccatcgggatcaaggtgacactg

SEQ ID NO: 136618 - DNA, 25 bp, Mus musculus
tcccatctgctttgatatgattgag

SEQ ID NO: 136619 - DNA, 25 bp, Mus musculus
tcccatgaagaggagaacgggttgc

SEQ ID NO: 136620 - DNA, 25 bp, Mus musculus
tcccatgagaggtagacagcttcgg

SEQ ID NO: 136621 - DNA, 25 bp, Mus musculus
tcccatgagcgtgtaagcaagcgtc

SEQ ID NO: 136622 - DNA, 25 bp, Mus musculus
tcccatgcagtggaggacctacaag

SEQ ID NO: 136623 - DNA, 25 bp, Mus musculus
tcccatgccctctgaagatagctac

SEQ ID NO: 136624 - DNA, 25 bp, Mus musculus
tcccatgcggacaagacaagtatat

SEQ ID NO: 136625 - DNA, 25 bp, Mus musculus
tcccatggagagagaaacagtgctg

SEQ ID NO: 136626 - DNA, 25 bp, Mus musculus
tcccatgggcctactgaagaacaag

SEQ ID NO: 136627 - DNA, 25 bp, Mus musculus
tcccatgggttatgagagcagtgcc

SEQ ID NO: 136628 - DNA, 25 bp, Mus musculus
tcccatgggttggacaagaaaacag

SEQ ID NO: 136629 - DNA, 25 bp, Mus musculus
tcccatgtgagaggagactcccaag

SEQ ID NO: 136630 - DNA, 25 bp, Mus musculus
tcccattccgttccagactcggtta

SEQ ID NO: 136631 - DNA, 25 bp, Mus musculus
tcccattgaagactggagatcgaca

SEQ ID NO: 136632 - DNA, 25 bp, Mus musculus
tcccattgtggaaaacagcctgtgt

SEQ ID NO: 136633 - DNA, 25 bp, Mus musculus
tcccatttgacctgcaagagctgcc

SEQ ID NO: 136634 - DNA, 25 bp, Mus musculus
tcccatttgggatcggcgatattcc

SEQ ID NO: 136635 - DNA, 25 bp, Mus musculus
tccccaaacccttgctacaatgatg

SEQ ID NO: 136636 - DNA, 25 bp, Mus musculus
tccccaaaggctgtcgacgatgctg

SEQ ID NO: 136637 - DNA, 25 bp, Mus musculus
tccccaaatttgagcttaagccaca

SEQ ID NO: 136638 - DNA, 25 bp, Mus musculus
tccccaaggaaacgtatgctgactt

SEQ ID NO: 136639 - DNA, 25 bp, Mus musculus
tccccaagtagaaggcacatgtgcg

SEQ ID NO: 136640 - DNA, 25 bp, Mus musculus
tccccacaggagtgcaaatgcttgc

SEQ ID NO: 136641 - DNA, 25 bp, Mus musculus
tccccacctacccagttgatggtga

SEQ ID NO: 136642 - DNA, 25 bp, Mus musculus
tccccacgggattgacagcgactag

SEQ ID NO: 136643 - DNA, 25 bp, Mus musculus
tccccacgtgagtatcggaaacgtg

SEQ ID NO: 136644 - DNA, 25 bp, Mus musculus
tccccactgtggaggaatacttcag

SEQ ID NO: 136645 - DNA, 25 bp, Mus musculus
tccccagagaaaagtagtgcagaga

SEQ ID NO: 136646 - DNA, 25 bp, Mus musculus
tccccagagatctgtcagaacaggc

SEQ ID NO: 136647 - DNA, 25 bp, Mus musculus
tccccagcaggctgcgtgtcggtgc

SEQ ID NO: 136648 - DNA, 25 bp, Mus musculus
tccccagcggatgcaacagacaaat

SEQ ID NO: 136649 - DNA, 25 bp, Mus musculus
tccccaggaagcacgaaacatgttg

SEQ ID NO: 136650 - DNA, 25 bp, Mus musculus
tccccaggagagaacaacggtagag

SEQ ID NO: 136651 - DNA, 25 bp, Mus musculus
tccccaggagtgagacggaaacgag

SEQ ID NO: 136652 - DNA, 25 bp, Mus musculus
tccccaggattgagctacaagaata

SEQ ID NO: 136653 - DNA, 25 bp, Mus musculus
tccccaggctacagggaacatagag

SEQ ID NO: 136654 - DNA, 25 bp, Mus musculus
tccccagggaaggagttgagcacaa

SEQ ID NO: 136655 - DNA, 25 bp, Mus musculus
tccccagggaggtgtgagcattgcc

SEQ ID NO: 136656 - DNA, 25 bp, Mus musculus
tccccagggcattcagcagttacag

SEQ ID NO: 136657 - DNA, 25 bp, Mus musculus
tccccagtaagctgcgagaagagag

SEQ ID NO: 136658 - DNA, 25 bp, Mus musculus
tccccagtctggtctccggagcgga

SEQ ID NO: 136659 - DNA, 25 bp, Mus musculus
tccccagtgggtactcgggatggtc

SEQ ID NO: 136660 - DNA, 25 bp, Mus musculus
tccccagtgtgagaggaaccagcaa

SEQ ID NO: 136661 - DNA, 25 bp, Mus musculus
tccccataggtgcaatcgcagcaga

SEQ ID NO: 136662 - DNA, 25 bp, Mus musculus
tccccatgaagaggacagtcgcagt

SEQ ID NO: 136663 - DNA, 25 bp, Mus musculus
tccccatgagggagaagcatgtgcc

SEQ ID NO: 136664 - DNA, 25 bp, Mus musculus
tccccatgcctggatttgatgaacg

SEQ ID NO: 136665 - DNA, 25 bp, Mus musculus
tccccatgcgagaagcttaaggaag

SEQ ID NO: 136666 - DNA, 25 bp, Mus musculus
tccccatggagccaccattcggaaa

SEQ ID NO: 136667 - DNA, 25 bp, Mus musculus
tccccatgggcgctgattacatcat

SEQ ID NO: 136668 - DNA, 25 bp, Mus musculus
tccccatgggtattgtgatctcgat

SEQ ID NO: 136669 - DNA, 25 bp, Mus musculus
tccccattgagaccaagaaccaaga

SEQ ID NO: 136670 - DNA, 25 bp, Mus musculus
tccccattggcctttgcgacagaag

SEQ ID NO: 136671 - DNA, 25 bp, Mus musculus
tccccattggcttgctcttctgtaa

SEQ ID NO: 136672 - DNA, 25 bp, Mus musculus
tcccccaggaatgcgcccaccaaga

SEQ ID NO: 136673 - DNA, 25 bp, Mus musculus
tcccccgtttgcctctgcaggtgca

SEQ ID NO: 136674 - DNA, 25 bp, Mus musculus
tccccgaagaagaactccaccaaga

SEQ ID NO: 136675 - DNA, 25 bp, Mus musculus
tccccgaccagacgcttggtgctgg

SEQ ID NO: 136676 - DNA, 25 bp, Mus musculus
tccccgagaagacagttagggcctt

SEQ ID NO: 136677 - DNA, 25 bp, Mus musculus
tccccgaggcagaaaatgcaacgct

SEQ ID NO: 136678 - DNA, 25 bp, Mus musculus
tccccgaggcctgccagagtgtaaa

SEQ ID NO: 136679 - DNA, 25 bp, Mus musculus
tccccgagggaagagaggtacccat

SEQ ID NO: 136680 - DNA, 25 bp, Mus musculus
tccccgagggatttgagcatctttc

SEQ ID NO: 136681 - DNA, 25 bp, Mus musculus
tccccgagtcggagaacatctgtgg

SEQ ID NO: 136682 - DNA, 25 bp, Mus musculus
tccccgagttgatagaattagccca

SEQ ID NO: 136683 - DNA, 25 bp, Mus musculus
tccccgcagctagggtactgggtag

SEQ ID NO: 136684 - DNA, 25 bp, Mus musculus
tccccggaccttcgactggatgaag

SEQ ID NO: 136685 - DNA, 25 bp, Mus musculus
tccccggaggagatgcggaaactct

SEQ ID NO: 136686 - DNA, 25 bp, Mus musculus
tccccggaggccataagaaggaagc

SEQ ID NO: 136687 - DNA, 25 bp, Mus musculus
tccccgggaaggctctacagaaagt

SEQ ID NO: 136688 - DNA, 25 bp, Mus musculus
tccccgggacctctttgaggatgaa

SEQ ID NO: 136689 - DNA, 25 bp, Mus musculus
tccccgggccgcaagagaaacagtg

SEQ ID NO: 136690 - DNA, 25 bp, Mus musculus
tccccgggctgaagttgagaacaca

SEQ ID NO: 136691 - DNA, 25 bp, Mus musculus
tccccgtgaaggaggtgacactgca

SEQ ID NO: 136692 - DNA, 25 bp, Mus musculus
tccccgtgttgtcctcaagatgcag

SEQ ID NO: 136693 - DNA, 25 bp, Mus musculus
tccccgttgttgaggagaccatgct

SEQ ID NO: 136694 - DNA, 25 bp, Mus musculus
tcccctagcagagataagaacacag

SEQ ID NO: 136695 - DNA, 25 bp, Mus musculus
tcccctcggtcagtctagagcagag

SEQ ID NO: 136696 - DNA, 25 bp, Mus musculus
tcccctctcctgtattgaaagcgtt

SEQ ID NO: 136697 - DNA, 25 bp, Mus musculus
tcccctctgggacgaattaacgaag

SEQ ID NO: 136698 - DNA, 25 bp, Mus musculus
tcccctgaaacttccgtgtctaata

SEQ ID NO: 136699 - DNA, 25 bp, Mus musculus
tcccctgaatccacaggtgcaagag

SEQ ID NO: 136700 - DNA, 25 bp, Mus musculus
tcccctgagatagaagagatggctc

SEQ ID NO: 136701 - DNA, 25 bp, Mus musculus
tcccctggaaatatgtcctcaacac

SEQ ID NO: 136702 - DNA, 25 bp, Mus musculus
tcccctggaagagacctatattgcc

SEQ ID NO: 136703 - DNA, 25 bp, Mus musculus
tcccctggcagtgccgaaaataacg

SEQ ID NO: 136704 - DNA, 25 bp, Mus musculus
tcccctgggtggtggtcaagtgtct

SEQ ID NO: 136705 - DNA, 25 bp, Mus musculus
tcccctgtttggtcagaaccgctgt

SEQ ID NO: 136706 - DNA, 25 bp, Mus musculus
tccccttaagtaagtgaagtatggt

SEQ ID NO: 136707 - DNA, 25 bp, Mus musculus
tccccttgaggaagatcgagaggct

SEQ ID NO: 136708 - DNA, 25 bp, Mus musculus
tcccctttaaatagcacaacattgc

SEQ ID NO: 136709 - DNA, 25 bp, Mus musculus
tcccctttgagagtggcaaaccatt

SEQ ID NO: 136710 - DNA, 25 bp, Mus musculus
tcccctttgcattgaagaaattgag

SEQ ID NO: 136711 - DNA, 25 bp, Mus musculus
tcccgaacacggatcatgtctgtac

SEQ ID NO: 136712 - DNA, 25 bp, Mus musculus
tcccgaatcgtcagccagaaggatg

SEQ ID NO: 136713 - DNA, 25 bp, Mus musculus
tcccgaatgaaaggtggaagcgcca

SEQ ID NO: 136714 - DNA, 25 bp, Mus musculus
tcccgacaagaagaggatgaagctc

SEQ ID NO: 136715 - DNA, 25 bp, Mus musculus
tcccgactagagatatgcaacctgt

SEQ ID NO: 136716 - DNA, 25 bp, Mus musculus
tcccgactgagagatcgctgagctg

SEQ ID NO: 136717 - DNA, 25 bp, Mus musculus
tcccgagaacgtggagttggcacta

SEQ ID NO: 136718 - DNA, 25 bp, Mus musculus
tcccgagactctagtgattctgctg

SEQ ID NO: 136719 - DNA, 25 bp, Mus musculus
tcccgagagactggtgatgcacatg

SEQ ID NO: 136720 - DNA, 25 bp, Mus musculus
tcccgagatgcatctgcatcaggtc

SEQ ID NO: 136721 - DNA, 25 bp, Mus musculus
tcccgagcccttggagaagtatact

SEQ ID NO: 136722 - DNA, 25 bp, Mus musculus
tcccgaggaggagcaaagtcaatcc

SEQ ID NO: 136723 - DNA, 25 bp, Mus musculus
tcccgaggatggcagcaatcagcat

SEQ ID NO: 136724 - DNA, 25 bp, Mus musculus
tcccgaggcacagcagttggttaaa

SEQ ID NO: 136725 - DNA, 25 bp, Mus musculus
tcccgaggcttgctgtgaactgact

SEQ ID NO: 136726 - DNA, 25 bp, Mus musculus
tcccgagtaagcatgaaaccagagt

SEQ ID NO: 136727 - DNA, 25 bp, Mus musculus
tcccgagtacgagaggttatcaaca

SEQ ID NO: 136728 - DNA, 25 bp, Mus musculus
tcccgagtccaaaaatacagagctt

SEQ ID NO: 136729 - DNA, 25 bp, Mus musculus
tcccgagtgagccatacatagtcca

SEQ ID NO: 136730 - DNA, 25 bp, Mus musculus
tcccgatgggcatggttcagcgtcc

SEQ ID NO: 136731 - DNA, 25 bp, Mus musculus
tcccgatgtgatgaacctcagccag

SEQ ID NO: 136732 - DNA, 25 bp, Mus musculus
tcccgattgggattccatgctcgat

SEQ ID NO: 136733 - DNA, 25 bp, Mus musculus
tcccgattggtgcacgaaaggcctg

SEQ ID NO: 136734 - DNA, 25 bp, Mus musculus
tcccgcaagaaggatgactcgttct

SEQ ID NO: 136735 - DNA, 25 bp, Mus musculus
tcccgcacagtttgacttgctcaag

SEQ ID NO: 136736 - DNA, 25 bp, Mus musculus
tcccgcagcagtgtcatgaagtcct

SEQ ID NO: 136737 - DNA, 25 bp, Mus musculus
tcccgcctggtgctctgtaagacat

SEQ ID NO: 136738 - DNA, 25 bp, Mus musculus
tcccgcgatggaagacgatcaggag

SEQ ID NO: 136739 - DNA, 25 bp, Mus musculus
tcccgcggttgaagagagaccaagg

SEQ ID NO: 136740 - DNA, 25 bp, Mus musculus
tcccgctcgggttcggtgtccgtcg

SEQ ID NO: 136741 - DNA, 25 bp, Mus musculus
tcccgctgtggtggtagatcccggc

SEQ ID NO: 136742 - DNA, 25 bp, Mus musculus
tcccgcttgcttggtcatggaggcg

SEQ ID NO: 136743 - DNA, 25 bp, Mus musculus
tcccgcttggaatctgtgcacatca

SEQ ID NO: 136744 - DNA, 25 bp, Mus musculus
tcccgcttggtggtaaagacagccc

SEQ ID NO: 136745 - DNA, 25 bp, Mus musculus
tcccgcttgtgaatggcaggacggc

SEQ ID NO: 136746 - DNA, 25 bp, Mus musculus
tcccggaactaaatgctcaggtctt

SEQ ID NO: 136747 - DNA, 25 bp, Mus musculus
tcccggaacttaaggtccagccaga

SEQ ID NO: 136748 - DNA, 25 bp, Mus musculus
tcccggaagtaatcggtacacgtgc

SEQ ID NO: 136749 - DNA, 25 bp, Mus musculus
tcccggagaacaagtgctagagccc

SEQ ID NO: 136750 - DNA, 25 bp, Mus musculus
tcccggagaccaaaggcaggacttt

SEQ ID NO: 136751 - DNA, 25 bp, Mus musculus
tcccggagcaccagaagcagtgaag

SEQ ID NO: 136752 - DNA, 25 bp, Mus musculus
tcccggagcctagtgtgggttttgt

SEQ ID NO: 136753 - DNA, 25 bp, Mus musculus
tcccggagctgaagaatgacacgtt

SEQ ID NO: 136754 - DNA, 25 bp, Mus musculus
tcccggaggagctcccgtcacggtg

SEQ ID NO: 136755 - DNA, 25 bp, Mus musculus
tcccggagtcgagacaaggatgagc

SEQ ID NO: 136756 - DNA, 25 bp, Mus musculus
tcccggattctggtgggttcttccg

SEQ ID NO: 136757 - DNA, 25 bp, Mus musculus
tcccggcaaagggttactgggcatt

SEQ ID NO: 136758 - DNA, 25 bp, Mus musculus
tcccggcaggtgaagcatgttatga

SEQ ID NO: 136759 - DNA, 25 bp, Mus musculus
tcccggcaggtgctggcaacttaat

SEQ ID NO: 136760 - DNA, 25 bp, Mus musculus
tcccggccaatgtgaccacactgag

SEQ ID NO: 136761 - DNA, 25 bp, Mus musculus
tcccggccaccaacaggtgatgacg

SEQ ID NO: 136762 - DNA, 25 bp, Mus musculus
tcccggccgacagacaatagtataa

SEQ ID NO: 136763 - DNA, 25 bp, Mus musculus
tcccggcggaagtgaagaagccccg

SEQ ID NO: 136764 - DNA, 25 bp, Mus musculus
tcccggcgggaagcatgcgattgct

SEQ ID NO: 136765 - DNA, 25 bp, Mus musculus
tcccggctactgtgtgaaggtgctg

SEQ ID NO: 136766 - DNA, 25 bp, Mus musculus
tcccggctgagaaaggaacaacagt

SEQ ID NO: 136767 - DNA, 25 bp, Mus musculus
tcccgggaaccagtaggcggtctct

SEQ ID NO: 136768 - DNA, 25 bp, Mus musculus
tcccgggaagtctatggacatgaga

SEQ ID NO: 136769 - DNA, 25 bp, Mus musculus
tcccgggaatacaaactagtgatgc

SEQ ID NO: 136770 - DNA, 25 bp, Mus musculus
tcccgggacggcaactttctgaaca

SEQ ID NO: 136771 - DNA, 25 bp, Mus musculus
tcccgggagtgaacctgacatgtct

SEQ ID NO: 136772 - DNA, 25 bp, Mus musculus
tcccgggatgttacctttgctcagg

SEQ ID NO: 136773 - DNA, 25 bp, Mus musculus
tcccgggcaagaaagatacagcgct

SEQ ID NO: 136774 - DNA, 25 bp, Mus musculus
tcccgggccacgaactggacgtgag

SEQ ID NO: 136775 - DNA, 25 bp, Mus musculus
tcccgggctgtattagtttgaagaa

SEQ ID NO: 136776 - DNA, 25 bp, Mus musculus
tcccgggtttcagtcgcggatcact

SEQ ID NO: 136777 - DNA, 25 bp, Mus musculus
tcccggtcaacaggatcatcgatgt

SEQ ID NO: 136778 - DNA, 25 bp, Mus musculus
tcccggtcaggatcaaggagcaagt

SEQ ID NO: 136779 - DNA, 25 bp, Mus musculus
tcccggtccagtaaagagaagatcc

SEQ ID NO: 136780 - DNA, 25 bp, Mus musculus
tcccggtgtccttctggagtccaaa

SEQ ID NO: 136781 - DNA, 25 bp, Mus musculus
tcccggttccgtgatgctcgtaagc

SEQ ID NO: 136782 - DNA, 25 bp, Mus musculus
tcccggttcgtgtgcaaaacaagct

SEQ ID NO: 136783 - DNA, 25 bp, Mus musculus
tcccgtcaggaagcccaagtatgtg

SEQ ID NO: 136784 - DNA, 25 bp, Mus musculus
tcccgtctgacattggcgtctttgc

SEQ ID NO: 136785 - DNA, 25 bp, Mus musculus
tcccgtgaaactgtggaggcgcttc

SEQ ID NO: 136786 - DNA, 25 bp, Mus musculus
tcccgtgaaagagttgagtacccct

SEQ ID NO: 136787 - DNA, 25 bp, Mus musculus
tcccgtgaagaatggcagtatgtct

SEQ ID NO: 136788 - DNA, 25 bp, Mus musculus
tcccgtgccaaaagagccattgcct

SEQ ID NO: 136789 - DNA, 25 bp, Mus musculus
tcccgtggaagagctttcgacaggc

SEQ ID NO: 136790 - DNA, 25 bp, Mus musculus
tcccgtggaagcatggcctacggca

SEQ ID NO: 136791 - DNA, 25 bp, Mus musculus
tcccgtggacagtgagcagttgcgc

SEQ ID NO: 136792 - DNA, 25 bp, Mus musculus
tcccgtggagaagagacgatgctac

SEQ ID NO: 136793 - DNA, 25 bp, Mus musculus
tcccgtggagtgaatctgaaccgtc

SEQ ID NO: 136794 - DNA, 25 bp, Mus musculus
tcccgtgtaacgaatgtgctaaact

SEQ ID NO: 136795 - DNA, 25 bp, Mus musculus
tcccgtgtgccaggatgattggagt

SEQ ID NO: 136796 - DNA, 25 bp, Mus musculus
tcccgttggttacgtcgccggctgt

SEQ ID NO: 136797 - DNA, 25 bp, Mus musculus
tcccgtttggtgacgaggatgccct

SEQ ID NO: 136798 - DNA, 25 bp, Mus musculus
tccctaaagcggaagagctgaagac

SEQ ID NO: 136799 - DNA, 25 bp, Mus musculus
tccctaatgtggatctaccaccgct

SEQ ID NO: 136800 - DNA, 25 bp, Mus musculus
tccctacagctatggaaacatcttc

SEQ ID NO: 136801 - DNA, 25 bp, Mus musculus
tccctacaggttgcgaatgattgct

SEQ ID NO: 136802 - DNA, 25 bp, Mus musculus
tccctacgtggtggagtgtacaggc

SEQ ID NO: 136803 - DNA, 25 bp, Mus musculus
tccctacgttaaggtgcacacggac

SEQ ID NO: 136804 - DNA, 25 bp, Mus musculus
tccctactcgtgaacaatgccaaag

SEQ ID NO: 136805 - DNA, 25 bp, Mus musculus
tccctactgcgagctctcagagaag

SEQ ID NO: 136806 - DNA, 25 bp, Mus musculus
tccctagagtcagtgccgggagccg

SEQ ID NO: 136807 - DNA, 25 bp, Mus musculus
tccctagagtcatgtggcatagcct

SEQ ID NO: 136808 - DNA, 25 bp, Mus musculus
tccctaggtccttcgcgttgcagtt

SEQ ID NO: 136809 - DNA, 25 bp, Mus musculus
tccctaggtttccatagacacgcag

SEQ ID NO: 136810 - DNA, 25 bp, Mus musculus
tccctagtgcagacaaaggaaatgt

SEQ ID NO: 136811 - DNA, 25 bp, Mus musculus
tccctatcaagatggtcaacttccc

SEQ ID NO: 136812 - DNA, 25 bp, Mus musculus
tccctatcaaggtggccagtggctc

SEQ ID NO: 136813 - DNA, 25 bp, Mus musculus
tccctatgacggagatactttccag

SEQ ID NO: 136814 - DNA, 25 bp, Mus musculus
tccctatggcccagaacatctttgc

SEQ ID NO: 136815 - DNA, 25 bp, Mus musculus
tccctatgggcatgctgtacaacag

SEQ ID NO: 136816 - DNA, 25 bp, Mus musculus
tccctatttgcttcgagagtttgaa

SEQ ID NO: 136817 - DNA, 25 bp, Mus musculus
tccctcagagaacgagaacagtcag

SEQ ID NO: 136818 - DNA, 25 bp, Mus musculus
tccctcagggtagcgaaagaatttg

SEQ ID NO: 136819 - DNA, 25 bp, Mus musculus
tccctcagggtgtgtctctcaaagt

SEQ ID NO: 136820 - DNA, 25 bp, Mus musculus
tccctcagggtgttcgtgaatgccg

SEQ ID NO: 136821 - DNA, 25 bp, Mus musculus
tccctcaggtcgctaataaagctgt

SEQ ID NO: 136822 - DNA, 25 bp, Mus musculus
tccctcagtatgtgtttggccaggc

SEQ ID NO: 136823 - DNA, 25 bp, Mus musculus
tccctcatgcagaagatatccccaa

SEQ ID NO: 136824 - DNA, 25 bp, Mus musculus
tccctcatggaaacggtggacacag

SEQ ID NO: 136825 - DNA, 25 bp, Mus musculus
tccctcattagaaaagtctgtccag

SEQ ID NO: 136826 - DNA, 25 bp, Mus musculus
tccctccatggtgtcggaaagcctt

SEQ ID NO: 136827 - DNA, 25 bp, Mus musculus
tccctcccaacccagacatgtggag

SEQ ID NO: 136828 - DNA, 25 bp, Mus musculus
tccctccggcgtcgccgaggtcgac

SEQ ID NO: 136829 - DNA, 25 bp, Mus musculus
tccctccttgggaagaagttgctgc

SEQ ID NO: 136830 - DNA, 25 bp, Mus musculus
tccctcgcagagatttgaaaatggc

SEQ ID NO: 136831 - DNA, 25 bp, Mus musculus
tccctcggagggaacaataaagctt

SEQ ID NO: 136832 - DNA, 25 bp, Mus musculus
tccctcggcgtgatgaaactagctt

SEQ ID NO: 136833 - DNA, 25 bp, Mus musculus
tccctcgtgggactggattcgccat

SEQ ID NO: 136834 - DNA, 25 bp, Mus musculus
tccctctaggcgaaaagcttctgtt

SEQ ID NO: 136835 - DNA, 25 bp, Mus musculus
tccctctccctcttcgatgatgagt

SEQ ID NO: 136836 - DNA, 25 bp, Mus musculus
tccctctgagaggagtagatgctgc

SEQ ID NO: 136837 - DNA, 25 bp, Mus musculus
tccctcttcggcttccgtagacgag

SEQ ID NO: 136838 - DNA, 25 bp, Mus musculus
tccctgaaaggactgcggtagcgac

SEQ ID NO: 136839 - DNA, 25 bp, Mus musculus
tccctgaaagtggtaggtcggccct

SEQ ID NO: 136840 - DNA, 25 bp, Mus musculus
tccctgaatggagattgatgctgct

SEQ ID NO: 136841 - DNA, 25 bp, Mus musculus
tccctgacggtgagggcagacatca

SEQ ID NO: 136842 - DNA, 25 bp, Mus musculus
tccctgagcagtgaggactgtccag

SEQ ID NO: 136843 - DNA, 25 bp, Mus musculus
tccctgagctgctgagagtctcggg

SEQ ID NO: 136844 - DNA, 25 bp, Mus musculus
tccctgagctggacgggaagacagc

SEQ ID NO: 136845 - DNA, 25 bp, Mus musculus
tccctgaggacgaggcactgatgct

SEQ ID NO: 136846 - DNA, 25 bp, Mus musculus
tccctgagggcgctgagacagactt

SEQ ID NO: 136847 - DNA, 25 bp, Mus musculus
tccctgagggtgtgatccgaatcta

SEQ ID NO: 136848 - DNA, 25 bp, Mus musculus
tccctgatgcggtatatctcccatg

SEQ ID NO: 136849 - DNA, 25 bp, Mus musculus
tccctgatggctgggattcagacga

SEQ ID NO: 136850 - DNA, 25 bp, Mus musculus
tccctgattagagatccaaaggcct

SEQ ID NO: 136851 - DNA, 25 bp, Mus musculus
tccctgcaagagtggtgaaggctca

SEQ ID NO: 136852 - DNA, 25 bp, Mus musculus
tccctgcaatggacgaggaggctct

SEQ ID NO: 136853 - DNA, 25 bp, Mus musculus
tccctgcagaagatatcagtgcaaa

SEQ ID NO: 136854 - DNA, 25 bp, Mus musculus
tccctgccaagaggcataagcagct

SEQ ID NO: 136855 - DNA, 25 bp, Mus musculus
tccctgcgttgagtgtgaatggcca

SEQ ID NO: 136856 - DNA, 25 bp, Mus musculus
tccctgctcaagtaaggaggcccgt

SEQ ID NO: 136857 - DNA, 25 bp, Mus musculus
tccctgctgtggagcgagtgaagcc

SEQ ID NO: 136858 - DNA, 25 bp, Mus musculus
tccctggaccatagaagagatgtca

SEQ ID NO: 136859 - DNA, 25 bp, Mus musculus
tccctggagacaaagagtactgcat

SEQ ID NO: 136860 - DNA, 25 bp, Mus musculus
tccctggagcttttctataccctgg

SEQ ID NO: 136861 - DNA, 25 bp, Mus musculus
tccctggagtaaagccctgtgaatg

SEQ ID NO: 136862 - DNA, 25 bp, Mus musculus
tccctggagtgtgtgacagacagca

SEQ ID NO: 136863 - DNA, 25 bp, Mus musculus
tccctggagttggaggaccggaaca

SEQ ID NO: 136864 - DNA, 25 bp, Mus musculus
tccctggatggcctgtgcgtgtctc

SEQ ID NO: 136865 - DNA, 25 bp, Mus musculus
tccctggatgtactgagcagcgcct

SEQ ID NO: 136866 - DNA, 25 bp, Mus musculus
tccctggcccagtgtctaatggagc

SEQ ID NO: 136867 - DNA, 25 bp, Mus musculus
tccctggcctgggagagtttgagca

SEQ ID NO: 136868 - DNA, 25 bp, Mus musculus
tccctggcgagttagaagctgcccc

SEQ ID NO: 136869 - DNA, 25 bp, Mus musculus
tccctggcggccaaagagaaggtct

SEQ ID NO: 136870 - DNA, 25 bp, Mus musculus
tccctgggagaaagcggaccacttt

SEQ ID NO: 136871 - DNA, 25 bp, Mus musculus
tccctgggatactggaagaccacca

SEQ ID NO: 136872 - DNA, 25 bp, Mus musculus
tccctgggcaacatctctggagtgt

SEQ ID NO: 136873 - DNA, 25 bp, Mus musculus
tccctgggcgtgtatcagaacatca

SEQ ID NO: 136874 - DNA, 25 bp, Mus musculus
tccctgggtactagcactgacataa

SEQ ID NO: 136875 - DNA, 25 bp, Mus musculus
tccctgggtagaggactagcctgca

SEQ ID NO: 136876 - DNA, 25 bp, Mus musculus
tccctggtctgcagttacaatcact

SEQ ID NO: 136877 - DNA, 25 bp, Mus musculus
tccctggtgaaacagaacagtgtct

SEQ ID NO: 136878 - DNA, 25 bp, Mus musculus
tccctggtggacacatcagtctcca

SEQ ID NO: 136879 - DNA, 25 bp, Mus musculus
tccctgtgaaagctgtgatcgccgt

SEQ ID NO: 136880 - DNA, 25 bp, Mus musculus
tccctgtgaccgagatgcaggaccc

SEQ ID NO: 136881 - DNA, 25 bp, Mus musculus
tccctgtgacttacatgcctgttcc

SEQ ID NO: 136882 - DNA, 25 bp, Mus musculus
tccctgtgcctctgagattctggac

SEQ ID NO: 136883 - DNA, 25 bp, Mus musculus
tccctgtggacgatagagctgtaga

SEQ ID NO: 136884 - DNA, 25 bp, Mus musculus
tccctgtggtcaagcatgtcaaccc

SEQ ID NO: 136885 - DNA, 25 bp, Mus musculus
tccctgtggtggagagaaaaatcct

SEQ ID NO: 136886 - DNA, 25 bp, Mus musculus
tccctgtgtgtgtagaagtaccctc

SEQ ID NO: 136887 - DNA, 25 bp, Mus musculus
tccctgttagcactggacttgacac

SEQ ID NO: 136888 - DNA, 25 bp, Mus musculus
tccctgttgggagcaatctgtacgt

SEQ ID NO: 136889 - DNA, 25 bp, Mus musculus
tccctgttggtcgtgctaagtggct

SEQ ID NO: 136890 - DNA, 25 bp, Mus musculus
tcccttaggatggtagcatggtaca

SEQ ID NO: 136891 - DNA, 25 bp, Mus musculus
tcccttccggatggctgtgtagcga

SEQ ID NO: 136892 - DNA, 25 bp, Mus musculus
tcccttcgcggtttcgagagctccg

SEQ ID NO: 136893 - DNA, 25 bp, Mus musculus
tcccttcgtggtgctgtagacatcg

SEQ ID NO: 136894 - DNA, 25 bp, Mus musculus
tcccttgaaagatgagccgtggcct

SEQ ID NO: 136895 - DNA, 25 bp, Mus musculus
tcccttgagatttgggctctgggcc

SEQ ID NO: 136896 - DNA, 25 bp, Mus musculus
tcccttgcgcggaacgtagagcgag

SEQ ID NO: 136897 - DNA, 25 bp, Mus musculus
tcccttggagccctgagaagatcaa

SEQ ID NO: 136898 - DNA, 25 bp, Mus musculus
tcccttggcgagtccagtggatgaa

SEQ ID NO: 136899 - DNA, 25 bp, Mus musculus
tcccttgggccaaagcttctgctgt

SEQ ID NO: 136900 - DNA, 25 bp, Mus musculus
tcccttgtagatggctccgagcgat

SEQ ID NO: 136901 - DNA, 25 bp, Mus musculus
tcccttgtgaatggctgggaagtgt

SEQ ID NO: 136902 - DNA, 25 bp, Mus musculus
tccctttggatacagcccacctgga

SEQ ID NO: 136903 - DNA, 25 bp, Mus musculus
tccctttgtccagcagtgtacacag

SEQ ID NO: 136904 - DNA, 25 bp, Mus musculus
tccctttgttgagaagactgaaaac

SEQ ID NO: 136905 - DNA, 25 bp, Mus musculus
tccgaaaactgcgtgacgatgtgtg

SEQ ID NO: 136906 - DNA, 25 bp, Mus musculus
tccgaaaatttgacaggcaaggacg

SEQ ID NO: 136907 - DNA, 25 bp, Mus musculus
tccgaaacgagaagcagatcaggtg

SEQ ID NO: 136908 - DNA, 25 bp, Mus musculus
tccgaaagccagtcaccatcacggt

SEQ ID NO: 136909 - DNA, 25 bp, Mus musculus
tccgaaagtgaaggtgacagacacc

SEQ ID NO: 136910 - DNA, 25 bp, Mus musculus
tccgaaatctggaaggcaggcgtaa

SEQ ID NO: 136911 - DNA, 25 bp, Mus musculus
tccgaaatggcaggtgtgagcagct

SEQ ID NO: 136912 - DNA, 25 bp, Mus musculus
tccgaacacggaatatcagggtcat

SEQ ID NO: 136913 - DNA, 25 bp, Mus musculus
tccgaacaggcgtcgccgggaactt

SEQ ID NO: 136914 - DNA, 25 bp, Mus musculus
tccgaacagtgcgttagtacagcag

SEQ ID NO: 136915 - DNA, 25 bp, Mus musculus
tccgaaccagtgagaagaggtcctt

SEQ ID NO: 136916 - DNA, 25 bp, Mus musculus
tccgaaccctgcagaagagatgcct

SEQ ID NO: 136917 - DNA, 25 bp, Mus musculus
tccgaacctccggatgaagccggtg

SEQ ID NO: 136918 - DNA, 25 bp, Mus musculus
tccgaactcgggtctctcttaagga

SEQ ID NO: 136919 - DNA, 25 bp, Mus musculus
tccgaagaccccaaaataactgtag

SEQ ID NO: 136920 - DNA, 25 bp, Mus musculus
tccgaagaggaaacggcgacgagtc

SEQ ID NO: 136921 - DNA, 25 bp, Mus musculus
tccgaagcaagatagcagatggcac

SEQ ID NO: 136922 - DNA, 25 bp, Mus musculus
tccgaagccagtggcatggtgactc

SEQ ID NO: 136923 - DNA, 25 bp, Mus musculus
tccgaagcggagaaggctttctgct

SEQ ID NO: 136924 - DNA, 25 bp, Mus musculus
tccgaagctgggaaaatgcaagcgg

SEQ ID NO: 136925 - DNA, 25 bp, Mus musculus
tccgaaggagacaaccaaggctgct

SEQ ID NO: 136926 - DNA, 25 bp, Mus musculus
tccgaaggaggaccacaactacagt

SEQ ID NO: 136927 - DNA, 25 bp, Mus musculus
tccgaaggctgaaacgcttgcgttc

SEQ ID NO: 136928 - DNA, 25 bp, Mus musculus
tccgaaggcttcagtggcataccag

SEQ ID NO: 136929 - DNA, 25 bp, Mus musculus
tccgaagggccactcagaaactagg

SEQ ID NO: 136930 - DNA, 25 bp, Mus musculus
tccgaatcagcagaactggagatct

SEQ ID NO: 136931 - DNA, 25 bp, Mus musculus
tccgaatgatgactgacgcgggtct

SEQ ID NO: 136932 - DNA, 25 bp, Mus musculus
tccgaatggtcacaagaaacagcgc

SEQ ID NO: 136933 - DNA, 25 bp, Mus musculus
tccgaattgaggatacaggacacat

SEQ ID NO: 136934 - DNA, 25 bp, Mus musculus
tccgacagggtagcgtaagctggtc

SEQ ID NO: 136935 - DNA, 25 bp, Mus musculus
tccgaccgctggtttcgaagacatg

SEQ ID NO: 136936 - DNA, 25 bp, Mus musculus
tccgaccgctttgaggaggattcac

SEQ ID NO: 136937 - DNA, 25 bp, Mus musculus
tccgaccgtctggagaaacgagcct

SEQ ID NO: 136938 - DNA, 25 bp, Mus musculus
tccgacctgggagatactgtcagcc

SEQ ID NO: 136939 - DNA, 25 bp, Mus musculus
tccgacgagatatcaccaagtgtct

SEQ ID NO: 136940 - DNA, 25 bp, Mus musculus
tccgacgcccagtatggacctggaa

SEQ ID NO: 136941 - DNA, 25 bp, Mus musculus
tccgacggaatctggaagttaagcc

SEQ ID NO: 136942 - DNA, 25 bp, Mus musculus
tccgacggacgatggaaaggagcca

SEQ ID NO: 136943 - DNA, 25 bp, Mus musculus
tccgacggtccatccagggtgtctt

SEQ ID NO: 136944 - DNA, 25 bp, Mus musculus
tccgactataacaagattcatccag

SEQ ID NO: 136945 - DNA, 25 bp, Mus musculus
tccgacttcgaagggtacgagcagg

SEQ ID NO: 136946 - DNA, 25 bp, Mus musculus
tccgagaacagagtagaacgcgtcc

SEQ ID NO: 136947 - DNA, 25 bp, Mus musculus
tccgagaagctaagccctgatgcct

SEQ ID NO: 136948 - DNA, 25 bp, Mus musculus
tccgagaagtggaaagcttgcctgc

SEQ ID NO: 136949 - DNA, 25 bp, Mus musculus
tccgagaagttagcaccgttgtgcc

SEQ ID NO: 136950 - DNA, 25 bp, Mus musculus
tccgagagaggaaattcaggaaagc

SEQ ID NO: 136951 - DNA, 25 bp, Mus musculus
tccgagagattagcaaagatgatgc

SEQ ID NO: 136952 - DNA, 25 bp, Mus musculus
tccgagagcgatacgggcctctgtg

SEQ ID NO: 136953 - DNA, 25 bp, Mus musculus
tccgagagcgcttaaccctgagatg

SEQ ID NO: 136954 - DNA, 25 bp, Mus musculus
tccgagagtaaggacattcttggtc

SEQ ID NO: 136955 - DNA, 25 bp, Mus musculus
tccgagatacctagttaaagagtgc

SEQ ID NO: 136956 - DNA, 25 bp, Mus musculus
tccgagatgtatgtgatgcctgccg

SEQ ID NO: 136957 - DNA, 25 bp, Mus musculus
tccgagcacagctctcaagggctgg

SEQ ID NO: 136958 - DNA, 25 bp, Mus musculus
tccgagcagtctctggtgcggtctc

SEQ ID NO: 136959 - DNA, 25 bp, Mus musculus
tccgagccacaaggaagcctctagt

SEQ ID NO: 136960 - DNA, 25 bp, Mus musculus
tccgagccagtgatcaaagacaatg

SEQ ID NO: 136961 - DNA, 25 bp, Mus musculus
tccgagcccgcagagatttactgca

SEQ ID NO: 136962 - DNA, 25 bp, Mus musculus
tccgagcccttgactttggaaatgg

SEQ ID NO: 136963 - DNA, 25 bp, Mus musculus
tccgagccggtgtaagtagagatgc

SEQ ID NO: 136964 - DNA, 25 bp, Mus musculus
tccgagcgtcgcgtgatcatcgtgc

SEQ ID NO: 136965 - DNA, 25 bp, Mus musculus
tccgagctagagctcggccgagcct

SEQ ID NO: 136966 - DNA, 25 bp, Mus musculus
tccgagctcagaaagtgataaaggg

SEQ ID NO: 136967 - DNA, 25 bp, Mus musculus
tccgagctgcagtccgatgctcagc

SEQ ID NO: 136968 - DNA, 25 bp, Mus musculus
tccgaggaaagaaaacaggccatct

SEQ ID NO: 136969 - DNA, 25 bp, Mus musculus
tccgaggaagtatgatcgacatgcc

SEQ ID NO: 136970 - DNA, 25 bp, Mus musculus
tccgaggagacatatctgcgagtcc

SEQ ID NO: 136971 - DNA, 25 bp, Mus musculus
tccgaggagcgtaagatattcaggc

SEQ ID NO: 136972 - DNA, 25 bp, Mus musculus
tccgaggcagcattcgaggcgagtc

SEQ ID NO: 136973 - DNA, 25 bp, Mus musculus
tccgaggcctgagtgttgcatcaca

SEQ ID NO: 136974 - DNA, 25 bp, Mus musculus
tccgaggcgagctaagattaaaatc

SEQ ID NO: 136975 - DNA, 25 bp, Mus musculus
tccgaggctgaaggcttggcgagaa

SEQ ID NO: 136976 - DNA, 25 bp, Mus musculus
tccgaggcttggagactctgactca

SEQ ID NO: 136977 - DNA, 25 bp, Mus musculus
tccgagggaactgggacataagtca

SEQ ID NO: 136978 - DNA, 25 bp, Mus musculus
tccgagggccatttctatcacacag

SEQ ID NO: 136979 - DNA, 25 bp, Mus musculus
tccgagggcgccgtgacgtgtgctc

SEQ ID NO: 136980 - DNA, 25 bp, Mus musculus
tccgaggtaggctcctctcggctct

SEQ ID NO: 136981 - DNA, 25 bp, Mus musculus
tccgaggtcggacagcagactttgt

SEQ ID NO: 136982 - DNA, 25 bp, Mus musculus
tccgagtacaccgagaattatccga

SEQ ID NO: 136983 - DNA, 25 bp, Mus musculus
tccgagtatttgaaggttctccgaa

SEQ ID NO: 136984 - DNA, 25 bp, Mus musculus
tccgagtcggacaaccatgcacttt

SEQ ID NO: 136985 - DNA, 25 bp, Mus musculus
tccgagtcggcaagaagataggctg

SEQ ID NO: 136986 - DNA, 25 bp, Mus musculus
tccgagtctgacgagctgatttttt

SEQ ID NO: 136987 - DNA, 25 bp, Mus musculus
tccgagtggagcgagcgagtcgagc

SEQ ID NO: 136988 - DNA, 25 bp, Mus musculus
tccgataagaacataccaggtgtgc

SEQ ID NO: 136989 - DNA, 25 bp, Mus musculus
tccgataccccatggaacacggtgt

SEQ ID NO: 136990 - DNA, 25 bp, Mus musculus
tccgatacgctcacatggtcaatgg

SEQ ID NO: 136991 - DNA, 25 bp, Mus musculus
tccgatagggtgaaaccgtgacctt

SEQ ID NO: 136992 - DNA, 25 bp, Mus musculus
tccgatcccaggaggagagcgtttc

SEQ ID NO: 136993 - DNA, 25 bp, Mus musculus
tccgatcctgctgcggtctaggtgg

SEQ ID NO: 136994 - DNA, 25 bp, Mus musculus
tccgatcggcttgtaagaagtaagc

SEQ ID NO: 136995 - DNA, 25 bp, Mus musculus
tccgatcttcacagagagggtcctt

SEQ ID NO: 136996 - DNA, 25 bp, Mus musculus
tccgatgaagagaatgtccaggtcc

SEQ ID NO: 136997 - DNA, 25 bp, Mus musculus
tccgatgagcccttggaagcgggca

SEQ ID NO: 136998 - DNA, 25 bp, Mus musculus
tccgatggaagaacgaggacgcagc

SEQ ID NO: 136999 - DNA, 25 bp, Mus musculus
tccgattactcctcagatgtttggg

SEQ ID NO: 137000 - DNA, 25 bp, Mus musculus
tccgattcactgagcaaagggctga

SEQ ID NO: 137001 - DNA, 25 bp, Mus musculus
tccgatttgaatacctgtggccgtt

SEQ ID NO: 137002 - DNA, 25 bp, Mus musculus
tccgattttagcagggcggcttccg

SEQ ID NO: 137003 - DNA, 25 bp, Mus musculus
tccgcaacgtctatgccgaggtgct

SEQ ID NO: 137004 - DNA, 25 bp, Mus musculus
tccgcaagactgagaaggccatcaa

SEQ ID NO: 137005 - DNA, 25 bp, Mus musculus
tccgcaaggccgtgggttgtgccac

SEQ ID NO: 137006 - DNA, 25 bp, Mus musculus
tccgcaagtgacagtggtgacagca

SEQ ID NO: 137007 - DNA, 25 bp, Mus musculus
tccgcaatggcggactgtaacccag

SEQ ID NO: 137008 - DNA, 25 bp, Mus musculus
tccgcacagtcaaggaggcactagc

SEQ ID NO: 137009 - DNA, 25 bp, Mus musculus
tccgcaccggaaagatgttgatgaa

SEQ ID NO: 137010 - DNA, 25 bp, Mus musculus
tccgcactaatgatggccgaggctg

SEQ ID NO: 137011 - DNA, 25 bp, Mus musculus
tccgcagaaggtacaaagagatcat

SEQ ID NO: 137012 - DNA, 25 bp, Mus musculus
tccgcagacagtgagaacgacatgg

SEQ ID NO: 137013 - DNA, 25 bp, Mus musculus
tccgcagaggaacgaaaaggacctt

SEQ ID NO: 137014 - DNA, 25 bp, Mus musculus
tccgcagccaagaggttgatgtcgc

SEQ ID NO: 137015 - DNA, 25 bp, Mus musculus
tccgcagctgctagaacttggtctt

SEQ ID NO: 137016 - DNA, 25 bp, Mus musculus
tccgcaggagcgagagtatctattg

SEQ ID NO: 137017 - DNA, 25 bp, Mus musculus
tccgcaggtgttgttgtacggccga

SEQ ID NO: 137018 - DNA, 25 bp, Mus musculus
tccgcagtgccgtgactctggaaga

SEQ ID NO: 137019 - DNA, 25 bp, Mus musculus
tccgcagtggcagtcaggacatgct

SEQ ID NO: 137020 - DNA, 25 bp, Mus musculus
tccgcagtggctgtgtccgcagcaa

SEQ ID NO: 137021 - DNA, 25 bp, Mus musculus
tccgcagtgtcttggatgggcctgt

SEQ ID NO: 137022 - DNA, 25 bp, Mus musculus
tccgcagtgtgtttagagttcccat

SEQ ID NO: 137023 - DNA, 25 bp, Mus musculus
tccgcatcgtgccactggcctggaa

SEQ ID NO: 137024 - DNA, 25 bp, Mus musculus
tccgcatgatcgagaggcactactt

SEQ ID NO: 137025 - DNA, 25 bp, Mus musculus
tccgcattgctaactgtgtgaccaa

SEQ ID NO: 137026 - DNA, 25 bp, Mus musculus
tccgcatttctgtgggagccgaggc

SEQ ID NO: 137027 - DNA, 25 bp, Mus musculus
tccgccaaagagcagatcatcctgg

SEQ ID NO: 137028 - DNA, 25 bp, Mus musculus
tccgccagatctacggggctaaggg

SEQ ID NO: 137029 - DNA, 25 bp, Mus musculus
tccgccaggtgctacaattgtacag

SEQ ID NO: 137030 - DNA, 25 bp, Mus musculus
tccgccgagtatagctgcctcaagg

SEQ ID NO: 137031 - DNA, 25 bp, Mus musculus
tccgccgcgtggatatcgacgaatt

SEQ ID NO: 137032 - DNA, 25 bp, Mus musculus
tccgccgctggcaacaatagcaaca

SEQ ID NO: 137033 - DNA, 25 bp, Mus musculus
tccgccgtgttgtagactgaactcc

SEQ ID NO: 137034 - DNA, 25 bp, Mus musculus
tccgcctcgggcttttctgcaagta

SEQ ID NO: 137035 - DNA, 25 bp, Mus musculus
tccgcctgaagctgacaaaagaggt

SEQ ID NO: 137036 - DNA, 25 bp, Mus musculus
tccgcctgagtcagggccgcgtcgt

SEQ ID NO: 137037 - DNA, 25 bp, Mus musculus
tccgcctggcgtccttaagtgatcc

SEQ ID NO: 137038 - DNA, 25 bp, Mus musculus
tccgcctggtgaaatggtaggctgc

SEQ ID NO: 137039 - DNA, 25 bp, Mus musculus
tccgccttagccgagagttggtgtt

SEQ ID NO: 137040 - DNA, 25 bp, Mus musculus
tccgccttgcggtttgagtcctatg

SEQ ID NO: 137041 - DNA, 25 bp, Mus musculus
tccgccttttcgatcagggtgggag

SEQ ID NO: 137042 - DNA, 25 bp, Mus musculus
tccgcgcgcttttccggccattcat

SEQ ID NO: 137043 - DNA, 25 bp, Mus musculus
tccgcgcgtgatcgcggggctgccg

SEQ ID NO: 137044 - DNA, 25 bp, Mus musculus
tccgcggaggccgacaggattcgtt

SEQ ID NO: 137045 - DNA, 25 bp, Mus musculus
tccgcggagggaaggagtacaacat

SEQ ID NO: 137046 - DNA, 25 bp, Mus musculus
tccgcggcagccaaaattacagtgg

SEQ ID NO: 137047 - DNA, 25 bp, Mus musculus
tccgcggccaggatgaagaggccta

SEQ ID NO: 137048 - DNA, 25 bp, Mus musculus
tccgcggctactgcagaggattcag

SEQ ID NO: 137049 - DNA, 25 bp, Mus musculus
tccgcggcttttccgaataagctat

SEQ ID NO: 137050 - DNA, 25 bp, Mus musculus
tccgcgggtcagatgtggaacacaa

SEQ ID NO: 137051 - DNA, 25 bp, Mus musculus
tccgcggtgttgaggagaaccacgc

SEQ ID NO: 137052 - DNA, 25 bp, Mus musculus
tccgcgtccgggtgagactaaggtc

SEQ ID NO: 137053 - DNA, 25 bp, Mus musculus
tccgcgtgaactgaactccaataag

SEQ ID NO: 137054 - DNA, 25 bp, Mus musculus
tccgcgtgaagttttaccctgccga

SEQ ID NO: 137055 - DNA, 25 bp, Mus musculus
tccgctaaacagaacaaaggcattg

SEQ ID NO: 137056 - DNA, 25 bp, Mus musculus
tccgctagggagatacttccgaacc

SEQ ID NO: 137057 - DNA, 25 bp, Mus musculus
tccgctcaatttagaagaagtccag

SEQ ID NO: 137058 - DNA, 25 bp, Mus musculus
tccgctctcggaggcacattagtga

SEQ ID NO: 137059 - DNA, 25 bp, Mus musculus
tccgctctgaggttaaggctggcat

SEQ ID NO: 137060 - DNA, 25 bp, Mus musculus
tccgctcttatggaactggacaaag

SEQ ID NO: 137061 - DNA, 25 bp, Mus musculus
tccgctgcagtgaccgaagtaacct

SEQ ID NO: 137062 - DNA, 25 bp, Mus musculus
tccgctgccacgtgagacaggccag

SEQ ID NO: 137063 - DNA, 25 bp, Mus musculus
tccgctgcgtctccggcatttgaat

SEQ ID NO: 137064 - DNA, 25 bp, Mus musculus
tccgctgctagctgaataacaagac

SEQ ID NO: 137065 - DNA, 25 bp, Mus musculus
tccgctggaaggtgcacggagactt

SEQ ID NO: 137066 - DNA, 25 bp, Mus musculus
tccgctggcatagggcatgacatct

SEQ ID NO: 137067 - DNA, 25 bp, Mus musculus
tccgctggctggacagatgcatcgc

SEQ ID NO: 137068 - DNA, 25 bp, Mus musculus
tccgctgtgccacggacagtacgag

SEQ ID NO: 137069 - DNA, 25 bp, Mus musculus
tccgctgtttgggatcatgtcatcg

SEQ ID NO: 137070 - DNA, 25 bp, Mus musculus
tccgcttcatgagggacgtggagcc

SEQ ID NO: 137071 - DNA, 25 bp, Mus musculus
tccgcttctggttgaccttcccggg

SEQ ID NO: 137072 - DNA, 25 bp, Mus musculus
tccgcttgccggtggaaaaggctcc

SEQ ID NO: 137073 - DNA, 25 bp, Mus musculus
tccgcttggtggaggagactcgaat

SEQ ID NO: 137074 - DNA, 25 bp, Mus musculus
tccggaaactcagggactacgctgc

SEQ ID NO: 137075 - DNA, 25 bp, Mus musculus
tccggaacagccttttcgaaagtag

SEQ ID NO: 137076 - DNA, 25 bp, Mus musculus
tccggaacattgtagagctgcgcct

SEQ ID NO: 137077 - DNA, 25 bp, Mus musculus
tccggaacggcattggaatccatga

SEQ ID NO: 137078 - DNA, 25 bp, Mus musculus
tccggaagcgggacaaagtgctttt

SEQ ID NO: 137079 - DNA, 25 bp, Mus musculus
tccggaaggaattagagtaccaggc

SEQ ID NO: 137080 - DNA, 25 bp, Mus musculus
tccggaagtgctcgatgaaaccatc

SEQ ID NO: 137081 - DNA, 25 bp, Mus musculus
tccggaagttgcaacgggaacagca

SEQ ID NO: 137082 - DNA, 25 bp, Mus musculus
tccggacaagagatatgactactgc

SEQ ID NO: 137083 - DNA, 25 bp, Mus musculus
tccggacccatagatggctataagc

SEQ ID NO: 137084 - DNA, 25 bp, Mus musculus
tccggacccatgttgttcgggaaga

SEQ ID NO: 137085 - DNA, 25 bp, Mus musculus
tccggacctgactgagacatgcagc

SEQ ID NO: 137086 - DNA, 25 bp, Mus musculus
tccggacttcccagaggatgccaag

SEQ ID NO: 137087 - DNA, 25 bp, Mus musculus
tccggagaaccaaggacgagatcat

SEQ ID NO: 137088 - DNA, 25 bp, Mus musculus
tccggagagatgaagcaggccgctt

SEQ ID NO: 137089 - DNA, 25 bp, Mus musculus
tccggagcagatcgttcagcagcag

SEQ ID NO: 137090 - DNA, 25 bp, Mus musculus
tccggagcggaatcatcagaaacaa

SEQ ID NO: 137091 - DNA, 25 bp, Mus musculus
tccggagcttatcctggaccatgac

SEQ ID NO: 137092 - DNA, 25 bp, Mus musculus
tccggaggaggagtaagtttgccaa

SEQ ID NO: 137093 - DNA, 25 bp, Mus musculus
tccggaggcctgagcgaggatttca

SEQ ID NO: 137094 - DNA, 25 bp, Mus musculus
tccggaggtccatgccagcatgcag

SEQ ID NO: 137095 - DNA, 25 bp, Mus musculus
tccggaggtcccctagtctgtgaca

SEQ ID NO: 137096 - DNA, 25 bp, Mus musculus
tccggagtgtacaagtccgccgagc

SEQ ID NO: 137097 - DNA, 25 bp, Mus musculus
tccggatccacaaacagagctgctg

SEQ ID NO: 137098 - DNA, 25 bp, Mus musculus
tccggatgcagaaccaagagaactt

SEQ ID NO: 137099 - DNA, 25 bp, Mus musculus
tccggatgccccagaggatgaagct

SEQ ID NO: 137100 - DNA, 25 bp, Mus musculus
tccggattactaaagctgatgctgc

SEQ ID NO: 137101 - DNA, 25 bp, Mus musculus
tccggcaactgcagtcaatggcttt

SEQ ID NO: 137102 - DNA, 25 bp, Mus musculus
tccggcaactttggagagccctgtt

SEQ ID NO: 137103 - DNA, 25 bp, Mus musculus
tccggcattagacgtgagcgctcag

SEQ ID NO: 137104 - DNA, 25 bp, Mus musculus
tccggcatttgaatcgcgcttccgc

SEQ ID NO: 137105 - DNA, 25 bp, Mus musculus
tccggccacaagaagttaaaaagca

SEQ ID NO: 137106 - DNA, 25 bp, Mus musculus
tccggccaggaatggtgcctatcag

SEQ ID NO: 137107 - DNA, 25 bp, Mus musculus
tccggccatgtgtctcaattgaagg

SEQ ID NO: 137108 - DNA, 25 bp, Mus musculus
tccggccctgatccctttgaaccct

SEQ ID NO: 137109 - DNA, 25 bp, Mus musculus
tccggcctggaatgtgaagtgactc

SEQ ID NO: 137110 - DNA, 25 bp, Mus musculus
tccggccttgatccccgaagggact

SEQ ID NO: 137111 - DNA, 25 bp, Mus musculus
tccggcgaaggagtgcaaggaaatc

SEQ ID NO: 137112 - DNA, 25 bp, Mus musculus
tccggcgatgacgaggaaactcagt

SEQ ID NO: 137113 - DNA, 25 bp, Mus musculus
tccggcgcaccatgcagaacctgga

SEQ ID NO: 137114 - DNA, 25 bp, Mus musculus
tccggcgcgtccagagtccgcggta

SEQ ID NO: 137115 - DNA, 25 bp, Mus musculus
tccggcggacgatgagttataccag

SEQ ID NO: 137116 - DNA, 25 bp, Mus musculus
tccggcggatggtcacaagtttctt

SEQ ID NO: 137117 - DNA, 25 bp, Mus musculus
tccggcgggtccatgaactccgtgt

SEQ ID NO: 137118 - DNA, 25 bp, Mus musculus
tccggctaagttgggaaggaagcta

SEQ ID NO: 137119 - DNA, 25 bp, Mus musculus
tccggctacttagtcggcacactaa

SEQ ID NO: 137120 - DNA, 25 bp, Mus musculus
tccggctcaaacctgtgctccagtt

SEQ ID NO: 137121 - DNA, 25 bp, Mus musculus
tccggctcaagcattgccctactgt

SEQ ID NO: 137122 - DNA, 25 bp, Mus musculus
tccggctccacaaaggcagacagat

SEQ ID NO: 137123 - DNA, 25 bp, Mus musculus
tccggctcctgcgtcaagatatagt

SEQ ID NO: 137124 - DNA, 25 bp, Mus musculus
tccggctcggaaatacgtgaacgcg

SEQ ID NO: 137125 - DNA, 25 bp, Mus musculus
tccggctctggcgaaactcgttcaa

SEQ ID NO: 137126 - DNA, 25 bp, Mus musculus
tccggctgcgggaatgctaaagcgt

SEQ ID NO: 137127 - DNA, 25 bp, Mus musculus
tccggctgcgtctcctggatcttga

SEQ ID NO: 137128 - DNA, 25 bp, Mus musculus
tccggctgtcaagtggagctgatcc

SEQ ID NO: 137129 - DNA, 25 bp, Mus musculus
tccggctttggcatcggcatgcgca

SEQ ID NO: 137130 - DNA, 25 bp, Mus musculus
tccgggaaaagcaactccaggagcg

SEQ ID NO: 137131 - DNA, 25 bp, Mus musculus
tccgggaaaagcacaacattcgtct

SEQ ID NO: 137132 - DNA, 25 bp, Mus musculus
tccgggaacccgctcgtgtacttgg

SEQ ID NO: 137133 - DNA, 25 bp, Mus musculus
tccgggaagcccatgaagtcatcct

SEQ ID NO: 137134 - DNA, 25 bp, Mus musculus
tccgggaaggtcgaaccaaggctgt

SEQ ID NO: 137135 - DNA, 25 bp, Mus musculus
tccgggaattcctgcacaagggact

SEQ ID NO: 137136 - DNA, 25 bp, Mus musculus
tccgggacacgtatcgtcaagagcg

SEQ ID NO: 137137 - DNA, 25 bp, Mus musculus
tccgggacagagtcattaaagcatc

SEQ ID NO: 137138 - DNA, 25 bp, Mus musculus
tccgggagaagatccaactactggg

SEQ ID NO: 137139 - DNA, 25 bp, Mus musculus
tccgggagacaaagggccctgtcgt

SEQ ID NO: 137140 - DNA, 25 bp, Mus musculus
tccgggagatgcacgaagctcagtt

SEQ ID NO: 137141 - DNA, 25 bp, Mus musculus
tccgggagcttgaacggcagctatc

SEQ ID NO: 137142 - DNA, 25 bp, Mus musculus
tccgggaggtatgcacaatttgtcc

SEQ ID NO: 137143 - DNA, 25 bp, Mus musculus
tccgggagtccgtggagatcatcaa

SEQ ID NO: 137144 - DNA, 25 bp, Mus musculus
tccgggataacaacctggagctggt

SEQ ID NO: 137145 - DNA, 25 bp, Mus musculus
tccgggcagccagaagcagtatgtg

SEQ ID NO: 137146 - DNA, 25 bp, Mus musculus
tccgggcaggaagaagtctcagatc

SEQ ID NO: 137147 - DNA, 25 bp, Mus musculus
tccgggcagtgcacgagaaagtcaa

SEQ ID NO: 137148 - DNA, 25 bp, Mus musculus
tccgggcggccaatgagaagtacgc

SEQ ID NO: 137149 - DNA, 25 bp, Mus musculus
tccgggcggtcctcgatcagtgttg

SEQ ID NO: 137150 - DNA, 25 bp, Mus musculus
tccgggctaaattctggcttggcgg

SEQ ID NO: 137151 - DNA, 25 bp, Mus musculus
tccgggctacttcaccttcagggtt

SEQ ID NO: 137152 - DNA, 25 bp, Mus musculus
tccgggcttgcattctggagatggt

SEQ ID NO: 137153 - DNA, 25 bp, Mus musculus
tccggggctcccagcgctataaaaa

SEQ ID NO: 137154 - DNA, 25 bp, Mus musculus
tccgggtaaaatagcagtcgaaggc

SEQ ID NO: 137155 - DNA, 25 bp, Mus musculus
tccgggtaccaacgctattaaagct

SEQ ID NO: 137156 - DNA, 25 bp, Mus musculus
tccgggtacccatggccagttgtga

SEQ ID NO: 137157 - DNA, 25 bp, Mus musculus
tccgggtcacgtggataaccagtct

SEQ ID NO: 137158 - DNA, 25 bp, Mus musculus
tccgggtccaggaacttccgagcgg

SEQ ID NO: 137159 - DNA, 25 bp, Mus musculus
tccgggtgcagcttcgtgagcagta

SEQ ID NO: 137160 - DNA, 25 bp, Mus musculus
tccgggtggatatcagagacctcct

SEQ ID NO: 137161 - DNA, 25 bp, Mus musculus
tccgggtgtgatacgccttcttgac

SEQ ID NO: 137162 - DNA, 25 bp, Mus musculus
tccggtacccgagacagatgctgtg

SEQ ID NO: 137163 - DNA, 25 bp, Mus musculus
tccggtacgatgctgtgacaattaa

SEQ ID NO: 137164 - DNA, 25 bp, Mus musculus
tccggtcttcgagccgagctgggaa

SEQ ID NO: 137165 - DNA, 25 bp, Mus musculus
tccggtgaatacaagaaggctctgc

SEQ ID NO: 137166 - DNA, 25 bp, Mus musculus
tccggtgcacccttttcgtcaatgg

SEQ ID NO: 137167 - DNA, 25 bp, Mus musculus
tccggtgcaggactgcgcgggctca

SEQ ID NO: 137168 - DNA, 25 bp, Mus musculus
tccggtgcgcgaggagaagctatca

SEQ ID NO: 137169 - DNA, 25 bp, Mus musculus
tccggtggagccttgcgaaggttcc

SEQ ID NO: 137170 - DNA, 25 bp, Mus musculus
tccggtggccagactttaaccagga

SEQ ID NO: 137171 - DNA, 25 bp, Mus musculus
tccggtggtgcaatcaatggaggcc

SEQ ID NO: 137172 - DNA, 25 bp, Mus musculus
tccggttatagagaagcagatgtgc

SEQ ID NO: 137173 - DNA, 25 bp, Mus musculus
tccggttccgagacaagcgctttgc

SEQ ID NO: 137174 - DNA, 25 bp, Mus musculus
tccggttctgaggtatcgggcacca

SEQ ID NO: 137175 - DNA, 25 bp, Mus musculus
tccggttgaaagacaagcatgcagg

SEQ ID NO: 137176 - DNA, 25 bp, Mus musculus
tccgtaactgttcccgctgggtctg

SEQ ID NO: 137177 - DNA, 25 bp, Mus musculus
tccgtaataagagcgagagccagtg

SEQ ID NO: 137178 - DNA, 25 bp, Mus musculus
tccgtacttcggtgatcacactgct

SEQ ID NO: 137179 - DNA, 25 bp, Mus musculus
tccgtagacgaggtcgggcggacct

SEQ ID NO: 137180 - DNA, 25 bp, Mus musculus
tccgtagaggagagactgcaaaagc

SEQ ID NO: 137181 - DNA, 25 bp, Mus musculus
tccgtagtgtggaaggcctgctcaa

SEQ ID NO: 137182 - DNA, 25 bp, Mus musculus
tccgtatggaatctgggcggccaca

SEQ ID NO: 137183 - DNA, 25 bp, Mus musculus
tccgtattagtacccgcaaaagccg

SEQ ID NO: 137184 - DNA, 25 bp, Mus musculus
tccgtcactgtaaggactatgtggc

SEQ ID NO: 137185 - DNA, 25 bp, Mus musculus
tccgtcccgcaagaaggatgactcg

SEQ ID NO: 137186 - DNA, 25 bp, Mus musculus
tccgtccgcgggtgccatcatggcg

SEQ ID NO: 137187 - DNA, 25 bp, Mus musculus
tccgtcctccatgaagtaaactcgt

SEQ ID NO: 137188 - DNA, 25 bp, Mus musculus
tccgtcgatgggacatctttcctga

SEQ ID NO: 137189 - DNA, 25 bp, Mus musculus
tccgtcggcccttgtaatttggaca

SEQ ID NO: 137190 - DNA, 25 bp, Mus musculus
tccgtctagccaagtatctggacag

SEQ ID NO: 137191 - DNA, 25 bp, Mus musculus
tccgtctcacggagcaagctgttga

SEQ ID NO: 137192 - DNA, 25 bp, Mus musculus
tccgtctccggcatgaccatgtgct

SEQ ID NO: 137193 - DNA, 25 bp, Mus musculus
tccgtctggtggaagtccatgaccc

SEQ ID NO: 137194 - DNA, 25 bp, Mus musculus
tccgtctttaacgtgatgaacgcca

SEQ ID NO: 137195 - DNA, 25 bp, Mus musculus
tccgtgaacgcagcaaagggcgcat

SEQ ID NO: 137196 - DNA, 25 bp, Mus musculus
tccgtgaagccgaaatgccagtcca

SEQ ID NO: 137197 - DNA, 25 bp, Mus musculus
tccgtgaaggtgatgtacaagtgcc

SEQ ID NO: 137198 - DNA, 25 bp, Mus musculus
tccgtgacatggactcagggactgt

SEQ ID NO: 137199 - DNA, 25 bp, Mus musculus
tccgtgacctagaagataaaacaga

SEQ ID NO: 137200 - DNA, 25 bp, Mus musculus
tccgtgagaagggatcatgaagcac

SEQ ID NO: 137201 - DNA, 25 bp, Mus musculus
tccgtgagacttgcagtacctgctg

SEQ ID NO: 137202 - DNA, 25 bp, Mus musculus
tccgtgagatgagggctacagagcc

SEQ ID NO: 137203 - DNA, 25 bp, Mus musculus
tccgtgaggagcaaacatagtctgt

SEQ ID NO: 137204 - DNA, 25 bp, Mus musculus
tccgtgatgccgtgtcgcaggtgct

SEQ ID NO: 137205 - DNA, 25 bp, Mus musculus
tccgtgatggaaaatgtgaacccat

SEQ ID NO: 137206 - DNA, 25 bp, Mus musculus
tccgtgcacaccaaggtcaaaggca

SEQ ID NO: 137207 - DNA, 25 bp, Mus musculus
tccgtgccagccaaatacgtggaag

SEQ ID NO: 137208 - DNA, 25 bp, Mus musculus
tccgtgcccaggatcggctcattga

SEQ ID NO: 137209 - DNA, 25 bp, Mus musculus
tccgtgctgtggcagcacgtaagaa

SEQ ID NO: 137210 - DNA, 25 bp, Mus musculus
tccgtgctgtgtgtgaagcccgacg

SEQ ID NO: 137211 - DNA, 25 bp, Mus musculus
tccgtggacttctcagagatcagcc

SEQ ID NO: 137212 - DNA, 25 bp, Mus musculus
tccgtggagaaggtcgtgctgctca

SEQ ID NO: 137213 - DNA, 25 bp, Mus musculus
tccgtggcctgacaggagtctctcc

SEQ ID NO: 137214 - DNA, 25 bp, Mus musculus
tccgtggcgacgatgttaaacaacc

SEQ ID NO: 137215 - DNA, 25 bp, Mus musculus
tccgtgggtagtcgcggcagcctaa

SEQ ID NO: 137216 - DNA, 25 bp, Mus musculus
tccgtgggtcaaagtaagggatact

SEQ ID NO: 137217 - DNA, 25 bp, Mus musculus
tccgtgggtctgaggcgctgcgagc

SEQ ID NO: 137218 - DNA, 25 bp, Mus musculus
tccgtggtatcagtgggaccactca

SEQ ID NO: 137219 - DNA, 25 bp, Mus musculus
tccgtggtcaccatgaagcggctgc

SEQ ID NO: 137220 - DNA, 25 bp, Mus musculus
tccgtgtatactccacaacagcctg

SEQ ID NO: 137221 - DNA, 25 bp, Mus musculus
tccgtgtcaggagcacaagcgaggt

SEQ ID NO: 137222 - DNA, 25 bp, Mus musculus
tccgtgtcctatggagcagggcagc

SEQ ID NO: 137223 - DNA, 25 bp, Mus musculus
tccgtgtctgacgaagaaatgatgg

SEQ ID NO: 137224 - DNA, 25 bp, Mus musculus
tccgttaaagagatagatgagctgg

SEQ ID NO: 137225 - DNA, 25 bp, Mus musculus
tccgttcacagcatctgccagctgg

SEQ ID NO: 137226 - DNA, 25 bp, Mus musculus
tccgttccgaagctgggaaaatgca

SEQ ID NO: 137227 - DNA, 25 bp, Mus musculus
tccgttcttcaggtgtcagactcca

SEQ ID NO: 137228 - DNA, 25 bp, Mus musculus
tccgttgagccgagagatcacaatg

SEQ ID NO: 137229 - DNA, 25 bp, Mus musculus
tccgttggattggacgccggaacgt

SEQ ID NO: 137230 - DNA, 25 bp, Mus musculus
tccgttgtagttggcagcagtgcag

SEQ ID NO: 137231 - DNA, 25 bp, Mus musculus
tcctaaaacactctgctaatacggt

SEQ ID NO: 137232 - DNA, 25 bp, Mus musculus
tcctaaaagggccaaagccatgaaa

SEQ ID NO: 137233 - DNA, 25 bp, Mus musculus
tcctaaatttgacccaggccctgaa

SEQ ID NO: 137234 - DNA, 25 bp, Mus musculus
tcctaacaccgcagtggacatctca

SEQ ID NO: 137235 - DNA, 25 bp, Mus musculus
tcctaacagccaatggagccgtggg

SEQ ID NO: 137236 - DNA, 25 bp, Mus musculus
tcctaactaaatcctgactggtact

SEQ ID NO: 137237 - DNA, 25 bp, Mus musculus
tcctaactatgatacagagggaagc

SEQ ID NO: 137238 - DNA, 25 bp, Mus musculus
tcctaagaagagatgtgggacttcc

SEQ ID NO: 137239 - DNA, 25 bp, Mus musculus
tcctaagaagtctccggtgcactcc

SEQ ID NO: 137240 - DNA, 25 bp, Mus musculus
tcctaagagcagcaatggaaaagcc

SEQ ID NO: 137241 - DNA, 25 bp, Mus musculus
tcctaagaggagacccgctgtgaag

SEQ ID NO: 137242 - DNA, 25 bp, Mus musculus
tcctaagcagaagcctatagaaggt

SEQ ID NO: 137243 - DNA, 25 bp, Mus musculus
tcctaagccacattgggaagctgct

SEQ ID NO: 137244 - DNA, 25 bp, Mus musculus
tcctaagggcatgtccaaaggatgc

SEQ ID NO: 137245 - DNA, 25 bp, Mus musculus
tcctaagggtttgcctggagcgata

SEQ ID NO: 137246 - DNA, 25 bp, Mus musculus
tcctaagtgcgagtaggtttgaaac

SEQ ID NO: 137247 - DNA, 25 bp, Mus musculus
tcctaagtggactggaagcacccgt

SEQ ID NO: 137248 - DNA, 25 bp, Mus musculus
tcctaatccctatgaagtcactatg

SEQ ID NO: 137249 - DNA, 25 bp, Mus musculus
tcctaattccggtagcagagggcat

SEQ ID NO: 137250 - DNA, 25 bp, Mus musculus
tcctaattggaggagagggaccaaa

SEQ ID NO: 137251 - DNA, 25 bp, Mus musculus
tcctaatttcttccgcaagggccag

SEQ ID NO: 137252 - DNA, 25 bp, Mus musculus
tcctacaagcccgtgatcgtggtgc

SEQ ID NO: 137253 - DNA, 25 bp, Mus musculus
tcctacaaggatcggcactggcatg

SEQ ID NO: 137254 - DNA, 25 bp, Mus musculus
tcctacaagggactagatctgggcg

SEQ ID NO: 137255 - DNA, 25 bp, Mus musculus
tcctacaaggtagcccacagtgatg

SEQ ID NO: 137256 - DNA, 25 bp, Mus musculus
tcctacaggagaacaggatcgaccc

SEQ ID NO: 137257 - DNA, 25 bp, Mus musculus
tcctacagggagtctacaagcggtc

SEQ ID NO: 137258 - DNA, 25 bp, Mus musculus
tcctacagggtcacatgttgaatgg

SEQ ID NO: 137259 - DNA, 25 bp, Mus musculus
tcctacagtacccttcgagcacatg

SEQ ID NO: 137260 - DNA, 25 bp, Mus musculus
tcctacatagtctggaaagagctgg

SEQ ID NO: 137261 - DNA, 25 bp, Mus musculus
tcctaccagcaatagcagagctgct

SEQ ID NO: 137262 - DNA, 25 bp, Mus musculus
tcctacccaggttcaagcagtccga

SEQ ID NO: 137263 - DNA, 25 bp, Mus musculus
tcctaccggatgtggatcgaaaaca

SEQ ID NO: 137264 - DNA, 25 bp, Mus musculus
tcctaccggctagcagcagaaacgt

SEQ ID NO: 137265 - DNA, 25 bp, Mus musculus
tcctacctcatctgtggaggccgag

SEQ ID NO: 137266 - DNA, 25 bp, Mus musculus
tcctacctggaaaagtgtctgcagc

SEQ ID NO: 137267 - DNA, 25 bp, Mus musculus
tcctacgacagttttggagaaccct

SEQ ID NO: 137268 - DNA, 25 bp, Mus musculus
tcctacgatcgggtgacaaagccaa

SEQ ID NO: 137269 - DNA, 25 bp, Mus musculus
tcctacggactacggtgaaagtgcc

SEQ ID NO: 137270 - DNA, 25 bp, Mus musculus
tcctacggctctgttggctcacgaa

SEQ ID NO: 137271 - DNA, 25 bp, Mus musculus
tcctacgtgatcacagacctgacac

SEQ ID NO: 137272 - DNA, 25 bp, Mus musculus
tcctactacaaaactgagggcgagg

SEQ ID NO: 137273 - DNA, 25 bp, Mus musculus
tcctactatggtgtgatggccctca

SEQ ID NO: 137274 - DNA, 25 bp, Mus musculus
tcctactcaggagacgtgactgctg

SEQ ID NO: 137275 - DNA, 25 bp, Mus musculus
tcctactccaggaagagatcgtgcc

SEQ ID NO: 137276 - DNA, 25 bp, Mus musculus
tcctactcttggcattgcacggaca

SEQ ID NO: 137277 - DNA, 25 bp, Mus musculus
tcctactgcaatgacgtggtgtgcg

SEQ ID NO: 137278 - DNA, 25 bp, Mus musculus
tcctactgtggaagcactgggcctc

SEQ ID NO: 137279 - DNA, 25 bp, Mus musculus
tcctactttgactgagcaggcgtgg

SEQ ID NO: 137280 - DNA, 25 bp, Mus musculus
tcctagaactgctggaactgttgtt

SEQ ID NO: 137281 - DNA, 25 bp, Mus musculus
tcctagaagctctggcgagtgctct

SEQ ID NO: 137282 - DNA, 25 bp, Mus musculus
tcctagaatcaagtgcccaagtgtg

SEQ ID NO: 137283 - DNA, 25 bp, Mus musculus
tcctagacaaggatgacctggccct

SEQ ID NO: 137284 - DNA, 25 bp, Mus musculus
tcctagacaccctgaagacaccagt

SEQ ID NO: 137285 - DNA, 25 bp, Mus musculus
tcctagactgcaaactgggtgggcc

SEQ ID NO: 137286 - DNA, 25 bp, Mus musculus
tcctagaggacttctgctcgccgag

SEQ ID NO: 137287 - DNA, 25 bp, Mus musculus
tcctagaggcactgagacagagacc

SEQ ID NO: 137288 - DNA, 25 bp, Mus musculus
tcctagataagacgtgctccagctt

SEQ ID NO: 137289 - DNA, 25 bp, Mus musculus
tcctagatgatcgaaaggccacagt

SEQ ID NO: 137290 - DNA, 25 bp, Mus musculus
tcctagatgatgtgtgggcgcgcac

SEQ ID NO: 137291 - DNA, 25 bp, Mus musculus
tcctagcagatcagggcaagagctt

SEQ ID NO: 137292 - DNA, 25 bp, Mus musculus
tcctagccacggagcaaagcaagct

SEQ ID NO: 137293 - DNA, 25 bp, Mus musculus
tcctagccagccagtcagtgggaaa

SEQ ID NO: 137294 - DNA, 25 bp, Mus musculus
tcctagccgaggaagggtaaccaca

SEQ ID NO: 137295 - DNA, 25 bp, Mus musculus
tcctagcctaggttctgagtgcatg

SEQ ID NO: 137296 - DNA, 25 bp, Mus musculus
tcctaggagactcagaagagccctc

SEQ ID NO: 137297 - DNA, 25 bp, Mus musculus
tcctaggagcactctggatgaagtc

SEQ ID NO: 137298 - DNA, 25 bp, Mus musculus
tcctaggaggtataagcagcagatg

SEQ ID NO: 137299 - DNA, 25 bp, Mus musculus
tcctaggatctagcaggcgctgaag

SEQ ID NO: 137300 - DNA, 25 bp, Mus musculus
tcctaggcgatagtgggcaagtctt

SEQ ID NO: 137301 - DNA, 25 bp, Mus musculus
tcctagggaccacagctctttggca

SEQ ID NO: 137302 - DNA, 25 bp, Mus musculus
tcctagggacccagggaaaggctgt

SEQ ID NO: 137303 - DNA, 25 bp, Mus musculus
tcctagggcctctatcagtcactca

SEQ ID NO: 137304 - DNA, 25 bp, Mus musculus
tcctagtaaaagttcacgtgccttc

SEQ ID NO: 137305 - DNA, 25 bp, Mus musculus
tcctagtaaggatgcagccgagcac

SEQ ID NO: 137306 - DNA, 25 bp, Mus musculus
tcctagtccagtcataagaagtact

SEQ ID NO: 137307 - DNA, 25 bp, Mus musculus
tcctagtctacaaggcatagcggtg

SEQ ID NO: 137308 - DNA, 25 bp, Mus musculus
tcctagtggcctgtgacgtctgctt

SEQ ID NO: 137309 - DNA, 25 bp, Mus musculus
tcctataaaaggcacacgcgggcat

SEQ ID NO: 137310 - DNA, 25 bp, Mus musculus
tcctataaggccaagcgctggatct

SEQ ID NO: 137311 - DNA, 25 bp, Mus musculus
tcctataatggtgaatgacgtgggc

SEQ ID NO: 137312 - DNA, 25 bp, Mus musculus
tcctatctagaaccagggagctcag

SEQ ID NO: 137313 - DNA, 25 bp, Mus musculus
tcctatctgaaggtgggacccagag

SEQ ID NO: 137314 - DNA, 25 bp, Mus musculus
tcctatgaaaacgagccagtgggca

SEQ ID NO: 137315 - DNA, 25 bp, Mus musculus
tcctatgccagtgttgcaggttccg

SEQ ID NO: 137316 - DNA, 25 bp, Mus musculus
tcctatggaggatgtaccagcggct

SEQ ID NO: 137317 - DNA, 25 bp, Mus musculus
tcctatggagtgctgctgtgaaccc

SEQ ID NO: 137318 - DNA, 25 bp, Mus musculus
tcctatggctcaaggccgatggcaa

SEQ ID NO: 137319 - DNA, 25 bp, Mus musculus
tcctatgggaacagtcgaagtacgc

SEQ ID NO: 137320 - DNA, 25 bp, Mus musculus
tcctatggtacaagaacagtctgcc

SEQ ID NO: 137321 - DNA, 25 bp, Mus musculus
tcctattgacaatgtgagctcctct

SEQ ID NO: 137322 - DNA, 25 bp, Mus musculus
tcctcaaagctgtgggatatccgag

SEQ ID NO: 137323 - DNA, 25 bp, Mus musculus
tcctcaaatgagacccagtgggaag

SEQ ID NO: 137324 - DNA, 25 bp, Mus musculus
tcctcaagagaagagctgcaagcag

SEQ ID NO: 137325 - DNA, 25 bp, Mus musculus
tcctcaagcagctgaaatttgcaga

SEQ ID NO: 137326 - DNA, 25 bp, Mus musculus
tcctcaagcgagaattccagaaggg

SEQ ID NO: 137327 - DNA, 25 bp, Mus musculus
tcctcaaggattacaggactctgac

SEQ ID NO: 137328 - DNA, 25 bp, Mus musculus
tcctcaagtctcaacgggactcgaa

SEQ ID NO: 137329 - DNA, 25 bp, Mus musculus
tcctcaagtgcaaggcagtgtctcg

SEQ ID NO: 137330 - DNA, 25 bp, Mus musculus
tcctcaagtggcgaatcctgtcggc

SEQ ID NO: 137331 - DNA, 25 bp, Mus musculus
tcctcaatgctggttcctggtactg

SEQ ID NO: 137332 - DNA, 25 bp, Mus musculus
tcctcacaaggcaaggtatgggtgc

SEQ ID NO: 137333 - DNA, 25 bp, Mus musculus
tcctcacatcaatgcactgccaatg

SEQ ID NO: 137334 - DNA, 25 bp, Mus musculus
tcctcaccaacaacagtctagtgga

SEQ ID NO: 137335 - DNA, 25 bp, Mus musculus
tcctcaccagatcagccagatttac

SEQ ID NO: 137336 - DNA, 25 bp, Mus musculus
tcctcacgagacagagctggttggc

SEQ ID NO: 137337 - DNA, 25 bp, Mus musculus
tcctcacggtgatgtcaatggcagc

SEQ ID NO: 137338 - DNA, 25 bp, Mus musculus
tcctcactaagctggctgtgaagat

SEQ ID NO: 137339 - DNA, 25 bp, Mus musculus
tcctcacttcttgggagaccatggt

SEQ ID NO: 137340 - DNA, 25 bp, Mus musculus
tcctcagaagctggtgactgctaac

SEQ ID NO: 137341 - DNA, 25 bp, Mus musculus
tcctcagaatcatgatagaatgcat

SEQ ID NO: 137342 - DNA, 25 bp, Mus musculus
tcctcagaccagatcgagaacatgg

SEQ ID NO: 137343 - DNA, 25 bp, Mus musculus
tcctcagagctctccagtgctgtcg

SEQ ID NO: 137344 - DNA, 25 bp, Mus musculus
tcctcagagggaatcagcagcttcc

SEQ ID NO: 137345 - DNA, 25 bp, Mus musculus
tcctcagagggcgtttcccttcgtt

SEQ ID NO: 137346 - DNA, 25 bp, Mus musculus
tcctcagataccaatgatgttggca

SEQ ID NO: 137347 - DNA, 25 bp, Mus musculus
tcctcagctctgaccgaatagtctg

SEQ ID NO: 137348 - DNA, 25 bp, Mus musculus
tcctcaggaggcctggtagaagcct

SEQ ID NO: 137349 - DNA, 25 bp, Mus musculus
tcctcaggaggcttgaatgctgcca

SEQ ID NO: 137350 - DNA, 25 bp, Mus musculus
tcctcagggctccagtcaggccgag

SEQ ID NO: 137351 - DNA, 25 bp, Mus musculus
tcctcagggttttccagccaatgtt

SEQ ID NO: 137352 - DNA, 25 bp, Mus musculus
tcctcaggtataagccacggctgca

SEQ ID NO: 137353 - DNA, 25 bp, Mus musculus
tcctcaggtgtacatggacatcaag

SEQ ID NO: 137354 - DNA, 25 bp, Mus musculus
tcctcagtatggcagggttcaaccc

SEQ ID NO: 137355 - DNA, 25 bp, Mus musculus
tcctcagtgagcaagccatgtcgtc

SEQ ID NO: 137356 - DNA, 25 bp, Mus musculus
tcctcagtgcggaggctcagagcct

SEQ ID NO: 137357 - DNA, 25 bp, Mus musculus
tcctcagtggtctggcaagccgttc

SEQ ID NO: 137358 - DNA, 25 bp, Mus musculus
tcctcagtgtcatctgtaggtggct

SEQ ID NO: 137359 - DNA, 25 bp, Mus musculus
tcctcataaaattggccgggtcata

SEQ ID NO: 137360 - DNA, 25 bp, Mus musculus
tcctcatactagcaggcagcctgct

SEQ ID NO: 137361 - DNA, 25 bp, Mus musculus
tcctcatccgagcaacacatgtggg

SEQ ID NO: 137362 - DNA, 25 bp, Mus musculus
tcctcatcgcggtggcaggactggt

SEQ ID NO: 137363 - DNA, 25 bp, Mus musculus
tcctcatgagcacagcggaagacag

SEQ ID NO: 137364 - DNA, 25 bp, Mus musculus
tcctcatgagggtgctggactccta

SEQ ID NO: 137365 - DNA, 25 bp, Mus musculus
tcctcattagggacagcgagtcctc

SEQ ID NO: 137366 - DNA, 25 bp, Mus musculus
tcctcattttgctgggtgctcaccg

SEQ ID NO: 137367 - DNA, 25 bp, Mus musculus
tcctccaaagaaacggaaaatcctg

SEQ ID NO: 137368 - DNA, 25 bp, Mus musculus
tcctccaaagagtgttcctgcagct

SEQ ID NO: 137369 - DNA, 25 bp, Mus musculus
tcctccaaggaatacgtgtgagctg

SEQ ID NO: 137370 - DNA, 25 bp, Mus musculus
tcctccaagtcccaagctgctgggt

SEQ ID NO: 137371 - DNA, 25 bp, Mus musculus
tcctccaagttggtcctatccaggg

SEQ ID NO: 137372 - DNA, 25 bp, Mus musculus
tcctccaatcccacgggagcagaat

SEQ ID NO: 137373 - DNA, 25 bp, Mus musculus
tcctccacagaggaactggaaagga

SEQ ID NO: 137374 - DNA, 25 bp, Mus musculus
tcctccagagagaagtggtgcagtc

SEQ ID NO: 137375 - DNA, 25 bp, Mus musculus
tcctccaggaaaaagtcggaagatt

SEQ ID NO: 137376 - DNA, 25 bp, Mus musculus
tcctccaggagaagttagcatcaga

SEQ ID NO: 137377 - DNA, 25 bp, Mus musculus
tcctccaggagtgcaacaagcaggg

SEQ ID NO: 137378 - DNA, 25 bp, Mus musculus
tcctcccagaactgcttttccagag

SEQ ID NO: 137379 - DNA, 25 bp, Mus musculus
tcctcccagctcaggacagatctga

SEQ ID NO: 137380 - DNA, 25 bp, Mus musculus
tcctccgaggcacacagtcggctgt

SEQ ID NO: 137381 - DNA, 25 bp, Mus musculus
tcctccgagtacatttttgaacggg

SEQ ID NO: 137382 - DNA, 25 bp, Mus musculus
tcctccgatcgaaatggcacattga

SEQ ID NO: 137383 - DNA, 25 bp, Mus musculus
tcctccggcgaagggacatcaagaa

SEQ ID NO: 137384 - DNA, 25 bp, Mus musculus
tcctccggctggaagagaactgcct

SEQ ID NO: 137385 - DNA, 25 bp, Mus musculus
tcctccgtcagcagaatgggcctag

SEQ ID NO: 137386 - DNA, 25 bp, Mus musculus
tcctcctaagaagagagcacggtgt

SEQ ID NO: 137387 - DNA, 25 bp, Mus musculus
tcctcctcattctctacccagttgt

SEQ ID NO: 137388 - DNA, 25 bp, Mus musculus
tcctcctcctattgaatcacacaat

SEQ ID NO: 137389 - DNA, 25 bp, Mus musculus
tcctcctctctacaacaagaaaaaa

SEQ ID NO: 137390 - DNA, 25 bp, Mus musculus
tcctcctgtggagtgaatgcagaca

SEQ ID NO: 137391 - DNA, 25 bp, Mus musculus
tcctcgaagagattaaggccatggc

SEQ ID NO: 137392 - DNA, 25 bp, Mus musculus
tcctcgaagcacattcctggacaag

SEQ ID NO: 137393 - DNA, 25 bp, Mus musculus
tcctcgaaggacaagaaatcagtgg

SEQ ID NO: 137394 - DNA, 25 bp, Mus musculus
tcctcgaaggctcatgacagtgctt

SEQ ID NO: 137395 - DNA, 25 bp, Mus musculus
tcctcgacaggagaccaagtgttcc

SEQ ID NO: 137396 - DNA, 25 bp, Mus musculus
tcctcgagcgggacaaacaggagac

SEQ ID NO: 137397 - DNA, 25 bp, Mus musculus
tcctcgagctgttgaagataccctg

SEQ ID NO: 137398 - DNA, 25 bp, Mus musculus
tcctcgagggtcgactcaaacagac

SEQ ID NO: 137399 - DNA, 25 bp, Mus musculus
tcctcgaggtccttggccgtgagag

SEQ ID NO: 137400 - DNA, 25 bp, Mus musculus
tcctcgatgacctgaataaaaatat

SEQ ID NO: 137401 - DNA, 25 bp, Mus musculus
tcctcgatgtaatagcgctgaagca

SEQ ID NO: 137402 - DNA, 25 bp, Mus musculus
tcctcgcactgttgaaggcgcttgc

SEQ ID NO: 137403 - DNA, 25 bp, Mus musculus
tcctcgccctagtggacatgacaat

SEQ ID NO: 137404 - DNA, 25 bp, Mus musculus
tcctcgccggaaggagacagatcct

SEQ ID NO: 137405 - DNA, 25 bp, Mus musculus
tcctcgcctgccagtggaaaaacaa

SEQ ID NO: 137406 - DNA, 25 bp, Mus musculus
tcctcgctggaaaaagaagtgggca

SEQ ID NO: 137407 - DNA, 25 bp, Mus musculus
tcctcggaccagatagagcagctgc

SEQ ID NO: 137408 - DNA, 25 bp, Mus musculus
tcctcggactagcttgagagcaaca

SEQ ID NO: 137409 - DNA, 25 bp, Mus musculus
tcctcggaggagtcaagtgttacct

SEQ ID NO: 137410 - DNA, 25 bp, Mus musculus
tcctcggagttacaaaagatgctgg

SEQ ID NO: 137411 - DNA, 25 bp, Mus musculus
tcctcggcactactgacaatggcat

SEQ ID NO: 137412 - DNA, 25 bp, Mus musculus
tcctcggctgagtttcagaacgcac

SEQ ID NO: 137413 - DNA, 25 bp, Mus musculus
tcctcgggaaccctatggccaatgc

SEQ ID NO: 137414 - DNA, 25 bp, Mus musculus
tcctcgggaacctcgaacagtttgg

SEQ ID NO: 137415 - DNA, 25 bp, Mus musculus
tcctcgggcagtatgagagcctgtc

SEQ ID NO: 137416 - DNA, 25 bp, Mus musculus
tcctcgggcgcattgtaaagcagtt

SEQ ID NO: 137417 - DNA, 25 bp, Mus musculus
tcctcgggctggtgacttcagcaag

SEQ ID NO: 137418 - DNA, 25 bp, Mus musculus
tcctcgggctttgtcatcgcatgca

SEQ ID NO: 137419 - DNA, 25 bp, Mus musculus
tcctcgtagaggatgaagaccacct

SEQ ID NO: 137420 - DNA, 25 bp, Mus musculus
tcctcgtgacgatgggcatgagccg

SEQ ID NO: 137421 - DNA, 25 bp, Mus musculus
tcctcgtgctaagctggatccgtgt

SEQ ID NO: 137422 - DNA, 25 bp, Mus musculus
tcctcgtgctctgcttatggcgttg

SEQ ID NO: 137423 - DNA, 25 bp, Mus musculus
tcctcgtggcagagcaaaagctgct

SEQ ID NO: 137424 - DNA, 25 bp, Mus musculus
tcctcgtggccatggagtgtccgca

SEQ ID NO: 137425 - DNA, 25 bp, Mus musculus
tcctcgtgggcacagccatctggta

SEQ ID NO: 137426 - DNA, 25 bp, Mus musculus
tcctcgtttgaagatgtagatgcgt

SEQ ID NO: 137427 - DNA, 25 bp, Mus musculus
tcctctacacataccagaaactggg

SEQ ID NO: 137428 - DNA, 25 bp, Mus musculus
tcctctacagggagtggtatgggta

SEQ ID NO: 137429 - DNA, 25 bp, Mus musculus
tcctctacttccctggggacgtgca

SEQ ID NO: 137430 - DNA, 25 bp, Mus musculus
tcctctagaatggaaccccaagggc

SEQ ID NO: 137431 - DNA, 25 bp, Mus musculus
tcctctagacagttagcctgggtgg

SEQ ID NO: 137432 - DNA, 25 bp, Mus musculus
tcctctagaggaagggaatgcaagt

SEQ ID NO: 137433 - DNA, 25 bp, Mus musculus
tcctctaggtgctcagtggtgtctg

SEQ ID NO: 137434 - DNA, 25 bp, Mus musculus
tcctctcaggagacgcatgacagtc

SEQ ID NO: 137435 - DNA, 25 bp, Mus musculus
tcctctcggaatacagtgctgtggc

SEQ ID NO: 137436 - DNA, 25 bp, Mus musculus
tcctctcggagagtggcagtggcaa

SEQ ID NO: 137437 - DNA, 25 bp, Mus musculus
tcctctcggatggttaaagcagtct

SEQ ID NO: 137438 - DNA, 25 bp, Mus musculus
tcctctcgtccgtaactgtgaactg

SEQ ID NO: 137439 - DNA, 25 bp, Mus musculus
tcctctctacaaaagtgcgatcaca

SEQ ID NO: 137440 - DNA, 25 bp, Mus musculus
tcctctctgaggtggtagaagaccg

SEQ ID NO: 137441 - DNA, 25 bp, Mus musculus
tcctctgcctgttctcgggcttgca

SEQ ID NO: 137442 - DNA, 25 bp, Mus musculus
tcctctgcggatgaggtgaacacct

SEQ ID NO: 137443 - DNA, 25 bp, Mus musculus
tcctctggcagctggaatgatagcc

SEQ ID NO: 137444 - DNA, 25 bp, Mus musculus
tcctctgggatgagaagtacggcca

SEQ ID NO: 137445 - DNA, 25 bp, Mus musculus
tcctctgtagctgggtttgatgaac

SEQ ID NO: 137446 - DNA, 25 bp, Mus musculus
tcctcttacgtctgtaccttgaaag

SEQ ID NO: 137447 - DNA, 25 bp, Mus musculus
tcctcttcagaattgggtgtttgct

SEQ ID NO: 137448 - DNA, 25 bp, Mus musculus
tcctcttgaatctctgacagggcgg

SEQ ID NO: 137449 - DNA, 25 bp, Mus musculus
tcctcttgctaacgagaagccgcgg

SEQ ID NO: 137450 - DNA, 25 bp, Mus musculus
tcctcttggaaaatagggccgtgcg

SEQ ID NO: 137451 - DNA, 25 bp, Mus musculus
tcctcttggaatttgtagcctcaca

SEQ ID NO: 137452 - DNA, 25 bp, Mus musculus
tcctcttgggcaaggtgatgggcaa

SEQ ID NO: 137453 - DNA, 25 bp, Mus musculus
tcctcttggtgtgggagagacacgc

SEQ ID NO: 137454 - DNA, 25 bp, Mus musculus
tcctctttcctcactatgaagaagg

SEQ ID NO: 137455 - DNA, 25 bp, Mus musculus
tcctctttggagatgtgccggccag

SEQ ID NO: 137456 - DNA, 25 bp, Mus musculus
tcctgaaaaagacggacagcccatc

SEQ ID NO: 137457 - DNA, 25 bp, Mus musculus
tcctgaaagacatgccagggctgcc

SEQ ID NO: 137458 - DNA, 25 bp, Mus musculus
tcctgaaagcagtttagtccatatg

SEQ ID NO: 137459 - DNA, 25 bp, Mus musculus
tcctgaaagttcacctgctgggcca

SEQ ID NO: 137460 - DNA, 25 bp, Mus musculus
tcctgaaataccctcccgaagaagt

SEQ ID NO: 137461 - DNA, 25 bp, Mus musculus
tcctgaacatcccagcttagaggat

SEQ ID NO: 137462 - DNA, 25 bp, Mus musculus
tcctgaacccgaagtgagcatgcgc

SEQ ID NO: 137463 - DNA, 25 bp, Mus musculus
tcctgaacctaaagagcagcggcag

SEQ ID NO: 137464 - DNA, 25 bp, Mus musculus
tcctgaactatccagtcctgaggga

SEQ ID NO: 137465 - DNA, 25 bp, Mus musculus
tcctgaacttgagcgggaaggtgct

SEQ ID NO: 137466 - DNA, 25 bp, Mus musculus
tcctgaagacctgctaagtgcgcct

SEQ ID NO: 137467 - DNA, 25 bp, Mus musculus
tcctgaagacctggaccgcgtgtat

SEQ ID NO: 137468 - DNA, 25 bp, Mus musculus
tcctgaagagccgatggaagttcag

SEQ ID NO: 137469 - DNA, 25 bp, Mus musculus
tcctgaagcagggtattgagacccc

SEQ ID NO: 137470 - DNA, 25 bp, Mus musculus
tcctgaagcggctgcgatggaacct

SEQ ID NO: 137471 - DNA, 25 bp, Mus musculus
tcctgaagcgggaaggcaacaagct

SEQ ID NO: 137472 - DNA, 25 bp, Mus musculus
tcctgaaggagtacaagctggttcc

SEQ ID NO: 137473 - DNA, 25 bp, Mus musculus
tcctgaaggatgctcgccatgactg

SEQ ID NO: 137474 - DNA, 25 bp, Mus musculus
tcctgaaggcactggtagtagggac

SEQ ID NO: 137475 - DNA, 25 bp, Mus musculus
tcctgaaggtcaaccagatcggctc

SEQ ID NO: 137476 - DNA, 25 bp, Mus musculus
tcctgaatacatgacactgtggcgg

SEQ ID NO: 137477 - DNA, 25 bp, Mus musculus
tcctgaatcagcacacaagcttagg

SEQ ID NO: 137478 - DNA, 25 bp, Mus musculus
tcctgaatcccaagtgccgtgatgt

SEQ ID NO: 137479 - DNA, 25 bp, Mus musculus
tcctgaatgccaacgttgctgagct

SEQ ID NO: 137480 - DNA, 25 bp, Mus musculus
tcctgaatgggagtggcagacctgc

SEQ ID NO: 137481 - DNA, 25 bp, Mus musculus
tcctgacacttgatgcctttgctga

SEQ ID NO: 137482 - DNA, 25 bp, Mus musculus
tcctgacagacttcctgggagccgt

SEQ ID NO: 137483 - DNA, 25 bp, Mus musculus
tcctgacaggcgtacacactgtcgt

SEQ ID NO: 137484 - DNA, 25 bp, Mus musculus
tcctgacagtaagtcggatgagccg

SEQ ID NO: 137485 - DNA, 25 bp, Mus musculus
tcctgaccatcgtgaaagacccttg

SEQ ID NO: 137486 - DNA, 25 bp, Mus musculus
tcctgacccatgtgagttaccggcg

SEQ ID NO: 137487 - DNA, 25 bp, Mus musculus
tcctgacctcatgcgagaacttggc

SEQ ID NO: 137488 - DNA, 25 bp, Mus musculus
tcctgacctgggacaagatgctgag

SEQ ID NO: 137489 - DNA, 25 bp, Mus musculus
tcctgacgtagtagagcatgccacc

SEQ ID NO: 137490 - DNA, 25 bp, Mus musculus
tcctgacgtcatgggcatcggacct

SEQ ID NO: 137491 - DNA, 25 bp, Mus musculus
tcctgacgtctgtatggtgattgca

SEQ ID NO: 137492 - DNA, 25 bp, Mus musculus
tcctgactcaggtcgaagctgctgg

SEQ ID NO: 137493 - DNA, 25 bp, Mus musculus
tcctgactggccttctgacaggagg

SEQ ID NO: 137494 - DNA, 25 bp, Mus musculus
tcctgactttagcattggcggctct

SEQ ID NO: 137495 - DNA, 25 bp, Mus musculus
tcctgagaaggcttagcgcctgcgc

SEQ ID NO: 137496 - DNA, 25 bp, Mus musculus
tcctgagacactaagatcccctggg

SEQ ID NO: 137497 - DNA, 25 bp, Mus musculus
tcctgagacagccagtgagaacact

SEQ ID NO: 137498 - DNA, 25 bp, Mus musculus
tcctgagagcagaaatgggccgaga

SEQ ID NO: 137499 - DNA, 25 bp, Mus musculus
tcctgagaggcaccgaatctactgg

SEQ ID NO: 137500 - DNA, 25 bp, Mus musculus
tcctgagatatcagccccgcagaac

SEQ ID NO: 137501 - DNA, 25 bp, Mus musculus
tcctgagcaagcagtgtcacctcac

SEQ ID NO: 137502 - DNA, 25 bp, Mus musculus
tcctgagcaggtggtccttgagtcc

SEQ ID NO: 137503 - DNA, 25 bp, Mus musculus
tcctgagccaagaagtgaccaagag

SEQ ID NO: 137504 - DNA, 25 bp, Mus musculus
tcctgagccatctacagcagcgtgg

SEQ ID NO: 137505 - DNA, 25 bp, Mus musculus
tcctgagcccgagaagcggagtgat

SEQ ID NO: 137506 - DNA, 25 bp, Mus musculus
tcctgagccgtgatacaagcttgag

SEQ ID NO: 137507 - DNA, 25 bp, Mus musculus
tcctgagcctgagttccaaaatatg

SEQ ID NO: 137508 - DNA, 25 bp, Mus musculus
tcctgaggacctgtagctagcttct

SEQ ID NO: 137509 - DNA, 25 bp, Mus musculus
tcctgaggactcgtggactagcact

SEQ ID NO: 137510 - DNA, 25 bp, Mus musculus
tcctgaggataagcggaaagcagcc

SEQ ID NO: 137511 - DNA, 25 bp, Mus musculus
tcctgaggatacaacagctggacgc

SEQ ID NO: 137512 - DNA, 25 bp, Mus musculus
tcctgaggccgaagatcgggctgcc

SEQ ID NO: 137513 - DNA, 25 bp, Mus musculus
tcctgaggcctgtaatattgggacc

SEQ ID NO: 137514 - DNA, 25 bp, Mus musculus
tcctgaggcctgttatattggtact

SEQ ID NO: 137515 - DNA, 25 bp, Mus musculus
tcctgaggcctttttcacctccggg

SEQ ID NO: 137516 - DNA, 25 bp, Mus musculus
tcctgaggctcgagaggccatgttc

SEQ ID NO: 137517 - DNA, 25 bp, Mus musculus
tcctgaggctgactacaaggtccag

SEQ ID NO: 137518 - DNA, 25 bp, Mus musculus
tcctgaggtcctatgcagtggtcgg

SEQ ID NO: 137519 - DNA, 25 bp, Mus musculus
tcctgaggtggcagaaacgtaccgg

SEQ ID NO: 137520 - DNA, 25 bp, Mus musculus
tcctgagtaacctgtgtgggtgaac

SEQ ID NO: 137521 - DNA, 25 bp, Mus musculus
tcctgagtactaggaccacggatgt

SEQ ID NO: 137522 - DNA, 25 bp, Mus musculus
tcctgagtatcgtggtggcctttgc

SEQ ID NO: 137523 - DNA, 25 bp, Mus musculus
tcctgagtcggttaagagaaaatcc

SEQ ID NO: 137524 - DNA, 25 bp, Mus musculus
tcctgagtctatgtcctgaggcaaa

SEQ ID NO: 137525 - DNA, 25 bp, Mus musculus
tcctgagtgccgagtgagctgagct

SEQ ID NO: 137526 - DNA, 25 bp, Mus musculus
tcctgagtgctttgataccagccgc

SEQ ID NO: 137527 - DNA, 25 bp, Mus musculus
tcctgagtggccatgtcgtagtctg

SEQ ID NO: 137528 - DNA, 25 bp, Mus musculus
tcctgagtgtgcagagagttcaccg

SEQ ID NO: 137529 - DNA, 25 bp, Mus musculus
tcctgagtgtgtcgccttgagcctg

SEQ ID NO: 137530 - DNA, 25 bp, Mus musculus
tcctgagttgggaacaaagcactgt

SEQ ID NO: 137531 - DNA, 25 bp, Mus musculus
tcctgataggcccaaagatgctgat

SEQ ID NO: 137532 - DNA, 25 bp, Mus musculus
tcctgatagtgttaattatctttgc

SEQ ID NO: 137533 - DNA, 25 bp, Mus musculus
tcctgatcagaaaagatgggcgcac

SEQ ID NO: 137534 - DNA, 25 bp, Mus musculus
tcctgatcagaaatggcaagccctt

SEQ ID NO: 137535 - DNA, 25 bp, Mus musculus
tcctgatcgcagtcctcagtgggag

SEQ ID NO: 137536 - DNA, 25 bp, Mus musculus
tcctgatcgtcctgaagacaaggcc

SEQ ID NO: 137537 - DNA, 25 bp, Mus musculus
tcctgatgagaaaccagaacctggt

SEQ ID NO: 137538 - DNA, 25 bp, Mus musculus
tcctgatgagaaatacgtggctgcc

SEQ ID NO: 137539 - DNA, 25 bp, Mus musculus
tcctgatgagttcctgttcgacgtg

SEQ ID NO: 137540 - DNA, 25 bp, Mus musculus
tcctgatgcatttccagaactttca

SEQ ID NO: 137541 - DNA, 25 bp, Mus musculus
tcctgatggaactgcaagactgtgc

SEQ ID NO: 137542 - DNA, 25 bp, Mus musculus
tcctgatggccgctggttgataagc

SEQ ID NO: 137543 - DNA, 25 bp, Mus musculus
tcctgatgtgactggacgtggagta

SEQ ID NO: 137544 - DNA, 25 bp, Mus musculus
tcctgattgacagtgtacacgcaag

SEQ ID NO: 137545 - DNA, 25 bp, Mus musculus
tcctgattggtcagaagggcctctt

SEQ ID NO: 137546 - DNA, 25 bp, Mus musculus
tcctgcaaaatctggagttgctggg

SEQ ID NO: 137547 - DNA, 25 bp, Mus musculus
tcctgcaactatggaagtggctctt

SEQ ID NO: 137548 - DNA, 25 bp, Mus musculus
tcctgcaaggagaagtgcaccacca

SEQ ID NO: 137549 - DNA, 25 bp, Mus musculus
tcctgcaagggaaagcagatccaca

SEQ ID NO: 137550 - DNA, 25 bp, Mus musculus
tcctgcaagtatgacagctgctgtg

SEQ ID NO: 137551 - DNA, 25 bp, Mus musculus
tcctgcaagtcaaggacgggatcct

SEQ ID NO: 137552 - DNA, 25 bp, Mus musculus
tcctgcacctaaaacacctgggaat

SEQ ID NO: 137553 - DNA, 25 bp, Mus musculus
tcctgcacgagaggaacgagctcaa

SEQ ID NO: 137554 - DNA, 25 bp, Mus musculus
tcctgcagactggataaaagccctg

SEQ ID NO: 137555 - DNA, 25 bp, Mus musculus
tcctgcagagccagactgtcgactg

SEQ ID NO: 137556 - DNA, 25 bp, Mus musculus
tcctgcagaggaaagatcgccctgt

SEQ ID NO: 137557 - DNA, 25 bp, Mus musculus
tcctgcagaggacgcctatctacgc

SEQ ID NO: 137558 - DNA, 25 bp, Mus musculus
tcctgcagaggtttccagagcgcgt

SEQ ID NO: 137559 - DNA, 25 bp, Mus musculus
tcctgcagagtggatcaagacctgg

SEQ ID NO: 137560 - DNA, 25 bp, Mus musculus
tcctgcaggaggaaaccaaatgttg

SEQ ID NO: 137561 - DNA, 25 bp, Mus musculus
tcctgcaggaggttatggacagtcc

SEQ ID NO: 137562 - DNA, 25 bp, Mus musculus
tcctgcaggccaagtcggagttctg

SEQ ID NO: 137563 - DNA, 25 bp, Mus musculus
tcctgcagtgccatggctaccggtg

SEQ ID NO: 137564 - DNA, 25 bp, Mus musculus
tcctgcagttcatcagccgcgagag

SEQ ID NO: 137565 - DNA, 25 bp, Mus musculus
tcctgcatagcatgaaccgggtggc

SEQ ID NO: 137566 - DNA, 25 bp, Mus musculus
tcctgcatgcctacagtctgggaag

SEQ ID NO: 137567 - DNA, 25 bp, Mus musculus
tcctgcatgtaaaggcctggtccgc

SEQ ID NO: 137568 - DNA, 25 bp, Mus musculus
tcctgcccacagaggcttcgtttgg

SEQ ID NO: 137569 - DNA, 25 bp, Mus musculus
tcctgccccacatcagaagactgtg

SEQ ID NO: 137570 - DNA, 25 bp, Mus musculus
tcctgcccctttgtttggaatgcca

SEQ ID NO: 137571 - DNA, 25 bp, Mus musculus
tcctgccctggaaatggaagctgtc

SEQ ID NO: 137572 - DNA, 25 bp, Mus musculus
tcctgccggcctcacggaaaatgag

SEQ ID NO: 137573 - DNA, 25 bp, Mus musculus
tcctgccgggcctgtacattggcaa

SEQ ID NO: 137574 - DNA, 25 bp, Mus musculus
tcctgccgggcttgagtttccatca

SEQ ID NO: 137575 - DNA, 25 bp, Mus musculus
tcctgccggtctttttatctgatca

SEQ ID NO: 137576 - DNA, 25 bp, Mus musculus
tcctgccgtctaatgaaggactgct

SEQ ID NO: 137577 - DNA, 25 bp, Mus musculus
tcctgccgtgacaagcgagttcgtg

SEQ ID NO: 137578 - DNA, 25 bp, Mus musculus
tcctgcctgataccctcagaaaggg

SEQ ID NO: 137579 - DNA, 25 bp, Mus musculus
tcctgcctgggaggtctctgtctac

SEQ ID NO: 137580 - DNA, 25 bp, Mus musculus
tcctgccttggacttgacctggagt

SEQ ID NO: 137581 - DNA, 25 bp, Mus musculus
tcctgcgaaagcatgggacctgcac

SEQ ID NO: 137582 - DNA, 25 bp, Mus musculus
tcctgcgaggtaaagacgtgctggc

SEQ ID NO: 137583 - DNA, 25 bp, Mus musculus
tcctgcgatgcttcatcaaagaagg

SEQ ID NO: 137584 - DNA, 25 bp, Mus musculus
tcctgcgcccgatgctacggatgct

SEQ ID NO: 137585 - DNA, 25 bp, Mus musculus
tcctgcggaactttggcatgggaaa

SEQ ID NO: 137586 - DNA, 25 bp, Mus musculus
tcctgcggagcgtatgccaaaagct

SEQ ID NO: 137587 - DNA, 25 bp, Mus musculus
tcctgcggccgttagatcctgataa

SEQ ID NO: 137588 - DNA, 25 bp, Mus musculus
tcctgcgggccctcgctttcattta

SEQ ID NO: 137589 - DNA, 25 bp, Mus musculus
tcctgcgggcttgcgccccgggccg

SEQ ID NO: 137590 - DNA, 25 bp, Mus musculus
tcctgcgtcgaaaggatggcactgt

SEQ ID NO: 137591 - DNA, 25 bp, Mus musculus
tcctgctaacctgcatgccgtgggt

SEQ ID NO: 137592 - DNA, 25 bp, Mus musculus
tcctgctactacaccaacgggcatg

SEQ ID NO: 137593 - DNA, 25 bp, Mus musculus
tcctgctagagagagaactggccaa

SEQ ID NO: 137594 - DNA, 25 bp, Mus musculus
tcctgctagctggtgttgaccttgg

SEQ ID NO: 137595 - DNA, 25 bp, Mus musculus
tcctgctagggctggtgacaatgtc

SEQ ID NO: 137596 - DNA, 25 bp, Mus musculus
tcctgctcaactggaccaagggctt

SEQ ID NO: 137597 - DNA, 25 bp, Mus musculus
tcctgctcagaacagatgtgccatg

SEQ ID NO: 137598 - DNA, 25 bp, Mus musculus
tcctgctcagatccagtccacgggt

SEQ ID NO: 137599 - DNA, 25 bp, Mus musculus
tcctgctcgtgtggtattactgcac

SEQ ID NO: 137600 - DNA, 25 bp, Mus musculus
tcctgctgaagtctaccgctttggg

SEQ ID NO: 137601 - DNA, 25 bp, Mus musculus
tcctgctgaccagagccaaagttgg

SEQ ID NO: 137602 - DNA, 25 bp, Mus musculus
tcctgctgagcctgaatcctcagtg

SEQ ID NO: 137603 - DNA, 25 bp, Mus musculus
tcctgctgatgaccatgagcctgag

SEQ ID NO: 137604 - DNA, 25 bp, Mus musculus
tcctgctgcaggagcacatacggga

SEQ ID NO: 137605 - DNA, 25 bp, Mus musculus
tcctgctgcgcttgcggcgcagtct

SEQ ID NO: 137606 - DNA, 25 bp, Mus musculus
tcctgctggaagtgacggaacacct

SEQ ID NO: 137607 - DNA, 25 bp, Mus musculus
tcctgctggacgaagaaggcgcctt

SEQ ID NO: 137608 - DNA, 25 bp, Mus musculus
tcctgctggacgtgtggaacaaagc

SEQ ID NO: 137609 - DNA, 25 bp, Mus musculus
tcctgctggagaacacaaatctgtc

SEQ ID NO: 137610 - DNA, 25 bp, Mus musculus
tcctgctggcggcatgttacctgct

SEQ ID NO: 137611 - DNA, 25 bp, Mus musculus
tcctgctgggctcaagatgaatcgg

SEQ ID NO: 137612 - DNA, 25 bp, Mus musculus
tcctgctgttggtggtcgtctccgt

SEQ ID NO: 137613 - DNA, 25 bp, Mus musculus
tcctgcttaagatccgaggtggcaa

SEQ ID NO: 137614 - DNA, 25 bp, Mus musculus
tcctgcttttgctacccggaggacg

SEQ ID NO: 137615 - DNA, 25 bp, Mus musculus
tcctggaaatcatggcactcgtggg

SEQ ID NO: 137616 - DNA, 25 bp, Mus musculus
tcctggaacaaccatgtcgccagtt

SEQ ID NO: 137617 - DNA, 25 bp, Mus musculus
tcctggaacgagaacacgatctggt

SEQ ID NO: 137618 - DNA, 25 bp, Mus musculus
tcctggaagctcaccaaaacgtggc

SEQ ID NO: 137619 - DNA, 25 bp, Mus musculus
tcctggaaggctacgatcctacagt

SEQ ID NO: 137620 - DNA, 25 bp, Mus musculus
tcctggaagttggagccctgcaagc

SEQ ID NO: 137621 - DNA, 25 bp, Mus musculus
tcctggacaccgtgaagaacttctg

SEQ ID NO: 137622 - DNA, 25 bp, Mus musculus
tcctggacacctgctgggagtgacc

SEQ ID NO: 137623 - DNA, 25 bp, Mus musculus
tcctggacagtgacggaagtgacag

SEQ ID NO: 137624 - DNA, 25 bp, Mus musculus
tcctggacatgacgtggctgaacct

SEQ ID NO: 137625 - DNA, 25 bp, Mus musculus
tcctggaccagattgcaaagtattg

SEQ ID NO: 137626 - DNA, 25 bp, Mus musculus
tcctggaccccatatccatctttgt

SEQ ID NO: 137627 - DNA, 25 bp, Mus musculus
tcctggacgccatagtagacacttt

SEQ ID NO: 137628 - DNA, 25 bp, Mus musculus
tcctggacgccctgattgtgtgcat

SEQ ID NO: 137629 - DNA, 25 bp, Mus musculus
tcctggacgggaagggctctggagt

SEQ ID NO: 137630 - DNA, 25 bp, Mus musculus
tcctggactacaagggatgggctgt

SEQ ID NO: 137631 - DNA, 25 bp, Mus musculus
tcctggactcacgaacaggcggcag

SEQ ID NO: 137632 - DNA, 25 bp, Mus musculus
tcctggagaaacctcattgaacaaa

SEQ ID NO: 137633 - DNA, 25 bp, Mus musculus
tcctggagaccgtgcagacagtgga

SEQ ID NO: 137634 - DNA, 25 bp, Mus musculus
tcctggagacgagcaagcatgaaag

SEQ ID NO: 137635 - DNA, 25 bp, Mus musculus
tcctggagaggaacaagatgagtat

SEQ ID NO: 137636 - DNA, 25 bp, Mus musculus
tcctggagaggcacagaagatcgac

SEQ ID NO: 137637 - DNA, 25 bp, Mus musculus
tcctggagagtcatgggatagatgt

SEQ ID NO: 137638 - DNA, 25 bp, Mus musculus
tcctggagatgggttggtgccatac

SEQ ID NO: 137639 - DNA, 25 bp, Mus musculus
tcctggagatgtaggttctgagccc

SEQ ID NO: 137640 - DNA, 25 bp, Mus musculus
tcctggagccaaagatgttgtgcac

SEQ ID NO: 137641 - DNA, 25 bp, Mus musculus
tcctggagccgagaactgaccaatg

SEQ ID NO: 137642 - DNA, 25 bp, Mus musculus
tcctggagccttcagcagacacttg

SEQ ID NO: 137643 - DNA, 25 bp, Mus musculus
tcctggagcgcgtgacgttgaaccg

SEQ ID NO: 137644 - DNA, 25 bp, Mus musculus
tcctggagctcgaacgagaggccag

SEQ ID NO: 137645 - DNA, 25 bp, Mus musculus
tcctggagggccaagtagttcctgt

SEQ ID NO: 137646 - DNA, 25 bp, Mus musculus
tcctggagggtcatcagcagcatcg

SEQ ID NO: 137647 - DNA, 25 bp, Mus musculus
tcctggaggtcgagtacgagcttcc

SEQ ID NO: 137648 - DNA, 25 bp, Mus musculus
tcctggagtaagcaaaagacaagta

SEQ ID NO: 137649 - DNA, 25 bp, Mus musculus
tcctggagtccatgatccctatcaa

SEQ ID NO: 137650 - DNA, 25 bp, Mus musculus
tcctggagtcgggttaaggcagacc

SEQ ID NO: 137651 - DNA, 25 bp, Mus musculus
tcctggagtggcaccgcgcgaactc

SEQ ID NO: 137652 - DNA, 25 bp, Mus musculus
tcctggagttccagtgccagcagct

SEQ ID NO: 137653 - DNA, 25 bp, Mus musculus
tcctggagttccgatttgaatacct

SEQ ID NO: 137654 - DNA, 25 bp, Mus musculus
tcctggataccagagaagacagctt

SEQ ID NO: 137655 - DNA, 25 bp, Mus musculus
tcctggatactgacacgggatagct

SEQ ID NO: 137656 - DNA, 25 bp, Mus musculus
tcctggatggaacgactcgggcact

SEQ ID NO: 137657 - DNA, 25 bp, Mus musculus
tcctggatgtaggaacgacagcctc

SEQ ID NO: 137658 - DNA, 25 bp, Mus musculus
tcctggatgtcggtgcaaagcacaa

SEQ ID NO: 137659 - DNA, 25 bp, Mus musculus
tcctggcaaggagtccgaacgtttt

SEQ ID NO: 137660 - DNA, 25 bp, Mus musculus
tcctggcactcttgcccgatgtcag

SEQ ID NO: 137661 - DNA, 25 bp, Mus musculus
tcctggcagcagacgtcatgaagag

SEQ ID NO: 137662 - DNA, 25 bp, Mus musculus
tcctggcagctaagggaatcaacac

SEQ ID NO: 137663 - DNA, 25 bp, Mus musculus
tcctggcaggaaacgaaattagagc

SEQ ID NO: 137664 - DNA, 25 bp, Mus musculus
tcctggcagtagcaaccaaagatgt

SEQ ID NO: 137665 - DNA, 25 bp, Mus musculus
tcctggcagtaggagaaactgaaca

SEQ ID NO: 137666 - DNA, 25 bp, Mus musculus
tcctggcattcctgatactcttcag

SEQ ID NO: 137667 - DNA, 25 bp, Mus musculus
tcctggccacagtcatctacaagag

SEQ ID NO: 137668 - DNA, 25 bp, Mus musculus
tcctggccagatcctacagcggagt

SEQ ID NO: 137669 - DNA, 25 bp, Mus musculus
tcctggccagtgagatatgcttccc

SEQ ID NO: 137670 - DNA, 25 bp, Mus musculus
tcctggcctaatctggcaaaaccca

SEQ ID NO: 137671 - DNA, 25 bp, Mus musculus
tcctggcgcaaacatgggaacaaac

SEQ ID NO: 137672 - DNA, 25 bp, Mus musculus
tcctggcggcctatgtgacaggcta

SEQ ID NO: 137673 - DNA, 25 bp, Mus musculus
tcctggcgtgcagccctttggagta

SEQ ID NO: 137674 - DNA, 25 bp, Mus musculus
tcctggcgttggagaagatgttcct

SEQ ID NO: 137675 - DNA, 25 bp, Mus musculus
tcctggctagtctggtgtactcggc

SEQ ID NO: 137676 - DNA, 25 bp, Mus musculus
tcctggctcacaagttcgcaagtct

SEQ ID NO: 137677 - DNA, 25 bp, Mus musculus
tcctggctcccagaggtgcaccaaa

SEQ ID NO: 137678 - DNA, 25 bp, Mus musculus
tcctggctcttgtgtttggaagacg

SEQ ID NO: 137679 - DNA, 25 bp, Mus musculus
tcctggctgaggacgggaccatagt

SEQ ID NO: 137680 - DNA, 25 bp, Mus musculus
tcctggctgcgatacacttgataaa

SEQ ID NO: 137681 - DNA, 25 bp, Mus musculus
tcctggctggtaattgggcaaaaga

SEQ ID NO: 137682 - DNA, 25 bp, Mus musculus
tcctgggaagtacaccaagcaggct

SEQ ID NO: 137683 - DNA, 25 bp, Mus musculus
tcctgggaattagaagaaaacgcgt

SEQ ID NO: 137684 - DNA, 25 bp, Mus musculus
tcctgggaattgtgtacgactcggt

SEQ ID NO: 137685 - DNA, 25 bp, Mus musculus
tcctgggacaaactggaccatctga

SEQ ID NO: 137686 - DNA, 25 bp, Mus musculus
tcctgggacaactgggaaacctggc

SEQ ID NO: 137687 - DNA, 25 bp, Mus musculus
tcctgggaccacaagcacttaaaga

SEQ ID NO: 137688 - DNA, 25 bp, Mus musculus
tcctgggacctgtgaagctgagcac

SEQ ID NO: 137689 - DNA, 25 bp, Mus musculus
tcctgggactcgaagttgaccgcct

SEQ ID NO: 137690 - DNA, 25 bp, Mus musculus
tcctgggagactaaggactagccct

SEQ ID NO: 137691 - DNA, 25 bp, Mus musculus
tcctgggagccatcattggtgactg

SEQ ID NO: 137692 - DNA, 25 bp, Mus musculus
tcctgggaggcctacgagcaggaca

SEQ ID NO: 137693 - DNA, 25 bp, Mus musculus
tcctgggagtgacgctcttgaagaa

SEQ ID NO: 137694 - DNA, 25 bp, Mus musculus
tcctgggatcgcagaatgcagcaat

SEQ ID NO: 137695 - DNA, 25 bp, Mus musculus
tcctgggcaacaccgataagaagct

SEQ ID NO: 137696 - DNA, 25 bp, Mus musculus
tcctgggcagctcctccgtattctg

SEQ ID NO: 137697 - DNA, 25 bp, Mus musculus
tcctgggcatctttggtaccgtgca

SEQ ID NO: 137698 - DNA, 25 bp, Mus musculus
tcctgggcccaagtgaagaaatgca

SEQ ID NO: 137699 - DNA, 25 bp, Mus musculus
tcctgggccttcaagagagaagact

SEQ ID NO: 137700 - DNA, 25 bp, Mus musculus
tcctgggcgacttacagacttaaca

SEQ ID NO: 137701 - DNA, 25 bp, Mus musculus
tcctgggctccacgaagagactcaa

SEQ ID NO: 137702 - DNA, 25 bp, Mus musculus
tcctgggctccgaagaacacatttt

SEQ ID NO: 137703 - DNA, 25 bp, Mus musculus
tcctgggctgaattgagctgcaatg

SEQ ID NO: 137704 - DNA, 25 bp, Mus musculus
tcctgggctggagtactgctataac

SEQ ID NO: 137705 - DNA, 25 bp, Mus musculus
tcctgggtcatgaaacttagtccac

SEQ ID NO: 137706 - DNA, 25 bp, Mus musculus
tcctgggtccaagatctcggtcgtt

SEQ ID NO: 137707 - DNA, 25 bp, Mus musculus
tcctgggtgacatacagaaatctac

SEQ ID NO: 137708 - DNA, 25 bp, Mus musculus
tcctgggtgcacctgacagtcaatt

SEQ ID NO: 137709 - DNA, 25 bp, Mus musculus
tcctggtactgaagagatactgcat

SEQ ID NO: 137710 - DNA, 25 bp, Mus musculus
tcctggtagacgacatggccgatac

SEQ ID NO: 137711 - DNA, 25 bp, Mus musculus
tcctggtagtgtgggcacttgtcct

SEQ ID NO: 137712 - DNA, 25 bp, Mus musculus
tcctggtcaccttgtacgagagaga

SEQ ID NO: 137713 - DNA, 25 bp, Mus musculus
tcctggtccagagcagcgagttgtg

SEQ ID NO: 137714 - DNA, 25 bp, Mus musculus
tcctggtcgtttgccggtgttcccg

SEQ ID NO: 137715 - DNA, 25 bp, Mus musculus
tcctggtctggagaagatgccgccg

SEQ ID NO: 137716 - DNA, 25 bp, Mus musculus
tcctggtgaaataaactgagccttc

SEQ ID NO: 137717 - DNA, 25 bp, Mus musculus
tcctggtgaaggtgaaggacccgac

SEQ ID NO: 137718 - DNA, 25 bp, Mus musculus
tcctggtgacagacaggtcgcgagc

SEQ ID NO: 137719 - DNA, 25 bp, Mus musculus
tcctggtgcagtacttaagacggaa

SEQ ID NO: 137720 - DNA, 25 bp, Mus musculus
tcctggtgggcaataagtctgacct

SEQ ID NO: 137721 - DNA, 25 bp, Mus musculus
tcctggtgggcgagtgcgaaaacat

SEQ ID NO: 137722 - DNA, 25 bp, Mus musculus
tcctggtggtggacatccgaaacag

SEQ ID NO: 137723 - DNA, 25 bp, Mus musculus
tcctggttatggctcctcagcacct

SEQ ID NO: 137724 - DNA, 25 bp, Mus musculus
tcctggttccggtccaaggtcaaag

SEQ ID NO: 137725 - DNA, 25 bp, Mus musculus
tcctggttgcctatgaaggcttgcc

SEQ ID NO: 137726 - DNA, 25 bp, Mus musculus
tcctggtttacgatggccctgaata

SEQ ID NO: 137727 - DNA, 25 bp, Mus musculus
tcctgtaagaaagatccggtgacca

SEQ ID NO: 137728 - DNA, 25 bp, Mus musculus
tcctgtaccccaactatcagagctg

SEQ ID NO: 137729 - DNA, 25 bp, Mus musculus
tcctgtacgaacacgcacgagaggg

SEQ ID NO: 137730 - DNA, 25 bp, Mus musculus
tcctgtacgggcaatgtgaatcatg

SEQ ID NO: 137731 - DNA, 25 bp, Mus musculus
tcctgtagagccaccagattgtgtt

SEQ ID NO: 137732 - DNA, 25 bp, Mus musculus
tcctgtagccaggtgctggagcacc

SEQ ID NO: 137733 - DNA, 25 bp, Mus musculus
tcctgtagctgcgaggagcaaggct

SEQ ID NO: 137734 - DNA, 25 bp, Mus musculus
tcctgtatcaggaaaaactccaagc

SEQ ID NO: 137735 - DNA, 25 bp, Mus musculus
tcctgtatctgtcttcccggaggcg

SEQ ID NO: 137736 - DNA, 25 bp, Mus musculus
tcctgtatgacaccgagggacctca

SEQ ID NO: 137737 - DNA, 25 bp, Mus musculus
tcctgtatgagcagattaggagagc

SEQ ID NO: 137738 - DNA, 25 bp, Mus musculus
tcctgtcaagcccacgtgaatgagc

SEQ ID NO: 137739 - DNA, 25 bp, Mus musculus
tcctgtcagatcagtacacggtgta

SEQ ID NO: 137740 - DNA, 25 bp, Mus musculus
tcctgtcagcggaactgcagatgtg

SEQ ID NO: 137741 - DNA, 25 bp, Mus musculus
tcctgtcagcggagcagtgagcagc

SEQ ID NO: 137742 - DNA, 25 bp, Mus musculus
tcctgtcagggccatagatctacct

SEQ ID NO: 137743 - DNA, 25 bp, Mus musculus
tcctgtcatctttgggtcaccgcgg

SEQ ID NO: 137744 - DNA, 25 bp, Mus musculus
tcctgtccagcccaaacatggaaaa

SEQ ID NO: 137745 - DNA, 25 bp, Mus musculus
tcctgtccctgggatggctgtacat

SEQ ID NO: 137746 - DNA, 25 bp, Mus musculus
tcctgtccgatccttgttcctgctg

SEQ ID NO: 137747 - DNA, 25 bp, Mus musculus
tcctgtcgccaaatgcagatcttta

SEQ ID NO: 137748 - DNA, 25 bp, Mus musculus
tcctgtcgcggcttctctgggcaga

SEQ ID NO: 137749 - DNA, 25 bp, Mus musculus
tcctgtcggacatcaaccagagtgt

SEQ ID NO: 137750 - DNA, 25 bp, Mus musculus
tcctgtcgtgaattgatgggtagcg

SEQ ID NO: 137751 - DNA, 25 bp, Mus musculus
tcctgtctgaggaggaagctaccca

SEQ ID NO: 137752 - DNA, 25 bp, Mus musculus
tcctgtctgagggaacacgagggac

SEQ ID NO: 137753 - DNA, 25 bp, Mus musculus
tcctgtctggctggaaacatggcgt

SEQ ID NO: 137754 - DNA, 25 bp, Mus musculus
tcctgtctgtcatcaatgtgggcaa

SEQ ID NO: 137755 - DNA, 25 bp, Mus musculus
tcctgtgaagatatccagtgtggcg

SEQ ID NO: 137756 - DNA, 25 bp, Mus musculus
tcctgtgaaggcagaaagcagacaa

SEQ ID NO: 137757 - DNA, 25 bp, Mus musculus
tcctgtgacacgacccttgagtgac

SEQ ID NO: 137758 - DNA, 25 bp, Mus musculus
tcctgtgactagagactgctgggcg

SEQ ID NO: 137759 - DNA, 25 bp, Mus musculus
tcctgtgagaataagcgggcagatc

SEQ ID NO: 137760 - DNA, 25 bp, Mus musculus
tcctgtgagaatagttgccttggcg

SEQ ID NO: 137761 - DNA, 25 bp, Mus musculus
tcctgtgagaccagagctcaggctc

SEQ ID NO: 137762 - DNA, 25 bp, Mus musculus
tcctgtgagcgctaccgtgcagatg

SEQ ID NO: 137763 - DNA, 25 bp, Mus musculus
tcctgtgagctgcatgtctgaatcc

SEQ ID NO: 137764 - DNA, 25 bp, Mus musculus
tcctgtgagctgtaccgattgtcca

SEQ ID NO: 137765 - DNA, 25 bp, Mus musculus
tcctgtgcactgatcgcgactgtaa

SEQ ID NO: 137766 - DNA, 25 bp, Mus musculus
tcctgtgcagagatctgtgggccgc

SEQ ID NO: 137767 - DNA, 25 bp, Mus musculus
tcctgtgcagatgaccaaacctgtc

SEQ ID NO: 137768 - DNA, 25 bp, Mus musculus
tcctgtgccacgaaggtcgagtgac

SEQ ID NO: 137769 - DNA, 25 bp, Mus musculus
tcctgtgctgaacgcagcccaaagt

SEQ ID NO: 137770 - DNA, 25 bp, Mus musculus
tcctgtgctggcgaagatggccgct

SEQ ID NO: 137771 - DNA, 25 bp, Mus musculus
tcctgtgcttcctgcaaaccgagtt

SEQ ID NO: 137772 - DNA, 25 bp, Mus musculus
tcctgtggcacagaaggctttcgca

SEQ ID NO: 137773 - DNA, 25 bp, Mus musculus
tcctgtggccatctgcctagtaaag

SEQ ID NO: 137774 - DNA, 25 bp, Mus musculus
tcctgtggccctatggtgtgatgct

SEQ ID NO: 137775 - DNA, 25 bp, Mus musculus
tcctgtggccgacacacatgagggt

SEQ ID NO: 137776 - DNA, 25 bp, Mus musculus
tcctgtggctgatcaacagacctca

SEQ ID NO: 137777 - DNA, 25 bp, Mus musculus
tcctgtgtccgcagtggaaatgccc

SEQ ID NO: 137778 - DNA, 25 bp, Mus musculus
tcctgtgtctggaaggactggctcg

SEQ ID NO: 137779 - DNA, 25 bp, Mus musculus
tcctgtgtgctttagatgccccaag

SEQ ID NO: 137780 - DNA, 25 bp, Mus musculus
tcctgtgtgtagactgtggcctagc

SEQ ID NO: 137781 - DNA, 25 bp, Mus musculus
tcctgtgtttgcactgggccgagca

SEQ ID NO: 137782 - DNA, 25 bp, Mus musculus
tcctgttaagcaaaaggtgcccagt

SEQ ID NO: 137783 - DNA, 25 bp, Mus musculus
tcctgttaatagaagcggccgactt

SEQ ID NO: 137784 - DNA, 25 bp, Mus musculus
tcctgttacaccaagagcggcatga

SEQ ID NO: 137785 - DNA, 25 bp, Mus musculus
tcctgttagcataggacgtgtcgcc

SEQ ID NO: 137786 - DNA, 25 bp, Mus musculus
tcctgttagtgagcagggctcagcc

SEQ ID NO: 137787 - DNA, 25 bp, Mus musculus
tcctgttccgaagcccaagtggtaa

SEQ ID NO: 137788 - DNA, 25 bp, Mus musculus
tcctgttcgtaaagctggccaaccc

SEQ ID NO: 137789 - DNA, 25 bp, Mus musculus
tcctgttctagagaagcaagccatg

SEQ ID NO: 137790 - DNA, 25 bp, Mus musculus
tcctgttcttctaacggaggcccca

SEQ ID NO: 137791 - DNA, 25 bp, Mus musculus
tcctgttggaggaaacggagaagca

SEQ ID NO: 137792 - DNA, 25 bp, Mus musculus
tcctgttgggtgaaagtagccatcc

SEQ ID NO: 137793 - DNA, 25 bp, Mus musculus
tcctgttgttcccagtcatgctgcc

SEQ ID NO: 137794 - DNA, 25 bp, Mus musculus
tcctgtttctcaaagtactgtgggc

SEQ ID NO: 137795 - DNA, 25 bp, Mus musculus
tcctgtttgggtccctgagctgtga

SEQ ID NO: 137796 - DNA, 25 bp, Mus musculus
tccttaaaagtagcatcagacctgg

SEQ ID NO: 137797 - DNA, 25 bp, Mus musculus
tccttaaactgactatactcccaac

SEQ ID NO: 137798 - DNA, 25 bp, Mus musculus
tccttaaactggtggcctcggaaca

SEQ ID NO: 137799 - DNA, 25 bp, Mus musculus
tccttaagtatgaagacatgcaccg

SEQ ID NO: 137800 - DNA, 25 bp, Mus musculus
tccttaagtcaagcatgcagtgagg

SEQ ID NO: 137801 - DNA, 25 bp, Mus musculus
tccttaagtgacagatcatcccgcc

SEQ ID NO: 137802 - DNA, 25 bp, Mus musculus
tccttaattcactggggtgagcgcc

SEQ ID NO: 137803 - DNA, 25 bp, Mus musculus
tccttaattgatgggcaaacactct

SEQ ID NO: 137804 - DNA, 25 bp, Mus musculus
tccttacaccagagactgtccagaa

SEQ ID NO: 137805 - DNA, 25 bp, Mus musculus
tccttacatgctggtcgggtcacgc

SEQ ID NO: 137806 - DNA, 25 bp, Mus musculus
tccttacgggcagagcttgagcagc

SEQ ID NO: 137807 - DNA, 25 bp, Mus musculus
tccttagaggatgttgcccgccttc

SEQ ID NO: 137808 - DNA, 25 bp, Mus musculus
tccttagaggcagcaagagtcttgg

SEQ ID NO: 137809 - DNA, 25 bp, Mus musculus
tccttagctgtgctggtggtccaga

SEQ ID NO: 137810 - DNA, 25 bp, Mus musculus
tccttaggacaaggccaacctgtgt

SEQ ID NO: 137811 - DNA, 25 bp, Mus musculus
tccttaggcggctttgctgttcgcg

SEQ ID NO: 137812 - DNA, 25 bp, Mus musculus
tccttagtcgaggtccgtgggacat

SEQ ID NO: 137813 - DNA, 25 bp, Mus musculus
tccttagtgacggagcgtggctgct

SEQ ID NO: 137814 - DNA, 25 bp, Mus musculus
tccttatccagtgtttcccggaggg

SEQ ID NO: 137815 - DNA, 25 bp, Mus musculus
tccttatggacgacctgggcacaag

SEQ ID NO: 137816 - DNA, 25 bp, Mus musculus
tccttatggagttctggcccagggc

SEQ ID NO: 137817 - DNA, 25 bp, Mus musculus
tccttatggcaaccctaagaacatg

SEQ ID NO: 137818 - DNA, 25 bp, Mus musculus
tccttatggctggagaggcacgtct

SEQ ID NO: 137819 - DNA, 25 bp, Mus musculus
tccttattaatagcaacactgacag

SEQ ID NO: 137820 - DNA, 25 bp, Mus musculus
tccttattgaactacagctccgtga

SEQ ID NO: 137821 - DNA, 25 bp, Mus musculus
tccttcaaaagaatggacaatgagg

SEQ ID NO: 137822 - DNA, 25 bp, Mus musculus
tccttcaaatctgaggcttgcctgc

SEQ ID NO: 137823 - DNA, 25 bp, Mus musculus
tccttcagagtagcgcttagtgtaa

SEQ ID NO: 137824 - DNA, 25 bp, Mus musculus
tccttcaggaagatgccagctgtgc

SEQ ID NO: 137825 - DNA, 25 bp, Mus musculus
tccttcaggaattgcagtggcagcc

SEQ ID NO: 137826 - DNA, 25 bp, Mus musculus
tccttcagtggctgaacagcaggag

SEQ ID NO: 137827 - DNA, 25 bp, Mus musculus
tccttccagatgactaatgagacgg

SEQ ID NO: 137828 - DNA, 25 bp, Mus musculus
tccttccaggaatggacagccggaa

SEQ ID NO: 137829 - DNA, 25 bp, Mus musculus
tccttccaggaatgtcggcatgacc

SEQ ID NO: 137830 - DNA, 25 bp, Mus musculus
tccttccaggatcaggacttaccgt

SEQ ID NO: 137831 - DNA, 25 bp, Mus musculus
tccttcccagggtttaactgctgaa

SEQ ID NO: 137832 - DNA, 25 bp, Mus musculus
tccttcccgaagtaaagatgtctgc

SEQ ID NO: 137833 - DNA, 25 bp, Mus musculus
tccttccgaagtagagctggactgc

SEQ ID NO: 137834 - DNA, 25 bp, Mus musculus
tccttccgagtcaaatacatgctgg

SEQ ID NO: 137835 - DNA, 25 bp, Mus musculus
tccttccgagttgttggccgcaaga

SEQ ID NO: 137836 - DNA, 25 bp, Mus musculus
tccttccggcgtcgccggagtgaat

SEQ ID NO: 137837 - DNA, 25 bp, Mus musculus
tccttccggtgaacagcgccttaaa

SEQ ID NO: 137838 - DNA, 25 bp, Mus musculus
tccttcctccggaaagctgcgtggg

SEQ ID NO: 137839 - DNA, 25 bp, Mus musculus
tccttcctcgccttccaagggcttt

SEQ ID NO: 137840 - DNA, 25 bp, Mus musculus
tccttcctgagcaaactcggacaga

SEQ ID NO: 137841 - DNA, 25 bp, Mus musculus
tccttcctgaggatgctggccgata

SEQ ID NO: 137842 - DNA, 25 bp, Mus musculus
tccttcctgtgacacgacccttgag

SEQ ID NO: 137843 - DNA, 25 bp, Mus musculus
tccttccttctatagttaccggtat

SEQ ID NO: 137844 - DNA, 25 bp, Mus musculus
tccttccttggatgtctgagcgaac

SEQ ID NO: 137845 - DNA, 25 bp, Mus musculus
tccttcgaatggtggagggcgacac

SEQ ID NO: 137846 - DNA, 25 bp, Mus musculus
tccttcgaggctatacagttccacg

SEQ ID NO: 137847 - DNA, 25 bp, Mus musculus
tccttcgagtccatccatagcccca

SEQ ID NO: 137848 - DNA, 25 bp, Mus musculus
tccttcggaacgtcacatgggtcat

SEQ ID NO: 137849 - DNA, 25 bp, Mus musculus
tccttcggagccagcgcttttagag

SEQ ID NO: 137850 - DNA, 25 bp, Mus musculus
tccttcggaggcagaatatgtcaac

SEQ ID NO: 137851 - DNA, 25 bp, Mus musculus
tccttcggagttacctggtggacaa

SEQ ID NO: 137852 - DNA, 25 bp, Mus musculus
tccttcggccggcacccgggcctga

SEQ ID NO: 137853 - DNA, 25 bp, Mus musculus
tccttctaagatggagctagatcct

SEQ ID NO: 137854 - DNA, 25 bp, Mus musculus
tccttctgaagagtgatggatcttt

SEQ ID NO: 137855 - DNA, 25 bp, Mus musculus
tccttctggaggaactaggccaggc

SEQ ID NO: 137856 - DNA, 25 bp, Mus musculus
tccttctggaggatagaccctgcct

SEQ ID NO: 137857 - DNA, 25 bp, Mus musculus
tccttctgggtacagtcagcctgca

SEQ ID NO: 137858 - DNA, 25 bp, Mus musculus
tccttctggtgggtgccacgctgtt

SEQ ID NO: 137859 - DNA, 25 bp, Mus musculus
tccttctgtaatgaggtgactgctg

SEQ ID NO: 137860 - DNA, 25 bp, Mus musculus
tccttctgtgactgcgagggccaga

SEQ ID NO: 137861 - DNA, 25 bp, Mus musculus
tccttgacagctgaccagatggtca

SEQ ID NO: 137862 - DNA, 25 bp, Mus musculus
tccttgactgtgagctgggagcccc

SEQ ID NO: 137863 - DNA, 25 bp, Mus musculus
tccttgaggagaagccagtctgaca

SEQ ID NO: 137864 - DNA, 25 bp, Mus musculus
tccttgaggaggcaaatcgagtgct

SEQ ID NO: 137865 - DNA, 25 bp, Mus musculus
tccttgagtgtatcctgtggcctac

SEQ ID NO: 137866 - DNA, 25 bp, Mus musculus
tccttgagttacagcaccacggtct

SEQ ID NO: 137867 - DNA, 25 bp, Mus musculus
tccttgatgccttacgtggaagccg

SEQ ID NO: 137868 - DNA, 25 bp, Mus musculus
tccttgatggacgaaaaccagccct

SEQ ID NO: 137869 - DNA, 25 bp, Mus musculus
tccttgatggagcagttatgtgccc

SEQ ID NO: 137870 - DNA, 25 bp, Mus musculus
tccttgattggcatgtggcaaacac

SEQ ID NO: 137871 - DNA, 25 bp, Mus musculus
tccttgcaatctggagagagactcg

SEQ ID NO: 137872 - DNA, 25 bp, Mus musculus
tccttgcagggaagcagcagaaagg

SEQ ID NO: 137873 - DNA, 25 bp, Mus musculus
tccttgccaaaaagggcgtccatcc

SEQ ID NO: 137874 - DNA, 25 bp, Mus musculus
tccttgccacttctatgtgcggaaa

SEQ ID NO: 137875 - DNA, 25 bp, Mus musculus
tccttgcccgataccctgagaatgt

SEQ ID NO: 137876 - DNA, 25 bp, Mus musculus
tccttgccgactttgtcctggagtt

SEQ ID NO: 137877 - DNA, 25 bp, Mus musculus
tccttgcgaggagatgcagagcaca

SEQ ID NO: 137878 - DNA, 25 bp, Mus musculus
tccttgctataattcctgccttgcc

SEQ ID NO: 137879 - DNA, 25 bp, Mus musculus
tccttgctatcagcactgggcactg

SEQ ID NO: 137880 - DNA, 25 bp, Mus musculus
tccttgctgagctgggacgctacta

SEQ ID NO: 137881 - DNA, 25 bp, Mus musculus
tccttgctggaagaggccacaacag

SEQ ID NO: 137882 - DNA, 25 bp, Mus musculus
tccttggacactcaaaaatagacgc

SEQ ID NO: 137883 - DNA, 25 bp, Mus musculus
tccttggaccggagaagaactggct

SEQ ID NO: 137884 - DNA, 25 bp, Mus musculus
tccttggaggacttctatggaagcc

SEQ ID NO: 137885 - DNA, 25 bp, Mus musculus
tccttggatgtcacgggttgggttc

SEQ ID NO: 137886 - DNA, 25 bp, Mus musculus
tccttggcaacagaagagcgagcta

SEQ ID NO: 137887 - DNA, 25 bp, Mus musculus
tccttggccccacagatggagatcg

SEQ ID NO: 137888 - DNA, 25 bp, Mus musculus
tccttggctggcagtggaagtcccc

SEQ ID NO: 137889 - DNA, 25 bp, Mus musculus
tccttgggcatgtatgagtgtgaca

SEQ ID NO: 137890 - DNA, 25 bp, Mus musculus
tccttgggcccaatatgatactaac

SEQ ID NO: 137891 - DNA, 25 bp, Mus musculus
tccttgggcctaccaaagaccgtgc

SEQ ID NO: 137892 - DNA, 25 bp, Mus musculus
tccttgggcgccttcgtgggccctg

SEQ ID NO: 137893 - DNA, 25 bp, Mus musculus
tccttggtcccagatccgtatctgt

SEQ ID NO: 137894 - DNA, 25 bp, Mus musculus
tccttggtgagcaaatacctcctga

SEQ ID NO: 137895 - DNA, 25 bp, Mus musculus
tccttgtacagaatcagcagacgcc

SEQ ID NO: 137896 - DNA, 25 bp, Mus musculus
tccttgtagacagaaggacctctgt

SEQ ID NO: 137897 - DNA, 25 bp, Mus musculus
tccttgtaggactccatgctgccag

SEQ ID NO: 137898 - DNA, 25 bp, Mus musculus
tccttgtctcccttggatgctaaga

SEQ ID NO: 137899 - DNA, 25 bp, Mus musculus
tccttgtggctagaaatctgcctgt

SEQ ID NO: 137900 - DNA, 25 bp, Mus musculus
tccttgtggctggaggcctcaatgc

SEQ ID NO: 137901 - DNA, 25 bp, Mus musculus
tccttgtgggtatcactgtgggcgc

SEQ ID NO: 137902 - DNA, 25 bp, Mus musculus
tccttgtgtgagtgatgtcgtgaat

SEQ ID NO: 137903 - DNA, 25 bp, Mus musculus
tcctttaatagatcgagcccgggct

SEQ ID NO: 137904 - DNA, 25 bp, Mus musculus
tcctttacctgaacgaactcctgag

SEQ ID NO: 137905 - DNA, 25 bp, Mus musculus
tcctttaggtacacagggatccatg

SEQ ID NO: 137906 - DNA, 25 bp, Mus musculus
tcctttcagggtgagcagaacccca

SEQ ID NO: 137907 - DNA, 25 bp, Mus musculus
tcctttcagtgactggcgcagccga

SEQ ID NO: 137908 - DNA, 25 bp, Mus musculus
tcctttcatggcgatggccggcaag

SEQ ID NO: 137909 - DNA, 25 bp, Mus musculus
tcctttccaagtgccagagatcctg

SEQ ID NO: 137910 - DNA, 25 bp, Mus musculus
tcctttcggagcacctcactatgct

SEQ ID NO: 137911 - DNA, 25 bp, Mus musculus
tcctttctggtcaggcctaacctct

SEQ ID NO: 137912 - DNA, 25 bp, Mus musculus
tcctttctgtagaacctctaaaacg

SEQ ID NO: 137913 - DNA, 25 bp, Mus musculus
tcctttgactgacacaggccatgtg

SEQ ID NO: 137914 - DNA, 25 bp, Mus musculus
tcctttgaggcagatgagccggaca

SEQ ID NO: 137915 - DNA, 25 bp, Mus musculus
tcctttgatctgctcccacgggagt

SEQ ID NO: 137916 - DNA, 25 bp, Mus musculus
tcctttgatgacctggctgagctca

SEQ ID NO: 137917 - DNA, 25 bp, Mus musculus
tcctttgccaaggagccccatgtgg

SEQ ID NO: 137918 - DNA, 25 bp, Mus musculus
tcctttgctggagcccaggaagcct

SEQ ID NO: 137919 - DNA, 25 bp, Mus musculus
tcctttgctgttaggcgctgctcgc

SEQ ID NO: 137920 - DNA, 25 bp, Mus musculus
tcctttggaggatcggaacaccatt

SEQ ID NO: 137921 - DNA, 25 bp, Mus musculus
tcctttggagggttcctgatgcaca

SEQ ID NO: 137922 - DNA, 25 bp, Mus musculus
tcctttggatcaaggactactgatt

SEQ ID NO: 137923 - DNA, 25 bp, Mus musculus
tcctttggtggagtgtcgatgccgc

SEQ ID NO: 137924 - DNA, 25 bp, Mus musculus
tcctttgtacaatgcagagagatgc

SEQ ID NO: 137925 - DNA, 25 bp, Mus musculus
tcctttgtggccatggtcaacctgg

SEQ ID NO: 137926 - DNA, 25 bp, Mus musculus
tccttttaccaggagaaagacatgc

SEQ ID NO: 137927 - DNA, 25 bp, Mus musculus
tccttttatccatggcagccgctga

SEQ ID NO: 137928 - DNA, 25 bp, Mus musculus
tccttttccacagattgtctaaagc

SEQ ID NO: 137929 - DNA, 25 bp, Mus musculus
tccttttggagacgctgcctggcta

SEQ ID NO: 137930 - DNA, 25 bp, Mus musculus
tccttttggcttcagtggagactca

SEQ ID NO: 137931 - DNA, 25 bp, Mus musculus
tccttttgtcggagcctatgttaaa

SEQ ID NO: 137932 - DNA, 25 bp, Mus musculus
tcgaaaaagcgaacaggaatgtccc

SEQ ID NO: 137933 - DNA, 25 bp, Mus musculus
tcgaaaacgggtggaagctgccctc

SEQ ID NO: 137934 - DNA, 25 bp, Mus musculus
tcgaaaatgggcttccgggcggcaa

SEQ ID NO: 137935 - DNA, 25 bp, Mus musculus
tcgaaacgcttcagctgtggccagg

SEQ ID NO: 137936 - DNA, 25 bp, Mus musculus
tcgaaacttatttcagcagctgtct

SEQ ID NO: 137937 - DNA, 25 bp, Mus musculus
tcgaaagaacttggggattcctgga

SEQ ID NO: 137938 - DNA, 25 bp, Mus musculus
tcgaaagactggtacaaaactatgt

SEQ ID NO: 137939 - DNA, 25 bp, Mus musculus
tcgaaagcccgtgacagctcaggaa

SEQ ID NO: 137940 - DNA, 25 bp, Mus musculus
tcgaaaggacctcaacgagggctac

SEQ ID NO: 137941 - DNA, 25 bp, Mus musculus
tcgaaaggtgctattgtggatcaac

SEQ ID NO: 137942 - DNA, 25 bp, Mus musculus
tcgaaatcacgtggagaagaaagcc

SEQ ID NO: 137943 - DNA, 25 bp, Mus musculus
tcgaacactcagaccctacaggact

SEQ ID NO: 137944 - DNA, 25 bp, Mus musculus
tcgaacagcagcaagatcagtgatc

SEQ ID NO: 137945 - DNA, 25 bp, Mus musculus
tcgaacctgggcttgaaagactgca

SEQ ID NO: 137946 - DNA, 25 bp, Mus musculus
tcgaacgacccgtaatgatgagcgt

SEQ ID NO: 137947 - DNA, 25 bp, Mus musculus
tcgaacggaccagatgtgaagacca

SEQ ID NO: 137948 - DNA, 25 bp, Mus musculus
tcgaactcagatgtgggacaaacag

SEQ ID NO: 137949 - DNA, 25 bp, Mus musculus
tcgaagaagactctggaattacctc

SEQ ID NO: 137950 - DNA, 25 bp, Mus musculus
tcgaagaagggaccctggatgccct

SEQ ID NO: 137951 - DNA, 25 bp, Mus musculus
tcgaagaagtggtaaatgacaggag

SEQ ID NO: 137952 - DNA, 25 bp, Mus musculus
tcgaagacagacgtggagaaagtgc

SEQ ID NO: 137953 - DNA, 25 bp, Mus musculus
tcgaagaggacttccgagatggcct

SEQ ID NO: 137954 - DNA, 25 bp, Mus musculus
tcgaagagtctcagtgtcacctggt

SEQ ID NO: 137955 - DNA, 25 bp, Mus musculus
tcgaagcaccaaccttacctctcag

SEQ ID NO: 137956 - DNA, 25 bp, Mus musculus
tcgaagcagacattcccggaagagc

SEQ ID NO: 137957 - DNA, 25 bp, Mus musculus
tcgaagcagagactgaccgggtcac

SEQ ID NO: 137958 - DNA, 25 bp, Mus musculus
tcgaagccagcatcgtctagagatc

SEQ ID NO: 137959 - DNA, 25 bp, Mus musculus
tcgaagcctaccgagtgaaacgcct

SEQ ID NO: 137960 - DNA, 25 bp, Mus musculus
tcgaagctatctccgccagtgggtg

SEQ ID NO: 137961 - DNA, 25 bp, Mus musculus
tcgaagctgcagaagattgtgtaca

SEQ ID NO: 137962 - DNA, 25 bp, Mus musculus
tcgaaggagccaagatctacactgt

SEQ ID NO: 137963 - DNA, 25 bp, Mus musculus
tcgaaggatgcatacccaaagggct

SEQ ID NO: 137964 - DNA, 25 bp, Mus musculus
tcgaaggcaacgtgtggagcagaaa

SEQ ID NO: 137965 - DNA, 25 bp, Mus musculus
tcgaaggccatgtttccaacggtgc

SEQ ID NO: 137966 - DNA, 25 bp, Mus musculus
tcgaaggcctgacagactctgagat

SEQ ID NO: 137967 - DNA, 25 bp, Mus musculus
tcgaagggactctacttagggcagt

SEQ ID NO: 137968 - DNA, 25 bp, Mus musculus
tcgaagtatagaacctggcctcaag

SEQ ID NO: 137969 - DNA, 25 bp, Mus musculus
tcgaagtggcacattccgatgccgt

SEQ ID NO: 137970 - DNA, 25 bp, Mus musculus
tcgaagtgggctggttccacaacaa

SEQ ID NO: 137971 - DNA, 25 bp, Mus musculus
tcgaagttgtgggtcaaccgactga

SEQ ID NO: 137972 - DNA, 25 bp, Mus musculus
tcgaatactacggaatgagtagaga

SEQ ID NO: 137973 - DNA, 25 bp, Mus musculus
tcgaatcctgagcaaacagcagagg

SEQ ID NO: 137974 - DNA, 25 bp, Mus musculus
tcgaatctgggaatctgcgcaaagt

SEQ ID NO: 137975 - DNA, 25 bp, Mus musculus
tcgaatgcagatgactgctaccagt

SEQ ID NO: 137976 - DNA, 25 bp, Mus musculus
tcgaatggcactaccttagggacat

SEQ ID NO: 137977 - DNA, 25 bp, Mus musculus
tcgaatgtttgaacccacgtgcctg

SEQ ID NO: 137978 - DNA, 25 bp, Mus musculus
tcgaattcagcagcaggcaggaacc

SEQ ID NO: 137979 - DNA, 25 bp, Mus musculus
tcgaattggctatgaacattgggcc

SEQ ID NO: 137980 - DNA, 25 bp, Mus musculus
tcgaatttaccccagcggctgactc

SEQ ID NO: 137981 - DNA, 25 bp, Mus musculus
tcgacaaatcccatgatcaagctgt

SEQ ID NO: 137982 - DNA, 25 bp, Mus musculus
tcgacaaccaagtagtgagcaccaa

SEQ ID NO: 137983 - DNA, 25 bp, Mus musculus
tcgacaagaatgacctaagggacac

SEQ ID NO: 137984 - DNA, 25 bp, Mus musculus
tcgacaagacgcagcgtaagcgctg

SEQ ID NO: 137985 - DNA, 25 bp, Mus musculus
tcgacaaggaagaagccaacgccat

SEQ ID NO: 137986 - DNA, 25 bp, Mus musculus
tcgacacagcagcacctaaagaagg

SEQ ID NO: 137987 - DNA, 25 bp, Mus musculus
tcgacacccgggagcttcattttga

SEQ ID NO: 137988 - DNA, 25 bp, Mus musculus
tcgacactgagcttggtcaccaggc

SEQ ID NO: 137989 - DNA, 25 bp, Mus musculus
tcgacaggaaaaggaggcgctaaag

SEQ ID NO: 137990 - DNA, 25 bp, Mus musculus
tcgacaggccctgcatgaagtgcat

SEQ ID NO: 137991 - DNA, 25 bp, Mus musculus
tcgacagggtcattcagggctcctc

SEQ ID NO: 137992 - DNA, 25 bp, Mus musculus
tcgacagtcaaagcggaggaaaatg

SEQ ID NO: 137993 - DNA, 25 bp, Mus musculus
tcgacagtcgggtttggaggaccct

SEQ ID NO: 137994 - DNA, 25 bp, Mus musculus
tcgacagttccgtctgcttcagccg

SEQ ID NO: 137995 - DNA, 25 bp, Mus musculus
tcgacatacccacggagaagctgag

SEQ ID NO: 137996 - DNA, 25 bp, Mus musculus
tcgacatagcgcgaagccagatctt

SEQ ID NO: 137997 - DNA, 25 bp, Mus musculus
tcgacatatcagactacgggacccg

SEQ ID NO: 137998 - DNA, 25 bp, Mus musculus
tcgacatcaggatggttctcctcca

SEQ ID NO: 137999 - DNA, 25 bp, Mus musculus
tcgacatcgccaacacgcttaggga

SEQ ID NO: 138000 - DNA, 25 bp, Mus musculus
tcgacatctggagagccgagatccc

SEQ ID NO: 138001 - DNA, 25 bp, Mus musculus
tcgacattccgacaagtggcagagc

SEQ ID NO: 138002 - DNA, 25 bp, Mus musculus
tcgaccaactgcgtaaggaccatgt

SEQ ID NO: 138003 - DNA, 25 bp, Mus musculus
tcgaccagcaagagcaacaggagct

SEQ ID NO: 138004 - DNA, 25 bp, Mus musculus
tcgaccccgacttggcagttttcct

SEQ ID NO: 138005 - DNA, 25 bp, Mus musculus
tcgacccttgcacagtgggccatgg

SEQ ID NO: 138006 - DNA, 25 bp, Mus musculus
tcgaccgcgaggaagtgaaccagtt

SEQ ID NO: 138007 - DNA, 25 bp, Mus musculus
tcgacctcaggtccgagctgaagcg

SEQ ID NO: 138008 - DNA, 25 bp, Mus musculus
tcgacctcagtcctgcgcaagcagg

SEQ ID NO: 138009 - DNA, 25 bp, Mus musculus
tcgacctgcaggaaaagttcaagca

SEQ ID NO: 138010 - DNA, 25 bp, Mus musculus
tcgacgacacaattcttcagatggc

SEQ ID NO: 138011 - DNA, 25 bp, Mus musculus
tcgacgacagtgagatggagagtcc

SEQ ID NO: 138012 - DNA, 25 bp, Mus musculus
tcgacgacttcttttggcatgggca

SEQ ID NO: 138013 - DNA, 25 bp, Mus musculus
tcgacgagcgcgagaagcacaagtt

SEQ ID NO: 138014 - DNA, 25 bp, Mus musculus
tcgacgatgaggagggatggtttcc

SEQ ID NO: 138015 - DNA, 25 bp, Mus musculus
tcgacgccatgagtaggtacaccag

SEQ ID NO: 138016 - DNA, 25 bp, Mus musculus
tcgacgccgtatttgagataaaaaa

SEQ ID NO: 138017 - DNA, 25 bp, Mus musculus
tcgacgctctcggaagatcgggatc

SEQ ID NO: 138018 - DNA, 25 bp, Mus musculus
tcgacggacgtgcaaagaaatcaag

SEQ ID NO: 138019 - DNA, 25 bp, Mus musculus
tcgacggcgagaccatgatcatcat

SEQ ID NO: 138020 - DNA, 25 bp, Mus musculus
tcgacggctgtggaacaacctggcc

SEQ ID NO: 138021 - DNA, 25 bp, Mus musculus
tcgacgggatgaaactggtgcagac

SEQ ID NO: 138022 - DNA, 25 bp, Mus musculus
tcgacggtgtctctgaaggcaaagc

SEQ ID NO: 138023 - DNA, 25 bp, Mus musculus
tcgactacattgtccgtgagggcaa

SEQ ID NO: 138024 - DNA, 25 bp, Mus musculus
tcgactacggacgaacatggcagcc

SEQ ID NO: 138025 - DNA, 25 bp, Mus musculus
tcgactagatcatgagggagcctcc

SEQ ID NO: 138026 - DNA, 25 bp, Mus musculus
tcgactcctcagaactaagacctgg

SEQ ID NO: 138027 - DNA, 25 bp, Mus musculus
tcgactcctgtgcttgtagataacc

SEQ ID NO: 138028 - DNA, 25 bp, Mus musculus
tcgactgctggtgtctggcggagac

SEQ ID NO: 138029 - DNA, 25 bp, Mus musculus
tcgacttccggagtttcatcattgc

SEQ ID NO: 138030 - DNA, 25 bp, Mus musculus
tcgacttggagatcgccgtggagca

SEQ ID NO: 138031 - DNA, 25 bp, Mus musculus
tcgactttatgtcccgagagacggc

SEQ ID NO: 138032 - DNA, 25 bp, Mus musculus
tcgagaaagtgtctagccgtgccat

SEQ ID NO: 138033 - DNA, 25 bp, Mus musculus
tcgagaacagttccaggcagataca

SEQ ID NO: 138034 - DNA, 25 bp, Mus musculus
tcgagaacctggagtgtgaccccaa

SEQ ID NO: 138035 - DNA, 25 bp, Mus musculus
tcgagaagactcaccaagtgaagac

SEQ ID NO: 138036 - DNA, 25 bp, Mus musculus
tcgagaagctggaactggtaccggt

SEQ ID NO: 138037 - DNA, 25 bp, Mus musculus
tcgagaaggagatcgctcgaacgca

SEQ ID NO: 138038 - DNA, 25 bp, Mus musculus
tcgagaaggttctccagccaactgg

SEQ ID NO: 138039 - DNA, 25 bp, Mus musculus
tcgagaagtctccagtgtaagtgcc

SEQ ID NO: 138040 - DNA, 25 bp, Mus musculus
tcgagaatatcgatgaggacttcag

SEQ ID NO: 138041 - DNA, 25 bp, Mus musculus
tcgagacaaggcacaatgagatcat

SEQ ID NO: 138042 - DNA, 25 bp, Mus musculus
tcgagacacacttggttcagcggct

SEQ ID NO: 138043 - DNA, 25 bp, Mus musculus
tcgagaccaggaccacaatgagtgc

SEQ ID NO: 138044 - DNA, 25 bp, Mus musculus
tcgagacccaggctggcattgtggc

SEQ ID NO: 138045 - DNA, 25 bp, Mus musculus
tcgagaccctgagaaagcaatgctt

SEQ ID NO: 138046 - DNA, 25 bp, Mus musculus
tcgagaccgtgtatgaactcaccaa

SEQ ID NO: 138047 - DNA, 25 bp, Mus musculus
tcgagagaaatgtggtgaactctgt

SEQ ID NO: 138048 - DNA, 25 bp, Mus musculus
tcgagagaacttaaaaccacctgag

SEQ ID NO: 138049 - DNA, 25 bp, Mus musculus
tcgagagattgagtctagtccccag

SEQ ID NO: 138050 - DNA, 25 bp, Mus musculus
tcgagagcactgatgaagccaagct

SEQ ID NO: 138051 - DNA, 25 bp, Mus musculus
tcgagagcgcatcaagcagcagatt

SEQ ID NO: 138052 - DNA, 25 bp, Mus musculus
tcgagagtcacttcagcagctccgc

SEQ ID NO: 138053 - DNA, 25 bp, Mus musculus
tcgagagtgcgaactacggtcggac

SEQ ID NO: 138054 - DNA, 25 bp, Mus musculus
tcgagataaacagagtcccagccag

SEQ ID NO: 138055 - DNA, 25 bp, Mus musculus
tcgagatcaacaatatcacctgtga

SEQ ID NO: 138056 - DNA, 25 bp, Mus musculus
tcgagatcccggatcagccctgctg

SEQ ID NO: 138057 - DNA, 25 bp, Mus musculus
tcgagatgacacgtttgatgtggcc

SEQ ID NO: 138058 - DNA, 25 bp, Mus musculus
tcgagatggacagccgctacaccag

SEQ ID NO: 138059 - DNA, 25 bp, Mus musculus
tcgagatgtgagctgcaaaaactgc

SEQ ID NO: 138060 - DNA, 25 bp, Mus musculus
tcgagatttatgtccccgaggccca

SEQ ID NO: 138061 - DNA, 25 bp, Mus musculus
tcgagatttcttgggtggcctggcc

SEQ ID NO: 138062 - DNA, 25 bp, Mus musculus
tcgagcaagagcatacccagggctt

SEQ ID NO: 138063 - DNA, 25 bp, Mus musculus
tcgagcagagcatcttgggacatgt

SEQ ID NO: 138064 - DNA, 25 bp, Mus musculus
tcgagcagagccctttggagcagtc

SEQ ID NO: 138065 - DNA, 25 bp, Mus musculus
tcgagcagctagaagaacggaggca

SEQ ID NO: 138066 - DNA, 25 bp, Mus musculus
tcgagccccgtacctggaggcttgc

SEQ ID NO: 138067 - DNA, 25 bp, Mus musculus
tcgagccggcggacatggtacttct

SEQ ID NO: 138068 - DNA, 25 bp, Mus musculus
tcgagccttaatggtggtgtccctg

SEQ ID NO: 138069 - DNA, 25 bp, Mus musculus
tcgagctcatatgaagaccaagatg

SEQ ID NO: 138070 - DNA, 25 bp, Mus musculus
tcgagctcgcacagaagttacaagg

SEQ ID NO: 138071 - DNA, 25 bp, Mus musculus
tcgagctgagagtcaagcagccgtt

SEQ ID NO: 138072 - DNA, 25 bp, Mus musculus
tcgagctgggagatgtgacgccaca

SEQ ID NO: 138073 - DNA, 25 bp, Mus musculus
tcgagctgtcgttgtcaatgccgcc

SEQ ID NO: 138074 - DNA, 25 bp, Mus musculus
tcgaggaacctctaggagctgagga

SEQ ID NO: 138075 - DNA, 25 bp, Mus musculus
tcgaggaactgcctacccagatcag

SEQ ID NO: 138076 - DNA, 25 bp, Mus musculus
tcgaggacaggcacatcagatgggc

SEQ ID NO: 138077 - DNA, 25 bp, Mus musculus
tcgaggacatacgtgccagcgaagc

SEQ ID NO: 138078 - DNA, 25 bp, Mus musculus
tcgaggactgccatcagaacctggg

SEQ ID NO: 138079 - DNA, 25 bp, Mus musculus
tcgaggagggcctatgtgtccatgt

SEQ ID NO: 138080 - DNA, 25 bp, Mus musculus
tcgaggattttaactgaccccgcca

SEQ ID NO: 138081 - DNA, 25 bp, Mus musculus
tcgaggcacgtttgaggactttacc

SEQ ID NO: 138082 - DNA, 25 bp, Mus musculus
tcgaggccaggtcgcagcgggcgac

SEQ ID NO: 138083 - DNA, 25 bp, Mus musculus
tcgaggccatccacaacttcgtaga

SEQ ID NO: 138084 - DNA, 25 bp, Mus musculus
tcgaggcctactttgaccagaagag

SEQ ID NO: 138085 - DNA, 25 bp, Mus musculus
tcgaggcggacgagaacgagaacat

SEQ ID NO: 138086 - DNA, 25 bp, Mus musculus
tcgaggctgtaaatcggcggacctt

SEQ ID NO: 138087 - DNA, 25 bp, Mus musculus
tcgaggctgtgtatgagctcaccaa

SEQ ID NO: 138088 - DNA, 25 bp, Mus musculus
tcgaggcttggtaccgccacggccg

SEQ ID NO: 138089 - DNA, 25 bp, Mus musculus
tcgagggaaacataccaatggttcc

SEQ ID NO: 138090 - DNA, 25 bp, Mus musculus
tcgagggcaaaaaggacatccgggc

SEQ ID NO: 138091 - DNA, 25 bp, Mus musculus
tcgagggtctgtggaagcgagagca

SEQ ID NO: 138092 - DNA, 25 bp, Mus musculus
tcgaggtaacgcaggccctggaaga

SEQ ID NO: 138093 - DNA, 25 bp, Mus musculus
tcgaggtgcagttcctgaagaaagc

SEQ ID NO: 138094 - DNA, 25 bp, Mus musculus
tcgagtaccagaacatgcggctgcc

SEQ ID NO: 138095 - DNA, 25 bp, Mus musculus
tcgagtacctggtgaaatggaaagg

SEQ ID NO: 138096 - DNA, 25 bp, Mus musculus
tcgagtatgagcatgaacgagacat

SEQ ID NO: 138097 - DNA, 25 bp, Mus musculus
tcgagtcatcgctcccaagaaggcg

SEQ ID NO: 138098 - DNA, 25 bp, Mus musculus
tcgagtcccaggtacgagaacttct

SEQ ID NO: 138099 - DNA, 25 bp, Mus musculus
tcgagtcgagctgagagtcaagcag

SEQ ID NO: 138100 - DNA, 25 bp, Mus musculus
tcgagtcgcagtgctggaagttcag

SEQ ID NO: 138101 - DNA, 25 bp, Mus musculus
tcgagtcgtgtcaaggctaggacgc

SEQ ID NO: 138102 - DNA, 25 bp, Mus musculus
tcgagtcttcggagcgggcgctgtc

SEQ ID NO: 138103 - DNA, 25 bp, Mus musculus
tcgagtgagcacgatctctggaacc

SEQ ID NO: 138104 - DNA, 25 bp, Mus musculus
tcgagtgcccatgctgagtagcagc

SEQ ID NO: 138105 - DNA, 25 bp, Mus musculus
tcgagtgctactgccctggagagga

SEQ ID NO: 138106 - DNA, 25 bp, Mus musculus
tcgagtggaccacaggcagtttgaa

SEQ ID NO: 138107 - DNA, 25 bp, Mus musculus
tcgagtggccgggtatgaaacccag

SEQ ID NO: 138108 - DNA, 25 bp, Mus musculus
tcgagttcacccgatgccacaagag

SEQ ID NO: 138109 - DNA, 25 bp, Mus musculus
tcgagttctgctcccgttacacagg

SEQ ID NO: 138110 - DNA, 25 bp, Mus musculus
tcgagttgggaaaactgaccctgtc

SEQ ID NO: 138111 - DNA, 25 bp, Mus musculus
tcgagtttctgcacaccgagatggt

SEQ ID NO: 138112 - DNA, 25 bp, Mus musculus
tcgataaccagtttggacaaccagg

SEQ ID NO: 138113 - DNA, 25 bp, Mus musculus
tcgataacgggaagcagcgagagtt

SEQ ID NO: 138114 - DNA, 25 bp, Mus musculus
tcgataagtcctacatgaacccggg

SEQ ID NO: 138115 - DNA, 25 bp, Mus musculus
tcgatacatgagcaatgaaaaaatt

SEQ ID NO: 138116 - DNA, 25 bp, Mus musculus
tcgatacgtggactacctgggaaac

SEQ ID NO: 138117 - DNA, 25 bp, Mus musculus
tcgatatccggactctggcagacag

SEQ ID NO: 138118 - DNA, 25 bp, Mus musculus
tcgatatgagctggtcaccgtccct

SEQ ID NO: 138119 - DNA, 25 bp, Mus musculus
tcgatcagtatcaaggagcagatgc

SEQ ID NO: 138120 - DNA, 25 bp, Mus musculus
tcgatccaacacagctcccagttgg

SEQ ID NO: 138121 - DNA, 25 bp, Mus musculus
tcgatccagcagatgccaatgtgcg

SEQ ID NO: 138122 - DNA, 25 bp, Mus musculus
tcgatccgtggagaaacttgcctgt

SEQ ID NO: 138123 - DNA, 25 bp, Mus musculus
tcgatcgagaagaccacagaagaca

SEQ ID NO: 138124 - DNA, 25 bp, Mus musculus
tcgatgaagccacaaggaacccagt

SEQ ID NO: 138125 - DNA, 25 bp, Mus musculus
tcgatgacatccagacgaagcgcag

SEQ ID NO: 138126 - DNA, 25 bp, Mus musculus
tcgatgaggtgataagcccagagcc

SEQ ID NO: 138127 - DNA, 25 bp, Mus musculus
tcgatgcaattttgccccgacagag

SEQ ID NO: 138128 - DNA, 25 bp, Mus musculus
tcgatgcacgggaatggagtattaa

SEQ ID NO: 138129 - DNA, 25 bp, Mus musculus
tcgatgcgcagatagggttcaacca

SEQ ID NO: 138130 - DNA, 25 bp, Mus musculus
tcgatgctcaaagatgactgtgcgt

SEQ ID NO: 138131 - DNA, 25 bp, Mus musculus
tcgatgctcaggagatcatgcagtc

SEQ ID NO: 138132 - DNA, 25 bp, Mus musculus
tcgatgctctcgatgggcaccagga

SEQ ID NO: 138133 - DNA, 25 bp, Mus musculus
tcgatggaccctaactgatgcccct

SEQ ID NO: 138134 - DNA, 25 bp, Mus musculus
tcgatggaccctggatggtgactgc

SEQ ID NO: 138135 - DNA, 25 bp, Mus musculus
tcgatggcaagtctcagtcacggca

SEQ ID NO: 138136 - DNA, 25 bp, Mus musculus
tcgatgggaacgctgcagatctgca

SEQ ID NO: 138137 - DNA, 25 bp, Mus musculus
tcgatgtcaaccagctgcagttccc

SEQ ID NO: 138138 - DNA, 25 bp, Mus musculus
tcgatgtgacatatgcggaaaacgc

SEQ ID NO: 138139 - DNA, 25 bp, Mus musculus
tcgatgtggacctcagctcctaggc

SEQ ID NO: 138140 - DNA, 25 bp, Mus musculus
tcgattacctcctcatctggctgta

SEQ ID NO: 138141 - DNA, 25 bp, Mus musculus
tcgattcagcgccaaaagcggagct

SEQ ID NO: 138142 - DNA, 25 bp, Mus musculus
tcgatttaacaacccgtacttctgg

SEQ ID NO: 138143 - DNA, 25 bp, Mus musculus
tcgcaaacaacccaagtcagaagac

SEQ ID NO: 138144 - DNA, 25 bp, Mus musculus
tcgcaaacggaagtggacgacgaat

SEQ ID NO: 138145 - DNA, 25 bp, Mus musculus
tcgcaaagccaccatcgaggagctg

SEQ ID NO: 138146 - DNA, 25 bp, Mus musculus
tcgcaaagcggcgagaaccggagcc

SEQ ID NO: 138147 - DNA, 25 bp, Mus musculus
tcgcaaagctgtcatggaccacgta

SEQ ID NO: 138148 - DNA, 25 bp, Mus musculus
tcgcaaagtgagaccacacagctgc

SEQ ID NO: 138149 - DNA, 25 bp, Mus musculus
tcgcaacgatattcttcaacagtgg

SEQ ID NO: 138150 - DNA, 25 bp, Mus musculus
tcgcaactttgatacctgtgccaag

SEQ ID NO: 138151 - DNA, 25 bp, Mus musculus
tcgcaagaatgaatgggaggaccgt

SEQ ID NO: 138152 - DNA, 25 bp, Mus musculus
tcgcaagagtggagcgagcaatgcc

SEQ ID NO: 138153 - DNA, 25 bp, Mus musculus
tcgcaagtgcgccagaactaccacc

SEQ ID NO: 138154 - DNA, 25 bp, Mus musculus
tcgcaatggttccactcagggaagc

SEQ ID NO: 138155 - DNA, 25 bp, Mus musculus
tcgcaattcaccgtcagcacatgag

SEQ ID NO: 138156 - DNA, 25 bp, Mus musculus
tcgcacacatgtacaccacggtttg

SEQ ID NO: 138157 - DNA, 25 bp, Mus musculus
tcgcacagagctgcatggacaactg

SEQ ID NO: 138158 - DNA, 25 bp, Mus musculus
tcgcaccctgaaggtggagccagct

SEQ ID NO: 138159 - DNA, 25 bp, Mus musculus
tcgcacccttgtactgggactggtg

SEQ ID NO: 138160 - DNA, 25 bp, Mus musculus
tcgcaccggcggtgtctgggctcca

SEQ ID NO: 138161 - DNA, 25 bp, Mus musculus
tcgcacgacagtgggaagctctttg

SEQ ID NO: 138162 - DNA, 25 bp, Mus musculus
tcgcactagatgcagcacggagaca

SEQ ID NO: 138163 - DNA, 25 bp, Mus musculus
tcgcagaagtgctaaggctgccaca

SEQ ID NO: 138164 - DNA, 25 bp, Mus musculus
tcgcagaatgcagcaatggagtctt

SEQ ID NO: 138165 - DNA, 25 bp, Mus musculus
tcgcagagattttcagaagacgctt

SEQ ID NO: 138166 - DNA, 25 bp, Mus musculus
tcgcagatagcgagagtgccgtccg

SEQ ID NO: 138167 - DNA, 25 bp, Mus musculus
tcgcagcactaaaatggaagacatc

SEQ ID NO: 138168 - DNA, 25 bp, Mus musculus
tcgcagcccttgcacctagtggaga

SEQ ID NO: 138169 - DNA, 25 bp, Mus musculus
tcgcagcctgccgaaagcctgttgt

SEQ ID NO: 138170 - DNA, 25 bp, Mus musculus
tcgcaggctctgtactcggacttct

SEQ ID NO: 138171 - DNA, 25 bp, Mus musculus
tcgcagggctcggtggacctaagca

SEQ ID NO: 138172 - DNA, 25 bp, Mus musculus
tcgcagttcaacaggcgggtcctca

SEQ ID NO: 138173 - DNA, 25 bp, Mus musculus
tcgcagttcggagctgtctcacagc

SEQ ID NO: 138174 - DNA, 25 bp, Mus musculus
tcgcatagacatatcctgcctaggg

SEQ ID NO: 138175 - DNA, 25 bp, Mus musculus
tcgcatcaagcacaaaggcatcagg

SEQ ID NO: 138176 - DNA, 25 bp, Mus musculus
tcgcatcagcccatgagatactgtc

SEQ ID NO: 138177 - DNA, 25 bp, Mus musculus
tcgcatgagccgtttccagaaaagt

SEQ ID NO: 138178 - DNA, 25 bp, Mus musculus
tcgcatgtgggactctgtactggcc

SEQ ID NO: 138179 - DNA, 25 bp, Mus musculus
tcgccaaatggttctggaggcccct

SEQ ID NO: 138180 - DNA, 25 bp, Mus musculus
tcgccaacagcgagatgaaccaggc

SEQ ID NO: 138181 - DNA, 25 bp, Mus musculus
tcgccaagcacatcgatgcagagta

SEQ ID NO: 138182 - DNA, 25 bp, Mus musculus
tcgccaaggcattgtcccagggaac

SEQ ID NO: 138183 - DNA, 25 bp, Mus musculus
tcgccacccacaggagagtcaattg

SEQ ID NO: 138184 - DNA, 25 bp, Mus musculus
tcgccagacttctcgctatcaggaa

SEQ ID NO: 138185 - DNA, 25 bp, Mus musculus
tcgccagatgaaagagcaactcagg

SEQ ID NO: 138186 - DNA, 25 bp, Mus musculus
tcgccagcacttggtaggaagcggc

SEQ ID NO: 138187 - DNA, 25 bp, Mus musculus
tcgccagccgtacagggttaaagtg

SEQ ID NO: 138188 - DNA, 25 bp, Mus musculus
tcgccaggaagaatatgcacagtgc

SEQ ID NO: 138189 - DNA, 25 bp, Mus musculus
tcgccaggcccgtcggagcctgaga

SEQ ID NO: 138190 - DNA, 25 bp, Mus musculus
tcgccagtgaaggacagggttctca

SEQ ID NO: 138191 - DNA, 25 bp, Mus musculus
tcgccagttgcttgaccaggtggaa

SEQ ID NO: 138192 - DNA, 25 bp, Mus musculus
tcgccatcctccaggggagcgggat

SEQ ID NO: 138193 - DNA, 25 bp, Mus musculus
tcgccatgaaccgactccaggatga

SEQ ID NO: 138194 - DNA, 25 bp, Mus musculus
tcgccatgaggctgagcggacagag

SEQ ID NO: 138195 - DNA, 25 bp, Mus musculus
tcgccatgcacgatgtggacctgct

SEQ ID NO: 138196 - DNA, 25 bp, Mus musculus
tcgccatgctgtgttgccaggagga

SEQ ID NO: 138197 - DNA, 25 bp, Mus musculus
tcgccatgtaataaagaccaaacgg

SEQ ID NO: 138198 - DNA, 25 bp, Mus musculus
tcgccatgtcgtcggtgttcggcaa

SEQ ID NO: 138199 - DNA, 25 bp, Mus musculus
tcgccatgtttgtgctctggaggcc

SEQ ID NO: 138200 - DNA, 25 bp, Mus musculus
tcgcccagaaacgagtcagctggag

SEQ ID NO: 138201 - DNA, 25 bp, Mus musculus
tcgccccattggtagcagctgtagc

SEQ ID NO: 138202 - DNA, 25 bp, Mus musculus
tcgcccggaggctggacaaaatggt

SEQ ID NO: 138203 - DNA, 25 bp, Mus musculus
tcgcccgggagcttgttacattgac

SEQ ID NO: 138204 - DNA, 25 bp, Mus musculus
tcgcccgtgaccaacatcatgtgcg

SEQ ID NO: 138205 - DNA, 25 bp, Mus musculus
tcgccctacgagtcagccattggtg

SEQ ID NO: 138206 - DNA, 25 bp, Mus musculus
tcgccctgaagctaggcatgatgcc

SEQ ID NO: 138207 - DNA, 25 bp, Mus musculus
tcgccctgatgagtttcccttggaa

SEQ ID NO: 138208 - DNA, 25 bp, Mus musculus
tcgccctgtacacggagaagtttga

SEQ ID NO: 138209 - DNA, 25 bp, Mus musculus
tcgccgaaagtctgggacaagttta

SEQ ID NO: 138210 - DNA, 25 bp, Mus musculus
tcgccgagccgtgatgagcgagggc

SEQ ID NO: 138211 - DNA, 25 bp, Mus musculus
tcgccgaggtcgacgcagctcaagc

SEQ ID NO: 138212 - DNA, 25 bp, Mus musculus
tcgccgcacaatccagaagaatctc

SEQ ID NO: 138213 - DNA, 25 bp, Mus musculus
tcgccgcgccatgttcaagaagctg

SEQ ID NO: 138214 - DNA, 25 bp, Mus musculus
tcgccgcttgtgtggctcgctggct

SEQ ID NO: 138215 - DNA, 25 bp, Mus musculus
tcgccggagaaagtggaagattaca

SEQ ID NO: 138216 - DNA, 25 bp, Mus musculus
tcgccggatcctttgagcttcatga

SEQ ID NO: 138217 - DNA, 25 bp, Mus musculus
tcgccggcggctgcagccttgcact

SEQ ID NO: 138218 - DNA, 25 bp, Mus musculus
tcgccgggaactgagcattgctgtc

SEQ ID NO: 138219 - DNA, 25 bp, Mus musculus
tcgccgtatttgagataaaacatcg

SEQ ID NO: 138220 - DNA, 25 bp, Mus musculus
tcgccgtggcaacgtgaggacatcc

SEQ ID NO: 138221 - DNA, 25 bp, Mus musculus
tcgccgtgtcaacctcagtgaggca

SEQ ID NO: 138222 - DNA, 25 bp, Mus musculus
tcgccgtgtgactcgctggtacctg

SEQ ID NO: 138223 - DNA, 25 bp, Mus musculus
tcgcctaggaacacatcctgactgg

SEQ ID NO: 138224 - DNA, 25 bp, Mus musculus
tcgcctattgagcatgcgcaggtgc

SEQ ID NO: 138225 - DNA, 25 bp, Mus musculus
tcgcctccaagagagcaatgaccat

SEQ ID NO: 138226 - DNA, 25 bp, Mus musculus
tcgcctcggttcctttgacttcaaa

SEQ ID NO: 138227 - DNA, 25 bp, Mus musculus
tcgcctgagcgagcaacaagtggac

SEQ ID NO: 138228 - DNA, 25 bp, Mus musculus
tcgcctgcgattcaaggcttgctgc

SEQ ID NO: 138229 - DNA, 25 bp, Mus musculus
tcgcctggaagaacctagaatggac

SEQ ID NO: 138230 - DNA, 25 bp, Mus musculus
tcgcctggagcctgaacggagccct

SEQ ID NO: 138231 - DNA, 25 bp, Mus musculus
tcgcctggagcgtggaaaaacaaag

SEQ ID NO: 138232 - DNA, 25 bp, Mus musculus
tcgcctggccaacatcatgaaagag

SEQ ID NO: 138233 - DNA, 25 bp, Mus musculus
tcgccttcgagacagtgagaatact

SEQ ID NO: 138234 - DNA, 25 bp, Mus musculus
tcgccttgaagaagcctatgagaag

SEQ ID NO: 138235 - DNA, 25 bp, Mus musculus
tcgccttgagcctgtgacgggcagg

SEQ ID NO: 138236 - DNA, 25 bp, Mus musculus
tcgccttggcgttgtgcggaatcaa

SEQ ID NO: 138237 - DNA, 25 bp, Mus musculus
tcgccttgtcatggcctacgaggag

SEQ ID NO: 138238 - DNA, 25 bp, Mus musculus
tcgcgaaccgagaagcgtttagtac

SEQ ID NO: 138239 - DNA, 25 bp, Mus musculus
tcgcgacgtattggcctggaccttc

SEQ ID NO: 138240 - DNA, 25 bp, Mus musculus
tcgcgaggcggcgtatggcggacgc

SEQ ID NO: 138241 - DNA, 25 bp, Mus musculus
tcgcgagggacttggtggagtgctc

SEQ ID NO: 138242 - DNA, 25 bp, Mus musculus
tcgcgcaagcttggaggccaagcta

SEQ ID NO: 138243 - DNA, 25 bp, Mus musculus
tcgcgcacgaggtgctcgtgtcccg

SEQ ID NO: 138244 - DNA, 25 bp, Mus musculus
tcgcgcagcgctacaagaagaagag

SEQ ID NO: 138245 - DNA, 25 bp, Mus musculus
tcgcgcagtgcagtcagaggatgac

SEQ ID NO: 138246 - DNA, 25 bp, Mus musculus
tcgcgcgacgattggctgcctcggt

SEQ ID NO: 138247 - DNA, 25 bp, Mus musculus
tcgcgcggtctaagagcgtcagtcc

SEQ ID NO: 138248 - DNA, 25 bp, Mus musculus
tcgcgctcgactttggactggtgcc

SEQ ID NO: 138249 - DNA, 25 bp, Mus musculus
tcgcgcttccgccatctttccagct

SEQ ID NO: 138250 - DNA, 25 bp, Mus musculus
tcgcggaacctttgaggtgaggcct

SEQ ID NO: 138251 - DNA, 25 bp, Mus musculus
tcgcggagccatttgagaacggacc

SEQ ID NO: 138252 - DNA, 25 bp, Mus musculus
tcgcggcaaagtgcagcggctgcat

SEQ ID NO: 138253 - DNA, 25 bp, Mus musculus
tcgcggcagttaaaaaactagatcc

SEQ ID NO: 138254 - DNA, 25 bp, Mus musculus
tcgcggccgaatccatcattaaacg

SEQ ID NO: 138255 - DNA, 25 bp, Mus musculus
tcgcggcctctggttctcggcggga

SEQ ID NO: 138256 - DNA, 25 bp, Mus musculus
tcgcggcgattggagctgcagtttc

SEQ ID NO: 138257 - DNA, 25 bp, Mus musculus
tcgcggcttctctgggcagacagag

SEQ ID NO: 138258 - DNA, 25 bp, Mus musculus
tcgcgtctcggaaacccgtagccct

SEQ ID NO: 138259 - DNA, 25 bp, Mus musculus
tcgcgttcataatggacggcaaccg

SEQ ID NO: 138260 - DNA, 25 bp, Mus musculus
tcgctaaaatcgtggcggcagacgc

SEQ ID NO: 138261 - DNA, 25 bp, Mus musculus
tcgctacagaagcaggaacttcgga

SEQ ID NO: 138262 - DNA, 25 bp, Mus musculus
tcgctagagaaatccagtgaccaag

SEQ ID NO: 138263 - DNA, 25 bp, Mus musculus
tcgctcagaccacgaacgggagaga

SEQ ID NO: 138264 - DNA, 25 bp, Mus musculus
tcgctcagcacaatgggctgcaaaa

SEQ ID NO: 138265 - DNA, 25 bp, Mus musculus
tcgctcaggctgagagtaactaact

SEQ ID NO: 138266 - DNA, 25 bp, Mus musculus
tcgctcatctggctctgaaacggag

SEQ ID NO: 138267 - DNA, 25 bp, Mus musculus
tcgctcatgcgtacaacagggtatg

SEQ ID NO: 138268 - DNA, 25 bp, Mus musculus
tcgctgaagagcacggcaagaagct

SEQ ID NO: 138269 - DNA, 25 bp, Mus musculus
tcgctgaaggtctgagcactgccct

SEQ ID NO: 138270 - DNA, 25 bp, Mus musculus
tcgctgagctagagatggaagcttt

SEQ ID NO: 138271 - DNA, 25 bp, Mus musculus
tcgctgatgcagtatgaaacaccgg

SEQ ID NO: 138272 - DNA, 25 bp, Mus musculus
tcgctgcacaaaaggaaaagactcc

SEQ ID NO: 138273 - DNA, 25 bp, Mus musculus
tcgctgccagcttgccctgaggagt

SEQ ID NO: 138274 - DNA, 25 bp, Mus musculus
tcgctgcgctggtcgtcgacaacgg

SEQ ID NO: 138275 - DNA, 25 bp, Mus musculus
tcgctgctgcctgatagaaacgcca

SEQ ID NO: 138276 - DNA, 25 bp, Mus musculus
tcgctggacccgaaagctggtgttg

SEQ ID NO: 138277 - DNA, 25 bp, Mus musculus
tcgctggaggaagagatccagttct

SEQ ID NO: 138278 - DNA, 25 bp, Mus musculus
tcgctggatagaactgagatggtgc

SEQ ID NO: 138279 - DNA, 25 bp, Mus musculus
tcgctggcccagctgcttcgtgtgc

SEQ ID NO: 138280 - DNA, 25 bp, Mus musculus
tcgctggcctatagcagtgtccaag

SEQ ID NO: 138281 - DNA, 25 bp, Mus musculus
tcgctggctatgacctgaacaagac

SEQ ID NO: 138282 - DNA, 25 bp, Mus musculus
tcgctggctgcgtggctcggttctt

SEQ ID NO: 138283 - DNA, 25 bp, Mus musculus
tcgctgtcccttaagtgaggcttcc

SEQ ID NO: 138284 - DNA, 25 bp, Mus musculus
tcgcttaacgcacacggcagcagcg

SEQ ID NO: 138285 - DNA, 25 bp, Mus musculus
tcgcttacacttgagaagaactact

SEQ ID NO: 138286 - DNA, 25 bp, Mus musculus
tcgcttacgtgagcagaagtagttc

SEQ ID NO: 138287 - DNA, 25 bp, Mus musculus
tcgcttaggaacagtgatgcaccgg

SEQ ID NO: 138288 - DNA, 25 bp, Mus musculus
tcgcttctctaagatggcagccagc

SEQ ID NO: 138289 - DNA, 25 bp, Mus musculus
tcgcttgaatggcactctacgggaa

SEQ ID NO: 138290 - DNA, 25 bp, Mus musculus
tcgcttggctgcaccatggagttca

SEQ ID NO: 138291 - DNA, 25 bp, Mus musculus
tcgctttaggatcagtaagtctcgg

SEQ ID NO: 138292 - DNA, 25 bp, Mus musculus
tcgctttctggatggagcattccca

SEQ ID NO: 138293 - DNA, 25 bp, Mus musculus
tcggaaaatgacagcaccagtgcgg

SEQ ID NO: 138294 - DNA, 25 bp, Mus musculus
tcggaaacaaaacagcggcagctga

SEQ ID NO: 138295 - DNA, 25 bp, Mus musculus
tcggaaacgcaagcaggaggaacaa

SEQ ID NO: 138296 - DNA, 25 bp, Mus musculus
tcggaaacgtagaaaccagtaccag

SEQ ID NO: 138297 - DNA, 25 bp, Mus musculus
tcggaaactaaggatgagaccaacc

SEQ ID NO: 138298 - DNA, 25 bp, Mus musculus
tcggaaagaagacacagagggcaat

SEQ ID NO: 138299 - DNA, 25 bp, Mus musculus
tcggaaagcatctgagccagcaggt

SEQ ID NO: 138300 - DNA, 25 bp, Mus musculus
tcggaaatctaaacacagctgtggt

SEQ ID NO: 138301 - DNA, 25 bp, Mus musculus
tcggaaatgactaactgaaacgtgg

SEQ ID NO: 138302 - DNA, 25 bp, Mus musculus
tcggaaattcctgtgcactgagctg

SEQ ID NO: 138303 - DNA, 25 bp, Mus musculus
tcggaacacatcagcacaagagcgc

SEQ ID NO: 138304 - DNA, 25 bp, Mus musculus
tcggaacagatccaccctgaaagtg

SEQ ID NO: 138305 - DNA, 25 bp, Mus musculus
tcggaacaggtgaagatgctgcagc

SEQ ID NO: 138306 - DNA, 25 bp, Mus musculus
tcggaacctggacaagaacactgtg

SEQ ID NO: 138307 - DNA, 25 bp, Mus musculus
tcggaactaaggagtgaactgcagc

SEQ ID NO: 138308 - DNA, 25 bp, Mus musculus
tcggaactacaacgccaagacggag

SEQ ID NO: 138309 - DNA, 25 bp, Mus musculus
tcggaactatggaagctacagaagc

SEQ ID NO: 138310 - DNA, 25 bp, Mus musculus
tcggaagactctttgatggtacaga

SEQ ID NO: 138311 - DNA, 25 bp, Mus musculus
tcggaagcactacacccttggaggc

SEQ ID NO: 138312 - DNA, 25 bp, Mus musculus
tcggaagggagtacatagaccacct

SEQ ID NO: 138313 - DNA, 25 bp, Mus musculus
tcggaagggcagcaaaaagcaattt

SEQ ID NO: 138314 - DNA, 25 bp, Mus musculus
tcggaaggttcgcaaaggcatcatg

SEQ ID NO: 138315 - DNA, 25 bp, Mus musculus
tcggaagtggcaatctgaggcaagc

SEQ ID NO: 138316 - DNA, 25 bp, Mus musculus
tcggaagtggtactcgcccatcaag

SEQ ID NO: 138317 - DNA, 25 bp, Mus musculus
tcggaatataatggcaacaggtgac

SEQ ID NO: 138318 - DNA, 25 bp, Mus musculus
tcggaatcagacaataacatcaggc

SEQ ID NO: 138319 - DNA, 25 bp, Mus musculus
tcggaatcagacttcgggaaaatga

SEQ ID NO: 138320 - DNA, 25 bp, Mus musculus
tcggaatccaagtgccagacagtgt

SEQ ID NO: 138321 - DNA, 25 bp, Mus musculus
tcggaattccgcttcccgtctgaca

SEQ ID NO: 138322 - DNA, 25 bp, Mus musculus
tcggaatttcgtgatgcccctgaga

SEQ ID NO: 138323 - DNA, 25 bp, Mus musculus
tcggacaagagtgaagactacaggc

SEQ ID NO: 138324 - DNA, 25 bp, Mus musculus
tcggacaccttcttgaccagagaca

SEQ ID NO: 138325 - DNA, 25 bp, Mus musculus
tcggacagaccatctctcggaagcg

SEQ ID NO: 138326 - DNA, 25 bp, Mus musculus
tcggacagcgagtgaccacggattg

SEQ ID NO: 138327 - DNA, 25 bp, Mus musculus
tcggacagttcctgcctgaggcaaa

SEQ ID NO: 138328 - DNA, 25 bp, Mus musculus
tcggacgatgaggacgagacgcacc

SEQ ID NO: 138329 - DNA, 25 bp, Mus musculus
tcggactaacctccgtgtcgtcgct

SEQ ID NO: 138330 - DNA, 25 bp, Mus musculus
tcggactaagaacgatggcttttct

SEQ ID NO: 138331 - DNA, 25 bp, Mus musculus
tcggactacgagagactagagagca

SEQ ID NO: 138332 - DNA, 25 bp, Mus musculus
tcggactccaacacaggcatgctag

SEQ ID NO: 138333 - DNA, 25 bp, Mus musculus
tcggactcctctgaatgccctaaag

SEQ ID NO: 138334 - DNA, 25 bp, Mus musculus
tcggactgtagcatcagcgctagcg

SEQ ID NO: 138335 - DNA, 25 bp, Mus musculus
tcggagaaaaggtttacaagcaagc

SEQ ID NO: 138336 - DNA, 25 bp, Mus musculus
tcggagaaagaagaccaagcaaggc

SEQ ID NO: 138337 - DNA, 25 bp, Mus musculus
tcggagaaagcagcattgagggcct

SEQ ID NO: 138338 - DNA, 25 bp, Mus musculus
tcggagaacctaactgtgaccaaag

SEQ ID NO: 138339 - DNA, 25 bp, Mus musculus
tcggagaatgaggaacaagcgacac

SEQ ID NO: 138340 - DNA, 25 bp, Mus musculus
tcggagacacttcagtttctcgcag

SEQ ID NO: 138341 - DNA, 25 bp, Mus musculus
tcggagacagggtggccgcaacatc

SEQ ID NO: 138342 - DNA, 25 bp, Mus musculus
tcggagagcttgatgaacctcagcc

SEQ ID NO: 138343 - DNA, 25 bp, Mus musculus
tcggagatctttgccaagcgcgctt

SEQ ID NO: 138344 - DNA, 25 bp, Mus musculus
tcggagcatgcctacccaccgggta

SEQ ID NO: 138345 - DNA, 25 bp, Mus musculus
tcggagcccatgagcgctctggcct

SEQ ID NO: 138346 - DNA, 25 bp, Mus musculus
tcggagcccttatccactacgtgga

SEQ ID NO: 138347 - DNA, 25 bp, Mus musculus
tcggagccgaccacggtgactggtt

SEQ ID NO: 138348 - DNA, 25 bp, Mus musculus
tcggagctgccaccaaagcgatgtg

SEQ ID NO: 138349 - DNA, 25 bp, Mus musculus
tcggagctgcgcgaacatggccgaa

SEQ ID NO: 138350 - DNA, 25 bp, Mus musculus
tcggagctgcgtgtgaaatggattc

SEQ ID NO: 138351 - DNA, 25 bp, Mus musculus
tcggagctttcagccgaggatcaga

SEQ ID NO: 138352 - DNA, 25 bp, Mus musculus
tcggaggaaagctcttgccaccagc

SEQ ID NO: 138353 - DNA, 25 bp, Mus musculus
tcggaggagctcttctgtttcctgt

SEQ ID NO: 138354 - DNA, 25 bp, Mus musculus
tcggaggcatcactcaacacattgg

SEQ ID NO: 138355 - DNA, 25 bp, Mus musculus
tcggaggcatgacaaagcaagactg

SEQ ID NO: 138356 - DNA, 25 bp, Mus musculus
tcggaggcttcacctcgtggtcgac

SEQ ID NO: 138357 - DNA, 25 bp, Mus musculus
tcggaggtcctgcatcaagtgttca

SEQ ID NO: 138358 - DNA, 25 bp, Mus musculus
tcggaggtgccgacctgcattgcag

SEQ ID NO: 138359 - DNA, 25 bp, Mus musculus
tcggagtagtataccaggcacggct

SEQ ID NO: 138360 - DNA, 25 bp, Mus musculus
tcggagtcaggttcaagagctagtc

SEQ ID NO: 138361 - DNA, 25 bp, Mus musculus
tcggagttcccacaaggtcatgatc

SEQ ID NO: 138362 - DNA, 25 bp, Mus musculus
tcggataaagactcggaagcctggg

SEQ ID NO: 138363 - DNA, 25 bp, Mus musculus
tcggataattcctcagtgcccacgg

SEQ ID NO: 138364 - DNA, 25 bp, Mus musculus
tcggatatggcagaggaacttggca

SEQ ID NO: 138365 - DNA, 25 bp, Mus musculus
tcggatattcgtgtgaatgccgtgg

SEQ ID NO: 138366 - DNA, 25 bp, Mus musculus
tcggatcagatccgattgaagtgta

SEQ ID NO: 138367 - DNA, 25 bp, Mus musculus
tcggatcgggacttcatggagacac

SEQ ID NO: 138368 - DNA, 25 bp, Mus musculus
tcggatcgtcccagcgggcggacga

SEQ ID NO: 138369 - DNA, 25 bp, Mus musculus
tcggatcttactgaggaaccctggt

SEQ ID NO: 138370 - DNA, 25 bp, Mus musculus
tcggatgagcagttaaggcgacgtc

SEQ ID NO: 138371 - DNA, 25 bp, Mus musculus
tcggatgcaaccaacaaacaggtgc

SEQ ID NO: 138372 - DNA, 25 bp, Mus musculus
tcggatgctcaggtgcaaacggacc

SEQ ID NO: 138373 - DNA, 25 bp, Mus musculus
tcggatgtctccgacgtggccgcag

SEQ ID NO: 138374 - DNA, 25 bp, Mus musculus
tcggattcagtctggatcggactaa

SEQ ID NO: 138375 - DNA, 25 bp, Mus musculus
tcggattcgtcatgctacactgtgc

SEQ ID NO: 138376 - DNA, 25 bp, Mus musculus
tcggcaaatggagaaaactgccacg

SEQ ID NO: 138377 - DNA, 25 bp, Mus musculus
tcggcaacggctacagaggaaccat

SEQ ID NO: 138378 - DNA, 25 bp, Mus musculus
tcggcaactacatgtgggatcccag

SEQ ID NO: 138379 - DNA, 25 bp, Mus musculus
tcggcaatttgtgtatctagaaagt

SEQ ID NO: 138380 - DNA, 25 bp, Mus musculus
tcggcacacccggagagtcatttgt

SEQ ID NO: 138381 - DNA, 25 bp, Mus musculus
tcggcacactaaggaacatggcggc

SEQ ID NO: 138382 - DNA, 25 bp, Mus musculus
tcggcacagttcaagagataggagc

SEQ ID NO: 138383 - DNA, 25 bp, Mus musculus
tcggcacatccttgaagcacctcag

SEQ ID NO: 138384 - DNA, 25 bp, Mus musculus
tcggcacccatttgcccaggcagtg

SEQ ID NO: 138385 - DNA, 25 bp, Mus musculus
tcggcacggtgctgaagaacctgga

SEQ ID NO: 138386 - DNA, 25 bp, Mus musculus
tcggcacttctgttaccatgaggca

SEQ ID NO: 138387 - DNA, 25 bp, Mus musculus
tcggcagaagatgcgcgagtgccat

SEQ ID NO: 138388 - DNA, 25 bp, Mus musculus
tcggcagagcccagatgctttcgag

SEQ ID NO: 138389 - DNA, 25 bp, Mus musculus
tcggcagccacacggtattggagct

SEQ ID NO: 138390 - DNA, 25 bp, Mus musculus
tcggcagtcagtgcatgcagcctaa

SEQ ID NO: 138391 - DNA, 25 bp, Mus musculus
tcggcagtgcaaattagtagaagcc

SEQ ID NO: 138392 - DNA, 25 bp, Mus musculus
tcggcagtggctggcaagaaacaat

SEQ ID NO: 138393 - DNA, 25 bp, Mus musculus
tcggcatacaagatagtaccagatg

SEQ ID NO: 138394 - DNA, 25 bp, Mus musculus
tcggcatagaacaagaacattgagt

SEQ ID NO: 138395 - DNA, 25 bp, Mus musculus
tcggcatagctgtctctggaggcca

SEQ ID NO: 138396 - DNA, 25 bp, Mus musculus
tcggcatagggaaagccacggtgct

SEQ ID NO: 138397 - DNA, 25 bp, Mus musculus
tcggcatctgtgtgctgactgacct

SEQ ID NO: 138398 - DNA, 25 bp, Mus musculus
tcggcatcttcttcactgcctctgg

SEQ ID NO: 138399 - DNA, 25 bp, Mus musculus
tcggcattggcattgcactctcagg

SEQ ID NO: 138400 - DNA, 25 bp, Mus musculus
tcggccacctttgaagactcggtgt

SEQ ID NO: 138401 - DNA, 25 bp, Mus musculus
tcggccagcgacagccatgaactat

SEQ ID NO: 138402 - DNA, 25 bp, Mus musculus
tcggccaggtctacggctgtgacaa

SEQ ID NO: 138403 - DNA, 25 bp, Mus musculus
tcggccatgtcgctgctctgtgtgc

SEQ ID NO: 138404 - DNA, 25 bp, Mus musculus
tcggcccaagatcctacgttgtaaa

SEQ ID NO: 138405 - DNA, 25 bp, Mus musculus
tcggcccaagctccatgtgttcggt

SEQ ID NO: 138406 - DNA, 25 bp, Mus musculus
tcggcccaccgaagtcacggaaaag

SEQ ID NO: 138407 - DNA, 25 bp, Mus musculus
tcggcccagtgatcatgacaggaat

SEQ ID NO: 138408 - DNA, 25 bp, Mus musculus
tcggccctgttatgagaaccagtga

SEQ ID NO: 138409 - DNA, 25 bp, Mus musculus
tcggccggtcctctctagctgggct

SEQ ID NO: 138410 - DNA, 25 bp, Mus musculus
tcggccgtgaggtgtttgcagcata

SEQ ID NO: 138411 - DNA, 25 bp, Mus musculus
tcggcctgcgttggtggaatcatat

SEQ ID NO: 138412 - DNA, 25 bp, Mus musculus
tcggcgaatgcctgcccttactgcg

SEQ ID NO: 138413 - DNA, 25 bp, Mus musculus
tcggcgaccgcctgtattcggaggt

SEQ ID NO: 138414 - DNA, 25 bp, Mus musculus
tcggcgacctcaaacctgggagatt

SEQ ID NO: 138415 - DNA, 25 bp, Mus musculus
tcggcgagaacaaccagaagtactt

SEQ ID NO: 138416 - DNA, 25 bp, Mus musculus
tcggcgagggcatggtctactgtct

SEQ ID NO: 138417 - DNA, 25 bp, Mus musculus
tcggcgctacaacgtcctgagcaag

SEQ ID NO: 138418 - DNA, 25 bp, Mus musculus
tcggcgctggcctatgtgctggaca

SEQ ID NO: 138419 - DNA, 25 bp, Mus musculus
tcggcggacaaaaacctagggcgct

SEQ ID NO: 138420 - DNA, 25 bp, Mus musculus
tcggcggccctcagtcagtttgtga

SEQ ID NO: 138421 - DNA, 25 bp, Mus musculus
tcggcggctgagagatcctgacata

SEQ ID NO: 138422 - DNA, 25 bp, Mus musculus
tcggcggctttcgtccggatggact

SEQ ID NO: 138423 - DNA, 25 bp, Mus musculus
tcggcgtacacagcccgcgctcctc

SEQ ID NO: 138424 - DNA, 25 bp, Mus musculus
tcggcgtgggtaagacgagcatcat

SEQ ID NO: 138425 - DNA, 25 bp, Mus musculus
tcggcgttcgcaagggttctcatgc

SEQ ID NO: 138426 - DNA, 25 bp, Mus musculus
tcggcgttgcgtttgtggacatgct

SEQ ID NO: 138427 - DNA, 25 bp, Mus musculus
tcggctaataacaacctgggagaaa

SEQ ID NO: 138428 - DNA, 25 bp, Mus musculus
tcggctacccaagaagacaggagct

SEQ ID NO: 138429 - DNA, 25 bp, Mus musculus
tcggctattgggaaacgtgaagtgc

SEQ ID NO: 138430 - DNA, 25 bp, Mus musculus
tcggctcagaggtctccagaaacaa

SEQ ID NO: 138431 - DNA, 25 bp, Mus musculus
tcggctcatggcctcgaatgtggaa

SEQ ID NO: 138432 - DNA, 25 bp, Mus musculus
tcggctcctctctgggctgcaacta

SEQ ID NO: 138433 - DNA, 25 bp, Mus musculus
tcggctctgtaactggctggcagca

SEQ ID NO: 138434 - DNA, 25 bp, Mus musculus
tcggctgacagtgcccggaccggat

SEQ ID NO: 138435 - DNA, 25 bp, Mus musculus
tcggctggcaatgggttctggatcc

SEQ ID NO: 138436 - DNA, 25 bp, Mus musculus
tcggctgtgcaggagaacgtcagct

SEQ ID NO: 138437 - DNA, 25 bp, Mus musculus
tcggcttccccactctggctgtggg

SEQ ID NO: 138438 - DNA, 25 bp, Mus musculus
tcggcttccgtagacgaggtcgggc

SEQ ID NO: 138439 - DNA, 25 bp, Mus musculus
tcggcttcgggaactgggacaagat

SEQ ID NO: 138440 - DNA, 25 bp, Mus musculus
tcggcttgtcactgtagaggaactt

SEQ ID NO: 138441 - DNA, 25 bp, Mus musculus
tcggctttaaggtggcagtgatcgc

SEQ ID NO: 138442 - DNA, 25 bp, Mus musculus
tcggctttcaccacaagaagggctg

SEQ ID NO: 138443 - DNA, 25 bp, Mus musculus
tcggctttccccttaaatggcgcag

SEQ ID NO: 138444 - DNA, 25 bp, Mus musculus
tcggctttgggcatcatattgaaca

SEQ ID NO: 138445 - DNA, 25 bp, Mus musculus
tcggctttgtggaatacggctgaga

SEQ ID NO: 138446 - DNA, 25 bp, Mus musculus
tcgggaaaacacctttcttctcaag

SEQ ID NO: 138447 - DNA, 25 bp, Mus musculus
tcgggaaaataaaactgcggatact

SEQ ID NO: 138448 - DNA, 25 bp, Mus musculus
tcgggaaagccaagaaagcctggaa

SEQ ID NO: 138449 - DNA, 25 bp, Mus musculus
tcgggaaagcggcaacactagatga

SEQ ID NO: 138450 - DNA, 25 bp, Mus musculus
tcgggaaatgtaaggcacaggctac

SEQ ID NO: 138451 - DNA, 25 bp, Mus musculus
tcgggaacacccaccatgaatggag

SEQ ID NO: 138452 - DNA, 25 bp, Mus musculus
tcgggaacgacaacaggaagtgacc

SEQ ID NO: 138453 - DNA, 25 bp, Mus musculus
tcgggaagcagggattccagtgtca

SEQ ID NO: 138454 - DNA, 25 bp, Mus musculus
tcgggaagctcctgcaggctcatga

SEQ ID NO: 138455 - DNA, 25 bp, Mus musculus
tcgggaagctgcatagtgaactaga

SEQ ID NO: 138456 - DNA, 25 bp, Mus musculus
tcgggaatcgctaccatctgctgct

SEQ ID NO: 138457 - DNA, 25 bp, Mus musculus
tcgggacacatcacaatccagctgt

SEQ ID NO: 138458 - DNA, 25 bp, Mus musculus
tcgggacctccctcagggacgtgtc

SEQ ID NO: 138459 - DNA, 25 bp, Mus musculus
tcgggactccaagtagtaatgattc

SEQ ID NO: 138460 - DNA, 25 bp, Mus musculus
tcgggactcggaagccgccgggact

SEQ ID NO: 138461 - DNA, 25 bp, Mus musculus
tcgggacttccggaacacatttggg

SEQ ID NO: 138462 - DNA, 25 bp, Mus musculus
tcgggagactctcgtccatgttgca

SEQ ID NO: 138463 - DNA, 25 bp, Mus musculus
tcgggagagcaatccggctgccctc

SEQ ID NO: 138464 - DNA, 25 bp, Mus musculus
tcgggagcctaaacagagcctgggt

SEQ ID NO: 138465 - DNA, 25 bp, Mus musculus
tcgggagcctgcatgacctgtaacc

SEQ ID NO: 138466 - DNA, 25 bp, Mus musculus
tcgggaggaggcgagagtcggctta

SEQ ID NO: 138467 - DNA, 25 bp, Mus musculus
tcgggagtgacagccagaattgctc

SEQ ID NO: 138468 - DNA, 25 bp, Mus musculus
tcgggatacatttaagcgcaacagc

SEQ ID NO: 138469 - DNA, 25 bp, Mus musculus
tcgggataccatctaccaagtgcca

SEQ ID NO: 138470 - DNA, 25 bp, Mus musculus
tcgggatctttgtggccttctgggc

SEQ ID NO: 138471 - DNA, 25 bp, Mus musculus
tcgggcaaacggagtaaacaataca

SEQ ID NO: 138472 - DNA, 25 bp, Mus musculus
tcgggcaccgtcaggttggcaccgc

SEQ ID NO: 138473 - DNA, 25 bp, Mus musculus
tcgggcacggagtgtaccatctaca

SEQ ID NO: 138474 - DNA, 25 bp, Mus musculus
tcgggcacttccaacagaatcaggt

SEQ ID NO: 138475 - DNA, 25 bp, Mus musculus
tcgggcagcactcatcaatgtgggc

SEQ ID NO: 138476 - DNA, 25 bp, Mus musculus
tcgggcagcagtgaacctagcgctt

SEQ ID NO: 138477 - DNA, 25 bp, Mus musculus
tcgggcatccatctgtaacgcgctg

SEQ ID NO: 138478 - DNA, 25 bp, Mus musculus
tcgggcatggctgtgtttcaataaa

SEQ ID NO: 138479 - DNA, 25 bp, Mus musculus
tcgggccagaaaagagcggaaatcc

SEQ ID NO: 138480 - DNA, 25 bp, Mus musculus
tcgggccgcagactgtaccaagtct

SEQ ID NO: 138481 - DNA, 25 bp, Mus musculus
tcgggccgctcgttcgccccgccgg

SEQ ID NO: 138482 - DNA, 25 bp, Mus musculus
tcgggccgggcgctggcagggctaa

SEQ ID NO: 138483 - DNA, 25 bp, Mus musculus
tcgggcctagtaacccaggaggagc

SEQ ID NO: 138484 - DNA, 25 bp, Mus musculus
tcgggcctccctttgtcctgtggaa

SEQ ID NO: 138485 - DNA, 25 bp, Mus musculus
tcgggcctgtgagcatctttggata

SEQ ID NO: 138486 - DNA, 25 bp, Mus musculus
tcgggcggcttttcgcagcaggaat

SEQ ID NO: 138487 - DNA, 25 bp, Mus musculus
tcgggcgggtatggaggcggcgcgc

SEQ ID NO: 138488 - DNA, 25 bp, Mus musculus
tcgggctaagctccagtgtaaagac

SEQ ID NO: 138489 - DNA, 25 bp, Mus musculus
tcgggctatgggacccagaacattc

SEQ ID NO: 138490 - DNA, 25 bp, Mus musculus
tcgggcttcgctagcctagcgccgt

SEQ ID NO: 138491 - DNA, 25 bp, Mus musculus
tcgggcttgctgaactgacaggaga

SEQ ID NO: 138492 - DNA, 25 bp, Mus musculus
tcggggcctcccggcctgagggaga

SEQ ID NO: 138493 - DNA, 25 bp, Mus musculus
tcgggggaagctgcgaggcgccacg

SEQ ID NO: 138494 - DNA, 25 bp, Mus musculus
tcgggtcacgagtagggccattctt

SEQ ID NO: 138495 - DNA, 25 bp, Mus musculus
tcgggtcatttcctttgaagagcag

SEQ ID NO: 138496 - DNA, 25 bp, Mus musculus
tcgggtcctgctggacacgtggtat

SEQ ID NO: 138497 - DNA, 25 bp, Mus musculus
tcgggtcttgttactggatgggtct

SEQ ID NO: 138498 - DNA, 25 bp, Mus musculus
tcgggtgtgaaaagccaaacatcag

SEQ ID NO: 138499 - DNA, 25 bp, Mus musculus
tcgggttcggtgtccgtcgcgtctc

SEQ ID NO: 138500 - DNA, 25 bp, Mus musculus
tcggtaagaccatgaagaccctgtc

SEQ ID NO: 138501 - DNA, 25 bp, Mus musculus
tcggtaagtcaattagcacgtggct

SEQ ID NO: 138502 - DNA, 25 bp, Mus musculus
tcggtacatgaggagaaaaacatct

SEQ ID NO: 138503 - DNA, 25 bp, Mus musculus
tcggtacggagcatctctcaaggag

SEQ ID NO: 138504 - DNA, 25 bp, Mus musculus
tcggtactaacccaggacagcatga

SEQ ID NO: 138505 - DNA, 25 bp, Mus musculus
tcggtagcaacctagaagactggac

SEQ ID NO: 138506 - DNA, 25 bp, Mus musculus
tcggtagcgactacggaaaccccat

SEQ ID NO: 138507 - DNA, 25 bp, Mus musculus
tcggtatccatgaacaagcagctgt

SEQ ID NO: 138508 - DNA, 25 bp, Mus musculus
tcggtatcgcctgtgaagactcctt

SEQ ID NO: 138509 - DNA, 25 bp, Mus musculus
tcggtattgatcagctgcccatggt

SEQ ID NO: 138510 - DNA, 25 bp, Mus musculus
tcggtcacaccgagcaacttgtggg

SEQ ID NO: 138511 - DNA, 25 bp, Mus musculus
tcggtcacgatccaaatctcggtct

SEQ ID NO: 138512 - DNA, 25 bp, Mus musculus
tcggtccaaacttgctcaacacggt

SEQ ID NO: 138513 - DNA, 25 bp, Mus musculus
tcggtcccggaagtgctcaaagatg

SEQ ID NO: 138514 - DNA, 25 bp, Mus musculus
tcggtcctgaccaaagacaagttga

SEQ ID NO: 138515 - DNA, 25 bp, Mus musculus
tcggtcgccggagcgacaatgtgcg

SEQ ID NO: 138516 - DNA, 25 bp, Mus musculus
tcggtctgatccacggacaccaagt

SEQ ID NO: 138517 - DNA, 25 bp, Mus musculus
tcggtctttgccatctttttcccag

SEQ ID NO: 138518 - DNA, 25 bp, Mus musculus
tcggtgaatctgaccaagcttgaag

SEQ ID NO: 138519 - DNA, 25 bp, Mus musculus
tcggtgacaattaggctttgggccc

SEQ ID NO: 138520 - DNA, 25 bp, Mus musculus
tcggtgcccacgttcacacaggttg

SEQ ID NO: 138521 - DNA, 25 bp, Mus musculus
tcggtgcccattcaagaacctgaaa

SEQ ID NO: 138522 - DNA, 25 bp, Mus musculus
tcggtgcccggtttctaggctgtag

SEQ ID NO: 138523 - DNA, 25 bp, Mus musculus
tcggtggaaccgaggatccagttct

SEQ ID NO: 138524 - DNA, 25 bp, Mus musculus
tcggtggcccagaagtcagagctgc

SEQ ID NO: 138525 - DNA, 25 bp, Mus musculus
tcggtggccccagaaaagtcggtgt

SEQ ID NO: 138526 - DNA, 25 bp, Mus musculus
tcggtggcctgggaacatcggtttc

SEQ ID NO: 138527 - DNA, 25 bp, Mus musculus
tcggtggctttgacccagtgtggct

SEQ ID NO: 138528 - DNA, 25 bp, Mus musculus
tcggtgggaactcacgagccttgca

SEQ ID NO: 138529 - DNA, 25 bp, Mus musculus
tcggtgggcgctggaagtaaaagag

SEQ ID NO: 138530 - DNA, 25 bp, Mus musculus
tcggtggtgctcaagattgctcgcc

SEQ ID NO: 138531 - DNA, 25 bp, Mus musculus
tcggtggtgtcctcaaaagtcaact

SEQ ID NO: 138532 - DNA, 25 bp, Mus musculus
tcggtgttaccgagatgaaggctca

SEQ ID NO: 138533 - DNA, 25 bp, Mus musculus
tcggtgttccgagcagaaatcgcaa

SEQ ID NO: 138534 - DNA, 25 bp, Mus musculus
tcggtgttcggcaagccccgagctg

SEQ ID NO: 138535 - DNA, 25 bp, Mus musculus
tcggttaatcacacctgcctcgcag

SEQ ID NO: 138536 - DNA, 25 bp, Mus musculus
tcggttacataacttgcgagctgtg

SEQ ID NO: 138537 - DNA, 25 bp, Mus musculus
tcggttacatctgggaagcacacct

SEQ ID NO: 138538 - DNA, 25 bp, Mus musculus
tcggttcacagacaaagatccacag

SEQ ID NO: 138539 - DNA, 25 bp, Mus musculus
tcggttcagtctccgtgaagcgttt

SEQ ID NO: 138540 - DNA, 25 bp, Mus musculus
tcggttcatcattcacacagtggga

SEQ ID NO: 138541 - DNA, 25 bp, Mus musculus
tcggttccagcgaaagttcaaggcc

SEQ ID NO: 138542 - DNA, 25 bp, Mus musculus
tcggttccatcactctcttcgctgt

SEQ ID NO: 138543 - DNA, 25 bp, Mus musculus
tcggttccccaatatcttgaaagaa

SEQ ID NO: 138544 - DNA, 25 bp, Mus musculus
tcggttcgagccgagaccaggagcc

SEQ ID NO: 138545 - DNA, 25 bp, Mus musculus
tcggttgttcattgccctgacaggc

SEQ ID NO: 138546 - DNA, 25 bp, Mus musculus
tcggtttaacatggcggagacggtc

SEQ ID NO: 138547 - DNA, 25 bp, Mus musculus
tcggtttctcgcgttgccgtggaaa

SEQ ID NO: 138548 - DNA, 25 bp, Mus musculus
tcgtaaaaaagatcggctcagcagc

SEQ ID NO: 138549 - DNA, 25 bp, Mus musculus
tcgtaaagcagtgaaggaaacccgg

SEQ ID NO: 138550 - DNA, 25 bp, Mus musculus
tcgtaaagtttagcctgcagaacct

SEQ ID NO: 138551 - DNA, 25 bp, Mus musculus
tcgtaaccatgtcttcaagcacaga

SEQ ID NO: 138552 - DNA, 25 bp, Mus musculus
tcgtaaccgggtagctacagggaca

SEQ ID NO: 138553 - DNA, 25 bp, Mus musculus
tcgtaataaagtgctcagcgtcagt

SEQ ID NO: 138554 - DNA, 25 bp, Mus musculus
tcgtacaagtggacagacatctggg

SEQ ID NO: 138555 - DNA, 25 bp, Mus musculus
tcgtacatccgagtgctgggcatcc

SEQ ID NO: 138556 - DNA, 25 bp, Mus musculus
tcgtacctcattcggcacaaattgg

SEQ ID NO: 138557 - DNA, 25 bp, Mus musculus
tcgtacctgaaccaaagactgtgcc

SEQ ID NO: 138558 - DNA, 25 bp, Mus musculus
tcgtacgggagctgggaaatcatct

SEQ ID NO: 138559 - DNA, 25 bp, Mus musculus
tcgtacgtcaccacactgagctgct

SEQ ID NO: 138560 - DNA, 25 bp, Mus musculus
tcgtactctgcgaccttcaaggaca

SEQ ID NO: 138561 - DNA, 25 bp, Mus musculus
tcgtagaagaagagcatcgcaggcc

SEQ ID NO: 138562 - DNA, 25 bp, Mus musculus
tcgtagacggaagcttgttcaccca

SEQ ID NO: 138563 - DNA, 25 bp, Mus musculus
tcgtagatcctgagcgtgacatgag

SEQ ID NO: 138564 - DNA, 25 bp, Mus musculus
tcgtagattccggagaaacacgtcg

SEQ ID NO: 138565 - DNA, 25 bp, Mus musculus
tcgtagccaacgtgccagaaggtct

SEQ ID NO: 138566 - DNA, 25 bp, Mus musculus
tcgtaggaggaaaaaacgcaccagc

SEQ ID NO: 138567 - DNA, 25 bp, Mus musculus
tcgtagggaacactcatgggcagct

SEQ ID NO: 138568 - DNA, 25 bp, Mus musculus
tcgtatcaggacactcggcagtgcc

SEQ ID NO: 138569 - DNA, 25 bp, Mus musculus
tcgtatggcaaaacatcggtggcag

SEQ ID NO: 138570 - DNA, 25 bp, Mus musculus
tcgtcaagcagctgtcggccaagct

SEQ ID NO: 138571 - DNA, 25 bp, Mus musculus
tcgtcaagcagggataccgaggcga

SEQ ID NO: 138572 - DNA, 25 bp, Mus musculus
tcgtcaatgggatgactcagggccc

SEQ ID NO: 138573 - DNA, 25 bp, Mus musculus
tcgtcacaccaaattcacagcagtg

SEQ ID NO: 138574 - DNA, 25 bp, Mus musculus
tcgtcacatccatagagttgccaaa

SEQ ID NO: 138575 - DNA, 25 bp, Mus musculus
tcgtcaccctgtctggtgcccaggg

SEQ ID NO: 138576 - DNA, 25 bp, Mus musculus
tcgtcacctcttacaacaggaactt

SEQ ID NO: 138577 - DNA, 25 bp, Mus musculus
tcgtcactgagagagtgcagcctct

SEQ ID NO: 138578 - DNA, 25 bp, Mus musculus
tcgtcatgacgtacctgtgccagat

SEQ ID NO: 138579 - DNA, 25 bp, Mus musculus
tcgtccagctgttggtcaaggccca

SEQ ID NO: 138580 - DNA, 25 bp, Mus musculus
tcgtcccaggaggaaacttcagcct

SEQ ID NO: 138581 - DNA, 25 bp, Mus musculus
tcgtcccggctgttgggatccctgg

SEQ ID NO: 138582 - DNA, 25 bp, Mus musculus
tcgtccgaagacaggcacctgggct

SEQ ID NO: 138583 - DNA, 25 bp, Mus musculus
tcgtccgaccggcaaaagatactgc

SEQ ID NO: 138584 - DNA, 25 bp, Mus musculus
tcgtccgagattggcttgagtgttc

SEQ ID NO: 138585 - DNA, 25 bp, Mus musculus
tcgtccgtgagtacaagtccatggt

SEQ ID NO: 138586 - DNA, 25 bp, Mus musculus
tcgtcctaagaagatgcgctgcggc

SEQ ID NO: 138587 - DNA, 25 bp, Mus musculus
tcgtcctcgtccaaaaagatgggca

SEQ ID NO: 138588 - DNA, 25 bp, Mus musculus
tcgtcctggttctctggcaataaaa

SEQ ID NO: 138589 - DNA, 25 bp, Mus musculus
tcgtcgacagaatcgaggcctctgg

SEQ ID NO: 138590 - DNA, 25 bp, Mus musculus
tcgtcgaggccagaacagtcttggc

SEQ ID NO: 138591 - DNA, 25 bp, Mus musculus
tcgtcgaggctgctccctggtgaat

SEQ ID NO: 138592 - DNA, 25 bp, Mus musculus
tcgtcgatttgagtatgaagaccct

SEQ ID NO: 138593 - DNA, 25 bp, Mus musculus
tcgtcgccgcaggattctactttca

SEQ ID NO: 138594 - DNA, 25 bp, Mus musculus
tcgtcgccgtgtcccaaaatatggg

SEQ ID NO: 138595 - DNA, 25 bp, Mus musculus
tcgtcgctggagaaaatatcttcat

SEQ ID NO: 138596 - DNA, 25 bp, Mus musculus
tcgtcgcttgcatcccgggtcatgg

SEQ ID NO: 138597 - DNA, 25 bp, Mus musculus
tcgtcgtcacctggactgaggctgc

SEQ ID NO: 138598 - DNA, 25 bp, Mus musculus
tcgtctactacgtgggtcgcaagcc

SEQ ID NO: 138599 - DNA, 25 bp, Mus musculus
tcgtctattacctctctggccgcga

SEQ ID NO: 138600 - DNA, 25 bp, Mus musculus
tcgtctccagaaaaccaaagctgtg

SEQ ID NO: 138601 - DNA, 25 bp, Mus musculus
tcgtctccagacatggagcccagct

SEQ ID NO: 138602 - DNA, 25 bp, Mus musculus
tcgtctctctactgaacatggccgg

SEQ ID NO: 138603 - DNA, 25 bp, Mus musculus
tcgtctgaaactcctaactttgtgg

SEQ ID NO: 138604 - DNA, 25 bp, Mus musculus
tcgtctgctccgcatgtccagggtg

SEQ ID NO: 138605 - DNA, 25 bp, Mus musculus
tcgtctgctgccaacgacacttgga

SEQ ID NO: 138606 - DNA, 25 bp, Mus musculus
tcgtctggcaaagggaaatcattcc

SEQ ID NO: 138607 - DNA, 25 bp, Mus musculus
tcgtctgtggttcctgtaatggtgt

SEQ ID NO: 138608 - DNA, 25 bp, Mus musculus
tcgtcttactattccaacctgggct

SEQ ID NO: 138609 - DNA, 25 bp, Mus musculus
tcgtcttatctagctccgctcttga

SEQ ID NO: 138610 - DNA, 25 bp, Mus musculus
tcgtcttcataaaggagcgcacgcg

SEQ ID NO: 138611 - DNA, 25 bp, Mus musculus
tcgtgaaataaaggagaatgcggtg

SEQ ID NO: 138612 - DNA, 25 bp, Mus musculus
tcgtgaaccaaaccaagctcaggga

SEQ ID NO: 138613 - DNA, 25 bp, Mus musculus
tcgtgaagatgctccggacagaact

SEQ ID NO: 138614 - DNA, 25 bp, Mus musculus
tcgtgaaggcacatcaggacaaccc

SEQ ID NO: 138615 - DNA, 25 bp, Mus musculus
tcgtgaagtattccatccgggacgg

SEQ ID NO: 138616 - DNA, 25 bp, Mus musculus
tcgtgacaactgagctgctgaaggc

SEQ ID NO: 138617 - DNA, 25 bp, Mus musculus
tcgtgacaaggctctagacctgctt

SEQ ID NO: 138618 - DNA, 25 bp, Mus musculus
tcgtgaccgtgatggttggcagccc

SEQ ID NO: 138619 - DNA, 25 bp, Mus musculus
tcgtgacgggcaggaaaccattaca

SEQ ID NO: 138620 - DNA, 25 bp, Mus musculus
tcgtgagggcgcctccaagaagcca

SEQ ID NO: 138621 - DNA, 25 bp, Mus musculus
tcgtgagtaccgacaccgaggacat

SEQ ID NO: 138622 - DNA, 25 bp, Mus musculus
tcgtgagtcaccagaaaaagccgta

SEQ ID NO: 138623 - DNA, 25 bp, Mus musculus
tcgtgattcgctatgtcaagaggca

SEQ ID NO: 138624 - DNA, 25 bp, Mus musculus
tcgtgcagttctacacaccgttcgg

SEQ ID NO: 138625 - DNA, 25 bp, Mus musculus
tcgtgcctgaggtaccagtctgctt

SEQ ID NO: 138626 - DNA, 25 bp, Mus musculus
tcgtgctcaaaacgctgagaatcca

SEQ ID NO: 138627 - DNA, 25 bp, Mus musculus
tcgtgctcttcagctatatgcagtg

SEQ ID NO: 138628 - DNA, 25 bp, Mus musculus
tcgtgctggtggtccgccagctgct

SEQ ID NO: 138629 - DNA, 25 bp, Mus musculus
tcgtgcttcaagctctcggaactgt

SEQ ID NO: 138630 - DNA, 25 bp, Mus musculus
tcgtggaacccgtcaatggcaagtt

SEQ ID NO: 138631 - DNA, 25 bp, Mus musculus
tcgtggaccagcaacgtttctcgcg

SEQ ID NO: 138632 - DNA, 25 bp, Mus musculus
tcgtggacgtcatggtaaacctgca

SEQ ID NO: 138633 - DNA, 25 bp, Mus musculus
tcgtggagtacaaaatctccgggcc

SEQ ID NO: 138634 - DNA, 25 bp, Mus musculus
tcgtggagtatcagaataagggccg

SEQ ID NO: 138635 - DNA, 25 bp, Mus musculus
tcgtggatgaatgcccgaaccacgg

SEQ ID NO: 138636 - DNA, 25 bp, Mus musculus
tcgtggatgatgaaaggctgtctgc

SEQ ID NO: 138637 - DNA, 25 bp, Mus musculus
tcgtggcatctaacaatgggccggc

SEQ ID NO: 138638 - DNA, 25 bp, Mus musculus
tcgtggcttaaccaaaacattgttc

SEQ ID NO: 138639 - DNA, 25 bp, Mus musculus
tcgtgggacccaagatctgcctgga

SEQ ID NO: 138640 - DNA, 25 bp, Mus musculus
tcgtgggaccgctggaaaaattctt

SEQ ID NO: 138641 - DNA, 25 bp, Mus musculus
tcgtgggactcgctattgggactct

SEQ ID NO: 138642 - DNA, 25 bp, Mus musculus
tcgtgggcacgcaaacatggaagaa

SEQ ID NO: 138643 - DNA, 25 bp, Mus musculus
tcgtgggcggaagaaccattttggc

SEQ ID NO: 138644 - DNA, 25 bp, Mus musculus
tcgtgggggtcctcctccacctatg

SEQ ID NO: 138645 - DNA, 25 bp, Mus musculus
tcgtggtcatgtacacagccggctt

SEQ ID NO: 138646 - DNA, 25 bp, Mus musculus
tcgtggtcgacatcacctgctaggc

SEQ ID NO: 138647 - DNA, 25 bp, Mus musculus
tcgtggtgcacggtcaaaggtaaca

SEQ ID NO: 138648 - DNA, 25 bp, Mus musculus
tcgtggtgctgctcctcggatggct

SEQ ID NO: 138649 - DNA, 25 bp, Mus musculus
tcgtggtgggtgttgtacacaatca

SEQ ID NO: 138650 - DNA, 25 bp, Mus musculus
tcgtgtacctggagaacactcacag

SEQ ID NO: 138651 - DNA, 25 bp, Mus musculus
tcgtgtacgacttggacacgtcggg

SEQ ID NO: 138652 - DNA, 25 bp, Mus musculus
tcgtgtagtgctttgccaccaagtg

SEQ ID NO: 138653 - DNA, 25 bp, Mus musculus
tcgtgtatccagtccgccttagcgc

SEQ ID NO: 138654 - DNA, 25 bp, Mus musculus
tcgtgtctcaaaagcacaaagttgt

SEQ ID NO: 138655 - DNA, 25 bp, Mus musculus
tcgtgtctgaatagaagttacctcg

SEQ ID NO: 138656 - DNA, 25 bp, Mus musculus
tcgtgtctttcgcaaccatggtgaa

SEQ ID NO: 138657 - DNA, 25 bp, Mus musculus
tcgtgtggcgttttcctaaaagagc

SEQ ID NO: 138658 - DNA, 25 bp, Mus musculus
tcgtgtgtggagtcaccagaccctg

SEQ ID NO: 138659 - DNA, 25 bp, Mus musculus
tcgtgtgtggatcctgcagaacaat

SEQ ID NO: 138660 - DNA, 25 bp, Mus musculus
tcgtgttccagaagcaactgcgagg

SEQ ID NO: 138661 - DNA, 25 bp, Mus musculus
tcgtgttgccttgactgacagctgc

SEQ ID NO: 138662 - DNA, 25 bp, Mus musculus
tcgtgtttaagtagacgcgtaggcc

SEQ ID NO: 138663 - DNA, 25 bp, Mus musculus
tcgttaagagtcaagctgccggtca

SEQ ID NO: 138664 - DNA, 25 bp, Mus musculus
tcgttacaagagtggtctcggaccc

SEQ ID NO: 138665 - DNA, 25 bp, Mus musculus
tcgttactagagatttacccatggg

SEQ ID NO: 138666 - DNA, 25 bp, Mus musculus
tcgttcaccagagagcgcacatgga

SEQ ID NO: 138667 - DNA, 25 bp, Mus musculus
tcgttcccaaagctgagttcccagg

SEQ ID NO: 138668 - DNA, 25 bp, Mus musculus
tcgttcgggctatgaccacgctcaa

SEQ ID NO: 138669 - DNA, 25 bp, Mus musculus
tcgttctgaagtccgagtgccggtc

SEQ ID NO: 138670 - DNA, 25 bp, Mus musculus
tcgttctggagggagcaaaagcttt

SEQ ID NO: 138671 - DNA, 25 bp, Mus musculus
tcgttgaaggaaagcggtatggcat

SEQ ID NO: 138672 - DNA, 25 bp, Mus musculus
tcgttgcaggacttaggaatggcgc

SEQ ID NO: 138673 - DNA, 25 bp, Mus musculus
tcgttgtgcccactgtcggaagcgc

SEQ ID NO: 138674 - DNA, 25 bp, Mus musculus
tcgtttacattaagctggagagccc

SEQ ID NO: 138675 - DNA, 25 bp, Mus musculus
tcgtttaccctcgaagccgaagagc

SEQ ID NO: 138676 - DNA, 25 bp, Mus musculus
tcgtttagtggctagtctcgtcgca

SEQ ID NO: 138677 - DNA, 25 bp, Mus musculus
tcgtttatgagcacagcatggctag

SEQ ID NO: 138678 - DNA, 25 bp, Mus musculus
tcgtttggacagattgaagagtgcc

SEQ ID NO: 138679 - DNA, 25 bp, Mus musculus
tcgtttggttacactcggaggagtc

SEQ ID NO: 138680 - DNA, 25 bp, Mus musculus
tctaaaacgttctagaggtcttgcc

SEQ ID NO: 138681 - DNA, 25 bp, Mus musculus
tctaaaactcagcagaggcacatgc

SEQ ID NO: 138682 - DNA, 25 bp, Mus musculus
tctaaaacttaacaagcggtcggtg

SEQ ID NO: 138683 - DNA, 25 bp, Mus musculus
tctaaaatctggatccctaaacatc

SEQ ID NO: 138684 - DNA, 25 bp, Mus musculus
tctaaaatgaggcacaacagtggca

SEQ ID NO: 138685 - DNA, 25 bp, Mus musculus
tctaaaatggtggtatgaagccctc

SEQ ID NO: 138686 - DNA, 25 bp, Mus musculus
tctaaaccctgcactgaccagacag

SEQ ID NO: 138687 - DNA, 25 bp, Mus musculus
tctaaaccgaaagccagtgagtggc

SEQ ID NO: 138688 - DNA, 25 bp, Mus musculus
tctaaaccgcggtaacgtggtggca

SEQ ID NO: 138689 - DNA, 25 bp, Mus musculus
tctaaaccgtcttggagcctgcagc

SEQ ID NO: 138690 - DNA, 25 bp, Mus musculus
tctaaagagaggaggcacccatgtt

SEQ ID NO: 138691 - DNA, 25 bp, Mus musculus
tctaaagagcaaaggcgggaaggtt

SEQ ID NO: 138692 - DNA, 25 bp, Mus musculus
tctaaagagcgctgcaggtctctgc

SEQ ID NO: 138693 - DNA, 25 bp, Mus musculus
tctaaagataggaagcggcatcgct

SEQ ID NO: 138694 - DNA, 25 bp, Mus musculus
tctaaagcatgactgcgtgcaggtg

SEQ ID NO: 138695 - DNA, 25 bp, Mus musculus
tctaaagccactacattggctaagg

SEQ ID NO: 138696 - DNA, 25 bp, Mus musculus
tctaaagctgtggaagggacagctc

SEQ ID NO: 138697 - DNA, 25 bp, Mus musculus
tctaaagcttctcatcctgtcgatg

SEQ ID NO: 138698 - DNA, 25 bp, Mus musculus
tctaaaggaggagaacccacactgt

SEQ ID NO: 138699 - DNA, 25 bp, Mus musculus
tctaaaggcagtagccgaagttcgc

SEQ ID NO: 138700 - DNA, 25 bp, Mus musculus
tctaaaggcatgcaagaacctctgc

SEQ ID NO: 138701 - DNA, 25 bp, Mus musculus
tctaaagtctcctgacgccagcatc

SEQ ID NO: 138702 - DNA, 25 bp, Mus musculus
tctaaagttgctgaaatgtccaagg

SEQ ID NO: 138703 - DNA, 25 bp, Mus musculus
tctaaatagctatggtgaaccggtg

SEQ ID NO: 138704 - DNA, 25 bp, Mus musculus
tctaaatatgctgcccagagactgt

SEQ ID NO: 138705 - DNA, 25 bp, Mus musculus
tctaaatgccagcaggtagagcggc

SEQ ID NO: 138706 - DNA, 25 bp, Mus musculus
tctaacaagcaggaaatgggcacct

SEQ ID NO: 138707 - DNA, 25 bp, Mus musculus
tctaacagcagcagggagatgtcgt

SEQ ID NO: 138708 - DNA, 25 bp, Mus musculus
tctaacagcagtgaaggacgggcct

SEQ ID NO: 138709 - DNA, 25 bp, Mus musculus
tctaacagcccctggcaaaaggaag

SEQ ID NO: 138710 - DNA, 25 bp, Mus musculus
tctaacatggatccccgaaagactg

SEQ ID NO: 138711 - DNA, 25 bp, Mus musculus
tctaacccatgcctagtcaacaagt

SEQ ID NO: 138712 - DNA, 25 bp, Mus musculus
tctaaccccttctcggcttcggaag

SEQ ID NO: 138713 - DNA, 25 bp, Mus musculus
tctaaccgagtaaaaggcaccccat

SEQ ID NO: 138714 - DNA, 25 bp, Mus musculus
tctaacctccacatgagagccctgg

SEQ ID NO: 138715 - DNA, 25 bp, Mus musculus
tctaacctctagagcgatgggaatc

SEQ ID NO: 138716 - DNA, 25 bp, Mus musculus
tctaacctgcaaggcatgggtaccc

SEQ ID NO: 138717 - DNA, 25 bp, Mus musculus
tctaacgagaccctgaacattgaca

SEQ ID NO: 138718 - DNA, 25 bp, Mus musculus
tctaactccattgcggctgacagcg

SEQ ID NO: 138719 - DNA, 25 bp, Mus musculus
tctaactgcttgctggtccagtggt

SEQ ID NO: 138720 - DNA, 25 bp, Mus musculus
tctaactggcgagcctacctggagt

SEQ ID NO: 138721 - DNA, 25 bp, Mus musculus
tctaactggtttggtgctgcctaag

SEQ ID NO: 138722 - DNA, 25 bp, Mus musculus
tctaacttaggtggcggtgatgatc

SEQ ID NO: 138723 - DNA, 25 bp, Mus musculus
tctaagaaatgtgcgctcaagggac

SEQ ID NO: 138724 - DNA, 25 bp, Mus musculus
tctaagaacacggatcagggtgtct

SEQ ID NO: 138725 - DNA, 25 bp, Mus musculus
tctaagaagggtgacgaggatgaac

SEQ ID NO: 138726 - DNA, 25 bp, Mus musculus
tctaagaagttcctgcctggcatgg

SEQ ID NO: 138727 - DNA, 25 bp, Mus musculus
tctaagaatggattgcagactgcct

SEQ ID NO: 138728 - DNA, 25 bp, Mus musculus
tctaagaccaagcaagtgatccagg

SEQ ID NO: 138729 - DNA, 25 bp, Mus musculus
tctaagaccttggaaccctagggca

SEQ ID NO: 138730 - DNA, 25 bp, Mus musculus
tctaagactcaaagaaatggaacct

SEQ ID NO: 138731 - DNA, 25 bp, Mus musculus
tctaagagcaagaagccatgcattc

SEQ ID NO: 138732 - DNA, 25 bp, Mus musculus
tctaagagggacaacgaggcatatc

SEQ ID NO: 138733 - DNA, 25 bp, Mus musculus
tctaagagtcctagtcaagggtccc

SEQ ID NO: 138734 - DNA, 25 bp, Mus musculus
tctaagatcttggagaacctgcggc

SEQ ID NO: 138735 - DNA, 25 bp, Mus musculus
tctaagccacacgtgatggtgccgc

SEQ ID NO: 138736 - DNA, 25 bp, Mus musculus
tctaagcccagtgacgtgagtttgt

SEQ ID NO: 138737 - DNA, 25 bp, Mus musculus
tctaagcctgttgtgatctcccagc

SEQ ID NO: 138738 - DNA, 25 bp, Mus musculus
tctaagcgtagaagccgaaagcgct

SEQ ID NO: 138739 - DNA, 25 bp, Mus musculus
tctaagctgagtgtggtacgtgcgc

SEQ ID NO: 138740 - DNA, 25 bp, Mus musculus
tctaaggaaaacactactgctcggc

SEQ ID NO: 138741 - DNA, 25 bp, Mus musculus
tctaaggaaaagcagcgagtgcagc

SEQ ID NO: 138742 - DNA, 25 bp, Mus musculus
tctaaggacctacaacaggaggcca

SEQ ID NO: 138743 - DNA, 25 bp, Mus musculus
tctaaggatcgctactgtgacaagg

SEQ ID NO: 138744 - DNA, 25 bp, Mus musculus
tctaaggcactgcagaaactgggtc

SEQ ID NO: 138745 - DNA, 25 bp, Mus musculus
tctaaggcgtctgtgtcaattcagg

SEQ ID NO: 138746 - DNA, 25 bp, Mus musculus
tctaaggctctagtaaaaggcacct

SEQ ID NO: 138747 - DNA, 25 bp, Mus musculus
tctaaggctgtacgaggctcatggc

SEQ ID NO: 138748 - DNA, 25 bp, Mus musculus
tctaagggaagtagcgacttctgtg

SEQ ID NO: 138749 - DNA, 25 bp, Mus musculus
tctaaggtcccaattaagaaaccag

SEQ ID NO: 138750 - DNA, 25 bp, Mus musculus
tctaaggtgagtgcagcagtcgccc

SEQ ID NO: 138751 - DNA, 25 bp, Mus musculus
tctaagtaagatccatttcctcgct

SEQ ID NO: 138752 - DNA, 25 bp, Mus musculus
tctaagtactacgagcatgtggaca

SEQ ID NO: 138753 - DNA, 25 bp, Mus musculus
tctaagtactcctgttggcccctgg

SEQ ID NO: 138754 - DNA, 25 bp, Mus musculus
tctaagtgggactaactgctgcttc

SEQ ID NO: 138755 - DNA, 25 bp, Mus musculus
tctaagtttctagaaaggctcatgg

SEQ ID NO: 138756 - DNA, 25 bp, Mus musculus
tctaagtttgtgagcgctatccgtc

SEQ ID NO: 138757 - DNA, 25 bp, Mus musculus
tctaataaacggagcggtgagccaa

SEQ ID NO: 138758 - DNA, 25 bp, Mus musculus
tctaataaagtgtctggatgtctct

SEQ ID NO: 138759 - DNA, 25 bp, Mus musculus
tctaataaatggaaggaatgtggca

SEQ ID NO: 138760 - DNA, 25 bp, Mus musculus
tctaataactgcgtgggccctgctt

SEQ ID NO: 138761 - DNA, 25 bp, Mus musculus
tctaataaggatgacgagccctgcc

SEQ ID NO: 138762 - DNA, 25 bp, Mus musculus
tctaatacacggaagcacatactgc

SEQ ID NO: 138763 - DNA, 25 bp, Mus musculus
tctaatagagaagcaggtcagccac

SEQ ID NO: 138764 - DNA, 25 bp, Mus musculus
tctaatcaagggagggagaatcgtc

SEQ ID NO: 138765 - DNA, 25 bp, Mus musculus
tctaatctgggaagcaccgagactc

SEQ ID NO: 138766 - DNA, 25 bp, Mus musculus
tctaatgaaacatgcccgacctatc

SEQ ID NO: 138767 - DNA, 25 bp, Mus musculus
tctaatgactgcacatgggaccgcg

SEQ ID NO: 138768 - DNA, 25 bp, Mus musculus
tctaatgcagaaaggctcagactct

SEQ ID NO: 138769 - DNA, 25 bp, Mus musculus
tctaatgcagtaaaacgcctgtgcg

SEQ ID NO: 138770 - DNA, 25 bp, Mus musculus
tctaatggccagtggcaggtgcatg

SEQ ID NO: 138771 - DNA, 25 bp, Mus musculus
tctaatgggcaagcgagtggacttc

SEQ ID NO: 138772 - DNA, 25 bp, Mus musculus
tctaatgggcacatggatgttactc

SEQ ID NO: 138773 - DNA, 25 bp, Mus musculus
tctaatggtatgaggaagcaacccc

SEQ ID NO: 138774 - DNA, 25 bp, Mus musculus
tctaatgtttgtgtaagacagaaga

SEQ ID NO: 138775 - DNA, 25 bp, Mus musculus
tctaattgaagaccgtttgacctgg

SEQ ID NO: 138776 - DNA, 25 bp, Mus musculus
tctaatttcaggctccttggagagg

SEQ ID NO: 138777 - DNA, 25 bp, Mus musculus
tctaatttgtcccggcttcggaggt

SEQ ID NO: 138778 - DNA, 25 bp, Mus musculus
tctacaaaactgctaaggactgcgt

SEQ ID NO: 138779 - DNA, 25 bp, Mus musculus
tctacaaaatggcagatagcttgga

SEQ ID NO: 138780 - DNA, 25 bp, Mus musculus
tctacaaagaccgtgagatcagcag

SEQ ID NO: 138781 - DNA, 25 bp, Mus musculus
tctacaaagcgcctcaagtctgtgg

SEQ ID NO: 138782 - DNA, 25 bp, Mus musculus
tctacaaaggattgcgtggtcagca

SEQ ID NO: 138783 - DNA, 25 bp, Mus musculus
tctacaacagaagacgaaggtcgct

SEQ ID NO: 138784 - DNA, 25 bp, Mus musculus
tctacaacggactctgtgaccgggt

SEQ ID NO: 138785 - DNA, 25 bp, Mus musculus
tctacaacgtacaggacccagaaac

SEQ ID NO: 138786 - DNA, 25 bp, Mus musculus
tctacaagattctcaataacgtggg

SEQ ID NO: 138787 - DNA, 25 bp, Mus musculus
tctacaagcaggtgaccacagtggg

SEQ ID NO: 138788 - DNA, 25 bp, Mus musculus
tctacaagctcagcaggtcaacagg

SEQ ID NO: 138789 - DNA, 25 bp, Mus musculus
tctacaaggagaggaacgccaacag

SEQ ID NO: 138790 - DNA, 25 bp, Mus musculus
tctacaaggattaccggcagctgga

SEQ ID NO: 138791 - DNA, 25 bp, Mus musculus
tctacaatgggcgactcagaggtgg

SEQ ID NO: 138792 - DNA, 25 bp, Mus musculus
tctacacagcgagaaggcgcacgat

SEQ ID NO: 138793 - DNA, 25 bp, Mus musculus
tctacacagggtgtgatctgcctcc

SEQ ID NO: 138794 - DNA, 25 bp, Mus musculus
tctacacccgattgttgccccaaag

SEQ ID NO: 138795 - DNA, 25 bp, Mus musculus
tctacaccggcttgatctacaacga

SEQ ID NO: 138796 - DNA, 25 bp, Mus musculus
tctacacctggatccgggaacacag

SEQ ID NO: 138797 - DNA, 25 bp, Mus musculus
tctacacggatcacatgaaaggcgt

SEQ ID NO: 138798 - DNA, 25 bp, Mus musculus
tctacactactttgaggagcctgaa

SEQ ID NO: 138799 - DNA, 25 bp, Mus musculus
tctacactgagaagaacgggcagct

SEQ ID NO: 138800 - DNA, 25 bp, Mus musculus
tctacactgaggagacgctggctga

SEQ ID NO: 138801 - DNA, 25 bp, Mus musculus
tctacactggcaactaggaactggg

SEQ ID NO: 138802 - DNA, 25 bp, Mus musculus
tctacactggtatcttaagcatcga

SEQ ID NO: 138803 - DNA, 25 bp, Mus musculus
tctacagaaccagaaccttgcaggc

SEQ ID NO: 138804 - DNA, 25 bp, Mus musculus
tctacagaacgagggaaagtggagc

SEQ ID NO: 138805 - DNA, 25 bp, Mus musculus
tctacagactgtgatcatggttggg

SEQ ID NO: 138806 - DNA, 25 bp, Mus musculus
tctacagagaagctatggcgagcct

SEQ ID NO: 138807 - DNA, 25 bp, Mus musculus
tctacagagaagcttgcgaagagca

SEQ ID NO: 138808 - DNA, 25 bp, Mus musculus
tctacagagacatgagctgggtgca

SEQ ID NO: 138809 - DNA, 25 bp, Mus musculus
tctacagagggcactgtgaaccatg

SEQ ID NO: 138810 - DNA, 25 bp, Mus musculus
tctacagagggctgacacccgatta

SEQ ID NO: 138811 - DNA, 25 bp, Mus musculus
tctacagatgaagtgggcatcccac

SEQ ID NO: 138812 - DNA, 25 bp, Mus musculus
tctacagatggagtgcgccaagtcc

SEQ ID NO: 138813 - DNA, 25 bp, Mus musculus
tctacagcagaggaggaagcatgga

SEQ ID NO: 138814 - DNA, 25 bp, Mus musculus
tctacagccgagatgtgaatggtct

SEQ ID NO: 138815 - DNA, 25 bp, Mus musculus
tctacagccggcagcatatggaacg

SEQ ID NO: 138816 - DNA, 25 bp, Mus musculus
tctacagcgatgaaaaagagcgtgt

SEQ ID NO: 138817 - DNA, 25 bp, Mus musculus
tctacagcgcaaggaatactacagc

SEQ ID NO: 138818 - DNA, 25 bp, Mus musculus
tctacaggaagcacaaagccaagtg

SEQ ID NO: 138819 - DNA, 25 bp, Mus musculus
tctacaggagctttaccagtttaaa

SEQ ID NO: 138820 - DNA, 25 bp, Mus musculus
tctacaggcgtgataaagaggatct

SEQ ID NO: 138821 - DNA, 25 bp, Mus musculus
tctacagggaggatcaaggcagttg

SEQ ID NO: 138822 - DNA, 25 bp, Mus musculus
tctacagtcggtaccagaggaaagg

SEQ ID NO: 138823 - DNA, 25 bp, Mus musculus
tctacagtcttcaggaggagcaagc

SEQ ID NO: 138824 - DNA, 25 bp, Mus musculus
tctacagtgacagctccaatggcag

SEQ ID NO: 138825 - DNA, 25 bp, Mus musculus
tctacagtgatttgcgaaaaggtct

SEQ ID NO: 138826 - DNA, 25 bp, Mus musculus
tctacagtgccacggatgggtcgct

SEQ ID NO: 138827 - DNA, 25 bp, Mus musculus
tctacagttgccagagacggaagca

SEQ ID NO: 138828 - DNA, 25 bp, Mus musculus
tctacatagggacgacctggagtcc

SEQ ID NO: 138829 - DNA, 25 bp, Mus musculus
tctacataggtgattttggtccctg

SEQ ID NO: 138830 - DNA, 25 bp, Mus musculus
tctacatcatccagagtggctgcgg

SEQ ID NO: 138831 - DNA, 25 bp, Mus musculus
tctacatcccggaggtgcagttcgc

SEQ ID NO: 138832 - DNA, 25 bp, Mus musculus
tctacatcgccaacagcagaggtct

SEQ ID NO: 138833 - DNA, 25 bp, Mus musculus
tctacatcggcgtaacctgaggcag

SEQ ID NO: 138834 - DNA, 25 bp, Mus musculus
tctacatcttttcaggaactggaag

SEQ ID NO: 138835 - DNA, 25 bp, Mus musculus
tctacatgaagggagcagacgtcgt

SEQ ID NO: 138836 - DNA, 25 bp, Mus musculus
tctacatgatagagaacggccccgg

SEQ ID NO: 138837 - DNA, 25 bp, Mus musculus
tctacatggcgcaggtgatggcccc

SEQ ID NO: 138838 - DNA, 25 bp, Mus musculus
tctacattaccttgactggcgtcca

SEQ ID NO: 138839 - DNA, 25 bp, Mus musculus
tctacatttctgaaggaactcactc

SEQ ID NO: 138840 - DNA, 25 bp, Mus musculus
tctaccacatcattaaggaagactg

SEQ ID NO: 138841 - DNA, 25 bp, Mus musculus
tctaccaccgctgtgttcttcgagg

SEQ ID NO: 138842 - DNA, 25 bp, Mus musculus
tctaccagcagtatgggccaggcag

SEQ ID NO: 138843 - DNA, 25 bp, Mus musculus
tctaccagcgagcttctgatgactg

SEQ ID NO: 138844 - DNA, 25 bp, Mus musculus
tctaccaggacgatacagtgactct

SEQ ID NO: 138845 - DNA, 25 bp, Mus musculus
tctaccaggagctgcacgtggactc

SEQ ID NO: 138846 - DNA, 25 bp, Mus musculus
tctaccaggagtacagcgacgtggc

SEQ ID NO: 138847 - DNA, 25 bp, Mus musculus
tctaccagggaagagtatcagcagt

SEQ ID NO: 138848 - DNA, 25 bp, Mus musculus
tctaccagggctccagtggaagcta

SEQ ID NO: 138849 - DNA, 25 bp, Mus musculus
tctaccagggtccatacaaggttgg

SEQ ID NO: 138850 - DNA, 25 bp, Mus musculus
tctaccatgggtccagtccatagct

SEQ ID NO: 138851 - DNA, 25 bp, Mus musculus
tctacccgttcgtgtttgaaagcag

SEQ ID NO: 138852 - DNA, 25 bp, Mus musculus
tctaccgcagccgaaagtggaggcc

SEQ ID NO: 138853 - DNA, 25 bp, Mus musculus
tctaccgcgccgagtgggagctctg

SEQ ID NO: 138854 - DNA, 25 bp, Mus musculus
tctaccgctgcattgttgaaagtgg

SEQ ID NO: 138855 - DNA, 25 bp, Mus musculus
tctaccgctggatgaagcacgagcc

SEQ ID NO: 138856 - DNA, 25 bp, Mus musculus
tctaccgggccagcttgcagtttga

SEQ ID NO: 138857 - DNA, 25 bp, Mus musculus
tctaccgggcggtgcccgataccat

SEQ ID NO: 138858 - DNA, 25 bp, Mus musculus
tctacctcatacactggcccatggg

SEQ ID NO: 138859 - DNA, 25 bp, Mus musculus
tctacctccagattggagagggaaa

SEQ ID NO: 138860 - DNA, 25 bp, Mus musculus
tctacctgaaacctttgatgcacgg

SEQ ID NO: 138861 - DNA, 25 bp, Mus musculus
tctacctgaaggagtatgcccgggc

SEQ ID NO: 138862 - DNA, 25 bp, Mus musculus
tctacctgagagatgagaatgccag

SEQ ID NO: 138863 - DNA, 25 bp, Mus musculus
tctacctgatcaagggcagtgccct

SEQ ID NO: 138864 - DNA, 25 bp, Mus musculus
tctacctggaaagcccgagtgtcga

SEQ ID NO: 138865 - DNA, 25 bp, Mus musculus
tctacctggcagtgcgagatcagct

SEQ ID NO: 138866 - DNA, 25 bp, Mus musculus
tctacctggctaacgtctgtggctg

SEQ ID NO: 138867 - DNA, 25 bp, Mus musculus
tctacctgtgtacggcatatgccag

SEQ ID NO: 138868 - DNA, 25 bp, Mus musculus
tctaccttcccatctgacctaggat

SEQ ID NO: 138869 - DNA, 25 bp, Mus musculus
tctacgaagcgctgaaagagaatga

SEQ ID NO: 138870 - DNA, 25 bp, Mus musculus
tctacgaccagcatatccgaggcag

SEQ ID NO: 138871 - DNA, 25 bp, Mus musculus
tctacgacctgatcgagcgaatcga

SEQ ID NO: 138872 - DNA, 25 bp, Mus musculus
tctacgagctcaagcaggcctgtgc

SEQ ID NO: 138873 - DNA, 25 bp, Mus musculus
tctacgaggagaaatggctgcaagc

SEQ ID NO: 138874 - DNA, 25 bp, Mus musculus
tctacgaggagctccatattcacag

SEQ ID NO: 138875 - DNA, 25 bp, Mus musculus
tctacgatggctggcagattccaca

SEQ ID NO: 138876 - DNA, 25 bp, Mus musculus
tctacgattggaagagatgctctcc

SEQ ID NO: 138877 - DNA, 25 bp, Mus musculus
tctacgattggagggcaacacggtg

SEQ ID NO: 138878 - DNA, 25 bp, Mus musculus
tctacgcaaatcaggaccaggaggt

SEQ ID NO: 138879 - DNA, 25 bp, Mus musculus
tctacgcaaggatacaaaaatggtt

SEQ ID NO: 138880 - DNA, 25 bp, Mus musculus
tctacgccctagaagtatccttgga

SEQ ID NO: 138881 - DNA, 25 bp, Mus musculus
tctacgccgcagagaagaagaagct

SEQ ID NO: 138882 - DNA, 25 bp, Mus musculus
tctacgccgtatgactgcaggagag

SEQ ID NO: 138883 - DNA, 25 bp, Mus musculus
tctacgctcatgtggctggacaggc

SEQ ID NO: 138884 - DNA, 25 bp, Mus musculus
tctacgctgcaaggagaatcaggtt

SEQ ID NO: 138885 - DNA, 25 bp, Mus musculus
tctacggaatcaaggagactgtggc

SEQ ID NO: 138886 - DNA, 25 bp, Mus musculus
tctacggacagtaacaccagtgctg

SEQ ID NO: 138887 - DNA, 25 bp, Mus musculus
tctacggatccacagagggcaatgt

SEQ ID NO: 138888 - DNA, 25 bp, Mus musculus
tctacggcatcttgggagccctggt

SEQ ID NO: 138889 - DNA, 25 bp, Mus musculus
tctacggccctggtgagaaacaaag

SEQ ID NO: 138890 - DNA, 25 bp, Mus musculus
tctacggtgccatcctgggtctaca

SEQ ID NO: 138891 - DNA, 25 bp, Mus musculus
tctacggtggcctaaaggagcagcg

SEQ ID NO: 138892 - DNA, 25 bp, Mus musculus
tctacgtagaggagctggtccagcg

SEQ ID NO: 138893 - DNA, 25 bp, Mus musculus
tctacgtgaaccacgcctgagtggc

SEQ ID NO: 138894 - DNA, 25 bp, Mus musculus
tctacgtgctggatgaggacaccgt

SEQ ID NO: 138895 - DNA, 25 bp, Mus musculus
tctacgtggaagaaaagcagctggt

SEQ ID NO: 138896 - DNA, 25 bp, Mus musculus
tctacgtggagctcgaggcaaacaa

SEQ ID NO: 138897 - DNA, 25 bp, Mus musculus
tctacgtggctcagacaagacagtc

SEQ ID NO: 138898 - DNA, 25 bp, Mus musculus
tctacgtgtcagatagcccaagaaa

SEQ ID NO: 138899 - DNA, 25 bp, Mus musculus
tctactaatgtggaggaaaagctgg

SEQ ID NO: 138900 - DNA, 25 bp, Mus musculus
tctactacaagttcggatgggccca

SEQ ID NO: 138901 - DNA, 25 bp, Mus musculus
tctactactctgaaggtggacaggc

SEQ ID NO: 138902 - DNA, 25 bp, Mus musculus
tctactaggctttgtggctgaccac

SEQ ID NO: 138903 - DNA, 25 bp, Mus musculus
tctactatgtatcggctcggaaagc

SEQ ID NO: 138904 - DNA, 25 bp, Mus musculus
tctactcagaggagggcaaaggagt

SEQ ID NO: 138905 - DNA, 25 bp, Mus musculus
tctactccaacgagggctacagaag

SEQ ID NO: 138906 - DNA, 25 bp, Mus musculus
tctactccaagttcccgagactgcg

SEQ ID NO: 138907 - DNA, 25 bp, Mus musculus
tctactcccagggtccagaagagag

SEQ ID NO: 138908 - DNA, 25 bp, Mus musculus
tctactccggacatacgtgctgtgg

SEQ ID NO: 138909 - DNA, 25 bp, Mus musculus
tctactcgagacagcagggtgacaa

SEQ ID NO: 138910 - DNA, 25 bp, Mus musculus
tctactcgggcatcctgtggaggct

SEQ ID NO: 138911 - DNA, 25 bp, Mus musculus
tctactctcggtctgcatagttgca

SEQ ID NO: 138912 - DNA, 25 bp, Mus musculus
tctactctgggtctgtggcctttgc

SEQ ID NO: 138913 - DNA, 25 bp, Mus musculus
tctactgaacagcttcctgcgggtt

SEQ ID NO: 138914 - DNA, 25 bp, Mus musculus
tctactgagtgaaggtgataaggtc

SEQ ID NO: 138915 - DNA, 25 bp, Mus musculus
tctactgatacaagcccggtggttc

SEQ ID NO: 138916 - DNA, 25 bp, Mus musculus
tctactgcaacattccgggactcta

SEQ ID NO: 138917 - DNA, 25 bp, Mus musculus
tctactgccctacagtcacggagga

SEQ ID NO: 138918 - DNA, 25 bp, Mus musculus
tctactggaaggcacagcgctacag

SEQ ID NO: 138919 - DNA, 25 bp, Mus musculus
tctactggaccaagcactacacgct

SEQ ID NO: 138920 - DNA, 25 bp, Mus musculus
tctactggacggcaggagccttcgt

SEQ ID NO: 138921 - DNA, 25 bp, Mus musculus
tctactggactaactggcacacggg

SEQ ID NO: 138922 - DNA, 25 bp, Mus musculus
tctactggctaaaactgaaaaactc

SEQ ID NO: 138923 - DNA, 25 bp, Mus musculus
tctactggcttgatccctggtgccg

SEQ ID NO: 138924 - DNA, 25 bp, Mus musculus
tctactgggacttaaggcagaagcg

SEQ ID NO: 138925 - DNA, 25 bp, Mus musculus
tctactggtgtcttatcagaagcct

SEQ ID NO: 138926 - DNA, 25 bp, Mus musculus
tctactgtaaggtgtgctatgggcg

SEQ ID NO: 138927 - DNA, 25 bp, Mus musculus
tctactgtgcgaatctggtctaaaa

SEQ ID NO: 138928 - DNA, 25 bp, Mus musculus
tctactgtggtgctgcttcacgccc

SEQ ID NO: 138929 - DNA, 25 bp, Mus musculus
tctacttacctgacggaaaatcggg

SEQ ID NO: 138930 - DNA, 25 bp, Mus musculus
tctacttagagtacgccaagagggc

SEQ ID NO: 138931 - DNA, 25 bp, Mus musculus
tctacttagccaaacacagtggtcg

SEQ ID NO: 138932 - DNA, 25 bp, Mus musculus
tctacttcacactgcagaactgggt

SEQ ID NO: 138933 - DNA, 25 bp, Mus musculus
tctacttcgatacatgagcaatgaa

SEQ ID NO: 138934 - DNA, 25 bp, Mus musculus
tctacttctggatgaacggcgaccg

SEQ ID NO: 138935 - DNA, 25 bp, Mus musculus
tctacttggtgagccagggtgccga

SEQ ID NO: 138936 - DNA, 25 bp, Mus musculus
tctacttgtgacgtaaaggtgaaaa

SEQ ID NO: 138937 - DNA, 25 bp, Mus musculus
tctactttaagggaatgtgggagga

SEQ ID NO: 138938 - DNA, 25 bp, Mus musculus
tctactttgaattgaggccagtggc

SEQ ID NO: 138939 - DNA, 25 bp, Mus musculus
tctactttggttccctgaggctcaa

SEQ ID NO: 138940 - DNA, 25 bp, Mus musculus
tctacttttagtgatggccccagct

SEQ ID NO: 138941 - DNA, 25 bp, Mus musculus
tctagaaaatgccacagaggtgctt

SEQ ID NO: 138942 - DNA, 25 bp, Mus musculus
tctagaaacagcaaaaggagtcacc

SEQ ID NO: 138943 - DNA, 25 bp, Mus musculus
tctagaaacctgatgtgaccccggc

SEQ ID NO: 138944 - DNA, 25 bp, Mus musculus
tctagaaacggagaccatgtcggcg

SEQ ID NO: 138945 - DNA, 25 bp, Mus musculus
tctagaaacgggacagctctccaga

SEQ ID NO: 138946 - DNA, 25 bp, Mus musculus
tctagaaagagaacggcagcatgat

SEQ ID NO: 138947 - DNA, 25 bp, Mus musculus
tctagaaaggcgacagcacactgct

SEQ ID NO: 138948 - DNA, 25 bp, Mus musculus
tctagaaatgtgtcctgcaagtgtg

SEQ ID NO: 138949 - DNA, 25 bp, Mus musculus
tctagaagaatgagcagggacaggc

SEQ ID NO: 138950 - DNA, 25 bp, Mus musculus
tctagaagcaagtgaagccgaccgt

SEQ ID NO: 138951 - DNA, 25 bp, Mus musculus
tctagaagtcttggagtggcagtgc

SEQ ID NO: 138952 - DNA, 25 bp, Mus musculus
tctagaatcgctgagtgtgcccgga

SEQ ID NO: 138953 - DNA, 25 bp, Mus musculus
tctagacaaaggcatgagcggatac

SEQ ID NO: 138954 - DNA, 25 bp, Mus musculus
tctagacacctttctgcgcgagcct

SEQ ID NO: 138955 - DNA, 25 bp, Mus musculus
tctagacagagccagactttgggcc

SEQ ID NO: 138956 - DNA, 25 bp, Mus musculus
tctagacaggtgaatcgggccaata

SEQ ID NO: 138957 - DNA, 25 bp, Mus musculus
tctagaccagtccttcgcagcgtat

SEQ ID NO: 138958 - DNA, 25 bp, Mus musculus
tctagacccctggagaggactaaag

SEQ ID NO: 138959 - DNA, 25 bp, Mus musculus
tctagacctccagagccactcctga

SEQ ID NO: 138960 - DNA, 25 bp, Mus musculus
tctagacctgaagatcgaaagcctt

SEQ ID NO: 138961 - DNA, 25 bp, Mus musculus
tctagacgaagccacgaagtatgcc

SEQ ID NO: 138962 - DNA, 25 bp, Mus musculus
tctagacgcctaaagacaggaagga

SEQ ID NO: 138963 - DNA, 25 bp, Mus musculus
tctagactgccaggaagtcccggga

SEQ ID NO: 138964 - DNA, 25 bp, Mus musculus
tctagactgcctgatcggatggccc

SEQ ID NO: 138965 - DNA, 25 bp, Mus musculus
tctagactgttaactgcactcagca

SEQ ID NO: 138966 - DNA, 25 bp, Mus musculus
tctagagaatcaagcaggaggatca

SEQ ID NO: 138967 - DNA, 25 bp, Mus musculus
tctagagagcctatctacgtctacg

SEQ ID NO: 138968 - DNA, 25 bp, Mus musculus
tctagagagctgaccgcagaaggga

SEQ ID NO: 138969 - DNA, 25 bp, Mus musculus
tctagagatcaagtcccaggacagg

SEQ ID NO: 138970 - DNA, 25 bp, Mus musculus
tctagagatctgttggaccagacgc

SEQ ID NO: 138971 - DNA, 25 bp, Mus musculus
tctagagcatcaggtgactggcagc

SEQ ID NO: 138972 - DNA, 25 bp, Mus musculus
tctagagcatctgagaaccgtgttg

SEQ ID NO: 138973 - DNA, 25 bp, Mus musculus
tctagagctacagacgtgaggtgtc

SEQ ID NO: 138974 - DNA, 25 bp, Mus musculus
tctagaggaaaagcatgaagcatcc

SEQ ID NO: 138975 - DNA, 25 bp, Mus musculus
tctagaggagtttgcactgaggcca

SEQ ID NO: 138976 - DNA, 25 bp, Mus musculus
tctagaggtgacttcgaaactggag

SEQ ID NO: 138977 - DNA, 25 bp, Mus musculus
tctagagtatcaggcagaaattccc

SEQ ID NO: 138978 - DNA, 25 bp, Mus musculus
tctagagtggatgtgtatacaacac

SEQ ID NO: 138979 - DNA, 25 bp, Mus musculus
tctagagtgtggtgaacgctgtgct

SEQ ID NO: 138980 - DNA, 25 bp, Mus musculus
tctagagttgagaacaggcagggcc

SEQ ID NO: 138981 - DNA, 25 bp, Mus musculus
tctagataaaactcaagatgagctg

SEQ ID NO: 138982 - DNA, 25 bp, Mus musculus
tctagataagttgctggctggacca

SEQ ID NO: 138983 - DNA, 25 bp, Mus musculus
tctagatatatggtggacatggccc

SEQ ID NO: 138984 - DNA, 25 bp, Mus musculus
tctagatatgggagtgttcagcctg

SEQ ID NO: 138985 - DNA, 25 bp, Mus musculus
tctagatcatttgcagcgggctcga

SEQ ID NO: 138986 - DNA, 25 bp, Mus musculus
tctagatgagcgcttggataaaaga

SEQ ID NO: 138987 - DNA, 25 bp, Mus musculus
tctagatggatggacatatgaccac

SEQ ID NO: 138988 - DNA, 25 bp, Mus musculus
tctagattaagcaagagccaagtgc

SEQ ID NO: 138989 - DNA, 25 bp, Mus musculus
tctagcaaagttggccctcactgag

SEQ ID NO: 138990 - DNA, 25 bp, Mus musculus
tctagcaagacacccgcatggatta

SEQ ID NO: 138991 - DNA, 25 bp, Mus musculus
tctagcaatcccagtagcggcaggt

SEQ ID NO: 138992 - DNA, 25 bp, Mus musculus
tctagcacatcggaaagcactcaag

SEQ ID NO: 138993 - DNA, 25 bp, Mus musculus
tctagcaccactcctgagaaagatt

SEQ ID NO: 138994 - DNA, 25 bp, Mus musculus
tctagcagcagcttgagtagtcagc

SEQ ID NO: 138995 - DNA, 25 bp, Mus musculus
tctagcagcagtcagttcaaggtgt

SEQ ID NO: 138996 - DNA, 25 bp, Mus musculus
tctagcagcggctactcagtggcta

SEQ ID NO: 138997 - DNA, 25 bp, Mus musculus
tctagcagttcagggaagatcggtc

SEQ ID NO: 138998 - DNA, 25 bp, Mus musculus
tctagccaaaagattagtaccagtt

SEQ ID NO: 138999 - DNA, 25 bp, Mus musculus
tctagccaactgctgtacagaaggg

SEQ ID NO: 139000 - DNA, 25 bp, Mus musculus
tctagccacagaatggaacacagtg

SEQ ID NO: 139001 - DNA, 25 bp, Mus musculus
tctagccagtgtgaaacggtctcct

SEQ ID NO: 139002 - DNA, 25 bp, Mus musculus
tctagccatgcttgggagctccgag

SEQ ID NO: 139003 - DNA, 25 bp, Mus musculus
tctagcccacaggagaatctcggtc

SEQ ID NO: 139004 - DNA, 25 bp, Mus musculus
tctagcccagcgtttaggagtagga

SEQ ID NO: 139005 - DNA, 25 bp, Mus musculus
tctagcccagtcctggtagaagaag

SEQ ID NO: 139006 - DNA, 25 bp, Mus musculus
tctagccctggacaagctgagtccg

SEQ ID NO: 139007 - DNA, 25 bp, Mus musculus
tctagccgggaggatgaaaggcctc

SEQ ID NO: 139008 - DNA, 25 bp, Mus musculus
tctagcgagacagagaaaattccct

SEQ ID NO: 139009 - DNA, 25 bp, Mus musculus
tctagctacagagtccaggccactg

SEQ ID NO: 139010 - DNA, 25 bp, Mus musculus
tctagctagtgaagtccaggatctg

SEQ ID NO: 139011 - DNA, 25 bp, Mus musculus
tctagctatgtcaagcagggaaagg

SEQ ID NO: 139012 - DNA, 25 bp, Mus musculus
tctagctgcgttttcgggagatcca

SEQ ID NO: 139013 - DNA, 25 bp, Mus musculus
tctagctgctgcaaccaaacgtggg

SEQ ID NO: 139014 - DNA, 25 bp, Mus musculus
tctaggagaaccacttgccaagggt

SEQ ID NO: 139015 - DNA, 25 bp, Mus musculus
tctaggagcaggacagagtgttcct

SEQ ID NO: 139016 - DNA, 25 bp, Mus musculus
tctaggagggcgtgaaaattccagg

SEQ ID NO: 139017 - DNA, 25 bp, Mus musculus
tctaggatgatcactggcaaaagca

SEQ ID NO: 139018 - DNA, 25 bp, Mus musculus
tctaggcagtgtctgtcgaagaacc

SEQ ID NO: 139019 - DNA, 25 bp, Mus musculus
tctaggccacttctctctactggtg

SEQ ID NO: 139020 - DNA, 25 bp, Mus musculus
tctaggccgccaacaaagtgtgaca

SEQ ID NO: 139021 - DNA, 25 bp, Mus musculus
tctaggcgaaggcaatggacgcatc

SEQ ID NO: 139022 - DNA, 25 bp, Mus musculus
tctaggctagcaagagcacagctcc

SEQ ID NO: 139023 - DNA, 25 bp, Mus musculus
tctagggacacgctgttggacctca

SEQ ID NO: 139024 - DNA, 25 bp, Mus musculus
tctagggaccgtctctgaagagtct

SEQ ID NO: 139025 - DNA, 25 bp, Mus musculus
tctagggacgaatcaccaagtgagt

SEQ ID NO: 139026 - DNA, 25 bp, Mus musculus
tctagggaggtaggtcagtcacatc

SEQ ID NO: 139027 - DNA, 25 bp, Mus musculus
tctagggcatcaaacacgggaggca

SEQ ID NO: 139028 - DNA, 25 bp, Mus musculus
tctagggcattctcccaggtgggtg

SEQ ID NO: 139029 - DNA, 25 bp, Mus musculus
tctagggccaattggaggaccacca

SEQ ID NO: 139030 - DNA, 25 bp, Mus musculus
tctagggccaccactcttttatcgc

SEQ ID NO: 139031 - DNA, 25 bp, Mus musculus
tctagggcgaagagaggaatatgac

SEQ ID NO: 139032 - DNA, 25 bp, Mus musculus
tctagggcgagttaagcactgcgtc

SEQ ID NO: 139033 - DNA, 25 bp, Mus musculus
tctagggcggcattacttactgaaa

SEQ ID NO: 139034 - DNA, 25 bp, Mus musculus
tctaggtaaaaaagtgagggctatt

SEQ ID NO: 139035 - DNA, 25 bp, Mus musculus
tctaggtaagtcaggaggaggtcaa

SEQ ID NO: 139036 - DNA, 25 bp, Mus musculus
tctaggtcaaagcatgggaacccca

SEQ ID NO: 139037 - DNA, 25 bp, Mus musculus
tctaggtcaaaggacgctgatggct

SEQ ID NO: 139038 - DNA, 25 bp, Mus musculus
tctaggtcgctgagggacatcgtcg

SEQ ID NO: 139039 - DNA, 25 bp, Mus musculus
tctaggtggcgtttctgtccggcca

SEQ ID NO: 139040 - DNA, 25 bp, Mus musculus
tctaggtgtctctcaaaagactggc

SEQ ID NO: 139041 - DNA, 25 bp, Mus musculus
tctaggttggtgcagcaaggactcc

SEQ ID NO: 139042 - DNA, 25 bp, Mus musculus
tctagtaactgggtcacaaacattg

SEQ ID NO: 139043 - DNA, 25 bp, Mus musculus
tctagtaaggaaggtacaaggtgta

SEQ ID NO: 139044 - DNA, 25 bp, Mus musculus
tctagtaatgtacaagggcccctcc

SEQ ID NO: 139045 - DNA, 25 bp, Mus musculus
tctagtaggctgaagtcaccctggc

SEQ ID NO: 139046 - DNA, 25 bp, Mus musculus
tctagtcaagatgaggatgccacac

SEQ ID NO: 139047 - DNA, 25 bp, Mus musculus
tctagtcagatttcaggttcagtga

SEQ ID NO: 139048 - DNA, 25 bp, Mus musculus
tctagtcctgtgagcccgtggtgta

SEQ ID NO: 139049 - DNA, 25 bp, Mus musculus
tctagtcgatcggtggtggtgcaca

SEQ ID NO: 139050 - DNA, 25 bp, Mus musculus
tctagtctgatgctaccaaaggtag

SEQ ID NO: 139051 - DNA, 25 bp, Mus musculus
tctagtctggcttctgacgtggtgc

SEQ ID NO: 139052 - DNA, 25 bp, Mus musculus
tctagtcttctgaccagaggcagcg

SEQ ID NO: 139053 - DNA, 25 bp, Mus musculus
tctagtgaatccacaccagcatcaa

SEQ ID NO: 139054 - DNA, 25 bp, Mus musculus
tctagtgacagtcctggagctcttc

SEQ ID NO: 139055 - DNA, 25 bp, Mus musculus
tctagtgaggtgattcttgggcgcc

SEQ ID NO: 139056 - DNA, 25 bp, Mus musculus
tctagtgagtgccaaagaggcttca

SEQ ID NO: 139057 - DNA, 25 bp, Mus musculus
tctagtgcctcaaataaaccgttca

SEQ ID NO: 139058 - DNA, 25 bp, Mus musculus
tctagtgcgaaggaaacagtggcca

SEQ ID NO: 139059 - DNA, 25 bp, Mus musculus
tctagtggagccatgggacctacgc

SEQ ID NO: 139060 - DNA, 25 bp, Mus musculus
tctagtgggacgacagtgacttccg

SEQ ID NO: 139061 - DNA, 25 bp, Mus musculus
tctagtgggctacatacaaggcaac

SEQ ID NO: 139062 - DNA, 25 bp, Mus musculus
tctagtgtaacaagagccccatgtc

SEQ ID NO: 139063 - DNA, 25 bp, Mus musculus
tctagtgtcgtcaaacaggaaagtg

SEQ ID NO: 139064 - DNA, 25 bp, Mus musculus
tctagtgtgagctatggcgctgcca

SEQ ID NO: 139065 - DNA, 25 bp, Mus musculus
tctagttccagctcgtcagactcgg

SEQ ID NO: 139066 - DNA, 25 bp, Mus musculus
tctagttcgaccaatgggagttcca

SEQ ID NO: 139067 - DNA, 25 bp, Mus musculus
tctataagcgcactcgggaagacgg

SEQ ID NO: 139068 - DNA, 25 bp, Mus musculus
tctataagcggacctacgccagtgg

SEQ ID NO: 139069 - DNA, 25 bp, Mus musculus
tctataagctcagcccagttgtgcc

SEQ ID NO: 139070 - DNA, 25 bp, Mus musculus
tctataaggatgttggctccctgcc

SEQ ID NO: 139071 - DNA, 25 bp, Mus musculus
tctataattccaatgagccggcctt

SEQ ID NO: 139072 - DNA, 25 bp, Mus musculus
tctatacagcgtgtagaaggtcctg

SEQ ID NO: 139073 - DNA, 25 bp, Mus musculus
tctataccagcgacagcagcctggg

SEQ ID NO: 139074 - DNA, 25 bp, Mus musculus
tctatacgtaacactggccaggatc

SEQ ID NO: 139075 - DNA, 25 bp, Mus musculus
tctatactatatgggcgctgctgct

SEQ ID NO: 139076 - DNA, 25 bp, Mus musculus
tctatagaagaaacgcgcgctctgg

SEQ ID NO: 139077 - DNA, 25 bp, Mus musculus
tctatagagtaacccttgaccagtc

SEQ ID NO: 139078 - DNA, 25 bp, Mus musculus
tctatagatgaaccacacctgcgca

SEQ ID NO: 139079 - DNA, 25 bp, Mus musculus
tctatagatgcaactctgcagcggc

SEQ ID NO: 139080 - DNA, 25 bp, Mus musculus
tctatagcttggtgggatgccctgt

SEQ ID NO: 139081 - DNA, 25 bp, Mus musculus
tctataggacatgaagcgtgcagct

SEQ ID NO: 139082 - DNA, 25 bp, Mus musculus
tctataggtagcaagcaatctctcc

SEQ ID NO: 139083 - DNA, 25 bp, Mus musculus
tctatagtaacgcatcatcccggcc

SEQ ID NO: 139084 - DNA, 25 bp, Mus musculus
tctatagtcgatatggaggaggtcc

SEQ ID NO: 139085 - DNA, 25 bp, Mus musculus
tctatagtgccttggaccagacggc

SEQ ID NO: 139086 - DNA, 25 bp, Mus musculus
tctatagtgtaacccaagctgcttg

SEQ ID NO: 139087 - DNA, 25 bp, Mus musculus
tctatatagttttgtgacactcagt

SEQ ID NO: 139088 - DNA, 25 bp, Mus musculus
tctatatccacggaggaggctgggc

SEQ ID NO: 139089 - DNA, 25 bp, Mus musculus
tctatatgctgaacacacactgggc

SEQ ID NO: 139090 - DNA, 25 bp, Mus musculus
tctatatggaataagactgccagcg

SEQ ID NO: 139091 - DNA, 25 bp, Mus musculus
tctatatgggattggccacctgcct

SEQ ID NO: 139092 - DNA, 25 bp, Mus musculus
tctatattcaactaaagttgcgtcc

SEQ ID NO: 139093 - DNA, 25 bp, Mus musculus
tctatcaagggagtgtgtgccaacc

SEQ ID NO: 139094 - DNA, 25 bp, Mus musculus
tctatcacaagtaaccaccagagag

SEQ ID NO: 139095 - DNA, 25 bp, Mus musculus
tctatcagaacctgaaccggcggca

SEQ ID NO: 139096 - DNA, 25 bp, Mus musculus
tctatcagacttggactcagcgtga

SEQ ID NO: 139097 - DNA, 25 bp, Mus musculus
tctatcagagcctggtcagtcctgg

SEQ ID NO: 139098 - DNA, 25 bp, Mus musculus
tctatcagcctactgaagaggaggg

SEQ ID NO: 139099 - DNA, 25 bp, Mus musculus
tctatcatccagaaaggcctgcagt

SEQ ID NO: 139100 - DNA, 25 bp, Mus musculus
tctatcatgtgcacaagcgcggtgt

SEQ ID NO: 139101 - DNA, 25 bp, Mus musculus
tctatcattagagggcccacagtgc

SEQ ID NO: 139102 - DNA, 25 bp, Mus musculus
tctatccaggaagagtgggtacggc

SEQ ID NO: 139103 - DNA, 25 bp, Mus musculus
tctatccgagaagccatcagtgaca

SEQ ID NO: 139104 - DNA, 25 bp, Mus musculus
tctatccggacagataaccgaggct

SEQ ID NO: 139105 - DNA, 25 bp, Mus musculus
tctatcctgactaaggagcggcggc

SEQ ID NO: 139106 - DNA, 25 bp, Mus musculus
tctatcgggcattgcgagacgtcca

SEQ ID NO: 139107 - DNA, 25 bp, Mus musculus
tctatcgtgaacgagggctacctca

SEQ ID NO: 139108 - DNA, 25 bp, Mus musculus
tctatcgtggtcagcatggtggcct

SEQ ID NO: 139109 - DNA, 25 bp, Mus musculus
tctatctacagctcatgggcagagg

SEQ ID NO: 139110 - DNA, 25 bp, Mus musculus
tctatctcaggacaaattgatgcag

SEQ ID NO: 139111 - DNA, 25 bp, Mus musculus
tctatctcgtccaaggagaaaagaa

SEQ ID NO: 139112 - DNA, 25 bp, Mus musculus
tctatctggacggaaaggcaatgcc

SEQ ID NO: 139113 - DNA, 25 bp, Mus musculus
tctatgaactggatgcggaccccaa

SEQ ID NO: 139114 - DNA, 25 bp, Mus musculus
tctatgacacccttggagctgacgc

SEQ ID NO: 139115 - DNA, 25 bp, Mus musculus
tctatgacacgtccacagacaggct

SEQ ID NO: 139116 - DNA, 25 bp, Mus musculus
tctatgacagcagggagtagccttg

SEQ ID NO: 139117 - DNA, 25 bp, Mus musculus
tctatgacatgttggccacgaggaa

SEQ ID NO: 139118 - DNA, 25 bp, Mus musculus
tctatgacccgcagcaggatgatgg

SEQ ID NO: 139119 - DNA, 25 bp, Mus musculus
tctatgagaacctgaggccacgcac

SEQ ID NO: 139120 - DNA, 25 bp, Mus musculus
tctatgagaagctaccccagggcta

SEQ ID NO: 139121 - DNA, 25 bp, Mus musculus
tctatgagaaggaaaacgctgtgcc

SEQ ID NO: 139122 - DNA, 25 bp, Mus musculus
tctatgagagctgggaatggctact

SEQ ID NO: 139123 - DNA, 25 bp, Mus musculus
tctatgaggaaggatgtggcctacc

SEQ ID NO: 139124 - DNA, 25 bp, Mus musculus
tctatgaggagaccattcgggagct

SEQ ID NO: 139125 - DNA, 25 bp, Mus musculus
tctatgaggcatcgcagacactgaa

SEQ ID NO: 139126 - DNA, 25 bp, Mus musculus
tctatgaggccctggaactaaggga

SEQ ID NO: 139127 - DNA, 25 bp, Mus musculus
tctatgcagccaaaagcaaggcacc

SEQ ID NO: 139128 - DNA, 25 bp, Mus musculus
tctatgcaggctgtctcgggactcc

SEQ ID NO: 139129 - DNA, 25 bp, Mus musculus
tctatgcagtattcaaggagcaccc

SEQ ID NO: 139130 - DNA, 25 bp, Mus musculus
tctatgccaactaccgggcagtccg

SEQ ID NO: 139131 - DNA, 25 bp, Mus musculus
tctatgccacaaaccagaacgcagg

SEQ ID NO: 139132 - DNA, 25 bp, Mus musculus
tctatgccagcaattatgacaatgt

SEQ ID NO: 139133 - DNA, 25 bp, Mus musculus
tctatgccatggcacacggcctaca

SEQ ID NO: 139134 - DNA, 25 bp, Mus musculus
tctatgcctagaggtgccacagcct

SEQ ID NO: 139135 - DNA, 25 bp, Mus musculus
tctatgcctgggaggtactgatcca

SEQ ID NO: 139136 - DNA, 25 bp, Mus musculus
tctatgccttggacgagacgtggca

SEQ ID NO: 139137 - DNA, 25 bp, Mus musculus
tctatgcggactgccaaggagcaag

SEQ ID NO: 139138 - DNA, 25 bp, Mus musculus
tctatgctcacagtcggtatgttag

SEQ ID NO: 139139 - DNA, 25 bp, Mus musculus
tctatgctgactggtggcaagagcc

SEQ ID NO: 139140 - DNA, 25 bp, Mus musculus
tctatgctgctctgttcacggctgc

SEQ ID NO: 139141 - DNA, 25 bp, Mus musculus
tctatgctggacacatcggtgcact

SEQ ID NO: 139142 - DNA, 25 bp, Mus musculus
tctatgctggtacaggcaacctcct

SEQ ID NO: 139143 - DNA, 25 bp, Mus musculus
tctatgctgtgttcagttggcgcca

SEQ ID NO: 139144 - DNA, 25 bp, Mus musculus
tctatggacatgaagatgtgaagaa

SEQ ID NO: 139145 - DNA, 25 bp, Mus musculus
tctatggacggacttaggacgagaa

SEQ ID NO: 139146 - DNA, 25 bp, Mus musculus
tctatggagaagacgtggcacaatc

SEQ ID NO: 139147 - DNA, 25 bp, Mus musculus
tctatggagacctcgctggccagta

SEQ ID NO: 139148 - DNA, 25 bp, Mus musculus
tctatggagcgtacggaatggacct

SEQ ID NO: 139149 - DNA, 25 bp, Mus musculus
tctatggcagaggtgattgggcttc

SEQ ID NO: 139150 - DNA, 25 bp, Mus musculus
tctatggccattaacgaagtcttca

SEQ ID NO: 139151 - DNA, 25 bp, Mus musculus
tctatggccccaaaaagcgaggacc

SEQ ID NO: 139152 - DNA, 25 bp, Mus musculus
tctatggccggaagattatgcggaa

SEQ ID NO: 139153 - DNA, 25 bp, Mus musculus
tctatggcggaagatctctgccgga

SEQ ID NO: 139154 - DNA, 25 bp, Mus musculus
tctatgggaagtgctactactgccg

SEQ ID NO: 139155 - DNA, 25 bp, Mus musculus
tctatgggcatcctctgcggcagat

SEQ ID NO: 139156 - DNA, 25 bp, Mus musculus
tctatggtgggtcctcatgggtaca

SEQ ID NO: 139157 - DNA, 25 bp, Mus musculus
tctatggttcgagctatgtggcagc

SEQ ID NO: 139158 - DNA, 25 bp, Mus musculus
tctatgtcaacacttacgggcggat

SEQ ID NO: 139159 - DNA, 25 bp, Mus musculus
tctatgtcaacatggatgagggcgg

SEQ ID NO: 139160 - DNA, 25 bp, Mus musculus
tctatgtcaacttcctgctgacggg

SEQ ID NO: 139161 - DNA, 25 bp, Mus musculus
tctatgtgcagggtgaagacagccc

SEQ ID NO: 139162 - DNA, 25 bp, Mus musculus
tctatgtggtgcatctgcaagggca

SEQ ID NO: 139163 - DNA, 25 bp, Mus musculus
tctattactgctgtctttgggctcc

SEQ ID NO: 139164 - DNA, 25 bp, Mus musculus
tctattatcccaagaacctttgtcc

SEQ ID NO: 139165 - DNA, 25 bp, Mus musculus
tctattcaataagtgggcgtggagc

SEQ ID NO: 139166 - DNA, 25 bp, Mus musculus
tctattcaggtagcactgggtacca

SEQ ID NO: 139167 - DNA, 25 bp, Mus musculus
tctattccatcacggtgcccaagga

SEQ ID NO: 139168 - DNA, 25 bp, Mus musculus
tctattccgcgctcttcccggttag

SEQ ID NO: 139169 - DNA, 25 bp, Mus musculus
tctattcctggacagatggtctgag

SEQ ID NO: 139170 - DNA, 25 bp, Mus musculus
tctattcgatggacgactgtgccca

SEQ ID NO: 139171 - DNA, 25 bp, Mus musculus
tctattggatgtatgtagggactcg

SEQ ID NO: 139172 - DNA, 25 bp, Mus musculus
tctattgttggaatactgggcctca

SEQ ID NO: 139173 - DNA, 25 bp, Mus musculus
tctatttaggaagggagccaggtcc

SEQ ID NO: 139174 - DNA, 25 bp, Mus musculus
tctatttccataacccaggagtggc

SEQ ID NO: 139175 - DNA, 25 bp, Mus musculus
tctatttctgactgcccaactgggt

SEQ ID NO: 139176 - DNA, 25 bp, Mus musculus
tctatttttaatgagctccccaggc

SEQ ID NO: 139177 - DNA, 25 bp, Mus musculus
tctcaaaagtggttggccccatgcg

SEQ ID NO: 139178 - DNA, 25 bp, Mus musculus
tctcaaaagtttggccaatgggctg

SEQ ID NO: 139179 - DNA, 25 bp, Mus musculus
tctcaaacaaaggagtcccgctggg

SEQ ID NO: 139180 - DNA, 25 bp, Mus musculus
tctcaaacaggcacaagacccagat

SEQ ID NO: 139181 - DNA, 25 bp, Mus musculus
tctcaaacatgacagagcgttcctt

SEQ ID NO: 139182 - DNA, 25 bp, Mus musculus
tctcaaactgatctgctcccgggtg

SEQ ID NO: 139183 - DNA, 25 bp, Mus musculus
tctcaaagacctatagtgctggctg

SEQ ID NO: 139184 - DNA, 25 bp, Mus musculus
tctcaaagatacatcctccagggtc

SEQ ID NO: 139185 - DNA, 25 bp, Mus musculus
tctcaaagctgctacagagcccagg

SEQ ID NO: 139186 - DNA, 25 bp, Mus musculus
tctcaaagctggtaaagaagcgtgc

SEQ ID NO: 139187 - DNA, 25 bp, Mus musculus
tctcaaagtagaacacgagtgggtc

SEQ ID NO: 139188 - DNA, 25 bp, Mus musculus
tctcaaatggacatgcaaggcttgt

SEQ ID NO: 139189 - DNA, 25 bp, Mus musculus
tctcaacaaatcaacctgggtccgt

SEQ ID NO: 139190 - DNA, 25 bp, Mus musculus
tctcaacaaattctgcgacaaccgg

SEQ ID NO: 139191 - DNA, 25 bp, Mus musculus
tctcaacatctacagtgggcaccag

SEQ ID NO: 139192 - DNA, 25 bp, Mus musculus
tctcaacgaggcaggcatccttcga

SEQ ID NO: 139193 - DNA, 25 bp, Mus musculus
tctcaacgggagatcgaggagtttc

SEQ ID NO: 139194 - DNA, 25 bp, Mus musculus
tctcaactcaagatcaagcggccgc

SEQ ID NO: 139195 - DNA, 25 bp, Mus musculus
tctcaacttagcagaggcttgttca

SEQ ID NO: 139196 - DNA, 25 bp, Mus musculus
tctcaagaagacgaaggactatgtc

SEQ ID NO: 139197 - DNA, 25 bp, Mus musculus
tctcaagaccagagaatggcaggtg

SEQ ID NO: 139198 - DNA, 25 bp, Mus musculus
tctcaagcaccttgaaataaagctg

SEQ ID NO: 139199 - DNA, 25 bp, Mus musculus
tctcaagccagggtgcactctcaga

SEQ ID NO: 139200 - DNA, 25 bp, Mus musculus
tctcaagcgaaaggaggaattctcc

SEQ ID NO: 139201 - DNA, 25 bp, Mus musculus
tctcaagctcgtcaagaaagaacct

SEQ ID NO: 139202 - DNA, 25 bp, Mus musculus
tctcaaggacaaagaaacaactggt

SEQ ID NO: 139203 - DNA, 25 bp, Mus musculus
tctcaagggccatgataggacacac

SEQ ID NO: 139204 - DNA, 25 bp, Mus musculus
tctcaagggctcagaaagtgcggtg

SEQ ID NO: 139205 - DNA, 25 bp, Mus musculus
tctcaagggtgaaaagcatgtctcc

SEQ ID NO: 139206 - DNA, 25 bp, Mus musculus
tctcaagtcagccaagatccaggtg

SEQ ID NO: 139207 - DNA, 25 bp, Mus musculus
tctcaagtgagatggaagatttgcc

SEQ ID NO: 139208 - DNA, 25 bp, Mus musculus
tctcaatcagtcaaagtagtgcacg

SEQ ID NO: 139209 - DNA, 25 bp, Mus musculus
tctcaatgcaaaagaggaaaattcc

SEQ ID NO: 139210 - DNA, 25 bp, Mus musculus
tctcaatgcagcaggtacgggcgtc

SEQ ID NO: 139211 - DNA, 25 bp, Mus musculus
tctcaatgctcagcgaggaacctgc

SEQ ID NO: 139212 - DNA, 25 bp, Mus musculus
tctcaatgtgagaaggcacagaggc

SEQ ID NO: 139213 - DNA, 25 bp, Mus musculus
tctcaatgtttaccctgcggcctga

SEQ ID NO: 139214 - DNA, 25 bp, Mus musculus
tctcaattctcctctggctctcagt

SEQ ID NO: 139215 - DNA, 25 bp, Mus musculus
tctcacagaacgtgcccaggcaagg

SEQ ID NO: 139216 - DNA, 25 bp, Mus musculus
tctcacagctggacgaccagtacag

SEQ ID NO: 139217 - DNA, 25 bp, Mus musculus
tctcacagtcaccaggccgagaggt

SEQ ID NO: 139218 - DNA, 25 bp, Mus musculus
tctcacagtgagagcggcgaagacg

SEQ ID NO: 139219 - DNA, 25 bp, Mus musculus
tctcacatcttatcctggccacagg

SEQ ID NO: 139220 - DNA, 25 bp, Mus musculus
tctcaccaatgatggtgaagctgac

SEQ ID NO: 139221 - DNA, 25 bp, Mus musculus
tctcaccagcggtctgcaagcgaat

SEQ ID NO: 139222 - DNA, 25 bp, Mus musculus
tctcacccaagaaggcaactggaag

SEQ ID NO: 139223 - DNA, 25 bp, Mus musculus
tctcaccgagaaagggatcctgcag

SEQ ID NO: 139224 - DNA, 25 bp, Mus musculus
tctcacctctcaacgctggaaaggg

SEQ ID NO: 139225 - DNA, 25 bp, Mus musculus
tctcacctctgacgacaaagttgcg

SEQ ID NO: 139226 - DNA, 25 bp, Mus musculus
tctcacctgggttgaagacgacact

SEQ ID NO: 139227 - DNA, 25 bp, Mus musculus
tctcacctgtgggtaccagaagtgt

SEQ ID NO: 139228 - DNA, 25 bp, Mus musculus
tctcacgctcaaggcaatcagggct

SEQ ID NO: 139229 - DNA, 25 bp, Mus musculus
tctcacgcttcggagtcaacacgga

SEQ ID NO: 139230 - DNA, 25 bp, Mus musculus
tctcacgttatcagccagcaccagt

SEQ ID NO: 139231 - DNA, 25 bp, Mus musculus
tctcactctggatgcatatctaggg

SEQ ID NO: 139232 - DNA, 25 bp, Mus musculus
tctcactgtatggaggcaagctgac

SEQ ID NO: 139233 - DNA, 25 bp, Mus musculus
tctcacttgcttctcctcacagagg

SEQ ID NO: 139234 - DNA, 25 bp, Mus musculus
tctcacttggagagcatggtcctct

SEQ ID NO: 139235 - DNA, 25 bp, Mus musculus
tctcagaaaaaagattccagtgtca

SEQ ID NO: 139236 - DNA, 25 bp, Mus musculus
tctcagaaatgcatgttacagttgt

SEQ ID NO: 139237 - DNA, 25 bp, Mus musculus
tctcagaagaaaaataggcagccct

SEQ ID NO: 139238 - DNA, 25 bp, Mus musculus
tctcagaagaagaggtgactgcccc

SEQ ID NO: 139239 - DNA, 25 bp, Mus musculus
tctcagaagactggagggacccaaa

SEQ ID NO: 139240 - DNA, 25 bp, Mus musculus
tctcagaaggtaatgtgagacctca

SEQ ID NO: 139241 - DNA, 25 bp, Mus musculus
tctcagaaggtgaagtagaccactc

SEQ ID NO: 139242 - DNA, 25 bp, Mus musculus
tctcagaagtcatcagcgtcacgct

SEQ ID NO: 139243 - DNA, 25 bp, Mus musculus
tctcagaagttccagtcacatatgt

SEQ ID NO: 139244 - DNA, 25 bp, Mus musculus
tctcagaccaggaagaagctgacca

SEQ ID NO: 139245 - DNA, 25 bp, Mus musculus
tctcagacccgctcaagaacttgcg

SEQ ID NO: 139246 - DNA, 25 bp, Mus musculus
tctcagactagttttgaatcccagc

SEQ ID NO: 139247 - DNA, 25 bp, Mus musculus
tctcagactccagtgtgcatctcag

SEQ ID NO: 139248 - DNA, 25 bp, Mus musculus
tctcagactctgactctggctatgg

SEQ ID NO: 139249 - DNA, 25 bp, Mus musculus
tctcagagacctacgttcaagcagt

SEQ ID NO: 139250 - DNA, 25 bp, Mus musculus
tctcagagacgccaaaggaaatctg

SEQ ID NO: 139251 - DNA, 25 bp, Mus musculus
tctcagagagaagcttcaggccatt

SEQ ID NO: 139252 - DNA, 25 bp, Mus musculus
tctcagagatgagcagatcagggaa

SEQ ID NO: 139253 - DNA, 25 bp, Mus musculus
tctcagagattgatggaaacagaaa

SEQ ID NO: 139254 - DNA, 25 bp, Mus musculus
tctcagagcaagactcgggatcact

SEQ ID NO: 139255 - DNA, 25 bp, Mus musculus
tctcagagccaggaggatatctcac

SEQ ID NO: 139256 - DNA, 25 bp, Mus musculus
tctcagagccgctgcaagtggtggc

SEQ ID NO: 139257 - DNA, 25 bp, Mus musculus
tctcagagctgggtcgtggagccta

SEQ ID NO: 139258 - DNA, 25 bp, Mus musculus
tctcagaggccgaaagataaaaaca

SEQ ID NO: 139259 - DNA, 25 bp, Mus musculus
tctcagagggaacattagggaccat

SEQ ID NO: 139260 - DNA, 25 bp, Mus musculus
tctcagagtgttcacaggaagcagc

SEQ ID NO: 139261 - DNA, 25 bp, Mus musculus
tctcagatcacagggctgaaaaagc

SEQ ID NO: 139262 - DNA, 25 bp, Mus musculus
tctcagatgataacggaaggacgca

SEQ ID NO: 139263 - DNA, 25 bp, Mus musculus
tctcagatgctgactgctctccatc

SEQ ID NO: 139264 - DNA, 25 bp, Mus musculus
tctcagatgtagtgcaccttacgct

SEQ ID NO: 139265 - DNA, 25 bp, Mus musculus
tctcagcaagatctagtcacccata

SEQ ID NO: 139266 - DNA, 25 bp, Mus musculus
tctcagcagacaggacacaccattg

SEQ ID NO: 139267 - DNA, 25 bp, Mus musculus
tctcagcagagaatgtagttccaca

SEQ ID NO: 139268 - DNA, 25 bp, Mus musculus
tctcagcaggttagaggcaggatta

SEQ ID NO: 139269 - DNA, 25 bp, Mus musculus
tctcagcaggttgtgtggcgctgcc

SEQ ID NO: 139270 - DNA, 25 bp, Mus musculus
tctcagcataattggtttgccctgc

SEQ ID NO: 139271 - DNA, 25 bp, Mus musculus
tctcagccacagatcacaggacagg

SEQ ID NO: 139272 - DNA, 25 bp, Mus musculus
tctcagccagcctattcttttggaa

SEQ ID NO: 139273 - DNA, 25 bp, Mus musculus
tctcagccattaggaagaagcgcct

SEQ ID NO: 139274 - DNA, 25 bp, Mus musculus
tctcagccgccatggatagcgacga

SEQ ID NO: 139275 - DNA, 25 bp, Mus musculus
tctcagcctgccttggactgactgt

SEQ ID NO: 139276 - DNA, 25 bp, Mus musculus
tctcagcctgtgcttcagagggtcc

SEQ ID NO: 139277 - DNA, 25 bp, Mus musculus
tctcagccttgccagagggatcctc

SEQ ID NO: 139278 - DNA, 25 bp, Mus musculus
tctcagcgacatgacgcaaggtggg

SEQ ID NO: 139279 - DNA, 25 bp, Mus musculus
tctcagcgaggtggaagaatcccat

SEQ ID NO: 139280 - DNA, 25 bp, Mus musculus
tctcaggacacacaggaaatggctt

SEQ ID NO: 139281 - DNA, 25 bp, Mus musculus
tctcaggacagagtggagccaagat

SEQ ID NO: 139282 - DNA, 25 bp, Mus musculus
tctcaggacccgcaataacgtgctg

SEQ ID NO: 139283 - DNA, 25 bp, Mus musculus
tctcaggagctatggggacctccca

SEQ ID NO: 139284 - DNA, 25 bp, Mus musculus
tctcaggatcacacttggcgatggc

SEQ ID NO: 139285 - DNA, 25 bp, Mus musculus
tctcaggatgagttctgggccttca

SEQ ID NO: 139286 - DNA, 25 bp, Mus musculus
tctcaggcaaaacacatgctgggtg

SEQ ID NO: 139287 - DNA, 25 bp, Mus musculus
tctcaggcatgagcaagatggtgtc

SEQ ID NO: 139288 - DNA, 25 bp, Mus musculus
tctcaggccaggatcacttagcagg

SEQ ID NO: 139289 - DNA, 25 bp, Mus musculus
tctcaggctagcagaaaagagggcc

SEQ ID NO: 139290 - DNA, 25 bp, Mus musculus
tctcaggctctccttatcggctggg

SEQ ID NO: 139291 - DNA, 25 bp, Mus musculus
tctcagggaattcggagcatgatct

SEQ ID NO: 139292 - DNA, 25 bp, Mus musculus
tctcagggacagttgaggctcagcc

SEQ ID NO: 139293 - DNA, 25 bp, Mus musculus
tctcagggttttccgcaatcaggcc

SEQ ID NO: 139294 - DNA, 25 bp, Mus musculus
tctcaggtgaaaagtacctccttca

SEQ ID NO: 139295 - DNA, 25 bp, Mus musculus
tctcaggtgccagacaaacagctca

SEQ ID NO: 139296 - DNA, 25 bp, Mus musculus
tctcagtcagaagaatgcgaacctg

SEQ ID NO: 139297 - DNA, 25 bp, Mus musculus
tctcagtcgacataatacagcagtg

SEQ ID NO: 139298 - DNA, 25 bp, Mus musculus
tctcagtgaaagtgccaaccaggtc

SEQ ID NO: 139299 - DNA, 25 bp, Mus musculus
tctcagtgagggtgtacgcttgccc

SEQ ID NO: 139300 - DNA, 25 bp, Mus musculus
tctcagtggccagcagtaaactcgg

SEQ ID NO: 139301 - DNA, 25 bp, Mus musculus
tctcagtggtgaaaggctagcctgc

SEQ ID NO: 139302 - DNA, 25 bp, Mus musculus
tctcagttcagcaaggaccgtctgt

SEQ ID NO: 139303 - DNA, 25 bp, Mus musculus
tctcagttcttttatgtgtgaccat

SEQ ID NO: 139304 - DNA, 25 bp, Mus musculus
tctcagttggatggacccctagtgc

SEQ ID NO: 139305 - DNA, 25 bp, Mus musculus
tctcagttggccacgttactcacaa

SEQ ID NO: 139306 - DNA, 25 bp, Mus musculus
tctcagttgggtttggaagcaggca

SEQ ID NO: 139307 - DNA, 25 bp, Mus musculus
tctcagttgtctggtggccatcagt

SEQ ID NO: 139308 - DNA, 25 bp, Mus musculus
tctcatattggcaagtaaaggcagc

SEQ ID NO: 139309 - DNA, 25 bp, Mus musculus
tctcatcagcaggtcacaagtctag

SEQ ID NO: 139310 - DNA, 25 bp, Mus musculus
tctcatcaggaaatacgtgtctcag

SEQ ID NO: 139311 - DNA, 25 bp, Mus musculus
tctcatcaggagtaaaaccaggttt

SEQ ID NO: 139312 - DNA, 25 bp, Mus musculus
tctcatcattgtggtatgcgtgggc

SEQ ID NO: 139313 - DNA, 25 bp, Mus musculus
tctcatccgggtggtggaaacctga

SEQ ID NO: 139314 - DNA, 25 bp, Mus musculus
tctcatcgagctccataacaagccg

SEQ ID NO: 139315 - DNA, 25 bp, Mus musculus
tctcatcgcccacaacttggtccac

SEQ ID NO: 139316 - DNA, 25 bp, Mus musculus
tctcatcgtgaaaagaatatccaca

SEQ ID NO: 139317 - DNA, 25 bp, Mus musculus
tctcatctcagcttggaatagcggc

SEQ ID NO: 139318 - DNA, 25 bp, Mus musculus
tctcatctcctaaagagtgtgggtt

SEQ ID NO: 139319 - DNA, 25 bp, Mus musculus
tctcatcttgggtacagcagtccgc

SEQ ID NO: 139320 - DNA, 25 bp, Mus musculus
tctcatgaagcagagccgctgggac

SEQ ID NO: 139321 - DNA, 25 bp, Mus musculus
tctcatgaccctgaatgaagagaga

SEQ ID NO: 139322 - DNA, 25 bp, Mus musculus
tctcatgagaaactccggaggcagc

SEQ ID NO: 139323 - DNA, 25 bp, Mus musculus
tctcatgaggcagaagcggagcaag

SEQ ID NO: 139324 - DNA, 25 bp, Mus musculus
tctcatgagtggaaacggaaatcgc

SEQ ID NO: 139325 - DNA, 25 bp, Mus musculus
tctcatgcccggctggctaggacgc

SEQ ID NO: 139326 - DNA, 25 bp, Mus musculus
tctcatggagcaggatcgatggtgt

SEQ ID NO: 139327 - DNA, 25 bp, Mus musculus
tctcatggagcccaaagaagctgta

SEQ ID NO: 139328 - DNA, 25 bp, Mus musculus
tctcatggcaaagatggctgaacac

SEQ ID NO: 139329 - DNA, 25 bp, Mus musculus
tctcatggcggaaagagttggtaca

SEQ ID NO: 139330 - DNA, 25 bp, Mus musculus
tctcatgggagcagtaataaaagtt

SEQ ID NO: 139331 - DNA, 25 bp, Mus musculus
tctcatggttcccagaagagccact

SEQ ID NO: 139332 - DNA, 25 bp, Mus musculus
tctcattaataaacaaggcacagtg

SEQ ID NO: 139333 - DNA, 25 bp, Mus musculus
tctcattagcaaaaacgaagtaggc

SEQ ID NO: 139334 - DNA, 25 bp, Mus musculus
tctcattcagggagtgtcgcagaca

SEQ ID NO: 139335 - DNA, 25 bp, Mus musculus
tctcattgaagcagggagcgctgcc

SEQ ID NO: 139336 - DNA, 25 bp, Mus musculus
tctcattgagcaaagaggcgatcac

SEQ ID NO: 139337 - DNA, 25 bp, Mus musculus
tctccaaagagtctccaagtcacgg

SEQ ID NO: 139338 - DNA, 25 bp, Mus musculus
tctccaacaagtggttccatgagcg

SEQ ID NO: 139339 - DNA, 25 bp, Mus musculus
tctccaacagggagctgaggcgctg

SEQ ID NO: 139340 - DNA, 25 bp, Mus musculus
tctccaacgtcacaggcgtggtgcg

SEQ ID NO: 139341 - DNA, 25 bp, Mus musculus
tctccaagaagctgactcgctacct

SEQ ID NO: 139342 - DNA, 25 bp, Mus musculus
tctccaagacttgaaggagctcaag

SEQ ID NO: 139343 - DNA, 25 bp, Mus musculus
tctccaagagagactcagagcctgt

SEQ ID NO: 139344 - DNA, 25 bp, Mus musculus
tctccaagatagaagcgagggacat

SEQ ID NO: 139345 - DNA, 25 bp, Mus musculus
tctccaagatggctacctactgctg

SEQ ID NO: 139346 - DNA, 25 bp, Mus musculus
tctccaagcaaatcaatgggcggtg

SEQ ID NO: 139347 - DNA, 25 bp, Mus musculus
tctccaagcaggtctgggtacagct

SEQ ID NO: 139348 - DNA, 25 bp, Mus musculus
tctccaagcccatgaggaataaggc

SEQ ID NO: 139349 - DNA, 25 bp, Mus musculus
tctccaagctgattatccgggctgc

SEQ ID NO: 139350 - DNA, 25 bp, Mus musculus
tctccaaggcggctgtcaatgtgca

SEQ ID NO: 139351 - DNA, 25 bp, Mus musculus
tctccaagggttggtaagaccagcg

SEQ ID NO: 139352 - DNA, 25 bp, Mus musculus
tctccaagtggatgcccaaggcaag

SEQ ID NO: 139353 - DNA, 25 bp, Mus musculus
tctccaagtttggtgttgaagcctt

SEQ ID NO: 139354 - DNA, 25 bp, Mus musculus
tctccaatgaaagagctgaccaatg

SEQ ID NO: 139355 - DNA, 25 bp, Mus musculus
tctccaccagtttattgagaataag

SEQ ID NO: 139356 - DNA, 25 bp, Mus musculus
tctccaccgaggagcgactactggg

SEQ ID NO: 139357 - DNA, 25 bp, Mus musculus
tctccaccgcgagagaaggagcacg

SEQ ID NO: 139358 - DNA, 25 bp, Mus musculus
tctccacgctggagagcacggacgt

SEQ ID NO: 139359 - DNA, 25 bp, Mus musculus
tctccacgggcctttttctcaagga

SEQ ID NO: 139360 - DNA, 25 bp, Mus musculus
tctccagaaataaagcaggtgacag

SEQ ID NO: 139361 - DNA, 25 bp, Mus musculus
tctccagaaggaatgaagacgaggc

SEQ ID NO: 139362 - DNA, 25 bp, Mus musculus
tctccagaagtgaacagggaatctt

SEQ ID NO: 139363 - DNA, 25 bp, Mus musculus
tctccagaagttagccccaagggtt

SEQ ID NO: 139364 - DNA, 25 bp, Mus musculus
tctccagacaggaggcaacatcagt

SEQ ID NO: 139365 - DNA, 25 bp, Mus musculus
tctccagagaacgtcagcaagaggg

SEQ ID NO: 139366 - DNA, 25 bp, Mus musculus
tctccagagcgaagcaggactcact

SEQ ID NO: 139367 - DNA, 25 bp, Mus musculus
tctccaggaaccttgaaccaggtgg

SEQ ID NO: 139368 - DNA, 25 bp, Mus musculus
tctccaggaagaacctccggtaaag

SEQ ID NO: 139369 - DNA, 25 bp, Mus musculus
tctccaggaataataagtacatcgt

SEQ ID NO: 139370 - DNA, 25 bp, Mus musculus
tctccaggacatcattgccatcttg

SEQ ID NO: 139371 - DNA, 25 bp, Mus musculus
tctccaggcaaggtgaagggtaccc

SEQ ID NO: 139372 - DNA, 25 bp, Mus musculus
tctccagggagcaagctgagagccc

SEQ ID NO: 139373 - DNA, 25 bp, Mus musculus
tctccagggatgctcaagtttcaca

SEQ ID NO: 139374 - DNA, 25 bp, Mus musculus
tctccagtagaagtgcagaaatgcc

SEQ ID NO: 139375 - DNA, 25 bp, Mus musculus
tctccagtctgatgagtatgcactg

SEQ ID NO: 139376 - DNA, 25 bp, Mus musculus
tctccagtgaacacaaccacggtca

SEQ ID NO: 139377 - DNA, 25 bp, Mus musculus
tctccagtgatgagtgcgtccagga

SEQ ID NO: 139378 - DNA, 25 bp, Mus musculus
tctccagtgtgcttgagatctgcct

SEQ ID NO: 139379 - DNA, 25 bp, Mus musculus
tctccagtgttgtccaaggaaatgt

SEQ ID NO: 139380 - DNA, 25 bp, Mus musculus
tctccataaagcctcggcgaatggg

SEQ ID NO: 139381 - DNA, 25 bp, Mus musculus
tctccataatcgcatggcggtggct

SEQ ID NO: 139382 - DNA, 25 bp, Mus musculus
tctccatagtgggaatctgtctggg

SEQ ID NO: 139383 - DNA, 25 bp, Mus musculus
tctccatatacagctgggcaaggct

SEQ ID NO: 139384 - DNA, 25 bp, Mus musculus
tctccatcaagggtcaaggcaccgt

SEQ ID NO: 139385 - DNA, 25 bp, Mus musculus
tctccatgaagaagatgggactcga

SEQ ID NO: 139386 - DNA, 25 bp, Mus musculus
tctccatgctgagctgtggccaagg

SEQ ID NO: 139387 - DNA, 25 bp, Mus musculus
tctccatggacggttttagagctga

SEQ ID NO: 139388 - DNA, 25 bp, Mus musculus
tctccatggtgcagcagcgttggct

SEQ ID NO: 139389 - DNA, 25 bp, Mus musculus
tctccattgagatgaacgggactct

SEQ ID NO: 139390 - DNA, 25 bp, Mus musculus
tctccattgaggaggaggaccccaa

SEQ ID NO: 139391 - DNA, 25 bp, Mus musculus
tctccatttatgacagcgatagctc

SEQ ID NO: 139392 - DNA, 25 bp, Mus musculus
tctcccaagggaagaatgagtccat

SEQ ID NO: 139393 - DNA, 25 bp, Mus musculus
tctcccaaggtatctgacggtgtgt

SEQ ID NO: 139394 - DNA, 25 bp, Mus musculus
tctcccaccagagcccggaacatga

SEQ ID NO: 139395 - DNA, 25 bp, Mus musculus
tctcccagagggaagtaatctcact

SEQ ID NO: 139396 - DNA, 25 bp, Mus musculus
tctcccagatggttcaggacaagcc

SEQ ID NO: 139397 - DNA, 25 bp, Mus musculus
tctcccagccgaaggtgatgaacaa

SEQ ID NO: 139398 - DNA, 25 bp, Mus musculus
tctcccagggctaccagagtaaaca

SEQ ID NO: 139399 - DNA, 25 bp, Mus musculus
tctcccattaaagaggaaccctgtg

SEQ ID NO: 139400 - DNA, 25 bp, Mus musculus
tctccccactggaggcagatgacct

SEQ ID NO: 139401 - DNA, 25 bp, Mus musculus
tctccccagagcaacgtggactttg

SEQ ID NO: 139402 - DNA, 25 bp, Mus musculus
tctccccagagtcggtattgaaagt

SEQ ID NO: 139403 - DNA, 25 bp, Mus musculus
tctccccagatatagacagtgaacg

SEQ ID NO: 139404 - DNA, 25 bp, Mus musculus
tctccccagatgcagaatggccttc

SEQ ID NO: 139405 - DNA, 25 bp, Mus musculus
tctcccctgagagcaacgctgtgta

SEQ ID NO: 139406 - DNA, 25 bp, Mus musculus
tctcccgaaatgacatccagtctga

SEQ ID NO: 139407 - DNA, 25 bp, Mus musculus
tctcccgcaggaagaagatctcagc

SEQ ID NO: 139408 - DNA, 25 bp, Mus musculus
tctcccgcgaagagtcgacatggcg

SEQ ID NO: 139409 - DNA, 25 bp, Mus musculus
tctcccggctgaaggctggcagctt

SEQ ID NO: 139410 - DNA, 25 bp, Mus musculus
tctcccgggagtacaatgaactgct

SEQ ID NO: 139411 - DNA, 25 bp, Mus musculus
tctcccggtttcagatccgcatttg

SEQ ID NO: 139412 - DNA, 25 bp, Mus musculus
tctcccgtaatcaggatgggctgct

SEQ ID NO: 139413 - DNA, 25 bp, Mus musculus
tctcccgtcctgaggagggtgacgc

SEQ ID NO: 139414 - DNA, 25 bp, Mus musculus
tctcccgtgtgccaagatgtgatgc

SEQ ID NO: 139415 - DNA, 25 bp, Mus musculus
tctccctacgctgactgacttatta

SEQ ID NO: 139416 - DNA, 25 bp, Mus musculus
tctccctagcaactgcgggtctgcg

SEQ ID NO: 139417 - DNA, 25 bp, Mus musculus
tctccctcagagtgcgatgctgaag

SEQ ID NO: 139418 - DNA, 25 bp, Mus musculus
tctccctctggatagtcactggcat

SEQ ID NO: 139419 - DNA, 25 bp, Mus musculus
tctccctcttcgatgatgagtttga

SEQ ID NO: 139420 - DNA, 25 bp, Mus musculus
tctccctgaagccagatgaatgctg

SEQ ID NO: 139421 - DNA, 25 bp, Mus musculus
tctccctggaggcagacatctatcg

SEQ ID NO: 139422 - DNA, 25 bp, Mus musculus
tctccctgggatgctttgcgctggc

SEQ ID NO: 139423 - DNA, 25 bp, Mus musculus
tctccctggtagagaagtacattga

SEQ ID NO: 139424 - DNA, 25 bp, Mus musculus
tctccctgtgaagtctatgaggtgc

SEQ ID NO: 139425 - DNA, 25 bp, Mus musculus
tctcccttggagcaaagacttagag

SEQ ID NO: 139426 - DNA, 25 bp, Mus musculus
tctcccttggagcagtcagtacctc

SEQ ID NO: 139427 - DNA, 25 bp, Mus musculus
tctccgaaaatgagctgccactgcc

SEQ ID NO: 139428 - DNA, 25 bp, Mus musculus
tctccgaagaaatgagggacctagc

SEQ ID NO: 139429 - DNA, 25 bp, Mus musculus
tctccgaagagtacacgggctccag

SEQ ID NO: 139430 - DNA, 25 bp, Mus musculus
tctccgaaggacatcgcaaaggcct

SEQ ID NO: 139431 - DNA, 25 bp, Mus musculus
tctccgacgaagcaatagcagcctt

SEQ ID NO: 139432 - DNA, 25 bp, Mus musculus
tctccgagagaagagttcaagatca

SEQ ID NO: 139433 - DNA, 25 bp, Mus musculus
tctccgagatggacagtgacaagcc

SEQ ID NO: 139434 - DNA, 25 bp, Mus musculus
tctccgagctgacgaaccatggcat

SEQ ID NO: 139435 - DNA, 25 bp, Mus musculus
tctccgagggcgatgtgtaccccaa

SEQ ID NO: 139436 - DNA, 25 bp, Mus musculus
tctccgaggtcgtgacaggattgtg

SEQ ID NO: 139437 - DNA, 25 bp, Mus musculus
tctccgagtcaagtcagaggaggac

SEQ ID NO: 139438 - DNA, 25 bp, Mus musculus
tctccgagttcctgtatgcatggct

SEQ ID NO: 139439 - DNA, 25 bp, Mus musculus
tctccgccgaagctgcaactatggg

SEQ ID NO: 139440 - DNA, 25 bp, Mus musculus
tctccgcgccgcgttctgagggaag

SEQ ID NO: 139441 - DNA, 25 bp, Mus musculus
tctccgcgggcggattgcgaacttg

SEQ ID NO: 139442 - DNA, 25 bp, Mus musculus
tctccgcgtgcagcgctgtaaagga

SEQ ID NO: 139443 - DNA, 25 bp, Mus musculus
tctccgctgatggagtcctgatgct

SEQ ID NO: 139444 - DNA, 25 bp, Mus musculus
tctccggagttgcagaccttacagg

SEQ ID NO: 139445 - DNA, 25 bp, Mus musculus
tctccggcatgaccatgtgctatgc

SEQ ID NO: 139446 - DNA, 25 bp, Mus musculus
tctccgggaaatggctgagcgctta

SEQ ID NO: 139447 - DNA, 25 bp, Mus musculus
tctccgggaaggctgtatgtaaatc

SEQ ID NO: 139448 - DNA, 25 bp, Mus musculus
tctccgggattgatgttagtacaca

SEQ ID NO: 139449 - DNA, 25 bp, Mus musculus
tctccgggtgagaggaagcatgctc

SEQ ID NO: 139450 - DNA, 25 bp, Mus musculus
tctccgtcgagtaagagacctgtgt

SEQ ID NO: 139451 - DNA, 25 bp, Mus musculus
tctccgtgatggaagaccactcgca

SEQ ID NO: 139452 - DNA, 25 bp, Mus musculus
tctccgtgcatgtccagggtcaaga

SEQ ID NO: 139453 - DNA, 25 bp, Mus musculus
tctccgtgggcgagaagtgtgtcct

SEQ ID NO: 139454 - DNA, 25 bp, Mus musculus
tctccgtggtggagcaggagaaact

SEQ ID NO: 139455 - DNA, 25 bp, Mus musculus
tctccgtgtggaaaacgtctcccga

SEQ ID NO: 139456 - DNA, 25 bp, Mus musculus
tctccgtgtgggtcttatgtaggtc

SEQ ID NO: 139457 - DNA, 25 bp, Mus musculus
tctcctaagcagtggacgagacgcc

SEQ ID NO: 139458 - DNA, 25 bp, Mus musculus
tctcctaagcatcccatagagcagg

SEQ ID NO: 139459 - DNA, 25 bp, Mus musculus
tctcctaatggaataagcgactatc

SEQ ID NO: 139460 - DNA, 25 bp, Mus musculus
tctcctacaggcagttcgaaggctt

SEQ ID NO: 139461 - DNA, 25 bp, Mus musculus
tctcctagaagtagagggtcgcgcg

SEQ ID NO: 139462 - DNA, 25 bp, Mus musculus
tctcctagagtgtgaagcagaaagc

SEQ ID NO: 139463 - DNA, 25 bp, Mus musculus
tctcctataaaaggcacacgcgggc

SEQ ID NO: 139464 - DNA, 25 bp, Mus musculus
tctcctcagaagtaaaaagctcagc

SEQ ID NO: 139465 - DNA, 25 bp, Mus musculus
tctcctcagacggagaagcatcgga

SEQ ID NO: 139466 - DNA, 25 bp, Mus musculus
tctcctcagagggtttatagaaact

SEQ ID NO: 139467 - DNA, 25 bp, Mus musculus
tctcctcatggaagcaaagagaagg

SEQ ID NO: 139468 - DNA, 25 bp, Mus musculus
tctcctccagaaaagggaccaaggg

SEQ ID NO: 139469 - DNA, 25 bp, Mus musculus
tctcctccgggacaaagatctgtgg

SEQ ID NO: 139470 - DNA, 25 bp, Mus musculus
tctcctccgtgaaaaactgtgtccg

SEQ ID NO: 139471 - DNA, 25 bp, Mus musculus
tctcctcggagttgcgtagcctgct

SEQ ID NO: 139472 - DNA, 25 bp, Mus musculus
tctcctcggtatccagactggctga

SEQ ID NO: 139473 - DNA, 25 bp, Mus musculus
tctcctctatggttgcgggagctga

SEQ ID NO: 139474 - DNA, 25 bp, Mus musculus
tctcctctgggacaagcataggatc

SEQ ID NO: 139475 - DNA, 25 bp, Mus musculus
tctcctgaacaggtagtaaggccca

SEQ ID NO: 139476 - DNA, 25 bp, Mus musculus
tctcctgaacgctgggatgacagat

SEQ ID NO: 139477 - DNA, 25 bp, Mus musculus
tctcctgaagagaaatcaaaactac

SEQ ID NO: 139478 - DNA, 25 bp, Mus musculus
tctcctgagacacactggaaaccag

SEQ ID NO: 139479 - DNA, 25 bp, Mus musculus
tctcctgagagttccctgctgcggt

SEQ ID NO: 139480 - DNA, 25 bp, Mus musculus
tctcctgagcagacagacactgttg

SEQ ID NO: 139481 - DNA, 25 bp, Mus musculus
tctcctgcaagagttcgatgttcag

SEQ ID NO: 139482 - DNA, 25 bp, Mus musculus
tctcctgctcgggatgacaaagcct

SEQ ID NO: 139483 - DNA, 25 bp, Mus musculus
tctcctggaagagcggaagctcatg

SEQ ID NO: 139484 - DNA, 25 bp, Mus musculus
tctcctggaggaagagttactgcgc

SEQ ID NO: 139485 - DNA, 25 bp, Mus musculus
tctcctggaggatgtaaccgcggga

SEQ ID NO: 139486 - DNA, 25 bp, Mus musculus
tctcctggccgaggaaaggatttca

SEQ ID NO: 139487 - DNA, 25 bp, Mus musculus
tctcctggctcatcgaatgcatggg

SEQ ID NO: 139488 - DNA, 25 bp, Mus musculus
tctcctgggaagtgtgttagtgcca

SEQ ID NO: 139489 - DNA, 25 bp, Mus musculus
tctcctgggaatggtcgcacacatg

SEQ ID NO: 139490 - DNA, 25 bp, Mus musculus
tctcctgggcttctatgaaaacggg

SEQ ID NO: 139491 - DNA, 25 bp, Mus musculus
tctcctgtaaaaacacagatcgaaa

SEQ ID NO: 139492 - DNA, 25 bp, Mus musculus
tctcctgtcaaacgaagggtgctca

SEQ ID NO: 139493 - DNA, 25 bp, Mus musculus
tctccttaaggattctcagacctgg

SEQ ID NO: 139494 - DNA, 25 bp, Mus musculus
tctccttcggattatgctgatagac

SEQ ID NO: 139495 - DNA, 25 bp, Mus musculus
tctccttgactggacgttgaactca

SEQ ID NO: 139496 - DNA, 25 bp, Mus musculus
tctccttgatagagatacattttct

SEQ ID NO: 139497 - DNA, 25 bp, Mus musculus
tctcctttatatactgctgaccggg

SEQ ID NO: 139498 - DNA, 25 bp, Mus musculus
tctcctttcccacgagaagagtgca

SEQ ID NO: 139499 - DNA, 25 bp, Mus musculus
tctcctttccggaggcacagctggg

SEQ ID NO: 139500 - DNA, 25 bp, Mus musculus
tctcctttgaccctggtggctgatg

SEQ ID NO: 139501 - DNA, 25 bp, Mus musculus
tctcctttgcggcttactttgcggc

SEQ ID NO: 139502 - DNA, 25 bp, Mus musculus
tctccttttgttggaaacttgatgt

SEQ ID NO: 139503 - DNA, 25 bp, Mus musculus
tctcgaatacttgacgtggcccagg

SEQ ID NO: 139504 - DNA, 25 bp, Mus musculus
tctcgaatggacaaattagcgcgcg

SEQ ID NO: 139505 - DNA, 25 bp, Mus musculus
tctcgaccctggatggaagcttgca

SEQ ID NO: 139506 - DNA, 25 bp, Mus musculus
tctcgacggagaagaggtccagata

SEQ ID NO: 139507 - DNA, 25 bp, Mus musculus
tctcgactcaaagctgcccagttag

SEQ ID NO: 139508 - DNA, 25 bp, Mus musculus
tctcgactgtctggatagaaccaac

SEQ ID NO: 139509 - DNA, 25 bp, Mus musculus
tctcgactgttttcacgcagtaaag

SEQ ID NO: 139510 - DNA, 25 bp, Mus musculus
tctcgagaactgacctgcacttggc

SEQ ID NO: 139511 - DNA, 25 bp, Mus musculus
tctcgagaagagcaggccaagtact

SEQ ID NO: 139512 - DNA, 25 bp, Mus musculus
tctcgagagctgtggaatagagtca

SEQ ID NO: 139513 - DNA, 25 bp, Mus musculus
tctcgagaggctggaaacgtgaaca

SEQ ID NO: 139514 - DNA, 25 bp, Mus musculus
tctcgagagtccgaatgtggagcct

SEQ ID NO: 139515 - DNA, 25 bp, Mus musculus
tctcgagatggacaacaggaagcgc

SEQ ID NO: 139516 - DNA, 25 bp, Mus musculus
tctcgagcgcactctcgtggaggct

SEQ ID NO: 139517 - DNA, 25 bp, Mus musculus
tctcgaggccctcaaaaaggataca

SEQ ID NO: 139518 - DNA, 25 bp, Mus musculus
tctcgagggaacaatgcaggtagcc

SEQ ID NO: 139519 - DNA, 25 bp, Mus musculus
tctcgaggtaaaacagaggagtcgg

SEQ ID NO: 139520 - DNA, 25 bp, Mus musculus
tctcgagtgaccaacttcttccggg

SEQ ID NO: 139521 - DNA, 25 bp, Mus musculus
tctcgagtgatgtattaaatgctgc

SEQ ID NO: 139522 - DNA, 25 bp, Mus musculus
tctcgataagaaaggacacgtaacg

SEQ ID NO: 139523 - DNA, 25 bp, Mus musculus
tctcgatgccggcaaaagcggaaac

SEQ ID NO: 139524 - DNA, 25 bp, Mus musculus
tctcgatgctgccaaattgagccgt

SEQ ID NO: 139525 - DNA, 25 bp, Mus musculus
tctcgattcagggaaaaccacctgt

SEQ ID NO: 139526 - DNA, 25 bp, Mus musculus
tctcgatttggacgcgtgttcccag

SEQ ID NO: 139527 - DNA, 25 bp, Mus musculus
tctcgcaaggataagaaatagcggt

SEQ ID NO: 139528 - DNA, 25 bp, Mus musculus
tctcgcagccgagagaacagcgtgt

SEQ ID NO: 139529 - DNA, 25 bp, Mus musculus
tctcgcagcctaggaaagttgcagc

SEQ ID NO: 139530 - DNA, 25 bp, Mus musculus
tctcgcagcttacatgggaaaatac

SEQ ID NO: 139531 - DNA, 25 bp, Mus musculus
tctcgcccgctctgctctttttggt

SEQ ID NO: 139532 - DNA, 25 bp, Mus musculus
tctcgccgaagttcatcagtgacta

SEQ ID NO: 139533 - DNA, 25 bp, Mus musculus
tctcgccgctgtggtatgatcacaa

SEQ ID NO: 139534 - DNA, 25 bp, Mus musculus
tctcgcgaagtgtcgcccggagtgg

SEQ ID NO: 139535 - DNA, 25 bp, Mus musculus
tctcgcggatcccagggacaccttt

SEQ ID NO: 139536 - DNA, 25 bp, Mus musculus
tctcgcttaagatggcagcggagtc

SEQ ID NO: 139537 - DNA, 25 bp, Mus musculus
tctcggacacccagactggagggct

SEQ ID NO: 139538 - DNA, 25 bp, Mus musculus
tctcggactcatgcatatggctggg

SEQ ID NO: 139539 - DNA, 25 bp, Mus musculus
tctcggactccccagaacaaaaagg

SEQ ID NO: 139540 - DNA, 25 bp, Mus musculus
tctcggacttatctcgactgcccgg

SEQ ID NO: 139541 - DNA, 25 bp, Mus musculus
tctcggagcagagatagaaggcgct

SEQ ID NO: 139542 - DNA, 25 bp, Mus musculus
tctcggagctgggacaagaactgac

SEQ ID NO: 139543 - DNA, 25 bp, Mus musculus
tctcggcaagtatagggagctcccc

SEQ ID NO: 139544 - DNA, 25 bp, Mus musculus
tctcggcactgaagtacaatggtct

SEQ ID NO: 139545 - DNA, 25 bp, Mus musculus
tctcggccccagatagcacagatgt

SEQ ID NO: 139546 - DNA, 25 bp, Mus musculus
tctcggccgagatcaaggagctctt

SEQ ID NO: 139547 - DNA, 25 bp, Mus musculus
tctcggccgcttgtccagcatgaaa

SEQ ID NO: 139548 - DNA, 25 bp, Mus musculus
tctcggcgacggaagagaaacccaa

SEQ ID NO: 139549 - DNA, 25 bp, Mus musculus
tctcggctagcaaagcattgggacg

SEQ ID NO: 139550 - DNA, 25 bp, Mus musculus
tctcggctgctgatggtaccaatgt

SEQ ID NO: 139551 - DNA, 25 bp, Mus musculus
tctcggcttgagagaaaggtggact

SEQ ID NO: 139552 - DNA, 25 bp, Mus musculus
tctcgggaccccagtgggagagact

SEQ ID NO: 139553 - DNA, 25 bp, Mus musculus
tctcgggccagaaggaagtgactag

SEQ ID NO: 139554 - DNA, 25 bp, Mus musculus
tctcgggcctccacgttattgcggg

SEQ ID NO: 139555 - DNA, 25 bp, Mus musculus
tctcgggctcagtgcattaaagcag

SEQ ID NO: 139556 - DNA, 25 bp, Mus musculus
tctcgggtcccctatgatgtaggta

SEQ ID NO: 139557 - DNA, 25 bp, Mus musculus
tctcgggtcctgctgaaaggtgact

SEQ ID NO: 139558 - DNA, 25 bp, Mus musculus
tctcggtccacagagcatgggctac

SEQ ID NO: 139559 - DNA, 25 bp, Mus musculus
tctcggtcgaaccaaagacagtgca

SEQ ID NO: 139560 - DNA, 25 bp, Mus musculus
tctcggtctcggacccgatctcgat

SEQ ID NO: 139561 - DNA, 25 bp, Mus musculus
tctcggtgactgtcccatggagcca

SEQ ID NO: 139562 - DNA, 25 bp, Mus musculus
tctcggttcagtctccgtgaagcgt

SEQ ID NO: 139563 - DNA, 25 bp, Mus musculus
tctcgtacgtcaccacactgagctg

SEQ ID NO: 139564 - DNA, 25 bp, Mus musculus
tctcgtagtccatttttcaggcggg

SEQ ID NO: 139565 - DNA, 25 bp, Mus musculus
tctcgtcaccgatgaagacagttgg

SEQ ID NO: 139566 - DNA, 25 bp, Mus musculus
tctcgtcagtcatggcatcggcaag

SEQ ID NO: 139567 - DNA, 25 bp, Mus musculus
tctcgtccatgttgcagaggcccct

SEQ ID NO: 139568 - DNA, 25 bp, Mus musculus
tctcgtcgacgggaagacattcaca

SEQ ID NO: 139569 - DNA, 25 bp, Mus musculus
tctcgtcggactctcagaaagctgc

SEQ ID NO: 139570 - DNA, 25 bp, Mus musculus
tctcgtcgttttcgtagcagaacta

SEQ ID NO: 139571 - DNA, 25 bp, Mus musculus
tctcgtcttgcaccagaagcgcagg

SEQ ID NO: 139572 - DNA, 25 bp, Mus musculus
tctcgtgaagttggaaaggctttac

SEQ ID NO: 139573 - DNA, 25 bp, Mus musculus
tctcgtgctccaagaactgcctgtg

SEQ ID NO: 139574 - DNA, 25 bp, Mus musculus
tctcgtggcgagactgtaactagtg

SEQ ID NO: 139575 - DNA, 25 bp, Mus musculus
tctcgtggcgctctccttcagtggg

SEQ ID NO: 139576 - DNA, 25 bp, Mus musculus
tctcgtgggagtacgccatgatgta

SEQ ID NO: 139577 - DNA, 25 bp, Mus musculus
tctcgtggttcccagtggcgagagg

SEQ ID NO: 139578 - DNA, 25 bp, Mus musculus
tctcgtgtgggtagggacgacatcc

SEQ ID NO: 139579 - DNA, 25 bp, Mus musculus
tctcgttgggatgaaacgccggcga

SEQ ID NO: 139580 - DNA, 25 bp, Mus musculus
tctctaaataaatactagcgcattg

SEQ ID NO: 139581 - DNA, 25 bp, Mus musculus
tctctaacgtcacagaccaaggctg

SEQ ID NO: 139582 - DNA, 25 bp, Mus musculus
tctctaagcgaagcagactggcaga

SEQ ID NO: 139583 - DNA, 25 bp, Mus musculus
tctctaaggctacaggctgctcagc

SEQ ID NO: 139584 - DNA, 25 bp, Mus musculus
tctctacaagcgcaggtgaccgatg

SEQ ID NO: 139585 - DNA, 25 bp, Mus musculus
tctctacaagggacacaagtgaccg

SEQ ID NO: 139586 - DNA, 25 bp, Mus musculus
tctctacactgttcccatccgggaa

SEQ ID NO: 139587 - DNA, 25 bp, Mus musculus
tctctacaggactgaaaagctggtc

SEQ ID NO: 139588 - DNA, 25 bp, Mus musculus
tctctacatggacgtacaggccacc

SEQ ID NO: 139589 - DNA, 25 bp, Mus musculus
tctctacgagctagctcgggagagc

SEQ ID NO: 139590 - DNA, 25 bp, Mus musculus
tctctactctgatggcgggacgtgc

SEQ ID NO: 139591 - DNA, 25 bp, Mus musculus
tctctagaagcggtgcgatcatgga

SEQ ID NO: 139592 - DNA, 25 bp, Mus musculus
tctctagagcatgagctcagccaag

SEQ ID NO: 139593 - DNA, 25 bp, Mus musculus
tctctagagcctttgccaccatggg

SEQ ID NO: 139594 - DNA, 25 bp, Mus musculus
tctctagcgccaacccggtacggag

SEQ ID NO: 139595 - DNA, 25 bp, Mus musculus
tctctagggtgagggaatgtggtca

SEQ ID NO: 139596 - DNA, 25 bp, Mus musculus
tctctagtattgagcgaactgcggc

SEQ ID NO: 139597 - DNA, 25 bp, Mus musculus
tctctagtggccagcgaagcagttc

SEQ ID NO: 139598 - DNA, 25 bp, Mus musculus
tctctatcacggaagcactctcgga

SEQ ID NO: 139599 - DNA, 25 bp, Mus musculus
tctctatgagagatgacgtgccgcc

SEQ ID NO: 139600 - DNA, 25 bp, Mus musculus
tctctatggctaaggagaacattcc

SEQ ID NO: 139601 - DNA, 25 bp, Mus musculus
tctctcaaggtcgataccgagtggg

SEQ ID NO: 139602 - DNA, 25 bp, Mus musculus
tctctcagcgtctgggctctcagaa

SEQ ID NO: 139603 - DNA, 25 bp, Mus musculus
tctctcagcgtgcagaggatggaaa

SEQ ID NO: 139604 - DNA, 25 bp, Mus musculus
tctctcagggaattagggctcaatg

SEQ ID NO: 139605 - DNA, 25 bp, Mus musculus
tctctcagggtttaccgcaaagtgc

SEQ ID NO: 139606 - DNA, 25 bp, Mus musculus
tctctcaggttcagtgggactgcca

SEQ ID NO: 139607 - DNA, 25 bp, Mus musculus
tctctccaagatctgaagctcctcg

SEQ ID NO: 139608 - DNA, 25 bp, Mus musculus
tctctccaataaggtggccctggtc

SEQ ID NO: 139609 - DNA, 25 bp, Mus musculus
tctctcccaataagaagcaggtgcc

SEQ ID NO: 139610 - DNA, 25 bp, Mus musculus
tctctccccagtgcataatggcaaa

SEQ ID NO: 139611 - DNA, 25 bp, Mus musculus
tctctccgcgggaaatataaaggac

SEQ ID NO: 139612 - DNA, 25 bp, Mus musculus
tctctccggagcgagcctttgctga

SEQ ID NO: 139613 - DNA, 25 bp, Mus musculus
tctctcctgtacaagcgaacacgga

SEQ ID NO: 139614 - DNA, 25 bp, Mus musculus
tctctcctgtagacgagacaccagc

SEQ ID NO: 139615 - DNA, 25 bp, Mus musculus
tctctcctttcccacgagaagagtg

SEQ ID NO: 139616 - DNA, 25 bp, Mus musculus
tctctcgaaggcaaaaaaggctggc

SEQ ID NO: 139617 - DNA, 25 bp, Mus musculus
tctctcgcgagatcaggtggctctg

SEQ ID NO: 139618 - DNA, 25 bp, Mus musculus
tctctcgctgaaggcgtacagactg

SEQ ID NO: 139619 - DNA, 25 bp, Mus musculus
tctctcggaactgagtggcaccgtg

SEQ ID NO: 139620 - DNA, 25 bp, Mus musculus
tctctcggattgacccagatggaac

SEQ ID NO: 139621 - DNA, 25 bp, Mus musculus
tctctcgggaaaggactcactcgtc

SEQ ID NO: 139622 - DNA, 25 bp, Mus musculus
tctctcggtatcagcagttcaagga

SEQ ID NO: 139623 - DNA, 25 bp, Mus musculus
tctctcgtgcggctggttaaggaaa

SEQ ID NO: 139624 - DNA, 25 bp, Mus musculus
tctctctgacatcagcaaagggaag

SEQ ID NO: 139625 - DNA, 25 bp, Mus musculus
tctctctgtctctgagcagaggatg

SEQ ID NO: 139626 - DNA, 25 bp, Mus musculus
tctctcttaacaacaggttctgccg

SEQ ID NO: 139627 - DNA, 25 bp, Mus musculus
tctctcttaggtaccccatccagaa

SEQ ID NO: 139628 - DNA, 25 bp, Mus musculus
tctctgaaacagtgctcgtctccgc

SEQ ID NO: 139629 - DNA, 25 bp, Mus musculus
tctctgaacaaggtagctgtcctgc

SEQ ID NO: 139630 - DNA, 25 bp, Mus musculus
tctctgaagaagtcaccgctgcttt

SEQ ID NO: 139631 - DNA, 25 bp, Mus musculus
tctctgaagagaccgctggaagcac

SEQ ID NO: 139632 - DNA, 25 bp, Mus musculus
tctctgaagatgcaatgagcacagc

SEQ ID NO: 139633 - DNA, 25 bp, Mus musculus
tctctgaaggtgaccaatgagccca

SEQ ID NO: 139634 - DNA, 25 bp, Mus musculus
tctctgaatctctgtctgaactgga

SEQ ID NO: 139635 - DNA, 25 bp, Mus musculus
tctctgaattactgtgaatgggccc

SEQ ID NO: 139636 - DNA, 25 bp, Mus musculus
tctctgacacacagtcgcagggaag

SEQ ID NO: 139637 - DNA, 25 bp, Mus musculus
tctctgacgcatccttcctgtcggg

SEQ ID NO: 139638 - DNA, 25 bp, Mus musculus
tctctgacttcggtggacggagcct

SEQ ID NO: 139639 - DNA, 25 bp, Mus musculus
tctctgagccatggagataccccga

SEQ ID NO: 139640 - DNA, 25 bp, Mus musculus
tctctgagctctgcatctgtctgct

SEQ ID NO: 139641 - DNA, 25 bp, Mus musculus
tctctgaggagaagcgaaggcagct

SEQ ID NO: 139642 - DNA, 25 bp, Mus musculus
tctctgagtcgggaagtgaccacta

SEQ ID NO: 139643 - DNA, 25 bp, Mus musculus
tctctgagtgggacacaagctctgt

SEQ ID NO: 139644 - DNA, 25 bp, Mus musculus
tctctgatgaaacctccagggagtc

SEQ ID NO: 139645 - DNA, 25 bp, Mus musculus
tctctgatgagaagaaccgtgcctc

SEQ ID NO: 139646 - DNA, 25 bp, Mus musculus
tctctgatgagatgtccagttgccg

SEQ ID NO: 139647 - DNA, 25 bp, Mus musculus
tctctgatgcagacaaaagactggc

SEQ ID NO: 139648 - DNA, 25 bp, Mus musculus
tctctgatgtcctggcgtgctcaca

SEQ ID NO: 139649 - DNA, 25 bp, Mus musculus
tctctgattgaggacattgctgctg

SEQ ID NO: 139650 - DNA, 25 bp, Mus musculus
tctctgcagggctttactttacact

SEQ ID NO: 139651 - DNA, 25 bp, Mus musculus
tctctgcagtaacaataaaagcgcc

SEQ ID NO: 139652 - DNA, 25 bp, Mus musculus
tctctgcatcgagcggcagtcgcag

SEQ ID NO: 139653 - DNA, 25 bp, Mus musculus
tctctgcattcaaaaacttcgggtc

SEQ ID NO: 139654 - DNA, 25 bp, Mus musculus
tctctgcattggtagaagaccacag

SEQ ID NO: 139655 - DNA, 25 bp, Mus musculus
tctctgccagtgataatgggtcctg

SEQ ID NO: 139656 - DNA, 25 bp, Mus musculus
tctctgcccggatacggactgtcat

SEQ ID NO: 139657 - DNA, 25 bp, Mus musculus
tctctgccgtgaataaggttgtcca

SEQ ID NO: 139658 - DNA, 25 bp, Mus musculus
tctctgcctcagctgtcagaactca

SEQ ID NO: 139659 - DNA, 25 bp, Mus musculus
tctctgcctccaacaaagtgggtac

SEQ ID NO: 139660 - DNA, 25 bp, Mus musculus
tctctgcctgaataggagcatgctc

SEQ ID NO: 139661 - DNA, 25 bp, Mus musculus
tctctgccttagtcccagggtgtcg

SEQ ID NO: 139662 - DNA, 25 bp, Mus musculus
tctctgcgcacgaggatggacacct

SEQ ID NO: 139663 - DNA, 25 bp, Mus musculus
tctctgcgcatagatcttgtttgtc

SEQ ID NO: 139664 - DNA, 25 bp, Mus musculus
tctctgcgcatgtttcacctgggcc

SEQ ID NO: 139665 - DNA, 25 bp, Mus musculus
tctctgcgggtgaaaagacctctgc

SEQ ID NO: 139666 - DNA, 25 bp, Mus musculus
tctctgcgtgggaagttctgggcgc

SEQ ID NO: 139667 - DNA, 25 bp, Mus musculus
tctctgctatggaagtttattaata

SEQ ID NO: 139668 - DNA, 25 bp, Mus musculus
tctctgctctcaacaaggcctggtg

SEQ ID NO: 139669 - DNA, 25 bp, Mus musculus
tctctgctggtagaagaggccatta

SEQ ID NO: 139670 - DNA, 25 bp, Mus musculus
tctctgctgtttccgagggagcccg

SEQ ID NO: 139671 - DNA, 25 bp, Mus musculus
tctctggaagaaactgtgtcatgtg

SEQ ID NO: 139672 - DNA, 25 bp, Mus musculus
tctctggaagaagcatcgctcagct

SEQ ID NO: 139673 - DNA, 25 bp, Mus musculus
tctctggacagaccaacctctcggt

SEQ ID NO: 139674 - DNA, 25 bp, Mus musculus
tctctggacctcagtaaccctcagg

SEQ ID NO: 139675 - DNA, 25 bp, Mus musculus
tctctggacgccaggtagaacgctg

SEQ ID NO: 139676 - DNA, 25 bp, Mus musculus
tctctggagaacacatggacctcac

SEQ ID NO: 139677 - DNA, 25 bp, Mus musculus
tctctggagaacgtggaggatgtcc

SEQ ID NO: 139678 - DNA, 25 bp, Mus musculus
tctctggagagagtacaaagttctg

SEQ ID NO: 139679 - DNA, 25 bp, Mus musculus
tctctggagatggacggaactacct

SEQ ID NO: 139680 - DNA, 25 bp, Mus musculus
tctctggagctaccatggcgtttgg

SEQ ID NO: 139681 - DNA, 25 bp, Mus musculus
tctctggagtaaaggatgagccaca

SEQ ID NO: 139682 - DNA, 25 bp, Mus musculus
tctctggataaaagcagcacttcag

SEQ ID NO: 139683 - DNA, 25 bp, Mus musculus
tctctggatgtacctgcaggcgctg

SEQ ID NO: 139684 - DNA, 25 bp, Mus musculus
tctctggcggacagccgcatgagga

SEQ ID NO: 139685 - DNA, 25 bp, Mus musculus
tctctggctgtggaaccctggaaga

SEQ ID NO: 139686 - DNA, 25 bp, Mus musculus
tctctgggatggactggacactgat

SEQ ID NO: 139687 - DNA, 25 bp, Mus musculus
tctctgggctttactgttgatgcac

SEQ ID NO: 139688 - DNA, 25 bp, Mus musculus
tctctgggtcaccaagctctggaag

SEQ ID NO: 139689 - DNA, 25 bp, Mus musculus
tctctgggtcacttcagggactgtc

SEQ ID NO: 139690 - DNA, 25 bp, Mus musculus
tctctgtaagacctgcaactcggct

SEQ ID NO: 139691 - DNA, 25 bp, Mus musculus
tctctgtaattggaaacacaatcag

SEQ ID NO: 139692 - DNA, 25 bp, Mus musculus
tctctgtacggatcctgggtctgcg

SEQ ID NO: 139693 - DNA, 25 bp, Mus musculus
tctctgtagtaaaaggtgggacctc

SEQ ID NO: 139694 - DNA, 25 bp, Mus musculus
tctctgtatgcggagggatctacga

SEQ ID NO: 139695 - DNA, 25 bp, Mus musculus
tctctgtcaagtactgcagtcatag

SEQ ID NO: 139696 - DNA, 25 bp, Mus musculus
tctctgtcagacagctacggctctg

SEQ ID NO: 139697 - DNA, 25 bp, Mus musculus
tctctgtcagcgtaggtaggcactc

SEQ ID NO: 139698 - DNA, 25 bp, Mus musculus
tctctgtctacgaagagcccgtggg

SEQ ID NO: 139699 - DNA, 25 bp, Mus musculus
tctctgtctgtggttggagcagcct

SEQ ID NO: 139700 - DNA, 25 bp, Mus musculus
tctctgtgaagctactgcggctgct

SEQ ID NO: 139701 - DNA, 25 bp, Mus musculus
tctctgtgaaggtcaacggcgtctc

SEQ ID NO: 139702 - DNA, 25 bp, Mus musculus
tctctgtgaagtccttggtatcatc

SEQ ID NO: 139703 - DNA, 25 bp, Mus musculus
tctctgtgcggtgtgatcggcctct

SEQ ID NO: 139704 - DNA, 25 bp, Mus musculus
tctctgtggagaacggcatgatcat

SEQ ID NO: 139705 - DNA, 25 bp, Mus musculus
tctctgtggataaggaaccgaaact

SEQ ID NO: 139706 - DNA, 25 bp, Mus musculus
tctctgtgtaacttccataactatg

SEQ ID NO: 139707 - DNA, 25 bp, Mus musculus
tctctgtgtgaagtagggcaggtcc

SEQ ID NO: 139708 - DNA, 25 bp, Mus musculus
tctctgtgtgtgtaaacaaacgtgc

SEQ ID NO: 139709 - DNA, 25 bp, Mus musculus
tctctgttggtaaaggctaggtaag

SEQ ID NO: 139710 - DNA, 25 bp, Mus musculus
tctcttaaaactccggtctggattt

SEQ ID NO: 139711 - DNA, 25 bp, Mus musculus
tctcttaagaggcacatgcagtgtc

SEQ ID NO: 139712 - DNA, 25 bp, Mus musculus
tctcttaaggaagctgcagacccat

SEQ ID NO: 139713 - DNA, 25 bp, Mus musculus
tctcttacacaccacagacgtgtgg

SEQ ID NO: 139714 - DNA, 25 bp, Mus musculus
tctcttaggcggagcggctttctgc

SEQ ID NO: 139715 - DNA, 25 bp, Mus musculus
tctcttattgatgtaaatcagtcaa

SEQ ID NO: 139716 - DNA, 25 bp, Mus musculus
tctcttcaaaagtgtggctggcctg

SEQ ID NO: 139717 - DNA, 25 bp, Mus musculus
tctcttcacgctttggccagggctc

SEQ ID NO: 139718 - DNA, 25 bp, Mus musculus
tctcttcagaagcatcaaagtgctg

SEQ ID NO: 139719 - DNA, 25 bp, Mus musculus
tctcttccagaccacaggagactgt

SEQ ID NO: 139720 - DNA, 25 bp, Mus musculus
tctcttccagcttctcgtcaagaca

SEQ ID NO: 139721 - DNA, 25 bp, Mus musculus
tctcttcccgttgaggtggcggccg

SEQ ID NO: 139722 - DNA, 25 bp, Mus musculus
tctcttcgaagagtgaccattgcct

SEQ ID NO: 139723 - DNA, 25 bp, Mus musculus
tctcttcgggcaattaacagctggc

SEQ ID NO: 139724 - DNA, 25 bp, Mus musculus
tctcttctggctgcgagtgcatcca

SEQ ID NO: 139725 - DNA, 25 bp, Mus musculus
tctcttgaatgggaaagaacacagc

SEQ ID NO: 139726 - DNA, 25 bp, Mus musculus
tctcttgagcaggacccaaatcact

SEQ ID NO: 139727 - DNA, 25 bp, Mus musculus
tctcttgcagcaactgcccaggctg

SEQ ID NO: 139728 - DNA, 25 bp, Mus musculus
tctcttggcctagaaggactgaacg

SEQ ID NO: 139729 - DNA, 25 bp, Mus musculus
tctcttgtaactgtgttggcttgct

SEQ ID NO: 139730 - DNA, 25 bp, Mus musculus
tctctttacgggaggcctcattgga

SEQ ID NO: 139731 - DNA, 25 bp, Mus musculus
tctctttcctagttatgtgacttca

SEQ ID NO: 139732 - DNA, 25 bp, Mus musculus
tctctttcgggactcaagctgccag

SEQ ID NO: 139733 - DNA, 25 bp, Mus musculus
tctctttgagcaaggtagctgggct

SEQ ID NO: 139734 - DNA, 25 bp, Mus musculus
tctctttgggaatcgtcggctgaaa

SEQ ID NO: 139735 - DNA, 25 bp, Mus musculus
tctctttgtcggaggagctcttctg

SEQ ID NO: 139736 - DNA, 25 bp, Mus musculus
tctcttttcctgaagcccttcaagg

SEQ ID NO: 139737 - DNA, 25 bp, Mus musculus
tctgaaaaaggtccagggcatcggt

SEQ ID NO: 139738 - DNA, 25 bp, Mus musculus
tctgaaaacagaggcgcggaaacca

SEQ ID NO: 139739 - DNA, 25 bp, Mus musculus
tctgaaaaccatgaggccctgtctg

SEQ ID NO: 139740 - DNA, 25 bp, Mus musculus
tctgaaaacccttgctgctgagagc

SEQ ID NO: 139741 - DNA, 25 bp, Mus musculus
tctgaaaactccactgagccttggt

SEQ ID NO: 139742 - DNA, 25 bp, Mus musculus
tctgaaaacttgagccgagagggtc

SEQ ID NO: 139743 - DNA, 25 bp, Mus musculus
tctgaaaaggaatccaaacgtgaac

SEQ ID NO: 139744 - DNA, 25 bp, Mus musculus
tctgaaaagtagagagtaatgcccc

SEQ ID NO: 139745 - DNA, 25 bp, Mus musculus
tctgaaacacatgggcctgagctcc

SEQ ID NO: 139746 - DNA, 25 bp, Mus musculus
tctgaaacactccaagatggtggca

SEQ ID NO: 139747 - DNA, 25 bp, Mus musculus
tctgaaaccagaggactagctgact

SEQ ID NO: 139748 - DNA, 25 bp, Mus musculus
tctgaaacccaagagagccgagact

SEQ ID NO: 139749 - DNA, 25 bp, Mus musculus
tctgaaacgagcaggtctgaggctg

SEQ ID NO: 139750 - DNA, 25 bp, Mus musculus
tctgaaagaaccagtggagacagct

SEQ ID NO: 139751 - DNA, 25 bp, Mus musculus
tctgaaagctggctaccatggcgtg

SEQ ID NO: 139752 - DNA, 25 bp, Mus musculus
tctgaaaggtgtgcgagattccagc

SEQ ID NO: 139753 - DNA, 25 bp, Mus musculus
tctgaaagtcccatagaaaagtgtc

SEQ ID NO: 139754 - DNA, 25 bp, Mus musculus
tctgaaagttccagcgacagcgact

SEQ ID NO: 139755 - DNA, 25 bp, Mus musculus
tctgaaatacctggctccggaagga

SEQ ID NO: 139756 - DNA, 25 bp, Mus musculus
tctgaaatcctctaccaggctatgg

SEQ ID NO: 139757 - DNA, 25 bp, Mus musculus
tctgaaatctgtgctgtgcggacaa

SEQ ID NO: 139758 - DNA, 25 bp, Mus musculus
tctgaaatggacgtccaggtgcgca

SEQ ID NO: 139759 - DNA, 25 bp, Mus musculus
tctgaacaatagaagtgccgcggcc

SEQ ID NO: 139760 - DNA, 25 bp, Mus musculus
tctgaacatcgcagctggcgtgtgg

SEQ ID NO: 139761 - DNA, 25 bp, Mus musculus
tctgaacatgatcattggagccaat

SEQ ID NO: 139762 - DNA, 25 bp, Mus musculus
tctgaacatgctcgaaaggccgtcc

SEQ ID NO: 139763 - DNA, 25 bp, Mus musculus
tctgaacgctggaaagacacctggg

SEQ ID NO: 139764 - DNA, 25 bp, Mus musculus
tctgaactccgagggctgtccacag

SEQ ID NO: 139765 - DNA, 25 bp, Mus musculus
tctgaactgggttgctctgggagcc

SEQ ID NO: 139766 - DNA, 25 bp, Mus musculus
tctgaagaaaatatgattcgtcttc

SEQ ID NO: 139767 - DNA, 25 bp, Mus musculus
tctgaagaaaatgaccagcaagcct

SEQ ID NO: 139768 - DNA, 25 bp, Mus musculus
tctgaagaaagtagcccaacagttc

SEQ ID NO: 139769 - DNA, 25 bp, Mus musculus
tctgaagaacagagttcaaagtcct

SEQ ID NO: 139770 - DNA, 25 bp, Mus musculus
tctgaagaactgtggcctgggctcc

SEQ ID NO: 139771 - DNA, 25 bp, Mus musculus
tctgaagaagcagtgtgatcgtggc

SEQ ID NO: 139772 - DNA, 25 bp, Mus musculus
tctgaagaagccgtgagctgtcact

SEQ ID NO: 139773 - DNA, 25 bp, Mus musculus
tctgaagaagctaaagtcgatcgag

SEQ ID NO: 139774 - DNA, 25 bp, Mus musculus
tctgaagacagacctacaggactgg

SEQ ID NO: 139775 - DNA, 25 bp, Mus musculus
tctgaagacattttggtaagagcct

SEQ ID NO: 139776 - DNA, 25 bp, Mus musculus
tctgaagacctggtgagacccatct

SEQ ID NO: 139777 - DNA, 25 bp, Mus musculus
tctgaagacggcagggagcatgcct

SEQ ID NO: 139778 - DNA, 25 bp, Mus musculus
tctgaagactgtcccggtgaacctc

SEQ ID NO: 139779 - DNA, 25 bp, Mus musculus
tctgaagagaagaccctgcaacctg

SEQ ID NO: 139780 - DNA, 25 bp, Mus musculus
tctgaagagcacagtcaaggacatt

SEQ ID NO: 139781 - DNA, 25 bp, Mus musculus
tctgaagagccccagctgcgcagac

SEQ ID NO: 139782 - DNA, 25 bp, Mus musculus
tctgaagagctgaaggctgcctacc

SEQ ID NO: 139783 - DNA, 25 bp, Mus musculus
tctgaagaggactcagctgaggcag

SEQ ID NO: 139784 - DNA, 25 bp, Mus musculus
tctgaagagtgatggatctttcatt

SEQ ID NO: 139785 - DNA, 25 bp, Mus musculus
tctgaagagtgcagtggagagccac

SEQ ID NO: 139786 - DNA, 25 bp, Mus musculus
tctgaagataatctggaacaagacc

SEQ ID NO: 139787 - DNA, 25 bp, Mus musculus
tctgaagatggaaaagcacacccct

SEQ ID NO: 139788 - DNA, 25 bp, Mus musculus
tctgaagatgttctcggcggacaag

SEQ ID NO: 139789 - DNA, 25 bp, Mus musculus
tctgaagattccaccaaagccctgg

SEQ ID NO: 139790 - DNA, 25 bp, Mus musculus
tctgaagcagacctaagcactcctg

SEQ ID NO: 139791 - DNA, 25 bp, Mus musculus
tctgaagccagatggagagtacacc

SEQ ID NO: 139792 - DNA, 25 bp, Mus musculus
tctgaagcgatgagagatgcctgcc

SEQ ID NO: 139793 - DNA, 25 bp, Mus musculus
tctgaagctatgctaggcacctggg

SEQ ID NO: 139794 - DNA, 25 bp, Mus musculus
tctgaagctgtactcccaagacaag

SEQ ID NO: 139795 - DNA, 25 bp, Mus musculus
tctgaaggaagcacatctgggcgca

SEQ ID NO: 139796 - DNA, 25 bp, Mus musculus
tctgaaggacgagcgattccagctg

SEQ ID NO: 139797 - DNA, 25 bp, Mus musculus
tctgaaggagcaagagtggaacacc

SEQ ID NO: 139798 - DNA, 25 bp, Mus musculus
tctgaaggagctgggaatcacaacc

SEQ ID NO: 139799 - DNA, 25 bp, Mus musculus
tctgaaggctgagtttgaccggcca

SEQ ID NO: 139800 - DNA, 25 bp, Mus musculus
tctgaaggctgtcaaaatagcaaga

SEQ ID NO: 139801 - DNA, 25 bp, Mus musculus
tctgaagggcctgagagggataccc

SEQ ID NO: 139802 - DNA, 25 bp, Mus musculus
tctgaagggtgatgctgggcctcca

SEQ ID NO: 139803 - DNA, 25 bp, Mus musculus
tctgaaggtcctgctaatccactct

SEQ ID NO: 139804 - DNA, 25 bp, Mus musculus
tctgaaggtgcatacgacgtcatcc

SEQ ID NO: 139805 - DNA, 25 bp, Mus musculus
tctgaagtacttcccaggacatggt

SEQ ID NO: 139806 - DNA, 25 bp, Mus musculus
tctgaagtatctgtacagggcctgc

SEQ ID NO: 139807 - DNA, 25 bp, Mus musculus
tctgaagtgaaaggaggagtctgca

SEQ ID NO: 139808 - DNA, 25 bp, Mus musculus
tctgaagtgacgagacctgcagcgg

SEQ ID NO: 139809 - DNA, 25 bp, Mus musculus
tctgaagtgcactgtgggagcctac

SEQ ID NO: 139810 - DNA, 25 bp, Mus musculus
tctgaagtgtaatccaaggcctgga

SEQ ID NO: 139811 - DNA, 25 bp, Mus musculus
tctgaagttagtcataggcgagcct

SEQ ID NO: 139812 - DNA, 25 bp, Mus musculus
tctgaagttcgttccttttctttgg

SEQ ID NO: 139813 - DNA, 25 bp, Mus musculus
tctgaagtttctgaagatcaaggcc

SEQ ID NO: 139814 - DNA, 25 bp, Mus musculus
tctgaataaacgtataaaaagccgc

SEQ ID NO: 139815 - DNA, 25 bp, Mus musculus
tctgaatcacagcagggcaccttga

SEQ ID NO: 139816 - DNA, 25 bp, Mus musculus
tctgaatcctagaggtggcaaagcc

SEQ ID NO: 139817 - DNA, 25 bp, Mus musculus
tctgaatcgagctcttgaagaagca

SEQ ID NO: 139818 - DNA, 25 bp, Mus musculus
tctgaatgaaactgaccttgctacc

SEQ ID NO: 139819 - DNA, 25 bp, Mus musculus
tctgaatgaagtaggaacaatgaca

SEQ ID NO: 139820 - DNA, 25 bp, Mus musculus
tctgaatgacatcctgtgatcccta

SEQ ID NO: 139821 - DNA, 25 bp, Mus musculus
tctgaatgagaattgcccctcggtc

SEQ ID NO: 139822 - DNA, 25 bp, Mus musculus
tctgaatgagagtatgcctgacccc

SEQ ID NO: 139823 - DNA, 25 bp, Mus musculus
tctgaatgagatcgagacaaggcac

SEQ ID NO: 139824 - DNA, 25 bp, Mus musculus
tctgaatgagcgtcactatggagcc

SEQ ID NO: 139825 - DNA, 25 bp, Mus musculus
tctgaatgaggtgtagcaaccaacc

SEQ ID NO: 139826 - DNA, 25 bp, Mus musculus
tctgaatgagttcacgacccacggc

SEQ ID NO: 139827 - DNA, 25 bp, Mus musculus
tctgaatgctagaggcccaacgaag

SEQ ID NO: 139828 - DNA, 25 bp, Mus musculus
tctgaatggcctgagaaatcctgag

SEQ ID NO: 139829 - DNA, 25 bp, Mus musculus
tctgaatgggcacaagcgaggcatc

SEQ ID NO: 139830 - DNA, 25 bp, Mus musculus
tctgaatgggcacagcctgagcaag

SEQ ID NO: 139831 - DNA, 25 bp, Mus musculus
tctgaatgtgatgacctgaccctcc

SEQ ID NO: 139832 - DNA, 25 bp, Mus musculus
tctgaattcctgtgatgctcggatc

SEQ ID NO: 139833 - DNA, 25 bp, Mus musculus
tctgaattggatgcgaggctcaggc

SEQ ID NO: 139834 - DNA, 25 bp, Mus musculus
tctgaattgttgagtaggttccggc

SEQ ID NO: 139835 - DNA, 25 bp, Mus musculus
tctgaatttactatggataacctgg

SEQ ID NO: 139836 - DNA, 25 bp, Mus musculus
tctgaatttgggtataaaggcctct

SEQ ID NO: 139837 - DNA, 25 bp, Mus musculus
tctgacaaaaagcagagtccgttgg

SEQ ID NO: 139838 - DNA, 25 bp, Mus musculus
tctgacaagagagagggcagcagca

SEQ ID NO: 139839 - DNA, 25 bp, Mus musculus
tctgacaagagcgacctaaaggccg

SEQ ID NO: 139840 - DNA, 25 bp, Mus musculus
tctgacaatgtgaacctgccccagg

SEQ ID NO: 139841 - DNA, 25 bp, Mus musculus
tctgacacaggattatgaagaatgg

SEQ ID NO: 139842 - DNA, 25 bp, Mus musculus
tctgacaccagactgcatgagctgc

SEQ ID NO: 139843 - DNA, 25 bp, Mus musculus
tctgacacgagctttctccggcggg

SEQ ID NO: 139844 - DNA, 25 bp, Mus musculus
tctgacactgtacactggccgtggg

SEQ ID NO: 139845 - DNA, 25 bp, Mus musculus
tctgacagactcagaggacgagtcc

SEQ ID NO: 139846 - DNA, 25 bp, Mus musculus
tctgacagaggagcagagctgacca

SEQ ID NO: 139847 - DNA, 25 bp, Mus musculus
tctgacaggcaaagatgcagccctt

SEQ ID NO: 139848 - DNA, 25 bp, Mus musculus
tctgacagtcagcaacctggaggag

SEQ ID NO: 139849 - DNA, 25 bp, Mus musculus
tctgacagtcttggacaaaggccgc

SEQ ID NO: 139850 - DNA, 25 bp, Mus musculus
tctgacatccagacagggcgtgtgc

SEQ ID NO: 139851 - DNA, 25 bp, Mus musculus
tctgacatggtacaaaacacctagc

SEQ ID NO: 139852 - DNA, 25 bp, Mus musculus
tctgacattgctgcgagggcctatg

SEQ ID NO: 139853 - DNA, 25 bp, Mus musculus
tctgacattggctccagcaaactag

SEQ ID NO: 139854 - DNA, 25 bp, Mus musculus
tctgaccaaagagctgcaaggcctt

SEQ ID NO: 139855 - DNA, 25 bp, Mus musculus
tctgaccacaggtcgcaaaggcagc

SEQ ID NO: 139856 - DNA, 25 bp, Mus musculus
tctgaccagatcgatgaaaaactcc

SEQ ID NO: 139857 - DNA, 25 bp, Mus musculus
tctgaccagggaagcagactgactt

SEQ ID NO: 139858 - DNA, 25 bp, Mus musculus
tctgaccagtggaagcgtttgcatc

SEQ ID NO: 139859 - DNA, 25 bp, Mus musculus
tctgaccatattcactgaggaccat

SEQ ID NO: 139860 - DNA, 25 bp, Mus musculus
tctgaccatctgtgaatagaaagct

SEQ ID NO: 139861 - DNA, 25 bp, Mus musculus
tctgaccccaaaataaacctggctg

SEQ ID NO: 139862 - DNA, 25 bp, Mus musculus
tctgacccggatgatgagaccagcc

SEQ ID NO: 139863 - DNA, 25 bp, Mus musculus
tctgaccctggagaccgaggctgcg

SEQ ID NO: 139864 - DNA, 25 bp, Mus musculus
tctgaccgacctgtataaggaccgg

SEQ ID NO: 139865 - DNA, 25 bp, Mus musculus
tctgaccgatgctggatgccttctt

SEQ ID NO: 139866 - DNA, 25 bp, Mus musculus
tctgaccgctggtgtgatcacaatg

SEQ ID NO: 139867 - DNA, 25 bp, Mus musculus
tctgaccggaacgtgtacccatctg

SEQ ID NO: 139868 - DNA, 25 bp, Mus musculus
tctgaccggatacttgaggaaaaca

SEQ ID NO: 139869 - DNA, 25 bp, Mus musculus
tctgaccggattagaaggcattcct

SEQ ID NO: 139870 - DNA, 25 bp, Mus musculus
tctgaccggcttgcacgattggcca

SEQ ID NO: 139871 - DNA, 25 bp, Mus musculus
tctgaccgggacgaagcagtgaaca

SEQ ID NO: 139872 - DNA, 25 bp, Mus musculus
tctgaccgggcgaggaagccaatta

SEQ ID NO: 139873 - DNA, 25 bp, Mus musculus
tctgacctaggatccctggccttgg

SEQ ID NO: 139874 - DNA, 25 bp, Mus musculus
tctgacctagtgaaaggcatctccg

SEQ ID NO: 139875 - DNA, 25 bp, Mus musculus
tctgacctctctggaaaagcctggc

SEQ ID NO: 139876 - DNA, 25 bp, Mus musculus
tctgacctctggagatttggctgcc

SEQ ID NO: 139877 - DNA, 25 bp, Mus musculus
tctgacctgataatgaataactcgg

SEQ ID NO: 139878 - DNA, 25 bp, Mus musculus
tctgacctgcaatgattatatttct

SEQ ID NO: 139879 - DNA, 25 bp, Mus musculus
tctgacctggtgaaacatctgcggg

SEQ ID NO: 139880 - DNA, 25 bp, Mus musculus
tctgacgaatcgaaggccacgtgct

SEQ ID NO: 139881 - DNA, 25 bp, Mus musculus
tctgacgacaaagttgcgccggcgt

SEQ ID NO: 139882 - DNA, 25 bp, Mus musculus
tctgacgagatgagcaccattctgg

SEQ ID NO: 139883 - DNA, 25 bp, Mus musculus
tctgacgcagggatcaagagactct

SEQ ID NO: 139884 - DNA, 25 bp, Mus musculus
tctgacgtaatcaggacatttccgt

SEQ ID NO: 139885 - DNA, 25 bp, Mus musculus
tctgacgtgattacaggaagcatac

SEQ ID NO: 139886 - DNA, 25 bp, Mus musculus
tctgacgttgggtgataaatccacc

SEQ ID NO: 139887 - DNA, 25 bp, Mus musculus
tctgactatcgcaatggaaaccact

SEQ ID NO: 139888 - DNA, 25 bp, Mus musculus
tctgactcacgggacgcttatgtaa

SEQ ID NO: 139889 - DNA, 25 bp, Mus musculus
tctgactcagaatgtgccaaaaagg

SEQ ID NO: 139890 - DNA, 25 bp, Mus musculus
tctgactcagccaacaaggaatggg

SEQ ID NO: 139891 - DNA, 25 bp, Mus musculus
tctgactgcctcaccgagaaaaggt

SEQ ID NO: 139892 - DNA, 25 bp, Mus musculus
tctgactgcggcagccgttgagggc

SEQ ID NO: 139893 - DNA, 25 bp, Mus musculus
tctgactgctcagacggcgagtcgg

SEQ ID NO: 139894 - DNA, 25 bp, Mus musculus
tctgactggatcgagcccattggag

SEQ ID NO: 139895 - DNA, 25 bp, Mus musculus
tctgactggcacgtatcgggaatgg

SEQ ID NO: 139896 - DNA, 25 bp, Mus musculus
tctgactgtcgaggcaataggaact

SEQ ID NO: 139897 - DNA, 25 bp, Mus musculus
tctgacttcgtgtgcaaaaacggcc

SEQ ID NO: 139898 - DNA, 25 bp, Mus musculus
tctgacttctgatcgctgagggtgg

SEQ ID NO: 139899 - DNA, 25 bp, Mus musculus
tctgacttgaaggacctgctgcgga

SEQ ID NO: 139900 - DNA, 25 bp, Mus musculus
tctgacttgagacccatgctgtatg

SEQ ID NO: 139901 - DNA, 25 bp, Mus musculus
tctgactttatgactgacgtccctg

SEQ ID NO: 139902 - DNA, 25 bp, Mus musculus
tctgagaacctgcaccgagtggaga

SEQ ID NO: 139903 - DNA, 25 bp, Mus musculus
tctgagaacgtgtactcgcagtggc

SEQ ID NO: 139904 - DNA, 25 bp, Mus musculus
tctgagaactgaggcacagcctggc

SEQ ID NO: 139905 - DNA, 25 bp, Mus musculus
tctgagaagaactggagcggcctct

SEQ ID NO: 139906 - DNA, 25 bp, Mus musculus
tctgagaagcagcatcaatctgcag

SEQ ID NO: 139907 - DNA, 25 bp, Mus musculus
tctgagaagcgagatgaaaactggg

SEQ ID NO: 139908 - DNA, 25 bp, Mus musculus
tctgagaaggctatgggaacacacc

SEQ ID NO: 139909 - DNA, 25 bp, Mus musculus
tctgagaatgttgcttctggtcccg

SEQ ID NO: 139910 - DNA, 25 bp, Mus musculus
tctgagacacatggcccagatggca

SEQ ID NO: 139911 - DNA, 25 bp, Mus musculus
tctgagacacccgactatgtgacac

SEQ ID NO: 139912 - DNA, 25 bp, Mus musculus
tctgagacatacctggaagcctagc

SEQ ID NO: 139913 - DNA, 25 bp, Mus musculus
tctgagaccgtggtacctgggaacc

SEQ ID NO: 139914 - DNA, 25 bp, Mus musculus
tctgagactcgtgcaggcgaacggc

SEQ ID NO: 139915 - DNA, 25 bp, Mus musculus
tctgagactctggtgcagcggaacg

SEQ ID NO: 139916 - DNA, 25 bp, Mus musculus
tctgagactggacaccaacacttcc

SEQ ID NO: 139917 - DNA, 25 bp, Mus musculus
tctgagactggtgaagctacaggca

SEQ ID NO: 139918 - DNA, 25 bp, Mus musculus
tctgagagaactgtcctggaatcct

SEQ ID NO: 139919 - DNA, 25 bp, Mus musculus
tctgagagagattaccaactgtggg

SEQ ID NO: 139920 - DNA, 25 bp, Mus musculus
tctgagagattaccgagcctgccat

SEQ ID NO: 139921 - DNA, 25 bp, Mus musculus
tctgagagcaaacaagagagggtcc

SEQ ID NO: 139922 - DNA, 25 bp, Mus musculus
tctgagagcacaaggccagaatctg

SEQ ID NO: 139923 - DNA, 25 bp, Mus musculus
tctgagagcctccaacggcaagttt

SEQ ID NO: 139924 - DNA, 25 bp, Mus musculus
tctgagagctctggaattgtaccgc

SEQ ID NO: 139925 - DNA, 25 bp, Mus musculus
tctgagaggacgattcgtaagccgg

SEQ ID NO: 139926 - DNA, 25 bp, Mus musculus
tctgagagtgatctctccggcgctt

SEQ ID NO: 139927 - DNA, 25 bp, Mus musculus
tctgagatagcaccaggcaggaatg

SEQ ID NO: 139928 - DNA, 25 bp, Mus musculus
tctgagatctgttgtccgaaaggac

SEQ ID NO: 139929 - DNA, 25 bp, Mus musculus
tctgagatgacaataggcagcatgg

SEQ ID NO: 139930 - DNA, 25 bp, Mus musculus
tctgagatgagcagcctacgccgta

SEQ ID NO: 139931 - DNA, 25 bp, Mus musculus
tctgagatgatgatgtcgagcccaa

SEQ ID NO: 139932 - DNA, 25 bp, Mus musculus
tctgagattcgactagcaaaggtgg

SEQ ID NO: 139933 - DNA, 25 bp, Mus musculus
tctgagcaaaagctgaagatcgacc

SEQ ID NO: 139934 - DNA, 25 bp, Mus musculus
tctgagcacagtccaaacgcatctg

SEQ ID NO: 139935 - DNA, 25 bp, Mus musculus
tctgagcagactgacggaagtgcgc

SEQ ID NO: 139936 - DNA, 25 bp, Mus musculus
tctgagcagactgagagcccttggt

SEQ ID NO: 139937 - DNA, 25 bp, Mus musculus
tctgagcagcgagaatacggcgtcc

SEQ ID NO: 139938 - DNA, 25 bp, Mus musculus
tctgagcagcttcacaaagggtggc

SEQ ID NO: 139939 - DNA, 25 bp, Mus musculus
tctgagcaggatctacccagctggg

SEQ ID NO: 139940 - DNA, 25 bp, Mus musculus
tctgagcagtccagcgttggtaccc

SEQ ID NO: 139941 - DNA, 25 bp, Mus musculus
tctgagcatcactcgagctgtgcgc

SEQ ID NO: 139942 - DNA, 25 bp, Mus musculus
tctgagcatcttcctgctgcgtgga

SEQ ID NO: 139943 - DNA, 25 bp, Mus musculus
tctgagccacattttacaatttaga

SEQ ID NO: 139944 - DNA, 25 bp, Mus musculus
tctgagccagccagctgttggcaat

SEQ ID NO: 139945 - DNA, 25 bp, Mus musculus
tctgagccaggcaaattacatcgcg

SEQ ID NO: 139946 - DNA, 25 bp, Mus musculus
tctgagccagtggagatcgggatcc

SEQ ID NO: 139947 - DNA, 25 bp, Mus musculus
tctgagccctgcgtggacgtgttgt

SEQ ID NO: 139948 - DNA, 25 bp, Mus musculus
tctgagccgagtacctgcggaggct

SEQ ID NO: 139949 - DNA, 25 bp, Mus musculus
tctgagccgcacatggagtggacgt

SEQ ID NO: 139950 - DNA, 25 bp, Mus musculus
tctgagccgcatgggtgctgtgcct

SEQ ID NO: 139951 - DNA, 25 bp, Mus musculus
tctgagccgtgtcagtgtcatccag

SEQ ID NO: 139952 - DNA, 25 bp, Mus musculus
tctgagcgccacagtagcacaaggc

SEQ ID NO: 139953 - DNA, 25 bp, Mus musculus
tctgagcgctagaacccggctccgg

SEQ ID NO: 139954 - DNA, 25 bp, Mus musculus
tctgagcggagagaatcaaggcctt

SEQ ID NO: 139955 - DNA, 25 bp, Mus musculus
tctgagctacatagtgtgtgtcccc

SEQ ID NO: 139956 - DNA, 25 bp, Mus musculus
tctgagctagcacccaggcgacaag

SEQ ID NO: 139957 - DNA, 25 bp, Mus musculus
tctgagctcaagaaagaacctgtgc

SEQ ID NO: 139958 - DNA, 25 bp, Mus musculus
tctgagctcaagaaggctggtttca

SEQ ID NO: 139959 - DNA, 25 bp, Mus musculus
tctgagctctaggaatgtgggtgcc

SEQ ID NO: 139960 - DNA, 25 bp, Mus musculus
tctgagctgaatagtagtgggtccc

SEQ ID NO: 139961 - DNA, 25 bp, Mus musculus
tctgagctgcaagagacttcggccg

SEQ ID NO: 139962 - DNA, 25 bp, Mus musculus
tctgagctggatgctgtagagaacc

SEQ ID NO: 139963 - DNA, 25 bp, Mus musculus
tctgagctgttcaatgactgcggcc

SEQ ID NO: 139964 - DNA, 25 bp, Mus musculus
tctgaggaaaattgggaacacccct

SEQ ID NO: 139965 - DNA, 25 bp, Mus musculus
tctgaggacaagtacccgctgatca

SEQ ID NO: 139966 - DNA, 25 bp, Mus musculus
tctgaggacatgcaacaggatgccg

SEQ ID NO: 139967 - DNA, 25 bp, Mus musculus
tctgaggaccaaggcaaagacccaa

SEQ ID NO: 139968 - DNA, 25 bp, Mus musculus
tctgaggaccagaacactctgatgg

SEQ ID NO: 139969 - DNA, 25 bp, Mus musculus
tctgaggatattccagggccactcc

SEQ ID NO: 139970 - DNA, 25 bp, Mus musculus
tctgaggatcctgtttgggtccctg

SEQ ID NO: 139971 - DNA, 25 bp, Mus musculus
tctgaggcacgtggtatcaatggag

SEQ ID NO: 139972 - DNA, 25 bp, Mus musculus
tctgaggcacttatggaagccagct

SEQ ID NO: 139973 - DNA, 25 bp, Mus musculus
tctgaggcccgaaaggtcttctaca

SEQ ID NO: 139974 - DNA, 25 bp, Mus musculus
tctgaggccttctgagtggaatcga

SEQ ID NO: 139975 - DNA, 25 bp, Mus musculus
tctgaggcgcagtccacaggtgttt

SEQ ID NO: 139976 - DNA, 25 bp, Mus musculus
tctgaggctgacaccttaaagagca

SEQ ID NO: 139977 - DNA, 25 bp, Mus musculus
tctgaggctggtctaaaagtgtctg

SEQ ID NO: 139978 - DNA, 25 bp, Mus musculus
tctgagggaagacctgaagttctac

SEQ ID NO: 139979 - DNA, 25 bp, Mus musculus
tctgagggacgctatgactacgacc

SEQ ID NO: 139980 - DNA, 25 bp, Mus musculus
tctgagggcagcttccagcattgct

SEQ ID NO: 139981 - DNA, 25 bp, Mus musculus
tctgagggcatacaaacaggatgat

SEQ ID NO: 139982 - DNA, 25 bp, Mus musculus
tctgagggccacctactttgggagc

SEQ ID NO: 139983 - DNA, 25 bp, Mus musculus
tctgagggtcaggatggccaagcat

SEQ ID NO: 139984 - DNA, 25 bp, Mus musculus
tctgaggtcaagacagcgtggagca

SEQ ID NO: 139985 - DNA, 25 bp, Mus musculus
tctgaggttgttggcccgagaagca

SEQ ID NO: 139986 - DNA, 25 bp, Mus musculus
tctgagtagcgtgctaataaagctc

SEQ ID NO: 139987 - DNA, 25 bp, Mus musculus
tctgagtatctacggcaggctgcat

SEQ ID NO: 139988 - DNA, 25 bp, Mus musculus
tctgagtatgagaaacccgaggccc

SEQ ID NO: 139989 - DNA, 25 bp, Mus musculus
tctgagtcagaaggagctgctccca

SEQ ID NO: 139990 - DNA, 25 bp, Mus musculus
tctgagtccacagaggcaccaggtg

SEQ ID NO: 139991 - DNA, 25 bp, Mus musculus
tctgagtccagtgcagaaacgggtt

SEQ ID NO: 139992 - DNA, 25 bp, Mus musculus
tctgagtctgagtctaagcctcatc

SEQ ID NO: 139993 - DNA, 25 bp, Mus musculus
tctgagtgaacaaattgccgacgcc

SEQ ID NO: 139994 - DNA, 25 bp, Mus musculus
tctgagtgactcaatagctaagggt

SEQ ID NO: 139995 - DNA, 25 bp, Mus musculus
tctgagtgatatgcaggtctgcctc

SEQ ID NO: 139996 - DNA, 25 bp, Mus musculus
tctgagtggctacctgatcgagacc

SEQ ID NO: 139997 - DNA, 25 bp, Mus musculus
tctgagtgtctttcccatggctggg

SEQ ID NO: 139998 - DNA, 25 bp, Mus musculus
tctgagttcttcctagctggccacc

SEQ ID NO: 139999 - DNA, 25 bp, Mus musculus
tctgagttgcctgatccgcgtgggt

SEQ ID NO: 140000 - DNA, 25 bp, Mus musculus
tctgataagccggagagggaactct

SEQ ID NO: 140001 - DNA, 25 bp, Mus musculus
tctgatcaaaaggtcggaggagcca

SEQ ID NO: 140002 - DNA, 25 bp, Mus musculus
tctgatcaccaaagacgaaggccca

SEQ ID NO: 140003 - DNA, 25 bp, Mus musculus
tctgatcagactgcgttatatattc

SEQ ID NO: 140004 - DNA, 25 bp, Mus musculus
tctgatcaggataacgacggcactc

SEQ ID NO: 140005 - DNA, 25 bp, Mus musculus
tctgatccagctctacaaaggcaag

SEQ ID NO: 140006 - DNA, 25 bp, Mus musculus
tctgatcccagaggaagccgagtca

SEQ ID NO: 140007 - DNA, 25 bp, Mus musculus
tctgatccgaaaacatgaggccttt

SEQ ID NO: 140008 - DNA, 25 bp, Mus musculus
tctgatcgaaggacgatacggtgcc

SEQ ID NO: 140009 - DNA, 25 bp, Mus musculus
tctgatcgagcagagtacctgggct

SEQ ID NO: 140010 - DNA, 25 bp, Mus musculus
tctgatcgctgtgactttgtcagga

SEQ ID NO: 140011 - DNA, 25 bp, Mus musculus
tctgatctgggtaagtgtgtctggc

SEQ ID NO: 140012 - DNA, 25 bp, Mus musculus
tctgatgaaactgatgggtactgct

SEQ ID NO: 140013 - DNA, 25 bp, Mus musculus
tctgatgaagcaggagcccaacctt

SEQ ID NO: 140014 - DNA, 25 bp, Mus musculus
tctgatgaatctgagccaaatgtgc

SEQ ID NO: 140015 - DNA, 25 bp, Mus musculus
tctgatgaatgaggaaccacagctg

SEQ ID NO: 140016 - DNA, 25 bp, Mus musculus
tctgatgaccaacgagctgctggct

SEQ ID NO: 140017 - DNA, 25 bp, Mus musculus
tctgatgaggtgcttgtcccagcca

SEQ ID NO: 140018 - DNA, 25 bp, Mus musculus
tctgatgataacctagacagtccgg

SEQ ID NO: 140019 - DNA, 25 bp, Mus musculus
tctgatgcacctaaggaaagtcacc

SEQ ID NO: 140020 - DNA, 25 bp, Mus musculus
tctgatgccaatgccatcgctgggt

SEQ ID NO: 140021 - DNA, 25 bp, Mus musculus
tctgatgccacaaaagccagcgagg

SEQ ID NO: 140022 - DNA, 25 bp, Mus musculus
tctgatgcctgtgccaatgaaacgg

SEQ ID NO: 140023 - DNA, 25 bp, Mus musculus
tctgatgctaacgttctgactaacg

SEQ ID NO: 140024 - DNA, 25 bp, Mus musculus
tctgatgctcctctagaagaagcga

SEQ ID NO: 140025 - DNA, 25 bp, Mus musculus
tctgatgctctctcacgacttgaag

SEQ ID NO: 140026 - DNA, 25 bp, Mus musculus
tctgatgctgcttttgaagacccat

SEQ ID NO: 140027 - DNA, 25 bp, Mus musculus
tctgatggactgtcactggcagccc

SEQ ID NO: 140028 - DNA, 25 bp, Mus musculus
tctgatggatgcaaccgctagacct

SEQ ID NO: 140029 - DNA, 25 bp, Mus musculus
tctgatggcagtgagaactttaaca

SEQ ID NO: 140030 - DNA, 25 bp, Mus musculus
tctgatggcgggacgtgctgtcctc

SEQ ID NO: 140031 - DNA, 25 bp, Mus musculus
tctgatggctacatgtgcaaaacac

SEQ ID NO: 140032 - DNA, 25 bp, Mus musculus
tctgatgggaggacgtcttctggct

SEQ ID NO: 140033 - DNA, 25 bp, Mus musculus
tctgatgtctcttacaacaggaagc

SEQ ID NO: 140034 - DNA, 25 bp, Mus musculus
tctgatgttctttcatttcaccaag

SEQ ID NO: 140035 - DNA, 25 bp, Mus musculus
tctgattatcaggtgcacttgggag

SEQ ID NO: 140036 - DNA, 25 bp, Mus musculus
tctgattccagagggtgctgtgcgc

SEQ ID NO: 140037 - DNA, 25 bp, Mus musculus
tctgattctcgctctgtcgacggca

SEQ ID NO: 140038 - DNA, 25 bp, Mus musculus
tctgattggcatagaccacagcgca

SEQ ID NO: 140039 - DNA, 25 bp, Mus musculus
tctgatttgggaggaaagcagcccc

SEQ ID NO: 140040 - DNA, 25 bp, Mus musculus
tctgatttgggcatgttacactgaa

SEQ ID NO: 140041 - DNA, 25 bp, Mus musculus
tctgcaaacaggtaagaaacatgcc

SEQ ID NO: 140042 - DNA, 25 bp, Mus musculus
tctgcaaagaggagcttagacctgc

SEQ ID NO: 140043 - DNA, 25 bp, Mus musculus
tctgcaaagggatgctccacacgtg

SEQ ID NO: 140044 - DNA, 25 bp, Mus musculus
tctgcaaataatggcgatgccccag

SEQ ID NO: 140045 - DNA, 25 bp, Mus musculus
tctgcaacagggaggccatgaggaa

SEQ ID NO: 140046 - DNA, 25 bp, Mus musculus
tctgcaacgtgcaaagaatgcggtt

SEQ ID NO: 140047 - DNA, 25 bp, Mus musculus
tctgcaactgcgagcacagtggaaa

SEQ ID NO: 140048 - DNA, 25 bp, Mus musculus
tctgcaagaaaaggtgagacttggg

SEQ ID NO: 140049 - DNA, 25 bp, Mus musculus
tctgcaagaaatggctcaggagcaa

SEQ ID NO: 140050 - DNA, 25 bp, Mus musculus
tctgcaagaactgaccatgcggagt

SEQ ID NO: 140051 - DNA, 25 bp, Mus musculus
tctgcaagaaggactactgggcccg

SEQ ID NO: 140052 - DNA, 25 bp, Mus musculus
tctgcaagactcatcgacaaggcct

SEQ ID NO: 140053 - DNA, 25 bp, Mus musculus
tctgcaagagtcagggctgaaatac

SEQ ID NO: 140054 - DNA, 25 bp, Mus musculus
tctgcaagatttccacctgctgggc

SEQ ID NO: 140055 - DNA, 25 bp, Mus musculus
tctgcaagcaccagggaggcctgtt

SEQ ID NO: 140056 - DNA, 25 bp, Mus musculus
tctgcaagctccatccactaaagag

SEQ ID NO: 140057 - DNA, 25 bp, Mus musculus
tctgcaaggaagcacaggacactct

SEQ ID NO: 140058 - DNA, 25 bp, Mus musculus
tctgcaaggattggagcaacctggc

SEQ ID NO: 140059 - DNA, 25 bp, Mus musculus
tctgcaatcctgcttcttgtggcca

SEQ ID NO: 140060 - DNA, 25 bp, Mus musculus
tctgcacaaggaggaacgctatgac

SEQ ID NO: 140061 - DNA, 25 bp, Mus musculus
tctgcacacggacaggatggactgc

SEQ ID NO: 140062 - DNA, 25 bp, Mus musculus
tctgcacagacattcagagtgccta

SEQ ID NO: 140063 - DNA, 25 bp, Mus musculus
tctgcacagaggcaggtttttcctg

SEQ ID NO: 140064 - DNA, 25 bp, Mus musculus
tctgcacagcagtgagggaaatcca

SEQ ID NO: 140065 - DNA, 25 bp, Mus musculus
tctgcacagcttccgacgaggcagg

SEQ ID NO: 140066 - DNA, 25 bp, Mus musculus
tctgcacagttaggaggagcaccaa

SEQ ID NO: 140067 - DNA, 25 bp, Mus musculus
tctgcaccaaggagagctacgacta

SEQ ID NO: 140068 - DNA, 25 bp, Mus musculus
tctgcacccagcattaccaggtggg

SEQ ID NO: 140069 - DNA, 25 bp, Mus musculus
tctgcaccgcctagaagaggaactg

SEQ ID NO: 140070 - DNA, 25 bp, Mus musculus
tctgcaccgcttacaggaagcttgt

SEQ ID NO: 140071 - DNA, 25 bp, Mus musculus
tctgcaccgtgctcagggaaatggc

SEQ ID NO: 140072 - DNA, 25 bp, Mus musculus
tctgcacctgtactacggcgcgatg

SEQ ID NO: 140073 - DNA, 25 bp, Mus musculus
tctgcacctgtagctgctgaaccat

SEQ ID NO: 140074 - DNA, 25 bp, Mus musculus
tctgcacgaactagaaactgggcat

SEQ ID NO: 140075 - DNA, 25 bp, Mus musculus
tctgcacgaagctgcctctatgggc

SEQ ID NO: 140076 - DNA, 25 bp, Mus musculus
tctgcacgatgaagtcctgaacctg

SEQ ID NO: 140077 - DNA, 25 bp, Mus musculus
tctgcacgtgtccagtgttgcatca

SEQ ID NO: 140078 - DNA, 25 bp, Mus musculus
tctgcactagggaatctgacccact

SEQ ID NO: 140079 - DNA, 25 bp, Mus musculus
tctgcactcacaagcgaagggaagg

SEQ ID NO: 140080 - DNA, 25 bp, Mus musculus
tctgcactctgctacaggaaccagt

SEQ ID NO: 140081 - DNA, 25 bp, Mus musculus
tctgcactgcgaggccacttttctt

SEQ ID NO: 140082 - DNA, 25 bp, Mus musculus
tctgcactggctccacatgctggga

SEQ ID NO: 140083 - DNA, 25 bp, Mus musculus
tctgcagaaacatcgacatccctgg

SEQ ID NO: 140084 - DNA, 25 bp, Mus musculus
tctgcagaacatgaccaggaagtct

SEQ ID NO: 140085 - DNA, 25 bp, Mus musculus
tctgcagaactgaacttgggcccta

SEQ ID NO: 140086 - DNA, 25 bp, Mus musculus
tctgcagactacatcggaggaagtc

SEQ ID NO: 140087 - DNA, 25 bp, Mus musculus
tctgcagactcagtaagcacaagtg

SEQ ID NO: 140088 - DNA, 25 bp, Mus musculus
tctgcagagaatgttctgcaccctc

SEQ ID NO: 140089 - DNA, 25 bp, Mus musculus
tctgcagagcgggaaatagctgact

SEQ ID NO: 140090 - DNA, 25 bp, Mus musculus
tctgcagaggatcttcaggctctcc

SEQ ID NO: 140091 - DNA, 25 bp, Mus musculus
tctgcagaggtgattcgggagtcca

SEQ ID NO: 140092 - DNA, 25 bp, Mus musculus
tctgcagagttcacttagaaggccc

SEQ ID NO: 140093 - DNA, 25 bp, Mus musculus
tctgcagatcgaaggcatgaagatc

SEQ ID NO: 140094 - DNA, 25 bp, Mus musculus
tctgcagatttcactcggccagcct

SEQ ID NO: 140095 - DNA, 25 bp, Mus musculus
tctgcagcagaaccaaagtgacttg

SEQ ID NO: 140096 - DNA, 25 bp, Mus musculus
tctgcagccagactacagtgaacgg

SEQ ID NO: 140097 - DNA, 25 bp, Mus musculus
tctgcagcctgatataatgaattta

SEQ ID NO: 140098 - DNA, 25 bp, Mus musculus
tctgcagcgatgtcataaggagtca

SEQ ID NO: 140099 - DNA, 25 bp, Mus musculus
tctgcagcgattgctgtgggtccgt

SEQ ID NO: 140100 - DNA, 25 bp, Mus musculus
tctgcagcgcaaaatcaacatgtgt

SEQ ID NO: 140101 - DNA, 25 bp, Mus musculus
tctgcagctaggaatgatgtgaggc

SEQ ID NO: 140102 - DNA, 25 bp, Mus musculus
tctgcaggactaccgtgcttcggga

SEQ ID NO: 140103 - DNA, 25 bp, Mus musculus
tctgcaggactgtatgcacacgagc

SEQ ID NO: 140104 - DNA, 25 bp, Mus musculus
tctgcaggagccctttaagaatgct

SEQ ID NO: 140105 - DNA, 25 bp, Mus musculus
tctgcaggagcgagaaggctactct

SEQ ID NO: 140106 - DNA, 25 bp, Mus musculus
tctgcaggcagaggtgctgtgactt

SEQ ID NO: 140107 - DNA, 25 bp, Mus musculus
tctgcaggcatccacaaaggtagct

SEQ ID NO: 140108 - DNA, 25 bp, Mus musculus
tctgcaggctgggtcatccccattg

SEQ ID NO: 140109 - DNA, 25 bp, Mus musculus
tctgcagggaaagatctctctactt

SEQ ID NO: 140110 - DNA, 25 bp, Mus musculus
tctgcagggatcgttaggccagcta

SEQ ID NO: 140111 - DNA, 25 bp, Mus musculus
tctgcagggcgttcatcttctaggg

SEQ ID NO: 140112 - DNA, 25 bp, Mus musculus
tctgcaggtgaggaagactcccagg

SEQ ID NO: 140113 - DNA, 25 bp, Mus musculus
tctgcaggtggcataccgggaaacc

SEQ ID NO: 140114 - DNA, 25 bp, Mus musculus
tctgcaggttgctatgttaatgctg

SEQ ID NO: 140115 - DNA, 25 bp, Mus musculus
tctgcagtacgatgagagggtgatc

SEQ ID NO: 140116 - DNA, 25 bp, Mus musculus
tctgcagtcgtcaggctcacaggtg

SEQ ID NO: 140117 - DNA, 25 bp, Mus musculus
tctgcagtggaaacagcaggccttt

SEQ ID NO: 140118 - DNA, 25 bp, Mus musculus
tctgcagtggcacccagacaagaac

SEQ ID NO: 140119 - DNA, 25 bp, Mus musculus
tctgcagtgggtccaggtatctgac

SEQ ID NO: 140120 - DNA, 25 bp, Mus musculus
tctgcagtgtggagatgcccgacat

SEQ ID NO: 140121 - DNA, 25 bp, Mus musculus
tctgcatacatgttacggctgccac

SEQ ID NO: 140122 - DNA, 25 bp, Mus musculus
tctgcataccaggacggagaactgc

SEQ ID NO: 140123 - DNA, 25 bp, Mus musculus
tctgcatatgtggagcacacccggg

SEQ ID NO: 140124 - DNA, 25 bp, Mus musculus
tctgcatcatggatctagagcctca

SEQ ID NO: 140125 - DNA, 25 bp, Mus musculus
tctgcatcggaaaagagctgctcac

SEQ ID NO: 140126 - DNA, 25 bp, Mus musculus
tctgcatcgtcatcttcgtaggcct

SEQ ID NO: 140127 - DNA, 25 bp, Mus musculus
tctgcatctggctcagagaaaggaa

SEQ ID NO: 140128 - DNA, 25 bp, Mus musculus
tctgcatgagcatccggagaggcag

SEQ ID NO: 140129 - DNA, 25 bp, Mus musculus
tctgcatgcagacttgagaagccct

SEQ ID NO: 140130 - DNA, 25 bp, Mus musculus
tctgcatgctgtcattgtcttcaag

SEQ ID NO: 140131 - DNA, 25 bp, Mus musculus
tctgcatggtggcactggtcctgct

SEQ ID NO: 140132 - DNA, 25 bp, Mus musculus
tctgcatgtcaagggtgtggctacc

SEQ ID NO: 140133 - DNA, 25 bp, Mus musculus
tctgcattcaaactaggctgaacaa

SEQ ID NO: 140134 - DNA, 25 bp, Mus musculus
tctgcattctgatgacaacgaggag

SEQ ID NO: 140135 - DNA, 25 bp, Mus musculus
tctgcattttggaccagtggtgccc

SEQ ID NO: 140136 - DNA, 25 bp, Mus musculus
tctgccaaagaagtatgcacaccag

SEQ ID NO: 140137 - DNA, 25 bp, Mus musculus
tctgccaagcgctccaaggaggagt

SEQ ID NO: 140138 - DNA, 25 bp, Mus musculus
tctgccaaggaggttctcagcgcca

SEQ ID NO: 140139 - DNA, 25 bp, Mus musculus
tctgccagagctgccgaaagagcat

SEQ ID NO: 140140 - DNA, 25 bp, Mus musculus
tctgccagcaccttgggaagagaaa

SEQ ID NO: 140141 - DNA, 25 bp, Mus musculus
tctgccagcagggagacgtaaagct

SEQ ID NO: 140142 - DNA, 25 bp, Mus musculus
tctgccagccgcttcagtaggtggt

SEQ ID NO: 140143 - DNA, 25 bp, Mus musculus
tctgccaggaagtcacgctgaacaa

SEQ ID NO: 140144 - DNA, 25 bp, Mus musculus
tctgccaggagaatacagggtccct

SEQ ID NO: 140145 - DNA, 25 bp, Mus musculus
tctgccatccgaaggtcagggagca

SEQ ID NO: 140146 - DNA, 25 bp, Mus musculus
tctgccatcctgattttataagtgg

SEQ ID NO: 140147 - DNA, 25 bp, Mus musculus
tctgccatgagggacacgaataata

SEQ ID NO: 140148 - DNA, 25 bp, Mus musculus
tctgccatgcaaaacgagggagcgt

SEQ ID NO: 140149 - DNA, 25 bp, Mus musculus
tctgccatgctagtgagcccagggc

SEQ ID NO: 140150 - DNA, 25 bp, Mus musculus
tctgccattataaaggaagtctgtg

SEQ ID NO: 140151 - DNA, 25 bp, Mus musculus
tctgcccaatgaggacgataaattc

SEQ ID NO: 140152 - DNA, 25 bp, Mus musculus
tctgcccacagcaatgatggaccac

SEQ ID NO: 140153 - DNA, 25 bp, Mus musculus
tctgcccaccctcatgtcagtgatg

SEQ ID NO: 140154 - DNA, 25 bp, Mus musculus
tctgcccaggactgcatgagtttcc

SEQ ID NO: 140155 - DNA, 25 bp, Mus musculus
tctgcccagggcttgaaaagctgtt

SEQ ID NO: 140156 - DNA, 25 bp, Mus musculus
tctgcccagtgaccggcaggctttg

SEQ ID NO: 140157 - DNA, 25 bp, Mus musculus
tctgccccaggatgagctcaaagag

SEQ ID NO: 140158 - DNA, 25 bp, Mus musculus
tctgccccgcgaaaggagctgatgt

SEQ ID NO: 140159 - DNA, 25 bp, Mus musculus
tctgccccgcttgtgacctgaatgg

SEQ ID NO: 140160 - DNA, 25 bp, Mus musculus
tctgcccgaggtcgtggccaagtac

SEQ ID NO: 140161 - DNA, 25 bp, Mus musculus
tctgccgaaagaagcacagaagctc

SEQ ID NO: 140162 - DNA, 25 bp, Mus musculus
tctgccgaaggaagatggcgcatac

SEQ ID NO: 140163 - DNA, 25 bp, Mus musculus
tctgccgactagtacagcggtgacg

SEQ ID NO: 140164 - DNA, 25 bp, Mus musculus
tctgccgatcttgcattgcgaccag

SEQ ID NO: 140165 - DNA, 25 bp, Mus musculus
tctgccgcagcagcgtcttttagaa

SEQ ID NO: 140166 - DNA, 25 bp, Mus musculus
tctgccgcagcgtcgggcacgtcct

SEQ ID NO: 140167 - DNA, 25 bp, Mus musculus
tctgccgctcagacgatcacgtggt

SEQ ID NO: 140168 - DNA, 25 bp, Mus musculus
tctgccgctgttttcaatgtagtca

SEQ ID NO: 140169 - DNA, 25 bp, Mus musculus
tctgccggaaaagcgccatcattga

SEQ ID NO: 140170 - DNA, 25 bp, Mus musculus
tctgccggcctgacgcatgcactgg

SEQ ID NO: 140171 - DNA, 25 bp, Mus musculus
tctgccgggtagagttacgctccgc

SEQ ID NO: 140172 - DNA, 25 bp, Mus musculus
tctgccgtgcccatttacaaaggct

SEQ ID NO: 140173 - DNA, 25 bp, Mus musculus
tctgccgtttcaaggaaaagtgaac

SEQ ID NO: 140174 - DNA, 25 bp, Mus musculus
tctgcctacaaaagtcatttccgga

SEQ ID NO: 140175 - DNA, 25 bp, Mus musculus
tctgcctacagatggaatgatccgg

SEQ ID NO: 140176 - DNA, 25 bp, Mus musculus
tctgcctagagaaaggagcggccct

SEQ ID NO: 140177 - DNA, 25 bp, Mus musculus
tctgcctccggaagcggcagagtca

SEQ ID NO: 140178 - DNA, 25 bp, Mus musculus
tctgcctcctgacgtttggaacggc

SEQ ID NO: 140179 - DNA, 25 bp, Mus musculus
tctgcctcggagacgtggataacga

SEQ ID NO: 140180 - DNA, 25 bp, Mus musculus
tctgcctctgggagagtgtgcctcc

SEQ ID NO: 140181 - DNA, 25 bp, Mus musculus
tctgcctgacatgtgcctggagtgt

SEQ ID NO: 140182 - DNA, 25 bp, Mus musculus
tctgcctgagcatccgggacaaaag

SEQ ID NO: 140183 - DNA, 25 bp, Mus musculus
tctgcctgaggtgaagacgcttgct

SEQ ID NO: 140184 - DNA, 25 bp, Mus musculus
tctgcctgcaggattgggactccca

SEQ ID NO: 140185 - DNA, 25 bp, Mus musculus
tctgcctgcagtacaaaaacaccta

SEQ ID NO: 140186 - DNA, 25 bp, Mus musculus
tctgcctgcgcatgtatgtttcacg

SEQ ID NO: 140187 - DNA, 25 bp, Mus musculus
tctgcctggaatgtggcgaagacta

SEQ ID NO: 140188 - DNA, 25 bp, Mus musculus
tctgcctggatgtgaagctattgga

SEQ ID NO: 140189 - DNA, 25 bp, Mus musculus
tctgcctgtcgcatgagaccattaa

SEQ ID NO: 140190 - DNA, 25 bp, Mus musculus
tctgcctgtggggacggaggagcgc

SEQ ID NO: 140191 - DNA, 25 bp, Mus musculus
tctgcctgtttgcttgaacctggag

SEQ ID NO: 140192 - DNA, 25 bp, Mus musculus
tctgccttagacatgactcggtact

SEQ ID NO: 140193 - DNA, 25 bp, Mus musculus
tctgccttagcaagaaagaagttgg

SEQ ID NO: 140194 - DNA, 25 bp, Mus musculus
tctgccttatcctctttggagagtg

SEQ ID NO: 140195 - DNA, 25 bp, Mus musculus
tctgccttcatctggagagttctcg

SEQ ID NO: 140196 - DNA, 25 bp, Mus musculus
tctgccttcctcacggacagctttg

SEQ ID NO: 140197 - DNA, 25 bp, Mus musculus
tctgcgaaccttgaggactgctctc

SEQ ID NO: 140198 - DNA, 25 bp, Mus musculus
tctgcgaatcacagctcgggaggca

SEQ ID NO: 140199 - DNA, 25 bp, Mus musculus
tctgcgaccctactgtagcgagccg

SEQ ID NO: 140200 - DNA, 25 bp, Mus musculus
tctgcgacggagcatctgagctgca

SEQ ID NO: 140201 - DNA, 25 bp, Mus musculus
tctgcgagcctgtgtcaccgagtga

SEQ ID NO: 140202 - DNA, 25 bp, Mus musculus
tctgcgagccttcagtaaaatcttt

SEQ ID NO: 140203 - DNA, 25 bp, Mus musculus
tctgcgagtccttgcaagcttgacc

SEQ ID NO: 140204 - DNA, 25 bp, Mus musculus
tctgcgatgaggtcaccaagtacga

SEQ ID NO: 140205 - DNA, 25 bp, Mus musculus
tctgcgatgtcaaaaatcctcctga

SEQ ID NO: 140206 - DNA, 25 bp, Mus musculus
tctgcgcaagagttcctcaagcctt

SEQ ID NO: 140207 - DNA, 25 bp, Mus musculus
tctgcgcaggcgcacttccaacgtt

SEQ ID NO: 140208 - DNA, 25 bp, Mus musculus
tctgcgcatgcgtgactggctcaaa

SEQ ID NO: 140209 - DNA, 25 bp, Mus musculus
tctgcgccactgactacacggaaga

SEQ ID NO: 140210 - DNA, 25 bp, Mus musculus
tctgcgccgaagagaagagcaacga

SEQ ID NO: 140211 - DNA, 25 bp, Mus musculus
tctgcgctccacaagagcatagagg

SEQ ID NO: 140212 - DNA, 25 bp, Mus musculus
tctgcgctctccgtctgaaaacttg

SEQ ID NO: 140213 - DNA, 25 bp, Mus musculus
tctgcgctgctagtctgagcgagcg

SEQ ID NO: 140214 - DNA, 25 bp, Mus musculus
tctgcggaccgggagcttttgacct

SEQ ID NO: 140215 - DNA, 25 bp, Mus musculus
tctgcggacttaaaaggcaccgtct

SEQ ID NO: 140216 - DNA, 25 bp, Mus musculus
tctgcggagaaatgggacacctgtc

SEQ ID NO: 140217 - DNA, 25 bp, Mus musculus
tctgcggagcgctatgacaagcttc

SEQ ID NO: 140218 - DNA, 25 bp, Mus musculus
tctgcggaggctcaagtacaagcac

SEQ ID NO: 140219 - DNA, 25 bp, Mus musculus
tctgcggcagcagaggatacacggt

SEQ ID NO: 140220 - DNA, 25 bp, Mus musculus
tctgcggcctctcctggtgaagaag

SEQ ID NO: 140221 - DNA, 25 bp, Mus musculus
tctgcggcctgaaagcaaagccttg

SEQ ID NO: 140222 - DNA, 25 bp, Mus musculus
tctgcggcgttctcaaagttcggac

SEQ ID NO: 140223 - DNA, 25 bp, Mus musculus
tctgcggctgacagagaaggttccc

SEQ ID NO: 140224 - DNA, 25 bp, Mus musculus
tctgcggtagacaaggtgatcctgt

SEQ ID NO: 140225 - DNA, 25 bp, Mus musculus
tctgcggtagcatcagggctcacga

SEQ ID NO: 140226 - DNA, 25 bp, Mus musculus
tctgcggtgactactaagatcccag

SEQ ID NO: 140227 - DNA, 25 bp, Mus musculus
tctgcgtccactctccagagaagtc

SEQ ID NO: 140228 - DNA, 25 bp, Mus musculus
tctgcgtctgcaaaggtgtcctgga

SEQ ID NO: 140229 - DNA, 25 bp, Mus musculus
tctgcgtggctcttggatgtgacat

SEQ ID NO: 140230 - DNA, 25 bp, Mus musculus
tctgcgtgggctcatgaagagctac

SEQ ID NO: 140231 - DNA, 25 bp, Mus musculus
tctgcgttgctgtcatggctgcctc

SEQ ID NO: 140232 - DNA, 25 bp, Mus musculus
tctgctaaggccgagagtgacaacc

SEQ ID NO: 140233 - DNA, 25 bp, Mus musculus
tctgctaatgggactgaggagccag

SEQ ID NO: 140234 - DNA, 25 bp, Mus musculus
tctgctaattgtttaccgttttgaa

SEQ ID NO: 140235 - DNA, 25 bp, Mus musculus
tctgctacagcctcatgattcgacg

SEQ ID NO: 140236 - DNA, 25 bp, Mus musculus
tctgctacaggaaccagtgaaccct

SEQ ID NO: 140237 - DNA, 25 bp, Mus musculus
tctgctacctcaataaataacaggc

SEQ ID NO: 140238 - DNA, 25 bp, Mus musculus
tctgctacctggacatgctgatgac

SEQ ID NO: 140239 - DNA, 25 bp, Mus musculus
tctgctacctggctggctgtttgga

SEQ ID NO: 140240 - DNA, 25 bp, Mus musculus
tctgctactctggattaagaatcgc

SEQ ID NO: 140241 - DNA, 25 bp, Mus musculus
tctgctagctttggatcccggtgat

SEQ ID NO: 140242 - DNA, 25 bp, Mus musculus
tctgctataacctacagaccgtggg

SEQ ID NO: 140243 - DNA, 25 bp, Mus musculus
tctgctatacattcggcctgagggc

SEQ ID NO: 140244 - DNA, 25 bp, Mus musculus
tctgctatctttgggcaatctgggc

SEQ ID NO: 140245 - DNA, 25 bp, Mus musculus
tctgctatgaggcttaactgctgtc

SEQ ID NO: 140246 - DNA, 25 bp, Mus musculus
tctgctatgatatgcgcttcgcgga

SEQ ID NO: 140247 - DNA, 25 bp, Mus musculus
tctgctatgctgttctccagtgtgg

SEQ ID NO: 140248 - DNA, 25 bp, Mus musculus
tctgctatggttaggtggcccacag

SEQ ID NO: 140249 - DNA, 25 bp, Mus musculus
tctgctcaaggatgaaggcctgttc

SEQ ID NO: 140250 - DNA, 25 bp, Mus musculus
tctgctcaagtctcatgccagtggg

SEQ ID NO: 140251 - DNA, 25 bp, Mus musculus
tctgctcaatgcacaagagggctgg

SEQ ID NO: 140252 - DNA, 25 bp, Mus musculus
tctgctccacctctgtaagacgagg

SEQ ID NO: 140253 - DNA, 25 bp, Mus musculus
tctgctccagacagatgcagtcttg

SEQ ID NO: 140254 - DNA, 25 bp, Mus musculus
tctgctcccagacaagctaggtgca

SEQ ID NO: 140255 - DNA, 25 bp, Mus musculus
tctgctcccggctagaaagtgcgct

SEQ ID NO: 140256 - DNA, 25 bp, Mus musculus
tctgctcgcttagaagacccagggc

SEQ ID NO: 140257 - DNA, 25 bp, Mus musculus
tctgctcggcagacatgggatctca

SEQ ID NO: 140258 - DNA, 25 bp, Mus musculus
tctgctcgttgagtgaagaaaatcc

SEQ ID NO: 140259 - DNA, 25 bp, Mus musculus
tctgctctaggtttttagccgcttg

SEQ ID NO: 140260 - DNA, 25 bp, Mus musculus
tctgctctcagataccgaaatggac

SEQ ID NO: 140261 - DNA, 25 bp, Mus musculus
tctgctctgctagaaaggcttgaag

SEQ ID NO: 140262 - DNA, 25 bp, Mus musculus
tctgctctggaagagtccacagtgt

SEQ ID NO: 140263 - DNA, 25 bp, Mus musculus
tctgctgaaacagggtgagggcttt

SEQ ID NO: 140264 - DNA, 25 bp, Mus musculus
tctgctgacggcttcctgaggagac

SEQ ID NO: 140265 - DNA, 25 bp, Mus musculus
tctgctgagaagagaaacgtgactc

SEQ ID NO: 140266 - DNA, 25 bp, Mus musculus
tctgctgcaagtagcctcgccgtcg

SEQ ID NO: 140267 - DNA, 25 bp, Mus musculus
tctgctgcaattggacctcatcgaa

SEQ ID NO: 140268 - DNA, 25 bp, Mus musculus
tctgctgcagaagttcacgtgatgt

SEQ ID NO: 140269 - DNA, 25 bp, Mus musculus
tctgctgcccgctgaagcaagtgca

SEQ ID NO: 140270 - DNA, 25 bp, Mus musculus
tctgctgccttaaggatgacagtcc

SEQ ID NO: 140271 - DNA, 25 bp, Mus musculus
tctgctgcttccaaggcccttctaa

SEQ ID NO: 140272 - DNA, 25 bp, Mus musculus
tctgctgctttgcaaggaaggctcc

SEQ ID NO: 140273 - DNA, 25 bp, Mus musculus
tctgctgctttgttgtacacaagcg

SEQ ID NO: 140274 - DNA, 25 bp, Mus musculus
tctgctggagatggacgaggccaaa

SEQ ID NO: 140275 - DNA, 25 bp, Mus musculus
tctgctggcggtggaacatgtgaaa

SEQ ID NO: 140276 - DNA, 25 bp, Mus musculus
tctgctggctgccactacagcttag

SEQ ID NO: 140277 - DNA, 25 bp, Mus musculus
tctgctggctttggagggactctgc

SEQ ID NO: 140278 - DNA, 25 bp, Mus musculus
tctgctgggagagagcgctgtaccc

SEQ ID NO: 140279 - DNA, 25 bp, Mus musculus
tctgctgggatttgtgccacgccac

SEQ ID NO: 140280 - DNA, 25 bp, Mus musculus
tctgctgggcatattaagtggtctc

SEQ ID NO: 140281 - DNA, 25 bp, Mus musculus
tctgctgggctcctgaagtgctact

SEQ ID NO: 140282 - DNA, 25 bp, Mus musculus
tctgctgggctggagtcctgtgcct

SEQ ID NO: 140283 - DNA, 25 bp, Mus musculus
tctgctgggcttggaaaaatgtcct

SEQ ID NO: 140284 - DNA, 25 bp, Mus musculus
tctgctgtcaccagatggagttcac

SEQ ID NO: 140285 - DNA, 25 bp, Mus musculus
tctgctgtcctgagaagatccgcca

SEQ ID NO: 140286 - DNA, 25 bp, Mus musculus
tctgctgtggaagatcgaggaccct

SEQ ID NO: 140287 - DNA, 25 bp, Mus musculus
tctgctgtgtctgaccctgaagaac

SEQ ID NO: 140288 - DNA, 25 bp, Mus musculus
tctgctgttggaaggattcttcaca

SEQ ID NO: 140289 - DNA, 25 bp, Mus musculus
tctgcttactgtggatggacccagg

SEQ ID NO: 140290 - DNA, 25 bp, Mus musculus
tctgcttcactaaacacactggtgg

SEQ ID NO: 140291 - DNA, 25 bp, Mus musculus
tctgcttctgccatcaacagcgaca

SEQ ID NO: 140292 - DNA, 25 bp, Mus musculus
tctgcttgatgtgttctgtgtaccg

SEQ ID NO: 140293 - DNA, 25 bp, Mus musculus
tctgcttgctgtggtcgaacactca

SEQ ID NO: 140294 - DNA, 25 bp, Mus musculus
tctgcttggatgagggactacctga

SEQ ID NO: 140295 - DNA, 25 bp, Mus musculus
tctgcttgggcaaaatcggctccta

SEQ ID NO: 140296 - DNA, 25 bp, Mus musculus
tctgcttgtcaacgcgtcagggaag

SEQ ID NO: 140297 - DNA, 25 bp, Mus musculus
tctgcttgtggagagtgccgtccct

SEQ ID NO: 140298 - DNA, 25 bp, Mus musculus
tctgctttgaggagcatatccgggc

SEQ ID NO: 140299 - DNA, 25 bp, Mus musculus
tctgctttggttctgcgtgctgttc

SEQ ID NO: 140300 - DNA, 25 bp, Mus musculus
tctgctttttcaaggtgccccatga

SEQ ID NO: 140301 - DNA, 25 bp, Mus musculus
tctggaaaaaagaacaagagcggct

SEQ ID NO: 140302 - DNA, 25 bp, Mus musculus
tctggaaaaggacattaagcctggc

SEQ ID NO: 140303 - DNA, 25 bp, Mus musculus
tctggaaacactgtagcagctttgg

SEQ ID NO: 140304 - DNA, 25 bp, Mus musculus
tctggaaagaaaacacctcgagctg

SEQ ID NO: 140305 - DNA, 25 bp, Mus musculus
tctggaaagccgacagaagctgagc

SEQ ID NO: 140306 - DNA, 25 bp, Mus musculus
tctggaaaggactgccagcacaagg

SEQ ID NO: 140307 - DNA, 25 bp, Mus musculus
tctggaaaggagaaaaatagagacc

SEQ ID NO: 140308 - DNA, 25 bp, Mus musculus
tctggaaaggctcctatcctcattg

SEQ ID NO: 140309 - DNA, 25 bp, Mus musculus
tctggaaattggaccccggacaggt

SEQ ID NO: 140310 - DNA, 25 bp, Mus musculus
tctggaaccagccaatcacactttt

SEQ ID NO: 140311 - DNA, 25 bp, Mus musculus
tctggaaccggctgtgtcgcttggt

SEQ ID NO: 140312 - DNA, 25 bp, Mus musculus
tctggaacctcctgaagatcgcctg

SEQ ID NO: 140313 - DNA, 25 bp, Mus musculus
tctggaacgacgaccagagccttgg

SEQ ID NO: 140314 - DNA, 25 bp, Mus musculus
tctggaactgtatcacaggaggcct

SEQ ID NO: 140315 - DNA, 25 bp, Mus musculus
tctggaacttctttgacctggaagg

SEQ ID NO: 140316 - DNA, 25 bp, Mus musculus
tctggaagaagcgtgtggaacaaga

SEQ ID NO: 140317 - DNA, 25 bp, Mus musculus
tctggaagcagcaaaagcataggca

SEQ ID NO: 140318 - DNA, 25 bp, Mus musculus
tctggaagccaacaagatagagttc

SEQ ID NO: 140319 - DNA, 25 bp, Mus musculus
tctggaagccactgcaagatagcct

SEQ ID NO: 140320 - DNA, 25 bp, Mus musculus
tctggaagccgtacatctatgctgg

SEQ ID NO: 140321 - DNA, 25 bp, Mus musculus
tctggaagcctcgatgcaagatgat

SEQ ID NO: 140322 - DNA, 25 bp, Mus musculus
tctggaagggacactcacgtggcac

SEQ ID NO: 140323 - DNA, 25 bp, Mus musculus
tctggaagtcgtagcaatcctgctc

SEQ ID NO: 140324 - DNA, 25 bp, Mus musculus
tctggaagtggccacgtacaccttc

SEQ ID NO: 140325 - DNA, 25 bp, Mus musculus
tctggaagttagagagaagggctac

SEQ ID NO: 140326 - DNA, 25 bp, Mus musculus
tctggaataaaactcgactccctca

SEQ ID NO: 140327 - DNA, 25 bp, Mus musculus
tctggaataaaagcagaagcatggt

SEQ ID NO: 140328 - DNA, 25 bp, Mus musculus
tctggaatctggagatgtcagccct

SEQ ID NO: 140329 - DNA, 25 bp, Mus musculus
tctggaatgccgtggagttttgaca

SEQ ID NO: 140330 - DNA, 25 bp, Mus musculus
tctggaatgcctgttgtcacctctg

SEQ ID NO: 140331 - DNA, 25 bp, Mus musculus
tctggaatggcaagacaactaaggt

SEQ ID NO: 140332 - DNA, 25 bp, Mus musculus
tctggaattttacatgggccgaaca

SEQ ID NO: 140333 - DNA, 25 bp, Mus musculus
tctggacaaacaacggctgctggac

SEQ ID NO: 140334 - DNA, 25 bp, Mus musculus
tctggacaaagacgcgtactaccgg

SEQ ID NO: 140335 - DNA, 25 bp, Mus musculus
tctggacaaagatggcgtcagtgct

SEQ ID NO: 140336 - DNA, 25 bp, Mus musculus
tctggacaaagtattccgaccagaa

SEQ ID NO: 140337 - DNA, 25 bp, Mus musculus
tctggacaagcagtggcatttgggc

SEQ ID NO: 140338 - DNA, 25 bp, Mus musculus
tctggacaatgctctgatgaggcct

SEQ ID NO: 140339 - DNA, 25 bp, Mus musculus
tctggacactgccttcaagctggga

SEQ ID NO: 140340 - DNA, 25 bp, Mus musculus
tctggacagaacaaacactgaaagg

SEQ ID NO: 140341 - DNA, 25 bp, Mus musculus
tctggacagaagattcctggaacca

SEQ ID NO: 140342 - DNA, 25 bp, Mus musculus
tctggacagtgcttgctgacagcgc

SEQ ID NO: 140343 - DNA, 25 bp, Mus musculus
tctggacagtggtgctcaagtgaac

SEQ ID NO: 140344 - DNA, 25 bp, Mus musculus
tctggaccagagaagcatcctcagg

SEQ ID NO: 140345 - DNA, 25 bp, Mus musculus
tctggaccagccaaccataatagag

SEQ ID NO: 140346 - DNA, 25 bp, Mus musculus
tctggacccagcctctgaagactgt

SEQ ID NO: 140347 - DNA, 25 bp, Mus musculus
tctggacctctaccaacaatatgga

SEQ ID NO: 140348 - DNA, 25 bp, Mus musculus
tctggacctgagacaggccgggaac

SEQ ID NO: 140349 - DNA, 25 bp, Mus musculus
tctggacctggctaaagctcaaagg

SEQ ID NO: 140350 - DNA, 25 bp, Mus musculus
tctggacgctcagcaaggacgatta

SEQ ID NO: 140351 - DNA, 25 bp, Mus musculus
tctggacgctgatgccaccggtcgg

SEQ ID NO: 140352 - DNA, 25 bp, Mus musculus
tctggacgctgctctggtcttatca

SEQ ID NO: 140353 - DNA, 25 bp, Mus musculus
tctggactacaggagaagtgtgcag

SEQ ID NO: 140354 - DNA, 25 bp, Mus musculus
tctggactcaggctttctggaaggc

SEQ ID NO: 140355 - DNA, 25 bp, Mus musculus
tctggactgcactagaagagatccc

SEQ ID NO: 140356 - DNA, 25 bp, Mus musculus
tctggactggacttcatgaccctaa

SEQ ID NO: 140357 - DNA, 25 bp, Mus musculus
tctggactggagaattaagaagctc

SEQ ID NO: 140358 - DNA, 25 bp, Mus musculus
tctggagaaccttcgtggtggaaca

SEQ ID NO: 140359 - DNA, 25 bp, Mus musculus
tctggagacaagtgcggttcaatca

SEQ ID NO: 140360 - DNA, 25 bp, Mus musculus
tctggagacagggatacctgcctgg

SEQ ID NO: 140361 - DNA, 25 bp, Mus musculus
tctggagactattgggactcctggg

SEQ ID NO: 140362 - DNA, 25 bp, Mus musculus
tctggagactccactgcgaggatat

SEQ ID NO: 140363 - DNA, 25 bp, Mus musculus
tctggagagaagacgccaccttgga

SEQ ID NO: 140364 - DNA, 25 bp, Mus musculus
tctggagagcaagcacggatcgtgc

SEQ ID NO: 140365 - DNA, 25 bp, Mus musculus
tctggagagcatcaactgtgtgcac

SEQ ID NO: 140366 - DNA, 25 bp, Mus musculus
tctggagagctgtggacacatcgag

SEQ ID NO: 140367 - DNA, 25 bp, Mus musculus
tctggagagttctcgctccctgcct

SEQ ID NO: 140368 - DNA, 25 bp, Mus musculus
tctggagatacatggtccccggctg

SEQ ID NO: 140369 - DNA, 25 bp, Mus musculus
tctggagatgtgtccccaggaccac

SEQ ID NO: 140370 - DNA, 25 bp, Mus musculus
tctggagcaaaagatcctgcaggtg

SEQ ID NO: 140371 - DNA, 25 bp, Mus musculus
tctggagcaaccatgaagtccctgg

SEQ ID NO: 140372 - DNA, 25 bp, Mus musculus
tctggagcagacgagaaagttcttc

SEQ ID NO: 140373 - DNA, 25 bp, Mus musculus
tctggagcagtactacgatcgagcc

SEQ ID NO: 140374 - DNA, 25 bp, Mus musculus
tctggagcccgagagggacacttac

SEQ ID NO: 140375 - DNA, 25 bp, Mus musculus
tctggagccctctgcactggttgac

SEQ ID NO: 140376 - DNA, 25 bp, Mus musculus
tctggagcctcacgtaagagcacga

SEQ ID NO: 140377 - DNA, 25 bp, Mus musculus
tctggagcctggtggacaccacgtg

SEQ ID NO: 140378 - DNA, 25 bp, Mus musculus
tctggagccttgtctgttgggaaac

SEQ ID NO: 140379 - DNA, 25 bp, Mus musculus
tctggagcgcaggagaatccttgcc

SEQ ID NO: 140380 - DNA, 25 bp, Mus musculus
tctggaggaagagaacgaccacctg

SEQ ID NO: 140381 - DNA, 25 bp, Mus musculus
tctggaggaagcagccaagtttact

SEQ ID NO: 140382 - DNA, 25 bp, Mus musculus
tctggaggctcttccggaaccaatg

SEQ ID NO: 140383 - DNA, 25 bp, Mus musculus
tctggaggctgagttatgaagcaca

SEQ ID NO: 140384 - DNA, 25 bp, Mus musculus
tctggagggaagtagcgtcctgact

SEQ ID NO: 140385 - DNA, 25 bp, Mus musculus
tctggagggtctgatgaagcaccac

SEQ ID NO: 140386 - DNA, 25 bp, Mus musculus
tctggaggtgtcatttgcggagcaa

SEQ ID NO: 140387 - DNA, 25 bp, Mus musculus
tctggagtaccaagcttctaaccgg

SEQ ID NO: 140388 - DNA, 25 bp, Mus musculus
tctggagtcagaatcagctggcttc

SEQ ID NO: 140389 - DNA, 25 bp, Mus musculus
tctggagtccaaagcggaaaggatc

SEQ ID NO: 140390 - DNA, 25 bp, Mus musculus
tctggagtgaaacctgagagaagcc

SEQ ID NO: 140391 - DNA, 25 bp, Mus musculus
tctggagtgaacaagaactacctct

SEQ ID NO: 140392 - DNA, 25 bp, Mus musculus
tctggagtggccctatgaagttacc

SEQ ID NO: 140393 - DNA, 25 bp, Mus musculus
tctggataagctcacccaagggcaa

SEQ ID NO: 140394 - DNA, 25 bp, Mus musculus
tctggatcaagagcgactgtacaac

SEQ ID NO: 140395 - DNA, 25 bp, Mus musculus
tctggatcgcaaacgacgggagaca

SEQ ID NO: 140396 - DNA, 25 bp, Mus musculus
tctggatcggagaccttcctagagt

SEQ ID NO: 140397 - DNA, 25 bp, Mus musculus
tctggatctccgtggaactgaactg

SEQ ID NO: 140398 - DNA, 25 bp, Mus musculus
tctggatctgtgctaccctggcctt

SEQ ID NO: 140399 - DNA, 25 bp, Mus musculus
tctggatcttgagagtggcaaaaaa

SEQ ID NO: 140400 - DNA, 25 bp, Mus musculus
tctggatgaagaatggcaacgtgga

SEQ ID NO: 140401 - DNA, 25 bp, Mus musculus
tctggatgacgggactgagcaaaac

SEQ ID NO: 140402 - DNA, 25 bp, Mus musculus
tctggatgagtttcgcccaagcagg

SEQ ID NO: 140403 - DNA, 25 bp, Mus musculus
tctggatgcaagatacagatagcac

SEQ ID NO: 140404 - DNA, 25 bp, Mus musculus
tctggatgcacgagaaaagtccatc

SEQ ID NO: 140405 - DNA, 25 bp, Mus musculus
tctggatggatctgggtgaaccgct

SEQ ID NO: 140406 - DNA, 25 bp, Mus musculus
tctggatggcattgagggtcgtcca

SEQ ID NO: 140407 - DNA, 25 bp, Mus musculus
tctggatgtcctgcttgagtacctg

SEQ ID NO: 140408 - DNA, 25 bp, Mus musculus
tctggatgtttggtaggcataagcc

SEQ ID NO: 140409 - DNA, 25 bp, Mus musculus
tctggattcctgcactctgctgcac

SEQ ID NO: 140410 - DNA, 25 bp, Mus musculus
tctggattcctgtggaccagccatc

SEQ ID NO: 140411 - DNA, 25 bp, Mus musculus
tctggattggacatgctgaaactgg

SEQ ID NO: 140412 - DNA, 25 bp, Mus musculus
tctggatttggaatcgtactcccca

SEQ ID NO: 140413 - DNA, 25 bp, Mus musculus
tctggcaacagctcaaaggcgaagt

SEQ ID NO: 140414 - DNA, 25 bp, Mus musculus
tctggcaagatggaaaggtccccgt

SEQ ID NO: 140415 - DNA, 25 bp, Mus musculus
tctggcaaggccagacagcatggct

SEQ ID NO: 140416 - DNA, 25 bp, Mus musculus
tctggcaagggctatggcaaaggct

SEQ ID NO: 140417 - DNA, 25 bp, Mus musculus
tctggcaccctttgtgcggaagctg

SEQ ID NO: 140418 - DNA, 25 bp, Mus musculus
tctggcacgcacagggagaaaggac

SEQ ID NO: 140419 - DNA, 25 bp, Mus musculus
tctggcagaagcctatggatctgga

SEQ ID NO: 140420 - DNA, 25 bp, Mus musculus
tctggcagacctagcagccgaaaag

SEQ ID NO: 140421 - DNA, 25 bp, Mus musculus
tctggcagataggtcctgggaacgc

SEQ ID NO: 140422 - DNA, 25 bp, Mus musculus
tctggcagccaacaaacaggtcatg

SEQ ID NO: 140423 - DNA, 25 bp, Mus musculus
tctggcagccggaagaaaaggtgct

SEQ ID NO: 140424 - DNA, 25 bp, Mus musculus
tctggcagggacaccaaagctgtgc

SEQ ID NO: 140425 - DNA, 25 bp, Mus musculus
tctggcagggcatcgacatcgagac

SEQ ID NO: 140426 - DNA, 25 bp, Mus musculus
tctggcagtggcagagaaggccggc

SEQ ID NO: 140427 - DNA, 25 bp, Mus musculus
tctggcatcagactagaatatgaac

SEQ ID NO: 140428 - DNA, 25 bp, Mus musculus
tctggccagataactacagccccgg

SEQ ID NO: 140429 - DNA, 25 bp, Mus musculus
tctggccatcgggtagcagtctgtc

SEQ ID NO: 140430 - DNA, 25 bp, Mus musculus
tctggcccaggcaagtgatacttgt

SEQ ID NO: 140431 - DNA, 25 bp, Mus musculus
tctggcccatcaacaagcagctgtt

SEQ ID NO: 140432 - DNA, 25 bp, Mus musculus
tctggccccgagaaaatccaggtct

SEQ ID NO: 140433 - DNA, 25 bp, Mus musculus
tctggcccgagtggttcacaagaag

SEQ ID NO: 140434 - DNA, 25 bp, Mus musculus
tctggcccgcatgtggaacgacttg

SEQ ID NO: 140435 - DNA, 25 bp, Mus musculus
tctggccgcatgtccgttcttaaga

SEQ ID NO: 140436 - DNA, 25 bp, Mus musculus
tctggccggctgaaccatcaggagt

SEQ ID NO: 140437 - DNA, 25 bp, Mus musculus
tctggccgtagtggcccatgctgca

SEQ ID NO: 140438 - DNA, 25 bp, Mus musculus
tctggccgtgacaagatctgcatag

SEQ ID NO: 140439 - DNA, 25 bp, Mus musculus
tctggcctcgacaggcacatgcaaa

SEQ ID NO: 140440 - DNA, 25 bp, Mus musculus
tctggcctctggaatggaatctgct

SEQ ID NO: 140441 - DNA, 25 bp, Mus musculus
tctggcctgcatcctggagaaagag

SEQ ID NO: 140442 - DNA, 25 bp, Mus musculus
tctggcctggagagacctgttcaac

SEQ ID NO: 140443 - DNA, 25 bp, Mus musculus
tctggcctggtgacaaaaaagtaca

SEQ ID NO: 140444 - DNA, 25 bp, Mus musculus
tctggcgccatggaggagtacgctc

SEQ ID NO: 140445 - DNA, 25 bp, Mus musculus
tctggcggcttactcactagcataa

SEQ ID NO: 140446 - DNA, 25 bp, Mus musculus
tctggcgggaactaaagctgactgg

SEQ ID NO: 140447 - DNA, 25 bp, Mus musculus
tctggcgggcaaaatacaaactctg

SEQ ID NO: 140448 - DNA, 25 bp, Mus musculus
tctggcgtgcactaaaagagaatcc

SEQ ID NO: 140449 - DNA, 25 bp, Mus musculus
tctggcgtgtggagaagtttgacct

SEQ ID NO: 140450 - DNA, 25 bp, Mus musculus
tctggctaattgctgggacttctgg

SEQ ID NO: 140451 - DNA, 25 bp, Mus musculus
tctggctagagatcccgcagattct

SEQ ID NO: 140452 - DNA, 25 bp, Mus musculus
tctggctaggccaggccagagccgc

SEQ ID NO: 140453 - DNA, 25 bp, Mus musculus
tctggctcagataaaggctgctcca

SEQ ID NO: 140454 - DNA, 25 bp, Mus musculus
tctggctccagaagcagagggacca

SEQ ID NO: 140455 - DNA, 25 bp, Mus musculus
tctggctctaccatgacgggaggct

SEQ ID NO: 140456 - DNA, 25 bp, Mus musculus
tctggctctcagtcatccagagatg

SEQ ID NO: 140457 - DNA, 25 bp, Mus musculus
tctggctctctgtggtggaataccc

SEQ ID NO: 140458 - DNA, 25 bp, Mus musculus
tctggctctgcaatcaggaaagaca

SEQ ID NO: 140459 - DNA, 25 bp, Mus musculus
tctggctgacctcttcaggagatac

SEQ ID NO: 140460 - DNA, 25 bp, Mus musculus
tctggctgcagaatgcgaagtctgt

SEQ ID NO: 140461 - DNA, 25 bp, Mus musculus
tctggctgccattgatctgcacgtg

SEQ ID NO: 140462 - DNA, 25 bp, Mus musculus
tctggctgcccttttatctgagtaa

SEQ ID NO: 140463 - DNA, 25 bp, Mus musculus
tctggctgcgagtaaagtcctggac

SEQ ID NO: 140464 - DNA, 25 bp, Mus musculus
tctggctggaactgggctgcaataa

SEQ ID NO: 140465 - DNA, 25 bp, Mus musculus
tctggctggtacgatctcggcggtc

SEQ ID NO: 140466 - DNA, 25 bp, Mus musculus
tctggctgtcccataaaagcacaag

SEQ ID NO: 140467 - DNA, 25 bp, Mus musculus
tctggctgtctgatgtgcagtcgac

SEQ ID NO: 140468 - DNA, 25 bp, Mus musculus
tctggctgttctctacggcaaacgg

SEQ ID NO: 140469 - DNA, 25 bp, Mus musculus
tctggcttcaggaggcggctttcat

SEQ ID NO: 140470 - DNA, 25 bp, Mus musculus
tctggcttctcgaatagttggcggc

SEQ ID NO: 140471 - DNA, 25 bp, Mus musculus
tctggcttggagaacagcaacgtct

SEQ ID NO: 140472 - DNA, 25 bp, Mus musculus
tctggcttggctatatcaattcggg

SEQ ID NO: 140473 - DNA, 25 bp, Mus musculus
tctggcttttcatcagaagcgtcta

SEQ ID NO: 140474 - DNA, 25 bp, Mus musculus
tctgggaaagaaagaaccctggagc

SEQ ID NO: 140475 - DNA, 25 bp, Mus musculus
tctgggaaattgaaaggacaaactc

SEQ ID NO: 140476 - DNA, 25 bp, Mus musculus
tctgggaacagctatgacatctaca

SEQ ID NO: 140477 - DNA, 25 bp, Mus musculus
tctgggaacaggaggtatcaaaccc

SEQ ID NO: 140478 - DNA, 25 bp, Mus musculus
tctgggaaccacaagactttctgct

SEQ ID NO: 140479 - DNA, 25 bp, Mus musculus
tctgggaaccctgtgcttcggatct

SEQ ID NO: 140480 - DNA, 25 bp, Mus musculus
tctgggaactgagtggcagacacca

SEQ ID NO: 140481 - DNA, 25 bp, Mus musculus
tctgggaagaaagggacatcatggc

SEQ ID NO: 140482 - DNA, 25 bp, Mus musculus
tctgggaagctggaacgaagtatcc

SEQ ID NO: 140483 - DNA, 25 bp, Mus musculus
tctgggaagcttgctgcgggactaa

SEQ ID NO: 140484 - DNA, 25 bp, Mus musculus
tctgggaagtgtcccgatgaccacg

SEQ ID NO: 140485 - DNA, 25 bp, Mus musculus
tctgggaattgggtatctggaccgc

SEQ ID NO: 140486 - DNA, 25 bp, Mus musculus
tctgggacagggagtattgaatgcc

SEQ ID NO: 140487 - DNA, 25 bp, Mus musculus
tctgggacattcaaaagctgaagct

SEQ ID NO: 140488 - DNA, 25 bp, Mus musculus
tctgggacatttagagaagattcac

SEQ ID NO: 140489 - DNA, 25 bp, Mus musculus
tctgggaccacagatcaggttctgg

SEQ ID NO: 140490 - DNA, 25 bp, Mus musculus
tctgggaccatttggattcacatcc

SEQ ID NO: 140491 - DNA, 25 bp, Mus musculus
tctgggacccaaacatgaactggaa

SEQ ID NO: 140492 - DNA, 25 bp, Mus musculus
tctgggacccagtgctatccgtgat

SEQ ID NO: 140493 - DNA, 25 bp, Mus musculus
tctgggacggacatcttcactggag

SEQ ID NO: 140494 - DNA, 25 bp, Mus musculus
tctgggacttccgtggacctggagc

SEQ ID NO: 140495 - DNA, 25 bp, Mus musculus
tctgggactttcttcacgcctctgg

SEQ ID NO: 140496 - DNA, 25 bp, Mus musculus
tctgggagaccagttgagcacagtc

SEQ ID NO: 140497 - DNA, 25 bp, Mus musculus
tctgggagaccttaccaaagcctgc

SEQ ID NO: 140498 - DNA, 25 bp, Mus musculus
tctgggagatgctcatggcgacgcc

SEQ ID NO: 140499 - DNA, 25 bp, Mus musculus
tctgggagccattatatgaaagtag

SEQ ID NO: 140500 - DNA, 25 bp, Mus musculus
tctgggaggcatgaagcatctactt

SEQ ID NO: 140501 - DNA, 25 bp, Mus musculus
tctgggaggctcatgaaagactggt

SEQ ID NO: 140502 - DNA, 25 bp, Mus musculus
tctgggataaaagcacactggaatg

SEQ ID NO: 140503 - DNA, 25 bp, Mus musculus
tctgggatatgctggagagtcaccg

SEQ ID NO: 140504 - DNA, 25 bp, Mus musculus
tctgggatcctgatttggcttcgct

SEQ ID NO: 140505 - DNA, 25 bp, Mus musculus
tctgggatgaagaccagcatcgcct

SEQ ID NO: 140506 - DNA, 25 bp, Mus musculus
tctgggatgacctcagagctggaat

SEQ ID NO: 140507 - DNA, 25 bp, Mus musculus
tctgggatgaggaatcggcacagct

SEQ ID NO: 140508 - DNA, 25 bp, Mus musculus
tctgggattctaaccctgaggacca

SEQ ID NO: 140509 - DNA, 25 bp, Mus musculus
tctgggattgaaaacggagccttcc

SEQ ID NO: 140510 - DNA, 25 bp, Mus musculus
tctgggcaactggtaaccatgagcg

SEQ ID NO: 140511 - DNA, 25 bp, Mus musculus
tctgggcacaagaagtggatcatcc

SEQ ID NO: 140512 - DNA, 25 bp, Mus musculus
tctgggcacacagaacaaaggccgg

SEQ ID NO: 140513 - DNA, 25 bp, Mus musculus
tctgggcaccaggtctgatgcttgc

SEQ ID NO: 140514 - DNA, 25 bp, Mus musculus
tctgggcaccatgagacacttggag

SEQ ID NO: 140515 - DNA, 25 bp, Mus musculus
tctgggcactcctaacaacgaagtg

SEQ ID NO: 140516 - DNA, 25 bp, Mus musculus
tctgggcagctggtgactagtcaag

SEQ ID NO: 140517 - DNA, 25 bp, Mus musculus
tctgggcaggaatgagggcaacatc

SEQ ID NO: 140518 - DNA, 25 bp, Mus musculus
tctgggcatctagaggacaaacccc

SEQ ID NO: 140519 - DNA, 25 bp, Mus musculus
tctgggcatggaacactgcgacaca

SEQ ID NO: 140520 - DNA, 25 bp, Mus musculus
tctgggcatggcaaacaccgatgac

SEQ ID NO: 140521 - DNA, 25 bp, Mus musculus
tctgggccaaaggacaagccattga

SEQ ID NO: 140522 - DNA, 25 bp, Mus musculus
tctgggccaagcgatgtgatcattt

SEQ ID NO: 140523 - DNA, 25 bp, Mus musculus
tctgggccagttcatagcaaagttg

SEQ ID NO: 140524 - DNA, 25 bp, Mus musculus
tctgggcccagagtaggatttcctt

SEQ ID NO: 140525 - DNA, 25 bp, Mus musculus
tctgggccccacaaagtgaagtgta

SEQ ID NO: 140526 - DNA, 25 bp, Mus musculus
tctgggccctggaatagagtccgcc

SEQ ID NO: 140527 - DNA, 25 bp, Mus musculus
tctgggcccttatccagcagtctgg

SEQ ID NO: 140528 - DNA, 25 bp, Mus musculus
tctgggccgcctccttcgtcgggcc

SEQ ID NO: 140529 - DNA, 25 bp, Mus musculus
tctgggccttgaaactcgtgtgtgt

SEQ ID NO: 140530 - DNA, 25 bp, Mus musculus
tctgggcggcagctactatatgatg

SEQ ID NO: 140531 - DNA, 25 bp, Mus musculus
tctgggctagaagaccagcggcgca

SEQ ID NO: 140532 - DNA, 25 bp, Mus musculus
tctgggctcagatagaattttatca

SEQ ID NO: 140533 - DNA, 25 bp, Mus musculus
tctgggctgacaaacatcaagacgg

SEQ ID NO: 140534 - DNA, 25 bp, Mus musculus
tctgggctgcccctagttcaccgtt

SEQ ID NO: 140535 - DNA, 25 bp, Mus musculus
tctgggctgcggatgtcatctttgc

SEQ ID NO: 140536 - DNA, 25 bp, Mus musculus
tctgggctgctatatggacggcccc

SEQ ID NO: 140537 - DNA, 25 bp, Mus musculus
tctgggctgtatgggactaacctga

SEQ ID NO: 140538 - DNA, 25 bp, Mus musculus
tctgggcttcaagcaacactgaaga

SEQ ID NO: 140539 - DNA, 25 bp, Mus musculus
tctgggtaacctcgcagaagaccga

SEQ ID NO: 140540 - DNA, 25 bp, Mus musculus
tctgggtaccaacacttggctgtgc

SEQ ID NO: 140541 - DNA, 25 bp, Mus musculus
tctgggtaccattacggtctcctca

SEQ ID NO: 140542 - DNA, 25 bp, Mus musculus
tctgggtagaccaacagaacggagt

SEQ ID NO: 140543 - DNA, 25 bp, Mus musculus
tctgggtatggcgatggacactgta

SEQ ID NO: 140544 - DNA, 25 bp, Mus musculus
tctgggtattcctccttgggtggct

SEQ ID NO: 140545 - DNA, 25 bp, Mus musculus
tctgggtcaacgagcagacgaagct

SEQ ID NO: 140546 - DNA, 25 bp, Mus musculus
tctgggtcacattctaaaacctggg

SEQ ID NO: 140547 - DNA, 25 bp, Mus musculus
tctgggtcacttcagggactgtcag

SEQ ID NO: 140548 - DNA, 25 bp, Mus musculus
tctgggtcatactgaacctgtggcc

SEQ ID NO: 140549 - DNA, 25 bp, Mus musculus
tctgggtctcccaactggcatggca

SEQ ID NO: 140550 - DNA, 25 bp, Mus musculus
tctgggtctgctccaagagatgaga

SEQ ID NO: 140551 - DNA, 25 bp, Mus musculus
tctgggtgcagaactcaacgtgctc

SEQ ID NO: 140552 - DNA, 25 bp, Mus musculus
tctgggtgcgtctcttcaagggcga

SEQ ID NO: 140553 - DNA, 25 bp, Mus musculus
tctgggtgggacttcctcccggaga

SEQ ID NO: 140554 - DNA, 25 bp, Mus musculus
tctgggtgtccgtgctctgcaagaa

SEQ ID NO: 140555 - DNA, 25 bp, Mus musculus
tctgggtgtgtgcaattctcagctg

SEQ ID NO: 140556 - DNA, 25 bp, Mus musculus
tctgggttagaaggatccgggaaca

SEQ ID NO: 140557 - DNA, 25 bp, Mus musculus
tctgggttcgtctcctacaagcaaa

SEQ ID NO: 140558 - DNA, 25 bp, Mus musculus
tctgggttctggtgccgcgcaagct

SEQ ID NO: 140559 - DNA, 25 bp, Mus musculus
tctgggtttatggaaagaccgctac

SEQ ID NO: 140560 - DNA, 25 bp, Mus musculus
tctggtaacttaagcacaacttggg

SEQ ID NO: 140561 - DNA, 25 bp, Mus musculus
tctggtaatgggagcatccacagcc

SEQ ID NO: 140562 - DNA, 25 bp, Mus musculus
tctggtacaaccttcttcgcagtgg

SEQ ID NO: 140563 - DNA, 25 bp, Mus musculus
tctggtacaagagccgcgagaagct

SEQ ID NO: 140564 - DNA, 25 bp, Mus musculus
tctggtacacccctcaaggaaggat

SEQ ID NO: 140565 - DNA, 25 bp, Mus musculus
tctggtaccgaatgggcagagtgcc

SEQ ID NO: 140566 - DNA, 25 bp, Mus musculus
tctggtaccgcaggtagagctgcca

SEQ ID NO: 140567 - DNA, 25 bp, Mus musculus
tctggtacctgcagctgagagcacc

SEQ ID NO: 140568 - DNA, 25 bp, Mus musculus
tctggtcactctgtcactaaccggg

SEQ ID NO: 140569 - DNA, 25 bp, Mus musculus
tctggtcagcttggacaattcctgc

SEQ ID NO: 140570 - DNA, 25 bp, Mus musculus
tctggtccagaacccctggtgggct

SEQ ID NO: 140571 - DNA, 25 bp, Mus musculus
tctggtcctcagctgtctcctcaca

SEQ ID NO: 140572 - DNA, 25 bp, Mus musculus
tctggtcgagttgtgcggagcttct

SEQ ID NO: 140573 - DNA, 25 bp, Mus musculus
tctggtcgcaaccaatctggacgcg

SEQ ID NO: 140574 - DNA, 25 bp, Mus musculus
tctggtcgcgtctcggaaacccgta

SEQ ID NO: 140575 - DNA, 25 bp, Mus musculus
tctggtctagcctgggtatcccgga

SEQ ID NO: 140576 - DNA, 25 bp, Mus musculus
tctggtctcaattcccgtctcaagg

SEQ ID NO: 140577 - DNA, 25 bp, Mus musculus
tctggtctccaggttacgggcggtc

SEQ ID NO: 140578 - DNA, 25 bp, Mus musculus
tctggtctcgctagagaagcctggt

SEQ ID NO: 140579 - DNA, 25 bp, Mus musculus
tctggtctctcgaccgcaaaggaga

SEQ ID NO: 140580 - DNA, 25 bp, Mus musculus
tctggtctctcgaggcaaaaggcga

SEQ ID NO: 140581 - DNA, 25 bp, Mus musculus
tctggtctgacgctccctataggtt

SEQ ID NO: 140582 - DNA, 25 bp, Mus musculus
tctggtgaagatagccactggctgc

SEQ ID NO: 140583 - DNA, 25 bp, Mus musculus
tctggtgaccactgtatctgagctc

SEQ ID NO: 140584 - DNA, 25 bp, Mus musculus
tctggtgacgagaagaagggtcctc

SEQ ID NO: 140585 - DNA, 25 bp, Mus musculus
tctggtgagcatagatcaagacact

SEQ ID NO: 140586 - DNA, 25 bp, Mus musculus
tctggtgatcattgtcgctgtggtc

SEQ ID NO: 140587 - DNA, 25 bp, Mus musculus
tctggtgcaagtgatgatggacgcc

SEQ ID NO: 140588 - DNA, 25 bp, Mus musculus
tctggtgcagctcaaatgttcctac

SEQ ID NO: 140589 - DNA, 25 bp, Mus musculus
tctggtgccagatcctacagggcca

SEQ ID NO: 140590 - DNA, 25 bp, Mus musculus
tctggtgcccaagaaactagaagct

SEQ ID NO: 140591 - DNA, 25 bp, Mus musculus
tctggtgccgcgcaagctctccccg

SEQ ID NO: 140592 - DNA, 25 bp, Mus musculus
tctggtgcggtctcgagcccgagca

SEQ ID NO: 140593 - DNA, 25 bp, Mus musculus
tctggtggaactctatggaaacagc

SEQ ID NO: 140594 - DNA, 25 bp, Mus musculus
tctggtggatgcttctgctgctctc

SEQ ID NO: 140595 - DNA, 25 bp, Mus musculus
tctggtggcccttgcttaataaaga

SEQ ID NO: 140596 - DNA, 25 bp, Mus musculus
tctggtggccgtgtggctatattcg

SEQ ID NO: 140597 - DNA, 25 bp, Mus musculus
tctggtgggaacgactatggctgcc

SEQ ID NO: 140598 - DNA, 25 bp, Mus musculus
tctggtgggctccatcgataacgac

SEQ ID NO: 140599 - DNA, 25 bp, Mus musculus
tctggtgggttcttccgctcagacc

SEQ ID NO: 140600 - DNA, 25 bp, Mus musculus
tctggtggtcaggtttccagggaca

SEQ ID NO: 140601 - DNA, 25 bp, Mus musculus
tctggtggtctgagagatctgagct

SEQ ID NO: 140602 - DNA, 25 bp, Mus musculus
tctggtggttgaaaaggacactcgc

SEQ ID NO: 140603 - DNA, 25 bp, Mus musculus
tctggtgtcattaacggaccttcta

SEQ ID NO: 140604 - DNA, 25 bp, Mus musculus
tctggtgtgagaaatatggctgtat

SEQ ID NO: 140605 - DNA, 25 bp, Mus musculus
tctggtgttggatgcataggctcct

SEQ ID NO: 140606 - DNA, 25 bp, Mus musculus
tctggttacccaggagcaggcttcc

SEQ ID NO: 140607 - DNA, 25 bp, Mus musculus
tctggttagaactgcaggcctggca

SEQ ID NO: 140608 - DNA, 25 bp, Mus musculus
tctggttatgacaatgaccggcccg

SEQ ID NO: 140609 - DNA, 25 bp, Mus musculus
tctggttcatacagcagccattaaa

SEQ ID NO: 140610 - DNA, 25 bp, Mus musculus
tctggttccagtcctaggagccacc

SEQ ID NO: 140611 - DNA, 25 bp, Mus musculus
tctggttcctgagcccaaaatcatt

SEQ ID NO: 140612 - DNA, 25 bp, Mus musculus
tctggttctcggcaaagttctgggt

SEQ ID NO: 140613 - DNA, 25 bp, Mus musculus
tctggttgtgggacatgaactcgcc

SEQ ID NO: 140614 - DNA, 25 bp, Mus musculus
tctggttgtgtaagcctcatagggc

SEQ ID NO: 140615 - DNA, 25 bp, Mus musculus
tctggttgttaaggcgacttgtccc

SEQ ID NO: 140616 - DNA, 25 bp, Mus musculus
tctggtttaactaccgacatgttgc

SEQ ID NO: 140617 - DNA, 25 bp, Mus musculus
tctggttttcggctatgcctgcaag

SEQ ID NO: 140618 - DNA, 25 bp, Mus musculus
tctggttttctacggccacagcgtg

SEQ ID NO: 140619 - DNA, 25 bp, Mus musculus
tctgtaaaaatgaccctgagggaat

SEQ ID NO: 140620 - DNA, 25 bp, Mus musculus
tctgtaaccaacagaacgactgtgg

SEQ ID NO: 140621 - DNA, 25 bp, Mus musculus
tctgtaactcggatggatgccttgc

SEQ ID NO: 140622 - DNA, 25 bp, Mus musculus
tctgtaagacagaaggagggtcccc

SEQ ID NO: 140623 - DNA, 25 bp, Mus musculus
tctgtaagatcttggccatgaaggc

SEQ ID NO: 140624 - DNA, 25 bp, Mus musculus
tctgtaagcaaaggaagggcctccg

SEQ ID NO: 140625 - DNA, 25 bp, Mus musculus
tctgtaaggcttcaccgtcacacca

SEQ ID NO: 140626 - DNA, 25 bp, Mus musculus
tctgtaagtcaacggcaaacaccac

SEQ ID NO: 140627 - DNA, 25 bp, Mus musculus
tctgtaagttcggaggccacccgag

SEQ ID NO: 140628 - DNA, 25 bp, Mus musculus
tctgtaataagagaaggtggcaacc

SEQ ID NO: 140629 - DNA, 25 bp, Mus musculus
tctgtaatctagaaaccagcgttgg

SEQ ID NO: 140630 - DNA, 25 bp, Mus musculus
tctgtaatgcagctccgccttgata

SEQ ID NO: 140631 - DNA, 25 bp, Mus musculus
tctgtacaaaggtgtgctatggcat

SEQ ID NO: 140632 - DNA, 25 bp, Mus musculus
tctgtacaacctgcacccgtttggg

SEQ ID NO: 140633 - DNA, 25 bp, Mus musculus
tctgtacaactcaatcaagaacgag

SEQ ID NO: 140634 - DNA, 25 bp, Mus musculus
tctgtacagacgacttcattgccaa

SEQ ID NO: 140635 - DNA, 25 bp, Mus musculus
tctgtacagccaccaacgctgtggg

SEQ ID NO: 140636 - DNA, 25 bp, Mus musculus
tctgtaccacctgcgcattgaggca

SEQ ID NO: 140637 - DNA, 25 bp, Mus musculus
tctgtaccagggaagacctatctcc

SEQ ID NO: 140638 - DNA, 25 bp, Mus musculus
tctgtaccatacgatagggcttgtc

SEQ ID NO: 140639 - DNA, 25 bp, Mus musculus
tctgtaccgatgcaagcagctgaag

SEQ ID NO: 140640 - DNA, 25 bp, Mus musculus
tctgtaccgcaagcaaattccagtg

SEQ ID NO: 140641 - DNA, 25 bp, Mus musculus
tctgtaccttgaaagctgctgctgc

SEQ ID NO: 140642 - DNA, 25 bp, Mus musculus
tctgtacgaagtgcaccgctgtgac

SEQ ID NO: 140643 - DNA, 25 bp, Mus musculus
tctgtacgccatgaagactctcagg

SEQ ID NO: 140644 - DNA, 25 bp, Mus musculus
tctgtacggcaccaatgagaaggag

SEQ ID NO: 140645 - DNA, 25 bp, Mus musculus
tctgtacgtgccagatgacagggtg

SEQ ID NO: 140646 - DNA, 25 bp, Mus musculus
tctgtactgagctgcgacatctcca

SEQ ID NO: 140647 - DNA, 25 bp, Mus musculus
tctgtagaagcgcatagagaatacg

SEQ ID NO: 140648 - DNA, 25 bp, Mus musculus
tctgtagataagatcgcccactccc

SEQ ID NO: 140649 - DNA, 25 bp, Mus musculus
tctgtagatgtgagaccagggcact

SEQ ID NO: 140650 - DNA, 25 bp, Mus musculus
tctgtagcagctagaaaggccttag

SEQ ID NO: 140651 - DNA, 25 bp, Mus musculus
tctgtaggaacctgagggagctaac

SEQ ID NO: 140652 - DNA, 25 bp, Mus musculus
tctgtaggataaccatgggaccacc

SEQ ID NO: 140653 - DNA, 25 bp, Mus musculus
tctgtaggttgtttcatttgttgca

SEQ ID NO: 140654 - DNA, 25 bp, Mus musculus
tctgtagtaggccatggctgtgcca

SEQ ID NO: 140655 - DNA, 25 bp, Mus musculus
tctgtagtgctaagaaccgtgggcc

SEQ ID NO: 140656 - DNA, 25 bp, Mus musculus
tctgtataccatggaggactctcgg

SEQ ID NO: 140657 - DNA, 25 bp, Mus musculus
tctgtataccttcaacgtggccgtg

SEQ ID NO: 140658 - DNA, 25 bp, Mus musculus
tctgtatccaccctgcgaaacttcg

SEQ ID NO: 140659 - DNA, 25 bp, Mus musculus
tctgtatcggatccctgagcctgaa

SEQ ID NO: 140660 - DNA, 25 bp, Mus musculus
tctgtatgccgagtatgaccgacca

SEQ ID NO: 140661 - DNA, 25 bp, Mus musculus
tctgtattaggttaatgtgctaaca

SEQ ID NO: 140662 - DNA, 25 bp, Mus musculus
tctgtcaacagctacgtggattcct

SEQ ID NO: 140663 - DNA, 25 bp, Mus musculus
tctgtcaagataaagtggtggctgc

SEQ ID NO: 140664 - DNA, 25 bp, Mus musculus
tctgtcaaggactggtgcaactgga

SEQ ID NO: 140665 - DNA, 25 bp, Mus musculus
tctgtcaagtactgcagtcatagta

SEQ ID NO: 140666 - DNA, 25 bp, Mus musculus
tctgtcaagtagtaccagcagggct

SEQ ID NO: 140667 - DNA, 25 bp, Mus musculus
tctgtcaatggcctcaacgtgctga

SEQ ID NO: 140668 - DNA, 25 bp, Mus musculus
tctgtcactctagagacggttccag

SEQ ID NO: 140669 - DNA, 25 bp, Mus musculus
tctgtcactgcgaaggagatgaaga

SEQ ID NO: 140670 - DNA, 25 bp, Mus musculus
tctgtcagatcagaaagaggcctcc

SEQ ID NO: 140671 - DNA, 25 bp, Mus musculus
tctgtcagtccatctgtccgccttg

SEQ ID NO: 140672 - DNA, 25 bp, Mus musculus
tctgtcagtgggaaaattgaaatag

SEQ ID NO: 140673 - DNA, 25 bp, Mus musculus
tctgtcagtgtatgccccaggagag

SEQ ID NO: 140674 - DNA, 25 bp, Mus musculus
tctgtcatcccgcaggcggtagaac

SEQ ID NO: 140675 - DNA, 25 bp, Mus musculus
tctgtcattgaggaagagcggcctc

SEQ ID NO: 140676 - DNA, 25 bp, Mus musculus
tctgtcattgtatccagccaaggag

SEQ ID NO: 140677 - DNA, 25 bp, Mus musculus
tctgtccacactcctgaccataaaa

SEQ ID NO: 140678 - DNA, 25 bp, Mus musculus
tctgtccagaggtcaaaggccaagc

SEQ ID NO: 140679 - DNA, 25 bp, Mus musculus
tctgtccagagtgtgcaatgcagcc

SEQ ID NO: 140680 - DNA, 25 bp, Mus musculus
tctgtccattgattccaggcctcag

SEQ ID NO: 140681 - DNA, 25 bp, Mus musculus
tctgtccatttcgtaggaccggtcc

SEQ ID NO: 140682 - DNA, 25 bp, Mus musculus
tctgtcccaaaatgctccagctgga

SEQ ID NO: 140683 - DNA, 25 bp, Mus musculus
tctgtcccagaagacaagactgagc

SEQ ID NO: 140684 - DNA, 25 bp, Mus musculus
tctgtcccggcagcattagctagtc

SEQ ID NO: 140685 - DNA, 25 bp, Mus musculus
tctgtccctgaggaaatggccctgc

SEQ ID NO: 140686 - DNA, 25 bp, Mus musculus
tctgtccgacaatgagccgtgggtg

SEQ ID NO: 140687 - DNA, 25 bp, Mus musculus
tctgtccgccgtgttgtagactgaa

SEQ ID NO: 140688 - DNA, 25 bp, Mus musculus
tctgtcctcgggtgaatctggagcc

SEQ ID NO: 140689 - DNA, 25 bp, Mus musculus
tctgtcctctacaactggaaggatg

SEQ ID NO: 140690 - DNA, 25 bp, Mus musculus
tctgtcctgaagacctatggagcct

SEQ ID NO: 140691 - DNA, 25 bp, Mus musculus
tctgtcctggtaaagagagcactgc

SEQ ID NO: 140692 - DNA, 25 bp, Mus musculus
tctgtcctgtatgccacctggtggt

SEQ ID NO: 140693 - DNA, 25 bp, Mus musculus
tctgtcgcaagccatagtcaaagtg

SEQ ID NO: 140694 - DNA, 25 bp, Mus musculus
tctgtcgccagggagcaggaatacc

SEQ ID NO: 140695 - DNA, 25 bp, Mus musculus
tctgtcgcggtcaaagaactcactt

SEQ ID NO: 140696 - DNA, 25 bp, Mus musculus
tctgtcggaaaatctggctcggtct

SEQ ID NO: 140697 - DNA, 25 bp, Mus musculus
tctgtcggaagactcgagccgctac

SEQ ID NO: 140698 - DNA, 25 bp, Mus musculus
tctgtcggacaacactgatgaggca

SEQ ID NO: 140699 - DNA, 25 bp, Mus musculus
tctgtcggacactctgactgaatgg

SEQ ID NO: 140700 - DNA, 25 bp, Mus musculus
tctgtcggagcaacctatctgtgga

SEQ ID NO: 140701 - DNA, 25 bp, Mus musculus
tctgtcgggatctgaaagaactcag

SEQ ID NO: 140702 - DNA, 25 bp, Mus musculus
tctgtcgtccaccatcgagtgagga

SEQ ID NO: 140703 - DNA, 25 bp, Mus musculus
tctgtctaaatcagggctcggagca

SEQ ID NO: 140704 - DNA, 25 bp, Mus musculus
tctgtctatggttgggaagccgtcc

SEQ ID NO: 140705 - DNA, 25 bp, Mus musculus
tctgtctcaaagaaggaatccctgg

SEQ ID NO: 140706 - DNA, 25 bp, Mus musculus
tctgtctccccagagaaggaagggc

SEQ ID NO: 140707 - DNA, 25 bp, Mus musculus
tctgtctcccttaagaggaggttgg

SEQ ID NO: 140708 - DNA, 25 bp, Mus musculus
tctgtctctgagcagaggatgtcca

SEQ ID NO: 140709 - DNA, 25 bp, Mus musculus
tctgtctctgggatgataaaggctc

SEQ ID NO: 140710 - DNA, 25 bp, Mus musculus
tctgtctgaagatcgaaggaccctg

SEQ ID NO: 140711 - DNA, 25 bp, Mus musculus
tctgtctgacacactgaccgctggg

SEQ ID NO: 140712 - DNA, 25 bp, Mus musculus
tctgtctgagacctatgggaacaag

SEQ ID NO: 140713 - DNA, 25 bp, Mus musculus
tctgtctgagagtgttaatggctgc

SEQ ID NO: 140714 - DNA, 25 bp, Mus musculus
tctgtctgatgtagcccatgtggaa

SEQ ID NO: 140715 - DNA, 25 bp, Mus musculus
tctgtctggagtggagtaaccctat

SEQ ID NO: 140716 - DNA, 25 bp, Mus musculus
tctgtctggataagtgtggccggcc

SEQ ID NO: 140717 - DNA, 25 bp, Mus musculus
tctgtctgggtttctcgagtgggtc

SEQ ID NO: 140718 - DNA, 25 bp, Mus musculus
tctgtctgtgcattgtgaacgtccg

SEQ ID NO: 140719 - DNA, 25 bp, Mus musculus
tctgtcttatgcagactgtgtcctg

SEQ ID NO: 140720 - DNA, 25 bp, Mus musculus
tctgtcttctggtgtcattaacgga

SEQ ID NO: 140721 - DNA, 25 bp, Mus musculus
tctgtctttacatttgcctcaaggg

SEQ ID NO: 140722 - DNA, 25 bp, Mus musculus
tctgtgaaaataatccgcctggtca

SEQ ID NO: 140723 - DNA, 25 bp, Mus musculus
tctgtgaacatcaagggcggaacca

SEQ ID NO: 140724 - DNA, 25 bp, Mus musculus
tctgtgaacttctggtacgtgctgg

SEQ ID NO: 140725 - DNA, 25 bp, Mus musculus
tctgtgaagaactgccggacagcct

SEQ ID NO: 140726 - DNA, 25 bp, Mus musculus
tctgtgaagcgaggcaacatggtcc

SEQ ID NO: 140727 - DNA, 25 bp, Mus musculus
tctgtgaaggcatccgtcctgcgga

SEQ ID NO: 140728 - DNA, 25 bp, Mus musculus
tctgtgaaggccgaggacaaagacc

SEQ ID NO: 140729 - DNA, 25 bp, Mus musculus
tctgtgaaggcgcacttcttcctgg

SEQ ID NO: 140730 - DNA, 25 bp, Mus musculus
tctgtgacaaaacctgtggcagtgt

SEQ ID NO: 140731 - DNA, 25 bp, Mus musculus
tctgtgacacttctacaagggagag

SEQ ID NO: 140732 - DNA, 25 bp, Mus musculus
tctgtgacagccagtgttagcatct

SEQ ID NO: 140733 - DNA, 25 bp, Mus musculus
tctgtgacctcgttggccaaactct

SEQ ID NO: 140734 - DNA, 25 bp, Mus musculus
tctgtgacgtcaccctcatagctgg

SEQ ID NO: 140735 - DNA, 25 bp, Mus musculus
tctgtgacttcggtgcctcgcggtt

SEQ ID NO: 140736 - DNA, 25 bp, Mus musculus
tctgtgacttcttcagggaggccac

SEQ ID NO: 140737 - DNA, 25 bp, Mus musculus
tctgtgagaccaggacaagggacct

SEQ ID NO: 140738 - DNA, 25 bp, Mus musculus
tctgtgagacctggctgggagtacc

SEQ ID NO: 140739 - DNA, 25 bp, Mus musculus
tctgtgagacttccttcgacgcggt

SEQ ID NO: 140740 - DNA, 25 bp, Mus musculus
tctgtgagactttgacgcggaaggc

SEQ ID NO: 140741 - DNA, 25 bp, Mus musculus
tctgtgagcctggatgttcgccctg

SEQ ID NO: 140742 - DNA, 25 bp, Mus musculus
tctgtgagctgataccccaggctgg

SEQ ID NO: 140743 - DNA, 25 bp, Mus musculus
tctgtgaggtgtgggccagcaatct

SEQ ID NO: 140744 - DNA, 25 bp, Mus musculus
tctgtgagttgagcttgaggccgca

SEQ ID NO: 140745 - DNA, 25 bp, Mus musculus
tctgtgatactgaggagagcccagg

SEQ ID NO: 140746 - DNA, 25 bp, Mus musculus
tctgtgatcggatactgggtagccc

SEQ ID NO: 140747 - DNA, 25 bp, Mus musculus
tctgtgatggacttccaggaggacc

SEQ ID NO: 140748 - DNA, 25 bp, Mus musculus
tctgtgatggccaaagcgaagggtt

SEQ ID NO: 140749 - DNA, 25 bp, Mus musculus
tctgtgattctgtgggcagtgccca

SEQ ID NO: 140750 - DNA, 25 bp, Mus musculus
tctgtgattttccagttgcccggga

SEQ ID NO: 140751 - DNA, 25 bp, Mus musculus
tctgtgcaaaacatgttacactggg

SEQ ID NO: 140752 - DNA, 25 bp, Mus musculus
tctgtgcaagaaagtcaagctgagc

SEQ ID NO: 140753 - DNA, 25 bp, Mus musculus
tctgtgcaccgtgagaagatgaacg

SEQ ID NO: 140754 - DNA, 25 bp, Mus musculus
tctgtgcagaagcttataatcctga

SEQ ID NO: 140755 - DNA, 25 bp, Mus musculus
tctgtgcagctctgagtgtaccgct

SEQ ID NO: 140756 - DNA, 25 bp, Mus musculus
tctgtgcaggctacgtagaaggcca

SEQ ID NO: 140757 - DNA, 25 bp, Mus musculus
tctgtgcaggtcagcgtcaatgcca

SEQ ID NO: 140758 - DNA, 25 bp, Mus musculus
tctgtgcagtgggaccaaggctcag

SEQ ID NO: 140759 - DNA, 25 bp, Mus musculus
tctgtgccagaagttatatgtccct

SEQ ID NO: 140760 - DNA, 25 bp, Mus musculus
tctgtgccaggactcgtggaagcct

SEQ ID NO: 140761 - DNA, 25 bp, Mus musculus
tctgtgccaggatatgctcgcagcc

SEQ ID NO: 140762 - DNA, 25 bp, Mus musculus
tctgtgccatgtccagaagtcaggg

SEQ ID NO: 140763 - DNA, 25 bp, Mus musculus
tctgtgcccggaaatgtactggtga

SEQ ID NO: 140764 - DNA, 25 bp, Mus musculus
tctgtgccctatactggatatgaac

SEQ ID NO: 140765 - DNA, 25 bp, Mus musculus
tctgtgcccttcagcaggctctggg

SEQ ID NO: 140766 - DNA, 25 bp, Mus musculus
tctgtgccgaatggagggactgcca

SEQ ID NO: 140767 - DNA, 25 bp, Mus musculus
tctgtgccgctgactgtggtggcca

SEQ ID NO: 140768 - DNA, 25 bp, Mus musculus
tctgtgccggctacttcgactgcaa

SEQ ID NO: 140769 - DNA, 25 bp, Mus musculus
tctgtgcctacttagaaagggctgc

SEQ ID NO: 140770 - DNA, 25 bp, Mus musculus
tctgtgcctccaaggactgtctggc

SEQ ID NO: 140771 - DNA, 25 bp, Mus musculus
tctgtgcctcggacgggaggacctt

SEQ ID NO: 140772 - DNA, 25 bp, Mus musculus
tctgtgccttctaaatcgagcagag

SEQ ID NO: 140773 - DNA, 25 bp, Mus musculus
tctgtgcgaaaagaccatctccgtg

SEQ ID NO: 140774 - DNA, 25 bp, Mus musculus
tctgtgcgacatcaacgaaaggtcc

SEQ ID NO: 140775 - DNA, 25 bp, Mus musculus
tctgtgctacgagacctgagctgac

SEQ ID NO: 140776 - DNA, 25 bp, Mus musculus
tctgtgctccctcatcactttttat

SEQ ID NO: 140777 - DNA, 25 bp, Mus musculus
tctgtgctgccaacattgagtttac

SEQ ID NO: 140778 - DNA, 25 bp, Mus musculus
tctgtgctgcggtcccaaaatgtgc

SEQ ID NO: 140779 - DNA, 25 bp, Mus musculus
tctgtgcttaagaccgggaccacgg

SEQ ID NO: 140780 - DNA, 25 bp, Mus musculus
tctgtgcttgcaatcctgacctcat

SEQ ID NO: 140781 - DNA, 25 bp, Mus musculus
tctgtgcttgtagaagactgtaacc

SEQ ID NO: 140782 - DNA, 25 bp, Mus musculus
tctgtgcttgtaggacgacccgttc

SEQ ID NO: 140783 - DNA, 25 bp, Mus musculus
tctgtggaaataggttcactccttg

SEQ ID NO: 140784 - DNA, 25 bp, Mus musculus
tctgtggaaatggaaatccggcctc

SEQ ID NO: 140785 - DNA, 25 bp, Mus musculus
tctgtggaccaaaggatgacgcaac

SEQ ID NO: 140786 - DNA, 25 bp, Mus musculus
tctgtggacgaaatgtgaaggccct

SEQ ID NO: 140787 - DNA, 25 bp, Mus musculus
tctgtggacgggaaacaaactcagc

SEQ ID NO: 140788 - DNA, 25 bp, Mus musculus
tctgtggagacaggtagacaggctc

SEQ ID NO: 140789 - DNA, 25 bp, Mus musculus
tctgtggagacgactaggtctgtgc

SEQ ID NO: 140790 - DNA, 25 bp, Mus musculus
tctgtggagacgtcagagggcttcc

SEQ ID NO: 140791 - DNA, 25 bp, Mus musculus
tctgtggagctacaaatgctgacca

SEQ ID NO: 140792 - DNA, 25 bp, Mus musculus
tctgtggatctaccattgctggcct

SEQ ID NO: 140793 - DNA, 25 bp, Mus musculus
tctgtggcacaatcgagtacatggc

SEQ ID NO: 140794 - DNA, 25 bp, Mus musculus
tctgtggcacctatgagaacctcat

SEQ ID NO: 140795 - DNA, 25 bp, Mus musculus
tctgtggcagagcaactatcctagt

SEQ ID NO: 140796 - DNA, 25 bp, Mus musculus
tctgtggcaggagctttccgtaaag

SEQ ID NO: 140797 - DNA, 25 bp, Mus musculus
tctgtggccaggcttgaaaagcaca

SEQ ID NO: 140798 - DNA, 25 bp, Mus musculus
tctgtggccccggaaataacggagg

SEQ ID NO: 140799 - DNA, 25 bp, Mus musculus
tctgtggcctgggaaggaagaaacc

SEQ ID NO: 140800 - DNA, 25 bp, Mus musculus
tctgtggctcccacatgctcaggag

SEQ ID NO: 140801 - DNA, 25 bp, Mus musculus
tctgtggcttcaaccggactgtgcg

SEQ ID NO: 140802 - DNA, 25 bp, Mus musculus
tctgtgggaaactcacgcaggcttt

SEQ ID NO: 140803 - DNA, 25 bp, Mus musculus
tctgtgggagccaagcattaccata

SEQ ID NO: 140804 - DNA, 25 bp, Mus musculus
tctgtgggccatgtcaacgccaaca

SEQ ID NO: 140805 - DNA, 25 bp, Mus musculus
tctgtgggcggaagtctcgcagtcc

SEQ ID NO: 140806 - DNA, 25 bp, Mus musculus
tctgtgggtggcatgatctcttcct

SEQ ID NO: 140807 - DNA, 25 bp, Mus musculus
tctgtgggttcaagagcccgttggt

SEQ ID NO: 140808 - DNA, 25 bp, Mus musculus
tctgtggtctaaatttgcctggagg

SEQ ID NO: 140809 - DNA, 25 bp, Mus musculus
tctgtggtgacctcgtcatggcatc

SEQ ID NO: 140810 - DNA, 25 bp, Mus musculus
tctgtggtggcgctaacgactcttg

SEQ ID NO: 140811 - DNA, 25 bp, Mus musculus
tctgtggtgggtgatcaaaggccct

SEQ ID NO: 140812 - DNA, 25 bp, Mus musculus
tctgtggttttgagggcttgaagct

SEQ ID NO: 140813 - DNA, 25 bp, Mus musculus
tctgtgtaacttctcttctggatct

SEQ ID NO: 140814 - DNA, 25 bp, Mus musculus
tctgtgtacacatgagccatagctc

SEQ ID NO: 140815 - DNA, 25 bp, Mus musculus
tctgtgtacatggaggaatgtctcc

SEQ ID NO: 140816 - DNA, 25 bp, Mus musculus
tctgtgtaccgctcctgggtgcggg

SEQ ID NO: 140817 - DNA, 25 bp, Mus musculus
tctgtgtagcaaagaagtcccagca

SEQ ID NO: 140818 - DNA, 25 bp, Mus musculus
tctgtgtcactatgggaaaccgcaa

SEQ ID NO: 140819 - DNA, 25 bp, Mus musculus
tctgtgtcagatgaagatccactct

SEQ ID NO: 140820 - DNA, 25 bp, Mus musculus
tctgtgtcagggaaaagactgcacg

SEQ ID NO: 140821 - DNA, 25 bp, Mus musculus
tctgtgtccagaatagtccccagga

SEQ ID NO: 140822 - DNA, 25 bp, Mus musculus
tctgtgtccctacggcatagcgatg

SEQ ID NO: 140823 - DNA, 25 bp, Mus musculus
tctgtgtcctaatcaagaagggagc

SEQ ID NO: 140824 - DNA, 25 bp, Mus musculus
tctgtgtctgcaaccagagccatgg

SEQ ID NO: 140825 - DNA, 25 bp, Mus musculus
tctgtgtctgcgaggccaatgcaaa

SEQ ID NO: 140826 - DNA, 25 bp, Mus musculus
tctgtgtctggtagccgcctgcaga

SEQ ID NO: 140827 - DNA, 25 bp, Mus musculus
tctgtgtcttcaccagcagtagtgc

SEQ ID NO: 140828 - DNA, 25 bp, Mus musculus
tctgtgtgaattcaagccctggaca

SEQ ID NO: 140829 - DNA, 25 bp, Mus musculus
tctgtgtgactcagacagcagcctg

SEQ ID NO: 140830 - DNA, 25 bp, Mus musculus
tctgtgtgagggagaccaaccttcg

SEQ ID NO: 140831 - DNA, 25 bp, Mus musculus
tctgtgtgagtgaccatctgagact

SEQ ID NO: 140832 - DNA, 25 bp, Mus musculus
tctgtgtgccttcatgtggcctggc

SEQ ID NO: 140833 - DNA, 25 bp, Mus musculus
tctgtgtggtactagctgctggctc

SEQ ID NO: 140834 - DNA, 25 bp, Mus musculus
tctgtgtgtacaaagctagcgcgca

SEQ ID NO: 140835 - DNA, 25 bp, Mus musculus
tctgtgttagcacaccagagcggcg

SEQ ID NO: 140836 - DNA, 25 bp, Mus musculus
tctgtgttcaacaagcactgcatca

SEQ ID NO: 140837 - DNA, 25 bp, Mus musculus
tctgtgttcgactggcggctctgag

SEQ ID NO: 140838 - DNA, 25 bp, Mus musculus
tctgttaactgctttggaaactttg

SEQ ID NO: 140839 - DNA, 25 bp, Mus musculus
tctgttaatgggaagccggaagcac

SEQ ID NO: 140840 - DNA, 25 bp, Mus musculus
tctgttacggactagggagccaggc

SEQ ID NO: 140841 - DNA, 25 bp, Mus musculus
tctgttaggcggtcacacaaacccg

SEQ ID NO: 140842 - DNA, 25 bp, Mus musculus
tctgttcaacacgtcaggagatgcg

SEQ ID NO: 140843 - DNA, 25 bp, Mus musculus
tctgttcaagatggcgaaggacctg

SEQ ID NO: 140844 - DNA, 25 bp, Mus musculus
tctgttcagaaaaggaggtggccga

SEQ ID NO: 140845 - DNA, 25 bp, Mus musculus
tctgttcatcaccacatggccgagt

SEQ ID NO: 140846 - DNA, 25 bp, Mus musculus
tctgttcatggagctggtgacctgt

SEQ ID NO: 140847 - DNA, 25 bp, Mus musculus
tctgttcccatgtggtgaaggccag

SEQ ID NO: 140848 - DNA, 25 bp, Mus musculus
tctgttcccggaagttcagcctcaa

SEQ ID NO: 140849 - DNA, 25 bp, Mus musculus
tctgttcgtgtacccggaggagtcc

SEQ ID NO: 140850 - DNA, 25 bp, Mus musculus
tctgttctagagtacccgagcatta

SEQ ID NO: 140851 - DNA, 25 bp, Mus musculus
tctgttctaggtggagagtcattct

SEQ ID NO: 140852 - DNA, 25 bp, Mus musculus
tctgttctccgtctacactggcttc

SEQ ID NO: 140853 - DNA, 25 bp, Mus musculus
tctgttctccttagctggcagggcc

SEQ ID NO: 140854 - DNA, 25 bp, Mus musculus
tctgttctcggaagtggatgagcca

SEQ ID NO: 140855 - DNA, 25 bp, Mus musculus
tctgttctgggcagcttgcctgggc

SEQ ID NO: 140856 - DNA, 25 bp, Mus musculus
tctgttctgtccgtgagggctttcc

SEQ ID NO: 140857 - DNA, 25 bp, Mus musculus
tctgttcttaagcaggcatcgcgtg

SEQ ID NO: 140858 - DNA, 25 bp, Mus musculus
tctgttgaaatagtccacggcatta

SEQ ID NO: 140859 - DNA, 25 bp, Mus musculus
tctgttgaagggagaagatgccact

SEQ ID NO: 140860 - DNA, 25 bp, Mus musculus
tctgttgacagtgaggatcattggc

SEQ ID NO: 140861 - DNA, 25 bp, Mus musculus
tctgttgacttctccggctgctggc

SEQ ID NO: 140862 - DNA, 25 bp, Mus musculus
tctgttgagaacatcgtccgagatt

SEQ ID NO: 140863 - DNA, 25 bp, Mus musculus
tctgttgcacgactgtaggccccag

SEQ ID NO: 140864 - DNA, 25 bp, Mus musculus
tctgttgccgttgaaatgagagcag

SEQ ID NO: 140865 - DNA, 25 bp, Mus musculus
tctgttgcctcctgcccaaatggga

SEQ ID NO: 140866 - DNA, 25 bp, Mus musculus
tctgttgctaaaatcgatccttcgg

SEQ ID NO: 140867 - DNA, 25 bp, Mus musculus
tctgttggaagtacacgagcaaacc

SEQ ID NO: 140868 - DNA, 25 bp, Mus musculus
tctgttggagaccagctagaggcac

SEQ ID NO: 140869 - DNA, 25 bp, Mus musculus
tctgttggccggaggactaagcctc

SEQ ID NO: 140870 - DNA, 25 bp, Mus musculus
tctgttgggacccagctaacacagc

SEQ ID NO: 140871 - DNA, 25 bp, Mus musculus
tctgttgtcatcacgcagcaggcag

SEQ ID NO: 140872 - DNA, 25 bp, Mus musculus
tctgttgtccagacgggcacatgca

SEQ ID NO: 140873 - DNA, 25 bp, Mus musculus
tctgttgtctactgccacggagggc

SEQ ID NO: 140874 - DNA, 25 bp, Mus musculus
tctgttgtgtgtaggactgcggcca

SEQ ID NO: 140875 - DNA, 25 bp, Mus musculus
tctgttgttaggcaaaggctggccc

SEQ ID NO: 140876 - DNA, 25 bp, Mus musculus
tctgttgttctaggtgaacggctgt

SEQ ID NO: 140877 - DNA, 25 bp, Mus musculus
tctgtttatagaagcgtcaagaggc

SEQ ID NO: 140878 - DNA, 25 bp, Mus musculus
tctgtttccaaggactctgttctgc

SEQ ID NO: 140879 - DNA, 25 bp, Mus musculus
tctgtttccaatgggcccagaagcg

SEQ ID NO: 140880 - DNA, 25 bp, Mus musculus
tctgtttgacaaccggacgtgggtc

SEQ ID NO: 140881 - DNA, 25 bp, Mus musculus
tctgtttgctgctccgagaggctga

SEQ ID NO: 140882 - DNA, 25 bp, Mus musculus
tctgtttggaaccacggatgccgtg

SEQ ID NO: 140883 - DNA, 25 bp, Mus musculus
tctgtttgggagatgcactgctgtc

SEQ ID NO: 140884 - DNA, 25 bp, Mus musculus
tctgtttgtagggacgtgcacaccc

SEQ ID NO: 140885 - DNA, 25 bp, Mus musculus
tctgttttacccgtatgaggtggac

SEQ ID NO: 140886 - DNA, 25 bp, Mus musculus
tctgtttttggcatctgtaggtgaa

SEQ ID NO: 140887 - DNA, 25 bp, Mus musculus
tctgttttttcagggcctagcaggg

SEQ ID NO: 140888 - DNA, 25 bp, Mus musculus
tcttaaaaacttgggtgagattctg

SEQ ID NO: 140889 - DNA, 25 bp, Mus musculus
tcttaaaacgaatgcaggccctgga

SEQ ID NO: 140890 - DNA, 25 bp, Mus musculus
tcttaaacgaagaagaattaataca

SEQ ID NO: 140891 - DNA, 25 bp, Mus musculus
tcttaaagcatgagaagacgccact

SEQ ID NO: 140892 - DNA, 25 bp, Mus musculus
tcttaaaggacaccagagcatctgg

SEQ ID NO: 140893 - DNA, 25 bp, Mus musculus
tcttaaagggattcaggaagaccac

SEQ ID NO: 140894 - DNA, 25 bp, Mus musculus
tcttaaaggtaagagggctcactcc

SEQ ID NO: 140895 - DNA, 25 bp, Mus musculus
tcttaaagtagccaccatgatgtca

SEQ ID NO: 140896 - DNA, 25 bp, Mus musculus
tcttaaatgtggactccaggagccg

SEQ ID NO: 140897 - DNA, 25 bp, Mus musculus
tcttaacaacatacagggctctggg

SEQ ID NO: 140898 - DNA, 25 bp, Mus musculus
tcttaacatgcttcagataaatcag

SEQ ID NO: 140899 - DNA, 25 bp, Mus musculus
tcttaaccagaatcaccttgtgagc

SEQ ID NO: 140900 - DNA, 25 bp, Mus musculus
tcttaacttagctgaagactgcatg

SEQ ID NO: 140901 - DNA, 25 bp, Mus musculus
tcttaacttcaaatgttatgggccc

SEQ ID NO: 140902 - DNA, 25 bp, Mus musculus
tcttaagacaaggtgacagcccatg

SEQ ID NO: 140903 - DNA, 25 bp, Mus musculus
tcttaagaccttgtggaacaacgga

SEQ ID NO: 140904 - DNA, 25 bp, Mus musculus
tcttaagatttttagagtctccaga

SEQ ID NO: 140905 - DNA, 25 bp, Mus musculus
tcttaaggccacaggatacagaagt

SEQ ID NO: 140906 - DNA, 25 bp, Mus musculus
tcttaagtcaacctgtccaagccca

SEQ ID NO: 140907 - DNA, 25 bp, Mus musculus
tcttaataaaactggaggtgccaag

SEQ ID NO: 140908 - DNA, 25 bp, Mus musculus
tcttaatactagtttggcatccact

SEQ ID NO: 140909 - DNA, 25 bp, Mus musculus
tcttaatcctactcagtgaagctgt

SEQ ID NO: 140910 - DNA, 25 bp, Mus musculus
tcttaatcgagaatggcctgctgaa

SEQ ID NO: 140911 - DNA, 25 bp, Mus musculus
tcttaatcgcacaggagatccaggc

SEQ ID NO: 140912 - DNA, 25 bp, Mus musculus
tcttaatcgctcctggaacagcaga

SEQ ID NO: 140913 - DNA, 25 bp, Mus musculus
tcttaatgaaaagcccaaccttgtg

SEQ ID NO: 140914 - DNA, 25 bp, Mus musculus
tcttacaattaggtggctgacgagc

SEQ ID NO: 140915 - DNA, 25 bp, Mus musculus
tcttacagcaaaggcagtgtctctg

SEQ ID NO: 140916 - DNA, 25 bp, Mus musculus
tcttacaggatagagaccaggaaag

SEQ ID NO: 140917 - DNA, 25 bp, Mus musculus
tcttacaggtcatcagacggccgga

SEQ ID NO: 140918 - DNA, 25 bp, Mus musculus
tcttacattggagaacaccaccgag

SEQ ID NO: 140919 - DNA, 25 bp, Mus musculus
tcttaccaagatgaagcagcaggca

SEQ ID NO: 140920 - DNA, 25 bp, Mus musculus
tcttacctctgatggcctagggcaa

SEQ ID NO: 140921 - DNA, 25 bp, Mus musculus
tcttacgacgaggatgacatggttc

SEQ ID NO: 140922 - DNA, 25 bp, Mus musculus
tcttacgcagagaattaagttgcct

SEQ ID NO: 140923 - DNA, 25 bp, Mus musculus
tcttacggagagtcaaaacctgcaa

SEQ ID NO: 140924 - DNA, 25 bp, Mus musculus
tcttacgtcatccaggcccaaggaa

SEQ ID NO: 140925 - DNA, 25 bp, Mus musculus
tcttactaaaagacgccaaggagga

SEQ ID NO: 140926 - DNA, 25 bp, Mus musculus
tcttactaacaaccagacactgaag

SEQ ID NO: 140927 - DNA, 25 bp, Mus musculus
tcttactaggacttacggtgcggtg

SEQ ID NO: 140928 - DNA, 25 bp, Mus musculus
tcttactcaatggtggtcgtcccgc

SEQ ID NO: 140929 - DNA, 25 bp, Mus musculus
tcttactcggctatcacggaggctg

SEQ ID NO: 140930 - DNA, 25 bp, Mus musculus
tcttactgctgaggcactgggccct

SEQ ID NO: 140931 - DNA, 25 bp, Mus musculus
tcttactggaaagaaggccgctggg

SEQ ID NO: 140932 - DNA, 25 bp, Mus musculus
tcttactggagaaagtgagtcatca

SEQ ID NO: 140933 - DNA, 25 bp, Mus musculus
tcttactgggctccctgccaacctg

SEQ ID NO: 140934 - DNA, 25 bp, Mus musculus
tcttagaaataggagaaacagttca

SEQ ID NO: 140935 - DNA, 25 bp, Mus musculus
tcttagaagaccttagtgaccgcaa

SEQ ID NO: 140936 - DNA, 25 bp, Mus musculus
tcttagacatctgggctagtggccg

SEQ ID NO: 140937 - DNA, 25 bp, Mus musculus
tcttagagactgactgccacgtgct

SEQ ID NO: 140938 - DNA, 25 bp, Mus musculus
tcttagagcagaagacgctgagccc

SEQ ID NO: 140939 - DNA, 25 bp, Mus musculus
tcttagaggatgatttagcctggca

SEQ ID NO: 140940 - DNA, 25 bp, Mus musculus
tcttagaggctaccagagaggcagt

SEQ ID NO: 140941 - DNA, 25 bp, Mus musculus
tcttagatccttcaccttcaggtcg

SEQ ID NO: 140942 - DNA, 25 bp, Mus musculus
tcttagatgaacacccagatgcagt

SEQ ID NO: 140943 - DNA, 25 bp, Mus musculus
tcttagatgagttttgcaatgtgaa

SEQ ID NO: 140944 - DNA, 25 bp, Mus musculus
tcttagatggtacaaggcccaggag

SEQ ID NO: 140945 - DNA, 25 bp, Mus musculus
tcttagcaatggacggaggccacgg

SEQ ID NO: 140946 - DNA, 25 bp, Mus musculus
tcttagcagctaaaaggcggtgcct

SEQ ID NO: 140947 - DNA, 25 bp, Mus musculus
tcttagcaggaaggcactaggctct

SEQ ID NO: 140948 - DNA, 25 bp, Mus musculus
tcttagcatgtcagaagaggaccag

SEQ ID NO: 140949 - DNA, 25 bp, Mus musculus
tcttagccggaggatcactcagagc

SEQ ID NO: 140950 - DNA, 25 bp, Mus musculus
tcttagccgtgaaagacaatcaggg

SEQ ID NO: 140951 - DNA, 25 bp, Mus musculus
tcttagctgcgcagtttccccgaag

SEQ ID NO: 140952 - DNA, 25 bp, Mus musculus
tcttagctggacacgacaaccgagt

SEQ ID NO: 140953 - DNA, 25 bp, Mus musculus
tcttagctgggaagtgtaactccgc

SEQ ID NO: 140954 - DNA, 25 bp, Mus musculus
tcttagcttcttccacgaatgttga

SEQ ID NO: 140955 - DNA, 25 bp, Mus musculus
tcttagcttgtaggagaactccagc

SEQ ID NO: 140956 - DNA, 25 bp, Mus musculus
tcttaggactcactcgccgtgtggc

SEQ ID NO: 140957 - DNA, 25 bp, Mus musculus
tcttaggagctaaggcctctgcggg

SEQ ID NO: 140958 - DNA, 25 bp, Mus musculus
tcttaggatccctcccagaaacctg

SEQ ID NO: 140959 - DNA, 25 bp, Mus musculus
tcttaggccatgtcgagacgtgacg

SEQ ID NO: 140960 - DNA, 25 bp, Mus musculus
tcttagggacatgcttccagtgccg

SEQ ID NO: 140961 - DNA, 25 bp, Mus musculus
tcttaggtagaagcaccctggtctg

SEQ ID NO: 140962 - DNA, 25 bp, Mus musculus
tcttaggtttgcagcatggtgggca

SEQ ID NO: 140963 - DNA, 25 bp, Mus musculus
tcttagtagaacgagctggacgacg

SEQ ID NO: 140964 - DNA, 25 bp, Mus musculus
tcttagtcttgtatccgagggacct

SEQ ID NO: 140965 - DNA, 25 bp, Mus musculus
tcttagtgacataaacatcgcgtcc

SEQ ID NO: 140966 - DNA, 25 bp, Mus musculus
tcttagtgatggactcaggaattca

SEQ ID NO: 140967 - DNA, 25 bp, Mus musculus
tcttagtgccctgcaaggcttcggc

SEQ ID NO: 140968 - DNA, 25 bp, Mus musculus
tcttatacgtggtgctgcgggccag

SEQ ID NO: 140969 - DNA, 25 bp, Mus musculus
tcttatagcagcaagggagccctgg

SEQ ID NO: 140970 - DNA, 25 bp, Mus musculus
tcttatagtggaccaggaagcgccc

SEQ ID NO: 140971 - DNA, 25 bp, Mus musculus
tcttatcaataacttgctacaagtg

SEQ ID NO: 140972 - DNA, 25 bp, Mus musculus
tcttatcccggaaactgaacagtgg

SEQ ID NO: 140973 - DNA, 25 bp, Mus musculus
tcttatcggagacaactggttgacc

SEQ ID NO: 140974 - DNA, 25 bp, Mus musculus
tcttatctaagttctatatgggcca

SEQ ID NO: 140975 - DNA, 25 bp, Mus musculus
tcttatgaaattattactccttgga

SEQ ID NO: 140976 - DNA, 25 bp, Mus musculus
tcttatgcaagctacatgatggctg

SEQ ID NO: 140977 - DNA, 25 bp, Mus musculus
tcttatgcagggagggacacagcaa

SEQ ID NO: 140978 - DNA, 25 bp, Mus musculus
tcttatggaaaaggacgacagcgca

SEQ ID NO: 140979 - DNA, 25 bp, Mus musculus
tcttatggcacaaatgcaagggccc

SEQ ID NO: 140980 - DNA, 25 bp, Mus musculus
tcttatggctgctttggacccgcgt

SEQ ID NO: 140981 - DNA, 25 bp, Mus musculus
tcttatgggaggagtcgcctggtca

SEQ ID NO: 140982 - DNA, 25 bp, Mus musculus
tcttattaaggcagctgacaaggcc

SEQ ID NO: 140983 - DNA, 25 bp, Mus musculus
tcttattctacatgggctggctgaa

SEQ ID NO: 140984 - DNA, 25 bp, Mus musculus
tcttcaaagacacttcaggctgagg

SEQ ID NO: 140985 - DNA, 25 bp, Mus musculus
tcttcaaagaccagctggtgtaccc

SEQ ID NO: 140986 - DNA, 25 bp, Mus musculus
tcttcaaagcactgcctcttcatgg

SEQ ID NO: 140987 - DNA, 25 bp, Mus musculus
tcttcaaagcggaggagaatatcct

SEQ ID NO: 140988 - DNA, 25 bp, Mus musculus
tcttcaaagtactgcagctggaggt

SEQ ID NO: 140989 - DNA, 25 bp, Mus musculus
tcttcaaagtgctcaggcgtctgtc

SEQ ID NO: 140990 - DNA, 25 bp, Mus musculus
tcttcaacctgtacccgaggaaagg

SEQ ID NO: 140991 - DNA, 25 bp, Mus musculus
tcttcaacgtcagtctggacgcggc

SEQ ID NO: 140992 - DNA, 25 bp, Mus musculus
tcttcaagaacaacctcagagctct

SEQ ID NO: 140993 - DNA, 25 bp, Mus musculus
tcttcaagaaggagcaagccatgtg

SEQ ID NO: 140994 - DNA, 25 bp, Mus musculus
tcttcaagaatggagacacagcctc

SEQ ID NO: 140995 - DNA, 25 bp, Mus musculus
tcttcaagacagaacagggcggaca

SEQ ID NO: 140996 - DNA, 25 bp, Mus musculus
tcttcaagcaggaagagccgcagct

SEQ ID NO: 140997 - DNA, 25 bp, Mus musculus
tcttcaagcgagtggctgccatgca

SEQ ID NO: 140998 - DNA, 25 bp, Mus musculus
tcttcaagcgcacagtccagaacaa

SEQ ID NO: 140999 - DNA, 25 bp, Mus musculus
tcttcaagctagtttcgatcctgtg

SEQ ID NO: 141000 - DNA, 25 bp, Mus musculus
tcttcaaggaaacaagagggtccac

SEQ ID NO: 141001 - DNA, 25 bp, Mus musculus
tcttcaaggcagttcccatgactct

SEQ ID NO: 141002 - DNA, 25 bp, Mus musculus
tcttcaaggtcatggccactgggtg

SEQ ID NO: 141003 - DNA, 25 bp, Mus musculus
tcttcaatgaagataacgtgggacc

SEQ ID NO: 141004 - DNA, 25 bp, Mus musculus
tcttcacacagcattatgtcagtag

SEQ ID NO: 141005 - DNA, 25 bp, Mus musculus
tcttcacagaagtcgtgggccagaa

SEQ ID NO: 141006 - DNA, 25 bp, Mus musculus
tcttcacagagagcactcgtgggct

SEQ ID NO: 141007 - DNA, 25 bp, Mus musculus
tcttcacagagctggtggacgccgt

SEQ ID NO: 141008 - DNA, 25 bp, Mus musculus
tcttcacagcggatgagtgtgtggc

SEQ ID NO: 141009 - DNA, 25 bp, Mus musculus
tcttcacatacgactgcagtactgc

SEQ ID NO: 141010 - DNA, 25 bp, Mus musculus
tcttcacattggtcggtgggcacat

SEQ ID NO: 141011 - DNA, 25 bp, Mus musculus
tcttcaccagcacccagtgtaaggt

SEQ ID NO: 141012 - DNA, 25 bp, Mus musculus
tcttcacccgggaccagagttgtcc

SEQ ID NO: 141013 - DNA, 25 bp, Mus musculus
tcttcacggatgacgacaaacagga

SEQ ID NO: 141014 - DNA, 25 bp, Mus musculus
tcttcacgggtcacatggggaagct

SEQ ID NO: 141015 - DNA, 25 bp, Mus musculus
tcttcacgggtgatgcctatgtcat

SEQ ID NO: 141016 - DNA, 25 bp, Mus musculus
tcttcactcgggatatcaacaaggc

SEQ ID NO: 141017 - DNA, 25 bp, Mus musculus
tcttcactgggcactaactgggtcc

SEQ ID NO: 141018 - DNA, 25 bp, Mus musculus
tcttcacttctacaaatggacgtcg

SEQ ID NO: 141019 - DNA, 25 bp, Mus musculus
tcttcagaaacatgcccttggtggg

SEQ ID NO: 141020 - DNA, 25 bp, Mus musculus
tcttcagaaactgtactggctcttg

SEQ ID NO: 141021 - DNA, 25 bp, Mus musculus
tcttcagaaggtccgcatgcacgtg

SEQ ID NO: 141022 - DNA, 25 bp, Mus musculus
tcttcagaataggtgcagacccctc

SEQ ID NO: 141023 - DNA, 25 bp, Mus musculus
tcttcagactacgaggacgacgaca

SEQ ID NO: 141024 - DNA, 25 bp, Mus musculus
tcttcagaggctgtaaaaatgccgg

SEQ ID NO: 141025 - DNA, 25 bp, Mus musculus
tcttcagagggtggctacaaatcct

SEQ ID NO: 141026 - DNA, 25 bp, Mus musculus
tcttcagaggttacgagcaaaggga

SEQ ID NO: 141027 - DNA, 25 bp, Mus musculus
tcttcagataaaccaagatggtttt

SEQ ID NO: 141028 - DNA, 25 bp, Mus musculus
tcttcagatggacctaggatgggct

SEQ ID NO: 141029 - DNA, 25 bp, Mus musculus
tcttcagcagctagatgaaaggtgt

SEQ ID NO: 141030 - DNA, 25 bp, Mus musculus
tcttcagccatgtatgtaggtcaca

SEQ ID NO: 141031 - DNA, 25 bp, Mus musculus
tcttcagcgcagtgacaccgtgtca

SEQ ID NO: 141032 - DNA, 25 bp, Mus musculus
tcttcagcgccagagagttcatcct

SEQ ID NO: 141033 - DNA, 25 bp, Mus musculus
tcttcagctcctgggtgcagtgtgc

SEQ ID NO: 141034 - DNA, 25 bp, Mus musculus
tcttcagctgccacacaggctatgg

SEQ ID NO: 141035 - DNA, 25 bp, Mus musculus
tcttcagcttagactcagagggccc

SEQ ID NO: 141036 - DNA, 25 bp, Mus musculus
tcttcaggaaaatcccggctagtgc

SEQ ID NO: 141037 - DNA, 25 bp, Mus musculus
tcttcaggagggtctatgtgcaacg

SEQ ID NO: 141038 - DNA, 25 bp, Mus musculus
tcttcaggagttgccaaagtgggag

SEQ ID NO: 141039 - DNA, 25 bp, Mus musculus
tcttcaggatgcaaacaggacttca

SEQ ID NO: 141040 - DNA, 25 bp, Mus musculus
tcttcaggctctagattgctaccgc

SEQ ID NO: 141041 - DNA, 25 bp, Mus musculus
tcttcagggaactgacactgggccc

SEQ ID NO: 141042 - DNA, 25 bp, Mus musculus
tcttcagggacatgcaccagggtct

SEQ ID NO: 141043 - DNA, 25 bp, Mus musculus
tcttcagggatccagacatgtccga

SEQ ID NO: 141044 - DNA, 25 bp, Mus musculus
tcttcagggcttctcagtggacaaa

SEQ ID NO: 141045 - DNA, 25 bp, Mus musculus
tcttcagggtctaagtgaggacaca

SEQ ID NO: 141046 - DNA, 25 bp, Mus musculus
tcttcaggtgggaatgtgtgatgcc

SEQ ID NO: 141047 - DNA, 25 bp, Mus musculus
tcttcagtcacatgcacgcggagtt

SEQ ID NO: 141048 - DNA, 25 bp, Mus musculus
tcttcagtggattcgggagaacatc

SEQ ID NO: 141049 - DNA, 25 bp, Mus musculus
tcttcagtgtgtccagtgcggcctt

SEQ ID NO: 141050 - DNA, 25 bp, Mus musculus
tcttcagtgttacagtaggtgccgg

SEQ ID NO: 141051 - DNA, 25 bp, Mus musculus
tcttcagttgccagagacagaactg

SEQ ID NO: 141052 - DNA, 25 bp, Mus musculus
tcttcataaagctgtagagactggg

SEQ ID NO: 141053 - DNA, 25 bp, Mus musculus
tcttcataacagtgggctgctaagc

SEQ ID NO: 141054 - DNA, 25 bp, Mus musculus
tcttcataggacagcagatcgggag

SEQ ID NO: 141055 - DNA, 25 bp, Mus musculus
tcttcatcaaccaaggagcctccag

SEQ ID NO: 141056 - DNA, 25 bp, Mus musculus
tcttcatcaagctcacaaagcaaag

SEQ ID NO: 141057 - DNA, 25 bp, Mus musculus
tcttcatccacggaggattggcagg

SEQ ID NO: 141058 - DNA, 25 bp, Mus musculus
tcttcatcccaggtggccttggaaa

SEQ ID NO: 141059 - DNA, 25 bp, Mus musculus
tcttcatcgctgagattgcaggtgc

SEQ ID NO: 141060 - DNA, 25 bp, Mus musculus
tcttcatctactgcgctgtcaaggg

SEQ ID NO: 141061 - DNA, 25 bp, Mus musculus
tcttcatgaaagcaacccagctcga

SEQ ID NO: 141062 - DNA, 25 bp, Mus musculus
tcttcatgagacagaggatagacaa

SEQ ID NO: 141063 - DNA, 25 bp, Mus musculus
tcttcatgagctacttcccacgagg

SEQ ID NO: 141064 - DNA, 25 bp, Mus musculus
tcttcatggaggagcacggagtgac

SEQ ID NO: 141065 - DNA, 25 bp, Mus musculus
tcttcatggcatacaaggacaggtg

SEQ ID NO: 141066 - DNA, 25 bp, Mus musculus
tcttcatggcgtgctaagccagtgc

SEQ ID NO: 141067 - DNA, 25 bp, Mus musculus
tcttcatgggaaagacaagcccctc

SEQ ID NO: 141068 - DNA, 25 bp, Mus musculus
tcttcatggtagacctctggcaccc

SEQ ID NO: 141069 - DNA, 25 bp, Mus musculus
tcttcattctgacaatccgggcgtt

SEQ ID NO: 141070 - DNA, 25 bp, Mus musculus
tcttcattgcgagcgatcctgtccg

SEQ ID NO: 141071 - DNA, 25 bp, Mus musculus
tcttccaaatgatctagagccaagg

SEQ ID NO: 141072 - DNA, 25 bp, Mus musculus
tcttccaacggctctggcagctgca

SEQ ID NO: 141073 - DNA, 25 bp, Mus musculus
tcttccaacgtaaacggtgggcctg

SEQ ID NO: 141074 - DNA, 25 bp, Mus musculus
tcttccaagctagagaggtcagagg

SEQ ID NO: 141075 - DNA, 25 bp, Mus musculus
tcttccaagtatccctctgcagggc

SEQ ID NO: 141076 - DNA, 25 bp, Mus musculus
tcttccaagtgtgattcaactagag

SEQ ID NO: 141077 - DNA, 25 bp, Mus musculus
tcttccaataagagcgtttgtgtgg

SEQ ID NO: 141078 - DNA, 25 bp, Mus musculus
tcttccacgaacagatattatgtca

SEQ ID NO: 141079 - DNA, 25 bp, Mus musculus
tcttccactgggaaagactggattc

SEQ ID NO: 141080 - DNA, 25 bp, Mus musculus
tcttccagaagagcggtgtgtttca

SEQ ID NO: 141081 - DNA, 25 bp, Mus musculus
tcttccagatgtggtaatgaacggg

SEQ ID NO: 141082 - DNA, 25 bp, Mus musculus
tcttccagcgatggagtcggagctg

SEQ ID NO: 141083 - DNA, 25 bp, Mus musculus
tcttccaggacaatcatctgctcaa

SEQ ID NO: 141084 - DNA, 25 bp, Mus musculus
tcttccaggatgatgtgttcccgga

SEQ ID NO: 141085 - DNA, 25 bp, Mus musculus
tcttccaggctttgaggcacgtcgg

SEQ ID NO: 141086 - DNA, 25 bp, Mus musculus
tcttccagggcaaaagtacacctaa

SEQ ID NO: 141087 - DNA, 25 bp, Mus musculus
tcttccagtcggaatgggacgtcgc

SEQ ID NO: 141088 - DNA, 25 bp, Mus musculus
tcttccagttggttgccaccgtgcg

SEQ ID NO: 141089 - DNA, 25 bp, Mus musculus
tcttccatcaggacaagcggctact

SEQ ID NO: 141090 - DNA, 25 bp, Mus musculus
tcttccatgatgttgctgtgctgac

SEQ ID NO: 141091 - DNA, 25 bp, Mus musculus
tcttccattacatcagcagctgcag

SEQ ID NO: 141092 - DNA, 25 bp, Mus musculus
tcttcccaagagaggaggagctttg

SEQ ID NO: 141093 - DNA, 25 bp, Mus musculus
tcttcccatggcagcacgctggact

SEQ ID NO: 141094 - DNA, 25 bp, Mus musculus
tcttccccaggaggaccgatgagga

SEQ ID NO: 141095 - DNA, 25 bp, Mus musculus
tcttccccagtgattgtacttttca

SEQ ID NO: 141096 - DNA, 25 bp, Mus musculus
tcttcccctggatacacattggtga

SEQ ID NO: 141097 - DNA, 25 bp, Mus musculus
tcttcccgagcgagctaacggcgat

SEQ ID NO: 141098 - DNA, 25 bp, Mus musculus
tcttcccgaggaaatcgacgacgtc

SEQ ID NO: 141099 - DNA, 25 bp, Mus musculus
tcttcccgggtcgagagatcatcca

SEQ ID NO: 141100 - DNA, 25 bp, Mus musculus
tcttccctcacctgactgtggtact

SEQ ID NO: 141101 - DNA, 25 bp, Mus musculus
tcttccctggcgagttagaagctgc

SEQ ID NO: 141102 - DNA, 25 bp, Mus musculus
tcttccctgggctataacggtgcca

SEQ ID NO: 141103 - DNA, 25 bp, Mus musculus
tcttccgaacatggatggtgccagc

SEQ ID NO: 141104 - DNA, 25 bp, Mus musculus
tcttccgaagaatacaggatcccct

SEQ ID NO: 141105 - DNA, 25 bp, Mus musculus
tcttccgacaccatgagctccttga

SEQ ID NO: 141106 - DNA, 25 bp, Mus musculus
tcttccgagggctacaaagtgaccg

SEQ ID NO: 141107 - DNA, 25 bp, Mus musculus
tcttccgcccaagagagtgctggga

SEQ ID NO: 141108 - DNA, 25 bp, Mus musculus
tcttccgcgcgttgccaggttataa

SEQ ID NO: 141109 - DNA, 25 bp, Mus musculus
tcttccggacaaccatcaacagggc

SEQ ID NO: 141110 - DNA, 25 bp, Mus musculus
tcttccggcatcaggatgtggccac

SEQ ID NO: 141111 - DNA, 25 bp, Mus musculus
tcttccgggagatacatgccagtct

SEQ ID NO: 141112 - DNA, 25 bp, Mus musculus
tcttccgtaacgagagccacgtcag

SEQ ID NO: 141113 - DNA, 25 bp, Mus musculus
tcttccgtcgctttggagattggag

SEQ ID NO: 141114 - DNA, 25 bp, Mus musculus
tcttccgtgagcaacatgaacgccg

SEQ ID NO: 141115 - DNA, 25 bp, Mus musculus
tcttccgtgtgggtgaggactggta

SEQ ID NO: 141116 - DNA, 25 bp, Mus musculus
tcttcctcactatcattcttctggt

SEQ ID NO: 141117 - DNA, 25 bp, Mus musculus
tcttcctccgggtaccaacgctatt

SEQ ID NO: 141118 - DNA, 25 bp, Mus musculus
tcttcctcgtgatgggcttctggac

SEQ ID NO: 141119 - DNA, 25 bp, Mus musculus
tcttcctctacatgggtgtggcctc

SEQ ID NO: 141120 - DNA, 25 bp, Mus musculus
tcttcctctggagaaaagaaaccgg

SEQ ID NO: 141121 - DNA, 25 bp, Mus musculus
tcttcctgacggagtatgccgggcc

SEQ ID NO: 141122 - DNA, 25 bp, Mus musculus
tcttcctgagaagagtgcaccagca

SEQ ID NO: 141123 - DNA, 25 bp, Mus musculus
tcttcctgagggagccttttctgtc

SEQ ID NO: 141124 - DNA, 25 bp, Mus musculus
tcttcctgaggtgataaacacatgg

SEQ ID NO: 141125 - DNA, 25 bp, Mus musculus
tcttcctgatgacaggtggcccagg

SEQ ID NO: 141126 - DNA, 25 bp, Mus musculus
tcttcctgatggatgggagcaagcc

SEQ ID NO: 141127 - DNA, 25 bp, Mus musculus
tcttcctgcgcctaggtatggcgag

SEQ ID NO: 141128 - DNA, 25 bp, Mus musculus
tcttcctggcaatgtggagggaccc

SEQ ID NO: 141129 - DNA, 25 bp, Mus musculus
tcttcctggccgtcgggtcccttgt

SEQ ID NO: 141130 - DNA, 25 bp, Mus musculus
tcttcctggtcaacctgagcctggg

SEQ ID NO: 141131 - DNA, 25 bp, Mus musculus
tcttcctgtgtatggcaagctccag

SEQ ID NO: 141132 - DNA, 25 bp, Mus musculus
tcttcctgtgtctcgcgtgggcagc

SEQ ID NO: 141133 - DNA, 25 bp, Mus musculus
tcttccttcgtgaggttggccaacc

SEQ ID NO: 141134 - DNA, 25 bp, Mus musculus
tcttccttttctgagctggctatgg

SEQ ID NO: 141135 - DNA, 25 bp, Mus musculus
tcttcgaaatagaaagccacaccat

SEQ ID NO: 141136 - DNA, 25 bp, Mus musculus
tcttcgaagctatcagggaactgcg

SEQ ID NO: 141137 - DNA, 25 bp, Mus musculus
tcttcgaagctgtaaatgaggcctt

SEQ ID NO: 141138 - DNA, 25 bp, Mus musculus
tcttcgaatcaagtctgtagagccg

SEQ ID NO: 141139 - DNA, 25 bp, Mus musculus
tcttcgacagggaattgaagaggaa

SEQ ID NO: 141140 - DNA, 25 bp, Mus musculus
tcttcgacatcacagaagggaacct

SEQ ID NO: 141141 - DNA, 25 bp, Mus musculus
tcttcgacgccaggaacaggatcat

SEQ ID NO: 141142 - DNA, 25 bp, Mus musculus
tcttcgacggtatttcatcctggat

SEQ ID NO: 141143 - DNA, 25 bp, Mus musculus
tcttcgactccacgactcttgaaca

SEQ ID NO: 141144 - DNA, 25 bp, Mus musculus
tcttcgagaattcctgtggcagcac

SEQ ID NO: 141145 - DNA, 25 bp, Mus musculus
tcttcgagagttctgggcactaagc

SEQ ID NO: 141146 - DNA, 25 bp, Mus musculus
tcttcgagatggaactggaccctca

SEQ ID NO: 141147 - DNA, 25 bp, Mus musculus
tcttcgagcaggagagcttcgacca

SEQ ID NO: 141148 - DNA, 25 bp, Mus musculus
tcttcgagcggttgccagagctgtc

SEQ ID NO: 141149 - DNA, 25 bp, Mus musculus
tcttcgaggaaaccggaagcccgtg

SEQ ID NO: 141150 - DNA, 25 bp, Mus musculus
tcttcgaggcccagttcagcttgag

SEQ ID NO: 141151 - DNA, 25 bp, Mus musculus
tcttcgaggcttggaaaccactgcc

SEQ ID NO: 141152 - DNA, 25 bp, Mus musculus
tcttcgagtcaacgtaggacagctg

SEQ ID NO: 141153 - DNA, 25 bp, Mus musculus
tcttcgatgaactgcggagactcgg

SEQ ID NO: 141154 - DNA, 25 bp, Mus musculus
tcttcgatgtaaggcccgagtgcca

SEQ ID NO: 141155 - DNA, 25 bp, Mus musculus
tcttcgcaaacgtggtgtacgcctg

SEQ ID NO: 141156 - DNA, 25 bp, Mus musculus
tcttcgcgctaagcagcaagctgtg

SEQ ID NO: 141157 - DNA, 25 bp, Mus musculus
tcttcgcggacatgggattgcccag

SEQ ID NO: 141158 - DNA, 25 bp, Mus musculus
tcttcgcggcatttaataaagttgc

SEQ ID NO: 141159 - DNA, 25 bp, Mus musculus
tcttcgctgacaagggtatggaccc

SEQ ID NO: 141160 - DNA, 25 bp, Mus musculus
tcttcgctggccttagtggagctgg

SEQ ID NO: 141161 - DNA, 25 bp, Mus musculus
tcttcgctgtctataaacctccggg

SEQ ID NO: 141162 - DNA, 25 bp, Mus musculus
tcttcggagcaccaagcaggaatgg

SEQ ID NO: 141163 - DNA, 25 bp, Mus musculus
tcttcggagtcagagggaacaggcc

SEQ ID NO: 141164 - DNA, 25 bp, Mus musculus
tcttcggcgtcgttgtgtacactgg

SEQ ID NO: 141165 - DNA, 25 bp, Mus musculus
tcttcggctacagctggaacagcag

SEQ ID NO: 141166 - DNA, 25 bp, Mus musculus
tcttcggctgtcgagaatcttaaag

SEQ ID NO: 141167 - DNA, 25 bp, Mus musculus
tcttcggcttccgtagacgaggtcg

SEQ ID NO: 141168 - DNA, 25 bp, Mus musculus
tcttcgggaccctagtggagcagga

SEQ ID NO: 141169 - DNA, 25 bp, Mus musculus
tcttcgggacctgactgaacagtgg

SEQ ID NO: 141170 - DNA, 25 bp, Mus musculus
tcttcgggaggtagagacctacggt

SEQ ID NO: 141171 - DNA, 25 bp, Mus musculus
tcttcgggtgtgaaaagccaaacat

SEQ ID NO: 141172 - DNA, 25 bp, Mus musculus
tcttcggtaaacttcaacagcacgg

SEQ ID NO: 141173 - DNA, 25 bp, Mus musculus
tcttcggtcgaatgaccaggagtct

SEQ ID NO: 141174 - DNA, 25 bp, Mus musculus
tcttcggtgaaaatgaggacggact

SEQ ID NO: 141175 - DNA, 25 bp, Mus musculus
tcttcggttactgtcacttcttcta

SEQ ID NO: 141176 - DNA, 25 bp, Mus musculus
tcttcggtttccttctttccagccg

SEQ ID NO: 141177 - DNA, 25 bp, Mus musculus
tcttcgtaaaaggttgcccgtgaca

SEQ ID NO: 141178 - DNA, 25 bp, Mus musculus
tcttcgtaacacaggccagcagtgg

SEQ ID NO: 141179 - DNA, 25 bp, Mus musculus
tcttcgtcaaggaacagagcgaggt

SEQ ID NO: 141180 - DNA, 25 bp, Mus musculus
tcttcgtcttcatagggcgctgagg

SEQ ID NO: 141181 - DNA, 25 bp, Mus musculus
tcttcgtgggccttggtgctctgct

SEQ ID NO: 141182 - DNA, 25 bp, Mus musculus
tcttcgtttgagtcagtcgccttga

SEQ ID NO: 141183 - DNA, 25 bp, Mus musculus
tcttctaaagtggaagggtttctca

SEQ ID NO: 141184 - DNA, 25 bp, Mus musculus
tcttctacagcgtcctggtgggcaa

SEQ ID NO: 141185 - DNA, 25 bp, Mus musculus
tcttctaccgggtgttgacctcaga

SEQ ID NO: 141186 - DNA, 25 bp, Mus musculus
tcttctacgggttctggcaatacag

SEQ ID NO: 141187 - DNA, 25 bp, Mus musculus
tcttctactgatgcacccgagttag

SEQ ID NO: 141188 - DNA, 25 bp, Mus musculus
tcttctactggaacgcaaaggctcc

SEQ ID NO: 141189 - DNA, 25 bp, Mus musculus
tcttctacttggagcagtgcgaggc

SEQ ID NO: 141190 - DNA, 25 bp, Mus musculus
tcttctatgaggaggacaacccagg

SEQ ID NO: 141191 - DNA, 25 bp, Mus musculus
tcttctatggaaactcagaccggag

SEQ ID NO: 141192 - DNA, 25 bp, Mus musculus
tcttctcacaaaacttttcatcaga

SEQ ID NO: 141193 - DNA, 25 bp, Mus musculus
tcttctcagcaacgaagcccatgct

SEQ ID NO: 141194 - DNA, 25 bp, Mus musculus
tcttctccaagttgaagggccgtgg

SEQ ID NO: 141195 - DNA, 25 bp, Mus musculus
tcttctccaatgaactgcaccgtcg

SEQ ID NO: 141196 - DNA, 25 bp, Mus musculus
tcttctccagagaggctgacaacgt

SEQ ID NO: 141197 - DNA, 25 bp, Mus musculus
tcttctccaggtgaaaaggtgttcc

SEQ ID NO: 141198 - DNA, 25 bp, Mus musculus
tcttctccgacggtcgcacgggagt

SEQ ID NO: 141199 - DNA, 25 bp, Mus musculus
tcttctcgctacaacacatgacggc

SEQ ID NO: 141200 - DNA, 25 bp, Mus musculus
tcttctcggaccaagtatcaaggcg

SEQ ID NO: 141201 - DNA, 25 bp, Mus musculus
tcttctcggagttcagagcctctgg

SEQ ID NO: 141202 - DNA, 25 bp, Mus musculus
tcttctcggctgaccatgtgcacgg

SEQ ID NO: 141203 - DNA, 25 bp, Mus musculus
tcttctcgtgaaatgcaatgcagcc

SEQ ID NO: 141204 - DNA, 25 bp, Mus musculus
tcttctcgtgggagtacgccatgat

SEQ ID NO: 141205 - DNA, 25 bp, Mus musculus
tcttctctccactgatgctgcagga

SEQ ID NO: 141206 - DNA, 25 bp, Mus musculus
tcttctctgcatgtgtgggactggg

SEQ ID NO: 141207 - DNA, 25 bp, Mus musculus
tcttctctggctaatcagcagctgc

SEQ ID NO: 141208 - DNA, 25 bp, Mus musculus
tcttctctgtcgcaagtcactgtga

SEQ ID NO: 141209 - DNA, 25 bp, Mus musculus
tcttctgaaagaacaaggacggttt

SEQ ID NO: 141210 - DNA, 25 bp, Mus musculus
tcttctgaacagagagcgatacatc

SEQ ID NO: 141211 - DNA, 25 bp, Mus musculus
tcttctgactacgtggagatccact

SEQ ID NO: 141212 - DNA, 25 bp, Mus musculus
tcttctgagaaacggattgtatccc

SEQ ID NO: 141213 - DNA, 25 bp, Mus musculus
tcttctgagcagacttgacgcagtt

SEQ ID NO: 141214 - DNA, 25 bp, Mus musculus
tcttctgagctatccagcagtcacg

SEQ ID NO: 141215 - DNA, 25 bp, Mus musculus
tcttctgcatagaggacgtggacac

SEQ ID NO: 141216 - DNA, 25 bp, Mus musculus
tcttctgcccaatctcttcctgaga

SEQ ID NO: 141217 - DNA, 25 bp, Mus musculus
tcttctgcgcagaccatgtggccta

SEQ ID NO: 141218 - DNA, 25 bp, Mus musculus
tcttctgctaatacacagccccggg

SEQ ID NO: 141219 - DNA, 25 bp, Mus musculus
tcttctggaatgacgtcaaggaccc

SEQ ID NO: 141220 - DNA, 25 bp, Mus musculus
tcttctggccgaactcctaagctgt

SEQ ID NO: 141221 - DNA, 25 bp, Mus musculus
tcttctggctcggttggctgggcat

SEQ ID NO: 141222 - DNA, 25 bp, Mus musculus
tcttctgggagaaggcccttggaac

SEQ ID NO: 141223 - DNA, 25 bp, Mus musculus
tcttctgggccatagggaccgtgtt

SEQ ID NO: 141224 - DNA, 25 bp, Mus musculus
tcttctggtctggaattgcagggac

SEQ ID NO: 141225 - DNA, 25 bp, Mus musculus
tcttctgtaagctgtcggagccccg

SEQ ID NO: 141226 - DNA, 25 bp, Mus musculus
tcttctgtgacatgtgcaacctggc

SEQ ID NO: 141227 - DNA, 25 bp, Mus musculus
tcttctgtggagactctgttgacca

SEQ ID NO: 141228 - DNA, 25 bp, Mus musculus
tcttctgtgtagctacggtggccgt

SEQ ID NO: 141229 - DNA, 25 bp, Mus musculus
tcttctgtgtccatggcgacgggca

SEQ ID NO: 141230 - DNA, 25 bp, Mus musculus
tcttctgttcagttccgggtcgcct

SEQ ID NO: 141231 - DNA, 25 bp, Mus musculus
tcttcttaagcagtagggtacaccc

SEQ ID NO: 141232 - DNA, 25 bp, Mus musculus
tcttcttatgcaagacggccgtgct

SEQ ID NO: 141233 - DNA, 25 bp, Mus musculus
tcttcttcagatggcaacagtggag

SEQ ID NO: 141234 - DNA, 25 bp, Mus musculus
tcttcttcaggatcgcgagggcttc

SEQ ID NO: 141235 - DNA, 25 bp, Mus musculus
tcttcttcagggattcaaacaggtc

SEQ ID NO: 141236 - DNA, 25 bp, Mus musculus
tcttcttcatgcaggcttcaaccgg

SEQ ID NO: 141237 - DNA, 25 bp, Mus musculus
tcttcttcgcggtgattggctttgg

SEQ ID NO: 141238 - DNA, 25 bp, Mus musculus
tcttcttctggttaatatgtccacg

SEQ ID NO: 141239 - DNA, 25 bp, Mus musculus
tcttcttgtactggacaggacccaa

SEQ ID NO: 141240 - DNA, 25 bp, Mus musculus
tcttcttgtgcgagcttgtcagctg

SEQ ID NO: 141241 - DNA, 25 bp, Mus musculus
tcttctttgaacgactggaatctaa

SEQ ID NO: 141242 - DNA, 25 bp, Mus musculus
tcttctttgaaggagccacggtggt

SEQ ID NO: 141243 - DNA, 25 bp, Mus musculus
tcttgaaactgctgtgagagccacc

SEQ ID NO: 141244 - DNA, 25 bp, Mus musculus
tcttgaaagtgatcggaaagggcag

SEQ ID NO: 141245 - DNA, 25 bp, Mus musculus
tcttgaaatgcaccatggaaaccag

SEQ ID NO: 141246 - DNA, 25 bp, Mus musculus
tcttgaagaaccacacggatgtgtg

SEQ ID NO: 141247 - DNA, 25 bp, Mus musculus
tcttgaagactttgacctgggcaca

SEQ ID NO: 141248 - DNA, 25 bp, Mus musculus
tcttgaagagccagtaagcctgggc

SEQ ID NO: 141249 - DNA, 25 bp, Mus musculus
tcttgaagcatgcagaggcgactct

SEQ ID NO: 141250 - DNA, 25 bp, Mus musculus
tcttgaagccggtgcagctgcggga

SEQ ID NO: 141251 - DNA, 25 bp, Mus musculus
tcttgaaggagccaagaacggatca

SEQ ID NO: 141252 - DNA, 25 bp, Mus musculus
tcttgaaggccacccaccagtgaat

SEQ ID NO: 141253 - DNA, 25 bp, Mus musculus
tcttgaaggccatgacagaacgcca

SEQ ID NO: 141254 - DNA, 25 bp, Mus musculus
tcttgaaggtcgagagaacttggcc

SEQ ID NO: 141255 - DNA, 25 bp, Mus musculus
tcttgaaggtgggaaacaagccgct

SEQ ID NO: 141256 - DNA, 25 bp, Mus musculus
tcttgaagtacaaaaactgccggcg

SEQ ID NO: 141257 - DNA, 25 bp, Mus musculus
tcttgaagtcatctgcaccgtctgc

SEQ ID NO: 141258 - DNA, 25 bp, Mus musculus
tcttgaagttggcacagcagctgcc

SEQ ID NO: 141259 - DNA, 25 bp, Mus musculus
tcttgaatgagttgagctggacctc

SEQ ID NO: 141260 - DNA, 25 bp, Mus musculus
tcttgacaaaaatggcaccggacag

SEQ ID NO: 141261 - DNA, 25 bp, Mus musculus
tcttgacaaaacttctggaggtatc

SEQ ID NO: 141262 - DNA, 25 bp, Mus musculus
tcttgacaactatgctggctacgag

SEQ ID NO: 141263 - DNA, 25 bp, Mus musculus
tcttgacacgataggcggtctcctg

SEQ ID NO: 141264 - DNA, 25 bp, Mus musculus
tcttgacatgaagaagcctcgctgt

SEQ ID NO: 141265 - DNA, 25 bp, Mus musculus
tcttgaccaaggaacacagatcttc

SEQ ID NO: 141266 - DNA, 25 bp, Mus musculus
tcttgacccaaatgagcctgaaagg

SEQ ID NO: 141267 - DNA, 25 bp, Mus musculus
tcttgaccccgagcagaaggagatg

SEQ ID NO: 141268 - DNA, 25 bp, Mus musculus
tcttgacccgggatgccaaaggcat

SEQ ID NO: 141269 - DNA, 25 bp, Mus musculus
tcttgaccggcccagtgaggaagtt

SEQ ID NO: 141270 - DNA, 25 bp, Mus musculus
tcttgacctttgtgggagccatctt

SEQ ID NO: 141271 - DNA, 25 bp, Mus musculus
tcttgacggccaaggcaagcactga

SEQ ID NO: 141272 - DNA, 25 bp, Mus musculus
tcttgactggcttacagggacgtgg

SEQ ID NO: 141273 - DNA, 25 bp, Mus musculus
tcttgacttcagagttggaccgaca

SEQ ID NO: 141274 - DNA, 25 bp, Mus musculus
tcttgagaacaccttgtggcgcacc

SEQ ID NO: 141275 - DNA, 25 bp, Mus musculus
tcttgagatcttcctggcactcttg

SEQ ID NO: 141276 - DNA, 25 bp, Mus musculus
tcttgagatgatcagcatgggcaca

SEQ ID NO: 141277 - DNA, 25 bp, Mus musculus
tcttgagattcttggagagtcctga

SEQ ID NO: 141278 - DNA, 25 bp, Mus musculus
tcttgagcagccacacattgggtgc

SEQ ID NO: 141279 - DNA, 25 bp, Mus musculus
tcttgagcggactgagggccaaatg

SEQ ID NO: 141280 - DNA, 25 bp, Mus musculus
tcttgaggaacttgaccttggctgg

SEQ ID NO: 141281 - DNA, 25 bp, Mus musculus
tcttgaggaagtccccgttgttggc

SEQ ID NO: 141282 - DNA, 25 bp, Mus musculus
tcttgaggcaactgagaacccaggg

SEQ ID NO: 141283 - DNA, 25 bp, Mus musculus
tcttgaggccaaggaacagaagtct

SEQ ID NO: 141284 - DNA, 25 bp, Mus musculus
tcttgagggccaactaagtgagtgt

SEQ ID NO: 141285 - DNA, 25 bp, Mus musculus
tcttgagtcgagatatgcgtggccg

SEQ ID NO: 141286 - DNA, 25 bp, Mus musculus
tcttgagttcaattaggacagtggc

SEQ ID NO: 141287 - DNA, 25 bp, Mus musculus
tcttgatactaaggagaatcccctc

SEQ ID NO: 141288 - DNA, 25 bp, Mus musculus
tcttgatatggaagacatggcgggc

SEQ ID NO: 141289 - DNA, 25 bp, Mus musculus
tcttgatccagcatgggtgtcccgg

SEQ ID NO: 141290 - DNA, 25 bp, Mus musculus
tcttgatccggctaaagaagaaggg

SEQ ID NO: 141291 - DNA, 25 bp, Mus musculus
tcttgatgaaacaacaggcgcagca

SEQ ID NO: 141292 - DNA, 25 bp, Mus musculus
tcttgatgaaactggactcgggcct

SEQ ID NO: 141293 - DNA, 25 bp, Mus musculus
tcttgatgacacgacctcgctgtgc

SEQ ID NO: 141294 - DNA, 25 bp, Mus musculus
tcttgattcaagatgcgcctactct

SEQ ID NO: 141295 - DNA, 25 bp, Mus musculus
tcttgcaaaggtggacacgatccgt

SEQ ID NO: 141296 - DNA, 25 bp, Mus musculus
tcttgcaaggactcacggacaactc

SEQ ID NO: 141297 - DNA, 25 bp, Mus musculus
tcttgcaccaagtcctcaaagtgag

SEQ ID NO: 141298 - DNA, 25 bp, Mus musculus
tcttgcacggcatctgtggcacagg

SEQ ID NO: 141299 - DNA, 25 bp, Mus musculus
tcttgcactgtaattggctgtctcc

SEQ ID NO: 141300 - DNA, 25 bp, Mus musculus
tcttgcactgttccccaaactttgg

SEQ ID NO: 141301 - DNA, 25 bp, Mus musculus
tcttgcagagaggtcacttgggcca

SEQ ID NO: 141302 - DNA, 25 bp, Mus musculus
tcttgcaggaagagaaggctcccct

SEQ ID NO: 141303 - DNA, 25 bp, Mus musculus
tcttgcagggcccagtgaaaaagcc

SEQ ID NO: 141304 - DNA, 25 bp, Mus musculus
tcttgcaggttggagacagtgcctc

SEQ ID NO: 141305 - DNA, 25 bp, Mus musculus
tcttgcatcgaggtgggcgcaaacc

SEQ ID NO: 141306 - DNA, 25 bp, Mus musculus
tcttgcatgaagaggtgaccccgct

SEQ ID NO: 141307 - DNA, 25 bp, Mus musculus
tcttgcatgccgaggatgatccagt

SEQ ID NO: 141308 - DNA, 25 bp, Mus musculus
tcttgccagaagatgaagcgagtcg

SEQ ID NO: 141309 - DNA, 25 bp, Mus musculus
tcttgccagaaggaaatctcgtgat

SEQ ID NO: 141310 - DNA, 25 bp, Mus musculus
tcttgccaggagcaacactgtgttt

SEQ ID NO: 141311 - DNA, 25 bp, Mus musculus
tcttgcccacgcagaagtcgactga

SEQ ID NO: 141312 - DNA, 25 bp, Mus musculus
tcttgccctagacaacagctgctgg

SEQ ID NO: 141313 - DNA, 25 bp, Mus musculus
tcttgccgactgcaccaatgttggt

SEQ ID NO: 141314 - DNA, 25 bp, Mus musculus
tcttgccgcgtgctggtgttggagg

SEQ ID NO: 141315 - DNA, 25 bp, Mus musculus
tcttgccgggacgtctatgcaaaac

SEQ ID NO: 141316 - DNA, 25 bp, Mus musculus
tcttgccgggagcagtagctatagc

SEQ ID NO: 141317 - DNA, 25 bp, Mus musculus
tcttgccggtgaactgcaggctctc

SEQ ID NO: 141318 - DNA, 25 bp, Mus musculus
tcttgcctcacctaacagggacggt

SEQ ID NO: 141319 - DNA, 25 bp, Mus musculus
tcttgcctcaggaatagcagaagct

SEQ ID NO: 141320 - DNA, 25 bp, Mus musculus
tcttgcctgtcaacctctcgggaga

SEQ ID NO: 141321 - DNA, 25 bp, Mus musculus
tcttgcctgtggattcagagcccca

SEQ ID NO: 141322 - DNA, 25 bp, Mus musculus
tcttgcgatgcgaactggagtctct

SEQ ID NO: 141323 - DNA, 25 bp, Mus musculus
tcttgcgcatgtgcagtgaccccaa

SEQ ID NO: 141324 - DNA, 25 bp, Mus musculus
tcttgcgcgcttactcgctgggttc

SEQ ID NO: 141325 - DNA, 25 bp, Mus musculus
tcttgcgggagatcctgaaaggcct

SEQ ID NO: 141326 - DNA, 25 bp, Mus musculus
tcttgcgtcaagaagtaacatcgcc

SEQ ID NO: 141327 - DNA, 25 bp, Mus musculus
tcttgcgtgctctgaagatggcggc

SEQ ID NO: 141328 - DNA, 25 bp, Mus musculus
tcttgcgtggtcctccagatggagc

SEQ ID NO: 141329 - DNA, 25 bp, Mus musculus
tcttgctattgctatggtacgcttt

SEQ ID NO: 141330 - DNA, 25 bp, Mus musculus
tcttgctcttgccgcgtgctggtgt

SEQ ID NO: 141331 - DNA, 25 bp, Mus musculus
tcttgctgagcgacactgcagggct

SEQ ID NO: 141332 - DNA, 25 bp, Mus musculus
tcttgctgagcgtcgcacagatgcc

SEQ ID NO: 141333 - DNA, 25 bp, Mus musculus
tcttgcttcggaagctgtagctgct

SEQ ID NO: 141334 - DNA, 25 bp, Mus musculus
tcttgctttggtgggctcaacgcct

SEQ ID NO: 141335 - DNA, 25 bp, Mus musculus
tcttggaaaccaactggatgggata

SEQ ID NO: 141336 - DNA, 25 bp, Mus musculus
tcttggaaatatttcaaaactagac

SEQ ID NO: 141337 - DNA, 25 bp, Mus musculus
tcttggaaatgaccatcacgctggt

SEQ ID NO: 141338 - DNA, 25 bp, Mus musculus
tcttggaacgaaacagccttgcctc

SEQ ID NO: 141339 - DNA, 25 bp, Mus musculus
tcttggaagactgagttgggaccct

SEQ ID NO: 141340 - DNA, 25 bp, Mus musculus
tcttggaattaggacctctgggcct

SEQ ID NO: 141341 - DNA, 25 bp, Mus musculus
tcttggacatcatgacagtggctgg

SEQ ID NO: 141342 - DNA, 25 bp, Mus musculus
tcttggaccccgggagaatccgcgt

SEQ ID NO: 141343 - DNA, 25 bp, Mus musculus
tcttggacgacggaagtgaatcacc

SEQ ID NO: 141344 - DNA, 25 bp, Mus musculus
tcttggacggactcttggatggcta

SEQ ID NO: 141345 - DNA, 25 bp, Mus musculus
tcttggactacgaagacgacgaggt

SEQ ID NO: 141346 - DNA, 25 bp, Mus musculus
tcttggactgacaatgggaccttca

SEQ ID NO: 141347 - DNA, 25 bp, Mus musculus
tcttggacttgagataagatgcaca

SEQ ID NO: 141348 - DNA, 25 bp, Mus musculus
tcttggagaacactcttcagggtgg

SEQ ID NO: 141349 - DNA, 25 bp, Mus musculus
tcttggagaactatggtgacgcgct

SEQ ID NO: 141350 - DNA, 25 bp, Mus musculus
tcttggagccacctaagaaacgagc

SEQ ID NO: 141351 - DNA, 25 bp, Mus musculus
tcttggagccatgcctaaaccgtag

SEQ ID NO: 141352 - DNA, 25 bp, Mus musculus
tcttggaggatttgcagtcatacag

SEQ ID NO: 141353 - DNA, 25 bp, Mus musculus
tcttggaggcagcagatggctttct

SEQ ID NO: 141354 - DNA, 25 bp, Mus musculus
tcttggaggccaaaaagacaccggt

SEQ ID NO: 141355 - DNA, 25 bp, Mus musculus
tcttggataaagcaggtgagccatc

SEQ ID NO: 141356 - DNA, 25 bp, Mus musculus
tcttggatagcctgcaactgctgtc

SEQ ID NO: 141357 - DNA, 25 bp, Mus musculus
tcttggatgaccttgtaaccttgca

SEQ ID NO: 141358 - DNA, 25 bp, Mus musculus
tcttggatgctctgacctggatggg

SEQ ID NO: 141359 - DNA, 25 bp, Mus musculus
tcttggatggtagtccggagaacac

SEQ ID NO: 141360 - DNA, 25 bp, Mus musculus
tcttggcaacagcaccaaagcggtg

SEQ ID NO: 141361 - DNA, 25 bp, Mus musculus
tcttggcaacgtgagcgtgaccctc

SEQ ID NO: 141362 - DNA, 25 bp, Mus musculus
tcttggcaagtatgaggtaaaggcc

SEQ ID NO: 141363 - DNA, 25 bp, Mus musculus
tcttggcactagctgaaaaacatgg

SEQ ID NO: 141364 - DNA, 25 bp, Mus musculus
tcttggcagcaaaaggaatcttcta

SEQ ID NO: 141365 - DNA, 25 bp, Mus musculus
tcttggcaggcttcgtggacttgac

SEQ ID NO: 141366 - DNA, 25 bp, Mus musculus
tcttggcaggtcctgaagctggtct

SEQ ID NO: 141367 - DNA, 25 bp, Mus musculus
tcttggcatatacagaaggtctgca

SEQ ID NO: 141368 - DNA, 25 bp, Mus musculus
tcttggccagtcaagagctgttcac

SEQ ID NO: 141369 - DNA, 25 bp, Mus musculus
tcttggccccacaagatgatccttg

SEQ ID NO: 141370 - DNA, 25 bp, Mus musculus
tcttggccgaagaaaactcactagg

SEQ ID NO: 141371 - DNA, 25 bp, Mus musculus
tcttggccgacttcaggtagacatg

SEQ ID NO: 141372 - DNA, 25 bp, Mus musculus
tcttggccggtaggaagctcagaac

SEQ ID NO: 141373 - DNA, 25 bp, Mus musculus
tcttggcgacgaagcaaaggtcaca

SEQ ID NO: 141374 - DNA, 25 bp, Mus musculus
tcttggcgagcagacatgggaatcc

SEQ ID NO: 141375 - DNA, 25 bp, Mus musculus
tcttggcgagcagatgtaaatagca

SEQ ID NO: 141376 - DNA, 25 bp, Mus musculus
tcttggcgagtacaatggtgacgac

SEQ ID NO: 141377 - DNA, 25 bp, Mus musculus
tcttggcggaagaagaagcgacaac

SEQ ID NO: 141378 - DNA, 25 bp, Mus musculus
tcttggctatgaacgggaaccgtcc

SEQ ID NO: 141379 - DNA, 25 bp, Mus musculus
tcttggctcagcaaagaatgcacag

SEQ ID NO: 141380 - DNA, 25 bp, Mus musculus
tcttggctccaacgatgggacagtg

SEQ ID NO: 141381 - DNA, 25 bp, Mus musculus
tcttggctctgttgctaaaagcgaa

SEQ ID NO: 141382 - DNA, 25 bp, Mus musculus
tcttggctgcgacatgatagacgac

SEQ ID NO: 141383 - DNA, 25 bp, Mus musculus
tcttgggaaacaaagacctggatgg

SEQ ID NO: 141384 - DNA, 25 bp, Mus musculus
tcttgggaaagctgcactggagaca

SEQ ID NO: 141385 - DNA, 25 bp, Mus musculus
tcttgggaatcacgttattttcatc

SEQ ID NO: 141386 - DNA, 25 bp, Mus musculus
tcttgggaatcagagaactagctct

SEQ ID NO: 141387 - DNA, 25 bp, Mus musculus
tcttgggaatcgctacagtagtcct

SEQ ID NO: 141388 - DNA, 25 bp, Mus musculus
tcttgggacatgtagtctttacagc

SEQ ID NO: 141389 - DNA, 25 bp, Mus musculus
tcttgggacccaccttatgggacaa

SEQ ID NO: 141390 - DNA, 25 bp, Mus musculus
tcttgggagaatgtgaagtcactct

SEQ ID NO: 141391 - DNA, 25 bp, Mus musculus
tcttgggagacattggagccctgct

SEQ ID NO: 141392 - DNA, 25 bp, Mus musculus
tcttgggagcgaagctttgtccggt

SEQ ID NO: 141393 - DNA, 25 bp, Mus musculus
tcttgggatcctacaccttgcaggc

SEQ ID NO: 141394 - DNA, 25 bp, Mus musculus
tcttgggatcggtgacaggcacaac

SEQ ID NO: 141395 - DNA, 25 bp, Mus musculus
tcttgggcattgatgatctacactt

SEQ ID NO: 141396 - DNA, 25 bp, Mus musculus
tcttgggctccaacgatgaggaaat

SEQ ID NO: 141397 - DNA, 25 bp, Mus musculus
tcttgggctccctggcatttgcgaa

SEQ ID NO: 141398 - DNA, 25 bp, Mus musculus
tcttgggtacaaacagatggatgca

SEQ ID NO: 141399 - DNA, 25 bp, Mus musculus
tcttgggtcgttctcatgccgtggc

SEQ ID NO: 141400 - DNA, 25 bp, Mus musculus
tcttggtaatgttctagactgccct

SEQ ID NO: 141401 - DNA, 25 bp, Mus musculus
tcttggtacggaagtgtgctcacgg

SEQ ID NO: 141402 - DNA, 25 bp, Mus musculus
tcttggtagaagagagcaacgtgca

SEQ ID NO: 141403 - DNA, 25 bp, Mus musculus
tcttggtagccctggtttgcattgc

SEQ ID NO: 141404 - DNA, 25 bp, Mus musculus
tcttggtattaactgggatgcccat

SEQ ID NO: 141405 - DNA, 25 bp, Mus musculus
tcttggtcatcgtgacagacgggcg

SEQ ID NO: 141406 - DNA, 25 bp, Mus musculus
tcttggtccaataaaagaggtaaag

SEQ ID NO: 141407 - DNA, 25 bp, Mus musculus
tcttggtccatgacagtggccctga

SEQ ID NO: 141408 - DNA, 25 bp, Mus musculus
tcttggtccgacgtcaattccagag

SEQ ID NO: 141409 - DNA, 25 bp, Mus musculus
tcttggtctgcataagggagcatca

SEQ ID NO: 141410 - DNA, 25 bp, Mus musculus
tcttggtgcaattagcgacagcgca

SEQ ID NO: 141411 - DNA, 25 bp, Mus musculus
tcttggtgctgcgacagtgtgtcca

SEQ ID NO: 141412 - DNA, 25 bp, Mus musculus
tcttggtgcttgaggaccggctaca

SEQ ID NO: 141413 - DNA, 25 bp, Mus musculus
tcttggtgtgtgtgacccgggaacc

SEQ ID NO: 141414 - DNA, 25 bp, Mus musculus
tcttggttgtagcaggacatcggcc

SEQ ID NO: 141415 - DNA, 25 bp, Mus musculus
tcttggtttagtgagcaatgttctc

SEQ ID NO: 141416 - DNA, 25 bp, Mus musculus
tcttgtaaagctgacgaacatcggc

SEQ ID NO: 141417 - DNA, 25 bp, Mus musculus
tcttgtaaaggtcgccaaagcctcc

SEQ ID NO: 141418 - DNA, 25 bp, Mus musculus
tcttgtaccctggactacgaggcag

SEQ ID NO: 141419 - DNA, 25 bp, Mus musculus
tcttgtagacactgtttgggcgctg

SEQ ID NO: 141420 - DNA, 25 bp, Mus musculus
tcttgtaggcaagcccgctgagttc

SEQ ID NO: 141421 - DNA, 25 bp, Mus musculus
tcttgtatgccgagcaggacagcag

SEQ ID NO: 141422 - DNA, 25 bp, Mus musculus
tcttgtatgctaactggaacacctg

SEQ ID NO: 141423 - DNA, 25 bp, Mus musculus
tcttgtcaatatagtcagccgatcg

SEQ ID NO: 141424 - DNA, 25 bp, Mus musculus
tcttgtctcagaatcgcgctggcgg

SEQ ID NO: 141425 - DNA, 25 bp, Mus musculus
tcttgtctggcaccatgattggcgg

SEQ ID NO: 141426 - DNA, 25 bp, Mus musculus
tcttgtgacctggaaaatgcctaca

SEQ ID NO: 141427 - DNA, 25 bp, Mus musculus
tcttgtgagccgcttgaagaccaga

SEQ ID NO: 141428 - DNA, 25 bp, Mus musculus
tcttgtgagcctggaccatgggcaa

SEQ ID NO: 141429 - DNA, 25 bp, Mus musculus
tcttgtgaggaggaatctgaccccg

SEQ ID NO: 141430 - DNA, 25 bp, Mus musculus
tcttgtgcaagaaatcaaatcccgg

SEQ ID NO: 141431 - DNA, 25 bp, Mus musculus
tcttgtgctgaagaggacgtgacca

SEQ ID NO: 141432 - DNA, 25 bp, Mus musculus
tcttgtgctgaatggaggcatctac

SEQ ID NO: 141433 - DNA, 25 bp, Mus musculus
tcttgtgctgtatagctgcctgggc

SEQ ID NO: 141434 - DNA, 25 bp, Mus musculus
tcttgtggaaggacgtgagttcccc

SEQ ID NO: 141435 - DNA, 25 bp, Mus musculus
tcttgtggaggaccacgacctcaca

SEQ ID NO: 141436 - DNA, 25 bp, Mus musculus
tcttgtggatgcgttgacagaacca

SEQ ID NO: 141437 - DNA, 25 bp, Mus musculus
tcttgtggcccgtaccagtctgtgg

SEQ ID NO: 141438 - DNA, 25 bp, Mus musculus
tcttgtgtcgctaccggcaatgggc

SEQ ID NO: 141439 - DNA, 25 bp, Mus musculus
tcttgtgtttactggtgtggactac

SEQ ID NO: 141440 - DNA, 25 bp, Mus musculus
tcttgttagaccctcatcctgaagg

SEQ ID NO: 141441 - DNA, 25 bp, Mus musculus
tcttgttccatgagtcgggtcacga

SEQ ID NO: 141442 - DNA, 25 bp, Mus musculus
tcttgttcctctaatgtgcctcgtg

SEQ ID NO: 141443 - DNA, 25 bp, Mus musculus
tcttgttgaacatccagcccagctt

SEQ ID NO: 141444 - DNA, 25 bp, Mus musculus
tcttgttgaatgtagcgggctatgc

SEQ ID NO: 141445 - DNA, 25 bp, Mus musculus
tcttgttgcaaacatgagctctggc

SEQ ID NO: 141446 - DNA, 25 bp, Mus musculus
tcttgttgccagagtacccaggtag

SEQ ID NO: 141447 - DNA, 25 bp, Mus musculus
tcttgttggaactcacgatgcccct

SEQ ID NO: 141448 - DNA, 25 bp, Mus musculus
tcttgtttactgttgccgggagaca

SEQ ID NO: 141449 - DNA, 25 bp, Mus musculus
tcttgtttgagaaccagctgctgca

SEQ ID NO: 141450 - DNA, 25 bp, Mus musculus
tcttgttttcaactcactggtggtc

SEQ ID NO: 141451 - DNA, 25 bp, Mus musculus
tctttaaacccgaggagctacgcca

SEQ ID NO: 141452 - DNA, 25 bp, Mus musculus
tctttaaatcagagaccaaggacgc

SEQ ID NO: 141453 - DNA, 25 bp, Mus musculus
tctttaacctggtgggtgagccctc

SEQ ID NO: 141454 - DNA, 25 bp, Mus musculus
tctttaacgggcttcctcgaggaca

SEQ ID NO: 141455 - DNA, 25 bp, Mus musculus
tctttaagcaacaggtaccccgtag

SEQ ID NO: 141456 - DNA, 25 bp, Mus musculus
tctttaatacaagtgaggcccctcg

SEQ ID NO: 141457 - DNA, 25 bp, Mus musculus
tctttaatgcgagaggaagcgatgc

SEQ ID NO: 141458 - DNA, 25 bp, Mus musculus
tctttacacgggatgcttgtgccct

SEQ ID NO: 141459 - DNA, 25 bp, Mus musculus
tctttacactcgaagaggcatggct

SEQ ID NO: 141460 - DNA, 25 bp, Mus musculus
tctttacagagccaaccagggacac

SEQ ID NO: 141461 - DNA, 25 bp, Mus musculus
tctttacagctaatttccctaggtc

SEQ ID NO: 141462 - DNA, 25 bp, Mus musculus
tctttaccagccaaaggcctcggag

SEQ ID NO: 141463 - DNA, 25 bp, Mus musculus
tctttacccagatggcgagagtcct

SEQ ID NO: 141464 - DNA, 25 bp, Mus musculus
tctttacgacactaacaggactgca

SEQ ID NO: 141465 - DNA, 25 bp, Mus musculus
tctttagacctatgggcctgcacac

SEQ ID NO: 141466 - DNA, 25 bp, Mus musculus
tctttagagataacgtggaactccc

SEQ ID NO: 141467 - DNA, 25 bp, Mus musculus
tctttagatcctaagtgcgagtagg

SEQ ID NO: 141468 - DNA, 25 bp, Mus musculus
tctttagcctaaaggactcagcgtc

SEQ ID NO: 141469 - DNA, 25 bp, Mus musculus
tctttagcctgggtggcctgcagca

SEQ ID NO: 141470 - DNA, 25 bp, Mus musculus
tctttatcgacgagaccagcagcga

SEQ ID NO: 141471 - DNA, 25 bp, Mus musculus
tctttatcggctgggcagggtctgc

SEQ ID NO: 141472 - DNA, 25 bp, Mus musculus
tctttatgcaaaaatccaggccggt

SEQ ID NO: 141473 - DNA, 25 bp, Mus musculus
tctttattcatcagcaacgtggtgc

SEQ ID NO: 141474 - DNA, 25 bp, Mus musculus
tctttcaaggcacaacagtctgctg

SEQ ID NO: 141475 - DNA, 25 bp, Mus musculus
tctttcacgaggatggcgaatgctg

SEQ ID NO: 141476 - DNA, 25 bp, Mus musculus
tctttcacgtgttctacaagaagcc

SEQ ID NO: 141477 - DNA, 25 bp, Mus musculus
tctttcagaaacgtgttccaggaca

SEQ ID NO: 141478 - DNA, 25 bp, Mus musculus
tctttcagacgattgtggagcaggc

SEQ ID NO: 141479 - DNA, 25 bp, Mus musculus
tctttccaaacctacaggaattggt

SEQ ID NO: 141480 - DNA, 25 bp, Mus musculus
tctttcccagacagcggaagtactg

SEQ ID NO: 141481 - DNA, 25 bp, Mus musculus
tctttcccaggagagtgcatccggc

SEQ ID NO: 141482 - DNA, 25 bp, Mus musculus
tctttcccatggataggaccaaggg

SEQ ID NO: 141483 - DNA, 25 bp, Mus musculus
tctttcccgattggagggacaggag

SEQ ID NO: 141484 - DNA, 25 bp, Mus musculus
tctttcccgctccaacgccatggag

SEQ ID NO: 141485 - DNA, 25 bp, Mus musculus
tctttcccgtggagacgtggtccat

SEQ ID NO: 141486 - DNA, 25 bp, Mus musculus
tctttccgccccagaatggcagctg

SEQ ID NO: 141487 - DNA, 25 bp, Mus musculus
tctttccggagagacggaccagtga

SEQ ID NO: 141488 - DNA, 25 bp, Mus musculus
tctttccggcagaaagggagcctaa

SEQ ID NO: 141489 - DNA, 25 bp, Mus musculus
tctttcctactaaaacatgtggtgg

SEQ ID NO: 141490 - DNA, 25 bp, Mus musculus
tctttcctgcacagctttcctgcgg

SEQ ID NO: 141491 - DNA, 25 bp, Mus musculus
tctttcgaaagctcagggacgcggt

SEQ ID NO: 141492 - DNA, 25 bp, Mus musculus
tctttcgaggaacgccaatggcaca

SEQ ID NO: 141493 - DNA, 25 bp, Mus musculus
tctttcgagtacatggacagcgtag

SEQ ID NO: 141494 - DNA, 25 bp, Mus musculus
tctttcgatgaagggagcagccact

SEQ ID NO: 141495 - DNA, 25 bp, Mus musculus
tctttcgggaagaggcgctactgtc

SEQ ID NO: 141496 - DNA, 25 bp, Mus musculus
tctttcgggcctcagatccgtgctg

SEQ ID NO: 141497 - DNA, 25 bp, Mus musculus
tctttcgtaagatcatggaagttcg

SEQ ID NO: 141498 - DNA, 25 bp, Mus musculus
tctttcgtgcccaaaccatgatgga

SEQ ID NO: 141499 - DNA, 25 bp, Mus musculus
tctttctcatggatgccgaatcggc

SEQ ID NO: 141500 - DNA, 25 bp, Mus musculus
tctttctggcccaaacggagcaggg

SEQ ID NO: 141501 - DNA, 25 bp, Mus musculus
tctttctgtatgagccagctgggac

SEQ ID NO: 141502 - DNA, 25 bp, Mus musculus
tctttctgtgcacgatactgccagg

SEQ ID NO: 141503 - DNA, 25 bp, Mus musculus
tctttgaaccgcagactggtagcca

SEQ ID NO: 141504 - DNA, 25 bp, Mus musculus
tctttgaactaggatagcccgcgct

SEQ ID NO: 141505 - DNA, 25 bp, Mus musculus
tctttgaagaaggttctcgctctgc

SEQ ID NO: 141506 - DNA, 25 bp, Mus musculus
tctttgaagaagtccacattcctgg

SEQ ID NO: 141507 - DNA, 25 bp, Mus musculus
tctttgacacagtggcacgcagcga

SEQ ID NO: 141508 - DNA, 25 bp, Mus musculus
tctttgacacccagaagcgcatggt

SEQ ID NO: 141509 - DNA, 25 bp, Mus musculus
tctttgacacgtacctgctcatcag

SEQ ID NO: 141510 - DNA, 25 bp, Mus musculus
tctttgacatccttcgggacgagct

SEQ ID NO: 141511 - DNA, 25 bp, Mus musculus
tctttgaccaagagtagtgttcgga

SEQ ID NO: 141512 - DNA, 25 bp, Mus musculus
tctttgacgcaaaggctcgggaccc

SEQ ID NO: 141513 - DNA, 25 bp, Mus musculus
tctttgagaccaagcaacaggagga

SEQ ID NO: 141514 - DNA, 25 bp, Mus musculus
tctttgagacctccggccttaggaa

SEQ ID NO: 141515 - DNA, 25 bp, Mus musculus
tctttgagcaaggataccgggagga

SEQ ID NO: 141516 - DNA, 25 bp, Mus musculus
tctttgagcacgagaggaccttcct

SEQ ID NO: 141517 - DNA, 25 bp, Mus musculus
tctttgagcccagcgcgatgtgggt

SEQ ID NO: 141518 - DNA, 25 bp, Mus musculus
tctttgagcccttctgggacagcgg

SEQ ID NO: 141519 - DNA, 25 bp, Mus musculus
tctttgagcggacacattacccgga

SEQ ID NO: 141520 - DNA, 25 bp, Mus musculus
tctttgaggcagagggagaacccag

SEQ ID NO: 141521 - DNA, 25 bp, Mus musculus
tctttgaggctatcaaggaccacgg

SEQ ID NO: 141522 - DNA, 25 bp, Mus musculus
tctttgagggacacagcagtccggc

SEQ ID NO: 141523 - DNA, 25 bp, Mus musculus
tctttgagtccctgcagatcggcga

SEQ ID NO: 141524 - DNA, 25 bp, Mus musculus
tctttgagttatcagtcggcccaca

SEQ ID NO: 141525 - DNA, 25 bp, Mus musculus
tctttgagttcaacggcacgcaggc

SEQ ID NO: 141526 - DNA, 25 bp, Mus musculus
tctttgatggagttgacacggttgc

SEQ ID NO: 141527 - DNA, 25 bp, Mus musculus
tctttgcaacttacctgactctggc

SEQ ID NO: 141528 - DNA, 25 bp, Mus musculus
tctttgcaagaatgaccctggatac

SEQ ID NO: 141529 - DNA, 25 bp, Mus musculus
tctttgcatgggaaaataataggcc

SEQ ID NO: 141530 - DNA, 25 bp, Mus musculus
tctttgccaacagcacagggctctt

SEQ ID NO: 141531 - DNA, 25 bp, Mus musculus
tctttgccaacatgagccgggaacc

SEQ ID NO: 141532 - DNA, 25 bp, Mus musculus
tctttgccacatctgcgcttcggag

SEQ ID NO: 141533 - DNA, 25 bp, Mus musculus
tctttgccagccaagtgatgcgcta

SEQ ID NO: 141534 - DNA, 25 bp, Mus musculus
tctttgcccaaagtagagccattta

SEQ ID NO: 141535 - DNA, 25 bp, Mus musculus
tctttgccctgtgagcggtcctgag

SEQ ID NO: 141536 - DNA, 25 bp, Mus musculus
tctttgcgacaaacagccaattgga

SEQ ID NO: 141537 - DNA, 25 bp, Mus musculus
tctttgcggactgcagcttcaggcc

SEQ ID NO: 141538 - DNA, 25 bp, Mus musculus
tctttgcggcgcacaacttgagcga

SEQ ID NO: 141539 - DNA, 25 bp, Mus musculus
tctttgcgtgtaacaggatctgtga

SEQ ID NO: 141540 - DNA, 25 bp, Mus musculus
tctttgctacctgggactggccaag

SEQ ID NO: 141541 - DNA, 25 bp, Mus musculus
tctttgctccgcacggcggcagcgg

SEQ ID NO: 141542 - DNA, 25 bp, Mus musculus
tctttgctccgggacgatgaggaca

SEQ ID NO: 141543 - DNA, 25 bp, Mus musculus
tctttgctgacttgtgtgacggtga

SEQ ID NO: 141544 - DNA, 25 bp, Mus musculus
tctttgctgcgagaaggaggttctg

SEQ ID NO: 141545 - DNA, 25 bp, Mus musculus
tctttgctgctgcacaaacggaccg

SEQ ID NO: 141546 - DNA, 25 bp, Mus musculus
tctttgcttgcaagggatgggatgt

SEQ ID NO: 141547 - DNA, 25 bp, Mus musculus
tctttggaaaagaggccagtcccca

SEQ ID NO: 141548 - DNA, 25 bp, Mus musculus
tctttggaaagatcggctactacct

SEQ ID NO: 141549 - DNA, 25 bp, Mus musculus
tctttggaaatcctgactgttgtcc

SEQ ID NO: 141550 - DNA, 25 bp, Mus musculus
tctttggaagatgctctccgcagcc

SEQ ID NO: 141551 - DNA, 25 bp, Mus musculus
tctttggacacctgaacaaggcctg

SEQ ID NO: 141552 - DNA, 25 bp, Mus musculus
tctttggacatagcaccaggcgaca

SEQ ID NO: 141553 - DNA, 25 bp, Mus musculus
tctttggcatgttctggtggacggc

SEQ ID NO: 141554 - DNA, 25 bp, Mus musculus
tctttggcccctaggccagatgtgc

SEQ ID NO: 141555 - DNA, 25 bp, Mus musculus
tctttggcctgggtatctgggctcc

SEQ ID NO: 141556 - DNA, 25 bp, Mus musculus
tctttggctcctcttggagtgtcca

SEQ ID NO: 141557 - DNA, 25 bp, Mus musculus
tctttgggcagaaattggcaccgac

SEQ ID NO: 141558 - DNA, 25 bp, Mus musculus
tctttgggtcaaaatggttttcagc

SEQ ID NO: 141559 - DNA, 25 bp, Mus musculus
tctttggtcaaggatacagccatgg

SEQ ID NO: 141560 - DNA, 25 bp, Mus musculus
tctttggtctcaagaacctgagccc

SEQ ID NO: 141561 - DNA, 25 bp, Mus musculus
tctttggtgaaaactgggaggagca

SEQ ID NO: 141562 - DNA, 25 bp, Mus musculus
tctttggtggcgagctgactagtac

SEQ ID NO: 141563 - DNA, 25 bp, Mus musculus
tctttgtaagttcatgctgcgcacg

SEQ ID NO: 141564 - DNA, 25 bp, Mus musculus
tctttgtacagagacacctcggcac

SEQ ID NO: 141565 - DNA, 25 bp, Mus musculus
tctttgtaccggaagcagagtcaga

SEQ ID NO: 141566 - DNA, 25 bp, Mus musculus
tctttgtagagatgcaaggccaccc

SEQ ID NO: 141567 - DNA, 25 bp, Mus musculus
tctttgtcacctgcggagactggga

SEQ ID NO: 141568 - DNA, 25 bp, Mus musculus
tctttgtcacgcttcttgatgccca

SEQ ID NO: 141569 - DNA, 25 bp, Mus musculus
tctttgtcagataagcccagggtga

SEQ ID NO: 141570 - DNA, 25 bp, Mus musculus
tctttgtcggaggagctcttctgtt

SEQ ID NO: 141571 - DNA, 25 bp, Mus musculus
tctttgtctttgacccgctgggcgg

SEQ ID NO: 141572 - DNA, 25 bp, Mus musculus
tctttgtgaagtatcctggtggcca

SEQ ID NO: 141573 - DNA, 25 bp, Mus musculus
tctttgtgcagtaccaacaccgcgt

SEQ ID NO: 141574 - DNA, 25 bp, Mus musculus
tctttgttcagtacctagccacctg

SEQ ID NO: 141575 - DNA, 25 bp, Mus musculus
tctttgttgcaattactgtagtcat

SEQ ID NO: 141576 - DNA, 25 bp, Mus musculus
tcttttaaaacaagatgccgtcggg

SEQ ID NO: 141577 - DNA, 25 bp, Mus musculus
tcttttaaagctggcagtcgcgaat

SEQ ID NO: 141578 - DNA, 25 bp, Mus musculus
tcttttaacttccatgacggcaccg

SEQ ID NO: 141579 - DNA, 25 bp, Mus musculus
tcttttaatcaaaattatggacgga

SEQ ID NO: 141580 - DNA, 25 bp, Mus musculus
tcttttagagtgagctggacacccc

SEQ ID NO: 141581 - DNA, 25 bp, Mus musculus
tcttttcacaagctcgccaggcagt

SEQ ID NO: 141582 - DNA, 25 bp, Mus musculus
tcttttcatggtggtagccccagag

SEQ ID NO: 141583 - DNA, 25 bp, Mus musculus
tcttttccaagtacggccgagtggc

SEQ ID NO: 141584 - DNA, 25 bp, Mus musculus
tcttttccaatggttgcaacggagt

SEQ ID NO: 141585 - DNA, 25 bp, Mus musculus
tcttttcccagaaagtgagcctttg

SEQ ID NO: 141586 - DNA, 25 bp, Mus musculus
tcttttccgaagagcacaagcccgg

SEQ ID NO: 141587 - DNA, 25 bp, Mus musculus
tcttttccttggctcagcatctacc

SEQ ID NO: 141588 - DNA, 25 bp, Mus musculus
tcttttcggcaaacagctggtcatc

SEQ ID NO: 141589 - DNA, 25 bp, Mus musculus
tcttttctacaataaagtgttcgtt

SEQ ID NO: 141590 - DNA, 25 bp, Mus musculus
tcttttctgaggagctccatgcgtt

SEQ ID NO: 141591 - DNA, 25 bp, Mus musculus
tcttttgatatagtcatcgttggag

SEQ ID NO: 141592 - DNA, 25 bp, Mus musculus
tcttttgatgcagagacgcagcagc

SEQ ID NO: 141593 - DNA, 25 bp, Mus musculus
tcttttgcaacaccatgcctccaga

SEQ ID NO: 141594 - DNA, 25 bp, Mus musculus
tcttttgcatagagcaggcgctgcg

SEQ ID NO: 141595 - DNA, 25 bp, Mus musculus
tcttttgcttgctggagcctgtctc

SEQ ID NO: 141596 - DNA, 25 bp, Mus musculus
tcttttggcaagcaaagcgcaaggt

SEQ ID NO: 141597 - DNA, 25 bp, Mus musculus
tcttttgggaacagcgagtcagcca

SEQ ID NO: 141598 - DNA, 25 bp, Mus musculus
tcttttggtcttcgtgaattttcac

SEQ ID NO: 141599 - DNA, 25 bp, Mus musculus
tcttttgtcacaaagagtcctaact

SEQ ID NO: 141600 - DNA, 25 bp, Mus musculus
tgaaaaaagagacagcccagcgtcg

SEQ ID NO: 141601 - DNA, 25 bp, Mus musculus
tgaaaaaattgctcaagaagaatac

SEQ ID NO: 141602 - DNA, 25 bp, Mus musculus
tgaaaaactttcatgtagacctttg

SEQ ID NO: 141603 - DNA, 25 bp, Mus musculus
tgaaaaagccgtgaccaaccgtagt

SEQ ID NO: 141604 - DNA, 25 bp, Mus musculus
tgaaaaagcggaacctggatacggg

SEQ ID NO: 141605 - DNA, 25 bp, Mus musculus
tgaaaaaggcaaacgggatccactg

SEQ ID NO: 141606 - DNA, 25 bp, Mus musculus
tgaaaaagggaacccaccactgtgg

SEQ ID NO: 141607 - DNA, 25 bp, Mus musculus
tgaaaaataaggcacagctgtcggc

SEQ ID NO: 141608 - DNA, 25 bp, Mus musculus
tgaaaaatccctcgtttttgttgtg

SEQ ID NO: 141609 - DNA, 25 bp, Mus musculus
tgaaaaatctgctgttcctgctttg

SEQ ID NO: 141610 - DNA, 25 bp, Mus musculus
tgaaaacaaaagagcctgtcaaaaa

SEQ ID NO: 141611 - DNA, 25 bp, Mus musculus
tgaaaacaaccactccgctggagaa

SEQ ID NO: 141612 - DNA, 25 bp, Mus musculus
tgaaaacaatcaggaacgtgctctg

SEQ ID NO: 141613 - DNA, 25 bp, Mus musculus
tgaaaacagaaactggccctctggt

SEQ ID NO: 141614 - DNA, 25 bp, Mus musculus
tgaaaacagaccatcctcaaggagt

SEQ ID NO: 141615 - DNA, 25 bp, Mus musculus
tgaaaacagacgaaggctaaagccc

SEQ ID NO: 141616 - DNA, 25 bp, Mus musculus
tgaaaacagatgctaccaagggctt

SEQ ID NO: 141617 - DNA, 25 bp, Mus musculus
tgaaaacagcatgcaccaataccct

SEQ ID NO: 141618 - DNA, 25 bp, Mus musculus
tgaaaacatcctggaatcggagccg

SEQ ID NO: 141619 - DNA, 25 bp, Mus musculus
tgaaaacatgaacccaggtggcctt

SEQ ID NO: 141620 - DNA, 25 bp, Mus musculus
tgaaaacccgggatctgcaccgtga

SEQ ID NO: 141621 - DNA, 25 bp, Mus musculus
tgaaaaccctgtctcccgcatagaa

SEQ ID NO: 141622 - DNA, 25 bp, Mus musculus
tgaaaaccctgttcctggccgttcg

SEQ ID NO: 141623 - DNA, 25 bp, Mus musculus
tgaaaaccctttcacggtgactgat

SEQ ID NO: 141624 - DNA, 25 bp, Mus musculus
tgaaaaccgtccagctgtgaaggct

SEQ ID NO: 141625 - DNA, 25 bp, Mus musculus
tgaaaacctgttgctggatgccgag

SEQ ID NO: 141626 - DNA, 25 bp, Mus musculus
tgaaaacgcattccagggcctatgc

SEQ ID NO: 141627 - DNA, 25 bp, Mus musculus
tgaaaactcagctgcacccaatgct

SEQ ID NO: 141628 - DNA, 25 bp, Mus musculus
tgaaaactgaagacgcccaaagggt

SEQ ID NO: 141629 - DNA, 25 bp, Mus musculus
tgaaaactgcaaacaccgttgcatc

SEQ ID NO: 141630 - DNA, 25 bp, Mus musculus
tgaaaactgtgatcgagcccatggc

SEQ ID NO: 141631 - DNA, 25 bp, Mus musculus
tgaaaacttagcagtttgtgtgtcc

SEQ ID NO: 141632 - DNA, 25 bp, Mus musculus
tgaaaactttcccttgcccacagga

SEQ ID NO: 141633 - DNA, 25 bp, Mus musculus
tgaaaactttgactatgaattggct

SEQ ID NO: 141634 - DNA, 25 bp, Mus musculus
tgaaaagaaagctgagccctccctg

SEQ ID NO: 141635 - DNA, 25 bp, Mus musculus
tgaaaagaaagttggaccatggttc

SEQ ID NO: 141636 - DNA, 25 bp, Mus musculus
tgaaaagaacctgacggcaacgctg

SEQ ID NO: 141637 - DNA, 25 bp, Mus musculus
tgaaaagaactacgagaaaaccctg

SEQ ID NO: 141638 - DNA, 25 bp, Mus musculus
tgaaaagagataaaaccttaagcac

SEQ ID NO: 141639 - DNA, 25 bp, Mus musculus
tgaaaagatagatgacctcgtcccc

SEQ ID NO: 141640 - DNA, 25 bp, Mus musculus
tgaaaagcacccacctgaaaacatc

SEQ ID NO: 141641 - DNA, 25 bp, Mus musculus
tgaaaagcactcctatgggaagctg

SEQ ID NO: 141642 - DNA, 25 bp, Mus musculus
tgaaaagccaaacatcagccaccat

SEQ ID NO: 141643 - DNA, 25 bp, Mus musculus
tgaaaagccacctgaaggagccgac

SEQ ID NO: 141644 - DNA, 25 bp, Mus musculus
tgaaaagccggagacagccgaaagc

SEQ ID NO: 141645 - DNA, 25 bp, Mus musculus
tgaaaagcggcctggttcagcatct

SEQ ID NO: 141646 - DNA, 25 bp, Mus musculus
tgaaaagctaaggaccacggtgacc

SEQ ID NO: 141647 - DNA, 25 bp, Mus musculus
tgaaaagcttgtgggcagtccagcc

SEQ ID NO: 141648 - DNA, 25 bp, Mus musculus
tgaaaaggacctctcgaagtgttgg

SEQ ID NO: 141649 - DNA, 25 bp, Mus musculus
tgaaaaggcggagtgaggagttggc

SEQ ID NO: 141650 - DNA, 25 bp, Mus musculus
tgaaaaggcggatatctctgccaac

SEQ ID NO: 141651 - DNA, 25 bp, Mus musculus
tgaaaaggctctactctaccagtgc

SEQ ID NO: 141652 - DNA, 25 bp, Mus musculus
tgaaaagtaaacagcaggagcaggc

SEQ ID NO: 141653 - DNA, 25 bp, Mus musculus
tgaaaagtacgagaagaccacagtt

SEQ ID NO: 141654 - DNA, 25 bp, Mus musculus
tgaaaagtcatagagcagtgccgcc

SEQ ID NO: 141655 - DNA, 25 bp, Mus musculus
tgaaaagtgacagacagagttggac

SEQ ID NO: 141656 - DNA, 25 bp, Mus musculus
tgaaaagtgctgaacggagtccgga

SEQ ID NO: 141657 - DNA, 25 bp, Mus musculus
tgaaaagtgtgatcccggatgggcc

SEQ ID NO: 141658 - DNA, 25 bp, Mus musculus
tgaaaatagcctgcgtgtagcccga

SEQ ID NO: 141659 - DNA, 25 bp, Mus musculus
tgaaaatcacgggagaactgcagcc

SEQ ID NO: 141660 - DNA, 25 bp, Mus musculus
tgaaaatccgtgttctagtcgggcg

SEQ ID NO: 141661 - DNA, 25 bp, Mus musculus
tgaaaatctaatatcgtccataagg

SEQ ID NO: 141662 - DNA, 25 bp, Mus musculus
tgaaaatgaactatggacctcgctg

SEQ ID NO: 141663 - DNA, 25 bp, Mus musculus
tgaaaatgcagtttccgggcacatc

SEQ ID NO: 141664 - DNA, 25 bp, Mus musculus
tgaaaatgccattgctggtcagcca

SEQ ID NO: 141665 - DNA, 25 bp, Mus musculus
tgaaaatgcgggtcaacagagaggc

SEQ ID NO: 141666 - DNA, 25 bp, Mus musculus
tgaaaatgctgcagtgccggagctg

SEQ ID NO: 141667 - DNA, 25 bp, Mus musculus
tgaaaatggaaactacgctaaggcg

SEQ ID NO: 141668 - DNA, 25 bp, Mus musculus
tgaaaatggaggactacggccgtcc

SEQ ID NO: 141669 - DNA, 25 bp, Mus musculus
tgaaaatggccagaggatccgtgtc

SEQ ID NO: 141670 - DNA, 25 bp, Mus musculus
tgaaaatggctggtgtacccggcac

SEQ ID NO: 141671 - DNA, 25 bp, Mus musculus
tgaaaatgtgcggatccagctgaca

SEQ ID NO: 141672 - DNA, 25 bp, Mus musculus
tgaaaattgcttggaaggcctgacg

SEQ ID NO: 141673 - DNA, 25 bp, Mus musculus
tgaaaattggacacccagaccctgc

SEQ ID NO: 141674 - DNA, 25 bp, Mus musculus
tgaaacaaatcacgaagtccctggt

SEQ ID NO: 141675 - DNA, 25 bp, Mus musculus
tgaaacaactgcactaggcgctgcc

SEQ ID NO: 141676 - DNA, 25 bp, Mus musculus
tgaaacaataaagactggatcgggc

SEQ ID NO: 141677 - DNA, 25 bp, Mus musculus
tgaaacaatgatctggcagctccag

SEQ ID NO: 141678 - DNA, 25 bp, Mus musculus
tgaaacacaagaaactacccctggg

SEQ ID NO: 141679 - DNA, 25 bp, Mus musculus
tgaaacactgcgcttgtgtctggag

SEQ ID NO: 141680 - DNA, 25 bp, Mus musculus
tgaaacagactaccccgaattactg

SEQ ID NO: 141681 - DNA, 25 bp, Mus musculus
tgaaacagatcagagatcaacgggt

SEQ ID NO: 141682 - DNA, 25 bp, Mus musculus
tgaaacagcccaaacgtgggctctg

SEQ ID NO: 141683 - DNA, 25 bp, Mus musculus
tgaaacagtcagtccagcagttgcg

SEQ ID NO: 141684 - DNA, 25 bp, Mus musculus
tgaaacatttgtccagagggctagc

SEQ ID NO: 141685 - DNA, 25 bp, Mus musculus
tgaaaccaacctgaggctggaggca

SEQ ID NO: 141686 - DNA, 25 bp, Mus musculus
tgaaaccacagagaactccacatct

SEQ ID NO: 141687 - DNA, 25 bp, Mus musculus
tgaaaccagaagctgcagagacgtg

SEQ ID NO: 141688 - DNA, 25 bp, Mus musculus
tgaaaccagagaggaatatgacccc

SEQ ID NO: 141689 - DNA, 25 bp, Mus musculus
tgaaaccagccacgatgacaagaac

SEQ ID NO: 141690 - DNA, 25 bp, Mus musculus
tgaaaccaggaaccagatgccgagt

SEQ ID NO: 141691 - DNA, 25 bp, Mus musculus
tgaaaccaggtggttgaccccaggg

SEQ ID NO: 141692 - DNA, 25 bp, Mus musculus
tgaaaccatccgaaactatgctcag

SEQ ID NO: 141693 - DNA, 25 bp, Mus musculus
tgaaacccaaggtggtcaccagcag

SEQ ID NO: 141694 - DNA, 25 bp, Mus musculus
tgaaacccatttacttaggactgtg

SEQ ID NO: 141695 - DNA, 25 bp, Mus musculus
tgaaaccccatagctgttcagccaa

SEQ ID NO: 141696 - DNA, 25 bp, Mus musculus
tgaaaccctccataatcttgctgac

SEQ ID NO: 141697 - DNA, 25 bp, Mus musculus
tgaaaccctccatgcctgaaacaac

SEQ ID NO: 141698 - DNA, 25 bp, Mus musculus
tgaaacctaccaggaacgcctggca

SEQ ID NO: 141699 - DNA, 25 bp, Mus musculus
tgaaacctagtgagctggaacccct

SEQ ID NO: 141700 - DNA, 25 bp, Mus musculus
tgaaacctcccaacctgaggactat

SEQ ID NO: 141701 - DNA, 25 bp, Mus musculus
tgaaacctggtgtgatgacgaatct

SEQ ID NO: 141702 - DNA, 25 bp, Mus musculus
tgaaacgagttccatgggcatgctg

SEQ ID NO: 141703 - DNA, 25 bp, Mus musculus
tgaaacgcactgtctgtgacggctg

SEQ ID NO: 141704 - DNA, 25 bp, Mus musculus
tgaaacgcctcaaacaagccaggag

SEQ ID NO: 141705 - DNA, 25 bp, Mus musculus
tgaaacgctctgaacagctgatgga

SEQ ID NO: 141706 - DNA, 25 bp, Mus musculus
tgaaacggccgtggaactagctgcc

SEQ ID NO: 141707 - DNA, 25 bp, Mus musculus
tgaaacgggagtcttgctctgcacg

SEQ ID NO: 141708 - DNA, 25 bp, Mus musculus
tgaaactaggctcaaggctcgacct

SEQ ID NO: 141709 - DNA, 25 bp, Mus musculus
tgaaactatctgcaaggaccgtcga

SEQ ID NO: 141710 - DNA, 25 bp, Mus musculus
tgaaactcctcaccaaagtgctggc

SEQ ID NO: 141711 - DNA, 25 bp, Mus musculus
tgaaactcgccctagaaggtgtgga

SEQ ID NO: 141712 - DNA, 25 bp, Mus musculus
tgaaactcgtggaaaacttctgccg

SEQ ID NO: 141713 - DNA, 25 bp, Mus musculus
tgaaactgaagagcggtgtcaagcc

SEQ ID NO: 141714 - DNA, 25 bp, Mus musculus
tgaaactgctactttgggctcagaa

SEQ ID NO: 141715 - DNA, 25 bp, Mus musculus
tgaaactggccaacatctatgctgc

SEQ ID NO: 141716 - DNA, 25 bp, Mus musculus
tgaaactggccatagcaagccggag

SEQ ID NO: 141717 - DNA, 25 bp, Mus musculus
tgaaactggcgtcccgaaatgtgga

SEQ ID NO: 141718 - DNA, 25 bp, Mus musculus
tgaaactgttcgtctcaccaggccg

SEQ ID NO: 141719 - DNA, 25 bp, Mus musculus
tgaaactgttggaccagaagacgca

SEQ ID NO: 141720 - DNA, 25 bp, Mus musculus
tgaaactttcatcagcctggaagag

SEQ ID NO: 141721 - DNA, 25 bp, Mus musculus
tgaaagaacaacaccttcgggatgc

SEQ ID NO: 141722 - DNA, 25 bp, Mus musculus
tgaaagaaccctaggcgaattccgg

SEQ ID NO: 141723 - DNA, 25 bp, Mus musculus
tgaaagaagctctcgcaatcattgg

SEQ ID NO: 141724 - DNA, 25 bp, Mus musculus
tgaaagaatacaacagggcgcgtgt

SEQ ID NO: 141725 - DNA, 25 bp, Mus musculus
tgaaagacacaactgtgtggatcat

SEQ ID NO: 141726 - DNA, 25 bp, Mus musculus
tgaaagacaccaaagaaatcaagag

SEQ ID NO: 141727 - DNA, 25 bp, Mus musculus
tgaaagacctgaatgccctgtcggc

SEQ ID NO: 141728 - DNA, 25 bp, Mus musculus
tgaaagagacttgacttcggcccgc

SEQ ID NO: 141729 - DNA, 25 bp, Mus musculus
tgaaagagatccaggccattgcggc

SEQ ID NO: 141730 - DNA, 25 bp, Mus musculus
tgaaagagatgtccctcaccacgga

SEQ ID NO: 141731 - DNA, 25 bp, Mus musculus
tgaaagagctgatcgatcttccgcc

SEQ ID NO: 141732 - DNA, 25 bp, Mus musculus
tgaaagaggcactggagcgctatgc

SEQ ID NO: 141733 - DNA, 25 bp, Mus musculus
tgaaagaggtgccatcccagagata

SEQ ID NO: 141734 - DNA, 25 bp, Mus musculus
tgaaagagtttaccaagcgaaggcg

SEQ ID NO: 141735 - DNA, 25 bp, Mus musculus
tgaaagatagcaggccatggcagca

SEQ ID NO: 141736 - DNA, 25 bp, Mus musculus
tgaaagatcacatgcgagaagctgg

SEQ ID NO: 141737 - DNA, 25 bp, Mus musculus
tgaaagattccacagagatccccgg

SEQ ID NO: 141738 - DNA, 25 bp, Mus musculus
tgaaagcaaagccagtacactccac

SEQ ID NO: 141739 - DNA, 25 bp, Mus musculus
tgaaagcaaagctgcgtaccgagca

SEQ ID NO: 141740 - DNA, 25 bp, Mus musculus
tgaaagcaacttacaagcaggccgg

SEQ ID NO: 141741 - DNA, 25 bp, Mus musculus
tgaaagcacgggtgtggaacagcac

SEQ ID NO: 141742 - DNA, 25 bp, Mus musculus
tgaaagcagaactaagaagtccatg

SEQ ID NO: 141743 - DNA, 25 bp, Mus musculus
tgaaagcagtagtgagccaaccacc

SEQ ID NO: 141744 - DNA, 25 bp, Mus musculus
tgaaagcatcctctgccagtgttgg

SEQ ID NO: 141745 - DNA, 25 bp, Mus musculus
tgaaagccaacgttgagaagcctgt

SEQ ID NO: 141746 - DNA, 25 bp, Mus musculus
tgaaagccctccgtgaaacaaagtg

SEQ ID NO: 141747 - DNA, 25 bp, Mus musculus
tgaaagccctggcagaagatcagcc

SEQ ID NO: 141748 - DNA, 25 bp, Mus musculus
tgaaagccgggtcctcagtaaccga

SEQ ID NO: 141749 - DNA, 25 bp, Mus musculus
tgaaagcctatttcccctgtattgg

SEQ ID NO: 141750 - DNA, 25 bp, Mus musculus
tgaaagcctcagaataccttggacc

SEQ ID NO: 141751 - DNA, 25 bp, Mus musculus
tgaaagcctggtcacagtcagagac

SEQ ID NO: 141752 - DNA, 25 bp, Mus musculus
tgaaagcgcacagacacaaggtcct

SEQ ID NO: 141753 - DNA, 25 bp, Mus musculus
tgaaagctaaaaagcacgcggccgc

SEQ ID NO: 141754 - DNA, 25 bp, Mus musculus
tgaaagctctaagacgacaccctgg

SEQ ID NO: 141755 - DNA, 25 bp, Mus musculus
tgaaagctgcctgtaacttggcgcg

SEQ ID NO: 141756 - DNA, 25 bp, Mus musculus
tgaaagctgtaaagtcaagactccg

SEQ ID NO: 141757 - DNA, 25 bp, Mus musculus
tgaaaggaaaataggtcgcacccgt

SEQ ID NO: 141758 - DNA, 25 bp, Mus musculus
tgaaaggaaagagattgacccaccc

SEQ ID NO: 141759 - DNA, 25 bp, Mus musculus
tgaaaggaaccgcagcacacagggt

SEQ ID NO: 141760 - DNA, 25 bp, Mus musculus
tgaaaggaatcttacagactgtatc

SEQ ID NO: 141761 - DNA, 25 bp, Mus musculus
tgaaaggacgggaggagatcccacc

SEQ ID NO: 141762 - DNA, 25 bp, Mus musculus
tgaaaggactgcatctccaggagcc

SEQ ID NO: 141763 - DNA, 25 bp, Mus musculus
tgaaaggagcaactacaaacatctg

SEQ ID NO: 141764 - DNA, 25 bp, Mus musculus
tgaaaggatgttgcagtgtcactga

SEQ ID NO: 141765 - DNA, 25 bp, Mus musculus
tgaaaggcattcttgtgctcgtcca

SEQ ID NO: 141766 - DNA, 25 bp, Mus musculus
tgaaaggccctgtgctggtggacaa

SEQ ID NO: 141767 - DNA, 25 bp, Mus musculus
tgaaaggcctgaagttgacccagcc

SEQ ID NO: 141768 - DNA, 25 bp, Mus musculus
tgaaaggcttccactttgccgacag

SEQ ID NO: 141769 - DNA, 25 bp, Mus musculus
tgaaagggaatccatctgccgcagc

SEQ ID NO: 141770 - DNA, 25 bp, Mus musculus
tgaaagggacatgcagctaatagcc

SEQ ID NO: 141771 - DNA, 25 bp, Mus musculus
tgaaagggcaagaacgcgcagactt

SEQ ID NO: 141772 - DNA, 25 bp, Mus musculus
tgaaagggtctctccaaaggaaagg

SEQ ID NO: 141773 - DNA, 25 bp, Mus musculus
tgaaagggttacagcgaagccagat

SEQ ID NO: 141774 - DNA, 25 bp, Mus musculus
tgaaaggtgtcctcactgccaaatg

SEQ ID NO: 141775 - DNA, 25 bp, Mus musculus
tgaaaggttgctggtctccctggac

SEQ ID NO: 141776 - DNA, 25 bp, Mus musculus
tgaaagtaacctcgtggccaggaga

SEQ ID NO: 141777 - DNA, 25 bp, Mus musculus
tgaaagtcaagccacagtcactcgc

SEQ ID NO: 141778 - DNA, 25 bp, Mus musculus
tgaaagtccaagagcagcatcggca

SEQ ID NO: 141779 - DNA, 25 bp, Mus musculus
tgaaagtcgacgtgctccggcaaat

SEQ ID NO: 141780 - DNA, 25 bp, Mus musculus
tgaaagtcgcctccacatctctggg

SEQ ID NO: 141781 - DNA, 25 bp, Mus musculus
tgaaagtcggataggtgccagcaac

SEQ ID NO: 141782 - DNA, 25 bp, Mus musculus
tgaaagtgaagcaagccatctccgt

SEQ ID NO: 141783 - DNA, 25 bp, Mus musculus
tgaaagtgacaatcagattactgat

SEQ ID NO: 141784 - DNA, 25 bp, Mus musculus
tgaaagtgaccaagagaacctccgc

SEQ ID NO: 141785 - DNA, 25 bp, Mus musculus
tgaaagtgcaatgaaggcccctgac

SEQ ID NO: 141786 - DNA, 25 bp, Mus musculus
tgaaagtgccattgaccaccgctgc

SEQ ID NO: 141787 - DNA, 25 bp, Mus musculus
tgaaagtgcccgaattcagagagca

SEQ ID NO: 141788 - DNA, 25 bp, Mus musculus
tgaaagtgcttaccctaatgccgaa

SEQ ID NO: 141789 - DNA, 25 bp, Mus musculus
tgaaagttggtcacgttactgaacg

SEQ ID NO: 141790 - DNA, 25 bp, Mus musculus
tgaaataaaagacccttcaggactc

SEQ ID NO: 141791 - DNA, 25 bp, Mus musculus
tgaaatacaggacgtagtagccacg

SEQ ID NO: 141792 - DNA, 25 bp, Mus musculus
tgaaatactcagagccacgaccctg

SEQ ID NO: 141793 - DNA, 25 bp, Mus musculus
tgaaatactttgttaccccaggcac

SEQ ID NO: 141794 - DNA, 25 bp, Mus musculus
tgaaatagagatggccaaggcacag

SEQ ID NO: 141795 - DNA, 25 bp, Mus musculus
tgaaatagaggagctcaacgctgcc

SEQ ID NO: 141796 - DNA, 25 bp, Mus musculus
tgaaatagcaagtcttgattcagag

SEQ ID NO: 141797 - DNA, 25 bp, Mus musculus
tgaaatagtctcgttcctgaaaggg

SEQ ID NO: 141798 - DNA, 25 bp, Mus musculus
tgaaatataccaacaacgaggccta

SEQ ID NO: 141799 - DNA, 25 bp, Mus musculus
tgaaatatatcaaccctccagggag

SEQ ID NO: 141800 - DNA, 25 bp, Mus musculus
tgaaatatgacagcaacaggcccaa

SEQ ID NO: 141801 - DNA, 25 bp, Mus musculus
tgaaatatggccgtcagcgctggaa

SEQ ID NO: 141802 - DNA, 25 bp, Mus musculus
tgaaatattccttgactggtcccgc

SEQ ID NO: 141803 - DNA, 25 bp, Mus musculus
tgaaatcaagaacctgcgcagggac

SEQ ID NO: 141804 - DNA, 25 bp, Mus musculus
tgaaatcacaagaagaccactggca

SEQ ID NO: 141805 - DNA, 25 bp, Mus musculus
tgaaatcaggacaaaccgctgctgt

SEQ ID NO: 141806 - DNA, 25 bp, Mus musculus
tgaaatcaggctgctcgaggccatg

SEQ ID NO: 141807 - DNA, 25 bp, Mus musculus
tgaaatcagtgcgtctaaagaagcc

SEQ ID NO: 141808 - DNA, 25 bp, Mus musculus
tgaaatcagttaccgtgctcaggcg

SEQ ID NO: 141809 - DNA, 25 bp, Mus musculus
tgaaatccagccaattggaaactgt

SEQ ID NO: 141810 - DNA, 25 bp, Mus musculus
tgaaatccatggaacagaatgggcc

SEQ ID NO: 141811 - DNA, 25 bp, Mus musculus
tgaaatccgggagacagagcgaaga

SEQ ID NO: 141812 - DNA, 25 bp, Mus musculus
tgaaatcgtgctggtactccaacag

SEQ ID NO: 141813 - DNA, 25 bp, Mus musculus
tgaaatctccgcgtccatctcagtg

SEQ ID NO: 141814 - DNA, 25 bp, Mus musculus
tgaaatctggatccccggcagtgct

SEQ ID NO: 141815 - DNA, 25 bp, Mus musculus
tgaaatcttggatgagacagacctg

SEQ ID NO: 141816 - DNA, 25 bp, Mus musculus
tgaaatgaatccaccaagctggagg

SEQ ID NO: 141817 - DNA, 25 bp, Mus musculus
tgaaatgaatttatcccagtggaag

SEQ ID NO: 141818 - DNA, 25 bp, Mus musculus
tgaaatgacaatggataaggcctgg

SEQ ID NO: 141819 - DNA, 25 bp, Mus musculus
tgaaatgaccaactccttaaaagtg

SEQ ID NO: 141820 - DNA, 25 bp, Mus musculus
tgaaatgagggctctcaccatcccg

SEQ ID NO: 141821 - DNA, 25 bp, Mus musculus
tgaaatgcactgtactgttagcgtc

SEQ ID NO: 141822 - DNA, 25 bp, Mus musculus
tgaaatgccacgtgataaacaccgg

SEQ ID NO: 141823 - DNA, 25 bp, Mus musculus
tgaaatgcctagtgatgggccagac

SEQ ID NO: 141824 - DNA, 25 bp, Mus musculus
tgaaatgcctcaacatgccgtactg

SEQ ID NO: 141825 - DNA, 25 bp, Mus musculus
tgaaatggacctgttgggaccgcct

SEQ ID NO: 141826 - DNA, 25 bp, Mus musculus
tgaaatggagcctggaacgaactct

SEQ ID NO: 141827 - DNA, 25 bp, Mus musculus
tgaaatggcaagaaggcctccaggt

SEQ ID NO: 141828 - DNA, 25 bp, Mus musculus
tgaaatggcggatagtcaagacccc

SEQ ID NO: 141829 - DNA, 25 bp, Mus musculus
tgaaatgggagatgatgaagccccg

SEQ ID NO: 141830 - DNA, 25 bp, Mus musculus
tgaaatgttattaggccaaaactct

SEQ ID NO: 141831 - DNA, 25 bp, Mus musculus
tgaaattcacacgtcctctattcaa

SEQ ID NO: 141832 - DNA, 25 bp, Mus musculus
tgaaattcaggaactacatggacca

SEQ ID NO: 141833 - DNA, 25 bp, Mus musculus
tgaaattgaaacaccacagcaggcg

SEQ ID NO: 141834 - DNA, 25 bp, Mus musculus
tgaaattgctcatgacgggcagagg

SEQ ID NO: 141835 - DNA, 25 bp, Mus musculus
tgaaattgggtcacaggctctagct

SEQ ID NO: 141836 - DNA, 25 bp, Mus musculus
tgaaatttcatgcaggcccagtacc

SEQ ID NO: 141837 - DNA, 25 bp, Mus musculus
tgaacaaaatgtgcagcgctccatg

SEQ ID NO: 141838 - DNA, 25 bp, Mus musculus
tgaacaaaccacttagctccgaagg

SEQ ID NO: 141839 - DNA, 25 bp, Mus musculus
tgaacaaacccgacagccatggtgg

SEQ ID NO: 141840 - DNA, 25 bp, Mus musculus
tgaacaaactgatctgtgtcaaagc

SEQ ID NO: 141841 - DNA, 25 bp, Mus musculus
tgaacaaagtgatgagagccaggct

SEQ ID NO: 141842 - DNA, 25 bp, Mus musculus
tgaacaaattgtacatcgggaacct

SEQ ID NO: 141843 - DNA, 25 bp, Mus musculus
tgaacaacagaggaaggccctccag

SEQ ID NO: 141844 - DNA, 25 bp, Mus musculus
tgaacaacagctggcatcctgagtg

SEQ ID NO: 141845 - DNA, 25 bp, Mus musculus
tgaacaacatgctgtgtccggccat

SEQ ID NO: 141846 - DNA, 25 bp, Mus musculus
tgaacaacattagggacgtcatgcc

SEQ ID NO: 141847 - DNA, 25 bp, Mus musculus
tgaacaaccaagacctgaatctgga

SEQ ID NO: 141848 - DNA, 25 bp, Mus musculus
tgaacaacggggctaccggcatgcc

SEQ ID NO: 141849 - DNA, 25 bp, Mus musculus
tgaacaactactgggctctgaacct

SEQ ID NO: 141850 - DNA, 25 bp, Mus musculus
tgaacaagaagccaatgagaaagca

SEQ ID NO: 141851 - DNA, 25 bp, Mus musculus
tgaacaagacgacttccgaggtgtg

SEQ ID NO: 141852 - DNA, 25 bp, Mus musculus
tgaacaagagcaggtggattacgcc

SEQ ID NO: 141853 - DNA, 25 bp, Mus musculus
tgaacaagcatcttaacaccccaca

SEQ ID NO: 141854 - DNA, 25 bp, Mus musculus
tgaacaagcggcagatcacagacct

SEQ ID NO: 141855 - DNA, 25 bp, Mus musculus
tgaacaaggacttctaccgagagct

SEQ ID NO: 141856 - DNA, 25 bp, Mus musculus
tgaacaagttgagcatggccagcct

SEQ ID NO: 141857 - DNA, 25 bp, Mus musculus
tgaacaatgagaccgactgtggctg

SEQ ID NO: 141858 - DNA, 25 bp, Mus musculus
tgaacacagaggactcgggcttctc

SEQ ID NO: 141859 - DNA, 25 bp, Mus musculus
tgaacacaggtacatccggagggac

SEQ ID NO: 141860 - DNA, 25 bp, Mus musculus
tgaacacagtgacaaaactcggctg

SEQ ID NO: 141861 - DNA, 25 bp, Mus musculus
tgaacaccaatttacgacaaatcgt

SEQ ID NO: 141862 - DNA, 25 bp, Mus musculus
tgaacaccatgaaggcaagtggaac

SEQ ID NO: 141863 - DNA, 25 bp, Mus musculus
tgaacaccgcgctgcctgtacggca

SEQ ID NO: 141864 - DNA, 25 bp, Mus musculus
tgaacacgaaaccaaggagctgcgg

SEQ ID NO: 141865 - DNA, 25 bp, Mus musculus
tgaacacgatggtgtcatgaccggg

SEQ ID NO: 141866 - DNA, 25 bp, Mus musculus
tgaacacgccgtttatgccaccaga

SEQ ID NO: 141867 - DNA, 25 bp, Mus musculus
tgaacacgctgcctcgaggattcgg

SEQ ID NO: 141868 - DNA, 25 bp, Mus musculus
tgaacacggattcggaaacggcagt

SEQ ID NO: 141869 - DNA, 25 bp, Mus musculus
tgaacactgctttgaacgaactccg

SEQ ID NO: 141870 - DNA, 25 bp, Mus musculus
tgaacactggccagctagcagggtt

SEQ ID NO: 141871 - DNA, 25 bp, Mus musculus
tgaacactgtggagagctctgacct

SEQ ID NO: 141872 - DNA, 25 bp, Mus musculus
tgaacactgtgtggacagagcccac

SEQ ID NO: 141873 - DNA, 25 bp, Mus musculus
tgaacacttccctctggtgcctgaa

SEQ ID NO: 141874 - DNA, 25 bp, Mus musculus
tgaacactttgcaaaaattggatgg

SEQ ID NO: 141875 - DNA, 25 bp, Mus musculus
tgaacagaaatctcaagccccagag

SEQ ID NO: 141876 - DNA, 25 bp, Mus musculus
tgaacagacttcatcctcggagagc

SEQ ID NO: 141877 - DNA, 25 bp, Mus musculus
tgaacagagctacaatgcaacgtgg

SEQ ID NO: 141878 - DNA, 25 bp, Mus musculus
tgaacagaggcgaaccgtacggatt

SEQ ID NO: 141879 - DNA, 25 bp, Mus musculus
tgaacagcagcttctttttcagaga

SEQ ID NO: 141880 - DNA, 25 bp, Mus musculus
tgaacagcctggattttgccccatg

SEQ ID NO: 141881 - DNA, 25 bp, Mus musculus
tgaacagctacatagagcagcgcct

SEQ ID NO: 141882 - DNA, 25 bp, Mus musculus
tgaacagctagctcacggaaatgct

SEQ ID NO: 141883 - DNA, 25 bp, Mus musculus
tgaacagcttactaagtgctcggca

SEQ ID NO: 141884 - DNA, 25 bp, Mus musculus
tgaacaggattttgccaacggctcc

SEQ ID NO: 141885 - DNA, 25 bp, Mus musculus
tgaacaggtcaatccccggtgggaa

SEQ ID NO: 141886 - DNA, 25 bp, Mus musculus
tgaacaggtcctgtgcacgagcagc

SEQ ID NO: 141887 - DNA, 25 bp, Mus musculus
tgaacagtcaaactttcgccaggct

SEQ ID NO: 141888 - DNA, 25 bp, Mus musculus
tgaacagtcggaaaccagatctacg

SEQ ID NO: 141889 - DNA, 25 bp, Mus musculus
tgaacagtctgagtggcagccgaca

SEQ ID NO: 141890 - DNA, 25 bp, Mus musculus
tgaacagtgctgttggacctccaac

SEQ ID NO: 141891 - DNA, 25 bp, Mus musculus
tgaacagtggtgcaagctcaacctg

SEQ ID NO: 141892 - DNA, 25 bp, Mus musculus
tgaacataaggataagcattggccc

SEQ ID NO: 141893 - DNA, 25 bp, Mus musculus
tgaacatattcgtgccttggcctga

SEQ ID NO: 141894 - DNA, 25 bp, Mus musculus
tgaacatcaagaaaccatcgtgccg

SEQ ID NO: 141895 - DNA, 25 bp, Mus musculus
tgaacatcaatgtcccacgatttgg

SEQ ID NO: 141896 - DNA, 25 bp, Mus musculus
tgaacatcagtaccttcctgggctg

SEQ ID NO: 141897 - DNA, 25 bp, Mus musculus
tgaacatcatggaacctagcctcct

SEQ ID NO: 141898 - DNA, 25 bp, Mus musculus
tgaacatcctgagtgaaagggagcc

SEQ ID NO: 141899 - DNA, 25 bp, Mus musculus
tgaacatctacacaaacccagggct

SEQ ID NO: 141900 - DNA, 25 bp, Mus musculus
tgaacatctatggagtcacggtgcc

SEQ ID NO: 141901 - DNA, 25 bp, Mus musculus
tgaacatctcaaggaccagactgtg

SEQ ID NO: 141902 - DNA, 25 bp, Mus musculus
tgaacatctccgtttagggttgtta

SEQ ID NO: 141903 - DNA, 25 bp, Mus musculus
tgaacatgcagcgagaattcggctt

SEQ ID NO: 141904 - DNA, 25 bp, Mus musculus
tgaacatgctctaaccgggaaggga

SEQ ID NO: 141905 - DNA, 25 bp, Mus musculus
tgaacatggcaggagattctctcag

SEQ ID NO: 141906 - DNA, 25 bp, Mus musculus
tgaacatggttcaagacagcgcctt

SEQ ID NO: 141907 - DNA, 25 bp, Mus musculus
tgaacatgttcgtgcgcggttgctg

SEQ ID NO: 141908 - DNA, 25 bp, Mus musculus
tgaaccaacgttagaagcagcctgg

SEQ ID NO: 141909 - DNA, 25 bp, Mus musculus
tgaaccaagcagtccatgaggagcg

SEQ ID NO: 141910 - DNA, 25 bp, Mus musculus
tgaaccacagcaagtgagtgcactt

SEQ ID NO: 141911 - DNA, 25 bp, Mus musculus
tgaaccacccggacacagttgaagg

SEQ ID NO: 141912 - DNA, 25 bp, Mus musculus
tgaaccaccggctctgtgcgtgaac

SEQ ID NO: 141913 - DNA, 25 bp, Mus musculus
tgaaccacttcagtcagcggtacgc

SEQ ID NO: 141914 - DNA, 25 bp, Mus musculus
tgaaccagaagtgtcagggcctgtg

SEQ ID NO: 141915 - DNA, 25 bp, Mus musculus
tgaaccagagatttgcagccacggt

SEQ ID NO: 141916 - DNA, 25 bp, Mus musculus
tgaaccagagttcgttggccaagga

SEQ ID NO: 141917 - DNA, 25 bp, Mus musculus
tgaaccagatgacaggccagatgag

SEQ ID NO: 141918 - DNA, 25 bp, Mus musculus
tgaaccagccaatccttacctaaga

SEQ ID NO: 141919 - DNA, 25 bp, Mus musculus
tgaaccagctcgaaggcaagaagtc

SEQ ID NO: 141920 - DNA, 25 bp, Mus musculus
tgaaccaggagctctgcttgggacg

SEQ ID NO: 141921 - DNA, 25 bp, Mus musculus
tgaaccaggcatccactcgaatgga

SEQ ID NO: 141922 - DNA, 25 bp, Mus musculus
tgaaccagggtgtgacccttgtttt

SEQ ID NO: 141923 - DNA, 25 bp, Mus musculus
tgaaccagtgcagggcctcaaacat

SEQ ID NO: 141924 - DNA, 25 bp, Mus musculus
tgaaccatacccaggctctgcagag

SEQ ID NO: 141925 - DNA, 25 bp, Mus musculus
tgaaccattaccttaccctccgaag

SEQ ID NO: 141926 - DNA, 25 bp, Mus musculus
tgaaccatttgggactatagacgag

SEQ ID NO: 141927 - DNA, 25 bp, Mus musculus
tgaacccaatgtgaaagaaacctgc

SEQ ID NO: 141928 - DNA, 25 bp, Mus musculus
tgaacccactcaggatagcaacgag

SEQ ID NO: 141929 - DNA, 25 bp, Mus musculus
tgaaccccaccgtgaccttcagtga

SEQ ID NO: 141930 - DNA, 25 bp, Mus musculus
tgaaccccagggtgatactcctgag

SEQ ID NO: 141931 - DNA, 25 bp, Mus musculus
tgaaccccatgggtcagcagatgcc

SEQ ID NO: 141932 - DNA, 25 bp, Mus musculus
tgaaccccggcagcagtaggtactg

SEQ ID NO: 141933 - DNA, 25 bp, Mus musculus
tgaacccgaggtcacaaaactgatg

SEQ ID NO: 141934 - DNA, 25 bp, Mus musculus
tgaacccgctggtcagagacctggg

SEQ ID NO: 141935 - DNA, 25 bp, Mus musculus
tgaaccctcacatccacctgatggg

SEQ ID NO: 141936 - DNA, 25 bp, Mus musculus
tgaaccgcatggagcagtacaggac

SEQ ID NO: 141937 - DNA, 25 bp, Mus musculus
tgaaccgccgcattcagctcgtaga

SEQ ID NO: 141938 - DNA, 25 bp, Mus musculus
tgaaccgccttgtggaagggacctg

SEQ ID NO: 141939 - DNA, 25 bp, Mus musculus
tgaaccgcgcatgagtttcccaaag

SEQ ID NO: 141940 - DNA, 25 bp, Mus musculus
tgaaccgctttgaccgaacagacag

SEQ ID NO: 141941 - DNA, 25 bp, Mus musculus
tgaaccggaatcaagtggcccatgt

SEQ ID NO: 141942 - DNA, 25 bp, Mus musculus
tgaaccgtgtgtcgcaaattctgca

SEQ ID NO: 141943 - DNA, 25 bp, Mus musculus
tgaaccgttactacccacagatcct

SEQ ID NO: 141944 - DNA, 25 bp, Mus musculus
tgaacctacagaacaacgaggctgg

SEQ ID NO: 141945 - DNA, 25 bp, Mus musculus
tgaacctcaatacctgtgctgcccg

SEQ ID NO: 141946 - DNA, 25 bp, Mus musculus
tgaacctcagaaatgcacagggcaa

SEQ ID NO: 141947 - DNA, 25 bp, Mus musculus
tgaacctcagtagtgctaacgctag

SEQ ID NO: 141948 - DNA, 25 bp, Mus musculus
tgaacctccttcgagagcaaagccg

SEQ ID NO: 141949 - DNA, 25 bp, Mus musculus
tgaacctgacagattcccgcttggc

SEQ ID NO: 141950 - DNA, 25 bp, Mus musculus
tgaacctgatcaccagcaacaggcg

SEQ ID NO: 141951 - DNA, 25 bp, Mus musculus
tgaacctgcccaagacgtgtgacat

SEQ ID NO: 141952 - DNA, 25 bp, Mus musculus
tgaacctgccctcaaagtttgtgcg

SEQ ID NO: 141953 - DNA, 25 bp, Mus musculus
tgaacctggaaaggaaagcccgtct

SEQ ID NO: 141954 - DNA, 25 bp, Mus musculus
tgaacctggacatatggactagcac

SEQ ID NO: 141955 - DNA, 25 bp, Mus musculus
tgaacctgggcatcctagaagtgac

SEQ ID NO: 141956 - DNA, 25 bp, Mus musculus
tgaacctggtgaagtgggaatccct

SEQ ID NO: 141957 - DNA, 25 bp, Mus musculus
tgaacctggtgcagctctacagcca

SEQ ID NO: 141958 - DNA, 25 bp, Mus musculus
tgaacctgtccgtttggcatcggga

SEQ ID NO: 141959 - DNA, 25 bp, Mus musculus
tgaacctgtcctggaaccgattccg

SEQ ID NO: 141960 - DNA, 25 bp, Mus musculus
tgaacctgtgacgaacgctactggg

SEQ ID NO: 141961 - DNA, 25 bp, Mus musculus
tgaacctgtgcagactggagtgaca

SEQ ID NO: 141962 - DNA, 25 bp, Mus musculus
tgaacctttggttggaagcccctga

SEQ ID NO: 141963 - DNA, 25 bp, Mus musculus
tgaacgaaccactgtccaatgagga

SEQ ID NO: 141964 - DNA, 25 bp, Mus musculus
tgaacgaacttcatggacaaacctg

SEQ ID NO: 141965 - DNA, 25 bp, Mus musculus
tgaacgaaggactgtcaacatgctg

SEQ ID NO: 141966 - DNA, 25 bp, Mus musculus
tgaacgaagtccagtgtacacgcag

SEQ ID NO: 141967 - DNA, 25 bp, Mus musculus
tgaacgacagttacttgcccagaat

SEQ ID NO: 141968 - DNA, 25 bp, Mus musculus
tgaacgagaaggactataaccctgg

SEQ ID NO: 141969 - DNA, 25 bp, Mus musculus
tgaacgagaccgtgtgcagaagaaa

SEQ ID NO: 141970 - DNA, 25 bp, Mus musculus
tgaacgaggcagagagatatgaagc

SEQ ID NO: 141971 - DNA, 25 bp, Mus musculus
tgaacgagggccgaaagagcttccc

SEQ ID NO: 141972 - DNA, 25 bp, Mus musculus
tgaacgagtaacaagacagccgcgg

SEQ ID NO: 141973 - DNA, 25 bp, Mus musculus
tgaacgagtacgcagaggccaactg

SEQ ID NO: 141974 - DNA, 25 bp, Mus musculus
tgaacgatgccctctacaagttggg

SEQ ID NO: 141975 - DNA, 25 bp, Mus musculus
tgaacgcagagctggtgcttaggcc

SEQ ID NO: 141976 - DNA, 25 bp, Mus musculus
tgaacgcagcactgtggtcagcacc

SEQ ID NO: 141977 - DNA, 25 bp, Mus musculus
tgaacgcatactgcacctcctgaga

SEQ ID NO: 141978 - DNA, 25 bp, Mus musculus
tgaacgcatcaacaccttcgtgagg

SEQ ID NO: 141979 - DNA, 25 bp, Mus musculus
tgaacgccatcatgggaagcggcat

SEQ ID NO: 141980 - DNA, 25 bp, Mus musculus
tgaacgccatctcaaggtgcacaca

SEQ ID NO: 141981 - DNA, 25 bp, Mus musculus
tgaacgcccagctggtacaagagac

SEQ ID NO: 141982 - DNA, 25 bp, Mus musculus
tgaacgccgcgcttgcgcactcagc

SEQ ID NO: 141983 - DNA, 25 bp, Mus musculus
tgaacgccttcatcctgttgttgtg

SEQ ID NO: 141984 - DNA, 25 bp, Mus musculus
tgaacgctctaggtcagaactgccc

SEQ ID NO: 141985 - DNA, 25 bp, Mus musculus
tgaacgctgcagtggtgtgaacctg

SEQ ID NO: 141986 - DNA, 25 bp, Mus musculus
tgaacgctttcttcgacgactggaa

SEQ ID NO: 141987 - DNA, 25 bp, Mus musculus
tgaacggacagacactgcagctgat

SEQ ID NO: 141988 - DNA, 25 bp, Mus musculus
tgaacggaccagaagtgagctcctg

SEQ ID NO: 141989 - DNA, 25 bp, Mus musculus
tgaacggcaaagctttcaccgggaa

SEQ ID NO: 141990 - DNA, 25 bp, Mus musculus
tgaacggccaattcaacgaggatgg

SEQ ID NO: 141991 - DNA, 25 bp, Mus musculus
tgaacggcgatcactacgtgggcga

SEQ ID NO: 141992 - DNA, 25 bp, Mus musculus
tgaacgggcacttggagagcactga

SEQ ID NO: 141993 - DNA, 25 bp, Mus musculus
tgaacgggtcaaagtggcagaacat

SEQ ID NO: 141994 - DNA, 25 bp, Mus musculus
tgaacggtgctgttcccgatgacct

SEQ ID NO: 141995 - DNA, 25 bp, Mus musculus
tgaacgtcaactcaaagctttaggg

SEQ ID NO: 141996 - DNA, 25 bp, Mus musculus
tgaacgtcactcgaaaggcctactg

SEQ ID NO: 141997 - DNA, 25 bp, Mus musculus
tgaacgtcgcctactacgtggcaga

SEQ ID NO: 141998 - DNA, 25 bp, Mus musculus
tgaacgtgaaggcaaccctctatga

SEQ ID NO: 141999 - DNA, 25 bp, Mus musculus
tgaacgtggtcaggatgggccaaaa

SEQ ID NO: 142000 - DNA, 25 bp, Mus musculus
tgaacgttgtaagtggcaatgaagt

SEQ ID NO: 142001 - DNA, 25 bp, Mus musculus
tgaacgtttcaaggagcaccgggac

SEQ ID NO: 142002 - DNA, 25 bp, Mus musculus
tgaacgtttggcctactacccaagg

SEQ ID NO: 142003 - DNA, 25 bp, Mus musculus
tgaactacagccatatctggaccag

SEQ ID NO: 142004 - DNA, 25 bp, Mus musculus
tgaactacctccctctggagagagc

SEQ ID NO: 142005 - DNA, 25 bp, Mus musculus
tgaactagactccaatatccctggg

SEQ ID NO: 142006 - DNA, 25 bp, Mus musculus
tgaactagagactctcgtcagagcc

SEQ ID NO: 142007 - DNA, 25 bp, Mus musculus
tgaactattggcttaggaacacaag

SEQ ID NO: 142008 - DNA, 25 bp, Mus musculus
tgaactcacagtaggaacgcggcct

SEQ ID NO: 142009 - DNA, 25 bp, Mus musculus
tgaactcacggatgtgacctttgcc

SEQ ID NO: 142010 - DNA, 25 bp, Mus musculus
tgaactcaggaatgtgcgccagtgg

SEQ ID NO: 142011 - DNA, 25 bp, Mus musculus
tgaactccgcttgcatacacgatgt

SEQ ID NO: 142012 - DNA, 25 bp, Mus musculus
tgaactccgggatagtgacagcgtc

SEQ ID NO: 142013 - DNA, 25 bp, Mus musculus
tgaactccgtctccttaccgtggag

SEQ ID NO: 142014 - DNA, 25 bp, Mus musculus
tgaactccgtgtgcatcagctgctg

SEQ ID NO: 142015 - DNA, 25 bp, Mus musculus
tgaactccttgaatgaacagcgtgg

SEQ ID NO: 142016 - DNA, 25 bp, Mus musculus
tgaactcgaactggatgggcagccg

SEQ ID NO: 142017 - DNA, 25 bp, Mus musculus
tgaactcggagcacgtcgggttaca

SEQ ID NO: 142018 - DNA, 25 bp, Mus musculus
tgaactcgggctggaaaatgagacg

SEQ ID NO: 142019 - DNA, 25 bp, Mus musculus
tgaactcgtcaaagtcaccaaggct

SEQ ID NO: 142020 - DNA, 25 bp, Mus musculus
tgaactctatcaaagctacgaaggg

SEQ ID NO: 142021 - DNA, 25 bp, Mus musculus
tgaactctcagaggcagaaggcaca

SEQ ID NO: 142022 - DNA, 25 bp, Mus musculus
tgaactctccagaatcaagtgtgtg

SEQ ID NO: 142023 - DNA, 25 bp, Mus musculus
tgaactctgaacgtgagctacagca

SEQ ID NO: 142024 - DNA, 25 bp, Mus musculus
tgaactctgcatgaaattgcggtgg

SEQ ID NO: 142025 - DNA, 25 bp, Mus musculus
tgaactctgtagattacgtggaaca

SEQ ID NO: 142026 - DNA, 25 bp, Mus musculus
tgaactctgtcaccgtggaagaagg

SEQ ID NO: 142027 - DNA, 25 bp, Mus musculus
tgaactctgtggaaaagtctctggc

SEQ ID NO: 142028 - DNA, 25 bp, Mus musculus
tgaactcttctactgcctcctgtat

SEQ ID NO: 142029 - DNA, 25 bp, Mus musculus
tgaactgaagggatatgccttcggg

SEQ ID NO: 142030 - DNA, 25 bp, Mus musculus
tgaactgacaaatcggaaccatggt

SEQ ID NO: 142031 - DNA, 25 bp, Mus musculus
tgaactgacaactaagatccgtggg

SEQ ID NO: 142032 - DNA, 25 bp, Mus musculus
tgaactgacagagacgctaagtgcg

SEQ ID NO: 142033 - DNA, 25 bp, Mus musculus
tgaactgagcagaatctatggcact

SEQ ID NO: 142034 - DNA, 25 bp, Mus musculus
tgaactgagcgccacagaaagtccg

SEQ ID NO: 142035 - DNA, 25 bp, Mus musculus
tgaactgattcaaatagaacacggg

SEQ ID NO: 142036 - DNA, 25 bp, Mus musculus
tgaactgcacggagctacaggagct

SEQ ID NO: 142037 - DNA, 25 bp, Mus musculus
tgaactgcatcgcatggctcttggg

SEQ ID NO: 142038 - DNA, 25 bp, Mus musculus
tgaactgccaccagattatccatcc

SEQ ID NO: 142039 - DNA, 25 bp, Mus musculus
tgaactgcgcaagcccatttactgg

SEQ ID NO: 142040 - DNA, 25 bp, Mus musculus
tgaactggaaagagccactggaacc

SEQ ID NO: 142041 - DNA, 25 bp, Mus musculus
tgaactggaacgtttgagcaacctg

SEQ ID NO: 142042 - DNA, 25 bp, Mus musculus
tgaactggccgacatactaacagag

SEQ ID NO: 142043 - DNA, 25 bp, Mus musculus
tgaactggccttcacgctgggagac

SEQ ID NO: 142044 - DNA, 25 bp, Mus musculus
tgaactggcgattgcatacatcctg

SEQ ID NO: 142045 - DNA, 25 bp, Mus musculus
tgaactgggaccagcaagccttgga

SEQ ID NO: 142046 - DNA, 25 bp, Mus musculus
tgaactgggtgcagaacaaagctcc

SEQ ID NO: 142047 - DNA, 25 bp, Mus musculus
tgaactggttcagcccttggacagc

SEQ ID NO: 142048 - DNA, 25 bp, Mus musculus
tgaactgtccaggagtgagccgtga

SEQ ID NO: 142049 - DNA, 25 bp, Mus musculus
tgaactgtccctgttgccactggca

SEQ ID NO: 142050 - DNA, 25 bp, Mus musculus
tgaactgtcttcacattagccctga

SEQ ID NO: 142051 - DNA, 25 bp, Mus musculus
tgaactgtgaacctactcttgctgc

SEQ ID NO: 142052 - DNA, 25 bp, Mus musculus
tgaacttaaagaaaccacagcatgt

SEQ ID NO: 142053 - DNA, 25 bp, Mus musculus
tgaacttaaggctgaagaatccgtc

SEQ ID NO: 142054 - DNA, 25 bp, Mus musculus
tgaacttagattacagcacctgtgg

SEQ ID NO: 142055 - DNA, 25 bp, Mus musculus
tgaacttcactattgggcgcgtggt

SEQ ID NO: 142056 - DNA, 25 bp, Mus musculus
tgaacttcaggagaaactacaccag

SEQ ID NO: 142057 - DNA, 25 bp, Mus musculus
tgaacttcatcgacaacttagtgag

SEQ ID NO: 142058 - DNA, 25 bp, Mus musculus
tgaacttccactgactacatgactg

SEQ ID NO: 142059 - DNA, 25 bp, Mus musculus
tgaacttccggacactacagagcat

SEQ ID NO: 142060 - DNA, 25 bp, Mus musculus
tgaacttctagccacgtgtagcgcc

SEQ ID NO: 142061 - DNA, 25 bp, Mus musculus
tgaacttctgcttcgagtgagggcc

SEQ ID NO: 142062 - DNA, 25 bp, Mus musculus
tgaacttgaccgttgcctgagccct

SEQ ID NO: 142063 - DNA, 25 bp, Mus musculus
tgaacttgcaaaatggctcctgtcc

SEQ ID NO: 142064 - DNA, 25 bp, Mus musculus
tgaacttgcagacgaactaccagac

SEQ ID NO: 142065 - DNA, 25 bp, Mus musculus
tgaacttgccaggtagctccagtgc

SEQ ID NO: 142066 - DNA, 25 bp, Mus musculus
tgaacttggacagcgaaaccattgc

SEQ ID NO: 142067 - DNA, 25 bp, Mus musculus
tgaacttgtgactctgatgtcccag

SEQ ID NO: 142068 - DNA, 25 bp, Mus musculus
tgaactttgaacatcagtaccttcc

SEQ ID NO: 142069 - DNA, 25 bp, Mus musculus
tgaactttgtgagcatatcttgggt

SEQ ID NO: 142070 - DNA, 25 bp, Mus musculus
tgaacttttattcctcagtgggcct

SEQ ID NO: 142071 - DNA, 25 bp, Mus musculus
tgaagaaaagagtctccgagcagct

SEQ ID NO: 142072 - DNA, 25 bp, Mus musculus
tgaagaaaaggtgacagccagaacg

SEQ ID NO: 142073 - DNA, 25 bp, Mus musculus
tgaagaaaattagtctgcagccctt

SEQ ID NO: 142074 - DNA, 25 bp, Mus musculus
tgaagaaaattcgatgccacgcgcc

SEQ ID NO: 142075 - DNA, 25 bp, Mus musculus
tgaagaaaccagagggaccaggtgc

SEQ ID NO: 142076 - DNA, 25 bp, Mus musculus
tgaagaaaccagtgaggagtccctc

SEQ ID NO: 142077 - DNA, 25 bp, Mus musculus
tgaagaaaccatgcccagtacagat

SEQ ID NO: 142078 - DNA, 25 bp, Mus musculus
tgaagaaacgaatgcagggccccat

SEQ ID NO: 142079 - DNA, 25 bp, Mus musculus
tgaagaaagcccaacagtcctaaag

SEQ ID NO: 142080 - DNA, 25 bp, Mus musculus
tgaagaaaggtgttggccaggccaa

SEQ ID NO: 142081 - DNA, 25 bp, Mus musculus
tgaagaaatacagtccgacttccag

SEQ ID NO: 142082 - DNA, 25 bp, Mus musculus
tgaagaaatacgaagctcagcctct

SEQ ID NO: 142083 - DNA, 25 bp, Mus musculus
tgaagaaatcgaagcaatggcagcc

SEQ ID NO: 142084 - DNA, 25 bp, Mus musculus
tgaagaacaaagctccaggcctagg

SEQ ID NO: 142085 - DNA, 25 bp, Mus musculus
tgaagaacaagcattcggagcagcc

SEQ ID NO: 142086 - DNA, 25 bp, Mus musculus
tgaagaacagcgacctagagaggac

SEQ ID NO: 142087 - DNA, 25 bp, Mus musculus
tgaagaacctgatgccaaactggcc

SEQ ID NO: 142088 - DNA, 25 bp, Mus musculus
tgaagaacgggattcctgccaaccg

SEQ ID NO: 142089 - DNA, 25 bp, Mus musculus
tgaagaacgtaccatgtggaaccag

SEQ ID NO: 142090 - DNA, 25 bp, Mus musculus
tgaagaactgccttctcccgctgag

SEQ ID NO: 142091 - DNA, 25 bp, Mus musculus
tgaagaactgggactcgctggatga

SEQ ID NO: 142092 - DNA, 25 bp, Mus musculus
tgaagaacttctgaggattggcctg

SEQ ID NO: 142093 - DNA, 25 bp, Mus musculus
tgaagaagaactgcccacacatcgt

SEQ ID NO: 142094 - DNA, 25 bp, Mus musculus
tgaagaagaagttcgcctgctggct

SEQ ID NO: 142095 - DNA, 25 bp, Mus musculus
tgaagaagaatcctggcatcgccgc

SEQ ID NO: 142096 - DNA, 25 bp, Mus musculus
tgaagaagacatcactggcagtcac

SEQ ID NO: 142097 - DNA, 25 bp, Mus musculus
tgaagaagaccagcctttattagct

SEQ ID NO: 142098 - DNA, 25 bp, Mus musculus
tgaagaagacctatgaaacctccct

SEQ ID NO: 142099 - DNA, 25 bp, Mus musculus
tgaagaagacctatgtgctcgacct

SEQ ID NO: 142100 - DNA, 25 bp, Mus musculus
tgaagaagatcaaacggcagctgtc

SEQ ID NO: 142101 - DNA, 25 bp, Mus musculus
tgaagaagatttacctatgagtgcc

SEQ ID NO: 142102 - DNA, 25 bp, Mus musculus
tgaagaagcaccataagccccattg

SEQ ID NO: 142103 - DNA, 25 bp, Mus musculus
tgaagaagccaagaacacactgacc

SEQ ID NO: 142104 - DNA, 25 bp, Mus musculus
tgaagaagcccataaactaccagta

SEQ ID NO: 142105 - DNA, 25 bp, Mus musculus
tgaagaagcccttgaggcagctgtg

SEQ ID NO: 142106 - DNA, 25 bp, Mus musculus
tgaagaagccgccaactcagagatc

SEQ ID NO: 142107 - DNA, 25 bp, Mus musculus
tgaagaagctccacacacaggagcg

SEQ ID NO: 142108 - DNA, 25 bp, Mus musculus
tgaagaaggagacccgtgactgact

SEQ ID NO: 142109 - DNA, 25 bp, Mus musculus
tgaagaaggcattcaggccctggat

SEQ ID NO: 142110 - DNA, 25 bp, Mus musculus
tgaagaaggttgtcagggttcccca

SEQ ID NO: 142111 - DNA, 25 bp, Mus musculus
tgaagaagtccacgagccaggttac

SEQ ID NO: 142112 - DNA, 25 bp, Mus musculus
tgaagaagtctatccacaacctggg

SEQ ID NO: 142113 - DNA, 25 bp, Mus musculus
tgaagaagtctccaaagcggtctcc

SEQ ID NO: 142114 - DNA, 25 bp, Mus musculus
tgaagaagttgcaagacccaggcgt

SEQ ID NO: 142115 - DNA, 25 bp, Mus musculus
tgaagaatagaaccccaataagaag

SEQ ID NO: 142116 - DNA, 25 bp, Mus musculus
tgaagaatcagagcactggcacccg

SEQ ID NO: 142117 - DNA, 25 bp, Mus musculus
tgaagaatgtccaaaagtcatcctg

SEQ ID NO: 142118 - DNA, 25 bp, Mus musculus
tgaagaattagaccccatggacccc

SEQ ID NO: 142119 - DNA, 25 bp, Mus musculus
tgaagaattgatcgcagcccgagca

SEQ ID NO: 142120 - DNA, 25 bp, Mus musculus
tgaagacaacgtgacagaacagacc

SEQ ID NO: 142121 - DNA, 25 bp, Mus musculus
tgaagacaagcaccggctctgaaga

SEQ ID NO: 142122 - DNA, 25 bp, Mus musculus
tgaagacaaggttaacaaggctgcc

SEQ ID NO: 142123 - DNA, 25 bp, Mus musculus
tgaagacacaactcacagtggcagg

SEQ ID NO: 142124 - DNA, 25 bp, Mus musculus
tgaagacacctttgaactacgggac

SEQ ID NO: 142125 - DNA, 25 bp, Mus musculus
tgaagacacggtacagccagaagat

SEQ ID NO: 142126 - DNA, 25 bp, Mus musculus
tgaagacactacagaccctggacag

SEQ ID NO: 142127 - DNA, 25 bp, Mus musculus
tgaagacagaatccgccatgcattt

SEQ ID NO: 142128 - DNA, 25 bp, Mus musculus
tgaagacagaccacaatgagcagct

SEQ ID NO: 142129 - DNA, 25 bp, Mus musculus
tgaagacagcatggacagtcccctg

SEQ ID NO: 142130 - DNA, 25 bp, Mus musculus
tgaagacagtggatacatcacaggg

SEQ ID NO: 142131 - DNA, 25 bp, Mus musculus
tgaagacagtttgaccagtgtggcc

SEQ ID NO: 142132 - DNA, 25 bp, Mus musculus
tgaagacatagcaacctgccctaag

SEQ ID NO: 142133 - DNA, 25 bp, Mus musculus
tgaagacatccgatccagtggccgg

SEQ ID NO: 142134 - DNA, 25 bp, Mus musculus
tgaagacattactgccactgtcccc

SEQ ID NO: 142135 - DNA, 25 bp, Mus musculus
tgaagacattgctaactacagaggc

SEQ ID NO: 142136 - DNA, 25 bp, Mus musculus
tgaagaccaatgagacggcctgtaa

SEQ ID NO: 142137 - DNA, 25 bp, Mus musculus
tgaagaccatgagcactagtgaccc

SEQ ID NO: 142138 - DNA, 25 bp, Mus musculus
tgaagacccctgatttcgatgacct

SEQ ID NO: 142139 - DNA, 25 bp, Mus musculus
tgaagacccctttcgcacagaggac

SEQ ID NO: 142140 - DNA, 25 bp, Mus musculus
tgaagaccctcaatgcgcatgaaca

SEQ ID NO: 142141 - DNA, 25 bp, Mus musculus
tgaagaccctcccaggctataacgg

SEQ ID NO: 142142 - DNA, 25 bp, Mus musculus
tgaagaccctgacatacgtggccct

SEQ ID NO: 142143 - DNA, 25 bp, Mus musculus
tgaagaccgcctgcgccaggaatat

SEQ ID NO: 142144 - DNA, 25 bp, Mus musculus
tgaagaccggcccttgcacatgttg

SEQ ID NO: 142145 - DNA, 25 bp, Mus musculus
tgaagacctctgaaaagcacagggc

SEQ ID NO: 142146 - DNA, 25 bp, Mus musculus
tgaagacctcttccgagaatggctg

SEQ ID NO: 142147 - DNA, 25 bp, Mus musculus
tgaagacctgctaccctctggagtc

SEQ ID NO: 142148 - DNA, 25 bp, Mus musculus
tgaagacctggcatatgtaccctat

SEQ ID NO: 142149 - DNA, 25 bp, Mus musculus
tgaagacctgtcaggagccagcggt

SEQ ID NO: 142150 - DNA, 25 bp, Mus musculus
tgaagaccttcgctgtggacgagac

SEQ ID NO: 142151 - DNA, 25 bp, Mus musculus
tgaagacgagttactgctgccgcgg

SEQ ID NO: 142152 - DNA, 25 bp, Mus musculus
tgaagacgatgatgagctcctggcc

SEQ ID NO: 142153 - DNA, 25 bp, Mus musculus
tgaagacgatgcaatggagttgctg

SEQ ID NO: 142154 - DNA, 25 bp, Mus musculus
tgaagacgcacatgcacaaggcggg

SEQ ID NO: 142155 - DNA, 25 bp, Mus musculus
tgaagacgcagtctaggctgactcc

SEQ ID NO: 142156 - DNA, 25 bp, Mus musculus
tgaagacgcccaaagggttttccag

SEQ ID NO: 142157 - DNA, 25 bp, Mus musculus
tgaagacgctaagggcaacactggc

SEQ ID NO: 142158 - DNA, 25 bp, Mus musculus
tgaagacgtagctcccactgttggc

SEQ ID NO: 142159 - DNA, 25 bp, Mus musculus
tgaagacgtcgaagccaagatggcg

SEQ ID NO: 142160 - DNA, 25 bp, Mus musculus
tgaagacgtcgcttctgcaacacag

SEQ ID NO: 142161 - DNA, 25 bp, Mus musculus
tgaagactcagtaccggaccctggt

SEQ ID NO: 142162 - DNA, 25 bp, Mus musculus
tgaagactcatgaaggcttacaagg

SEQ ID NO: 142163 - DNA, 25 bp, Mus musculus
tgaagactcgggactgattggcagc

SEQ ID NO: 142164 - DNA, 25 bp, Mus musculus
tgaagactgcgcttacaagggtgct

SEQ ID NO: 142165 - DNA, 25 bp, Mus musculus
tgaagactgggaaaacagtaagacc

SEQ ID NO: 142166 - DNA, 25 bp, Mus musculus
tgaagactgtactgatgagctaagc

SEQ ID NO: 142167 - DNA, 25 bp, Mus musculus
tgaagactttctacacctggcggaa

SEQ ID NO: 142168 - DNA, 25 bp, Mus musculus
tgaagagaaaaagatccggctccgg

SEQ ID NO: 142169 - DNA, 25 bp, Mus musculus
tgaagagaacaacccttctgctggg

SEQ ID NO: 142170 - DNA, 25 bp, Mus musculus
tgaagagaacaacgtgcaccaaggc

SEQ ID NO: 142171 - DNA, 25 bp, Mus musculus
tgaagagaagaaaccgcacagctgg

SEQ ID NO: 142172 - DNA, 25 bp, Mus musculus
tgaagagaagaactcttagatcctc

SEQ ID NO: 142173 - DNA, 25 bp, Mus musculus
tgaagagaagacgacaatcaagcgc

SEQ ID NO: 142174 - DNA, 25 bp, Mus musculus
tgaagagaccccagaacaagaggct

SEQ ID NO: 142175 - DNA, 25 bp, Mus musculus
tgaagagactttcaagaacctggtg

SEQ ID NO: 142176 - DNA, 25 bp, Mus musculus
tgaagagagcacaattcatgcagga

SEQ ID NO: 142177 - DNA, 25 bp, Mus musculus
tgaagagccatttgatatcggagat

SEQ ID NO: 142178 - DNA, 25 bp, Mus musculus
tgaagagcccataaccaggaaagga

SEQ ID NO: 142179 - DNA, 25 bp, Mus musculus
tgaagagcctattcccagctggtga

SEQ ID NO: 142180 - DNA, 25 bp, Mus musculus
tgaagagcctttgccggatcatgga

SEQ ID NO: 142181 - DNA, 25 bp, Mus musculus
tgaagagcgcccgactcaggtattg

SEQ ID NO: 142182 - DNA, 25 bp, Mus musculus
tgaagagctacctggataccggtgg

SEQ ID NO: 142183 - DNA, 25 bp, Mus musculus
tgaagagctagctcgccgtgtcaac

SEQ ID NO: 142184 - DNA, 25 bp, Mus musculus
tgaagagctttgaccagttcacctg

SEQ ID NO: 142185 - DNA, 25 bp, Mus musculus
tgaagaggaaacactggactacggc

SEQ ID NO: 142186 - DNA, 25 bp, Mus musculus
tgaagaggaacgactacgtgcacgc

SEQ ID NO: 142187 - DNA, 25 bp, Mus musculus
tgaagaggaactggaccatccgaac

SEQ ID NO: 142188 - DNA, 25 bp, Mus musculus
tgaagaggacccagcaggaatcatg

SEQ ID NO: 142189 - DNA, 25 bp, Mus musculus
tgaagaggccttgcacagatccaac

SEQ ID NO: 142190 - DNA, 25 bp, Mus musculus
tgaagaggcgaagcattaccatgac

SEQ ID NO: 142191 - DNA, 25 bp, Mus musculus
tgaagagggactatctgagcagcct

SEQ ID NO: 142192 - DNA, 25 bp, Mus musculus
tgaagagggcatcatcgagaacacg

SEQ ID NO: 142193 - DNA, 25 bp, Mus musculus
tgaagagggctccaaaggtgggaag

SEQ ID NO: 142194 - DNA, 25 bp, Mus musculus
tgaagaggtcattgccacacagatc

SEQ ID NO: 142195 - DNA, 25 bp, Mus musculus
tgaagaggtcccagaagagccatgg

SEQ ID NO: 142196 - DNA, 25 bp, Mus musculus
tgaagaggtctgtcaccgaagacat

SEQ ID NO: 142197 - DNA, 25 bp, Mus musculus
tgaagaggttgcagcgacaggctcc

SEQ ID NO: 142198 - DNA, 25 bp, Mus musculus
tgaagagtcccagatatccgccaaa

SEQ ID NO: 142199 - DNA, 25 bp, Mus musculus
tgaagagtcctatagcctcctaagg

SEQ ID NO: 142200 - DNA, 25 bp, Mus musculus
tgaagagtctttgggctccacgccc

SEQ ID NO: 142201 - DNA, 25 bp, Mus musculus
tgaagagtgtcagcctacaggagcc

SEQ ID NO: 142202 - DNA, 25 bp, Mus musculus
tgaagagttactagccgaggcagcc

SEQ ID NO: 142203 - DNA, 25 bp, Mus musculus
tgaagagttccagagcacaccaggt

SEQ ID NO: 142204 - DNA, 25 bp, Mus musculus
tgaagagtttagagccatttaccgg

SEQ ID NO: 142205 - DNA, 25 bp, Mus musculus
tgaagataaacaccgacattactgg

SEQ ID NO: 142206 - DNA, 25 bp, Mus musculus
tgaagataagaatgggaacacccct

SEQ ID NO: 142207 - DNA, 25 bp, Mus musculus
tgaagatacaatgtcctcccaaggg

SEQ ID NO: 142208 - DNA, 25 bp, Mus musculus
tgaagatacagaccacaacttaact

SEQ ID NO: 142209 - DNA, 25 bp, Mus musculus
tgaagatacccacatcctgagctgt

SEQ ID NO: 142210 - DNA, 25 bp, Mus musculus
tgaagatatcctgctgtcctcgcct

SEQ ID NO: 142211 - DNA, 25 bp, Mus musculus
tgaagatcaacaatcagctgcggcg

SEQ ID NO: 142212 - DNA, 25 bp, Mus musculus
tgaagatcatcttgcccgagggagc

SEQ ID NO: 142213 - DNA, 25 bp, Mus musculus
tgaagatccccttttacaacggtgg

SEQ ID NO: 142214 - DNA, 25 bp, Mus musculus
tgaagatctcacctcacggcttgga

SEQ ID NO: 142215 - DNA, 25 bp, Mus musculus
tgaagatgacaaagagtgacgatga

SEQ ID NO: 142216 - DNA, 25 bp, Mus musculus
tgaagatgacatgccggcacctaac

SEQ ID NO: 142217 - DNA, 25 bp, Mus musculus
tgaagatgacattcgcagggcacgg

SEQ ID NO: 142218 - DNA, 25 bp, Mus musculus
tgaagatgaccgaaggagtaccctc

SEQ ID NO: 142219 - DNA, 25 bp, Mus musculus
tgaagatgactaacacactggtgac

SEQ ID NO: 142220 - DNA, 25 bp, Mus musculus
tgaagatgactgcaaaaattttgga

SEQ ID NO: 142221 - DNA, 25 bp, Mus musculus
tgaagatgagtacaggagcatgaca

SEQ ID NO: 142222 - DNA, 25 bp, Mus musculus
tgaagatgatccatggctaccccat

SEQ ID NO: 142223 - DNA, 25 bp, Mus musculus
tgaagatgatgaagcaacagagtgg

SEQ ID NO: 142224 - DNA, 25 bp, Mus musculus
tgaagatgatgctattttttacttg

SEQ ID NO: 142225 - DNA, 25 bp, Mus musculus
tgaagatgattccactaagcctcga

SEQ ID NO: 142226 - DNA, 25 bp, Mus musculus
tgaagatgcagcagcctgaacaggc

SEQ ID NO: 142227 - DNA, 25 bp, Mus musculus
tgaagatgcagctgtgccaggcgca

SEQ ID NO: 142228 - DNA, 25 bp, Mus musculus
tgaagatgcaggcagaacagctcca

SEQ ID NO: 142229 - DNA, 25 bp, Mus musculus
tgaagatgcccaagagcctggagac

SEQ ID NO: 142230 - DNA, 25 bp, Mus musculus
tgaagatgcctgctggaaacatggc

SEQ ID NO: 142231 - DNA, 25 bp, Mus musculus
tgaagatgctcgaggactgccagag

SEQ ID NO: 142232 - DNA, 25 bp, Mus musculus
tgaagatgctgacgactgaagcccc

SEQ ID NO: 142233 - DNA, 25 bp, Mus musculus
tgaagatgctgagggagcacaaccc

SEQ ID NO: 142234 - DNA, 25 bp, Mus musculus
tgaagatgcttctgaaaaccctggg

SEQ ID NO: 142235 - DNA, 25 bp, Mus musculus
tgaagatggcgacacagatgagtac

SEQ ID NO: 142236 - DNA, 25 bp, Mus musculus
tgaagatgggaaaacaccattggat

SEQ ID NO: 142237 - DNA, 25 bp, Mus musculus
tgaagatggtggaccgcgagcaact

SEQ ID NO: 142238 - DNA, 25 bp, Mus musculus
tgaagattcaaactccacgtggtct

SEQ ID NO: 142239 - DNA, 25 bp, Mus musculus
tgaagattcctgagaaagagccacc

SEQ ID NO: 142240 - DNA, 25 bp, Mus musculus
tgaagattctgtggcattacctccc

SEQ ID NO: 142241 - DNA, 25 bp, Mus musculus
tgaagattgacaacctcaccggcga

SEQ ID NO: 142242 - DNA, 25 bp, Mus musculus
tgaagattgccatctcggaggctga

SEQ ID NO: 142243 - DNA, 25 bp, Mus musculus
tgaagattgccctgcagcacggtga

SEQ ID NO: 142244 - DNA, 25 bp, Mus musculus
tgaagattggccatgctcactcagg

SEQ ID NO: 142245 - DNA, 25 bp, Mus musculus
tgaagatttcatcccacatggcggg

SEQ ID NO: 142246 - DNA, 25 bp, Mus musculus
tgaagatttctcagcagcctttggg

SEQ ID NO: 142247 - DNA, 25 bp, Mus musculus
tgaagcaaaccacgtccaaggagtc

SEQ ID NO: 142248 - DNA, 25 bp, Mus musculus
tgaagcaaatacctcggtgcctcag

SEQ ID NO: 142249 - DNA, 25 bp, Mus musculus
tgaagcaagatataaccggagtccc

SEQ ID NO: 142250 - DNA, 25 bp, Mus musculus
tgaagcaagcttgtatttcctcctg

SEQ ID NO: 142251 - DNA, 25 bp, Mus musculus
tgaagcacaagtccgtctatgaagc

SEQ ID NO: 142252 - DNA, 25 bp, Mus musculus
tgaagcaccagggtttctgccttgg

SEQ ID NO: 142253 - DNA, 25 bp, Mus musculus
tgaagcacccagacctagttaggcc

SEQ ID NO: 142254 - DNA, 25 bp, Mus musculus
tgaagcacctgatcaagatgacctt

SEQ ID NO: 142255 - DNA, 25 bp, Mus musculus
tgaagcacggtttcctgaggcacac

SEQ ID NO: 142256 - DNA, 25 bp, Mus musculus
tgaagcactaggtcggaacacagcc

SEQ ID NO: 142257 - DNA, 25 bp, Mus musculus
tgaagcactgcgtggaaagtcaccg

SEQ ID NO: 142258 - DNA, 25 bp, Mus musculus
tgaagcactttcctaaacatgcagc

SEQ ID NO: 142259 - DNA, 25 bp, Mus musculus
tgaagcagaccatcggaaactcctg

SEQ ID NO: 142260 - DNA, 25 bp, Mus musculus
tgaagcagatctgcagacataggac

SEQ ID NO: 142261 - DNA, 25 bp, Mus musculus
tgaagcagatgctgggtgcctccaa

SEQ ID NO: 142262 - DNA, 25 bp, Mus musculus
tgaagcagctgacatgagaaaacgg

SEQ ID NO: 142263 - DNA, 25 bp, Mus musculus
tgaagcatcccagtgtcaaccagga

SEQ ID NO: 142264 - DNA, 25 bp, Mus musculus
tgaagcatgacctgtgctccgcagc

SEQ ID NO: 142265 - DNA, 25 bp, Mus musculus
tgaagcatttgcagcctcctcagga

SEQ ID NO: 142266 - DNA, 25 bp, Mus musculus
tgaagccaccactgtcgactgcaat

SEQ ID NO: 142267 - DNA, 25 bp, Mus musculus
tgaagccactgacaccgagtctggt

SEQ ID NO: 142268 - DNA, 25 bp, Mus musculus
tgaagccactgagaccatcggtagg

SEQ ID NO: 142269 - DNA, 25 bp, Mus musculus
tgaagccagagtttgagagtgctgc

SEQ ID NO: 142270 - DNA, 25 bp, Mus musculus
tgaagccagatgtgaagatgaatac

SEQ ID NO: 142271 - DNA, 25 bp, Mus musculus
tgaagccagcagaggaatgacagcc

SEQ ID NO: 142272 - DNA, 25 bp, Mus musculus
tgaagccagcctcgtcatgggccta

SEQ ID NO: 142273 - DNA, 25 bp, Mus musculus
tgaagccagcgaatgtccggaggaa

SEQ ID NO: 142274 - DNA, 25 bp, Mus musculus
tgaagccaggattccacgttagtgc

SEQ ID NO: 142275 - DNA, 25 bp, Mus musculus
tgaagccagtaactcaacagaagcg

SEQ ID NO: 142276 - DNA, 25 bp, Mus musculus
tgaagccagtccagtttgtagcagc

SEQ ID NO: 142277 - DNA, 25 bp, Mus musculus
tgaagccatacacggagcctgagga

SEQ ID NO: 142278 - DNA, 25 bp, Mus musculus
tgaagccatgaatcctatccgcacg

SEQ ID NO: 142279 - DNA, 25 bp, Mus musculus
tgaagccatgttgtaccaccagaag

SEQ ID NO: 142280 - DNA, 25 bp, Mus musculus
tgaagcccactggtttccggaagcg

SEQ ID NO: 142281 - DNA, 25 bp, Mus musculus
tgaagcccagagaatgacctatagc

SEQ ID NO: 142282 - DNA, 25 bp, Mus musculus
tgaagcccaggaggtcacaattggc

SEQ ID NO: 142283 - DNA, 25 bp, Mus musculus
tgaagcccagtcctaactccagaaa

SEQ ID NO: 142284 - DNA, 25 bp, Mus musculus
tgaagccccatatagacccgtgatg

SEQ ID NO: 142285 - DNA, 25 bp, Mus musculus
tgaagccccggaaagtatgtacagg

SEQ ID NO: 142286 - DNA, 25 bp, Mus musculus
tgaagccccgtcaaacaagaacatg

SEQ ID NO: 142287 - DNA, 25 bp, Mus musculus
tgaagcccgctccaagaagtgtggt

SEQ ID NO: 142288 - DNA, 25 bp, Mus musculus
tgaagcccggaggaatgctattgtt

SEQ ID NO: 142289 - DNA, 25 bp, Mus musculus
tgaagccctaccagccagaaaccaa

SEQ ID NO: 142290 - DNA, 25 bp, Mus musculus
tgaagccctcaaacagatctgcctg

SEQ ID NO: 142291 - DNA, 25 bp, Mus musculus
tgaagcccttcgaatgtacacagtg

SEQ ID NO: 142292 - DNA, 25 bp, Mus musculus
tgaagccctttcgatgaagaagaca

SEQ ID NO: 142293 - DNA, 25 bp, Mus musculus
tgaagccctttggaggtacacctgg

SEQ ID NO: 142294 - DNA, 25 bp, Mus musculus
tgaagccgatggagattaaccccga

SEQ ID NO: 142295 - DNA, 25 bp, Mus musculus
tgaagccgttatccaggattctacc

SEQ ID NO: 142296 - DNA, 25 bp, Mus musculus
tgaagcctagcactggaaagctaac

SEQ ID NO: 142297 - DNA, 25 bp, Mus musculus
tgaagcctccggtgtgaacaagcat

SEQ ID NO: 142298 - DNA, 25 bp, Mus musculus
tgaagcctgcagtcgcacatctgag

SEQ ID NO: 142299 - DNA, 25 bp, Mus musculus
tgaagcctgcctattcgaagaagca

SEQ ID NO: 142300 - DNA, 25 bp, Mus musculus
tgaagcctgccttttccgtctagcc

SEQ ID NO: 142301 - DNA, 25 bp, Mus musculus
tgaagccttgctcctgacagtgttc

SEQ ID NO: 142302 - DNA, 25 bp, Mus musculus
tgaagccttggatgctctggatgct

SEQ ID NO: 142303 - DNA, 25 bp, Mus musculus
tgaagccttgtgactcttcccgaag

SEQ ID NO: 142304 - DNA, 25 bp, Mus musculus
tgaagcgagtcaagggtctctctga

SEQ ID NO: 142305 - DNA, 25 bp, Mus musculus
tgaagcgattgcagcctgcagagct

SEQ ID NO: 142306 - DNA, 25 bp, Mus musculus
tgaagcgcagaccaagccatagtga

SEQ ID NO: 142307 - DNA, 25 bp, Mus musculus
tgaagcgctctcagggagtcacggt

SEQ ID NO: 142308 - DNA, 25 bp, Mus musculus
tgaagcggaacaacctgaaccggga

SEQ ID NO: 142309 - DNA, 25 bp, Mus musculus
tgaagcggcgacattactggagaat

SEQ ID NO: 142310 - DNA, 25 bp, Mus musculus
tgaagcgggactgacttcttccgac

SEQ ID NO: 142311 - DNA, 25 bp, Mus musculus
tgaagctacagcatccgacactgaa

SEQ ID NO: 142312 - DNA, 25 bp, Mus musculus
tgaagctacgtgtacctggagtggc

SEQ ID NO: 142313 - DNA, 25 bp, Mus musculus
tgaagctagctcaagtcctcctggg

SEQ ID NO: 142314 - DNA, 25 bp, Mus musculus
tgaagctagttacctccaagcagca

SEQ ID NO: 142315 - DNA, 25 bp, Mus musculus
tgaagctcagaagctccaggcagag

SEQ ID NO: 142316 - DNA, 25 bp, Mus musculus
tgaagctcccgaagccttggtgggc

SEQ ID NO: 142317 - DNA, 25 bp, Mus musculus
tgaagctccctctggaaataacaaa

SEQ ID NO: 142318 - DNA, 25 bp, Mus musculus
tgaagctcgtcaggtggaacaagtg

SEQ ID NO: 142319 - DNA, 25 bp, Mus musculus
tgaagctcttcaatgccaccacgaa

SEQ ID NO: 142320 - DNA, 25 bp, Mus musculus
tgaagctcttttggtacccgatggg

SEQ ID NO: 142321 - DNA, 25 bp, Mus musculus
tgaagctgactacgcaggcctactg

SEQ ID NO: 142322 - DNA, 25 bp, Mus musculus
tgaagctgagctcaagtatgacccg

SEQ ID NO: 142323 - DNA, 25 bp, Mus musculus
tgaagctgaggacatattggaaaca

SEQ ID NO: 142324 - DNA, 25 bp, Mus musculus
tgaagctgatactcacggagagacc

SEQ ID NO: 142325 - DNA, 25 bp, Mus musculus
tgaagctgatgatgaaaggccagcc

SEQ ID NO: 142326 - DNA, 25 bp, Mus musculus
tgaagctgcacactttgtctccacc

SEQ ID NO: 142327 - DNA, 25 bp, Mus musculus
tgaagctgcccaggtatccacgtgt

SEQ ID NO: 142328 - DNA, 25 bp, Mus musculus
tgaagctgccctctgacgttgtgac

SEQ ID NO: 142329 - DNA, 25 bp, Mus musculus
tgaagctgccgagaagcctgtacct

SEQ ID NO: 142330 - DNA, 25 bp, Mus musculus
tgaagctgctcactcaagaggtggc

SEQ ID NO: 142331 - DNA, 25 bp, Mus musculus
tgaagctggaccactaccgagcagc

SEQ ID NO: 142332 - DNA, 25 bp, Mus musculus
tgaagctggatcctttcgtggagca

SEQ ID NO: 142333 - DNA, 25 bp, Mus musculus
tgaagctggcgaacctgagcaagca

SEQ ID NO: 142334 - DNA, 25 bp, Mus musculus
tgaagctgggcatttataactagat

SEQ ID NO: 142335 - DNA, 25 bp, Mus musculus
tgaagctgggtgtggatactatcgc

SEQ ID NO: 142336 - DNA, 25 bp, Mus musculus
tgaagctggtgcatacacaggaacc

SEQ ID NO: 142337 - DNA, 25 bp, Mus musculus
tgaagctgtcggtcaatgcccgggc

SEQ ID NO: 142338 - DNA, 25 bp, Mus musculus
tgaagctgtgatcagtttagcaaag

SEQ ID NO: 142339 - DNA, 25 bp, Mus musculus
tgaagcttaccgatgggatgacgat

SEQ ID NO: 142340 - DNA, 25 bp, Mus musculus
tgaagcttccctgtcgacgatgatg

SEQ ID NO: 142341 - DNA, 25 bp, Mus musculus
tgaagcttgcagactagggagccgc

SEQ ID NO: 142342 - DNA, 25 bp, Mus musculus
tgaagcttgtaacaacaacctggag

SEQ ID NO: 142343 - DNA, 25 bp, Mus musculus
tgaaggaaaaggtcaatgccgcccg

SEQ ID NO: 142344 - DNA, 25 bp, Mus musculus
tgaaggaaaggagtctgccagctct

SEQ ID NO: 142345 - DNA, 25 bp, Mus musculus
tgaaggaacctgctctgatactggg

SEQ ID NO: 142346 - DNA, 25 bp, Mus musculus
tgaaggaactcgatggtgaacttgc

SEQ ID NO: 142347 - DNA, 25 bp, Mus musculus
tgaaggaactggatgaaaacggaga

SEQ ID NO: 142348 - DNA, 25 bp, Mus musculus
tgaaggaacttctacagtcttccag

SEQ ID NO: 142349 - DNA, 25 bp, Mus musculus
tgaaggaagacctggtactagcccc

SEQ ID NO: 142350 - DNA, 25 bp, Mus musculus
tgaaggaagagcaccgttactggct

SEQ ID NO: 142351 - DNA, 25 bp, Mus musculus
tgaaggaagtgatccggctgtgcca

SEQ ID NO: 142352 - DNA, 25 bp, Mus musculus
tgaaggaattcagcagtcaactggc

SEQ ID NO: 142353 - DNA, 25 bp, Mus musculus
tgaaggaatttgaccaccccaacgt

SEQ ID NO: 142354 - DNA, 25 bp, Mus musculus
tgaaggacaatgtgaggcccctgca

SEQ ID NO: 142355 - DNA, 25 bp, Mus musculus
tgaaggacagtctgcaccatgggac

SEQ ID NO: 142356 - DNA, 25 bp, Mus musculus
tgaaggacatcaactgggacagctc

SEQ ID NO: 142357 - DNA, 25 bp, Mus musculus
tgaaggacatcagtggccgaaagct

SEQ ID NO: 142358 - DNA, 25 bp, Mus musculus
tgaaggacatccctgcgaagcatgt

SEQ ID NO: 142359 - DNA, 25 bp, Mus musculus
tgaaggaccatttgcatccagaagt

SEQ ID NO: 142360 - DNA, 25 bp, Mus musculus
tgaaggacgagtgcctgttttcagc

SEQ ID NO: 142361 - DNA, 25 bp, Mus musculus
tgaaggactacctcagctggcgaca

SEQ ID NO: 142362 - DNA, 25 bp, Mus musculus
tgaaggactggcataacaaggaggc

SEQ ID NO: 142363 - DNA, 25 bp, Mus musculus
tgaaggacttatacaccgcagagtg

SEQ ID NO: 142364 - DNA, 25 bp, Mus musculus
tgaaggacttccagtatgtggaccg

SEQ ID NO: 142365 - DNA, 25 bp, Mus musculus
tgaaggacttgccaacgaggaacgt

SEQ ID NO: 142366 - DNA, 25 bp, Mus musculus
tgaaggagaaattcaccacctttag

SEQ ID NO: 142367 - DNA, 25 bp, Mus musculus
tgaaggagaagggaacatcgcacgt

SEQ ID NO: 142368 - DNA, 25 bp, Mus musculus
tgaaggagagacactctggccgcac

SEQ ID NO: 142369 - DNA, 25 bp, Mus musculus
tgaaggagagcgactggaatcagca

SEQ ID NO: 142370 - DNA, 25 bp, Mus musculus
tgaaggagagcgttccaagaccaca

SEQ ID NO: 142371 - DNA, 25 bp, Mus musculus
tgaaggagatcgtgaaggctgccaa

SEQ ID NO: 142372 - DNA, 25 bp, Mus musculus
tgaaggagatgatccagcactgcgt

SEQ ID NO: 142373 - DNA, 25 bp, Mus musculus
tgaaggagcaacactcgcaggaact

SEQ ID NO: 142374 - DNA, 25 bp, Mus musculus
tgaaggagcaatcaaaagcagacgg

SEQ ID NO: 142375 - DNA, 25 bp, Mus musculus
tgaaggagccgtgatctcgaagatc

SEQ ID NO: 142376 - DNA, 25 bp, Mus musculus
tgaaggagctcaacgtacaggtgga

SEQ ID NO: 142377 - DNA, 25 bp, Mus musculus
tgaaggagctgtgggcataccagca

SEQ ID NO: 142378 - DNA, 25 bp, Mus musculus
tgaaggaggaatcagagaccttagc

SEQ ID NO: 142379 - DNA, 25 bp, Mus musculus
tgaaggagggccagttaagcaagca

SEQ ID NO: 142380 - DNA, 25 bp, Mus musculus
tgaaggagttcaggcagctggctaa

SEQ ID NO: 142381 - DNA, 25 bp, Mus musculus
tgaaggatcccctgtgtagaccgcc

SEQ ID NO: 142382 - DNA, 25 bp, Mus musculus
tgaaggatcctgtggtctccaacgg

SEQ ID NO: 142383 - DNA, 25 bp, Mus musculus
tgaaggatgtgcctaccatactacc

SEQ ID NO: 142384 - DNA, 25 bp, Mus musculus
tgaaggcagcaaatccagtgagact

SEQ ID NO: 142385 - DNA, 25 bp, Mus musculus
tgaaggcagcagtctctacaaacac

SEQ ID NO: 142386 - DNA, 25 bp, Mus musculus
tgaaggccatcgtgtcatcagggac

SEQ ID NO: 142387 - DNA, 25 bp, Mus musculus
tgaaggccctccatcacatgctggc

SEQ ID NO: 142388 - DNA, 25 bp, Mus musculus
tgaaggccgccttgtgacagtgaag

SEQ ID NO: 142389 - DNA, 25 bp, Mus musculus
tgaaggccggcagcatcaatgtctg

SEQ ID NO: 142390 - DNA, 25 bp, Mus musculus
tgaaggcctagaccttactcacggg

SEQ ID NO: 142391 - DNA, 25 bp, Mus musculus
tgaaggccttcgtgtattttactat

SEQ ID NO: 142392 - DNA, 25 bp, Mus musculus
tgaaggcgaacctgggatcgagtct

SEQ ID NO: 142393 - DNA, 25 bp, Mus musculus
tgaaggcgcactagagctgctggca

SEQ ID NO: 142394 - DNA, 25 bp, Mus musculus
tgaaggcggaatgttcaccgatgcc

SEQ ID NO: 142395 - DNA, 25 bp, Mus musculus
tgaaggctcaagaccggatagacag

SEQ ID NO: 142396 - DNA, 25 bp, Mus musculus
tgaaggctcctggaattcttacgtg

SEQ ID NO: 142397 - DNA, 25 bp, Mus musculus
tgaaggctggcaagggcctgaccat

SEQ ID NO: 142398 - DNA, 25 bp, Mus musculus
tgaaggctgtactgctcctacacag

SEQ ID NO: 142399 - DNA, 25 bp, Mus musculus
tgaaggcttgctcctcagaactgga

SEQ ID NO: 142400 - DNA, 25 bp, Mus musculus
tgaaggcttttactacctggacagc

SEQ ID NO: 142401 - DNA, 25 bp, Mus musculus
tgaagggaacgttcctcagcaccac

SEQ ID NO: 142402 - DNA, 25 bp, Mus musculus
tgaagggacctgctcacgataagct

SEQ ID NO: 142403 - DNA, 25 bp, Mus musculus
tgaagggcacaagaccaggaactca

SEQ ID NO: 142404 - DNA, 25 bp, Mus musculus
tgaagggccacagacagctggtgaa

SEQ ID NO: 142405 - DNA, 25 bp, Mus musculus
tgaagggccccagactgagatgact

SEQ ID NO: 142406 - DNA, 25 bp, Mus musculus
tgaagggcgcattactccagagctg

SEQ ID NO: 142407 - DNA, 25 bp, Mus musculus
tgaagggctgcagcatgtacgtcgc

SEQ ID NO: 142408 - DNA, 25 bp, Mus musculus
tgaagggtccctgatcaagctcacc

SEQ ID NO: 142409 - DNA, 25 bp, Mus musculus
tgaagggtgcgagcccacaatagtg

SEQ ID NO: 142410 - DNA, 25 bp, Mus musculus
tgaaggtacccatgaacacagtgga

SEQ ID NO: 142411 - DNA, 25 bp, Mus musculus
tgaaggtcactcaagagccaagagc

SEQ ID NO: 142412 - DNA, 25 bp, Mus musculus
tgaaggtcttcagggtgcctcccag

SEQ ID NO: 142413 - DNA, 25 bp, Mus musculus
tgaaggtgacagggcagaaccaaga

SEQ ID NO: 142414 - DNA, 25 bp, Mus musculus
tgaaggtgccaacctcaattcatcc

SEQ ID NO: 142415 - DNA, 25 bp, Mus musculus
tgaaggtgctatgcttgcagccagt

SEQ ID NO: 142416 - DNA, 25 bp, Mus musculus
tgaaggtggtctgagaaatactccc

SEQ ID NO: 142417 - DNA, 25 bp, Mus musculus
tgaaggttaagaaactgcccctgat

SEQ ID NO: 142418 - DNA, 25 bp, Mus musculus
tgaaggttcaagaggtttcccagga

SEQ ID NO: 142419 - DNA, 25 bp, Mus musculus
tgaaggttcacagcaaatcgcctgc

SEQ ID NO: 142420 - DNA, 25 bp, Mus musculus
tgaaggttcagatccacagccagtc

SEQ ID NO: 142421 - DNA, 25 bp, Mus musculus
tgaaggttccagaccggctgagcat

SEQ ID NO: 142422 - DNA, 25 bp, Mus musculus
tgaaggttgcctacatcccagatga

SEQ ID NO: 142423 - DNA, 25 bp, Mus musculus
tgaaggtttcttccccacgcagtga

SEQ ID NO: 142424 - DNA, 25 bp, Mus musculus
tgaaggttttgatcctcagggagcc

SEQ ID NO: 142425 - DNA, 25 bp, Mus musculus
tgaagtaaaacatacgcctgcctcg

SEQ ID NO: 142426 - DNA, 25 bp, Mus musculus
tgaagtaacgctactccgggacaat

SEQ ID NO: 142427 - DNA, 25 bp, Mus musculus
tgaagtaactcaagatgagcaagct

SEQ ID NO: 142428 - DNA, 25 bp, Mus musculus
tgaagtaactcgtatggccaggaag

SEQ ID NO: 142429 - DNA, 25 bp, Mus musculus
tgaagtacaacctcacgctgaacga

SEQ ID NO: 142430 - DNA, 25 bp, Mus musculus
tgaagtacaatcaggcaacacccac

SEQ ID NO: 142431 - DNA, 25 bp, Mus musculus
tgaagtacagacagactgcgccgag

SEQ ID NO: 142432 - DNA, 25 bp, Mus musculus
tgaagtaccggaaccgtgtgcgcag

SEQ ID NO: 142433 - DNA, 25 bp, Mus musculus
tgaagtacgttaacgtgggagatct

SEQ ID NO: 142434 - DNA, 25 bp, Mus musculus
tgaagtagaacacccgtcactgctg

SEQ ID NO: 142435 - DNA, 25 bp, Mus musculus
tgaagtagcacatagcaccagcact

SEQ ID NO: 142436 - DNA, 25 bp, Mus musculus
tgaagtagccgacaagactgaggac

SEQ ID NO: 142437 - DNA, 25 bp, Mus musculus
tgaagtagtctacgtggcacctgaa

SEQ ID NO: 142438 - DNA, 25 bp, Mus musculus
tgaagtagttgagcgccttggccct

SEQ ID NO: 142439 - DNA, 25 bp, Mus musculus
tgaagtagtttctcagacacctgct

SEQ ID NO: 142440 - DNA, 25 bp, Mus musculus
tgaagtatgcaccaaacaacggtgg

SEQ ID NO: 142441 - DNA, 25 bp, Mus musculus
tgaagtcaaaaaggagccagatgcc

SEQ ID NO: 142442 - DNA, 25 bp, Mus musculus
tgaagtcaatgctgtcaggccaggg

SEQ ID NO: 142443 - DNA, 25 bp, Mus musculus
tgaagtcacctgttccccgatcaga

SEQ ID NO: 142444 - DNA, 25 bp, Mus musculus
tgaagtcagcccgagaagaacagag

SEQ ID NO: 142445 - DNA, 25 bp, Mus musculus
tgaagtcagccctaagtttcctgcg

SEQ ID NO: 142446 - DNA, 25 bp, Mus musculus
tgaagtcagtgactccgacagcggc

SEQ ID NO: 142447 - DNA, 25 bp, Mus musculus
tgaagtcatctgcaccgtctgcctg

SEQ ID NO: 142448 - DNA, 25 bp, Mus musculus
tgaagtcattgtcccagtttagaag

SEQ ID NO: 142449 - DNA, 25 bp, Mus musculus
tgaagtccaatcgacaagctaccct

SEQ ID NO: 142450 - DNA, 25 bp, Mus musculus
tgaagtccagcctcctacgataata

SEQ ID NO: 142451 - DNA, 25 bp, Mus musculus
tgaagtccagtgtgagattgaagaa

SEQ ID NO: 142452 - DNA, 25 bp, Mus musculus
tgaagtccatcctacgacaaatctt

SEQ ID NO: 142453 - DNA, 25 bp, Mus musculus
tgaagtccattatccaacacgaaga

SEQ ID NO: 142454 - DNA, 25 bp, Mus musculus
tgaagtccgagttacaccaaccagg

SEQ ID NO: 142455 - DNA, 25 bp, Mus musculus
tgaagtccgcaactgacaatgcagc

SEQ ID NO: 142456 - DNA, 25 bp, Mus musculus
tgaagtccttaatcacagggcctag

SEQ ID NO: 142457 - DNA, 25 bp, Mus musculus
tgaagtcgagaccaagttctgcaga

SEQ ID NO: 142458 - DNA, 25 bp, Mus musculus
tgaagtcgctgctcctaggcagccg

SEQ ID NO: 142459 - DNA, 25 bp, Mus musculus
tgaagtcggcagtctgtacctgggc

SEQ ID NO: 142460 - DNA, 25 bp, Mus musculus
tgaagtctacactgaagaagatgct

SEQ ID NO: 142461 - DNA, 25 bp, Mus musculus
tgaagtctccgccatacagtgcaac

SEQ ID NO: 142462 - DNA, 25 bp, Mus musculus
tgaagtctctctgcgccaagcatgg

SEQ ID NO: 142463 - DNA, 25 bp, Mus musculus
tgaagtctctggttgaccctaagga

SEQ ID NO: 142464 - DNA, 25 bp, Mus musculus
tgaagtctgaaccatacagtgagga

SEQ ID NO: 142465 - DNA, 25 bp, Mus musculus
tgaagtctgacatatacaagggcct

SEQ ID NO: 142466 - DNA, 25 bp, Mus musculus
tgaagtctggcacaccatggatgac

SEQ ID NO: 142467 - DNA, 25 bp, Mus musculus
tgaagtctgttgacatcaaggccct

SEQ ID NO: 142468 - DNA, 25 bp, Mus musculus
tgaagtcttccaccagtgtcagcag

SEQ ID NO: 142469 - DNA, 25 bp, Mus musculus
tgaagtgaatatcccaaagaagcca

SEQ ID NO: 142470 - DNA, 25 bp, Mus musculus
tgaagtgcacaacgaagacggaaga

SEQ ID NO: 142471 - DNA, 25 bp, Mus musculus
tgaagtgcagcacctcctaaggctg

SEQ ID NO: 142472 - DNA, 25 bp, Mus musculus
tgaagtgcattccagtcctctcaag

SEQ ID NO: 142473 - DNA, 25 bp, Mus musculus
tgaagtgccagaagctgaccgacga

SEQ ID NO: 142474 - DNA, 25 bp, Mus musculus
tgaagtgcgcaagcatctgaccgct

SEQ ID NO: 142475 - DNA, 25 bp, Mus musculus
tgaagtggcctgagatgtagagttt

SEQ ID NO: 142476 - DNA, 25 bp, Mus musculus
tgaagtggttgactcctctgtgaac

SEQ ID NO: 142477 - DNA, 25 bp, Mus musculus
tgaagtggtttctcagcccattgac

SEQ ID NO: 142478 - DNA, 25 bp, Mus musculus
tgaagtgtatgaaacctgctgcccc

SEQ ID NO: 142479 - DNA, 25 bp, Mus musculus
tgaagtgtcagtcaacgtggcccct

SEQ ID NO: 142480 - DNA, 25 bp, Mus musculus
tgaagtgtgccagcctaagcctgcg

SEQ ID NO: 142481 - DNA, 25 bp, Mus musculus
tgaagttacgcaggcttgagccagc

SEQ ID NO: 142482 - DNA, 25 bp, Mus musculus
tgaagttagagcattaaaggacgcc

SEQ ID NO: 142483 - DNA, 25 bp, Mus musculus
tgaagttcaacgacgcagactcggt

SEQ ID NO: 142484 - DNA, 25 bp, Mus musculus
tgaagttcacaaaagaccacacagt

SEQ ID NO: 142485 - DNA, 25 bp, Mus musculus
tgaagttcagctactcggtgcaggg

SEQ ID NO: 142486 - DNA, 25 bp, Mus musculus
tgaagttccgttcgagcaaatccag

SEQ ID NO: 142487 - DNA, 25 bp, Mus musculus
tgaagttcgatgagctctaccacct

SEQ ID NO: 142488 - DNA, 25 bp, Mus musculus
tgaagttctggagcatacggcggct

SEQ ID NO: 142489 - DNA, 25 bp, Mus musculus
tgaagttgaccctgtgccaaagaag

SEQ ID NO: 142490 - DNA, 25 bp, Mus musculus
tgaagttgaccttggtggacacgcc

SEQ ID NO: 142491 - DNA, 25 bp, Mus musculus
tgaagttgatgagcgtattacaccc

SEQ ID NO: 142492 - DNA, 25 bp, Mus musculus
tgaagttgccaacctcaaggaaggg

SEQ ID NO: 142493 - DNA, 25 bp, Mus musculus
tgaagttgcgactggaacaggaccc

SEQ ID NO: 142494 - DNA, 25 bp, Mus musculus
tgaagttgctggacgcctatctcct

SEQ ID NO: 142495 - DNA, 25 bp, Mus musculus
tgaagttggccctgatcctaaccag

SEQ ID NO: 142496 - DNA, 25 bp, Mus musculus
tgaagttgtcgtccctactggaccc

SEQ ID NO: 142497 - DNA, 25 bp, Mus musculus
tgaagttgtgtctcgtaccatgact

SEQ ID NO: 142498 - DNA, 25 bp, Mus musculus
tgaagtttcctcacatcagccagtg

SEQ ID NO: 142499 - DNA, 25 bp, Mus musculus
tgaagtttctgcccctggctccatt

SEQ ID NO: 142500 - DNA, 25 bp, Mus musculus
tgaagttttaaaatgggcccaatct

SEQ ID NO: 142501 - DNA, 25 bp, Mus musculus
tgaataaaatcaagagcatggcccc

SEQ ID NO: 142502 - DNA, 25 bp, Mus musculus
tgaataacatcagagcactgcgcag

SEQ ID NO: 142503 - DNA, 25 bp, Mus musculus
tgaataacgtggcagctacagctcg

SEQ ID NO: 142504 - DNA, 25 bp, Mus musculus
tgaataactgagctgggtccatgga

SEQ ID NO: 142505 - DNA, 25 bp, Mus musculus
tgaataagtttttgcggcgccagaa

SEQ ID NO: 142506 - DNA, 25 bp, Mus musculus
tgaatacaaaaagcataggcggacc

SEQ ID NO: 142507 - DNA, 25 bp, Mus musculus
tgaatacaatcagagtcctcgggcg

SEQ ID NO: 142508 - DNA, 25 bp, Mus musculus
tgaataccatgaaaaagactacgct

SEQ ID NO: 142509 - DNA, 25 bp, Mus musculus
tgaataccttaagtacaacaaaggg

SEQ ID NO: 142510 - DNA, 25 bp, Mus musculus
tgaataccttgtacagcagaacgta

SEQ ID NO: 142511 - DNA, 25 bp, Mus musculus
tgaatacgcctaagcacagcaggac

SEQ ID NO: 142512 - DNA, 25 bp, Mus musculus
tgaatacggcacgaaaacattttgg

SEQ ID NO: 142513 - DNA, 25 bp, Mus musculus
tgaatacggctgtgatggagctgct

SEQ ID NO: 142514 - DNA, 25 bp, Mus musculus
tgaatactcttccagcctgcctcag

SEQ ID NO: 142515 - DNA, 25 bp, Mus musculus
tgaatactgacttgggcgtgggccc

SEQ ID NO: 142516 - DNA, 25 bp, Mus musculus
tgaatactgatgaacctccaatggt

SEQ ID NO: 142517 - DNA, 25 bp, Mus musculus
tgaatactgtggagcgatgggaccc

SEQ ID NO: 142518 - DNA, 25 bp, Mus musculus
tgaatagttcatggaagctccccgt

SEQ ID NO: 142519 - DNA, 25 bp, Mus musculus
tgaatatcagcggtctggcggcgct

SEQ ID NO: 142520 - DNA, 25 bp, Mus musculus
tgaatatgactaccagtggcccaga

SEQ ID NO: 142521 - DNA, 25 bp, Mus musculus
tgaatatgactctcgggtgaaggcc

SEQ ID NO: 142522 - DNA, 25 bp, Mus musculus
tgaatatgatgctgggcaagcggtc

SEQ ID NO: 142523 - DNA, 25 bp, Mus musculus
tgaatatgcaagaagacaccactgg

SEQ ID NO: 142524 - DNA, 25 bp, Mus musculus
tgaatatgctttcaagctggcccag

SEQ ID NO: 142525 - DNA, 25 bp, Mus musculus
tgaatcacacaattacaatgcaaag

SEQ ID NO: 142526 - DNA, 25 bp, Mus musculus
tgaatcattgaggatccaagtcatg

SEQ ID NO: 142527 - DNA, 25 bp, Mus musculus
tgaatcccaggcagatgacagctct

SEQ ID NO: 142528 - DNA, 25 bp, Mus musculus
tgaatcccaggttcagtaacgccca

SEQ ID NO: 142529 - DNA, 25 bp, Mus musculus
tgaatcccgatctgcgcaaggagcg

SEQ ID NO: 142530 - DNA, 25 bp, Mus musculus
tgaatcccgtgtagcttttgtgagg

SEQ ID NO: 142531 - DNA, 25 bp, Mus musculus
tgaatcccttcaccatgcaggagga

SEQ ID NO: 142532 - DNA, 25 bp, Mus musculus
tgaatccgcggctatggagcgtcct

SEQ ID NO: 142533 - DNA, 25 bp, Mus musculus
tgaatccgtgcaccaacatgaaggt

SEQ ID NO: 142534 - DNA, 25 bp, Mus musculus
tgaatcctaagaatgtccaccagag

SEQ ID NO: 142535 - DNA, 25 bp, Mus musculus
tgaatcctagcacctcactgctggt

SEQ ID NO: 142536 - DNA, 25 bp, Mus musculus
tgaatcctggttccatctacgaggc

SEQ ID NO: 142537 - DNA, 25 bp, Mus musculus
tgaatcctgttgcacccagctgctg

SEQ ID NO: 142538 - DNA, 25 bp, Mus musculus
tgaatcgaccagttttgagaggaga

SEQ ID NO: 142539 - DNA, 25 bp, Mus musculus
tgaatcgctctctccccgatatccg

SEQ ID NO: 142540 - DNA, 25 bp, Mus musculus
tgaatcggccgagacaatgtatgac

SEQ ID NO: 142541 - DNA, 25 bp, Mus musculus
tgaatctaccctccgtgctctcaga

SEQ ID NO: 142542 - DNA, 25 bp, Mus musculus
tgaatctactggcaaggcacctctg

SEQ ID NO: 142543 - DNA, 25 bp, Mus musculus
tgaatctcacatctgaagaccagtg

SEQ ID NO: 142544 - DNA, 25 bp, Mus musculus
tgaatctcacggtctggagggccag

SEQ ID NO: 142545 - DNA, 25 bp, Mus musculus
tgaatctccgagtgctgaacgctgt

SEQ ID NO: 142546 - DNA, 25 bp, Mus musculus
tgaatctgggccttaaccacctgga

SEQ ID NO: 142547 - DNA, 25 bp, Mus musculus
tgaatcttgtcaggcagaagtgaac

SEQ ID NO: 142548 - DNA, 25 bp, Mus musculus
tgaatgaactgctgtcggactcggc

SEQ ID NO: 142549 - DNA, 25 bp, Mus musculus
tgaatgaagattatcccgtagaaat

SEQ ID NO: 142550 - DNA, 25 bp, Mus musculus
tgaatgaagccatcgaccagcgtaa

SEQ ID NO: 142551 - DNA, 25 bp, Mus musculus
tgaatgacaccaagcgaggagatgc

SEQ ID NO: 142552 - DNA, 25 bp, Mus musculus
tgaatgacaccagcaagcctgtggg

SEQ ID NO: 142553 - DNA, 25 bp, Mus musculus
tgaatgagacagtcacagggacgtg

SEQ ID NO: 142554 - DNA, 25 bp, Mus musculus
tgaatgagatctctgcgcggcacag

SEQ ID NO: 142555 - DNA, 25 bp, Mus musculus
tgaatgagatgtcggccatcctgcg

SEQ ID NO: 142556 - DNA, 25 bp, Mus musculus
tgaatgagcaaaacccagaggcgca

SEQ ID NO: 142557 - DNA, 25 bp, Mus musculus
tgaatgagctcgtgtccctgacatg

SEQ ID NO: 142558 - DNA, 25 bp, Mus musculus
tgaatgaggctgactgtgccaccgt

SEQ ID NO: 142559 - DNA, 25 bp, Mus musculus
tgaatgagttctatgcccatccccg

SEQ ID NO: 142560 - DNA, 25 bp, Mus musculus
tgaatgataagaaaccgggccctgg

SEQ ID NO: 142561 - DNA, 25 bp, Mus musculus
tgaatgatgacttagagccggccac

SEQ ID NO: 142562 - DNA, 25 bp, Mus musculus
tgaatgatttcagaaaacgtgcctg

SEQ ID NO: 142563 - DNA, 25 bp, Mus musculus
tgaatgcaacttctgcaggaggccc

SEQ ID NO: 142564 - DNA, 25 bp, Mus musculus
tgaatgcacgaaggtgagacgccac

SEQ ID NO: 142565 - DNA, 25 bp, Mus musculus
tgaatgcatcgaggccgtaatccgc

SEQ ID NO: 142566 - DNA, 25 bp, Mus musculus
tgaatgccaacaacaccagagtcca

SEQ ID NO: 142567 - DNA, 25 bp, Mus musculus
tgaatgccactgtccgtcaggatgg

SEQ ID NO: 142568 - DNA, 25 bp, Mus musculus
tgaatgccatggtagcaaagctggg

SEQ ID NO: 142569 - DNA, 25 bp, Mus musculus
tgaatgcccaggaatcagccaagag

SEQ ID NO: 142570 - DNA, 25 bp, Mus musculus
tgaatgccgaggttctgagcgtccg

SEQ ID NO: 142571 - DNA, 25 bp, Mus musculus
tgaatgcctccatgggtcctggacg

SEQ ID NO: 142572 - DNA, 25 bp, Mus musculus
tgaatgccttggaatcacatagtcc

SEQ ID NO: 142573 - DNA, 25 bp, Mus musculus
tgaatgctagtacccaagaccttga

SEQ ID NO: 142574 - DNA, 25 bp, Mus musculus
tgaatgctgcatgtctggtccggga

SEQ ID NO: 142575 - DNA, 25 bp, Mus musculus
tgaatgctgcggaagatcggctacc

SEQ ID NO: 142576 - DNA, 25 bp, Mus musculus
tgaatgctgtcctgtataccaaccg

SEQ ID NO: 142577 - DNA, 25 bp, Mus musculus
tgaatggaaaaacaaggctgctgca

SEQ ID NO: 142578 - DNA, 25 bp, Mus musculus
tgaatggaaactggattcagagctg

SEQ ID NO: 142579 - DNA, 25 bp, Mus musculus
tgaatggaaccctctctgcgggtgc

SEQ ID NO: 142580 - DNA, 25 bp, Mus musculus
tgaatggaatccacagcgaactgaa

SEQ ID NO: 142581 - DNA, 25 bp, Mus musculus
tgaatggacacgatttgcccggacc

SEQ ID NO: 142582 - DNA, 25 bp, Mus musculus
tgaatggactaaacatgaagagcct

SEQ ID NO: 142583 - DNA, 25 bp, Mus musculus
tgaatggacttggatcagctggacc

SEQ ID NO: 142584 - DNA, 25 bp, Mus musculus
tgaatggagacacaatgatggagac

SEQ ID NO: 142585 - DNA, 25 bp, Mus musculus
tgaatggcaagtacacggctgacgg

SEQ ID NO: 142586 - DNA, 25 bp, Mus musculus
tgaatggcaccttcgaaagcgccct

SEQ ID NO: 142587 - DNA, 25 bp, Mus musculus
tgaatggcagaaaagcgcctacctc

SEQ ID NO: 142588 - DNA, 25 bp, Mus musculus
tgaatggcgattgatcagcaatgcc

SEQ ID NO: 142589 - DNA, 25 bp, Mus musculus
tgaatggcttcaacaagacggtcct

SEQ ID NO: 142590 - DNA, 25 bp, Mus musculus
tgaatggcttctatatccccaaggg

SEQ ID NO: 142591 - DNA, 25 bp, Mus musculus
tgaatgggaacgagctttagagcgc

SEQ ID NO: 142592 - DNA, 25 bp, Mus musculus
tgaatgggaccaatgccttgccaca

SEQ ID NO: 142593 - DNA, 25 bp, Mus musculus
tgaatggtcagggtacacacctcgc

SEQ ID NO: 142594 - DNA, 25 bp, Mus musculus
tgaatgtaaggactggatcggcccc

SEQ ID NO: 142595 - DNA, 25 bp, Mus musculus
tgaatgtacactgcgtatcccaagg

SEQ ID NO: 142596 - DNA, 25 bp, Mus musculus
tgaatgtacccagcctcttgagagg

SEQ ID NO: 142597 - DNA, 25 bp, Mus musculus
tgaatgtacgcaacccactgagtat

SEQ ID NO: 142598 - DNA, 25 bp, Mus musculus
tgaatgtccccttcatgctggtgga

SEQ ID NO: 142599 - DNA, 25 bp, Mus musculus
tgaatgtccttgtgacgccagagct

SEQ ID NO: 142600 - DNA, 25 bp, Mus musculus
tgaatgtcgctgtgtggcctatacc

SEQ ID NO: 142601 - DNA, 25 bp, Mus musculus
tgaatgtgccaaccccggaaggaca

SEQ ID NO: 142602 - DNA, 25 bp, Mus musculus
tgaatgtgctcatagcccagctagc

SEQ ID NO: 142603 - DNA, 25 bp, Mus musculus
tgaatgtgcttgctttggacaggac

SEQ ID NO: 142604 - DNA, 25 bp, Mus musculus
tgaatgtttgtaccctttcagggag

SEQ ID NO: 142605 - DNA, 25 bp, Mus musculus
tgaattaacacagctaatccgggca

SEQ ID NO: 142606 - DNA, 25 bp, Mus musculus
tgaattaagcgctgtgtttgatggg

SEQ ID NO: 142607 - DNA, 25 bp, Mus musculus
tgaattacacgaccattccggtcta

SEQ ID NO: 142608 - DNA, 25 bp, Mus musculus
tgaattactatgagtctatgaaagc

SEQ ID NO: 142609 - DNA, 25 bp, Mus musculus
tgaattagaagctccagggtctccg

SEQ ID NO: 142610 - DNA, 25 bp, Mus musculus
tgaattattattgcctgccctggct

SEQ ID NO: 142611 - DNA, 25 bp, Mus musculus
tgaattcaaagtcacagacgcccgg

SEQ ID NO: 142612 - DNA, 25 bp, Mus musculus
tgaattccactactcggagcgcatg

SEQ ID NO: 142613 - DNA, 25 bp, Mus musculus
tgaattcggaccacagatccacagc

SEQ ID NO: 142614 - DNA, 25 bp, Mus musculus
tgaattctcagcaccaatcggcagc

SEQ ID NO: 142615 - DNA, 25 bp, Mus musculus
tgaattctgtgaacagtcgggccag

SEQ ID NO: 142616 - DNA, 25 bp, Mus musculus
tgaattcttaaagtctcaaaactgg

SEQ ID NO: 142617 - DNA, 25 bp, Mus musculus
tgaattcttcgctgacattgccctg

SEQ ID NO: 142618 - DNA, 25 bp, Mus musculus
tgaattcttcgtccccacatactgg

SEQ ID NO: 142619 - DNA, 25 bp, Mus musculus
tgaattgccctctggtgaaggtccc

SEQ ID NO: 142620 - DNA, 25 bp, Mus musculus
tgaattgcttataccatggagaagg

SEQ ID NO: 142621 - DNA, 25 bp, Mus musculus
tgaattggccccaaacagggtccct

SEQ ID NO: 142622 - DNA, 25 bp, Mus musculus
tgaattggcttctgcgagaccggct

SEQ ID NO: 142623 - DNA, 25 bp, Mus musculus
tgaattgtagccctaatgctgtggg

SEQ ID NO: 142624 - DNA, 25 bp, Mus musculus
tgaattgtcgtggaaaactagggtc

SEQ ID NO: 142625 - DNA, 25 bp, Mus musculus
tgaatttgactctccaactttagga

SEQ ID NO: 142626 - DNA, 25 bp, Mus musculus
tgaatttgccaaagagccaccgcag

SEQ ID NO: 142627 - DNA, 25 bp, Mus musculus
tgaatttggcgcttgctggtgacat

SEQ ID NO: 142628 - DNA, 25 bp, Mus musculus
tgaattttctacgaacatcaaaact

SEQ ID NO: 142629 - DNA, 25 bp, Mus musculus
tgaattttgcctgggactgcagacc

SEQ ID NO: 142630 - DNA, 25 bp, Mus musculus
tgacaaaaacgaacctgctgaccct

SEQ ID NO: 142631 - DNA, 25 bp, Mus musculus
tgacaaaaagcatcagctagaagga

SEQ ID NO: 142632 - DNA, 25 bp, Mus musculus
tgacaaaaagctgagaccggacatt

SEQ ID NO: 142633 - DNA, 25 bp, Mus musculus
tgacaaaacactccctggccaatgg

SEQ ID NO: 142634 - DNA, 25 bp, Mus musculus
tgacaaaagcttcaggagggcgcct

SEQ ID NO: 142635 - DNA, 25 bp, Mus musculus
tgacaaaattcattatacctgagta

SEQ ID NO: 142636 - DNA, 25 bp, Mus musculus
tgacaaaattgacctcagcatggag

SEQ ID NO: 142637 - DNA, 25 bp, Mus musculus
tgacaaacggaagcgcatgctacgt

SEQ ID NO: 142638 - DNA, 25 bp, Mus musculus
tgacaaagaaaccagcccaaggagc

SEQ ID NO: 142639 - DNA, 25 bp, Mus musculus
tgacaaaggactcatgggaccacca

SEQ ID NO: 142640 - DNA, 25 bp, Mus musculus
tgacaaaggagacctcttacggtgt

SEQ ID NO: 142641 - DNA, 25 bp, Mus musculus
tgacaaaggatgacttccagcggct

SEQ ID NO: 142642 - DNA, 25 bp, Mus musculus
tgacaaaggctggagtgcccacaac

SEQ ID NO: 142643 - DNA, 25 bp, Mus musculus
tgacaaatacatgtgcagctttctg

SEQ ID NO: 142644 - DNA, 25 bp, Mus musculus
tgacaacaacggctaccagatgcag

SEQ ID NO: 142645 - DNA, 25 bp, Mus musculus
tgacaacaatccaaggcgtacaggc

SEQ ID NO: 142646 - DNA, 25 bp, Mus musculus
tgacaacagccactttggtgcctgg

SEQ ID NO: 142647 - DNA, 25 bp, Mus musculus
tgacaacagtctttgggcagcctct

SEQ ID NO: 142648 - DNA, 25 bp, Mus musculus
tgacaacagtgatgacccagaggaa

SEQ ID NO: 142649 - DNA, 25 bp, Mus musculus
tgacaacattatgcgcctggacagc

SEQ ID NO: 142650 - DNA, 25 bp, Mus musculus
tgacaacattgcctggacttctcaa

SEQ ID NO: 142651 - DNA, 25 bp, Mus musculus
tgacaaccagctgatgcacgtgaag

SEQ ID NO: 142652 - DNA, 25 bp, Mus musculus
tgacaaccaggcaaattgttaccag

SEQ ID NO: 142653 - DNA, 25 bp, Mus musculus
tgacaaccttgatgtgccacctcgg

SEQ ID NO: 142654 - DNA, 25 bp, Mus musculus
tgacaacgaactcatggacatgaga

SEQ ID NO: 142655 - DNA, 25 bp, Mus musculus
tgacaacgcatttggacccgatgga

SEQ ID NO: 142656 - DNA, 25 bp, Mus musculus
tgacaacggctctggcctggtgaaa

SEQ ID NO: 142657 - DNA, 25 bp, Mus musculus
tgacaactactgcaacgtgatgatg

SEQ ID NO: 142658 - DNA, 25 bp, Mus musculus
tgacaactctccaggactggcaggg

SEQ ID NO: 142659 - DNA, 25 bp, Mus musculus
tgacaactgtggactgactctagaa

SEQ ID NO: 142660 - DNA, 25 bp, Mus musculus
tgacaagaaatggagacttcggagc

SEQ ID NO: 142661 - DNA, 25 bp, Mus musculus
tgacaagaagatacaggtctcgcgg

SEQ ID NO: 142662 - DNA, 25 bp, Mus musculus
tgacaagaatgatgcagcctcccag

SEQ ID NO: 142663 - DNA, 25 bp, Mus musculus
tgacaagagccacgaatttgcactg

SEQ ID NO: 142664 - DNA, 25 bp, Mus musculus
tgacaagatagagtgcccagaggtg

SEQ ID NO: 142665 - DNA, 25 bp, Mus musculus
tgacaagatcacacaggctgccatg

SEQ ID NO: 142666 - DNA, 25 bp, Mus musculus
tgacaagatgtacgtgaccaatgac

SEQ ID NO: 142667 - DNA, 25 bp, Mus musculus
tgacaagattggcaagaacgacgcc

SEQ ID NO: 142668 - DNA, 25 bp, Mus musculus
tgacaagcaaccaattgggagactg

SEQ ID NO: 142669 - DNA, 25 bp, Mus musculus
tgacaagccaccagaaccgtgtagg

SEQ ID NO: 142670 - DNA, 25 bp, Mus musculus
tgacaagctggaggagctcatccgg

SEQ ID NO: 142671 - DNA, 25 bp, Mus musculus
tgacaaggatctggccacagggaca

SEQ ID NO: 142672 - DNA, 25 bp, Mus musculus
tgacaaggcctacccgacagtgtgt

SEQ ID NO: 142673 - DNA, 25 bp, Mus musculus
tgacaaggcgacacacgatggaagc

SEQ ID NO: 142674 - DNA, 25 bp, Mus musculus
tgacaagggtcagtacatcaaggcc

SEQ ID NO: 142675 - DNA, 25 bp, Mus musculus
tgacaagtaccttccacacgaggag

SEQ ID NO: 142676 - DNA, 25 bp, Mus musculus
tgacaagtgtgtaactgcccctggc

SEQ ID NO: 142677 - DNA, 25 bp, Mus musculus
tgacaagttgatgcatagccccacg

SEQ ID NO: 142678 - DNA, 25 bp, Mus musculus
tgacaagtttgacggctctcggcag

SEQ ID NO: 142679 - DNA, 25 bp, Mus musculus
tgacaatatcctggccatggctcgt

SEQ ID NO: 142680 - DNA, 25 bp, Mus musculus
tgacaatcgggattccggaagccca

SEQ ID NO: 142681 - DNA, 25 bp, Mus musculus
tgacaatgaatggtgcggccacggc

SEQ ID NO: 142682 - DNA, 25 bp, Mus musculus
tgacaatggagacctgaacgacagt

SEQ ID NO: 142683 - DNA, 25 bp, Mus musculus
tgacaatggcagagtccgcatacag

SEQ ID NO: 142684 - DNA, 25 bp, Mus musculus
tgacaatgttgctgaatccccggat

SEQ ID NO: 142685 - DNA, 25 bp, Mus musculus
tgacaattaggcaaagctcctggaa

SEQ ID NO: 142686 - DNA, 25 bp, Mus musculus
tgacaattgtatcccggttccccag

SEQ ID NO: 142687 - DNA, 25 bp, Mus musculus
tgacacaagcatttagaagaaagtt

SEQ ID NO: 142688 - DNA, 25 bp, Mus musculus
tgacacaaggagacagacttcgggc

SEQ ID NO: 142689 - DNA, 25 bp, Mus musculus
tgacacaagtgacgacaggctcagt

SEQ ID NO: 142690 - DNA, 25 bp, Mus musculus
tgacacaatgcatgatggcccttcg

SEQ ID NO: 142691 - DNA, 25 bp, Mus musculus
tgacacactgggtaagggcagctat

SEQ ID NO: 142692 - DNA, 25 bp, Mus musculus
tgacacactgggtggccatacgggt

SEQ ID NO: 142693 - DNA, 25 bp, Mus musculus
tgacacagagctgcaagaatcagtc

SEQ ID NO: 142694 - DNA, 25 bp, Mus musculus
tgacacagcaacctatgagtgccgg

SEQ ID NO: 142695 - DNA, 25 bp, Mus musculus
tgacacagcagtggccacatgtgct

SEQ ID NO: 142696 - DNA, 25 bp, Mus musculus
tgacacagcccggagattggacctt

SEQ ID NO: 142697 - DNA, 25 bp, Mus musculus
tgacacagccctttggttgggagtg

SEQ ID NO: 142698 - DNA, 25 bp, Mus musculus
tgacacagcctactgctgaccagag

SEQ ID NO: 142699 - DNA, 25 bp, Mus musculus
tgacacagcgaacagcacggatggt

SEQ ID NO: 142700 - DNA, 25 bp, Mus musculus
tgacacaggcacaatttgaagagct

SEQ ID NO: 142701 - DNA, 25 bp, Mus musculus
tgacacagtatgacagcctgctggg

SEQ ID NO: 142702 - DNA, 25 bp, Mus musculus
tgacacagtcaagcagatctacccg

SEQ ID NO: 142703 - DNA, 25 bp, Mus musculus
tgacacagtcgctggtgacactcgc

SEQ ID NO: 142704 - DNA, 25 bp, Mus musculus
tgacaccacggccagtggactttcc

SEQ ID NO: 142705 - DNA, 25 bp, Mus musculus
tgacaccactagacagaggctgctg

SEQ ID NO: 142706 - DNA, 25 bp, Mus musculus
tgacaccaggtctaggagtgctggc

SEQ ID NO: 142707 - DNA, 25 bp, Mus musculus
tgacaccatccaggtaccagtcggg

SEQ ID NO: 142708 - DNA, 25 bp, Mus musculus
tgacacccagtacaccggccgaaag

SEQ ID NO: 142709 - DNA, 25 bp, Mus musculus
tgacacccttggagaaatcgcatcg

SEQ ID NO: 142710 - DNA, 25 bp, Mus musculus
tgacaccgacactgaaagccaaacg

SEQ ID NO: 142711 - DNA, 25 bp, Mus musculus
tgacaccggtgaaaagatgactctg

SEQ ID NO: 142712 - DNA, 25 bp, Mus musculus
tgacaccgttgatctgactctgcag

SEQ ID NO: 142713 - DNA, 25 bp, Mus musculus
tgacacctacactcaagaagcggag

SEQ ID NO: 142714 - DNA, 25 bp, Mus musculus
tgacacgcttggtgctgcctggcat

SEQ ID NO: 142715 - DNA, 25 bp, Mus musculus
tgacacggagaaaaaagatgagccc

SEQ ID NO: 142716 - DNA, 25 bp, Mus musculus
tgacacgggccatgatgtgggacct

SEQ ID NO: 142717 - DNA, 25 bp, Mus musculus
tgacacgttcctgagagcagcctgg

SEQ ID NO: 142718 - DNA, 25 bp, Mus musculus
tgacactccgaagaagcaggccttg

SEQ ID NO: 142719 - DNA, 25 bp, Mus musculus
tgacactctgatttcacagccctga

SEQ ID NO: 142720 - DNA, 25 bp, Mus musculus
tgacactgcagggtccgagagaatt

SEQ ID NO: 142721 - DNA, 25 bp, Mus musculus
tgacactgggaaaatagaggagatt

SEQ ID NO: 142722 - DNA, 25 bp, Mus musculus
tgacactgggcaccttttcacagag

SEQ ID NO: 142723 - DNA, 25 bp, Mus musculus
tgacacttgggctacgcttcctgca

SEQ ID NO: 142724 - DNA, 25 bp, Mus musculus
tgacacttgtgatggtcggccttga

SEQ ID NO: 142725 - DNA, 25 bp, Mus musculus
tgacagaaaaccacattcaagaaat

SEQ ID NO: 142726 - DNA, 25 bp, Mus musculus
tgacagaaaccgagagaacccagat

SEQ ID NO: 142727 - DNA, 25 bp, Mus musculus
tgacagaagaatttccccactggga

SEQ ID NO: 142728 - DNA, 25 bp, Mus musculus
tgacagaagacacgaggctacaact

SEQ ID NO: 142729 - DNA, 25 bp, Mus musculus
tgacagaagcaaccggtttggaccg

SEQ ID NO: 142730 - DNA, 25 bp, Mus musculus
tgacagaagtccaccgtagtgcctg

SEQ ID NO: 142731 - DNA, 25 bp, Mus musculus
tgacagacctgtctcctgctggagt

SEQ ID NO: 142732 - DNA, 25 bp, Mus musculus
tgacagactacgaccgctaagttat

SEQ ID NO: 142733 - DNA, 25 bp, Mus musculus
tgacagagaccgaagactggctact

SEQ ID NO: 142734 - DNA, 25 bp, Mus musculus
tgacagagaggccttgagtcttcga

SEQ ID NO: 142735 - DNA, 25 bp, Mus musculus
tgacagagatcctgccctttctcct

SEQ ID NO: 142736 - DNA, 25 bp, Mus musculus
tgacagagcagatcagcacaaggtg

SEQ ID NO: 142737 - DNA, 25 bp, Mus musculus
tgacagagccccagtatgtgtgtgc

SEQ ID NO: 142738 - DNA, 25 bp, Mus musculus
tgacagagccgagaacaagggaact

SEQ ID NO: 142739 - DNA, 25 bp, Mus musculus
tgacagagcgcgacatcatcgtgct

SEQ ID NO: 142740 - DNA, 25 bp, Mus musculus
tgacagagctgtatataaggagccg

SEQ ID NO: 142741 - DNA, 25 bp, Mus musculus
tgacagaggacacaacggatgctcc

SEQ ID NO: 142742 - DNA, 25 bp, Mus musculus
tgacagaggatcttaagggagcacc

SEQ ID NO: 142743 - DNA, 25 bp, Mus musculus
tgacagaggcaacctcaggacggac

SEQ ID NO: 142744 - DNA, 25 bp, Mus musculus
tgacagagtctatcatcagtggccg

SEQ ID NO: 142745 - DNA, 25 bp, Mus musculus
tgacagatctgagaaggaactgagc

SEQ ID NO: 142746 - DNA, 25 bp, Mus musculus
tgacagatgcgggactggccttgct

SEQ ID NO: 142747 - DNA, 25 bp, Mus musculus
tgacagattaaccaagaggccttcc

SEQ ID NO: 142748 - DNA, 25 bp, Mus musculus
tgacagattgtgctatacatacggg

SEQ ID NO: 142749 - DNA, 25 bp, Mus musculus
tgacagcaactcagcacactctgtg

SEQ ID NO: 142750 - DNA, 25 bp, Mus musculus
tgacagcaattgtgaaggcttggcc

SEQ ID NO: 142751 - DNA, 25 bp, Mus musculus
tgacagcactgaattggacaactcc

SEQ ID NO: 142752 - DNA, 25 bp, Mus musculus
tgacagcagaccttatgggccggga

SEQ ID NO: 142753 - DNA, 25 bp, Mus musculus
tgacagcagcaacccgacaagaagt

SEQ ID NO: 142754 - DNA, 25 bp, Mus musculus
tgacagcataatcttgaactggcca

SEQ ID NO: 142755 - DNA, 25 bp, Mus musculus
tgacagccactaggaagagttctcg

SEQ ID NO: 142756 - DNA, 25 bp, Mus musculus
tgacagccagaagctcagaggagct

SEQ ID NO: 142757 - DNA, 25 bp, Mus musculus
tgacagccatgaagagcaccagtga

SEQ ID NO: 142758 - DNA, 25 bp, Mus musculus
tgacagccatggagttgtaccagct

SEQ ID NO: 142759 - DNA, 25 bp, Mus musculus
tgacagccatgtacacctgggtgcg

SEQ ID NO: 142760 - DNA, 25 bp, Mus musculus
tgacagcccagcagttggaaactac

SEQ ID NO: 142761 - DNA, 25 bp, Mus musculus
tgacagcccggagatccttaagagg

SEQ ID NO: 142762 - DNA, 25 bp, Mus musculus
tgacagccggaacattatctgacat

SEQ ID NO: 142763 - DNA, 25 bp, Mus musculus
tgacagcctcaacgaggtgcctacc

SEQ ID NO: 142764 - DNA, 25 bp, Mus musculus
tgacagccttagtctggaaccagag

SEQ ID NO: 142765 - DNA, 25 bp, Mus musculus
tgacagccttcctgagcaccggagg

SEQ ID NO: 142766 - DNA, 25 bp, Mus musculus
tgacagcgcaccacctgcatgagtt

SEQ ID NO: 142767 - DNA, 25 bp, Mus musculus
tgacagcggagaatgaacctacagc

SEQ ID NO: 142768 - DNA, 25 bp, Mus musculus
tgacagctatcaagcgtgcggccag

SEQ ID NO: 142769 - DNA, 25 bp, Mus musculus
tgacagctccaaagctaagaggagg

SEQ ID NO: 142770 - DNA, 25 bp, Mus musculus
tgacagctcctgctcgaagatggct

SEQ ID NO: 142771 - DNA, 25 bp, Mus musculus
tgacagctccttgatgacctacaga

SEQ ID NO: 142772 - DNA, 25 bp, Mus musculus
tgacagctgcttttgtgactcggac

SEQ ID NO: 142773 - DNA, 25 bp, Mus musculus
tgacagctgtggtacaacgggaaca

SEQ ID NO: 142774 - DNA, 25 bp, Mus musculus
tgacagcttccaagagtgagacctg

SEQ ID NO: 142775 - DNA, 25 bp, Mus musculus
tgacaggagagcatttacttaccgc

SEQ ID NO: 142776 - DNA, 25 bp, Mus musculus
tgacaggagctgctatctaccacaa

SEQ ID NO: 142777 - DNA, 25 bp, Mus musculus
tgacaggaggcgtgtgcaagtccac

SEQ ID NO: 142778 - DNA, 25 bp, Mus musculus
tgacaggagttgctcgacacacact

SEQ ID NO: 142779 - DNA, 25 bp, Mus musculus
tgacaggcacaagccagattgagaa

SEQ ID NO: 142780 - DNA, 25 bp, Mus musculus
tgacaggcagtgtctgcagtgcccc

SEQ ID NO: 142781 - DNA, 25 bp, Mus musculus
tgacaggccagtgtgaacgtatccc

SEQ ID NO: 142782 - DNA, 25 bp, Mus musculus
tgacaggctccttgacggcagtact

SEQ ID NO: 142783 - DNA, 25 bp, Mus musculus
tgacaggcttttggctcaccgagta

SEQ ID NO: 142784 - DNA, 25 bp, Mus musculus
tgacagggtccatgccgattaggaa

SEQ ID NO: 142785 - DNA, 25 bp, Mus musculus
tgacaggtgtctacagaaagtggct

SEQ ID NO: 142786 - DNA, 25 bp, Mus musculus
tgacagtaaacagcgggaagacacc

SEQ ID NO: 142787 - DNA, 25 bp, Mus musculus
tgacagtaatgaagaagataccgct

SEQ ID NO: 142788 - DNA, 25 bp, Mus musculus
tgacagtacggaggaagcttccagc

SEQ ID NO: 142789 - DNA, 25 bp, Mus musculus
tgacagtcatcgacacaccaggctt

SEQ ID NO: 142790 - DNA, 25 bp, Mus musculus
tgacagtccagatctcccaggagac

SEQ ID NO: 142791 - DNA, 25 bp, Mus musculus
tgacagtgaaaaaccgcatgatccg

SEQ ID NO: 142792 - DNA, 25 bp, Mus musculus
tgacagtgaactggagttatccacg

SEQ ID NO: 142793 - DNA, 25 bp, Mus musculus
tgacagtgacagaccggaggacact

SEQ ID NO: 142794 - DNA, 25 bp, Mus musculus
tgacagtgcaccaaagacacagagc

SEQ ID NO: 142795 - DNA, 25 bp, Mus musculus
tgacagtgcaggcagtgatccatcc

SEQ ID NO: 142796 - DNA, 25 bp, Mus musculus
tgacagtggagcttctaacgagaca

SEQ ID NO: 142797 - DNA, 25 bp, Mus musculus
tgacagtggcatccaaccaggaagt

SEQ ID NO: 142798 - DNA, 25 bp, Mus musculus
tgacagtggtgaagtagaccgcatc

SEQ ID NO: 142799 - DNA, 25 bp, Mus musculus
tgacagtgtgtgtagaagacctcca

SEQ ID NO: 142800 - DNA, 25 bp, Mus musculus
tgacatacaagccacacctacagga

SEQ ID NO: 142801 - DNA, 25 bp, Mus musculus
tgacatactgccatggcctgcctgg

SEQ ID NO: 142802 - DNA, 25 bp, Mus musculus
tgacatagacgagtgggtgaccaag

SEQ ID NO: 142803 - DNA, 25 bp, Mus musculus
tgacatagtgtcaagggccctcgat

SEQ ID NO: 142804 - DNA, 25 bp, Mus musculus
tgacatatatgaagaggagcccttt

SEQ ID NO: 142805 - DNA, 25 bp, Mus musculus
tgacatatccgtggagaacaagccc

SEQ ID NO: 142806 - DNA, 25 bp, Mus musculus
tgacatcaaactcaccaaagacggc

SEQ ID NO: 142807 - DNA, 25 bp, Mus musculus
tgacatcaacgtgaccaaggcggat

SEQ ID NO: 142808 - DNA, 25 bp, Mus musculus
tgacatcaccgaggatcgatcagct

SEQ ID NO: 142809 - DNA, 25 bp, Mus musculus
tgacatcacgctgacagtagacggc

SEQ ID NO: 142810 - DNA, 25 bp, Mus musculus
tgacatcactgttttggacctggga

SEQ ID NO: 142811 - DNA, 25 bp, Mus musculus
tgacatcagaggaggaactaacacc

SEQ ID NO: 142812 - DNA, 25 bp, Mus musculus
tgacatcagcccatgcaggataggt

SEQ ID NO: 142813 - DNA, 25 bp, Mus musculus
tgacatcagcgcttccatggtggga

SEQ ID NO: 142814 - DNA, 25 bp, Mus musculus
tgacatcaggcatcaggcccagtga

SEQ ID NO: 142815 - DNA, 25 bp, Mus musculus
tgacatcattggagacacttccggc

SEQ ID NO: 142816 - DNA, 25 bp, Mus musculus
tgacatccaaaagcacggctcaggt

SEQ ID NO: 142817 - DNA, 25 bp, Mus musculus
tgacatccagcggtttcaaagggac

SEQ ID NO: 142818 - DNA, 25 bp, Mus musculus
tgacatccaggtggtctcaatgccc

SEQ ID NO: 142819 - DNA, 25 bp, Mus musculus
tgacatccgctgtggagaggaaacc

SEQ ID NO: 142820 - DNA, 25 bp, Mus musculus
tgacatcctcagatgacccttggga

SEQ ID NO: 142821 - DNA, 25 bp, Mus musculus
tgacatcgttccaaccagttcaaag

SEQ ID NO: 142822 - DNA, 25 bp, Mus musculus
tgacatctacgaccttccggaaagg

SEQ ID NO: 142823 - DNA, 25 bp, Mus musculus
tgacatctcagttgattccaaggag

SEQ ID NO: 142824 - DNA, 25 bp, Mus musculus
tgacatgaagctgaggacaacctac

SEQ ID NO: 142825 - DNA, 25 bp, Mus musculus
tgacatgaccctgagcagatttgct

SEQ ID NO: 142826 - DNA, 25 bp, Mus musculus
tgacatgaggccactggacagacca

SEQ ID NO: 142827 - DNA, 25 bp, Mus musculus
tgacatgcacagaccttgagcaggg

SEQ ID NO: 142828 - DNA, 25 bp, Mus musculus
tgacatgcccctggacgagctgctt

SEQ ID NO: 142829 - DNA, 25 bp, Mus musculus
tgacatgcctcagggatccttggcc

SEQ ID NO: 142830 - DNA, 25 bp, Mus musculus
tgacatgcgggccttggcgaaaaac

SEQ ID NO: 142831 - DNA, 25 bp, Mus musculus
tgacatgctatagccttgcccaggg

SEQ ID NO: 142832 - DNA, 25 bp, Mus musculus
tgacatgctcatggtgaagccggga

SEQ ID NO: 142833 - DNA, 25 bp, Mus musculus
tgacatggacaaagcccgtcacaag

SEQ ID NO: 142834 - DNA, 25 bp, Mus musculus
tgacatggacccaaatccgagagca

SEQ ID NO: 142835 - DNA, 25 bp, Mus musculus
tgacatgggcgccagcggctccaaa

SEQ ID NO: 142836 - DNA, 25 bp, Mus musculus
tgacatggttctggaccccagcctg

SEQ ID NO: 142837 - DNA, 25 bp, Mus musculus
tgacatgtacacagaaggagtggcg

SEQ ID NO: 142838 - DNA, 25 bp, Mus musculus
tgacatgtcaggcaatccctccagg

SEQ ID NO: 142839 - DNA, 25 bp, Mus musculus
tgacatgttccacggatcaggacgg

SEQ ID NO: 142840 - DNA, 25 bp, Mus musculus
tgacattacaactgccgctgccagc

SEQ ID NO: 142841 - DNA, 25 bp, Mus musculus
tgacattcagggagatcacagggaa

SEQ ID NO: 142842 - DNA, 25 bp, Mus musculus
tgacattcttgatgagccctccggc

SEQ ID NO: 142843 - DNA, 25 bp, Mus musculus
tgacattgatgccaaaacccgacgt

SEQ ID NO: 142844 - DNA, 25 bp, Mus musculus
tgacattgcaactggaaagcttttg

SEQ ID NO: 142845 - DNA, 25 bp, Mus musculus
tgacattggccaagctgcagaacaa

SEQ ID NO: 142846 - DNA, 25 bp, Mus musculus
tgacatttctggaggcagacccctg

SEQ ID NO: 142847 - DNA, 25 bp, Mus musculus
tgacatttgaaacccacagggacag

SEQ ID NO: 142848 - DNA, 25 bp, Mus musculus
tgaccaaaacccatgtgatagcagc

SEQ ID NO: 142849 - DNA, 25 bp, Mus musculus
tgaccaaaggaccaacctcttgcgg

SEQ ID NO: 142850 - DNA, 25 bp, Mus musculus
tgaccaaatatgcaagcgaagagct

SEQ ID NO: 142851 - DNA, 25 bp, Mus musculus
tgaccaaatatgcagaacaacttct

SEQ ID NO: 142852 - DNA, 25 bp, Mus musculus
tgaccaacacgaacactgaaaagct

SEQ ID NO: 142853 - DNA, 25 bp, Mus musculus
tgaccaaccatgcaaaagtgaaaga

SEQ ID NO: 142854 - DNA, 25 bp, Mus musculus
tgaccaagaacaaggaacggacatc

SEQ ID NO: 142855 - DNA, 25 bp, Mus musculus
tgaccaagaagcagcgtcgcctgct

SEQ ID NO: 142856 - DNA, 25 bp, Mus musculus
tgaccaagaggtcctagcagagctg

SEQ ID NO: 142857 - DNA, 25 bp, Mus musculus
tgaccaagagttacacaagaatgcg

SEQ ID NO: 142858 - DNA, 25 bp, Mus musculus
tgaccaagatgaggaaaaccaaagc

SEQ ID NO: 142859 - DNA, 25 bp, Mus musculus
tgaccaagcacctgaggacacatgg

SEQ ID NO: 142860 - DNA, 25 bp, Mus musculus
tgaccaagcagctgcttcactgtat

SEQ ID NO: 142861 - DNA, 25 bp, Mus musculus
tgaccaagcataatagggatcatta

SEQ ID NO: 142862 - DNA, 25 bp, Mus musculus
tgaccaagctacatcaaaggttacc

SEQ ID NO: 142863 - DNA, 25 bp, Mus musculus
tgaccaagtggagtaacgagaagcc

SEQ ID NO: 142864 - DNA, 25 bp, Mus musculus
tgaccaatgatggagagctgatcct

SEQ ID NO: 142865 - DNA, 25 bp, Mus musculus
tgaccacaaaggatggagaaccggc

SEQ ID NO: 142866 - DNA, 25 bp, Mus musculus
tgaccacactgggactggacgtgtc

SEQ ID NO: 142867 - DNA, 25 bp, Mus musculus
tgaccacagggatgacagagaacca

SEQ ID NO: 142868 - DNA, 25 bp, Mus musculus
tgaccacagtggctgagaagtctcg

SEQ ID NO: 142869 - DNA, 25 bp, Mus musculus
tgaccacataaagggcccactgaag

SEQ ID NO: 142870 - DNA, 25 bp, Mus musculus
tgaccaccagtaccagaactcagat

SEQ ID NO: 142871 - DNA, 25 bp, Mus musculus
tgaccacgagcgaaaggaggaaaat

SEQ ID NO: 142872 - DNA, 25 bp, Mus musculus
tgaccacgcagttctcctaagggcc

SEQ ID NO: 142873 - DNA, 25 bp, Mus musculus
tgaccacgggtgagctgttcttccg

SEQ ID NO: 142874 - DNA, 25 bp, Mus musculus
tgaccactatggcaggaagattctc

SEQ ID NO: 142875 - DNA, 25 bp, Mus musculus
tgaccactgactgggaccttcagaa

SEQ ID NO: 142876 - DNA, 25 bp, Mus musculus
tgaccactgtgctagctcggaacct

SEQ ID NO: 142877 - DNA, 25 bp, Mus musculus
tgaccacttagagggacataggact

SEQ ID NO: 142878 - DNA, 25 bp, Mus musculus
tgaccacttgtattccgagagcccg

SEQ ID NO: 142879 - DNA, 25 bp, Mus musculus
tgaccagagaaatgctagttaccct

SEQ ID NO: 142880 - DNA, 25 bp, Mus musculus
tgaccagcagaatgggttgtaccgc

SEQ ID NO: 142881 - DNA, 25 bp, Mus musculus
tgaccagcgggaatggaatgagcct

SEQ ID NO: 142882 - DNA, 25 bp, Mus musculus
tgaccagctgtacaaggacatcgag

SEQ ID NO: 142883 - DNA, 25 bp, Mus musculus
tgaccaggacccgaagttctcaggg

SEQ ID NO: 142884 - DNA, 25 bp, Mus musculus
tgaccaggagcgttttgataacagc

SEQ ID NO: 142885 - DNA, 25 bp, Mus musculus
tgaccaggatacttgaggccacaga

SEQ ID NO: 142886 - DNA, 25 bp, Mus musculus
tgaccaggcacgagaaggttgccaa

SEQ ID NO: 142887 - DNA, 25 bp, Mus musculus
tgaccagggcagtaggcgtaattaa

SEQ ID NO: 142888 - DNA, 25 bp, Mus musculus
tgaccaggtgtctcatcatgcccga

SEQ ID NO: 142889 - DNA, 25 bp, Mus musculus
tgaccagtacccaaacacgtggcgt

SEQ ID NO: 142890 - DNA, 25 bp, Mus musculus
tgaccagtcctatcatgggaaacag

SEQ ID NO: 142891 - DNA, 25 bp, Mus musculus
tgaccagtgaattgcgatccaaacg

SEQ ID NO: 142892 - DNA, 25 bp, Mus musculus
tgaccagttaaaacaagtccagcag

SEQ ID NO: 142893 - DNA, 25 bp, Mus musculus
tgaccatcaaccgaccaggagtgct

SEQ ID NO: 142894 - DNA, 25 bp, Mus musculus
tgaccatcagcacagacggagatct

SEQ ID NO: 142895 - DNA, 25 bp, Mus musculus
tgaccatcatggacaggagcctagt

SEQ ID NO: 142896 - DNA, 25 bp, Mus musculus
tgaccatcgtgggatctgtgctaga

SEQ ID NO: 142897 - DNA, 25 bp, Mus musculus
tgaccatgaagaggcctcagtcctt

SEQ ID NO: 142898 - DNA, 25 bp, Mus musculus
tgaccatgaagctcaacgagcgcag

SEQ ID NO: 142899 - DNA, 25 bp, Mus musculus
tgaccatgatgaccaagagctgctc

SEQ ID NO: 142900 - DNA, 25 bp, Mus musculus
tgaccatgcagcaaaaatcgaggct

SEQ ID NO: 142901 - DNA, 25 bp, Mus musculus
tgaccatgctgaacgagagctccgc

SEQ ID NO: 142902 - DNA, 25 bp, Mus musculus
tgaccatggcactacacggctgtga

SEQ ID NO: 142903 - DNA, 25 bp, Mus musculus
tgaccatggcttacgagagacacca

SEQ ID NO: 142904 - DNA, 25 bp, Mus musculus
tgaccatggtacctggcaaaggacc

SEQ ID NO: 142905 - DNA, 25 bp, Mus musculus
tgaccatggtggaaccttaggcagg

SEQ ID NO: 142906 - DNA, 25 bp, Mus musculus
tgaccatgtagctggaaagcccgag

SEQ ID NO: 142907 - DNA, 25 bp, Mus musculus
tgaccatgttcgacaagacgcggct

SEQ ID NO: 142908 - DNA, 25 bp, Mus musculus
tgaccatgtttgactgcccagtgag

SEQ ID NO: 142909 - DNA, 25 bp, Mus musculus
tgaccattaaaccaggcgagcacgg

SEQ ID NO: 142910 - DNA, 25 bp, Mus musculus
tgacccaacgactcctgaagcgagg

SEQ ID NO: 142911 - DNA, 25 bp, Mus musculus
tgacccaagagtgagtgagccaatt

SEQ ID NO: 142912 - DNA, 25 bp, Mus musculus
tgacccaagcatgatgagacacctg

SEQ ID NO: 142913 - DNA, 25 bp, Mus musculus
tgacccacacagacttgaagccaga

SEQ ID NO: 142914 - DNA, 25 bp, Mus musculus
tgacccacacagagatctcaccaga

SEQ ID NO: 142915 - DNA, 25 bp, Mus musculus
tgacccacaccatatagacctgagg

SEQ ID NO: 142916 - DNA, 25 bp, Mus musculus
tgacccacagcgatcagtactgaag

SEQ ID NO: 142917 - DNA, 25 bp, Mus musculus
tgacccaccatgtatgctggctgtg

SEQ ID NO: 142918 - DNA, 25 bp, Mus musculus
tgacccacgagcatctgacaatgac

SEQ ID NO: 142919 - DNA, 25 bp, Mus musculus
tgacccagaagcttgtaaacaccag

SEQ ID NO: 142920 - DNA, 25 bp, Mus musculus
tgacccagaataggaagatggcagc

SEQ ID NO: 142921 - DNA, 25 bp, Mus musculus
tgacccagagacagataagcacttg

SEQ ID NO: 142922 - DNA, 25 bp, Mus musculus
tgacccagcacagcaaaaacgcaag

SEQ ID NO: 142923 - DNA, 25 bp, Mus musculus
tgacccagcgagaaggatcaccttg

SEQ ID NO: 142924 - DNA, 25 bp, Mus musculus
tgacccaggaccatgtgatgcatct

SEQ ID NO: 142925 - DNA, 25 bp, Mus musculus
tgacccaggagcatagactacagtg

SEQ ID NO: 142926 - DNA, 25 bp, Mus musculus
tgacccatgtggagaaacggttgcc

SEQ ID NO: 142927 - DNA, 25 bp, Mus musculus
tgaccccaacaaggagaggcgtgaa

SEQ ID NO: 142928 - DNA, 25 bp, Mus musculus
tgaccccaacggcaaaggctggatt

SEQ ID NO: 142929 - DNA, 25 bp, Mus musculus
tgaccccaagaagatggccgcatag

SEQ ID NO: 142930 - DNA, 25 bp, Mus musculus
tgaccccaaggacagcgttatgcag

SEQ ID NO: 142931 - DNA, 25 bp, Mus musculus
tgaccccaaggtcttctgcactagg

SEQ ID NO: 142932 - DNA, 25 bp, Mus musculus
tgaccccaatgatcagagtgcctgg

SEQ ID NO: 142933 - DNA, 25 bp, Mus musculus
tgaccccaatgccaaataccacgga

SEQ ID NO: 142934 - DNA, 25 bp, Mus musculus
tgaccccaggaataaatcaaggccc

SEQ ID NO: 142935 - DNA, 25 bp, Mus musculus
tgaccccagttttgaggacatgaaa

SEQ ID NO: 142936 - DNA, 25 bp, Mus musculus
tgaccccgacttggaagaatacagc

SEQ ID NO: 142937 - DNA, 25 bp, Mus musculus
tgaccccggctgatgtagatagagc

SEQ ID NO: 142938 - DNA, 25 bp, Mus musculus
tgacccctccgactataacaagatt

SEQ ID NO: 142939 - DNA, 25 bp, Mus musculus
tgacccctgatgagaagcggaaagc

SEQ ID NO: 142940 - DNA, 25 bp, Mus musculus
tgacccctggaagcccggtataagc

SEQ ID NO: 142941 - DNA, 25 bp, Mus musculus
tgacccctgggtgcaagaccaaatg

SEQ ID NO: 142942 - DNA, 25 bp, Mus musculus
tgacccctgtctaagatgacttaag

SEQ ID NO: 142943 - DNA, 25 bp, Mus musculus
tgacccgcaagaaaggcatcctgct

SEQ ID NO: 142944 - DNA, 25 bp, Mus musculus
tgacccgcatgctggcagagatgag

SEQ ID NO: 142945 - DNA, 25 bp, Mus musculus
tgacccgctgggaaacaacatcttc

SEQ ID NO: 142946 - DNA, 25 bp, Mus musculus
tgacccgggaacaagctgactattg

SEQ ID NO: 142947 - DNA, 25 bp, Mus musculus
tgacccgggccaagtacttcattcg

SEQ ID NO: 142948 - DNA, 25 bp, Mus musculus
tgacccggttcaagtggatccacat

SEQ ID NO: 142949 - DNA, 25 bp, Mus musculus
tgaccctaagagaatccttcccctg

SEQ ID NO: 142950 - DNA, 25 bp, Mus musculus
tgaccctaagtccatcaactctcgg

SEQ ID NO: 142951 - DNA, 25 bp, Mus musculus
tgaccctcggtctctgtacgaacgg

SEQ ID NO: 142952 - DNA, 25 bp, Mus musculus
tgaccctgaagaaccctatccggag

SEQ ID NO: 142953 - DNA, 25 bp, Mus musculus
tgaccctgcaactgttggctgtgag

SEQ ID NO: 142954 - DNA, 25 bp, Mus musculus
tgaccctgcccgtgtgggtgagaac

SEQ ID NO: 142955 - DNA, 25 bp, Mus musculus
tgaccctgcgcccaggactgtgtgc

SEQ ID NO: 142956 - DNA, 25 bp, Mus musculus
tgaccctgctttgtggaattgccag

SEQ ID NO: 142957 - DNA, 25 bp, Mus musculus
tgaccctggaacttcttgaggaaac

SEQ ID NO: 142958 - DNA, 25 bp, Mus musculus
tgaccctggcactcagcttggaggc

SEQ ID NO: 142959 - DNA, 25 bp, Mus musculus
tgaccctgtaaagtctgtgcaccga

SEQ ID NO: 142960 - DNA, 25 bp, Mus musculus
tgaccctgtggtggaagagcacttc

SEQ ID NO: 142961 - DNA, 25 bp, Mus musculus
tgacccttcccatgcttcgaggagg

SEQ ID NO: 142962 - DNA, 25 bp, Mus musculus
tgacccttggcaaacgttaacacca

SEQ ID NO: 142963 - DNA, 25 bp, Mus musculus
tgacccttggttatcgttgcagaat

SEQ ID NO: 142964 - DNA, 25 bp, Mus musculus
tgacccttgttttggacagatacgc

SEQ ID NO: 142965 - DNA, 25 bp, Mus musculus
tgaccgaaataggtgagaccctgcc

SEQ ID NO: 142966 - DNA, 25 bp, Mus musculus
tgaccgagaaccacgtatcctatgc

SEQ ID NO: 142967 - DNA, 25 bp, Mus musculus
tgaccgagaacgtgatagaggagac

SEQ ID NO: 142968 - DNA, 25 bp, Mus musculus
tgaccgagaggatccacctgcgaaa

SEQ ID NO: 142969 - DNA, 25 bp, Mus musculus
tgaccgaggacacattgctggtacg

SEQ ID NO: 142970 - DNA, 25 bp, Mus musculus
tgaccgaggacggatgttcagccct

SEQ ID NO: 142971 - DNA, 25 bp, Mus musculus
tgaccgaggcgatgctctacgagaa

SEQ ID NO: 142972 - DNA, 25 bp, Mus musculus
tgaccgagggtcagcaggaacgtct

SEQ ID NO: 142973 - DNA, 25 bp, Mus musculus
tgaccgagtgtctgtgatgaggcca

SEQ ID NO: 142974 - DNA, 25 bp, Mus musculus
tgaccgatccaaggacaactagctt

SEQ ID NO: 142975 - DNA, 25 bp, Mus musculus
tgaccgatgccgagagagtggacca

SEQ ID NO: 142976 - DNA, 25 bp, Mus musculus
tgaccgatggacacccattggaagg

SEQ ID NO: 142977 - DNA, 25 bp, Mus musculus
tgaccgattcctacgcttggctaat

SEQ ID NO: 142978 - DNA, 25 bp, Mus musculus
tgaccgcaagtctgctgaagaggcc

SEQ ID NO: 142979 - DNA, 25 bp, Mus musculus
tgaccgcagaccctcgattgtatat

SEQ ID NO: 142980 - DNA, 25 bp, Mus musculus
tgaccgcaggattaagtatgagacc

SEQ ID NO: 142981 - DNA, 25 bp, Mus musculus
tgaccgcagtgatgtagagagcagc

SEQ ID NO: 142982 - DNA, 25 bp, Mus musculus
tgaccgcattgtgccagtggacatc

SEQ ID NO: 142983 - DNA, 25 bp, Mus musculus
tgaccgccttagtgagaaacgctct

SEQ ID NO: 142984 - DNA, 25 bp, Mus musculus
tgaccgctgccaacgtggtggaaac

SEQ ID NO: 142985 - DNA, 25 bp, Mus musculus
tgaccggaatcaaaacctctaggga

SEQ ID NO: 142986 - DNA, 25 bp, Mus musculus
tgaccggcaacaacctgacggcgct

SEQ ID NO: 142987 - DNA, 25 bp, Mus musculus
tgaccggcaggctttggtcaaaaag

SEQ ID NO: 142988 - DNA, 25 bp, Mus musculus
tgaccggcgcggtgagcctgccttc

SEQ ID NO: 142989 - DNA, 25 bp, Mus musculus
tgaccggctaccagtgcagagcatc

SEQ ID NO: 142990 - DNA, 25 bp, Mus musculus
tgaccggctcctggctccggaaagg

SEQ ID NO: 142991 - DNA, 25 bp, Mus musculus
tgaccgggctcatgcttcccaagtg

SEQ ID NO: 142992 - DNA, 25 bp, Mus musculus
tgaccgggtgaaagccttgaaagcc

SEQ ID NO: 142993 - DNA, 25 bp, Mus musculus
tgaccgtatgcagtgatggatccct

SEQ ID NO: 142994 - DNA, 25 bp, Mus musculus
tgaccgtcacctgtataaaatggac

SEQ ID NO: 142995 - DNA, 25 bp, Mus musculus
tgaccgtgaacatgactgcaaggac

SEQ ID NO: 142996 - DNA, 25 bp, Mus musculus
tgaccgtgagaagtccgaaggcctt

SEQ ID NO: 142997 - DNA, 25 bp, Mus musculus
tgaccgtgatacacagctggcgcgg

SEQ ID NO: 142998 - DNA, 25 bp, Mus musculus
tgaccgtgatcatgagggaccttac

SEQ ID NO: 142999 - DNA, 25 bp, Mus musculus
tgaccgtggcttttcggaacccagg

SEQ ID NO: 143000 - DNA, 25 bp, Mus musculus
tgaccgttacatatgggtgtggccc

SEQ ID NO: 143001 - DNA, 25 bp, Mus musculus
tgacctacagaagctagatgccctg

SEQ ID NO: 143002 - DNA, 25 bp, Mus musculus
tgacctacaggaagaagacgggctt

SEQ ID NO: 143003 - DNA, 25 bp, Mus musculus
tgacctacagttgctgctcccagag

SEQ ID NO: 143004 - DNA, 25 bp, Mus musculus
tgacctagagaagccatgttcctgc

SEQ ID NO: 143005 - DNA, 25 bp, Mus musculus
tgacctagccggctacccttgagtt

SEQ ID NO: 143006 - DNA, 25 bp, Mus musculus
tgacctagctgaggtgaacaactac

SEQ ID NO: 143007 - DNA, 25 bp, Mus musculus
tgacctaggctgactcggaagacca

SEQ ID NO: 143008 - DNA, 25 bp, Mus musculus
tgacctagggatggagatgttcctc

SEQ ID NO: 143009 - DNA, 25 bp, Mus musculus
tgacctatagcatcgctggcggcaa

SEQ ID NO: 143010 - DNA, 25 bp, Mus musculus
tgacctatcattccgagccagcgag

SEQ ID NO: 143011 - DNA, 25 bp, Mus musculus
tgacctatttgacagcacccgtgac

SEQ ID NO: 143012 - DNA, 25 bp, Mus musculus
tgacctcaaactacgtcgaactacc

SEQ ID NO: 143013 - DNA, 25 bp, Mus musculus
tgacctcagcataataatggagccc

SEQ ID NO: 143014 - DNA, 25 bp, Mus musculus
tgacctcaggagagcaggccaataa

SEQ ID NO: 143015 - DNA, 25 bp, Mus musculus
tgacctcagggaacggaaactctgc

SEQ ID NO: 143016 - DNA, 25 bp, Mus musculus
tgacctcagtgatagcaccagcctg

SEQ ID NO: 143017 - DNA, 25 bp, Mus musculus
tgacctcatcgctagtggcatccag

SEQ ID NO: 143018 - DNA, 25 bp, Mus musculus
tgacctcctgtgtgggtacccagag

SEQ ID NO: 143019 - DNA, 25 bp, Mus musculus
tgacctcgataacatgggccctaga

SEQ ID NO: 143020 - DNA, 25 bp, Mus musculus
tgacctctctgcgtacgatgctgag

SEQ ID NO: 143021 - DNA, 25 bp, Mus musculus
tgacctgaagttggtgtgggtaaaa

SEQ ID NO: 143022 - DNA, 25 bp, Mus musculus
tgacctgagaaccttgtgctcccgg

SEQ ID NO: 143023 - DNA, 25 bp, Mus musculus
tgacctgagccccaaacaggaggag

SEQ ID NO: 143024 - DNA, 25 bp, Mus musculus
tgacctgatttcaccacaagcctgg

SEQ ID NO: 143025 - DNA, 25 bp, Mus musculus
tgacctgccgcgaagttgtggccag

SEQ ID NO: 143026 - DNA, 25 bp, Mus musculus
tgacctgcggcaaagcggacaataa

SEQ ID NO: 143027 - DNA, 25 bp, Mus musculus
tgacctgctcaggttaaaggacagt

SEQ ID NO: 143028 - DNA, 25 bp, Mus musculus
tgacctgctcttggctgaagttgac

SEQ ID NO: 143029 - DNA, 25 bp, Mus musculus
tgacctgctggatcggcggaaacat

SEQ ID NO: 143030 - DNA, 25 bp, Mus musculus
tgacctggactcaagtagcctgaat

SEQ ID NO: 143031 - DNA, 25 bp, Mus musculus
tgacctggagctactgagaaagcat

SEQ ID NO: 143032 - DNA, 25 bp, Mus musculus
tgacctggatgaccctgaacgagga

SEQ ID NO: 143033 - DNA, 25 bp, Mus musculus
tgacctggcagagctatttgaacct

SEQ ID NO: 143034 - DNA, 25 bp, Mus musculus
tgacctgggaggaattctgcaatgc

SEQ ID NO: 143035 - DNA, 25 bp, Mus musculus
tgacctggtcagagtatctagctcc

SEQ ID NO: 143036 - DNA, 25 bp, Mus musculus
tgacctggtgtcagcctcttgtgct

SEQ ID NO: 143037 - DNA, 25 bp, Mus musculus
tgacctgtagacgagctgatgctgg

SEQ ID NO: 143038 - DNA, 25 bp, Mus musculus
tgacctgtcgctttgctggagcaca

SEQ ID NO: 143039 - DNA, 25 bp, Mus musculus
tgacctgtgaggaagccattcgggc

SEQ ID NO: 143040 - DNA, 25 bp, Mus musculus
tgacctgtgaggacgacaccttgac

SEQ ID NO: 143041 - DNA, 25 bp, Mus musculus
tgacctgtgaggtgatgggacctac

SEQ ID NO: 143042 - DNA, 25 bp, Mus musculus
tgacctgttcaagccggccaaggtg

SEQ ID NO: 143043 - DNA, 25 bp, Mus musculus
tgacctgttgccttggaggagaaca

SEQ ID NO: 143044 - DNA, 25 bp, Mus musculus
tgaccttaacatgcaaggcctcggg

SEQ ID NO: 143045 - DNA, 25 bp, Mus musculus
tgaccttaagcaggaagaaccgccg

SEQ ID NO: 143046 - DNA, 25 bp, Mus musculus
tgaccttacccatcagttcagactg

SEQ ID NO: 143047 - DNA, 25 bp, Mus musculus
tgaccttagccaacctgctggagac

SEQ ID NO: 143048 - DNA, 25 bp, Mus musculus
tgaccttatagcgaagcccctggaa

SEQ ID NO: 143049 - DNA, 25 bp, Mus musculus
tgaccttcagggagtacgtgtatcg

SEQ ID NO: 143050 - DNA, 25 bp, Mus musculus
tgaccttcgaaaccttgatgagctg

SEQ ID NO: 143051 - DNA, 25 bp, Mus musculus
tgaccttctgacaagcactggcctg

SEQ ID NO: 143052 - DNA, 25 bp, Mus musculus
tgaccttctggcctaagcggtgccc

SEQ ID NO: 143053 - DNA, 25 bp, Mus musculus
tgaccttgcccctcaaggtcgcggg

SEQ ID NO: 143054 - DNA, 25 bp, Mus musculus
tgaccttgcctaaggagatgctggc

SEQ ID NO: 143055 - DNA, 25 bp, Mus musculus
tgaccttggagagcgtgcaacacac

SEQ ID NO: 143056 - DNA, 25 bp, Mus musculus
tgaccttggcggatcattatctgca

SEQ ID NO: 143057 - DNA, 25 bp, Mus musculus
tgaccttgttagcagccgacagaaa

SEQ ID NO: 143058 - DNA, 25 bp, Mus musculus
tgacctttccaagctgtgcgtcctg

SEQ ID NO: 143059 - DNA, 25 bp, Mus musculus
tgacctttgaacctgatcccgctga

SEQ ID NO: 143060 - DNA, 25 bp, Mus musculus
tgacgaaacgaagaacacagacgtg

SEQ ID NO: 143061 - DNA, 25 bp, Mus musculus
tgacgaaagcgaggatgagaagccc

SEQ ID NO: 143062 - DNA, 25 bp, Mus musculus
tgacgaaagtaccatgcctacaagg

SEQ ID NO: 143063 - DNA, 25 bp, Mus musculus
tgacgaacaggtactgctgcttcag

SEQ ID NO: 143064 - DNA, 25 bp, Mus musculus
tgacgaacatcacggacctcagggt

SEQ ID NO: 143065 - DNA, 25 bp, Mus musculus
tgacgaacttgtgcagaggaactac

SEQ ID NO: 143066 - DNA, 25 bp, Mus musculus
tgacgaagacgagcgcttgtccgtg

SEQ ID NO: 143067 - DNA, 25 bp, Mus musculus
tgacgaagtacgagaaacacgttcc

SEQ ID NO: 143068 - DNA, 25 bp, Mus musculus
tgacgaagttaggacacagcatctt

SEQ ID NO: 143069 - DNA, 25 bp, Mus musculus
tgacgacaaagttgcgccggcgtcc

SEQ ID NO: 143070 - DNA, 25 bp, Mus musculus
tgacgacatccactctgtgcgaaga

SEQ ID NO: 143071 - DNA, 25 bp, Mus musculus
tgacgaccatcaccaggcttcggaa

SEQ ID NO: 143072 - DNA, 25 bp, Mus musculus
tgacgacctcaacaacaactctggc

SEQ ID NO: 143073 - DNA, 25 bp, Mus musculus
tgacgacgaggatgaagagtttgac

SEQ ID NO: 143074 - DNA, 25 bp, Mus musculus
tgacgacgtgctcggcgtataagta

SEQ ID NO: 143075 - DNA, 25 bp, Mus musculus
tgacgacgtggaaagcttcaaagcc

SEQ ID NO: 143076 - DNA, 25 bp, Mus musculus
tgacgactacgatctggaatccgat

SEQ ID NO: 143077 - DNA, 25 bp, Mus musculus
tgacgactgggctccggagtatgac

SEQ ID NO: 143078 - DNA, 25 bp, Mus musculus
tgacgagagcatcaagtatcccctg

SEQ ID NO: 143079 - DNA, 25 bp, Mus musculus
tgacgagagcgatcagcaggagtcc

SEQ ID NO: 143080 - DNA, 25 bp, Mus musculus
tgacgagtcccagatggcacagact

SEQ ID NO: 143081 - DNA, 25 bp, Mus musculus
tgacgagtctggatgctcacgcgga

SEQ ID NO: 143082 - DNA, 25 bp, Mus musculus
tgacgataaggccattgaacgactg

SEQ ID NO: 143083 - DNA, 25 bp, Mus musculus
tgacgatatcgaaatgccctgcgcg

SEQ ID NO: 143084 - DNA, 25 bp, Mus musculus
tgacgatatcgctgcgctggtcgtc

SEQ ID NO: 143085 - DNA, 25 bp, Mus musculus
tgacgatgaagaaattgagcggcgc

SEQ ID NO: 143086 - DNA, 25 bp, Mus musculus
tgacgatgatgcagagacaggcctg

SEQ ID NO: 143087 - DNA, 25 bp, Mus musculus
tgacgcaatactctttcttctaagg

SEQ ID NO: 143088 - DNA, 25 bp, Mus musculus
tgacgcagacgactatgacaaccgg

SEQ ID NO: 143089 - DNA, 25 bp, Mus musculus
tgacgcagacgctgaatgaaacccg

SEQ ID NO: 143090 - DNA, 25 bp, Mus musculus
tgacgcagcttcttcgctgcgcgcg

SEQ ID NO: 143091 - DNA, 25 bp, Mus musculus
tgacgcagggctgtatgtcattgta

SEQ ID NO: 143092 - DNA, 25 bp, Mus musculus
tgacgcatggactaaggcagagact

SEQ ID NO: 143093 - DNA, 25 bp, Mus musculus
tgacgccactccattgggcagcttt

SEQ ID NO: 143094 - DNA, 25 bp, Mus musculus
tgacgccatcatgggagctccggcg

SEQ ID NO: 143095 - DNA, 25 bp, Mus musculus
tgacgcccacagctatcaaggcagg

SEQ ID NO: 143096 - DNA, 25 bp, Mus musculus
tgacgccccacagccttggtatgca

SEQ ID NO: 143097 - DNA, 25 bp, Mus musculus
tgacgcccccgcagaggcttcgccg

SEQ ID NO: 143098 - DNA, 25 bp, Mus musculus
tgacgcccggcaggatgtcatccaa

SEQ ID NO: 143099 - DNA, 25 bp, Mus musculus
tgacgccctcgctgcaggagccggg

SEQ ID NO: 143100 - DNA, 25 bp, Mus musculus
tgacgcctccgactgatatgccaac

SEQ ID NO: 143101 - DNA, 25 bp, Mus musculus
tgacgcctgcgacatgacaatagag

SEQ ID NO: 143102 - DNA, 25 bp, Mus musculus
tgacgcctgtgcatgtggctgccgc

SEQ ID NO: 143103 - DNA, 25 bp, Mus musculus
tgacgcggagccaactggagctgat

SEQ ID NO: 143104 - DNA, 25 bp, Mus musculus
tgacgcgggtctgcgcgatagccct

SEQ ID NO: 143105 - DNA, 25 bp, Mus musculus
tgacgctagagatccgatgggcact

SEQ ID NO: 143106 - DNA, 25 bp, Mus musculus
tgacgctccttaccggagccaagat

SEQ ID NO: 143107 - DNA, 25 bp, Mus musculus
tgacgctctcaatattcctgtgtag

SEQ ID NO: 143108 - DNA, 25 bp, Mus musculus
tgacgctctcgccaggaaaaggtgc

SEQ ID NO: 143109 - DNA, 25 bp, Mus musculus
tgacgctgagaaggacagaccctgt

SEQ ID NO: 143110 - DNA, 25 bp, Mus musculus
tgacgctggcagtcgctatgagact

SEQ ID NO: 143111 - DNA, 25 bp, Mus musculus
tgacggacagacaaaccgacagcct

SEQ ID NO: 143112 - DNA, 25 bp, Mus musculus
tgacggactcattcagcaacctggt

SEQ ID NO: 143113 - DNA, 25 bp, Mus musculus
tgacggactctcagatcggagggac

SEQ ID NO: 143114 - DNA, 25 bp, Mus musculus
tgacggagccccagaagtactagct

SEQ ID NO: 143115 - DNA, 25 bp, Mus musculus
tgacggatctgttgctcaccacgaa

SEQ ID NO: 143116 - DNA, 25 bp, Mus musculus
tgacggattcgctcttcctgtgggt

SEQ ID NO: 143117 - DNA, 25 bp, Mus musculus
tgacggcaatcctagcgtgaaggct

SEQ ID NO: 143118 - DNA, 25 bp, Mus musculus
tgacggcacactgcgatgtggtgat

SEQ ID NO: 143119 - DNA, 25 bp, Mus musculus
tgacggcactggaaactgatgtacc

SEQ ID NO: 143120 - DNA, 25 bp, Mus musculus
tgacggccttgcacacgctgtttgt

SEQ ID NO: 143121 - DNA, 25 bp, Mus musculus
tgacggcctttctgcatccggagga

SEQ ID NO: 143122 - DNA, 25 bp, Mus musculus
tgacgggaactcttccagagggact

SEQ ID NO: 143123 - DNA, 25 bp, Mus musculus
tgacgggcatcgcagctaaccttgt

SEQ ID NO: 143124 - DNA, 25 bp, Mus musculus
tgacgggcatgatcaacgggaacac

SEQ ID NO: 143125 - DNA, 25 bp, Mus musculus
tgacgggccatgaacacatacggtg

SEQ ID NO: 143126 - DNA, 25 bp, Mus musculus
tgacgggtccattaacaaagctggc

SEQ ID NO: 143127 - DNA, 25 bp, Mus musculus
tgacggtcaccaacgactatcagca

SEQ ID NO: 143128 - DNA, 25 bp, Mus musculus
tgacggtccccgtgaacgattcagt

SEQ ID NO: 143129 - DNA, 25 bp, Mus musculus
tgacggtgaggtgcatgagattcac

SEQ ID NO: 143130 - DNA, 25 bp, Mus musculus
tgacggtgcctgatgagttctccca

SEQ ID NO: 143131 - DNA, 25 bp, Mus musculus
tgacggtggcaacggcagcgtcggg

SEQ ID NO: 143132 - DNA, 25 bp, Mus musculus
tgacggtgtcctcaaagggtcttct

SEQ ID NO: 143133 - DNA, 25 bp, Mus musculus
tgacgtactgatgcagcagggactt

SEQ ID NO: 143134 - DNA, 25 bp, Mus musculus
tgacgtcaatgtgctgatggccctg

SEQ ID NO: 143135 - DNA, 25 bp, Mus musculus
tgacgtcatgattcgggccctggac

SEQ ID NO: 143136 - DNA, 25 bp, Mus musculus
tgacgtccgcgatactttgatcctg

SEQ ID NO: 143137 - DNA, 25 bp, Mus musculus
tgacgtccggacattctctgagggc

SEQ ID NO: 143138 - DNA, 25 bp, Mus musculus
tgacgtctgggagcagtgaattaga

SEQ ID NO: 143139 - DNA, 25 bp, Mus musculus
tgacgtggaccttccctggagagct

SEQ ID NO: 143140 - DNA, 25 bp, Mus musculus
tgacgtggtgcagccagctgctgcc

SEQ ID NO: 143141 - DNA, 25 bp, Mus musculus
tgacgtggtgcgtcccaaagtacga

SEQ ID NO: 143142 - DNA, 25 bp, Mus musculus
tgacgtgtccttggaatcgcagaag

SEQ ID NO: 143143 - DNA, 25 bp, Mus musculus
tgacgtgtgcccgagtcctcgtggt

SEQ ID NO: 143144 - DNA, 25 bp, Mus musculus
tgacgtgtttcagatccaggcaacc

SEQ ID NO: 143145 - DNA, 25 bp, Mus musculus
tgacgttcacacctcagcctcagga

SEQ ID NO: 143146 - DNA, 25 bp, Mus musculus
tgacgttcacgtggaaggatgcttt

SEQ ID NO: 143147 - DNA, 25 bp, Mus musculus
tgacgttcttccctaacctgatggg

SEQ ID NO: 143148 - DNA, 25 bp, Mus musculus
tgacgttgcaccgtatttcaaaacg

SEQ ID NO: 143149 - DNA, 25 bp, Mus musculus
tgacgttggcatagcaacactagct

SEQ ID NO: 143150 - DNA, 25 bp, Mus musculus
tgactaacacatttccatgctgaag

SEQ ID NO: 143151 - DNA, 25 bp, Mus musculus
tgactaacctggaatacctgacgga

SEQ ID NO: 143152 - DNA, 25 bp, Mus musculus
tgactaagataaagctgaccacgcc

SEQ ID NO: 143153 - DNA, 25 bp, Mus musculus
tgactacaaagagggcaagcctggt

SEQ ID NO: 143154 - DNA, 25 bp, Mus musculus
tgactacccagccttcagcgagatc

SEQ ID NO: 143155 - DNA, 25 bp, Mus musculus
tgactacccggtacacatcgataag

SEQ ID NO: 143156 - DNA, 25 bp, Mus musculus
tgactaccgcagtgagaccagcaat

SEQ ID NO: 143157 - DNA, 25 bp, Mus musculus
tgactaccggagttttgacaagcag

SEQ ID NO: 143158 - DNA, 25 bp, Mus musculus
tgactacctgtaccggtgaccagac

SEQ ID NO: 143159 - DNA, 25 bp, Mus musculus
tgactacgaagtcgacggcagagac

SEQ ID NO: 143160 - DNA, 25 bp, Mus musculus
tgactacgacccaaagaaagaagcc

SEQ ID NO: 143161 - DNA, 25 bp, Mus musculus
tgactacgaccgacttccgagagaa

SEQ ID NO: 143162 - DNA, 25 bp, Mus musculus
tgactacgaggcacttgctaacagg

SEQ ID NO: 143163 - DNA, 25 bp, Mus musculus
tgactacgggctgaatgatcacgcc

SEQ ID NO: 143164 - DNA, 25 bp, Mus musculus
tgactactacatcgagcgtgccctg

SEQ ID NO: 143165 - DNA, 25 bp, Mus musculus
tgactactatttcccaggaggccag

SEQ ID NO: 143166 - DNA, 25 bp, Mus musculus
tgactactccatggtgttgacagga

SEQ ID NO: 143167 - DNA, 25 bp, Mus musculus
tgactactcgctgactgccaaggag

SEQ ID NO: 143168 - DNA, 25 bp, Mus musculus
tgactactgctgaaaacgagctggg

SEQ ID NO: 143169 - DNA, 25 bp, Mus musculus
tgactactggcgcattctgaacccg

SEQ ID NO: 143170 - DNA, 25 bp, Mus musculus
tgactagaagttggcggcactacag

SEQ ID NO: 143171 - DNA, 25 bp, Mus musculus
tgactagaatcgtgctcctgcgggc

SEQ ID NO: 143172 - DNA, 25 bp, Mus musculus
tgactaggtcaagggtaatgggcca

SEQ ID NO: 143173 - DNA, 25 bp, Mus musculus
tgactagtcagcactgcagggcacg

SEQ ID NO: 143174 - DNA, 25 bp, Mus musculus
tgactagtcccctgaagatcttgaa

SEQ ID NO: 143175 - DNA, 25 bp, Mus musculus
tgactataagtacaagccaaggcct

SEQ ID NO: 143176 - DNA, 25 bp, Mus musculus
tgactataagtagccatgctgatgt

SEQ ID NO: 143177 - DNA, 25 bp, Mus musculus
tgactatataaagagacgccgggcg

SEQ ID NO: 143178 - DNA, 25 bp, Mus musculus
tgactatatacctttctaggagctg

SEQ ID NO: 143179 - DNA, 25 bp, Mus musculus
tgactatcaggacgtggcactggct

SEQ ID NO: 143180 - DNA, 25 bp, Mus musculus
tgactatgaccacctgacgttgatg

SEQ ID NO: 143181 - DNA, 25 bp, Mus musculus
tgactatgataaggtggagctggcc

SEQ ID NO: 143182 - DNA, 25 bp, Mus musculus
tgactatggccaaaggaacagggtt

SEQ ID NO: 143183 - DNA, 25 bp, Mus musculus
tgactatgggtcaggttcgggctcc

SEQ ID NO: 143184 - DNA, 25 bp, Mus musculus
tgactcaaaaccactcaggaccctg

SEQ ID NO: 143185 - DNA, 25 bp, Mus musculus
tgactcaagccctagccaagcaatg

SEQ ID NO: 143186 - DNA, 25 bp, Mus musculus
tgactcaagtacaagcagtaggctg

SEQ ID NO: 143187 - DNA, 25 bp, Mus musculus
tgactcagggcaaccagatgaacgg

SEQ ID NO: 143188 - DNA, 25 bp, Mus musculus
tgactccaagcatatggccccagga

SEQ ID NO: 143189 - DNA, 25 bp, Mus musculus
tgactccgaacaacctgaagcccgt

SEQ ID NO: 143190 - DNA, 25 bp, Mus musculus
tgactccggcctccacagttagatg

SEQ ID NO: 143191 - DNA, 25 bp, Mus musculus
tgactccgtcccatcggaagtccgg

SEQ ID NO: 143192 - DNA, 25 bp, Mus musculus
tgactcgaggtgttggctggacccc

SEQ ID NO: 143193 - DNA, 25 bp, Mus musculus
tgactcgctccagagctgatgggaa

SEQ ID NO: 143194 - DNA, 25 bp, Mus musculus
tgactcggagggtgtggataaaacc

SEQ ID NO: 143195 - DNA, 25 bp, Mus musculus
tgactcgggctccacacagaatgtg

SEQ ID NO: 143196 - DNA, 25 bp, Mus musculus
tgactcggggccacataggcagcaa

SEQ ID NO: 143197 - DNA, 25 bp, Mus musculus
tgactcgttcttggggaaactcgga

SEQ ID NO: 143198 - DNA, 25 bp, Mus musculus
tgactctaaacaaaggccaggcctc

SEQ ID NO: 143199 - DNA, 25 bp, Mus musculus
tgactctagtgggatgctacaacct

SEQ ID NO: 143200 - DNA, 25 bp, Mus musculus
tgactctccaagaccgcaacgagaa

SEQ ID NO: 143201 - DNA, 25 bp, Mus musculus
tgactctctggtggctacaaacaag

SEQ ID NO: 143202 - DNA, 25 bp, Mus musculus
tgactctgaccccatcacagtggtg

SEQ ID NO: 143203 - DNA, 25 bp, Mus musculus
tgactctgctcgtggctctcttggc

SEQ ID NO: 143204 - DNA, 25 bp, Mus musculus
tgactctgctgccaaagaagccctg

SEQ ID NO: 143205 - DNA, 25 bp, Mus musculus
tgactctggttgatgccttggatac

SEQ ID NO: 143206 - DNA, 25 bp, Mus musculus
tgactctgtgatgactccccatggg

SEQ ID NO: 143207 - DNA, 25 bp, Mus musculus
tgactcttgaggagcacatagccca

SEQ ID NO: 143208 - DNA, 25 bp, Mus musculus
tgactcttggaatgccccagggttg

SEQ ID NO: 143209 - DNA, 25 bp, Mus musculus
tgactgaagggcacaagtttgaccg

SEQ ID NO: 143210 - DNA, 25 bp, Mus musculus
tgactgaatcacaagccacctgtgc

SEQ ID NO: 143211 - DNA, 25 bp, Mus musculus
tgactgaccgctccatgtgtaaacc

SEQ ID NO: 143212 - DNA, 25 bp, Mus musculus
tgactgacggacaacaaaaatggcg

SEQ ID NO: 143213 - DNA, 25 bp, Mus musculus
tgactgagagaataaaggcaaccca

SEQ ID NO: 143214 - DNA, 25 bp, Mus musculus
tgactgaggaaaggacccagagact

SEQ ID NO: 143215 - DNA, 25 bp, Mus musculus
tgactgataacgtccaatgaccctg

SEQ ID NO: 143216 - DNA, 25 bp, Mus musculus
tgactgatggggactcctgccactc

SEQ ID NO: 143217 - DNA, 25 bp, Mus musculus
tgactgcactgcacctggaaaagga

SEQ ID NO: 143218 - DNA, 25 bp, Mus musculus
tgactgcagtgctgagaacaccctg

SEQ ID NO: 143219 - DNA, 25 bp, Mus musculus
tgactgccaagctcgattgccctgg

SEQ ID NO: 143220 - DNA, 25 bp, Mus musculus
tgactgccacacgatatgaccggaa

SEQ ID NO: 143221 - DNA, 25 bp, Mus musculus
tgactgccagtctcacatttgggct

SEQ ID NO: 143222 - DNA, 25 bp, Mus musculus
tgactgccatcttcatctgcattgg

SEQ ID NO: 143223 - DNA, 25 bp, Mus musculus
tgactgcctgatgtacgaccgtacg

SEQ ID NO: 143224 - DNA, 25 bp, Mus musculus
tgactgcgcaccctcatctatcaag

SEQ ID NO: 143225 - DNA, 25 bp, Mus musculus
tgactgcgctgggaaacatggcgac

SEQ ID NO: 143226 - DNA, 25 bp, Mus musculus
tgactgcgctgtgccactgcaatgg

SEQ ID NO: 143227 - DNA, 25 bp, Mus musculus
tgactgctaacttgctgcgcttcct

SEQ ID NO: 143228 - DNA, 25 bp, Mus musculus
tgactgctctccatcctgttatgca

SEQ ID NO: 143229 - DNA, 25 bp, Mus musculus
tgactggaagcccaagacctgaggc

SEQ ID NO: 143230 - DNA, 25 bp, Mus musculus
tgactggaatccctttctgctaatg

SEQ ID NO: 143231 - DNA, 25 bp, Mus musculus
tgactggactcttggaatgcatcgg

SEQ ID NO: 143232 - DNA, 25 bp, Mus musculus
tgactggagctgaccttaaggactg

SEQ ID NO: 143233 - DNA, 25 bp, Mus musculus
tgactggattactgcagtgaggcca

SEQ ID NO: 143234 - DNA, 25 bp, Mus musculus
tgactggcaactagaggaaaggacc

SEQ ID NO: 143235 - DNA, 25 bp, Mus musculus
tgactggccttgaggacggccgccc

SEQ ID NO: 143236 - DNA, 25 bp, Mus musculus
tgactggctcccttgtcagcaagac

SEQ ID NO: 143237 - DNA, 25 bp, Mus musculus
tgactgggaactcccagatgtccct

SEQ ID NO: 143238 - DNA, 25 bp, Mus musculus
tgactgggactttgccggcagagta

SEQ ID NO: 143239 - DNA, 25 bp, Mus musculus
tgactggtaacagcagtgccttacc

SEQ ID NO: 143240 - DNA, 25 bp, Mus musculus
tgactggttggacagcatacggcca

SEQ ID NO: 143241 - DNA, 25 bp, Mus musculus
tgactgtatataccctcctggcagc

SEQ ID NO: 143242 - DNA, 25 bp, Mus musculus
tgactgtcagtgaaatcaaaaccag

SEQ ID NO: 143243 - DNA, 25 bp, Mus musculus
tgactgtcccggaaatgggcctgca

SEQ ID NO: 143244 - DNA, 25 bp, Mus musculus
tgactgtgatcaaggctgcctggct

SEQ ID NO: 143245 - DNA, 25 bp, Mus musculus
tgactgtgcccatgagctacggcgt

SEQ ID NO: 143246 - DNA, 25 bp, Mus musculus
tgactgtgctcgagccatagcgcct

SEQ ID NO: 143247 - DNA, 25 bp, Mus musculus
tgactgtggacaccccttacctggg

SEQ ID NO: 143248 - DNA, 25 bp, Mus musculus
tgactgtggagtacatcacccgcta

SEQ ID NO: 143249 - DNA, 25 bp, Mus musculus
tgactgtggatatgagggctcccct

SEQ ID NO: 143250 - DNA, 25 bp, Mus musculus
tgactgtgggccctgactctaaccc

SEQ ID NO: 143251 - DNA, 25 bp, Mus musculus
tgactgtgtcttcacatacgactgc

SEQ ID NO: 143252 - DNA, 25 bp, Mus musculus
tgactgttggccatgtcatctcaga

SEQ ID NO: 143253 - DNA, 25 bp, Mus musculus
tgactgtttacccaccataacggtg

SEQ ID NO: 143254 - DNA, 25 bp, Mus musculus
tgacttaaaacataacctggaggcg

SEQ ID NO: 143255 - DNA, 25 bp, Mus musculus
tgacttaacatccaaggctgcccag

SEQ ID NO: 143256 - DNA, 25 bp, Mus musculus
tgacttacatgaaaccaccagctgc

SEQ ID NO: 143257 - DNA, 25 bp, Mus musculus
tgacttaggaagagagggagccact

SEQ ID NO: 143258 - DNA, 25 bp, Mus musculus
tgacttattcgcagacatcaagaag

SEQ ID NO: 143259 - DNA, 25 bp, Mus musculus
tgacttattgcctctgcctgaggac

SEQ ID NO: 143260 - DNA, 25 bp, Mus musculus
tgacttcaaggctcacaaggcggtg

SEQ ID NO: 143261 - DNA, 25 bp, Mus musculus
tgacttcacggctggccaggactgt

SEQ ID NO: 143262 - DNA, 25 bp, Mus musculus
tgacttcagattctgagtgctggga

SEQ ID NO: 143263 - DNA, 25 bp, Mus musculus
tgacttcagccctcgctttgtggcg

SEQ ID NO: 143264 - DNA, 25 bp, Mus musculus
tgacttcagctatggccagccctgt

SEQ ID NO: 143265 - DNA, 25 bp, Mus musculus
tgacttcagtctcacgtgggaccgg

SEQ ID NO: 143266 - DNA, 25 bp, Mus musculus
tgacttccaagctgagaggcatgcc

SEQ ID NO: 143267 - DNA, 25 bp, Mus musculus
tgacttccccacctgtggaacatgt

SEQ ID NO: 143268 - DNA, 25 bp, Mus musculus
tgacttcctggtggcgatcgtctgc

SEQ ID NO: 143269 - DNA, 25 bp, Mus musculus
tgacttcctgtttaactctctgcct

SEQ ID NO: 143270 - DNA, 25 bp, Mus musculus
tgacttcggcttccactcaaaggcg

SEQ ID NO: 143271 - DNA, 25 bp, Mus musculus
tgacttcttagaacgggtagccgaa

SEQ ID NO: 143272 - DNA, 25 bp, Mus musculus
tgacttcttcaactatgcgggactg

SEQ ID NO: 143273 - DNA, 25 bp, Mus musculus
tgacttcttgcaccatcttgcctgg

SEQ ID NO: 143274 - DNA, 25 bp, Mus musculus
tgacttctttgaggagactcgtggc

SEQ ID NO: 143275 - DNA, 25 bp, Mus musculus
tgacttgaagttatgggctggatcc

SEQ ID NO: 143276 - DNA, 25 bp, Mus musculus
tgacttgaccgccatctgtgatgcc

SEQ ID NO: 143277 - DNA, 25 bp, Mus musculus
tgacttgacctacattgactccgcg

SEQ ID NO: 143278 - DNA, 25 bp, Mus musculus
tgacttggaagaaaggacggcagcc

SEQ ID NO: 143279 - DNA, 25 bp, Mus musculus
tgacttggagaacatccggagcctg

SEQ ID NO: 143280 - DNA, 25 bp, Mus musculus
tgacttggataaaagcactgggcgt

SEQ ID NO: 143281 - DNA, 25 bp, Mus musculus
tgacttggatgggagctgtaacacc

SEQ ID NO: 143282 - DNA, 25 bp, Mus musculus
tgacttggcagttgacgggaccacg

SEQ ID NO: 143283 - DNA, 25 bp, Mus musculus
tgacttgggaggagactgaggagac

SEQ ID NO: 143284 - DNA, 25 bp, Mus musculus
tgacttgtcctacctgccaaggcaa

SEQ ID NO: 143285 - DNA, 25 bp, Mus musculus
tgactttaaaacgataatccgggct

SEQ ID NO: 143286 - DNA, 25 bp, Mus musculus
tgactttaaagtgagcctgctccgt

SEQ ID NO: 143287 - DNA, 25 bp, Mus musculus
tgactttcaccacttttgatctcgg

SEQ ID NO: 143288 - DNA, 25 bp, Mus musculus
tgactttgaaaagaccggacctcct

SEQ ID NO: 143289 - DNA, 25 bp, Mus musculus
tgactttgagatctatgcggacccc

SEQ ID NO: 143290 - DNA, 25 bp, Mus musculus
tgactttgccgtggacagccttggg

SEQ ID NO: 143291 - DNA, 25 bp, Mus musculus
tgactttggacgagtagggcaacct

SEQ ID NO: 143292 - DNA, 25 bp, Mus musculus
tgactttgtagaagcccagatgact

SEQ ID NO: 143293 - DNA, 25 bp, Mus musculus
tgacttttgaatgtgacctgggccg

SEQ ID NO: 143294 - DNA, 25 bp, Mus musculus
tgacttttgggatggtcaatccaca

SEQ ID NO: 143295 - DNA, 25 bp, Mus musculus
tgagaaaacctggagcaaatgtccc

SEQ ID NO: 143296 - DNA, 25 bp, Mus musculus
tgagaaaagtgtcccacaagaagag

SEQ ID NO: 143297 - DNA, 25 bp, Mus musculus
tgagaaaatccccattcctgaggag

SEQ ID NO: 143298 - DNA, 25 bp, Mus musculus
tgagaaaatgacatctactccagag

SEQ ID NO: 143299 - DNA, 25 bp, Mus musculus
tgagaaacaaaagctatacaccgtg

SEQ ID NO: 143300 - DNA, 25 bp, Mus musculus
tgagaaaccaatcccttggacagtc

SEQ ID NO: 143301 - DNA, 25 bp, Mus musculus
tgagaaacctcaggtgtccacagct

SEQ ID NO: 143302 - DNA, 25 bp, Mus musculus
tgagaaacgaacttgccagcagaat

SEQ ID NO: 143303 - DNA, 25 bp, Mus musculus
tgagaaactaacaggcccaatggag

SEQ ID NO: 143304 - DNA, 25 bp, Mus musculus
tgagaaactacaaactgccattgag

SEQ ID NO: 143305 - DNA, 25 bp, Mus musculus
tgagaaactcaagaaggctgtgcgg

SEQ ID NO: 143306 - DNA, 25 bp, Mus musculus
tgagaaactgtgtggccttcatgcc

SEQ ID NO: 143307 - DNA, 25 bp, Mus musculus
tgagaaagaagagtgtgaaacaaga

SEQ ID NO: 143308 - DNA, 25 bp, Mus musculus
tgagaaagcctcagaactccgggtc

SEQ ID NO: 143309 - DNA, 25 bp, Mus musculus
tgagaaagcgaggacacaagcgtct

SEQ ID NO: 143310 - DNA, 25 bp, Mus musculus
tgagaaagctgcactagcaggctga

SEQ ID NO: 143311 - DNA, 25 bp, Mus musculus
tgagaaagcttatcatagtcgacgc

SEQ ID NO: 143312 - DNA, 25 bp, Mus musculus
tgagaaaggagaagtcggtccagct

SEQ ID NO: 143313 - DNA, 25 bp, Mus musculus
tgagaaagttcagcggaaaggcaca

SEQ ID NO: 143314 - DNA, 25 bp, Mus musculus
tgagaaatgctaccgcggccatgaa

SEQ ID NO: 143315 - DNA, 25 bp, Mus musculus
tgagaaatgtgaacaggccacccag

SEQ ID NO: 143316 - DNA, 25 bp, Mus musculus
tgagaaattgacagcccttgaacgg

SEQ ID NO: 143317 - DNA, 25 bp, Mus musculus
tgagaacactagcaacgtgcgggac

SEQ ID NO: 143318 - DNA, 25 bp, Mus musculus
tgagaacaggcaccttgtcagcccg

SEQ ID NO: 143319 - DNA, 25 bp, Mus musculus
tgagaaccaagcctgaccctgaagt

SEQ ID NO: 143320 - DNA, 25 bp, Mus musculus
tgagaaccagtcaggcaaggacacc

SEQ ID NO: 143321 - DNA, 25 bp, Mus musculus
tgagaaccttatgtggtacgcccac

SEQ ID NO: 143322 - DNA, 25 bp, Mus musculus
tgagaaccttcccttctcacagagg

SEQ ID NO: 143323 - DNA, 25 bp, Mus musculus
tgagaacgacaatctgccaaagcct

SEQ ID NO: 143324 - DNA, 25 bp, Mus musculus
tgagaacgaggagagagagctcagc

SEQ ID NO: 143325 - DNA, 25 bp, Mus musculus
tgagaacgcctatgagccacggaaa

SEQ ID NO: 143326 - DNA, 25 bp, Mus musculus
tgagaacggaaaccctgaccgagtc

SEQ ID NO: 143327 - DNA, 25 bp, Mus musculus
tgagaacgggatccagcctctaagt

SEQ ID NO: 143328 - DNA, 25 bp, Mus musculus
tgagaacgggcagcttcgagaagaa

SEQ ID NO: 143329 - DNA, 25 bp, Mus musculus
tgagaactcgtcgactcctgtggac

SEQ ID NO: 143330 - DNA, 25 bp, Mus musculus
tgagaactcgtttgacatggcagca

SEQ ID NO: 143331 - DNA, 25 bp, Mus musculus
tgagaacttagtccgtccgtaccca

SEQ ID NO: 143332 - DNA, 25 bp, Mus musculus
tgagaacttgcattcgccgggtgag

SEQ ID NO: 143333 - DNA, 25 bp, Mus musculus
tgagaagaaaacgatgctgaaggcc

SEQ ID NO: 143334 - DNA, 25 bp, Mus musculus
tgagaagaaagaccctttacccgca

SEQ ID NO: 143335 - DNA, 25 bp, Mus musculus
tgagaagaacaatggagcaggctac

SEQ ID NO: 143336 - DNA, 25 bp, Mus musculus
tgagaagaacacagaccacatccag

SEQ ID NO: 143337 - DNA, 25 bp, Mus musculus
tgagaagaagcctgcgcagggcaac

SEQ ID NO: 143338 - DNA, 25 bp, Mus musculus
tgagaagacactgtgcaccagctgt

SEQ ID NO: 143339 - DNA, 25 bp, Mus musculus
tgagaagagacctgagcacaatcct

SEQ ID NO: 143340 - DNA, 25 bp, Mus musculus
tgagaagagtgttcccagcctctgt

SEQ ID NO: 143341 - DNA, 25 bp, Mus musculus
tgagaagatgacactggcacaactg

SEQ ID NO: 143342 - DNA, 25 bp, Mus musculus
tgagaagccagtgctaggcagccac

SEQ ID NO: 143343 - DNA, 25 bp, Mus musculus
tgagaagccgccagagctcatgttt

SEQ ID NO: 143344 - DNA, 25 bp, Mus musculus
tgagaagccggcaaacatggcggcc

SEQ ID NO: 143345 - DNA, 25 bp, Mus musculus
tgagaagccttacctctgtggcaag

SEQ ID NO: 143346 - DNA, 25 bp, Mus musculus
tgagaagccttgtgatagccctgcg

SEQ ID NO: 143347 - DNA, 25 bp, Mus musculus
tgagaagctggtcaaagctccccgg

SEQ ID NO: 143348 - DNA, 25 bp, Mus musculus
tgagaaggaccatctttcccctggg

SEQ ID NO: 143349 - DNA, 25 bp, Mus musculus
tgagaaggatctagaggcaatgaaa

SEQ ID NO: 143350 - DNA, 25 bp, Mus musculus
tgagaaggcaaggaaacccctggaa

SEQ ID NO: 143351 - DNA, 25 bp, Mus musculus
tgagaaggccatagagatccgctct

SEQ ID NO: 143352 - DNA, 25 bp, Mus musculus
tgagaaggcttcgtcgacacagtac

SEQ ID NO: 143353 - DNA, 25 bp, Mus musculus
tgagaagggttctccaagccgtgcc

SEQ ID NO: 143354 - DNA, 25 bp, Mus musculus
tgagaagtacccagcaatggcgagc

SEQ ID NO: 143355 - DNA, 25 bp, Mus musculus
tgagaagtctcaacaagccgtgctc

SEQ ID NO: 143356 - DNA, 25 bp, Mus musculus
tgagaagtgccaggatctccggact

SEQ ID NO: 143357 - DNA, 25 bp, Mus musculus
tgagaagttagagcagtcggaagcc

SEQ ID NO: 143358 - DNA, 25 bp, Mus musculus
tgagaagttctccaaggccgtcagc

SEQ ID NO: 143359 - DNA, 25 bp, Mus musculus
tgagaataccaaccgcctgatgcag

SEQ ID NO: 143360 - DNA, 25 bp, Mus musculus
tgagaatagactccaggctgccgag

SEQ ID NO: 143361 - DNA, 25 bp, Mus musculus
tgagaatagcaaagtaattggtggt

SEQ ID NO: 143362 - DNA, 25 bp, Mus musculus
tgagaatccgatatgggcagaccaa

SEQ ID NO: 143363 - DNA, 25 bp, Mus musculus
tgagaatcctgaccacagtgaaggc

SEQ ID NO: 143364 - DNA, 25 bp, Mus musculus
tgagaatctgcacacccggtttgga

SEQ ID NO: 143365 - DNA, 25 bp, Mus musculus
tgagaatgaagagcacgatgatgga

SEQ ID NO: 143366 - DNA, 25 bp, Mus musculus
tgagaatgctaatggagcccctgcc

SEQ ID NO: 143367 - DNA, 25 bp, Mus musculus
tgagaatgtcacagatgctaccttg

SEQ ID NO: 143368 - DNA, 25 bp, Mus musculus
tgagaatgtgcagatagctggctcc

SEQ ID NO: 143369 - DNA, 25 bp, Mus musculus
tgagaattacaccaaggccctggcg

SEQ ID NO: 143370 - DNA, 25 bp, Mus musculus
tgagaattttactccacagtgggca

SEQ ID NO: 143371 - DNA, 25 bp, Mus musculus
tgagaattttctatataccacagag

SEQ ID NO: 143372 - DNA, 25 bp, Mus musculus
tgagaattttggtgctaccctgagc

SEQ ID NO: 143373 - DNA, 25 bp, Mus musculus
tgagacaacagatcccgacaagagg

SEQ ID NO: 143374 - DNA, 25 bp, Mus musculus
tgagacacaaactgaaaacggcctt

SEQ ID NO: 143375 - DNA, 25 bp, Mus musculus
tgagacagcttaacaaccattttgg

SEQ ID NO: 143376 - DNA, 25 bp, Mus musculus
tgagacagtgctggatcctgccgag

SEQ ID NO: 143377 - DNA, 25 bp, Mus musculus
tgagacatttgactccagggacgga

SEQ ID NO: 143378 - DNA, 25 bp, Mus musculus
tgagaccaccaggagctcctaagtg

SEQ ID NO: 143379 - DNA, 25 bp, Mus musculus
tgagaccacttatgaatggacttgg

SEQ ID NO: 143380 - DNA, 25 bp, Mus musculus
tgagaccagagatgcagatgccaca

SEQ ID NO: 143381 - DNA, 25 bp, Mus musculus
tgagaccagccaggatgccaagtgt

SEQ ID NO: 143382 - DNA, 25 bp, Mus musculus
tgagaccagctttactaggaccatt

SEQ ID NO: 143383 - DNA, 25 bp, Mus musculus
tgagacccacttcacggctggagaa

SEQ ID NO: 143384 - DNA, 25 bp, Mus musculus
tgagacccctgcttcggtcgaagaa

SEQ ID NO: 143385 - DNA, 25 bp, Mus musculus
tgagacccgctacatcgtggagaac

SEQ ID NO: 143386 - DNA, 25 bp, Mus musculus
tgagacccgggtcaaacaacaacag

SEQ ID NO: 143387 - DNA, 25 bp, Mus musculus
tgagaccgggcagcacaattgcgtt

SEQ ID NO: 143388 - DNA, 25 bp, Mus musculus
tgagaccgggctggccatgatttat

SEQ ID NO: 143389 - DNA, 25 bp, Mus musculus
tgagacctacaggaagcaatgccgg

SEQ ID NO: 143390 - DNA, 25 bp, Mus musculus
tgagacctacgtcatggacagccgg

SEQ ID NO: 143391 - DNA, 25 bp, Mus musculus
tgagacctcaccagcactgatgcag

SEQ ID NO: 143392 - DNA, 25 bp, Mus musculus
tgagacctctggtggaagctggcct

SEQ ID NO: 143393 - DNA, 25 bp, Mus musculus
tgagacctgaggacagcaaagcctg

SEQ ID NO: 143394 - DNA, 25 bp, Mus musculus
tgagacctgtagtgtggaaatccca

SEQ ID NO: 143395 - DNA, 25 bp, Mus musculus
tgagacggaagatgtcaaagcaacc

SEQ ID NO: 143396 - DNA, 25 bp, Mus musculus
tgagacggatccttcgccgagctgt

SEQ ID NO: 143397 - DNA, 25 bp, Mus musculus
tgagacgggactctttacactgcgg

SEQ ID NO: 143398 - DNA, 25 bp, Mus musculus
tgagacggtcaacatctggactcac

SEQ ID NO: 143399 - DNA, 25 bp, Mus musculus
tgagacgttctaacccaggacgcgt

SEQ ID NO: 143400 - DNA, 25 bp, Mus musculus
tgagactcactttgcagacatgtat

SEQ ID NO: 143401 - DNA, 25 bp, Mus musculus
tgagactccaagcttcatcagaagg

SEQ ID NO: 143402 - DNA, 25 bp, Mus musculus
tgagactccacaccagactcaagga

SEQ ID NO: 143403 - DNA, 25 bp, Mus musculus
tgagactgagcattgagtgccctgt

SEQ ID NO: 143404 - DNA, 25 bp, Mus musculus
tgagactgaggaaaacgcgccaagt

SEQ ID NO: 143405 - DNA, 25 bp, Mus musculus
tgagactgatcctgaccctttcctg

SEQ ID NO: 143406 - DNA, 25 bp, Mus musculus
tgagacttcctgcaaaacaatgacc

SEQ ID NO: 143407 - DNA, 25 bp, Mus musculus
tgagactttcgacatcgcccgcttg

SEQ ID NO: 143408 - DNA, 25 bp, Mus musculus
tgagacttttgaccctcggagacac

SEQ ID NO: 143409 - DNA, 25 bp, Mus musculus
tgagagaacacccaaaacatgtgag

SEQ ID NO: 143410 - DNA, 25 bp, Mus musculus
tgagagaaccctgaaacggacagcg

SEQ ID NO: 143411 - DNA, 25 bp, Mus musculus
tgagagaactcggtatccagcggac

SEQ ID NO: 143412 - DNA, 25 bp, Mus musculus
tgagagaagaggtgcacagctactg

SEQ ID NO: 143413 - DNA, 25 bp, Mus musculus
tgagagaatcacctaggacgccggt

SEQ ID NO: 143414 - DNA, 25 bp, Mus musculus
tgagagacaatccaaagcccagaac

SEQ ID NO: 143415 - DNA, 25 bp, Mus musculus
tgagagacaccatcaagcacattgg

SEQ ID NO: 143416 - DNA, 25 bp, Mus musculus
tgagagaccgacttgagagaacagc

SEQ ID NO: 143417 - DNA, 25 bp, Mus musculus
tgagagacgacccatgttgcagagt

SEQ ID NO: 143418 - DNA, 25 bp, Mus musculus
tgagagacttctacgtcagagttac

SEQ ID NO: 143419 - DNA, 25 bp, Mus musculus
tgagagagatcaacagccagtgcta

SEQ ID NO: 143420 - DNA, 25 bp, Mus musculus
tgagagagatcaggaagcttagacc

SEQ ID NO: 143421 - DNA, 25 bp, Mus musculus
tgagagaggaaccactagggtccct

SEQ ID NO: 143422 - DNA, 25 bp, Mus musculus
tgagagaggacaggtattgccccac

SEQ ID NO: 143423 - DNA, 25 bp, Mus musculus
tgagagaggactgctagacagaacc

SEQ ID NO: 143424 - DNA, 25 bp, Mus musculus
tgagagaggcctttccaggaagcac

SEQ ID NO: 143425 - DNA, 25 bp, Mus musculus
tgagagagggtgttctgacttccct

SEQ ID NO: 143426 - DNA, 25 bp, Mus musculus
tgagagaggtgaacaaggtcccgct

SEQ ID NO: 143427 - DNA, 25 bp, Mus musculus
tgagagagtgaagaagcagctagcc

SEQ ID NO: 143428 - DNA, 25 bp, Mus musculus
tgagagatcctgacataaacccttg

SEQ ID NO: 143429 - DNA, 25 bp, Mus musculus
tgagagatcgctgagctgcgcaggg

SEQ ID NO: 143430 - DNA, 25 bp, Mus musculus
tgagagcaaaactgacttccggtcc

SEQ ID NO: 143431 - DNA, 25 bp, Mus musculus
tgagagcaacggcaatgacgtccat

SEQ ID NO: 143432 - DNA, 25 bp, Mus musculus
tgagagcagcaagaacatgcccctg

SEQ ID NO: 143433 - DNA, 25 bp, Mus musculus
tgagagcagcctacttggacgacct

SEQ ID NO: 143434 - DNA, 25 bp, Mus musculus
tgagagccattcttgttcacgtcgc

SEQ ID NO: 143435 - DNA, 25 bp, Mus musculus
tgagagccgagaaaagtactcgcgc

SEQ ID NO: 143436 - DNA, 25 bp, Mus musculus
tgagagcctataacactgcagggac

SEQ ID NO: 143437 - DNA, 25 bp, Mus musculus
tgagagcgagacagacattgcacct

SEQ ID NO: 143438 - DNA, 25 bp, Mus musculus
tgagagctcaagaggacactgtggc

SEQ ID NO: 143439 - DNA, 25 bp, Mus musculus
tgagagctcagacaaaacagcagct

SEQ ID NO: 143440 - DNA, 25 bp, Mus musculus
tgagaggacctagcgcatctccaga

SEQ ID NO: 143441 - DNA, 25 bp, Mus musculus
tgagaggcatcagtcagaaaaggga

SEQ ID NO: 143442 - DNA, 25 bp, Mus musculus
tgagaggcctgagcccttgttctgg

SEQ ID NO: 143443 - DNA, 25 bp, Mus musculus
tgagaggccttgctataaccggaga

SEQ ID NO: 143444 - DNA, 25 bp, Mus musculus
tgagaggctacgcaaacagtttggc

SEQ ID NO: 143445 - DNA, 25 bp, Mus musculus
tgagaggctcttcccaaactccact

SEQ ID NO: 143446 - DNA, 25 bp, Mus musculus
tgagagggaaaagacttcgacggac

SEQ ID NO: 143447 - DNA, 25 bp, Mus musculus
tgagaggtcccataaaggcaagcac

SEQ ID NO: 143448 - DNA, 25 bp, Mus musculus
tgagaggtgtaagcccgcccggaat

SEQ ID NO: 143449 - DNA, 25 bp, Mus musculus
tgagagtagccctggccagagatcc

SEQ ID NO: 143450 - DNA, 25 bp, Mus musculus
tgagagtcaacttcaccaagctggc

SEQ ID NO: 143451 - DNA, 25 bp, Mus musculus
tgagagtcaagcagccgttagtggt

SEQ ID NO: 143452 - DNA, 25 bp, Mus musculus
tgagagtcgatcaagacaaagacag

SEQ ID NO: 143453 - DNA, 25 bp, Mus musculus
tgagagtcgccagattacccaggtc

SEQ ID NO: 143454 - DNA, 25 bp, Mus musculus
tgagagtctacagcgcattggtacc

SEQ ID NO: 143455 - DNA, 25 bp, Mus musculus
tgagagtggactgaacaggcgtcac

SEQ ID NO: 143456 - DNA, 25 bp, Mus musculus
tgagagtggccaacctgcccttggt

SEQ ID NO: 143457 - DNA, 25 bp, Mus musculus
tgagagtgtctgtgcgccatagcct

SEQ ID NO: 143458 - DNA, 25 bp, Mus musculus
tgagagttcggccaggtttgtaccc

SEQ ID NO: 143459 - DNA, 25 bp, Mus musculus
tgagagtttcttccagcccctgtac

SEQ ID NO: 143460 - DNA, 25 bp, Mus musculus
tgagataatccgagataacactggc

SEQ ID NO: 143461 - DNA, 25 bp, Mus musculus
tgagatacatcgcacgcaagcacaa

SEQ ID NO: 143462 - DNA, 25 bp, Mus musculus
tgagataccactgccctgaggagtc

SEQ ID NO: 143463 - DNA, 25 bp, Mus musculus
tgagatacccctttgagagcccaga

SEQ ID NO: 143464 - DNA, 25 bp, Mus musculus
tgagataccgctgcaacttagaaca

SEQ ID NO: 143465 - DNA, 25 bp, Mus musculus
tgagataggcctctgcaacttttat

SEQ ID NO: 143466 - DNA, 25 bp, Mus musculus
tgagatatgcagctgtgaggaccct

SEQ ID NO: 143467 - DNA, 25 bp, Mus musculus
tgagatattgtgaattgaaagacaa

SEQ ID NO: 143468 - DNA, 25 bp, Mus musculus
tgagatcaaactccagagcacagag

SEQ ID NO: 143469 - DNA, 25 bp, Mus musculus
tgagatcaagattgtgcgacccggg

SEQ ID NO: 143470 - DNA, 25 bp, Mus musculus
tgagatcaatggtgagcccgtggac

SEQ ID NO: 143471 - DNA, 25 bp, Mus musculus
tgagatcacacctcgtgcagaagga

SEQ ID NO: 143472 - DNA, 25 bp, Mus musculus
tgagatcaccagcaagattgcaagg

SEQ ID NO: 143473 - DNA, 25 bp, Mus musculus
tgagatcagacgaccaaatggagag

SEQ ID NO: 143474 - DNA, 25 bp, Mus musculus
tgagatcatggaaaccctgaaagac

SEQ ID NO: 143475 - DNA, 25 bp, Mus musculus
tgagatccaaaagacggagagcacc

SEQ ID NO: 143476 - DNA, 25 bp, Mus musculus
tgagatccaatactgccagcgcctg

SEQ ID NO: 143477 - DNA, 25 bp, Mus musculus
tgagatccccacaaatctgcctgag

SEQ ID NO: 143478 - DNA, 25 bp, Mus musculus
tgagatccggaaactggacggtttc

SEQ ID NO: 143479 - DNA, 25 bp, Mus musculus
tgagatcctgagtggcttgctagcc

SEQ ID NO: 143480 - DNA, 25 bp, Mus musculus
tgagatcctgcgctctaacctagga

SEQ ID NO: 143481 - DNA, 25 bp, Mus musculus
tgagatccttggtgcagcttcggaa

SEQ ID NO: 143482 - DNA, 25 bp, Mus musculus
tgagatcgaggctaaactggacaag

SEQ ID NO: 143483 - DNA, 25 bp, Mus musculus
tgagatcgtggaccgcaagtacagc

SEQ ID NO: 143484 - DNA, 25 bp, Mus musculus
tgagatcttctaggcagctcccctg

SEQ ID NO: 143485 - DNA, 25 bp, Mus musculus
tgagatgaactacaagacccaagag

SEQ ID NO: 143486 - DNA, 25 bp, Mus musculus
tgagatgaactcaccaagcaggacc

SEQ ID NO: 143487 - DNA, 25 bp, Mus musculus
tgagatgaactcacggacgacagaa

SEQ ID NO: 143488 - DNA, 25 bp, Mus musculus
tgagatgaagattcccgggcagcaa

SEQ ID NO: 143489 - DNA, 25 bp, Mus musculus
tgagatgacaggctacgtggctacc

SEQ ID NO: 143490 - DNA, 25 bp, Mus musculus
tgagatgacccctcagctggaactg

SEQ ID NO: 143491 - DNA, 25 bp, Mus musculus
tgagatgaccctcaagaacccggag

SEQ ID NO: 143492 - DNA, 25 bp, Mus musculus
tgagatgaccctccggcacatggtc

SEQ ID NO: 143493 - DNA, 25 bp, Mus musculus
tgagatgcccaaactaacagagcag

SEQ ID NO: 143494 - DNA, 25 bp, Mus musculus
tgagatgctcaagtaccagcggaga

SEQ ID NO: 143495 - DNA, 25 bp, Mus musculus
tgagatgctcaagtctacggaccct

SEQ ID NO: 143496 - DNA, 25 bp, Mus musculus
tgagatgctgcttcggcgtctggca

SEQ ID NO: 143497 - DNA, 25 bp, Mus musculus
tgagatggacctcaacacagggcgc

SEQ ID NO: 143498 - DNA, 25 bp, Mus musculus
tgagatggactcagctcagggcgcc

SEQ ID NO: 143499 - DNA, 25 bp, Mus musculus
tgagatggccgtgtgtacgaacctg

SEQ ID NO: 143500 - DNA, 25 bp, Mus musculus
tgagatgtgccaggcccagtcttcc

SEQ ID NO: 143501 - DNA, 25 bp, Mus musculus
tgagatgtgctgtcgtgcaaggcct

SEQ ID NO: 143502 - DNA, 25 bp, Mus musculus
tgagatgtgtagcacccaaaggccc

SEQ ID NO: 143503 - DNA, 25 bp, Mus musculus
tgagattactatttgggctgcagag

SEQ ID NO: 143504 - DNA, 25 bp, Mus musculus
tgagattcaacagagcttccgagca

SEQ ID NO: 143505 - DNA, 25 bp, Mus musculus
tgagattcaccttcaccgagctctg

SEQ ID NO: 143506 - DNA, 25 bp, Mus musculus
tgagattccaaaagcgtctgagaag

SEQ ID NO: 143507 - DNA, 25 bp, Mus musculus
tgagattcgcagtaaactgccgcat

SEQ ID NO: 143508 - DNA, 25 bp, Mus musculus
tgagattgaccgcatgacgttgacg

SEQ ID NO: 143509 - DNA, 25 bp, Mus musculus
tgagattgcaccactcctgaaaatg

SEQ ID NO: 143510 - DNA, 25 bp, Mus musculus
tgagattgccgttgctggctgcccc

SEQ ID NO: 143511 - DNA, 25 bp, Mus musculus
tgagatttcaagaggctacagcctg

SEQ ID NO: 143512 - DNA, 25 bp, Mus musculus
tgagatttctgagctccggcgcacc

SEQ ID NO: 143513 - DNA, 25 bp, Mus musculus
tgagcaaaatcacagcccaagggca

SEQ ID NO: 143514 - DNA, 25 bp, Mus musculus
tgagcaaacactatggtgactggac

SEQ ID NO: 143515 - DNA, 25 bp, Mus musculus
tgagcaaagcagtccagggtagtct

SEQ ID NO: 143516 - DNA, 25 bp, Mus musculus
tgagcaaagggtattcctgtcagtc

SEQ ID NO: 143517 - DNA, 25 bp, Mus musculus
tgagcaaccatacccgggaaagagt

SEQ ID NO: 143518 - DNA, 25 bp, Mus musculus
tgagcaacctggtaggcaagccgtc

SEQ ID NO: 143519 - DNA, 25 bp, Mus musculus
tgagcaactcctcttggaactgcag

SEQ ID NO: 143520 - DNA, 25 bp, Mus musculus
tgagcaactgctccgattactctgg

SEQ ID NO: 143521 - DNA, 25 bp, Mus musculus
tgagcaactgtgtcctctggaggtg

SEQ ID NO: 143522 - DNA, 25 bp, Mus musculus
tgagcaacttagtccccagggagca

SEQ ID NO: 143523 - DNA, 25 bp, Mus musculus
tgagcaagaacccagacggctactg

SEQ ID NO: 143524 - DNA, 25 bp, Mus musculus
tgagcaagactgtggttaacatctc

SEQ ID NO: 143525 - DNA, 25 bp, Mus musculus
tgagcaagcaagcacgtaggcatcg

SEQ ID NO: 143526 - DNA, 25 bp, Mus musculus
tgagcaagcggagccaaaatgtccc

SEQ ID NO: 143527 - DNA, 25 bp, Mus musculus
tgagcaagcttctatgagagccgat

SEQ ID NO: 143528 - DNA, 25 bp, Mus musculus
tgagcaatctcaaagtggccaacta

SEQ ID NO: 143529 - DNA, 25 bp, Mus musculus
tgagcaatctggtgagggcctacgt

SEQ ID NO: 143530 - DNA, 25 bp, Mus musculus
tgagcaatgggcacgactactccaa

SEQ ID NO: 143531 - DNA, 25 bp, Mus musculus
tgagcacaatcacgtcagctggccg

SEQ ID NO: 143532 - DNA, 25 bp, Mus musculus
tgagcacatggagatgcggcagaac

SEQ ID NO: 143533 - DNA, 25 bp, Mus musculus
tgagcaccacatcagaaaccatgag

SEQ ID NO: 143534 - DNA, 25 bp, Mus musculus
tgagcaccagatggcgaagacaggc

SEQ ID NO: 143535 - DNA, 25 bp, Mus musculus
tgagcaccgagcagggcgcagcact

SEQ ID NO: 143536 - DNA, 25 bp, Mus musculus
tgagcaccgaggatgcgcttctgca

SEQ ID NO: 143537 - DNA, 25 bp, Mus musculus
tgagcacgctgggagacctttcctc

SEQ ID NO: 143538 - DNA, 25 bp, Mus musculus
tgagcacgggaggaattgaaacact

SEQ ID NO: 143539 - DNA, 25 bp, Mus musculus
tgagcactaaactggcctgtgggcc

SEQ ID NO: 143540 - DNA, 25 bp, Mus musculus
tgagcactattacccatcagctgag

SEQ ID NO: 143541 - DNA, 25 bp, Mus musculus
tgagcactctaattagcaagctggg

SEQ ID NO: 143542 - DNA, 25 bp, Mus musculus
tgagcactctgtgaactacaagcct

SEQ ID NO: 143543 - DNA, 25 bp, Mus musculus
tgagcactttgacttcaacctgcac

SEQ ID NO: 143544 - DNA, 25 bp, Mus musculus
tgagcagaacaaggaacaagcctcc

SEQ ID NO: 143545 - DNA, 25 bp, Mus musculus
tgagcagagaaaccagtgtccttga

SEQ ID NO: 143546 - DNA, 25 bp, Mus musculus
tgagcagagcatccttcacggtagc

SEQ ID NO: 143547 - DNA, 25 bp, Mus musculus
tgagcagagcgctgtctacagtcca

SEQ ID NO: 143548 - DNA, 25 bp, Mus musculus
tgagcagatccaggacaacgtgcgg

SEQ ID NO: 143549 - DNA, 25 bp, Mus musculus
tgagcagcagcggtgttttcagaca

SEQ ID NO: 143550 - DNA, 25 bp, Mus musculus
tgagcagcaggattgtccaggacct

SEQ ID NO: 143551 - DNA, 25 bp, Mus musculus
tgagcagcagttcccatggaggctt

SEQ ID NO: 143552 - DNA, 25 bp, Mus musculus
tgagcagcatccatccagaatgtcg

SEQ ID NO: 143553 - DNA, 25 bp, Mus musculus
tgagcagcattttgtccggcagagg

SEQ ID NO: 143554 - DNA, 25 bp, Mus musculus
tgagcagcccatgcaactgtattta

SEQ ID NO: 143555 - DNA, 25 bp, Mus musculus
tgagcagcccatgtctgaacggagg

SEQ ID NO: 143556 - DNA, 25 bp, Mus musculus
tgagcagcctgcctgagatcgacaa

SEQ ID NO: 143557 - DNA, 25 bp, Mus musculus
tgagcagcctgtacagagacgcgtg

SEQ ID NO: 143558 - DNA, 25 bp, Mus musculus
tgagcagctcaacaaacagcagagg

SEQ ID NO: 143559 - DNA, 25 bp, Mus musculus
tgagcagcttgcaccatctgtggcg

SEQ ID NO: 143560 - DNA, 25 bp, Mus musculus
tgagcaggaggacactcagaagaaa

SEQ ID NO: 143561 - DNA, 25 bp, Mus musculus
tgagcaggcccaggctgttgccact

SEQ ID NO: 143562 - DNA, 25 bp, Mus musculus
tgagcaggcgccagtatgcagagca

SEQ ID NO: 143563 - DNA, 25 bp, Mus musculus
tgagcagtatccttcctgcggcggg

SEQ ID NO: 143564 - DNA, 25 bp, Mus musculus
tgagcagtcgttctacacaaagcct

SEQ ID NO: 143565 - DNA, 25 bp, Mus musculus
tgagcagtcttatctcaggccggcc

SEQ ID NO: 143566 - DNA, 25 bp, Mus musculus
tgagcagtgcggagaatatttgccc

SEQ ID NO: 143567 - DNA, 25 bp, Mus musculus
tgagcagtgtccctaacccattgat

SEQ ID NO: 143568 - DNA, 25 bp, Mus musculus
tgagcagttggcaggttattcccgt

SEQ ID NO: 143569 - DNA, 25 bp, Mus musculus
tgagcatacagcaagaccacagttt

SEQ ID NO: 143570 - DNA, 25 bp, Mus musculus
tgagcatagcagtcacctaggatga

SEQ ID NO: 143571 - DNA, 25 bp, Mus musculus
tgagcatatagaccaggacctgagg

SEQ ID NO: 143572 - DNA, 25 bp, Mus musculus
tgagcatatgctcttccctggcccg

SEQ ID NO: 143573 - DNA, 25 bp, Mus musculus
tgagcatatttctccacaagtcaca

SEQ ID NO: 143574 - DNA, 25 bp, Mus musculus
tgagcatcatccaccgcaagttcag

SEQ ID NO: 143575 - DNA, 25 bp, Mus musculus
tgagcatccgatctgacaggtccgt

SEQ ID NO: 143576 - DNA, 25 bp, Mus musculus
tgagcatcgtatgtcctgcccggag

SEQ ID NO: 143577 - DNA, 25 bp, Mus musculus
tgagcatctccttcgtatacatctt

SEQ ID NO: 143578 - DNA, 25 bp, Mus musculus
tgagcatctctcaagggtcccagga

SEQ ID NO: 143579 - DNA, 25 bp, Mus musculus
tgagcatctgggacaagcgagcatt

SEQ ID NO: 143580 - DNA, 25 bp, Mus musculus
tgagcatcttctttggcccatgtac

SEQ ID NO: 143581 - DNA, 25 bp, Mus musculus
tgagcatgaactgcaaccactggaa

SEQ ID NO: 143582 - DNA, 25 bp, Mus musculus
tgagcatggagtatggcctaacccg

SEQ ID NO: 143583 - DNA, 25 bp, Mus musculus
tgagcatggctcttacaggtacacg

SEQ ID NO: 143584 - DNA, 25 bp, Mus musculus
tgagcatgtaactgagccaggagcc

SEQ ID NO: 143585 - DNA, 25 bp, Mus musculus
tgagcatgtcacctgagaacagcgg

SEQ ID NO: 143586 - DNA, 25 bp, Mus musculus
tgagcattgaagagtacacccagat

SEQ ID NO: 143587 - DNA, 25 bp, Mus musculus
tgagcattgtgacacccaggatccc

SEQ ID NO: 143588 - DNA, 25 bp, Mus musculus
tgagccaaaagccacaattagccgg

SEQ ID NO: 143589 - DNA, 25 bp, Mus musculus
tgagccaactcctgcgcgtgctagc

SEQ ID NO: 143590 - DNA, 25 bp, Mus musculus
tgagccaagtgcagaccaatgtgtc

SEQ ID NO: 143591 - DNA, 25 bp, Mus musculus
tgagccaatagcaagagtccgacag

SEQ ID NO: 143592 - DNA, 25 bp, Mus musculus
tgagccaatccgtaagaggacccgt

SEQ ID NO: 143593 - DNA, 25 bp, Mus musculus
tgagccacaccgcaccggagatctt

SEQ ID NO: 143594 - DNA, 25 bp, Mus musculus
tgagccaccagaagtccaaatgctg

SEQ ID NO: 143595 - DNA, 25 bp, Mus musculus
tgagccacctgaagcagtacgagcg

SEQ ID NO: 143596 - DNA, 25 bp, Mus musculus
tgagccacgacgcttctccatgttg

SEQ ID NO: 143597 - DNA, 25 bp, Mus musculus
tgagccagactgtgggtcacttaga

SEQ ID NO: 143598 - DNA, 25 bp, Mus musculus
tgagccagcgcaattcatttcgagg

SEQ ID NO: 143599 - DNA, 25 bp, Mus musculus
tgagccagctgtatgcccggaaagt

SEQ ID NO: 143600 - DNA, 25 bp, Mus musculus
tgagccaggacaccgaagtggacat

SEQ ID NO: 143601 - DNA, 25 bp, Mus musculus
tgagccaggctttcaaaaggaccca

SEQ ID NO: 143602 - DNA, 25 bp, Mus musculus
tgagccaggtccacatagatgcagc

SEQ ID NO: 143603 - DNA, 25 bp, Mus musculus
tgagccagtggatcaagggcaccgt

SEQ ID NO: 143604 - DNA, 25 bp, Mus musculus
tgagccagtgtgtaagtgagcagcc

SEQ ID NO: 143605 - DNA, 25 bp, Mus musculus
tgagccagttataaatgcccttttg

SEQ ID NO: 143606 - DNA, 25 bp, Mus musculus
tgagccatcccacatctggagcaga

SEQ ID NO: 143607 - DNA, 25 bp, Mus musculus
tgagccatcgccgtgaactgtgaac

SEQ ID NO: 143608 - DNA, 25 bp, Mus musculus
tgagccatcgctctggagaaacgga

SEQ ID NO: 143609 - DNA, 25 bp, Mus musculus
tgagccatctcaagagtctggacct

SEQ ID NO: 143610 - DNA, 25 bp, Mus musculus
tgagccatggctacagcaaactgcg

SEQ ID NO: 143611 - DNA, 25 bp, Mus musculus
tgagcccaataagctgacagtccgg

SEQ ID NO: 143612 - DNA, 25 bp, Mus musculus
tgagcccaggaagtgtgtcccgtct

SEQ ID NO: 143613 - DNA, 25 bp, Mus musculus
tgagcccagggaaatctcgagacct

SEQ ID NO: 143614 - DNA, 25 bp, Mus musculus
tgagcccatccaagctaggagacga

SEQ ID NO: 143615 - DNA, 25 bp, Mus musculus
tgagccccaataaccatgaggtgca

SEQ ID NO: 143616 - DNA, 25 bp, Mus musculus
tgagccccacgtgatggtggaacat

SEQ ID NO: 143617 - DNA, 25 bp, Mus musculus
tgagccccaggtgtgaccccaggga

SEQ ID NO: 143618 - DNA, 25 bp, Mus musculus
tgagccccgtgcatccggcagcgag

SEQ ID NO: 143619 - DNA, 25 bp, Mus musculus
tgagcccctcactttctgcgggtgg

SEQ ID NO: 143620 - DNA, 25 bp, Mus musculus
tgagcccctcagtgccatacttctg

SEQ ID NO: 143621 - DNA, 25 bp, Mus musculus
tgagccccttgaacctgaacagcat

SEQ ID NO: 143622 - DNA, 25 bp, Mus musculus
tgagcccgacctttgtaaaaccgtg

SEQ ID NO: 143623 - DNA, 25 bp, Mus musculus
tgagccctcactcggtaggactgga

SEQ ID NO: 143624 - DNA, 25 bp, Mus musculus
tgagccctccttatactgtaccagc

SEQ ID NO: 143625 - DNA, 25 bp, Mus musculus
tgagccctctcacatactagaaggt

SEQ ID NO: 143626 - DNA, 25 bp, Mus musculus
tgagccctgcggacatcaactatga

SEQ ID NO: 143627 - DNA, 25 bp, Mus musculus
tgagccctggctatatccgacaggg

SEQ ID NO: 143628 - DNA, 25 bp, Mus musculus
tgagccctgtaagaagcggttgacc

SEQ ID NO: 143629 - DNA, 25 bp, Mus musculus
tgagccctgtggagttgaggcacct

SEQ ID NO: 143630 - DNA, 25 bp, Mus musculus
tgagccctgttaagtccccagttac

SEQ ID NO: 143631 - DNA, 25 bp, Mus musculus
tgagcccttcattctgagctgtagg

SEQ ID NO: 143632 - DNA, 25 bp, Mus musculus
tgagcccttgtctccctacatcagg

SEQ ID NO: 143633 - DNA, 25 bp, Mus musculus
tgagcccttttatatcccagacaaa

SEQ ID NO: 143634 - DNA, 25 bp, Mus musculus
tgagccgagaattgccaggacacac

SEQ ID NO: 143635 - DNA, 25 bp, Mus musculus
tgagccgcagcaccagaatctggat

SEQ ID NO: 143636 - DNA, 25 bp, Mus musculus
tgagccgccgcctcgatgagttaga

SEQ ID NO: 143637 - DNA, 25 bp, Mus musculus
tgagccgcgcatctacatcagtgac

SEQ ID NO: 143638 - DNA, 25 bp, Mus musculus
tgagccggaaaggaagcacgtcttc

SEQ ID NO: 143639 - DNA, 25 bp, Mus musculus
tgagccggcatgtcctgattcacac

SEQ ID NO: 143640 - DNA, 25 bp, Mus musculus
tgagccggggagacatccctatcat

SEQ ID NO: 143641 - DNA, 25 bp, Mus musculus
tgagccgtagaggaagagtattgcc

SEQ ID NO: 143642 - DNA, 25 bp, Mus musculus
tgagccgtagtcactgctggccgct

SEQ ID NO: 143643 - DNA, 25 bp, Mus musculus
tgagccgtggcctaataaacgtgga

SEQ ID NO: 143644 - DNA, 25 bp, Mus musculus
tgagccgtttaagatcccagaagac

SEQ ID NO: 143645 - DNA, 25 bp, Mus musculus
tgagcctcaccctatgggccattag

SEQ ID NO: 143646 - DNA, 25 bp, Mus musculus
tgagcctccctgagttgtcaggagc

SEQ ID NO: 143647 - DNA, 25 bp, Mus musculus
tgagcctccgaaattataaaccagc

SEQ ID NO: 143648 - DNA, 25 bp, Mus musculus
tgagcctctgctatatcaccgtgag

SEQ ID NO: 143649 - DNA, 25 bp, Mus musculus
tgagcctgaaagacagcaactggca

SEQ ID NO: 143650 - DNA, 25 bp, Mus musculus
tgagcctgaaggtcctggagtccac

SEQ ID NO: 143651 - DNA, 25 bp, Mus musculus
tgagcctgctgaagccacagtgaat

SEQ ID NO: 143652 - DNA, 25 bp, Mus musculus
tgagcctggctcacaaatacggatt

SEQ ID NO: 143653 - DNA, 25 bp, Mus musculus
tgagcctggctcctatgacgtgatc

SEQ ID NO: 143654 - DNA, 25 bp, Mus musculus
tgagcctgggcaccacagatatagc

SEQ ID NO: 143655 - DNA, 25 bp, Mus musculus
tgagcctgtgtgaccattagtgcgg

SEQ ID NO: 143656 - DNA, 25 bp, Mus musculus
tgagccttatcccagatgaccgaag

SEQ ID NO: 143657 - DNA, 25 bp, Mus musculus
tgagccttcagtcaatacaggccgt

SEQ ID NO: 143658 - DNA, 25 bp, Mus musculus
tgagccttctgtagccaagaggacc

SEQ ID NO: 143659 - DNA, 25 bp, Mus musculus
tgagccttgcacctccagtgaggag

SEQ ID NO: 143660 - DNA, 25 bp, Mus musculus
tgagccttgtttcgcctcttgaccg

SEQ ID NO: 143661 - DNA, 25 bp, Mus musculus
tgagcgaaagcaccaccctcgagct

SEQ ID NO: 143662 - DNA, 25 bp, Mus musculus
tgagcgaagacctcgaagtggactg

SEQ ID NO: 143663 - DNA, 25 bp, Mus musculus
tgagcgacgaacttccatggcagaa

SEQ ID NO: 143664 - DNA, 25 bp, Mus musculus
tgagcgacgccgagcagaaatacta

SEQ ID NO: 143665 - DNA, 25 bp, Mus musculus
tgagcgagccttgcgagcgcgccta

SEQ ID NO: 143666 - DNA, 25 bp, Mus musculus
tgagcgagctctatcatcctgatga

SEQ ID NO: 143667 - DNA, 25 bp, Mus musculus
tgagcgagtgaaaaactgagccccg

SEQ ID NO: 143668 - DNA, 25 bp, Mus musculus
tgagcgcaagtttcaccagaagcaa

SEQ ID NO: 143669 - DNA, 25 bp, Mus musculus
tgagcgcactcttccctgctgggaa

SEQ ID NO: 143670 - DNA, 25 bp, Mus musculus
tgagcgcagccgagcgtgccaagaa

SEQ ID NO: 143671 - DNA, 25 bp, Mus musculus
tgagcgcaggcatagcactgggcat

SEQ ID NO: 143672 - DNA, 25 bp, Mus musculus
tgagcgcatgctggtggaacctgcc

SEQ ID NO: 143673 - DNA, 25 bp, Mus musculus
tgagcgcccagagcgctggcaaatc

SEQ ID NO: 143674 - DNA, 25 bp, Mus musculus
tgagcgccctgcgtgaagaacacag

SEQ ID NO: 143675 - DNA, 25 bp, Mus musculus
tgagcgccgagggatcgcagtccct

SEQ ID NO: 143676 - DNA, 25 bp, Mus musculus
tgagcgcggcttcagaattatccca

SEQ ID NO: 143677 - DNA, 25 bp, Mus musculus
tgagcgcgtcactagctcggaagcc

SEQ ID NO: 143678 - DNA, 25 bp, Mus musculus
tgagcgctacgactactttgcccag

SEQ ID NO: 143679 - DNA, 25 bp, Mus musculus
tgagcgctacgtcctgtacatggtg

SEQ ID NO: 143680 - DNA, 25 bp, Mus musculus
tgagcgctgcaagaagaacaacggc

SEQ ID NO: 143681 - DNA, 25 bp, Mus musculus
tgagcgcttcaatgagaccatcggc

SEQ ID NO: 143682 - DNA, 25 bp, Mus musculus
tgagcgcttggataaaagagtggat

SEQ ID NO: 143683 - DNA, 25 bp, Mus musculus
tgagcggacgcatctcaaccctgaa

SEQ ID NO: 143684 - DNA, 25 bp, Mus musculus
tgagcggagagcagccatctatgac

SEQ ID NO: 143685 - DNA, 25 bp, Mus musculus
tgagcggccactctaattttgtgtc

SEQ ID NO: 143686 - DNA, 25 bp, Mus musculus
tgagcggccactgcagttaactcct

SEQ ID NO: 143687 - DNA, 25 bp, Mus musculus
tgagcgggaactgaagcctttactg

SEQ ID NO: 143688 - DNA, 25 bp, Mus musculus
tgagcggtgctaaagtgaatgcccc

SEQ ID NO: 143689 - DNA, 25 bp, Mus musculus
tgagcggtgtccgagacctgtctca

SEQ ID NO: 143690 - DNA, 25 bp, Mus musculus
tgagcgtcaaaattatccgaaaccg

SEQ ID NO: 143691 - DNA, 25 bp, Mus musculus
tgagcgtcatgcttcgggctctcgg

SEQ ID NO: 143692 - DNA, 25 bp, Mus musculus
tgagcgtgaggaatggcgacctttt

SEQ ID NO: 143693 - DNA, 25 bp, Mus musculus
tgagcgtggaggaacaacatcttgg

SEQ ID NO: 143694 - DNA, 25 bp, Mus musculus
tgagctaaaagggtacagacttcct

SEQ ID NO: 143695 - DNA, 25 bp, Mus musculus
tgagctaacgcacaacttcaagggc

SEQ ID NO: 143696 - DNA, 25 bp, Mus musculus
tgagctaatctatcagcggcatgtc

SEQ ID NO: 143697 - DNA, 25 bp, Mus musculus
tgagctaatgttcacagggcctgtg

SEQ ID NO: 143698 - DNA, 25 bp, Mus musculus
tgagctacaaactaccaatggagga

SEQ ID NO: 143699 - DNA, 25 bp, Mus musculus
tgagctaccagaacaccatatccag

SEQ ID NO: 143700 - DNA, 25 bp, Mus musculus
tgagctactatgaaaacgaacgggc

SEQ ID NO: 143701 - DNA, 25 bp, Mus musculus
tgagctagatgaagcaagcccacgg

SEQ ID NO: 143702 - DNA, 25 bp, Mus musculus
tgagctatgaagttccggaatttgt

SEQ ID NO: 143703 - DNA, 25 bp, Mus musculus
tgagctatgccctcgaaactgtgct

SEQ ID NO: 143704 - DNA, 25 bp, Mus musculus
tgagctcaagacagtcgcaatgaag

SEQ ID NO: 143705 - DNA, 25 bp, Mus musculus
tgagctcaaggacgaagacaaggac

SEQ ID NO: 143706 - DNA, 25 bp, Mus musculus
tgagctcaagggaacagccacggtt

SEQ ID NO: 143707 - DNA, 25 bp, Mus musculus
tgagctcaccgtgcatctggaaggc

SEQ ID NO: 143708 - DNA, 25 bp, Mus musculus
tgagctcactacacaaagggcctgg

SEQ ID NO: 143709 - DNA, 25 bp, Mus musculus
tgagctcagagatgcagtcttgttg

SEQ ID NO: 143710 - DNA, 25 bp, Mus musculus
tgagctcagatttggcggcaagtcc

SEQ ID NO: 143711 - DNA, 25 bp, Mus musculus
tgagctcagcacttaacctagatgg

SEQ ID NO: 143712 - DNA, 25 bp, Mus musculus
tgagctcagcccagtgtccggtgtt

SEQ ID NO: 143713 - DNA, 25 bp, Mus musculus
tgagctcatccctgacagtgcagag

SEQ ID NO: 143714 - DNA, 25 bp, Mus musculus
tgagctcatgatctactgcctggaa

SEQ ID NO: 143715 - DNA, 25 bp, Mus musculus
tgagctccagtcacgcagaacttgt

SEQ ID NO: 143716 - DNA, 25 bp, Mus musculus
tgagctcccttcagaaatcgagaga

SEQ ID NO: 143717 - DNA, 25 bp, Mus musculus
tgagctccgagtccactcgcaaggc

SEQ ID NO: 143718 - DNA, 25 bp, Mus musculus
tgagctcctagaggacttccgtcgg

SEQ ID NO: 143719 - DNA, 25 bp, Mus musculus
tgagctctaacaaaagccgcgacag

SEQ ID NO: 143720 - DNA, 25 bp, Mus musculus
tgagctctgctcgtcttagcgttgg

SEQ ID NO: 143721 - DNA, 25 bp, Mus musculus
tgagctctgtggtgtggccgaccac

SEQ ID NO: 143722 - DNA, 25 bp, Mus musculus
tgagctcttcgtgctgaacgcggcg

SEQ ID NO: 143723 - DNA, 25 bp, Mus musculus
tgagctgaaattccacccacgagac

SEQ ID NO: 143724 - DNA, 25 bp, Mus musculus
tgagctgaacatcaagcgccgctcc

SEQ ID NO: 143725 - DNA, 25 bp, Mus musculus
tgagctgacacgtgaggagaccttc

SEQ ID NO: 143726 - DNA, 25 bp, Mus musculus
tgagctgacggctgagaaaatcaca

SEQ ID NO: 143727 - DNA, 25 bp, Mus musculus
tgagctgagacctggcctcattggc

SEQ ID NO: 143728 - DNA, 25 bp, Mus musculus
tgagctgatgtctgtcctgtaccca

SEQ ID NO: 143729 - DNA, 25 bp, Mus musculus
tgagctgcaagaggacagactgcgt

SEQ ID NO: 143730 - DNA, 25 bp, Mus musculus
tgagctgcacatgcctcgggaatgg

SEQ ID NO: 143731 - DNA, 25 bp, Mus musculus
tgagctgcaggtcccatctggatga

SEQ ID NO: 143732 - DNA, 25 bp, Mus musculus
tgagctgccaatcctacatggtggg

SEQ ID NO: 143733 - DNA, 25 bp, Mus musculus
tgagctgccgtctctggataaaccg

SEQ ID NO: 143734 - DNA, 25 bp, Mus musculus
tgagctgcgcattcatgacctggag

SEQ ID NO: 143735 - DNA, 25 bp, Mus musculus
tgagctggaaaaacggactagtcct

SEQ ID NO: 143736 - DNA, 25 bp, Mus musculus
tgagctggaccctttaacactggcc

SEQ ID NO: 143737 - DNA, 25 bp, Mus musculus
tgagctggacgagttcctcctggag

SEQ ID NO: 143738 - DNA, 25 bp, Mus musculus
tgagctggagcactcggccataaag

SEQ ID NO: 143739 - DNA, 25 bp, Mus musculus
tgagctggccatcctgtcaaatgag

SEQ ID NO: 143740 - DNA, 25 bp, Mus musculus
tgagctggcccgactcaaggttcat

SEQ ID NO: 143741 - DNA, 25 bp, Mus musculus
tgagctggctggtcataccctgaat

SEQ ID NO: 143742 - DNA, 25 bp, Mus musculus
tgagctgggactcgaaacacgattg

SEQ ID NO: 143743 - DNA, 25 bp, Mus musculus
tgagctgggagctacactggccctt

SEQ ID NO: 143744 - DNA, 25 bp, Mus musculus
tgagctggtgcgtctccatgacgac

SEQ ID NO: 143745 - DNA, 25 bp, Mus musculus
tgagctgtcagaaagcgcctttggc

SEQ ID NO: 143746 - DNA, 25 bp, Mus musculus
tgagctgtcctttcccgagggagca

SEQ ID NO: 143747 - DNA, 25 bp, Mus musculus
tgagctgtgaggtcatcgggatccc

SEQ ID NO: 143748 - DNA, 25 bp, Mus musculus
tgagctgtgccacggctattgccaa

SEQ ID NO: 143749 - DNA, 25 bp, Mus musculus
tgagcttacccatgaggacctgaaa

SEQ ID NO: 143750 - DNA, 25 bp, Mus musculus
tgagcttacctctctgtccaccgga

SEQ ID NO: 143751 - DNA, 25 bp, Mus musculus
tgagcttcatcaagggcggcatcaa

SEQ ID NO: 143752 - DNA, 25 bp, Mus musculus
tgagcttcatccaggctccgcttgc

SEQ ID NO: 143753 - DNA, 25 bp, Mus musculus
tgagcttcgtgtgccagcgctgtag

SEQ ID NO: 143754 - DNA, 25 bp, Mus musculus
tgagcttgctgctggcagcatggaa

SEQ ID NO: 143755 - DNA, 25 bp, Mus musculus
tgagcttggccctggcttggaaccg

SEQ ID NO: 143756 - DNA, 25 bp, Mus musculus
tgagcttggccttcagggtgccctt

SEQ ID NO: 143757 - DNA, 25 bp, Mus musculus
tgagcttggctatgctaaggagtcc

SEQ ID NO: 143758 - DNA, 25 bp, Mus musculus
tgagctttaccctgaccatggatgg

SEQ ID NO: 143759 - DNA, 25 bp, Mus musculus
tgagctttgaacatctccggcggat

SEQ ID NO: 143760 - DNA, 25 bp, Mus musculus
tgagctttgaattatgccaccatgc

SEQ ID NO: 143761 - DNA, 25 bp, Mus musculus
tgagctttgcttcgtttcctgaaga

SEQ ID NO: 143762 - DNA, 25 bp, Mus musculus
tgaggaaaacgatccagactatgac

SEQ ID NO: 143763 - DNA, 25 bp, Mus musculus
tgaggaaaagagataccccagctgc

SEQ ID NO: 143764 - DNA, 25 bp, Mus musculus
tgaggaaaatctagagccctggcct

SEQ ID NO: 143765 - DNA, 25 bp, Mus musculus
tgaggaaacaaccacacatacgacc

SEQ ID NO: 143766 - DNA, 25 bp, Mus musculus
tgaggaaaccccacattgaggaatc

SEQ ID NO: 143767 - DNA, 25 bp, Mus musculus
tgaggaaatcgcatcagtagccgac

SEQ ID NO: 143768 - DNA, 25 bp, Mus musculus
tgaggaacacttagcaccagagaca

SEQ ID NO: 143769 - DNA, 25 bp, Mus musculus
tgaggaacattctccgggaaggaca

SEQ ID NO: 143770 - DNA, 25 bp, Mus musculus
tgaggaaccattaaccaccaaatta

SEQ ID NO: 143771 - DNA, 25 bp, Mus musculus
tgaggaacccgcacccagcaaaaat

SEQ ID NO: 143772 - DNA, 25 bp, Mus musculus
tgaggaacctgcagaaaaagccgat

SEQ ID NO: 143773 - DNA, 25 bp, Mus musculus
tgaggaaccttacttctgccagtgg

SEQ ID NO: 143774 - DNA, 25 bp, Mus musculus
tgaggaacgccatgactcaagaggc

SEQ ID NO: 143775 - DNA, 25 bp, Mus musculus
tgaggaactccagcactccatgggt

SEQ ID NO: 143776 - DNA, 25 bp, Mus musculus
tgaggaagaactgaagccacagccc

SEQ ID NO: 143777 - DNA, 25 bp, Mus musculus
tgaggaagagccacattacaggacc

SEQ ID NO: 143778 - DNA, 25 bp, Mus musculus
tgaggaagccaagatacatccggcg

SEQ ID NO: 143779 - DNA, 25 bp, Mus musculus
tgaggaagcggttacggctgtacag

SEQ ID NO: 143780 - DNA, 25 bp, Mus musculus
tgaggaagctccaccgcagatggaa

SEQ ID NO: 143781 - DNA, 25 bp, Mus musculus
tgaggaaggtcgaacagaagattgc

SEQ ID NO: 143782 - DNA, 25 bp, Mus musculus
tgaggaagtgtttcacgtggaaccc

SEQ ID NO: 143783 - DNA, 25 bp, Mus musculus
tgaggaatctgaacgccatagtgca

SEQ ID NO: 143784 - DNA, 25 bp, Mus musculus
tgaggaatgctaaggacacggccca

SEQ ID NO: 143785 - DNA, 25 bp, Mus musculus
tgaggacaaacttcagaacacagcc

SEQ ID NO: 143786 - DNA, 25 bp, Mus musculus
tgaggacaactacaccctggtcaag

SEQ ID NO: 143787 - DNA, 25 bp, Mus musculus
tgaggacacgaatctggcttccagc

SEQ ID NO: 143788 - DNA, 25 bp, Mus musculus
tgaggacaggtcaccaactgagcag

SEQ ID NO: 143789 - DNA, 25 bp, Mus musculus
tgaggacataggaccctgcacagct

SEQ ID NO: 143790 - DNA, 25 bp, Mus musculus
tgaggacatccacacatggcagagt

SEQ ID NO: 143791 - DNA, 25 bp, Mus musculus
tgaggaccaagagccgaaggtgatc

SEQ ID NO: 143792 - DNA, 25 bp, Mus musculus
tgaggaccatgaagctcgtcagcac

SEQ ID NO: 143793 - DNA, 25 bp, Mus musculus
tgaggaccccagtgtatcttttggc

SEQ ID NO: 143794 - DNA, 25 bp, Mus musculus
tgaggaccccgagactgaggtaaaa

SEQ ID NO: 143795 - DNA, 25 bp, Mus musculus
tgaggacccgaagttccgagaggct

SEQ ID NO: 143796 - DNA, 25 bp, Mus musculus
tgaggacccgaatgccaagctggtt

SEQ ID NO: 143797 - DNA, 25 bp, Mus musculus
tgaggacctcctgaactggaataac

SEQ ID NO: 143798 - DNA, 25 bp, Mus musculus
tgaggacgacaacgacatcatggaa

SEQ ID NO: 143799 - DNA, 25 bp, Mus musculus
tgaggacgcagacattccaaagggc

SEQ ID NO: 143800 - DNA, 25 bp, Mus musculus
tgaggacggcaacaaccagtggcct

SEQ ID NO: 143801 - DNA, 25 bp, Mus musculus
tgaggacgtcccaattgcacacatt

SEQ ID NO: 143802 - DNA, 25 bp, Mus musculus
tgaggactacaatgctgcagtggtc

SEQ ID NO: 143803 - DNA, 25 bp, Mus musculus
tgaggactatctgtaccgcgaggag

SEQ ID NO: 143804 - DNA, 25 bp, Mus musculus
tgaggactcctgattgaaaagccac

SEQ ID NO: 143805 - DNA, 25 bp, Mus musculus
tgaggactcctttgacaacctcggg

SEQ ID NO: 143806 - DNA, 25 bp, Mus musculus
tgaggacttccatgcacgacgggag

SEQ ID NO: 143807 - DNA, 25 bp, Mus musculus
tgaggacttttttacaccccagcag

SEQ ID NO: 143808 - DNA, 25 bp, Mus musculus
tgaggagaaccttagcgccatgctg

SEQ ID NO: 143809 - DNA, 25 bp, Mus musculus
tgaggagacattcgaccatactgcc

SEQ ID NO: 143810 - DNA, 25 bp, Mus musculus
tgaggagaccccagtcctggagtag

SEQ ID NO: 143811 - DNA, 25 bp, Mus musculus
tgaggagacctctcgtgaagccgag

SEQ ID NO: 143812 - DNA, 25 bp, Mus musculus
tgaggagaccttgctactttgggag

SEQ ID NO: 143813 - DNA, 25 bp, Mus musculus
tgaggagcaccagatctcacttctc

SEQ ID NO: 143814 - DNA, 25 bp, Mus musculus
tgaggagccctactgcaatgtggcc

SEQ ID NO: 143815 - DNA, 25 bp, Mus musculus
tgaggagccctgatgaacccagaac

SEQ ID NO: 143816 - DNA, 25 bp, Mus musculus
tgaggagccggcagctcttccagtc

SEQ ID NO: 143817 - DNA, 25 bp, Mus musculus
tgaggagctcaatctggaaggcaac

SEQ ID NO: 143818 - DNA, 25 bp, Mus musculus
tgaggagctgcctacacttgtcagt

SEQ ID NO: 143819 - DNA, 25 bp, Mus musculus
tgaggagcttcaacagagacaggcg

SEQ ID NO: 143820 - DNA, 25 bp, Mus musculus
tgaggaggcctatcgctgcaacttc

SEQ ID NO: 143821 - DNA, 25 bp, Mus musculus
tgaggaggctctgtggatcaccagc

SEQ ID NO: 143822 - DNA, 25 bp, Mus musculus
tgaggaggtcacagcctggctacaa

SEQ ID NO: 143823 - DNA, 25 bp, Mus musculus
tgaggaggttcatccagagggtcca

SEQ ID NO: 143824 - DNA, 25 bp, Mus musculus
tgaggagtcaacaactgaagcctgt

SEQ ID NO: 143825 - DNA, 25 bp, Mus musculus
tgaggagtgcgtcctacagcgcaac

SEQ ID NO: 143826 - DNA, 25 bp, Mus musculus
tgaggagttcttcatcccgtacgtc

SEQ ID NO: 143827 - DNA, 25 bp, Mus musculus
tgaggataaacagccagagcagcag

SEQ ID NO: 143828 - DNA, 25 bp, Mus musculus
tgaggataacccaagcagcaaaatg

SEQ ID NO: 143829 - DNA, 25 bp, Mus musculus
tgaggataccttgggcatcagctcc

SEQ ID NO: 143830 - DNA, 25 bp, Mus musculus
tgaggataggacactgaggccagca

SEQ ID NO: 143831 - DNA, 25 bp, Mus musculus
tgaggatatcaagccgccactaggc

SEQ ID NO: 143832 - DNA, 25 bp, Mus musculus
tgaggatcaggctgttgagacccgc

SEQ ID NO: 143833 - DNA, 25 bp, Mus musculus
tgaggatcatccacgggtcgggcta

SEQ ID NO: 143834 - DNA, 25 bp, Mus musculus
tgaggatcctaaccaggctaagctg

SEQ ID NO: 143835 - DNA, 25 bp, Mus musculus
tgaggatcctggctaacaagacaag

SEQ ID NO: 143836 - DNA, 25 bp, Mus musculus
tgaggatctagagctacccagcact

SEQ ID NO: 143837 - DNA, 25 bp, Mus musculus
tgaggatgaagctaccagcagtggc

SEQ ID NO: 143838 - DNA, 25 bp, Mus musculus
tgaggatgagcatgaggcaggccgt

SEQ ID NO: 143839 - DNA, 25 bp, Mus musculus
tgaggatgccactacacagctgaag

SEQ ID NO: 143840 - DNA, 25 bp, Mus musculus
tgaggatggccttccaatggacacc

SEQ ID NO: 143841 - DNA, 25 bp, Mus musculus
tgaggatggcgtctacttcagctcc

SEQ ID NO: 143842 - DNA, 25 bp, Mus musculus
tgaggattaaccgtgcagccacttt

SEQ ID NO: 143843 - DNA, 25 bp, Mus musculus
tgaggattccacagggtgaccgagc

SEQ ID NO: 143844 - DNA, 25 bp, Mus musculus
tgaggcaaattatgtgaagagagcg

SEQ ID NO: 143845 - DNA, 25 bp, Mus musculus
tgaggcaacgactagggctgcagct

SEQ ID NO: 143846 - DNA, 25 bp, Mus musculus
tgaggcacagcaactgagcaaggag

SEQ ID NO: 143847 - DNA, 25 bp, Mus musculus
tgaggcacccgtgaccaatggaaac

SEQ ID NO: 143848 - DNA, 25 bp, Mus musculus
tgaggcagctcctgatcacaaggtg

SEQ ID NO: 143849 - DNA, 25 bp, Mus musculus
tgaggcagttttacagagaaccagc

SEQ ID NO: 143850 - DNA, 25 bp, Mus musculus
tgaggccaaaataggagcacatggg

SEQ ID NO: 143851 - DNA, 25 bp, Mus musculus
tgaggccaacgacctgtttgaaaac

SEQ ID NO: 143852 - DNA, 25 bp, Mus musculus
tgaggccagaggtcaacactggaca

SEQ ID NO: 143853 - DNA, 25 bp, Mus musculus
tgaggccatcatagatccagactcg

SEQ ID NO: 143854 - DNA, 25 bp, Mus musculus
tgaggcccacgagaacagctttgtt

SEQ ID NO: 143855 - DNA, 25 bp, Mus musculus
tgaggcccagaatgcactgcacaat

SEQ ID NO: 143856 - DNA, 25 bp, Mus musculus
tgaggccccaaaaccgtgtgctgag

SEQ ID NO: 143857 - DNA, 25 bp, Mus musculus
tgaggccccggaagatcgtgtttgc

SEQ ID NO: 143858 - DNA, 25 bp, Mus musculus
tgaggcccggcttatatcactactg

SEQ ID NO: 143859 - DNA, 25 bp, Mus musculus
tgaggcccgggaagaattgaccaga

SEQ ID NO: 143860 - DNA, 25 bp, Mus musculus
tgaggccggagaaagtgacgttaac

SEQ ID NO: 143861 - DNA, 25 bp, Mus musculus
tgaggcctacgatgtgctgagtgac

SEQ ID NO: 143862 - DNA, 25 bp, Mus musculus
tgaggcctataacatgcgcaccgga

SEQ ID NO: 143863 - DNA, 25 bp, Mus musculus
tgaggcctgaacaccacaaggtctt

SEQ ID NO: 143864 - DNA, 25 bp, Mus musculus
tgaggcctgcctagtttacaaatgc

SEQ ID NO: 143865 - DNA, 25 bp, Mus musculus
tgaggccttagaaaaccggagcagc

SEQ ID NO: 143866 - DNA, 25 bp, Mus musculus
tgaggcctttttcacctccgggcta

SEQ ID NO: 143867 - DNA, 25 bp, Mus musculus
tgaggcgagtgctttactagcgaaa

SEQ ID NO: 143868 - DNA, 25 bp, Mus musculus
tgaggcgccttgcaaatccgacaat

SEQ ID NO: 143869 - DNA, 25 bp, Mus musculus
tgaggcgcttagctgactacccaga

SEQ ID NO: 143870 - DNA, 25 bp, Mus musculus
tgaggcgggcgtgacgctcatctct

SEQ ID NO: 143871 - DNA, 25 bp, Mus musculus
tgaggcgtgcagaggactagtatcc

SEQ ID NO: 143872 - DNA, 25 bp, Mus musculus
tgaggcgtttggtgctccggtaacc

SEQ ID NO: 143873 - DNA, 25 bp, Mus musculus
tgaggctcaaggagacacggaagcc

SEQ ID NO: 143874 - DNA, 25 bp, Mus musculus
tgaggctcaagtaccagcacactgg

SEQ ID NO: 143875 - DNA, 25 bp, Mus musculus
tgaggctctctctgcttgcacttgt

SEQ ID NO: 143876 - DNA, 25 bp, Mus musculus
tgaggctgagcggacagaggtgctg

SEQ ID NO: 143877 - DNA, 25 bp, Mus musculus
tgaggctgagctcaggaaagccacc

SEQ ID NO: 143878 - DNA, 25 bp, Mus musculus
tgaggctgagctctagcatggacct

SEQ ID NO: 143879 - DNA, 25 bp, Mus musculus
tgaggctgagtacaccgacgtgctt

SEQ ID NO: 143880 - DNA, 25 bp, Mus musculus
tgaggctgccaaagatgactaccaa

SEQ ID NO: 143881 - DNA, 25 bp, Mus musculus
tgaggctgcggctcaccattgtgga

SEQ ID NO: 143882 - DNA, 25 bp, Mus musculus
tgaggctggcctacaacgaaagtga

SEQ ID NO: 143883 - DNA, 25 bp, Mus musculus
tgaggctgggcatctatggttgtcc

SEQ ID NO: 143884 - DNA, 25 bp, Mus musculus
tgaggctgtggctctgaaccaggaa

SEQ ID NO: 143885 - DNA, 25 bp, Mus musculus
tgaggcttaactgctgtcataaaat

SEQ ID NO: 143886 - DNA, 25 bp, Mus musculus
tgaggcttcactgaccaacacaagt

SEQ ID NO: 143887 - DNA, 25 bp, Mus musculus
tgaggcttctttccagctgccaagg

SEQ ID NO: 143888 - DNA, 25 bp, Mus musculus
tgaggcttgcggatcctatctgccg

SEQ ID NO: 143889 - DNA, 25 bp, Mus musculus
tgaggctttccctgtctcggagcac

SEQ ID NO: 143890 - DNA, 25 bp, Mus musculus
tgaggctttcttaccaacatgtggg

SEQ ID NO: 143891 - DNA, 25 bp, Mus musculus
tgagggaacatcagctgacagagag

SEQ ID NO: 143892 - DNA, 25 bp, Mus musculus
tgagggaactcacgaaaatccagag

SEQ ID NO: 143893 - DNA, 25 bp, Mus musculus
tgagggaatgacaccaccagacgtc

SEQ ID NO: 143894 - DNA, 25 bp, Mus musculus
tgagggacagctaaaacacccgcac

SEQ ID NO: 143895 - DNA, 25 bp, Mus musculus
tgagggacagctttggcatcagaca

SEQ ID NO: 143896 - DNA, 25 bp, Mus musculus
tgagggacctgcaggattccttcga

SEQ ID NO: 143897 - DNA, 25 bp, Mus musculus
tgagggaccttgtagccagaatgag

SEQ ID NO: 143898 - DNA, 25 bp, Mus musculus
tgagggacggtctacaaactgccat

SEQ ID NO: 143899 - DNA, 25 bp, Mus musculus
tgagggactgcattgccaccggtat

SEQ ID NO: 143900 - DNA, 25 bp, Mus musculus
tgagggacttgaccaggctcttccc

SEQ ID NO: 143901 - DNA, 25 bp, Mus musculus
tgagggagctaactgaagcctagct

SEQ ID NO: 143902 - DNA, 25 bp, Mus musculus
tgagggaggcctgatccacagttct

SEQ ID NO: 143903 - DNA, 25 bp, Mus musculus
tgagggaggcgctgctaaagatctt

SEQ ID NO: 143904 - DNA, 25 bp, Mus musculus
tgagggatacggaagtttgatcaat

SEQ ID NO: 143905 - DNA, 25 bp, Mus musculus
tgagggatctccagtcagcaagggt

SEQ ID NO: 143906 - DNA, 25 bp, Mus musculus
tgagggatgcccaagaagttccagg

SEQ ID NO: 143907 - DNA, 25 bp, Mus musculus
tgagggatttttgacccaggaagca

SEQ ID NO: 143908 - DNA, 25 bp, Mus musculus
tgagggcaatgaggcagaactatcc

SEQ ID NO: 143909 - DNA, 25 bp, Mus musculus
tgagggcaattacagctgccgcaca

SEQ ID NO: 143910 - DNA, 25 bp, Mus musculus
tgagggcacaccactgttccgaatg

SEQ ID NO: 143911 - DNA, 25 bp, Mus musculus
tgagggcagcacaaactactcagcc

SEQ ID NO: 143912 - DNA, 25 bp, Mus musculus
tgagggcatcatcccagccaactat

SEQ ID NO: 143913 - DNA, 25 bp, Mus musculus
tgagggccagaagcagtgttacaca

SEQ ID NO: 143914 - DNA, 25 bp, Mus musculus
tgagggccagcctatcaagagcaga

SEQ ID NO: 143915 - DNA, 25 bp, Mus musculus
tgagggcccatttccatctgaaggg

SEQ ID NO: 143916 - DNA, 25 bp, Mus musculus
tgagggccctgatcgacattgtgag

SEQ ID NO: 143917 - DNA, 25 bp, Mus musculus
tgagggccctttccatacagaggct

SEQ ID NO: 143918 - DNA, 25 bp, Mus musculus
tgagggccgcctcgggggaagctgc

SEQ ID NO: 143919 - DNA, 25 bp, Mus musculus
tgagggcgaccatccttttaggaga

SEQ ID NO: 143920 - DNA, 25 bp, Mus musculus
tgagggcgccgccaaaatcgtcttt

SEQ ID NO: 143921 - DNA, 25 bp, Mus musculus
tgagggcgtcagtaaggaaatgcac

SEQ ID NO: 143922 - DNA, 25 bp, Mus musculus
tgagggctatgtgggctttgccaac

SEQ ID NO: 143923 - DNA, 25 bp, Mus musculus
tgagggctccaaaatcatattccgg

SEQ ID NO: 143924 - DNA, 25 bp, Mus musculus
tgagggctccggttacgaaagtcca

SEQ ID NO: 143925 - DNA, 25 bp, Mus musculus
tgagggctgtcacaccgctgtaccc

SEQ ID NO: 143926 - DNA, 25 bp, Mus musculus
tgagggctttgaccccagtgtactg

SEQ ID NO: 143927 - DNA, 25 bp, Mus musculus
tgagggtacagctactatggtggca

SEQ ID NO: 143928 - DNA, 25 bp, Mus musculus
tgagggtctggtctctacagcagcc

SEQ ID NO: 143929 - DNA, 25 bp, Mus musculus
tgagggtgaataaatccgggaaaca

SEQ ID NO: 143930 - DNA, 25 bp, Mus musculus
tgagggtgacctcagcactcttcag

SEQ ID NO: 143931 - DNA, 25 bp, Mus musculus
tgaggtaaaaatccccaagcccttg

SEQ ID NO: 143932 - DNA, 25 bp, Mus musculus
tgaggtaaaccccaatactcgtgta

SEQ ID NO: 143933 - DNA, 25 bp, Mus musculus
tgaggtaagaatcgtaaactttact

SEQ ID NO: 143934 - DNA, 25 bp, Mus musculus
tgaggtacagtagggtcgtttccag

SEQ ID NO: 143935 - DNA, 25 bp, Mus musculus
tgaggtacctactccaggcgatggg

SEQ ID NO: 143936 - DNA, 25 bp, Mus musculus
tgaggtaccttagctggcagcagcg

SEQ ID NO: 143937 - DNA, 25 bp, Mus musculus
tgaggtagtcccaacccagggagct

SEQ ID NO: 143938 - DNA, 25 bp, Mus musculus
tgaggtcaaccaatttcctgtgggt

SEQ ID NO: 143939 - DNA, 25 bp, Mus musculus
tgaggtcaagcacagcaaagaggcc

SEQ ID NO: 143940 - DNA, 25 bp, Mus musculus
tgaggtcaaggacatacccctgctg

SEQ ID NO: 143941 - DNA, 25 bp, Mus musculus
tgaggtcaatgaacagctccaagcc

SEQ ID NO: 143942 - DNA, 25 bp, Mus musculus
tgaggtcacgccatcgatgcttgct

SEQ ID NO: 143943 - DNA, 25 bp, Mus musculus
tgaggtcagtcctggagcctgtgtt

SEQ ID NO: 143944 - DNA, 25 bp, Mus musculus
tgaggtcatcagcttgtaaccaggg

SEQ ID NO: 143945 - DNA, 25 bp, Mus musculus
tgaggtcatccaagtccatcgcaaa

SEQ ID NO: 143946 - DNA, 25 bp, Mus musculus
tgaggtccaacacaccacccaatgg

SEQ ID NO: 143947 - DNA, 25 bp, Mus musculus
tgaggtccacatacataccgggtgc

SEQ ID NO: 143948 - DNA, 25 bp, Mus musculus
tgaggtccaccagatgatcggcaac

SEQ ID NO: 143949 - DNA, 25 bp, Mus musculus
tgaggtccagatctatgccatgctg

SEQ ID NO: 143950 - DNA, 25 bp, Mus musculus
tgaggtcccctctttgatggagaca

SEQ ID NO: 143951 - DNA, 25 bp, Mus musculus
tgaggtcccgaggacgtcactgacg

SEQ ID NO: 143952 - DNA, 25 bp, Mus musculus
tgaggtccctcaaagctggaaatgc

SEQ ID NO: 143953 - DNA, 25 bp, Mus musculus
tgaggtcctcaagtccctgctggag

SEQ ID NO: 143954 - DNA, 25 bp, Mus musculus
tgaggtcctggaaatgctgcagcag

SEQ ID NO: 143955 - DNA, 25 bp, Mus musculus
tgaggtcgccgagagatgccagttt

SEQ ID NO: 143956 - DNA, 25 bp, Mus musculus
tgaggtcggtaaatccaggaagatg

SEQ ID NO: 143957 - DNA, 25 bp, Mus musculus
tgaggtcgtacagcgcaagaagcag

SEQ ID NO: 143958 - DNA, 25 bp, Mus musculus
tgaggtctcatctctgcaattccag

SEQ ID NO: 143959 - DNA, 25 bp, Mus musculus
tgaggtctccccacagcagtagatt

SEQ ID NO: 143960 - DNA, 25 bp, Mus musculus
tgaggtctctaaacataaagccgcc

SEQ ID NO: 143961 - DNA, 25 bp, Mus musculus
tgaggtctgcaacacgtccatggat

SEQ ID NO: 143962 - DNA, 25 bp, Mus musculus
tgaggtgaagctcccaaagatgcct

SEQ ID NO: 143963 - DNA, 25 bp, Mus musculus
tgaggtgacatcctgcagcgttccg

SEQ ID NO: 143964 - DNA, 25 bp, Mus musculus
tgaggtgcaactacacagaggcctt

SEQ ID NO: 143965 - DNA, 25 bp, Mus musculus
tgaggtgcaactgtgtcttcccgtg

SEQ ID NO: 143966 - DNA, 25 bp, Mus musculus
tgaggtggatgaagaggatcccaac

SEQ ID NO: 143967 - DNA, 25 bp, Mus musculus
tgaggtggccaagaacctagtcctt

SEQ ID NO: 143968 - DNA, 25 bp, Mus musculus
tgaggtgtccatcgagcccctgtta

SEQ ID NO: 143969 - DNA, 25 bp, Mus musculus
tgaggtgttgtgacagctggtttca

SEQ ID NO: 143970 - DNA, 25 bp, Mus musculus
tgaggttaccctgatgaatgcgcga

SEQ ID NO: 143971 - DNA, 25 bp, Mus musculus
tgaggttacctccagcattagctcg

SEQ ID NO: 143972 - DNA, 25 bp, Mus musculus
tgaggttatccgtgccaatattggg

SEQ ID NO: 143973 - DNA, 25 bp, Mus musculus
tgaggttcccgatgcacacacggtg

SEQ ID NO: 143974 - DNA, 25 bp, Mus musculus
tgaggttcctgagaaagactcgctg

SEQ ID NO: 143975 - DNA, 25 bp, Mus musculus
tgaggttgactacgtaggaagccac

SEQ ID NO: 143976 - DNA, 25 bp, Mus musculus
tgaggtttctaccaagtctgctacc

SEQ ID NO: 143977 - DNA, 25 bp, Mus musculus
tgagtaaacagggacaggcatcgca

SEQ ID NO: 143978 - DNA, 25 bp, Mus musculus
tgagtaaactcaggcaaactaacaa

SEQ ID NO: 143979 - DNA, 25 bp, Mus musculus
tgagtaacggaaccagacccaatgt

SEQ ID NO: 143980 - DNA, 25 bp, Mus musculus
tgagtaacttagtgaggctctgacc

SEQ ID NO: 143981 - DNA, 25 bp, Mus musculus
tgagtaacttgctacctgctcggct

SEQ ID NO: 143982 - DNA, 25 bp, Mus musculus
tgagtaagcagtacggcagcgagac

SEQ ID NO: 143983 - DNA, 25 bp, Mus musculus
tgagtaatctggaagagacctgccc

SEQ ID NO: 143984 - DNA, 25 bp, Mus musculus
tgagtacaaccagccctctgaggct

SEQ ID NO: 143985 - DNA, 25 bp, Mus musculus
tgagtacaacgtggaacattccgtg

SEQ ID NO: 143986 - DNA, 25 bp, Mus musculus
tgagtacacacaaaccgacatcgga

SEQ ID NO: 143987 - DNA, 25 bp, Mus musculus
tgagtacagtcaggacgtggcctcc

SEQ ID NO: 143988 - DNA, 25 bp, Mus musculus
tgagtacatggcctacctccagagg

SEQ ID NO: 143989 - DNA, 25 bp, Mus musculus
tgagtaccatcaaggcagtgtctgt

SEQ ID NO: 143990 - DNA, 25 bp, Mus musculus
tgagtaccctgaataagagcagtcc

SEQ ID NO: 143991 - DNA, 25 bp, Mus musculus
tgagtaccgagagatcgacaaacgc

SEQ ID NO: 143992 - DNA, 25 bp, Mus musculus
tgagtacctacacctggcgctgtga

SEQ ID NO: 143993 - DNA, 25 bp, Mus musculus
tgagtacctgacaccatggcagagg

SEQ ID NO: 143994 - DNA, 25 bp, Mus musculus
tgagtacctggatgacgtctacccg

SEQ ID NO: 143995 - DNA, 25 bp, Mus musculus
tgagtacgcgtcgattccggttgaa

SEQ ID NO: 143996 - DNA, 25 bp, Mus musculus
tgagtactatagacagcaagcagcg

SEQ ID NO: 143997 - DNA, 25 bp, Mus musculus
tgagtactcctgtgcctacgatggc

SEQ ID NO: 143998 - DNA, 25 bp, Mus musculus
tgagtagagaccacatattgccatg

SEQ ID NO: 143999 - DNA, 25 bp, Mus musculus
tgagtagcagaatgtccttgacccc

SEQ ID NO: 144000 - DNA, 25 bp, Mus musculus
tgagtaggagcacacaggcgcactc

SEQ ID NO: 144001 - DNA, 25 bp, Mus musculus
tgagtagtcgctccataagcacgca

SEQ ID NO: 144002 - DNA, 25 bp, Mus musculus
tgagtataaaactgggagccacctc

SEQ ID NO: 144003 - DNA, 25 bp, Mus musculus
tgagtataatctcggcacacccaga

SEQ ID NO: 144004 - DNA, 25 bp, Mus musculus
tgagtatgaagctgcagcaaccaga

SEQ ID NO: 144005 - DNA, 25 bp, Mus musculus
tgagtatgacaactctgctcaggac

SEQ ID NO: 144006 - DNA, 25 bp, Mus musculus
tgagtatgacagagcagtggcgcct

SEQ ID NO: 144007 - DNA, 25 bp, Mus musculus
tgagtattagctgacccgatgggac

SEQ ID NO: 144008 - DNA, 25 bp, Mus musculus
tgagtcaacggaagcactaagtcct

SEQ ID NO: 144009 - DNA, 25 bp, Mus musculus
tgagtcaatgccagcaaaccaacag

SEQ ID NO: 144010 - DNA, 25 bp, Mus musculus
tgagtcacccaagaagcgggaaccg

SEQ ID NO: 144011 - DNA, 25 bp, Mus musculus
tgagtcacgccatgttcaacgaggt

SEQ ID NO: 144012 - DNA, 25 bp, Mus musculus
tgagtcagaaaagtgctaaaacagc

SEQ ID NO: 144013 - DNA, 25 bp, Mus musculus
tgagtcagatgaaccaccttagcac

SEQ ID NO: 144014 - DNA, 25 bp, Mus musculus
tgagtcaggagcgatcaagacagcc

SEQ ID NO: 144015 - DNA, 25 bp, Mus musculus
tgagtcaggatactcactgcacaag

SEQ ID NO: 144016 - DNA, 25 bp, Mus musculus
tgagtcagggctgcctactcttggc

SEQ ID NO: 144017 - DNA, 25 bp, Mus musculus
tgagtcagtgcgcaaagaacctagg

SEQ ID NO: 144018 - DNA, 25 bp, Mus musculus
tgagtcagttcaggagccgctcagc

SEQ ID NO: 144019 - DNA, 25 bp, Mus musculus
tgagtcagttctggaaagaggttcc

SEQ ID NO: 144020 - DNA, 25 bp, Mus musculus
tgagtcatacccaggcaagtgcttt

SEQ ID NO: 144021 - DNA, 25 bp, Mus musculus
tgagtcatagaatgggaaggctcct

SEQ ID NO: 144022 - DNA, 25 bp, Mus musculus
tgagtcatcctccaaagaacacata

SEQ ID NO: 144023 - DNA, 25 bp, Mus musculus
tgagtcccatgctgagcctgaagct

SEQ ID NO: 144024 - DNA, 25 bp, Mus musculus
tgagtcccgaggacgcacaggaaga

SEQ ID NO: 144025 - DNA, 25 bp, Mus musculus
tgagtcccgcagtcgcattcgagtg

SEQ ID NO: 144026 - DNA, 25 bp, Mus musculus
tgagtcccgctccacagtgagaagg

SEQ ID NO: 144027 - DNA, 25 bp, Mus musculus
tgagtcccggattctggtgggttct

SEQ ID NO: 144028 - DNA, 25 bp, Mus musculus
tgagtccctgcctttcaccttggag

SEQ ID NO: 144029 - DNA, 25 bp, Mus musculus
tgagtccctggagtcagacatgcag

SEQ ID NO: 144030 - DNA, 25 bp, Mus musculus
tgagtccctggttctactgcaagag

SEQ ID NO: 144031 - DNA, 25 bp, Mus musculus
tgagtccgctccacgaataatgcgg

SEQ ID NO: 144032 - DNA, 25 bp, Mus musculus
tgagtccgtgctgtgtgtgaagccc

SEQ ID NO: 144033 - DNA, 25 bp, Mus musculus
tgagtcctaaatagtctgtccccga

SEQ ID NO: 144034 - DNA, 25 bp, Mus musculus
tgagtcctatacagcgctcgcagct

SEQ ID NO: 144035 - DNA, 25 bp, Mus musculus
tgagtcctatgtggctcagcagaag

SEQ ID NO: 144036 - DNA, 25 bp, Mus musculus
tgagtcctcctgtccgagactgggt

SEQ ID NO: 144037 - DNA, 25 bp, Mus musculus
tgagtcctctctggctgtcagtcgc

SEQ ID NO: 144038 - DNA, 25 bp, Mus musculus
tgagtcctgcgatctatggagcctg

SEQ ID NO: 144039 - DNA, 25 bp, Mus musculus
tgagtcctgggaaaccttagaagcg

SEQ ID NO: 144040 - DNA, 25 bp, Mus musculus
tgagtcctggtcatcaaaaagcccc

SEQ ID NO: 144041 - DNA, 25 bp, Mus musculus
tgagtcgaacaaacccgaacagtgg

SEQ ID NO: 144042 - DNA, 25 bp, Mus musculus
tgagtcgatgctgcggcaactgaag

SEQ ID NO: 144043 - DNA, 25 bp, Mus musculus
tgagtcgcgtccagcgtgtcctaga

SEQ ID NO: 144044 - DNA, 25 bp, Mus musculus
tgagtcggacctggtactgtgcagc

SEQ ID NO: 144045 - DNA, 25 bp, Mus musculus
tgagtcggatggcagccctgtacca

SEQ ID NO: 144046 - DNA, 25 bp, Mus musculus
tgagtcggtgaggaagcatccgagc

SEQ ID NO: 144047 - DNA, 25 bp, Mus musculus
tgagtctcagaagctggcgcattac

SEQ ID NO: 144048 - DNA, 25 bp, Mus musculus
tgagtctccagtcagtaatgctgga

SEQ ID NO: 144049 - DNA, 25 bp, Mus musculus
tgagtctgaagaccgaatctactgg

SEQ ID NO: 144050 - DNA, 25 bp, Mus musculus
tgagtctgcacatcaccagttgcca

SEQ ID NO: 144051 - DNA, 25 bp, Mus musculus
tgagtctgcagaaagaacaagcccg

SEQ ID NO: 144052 - DNA, 25 bp, Mus musculus
tgagtctgcatctaaaccccatgga

SEQ ID NO: 144053 - DNA, 25 bp, Mus musculus
tgagtctgtaatcccctccaaggag

SEQ ID NO: 144054 - DNA, 25 bp, Mus musculus
tgagtctgtggttgtcccggcagca

SEQ ID NO: 144055 - DNA, 25 bp, Mus musculus
tgagtctgttgtcagttccccagcg

SEQ ID NO: 144056 - DNA, 25 bp, Mus musculus
tgagtcttcgatggcagtgtcgtac

SEQ ID NO: 144057 - DNA, 25 bp, Mus musculus
tgagtgaaacaagcgacatcggcca

SEQ ID NO: 144058 - DNA, 25 bp, Mus musculus
tgagtgaacgccaccatcctgccga

SEQ ID NO: 144059 - DNA, 25 bp, Mus musculus
tgagtgaagcctcccagatctatga

SEQ ID NO: 144060 - DNA, 25 bp, Mus musculus
tgagtgacagcaaaacgatcttgga

SEQ ID NO: 144061 - DNA, 25 bp, Mus musculus
tgagtgacaggaagaacttgacccg

SEQ ID NO: 144062 - DNA, 25 bp, Mus musculus
tgagtgaccggctctctgcaaggac

SEQ ID NO: 144063 - DNA, 25 bp, Mus musculus
tgagtgacggaaatccagagctcct

SEQ ID NO: 144064 - DNA, 25 bp, Mus musculus
tgagtgactgatccccagaagtccc

SEQ ID NO: 144065 - DNA, 25 bp, Mus musculus
tgagtgagaaagtagaacccaggac

SEQ ID NO: 144066 - DNA, 25 bp, Mus musculus
tgagtgagacccaagttctggcaac

SEQ ID NO: 144067 - DNA, 25 bp, Mus musculus
tgagtgagagcatctaccgcagcaa

SEQ ID NO: 144068 - DNA, 25 bp, Mus musculus
tgagtgagccagcttgtgcccatgc

SEQ ID NO: 144069 - DNA, 25 bp, Mus musculus
tgagtgagctcctaggtctctggcc

SEQ ID NO: 144070 - DNA, 25 bp, Mus musculus
tgagtgaggttctccaatgcagcac

SEQ ID NO: 144071 - DNA, 25 bp, Mus musculus
tgagtgagtggatcaaacaccggcc

SEQ ID NO: 144072 - DNA, 25 bp, Mus musculus
tgagtgatagtcacgggatcgcgac

SEQ ID NO: 144073 - DNA, 25 bp, Mus musculus
tgagtgatggtccagaaggctccca

SEQ ID NO: 144074 - DNA, 25 bp, Mus musculus
tgagtgcaccatccgcatgaacgat

SEQ ID NO: 144075 - DNA, 25 bp, Mus musculus
tgagtgcactgacacagacacaggc

SEQ ID NO: 144076 - DNA, 25 bp, Mus musculus
tgagtgcacttctgatcctagccct

SEQ ID NO: 144077 - DNA, 25 bp, Mus musculus
tgagtgcaggatccagcatccagga

SEQ ID NO: 144078 - DNA, 25 bp, Mus musculus
tgagtgcatattccacttcaacagc

SEQ ID NO: 144079 - DNA, 25 bp, Mus musculus
tgagtgcatcaaacaacgaagccgg

SEQ ID NO: 144080 - DNA, 25 bp, Mus musculus
tgagtgccaccgagaaaatccggcg

SEQ ID NO: 144081 - DNA, 25 bp, Mus musculus
tgagtgccacttctacgctggtgga

SEQ ID NO: 144082 - DNA, 25 bp, Mus musculus
tgagtgccatccttaaccctgcagg

SEQ ID NO: 144083 - DNA, 25 bp, Mus musculus
tgagtgccgacctgaggtacctctg

SEQ ID NO: 144084 - DNA, 25 bp, Mus musculus
tgagtgccgggtgaagaagaccacc

SEQ ID NO: 144085 - DNA, 25 bp, Mus musculus
tgagtgctacctctaccagcggaac

SEQ ID NO: 144086 - DNA, 25 bp, Mus musculus
tgagtggaccatcaaactgaactgg

SEQ ID NO: 144087 - DNA, 25 bp, Mus musculus
tgagtggatcagatagaagcgccca

SEQ ID NO: 144088 - DNA, 25 bp, Mus musculus
tgagtggcaaacgagacgggacctt

SEQ ID NO: 144089 - DNA, 25 bp, Mus musculus
tgagtggcaacatcacggcatttgc

SEQ ID NO: 144090 - DNA, 25 bp, Mus musculus
tgagtggcaaccagatacccatgtg

SEQ ID NO: 144091 - DNA, 25 bp, Mus musculus
tgagtggcagacaccagttatctca

SEQ ID NO: 144092 - DNA, 25 bp, Mus musculus
tgagtggcagctcaagcacaattgc

SEQ ID NO: 144093 - DNA, 25 bp, Mus musculus
tgagtggcctaagaacatgatgccg

SEQ ID NO: 144094 - DNA, 25 bp, Mus musculus
tgagtgggatcagtgtgcacgcacc

SEQ ID NO: 144095 - DNA, 25 bp, Mus musculus
tgagtgggtaaagacagcctgcagc

SEQ ID NO: 144096 - DNA, 25 bp, Mus musculus
tgagtgtcaacgaccttccggtggg

SEQ ID NO: 144097 - DNA, 25 bp, Mus musculus
tgagtgtcaccccagaggtcaagag

SEQ ID NO: 144098 - DNA, 25 bp, Mus musculus
tgagtgtcaccgcaagtccagtgcc

SEQ ID NO: 144099 - DNA, 25 bp, Mus musculus
tgagtgtccccgttatatgaagcgc

SEQ ID NO: 144100 - DNA, 25 bp, Mus musculus
tgagtgtctgcgagacttcctgacg

SEQ ID NO: 144101 - DNA, 25 bp, Mus musculus
tgagtgtgtcccagctacaggcctt

SEQ ID NO: 144102 - DNA, 25 bp, Mus musculus
tgagtgtgtcgctggccctttaaag

SEQ ID NO: 144103 - DNA, 25 bp, Mus musculus
tgagtgttccaataagactggccgc

SEQ ID NO: 144104 - DNA, 25 bp, Mus musculus
tgagtgttggccttacggcatccga

SEQ ID NO: 144105 - DNA, 25 bp, Mus musculus
tgagttacaaccaccatcgcctgga

SEQ ID NO: 144106 - DNA, 25 bp, Mus musculus
tgagttacagactcacccggagctg

SEQ ID NO: 144107 - DNA, 25 bp, Mus musculus
tgagttacagaggtgtccacgagct

SEQ ID NO: 144108 - DNA, 25 bp, Mus musculus
tgagttaccgcctcaggagcttggg

SEQ ID NO: 144109 - DNA, 25 bp, Mus musculus
tgagttagaacagaggctcggcgcc

SEQ ID NO: 144110 - DNA, 25 bp, Mus musculus
tgagttagtgtcaggagccctccag

SEQ ID NO: 144111 - DNA, 25 bp, Mus musculus
tgagttatgagaaacggagcccgcg

SEQ ID NO: 144112 - DNA, 25 bp, Mus musculus
tgagttcaatacagggaagccaccc

SEQ ID NO: 144113 - DNA, 25 bp, Mus musculus
tgagttcagaacagggtgagcacct

SEQ ID NO: 144114 - DNA, 25 bp, Mus musculus
tgagttcattctcgcctgtcagcag

SEQ ID NO: 144115 - DNA, 25 bp, Mus musculus
tgagttccagccatgggttcttctg

SEQ ID NO: 144116 - DNA, 25 bp, Mus musculus
tgagttccccatcaacacggctgtt

SEQ ID NO: 144117 - DNA, 25 bp, Mus musculus
tgagttccccgagcagtagagagac

SEQ ID NO: 144118 - DNA, 25 bp, Mus musculus
tgagttccctagtaaagcggtggct

SEQ ID NO: 144119 - DNA, 25 bp, Mus musculus
tgagttccgtgacatacaacttagc

SEQ ID NO: 144120 - DNA, 25 bp, Mus musculus
tgagttcctccgaagtatgtccccg

SEQ ID NO: 144121 - DNA, 25 bp, Mus musculus
tgagttcctgctggagaacggcatc

SEQ ID NO: 144122 - DNA, 25 bp, Mus musculus
tgagttcggtgccacccaagttacg

SEQ ID NO: 144123 - DNA, 25 bp, Mus musculus
tgagttctctaaatgggccagtgat

SEQ ID NO: 144124 - DNA, 25 bp, Mus musculus
tgagttctgcggtacaaggactacc

SEQ ID NO: 144125 - DNA, 25 bp, Mus musculus
tgagttcttctgctcacactgccgc

SEQ ID NO: 144126 - DNA, 25 bp, Mus musculus
tgagttgagtctttggtcccttacc

SEQ ID NO: 144127 - DNA, 25 bp, Mus musculus
tgagttgccacatgctgacttgtcc

SEQ ID NO: 144128 - DNA, 25 bp, Mus musculus
tgagttgccctttttcctcgagctc

SEQ ID NO: 144129 - DNA, 25 bp, Mus musculus
tgagttgccttccactatgcagagg

SEQ ID NO: 144130 - DNA, 25 bp, Mus musculus
tgagttggaacagaagcgagccttg

SEQ ID NO: 144131 - DNA, 25 bp, Mus musculus
tgagttgtcctgctccaagcctaaa

SEQ ID NO: 144132 - DNA, 25 bp, Mus musculus
tgagttgtccttggctttagggcga

SEQ ID NO: 144133 - DNA, 25 bp, Mus musculus
tgagttgtgttgaagtcccctggac

SEQ ID NO: 144134 - DNA, 25 bp, Mus musculus
tgagtttctggctaatcaggctgcc

SEQ ID NO: 144135 - DNA, 25 bp, Mus musculus
tgagtttgacactcgggacaacccc

SEQ ID NO: 144136 - DNA, 25 bp, Mus musculus
tgagtttttaacactggtgcagctg

SEQ ID NO: 144137 - DNA, 25 bp, Mus musculus
tgataaacatcaccaaatgctactg

SEQ ID NO: 144138 - DNA, 25 bp, Mus musculus
tgataaacccctaacaacggaagag

SEQ ID NO: 144139 - DNA, 25 bp, Mus musculus
tgataaactgtttaccttaatgaaa

SEQ ID NO: 144140 - DNA, 25 bp, Mus musculus
tgataaatcccgcaaccgcaaagag

SEQ ID NO: 144141 - DNA, 25 bp, Mus musculus
tgataacaacaatgcagcagtggcg

SEQ ID NO: 144142 - DNA, 25 bp, Mus musculus
tgataacagcgacctctccgcgtga

SEQ ID NO: 144143 - DNA, 25 bp, Mus musculus
tgataacctgggaatccgacgctgg

SEQ ID NO: 144144 - DNA, 25 bp, Mus musculus
tgataacgagtgaccatcctggacg

SEQ ID NO: 144145 - DNA, 25 bp, Mus musculus
tgataactaccatctggcccggagg

SEQ ID NO: 144146 - DNA, 25 bp, Mus musculus
tgataactatgacttggccagcgaa

SEQ ID NO: 144147 - DNA, 25 bp, Mus musculus
tgataactatggcaatagcagtggc

SEQ ID NO: 144148 - DNA, 25 bp, Mus musculus
tgataagaatgcctacccagtgccc

SEQ ID NO: 144149 - DNA, 25 bp, Mus musculus
tgataagccgaaccccagaggtgag

SEQ ID NO: 144150 - DNA, 25 bp, Mus musculus
tgataagcttctctgccctgacgag

SEQ ID NO: 144151 - DNA, 25 bp, Mus musculus
tgataaggaagcaacagaaccaggc

SEQ ID NO: 144152 - DNA, 25 bp, Mus musculus
tgataaggacggaaacacagccctg

SEQ ID NO: 144153 - DNA, 25 bp, Mus musculus
tgataaggctatccgcttcttgggc

SEQ ID NO: 144154 - DNA, 25 bp, Mus musculus
tgataagttcaagccaggtggacca

SEQ ID NO: 144155 - DNA, 25 bp, Mus musculus
tgataatcacgtggcacctctggca

SEQ ID NO: 144156 - DNA, 25 bp, Mus musculus
tgataatcctgctcctaagtgtggg

SEQ ID NO: 144157 - DNA, 25 bp, Mus musculus
tgataatctcaagcaggtggccaga

SEQ ID NO: 144158 - DNA, 25 bp, Mus musculus
tgataatgtctttgtggccagccag

SEQ ID NO: 144159 - DNA, 25 bp, Mus musculus
tgataatttatgatctccatggaag

SEQ ID NO: 144160 - DNA, 25 bp, Mus musculus
tgatacacaggcaaatccccgagag

SEQ ID NO: 144161 - DNA, 25 bp, Mus musculus
tgatacacaggtgcgaagtgctgct

SEQ ID NO: 144162 - DNA, 25 bp, Mus musculus
tgatacaccagagtagggcagccac

SEQ ID NO: 144163 - DNA, 25 bp, Mus musculus
tgatacacctgggagctccaagctg

SEQ ID NO: 144164 - DNA, 25 bp, Mus musculus
tgatacacgctcacagatagcctgg

SEQ ID NO: 144165 - DNA, 25 bp, Mus musculus
tgatacagaacaacgcctatgcggt

SEQ ID NO: 144166 - DNA, 25 bp, Mus musculus
tgatacagacggagagggattacct

SEQ ID NO: 144167 - DNA, 25 bp, Mus musculus
tgatacatgactctcatctgggctg

SEQ ID NO: 144168 - DNA, 25 bp, Mus musculus
tgataccaccagagaagtgactgcc

SEQ ID NO: 144169 - DNA, 25 bp, Mus musculus
tgataccaccagtaatgtagcggct

SEQ ID NO: 144170 - DNA, 25 bp, Mus musculus
tgataccacgctacttccgaagcat

SEQ ID NO: 144171 - DNA, 25 bp, Mus musculus
tgataccatcactttgaagccccgg

SEQ ID NO: 144172 - DNA, 25 bp, Mus musculus
tgatacccagcttcccaatcagcag

SEQ ID NO: 144173 - DNA, 25 bp, Mus musculus
tgataccccaagcagatgtacctgg

SEQ ID NO: 144174 - DNA, 25 bp, Mus musculus
tgatacgaggaacagagacgatact

SEQ ID NO: 144175 - DNA, 25 bp, Mus musculus
tgatacggctcttctcatggtgcgc

SEQ ID NO: 144176 - DNA, 25 bp, Mus musculus
tgatactgccaaagagctgggagcc

SEQ ID NO: 144177 - DNA, 25 bp, Mus musculus
tgatactggacatttctagggccct

SEQ ID NO: 144178 - DNA, 25 bp, Mus musculus
tgatactggctcctctaacctgtgg

SEQ ID NO: 144179 - DNA, 25 bp, Mus musculus
tgatactgggcctgtggacacacaa

SEQ ID NO: 144180 - DNA, 25 bp, Mus musculus
tgatactgtcagcagaagccctggc

SEQ ID NO: 144181 - DNA, 25 bp, Mus musculus
tgatactgtgaaacctgaggccgag

SEQ ID NO: 144182 - DNA, 25 bp, Mus musculus
tgatagaaaatctcgacacccggga

SEQ ID NO: 144183 - DNA, 25 bp, Mus musculus
tgatagaagacgtgctgagacctct

SEQ ID NO: 144184 - DNA, 25 bp, Mus musculus
tgatagacgatctcagcgtgagcct

SEQ ID NO: 144185 - DNA, 25 bp, Mus musculus
tgatagactgccagacaggcctcgt

SEQ ID NO: 144186 - DNA, 25 bp, Mus musculus
tgatagacttgtgtgcccggaagcc

SEQ ID NO: 144187 - DNA, 25 bp, Mus musculus
tgatagagggaaagctggctccatt

SEQ ID NO: 144188 - DNA, 25 bp, Mus musculus
tgatagatctgtgggacctggctca

SEQ ID NO: 144189 - DNA, 25 bp, Mus musculus
tgatagcacactcggataagaaccg

SEQ ID NO: 144190 - DNA, 25 bp, Mus musculus
tgatagcactcctcacaaactgggt

SEQ ID NO: 144191 - DNA, 25 bp, Mus musculus
tgatagcatagactggtcaccctgg

SEQ ID NO: 144192 - DNA, 25 bp, Mus musculus
tgatagccaagcacctgaagggccg

SEQ ID NO: 144193 - DNA, 25 bp, Mus musculus
tgatagccagcctgacaagaaagct

SEQ ID NO: 144194 - DNA, 25 bp, Mus musculus
tgatagccgggcaaacactgtttat

SEQ ID NO: 144195 - DNA, 25 bp, Mus musculus
tgatagcggcacatactcagtaccc

SEQ ID NO: 144196 - DNA, 25 bp, Mus musculus
tgatagctaagaagcacccaagcag

SEQ ID NO: 144197 - DNA, 25 bp, Mus musculus
tgatagctcctgcttcggtagggaa

SEQ ID NO: 144198 - DNA, 25 bp, Mus musculus
tgatagctgtcagcgcttcagtgga

SEQ ID NO: 144199 - DNA, 25 bp, Mus musculus
tgatagctgtcctccaagtggccac

SEQ ID NO: 144200 - DNA, 25 bp, Mus musculus
tgataggaacgggaaccaagcgttt

SEQ ID NO: 144201 - DNA, 25 bp, Mus musculus
tgataggagagagaaagctgccact

SEQ ID NO: 144202 - DNA, 25 bp, Mus musculus
tgataggagcgtctttcctcgtcgc

SEQ ID NO: 144203 - DNA, 25 bp, Mus musculus
tgatagggaaatccgaacactggcc

SEQ ID NO: 144204 - DNA, 25 bp, Mus musculus
tgatagtgaagaaaccgtacagagc

SEQ ID NO: 144205 - DNA, 25 bp, Mus musculus
tgatagtggctctacctcaggtggg

SEQ ID NO: 144206 - DNA, 25 bp, Mus musculus
tgatagttctcacggagtctggcag

SEQ ID NO: 144207 - DNA, 25 bp, Mus musculus
tgatatacagcatcgtggacctcca

SEQ ID NO: 144208 - DNA, 25 bp, Mus musculus
tgatatacttcctagcgggctggct

SEQ ID NO: 144209 - DNA, 25 bp, Mus musculus
tgatatagacaagtgggatgacccc

SEQ ID NO: 144210 - DNA, 25 bp, Mus musculus
tgatatatcctccaacacggctggg

SEQ ID NO: 144211 - DNA, 25 bp, Mus musculus
tgatatcaccttcggagttcgagcg

SEQ ID NO: 144212 - DNA, 25 bp, Mus musculus
tgatatccaagaacaagcactgcag

SEQ ID NO: 144213 - DNA, 25 bp, Mus musculus
tgatatccaggtgcagtcctccaga

SEQ ID NO: 144214 - DNA, 25 bp, Mus musculus
tgatatcgaactctacagtgttggg

SEQ ID NO: 144215 - DNA, 25 bp, Mus musculus
tgatatgccaagcagagggcagaat

SEQ ID NO: 144216 - DNA, 25 bp, Mus musculus
tgatatgtaacaccgaggccttgtg

SEQ ID NO: 144217 - DNA, 25 bp, Mus musculus
tgatatgtcccttgtgaatggctgg

SEQ ID NO: 144218 - DNA, 25 bp, Mus musculus
tgatattcagcctggaaggagggca

SEQ ID NO: 144219 - DNA, 25 bp, Mus musculus
tgatattggccatgtcaagcaggcc

SEQ ID NO: 144220 - DNA, 25 bp, Mus musculus
tgatcaaacaggagcgcacagactt

SEQ ID NO: 144221 - DNA, 25 bp, Mus musculus
tgatcaaagtcttccaccgggatgg

SEQ ID NO: 144222 - DNA, 25 bp, Mus musculus
tgatcaaatgggaagaccgttcgga

SEQ ID NO: 144223 - DNA, 25 bp, Mus musculus
tgatcaagaactgcagcgagaccca

SEQ ID NO: 144224 - DNA, 25 bp, Mus musculus
tgatcaagaggaggatacaaagcga

SEQ ID NO: 144225 - DNA, 25 bp, Mus musculus
tgatcaaggcaaccaaacagcggcc

SEQ ID NO: 144226 - DNA, 25 bp, Mus musculus
tgatcaagggatacatgcaacagca

SEQ ID NO: 144227 - DNA, 25 bp, Mus musculus
tgatcaaggtgaacagcaagcagcg

SEQ ID NO: 144228 - DNA, 25 bp, Mus musculus
tgatcaatagtacaaccctgcagct

SEQ ID NO: 144229 - DNA, 25 bp, Mus musculus
tgatcaatcgcttacgtgagcagaa

SEQ ID NO: 144230 - DNA, 25 bp, Mus musculus
tgatcaatgaaagtggcctctaccg

SEQ ID NO: 144231 - DNA, 25 bp, Mus musculus
tgatcacaaaacgagaggccgaacg

SEQ ID NO: 144232 - DNA, 25 bp, Mus musculus
tgatcacaatgcctcagtacctccg

SEQ ID NO: 144233 - DNA, 25 bp, Mus musculus
tgatcacagaggtaggaactgcctt

SEQ ID NO: 144234 - DNA, 25 bp, Mus musculus
tgatcaccagcaacaggcgcagcat

SEQ ID NO: 144235 - DNA, 25 bp, Mus musculus
tgatcacccggcctgtgtggttaca

SEQ ID NO: 144236 - DNA, 25 bp, Mus musculus
tgatcaccttcatcgacttggctgg

SEQ ID NO: 144237 - DNA, 25 bp, Mus musculus
tgatcacgacggatgccttgcacag

SEQ ID NO: 144238 - DNA, 25 bp, Mus musculus
tgatcacggtgatgacgtcagctgc

SEQ ID NO: 144239 - DNA, 25 bp, Mus musculus
tgatcacttcacagagcattaggag

SEQ ID NO: 144240 - DNA, 25 bp, Mus musculus
tgatcagaaaggcaactggaggccc

SEQ ID NO: 144241 - DNA, 25 bp, Mus musculus
tgatcagagatgctcaccactatgg

SEQ ID NO: 144242 - DNA, 25 bp, Mus musculus
tgatcagcatggctcagaacaatgt

SEQ ID NO: 144243 - DNA, 25 bp, Mus musculus
tgatcagcgaggtcttaacttccga

SEQ ID NO: 144244 - DNA, 25 bp, Mus musculus
tgatcagcgccaagacgggctatgg

SEQ ID NO: 144245 - DNA, 25 bp, Mus musculus
tgatcagcttctctcggacttttgg

SEQ ID NO: 144246 - DNA, 25 bp, Mus musculus
tgatcaggaaggactcgtggagcac

SEQ ID NO: 144247 - DNA, 25 bp, Mus musculus
tgatcaggacaacaacggaaagggc

SEQ ID NO: 144248 - DNA, 25 bp, Mus musculus
tgatcagggagacctacttggttcc

SEQ ID NO: 144249 - DNA, 25 bp, Mus musculus
tgatcagggaggagcaagacttcca

SEQ ID NO: 144250 - DNA, 25 bp, Mus musculus
tgatcagtgggctaacgaggtgacc

SEQ ID NO: 144251 - DNA, 25 bp, Mus musculus
tgatcatagtcagcgctatcctggg

SEQ ID NO: 144252 - DNA, 25 bp, Mus musculus
tgatcatcccgaatcctggtgggcg

SEQ ID NO: 144253 - DNA, 25 bp, Mus musculus
tgatcatgatgagtcaccacctcga

SEQ ID NO: 144254 - DNA, 25 bp, Mus musculus
tgatcatgcatacccacccttggga

SEQ ID NO: 144255 - DNA, 25 bp, Mus musculus
tgatcatgctgctgggacgtcctac

SEQ ID NO: 144256 - DNA, 25 bp, Mus musculus
tgatcatggcagctcggaccagtca

SEQ ID NO: 144257 - DNA, 25 bp, Mus musculus
tgatcatggctacaaacagaccaga

SEQ ID NO: 144258 - DNA, 25 bp, Mus musculus
tgatcattatcgaggtcacaaccaa

SEQ ID NO: 144259 - DNA, 25 bp, Mus musculus
tgatcattattcaggcatgccgtgg

SEQ ID NO: 144260 - DNA, 25 bp, Mus musculus
tgatcattgatgaggacacccagga

SEQ ID NO: 144261 - DNA, 25 bp, Mus musculus
tgatccaacagtcagagatgaggcg

SEQ ID NO: 144262 - DNA, 25 bp, Mus musculus
tgatccaacccgtagaaaagtctgt

SEQ ID NO: 144263 - DNA, 25 bp, Mus musculus
tgatccaactctatgactctggtgg

SEQ ID NO: 144264 - DNA, 25 bp, Mus musculus
tgatccaagtaaaggaagacatggt

SEQ ID NO: 144265 - DNA, 25 bp, Mus musculus
tgatccacaacatacggtgaagcct

SEQ ID NO: 144266 - DNA, 25 bp, Mus musculus
tgatccaccctaaagcacgaattat

SEQ ID NO: 144267 - DNA, 25 bp, Mus musculus
tgatccagacatgcgaacagtacca

SEQ ID NO: 144268 - DNA, 25 bp, Mus musculus
tgatccagacctctacaagcaaatg

SEQ ID NO: 144269 - DNA, 25 bp, Mus musculus
tgatccagatgagaacaaaccactg

SEQ ID NO: 144270 - DNA, 25 bp, Mus musculus
tgatccagcaactggctgcctactg

SEQ ID NO: 144271 - DNA, 25 bp, Mus musculus
tgatccagcaccatatagaagcctg

SEQ ID NO: 144272 - DNA, 25 bp, Mus musculus
tgatccagcggctgtcgcttcagga

SEQ ID NO: 144273 - DNA, 25 bp, Mus musculus
tgatccaggaacaactgcgctatgg

SEQ ID NO: 144274 - DNA, 25 bp, Mus musculus
tgatccaggaatccgactgcggcgt

SEQ ID NO: 144275 - DNA, 25 bp, Mus musculus
tgatccagggagctttcaccagtga

SEQ ID NO: 144276 - DNA, 25 bp, Mus musculus
tgatccagggccagaacttcgtgac

SEQ ID NO: 144277 - DNA, 25 bp, Mus musculus
tgatccagtccctgtcaagcaggag

SEQ ID NO: 144278 - DNA, 25 bp, Mus musculus
tgatccatataacccagcaagctga

SEQ ID NO: 144279 - DNA, 25 bp, Mus musculus
tgatccatgagaatgcgtcacagcc

SEQ ID NO: 144280 - DNA, 25 bp, Mus musculus
tgatccatgatcctgttaaccgcga

SEQ ID NO: 144281 - DNA, 25 bp, Mus musculus
tgatccatgttgcagatgtgggccc

SEQ ID NO: 144282 - DNA, 25 bp, Mus musculus
tgatccccaagatgtcgcaatgctg

SEQ ID NO: 144283 - DNA, 25 bp, Mus musculus
tgatccccatgttgagctctgcaag

SEQ ID NO: 144284 - DNA, 25 bp, Mus musculus
tgatccccgggccaattttgaccag

SEQ ID NO: 144285 - DNA, 25 bp, Mus musculus
tgatcccctacattgagcactggcc

SEQ ID NO: 144286 - DNA, 25 bp, Mus musculus
tgatcccgccaaaagaattactctc

SEQ ID NO: 144287 - DNA, 25 bp, Mus musculus
tgatcccggcgcctacagatgcagc

SEQ ID NO: 144288 - DNA, 25 bp, Mus musculus
tgatccctattcaagtgcagagccg

SEQ ID NO: 144289 - DNA, 25 bp, Mus musculus
tgatccctgactctacgaagactgc

SEQ ID NO: 144290 - DNA, 25 bp, Mus musculus
tgatccctgtactgacgtcaaagag

SEQ ID NO: 144291 - DNA, 25 bp, Mus musculus
tgatccgagatgaccgtgaatcccg

SEQ ID NO: 144292 - DNA, 25 bp, Mus musculus
tgatccgattcattgcccagcagcg

SEQ ID NO: 144293 - DNA, 25 bp, Mus musculus
tgatccggaagcgtatcaaagtctg

SEQ ID NO: 144294 - DNA, 25 bp, Mus musculus
tgatccggaaggacatggtggaccc

SEQ ID NO: 144295 - DNA, 25 bp, Mus musculus
tgatccggctagatgaagttcccaa

SEQ ID NO: 144296 - DNA, 25 bp, Mus musculus
tgatccggctgagggcgatcccaca

SEQ ID NO: 144297 - DNA, 25 bp, Mus musculus
tgatccgggaaaagctagcagaggt

SEQ ID NO: 144298 - DNA, 25 bp, Mus musculus
tgatccgggacatgaccttgcacag

SEQ ID NO: 144299 - DNA, 25 bp, Mus musculus
tgatccgggccatcttgaaagtccc

SEQ ID NO: 144300 - DNA, 25 bp, Mus musculus
tgatccgtgacatggagttggctgt

SEQ ID NO: 144301 - DNA, 25 bp, Mus musculus
tgatcctaaaggaagaggccaactc

SEQ ID NO: 144302 - DNA, 25 bp, Mus musculus
tgatcctcagaagggaaacgtctac

SEQ ID NO: 144303 - DNA, 25 bp, Mus musculus
tgatcctcgatgtggcctgtggcac

SEQ ID NO: 144304 - DNA, 25 bp, Mus musculus
tgatcctgagagactaacagctgga

SEQ ID NO: 144305 - DNA, 25 bp, Mus musculus
tgatcctgccagagccactgactaa

SEQ ID NO: 144306 - DNA, 25 bp, Mus musculus
tgatcctgcgcctgaagagtgtccg

SEQ ID NO: 144307 - DNA, 25 bp, Mus musculus
tgatcctggccctgcaactactggg

SEQ ID NO: 144308 - DNA, 25 bp, Mus musculus
tgatcctggctaccgacatggcaag

SEQ ID NO: 144309 - DNA, 25 bp, Mus musculus
tgatcctgtctgaagcctacacgga

SEQ ID NO: 144310 - DNA, 25 bp, Mus musculus
tgatccttctagacccttcagtgaa

SEQ ID NO: 144311 - DNA, 25 bp, Mus musculus
tgatcgacattccagagtagccacc

SEQ ID NO: 144312 - DNA, 25 bp, Mus musculus
tgatcgaccgaattgagtacaacgt

SEQ ID NO: 144313 - DNA, 25 bp, Mus musculus
tgatcgaccgcatggtcagcctgca

SEQ ID NO: 144314 - DNA, 25 bp, Mus musculus
tgatcgaccggatgaaggagtcctc

SEQ ID NO: 144315 - DNA, 25 bp, Mus musculus
tgatcgacctctacagcaaccaggg

SEQ ID NO: 144316 - DNA, 25 bp, Mus musculus
tgatcgactccatggccaactcgtt

SEQ ID NO: 144317 - DNA, 25 bp, Mus musculus
tgatcgagaacaagttcagcctaag

SEQ ID NO: 144318 - DNA, 25 bp, Mus musculus
tgatcgagaagctggacatcaagct

SEQ ID NO: 144319 - DNA, 25 bp, Mus musculus
tgatcgagacactaaccaagacggc

SEQ ID NO: 144320 - DNA, 25 bp, Mus musculus
tgatcgagccttgccggccaatgaa

SEQ ID NO: 144321 - DNA, 25 bp, Mus musculus
tgatcgagtcatcccttctcaggag

SEQ ID NO: 144322 - DNA, 25 bp, Mus musculus
tgatcgatcctctgagcagcgtcct

SEQ ID NO: 144323 - DNA, 25 bp, Mus musculus
tgatcgcagcgctgatgagcttcct

SEQ ID NO: 144324 - DNA, 25 bp, Mus musculus
tgatcgccattgcaacaggaggacg

SEQ ID NO: 144325 - DNA, 25 bp, Mus musculus
tgatcgctggctgtcggagaactgc

SEQ ID NO: 144326 - DNA, 25 bp, Mus musculus
tgatcggcctctacgtctttgagcg

SEQ ID NO: 144327 - DNA, 25 bp, Mus musculus
tgatcggtctcaccaagtccgtggc

SEQ ID NO: 144328 - DNA, 25 bp, Mus musculus
tgatcgtagcaggaggaaacacgct

SEQ ID NO: 144329 - DNA, 25 bp, Mus musculus
tgatcgtcatcatcaaatcacagca

SEQ ID NO: 144330 - DNA, 25 bp, Mus musculus
tgatcgtgtgcgcagcattgccaag

SEQ ID NO: 144331 - DNA, 25 bp, Mus musculus
tgatcgttccttcttccacctgtaa

SEQ ID NO: 144332 - DNA, 25 bp, Mus musculus
tgatctacgtcttcccgctctggtg

SEQ ID NO: 144333 - DNA, 25 bp, Mus musculus
tgatctattgcattcacgcgctaag

SEQ ID NO: 144334 - DNA, 25 bp, Mus musculus
tgatctcaacgttttaaaggcccag

SEQ ID NO: 144335 - DNA, 25 bp, Mus musculus
tgatctcacggcaactgctaacaga

SEQ ID NO: 144336 - DNA, 25 bp, Mus musculus
tgatctcacggcagctccaagagtt

SEQ ID NO: 144337 - DNA, 25 bp, Mus musculus
tgatctcaggactgctgtactggag

SEQ ID NO: 144338 - DNA, 25 bp, Mus musculus
tgatctccatctgtgggccctgacg

SEQ ID NO: 144339 - DNA, 25 bp, Mus musculus
tgatctccatgctggtcatctttcc

SEQ ID NO: 144340 - DNA, 25 bp, Mus musculus
tgatctcccagattgcacaggaggt

SEQ ID NO: 144341 - DNA, 25 bp, Mus musculus
tgatctctgtgggtgagaggcccct

SEQ ID NO: 144342 - DNA, 25 bp, Mus musculus
tgatctgaaagagctgatgccagcc

SEQ ID NO: 144343 - DNA, 25 bp, Mus musculus
tgatctgcagctcagctccgtggag

SEQ ID NO: 144344 - DNA, 25 bp, Mus musculus
tgatctgcccaaaaaagaagacgcc

SEQ ID NO: 144345 - DNA, 25 bp, Mus musculus
tgatctggactgacatggacgggct

SEQ ID NO: 144346 - DNA, 25 bp, Mus musculus
tgatctggccaaatgcactcggtcc

SEQ ID NO: 144347 - DNA, 25 bp, Mus musculus
tgatctgggctggtgcaattcctgg

SEQ ID NO: 144348 - DNA, 25 bp, Mus musculus
tgatctggtggacgaatctgaccca

SEQ ID NO: 144349 - DNA, 25 bp, Mus musculus
tgatctgtacttccacatgactggg

SEQ ID NO: 144350 - DNA, 25 bp, Mus musculus
tgatctgtctctcccagattgtaaa

SEQ ID NO: 144351 - DNA, 25 bp, Mus musculus
tgatctgtgggcctgtaacgcgcca

SEQ ID NO: 144352 - DNA, 25 bp, Mus musculus
tgatctgttaaatgaagccctcctc

SEQ ID NO: 144353 - DNA, 25 bp, Mus musculus
tgatctgttcattaggccggacacc

SEQ ID NO: 144354 - DNA, 25 bp, Mus musculus
tgatcttaccaaggcaggctctgcc

SEQ ID NO: 144355 - DNA, 25 bp, Mus musculus
tgatcttccacaccagagacaaagg

SEQ ID NO: 144356 - DNA, 25 bp, Mus musculus
tgatcttcccaacagtgctgcatgg

SEQ ID NO: 144357 - DNA, 25 bp, Mus musculus
tgatcttccctctaacataacagtg

SEQ ID NO: 144358 - DNA, 25 bp, Mus musculus
tgatcttcgtctcaggccctgtagg

SEQ ID NO: 144359 - DNA, 25 bp, Mus musculus
tgatcttgaactccatgctgtggcg

SEQ ID NO: 144360 - DNA, 25 bp, Mus musculus
tgatcttgaagagatggcatctgga

SEQ ID NO: 144361 - DNA, 25 bp, Mus musculus
tgatcttgaatacgccatgatggtg

SEQ ID NO: 144362 - DNA, 25 bp, Mus musculus
tgatcttgatcactaccgggactgg

SEQ ID NO: 144363 - DNA, 25 bp, Mus musculus
tgatcttggcccagacaagtacttg

SEQ ID NO: 144364 - DNA, 25 bp, Mus musculus
tgatcttgtggctgggagacctcaa

SEQ ID NO: 144365 - DNA, 25 bp, Mus musculus
tgatctttcaccttcgctgagcttc

SEQ ID NO: 144366 - DNA, 25 bp, Mus musculus
tgatctttccacgatccctcggtgg

SEQ ID NO: 144367 - DNA, 25 bp, Mus musculus
tgatctttgctttagcccactttga

SEQ ID NO: 144368 - DNA, 25 bp, Mus musculus
tgatctttgtgctctcagctgtgca

SEQ ID NO: 144369 - DNA, 25 bp, Mus musculus
tgatctttttggagccggaacagag

SEQ ID NO: 144370 - DNA, 25 bp, Mus musculus
tgatcttttttgtcgctgccacggt

SEQ ID NO: 144371 - DNA, 25 bp, Mus musculus
tgatgaaaactatggacctggaccc

SEQ ID NO: 144372 - DNA, 25 bp, Mus musculus
tgatgaaaatccaacagaaacttaa

SEQ ID NO: 144373 - DNA, 25 bp, Mus musculus
tgatgaaaatcctcactgagcgtgg

SEQ ID NO: 144374 - DNA, 25 bp, Mus musculus
tgatgaaaccggaccctaacctgat

SEQ ID NO: 144375 - DNA, 25 bp, Mus musculus
tgatgaaactcaaaagcctgggtct

SEQ ID NO: 144376 - DNA, 25 bp, Mus musculus
tgatgaaaggactgtcagcccctta

SEQ ID NO: 144377 - DNA, 25 bp, Mus musculus
tgatgaacattgacgagcagctgcc

SEQ ID NO: 144378 - DNA, 25 bp, Mus musculus
tgatgaaccagaccatggcccgttg

SEQ ID NO: 144379 - DNA, 25 bp, Mus musculus
tgatgaactctacacccgattgttg

SEQ ID NO: 144380 - DNA, 25 bp, Mus musculus
tgatgaagaacttccgccaggagct

SEQ ID NO: 144381 - DNA, 25 bp, Mus musculus
tgatgaagacaagcagtcccggcta

SEQ ID NO: 144382 - DNA, 25 bp, Mus musculus
tgatgaagacgtccaataccgtgtg

SEQ ID NO: 144383 - DNA, 25 bp, Mus musculus
tgatgaagagggtacagcagagctc

SEQ ID NO: 144384 - DNA, 25 bp, Mus musculus
tgatgaagcatcctacggacctgga

SEQ ID NO: 144385 - DNA, 25 bp, Mus musculus
tgatgaagcctttgaccacgaggtc

SEQ ID NO: 144386 - DNA, 25 bp, Mus musculus
tgatgaaggcctgaacgacctgcag

SEQ ID NO: 144387 - DNA, 25 bp, Mus musculus
tgatgaaggtcaacctggaagccgc

SEQ ID NO: 144388 - DNA, 25 bp, Mus musculus
tgatgaaggttagcgagcatgcccc

SEQ ID NO: 144389 - DNA, 25 bp, Mus musculus
tgatgaaggttcaaagtcctgggcc

SEQ ID NO: 144390 - DNA, 25 bp, Mus musculus
tgatgaaggttctggaggtagcggt

SEQ ID NO: 144391 - DNA, 25 bp, Mus musculus
tgatgaatacgaccgaagacgcagg

SEQ ID NO: 144392 - DNA, 25 bp, Mus musculus
tgatgacaccatcctcagcaggcag

SEQ ID NO: 144393 - DNA, 25 bp, Mus musculus
tgatgacacccactcaagaatagag

SEQ ID NO: 144394 - DNA, 25 bp, Mus musculus
tgatgacagcttagccgggaagtca

SEQ ID NO: 144395 - DNA, 25 bp, Mus musculus
tgatgacagttttccctgaggactc

SEQ ID NO: 144396 - DNA, 25 bp, Mus musculus
tgatgacatcggttgaaaggcccac

SEQ ID NO: 144397 - DNA, 25 bp, Mus musculus
tgatgacatctttgggttgagcacg

SEQ ID NO: 144398 - DNA, 25 bp, Mus musculus
tgatgacatgggtttggattccttc

SEQ ID NO: 144399 - DNA, 25 bp, Mus musculus
tgatgaccagaccaacctgaagttg

SEQ ID NO: 144400 - DNA, 25 bp, Mus musculus
tgatgaccatcgaggagtttgccgc

SEQ ID NO: 144401 - DNA, 25 bp, Mus musculus
tgatgacccacgagtgaggacgacc

SEQ ID NO: 144402 - DNA, 25 bp, Mus musculus
tgatgaccccacacttctgaggagg

SEQ ID NO: 144403 - DNA, 25 bp, Mus musculus
tgatgaccccgaatatgaccctggc

SEQ ID NO: 144404 - DNA, 25 bp, Mus musculus
tgatgaccctcaggaatgtcccagc

SEQ ID NO: 144405 - DNA, 25 bp, Mus musculus
tgatgaccgcatgaatgagcctccc

SEQ ID NO: 144406 - DNA, 25 bp, Mus musculus
tgatgacctcacacgaagaatgcgc

SEQ ID NO: 144407 - DNA, 25 bp, Mus musculus
tgatgacctccagcctttagactgt

SEQ ID NO: 144408 - DNA, 25 bp, Mus musculus
tgatgacctcgatgaagacacaccc

SEQ ID NO: 144409 - DNA, 25 bp, Mus musculus
tgatgacctgtgcaacctgccagag

SEQ ID NO: 144410 - DNA, 25 bp, Mus musculus
tgatgacctttctcttcaggagcgg

SEQ ID NO: 144411 - DNA, 25 bp, Mus musculus
tgatgacgaccaacgtgtgggtgaa

SEQ ID NO: 144412 - DNA, 25 bp, Mus musculus
tgatgacggctccagcccagatgag

SEQ ID NO: 144413 - DNA, 25 bp, Mus musculus
tgatgacgtcaaacacagtgaacgc

SEQ ID NO: 144414 - DNA, 25 bp, Mus musculus
tgatgacgttaacccctggactggc

SEQ ID NO: 144415 - DNA, 25 bp, Mus musculus
tgatgactacatctccacgcaggag

SEQ ID NO: 144416 - DNA, 25 bp, Mus musculus
tgatgactacctgcctgacaatgtg

SEQ ID NO: 144417 - DNA, 25 bp, Mus musculus
tgatgactccgtatgtggtgacgcg

SEQ ID NO: 144418 - DNA, 25 bp, Mus musculus
tgatgactcgttcctgcacactgcg

SEQ ID NO: 144419 - DNA, 25 bp, Mus musculus
tgatgagaacttccacttccccgtg

SEQ ID NO: 144420 - DNA, 25 bp, Mus musculus
tgatgagaaggataagggccaccct

SEQ ID NO: 144421 - DNA, 25 bp, Mus musculus
tgatgagacacttggctgcaggctg

SEQ ID NO: 144422 - DNA, 25 bp, Mus musculus
tgatgagacaggaagttatcctctg

SEQ ID NO: 144423 - DNA, 25 bp, Mus musculus
tgatgagaccgaggaatgcatgccc

SEQ ID NO: 144424 - DNA, 25 bp, Mus musculus
tgatgagatcgctgggacagaaccc

SEQ ID NO: 144425 - DNA, 25 bp, Mus musculus
tgatgagattaccacagtccggaag

SEQ ID NO: 144426 - DNA, 25 bp, Mus musculus
tgatgagcacggctttgacaactgt

SEQ ID NO: 144427 - DNA, 25 bp, Mus musculus
tgatgagcatgatcctgtggacagc

SEQ ID NO: 144428 - DNA, 25 bp, Mus musculus
tgatgagccatccacacttgctgga

SEQ ID NO: 144429 - DNA, 25 bp, Mus musculus
tgatgagcccttttccaggcaagac

SEQ ID NO: 144430 - DNA, 25 bp, Mus musculus
tgatgagccggcatgagtacctgcc

SEQ ID NO: 144431 - DNA, 25 bp, Mus musculus
tgatgagctatgctcaggcccagcg

SEQ ID NO: 144432 - DNA, 25 bp, Mus musculus
tgatgagctcttggctgacctcgag

SEQ ID NO: 144433 - DNA, 25 bp, Mus musculus
tgatgaggaacttggccctgcctga

SEQ ID NO: 144434 - DNA, 25 bp, Mus musculus
tgatgaggcaagctctgaagtcctg

SEQ ID NO: 144435 - DNA, 25 bp, Mus musculus
tgatgagggcatagtgtgtgcccat

SEQ ID NO: 144436 - DNA, 25 bp, Mus musculus
tgatgagtctgcagagtgcttcgct

SEQ ID NO: 144437 - DNA, 25 bp, Mus musculus
tgatgagttccagttattgcagaga

SEQ ID NO: 144438 - DNA, 25 bp, Mus musculus
tgatgataacctgcacggctggtac

SEQ ID NO: 144439 - DNA, 25 bp, Mus musculus
tgatgatagagatgacccgaagtac

SEQ ID NO: 144440 - DNA, 25 bp, Mus musculus
tgatgatccctgcacttgattgaga

SEQ ID NO: 144441 - DNA, 25 bp, Mus musculus
tgatgatccctggagagtcggcttg

SEQ ID NO: 144442 - DNA, 25 bp, Mus musculus
tgatgatcctcaccttactgtagca

SEQ ID NO: 144443 - DNA, 25 bp, Mus musculus
tgatgatctccaagtatgaccgcct

SEQ ID NO: 144444 - DNA, 25 bp, Mus musculus
tgatgatctggctaaccgaggcctg

SEQ ID NO: 144445 - DNA, 25 bp, Mus musculus
tgatgatcttaggaggatcgcaacg

SEQ ID NO: 144446 - DNA, 25 bp, Mus musculus
tgatgatgacattggtgacagctgt

SEQ ID NO: 144447 - DNA, 25 bp, Mus musculus
tgatgatgaccctgaccagaagaag

SEQ ID NO: 144448 - DNA, 25 bp, Mus musculus
tgatgatgataccaccataagcctg

SEQ ID NO: 144449 - DNA, 25 bp, Mus musculus
tgatgatgatgaggcagccactgtg

SEQ ID NO: 144450 - DNA, 25 bp, Mus musculus
tgatgatggacatcggctccacacg

SEQ ID NO: 144451 - DNA, 25 bp, Mus musculus
tgatgatgggcctcctggagagctt

SEQ ID NO: 144452 - DNA, 25 bp, Mus musculus
tgatgatgtcatactgtctggaggc

SEQ ID NO: 144453 - DNA, 25 bp, Mus musculus
tgatgatgttgtttgggtccgtgca

SEQ ID NO: 144454 - DNA, 25 bp, Mus musculus
tgatgattaaagaccgctggcggac

SEQ ID NO: 144455 - DNA, 25 bp, Mus musculus
tgatgattgcattcagggtccgacc

SEQ ID NO: 144456 - DNA, 25 bp, Mus musculus
tgatgcaaagatggcttagacagtg

SEQ ID NO: 144457 - DNA, 25 bp, Mus musculus
tgatgcaacccgaaatgtgtaccgc

SEQ ID NO: 144458 - DNA, 25 bp, Mus musculus
tgatgcaagcatggaaactgggccc

SEQ ID NO: 144459 - DNA, 25 bp, Mus musculus
tgatgcacacatagcaatgcgtggc

SEQ ID NO: 144460 - DNA, 25 bp, Mus musculus
tgatgcacgattcacacggcagacg

SEQ ID NO: 144461 - DNA, 25 bp, Mus musculus
tgatgcacgggaacaatggtccaac

SEQ ID NO: 144462 - DNA, 25 bp, Mus musculus
tgatgcactagcaggccctggcatt

SEQ ID NO: 144463 - DNA, 25 bp, Mus musculus
tgatgcactcacctttgccgaagta

SEQ ID NO: 144464 - DNA, 25 bp, Mus musculus
tgatgcagacactgaacacgctgag

SEQ ID NO: 144465 - DNA, 25 bp, Mus musculus
tgatgcagcctaatggagagagcct

SEQ ID NO: 144466 - DNA, 25 bp, Mus musculus
tgatgcagcgctgtgacctagaggc

SEQ ID NO: 144467 - DNA, 25 bp, Mus musculus
tgatgcagctagtctggaaggaacc

SEQ ID NO: 144468 - DNA, 25 bp, Mus musculus
tgatgcaggacctcatggccaggat

SEQ ID NO: 144469 - DNA, 25 bp, Mus musculus
tgatgcaggccgagttctctgtgct

SEQ ID NO: 144470 - DNA, 25 bp, Mus musculus
tgatgcagtccttatacaaaaccga

SEQ ID NO: 144471 - DNA, 25 bp, Mus musculus
tgatgcatctgacactctagctttg

SEQ ID NO: 144472 - DNA, 25 bp, Mus musculus
tgatgccaaatggacaggatatgtc

SEQ ID NO: 144473 - DNA, 25 bp, Mus musculus
tgatgccaacatactggtcacgctg

SEQ ID NO: 144474 - DNA, 25 bp, Mus musculus
tgatgccaacgataacgctccggag

SEQ ID NO: 144475 - DNA, 25 bp, Mus musculus
tgatgccaacgcaagttacttaaga

SEQ ID NO: 144476 - DNA, 25 bp, Mus musculus
tgatgccaagttcaccaaaggcgag

SEQ ID NO: 144477 - DNA, 25 bp, Mus musculus
tgatgccacagatgaggacctcacc

SEQ ID NO: 144478 - DNA, 25 bp, Mus musculus
tgatgccaccacaggcaatgtgctg

SEQ ID NO: 144479 - DNA, 25 bp, Mus musculus
tgatgccaccggtcgggcgggtatg

SEQ ID NO: 144480 - DNA, 25 bp, Mus musculus
tgatgccagttttatgttacaatct

SEQ ID NO: 144481 - DNA, 25 bp, Mus musculus
tgatgccatctcacgtctgctggag

SEQ ID NO: 144482 - DNA, 25 bp, Mus musculus
tgatgccatgctcccataccttgtc

SEQ ID NO: 144483 - DNA, 25 bp, Mus musculus
tgatgcccaccgcaaggagatctgc

SEQ ID NO: 144484 - DNA, 25 bp, Mus musculus
tgatgcccagtctgcaggaagcgct

SEQ ID NO: 144485 - DNA, 25 bp, Mus musculus
tgatgcccgtgtggagctctgacgc

SEQ ID NO: 144486 - DNA, 25 bp, Mus musculus
tgatgccgaagactagaagtgtcac

SEQ ID NO: 144487 - DNA, 25 bp, Mus musculus
tgatgccgcagatgaggaccctgta

SEQ ID NO: 144488 - DNA, 25 bp, Mus musculus
tgatgccgtggaagctctcactgcg

SEQ ID NO: 144489 - DNA, 25 bp, Mus musculus
tgatgccgttgggttcacctttccc

SEQ ID NO: 144490 - DNA, 25 bp, Mus musculus
tgatgcctacgaagaagtaacagat

SEQ ID NO: 144491 - DNA, 25 bp, Mus musculus
tgatgccttaaagagccgtgagcct

SEQ ID NO: 144492 - DNA, 25 bp, Mus musculus
tgatgccttcatccaggtagccctg

SEQ ID NO: 144493 - DNA, 25 bp, Mus musculus
tgatgccttgcaaagctcgcagcct

SEQ ID NO: 144494 - DNA, 25 bp, Mus musculus
tgatgccttgtctcaggacttctcc

SEQ ID NO: 144495 - DNA, 25 bp, Mus musculus
tgatgcgaagtgatgggacctctct

SEQ ID NO: 144496 - DNA, 25 bp, Mus musculus
tgatgcgattctgctggctgatggc

SEQ ID NO: 144497 - DNA, 25 bp, Mus musculus
tgatgcgattgcacacttggcgcac

SEQ ID NO: 144498 - DNA, 25 bp, Mus musculus
tgatgcgctggaactaacactgggc

SEQ ID NO: 144499 - DNA, 25 bp, Mus musculus
tgatgcggaaactcaccggaaggtg

SEQ ID NO: 144500 - DNA, 25 bp, Mus musculus
tgatgcggtatatctcccatgtgcc

SEQ ID NO: 144501 - DNA, 25 bp, Mus musculus
tgatgcggttctccttggacactgg

SEQ ID NO: 144502 - DNA, 25 bp, Mus musculus
tgatgctaaactgggagccgggcct

SEQ ID NO: 144503 - DNA, 25 bp, Mus musculus
tgatgctaacgttctgactaacgag

SEQ ID NO: 144504 - DNA, 25 bp, Mus musculus
tgatgctagcatcgaacccgctgtg

SEQ ID NO: 144505 - DNA, 25 bp, Mus musculus
tgatgctcgtaagcgcacgcagtga

SEQ ID NO: 144506 - DNA, 25 bp, Mus musculus
tgatgctctgtccttaaactgcagc

SEQ ID NO: 144507 - DNA, 25 bp, Mus musculus
tgatgctctgtgtaacctgcgtgaa

SEQ ID NO: 144508 - DNA, 25 bp, Mus musculus
tgatgctgacaacaagactgaccct

SEQ ID NO: 144509 - DNA, 25 bp, Mus musculus
tgatgctgatgaactgtgggctcga

SEQ ID NO: 144510 - DNA, 25 bp, Mus musculus
tgatgctgcaacacttaaaaccatg

SEQ ID NO: 144511 - DNA, 25 bp, Mus musculus
tgatgctgcgaagctgatggagttt

SEQ ID NO: 144512 - DNA, 25 bp, Mus musculus
tgatgctggaacaaacatggccgtc

SEQ ID NO: 144513 - DNA, 25 bp, Mus musculus
tgatgctggcgctggctagccacct

SEQ ID NO: 144514 - DNA, 25 bp, Mus musculus
tgatgctggtctgccatgctagcct

SEQ ID NO: 144515 - DNA, 25 bp, Mus musculus
tgatgctgtcaagctgagccacgtg

SEQ ID NO: 144516 - DNA, 25 bp, Mus musculus
tgatgctgtggaggtcaaggtcaaa

SEQ ID NO: 144517 - DNA, 25 bp, Mus musculus
tgatgctgttgtctttcacccaaag

SEQ ID NO: 144518 - DNA, 25 bp, Mus musculus
tgatgctttgcaagggtcttacaag

SEQ ID NO: 144519 - DNA, 25 bp, Mus musculus
tgatggaacctgacatcccaggcca

SEQ ID NO: 144520 - DNA, 25 bp, Mus musculus
tgatggaacctgtaagacctgtgtc

SEQ ID NO: 144521 - DNA, 25 bp, Mus musculus
tgatggaagagtgcaagcgactcca

SEQ ID NO: 144522 - DNA, 25 bp, Mus musculus
tgatggacaagagagcaccagggat

SEQ ID NO: 144523 - DNA, 25 bp, Mus musculus
tgatggacacgcacctgaaggaaca

SEQ ID NO: 144524 - DNA, 25 bp, Mus musculus
tgatggacaggaaaagtttgaaacc

SEQ ID NO: 144525 - DNA, 25 bp, Mus musculus
tgatggacatggaggaatacgagcc

SEQ ID NO: 144526 - DNA, 25 bp, Mus musculus
tgatggaccacagcaagtccccttt

SEQ ID NO: 144527 - DNA, 25 bp, Mus musculus
tgatggaccactcaagttccctgga

SEQ ID NO: 144528 - DNA, 25 bp, Mus musculus
tgatggacgtgcatatcttctcggc

SEQ ID NO: 144529 - DNA, 25 bp, Mus musculus
tgatggactctacgacagcaacggc

SEQ ID NO: 144530 - DNA, 25 bp, Mus musculus
tgatggacttgaacaagaaggagcc

SEQ ID NO: 144531 - DNA, 25 bp, Mus musculus
tgatggacttggagttgccaccgcc

SEQ ID NO: 144532 - DNA, 25 bp, Mus musculus
tgatggagagccttgtgaccagtct

SEQ ID NO: 144533 - DNA, 25 bp, Mus musculus
tgatggagcaacactagcactgtcg

SEQ ID NO: 144534 - DNA, 25 bp, Mus musculus
tgatggagctactactgtaatgcgt

SEQ ID NO: 144535 - DNA, 25 bp, Mus musculus
tgatggagctcctcgtaaactaccg

SEQ ID NO: 144536 - DNA, 25 bp, Mus musculus
tgatggagcttccacccggctaatg

SEQ ID NO: 144537 - DNA, 25 bp, Mus musculus
tgatggaggcctcaaaggacttcca

SEQ ID NO: 144538 - DNA, 25 bp, Mus musculus
tgatggatcctgtccccgaagtggc

SEQ ID NO: 144539 - DNA, 25 bp, Mus musculus
tgatggatgacctgcagtcccagaa

SEQ ID NO: 144540 - DNA, 25 bp, Mus musculus
tgatggattgagcaggccttcccgc

SEQ ID NO: 144541 - DNA, 25 bp, Mus musculus
tgatggcaaaagcagagtacctctg

SEQ ID NO: 144542 - DNA, 25 bp, Mus musculus
tgatggcaattactacaacgcgagg

SEQ ID NO: 144543 - DNA, 25 bp, Mus musculus
tgatggcacaatatggcacgcccaa

SEQ ID NO: 144544 - DNA, 25 bp, Mus musculus
tgatggcacagacgagtacaacagc

SEQ ID NO: 144545 - DNA, 25 bp, Mus musculus
tgatggcacgatgcttctggctgcg

SEQ ID NO: 144546 - DNA, 25 bp, Mus musculus
tgatggcactttagacaccccaacg

SEQ ID NO: 144547 - DNA, 25 bp, Mus musculus
tgatggcagtgacaacaagaatgac

SEQ ID NO: 144548 - DNA, 25 bp, Mus musculus
tgatggcatcttgggcatgggctac

SEQ ID NO: 144549 - DNA, 25 bp, Mus musculus
tgatggccaacaaaactaggatttt

SEQ ID NO: 144550 - DNA, 25 bp, Mus musculus
tgatggccacaggtgatctggacca

SEQ ID NO: 144551 - DNA, 25 bp, Mus musculus
tgatggccccgggaagggcctcggt

SEQ ID NO: 144552 - DNA, 25 bp, Mus musculus
tgatggccctcacttcgctagcttg

SEQ ID NO: 144553 - DNA, 25 bp, Mus musculus
tgatggcctacctgaggagcaacca

SEQ ID NO: 144554 - DNA, 25 bp, Mus musculus
tgatggcctgcaaagcttaccggga

SEQ ID NO: 144555 - DNA, 25 bp, Mus musculus
tgatggcgacaagaagcttcctgag

SEQ ID NO: 144556 - DNA, 25 bp, Mus musculus
tgatggcgctgtccaatcacctgaa

SEQ ID NO: 144557 - DNA, 25 bp, Mus musculus
tgatggcgtccagctagaaggaact

SEQ ID NO: 144558 - DNA, 25 bp, Mus musculus
tgatggcgtgcagcaaacaacctac

SEQ ID NO: 144559 - DNA, 25 bp, Mus musculus
tgatggcgttgagcaagaccttcgg

SEQ ID NO: 144560 - DNA, 25 bp, Mus musculus
tgatggctccaagaacttcgatggc

SEQ ID NO: 144561 - DNA, 25 bp, Mus musculus
tgatggctccgtggaccagtgaacg

SEQ ID NO: 144562 - DNA, 25 bp, Mus musculus
tgatggctcgaaactaaatgtgacc

SEQ ID NO: 144563 - DNA, 25 bp, Mus musculus
tgatggctcggagccacgacctgct

SEQ ID NO: 144564 - DNA, 25 bp, Mus musculus
tgatggctgaaaagatccggccacc

SEQ ID NO: 144565 - DNA, 25 bp, Mus musculus
tgatggctgtcttgagaggctcacc

SEQ ID NO: 144566 - DNA, 25 bp, Mus musculus
tgatggctgttttctaatctcttcc

SEQ ID NO: 144567 - DNA, 25 bp, Mus musculus
tgatgggaagccacacgcatgggaa

SEQ ID NO: 144568 - DNA, 25 bp, Mus musculus
tgatgggacccatccatgtaaaagg

SEQ ID NO: 144569 - DNA, 25 bp, Mus musculus
tgatgggatcctgggcctcggcttc

SEQ ID NO: 144570 - DNA, 25 bp, Mus musculus
tgatgggcaaacactctccaaagag

SEQ ID NO: 144571 - DNA, 25 bp, Mus musculus
tgatgggcagatgcaacctgtgccc

SEQ ID NO: 144572 - DNA, 25 bp, Mus musculus
tgatgggcctttggctcaacgcctg

SEQ ID NO: 144573 - DNA, 25 bp, Mus musculus
tgatgggcttattgaccaacctagc

SEQ ID NO: 144574 - DNA, 25 bp, Mus musculus
tgatgggtcccaagctgctggcaga

SEQ ID NO: 144575 - DNA, 25 bp, Mus musculus
tgatgggttaccagcaggcattgcc

SEQ ID NO: 144576 - DNA, 25 bp, Mus musculus
tgatggtaaccgtcctgaagctcct

SEQ ID NO: 144577 - DNA, 25 bp, Mus musculus
tgatggtacatccacgctgcgtgaa

SEQ ID NO: 144578 - DNA, 25 bp, Mus musculus
tgatggtaccatctttcacaggtcc

SEQ ID NO: 144579 - DNA, 25 bp, Mus musculus
tgatggtattttgcgaggcatcacc

SEQ ID NO: 144580 - DNA, 25 bp, Mus musculus
tgatggtcagtgaccgcatggacct

SEQ ID NO: 144581 - DNA, 25 bp, Mus musculus
tgatggtctatgagtggatgtcccc

SEQ ID NO: 144582 - DNA, 25 bp, Mus musculus
tgatggtctgtaagccaaggaagcc

SEQ ID NO: 144583 - DNA, 25 bp, Mus musculus
tgatggtgaagtcccctctgaaccg

SEQ ID NO: 144584 - DNA, 25 bp, Mus musculus
tgatggtgaatgtagaggaaatctc

SEQ ID NO: 144585 - DNA, 25 bp, Mus musculus
tgatggtgaccaacgacggtgctac

SEQ ID NO: 144586 - DNA, 25 bp, Mus musculus
tgatggtgacccagcagacggttcg

SEQ ID NO: 144587 - DNA, 25 bp, Mus musculus
tgatggtgaccgcaggacccattca

SEQ ID NO: 144588 - DNA, 25 bp, Mus musculus
tgatggtgagatcactagagcccca

SEQ ID NO: 144589 - DNA, 25 bp, Mus musculus
tgatggtgatcagttaggctcttcc

SEQ ID NO: 144590 - DNA, 25 bp, Mus musculus
tgatggtggcccagaaaaattaatc

SEQ ID NO: 144591 - DNA, 25 bp, Mus musculus
tgatggtgggcccaaacttccgagt

SEQ ID NO: 144592 - DNA, 25 bp, Mus musculus
tgatggttaccagggacacgtgctc

SEQ ID NO: 144593 - DNA, 25 bp, Mus musculus
tgatggttcccctacggacagaagc

SEQ ID NO: 144594 - DNA, 25 bp, Mus musculus
tgatggttgcaaggtagcaggccac

SEQ ID NO: 144595 - DNA, 25 bp, Mus musculus
tgatgtacctaaactggtgactgag

SEQ ID NO: 144596 - DNA, 25 bp, Mus musculus
tgatgtactgaatgcccggaaccga

SEQ ID NO: 144597 - DNA, 25 bp, Mus musculus
tgatgtactgtcatggaagtggtgt

SEQ ID NO: 144598 - DNA, 25 bp, Mus musculus
tgatgtagaccgcacccttgaggaa

SEQ ID NO: 144599 - DNA, 25 bp, Mus musculus
tgatgtagccactattcagccctct

SEQ ID NO: 144600 - DNA, 25 bp, Mus musculus
tgatgtagcgcaggtctcagacagc

SEQ ID NO: 144601 - DNA, 25 bp, Mus musculus
tgatgtagctttgttcggcacccgt

SEQ ID NO: 144602 - DNA, 25 bp, Mus musculus
tgatgtatacaggttccaacgtgct

SEQ ID NO: 144603 - DNA, 25 bp, Mus musculus
tgatgtatcaggacgagtgtgaccg

SEQ ID NO: 144604 - DNA, 25 bp, Mus musculus
tgatgtattgttccctagcctatgg

SEQ ID NO: 144605 - DNA, 25 bp, Mus musculus
tgatgtcaaagtggcaacagatccc

SEQ ID NO: 144606 - DNA, 25 bp, Mus musculus
tgatgtcaaagtggctcaccatggg

SEQ ID NO: 144607 - DNA, 25 bp, Mus musculus
tgatgtcaagatgactaagcttgga

SEQ ID NO: 144608 - DNA, 25 bp, Mus musculus
tgatgtcacagcagtttgcacagcc

SEQ ID NO: 144609 - DNA, 25 bp, Mus musculus
tgatgtcaccaggaacagctatcgg

SEQ ID NO: 144610 - DNA, 25 bp, Mus musculus
tgatgtcagcatgcagcaagccagc

SEQ ID NO: 144611 - DNA, 25 bp, Mus musculus
tgatgtcagtagcaacccagcagta

SEQ ID NO: 144612 - DNA, 25 bp, Mus musculus
tgatgtcatgagtatttgtggaacc

SEQ ID NO: 144613 - DNA, 25 bp, Mus musculus
tgatgtccacctctcttgggttgga

SEQ ID NO: 144614 - DNA, 25 bp, Mus musculus
tgatgtcccatgactggcctccagt

SEQ ID NO: 144615 - DNA, 25 bp, Mus musculus
tgatgtccgagatgcccctctgaag

SEQ ID NO: 144616 - DNA, 25 bp, Mus musculus
tgatgtcctcaaacgagatgcccac

SEQ ID NO: 144617 - DNA, 25 bp, Mus musculus
tgatgtccttttcccactggctgtg

SEQ ID NO: 144618 - DNA, 25 bp, Mus musculus
tgatgtcgacagtgaatcctcagat

SEQ ID NO: 144619 - DNA, 25 bp, Mus musculus
tgatgtcggaccaggatgtcaacgc

SEQ ID NO: 144620 - DNA, 25 bp, Mus musculus
tgatgtctgcatttccctgggttcc

SEQ ID NO: 144621 - DNA, 25 bp, Mus musculus
tgatgtctgcttggcggtaaaccgt

SEQ ID NO: 144622 - DNA, 25 bp, Mus musculus
tgatgtctgttgcaagacctgtccc

SEQ ID NO: 144623 - DNA, 25 bp, Mus musculus
tgatgtgaagatatggaccgcgcac

SEQ ID NO: 144624 - DNA, 25 bp, Mus musculus
tgatgtgacccgcttcatgatcgag

SEQ ID NO: 144625 - DNA, 25 bp, Mus musculus
tgatgtgacgcccaagatctggcca

SEQ ID NO: 144626 - DNA, 25 bp, Mus musculus
tgatgtgacttatgcggccctggtg

SEQ ID NO: 144627 - DNA, 25 bp, Mus musculus
tgatgtgcaaaacccagatgacgtg

SEQ ID NO: 144628 - DNA, 25 bp, Mus musculus
tgatgtgcaacacactgcagtccag

SEQ ID NO: 144629 - DNA, 25 bp, Mus musculus
tgatgtgccccgaaaaaggaaactc

SEQ ID NO: 144630 - DNA, 25 bp, Mus musculus
tgatgtgccctcttcccctgaaaag

SEQ ID NO: 144631 - DNA, 25 bp, Mus musculus
tgatgtgcctaaacgctcccttgaa

SEQ ID NO: 144632 - DNA, 25 bp, Mus musculus
tgatgtggactacaacgagcttgcc

SEQ ID NO: 144633 - DNA, 25 bp, Mus musculus
tgatgtgggacgtttgcctgctacc

SEQ ID NO: 144634 - DNA, 25 bp, Mus musculus
tgatgtgtagtgaacctcccgtgtg

SEQ ID NO: 144635 - DNA, 25 bp, Mus musculus
tgatgtgtcaagcactaccacccag

SEQ ID NO: 144636 - DNA, 25 bp, Mus musculus
tgatgtgtccaccagaaacctcctg

SEQ ID NO: 144637 - DNA, 25 bp, Mus musculus
tgatgttaaacatgggaggccccga

SEQ ID NO: 144638 - DNA, 25 bp, Mus musculus
tgatgttacctaggcaccattggag

SEQ ID NO: 144639 - DNA, 25 bp, Mus musculus
tgatgttatctcacctggaaggccc

SEQ ID NO: 144640 - DNA, 25 bp, Mus musculus
tgatgttcccctgtgcaaagaggac

SEQ ID NO: 144641 - DNA, 25 bp, Mus musculus
tgatgttccgatgacgcctttgcgg

SEQ ID NO: 144642 - DNA, 25 bp, Mus musculus
tgatgttcgagcatatgacaccgta

SEQ ID NO: 144643 - DNA, 25 bp, Mus musculus
tgatgttctccccactgaagcagct

SEQ ID NO: 144644 - DNA, 25 bp, Mus musculus
tgatgttgacaaccatgagcccacg

SEQ ID NO: 144645 - DNA, 25 bp, Mus musculus
tgatgttggccacctgttcagcaga

SEQ ID NO: 144646 - DNA, 25 bp, Mus musculus
tgatgttgtgtagaccgtttctaag

SEQ ID NO: 144647 - DNA, 25 bp, Mus musculus
tgatgtttcccactcctgagctggc

SEQ ID NO: 144648 - DNA, 25 bp, Mus musculus
tgattaaacagcagcgcctgaaccg

SEQ ID NO: 144649 - DNA, 25 bp, Mus musculus
tgattaaatggaccccgcgttccgg

SEQ ID NO: 144650 - DNA, 25 bp, Mus musculus
tgattaaccacaccaaaccacggaa

SEQ ID NO: 144651 - DNA, 25 bp, Mus musculus
tgattaacccagagggagttctcct

SEQ ID NO: 144652 - DNA, 25 bp, Mus musculus
tgattaaccctctagagaccagctt

SEQ ID NO: 144653 - DNA, 25 bp, Mus musculus
tgattaacctgcacagcaaatacag

SEQ ID NO: 144654 - DNA, 25 bp, Mus musculus
tgattaagccaaacaccaagccatg

SEQ ID NO: 144655 - DNA, 25 bp, Mus musculus
tgattaaggagaacgaccccagtgg

SEQ ID NO: 144656 - DNA, 25 bp, Mus musculus
tgattacaaacgcattaaagcctgg

SEQ ID NO: 144657 - DNA, 25 bp, Mus musculus
tgattaccggtgtggaaaggccttg

SEQ ID NO: 144658 - DNA, 25 bp, Mus musculus
tgattacctgtgcatccgcgggtgc

SEQ ID NO: 144659 - DNA, 25 bp, Mus musculus
tgattagagtaacccagccggagct

SEQ ID NO: 144660 - DNA, 25 bp, Mus musculus
tgattatacaccactgagtctggct

SEQ ID NO: 144661 - DNA, 25 bp, Mus musculus
tgattatattcctcagctggccaaa

SEQ ID NO: 144662 - DNA, 25 bp, Mus musculus
tgattatccctcactcgggctggga

SEQ ID NO: 144663 - DNA, 25 bp, Mus musculus
tgattatgaaaaagccaaatcgctc

SEQ ID NO: 144664 - DNA, 25 bp, Mus musculus
tgattcaactgggaaacagctggtg

SEQ ID NO: 144665 - DNA, 25 bp, Mus musculus
tgattcacaccagagtggcggcaca

SEQ ID NO: 144666 - DNA, 25 bp, Mus musculus
tgattcagatccctggtgggcagct

SEQ ID NO: 144667 - DNA, 25 bp, Mus musculus
tgattcagccttgcttgtcacagct

SEQ ID NO: 144668 - DNA, 25 bp, Mus musculus
tgattcaggaatggtagctcccact

SEQ ID NO: 144669 - DNA, 25 bp, Mus musculus
tgattccaacaaaccagtccgagag

SEQ ID NO: 144670 - DNA, 25 bp, Mus musculus
tgattccaatcatcgcatgcccaaa

SEQ ID NO: 144671 - DNA, 25 bp, Mus musculus
tgattccagtggtgccagccgtggt

SEQ ID NO: 144672 - DNA, 25 bp, Mus musculus
tgattccatagtgcgtcagcgtgac

SEQ ID NO: 144673 - DNA, 25 bp, Mus musculus
tgattcccaacgtgtgtgccgcagt

SEQ ID NO: 144674 - DNA, 25 bp, Mus musculus
tgattcccaccgagttacgccggga

SEQ ID NO: 144675 - DNA, 25 bp, Mus musculus
tgattccgccccagatgaggagacc

SEQ ID NO: 144676 - DNA, 25 bp, Mus musculus
tgattcgaaatgagacggtgcccag

SEQ ID NO: 144677 - DNA, 25 bp, Mus musculus
tgattcgagccagcaagcagtggtt

SEQ ID NO: 144678 - DNA, 25 bp, Mus musculus
tgattcgagtagaagggaacagcca

SEQ ID NO: 144679 - DNA, 25 bp, Mus musculus
tgattcgctccccaacaacagttaa

SEQ ID NO: 144680 - DNA, 25 bp, Mus musculus
tgattcggaaggaaggccgacagct

SEQ ID NO: 144681 - DNA, 25 bp, Mus musculus
tgattcggataaggcatagttttgt

SEQ ID NO: 144682 - DNA, 25 bp, Mus musculus
tgattcggcttttctcggttcagtc

SEQ ID NO: 144683 - DNA, 25 bp, Mus musculus
tgattctactgagccgagatctccc

SEQ ID NO: 144684 - DNA, 25 bp, Mus musculus
tgattctagatctgcagagactcga

SEQ ID NO: 144685 - DNA, 25 bp, Mus musculus
tgattctagctgctacagccgcagg

SEQ ID NO: 144686 - DNA, 25 bp, Mus musculus
tgattctcccagactgcctgtgtag

SEQ ID NO: 144687 - DNA, 25 bp, Mus musculus
tgattctggccacatcgagtgatga

SEQ ID NO: 144688 - DNA, 25 bp, Mus musculus
tgattcttctcgtacctccgctggg

SEQ ID NO: 144689 - DNA, 25 bp, Mus musculus
tgattcttctggagatgtgtcccca

SEQ ID NO: 144690 - DNA, 25 bp, Mus musculus
tgattgaaggtgaacgagagctgca

SEQ ID NO: 144691 - DNA, 25 bp, Mus musculus
tgattgacaacaccaacccagatgt

SEQ ID NO: 144692 - DNA, 25 bp, Mus musculus
tgattgacccagacctgcagacagg

SEQ ID NO: 144693 - DNA, 25 bp, Mus musculus
tgattgacgaaaccagaaatagcct

SEQ ID NO: 144694 - DNA, 25 bp, Mus musculus
tgattgagaggacgttgcagaccct

SEQ ID NO: 144695 - DNA, 25 bp, Mus musculus
tgattgagccgctggtacccgagga

SEQ ID NO: 144696 - DNA, 25 bp, Mus musculus
tgattgaggagttgaggcaccgctt

SEQ ID NO: 144697 - DNA, 25 bp, Mus musculus
tgattgatcgtgctcatggaggccc

SEQ ID NO: 144698 - DNA, 25 bp, Mus musculus
tgattgatgacctcactaccctggg

SEQ ID NO: 144699 - DNA, 25 bp, Mus musculus
tgattgcaaacaacacgacggtgga

SEQ ID NO: 144700 - DNA, 25 bp, Mus musculus
tgattgccggctactgggtgtctac

SEQ ID NO: 144701 - DNA, 25 bp, Mus musculus
tgattgcctccaaagctccgctgga

SEQ ID NO: 144702 - DNA, 25 bp, Mus musculus
tgattgcctccagtactgtgaggaa

SEQ ID NO: 144703 - DNA, 25 bp, Mus musculus
tgattgcgattactaacgacttggg

SEQ ID NO: 144704 - DNA, 25 bp, Mus musculus
tgattggcacagaccagtgtgtgga

SEQ ID NO: 144705 - DNA, 25 bp, Mus musculus
tgattggcagcagaaaggcggcact

SEQ ID NO: 144706 - DNA, 25 bp, Mus musculus
tgattggccagaaagtgagccacgc

SEQ ID NO: 144707 - DNA, 25 bp, Mus musculus
tgattggccagtcgaagcatcccag

SEQ ID NO: 144708 - DNA, 25 bp, Mus musculus
tgattggccgcagcctggttatcga

SEQ ID NO: 144709 - DNA, 25 bp, Mus musculus
tgattggccttcgactctacgatgg

SEQ ID NO: 144710 - DNA, 25 bp, Mus musculus
tgattggctgaggaaacagaggctc

SEQ ID NO: 144711 - DNA, 25 bp, Mus musculus
tgattggtccagtgcaagagacccc

SEQ ID NO: 144712 - DNA, 25 bp, Mus musculus
tgattggtgagatcctccggcagct

SEQ ID NO: 144713 - DNA, 25 bp, Mus musculus
tgattgtactggagcacacgttgaa

SEQ ID NO: 144714 - DNA, 25 bp, Mus musculus
tgattgtagataagcttagccgccc

SEQ ID NO: 144715 - DNA, 25 bp, Mus musculus
tgattgtccccttgcacacaactcc

SEQ ID NO: 144716 - DNA, 25 bp, Mus musculus
tgattgtcctgctctacgtgacgag

SEQ ID NO: 144717 - DNA, 25 bp, Mus musculus
tgattgtccttttaatacccaatat

SEQ ID NO: 144718 - DNA, 25 bp, Mus musculus
tgattgtctccagccgagagttgtt

SEQ ID NO: 144719 - DNA, 25 bp, Mus musculus
tgattgtgaagaccccatgtcctgt

SEQ ID NO: 144720 - DNA, 25 bp, Mus musculus
tgattgtgcacatagcccgagtcca

SEQ ID NO: 144721 - DNA, 25 bp, Mus musculus
tgattgtggaacagcaggatgagca

SEQ ID NO: 144722 - DNA, 25 bp, Mus musculus
tgatttacaccccagagatttaagg

SEQ ID NO: 144723 - DNA, 25 bp, Mus musculus
tgatttacataccatagcaattgag

SEQ ID NO: 144724 - DNA, 25 bp, Mus musculus
tgatttatggacagacactgacctg

SEQ ID NO: 144725 - DNA, 25 bp, Mus musculus
tgatttcaaagacggtgccagcagt

SEQ ID NO: 144726 - DNA, 25 bp, Mus musculus
tgatttcaaaggtcgggctgagccc

SEQ ID NO: 144727 - DNA, 25 bp, Mus musculus
tgatttcagttgtgggcagtcggca

SEQ ID NO: 144728 - DNA, 25 bp, Mus musculus
tgatttcatccctggtcacctccga

SEQ ID NO: 144729 - DNA, 25 bp, Mus musculus
tgatttccgagctctacactggctg

SEQ ID NO: 144730 - DNA, 25 bp, Mus musculus
tgatttcgcatgctgtactgtgggc

SEQ ID NO: 144731 - DNA, 25 bp, Mus musculus
tgatttctactgtgccgaggtggcc

SEQ ID NO: 144732 - DNA, 25 bp, Mus musculus
tgatttctctacctcgggccaatgg

SEQ ID NO: 144733 - DNA, 25 bp, Mus musculus
tgatttgcaagtcacccagggttac

SEQ ID NO: 144734 - DNA, 25 bp, Mus musculus
tgatttgccaaagaagcggcctgcc

SEQ ID NO: 144735 - DNA, 25 bp, Mus musculus
tgatttgccccattcagaagcaggg

SEQ ID NO: 144736 - DNA, 25 bp, Mus musculus
tgatttggaataccatgatgggaac

SEQ ID NO: 144737 - DNA, 25 bp, Mus musculus
tgatttggccaatgaagacacccca

SEQ ID NO: 144738 - DNA, 25 bp, Mus musculus
tgatttggcgggagtcttgacgacc

SEQ ID NO: 144739 - DNA, 25 bp, Mus musculus
tgatttgggatcataatgcacagat

SEQ ID NO: 144740 - DNA, 25 bp, Mus musculus
tgatttgggccatttgtccccgaga

SEQ ID NO: 144741 - DNA, 25 bp, Mus musculus
tgatttgttacttctccgaggcagg

SEQ ID NO: 144742 - DNA, 25 bp, Mus musculus
tgattttaatgtggataaagccgta

SEQ ID NO: 144743 - DNA, 25 bp, Mus musculus
tgattttctcccctttgagcccagg

SEQ ID NO: 144744 - DNA, 25 bp, Mus musculus
tgattttgacctgggctgcacctgt

SEQ ID NO: 144745 - DNA, 25 bp, Mus musculus
tgattttgccatagctctccactgt

SEQ ID NO: 144746 - DNA, 25 bp, Mus musculus
tgattttgtagaaacccggcgaagg

SEQ ID NO: 144747 - DNA, 25 bp, Mus musculus
tgattttgtagaagttgaggagccc

SEQ ID NO: 144748 - DNA, 25 bp, Mus musculus
tgatttttcaaaaggctcagcaagc

SEQ ID NO: 144749 - DNA, 25 bp, Mus musculus
tgatttttgagagcggagaccggac

SEQ ID NO: 144750 - DNA, 25 bp, Mus musculus
tgcaaaaacatcctgcggaggcctt

SEQ ID NO: 144751 - DNA, 25 bp, Mus musculus
tgcaaaaaccttgggactgactgta

SEQ ID NO: 144752 - DNA, 25 bp, Mus musculus
tgcaaaaactcttcctggaggagcc

SEQ ID NO: 144753 - DNA, 25 bp, Mus musculus
tgcaaaaagcgcctcaatgaccgga

SEQ ID NO: 144754 - DNA, 25 bp, Mus musculus
tgcaaaaattatgggttggaagatt

SEQ ID NO: 144755 - DNA, 25 bp, Mus musculus
tgcaaaaccaccaccagctacgtgg

SEQ ID NO: 144756 - DNA, 25 bp, Mus musculus
tgcaaaacctgagctacaccgagat

SEQ ID NO: 144757 - DNA, 25 bp, Mus musculus
tgcaaaacgccaattcgcaacagag

SEQ ID NO: 144758 - DNA, 25 bp, Mus musculus
tgcaaaacgcgcagatgtgcagcag

SEQ ID NO: 144759 - DNA, 25 bp, Mus musculus
tgcaaaacggtctcagaggatggtc

SEQ ID NO: 144760 - DNA, 25 bp, Mus musculus
tgcaaaagagaatcgcgtacctcag

SEQ ID NO: 144761 - DNA, 25 bp, Mus musculus
tgcaaaagcggcacctgcacctcat

SEQ ID NO: 144762 - DNA, 25 bp, Mus musculus
tgcaaaagctacaagagcgcctgga

SEQ ID NO: 144763 - DNA, 25 bp, Mus musculus
tgcaaaatgaaaaggtaagagaacg

SEQ ID NO: 144764 - DNA, 25 bp, Mus musculus
tgcaaacactgaggagccagttggc

SEQ ID NO: 144765 - DNA, 25 bp, Mus musculus
tgcaaacactggctgagaggactgt

SEQ ID NO: 144766 - DNA, 25 bp, Mus musculus
tgcaaacactggcttcgaggcctct

SEQ ID NO: 144767 - DNA, 25 bp, Mus musculus
tgcaaacagctgtgtcgggaacctg

SEQ ID NO: 144768 - DNA, 25 bp, Mus musculus
tgcaaacctatgttccacgtgggtg

SEQ ID NO: 144769 - DNA, 25 bp, Mus musculus
tgcaaacgcacccagggtgtgtcca

SEQ ID NO: 144770 - DNA, 25 bp, Mus musculus
tgcaaacggacagacagactcagct

SEQ ID NO: 144771 - DNA, 25 bp, Mus musculus
tgcaaacgtgctttccctgcgtggg

SEQ ID NO: 144772 - DNA, 25 bp, Mus musculus
tgcaaactcgacctctcgctggaga

SEQ ID NO: 144773 - DNA, 25 bp, Mus musculus
tgcaaactctgtgaggccatctgtc

SEQ ID NO: 144774 - DNA, 25 bp, Mus musculus
tgcaaactgcttcaactcctcaatg

SEQ ID NO: 144775 - DNA, 25 bp, Mus musculus
tgcaaactttaaccgctggcgccag

SEQ ID NO: 144776 - DNA, 25 bp, Mus musculus
tgcaaagaagctggcatccggttcc

SEQ ID NO: 144777 - DNA, 25 bp, Mus musculus
tgcaaagaatcctgatggcccctgg

SEQ ID NO: 144778 - DNA, 25 bp, Mus musculus
tgcaaagacaaaggactagcccagg

SEQ ID NO: 144779 - DNA, 25 bp, Mus musculus
tgcaaagactaaaaaactggagttc

SEQ ID NO: 144780 - DNA, 25 bp, Mus musculus
tgcaaagcctttcgaagccgtgaag

SEQ ID NO: 144781 - DNA, 25 bp, Mus musculus
tgcaaagctatttctgggcacacag

SEQ ID NO: 144782 - DNA, 25 bp, Mus musculus
tgcaaaggaactcgatacccagtgt

SEQ ID NO: 144783 - DNA, 25 bp, Mus musculus
tgcaaagggcgggactcccaaagtg

SEQ ID NO: 144784 - DNA, 25 bp, Mus musculus
tgcaaaggtgatccatctactggct

SEQ ID NO: 144785 - DNA, 25 bp, Mus musculus
tgcaaagtaaaggacgccgcgggtc

SEQ ID NO: 144786 - DNA, 25 bp, Mus musculus
tgcaaagtcggagtcagctacacct

SEQ ID NO: 144787 - DNA, 25 bp, Mus musculus
tgcaaagtgcaaactcaggactgag

SEQ ID NO: 144788 - DNA, 25 bp, Mus musculus
tgcaaagtgctcagccaagcaggct

SEQ ID NO: 144789 - DNA, 25 bp, Mus musculus
tgcaaagtggccttatcagaatggc

SEQ ID NO: 144790 - DNA, 25 bp, Mus musculus
tgcaaataccggaccttctatgagg

SEQ ID NO: 144791 - DNA, 25 bp, Mus musculus
tgcaaatagtctacaagccggtgga

SEQ ID NO: 144792 - DNA, 25 bp, Mus musculus
tgcaaatattgtgcgcgctctggaa

SEQ ID NO: 144793 - DNA, 25 bp, Mus musculus
tgcaaatcagctcaccggaaggaag

SEQ ID NO: 144794 - DNA, 25 bp, Mus musculus
tgcaaatcatcgatacagctacggc

SEQ ID NO: 144795 - DNA, 25 bp, Mus musculus
tgcaaatcatctccagccagcttag

SEQ ID NO: 144796 - DNA, 25 bp, Mus musculus
tgcaaatcgaaggtatggcagcgtg

SEQ ID NO: 144797 - DNA, 25 bp, Mus musculus
tgcaaatgagacttaaaaccctggc

SEQ ID NO: 144798 - DNA, 25 bp, Mus musculus
tgcaaatgattaccgcgaggctgaa

SEQ ID NO: 144799 - DNA, 25 bp, Mus musculus
tgcaaatgcaaagaaagaccccagc

SEQ ID NO: 144800 - DNA, 25 bp, Mus musculus
tgcaaatgcacccatagaggaccgg

SEQ ID NO: 144801 - DNA, 25 bp, Mus musculus
tgcaaatgcgggtcactcctaagct

SEQ ID NO: 144802 - DNA, 25 bp, Mus musculus
tgcaaatggaacagcgtttctcacc

SEQ ID NO: 144803 - DNA, 25 bp, Mus musculus
tgcaaattccgagtgtctatggacg

SEQ ID NO: 144804 - DNA, 25 bp, Mus musculus
tgcaaattccttttcactctgccct

SEQ ID NO: 144805 - DNA, 25 bp, Mus musculus
tgcaaattgataacgccagactggc

SEQ ID NO: 144806 - DNA, 25 bp, Mus musculus
tgcaacaaaccctccaacaagacag

SEQ ID NO: 144807 - DNA, 25 bp, Mus musculus
tgcaacaaacgcttcggccggtatt

SEQ ID NO: 144808 - DNA, 25 bp, Mus musculus
tgcaacaaaggcgacaagaagctac

SEQ ID NO: 144809 - DNA, 25 bp, Mus musculus
tgcaacaacagcaggtaagttttgt

SEQ ID NO: 144810 - DNA, 25 bp, Mus musculus
tgcaacaaggaaggttctcaccctg

SEQ ID NO: 144811 - DNA, 25 bp, Mus musculus
tgcaacaataaccaggacttccagg

SEQ ID NO: 144812 - DNA, 25 bp, Mus musculus
tgcaacactgaaatggaaggagagc

SEQ ID NO: 144813 - DNA, 25 bp, Mus musculus
tgcaacagatccctacaaccagaga

SEQ ID NO: 144814 - DNA, 25 bp, Mus musculus
tgcaacagcccggaaacatctggga

SEQ ID NO: 144815 - DNA, 25 bp, Mus musculus
tgcaacaggtgatggagagccacat

SEQ ID NO: 144816 - DNA, 25 bp, Mus musculus
tgcaacagtcccagcatcagaaggt

SEQ ID NO: 144817 - DNA, 25 bp, Mus musculus
tgcaacagttgatggacaggaaaag

SEQ ID NO: 144818 - DNA, 25 bp, Mus musculus
tgcaacatatgtcccaagaactggc

SEQ ID NO: 144819 - DNA, 25 bp, Mus musculus
tgcaacatgcatactgggaactgaa

SEQ ID NO: 144820 - DNA, 25 bp, Mus musculus
tgcaacatggagacaggtcagacct

SEQ ID NO: 144821 - DNA, 25 bp, Mus musculus
tgcaaccagcccaatcctaaggaag

SEQ ID NO: 144822 - DNA, 25 bp, Mus musculus
tgcaacctccagtgacaaagtccag

SEQ ID NO: 144823 - DNA, 25 bp, Mus musculus
tgcaacctctacatggcagccagga

SEQ ID NO: 144824 - DNA, 25 bp, Mus musculus
tgcaacctgctgtacgtgagctgga

SEQ ID NO: 144825 - DNA, 25 bp, Mus musculus
tgcaacctgtctcaagtaggcggct

SEQ ID NO: 144826 - DNA, 25 bp, Mus musculus
tgcaacgccaagatcatgattcggg

SEQ ID NO: 144827 - DNA, 25 bp, Mus musculus
tgcaacgcccatgacccagaaaatg

SEQ ID NO: 144828 - DNA, 25 bp, Mus musculus
tgcaacgcctcagtcaaggaagcct

SEQ ID NO: 144829 - DNA, 25 bp, Mus musculus
tgcaacgctccaagaagaggctggg

SEQ ID NO: 144830 - DNA, 25 bp, Mus musculus
tgcaacggtctcaacatctcaggga

SEQ ID NO: 144831 - DNA, 25 bp, Mus musculus
tgcaacggtgacgatagcgcacaga

SEQ ID NO: 144832 - DNA, 25 bp, Mus musculus
tgcaacgtttgaagagtggttcccc

SEQ ID NO: 144833 - DNA, 25 bp, Mus musculus
tgcaactaagggacagaatgggact

SEQ ID NO: 144834 - DNA, 25 bp, Mus musculus
tgcaactcaaagctggcgatgtggt

SEQ ID NO: 144835 - DNA, 25 bp, Mus musculus
tgcaactcctcatgaatgaactggg

SEQ ID NO: 144836 - DNA, 25 bp, Mus musculus
tgcaactcctcccagagagtcgagc

SEQ ID NO: 144837 - DNA, 25 bp, Mus musculus
tgcaactgccaatgagatccgtagg

SEQ ID NO: 144838 - DNA, 25 bp, Mus musculus
tgcaactgccattaacgggacagac

SEQ ID NO: 144839 - DNA, 25 bp, Mus musculus
tgcaactgcccatgtgtgcccttgg

SEQ ID NO: 144840 - DNA, 25 bp, Mus musculus
tgcaactgtgaatgacccactaggg

SEQ ID NO: 144841 - DNA, 25 bp, Mus musculus
tgcaacttcaaggatgggcacatct

SEQ ID NO: 144842 - DNA, 25 bp, Mus musculus
tgcaacttctctctaactcacatca

SEQ ID NO: 144843 - DNA, 25 bp, Mus musculus
tgcaacttggctagtggtcacaaca

SEQ ID NO: 144844 - DNA, 25 bp, Mus musculus
tgcaagaaaatccacaagacggtcc

SEQ ID NO: 144845 - DNA, 25 bp, Mus musculus
tgcaagaacagcgtagcctacatgg

SEQ ID NO: 144846 - DNA, 25 bp, Mus musculus
tgcaagaaccgctacgacaaggaca

SEQ ID NO: 144847 - DNA, 25 bp, Mus musculus
tgcaagaagcaagcctccactggta

SEQ ID NO: 144848 - DNA, 25 bp, Mus musculus
tgcaagaagtgagaaaccggagcgc

SEQ ID NO: 144849 - DNA, 25 bp, Mus musculus
tgcaagacaaagaagttggagatgg

SEQ ID NO: 144850 - DNA, 25 bp, Mus musculus
tgcaagacactccagagtcaagggc

SEQ ID NO: 144851 - DNA, 25 bp, Mus musculus
tgcaagacactgacacgcaaggacg

SEQ ID NO: 144852 - DNA, 25 bp, Mus musculus
tgcaagacctagcaagtccccatgc

SEQ ID NO: 144853 - DNA, 25 bp, Mus musculus
tgcaagactacagacttcgtgaact

SEQ ID NO: 144854 - DNA, 25 bp, Mus musculus
tgcaagactaggtgacagcctgccg

SEQ ID NO: 144855 - DNA, 25 bp, Mus musculus
tgcaagactgtgctcaccagcaagg

SEQ ID NO: 144856 - DNA, 25 bp, Mus musculus
tgcaagactttctagggccgggacc

SEQ ID NO: 144857 - DNA, 25 bp, Mus musculus
tgcaagagactgcttaccacgaact

SEQ ID NO: 144858 - DNA, 25 bp, Mus musculus
tgcaagagatatgcgggagctctcc

SEQ ID NO: 144859 - DNA, 25 bp, Mus musculus
tgcaagagctttagcaggaggccca

SEQ ID NO: 144860 - DNA, 25 bp, Mus musculus
tgcaagagtgctacgaaacaggatc

SEQ ID NO: 144861 - DNA, 25 bp, Mus musculus
tgcaagatgagcccatccaacctgg

SEQ ID NO: 144862 - DNA, 25 bp, Mus musculus
tgcaagcaatgcatccaagcctggc

SEQ ID NO: 144863 - DNA, 25 bp, Mus musculus
tgcaagcacccggaaagcaactttt

SEQ ID NO: 144864 - DNA, 25 bp, Mus musculus
tgcaagcagctttggccaagtacaa

SEQ ID NO: 144865 - DNA, 25 bp, Mus musculus
tgcaagccgcgagaagatcaagtcg

SEQ ID NO: 144866 - DNA, 25 bp, Mus musculus
tgcaagcgaatcctacacacagagc

SEQ ID NO: 144867 - DNA, 25 bp, Mus musculus
tgcaagcgcaaggtagccgagtgcc

SEQ ID NO: 144868 - DNA, 25 bp, Mus musculus
tgcaagcgtgcagaaactaactcct

SEQ ID NO: 144869 - DNA, 25 bp, Mus musculus
tgcaagctatcaaacagagactggt

SEQ ID NO: 144870 - DNA, 25 bp, Mus musculus
tgcaagctccccaggatgaaaggct

SEQ ID NO: 144871 - DNA, 25 bp, Mus musculus
tgcaagctctgcctgtgtgaacagt

SEQ ID NO: 144872 - DNA, 25 bp, Mus musculus
tgcaagctgacagagacgattctcg

SEQ ID NO: 144873 - DNA, 25 bp, Mus musculus
tgcaagcttcgaggtctgcaccaca

SEQ ID NO: 144874 - DNA, 25 bp, Mus musculus
tgcaagcttgccatcgacaacctgg

SEQ ID NO: 144875 - DNA, 25 bp, Mus musculus
tgcaaggagaatgtggagtctgcca

SEQ ID NO: 144876 - DNA, 25 bp, Mus musculus
tgcaaggaggtggttgactcttacc

SEQ ID NO: 144877 - DNA, 25 bp, Mus musculus
tgcaaggatcgtcccagaatgggtc

SEQ ID NO: 144878 - DNA, 25 bp, Mus musculus
tgcaaggattccctagtcagaacgt

SEQ ID NO: 144879 - DNA, 25 bp, Mus musculus
tgcaaggcagtatggctccaaagcc

SEQ ID NO: 144880 - DNA, 25 bp, Mus musculus
tgcaaggccacttacccgcagatgt

SEQ ID NO: 144881 - DNA, 25 bp, Mus musculus
tgcaaggccctcctggaaaagtagg

SEQ ID NO: 144882 - DNA, 25 bp, Mus musculus
tgcaaggccgtttcctacctcatgg

SEQ ID NO: 144883 - DNA, 25 bp, Mus musculus
tgcaaggcctgagacctaccagata

SEQ ID NO: 144884 - DNA, 25 bp, Mus musculus
tgcaaggcttgtgtgtctccggaca

SEQ ID NO: 144885 - DNA, 25 bp, Mus musculus
tgcaagggacgtttagacagcggcc

SEQ ID NO: 144886 - DNA, 25 bp, Mus musculus
tgcaagggtgatgaaggcctgcacc

SEQ ID NO: 144887 - DNA, 25 bp, Mus musculus
tgcaaggtccgccactcgggcttct

SEQ ID NO: 144888 - DNA, 25 bp, Mus musculus
tgcaaggtctatacgctgactccct

SEQ ID NO: 144889 - DNA, 25 bp, Mus musculus
tgcaagtagagtctttacaagaaca

SEQ ID NO: 144890 - DNA, 25 bp, Mus musculus
tgcaagtatgttgctgtggagctga

SEQ ID NO: 144891 - DNA, 25 bp, Mus musculus
tgcaagtcaacccagcatggctgtg

SEQ ID NO: 144892 - DNA, 25 bp, Mus musculus
tgcaagtcaagagataataatcgcc

SEQ ID NO: 144893 - DNA, 25 bp, Mus musculus
tgcaagtcagcaagtagtccaggct

SEQ ID NO: 144894 - DNA, 25 bp, Mus musculus
tgcaagtgaatgacagtggccagcc

SEQ ID NO: 144895 - DNA, 25 bp, Mus musculus
tgcaagtgacactaatgaggccctg

SEQ ID NO: 144896 - DNA, 25 bp, Mus musculus
tgcaagtgggaagacgacatgcctg

SEQ ID NO: 144897 - DNA, 25 bp, Mus musculus
tgcaagttcctacaccaggagcgga

SEQ ID NO: 144898 - DNA, 25 bp, Mus musculus
tgcaataaagactgagaaatttggt

SEQ ID NO: 144899 - DNA, 25 bp, Mus musculus
tgcaataagtgcgtatgcggcttcg

SEQ ID NO: 144900 - DNA, 25 bp, Mus musculus
tgcaatagaactgaaatccgggagt

SEQ ID NO: 144901 - DNA, 25 bp, Mus musculus
tgcaatagggttgtgcggcgactca

SEQ ID NO: 144902 - DNA, 25 bp, Mus musculus
tgcaatagttttccctgagtgaggc

SEQ ID NO: 144903 - DNA, 25 bp, Mus musculus
tgcaatcatacgagccatgggacgg

SEQ ID NO: 144904 - DNA, 25 bp, Mus musculus
tgcaatcggttggtatcatagccac

SEQ ID NO: 144905 - DNA, 25 bp, Mus musculus
tgcaatctatgtgggctatacccga

SEQ ID NO: 144906 - DNA, 25 bp, Mus musculus
tgcaatctgcgcacgtaccatgacg

SEQ ID NO: 144907 - DNA, 25 bp, Mus musculus
tgcaatctttgtgactgggcgagtc

SEQ ID NO: 144908 - DNA, 25 bp, Mus musculus
tgcaatgaagaactggactgtccca

SEQ ID NO: 144909 - DNA, 25 bp, Mus musculus
tgcaatgacaaatgaggaacctcta

SEQ ID NO: 144910 - DNA, 25 bp, Mus musculus
tgcaatgacgtccttgcgcgagcca

SEQ ID NO: 144911 - DNA, 25 bp, Mus musculus
tgcaatgattctgaccggtggagcc

SEQ ID NO: 144912 - DNA, 25 bp, Mus musculus
tgcaatgcagtcatacagaagccag

SEQ ID NO: 144913 - DNA, 25 bp, Mus musculus
tgcaatgcctttaccaaagtggcct

SEQ ID NO: 144914 - DNA, 25 bp, Mus musculus
tgcaatggatccagcaggacgagtc

SEQ ID NO: 144915 - DNA, 25 bp, Mus musculus
tgcaatggcctaaagagcagccttt

SEQ ID NO: 144916 - DNA, 25 bp, Mus musculus
tgcaatggttgctgctctgagccca

SEQ ID NO: 144917 - DNA, 25 bp, Mus musculus
tgcaatgtcaaaggcctctcagaag

SEQ ID NO: 144918 - DNA, 25 bp, Mus musculus
tgcaattcaaaaagagccaaagtcc

SEQ ID NO: 144919 - DNA, 25 bp, Mus musculus
tgcaattccgtctctatggcgagga

SEQ ID NO: 144920 - DNA, 25 bp, Mus musculus
tgcaattctgaagagcgagggaccc

SEQ ID NO: 144921 - DNA, 25 bp, Mus musculus
tgcaattcttcactcggctacgccg

SEQ ID NO: 144922 - DNA, 25 bp, Mus musculus
tgcaattgcgtttcaggcgaccttg

SEQ ID NO: 144923 - DNA, 25 bp, Mus musculus
tgcaattggaattagccaggcctct

SEQ ID NO: 144924 - DNA, 25 bp, Mus musculus
tgcaatttcacactgatggcgcaga

SEQ ID NO: 144925 - DNA, 25 bp, Mus musculus
tgcacaaaagggtgacaacggttct

SEQ ID NO: 144926 - DNA, 25 bp, Mus musculus
tgcacaaatgtaaaggccccatgcg

SEQ ID NO: 144927 - DNA, 25 bp, Mus musculus
tgcacaacactagaggctgaccgtc

SEQ ID NO: 144928 - DNA, 25 bp, Mus musculus
tgcacaacctcctgaaattcctaat

SEQ ID NO: 144929 - DNA, 25 bp, Mus musculus
tgcacaacgaagaccaaatggccgt

SEQ ID NO: 144930 - DNA, 25 bp, Mus musculus
tgcacaacttcctgagcgtcctctt

SEQ ID NO: 144931 - DNA, 25 bp, Mus musculus
tgcacaagcaacaaccacagagggt

SEQ ID NO: 144932 - DNA, 25 bp, Mus musculus
tgcacaagggcagatctgagtccca

SEQ ID NO: 144933 - DNA, 25 bp, Mus musculus
tgcacaatgacttccaggccctgaa

SEQ ID NO: 144934 - DNA, 25 bp, Mus musculus
tgcacacaagataatggccagctcc

SEQ ID NO: 144935 - DNA, 25 bp, Mus musculus
tgcacacagagctggcgtgtactcg

SEQ ID NO: 144936 - DNA, 25 bp, Mus musculus
tgcacacagtgaggaccgggaaagt

SEQ ID NO: 144937 - DNA, 25 bp, Mus musculus
tgcacacattgttggaagcccagaa

SEQ ID NO: 144938 - DNA, 25 bp, Mus musculus
tgcacaccctggagcttcgagggaa

SEQ ID NO: 144939 - DNA, 25 bp, Mus musculus
tgcacaccgttcatggagaccggaa

SEQ ID NO: 144940 - DNA, 25 bp, Mus musculus
tgcacacgcccatatgaagcggttt

SEQ ID NO: 144941 - DNA, 25 bp, Mus musculus
tgcacactaaaaacggtggcggcgg

SEQ ID NO: 144942 - DNA, 25 bp, Mus musculus
tgcacactacagcttcgggaagaat

SEQ ID NO: 144943 - DNA, 25 bp, Mus musculus
tgcacactctacagcaatatctggg

SEQ ID NO: 144944 - DNA, 25 bp, Mus musculus
tgcacactgctctatgccgatctgg

SEQ ID NO: 144945 - DNA, 25 bp, Mus musculus
tgcacagaaacctgcagcggcaatt

SEQ ID NO: 144946 - DNA, 25 bp, Mus musculus
tgcacagaactgatgaggctacggt

SEQ ID NO: 144947 - DNA, 25 bp, Mus musculus
tgcacagatattccctaatggtcag

SEQ ID NO: 144948 - DNA, 25 bp, Mus musculus
tgcacagcactggaacttctcgagc

SEQ ID NO: 144949 - DNA, 25 bp, Mus musculus
tgcacagccaagaacgcacatctgg

SEQ ID NO: 144950 - DNA, 25 bp, Mus musculus
tgcacagcctagatgagaagacact

SEQ ID NO: 144951 - DNA, 25 bp, Mus musculus
tgcacagcgagcaatgagactccag

SEQ ID NO: 144952 - DNA, 25 bp, Mus musculus
tgcacaggaagacgttgaaccccat

SEQ ID NO: 144953 - DNA, 25 bp, Mus musculus
tgcacaggagagacgtgtcagacaa

SEQ ID NO: 144954 - DNA, 25 bp, Mus musculus
tgcacaggcaggagactgtagactg

SEQ ID NO: 144955 - DNA, 25 bp, Mus musculus
tgcacaggcatggacgggaagaaat

SEQ ID NO: 144956 - DNA, 25 bp, Mus musculus
tgcacagggccactttgatgatgcc

SEQ ID NO: 144957 - DNA, 25 bp, Mus musculus
tgcacagtcactgccaatgctgagt

SEQ ID NO: 144958 - DNA, 25 bp, Mus musculus
tgcacagtcgggtgacaaacatccc

SEQ ID NO: 144959 - DNA, 25 bp, Mus musculus
tgcacagtgagaatcgcggccatta

SEQ ID NO: 144960 - DNA, 25 bp, Mus musculus
tgcacagtgccttagacgagttctt

SEQ ID NO: 144961 - DNA, 25 bp, Mus musculus
tgcacatcaaagtcaccttcaaagg

SEQ ID NO: 144962 - DNA, 25 bp, Mus musculus
tgcacatcgcccaaggtcagaagag

SEQ ID NO: 144963 - DNA, 25 bp, Mus musculus
tgcacatcgccgctgctaatgggtt

SEQ ID NO: 144964 - DNA, 25 bp, Mus musculus
tgcacatctgtacacctgagggctt

SEQ ID NO: 144965 - DNA, 25 bp, Mus musculus
tgcacatgacatagagaccaggctc

SEQ ID NO: 144966 - DNA, 25 bp, Mus musculus
tgcacatgacgaaaggcctggccat

SEQ ID NO: 144967 - DNA, 25 bp, Mus musculus
tgcacatgagcagaagtcacaggcg

SEQ ID NO: 144968 - DNA, 25 bp, Mus musculus
tgcacatgatggtagccacacctgg

SEQ ID NO: 144969 - DNA, 25 bp, Mus musculus
tgcacatgcagagtgtctttcacag

SEQ ID NO: 144970 - DNA, 25 bp, Mus musculus
tgcacatgcagctcagggaagacag

SEQ ID NO: 144971 - DNA, 25 bp, Mus musculus
tgcacatgctgaacaacatcctgta

SEQ ID NO: 144972 - DNA, 25 bp, Mus musculus
tgcacatggcaccagacacatgctg

SEQ ID NO: 144973 - DNA, 25 bp, Mus musculus
tgcacatgtggataaggctaacttc

SEQ ID NO: 144974 - DNA, 25 bp, Mus musculus
tgcacatgttgggtctggccagcca

SEQ ID NO: 144975 - DNA, 25 bp, Mus musculus
tgcacattgagcgacagttctacag

SEQ ID NO: 144976 - DNA, 25 bp, Mus musculus
tgcacatttccacttccggtccgtg

SEQ ID NO: 144977 - DNA, 25 bp, Mus musculus
tgcacatttgtttcagccggatcca

SEQ ID NO: 144978 - DNA, 25 bp, Mus musculus
tgcaccaacgtgatcgggagcttcg

SEQ ID NO: 144979 - DNA, 25 bp, Mus musculus
tgcaccaataccctggaagccctaa

SEQ ID NO: 144980 - DNA, 25 bp, Mus musculus
tgcaccacagggagacatgatatac

SEQ ID NO: 144981 - DNA, 25 bp, Mus musculus
tgcaccaccccaagctgtgtgatag

SEQ ID NO: 144982 - DNA, 25 bp, Mus musculus
tgcaccagcggcagaagcagaatgc

SEQ ID NO: 144983 - DNA, 25 bp, Mus musculus
tgcaccaggagcttcatcgtctgaa

SEQ ID NO: 144984 - DNA, 25 bp, Mus musculus
tgcaccaggtggaatacgaggagct

SEQ ID NO: 144985 - DNA, 25 bp, Mus musculus
tgcaccagtcgagctgacaaccagt

SEQ ID NO: 144986 - DNA, 25 bp, Mus musculus
tgcaccatagacatcgaagcattta

SEQ ID NO: 144987 - DNA, 25 bp, Mus musculus
tgcaccatcagacacagcgcttccg

SEQ ID NO: 144988 - DNA, 25 bp, Mus musculus
tgcaccatgaagaacccaaaagtag

SEQ ID NO: 144989 - DNA, 25 bp, Mus musculus
tgcaccatgaagaccagcaggttcg

SEQ ID NO: 144990 - DNA, 25 bp, Mus musculus
tgcaccattgagagggaccagtaca

SEQ ID NO: 144991 - DNA, 25 bp, Mus musculus
tgcacccacgatacttcggtccaaa

SEQ ID NO: 144992 - DNA, 25 bp, Mus musculus
tgcacccagtagaactaaagccttt

SEQ ID NO: 144993 - DNA, 25 bp, Mus musculus
tgcaccccgaagagcaggtcatgct

SEQ ID NO: 144994 - DNA, 25 bp, Mus musculus
tgcacccgtatgttcatggcggcgg

SEQ ID NO: 144995 - DNA, 25 bp, Mus musculus
tgcaccctgagaagcatcccagaga

SEQ ID NO: 144996 - DNA, 25 bp, Mus musculus
tgcaccctgggaacatgatgtactc

SEQ ID NO: 144997 - DNA, 25 bp, Mus musculus
tgcaccgcaagtccgtcaagaaagg

SEQ ID NO: 144998 - DNA, 25 bp, Mus musculus
tgcaccgcaatcgaaggcttgtgtt

SEQ ID NO: 144999 - DNA, 25 bp, Mus musculus
tgcaccgcctgctactgacatggaa

SEQ ID NO: 145000 - DNA, 25 bp, Mus musculus
tgcaccgctgtgacaaattatgagg

SEQ ID NO: 145001 - DNA, 25 bp, Mus musculus
tgcaccggagggaccgagccagtcc

SEQ ID NO: 145002 - DNA, 25 bp, Mus musculus
tgcaccgtctgcctgggaaaagatg

SEQ ID NO: 145003 - DNA, 25 bp, Mus musculus
tgcacctagtgaagatacgaacccc

SEQ ID NO: 145004 - DNA, 25 bp, Mus musculus
tgcacctatgagctattgatccatg

SEQ ID NO: 145005 - DNA, 25 bp, Mus musculus
tgcacctgaatcttagccaccgtag

SEQ ID NO: 145006 - DNA, 25 bp, Mus musculus
tgcacctgctgtgtttgcagaaagc

SEQ ID NO: 145007 - DNA, 25 bp, Mus musculus
tgcacctggcctcacatgccggtga

SEQ ID NO: 145008 - DNA, 25 bp, Mus musculus
tgcacctggtggacatttggaacgt

SEQ ID NO: 145009 - DNA, 25 bp, Mus musculus
tgcacctgtcccaactgtaaagaag

SEQ ID NO: 145010 - DNA, 25 bp, Mus musculus
tgcacctgtgcaagaggaaggcaat

SEQ ID NO: 145011 - DNA, 25 bp, Mus musculus
tgcacctgtgtgaaataaagcttgc

SEQ ID NO: 145012 - DNA, 25 bp, Mus musculus
tgcacctgttgttcccttggcttgg

SEQ ID NO: 145013 - DNA, 25 bp, Mus musculus
tgcaccttcattattcaagcttgcc

SEQ ID NO: 145014 - DNA, 25 bp, Mus musculus
tgcaccttcccttacggctggcttg

SEQ ID NO: 145015 - DNA, 25 bp, Mus musculus
tgcaccttgggaagaaaacggaccg

SEQ ID NO: 145016 - DNA, 25 bp, Mus musculus
tgcacctttcaggacagtgaggaat

SEQ ID NO: 145017 - DNA, 25 bp, Mus musculus
tgcacgaggcgcttcagtcagaaac

SEQ ID NO: 145018 - DNA, 25 bp, Mus musculus
tgcacgatgccagcgacaagaggtt

SEQ ID NO: 145019 - DNA, 25 bp, Mus musculus
tgcacgatggacactagaaccaggg

SEQ ID NO: 145020 - DNA, 25 bp, Mus musculus
tgcacgcaaagtccaaagggctgct

SEQ ID NO: 145021 - DNA, 25 bp, Mus musculus
tgcacgcacacagtcggaagaaggt

SEQ ID NO: 145022 - DNA, 25 bp, Mus musculus
tgcacgcacgtcatcgaaagtgagg

SEQ ID NO: 145023 - DNA, 25 bp, Mus musculus
tgcacgcctcctctggacacaagta

SEQ ID NO: 145024 - DNA, 25 bp, Mus musculus
tgcacgctagagtttccagccagga

SEQ ID NO: 145025 - DNA, 25 bp, Mus musculus
tgcacgctatttaccagagtgggcc

SEQ ID NO: 145026 - DNA, 25 bp, Mus musculus
tgcacgctggtagctgtcactaggc

SEQ ID NO: 145027 - DNA, 25 bp, Mus musculus
tgcacggacacccatgaagatcagt

SEQ ID NO: 145028 - DNA, 25 bp, Mus musculus
tgcacggacttgtcagcacgctcag

SEQ ID NO: 145029 - DNA, 25 bp, Mus musculus
tgcacggcactgttgcggagagctc

SEQ ID NO: 145030 - DNA, 25 bp, Mus musculus
tgcacggccctgctggaacatatga

SEQ ID NO: 145031 - DNA, 25 bp, Mus musculus
tgcacggctagggagtgtcatctca

SEQ ID NO: 145032 - DNA, 25 bp, Mus musculus
tgcacggctgaagaacaacaacaga

SEQ ID NO: 145033 - DNA, 25 bp, Mus musculus
tgcacgggaagcgatcgatgctgct

SEQ ID NO: 145034 - DNA, 25 bp, Mus musculus
tgcacgggcaactgattggcagacc

SEQ ID NO: 145035 - DNA, 25 bp, Mus musculus
tgcacggtgctagtaagtcgcgcca

SEQ ID NO: 145036 - DNA, 25 bp, Mus musculus
tgcacgtgactgatgtgagccaccc

SEQ ID NO: 145037 - DNA, 25 bp, Mus musculus
tgcacgtgcaaaggtctgtgtcccg

SEQ ID NO: 145038 - DNA, 25 bp, Mus musculus
tgcacgtgcagctgaatgactacct

SEQ ID NO: 145039 - DNA, 25 bp, Mus musculus
tgcacgtggctgacctgagcatggt

SEQ ID NO: 145040 - DNA, 25 bp, Mus musculus
tgcactacagcaacggagacgagag

SEQ ID NO: 145041 - DNA, 25 bp, Mus musculus
tgcactacgccttccagacggatgc

SEQ ID NO: 145042 - DNA, 25 bp, Mus musculus
tgcactactttcgagtaccgccggt

SEQ ID NO: 145043 - DNA, 25 bp, Mus musculus
tgcactatactctgaaggcccaagg

SEQ ID NO: 145044 - DNA, 25 bp, Mus musculus
tgcactatatgcacacagggtaact

SEQ ID NO: 145045 - DNA, 25 bp, Mus musculus
tgcactatcctccagggactcggat

SEQ ID NO: 145046 - DNA, 25 bp, Mus musculus
tgcactatgggcactaaccaccctg

SEQ ID NO: 145047 - DNA, 25 bp, Mus musculus
tgcactatgtggagggctcgtaccg

SEQ ID NO: 145048 - DNA, 25 bp, Mus musculus
tgcactattagcaagcgcgcggatg

SEQ ID NO: 145049 - DNA, 25 bp, Mus musculus
tgcactcaattgtcatctgctaaag

SEQ ID NO: 145050 - DNA, 25 bp, Mus musculus
tgcactcagcaggactttcaaaagc

SEQ ID NO: 145051 - DNA, 25 bp, Mus musculus
tgcactcagggtttcatggccagca

SEQ ID NO: 145052 - DNA, 25 bp, Mus musculus
tgcactcatggaaagacacactgga

SEQ ID NO: 145053 - DNA, 25 bp, Mus musculus
tgcactccaatttagctgctgtctg

SEQ ID NO: 145054 - DNA, 25 bp, Mus musculus
tgcactccacacaatcagcatcaag

SEQ ID NO: 145055 - DNA, 25 bp, Mus musculus
tgcactcccgtcaagcctgctggag

SEQ ID NO: 145056 - DNA, 25 bp, Mus musculus
tgcactcgatgctgataacgcggga

SEQ ID NO: 145057 - DNA, 25 bp, Mus musculus
tgcactctacttgcaggggtgctta

SEQ ID NO: 145058 - DNA, 25 bp, Mus musculus
tgcactctaggaaactcgtcagctt

SEQ ID NO: 145059 - DNA, 25 bp, Mus musculus
tgcactctgcactgggagactttgt

SEQ ID NO: 145060 - DNA, 25 bp, Mus musculus
tgcactctttggaatgaaatgtacc

SEQ ID NO: 145061 - DNA, 25 bp, Mus musculus
tgcactgaacgcacggtcggctgag

SEQ ID NO: 145062 - DNA, 25 bp, Mus musculus
tgcactgaagaacgtctgaaagctt

SEQ ID NO: 145063 - DNA, 25 bp, Mus musculus
tgcactgacagatggagccgtgacc

SEQ ID NO: 145064 - DNA, 25 bp, Mus musculus
tgcactgaccagacagccatctgag

SEQ ID NO: 145065 - DNA, 25 bp, Mus musculus
tgcactgagcgccatgttaccgagc

SEQ ID NO: 145066 - DNA, 25 bp, Mus musculus
tgcactgattcatccagctaagatc

SEQ ID NO: 145067 - DNA, 25 bp, Mus musculus
tgcactgcagctgcaagaacctggc

SEQ ID NO: 145068 - DNA, 25 bp, Mus musculus
tgcactgccggacagaattttccac

SEQ ID NO: 145069 - DNA, 25 bp, Mus musculus
tgcactggaacgaaaacgtagggac

SEQ ID NO: 145070 - DNA, 25 bp, Mus musculus
tgcactggaatggaagcctgaaagc

SEQ ID NO: 145071 - DNA, 25 bp, Mus musculus
tgcactgggcaatcatgactactgg

SEQ ID NO: 145072 - DNA, 25 bp, Mus musculus
tgcactggtacattcatctggctgg

SEQ ID NO: 145073 - DNA, 25 bp, Mus musculus
tgcactggttccgaaagggactccg

SEQ ID NO: 145074 - DNA, 25 bp, Mus musculus
tgcactgtctccagcagacttacca

SEQ ID NO: 145075 - DNA, 25 bp, Mus musculus
tgcactgtctgaagctcgtcaggtg

SEQ ID NO: 145076 - DNA, 25 bp, Mus musculus
tgcactgtgagaggatgtccacgga

SEQ ID NO: 145077 - DNA, 25 bp, Mus musculus
tgcacttcaaagtggcccgagaccg

SEQ ID NO: 145078 - DNA, 25 bp, Mus musculus
tgcacttcaagattcacggccaagg

SEQ ID NO: 145079 - DNA, 25 bp, Mus musculus
tgcacttccagggttgagcttagcc

SEQ ID NO: 145080 - DNA, 25 bp, Mus musculus
tgcacttcggccaaagagaccagag

SEQ ID NO: 145081 - DNA, 25 bp, Mus musculus
tgcacttctgaaaccaactctggga

SEQ ID NO: 145082 - DNA, 25 bp, Mus musculus
tgcacttctggctttggacgagact

SEQ ID NO: 145083 - DNA, 25 bp, Mus musculus
tgcacttgcgcctggagcgtctgac

SEQ ID NO: 145084 - DNA, 25 bp, Mus musculus
tgcacttgcgcctgggagcgccact

SEQ ID NO: 145085 - DNA, 25 bp, Mus musculus
tgcacttggctactcaaaacgggtc

SEQ ID NO: 145086 - DNA, 25 bp, Mus musculus
tgcacttggtctgtgtggacatgcc

SEQ ID NO: 145087 - DNA, 25 bp, Mus musculus
tgcacttgtatgacacccgaggcct

SEQ ID NO: 145088 - DNA, 25 bp, Mus musculus
tgcagaaaaggttcctaccccagct

SEQ ID NO: 145089 - DNA, 25 bp, Mus musculus
tgcagaaacgacctgggaccctcag

SEQ ID NO: 145090 - DNA, 25 bp, Mus musculus
tgcagaaactgcgagaggacctaac

SEQ ID NO: 145091 - DNA, 25 bp, Mus musculus
tgcagaaagagcacaagtgagccag

SEQ ID NO: 145092 - DNA, 25 bp, Mus musculus
tgcagaaagcgcagctggaacagct

SEQ ID NO: 145093 - DNA, 25 bp, Mus musculus
tgcagaaatgagacctgaaccaccg

SEQ ID NO: 145094 - DNA, 25 bp, Mus musculus
tgcagaaatggagaggacatctgtg

SEQ ID NO: 145095 - DNA, 25 bp, Mus musculus
tgcagaacacgggacctgccgggac

SEQ ID NO: 145096 - DNA, 25 bp, Mus musculus
tgcagaacagcgtggacaagaccaa

SEQ ID NO: 145097 - DNA, 25 bp, Mus musculus
tgcagaacagctagaggcacaggcc

SEQ ID NO: 145098 - DNA, 25 bp, Mus musculus
tgcagaacatagtagactttggcaa

SEQ ID NO: 145099 - DNA, 25 bp, Mus musculus
tgcagaacgccaacacgaagtgcaa

SEQ ID NO: 145100 - DNA, 25 bp, Mus musculus
tgcagaacgccaagtacgagggctg

SEQ ID NO: 145101 - DNA, 25 bp, Mus musculus
tgcagaacgctcatcagcagaagct

SEQ ID NO: 145102 - DNA, 25 bp, Mus musculus
tgcagaactaggctcaaaaccaagg

SEQ ID NO: 145103 - DNA, 25 bp, Mus musculus
tgcagaactgctgtgaggacctggc

SEQ ID NO: 145104 - DNA, 25 bp, Mus musculus
tgcagaactggagtaaaccgaggct

SEQ ID NO: 145105 - DNA, 25 bp, Mus musculus
tgcagaagaatgtatccagatcacg

SEQ ID NO: 145106 - DNA, 25 bp, Mus musculus
tgcagaagacccagaccctggataa

SEQ ID NO: 145107 - DNA, 25 bp, Mus musculus
tgcagaagacgccatgcagatcatg

SEQ ID NO: 145108 - DNA, 25 bp, Mus musculus
tgcagaagattccagccagactggc

SEQ ID NO: 145109 - DNA, 25 bp, Mus musculus
tgcagaagcaccttcccaactgcag

SEQ ID NO: 145110 - DNA, 25 bp, Mus musculus
tgcagaagcagtgccggaagtcatc

SEQ ID NO: 145111 - DNA, 25 bp, Mus musculus
tgcagaagctcaaggtcaagtcagc

SEQ ID NO: 145112 - DNA, 25 bp, Mus musculus
tgcagaagcttcgtcaggtgccacc

SEQ ID NO: 145113 - DNA, 25 bp, Mus musculus
tgcagaaggccagcataaggaagcc

SEQ ID NO: 145114 - DNA, 25 bp, Mus musculus
tgcagaaggcgctatcctcagggac

SEQ ID NO: 145115 - DNA, 25 bp, Mus musculus
tgcagaaggctatgcacgagatgcc

SEQ ID NO: 145116 - DNA, 25 bp, Mus musculus
tgcagaagtcagaatgcggtccacc

SEQ ID NO: 145117 - DNA, 25 bp, Mus musculus
tgcagaagttaacatggtggagtcc

SEQ ID NO: 145118 - DNA, 25 bp, Mus musculus
tgcagaatcagcaaagaccgcggaa

SEQ ID NO: 145119 - DNA, 25 bp, Mus musculus
tgcagaatcttaacaaccgcttggc

SEQ ID NO: 145120 - DNA, 25 bp, Mus musculus
tgcagaatcttctctcaaggtgact

SEQ ID NO: 145121 - DNA, 25 bp, Mus musculus
tgcagaatgagactcggcagacacc

SEQ ID NO: 145122 - DNA, 25 bp, Mus musculus
tgcagaatgcctactacagagagcg

SEQ ID NO: 145123 - DNA, 25 bp, Mus musculus
tgcagaatgctgtgcgcaacgtcct

SEQ ID NO: 145124 - DNA, 25 bp, Mus musculus
tgcagaattcaagtgatgatcatac

SEQ ID NO: 145125 - DNA, 25 bp, Mus musculus
tgcagacacaatcctcaagaccagt

SEQ ID NO: 145126 - DNA, 25 bp, Mus musculus
tgcagacaccattgctgtggagccg

SEQ ID NO: 145127 - DNA, 25 bp, Mus musculus
tgcagacacccctggccaatgagtt

SEQ ID NO: 145128 - DNA, 25 bp, Mus musculus
tgcagacagccacgaaagaggccat

SEQ ID NO: 145129 - DNA, 25 bp, Mus musculus
tgcagacagcgaaacttctcccagg

SEQ ID NO: 145130 - DNA, 25 bp, Mus musculus
tgcagacaggaggacgaagactctc

SEQ ID NO: 145131 - DNA, 25 bp, Mus musculus
tgcagacaggcaaaccaggcttgaa

SEQ ID NO: 145132 - DNA, 25 bp, Mus musculus
tgcagacaggctcgaagctaccttg

SEQ ID NO: 145133 - DNA, 25 bp, Mus musculus
tgcagacagtctcggttcacgaggc

SEQ ID NO: 145134 - DNA, 25 bp, Mus musculus
tgcagacattgagttccagacccct

SEQ ID NO: 145135 - DNA, 25 bp, Mus musculus
tgcagacctctggacgactcagcaa

SEQ ID NO: 145136 - DNA, 25 bp, Mus musculus
tgcagacgagactaaaggtgggacc

SEQ ID NO: 145137 - DNA, 25 bp, Mus musculus
tgcagacgcgcatgtgcttcagaaa

SEQ ID NO: 145138 - DNA, 25 bp, Mus musculus
tgcagacgcggatctcaggacaaga

SEQ ID NO: 145139 - DNA, 25 bp, Mus musculus
tgcagacggacatgaagaccaccaa

SEQ ID NO: 145140 - DNA, 25 bp, Mus musculus
tgcagacggtcatgaaggacatcct

SEQ ID NO: 145141 - DNA, 25 bp, Mus musculus
tgcagactacaccttccctttgcag

SEQ ID NO: 145142 - DNA, 25 bp, Mus musculus
tgcagactaccctacagagcagagt

SEQ ID NO: 145143 - DNA, 25 bp, Mus musculus
tgcagactagactgctgccctcatc

SEQ ID NO: 145144 - DNA, 25 bp, Mus musculus
tgcagactattacagcccagaatgc

SEQ ID NO: 145145 - DNA, 25 bp, Mus musculus
tgcagactctgaagccagtagctga

SEQ ID NO: 145146 - DNA, 25 bp, Mus musculus
tgcagactgcagagccttaatagac

SEQ ID NO: 145147 - DNA, 25 bp, Mus musculus
tgcagactgtgcagaaccctacatg

SEQ ID NO: 145148 - DNA, 25 bp, Mus musculus
tgcagactgtgcctatcgtgaccta

SEQ ID NO: 145149 - DNA, 25 bp, Mus musculus
tgcagacttcgtccatccagcaggg

SEQ ID NO: 145150 - DNA, 25 bp, Mus musculus
tgcagacttcttcgctggattggcc

SEQ ID NO: 145151 - DNA, 25 bp, Mus musculus
tgcagagaaaagacaggagtgacct

SEQ ID NO: 145152 - DNA, 25 bp, Mus musculus
tgcagagaatttcatccagttccct

SEQ ID NO: 145153 - DNA, 25 bp, Mus musculus
tgcagagacagctagctatccagcg

SEQ ID NO: 145154 - DNA, 25 bp, Mus musculus
tgcagagaccttgccaggagaacca

SEQ ID NO: 145155 - DNA, 25 bp, Mus musculus
tgcagagaggatcaacacacaagcc

SEQ ID NO: 145156 - DNA, 25 bp, Mus musculus
tgcagagcaagcaggcctgcaccgt

SEQ ID NO: 145157 - DNA, 25 bp, Mus musculus
tgcagagcaccccagactggcatgt

SEQ ID NO: 145158 - DNA, 25 bp, Mus musculus
tgcagagcaccctaaccggaagtaa

SEQ ID NO: 145159 - DNA, 25 bp, Mus musculus
tgcagagcactatggtcaccgggaa

SEQ ID NO: 145160 - DNA, 25 bp, Mus musculus
tgcagagcaggacctgaccacaaag

SEQ ID NO: 145161 - DNA, 25 bp, Mus musculus
tgcagagccagccaacactgatgat

SEQ ID NO: 145162 - DNA, 25 bp, Mus musculus
tgcagagccatcgagtagggacctt

SEQ ID NO: 145163 - DNA, 25 bp, Mus musculus
tgcagagccatgtactcttcaagct

SEQ ID NO: 145164 - DNA, 25 bp, Mus musculus
tgcagagcccatcaaaagccgggac

SEQ ID NO: 145165 - DNA, 25 bp, Mus musculus
tgcagagctacaagcgggactcggt

SEQ ID NO: 145166 - DNA, 25 bp, Mus musculus
tgcagagctgaattcgggccacttt

SEQ ID NO: 145167 - DNA, 25 bp, Mus musculus
tgcagaggactatgccaggaaactg

SEQ ID NO: 145168 - DNA, 25 bp, Mus musculus
tgcagaggccacagcttctcaagga

SEQ ID NO: 145169 - DNA, 25 bp, Mus musculus
tgcagaggcctacattccacagaga

SEQ ID NO: 145170 - DNA, 25 bp, Mus musculus
tgcagaggctcggagacggatccta

SEQ ID NO: 145171 - DNA, 25 bp, Mus musculus
tgcagaggcttcagactgacggacg

SEQ ID NO: 145172 - DNA, 25 bp, Mus musculus
tgcagagggcctatgaggccatacg

SEQ ID NO: 145173 - DNA, 25 bp, Mus musculus
tgcagagtctccactgcgcattctg

SEQ ID NO: 145174 - DNA, 25 bp, Mus musculus
tgcagagtctggtggaggctttcca

SEQ ID NO: 145175 - DNA, 25 bp, Mus musculus
tgcagagtcttcaacaaacacccag

SEQ ID NO: 145176 - DNA, 25 bp, Mus musculus
tgcagagtctttgtacatcgcccgg

SEQ ID NO: 145177 - DNA, 25 bp, Mus musculus
tgcagagtgccatgaagagtgcttc

SEQ ID NO: 145178 - DNA, 25 bp, Mus musculus
tgcagagtgtacaggctcaggccct

SEQ ID NO: 145179 - DNA, 25 bp, Mus musculus
tgcagagttacgaccttgattatcc

SEQ ID NO: 145180 - DNA, 25 bp, Mus musculus
tgcagagtttgccttcgagtacgct

SEQ ID NO: 145181 - DNA, 25 bp, Mus musculus
tgcagatacctttgagggtgccctt

SEQ ID NO: 145182 - DNA, 25 bp, Mus musculus
tgcagatagacgaggaaagcgccct

SEQ ID NO: 145183 - DNA, 25 bp, Mus musculus
tgcagatcactccaagtccccggag

SEQ ID NO: 145184 - DNA, 25 bp, Mus musculus
tgcagatcagaatgttggagagcct

SEQ ID NO: 145185 - DNA, 25 bp, Mus musculus
tgcagatcatgctacagcgcaggaa

SEQ ID NO: 145186 - DNA, 25 bp, Mus musculus
tgcagatccctaactggtaacaggc

SEQ ID NO: 145187 - DNA, 25 bp, Mus musculus
tgcagatgagaaagcgcagaggcct

SEQ ID NO: 145188 - DNA, 25 bp, Mus musculus
tgcagatgatcaagcggaaccagct

SEQ ID NO: 145189 - DNA, 25 bp, Mus musculus
tgcagatgcacgagcctttgacagg

SEQ ID NO: 145190 - DNA, 25 bp, Mus musculus
tgcagatgcgacagtgctggcaatg

SEQ ID NO: 145191 - DNA, 25 bp, Mus musculus
tgcagatggcgtttatggcgctcac

SEQ ID NO: 145192 - DNA, 25 bp, Mus musculus
tgcagatgtcacttcttctgagccc

SEQ ID NO: 145193 - DNA, 25 bp, Mus musculus
tgcagattctgctcgaggcagccag

SEQ ID NO: 145194 - DNA, 25 bp, Mus musculus
tgcagattgagttcataagtcaggg

SEQ ID NO: 145195 - DNA, 25 bp, Mus musculus
tgcagattggcagctcagaaacaac

SEQ ID NO: 145196 - DNA, 25 bp, Mus musculus
tgcagattttgtgaccctccaggcg

SEQ ID NO: 145197 - DNA, 25 bp, Mus musculus
tgcagcaagaccctgtggcatcctc

SEQ ID NO: 145198 - DNA, 25 bp, Mus musculus
tgcagcaattgctggactatccaga

SEQ ID NO: 145199 - DNA, 25 bp, Mus musculus
tgcagcaccctgagacggtgggctc

SEQ ID NO: 145200 - DNA, 25 bp, Mus musculus
tgcagcaccttgaccttggacacgg

SEQ ID NO: 145201 - DNA, 25 bp, Mus musculus
tgcagcactagtaaggttgggaacc

SEQ ID NO: 145202 - DNA, 25 bp, Mus musculus
tgcagcactcagagcggttgggaac

SEQ ID NO: 145203 - DNA, 25 bp, Mus musculus
tgcagcagaacaccttgaaactccg

SEQ ID NO: 145204 - DNA, 25 bp, Mus musculus
tgcagcagaagatctaccacatcat

SEQ ID NO: 145205 - DNA, 25 bp, Mus musculus
tgcagcagagcattgccagagagcc

SEQ ID NO: 145206 - DNA, 25 bp, Mus musculus
tgcagcagattgaaaccaggaaccg

SEQ ID NO: 145207 - DNA, 25 bp, Mus musculus
tgcagcagccaaggccgctacgaaa

SEQ ID NO: 145208 - DNA, 25 bp, Mus musculus
tgcagcagctcgaggtaccactcat

SEQ ID NO: 145209 - DNA, 25 bp, Mus musculus
tgcagcagctctatagacaggccat

SEQ ID NO: 145210 - DNA, 25 bp, Mus musculus
tgcagcaggaggacccaatggatag

SEQ ID NO: 145211 - DNA, 25 bp, Mus musculus
tgcagcaggccgtcacaggaatttc

SEQ ID NO: 145212 - DNA, 25 bp, Mus musculus
tgcagcaggcctacgctggagtgca

SEQ ID NO: 145213 - DNA, 25 bp, Mus musculus
tgcagcaggcctagatgtgtcccaa

SEQ ID NO: 145214 - DNA, 25 bp, Mus musculus
tgcagcaggctaaggatgagatcac

SEQ ID NO: 145215 - DNA, 25 bp, Mus musculus
tgcagcaggctatgaacagagtgag

SEQ ID NO: 145216 - DNA, 25 bp, Mus musculus
tgcagcatacggatcttcacagtag

SEQ ID NO: 145217 - DNA, 25 bp, Mus musculus
tgcagcattgcaagccattccgagg

SEQ ID NO: 145218 - DNA, 25 bp, Mus musculus
tgcagccaagagtgagccggtttcc

SEQ ID NO: 145219 - DNA, 25 bp, Mus musculus
tgcagccaccaacacaataaacaca

SEQ ID NO: 145220 - DNA, 25 bp, Mus musculus
tgcagccagattggagtggcccctg

SEQ ID NO: 145221 - DNA, 25 bp, Mus musculus
tgcagccagcccatggttggagtga

SEQ ID NO: 145222 - DNA, 25 bp, Mus musculus
tgcagccaggtctccactaataaaa

SEQ ID NO: 145223 - DNA, 25 bp, Mus musculus
tgcagccagttcatacccatggagg

SEQ ID NO: 145224 - DNA, 25 bp, Mus musculus
tgcagccccatggaacaggatgatg

SEQ ID NO: 145225 - DNA, 25 bp, Mus musculus
tgcagccccggctggaatggagagc

SEQ ID NO: 145226 - DNA, 25 bp, Mus musculus
tgcagccctatgatgtggagattcg

SEQ ID NO: 145227 - DNA, 25 bp, Mus musculus
tgcagccctgccatgaccctgtggt

SEQ ID NO: 145228 - DNA, 25 bp, Mus musculus
tgcagccctgccgtgcttgaggaag

SEQ ID NO: 145229 - DNA, 25 bp, Mus musculus
tgcagccgcgatcaaaggcgcagtt

SEQ ID NO: 145230 - DNA, 25 bp, Mus musculus
tgcagccgctgcagagataacgcct

SEQ ID NO: 145231 - DNA, 25 bp, Mus musculus
tgcagccggaaaggtccagatagat

SEQ ID NO: 145232 - DNA, 25 bp, Mus musculus
tgcagccggaagtgcagcgctatga

SEQ ID NO: 145233 - DNA, 25 bp, Mus musculus
tgcagcctcggcctggaaagtttgt

SEQ ID NO: 145234 - DNA, 25 bp, Mus musculus
tgcagcctgaaaggacactgaagtc

SEQ ID NO: 145235 - DNA, 25 bp, Mus musculus
tgcagcctgccctaaatgagagatc

SEQ ID NO: 145236 - DNA, 25 bp, Mus musculus
tgcagcctggaaacgaaggagctct

SEQ ID NO: 145237 - DNA, 25 bp, Mus musculus
tgcagcctgggaccttgttggacct

SEQ ID NO: 145238 - DNA, 25 bp, Mus musculus
tgcagcctgtctgggtctcctgtac

SEQ ID NO: 145239 - DNA, 25 bp, Mus musculus
tgcagccttaaacatccaagtgggc

SEQ ID NO: 145240 - DNA, 25 bp, Mus musculus
tgcagccttccagattgacggacat

SEQ ID NO: 145241 - DNA, 25 bp, Mus musculus
tgcagccttgcagtcttgccagaca

SEQ ID NO: 145242 - DNA, 25 bp, Mus musculus
tgcagcgaaccatgatcagatactt

SEQ ID NO: 145243 - DNA, 25 bp, Mus musculus
tgcagcgaactttccagagcaccca

SEQ ID NO: 145244 - DNA, 25 bp, Mus musculus
tgcagcgacacgtagatgccatctt

SEQ ID NO: 145245 - DNA, 25 bp, Mus musculus
tgcagcgcagagagcagctaaagaa

SEQ ID NO: 145246 - DNA, 25 bp, Mus musculus
tgcagcgcaggagccgaacatgtga

SEQ ID NO: 145247 - DNA, 25 bp, Mus musculus
tgcagcgcctctccggcttggctga

SEQ ID NO: 145248 - DNA, 25 bp, Mus musculus
tgcagcgctcaccgtcaggaaggca

SEQ ID NO: 145249 - DNA, 25 bp, Mus musculus
tgcagcgcttcaagaccggcgcctt

SEQ ID NO: 145250 - DNA, 25 bp, Mus musculus
tgcagcggcctttggaagaattgcc

SEQ ID NO: 145251 - DNA, 25 bp, Mus musculus
tgcagcggctggaaccacattcttt

SEQ ID NO: 145252 - DNA, 25 bp, Mus musculus
tgcagcgggagattcaccaggactg

SEQ ID NO: 145253 - DNA, 25 bp, Mus musculus
tgcagcgtgagatccagatggactc

SEQ ID NO: 145254 - DNA, 25 bp, Mus musculus
tgcagcgtgtggatgtttctacctc

SEQ ID NO: 145255 - DNA, 25 bp, Mus musculus
tgcagcgttcatactcttcaggaag

SEQ ID NO: 145256 - DNA, 25 bp, Mus musculus
tgcagctcaagcaaagcacgtgtga

SEQ ID NO: 145257 - DNA, 25 bp, Mus musculus
tgcagctcaccagaatgtatccagg

SEQ ID NO: 145258 - DNA, 25 bp, Mus musculus
tgcagctcacgccagaggtgcaact

SEQ ID NO: 145259 - DNA, 25 bp, Mus musculus
tgcagctgccagatagcatgaagct

SEQ ID NO: 145260 - DNA, 25 bp, Mus musculus
tgcagctgccgccaggtgaagatct

SEQ ID NO: 145261 - DNA, 25 bp, Mus musculus
tgcagctgctcatttcagctgggtg

SEQ ID NO: 145262 - DNA, 25 bp, Mus musculus
tgcagctggcaaaacgacgatcttg

SEQ ID NO: 145263 - DNA, 25 bp, Mus musculus
tgcagctgtccatggcagaaaacaa

SEQ ID NO: 145264 - DNA, 25 bp, Mus musculus
tgcagctgttctccggaagcgcaag

SEQ ID NO: 145265 - DNA, 25 bp, Mus musculus
tgcagcttaaagaaaatcccatggt

SEQ ID NO: 145266 - DNA, 25 bp, Mus musculus
tgcagcttacagatatgctcagcca

SEQ ID NO: 145267 - DNA, 25 bp, Mus musculus
tgcagcttagagaggaaacaggctc

SEQ ID NO: 145268 - DNA, 25 bp, Mus musculus
tgcagcttccagttccctgaggagg

SEQ ID NO: 145269 - DNA, 25 bp, Mus musculus
tgcagcttcgaattgctaggattcc

SEQ ID NO: 145270 - DNA, 25 bp, Mus musculus
tgcagcttcgccatgtcgtcggtgt

SEQ ID NO: 145271 - DNA, 25 bp, Mus musculus
tgcagcttgcacagaagtcccagta

SEQ ID NO: 145272 - DNA, 25 bp, Mus musculus
tgcagcttggagacatcatcgatgg

SEQ ID NO: 145273 - DNA, 25 bp, Mus musculus
tgcagcttgtaggtgacaaagagcc

SEQ ID NO: 145274 - DNA, 25 bp, Mus musculus
tgcaggaaaagtgaatcttggcgcc

SEQ ID NO: 145275 - DNA, 25 bp, Mus musculus
tgcaggaaacccacgtgacatgcgg

SEQ ID NO: 145276 - DNA, 25 bp, Mus musculus
tgcaggaaatgtgtatccacagccc

SEQ ID NO: 145277 - DNA, 25 bp, Mus musculus
tgcaggaacacacagaccagatctg

SEQ ID NO: 145278 - DNA, 25 bp, Mus musculus
tgcaggaagtcattggctcagccat

SEQ ID NO: 145279 - DNA, 25 bp, Mus musculus
tgcaggacactggaacaggagaagt

SEQ ID NO: 145280 - DNA, 25 bp, Mus musculus
tgcaggaccattccgccagtgtgga

SEQ ID NO: 145281 - DNA, 25 bp, Mus musculus
tgcaggaccggtttgctcaagataa

SEQ ID NO: 145282 - DNA, 25 bp, Mus musculus
tgcaggacctaaaggatgtgacccg

SEQ ID NO: 145283 - DNA, 25 bp, Mus musculus
tgcaggacgtgaccgatgaccacat

SEQ ID NO: 145284 - DNA, 25 bp, Mus musculus
tgcaggactatgtcagcacacagag

SEQ ID NO: 145285 - DNA, 25 bp, Mus musculus
tgcaggacttgctcccgagcacatc

SEQ ID NO: 145286 - DNA, 25 bp, Mus musculus
tgcaggagaggtttatcggagccac

SEQ ID NO: 145287 - DNA, 25 bp, Mus musculus
tgcaggagatgtctatcgtctggcc

SEQ ID NO: 145288 - DNA, 25 bp, Mus musculus
tgcaggagcaccttcgggcctgtag

SEQ ID NO: 145289 - DNA, 25 bp, Mus musculus
tgcaggagcctttcttgggagtgac

SEQ ID NO: 145290 - DNA, 25 bp, Mus musculus
tgcaggaggtcagagctctggacaa

SEQ ID NO: 145291 - DNA, 25 bp, Mus musculus
tgcaggagttcaaggatgtggccct

SEQ ID NO: 145292 - DNA, 25 bp, Mus musculus
tgcaggatcttcacgctgagcagga

SEQ ID NO: 145293 - DNA, 25 bp, Mus musculus
tgcaggatgacaactcccctgggac

SEQ ID NO: 145294 - DNA, 25 bp, Mus musculus
tgcaggatgatttactgatggacaa

SEQ ID NO: 145295 - DNA, 25 bp, Mus musculus
tgcaggattggatggtggcctacct

SEQ ID NO: 145296 - DNA, 25 bp, Mus musculus
tgcaggcaagactgagcaagattaa

SEQ ID NO: 145297 - DNA, 25 bp, Mus musculus
tgcaggcaccatctatgtgaaccag

SEQ ID NO: 145298 - DNA, 25 bp, Mus musculus
tgcaggcagcctaactgaagagagt

SEQ ID NO: 145299 - DNA, 25 bp, Mus musculus
tgcaggccaagcgaagtgaggcaca

SEQ ID NO: 145300 - DNA, 25 bp, Mus musculus
tgcaggccagagttggttccccaaa

SEQ ID NO: 145301 - DNA, 25 bp, Mus musculus
tgcaggccagcgtgctaatgatcaa

SEQ ID NO: 145302 - DNA, 25 bp, Mus musculus
tgcaggcccagttgatcagctatag

SEQ ID NO: 145303 - DNA, 25 bp, Mus musculus
tgcaggccttgcacaccttactggg

SEQ ID NO: 145304 - DNA, 25 bp, Mus musculus
tgcaggccttgggaggacaatgcct

SEQ ID NO: 145305 - DNA, 25 bp, Mus musculus
tgcaggcgagagtgtccagtagtcc

SEQ ID NO: 145306 - DNA, 25 bp, Mus musculus
tgcaggctgtgtccaacttgtccgg

SEQ ID NO: 145307 - DNA, 25 bp, Mus musculus
tgcagggacaacacattaacttatt

SEQ ID NO: 145308 - DNA, 25 bp, Mus musculus
tgcagggacagattgccctcctggt

SEQ ID NO: 145309 - DNA, 25 bp, Mus musculus
tgcagggaccaggaatgtacagagt

SEQ ID NO: 145310 - DNA, 25 bp, Mus musculus
tgcagggacgagaatgacaggctcc

SEQ ID NO: 145311 - DNA, 25 bp, Mus musculus
tgcagggcatttccggcctgaagcc

SEQ ID NO: 145312 - DNA, 25 bp, Mus musculus
tgcagggccgtcaaagactgtctcc

SEQ ID NO: 145313 - DNA, 25 bp, Mus musculus
tgcagggcctgtagcaactgaccct

SEQ ID NO: 145314 - DNA, 25 bp, Mus musculus
tgcagggctacatgagagaaggacc

SEQ ID NO: 145315 - DNA, 25 bp, Mus musculus
tgcagggctccagagcagcaagaac

SEQ ID NO: 145316 - DNA, 25 bp, Mus musculus
tgcagggtcgccaggaaatgtcaac

SEQ ID NO: 145317 - DNA, 25 bp, Mus musculus
tgcagggtgatacgaacagccaaaa

SEQ ID NO: 145318 - DNA, 25 bp, Mus musculus
tgcaggtaagattgccagcggctct

SEQ ID NO: 145319 - DNA, 25 bp, Mus musculus
tgcaggtcaattactccctaaaggg

SEQ ID NO: 145320 - DNA, 25 bp, Mus musculus
tgcaggtcactaccagccaccgaga

SEQ ID NO: 145321 - DNA, 25 bp, Mus musculus
tgcaggtcagcatgaacgacggcct

SEQ ID NO: 145322 - DNA, 25 bp, Mus musculus
tgcaggtcaggagtcatctttcccc

SEQ ID NO: 145323 - DNA, 25 bp, Mus musculus
tgcaggtccgccaaactgaagatta

SEQ ID NO: 145324 - DNA, 25 bp, Mus musculus
tgcaggtgaatgatacactgacttc

SEQ ID NO: 145325 - DNA, 25 bp, Mus musculus
tgcaggtgctctagaaacttcaaaa

SEQ ID NO: 145326 - DNA, 25 bp, Mus musculus
tgcaggttagacctccagacaccgg

SEQ ID NO: 145327 - DNA, 25 bp, Mus musculus
tgcaggttccagaggctcgctgctt

SEQ ID NO: 145328 - DNA, 25 bp, Mus musculus
tgcaggttctggactatgcccatcg

SEQ ID NO: 145329 - DNA, 25 bp, Mus musculus
tgcagtacacatggacgcacggacg

SEQ ID NO: 145330 - DNA, 25 bp, Mus musculus
tgcagtacctacagaacatctctgg

SEQ ID NO: 145331 - DNA, 25 bp, Mus musculus
tgcagtacgcaagcagcagagggct

SEQ ID NO: 145332 - DNA, 25 bp, Mus musculus
tgcagtacgggaaagcaacagcacc

SEQ ID NO: 145333 - DNA, 25 bp, Mus musculus
tgcagtactacagccgagtgtccct

SEQ ID NO: 145334 - DNA, 25 bp, Mus musculus
tgcagtagcatctggacatcacaag

SEQ ID NO: 145335 - DNA, 25 bp, Mus musculus
tgcagtataacaaaacgcccggatt

SEQ ID NO: 145336 - DNA, 25 bp, Mus musculus
tgcagtatagcatccatccagatta

SEQ ID NO: 145337 - DNA, 25 bp, Mus musculus
tgcagtattctcgtagacccagtgg

SEQ ID NO: 145338 - DNA, 25 bp, Mus musculus
tgcagtattgacacgtccccgggta

SEQ ID NO: 145339 - DNA, 25 bp, Mus musculus
tgcagtattgctgtggaagccaccc

SEQ ID NO: 145340 - DNA, 25 bp, Mus musculus
tgcagtcaacgaccctcaggatatc

SEQ ID NO: 145341 - DNA, 25 bp, Mus musculus
tgcagtcaccggagcaggtaaagtc

SEQ ID NO: 145342 - DNA, 25 bp, Mus musculus
tgcagtcagtcaacgtcggcctttt

SEQ ID NO: 145343 - DNA, 25 bp, Mus musculus
tgcagtcagttaccaagagcggtcc

SEQ ID NO: 145344 - DNA, 25 bp, Mus musculus
tgcagtcatacaacaagcggctcaa

SEQ ID NO: 145345 - DNA, 25 bp, Mus musculus
tgcagtcatcgcctaagaccacgga

SEQ ID NO: 145346 - DNA, 25 bp, Mus musculus
tgcagtcatggagctcttcaggccc

SEQ ID NO: 145347 - DNA, 25 bp, Mus musculus
tgcagtcatggcagctgagtccctg

SEQ ID NO: 145348 - DNA, 25 bp, Mus musculus
tgcagtcatgttcgttccctgcggg

SEQ ID NO: 145349 - DNA, 25 bp, Mus musculus
tgcagtccctcggtgagagacacgt

SEQ ID NO: 145350 - DNA, 25 bp, Mus musculus
tgcagtcgtgccactagtaggcaaa

SEQ ID NO: 145351 - DNA, 25 bp, Mus musculus
tgcagtcgtgcggtttacggaaagc

SEQ ID NO: 145352 - DNA, 25 bp, Mus musculus
tgcagtctacatacgcaacacccgt

SEQ ID NO: 145353 - DNA, 25 bp, Mus musculus
tgcagtctacgtgaaaggcacccac

SEQ ID NO: 145354 - DNA, 25 bp, Mus musculus
tgcagtgaggttaccaccgcctttg

SEQ ID NO: 145355 - DNA, 25 bp, Mus musculus
tgcagtgcaaacaaatacttctggg

SEQ ID NO: 145356 - DNA, 25 bp, Mus musculus
tgcagtgcatgaacaccagcacagg

SEQ ID NO: 145357 - DNA, 25 bp, Mus musculus
tgcagtgcccatgatcacaggtgcc

SEQ ID NO: 145358 - DNA, 25 bp, Mus musculus
tgcagtgcggctcctttaaacgtcg

SEQ ID NO: 145359 - DNA, 25 bp, Mus musculus
tgcagtggaacgttgtcaggcccga

SEQ ID NO: 145360 - DNA, 25 bp, Mus musculus
tgcagtggcaagactaactctgtcc

SEQ ID NO: 145361 - DNA, 25 bp, Mus musculus
tgcagtggcagggttaaaagcaaac

SEQ ID NO: 145362 - DNA, 25 bp, Mus musculus
tgcagtggcataagatgaaggctcc

SEQ ID NO: 145363 - DNA, 25 bp, Mus musculus
tgcagtggctagagcagagacatct

SEQ ID NO: 145364 - DNA, 25 bp, Mus musculus
tgcagtggctgaggctggacttcat

SEQ ID NO: 145365 - DNA, 25 bp, Mus musculus
tgcagtgggcatcacatacgcctgg

SEQ ID NO: 145366 - DNA, 25 bp, Mus musculus
tgcagtgtaccatcagcggaaccga

SEQ ID NO: 145367 - DNA, 25 bp, Mus musculus
tgcagtgtctatgtcctcggaggtg

SEQ ID NO: 145368 - DNA, 25 bp, Mus musculus
tgcagtgtgacaggtagcctcacca

SEQ ID NO: 145369 - DNA, 25 bp, Mus musculus
tgcagtgttcaactcttagagccca

SEQ ID NO: 145370 - DNA, 25 bp, Mus musculus
tgcagtgttcctgttgcctggacct

SEQ ID NO: 145371 - DNA, 25 bp, Mus musculus
tgcagttaaaggaaaccaaggtgcc

SEQ ID NO: 145372 - DNA, 25 bp, Mus musculus
tgcagttaacatgttccgaaccttg

SEQ ID NO: 145373 - DNA, 25 bp, Mus musculus
tgcagttccactcaatgccgatcag

SEQ ID NO: 145374 - DNA, 25 bp, Mus musculus
tgcagttcgcggagctcttccagcg

SEQ ID NO: 145375 - DNA, 25 bp, Mus musculus
tgcagttctaacactatggccctgg

SEQ ID NO: 145376 - DNA, 25 bp, Mus musculus
tgcagttctcaggaaggatccggaa

SEQ ID NO: 145377 - DNA, 25 bp, Mus musculus
tgcagttctccaggcctgaatggct

SEQ ID NO: 145378 - DNA, 25 bp, Mus musculus
tgcagttgacagaagggtcacgtcc

SEQ ID NO: 145379 - DNA, 25 bp, Mus musculus
tgcagttgctcaaacgcagtcgtct

SEQ ID NO: 145380 - DNA, 25 bp, Mus musculus
tgcagttgctcctgaaagccgggac

SEQ ID NO: 145381 - DNA, 25 bp, Mus musculus
tgcagttggacccaatgccaccagg

SEQ ID NO: 145382 - DNA, 25 bp, Mus musculus
tgcagttgggtacatcacatcagtc

SEQ ID NO: 145383 - DNA, 25 bp, Mus musculus
tgcagtttatacagagggccagctg

SEQ ID NO: 145384 - DNA, 25 bp, Mus musculus
tgcagttttccagggtagcccgggt

SEQ ID NO: 145385 - DNA, 25 bp, Mus musculus
tgcataaaaatgagcagcgcacctc

SEQ ID NO: 145386 - DNA, 25 bp, Mus musculus
tgcataaagtctgcctccaacctgt

SEQ ID NO: 145387 - DNA, 25 bp, Mus musculus
tgcataacgtggatggtgacagctg

SEQ ID NO: 145388 - DNA, 25 bp, Mus musculus
tgcataagtataacccctgtgcgcc

SEQ ID NO: 145389 - DNA, 25 bp, Mus musculus
tgcataatccccttggcagctggcc

SEQ ID NO: 145390 - DNA, 25 bp, Mus musculus
tgcataatgggacgaaagccttcct

SEQ ID NO: 145391 - DNA, 25 bp, Mus musculus
tgcatacacaatggcctaagggtcc

SEQ ID NO: 145392 - DNA, 25 bp, Mus musculus
tgcatacggacttgcttgaggagga

SEQ ID NO: 145393 - DNA, 25 bp, Mus musculus
tgcatagacagggacgagctgctca

SEQ ID NO: 145394 - DNA, 25 bp, Mus musculus
tgcatagcaaaggactgtgccgctg

SEQ ID NO: 145395 - DNA, 25 bp, Mus musculus
tgcatatcgcagtcatcctcagaat

SEQ ID NO: 145396 - DNA, 25 bp, Mus musculus
tgcatatgtctatcagaatgagagc

SEQ ID NO: 145397 - DNA, 25 bp, Mus musculus
tgcatattaccactctgtttattct

SEQ ID NO: 145398 - DNA, 25 bp, Mus musculus
tgcatcaagttcatgacgctcctga

SEQ ID NO: 145399 - DNA, 25 bp, Mus musculus
tgcatcaataaagcccaaggactcg

SEQ ID NO: 145400 - DNA, 25 bp, Mus musculus
tgcatcacatgcagtaggacatcat

SEQ ID NO: 145401 - DNA, 25 bp, Mus musculus
tgcatcagacatacctagaggagct

SEQ ID NO: 145402 - DNA, 25 bp, Mus musculus
tgcatcagcactgcatcagactgtg

SEQ ID NO: 145403 - DNA, 25 bp, Mus musculus
tgcatcagcatccacgacgaggttc

SEQ ID NO: 145404 - DNA, 25 bp, Mus musculus
tgcatcagccctgcctttcggacac

SEQ ID NO: 145405 - DNA, 25 bp, Mus musculus
tgcatcagcgtggaaaagtgttacc

SEQ ID NO: 145406 - DNA, 25 bp, Mus musculus
tgcatcagctccagggcaacaagga

SEQ ID NO: 145407 - DNA, 25 bp, Mus musculus
tgcatcagcttgaccaacttggacg

SEQ ID NO: 145408 - DNA, 25 bp, Mus musculus
tgcatcaggaagctgctacgcaagg

SEQ ID NO: 145409 - DNA, 25 bp, Mus musculus
tgcatcagttttgtcacgcagcatg

SEQ ID NO: 145410 - DNA, 25 bp, Mus musculus
tgcatcatccgaaaaatcaaagcta

SEQ ID NO: 145411 - DNA, 25 bp, Mus musculus
tgcatcatccttgggccgtcgggtt

SEQ ID NO: 145412 - DNA, 25 bp, Mus musculus
tgcatcatgcctcatattgataatg

SEQ ID NO: 145413 - DNA, 25 bp, Mus musculus
tgcatccacactgactgagaggcct

SEQ ID NO: 145414 - DNA, 25 bp, Mus musculus
tgcatccacggaggcggtgggctcg

SEQ ID NO: 145415 - DNA, 25 bp, Mus musculus
tgcatcccctatcggccagtgtgtg

SEQ ID NO: 145416 - DNA, 25 bp, Mus musculus
tgcatccctctgaaaaagcctggct

SEQ ID NO: 145417 - DNA, 25 bp, Mus musculus
tgcatccgacaggacaagggtttcc

SEQ ID NO: 145418 - DNA, 25 bp, Mus musculus
tgcatccgggctgtacaagacgaca

SEQ ID NO: 145419 - DNA, 25 bp, Mus musculus
tgcatcctacctcagtccacagagg

SEQ ID NO: 145420 - DNA, 25 bp, Mus musculus
tgcatccttgctgtacctgacgaag

SEQ ID NO: 145421 - DNA, 25 bp, Mus musculus
tgcatcgaaggcattcacctatacc

SEQ ID NO: 145422 - DNA, 25 bp, Mus musculus
tgcatcgacggcataggcagcttca

SEQ ID NO: 145423 - DNA, 25 bp, Mus musculus
tgcatcgagggctttgcagagccag

SEQ ID NO: 145424 - DNA, 25 bp, Mus musculus
tgcatcgcaaagtcaagttaaccct

SEQ ID NO: 145425 - DNA, 25 bp, Mus musculus
tgcatcggacatactcggcgccagc

SEQ ID NO: 145426 - DNA, 25 bp, Mus musculus
tgcatcggctttcctgtcctggtgg

SEQ ID NO: 145427 - DNA, 25 bp, Mus musculus
tgcatctactacttcgagcctggcc

SEQ ID NO: 145428 - DNA, 25 bp, Mus musculus
tgcatctccatcgtacgcagtggcg

SEQ ID NO: 145429 - DNA, 25 bp, Mus musculus
tgcatctctgtccagcaggttaggt

SEQ ID NO: 145430 - DNA, 25 bp, Mus musculus
tgcatctgggaagaccactgtggcc

SEQ ID NO: 145431 - DNA, 25 bp, Mus musculus
tgcatgaagtgcatcccatcagttc

SEQ ID NO: 145432 - DNA, 25 bp, Mus musculus
tgcatgacaagccaagcaggtgctc

SEQ ID NO: 145433 - DNA, 25 bp, Mus musculus
tgcatgaccttcagattggagagaa

SEQ ID NO: 145434 - DNA, 25 bp, Mus musculus
tgcatgacttgttcgagccaagagg

SEQ ID NO: 145435 - DNA, 25 bp, Mus musculus
tgcatgagccactacctgagagtgt

SEQ ID NO: 145436 - DNA, 25 bp, Mus musculus
tgcatgagttctttctgaggaagcc

SEQ ID NO: 145437 - DNA, 25 bp, Mus musculus
tgcatgatcacaggcgcagctcttt

SEQ ID NO: 145438 - DNA, 25 bp, Mus musculus
tgcatgcaagatactgacgaattcc

SEQ ID NO: 145439 - DNA, 25 bp, Mus musculus
tgcatgcagtacctagacagagcgg

SEQ ID NO: 145440 - DNA, 25 bp, Mus musculus
tgcatgccaatgagccaagtcctgg

SEQ ID NO: 145441 - DNA, 25 bp, Mus musculus
tgcatgccatgattacagaaactag

SEQ ID NO: 145442 - DNA, 25 bp, Mus musculus
tgcatgccctgctacacagtgacaa

SEQ ID NO: 145443 - DNA, 25 bp, Mus musculus
tgcatgcccttgtcgtgggacctgg

SEQ ID NO: 145444 - DNA, 25 bp, Mus musculus
tgcatgccggcatattcagcagctg

SEQ ID NO: 145445 - DNA, 25 bp, Mus musculus
tgcatgccttcccactggctttggg

SEQ ID NO: 145446 - DNA, 25 bp, Mus musculus
tgcatgcgcgcacaattggagccaa

SEQ ID NO: 145447 - DNA, 25 bp, Mus musculus
tgcatgctatgcttgaccacaggac

SEQ ID NO: 145448 - DNA, 25 bp, Mus musculus
tgcatggaaggaggcaagagcatcc

SEQ ID NO: 145449 - DNA, 25 bp, Mus musculus
tgcatggaccatcacatcctgtgtg

SEQ ID NO: 145450 - DNA, 25 bp, Mus musculus
tgcatggcacagactaccctcgtgt

SEQ ID NO: 145451 - DNA, 25 bp, Mus musculus
tgcatggcgcaaagctcaggaagtc

SEQ ID NO: 145452 - DNA, 25 bp, Mus musculus
tgcatgggcctcactgcagagtcct

SEQ ID NO: 145453 - DNA, 25 bp, Mus musculus
tgcatgggtgcgaaagaaaacggtt

SEQ ID NO: 145454 - DNA, 25 bp, Mus musculus
tgcatggtcatggaagccttcgaga

SEQ ID NO: 145455 - DNA, 25 bp, Mus musculus
tgcatgtactgagccgcaaggacaa

SEQ ID NO: 145456 - DNA, 25 bp, Mus musculus
tgcatgtagaacacaagaagaccct

SEQ ID NO: 145457 - DNA, 25 bp, Mus musculus
tgcatgtccctccaagaaggtccag

SEQ ID NO: 145458 - DNA, 25 bp, Mus musculus
tgcatgttaaaagactcctgaataa

SEQ ID NO: 145459 - DNA, 25 bp, Mus musculus
tgcatgttgcttctccaccaaaaga

SEQ ID NO: 145460 - DNA, 25 bp, Mus musculus
tgcattaagcaagtccctgagctgt

SEQ ID NO: 145461 - DNA, 25 bp, Mus musculus
tgcattaaggagagcctacggctgc

SEQ ID NO: 145462 - DNA, 25 bp, Mus musculus
tgcattagtgcgagagcccttcagc

SEQ ID NO: 145463 - DNA, 25 bp, Mus musculus
tgcattatcggaggagacctgcccg

SEQ ID NO: 145464 - DNA, 25 bp, Mus musculus
tgcattatgggaggcgcgcgctttt

SEQ ID NO: 145465 - DNA, 25 bp, Mus musculus
tgcattatgggggatacttgccttg

SEQ ID NO: 145466 - DNA, 25 bp, Mus musculus
tgcattcatcacaggtgctgcgcaa

SEQ ID NO: 145467 - DNA, 25 bp, Mus musculus
tgcattcatgcgctcagtgtcttca

SEQ ID NO: 145468 - DNA, 25 bp, Mus musculus
tgcattccgcacatcacggcctgga

SEQ ID NO: 145469 - DNA, 25 bp, Mus musculus
tgcattccgtcagatacacaaagtt

SEQ ID NO: 145470 - DNA, 25 bp, Mus musculus
tgcattcctgtagggacacacgagt

SEQ ID NO: 145471 - DNA, 25 bp, Mus musculus
tgcattcgcaagatggatcaccact

SEQ ID NO: 145472 - DNA, 25 bp, Mus musculus
tgcattctacagaccactcagcaga

SEQ ID NO: 145473 - DNA, 25 bp, Mus musculus
tgcattgaaggatgtcagctacagg

SEQ ID NO: 145474 - DNA, 25 bp, Mus musculus
tgcattgaagtggtggacagcgtcc

SEQ ID NO: 145475 - DNA, 25 bp, Mus musculus
tgcattgactgaggtgacactgggc

SEQ ID NO: 145476 - DNA, 25 bp, Mus musculus
tgcattgaggaacgttacaaggccg

SEQ ID NO: 145477 - DNA, 25 bp, Mus musculus
tgcattgcatgtctccgccactgct

SEQ ID NO: 145478 - DNA, 25 bp, Mus musculus
tgcattgccgatccagccagaaggc

SEQ ID NO: 145479 - DNA, 25 bp, Mus musculus
tgcattgcctcccattgcaaagtgg

SEQ ID NO: 145480 - DNA, 25 bp, Mus musculus
tgcattggtctttgggatcaacact

SEQ ID NO: 145481 - DNA, 25 bp, Mus musculus
tgcatttatatcaccattgttgaaa

SEQ ID NO: 145482 - DNA, 25 bp, Mus musculus
tgcatttcctagtgtgaacaaactg

SEQ ID NO: 145483 - DNA, 25 bp, Mus musculus
tgcatttcctttcattaactgggac

SEQ ID NO: 145484 - DNA, 25 bp, Mus musculus
tgcatttggcattcaatacccaggc

SEQ ID NO: 145485 - DNA, 25 bp, Mus musculus
tgcatttgtatcagggcaagcagta

SEQ ID NO: 145486 - DNA, 25 bp, Mus musculus
tgcatttgtgcccagaaaccttgac

SEQ ID NO: 145487 - DNA, 25 bp, Mus musculus
tgcatttgtgggaacgccagctgag

SEQ ID NO: 145488 - DNA, 25 bp, Mus musculus
tgcatttgtttgtggccaaggccta

SEQ ID NO: 145489 - DNA, 25 bp, Mus musculus
tgccaaaagttatgctccagagctg

SEQ ID NO: 145490 - DNA, 25 bp, Mus musculus
tgccaaaatcaactgcccagagggt

SEQ ID NO: 145491 - DNA, 25 bp, Mus musculus
tgccaaacgaatccagcagcgcttg

SEQ ID NO: 145492 - DNA, 25 bp, Mus musculus
tgccaaactgtatgagatcggagct

SEQ ID NO: 145493 - DNA, 25 bp, Mus musculus
tgccaaagaaagtgcagcccacagg

SEQ ID NO: 145494 - DNA, 25 bp, Mus musculus
tgccaaagagatcgccagaaccgtg

SEQ ID NO: 145495 - DNA, 25 bp, Mus musculus
tgccaaagatgtcaaccccgagaag

SEQ ID NO: 145496 - DNA, 25 bp, Mus musculus
tgccaaagctgatgagaactgtctc

SEQ ID NO: 145497 - DNA, 25 bp, Mus musculus
tgccaaatacaccaagcttcgagaa

SEQ ID NO: 145498 - DNA, 25 bp, Mus musculus
tgccaaatggcgaaagcgaaagagc

SEQ ID NO: 145499 - DNA, 25 bp, Mus musculus
tgccaaatgggtgcagtgatgacct

SEQ ID NO: 145500 - DNA, 25 bp, Mus musculus
tgccaacaggaggactgaagcagcc

SEQ ID NO: 145501 - DNA, 25 bp, Mus musculus
tgccaacaggtgtatcaggaacagg

SEQ ID NO: 145502 - DNA, 25 bp, Mus musculus
tgccaacaggttgaagtggagcctc

SEQ ID NO: 145503 - DNA, 25 bp, Mus musculus
tgccaacatagatgcccagtcaggg

SEQ ID NO: 145504 - DNA, 25 bp, Mus musculus
tgccaacattctaggaggacacagt

SEQ ID NO: 145505 - DNA, 25 bp, Mus musculus
tgccaaccggtaccttgctatgaag

SEQ ID NO: 145506 - DNA, 25 bp, Mus musculus
tgccaacctggggaggattttcaaa

SEQ ID NO: 145507 - DNA, 25 bp, Mus musculus
tgccaacgccttgagggtgtcactg

SEQ ID NO: 145508 - DNA, 25 bp, Mus musculus
tgccaacggatagagcagcagtacc

SEQ ID NO: 145509 - DNA, 25 bp, Mus musculus
tgccaacgtggtggtttacagctac

SEQ ID NO: 145510 - DNA, 25 bp, Mus musculus
tgccaactgtggagtgcgagaatac

SEQ ID NO: 145511 - DNA, 25 bp, Mus musculus
tgccaacttatgcagaactgctgtg

SEQ ID NO: 145512 - DNA, 25 bp, Mus musculus
tgccaacttccattgaacttcccag

SEQ ID NO: 145513 - DNA, 25 bp, Mus musculus
tgccaagaaggaaaactgcgtccgc

SEQ ID NO: 145514 - DNA, 25 bp, Mus musculus
tgccaagagagctgagaacacaaca

SEQ ID NO: 145515 - DNA, 25 bp, Mus musculus
tgccaagatgaagtaccaggagtgc

SEQ ID NO: 145516 - DNA, 25 bp, Mus musculus
tgccaagatgcagaaagtggacctg

SEQ ID NO: 145517 - DNA, 25 bp, Mus musculus
tgccaagcagacaggccagtggatt

SEQ ID NO: 145518 - DNA, 25 bp, Mus musculus
tgccaagccctgctgacagtggact

SEQ ID NO: 145519 - DNA, 25 bp, Mus musculus
tgccaagccgggtggacacaggcat

SEQ ID NO: 145520 - DNA, 25 bp, Mus musculus
tgccaagctgggaagaacactccag

SEQ ID NO: 145521 - DNA, 25 bp, Mus musculus
tgccaaggaactagaggccagcttt

SEQ ID NO: 145522 - DNA, 25 bp, Mus musculus
tgccaaggaagagacgaagaaagcc

SEQ ID NO: 145523 - DNA, 25 bp, Mus musculus
tgccaaggatgctgcacgcaagctg

SEQ ID NO: 145524 - DNA, 25 bp, Mus musculus
tgccaaggcgagtctttgagtccgc

SEQ ID NO: 145525 - DNA, 25 bp, Mus musculus
tgccaagggaagtcaccacagtgct

SEQ ID NO: 145526 - DNA, 25 bp, Mus musculus
tgccaagggtgatcaaggagaagcc

SEQ ID NO: 145527 - DNA, 25 bp, Mus musculus
tgccaagtcaaagccagattaaaag

SEQ ID NO: 145528 - DNA, 25 bp, Mus musculus
tgccaagtgacggaaaccatgcgtg

SEQ ID NO: 145529 - DNA, 25 bp, Mus musculus
tgccaagtgcctcattaagcagtgc

SEQ ID NO: 145530 - DNA, 25 bp, Mus musculus
tgccaagttgatcaaagggtcccgg

SEQ ID NO: 145531 - DNA, 25 bp, Mus musculus
tgccaatctgcacggaggagacctt

SEQ ID NO: 145532 - DNA, 25 bp, Mus musculus
tgccaatgttatccagcaggctggt

SEQ ID NO: 145533 - DNA, 25 bp, Mus musculus
tgccacacactacgaaagatttctg

SEQ ID NO: 145534 - DNA, 25 bp, Mus musculus
tgccacaccaactaggagaagctgg

SEQ ID NO: 145535 - DNA, 25 bp, Mus musculus
tgccacactggaagacggagggttt

SEQ ID NO: 145536 - DNA, 25 bp, Mus musculus
tgccacagaaacagctaacgaaggt

SEQ ID NO: 145537 - DNA, 25 bp, Mus musculus
tgccacagctgaattcccttctcag

SEQ ID NO: 145538 - DNA, 25 bp, Mus musculus
tgccacaggctctcttgaaggttga

SEQ ID NO: 145539 - DNA, 25 bp, Mus musculus
tgccacatacgtcaggaaagccttg

SEQ ID NO: 145540 - DNA, 25 bp, Mus musculus
tgccacattgcagaggaaccaaccg

SEQ ID NO: 145541 - DNA, 25 bp, Mus musculus
tgccacccacgagttcaagcaggcc

SEQ ID NO: 145542 - DNA, 25 bp, Mus musculus
tgccaccgcgagagacttggacact

SEQ ID NO: 145543 - DNA, 25 bp, Mus musculus
tgccacctgaggattgtgcctgcga

SEQ ID NO: 145544 - DNA, 25 bp, Mus musculus
tgccacctgtgtgaagaagtgcccc

SEQ ID NO: 145545 - DNA, 25 bp, Mus musculus
tgccaccttagactggagaccaagc

SEQ ID NO: 145546 - DNA, 25 bp, Mus musculus
tgccacgcctgtaagcgacgtggcc

SEQ ID NO: 145547 - DNA, 25 bp, Mus musculus
tgccacgctgagtccggaaactttg

SEQ ID NO: 145548 - DNA, 25 bp, Mus musculus
tgccacgggtggagtaaacctcctg

SEQ ID NO: 145549 - DNA, 25 bp, Mus musculus
tgccacggtggcagacatgcttcaa

SEQ ID NO: 145550 - DNA, 25 bp, Mus musculus
tgccactacagcttagatcgcagcc

SEQ ID NO: 145551 - DNA, 25 bp, Mus musculus
tgccactcagagcaatgacccggat

SEQ ID NO: 145552 - DNA, 25 bp, Mus musculus
tgccactctgtaatgtcctgtacag

SEQ ID NO: 145553 - DNA, 25 bp, Mus musculus
tgccactgaagaggactccgcaaaa

SEQ ID NO: 145554 - DNA, 25 bp, Mus musculus
tgccactgaagttagaggccagcgt

SEQ ID NO: 145555 - DNA, 25 bp, Mus musculus
tgccactgcagacttggtccaaggt

SEQ ID NO: 145556 - DNA, 25 bp, Mus musculus
tgccactggtaaggaggaacccaat

SEQ ID NO: 145557 - DNA, 25 bp, Mus musculus
tgccacttcttagctgcgcagtttc

SEQ ID NO: 145558 - DNA, 25 bp, Mus musculus
tgccagaaaagcagcgcacaggctg

SEQ ID NO: 145559 - DNA, 25 bp, Mus musculus
tgccagaaagccatagactgtggac

SEQ ID NO: 145560 - DNA, 25 bp, Mus musculus
tgccagaagccatgtagcacgtaac

SEQ ID NO: 145561 - DNA, 25 bp, Mus musculus
tgccagaagggatacatcggaactt

SEQ ID NO: 145562 - DNA, 25 bp, Mus musculus
tgccagaatcccctacacaaagagt

SEQ ID NO: 145563 - DNA, 25 bp, Mus musculus
tgccagaatcctcgaaaacatggac

SEQ ID NO: 145564 - DNA, 25 bp, Mus musculus
tgccagacaaaaataagagccccgg

SEQ ID NO: 145565 - DNA, 25 bp, Mus musculus
tgccagacaacaacaatcccgagag

SEQ ID NO: 145566 - DNA, 25 bp, Mus musculus
tgccagacacgtttccttacagacc

SEQ ID NO: 145567 - DNA, 25 bp, Mus musculus
tgccagactacacaggtgataagct

SEQ ID NO: 145568 - DNA, 25 bp, Mus musculus
tgccagactccatagccagcgttgg

SEQ ID NO: 145569 - DNA, 25 bp, Mus musculus
tgccagagagcgagaaaccagaggt

SEQ ID NO: 145570 - DNA, 25 bp, Mus musculus
tgccagagcagacagccaaacgaat

SEQ ID NO: 145571 - DNA, 25 bp, Mus musculus
tgccagagcccgttccaaagggaaa

SEQ ID NO: 145572 - DNA, 25 bp, Mus musculus
tgccagaggaagtaagaaagccacc

SEQ ID NO: 145573 - DNA, 25 bp, Mus musculus
tgccagagtcatgctattacatagc

SEQ ID NO: 145574 - DNA, 25 bp, Mus musculus
tgccagatgtagatggcgaccttcc

SEQ ID NO: 145575 - DNA, 25 bp, Mus musculus
tgccagatgtgtgtcccaaggaacc

SEQ ID NO: 145576 - DNA, 25 bp, Mus musculus
tgccagcaaaccaacagtcctgtga

SEQ ID NO: 145577 - DNA, 25 bp, Mus musculus
tgccagcaccacagagtaagcagtc

SEQ ID NO: 145578 - DNA, 25 bp, Mus musculus
tgccagcagcaaccgtagatcatag

SEQ ID NO: 145579 - DNA, 25 bp, Mus musculus
tgccagcagctaagacacagttgtg

SEQ ID NO: 145580 - DNA, 25 bp, Mus musculus
tgccagcagctgtgatacttgcccg

SEQ ID NO: 145581 - DNA, 25 bp, Mus musculus
tgccagcagtgagtacttccagagt

SEQ ID NO: 145582 - DNA, 25 bp, Mus musculus
tgccagccaccaggagattcaggat

SEQ ID NO: 145583 - DNA, 25 bp, Mus musculus
tgccagcctgagcaaacagccaaag

SEQ ID NO: 145584 - DNA, 25 bp, Mus musculus
tgccagcgaagaagaagatagtaac

SEQ ID NO: 145585 - DNA, 25 bp, Mus musculus
tgccagcgagggatagacgtgcctt

SEQ ID NO: 145586 - DNA, 25 bp, Mus musculus
tgccagcggtggtggtcagcttcta

SEQ ID NO: 145587 - DNA, 25 bp, Mus musculus
tgccagcgtagacgtgttccaagag

SEQ ID NO: 145588 - DNA, 25 bp, Mus musculus
tgccagctcaagctccgagtgctca

SEQ ID NO: 145589 - DNA, 25 bp, Mus musculus
tgccagctgcaaaggagggtttgac

SEQ ID NO: 145590 - DNA, 25 bp, Mus musculus
tgccagctgctagaacacaaagaac

SEQ ID NO: 145591 - DNA, 25 bp, Mus musculus
tgccagctggcaaaggactcatcgt

SEQ ID NO: 145592 - DNA, 25 bp, Mus musculus
tgccaggaatactcggcgcagaacg

SEQ ID NO: 145593 - DNA, 25 bp, Mus musculus
tgccaggacccaggaggaaaacgtt

SEQ ID NO: 145594 - DNA, 25 bp, Mus musculus
tgccaggatgccagaagaatattct

SEQ ID NO: 145595 - DNA, 25 bp, Mus musculus
tgccaggccaagacaccgttgatct

SEQ ID NO: 145596 - DNA, 25 bp, Mus musculus
tgccaggctacctatgatggcgagt

SEQ ID NO: 145597 - DNA, 25 bp, Mus musculus
tgccagggaaagtggacgctgctat

SEQ ID NO: 145598 - DNA, 25 bp, Mus musculus
tgccagggcacgcatgaagaagtct

SEQ ID NO: 145599 - DNA, 25 bp, Mus musculus
tgccagggtagttcaggagccctgc

SEQ ID NO: 145600 - DNA, 25 bp, Mus musculus
tgccaggtcaccagatggaaagcga

SEQ ID NO: 145601 - DNA, 25 bp, Mus musculus
tgccaggtcatggaggattccccaa

SEQ ID NO: 145602 - DNA, 25 bp, Mus musculus
tgccaggtttggtcagaaagactct

SEQ ID NO: 145603 - DNA, 25 bp, Mus musculus
tgccagtacccagggcttcagtggg

SEQ ID NO: 145604 - DNA, 25 bp, Mus musculus
tgccagtagttatcagggtgccaaa

SEQ ID NO: 145605 - DNA, 25 bp, Mus musculus
tgccagtatgacgagtggatagccg

SEQ ID NO: 145606 - DNA, 25 bp, Mus musculus
tgccagtcaatcatccctgaagagg

SEQ ID NO: 145607 - DNA, 25 bp, Mus musculus
tgccagtcacattcactagaggagg

SEQ ID NO: 145608 - DNA, 25 bp, Mus musculus
tgccagtccagcctttcatttgtcc

SEQ ID NO: 145609 - DNA, 25 bp, Mus musculus
tgccagtcgctcatccagatgacta

SEQ ID NO: 145610 - DNA, 25 bp, Mus musculus
tgccagtgactccagaacagggtac

SEQ ID NO: 145611 - DNA, 25 bp, Mus musculus
tgccagtgcagtccagggtttcagc

SEQ ID NO: 145612 - DNA, 25 bp, Mus musculus
tgccagtgccctgtgggctactcgg

SEQ ID NO: 145613 - DNA, 25 bp, Mus musculus
tgccagtgccgtttcttcggcagcg

SEQ ID NO: 145614 - DNA, 25 bp, Mus musculus
tgccagtggcatgtacaaagagact

SEQ ID NO: 145615 - DNA, 25 bp, Mus musculus
tgccagtggctttcaccaagagctg

SEQ ID NO: 145616 - DNA, 25 bp, Mus musculus
tgccagtggtccctaactccagtag

SEQ ID NO: 145617 - DNA, 25 bp, Mus musculus
tgccagtgtcgctgatggagctccc

SEQ ID NO: 145618 - DNA, 25 bp, Mus musculus
tgccagttcttcctttgcccatagg

SEQ ID NO: 145619 - DNA, 25 bp, Mus musculus
tgccataggtgactggccctgtgtc

SEQ ID NO: 145620 - DNA, 25 bp, Mus musculus
tgccatatactccagagactgtggg

SEQ ID NO: 145621 - DNA, 25 bp, Mus musculus
tgccatatcgacagatagtccagac

SEQ ID NO: 145622 - DNA, 25 bp, Mus musculus
tgccatattttggatcacagaagcc

SEQ ID NO: 145623 - DNA, 25 bp, Mus musculus
tgccatcaccagtcacgaacgggac

SEQ ID NO: 145624 - DNA, 25 bp, Mus musculus
tgccatcagggacaagtaccgctct

SEQ ID NO: 145625 - DNA, 25 bp, Mus musculus
tgccatccatggagggcgttcgttg

SEQ ID NO: 145626 - DNA, 25 bp, Mus musculus
tgccatccgcgaagatgcagctgaa

SEQ ID NO: 145627 - DNA, 25 bp, Mus musculus
tgccatccgtgcagacaagaagtcc

SEQ ID NO: 145628 - DNA, 25 bp, Mus musculus
tgccatcctcgtggtcttcttagag

SEQ ID NO: 145629 - DNA, 25 bp, Mus musculus
tgccatctactttaagggaatgtgg

SEQ ID NO: 145630 - DNA, 25 bp, Mus musculus
tgccatctgcacaagatcagagctg

SEQ ID NO: 145631 - DNA, 25 bp, Mus musculus
tgccatctgggtgaagtctagacca

SEQ ID NO: 145632 - DNA, 25 bp, Mus musculus
tgccatctgtgacattcgcatcatg

SEQ ID NO: 145633 - DNA, 25 bp, Mus musculus
tgccatcttgatgaccgtggctctg

SEQ ID NO: 145634 - DNA, 25 bp, Mus musculus
tgccatgagaaagcaaactgcgtcc

SEQ ID NO: 145635 - DNA, 25 bp, Mus musculus
tgccatgaggccaaaaactactttg

SEQ ID NO: 145636 - DNA, 25 bp, Mus musculus
tgccatgcagcaagtctctcgggac

SEQ ID NO: 145637 - DNA, 25 bp, Mus musculus
tgccatgccaaagcctacagaaggt

SEQ ID NO: 145638 - DNA, 25 bp, Mus musculus
tgccatgcgggtagcaggcatctcg

SEQ ID NO: 145639 - DNA, 25 bp, Mus musculus
tgccatggagaatgaaatgcggacc

SEQ ID NO: 145640 - DNA, 25 bp, Mus musculus
tgccatggaggaatacagcgtaagt

SEQ ID NO: 145641 - DNA, 25 bp, Mus musculus
tgccatggaggcactgttgaatacc

SEQ ID NO: 145642 - DNA, 25 bp, Mus musculus
tgccatggaggtcaaaattaaggat

SEQ ID NO: 145643 - DNA, 25 bp, Mus musculus
tgccatggatgtgtacgacgaagtt

SEQ ID NO: 145644 - DNA, 25 bp, Mus musculus
tgccatggcgactggaagaccattc

SEQ ID NO: 145645 - DNA, 25 bp, Mus musculus
tgccatggtggttgcgtcctccaaa

SEQ ID NO: 145646 - DNA, 25 bp, Mus musculus
tgccattaactgatgatgccgagag

SEQ ID NO: 145647 - DNA, 25 bp, Mus musculus
tgccattagaaaccccaagtcctgg

SEQ ID NO: 145648 - DNA, 25 bp, Mus musculus
tgccattgaaggactggatgccact

SEQ ID NO: 145649 - DNA, 25 bp, Mus musculus
tgccattgagttgggcgagctgcaa

SEQ ID NO: 145650 - DNA, 25 bp, Mus musculus
tgccattgatcgagtaaagtccagg

SEQ ID NO: 145651 - DNA, 25 bp, Mus musculus
tgccattgccgagttctacaacacg

SEQ ID NO: 145652 - DNA, 25 bp, Mus musculus
tgccattgttgagcagccttgaaat

SEQ ID NO: 145653 - DNA, 25 bp, Mus musculus
tgcccaatcaccattggaggataag

SEQ ID NO: 145654 - DNA, 25 bp, Mus musculus
tgcccaatggacagcccaggcctag

SEQ ID NO: 145655 - DNA, 25 bp, Mus musculus
tgcccaatggcaaacacttggaggg

SEQ ID NO: 145656 - DNA, 25 bp, Mus musculus
tgcccacactgtaagaaggtcatcc

SEQ ID NO: 145657 - DNA, 25 bp, Mus musculus
tgcccacatcttctggaggcagaat

SEQ ID NO: 145658 - DNA, 25 bp, Mus musculus
tgcccaccacttggacctggagaag

SEQ ID NO: 145659 - DNA, 25 bp, Mus musculus
tgcccaccccaggttcctcgtgcgg

SEQ ID NO: 145660 - DNA, 25 bp, Mus musculus
tgcccacctccaccagaaggaaaag

SEQ ID NO: 145661 - DNA, 25 bp, Mus musculus
tgcccacgaggccatcaccattgcc

SEQ ID NO: 145662 - DNA, 25 bp, Mus musculus
tgcccactggtgttaccaaaagaca

SEQ ID NO: 145663 - DNA, 25 bp, Mus musculus
tgcccacttgaggttgcgctgctgt

SEQ ID NO: 145664 - DNA, 25 bp, Mus musculus
tgcccagacgggtgaaaaggtgctc

SEQ ID NO: 145665 - DNA, 25 bp, Mus musculus
tgcccagacgtaatggtgatgcagg

SEQ ID NO: 145666 - DNA, 25 bp, Mus musculus
tgcccagaggtctacagtcaccctt

SEQ ID NO: 145667 - DNA, 25 bp, Mus musculus
tgcccagatgaagaaccggcccatg

SEQ ID NO: 145668 - DNA, 25 bp, Mus musculus
tgcccagcagctccatgaacgaata

SEQ ID NO: 145669 - DNA, 25 bp, Mus musculus
tgcccagcctgcaacatttgacaag

SEQ ID NO: 145670 - DNA, 25 bp, Mus musculus
tgcccagccttccatccgagtggtg

SEQ ID NO: 145671 - DNA, 25 bp, Mus musculus
tgcccagcgctggaagtgggtctcc

SEQ ID NO: 145672 - DNA, 25 bp, Mus musculus
tgcccagctggatcctgaggaagaa

SEQ ID NO: 145673 - DNA, 25 bp, Mus musculus
tgcccagctggattcgtcgacaaga

SEQ ID NO: 145674 - DNA, 25 bp, Mus musculus
tgcccaggcatgtagatcagagact

SEQ ID NO: 145675 - DNA, 25 bp, Mus musculus
tgcccaggctgaaataaaacaagaa

SEQ ID NO: 145676 - DNA, 25 bp, Mus musculus
tgcccaggtacttttgtctgtgtgc

SEQ ID NO: 145677 - DNA, 25 bp, Mus musculus
tgcccagtagcaggagacatgagcc

SEQ ID NO: 145678 - DNA, 25 bp, Mus musculus
tgcccagtggcgttcacctaaaagc

SEQ ID NO: 145679 - DNA, 25 bp, Mus musculus
tgcccagtggtacaaaacgataagc

SEQ ID NO: 145680 - DNA, 25 bp, Mus musculus
tgcccatagatgaggtccaccggaa

SEQ ID NO: 145681 - DNA, 25 bp, Mus musculus
tgcccatatatgtaagtgccccgtg

SEQ ID NO: 145682 - DNA, 25 bp, Mus musculus
tgcccatgacaaaggacagtccggt

SEQ ID NO: 145683 - DNA, 25 bp, Mus musculus
tgcccatgagaagatgaaagtgcct

SEQ ID NO: 145684 - DNA, 25 bp, Mus musculus
tgcccatgcacaagatgatgaacac

SEQ ID NO: 145685 - DNA, 25 bp, Mus musculus
tgcccatgcctgatacgcctgtgaa

SEQ ID NO: 145686 - DNA, 25 bp, Mus musculus
tgcccatgctggagacgcttaagac

SEQ ID NO: 145687 - DNA, 25 bp, Mus musculus
tgcccatggaaagagtacaaatctg

SEQ ID NO: 145688 - DNA, 25 bp, Mus musculus
tgcccattaagtcggcacggtatcg

SEQ ID NO: 145689 - DNA, 25 bp, Mus musculus
tgccccaaggctttgtcccgactgt

SEQ ID NO: 145690 - DNA, 25 bp, Mus musculus
tgccccaagttgtgtctatgagaca

SEQ ID NO: 145691 - DNA, 25 bp, Mus musculus
tgccccagaacgtctactgtgtgca

SEQ ID NO: 145692 - DNA, 25 bp, Mus musculus
tgccccagaccagatagcaggtgtg

SEQ ID NO: 145693 - DNA, 25 bp, Mus musculus
tgccccagacccgagagcacttact

SEQ ID NO: 145694 - DNA, 25 bp, Mus musculus
tgccccagagaccacaagtatgaat

SEQ ID NO: 145695 - DNA, 25 bp, Mus musculus
tgccccagagctgcgctttaattgg

SEQ ID NO: 145696 - DNA, 25 bp, Mus musculus
tgccccaggattccaagctcttgcg

SEQ ID NO: 145697 - DNA, 25 bp, Mus musculus
tgccccaggcagcaccttgaatgtg

SEQ ID NO: 145698 - DNA, 25 bp, Mus musculus
tgcccccctggatggctgtatcctg

SEQ ID NO: 145699 - DNA, 25 bp, Mus musculus
tgccccgcgagatgcaatgccagtt

SEQ ID NO: 145700 - DNA, 25 bp, Mus musculus
tgcccctcaaaaagagacgcacgga

SEQ ID NO: 145701 - DNA, 25 bp, Mus musculus
tgcccctcagggtgcaagtaaaacc

SEQ ID NO: 145702 - DNA, 25 bp, Mus musculus
tgcccctgaggaagtgacaacagga

SEQ ID NO: 145703 - DNA, 25 bp, Mus musculus
tgcccctgatctccatgctggtcat

SEQ ID NO: 145704 - DNA, 25 bp, Mus musculus
tgcccctgatgcttccccgtaggat

SEQ ID NO: 145705 - DNA, 25 bp, Mus musculus
tgcccctgctgagaccacttatgaa

SEQ ID NO: 145706 - DNA, 25 bp, Mus musculus
tgcccctggagacaccggcctttag

SEQ ID NO: 145707 - DNA, 25 bp, Mus musculus
tgcccctggagcgttagagaccact

SEQ ID NO: 145708 - DNA, 25 bp, Mus musculus
tgcccctgggaaaggactactacgt

SEQ ID NO: 145709 - DNA, 25 bp, Mus musculus
tgcccctgggatgcagacctgtaag

SEQ ID NO: 145710 - DNA, 25 bp, Mus musculus
tgcccctgtggggataactttgcca

SEQ ID NO: 145711 - DNA, 25 bp, Mus musculus
tgcccgaatccatgtgtgaagccct

SEQ ID NO: 145712 - DNA, 25 bp, Mus musculus
tgcccgacagaggaagatcaacgaa

SEQ ID NO: 145713 - DNA, 25 bp, Mus musculus
tgcccgaccattggacagattagag

SEQ ID NO: 145714 - DNA, 25 bp, Mus musculus
tgcccgacctagaggaaaagactcc

SEQ ID NO: 145715 - DNA, 25 bp, Mus musculus
tgcccgacgggcagagcctgattgt

SEQ ID NO: 145716 - DNA, 25 bp, Mus musculus
tgcccgagagcgtgagaagaacttt

SEQ ID NO: 145717 - DNA, 25 bp, Mus musculus
tgcccgagatgttctggaggccctc

SEQ ID NO: 145718 - DNA, 25 bp, Mus musculus
tgcccgaggagggtgtgcccctgac

SEQ ID NO: 145719 - DNA, 25 bp, Mus musculus
tgcccgaggcctgtagactgttcta

SEQ ID NO: 145720 - DNA, 25 bp, Mus musculus
tgcccgagttgcagcggctgtgcac

SEQ ID NO: 145721 - DNA, 25 bp, Mus musculus
tgcccgatgtaatgaacccaagagt

SEQ ID NO: 145722 - DNA, 25 bp, Mus musculus
tgcccgcagtgtcttgaaggagtac

SEQ ID NO: 145723 - DNA, 25 bp, Mus musculus
tgcccgcatggatttcgggagactc

SEQ ID NO: 145724 - DNA, 25 bp, Mus musculus
tgcccgcctggaagcacgagtggtt

SEQ ID NO: 145725 - DNA, 25 bp, Mus musculus
tgcccgcgctcgttccggacggcga

SEQ ID NO: 145726 - DNA, 25 bp, Mus musculus
tgcccgctgggacaaactgtgcaaa

SEQ ID NO: 145727 - DNA, 25 bp, Mus musculus
tgcccggaagaagcgtgcaatcctg

SEQ ID NO: 145728 - DNA, 25 bp, Mus musculus
tgcccggagacaccttgaatacttg

SEQ ID NO: 145729 - DNA, 25 bp, Mus musculus
tgcccggagagacctaacctgtatg

SEQ ID NO: 145730 - DNA, 25 bp, Mus musculus
tgcccggaggcacattgggaatcct

SEQ ID NO: 145731 - DNA, 25 bp, Mus musculus
tgcccggagtgagagctaagctaac

SEQ ID NO: 145732 - DNA, 25 bp, Mus musculus
tgcccggatccaggagatcatagtg

SEQ ID NO: 145733 - DNA, 25 bp, Mus musculus
tgcccggccctccatgctttggtgg

SEQ ID NO: 145734 - DNA, 25 bp, Mus musculus
tgcccggcctggaagaaggctctga

SEQ ID NO: 145735 - DNA, 25 bp, Mus musculus
tgcccgggatctcagaatatgctca

SEQ ID NO: 145736 - DNA, 25 bp, Mus musculus
tgcccgggctcgtatcgtagctgag

SEQ ID NO: 145737 - DNA, 25 bp, Mus musculus
tgcccgtccgtaggcaatgcctgag

SEQ ID NO: 145738 - DNA, 25 bp, Mus musculus
tgcccgtctcgttgcattctccaga

SEQ ID NO: 145739 - DNA, 25 bp, Mus musculus
tgcccgtctgtactgttgccatgag

SEQ ID NO: 145740 - DNA, 25 bp, Mus musculus
tgcccgtgagcctggggaacttgca

SEQ ID NO: 145741 - DNA, 25 bp, Mus musculus
tgcccgtggagaagacggctcttga

SEQ ID NO: 145742 - DNA, 25 bp, Mus musculus
tgcccgtgtacttctcgtcagactg

SEQ ID NO: 145743 - DNA, 25 bp, Mus musculus
tgcccgttccattgctcccgatggt

SEQ ID NO: 145744 - DNA, 25 bp, Mus musculus
tgcccgttgaatacaaaaggagacc

SEQ ID NO: 145745 - DNA, 25 bp, Mus musculus
tgccctaaagccacacaaattgaag

SEQ ID NO: 145746 - DNA, 25 bp, Mus musculus
tgccctaagctgttcaacaatccct

SEQ ID NO: 145747 - DNA, 25 bp, Mus musculus
tgccctacctcatggacgggaagaa

SEQ ID NO: 145748 - DNA, 25 bp, Mus musculus
tgccctatggcaccttggacctgaa

SEQ ID NO: 145749 - DNA, 25 bp, Mus musculus
tgccctatgtctaaaacagaacctc

SEQ ID NO: 145750 - DNA, 25 bp, Mus musculus
tgccctcaacgaagccaaacagatg

SEQ ID NO: 145751 - DNA, 25 bp, Mus musculus
tgccctcaccagctcaaggcgttgt

SEQ ID NO: 145752 - DNA, 25 bp, Mus musculus
tgccctcatcccagctgttgggagg

SEQ ID NO: 145753 - DNA, 25 bp, Mus musculus
tgccctccaaggtcgtgtacaagta

SEQ ID NO: 145754 - DNA, 25 bp, Mus musculus
tgccctcctaatattgaaagtatgg

SEQ ID NO: 145755 - DNA, 25 bp, Mus musculus
tgccctcgagacaaacccgtatgtg

SEQ ID NO: 145756 - DNA, 25 bp, Mus musculus
tgccctgaagagtagctactacatg

SEQ ID NO: 145757 - DNA, 25 bp, Mus musculus
tgccctgaaggcagcagcaagtttc

SEQ ID NO: 145758 - DNA, 25 bp, Mus musculus
tgccctgagagaggcgccaacaaag

SEQ ID NO: 145759 - DNA, 25 bp, Mus musculus
tgccctgagcccttgttcagtgaac

SEQ ID NO: 145760 - DNA, 25 bp, Mus musculus
tgccctgagctagtgactttaaacc

SEQ ID NO: 145761 - DNA, 25 bp, Mus musculus
tgccctgagttgttgcgggaaatca

SEQ ID NO: 145762 - DNA, 25 bp, Mus musculus
tgccctgcagagatgcccctgtgtg

SEQ ID NO: 145763 - DNA, 25 bp, Mus musculus
tgccctgccctgttgcatctttgag

SEQ ID NO: 145764 - DNA, 25 bp, Mus musculus
tgccctgcctagcaacctgattgtt

SEQ ID NO: 145765 - DNA, 25 bp, Mus musculus
tgccctgcgggtcccggaagtgagt

SEQ ID NO: 145766 - DNA, 25 bp, Mus musculus
tgccctgctggtgatcttggtggta

SEQ ID NO: 145767 - DNA, 25 bp, Mus musculus
tgccctggaagacatgctgcaggcc

SEQ ID NO: 145768 - DNA, 25 bp, Mus musculus
tgccctggacgagtactatgacaag

SEQ ID NO: 145769 - DNA, 25 bp, Mus musculus
tgccctggatgctgcgagtggccat

SEQ ID NO: 145770 - DNA, 25 bp, Mus musculus
tgccctggcacagaaacttgggagg

SEQ ID NO: 145771 - DNA, 25 bp, Mus musculus
tgccctggcagctcatcaggcgggt

SEQ ID NO: 145772 - DNA, 25 bp, Mus musculus
tgccctgggaaagcgactcttgctg

SEQ ID NO: 145773 - DNA, 25 bp, Mus musculus
tgccctgggacgtcagactgaactt

SEQ ID NO: 145774 - DNA, 25 bp, Mus musculus
tgccctgggatcacattagcgttat

SEQ ID NO: 145775 - DNA, 25 bp, Mus musculus
tgccctgggctcagtggtctaggaa

SEQ ID NO: 145776 - DNA, 25 bp, Mus musculus
tgccctgtacacttggtacgtcaga

SEQ ID NO: 145777 - DNA, 25 bp, Mus musculus
tgccctgtaggaccagaccaagaaa

SEQ ID NO: 145778 - DNA, 25 bp, Mus musculus
tgccctgtgaagctgatgtccatac

SEQ ID NO: 145779 - DNA, 25 bp, Mus musculus
tgccctgtgcgccatctgtggcgac

SEQ ID NO: 145780 - DNA, 25 bp, Mus musculus
tgccctgtgggcatgaacaagctct

SEQ ID NO: 145781 - DNA, 25 bp, Mus musculus
tgccctgttacctgcaagcattgtg

SEQ ID NO: 145782 - DNA, 25 bp, Mus musculus
tgcccttcgcgatggcgggcatcct

SEQ ID NO: 145783 - DNA, 25 bp, Mus musculus
tgcccttggcaggttctgtctggaa

SEQ ID NO: 145784 - DNA, 25 bp, Mus musculus
tgcccttgggagtcaaagaccctag

SEQ ID NO: 145785 - DNA, 25 bp, Mus musculus
tgccctttgtgcttgcagcccgcat

SEQ ID NO: 145786 - DNA, 25 bp, Mus musculus
tgcccttttggataatggaactcgg

SEQ ID NO: 145787 - DNA, 25 bp, Mus musculus
tgccgaaaatcaacaggagcgcctc

SEQ ID NO: 145788 - DNA, 25 bp, Mus musculus
tgccgaatgcactgagagaattttt

SEQ ID NO: 145789 - DNA, 25 bp, Mus musculus
tgccgacacattctattatcccaag

SEQ ID NO: 145790 - DNA, 25 bp, Mus musculus
tgccgacaccaacaaacgcaagagg

SEQ ID NO: 145791 - DNA, 25 bp, Mus musculus
tgccgaccgggtgaccatggcggtg

SEQ ID NO: 145792 - DNA, 25 bp, Mus musculus
tgccgactttccctcctgatgagag

SEQ ID NO: 145793 - DNA, 25 bp, Mus musculus
tgccgagaagtaggactccagaggt

SEQ ID NO: 145794 - DNA, 25 bp, Mus musculus
tgccgagacttaggaaagcgccttc

SEQ ID NO: 145795 - DNA, 25 bp, Mus musculus
tgccgagcctgcaagaggtgaagcc

SEQ ID NO: 145796 - DNA, 25 bp, Mus musculus
tgccgagcttgtgcgagacagacag

SEQ ID NO: 145797 - DNA, 25 bp, Mus musculus
tgccgaggcctcaagcagactttga

SEQ ID NO: 145798 - DNA, 25 bp, Mus musculus
tgccgatcaacaaaatgagccccag

SEQ ID NO: 145799 - DNA, 25 bp, Mus musculus
tgccgatcagtaacgaggttgacct

SEQ ID NO: 145800 - DNA, 25 bp, Mus musculus
tgccgatcttgcattgcgaccagta

SEQ ID NO: 145801 - DNA, 25 bp, Mus musculus
tgccgatgatgactacgatgaaccg

SEQ ID NO: 145802 - DNA, 25 bp, Mus musculus
tgccgcaaactaagcatccctttga

SEQ ID NO: 145803 - DNA, 25 bp, Mus musculus
tgccgcaagggtgacagtgagatcc

SEQ ID NO: 145804 - DNA, 25 bp, Mus musculus
tgccgcacttcgacctgcggtggga

SEQ ID NO: 145805 - DNA, 25 bp, Mus musculus
tgccgcagaagctgtcacctgcctt

SEQ ID NO: 145806 - DNA, 25 bp, Mus musculus
tgccgcagctagttccgtggagact

SEQ ID NO: 145807 - DNA, 25 bp, Mus musculus
tgccgcattgcttagtgactctgcc

SEQ ID NO: 145808 - DNA, 25 bp, Mus musculus
tgccgccgagtgcacctgaaagaga

SEQ ID NO: 145809 - DNA, 25 bp, Mus musculus
tgccgccgccgcagaacagccccag

SEQ ID NO: 145810 - DNA, 25 bp, Mus musculus
tgccgccgggcttaactctctaagt

SEQ ID NO: 145811 - DNA, 25 bp, Mus musculus
tgccgcgactgggacttaactgtag

SEQ ID NO: 145812 - DNA, 25 bp, Mus musculus
tgccgcgagagtagctttcaagcct

SEQ ID NO: 145813 - DNA, 25 bp, Mus musculus
tgccgcgtgctggtgttggaggacc

SEQ ID NO: 145814 - DNA, 25 bp, Mus musculus
tgccgctacgatgctctggaggtct

SEQ ID NO: 145815 - DNA, 25 bp, Mus musculus
tgccgctgaggagacctgtacacct

SEQ ID NO: 145816 - DNA, 25 bp, Mus musculus
tgccgctggagctaaagagtaaaga

SEQ ID NO: 145817 - DNA, 25 bp, Mus musculus
tgccgctggtcctactgagactgct

SEQ ID NO: 145818 - DNA, 25 bp, Mus musculus
tgccggaacattgaacatttaaacc

SEQ ID NO: 145819 - DNA, 25 bp, Mus musculus
tgccggaacccttttacagacagga

SEQ ID NO: 145820 - DNA, 25 bp, Mus musculus
tgccggaacctggaatatctgaacc

SEQ ID NO: 145821 - DNA, 25 bp, Mus musculus
tgccggaaggccagctttgagctct

SEQ ID NO: 145822 - DNA, 25 bp, Mus musculus
tgccggacaggatgcccagtgtcag

SEQ ID NO: 145823 - DNA, 25 bp, Mus musculus
tgccggagagtctgtccttgtcaca

SEQ ID NO: 145824 - DNA, 25 bp, Mus musculus
tgccggataccaccaagcaagtccg

SEQ ID NO: 145825 - DNA, 25 bp, Mus musculus
tgccggcacatgttccacaaggagt

SEQ ID NO: 145826 - DNA, 25 bp, Mus musculus
tgccggcaccctaactgaggtgttt

SEQ ID NO: 145827 - DNA, 25 bp, Mus musculus
tgccggcaggaagaatacaattgtg

SEQ ID NO: 145828 - DNA, 25 bp, Mus musculus
tgccggcatggcatctggcatgaca

SEQ ID NO: 145829 - DNA, 25 bp, Mus musculus
tgccggccgtgggaactatgatgct

SEQ ID NO: 145830 - DNA, 25 bp, Mus musculus
tgccgggatgctaggaagctctcag

SEQ ID NO: 145831 - DNA, 25 bp, Mus musculus
tgccgggcgagaaggtgacattcac

SEQ ID NO: 145832 - DNA, 25 bp, Mus musculus
tgccgggcgcatatttattcacagt

SEQ ID NO: 145833 - DNA, 25 bp, Mus musculus
tgccgggctcacgagagaaagctct

SEQ ID NO: 145834 - DNA, 25 bp, Mus musculus
tgccgggtatctacaccagagtttt

SEQ ID NO: 145835 - DNA, 25 bp, Mus musculus
tgccgggtgggcagacaaaatccag

SEQ ID NO: 145836 - DNA, 25 bp, Mus musculus
tgccgggttcccaaaagcaagctgg

SEQ ID NO: 145837 - DNA, 25 bp, Mus musculus
tgccggtacaactaacatcaaggag

SEQ ID NO: 145838 - DNA, 25 bp, Mus musculus
tgccggtacatctgtggcaaacgag

SEQ ID NO: 145839 - DNA, 25 bp, Mus musculus
tgccggtccctgtgatagtctccaa

SEQ ID NO: 145840 - DNA, 25 bp, Mus musculus
tgccggtccgggtttgtaacgtgca

SEQ ID NO: 145841 - DNA, 25 bp, Mus musculus
tgccggtgcctgtcatcgtgaacaa

SEQ ID NO: 145842 - DNA, 25 bp, Mus musculus
tgccggtggccccaataacaaatag

SEQ ID NO: 145843 - DNA, 25 bp, Mus musculus
tgccggttcttcgagagccacatcg

SEQ ID NO: 145844 - DNA, 25 bp, Mus musculus
tgccggttctttactttagggcaag

SEQ ID NO: 145845 - DNA, 25 bp, Mus musculus
tgccgtagccagaaacatcctggag

SEQ ID NO: 145846 - DNA, 25 bp, Mus musculus
tgccgtatgacagcaaccgtgtggt

SEQ ID NO: 145847 - DNA, 25 bp, Mus musculus
tgccgtcaggcttctctgcagtcaa

SEQ ID NO: 145848 - DNA, 25 bp, Mus musculus
tgccgtccaggtgcaaccagtgtgt

SEQ ID NO: 145849 - DNA, 25 bp, Mus musculus
tgccgtccggcaaaaacattctggt

SEQ ID NO: 145850 - DNA, 25 bp, Mus musculus
tgccgtcgggtttccagcagatcgg

SEQ ID NO: 145851 - DNA, 25 bp, Mus musculus
tgccgtctgatagggcatcgacaac

SEQ ID NO: 145852 - DNA, 25 bp, Mus musculus
tgccgtgcagatgcagcacatggct

SEQ ID NO: 145853 - DNA, 25 bp, Mus musculus
tgccgtgcgacaggatttggcccag

SEQ ID NO: 145854 - DNA, 25 bp, Mus musculus
tgccgtggatccagaagactcagct

SEQ ID NO: 145855 - DNA, 25 bp, Mus musculus
tgccgtggcccgtgaaaatgctggc

SEQ ID NO: 145856 - DNA, 25 bp, Mus musculus
tgccgtgtggatacaggatgttgac

SEQ ID NO: 145857 - DNA, 25 bp, Mus musculus
tgccgttaccggtcacacagtgtgt

SEQ ID NO: 145858 - DNA, 25 bp, Mus musculus
tgccgttcccaacaccgtgggtgct

SEQ ID NO: 145859 - DNA, 25 bp, Mus musculus
tgccgttgcgagattgcagctgtag

SEQ ID NO: 145860 - DNA, 25 bp, Mus musculus
tgcctaacggagagaccccatcgtg

SEQ ID NO: 145861 - DNA, 25 bp, Mus musculus
tgcctaagaccatcaccgcagaggt

SEQ ID NO: 145862 - DNA, 25 bp, Mus musculus
tgcctacaagttcaagcgttccaag

SEQ ID NO: 145863 - DNA, 25 bp, Mus musculus
tgcctacatgaggatgaagtacccc

SEQ ID NO: 145864 - DNA, 25 bp, Mus musculus
tgcctaccaagcaacagaccagtgg

SEQ ID NO: 145865 - DNA, 25 bp, Mus musculus
tgcctaccctgctgcctatggtcag

SEQ ID NO: 145866 - DNA, 25 bp, Mus musculus
tgcctacgctgcattcagactcggg

SEQ ID NO: 145867 - DNA, 25 bp, Mus musculus
tgcctacggatgtttcggaagccct

SEQ ID NO: 145868 - DNA, 25 bp, Mus musculus
tgcctacgtgagagagaggagtccc

SEQ ID NO: 145869 - DNA, 25 bp, Mus musculus
tgcctactcgtaccaagcaatggat

SEQ ID NO: 145870 - DNA, 25 bp, Mus musculus
tgcctactgtgctcgggatgtgcga

SEQ ID NO: 145871 - DNA, 25 bp, Mus musculus
tgcctacttagtccagcccagaggg

SEQ ID NO: 145872 - DNA, 25 bp, Mus musculus
tgcctacttcatggctgaatccttg

SEQ ID NO: 145873 - DNA, 25 bp, Mus musculus
tgcctagatgacaagaacagcttct

SEQ ID NO: 145874 - DNA, 25 bp, Mus musculus
tgcctagcagagacctccaagggac

SEQ ID NO: 145875 - DNA, 25 bp, Mus musculus
tgcctagcatatataaaggcctgag

SEQ ID NO: 145876 - DNA, 25 bp, Mus musculus
tgcctagccttctcatgtgtggata

SEQ ID NO: 145877 - DNA, 25 bp, Mus musculus
tgcctagctccatccagatttcggg

SEQ ID NO: 145878 - DNA, 25 bp, Mus musculus
tgcctataatcggaccctggagctg

SEQ ID NO: 145879 - DNA, 25 bp, Mus musculus
tgcctatcctacaggaggagccctt

SEQ ID NO: 145880 - DNA, 25 bp, Mus musculus
tgcctatcgccgaggaggagaagct

SEQ ID NO: 145881 - DNA, 25 bp, Mus musculus
tgcctatggagtgtatggccagcca

SEQ ID NO: 145882 - DNA, 25 bp, Mus musculus
tgcctatggtcagattagccaggcc

SEQ ID NO: 145883 - DNA, 25 bp, Mus musculus
tgcctcaagtgacaaggccgtcggt

SEQ ID NO: 145884 - DNA, 25 bp, Mus musculus
tgcctcaccgcaaggagcggccgag

SEQ ID NO: 145885 - DNA, 25 bp, Mus musculus
tgcctcacggcaacagggatgggat

SEQ ID NO: 145886 - DNA, 25 bp, Mus musculus
tgcctcagcagtctctatcttcggt

SEQ ID NO: 145887 - DNA, 25 bp, Mus musculus
tgcctcagcgttgaagccgttgaaa

SEQ ID NO: 145888 - DNA, 25 bp, Mus musculus
tgcctcagctcagaaactgttcctg

SEQ ID NO: 145889 - DNA, 25 bp, Mus musculus
tgcctcaggaacagtattcccacca

SEQ ID NO: 145890 - DNA, 25 bp, Mus musculus
tgcctcaggagtctaggctgctgca

SEQ ID NO: 145891 - DNA, 25 bp, Mus musculus
tgcctccaaggcacagtgagctgag

SEQ ID NO: 145892 - DNA, 25 bp, Mus musculus
tgcctccacttgcctgatgctggca

SEQ ID NO: 145893 - DNA, 25 bp, Mus musculus
tgcctccagaggtgggtaacatgct

SEQ ID NO: 145894 - DNA, 25 bp, Mus musculus
tgcctccagctacgaagagtgccgg

SEQ ID NO: 145895 - DNA, 25 bp, Mus musculus
tgcctccagctactcagcaaaggtg

SEQ ID NO: 145896 - DNA, 25 bp, Mus musculus
tgcctccaggccaagttcagggtgt

SEQ ID NO: 145897 - DNA, 25 bp, Mus musculus
tgcctccccgattctgacagaaaag

SEQ ID NO: 145898 - DNA, 25 bp, Mus musculus
tgcctccgaagagtataagcaccga

SEQ ID NO: 145899 - DNA, 25 bp, Mus musculus
tgcctccgacatggtcaccccaggc

SEQ ID NO: 145900 - DNA, 25 bp, Mus musculus
tgcctccggaattcccacagatgga

SEQ ID NO: 145901 - DNA, 25 bp, Mus musculus
tgcctcctaccgaccattgcttttg

SEQ ID NO: 145902 - DNA, 25 bp, Mus musculus
tgcctcctgcaaatcgtgggttaca

SEQ ID NO: 145903 - DNA, 25 bp, Mus musculus
tgcctccttggaatttgaacatggg

SEQ ID NO: 145904 - DNA, 25 bp, Mus musculus
tgcctcgagaaaatgggcccctgga

SEQ ID NO: 145905 - DNA, 25 bp, Mus musculus
tgcctcgagggaacaaaagcctgat

SEQ ID NO: 145906 - DNA, 25 bp, Mus musculus
tgcctcgctggatgggcagatcccc

SEQ ID NO: 145907 - DNA, 25 bp, Mus musculus
tgcctcgggagctagccaagatgat

SEQ ID NO: 145908 - DNA, 25 bp, Mus musculus
tgcctcgtggctgctgcttttgcta

SEQ ID NO: 145909 - DNA, 25 bp, Mus musculus
tgcctctaatacacagtctccacag

SEQ ID NO: 145910 - DNA, 25 bp, Mus musculus
tgcctctatcacagaaacgtcgttt

SEQ ID NO: 145911 - DNA, 25 bp, Mus musculus
tgcctctccctcaatggtgcatgag

SEQ ID NO: 145912 - DNA, 25 bp, Mus musculus
tgcctctcgggataggagacgacga

SEQ ID NO: 145913 - DNA, 25 bp, Mus musculus
tgcctctgagaaatccctggtgggt

SEQ ID NO: 145914 - DNA, 25 bp, Mus musculus
tgcctctgagctgccgaatcattga

SEQ ID NO: 145915 - DNA, 25 bp, Mus musculus
tgcctctgtagatgatagaacacgg

SEQ ID NO: 145916 - DNA, 25 bp, Mus musculus
tgcctgaagcaagtactccaaagaa

SEQ ID NO: 145917 - DNA, 25 bp, Mus musculus
tgcctgaaggactgggactataacg

SEQ ID NO: 145918 - DNA, 25 bp, Mus musculus
tgcctgaaggagtttgtcacccctg

SEQ ID NO: 145919 - DNA, 25 bp, Mus musculus
tgcctgaccgcgagtacaaattccg

SEQ ID NO: 145920 - DNA, 25 bp, Mus musculus
tgcctgacgcctacagccagtggtc

SEQ ID NO: 145921 - DNA, 25 bp, Mus musculus
tgcctgagagcctgcgccgggtcca

SEQ ID NO: 145922 - DNA, 25 bp, Mus musculus
tgcctgagctttaaggaagtcacct

SEQ ID NO: 145923 - DNA, 25 bp, Mus musculus
tgcctgaggacagtacgacagattg

SEQ ID NO: 145924 - DNA, 25 bp, Mus musculus
tgcctgaggcggatcagaactcaac

SEQ ID NO: 145925 - DNA, 25 bp, Mus musculus
tgcctgaggctccagttagcagctg

SEQ ID NO: 145926 - DNA, 25 bp, Mus musculus
tgcctgagtacgagttgagcccatc

SEQ ID NO: 145927 - DNA, 25 bp, Mus musculus
tgcctgatcgcaaaaagaagttcca

SEQ ID NO: 145928 - DNA, 25 bp, Mus musculus
tgcctgatggaaggagcattaaagt

SEQ ID NO: 145929 - DNA, 25 bp, Mus musculus
tgcctgatgggcttgttccgaggaa

SEQ ID NO: 145930 - DNA, 25 bp, Mus musculus
tgcctgcaactggaaccgtacaacg

SEQ ID NO: 145931 - DNA, 25 bp, Mus musculus
tgcctgcactacacgcggagagttg

SEQ ID NO: 145932 - DNA, 25 bp, Mus musculus
tgcctgccagcccaaggtgatgcgc

SEQ ID NO: 145933 - DNA, 25 bp, Mus musculus
tgcctgccatcaagagtcctgctga

SEQ ID NO: 145934 - DNA, 25 bp, Mus musculus
tgcctgccctgagaaactggacctg

SEQ ID NO: 145935 - DNA, 25 bp, Mus musculus
tgcctgccgaagatgaagagtcttc

SEQ ID NO: 145936 - DNA, 25 bp, Mus musculus
tgcctgccttcagtgtagatttaag

SEQ ID NO: 145937 - DNA, 25 bp, Mus musculus
tgcctgcgagaagacgtcattcact

SEQ ID NO: 145938 - DNA, 25 bp, Mus musculus
tgcctgcggcacttgtagaaaacag

SEQ ID NO: 145939 - DNA, 25 bp, Mus musculus
tgcctgcggtatagggaaaagccat

SEQ ID NO: 145940 - DNA, 25 bp, Mus musculus
tgcctgctcctgaagcagcaagtac

SEQ ID NO: 145941 - DNA, 25 bp, Mus musculus
tgcctgctctgaggctaacgcttca

SEQ ID NO: 145942 - DNA, 25 bp, Mus musculus
tgcctgctgtcgatgagtcaagtct

SEQ ID NO: 145943 - DNA, 25 bp, Mus musculus
tgcctgcttcctaacaaaatgcctg

SEQ ID NO: 145944 - DNA, 25 bp, Mus musculus
tgcctgcttgcccacagagatgaag

SEQ ID NO: 145945 - DNA, 25 bp, Mus musculus
tgcctgcttggaaagaagaggtagc

SEQ ID NO: 145946 - DNA, 25 bp, Mus musculus
tgcctgctttactggaattctacaa

SEQ ID NO: 145947 - DNA, 25 bp, Mus musculus
tgcctgctttcctccaagggatggg

SEQ ID NO: 145948 - DNA, 25 bp, Mus musculus
tgcctgctttctggtgttggataca

SEQ ID NO: 145949 - DNA, 25 bp, Mus musculus
tgcctggacaaaatacagaggatcc

SEQ ID NO: 145950 - DNA, 25 bp, Mus musculus
tgcctggacaccatggaggagcctg

SEQ ID NO: 145951 - DNA, 25 bp, Mus musculus
tgcctggaccaagagtgctgaagcc

SEQ ID NO: 145952 - DNA, 25 bp, Mus musculus
tgcctggatagatttagagacctgc

SEQ ID NO: 145953 - DNA, 25 bp, Mus musculus
tgcctggcagcaaaagcactctttg

SEQ ID NO: 145954 - DNA, 25 bp, Mus musculus
tgcctggcaggcagaacgtgtacgt

SEQ ID NO: 145955 - DNA, 25 bp, Mus musculus
tgcctggcatacaaacttaagtcgg

SEQ ID NO: 145956 - DNA, 25 bp, Mus musculus
tgcctggctacggacggttattcgc

SEQ ID NO: 145957 - DNA, 25 bp, Mus musculus
tgcctggctcacttgttgctgaaga

SEQ ID NO: 145958 - DNA, 25 bp, Mus musculus
tgcctggctgaagggagctggcctc

SEQ ID NO: 145959 - DNA, 25 bp, Mus musculus
tgcctggctggctcgagatcatagt

SEQ ID NO: 145960 - DNA, 25 bp, Mus musculus
tgcctgggactctggaaccgtctgt

SEQ ID NO: 145961 - DNA, 25 bp, Mus musculus
tgcctgggccctggaaagttcaagt

SEQ ID NO: 145962 - DNA, 25 bp, Mus musculus
tgcctgggcctaagcagcgtcgttg

SEQ ID NO: 145963 - DNA, 25 bp, Mus musculus
tgcctgggctcaagcgtgcggagaa

SEQ ID NO: 145964 - DNA, 25 bp, Mus musculus
tgcctggtgcaggatgcagataacc

SEQ ID NO: 145965 - DNA, 25 bp, Mus musculus
tgcctggtgccatgataacaagtcc

SEQ ID NO: 145966 - DNA, 25 bp, Mus musculus
tgcctggtggcagagattcgagctc

SEQ ID NO: 145967 - DNA, 25 bp, Mus musculus
tgcctgtaaagagaacacatcccag

SEQ ID NO: 145968 - DNA, 25 bp, Mus musculus
tgcctgtagaatcaccccaagcgat

SEQ ID NO: 145969 - DNA, 25 bp, Mus musculus
tgcctgtccgcaagaatagcagaga

SEQ ID NO: 145970 - DNA, 25 bp, Mus musculus
tgcctgtgatcctacaactcagaag

SEQ ID NO: 145971 - DNA, 25 bp, Mus musculus
tgcctgtggacatcgtcaaaactag

SEQ ID NO: 145972 - DNA, 25 bp, Mus musculus
tgcctgtggggacggaggagcgcgc

SEQ ID NO: 145973 - DNA, 25 bp, Mus musculus
tgccttaaggaggtccagctgcctt

SEQ ID NO: 145974 - DNA, 25 bp, Mus musculus
tgccttacccatgccagttctgtga

SEQ ID NO: 145975 - DNA, 25 bp, Mus musculus
tgccttagatgaacgaacacttgag

SEQ ID NO: 145976 - DNA, 25 bp, Mus musculus
tgccttagctggctctggaaaccca

SEQ ID NO: 145977 - DNA, 25 bp, Mus musculus
tgccttcaccgaacggatcctgcgg

SEQ ID NO: 145978 - DNA, 25 bp, Mus musculus
tgccttcagctggatcacgggacaa

SEQ ID NO: 145979 - DNA, 25 bp, Mus musculus
tgccttccaggagatgccctttcag

SEQ ID NO: 145980 - DNA, 25 bp, Mus musculus
tgccttccgtctccgagtctgacga

SEQ ID NO: 145981 - DNA, 25 bp, Mus musculus
tgccttctatggtggcgaatcgacc

SEQ ID NO: 145982 - DNA, 25 bp, Mus musculus
tgccttctcaaagcatgtctgtgga

SEQ ID NO: 145983 - DNA, 25 bp, Mus musculus
tgccttctcacagagagccgatgaa

SEQ ID NO: 145984 - DNA, 25 bp, Mus musculus
tgccttctctcttcttagccggtga

SEQ ID NO: 145985 - DNA, 25 bp, Mus musculus
tgccttctgaagaccagggtgggat

SEQ ID NO: 145986 - DNA, 25 bp, Mus musculus
tgccttctgcaatcctgtccaggtc

SEQ ID NO: 145987 - DNA, 25 bp, Mus musculus
tgccttgaaaaagtaccgtcgagaa

SEQ ID NO: 145988 - DNA, 25 bp, Mus musculus
tgccttgaacctccgaaacagacag

SEQ ID NO: 145989 - DNA, 25 bp, Mus musculus
tgccttgagcagacacaccaatgtg

SEQ ID NO: 145990 - DNA, 25 bp, Mus musculus
tgccttgagtgctaccagtgggtct

SEQ ID NO: 145991 - DNA, 25 bp, Mus musculus
tgccttgcctgttcagacactggtg

SEQ ID NO: 145992 - DNA, 25 bp, Mus musculus
tgccttgctggaactggataaacct

SEQ ID NO: 145993 - DNA, 25 bp, Mus musculus
tgccttggaaggtcccggccaggct

SEQ ID NO: 145994 - DNA, 25 bp, Mus musculus
tgccttggcataaccctagctttgg

SEQ ID NO: 145995 - DNA, 25 bp, Mus musculus
tgccttggctcatctggagacgtcg

SEQ ID NO: 145996 - DNA, 25 bp, Mus musculus
tgccttgggcgtcaacggctacagc

SEQ ID NO: 145997 - DNA, 25 bp, Mus musculus
tgccttgggctatgcacatttctgg

SEQ ID NO: 145998 - DNA, 25 bp, Mus musculus
tgccttgttaaccaggatcctgaac

SEQ ID NO: 145999 - DNA, 25 bp, Mus musculus
tgcctttcaggatccaggttgacac

SEQ ID NO: 146000 - DNA, 25 bp, Mus musculus
tgcctttccagacagcatggaccag

SEQ ID NO: 146001 - DNA, 25 bp, Mus musculus
tgcctttccatattttgccagacta

SEQ ID NO: 146002 - DNA, 25 bp, Mus musculus
tgcctttcccaccaaccatgagagg

SEQ ID NO: 146003 - DNA, 25 bp, Mus musculus
tgcctttccgcagagagagcctggc

SEQ ID NO: 146004 - DNA, 25 bp, Mus musculus
tgcctttgaagggagcgtgcgcaat

SEQ ID NO: 146005 - DNA, 25 bp, Mus musculus
tgcctttgagggacaaatactgtca

SEQ ID NO: 146006 - DNA, 25 bp, Mus musculus
tgcgaaacccctcggccgtgttctg

SEQ ID NO: 146007 - DNA, 25 bp, Mus musculus
tgcgaaattatttaaaagaacgagg

SEQ ID NO: 146008 - DNA, 25 bp, Mus musculus
tgcgaaccctggagaagctaatgtc

SEQ ID NO: 146009 - DNA, 25 bp, Mus musculus
tgcgaagaatgtaatccagaccaga

SEQ ID NO: 146010 - DNA, 25 bp, Mus musculus
tgcgaagagtcatggaggtcaactt

SEQ ID NO: 146011 - DNA, 25 bp, Mus musculus
tgcgaagcgaacaccctttggagct

SEQ ID NO: 146012 - DNA, 25 bp, Mus musculus
tgcgaagcggtgatttccctccagg

SEQ ID NO: 146013 - DNA, 25 bp, Mus musculus
tgcgaagctacagtcatcccaggaa

SEQ ID NO: 146014 - DNA, 25 bp, Mus musculus
tgcgaaggttccagagccgtctcgt

SEQ ID NO: 146015 - DNA, 25 bp, Mus musculus
tgcgaagtctgcgatggaaacgtca

SEQ ID NO: 146016 - DNA, 25 bp, Mus musculus
tgcgaatcctagatgcagcgggcaa

SEQ ID NO: 146017 - DNA, 25 bp, Mus musculus
tgcgaatgccagactttaagactgc

SEQ ID NO: 146018 - DNA, 25 bp, Mus musculus
tgcgaatgccttccataagaagctg

SEQ ID NO: 146019 - DNA, 25 bp, Mus musculus
tgcgacaagggattgaaaactcacc

SEQ ID NO: 146020 - DNA, 25 bp, Mus musculus
tgcgacaccagcgtctaaagattgt

SEQ ID NO: 146021 - DNA, 25 bp, Mus musculus
tgcgacaccccagcgaatcttttag

SEQ ID NO: 146022 - DNA, 25 bp, Mus musculus
tgcgacagctcagcactggaaggac

SEQ ID NO: 146023 - DNA, 25 bp, Mus musculus
tgcgacatcgacatcaggaaggacc

SEQ ID NO: 146024 - DNA, 25 bp, Mus musculus
tgcgacatggtcaagcagcccagat

SEQ ID NO: 146025 - DNA, 25 bp, Mus musculus
tgcgaccaaagctgaggaagatctt

SEQ ID NO: 146026 - DNA, 25 bp, Mus musculus
tgcgaccccacaaggtgaaaagctt

SEQ ID NO: 146027 - DNA, 25 bp, Mus musculus
tgcgaccgcattccagaggataacc

SEQ ID NO: 146028 - DNA, 25 bp, Mus musculus
tgcgacctcactcacaggacttgag

SEQ ID NO: 146029 - DNA, 25 bp, Mus musculus
tgcgaccttgtatcagcaactgaga

SEQ ID NO: 146030 - DNA, 25 bp, Mus musculus
tgcgacctttactgtcacaagccgc

SEQ ID NO: 146031 - DNA, 25 bp, Mus musculus
tgcgacggagtcctccaaaggctct

SEQ ID NO: 146032 - DNA, 25 bp, Mus musculus
tgcgactctagatgcatcccatgaa

SEQ ID NO: 146033 - DNA, 25 bp, Mus musculus
tgcgactggcagatactcactttgt

SEQ ID NO: 146034 - DNA, 25 bp, Mus musculus
tgcgacttcctgcaccagtatgacg

SEQ ID NO: 146035 - DNA, 25 bp, Mus musculus
tgcgacttcgagataacgggcttct

SEQ ID NO: 146036 - DNA, 25 bp, Mus musculus
tgcgagacaggagctacgaaccctt

SEQ ID NO: 146037 - DNA, 25 bp, Mus musculus
tgcgagactaccctgtgaggaaacg

SEQ ID NO: 146038 - DNA, 25 bp, Mus musculus
tgcgagactgcggaccaattacaca

SEQ ID NO: 146039 - DNA, 25 bp, Mus musculus
tgcgagagacccagaagttcttccg

SEQ ID NO: 146040 - DNA, 25 bp, Mus musculus
tgcgagaggctttcctacgaggaga

SEQ ID NO: 146041 - DNA, 25 bp, Mus musculus
tgcgagattgcagctgtagtcgctc

SEQ ID NO: 146042 - DNA, 25 bp, Mus musculus
tgcgagcacagtggaaattgttcct

SEQ ID NO: 146043 - DNA, 25 bp, Mus musculus
tgcgagccagcatagggagaggaca

SEQ ID NO: 146044 - DNA, 25 bp, Mus musculus
tgcgagcccattcagagcgtctatt

SEQ ID NO: 146045 - DNA, 25 bp, Mus musculus
tgcgagcgcgcctaacggagaacgg

SEQ ID NO: 146046 - DNA, 25 bp, Mus musculus
tgcgagcggtgaaacagctttccca

SEQ ID NO: 146047 - DNA, 25 bp, Mus musculus
tgcgagctcagaaagagcagccctg

SEQ ID NO: 146048 - DNA, 25 bp, Mus musculus
tgcgagcttccatatccagaacagg

SEQ ID NO: 146049 - DNA, 25 bp, Mus musculus
tgcgagcttgtccagagccctgtga

SEQ ID NO: 146050 - DNA, 25 bp, Mus musculus
tgcgaggcagaaagtaaccaggacc

SEQ ID NO: 146051 - DNA, 25 bp, Mus musculus
tgcgaggcagtgagagtcacaagat

SEQ ID NO: 146052 - DNA, 25 bp, Mus musculus
tgcgagtagcaatttacagctcaag

SEQ ID NO: 146053 - DNA, 25 bp, Mus musculus
tgcgagtcagaagaggacaaggacc

SEQ ID NO: 146054 - DNA, 25 bp, Mus musculus
tgcgagtccatcagcaagaacgagg

SEQ ID NO: 146055 - DNA, 25 bp, Mus musculus
tgcgagtcctgcaggcagtagacac

SEQ ID NO: 146056 - DNA, 25 bp, Mus musculus
tgcgagtcgaggacatcatggttcg

SEQ ID NO: 146057 - DNA, 25 bp, Mus musculus
tgcgagtgacaaagcccaatatacc

SEQ ID NO: 146058 - DNA, 25 bp, Mus musculus
tgcgagtgctgaagcccctggattc

SEQ ID NO: 146059 - DNA, 25 bp, Mus musculus
tgcgatacagcagaatggagacccg

SEQ ID NO: 146060 - DNA, 25 bp, Mus musculus
tgcgatacctcctttcatgccaggg

SEQ ID NO: 146061 - DNA, 25 bp, Mus musculus
tgcgatatgcccatggagtcccaga

SEQ ID NO: 146062 - DNA, 25 bp, Mus musculus
tgcgatgatcgaagctacagctact

SEQ ID NO: 146063 - DNA, 25 bp, Mus musculus
tgcgatgcgctattctgacaacact

SEQ ID NO: 146064 - DNA, 25 bp, Mus musculus
tgcgatggaagtcctcaggaaaacc

SEQ ID NO: 146065 - DNA, 25 bp, Mus musculus
tgcgattgtcctatgagaagcagga

SEQ ID NO: 146066 - DNA, 25 bp, Mus musculus
tgcgatttcctgaacctgaggcgga

SEQ ID NO: 146067 - DNA, 25 bp, Mus musculus
tgcgcaaacaggaaattatcaaagt

SEQ ID NO: 146068 - DNA, 25 bp, Mus musculus
tgcgcaaaccatgcaggatgattta

SEQ ID NO: 146069 - DNA, 25 bp, Mus musculus
tgcgcaacaacattgggaaggacct

SEQ ID NO: 146070 - DNA, 25 bp, Mus musculus
tgcgcaagaaacctccacgtggtgt

SEQ ID NO: 146071 - DNA, 25 bp, Mus musculus
tgcgcaaggatcatgagcaccagct

SEQ ID NO: 146072 - DNA, 25 bp, Mus musculus
tgcgcacagatagcgtcaggacgcc

SEQ ID NO: 146073 - DNA, 25 bp, Mus musculus
tgcgcacccggtctactctgctggg

SEQ ID NO: 146074 - DNA, 25 bp, Mus musculus
tgcgcacgttgcagtctaagcttgt

SEQ ID NO: 146075 - DNA, 25 bp, Mus musculus
tgcgcagacctagggtggtttgaaa

SEQ ID NO: 146076 - DNA, 25 bp, Mus musculus
tgcgcagactcagaaggcgctcttg

SEQ ID NO: 146077 - DNA, 25 bp, Mus musculus
tgcgcagagtacaccacgctgctga

SEQ ID NO: 146078 - DNA, 25 bp, Mus musculus
tgcgcagcacaagaagggtgtccgt

SEQ ID NO: 146079 - DNA, 25 bp, Mus musculus
tgcgcagctacatcaccgatgacaa

SEQ ID NO: 146080 - DNA, 25 bp, Mus musculus
tgcgcagctcgtacaggtcatcaag

SEQ ID NO: 146081 - DNA, 25 bp, Mus musculus
tgcgcagctctgcaaatctttgaga

SEQ ID NO: 146082 - DNA, 25 bp, Mus musculus
tgcgcaggagcttcaggccagattg

SEQ ID NO: 146083 - DNA, 25 bp, Mus musculus
tgcgcaggattcaaatgtgtagcgc

SEQ ID NO: 146084 - DNA, 25 bp, Mus musculus
tgcgcagttcctggtcgtttgccgg

SEQ ID NO: 146085 - DNA, 25 bp, Mus musculus
tgcgcagttgcgaaaactacgcctg

SEQ ID NO: 146086 - DNA, 25 bp, Mus musculus
tgcgcataactacagatccagaggt

SEQ ID NO: 146087 - DNA, 25 bp, Mus musculus
tgcgcatccagatcctgaggagaaa

SEQ ID NO: 146088 - DNA, 25 bp, Mus musculus
tgcgcatccggaatgtggcctacga

SEQ ID NO: 146089 - DNA, 25 bp, Mus musculus
tgcgcattgtagaaggccagggtca

SEQ ID NO: 146090 - DNA, 25 bp, Mus musculus
tgcgccaagttcctttcaagaaaac

SEQ ID NO: 146091 - DNA, 25 bp, Mus musculus
tgcgccacaggaggttaattcagag

SEQ ID NO: 146092 - DNA, 25 bp, Mus musculus
tgcgccactcctggaaaataatgac

SEQ ID NO: 146093 - DNA, 25 bp, Mus musculus
tgcgccagcaaggaaagccagtgct

SEQ ID NO: 146094 - DNA, 25 bp, Mus musculus
tgcgccagctggtcgagttccttta

SEQ ID NO: 146095 - DNA, 25 bp, Mus musculus
tgcgccagtagacagaacagcctga

SEQ ID NO: 146096 - DNA, 25 bp, Mus musculus
tgcgccatagggatcttcctgaagt

SEQ ID NO: 146097 - DNA, 25 bp, Mus musculus
tgcgccatgacttctttcaaatgga

SEQ ID NO: 146098 - DNA, 25 bp, Mus musculus
tgcgccccagagaggactagagcag

SEQ ID NO: 146099 - DNA, 25 bp, Mus musculus
tgcgccctttagagaagatccagct

SEQ ID NO: 146100 - DNA, 25 bp, Mus musculus
tgcgccgagactacaacttccagaa

SEQ ID NO: 146101 - DNA, 25 bp, Mus musculus
tgcgccggaactttactgcagaaac

SEQ ID NO: 146102 - DNA, 25 bp, Mus musculus
tgcgccgtcatctgtggcaacgttt

SEQ ID NO: 146103 - DNA, 25 bp, Mus musculus
tgcgcctaatagaaaccatgccctg

SEQ ID NO: 146104 - DNA, 25 bp, Mus musculus
tgcgcctcaactaacaaaacgtggg

SEQ ID NO: 146105 - DNA, 25 bp, Mus musculus
tgcgcctccgaggaaacacttggtc

SEQ ID NO: 146106 - DNA, 25 bp, Mus musculus
tgcgcctgcatatgccgtacctaag

SEQ ID NO: 146107 - DNA, 25 bp, Mus musculus
tgcgcgaccagatgccaagtgtatt

SEQ ID NO: 146108 - DNA, 25 bp, Mus musculus
tgcgcgaggaattgagccagcgact

SEQ ID NO: 146109 - DNA, 25 bp, Mus musculus
tgcgcgcatgaggaagtcccaaggt

SEQ ID NO: 146110 - DNA, 25 bp, Mus musculus
tgcgcgcccctttttcagcagtgtg

SEQ ID NO: 146111 - DNA, 25 bp, Mus musculus
tgcgcgcgccgctaagcggaagcta

SEQ ID NO: 146112 - DNA, 25 bp, Mus musculus
tgcgcggccctgcttgaacacttta

SEQ ID NO: 146113 - DNA, 25 bp, Mus musculus
tgcgcggcgctagtggaagtggcgg

SEQ ID NO: 146114 - DNA, 25 bp, Mus musculus
tgcgcggcggcggtgatgaaagcga

SEQ ID NO: 146115 - DNA, 25 bp, Mus musculus
tgcgcggggcctcgggccgctcgtt

SEQ ID NO: 146116 - DNA, 25 bp, Mus musculus
tgcgcgtgcgcaagtgcttctttct

SEQ ID NO: 146117 - DNA, 25 bp, Mus musculus
tgcgcgttgtaggtttcggggcctc

SEQ ID NO: 146118 - DNA, 25 bp, Mus musculus
tgcgctaatgaaccagcagttcctg

SEQ ID NO: 146119 - DNA, 25 bp, Mus musculus
tgcgctactgcgagaacaagttcaa

SEQ ID NO: 146120 - DNA, 25 bp, Mus musculus
tgcgctagcagtgagcaaccctgtg

SEQ ID NO: 146121 - DNA, 25 bp, Mus musculus
tgcgctatgattcttccaaccaggt

SEQ ID NO: 146122 - DNA, 25 bp, Mus musculus
tgcgctatgcggacaaacacatgaa

SEQ ID NO: 146123 - DNA, 25 bp, Mus musculus
tgcgctccataacgcccaatgagaa

SEQ ID NO: 146124 - DNA, 25 bp, Mus musculus
tgcgctcccctacaggatctcgagt

SEQ ID NO: 146125 - DNA, 25 bp, Mus musculus
tgcgctccggcaccttcggcaattt

SEQ ID NO: 146126 - DNA, 25 bp, Mus musculus
tgcgctccgggatttcttgacttta

SEQ ID NO: 146127 - DNA, 25 bp, Mus musculus
tgcgctcctggctacacaggcgttt

SEQ ID NO: 146128 - DNA, 25 bp, Mus musculus
tgcgctcgcataggagcccgaatcg

SEQ ID NO: 146129 - DNA, 25 bp, Mus musculus
tgcgctcgggcttcgctagcctagc

SEQ ID NO: 146130 - DNA, 25 bp, Mus musculus
tgcgctctagcctcactggtacctg

SEQ ID NO: 146131 - DNA, 25 bp, Mus musculus
tgcgctgcatctgaaataaaacctg

SEQ ID NO: 146132 - DNA, 25 bp, Mus musculus
tgcgctgccgggagccctcactgat

SEQ ID NO: 146133 - DNA, 25 bp, Mus musculus
tgcgctggaggctacgcgcggtggc

SEQ ID NO: 146134 - DNA, 25 bp, Mus musculus
tgcgctggcccaagatgaccttttc

SEQ ID NO: 146135 - DNA, 25 bp, Mus musculus
tgcgctggctcctgctacaacaagt

SEQ ID NO: 146136 - DNA, 25 bp, Mus musculus
tgcgctgtgccaactgtgacctgga

SEQ ID NO: 146137 - DNA, 25 bp, Mus musculus
tgcgctgtttaacatcggcctcctg

SEQ ID NO: 146138 - DNA, 25 bp, Mus musculus
tgcgcttcctacagggactttgagt

SEQ ID NO: 146139 - DNA, 25 bp, Mus musculus
tgcgcttcgtagtttctgatccgga

SEQ ID NO: 146140 - DNA, 25 bp, Mus musculus
tgcgcttgaagaagtcccaccgctg

SEQ ID NO: 146141 - DNA, 25 bp, Mus musculus
tgcgcttgctaatcgcccagacaga

SEQ ID NO: 146142 - DNA, 25 bp, Mus musculus
tgcggaaactcttagcacaggccag

SEQ ID NO: 146143 - DNA, 25 bp, Mus musculus
tgcggaaatccgacttcaatggact

SEQ ID NO: 146144 - DNA, 25 bp, Mus musculus
tgcggaaccgcacagtcaaaaacct

SEQ ID NO: 146145 - DNA, 25 bp, Mus musculus
tgcggaagaacctacacaaccgtgt

SEQ ID NO: 146146 - DNA, 25 bp, Mus musculus
tgcggaagcctcagccatgctgttc

SEQ ID NO: 146147 - DNA, 25 bp, Mus musculus
tgcggaatcgctacctgaagaaaag

SEQ ID NO: 146148 - DNA, 25 bp, Mus musculus
tgcggacaagctcctagaagcagcg

SEQ ID NO: 146149 - DNA, 25 bp, Mus musculus
tgcggacactactgactggagacgg

SEQ ID NO: 146150 - DNA, 25 bp, Mus musculus
tgcggacagtggatcagcacagact

SEQ ID NO: 146151 - DNA, 25 bp, Mus musculus
tgcggacatcaacacggtcaacgtg

SEQ ID NO: 146152 - DNA, 25 bp, Mus musculus
tgcggaccaaagagttagatcccag

SEQ ID NO: 146153 - DNA, 25 bp, Mus musculus
tgcggaccctaaagcacgcagcgaa

SEQ ID NO: 146154 - DNA, 25 bp, Mus musculus
tgcggaccctaatgacacaaagtgg

SEQ ID NO: 146155 - DNA, 25 bp, Mus musculus
tgcggaccctgagatctagcgtgat

SEQ ID NO: 146156 - DNA, 25 bp, Mus musculus
tgcggacggaactactcagagacct

SEQ ID NO: 146157 - DNA, 25 bp, Mus musculus
tgcggacggtttgcccgagcccgtt

SEQ ID NO: 146158 - DNA, 25 bp, Mus musculus
tgcggagagaagacagacaagtaca

SEQ ID NO: 146159 - DNA, 25 bp, Mus musculus
tgcggagcctgcgaaaaccgatcca

SEQ ID NO: 146160 - DNA, 25 bp, Mus musculus
tgcggagctccagccatgaagaagc

SEQ ID NO: 146161 - DNA, 25 bp, Mus musculus
tgcggaggaatcactgacagtagct

SEQ ID NO: 146162 - DNA, 25 bp, Mus musculus
tgcggaggatcccagtctagacttc

SEQ ID NO: 146163 - DNA, 25 bp, Mus musculus
tgcggaggcacgagctacttccttt

SEQ ID NO: 146164 - DNA, 25 bp, Mus musculus
tgcggagtaccttcaacccaaagcc

SEQ ID NO: 146165 - DNA, 25 bp, Mus musculus
tgcggagtgccacccataaattagc

SEQ ID NO: 146166 - DNA, 25 bp, Mus musculus
tgcggatccccgtgtgacaaggagt

SEQ ID NO: 146167 - DNA, 25 bp, Mus musculus
tgcggatcgacgagagcatacacct

SEQ ID NO: 146168 - DNA, 25 bp, Mus musculus
tgcggatctctctcacagagaagtg

SEQ ID NO: 146169 - DNA, 25 bp, Mus musculus
tgcggattccccaggctttgtggag

SEQ ID NO: 146170 - DNA, 25 bp, Mus musculus
tgcggattgggcaaaaggagaaacc

SEQ ID NO: 146171 - DNA, 25 bp, Mus musculus
tgcggatttccgatttgataagccc

SEQ ID NO: 146172 - DNA, 25 bp, Mus musculus
tgcggcacacgcttctaaagctggt

SEQ ID NO: 146173 - DNA, 25 bp, Mus musculus
tgcggcagccgttgagggccgcctc

SEQ ID NO: 146174 - DNA, 25 bp, Mus musculus
tgcggcagctagaagtcgtcaagtc

SEQ ID NO: 146175 - DNA, 25 bp, Mus musculus
tgcggcagctgtacattgactttag

SEQ ID NO: 146176 - DNA, 25 bp, Mus musculus
tgcggcagtatctcctcctcagaaa

SEQ ID NO: 146177 - DNA, 25 bp, Mus musculus
tgcggcattgccacagactgtcaga

SEQ ID NO: 146178 - DNA, 25 bp, Mus musculus
tgcggccaacacctcttctgtctgg

SEQ ID NO: 146179 - DNA, 25 bp, Mus musculus
tgcggccaataagcggtggctgccc

SEQ ID NO: 146180 - DNA, 25 bp, Mus musculus
tgcggccactgggtcatgctgtgct

SEQ ID NO: 146181 - DNA, 25 bp, Mus musculus
tgcggccagacaacacctatgaggt

SEQ ID NO: 146182 - DNA, 25 bp, Mus musculus
tgcggccagctttcaggcagaggtt

SEQ ID NO: 146183 - DNA, 25 bp, Mus musculus
tgcggccatcgccagtaacatctgg

SEQ ID NO: 146184 - DNA, 25 bp, Mus musculus
tgcggccgaagaacgcgcccctgct

SEQ ID NO: 146185 - DNA, 25 bp, Mus musculus
tgcggccgcaggttgcagagcgggt

SEQ ID NO: 146186 - DNA, 25 bp, Mus musculus
tgcggccgctgctcgcttccggaga

SEQ ID NO: 146187 - DNA, 25 bp, Mus musculus
tgcggccgtaatgcaagaatgtcag

SEQ ID NO: 146188 - DNA, 25 bp, Mus musculus
tgcggcctgaacctggagattactg

SEQ ID NO: 146189 - DNA, 25 bp, Mus musculus
tgcggcgaggcaatgatgatctcct

SEQ ID NO: 146190 - DNA, 25 bp, Mus musculus
tgcggcgcgggagtaagttcatcaa

SEQ ID NO: 146191 - DNA, 25 bp, Mus musculus
tgcggcggatttgcctgttccagga

SEQ ID NO: 146192 - DNA, 25 bp, Mus musculus
tgcggcgttctcaaagttcggacag

SEQ ID NO: 146193 - DNA, 25 bp, Mus musculus
tgcggctcacacaaagcaggagggt

SEQ ID NO: 146194 - DNA, 25 bp, Mus musculus
tgcggctcagcgttaaggccaagcc

SEQ ID NO: 146195 - DNA, 25 bp, Mus musculus
tgcggctccgtaataggaccaactt

SEQ ID NO: 146196 - DNA, 25 bp, Mus musculus
tgcggctgagtgaaaagcacgatcc

SEQ ID NO: 146197 - DNA, 25 bp, Mus musculus
tgcggctgccctctaaccagaaagt

SEQ ID NO: 146198 - DNA, 25 bp, Mus musculus
tgcggctgctacgactgctggcgtt

SEQ ID NO: 146199 - DNA, 25 bp, Mus musculus
tgcggctggctttacgagagcaaaa

SEQ ID NO: 146200 - DNA, 25 bp, Mus musculus
tgcggctggtcactcacttcgatgt

SEQ ID NO: 146201 - DNA, 25 bp, Mus musculus
tgcggcttcgatcaccattgcaagt

SEQ ID NO: 146202 - DNA, 25 bp, Mus musculus
tgcggcttgcgcttctcctggctct

SEQ ID NO: 146203 - DNA, 25 bp, Mus musculus
tgcggctttgccctttttcaggcca

SEQ ID NO: 146204 - DNA, 25 bp, Mus musculus
tgcgggaatcaccaccaagcttttg

SEQ ID NO: 146205 - DNA, 25 bp, Mus musculus
tgcgggacacggagtcattgctgca

SEQ ID NO: 146206 - DNA, 25 bp, Mus musculus
tgcgggacatccaaaacactcagtg

SEQ ID NO: 146207 - DNA, 25 bp, Mus musculus
tgcgggacgccgatttgctaaagaa

SEQ ID NO: 146208 - DNA, 25 bp, Mus musculus
tgcgggagatctcaacccagctgga

SEQ ID NO: 146209 - DNA, 25 bp, Mus musculus
tgcgggaggctcacaaacttacaaa

SEQ ID NO: 146210 - DNA, 25 bp, Mus musculus
tgcgggatacaggaattcaggccac

SEQ ID NO: 146211 - DNA, 25 bp, Mus musculus
tgcgggcacctatgaggtcagattc

SEQ ID NO: 146212 - DNA, 25 bp, Mus musculus
tgcgggccgaagacatgtacatggt

SEQ ID NO: 146213 - DNA, 25 bp, Mus musculus
tgcgggcgacacatcatcagaagag

SEQ ID NO: 146214 - DNA, 25 bp, Mus musculus
tgcgggcgatgctaccatttcgagg

SEQ ID NO: 146215 - DNA, 25 bp, Mus musculus
tgcgggcgctggtctatggcaacca

SEQ ID NO: 146216 - DNA, 25 bp, Mus musculus
tgcgggcttccagttgttggacctg

SEQ ID NO: 146217 - DNA, 25 bp, Mus musculus
tgcgggcttcctacaggcagatcgg

SEQ ID NO: 146218 - DNA, 25 bp, Mus musculus
tgcgggcttgcgccccgggccgtgg

SEQ ID NO: 146219 - DNA, 25 bp, Mus musculus
tgcgggtcaactaccacatcgtgga

SEQ ID NO: 146220 - DNA, 25 bp, Mus musculus
tgcgggtcaagcgagtcacactgct

SEQ ID NO: 146221 - DNA, 25 bp, Mus musculus
tgcgggtggcttaataagagctcaa

SEQ ID NO: 146222 - DNA, 25 bp, Mus musculus
tgcggtacgaccatcaacagagatt

SEQ ID NO: 146223 - DNA, 25 bp, Mus musculus
tgcggtatatctcccatgtgcctat

SEQ ID NO: 146224 - DNA, 25 bp, Mus musculus
tgcggtcacaaaggaccagtaaggc

SEQ ID NO: 146225 - DNA, 25 bp, Mus musculus
tgcggtcagtctagcgagacagaga

SEQ ID NO: 146226 - DNA, 25 bp, Mus musculus
tgcggtccagactccatgctcctgg

SEQ ID NO: 146227 - DNA, 25 bp, Mus musculus
tgcggtcctggcaccaagaaggttc

SEQ ID NO: 146228 - DNA, 25 bp, Mus musculus
tgcggtccttcgtcagtcctccggt

SEQ ID NO: 146229 - DNA, 25 bp, Mus musculus
tgcggtcggagaagtggaaccacac

SEQ ID NO: 146230 - DNA, 25 bp, Mus musculus
tgcggtctatccagccggaggagaa

SEQ ID NO: 146231 - DNA, 25 bp, Mus musculus
tgcggtctgggttgccacccaggct

SEQ ID NO: 146232 - DNA, 25 bp, Mus musculus
tgcggtgcatcaataccagccctgg

SEQ ID NO: 146233 - DNA, 25 bp, Mus musculus
tgcggtgtcaccaattacggagatt

SEQ ID NO: 146234 - DNA, 25 bp, Mus musculus
tgcggttggctacaccctgatgaat

SEQ ID NO: 146235 - DNA, 25 bp, Mus musculus
tgcggtttaagccagactacagggt

SEQ ID NO: 146236 - DNA, 25 bp, Mus musculus
tgcggtttagagtgacagctaggcc

SEQ ID NO: 146237 - DNA, 25 bp, Mus musculus
tgcgtaaccctgtacggcaccgctc

SEQ ID NO: 146238 - DNA, 25 bp, Mus musculus
tgcgtaagaaaaacagccaagtgac

SEQ ID NO: 146239 - DNA, 25 bp, Mus musculus
tgcgtacagccaaactcagtggaac

SEQ ID NO: 146240 - DNA, 25 bp, Mus musculus
tgcgtaccggcggatgtcctgagtc

SEQ ID NO: 146241 - DNA, 25 bp, Mus musculus
tgcgtagaaaccaagcatgcgggct

SEQ ID NO: 146242 - DNA, 25 bp, Mus musculus
tgcgtagttcccagcagactgagaa

SEQ ID NO: 146243 - DNA, 25 bp, Mus musculus
tgcgtatatatacccatagggctag

SEQ ID NO: 146244 - DNA, 25 bp, Mus musculus
tgcgtatgcagaaccagagcgtgga

SEQ ID NO: 146245 - DNA, 25 bp, Mus musculus
tgcgtcaaatgacccactgctgtgg

SEQ ID NO: 146246 - DNA, 25 bp, Mus musculus
tgcgtcagctgcagggcgatctaaa

SEQ ID NO: 146247 - DNA, 25 bp, Mus musculus
tgcgtcatgatccacagaccaccag

SEQ ID NO: 146248 - DNA, 25 bp, Mus musculus
tgcgtccagctcaatctcagaagag

SEQ ID NO: 146249 - DNA, 25 bp, Mus musculus
tgcgtcccagaaggctggtctggtc

SEQ ID NO: 146250 - DNA, 25 bp, Mus musculus
tgcgtccccggccaaagagaagatc

SEQ ID NO: 146251 - DNA, 25 bp, Mus musculus
tgcgtctaagtgatggtcacttcat

SEQ ID NO: 146252 - DNA, 25 bp, Mus musculus
tgcgtctagcggagacattgccctg

SEQ ID NO: 146253 - DNA, 25 bp, Mus musculus
tgcgtctcaaacgaggccacgtggt

SEQ ID NO: 146254 - DNA, 25 bp, Mus musculus
tgcgtctccatgacgacgtgctcgg

SEQ ID NO: 146255 - DNA, 25 bp, Mus musculus
tgcgtctccggcatttgaatcgcgc

SEQ ID NO: 146256 - DNA, 25 bp, Mus musculus
tgcgtctggcactagaattccgggc

SEQ ID NO: 146257 - DNA, 25 bp, Mus musculus
tgcgtgacggcctgctgctccgagc

SEQ ID NO: 146258 - DNA, 25 bp, Mus musculus
tgcgtgagctccgacaaagaaagag

SEQ ID NO: 146259 - DNA, 25 bp, Mus musculus
tgcgtgcacgtacagcaacttggaa

SEQ ID NO: 146260 - DNA, 25 bp, Mus musculus
tgcgtgctacttcctggctcgccta

SEQ ID NO: 146261 - DNA, 25 bp, Mus musculus
tgcgtggctgcgagtctcagaacta

SEQ ID NO: 146262 - DNA, 25 bp, Mus musculus
tgcgtgggctctggtttcgtgcggg

SEQ ID NO: 146263 - DNA, 25 bp, Mus musculus
tgcgtggtatgtagagaagcgttcc

SEQ ID NO: 146264 - DNA, 25 bp, Mus musculus
tgcgtgtcttgacctgcacctgagt

SEQ ID NO: 146265 - DNA, 25 bp, Mus musculus
tgcgtgtgcgcagggtcctcgtcat

SEQ ID NO: 146266 - DNA, 25 bp, Mus musculus
tgcgtgtgttctccggctacttagt

SEQ ID NO: 146267 - DNA, 25 bp, Mus musculus
tgcgtgttgacatccgtgggtgcca

SEQ ID NO: 146268 - DNA, 25 bp, Mus musculus
tgcgttaacctgtgcaaggcccatg

SEQ ID NO: 146269 - DNA, 25 bp, Mus musculus
tgcgttaccaggtgtgggttctacc

SEQ ID NO: 146270 - DNA, 25 bp, Mus musculus
tgcgttagtgagtcccggattctgg

SEQ ID NO: 146271 - DNA, 25 bp, Mus musculus
tgcgttgcaaatgtcactgaagccc

SEQ ID NO: 146272 - DNA, 25 bp, Mus musculus
tgcgttttgatgaatgccccagcgg

SEQ ID NO: 146273 - DNA, 25 bp, Mus musculus
tgctaaaaagcagtctggagggaag

SEQ ID NO: 146274 - DNA, 25 bp, Mus musculus
tgctaaaaataagatcccagggtgt

SEQ ID NO: 146275 - DNA, 25 bp, Mus musculus
tgctaaacttcgtggcagcccgtga

SEQ ID NO: 146276 - DNA, 25 bp, Mus musculus
tgctaaagcaacatcacaatcggag

SEQ ID NO: 146277 - DNA, 25 bp, Mus musculus
tgctaaataaaactagaccgctgga

SEQ ID NO: 146278 - DNA, 25 bp, Mus musculus
tgctaaatagcttctggcctctgag

SEQ ID NO: 146279 - DNA, 25 bp, Mus musculus
tgctaaatcgccaagcccggaagat

SEQ ID NO: 146280 - DNA, 25 bp, Mus musculus
tgctaaccaacctaaacctagtcct

SEQ ID NO: 146281 - DNA, 25 bp, Mus musculus
tgctaacgagttccagcagcactgt

SEQ ID NO: 146282 - DNA, 25 bp, Mus musculus
tgctaacgttctgactaacgagcta

SEQ ID NO: 146283 - DNA, 25 bp, Mus musculus
tgctaactcaggttctgcagcgggc

SEQ ID NO: 146284 - DNA, 25 bp, Mus musculus
tgctaactgtggagtcttcactgcc

SEQ ID NO: 146285 - DNA, 25 bp, Mus musculus
tgctaagaaactcctgggtaccccg

SEQ ID NO: 146286 - DNA, 25 bp, Mus musculus
tgctaagaagcaggccatgaaacag

SEQ ID NO: 146287 - DNA, 25 bp, Mus musculus
tgctaagaggaaactactacagcag

SEQ ID NO: 146288 - DNA, 25 bp, Mus musculus
tgctaagcactcttcatagggcagg

SEQ ID NO: 146289 - DNA, 25 bp, Mus musculus
tgctaagcagccaaacggagaatca

SEQ ID NO: 146290 - DNA, 25 bp, Mus musculus
tgctaagctctaacaagtacacgga

SEQ ID NO: 146291 - DNA, 25 bp, Mus musculus
tgctaaggcagaagtcacaaagact

SEQ ID NO: 146292 - DNA, 25 bp, Mus musculus
tgctaataatcacagcgtcttcttc

SEQ ID NO: 146293 - DNA, 25 bp, Mus musculus
tgctaatctgcgtagttggctcggg

SEQ ID NO: 146294 - DNA, 25 bp, Mus musculus
tgctaatgcacctggagaggcgctg

SEQ ID NO: 146295 - DNA, 25 bp, Mus musculus
tgctaatgccaaccgaggtgcaggc

SEQ ID NO: 146296 - DNA, 25 bp, Mus musculus
tgctaattgtttaccgttttgaagc

SEQ ID NO: 146297 - DNA, 25 bp, Mus musculus
tgctacaacagggagccattgagcc

SEQ ID NO: 146298 - DNA, 25 bp, Mus musculus
tgctacaagatggaggacgcagtcc

SEQ ID NO: 146299 - DNA, 25 bp, Mus musculus
tgctacacaaaacttcgggagaggg

SEQ ID NO: 146300 - DNA, 25 bp, Mus musculus
tgctacacattagcagtccttgtca

SEQ ID NO: 146301 - DNA, 25 bp, Mus musculus
tgctacacgagaagcggacatcatg

SEQ ID NO: 146302 - DNA, 25 bp, Mus musculus
tgctacagaatgtggagctagaccc

SEQ ID NO: 146303 - DNA, 25 bp, Mus musculus
tgctacagacagacgacactcctat

SEQ ID NO: 146304 - DNA, 25 bp, Mus musculus
tgctacagcatcttcaatcccaggg

SEQ ID NO: 146305 - DNA, 25 bp, Mus musculus
tgctacagtaaagctacacttgggc

SEQ ID NO: 146306 - DNA, 25 bp, Mus musculus
tgctacagtgcgaagaaagggacca

SEQ ID NO: 146307 - DNA, 25 bp, Mus musculus
tgctacatacacttttgccaaaagt

SEQ ID NO: 146308 - DNA, 25 bp, Mus musculus
tgctacatgcactcagggaggccct

SEQ ID NO: 146309 - DNA, 25 bp, Mus musculus
tgctaccagcgctatatcgtgccgc

SEQ ID NO: 146310 - DNA, 25 bp, Mus musculus
tgctaccagtctaaactgaaaggag

SEQ ID NO: 146311 - DNA, 25 bp, Mus musculus
tgctaccctggccattacaacattg

SEQ ID NO: 146312 - DNA, 25 bp, Mus musculus
tgctaccgcagctacacagagtctc

SEQ ID NO: 146313 - DNA, 25 bp, Mus musculus
tgctaccgggtctacctcagtggag

SEQ ID NO: 146314 - DNA, 25 bp, Mus musculus
tgctaccgtaagacagaggacttct

SEQ ID NO: 146315 - DNA, 25 bp, Mus musculus
tgctacctgtgttatgatgactcaa

SEQ ID NO: 146316 - DNA, 25 bp, Mus musculus
tgctacctgttcaactgcacggcgc

SEQ ID NO: 146317 - DNA, 25 bp, Mus musculus
tgctacctgttgatgagtttctgcc

SEQ ID NO: 146318 - DNA, 25 bp, Mus musculus
tgctacgtaagagtgtggagacccg

SEQ ID NO: 146319 - DNA, 25 bp, Mus musculus
tgctacgtgtggatcccatggaacc

SEQ ID NO: 146320 - DNA, 25 bp, Mus musculus
tgctactagcgggaggagtaaagat

SEQ ID NO: 146321 - DNA, 25 bp, Mus musculus
tgctactcagcatgctctggatgga

SEQ ID NO: 146322 - DNA, 25 bp, Mus musculus
tgctactcccaaaacagctgctgag

SEQ ID NO: 146323 - DNA, 25 bp, Mus musculus
tgctactccttctggcaggcagggc

SEQ ID NO: 146324 - DNA, 25 bp, Mus musculus
tgctactctcctcttcaaactgtga

SEQ ID NO: 146325 - DNA, 25 bp, Mus musculus
tgctactgcagttgctggccctgaa

SEQ ID NO: 146326 - DNA, 25 bp, Mus musculus
tgctactgctgctacaaaaagagcc

SEQ ID NO: 146327 - DNA, 25 bp, Mus musculus
tgctacttacatgaggtcgctggga

SEQ ID NO: 146328 - DNA, 25 bp, Mus musculus
tgctacttcatgatccaggcgcgtg

SEQ ID NO: 146329 - DNA, 25 bp, Mus musculus
tgctacttcctcagaaccgggagaa

SEQ ID NO: 146330 - DNA, 25 bp, Mus musculus
tgctacttgctagatggaatcctct

SEQ ID NO: 146331 - DNA, 25 bp, Mus musculus
tgctacttggcggaacaggacgcta

SEQ ID NO: 146332 - DNA, 25 bp, Mus musculus
tgctagaacggtgggtaaatgaccc

SEQ ID NO: 146333 - DNA, 25 bp, Mus musculus
tgctagaacttgtgctggtcccagc

SEQ ID NO: 146334 - DNA, 25 bp, Mus musculus
tgctagaagcacagaaacagtccat

SEQ ID NO: 146335 - DNA, 25 bp, Mus musculus
tgctagacctctctctccagtggag

SEQ ID NO: 146336 - DNA, 25 bp, Mus musculus
tgctagactagttttgcacagaact

SEQ ID NO: 146337 - DNA, 25 bp, Mus musculus
tgctagagacacagctgagcctgga

SEQ ID NO: 146338 - DNA, 25 bp, Mus musculus
tgctagagccttcaagatcatccgt

SEQ ID NO: 146339 - DNA, 25 bp, Mus musculus
tgctagagctgttcccacgtgaagg

SEQ ID NO: 146340 - DNA, 25 bp, Mus musculus
tgctagagggcacctacttagacaa

SEQ ID NO: 146341 - DNA, 25 bp, Mus musculus
tgctagagtctccttaccacagtga

SEQ ID NO: 146342 - DNA, 25 bp, Mus musculus
tgctagatgagccaaccacaggact

SEQ ID NO: 146343 - DNA, 25 bp, Mus musculus
tgctagcagatgagagaagtgcccc

SEQ ID NO: 146344 - DNA, 25 bp, Mus musculus
tgctagcgcgatacatccagcaggt

SEQ ID NO: 146345 - DNA, 25 bp, Mus musculus
tgctagctatgttctcacatgtaag

SEQ ID NO: 146346 - DNA, 25 bp, Mus musculus
tgctagctcccctaaggtcactgct

SEQ ID NO: 146347 - DNA, 25 bp, Mus musculus
tgctagctgcttaaggctcgtgcac

SEQ ID NO: 146348 - DNA, 25 bp, Mus musculus
tgctagcttgcagaaaccctcttgg

SEQ ID NO: 146349 - DNA, 25 bp, Mus musculus
tgctaggaatgagagtaaacaacgt

SEQ ID NO: 146350 - DNA, 25 bp, Mus musculus
tgctaggatcccacacagactggct

SEQ ID NO: 146351 - DNA, 25 bp, Mus musculus
tgctaggcaagaaactgggcatccc

SEQ ID NO: 146352 - DNA, 25 bp, Mus musculus
tgctaggcacgcatacatgtaggcg

SEQ ID NO: 146353 - DNA, 25 bp, Mus musculus
tgctaggtgaagacagtgcccatgc

SEQ ID NO: 146354 - DNA, 25 bp, Mus musculus
tgctaggtgagctgatcctggaccg

SEQ ID NO: 146355 - DNA, 25 bp, Mus musculus
tgctagtaacttggcgggcttccct

SEQ ID NO: 146356 - DNA, 25 bp, Mus musculus
tgctagtaagaaggaaaacgtctct

SEQ ID NO: 146357 - DNA, 25 bp, Mus musculus
tgctagtaagcgctacgaagtgccc

SEQ ID NO: 146358 - DNA, 25 bp, Mus musculus
tgctagtcaagcatttctggacccc

SEQ ID NO: 146359 - DNA, 25 bp, Mus musculus
tgctagtcgggaacatcaacatctg

SEQ ID NO: 146360 - DNA, 25 bp, Mus musculus
tgctagtgacaagcagagtgcctgt

SEQ ID NO: 146361 - DNA, 25 bp, Mus musculus
tgctatattgcaccacagctgggcc

SEQ ID NO: 146362 - DNA, 25 bp, Mus musculus
tgctatcaagtatgccacctggctg

SEQ ID NO: 146363 - DNA, 25 bp, Mus musculus
tgctatcaggcatgggtgtctcggc

SEQ ID NO: 146364 - DNA, 25 bp, Mus musculus
tgctatctgaaacatggaaataccc

SEQ ID NO: 146365 - DNA, 25 bp, Mus musculus
tgctatctgttctttgtccggagga

SEQ ID NO: 146366 - DNA, 25 bp, Mus musculus
tgctatgaaatcttccttggaggac

SEQ ID NO: 146367 - DNA, 25 bp, Mus musculus
tgctatgaccgcaaagtgctccagg

SEQ ID NO: 146368 - DNA, 25 bp, Mus musculus
tgctatgcagtacagacctgggacc

SEQ ID NO: 146369 - DNA, 25 bp, Mus musculus
tgctatgcccacctgaagatcgatg

SEQ ID NO: 146370 - DNA, 25 bp, Mus musculus
tgctatgctgaaagaagtatgtaca

SEQ ID NO: 146371 - DNA, 25 bp, Mus musculus
tgctatgctgctacgctggattcgg

SEQ ID NO: 146372 - DNA, 25 bp, Mus musculus
tgctatggacaaggcacgggaccta

SEQ ID NO: 146373 - DNA, 25 bp, Mus musculus
tgctatggctaaaggagtagcggcc

SEQ ID NO: 146374 - DNA, 25 bp, Mus musculus
tgctatgggaaggatcaggctctct

SEQ ID NO: 146375 - DNA, 25 bp, Mus musculus
tgctatggtgctgagttccccggta

SEQ ID NO: 146376 - DNA, 25 bp, Mus musculus
tgctatgtgaggaaggaacaatttc

SEQ ID NO: 146377 - DNA, 25 bp, Mus musculus
tgctatgtttgaagcctgaggtggc

SEQ ID NO: 146378 - DNA, 25 bp, Mus musculus
tgctattacacaacaatgaccagga

SEQ ID NO: 146379 - DNA, 25 bp, Mus musculus
tgctattccagtgagcaggtcaccg

SEQ ID NO: 146380 - DNA, 25 bp, Mus musculus
tgctattgaagagtcccggaagagg

SEQ ID NO: 146381 - DNA, 25 bp, Mus musculus
tgctattgtgatgccaatgccggtg

SEQ ID NO: 146382 - DNA, 25 bp, Mus musculus
tgctcaaagagacagaagactcccg

SEQ ID NO: 146383 - DNA, 25 bp, Mus musculus
tgctcaaagtcctgacccgggaaat

SEQ ID NO: 146384 - DNA, 25 bp, Mus musculus
tgctcaaataccgaggccagagata

SEQ ID NO: 146385 - DNA, 25 bp, Mus musculus
tgctcaagagatccaatttcatcgc

SEQ ID NO: 146386 - DNA, 25 bp, Mus musculus
tgctcaagcaggaccaagtggtaaa

SEQ ID NO: 146387 - DNA, 25 bp, Mus musculus
tgctcaagcagttccccaacagtgg

SEQ ID NO: 146388 - DNA, 25 bp, Mus musculus
tgctcaagcgacagaagaaacggcg

SEQ ID NO: 146389 - DNA, 25 bp, Mus musculus
tgctcaaggaggacatcagcctggc

SEQ ID NO: 146390 - DNA, 25 bp, Mus musculus
tgctcaaggcactacaaagtcaggc

SEQ ID NO: 146391 - DNA, 25 bp, Mus musculus
tgctcaaggttcttggtcagggatc

SEQ ID NO: 146392 - DNA, 25 bp, Mus musculus
tgctcaagtggacagagtacacacc

SEQ ID NO: 146393 - DNA, 25 bp, Mus musculus
tgctcaatacaagatggaccctgtg

SEQ ID NO: 146394 - DNA, 25 bp, Mus musculus
tgctcaatccacaaacagcgaggag

SEQ ID NO: 146395 - DNA, 25 bp, Mus musculus
tgctcaatgctgacgtctgctctga

SEQ ID NO: 146396 - DNA, 25 bp, Mus musculus
tgctcaatggcaccaaggaggatgt

SEQ ID NO: 146397 - DNA, 25 bp, Mus musculus
tgctcaatgggcacctgaagaaggt

SEQ ID NO: 146398 - DNA, 25 bp, Mus musculus
tgctcaatgtgcacctgctgcctca

SEQ ID NO: 146399 - DNA, 25 bp, Mus musculus
tgctcacaagaacaaccgctgcgtg

SEQ ID NO: 146400 - DNA, 25 bp, Mus musculus
tgctcacaccagaaccagggtctgt

SEQ ID NO: 146401 - DNA, 25 bp, Mus musculus
tgctcacagtctcgatggaccagag

SEQ ID NO: 146402 - DNA, 25 bp, Mus musculus
tgctcaccagggagaatgtggcgct

SEQ ID NO: 146403 - DNA, 25 bp, Mus musculus
tgctcaccctcaagttcaagcgcgg

SEQ ID NO: 146404 - DNA, 25 bp, Mus musculus
tgctcaccgtgatctgaagccagaa

SEQ ID NO: 146405 - DNA, 25 bp, Mus musculus
tgctcacgagccactgaatcctgag

SEQ ID NO: 146406 - DNA, 25 bp, Mus musculus
tgctcacgggagctgctagatcttc

SEQ ID NO: 146407 - DNA, 25 bp, Mus musculus
tgctcacggtcactgctgtcattgt

SEQ ID NO: 146408 - DNA, 25 bp, Mus musculus
tgctcactctgagaacaagtgtgtg

SEQ ID NO: 146409 - DNA, 25 bp, Mus musculus
tgctcagaacagatgtgccatgctt

SEQ ID NO: 146410 - DNA, 25 bp, Mus musculus
tgctcagaacagcttcaagtcactg

SEQ ID NO: 146411 - DNA, 25 bp, Mus musculus
tgctcagacctctaataaaactcgg

SEQ ID NO: 146412 - DNA, 25 bp, Mus musculus
tgctcagagccacaaagaccttgag

SEQ ID NO: 146413 - DNA, 25 bp, Mus musculus
tgctcagagcggaacttacacaaat

SEQ ID NO: 146414 - DNA, 25 bp, Mus musculus
tgctcagcagctgagcgcggaagcc

SEQ ID NO: 146415 - DNA, 25 bp, Mus musculus
tgctcagcagtacatccgacaagga

SEQ ID NO: 146416 - DNA, 25 bp, Mus musculus
tgctcagcggtaatgacaggacaca

SEQ ID NO: 146417 - DNA, 25 bp, Mus musculus
tgctcagctccgtgagcccggacga

SEQ ID NO: 146418 - DNA, 25 bp, Mus musculus
tgctcaggactatctacaggaaaag

SEQ ID NO: 146419 - DNA, 25 bp, Mus musculus
tgctcaggactttggagaccccttt

SEQ ID NO: 146420 - DNA, 25 bp, Mus musculus
tgctcaggagcctttggactgtcag

SEQ ID NO: 146421 - DNA, 25 bp, Mus musculus
tgctcaggcaactcaaaggaaacgg

SEQ ID NO: 146422 - DNA, 25 bp, Mus musculus
tgctcaggcaagagctgaacacgcg

SEQ ID NO: 146423 - DNA, 25 bp, Mus musculus
tgctcagggcaagaagagtccgcga

SEQ ID NO: 146424 - DNA, 25 bp, Mus musculus
tgctcagggtgccatgaatcaaccg

SEQ ID NO: 146425 - DNA, 25 bp, Mus musculus
tgctcagggtgttcgagaccagcct

SEQ ID NO: 146426 - DNA, 25 bp, Mus musculus
tgctcaggtagcgatgctggctccg

SEQ ID NO: 146427 - DNA, 25 bp, Mus musculus
tgctcaggtggctgcgcagaatgct

SEQ ID NO: 146428 - DNA, 25 bp, Mus musculus
tgctcagtataagaaggacggtgct

SEQ ID NO: 146429 - DNA, 25 bp, Mus musculus
tgctcagtccacatgcgtgtcagcg

SEQ ID NO: 146430 - DNA, 25 bp, Mus musculus
tgctcagtgagccttttgcccacca

SEQ ID NO: 146431 - DNA, 25 bp, Mus musculus
tgctcagtgatggtgtggtccgcct

SEQ ID NO: 146432 - DNA, 25 bp, Mus musculus
tgctcagtggcatccgcaggagtct

SEQ ID NO: 146433 - DNA, 25 bp, Mus musculus
tgctcagttgcaacctaaagaggtg

SEQ ID NO: 146434 - DNA, 25 bp, Mus musculus
tgctcataatctgggtcaaccctga

SEQ ID NO: 146435 - DNA, 25 bp, Mus musculus
tgctcatcagcacgtacccaaagtc

SEQ ID NO: 146436 - DNA, 25 bp, Mus musculus
tgctcatcctcacgtcagggaaggg

SEQ ID NO: 146437 - DNA, 25 bp, Mus musculus
tgctcatcgcacaggaaggactgct

SEQ ID NO: 146438 - DNA, 25 bp, Mus musculus
tgctcatctggataacctgaaacgg

SEQ ID NO: 146439 - DNA, 25 bp, Mus musculus
tgctcatgaccctggaggcacacag

SEQ ID NO: 146440 - DNA, 25 bp, Mus musculus
tgctcatgacctggagctactgaga

SEQ ID NO: 146441 - DNA, 25 bp, Mus musculus
tgctcatgatcaccgggcaggtaga

SEQ ID NO: 146442 - DNA, 25 bp, Mus musculus
tgctcatgcagcttgaagccaggga

SEQ ID NO: 146443 - DNA, 25 bp, Mus musculus
tgctcatggcctactcgggcaaggg

SEQ ID NO: 146444 - DNA, 25 bp, Mus musculus
tgctcatgtagaacagagaccccgc

SEQ ID NO: 146445 - DNA, 25 bp, Mus musculus
tgctccaaaacatgaaaatcgtcgt

SEQ ID NO: 146446 - DNA, 25 bp, Mus musculus
tgctccaagatcttcacaaggcctg

SEQ ID NO: 146447 - DNA, 25 bp, Mus musculus
tgctccaagctgtggagccgattca

SEQ ID NO: 146448 - DNA, 25 bp, Mus musculus
tgctccaagtgctgaacctgtgtga

SEQ ID NO: 146449 - DNA, 25 bp, Mus musculus
tgctccactggatgtgtcacgcctg

SEQ ID NO: 146450 - DNA, 25 bp, Mus musculus
tgctccagcgatgaagaggaccgag

SEQ ID NO: 146451 - DNA, 25 bp, Mus musculus
tgctccagtaccgagtacctggctg

SEQ ID NO: 146452 - DNA, 25 bp, Mus musculus
tgctccataagcacgagtacctgaa

SEQ ID NO: 146453 - DNA, 25 bp, Mus musculus
tgctccatggaggacatatgccgca

SEQ ID NO: 146454 - DNA, 25 bp, Mus musculus
tgctcccaaattgcctgaggtggtg

SEQ ID NO: 146455 - DNA, 25 bp, Mus musculus
tgctcccacgcgaggaaagtttgcc

SEQ ID NO: 146456 - DNA, 25 bp, Mus musculus
tgctcccagaatcaggctgcactca

SEQ ID NO: 146457 - DNA, 25 bp, Mus musculus
tgctcccagccgtgatgatgaatgc

SEQ ID NO: 146458 - DNA, 25 bp, Mus musculus
tgctcccaggacgacgaatgcgtgt

SEQ ID NO: 146459 - DNA, 25 bp, Mus musculus
tgctcccagttatccagctgagtac

SEQ ID NO: 146460 - DNA, 25 bp, Mus musculus
tgctccccacgatcaagaactaggt

SEQ ID NO: 146461 - DNA, 25 bp, Mus musculus
tgctcccggaggatgatgccgatta

SEQ ID NO: 146462 - DNA, 25 bp, Mus musculus
tgctcccgtcagtctaagaggctcg

SEQ ID NO: 146463 - DNA, 25 bp, Mus musculus
tgctcccgtgatgacctgctaaaag

SEQ ID NO: 146464 - DNA, 25 bp, Mus musculus
tgctccctgatctggaaaagccttg

SEQ ID NO: 146465 - DNA, 25 bp, Mus musculus
tgctccctggtataaagtagacaag

SEQ ID NO: 146466 - DNA, 25 bp, Mus musculus
tgctccgagagttacaaaggctgcg

SEQ ID NO: 146467 - DNA, 25 bp, Mus musculus
tgctccgcctcttggtaaaaatacg

SEQ ID NO: 146468 - DNA, 25 bp, Mus musculus
tgctccgcggatgaagtgcagcgct

SEQ ID NO: 146469 - DNA, 25 bp, Mus musculus
tgctccggaccactatgaccatgag

SEQ ID NO: 146470 - DNA, 25 bp, Mus musculus
tgctccgggacgcaagtgctacttc

SEQ ID NO: 146471 - DNA, 25 bp, Mus musculus
tgctccgggaggtgataatcaacac

SEQ ID NO: 146472 - DNA, 25 bp, Mus musculus
tgctccgggccatcgttgactgtgg

SEQ ID NO: 146473 - DNA, 25 bp, Mus musculus
tgctccgggtgtttcagctagaacc

SEQ ID NO: 146474 - DNA, 25 bp, Mus musculus
tgctcctacgtcatagaaatgctga

SEQ ID NO: 146475 - DNA, 25 bp, Mus musculus
tgctcctcacaattccttttcctag

SEQ ID NO: 146476 - DNA, 25 bp, Mus musculus
tgctcctcattctcaaagcgggaag

SEQ ID NO: 146477 - DNA, 25 bp, Mus musculus
tgctcctcgggaaaacgaatcgatc

SEQ ID NO: 146478 - DNA, 25 bp, Mus musculus
tgctcctctacatggtgtcgccgct

SEQ ID NO: 146479 - DNA, 25 bp, Mus musculus
tgctcctgaactggaagatgctccc

SEQ ID NO: 146480 - DNA, 25 bp, Mus musculus
tgctcctgacgtgggtgaacagctc

SEQ ID NO: 146481 - DNA, 25 bp, Mus musculus
tgctcctgggatcgcagaatgcagc

SEQ ID NO: 146482 - DNA, 25 bp, Mus musculus
tgctcctgtaccaggcatgcagcct

SEQ ID NO: 146483 - DNA, 25 bp, Mus musculus
tgctccttaagacaccagttggctg

SEQ ID NO: 146484 - DNA, 25 bp, Mus musculus
tgctccttcaggatttcagccgcaa

SEQ ID NO: 146485 - DNA, 25 bp, Mus musculus
tgctccttgccaagtcggctaaggg

SEQ ID NO: 146486 - DNA, 25 bp, Mus musculus
tgctccttggcatcgtcgtcttgtc

SEQ ID NO: 146487 - DNA, 25 bp, Mus musculus
tgctccttgggaatagacactcgaa

SEQ ID NO: 146488 - DNA, 25 bp, Mus musculus
tgctccttgggatgggacgatgaat

SEQ ID NO: 146489 - DNA, 25 bp, Mus musculus
tgctcctttgagcacgagttcagga

SEQ ID NO: 146490 - DNA, 25 bp, Mus musculus
tgctcgaagctgaattggtggactc

SEQ ID NO: 146491 - DNA, 25 bp, Mus musculus
tgctcgaataaagcaccagcgtggg

SEQ ID NO: 146492 - DNA, 25 bp, Mus musculus
tgctcgaccacctgcatgtgggagt

SEQ ID NO: 146493 - DNA, 25 bp, Mus musculus
tgctcgagattcctccaggcactgc

SEQ ID NO: 146494 - DNA, 25 bp, Mus musculus
tgctcgagattgtagagcgacagct

SEQ ID NO: 146495 - DNA, 25 bp, Mus musculus
tgctcgagcagacccagatcatagg

SEQ ID NO: 146496 - DNA, 25 bp, Mus musculus
tgctcgagcgaagcgggctactgtt

SEQ ID NO: 146497 - DNA, 25 bp, Mus musculus
tgctcgatgtagtatacaagtcgtt

SEQ ID NO: 146498 - DNA, 25 bp, Mus musculus
tgctcgccttgcagagcagctgcct

SEQ ID NO: 146499 - DNA, 25 bp, Mus musculus
tgctcgcggagctcattcctgacgt

SEQ ID NO: 146500 - DNA, 25 bp, Mus musculus
tgctcgcgtcccctcatgagggtat

SEQ ID NO: 146501 - DNA, 25 bp, Mus musculus
tgctcgctgccttcagctagcatgg

SEQ ID NO: 146502 - DNA, 25 bp, Mus musculus
tgctcgcttccggagactccgcgtc

SEQ ID NO: 146503 - DNA, 25 bp, Mus musculus
tgctcggaattgaactaggctcctc

SEQ ID NO: 146504 - DNA, 25 bp, Mus musculus
tgctcggactattgcgaaagcccca

SEQ ID NO: 146505 - DNA, 25 bp, Mus musculus
tgctcggcaccaggactattgggct

SEQ ID NO: 146506 - DNA, 25 bp, Mus musculus
tgctcggccacagagtaaagttgct

SEQ ID NO: 146507 - DNA, 25 bp, Mus musculus
tgctcggctcgcagagctgagctct

SEQ ID NO: 146508 - DNA, 25 bp, Mus musculus
tgctcgggagctcctgccagttcgt

SEQ ID NO: 146509 - DNA, 25 bp, Mus musculus
tgctcggggcggaagccccaacctt

SEQ ID NO: 146510 - DNA, 25 bp, Mus musculus
tgctcgtccattggctggcaacgct

SEQ ID NO: 146511 - DNA, 25 bp, Mus musculus
tgctcgtggagatcttcgcgtcgct

SEQ ID NO: 146512 - DNA, 25 bp, Mus musculus
tgctcgtgtatttctgcatctggaa

SEQ ID NO: 146513 - DNA, 25 bp, Mus musculus
tgctctaaggacagggatggctctg

SEQ ID NO: 146514 - DNA, 25 bp, Mus musculus
tgctctacctcttcttcgcggtgat

SEQ ID NO: 146515 - DNA, 25 bp, Mus musculus
tgctctagaaacttcaaaatgcgac

SEQ ID NO: 146516 - DNA, 25 bp, Mus musculus
tgctctagagagctgaccgcagaag

SEQ ID NO: 146517 - DNA, 25 bp, Mus musculus
tgctctagagcattctaaggcttgc

SEQ ID NO: 146518 - DNA, 25 bp, Mus musculus
tgctctagtggaaataggacctcgt

SEQ ID NO: 146519 - DNA, 25 bp, Mus musculus
tgctctatggatgggcgctgcgtcc

SEQ ID NO: 146520 - DNA, 25 bp, Mus musculus
tgctctatgtgacacggcccagtga

SEQ ID NO: 146521 - DNA, 25 bp, Mus musculus
tgctctattttgactactgctaacc

SEQ ID NO: 146522 - DNA, 25 bp, Mus musculus
tgctctcaggtaccgccagaggaag

SEQ ID NO: 146523 - DNA, 25 bp, Mus musculus
tgctctccacccaagggcatagatg

SEQ ID NO: 146524 - DNA, 25 bp, Mus musculus
tgctctccccaacatgacaggtgat

SEQ ID NO: 146525 - DNA, 25 bp, Mus musculus
tgctctccgcctctagaagggctct

SEQ ID NO: 146526 - DNA, 25 bp, Mus musculus
tgctctccggcaagtggctgattca

SEQ ID NO: 146527 - DNA, 25 bp, Mus musculus
tgctctcctgtcttcttactccatt

SEQ ID NO: 146528 - DNA, 25 bp, Mus musculus
tgctctctaccaacgttcccaggga

SEQ ID NO: 146529 - DNA, 25 bp, Mus musculus
tgctctctgtgtgggactgggccaa

SEQ ID NO: 146530 - DNA, 25 bp, Mus musculus
tgctctcttgctgggttgcttaaag

SEQ ID NO: 146531 - DNA, 25 bp, Mus musculus
tgctctctttgtggactgcgtgccc

SEQ ID NO: 146532 - DNA, 25 bp, Mus musculus
tgctctgacgacctatgaaacactg

SEQ ID NO: 146533 - DNA, 25 bp, Mus musculus
tgctctgactgcggcagccgttgag

SEQ ID NO: 146534 - DNA, 25 bp, Mus musculus
tgctctgagactcactgtcagatcc

SEQ ID NO: 146535 - DNA, 25 bp, Mus musculus
tgctctgagccatcctcatggatga

SEQ ID NO: 146536 - DNA, 25 bp, Mus musculus
tgctctgcagtatcaggtggtgccc

SEQ ID NO: 146537 - DNA, 25 bp, Mus musculus
tgctctgccttctcgctggatggca

SEQ ID NO: 146538 - DNA, 25 bp, Mus musculus
tgctctgcgaccttcggcgaatgcc

SEQ ID NO: 146539 - DNA, 25 bp, Mus musculus
tgctctgcgctccatcggcttgaaa

SEQ ID NO: 146540 - DNA, 25 bp, Mus musculus
tgctctgctagaacgcacatggctg

SEQ ID NO: 146541 - DNA, 25 bp, Mus musculus
tgctctgctcatctacaaggcgggt

SEQ ID NO: 146542 - DNA, 25 bp, Mus musculus
tgctctgctcattccaaccttggag

SEQ ID NO: 146543 - DNA, 25 bp, Mus musculus
tgctctggaatcacatggtgccata

SEQ ID NO: 146544 - DNA, 25 bp, Mus musculus
tgctctggagaaaactggatgcgtc

SEQ ID NO: 146545 - DNA, 25 bp, Mus musculus
tgctctggatgactagctcccacgt

SEQ ID NO: 146546 - DNA, 25 bp, Mus musculus
tgctctggcttggtgtgcgtgcaaa

SEQ ID NO: 146547 - DNA, 25 bp, Mus musculus
tgctctggtgcacatctgggcctct

SEQ ID NO: 146548 - DNA, 25 bp, Mus musculus
tgctctggtgcagacagaacctgtg

SEQ ID NO: 146549 - DNA, 25 bp, Mus musculus
tgctctgtcacatgctccaaaggaa

SEQ ID NO: 146550 - DNA, 25 bp, Mus musculus
tgctctgtcttctcttgcagagttg

SEQ ID NO: 146551 - DNA, 25 bp, Mus musculus
tgctctgtgagccagtgacactgct

SEQ ID NO: 146552 - DNA, 25 bp, Mus musculus
tgctcttaggtaggccttggaaata

SEQ ID NO: 146553 - DNA, 25 bp, Mus musculus
tgctcttcagacaggacccggatgt

SEQ ID NO: 146554 - DNA, 25 bp, Mus musculus
tgctcttcagagtgcagactggctc

SEQ ID NO: 146555 - DNA, 25 bp, Mus musculus
tgctcttccaagatgaaaacgatcg

SEQ ID NO: 146556 - DNA, 25 bp, Mus musculus
tgctcttgaaaacttagcagtttgt

SEQ ID NO: 146557 - DNA, 25 bp, Mus musculus
tgctcttgaccttgcagtgcccaaa

SEQ ID NO: 146558 - DNA, 25 bp, Mus musculus
tgctcttgccgcgtgctggtgttgg

SEQ ID NO: 146559 - DNA, 25 bp, Mus musculus
tgctcttggactgcgctagggctgc

SEQ ID NO: 146560 - DNA, 25 bp, Mus musculus
tgctctttggcgtaaattgcaatcg

SEQ ID NO: 146561 - DNA, 25 bp, Mus musculus
tgctgaaaaccaggcctgccatggg

SEQ ID NO: 146562 - DNA, 25 bp, Mus musculus
tgctgaaaagcaggtcacaggctag

SEQ ID NO: 146563 - DNA, 25 bp, Mus musculus
tgctgaaacagttcacctgcttgac

SEQ ID NO: 146564 - DNA, 25 bp, Mus musculus
tgctgaaaccagaggtgtgcacccc

SEQ ID NO: 146565 - DNA, 25 bp, Mus musculus
tgctgaaactgcatccgcagccgag

SEQ ID NO: 146566 - DNA, 25 bp, Mus musculus
tgctgaaattccaagagactgcgaa

SEQ ID NO: 146567 - DNA, 25 bp, Mus musculus
tgctgaaattttaactacccaagat

SEQ ID NO: 146568 - DNA, 25 bp, Mus musculus
tgctgaacagggaccggaggatctc

SEQ ID NO: 146569 - DNA, 25 bp, Mus musculus
tgctgaaccaggtgctgaaccgggt

SEQ ID NO: 146570 - DNA, 25 bp, Mus musculus
tgctgaaccgccatcctgagattgt

SEQ ID NO: 146571 - DNA, 25 bp, Mus musculus
tgctgaacgaaagtgacaagcgccc

SEQ ID NO: 146572 - DNA, 25 bp, Mus musculus
tgctgaacgagatgaaccgcttggg

SEQ ID NO: 146573 - DNA, 25 bp, Mus musculus
tgctgaacgcctggagcggaacttt

SEQ ID NO: 146574 - DNA, 25 bp, Mus musculus
tgctgaactacagccatatctggac

SEQ ID NO: 146575 - DNA, 25 bp, Mus musculus
tgctgaactgacaagagggtacttc

SEQ ID NO: 146576 - DNA, 25 bp, Mus musculus
tgctgaagaaactccgtgccctggt

SEQ ID NO: 146577 - DNA, 25 bp, Mus musculus
tgctgaagaagcgatggtggacaac

SEQ ID NO: 146578 - DNA, 25 bp, Mus musculus
tgctgaagacatacgagctgcgggt

SEQ ID NO: 146579 - DNA, 25 bp, Mus musculus
tgctgaagacattggcacactctgg

SEQ ID NO: 146580 - DNA, 25 bp, Mus musculus
tgctgaagaccagggtacagtcccg

SEQ ID NO: 146581 - DNA, 25 bp, Mus musculus
tgctgaagactacgatgatgatcct

SEQ ID NO: 146582 - DNA, 25 bp, Mus musculus
tgctgaagaggaaccctaccatgtt

SEQ ID NO: 146583 - DNA, 25 bp, Mus musculus
tgctgaagatcatgggctacgactg

SEQ ID NO: 146584 - DNA, 25 bp, Mus musculus
tgctgaagcagcaaacgtgactggc

SEQ ID NO: 146585 - DNA, 25 bp, Mus musculus
tgctgaagcagcaaggagacttcct

SEQ ID NO: 146586 - DNA, 25 bp, Mus musculus
tgctgaagcagcacctggagatcac

SEQ ID NO: 146587 - DNA, 25 bp, Mus musculus
tgctgaagctctgcctgctacaggg

SEQ ID NO: 146588 - DNA, 25 bp, Mus musculus
tgctgaaggttccacatgacccggt

SEQ ID NO: 146589 - DNA, 25 bp, Mus musculus
tgctgaagtggcagtcataggcttc

SEQ ID NO: 146590 - DNA, 25 bp, Mus musculus
tgctgaatgagatgccacaggtcgg

SEQ ID NO: 146591 - DNA, 25 bp, Mus musculus
tgctgaatgcctatcgccgaggagg

SEQ ID NO: 146592 - DNA, 25 bp, Mus musculus
tgctgaatgcgaagcagctggccgt

SEQ ID NO: 146593 - DNA, 25 bp, Mus musculus
tgctgaattatgcatacacggctca

SEQ ID NO: 146594 - DNA, 25 bp, Mus musculus
tgctgacaagccctacatcgaggag

SEQ ID NO: 146595 - DNA, 25 bp, Mus musculus
tgctgacaccccataccatctgtat

SEQ ID NO: 146596 - DNA, 25 bp, Mus musculus
tgctgacatgctaacgggtgacgag

SEQ ID NO: 146597 - DNA, 25 bp, Mus musculus
tgctgacattgccacgctttgaggt

SEQ ID NO: 146598 - DNA, 25 bp, Mus musculus
tgctgaccagctatacgaagacttc

SEQ ID NO: 146599 - DNA, 25 bp, Mus musculus
tgctgacccagcttaagcgactgga

SEQ ID NO: 146600 - DNA, 25 bp, Mus musculus
tgctgaccggtctgtccaggatcgt

SEQ ID NO: 146601 - DNA, 25 bp, Mus musculus
tgctgacctcggtgtactgtgcagt

SEQ ID NO: 146602 - DNA, 25 bp, Mus musculus
tgctgacctggagcaagagttccaa

SEQ ID NO: 146603 - DNA, 25 bp, Mus musculus
tgctgacggacctgaacacgtacct

SEQ ID NO: 146604 - DNA, 25 bp, Mus musculus
tgctgacggagctgatactacggcg

SEQ ID NO: 146605 - DNA, 25 bp, Mus musculus
tgctgacggctgaagcccaggagcc

SEQ ID NO: 146606 - DNA, 25 bp, Mus musculus
tgctgacgtctaaaacgggctccgt

SEQ ID NO: 146607 - DNA, 25 bp, Mus musculus
tgctgacgtggcacaacagtgggca

SEQ ID NO: 146608 - DNA, 25 bp, Mus musculus
tgctgactaattgtgccatgagacc

SEQ ID NO: 146609 - DNA, 25 bp, Mus musculus
tgctgactacttcacggccatggcg

SEQ ID NO: 146610 - DNA, 25 bp, Mus musculus
tgctgactcacaggtcacagacggc

SEQ ID NO: 146611 - DNA, 25 bp, Mus musculus
tgctgagaaaactggccctccaacc

SEQ ID NO: 146612 - DNA, 25 bp, Mus musculus
tgctgagaaccagctctagatctct

SEQ ID NO: 146613 - DNA, 25 bp, Mus musculus
tgctgagacatctaacagggaccct

SEQ ID NO: 146614 - DNA, 25 bp, Mus musculus
tgctgagactgttcgagactgttgc

SEQ ID NO: 146615 - DNA, 25 bp, Mus musculus
tgctgagacttgtcgtaacctcccg

SEQ ID NO: 146616 - DNA, 25 bp, Mus musculus
tgctgagagacttggagtataagac

SEQ ID NO: 146617 - DNA, 25 bp, Mus musculus
tgctgagagcattgatacccacctg

SEQ ID NO: 146618 - DNA, 25 bp, Mus musculus
tgctgagatcctctacctgactgtg

SEQ ID NO: 146619 - DNA, 25 bp, Mus musculus
tgctgagattcgcagtaaactgccg

SEQ ID NO: 146620 - DNA, 25 bp, Mus musculus
tgctgagcaagatagagggccacca

SEQ ID NO: 146621 - DNA, 25 bp, Mus musculus
tgctgagcaagtgaccaccaggttc

SEQ ID NO: 146622 - DNA, 25 bp, Mus musculus
tgctgagcagaccttcattaaagat

SEQ ID NO: 146623 - DNA, 25 bp, Mus musculus
tgctgagccacagagaccttcaaga

SEQ ID NO: 146624 - DNA, 25 bp, Mus musculus
tgctgagccctcgaatgcagatgac

SEQ ID NO: 146625 - DNA, 25 bp, Mus musculus
tgctgagccggtctaacaaggcgcc

SEQ ID NO: 146626 - DNA, 25 bp, Mus musculus
tgctgagcctccctgagtctagggt

SEQ ID NO: 146627 - DNA, 25 bp, Mus musculus
tgctgagctgaaacccttctgggac

SEQ ID NO: 146628 - DNA, 25 bp, Mus musculus
tgctgaggagcagcgccagttcctt

SEQ ID NO: 146629 - DNA, 25 bp, Mus musculus
tgctgaggtcaccaccaatggctgt

SEQ ID NO: 146630 - DNA, 25 bp, Mus musculus
tgctgagtcccgagcgcctagctct

SEQ ID NO: 146631 - DNA, 25 bp, Mus musculus
tgctgagtctgcagttccgggatca

SEQ ID NO: 146632 - DNA, 25 bp, Mus musculus
tgctgagtgcaaggaaaagttcgct

SEQ ID NO: 146633 - DNA, 25 bp, Mus musculus
tgctgagtgcccatgacacagtggc

SEQ ID NO: 146634 - DNA, 25 bp, Mus musculus
tgctgagtggtctgctgtaccccgg

SEQ ID NO: 146635 - DNA, 25 bp, Mus musculus
tgctgatcaacaaggatatccggtg

SEQ ID NO: 146636 - DNA, 25 bp, Mus musculus
tgctgatcagcgtgcccatggagct

SEQ ID NO: 146637 - DNA, 25 bp, Mus musculus
tgctgatcctaagcagttggagagg

SEQ ID NO: 146638 - DNA, 25 bp, Mus musculus
tgctgatgacatgcaagagttcacc

SEQ ID NO: 146639 - DNA, 25 bp, Mus musculus
tgctgatgaccagcgaggaacgccg

SEQ ID NO: 146640 - DNA, 25 bp, Mus musculus
tgctgatgagcaaccctgagacaaa

SEQ ID NO: 146641 - DNA, 25 bp, Mus musculus
tgctgatgccataaagttggagcgg

SEQ ID NO: 146642 - DNA, 25 bp, Mus musculus
tgctgatgccgagacagacctgggt

SEQ ID NO: 146643 - DNA, 25 bp, Mus musculus
tgctgatgctcccaatccagtggta

SEQ ID NO: 146644 - DNA, 25 bp, Mus musculus
tgctgatggcaagcggtacttcact

SEQ ID NO: 146645 - DNA, 25 bp, Mus musculus
tgctgatgtgagctacgcaaaccac

SEQ ID NO: 146646 - DNA, 25 bp, Mus musculus
tgctgattcacggagtcccctgggt

SEQ ID NO: 146647 - DNA, 25 bp, Mus musculus
tgctgattctgctcaagggcctgca

SEQ ID NO: 146648 - DNA, 25 bp, Mus musculus
tgctgattgaccacatgcctgacgt

SEQ ID NO: 146649 - DNA, 25 bp, Mus musculus
tgctgattgccacccaggactgatg

SEQ ID NO: 146650 - DNA, 25 bp, Mus musculus
tgctgattgccatgagcgcgccaat

SEQ ID NO: 146651 - DNA, 25 bp, Mus musculus
tgctgattgtgttctaagggtcgga

SEQ ID NO: 146652 - DNA, 25 bp, Mus musculus
tgctgcaaaggttgaaacgagttcc

SEQ ID NO: 146653 - DNA, 25 bp, Mus musculus
tgctgcaagctgtacgagccctgat

SEQ ID NO: 146654 - DNA, 25 bp, Mus musculus
tgctgcaaggcacccactatagtgg

SEQ ID NO: 146655 - DNA, 25 bp, Mus musculus
tgctgcacaaacatcggaggaaacc

SEQ ID NO: 146656 - DNA, 25 bp, Mus musculus
tgctgcaccgagacacaatgctggc

SEQ ID NO: 146657 - DNA, 25 bp, Mus musculus
tgctgcaccggatgaaggagctctg

SEQ ID NO: 146658 - DNA, 25 bp, Mus musculus
tgctgcacctacaaatgccaactct

SEQ ID NO: 146659 - DNA, 25 bp, Mus musculus
tgctgcacgtctgaagagggccaac

SEQ ID NO: 146660 - DNA, 25 bp, Mus musculus
tgctgcagaaccgtggccatgagtg

SEQ ID NO: 146661 - DNA, 25 bp, Mus musculus
tgctgcagaactccgtctatgtcaa

SEQ ID NO: 146662 - DNA, 25 bp, Mus musculus
tgctgcagcagccatgggctccata

SEQ ID NO: 146663 - DNA, 25 bp, Mus musculus
tgctgcagcaggttacagagtgtga

SEQ ID NO: 146664 - DNA, 25 bp, Mus musculus
tgctgcagctcaacctggaacctac

SEQ ID NO: 146665 - DNA, 25 bp, Mus musculus
tgctgcagctgaaaacgaggtccat

SEQ ID NO: 146666 - DNA, 25 bp, Mus musculus
tgctgcagctggaatacagcaagtg

SEQ ID NO: 146667 - DNA, 25 bp, Mus musculus
tgctgcaggcaaacagcaaccctgt

SEQ ID NO: 146668 - DNA, 25 bp, Mus musculus
tgctgcagtaagaccgagtgcctgt

SEQ ID NO: 146669 - DNA, 25 bp, Mus musculus
tgctgcatactacgcccagaggatg

SEQ ID NO: 146670 - DNA, 25 bp, Mus musculus
tgctgcatggataccgaagcctcat

SEQ ID NO: 146671 - DNA, 25 bp, Mus musculus
tgctgcatggcagatgctctacctg

SEQ ID NO: 146672 - DNA, 25 bp, Mus musculus
tgctgccaaattcaagctaacaagg

SEQ ID NO: 146673 - DNA, 25 bp, Mus musculus
tgctgccaagccactggccaaaatg

SEQ ID NO: 146674 - DNA, 25 bp, Mus musculus
tgctgccaatgacgctgacctgtgt

SEQ ID NO: 146675 - DNA, 25 bp, Mus musculus
tgctgccacgggtggagtaaacctc

SEQ ID NO: 146676 - DNA, 25 bp, Mus musculus
tgctgccagacacagtacatctttc

SEQ ID NO: 146677 - DNA, 25 bp, Mus musculus
tgctgcccaaagtggagacggaagc

SEQ ID NO: 146678 - DNA, 25 bp, Mus musculus
tgctgcccaaggacgaccaggaggt

SEQ ID NO: 146679 - DNA, 25 bp, Mus musculus
tgctgcccagaatcaaagccagagg

SEQ ID NO: 146680 - DNA, 25 bp, Mus musculus
tgctgccccgacttctgggacttct

SEQ ID NO: 146681 - DNA, 25 bp, Mus musculus
tgctgccccgagagtggtgacgaaa

SEQ ID NO: 146682 - DNA, 25 bp, Mus musculus
tgctgcccgggacatcttgatagag

SEQ ID NO: 146683 - DNA, 25 bp, Mus musculus
tgctgccctcgtgtgcggtgttgtc

SEQ ID NO: 146684 - DNA, 25 bp, Mus musculus
tgctgccgagcggatcccagtgtgc

SEQ ID NO: 146685 - DNA, 25 bp, Mus musculus
tgctgccgatgatcaagaaagcccg

SEQ ID NO: 146686 - DNA, 25 bp, Mus musculus
tgctgccgccacagctgtgctggct

SEQ ID NO: 146687 - DNA, 25 bp, Mus musculus
tgctgccgctgaggagacctgtaca

SEQ ID NO: 146688 - DNA, 25 bp, Mus musculus
tgctgccgtctctgaaccaaagctg

SEQ ID NO: 146689 - DNA, 25 bp, Mus musculus
tgctgcctaggtgaccagaactctt

SEQ ID NO: 146690 - DNA, 25 bp, Mus musculus
tgctgcctatggtcagattagccag

SEQ ID NO: 146691 - DNA, 25 bp, Mus musculus
tgctgcctcatacacacgatgatgt

SEQ ID NO: 146692 - DNA, 25 bp, Mus musculus
tgctgcctctggttcatcagtgtta

SEQ ID NO: 146693 - DNA, 25 bp, Mus musculus
tgctgcctcttgaacatggacgtgg

SEQ ID NO: 146694 - DNA, 25 bp, Mus musculus
tgctgcctggagaatagcaagggcc

SEQ ID NO: 146695 - DNA, 25 bp, Mus musculus
tgctgccttcatcctgacattcttc

SEQ ID NO: 146696 - DNA, 25 bp, Mus musculus
tgctgcctttaatagacccgcggag

SEQ ID NO: 146697 - DNA, 25 bp, Mus musculus
tgctgcgacctctctacatggacgt

SEQ ID NO: 146698 - DNA, 25 bp, Mus musculus
tgctgcgcaagcacgtgaaccagtg

SEQ ID NO: 146699 - DNA, 25 bp, Mus musculus
tgctgcgcccaggaagattagatag

SEQ ID NO: 146700 - DNA, 25 bp, Mus musculus
tgctgcgctgcgtcttgcttctcgg

SEQ ID NO: 146701 - DNA, 25 bp, Mus musculus
tgctgcggacaaggcatccaggatg

SEQ ID NO: 146702 - DNA, 25 bp, Mus musculus
tgctgcggaggcacgagctacttcc

SEQ ID NO: 146703 - DNA, 25 bp, Mus musculus
tgctgcggccgcctggggagcccag

SEQ ID NO: 146704 - DNA, 25 bp, Mus musculus
tgctgcggcggatgtagaccaagaa

SEQ ID NO: 146705 - DNA, 25 bp, Mus musculus
tgctgcggcgggtggcagacgccgc

SEQ ID NO: 146706 - DNA, 25 bp, Mus musculus
tgctgcgggcagaaaagaatcccag

SEQ ID NO: 146707 - DNA, 25 bp, Mus musculus
tgctgcgtaaggctcaacaaagtgg

SEQ ID NO: 146708 - DNA, 25 bp, Mus musculus
tgctgcgtaccccaggaaatctcgg

SEQ ID NO: 146709 - DNA, 25 bp, Mus musculus
tgctgcgtgccaaggagtacctgga

SEQ ID NO: 146710 - DNA, 25 bp, Mus musculus
tgctgctaagaggaagggctcccgt

SEQ ID NO: 146711 - DNA, 25 bp, Mus musculus
tgctgctaggctaacgggcttcgag

SEQ ID NO: 146712 - DNA, 25 bp, Mus musculus
tgctgctagttcgaaggatgccgcc

SEQ ID NO: 146713 - DNA, 25 bp, Mus musculus
tgctgctcaacctgctgaccatgct

SEQ ID NO: 146714 - DNA, 25 bp, Mus musculus
tgctgctcaaggtactgcgcctggc

SEQ ID NO: 146715 - DNA, 25 bp, Mus musculus
tgctgctctaaagcgggtacccaga

SEQ ID NO: 146716 - DNA, 25 bp, Mus musculus
tgctgctctgctacggccctgagga

SEQ ID NO: 146717 - DNA, 25 bp, Mus musculus
tgctgctcttcaaaagccgcccaag

SEQ ID NO: 146718 - DNA, 25 bp, Mus musculus
tgctgctcttcactctgccagggac

SEQ ID NO: 146719 - DNA, 25 bp, Mus musculus
tgctgctgaatttgagggcctcctg

SEQ ID NO: 146720 - DNA, 25 bp, Mus musculus
tgctgctgacagagctctgccctga

SEQ ID NO: 146721 - DNA, 25 bp, Mus musculus
tgctgctgagcccatcacggtcaag

SEQ ID NO: 146722 - DNA, 25 bp, Mus musculus
tgctgctgagcgagctgttagaaca

SEQ ID NO: 146723 - DNA, 25 bp, Mus musculus
tgctgctgatctgggtgtcttgttg

SEQ ID NO: 146724 - DNA, 25 bp, Mus musculus
tgctgctgcagatacggaatgacgt

SEQ ID NO: 146725 - DNA, 25 bp, Mus musculus
tgctgctgccgaaggaacagggaaa

SEQ ID NO: 146726 - DNA, 25 bp, Mus musculus
tgctgctgcgacatcagaagagccg

SEQ ID NO: 146727 - DNA, 25 bp, Mus musculus
tgctgctggaacatggcctggaacg

SEQ ID NO: 146728 - DNA, 25 bp, Mus musculus
tgctgctggaattcgtggcacgcgc

SEQ ID NO: 146729 - DNA, 25 bp, Mus musculus
tgctgctggatgtcgtgccctggta

SEQ ID NO: 146730 - DNA, 25 bp, Mus musculus
tgctgctgggactcacacttggagt

SEQ ID NO: 146731 - DNA, 25 bp, Mus musculus
tgctgctgggtaacgggcctgttcc

SEQ ID NO: 146732 - DNA, 25 bp, Mus musculus
tgctgctgtcgctgtgcgagtcccc

SEQ ID NO: 146733 - DNA, 25 bp, Mus musculus
tgctgcttactcatttgacaaccgg

SEQ ID NO: 146734 - DNA, 25 bp, Mus musculus
tgctgctttactgcgggatccctgc

SEQ ID NO: 146735 - DNA, 25 bp, Mus musculus
tgctggaaactgctcggaatgtctt

SEQ ID NO: 146736 - DNA, 25 bp, Mus musculus
tgctggaaataccaggagagactcc

SEQ ID NO: 146737 - DNA, 25 bp, Mus musculus
tgctggaaccaggaatggcgctcct

SEQ ID NO: 146738 - DNA, 25 bp, Mus musculus
tgctggaagcaacgttgacctgccg

SEQ ID NO: 146739 - DNA, 25 bp, Mus musculus
tgctggaaggttctcgaaagctctt

SEQ ID NO: 146740 - DNA, 25 bp, Mus musculus
tgctggaatgccatgctgccctcag

SEQ ID NO: 146741 - DNA, 25 bp, Mus musculus
tgctggacaaactgatacgaaaccc

SEQ ID NO: 146742 - DNA, 25 bp, Mus musculus
tgctggacaagctggtcctccctgt

SEQ ID NO: 146743 - DNA, 25 bp, Mus musculus
tgctggacaatcagtatcacctggg

SEQ ID NO: 146744 - DNA, 25 bp, Mus musculus
tgctggacacactggcggtaatacg

SEQ ID NO: 146745 - DNA, 25 bp, Mus musculus
tgctggacatgaaggaacccgagac

SEQ ID NO: 146746 - DNA, 25 bp, Mus musculus
tgctggaccaaatgggcactgcgct

SEQ ID NO: 146747 - DNA, 25 bp, Mus musculus
tgctggaccagcaatgacaacatgg

SEQ ID NO: 146748 - DNA, 25 bp, Mus musculus
tgctggacccctcagtctctcatgc

SEQ ID NO: 146749 - DNA, 25 bp, Mus musculus
tgctggaccgggatgtcacctccaa

SEQ ID NO: 146750 - DNA, 25 bp, Mus musculus
tgctggaccgggtgtacccgctcac

SEQ ID NO: 146751 - DNA, 25 bp, Mus musculus
tgctggaccttacaaagcgtcggga

SEQ ID NO: 146752 - DNA, 25 bp, Mus musculus
tgctggacgacctgtgccgcaatat

SEQ ID NO: 146753 - DNA, 25 bp, Mus musculus
tgctggacgtactcagattgaacca

SEQ ID NO: 146754 - DNA, 25 bp, Mus musculus
tgctggactcagcttgcagatggcc

SEQ ID NO: 146755 - DNA, 25 bp, Mus musculus
tgctggactcggattcagggctcct

SEQ ID NO: 146756 - DNA, 25 bp, Mus musculus
tgctggactctcatgacaatggcca

SEQ ID NO: 146757 - DNA, 25 bp, Mus musculus
tgctggactttgaggccacatgcga

SEQ ID NO: 146758 - DNA, 25 bp, Mus musculus
tgctggagaaaaggacgagctcttg

SEQ ID NO: 146759 - DNA, 25 bp, Mus musculus
tgctggagaagaaagacagcttcat

SEQ ID NO: 146760 - DNA, 25 bp, Mus musculus
tgctggagacgagtttgagacccgt

SEQ ID NO: 146761 - DNA, 25 bp, Mus musculus
tgctggagagacacggccgcgaaca

SEQ ID NO: 146762 - DNA, 25 bp, Mus musculus
tgctggagatctgtgcctacctgga

SEQ ID NO: 146763 - DNA, 25 bp, Mus musculus
tgctggagcaaggtgcgccctagcc

SEQ ID NO: 146764 - DNA, 25 bp, Mus musculus
tgctggagcgggactgacctcttaa

SEQ ID NO: 146765 - DNA, 25 bp, Mus musculus
tgctggagcgtctgcttttggaaag

SEQ ID NO: 146766 - DNA, 25 bp, Mus musculus
tgctggagcttgaggtccctgtgaa

SEQ ID NO: 146767 - DNA, 25 bp, Mus musculus
tgctggaggcataacgatgggaaac

SEQ ID NO: 146768 - DNA, 25 bp, Mus musculus
tgctggagtccaagaaaggcctttc

SEQ ID NO: 146769 - DNA, 25 bp, Mus musculus
tgctggatcaaaatacataaacact

SEQ ID NO: 146770 - DNA, 25 bp, Mus musculus
tgctggatctatcccaaaaggagct

SEQ ID NO: 146771 - DNA, 25 bp, Mus musculus
tgctggatgccaaagcaggtttgct

SEQ ID NO: 146772 - DNA, 25 bp, Mus musculus
tgctggatgctaccgagagaccttt

SEQ ID NO: 146773 - DNA, 25 bp, Mus musculus
tgctggatggaaagatcgacgacct

SEQ ID NO: 146774 - DNA, 25 bp, Mus musculus
tgctggcaagacactggacaaggac

SEQ ID NO: 146775 - DNA, 25 bp, Mus musculus
tgctggcaatggacccgaaagcctt

SEQ ID NO: 146776 - DNA, 25 bp, Mus musculus
tgctggcagaacctacaatgtccga

SEQ ID NO: 146777 - DNA, 25 bp, Mus musculus
tgctggcagcgaacttgaagaaaca

SEQ ID NO: 146778 - DNA, 25 bp, Mus musculus
tgctggcaggcgaggagttcaccat

SEQ ID NO: 146779 - DNA, 25 bp, Mus musculus
tgctggcatgggaaacttgctcaaa

SEQ ID NO: 146780 - DNA, 25 bp, Mus musculus
tgctggccatggacaggaagtcctc

SEQ ID NO: 146781 - DNA, 25 bp, Mus musculus
tgctggcccagactattgcgatgtg

SEQ ID NO: 146782 - DNA, 25 bp, Mus musculus
tgctggcccagcatggaatccgatg

SEQ ID NO: 146783 - DNA, 25 bp, Mus musculus
tgctggcccggtactgtcaacatgg

SEQ ID NO: 146784 - DNA, 25 bp, Mus musculus
tgctggcctacgtcatggaggagtt

SEQ ID NO: 146785 - DNA, 25 bp, Mus musculus
tgctggcctctcctctagcatcgtg

SEQ ID NO: 146786 - DNA, 25 bp, Mus musculus
tgctggcctgatgaggactgaccaa

SEQ ID NO: 146787 - DNA, 25 bp, Mus musculus
tgctggcctgcctaaaagatactga

SEQ ID NO: 146788 - DNA, 25 bp, Mus musculus
tgctggcctgccttaagttctgaac

SEQ ID NO: 146789 - DNA, 25 bp, Mus musculus
tgctggccttcatgactagaccctc

SEQ ID NO: 146790 - DNA, 25 bp, Mus musculus
tgctggcctttgctggttattcagg

SEQ ID NO: 146791 - DNA, 25 bp, Mus musculus
tgctggcgcaagaatgcaagcacat

SEQ ID NO: 146792 - DNA, 25 bp, Mus musculus
tgctggcgctggacttaggagctcc

SEQ ID NO: 146793 - DNA, 25 bp, Mus musculus
tgctggcgtccaagatgtcgaccaa

SEQ ID NO: 146794 - DNA, 25 bp, Mus musculus
tgctggctaattgcacaggactgcg

SEQ ID NO: 146795 - DNA, 25 bp, Mus musculus
tgctggctaccgcaagggcaagaaa

SEQ ID NO: 146796 - DNA, 25 bp, Mus musculus
tgctggctagttacatccctgagga

SEQ ID NO: 146797 - DNA, 25 bp, Mus musculus
tgctggctcaagtgatcgagaacct

SEQ ID NO: 146798 - DNA, 25 bp, Mus musculus
tgctggctctcaccgctctagtggg

SEQ ID NO: 146799 - DNA, 25 bp, Mus musculus
tgctggcttggtgaaatcccttggg

SEQ ID NO: 146800 - DNA, 25 bp, Mus musculus
tgctgggaacacaacgcctgtccca

SEQ ID NO: 146801 - DNA, 25 bp, Mus musculus
tgctgggagcgaaagaaccaaccgt

SEQ ID NO: 146802 - DNA, 25 bp, Mus musculus
tgctgggcaaagaaggcagactctt

SEQ ID NO: 146803 - DNA, 25 bp, Mus musculus
tgctgggcagtctggttacaaagga

SEQ ID NO: 146804 - DNA, 25 bp, Mus musculus
tgctgggccacgagaccatgaagga

SEQ ID NO: 146805 - DNA, 25 bp, Mus musculus
tgctgggccataaagagggtccccg

SEQ ID NO: 146806 - DNA, 25 bp, Mus musculus
tgctgggccatgtcgagctgcagcc

SEQ ID NO: 146807 - DNA, 25 bp, Mus musculus
tgctgggcccaggacagtgctgttt

SEQ ID NO: 146808 - DNA, 25 bp, Mus musculus
tgctgggcccgatttgcagagccat

SEQ ID NO: 146809 - DNA, 25 bp, Mus musculus
tgctgggccgcaagcagaaagcctt

SEQ ID NO: 146810 - DNA, 25 bp, Mus musculus
tgctgggcctagctacagggcatcc

SEQ ID NO: 146811 - DNA, 25 bp, Mus musculus
tgctgggcctcttgacatgtctctg

SEQ ID NO: 146812 - DNA, 25 bp, Mus musculus
tgctgggcgctacacatacagtaag

SEQ ID NO: 146813 - DNA, 25 bp, Mus musculus
tgctgggtgcctgagacctgtctct

SEQ ID NO: 146814 - DNA, 25 bp, Mus musculus
tgctggtacccacgtctgacaggac

SEQ ID NO: 146815 - DNA, 25 bp, Mus musculus
tgctggtagcagtgaagatcctccg

SEQ ID NO: 146816 - DNA, 25 bp, Mus musculus
tgctggtagccaagcgagatgcctt

SEQ ID NO: 146817 - DNA, 25 bp, Mus musculus
tgctggtagggaggacattatttcc

SEQ ID NO: 146818 - DNA, 25 bp, Mus musculus
tgctggtattccttgtcactgccgc

SEQ ID NO: 146819 - DNA, 25 bp, Mus musculus
tgctggtattgacaaagcccctggg

SEQ ID NO: 146820 - DNA, 25 bp, Mus musculus
tgctggtcaccatggcaatgcggga

SEQ ID NO: 146821 - DNA, 25 bp, Mus musculus
tgctggtcacggacactggctgtga

SEQ ID NO: 146822 - DNA, 25 bp, Mus musculus
tgctggtcagatttaagtgtgttgt

SEQ ID NO: 146823 - DNA, 25 bp, Mus musculus
tgctggtcatcaactccagggagga

SEQ ID NO: 146824 - DNA, 25 bp, Mus musculus
tgctggtcggattgaactgtgctct

SEQ ID NO: 146825 - DNA, 25 bp, Mus musculus
tgctggtctcctacttctgtcctga

SEQ ID NO: 146826 - DNA, 25 bp, Mus musculus
tgctggtctttgtccattgctgctg

SEQ ID NO: 146827 - DNA, 25 bp, Mus musculus
tgctggtgacacacgagtacacggc

SEQ ID NO: 146828 - DNA, 25 bp, Mus musculus
tgctggtgaccaaggcccatcacag

SEQ ID NO: 146829 - DNA, 25 bp, Mus musculus
tgctggtgaggtccttaagaacaca

SEQ ID NO: 146830 - DNA, 25 bp, Mus musculus
tgctggtgagtagcagtcggtaccc

SEQ ID NO: 146831 - DNA, 25 bp, Mus musculus
tgctggtgcgctgtgtcactctgtc

SEQ ID NO: 146832 - DNA, 25 bp, Mus musculus
tgctggtgctcatcccctgcatctg

SEQ ID NO: 146833 - DNA, 25 bp, Mus musculus
tgctggtgctgctcaatgacgggat

SEQ ID NO: 146834 - DNA, 25 bp, Mus musculus
tgctggtgctgggctgtgccgttca

SEQ ID NO: 146835 - DNA, 25 bp, Mus musculus
tgctggtggcaattgtctacgtggt

SEQ ID NO: 146836 - DNA, 25 bp, Mus musculus
tgctggtgggactcaacgttctgga

SEQ ID NO: 146837 - DNA, 25 bp, Mus musculus
tgctggtggtctaacagtaatgccc

SEQ ID NO: 146838 - DNA, 25 bp, Mus musculus
tgctggttcagccaaacactgaggg

SEQ ID NO: 146839 - DNA, 25 bp, Mus musculus
tgctggttcgaagtctctgcggctc

SEQ ID NO: 146840 - DNA, 25 bp, Mus musculus
tgctggttggctcctccacatctca

SEQ ID NO: 146841 - DNA, 25 bp, Mus musculus
tgctgtaacacaagtagatgcctga

SEQ ID NO: 146842 - DNA, 25 bp, Mus musculus
tgctgtaagaaccacactcgtgcgt

SEQ ID NO: 146843 - DNA, 25 bp, Mus musculus
tgctgtaattctctgctcacctcgg

SEQ ID NO: 146844 - DNA, 25 bp, Mus musculus
tgctgtacaacttccccatgacctg

SEQ ID NO: 146845 - DNA, 25 bp, Mus musculus
tgctgtagagcaagtcgccaaacaa

SEQ ID NO: 146846 - DNA, 25 bp, Mus musculus
tgctgtagcatcctagcggttggac

SEQ ID NO: 146847 - DNA, 25 bp, Mus musculus
tgctgtatgccatgctggaccacag

SEQ ID NO: 146848 - DNA, 25 bp, Mus musculus
tgctgtcaaagatgcctggatgtac

SEQ ID NO: 146849 - DNA, 25 bp, Mus musculus
tgctgtcaaagtcttgggaaacctg

SEQ ID NO: 146850 - DNA, 25 bp, Mus musculus
tgctgtcaagagaatccaggctggg

SEQ ID NO: 146851 - DNA, 25 bp, Mus musculus
tgctgtcaatcttgctgccctcggg

SEQ ID NO: 146852 - DNA, 25 bp, Mus musculus
tgctgtcaccaagtcaaccatggag

SEQ ID NO: 146853 - DNA, 25 bp, Mus musculus
tgctgtcaccactctcatgtacctg

SEQ ID NO: 146854 - DNA, 25 bp, Mus musculus
tgctgtcaccgtcagctctgcatgc

SEQ ID NO: 146855 - DNA, 25 bp, Mus musculus
tgctgtcactgaagcggaaatccag

SEQ ID NO: 146856 - DNA, 25 bp, Mus musculus
tgctgtcagaacatctaaggcgtct

SEQ ID NO: 146857 - DNA, 25 bp, Mus musculus
tgctgtcatcacaagagcagcgccg

SEQ ID NO: 146858 - DNA, 25 bp, Mus musculus
tgctgtccagctgctgttgacactg

SEQ ID NO: 146859 - DNA, 25 bp, Mus musculus
tgctgtccggacctagtctgaaccg

SEQ ID NO: 146860 - DNA, 25 bp, Mus musculus
tgctgtcctcagagataacacggga

SEQ ID NO: 146861 - DNA, 25 bp, Mus musculus
tgctgtccttcacctctcagctgaa

SEQ ID NO: 146862 - DNA, 25 bp, Mus musculus
tgctgtcggcagagagatccggtta

SEQ ID NO: 146863 - DNA, 25 bp, Mus musculus
tgctgtctacaaggtggccgagtac

SEQ ID NO: 146864 - DNA, 25 bp, Mus musculus
tgctgtctgagatctgggatgtcca

SEQ ID NO: 146865 - DNA, 25 bp, Mus musculus
tgctgtctgccaccagaactggagg

SEQ ID NO: 146866 - DNA, 25 bp, Mus musculus
tgctgtctgctgatccatggaaaac

SEQ ID NO: 146867 - DNA, 25 bp, Mus musculus
tgctgtctggcaaacagagcgacat

SEQ ID NO: 146868 - DNA, 25 bp, Mus musculus
tgctgtctggtaccccactttggga

SEQ ID NO: 146869 - DNA, 25 bp, Mus musculus
tgctgtgaaaaacgccgatggctac

SEQ ID NO: 146870 - DNA, 25 bp, Mus musculus
tgctgtgaagcaggtcaactgtttt

SEQ ID NO: 146871 - DNA, 25 bp, Mus musculus
tgctgtgcaagggtgactatgagaa

SEQ ID NO: 146872 - DNA, 25 bp, Mus musculus
tgctgtgcactacttcaagggctgg

SEQ ID NO: 146873 - DNA, 25 bp, Mus musculus
tgctgtgcagcctcaacgagcagcg

SEQ ID NO: 146874 - DNA, 25 bp, Mus musculus
tgctgtgccactttcaaggagcgac

SEQ ID NO: 146875 - DNA, 25 bp, Mus musculus
tgctgtgccagaacgctcagacgtt

SEQ ID NO: 146876 - DNA, 25 bp, Mus musculus
tgctgtgccctagggcctgggtggc

SEQ ID NO: 146877 - DNA, 25 bp, Mus musculus
tgctgtgctaacaggagctgtgcac

SEQ ID NO: 146878 - DNA, 25 bp, Mus musculus
tgctgtgctgccgagcggatcccag

SEQ ID NO: 146879 - DNA, 25 bp, Mus musculus
tgctgtgctgggttagtgactctca

SEQ ID NO: 146880 - DNA, 25 bp, Mus musculus
tgctgtgctgttactagaggtccct

SEQ ID NO: 146881 - DNA, 25 bp, Mus musculus
tgctgtggaaaacccctataaatgt

SEQ ID NO: 146882 - DNA, 25 bp, Mus musculus
tgctgtggaccagtttgaaggcagt

SEQ ID NO: 146883 - DNA, 25 bp, Mus musculus
tgctgtggatgaactgagagcctct

SEQ ID NO: 146884 - DNA, 25 bp, Mus musculus
tgctgtggccaagatcgagtatgct

SEQ ID NO: 146885 - DNA, 25 bp, Mus musculus
tgctgtggcctcgagatcgtgccct

SEQ ID NO: 146886 - DNA, 25 bp, Mus musculus
tgctgtgggactagaagagaaaatc

SEQ ID NO: 146887 - DNA, 25 bp, Mus musculus
tgctgtgtatgagaccgacgtgttt

SEQ ID NO: 146888 - DNA, 25 bp, Mus musculus
tgctgtgtgaatatcaaaggactgg

SEQ ID NO: 146889 - DNA, 25 bp, Mus musculus
tgctgtgtgtgaagcccgacgtcag

SEQ ID NO: 146890 - DNA, 25 bp, Mus musculus
tgctgtgttttctctgtcaagtact

SEQ ID NO: 146891 - DNA, 25 bp, Mus musculus
tgctgttaaacaatgcccgggaagc

SEQ ID NO: 146892 - DNA, 25 bp, Mus musculus
tgctgttaccatgggcgtgctgctg

SEQ ID NO: 146893 - DNA, 25 bp, Mus musculus
tgctgttactgcctgcaatctggac

SEQ ID NO: 146894 - DNA, 25 bp, Mus musculus
tgctgttagcaagaggacgggctcc

SEQ ID NO: 146895 - DNA, 25 bp, Mus musculus
tgctgttcagataaaggctggctgc

SEQ ID NO: 146896 - DNA, 25 bp, Mus musculus
tgctgttcctgttgcggaccgaatc

SEQ ID NO: 146897 - DNA, 25 bp, Mus musculus
tgctgttcgagcatgcggtcggcta

SEQ ID NO: 146898 - DNA, 25 bp, Mus musculus
tgctgttcttcatcccgggcgtggt

SEQ ID NO: 146899 - DNA, 25 bp, Mus musculus
tgctgttgctcatactctgaaggga

SEQ ID NO: 146900 - DNA, 25 bp, Mus musculus
tgctgttgctgcacttccgcttctc

SEQ ID NO: 146901 - DNA, 25 bp, Mus musculus
tgctgttggccatagaccgagcctg

SEQ ID NO: 146902 - DNA, 25 bp, Mus musculus
tgctgttgggaagctcctggatgaa

SEQ ID NO: 146903 - DNA, 25 bp, Mus musculus
tgctgttgggcaaaggtgcctctca

SEQ ID NO: 146904 - DNA, 25 bp, Mus musculus
tgctgtttatagtctggcccgtggg

SEQ ID NO: 146905 - DNA, 25 bp, Mus musculus
tgctgtttgccagtggaggcttcaa

SEQ ID NO: 146906 - DNA, 25 bp, Mus musculus
tgctgtttggaaactctggtaagcc

SEQ ID NO: 146907 - DNA, 25 bp, Mus musculus
tgctgtttggcactcatgggtgtaa

SEQ ID NO: 146908 - DNA, 25 bp, Mus musculus
tgctgttttacctgtcgggaaccca

SEQ ID NO: 146909 - DNA, 25 bp, Mus musculus
tgcttaaactggagactgcagccct

SEQ ID NO: 146910 - DNA, 25 bp, Mus musculus
tgcttaaactggctcccagggtgtg

SEQ ID NO: 146911 - DNA, 25 bp, Mus musculus
tgcttaaagcaattgagaacctcgg

SEQ ID NO: 146912 - DNA, 25 bp, Mus musculus
tgcttaaagcacagcgaagtacctg

SEQ ID NO: 146913 - DNA, 25 bp, Mus musculus
tgcttaacatgcaaagcgaggcccc

SEQ ID NO: 146914 - DNA, 25 bp, Mus musculus
tgcttaattatccagagggagctcc

SEQ ID NO: 146915 - DNA, 25 bp, Mus musculus
tgcttacaatggacagcgatgccct

SEQ ID NO: 146916 - DNA, 25 bp, Mus musculus
tgcttacagaccacatccctggcgt

SEQ ID NO: 146917 - DNA, 25 bp, Mus musculus
tgcttaccacgaactcgtggccaga

SEQ ID NO: 146918 - DNA, 25 bp, Mus musculus
tgcttacccaccagcaccaagtggt

SEQ ID NO: 146919 - DNA, 25 bp, Mus musculus
tgcttaccgtgcagcccaaagcgtg

SEQ ID NO: 146920 - DNA, 25 bp, Mus musculus
tgcttacggtctccaatagctgctg

SEQ ID NO: 146921 - DNA, 25 bp, Mus musculus
tgcttactggccgagaaacggtacc

SEQ ID NO: 146922 - DNA, 25 bp, Mus musculus
tgcttagacactagccaggttgaag

SEQ ID NO: 146923 - DNA, 25 bp, Mus musculus
tgcttagacgtagaggctgaggcca

SEQ ID NO: 146924 - DNA, 25 bp, Mus musculus
tgcttagagccaggaagcctgtctt

SEQ ID NO: 146925 - DNA, 25 bp, Mus musculus
tgcttagcatcactcacttgttagg

SEQ ID NO: 146926 - DNA, 25 bp, Mus musculus
tgcttatagtgaggaggccaccacc

SEQ ID NO: 146927 - DNA, 25 bp, Mus musculus
tgcttatgaagctggcccgtgggct

SEQ ID NO: 146928 - DNA, 25 bp, Mus musculus
tgcttatgggacactgactgtgcgc

SEQ ID NO: 146929 - DNA, 25 bp, Mus musculus
tgcttcaaaaactcccaagtgctct

SEQ ID NO: 146930 - DNA, 25 bp, Mus musculus
tgcttcaaaccatgtgagatcagag

SEQ ID NO: 146931 - DNA, 25 bp, Mus musculus
tgcttcaagaaggtgccccgagatg

SEQ ID NO: 146932 - DNA, 25 bp, Mus musculus
tgcttcaagctctcggaactgttgc

SEQ ID NO: 146933 - DNA, 25 bp, Mus musculus
tgcttcaagtcctgccgtgcgtgtg

SEQ ID NO: 146934 - DNA, 25 bp, Mus musculus
tgcttcaagttcagatcaggcaagg

SEQ ID NO: 146935 - DNA, 25 bp, Mus musculus
tgcttcacggagctccagcggaact

SEQ ID NO: 146936 - DNA, 25 bp, Mus musculus
tgcttcagaagaacgggcacgtgcc

SEQ ID NO: 146937 - DNA, 25 bp, Mus musculus
tgcttcagacctccatagatgtgtg

SEQ ID NO: 146938 - DNA, 25 bp, Mus musculus
tgcttcagccttcaaggttcctgca

SEQ ID NO: 146939 - DNA, 25 bp, Mus musculus
tgcttcagctggatccacagacaat

SEQ ID NO: 146940 - DNA, 25 bp, Mus musculus
tgcttcataccagcctgacgaggaa

SEQ ID NO: 146941 - DNA, 25 bp, Mus musculus
tgcttcatcccgttctgcgtagacg

SEQ ID NO: 146942 - DNA, 25 bp, Mus musculus
tgcttccaacaaggattggtggtgg

SEQ ID NO: 146943 - DNA, 25 bp, Mus musculus
tgcttccaagaacgtgcccgcattg

SEQ ID NO: 146944 - DNA, 25 bp, Mus musculus
tgcttccagaaggatccagggttgg

SEQ ID NO: 146945 - DNA, 25 bp, Mus musculus
tgcttcccaagagccaaatgtcaga

SEQ ID NO: 146946 - DNA, 25 bp, Mus musculus
tgcttccggctgtgctctggtttga

SEQ ID NO: 146947 - DNA, 25 bp, Mus musculus
tgcttccggttgctacaatgggccc

SEQ ID NO: 146948 - DNA, 25 bp, Mus musculus
tgcttcctgaccgagtgctgggcac

SEQ ID NO: 146949 - DNA, 25 bp, Mus musculus
tgcttcctgagctcggcagtgcctt

SEQ ID NO: 146950 - DNA, 25 bp, Mus musculus
tgcttcgatgcaacaaaggcactta

SEQ ID NO: 146951 - DNA, 25 bp, Mus musculus
tgcttcgcaagatccagtgccggga

SEQ ID NO: 146952 - DNA, 25 bp, Mus musculus
tgcttcgcatccagaccgtcattga

SEQ ID NO: 146953 - DNA, 25 bp, Mus musculus
tgcttcggaaggatggcaaagaccc

SEQ ID NO: 146954 - DNA, 25 bp, Mus musculus
tgcttcggaggaacaacagttacac

SEQ ID NO: 146955 - DNA, 25 bp, Mus musculus
tgcttcggattagagcactcaggtg

SEQ ID NO: 146956 - DNA, 25 bp, Mus musculus
tgcttcggtcactgaattaccccaa

SEQ ID NO: 146957 - DNA, 25 bp, Mus musculus
tgcttcgtgagagacgggaaaacct

SEQ ID NO: 146958 - DNA, 25 bp, Mus musculus
tgcttcgtggccaaagctgctctga

SEQ ID NO: 146959 - DNA, 25 bp, Mus musculus
tgcttcgtgggcgtcgttgtcacca

SEQ ID NO: 146960 - DNA, 25 bp, Mus musculus
tgcttctccgggaaccacgttgtga

SEQ ID NO: 146961 - DNA, 25 bp, Mus musculus
tgcttctcgacatcatgggccaggt

SEQ ID NO: 146962 - DNA, 25 bp, Mus musculus
tgcttctgatagacgtgaggcgcct

SEQ ID NO: 146963 - DNA, 25 bp, Mus musculus
tgcttctgggacaacggccacctgt

SEQ ID NO: 146964 - DNA, 25 bp, Mus musculus
tgcttctgttgctagcgctgctcag

SEQ ID NO: 146965 - DNA, 25 bp, Mus musculus
tgcttgaacattacacagagtgccc

SEQ ID NO: 146966 - DNA, 25 bp, Mus musculus
tgcttgaagcgctaaatatggaaaa

SEQ ID NO: 146967 - DNA, 25 bp, Mus musculus
tgcttgacaacccagaccagggcat

SEQ ID NO: 146968 - DNA, 25 bp, Mus musculus
tgcttgaccgggaggcatcttctct

SEQ ID NO: 146969 - DNA, 25 bp, Mus musculus
tgcttgagtgcctgcagaagacacc

SEQ ID NO: 146970 - DNA, 25 bp, Mus musculus
tgcttgatacgtccgccattttggg

SEQ ID NO: 146971 - DNA, 25 bp, Mus musculus
tgcttgcagaccagagggatgctct

SEQ ID NO: 146972 - DNA, 25 bp, Mus musculus
tgcttgccagcgaagaaccacatta

SEQ ID NO: 146973 - DNA, 25 bp, Mus musculus
tgcttgccagtatgcagtcgaccgg

SEQ ID NO: 146974 - DNA, 25 bp, Mus musculus
tgcttgcccagaaccccatatgtga

SEQ ID NO: 146975 - DNA, 25 bp, Mus musculus
tgcttgcctatgtgcggagcccaat

SEQ ID NO: 146976 - DNA, 25 bp, Mus musculus
tgcttgctcaatctgcgctagcccc

SEQ ID NO: 146977 - DNA, 25 bp, Mus musculus
tgcttgctgccgacaatggaaaccc

SEQ ID NO: 146978 - DNA, 25 bp, Mus musculus
tgcttgctgtacttccatcggctag

SEQ ID NO: 146979 - DNA, 25 bp, Mus musculus
tgcttggctagacatccacagggac

SEQ ID NO: 146980 - DNA, 25 bp, Mus musculus
tgcttgggtacgacatcagctgggc

SEQ ID NO: 146981 - DNA, 25 bp, Mus musculus
tgcttgggtcgcacgtgtcatcacg

SEQ ID NO: 146982 - DNA, 25 bp, Mus musculus
tgcttggtgccaataacgaggagac

SEQ ID NO: 146983 - DNA, 25 bp, Mus musculus
tgcttggtgccgtctgtacccgaga

SEQ ID NO: 146984 - DNA, 25 bp, Mus musculus
tgcttgtaagtgaggactcggacag

SEQ ID NO: 146985 - DNA, 25 bp, Mus musculus
tgcttgtccacatctggtccaggtg

SEQ ID NO: 146986 - DNA, 25 bp, Mus musculus
tgcttgtctgacacagtccaggctg

SEQ ID NO: 146987 - DNA, 25 bp, Mus musculus
tgcttgtgtccttgccccgtgcatc

SEQ ID NO: 146988 - DNA, 25 bp, Mus musculus
tgcttgttcccaggcagtcagtgaa

SEQ ID NO: 146989 - DNA, 25 bp, Mus musculus
tgcttgttgaaggatctcagtgaca

SEQ ID NO: 146990 - DNA, 25 bp, Mus musculus
tgcttgttggcctgactgtactgag

SEQ ID NO: 146991 - DNA, 25 bp, Mus musculus
tgctttaacccaggatacgagaagg

SEQ ID NO: 146992 - DNA, 25 bp, Mus musculus
tgctttacctacaagggccagtgga

SEQ ID NO: 146993 - DNA, 25 bp, Mus musculus
tgctttacgagataccttggtggct

SEQ ID NO: 146994 - DNA, 25 bp, Mus musculus
tgctttaggaaaacacctcggctga

SEQ ID NO: 146995 - DNA, 25 bp, Mus musculus
tgctttatgggttgatccacgcccg

SEQ ID NO: 146996 - DNA, 25 bp, Mus musculus
tgctttcaaggcaaacacggtgtct

SEQ ID NO: 146997 - DNA, 25 bp, Mus musculus
tgctttcaatggtcccaaaggaggc

SEQ ID NO: 146998 - DNA, 25 bp, Mus musculus
tgctttcacagtggcgctatccgag

SEQ ID NO: 146999 - DNA, 25 bp, Mus musculus
tgctttcacattgaagggcagagcc

SEQ ID NO: 147000 - DNA, 25 bp, Mus musculus
tgctttcatacagtgaagggttgaa

SEQ ID NO: 147001 - DNA, 25 bp, Mus musculus
tgctttcccaggactccttcgagtc

SEQ ID NO: 147002 - DNA, 25 bp, Mus musculus
tgctttcctgcctgctgcgagggaa

SEQ ID NO: 147003 - DNA, 25 bp, Mus musculus
tgctttcgagacagaagtggctgcc

SEQ ID NO: 147004 - DNA, 25 bp, Mus musculus
tgctttcgaggagctagaggcccaa

SEQ ID NO: 147005 - DNA, 25 bp, Mus musculus
tgctttctacgatctcagtcaggga

SEQ ID NO: 147006 - DNA, 25 bp, Mus musculus
tgctttctgcttgtatccgatcggc

SEQ ID NO: 147007 - DNA, 25 bp, Mus musculus
tgctttctgggttgtcttcatgact

SEQ ID NO: 147008 - DNA, 25 bp, Mus musculus
tgctttgaacccagaaggaacggac

SEQ ID NO: 147009 - DNA, 25 bp, Mus musculus
tgctttgaatgctacggctacgaca

SEQ ID NO: 147010 - DNA, 25 bp, Mus musculus
tgctttgactgaaggtgtgctccac

SEQ ID NO: 147011 - DNA, 25 bp, Mus musculus
tgctttgagaacactggcgagctca

SEQ ID NO: 147012 - DNA, 25 bp, Mus musculus
tgctttgagcgagctgagcaggccc

SEQ ID NO: 147013 - DNA, 25 bp, Mus musculus
tgctttgagtccttgccttggcgcc

SEQ ID NO: 147014 - DNA, 25 bp, Mus musculus
tgctttgctatcactggctgggccg

SEQ ID NO: 147015 - DNA, 25 bp, Mus musculus
tgctttgctgctgcctgtggacttt

SEQ ID NO: 147016 - DNA, 25 bp, Mus musculus
tgctttggaaatagcgatgctcacg

SEQ ID NO: 147017 - DNA, 25 bp, Mus musculus
tgctttggacacagaaggttcttcc

SEQ ID NO: 147018 - DNA, 25 bp, Mus musculus
tgctttgggaccacttacctggcag

SEQ ID NO: 147019 - DNA, 25 bp, Mus musculus
tgctttgtttatcctccatagaggg

SEQ ID NO: 147020 - DNA, 25 bp, Mus musculus
tgcttttagaagatccggcccgcag

SEQ ID NO: 147021 - DNA, 25 bp, Mus musculus
tgcttttcagagagatgccctttgc

SEQ ID NO: 147022 - DNA, 25 bp, Mus musculus
tgcttttctcagttggatggacccc

SEQ ID NO: 147023 - DNA, 25 bp, Mus musculus
tgcttttctgatgctgagccctggg

SEQ ID NO: 147024 - DNA, 25 bp, Mus musculus
tgcttttggaattgacgcgccgtgg

SEQ ID NO: 147025 - DNA, 25 bp, Mus musculus
tgcttttgttgccactacccctggg

SEQ ID NO: 147026 - DNA, 25 bp, Mus musculus
tggaaaaaactcacccagttagtgg

SEQ ID NO: 147027 - DNA, 25 bp, Mus musculus
tggaaaaaccctgatggacacatgg

SEQ ID NO: 147028 - DNA, 25 bp, Mus musculus
tggaaaaacgtttgacacttgagcc

SEQ ID NO: 147029 - DNA, 25 bp, Mus musculus
tggaaaaagagatgtccccgcagct

SEQ ID NO: 147030 - DNA, 25 bp, Mus musculus
tggaaaacccaggaagctctgcggg

SEQ ID NO: 147031 - DNA, 25 bp, Mus musculus
tggaaaaccctctcttcaggtggac

SEQ ID NO: 147032 - DNA, 25 bp, Mus musculus
tggaaaaccctgatgaggccgtggt

SEQ ID NO: 147033 - DNA, 25 bp, Mus musculus
tggaaaaccgtttctagagtccctg

SEQ ID NO: 147034 - DNA, 25 bp, Mus musculus
tggaaaactgggacgagagaacccg

SEQ ID NO: 147035 - DNA, 25 bp, Mus musculus
tggaaaacttcgaacacaaacaaga

SEQ ID NO: 147036 - DNA, 25 bp, Mus musculus
tggaaaagatgctgtccaaacccga

SEQ ID NO: 147037 - DNA, 25 bp, Mus musculus
tggaaaagcctgcaactaggaaaaa

SEQ ID NO: 147038 - DNA, 25 bp, Mus musculus
tggaaaagctgctgggcaacacccc

SEQ ID NO: 147039 - DNA, 25 bp, Mus musculus
tggaaaaggctaaacccctgggcag

SEQ ID NO: 147040 - DNA, 25 bp, Mus musculus
tggaaaaggctccttagaagccggc

SEQ ID NO: 147041 - DNA, 25 bp, Mus musculus
tggaaaagtgtggtcagccgctctg

SEQ ID NO: 147042 - DNA, 25 bp, Mus musculus
tggaaaatagtacgctcccatggag

SEQ ID NO: 147043 - DNA, 25 bp, Mus musculus
tggaaaatgtgaccctgctaaaccc

SEQ ID NO: 147044 - DNA, 25 bp, Mus musculus
tggaaacaagactgagcggctgcac

SEQ ID NO: 147045 - DNA, 25 bp, Mus musculus
tggaaacaagccatacgattctagt

SEQ ID NO: 147046 - DNA, 25 bp, Mus musculus
tggaaacagcaacgcccatcaaagt

SEQ ID NO: 147047 - DNA, 25 bp, Mus musculus
tggaaacagctatgtgccgagcatg

SEQ ID NO: 147048 - DNA, 25 bp, Mus musculus
tggaaacagctcacaacccaggagt

SEQ ID NO: 147049 - DNA, 25 bp, Mus musculus
tggaaacatggcgtcgcgcaaggaa

SEQ ID NO: 147050 - DNA, 25 bp, Mus musculus
tggaaaccaccagagaaaaacactg

SEQ ID NO: 147051 - DNA, 25 bp, Mus musculus
tggaaaccactaatgctgacatcgt

SEQ ID NO: 147052 - DNA, 25 bp, Mus musculus
tggaaaccacttcagcctgggctgc

SEQ ID NO: 147053 - DNA, 25 bp, Mus musculus
tggaaacccaaatagccaagtggaa

SEQ ID NO: 147054 - DNA, 25 bp, Mus musculus
tggaaacccagccatcgttcaggat

SEQ ID NO: 147055 - DNA, 25 bp, Mus musculus
tggaaacccagtagcaaacggacag

SEQ ID NO: 147056 - DNA, 25 bp, Mus musculus
tggaaacccctcttaagttgtggct

SEQ ID NO: 147057 - DNA, 25 bp, Mus musculus
tggaaacccggaccacattttgtgc

SEQ ID NO: 147058 - DNA, 25 bp, Mus musculus
tggaaaccgacgagccagatgacga

SEQ ID NO: 147059 - DNA, 25 bp, Mus musculus
tggaaacctgagaaactatgacggg

SEQ ID NO: 147060 - DNA, 25 bp, Mus musculus
tggaaacctgggtgctcctagcaat

SEQ ID NO: 147061 - DNA, 25 bp, Mus musculus
tggaaaccttttgtgtatggcggcc

SEQ ID NO: 147062 - DNA, 25 bp, Mus musculus
tggaaacgcgcgctcagccatgtct

SEQ ID NO: 147063 - DNA, 25 bp, Mus musculus
tggaaactctggtaagcccctgtag

SEQ ID NO: 147064 - DNA, 25 bp, Mus musculus
tggaaactggcgttcgtcgaggcct

SEQ ID NO: 147065 - DNA, 25 bp, Mus musculus
tggaaagaaaacctcaactgcaggc

SEQ ID NO: 147066 - DNA, 25 bp, Mus musculus
tggaaagaccacgataatgaagaat

SEQ ID NO: 147067 - DNA, 25 bp, Mus musculus
tggaaagacctgataaccgggatgg

SEQ ID NO: 147068 - DNA, 25 bp, Mus musculus
tggaaagaggtcttgtgccacccag

SEQ ID NO: 147069 - DNA, 25 bp, Mus musculus
tggaaagatccgagtgaccgtgact

SEQ ID NO: 147070 - DNA, 25 bp, Mus musculus
tggaaagatgggaaacagcccgagc

SEQ ID NO: 147071 - DNA, 25 bp, Mus musculus
tggaaagcagcccaggcatggccac

SEQ ID NO: 147072 - DNA, 25 bp, Mus musculus
tggaaagccgtgtgaagtgactact

SEQ ID NO: 147073 - DNA, 25 bp, Mus musculus
tggaaaggaaatttaccctagagat

SEQ ID NO: 147074 - DNA, 25 bp, Mus musculus
tggaaaggactacaccaaggtggac

SEQ ID NO: 147075 - DNA, 25 bp, Mus musculus
tggaaaggctcatcgacctcatggc

SEQ ID NO: 147076 - DNA, 25 bp, Mus musculus
tggaaaggctctgtctgatgaggac

SEQ ID NO: 147077 - DNA, 25 bp, Mus musculus
tggaaaggtctgtgggctacaccca

SEQ ID NO: 147078 - DNA, 25 bp, Mus musculus
tggaaagtaatgacagctggcacct

SEQ ID NO: 147079 - DNA, 25 bp, Mus musculus
tggaaagtataagggcactcggctc

SEQ ID NO: 147080 - DNA, 25 bp, Mus musculus
tggaaagtccaggttctgacagctg

SEQ ID NO: 147081 - DNA, 25 bp, Mus musculus
tggaaagtgccagagctgacctgct

SEQ ID NO: 147082 - DNA, 25 bp, Mus musculus
tggaaagtgtctgttctcgcctgca

SEQ ID NO: 147083 - DNA, 25 bp, Mus musculus
tggaaatacagacataccgccaatt

SEQ ID NO: 147084 - DNA, 25 bp, Mus musculus
tggaaatagacaacaccctggaaac

SEQ ID NO: 147085 - DNA, 25 bp, Mus musculus
tggaaataggccgtcgtcagctgct

SEQ ID NO: 147086 - DNA, 25 bp, Mus musculus
tggaaatatctgagccccactcagc

SEQ ID NO: 147087 - DNA, 25 bp, Mus musculus
tggaaatcagccctcagaacgtgga

SEQ ID NO: 147088 - DNA, 25 bp, Mus musculus
tggaaatccccagagatcagggcat

SEQ ID NO: 147089 - DNA, 25 bp, Mus musculus
tggaaatccctcagctgaaccgact

SEQ ID NO: 147090 - DNA, 25 bp, Mus musculus
tggaaatccgtcagaaaccctaagg

SEQ ID NO: 147091 - DNA, 25 bp, Mus musculus
tggaaatctcccagctaactcggga

SEQ ID NO: 147092 - DNA, 25 bp, Mus musculus
tggaaatctcctatactaccggtat

SEQ ID NO: 147093 - DNA, 25 bp, Mus musculus
tggaaatcttataatcacccgcgag

SEQ ID NO: 147094 - DNA, 25 bp, Mus musculus
tggaaatgcaaaaatgcccgaggcc

SEQ ID NO: 147095 - DNA, 25 bp, Mus musculus
tggaaatgcaactgcctcccaggag

SEQ ID NO: 147096 - DNA, 25 bp, Mus musculus
tggaaatgcctaagtcagaagggtc

SEQ ID NO: 147097 - DNA, 25 bp, Mus musculus
tggaaattcatcaaggacaactggg

SEQ ID NO: 147098 - DNA, 25 bp, Mus musculus
tggaaattcttcaagccctggcagc

SEQ ID NO: 147099 - DNA, 25 bp, Mus musculus
tggaaattggatgccaaaatgaagc

SEQ ID NO: 147100 - DNA, 25 bp, Mus musculus
tggaacaagaggtcaatcggaagcc

SEQ ID NO: 147101 - DNA, 25 bp, Mus musculus
tggaacaaggaaacgcaaataaaat

SEQ ID NO: 147102 - DNA, 25 bp, Mus musculus
tggaacaatacaaagggccctggac

SEQ ID NO: 147103 - DNA, 25 bp, Mus musculus
tggaacacaatggatcacacaggag

SEQ ID NO: 147104 - DNA, 25 bp, Mus musculus
tggaacagccatcgaaggaaacaga

SEQ ID NO: 147105 - DNA, 25 bp, Mus musculus
tggaacagggcatccacagcgatgt

SEQ ID NO: 147106 - DNA, 25 bp, Mus musculus
tggaacagtaccaccaggcgattcc

SEQ ID NO: 147107 - DNA, 25 bp, Mus musculus
tggaacatgctacagttgccccgac

SEQ ID NO: 147108 - DNA, 25 bp, Mus musculus
tggaaccaccattaaagcctaagac

SEQ ID NO: 147109 - DNA, 25 bp, Mus musculus
tggaaccagatgaagctactcggcg

SEQ ID NO: 147110 - DNA, 25 bp, Mus musculus
tggaaccattgatggcaccaaagac

SEQ ID NO: 147111 - DNA, 25 bp, Mus musculus
tggaacccagaatgtaagccctgcg

SEQ ID NO: 147112 - DNA, 25 bp, Mus musculus
tggaaccccaaggattgctccgaga

SEQ ID NO: 147113 - DNA, 25 bp, Mus musculus
tggaacccctggtagaggctctact

SEQ ID NO: 147114 - DNA, 25 bp, Mus musculus
tggaaccctcagtgaaaggcagcct

SEQ ID NO: 147115 - DNA, 25 bp, Mus musculus
tggaaccgagcctgcatgggagatc

SEQ ID NO: 147116 - DNA, 25 bp, Mus musculus
tggaacctaagacccagtgcgtgct

SEQ ID NO: 147117 - DNA, 25 bp, Mus musculus
tggaacctgaggtcgaaaccggagc

SEQ ID NO: 147118 - DNA, 25 bp, Mus musculus
tggaaccttgagagccaagggagat

SEQ ID NO: 147119 - DNA, 25 bp, Mus musculus
tggaacgatatggataaattagtct

SEQ ID NO: 147120 - DNA, 25 bp, Mus musculus
tggaacgcaaccagtacaaggaacg

SEQ ID NO: 147121 - DNA, 25 bp, Mus musculus
tggaacgcaagctccgggaagtcat

SEQ ID NO: 147122 - DNA, 25 bp, Mus musculus
tggaacgggagtggccggattcgcg

SEQ ID NO: 147123 - DNA, 25 bp, Mus musculus
tggaactacagtacatcatggacct

SEQ ID NO: 147124 - DNA, 25 bp, Mus musculus
tggaactcaaacatgctacaagacc

SEQ ID NO: 147125 - DNA, 25 bp, Mus musculus
tggaactcgccaagtgcaagatgga

SEQ ID NO: 147126 - DNA, 25 bp, Mus musculus
tggaactcggtacaatcttttaaat

SEQ ID NO: 147127 - DNA, 25 bp, Mus musculus
tggaactgactttgacctgcgcaca

SEQ ID NO: 147128 - DNA, 25 bp, Mus musculus
tggaactgatggacgccaacctgtg

SEQ ID NO: 147129 - DNA, 25 bp, Mus musculus
tggaactgtccaccgaactgatacc

SEQ ID NO: 147130 - DNA, 25 bp, Mus musculus
tggaactgtgcaggaaaccggagcc

SEQ ID NO: 147131 - DNA, 25 bp, Mus musculus
tggaactgttcttgctcaccctcgc

SEQ ID NO: 147132 - DNA, 25 bp, Mus musculus
tggaacttaaaggtctatcgctggg

SEQ ID NO: 147133 - DNA, 25 bp, Mus musculus
tggaactttcccatggatggctcca

SEQ ID NO: 147134 - DNA, 25 bp, Mus musculus
tggaactttctctgtgaatgtcacc

SEQ ID NO: 147135 - DNA, 25 bp, Mus musculus
tggaagaactgcacacgacatgact

SEQ ID NO: 147136 - DNA, 25 bp, Mus musculus
tggaagacacaaagctcctcgtgtc

SEQ ID NO: 147137 - DNA, 25 bp, Mus musculus
tggaagaccccacagatgactacgg

SEQ ID NO: 147138 - DNA, 25 bp, Mus musculus
tggaagaccctgctatagtgagtga

SEQ ID NO: 147139 - DNA, 25 bp, Mus musculus
tggaagaccgcgttctgcagaacct

SEQ ID NO: 147140 - DNA, 25 bp, Mus musculus
tggaagacgccaagatacactgatg

SEQ ID NO: 147141 - DNA, 25 bp, Mus musculus
tggaagagacgtatctgcagcagct

SEQ ID NO: 147142 - DNA, 25 bp, Mus musculus
tggaagagcggaagctcatgatgat

SEQ ID NO: 147143 - DNA, 25 bp, Mus musculus
tggaagagctacctcatgaagcggt

SEQ ID NO: 147144 - DNA, 25 bp, Mus musculus
tggaagagctgaaccccaaaggcat

SEQ ID NO: 147145 - DNA, 25 bp, Mus musculus
tggaagagggagagtgccatctact

SEQ ID NO: 147146 - DNA, 25 bp, Mus musculus
tggaagagttcagtttaccggatgc

SEQ ID NO: 147147 - DNA, 25 bp, Mus musculus
tggaagatattgaagagaatgcccc

SEQ ID NO: 147148 - DNA, 25 bp, Mus musculus
tggaagatctgctgaagcccacgca

SEQ ID NO: 147149 - DNA, 25 bp, Mus musculus
tggaagatgccaggcattagcctct

SEQ ID NO: 147150 - DNA, 25 bp, Mus musculus
tggaagatggcaacctgcacgtgac

SEQ ID NO: 147151 - DNA, 25 bp, Mus musculus
tggaagattccccatatgagccggt

SEQ ID NO: 147152 - DNA, 25 bp, Mus musculus
tggaagattctacacgcactgatga

SEQ ID NO: 147153 - DNA, 25 bp, Mus musculus
tggaagattctgtacaacctgggcc

SEQ ID NO: 147154 - DNA, 25 bp, Mus musculus
tggaagcacgttccctcccacggtt

SEQ ID NO: 147155 - DNA, 25 bp, Mus musculus
tggaagcactcctcagaacatcttt

SEQ ID NO: 147156 - DNA, 25 bp, Mus musculus
tggaagcagctaatggcgcagagca

SEQ ID NO: 147157 - DNA, 25 bp, Mus musculus
tggaagcagttgagccagacatggc

SEQ ID NO: 147158 - DNA, 25 bp, Mus musculus
tggaagccagcaaagtcagcaagac

SEQ ID NO: 147159 - DNA, 25 bp, Mus musculus
tggaagccagcatagtccaggcagg

SEQ ID NO: 147160 - DNA, 25 bp, Mus musculus
tggaagcccagacagcatgaatgtg

SEQ ID NO: 147161 - DNA, 25 bp, Mus musculus
tggaagcccatatgcgctctcacac

SEQ ID NO: 147162 - DNA, 25 bp, Mus musculus
tggaagccgcaccttgtacatagat

SEQ ID NO: 147163 - DNA, 25 bp, Mus musculus
tggaagccttttacaaacattatat

SEQ ID NO: 147164 - DNA, 25 bp, Mus musculus
tggaagcgcttaccagcccagcttt

SEQ ID NO: 147165 - DNA, 25 bp, Mus musculus
tggaagcggaccactatcaactcgt

SEQ ID NO: 147166 - DNA, 25 bp, Mus musculus
tggaagcgttgatgatggacataaa

SEQ ID NO: 147167 - DNA, 25 bp, Mus musculus
tggaagctacttttgggacaggcct

SEQ ID NO: 147168 - DNA, 25 bp, Mus musculus
tggaagctcaaaagacccatgctct

SEQ ID NO: 147169 - DNA, 25 bp, Mus musculus
tggaagctcagctcggagttccagc

SEQ ID NO: 147170 - DNA, 25 bp, Mus musculus
tggaagcttccaggtgacaacaggc

SEQ ID NO: 147171 - DNA, 25 bp, Mus musculus
tggaagcttctagcaagccctatgc

SEQ ID NO: 147172 - DNA, 25 bp, Mus musculus
tggaagcttggagatgacatcgacc

SEQ ID NO: 147173 - DNA, 25 bp, Mus musculus
tggaaggacctgttatgtgtgcccc

SEQ ID NO: 147174 - DNA, 25 bp, Mus musculus
tggaaggagagaacgcagtactgct

SEQ ID NO: 147175 - DNA, 25 bp, Mus musculus
tggaaggagcctgaagaactcaagc

SEQ ID NO: 147176 - DNA, 25 bp, Mus musculus
tggaaggcagctttcacggctggcc

SEQ ID NO: 147177 - DNA, 25 bp, Mus musculus
tggaaggcagtctcagcagaatttc

SEQ ID NO: 147178 - DNA, 25 bp, Mus musculus
tggaaggctacgatcctacagtgga

SEQ ID NO: 147179 - DNA, 25 bp, Mus musculus
tggaaggctggaatcgccatgaggc

SEQ ID NO: 147180 - DNA, 25 bp, Mus musculus
tggaagggaatgagattcatcactg

SEQ ID NO: 147181 - DNA, 25 bp, Mus musculus
tggaagggccctatcgtctcaagca

SEQ ID NO: 147182 - DNA, 25 bp, Mus musculus
tggaaggtcagctcaatcaggatga

SEQ ID NO: 147183 - DNA, 25 bp, Mus musculus
tggaaggtcccgggatctcccgtca

SEQ ID NO: 147184 - DNA, 25 bp, Mus musculus
tggaagtacttcttacacgagaaac

SEQ ID NO: 147185 - DNA, 25 bp, Mus musculus
tggaagtagcaactgaacccaccgg

SEQ ID NO: 147186 - DNA, 25 bp, Mus musculus
tggaagtcactaggcacatcctgga

SEQ ID NO: 147187 - DNA, 25 bp, Mus musculus
tggaagtcatcgtggtcaaccaggt

SEQ ID NO: 147188 - DNA, 25 bp, Mus musculus
tggaagtccagacactgaatccgcg

SEQ ID NO: 147189 - DNA, 25 bp, Mus musculus
tggaagtcgtcccaccagaaaagga

SEQ ID NO: 147190 - DNA, 25 bp, Mus musculus
tggaagtctgaaatggctgtctgca

SEQ ID NO: 147191 - DNA, 25 bp, Mus musculus
tggaagtgccaagaaagactcatcc

SEQ ID NO: 147192 - DNA, 25 bp, Mus musculus
tggaagtggaatcctcaccgcctgt

SEQ ID NO: 147193 - DNA, 25 bp, Mus musculus
tggaagtggcggcatcgctggctcg

SEQ ID NO: 147194 - DNA, 25 bp, Mus musculus
tggaagtggttctggccgaccctaa

SEQ ID NO: 147195 - DNA, 25 bp, Mus musculus
tggaagtgtcaaacagaacggccct

SEQ ID NO: 147196 - DNA, 25 bp, Mus musculus
tggaagtgtctcctacacagtggcg

SEQ ID NO: 147197 - DNA, 25 bp, Mus musculus
tggaagttcctctccgcaaaggagg

SEQ ID NO: 147198 - DNA, 25 bp, Mus musculus
tggaataagtacgatgaccggttga

SEQ ID NO: 147199 - DNA, 25 bp, Mus musculus
tggaatacaaaactcacaccgacag

SEQ ID NO: 147200 - DNA, 25 bp, Mus musculus
tggaatacaacgtggagcctcagga

SEQ ID NO: 147201 - DNA, 25 bp, Mus musculus
tggaataccagcagagaccacagcg

SEQ ID NO: 147202 - DNA, 25 bp, Mus musculus
tggaataccgtcagcaccacgaatg

SEQ ID NO: 147203 - DNA, 25 bp, Mus musculus
tggaatacctaggtggaggttcagc

SEQ ID NO: 147204 - DNA, 25 bp, Mus musculus
tggaatagaagagcacactgttggc

SEQ ID NO: 147205 - DNA, 25 bp, Mus musculus
tggaatagacctttgaaaacgcggc

SEQ ID NO: 147206 - DNA, 25 bp, Mus musculus
tggaatagctcatacccgttgggcg

SEQ ID NO: 147207 - DNA, 25 bp, Mus musculus
tggaatatccaaacagacactcttg

SEQ ID NO: 147208 - DNA, 25 bp, Mus musculus
tggaatcaaaatgcaccggcctagg

SEQ ID NO: 147209 - DNA, 25 bp, Mus musculus
tggaatcaactatgacaagccgctg

SEQ ID NO: 147210 - DNA, 25 bp, Mus musculus
tggaatcactccgacactcgatggg

SEQ ID NO: 147211 - DNA, 25 bp, Mus musculus
tggaatcagatcaaggcacaggagc

SEQ ID NO: 147212 - DNA, 25 bp, Mus musculus
tggaatcagattgtcccgggctcct

SEQ ID NO: 147213 - DNA, 25 bp, Mus musculus
tggaatcatccagacgaaggccctg

SEQ ID NO: 147214 - DNA, 25 bp, Mus musculus
tggaatccaaacaagcaaaccggct

SEQ ID NO: 147215 - DNA, 25 bp, Mus musculus
tggaatccaaaggagcccatcgagc

SEQ ID NO: 147216 - DNA, 25 bp, Mus musculus
tggaatccaattccccagcagcgct

SEQ ID NO: 147217 - DNA, 25 bp, Mus musculus
tggaatccactgtaccgagctgtcg

SEQ ID NO: 147218 - DNA, 25 bp, Mus musculus
tggaatccagaaacattggccgccc

SEQ ID NO: 147219 - DNA, 25 bp, Mus musculus
tggaatccagtatagagctcatagc

SEQ ID NO: 147220 - DNA, 25 bp, Mus musculus
tggaatcccggccattgtgaaactg

SEQ ID NO: 147221 - DNA, 25 bp, Mus musculus
tggaatcccttactctggcccttgg

SEQ ID NO: 147222 - DNA, 25 bp, Mus musculus
tggaatcctctacacattgacccgg

SEQ ID NO: 147223 - DNA, 25 bp, Mus musculus
tggaatcctgattgcgaactgcggg

SEQ ID NO: 147224 - DNA, 25 bp, Mus musculus
tggaatccttcggagactgtgcggc

SEQ ID NO: 147225 - DNA, 25 bp, Mus musculus
tggaatcctttcaatgactttgaga

SEQ ID NO: 147226 - DNA, 25 bp, Mus musculus
tggaatctagagtaccccagccgtg

SEQ ID NO: 147227 - DNA, 25 bp, Mus musculus
tggaatctcctcacgaagagcgggt

SEQ ID NO: 147228 - DNA, 25 bp, Mus musculus
tggaatgaacaaacacccgtggcag

SEQ ID NO: 147229 - DNA, 25 bp, Mus musculus
tggaatgaacataacttgaaggctg

SEQ ID NO: 147230 - DNA, 25 bp, Mus musculus
tggaatgaccgcttgtattgagtgc

SEQ ID NO: 147231 - DNA, 25 bp, Mus musculus
tggaatgagagcaaatgagccggca

SEQ ID NO: 147232 - DNA, 25 bp, Mus musculus
tggaatgcaggagcactctggcagc

SEQ ID NO: 147233 - DNA, 25 bp, Mus musculus
tggaatgctccaaaaaactcggtag

SEQ ID NO: 147234 - DNA, 25 bp, Mus musculus
tggaatgctcgtgttccagtaaggg

SEQ ID NO: 147235 - DNA, 25 bp, Mus musculus
tggaatggaacagagacggaagcct

SEQ ID NO: 147236 - DNA, 25 bp, Mus musculus
tggaatggaagacataaaccctggg

SEQ ID NO: 147237 - DNA, 25 bp, Mus musculus
tggaatggacagacgtcagaacaca

SEQ ID NO: 147238 - DNA, 25 bp, Mus musculus
tggaatggctagatcaggttcatgc

SEQ ID NO: 147239 - DNA, 25 bp, Mus musculus
tggaatggcttactcatggaccgcc

SEQ ID NO: 147240 - DNA, 25 bp, Mus musculus
tggaattcagccacgaccagtacaa

SEQ ID NO: 147241 - DNA, 25 bp, Mus musculus
tggaattccaacaggacagagaggc

SEQ ID NO: 147242 - DNA, 25 bp, Mus musculus
tggaattccaccatgcgtcgcaagg

SEQ ID NO: 147243 - DNA, 25 bp, Mus musculus
tggaattccatcagcagtggagcgt

SEQ ID NO: 147244 - DNA, 25 bp, Mus musculus
tggaattccggaaacattgctgtga

SEQ ID NO: 147245 - DNA, 25 bp, Mus musculus
tggaattctactcagcgctgccagg

SEQ ID NO: 147246 - DNA, 25 bp, Mus musculus
tggaattctcttcaactgtggtgga

SEQ ID NO: 147247 - DNA, 25 bp, Mus musculus
tggaattgaaccacagaggactgac

SEQ ID NO: 147248 - DNA, 25 bp, Mus musculus
tggaattgccgaagtcaccatccgg

SEQ ID NO: 147249 - DNA, 25 bp, Mus musculus
tggaattgtatcctttgaccatgac

SEQ ID NO: 147250 - DNA, 25 bp, Mus musculus
tggaattgtgctggccccttagtct

SEQ ID NO: 147251 - DNA, 25 bp, Mus musculus
tggaattgttgtccacgcagcagcc

SEQ ID NO: 147252 - DNA, 25 bp, Mus musculus
tggaatttactcctctggacttgca

SEQ ID NO: 147253 - DNA, 25 bp, Mus musculus
tggaatttatctcatcagactactg

SEQ ID NO: 147254 - DNA, 25 bp, Mus musculus
tggaatttctagtgccacccacagt

SEQ ID NO: 147255 - DNA, 25 bp, Mus musculus
tggaatttctcaggcccagagggct

SEQ ID NO: 147256 - DNA, 25 bp, Mus musculus
tggaatttctgtcgccttctctccg

SEQ ID NO: 147257 - DNA, 25 bp, Mus musculus
tggaatttgcacaagaggatcgctc

SEQ ID NO: 147258 - DNA, 25 bp, Mus musculus
tggaatttgtccgaactggctatgg

SEQ ID NO: 147259 - DNA, 25 bp, Mus musculus
tggaatttttgggtctacagggtgt

SEQ ID NO: 147260 - DNA, 25 bp, Mus musculus
tggacaaaagccttctccctctgat

SEQ ID NO: 147261 - DNA, 25 bp, Mus musculus
tggacaaacttatcgctcagaaagt

SEQ ID NO: 147262 - DNA, 25 bp, Mus musculus
tggacaaagtattccgaccagaaac

SEQ ID NO: 147263 - DNA, 25 bp, Mus musculus
tggacaaagtctgcctcatcggctg

SEQ ID NO: 147264 - DNA, 25 bp, Mus musculus
tggacaaatagtctccaagaggagg

SEQ ID NO: 147265 - DNA, 25 bp, Mus musculus
tggacaacacagatcgcaagggcgt

SEQ ID NO: 147266 - DNA, 25 bp, Mus musculus
tggacaaccttttgggcagcctccg

SEQ ID NO: 147267 - DNA, 25 bp, Mus musculus
tggacaacgtcaagtactgcggcta

SEQ ID NO: 147268 - DNA, 25 bp, Mus musculus
tggacaagaagttcaccgtgactgt

SEQ ID NO: 147269 - DNA, 25 bp, Mus musculus
tggacaagacaagcatccggcatgg

SEQ ID NO: 147270 - DNA, 25 bp, Mus musculus
tggacaagaccgaacactactggcc

SEQ ID NO: 147271 - DNA, 25 bp, Mus musculus
tggacaagacgtcagatgccacgct

SEQ ID NO: 147272 - DNA, 25 bp, Mus musculus
tggacaagatcatgcagcgcacaaa

SEQ ID NO: 147273 - DNA, 25 bp, Mus musculus
tggacaagccagtcaccgtgcagtt

SEQ ID NO: 147274 - DNA, 25 bp, Mus musculus
tggacaagcgccagcggaatcgctg

SEQ ID NO: 147275 - DNA, 25 bp, Mus musculus
tggacaaggcgcaagccaagttctg

SEQ ID NO: 147276 - DNA, 25 bp, Mus musculus
tggacaaggtcctgcacaagttcct

SEQ ID NO: 147277 - DNA, 25 bp, Mus musculus
tggacaagtacaacgctgagaagcc

SEQ ID NO: 147278 - DNA, 25 bp, Mus musculus
tggacaagtccaacatcaaccggca

SEQ ID NO: 147279 - DNA, 25 bp, Mus musculus
tggacaagtttgctaacgagcctct

SEQ ID NO: 147280 - DNA, 25 bp, Mus musculus
tggacaatcccaaatcagcaggcgt

SEQ ID NO: 147281 - DNA, 25 bp, Mus musculus
tggacaatccctacagcaactgtgg

SEQ ID NO: 147282 - DNA, 25 bp, Mus musculus
tggacaatgccaatgtcctcctgca

SEQ ID NO: 147283 - DNA, 25 bp, Mus musculus
tggacaatgtcaaatgccgaggaga

SEQ ID NO: 147284 - DNA, 25 bp, Mus musculus
tggacacacccatgtcttaggcacg

SEQ ID NO: 147285 - DNA, 25 bp, Mus musculus
tggacacagctgtggctcttccgct

SEQ ID NO: 147286 - DNA, 25 bp, Mus musculus
tggacacagtgtcaacgctgccagg

SEQ ID NO: 147287 - DNA, 25 bp, Mus musculus
tggacacatccagtgtgcaggagct

SEQ ID NO: 147288 - DNA, 25 bp, Mus musculus
tggacacattggatcctcagacagg

SEQ ID NO: 147289 - DNA, 25 bp, Mus musculus
tggacaccaaccagctagacgctag

SEQ ID NO: 147290 - DNA, 25 bp, Mus musculus
tggacaccattaagacaaggctgca

SEQ ID NO: 147291 - DNA, 25 bp, Mus musculus
tggacaccattaagagcaacctgga

SEQ ID NO: 147292 - DNA, 25 bp, Mus musculus
tggacacccagatgtttcagaatgc

SEQ ID NO: 147293 - DNA, 25 bp, Mus musculus
tggacaccctgccacttaacggcaa

SEQ ID NO: 147294 - DNA, 25 bp, Mus musculus
tggacaccgcaccaaaggactttgt

SEQ ID NO: 147295 - DNA, 25 bp, Mus musculus
tggacacctcacctcacagagagca

SEQ ID NO: 147296 - DNA, 25 bp, Mus musculus
tggacaccttactacttgagcctgg

SEQ ID NO: 147297 - DNA, 25 bp, Mus musculus
tggacaccttcatggccctcagtgg

SEQ ID NO: 147298 - DNA, 25 bp, Mus musculus
tggacacgataccattgttcacttg

SEQ ID NO: 147299 - DNA, 25 bp, Mus musculus
tggacacgtcctacaaaacattgag

SEQ ID NO: 147300 - DNA, 25 bp, Mus musculus
tggacactggccctcaagagtgact

SEQ ID NO: 147301 - DNA, 25 bp, Mus musculus
tggacacttggcttgggctacctgg

SEQ ID NO: 147302 - DNA, 25 bp, Mus musculus
tggacagaaggccatactgtttctt

SEQ ID NO: 147303 - DNA, 25 bp, Mus musculus
tggacagacctttcgtcaccctgct

SEQ ID NO: 147304 - DNA, 25 bp, Mus musculus
tggacagacgtcagaacacatacat

SEQ ID NO: 147305 - DNA, 25 bp, Mus musculus
tggacagagaccagcagataactcc

SEQ ID NO: 147306 - DNA, 25 bp, Mus musculus
tggacagagatcaacgacagccgta

SEQ ID NO: 147307 - DNA, 25 bp, Mus musculus
tggacagagccctgcatccttgctg

SEQ ID NO: 147308 - DNA, 25 bp, Mus musculus
tggacagagtgctcagcaggctcct

SEQ ID NO: 147309 - DNA, 25 bp, Mus musculus
tggacagatgtcaggttaccgccgt

SEQ ID NO: 147310 - DNA, 25 bp, Mus musculus
tggacagcagcaaagaatcagctga

SEQ ID NO: 147311 - DNA, 25 bp, Mus musculus
tggacagcagtcctagttcccagaa

SEQ ID NO: 147312 - DNA, 25 bp, Mus musculus
tggacagcattttccgaaggatcag

SEQ ID NO: 147313 - DNA, 25 bp, Mus musculus
tggacagccttgcaaccaggtgacg

SEQ ID NO: 147314 - DNA, 25 bp, Mus musculus
tggacagccttgttcacgagaaaga

SEQ ID NO: 147315 - DNA, 25 bp, Mus musculus
tggacagcgacgatgccatcttcac

SEQ ID NO: 147316 - DNA, 25 bp, Mus musculus
tggacagctccatacacggtttgac

SEQ ID NO: 147317 - DNA, 25 bp, Mus musculus
tggacagctgccctgaacagaaaga

SEQ ID NO: 147318 - DNA, 25 bp, Mus musculus
tggacaggactttctttattgagcc

SEQ ID NO: 147319 - DNA, 25 bp, Mus musculus
tggacaggatccaacagtagccttc

SEQ ID NO: 147320 - DNA, 25 bp, Mus musculus
tggacaggcctctccatggcttggg

SEQ ID NO: 147321 - DNA, 25 bp, Mus musculus
tggacagggctttacaagaaatgga

SEQ ID NO: 147322 - DNA, 25 bp, Mus musculus
tggacaggtcttaagccgcggcttc

SEQ ID NO: 147323 - DNA, 25 bp, Mus musculus
tggacagtaacagctcaaaccggtt

SEQ ID NO: 147324 - DNA, 25 bp, Mus musculus
tggacagtatcttcaacttctcgga

SEQ ID NO: 147325 - DNA, 25 bp, Mus musculus
tggacagtgacgaactagaaaggac

SEQ ID NO: 147326 - DNA, 25 bp, Mus musculus
tggacagtggtagaactcagagcct

SEQ ID NO: 147327 - DNA, 25 bp, Mus musculus
tggacatagcattcggcatcaactg

SEQ ID NO: 147328 - DNA, 25 bp, Mus musculus
tggacatcatcgatcctcgaacact

SEQ ID NO: 147329 - DNA, 25 bp, Mus musculus
tggacatccgtgatcgggagctgaa

SEQ ID NO: 147330 - DNA, 25 bp, Mus musculus
tggacatctacccttcgagccggga

SEQ ID NO: 147331 - DNA, 25 bp, Mus musculus
tggacatctcagaaccacccgtgac

SEQ ID NO: 147332 - DNA, 25 bp, Mus musculus
tggacatcttcacagcccagtggca

SEQ ID NO: 147333 - DNA, 25 bp, Mus musculus
tggacatgaccaggctcagtgctga

SEQ ID NO: 147334 - DNA, 25 bp, Mus musculus
tggacatgccaagtgataagcaagc

SEQ ID NO: 147335 - DNA, 25 bp, Mus musculus
tggacatggcggtcgcagggagctg

SEQ ID NO: 147336 - DNA, 25 bp, Mus musculus
tggacatggtggagtctgctacaac

SEQ ID NO: 147337 - DNA, 25 bp, Mus musculus
tggacatgtccatactgccgggcat

SEQ ID NO: 147338 - DNA, 25 bp, Mus musculus
tggacatgtcccgaaaatcacaaga

SEQ ID NO: 147339 - DNA, 25 bp, Mus musculus
tggacattaattcaacaccggaaag

SEQ ID NO: 147340 - DNA, 25 bp, Mus musculus
tggacattccaagagctggctggac

SEQ ID NO: 147341 - DNA, 25 bp, Mus musculus
tggacattccgaagggtcagccctg

SEQ ID NO: 147342 - DNA, 25 bp, Mus musculus
tggacattcttatctcaggacacac

SEQ ID NO: 147343 - DNA, 25 bp, Mus musculus
tggacattggatctggacatgacac

SEQ ID NO: 147344 - DNA, 25 bp, Mus musculus
tggacattgtgcaccaggtcgccat

SEQ ID NO: 147345 - DNA, 25 bp, Mus musculus
tggaccaaaaactgacctacacatg

SEQ ID NO: 147346 - DNA, 25 bp, Mus musculus
tggaccaaaattgccaccaagatgg

SEQ ID NO: 147347 - DNA, 25 bp, Mus musculus
tggaccaaattcattctagctcggg

SEQ ID NO: 147348 - DNA, 25 bp, Mus musculus
tggaccaacaggcaaagatcttatg

SEQ ID NO: 147349 - DNA, 25 bp, Mus musculus
tggaccaacttgaaactgcagaccc

SEQ ID NO: 147350 - DNA, 25 bp, Mus musculus
tggaccaagagttctcccggaggct

SEQ ID NO: 147351 - DNA, 25 bp, Mus musculus
tggaccaagcagtaagcagacagca

SEQ ID NO: 147352 - DNA, 25 bp, Mus musculus
tggaccaatcgaatacaaaggcccc

SEQ ID NO: 147353 - DNA, 25 bp, Mus musculus
tggaccaatcgaggaacccctgtga

SEQ ID NO: 147354 - DNA, 25 bp, Mus musculus
tggaccacatgaaaaccctgctgct

SEQ ID NO: 147355 - DNA, 25 bp, Mus musculus
tggaccaccccaggatagtgaagct

SEQ ID NO: 147356 - DNA, 25 bp, Mus musculus
tggaccacgtcattgcgaaggagct

SEQ ID NO: 147357 - DNA, 25 bp, Mus musculus
tggaccactggagaaaaggaagacg

SEQ ID NO: 147358 - DNA, 25 bp, Mus musculus
tggaccactgggaacatctctgact

SEQ ID NO: 147359 - DNA, 25 bp, Mus musculus
tggaccagactacgaactttgagga

SEQ ID NO: 147360 - DNA, 25 bp, Mus musculus
tggaccagaggttgacaagcacgcg

SEQ ID NO: 147361 - DNA, 25 bp, Mus musculus
tggaccagctcatgggcacggctcg

SEQ ID NO: 147362 - DNA, 25 bp, Mus musculus
tggaccaggagaaccaagatccgag

SEQ ID NO: 147363 - DNA, 25 bp, Mus musculus
tggaccaggcgagctcaggaatttc

SEQ ID NO: 147364 - DNA, 25 bp, Mus musculus
tggaccataacgtgaagaagccttc

SEQ ID NO: 147365 - DNA, 25 bp, Mus musculus
tggaccatctatgcctatgacagag

SEQ ID NO: 147366 - DNA, 25 bp, Mus musculus
tggaccatgcagtgtacaagctgtg

SEQ ID NO: 147367 - DNA, 25 bp, Mus musculus
tggaccatggtacaagaactgcctt

SEQ ID NO: 147368 - DNA, 25 bp, Mus musculus
tggaccatggtcagggacggacttc

SEQ ID NO: 147369 - DNA, 25 bp, Mus musculus
tggaccatggttctgaagttcgttc

SEQ ID NO: 147370 - DNA, 25 bp, Mus musculus
tggacccaaactctatccccaagga

SEQ ID NO: 147371 - DNA, 25 bp, Mus musculus
tggacccaagaaggcaagaattatt

SEQ ID NO: 147372 - DNA, 25 bp, Mus musculus
tggacccaagaaggcgggctctctg

SEQ ID NO: 147373 - DNA, 25 bp, Mus musculus
tggacccacagtcggccagtggata

SEQ ID NO: 147374 - DNA, 25 bp, Mus musculus
tggacccaccgcaggaaataaatga

SEQ ID NO: 147375 - DNA, 25 bp, Mus musculus
tggacccagcggtactttgatagct

SEQ ID NO: 147376 - DNA, 25 bp, Mus musculus
tggacccaggccaagccaaggagtt

SEQ ID NO: 147377 - DNA, 25 bp, Mus musculus
tggacccagtttatgagacgctgcg

SEQ ID NO: 147378 - DNA, 25 bp, Mus musculus
tggaccccaaggatgcgtcgatact

SEQ ID NO: 147379 - DNA, 25 bp, Mus musculus
tggaccccactaagcagtacaaggt

SEQ ID NO: 147380 - DNA, 25 bp, Mus musculus
tggaccccatggctgataggaaact

SEQ ID NO: 147381 - DNA, 25 bp, Mus musculus
tggaccccgatgacacctacaatga

SEQ ID NO: 147382 - DNA, 25 bp, Mus musculus
tggaccccgcagcatgactgtcaag

SEQ ID NO: 147383 - DNA, 25 bp, Mus musculus
tggaccccgctcatggaggatggct

SEQ ID NO: 147384 - DNA, 25 bp, Mus musculus
tggaccccgggagaatccgcgttga

SEQ ID NO: 147385 - DNA, 25 bp, Mus musculus
tggaccccgtgaaggacatgctgat

SEQ ID NO: 147386 - DNA, 25 bp, Mus musculus
tggacccctagtgcagagacctcat

SEQ ID NO: 147387 - DNA, 25 bp, Mus musculus
tggacccctatgaacgagagcagct

SEQ ID NO: 147388 - DNA, 25 bp, Mus musculus
tggacccctatgttaagaagctgct

SEQ ID NO: 147389 - DNA, 25 bp, Mus musculus
tggacccctcgcagacagactttta

SEQ ID NO: 147390 - DNA, 25 bp, Mus musculus
tggacccctggctataccagcatcg

SEQ ID NO: 147391 - DNA, 25 bp, Mus musculus
tggacccctgggatcctgaaggaga

SEQ ID NO: 147392 - DNA, 25 bp, Mus musculus
tggacccgaggctgcaactccgtgg

SEQ ID NO: 147393 - DNA, 25 bp, Mus musculus
tggacccgcagatggcagagcgcac

SEQ ID NO: 147394 - DNA, 25 bp, Mus musculus
tggacccgggcgttgtggacaactt

SEQ ID NO: 147395 - DNA, 25 bp, Mus musculus
tggacccgtctcagctgcttgtgga

SEQ ID NO: 147396 - DNA, 25 bp, Mus musculus
tggaccctctcagcaaatgacatgg

SEQ ID NO: 147397 - DNA, 25 bp, Mus musculus
tggaccctgacaaagtacctgaact

SEQ ID NO: 147398 - DNA, 25 bp, Mus musculus
tggaccctgatgtggagtatgagat

SEQ ID NO: 147399 - DNA, 25 bp, Mus musculus
tggacccttcacagagacctttggg

SEQ ID NO: 147400 - DNA, 25 bp, Mus musculus
tggaccctttccagaagagtctgta

SEQ ID NO: 147401 - DNA, 25 bp, Mus musculus
tggaccgcgagcaactggtgcagaa

SEQ ID NO: 147402 - DNA, 25 bp, Mus musculus
tggaccggcaggtgatacccatcat

SEQ ID NO: 147403 - DNA, 25 bp, Mus musculus
tggaccggcattacctacttcgtgg

SEQ ID NO: 147404 - DNA, 25 bp, Mus musculus
tggaccgtaaccctcgcttgcaatg

SEQ ID NO: 147405 - DNA, 25 bp, Mus musculus
tggaccgtgacattatacctgcttg

SEQ ID NO: 147406 - DNA, 25 bp, Mus musculus
tggaccgtgccctagaatttgcccc

SEQ ID NO: 147407 - DNA, 25 bp, Mus musculus
tggaccgtgtcttcggattgccccg

SEQ ID NO: 147408 - DNA, 25 bp, Mus musculus
tggacctaagcatgggcctgtcgag

SEQ ID NO: 147409 - DNA, 25 bp, Mus musculus
tggacctatctttgacttacacggg

SEQ ID NO: 147410 - DNA, 25 bp, Mus musculus
tggacctcaataagccaggccttta

SEQ ID NO: 147411 - DNA, 25 bp, Mus musculus
tggacctcagcttcctgacagagga

SEQ ID NO: 147412 - DNA, 25 bp, Mus musculus
tggacctcagttccccttcaaaggg

SEQ ID NO: 147413 - DNA, 25 bp, Mus musculus
tggacctcgctgaggtgaagcctct

SEQ ID NO: 147414 - DNA, 25 bp, Mus musculus
tggacctcggctacgaaatatggct

SEQ ID NO: 147415 - DNA, 25 bp, Mus musculus
tggacctctatttgatgcactggcc

SEQ ID NO: 147416 - DNA, 25 bp, Mus musculus
tggacctgagatccccacaggatgt

SEQ ID NO: 147417 - DNA, 25 bp, Mus musculus
tggacctgcccagcgagacggatct

SEQ ID NO: 147418 - DNA, 25 bp, Mus musculus
tggacctgcgctggcagatccatca

SEQ ID NO: 147419 - DNA, 25 bp, Mus musculus
tggacctgctggatcaccgaatgac

SEQ ID NO: 147420 - DNA, 25 bp, Mus musculus
tggacctgcttgataccccttctgg

SEQ ID NO: 147421 - DNA, 25 bp, Mus musculus
tggacctggacaagggctgcaccgt

SEQ ID NO: 147422 - DNA, 25 bp, Mus musculus
tggacctggatgtgccgtactttgc

SEQ ID NO: 147423 - DNA, 25 bp, Mus musculus
tggacctggtccacgaggaggaaaa

SEQ ID NO: 147424 - DNA, 25 bp, Mus musculus
tggacctggttatcaactgcctgga

SEQ ID NO: 147425 - DNA, 25 bp, Mus musculus
tggacctgtggaagctctcctcatg

SEQ ID NO: 147426 - DNA, 25 bp, Mus musculus
tggacctgtgtacccaatcctgcga

SEQ ID NO: 147427 - DNA, 25 bp, Mus musculus
tggaccttctcttcagctgtgacag

SEQ ID NO: 147428 - DNA, 25 bp, Mus musculus
tggaccttgtaaaaactgcaaaatg

SEQ ID NO: 147429 - DNA, 25 bp, Mus musculus
tggaccttgtcacattcctagtgct

SEQ ID NO: 147430 - DNA, 25 bp, Mus musculus
tggaccttgtgaacctgctgctgac

SEQ ID NO: 147431 - DNA, 25 bp, Mus musculus
tggacgaacgctctgaatcatcttg

SEQ ID NO: 147432 - DNA, 25 bp, Mus musculus
tggacgaagtagtagcctcagctgc

SEQ ID NO: 147433 - DNA, 25 bp, Mus musculus
tggacgaatatgacgagaacagttc

SEQ ID NO: 147434 - DNA, 25 bp, Mus musculus
tggacgaatccaacgaccatgtgct

SEQ ID NO: 147435 - DNA, 25 bp, Mus musculus
tggacgacctgttccggaattcgga

SEQ ID NO: 147436 - DNA, 25 bp, Mus musculus
tggacgacgccaagatcattgacgg

SEQ ID NO: 147437 - DNA, 25 bp, Mus musculus
tggacgagacaagtatgagcctgcc

SEQ ID NO: 147438 - DNA, 25 bp, Mus musculus
tggacgagcaactagccctggagct

SEQ ID NO: 147439 - DNA, 25 bp, Mus musculus
tggacgagctcaaatgccgcaagcg

SEQ ID NO: 147440 - DNA, 25 bp, Mus musculus
tggacgaggacaacctagagactgc

SEQ ID NO: 147441 - DNA, 25 bp, Mus musculus
tggacgaggtcgtgtccagcaacgt

SEQ ID NO: 147442 - DNA, 25 bp, Mus musculus
tggacgagtttatggcctggcagca

SEQ ID NO: 147443 - DNA, 25 bp, Mus musculus
tggacgatgtccaggagaaacctaa

SEQ ID NO: 147444 - DNA, 25 bp, Mus musculus
tggacgcaggcaacatcaagctgac

SEQ ID NO: 147445 - DNA, 25 bp, Mus musculus
tggacgccaaggtcgtcgccgtgct

SEQ ID NO: 147446 - DNA, 25 bp, Mus musculus
tggacgccaccgataaaagatgacc

SEQ ID NO: 147447 - DNA, 25 bp, Mus musculus
tggacgccattagcctgacaactga

SEQ ID NO: 147448 - DNA, 25 bp, Mus musculus
tggacgccgccagctgagaattaga

SEQ ID NO: 147449 - DNA, 25 bp, Mus musculus
tggacgctgtagtgcatgagattca

SEQ ID NO: 147450 - DNA, 25 bp, Mus musculus
tggacgctgtcatcgccagtgctgg

SEQ ID NO: 147451 - DNA, 25 bp, Mus musculus
tggacggccccaccaatctttggtt

SEQ ID NO: 147452 - DNA, 25 bp, Mus musculus
tggacgggtaacaaaagcagactct

SEQ ID NO: 147453 - DNA, 25 bp, Mus musculus
tggacggtgcaagcaggcgttctac

SEQ ID NO: 147454 - DNA, 25 bp, Mus musculus
tggacggttcctcattggcgcctac

SEQ ID NO: 147455 - DNA, 25 bp, Mus musculus
tggacggtttccctttgttgagaag

SEQ ID NO: 147456 - DNA, 25 bp, Mus musculus
tggacgtacagctggtccctcagga

SEQ ID NO: 147457 - DNA, 25 bp, Mus musculus
tggacgtcactcgaagggccgttgc

SEQ ID NO: 147458 - DNA, 25 bp, Mus musculus
tggacgtccagttcgatgagggatt

SEQ ID NO: 147459 - DNA, 25 bp, Mus musculus
tggacgtcgaaagtcccgccgagta

SEQ ID NO: 147460 - DNA, 25 bp, Mus musculus
tggactaacaatgaggccaaagact

SEQ ID NO: 147461 - DNA, 25 bp, Mus musculus
tggactaaggtcactagcccaggct

SEQ ID NO: 147462 - DNA, 25 bp, Mus musculus
tggactacagctagcacagggaatt

SEQ ID NO: 147463 - DNA, 25 bp, Mus musculus
tggactacaggctgtcccggaagga

SEQ ID NO: 147464 - DNA, 25 bp, Mus musculus
tggactaccatgagatcggccgctc

SEQ ID NO: 147465 - DNA, 25 bp, Mus musculus
tggactacgaacgacccaacgttga

SEQ ID NO: 147466 - DNA, 25 bp, Mus musculus
tggactacgcagcttctatggacag

SEQ ID NO: 147467 - DNA, 25 bp, Mus musculus
tggactacttctggtaccgagagac

SEQ ID NO: 147468 - DNA, 25 bp, Mus musculus
tggactagagctacctgaggagatc

SEQ ID NO: 147469 - DNA, 25 bp, Mus musculus
tggactagcacccagcactgagaac

SEQ ID NO: 147470 - DNA, 25 bp, Mus musculus
tggactagccacaacagggttaacg

SEQ ID NO: 147471 - DNA, 25 bp, Mus musculus
tggactaggccacggcgtgacaaaa

SEQ ID NO: 147472 - DNA, 25 bp, Mus musculus
tggactataccctgaaaccatgggc

SEQ ID NO: 147473 - DNA, 25 bp, Mus musculus
tggactatatcatccgcagccatga

SEQ ID NO: 147474 - DNA, 25 bp, Mus musculus
tggactatggttttgcagccccaca

SEQ ID NO: 147475 - DNA, 25 bp, Mus musculus
tggactattcatgccagacctgggt

SEQ ID NO: 147476 - DNA, 25 bp, Mus musculus
tggactcaaaggcagtgaaggcccc

SEQ ID NO: 147477 - DNA, 25 bp, Mus musculus
tggactcagacatacgaagaagctt

SEQ ID NO: 147478 - DNA, 25 bp, Mus musculus
tggactcagcgcctctaaatgttac

SEQ ID NO: 147479 - DNA, 25 bp, Mus musculus
tggactcagtgaagcccttggaaaa

SEQ ID NO: 147480 - DNA, 25 bp, Mus musculus
tggactccacaattctcctagaggg

SEQ ID NO: 147481 - DNA, 25 bp, Mus musculus
tggactccacgatgttcaacaaagg

SEQ ID NO: 147482 - DNA, 25 bp, Mus musculus
tggactccagtctgaactcctcagt

SEQ ID NO: 147483 - DNA, 25 bp, Mus musculus
tggactcccgtcttaccaagtttgt

SEQ ID NO: 147484 - DNA, 25 bp, Mus musculus
tggactccgagtgaagctttagctt

SEQ ID NO: 147485 - DNA, 25 bp, Mus musculus
tggactcctgcttcgaggtggaccg

SEQ ID NO: 147486 - DNA, 25 bp, Mus musculus
tggactcgctacagaagcaggaact

SEQ ID NO: 147487 - DNA, 25 bp, Mus musculus
tggactctcagaagcacatcgactt

SEQ ID NO: 147488 - DNA, 25 bp, Mus musculus
tggactctcccaactacaagctctg

SEQ ID NO: 147489 - DNA, 25 bp, Mus musculus
tggactctccggtcactcaggacat

SEQ ID NO: 147490 - DNA, 25 bp, Mus musculus
tggactctgaggagcaccagactgt

SEQ ID NO: 147491 - DNA, 25 bp, Mus musculus
tggactctgcgcaatctctcggatg

SEQ ID NO: 147492 - DNA, 25 bp, Mus musculus
tggactctgctgtggcgtcttggcc

SEQ ID NO: 147493 - DNA, 25 bp, Mus musculus
tggactctgcttggtggtggacact

SEQ ID NO: 147494 - DNA, 25 bp, Mus musculus
tggactcttgtctatcagtgtgacc

SEQ ID NO: 147495 - DNA, 25 bp, Mus musculus
tggactgaaagagccggattcctca

SEQ ID NO: 147496 - DNA, 25 bp, Mus musculus
tggactgaaagcacagcctggccat

SEQ ID NO: 147497 - DNA, 25 bp, Mus musculus
tggactgaagccagcatagccacct

SEQ ID NO: 147498 - DNA, 25 bp, Mus musculus
tggactgacacgcactacgtgggac

SEQ ID NO: 147499 - DNA, 25 bp, Mus musculus
tggactgaccaagctacggactgac

SEQ ID NO: 147500 - DNA, 25 bp, Mus musculus
tggactgagcccctatgtgaagttc

SEQ ID NO: 147501 - DNA, 25 bp, Mus musculus
tggactgatgacgacctggtagatt

SEQ ID NO: 147502 - DNA, 25 bp, Mus musculus
tggactgcaaaactcccactggagc

SEQ ID NO: 147503 - DNA, 25 bp, Mus musculus
tggactgcattgtcaattcacaccg

SEQ ID NO: 147504 - DNA, 25 bp, Mus musculus
tggactggacaagaatgcaacctca

SEQ ID NO: 147505 - DNA, 25 bp, Mus musculus
tggactggcacagcgacgatgaacc

SEQ ID NO: 147506 - DNA, 25 bp, Mus musculus
tggactggcctgagtcccatgctga

SEQ ID NO: 147507 - DNA, 25 bp, Mus musculus
tggactgtatgtaccccgtggaata

SEQ ID NO: 147508 - DNA, 25 bp, Mus musculus
tggactgtcagtgtcaggcgctcag

SEQ ID NO: 147509 - DNA, 25 bp, Mus musculus
tggactgtccatgtgttctcacgga

SEQ ID NO: 147510 - DNA, 25 bp, Mus musculus
tggactgtctctgggcctgcttaga

SEQ ID NO: 147511 - DNA, 25 bp, Mus musculus
tggactgtgacttcaaaggcatggc

SEQ ID NO: 147512 - DNA, 25 bp, Mus musculus
tggactgtgagatgtatgggcttac

SEQ ID NO: 147513 - DNA, 25 bp, Mus musculus
tggacttaaactagcaatgcctgtg

SEQ ID NO: 147514 - DNA, 25 bp, Mus musculus
tggacttaactttctttacagagac

SEQ ID NO: 147515 - DNA, 25 bp, Mus musculus
tggacttaggctggactgtgacacc

SEQ ID NO: 147516 - DNA, 25 bp, Mus musculus
tggacttatcacttggacctcgggt

SEQ ID NO: 147517 - DNA, 25 bp, Mus musculus
tggacttcagtaagccagtgtctgc

SEQ ID NO: 147518 - DNA, 25 bp, Mus musculus
tggacttcatctggttattcaaacg

SEQ ID NO: 147519 - DNA, 25 bp, Mus musculus
tggacttccagatcttcaagaaccg

SEQ ID NO: 147520 - DNA, 25 bp, Mus musculus
tggacttccgcatgcagctggttcg

SEQ ID NO: 147521 - DNA, 25 bp, Mus musculus
tggacttcctggcacaaaagggacg

SEQ ID NO: 147522 - DNA, 25 bp, Mus musculus
tggacttgactcacctacggcagag

SEQ ID NO: 147523 - DNA, 25 bp, Mus musculus
tggacttggcatatctcggctcccc

SEQ ID NO: 147524 - DNA, 25 bp, Mus musculus
tggacttgggaaacctgaagccacg

SEQ ID NO: 147525 - DNA, 25 bp, Mus musculus
tggacttttacatccacgagtcggt

SEQ ID NO: 147526 - DNA, 25 bp, Mus musculus
tggacttttgcaatcagagataaca

SEQ ID NO: 147527 - DNA, 25 bp, Mus musculus
tggagaaaagcacccgagaaactga

SEQ ID NO: 147528 - DNA, 25 bp, Mus musculus
tggagaaaccacttgctctagagcc

SEQ ID NO: 147529 - DNA, 25 bp, Mus musculus
tggagaaacccatgtccaggagcag

SEQ ID NO: 147530 - DNA, 25 bp, Mus musculus
tggagaaaccgatcaggattttcaa

SEQ ID NO: 147531 - DNA, 25 bp, Mus musculus
tggagaaaggcgaccgagcatacct

SEQ ID NO: 147532 - DNA, 25 bp, Mus musculus
tggagaaatttacgatgccttggac

SEQ ID NO: 147533 - DNA, 25 bp, Mus musculus
tggagaacaagacaccagcatcgag

SEQ ID NO: 147534 - DNA, 25 bp, Mus musculus
tggagaacacccagtttgacgcggc

SEQ ID NO: 147535 - DNA, 25 bp, Mus musculus
tggagaacatactgacctacaggcg

SEQ ID NO: 147536 - DNA, 25 bp, Mus musculus
tggagaacccaatcctgtcaatagt

SEQ ID NO: 147537 - DNA, 25 bp, Mus musculus
tggagaacccagaacacaatgactt

SEQ ID NO: 147538 - DNA, 25 bp, Mus musculus
tggagaacctcaacaaggccttgac

SEQ ID NO: 147539 - DNA, 25 bp, Mus musculus
tggagaacctggaagcagataccag

SEQ ID NO: 147540 - DNA, 25 bp, Mus musculus
tggagaacgctacctcagagatgac

SEQ ID NO: 147541 - DNA, 25 bp, Mus musculus
tggagaacgtcacatctgcctttgc

SEQ ID NO: 147542 - DNA, 25 bp, Mus musculus
tggagaacgtcgtggacaccattct

SEQ ID NO: 147543 - DNA, 25 bp, Mus musculus
tggagaactaagacacccgtgctga

SEQ ID NO: 147544 - DNA, 25 bp, Mus musculus
tggagaactccttgcgaagaacttg

SEQ ID NO: 147545 - DNA, 25 bp, Mus musculus
tggagaacttagtgcgagcaggcct

SEQ ID NO: 147546 - DNA, 25 bp, Mus musculus
tggagaagatcaactacactggccg

SEQ ID NO: 147547 - DNA, 25 bp, Mus musculus
tggagaagatccagcctcgggtcat

SEQ ID NO: 147548 - DNA, 25 bp, Mus musculus
tggagaagatctaccccgaggagct

SEQ ID NO: 147549 - DNA, 25 bp, Mus musculus
tggagaagcaactgccactaggctc

SEQ ID NO: 147550 - DNA, 25 bp, Mus musculus
tggagaagcgtctgtcggaagactc

SEQ ID NO: 147551 - DNA, 25 bp, Mus musculus
tggagaaggaaattgcagctctgaa

SEQ ID NO: 147552 - DNA, 25 bp, Mus musculus
tggagaaggcaacaacatacctaat

SEQ ID NO: 147553 - DNA, 25 bp, Mus musculus
tggagaaggcagtctaccagggtcc

SEQ ID NO: 147554 - DNA, 25 bp, Mus musculus
tggagaaggcgcagtcagaactgtc

SEQ ID NO: 147555 - DNA, 25 bp, Mus musculus
tggagaaggcgtacatcaaggactg

SEQ ID NO: 147556 - DNA, 25 bp, Mus musculus
tggagaaggctccatgctcacaggc

SEQ ID NO: 147557 - DNA, 25 bp, Mus musculus
tggagaagtatagcagtctggtttc

SEQ ID NO: 147558 - DNA, 25 bp, Mus musculus
tggagaagtctccatgtgccagcac

SEQ ID NO: 147559 - DNA, 25 bp, Mus musculus
tggagaagtgtacccaagatcttgg

SEQ ID NO: 147560 - DNA, 25 bp, Mus musculus
tggagaagttcaacgccctgcacgt

SEQ ID NO: 147561 - DNA, 25 bp, Mus musculus
tggagaagtttcgaaaggagcagat

SEQ ID NO: 147562 - DNA, 25 bp, Mus musculus
tggagaagtttctgacgtggagatc

SEQ ID NO: 147563 - DNA, 25 bp, Mus musculus
tggagaatacatggctggacagctt

SEQ ID NO: 147564 - DNA, 25 bp, Mus musculus
tggagaatactaacccgctggactg

SEQ ID NO: 147565 - DNA, 25 bp, Mus musculus
tggagaatcacaagatatcagcccc

SEQ ID NO: 147566 - DNA, 25 bp, Mus musculus
tggagaatcaccacatcagctctgt

SEQ ID NO: 147567 - DNA, 25 bp, Mus musculus
tggagaatccaatgctggaaacagc

SEQ ID NO: 147568 - DNA, 25 bp, Mus musculus
tggagaatccagtacagcagggcaa

SEQ ID NO: 147569 - DNA, 25 bp, Mus musculus
tggagaatcttaaccaagtggcaca

SEQ ID NO: 147570 - DNA, 25 bp, Mus musculus
tggagacacaggacgactatgagcc

SEQ ID NO: 147571 - DNA, 25 bp, Mus musculus
tggagacacattcagcatgaacagg

SEQ ID NO: 147572 - DNA, 25 bp, Mus musculus
tggagacactaagctgacacttggg

SEQ ID NO: 147573 - DNA, 25 bp, Mus musculus
tggagacagacttgaaggccttgac

SEQ ID NO: 147574 - DNA, 25 bp, Mus musculus
tggagacagcccgaactctgaagga

SEQ ID NO: 147575 - DNA, 25 bp, Mus musculus
tggagacagccctctgttcctgtgc

SEQ ID NO: 147576 - DNA, 25 bp, Mus musculus
tggagacataccaggcacagaagct

SEQ ID NO: 147577 - DNA, 25 bp, Mus musculus
tggagacatttctacaggccagagt

SEQ ID NO: 147578 - DNA, 25 bp, Mus musculus
tggagaccaaacctgacaaggctgt

SEQ ID NO: 147579 - DNA, 25 bp, Mus musculus
tggagaccaccatgaaactgctgaa

SEQ ID NO: 147580 - DNA, 25 bp, Mus musculus
tggagaccatctctacagcaagggc

SEQ ID NO: 147581 - DNA, 25 bp, Mus musculus
tggagacccagcaaagagagtgagt

SEQ ID NO: 147582 - DNA, 25 bp, Mus musculus
tggagacccagtggccaatatggca

SEQ ID NO: 147583 - DNA, 25 bp, Mus musculus
tggagaccccagaccacctgtatgt

SEQ ID NO: 147584 - DNA, 25 bp, Mus musculus
tggagacccgagaatccacagagtc

SEQ ID NO: 147585 - DNA, 25 bp, Mus musculus
tggagacctcagaagcagagcttgt

SEQ ID NO: 147586 - DNA, 25 bp, Mus musculus
tggagacctgccactttcaagcctt

SEQ ID NO: 147587 - DNA, 25 bp, Mus musculus
tggagacctgtggaactgccacgac

SEQ ID NO: 147588 - DNA, 25 bp, Mus musculus
tggagaccttcttgcaacaggagac

SEQ ID NO: 147589 - DNA, 25 bp, Mus musculus
tggagaccttgaatgaaagccgcct

SEQ ID NO: 147590 - DNA, 25 bp, Mus musculus
tggagacgcccatccagcgcgaaat

SEQ ID NO: 147591 - DNA, 25 bp, Mus musculus
tggagacgctgaacctgcagaacaa

SEQ ID NO: 147592 - DNA, 25 bp, Mus musculus
tggagacggacgtgaagcagctaca

SEQ ID NO: 147593 - DNA, 25 bp, Mus musculus
tggagacggcgtcctgctccacctt

SEQ ID NO: 147594 - DNA, 25 bp, Mus musculus
tggagacgtgtctgcaacatcaacg

SEQ ID NO: 147595 - DNA, 25 bp, Mus musculus
tggagactcgagtgttcctgcagta

SEQ ID NO: 147596 - DNA, 25 bp, Mus musculus
tggagactgcagaagacttgtaaat

SEQ ID NO: 147597 - DNA, 25 bp, Mus musculus
tggagagaaagcatccgagagcagc

SEQ ID NO: 147598 - DNA, 25 bp, Mus musculus
tggagagaagccacacttgtgtgac

SEQ ID NO: 147599 - DNA, 25 bp, Mus musculus
tggagagaatcaacaacattataca

SEQ ID NO: 147600 - DNA, 25 bp, Mus musculus
tggagagaattatgcacctgacagc

SEQ ID NO: 147601 - DNA, 25 bp, Mus musculus
tggagagacagtctttcccagggaa

SEQ ID NO: 147602 - DNA, 25 bp, Mus musculus
tggagagaccagcaacacacatgga

SEQ ID NO: 147603 - DNA, 25 bp, Mus musculus
tggagagactaattcccacagtccc

SEQ ID NO: 147604 - DNA, 25 bp, Mus musculus
tggagagagctcatacagagcttgc

SEQ ID NO: 147605 - DNA, 25 bp, Mus musculus
tggagagatggctatggaacaccgc

SEQ ID NO: 147606 - DNA, 25 bp, Mus musculus
tggagagcagctccctgtatttaac

SEQ ID NO: 147607 - DNA, 25 bp, Mus musculus
tggagagcagtgtgaaacccacctt

SEQ ID NO: 147608 - DNA, 25 bp, Mus musculus
tggagagcccctgctggcaaatgac

SEQ ID NO: 147609 - DNA, 25 bp, Mus musculus
tggagagccttcagtactgcttcct

SEQ ID NO: 147610 - DNA, 25 bp, Mus musculus
tggagagctctttcctgtggcctca

SEQ ID NO: 147611 - DNA, 25 bp, Mus musculus
tggagagctgtaccgtcgaaagccc

SEQ ID NO: 147612 - DNA, 25 bp, Mus musculus
tggagaggccgctgaactggctact

SEQ ID NO: 147613 - DNA, 25 bp, Mus musculus
tggagaggtgatccccacccttttt

SEQ ID NO: 147614 - DNA, 25 bp, Mus musculus
tggagagtacccactgacagctatg

SEQ ID NO: 147615 - DNA, 25 bp, Mus musculus
tggagagtacctgaaggcactcaag

SEQ ID NO: 147616 - DNA, 25 bp, Mus musculus
tggagagtgcagaagacgttagccc

SEQ ID NO: 147617 - DNA, 25 bp, Mus musculus
tggagataatgacgtcaccccgtgc

SEQ ID NO: 147618 - DNA, 25 bp, Mus musculus
tggagatacaccacaccaatgtgag

SEQ ID NO: 147619 - DNA, 25 bp, Mus musculus
tggagataccacacacaccctggtg

SEQ ID NO: 147620 - DNA, 25 bp, Mus musculus
tggagatagcaaactcgaaagcttc

SEQ ID NO: 147621 - DNA, 25 bp, Mus musculus
tggagatcaagaagccgagtggccc

SEQ ID NO: 147622 - DNA, 25 bp, Mus musculus
tggagatcaccttcagctactggga

SEQ ID NO: 147623 - DNA, 25 bp, Mus musculus
tggagatcagcgctgtgcactcacg

SEQ ID NO: 147624 - DNA, 25 bp, Mus musculus
tggagatcattgctggcatcctggc

SEQ ID NO: 147625 - DNA, 25 bp, Mus musculus
tggagatcgaaaggcctatactggg

SEQ ID NO: 147626 - DNA, 25 bp, Mus musculus
tggagatcgacacgcccaaagtaga

SEQ ID NO: 147627 - DNA, 25 bp, Mus musculus
tggagatgacttgattgtgaccccg

SEQ ID NO: 147628 - DNA, 25 bp, Mus musculus
tggagatgcaggagagccatggaga

SEQ ID NO: 147629 - DNA, 25 bp, Mus musculus
tggagatgctcattcagctgccagc

SEQ ID NO: 147630 - DNA, 25 bp, Mus musculus
tggagatgcttctccaccaccaggc

SEQ ID NO: 147631 - DNA, 25 bp, Mus musculus
tggagatggagatatcacccgccca

SEQ ID NO: 147632 - DNA, 25 bp, Mus musculus
tggagatggccaagttccgatacat

SEQ ID NO: 147633 - DNA, 25 bp, Mus musculus
tggagatgtactgcgaagagccctt

SEQ ID NO: 147634 - DNA, 25 bp, Mus musculus
tggagattaaccctgactacgctgc

SEQ ID NO: 147635 - DNA, 25 bp, Mus musculus
tggagattactaagcacgcagtgga

SEQ ID NO: 147636 - DNA, 25 bp, Mus musculus
tggagattcacctctaagctgcttg

SEQ ID NO: 147637 - DNA, 25 bp, Mus musculus
tggagattgtatacgcctcgctggg

SEQ ID NO: 147638 - DNA, 25 bp, Mus musculus
tggagatttcaactggataatacca

SEQ ID NO: 147639 - DNA, 25 bp, Mus musculus
tggagcaaactgtcccctgaaacaa

SEQ ID NO: 147640 - DNA, 25 bp, Mus musculus
tggagcaaatggctcccctggaccc

SEQ ID NO: 147641 - DNA, 25 bp, Mus musculus
tggagcaagagttacagctcagacc

SEQ ID NO: 147642 - DNA, 25 bp, Mus musculus
tggagcaattcaacatggagagccc

SEQ ID NO: 147643 - DNA, 25 bp, Mus musculus
tggagcacctacagcctgcgtactg

SEQ ID NO: 147644 - DNA, 25 bp, Mus musculus
tggagcacctacctttggcagtcag

SEQ ID NO: 147645 - DNA, 25 bp, Mus musculus
tggagcactacctagacaagcatga

SEQ ID NO: 147646 - DNA, 25 bp, Mus musculus
tggagcactggctgaatcctcactg

SEQ ID NO: 147647 - DNA, 25 bp, Mus musculus
tggagcactgtacctcatggcagag

SEQ ID NO: 147648 - DNA, 25 bp, Mus musculus
tggagcagaacaacggacactactt

SEQ ID NO: 147649 - DNA, 25 bp, Mus musculus
tggagcagagcgtttgcgaacagct

SEQ ID NO: 147650 - DNA, 25 bp, Mus musculus
tggagcagcacactagtaaccctac

SEQ ID NO: 147651 - DNA, 25 bp, Mus musculus
tggagcagcaccgattcagacagct

SEQ ID NO: 147652 - DNA, 25 bp, Mus musculus
tggagcagccggagaacattgccac

SEQ ID NO: 147653 - DNA, 25 bp, Mus musculus
tggagcagtcaccttctagcagtaa

SEQ ID NO: 147654 - DNA, 25 bp, Mus musculus
tggagcagttcaatggccaagcgcc

SEQ ID NO: 147655 - DNA, 25 bp, Mus musculus
tggagcagttcacacacgctaagta

SEQ ID NO: 147656 - DNA, 25 bp, Mus musculus
tggagcatatgcgaacagtaaaagc

SEQ ID NO: 147657 - DNA, 25 bp, Mus musculus
tggagcatggagtcccaggcatctg

SEQ ID NO: 147658 - DNA, 25 bp, Mus musculus
tggagcattctttgccttggtcaga

SEQ ID NO: 147659 - DNA, 25 bp, Mus musculus
tggagccaacaaacatccagtcttg

SEQ ID NO: 147660 - DNA, 25 bp, Mus musculus
tggagccacatgtcacagcagtgtg

SEQ ID NO: 147661 - DNA, 25 bp, Mus musculus
tggagccagaactgtgccaaatact

SEQ ID NO: 147662 - DNA, 25 bp, Mus musculus
tggagccagcaccaacattctcagg

SEQ ID NO: 147663 - DNA, 25 bp, Mus musculus
tggagccattatggcacgcatcgcc

SEQ ID NO: 147664 - DNA, 25 bp, Mus musculus
tggagccatttgtccaccaggttgg

SEQ ID NO: 147665 - DNA, 25 bp, Mus musculus
tggagcccaccacgtgccaatgtct

SEQ ID NO: 147666 - DNA, 25 bp, Mus musculus
tggagcccagagaccaaacttgact

SEQ ID NO: 147667 - DNA, 25 bp, Mus musculus
tggagcccatgacttctgatcagga

SEQ ID NO: 147668 - DNA, 25 bp, Mus musculus
tggagccccagattgaggacctgat

SEQ ID NO: 147669 - DNA, 25 bp, Mus musculus
tggagccccgacattgagcagagtt

SEQ ID NO: 147670 - DNA, 25 bp, Mus musculus
tggagcccctaactcaggattctgt

SEQ ID NO: 147671 - DNA, 25 bp, Mus musculus
tggagcccgggttcagtcatctgca

SEQ ID NO: 147672 - DNA, 25 bp, Mus musculus
tggagccctgaagaaaccgagacaa

SEQ ID NO: 147673 - DNA, 25 bp, Mus musculus
tggagcccttcagatctatgcagac

SEQ ID NO: 147674 - DNA, 25 bp, Mus musculus
tggagccggaacagagacaacgagt

SEQ ID NO: 147675 - DNA, 25 bp, Mus musculus
tggagccggagcctacattctgtcg

SEQ ID NO: 147676 - DNA, 25 bp, Mus musculus
tggagcctcacaagcctgctgctgt

SEQ ID NO: 147677 - DNA, 25 bp, Mus musculus
tggagcctccgtgaaagttgcagtg

SEQ ID NO: 147678 - DNA, 25 bp, Mus musculus
tggagcctgcctgtaagagtcactt

SEQ ID NO: 147679 - DNA, 25 bp, Mus musculus
tggagcctggaatcccacagtgggc

SEQ ID NO: 147680 - DNA, 25 bp, Mus musculus
tggagcctggttctacttgtgccgt

SEQ ID NO: 147681 - DNA, 25 bp, Mus musculus
tggagcctttctccatgcccaggga

SEQ ID NO: 147682 - DNA, 25 bp, Mus musculus
tggagcgaccctgttacactaaaga

SEQ ID NO: 147683 - DNA, 25 bp, Mus musculus
tggagcgagccagcatggactacga

SEQ ID NO: 147684 - DNA, 25 bp, Mus musculus
tggagcgagcgagtcgagcggttgt

SEQ ID NO: 147685 - DNA, 25 bp, Mus musculus
tggagcgatttctggctcagctctc

SEQ ID NO: 147686 - DNA, 25 bp, Mus musculus
tggagcgccagatcagccaggatgt

SEQ ID NO: 147687 - DNA, 25 bp, Mus musculus
tggagcgccccaaaagttacattgc

SEQ ID NO: 147688 - DNA, 25 bp, Mus musculus
tggagcgccgactcagcaggctgaa

SEQ ID NO: 147689 - DNA, 25 bp, Mus musculus
tggagcgcgagaacaccctcctgaa

SEQ ID NO: 147690 - DNA, 25 bp, Mus musculus
tggagcggactgtcaaagaagtgct

SEQ ID NO: 147691 - DNA, 25 bp, Mus musculus
tggagcggcagcagatcagccagtt

SEQ ID NO: 147692 - DNA, 25 bp, Mus musculus
tggagcggtacctgcccttggagta

SEQ ID NO: 147693 - DNA, 25 bp, Mus musculus
tggagcgtggaaactacccggtcaa

SEQ ID NO: 147694 - DNA, 25 bp, Mus musculus
tggagcgtgtctacagccaacggag

SEQ ID NO: 147695 - DNA, 25 bp, Mus musculus
tggagcgttcgctgcctgagctgca

SEQ ID NO: 147696 - DNA, 25 bp, Mus musculus
tggagctaccgctgacaccatgttg

SEQ ID NO: 147697 - DNA, 25 bp, Mus musculus
tggagctcaagcacaagcaagatgc

SEQ ID NO: 147698 - DNA, 25 bp, Mus musculus
tggagctcagcaatagtcagaagag

SEQ ID NO: 147699 - DNA, 25 bp, Mus musculus
tggagctccaagaaggcgaagatga

SEQ ID NO: 147700 - DNA, 25 bp, Mus musculus
tggagctccacgaaggatccttaga

SEQ ID NO: 147701 - DNA, 25 bp, Mus musculus
tggagctcctgggtctcacaggcta

SEQ ID NO: 147702 - DNA, 25 bp, Mus musculus
tggagctccttttactacagactgg

SEQ ID NO: 147703 - DNA, 25 bp, Mus musculus
tggagctgagcgacaccatccaggt

SEQ ID NO: 147704 - DNA, 25 bp, Mus musculus
tggagctgccaaaaggactgatcac

SEQ ID NO: 147705 - DNA, 25 bp, Mus musculus
tggagcttacaacgccaaaatcggt

SEQ ID NO: 147706 - DNA, 25 bp, Mus musculus
tggagctttcaatctgaccacagga

SEQ ID NO: 147707 - DNA, 25 bp, Mus musculus
tggaggaactcaagcctagctctgg

SEQ ID NO: 147708 - DNA, 25 bp, Mus musculus
tggaggaacttaaccggcacctaag

SEQ ID NO: 147709 - DNA, 25 bp, Mus musculus
tggaggaagtctaggtaaaaaagtg

SEQ ID NO: 147710 - DNA, 25 bp, Mus musculus
tggaggacaagataaagcggcacac

SEQ ID NO: 147711 - DNA, 25 bp, Mus musculus
tggaggacaatgaaaccgttagctg

SEQ ID NO: 147712 - DNA, 25 bp, Mus musculus
tggaggacacaagccacctacttgc

SEQ ID NO: 147713 - DNA, 25 bp, Mus musculus
tggaggacactttgcagaactgccc

SEQ ID NO: 147714 - DNA, 25 bp, Mus musculus
tggaggacatcctatcccaggccta

SEQ ID NO: 147715 - DNA, 25 bp, Mus musculus
tggaggacatgtggaacttgcagcc

SEQ ID NO: 147716 - DNA, 25 bp, Mus musculus
tggaggaccgtaagtggcacagcat

SEQ ID NO: 147717 - DNA, 25 bp, Mus musculus
tggaggacctaattgaacagcagac

SEQ ID NO: 147718 - DNA, 25 bp, Mus musculus
tggaggaccttttcgacctgtgcga

SEQ ID NO: 147719 - DNA, 25 bp, Mus musculus
tggaggagaaactactgcctgtgct

SEQ ID NO: 147720 - DNA, 25 bp, Mus musculus
tggaggagaaccgaaacagcctgtt

SEQ ID NO: 147721 - DNA, 25 bp, Mus musculus
tggaggagaatgaccagctgatccg

SEQ ID NO: 147722 - DNA, 25 bp, Mus musculus
tggaggagcctatcctaactgccgc

SEQ ID NO: 147723 - DNA, 25 bp, Mus musculus
tggaggagctaccatagaagaacta

SEQ ID NO: 147724 - DNA, 25 bp, Mus musculus
tggaggaggaacacaacctactgtg

SEQ ID NO: 147725 - DNA, 25 bp, Mus musculus
tggaggagtaaagacagcgatgccc

SEQ ID NO: 147726 - DNA, 25 bp, Mus musculus
tggaggagtacagaactaccaccca

SEQ ID NO: 147727 - DNA, 25 bp, Mus musculus
tggaggcaacactgacaaaagctga

SEQ ID NO: 147728 - DNA, 25 bp, Mus musculus
tggaggcaactcacgaaataagtgc

SEQ ID NO: 147729 - DNA, 25 bp, Mus musculus
tggaggcaagacacatcaaagccga

SEQ ID NO: 147730 - DNA, 25 bp, Mus musculus
tggaggcagatagattatgtggttc

SEQ ID NO: 147731 - DNA, 25 bp, Mus musculus
tggaggcagcaccacagaagatcct

SEQ ID NO: 147732 - DNA, 25 bp, Mus musculus
tggaggcagcgtcaccaaaaagcgc

SEQ ID NO: 147733 - DNA, 25 bp, Mus musculus
tggaggcccacacaaatgatcttta

SEQ ID NO: 147734 - DNA, 25 bp, Mus musculus
tggaggcccagaacaagatcaagtc

SEQ ID NO: 147735 - DNA, 25 bp, Mus musculus
tggaggccccagaaatgatgagagc

SEQ ID NO: 147736 - DNA, 25 bp, Mus musculus
tggaggcccctggtgtctacgtgtt

SEQ ID NO: 147737 - DNA, 25 bp, Mus musculus
tggaggccctccaacaaggtgcttg

SEQ ID NO: 147738 - DNA, 25 bp, Mus musculus
tggaggccgccacctggattccgtt

SEQ ID NO: 147739 - DNA, 25 bp, Mus musculus
tggaggccgtaagcatgagtgccct

SEQ ID NO: 147740 - DNA, 25 bp, Mus musculus
tggaggccgtcaacgccaagtgttc

SEQ ID NO: 147741 - DNA, 25 bp, Mus musculus
tggaggcctcccagaaaaagtccct

SEQ ID NO: 147742 - DNA, 25 bp, Mus musculus
tggaggcctctgttaccgtaagaca

SEQ ID NO: 147743 - DNA, 25 bp, Mus musculus
tggaggccttctttgtgttccccat

SEQ ID NO: 147744 - DNA, 25 bp, Mus musculus
tggaggcggcactgcaagagtactt

SEQ ID NO: 147745 - DNA, 25 bp, Mus musculus
tggaggcggccaattgctctctgcg

SEQ ID NO: 147746 - DNA, 25 bp, Mus musculus
tggaggcggctactacttcagattc

SEQ ID NO: 147747 - DNA, 25 bp, Mus musculus
tggaggctgcgctatgacgtgtacc

SEQ ID NO: 147748 - DNA, 25 bp, Mus musculus
tggagggacggcttttcatgctgct

SEQ ID NO: 147749 - DNA, 25 bp, Mus musculus
tggagggaggaaccacacccagtat

SEQ ID NO: 147750 - DNA, 25 bp, Mus musculus
tggagggcaggatagacaattcttg

SEQ ID NO: 147751 - DNA, 25 bp, Mus musculus
tggagggcatcagcatttggtcagc

SEQ ID NO: 147752 - DNA, 25 bp, Mus musculus
tggagggtcagcaacaaggccatct

SEQ ID NO: 147753 - DNA, 25 bp, Mus musculus
tggagggtggcacaaacaaacaaac

SEQ ID NO: 147754 - DNA, 25 bp, Mus musculus
tggaggtactaaacttcttcaacaa

SEQ ID NO: 147755 - DNA, 25 bp, Mus musculus
tggaggtcatcttcaccctgaggag

SEQ ID NO: 147756 - DNA, 25 bp, Mus musculus
tggaggtccaaaaagctgacggcat

SEQ ID NO: 147757 - DNA, 25 bp, Mus musculus
tggaggtccccaacgttgttcagaa

SEQ ID NO: 147758 - DNA, 25 bp, Mus musculus
tggaggtctacacccagagcttctc

SEQ ID NO: 147759 - DNA, 25 bp, Mus musculus
tggaggtcttacagtcaatgcgagc

SEQ ID NO: 147760 - DNA, 25 bp, Mus musculus
tggaggtcttcacttccgagggcaa

SEQ ID NO: 147761 - DNA, 25 bp, Mus musculus
tggaggtgaacaaccgcatcatcga

SEQ ID NO: 147762 - DNA, 25 bp, Mus musculus
tggaggtgacctgacataccaaagc

SEQ ID NO: 147763 - DNA, 25 bp, Mus musculus
tggaggtgcctcagagaacgatgac

SEQ ID NO: 147764 - DNA, 25 bp, Mus musculus
tggagtaagaaagagacgtctgtca

SEQ ID NO: 147765 - DNA, 25 bp, Mus musculus
tggagtacagctcatagcaccaggc

SEQ ID NO: 147766 - DNA, 25 bp, Mus musculus
tggagtacatggagacaggctccct

SEQ ID NO: 147767 - DNA, 25 bp, Mus musculus
tggagtaccggcaacaacttatccc

SEQ ID NO: 147768 - DNA, 25 bp, Mus musculus
tggagtacgcctatacgggcacagt

SEQ ID NO: 147769 - DNA, 25 bp, Mus musculus
tggagtacgtgcacaccaagagcct

SEQ ID NO: 147770 - DNA, 25 bp, Mus musculus
tggagtactacgacaaagcctttga

SEQ ID NO: 147771 - DNA, 25 bp, Mus musculus
tggagtatctccaggctgactacaa

SEQ ID NO: 147772 - DNA, 25 bp, Mus musculus
tggagtattattacctgtggaagaa

SEQ ID NO: 147773 - DNA, 25 bp, Mus musculus
tggagtattccgagaacaacgcgcc

SEQ ID NO: 147774 - DNA, 25 bp, Mus musculus
tggagtcaacctgaaaagcagctgc

SEQ ID NO: 147775 - DNA, 25 bp, Mus musculus
tggagtcacagaatacgttattacg

SEQ ID NO: 147776 - DNA, 25 bp, Mus musculus
tggagtcacctaagccagcacaagg

SEQ ID NO: 147777 - DNA, 25 bp, Mus musculus
tggagtcagaccctatacatggaga

SEQ ID NO: 147778 - DNA, 25 bp, Mus musculus
tggagtcagattccacaatagtcta

SEQ ID NO: 147779 - DNA, 25 bp, Mus musculus
tggagtcagcacaggacagccactt

SEQ ID NO: 147780 - DNA, 25 bp, Mus musculus
tggagtcaggccagtacaacaggac

SEQ ID NO: 147781 - DNA, 25 bp, Mus musculus
tggagtcataagagggcagccgtct

SEQ ID NO: 147782 - DNA, 25 bp, Mus musculus
tggagtcattagcagtcaatcgccg

SEQ ID NO: 147783 - DNA, 25 bp, Mus musculus
tggagtccacgtgtccaactctcag

SEQ ID NO: 147784 - DNA, 25 bp, Mus musculus
tggagtccactcatctagaaaactg

SEQ ID NO: 147785 - DNA, 25 bp, Mus musculus
tggagtccagaagctcatcaagcgc

SEQ ID NO: 147786 - DNA, 25 bp, Mus musculus
tggagtccatgaaagctaagctgtc

SEQ ID NO: 147787 - DNA, 25 bp, Mus musculus
tggagtccctgatcactagcacgca

SEQ ID NO: 147788 - DNA, 25 bp, Mus musculus
tggagtcccttgatgcggaaaccag

SEQ ID NO: 147789 - DNA, 25 bp, Mus musculus
tggagtcctacctcagcagcagtgg

SEQ ID NO: 147790 - DNA, 25 bp, Mus musculus
tggagtcctccacaatgcctgcgag

SEQ ID NO: 147791 - DNA, 25 bp, Mus musculus
tggagtcctgatgctatcacttcgt

SEQ ID NO: 147792 - DNA, 25 bp, Mus musculus
tggagtcctgccttacactgggagg

SEQ ID NO: 147793 - DNA, 25 bp, Mus musculus
tggagtcgccggtcgagctgctggc

SEQ ID NO: 147794 - DNA, 25 bp, Mus musculus
tggagtcgggctgctatcactgaag

SEQ ID NO: 147795 - DNA, 25 bp, Mus musculus
tggagtctacccttaaccagccagc

SEQ ID NO: 147796 - DNA, 25 bp, Mus musculus
tggagtctaggcacctccgactgtg

SEQ ID NO: 147797 - DNA, 25 bp, Mus musculus
tggagtctcatatcccaagggcatg

SEQ ID NO: 147798 - DNA, 25 bp, Mus musculus
tggagtctccttctttctaacccgg

SEQ ID NO: 147799 - DNA, 25 bp, Mus musculus
tggagtctgaggtctacgacacccc

SEQ ID NO: 147800 - DNA, 25 bp, Mus musculus
tggagtgaccaaataagcagctgga

SEQ ID NO: 147801 - DNA, 25 bp, Mus musculus
tggagtgaccctgaaaagcacccag

SEQ ID NO: 147802 - DNA, 25 bp, Mus musculus
tggagtgaccgcttacagaatgcag

SEQ ID NO: 147803 - DNA, 25 bp, Mus musculus
tggagtgactgaacaacaaggctgt

SEQ ID NO: 147804 - DNA, 25 bp, Mus musculus
tggagtgccagagccacaagctcac

SEQ ID NO: 147805 - DNA, 25 bp, Mus musculus
tggagtgcctaaaccttctgctgaa

SEQ ID NO: 147806 - DNA, 25 bp, Mus musculus
tggagtgctcgggactcggaagccg

SEQ ID NO: 147807 - DNA, 25 bp, Mus musculus
tggagtggcaccgcgcgaactctgc

SEQ ID NO: 147808 - DNA, 25 bp, Mus musculus
tggagtggccactgagtaaagttgc

SEQ ID NO: 147809 - DNA, 25 bp, Mus musculus
tggagtgggaacattcagagccgcc

SEQ ID NO: 147810 - DNA, 25 bp, Mus musculus
tggagtggtccaaagcctgggtttc

SEQ ID NO: 147811 - DNA, 25 bp, Mus musculus
tggagtgtctgcaaggccttggcca

SEQ ID NO: 147812 - DNA, 25 bp, Mus musculus
tggagttaaaagtacacatgctgga

SEQ ID NO: 147813 - DNA, 25 bp, Mus musculus
tggagttatccacggtgcgccatca

SEQ ID NO: 147814 - DNA, 25 bp, Mus musculus
tggagttcactatgactaacaacgg

SEQ ID NO: 147815 - DNA, 25 bp, Mus musculus
tggagttcatcctgtagcgctgcag

SEQ ID NO: 147816 - DNA, 25 bp, Mus musculus
tggagttccccaggacttacggagg

SEQ ID NO: 147817 - DNA, 25 bp, Mus musculus
tggagttctgctggccatcttgggc

SEQ ID NO: 147818 - DNA, 25 bp, Mus musculus
tggagttgaacagcatgcagccggt

SEQ ID NO: 147819 - DNA, 25 bp, Mus musculus
tggagttgcccacagtgaggtaaac

SEQ ID NO: 147820 - DNA, 25 bp, Mus musculus
tggagtttcgggacattcaggcacc

SEQ ID NO: 147821 - DNA, 25 bp, Mus musculus
tggagtttgtgtacaagaatcggaa

SEQ ID NO: 147822 - DNA, 25 bp, Mus musculus
tggagttttgggtggtaacgattat

SEQ ID NO: 147823 - DNA, 25 bp, Mus musculus
tggataaaaatggaacgggccctct

SEQ ID NO: 147824 - DNA, 25 bp, Mus musculus
tggataaatctggtctcagcagcac

SEQ ID NO: 147825 - DNA, 25 bp, Mus musculus
tggataacatcctgcagcgcattgg

SEQ ID NO: 147826 - DNA, 25 bp, Mus musculus
tggataacctgaaacggcaccagcg

SEQ ID NO: 147827 - DNA, 25 bp, Mus musculus
tggataagaaactgctggctgtgcc

SEQ ID NO: 147828 - DNA, 25 bp, Mus musculus
tggataaggaactgcaagatggacg

SEQ ID NO: 147829 - DNA, 25 bp, Mus musculus
tggataaggacctctcagaccgcag

SEQ ID NO: 147830 - DNA, 25 bp, Mus musculus
tggataagttctaccggaaggtgct

SEQ ID NO: 147831 - DNA, 25 bp, Mus musculus
tggataatgccctacgagccgttgg

SEQ ID NO: 147832 - DNA, 25 bp, Mus musculus
tggataatgtgctaccctctgccca

SEQ ID NO: 147833 - DNA, 25 bp, Mus musculus
tggatacaaaactgtttccgaaatg

SEQ ID NO: 147834 - DNA, 25 bp, Mus musculus
tggatacacaccatacacagcatgt

SEQ ID NO: 147835 - DNA, 25 bp, Mus musculus
tggatactatatcacaacgcgggcc

SEQ ID NO: 147836 - DNA, 25 bp, Mus musculus
tggatactgcaagaacacctctgag

SEQ ID NO: 147837 - DNA, 25 bp, Mus musculus
tggatactggtctgtttggaaaggc

SEQ ID NO: 147838 - DNA, 25 bp, Mus musculus
tggatagcaccaacgacactgtagc

SEQ ID NO: 147839 - DNA, 25 bp, Mus musculus
tggatagctacaataagcgcctgcg

SEQ ID NO: 147840 - DNA, 25 bp, Mus musculus
tggatatacaggacccagcccagaa

SEQ ID NO: 147841 - DNA, 25 bp, Mus musculus
tggatatcaccgaggcagagctgca

SEQ ID NO: 147842 - DNA, 25 bp, Mus musculus
tggatatcagaatgtgctcaggaac

SEQ ID NO: 147843 - DNA, 25 bp, Mus musculus
tggatatgcccgaaaatcagcttgg

SEQ ID NO: 147844 - DNA, 25 bp, Mus musculus
tggatattaccaaccctaaagcggt

SEQ ID NO: 147845 - DNA, 25 bp, Mus musculus
tggatattctttgcagcggcctgag

SEQ ID NO: 147846 - DNA, 25 bp, Mus musculus
tggatcaacctgagccgagtggatc

SEQ ID NO: 147847 - DNA, 25 bp, Mus musculus
tggatcaatccacacagccgaggga

SEQ ID NO: 147848 - DNA, 25 bp, Mus musculus
tggatcacgtctatgaccggctggc

SEQ ID NO: 147849 - DNA, 25 bp, Mus musculus
tggatcagaggttctcgcagcttac

SEQ ID NO: 147850 - DNA, 25 bp, Mus musculus
tggatcagcctgaacctcctgtggg

SEQ ID NO: 147851 - DNA, 25 bp, Mus musculus
tggatcagcgaccaagccttctgtg

SEQ ID NO: 147852 - DNA, 25 bp, Mus musculus
tggatcaggcacacgctgtcatgga

SEQ ID NO: 147853 - DNA, 25 bp, Mus musculus
tggatcaggctcagtcatggaccgg

SEQ ID NO: 147854 - DNA, 25 bp, Mus musculus
tggatcagtcagatggctaccctgc

SEQ ID NO: 147855 - DNA, 25 bp, Mus musculus
tggatcatggattttcccggcaccc

SEQ ID NO: 147856 - DNA, 25 bp, Mus musculus
tggatcatgttttcattgaccaaga

SEQ ID NO: 147857 - DNA, 25 bp, Mus musculus
tggatccaaatctctcctcagatga

SEQ ID NO: 147858 - DNA, 25 bp, Mus musculus
tggatccagaacctctcagccaagt

SEQ ID NO: 147859 - DNA, 25 bp, Mus musculus
tggatcccctcccataggtagcaga

SEQ ID NO: 147860 - DNA, 25 bp, Mus musculus
tggatcccgagacaaagaaaccttg

SEQ ID NO: 147861 - DNA, 25 bp, Mus musculus
tggatccgaccctttttcgacctag

SEQ ID NO: 147862 - DNA, 25 bp, Mus musculus
tggatccggtgtggctccttgtagc

SEQ ID NO: 147863 - DNA, 25 bp, Mus musculus
tggatcctacagaaggcccactgtg

SEQ ID NO: 147864 - DNA, 25 bp, Mus musculus
tggatcctgagctgccgaagccgct

SEQ ID NO: 147865 - DNA, 25 bp, Mus musculus
tggatcctgctcaccttgggcttga

SEQ ID NO: 147866 - DNA, 25 bp, Mus musculus
tggatcctggacaagtggcccagta

SEQ ID NO: 147867 - DNA, 25 bp, Mus musculus
tggatcctggactggccgaattttc

SEQ ID NO: 147868 - DNA, 25 bp, Mus musculus
tggatcctgtcaggccgttgttcag

SEQ ID NO: 147869 - DNA, 25 bp, Mus musculus
tggatccttccagtggacagcttgt

SEQ ID NO: 147870 - DNA, 25 bp, Mus musculus
tggatccttgggagatgcagctgcc

SEQ ID NO: 147871 - DNA, 25 bp, Mus musculus
tggatcgccaggctcgtaaactagc

SEQ ID NO: 147872 - DNA, 25 bp, Mus musculus
tggatcgcctcaagcagaacagtct

SEQ ID NO: 147873 - DNA, 25 bp, Mus musculus
tggatcggcctcacatgttgcagat

SEQ ID NO: 147874 - DNA, 25 bp, Mus musculus
tggatctccaaacccgagcatgttc

SEQ ID NO: 147875 - DNA, 25 bp, Mus musculus
tggatctcggcttggtgtgacccgc

SEQ ID NO: 147876 - DNA, 25 bp, Mus musculus
tggatctctgcatcacatctggctg

SEQ ID NO: 147877 - DNA, 25 bp, Mus musculus
tggatctctgtgaaccaagcccctg

SEQ ID NO: 147878 - DNA, 25 bp, Mus musculus
tggatctgcagcatcaggccaaggt

SEQ ID NO: 147879 - DNA, 25 bp, Mus musculus
tggatctgccaatagagagcgctcg

SEQ ID NO: 147880 - DNA, 25 bp, Mus musculus
tggatcttctcgtgggagtacgcca

SEQ ID NO: 147881 - DNA, 25 bp, Mus musculus
tggatcttgatcatgcgcacagcct

SEQ ID NO: 147882 - DNA, 25 bp, Mus musculus
tggatgaaataaagaccggcaagcc

SEQ ID NO: 147883 - DNA, 25 bp, Mus musculus
tggatgaacaaaagacacaagctct

SEQ ID NO: 147884 - DNA, 25 bp, Mus musculus
tggatgaaccagctaccgctcttgg

SEQ ID NO: 147885 - DNA, 25 bp, Mus musculus
tggatgaactcctacagatagctga

SEQ ID NO: 147886 - DNA, 25 bp, Mus musculus
tggatgaactcgatacccctgatga

SEQ ID NO: 147887 - DNA, 25 bp, Mus musculus
tggatgaagctgcaaagagaccatt

SEQ ID NO: 147888 - DNA, 25 bp, Mus musculus
tggatgacgatatcgctgcgctggt

SEQ ID NO: 147889 - DNA, 25 bp, Mus musculus
tggatgactacaaccgccgggtcac

SEQ ID NO: 147890 - DNA, 25 bp, Mus musculus
tggatgactcctttcgcaagtgggc

SEQ ID NO: 147891 - DNA, 25 bp, Mus musculus
tggatgagaacagggtgcccgacct

SEQ ID NO: 147892 - DNA, 25 bp, Mus musculus
tggatgagacacaacacatttggcg

SEQ ID NO: 147893 - DNA, 25 bp, Mus musculus
tggatgagcacaggacaaccttggg

SEQ ID NO: 147894 - DNA, 25 bp, Mus musculus
tggatgagcctacatatacactggc

SEQ ID NO: 147895 - DNA, 25 bp, Mus musculus
tggatgagcctatcccaggtgtcgg

SEQ ID NO: 147896 - DNA, 25 bp, Mus musculus
tggatgagcttcacagtctggaccc

SEQ ID NO: 147897 - DNA, 25 bp, Mus musculus
tggatgaggtaaaacgcacgctggc

SEQ ID NO: 147898 - DNA, 25 bp, Mus musculus
tggatgagtgtgctaccccatggac

SEQ ID NO: 147899 - DNA, 25 bp, Mus musculus
tggatgagtgttcaaggcccaaccg

SEQ ID NO: 147900 - DNA, 25 bp, Mus musculus
tggatgatggcacctatggccgcct

SEQ ID NO: 147901 - DNA, 25 bp, Mus musculus
tggatgcatccatccaggacctggg

SEQ ID NO: 147902 - DNA, 25 bp, Mus musculus
tggatgccaagtagctaccagccca

SEQ ID NO: 147903 - DNA, 25 bp, Mus musculus
tggatgccactgttcccctgaggat

SEQ ID NO: 147904 - DNA, 25 bp, Mus musculus
tggatgccccaagataccagcatgg

SEQ ID NO: 147905 - DNA, 25 bp, Mus musculus
tggatgccccacatagcacctacaa

SEQ ID NO: 147906 - DNA, 25 bp, Mus musculus
tggatgccctgagccaagtgtgcct

SEQ ID NO: 147907 - DNA, 25 bp, Mus musculus
tggatgccctggttgccgacagtga

SEQ ID NO: 147908 - DNA, 25 bp, Mus musculus
tggatgccgcagaaaacaactcagg

SEQ ID NO: 147909 - DNA, 25 bp, Mus musculus
tggatgcctctatcacggtgaccct

SEQ ID NO: 147910 - DNA, 25 bp, Mus musculus
tggatgcgacaatctgagcaccctc

SEQ ID NO: 147911 - DNA, 25 bp, Mus musculus
tggatgcgagttcacacgacaagcc

SEQ ID NO: 147912 - DNA, 25 bp, Mus musculus
tggatgctaccaacccaagacactc

SEQ ID NO: 147913 - DNA, 25 bp, Mus musculus
tggatgctctggaaagaacgctgga

SEQ ID NO: 147914 - DNA, 25 bp, Mus musculus
tggatggaaaatctgatatatgtgg

SEQ ID NO: 147915 - DNA, 25 bp, Mus musculus
tggatggaaccagtcttacgagaac

SEQ ID NO: 147916 - DNA, 25 bp, Mus musculus
tggatggactcactaccaacggtgt

SEQ ID NO: 147917 - DNA, 25 bp, Mus musculus
tggatggactcgattccgatgagag

SEQ ID NO: 147918 - DNA, 25 bp, Mus musculus
tggatggagctttccctcgctggga

SEQ ID NO: 147919 - DNA, 25 bp, Mus musculus
tggatggatattcacggaccttgtc

SEQ ID NO: 147920 - DNA, 25 bp, Mus musculus
tggatggcaccatactgaagagcag

SEQ ID NO: 147921 - DNA, 25 bp, Mus musculus
tggatggcaccctaggactcagaag

SEQ ID NO: 147922 - DNA, 25 bp, Mus musculus
tggatggcagccacatgtcttcaaa

SEQ ID NO: 147923 - DNA, 25 bp, Mus musculus
tggatggcatcctgttggcaactgg

SEQ ID NO: 147924 - DNA, 25 bp, Mus musculus
tggatggcctcgtcaagcggatgct

SEQ ID NO: 147925 - DNA, 25 bp, Mus musculus
tggatggcctttccacgcaatagca

SEQ ID NO: 147926 - DNA, 25 bp, Mus musculus
tggatggctcgaagcactacgtgct

SEQ ID NO: 147927 - DNA, 25 bp, Mus musculus
tggatgtaaagacctgcagccaggc

SEQ ID NO: 147928 - DNA, 25 bp, Mus musculus
tggatgtaccctggtgatggccctc

SEQ ID NO: 147929 - DNA, 25 bp, Mus musculus
tggatgtagcatggtctccccacga

SEQ ID NO: 147930 - DNA, 25 bp, Mus musculus
tggatgtaggtcatggttgtttcat

SEQ ID NO: 147931 - DNA, 25 bp, Mus musculus
tggatgtcaccaagaacgcggtggc

SEQ ID NO: 147932 - DNA, 25 bp, Mus musculus
tggatgtcatcagaacccgtgtgca

SEQ ID NO: 147933 - DNA, 25 bp, Mus musculus
tggatgtctgccctctacctgagag

SEQ ID NO: 147934 - DNA, 25 bp, Mus musculus
tggatgtgccccacgctttagtgac

SEQ ID NO: 147935 - DNA, 25 bp, Mus musculus
tggatgtggacaagcgtctgaccgc

SEQ ID NO: 147936 - DNA, 25 bp, Mus musculus
tggatgttgttgaggctcgaaccca

SEQ ID NO: 147937 - DNA, 25 bp, Mus musculus
tggatgttttctgccctcactatga

SEQ ID NO: 147938 - DNA, 25 bp, Mus musculus
tggattaagaatcgctaggatgcct

SEQ ID NO: 147939 - DNA, 25 bp, Mus musculus
tggattacaaccagatcagctgcat

SEQ ID NO: 147940 - DNA, 25 bp, Mus musculus
tggattacagcatcgagatcccgga

SEQ ID NO: 147941 - DNA, 25 bp, Mus musculus
tggattactcactggcacagcggcg

SEQ ID NO: 147942 - DNA, 25 bp, Mus musculus
tggattatgactacgccctgctgga

SEQ ID NO: 147943 - DNA, 25 bp, Mus musculus
tggattcagcatcaagacttacaga

SEQ ID NO: 147944 - DNA, 25 bp, Mus musculus
tggattcaggtaagggtccctccca

SEQ ID NO: 147945 - DNA, 25 bp, Mus musculus
tggattcagtatgcccaccgtggta

SEQ ID NO: 147946 - DNA, 25 bp, Mus musculus
tggattcatctgtaggtgccctgcg

SEQ ID NO: 147947 - DNA, 25 bp, Mus musculus
tggattcatcttggtcatagaccga

SEQ ID NO: 147948 - DNA, 25 bp, Mus musculus
tggattcatgagtgttagcgctggc

SEQ ID NO: 147949 - DNA, 25 bp, Mus musculus
tggattccccgagcaaatggtggct

SEQ ID NO: 147950 - DNA, 25 bp, Mus musculus
tggattcccgagaatatcaagaaga

SEQ ID NO: 147951 - DNA, 25 bp, Mus musculus
tggattcccgtgaattccggaggag

SEQ ID NO: 147952 - DNA, 25 bp, Mus musculus
tggattccgttcctctgcaagagca

SEQ ID NO: 147953 - DNA, 25 bp, Mus musculus
tggattcctaagtgacctgaacccg

SEQ ID NO: 147954 - DNA, 25 bp, Mus musculus
tggattcctagtgctcaagtggcag

SEQ ID NO: 147955 - DNA, 25 bp, Mus musculus
tggattctccgcacacaaggacatg

SEQ ID NO: 147956 - DNA, 25 bp, Mus musculus
tggattctgccctgaacaaggaagg

SEQ ID NO: 147957 - DNA, 25 bp, Mus musculus
tggattgactccactggctcagcag

SEQ ID NO: 147958 - DNA, 25 bp, Mus musculus
tggattgatagacattgctgctgac

SEQ ID NO: 147959 - DNA, 25 bp, Mus musculus
tggattgcaatcgtaccaagaagct

SEQ ID NO: 147960 - DNA, 25 bp, Mus musculus
tggattgctgattgccagtcggcga

SEQ ID NO: 147961 - DNA, 25 bp, Mus musculus
tggatttctagacctgtcactctgt

SEQ ID NO: 147962 - DNA, 25 bp, Mus musculus
tggatttctctcacgaaggacccgc

SEQ ID NO: 147963 - DNA, 25 bp, Mus musculus
tggatttgccctccgaccgtataaa

SEQ ID NO: 147964 - DNA, 25 bp, Mus musculus
tggatttggctcatagttctgaaag

SEQ ID NO: 147965 - DNA, 25 bp, Mus musculus
tggattttcgaggacccgaggctga

SEQ ID NO: 147966 - DNA, 25 bp, Mus musculus
tggattttcttcctgccggcggctg

SEQ ID NO: 147967 - DNA, 25 bp, Mus musculus
tggcaaaaacctggctgatcaaggc

SEQ ID NO: 147968 - DNA, 25 bp, Mus musculus
tggcaaaaatccacccagagcctgg

SEQ ID NO: 147969 - DNA, 25 bp, Mus musculus
tggcaaaaatctggaacttcccggg

SEQ ID NO: 147970 - DNA, 25 bp, Mus musculus
tggcaaaagcacactcctgggagtc

SEQ ID NO: 147971 - DNA, 25 bp, Mus musculus
tggcaaacatgaggatccaggacct

SEQ ID NO: 147972 - DNA, 25 bp, Mus musculus
tggcaaacgagaagtgcacagcact

SEQ ID NO: 147973 - DNA, 25 bp, Mus musculus
tggcaaacgcagtgggcatgaaccg

SEQ ID NO: 147974 - DNA, 25 bp, Mus musculus
tggcaaagacgctatttttacctgt

SEQ ID NO: 147975 - DNA, 25 bp, Mus musculus
tggcaaagcacagggaaaaggcatc

SEQ ID NO: 147976 - DNA, 25 bp, Mus musculus
tggcaaagccaagaaagcactgacg

SEQ ID NO: 147977 - DNA, 25 bp, Mus musculus
tggcaaagcccactgtgaccatcag

SEQ ID NO: 147978 - DNA, 25 bp, Mus musculus
tggcaaagctccgagaggaaaaatc

SEQ ID NO: 147979 - DNA, 25 bp, Mus musculus
tggcaaagtcctgacccctgaagag

SEQ ID NO: 147980 - DNA, 25 bp, Mus musculus
tggcaaagtgcgcaagcccaagttt

SEQ ID NO: 147981 - DNA, 25 bp, Mus musculus
tggcaaatacaaaggcaatggtcgt

SEQ ID NO: 147982 - DNA, 25 bp, Mus musculus
tggcaaatacggcatcaaatacatc

SEQ ID NO: 147983 - DNA, 25 bp, Mus musculus
tggcaaatggctgtcaccaactcag

SEQ ID NO: 147984 - DNA, 25 bp, Mus musculus
tggcaaatggttccccactctaatt

SEQ ID NO: 147985 - DNA, 25 bp, Mus musculus
tggcaacaaggatatggcccacaag

SEQ ID NO: 147986 - DNA, 25 bp, Mus musculus
tggcaacaatgcacggaacttctcg

SEQ ID NO: 147987 - DNA, 25 bp, Mus musculus
tggcaacagttactcaccagaggaa

SEQ ID NO: 147988 - DNA, 25 bp, Mus musculus
tggcaacatggctaccgagagcagt

SEQ ID NO: 147989 - DNA, 25 bp, Mus musculus
tggcaaccaagcatacttccagatg

SEQ ID NO: 147990 - DNA, 25 bp, Mus musculus
tggcaaccggtctcccttagcagat

SEQ ID NO: 147991 - DNA, 25 bp, Mus musculus
tggcaacggaagtctggagtcccag

SEQ ID NO: 147992 - DNA, 25 bp, Mus musculus
tggcaacgggcagttcactgagaag

SEQ ID NO: 147993 - DNA, 25 bp, Mus musculus
tggcaactcccgaactgcaatggtt

SEQ ID NO: 147994 - DNA, 25 bp, Mus musculus
tggcaactgcctatgcaacgctggg

SEQ ID NO: 147995 - DNA, 25 bp, Mus musculus
tggcaactggagatgacaatggaga

SEQ ID NO: 147996 - DNA, 25 bp, Mus musculus
tggcaagaaattaaacaggaggctg

SEQ ID NO: 147997 - DNA, 25 bp, Mus musculus
tggcaagaacgcagtcaccctgaag

SEQ ID NO: 147998 - DNA, 25 bp, Mus musculus
tggcaagacatgcagataactgtgc

SEQ ID NO: 147999 - DNA, 25 bp, Mus musculus
tggcaagaccatggactacgctgag

SEQ ID NO: 148000 - DNA, 25 bp, Mus musculus
tggcaagacgtctctggtccagcgc

SEQ ID NO: 148001 - DNA, 25 bp, Mus musculus
tggcaagagagggattggctccatc

SEQ ID NO: 148002 - DNA, 25 bp, Mus musculus
tggcaagcacattttaaggtcccgt

SEQ ID NO: 148003 - DNA, 25 bp, Mus musculus
tggcaagcagccacacttggacatg

SEQ ID NO: 148004 - DNA, 25 bp, Mus musculus
tggcaagctcttctgaatacagtac

SEQ ID NO: 148005 - DNA, 25 bp, Mus musculus
tggcaagctgcctcctgagttttgt

SEQ ID NO: 148006 - DNA, 25 bp, Mus musculus
tggcaaggaactaactgaagacatt

SEQ ID NO: 148007 - DNA, 25 bp, Mus musculus
tggcaaggccctgtatgactactcc

SEQ ID NO: 148008 - DNA, 25 bp, Mus musculus
tggcaagtgcatatccccaggtaga

SEQ ID NO: 148009 - DNA, 25 bp, Mus musculus
tggcaagtggttctcccagatggct

SEQ ID NO: 148010 - DNA, 25 bp, Mus musculus
tggcaagttcaacgacaacgcctgg

SEQ ID NO: 148011 - DNA, 25 bp, Mus musculus
tggcaatacagaacattcttgcagc

SEQ ID NO: 148012 - DNA, 25 bp, Mus musculus
tggcaatacatggaacaacactggc

SEQ ID NO: 148013 - DNA, 25 bp, Mus musculus
tggcaatcctacatggccgtcaccg

SEQ ID NO: 148014 - DNA, 25 bp, Mus musculus
tggcaatgaagcacccctctgctgt

SEQ ID NO: 148015 - DNA, 25 bp, Mus musculus
tggcaatgaatggagacaggctgtc

SEQ ID NO: 148016 - DNA, 25 bp, Mus musculus
tggcaatgaggagcagcaattggct

SEQ ID NO: 148017 - DNA, 25 bp, Mus musculus
tggcaatgcagtatgcgcccagtgc

SEQ ID NO: 148018 - DNA, 25 bp, Mus musculus
tggcaatggaacatccaacaactgg

SEQ ID NO: 148019 - DNA, 25 bp, Mus musculus
tggcaatgggagacacatgacccct

SEQ ID NO: 148020 - DNA, 25 bp, Mus musculus
tggcaatgtcgtttctcaaaagaga

SEQ ID NO: 148021 - DNA, 25 bp, Mus musculus
tggcacaagcgcagaaaggtgcgtt

SEQ ID NO: 148022 - DNA, 25 bp, Mus musculus
tggcacactgattgaggacctcctg

SEQ ID NO: 148023 - DNA, 25 bp, Mus musculus
tggcacagacacatgggagcaagca

SEQ ID NO: 148024 - DNA, 25 bp, Mus musculus
tggcacagatgtggtcccagcagcc

SEQ ID NO: 148025 - DNA, 25 bp, Mus musculus
tggcacagcactcgtagaaatgggt

SEQ ID NO: 148026 - DNA, 25 bp, Mus musculus
tggcacagctccactattagagcga

SEQ ID NO: 148027 - DNA, 25 bp, Mus musculus
tggcacaggcctcttgtcaatgatg

SEQ ID NO: 148028 - DNA, 25 bp, Mus musculus
tggcacagtaaagaaggagaccctc

SEQ ID NO: 148029 - DNA, 25 bp, Mus musculus
tggcaccaaccttggtttctaccat

SEQ ID NO: 148030 - DNA, 25 bp, Mus musculus
tggcaccaagagtggagggccttct

SEQ ID NO: 148031 - DNA, 25 bp, Mus musculus
tggcaccacagaagagcaaaccgag

SEQ ID NO: 148032 - DNA, 25 bp, Mus musculus
tggcaccagagtcgtctagcttcgg

SEQ ID NO: 148033 - DNA, 25 bp, Mus musculus
tggcaccattaccaccaaggagctg

SEQ ID NO: 148034 - DNA, 25 bp, Mus musculus
tggcaccccaactgagaacatgaac

SEQ ID NO: 148035 - DNA, 25 bp, Mus musculus
tggcacccctaggaggtctggagtt

SEQ ID NO: 148036 - DNA, 25 bp, Mus musculus
tggcacctcgacatggaatcacctg

SEQ ID NO: 148037 - DNA, 25 bp, Mus musculus
tggcacctgcgtaatcaatctgaca

SEQ ID NO: 148038 - DNA, 25 bp, Mus musculus
tggcacctgggaagagttcctagag

SEQ ID NO: 148039 - DNA, 25 bp, Mus musculus
tggcacgcacagattgagcccgagt

SEQ ID NO: 148040 - DNA, 25 bp, Mus musculus
tggcacgcagggtttacaggcagct

SEQ ID NO: 148041 - DNA, 25 bp, Mus musculus
tggcactagcgtgcaggagactccg

SEQ ID NO: 148042 - DNA, 25 bp, Mus musculus
tggcactaggcaatgtcaccgcctg

SEQ ID NO: 148043 - DNA, 25 bp, Mus musculus
tggcactcaagaaagagatcgggct

SEQ ID NO: 148044 - DNA, 25 bp, Mus musculus
tggcactgaccggaaccgtggtcta

SEQ ID NO: 148045 - DNA, 25 bp, Mus musculus
tggcactgatggaattggaaaagca

SEQ ID NO: 148046 - DNA, 25 bp, Mus musculus
tggcactggcgtcatggcactaagc

SEQ ID NO: 148047 - DNA, 25 bp, Mus musculus
tggcactgtcaggacccgggagact

SEQ ID NO: 148048 - DNA, 25 bp, Mus musculus
tggcactttgcagatggcttgaccc

SEQ ID NO: 148049 - DNA, 25 bp, Mus musculus
tggcactttggtacctaaaatctgt

SEQ ID NO: 148050 - DNA, 25 bp, Mus musculus
tggcagaaaacatcatccttgaggc

SEQ ID NO: 148051 - DNA, 25 bp, Mus musculus
tggcagaacccaggacactactgaa

SEQ ID NO: 148052 - DNA, 25 bp, Mus musculus
tggcagaactggcacgccggaggga

SEQ ID NO: 148053 - DNA, 25 bp, Mus musculus
tggcagaagaaactgaccccggaac

SEQ ID NO: 148054 - DNA, 25 bp, Mus musculus
tggcagaagctctcgccaacggagt

SEQ ID NO: 148055 - DNA, 25 bp, Mus musculus
tggcagaagtttgacgggccctttc

SEQ ID NO: 148056 - DNA, 25 bp, Mus musculus
tggcagaatgaggaacgagcagcta

SEQ ID NO: 148057 - DNA, 25 bp, Mus musculus
tggcagacgggagggaattctctct

SEQ ID NO: 148058 - DNA, 25 bp, Mus musculus
tggcagagatcacactagccctggg

SEQ ID NO: 148059 - DNA, 25 bp, Mus musculus
tggcagaggcatacctgagtccagg

SEQ ID NO: 148060 - DNA, 25 bp, Mus musculus
tggcagaggtccagcgaaggtacaa

SEQ ID NO: 148061 - DNA, 25 bp, Mus musculus
tggcagatccatcaccgagagaaga

SEQ ID NO: 148062 - DNA, 25 bp, Mus musculus
tggcagatccctctaacctcatacg

SEQ ID NO: 148063 - DNA, 25 bp, Mus musculus
tggcagattcagagcagcagcagac

SEQ ID NO: 148064 - DNA, 25 bp, Mus musculus
tggcagcaaagacccttcggaagac

SEQ ID NO: 148065 - DNA, 25 bp, Mus musculus
tggcagcacagctgagccagacagg

SEQ ID NO: 148066 - DNA, 25 bp, Mus musculus
tggcagcagattgcaatggaccctg

SEQ ID NO: 148067 - DNA, 25 bp, Mus musculus
tggcagcagccttccaagaggagtt

SEQ ID NO: 148068 - DNA, 25 bp, Mus musculus
tggcagcagctgtctccaacttcgg

SEQ ID NO: 148069 - DNA, 25 bp, Mus musculus
tggcagcagctgtgggaaacaccaa

SEQ ID NO: 148070 - DNA, 25 bp, Mus musculus
tggcagcagtgagtgaagactcccc

SEQ ID NO: 148071 - DNA, 25 bp, Mus musculus
tggcagcatccagcaactctagtct

SEQ ID NO: 148072 - DNA, 25 bp, Mus musculus
tggcagcatggcagcaaagctctgg

SEQ ID NO: 148073 - DNA, 25 bp, Mus musculus
tggcagccagcgaagcacagataaa

SEQ ID NO: 148074 - DNA, 25 bp, Mus musculus
tggcagccagttgtaccatgcagcg

SEQ ID NO: 148075 - DNA, 25 bp, Mus musculus
tggcagccatcaatgcacgcaagat

SEQ ID NO: 148076 - DNA, 25 bp, Mus musculus
tggcagcccagcgaagtcctgataa

SEQ ID NO: 148077 - DNA, 25 bp, Mus musculus
tggcagccctggagctaacgtgtct

SEQ ID NO: 148078 - DNA, 25 bp, Mus musculus
tggcagccgaagcagccaggacacc

SEQ ID NO: 148079 - DNA, 25 bp, Mus musculus
tggcagccgagaaaagtacattaac

SEQ ID NO: 148080 - DNA, 25 bp, Mus musculus
tggcagccgctgtagaagctatgac

SEQ ID NO: 148081 - DNA, 25 bp, Mus musculus
tggcagcgacctttaccctcattgg

SEQ ID NO: 148082 - DNA, 25 bp, Mus musculus
tggcagcgctgtccaaagggatact

SEQ ID NO: 148083 - DNA, 25 bp, Mus musculus
tggcagcgggcacaaaactcttcat

SEQ ID NO: 148084 - DNA, 25 bp, Mus musculus
tggcagctaactcccaagggtcgat

SEQ ID NO: 148085 - DNA, 25 bp, Mus musculus
tggcagctaatgatggccccatgcc

SEQ ID NO: 148086 - DNA, 25 bp, Mus musculus
tggcagctacaacggacaaattgga

SEQ ID NO: 148087 - DNA, 25 bp, Mus musculus
tggcagctactgacctcgcagaggg

SEQ ID NO: 148088 - DNA, 25 bp, Mus musculus
tggcagctattttaccagactgtgc

SEQ ID NO: 148089 - DNA, 25 bp, Mus musculus
tggcagctgaccatactgaaggacc

SEQ ID NO: 148090 - DNA, 25 bp, Mus musculus
tggcagctgcactccaggaagttcg

SEQ ID NO: 148091 - DNA, 25 bp, Mus musculus
tggcagctggcctagaacgtaatgg

SEQ ID NO: 148092 - DNA, 25 bp, Mus musculus
tggcagctgttaagaatgaccctcc

SEQ ID NO: 148093 - DNA, 25 bp, Mus musculus
tggcagcttcctggtgcgagatagc

SEQ ID NO: 148094 - DNA, 25 bp, Mus musculus
tggcaggaaagctccaccacttggt

SEQ ID NO: 148095 - DNA, 25 bp, Mus musculus
tggcaggagacattcgaacagacgt

SEQ ID NO: 148096 - DNA, 25 bp, Mus musculus
tggcaggagtcaaagggctcaccat

SEQ ID NO: 148097 - DNA, 25 bp, Mus musculus
tggcaggcaacaaagacacagtggc

SEQ ID NO: 148098 - DNA, 25 bp, Mus musculus
tggcaggcgccgatagtcaagttcc

SEQ ID NO: 148099 - DNA, 25 bp, Mus musculus
tggcaggtagaccaggccatccttt

SEQ ID NO: 148100 - DNA, 25 bp, Mus musculus
tggcagtacaggtcatggacatcaa

SEQ ID NO: 148101 - DNA, 25 bp, Mus musculus
tggcagtactcactctggaaaggga

SEQ ID NO: 148102 - DNA, 25 bp, Mus musculus
tggcagtcaccctagaagaatcaag

SEQ ID NO: 148103 - DNA, 25 bp, Mus musculus
tggcagtcggcctatctcgggtctt

SEQ ID NO: 148104 - DNA, 25 bp, Mus musculus
tggcagtgagccaccaaacaagcgt

SEQ ID NO: 148105 - DNA, 25 bp, Mus musculus
tggcagttgacactacactggctgg

SEQ ID NO: 148106 - DNA, 25 bp, Mus musculus
tggcataatctgttctaaatctggg

SEQ ID NO: 148107 - DNA, 25 bp, Mus musculus
tggcataccgaggaagaaccacctt

SEQ ID NO: 148108 - DNA, 25 bp, Mus musculus
tggcatagatattactcaacctttg

SEQ ID NO: 148109 - DNA, 25 bp, Mus musculus
tggcatatgaccagcccacaataag

SEQ ID NO: 148110 - DNA, 25 bp, Mus musculus
tggcatcaaagaaagcagtgcatat

SEQ ID NO: 148111 - DNA, 25 bp, Mus musculus
tggcatcagccgagacaaagtcatc

SEQ ID NO: 148112 - DNA, 25 bp, Mus musculus
tggcatccaacagctctccgtagag

SEQ ID NO: 148113 - DNA, 25 bp, Mus musculus
tggcatccagtgacgggaaacctgg

SEQ ID NO: 148114 - DNA, 25 bp, Mus musculus
tggcatccatgaccaaggccacgga

SEQ ID NO: 148115 - DNA, 25 bp, Mus musculus
tggcatcgcctttgaccacatgaag

SEQ ID NO: 148116 - DNA, 25 bp, Mus musculus
tggcatcggagactacaagcttggc

SEQ ID NO: 148117 - DNA, 25 bp, Mus musculus
tggcatcgtgagcttcggctcctct

SEQ ID NO: 148118 - DNA, 25 bp, Mus musculus
tggcatctaagacaaccaccaccgt

SEQ ID NO: 148119 - DNA, 25 bp, Mus musculus
tggcatctatgaactcaggcgaatg

SEQ ID NO: 148120 - DNA, 25 bp, Mus musculus
tggcatcttcatctgctactgggat

SEQ ID NO: 148121 - DNA, 25 bp, Mus musculus
tggcatcttcatgagctccagaggt

SEQ ID NO: 148122 - DNA, 25 bp, Mus musculus
tggcatgacaccctcgggcatgaga

SEQ ID NO: 148123 - DNA, 25 bp, Mus musculus
tggcatgcctgccaagagacgaaag

SEQ ID NO: 148124 - DNA, 25 bp, Mus musculus
tggcatggtgcccaagaacagcaag

SEQ ID NO: 148125 - DNA, 25 bp, Mus musculus
tggcattactagatcaccctcgggc

SEQ ID NO: 148126 - DNA, 25 bp, Mus musculus
tggcattcacgcaaagcagtcttgg

SEQ ID NO: 148127 - DNA, 25 bp, Mus musculus
tggcattcacggcacaacctcattg

SEQ ID NO: 148128 - DNA, 25 bp, Mus musculus
tggcattcctgatactcttcagtgt

SEQ ID NO: 148129 - DNA, 25 bp, Mus musculus
tggcattgcattaaccccactaggg

SEQ ID NO: 148130 - DNA, 25 bp, Mus musculus
tggcattgggagaccttgggatccc

SEQ ID NO: 148131 - DNA, 25 bp, Mus musculus
tggcatttgccgtaggctcagcctc

SEQ ID NO: 148132 - DNA, 25 bp, Mus musculus
tggcatttggctatacaacagaggc

SEQ ID NO: 148133 - DNA, 25 bp, Mus musculus
tggcattttgctgtgggagaccttc

SEQ ID NO: 148134 - DNA, 25 bp, Mus musculus
tggccaaacgggatgaacagtgctg

SEQ ID NO: 148135 - DNA, 25 bp, Mus musculus
tggccaacaaaatccagatgtcttc

SEQ ID NO: 148136 - DNA, 25 bp, Mus musculus
tggccaacagtaattcagacatccg

SEQ ID NO: 148137 - DNA, 25 bp, Mus musculus
tggccaaccccgagcacatggaaat

SEQ ID NO: 148138 - DNA, 25 bp, Mus musculus
tggccaaccgcaaagataaagcatc

SEQ ID NO: 148139 - DNA, 25 bp, Mus musculus
tggccaactccatcgagagtccctg

SEQ ID NO: 148140 - DNA, 25 bp, Mus musculus
tggccaagccaacccacggtgatat

SEQ ID NO: 148141 - DNA, 25 bp, Mus musculus
tggccaagctgagagtggtcaagcc

SEQ ID NO: 148142 - DNA, 25 bp, Mus musculus
tggccaaggtcatacgctttgaaag

SEQ ID NO: 148143 - DNA, 25 bp, Mus musculus
tggccaagtggtacatgcagttcga

SEQ ID NO: 148144 - DNA, 25 bp, Mus musculus
tggccaagttgttcgtgaagctcaa

SEQ ID NO: 148145 - DNA, 25 bp, Mus musculus
tggccaatacgagagggctgtgacc

SEQ ID NO: 148146 - DNA, 25 bp, Mus musculus
tggccaatctggagaccataccctg

SEQ ID NO: 148147 - DNA, 25 bp, Mus musculus
tggccaatgaggagtctgaacacaa

SEQ ID NO: 148148 - DNA, 25 bp, Mus musculus
tggccaatgagttccgctgttacac

SEQ ID NO: 148149 - DNA, 25 bp, Mus musculus
tggccacagtaaccatcttggatga

SEQ ID NO: 148150 - DNA, 25 bp, Mus musculus
tggccacagtgatcatgcagtacgg

SEQ ID NO: 148151 - DNA, 25 bp, Mus musculus
tggccacagttcaaactctgaagca

SEQ ID NO: 148152 - DNA, 25 bp, Mus musculus
tggccacatccatccaacatggtgg

SEQ ID NO: 148153 - DNA, 25 bp, Mus musculus
tggccacatggcgaaggctcactga

SEQ ID NO: 148154 - DNA, 25 bp, Mus musculus
tggccaccacgctggacagcgagac

SEQ ID NO: 148155 - DNA, 25 bp, Mus musculus
tggccaccagccgaatcatcaaata

SEQ ID NO: 148156 - DNA, 25 bp, Mus musculus
tggccacccagtactttgctgatag

SEQ ID NO: 148157 - DNA, 25 bp, Mus musculus
tggccaccctcaatgccttggaaag

SEQ ID NO: 148158 - DNA, 25 bp, Mus musculus
tggccaccggctactggaagaggct

SEQ ID NO: 148159 - DNA, 25 bp, Mus musculus
tggccacctcactgtggatgagttc

SEQ ID NO: 148160 - DNA, 25 bp, Mus musculus
tggccacgcgctaaaggagaagttt

SEQ ID NO: 148161 - DNA, 25 bp, Mus musculus
tggccacgggcgagaactttttcag

SEQ ID NO: 148162 - DNA, 25 bp, Mus musculus
tggccactacaaacctgacaccttg

SEQ ID NO: 148163 - DNA, 25 bp, Mus musculus
tggccactaccatgctgacaagaag

SEQ ID NO: 148164 - DNA, 25 bp, Mus musculus
tggccactcccgagatgctggaaag

SEQ ID NO: 148165 - DNA, 25 bp, Mus musculus
tggccactctaccacaggtcctgag

SEQ ID NO: 148166 - DNA, 25 bp, Mus musculus
tggccactgaatataattgacccag

SEQ ID NO: 148167 - DNA, 25 bp, Mus musculus
tggccactgacaaaacctgggagca

SEQ ID NO: 148168 - DNA, 25 bp, Mus musculus
tggccactgatctactaccttaagg

SEQ ID NO: 148169 - DNA, 25 bp, Mus musculus
tggccactgtgggaatcgtcttctc

SEQ ID NO: 148170 - DNA, 25 bp, Mus musculus
tggccagaaatgttgcaccttccag

SEQ ID NO: 148171 - DNA, 25 bp, Mus musculus
tggccagaccagagtacagagagtg

SEQ ID NO: 148172 - DNA, 25 bp, Mus musculus
tggccagagccagatcaagttgctg

SEQ ID NO: 148173 - DNA, 25 bp, Mus musculus
tggccagagtgtcttcatcaccaag

SEQ ID NO: 148174 - DNA, 25 bp, Mus musculus
tggccagatggaaagcccctggaga

SEQ ID NO: 148175 - DNA, 25 bp, Mus musculus
tggccagattatgtcaggtgtacct

SEQ ID NO: 148176 - DNA, 25 bp, Mus musculus
tggccagcccaagaaccaggaaagt

SEQ ID NO: 148177 - DNA, 25 bp, Mus musculus
tggccagctcccaggtagagatgga

SEQ ID NO: 148178 - DNA, 25 bp, Mus musculus
tggccaggaatacaacatcactagg

SEQ ID NO: 148179 - DNA, 25 bp, Mus musculus
tggccaggaccaagtgtagctcagc

SEQ ID NO: 148180 - DNA, 25 bp, Mus musculus
tggccaggaccacaagggtagcttc

SEQ ID NO: 148181 - DNA, 25 bp, Mus musculus
tggccaggactacccacaggttgga

SEQ ID NO: 148182 - DNA, 25 bp, Mus musculus
tggccaggctgagaggaatccttcc

SEQ ID NO: 148183 - DNA, 25 bp, Mus musculus
tggccagggaaaactgcaagaagtt

SEQ ID NO: 148184 - DNA, 25 bp, Mus musculus
tggccagggacggaagactagtaaa

SEQ ID NO: 148185 - DNA, 25 bp, Mus musculus
tggccagtacatccgctctgtggac

SEQ ID NO: 148186 - DNA, 25 bp, Mus musculus
tggccagtgaagacacccgatgttc

SEQ ID NO: 148187 - DNA, 25 bp, Mus musculus
tggccagtggaacagagtctattga

SEQ ID NO: 148188 - DNA, 25 bp, Mus musculus
tggccagttactcgtctctcccaga

SEQ ID NO: 148189 - DNA, 25 bp, Mus musculus
tggccagttcccatacgagccgaag

SEQ ID NO: 148190 - DNA, 25 bp, Mus musculus
tggccagttgtgctcaggaaactgc

SEQ ID NO: 148191 - DNA, 25 bp, Mus musculus
tggccatacccagcatggctgatgc

SEQ ID NO: 148192 - DNA, 25 bp, Mus musculus
tggccatagtggtacagtctttaat

SEQ ID NO: 148193 - DNA, 25 bp, Mus musculus
tggccatcaaagctatccgggaagg

SEQ ID NO: 148194 - DNA, 25 bp, Mus musculus
tggccatcacactggccattgcctg

SEQ ID NO: 148195 - DNA, 25 bp, Mus musculus
tggccatcaggacccaaatgcggtg

SEQ ID NO: 148196 - DNA, 25 bp, Mus musculus
tggccatccacttgtgtgtccgctg

SEQ ID NO: 148197 - DNA, 25 bp, Mus musculus
tggccatcccagacgatttctcaga

SEQ ID NO: 148198 - DNA, 25 bp, Mus musculus
tggccatgggagagaagggtcacct

SEQ ID NO: 148199 - DNA, 25 bp, Mus musculus
tggccatggtcctcactgaaaaccg

SEQ ID NO: 148200 - DNA, 25 bp, Mus musculus
tggccattgaagagccaggccctgg

SEQ ID NO: 148201 - DNA, 25 bp, Mus musculus
tggccattgccagtgtgatctatct

SEQ ID NO: 148202 - DNA, 25 bp, Mus musculus
tggccattgcctgggtgctcgtgta

SEQ ID NO: 148203 - DNA, 25 bp, Mus musculus
tggccatttacactggcggcaccat

SEQ ID NO: 148204 - DNA, 25 bp, Mus musculus
tggcccaaactcatttaactcgagc

SEQ ID NO: 148205 - DNA, 25 bp, Mus musculus
tggcccaacacgtagcatcctgtgg

SEQ ID NO: 148206 - DNA, 25 bp, Mus musculus
tggcccaagctccaaaccatgttgt

SEQ ID NO: 148207 - DNA, 25 bp, Mus musculus
tggcccaatagtgtacacagcatat

SEQ ID NO: 148208 - DNA, 25 bp, Mus musculus
tggcccaatcccaacagtgctaact

SEQ ID NO: 148209 - DNA, 25 bp, Mus musculus
tggcccaccacacatgaagaacttt

SEQ ID NO: 148210 - DNA, 25 bp, Mus musculus
tggcccaccggaaggctatgaagag

SEQ ID NO: 148211 - DNA, 25 bp, Mus musculus
tggcccagaatcaccatccagtgaa

SEQ ID NO: 148212 - DNA, 25 bp, Mus musculus
tggcccagatgaccgggacagaata

SEQ ID NO: 148213 - DNA, 25 bp, Mus musculus
tggcccagattcactagctacggag

SEQ ID NO: 148214 - DNA, 25 bp, Mus musculus
tggcccagcagatagccacactgtg

SEQ ID NO: 148215 - DNA, 25 bp, Mus musculus
tggcccagcccaaaattcgaaagga

SEQ ID NO: 148216 - DNA, 25 bp, Mus musculus
tggcccaggtgaacagctgccagta

SEQ ID NO: 148217 - DNA, 25 bp, Mus musculus
tggcccagtcggtcagcttgcagac

SEQ ID NO: 148218 - DNA, 25 bp, Mus musculus
tggcccatagagctttcgacaatga

SEQ ID NO: 148219 - DNA, 25 bp, Mus musculus
tggcccatccccatggtgacagagc

SEQ ID NO: 148220 - DNA, 25 bp, Mus musculus
tggcccatctggagatcaccactga

SEQ ID NO: 148221 - DNA, 25 bp, Mus musculus
tggcccattattttcagagcttaaa

SEQ ID NO: 148222 - DNA, 25 bp, Mus musculus
tggccccacagatgctgcgagaact

SEQ ID NO: 148223 - DNA, 25 bp, Mus musculus
tggccccagaagcatcaggtgtcct

SEQ ID NO: 148224 - DNA, 25 bp, Mus musculus
tggccccgaagtgaggctgtctgtt

SEQ ID NO: 148225 - DNA, 25 bp, Mus musculus
tggccccgcagatgtggaagtaact

SEQ ID NO: 148226 - DNA, 25 bp, Mus musculus
tggccccggcaggaaataacaagtt

SEQ ID NO: 148227 - DNA, 25 bp, Mus musculus
tggccccggctttggtggacattca

SEQ ID NO: 148228 - DNA, 25 bp, Mus musculus
tggccccgtgcggtgcctggtgtgg

SEQ ID NO: 148229 - DNA, 25 bp, Mus musculus
tggcccctcctgtggacaccaaagc

SEQ ID NO: 148230 - DNA, 25 bp, Mus musculus
tggcccctgcacaagctggaatgct

SEQ ID NO: 148231 - DNA, 25 bp, Mus musculus
tggcccctgccatggacatgcctga

SEQ ID NO: 148232 - DNA, 25 bp, Mus musculus
tggcccgatggtagcgtccgaggtt

SEQ ID NO: 148233 - DNA, 25 bp, Mus musculus
tggcccgcccataacacaatgaaca

SEQ ID NO: 148234 - DNA, 25 bp, Mus musculus
tggcccggctgtacacttctggaga

SEQ ID NO: 148235 - DNA, 25 bp, Mus musculus
tggcccgggagtattacagtgaagc

SEQ ID NO: 148236 - DNA, 25 bp, Mus musculus
tggcccgggtaccaccagatgtgtc

SEQ ID NO: 148237 - DNA, 25 bp, Mus musculus
tggcccgtgaagaacagtggtaaac

SEQ ID NO: 148238 - DNA, 25 bp, Mus musculus
tggccctaatgctcccttgtcatgg

SEQ ID NO: 148239 - DNA, 25 bp, Mus musculus
tggccctacagtgatccctactggg

SEQ ID NO: 148240 - DNA, 25 bp, Mus musculus
tggccctaggagtccccatagactc

SEQ ID NO: 148241 - DNA, 25 bp, Mus musculus
tggccctatgggagctgaagaactt

SEQ ID NO: 148242 - DNA, 25 bp, Mus musculus
tggccctcaaactcacatgaactgg

SEQ ID NO: 148243 - DNA, 25 bp, Mus musculus
tggccctccaaccactgaaaaaaca

SEQ ID NO: 148244 - DNA, 25 bp, Mus musculus
tggccctcgaccaggttcattgcag

SEQ ID NO: 148245 - DNA, 25 bp, Mus musculus
tggccctcggtgaagaagatctgtc

SEQ ID NO: 148246 - DNA, 25 bp, Mus musculus
tggccctctgacatagcagaggtgg

SEQ ID NO: 148247 - DNA, 25 bp, Mus musculus
tggccctgaccatcgcaaacatttc

SEQ ID NO: 148248 - DNA, 25 bp, Mus musculus
tggccctgagaaagcagaggcagcc

SEQ ID NO: 148249 - DNA, 25 bp, Mus musculus
tggccctgaggctgagtgactacct

SEQ ID NO: 148250 - DNA, 25 bp, Mus musculus
tggccctgtccacttgaggctgctc

SEQ ID NO: 148251 - DNA, 25 bp, Mus musculus
tggcccttgggaaccgcatggatct

SEQ ID NO: 148252 - DNA, 25 bp, Mus musculus
tggccctttccatgagctgacagtg

SEQ ID NO: 148253 - DNA, 25 bp, Mus musculus
tggccctttgggactgttgataaaa

SEQ ID NO: 148254 - DNA, 25 bp, Mus musculus
tggccgaactctttggcggccccga

SEQ ID NO: 148255 - DNA, 25 bp, Mus musculus
tggccgaagccatctcctacgtgga

SEQ ID NO: 148256 - DNA, 25 bp, Mus musculus
tggccgaatgtcttatcagatccga

SEQ ID NO: 148257 - DNA, 25 bp, Mus musculus
tggccgaattatatatgacaaaaca

SEQ ID NO: 148258 - DNA, 25 bp, Mus musculus
tggccgaattctagccctggctcga

SEQ ID NO: 148259 - DNA, 25 bp, Mus musculus
tggccgactctgcaaatctcgagga

SEQ ID NO: 148260 - DNA, 25 bp, Mus musculus
tggccgagctaccttccggatagag

SEQ ID NO: 148261 - DNA, 25 bp, Mus musculus
tggccgagctgagcgctggtgagga

SEQ ID NO: 148262 - DNA, 25 bp, Mus musculus
tggccgatcttctgcatcacgtgag

SEQ ID NO: 148263 - DNA, 25 bp, Mus musculus
tggccgcaaatacgactttacgtcc

SEQ ID NO: 148264 - DNA, 25 bp, Mus musculus
tggccgcagacgatttccgactaaa

SEQ ID NO: 148265 - DNA, 25 bp, Mus musculus
tggccgcagcagagaacatctagga

SEQ ID NO: 148266 - DNA, 25 bp, Mus musculus
tggccgcagcatcaagggttacact

SEQ ID NO: 148267 - DNA, 25 bp, Mus musculus
tggccgcagctcacgaatatctggt

SEQ ID NO: 148268 - DNA, 25 bp, Mus musculus
tggccgcagtgctacgccagtacaa

SEQ ID NO: 148269 - DNA, 25 bp, Mus musculus
tggccgccgcggtgcgggagggagc

SEQ ID NO: 148270 - DNA, 25 bp, Mus musculus
tggccgcgcccagagcgtagttctt

SEQ ID NO: 148271 - DNA, 25 bp, Mus musculus
tggccgcgccttctacttgcaactg

SEQ ID NO: 148272 - DNA, 25 bp, Mus musculus
tggccgcttccacacttccatgagg

SEQ ID NO: 148273 - DNA, 25 bp, Mus musculus
tggccgcttgcgttcatgcgcgccg

SEQ ID NO: 148274 - DNA, 25 bp, Mus musculus
tggccggaccatggaaatcgagtct

SEQ ID NO: 148275 - DNA, 25 bp, Mus musculus
tggccggagctataaacagcgaagc

SEQ ID NO: 148276 - DNA, 25 bp, Mus musculus
tggccggcgccagtttgatcacttg

SEQ ID NO: 148277 - DNA, 25 bp, Mus musculus
tggccggcggaagtactcgacagtt

SEQ ID NO: 148278 - DNA, 25 bp, Mus musculus
tggccggctccatagagaagcagaa

SEQ ID NO: 148279 - DNA, 25 bp, Mus musculus
tggccgggccagatccagtaaatac

SEQ ID NO: 148280 - DNA, 25 bp, Mus musculus
tggccgggcgtcagtacattcaatg

SEQ ID NO: 148281 - DNA, 25 bp, Mus musculus
tggccgggctaaggccgtttcgatc

SEQ ID NO: 148282 - DNA, 25 bp, Mus musculus
tggccggggcgagcgagtgagggcc

SEQ ID NO: 148283 - DNA, 25 bp, Mus musculus
tggccgtagccagtaccaagactct

SEQ ID NO: 148284 - DNA, 25 bp, Mus musculus
tggccgtccctctgtaaatagcaaa

SEQ ID NO: 148285 - DNA, 25 bp, Mus musculus
tggccgtcggttttctgagggaaca

SEQ ID NO: 148286 - DNA, 25 bp, Mus musculus
tggccgtcttttccagcctgcagag

SEQ ID NO: 148287 - DNA, 25 bp, Mus musculus
tggccgtgcagtgcttgaatgaact

SEQ ID NO: 148288 - DNA, 25 bp, Mus musculus
tggccgtgcttcctgctcgtatgac

SEQ ID NO: 148289 - DNA, 25 bp, Mus musculus
tggccgttgacatgcaaacctagag

SEQ ID NO: 148290 - DNA, 25 bp, Mus musculus
tggcctaaaaaagccgtccagcaat

SEQ ID NO: 148291 - DNA, 25 bp, Mus musculus
tggcctacaagactgagatcatcgg

SEQ ID NO: 148292 - DNA, 25 bp, Mus musculus
tggcctaccatgacctcttgagtcg

SEQ ID NO: 148293 - DNA, 25 bp, Mus musculus
tggcctaccgcgatgcattttggga

SEQ ID NO: 148294 - DNA, 25 bp, Mus musculus
tggcctacctggagacacgtctggc

SEQ ID NO: 148295 - DNA, 25 bp, Mus musculus
tggcctacgctttcccacgcgtgag

SEQ ID NO: 148296 - DNA, 25 bp, Mus musculus
tggcctagatgactcgggtgtaaac

SEQ ID NO: 148297 - DNA, 25 bp, Mus musculus
tggcctataaggatgggtcccctgc

SEQ ID NO: 148298 - DNA, 25 bp, Mus musculus
tggcctcaaggaagacactctggaa

SEQ ID NO: 148299 - DNA, 25 bp, Mus musculus
tggcctcacacctcggagtctcaat

SEQ ID NO: 148300 - DNA, 25 bp, Mus musculus
tggcctcactgcattgggactgaaa

SEQ ID NO: 148301 - DNA, 25 bp, Mus musculus
tggcctcagccgtgggtgtcacaca

SEQ ID NO: 148302 - DNA, 25 bp, Mus musculus
tggcctccaatgtagcaagctctgt

SEQ ID NO: 148303 - DNA, 25 bp, Mus musculus
tggcctccagttcacaaagagcctc

SEQ ID NO: 148304 - DNA, 25 bp, Mus musculus
tggcctcccagagaagctgatcagg

SEQ ID NO: 148305 - DNA, 25 bp, Mus musculus
tggcctcccggaattcactctgctg

SEQ ID NO: 148306 - DNA, 25 bp, Mus musculus
tggcctccgggacgctttattagat

SEQ ID NO: 148307 - DNA, 25 bp, Mus musculus
tggcctccggttcagctgacaggac

SEQ ID NO: 148308 - DNA, 25 bp, Mus musculus
tggcctcctgggagcttcgagtaga

SEQ ID NO: 148309 - DNA, 25 bp, Mus musculus
tggcctcggccgagctggattacag

SEQ ID NO: 148310 - DNA, 25 bp, Mus musculus
tggcctcgggaggacaacatttgga

SEQ ID NO: 148311 - DNA, 25 bp, Mus musculus
tggcctctccaaacgcagagtatgt

SEQ ID NO: 148312 - DNA, 25 bp, Mus musculus
tggcctctccaggaatgctgctggg

SEQ ID NO: 148313 - DNA, 25 bp, Mus musculus
tggcctctctccagtagaactcggg

SEQ ID NO: 148314 - DNA, 25 bp, Mus musculus
tggcctctgagcaagcggagccaaa

SEQ ID NO: 148315 - DNA, 25 bp, Mus musculus
tggcctctgcggagattccaggccc

SEQ ID NO: 148316 - DNA, 25 bp, Mus musculus
tggcctctgcttcactttcgtctct

SEQ ID NO: 148317 - DNA, 25 bp, Mus musculus
tggcctctggagtcttaaagcaagt

SEQ ID NO: 148318 - DNA, 25 bp, Mus musculus
tggcctgaacatcgccctggtgaat

SEQ ID NO: 148319 - DNA, 25 bp, Mus musculus
tggcctgaccccagagacttggaag

SEQ ID NO: 148320 - DNA, 25 bp, Mus musculus
tggcctgacctctgacccacgtgag

SEQ ID NO: 148321 - DNA, 25 bp, Mus musculus
tggcctgagaggacagcctggcaat

SEQ ID NO: 148322 - DNA, 25 bp, Mus musculus
tggcctgagcaccatcccaggtgag

SEQ ID NO: 148323 - DNA, 25 bp, Mus musculus
tggcctgaggagtcggcggccatct

SEQ ID NO: 148324 - DNA, 25 bp, Mus musculus
tggcctgccgcatctccgatgactt

SEQ ID NO: 148325 - DNA, 25 bp, Mus musculus
tggcctgcgagtttctcctccaaaa

SEQ ID NO: 148326 - DNA, 25 bp, Mus musculus
tggcctggcatattgaccctttcgg

SEQ ID NO: 148327 - DNA, 25 bp, Mus musculus
tggcctggcgaagcgtagtcaaagt

SEQ ID NO: 148328 - DNA, 25 bp, Mus musculus
tggcctggcgtactcaaacctggtg

SEQ ID NO: 148329 - DNA, 25 bp, Mus musculus
tggcctggtcttcgagtatccaagg

SEQ ID NO: 148330 - DNA, 25 bp, Mus musculus
tggcctggtgccaaaaaactacgtt

SEQ ID NO: 148331 - DNA, 25 bp, Mus musculus
tggcctgtcggtgctgcggaccttc

SEQ ID NO: 148332 - DNA, 25 bp, Mus musculus
tggcctgtgagtacctgagcaaaga

SEQ ID NO: 148333 - DNA, 25 bp, Mus musculus
tggcctgtgcccgaggtagcatcgt

SEQ ID NO: 148334 - DNA, 25 bp, Mus musculus
tggccttcaccccagaattgagacg

SEQ ID NO: 148335 - DNA, 25 bp, Mus musculus
tggccttccagatcagcaaggagta

SEQ ID NO: 148336 - DNA, 25 bp, Mus musculus
tggccttcggaaagtggaaatggct

SEQ ID NO: 148337 - DNA, 25 bp, Mus musculus
tggccttctacgcaacctgcgatgc

SEQ ID NO: 148338 - DNA, 25 bp, Mus musculus
tggccttctgataccttcacagggc

SEQ ID NO: 148339 - DNA, 25 bp, Mus musculus
tggccttgaccgaagcttcctggaa

SEQ ID NO: 148340 - DNA, 25 bp, Mus musculus
tggcgaaacccaggctctgagatgc

SEQ ID NO: 148341 - DNA, 25 bp, Mus musculus
tggcgaagaccatcatcagtgacgt

SEQ ID NO: 148342 - DNA, 25 bp, Mus musculus
tggcgaagcaagatcctcctgggct

SEQ ID NO: 148343 - DNA, 25 bp, Mus musculus
tggcgaagcctcacagaaatttgga

SEQ ID NO: 148344 - DNA, 25 bp, Mus musculus
tggcgaagcggaggccatcttcaaa

SEQ ID NO: 148345 - DNA, 25 bp, Mus musculus
tggcgaaggctggttacctgcataa

SEQ ID NO: 148346 - DNA, 25 bp, Mus musculus
tggcgacccaaagctgaagagacct

SEQ ID NO: 148347 - DNA, 25 bp, Mus musculus
tggcgacgccgtgagtaagtgacaa

SEQ ID NO: 148348 - DNA, 25 bp, Mus musculus
tggcgacgtagaagaagacgcttcc

SEQ ID NO: 148349 - DNA, 25 bp, Mus musculus
tggcgactccagtggtaagtcttta

SEQ ID NO: 148350 - DNA, 25 bp, Mus musculus
tggcgactccatggctactcgggaa

SEQ ID NO: 148351 - DNA, 25 bp, Mus musculus
tggcgactccttgctcatcacgtgt

SEQ ID NO: 148352 - DNA, 25 bp, Mus musculus
tggcgagagtccttcatcgtcgcag

SEQ ID NO: 148353 - DNA, 25 bp, Mus musculus
tggcgagctcatcctgcagtctggc

SEQ ID NO: 148354 - DNA, 25 bp, Mus musculus
tggcgaggcccagcgattcttgaag

SEQ ID NO: 148355 - DNA, 25 bp, Mus musculus
tggcgagggcactgcagaagaacac

SEQ ID NO: 148356 - DNA, 25 bp, Mus musculus
tggcgagggccaactgtgctataac

SEQ ID NO: 148357 - DNA, 25 bp, Mus musculus
tggcgagtctctacaaggcttagca

SEQ ID NO: 148358 - DNA, 25 bp, Mus musculus
tggcgagttagaagctgcccctcac

SEQ ID NO: 148359 - DNA, 25 bp, Mus musculus
tggcgatgaagatccaacttgcccc

SEQ ID NO: 148360 - DNA, 25 bp, Mus musculus
tggcgatggacactgtaattccagt

SEQ ID NO: 148361 - DNA, 25 bp, Mus musculus
tggcgatggctacaaacgactcaat

SEQ ID NO: 148362 - DNA, 25 bp, Mus musculus
tggcgcaacccagatgagcaacaga

SEQ ID NO: 148363 - DNA, 25 bp, Mus musculus
tggcgcacagttcattttttccaga

SEQ ID NO: 148364 - DNA, 25 bp, Mus musculus
tggcgcaggccatgtggccgaccct

SEQ ID NO: 148365 - DNA, 25 bp, Mus musculus
tggcgccaaccatggaggaggctac

SEQ ID NO: 148366 - DNA, 25 bp, Mus musculus
tggcgccccatgcagatctgaacgt

SEQ ID NO: 148367 - DNA, 25 bp, Mus musculus
tggcgcctaccctaaactcatggag

SEQ ID NO: 148368 - DNA, 25 bp, Mus musculus
tggcgcctaccctctgcctgtgggg

SEQ ID NO: 148369 - DNA, 25 bp, Mus musculus
tggcgcctggtcgttgccttcttgg

SEQ ID NO: 148370 - DNA, 25 bp, Mus musculus
tggcgccttacgtgaaccaagtgaa

SEQ ID NO: 148371 - DNA, 25 bp, Mus musculus
tggcgcgcgagaaagcgcccggtcg

SEQ ID NO: 148372 - DNA, 25 bp, Mus musculus
tggcgctgcccaaggctatacctgt

SEQ ID NO: 148373 - DNA, 25 bp, Mus musculus
tggcgctgcgactgccgcctattgc

SEQ ID NO: 148374 - DNA, 25 bp, Mus musculus
tggcgctggatcaacaactctgtgt

SEQ ID NO: 148375 - DNA, 25 bp, Mus musculus
tggcgctggtcttccggctctggac

SEQ ID NO: 148376 - DNA, 25 bp, Mus musculus
tggcgctgtcagaagaagaacggct

SEQ ID NO: 148377 - DNA, 25 bp, Mus musculus
tggcgcttctgccagcagctcatct

SEQ ID NO: 148378 - DNA, 25 bp, Mus musculus
tggcggaaggacatggacactgtct

SEQ ID NO: 148379 - DNA, 25 bp, Mus musculus
tggcggaatcagctcatttcataat

SEQ ID NO: 148380 - DNA, 25 bp, Mus musculus
tggcggacataccatctgacctcag

SEQ ID NO: 148381 - DNA, 25 bp, Mus musculus
tggcggagaaatggctctgagaccc

SEQ ID NO: 148382 - DNA, 25 bp, Mus musculus
tggcggagatgaacaggctgctatc

SEQ ID NO: 148383 - DNA, 25 bp, Mus musculus
tggcggccatgacaacagtgacatt

SEQ ID NO: 148384 - DNA, 25 bp, Mus musculus
tggcggccggtgagtgattctccct

SEQ ID NO: 148385 - DNA, 25 bp, Mus musculus
tggcggcgctgtgtctggcttcctt

SEQ ID NO: 148386 - DNA, 25 bp, Mus musculus
tggcgggacgcgggggaggcgcgcg

SEQ ID NO: 148387 - DNA, 25 bp, Mus musculus
tggcgggcattgtgcccgccacgat

SEQ ID NO: 148388 - DNA, 25 bp, Mus musculus
tggcggtccctgaagctgtgttttc

SEQ ID NO: 148389 - DNA, 25 bp, Mus musculus
tggcggttcctctctcagcagtgca

SEQ ID NO: 148390 - DNA, 25 bp, Mus musculus
tggcgtagacgtttcctggctatgg

SEQ ID NO: 148391 - DNA, 25 bp, Mus musculus
tggcgtcagacataccaggatctgt

SEQ ID NO: 148392 - DNA, 25 bp, Mus musculus
tggcgtcagtcaaaacacagacctg

SEQ ID NO: 148393 - DNA, 25 bp, Mus musculus
tggcgtccatcatccctgagaggaa

SEQ ID NO: 148394 - DNA, 25 bp, Mus musculus
tggcgtggacttcgccctcaaagtt

SEQ ID NO: 148395 - DNA, 25 bp, Mus musculus
tggcgtggtcaatatcgttcccgga

SEQ ID NO: 148396 - DNA, 25 bp, Mus musculus
tggcgtgtgatagcgaagacccaac

SEQ ID NO: 148397 - DNA, 25 bp, Mus musculus
tggcgtgttgtctgagttgagtctt

SEQ ID NO: 148398 - DNA, 25 bp, Mus musculus
tggcgttttcctaaaagagccagac

SEQ ID NO: 148399 - DNA, 25 bp, Mus musculus
tggctaaccagaagcaacggcatct

SEQ ID NO: 148400 - DNA, 25 bp, Mus musculus
tggctaagacagagatgaccgcatc

SEQ ID NO: 148401 - DNA, 25 bp, Mus musculus
tggctaagattcacaccatccacgc

SEQ ID NO: 148402 - DNA, 25 bp, Mus musculus
tggctaatgctgtgcgtcctggacc

SEQ ID NO: 148403 - DNA, 25 bp, Mus musculus
tggctaattcaccagacaaaggagc

SEQ ID NO: 148404 - DNA, 25 bp, Mus musculus
tggctacaaagcaccgtcaggacag

SEQ ID NO: 148405 - DNA, 25 bp, Mus musculus
tggctacagagaaaaggcagctccg

SEQ ID NO: 148406 - DNA, 25 bp, Mus musculus
tggctacagcatgactttgggcacc

SEQ ID NO: 148407 - DNA, 25 bp, Mus musculus
tggctacaggcctgcagacagagct

SEQ ID NO: 148408 - DNA, 25 bp, Mus musculus
tggctacagtgacccagtgctgaaa

SEQ ID NO: 148409 - DNA, 25 bp, Mus musculus
tggctacagtgtcaatggaggatct

SEQ ID NO: 148410 - DNA, 25 bp, Mus musculus
tggctacatcggaccctgggcagat

SEQ ID NO: 148411 - DNA, 25 bp, Mus musculus
tggctacatcttcggcaagcggatc

SEQ ID NO: 148412 - DNA, 25 bp, Mus musculus
tggctaccggttagacgagatcccc

SEQ ID NO: 148413 - DNA, 25 bp, Mus musculus
tggctacctgcgtggtgctggcact

SEQ ID NO: 148414 - DNA, 25 bp, Mus musculus
tggctacgccggtacatcaagtggc

SEQ ID NO: 148415 - DNA, 25 bp, Mus musculus
tggctacggctttgaccaggctctg

SEQ ID NO: 148416 - DNA, 25 bp, Mus musculus
tggctactctgaagacaaggatggg

SEQ ID NO: 148417 - DNA, 25 bp, Mus musculus
tggctactctggagttgaagtccga

SEQ ID NO: 148418 - DNA, 25 bp, Mus musculus
tggctactggagaggacccaactag

SEQ ID NO: 148419 - DNA, 25 bp, Mus musculus
tggctagacgaacacacactggtca

SEQ ID NO: 148420 - DNA, 25 bp, Mus musculus
tggctagagaccagaaagcacgcga

SEQ ID NO: 148421 - DNA, 25 bp, Mus musculus
tggctagatcaggttcatgcactga

SEQ ID NO: 148422 - DNA, 25 bp, Mus musculus
tggctagcagcacacaaggacactt

SEQ ID NO: 148423 - DNA, 25 bp, Mus musculus
tggctaggtttctgcggtcgcgtca

SEQ ID NO: 148424 - DNA, 25 bp, Mus musculus
tggctataccagcagcatacaggaa

SEQ ID NO: 148425 - DNA, 25 bp, Mus musculus
tggctatacggatgctcacggtgac

SEQ ID NO: 148426 - DNA, 25 bp, Mus musculus
tggctatcaagaaggacactgggcg

SEQ ID NO: 148427 - DNA, 25 bp, Mus musculus
tggctatcctgggtccacagcagag

SEQ ID NO: 148428 - DNA, 25 bp, Mus musculus
tggctatgaactcccatcctgagga

SEQ ID NO: 148429 - DNA, 25 bp, Mus musculus
tggctcaagtacatcagattcgctg

SEQ ID NO: 148430 - DNA, 25 bp, Mus musculus
tggctcaagttgtagaaacatcagc

SEQ ID NO: 148431 - DNA, 25 bp, Mus musculus
tggctcacgattagattaccgtcgc

SEQ ID NO: 148432 - DNA, 25 bp, Mus musculus
tggctcacggcctgtgacaggcagt

SEQ ID NO: 148433 - DNA, 25 bp, Mus musculus
tggctcagacgatgccacatgcagg

SEQ ID NO: 148434 - DNA, 25 bp, Mus musculus
tggctcagcaggtggccctaaggtt

SEQ ID NO: 148435 - DNA, 25 bp, Mus musculus
tggctcaggtctgcagcaggttccg

SEQ ID NO: 148436 - DNA, 25 bp, Mus musculus
tggctcatggccagtggctatcccc

SEQ ID NO: 148437 - DNA, 25 bp, Mus musculus
tggctccaactttgtaccacttaaa

SEQ ID NO: 148438 - DNA, 25 bp, Mus musculus
tggctccatttttgaatcccgtgta

SEQ ID NO: 148439 - DNA, 25 bp, Mus musculus
tggctcccagaacatatgctgatct

SEQ ID NO: 148440 - DNA, 25 bp, Mus musculus
tggctcccagaagatccctaaagga

SEQ ID NO: 148441 - DNA, 25 bp, Mus musculus
tggctccctaatcaagatgaccagg

SEQ ID NO: 148442 - DNA, 25 bp, Mus musculus
tggctccctcattttccatagacct

SEQ ID NO: 148443 - DNA, 25 bp, Mus musculus
tggctccggcgaacgattcattcgg

SEQ ID NO: 148444 - DNA, 25 bp, Mus musculus
tggctcctcccatagctggctagtc

SEQ ID NO: 148445 - DNA, 25 bp, Mus musculus
tggctcctgacgagacgcatacctg

SEQ ID NO: 148446 - DNA, 25 bp, Mus musculus
tggctcctggagtttgcagcaaagc

SEQ ID NO: 148447 - DNA, 25 bp, Mus musculus
tggctcctgggacaactaactaact

SEQ ID NO: 148448 - DNA, 25 bp, Mus musculus
tggctcctttggaaacctggagaac

SEQ ID NO: 148449 - DNA, 25 bp, Mus musculus
tggctcgatgtgattgagaaggacc

SEQ ID NO: 148450 - DNA, 25 bp, Mus musculus
tggctcgcagggaccgaattgtgat

SEQ ID NO: 148451 - DNA, 25 bp, Mus musculus
tggctcggaatggttacgcccgctg

SEQ ID NO: 148452 - DNA, 25 bp, Mus musculus
tggctcggaggctccgcgccctttg

SEQ ID NO: 148453 - DNA, 25 bp, Mus musculus
tggctcgggagttcctggcagccac

SEQ ID NO: 148454 - DNA, 25 bp, Mus musculus
tggctctgcgctgtctttagttgtg

SEQ ID NO: 148455 - DNA, 25 bp, Mus musculus
tggctctgggtctgtggtcactctc

SEQ ID NO: 148456 - DNA, 25 bp, Mus musculus
tggctcttgatagcaagctgggcaa

SEQ ID NO: 148457 - DNA, 25 bp, Mus musculus
tggctcttgtcctcatgcagcgtgg

SEQ ID NO: 148458 - DNA, 25 bp, Mus musculus
tggctgaacatgaagacgcactcct

SEQ ID NO: 148459 - DNA, 25 bp, Mus musculus
tggctgaacatgaagggacctctct

SEQ ID NO: 148460 - DNA, 25 bp, Mus musculus
tggctgaccataaaagactttgtga

SEQ ID NO: 148461 - DNA, 25 bp, Mus musculus
tggctgacctgaaccctccagaagt

SEQ ID NO: 148462 - DNA, 25 bp, Mus musculus
tggctgacgaagaaacgcccgttca

SEQ ID NO: 148463 - DNA, 25 bp, Mus musculus
tggctgactcatcctgcacacgtga

SEQ ID NO: 148464 - DNA, 25 bp, Mus musculus
tggctgagaagttcacccctcgaag

SEQ ID NO: 148465 - DNA, 25 bp, Mus musculus
tggctgagcgagcatctgagctacc

SEQ ID NO: 148466 - DNA, 25 bp, Mus musculus
tggctgatgtcaaccctgagccgcg

SEQ ID NO: 148467 - DNA, 25 bp, Mus musculus
tggctgattgcctgaaaaactgtaa

SEQ ID NO: 148468 - DNA, 25 bp, Mus musculus
tggctgcaaccgaaaaatcaaggac

SEQ ID NO: 148469 - DNA, 25 bp, Mus musculus
tggctgcaatgctttcccaggactc

SEQ ID NO: 148470 - DNA, 25 bp, Mus musculus
tggctgcaccgtcacattgctggag

SEQ ID NO: 148471 - DNA, 25 bp, Mus musculus
tggctgcacctatcaactccgggta

SEQ ID NO: 148472 - DNA, 25 bp, Mus musculus
tggctgcagacttcatccaacaggg

SEQ ID NO: 148473 - DNA, 25 bp, Mus musculus
tggctgcagtcaaagggattcaacc

SEQ ID NO: 148474 - DNA, 25 bp, Mus musculus
tggctgcatttaaacctgtcggtgg

SEQ ID NO: 148475 - DNA, 25 bp, Mus musculus
tggctgccacaagtatgctgattac

SEQ ID NO: 148476 - DNA, 25 bp, Mus musculus
tggctgccaccaacatgaacgagac

SEQ ID NO: 148477 - DNA, 25 bp, Mus musculus
tggctgccagcgatgttaccaagca

SEQ ID NO: 148478 - DNA, 25 bp, Mus musculus
tggctgcccacgaggccatcaccat

SEQ ID NO: 148479 - DNA, 25 bp, Mus musculus
tggctgccctgcacaaagtcgttga

SEQ ID NO: 148480 - DNA, 25 bp, Mus musculus
tggctgccgaagtcactcattacgt

SEQ ID NO: 148481 - DNA, 25 bp, Mus musculus
tggctgcctccactatgcctgtgtc

SEQ ID NO: 148482 - DNA, 25 bp, Mus musculus
tggctgcgcgggaggcctgacattg

SEQ ID NO: 148483 - DNA, 25 bp, Mus musculus
tggctgcggcactattgtctactgt

SEQ ID NO: 148484 - DNA, 25 bp, Mus musculus
tggctgcggctacgatgctgctctt

SEQ ID NO: 148485 - DNA, 25 bp, Mus musculus
tggctgcgtggcttcaggtgtctcc

SEQ ID NO: 148486 - DNA, 25 bp, Mus musculus
tggctgctacaaggatcatggaaac

SEQ ID NO: 148487 - DNA, 25 bp, Mus musculus
tggctgctactgacctgttgaaaag

SEQ ID NO: 148488 - DNA, 25 bp, Mus musculus
tggctgctcgccctgtgtttttgac

SEQ ID NO: 148489 - DNA, 25 bp, Mus musculus
tggctgctggctcaacaaggttctg

SEQ ID NO: 148490 - DNA, 25 bp, Mus musculus
tggctgctgtaaagtgatccgtcac

SEQ ID NO: 148491 - DNA, 25 bp, Mus musculus
tggctgctgtcaaaaagcaactgag

SEQ ID NO: 148492 - DNA, 25 bp, Mus musculus
tggctggaagcaatcaaaatgggtc

SEQ ID NO: 148493 - DNA, 25 bp, Mus musculus
tggctggaccgactaatgccatctt

SEQ ID NO: 148494 - DNA, 25 bp, Mus musculus
tggctggactgtgaccaactccctt

SEQ ID NO: 148495 - DNA, 25 bp, Mus musculus
tggctggcgatcaccactctggctt

SEQ ID NO: 148496 - DNA, 25 bp, Mus musculus
tggctggctccgatcaaagaaggct

SEQ ID NO: 148497 - DNA, 25 bp, Mus musculus
tggctggctggtagacccctggcca

SEQ ID NO: 148498 - DNA, 25 bp, Mus musculus
tggctgggaagctcaacacattggc

SEQ ID NO: 148499 - DNA, 25 bp, Mus musculus
tggctgggaccgtgcacttgcgcct

SEQ ID NO: 148500 - DNA, 25 bp, Mus musculus
tggctgggcacagggtaaactcttc

SEQ ID NO: 148501 - DNA, 25 bp, Mus musculus
tggctggtcagctgcctcagcaaag

SEQ ID NO: 148502 - DNA, 25 bp, Mus musculus
tggctggtgccagacaaatccattc

SEQ ID NO: 148503 - DNA, 25 bp, Mus musculus
tggctggtgtgtcctcggaggcgga

SEQ ID NO: 148504 - DNA, 25 bp, Mus musculus
tggctgtaagtaccgtctctttgtc

SEQ ID NO: 148505 - DNA, 25 bp, Mus musculus
tggctgtagcgcttcggagcgactc

SEQ ID NO: 148506 - DNA, 25 bp, Mus musculus
tggctgtccccaagatagaaatgtt

SEQ ID NO: 148507 - DNA, 25 bp, Mus musculus
tggctgtgcatctgcctccaggtgc

SEQ ID NO: 148508 - DNA, 25 bp, Mus musculus
tggctgtgccccagttggactcaag

SEQ ID NO: 148509 - DNA, 25 bp, Mus musculus
tggctgtgctggagaacccgagccc

SEQ ID NO: 148510 - DNA, 25 bp, Mus musculus
tggctgtggccaaatgagtcctcat

SEQ ID NO: 148511 - DNA, 25 bp, Mus musculus
tggctgtggccgacggcgcgtctga

SEQ ID NO: 148512 - DNA, 25 bp, Mus musculus
tggctgtggctgactatgtggaacc

SEQ ID NO: 148513 - DNA, 25 bp, Mus musculus
tggctgtggtaattctgggatttgc

SEQ ID NO: 148514 - DNA, 25 bp, Mus musculus
tggctgttatctatgcgggtgtacg

SEQ ID NO: 148515 - DNA, 25 bp, Mus musculus
tggcttaaggccacacgggtgatcc

SEQ ID NO: 148516 - DNA, 25 bp, Mus musculus
tggcttacgatctatggctctgcac

SEQ ID NO: 148517 - DNA, 25 bp, Mus musculus
tggcttatcatcaccctggtacggg

SEQ ID NO: 148518 - DNA, 25 bp, Mus musculus
tggcttcaccggacctaaaaatggg

SEQ ID NO: 148519 - DNA, 25 bp, Mus musculus
tggcttcagaccaccgtcacagaga

SEQ ID NO: 148520 - DNA, 25 bp, Mus musculus
tggcttcagcgatcagtgagggtac

SEQ ID NO: 148521 - DNA, 25 bp, Mus musculus
tggcttcaggccagcaaacggagga

SEQ ID NO: 148522 - DNA, 25 bp, Mus musculus
tggcttccaagtcccacaaaaggtg

SEQ ID NO: 148523 - DNA, 25 bp, Mus musculus
tggcttccacttggacctggacttc

SEQ ID NO: 148524 - DNA, 25 bp, Mus musculus
tggcttcctggtgccatggtcacac

SEQ ID NO: 148525 - DNA, 25 bp, Mus musculus
tggcttcgacactctgctgaaaaag

SEQ ID NO: 148526 - DNA, 25 bp, Mus musculus
tggcttcggagcatccagcaggtgc

SEQ ID NO: 148527 - DNA, 25 bp, Mus musculus
tggcttctcccttcgtggtgctgta

SEQ ID NO: 148528 - DNA, 25 bp, Mus musculus
tggcttctgctccaaccggatctgg

SEQ ID NO: 148529 - DNA, 25 bp, Mus musculus
tggcttgatctagcccaattctggc

SEQ ID NO: 148530 - DNA, 25 bp, Mus musculus
tggcttgtgccattcccgtgactgt

SEQ ID NO: 148531 - DNA, 25 bp, Mus musculus
tggcttgtgggcatcctaaaattcc

SEQ ID NO: 148532 - DNA, 25 bp, Mus musculus
tggcttgttccatcgtggaccagaa

SEQ ID NO: 148533 - DNA, 25 bp, Mus musculus
tggcttgtttccctcaatgcaggag

SEQ ID NO: 148534 - DNA, 25 bp, Mus musculus
tggctttaaaatagaccctgtggaa

SEQ ID NO: 148535 - DNA, 25 bp, Mus musculus
tggctttaactgtagccctgtcagg

SEQ ID NO: 148536 - DNA, 25 bp, Mus musculus
tggctttagccctgaacctgatgcg

SEQ ID NO: 148537 - DNA, 25 bp, Mus musculus
tggctttagttcttcaggcctccgc

SEQ ID NO: 148538 - DNA, 25 bp, Mus musculus
tggctttcaaaggagtctggactca

SEQ ID NO: 148539 - DNA, 25 bp, Mus musculus
tggctttccccaaagagtggttctc

SEQ ID NO: 148540 - DNA, 25 bp, Mus musculus
tggctttccgcttccgctggaggga

SEQ ID NO: 148541 - DNA, 25 bp, Mus musculus
tggctttccgtcctccaggtcgggc

SEQ ID NO: 148542 - DNA, 25 bp, Mus musculus
tggctttcgttcactttcctgggct

SEQ ID NO: 148543 - DNA, 25 bp, Mus musculus
tggctttgattctgaaagccatgcg

SEQ ID NO: 148544 - DNA, 25 bp, Mus musculus
tggctttgcccaggatgatctgcag

SEQ ID NO: 148545 - DNA, 25 bp, Mus musculus
tggctttggacatcgacagggacac

SEQ ID NO: 148546 - DNA, 25 bp, Mus musculus
tggctttggcattgccctgagcacc

SEQ ID NO: 148547 - DNA, 25 bp, Mus musculus
tggctttgggctttgtgacaggcac

SEQ ID NO: 148548 - DNA, 25 bp, Mus musculus
tggctttggtgttagctctggagac

SEQ ID NO: 148549 - DNA, 25 bp, Mus musculus
tggctttgtcccacctgaagtgaca

SEQ ID NO: 148550 - DNA, 25 bp, Mus musculus
tggcttttacaagggaattatccca

SEQ ID NO: 148551 - DNA, 25 bp, Mus musculus
tggctttttgagtaccaccggccca

SEQ ID NO: 148552 - DNA, 25 bp, Mus musculus
tgggaaaaatagtcccctgtgaatt

SEQ ID NO: 148553 - DNA, 25 bp, Mus musculus
tgggaaaagatggtcaacgtgctga

SEQ ID NO: 148554 - DNA, 25 bp, Mus musculus
tgggaaaaggaccaggtgaccgtgc

SEQ ID NO: 148555 - DNA, 25 bp, Mus musculus
tgggaaaaggtagacctcactctgc

SEQ ID NO: 148556 - DNA, 25 bp, Mus musculus
tgggaaaatccctccgtgctgaaga

SEQ ID NO: 148557 - DNA, 25 bp, Mus musculus
tgggaaacacacacttggcgagaac

SEQ ID NO: 148558 - DNA, 25 bp, Mus musculus
tgggaaaccctgcttcaaggcttgg

SEQ ID NO: 148559 - DNA, 25 bp, Mus musculus
tgggaaacccttcagcaaatggcct

SEQ ID NO: 148560 - DNA, 25 bp, Mus musculus
tgggaaaccttttgcagttgtcctg

SEQ ID NO: 148561 - DNA, 25 bp, Mus musculus
tgggaaactcagctccagtctgcag

SEQ ID NO: 148562 - DNA, 25 bp, Mus musculus
tgggaaactctactccgtggatgac

SEQ ID NO: 148563 - DNA, 25 bp, Mus musculus
tgggaaagactttagccggagctca

SEQ ID NO: 148564 - DNA, 25 bp, Mus musculus
tgggaaagccgaagactcttcagac

SEQ ID NO: 148565 - DNA, 25 bp, Mus musculus
tgggaaagcctccacaatgtagatg

SEQ ID NO: 148566 - DNA, 25 bp, Mus musculus
tgggaaagctcccttgaccaagcct

SEQ ID NO: 148567 - DNA, 25 bp, Mus musculus
tgggaaagctggtctccatggccgt

SEQ ID NO: 148568 - DNA, 25 bp, Mus musculus
tgggaaaggctacactcaggacaac

SEQ ID NO: 148569 - DNA, 25 bp, Mus musculus
tgggaaagtaaaaatatccttgcgg

SEQ ID NO: 148570 - DNA, 25 bp, Mus musculus
tgggaaatggcacgaaggactctac

SEQ ID NO: 148571 - DNA, 25 bp, Mus musculus
tgggaacacccctttgcatatagca

SEQ ID NO: 148572 - DNA, 25 bp, Mus musculus
tgggaacactgctcaccttggtcaa

SEQ ID NO: 148573 - DNA, 25 bp, Mus musculus
tgggaacagatagtccagtccacct

SEQ ID NO: 148574 - DNA, 25 bp, Mus musculus
tgggaacagcgtcacacagtatgtc

SEQ ID NO: 148575 - DNA, 25 bp, Mus musculus
tgggaaccacctatgcagatgacgg

SEQ ID NO: 148576 - DNA, 25 bp, Mus musculus
tgggaaccactgatgtaactgtcac

SEQ ID NO: 148577 - DNA, 25 bp, Mus musculus
tgggaaccatcacgaagcgaacagg

SEQ ID NO: 148578 - DNA, 25 bp, Mus musculus
tgggaacccacctctgagacaaggg

SEQ ID NO: 148579 - DNA, 25 bp, Mus musculus
tgggaacctgtacccggctgctatg

SEQ ID NO: 148580 - DNA, 25 bp, Mus musculus
tgggaactccgcagcagagacttca

SEQ ID NO: 148581 - DNA, 25 bp, Mus musculus
tgggaactgactctctgcctgcttg

SEQ ID NO: 148582 - DNA, 25 bp, Mus musculus
tgggaactgtacctgaaggagaact

SEQ ID NO: 148583 - DNA, 25 bp, Mus musculus
tgggaacttcctaggacatgcaagg

SEQ ID NO: 148584 - DNA, 25 bp, Mus musculus
tgggaacttttcatggacagccgcc

SEQ ID NO: 148585 - DNA, 25 bp, Mus musculus
tgggaagaagccacaccaatatgga

SEQ ID NO: 148586 - DNA, 25 bp, Mus musculus
tgggaagaaggcatcatgtctggct

SEQ ID NO: 148587 - DNA, 25 bp, Mus musculus
tgggaagacatgtccccgagactct

SEQ ID NO: 148588 - DNA, 25 bp, Mus musculus
tgggaagacccatgccctgagagca

SEQ ID NO: 148589 - DNA, 25 bp, Mus musculus
tgggaagacgacatgcctggagttc

SEQ ID NO: 148590 - DNA, 25 bp, Mus musculus
tgggaagactaagaccgtgcctgga

SEQ ID NO: 148591 - DNA, 25 bp, Mus musculus
tgggaagatacctgaacatgacctg

SEQ ID NO: 148592 - DNA, 25 bp, Mus musculus
tgggaagatcccagcagctgttacc

SEQ ID NO: 148593 - DNA, 25 bp, Mus musculus
tgggaagatcgtgtccacaaaggcg

SEQ ID NO: 148594 - DNA, 25 bp, Mus musculus
tgggaagcacacactgctacgatgg

SEQ ID NO: 148595 - DNA, 25 bp, Mus musculus
tgggaagccctcctcctgttagaac

SEQ ID NO: 148596 - DNA, 25 bp, Mus musculus
tgggaagccgcgaattgtcagcaag

SEQ ID NO: 148597 - DNA, 25 bp, Mus musculus
tgggaagcctccaacctggtctgag

SEQ ID NO: 148598 - DNA, 25 bp, Mus musculus
tgggaagctcgacctcagtacaact

SEQ ID NO: 148599 - DNA, 25 bp, Mus musculus
tgggaagctttcagcctaccggagc

SEQ ID NO: 148600 - DNA, 25 bp, Mus musculus
tgggaaggccaaacggatgatcatc

SEQ ID NO: 148601 - DNA, 25 bp, Mus musculus
tgggaaggccagtccaaagaccatc

SEQ ID NO: 148602 - DNA, 25 bp, Mus musculus
tgggaaggccccaatgtggtccata

SEQ ID NO: 148603 - DNA, 25 bp, Mus musculus
tgggaaggcctgactgttgatgaca

SEQ ID NO: 148604 - DNA, 25 bp, Mus musculus
tgggaagtccctcaaaagctccttg

SEQ ID NO: 148605 - DNA, 25 bp, Mus musculus
tgggaagtctttcaccatgcaggga

SEQ ID NO: 148606 - DNA, 25 bp, Mus musculus
tgggaagtgcactctgtcagctctg

SEQ ID NO: 148607 - DNA, 25 bp, Mus musculus
tgggaagttctccacctgctgccaa

SEQ ID NO: 148608 - DNA, 25 bp, Mus musculus
tgggaataaatgtgccttctgcaag

SEQ ID NO: 148609 - DNA, 25 bp, Mus musculus
tgggaataacgtttcttggaatcgg

SEQ ID NO: 148610 - DNA, 25 bp, Mus musculus
tgggaatacctaaatgcctacgcgg

SEQ ID NO: 148611 - DNA, 25 bp, Mus musculus
tgggaatatagctgctgccactggc

SEQ ID NO: 148612 - DNA, 25 bp, Mus musculus
tgggaatcagccttggacagtgccg

SEQ ID NO: 148613 - DNA, 25 bp, Mus musculus
tgggaatcccaaaggacggtgcgat

SEQ ID NO: 148614 - DNA, 25 bp, Mus musculus
tgggaatctcacaggaaacatcagg

SEQ ID NO: 148615 - DNA, 25 bp, Mus musculus
tgggaatctgcagtatgacctccac

SEQ ID NO: 148616 - DNA, 25 bp, Mus musculus
tgggaatggacacccggaatacatc

SEQ ID NO: 148617 - DNA, 25 bp, Mus musculus
tgggaatggctatattagcgctgcc

SEQ ID NO: 148618 - DNA, 25 bp, Mus musculus
tgggaattcaggagcccttcagctg

SEQ ID NO: 148619 - DNA, 25 bp, Mus musculus
tgggaattccaaccatctaaccgga

SEQ ID NO: 148620 - DNA, 25 bp, Mus musculus
tgggacaacggagctcagatcatct

SEQ ID NO: 148621 - DNA, 25 bp, Mus musculus
tgggacaagaacattcgccaggcct

SEQ ID NO: 148622 - DNA, 25 bp, Mus musculus
tgggacaatggaccccaaaggcctt

SEQ ID NO: 148623 - DNA, 25 bp, Mus musculus
tgggacacagcctacactcaggtgg

SEQ ID NO: 148624 - DNA, 25 bp, Mus musculus
tgggacacccgcagataaacttatt

SEQ ID NO: 148625 - DNA, 25 bp, Mus musculus
tgggacaccgggacatagaggaaat

SEQ ID NO: 148626 - DNA, 25 bp, Mus musculus
tgggacactaccaataagcagtgcg

SEQ ID NO: 148627 - DNA, 25 bp, Mus musculus
tgggacagcaaagcgcagagcaatc

SEQ ID NO: 148628 - DNA, 25 bp, Mus musculus
tgggacaggcattgcagctgcctcc

SEQ ID NO: 148629 - DNA, 25 bp, Mus musculus
tgggacatcaaccatgactgtaatc

SEQ ID NO: 148630 - DNA, 25 bp, Mus musculus
tgggacatccacaactcgaaacaga

SEQ ID NO: 148631 - DNA, 25 bp, Mus musculus
tgggaccaagcaaggatactgttct

SEQ ID NO: 148632 - DNA, 25 bp, Mus musculus
tgggaccaaggctacaggcaagctt

SEQ ID NO: 148633 - DNA, 25 bp, Mus musculus
tgggaccacatcaggcaagcgggtt

SEQ ID NO: 148634 - DNA, 25 bp, Mus musculus
tgggaccagacagcagtgacatcag

SEQ ID NO: 148635 - DNA, 25 bp, Mus musculus
tgggaccagcccctcgttagcatgt

SEQ ID NO: 148636 - DNA, 25 bp, Mus musculus
tgggaccagccttccgtggactgaa

SEQ ID NO: 148637 - DNA, 25 bp, Mus musculus
tgggaccagctacacccctggaagt

SEQ ID NO: 148638 - DNA, 25 bp, Mus musculus
tgggaccagtacaccaatagccttg

SEQ ID NO: 148639 - DNA, 25 bp, Mus musculus
tgggacccagagacatgaggattgc

SEQ ID NO: 148640 - DNA, 25 bp, Mus musculus
tgggacccagcggttccatgaagtg

SEQ ID NO: 148641 - DNA, 25 bp, Mus musculus
tgggacccatagtcatcacattaag

SEQ ID NO: 148642 - DNA, 25 bp, Mus musculus
tgggaccccataagacagcagtgta

SEQ ID NO: 148643 - DNA, 25 bp, Mus musculus
tgggaccctgtgtaatgattcggct

SEQ ID NO: 148644 - DNA, 25 bp, Mus musculus
tgggaccgactttgagaaaggcttt

SEQ ID NO: 148645 - DNA, 25 bp, Mus musculus
tgggaccggagacgcccaagacttc

SEQ ID NO: 148646 - DNA, 25 bp, Mus musculus
tgggaccgggatctgcaatctctga

SEQ ID NO: 148647 - DNA, 25 bp, Mus musculus
tgggacctactgtgcaaactggact

SEQ ID NO: 148648 - DNA, 25 bp, Mus musculus
tgggacctatattagagatgacact

SEQ ID NO: 148649 - DNA, 25 bp, Mus musculus
tgggacctcactggccatgggagct

SEQ ID NO: 148650 - DNA, 25 bp, Mus musculus
tgggacctcctggtcatggacagac

SEQ ID NO: 148651 - DNA, 25 bp, Mus musculus
tgggacctctcctgtcaaagcagca

SEQ ID NO: 148652 - DNA, 25 bp, Mus musculus
tgggacctgacaccgcctgcaagct

SEQ ID NO: 148653 - DNA, 25 bp, Mus musculus
tgggacctggaagcgtatcctcctg

SEQ ID NO: 148654 - DNA, 25 bp, Mus musculus
tgggaccttgcggaactcacaaaga

SEQ ID NO: 148655 - DNA, 25 bp, Mus musculus
tgggaccttgtatatgagcgaaaac

SEQ ID NO: 148656 - DNA, 25 bp, Mus musculus
tgggacgaagcctcccttagaggaa

SEQ ID NO: 148657 - DNA, 25 bp, Mus musculus
tgggacgagctcacagacaagtctg

SEQ ID NO: 148658 - DNA, 25 bp, Mus musculus
tgggacgatgttccaaaccccaaga

SEQ ID NO: 148659 - DNA, 25 bp, Mus musculus
tgggacggaagcctcctacttttgg

SEQ ID NO: 148660 - DNA, 25 bp, Mus musculus
tgggacggatcatctggccctgttc

SEQ ID NO: 148661 - DNA, 25 bp, Mus musculus
tgggacgtcccacagagtttctgaa

SEQ ID NO: 148662 - DNA, 25 bp, Mus musculus
tgggacgtcgctgcctttgtggtct

SEQ ID NO: 148663 - DNA, 25 bp, Mus musculus
tgggactacagtcacagcgtggaac

SEQ ID NO: 148664 - DNA, 25 bp, Mus musculus
tgggactcaaagaagcatactggct

SEQ ID NO: 148665 - DNA, 25 bp, Mus musculus
tgggactcactacagtacctctggg

SEQ ID NO: 148666 - DNA, 25 bp, Mus musculus
tgggactcagcagttttgaaacgtg

SEQ ID NO: 148667 - DNA, 25 bp, Mus musculus
tgggactcaggagcctctaacacag

SEQ ID NO: 148668 - DNA, 25 bp, Mus musculus
tgggactcctcctaccagttgtgag

SEQ ID NO: 148669 - DNA, 25 bp, Mus musculus
tgggactctagcctctgaactggac

SEQ ID NO: 148670 - DNA, 25 bp, Mus musculus
tgggactctgcatacgcctgtgcca

SEQ ID NO: 148671 - DNA, 25 bp, Mus musculus
tgggactcttgagcccagagggact

SEQ ID NO: 148672 - DNA, 25 bp, Mus musculus
tgggactggacattcctcctaggaa

SEQ ID NO: 148673 - DNA, 25 bp, Mus musculus
tgggactggcttatgccatggcaca

SEQ ID NO: 148674 - DNA, 25 bp, Mus musculus
tgggactgttcctgtgcctggctct

SEQ ID NO: 148675 - DNA, 25 bp, Mus musculus
tgggacttctacaacggcaaggact

SEQ ID NO: 148676 - DNA, 25 bp, Mus musculus
tgggacttctcttcacgctggcttg

SEQ ID NO: 148677 - DNA, 25 bp, Mus musculus
tgggacttgacggaggcaatgacaa

SEQ ID NO: 148678 - DNA, 25 bp, Mus musculus
tgggacttggacctcacctatgtaa

SEQ ID NO: 148679 - DNA, 25 bp, Mus musculus
tgggactttttcactcagaccgaag

SEQ ID NO: 148680 - DNA, 25 bp, Mus musculus
tgggagaaaccaaagcacagctatg

SEQ ID NO: 148681 - DNA, 25 bp, Mus musculus
tgggagaacaacaaagaagcgctgc

SEQ ID NO: 148682 - DNA, 25 bp, Mus musculus
tgggagaacatgctcaatcactctg

SEQ ID NO: 148683 - DNA, 25 bp, Mus musculus
tgggagaagctgcactacattactg

SEQ ID NO: 148684 - DNA, 25 bp, Mus musculus
tgggagaataaccacctgctcgtta

SEQ ID NO: 148685 - DNA, 25 bp, Mus musculus
tgggagacaccagcgggaaactgtc

SEQ ID NO: 148686 - DNA, 25 bp, Mus musculus
tgggagaccacaagcagagaagcct

SEQ ID NO: 148687 - DNA, 25 bp, Mus musculus
tgggagacctcctcatctggaagag

SEQ ID NO: 148688 - DNA, 25 bp, Mus musculus
tgggagacgtgatcgcactcagcga

SEQ ID NO: 148689 - DNA, 25 bp, Mus musculus
tgggagagacacatgcctcaggtcg

SEQ ID NO: 148690 - DNA, 25 bp, Mus musculus
tgggagagctccgagaacaacgtcc

SEQ ID NO: 148691 - DNA, 25 bp, Mus musculus
tgggagagcttcaacaagggcgact

SEQ ID NO: 148692 - DNA, 25 bp, Mus musculus
tgggagatgacaccacggactgctc

SEQ ID NO: 148693 - DNA, 25 bp, Mus musculus
tgggagatttccgactcagacggtg

SEQ ID NO: 148694 - DNA, 25 bp, Mus musculus
tgggagcaatcctgtcattaggagg

SEQ ID NO: 148695 - DNA, 25 bp, Mus musculus
tgggagcagctggtccactttcatg

SEQ ID NO: 148696 - DNA, 25 bp, Mus musculus
tgggagccacactcatcagcatgtc

SEQ ID NO: 148697 - DNA, 25 bp, Mus musculus
tgggagccatcttcaacggcttgac

SEQ ID NO: 148698 - DNA, 25 bp, Mus musculus
tgggagccatgaggatcctggctaa

SEQ ID NO: 148699 - DNA, 25 bp, Mus musculus
tgggagccattcctgcaggattccg

SEQ ID NO: 148700 - DNA, 25 bp, Mus musculus
tgggagcccagactgcctatatcgg

SEQ ID NO: 148701 - DNA, 25 bp, Mus musculus
tgggagccccaaagtatacaagtga

SEQ ID NO: 148702 - DNA, 25 bp, Mus musculus
tgggagcccgcagtgctaacttagt

SEQ ID NO: 148703 - DNA, 25 bp, Mus musculus
tgggagccctgctcacacttcggtg

SEQ ID NO: 148704 - DNA, 25 bp, Mus musculus
tgggagcctataccttctgaagacc

SEQ ID NO: 148705 - DNA, 25 bp, Mus musculus
tgggaggagatcattccagaagagc

SEQ ID NO: 148706 - DNA, 25 bp, Mus musculus
tgggaggagcattacagccaaggcc

SEQ ID NO: 148707 - DNA, 25 bp, Mus musculus
tgggaggagcgcaatgtcacagcaa

SEQ ID NO: 148708 - DNA, 25 bp, Mus musculus
tgggaggagtataagaccggcaaca

SEQ ID NO: 148709 - DNA, 25 bp, Mus musculus
tgggaggagtcacagaaaagttcta

SEQ ID NO: 148710 - DNA, 25 bp, Mus musculus
tgggaggagtttccacaagacctgt

SEQ ID NO: 148711 - DNA, 25 bp, Mus musculus
tgggaggatttctcaggctatgcca

SEQ ID NO: 148712 - DNA, 25 bp, Mus musculus
tgggaggccaccaagaccaatgatg

SEQ ID NO: 148713 - DNA, 25 bp, Mus musculus
tgggaggccccagttcagtggacat

SEQ ID NO: 148714 - DNA, 25 bp, Mus musculus
tgggaggccccatgcataatgaagt

SEQ ID NO: 148715 - DNA, 25 bp, Mus musculus
tgggaggctggcatgtcacaagtct

SEQ ID NO: 148716 - DNA, 25 bp, Mus musculus
tgggaggtctgctgttactggctct

SEQ ID NO: 148717 - DNA, 25 bp, Mus musculus
tgggagtcatcctctatacactggt

SEQ ID NO: 148718 - DNA, 25 bp, Mus musculus
tgggagtccccaagttttaccgatg

SEQ ID NO: 148719 - DNA, 25 bp, Mus musculus
tgggagtctcctacaaaaactggaa

SEQ ID NO: 148720 - DNA, 25 bp, Mus musculus
tgggagtttccagccgcattaacga

SEQ ID NO: 148721 - DNA, 25 bp, Mus musculus
tgggataagcgctactgcctggaca

SEQ ID NO: 148722 - DNA, 25 bp, Mus musculus
tgggataatcgtctttattttagtc

SEQ ID NO: 148723 - DNA, 25 bp, Mus musculus
tgggatacagaaagccaaaccagcc

SEQ ID NO: 148724 - DNA, 25 bp, Mus musculus
tgggatacccggctcttcagcagtg

SEQ ID NO: 148725 - DNA, 25 bp, Mus musculus
tgggatatccgaacactctattcga

SEQ ID NO: 148726 - DNA, 25 bp, Mus musculus
tgggatcaatctggccactgcggac

SEQ ID NO: 148727 - DNA, 25 bp, Mus musculus
tgggatcatacagcgagtgcctttc

SEQ ID NO: 148728 - DNA, 25 bp, Mus musculus
tgggatccaggagtccatccccagt

SEQ ID NO: 148729 - DNA, 25 bp, Mus musculus
tgggatccatcgaacgctcacaggt

SEQ ID NO: 148730 - DNA, 25 bp, Mus musculus
tgggatccccatggctctattctgt

SEQ ID NO: 148731 - DNA, 25 bp, Mus musculus
tgggatccgatatctgcatgaaaac

SEQ ID NO: 148732 - DNA, 25 bp, Mus musculus
tgggatcctaggactgaagagcttg

SEQ ID NO: 148733 - DNA, 25 bp, Mus musculus
tgggatccttccgttgcagaccgaa

SEQ ID NO: 148734 - DNA, 25 bp, Mus musculus
tgggatcgagccacctgttaagtga

SEQ ID NO: 148735 - DNA, 25 bp, Mus musculus
tgggatcgcagaatgcagcaatgga

SEQ ID NO: 148736 - DNA, 25 bp, Mus musculus
tgggatctggttttcgcccgccgct

SEQ ID NO: 148737 - DNA, 25 bp, Mus musculus
tgggatcttggagcacgacccgttc

SEQ ID NO: 148738 - DNA, 25 bp, Mus musculus
tgggatgaccccacgttggccattg

SEQ ID NO: 148739 - DNA, 25 bp, Mus musculus
tgggatgaggctatccagaaccccg

SEQ ID NO: 148740 - DNA, 25 bp, Mus musculus
tgggatgagtttcctaacggccgct

SEQ ID NO: 148741 - DNA, 25 bp, Mus musculus
tgggatgcttcctaccgtgccagga

SEQ ID NO: 148742 - DNA, 25 bp, Mus musculus
tgggatggaaattctatgatgccga

SEQ ID NO: 148743 - DNA, 25 bp, Mus musculus
tgggatggaatcaccacactgcgct

SEQ ID NO: 148744 - DNA, 25 bp, Mus musculus
tgggatgtcagcaccacctcaacta

SEQ ID NO: 148745 - DNA, 25 bp, Mus musculus
tgggattcacccctgctgaaaagcg

SEQ ID NO: 148746 - DNA, 25 bp, Mus musculus
tgggattccagacttccacgcggtg

SEQ ID NO: 148747 - DNA, 25 bp, Mus musculus
tgggattcctaaagctacagcagaa

SEQ ID NO: 148748 - DNA, 25 bp, Mus musculus
tgggattcgacctcctcagcttgaa

SEQ ID NO: 148749 - DNA, 25 bp, Mus musculus
tgggattctacacccccagaaaggg

SEQ ID NO: 148750 - DNA, 25 bp, Mus musculus
tgggattctgttccatagacaagca

SEQ ID NO: 148751 - DNA, 25 bp, Mus musculus
tgggattgccctgactgaagcagac

SEQ ID NO: 148752 - DNA, 25 bp, Mus musculus
tgggattggcatcaaagaaagcagt

SEQ ID NO: 148753 - DNA, 25 bp, Mus musculus
tgggatttctatgggacacctactg

SEQ ID NO: 148754 - DNA, 25 bp, Mus musculus
tgggcaaacactctccaaagagtct

SEQ ID NO: 148755 - DNA, 25 bp, Mus musculus
tgggcaaactctatgctgactgagc

SEQ ID NO: 148756 - DNA, 25 bp, Mus musculus
tgggcaaagctacagacaacttctg

SEQ ID NO: 148757 - DNA, 25 bp, Mus musculus
tgggcaacacactcaaggtcctagg

SEQ ID NO: 148758 - DNA, 25 bp, Mus musculus
tgggcaacaccaagtccgaatgcag

SEQ ID NO: 148759 - DNA, 25 bp, Mus musculus
tgggcaagccaaaatggagaacgct

SEQ ID NO: 148760 - DNA, 25 bp, Mus musculus
tgggcaagcccatcaactcagtagt

SEQ ID NO: 148761 - DNA, 25 bp, Mus musculus
tgggcaagcgcatgtatgaacagct

SEQ ID NO: 148762 - DNA, 25 bp, Mus musculus
tgggcaagtcagctactcagggacc

SEQ ID NO: 148763 - DNA, 25 bp, Mus musculus
tgggcaatggacacacgactgatct

SEQ ID NO: 148764 - DNA, 25 bp, Mus musculus
tgggcacacatggaaactaggcaac

SEQ ID NO: 148765 - DNA, 25 bp, Mus musculus
tgggcacagataccttgaagaagct

SEQ ID NO: 148766 - DNA, 25 bp, Mus musculus
tgggcacagccataggcacctgctt

SEQ ID NO: 148767 - DNA, 25 bp, Mus musculus
tgggcacagccatggaatatctctg

SEQ ID NO: 148768 - DNA, 25 bp, Mus musculus
tgggcacatcacatggccaaggctt

SEQ ID NO: 148769 - DNA, 25 bp, Mus musculus
tgggcacatctcacgtgaatgacga

SEQ ID NO: 148770 - DNA, 25 bp, Mus musculus
tgggcacattcatcttcggcacagt

SEQ ID NO: 148771 - DNA, 25 bp, Mus musculus
tgggcaccaaagaacctgtaaacgt

SEQ ID NO: 148772 - DNA, 25 bp, Mus musculus
tgggcaccactaatgctggcaagtc

SEQ ID NO: 148773 - DNA, 25 bp, Mus musculus
tgggcaccagctatgtggcacgtcc

SEQ ID NO: 148774 - DNA, 25 bp, Mus musculus
tgggcaccatgatccggaaaacact

SEQ ID NO: 148775 - DNA, 25 bp, Mus musculus
tgggcacccggcactgattaaatgg

SEQ ID NO: 148776 - DNA, 25 bp, Mus musculus
tgggcaccgacgaggtccgagcctt

SEQ ID NO: 148777 - DNA, 25 bp, Mus musculus
tgggcaccgggaaatcgtcgggagc

SEQ ID NO: 148778 - DNA, 25 bp, Mus musculus
tgggcacctcacatggacattagat

SEQ ID NO: 148779 - DNA, 25 bp, Mus musculus
tgggcacggccatgatcttcacctg

SEQ ID NO: 148780 - DNA, 25 bp, Mus musculus
tgggcactgaggtgcaaggcgccct

SEQ ID NO: 148781 - DNA, 25 bp, Mus musculus
tgggcactgccttcgagaacctttc

SEQ ID NO: 148782 - DNA, 25 bp, Mus musculus
tgggcactgctcagcgcggctagca

SEQ ID NO: 148783 - DNA, 25 bp, Mus musculus
tgggcagacaccaaaacagctgttt

SEQ ID NO: 148784 - DNA, 25 bp, Mus musculus
tgggcagacagtcgagccaacactg

SEQ ID NO: 148785 - DNA, 25 bp, Mus musculus
tgggcagccccgaaatcatatgcat

SEQ ID NO: 148786 - DNA, 25 bp, Mus musculus
tgggcagcccgctcggagatgtccc

SEQ ID NO: 148787 - DNA, 25 bp, Mus musculus
tgggcagcccttcgacacgatgaag

SEQ ID NO: 148788 - DNA, 25 bp, Mus musculus
tgggcagccgagatcacctgtttaa

SEQ ID NO: 148789 - DNA, 25 bp, Mus musculus
tgggcagctcctccgtattctgcaa

SEQ ID NO: 148790 - DNA, 25 bp, Mus musculus
tgggcagctgatcacacatctgggc

SEQ ID NO: 148791 - DNA, 25 bp, Mus musculus
tgggcagctttggtgctcttcagcg

SEQ ID NO: 148792 - DNA, 25 bp, Mus musculus
tgggcaggaacaagggcaatctagt

SEQ ID NO: 148793 - DNA, 25 bp, Mus musculus
tgggcaggcttctacaacaacattg

SEQ ID NO: 148794 - DNA, 25 bp, Mus musculus
tgggcaggtacaccaaggcttgcta

SEQ ID NO: 148795 - DNA, 25 bp, Mus musculus
tgggcagtgaaaaccaagctgagcc

SEQ ID NO: 148796 - DNA, 25 bp, Mus musculus
tgggcagtgactttaattccagcac

SEQ ID NO: 148797 - DNA, 25 bp, Mus musculus
tgggcagtgcatacctgtttttgga

SEQ ID NO: 148798 - DNA, 25 bp, Mus musculus
tgggcagtggcctctagtgaccagt

SEQ ID NO: 148799 - DNA, 25 bp, Mus musculus
tgggcagttaaaagccggaccagct

SEQ ID NO: 148800 - DNA, 25 bp, Mus musculus
tgggcatcacgtaccagcacatcga

SEQ ID NO: 148801 - DNA, 25 bp, Mus musculus
tgggcatcctgatcactattgcggg

SEQ ID NO: 148802 - DNA, 25 bp, Mus musculus
tgggcatctacatcctcagcaatgg

SEQ ID NO: 148803 - DNA, 25 bp, Mus musculus
tgggcatcttccagaagcgcaagaa

SEQ ID NO: 148804 - DNA, 25 bp, Mus musculus
tgggcatgatccacttgagcttcgg

SEQ ID NO: 148805 - DNA, 25 bp, Mus musculus
tgggcatgctaggaaagcagcagac

SEQ ID NO: 148806 - DNA, 25 bp, Mus musculus
tgggcattctggaccgtaaccctcg

SEQ ID NO: 148807 - DNA, 25 bp, Mus musculus
tgggcattgcacttattgctatggg

SEQ ID NO: 148808 - DNA, 25 bp, Mus musculus
tgggcattgtctgcagctgcggaac

SEQ ID NO: 148809 - DNA, 25 bp, Mus musculus
tgggcattgttaacggtcgcccgcc

SEQ ID NO: 148810 - DNA, 25 bp, Mus musculus
tgggccaacagtgctacccaggaga

SEQ ID NO: 148811 - DNA, 25 bp, Mus musculus
tgggccaaggctcaaagtatagtgc

SEQ ID NO: 148812 - DNA, 25 bp, Mus musculus
tgggccaatccaaagtacatcagag

SEQ ID NO: 148813 - DNA, 25 bp, Mus musculus
tgggccacgcgagatagcttagcta

SEQ ID NO: 148814 - DNA, 25 bp, Mus musculus
tgggccactatggaccacgtcaggt

SEQ ID NO: 148815 - DNA, 25 bp, Mus musculus
tgggccactgcactgtttagtcaca

SEQ ID NO: 148816 - DNA, 25 bp, Mus musculus
tgggccactgcttttccctgggaag

SEQ ID NO: 148817 - DNA, 25 bp, Mus musculus
tgggccacttcatgctacggtgcct

SEQ ID NO: 148818 - DNA, 25 bp, Mus musculus
tgggccaggtaacaccaaccctgta

SEQ ID NO: 148819 - DNA, 25 bp, Mus musculus
tgggccatcatgtctcgggaagaag

SEQ ID NO: 148820 - DNA, 25 bp, Mus musculus
tgggccatgacttccatgatgtcca

SEQ ID NO: 148821 - DNA, 25 bp, Mus musculus
tgggccattgatcagtaccgtgtct

SEQ ID NO: 148822 - DNA, 25 bp, Mus musculus
tgggcccactgcaaccatagctgga

SEQ ID NO: 148823 - DNA, 25 bp, Mus musculus
tgggcccatcggaattccagggaga

SEQ ID NO: 148824 - DNA, 25 bp, Mus musculus
tgggccccaaaggaccaatgatgga

SEQ ID NO: 148825 - DNA, 25 bp, Mus musculus
tgggccccatgaaggatcgaatcaa

SEQ ID NO: 148826 - DNA, 25 bp, Mus musculus
tgggcccgataatccaccgtgaagg

SEQ ID NO: 148827 - DNA, 25 bp, Mus musculus
tgggccctagaagttcccgaagcga

SEQ ID NO: 148828 - DNA, 25 bp, Mus musculus
tgggccctgagcactgaggatgcca

SEQ ID NO: 148829 - DNA, 25 bp, Mus musculus
tgggccctgtgctgaacttattcgg

SEQ ID NO: 148830 - DNA, 25 bp, Mus musculus
tgggcccttgtgtaaatatctgctg

SEQ ID NO: 148831 - DNA, 25 bp, Mus musculus
tgggccgaccggcttctcaagatgc

SEQ ID NO: 148832 - DNA, 25 bp, Mus musculus
tgggccgagacccacatcgtggact

SEQ ID NO: 148833 - DNA, 25 bp, Mus musculus
tgggccgagcagatgaacttaacaa

SEQ ID NO: 148834 - DNA, 25 bp, Mus musculus
tgggccgcctccttcgtcgggcctc

SEQ ID NO: 148835 - DNA, 25 bp, Mus musculus
tgggccgcgagtattcgtcggaaac

SEQ ID NO: 148836 - DNA, 25 bp, Mus musculus
tgggccgctacaaagagatgctgaa

SEQ ID NO: 148837 - DNA, 25 bp, Mus musculus
tgggccggaagctcagcatcatgtt

SEQ ID NO: 148838 - DNA, 25 bp, Mus musculus
tgggcctaatggaacccctaagtgg

SEQ ID NO: 148839 - DNA, 25 bp, Mus musculus
tgggcctaccttttcgaccgtcact

SEQ ID NO: 148840 - DNA, 25 bp, Mus musculus
tgggcctagacagccaatggaggct

SEQ ID NO: 148841 - DNA, 25 bp, Mus musculus
tgggcctaggagatgggcaattcta

SEQ ID NO: 148842 - DNA, 25 bp, Mus musculus
tgggcctaggcaaatacacggatgt

SEQ ID NO: 148843 - DNA, 25 bp, Mus musculus
tgggcctcagcagacacagaaggtt

SEQ ID NO: 148844 - DNA, 25 bp, Mus musculus
tgggcctccatttccagtctgaagg

SEQ ID NO: 148845 - DNA, 25 bp, Mus musculus
tgggcctcccacagggcaatgtact

SEQ ID NO: 148846 - DNA, 25 bp, Mus musculus
tgggcctgaatgttaacaaccctca

SEQ ID NO: 148847 - DNA, 25 bp, Mus musculus
tgggcctgcactacactggaaacag

SEQ ID NO: 148848 - DNA, 25 bp, Mus musculus
tgggcctggatcagtatataataaa

SEQ ID NO: 148849 - DNA, 25 bp, Mus musculus
tgggcctggcggatgggattattaa

SEQ ID NO: 148850 - DNA, 25 bp, Mus musculus
tgggccttctagacgcgtccgtaac

SEQ ID NO: 148851 - DNA, 25 bp, Mus musculus
tgggccttcttcatgtagctggtgc

SEQ ID NO: 148852 - DNA, 25 bp, Mus musculus
tgggccttttcaccaacctcgtcta

SEQ ID NO: 148853 - DNA, 25 bp, Mus musculus
tgggcgaaccccacttggcatgtgc

SEQ ID NO: 148854 - DNA, 25 bp, Mus musculus
tgggcgacccaagacggataagctg

SEQ ID NO: 148855 - DNA, 25 bp, Mus musculus
tgggcgacccggtaggatccttcct

SEQ ID NO: 148856 - DNA, 25 bp, Mus musculus
tgggcgatgagaccgatcttgctaa

SEQ ID NO: 148857 - DNA, 25 bp, Mus musculus
tgggcgatgctgaccttgagagaca

SEQ ID NO: 148858 - DNA, 25 bp, Mus musculus
tgggcgcaggccatttggtatctcg

SEQ ID NO: 148859 - DNA, 25 bp, Mus musculus
tgggcgcatcatcacggagagcctc

SEQ ID NO: 148860 - DNA, 25 bp, Mus musculus
tgggcgcattgactatcaagataaa

SEQ ID NO: 148861 - DNA, 25 bp, Mus musculus
tgggcgcgagcaccattgcctacct

SEQ ID NO: 148862 - DNA, 25 bp, Mus musculus
tgggcgcttaaggatcccgcggctc

SEQ ID NO: 148863 - DNA, 25 bp, Mus musculus
tgggcgcttcccagatcacaagggc

SEQ ID NO: 148864 - DNA, 25 bp, Mus musculus
tgggcggagttatgatacctacacc

SEQ ID NO: 148865 - DNA, 25 bp, Mus musculus
tgggcggtccttcctgtgacacgac

SEQ ID NO: 148866 - DNA, 25 bp, Mus musculus
tgggcgtcctttacatccgttcctg

SEQ ID NO: 148867 - DNA, 25 bp, Mus musculus
tgggcgtcttgatgagcagaaatct

SEQ ID NO: 148868 - DNA, 25 bp, Mus musculus
tgggcgtggcaagctctacaggtca

SEQ ID NO: 148869 - DNA, 25 bp, Mus musculus
tgggcgtggtccaagccgaacatct

SEQ ID NO: 148870 - DNA, 25 bp, Mus musculus
tgggcgtgtctcttctcacacttgg

SEQ ID NO: 148871 - DNA, 25 bp, Mus musculus
tgggcgtgttcctaatcactcgaaa

SEQ ID NO: 148872 - DNA, 25 bp, Mus musculus
tgggctaacctctttgggaacaggg

SEQ ID NO: 148873 - DNA, 25 bp, Mus musculus
tgggctaaggacagcaatgacagct

SEQ ID NO: 148874 - DNA, 25 bp, Mus musculus
tgggctacatgggactctatcttta

SEQ ID NO: 148875 - DNA, 25 bp, Mus musculus
tgggctaccccagctgctactgtga

SEQ ID NO: 148876 - DNA, 25 bp, Mus musculus
tgggctacctgagcagcagtcacag

SEQ ID NO: 148877 - DNA, 25 bp, Mus musculus
tgggctactagctacctcaggtgtc

SEQ ID NO: 148878 - DNA, 25 bp, Mus musculus
tgggctagacagacagcaagactct

SEQ ID NO: 148879 - DNA, 25 bp, Mus musculus
tgggctagtgactcagtgtcagaaa

SEQ ID NO: 148880 - DNA, 25 bp, Mus musculus
tgggctatttactggccaggaggcc

SEQ ID NO: 148881 - DNA, 25 bp, Mus musculus
tgggctcaccgctggatagatctgt

SEQ ID NO: 148882 - DNA, 25 bp, Mus musculus
tgggctcagatagaattttatcaga

SEQ ID NO: 148883 - DNA, 25 bp, Mus musculus
tgggctcaggctacactaaggctgt

SEQ ID NO: 148884 - DNA, 25 bp, Mus musculus
tgggctcatcacgaacagcttggca

SEQ ID NO: 148885 - DNA, 25 bp, Mus musculus
tgggctcatgagctctactcagctg

SEQ ID NO: 148886 - DNA, 25 bp, Mus musculus
tgggctccgtgcagataataaaggc

SEQ ID NO: 148887 - DNA, 25 bp, Mus musculus
tgggctcctccagtttgaagtgtgt

SEQ ID NO: 148888 - DNA, 25 bp, Mus musculus
tgggctcctgacaccaagccagata

SEQ ID NO: 148889 - DNA, 25 bp, Mus musculus
tgggctcgggacaagtgctccgttc

SEQ ID NO: 148890 - DNA, 25 bp, Mus musculus
tgggctctcacctcagtgccagtgg

SEQ ID NO: 148891 - DNA, 25 bp, Mus musculus
tgggctctccacagacgagtcagag

SEQ ID NO: 148892 - DNA, 25 bp, Mus musculus
tgggctctcccggtacattgaggac

SEQ ID NO: 148893 - DNA, 25 bp, Mus musculus
tgggctctccgagggaaggcttcca

SEQ ID NO: 148894 - DNA, 25 bp, Mus musculus
tgggctctctgccaaatgataaagc

SEQ ID NO: 148895 - DNA, 25 bp, Mus musculus
tgggctctgaacctgacctccatgc

SEQ ID NO: 148896 - DNA, 25 bp, Mus musculus
tgggctctgccgaccatcagttcaa

SEQ ID NO: 148897 - DNA, 25 bp, Mus musculus
tgggctctgcctataaactcaagag

SEQ ID NO: 148898 - DNA, 25 bp, Mus musculus
tgggctctgggagaaatcaagcttg

SEQ ID NO: 148899 - DNA, 25 bp, Mus musculus
tgggctctggtaaagctgtattcaa

SEQ ID NO: 148900 - DNA, 25 bp, Mus musculus
tgggctcttatccacatcttttgtg

SEQ ID NO: 148901 - DNA, 25 bp, Mus musculus
tgggctgacatttctccatagagag

SEQ ID NO: 148902 - DNA, 25 bp, Mus musculus
tgggctgaccacgaggaacactaaa

SEQ ID NO: 148903 - DNA, 25 bp, Mus musculus
tgggctgactcactggctgaatgac

SEQ ID NO: 148904 - DNA, 25 bp, Mus musculus
tgggctggaacctaggccaggacct

SEQ ID NO: 148905 - DNA, 25 bp, Mus musculus
tgggctggcccaccgtgaactttgt

SEQ ID NO: 148906 - DNA, 25 bp, Mus musculus
tgggctggcccattctgatctgacg

SEQ ID NO: 148907 - DNA, 25 bp, Mus musculus
tgggctggccctgatcatgacaagt

SEQ ID NO: 148908 - DNA, 25 bp, Mus musculus
tgggctgggttcagaacaccgaccg

SEQ ID NO: 148909 - DNA, 25 bp, Mus musculus
tgggctgtcgtctcagacctcagca

SEQ ID NO: 148910 - DNA, 25 bp, Mus musculus
tgggctgtgccttcatcaacctctg

SEQ ID NO: 148911 - DNA, 25 bp, Mus musculus
tgggctgtgtccagtacctcctgta

SEQ ID NO: 148912 - DNA, 25 bp, Mus musculus
tgggctgttgtacccctgcattgac

SEQ ID NO: 148913 - DNA, 25 bp, Mus musculus
tgggcttaaacctaacctggcagac

SEQ ID NO: 148914 - DNA, 25 bp, Mus musculus
tgggcttactgttgagatgtttgga

SEQ ID NO: 148915 - DNA, 25 bp, Mus musculus
tgggcttcaccatcgacatcaagag

SEQ ID NO: 148916 - DNA, 25 bp, Mus musculus
tgggcttcagctggcatgacacatg

SEQ ID NO: 148917 - DNA, 25 bp, Mus musculus
tgggcttccatctgactgcggcaca

SEQ ID NO: 148918 - DNA, 25 bp, Mus musculus
tgggcttccccacctgcatcggtgt

SEQ ID NO: 148919 - DNA, 25 bp, Mus musculus
tgggcttcttcacgcgacatcagag

SEQ ID NO: 148920 - DNA, 25 bp, Mus musculus
tgggctttccagctcagcgtctctg

SEQ ID NO: 148921 - DNA, 25 bp, Mus musculus
tgggctttgccatttaccgtgcgct

SEQ ID NO: 148922 - DNA, 25 bp, Mus musculus
tgggctttgccctacccaggttgac

SEQ ID NO: 148923 - DNA, 25 bp, Mus musculus
tgggcttttgctagaactgttgggc

SEQ ID NO: 148924 - DNA, 25 bp, Mus musculus
tggggaacttgcagcttaaagccag

SEQ ID NO: 148925 - DNA, 25 bp, Mus musculus
tggggtcccaccagggcagcctgtc

SEQ ID NO: 148926 - DNA, 25 bp, Mus musculus
tggggtcttatgtgccccaaaccaa

SEQ ID NO: 148927 - DNA, 25 bp, Mus musculus
tgggtaaagccaagaggcgcctctt

SEQ ID NO: 148928 - DNA, 25 bp, Mus musculus
tgggtaaagccacactgaactgaga

SEQ ID NO: 148929 - DNA, 25 bp, Mus musculus
tgggtaacctacctccggatatccg

SEQ ID NO: 148930 - DNA, 25 bp, Mus musculus
tgggtaactccctgatccggtctgc

SEQ ID NO: 148931 - DNA, 25 bp, Mus musculus
tgggtacagccagcaggcgaatctg

SEQ ID NO: 148932 - DNA, 25 bp, Mus musculus
tgggtacatgagacagccttgaagc

SEQ ID NO: 148933 - DNA, 25 bp, Mus musculus
tgggtaccagattggccacagaggc

SEQ ID NO: 148934 - DNA, 25 bp, Mus musculus
tgggtacctgagacgctccaagctg

SEQ ID NO: 148935 - DNA, 25 bp, Mus musculus
tgggtaccttcagccgttacgagag

SEQ ID NO: 148936 - DNA, 25 bp, Mus musculus
tgggtacgctgccagggacttctac

SEQ ID NO: 148937 - DNA, 25 bp, Mus musculus
tgggtactagaaatgggcacttggc

SEQ ID NO: 148938 - DNA, 25 bp, Mus musculus
tgggtactgcaagcaccatggtgac

SEQ ID NO: 148939 - DNA, 25 bp, Mus musculus
tgggtacttcgagcaccgagaggat

SEQ ID NO: 148940 - DNA, 25 bp, Mus musculus
tgggtagaatcagctaatagaggct

SEQ ID NO: 148941 - DNA, 25 bp, Mus musculus
tgggtagctgccatggcctccccta

SEQ ID NO: 148942 - DNA, 25 bp, Mus musculus
tgggtataaggagaggcccgaggcc

SEQ ID NO: 148943 - DNA, 25 bp, Mus musculus
tgggtatagccctcaactgcaaggc

SEQ ID NO: 148944 - DNA, 25 bp, Mus musculus
tgggtatctgcaggacttagtctaa

SEQ ID NO: 148945 - DNA, 25 bp, Mus musculus
tgggtatctgggtgctgctgctcct

SEQ ID NO: 148946 - DNA, 25 bp, Mus musculus
tgggtatcttctccatctacaccgg

SEQ ID NO: 148947 - DNA, 25 bp, Mus musculus
tgggtatggacagcaagcctgagct

SEQ ID NO: 148948 - DNA, 25 bp, Mus musculus
tgggtattgccagacagaatctcgg

SEQ ID NO: 148949 - DNA, 25 bp, Mus musculus
tgggtattgccatcgctcggtacga

SEQ ID NO: 148950 - DNA, 25 bp, Mus musculus
tgggtattgtgacccctcctcgtgc

SEQ ID NO: 148951 - DNA, 25 bp, Mus musculus
tgggtcaaaactaggcaacttgatg

SEQ ID NO: 148952 - DNA, 25 bp, Mus musculus
tgggtcaaataaatcggccggtcct

SEQ ID NO: 148953 - DNA, 25 bp, Mus musculus
tgggtcacttcagggactgtcagca

SEQ ID NO: 148954 - DNA, 25 bp, Mus musculus
tgggtcagaatggacagagccacag

SEQ ID NO: 148955 - DNA, 25 bp, Mus musculus
tgggtcagcctggagaatatagcct

SEQ ID NO: 148956 - DNA, 25 bp, Mus musculus
tgggtcagctaaaaaggaaagccac

SEQ ID NO: 148957 - DNA, 25 bp, Mus musculus
tgggtcatccttagatctctccgca

SEQ ID NO: 148958 - DNA, 25 bp, Mus musculus
tgggtcattcaagtacacggccgtg

SEQ ID NO: 148959 - DNA, 25 bp, Mus musculus
tgggtccacaccgagttaaaacaga

SEQ ID NO: 148960 - DNA, 25 bp, Mus musculus
tgggtccagtacacaagcatctttt

SEQ ID NO: 148961 - DNA, 25 bp, Mus musculus
tgggtcccacccaagcgtataacag

SEQ ID NO: 148962 - DNA, 25 bp, Mus musculus
tgggtcccagcctaaaggtcacctt

SEQ ID NO: 148963 - DNA, 25 bp, Mus musculus
tgggtccccagaaaaagctaagatg

SEQ ID NO: 148964 - DNA, 25 bp, Mus musculus
tgggtcctacccagtcttgtcctcc

SEQ ID NO: 148965 - DNA, 25 bp, Mus musculus
tgggtcctcatcagcctccagagtg

SEQ ID NO: 148966 - DNA, 25 bp, Mus musculus
tgggtcctggaggtcgacgaccatc

SEQ ID NO: 148967 - DNA, 25 bp, Mus musculus
tgggtccttggcagtaatgtaccac

SEQ ID NO: 148968 - DNA, 25 bp, Mus musculus
tgggtccttgttgccggctttcgta

SEQ ID NO: 148969 - DNA, 25 bp, Mus musculus
tgggtcgacgagaagactccatgga

SEQ ID NO: 148970 - DNA, 25 bp, Mus musculus
tgggtcgcatgctgctggtgaccaa

SEQ ID NO: 148971 - DNA, 25 bp, Mus musculus
tgggtcgcgcgatgtctcatggatc

SEQ ID NO: 148972 - DNA, 25 bp, Mus musculus
tgggtcggaacagcaccattgcggt

SEQ ID NO: 148973 - DNA, 25 bp, Mus musculus
tgggtcggtccctccgacacacgag

SEQ ID NO: 148974 - DNA, 25 bp, Mus musculus
tgggtcgtcaccctctacaacagca

SEQ ID NO: 148975 - DNA, 25 bp, Mus musculus
tgggtctcagacacgggcattccag

SEQ ID NO: 148976 - DNA, 25 bp, Mus musculus
tgggtctccccaaactgatcatggc

SEQ ID NO: 148977 - DNA, 25 bp, Mus musculus
tgggtctgttctccgtctacactgg

SEQ ID NO: 148978 - DNA, 25 bp, Mus musculus
tgggtcttcaggcacatgcatcagc

SEQ ID NO: 148979 - DNA, 25 bp, Mus musculus
tgggtcttcttctcgcagcagctct

SEQ ID NO: 148980 - DNA, 25 bp, Mus musculus
tgggtcttggcgaacgtcccaatga

SEQ ID NO: 148981 - DNA, 25 bp, Mus musculus
tgggtgaacccggaatcctttgcgt

SEQ ID NO: 148982 - DNA, 25 bp, Mus musculus
tgggtgacatgaccaacagcgactt

SEQ ID NO: 148983 - DNA, 25 bp, Mus musculus
tgggtgacggctggctttttgcaca

SEQ ID NO: 148984 - DNA, 25 bp, Mus musculus
tgggtgacgttctcctgcatagcgc

SEQ ID NO: 148985 - DNA, 25 bp, Mus musculus
tgggtgagaaaacaggccacgactt

SEQ ID NO: 148986 - DNA, 25 bp, Mus musculus
tgggtgatgaacgacgaagcagcca

SEQ ID NO: 148987 - DNA, 25 bp, Mus musculus
tgggtgcagaacaccgcgaatcgag

SEQ ID NO: 148988 - DNA, 25 bp, Mus musculus
tgggtgcagacagaggcatccacgt

SEQ ID NO: 148989 - DNA, 25 bp, Mus musculus
tgggtgcaggcattcacacatggac

SEQ ID NO: 148990 - DNA, 25 bp, Mus musculus
tgggtgccaaacgactacacagcgt

SEQ ID NO: 148991 - DNA, 25 bp, Mus musculus
tgggtgccaccttagaccagtttga

SEQ ID NO: 148992 - DNA, 25 bp, Mus musculus
tgggtgccacgaaagaaacatgaga

SEQ ID NO: 148993 - DNA, 25 bp, Mus musculus
tgggtgccagcctcatgtattggac

SEQ ID NO: 148994 - DNA, 25 bp, Mus musculus
tgggtgcccgacacatatttcttaa

SEQ ID NO: 148995 - DNA, 25 bp, Mus musculus
tgggtgctctttgtgatcctcatcc

SEQ ID NO: 148996 - DNA, 25 bp, Mus musculus
tgggtggaaccctctacataggcca

SEQ ID NO: 148997 - DNA, 25 bp, Mus musculus
tgggtggatttggtgctcagcctcc

SEQ ID NO: 148998 - DNA, 25 bp, Mus musculus
tgggtggcaccactatgaaggcaca

SEQ ID NO: 148999 - DNA, 25 bp, Mus musculus
tgggtggccagaagcttctggtcct

SEQ ID NO: 149000 - DNA, 25 bp, Mus musculus
tgggtggccagtagcatcagataac

SEQ ID NO: 149001 - DNA, 25 bp, Mus musculus
tgggtgggcctctcattgacagctg

SEQ ID NO: 149002 - DNA, 25 bp, Mus musculus
tgggtggtgagaaccgcttccgcct

SEQ ID NO: 149003 - DNA, 25 bp, Mus musculus
tgggtgtgacctccttcaagcggaa

SEQ ID NO: 149004 - DNA, 25 bp, Mus musculus
tgggtgtggcggtcattcttcagtc

SEQ ID NO: 149005 - DNA, 25 bp, Mus musculus
tgggtgtgtacctaaaccagatgcc

SEQ ID NO: 149006 - DNA, 25 bp, Mus musculus
tgggtgtgttttactaagcatcgtc

SEQ ID NO: 149007 - DNA, 25 bp, Mus musculus
tgggtgttgcaggtgtctcctccgc

SEQ ID NO: 149008 - DNA, 25 bp, Mus musculus
tgggttactacacaagaggccgaac

SEQ ID NO: 149009 - DNA, 25 bp, Mus musculus
tgggttcagcgatcaatctcagagc

SEQ ID NO: 149010 - DNA, 25 bp, Mus musculus
tgggttcagctcagactcagtggac

SEQ ID NO: 149011 - DNA, 25 bp, Mus musculus
tgggttccagacagtgcccggatca

SEQ ID NO: 149012 - DNA, 25 bp, Mus musculus
tgggttccgccagctctgccggata

SEQ ID NO: 149013 - DNA, 25 bp, Mus musculus
tgggttcctctgaccgtgcttggcg

SEQ ID NO: 149014 - DNA, 25 bp, Mus musculus
tgggttcctgagtgtgtcgccttga

SEQ ID NO: 149015 - DNA, 25 bp, Mus musculus
tgggttctagagaagaggagtattg

SEQ ID NO: 149016 - DNA, 25 bp, Mus musculus
tgggttctatcaccaccaggagacg

SEQ ID NO: 149017 - DNA, 25 bp, Mus musculus
tgggttcttctatgccccacataag

SEQ ID NO: 149018 - DNA, 25 bp, Mus musculus
tgggttctttcgaggcagctctcag

SEQ ID NO: 149019 - DNA, 25 bp, Mus musculus
tgggttgaccaaatcctcttcagag

SEQ ID NO: 149020 - DNA, 25 bp, Mus musculus
tgggttgcaacacctaggcagagac

SEQ ID NO: 149021 - DNA, 25 bp, Mus musculus
tgggttgcacaactccaaaatggga

SEQ ID NO: 149022 - DNA, 25 bp, Mus musculus
tgggttgcctggtgccacacctttc

SEQ ID NO: 149023 - DNA, 25 bp, Mus musculus
tgggttggctggaacgccttcatca

SEQ ID NO: 149024 - DNA, 25 bp, Mus musculus
tgggtttaaagctcaggcaatgcct

SEQ ID NO: 149025 - DNA, 25 bp, Mus musculus
tgggtttaccacttctgctgaggag

SEQ ID NO: 149026 - DNA, 25 bp, Mus musculus
tgggtttaccgatcaaatatagact

SEQ ID NO: 149027 - DNA, 25 bp, Mus musculus
tgggttttcagaaacagacatacac

SEQ ID NO: 149028 - DNA, 25 bp, Mus musculus
tgggttttcgccacaacaaagaagc

SEQ ID NO: 149029 - DNA, 25 bp, Mus musculus
tggtaaaactcgctaacccgctgta

SEQ ID NO: 149030 - DNA, 25 bp, Mus musculus
tggtaaaccccaacgaagtcttctg

SEQ ID NO: 149031 - DNA, 25 bp, Mus musculus
tggtaaacctctctcggtcgagctg

SEQ ID NO: 149032 - DNA, 25 bp, Mus musculus
tggtaaaccttggattgggcacacg

SEQ ID NO: 149033 - DNA, 25 bp, Mus musculus
tggtaaatacaacgcgatggtgctg

SEQ ID NO: 149034 - DNA, 25 bp, Mus musculus
tggtaaatgccatccaggtgcccgg

SEQ ID NO: 149035 - DNA, 25 bp, Mus musculus
tggtaacagggctcactccagagga

SEQ ID NO: 149036 - DNA, 25 bp, Mus musculus
tggtaacaggtattgcacagacatg

SEQ ID NO: 149037 - DNA, 25 bp, Mus musculus
tggtaacagttcaacaatccgtggc

SEQ ID NO: 149038 - DNA, 25 bp, Mus musculus
tggtaacattggaagcctcagcacg

SEQ ID NO: 149039 - DNA, 25 bp, Mus musculus
tggtaacctagcgacccgagagctt

SEQ ID NO: 149040 - DNA, 25 bp, Mus musculus
tggtaacgattataatgagaataac

SEQ ID NO: 149041 - DNA, 25 bp, Mus musculus
tggtaactttgtaggccgactaggc

SEQ ID NO: 149042 - DNA, 25 bp, Mus musculus
tggtaagaagctgtccagctgagca

SEQ ID NO: 149043 - DNA, 25 bp, Mus musculus
tggtaagactgtcacgcccatgtgc

SEQ ID NO: 149044 - DNA, 25 bp, Mus musculus
tggtaagatagacccatctcctcga

SEQ ID NO: 149045 - DNA, 25 bp, Mus musculus
tggtaaggcctttaataatcgttca

SEQ ID NO: 149046 - DNA, 25 bp, Mus musculus
tggtaagtctttaataccagtttct

SEQ ID NO: 149047 - DNA, 25 bp, Mus musculus
tggtacaagacaaaggagatcctgc

SEQ ID NO: 149048 - DNA, 25 bp, Mus musculus
tggtacacagtggacaaagcccctg

SEQ ID NO: 149049 - DNA, 25 bp, Mus musculus
tggtacacatggctcgacaatgcgt

SEQ ID NO: 149050 - DNA, 25 bp, Mus musculus
tggtacagagcccattgttctggac

SEQ ID NO: 149051 - DNA, 25 bp, Mus musculus
tggtacagaggctacaccttaagga

SEQ ID NO: 149052 - DNA, 25 bp, Mus musculus
tggtacagcccatctagaaggcggg

SEQ ID NO: 149053 - DNA, 25 bp, Mus musculus
tggtacatcgtaacagctgcgaagg

SEQ ID NO: 149054 - DNA, 25 bp, Mus musculus
tggtaccagcctcgacacaatgtca

SEQ ID NO: 149055 - DNA, 25 bp, Mus musculus
tggtaccagcttggccttgtgtaac

SEQ ID NO: 149056 - DNA, 25 bp, Mus musculus
tggtaccgacagaagccaaatgagt

SEQ ID NO: 149057 - DNA, 25 bp, Mus musculus
tggtaccgatggagacgcaactgca

SEQ ID NO: 149058 - DNA, 25 bp, Mus musculus
tggtaccgcaggatccaggaaagca

SEQ ID NO: 149059 - DNA, 25 bp, Mus musculus
tggtacctccctgcaggaagaatgg

SEQ ID NO: 149060 - DNA, 25 bp, Mus musculus
tggtacctgccactatgagtgccag

SEQ ID NO: 149061 - DNA, 25 bp, Mus musculus
tggtacgaactccacaggtcctggg

SEQ ID NO: 149062 - DNA, 25 bp, Mus musculus
tggtacgggttatcttcagtgtgtc

SEQ ID NO: 149063 - DNA, 25 bp, Mus musculus
tggtactgaaccatcggaagcaggc

SEQ ID NO: 149064 - DNA, 25 bp, Mus musculus
tggtactgagcctgcaagcaacagc

SEQ ID NO: 149065 - DNA, 25 bp, Mus musculus
tggtactgtgcagcccagaatgccc

SEQ ID NO: 149066 - DNA, 25 bp, Mus musculus
tggtactttggaaaacttggccgca

SEQ ID NO: 149067 - DNA, 25 bp, Mus musculus
tggtacttttcaacgtggcagaggg

SEQ ID NO: 149068 - DNA, 25 bp, Mus musculus
tggtagaacgccaggagaaagatct

SEQ ID NO: 149069 - DNA, 25 bp, Mus musculus
tggtagacaaccaggagctcggcta

SEQ ID NO: 149070 - DNA, 25 bp, Mus musculus
tggtagacccagaaatggaactgct

SEQ ID NO: 149071 - DNA, 25 bp, Mus musculus
tggtagacctgatcacactgtagac

SEQ ID NO: 149072 - DNA, 25 bp, Mus musculus
tggtagagaaagtgcggcatgctca

SEQ ID NO: 149073 - DNA, 25 bp, Mus musculus
tggtagagacgaagtccccagcagt

SEQ ID NO: 149074 - DNA, 25 bp, Mus musculus
tggtagaggctcagacatcggttcc

SEQ ID NO: 149075 - DNA, 25 bp, Mus musculus
tggtagatgcccgagagaagcttca

SEQ ID NO: 149076 - DNA, 25 bp, Mus musculus
tggtagccatcatcagcaacctggg

SEQ ID NO: 149077 - DNA, 25 bp, Mus musculus
tggtagccgaagaagaacacccggt

SEQ ID NO: 149078 - DNA, 25 bp, Mus musculus
tggtagctcagtagaagtgcgtcct

SEQ ID NO: 149079 - DNA, 25 bp, Mus musculus
tggtagctgcccaccacttggacct

SEQ ID NO: 149080 - DNA, 25 bp, Mus musculus
tggtaggcctgacacccatgtttgg

SEQ ID NO: 149081 - DNA, 25 bp, Mus musculus
tggtaggcgccatcagaaacgctgc

SEQ ID NO: 149082 - DNA, 25 bp, Mus musculus
tggtagtaatgtgagcctgggcaac

SEQ ID NO: 149083 - DNA, 25 bp, Mus musculus
tggtagtattttggcaggaccagca

SEQ ID NO: 149084 - DNA, 25 bp, Mus musculus
tggtagtccaacaagcaatgctgat

SEQ ID NO: 149085 - DNA, 25 bp, Mus musculus
tggtagtgaaactcctggctgctgc

SEQ ID NO: 149086 - DNA, 25 bp, Mus musculus
tggtatagcctacgcggtcaaagtc

SEQ ID NO: 149087 - DNA, 25 bp, Mus musculus
tggtatccaaaaaagctcctgctct

SEQ ID NO: 149088 - DNA, 25 bp, Mus musculus
tggtatctggaaccccgattcgaag

SEQ ID NO: 149089 - DNA, 25 bp, Mus musculus
tggtatgcagcccagaacttcaccc

SEQ ID NO: 149090 - DNA, 25 bp, Mus musculus
tggtatggctacgacccaggaaaga

SEQ ID NO: 149091 - DNA, 25 bp, Mus musculus
tggtattactgactgcagcgccacc

SEQ ID NO: 149092 - DNA, 25 bp, Mus musculus
tggtattagtggagccctgcgagcc

SEQ ID NO: 149093 - DNA, 25 bp, Mus musculus
tggtattctctccagcggcaaggga

SEQ ID NO: 149094 - DNA, 25 bp, Mus musculus
tggtatttatcctccactgaactgg

SEQ ID NO: 149095 - DNA, 25 bp, Mus musculus
tggtcaaagactgggctcctaaagc

SEQ ID NO: 149096 - DNA, 25 bp, Mus musculus
tggtcaaagttctccatattcagag

SEQ ID NO: 149097 - DNA, 25 bp, Mus musculus
tggtcaacatgggtatcagcgtggt

SEQ ID NO: 149098 - DNA, 25 bp, Mus musculus
tggtcaaccgtcctcaaagcatctt

SEQ ID NO: 149099 - DNA, 25 bp, Mus musculus
tggtcaagctctgaatcccctcgag

SEQ ID NO: 149100 - DNA, 25 bp, Mus musculus
tggtcaattgcagtttacacccggg

SEQ ID NO: 149101 - DNA, 25 bp, Mus musculus
tggtcacaatggagcccggatacct

SEQ ID NO: 149102 - DNA, 25 bp, Mus musculus
tggtcacacatcctagtggccgaga

SEQ ID NO: 149103 - DNA, 25 bp, Mus musculus
tggtcacaccttgttctgaagcaaa

SEQ ID NO: 149104 - DNA, 25 bp, Mus musculus
tggtcacaggatgggaactctgtgc

SEQ ID NO: 149105 - DNA, 25 bp, Mus musculus
tggtcaccaccagcatcggcatgtg

SEQ ID NO: 149106 - DNA, 25 bp, Mus musculus
tggtcaccacctcagaactataaga

SEQ ID NO: 149107 - DNA, 25 bp, Mus musculus
tggtcacgagcgtgctcaacctcga

SEQ ID NO: 149108 - DNA, 25 bp, Mus musculus
tggtcacgtatctccacggcaggga

SEQ ID NO: 149109 - DNA, 25 bp, Mus musculus
tggtcacgtcaccaaaacgaggagg

SEQ ID NO: 149110 - DNA, 25 bp, Mus musculus
tggtcactcggacgaagaagatctt

SEQ ID NO: 149111 - DNA, 25 bp, Mus musculus
tggtcactgcaggacaagtacagca

SEQ ID NO: 149112 - DNA, 25 bp, Mus musculus
tggtcactttataggaggcagcccc

SEQ ID NO: 149113 - DNA, 25 bp, Mus musculus
tggtcagaaaacacaatatggcctc

SEQ ID NO: 149114 - DNA, 25 bp, Mus musculus
tggtcagacaccacgaagagacctg

SEQ ID NO: 149115 - DNA, 25 bp, Mus musculus
tggtcagagcaaacacgaaaggcct

SEQ ID NO: 149116 - DNA, 25 bp, Mus musculus
tggtcagcacaactaaacttcagga

SEQ ID NO: 149117 - DNA, 25 bp, Mus musculus
tggtcagcaggaggtgcaaacccat

SEQ ID NO: 149118 - DNA, 25 bp, Mus musculus
tggtcagccaggatatccccatggt

SEQ ID NO: 149119 - DNA, 25 bp, Mus musculus
tggtcagcccgagataaagcccatg

SEQ ID NO: 149120 - DNA, 25 bp, Mus musculus
tggtcagcctcagtacttgctctgg

SEQ ID NO: 149121 - DNA, 25 bp, Mus musculus
tggtcaggcggaagctaggaaccca

SEQ ID NO: 149122 - DNA, 25 bp, Mus musculus
tggtcagggacagctgcgaactctg

SEQ ID NO: 149123 - DNA, 25 bp, Mus musculus
tggtcagtccaagtcaaaagaaagc

SEQ ID NO: 149124 - DNA, 25 bp, Mus musculus
tggtcagtctgcatgttgtacagcc

SEQ ID NO: 149125 - DNA, 25 bp, Mus musculus
tggtcagtgccgagtctcctgcaga

SEQ ID NO: 149126 - DNA, 25 bp, Mus musculus
tggtcatcactgatctgacagcgcc

SEQ ID NO: 149127 - DNA, 25 bp, Mus musculus
tggtcatcagcgagaagcagcacgt

SEQ ID NO: 149128 - DNA, 25 bp, Mus musculus
tggtcatcataggaggtgggattct

SEQ ID NO: 149129 - DNA, 25 bp, Mus musculus
tggtcatggagacagcacatcgtgt

SEQ ID NO: 149130 - DNA, 25 bp, Mus musculus
tggtcattgatcacatcccagcagc

SEQ ID NO: 149131 - DNA, 25 bp, Mus musculus
tggtccaaggctccacagcaaacaa

SEQ ID NO: 149132 - DNA, 25 bp, Mus musculus
tggtccaagttcacagccaacgtcg

SEQ ID NO: 149133 - DNA, 25 bp, Mus musculus
tggtccacatcacacgagcatgcag

SEQ ID NO: 149134 - DNA, 25 bp, Mus musculus
tggtccacccagcatgtagtcagca

SEQ ID NO: 149135 - DNA, 25 bp, Mus musculus
tggtccaccctgcaggcttcgatgt

SEQ ID NO: 149136 - DNA, 25 bp, Mus musculus
tggtccaccgggaactgtgacgctg

SEQ ID NO: 149137 - DNA, 25 bp, Mus musculus
tggtccacgtcaccataagaggctt

SEQ ID NO: 149138 - DNA, 25 bp, Mus musculus
tggtccagaaatcacctgagactgt

SEQ ID NO: 149139 - DNA, 25 bp, Mus musculus
tggtccagagacaaacatacctcgg

SEQ ID NO: 149140 - DNA, 25 bp, Mus musculus
tggtccagaggagcaactgcgtgct

SEQ ID NO: 149141 - DNA, 25 bp, Mus musculus
tggtccagaggagcccgtatggatt

SEQ ID NO: 149142 - DNA, 25 bp, Mus musculus
tggtccagcctaagatcctcagttg

SEQ ID NO: 149143 - DNA, 25 bp, Mus musculus
tggtccagcgagtctaccagagctg

SEQ ID NO: 149144 - DNA, 25 bp, Mus musculus
tggtccaggaaaggcagtacacatc

SEQ ID NO: 149145 - DNA, 25 bp, Mus musculus
tggtccaggagcaagagtaccgaac

SEQ ID NO: 149146 - DNA, 25 bp, Mus musculus
tggtccaggcgaggaaaagctgttc

SEQ ID NO: 149147 - DNA, 25 bp, Mus musculus
tggtcccaaaaagcgaatgccaggc

SEQ ID NO: 149148 - DNA, 25 bp, Mus musculus
tggtccccgcgtggaagaggcacgg

SEQ ID NO: 149149 - DNA, 25 bp, Mus musculus
tggtccccggaatttgaagagctcc

SEQ ID NO: 149150 - DNA, 25 bp, Mus musculus
tggtcccgccccatgtctggcgagg

SEQ ID NO: 149151 - DNA, 25 bp, Mus musculus
tggtccctctgggtccataacggcc

SEQ ID NO: 149152 - DNA, 25 bp, Mus musculus
tggtccctggaatgatgatgtctgc

SEQ ID NO: 149153 - DNA, 25 bp, Mus musculus
tggtccctggccatcatttcctggg

SEQ ID NO: 149154 - DNA, 25 bp, Mus musculus
tggtccctggcttcatccagaagac

SEQ ID NO: 149155 - DNA, 25 bp, Mus musculus
tggtccctgtggaagataacgatga

SEQ ID NO: 149156 - DNA, 25 bp, Mus musculus
tggtcccttccaagtgtccgtgtaa

SEQ ID NO: 149157 - DNA, 25 bp, Mus musculus
tggtccgcagccgagagatctttga

SEQ ID NO: 149158 - DNA, 25 bp, Mus musculus
tggtccgcctcatacacaaggagtt

SEQ ID NO: 149159 - DNA, 25 bp, Mus musculus
tggtccggaagctgttgaaacaaac

SEQ ID NO: 149160 - DNA, 25 bp, Mus musculus
tggtccgtgtcagagcaaatgcagc

SEQ ID NO: 149161 - DNA, 25 bp, Mus musculus
tggtcctagaccacacaggaggctt

SEQ ID NO: 149162 - DNA, 25 bp, Mus musculus
tggtcctcacctcgcatcgagggat

SEQ ID NO: 149163 - DNA, 25 bp, Mus musculus
tggtcctcacggctttcccgattga

SEQ ID NO: 149164 - DNA, 25 bp, Mus musculus
tggtcctcttctacaccccgtggtg

SEQ ID NO: 149165 - DNA, 25 bp, Mus musculus
tggtcctgagctgcgatctgataac

SEQ ID NO: 149166 - DNA, 25 bp, Mus musculus
tggtcctgatgctgggcagctctat

SEQ ID NO: 149167 - DNA, 25 bp, Mus musculus
tggtcctgcatcatcagcgaaagcg

SEQ ID NO: 149168 - DNA, 25 bp, Mus musculus
tggtcctgcgactcttcctcgggct

SEQ ID NO: 149169 - DNA, 25 bp, Mus musculus
tggtcctgtgtcatccataaacatg

SEQ ID NO: 149170 - DNA, 25 bp, Mus musculus
tggtccttggtcttgcctggcctcc

SEQ ID NO: 149171 - DNA, 25 bp, Mus musculus
tggtcctttagacaccatgctgctg

SEQ ID NO: 149172 - DNA, 25 bp, Mus musculus
tggtcctttccactgttgatgctga

SEQ ID NO: 149173 - DNA, 25 bp, Mus musculus
tggtcgaaaggcataccttgctggc

SEQ ID NO: 149174 - DNA, 25 bp, Mus musculus
tggtcgaagtctgccgtgcagaaca

SEQ ID NO: 149175 - DNA, 25 bp, Mus musculus
tggtcgactcaacaatatccgggct

SEQ ID NO: 149176 - DNA, 25 bp, Mus musculus
tggtcgagacagtgagaggtccacc

SEQ ID NO: 149177 - DNA, 25 bp, Mus musculus
tggtcgcaaggccaatgtgaacctg

SEQ ID NO: 149178 - DNA, 25 bp, Mus musculus
tggtcgcacaccacagtaaggaatg

SEQ ID NO: 149179 - DNA, 25 bp, Mus musculus
tggtcgcagaggaatacaatgcctt

SEQ ID NO: 149180 - DNA, 25 bp, Mus musculus
tggtcgctcacgcttcgcagctatg

SEQ ID NO: 149181 - DNA, 25 bp, Mus musculus
tggtcgcttcttcatcaccaacaag

SEQ ID NO: 149182 - DNA, 25 bp, Mus musculus
tggtcggcaacaaaacggatctggg

SEQ ID NO: 149183 - DNA, 25 bp, Mus musculus
tggtcggcccatcacagaagatgag

SEQ ID NO: 149184 - DNA, 25 bp, Mus musculus
tggtcgtaaacagcacaaggagctc

SEQ ID NO: 149185 - DNA, 25 bp, Mus musculus
tggtcgtcgcgctaaggaagttttc

SEQ ID NO: 149186 - DNA, 25 bp, Mus musculus
tggtcgtgccatagaatcaacttga

SEQ ID NO: 149187 - DNA, 25 bp, Mus musculus
tggtcgtggattcctccaatacagc

SEQ ID NO: 149188 - DNA, 25 bp, Mus musculus
tggtctacaactcagcggtcggctt

SEQ ID NO: 149189 - DNA, 25 bp, Mus musculus
tggtctacatcgacacagagtctgc

SEQ ID NO: 149190 - DNA, 25 bp, Mus musculus
tggtctatgagccaatgagtccagc

SEQ ID NO: 149191 - DNA, 25 bp, Mus musculus
tggtctatgccttaaagtgtaaggg

SEQ ID NO: 149192 - DNA, 25 bp, Mus musculus
tggtctattggagcccagttctggg

SEQ ID NO: 149193 - DNA, 25 bp, Mus musculus
tggtctcacggtctcatggtctcgg

SEQ ID NO: 149194 - DNA, 25 bp, Mus musculus
tggtctcagatcaacccaatcatga

SEQ ID NO: 149195 - DNA, 25 bp, Mus musculus
tggtctcagcgactcctgggatccc

SEQ ID NO: 149196 - DNA, 25 bp, Mus musculus
tggtctcccgcaaagcacggaggtg

SEQ ID NO: 149197 - DNA, 25 bp, Mus musculus
tggtctcctaccatgcgcataacgg

SEQ ID NO: 149198 - DNA, 25 bp, Mus musculus
tggtctctaccgcttagttcaggca

SEQ ID NO: 149199 - DNA, 25 bp, Mus musculus
tggtctctagccagcgacgacttgg

SEQ ID NO: 149200 - DNA, 25 bp, Mus musculus
tggtctctcagtatgtgggaaatcc

SEQ ID NO: 149201 - DNA, 25 bp, Mus musculus
tggtctctcgggtacatctgtggca

SEQ ID NO: 149202 - DNA, 25 bp, Mus musculus
tggtctctgcaatcatcaccgtcag

SEQ ID NO: 149203 - DNA, 25 bp, Mus musculus
tggtctctgtgttgttggcggtccc

SEQ ID NO: 149204 - DNA, 25 bp, Mus musculus
tggtctgagcatctctgccatgcgg

SEQ ID NO: 149205 - DNA, 25 bp, Mus musculus
tggtctgagcgtggatacactgcac

SEQ ID NO: 149206 - DNA, 25 bp, Mus musculus
tggtctgatccgtgagctagttctc

SEQ ID NO: 149207 - DNA, 25 bp, Mus musculus
tggtctgcccttcgaggaaacaact

SEQ ID NO: 149208 - DNA, 25 bp, Mus musculus
tggtctggaaacacactcgagggat

SEQ ID NO: 149209 - DNA, 25 bp, Mus musculus
tggtctgggccctgctacttgccct

SEQ ID NO: 149210 - DNA, 25 bp, Mus musculus
tggtctgggtctgagtccaggccca

SEQ ID NO: 149211 - DNA, 25 bp, Mus musculus
tggtctgtcaccgtctccctttaaa

SEQ ID NO: 149212 - DNA, 25 bp, Mus musculus
tggtctgtgttctcgctgcagcgga

SEQ ID NO: 149213 - DNA, 25 bp, Mus musculus
tggtcttcccttatagacgcagaga

SEQ ID NO: 149214 - DNA, 25 bp, Mus musculus
tggtcttgaacacgctgccagctga

SEQ ID NO: 149215 - DNA, 25 bp, Mus musculus
tggtcttgcctgctgtcaatatggg

SEQ ID NO: 149216 - DNA, 25 bp, Mus musculus
tggtctttatcgtgaggctctggca

SEQ ID NO: 149217 - DNA, 25 bp, Mus musculus
tggtctttgcctcctaaaaacgcgg

SEQ ID NO: 149218 - DNA, 25 bp, Mus musculus
tggtgaaaagggactaaatctctaa

SEQ ID NO: 149219 - DNA, 25 bp, Mus musculus
tggtgaaatacacacgtagccctct

SEQ ID NO: 149220 - DNA, 25 bp, Mus musculus
tggtgaactgcgtcagaatcccggc

SEQ ID NO: 149221 - DNA, 25 bp, Mus musculus
tggtgaagacatgacgaccctggac

SEQ ID NO: 149222 - DNA, 25 bp, Mus musculus
tggtgaagccaatccctattaaagg

SEQ ID NO: 149223 - DNA, 25 bp, Mus musculus
tggtgaagcccaagtacaaaggacg

SEQ ID NO: 149224 - DNA, 25 bp, Mus musculus
tggtgaagctcacacacatttctgc

SEQ ID NO: 149225 - DNA, 25 bp, Mus musculus
tggtgaagctctgcgactcgggcca

SEQ ID NO: 149226 - DNA, 25 bp, Mus musculus
tggtgaaggtcccagtaaattctca

SEQ ID NO: 149227 - DNA, 25 bp, Mus musculus
tggtgaataactatggcagccggcc

SEQ ID NO: 149228 - DNA, 25 bp, Mus musculus
tggtgaatcccacaaaaatcagagc

SEQ ID NO: 149229 - DNA, 25 bp, Mus musculus
tggtgaatcccagagaccgccgcgt

SEQ ID NO: 149230 - DNA, 25 bp, Mus musculus
tggtgaatcctcaggcgggtctcag

SEQ ID NO: 149231 - DNA, 25 bp, Mus musculus
tggtgaatctcataggctcctggga

SEQ ID NO: 149232 - DNA, 25 bp, Mus musculus
tggtgaatctctaacatggaagcct

SEQ ID NO: 149233 - DNA, 25 bp, Mus musculus
tggtgaatgaccagctgccggacat

SEQ ID NO: 149234 - DNA, 25 bp, Mus musculus
tggtgaatgagaatgtcagcctcgt

SEQ ID NO: 149235 - DNA, 25 bp, Mus musculus
tggtgaatggacttgttctagaatc

SEQ ID NO: 149236 - DNA, 25 bp, Mus musculus
tggtgaattctatagccaagacgta

SEQ ID NO: 149237 - DNA, 25 bp, Mus musculus
tggtgacaacaagcgcaatgaacgg

SEQ ID NO: 149238 - DNA, 25 bp, Mus musculus
tggtgacacacaggtcccatggtct

SEQ ID NO: 149239 - DNA, 25 bp, Mus musculus
tggtgacacagttcaacccctcaga

SEQ ID NO: 149240 - DNA, 25 bp, Mus musculus
tggtgacaccattcggagaatcatg

SEQ ID NO: 149241 - DNA, 25 bp, Mus musculus
tggtgacaggttccaaggccactgc

SEQ ID NO: 149242 - DNA, 25 bp, Mus musculus
tggtgacagtaaacaagcctcaact

SEQ ID NO: 149243 - DNA, 25 bp, Mus musculus
tggtgacagtggcagtatacagctt

SEQ ID NO: 149244 - DNA, 25 bp, Mus musculus
tggtgaccacaaccacttgctagtg

SEQ ID NO: 149245 - DNA, 25 bp, Mus musculus
tggtgaccaccaacgattgcaagtt

SEQ ID NO: 149246 - DNA, 25 bp, Mus musculus
tggtgaccatacatccagttgggct

SEQ ID NO: 149247 - DNA, 25 bp, Mus musculus
tggtgacccgaagaataagcatgtg

SEQ ID NO: 149248 - DNA, 25 bp, Mus musculus
tggtgacccggcacaaggacataga

SEQ ID NO: 149249 - DNA, 25 bp, Mus musculus
tggtgaccgccttcgtagagtgtga

SEQ ID NO: 149250 - DNA, 25 bp, Mus musculus
tggtgacggagaggaccacatcgcc

SEQ ID NO: 149251 - DNA, 25 bp, Mus musculus
tggtgacgggaaaggactgccctca

SEQ ID NO: 149252 - DNA, 25 bp, Mus musculus
tggtgacggtggcaacggcagcgtc

SEQ ID NO: 149253 - DNA, 25 bp, Mus musculus
tggtgactgtcagctgccggcttca

SEQ ID NO: 149254 - DNA, 25 bp, Mus musculus
tggtgacttctggattggcctcaag

SEQ ID NO: 149255 - DNA, 25 bp, Mus musculus
tggtgagaacctgaggacagaccct

SEQ ID NO: 149256 - DNA, 25 bp, Mus musculus
tggtgagaagccagtcctaggccct

SEQ ID NO: 149257 - DNA, 25 bp, Mus musculus
tggtgagcacctccgtgagcttctt

SEQ ID NO: 149258 - DNA, 25 bp, Mus musculus
tggtgagcgagtgactgaaacctgc

SEQ ID NO: 149259 - DNA, 25 bp, Mus musculus
tggtgagcggcctccacccaaacga

SEQ ID NO: 149260 - DNA, 25 bp, Mus musculus
tggtgagctcatccatgccggcgtt

SEQ ID NO: 149261 - DNA, 25 bp, Mus musculus
tggtgagtagccagccaaagtacga

SEQ ID NO: 149262 - DNA, 25 bp, Mus musculus
tggtgagtgaaatggagagccaacc

SEQ ID NO: 149263 - DNA, 25 bp, Mus musculus
tggtgatcaatactgaagcggagca

SEQ ID NO: 149264 - DNA, 25 bp, Mus musculus
tggtgatcctactcagcacttggaa

SEQ ID NO: 149265 - DNA, 25 bp, Mus musculus
tggtgatcctgttccgtcctgtgaa

SEQ ID NO: 149266 - DNA, 25 bp, Mus musculus
tggtgatgaactctacacccgattg

SEQ ID NO: 149267 - DNA, 25 bp, Mus musculus
tggtgatgacaagagccaggctgcc

SEQ ID NO: 149268 - DNA, 25 bp, Mus musculus
tggtgatgagagtggccaacctgcc

SEQ ID NO: 149269 - DNA, 25 bp, Mus musculus
tggtgatgatgattcggcccaaccc

SEQ ID NO: 149270 - DNA, 25 bp, Mus musculus
tggtgatgccacttcgtgctagcaa

SEQ ID NO: 149271 - DNA, 25 bp, Mus musculus
tggtgatgcccttcatgcagacaga

SEQ ID NO: 149272 - DNA, 25 bp, Mus musculus
tggtgatgctgatccctgctaagaa

SEQ ID NO: 149273 - DNA, 25 bp, Mus musculus
tggtgatggcacaaacttcgttctg

SEQ ID NO: 149274 - DNA, 25 bp, Mus musculus
tggtgattattaccgccaaggccgc

SEQ ID NO: 149275 - DNA, 25 bp, Mus musculus
tggtgattccggaaaagggcaaagc

SEQ ID NO: 149276 - DNA, 25 bp, Mus musculus
tggtgattctacaacggcgactagc

SEQ ID NO: 149277 - DNA, 25 bp, Mus musculus
tggtgattgccagtgtccagctccc

SEQ ID NO: 149278 - DNA, 25 bp, Mus musculus
tggtgcaaaagatgtcccacggctc

SEQ ID NO: 149279 - DNA, 25 bp, Mus musculus
tggtgcaaaggttgccgtgccgaca

SEQ ID NO: 149280 - DNA, 25 bp, Mus musculus
tggtgcaagaccctgtgtaagaact

SEQ ID NO: 149281 - DNA, 25 bp, Mus musculus
tggtgcaatgtccagctgcctctcg

SEQ ID NO: 149282 - DNA, 25 bp, Mus musculus
tggtgcaccagtgaagaccctgagc

SEQ ID NO: 149283 - DNA, 25 bp, Mus musculus
tggtgcacgtctactgaaatgaggg

SEQ ID NO: 149284 - DNA, 25 bp, Mus musculus
tggtgcactgaagagccaccctgtg

SEQ ID NO: 149285 - DNA, 25 bp, Mus musculus
tggtgcagcacgctacactctactg

SEQ ID NO: 149286 - DNA, 25 bp, Mus musculus
tggtgcagcccaaaccacgatggct

SEQ ID NO: 149287 - DNA, 25 bp, Mus musculus
tggtgcagctacaccaataattggc

SEQ ID NO: 149288 - DNA, 25 bp, Mus musculus
tggtgcaggactatatgcagatgaa

SEQ ID NO: 149289 - DNA, 25 bp, Mus musculus
tggtgccaaggagtatcgtaatgcg

SEQ ID NO: 149290 - DNA, 25 bp, Mus musculus
tggtgccagctattctcaaggaagc

SEQ ID NO: 149291 - DNA, 25 bp, Mus musculus
tggtgccatgggaaaaacctgaagc

SEQ ID NO: 149292 - DNA, 25 bp, Mus musculus
tggtgcccaccgaaactacaagaag

SEQ ID NO: 149293 - DNA, 25 bp, Mus musculus
tggtgcccacctgagaacagcagag

SEQ ID NO: 149294 - DNA, 25 bp, Mus musculus
tggtgcccttatgcctgcaacacga

SEQ ID NO: 149295 - DNA, 25 bp, Mus musculus
tggtgccctttcgtgagcgctttga

SEQ ID NO: 149296 - DNA, 25 bp, Mus musculus
tggtgcctatgagcagaaggccctg

SEQ ID NO: 149297 - DNA, 25 bp, Mus musculus
tggtgcctgcatgccaacaactggc

SEQ ID NO: 149298 - DNA, 25 bp, Mus musculus
tggtgcctgtgaagggaatcccact

SEQ ID NO: 149299 - DNA, 25 bp, Mus musculus
tggtgccttccaagaggtttggacc

SEQ ID NO: 149300 - DNA, 25 bp, Mus musculus
tggtgccttctgatcatgatcagct

SEQ ID NO: 149301 - DNA, 25 bp, Mus musculus
tggtgcgacctttactgtcacaagc

SEQ ID NO: 149302 - DNA, 25 bp, Mus musculus
tggtgcgagaccatcataagcgcct

SEQ ID NO: 149303 - DNA, 25 bp, Mus musculus
tggtgcgccacgacgatttactgct

SEQ ID NO: 149304 - DNA, 25 bp, Mus musculus
tggtgcggaacatgcccttgagtct

SEQ ID NO: 149305 - DNA, 25 bp, Mus musculus
tggtgcggcaccagaaggcgcacgt

SEQ ID NO: 149306 - DNA, 25 bp, Mus musculus
tggtgcgggtcattgtgcagcaccc

SEQ ID NO: 149307 - DNA, 25 bp, Mus musculus
tggtgctacatcagcagcgagaccg

SEQ ID NO: 149308 - DNA, 25 bp, Mus musculus
tggtgctacggactcaagacagaac

SEQ ID NO: 149309 - DNA, 25 bp, Mus musculus
tggtgctactcctctggactggagc

SEQ ID NO: 149310 - DNA, 25 bp, Mus musculus
tggtgctctgactgcggcagccgtt

SEQ ID NO: 149311 - DNA, 25 bp, Mus musculus
tggtgctggccaagcagctgctgct

SEQ ID NO: 149312 - DNA, 25 bp, Mus musculus
tggtggaaaccaaccacagggacgt

SEQ ID NO: 149313 - DNA, 25 bp, Mus musculus
tggtggaaccggaggtacttcattt

SEQ ID NO: 149314 - DNA, 25 bp, Mus musculus
tggtggaagccggacagacaatagc

SEQ ID NO: 149315 - DNA, 25 bp, Mus musculus
tggtggacacatcatcctgagaggc

SEQ ID NO: 149316 - DNA, 25 bp, Mus musculus
tggtggacacccagatccagacaaa

SEQ ID NO: 149317 - DNA, 25 bp, Mus musculus
tggtggacactgaacacagccctct

SEQ ID NO: 149318 - DNA, 25 bp, Mus musculus
tggtggaccccaaggacatcgatga

SEQ ID NO: 149319 - DNA, 25 bp, Mus musculus
tggtggaccgtgatctccgcaagac

SEQ ID NO: 149320 - DNA, 25 bp, Mus musculus
tggtggacgcgcaaagggattactg

SEQ ID NO: 149321 - DNA, 25 bp, Mus musculus
tggtggacggctgctactccttctg

SEQ ID NO: 149322 - DNA, 25 bp, Mus musculus
tggtggagatccatcagtacgctgg

SEQ ID NO: 149323 - DNA, 25 bp, Mus musculus
tggtggagctcatcgacaagtcggt

SEQ ID NO: 149324 - DNA, 25 bp, Mus musculus
tggtggagctgatgcacagacccgt

SEQ ID NO: 149325 - DNA, 25 bp, Mus musculus
tggtggagctgctgaggccgcagga

SEQ ID NO: 149326 - DNA, 25 bp, Mus musculus
tggtggatatcatcgctgcagtccc

SEQ ID NO: 149327 - DNA, 25 bp, Mus musculus
tggtggatcagtgtcgccatcgcct

SEQ ID NO: 149328 - DNA, 25 bp, Mus musculus
tggtggatcatcatagacgcggctg

SEQ ID NO: 149329 - DNA, 25 bp, Mus musculus
tggtggcagctaatgatggccccat

SEQ ID NO: 149330 - DNA, 25 bp, Mus musculus
tggtggcattctacccctgtggtca

SEQ ID NO: 149331 - DNA, 25 bp, Mus musculus
tggtggccaaccagacactgacaga

SEQ ID NO: 149332 - DNA, 25 bp, Mus musculus
tggtggccacatcctagaaagtgag

SEQ ID NO: 149333 - DNA, 25 bp, Mus musculus
tggtggccatcttcaagacactggg

SEQ ID NO: 149334 - DNA, 25 bp, Mus musculus
tggtggccatgacaacatttctgct

SEQ ID NO: 149335 - DNA, 25 bp, Mus musculus
tggtggcccatgagcagaattcctg

SEQ ID NO: 149336 - DNA, 25 bp, Mus musculus
tggtggcccgcagtattctcaacaa

SEQ ID NO: 149337 - DNA, 25 bp, Mus musculus
tggtggccctgaacacactgtgtgt

SEQ ID NO: 149338 - DNA, 25 bp, Mus musculus
tggtggccctgctcgcactggtcct

SEQ ID NO: 149339 - DNA, 25 bp, Mus musculus
tggtggccggagagattctacaagc

SEQ ID NO: 149340 - DNA, 25 bp, Mus musculus
tggtggccgggatcttggtacaaaa

SEQ ID NO: 149341 - DNA, 25 bp, Mus musculus
tggtggcctaccagaaaggtcttgt

SEQ ID NO: 149342 - DNA, 25 bp, Mus musculus
tggtggcctcagaagccggagctat

SEQ ID NO: 149343 - DNA, 25 bp, Mus musculus
tggtggcctggtctcccaaatagag

SEQ ID NO: 149344 - DNA, 25 bp, Mus musculus
tggtggcgatcgaccagatgtgttc

SEQ ID NO: 149345 - DNA, 25 bp, Mus musculus
tggtggcgtccgaggctgaaggctt

SEQ ID NO: 149346 - DNA, 25 bp, Mus musculus
tggtggctgaagaaaacccgttctc

SEQ ID NO: 149347 - DNA, 25 bp, Mus musculus
tggtggcttcagtaacaactccagc

SEQ ID NO: 149348 - DNA, 25 bp, Mus musculus
tggtgggaaccccatcccgagtgtt

SEQ ID NO: 149349 - DNA, 25 bp, Mus musculus
tggtgggcccaaacctccaagtggg

SEQ ID NO: 149350 - DNA, 25 bp, Mus musculus
tggtgggtgagccctccttatactg

SEQ ID NO: 149351 - DNA, 25 bp, Mus musculus
tggtgggtggctctgactactctaa

SEQ ID NO: 149352 - DNA, 25 bp, Mus musculus
tggtgggttcttccgctcagacctg

SEQ ID NO: 149353 - DNA, 25 bp, Mus musculus
tggtggtaaccacaaaagctggcct

SEQ ID NO: 149354 - DNA, 25 bp, Mus musculus
tggtggtaactcagcacagtgctca

SEQ ID NO: 149355 - DNA, 25 bp, Mus musculus
tggtggtacttttggcagcagctgc

SEQ ID NO: 149356 - DNA, 25 bp, Mus musculus
tggtggtcagaacatcacagcccgg

SEQ ID NO: 149357 - DNA, 25 bp, Mus musculus
tggtggtcagcaacatcacaaggct

SEQ ID NO: 149358 - DNA, 25 bp, Mus musculus
tggtggtcatcccatacaggctgag

SEQ ID NO: 149359 - DNA, 25 bp, Mus musculus
tggtggtgatcagcttcttgtccct

SEQ ID NO: 149360 - DNA, 25 bp, Mus musculus
tggtggttcccgacccagattcact

SEQ ID NO: 149361 - DNA, 25 bp, Mus musculus
tggtggttggctccgagctgcagtc

SEQ ID NO: 149362 - DNA, 25 bp, Mus musculus
tggtgtaaaagtagtgagttccccg

SEQ ID NO: 149363 - DNA, 25 bp, Mus musculus
tggtgtaccacaccccgcaggtgct

SEQ ID NO: 149364 - DNA, 25 bp, Mus musculus
tggtgtaccaccctgacctagagga

SEQ ID NO: 149365 - DNA, 25 bp, Mus musculus
tggtgtcaatactcagccaggctga

SEQ ID NO: 149366 - DNA, 25 bp, Mus musculus
tggtgtcactgggaagcatggagga

SEQ ID NO: 149367 - DNA, 25 bp, Mus musculus
tggtgtcatgattgagccgctcccc

SEQ ID NO: 149368 - DNA, 25 bp, Mus musculus
tggtgtccaaccgaaccttcagtgc

SEQ ID NO: 149369 - DNA, 25 bp, Mus musculus
tggtgtccatgtgaaccaagtcact

SEQ ID NO: 149370 - DNA, 25 bp, Mus musculus
tggtgtccgtatggctgcagtgcac

SEQ ID NO: 149371 - DNA, 25 bp, Mus musculus
tggtgtcgacaggaaaatgcctctg

SEQ ID NO: 149372 - DNA, 25 bp, Mus musculus
tggtgtctatgtcctagccggtgcc

SEQ ID NO: 149373 - DNA, 25 bp, Mus musculus
tggtgtctgccttttttgttctttg

SEQ ID NO: 149374 - DNA, 25 bp, Mus musculus
tggtgtctggcggagacagcatggc

SEQ ID NO: 149375 - DNA, 25 bp, Mus musculus
tggtgtcttatgagagccctgcaaa

SEQ ID NO: 149376 - DNA, 25 bp, Mus musculus
tggtgtgaagcactccatgaacccc

SEQ ID NO: 149377 - DNA, 25 bp, Mus musculus
tggtgtgacaccatcactgagaagg

SEQ ID NO: 149378 - DNA, 25 bp, Mus musculus
tggtgtgaccttgaatgagtcagcc

SEQ ID NO: 149379 - DNA, 25 bp, Mus musculus
tggtgtgccagaaaaaatcagcctg

SEQ ID NO: 149380 - DNA, 25 bp, Mus musculus
tggtgtgcttttgggatcatggcaa

SEQ ID NO: 149381 - DNA, 25 bp, Mus musculus
tggtgtggagaacccagtccttcct

SEQ ID NO: 149382 - DNA, 25 bp, Mus musculus
tggtgtggcaagaagacagtcccgt

SEQ ID NO: 149383 - DNA, 25 bp, Mus musculus
tggtgtgggacagcaatactggacc

SEQ ID NO: 149384 - DNA, 25 bp, Mus musculus
tggtgtgtgacctccctagtagcag

SEQ ID NO: 149385 - DNA, 25 bp, Mus musculus
tggtgttacttcttaagggccttgg

SEQ ID NO: 149386 - DNA, 25 bp, Mus musculus
tggtgttggaggaccctccccgctg

SEQ ID NO: 149387 - DNA, 25 bp, Mus musculus
tggtgttttcccctgccatctggcc

SEQ ID NO: 149388 - DNA, 25 bp, Mus musculus
tggttacaggataacgattgcgccc

SEQ ID NO: 149389 - DNA, 25 bp, Mus musculus
tggttacctacgagcttctgcagcg

SEQ ID NO: 149390 - DNA, 25 bp, Mus musculus
tggttacggctctgcattcaatcga

SEQ ID NO: 149391 - DNA, 25 bp, Mus musculus
tggttacggtcatcctgctggctac

SEQ ID NO: 149392 - DNA, 25 bp, Mus musculus
tggttactacaagactgccctgctg

SEQ ID NO: 149393 - DNA, 25 bp, Mus musculus
tggttactcgtcatgggcctgctga

SEQ ID NO: 149394 - DNA, 25 bp, Mus musculus
tggttactgcacagctgaggagtga

SEQ ID NO: 149395 - DNA, 25 bp, Mus musculus
tggttagaatatggacagccagctg

SEQ ID NO: 149396 - DNA, 25 bp, Mus musculus
tggttatccaccacccggcggagga

SEQ ID NO: 149397 - DNA, 25 bp, Mus musculus
tggttatgacaacaggctgcgtcct

SEQ ID NO: 149398 - DNA, 25 bp, Mus musculus
tggttattcaggactgctgactggg

SEQ ID NO: 149399 - DNA, 25 bp, Mus musculus
tggttcaacggtgcagcttcgatgt

SEQ ID NO: 149400 - DNA, 25 bp, Mus musculus
tggttcacaccagaaggattccggt

SEQ ID NO: 149401 - DNA, 25 bp, Mus musculus
tggttcacagacagccacacaggat

SEQ ID NO: 149402 - DNA, 25 bp, Mus musculus
tggttcaccaacatcagacatctgg

SEQ ID NO: 149403 - DNA, 25 bp, Mus musculus
tggttcaccccgtcatgattgctgt

SEQ ID NO: 149404 - DNA, 25 bp, Mus musculus
tggttcaggcactcaagacatcaag

SEQ ID NO: 149405 - DNA, 25 bp, Mus musculus
tggttcatcatctcagtacagcagc

SEQ ID NO: 149406 - DNA, 25 bp, Mus musculus
tggttcatgtggttgactccccagc

SEQ ID NO: 149407 - DNA, 25 bp, Mus musculus
tggttcattgataaaccccaatgtg

SEQ ID NO: 149408 - DNA, 25 bp, Mus musculus
tggttccagaaagtccagcgcagca

SEQ ID NO: 149409 - DNA, 25 bp, Mus musculus
tggttccagcagagatcttgccgac

SEQ ID NO: 149410 - DNA, 25 bp, Mus musculus
tggttccatcccgagactacgcgta

SEQ ID NO: 149411 - DNA, 25 bp, Mus musculus
tggttcccaatgcaacgctgctgtt

SEQ ID NO: 149412 - DNA, 25 bp, Mus musculus
tggttccccgggtttcactgtggtg

SEQ ID NO: 149413 - DNA, 25 bp, Mus musculus
tggttcccggatgcaccgtcactgt

SEQ ID NO: 149414 - DNA, 25 bp, Mus musculus
tggttccgggaacgctcatcaaaaa

SEQ ID NO: 149415 - DNA, 25 bp, Mus musculus
tggttcctcgagtaaaagtggcaga

SEQ ID NO: 149416 - DNA, 25 bp, Mus musculus
tggttcctgacactgtgaacctgag

SEQ ID NO: 149417 - DNA, 25 bp, Mus musculus
tggttcctgccccaaaggtggtcct

SEQ ID NO: 149418 - DNA, 25 bp, Mus musculus
tggttcctggtttcagccctgcgga

SEQ ID NO: 149419 - DNA, 25 bp, Mus musculus
tggttccttaatggagagcagctcc

SEQ ID NO: 149420 - DNA, 25 bp, Mus musculus
tggttcgagtgagtaaaaattaccg

SEQ ID NO: 149421 - DNA, 25 bp, Mus musculus
tggttcggagcaacagttcgggccc

SEQ ID NO: 149422 - DNA, 25 bp, Mus musculus
tggttctactctcatcttccttggg

SEQ ID NO: 149423 - DNA, 25 bp, Mus musculus
tggttctatggaaggatatcagccc

SEQ ID NO: 149424 - DNA, 25 bp, Mus musculus
tggttctccgaaacatggtggaccc

SEQ ID NO: 149425 - DNA, 25 bp, Mus musculus
tggttctgaagttcgttccttttct

SEQ ID NO: 149426 - DNA, 25 bp, Mus musculus
tggttctgcgtgctgttccttctgg

SEQ ID NO: 149427 - DNA, 25 bp, Mus musculus
tggttctgtacggtctcctggaggc

SEQ ID NO: 149428 - DNA, 25 bp, Mus musculus
tggttctttgccactacctgcggct

SEQ ID NO: 149429 - DNA, 25 bp, Mus musculus
tggttgacgctggacaaagatgtgc

SEQ ID NO: 149430 - DNA, 25 bp, Mus musculus
tggttgagcacagcagcaaactttt

SEQ ID NO: 149431 - DNA, 25 bp, Mus musculus
tggttgatgagatccttcacgtgcc

SEQ ID NO: 149432 - DNA, 25 bp, Mus musculus
tggttgcaagccgacaaagctgcac

SEQ ID NO: 149433 - DNA, 25 bp, Mus musculus
tggttgcaagtcataagcctgaggc

SEQ ID NO: 149434 - DNA, 25 bp, Mus musculus
tggttgcaggcttgctggcacgcac

SEQ ID NO: 149435 - DNA, 25 bp, Mus musculus
tggttgcagggacagatttagctca

SEQ ID NO: 149436 - DNA, 25 bp, Mus musculus
tggttgccagcctacaagataaagg

SEQ ID NO: 149437 - DNA, 25 bp, Mus musculus
tggttgctaagacactctggctcgc

SEQ ID NO: 149438 - DNA, 25 bp, Mus musculus
tggttgctctgtgcacaaaggctat

SEQ ID NO: 149439 - DNA, 25 bp, Mus musculus
tggttgtagaggatgagcagcccgg

SEQ ID NO: 149440 - DNA, 25 bp, Mus musculus
tggttgtcagcatcttgctcctgta

SEQ ID NO: 149441 - DNA, 25 bp, Mus musculus
tggttgtctacccttggacccagcg

SEQ ID NO: 149442 - DNA, 25 bp, Mus musculus
tggttgtgacattgaacatggcagc

SEQ ID NO: 149443 - DNA, 25 bp, Mus musculus
tggttgtgagtcatcccagagagtg

SEQ ID NO: 149444 - DNA, 25 bp, Mus musculus
tggttgtggacacacctccagggac

SEQ ID NO: 149445 - DNA, 25 bp, Mus musculus
tggttgttggaggttcttttggtct

SEQ ID NO: 149446 - DNA, 25 bp, Mus musculus
tggtttacaacagaacatctcgggc

SEQ ID NO: 149447 - DNA, 25 bp, Mus musculus
tggtttaccatacaagagatctgag

SEQ ID NO: 149448 - DNA, 25 bp, Mus musculus
tggtttacgaagagcagtcaaagtg

SEQ ID NO: 149449 - DNA, 25 bp, Mus musculus
tggtttatccctatatgagcaacgg

SEQ ID NO: 149450 - DNA, 25 bp, Mus musculus
tggtttcaagtgactacccggtaca

SEQ ID NO: 149451 - DNA, 25 bp, Mus musculus
tggtttcaccctcaacgacgatgga

SEQ ID NO: 149452 - DNA, 25 bp, Mus musculus
tggtttcagaatgcccgggccaagt

SEQ ID NO: 149453 - DNA, 25 bp, Mus musculus
tggtttcagctgctcaagtctggag

SEQ ID NO: 149454 - DNA, 25 bp, Mus musculus
tggtttcatcatggcgtcaatgcag

SEQ ID NO: 149455 - DNA, 25 bp, Mus musculus
tggtttccaacatgacctgagcagc

SEQ ID NO: 149456 - DNA, 25 bp, Mus musculus
tggtttccaagttcagccctggtgc

SEQ ID NO: 149457 - DNA, 25 bp, Mus musculus
tggtttccagtccatcgtgagcgga

SEQ ID NO: 149458 - DNA, 25 bp, Mus musculus
tggtttccgttcaggcaagaaggcg

SEQ ID NO: 149459 - DNA, 25 bp, Mus musculus
tggtttcggccgtgagcttcatgca

SEQ ID NO: 149460 - DNA, 25 bp, Mus musculus
tggtttcgtttctgcaccgactgga

SEQ ID NO: 149461 - DNA, 25 bp, Mus musculus
tggtttctacacatgcaaggcggtc

SEQ ID NO: 149462 - DNA, 25 bp, Mus musculus
tggtttctggcttacagagtgcgcc

SEQ ID NO: 149463 - DNA, 25 bp, Mus musculus
tggtttgaccacatcaagggctgga

SEQ ID NO: 149464 - DNA, 25 bp, Mus musculus
tggtttgagagtctctgagaagtcc

SEQ ID NO: 149465 - DNA, 25 bp, Mus musculus
tggtttgccatggaacgacttgaaa

SEQ ID NO: 149466 - DNA, 25 bp, Mus musculus
tggtttggagaaagcacacctgcac

SEQ ID NO: 149467 - DNA, 25 bp, Mus musculus
tggtttggagagaaagcgttgcagg

SEQ ID NO: 149468 - DNA, 25 bp, Mus musculus
tggttttaagagtggaaagctagct

SEQ ID NO: 149469 - DNA, 25 bp, Mus musculus
tggttttaagcaccccaggcaatta

SEQ ID NO: 149470 - DNA, 25 bp, Mus musculus
tggttttcagatccggctcagacag

SEQ ID NO: 149471 - DNA, 25 bp, Mus musculus
tggttttggatgtgtgtaccgagca

SEQ ID NO: 149472 - DNA, 25 bp, Mus musculus
tgtaaaaacacagggaggatgcagt

SEQ ID NO: 149473 - DNA, 25 bp, Mus musculus
tgtaaaaaccctcactctgtcgcag

SEQ ID NO: 149474 - DNA, 25 bp, Mus musculus
tgtaaaaagcaaggaagacatatac

SEQ ID NO: 149475 - DNA, 25 bp, Mus musculus
tgtaaaaaggacatctgagcaggcc

SEQ ID NO: 149476 - DNA, 25 bp, Mus musculus
tgtaaaacatgcagctcctgtcgtg

SEQ ID NO: 149477 - DNA, 25 bp, Mus musculus
tgtaaaaggactgacttggaagccc

SEQ ID NO: 149478 - DNA, 25 bp, Mus musculus
tgtaaaaggatctcaggtcgcccag

SEQ ID NO: 149479 - DNA, 25 bp, Mus musculus
tgtaaaataacaagtcgatcctcag

SEQ ID NO: 149480 - DNA, 25 bp, Mus musculus
tgtaaacaaacgtgcacgtgctcgc

SEQ ID NO: 149481 - DNA, 25 bp, Mus musculus
tgtaaacacgaccaagagagacgct

SEQ ID NO: 149482 - DNA, 25 bp, Mus musculus
tgtaaacacggaaagaactgcccca

SEQ ID NO: 149483 - DNA, 25 bp, Mus musculus
tgtaaacccacaagagaggccactc

SEQ ID NO: 149484 - DNA, 25 bp, Mus musculus
tgtaaacccactagaagctcaagag

SEQ ID NO: 149485 - DNA, 25 bp, Mus musculus
tgtaaacgaaacagttccaaggcgc

SEQ ID NO: 149486 - DNA, 25 bp, Mus musculus
tgtaaacgacattgacgagtcatcc

SEQ ID NO: 149487 - DNA, 25 bp, Mus musculus
tgtaaacgcaaccatggacaggtgg

SEQ ID NO: 149488 - DNA, 25 bp, Mus musculus
tgtaaacgcgaggataaagctgttc

SEQ ID NO: 149489 - DNA, 25 bp, Mus musculus
tgtaaacgtgtccaaaataacgaga

SEQ ID NO: 149490 - DNA, 25 bp, Mus musculus
tgtaaacgtgtcctcgatgaccggc

SEQ ID NO: 149491 - DNA, 25 bp, Mus musculus
tgtaaactgctctgatttctgcctc

SEQ ID NO: 149492 - DNA, 25 bp, Mus musculus
tgtaaagaagtcgtcctccaggtcc

SEQ ID NO: 149493 - DNA, 25 bp, Mus musculus
tgtaaagacaccctggccaactgta

SEQ ID NO: 149494 - DNA, 25 bp, Mus musculus
tgtaaagactgaccagcctgtaggc

SEQ ID NO: 149495 - DNA, 25 bp, Mus musculus
tgtaaagatgttgcccacctacgtg

SEQ ID NO: 149496 - DNA, 25 bp, Mus musculus
tgtaaagccacttttcaacgtgttc

SEQ ID NO: 149497 - DNA, 25 bp, Mus musculus
tgtaaaggaaccatagccctgtccc

SEQ ID NO: 149498 - DNA, 25 bp, Mus musculus
tgtaaaggatattccagccaccctg

SEQ ID NO: 149499 - DNA, 25 bp, Mus musculus
tgtaaaggatgccacaacgatcgct

SEQ ID NO: 149500 - DNA, 25 bp, Mus musculus
tgtaaaggctcgctctcagagacgt

SEQ ID NO: 149501 - DNA, 25 bp, Mus musculus
tgtaaaggcttcgtccacaggcacg

SEQ ID NO: 149502 - DNA, 25 bp, Mus musculus
tgtaaagtcctgatcagtggccact

SEQ ID NO: 149503 - DNA, 25 bp, Mus musculus
tgtaaagtctgtctcagggcccagc

SEQ ID NO: 149504 - DNA, 25 bp, Mus musculus
tgtaaataacatcgtggttccccag

SEQ ID NO: 149505 - DNA, 25 bp, Mus musculus
tgtaaatacagagccgagttcgctg

SEQ ID NO: 149506 - DNA, 25 bp, Mus musculus
tgtaaatactatggcctctggctcc

SEQ ID NO: 149507 - DNA, 25 bp, Mus musculus
tgtaaatatcgtcaccatccgagag

SEQ ID NO: 149508 - DNA, 25 bp, Mus musculus
tgtaaatattactctgtcctctggg

SEQ ID NO: 149509 - DNA, 25 bp, Mus musculus
tgtaaatgacagaggatcagcccag

SEQ ID NO: 149510 - DNA, 25 bp, Mus musculus
tgtaaatgtatgatcgaccaggcac

SEQ ID NO: 149511 - DNA, 25 bp, Mus musculus
tgtaaatgtggccaacctcggtgct

SEQ ID NO: 149512 - DNA, 25 bp, Mus musculus
tgtaaatgttcatgcaccctgcctg

SEQ ID NO: 149513 - DNA, 25 bp, Mus musculus
tgtaacaaagccgtaccttgccctg

SEQ ID NO: 149514 - DNA, 25 bp, Mus musculus
tgtaacaacggcgagatcctctacc

SEQ ID NO: 149515 - DNA, 25 bp, Mus musculus
tgtaacaaggccttccatcaggtct

SEQ ID NO: 149516 - DNA, 25 bp, Mus musculus
tgtaacaatgagaccttcggccagt

SEQ ID NO: 149517 - DNA, 25 bp, Mus musculus
tgtaacaccaccctgtgtggagatg

SEQ ID NO: 149518 - DNA, 25 bp, Mus musculus
tgtaacaccactacagaagacgaag

SEQ ID NO: 149519 - DNA, 25 bp, Mus musculus
tgtaacagttctcattgggattgct

SEQ ID NO: 149520 - DNA, 25 bp, Mus musculus
tgtaacataacaaaggccaaggcca

SEQ ID NO: 149521 - DNA, 25 bp, Mus musculus
tgtaacatctgttcccgcaaaagag

SEQ ID NO: 149522 - DNA, 25 bp, Mus musculus
tgtaaccaacaagaatgaccctaag

SEQ ID NO: 149523 - DNA, 25 bp, Mus musculus
tgtaaccaccagaacaacggcaggt

SEQ ID NO: 149524 - DNA, 25 bp, Mus musculus
tgtaaccacccgttcccagtatggg

SEQ ID NO: 149525 - DNA, 25 bp, Mus musculus
tgtaaccagcatgggccggaaagtg

SEQ ID NO: 149526 - DNA, 25 bp, Mus musculus
tgtaaccccagtcggtgctctgtgg

SEQ ID NO: 149527 - DNA, 25 bp, Mus musculus
tgtaaccctgcgtgccttgaggcct

SEQ ID NO: 149528 - DNA, 25 bp, Mus musculus
tgtaaccgccgccagaaggagaaaa

SEQ ID NO: 149529 - DNA, 25 bp, Mus musculus
tgtaacctaacaaagtgactgagcc

SEQ ID NO: 149530 - DNA, 25 bp, Mus musculus
tgtaacctgagctaaaggcacaagc

SEQ ID NO: 149531 - DNA, 25 bp, Mus musculus
tgtaacctgttcagagagaccctgg

SEQ ID NO: 149532 - DNA, 25 bp, Mus musculus
tgtaacgacactctcaagcagctga

SEQ ID NO: 149533 - DNA, 25 bp, Mus musculus
tgtaacgagtaatgccgtccagcct

SEQ ID NO: 149534 - DNA, 25 bp, Mus musculus
tgtaactaacagaacaaacgagaac

SEQ ID NO: 149535 - DNA, 25 bp, Mus musculus
tgtaactaactagcatgctgcgcag

SEQ ID NO: 149536 - DNA, 25 bp, Mus musculus
tgtaactccgcaggaactgggcatc

SEQ ID NO: 149537 - DNA, 25 bp, Mus musculus
tgtaactccgtcatgaccaggtgct

SEQ ID NO: 149538 - DNA, 25 bp, Mus musculus
tgtaactgcactggctgtttcccgg

SEQ ID NO: 149539 - DNA, 25 bp, Mus musculus
tgtaactgcctgatggaagccggac

SEQ ID NO: 149540 - DNA, 25 bp, Mus musculus
tgtaactggcaaggatcacagcccg

SEQ ID NO: 149541 - DNA, 25 bp, Mus musculus
tgtaactggtaagggaattgacgcc

SEQ ID NO: 149542 - DNA, 25 bp, Mus musculus
tgtaacttctcttctggatctaaca

SEQ ID NO: 149543 - DNA, 25 bp, Mus musculus
tgtaacttctggaagggccgcgtgc

SEQ ID NO: 149544 - DNA, 25 bp, Mus musculus
tgtaacttgtttcctcggctgcaga

SEQ ID NO: 149545 - DNA, 25 bp, Mus musculus
tgtaactttaatgagagcccagagg

SEQ ID NO: 149546 - DNA, 25 bp, Mus musculus
tgtaagaacagcatcgcctacctgg

SEQ ID NO: 149547 - DNA, 25 bp, Mus musculus
tgtaagaagaaagacgggaagagcc

SEQ ID NO: 149548 - DNA, 25 bp, Mus musculus
tgtaagacggagacatcagaccacc

SEQ ID NO: 149549 - DNA, 25 bp, Mus musculus
tgtaagacttactcagcatcaggat

SEQ ID NO: 149550 - DNA, 25 bp, Mus musculus
tgtaagaggtgctagctcaagaagc

SEQ ID NO: 149551 - DNA, 25 bp, Mus musculus
tgtaagattcactgctggccgacga

SEQ ID NO: 149552 - DNA, 25 bp, Mus musculus
tgtaagcagcacttcagcaatctgg

SEQ ID NO: 149553 - DNA, 25 bp, Mus musculus
tgtaagccaaaagcaccaagatgtc

SEQ ID NO: 149554 - DNA, 25 bp, Mus musculus
tgtaagctgccaagactgtctctga

SEQ ID NO: 149555 - DNA, 25 bp, Mus musculus
tgtaagctgctgtgtatggatctca

SEQ ID NO: 149556 - DNA, 25 bp, Mus musculus
tgtaagctggacactcacgctctgt

SEQ ID NO: 149557 - DNA, 25 bp, Mus musculus
tgtaaggacagagaaaggcacagac

SEQ ID NO: 149558 - DNA, 25 bp, Mus musculus
tgtaaggagtctacccaaggcagca

SEQ ID NO: 149559 - DNA, 25 bp, Mus musculus
tgtaagggattgagttgcgccagac

SEQ ID NO: 149560 - DNA, 25 bp, Mus musculus
tgtaagggccaagcttgtggacttt

SEQ ID NO: 149561 - DNA, 25 bp, Mus musculus
tgtaaggtgaccatcgatgggaccg

SEQ ID NO: 149562 - DNA, 25 bp, Mus musculus
tgtaagtcacccagatcctgagccg

SEQ ID NO: 149563 - DNA, 25 bp, Mus musculus
tgtaagttaaagttcctccatggag

SEQ ID NO: 149564 - DNA, 25 bp, Mus musculus
tgtaagttgcatgccaaccaggcct

SEQ ID NO: 149565 - DNA, 25 bp, Mus musculus
tgtaatccacgcttccgagtctggt

SEQ ID NO: 149566 - DNA, 25 bp, Mus musculus
tgtaatcggatttgcccagagccct

SEQ ID NO: 149567 - DNA, 25 bp, Mus musculus
tgtaatctcttcttgcctcgcgctg

SEQ ID NO: 149568 - DNA, 25 bp, Mus musculus
tgtaatctggctgaagacactgcca

SEQ ID NO: 149569 - DNA, 25 bp, Mus musculus
tgtaatgaacatgcaaaaccggcag

SEQ ID NO: 149570 - DNA, 25 bp, Mus musculus
tgtaatgcaccaggtactggccctg

SEQ ID NO: 149571 - DNA, 25 bp, Mus musculus
tgtaatgccaccaactccattggct

SEQ ID NO: 149572 - DNA, 25 bp, Mus musculus
tgtaatggacacaccacagggatgg

SEQ ID NO: 149573 - DNA, 25 bp, Mus musculus
tgtaatgttttttgtctgcacagct

SEQ ID NO: 149574 - DNA, 25 bp, Mus musculus
tgtaattcattgatccagagcctgg

SEQ ID NO: 149575 - DNA, 25 bp, Mus musculus
tgtaatttaaaacctcagcagagtg

SEQ ID NO: 149576 - DNA, 25 bp, Mus musculus
tgtaatttgtacagggccatgcccc

SEQ ID NO: 149577 - DNA, 25 bp, Mus musculus
tgtacaaaggcagagcagctggttg

SEQ ID NO: 149578 - DNA, 25 bp, Mus musculus
tgtacaaatttgtggttcctaagcc

SEQ ID NO: 149579 - DNA, 25 bp, Mus musculus
tgtacaacagcctagatgcatctct

SEQ ID NO: 149580 - DNA, 25 bp, Mus musculus
tgtacaacccaaaaatggtgagttt

SEQ ID NO: 149581 - DNA, 25 bp, Mus musculus
tgtacaacggaagcctggtccacag

SEQ ID NO: 149582 - DNA, 25 bp, Mus musculus
tgtacaacgtcaccgagagcaacgc

SEQ ID NO: 149583 - DNA, 25 bp, Mus musculus
tgtacaactcaatcaagaacgagaa

SEQ ID NO: 149584 - DNA, 25 bp, Mus musculus
tgtacaagaaatgcaaacggccact

SEQ ID NO: 149585 - DNA, 25 bp, Mus musculus
tgtacaagagattgagggtgacctc

SEQ ID NO: 149586 - DNA, 25 bp, Mus musculus
tgtacaagcagtccattgcgcagcg

SEQ ID NO: 149587 - DNA, 25 bp, Mus musculus
tgtacaaggagtttgagccgagcct

SEQ ID NO: 149588 - DNA, 25 bp, Mus musculus
tgtacaagttgaaccaaggcccaca

SEQ ID NO: 149589 - DNA, 25 bp, Mus musculus
tgtacaataaatacatccgccgggc

SEQ ID NO: 149590 - DNA, 25 bp, Mus musculus
tgtacaataagcgaactccccacga

SEQ ID NO: 149591 - DNA, 25 bp, Mus musculus
tgtacaatgtgcctcagtgccagag

SEQ ID NO: 149592 - DNA, 25 bp, Mus musculus
tgtacacaaagaagaacgtcccctc

SEQ ID NO: 149593 - DNA, 25 bp, Mus musculus
tgtacacagtgacctgataaggctg

SEQ ID NO: 149594 - DNA, 25 bp, Mus musculus
tgtacacatcatagctactagcaaa

SEQ ID NO: 149595 - DNA, 25 bp, Mus musculus
tgtacacatgtaaacacgcataggg

SEQ ID NO: 149596 - DNA, 25 bp, Mus musculus
tgtacacattagaacagaggcctgc

SEQ ID NO: 149597 - DNA, 25 bp, Mus musculus
tgtacaccagtggttctacgggccg

SEQ ID NO: 149598 - DNA, 25 bp, Mus musculus
tgtacaccatcatgaatcccatcgg

SEQ ID NO: 149599 - DNA, 25 bp, Mus musculus
tgtacaccgagtgctactgtggcct

SEQ ID NO: 149600 - DNA, 25 bp, Mus musculus
tgtacacgaagcttggctgagggct

SEQ ID NO: 149601 - DNA, 25 bp, Mus musculus
tgtacacgcaagagcccaccagagg

SEQ ID NO: 149602 - DNA, 25 bp, Mus musculus
tgtacacggacacaatccaacagcg

SEQ ID NO: 149603 - DNA, 25 bp, Mus musculus
tgtacacggaccttcgagatggacg

SEQ ID NO: 149604 - DNA, 25 bp, Mus musculus
tgtacactccagctctaagggccag

SEQ ID NO: 149605 - DNA, 25 bp, Mus musculus
tgtacactcgggaacaggctctctt

SEQ ID NO: 149606 - DNA, 25 bp, Mus musculus
tgtacagaaacactctgaaagaatc

SEQ ID NO: 149607 - DNA, 25 bp, Mus musculus
tgtacagaacgagaaagcaatggct

SEQ ID NO: 149608 - DNA, 25 bp, Mus musculus
tgtacagacgtgaaccatctatgga

SEQ ID NO: 149609 - DNA, 25 bp, Mus musculus
tgtacagaggccatcaagagagacc

SEQ ID NO: 149610 - DNA, 25 bp, Mus musculus
tgtacagcagtgaggcctaagggct

SEQ ID NO: 149611 - DNA, 25 bp, Mus musculus
tgtacagcattattggaagcagatg

SEQ ID NO: 149612 - DNA, 25 bp, Mus musculus
tgtacagcccagtacccgggagatt

SEQ ID NO: 149613 - DNA, 25 bp, Mus musculus
tgtacagccctcctatggccaggat

SEQ ID NO: 149614 - DNA, 25 bp, Mus musculus
tgtacagccgcctcagggagtacct

SEQ ID NO: 149615 - DNA, 25 bp, Mus musculus
tgtacagcgagaacaccctgcagtt

SEQ ID NO: 149616 - DNA, 25 bp, Mus musculus
tgtacagcgtcatataggctttgcc

SEQ ID NO: 149617 - DNA, 25 bp, Mus musculus
tgtacaggcaacaggagtctggcag

SEQ ID NO: 149618 - DNA, 25 bp, Mus musculus
tgtacaggcacccactataagagtg

SEQ ID NO: 149619 - DNA, 25 bp, Mus musculus
tgtacaggcctaagtacagggcaga

SEQ ID NO: 149620 - DNA, 25 bp, Mus musculus
tgtacaggctgaaattgaccgagtg

SEQ ID NO: 149621 - DNA, 25 bp, Mus musculus
tgtacagggcacacagaatcattga

SEQ ID NO: 149622 - DNA, 25 bp, Mus musculus
tgtacagggtcatccaggacatcca

SEQ ID NO: 149623 - DNA, 25 bp, Mus musculus
tgtacagtaagtccctgcccttgga

SEQ ID NO: 149624 - DNA, 25 bp, Mus musculus
tgtacagtcaatacctggagcgcct

SEQ ID NO: 149625 - DNA, 25 bp, Mus musculus
tgtacagtctctgggcacggttgaa

SEQ ID NO: 149626 - DNA, 25 bp, Mus musculus
tgtacagtcttctgcgtgaccagga

SEQ ID NO: 149627 - DNA, 25 bp, Mus musculus
tgtacagtgagctccttgaaggtga

SEQ ID NO: 149628 - DNA, 25 bp, Mus musculus
tgtacataagcctaagatctggacc

SEQ ID NO: 149629 - DNA, 25 bp, Mus musculus
tgtacatacctggtgctcagaagca

SEQ ID NO: 149630 - DNA, 25 bp, Mus musculus
tgtacatagcacaacatgatccgga

SEQ ID NO: 149631 - DNA, 25 bp, Mus musculus
tgtacatagccagcggaacagtcgt

SEQ ID NO: 149632 - DNA, 25 bp, Mus musculus
tgtacatcccaagtactatggccag

SEQ ID NO: 149633 - DNA, 25 bp, Mus musculus
tgtacatcggagaggcttgtcccaa

SEQ ID NO: 149634 - DNA, 25 bp, Mus musculus
tgtacatgcgaaggagaaagcctga

SEQ ID NO: 149635 - DNA, 25 bp, Mus musculus
tgtacatgctggtcccatgctgggc

SEQ ID NO: 149636 - DNA, 25 bp, Mus musculus
tgtacatggatctgctgtcggcgcc

SEQ ID NO: 149637 - DNA, 25 bp, Mus musculus
tgtacatggatggaggatttcggcc

SEQ ID NO: 149638 - DNA, 25 bp, Mus musculus
tgtacatggccgaaaatcagagtcc

SEQ ID NO: 149639 - DNA, 25 bp, Mus musculus
tgtacatgggttggcctacaagggc

SEQ ID NO: 149640 - DNA, 25 bp, Mus musculus
tgtacatgtccacgttcttcccagg

SEQ ID NO: 149641 - DNA, 25 bp, Mus musculus
tgtacatgtgcaagccagccttcgt

SEQ ID NO: 149642 - DNA, 25 bp, Mus musculus
tgtaccaagtctgcatgccagggtt

SEQ ID NO: 149643 - DNA, 25 bp, Mus musculus
tgtaccaatgagtcccagaaatccc

SEQ ID NO: 149644 - DNA, 25 bp, Mus musculus
tgtaccaccgtgatgaggaccaact

SEQ ID NO: 149645 - DNA, 25 bp, Mus musculus
tgtaccacctacttgaatcccggcg

SEQ ID NO: 149646 - DNA, 25 bp, Mus musculus
tgtaccactggagaacgcaagcaaa

SEQ ID NO: 149647 - DNA, 25 bp, Mus musculus
tgtaccagagagtgttataaagacc

SEQ ID NO: 149648 - DNA, 25 bp, Mus musculus
tgtaccagcatgtaccagagaaacg

SEQ ID NO: 149649 - DNA, 25 bp, Mus musculus
tgtaccagccggcagaactggcctt

SEQ ID NO: 149650 - DNA, 25 bp, Mus musculus
tgtaccagccttacggagattcggc

SEQ ID NO: 149651 - DNA, 25 bp, Mus musculus
tgtaccagctcaccaagggctctgc

SEQ ID NO: 149652 - DNA, 25 bp, Mus musculus
tgtaccaggctgtgatcaaaaccca

SEQ ID NO: 149653 - DNA, 25 bp, Mus musculus
tgtaccaggtggacacactgaagga

SEQ ID NO: 149654 - DNA, 25 bp, Mus musculus
tgtaccagtgtatgccttttcaatg

SEQ ID NO: 149655 - DNA, 25 bp, Mus musculus
tgtaccatacaagcccttcactggg

SEQ ID NO: 149656 - DNA, 25 bp, Mus musculus
tgtaccatgtgatcaaaaagcggag

SEQ ID NO: 149657 - DNA, 25 bp, Mus musculus
tgtacccagaataagaagtgtctct

SEQ ID NO: 149658 - DNA, 25 bp, Mus musculus
tgtacccagaattgcacgtgccaga

SEQ ID NO: 149659 - DNA, 25 bp, Mus musculus
tgtacccatgccacaaacattggag

SEQ ID NO: 149660 - DNA, 25 bp, Mus musculus
tgtaccccaggtgagcataaccttg

SEQ ID NO: 149661 - DNA, 25 bp, Mus musculus
tgtacccgaacataccagagagttt

SEQ ID NO: 149662 - DNA, 25 bp, Mus musculus
tgtacccgctgccaagtctgtgatg

SEQ ID NO: 149663 - DNA, 25 bp, Mus musculus
tgtaccctcgatttctccagcgctg

SEQ ID NO: 149664 - DNA, 25 bp, Mus musculus
tgtaccgagaaccatccttgcatga

SEQ ID NO: 149665 - DNA, 25 bp, Mus musculus
tgtaccgcaagaggagctatcccca

SEQ ID NO: 149666 - DNA, 25 bp, Mus musculus
tgtaccgcatccagtttaacgagag

SEQ ID NO: 149667 - DNA, 25 bp, Mus musculus
tgtaccgcgcgctgtatgcgttccg

SEQ ID NO: 149668 - DNA, 25 bp, Mus musculus
tgtaccggctacaggaacatgtgcg

SEQ ID NO: 149669 - DNA, 25 bp, Mus musculus
tgtaccgggaccctgttacagacat

SEQ ID NO: 149670 - DNA, 25 bp, Mus musculus
tgtaccgtacagatgagcacctgcc

SEQ ID NO: 149671 - DNA, 25 bp, Mus musculus
tgtaccgtgaaagacccagaatcgt

SEQ ID NO: 149672 - DNA, 25 bp, Mus musculus
tgtaccgttcggacagcgaccatga

SEQ ID NO: 149673 - DNA, 25 bp, Mus musculus
tgtacctaaaccatgggctcccctt

SEQ ID NO: 149674 - DNA, 25 bp, Mus musculus
tgtacctattgacctcgatgagtgg

SEQ ID NO: 149675 - DNA, 25 bp, Mus musculus
tgtacctcccagagaaccaagtgtt

SEQ ID NO: 149676 - DNA, 25 bp, Mus musculus
tgtacctgaagcaagagaaacccca

SEQ ID NO: 149677 - DNA, 25 bp, Mus musculus
tgtacctgacagatcccgtgctttt

SEQ ID NO: 149678 - DNA, 25 bp, Mus musculus
tgtacctgcagataaagctacttga

SEQ ID NO: 149679 - DNA, 25 bp, Mus musculus
tgtacctgccacaagaagtcattgg

SEQ ID NO: 149680 - DNA, 25 bp, Mus musculus
tgtacctgccgctgtcattggatga

SEQ ID NO: 149681 - DNA, 25 bp, Mus musculus
tgtacctggttggaagctttgcccc

SEQ ID NO: 149682 - DNA, 25 bp, Mus musculus
tgtacctgtactgattgccccttgg

SEQ ID NO: 149683 - DNA, 25 bp, Mus musculus
tgtacctgtcaaactggatggccta

SEQ ID NO: 149684 - DNA, 25 bp, Mus musculus
tgtacctgtgtaacctgaccattgc

SEQ ID NO: 149685 - DNA, 25 bp, Mus musculus
tgtacctgttctctatagcagagga

SEQ ID NO: 149686 - DNA, 25 bp, Mus musculus
tgtaccttaggcagcatagcacctg

SEQ ID NO: 149687 - DNA, 25 bp, Mus musculus
tgtaccttatggatctgagccacct

SEQ ID NO: 149688 - DNA, 25 bp, Mus musculus
tgtaccttcctattggcagtcggcc

SEQ ID NO: 149689 - DNA, 25 bp, Mus musculus
tgtaccttggtacctggcagcgtcg

SEQ ID NO: 149690 - DNA, 25 bp, Mus musculus
tgtacgaacgactctgtggcgagga

SEQ ID NO: 149691 - DNA, 25 bp, Mus musculus
tgtacgacctgatgaacctgtgctg

SEQ ID NO: 149692 - DNA, 25 bp, Mus musculus
tgtacgagaagatggccagcaagct

SEQ ID NO: 149693 - DNA, 25 bp, Mus musculus
tgtacgagccttcgcagagagtcac

SEQ ID NO: 149694 - DNA, 25 bp, Mus musculus
tgtacgagggctatgcagcagtcac

SEQ ID NO: 149695 - DNA, 25 bp, Mus musculus
tgtacgagtacaaccaggccgagat

SEQ ID NO: 149696 - DNA, 25 bp, Mus musculus
tgtacgagtcaagtcgggctcactg

SEQ ID NO: 149697 - DNA, 25 bp, Mus musculus
tgtacgagtgtaaaaagctttgccc

SEQ ID NO: 149698 - DNA, 25 bp, Mus musculus
tgtacgatgacagtttccccatgga

SEQ ID NO: 149699 - DNA, 25 bp, Mus musculus
tgtacgattcggaacacaccttcag

SEQ ID NO: 149700 - DNA, 25 bp, Mus musculus
tgtacgatttcatggagaagaaggc

SEQ ID NO: 149701 - DNA, 25 bp, Mus musculus
tgtacgcacgtcagatggagatccg

SEQ ID NO: 149702 - DNA, 25 bp, Mus musculus
tgtacgcagggccaggaccacaaca

SEQ ID NO: 149703 - DNA, 25 bp, Mus musculus
tgtacgcctccatccacaagatcga

SEQ ID NO: 149704 - DNA, 25 bp, Mus musculus
tgtacgctctggtgtgcgagacgca

SEQ ID NO: 149705 - DNA, 25 bp, Mus musculus
tgtacggctcccagcctcatgagca

SEQ ID NO: 149706 - DNA, 25 bp, Mus musculus
tgtacggtgttgacctgcaccatgc

SEQ ID NO: 149707 - DNA, 25 bp, Mus musculus
tgtacgtaccagacaggttcgccct

SEQ ID NO: 149708 - DNA, 25 bp, Mus musculus
tgtacgtagtctaacatctgctcgg

SEQ ID NO: 149709 - DNA, 25 bp, Mus musculus
tgtacgtcgccttgttcccgtgtaa

SEQ ID NO: 149710 - DNA, 25 bp, Mus musculus
tgtacgtggctttccatgacccgca

SEQ ID NO: 149711 - DNA, 25 bp, Mus musculus
tgtactacactaaccgggccctgtg

SEQ ID NO: 149712 - DNA, 25 bp, Mus musculus
tgtactacagcgtgtccgaggagcg

SEQ ID NO: 149713 - DNA, 25 bp, Mus musculus
tgtactacccagctcaagatcaagg

SEQ ID NO: 149714 - DNA, 25 bp, Mus musculus
tgtactactggttcagcggcctcgg

SEQ ID NO: 149715 - DNA, 25 bp, Mus musculus
tgtactagctgagatcgagtgcctg

SEQ ID NO: 149716 - DNA, 25 bp, Mus musculus
tgtactatctacagaaccgccgaga

SEQ ID NO: 149717 - DNA, 25 bp, Mus musculus
tgtactatgaagtgcctgatcaccg

SEQ ID NO: 149718 - DNA, 25 bp, Mus musculus
tgtactatgacctcacccgagagcg

SEQ ID NO: 149719 - DNA, 25 bp, Mus musculus
tgtactatgtttgcactgccccaca

SEQ ID NO: 149720 - DNA, 25 bp, Mus musculus
tgtactcaaaagtgcagcggccttg

SEQ ID NO: 149721 - DNA, 25 bp, Mus musculus
tgtactcaccggagagcctcagtct

SEQ ID NO: 149722 - DNA, 25 bp, Mus musculus
tgtactcacctgctgagcgaaggac

SEQ ID NO: 149723 - DNA, 25 bp, Mus musculus
tgtactcactgtaacaagcaccgct

SEQ ID NO: 149724 - DNA, 25 bp, Mus musculus
tgtactcagtgtctatgggccggat

SEQ ID NO: 149725 - DNA, 25 bp, Mus musculus
tgtactcatcagaggtgaccaggca

SEQ ID NO: 149726 - DNA, 25 bp, Mus musculus
tgtactcatctttgcttcatacatg

SEQ ID NO: 149727 - DNA, 25 bp, Mus musculus
tgtactccaggcagcagacatcctg

SEQ ID NO: 149728 - DNA, 25 bp, Mus musculus
tgtactccataagctgaccaccttg

SEQ ID NO: 149729 - DNA, 25 bp, Mus musculus
tgtactccgtcctgaaatgtccaag

SEQ ID NO: 149730 - DNA, 25 bp, Mus musculus
tgtactctactgcttcctgaatggg

SEQ ID NO: 149731 - DNA, 25 bp, Mus musculus
tgtactctgcctcgaacctgctggt

SEQ ID NO: 149732 - DNA, 25 bp, Mus musculus
tgtactgaactgataggtggcctag

SEQ ID NO: 149733 - DNA, 25 bp, Mus musculus
tgtactgagacatgccaaggaggtc

SEQ ID NO: 149734 - DNA, 25 bp, Mus musculus
tgtactgcacagagcctttccggat

SEQ ID NO: 149735 - DNA, 25 bp, Mus musculus
tgtactgcagctaggacggtagaca

SEQ ID NO: 149736 - DNA, 25 bp, Mus musculus
tgtactgccacaaggactactgggc

SEQ ID NO: 149737 - DNA, 25 bp, Mus musculus
tgtactgccattttgaggatctgga

SEQ ID NO: 149738 - DNA, 25 bp, Mus musculus
tgtactgccctctggaactgaacga

SEQ ID NO: 149739 - DNA, 25 bp, Mus musculus
tgtactgcggctcttcaatgaccca

SEQ ID NO: 149740 - DNA, 25 bp, Mus musculus
tgtactggagaccatgacggccttc

SEQ ID NO: 149741 - DNA, 25 bp, Mus musculus
tgtactggcccctgtgcgatggcag

SEQ ID NO: 149742 - DNA, 25 bp, Mus musculus
tgtactgggagctgtaatggttacc

SEQ ID NO: 149743 - DNA, 25 bp, Mus musculus
tgtactgggatacctaaggaccaat

SEQ ID NO: 149744 - DNA, 25 bp, Mus musculus
tgtactgggcatcgacaacgtgtgc

SEQ ID NO: 149745 - DNA, 25 bp, Mus musculus
tgtactgtcacagcacctgggcaag

SEQ ID NO: 149746 - DNA, 25 bp, Mus musculus
tgtactgtgtgcaagcaggcggcaa

SEQ ID NO: 149747 - DNA, 25 bp, Mus musculus
tgtactgttgtgaagccgcggaaac

SEQ ID NO: 149748 - DNA, 25 bp, Mus musculus
tgtacttatcaaaaatcctggcagt

SEQ ID NO: 149749 - DNA, 25 bp, Mus musculus
tgtacttcagtagagtcagacagag

SEQ ID NO: 149750 - DNA, 25 bp, Mus musculus
tgtacttcagtcagtaacagcccgg

SEQ ID NO: 149751 - DNA, 25 bp, Mus musculus
tgtacttcatctagagggctgctcc

SEQ ID NO: 149752 - DNA, 25 bp, Mus musculus
tgtacttcccgcagatcagcagtgt

SEQ ID NO: 149753 - DNA, 25 bp, Mus musculus
tgtacttcctgccacaatgtcacag

SEQ ID NO: 149754 - DNA, 25 bp, Mus musculus
tgtacttcgcctacggcagcaatct

SEQ ID NO: 149755 - DNA, 25 bp, Mus musculus
tgtacttggctaaaagtctggcaga

SEQ ID NO: 149756 - DNA, 25 bp, Mus musculus
tgtacttgtggtatcttcctgatga

SEQ ID NO: 149757 - DNA, 25 bp, Mus musculus
tgtactttgatgtctgcagctgcca

SEQ ID NO: 149758 - DNA, 25 bp, Mus musculus
tgtacttttcaatcgggcttcaaac

SEQ ID NO: 149759 - DNA, 25 bp, Mus musculus
tgtagaaatctcagtggcccaactg

SEQ ID NO: 149760 - DNA, 25 bp, Mus musculus
tgtagaagacactgtagaagaagaa

SEQ ID NO: 149761 - DNA, 25 bp, Mus musculus
tgtagaaggagtacaggtgtccctg

SEQ ID NO: 149762 - DNA, 25 bp, Mus musculus
tgtagaaggctatcggtccagggca

SEQ ID NO: 149763 - DNA, 25 bp, Mus musculus
tgtagaagtaaagcacgcgcctgag

SEQ ID NO: 149764 - DNA, 25 bp, Mus musculus
tgtagaagtggaactgagccaggcc

SEQ ID NO: 149765 - DNA, 25 bp, Mus musculus
tgtagaagtgtgaagctgcgcgtcc

SEQ ID NO: 149766 - DNA, 25 bp, Mus musculus
tgtagaatccgctgcagtaacctgc

SEQ ID NO: 149767 - DNA, 25 bp, Mus musculus
tgtagacaaactctgccgcgtggag

SEQ ID NO: 149768 - DNA, 25 bp, Mus musculus
tgtagacagtctttcaccggacaca

SEQ ID NO: 149769 - DNA, 25 bp, Mus musculus
tgtagaccattccagtttccacagg

SEQ ID NO: 149770 - DNA, 25 bp, Mus musculus
tgtagacccggctcagtaattgggc

SEQ ID NO: 149771 - DNA, 25 bp, Mus musculus
tgtagaccggctaagcaagaggacc

SEQ ID NO: 149772 - DNA, 25 bp, Mus musculus
tgtagacgccttcactatccaggga

SEQ ID NO: 149773 - DNA, 25 bp, Mus musculus
tgtagactacctgatccggcaagag

SEQ ID NO: 149774 - DNA, 25 bp, Mus musculus
tgtagactgaactccgtggctcagg

SEQ ID NO: 149775 - DNA, 25 bp, Mus musculus
tgtagactgcagtgggagacaccct

SEQ ID NO: 149776 - DNA, 25 bp, Mus musculus
tgtagactggaatccctttgatcag

SEQ ID NO: 149777 - DNA, 25 bp, Mus musculus
tgtagactggcatccaaccaaaggg

SEQ ID NO: 149778 - DNA, 25 bp, Mus musculus
tgtagagaaaatgcccgttgaatac

SEQ ID NO: 149779 - DNA, 25 bp, Mus musculus
tgtagagacccagcaggacagaatc

SEQ ID NO: 149780 - DNA, 25 bp, Mus musculus
tgtagagacctgaaaatcccacttg

SEQ ID NO: 149781 - DNA, 25 bp, Mus musculus
tgtagagactaacttgccattggcc

SEQ ID NO: 149782 - DNA, 25 bp, Mus musculus
tgtagaggactaatgatcgctgcgg

SEQ ID NO: 149783 - DNA, 25 bp, Mus musculus
tgtagaggcagaggcaacacagctt

SEQ ID NO: 149784 - DNA, 25 bp, Mus musculus
tgtagagttccttgcagcccgtgag

SEQ ID NO: 149785 - DNA, 25 bp, Mus musculus
tgtagatacacaccccggaagaacg

SEQ ID NO: 149786 - DNA, 25 bp, Mus musculus
tgtagatacacacgactgccaggat

SEQ ID NO: 149787 - DNA, 25 bp, Mus musculus
tgtagatcgctagcaaactctggag

SEQ ID NO: 149788 - DNA, 25 bp, Mus musculus
tgtagatcgggcaccagttgaacgc

SEQ ID NO: 149789 - DNA, 25 bp, Mus musculus
tgtagatgaccccaagaaaggagca

SEQ ID NO: 149790 - DNA, 25 bp, Mus musculus
tgtagatgtctgaatttgatggctg

SEQ ID NO: 149791 - DNA, 25 bp, Mus musculus
tgtagatttttctcccgctgcagga

SEQ ID NO: 149792 - DNA, 25 bp, Mus musculus
tgtagcaaaccaggcagagacatgt

SEQ ID NO: 149793 - DNA, 25 bp, Mus musculus
tgtagcaccagcaaataaaggccgt

SEQ ID NO: 149794 - DNA, 25 bp, Mus musculus
tgtagcagaacccaagaaccaactc

SEQ ID NO: 149795 - DNA, 25 bp, Mus musculus
tgtagcagctgcagttgatctggat

SEQ ID NO: 149796 - DNA, 25 bp, Mus musculus
tgtagcagtggccaggaagaaaact

SEQ ID NO: 149797 - DNA, 25 bp, Mus musculus
tgtagcatatgaaacccacatctgg

SEQ ID NO: 149798 - DNA, 25 bp, Mus musculus
tgtagcatcatcaacatgggacccc

SEQ ID NO: 149799 - DNA, 25 bp, Mus musculus
tgtagccagagttcaggcgctgtct

SEQ ID NO: 149800 - DNA, 25 bp, Mus musculus
tgtagccaggatctagcccagttgg

SEQ ID NO: 149801 - DNA, 25 bp, Mus musculus
tgtagccatcctggacctgcctgaa

SEQ ID NO: 149802 - DNA, 25 bp, Mus musculus
tgtagcccatcaggaacaagatgga

SEQ ID NO: 149803 - DNA, 25 bp, Mus musculus
tgtagcccatcgctgttacctggag

SEQ ID NO: 149804 - DNA, 25 bp, Mus musculus
tgtagccctgaagaccagattcaga

SEQ ID NO: 149805 - DNA, 25 bp, Mus musculus
tgtagccctggaacccctggtgtgt

SEQ ID NO: 149806 - DNA, 25 bp, Mus musculus
tgtagcccttccttgcaagcagaaa

SEQ ID NO: 149807 - DNA, 25 bp, Mus musculus
tgtagccgcctcaagaaacatgcgt

SEQ ID NO: 149808 - DNA, 25 bp, Mus musculus
tgtagcctacagcagtgctggctct

SEQ ID NO: 149809 - DNA, 25 bp, Mus musculus
tgtagcgaacgtaggcgacaccttg

SEQ ID NO: 149810 - DNA, 25 bp, Mus musculus
tgtagcgatgaatcctcactggcgt

SEQ ID NO: 149811 - DNA, 25 bp, Mus musculus
tgtagctacatttcctggccccgga

SEQ ID NO: 149812 - DNA, 25 bp, Mus musculus
tgtagctccccatctaggaaaaggg

SEQ ID NO: 149813 - DNA, 25 bp, Mus musculus
tgtagctctgctagaaaacggccca

SEQ ID NO: 149814 - DNA, 25 bp, Mus musculus
tgtagctgagctgcttcggaccaga

SEQ ID NO: 149815 - DNA, 25 bp, Mus musculus
tgtagctgccacagatgaccgtgtc

SEQ ID NO: 149816 - DNA, 25 bp, Mus musculus
tgtagctgccaggagcatggcaacc

SEQ ID NO: 149817 - DNA, 25 bp, Mus musculus
tgtagctgccgatgtccacaggaag

SEQ ID NO: 149818 - DNA, 25 bp, Mus musculus
tgtagctggtactgctctgcaatgc

SEQ ID NO: 149819 - DNA, 25 bp, Mus musculus
tgtagctgttcttaggccaccaggg

SEQ ID NO: 149820 - DNA, 25 bp, Mus musculus
tgtagcttaagccttcagccctggc

SEQ ID NO: 149821 - DNA, 25 bp, Mus musculus
tgtaggaaaacatatgcttgaagct

SEQ ID NO: 149822 - DNA, 25 bp, Mus musculus
tgtaggaagagaataaccgcagaag

SEQ ID NO: 149823 - DNA, 25 bp, Mus musculus
tgtaggacagcccagacagaatgga

SEQ ID NO: 149824 - DNA, 25 bp, Mus musculus
tgtaggagatgaacttcaggacaac

SEQ ID NO: 149825 - DNA, 25 bp, Mus musculus
tgtaggagcaggcatcagacttttc

SEQ ID NO: 149826 - DNA, 25 bp, Mus musculus
tgtaggagctagtgcctgtactgag

SEQ ID NO: 149827 - DNA, 25 bp, Mus musculus
tgtaggcggcaaaatctgtctataa

SEQ ID NO: 149828 - DNA, 25 bp, Mus musculus
tgtaggctcaggagatctacttcct

SEQ ID NO: 149829 - DNA, 25 bp, Mus musculus
tgtaggctcctaccaagaaaaggtg

SEQ ID NO: 149830 - DNA, 25 bp, Mus musculus
tgtaggctgtgctccctacgaccca

SEQ ID NO: 149831 - DNA, 25 bp, Mus musculus
tgtagggtccagattcaagagctct

SEQ ID NO: 149832 - DNA, 25 bp, Mus musculus
tgtagggtcccaaagaagcaagcct

SEQ ID NO: 149833 - DNA, 25 bp, Mus musculus
tgtagggttctctctgacgcgggac

SEQ ID NO: 149834 - DNA, 25 bp, Mus musculus
tgtaggtgagaatgaaacttacccc

SEQ ID NO: 149835 - DNA, 25 bp, Mus musculus
tgtaggtgccatagaaccccagttc

SEQ ID NO: 149836 - DNA, 25 bp, Mus musculus
tgtaggtggccaaagatccgaacga

SEQ ID NO: 149837 - DNA, 25 bp, Mus musculus
tgtaggttgcaaacagggatctctg

SEQ ID NO: 149838 - DNA, 25 bp, Mus musculus
tgtagtaaatgctcactccccaagc

SEQ ID NO: 149839 - DNA, 25 bp, Mus musculus
tgtagtaaggaatagaacggtccag

SEQ ID NO: 149840 - DNA, 25 bp, Mus musculus
tgtagtcaagaaaggacgcgccaca

SEQ ID NO: 149841 - DNA, 25 bp, Mus musculus
tgtagtcaagtaacaggcctcacgc

SEQ ID NO: 149842 - DNA, 25 bp, Mus musculus
tgtagtcccaatggcccagcaggga

SEQ ID NO: 149843 - DNA, 25 bp, Mus musculus
tgtagtcgcacctggcaaccaagtg

SEQ ID NO: 149844 - DNA, 25 bp, Mus musculus
tgtagtgaatgacgactccgcctgg

SEQ ID NO: 149845 - DNA, 25 bp, Mus musculus
tgtagtgaccttagaacagcctgcc

SEQ ID NO: 149846 - DNA, 25 bp, Mus musculus
tgtagtgcagaagccagatctgggc

SEQ ID NO: 149847 - DNA, 25 bp, Mus musculus
tgtagtgccctacctggaggacctg

SEQ ID NO: 149848 - DNA, 25 bp, Mus musculus
tgtagtggagggtcacgttccttcc

SEQ ID NO: 149849 - DNA, 25 bp, Mus musculus
tgtagtgtacgtttcctgggctccc

SEQ ID NO: 149850 - DNA, 25 bp, Mus musculus
tgtagtgttaaaagatgcagaaggc

SEQ ID NO: 149851 - DNA, 25 bp, Mus musculus
tgtagttaccaagtgccggttcttt

SEQ ID NO: 149852 - DNA, 25 bp, Mus musculus
tgtagttccagaaaggtgtacttcc

SEQ ID NO: 149853 - DNA, 25 bp, Mus musculus
tgtagttccggaagccaagccggag

SEQ ID NO: 149854 - DNA, 25 bp, Mus musculus
tgtagttcctagtagaagccccgtg

SEQ ID NO: 149855 - DNA, 25 bp, Mus musculus
tgtataaacgaggtcatccccaagg

SEQ ID NO: 149856 - DNA, 25 bp, Mus musculus
tgtataacttcaccttgcacggaca

SEQ ID NO: 149857 - DNA, 25 bp, Mus musculus
tgtataagaatgacgacagccggcc

SEQ ID NO: 149858 - DNA, 25 bp, Mus musculus
tgtataataagtccaagcctgtggc

SEQ ID NO: 149859 - DNA, 25 bp, Mus musculus
tgtataatcagctcgggctcacagg

SEQ ID NO: 149860 - DNA, 25 bp, Mus musculus
tgtataatccgacaaggcgaggtga

SEQ ID NO: 149861 - DNA, 25 bp, Mus musculus
tgtatacaaactcgcacttgcaggt

SEQ ID NO: 149862 - DNA, 25 bp, Mus musculus
tgtatacaacacactgccctgcggg

SEQ ID NO: 149863 - DNA, 25 bp, Mus musculus
tgtatacaagcgtggactcctggag

SEQ ID NO: 149864 - DNA, 25 bp, Mus musculus
tgtatacaatccatgcagactcctg

SEQ ID NO: 149865 - DNA, 25 bp, Mus musculus
tgtatacatcacaagggcacagctt

SEQ ID NO: 149866 - DNA, 25 bp, Mus musculus
tgtatacccaagtgcctgatggagg

SEQ ID NO: 149867 - DNA, 25 bp, Mus musculus
tgtatacgcttgcagcttcaggaag

SEQ ID NO: 149868 - DNA, 25 bp, Mus musculus
tgtatactaggttttcctcagccaa

SEQ ID NO: 149869 - DNA, 25 bp, Mus musculus
tgtatatcaaatccactagccgggt

SEQ ID NO: 149870 - DNA, 25 bp, Mus musculus
tgtatatgaaatggccaccctgaag

SEQ ID NO: 149871 - DNA, 25 bp, Mus musculus
tgtatatgaggagcaaggaagcagc

SEQ ID NO: 149872 - DNA, 25 bp, Mus musculus
tgtatatgatcagcaaacacagcca

SEQ ID NO: 149873 - DNA, 25 bp, Mus musculus
tgtatattctctgagccgggcacag

SEQ ID NO: 149874 - DNA, 25 bp, Mus musculus
tgtatattgcgttcctccctttcta

SEQ ID NO: 149875 - DNA, 25 bp, Mus musculus
tgtatcaatgaacgtgctgcccagc

SEQ ID NO: 149876 - DNA, 25 bp, Mus musculus
tgtatcagagcgagacaggcaggac

SEQ ID NO: 149877 - DNA, 25 bp, Mus musculus
tgtatcagcattagaaaaccaccca

SEQ ID NO: 149878 - DNA, 25 bp, Mus musculus
tgtatcattgttgtcagcctgcggg

SEQ ID NO: 149879 - DNA, 25 bp, Mus musculus
tgtatccatagagagttcgcgcccc

SEQ ID NO: 149880 - DNA, 25 bp, Mus musculus
tgtatccccaactggaagcgctgtg

SEQ ID NO: 149881 - DNA, 25 bp, Mus musculus
tgtatcccgcgtgttggcaggctct

SEQ ID NO: 149882 - DNA, 25 bp, Mus musculus
tgtatccgattgtgagccgggctgc

SEQ ID NO: 149883 - DNA, 25 bp, Mus musculus
tgtatccgccaccactcattgagga

SEQ ID NO: 149884 - DNA, 25 bp, Mus musculus
tgtatccgggacttcaaggaccgtg

SEQ ID NO: 149885 - DNA, 25 bp, Mus musculus
tgtatcctggaaaccatggcgctcc

SEQ ID NO: 149886 - DNA, 25 bp, Mus musculus
tgtatcctggatcacagaatggccc

SEQ ID NO: 149887 - DNA, 25 bp, Mus musculus
tgtatcgccacaataacgtgagggt

SEQ ID NO: 149888 - DNA, 25 bp, Mus musculus
tgtatcgctaacgtgggcagccgtg

SEQ ID NO: 149889 - DNA, 25 bp, Mus musculus
tgtatctacatggaacaggcaccgc

SEQ ID NO: 149890 - DNA, 25 bp, Mus musculus
tgtatctagggcataatccagcagg

SEQ ID NO: 149891 - DNA, 25 bp, Mus musculus
tgtatctcaacagcacaggctaccg

SEQ ID NO: 149892 - DNA, 25 bp, Mus musculus
tgtatctcacgcacagaaggaggct

SEQ ID NO: 149893 - DNA, 25 bp, Mus musculus
tgtatctcgagcagcacgaaggcga

SEQ ID NO: 149894 - DNA, 25 bp, Mus musculus
tgtatctgactatgacggcaagctg

SEQ ID NO: 149895 - DNA, 25 bp, Mus musculus
tgtatctggcaagcggaacctctgg

SEQ ID NO: 149896 - DNA, 25 bp, Mus musculus
tgtatctgtgccctttgtcttacca

SEQ ID NO: 149897 - DNA, 25 bp, Mus musculus
tgtatcttactggacagggccagct

SEQ ID NO: 149898 - DNA, 25 bp, Mus musculus
tgtatcttgaatcccagggtggcca

SEQ ID NO: 149899 - DNA, 25 bp, Mus musculus
tgtatgaacagctgtgcgaccggca

SEQ ID NO: 149900 - DNA, 25 bp, Mus musculus
tgtatgaaccacagggaaatgccct

SEQ ID NO: 149901 - DNA, 25 bp, Mus musculus
tgtatgaactgtacccggcttagcg

SEQ ID NO: 149902 - DNA, 25 bp, Mus musculus
tgtatgacaacgtccctgagtgtgc

SEQ ID NO: 149903 - DNA, 25 bp, Mus musculus
tgtatgacacacaaggaccttctag

SEQ ID NO: 149904 - DNA, 25 bp, Mus musculus
tgtatgaccgactctaccaggactc

SEQ ID NO: 149905 - DNA, 25 bp, Mus musculus
tgtatgacgccatcgcggccaatga

SEQ ID NO: 149906 - DNA, 25 bp, Mus musculus
tgtatgactaacaccccggtcgtgg

SEQ ID NO: 149907 - DNA, 25 bp, Mus musculus
tgtatgagcgctgcccaaaggctgt

SEQ ID NO: 149908 - DNA, 25 bp, Mus musculus
tgtatgagctctcaccaatgatggt

SEQ ID NO: 149909 - DNA, 25 bp, Mus musculus
tgtatgagtacctgcagcccttggg

SEQ ID NO: 149910 - DNA, 25 bp, Mus musculus
tgtatgataagaagccagtaggacc

SEQ ID NO: 149911 - DNA, 25 bp, Mus musculus
tgtatgatcaaagaggccgggaacc

SEQ ID NO: 149912 - DNA, 25 bp, Mus musculus
tgtatgatgaacttggcggtagccc

SEQ ID NO: 149913 - DNA, 25 bp, Mus musculus
tgtatgatgttcagcgccaccctga

SEQ ID NO: 149914 - DNA, 25 bp, Mus musculus
tgtatgcacggcctctcaaggagaa

SEQ ID NO: 149915 - DNA, 25 bp, Mus musculus
tgtatgcagtcacaaaaggcctgcg

SEQ ID NO: 149916 - DNA, 25 bp, Mus musculus
tgtatgcccaagtaaagaaacctcg

SEQ ID NO: 149917 - DNA, 25 bp, Mus musculus
tgtatgcccagaggaggatctccac

SEQ ID NO: 149918 - DNA, 25 bp, Mus musculus
tgtatgccctaaataggagccttga

SEQ ID NO: 149919 - DNA, 25 bp, Mus musculus
tgtatgcgaataccaagagaattgg

SEQ ID NO: 149920 - DNA, 25 bp, Mus musculus
tgtatgcgccgtactagagtcccca

SEQ ID NO: 149921 - DNA, 25 bp, Mus musculus
tgtatgcgtgcaacagtaggcggcc

SEQ ID NO: 149922 - DNA, 25 bp, Mus musculus
tgtatgctaccatccgcactgagag

SEQ ID NO: 149923 - DNA, 25 bp, Mus musculus
tgtatggaacaagagaaggcctttc

SEQ ID NO: 149924 - DNA, 25 bp, Mus musculus
tgtatggccaccaacaatgctgggc

SEQ ID NO: 149925 - DNA, 25 bp, Mus musculus
tgtatggcgaattgagcctgggccc

SEQ ID NO: 149926 - DNA, 25 bp, Mus musculus
tgtatgggaccaactatcgcaaagc

SEQ ID NO: 149927 - DNA, 25 bp, Mus musculus
tgtatgggacttaagagaagactcc

SEQ ID NO: 149928 - DNA, 25 bp, Mus musculus
tgtatgggcccatcgtgaaacacat

SEQ ID NO: 149929 - DNA, 25 bp, Mus musculus
tgtatgggcttgttagcaacgtcca

SEQ ID NO: 149930 - DNA, 25 bp, Mus musculus
tgtatggtacatggataatccacag

SEQ ID NO: 149931 - DNA, 25 bp, Mus musculus
tgtatggtgaccacagcctctgtcc

SEQ ID NO: 149932 - DNA, 25 bp, Mus musculus
tgtatgtaagacctcgttcaccacg

SEQ ID NO: 149933 - DNA, 25 bp, Mus musculus
tgtatgtagcaacccacgtgtgaag

SEQ ID NO: 149934 - DNA, 25 bp, Mus musculus
tgtatgtcactcaaagacccgaagc

SEQ ID NO: 149935 - DNA, 25 bp, Mus musculus
tgtatgtccccaaggaggcgtacga

SEQ ID NO: 149936 - DNA, 25 bp, Mus musculus
tgtatgtccctcattgctgtgcgcg

SEQ ID NO: 149937 - DNA, 25 bp, Mus musculus
tgtatgtgaatagccgtgcctggcc

SEQ ID NO: 149938 - DNA, 25 bp, Mus musculus
tgtatgtgacctaaagcatgtaact

SEQ ID NO: 149939 - DNA, 25 bp, Mus musculus
tgtatgtgcactggacagatgctgg

SEQ ID NO: 149940 - DNA, 25 bp, Mus musculus
tgtatgtgcggaaacacacacgtgc

SEQ ID NO: 149941 - DNA, 25 bp, Mus musculus
tgtatgtgtgcgagtatgagcgccc

SEQ ID NO: 149942 - DNA, 25 bp, Mus musculus
tgtatgtgtttgctccagactgtga

SEQ ID NO: 149943 - DNA, 25 bp, Mus musculus
tgtatgttacatcgcctcccagagc

SEQ ID NO: 149944 - DNA, 25 bp, Mus musculus
tgtattaaacctcgacttagccctg

SEQ ID NO: 149945 - DNA, 25 bp, Mus musculus
tgtattaccctccaaagaaacggca

SEQ ID NO: 149946 - DNA, 25 bp, Mus musculus
tgtattaccgtgaagaacccagctg

SEQ ID NO: 149947 - DNA, 25 bp, Mus musculus
tgtattacggtctacagtggctgcc

SEQ ID NO: 149948 - DNA, 25 bp, Mus musculus
tgtattatacgtgtccctgcaccgg

SEQ ID NO: 149949 - DNA, 25 bp, Mus musculus
tgtattatggctttcccacccgaga

SEQ ID NO: 149950 - DNA, 25 bp, Mus musculus
tgtattcatggatcagggcttcaaa

SEQ ID NO: 149951 - DNA, 25 bp, Mus musculus
tgtattccaatagtatgtggccagc

SEQ ID NO: 149952 - DNA, 25 bp, Mus musculus
tgtattcccagaagcagcccaagag

SEQ ID NO: 149953 - DNA, 25 bp, Mus musculus
tgtattcccgtgtgcctgagtgcca

SEQ ID NO: 149954 - DNA, 25 bp, Mus musculus
tgtattcctggactagtttccctgg

SEQ ID NO: 149955 - DNA, 25 bp, Mus musculus
tgtattcgacatgagccacttgcca

SEQ ID NO: 149956 - DNA, 25 bp, Mus musculus
tgtattcgagtctctagcacagcca

SEQ ID NO: 149957 - DNA, 25 bp, Mus musculus
tgtattctatggctcccagacggga

SEQ ID NO: 149958 - DNA, 25 bp, Mus musculus
tgtattctgggcacccaccatgaga

SEQ ID NO: 149959 - DNA, 25 bp, Mus musculus
tgtattgccaagtacaacttccatg

SEQ ID NO: 149960 - DNA, 25 bp, Mus musculus
tgtattgccagctcaagccacagag

SEQ ID NO: 149961 - DNA, 25 bp, Mus musculus
tgtattggcaaagtataccctgtgg

SEQ ID NO: 149962 - DNA, 25 bp, Mus musculus
tgtattggccgagagctttcccgga

SEQ ID NO: 149963 - DNA, 25 bp, Mus musculus
tgtattgtaacattctctgcgatgg

SEQ ID NO: 149964 - DNA, 25 bp, Mus musculus
tgtattgtatccttgctcccagggc

SEQ ID NO: 149965 - DNA, 25 bp, Mus musculus
tgtatttaaagaaggcgcgagagct

SEQ ID NO: 149966 - DNA, 25 bp, Mus musculus
tgtatttcaagctcaatgcgcggcg

SEQ ID NO: 149967 - DNA, 25 bp, Mus musculus
tgtatttctatgagcgcagccggca

SEQ ID NO: 149968 - DNA, 25 bp, Mus musculus
tgtatttgctgagaaaactggccct

SEQ ID NO: 149969 - DNA, 25 bp, Mus musculus
tgtatttgtgtcgttggcaccagcc

SEQ ID NO: 149970 - DNA, 25 bp, Mus musculus
tgtattttcacaaccccagtggctg

SEQ ID NO: 149971 - DNA, 25 bp, Mus musculus
tgtcaaacccagcacaatccacatg

SEQ ID NO: 149972 - DNA, 25 bp, Mus musculus
tgtcaaaccccgtcagtgagatgga

SEQ ID NO: 149973 - DNA, 25 bp, Mus musculus
tgtcaaacccctcaagatacttgtg

SEQ ID NO: 149974 - DNA, 25 bp, Mus musculus
tgtcaaacgctgcacaggctcgggt

SEQ ID NO: 149975 - DNA, 25 bp, Mus musculus
tgtcaaagctcagggcagcggatcc

SEQ ID NO: 149976 - DNA, 25 bp, Mus musculus
tgtcaaaggacaagaaatttcaaag

SEQ ID NO: 149977 - DNA, 25 bp, Mus musculus
tgtcaaaggcagtacctaaaccagg

SEQ ID NO: 149978 - DNA, 25 bp, Mus musculus
tgtcaaagtgccagccaaaagcata

SEQ ID NO: 149979 - DNA, 25 bp, Mus musculus
tgtcaaagtgttgctgagctcccgg

SEQ ID NO: 149980 - DNA, 25 bp, Mus musculus
tgtcaaagttgtagcgctcctcgag

SEQ ID NO: 149981 - DNA, 25 bp, Mus musculus
tgtcaaatggctcccagaagactgt

SEQ ID NO: 149982 - DNA, 25 bp, Mus musculus
tgtcaaatgggccaaaaacttgcct

SEQ ID NO: 149983 - DNA, 25 bp, Mus musculus
tgtcaacaatcctaaccagtcagtg

SEQ ID NO: 149984 - DNA, 25 bp, Mus musculus
tgtcaacatgcaaacgacgctgctg

SEQ ID NO: 149985 - DNA, 25 bp, Mus musculus
tgtcaaccagaagctagagcgcctg

SEQ ID NO: 149986 - DNA, 25 bp, Mus musculus
tgtcaaccttgaagtgcagccctcc

SEQ ID NO: 149987 - DNA, 25 bp, Mus musculus
tgtcaacgacaacaatctggcctat

SEQ ID NO: 149988 - DNA, 25 bp, Mus musculus
tgtcaacgaggaacccataatgtct

SEQ ID NO: 149989 - DNA, 25 bp, Mus musculus
tgtcaacgtcaaccgcagcgtgtca

SEQ ID NO: 149990 - DNA, 25 bp, Mus musculus
tgtcaactataagggctgctgcgag

SEQ ID NO: 149991 - DNA, 25 bp, Mus musculus
tgtcaactgcaggaaatgcgccatg

SEQ ID NO: 149992 - DNA, 25 bp, Mus musculus
tgtcaactgcagtgctgaccagcct

SEQ ID NO: 149993 - DNA, 25 bp, Mus musculus
tgtcaactggctgaagaaacgcacg

SEQ ID NO: 149994 - DNA, 25 bp, Mus musculus
tgtcaactttcttctcggtgagaat

SEQ ID NO: 149995 - DNA, 25 bp, Mus musculus
tgtcaacttttttctgcggcctggg

SEQ ID NO: 149996 - DNA, 25 bp, Mus musculus
tgtcaagaacatcaaacaagcggag

SEQ ID NO: 149997 - DNA, 25 bp, Mus musculus
tgtcaagaagactgagagcccaata

SEQ ID NO: 149998 - DNA, 25 bp, Mus musculus
tgtcaagagtttgccctgagtgcca

SEQ ID NO: 149999 - DNA, 25 bp, Mus musculus
tgtcaagatcttcccctacgaggag

SEQ ID NO: 150000 - DNA, 25 bp, Mus musculus
tgtcaagcagattcgccagaggctg

SEQ ID NO: 150001 - DNA, 25 bp, Mus musculus
tgtcaagcattccaggccatgagac

SEQ ID NO: 150002 - DNA, 25 bp, Mus musculus
tgtcaagcgggtttcaaaggaagcc

SEQ ID NO: 150003 - DNA, 25 bp, Mus musculus
tgtcaagcgtgagcggacatcctct

SEQ ID NO: 150004 - DNA, 25 bp, Mus musculus
tgtcaaggacgggaagagtatcact

SEQ ID NO: 150005 - DNA, 25 bp, Mus musculus
tgtcaaggacttcgtgattgtcccc

SEQ ID NO: 150006 - DNA, 25 bp, Mus musculus
tgtcaaggagacacatggcaaccgc

SEQ ID NO: 150007 - DNA, 25 bp, Mus musculus
tgtcaaggatagctcattggtggcc

SEQ ID NO: 150008 - DNA, 25 bp, Mus musculus
tgtcaaggcttacatcaaacccggg

SEQ ID NO: 150009 - DNA, 25 bp, Mus musculus
tgtcaaggcttcctgatccagggac

SEQ ID NO: 150010 - DNA, 25 bp, Mus musculus
tgtcaaggtcctgatagttccgagg

SEQ ID NO: 150011 - DNA, 25 bp, Mus musculus
tgtcaaggtgacctccaagaaggcc

SEQ ID NO: 150012 - DNA, 25 bp, Mus musculus
tgtcaagtcctctggccgccttagg

SEQ ID NO: 150013 - DNA, 25 bp, Mus musculus
tgtcaagtgctgtgcgaactcggag

SEQ ID NO: 150014 - DNA, 25 bp, Mus musculus
tgtcaagtggaacacgaagtgagcc

SEQ ID NO: 150015 - DNA, 25 bp, Mus musculus
tgtcaagttcgcagccctgatgcag

SEQ ID NO: 150016 - DNA, 25 bp, Mus musculus
tgtcaagttgagaagaggcgcaacg

SEQ ID NO: 150017 - DNA, 25 bp, Mus musculus
tgtcaatcactttccagcccaaagg

SEQ ID NO: 150018 - DNA, 25 bp, Mus musculus
tgtcaatcagctacaagccctgcag

SEQ ID NO: 150019 - DNA, 25 bp, Mus musculus
tgtcaatctaggaggcactgcatgg

SEQ ID NO: 150020 - DNA, 25 bp, Mus musculus
tgtcaatggcttacaggctgctaag

SEQ ID NO: 150021 - DNA, 25 bp, Mus musculus
tgtcaatgtcagatccagaaggcct

SEQ ID NO: 150022 - DNA, 25 bp, Mus musculus
tgtcaatgtcccagacatgaaccag

SEQ ID NO: 150023 - DNA, 25 bp, Mus musculus
tgtcaattgtagcatctgcccagcc

SEQ ID NO: 150024 - DNA, 25 bp, Mus musculus
tgtcacaaacccaccagctcatgga

SEQ ID NO: 150025 - DNA, 25 bp, Mus musculus
tgtcacaactcagccaacaggaagg

SEQ ID NO: 150026 - DNA, 25 bp, Mus musculus
tgtcacaatcaaacagtgtacctag

SEQ ID NO: 150027 - DNA, 25 bp, Mus musculus
tgtcacaatggagcggtttgaacct

SEQ ID NO: 150028 - DNA, 25 bp, Mus musculus
tgtcacaattgtccacgactgccag

SEQ ID NO: 150029 - DNA, 25 bp, Mus musculus
tgtcacacaggcaaaaaggcatatg

SEQ ID NO: 150030 - DNA, 25 bp, Mus musculus
tgtcacacagtgacaagacagccga

SEQ ID NO: 150031 - DNA, 25 bp, Mus musculus
tgtcacaccgttgagagcagcaaac

SEQ ID NO: 150032 - DNA, 25 bp, Mus musculus
tgtcacacggagagaaaggccaagc

SEQ ID NO: 150033 - DNA, 25 bp, Mus musculus
tgtcacagaacacagacgccatgga

SEQ ID NO: 150034 - DNA, 25 bp, Mus musculus
tgtcacagagaacagtgccagcctg

SEQ ID NO: 150035 - DNA, 25 bp, Mus musculus
tgtcacagaggagctattccagaga

SEQ ID NO: 150036 - DNA, 25 bp, Mus musculus
tgtcacaggcacaggattatgaatg

SEQ ID NO: 150037 - DNA, 25 bp, Mus musculus
tgtcacagtccttattgggcagagc

SEQ ID NO: 150038 - DNA, 25 bp, Mus musculus
tgtcacatcaatccctggccaagag

SEQ ID NO: 150039 - DNA, 25 bp, Mus musculus
tgtcacattcgatgatgtcgccgtc

SEQ ID NO: 150040 - DNA, 25 bp, Mus musculus
tgtcaccaacaagaccaagaagacg

SEQ ID NO: 150041 - DNA, 25 bp, Mus musculus
tgtcaccagaggcatcgagatcact

SEQ ID NO: 150042 - DNA, 25 bp, Mus musculus
tgtcaccaggaagcaggatgcccat

SEQ ID NO: 150043 - DNA, 25 bp, Mus musculus
tgtcaccagtgatgaagaccaaggc

SEQ ID NO: 150044 - DNA, 25 bp, Mus musculus
tgtcaccagttgctggtccaggtgt

SEQ ID NO: 150045 - DNA, 25 bp, Mus musculus
tgtcaccatccgtcgctgtgtgcct

SEQ ID NO: 150046 - DNA, 25 bp, Mus musculus
tgtcaccatgagtgcacttctgatc

SEQ ID NO: 150047 - DNA, 25 bp, Mus musculus
tgtcacccagagtgggacccgagtg

SEQ ID NO: 150048 - DNA, 25 bp, Mus musculus
tgtcacccatgtgcatcggcgaggt

SEQ ID NO: 150049 - DNA, 25 bp, Mus musculus
tgtcaccccagagtcagcaattggc

SEQ ID NO: 150050 - DNA, 25 bp, Mus musculus
tgtcacccgctgagttctgccggag

SEQ ID NO: 150051 - DNA, 25 bp, Mus musculus
tgtcaccctaatggacagaggctct

SEQ ID NO: 150052 - DNA, 25 bp, Mus musculus
tgtcaccgcagggacagaagagttc

SEQ ID NO: 150053 - DNA, 25 bp, Mus musculus
tgtcaccggaggtatagctgtgccc

SEQ ID NO: 150054 - DNA, 25 bp, Mus musculus
tgtcaccgggataaccacaaagggc

SEQ ID NO: 150055 - DNA, 25 bp, Mus musculus
tgtcacctactacaagagacggcct

SEQ ID NO: 150056 - DNA, 25 bp, Mus musculus
tgtcacctcactagtctcgagatgg

SEQ ID NO: 150057 - DNA, 25 bp, Mus musculus
tgtcacctggagcagaatcgggtta

SEQ ID NO: 150058 - DNA, 25 bp, Mus musculus
tgtcacctgtctgtgcctccgtttg

SEQ ID NO: 150059 - DNA, 25 bp, Mus musculus
tgtcaccttggtaggatgggccctc

SEQ ID NO: 150060 - DNA, 25 bp, Mus musculus
tgtcacgaaatcttctgctgcccgc

SEQ ID NO: 150061 - DNA, 25 bp, Mus musculus
tgtcacgaagacaggtgtgcccact

SEQ ID NO: 150062 - DNA, 25 bp, Mus musculus
tgtcacgaatgtgtccatggcccgg

SEQ ID NO: 150063 - DNA, 25 bp, Mus musculus
tgtcacgggcagctacacttctaga

SEQ ID NO: 150064 - DNA, 25 bp, Mus musculus
tgtcacggtacaagctagacctcag

SEQ ID NO: 150065 - DNA, 25 bp, Mus musculus
tgtcactaaaaggagaggtgcctag

SEQ ID NO: 150066 - DNA, 25 bp, Mus musculus
tgtcactcaagatccggaagtcatg

SEQ ID NO: 150067 - DNA, 25 bp, Mus musculus
tgtcactcacagcttgaacaaggga

SEQ ID NO: 150068 - DNA, 25 bp, Mus musculus
tgtcactctgaatacaagccttgtg

SEQ ID NO: 150069 - DNA, 25 bp, Mus musculus
tgtcactctgcctgatatggaaccc

SEQ ID NO: 150070 - DNA, 25 bp, Mus musculus
tgtcactcttctgcgatgatggaga

SEQ ID NO: 150071 - DNA, 25 bp, Mus musculus
tgtcactgaaaagcgagaccagggt

SEQ ID NO: 150072 - DNA, 25 bp, Mus musculus
tgtcactgaacctggccagattggg

SEQ ID NO: 150073 - DNA, 25 bp, Mus musculus
tgtcactgaactgagagaagccggt

SEQ ID NO: 150074 - DNA, 25 bp, Mus musculus
tgtcactgacactcaagcagagagc

SEQ ID NO: 150075 - DNA, 25 bp, Mus musculus
tgtcactgagacagctggatctgca

SEQ ID NO: 150076 - DNA, 25 bp, Mus musculus
tgtcactgagcccaaagagccaggg

SEQ ID NO: 150077 - DNA, 25 bp, Mus musculus
tgtcactggaccgatttgaaaacca

SEQ ID NO: 150078 - DNA, 25 bp, Mus musculus
tgtcactggcaaacagacatggagt

SEQ ID NO: 150079 - DNA, 25 bp, Mus musculus
tgtcactgtagaggaacttctagaa

SEQ ID NO: 150080 - DNA, 25 bp, Mus musculus
tgtcactgtccagtatcgccttggg

SEQ ID NO: 150081 - DNA, 25 bp, Mus musculus
tgtcacttgtcacacatgccggtca

SEQ ID NO: 150082 - DNA, 25 bp, Mus musculus
tgtcagaaacggcagaatgtcctcc

SEQ ID NO: 150083 - DNA, 25 bp, Mus musculus
tgtcagaacttgaaggcaatccggg

SEQ ID NO: 150084 - DNA, 25 bp, Mus musculus
tgtcagaagaacttgcccagctgga

SEQ ID NO: 150085 - DNA, 25 bp, Mus musculus
tgtcagaagctacaagcgaaaaatg

SEQ ID NO: 150086 - DNA, 25 bp, Mus musculus
tgtcagacaagaaagccaaacctgg

SEQ ID NO: 150087 - DNA, 25 bp, Mus musculus
tgtcagacatcccagacacacctga

SEQ ID NO: 150088 - DNA, 25 bp, Mus musculus
tgtcagacctgcgtatccaaaccga

SEQ ID NO: 150089 - DNA, 25 bp, Mus musculus
tgtcagagaaggcactcctaggccg

SEQ ID NO: 150090 - DNA, 25 bp, Mus musculus
tgtcagagaatgtcgccctgtggga

SEQ ID NO: 150091 - DNA, 25 bp, Mus musculus
tgtcagagacagcagactcggatac

SEQ ID NO: 150092 - DNA, 25 bp, Mus musculus
tgtcagagaccaagggagtgtccct

SEQ ID NO: 150093 - DNA, 25 bp, Mus musculus
tgtcagagacctaccaggaattcag

SEQ ID NO: 150094 - DNA, 25 bp, Mus musculus
tgtcagagagtaagcgggagctcac

SEQ ID NO: 150095 - DNA, 25 bp, Mus musculus
tgtcagagattgagaatgtccatgg

SEQ ID NO: 150096 - DNA, 25 bp, Mus musculus
tgtcagaggaaggtgacgcggaagg

SEQ ID NO: 150097 - DNA, 25 bp, Mus musculus
tgtcagaggacgagattaaccggct

SEQ ID NO: 150098 - DNA, 25 bp, Mus musculus
tgtcagaggatcaatcagaacaagc

SEQ ID NO: 150099 - DNA, 25 bp, Mus musculus
tgtcagagtccaaggcacgggagtt

SEQ ID NO: 150100 - DNA, 25 bp, Mus musculus
tgtcagatagcccaagaaatcgctg

SEQ ID NO: 150101 - DNA, 25 bp, Mus musculus
tgtcagatcgtaacaggatcccaaa

SEQ ID NO: 150102 - DNA, 25 bp, Mus musculus
tgtcagatgactagatacttgggta

SEQ ID NO: 150103 - DNA, 25 bp, Mus musculus
tgtcagatggccatacccagcatgg

SEQ ID NO: 150104 - DNA, 25 bp, Mus musculus
tgtcagattgatcagcaccaccgga

SEQ ID NO: 150105 - DNA, 25 bp, Mus musculus
tgtcagcaactgtgacagaggcctt

SEQ ID NO: 150106 - DNA, 25 bp, Mus musculus
tgtcagcactggagcagcatactgc

SEQ ID NO: 150107 - DNA, 25 bp, Mus musculus
tgtcagcactgtggtgtggacgcac

SEQ ID NO: 150108 - DNA, 25 bp, Mus musculus
tgtcagcagcggcaaccttgtctca

SEQ ID NO: 150109 - DNA, 25 bp, Mus musculus
tgtcagcagtgcaagaaagcctggc

SEQ ID NO: 150110 - DNA, 25 bp, Mus musculus
tgtcagcatcaaggcggaggtcctg

SEQ ID NO: 150111 - DNA, 25 bp, Mus musculus
tgtcagccacatatgcaaagccaaa

SEQ ID NO: 150112 - DNA, 25 bp, Mus musculus
tgtcagcccaagtacagaagaagcg

SEQ ID NO: 150113 - DNA, 25 bp, Mus musculus
tgtcagccccagataacacagaggg

SEQ ID NO: 150114 - DNA, 25 bp, Mus musculus
tgtcagccgagtcccaaaggtgctg

SEQ ID NO: 150115 - DNA, 25 bp, Mus musculus
tgtcagccgctctcaagctattaga

SEQ ID NO: 150116 - DNA, 25 bp, Mus musculus
tgtcagccggcttcgaggtgtgtcc

SEQ ID NO: 150117 - DNA, 25 bp, Mus musculus
tgtcagcgcccatctagtgcaagga

SEQ ID NO: 150118 - DNA, 25 bp, Mus musculus
tgtcagcgcgggtgtttctttcagc

SEQ ID NO: 150119 - DNA, 25 bp, Mus musculus
tgtcagctctgtagccgtgcacgct

SEQ ID NO: 150120 - DNA, 25 bp, Mus musculus
tgtcagctctgtgcacagccgatgt

SEQ ID NO: 150121 - DNA, 25 bp, Mus musculus
tgtcagctgcacaaaggccagtcct

SEQ ID NO: 150122 - DNA, 25 bp, Mus musculus
tgtcagctgccctcttgttgtcaag

SEQ ID NO: 150123 - DNA, 25 bp, Mus musculus
tgtcaggaaagcaacgtcatcaagg

SEQ ID NO: 150124 - DNA, 25 bp, Mus musculus
tgtcaggaagactcatgggctctcc

SEQ ID NO: 150125 - DNA, 25 bp, Mus musculus
tgtcaggacaagatgcccagctggg

SEQ ID NO: 150126 - DNA, 25 bp, Mus musculus
tgtcaggagccctggaagaccgtgt

SEQ ID NO: 150127 - DNA, 25 bp, Mus musculus
tgtcaggatcctctgcaacggagca

SEQ ID NO: 150128 - DNA, 25 bp, Mus musculus
tgtcaggcagaagataccatgtcca

SEQ ID NO: 150129 - DNA, 25 bp, Mus musculus
tgtcaggcgctcaggcctcttggga

SEQ ID NO: 150130 - DNA, 25 bp, Mus musculus
tgtcaggcggctttggatatagccc

SEQ ID NO: 150131 - DNA, 25 bp, Mus musculus
tgtcagggccatagatctaccttgc

SEQ ID NO: 150132 - DNA, 25 bp, Mus musculus
tgtcagtacaaaggatcagtacccg

SEQ ID NO: 150133 - DNA, 25 bp, Mus musculus
tgtcagtacacttcagctcaaaggc

SEQ ID NO: 150134 - DNA, 25 bp, Mus musculus
tgtcagtaccgatgagctgggccct

SEQ ID NO: 150135 - DNA, 25 bp, Mus musculus
tgtcagtagataagccccagggcat

SEQ ID NO: 150136 - DNA, 25 bp, Mus musculus
tgtcagtcaccaaagaataccgcct

SEQ ID NO: 150137 - DNA, 25 bp, Mus musculus
tgtcagtcacccttctccaggacat

SEQ ID NO: 150138 - DNA, 25 bp, Mus musculus
tgtcagtcactcaattccaaaacgg

SEQ ID NO: 150139 - DNA, 25 bp, Mus musculus
tgtcagtcactcacaaactcaggga

SEQ ID NO: 150140 - DNA, 25 bp, Mus musculus
tgtcagtgaagactacgaggctgcc

SEQ ID NO: 150141 - DNA, 25 bp, Mus musculus
tgtcagtgagatgctggacctggaa

SEQ ID NO: 150142 - DNA, 25 bp, Mus musculus
tgtcagtggctaacaatcgcttggt

SEQ ID NO: 150143 - DNA, 25 bp, Mus musculus
tgtcagtgtatccaccatgtcgggc

SEQ ID NO: 150144 - DNA, 25 bp, Mus musculus
tgtcagtgtcatccagttcgaggac

SEQ ID NO: 150145 - DNA, 25 bp, Mus musculus
tgtcagtgtgattaacaataaaagt

SEQ ID NO: 150146 - DNA, 25 bp, Mus musculus
tgtcagtgttacaatggagtagtcc

SEQ ID NO: 150147 - DNA, 25 bp, Mus musculus
tgtcagtgttgttcatcatggcccc

SEQ ID NO: 150148 - DNA, 25 bp, Mus musculus
tgtcagttacctagagtcccagcag

SEQ ID NO: 150149 - DNA, 25 bp, Mus musculus
tgtcagttcagttgcagcctaccga

SEQ ID NO: 150150 - DNA, 25 bp, Mus musculus
tgtcagttcccgtccaagttcccgg

SEQ ID NO: 150151 - DNA, 25 bp, Mus musculus
tgtcataaacagaagcagtgcatcc

SEQ ID NO: 150152 - DNA, 25 bp, Mus musculus
tgtcataaggccttctgtgctccct

SEQ ID NO: 150153 - DNA, 25 bp, Mus musculus
tgtcatacaaattccaaagggtctg

SEQ ID NO: 150154 - DNA, 25 bp, Mus musculus
tgtcatagaagatcagaagaatcca

SEQ ID NO: 150155 - DNA, 25 bp, Mus musculus
tgtcatagagaaggttctagaagag

SEQ ID NO: 150156 - DNA, 25 bp, Mus musculus
tgtcatagagcagaacacaggaggg

SEQ ID NO: 150157 - DNA, 25 bp, Mus musculus
tgtcatcaactggaaacagcatctg

SEQ ID NO: 150158 - DNA, 25 bp, Mus musculus
tgtcatcaaggatgtgcacctggcc

SEQ ID NO: 150159 - DNA, 25 bp, Mus musculus
tgtcatcacctagaaagatggccag

SEQ ID NO: 150160 - DNA, 25 bp, Mus musculus
tgtcatcagaggactctccctgcct

SEQ ID NO: 150161 - DNA, 25 bp, Mus musculus
tgtcatcagtcctagtggcccaacg

SEQ ID NO: 150162 - DNA, 25 bp, Mus musculus
tgtcatcatagaagcctggccagcg

SEQ ID NO: 150163 - DNA, 25 bp, Mus musculus
tgtcatcatcaagcaagggcacgag

SEQ ID NO: 150164 - DNA, 25 bp, Mus musculus
tgtcatcatcgaggtaggcagggaa

SEQ ID NO: 150165 - DNA, 25 bp, Mus musculus
tgtcatcatgattctttggcggcca

SEQ ID NO: 150166 - DNA, 25 bp, Mus musculus
tgtcatccaggaggagttcgaccgc

SEQ ID NO: 150167 - DNA, 25 bp, Mus musculus
tgtcatccccaatgcaaagaagtcg

SEQ ID NO: 150168 - DNA, 25 bp, Mus musculus
tgtcatcccgtgaagcgaatgcgca

SEQ ID NO: 150169 - DNA, 25 bp, Mus musculus
tgtcatccggcacatcctggacaat

SEQ ID NO: 150170 - DNA, 25 bp, Mus musculus
tgtcatcgatttagtgcagcccgca

SEQ ID NO: 150171 - DNA, 25 bp, Mus musculus
tgtcatcgcagggtaacacaagtcc

SEQ ID NO: 150172 - DNA, 25 bp, Mus musculus
tgtcatctacgcctggtccattgga

SEQ ID NO: 150173 - DNA, 25 bp, Mus musculus
tgtcatctcactatgggcacagcag

SEQ ID NO: 150174 - DNA, 25 bp, Mus musculus
tgtcatctcagctgaaggcctcacc

SEQ ID NO: 150175 - DNA, 25 bp, Mus musculus
tgtcatctgctctctgattgtcacc

SEQ ID NO: 150176 - DNA, 25 bp, Mus musculus
tgtcatgaccttcgagcagcaggac

SEQ ID NO: 150177 - DNA, 25 bp, Mus musculus
tgtcatgatgacaccccaggatgtg

SEQ ID NO: 150178 - DNA, 25 bp, Mus musculus
tgtcatgattgcagactacagatct

SEQ ID NO: 150179 - DNA, 25 bp, Mus musculus
tgtcatgcagggaccatacagcgag

SEQ ID NO: 150180 - DNA, 25 bp, Mus musculus
tgtcatgctgccagacaaccagagc

SEQ ID NO: 150181 - DNA, 25 bp, Mus musculus
tgtcatggcttacgagaactggccc

SEQ ID NO: 150182 - DNA, 25 bp, Mus musculus
tgtcatgtaggcaaggtggctccca

SEQ ID NO: 150183 - DNA, 25 bp, Mus musculus
tgtcattaaacatctccagtctgat

SEQ ID NO: 150184 - DNA, 25 bp, Mus musculus
tgtcattaacttggagaagcctgtg

SEQ ID NO: 150185 - DNA, 25 bp, Mus musculus
tgtcattcgacattcaggcccgcat

SEQ ID NO: 150186 - DNA, 25 bp, Mus musculus
tgtcattcttaaggcagggcccagt

SEQ ID NO: 150187 - DNA, 25 bp, Mus musculus
tgtcattgaaccttgtccccttaag

SEQ ID NO: 150188 - DNA, 25 bp, Mus musculus
tgtcattgagcagatagcccacgtc

SEQ ID NO: 150189 - DNA, 25 bp, Mus musculus
tgtcattgatcccaaggtgctcgcc

SEQ ID NO: 150190 - DNA, 25 bp, Mus musculus
tgtcattgcgtatcaccgcacagcg

SEQ ID NO: 150191 - DNA, 25 bp, Mus musculus
tgtcatttccagctccaatcacgag

SEQ ID NO: 150192 - DNA, 25 bp, Mus musculus
tgtcatttctgacgtcatcagggcg

SEQ ID NO: 150193 - DNA, 25 bp, Mus musculus
tgtcattttgacaaccccaactgtt

SEQ ID NO: 150194 - DNA, 25 bp, Mus musculus
tgtccaaaagtgtaaggcctcgggc

SEQ ID NO: 150195 - DNA, 25 bp, Mus musculus
tgtccaaacctctctccaagaatct

SEQ ID NO: 150196 - DNA, 25 bp, Mus musculus
tgtccaaagacaagaagtggtctgt

SEQ ID NO: 150197 - DNA, 25 bp, Mus musculus
tgtccaaagcaagtcacctcctgag

SEQ ID NO: 150198 - DNA, 25 bp, Mus musculus
tgtccaaagggcacgatgtgaccat

SEQ ID NO: 150199 - DNA, 25 bp, Mus musculus
tgtccaaatcccagctgagcctgag

SEQ ID NO: 150200 - DNA, 25 bp, Mus musculus
tgtccaacatcagctgcagaggtct

SEQ ID NO: 150201 - DNA, 25 bp, Mus musculus
tgtccaacatgctggcccaggacgg

SEQ ID NO: 150202 - DNA, 25 bp, Mus musculus
tgtccaagaaacgtcgcgtgtccgg

SEQ ID NO: 150203 - DNA, 25 bp, Mus musculus
tgtccaagatgtgcccgagcgatgt

SEQ ID NO: 150204 - DNA, 25 bp, Mus musculus
tgtccaagcccagacagttggcaga

SEQ ID NO: 150205 - DNA, 25 bp, Mus musculus
tgtccaaggaaagtagagccgccgt

SEQ ID NO: 150206 - DNA, 25 bp, Mus musculus
tgtccaagggcgatgcagataccaa

SEQ ID NO: 150207 - DNA, 25 bp, Mus musculus
tgtccaaggttctggtgctgccctg

SEQ ID NO: 150208 - DNA, 25 bp, Mus musculus
tgtccaagtccaacagcaatgctgt

SEQ ID NO: 150209 - DNA, 25 bp, Mus musculus
tgtccaagtgcagtactacaaaggc

SEQ ID NO: 150210 - DNA, 25 bp, Mus musculus
tgtccacacatcagtttcacaggga

SEQ ID NO: 150211 - DNA, 25 bp, Mus musculus
tgtccacctccgtgaagaaacgtgt

SEQ ID NO: 150212 - DNA, 25 bp, Mus musculus
tgtccacctttgttccaacgaggag

SEQ ID NO: 150213 - DNA, 25 bp, Mus musculus
tgtccacggtgattctccgagcctg

SEQ ID NO: 150214 - DNA, 25 bp, Mus musculus
tgtccacgtctgtaagtctccaggg

SEQ ID NO: 150215 - DNA, 25 bp, Mus musculus
tgtccactagtctgtaaacacttgt

SEQ ID NO: 150216 - DNA, 25 bp, Mus musculus
tgtccactcaaaaccttcagctcgg

SEQ ID NO: 150217 - DNA, 25 bp, Mus musculus
tgtccagaagcttggtagacccgtg

SEQ ID NO: 150218 - DNA, 25 bp, Mus musculus
tgtccagaaggagaacagggatgcc

SEQ ID NO: 150219 - DNA, 25 bp, Mus musculus
tgtccagagacttcccatttccggg

SEQ ID NO: 150220 - DNA, 25 bp, Mus musculus
tgtccagagccctgaagtggtccag

SEQ ID NO: 150221 - DNA, 25 bp, Mus musculus
tgtccagaggaaacacaggaaggcc

SEQ ID NO: 150222 - DNA, 25 bp, Mus musculus
tgtccagagggctcaagagggctac

SEQ ID NO: 150223 - DNA, 25 bp, Mus musculus
tgtccagagtgcagtctgatgccca

SEQ ID NO: 150224 - DNA, 25 bp, Mus musculus
tgtccagcagcttctggcagcaaga

SEQ ID NO: 150225 - DNA, 25 bp, Mus musculus
tgtccagcgaacgagcaagccagcg

SEQ ID NO: 150226 - DNA, 25 bp, Mus musculus
tgtccagcgtcccttttcaaagtgc

SEQ ID NO: 150227 - DNA, 25 bp, Mus musculus
tgtccagctggtgtgaagggtcctc

SEQ ID NO: 150228 - DNA, 25 bp, Mus musculus
tgtccaggaagtcatcacaaagtac

SEQ ID NO: 150229 - DNA, 25 bp, Mus musculus
tgtccaggacccgttgttcagatgt

SEQ ID NO: 150230 - DNA, 25 bp, Mus musculus
tgtccaggagtcagtgcacataatg

SEQ ID NO: 150231 - DNA, 25 bp, Mus musculus
tgtccaggccacttacatctctggt

SEQ ID NO: 150232 - DNA, 25 bp, Mus musculus
tgtccagggccagattgtacaatgt

SEQ ID NO: 150233 - DNA, 25 bp, Mus musculus
tgtccaggtcctgaaaatcgctcag

SEQ ID NO: 150234 - DNA, 25 bp, Mus musculus
tgtccagtagtagtgccaagccctt

SEQ ID NO: 150235 - DNA, 25 bp, Mus musculus
tgtccagtcctaaaacgagtgagag

SEQ ID NO: 150236 - DNA, 25 bp, Mus musculus
tgtccagtcggatagtgagatcacc

SEQ ID NO: 150237 - DNA, 25 bp, Mus musculus
tgtccagtggctaaacagaagcctt

SEQ ID NO: 150238 - DNA, 25 bp, Mus musculus
tgtccagtgtgcaaacagcagtgct

SEQ ID NO: 150239 - DNA, 25 bp, Mus musculus
tgtccagttcccatcatgtccgaag

SEQ ID NO: 150240 - DNA, 25 bp, Mus musculus
tgtccagtttaaattccgggccaag

SEQ ID NO: 150241 - DNA, 25 bp, Mus musculus
tgtccataagatctgtgccaaacgg

SEQ ID NO: 150242 - DNA, 25 bp, Mus musculus
tgtccatacgcctctgctcatctgg

SEQ ID NO: 150243 - DNA, 25 bp, Mus musculus
tgtccataggacagagccgagtcct

SEQ ID NO: 150244 - DNA, 25 bp, Mus musculus
tgtccatatgattacaaagcagaag

SEQ ID NO: 150245 - DNA, 25 bp, Mus musculus
tgtccatcatacctcgaggcaaggg

SEQ ID NO: 150246 - DNA, 25 bp, Mus musculus
tgtccatccctgtgcttaaagcgag

SEQ ID NO: 150247 - DNA, 25 bp, Mus musculus
tgtccatcctgtcgtcctttgagag

SEQ ID NO: 150248 - DNA, 25 bp, Mus musculus
tgtccatcttttcggatatcatcgc

SEQ ID NO: 150249 - DNA, 25 bp, Mus musculus
tgtccatgaccacaacaagtgcgga

SEQ ID NO: 150250 - DNA, 25 bp, Mus musculus
tgtccatggcctacctcactgggat

SEQ ID NO: 150251 - DNA, 25 bp, Mus musculus
tgtccatgttgatcgagcaggcccg

SEQ ID NO: 150252 - DNA, 25 bp, Mus musculus
tgtccattccaaaagccaaaggctg

SEQ ID NO: 150253 - DNA, 25 bp, Mus musculus
tgtccattccgccacatcagtggtg

SEQ ID NO: 150254 - DNA, 25 bp, Mus musculus
tgtcccaaatgaacgtcctgctagg

SEQ ID NO: 150255 - DNA, 25 bp, Mus musculus
tgtcccaaggaggtggcctcgctat

SEQ ID NO: 150256 - DNA, 25 bp, Mus musculus
tgtcccacaaaggaaggctcgcctt

SEQ ID NO: 150257 - DNA, 25 bp, Mus musculus
tgtcccacctaaaaacttctcggag

SEQ ID NO: 150258 - DNA, 25 bp, Mus musculus
tgtcccacctggcttcaagaaaggg

SEQ ID NO: 150259 - DNA, 25 bp, Mus musculus
tgtcccacgcgttagcaggtttcct

SEQ ID NO: 150260 - DNA, 25 bp, Mus musculus
tgtcccacggacagacgcagaagtt

SEQ ID NO: 150261 - DNA, 25 bp, Mus musculus
tgtcccactgtaaaaagtaccctgt

SEQ ID NO: 150262 - DNA, 25 bp, Mus musculus
tgtcccagagtttaaggagtctaga

SEQ ID NO: 150263 - DNA, 25 bp, Mus musculus
tgtcccaggaagcagtccctttctg

SEQ ID NO: 150264 - DNA, 25 bp, Mus musculus
tgtcccaggtgtactgccacaaggg

SEQ ID NO: 150265 - DNA, 25 bp, Mus musculus
tgtcccatcgcacacagtggctgtt

SEQ ID NO: 150266 - DNA, 25 bp, Mus musculus
tgtcccatctacctggtcaatgtgt

SEQ ID NO: 150267 - DNA, 25 bp, Mus musculus
tgtcccattcaaggagagccgtgcc

SEQ ID NO: 150268 - DNA, 25 bp, Mus musculus
tgtccccaagccaggaagtcaagtc

SEQ ID NO: 150269 - DNA, 25 bp, Mus musculus
tgtccccaagtgtggaatggccgca

SEQ ID NO: 150270 - DNA, 25 bp, Mus musculus
tgtccccaattggaagaagctgcag

SEQ ID NO: 150271 - DNA, 25 bp, Mus musculus
tgtccccagaggagtttggtacccg

SEQ ID NO: 150272 - DNA, 25 bp, Mus musculus
tgtccccaggacaaaggtgaaaacg

SEQ ID NO: 150273 - DNA, 25 bp, Mus musculus
tgtccccgcggtacctgaagaagta

SEQ ID NO: 150274 - DNA, 25 bp, Mus musculus
tgtccccggaggtgtgaagaccatc

SEQ ID NO: 150275 - DNA, 25 bp, Mus musculus
tgtcccctatcaggtgtccctaaat

SEQ ID NO: 150276 - DNA, 25 bp, Mus musculus
tgtcccctcaagagttcaagcaagg

SEQ ID NO: 150277 - DNA, 25 bp, Mus musculus
tgtcccctggagaggtttgcccaac

SEQ ID NO: 150278 - DNA, 25 bp, Mus musculus
tgtccccttggccagtgtaaagtct

SEQ ID NO: 150279 - DNA, 25 bp, Mus musculus
tgtcccgacacactaataaaggcat

SEQ ID NO: 150280 - DNA, 25 bp, Mus musculus
tgtcccgagagaaaacacatgccct

SEQ ID NO: 150281 - DNA, 25 bp, Mus musculus
tgtcccgaggcccagaatagctgag

SEQ ID NO: 150282 - DNA, 25 bp, Mus musculus
tgtcccggacacacctgggtccttg

SEQ ID NO: 150283 - DNA, 25 bp, Mus musculus
tgtcccggacactgagctacaagta

SEQ ID NO: 150284 - DNA, 25 bp, Mus musculus
tgtcccggactaaggaacacaagta

SEQ ID NO: 150285 - DNA, 25 bp, Mus musculus
tgtcccggatcactagaagaacctc

SEQ ID NO: 150286 - DNA, 25 bp, Mus musculus
tgtcccggccggatggatctgcttc

SEQ ID NO: 150287 - DNA, 25 bp, Mus musculus
tgtcccgggtcagcacagttgtggc

SEQ ID NO: 150288 - DNA, 25 bp, Mus musculus
tgtccctaaacgttctacttttctg

SEQ ID NO: 150289 - DNA, 25 bp, Mus musculus
tgtccctatcgagctgggtcaggag

SEQ ID NO: 150290 - DNA, 25 bp, Mus musculus
tgtccctatggaagcgcaagagtct

SEQ ID NO: 150291 - DNA, 25 bp, Mus musculus
tgtccctcctccaataaaggttaag

SEQ ID NO: 150292 - DNA, 25 bp, Mus musculus
tgtccctcttctccaaaagcagcga

SEQ ID NO: 150293 - DNA, 25 bp, Mus musculus
tgtccctgaagtgtcgagcaccgga

SEQ ID NO: 150294 - DNA, 25 bp, Mus musculus
tgtccctgacagtgagcaaaagaac

SEQ ID NO: 150295 - DNA, 25 bp, Mus musculus
tgtccctgagcagataggcctggat

SEQ ID NO: 150296 - DNA, 25 bp, Mus musculus
tgtccctggcaaacctcagctggag

SEQ ID NO: 150297 - DNA, 25 bp, Mus musculus
tgtccctggccagagtgcaggaacc

SEQ ID NO: 150298 - DNA, 25 bp, Mus musculus
tgtccctggcgaacatctacttgga

SEQ ID NO: 150299 - DNA, 25 bp, Mus musculus
tgtccctggcgctctggtttctctg

SEQ ID NO: 150300 - DNA, 25 bp, Mus musculus
tgtccctgggaaacacgagtgtccg

SEQ ID NO: 150301 - DNA, 25 bp, Mus musculus
tgtccctgtccttccgagtcttcga

SEQ ID NO: 150302 - DNA, 25 bp, Mus musculus
tgtcccttggcagcagaacaccaat

SEQ ID NO: 150303 - DNA, 25 bp, Mus musculus
tgtcccttgtcctttgttactttgt

SEQ ID NO: 150304 - DNA, 25 bp, Mus musculus
tgtccgaaagaaacaaagtgccact

SEQ ID NO: 150305 - DNA, 25 bp, Mus musculus
tgtccgacaacacctagaggaagag

SEQ ID NO: 150306 - DNA, 25 bp, Mus musculus
tgtccgacggccagatgatgggtcc

SEQ ID NO: 150307 - DNA, 25 bp, Mus musculus
tgtccgacgtctacagaaggctctg

SEQ ID NO: 150308 - DNA, 25 bp, Mus musculus
tgtccgagacatcaagaagccctga

SEQ ID NO: 150309 - DNA, 25 bp, Mus musculus
tgtccgagagaagcagtatgaagta

SEQ ID NO: 150310 - DNA, 25 bp, Mus musculus
tgtccgagaggatcgaaggcttcgt

SEQ ID NO: 150311 - DNA, 25 bp, Mus musculus
tgtccgaggaagtcaagctcagcct

SEQ ID NO: 150312 - DNA, 25 bp, Mus musculus
tgtccgatgccatgaagtccgagga

SEQ ID NO: 150313 - DNA, 25 bp, Mus musculus
tgtccgcaaggagcacgtaaagttc

SEQ ID NO: 150314 - DNA, 25 bp, Mus musculus
tgtccgcacgctggaaaagatccga

SEQ ID NO: 150315 - DNA, 25 bp, Mus musculus
tgtccgcattctggtacagccatga

SEQ ID NO: 150316 - DNA, 25 bp, Mus musculus
tgtccgccacgacgaaaagactttc

SEQ ID NO: 150317 - DNA, 25 bp, Mus musculus
tgtccgccgacttgtggccaaaggg

SEQ ID NO: 150318 - DNA, 25 bp, Mus musculus
tgtccgcctcatagattcaatgacc

SEQ ID NO: 150319 - DNA, 25 bp, Mus musculus
tgtccgctgtaatgtagtgaatccc

SEQ ID NO: 150320 - DNA, 25 bp, Mus musculus
tgtccggacacaaggacaaagtgac

SEQ ID NO: 150321 - DNA, 25 bp, Mus musculus
tgtccggaccattgaacagcagatt

SEQ ID NO: 150322 - DNA, 25 bp, Mus musculus
tgtccggccacgagagactgtatag

SEQ ID NO: 150323 - DNA, 25 bp, Mus musculus
tgtccggctgggaacaaaccactaa

SEQ ID NO: 150324 - DNA, 25 bp, Mus musculus
tgtccgggactacgtgagaaccatg

SEQ ID NO: 150325 - DNA, 25 bp, Mus musculus
tgtccgggagaaagatgtcttgctc

SEQ ID NO: 150326 - DNA, 25 bp, Mus musculus
tgtccggtccctggctgtcggctgt

SEQ ID NO: 150327 - DNA, 25 bp, Mus musculus
tgtccgtaggacgtcagctcagtga

SEQ ID NO: 150328 - DNA, 25 bp, Mus musculus
tgtccgtatgcctgtggcaacctgg

SEQ ID NO: 150329 - DNA, 25 bp, Mus musculus
tgtccgtattaccacctgctcaggg

SEQ ID NO: 150330 - DNA, 25 bp, Mus musculus
tgtccgtcacaattaccctgggagg

SEQ ID NO: 150331 - DNA, 25 bp, Mus musculus
tgtccgtcagagagaaccccattat

SEQ ID NO: 150332 - DNA, 25 bp, Mus musculus
tgtccgtgaccaccggcttgtatct

SEQ ID NO: 150333 - DNA, 25 bp, Mus musculus
tgtccgtgaccttcagggtaacccg

SEQ ID NO: 150334 - DNA, 25 bp, Mus musculus
tgtccgtgaggccttttgaaagtcc

SEQ ID NO: 150335 - DNA, 25 bp, Mus musculus
tgtccgtgcacatacacctccaggt

SEQ ID NO: 150336 - DNA, 25 bp, Mus musculus
tgtccgtggtggtcagaatctgcgt

SEQ ID NO: 150337 - DNA, 25 bp, Mus musculus
tgtccgttcacgtgcagaaagcttg

SEQ ID NO: 150338 - DNA, 25 bp, Mus musculus
tgtcctaacaaggagcatctgcatg

SEQ ID NO: 150339 - DNA, 25 bp, Mus musculus
tgtcctaactgagggagaactggcc

SEQ ID NO: 150340 - DNA, 25 bp, Mus musculus
tgtcctaccgcctctacgacgagat

SEQ ID NO: 150341 - DNA, 25 bp, Mus musculus
tgtcctaccgggaaaaaggtctctg

SEQ ID NO: 150342 - DNA, 25 bp, Mus musculus
tgtcctacctgtcggaaaaaactgg

SEQ ID NO: 150343 - DNA, 25 bp, Mus musculus
tgtcctacgatgtgcagctgctcca

SEQ ID NO: 150344 - DNA, 25 bp, Mus musculus
tgtcctactgctcggaacactgtta

SEQ ID NO: 150345 - DNA, 25 bp, Mus musculus
tgtcctatatacacaagcagttggg

SEQ ID NO: 150346 - DNA, 25 bp, Mus musculus
tgtcctatttaaagcaaaagcaggc

SEQ ID NO: 150347 - DNA, 25 bp, Mus musculus
tgtcctcacacaaagggctgaatgg

SEQ ID NO: 150348 - DNA, 25 bp, Mus musculus
tgtcctcaccctgttctcaaaagaa

SEQ ID NO: 150349 - DNA, 25 bp, Mus musculus
tgtcctcacgccaatgtcctttctt

SEQ ID NO: 150350 - DNA, 25 bp, Mus musculus
tgtcctcagagacctttcatctctg

SEQ ID NO: 150351 - DNA, 25 bp, Mus musculus
tgtcctccaggagttagctgtgcct

SEQ ID NO: 150352 - DNA, 25 bp, Mus musculus
tgtcctccggctgcaaaggaatgct

SEQ ID NO: 150353 - DNA, 25 bp, Mus musculus
tgtcctcctgacgatacctggaagc

SEQ ID NO: 150354 - DNA, 25 bp, Mus musculus
tgtcctcgatgaaatgctaccgcag

SEQ ID NO: 150355 - DNA, 25 bp, Mus musculus
tgtcctcggaacaaaggcagggtta

SEQ ID NO: 150356 - DNA, 25 bp, Mus musculus
tgtcctcggacactgatcaatcatg

SEQ ID NO: 150357 - DNA, 25 bp, Mus musculus
tgtcctcgggctgcaatttacctgt

SEQ ID NO: 150358 - DNA, 25 bp, Mus musculus
tgtcctctagaaacacttcacaatg

SEQ ID NO: 150359 - DNA, 25 bp, Mus musculus
tgtcctctccaagtgcgcaccggcc

SEQ ID NO: 150360 - DNA, 25 bp, Mus musculus
tgtcctctgaagtaactgcctgctg

SEQ ID NO: 150361 - DNA, 25 bp, Mus musculus
tgtcctgaaaaaccagctgtccgcc

SEQ ID NO: 150362 - DNA, 25 bp, Mus musculus
tgtcctgaaaccatggaagactgtg

SEQ ID NO: 150363 - DNA, 25 bp, Mus musculus
tgtcctgaactccagtatgttggct

SEQ ID NO: 150364 - DNA, 25 bp, Mus musculus
tgtcctgacactgaagggcctgacc

SEQ ID NO: 150365 - DNA, 25 bp, Mus musculus
tgtcctgaccctagcgctctgatgg

SEQ ID NO: 150366 - DNA, 25 bp, Mus musculus
tgtcctgagaaggcttagcgcctgc

SEQ ID NO: 150367 - DNA, 25 bp, Mus musculus
tgtcctgagtggagagaacgcctat

SEQ ID NO: 150368 - DNA, 25 bp, Mus musculus
tgtcctgcactagaaaccctttgag

SEQ ID NO: 150369 - DNA, 25 bp, Mus musculus
tgtcctgcagaagcgcaacagggcc

SEQ ID NO: 150370 - DNA, 25 bp, Mus musculus
tgtcctgccaggtggttatcccgcc

SEQ ID NO: 150371 - DNA, 25 bp, Mus musculus
tgtcctgcccacgtttctctagtag

SEQ ID NO: 150372 - DNA, 25 bp, Mus musculus
tgtcctgctactggtgtggagcccc

SEQ ID NO: 150373 - DNA, 25 bp, Mus musculus
tgtcctggagcatgaagcctctgac

SEQ ID NO: 150374 - DNA, 25 bp, Mus musculus
tgtcctggcagccttcagccagtat

SEQ ID NO: 150375 - DNA, 25 bp, Mus musculus
tgtcctggcctcttgcaccatcagc

SEQ ID NO: 150376 - DNA, 25 bp, Mus musculus
tgtcctggcgcaagctctacttaag

SEQ ID NO: 150377 - DNA, 25 bp, Mus musculus
tgtcctggctactacacttggcggc

SEQ ID NO: 150378 - DNA, 25 bp, Mus musculus
tgtcctggctgtattcataagatcc

SEQ ID NO: 150379 - DNA, 25 bp, Mus musculus
tgtcctgggtcatgaaacttagtcc

SEQ ID NO: 150380 - DNA, 25 bp, Mus musculus
tgtcctggtcaacgcccaagggtta

SEQ ID NO: 150381 - DNA, 25 bp, Mus musculus
tgtcctgtgataaggcccagctgga

SEQ ID NO: 150382 - DNA, 25 bp, Mus musculus
tgtcctgtggaaaccgggacgtctc

SEQ ID NO: 150383 - DNA, 25 bp, Mus musculus
tgtcctgtgtttgactacgtgcccc

SEQ ID NO: 150384 - DNA, 25 bp, Mus musculus
tgtccttcagctttggaaaggccgc

SEQ ID NO: 150385 - DNA, 25 bp, Mus musculus
tgtccttccaagagagcctaggcga

SEQ ID NO: 150386 - DNA, 25 bp, Mus musculus
tgtccttccagagttcgcagcagtc

SEQ ID NO: 150387 - DNA, 25 bp, Mus musculus
tgtccttccggctgctggctgcagt

SEQ ID NO: 150388 - DNA, 25 bp, Mus musculus
tgtccttgaacaaacacatggaaga

SEQ ID NO: 150389 - DNA, 25 bp, Mus musculus
tgtccttgaacgagcaaagccagag

SEQ ID NO: 150390 - DNA, 25 bp, Mus musculus
tgtccttgcgttggacaaagctgcc

SEQ ID NO: 150391 - DNA, 25 bp, Mus musculus
tgtccttgctcagtgtgcgccgctg

SEQ ID NO: 150392 - DNA, 25 bp, Mus musculus
tgtccttggaagaaatgctcaagag

SEQ ID NO: 150393 - DNA, 25 bp, Mus musculus
tgtccttgtaggagacggtgcccgc

SEQ ID NO: 150394 - DNA, 25 bp, Mus musculus
tgtccttgtcaatggattggtccac

SEQ ID NO: 150395 - DNA, 25 bp, Mus musculus
tgtcctttagaatgtgagcgtcgct

SEQ ID NO: 150396 - DNA, 25 bp, Mus musculus
tgtccttttgagacctgcccgtcgg

SEQ ID NO: 150397 - DNA, 25 bp, Mus musculus
tgtcgaaactccttagcaagtgtgg

SEQ ID NO: 150398 - DNA, 25 bp, Mus musculus
tgtcgaaccacatcgaggactggta

SEQ ID NO: 150399 - DNA, 25 bp, Mus musculus
tgtcgaactgggtttgaacggcagc

SEQ ID NO: 150400 - DNA, 25 bp, Mus musculus
tgtcgaagaacctgcctgagaccct

SEQ ID NO: 150401 - DNA, 25 bp, Mus musculus
tgtcgaagatcacgtcaccggtgct

SEQ ID NO: 150402 - DNA, 25 bp, Mus musculus
tgtcgaatgctagaagaaggctctt

SEQ ID NO: 150403 - DNA, 25 bp, Mus musculus
tgtcgaattcctgagagcgcttgag

SEQ ID NO: 150404 - DNA, 25 bp, Mus musculus
tgtcgacacagctgtgcgccatgtg

SEQ ID NO: 150405 - DNA, 25 bp, Mus musculus
tgtcgacacattgcaacaagaaagt

SEQ ID NO: 150406 - DNA, 25 bp, Mus musculus
tgtcgacactgaacaccgtctggtc

SEQ ID NO: 150407 - DNA, 25 bp, Mus musculus
tgtcgacagcaacgaacaaggctcc

SEQ ID NO: 150408 - DNA, 25 bp, Mus musculus
tgtcgacggtcaaaatgggagtccc

SEQ ID NO: 150409 - DNA, 25 bp, Mus musculus
tgtcgacgtcgaaagaaagagtatg

SEQ ID NO: 150410 - DNA, 25 bp, Mus musculus
tgtcgagaggcccaagtgtccactt

SEQ ID NO: 150411 - DNA, 25 bp, Mus musculus
tgtcgagatcgattgcagcctggct

SEQ ID NO: 150412 - DNA, 25 bp, Mus musculus
tgtcgagcatcaaccaggaggcgct

SEQ ID NO: 150413 - DNA, 25 bp, Mus musculus
tgtcgagccttggaattgatgcagc

SEQ ID NO: 150414 - DNA, 25 bp, Mus musculus
tgtcgagctcatcaacaagtgcaac

SEQ ID NO: 150415 - DNA, 25 bp, Mus musculus
tgtcgagctggctgtattcctgcct

SEQ ID NO: 150416 - DNA, 25 bp, Mus musculus
tgtcgaggatggaactgccaatcag

SEQ ID NO: 150417 - DNA, 25 bp, Mus musculus
tgtcgagggcctggcaattctggca

SEQ ID NO: 150418 - DNA, 25 bp, Mus musculus
tgtcgagtttccacaggttcccgtc

SEQ ID NO: 150419 - DNA, 25 bp, Mus musculus
tgtcgatagcaaggagcagatctca

SEQ ID NO: 150420 - DNA, 25 bp, Mus musculus
tgtcgatccatttcagatacttgtg

SEQ ID NO: 150421 - DNA, 25 bp, Mus musculus
tgtcgcaagcacttcatccaggcca

SEQ ID NO: 150422 - DNA, 25 bp, Mus musculus
tgtcgcagagcctcacacccaggag

SEQ ID NO: 150423 - DNA, 25 bp, Mus musculus
tgtcgcagcaataatggcaattacg

SEQ ID NO: 150424 - DNA, 25 bp, Mus musculus
tgtcgccaaatgcagatctttagca

SEQ ID NO: 150425 - DNA, 25 bp, Mus musculus
tgtcgccacgatgggcatgaagtgc

SEQ ID NO: 150426 - DNA, 25 bp, Mus musculus
tgtcgccagagagatccagtaccta

SEQ ID NO: 150427 - DNA, 25 bp, Mus musculus
tgtcgccagttttgcgcgtgccaaa

SEQ ID NO: 150428 - DNA, 25 bp, Mus musculus
tgtcgcccagcaactaaggcggcag

SEQ ID NO: 150429 - DNA, 25 bp, Mus musculus
tgtcgccgccgttagacaagctggg

SEQ ID NO: 150430 - DNA, 25 bp, Mus musculus
tgtcgcctttagaaccttggccctg

SEQ ID NO: 150431 - DNA, 25 bp, Mus musculus
tgtcgcgtccgaatcgagttcccgg

SEQ ID NO: 150432 - DNA, 25 bp, Mus musculus
tgtcgcgtttacgaagcccatctgt

SEQ ID NO: 150433 - DNA, 25 bp, Mus musculus
tgtcgctaggcatgaactccggata

SEQ ID NO: 150434 - DNA, 25 bp, Mus musculus
tgtcgctgcaacgtggaaggccaat

SEQ ID NO: 150435 - DNA, 25 bp, Mus musculus
tgtcgctgcacaggaaccttgcgct

SEQ ID NO: 150436 - DNA, 25 bp, Mus musculus
tgtcgcttcaggagcataagatggt

SEQ ID NO: 150437 - DNA, 25 bp, Mus musculus
tgtcggaacccatgtgcctcattga

SEQ ID NO: 150438 - DNA, 25 bp, Mus musculus
tgtcggacaagtaaccgcaagagct

SEQ ID NO: 150439 - DNA, 25 bp, Mus musculus
tgtcggagcagtaactctgtgcgcc

SEQ ID NO: 150440 - DNA, 25 bp, Mus musculus
tgtcggccgcgtacattccattcgg

SEQ ID NO: 150441 - DNA, 25 bp, Mus musculus
tgtcggcggcttttcgcaaggcagc

SEQ ID NO: 150442 - DNA, 25 bp, Mus musculus
tgtcgggagaggtggcacaaccatt

SEQ ID NO: 150443 - DNA, 25 bp, Mus musculus
tgtcgggagcccttagtcgtcatca

SEQ ID NO: 150444 - DNA, 25 bp, Mus musculus
tgtcgggattcgatgaccaggatct

SEQ ID NO: 150445 - DNA, 25 bp, Mus musculus
tgtcgggcaccgagtatattccttc

SEQ ID NO: 150446 - DNA, 25 bp, Mus musculus
tgtcgggccggcaattctcactgca

SEQ ID NO: 150447 - DNA, 25 bp, Mus musculus
tgtcggtacctctccaaggtcttgg

SEQ ID NO: 150448 - DNA, 25 bp, Mus musculus
tgtcggtagggcatttgtttcaaat

SEQ ID NO: 150449 - DNA, 25 bp, Mus musculus
tgtcggtgcaagctaacacagggcc

SEQ ID NO: 150450 - DNA, 25 bp, Mus musculus
tgtcggtttcgtgacatcgtggtga

SEQ ID NO: 150451 - DNA, 25 bp, Mus musculus
tgtcgtatgtgacagatgcccctga

SEQ ID NO: 150452 - DNA, 25 bp, Mus musculus
tgtcgtcgatgaagtgagcatctcc

SEQ ID NO: 150453 - DNA, 25 bp, Mus musculus
tgtcgtgaccaacaccacaactact

SEQ ID NO: 150454 - DNA, 25 bp, Mus musculus
tgtcgtgtccaagtacaaagccctg

SEQ ID NO: 150455 - DNA, 25 bp, Mus musculus
tgtcgtgttagcaccgcagatcgga

SEQ ID NO: 150456 - DNA, 25 bp, Mus musculus
tgtcgttcttgctgaggctcacggg

SEQ ID NO: 150457 - DNA, 25 bp, Mus musculus
tgtcgttgatgtcagaccccaggcc

SEQ ID NO: 150458 - DNA, 25 bp, Mus musculus
tgtcgtttcatccacggctccaagg

SEQ ID NO: 150459 - DNA, 25 bp, Mus musculus
tgtctaaacagaggcttcagtcggc

SEQ ID NO: 150460 - DNA, 25 bp, Mus musculus
tgtctaacagcacccaagcacaagg

SEQ ID NO: 150461 - DNA, 25 bp, Mus musculus
tgtctaagaagccagagaaccaggt

SEQ ID NO: 150462 - DNA, 25 bp, Mus musculus
tgtctaatgagatcgtcaaccctga

SEQ ID NO: 150463 - DNA, 25 bp, Mus musculus
tgtctacaaaatacacgtggctggg

SEQ ID NO: 150464 - DNA, 25 bp, Mus musculus
tgtctacaacaagtctgcctggcgc

SEQ ID NO: 150465 - DNA, 25 bp, Mus musculus
tgtctacagcaatggccgaatgcgg

SEQ ID NO: 150466 - DNA, 25 bp, Mus musculus
tgtctacaggctccgtgacgcaggt

SEQ ID NO: 150467 - DNA, 25 bp, Mus musculus
tgtctacagtggaccaggagagccc

SEQ ID NO: 150468 - DNA, 25 bp, Mus musculus
tgtctacatgctccctgttgtgttt

SEQ ID NO: 150469 - DNA, 25 bp, Mus musculus
tgtctaccagatcaacgtcctccgg

SEQ ID NO: 150470 - DNA, 25 bp, Mus musculus
tgtctacccggaaggccctcagtgt

SEQ ID NO: 150471 - DNA, 25 bp, Mus musculus
tgtctaccctgtgagaaagtgcggg

SEQ ID NO: 150472 - DNA, 25 bp, Mus musculus
tgtctacctgaaccggaagattgtc

SEQ ID NO: 150473 - DNA, 25 bp, Mus musculus
tgtctacgctcattgcccagtggtg

SEQ ID NO: 150474 - DNA, 25 bp, Mus musculus
tgtctacgttaaggtgcctgttgcc

SEQ ID NO: 150475 - DNA, 25 bp, Mus musculus
tgtctactggacaacttcctctggg

SEQ ID NO: 150476 - DNA, 25 bp, Mus musculus
tgtctacttccatgcaacgctgagt

SEQ ID NO: 150477 - DNA, 25 bp, Mus musculus
tgtctagacccagtcctgagcagag

SEQ ID NO: 150478 - DNA, 25 bp, Mus musculus
tgtctagcagccacctgaacgtgta

SEQ ID NO: 150479 - DNA, 25 bp, Mus musculus
tgtctagcgtttgacagaagcttgc

SEQ ID NO: 150480 - DNA, 25 bp, Mus musculus
tgtctaggatgcaccagaaggaaac

SEQ ID NO: 150481 - DNA, 25 bp, Mus musculus
tgtctaggcctgatggctcggtcag

SEQ ID NO: 150482 - DNA, 25 bp, Mus musculus
tgtctaggctgagatgggaccctcc

SEQ ID NO: 150483 - DNA, 25 bp, Mus musculus
tgtctaggttacacagggccctggg

SEQ ID NO: 150484 - DNA, 25 bp, Mus musculus
tgtctataacaattccaggatgctg

SEQ ID NO: 150485 - DNA, 25 bp, Mus musculus
tgtctatagagaagatttgggcccg

SEQ ID NO: 150486 - DNA, 25 bp, Mus musculus
tgtctatcagaatgagagcgaggtg

SEQ ID NO: 150487 - DNA, 25 bp, Mus musculus
tgtctatccactgctacgtcagggc

SEQ ID NO: 150488 - DNA, 25 bp, Mus musculus
tgtctatccataaacccaggctggc

SEQ ID NO: 150489 - DNA, 25 bp, Mus musculus
tgtctatgagcagtcatgtgaagcc

SEQ ID NO: 150490 - DNA, 25 bp, Mus musculus
tgtctatgattcagggaccctacag

SEQ ID NO: 150491 - DNA, 25 bp, Mus musculus
tgtctatgccctgccaaattcaacg

SEQ ID NO: 150492 - DNA, 25 bp, Mus musculus
tgtctatgcgctttggtgaccaagc

SEQ ID NO: 150493 - DNA, 25 bp, Mus musculus
tgtctatgttgaacctgcggaggcc

SEQ ID NO: 150494 - DNA, 25 bp, Mus musculus
tgtctatttttgtgccagcagccaa

SEQ ID NO: 150495 - DNA, 25 bp, Mus musculus
tgtctcaaagaacgtgcctgctcag

SEQ ID NO: 150496 - DNA, 25 bp, Mus musculus
tgtctcaaagcgcaagattctccag

SEQ ID NO: 150497 - DNA, 25 bp, Mus musculus
tgtctcaagactataaccaagtgga

SEQ ID NO: 150498 - DNA, 25 bp, Mus musculus
tgtctcaagcgcctggaaaccaaag

SEQ ID NO: 150499 - DNA, 25 bp, Mus musculus
tgtctcaagtagtgatgcagcatgg

SEQ ID NO: 150500 - DNA, 25 bp, Mus musculus
tgtctcaatggagcgggaagatgcc

SEQ ID NO: 150501 - DNA, 25 bp, Mus musculus
tgtctcagaagacacccgaaagggt

SEQ ID NO: 150502 - DNA, 25 bp, Mus musculus
tgtctcagagaagaacctgtcagag

SEQ ID NO: 150503 - DNA, 25 bp, Mus musculus
tgtctcagcactaagaacaactgtg

SEQ ID NO: 150504 - DNA, 25 bp, Mus musculus
tgtctcaggtcgaaagggttctccc

SEQ ID NO: 150505 - DNA, 25 bp, Mus musculus
tgtctcaggtggttacgcgtctgcc

SEQ ID NO: 150506 - DNA, 25 bp, Mus musculus
tgtctcatcaccatcatgacggtgt

SEQ ID NO: 150507 - DNA, 25 bp, Mus musculus
tgtctcatcggtcactagcggcact

SEQ ID NO: 150508 - DNA, 25 bp, Mus musculus
tgtctccagagaggaagtccagtgg

SEQ ID NO: 150509 - DNA, 25 bp, Mus musculus
tgtctccagtcgcaagggctctaac

SEQ ID NO: 150510 - DNA, 25 bp, Mus musculus
tgtctccccgcagctagggtactgg

SEQ ID NO: 150511 - DNA, 25 bp, Mus musculus
tgtctccctggtgcaattgtcgtgg

SEQ ID NO: 150512 - DNA, 25 bp, Mus musculus
tgtctccgaagtgtcaggctccagt

SEQ ID NO: 150513 - DNA, 25 bp, Mus musculus
tgtctccgccctgaaggcgaatgga

SEQ ID NO: 150514 - DNA, 25 bp, Mus musculus
tgtctccggagaggaaaacccactc

SEQ ID NO: 150515 - DNA, 25 bp, Mus musculus
tgtctccgggtaaagcccacctagt

SEQ ID NO: 150516 - DNA, 25 bp, Mus musculus
tgtctcctcgaactagcaaaagccg

SEQ ID NO: 150517 - DNA, 25 bp, Mus musculus
tgtctcctgccctagtcaagaaagc

SEQ ID NO: 150518 - DNA, 25 bp, Mus musculus
tgtctccttgtagaaactgttatct

SEQ ID NO: 150519 - DNA, 25 bp, Mus musculus
tgtctcgaaccttgaacaggatgtg

SEQ ID NO: 150520 - DNA, 25 bp, Mus musculus
tgtctcgcaagagcataaaggcgcc

SEQ ID NO: 150521 - DNA, 25 bp, Mus musculus
tgtctcgcatgcaaagccgttttgg

SEQ ID NO: 150522 - DNA, 25 bp, Mus musculus
tgtctcgccgacagatgatctacag

SEQ ID NO: 150523 - DNA, 25 bp, Mus musculus
tgtctcgccttcgatcaactgcggg

SEQ ID NO: 150524 - DNA, 25 bp, Mus musculus
tgtctcggatgcctataaatgccct

SEQ ID NO: 150525 - DNA, 25 bp, Mus musculus
tgtctcggcaagaacggcgtcttcg

SEQ ID NO: 150526 - DNA, 25 bp, Mus musculus
tgtctcggctacaaagggaccagct

SEQ ID NO: 150527 - DNA, 25 bp, Mus musculus
tgtctcgggtgatgatcggacgcca

SEQ ID NO: 150528 - DNA, 25 bp, Mus musculus
tgtctcgttcgatccagttttctgg

SEQ ID NO: 150529 - DNA, 25 bp, Mus musculus
tgtctctacggagcgctaagcgacc

SEQ ID NO: 150530 - DNA, 25 bp, Mus musculus
tgtctctagaaagcaccagtacgtt

SEQ ID NO: 150531 - DNA, 25 bp, Mus musculus
tgtctctagcggtggcgcctgattc

SEQ ID NO: 150532 - DNA, 25 bp, Mus musculus
tgtctctccggaagtgtacccagca

SEQ ID NO: 150533 - DNA, 25 bp, Mus musculus
tgtctctgaagaagtgccccatgat

SEQ ID NO: 150534 - DNA, 25 bp, Mus musculus
tgtctctgagaacatacctagttgg

SEQ ID NO: 150535 - DNA, 25 bp, Mus musculus
tgtctctgccacaataaaggtttgc

SEQ ID NO: 150536 - DNA, 25 bp, Mus musculus
tgtctctgccctacaatgaatgcgg

SEQ ID NO: 150537 - DNA, 25 bp, Mus musculus
tgtctctggcaaagacatccagccc

SEQ ID NO: 150538 - DNA, 25 bp, Mus musculus
tgtctctgtccccattgttctctga

SEQ ID NO: 150539 - DNA, 25 bp, Mus musculus
tgtctcttcagtcaaccgcaggagg

SEQ ID NO: 150540 - DNA, 25 bp, Mus musculus
tgtctgaaacggagaagctgtcccc

SEQ ID NO: 150541 - DNA, 25 bp, Mus musculus
tgtctgaagacttggagccctcggt

SEQ ID NO: 150542 - DNA, 25 bp, Mus musculus
tgtctgaagtcatgcgaatcctcca

SEQ ID NO: 150543 - DNA, 25 bp, Mus musculus
tgtctgacagagctcatcctcacca

SEQ ID NO: 150544 - DNA, 25 bp, Mus musculus
tgtctgacagcttggataacgaaga

SEQ ID NO: 150545 - DNA, 25 bp, Mus musculus
tgtctgaccatgactgcggaaaacc

SEQ ID NO: 150546 - DNA, 25 bp, Mus musculus
tgtctgacgccaagaggaagcttcg

SEQ ID NO: 150547 - DNA, 25 bp, Mus musculus
tgtctgactaccagatccttcggga

SEQ ID NO: 150548 - DNA, 25 bp, Mus musculus
tgtctgactgaaccacagccagctg

SEQ ID NO: 150549 - DNA, 25 bp, Mus musculus
tgtctgactggttcaacttccatgg

SEQ ID NO: 150550 - DNA, 25 bp, Mus musculus
tgtctgagagcacaggcagcatcct

SEQ ID NO: 150551 - DNA, 25 bp, Mus musculus
tgtctgagcggcctgaagattcccc

SEQ ID NO: 150552 - DNA, 25 bp, Mus musculus
tgtctgatcacaagcaataccaaag

SEQ ID NO: 150553 - DNA, 25 bp, Mus musculus
tgtctgatccagctgcatgggccac

SEQ ID NO: 150554 - DNA, 25 bp, Mus musculus
tgtctgatgcttgcaaaccactgaa

SEQ ID NO: 150555 - DNA, 25 bp, Mus musculus
tgtctgatggtcaggaagccagctc

SEQ ID NO: 150556 - DNA, 25 bp, Mus musculus
tgtctgcaagaaatggctcaggagc

SEQ ID NO: 150557 - DNA, 25 bp, Mus musculus
tgtctgcaattacaacgtgcttggc

SEQ ID NO: 150558 - DNA, 25 bp, Mus musculus
tgtctgcactgcacccggatacttg

SEQ ID NO: 150559 - DNA, 25 bp, Mus musculus
tgtctgcagaaacccaaatgggctt

SEQ ID NO: 150560 - DNA, 25 bp, Mus musculus
tgtctgcagcgtgtctccaaggcac

SEQ ID NO: 150561 - DNA, 25 bp, Mus musculus
tgtctgccaaactgggaccacaggc

SEQ ID NO: 150562 - DNA, 25 bp, Mus musculus
tgtctgccatggacgactatgcggt

SEQ ID NO: 150563 - DNA, 25 bp, Mus musculus
tgtctgccatgtgtaagtccctgta

SEQ ID NO: 150564 - DNA, 25 bp, Mus musculus
tgtctgccccttgcaactgaatggt

SEQ ID NO: 150565 - DNA, 25 bp, Mus musculus
tgtctgcccgagaacagcgagattg

SEQ ID NO: 150566 - DNA, 25 bp, Mus musculus
tgtctgcccgcaggctagagcatgg

SEQ ID NO: 150567 - DNA, 25 bp, Mus musculus
tgtctgccctgaagacgctgagcct

SEQ ID NO: 150568 - DNA, 25 bp, Mus musculus
tgtctgcggactggcccggtactgc

SEQ ID NO: 150569 - DNA, 25 bp, Mus musculus
tgtctgcggccgtagtgagctttgc

SEQ ID NO: 150570 - DNA, 25 bp, Mus musculus
tgtctgcggttgaagaatccacgga

SEQ ID NO: 150571 - DNA, 25 bp, Mus musculus
tgtctgctcgctcctgggatcacaa

SEQ ID NO: 150572 - DNA, 25 bp, Mus musculus
tgtctgctcttttcgatcccggacg

SEQ ID NO: 150573 - DNA, 25 bp, Mus musculus
tgtctgctgccagcgaaaagaacct

SEQ ID NO: 150574 - DNA, 25 bp, Mus musculus
tgtctgcttacatgcctggccttgg

SEQ ID NO: 150575 - DNA, 25 bp, Mus musculus
tgtctgcttgggaacgtggaaaact

SEQ ID NO: 150576 - DNA, 25 bp, Mus musculus
tgtctggaaccaaatgccccaaggt

SEQ ID NO: 150577 - DNA, 25 bp, Mus musculus
tgtctggaagactcgcctacgctgt

SEQ ID NO: 150578 - DNA, 25 bp, Mus musculus
tgtctggacaacagcgatgaggccc

SEQ ID NO: 150579 - DNA, 25 bp, Mus musculus
tgtctggagactcacgagcgcttca

SEQ ID NO: 150580 - DNA, 25 bp, Mus musculus
tgtctggcactgaaaataaggaaaa

SEQ ID NO: 150581 - DNA, 25 bp, Mus musculus
tgtctggcactggagaagcgcttcc

SEQ ID NO: 150582 - DNA, 25 bp, Mus musculus
tgtctggcctcggtttgatcccggg

SEQ ID NO: 150583 - DNA, 25 bp, Mus musculus
tgtctggcggagacagcatggcggc

SEQ ID NO: 150584 - DNA, 25 bp, Mus musculus
tgtctggctgctgcttccatccgag

SEQ ID NO: 150585 - DNA, 25 bp, Mus musculus
tgtctggctggaaacatggcgtcgc

SEQ ID NO: 150586 - DNA, 25 bp, Mus musculus
tgtctgggacaacatcacatgctgg

SEQ ID NO: 150587 - DNA, 25 bp, Mus musculus
tgtctgggctcctatgctggcatga

SEQ ID NO: 150588 - DNA, 25 bp, Mus musculus
tgtctggtaccctcaaagctgatgc

SEQ ID NO: 150589 - DNA, 25 bp, Mus musculus
tgtctggtagacacgagaagattcc

SEQ ID NO: 150590 - DNA, 25 bp, Mus musculus
tgtctggtagataggtgaaatggct

SEQ ID NO: 150591 - DNA, 25 bp, Mus musculus
tgtctggtcgcgtctcggaaacccg

SEQ ID NO: 150592 - DNA, 25 bp, Mus musculus
tgtctgtcacctaacctggccgtag

SEQ ID NO: 150593 - DNA, 25 bp, Mus musculus
tgtctgtcagccaccagtgagtcag

SEQ ID NO: 150594 - DNA, 25 bp, Mus musculus
tgtctgtcaggtagcgaaggcctcg

SEQ ID NO: 150595 - DNA, 25 bp, Mus musculus
tgtctgtccaagaacagtgtgtccc

SEQ ID NO: 150596 - DNA, 25 bp, Mus musculus
tgtctgtcccacgacctgttcttgg

SEQ ID NO: 150597 - DNA, 25 bp, Mus musculus
tgtctgtcgccgtgtgactcgctgg

SEQ ID NO: 150598 - DNA, 25 bp, Mus musculus
tgtctgtcgggcacccaggttgtag

SEQ ID NO: 150599 - DNA, 25 bp, Mus musculus
tgtctgtctcgacgacctagatgag

SEQ ID NO: 150600 - DNA, 25 bp, Mus musculus
tgtctgtgactctaccctctgcgaa

SEQ ID NO: 150601 - DNA, 25 bp, Mus musculus
tgtctgtgcgcgagttgaaccggca

SEQ ID NO: 150602 - DNA, 25 bp, Mus musculus
tgtctgtgtgaatcctgggcggctc

SEQ ID NO: 150603 - DNA, 25 bp, Mus musculus
tgtctgttagccagcacttctgctc

SEQ ID NO: 150604 - DNA, 25 bp, Mus musculus
tgtctgttgatgctgggacctccca

SEQ ID NO: 150605 - DNA, 25 bp, Mus musculus
tgtctgttggtccagtcaatctgag

SEQ ID NO: 150606 - DNA, 25 bp, Mus musculus
tgtctgtttttctgggcgcgttcgg

SEQ ID NO: 150607 - DNA, 25 bp, Mus musculus
tgtcttaaaccctagatggtccccg

SEQ ID NO: 150608 - DNA, 25 bp, Mus musculus
tgtcttaaatgacgaaaacgtgccc

SEQ ID NO: 150609 - DNA, 25 bp, Mus musculus
tgtcttaacaaaccagcagtccggc

SEQ ID NO: 150610 - DNA, 25 bp, Mus musculus
tgtcttacactgaaaccgaggccac

SEQ ID NO: 150611 - DNA, 25 bp, Mus musculus
tgtcttaccataaagaatggactga

SEQ ID NO: 150612 - DNA, 25 bp, Mus musculus
tgtcttacgatcaggcaaaacgggt

SEQ ID NO: 150613 - DNA, 25 bp, Mus musculus
tgtcttactatagcgatgactcaga

SEQ ID NO: 150614 - DNA, 25 bp, Mus musculus
tgtcttataaaagcccacggtggcg

SEQ ID NO: 150615 - DNA, 25 bp, Mus musculus
tgtcttataacatcctctcgcagga

SEQ ID NO: 150616 - DNA, 25 bp, Mus musculus
tgtcttcaagatgtgttagaaatgt

SEQ ID NO: 150617 - DNA, 25 bp, Mus musculus
tgtcttcacatacgactgcagtact

SEQ ID NO: 150618 - DNA, 25 bp, Mus musculus
tgtcttcatgatgcaggacctgggc

SEQ ID NO: 150619 - DNA, 25 bp, Mus musculus
tgtcttcccaaaggcaaaggcagca

SEQ ID NO: 150620 - DNA, 25 bp, Mus musculus
tgtcttcccagtgcaaatgagtccc

SEQ ID NO: 150621 - DNA, 25 bp, Mus musculus
tgtcttccctcacctgactgtggta

SEQ ID NO: 150622 - DNA, 25 bp, Mus musculus
tgtcttccgggaggaactgttgccc

SEQ ID NO: 150623 - DNA, 25 bp, Mus musculus
tgtcttctagtgatcggcttcggga

SEQ ID NO: 150624 - DNA, 25 bp, Mus musculus
tgtcttctttgacatggaggcctac

SEQ ID NO: 150625 - DNA, 25 bp, Mus musculus
tgtcttgaaaagtgcctgagctact

SEQ ID NO: 150626 - DNA, 25 bp, Mus musculus
tgtcttgaattaggaccccagagcc

SEQ ID NO: 150627 - DNA, 25 bp, Mus musculus
tgtcttgcacatcaggaaggctgcc

SEQ ID NO: 150628 - DNA, 25 bp, Mus musculus
tgtcttgcttcctcctcagtctcgg

SEQ ID NO: 150629 - DNA, 25 bp, Mus musculus
tgtcttggaacgttacacctctgcc

SEQ ID NO: 150630 - DNA, 25 bp, Mus musculus
tgtcttgtatgagaccccggttggc

SEQ ID NO: 150631 - DNA, 25 bp, Mus musculus
tgtctttaaggtccacaagtgtgcc

SEQ ID NO: 150632 - DNA, 25 bp, Mus musculus
tgtctttgtgggactgcgaccgaaa

SEQ ID NO: 150633 - DNA, 25 bp, Mus musculus
tgtcttttcggctggtgccacaggg

SEQ ID NO: 150634 - DNA, 25 bp, Mus musculus
tgtcttttgtacagcccaatggagc

SEQ ID NO: 150635 - DNA, 25 bp, Mus musculus
tgtgaaaaacaatcccatcgcaccg

SEQ ID NO: 150636 - DNA, 25 bp, Mus musculus
tgtgaaaaagaagcaccgcttcggg

SEQ ID NO: 150637 - DNA, 25 bp, Mus musculus
tgtgaaaaagtcaagcagcaagctt

SEQ ID NO: 150638 - DNA, 25 bp, Mus musculus
tgtgaaaacagtgaccagggtgccc

SEQ ID NO: 150639 - DNA, 25 bp, Mus musculus
tgtgaaaaccgatggagaggatcca

SEQ ID NO: 150640 - DNA, 25 bp, Mus musculus
tgtgaaacaagaagcaaagatcggg

SEQ ID NO: 150641 - DNA, 25 bp, Mus musculus
tgtgaaacatcagtgctagccatgc

SEQ ID NO: 150642 - DNA, 25 bp, Mus musculus
tgtgaaacccatcaaagccaagccc

SEQ ID NO: 150643 - DNA, 25 bp, Mus musculus
tgtgaaagaacgtatagctgagccc

SEQ ID NO: 150644 - DNA, 25 bp, Mus musculus
tgtgaaagcatcgataccccggagt

SEQ ID NO: 150645 - DNA, 25 bp, Mus musculus
tgtgaaagcatgcagagcccgtatt

SEQ ID NO: 150646 - DNA, 25 bp, Mus musculus
tgtgaaagccagtgatcagtgcctg

SEQ ID NO: 150647 - DNA, 25 bp, Mus musculus
tgtgaaagcgcacaagctggcagta

SEQ ID NO: 150648 - DNA, 25 bp, Mus musculus
tgtgaaaggcgcgtggcctcattca

SEQ ID NO: 150649 - DNA, 25 bp, Mus musculus
tgtgaaagtcaagaggactcctgga

SEQ ID NO: 150650 - DNA, 25 bp, Mus musculus
tgtgaaagtctacataatgcccaag

SEQ ID NO: 150651 - DNA, 25 bp, Mus musculus
tgtgaaatcaaggttgcccagccca

SEQ ID NO: 150652 - DNA, 25 bp, Mus musculus
tgtgaaatgtttctcccgacccgac

SEQ ID NO: 150653 - DNA, 25 bp, Mus musculus
tgtgaaattctcacccggagactcg

SEQ ID NO: 150654 - DNA, 25 bp, Mus musculus
tgtgaacaaggacattaccgagcag

SEQ ID NO: 150655 - DNA, 25 bp, Mus musculus
tgtgaacaccaatgtgaccccgaaa

SEQ ID NO: 150656 - DNA, 25 bp, Mus musculus
tgtgaacagagacctgacccgtcgt

SEQ ID NO: 150657 - DNA, 25 bp, Mus musculus
tgtgaacatccatggcgcagtcctg

SEQ ID NO: 150658 - DNA, 25 bp, Mus musculus
tgtgaacatctggatgcctggcgcc

SEQ ID NO: 150659 - DNA, 25 bp, Mus musculus
tgtgaacatgccagaacccagaatg

SEQ ID NO: 150660 - DNA, 25 bp, Mus musculus
tgtgaaccagaagagctgactgact

SEQ ID NO: 150661 - DNA, 25 bp, Mus musculus
tgtgaaccagcaagacaaagacggg

SEQ ID NO: 150662 - DNA, 25 bp, Mus musculus
tgtgaacccagtaagcacgacagag

SEQ ID NO: 150663 - DNA, 25 bp, Mus musculus
tgtgaaccccactgagatgcgcttg

SEQ ID NO: 150664 - DNA, 25 bp, Mus musculus
tgtgaaccccagagcctcgctggtc

SEQ ID NO: 150665 - DNA, 25 bp, Mus musculus
tgtgaaccctgtggaaatgacacct

SEQ ID NO: 150666 - DNA, 25 bp, Mus musculus
tgtgaaccgaagtttagccatggaa

SEQ ID NO: 150667 - DNA, 25 bp, Mus musculus
tgtgaaccggaaacaaagacaagcc

SEQ ID NO: 150668 - DNA, 25 bp, Mus musculus
tgtgaacctccttaaagccagtggc

SEQ ID NO: 150669 - DNA, 25 bp, Mus musculus
tgtgaacgcgacatcaacgagtgct

SEQ ID NO: 150670 - DNA, 25 bp, Mus musculus
tgtgaactatatggtagcacctgtg

SEQ ID NO: 150671 - DNA, 25 bp, Mus musculus
tgtgaactttgcaccacctgaacgc

SEQ ID NO: 150672 - DNA, 25 bp, Mus musculus
tgtgaagaaagtagccgaccgactc

SEQ ID NO: 150673 - DNA, 25 bp, Mus musculus
tgtgaagaaatggatcgaaaactcc

SEQ ID NO: 150674 - DNA, 25 bp, Mus musculus
tgtgaagaacgttaccaagtacggc

SEQ ID NO: 150675 - DNA, 25 bp, Mus musculus
tgtgaagaagaacccacgccattca

SEQ ID NO: 150676 - DNA, 25 bp, Mus musculus
tgtgaagaatcctctgtgcccgctg

SEQ ID NO: 150677 - DNA, 25 bp, Mus musculus
tgtgaagaccacaccattaaagcgc

SEQ ID NO: 150678 - DNA, 25 bp, Mus musculus
tgtgaagaccagcaagctttccgga

SEQ ID NO: 150679 - DNA, 25 bp, Mus musculus
tgtgaagatccacgatagtttcccg

SEQ ID NO: 150680 - DNA, 25 bp, Mus musculus
tgtgaagcattaggccgacaaccga

SEQ ID NO: 150681 - DNA, 25 bp, Mus musculus
tgtgaagcccaaacgaaaaatggcc

SEQ ID NO: 150682 - DNA, 25 bp, Mus musculus
tgtgaagcccgacgtcagcgtctac

SEQ ID NO: 150683 - DNA, 25 bp, Mus musculus
tgtgaagccgcggaaacttgatggt

SEQ ID NO: 150684 - DNA, 25 bp, Mus musculus
tgtgaagcctataagcaccaaggaa

SEQ ID NO: 150685 - DNA, 25 bp, Mus musculus
tgtgaagcctgcaaaaccaagaatg

SEQ ID NO: 150686 - DNA, 25 bp, Mus musculus
tgtgaaggaccagagaaaccaggcc

SEQ ID NO: 150687 - DNA, 25 bp, Mus musculus
tgtgaaggataacccggagaaccca

SEQ ID NO: 150688 - DNA, 25 bp, Mus musculus
tgtgaaggatggcttcccagagtct

SEQ ID NO: 150689 - DNA, 25 bp, Mus musculus
tgtgaaggcacagacttaagaccca

SEQ ID NO: 150690 - DNA, 25 bp, Mus musculus
tgtgaaggctacaggacatgatccc

SEQ ID NO: 150691 - DNA, 25 bp, Mus musculus
tgtgaagggcctgtggacgggaacc

SEQ ID NO: 150692 - DNA, 25 bp, Mus musculus
tgtgaaggtcccagaagagttactc

SEQ ID NO: 150693 - DNA, 25 bp, Mus musculus
tgtgaagtaacaagcgtgcgagccc

SEQ ID NO: 150694 - DNA, 25 bp, Mus musculus
tgtgaagtcactgggaagccaactc

SEQ ID NO: 150695 - DNA, 25 bp, Mus musculus
tgtgaagtctcaggaagccgctctt

SEQ ID NO: 150696 - DNA, 25 bp, Mus musculus
tgtgaagttccatgccaggacaggg

SEQ ID NO: 150697 - DNA, 25 bp, Mus musculus
tgtgaagttccccaagatgatctgg

SEQ ID NO: 150698 - DNA, 25 bp, Mus musculus
tgtgaataagattgaggaatttctc

SEQ ID NO: 150699 - DNA, 25 bp, Mus musculus
tgtgaataccagcaatgaaagcctc

SEQ ID NO: 150700 - DNA, 25 bp, Mus musculus
tgtgaatagtccctacagcagcagg

SEQ ID NO: 150701 - DNA, 25 bp, Mus musculus
tgtgaatagttctgacggcaaagcg

SEQ ID NO: 150702 - DNA, 25 bp, Mus musculus
tgtgaatcaccagaatagagctggc

SEQ ID NO: 150703 - DNA, 25 bp, Mus musculus
tgtgaatcctcagtgggccttggca

SEQ ID NO: 150704 - DNA, 25 bp, Mus musculus
tgtgaatcctgacatcccagaggcc

SEQ ID NO: 150705 - DNA, 25 bp, Mus musculus
tgtgaatccttctgactctgtggct

SEQ ID NO: 150706 - DNA, 25 bp, Mus musculus
tgtgaatcgagcacttggccgctgg

SEQ ID NO: 150707 - DNA, 25 bp, Mus musculus
tgtgaatgaacaaggcatctgtccg

SEQ ID NO: 150708 - DNA, 25 bp, Mus musculus
tgtgaatgaagctctgccggctacg

SEQ ID NO: 150709 - DNA, 25 bp, Mus musculus
tgtgaatgacaagtcctggtcccct

SEQ ID NO: 150710 - DNA, 25 bp, Mus musculus
tgtgaatgagtgtctaggcaggacc

SEQ ID NO: 150711 - DNA, 25 bp, Mus musculus
tgtgaatgctccttacaccagagac

SEQ ID NO: 150712 - DNA, 25 bp, Mus musculus
tgtgaatggaccttgtgaatgtgag

SEQ ID NO: 150713 - DNA, 25 bp, Mus musculus
tgtgaatggtctgagcagctcccca

SEQ ID NO: 150714 - DNA, 25 bp, Mus musculus
tgtgaattccaaggccttccagtat

SEQ ID NO: 150715 - DNA, 25 bp, Mus musculus
tgtgaattctctccggaaggcggcc

SEQ ID NO: 150716 - DNA, 25 bp, Mus musculus
tgtgaattctgatgctagtgaccca

SEQ ID NO: 150717 - DNA, 25 bp, Mus musculus
tgtgacaaacggagggaagacgaca

SEQ ID NO: 150718 - DNA, 25 bp, Mus musculus
tgtgacaacatagggtttggccagg

SEQ ID NO: 150719 - DNA, 25 bp, Mus musculus
tgtgacaacatctcaacatgctgag

SEQ ID NO: 150720 - DNA, 25 bp, Mus musculus
tgtgacaagcgagaaccagatggca

SEQ ID NO: 150721 - DNA, 25 bp, Mus musculus
tgtgacaagctttatacctgccggc

SEQ ID NO: 150722 - DNA, 25 bp, Mus musculus
tgtgacaccaaagccagacagcgtg

SEQ ID NO: 150723 - DNA, 25 bp, Mus musculus
tgtgacaccagcatccgaagagaga

SEQ ID NO: 150724 - DNA, 25 bp, Mus musculus
tgtgacacgacccttgagtgacagt

SEQ ID NO: 150725 - DNA, 25 bp, Mus musculus
tgtgacacgcctgcctaactagaga

SEQ ID NO: 150726 - DNA, 25 bp, Mus musculus
tgtgacactcaagaagctaccagag

SEQ ID NO: 150727 - DNA, 25 bp, Mus musculus
tgtgacactgtcctctgggcgaaga

SEQ ID NO: 150728 - DNA, 25 bp, Mus musculus
tgtgacacttttcatcctgtgtggg

SEQ ID NO: 150729 - DNA, 25 bp, Mus musculus
tgtgacagaccttacgccaatggag

SEQ ID NO: 150730 - DNA, 25 bp, Mus musculus
tgtgacagcagtcgctcagaagaca

SEQ ID NO: 150731 - DNA, 25 bp, Mus musculus
tgtgacagcctcaacaacagatgcg

SEQ ID NO: 150732 - DNA, 25 bp, Mus musculus
tgtgacagctgcaacatggcggacg

SEQ ID NO: 150733 - DNA, 25 bp, Mus musculus
tgtgacatccacacttgcaacatga

SEQ ID NO: 150734 - DNA, 25 bp, Mus musculus
tgtgacatccgggtagtgcctgctc

SEQ ID NO: 150735 - DNA, 25 bp, Mus musculus
tgtgacattaccacttccctcggtg

SEQ ID NO: 150736 - DNA, 25 bp, Mus musculus
tgtgacattcgcatcatgggccgga

SEQ ID NO: 150737 - DNA, 25 bp, Mus musculus
tgtgaccaaaagcttccaacaagtg

SEQ ID NO: 150738 - DNA, 25 bp, Mus musculus
tgtgaccaaggtctcccgtgagtgt

SEQ ID NO: 150739 - DNA, 25 bp, Mus musculus
tgtgaccaatacaaccaaagagagc

SEQ ID NO: 150740 - DNA, 25 bp, Mus musculus
tgtgaccaattccaaggtgaaattt

SEQ ID NO: 150741 - DNA, 25 bp, Mus musculus
tgtgaccacaaggacagtacgccag

SEQ ID NO: 150742 - DNA, 25 bp, Mus musculus
tgtgaccacacaatgagaagttcct

SEQ ID NO: 150743 - DNA, 25 bp, Mus musculus
tgtgaccacatatgaaacctgccag

SEQ ID NO: 150744 - DNA, 25 bp, Mus musculus
tgtgaccaccgcaggagagtttctc

SEQ ID NO: 150745 - DNA, 25 bp, Mus musculus
tgtgaccactacctggccaaatgat

SEQ ID NO: 150746 - DNA, 25 bp, Mus musculus
tgtgaccagtcctagctcagcagag

SEQ ID NO: 150747 - DNA, 25 bp, Mus musculus
tgtgaccatcactggctcaccggtc

SEQ ID NO: 150748 - DNA, 25 bp, Mus musculus
tgtgacccaatccagcaggaggctg

SEQ ID NO: 150749 - DNA, 25 bp, Mus musculus
tgtgacccagccaagaaagatgagc

SEQ ID NO: 150750 - DNA, 25 bp, Mus musculus
tgtgacccatgcttattaccgagat

SEQ ID NO: 150751 - DNA, 25 bp, Mus musculus
tgtgacccatgctttgagactcccg

SEQ ID NO: 150752 - DNA, 25 bp, Mus musculus
tgtgaccccagggatccaggtgaca

SEQ ID NO: 150753 - DNA, 25 bp, Mus musculus
tgtgaccccgaccattctgcagagg

SEQ ID NO: 150754 - DNA, 25 bp, Mus musculus
tgtgacccgatgttaccagccaagt

SEQ ID NO: 150755 - DNA, 25 bp, Mus musculus
tgtgacccggtactataatgccaat

SEQ ID NO: 150756 - DNA, 25 bp, Mus musculus
tgtgacccgtctacccatcaaatgg

SEQ ID NO: 150757 - DNA, 25 bp, Mus musculus
tgtgaccctaaacagagcagcagtg

SEQ ID NO: 150758 - DNA, 25 bp, Mus musculus
tgtgaccctcagtgtggccaggtgt

SEQ ID NO: 150759 - DNA, 25 bp, Mus musculus
tgtgacccttgaggactggaaagac

SEQ ID NO: 150760 - DNA, 25 bp, Mus musculus
tgtgaccgcctctctgtagctaagc

SEQ ID NO: 150761 - DNA, 25 bp, Mus musculus
tgtgaccggctggtacaggacactc

SEQ ID NO: 150762 - DNA, 25 bp, Mus musculus
tgtgaccggtcattcagcatctcct

SEQ ID NO: 150763 - DNA, 25 bp, Mus musculus
tgtgaccgtgggaggttattaccca

SEQ ID NO: 150764 - DNA, 25 bp, Mus musculus
tgtgacctactcaagacaagtttgg

SEQ ID NO: 150765 - DNA, 25 bp, Mus musculus
tgtgacctcactagagacgacctgc

SEQ ID NO: 150766 - DNA, 25 bp, Mus musculus
tgtgacctccggcaagatcatcgag

SEQ ID NO: 150767 - DNA, 25 bp, Mus musculus
tgtgacctcggagaaccagcttgtg

SEQ ID NO: 150768 - DNA, 25 bp, Mus musculus
tgtgacctgggctgtcagatcacca

SEQ ID NO: 150769 - DNA, 25 bp, Mus musculus
tgtgacctgtaaaatccgaatcctg

SEQ ID NO: 150770 - DNA, 25 bp, Mus musculus
tgtgaccttgagcaagtctcgcccg

SEQ ID NO: 150771 - DNA, 25 bp, Mus musculus
tgtgacgagctgatacctgagtacc

SEQ ID NO: 150772 - DNA, 25 bp, Mus musculus
tgtgacggacgtgcaccagctgtcc

SEQ ID NO: 150773 - DNA, 25 bp, Mus musculus
tgtgacgtgccagctgagacgctct

SEQ ID NO: 150774 - DNA, 25 bp, Mus musculus
tgtgacgtttctgagccgaggcctg

SEQ ID NO: 150775 - DNA, 25 bp, Mus musculus
tgtgactacaagcaccactggcaag

SEQ ID NO: 150776 - DNA, 25 bp, Mus musculus
tgtgactacagaccatggacacctt

SEQ ID NO: 150777 - DNA, 25 bp, Mus musculus
tgtgactacgacaacgactgcggag

SEQ ID NO: 150778 - DNA, 25 bp, Mus musculus
tgtgactactgcagagaagcggcct

SEQ ID NO: 150779 - DNA, 25 bp, Mus musculus
tgtgactatgaaaaccgaagggcta

SEQ ID NO: 150780 - DNA, 25 bp, Mus musculus
tgtgactccaacaagatggcgactg

SEQ ID NO: 150781 - DNA, 25 bp, Mus musculus
tgtgactccgtggaacagctagagc

SEQ ID NO: 150782 - DNA, 25 bp, Mus musculus
tgtgactcgggtggcgccagccttc

SEQ ID NO: 150783 - DNA, 25 bp, Mus musculus
tgtgactgaacgaccttgcccatgg

SEQ ID NO: 150784 - DNA, 25 bp, Mus musculus
tgtgactgagtaccgccttgatggc

SEQ ID NO: 150785 - DNA, 25 bp, Mus musculus
tgtgactgctatcatcccaacatgg

SEQ ID NO: 150786 - DNA, 25 bp, Mus musculus
tgtgactgtacctggaaggaggccc

SEQ ID NO: 150787 - DNA, 25 bp, Mus musculus
tgtgactgtcagtgaaatcaaaacc

SEQ ID NO: 150788 - DNA, 25 bp, Mus musculus
tgtgactgtggacaatcgcctggac

SEQ ID NO: 150789 - DNA, 25 bp, Mus musculus
tgtgactgttcactcctgggagaga

SEQ ID NO: 150790 - DNA, 25 bp, Mus musculus
tgtgacttagccctggactctgttt

SEQ ID NO: 150791 - DNA, 25 bp, Mus musculus
tgtgacttcactatcgaccaccagt

SEQ ID NO: 150792 - DNA, 25 bp, Mus musculus
tgtgacttctcctacggaaggcccg

SEQ ID NO: 150793 - DNA, 25 bp, Mus musculus
tgtgacttggtaaacactgggaccc

SEQ ID NO: 150794 - DNA, 25 bp, Mus musculus
tgtgagaacaaaagtgccccagtgt

SEQ ID NO: 150795 - DNA, 25 bp, Mus musculus
tgtgagaacacacgtggcggctacc

SEQ ID NO: 150796 - DNA, 25 bp, Mus musculus
tgtgagaacgatgacttagcaacca

SEQ ID NO: 150797 - DNA, 25 bp, Mus musculus
tgtgagaacggtcccagaagagact

SEQ ID NO: 150798 - DNA, 25 bp, Mus musculus
tgtgagaacttgacccctttgctgg

SEQ ID NO: 150799 - DNA, 25 bp, Mus musculus
tgtgagaagaatatgtgaccctaac

SEQ ID NO: 150800 - DNA, 25 bp, Mus musculus
tgtgagaatgcacgccatggtcgcc

SEQ ID NO: 150801 - DNA, 25 bp, Mus musculus
tgtgagaatggaccaaccacctgtg

SEQ ID NO: 150802 - DNA, 25 bp, Mus musculus
tgtgagaattcaactagcgcgggcc

SEQ ID NO: 150803 - DNA, 25 bp, Mus musculus
tgtgagacaacggtggagctcctct

SEQ ID NO: 150804 - DNA, 25 bp, Mus musculus
tgtgagaccagagaactagcgctgc

SEQ ID NO: 150805 - DNA, 25 bp, Mus musculus
tgtgagacctgtgatagcaagttcc

SEQ ID NO: 150806 - DNA, 25 bp, Mus musculus
tgtgagactgagcaattgtttctgg

SEQ ID NO: 150807 - DNA, 25 bp, Mus musculus
tgtgagagaacatataccgaggaga

SEQ ID NO: 150808 - DNA, 25 bp, Mus musculus
tgtgagagaagctgccgcaaccaca

SEQ ID NO: 150809 - DNA, 25 bp, Mus musculus
tgtgagagtggaaacacaagctcct

SEQ ID NO: 150810 - DNA, 25 bp, Mus musculus
tgtgagatagtgagatttatgttaa

SEQ ID NO: 150811 - DNA, 25 bp, Mus musculus
tgtgagatcaaaagccagtccgttt

SEQ ID NO: 150812 - DNA, 25 bp, Mus musculus
tgtgagatcaagtgcagggacaact

SEQ ID NO: 150813 - DNA, 25 bp, Mus musculus
tgtgagatggcacagaccgtctgca

SEQ ID NO: 150814 - DNA, 25 bp, Mus musculus
tgtgagatttgatgctaagctggcc

SEQ ID NO: 150815 - DNA, 25 bp, Mus musculus
tgtgagcaccaatgcaaagaactgc

SEQ ID NO: 150816 - DNA, 25 bp, Mus musculus
tgtgagcaccggaagatttataccc

SEQ ID NO: 150817 - DNA, 25 bp, Mus musculus
tgtgagcacctcaccagcaacgtgc

SEQ ID NO: 150818 - DNA, 25 bp, Mus musculus
tgtgagcaccttaacctcctggaga

SEQ ID NO: 150819 - DNA, 25 bp, Mus musculus
tgtgagcagctcaaaacatctggat

SEQ ID NO: 150820 - DNA, 25 bp, Mus musculus
tgtgagcatcggctacctcctggtg

SEQ ID NO: 150821 - DNA, 25 bp, Mus musculus
tgtgagcattgtctggttacaggcc

SEQ ID NO: 150822 - DNA, 25 bp, Mus musculus
tgtgagccaccctgatgcagagctg

SEQ ID NO: 150823 - DNA, 25 bp, Mus musculus
tgtgagccacggtacaggtctgtct

SEQ ID NO: 150824 - DNA, 25 bp, Mus musculus
tgtgagccgaaatgaggacctgttg

SEQ ID NO: 150825 - DNA, 25 bp, Mus musculus
tgtgagcctgagtcgcagcagcttg

SEQ ID NO: 150826 - DNA, 25 bp, Mus musculus
tgtgagccttaagcaacccctgtgt

SEQ ID NO: 150827 - DNA, 25 bp, Mus musculus
tgtgagccttgaacgcctggatctg

SEQ ID NO: 150828 - DNA, 25 bp, Mus musculus
tgtgagccttgccaaagatgagcct

SEQ ID NO: 150829 - DNA, 25 bp, Mus musculus
tgtgagcgagccacctcgaaggcct

SEQ ID NO: 150830 - DNA, 25 bp, Mus musculus
tgtgagcgctcagaaacatacgtga

SEQ ID NO: 150831 - DNA, 25 bp, Mus musculus
tgtgagcggccgcctttcccgggga

SEQ ID NO: 150832 - DNA, 25 bp, Mus musculus
tgtgagctccttgctgacagaggcg

SEQ ID NO: 150833 - DNA, 25 bp, Mus musculus
tgtgagctcggaacttcagatccag

SEQ ID NO: 150834 - DNA, 25 bp, Mus musculus
tgtgagctgaacctctccgtgactg

SEQ ID NO: 150835 - DNA, 25 bp, Mus musculus
tgtgagctgccattagacgctgggc

SEQ ID NO: 150836 - DNA, 25 bp, Mus musculus
tgtgagctgctcaagaacctggtgc

SEQ ID NO: 150837 - DNA, 25 bp, Mus musculus
tgtgagcttcaaagtcagcgcccgg

SEQ ID NO: 150838 - DNA, 25 bp, Mus musculus
tgtgagcttgtaccccttccagata

SEQ ID NO: 150839 - DNA, 25 bp, Mus musculus
tgtgaggacctatgagcgcaagctg

SEQ ID NO: 150840 - DNA, 25 bp, Mus musculus
tgtgaggcacaagcaaacgacgctg

SEQ ID NO: 150841 - DNA, 25 bp, Mus musculus
tgtgaggccaaaatcgaatgctcgg

SEQ ID NO: 150842 - DNA, 25 bp, Mus musculus
tgtgaggcccacactagagatgctg

SEQ ID NO: 150843 - DNA, 25 bp, Mus musculus
tgtgaggccgacataactcccgaag

SEQ ID NO: 150844 - DNA, 25 bp, Mus musculus
tgtgagggaagctctagcaagttgc

SEQ ID NO: 150845 - DNA, 25 bp, Mus musculus
tgtgaggtaccccatgtgcattaga

SEQ ID NO: 150846 - DNA, 25 bp, Mus musculus
tgtgagtatccctgccactaagagc

SEQ ID NO: 150847 - DNA, 25 bp, Mus musculus
tgtgagtcagtcagcgacaaggctc

SEQ ID NO: 150848 - DNA, 25 bp, Mus musculus
tgtgagtcctgccaagagtacttcg

SEQ ID NO: 150849 - DNA, 25 bp, Mus musculus
tgtgagtgagacagccaatgagccg

SEQ ID NO: 150850 - DNA, 25 bp, Mus musculus
tgtgagtgccaaatacagaggagcc

SEQ ID NO: 150851 - DNA, 25 bp, Mus musculus
tgtgagttccttccccgggcttctg

SEQ ID NO: 150852 - DNA, 25 bp, Mus musculus
tgtgataatttcagagggccagcct

SEQ ID NO: 150853 - DNA, 25 bp, Mus musculus
tgtgatacaaacctataacccaaag

SEQ ID NO: 150854 - DNA, 25 bp, Mus musculus
tgtgatacaaagatgcacgtgctgc

SEQ ID NO: 150855 - DNA, 25 bp, Mus musculus
tgtgatacaatcctgaccaatcgct

SEQ ID NO: 150856 - DNA, 25 bp, Mus musculus
tgtgatacctttccaagcccctgga

SEQ ID NO: 150857 - DNA, 25 bp, Mus musculus
tgtgatagaacagggcacagctgca

SEQ ID NO: 150858 - DNA, 25 bp, Mus musculus
tgtgatagagcccacccgaattgga

SEQ ID NO: 150859 - DNA, 25 bp, Mus musculus
tgtgatagagctacagcagtatgcc

SEQ ID NO: 150860 - DNA, 25 bp, Mus musculus
tgtgatagccagcatgataggagcc

SEQ ID NO: 150861 - DNA, 25 bp, Mus musculus
tgtgatatctcacccaactctggtt

SEQ ID NO: 150862 - DNA, 25 bp, Mus musculus
tgtgatattaggtccgcctgcctca

SEQ ID NO: 150863 - DNA, 25 bp, Mus musculus
tgtgatcaatgctaccgccaaggca

SEQ ID NO: 150864 - DNA, 25 bp, Mus musculus
tgtgatcagcattgagcgggcctac

SEQ ID NO: 150865 - DNA, 25 bp, Mus musculus
tgtgatcccggcttcaggctcgttg

SEQ ID NO: 150866 - DNA, 25 bp, Mus musculus
tgtgatccctattaaaggcctgctg

SEQ ID NO: 150867 - DNA, 25 bp, Mus musculus
tgtgatccgagctctggacctggtg

SEQ ID NO: 150868 - DNA, 25 bp, Mus musculus
tgtgatccgagtgaggacgcaacgc

SEQ ID NO: 150869 - DNA, 25 bp, Mus musculus
tgtgatcctcctaataacaagctgg

SEQ ID NO: 150870 - DNA, 25 bp, Mus musculus
tgtgatcctgacagtaagccacctg

SEQ ID NO: 150871 - DNA, 25 bp, Mus musculus
tgtgatcctgtgcttgataaagaca

SEQ ID NO: 150872 - DNA, 25 bp, Mus musculus
tgtgatcgaaagagtcaacgtgcag

SEQ ID NO: 150873 - DNA, 25 bp, Mus musculus
tgtgatcgacaaggccagcgagact

SEQ ID NO: 150874 - DNA, 25 bp, Mus musculus
tgtgatcgcgtctcgccagttggcg

SEQ ID NO: 150875 - DNA, 25 bp, Mus musculus
tgtgatctcccagtagtcgctcggc

SEQ ID NO: 150876 - DNA, 25 bp, Mus musculus
tgtgatctggatgcccgcaaaactg

SEQ ID NO: 150877 - DNA, 25 bp, Mus musculus
tgtgatctgtaaccgcaagctggat

SEQ ID NO: 150878 - DNA, 25 bp, Mus musculus
tgtgatgaacgatgcctggagactc

SEQ ID NO: 150879 - DNA, 25 bp, Mus musculus
tgtgatgaagttaacctggaaggca

SEQ ID NO: 150880 - DNA, 25 bp, Mus musculus
tgtgatgaatgcaggctgtgctacc

SEQ ID NO: 150881 - DNA, 25 bp, Mus musculus
tgtgatgagcgcaccgtcagacttt

SEQ ID NO: 150882 - DNA, 25 bp, Mus musculus
tgtgatgatagcgactcagggccac

SEQ ID NO: 150883 - DNA, 25 bp, Mus musculus
tgtgatgatatcagccgacgcttgg

SEQ ID NO: 150884 - DNA, 25 bp, Mus musculus
tgtgatgatgcaagcgctgaagccc

SEQ ID NO: 150885 - DNA, 25 bp, Mus musculus
tgtgatgcacttctgccagcaaggc

SEQ ID NO: 150886 - DNA, 25 bp, Mus musculus
tgtgatgcagctcatagaaacctcc

SEQ ID NO: 150887 - DNA, 25 bp, Mus musculus
tgtgatgcagggtattacgggcccc

SEQ ID NO: 150888 - DNA, 25 bp, Mus musculus
tgtgatgcagtttgtccgggaagcc

SEQ ID NO: 150889 - DNA, 25 bp, Mus musculus
tgtgatgcattccaacaaagcccgg

SEQ ID NO: 150890 - DNA, 25 bp, Mus musculus
tgtgatgccaatctcctggagactg

SEQ ID NO: 150891 - DNA, 25 bp, Mus musculus
tgtgatgccatgaagcccattgacg

SEQ ID NO: 150892 - DNA, 25 bp, Mus musculus
tgtgatgcctgcagtcaaaaagccc

SEQ ID NO: 150893 - DNA, 25 bp, Mus musculus
tgtgatgctgctggaacagtaccac

SEQ ID NO: 150894 - DNA, 25 bp, Mus musculus
tgtgatgcttctggacacctgggac

SEQ ID NO: 150895 - DNA, 25 bp, Mus musculus
tgtgatggatctgacaccaaagctg

SEQ ID NO: 150896 - DNA, 25 bp, Mus musculus
tgtgatggcacacctaggaagactg

SEQ ID NO: 150897 - DNA, 25 bp, Mus musculus
tgtgatgtacagctcgggactagtc

SEQ ID NO: 150898 - DNA, 25 bp, Mus musculus
tgtgatgtacctggaggagcacgcc

SEQ ID NO: 150899 - DNA, 25 bp, Mus musculus
tgtgatgtacgaagcaacccagagc

SEQ ID NO: 150900 - DNA, 25 bp, Mus musculus
tgtgatgtcaccgaagcagaggtca

SEQ ID NO: 150901 - DNA, 25 bp, Mus musculus
tgtgatgtgagcaccagccgagagt

SEQ ID NO: 150902 - DNA, 25 bp, Mus musculus
tgtgatgtgtgccagaaaaccttct

SEQ ID NO: 150903 - DNA, 25 bp, Mus musculus
tgtgattacttcttcgaggcccaag

SEQ ID NO: 150904 - DNA, 25 bp, Mus musculus
tgtgattagccttcctcctggagaa

SEQ ID NO: 150905 - DNA, 25 bp, Mus musculus
tgtgattcatcaccgggattggcag

SEQ ID NO: 150906 - DNA, 25 bp, Mus musculus
tgtgattgacattgaccgtggagaa

SEQ ID NO: 150907 - DNA, 25 bp, Mus musculus
tgtgattgggaagcagccgacactc

SEQ ID NO: 150908 - DNA, 25 bp, Mus musculus
tgtgattgtgctctctgacagtgag

SEQ ID NO: 150909 - DNA, 25 bp, Mus musculus
tgtgattttgctctgactgccaaga

SEQ ID NO: 150910 - DNA, 25 bp, Mus musculus
tgtgcaaacccctggttccgaggga

SEQ ID NO: 150911 - DNA, 25 bp, Mus musculus
tgtgcaaacgcaaagactgaagatt

SEQ ID NO: 150912 - DNA, 25 bp, Mus musculus
tgtgcaaactcaagccactgctgga

SEQ ID NO: 150913 - DNA, 25 bp, Mus musculus
tgtgcaacaagtgcgctactcggga

SEQ ID NO: 150914 - DNA, 25 bp, Mus musculus
tgtgcaacaattcttcctggagccc

SEQ ID NO: 150915 - DNA, 25 bp, Mus musculus
tgtgcaacagaagcaagacaagccc

SEQ ID NO: 150916 - DNA, 25 bp, Mus musculus
tgtgcaacagagagaccatctgtga

SEQ ID NO: 150917 - DNA, 25 bp, Mus musculus
tgtgcaacccctagatggacagctt

SEQ ID NO: 150918 - DNA, 25 bp, Mus musculus
tgtgcaacgtgatggaagccagcca

SEQ ID NO: 150919 - DNA, 25 bp, Mus musculus
tgtgcaactcaactatgaactccag

SEQ ID NO: 150920 - DNA, 25 bp, Mus musculus
tgtgcaacttcttcgctaaagggct

SEQ ID NO: 150921 - DNA, 25 bp, Mus musculus
tgtgcaagaactcccaagatgtcat

SEQ ID NO: 150922 - DNA, 25 bp, Mus musculus
tgtgcaagactcaacacatgtgagc

SEQ ID NO: 150923 - DNA, 25 bp, Mus musculus
tgtgcaagagccacgaagggtcatc

SEQ ID NO: 150924 - DNA, 25 bp, Mus musculus
tgtgcaagaggaagggctacagcta

SEQ ID NO: 150925 - DNA, 25 bp, Mus musculus
tgtgcaagcaaaccttccagagagc

SEQ ID NO: 150926 - DNA, 25 bp, Mus musculus
tgtgcaagcgcagaaagaaccgagc

SEQ ID NO: 150927 - DNA, 25 bp, Mus musculus
tgtgcaagcttttcagcaggctacc

SEQ ID NO: 150928 - DNA, 25 bp, Mus musculus
tgtgcaaggagtacgctggtcccaa

SEQ ID NO: 150929 - DNA, 25 bp, Mus musculus
tgtgcaaggcggactacgaaacagc

SEQ ID NO: 150930 - DNA, 25 bp, Mus musculus
tgtgcaagtatgttgctgtggagct

SEQ ID NO: 150931 - DNA, 25 bp, Mus musculus
tgtgcaagtcgttcctgggcgagca

SEQ ID NO: 150932 - DNA, 25 bp, Mus musculus
tgtgcaatacggaactcacgcgatg

SEQ ID NO: 150933 - DNA, 25 bp, Mus musculus
tgtgcaatactttagacgccctcgc

SEQ ID NO: 150934 - DNA, 25 bp, Mus musculus
tgtgcaatgccttcagtgacacgtc

SEQ ID NO: 150935 - DNA, 25 bp, Mus musculus
tgtgcacaaacgcagtcccaaggtt

SEQ ID NO: 150936 - DNA, 25 bp, Mus musculus
tgtgcacaacacagccatgcgagat

SEQ ID NO: 150937 - DNA, 25 bp, Mus musculus
tgtgcacagaattcagaagcccagc

SEQ ID NO: 150938 - DNA, 25 bp, Mus musculus
tgtgcacagcactgacaagggtccg

SEQ ID NO: 150939 - DNA, 25 bp, Mus musculus
tgtgcacaggaaggcagagtctccg

SEQ ID NO: 150940 - DNA, 25 bp, Mus musculus
tgtgcacatcatagaggcgtctttc

SEQ ID NO: 150941 - DNA, 25 bp, Mus musculus
tgtgcaccactgcttcgctgagaca

SEQ ID NO: 150942 - DNA, 25 bp, Mus musculus
tgtgcacccatgaaaagggctttgg

SEQ ID NO: 150943 - DNA, 25 bp, Mus musculus
tgtgcacccccatgtgcagatgcga

SEQ ID NO: 150944 - DNA, 25 bp, Mus musculus
tgtgcaccccgatgtcaccatgaag

SEQ ID NO: 150945 - DNA, 25 bp, Mus musculus
tgtgcaccccgcttctctagatgga

SEQ ID NO: 150946 - DNA, 25 bp, Mus musculus
tgtgcacccctaagcttgaaattga

SEQ ID NO: 150947 - DNA, 25 bp, Mus musculus
tgtgcaccctgctgaattctggagg

SEQ ID NO: 150948 - DNA, 25 bp, Mus musculus
tgtgcaccgctgctgtcttactggc

SEQ ID NO: 150949 - DNA, 25 bp, Mus musculus
tgtgcaccggcagatactgacactg

SEQ ID NO: 150950 - DNA, 25 bp, Mus musculus
tgtgcacctggatacagcggagacc

SEQ ID NO: 150951 - DNA, 25 bp, Mus musculus
tgtgcacgatgctcaaaatggcctt

SEQ ID NO: 150952 - DNA, 25 bp, Mus musculus
tgtgcacgctggtcatctggcccat

SEQ ID NO: 150953 - DNA, 25 bp, Mus musculus
tgtgcacgctggtggctgccttctt

SEQ ID NO: 150954 - DNA, 25 bp, Mus musculus
tgtgcactcaatcagtgggccctgg

SEQ ID NO: 150955 - DNA, 25 bp, Mus musculus
tgtgcactgccacggaaataagctt

SEQ ID NO: 150956 - DNA, 25 bp, Mus musculus
tgtgcactgctacaacttgatgctg

SEQ ID NO: 150957 - DNA, 25 bp, Mus musculus
tgtgcactttgattctgtctctgcc

SEQ ID NO: 150958 - DNA, 25 bp, Mus musculus
tgtgcagaaagtgatagagggatcc

SEQ ID NO: 150959 - DNA, 25 bp, Mus musculus
tgtgcagaacgtgcatacgcctcgt

SEQ ID NO: 150960 - DNA, 25 bp, Mus musculus
tgtgcagaagtcaggaacaagggcc

SEQ ID NO: 150961 - DNA, 25 bp, Mus musculus
tgtgcagaatgggacaaaccgtcgt

SEQ ID NO: 150962 - DNA, 25 bp, Mus musculus
tgtgcagaccctgatttgaatgctg

SEQ ID NO: 150963 - DNA, 25 bp, Mus musculus
tgtgcagactagactgctgccctca

SEQ ID NO: 150964 - DNA, 25 bp, Mus musculus
tgtgcagagcagatagtaaggttcc

SEQ ID NO: 150965 - DNA, 25 bp, Mus musculus
tgtgcagagcatctgccctagccgg

SEQ ID NO: 150966 - DNA, 25 bp, Mus musculus
tgtgcagagcttatgatccagaact

SEQ ID NO: 150967 - DNA, 25 bp, Mus musculus
tgtgcagagtgtagtgcctcacccg

SEQ ID NO: 150968 - DNA, 25 bp, Mus musculus
tgtgcagatcatcgacgacgagcct

SEQ ID NO: 150969 - DNA, 25 bp, Mus musculus
tgtgcagattctagaagaccccgcc

SEQ ID NO: 150970 - DNA, 25 bp, Mus musculus
tgtgcagcaaaaacagctctacagg

SEQ ID NO: 150971 - DNA, 25 bp, Mus musculus
tgtgcagcacctagaactggaactg

SEQ ID NO: 150972 - DNA, 25 bp, Mus musculus
tgtgcagcagaaccatgtaacagtc

SEQ ID NO: 150973 - DNA, 25 bp, Mus musculus
tgtgcagcagctcccgttgcggagg

SEQ ID NO: 150974 - DNA, 25 bp, Mus musculus
tgtgcagcccaggaaggaagattcc

SEQ ID NO: 150975 - DNA, 25 bp, Mus musculus
tgtgcagccccttaggaatagcagg

SEQ ID NO: 150976 - DNA, 25 bp, Mus musculus
tgtgcagctatttgaccagtcggcc

SEQ ID NO: 150977 - DNA, 25 bp, Mus musculus
tgtgcagctgcctttcatggaagac

SEQ ID NO: 150978 - DNA, 25 bp, Mus musculus
tgtgcaggacactaagaagcggagc

SEQ ID NO: 150979 - DNA, 25 bp, Mus musculus
tgtgcaggacatccaagtacacctg

SEQ ID NO: 150980 - DNA, 25 bp, Mus musculus
tgtgcaggcacctctatgtcaggaa

SEQ ID NO: 150981 - DNA, 25 bp, Mus musculus
tgtgcaggtccaacaaaagcccctg

SEQ ID NO: 150982 - DNA, 25 bp, Mus musculus
tgtgcagtactaagacaggacctgg

SEQ ID NO: 150983 - DNA, 25 bp, Mus musculus
tgtgcagtcacctcgtacatatgtg

SEQ ID NO: 150984 - DNA, 25 bp, Mus musculus
tgtgcagtcgcccagatgctacgct

SEQ ID NO: 150985 - DNA, 25 bp, Mus musculus
tgtgcagtgcccgtcattcaaaagc

SEQ ID NO: 150986 - DNA, 25 bp, Mus musculus
tgtgcagttacaccaacgaccgtca

SEQ ID NO: 150987 - DNA, 25 bp, Mus musculus
tgtgcataccaccatgcacctgtga

SEQ ID NO: 150988 - DNA, 25 bp, Mus musculus
tgtgcataccttggagactacggtc

SEQ ID NO: 150989 - DNA, 25 bp, Mus musculus
tgtgcatcactaggccaccaggata

SEQ ID NO: 150990 - DNA, 25 bp, Mus musculus
tgtgcatcttgctgctagccatgcg

SEQ ID NO: 150991 - DNA, 25 bp, Mus musculus
tgtgcatgagtcagggcaaaaccat

SEQ ID NO: 150992 - DNA, 25 bp, Mus musculus
tgtgcatgcacacgcctatagcagg

SEQ ID NO: 150993 - DNA, 25 bp, Mus musculus
tgtgcatgggcagaaacgactccag

SEQ ID NO: 150994 - DNA, 25 bp, Mus musculus
tgtgcatgttctgtgtgacccaagc

SEQ ID NO: 150995 - DNA, 25 bp, Mus musculus
tgtgcattgcaagtgtctccctccg

SEQ ID NO: 150996 - DNA, 25 bp, Mus musculus
tgtgcatttacaccgacaactctgt

SEQ ID NO: 150997 - DNA, 25 bp, Mus musculus
tgtgccaaagatgcaggtgtgccct

SEQ ID NO: 150998 - DNA, 25 bp, Mus musculus
tgtgccaaagccacgaagtgatcgg

SEQ ID NO: 150999 - DNA, 25 bp, Mus musculus
tgtgccaaagtcttccatgctgcgg

SEQ ID NO: 151000 - DNA, 25 bp, Mus musculus
tgtgccaagcgttgcacgacctcgt

SEQ ID NO: 151001 - DNA, 25 bp, Mus musculus
tgtgccaagcttgccaacgtgaggg

SEQ ID NO: 151002 - DNA, 25 bp, Mus musculus
tgtgccaatgggttgcggcctcttg

SEQ ID NO: 151003 - DNA, 25 bp, Mus musculus
tgtgccaatgtgcaggtgtccctga

SEQ ID NO: 151004 - DNA, 25 bp, Mus musculus
tgtgccacacagcaatgtcgagaac

SEQ ID NO: 151005 - DNA, 25 bp, Mus musculus
tgtgccacacgagggagctggcctt

SEQ ID NO: 151006 - DNA, 25 bp, Mus musculus
tgtgccaccaaatgtagcggaactg

SEQ ID NO: 151007 - DNA, 25 bp, Mus musculus
tgtgccaccctgtgaaagctttgga

SEQ ID NO: 151008 - DNA, 25 bp, Mus musculus
tgtgccacgtatgaaagtgcctctc

SEQ ID NO: 151009 - DNA, 25 bp, Mus musculus
tgtgccacgtcagccaatgagaagc

SEQ ID NO: 151010 - DNA, 25 bp, Mus musculus
tgtgccactggtgtcagcgcaaact

SEQ ID NO: 151011 - DNA, 25 bp, Mus musculus
tgtgccagaccagaccaagatgtga

SEQ ID NO: 151012 - DNA, 25 bp, Mus musculus
tgtgccagactgaggaaggtccctg

SEQ ID NO: 151013 - DNA, 25 bp, Mus musculus
tgtgccagagccaatgtgtataccc

SEQ ID NO: 151014 - DNA, 25 bp, Mus musculus
tgtgccagatcccattgaacagtgg

SEQ ID NO: 151015 - DNA, 25 bp, Mus musculus
tgtgccagcgagtatggacgccttg

SEQ ID NO: 151016 - DNA, 25 bp, Mus musculus
tgtgccaggcattcatcaattacgg

SEQ ID NO: 151017 - DNA, 25 bp, Mus musculus
tgtgccaggctttgcataaaccaag

SEQ ID NO: 151018 - DNA, 25 bp, Mus musculus
tgtgccagtaattactacaacggct

SEQ ID NO: 151019 - DNA, 25 bp, Mus musculus
tgtgccagtacatgatgccagatga

SEQ ID NO: 151020 - DNA, 25 bp, Mus musculus
tgtgccagtgcacaatgcccatgag

SEQ ID NO: 151021 - DNA, 25 bp, Mus musculus
tgtgccatatttcagccggagaccc

SEQ ID NO: 151022 - DNA, 25 bp, Mus musculus
tgtgccatcaacagcaagatcctgg

SEQ ID NO: 151023 - DNA, 25 bp, Mus musculus
tgtgccatcagagaagagatcccac

SEQ ID NO: 151024 - DNA, 25 bp, Mus musculus
tgtgccatcgcgtcctttgggagtg

SEQ ID NO: 151025 - DNA, 25 bp, Mus musculus
tgtgccatgaaggaagctgcctgct

SEQ ID NO: 151026 - DNA, 25 bp, Mus musculus
tgtgccatgccgagctgaacgccat

SEQ ID NO: 151027 - DNA, 25 bp, Mus musculus
tgtgccattctcgaagctacagctg

SEQ ID NO: 151028 - DNA, 25 bp, Mus musculus
tgtgcccaatgtcagaagcgcttca

SEQ ID NO: 151029 - DNA, 25 bp, Mus musculus
tgtgcccacctcaaaacgcttgcgt

SEQ ID NO: 151030 - DNA, 25 bp, Mus musculus
tgtgcccactctgtcgtaaaactcg

SEQ ID NO: 151031 - DNA, 25 bp, Mus musculus
tgtgcccagaaggagacagactacg

SEQ ID NO: 151032 - DNA, 25 bp, Mus musculus
tgtgcccagaatcaaacctgctgtg

SEQ ID NO: 151033 - DNA, 25 bp, Mus musculus
tgtgcccagacagtaatggaggagc

SEQ ID NO: 151034 - DNA, 25 bp, Mus musculus
tgtgcccagagaccgctgaagagct

SEQ ID NO: 151035 - DNA, 25 bp, Mus musculus
tgtgcccataagatcctgcctgtgc

SEQ ID NO: 151036 - DNA, 25 bp, Mus musculus
tgtgcccatcctgttggcaacaggt

SEQ ID NO: 151037 - DNA, 25 bp, Mus musculus
tgtgcccatcggtacaccaaggtgc

SEQ ID NO: 151038 - DNA, 25 bp, Mus musculus
tgtgccccagtactggccaagctgc

SEQ ID NO: 151039 - DNA, 25 bp, Mus musculus
tgtgccccattaatgtcagtgccgg

SEQ ID NO: 151040 - DNA, 25 bp, Mus musculus
tgtgcccgaaggaatccgaagctga

SEQ ID NO: 151041 - DNA, 25 bp, Mus musculus
tgtgcccgacaacacagtgatcctg

SEQ ID NO: 151042 - DNA, 25 bp, Mus musculus
tgtgcccggaatgttaacaacgaag

SEQ ID NO: 151043 - DNA, 25 bp, Mus musculus
tgtgcccgtcgtatgaacttcctgg

SEQ ID NO: 151044 - DNA, 25 bp, Mus musculus
tgtgccctcacaggcctgtggaaat

SEQ ID NO: 151045 - DNA, 25 bp, Mus musculus
tgtgccctgggaatcataagcttga

SEQ ID NO: 151046 - DNA, 25 bp, Mus musculus
tgtgccctgggcattatagtcctta

SEQ ID NO: 151047 - DNA, 25 bp, Mus musculus
tgtgccctgtcaaactagtgtgtgt

SEQ ID NO: 151048 - DNA, 25 bp, Mus musculus
tgtgccgaaaaccatggaatctgga

SEQ ID NO: 151049 - DNA, 25 bp, Mus musculus
tgtgccgaaaactgaggcttccgga

SEQ ID NO: 151050 - DNA, 25 bp, Mus musculus
tgtgccgcactgacctggagattca

SEQ ID NO: 151051 - DNA, 25 bp, Mus musculus
tgtgccgctgacatccaggagcagc

SEQ ID NO: 151052 - DNA, 25 bp, Mus musculus
tgtgccgctggcatattgatctcag

SEQ ID NO: 151053 - DNA, 25 bp, Mus musculus
tgtgccggagctgtggcgcttcctc

SEQ ID NO: 151054 - DNA, 25 bp, Mus musculus
tgtgccgggagccttgtccatacct

SEQ ID NO: 151055 - DNA, 25 bp, Mus musculus
tgtgccgggagctggctttaactgt

SEQ ID NO: 151056 - DNA, 25 bp, Mus musculus
tgtgccgggtatctacaccagagtt

SEQ ID NO: 151057 - DNA, 25 bp, Mus musculus
tgtgccggttggaagaacccacacc

SEQ ID NO: 151058 - DNA, 25 bp, Mus musculus
tgtgccgtcaccaagtctattctga

SEQ ID NO: 151059 - DNA, 25 bp, Mus musculus
tgtgcctacccactggacatgagcg

SEQ ID NO: 151060 - DNA, 25 bp, Mus musculus
tgtgcctacctttgagcagcatgaa

SEQ ID NO: 151061 - DNA, 25 bp, Mus musculus
tgtgcctcaccagagagcagtgggt

SEQ ID NO: 151062 - DNA, 25 bp, Mus musculus
tgtgcctcagactttcactacgata

SEQ ID NO: 151063 - DNA, 25 bp, Mus musculus
tgtgcctccagagaaagacacccga

SEQ ID NO: 151064 - DNA, 25 bp, Mus musculus
tgtgcctccgggacgggaactacaa

SEQ ID NO: 151065 - DNA, 25 bp, Mus musculus
tgtgcctcctcagaagaatggtggg

SEQ ID NO: 151066 - DNA, 25 bp, Mus musculus
tgtgcctcctgaatgtcgctgtgtg

SEQ ID NO: 151067 - DNA, 25 bp, Mus musculus
tgtgcctctctaaaggaagacggct

SEQ ID NO: 151068 - DNA, 25 bp, Mus musculus
tgtgcctctgaggagcatgtccgac

SEQ ID NO: 151069 - DNA, 25 bp, Mus musculus
tgtgcctgaatgctacggacgacgt

SEQ ID NO: 151070 - DNA, 25 bp, Mus musculus
tgtgcctgagagttagcctcccctg

SEQ ID NO: 151071 - DNA, 25 bp, Mus musculus
tgtgcctgagatggcgctaacccct

SEQ ID NO: 151072 - DNA, 25 bp, Mus musculus
tgtgcctgagtctcctaaccgaaga

SEQ ID NO: 151073 - DNA, 25 bp, Mus musculus
tgtgcctgataagagccattcccca

SEQ ID NO: 151074 - DNA, 25 bp, Mus musculus
tgtgcctggaagaagtagaccccaa

SEQ ID NO: 151075 - DNA, 25 bp, Mus musculus
tgtgcctggtgatagaacctcccat

SEQ ID NO: 151076 - DNA, 25 bp, Mus musculus
tgtgcctggtgctattggtggccaa

SEQ ID NO: 151077 - DNA, 25 bp, Mus musculus
tgtgccttactaacaccctggaggt

SEQ ID NO: 151078 - DNA, 25 bp, Mus musculus
tgtgccttgccagtacatgctgcag

SEQ ID NO: 151079 - DNA, 25 bp, Mus musculus
tgtgcctttattgtgcggagagact

SEQ ID NO: 151080 - DNA, 25 bp, Mus musculus
tgtgcgacgggaacccaagaagtac

SEQ ID NO: 151081 - DNA, 25 bp, Mus musculus
tgtgcgattccgaagcccagccacg

SEQ ID NO: 151082 - DNA, 25 bp, Mus musculus
tgtgcgcaacgacactctgcaggag

SEQ ID NO: 151083 - DNA, 25 bp, Mus musculus
tgtgcgcaccgaggacaaaatcctg

SEQ ID NO: 151084 - DNA, 25 bp, Mus musculus
tgtgcgcatgcccagaaaaagccgc

SEQ ID NO: 151085 - DNA, 25 bp, Mus musculus
tgtgcgccccagatggagtcctgga

SEQ ID NO: 151086 - DNA, 25 bp, Mus musculus
tgtgcgccctgtggaagcggccctt

SEQ ID NO: 151087 - DNA, 25 bp, Mus musculus
tgtgcgcctcaactatggaatcccg

SEQ ID NO: 151088 - DNA, 25 bp, Mus musculus
tgtgcgcgcactttccgggtcttgg

SEQ ID NO: 151089 - DNA, 25 bp, Mus musculus
tgtgcgcgctcaacctgctgtatac

SEQ ID NO: 151090 - DNA, 25 bp, Mus musculus
tgtgcgcgcttcattgggaaccgga

SEQ ID NO: 151091 - DNA, 25 bp, Mus musculus
tgtgcgcgtgctcaaggtactcaag

SEQ ID NO: 151092 - DNA, 25 bp, Mus musculus
tgtgcgctcactggccagagtaagc

SEQ ID NO: 151093 - DNA, 25 bp, Mus musculus
tgtgcgctccataacgcccaatgag

SEQ ID NO: 151094 - DNA, 25 bp, Mus musculus
tgtgcgctcccgctacatctgtagt

SEQ ID NO: 151095 - DNA, 25 bp, Mus musculus
tgtgcggatgctgccttacgccatg

SEQ ID NO: 151096 - DNA, 25 bp, Mus musculus
tgtgcggcacactaaaccctgagat

SEQ ID NO: 151097 - DNA, 25 bp, Mus musculus
tgtgcggcaccatcttagaaaccgt

SEQ ID NO: 151098 - DNA, 25 bp, Mus musculus
tgtgcggccctcagaaggtctacag

SEQ ID NO: 151099 - DNA, 25 bp, Mus musculus
tgtgcggctaaaggagaagaaactg

SEQ ID NO: 151100 - DNA, 25 bp, Mus musculus
tgtgcggctcacagcaagaattctg

SEQ ID NO: 151101 - DNA, 25 bp, Mus musculus
tgtgcgggacctacgccaagagctt

SEQ ID NO: 151102 - DNA, 25 bp, Mus musculus
tgtgcgggagccatgacctcgctga

SEQ ID NO: 151103 - DNA, 25 bp, Mus musculus
tgtgcggtcaagaacgggatcctga

SEQ ID NO: 151104 - DNA, 25 bp, Mus musculus
tgtgcggtgaccagcctaatcaaag

SEQ ID NO: 151105 - DNA, 25 bp, Mus musculus
tgtgcggtgaccagggcccacattc

SEQ ID NO: 151106 - DNA, 25 bp, Mus musculus
tgtgcgtcggcatcataagcctcag

SEQ ID NO: 151107 - DNA, 25 bp, Mus musculus
tgtgctaaactcatcatccaggcag

SEQ ID NO: 151108 - DNA, 25 bp, Mus musculus
tgtgctaaactggagccagaggacg

SEQ ID NO: 151109 - DNA, 25 bp, Mus musculus
tgtgctaacagagtggctatcccag

SEQ ID NO: 151110 - DNA, 25 bp, Mus musculus
tgtgctaacattaacactggtgagc

SEQ ID NO: 151111 - DNA, 25 bp, Mus musculus
tgtgctacacaagattaaaggtcgc

SEQ ID NO: 151112 - DNA, 25 bp, Mus musculus
tgtgctacagagacagacactcgtc

SEQ ID NO: 151113 - DNA, 25 bp, Mus musculus
tgtgctagattcatggaatgcttgt

SEQ ID NO: 151114 - DNA, 25 bp, Mus musculus
tgtgctagcagtggtgactcggaca

SEQ ID NO: 151115 - DNA, 25 bp, Mus musculus
tgtgctagcttcatgtccttcggag

SEQ ID NO: 151116 - DNA, 25 bp, Mus musculus
tgtgctatatgaatgctgccctggc

SEQ ID NO: 151117 - DNA, 25 bp, Mus musculus
tgtgctatgtgtaacccaacgactg

SEQ ID NO: 151118 - DNA, 25 bp, Mus musculus
tgtgctcaacagtcagaaccggatc

SEQ ID NO: 151119 - DNA, 25 bp, Mus musculus
tgtgctcacatagtgccatagcctg

SEQ ID NO: 151120 - DNA, 25 bp, Mus musculus
tgtgctcacgatcagaccagaaccg

SEQ ID NO: 151121 - DNA, 25 bp, Mus musculus
tgtgctcacgcagttccatgtatgg

SEQ ID NO: 151122 - DNA, 25 bp, Mus musculus
tgtgctcactcagatgccaccagtg

SEQ ID NO: 151123 - DNA, 25 bp, Mus musculus
tgtgctcagagtttgcaacagctcc

SEQ ID NO: 151124 - DNA, 25 bp, Mus musculus
tgtgctcagccaatgtgacagtcct

SEQ ID NO: 151125 - DNA, 25 bp, Mus musculus
tgtgctcaggccgtcacattggacc

SEQ ID NO: 151126 - DNA, 25 bp, Mus musculus
tgtgctccacgcacagcattagtgc

SEQ ID NO: 151127 - DNA, 25 bp, Mus musculus
tgtgctccagccctgtcaagtactg

SEQ ID NO: 151128 - DNA, 25 bp, Mus musculus
tgtgctcccaagaggatctcctaga

SEQ ID NO: 151129 - DNA, 25 bp, Mus musculus
tgtgctccctcggacggaagcggcc

SEQ ID NO: 151130 - DNA, 25 bp, Mus musculus
tgtgctccctctatgaaaacgactg

SEQ ID NO: 151131 - DNA, 25 bp, Mus musculus
tgtgctccggaggaaaaccttgcta

SEQ ID NO: 151132 - DNA, 25 bp, Mus musculus
tgtgctcctctccataaaaccgtcg

SEQ ID NO: 151133 - DNA, 25 bp, Mus musculus
tgtgctcctgcaggaaaggcatgca

SEQ ID NO: 151134 - DNA, 25 bp, Mus musculus
tgtgctcgagcagcagacctacgtg

SEQ ID NO: 151135 - DNA, 25 bp, Mus musculus
tgtgctcgagtcatccatgggaacc

SEQ ID NO: 151136 - DNA, 25 bp, Mus musculus
tgtgctcggtaaactcccagctgga

SEQ ID NO: 151137 - DNA, 25 bp, Mus musculus
tgtgctctaccatgctgggacggtg

SEQ ID NO: 151138 - DNA, 25 bp, Mus musculus
tgtgctctcgcatctcctgatcgcg

SEQ ID NO: 151139 - DNA, 25 bp, Mus musculus
tgtgctctgcaagaaccatgtccgc

SEQ ID NO: 151140 - DNA, 25 bp, Mus musculus
tgtgctctgctcctgaaggcacaag

SEQ ID NO: 151141 - DNA, 25 bp, Mus musculus
tgtgctctgtggaggttacctgtga

SEQ ID NO: 151142 - DNA, 25 bp, Mus musculus
tgtgctgaactttgaactgccacca

SEQ ID NO: 151143 - DNA, 25 bp, Mus musculus
tgtgctgaccttgtgattccagtga

SEQ ID NO: 151144 - DNA, 25 bp, Mus musculus
tgtgctgagaagtactgatgttcac

SEQ ID NO: 151145 - DNA, 25 bp, Mus musculus
tgtgctgaggagaccaacagtgctg

SEQ ID NO: 151146 - DNA, 25 bp, Mus musculus
tgtgctgatgacaagaccctccgtg

SEQ ID NO: 151147 - DNA, 25 bp, Mus musculus
tgtgctgcaagaggcactggacaag

SEQ ID NO: 151148 - DNA, 25 bp, Mus musculus
tgtgctgcatcgctgcttacggccc

SEQ ID NO: 151149 - DNA, 25 bp, Mus musculus
tgtgctgcatggaaacaacctgtta

SEQ ID NO: 151150 - DNA, 25 bp, Mus musculus
tgtgctgccctcagacaaagactgt

SEQ ID NO: 151151 - DNA, 25 bp, Mus musculus
tgtgctgcgcctagtggcatacgcc

SEQ ID NO: 151152 - DNA, 25 bp, Mus musculus
tgtgctgcggcaagaatccactggg

SEQ ID NO: 151153 - DNA, 25 bp, Mus musculus
tgtgctgctcaaactctactcggat

SEQ ID NO: 151154 - DNA, 25 bp, Mus musculus
tgtgctggaccctgactgccaagaa

SEQ ID NO: 151155 - DNA, 25 bp, Mus musculus
tgtgctggagtatgcaaacctcgta

SEQ ID NO: 151156 - DNA, 25 bp, Mus musculus
tgtgctgggtctggccatggtacca

SEQ ID NO: 151157 - DNA, 25 bp, Mus musculus
tgtgctggtgatgccactcggaacc

SEQ ID NO: 151158 - DNA, 25 bp, Mus musculus
tgtgctggtggctgctctcacagtg

SEQ ID NO: 151159 - DNA, 25 bp, Mus musculus
tgtgctggtgtttcggtgtgtcttc

SEQ ID NO: 151160 - DNA, 25 bp, Mus musculus
tgtgctggtttacatgactccagag

SEQ ID NO: 151161 - DNA, 25 bp, Mus musculus
tgtgctgtagccatgccgctagaaa

SEQ ID NO: 151162 - DNA, 25 bp, Mus musculus
tgtgctgtcagatgtccacctgtac

SEQ ID NO: 151163 - DNA, 25 bp, Mus musculus
tgtgctgtcagcagatcctcggtct

SEQ ID NO: 151164 - DNA, 25 bp, Mus musculus
tgtgctgtcccatgcgataaaacgg

SEQ ID NO: 151165 - DNA, 25 bp, Mus musculus
tgtgctgtggactctgaagagccgc

SEQ ID NO: 151166 - DNA, 25 bp, Mus musculus
tgtgctgtggcgtgtgcctcctagt

SEQ ID NO: 151167 - DNA, 25 bp, Mus musculus
tgtgcttacgaagtgacccaggcca

SEQ ID NO: 151168 - DNA, 25 bp, Mus musculus
tgtgcttcagagacaaggcagtact

SEQ ID NO: 151169 - DNA, 25 bp, Mus musculus
tgtgcttcagaggatcctcgctgtc

SEQ ID NO: 151170 - DNA, 25 bp, Mus musculus
tgtgcttccgaggaacaccgtgcgc

SEQ ID NO: 151171 - DNA, 25 bp, Mus musculus
tgtgcttcctacagactcctccaag

SEQ ID NO: 151172 - DNA, 25 bp, Mus musculus
tgtgcttcctgcaaaccgagttcct

SEQ ID NO: 151173 - DNA, 25 bp, Mus musculus
tgtgcttcgcctgcaagattggaaa

SEQ ID NO: 151174 - DNA, 25 bp, Mus musculus
tgtgcttgacacagccagcgacgtt

SEQ ID NO: 151175 - DNA, 25 bp, Mus musculus
tgtgcttggcacaaactgcagtggc

SEQ ID NO: 151176 - DNA, 25 bp, Mus musculus
tgtgcttgggatcctcttgctgcag

SEQ ID NO: 151177 - DNA, 25 bp, Mus musculus
tgtggaaaacggaagcaccatccgg

SEQ ID NO: 151178 - DNA, 25 bp, Mus musculus
tgtggaaaacttacattatgagacc

SEQ ID NO: 151179 - DNA, 25 bp, Mus musculus
tgtggaaaaggtagacgagctaaag

SEQ ID NO: 151180 - DNA, 25 bp, Mus musculus
tgtggaaagagctagccacgtgccg

SEQ ID NO: 151181 - DNA, 25 bp, Mus musculus
tgtggaaagctgatctgtcgtctcg

SEQ ID NO: 151182 - DNA, 25 bp, Mus musculus
tgtggaaaggcatccagcgtagatg

SEQ ID NO: 151183 - DNA, 25 bp, Mus musculus
tgtggaaatgctaccggccaggtcc

SEQ ID NO: 151184 - DNA, 25 bp, Mus musculus
tgtggaacaaagcagacacggtgca

SEQ ID NO: 151185 - DNA, 25 bp, Mus musculus
tgtggaacatcgctcacgggacaag

SEQ ID NO: 151186 - DNA, 25 bp, Mus musculus
tgtggaacatcttcttcaatgggcg

SEQ ID NO: 151187 - DNA, 25 bp, Mus musculus
tgtggaacccttttccaagagcccg

SEQ ID NO: 151188 - DNA, 25 bp, Mus musculus
tgtggaacgctgtcacgcagcactg

SEQ ID NO: 151189 - DNA, 25 bp, Mus musculus
tgtggaacggctttgcaaactggca

SEQ ID NO: 151190 - DNA, 25 bp, Mus musculus
tgtggaactgatgggccctaaactc

SEQ ID NO: 151191 - DNA, 25 bp, Mus musculus
tgtggaactggaatttggtctggct

SEQ ID NO: 151192 - DNA, 25 bp, Mus musculus
tgtggaagacagaacctcaagatgc

SEQ ID NO: 151193 - DNA, 25 bp, Mus musculus
tgtggaagcatttgaggcttggttt

SEQ ID NO: 151194 - DNA, 25 bp, Mus musculus
tgtggaagccgatcacctgcagtga

SEQ ID NO: 151195 - DNA, 25 bp, Mus musculus
tgtggaaggcttcaggacaaaatgt

SEQ ID NO: 151196 - DNA, 25 bp, Mus musculus
tgtggaaggtcaactcaaaaggctc

SEQ ID NO: 151197 - DNA, 25 bp, Mus musculus
tgtggaagtctatgcatgggcaccg

SEQ ID NO: 151198 - DNA, 25 bp, Mus musculus
tgtggaagtgctccaatcagggtac

SEQ ID NO: 151199 - DNA, 25 bp, Mus musculus
tgtggaatactatgggaaggccctg

SEQ ID NO: 151200 - DNA, 25 bp, Mus musculus
tgtggaatagcttctccagcaatga

SEQ ID NO: 151201 - DNA, 25 bp, Mus musculus
tgtggaatcacagacctcaggagat

SEQ ID NO: 151202 - DNA, 25 bp, Mus musculus
tgtggaatgacgacacccagtccta

SEQ ID NO: 151203 - DNA, 25 bp, Mus musculus
tgtggacaacaatcagggaggcccg

SEQ ID NO: 151204 - DNA, 25 bp, Mus musculus
tgtggacaacagtgagtacatgcgg

SEQ ID NO: 151205 - DNA, 25 bp, Mus musculus
tgtggacaaccaacctaatagctag

SEQ ID NO: 151206 - DNA, 25 bp, Mus musculus
tgtggacaagatgcatgacaccagc

SEQ ID NO: 151207 - DNA, 25 bp, Mus musculus
tgtggacaagcaaaaccggcgtatg

SEQ ID NO: 151208 - DNA, 25 bp, Mus musculus
tgtggacaagcgtgtcaatgacctt

SEQ ID NO: 151209 - DNA, 25 bp, Mus musculus
tgtggacaatactggctgccggacg

SEQ ID NO: 151210 - DNA, 25 bp, Mus musculus
tgtggacacagagcctgggaagctt

SEQ ID NO: 151211 - DNA, 25 bp, Mus musculus
tgtggacacatcgagatttcacccc

SEQ ID NO: 151212 - DNA, 25 bp, Mus musculus
tgtggacaccatccttaccatgaag

SEQ ID NO: 151213 - DNA, 25 bp, Mus musculus
tgtggacacccgtaagaacagcctg

SEQ ID NO: 151214 - DNA, 25 bp, Mus musculus
tgtggacactgggaaataaagagcc

SEQ ID NO: 151215 - DNA, 25 bp, Mus musculus
tgtggacacttctctacctgatgat

SEQ ID NO: 151216 - DNA, 25 bp, Mus musculus
tgtggacagtaatgaccgcacgttt

SEQ ID NO: 151217 - DNA, 25 bp, Mus musculus
tgtggacatgaacagccaagggtca

SEQ ID NO: 151218 - DNA, 25 bp, Mus musculus
tgtggacatggcagagtatagataa

SEQ ID NO: 151219 - DNA, 25 bp, Mus musculus
tgtggacattcctgcagtagagaga

SEQ ID NO: 151220 - DNA, 25 bp, Mus musculus
tgtggacattggagttaagtattcg

SEQ ID NO: 151221 - DNA, 25 bp, Mus musculus
tgtggaccacaaagacacttcagcc

SEQ ID NO: 151222 - DNA, 25 bp, Mus musculus
tgtggaccacaatagaagagcaact

SEQ ID NO: 151223 - DNA, 25 bp, Mus musculus
tgtggaccaccatcgttacctgggt

SEQ ID NO: 151224 - DNA, 25 bp, Mus musculus
tgtggaccactaccctatcctggtg

SEQ ID NO: 151225 - DNA, 25 bp, Mus musculus
tgtggaccagccacggctagtaggc

SEQ ID NO: 151226 - DNA, 25 bp, Mus musculus
tgtggaccatcgagtcatcctggga

SEQ ID NO: 151227 - DNA, 25 bp, Mus musculus
tgtggaccctcagctttatgtcacg

SEQ ID NO: 151228 - DNA, 25 bp, Mus musculus
tgtggaccgaagcatacagacagtg

SEQ ID NO: 151229 - DNA, 25 bp, Mus musculus
tgtggaccgtgcaagtacaaggccg

SEQ ID NO: 151230 - DNA, 25 bp, Mus musculus
tgtggaccgtgcagtggccacacta

SEQ ID NO: 151231 - DNA, 25 bp, Mus musculus
tgtggacgagtctcgcgctgtgccc

SEQ ID NO: 151232 - DNA, 25 bp, Mus musculus
tgtggacgcaattcacacagacgcc

SEQ ID NO: 151233 - DNA, 25 bp, Mus musculus
tgtggacgcagcttataagccaggc

SEQ ID NO: 151234 - DNA, 25 bp, Mus musculus
tgtggacgtgagatcaaccatgagc

SEQ ID NO: 151235 - DNA, 25 bp, Mus musculus
tgtggactacagacatattgtgaag

SEQ ID NO: 151236 - DNA, 25 bp, Mus musculus
tgtggactacatgtggccggctact

SEQ ID NO: 151237 - DNA, 25 bp, Mus musculus
tgtggactaccactcccgtgaggta

SEQ ID NO: 151238 - DNA, 25 bp, Mus musculus
tgtggactactcgagtgcactcaga

SEQ ID NO: 151239 - DNA, 25 bp, Mus musculus
tgtggactccaaaccactgctagct

SEQ ID NO: 151240 - DNA, 25 bp, Mus musculus
tgtggactctgggaaaacacctgca

SEQ ID NO: 151241 - DNA, 25 bp, Mus musculus
tgtggactgggatgaagaccacccc

SEQ ID NO: 151242 - DNA, 25 bp, Mus musculus
tgtggactgtggacgccggtttacc

SEQ ID NO: 151243 - DNA, 25 bp, Mus musculus
tgtggacttcctcatacgcaaaggg

SEQ ID NO: 151244 - DNA, 25 bp, Mus musculus
tgtggagaacctagtacagagcctg

SEQ ID NO: 151245 - DNA, 25 bp, Mus musculus
tgtggagaagacatctgaagagcac

SEQ ID NO: 151246 - DNA, 25 bp, Mus musculus
tgtggagaaggagtaccccaatcgg

SEQ ID NO: 151247 - DNA, 25 bp, Mus musculus
tgtggagacagctatccctaagcct

SEQ ID NO: 151248 - DNA, 25 bp, Mus musculus
tgtggagacccaccaggtacatgag

SEQ ID NO: 151249 - DNA, 25 bp, Mus musculus
tgtggagacgccctatggcttccac

SEQ ID NO: 151250 - DNA, 25 bp, Mus musculus
tgtggagactctacgctacttgacc

SEQ ID NO: 151251 - DNA, 25 bp, Mus musculus
tgtggagatccctggccagaagtac

SEQ ID NO: 151252 - DNA, 25 bp, Mus musculus
tgtggagattctcacccagagtccc

SEQ ID NO: 151253 - DNA, 25 bp, Mus musculus
tgtggagcaaaaatacatctttagc

SEQ ID NO: 151254 - DNA, 25 bp, Mus musculus
tgtggagcaacccatcgtacctcgt

SEQ ID NO: 151255 - DNA, 25 bp, Mus musculus
tgtggagcaactggtctgcagacgc

SEQ ID NO: 151256 - DNA, 25 bp, Mus musculus
tgtggagcacatattcagacaaggg

SEQ ID NO: 151257 - DNA, 25 bp, Mus musculus
tgtggagccaagattacgagaggcc

SEQ ID NO: 151258 - DNA, 25 bp, Mus musculus
tgtggagcccgtggtcatgatgcac

SEQ ID NO: 151259 - DNA, 25 bp, Mus musculus
tgtggagccgaaggaacccgtatgt

SEQ ID NO: 151260 - DNA, 25 bp, Mus musculus
tgtggagccgattcacttggccagg

SEQ ID NO: 151261 - DNA, 25 bp, Mus musculus
tgtggagccgtattaactgcattgt

SEQ ID NO: 151262 - DNA, 25 bp, Mus musculus
tgtggagcctggctatcttcggccc

SEQ ID NO: 151263 - DNA, 25 bp, Mus musculus
tgtggagcctgggaaatgaaagaac

SEQ ID NO: 151264 - DNA, 25 bp, Mus musculus
tgtggagcctgtgaaaagacggtct

SEQ ID NO: 151265 - DNA, 25 bp, Mus musculus
tgtggaggacttgaatgaaccttcc

SEQ ID NO: 151266 - DNA, 25 bp, Mus musculus
tgtggaggagacaacagactggatc

SEQ ID NO: 151267 - DNA, 25 bp, Mus musculus
tgtggaggagatataagagcgtaac

SEQ ID NO: 151268 - DNA, 25 bp, Mus musculus
tgtggaggccgctcaagctgccttc

SEQ ID NO: 151269 - DNA, 25 bp, Mus musculus
tgtggagggcagtgctgccacgggt

SEQ ID NO: 151270 - DNA, 25 bp, Mus musculus
tgtggagtacatgaacttatctgta

SEQ ID NO: 151271 - DNA, 25 bp, Mus musculus
tgtggagtccttcaaagccatgtgg

SEQ ID NO: 151272 - DNA, 25 bp, Mus musculus
tgtggagtttgtagtggcagaccct

SEQ ID NO: 151273 - DNA, 25 bp, Mus musculus
tgtggataaacttcgagagcagctc

SEQ ID NO: 151274 - DNA, 25 bp, Mus musculus
tgtggataaagaccccgtgaaggaa

SEQ ID NO: 151275 - DNA, 25 bp, Mus musculus
tgtggataacttggccctggaacct

SEQ ID NO: 151276 - DNA, 25 bp, Mus musculus
tgtggataagaaaacccctgctggg

SEQ ID NO: 151277 - DNA, 25 bp, Mus musculus
tgtggatcaacttggaggagacctg

SEQ ID NO: 151278 - DNA, 25 bp, Mus musculus
tgtggatcagaaaagccagggtgcc

SEQ ID NO: 151279 - DNA, 25 bp, Mus musculus
tgtggatcattgtggccgttctctc

SEQ ID NO: 151280 - DNA, 25 bp, Mus musculus
tgtggatccccaaggagccttcaga

SEQ ID NO: 151281 - DNA, 25 bp, Mus musculus
tgtggatctagctaccttaaaggag

SEQ ID NO: 151282 - DNA, 25 bp, Mus musculus
tgtggatctcatcgtacaggacctg

SEQ ID NO: 151283 - DNA, 25 bp, Mus musculus
tgtggatctgcaggagagcaaccca

SEQ ID NO: 151284 - DNA, 25 bp, Mus musculus
tgtggatgagagaaaggttgtatca

SEQ ID NO: 151285 - DNA, 25 bp, Mus musculus
tgtggatgatacagcactgtgcccg

SEQ ID NO: 151286 - DNA, 25 bp, Mus musculus
tgtggatgccaccatgaatcaggtt

SEQ ID NO: 151287 - DNA, 25 bp, Mus musculus
tgtggatggcagtcttcagctacct

SEQ ID NO: 151288 - DNA, 25 bp, Mus musculus
tgtggatgtcaacaaccgagtgtcc

SEQ ID NO: 151289 - DNA, 25 bp, Mus musculus
tgtggattgctgtgcagagccgacc

SEQ ID NO: 151290 - DNA, 25 bp, Mus musculus
tgtggatttccacctgaggatctcc

SEQ ID NO: 151291 - DNA, 25 bp, Mus musculus
tgtggcaaacgcagacgaaatcgag

SEQ ID NO: 151292 - DNA, 25 bp, Mus musculus
tgtggcaacgctgtctgaacgggtc

SEQ ID NO: 151293 - DNA, 25 bp, Mus musculus
tgtggcaagtgcttcaaacggaact

SEQ ID NO: 151294 - DNA, 25 bp, Mus musculus
tgtggcacataaaacactccaggtg

SEQ ID NO: 151295 - DNA, 25 bp, Mus musculus
tgtggcactgcttcgaagacgcatg

SEQ ID NO: 151296 - DNA, 25 bp, Mus musculus
tgtggcacttctcgctgtaatcgca

SEQ ID NO: 151297 - DNA, 25 bp, Mus musculus
tgtggcacttctggtaagcactccg

SEQ ID NO: 151298 - DNA, 25 bp, Mus musculus
tgtggcagaagaggtgacccagacc

SEQ ID NO: 151299 - DNA, 25 bp, Mus musculus
tgtggcagaagatgcgacagtaccc

SEQ ID NO: 151300 - DNA, 25 bp, Mus musculus
tgtggcagacaaccagatcgactct

SEQ ID NO: 151301 - DNA, 25 bp, Mus musculus
tgtggcagagcatagtcatgatcct

SEQ ID NO: 151302 - DNA, 25 bp, Mus musculus
tgtggcagccaagtcaagcttcggg

SEQ ID NO: 151303 - DNA, 25 bp, Mus musculus
tgtggcagcctaaccctagagattg

SEQ ID NO: 151304 - DNA, 25 bp, Mus musculus
tgtggcagctgaagtctacgggacc

SEQ ID NO: 151305 - DNA, 25 bp, Mus musculus
tgtggcaggactttcacacggcgct

SEQ ID NO: 151306 - DNA, 25 bp, Mus musculus
tgtggcaggcgttcccatgatccag

SEQ ID NO: 151307 - DNA, 25 bp, Mus musculus
tgtggcagtcagcatcagtggtaac

SEQ ID NO: 151308 - DNA, 25 bp, Mus musculus
tgtggcagtccacctctggaggcaa

SEQ ID NO: 151309 - DNA, 25 bp, Mus musculus
tgtggcatacatacacttaaataaa

SEQ ID NO: 151310 - DNA, 25 bp, Mus musculus
tgtggcatcattgcacgctctgccg

SEQ ID NO: 151311 - DNA, 25 bp, Mus musculus
tgtggcatccgttccccaagttcag

SEQ ID NO: 151312 - DNA, 25 bp, Mus musculus
tgtggcatctcaaaataagtttgga

SEQ ID NO: 151313 - DNA, 25 bp, Mus musculus
tgtggcatctctacccactctgagg

SEQ ID NO: 151314 - DNA, 25 bp, Mus musculus
tgtggcatgaagaccctcgagtggc

SEQ ID NO: 151315 - DNA, 25 bp, Mus musculus
tgtggcattgcctccgtgaactgta

SEQ ID NO: 151316 - DNA, 25 bp, Mus musculus
tgtggccaatgcagagctggttcgc

SEQ ID NO: 151317 - DNA, 25 bp, Mus musculus
tgtggccagctacaatatgggcagc

SEQ ID NO: 151318 - DNA, 25 bp, Mus musculus
tgtggccaggaagcagcctacatac

SEQ ID NO: 151319 - DNA, 25 bp, Mus musculus
tgtggccaggacctcaacaagctca

SEQ ID NO: 151320 - DNA, 25 bp, Mus musculus
tgtggcccaatcacagctggtgtat

SEQ ID NO: 151321 - DNA, 25 bp, Mus musculus
tgtggcccacgtacatgaaatgaga

SEQ ID NO: 151322 - DNA, 25 bp, Mus musculus
tgtggcccagccctacctttggtgg

SEQ ID NO: 151323 - DNA, 25 bp, Mus musculus
tgtggcccaggcctacatgaaccag

SEQ ID NO: 151324 - DNA, 25 bp, Mus musculus
tgtggccccaaagcccaaagtgaat

SEQ ID NO: 151325 - DNA, 25 bp, Mus musculus
tgtggccccaagagtagtcctagga

SEQ ID NO: 151326 - DNA, 25 bp, Mus musculus
tgtggccccgggtgtcaaaagtgtc

SEQ ID NO: 151327 - DNA, 25 bp, Mus musculus
tgtggcccctgcaaaacaattgctc

SEQ ID NO: 151328 - DNA, 25 bp, Mus musculus
tgtggcccgagtttccaatctctga

SEQ ID NO: 151329 - DNA, 25 bp, Mus musculus
tgtggccctcacagaattaagctgg

SEQ ID NO: 151330 - DNA, 25 bp, Mus musculus
tgtggccctggcaaggttcagaacg

SEQ ID NO: 151331 - DNA, 25 bp, Mus musculus
tgtggccgaattggataccctggag

SEQ ID NO: 151332 - DNA, 25 bp, Mus musculus
tgtggccgcagatcaaagggcgact

SEQ ID NO: 151333 - DNA, 25 bp, Mus musculus
tgtggccgctacagaagatcctgct

SEQ ID NO: 151334 - DNA, 25 bp, Mus musculus
tgtggccgctgcatatcgtcctgtg

SEQ ID NO: 151335 - DNA, 25 bp, Mus musculus
tgtggccggatgacagctactggtt

SEQ ID NO: 151336 - DNA, 25 bp, Mus musculus
tgtggccgttctctctgctgtcatc

SEQ ID NO: 151337 - DNA, 25 bp, Mus musculus
tgtggcctacatgtgtcttcatcct

SEQ ID NO: 151338 - DNA, 25 bp, Mus musculus
tgtggcctataccttccgccgagag

SEQ ID NO: 151339 - DNA, 25 bp, Mus musculus
tgtggcctcacagtcttcaatggaa

SEQ ID NO: 151340 - DNA, 25 bp, Mus musculus
tgtggcctcactgtcatagacctgg

SEQ ID NO: 151341 - DNA, 25 bp, Mus musculus
tgtggcctcatagctgctcttctgc

SEQ ID NO: 151342 - DNA, 25 bp, Mus musculus
tgtggcctccactaccaagaagttc

SEQ ID NO: 151343 - DNA, 25 bp, Mus musculus
tgtggcctccctgaatggcatccag

SEQ ID NO: 151344 - DNA, 25 bp, Mus musculus
tgtggcctgaacacatctgatcgct

SEQ ID NO: 151345 - DNA, 25 bp, Mus musculus
tgtggcctgatgctagacaactgga

SEQ ID NO: 151346 - DNA, 25 bp, Mus musculus
tgtggcctgtataaccctctctggt

SEQ ID NO: 151347 - DNA, 25 bp, Mus musculus
tgtggcctttgtcacgggctccctg

SEQ ID NO: 151348 - DNA, 25 bp, Mus musculus
tgtggcgacgttccgaaaaaacagc

SEQ ID NO: 151349 - DNA, 25 bp, Mus musculus
tgtggcgataaagtgtctgggtacc

SEQ ID NO: 151350 - DNA, 25 bp, Mus musculus
tgtggcgctgtgttcctggtcctct

SEQ ID NO: 151351 - DNA, 25 bp, Mus musculus
tgtggcggcgggaaaaaatgcctat

SEQ ID NO: 151352 - DNA, 25 bp, Mus musculus
tgtggcggtgtacggaacactaaac

SEQ ID NO: 151353 - DNA, 25 bp, Mus musculus
tgtggcgtgaacagggcagaacctt

SEQ ID NO: 151354 - DNA, 25 bp, Mus musculus
tgtggctaatgactacccagtaggg

SEQ ID NO: 151355 - DNA, 25 bp, Mus musculus
tgtggctacatcgaaagcatccagc

SEQ ID NO: 151356 - DNA, 25 bp, Mus musculus
tgtggctagacagctgtgccaggac

SEQ ID NO: 151357 - DNA, 25 bp, Mus musculus
tgtggctagccaagcagcagtgcct

SEQ ID NO: 151358 - DNA, 25 bp, Mus musculus
tgtggctcacgaattccaggaactg

SEQ ID NO: 151359 - DNA, 25 bp, Mus musculus
tgtggctcctcgagcaaaaatgaac

SEQ ID NO: 151360 - DNA, 25 bp, Mus musculus
tgtggctctcgcgatatttccgaag

SEQ ID NO: 151361 - DNA, 25 bp, Mus musculus
tgtggctctgcgctgtctttagttg

SEQ ID NO: 151362 - DNA, 25 bp, Mus musculus
tgtggctgcacgttgccaaggtcca

SEQ ID NO: 151363 - DNA, 25 bp, Mus musculus
tgtggctgcagaactacttttggac

SEQ ID NO: 151364 - DNA, 25 bp, Mus musculus
tgtggctgcctaaacacctgctggg

SEQ ID NO: 151365 - DNA, 25 bp, Mus musculus
tgtggctgctgtggcgcattacctg

SEQ ID NO: 151366 - DNA, 25 bp, Mus musculus
tgtggctggcacacaatgagatccg

SEQ ID NO: 151367 - DNA, 25 bp, Mus musculus
tgtggctggcttcttcatcaacaag

SEQ ID NO: 151368 - DNA, 25 bp, Mus musculus
tgtggcttactaggcaatgcatcgc

SEQ ID NO: 151369 - DNA, 25 bp, Mus musculus
tgtggcttctccatcgatgtgcgag

SEQ ID NO: 151370 - DNA, 25 bp, Mus musculus
tgtggcttcttaaaacttccctgca

SEQ ID NO: 151371 - DNA, 25 bp, Mus musculus
tgtggcttgtaaccacctgagaagc

SEQ ID NO: 151372 - DNA, 25 bp, Mus musculus
tgtgggaaagtaaaaagcagagctt

SEQ ID NO: 151373 - DNA, 25 bp, Mus musculus
tgtgggaaatcctactaccggaagt

SEQ ID NO: 151374 - DNA, 25 bp, Mus musculus
tgtgggaacctactgtgcctttgcc

SEQ ID NO: 151375 - DNA, 25 bp, Mus musculus
tgtgggaagcatttcacctggagcc

SEQ ID NO: 151376 - DNA, 25 bp, Mus musculus
tgtgggaagctacagctgtacctgt

SEQ ID NO: 151377 - DNA, 25 bp, Mus musculus
tgtgggaatcgctgtcaccatcctg

SEQ ID NO: 151378 - DNA, 25 bp, Mus musculus
tgtgggacctatgcttcaacaagac

SEQ ID NO: 151379 - DNA, 25 bp, Mus musculus
tgtgggacgcacgtgagcaatctca

SEQ ID NO: 151380 - DNA, 25 bp, Mus musculus
tgtgggacggaagcctcctactttt

SEQ ID NO: 151381 - DNA, 25 bp, Mus musculus
tgtgggacgggcaatcccaggtgga

SEQ ID NO: 151382 - DNA, 25 bp, Mus musculus
tgtgggactcacaacaatcgtggag

SEQ ID NO: 151383 - DNA, 25 bp, Mus musculus
tgtgggagaaactacgacgggcatt

SEQ ID NO: 151384 - DNA, 25 bp, Mus musculus
tgtgggagaataaactaatgcagtc

SEQ ID NO: 151385 - DNA, 25 bp, Mus musculus
tgtgggagatgacctcacggtaacc

SEQ ID NO: 151386 - DNA, 25 bp, Mus musculus
tgtgggaggtctaaaccctgaagcc

SEQ ID NO: 151387 - DNA, 25 bp, Mus musculus
tgtgggatctctgagcctgaaggcc

SEQ ID NO: 151388 - DNA, 25 bp, Mus musculus
tgtgggatttctaagcaggtggtcc

SEQ ID NO: 151389 - DNA, 25 bp, Mus musculus
tgtgggcaaaaaccaaggcctcctt

SEQ ID NO: 151390 - DNA, 25 bp, Mus musculus
tgtgggcaacagcatcatgttcgtc

SEQ ID NO: 151391 - DNA, 25 bp, Mus musculus
tgtgggcaacattaccttgacctgc

SEQ ID NO: 151392 - DNA, 25 bp, Mus musculus
tgtgggcaacctgatccaacctggg

SEQ ID NO: 151393 - DNA, 25 bp, Mus musculus
tgtgggcaagtcaaaataaaggtgc

SEQ ID NO: 151394 - DNA, 25 bp, Mus musculus
tgtgggcacaaaaactaccatccgc

SEQ ID NO: 151395 - DNA, 25 bp, Mus musculus
tgtgggcaccaaggacaaggttgct

SEQ ID NO: 151396 - DNA, 25 bp, Mus musculus
tgtgggcacttgtcctccttgccga

SEQ ID NO: 151397 - DNA, 25 bp, Mus musculus
tgtgggcagcctcaccctgcatgat

SEQ ID NO: 151398 - DNA, 25 bp, Mus musculus
tgtgggcagtgccagatgaatttcc

SEQ ID NO: 151399 - DNA, 25 bp, Mus musculus
tgtgggccacggacatcaaatcttc

SEQ ID NO: 151400 - DNA, 25 bp, Mus musculus
tgtgggccagcctgatgaacagtcc

SEQ ID NO: 151401 - DNA, 25 bp, Mus musculus
tgtgggccagcttccttaatgatgt

SEQ ID NO: 151402 - DNA, 25 bp, Mus musculus
tgtgggccctgaagacatgacgctg

SEQ ID NO: 151403 - DNA, 25 bp, Mus musculus
tgtgggccgaaaccgagaagcacta

SEQ ID NO: 151404 - DNA, 25 bp, Mus musculus
tgtgggccgaagctgaccaactccc

SEQ ID NO: 151405 - DNA, 25 bp, Mus musculus
tgtgggccgccatgttccagaagca

SEQ ID NO: 151406 - DNA, 25 bp, Mus musculus
tgtgggcctcatcatgtaccttggg

SEQ ID NO: 151407 - DNA, 25 bp, Mus musculus
tgtgggcctcttctcatgtacatag

SEQ ID NO: 151408 - DNA, 25 bp, Mus musculus
tgtgggcctgactactacgaagtgg

SEQ ID NO: 151409 - DNA, 25 bp, Mus musculus
tgtgggcgtcatggcaactaatgtg

SEQ ID NO: 151410 - DNA, 25 bp, Mus musculus
tgtgggctaaggaaaaagaggctca

SEQ ID NO: 151411 - DNA, 25 bp, Mus musculus
tgtgggctaccctctggatacagtg

SEQ ID NO: 151412 - DNA, 25 bp, Mus musculus
tgtgggctcaccctctagaccgatg

SEQ ID NO: 151413 - DNA, 25 bp, Mus musculus
tgtgggctccattgagtacctcaag

SEQ ID NO: 151414 - DNA, 25 bp, Mus musculus
tgtgggctgcatcctaaaaccctgg

SEQ ID NO: 151415 - DNA, 25 bp, Mus musculus
tgtgggcttctctccaaggtcatgg

SEQ ID NO: 151416 - DNA, 25 bp, Mus musculus
tgtgggcttgaaccctccagaagag

SEQ ID NO: 151417 - DNA, 25 bp, Mus musculus
tgtgggtacacaagaggccttcaga

SEQ ID NO: 151418 - DNA, 25 bp, Mus musculus
tgtgggtaccaacaatcaaagctac

SEQ ID NO: 151419 - DNA, 25 bp, Mus musculus
tgtgggtaccaagaccaagctggct

SEQ ID NO: 151420 - DNA, 25 bp, Mus musculus
tgtgggtagcaccaagccagtcagt

SEQ ID NO: 151421 - DNA, 25 bp, Mus musculus
tgtgggtagcctcctaaagcgcatt

SEQ ID NO: 151422 - DNA, 25 bp, Mus musculus
tgtgggtcacagcataacaagtcca

SEQ ID NO: 151423 - DNA, 25 bp, Mus musculus
tgtgggtccctagttccagatgtcg

SEQ ID NO: 151424 - DNA, 25 bp, Mus musculus
tgtgggtctcaaccctgagctgttc

SEQ ID NO: 151425 - DNA, 25 bp, Mus musculus
tgtgggtctctccatctgaacggga

SEQ ID NO: 151426 - DNA, 25 bp, Mus musculus
tgtgggtgatacctccctgaggata

SEQ ID NO: 151427 - DNA, 25 bp, Mus musculus
tgtgggtgccacataaaaggactgc

SEQ ID NO: 151428 - DNA, 25 bp, Mus musculus
tgtgggtgtaccctttcctggaaca

SEQ ID NO: 151429 - DNA, 25 bp, Mus musculus
tgtgggttccctagagactctggta

SEQ ID NO: 151430 - DNA, 25 bp, Mus musculus
tgtggtaaaccaacacagcgggtcc

SEQ ID NO: 151431 - DNA, 25 bp, Mus musculus
tgtggtaaacgcaaaggactgggcc

SEQ ID NO: 151432 - DNA, 25 bp, Mus musculus
tgtggtaaagcctccagctcagctc

SEQ ID NO: 151433 - DNA, 25 bp, Mus musculus
tgtggtaacagcaggcacctcagaa

SEQ ID NO: 151434 - DNA, 25 bp, Mus musculus
tgtggtaagggatgaagacacgatc

SEQ ID NO: 151435 - DNA, 25 bp, Mus musculus
tgtggtacaccgcttcgaatccctg

SEQ ID NO: 151436 - DNA, 25 bp, Mus musculus
tgtggtacacggaaagccgttccgg

SEQ ID NO: 151437 - DNA, 25 bp, Mus musculus
tgtggtaccagaacaggacttcgtc

SEQ ID NO: 151438 - DNA, 25 bp, Mus musculus
tgtggtacctcattaacccaaggac

SEQ ID NO: 151439 - DNA, 25 bp, Mus musculus
tgtggtagaacgttccaaggacttc

SEQ ID NO: 151440 - DNA, 25 bp, Mus musculus
tgtggtaggcaatagaaatcagact

SEQ ID NO: 151441 - DNA, 25 bp, Mus musculus
tgtggtagtcctccatatgcagccc

SEQ ID NO: 151442 - DNA, 25 bp, Mus musculus
tgtggtatgccgaagatttacaggc

SEQ ID NO: 151443 - DNA, 25 bp, Mus musculus
tgtggtattgcctctgtcgcaggcc

SEQ ID NO: 151444 - DNA, 25 bp, Mus musculus
tgtggtcaaaagacaggaaaccgtc

SEQ ID NO: 151445 - DNA, 25 bp, Mus musculus
tgtggtcaacaaccacagagtctct

SEQ ID NO: 151446 - DNA, 25 bp, Mus musculus
tgtggtcagatttctcagtacagta

SEQ ID NO: 151447 - DNA, 25 bp, Mus musculus
tgtggtcagcccagagcctcttctg

SEQ ID NO: 151448 - DNA, 25 bp, Mus musculus
tgtggtcatcgcatcaaacattggc

SEQ ID NO: 151449 - DNA, 25 bp, Mus musculus
tgtggtccaagcaagagatgacttt

SEQ ID NO: 151450 - DNA, 25 bp, Mus musculus
tgtggtccaagctggtcatcgcagg

SEQ ID NO: 151451 - DNA, 25 bp, Mus musculus
tgtggtccaccggactccagttgta

SEQ ID NO: 151452 - DNA, 25 bp, Mus musculus
tgtggtccaggactccagacttgaa

SEQ ID NO: 151453 - DNA, 25 bp, Mus musculus
tgtggtccccaaccgcaaggaagat

SEQ ID NO: 151454 - DNA, 25 bp, Mus musculus
tgtggtccgacccagataaggatgt

SEQ ID NO: 151455 - DNA, 25 bp, Mus musculus
tgtggtccgtaaggctccaaacgtg

SEQ ID NO: 151456 - DNA, 25 bp, Mus musculus
tgtggtcctccagtaactcccgagt

SEQ ID NO: 151457 - DNA, 25 bp, Mus musculus
tgtggtcgtagccatgaccttggaa

SEQ ID NO: 151458 - DNA, 25 bp, Mus musculus
tgtggtcgtttgaagagcccagcct

SEQ ID NO: 151459 - DNA, 25 bp, Mus musculus
tgtggtctatgccataatttcagaa

SEQ ID NO: 151460 - DNA, 25 bp, Mus musculus
tgtggtctcacaggcaggctctgca

SEQ ID NO: 151461 - DNA, 25 bp, Mus musculus
tgtggtctccttgcgcttgtctctg

SEQ ID NO: 151462 - DNA, 25 bp, Mus musculus
tgtggtgaacgaattctgcgagcga

SEQ ID NO: 151463 - DNA, 25 bp, Mus musculus
tgtggtgaccaactacgaggaatcc

SEQ ID NO: 151464 - DNA, 25 bp, Mus musculus
tgtggtgcaggagacctacagtcac

SEQ ID NO: 151465 - DNA, 25 bp, Mus musculus
tgtggtgccaaactacgacaatgtc

SEQ ID NO: 151466 - DNA, 25 bp, Mus musculus
tgtggtgcttctggcctgtggttcc

SEQ ID NO: 151467 - DNA, 25 bp, Mus musculus
tgtggtggcttaagagaattttccc

SEQ ID NO: 151468 - DNA, 25 bp, Mus musculus
tgtggtgggaaatacactgtctcca

SEQ ID NO: 151469 - DNA, 25 bp, Mus musculus
tgtggtggtacaaacgcctatcagc

SEQ ID NO: 151470 - DNA, 25 bp, Mus musculus
tgtggtggtttcagcaaggcctcag

SEQ ID NO: 151471 - DNA, 25 bp, Mus musculus
tgtggtgtacctgccacaagaagtc

SEQ ID NO: 151472 - DNA, 25 bp, Mus musculus
tgtggtgtgtctctctgacgtccgc

SEQ ID NO: 151473 - DNA, 25 bp, Mus musculus
tgtggtgttgctcctactgaagtac

SEQ ID NO: 151474 - DNA, 25 bp, Mus musculus
tgtggtgttggctgcccggacgaaa

SEQ ID NO: 151475 - DNA, 25 bp, Mus musculus
tgtggttatgctggtcccggccatc

SEQ ID NO: 151476 - DNA, 25 bp, Mus musculus
tgtggttccttcaaccccatcacga

SEQ ID NO: 151477 - DNA, 25 bp, Mus musculus
tgtggttcttttgcactaaattaag

SEQ ID NO: 151478 - DNA, 25 bp, Mus musculus
tgtggttgaatctacagagacatga

SEQ ID NO: 151479 - DNA, 25 bp, Mus musculus
tgtggttgcaactcagcttcttgaa

SEQ ID NO: 151480 - DNA, 25 bp, Mus musculus
tgtggttgccaaagccctctgtgtc

SEQ ID NO: 151481 - DNA, 25 bp, Mus musculus
tgtggttgctccagaacaaaacctg

SEQ ID NO: 151482 - DNA, 25 bp, Mus musculus
tgtggttgtccaacaagaggagcct

SEQ ID NO: 151483 - DNA, 25 bp, Mus musculus
tgtggtttctcagctagcccagcag

SEQ ID NO: 151484 - DNA, 25 bp, Mus musculus
tgtggtttctgccaggaagcctgcc

SEQ ID NO: 151485 - DNA, 25 bp, Mus musculus
tgtgtaaatctggacaatgtgactt

SEQ ID NO: 151486 - DNA, 25 bp, Mus musculus
tgtgtaaattactgatcgctgtgca

SEQ ID NO: 151487 - DNA, 25 bp, Mus musculus
tgtgtaacaaaagatgcaccgtgtg

SEQ ID NO: 151488 - DNA, 25 bp, Mus musculus
tgtgtaacgcccagatcaccatgct

SEQ ID NO: 151489 - DNA, 25 bp, Mus musculus
tgtgtaacttctcttctggatctaa

SEQ ID NO: 151490 - DNA, 25 bp, Mus musculus
tgtgtaagataaaaatgctggtcag

SEQ ID NO: 151491 - DNA, 25 bp, Mus musculus
tgtgtaagccaagtggatgcctaag

SEQ ID NO: 151492 - DNA, 25 bp, Mus musculus
tgtgtaagctcagtggatccaggga

SEQ ID NO: 151493 - DNA, 25 bp, Mus musculus
tgtgtaagggactggcagctctgcc

SEQ ID NO: 151494 - DNA, 25 bp, Mus musculus
tgtgtaatctgcctgtcaaagtggt

SEQ ID NO: 151495 - DNA, 25 bp, Mus musculus
tgtgtaattctgcatccctaaggga

SEQ ID NO: 151496 - DNA, 25 bp, Mus musculus
tgtgtacaaacaccagacatccagg

SEQ ID NO: 151497 - DNA, 25 bp, Mus musculus
tgtgtacaagaaccacccaggagaa

SEQ ID NO: 151498 - DNA, 25 bp, Mus musculus
tgtgtacacatctcagccaggacga

SEQ ID NO: 151499 - DNA, 25 bp, Mus musculus
tgtgtacacatcttgcttaggaaag

SEQ ID NO: 151500 - DNA, 25 bp, Mus musculus
tgtgtacacgtcacagaccagaagc

SEQ ID NO: 151501 - DNA, 25 bp, Mus musculus
tgtgtacagtgctaccaaggcggct

SEQ ID NO: 151502 - DNA, 25 bp, Mus musculus
tgtgtaccagttaaaagatcctcgg

SEQ ID NO: 151503 - DNA, 25 bp, Mus musculus
tgtgtacccaatcctgcgactcgtc

SEQ ID NO: 151504 - DNA, 25 bp, Mus musculus
tgtgtacccatcaacagtgcccaag

SEQ ID NO: 151505 - DNA, 25 bp, Mus musculus
tgtgtaccccatagcacttactcgg

SEQ ID NO: 151506 - DNA, 25 bp, Mus musculus
tgtgtaccccggtaactccctgaag

SEQ ID NO: 151507 - DNA, 25 bp, Mus musculus
tgtgtaccgtaccaaaggcctttag

SEQ ID NO: 151508 - DNA, 25 bp, Mus musculus
tgtgtacctgaagctagaccgacct

SEQ ID NO: 151509 - DNA, 25 bp, Mus musculus
tgtgtacctggtcaacatcatgccg

SEQ ID NO: 151510 - DNA, 25 bp, Mus musculus
tgtgtacgcgctcagagagcaatat

SEQ ID NO: 151511 - DNA, 25 bp, Mus musculus
tgtgtacgggaaaatcgagccctcg

SEQ ID NO: 151512 - DNA, 25 bp, Mus musculus
tgtgtactcccgagaccggaagttt

SEQ ID NO: 151513 - DNA, 25 bp, Mus musculus
tgtgtactccgacccggactgaggc

SEQ ID NO: 151514 - DNA, 25 bp, Mus musculus
tgtgtactcgggtgtgcagcctggg

SEQ ID NO: 151515 - DNA, 25 bp, Mus musculus
tgtgtacttaaaacaggccacgtgg

SEQ ID NO: 151516 - DNA, 25 bp, Mus musculus
tgtgtacttcagaccgagggagctg

SEQ ID NO: 151517 - DNA, 25 bp, Mus musculus
tgtgtacttgtagcaaagataacgc

SEQ ID NO: 151518 - DNA, 25 bp, Mus musculus
tgtgtagaagcttgtccccgaggtc

SEQ ID NO: 151519 - DNA, 25 bp, Mus musculus
tgtgtagactcaatcctggcagctg

SEQ ID NO: 151520 - DNA, 25 bp, Mus musculus
tgtgtagcacccaaaggccctgtgc

SEQ ID NO: 151521 - DNA, 25 bp, Mus musculus
tgtgtagccaaaaaagccatgagtc

SEQ ID NO: 151522 - DNA, 25 bp, Mus musculus
tgtgtaggaagccaacctgtacgaa

SEQ ID NO: 151523 - DNA, 25 bp, Mus musculus
tgtgtataaaccatcgggcatggct

SEQ ID NO: 151524 - DNA, 25 bp, Mus musculus
tgtgtataacttaactgcaagacca

SEQ ID NO: 151525 - DNA, 25 bp, Mus musculus
tgtgtatcaccttgactgcttcgcc

SEQ ID NO: 151526 - DNA, 25 bp, Mus musculus
tgtgtatgcacctgaagacgatcca

SEQ ID NO: 151527 - DNA, 25 bp, Mus musculus
tgtgtatggctaggaagcttcccct

SEQ ID NO: 151528 - DNA, 25 bp, Mus musculus
tgtgtatgtaactggccggcctgac

SEQ ID NO: 151529 - DNA, 25 bp, Mus musculus
tgtgtatttttgaacccctgggtgt

SEQ ID NO: 151530 - DNA, 25 bp, Mus musculus
tgtgtcaaaaccaaacatcctcagc

SEQ ID NO: 151531 - DNA, 25 bp, Mus musculus
tgtgtcaacacctcctgcagaaaag

SEQ ID NO: 151532 - DNA, 25 bp, Mus musculus
tgtgtcaagaaagagtgctggcccc

SEQ ID NO: 151533 - DNA, 25 bp, Mus musculus
tgtgtcacaaatgagggactctgac

SEQ ID NO: 151534 - DNA, 25 bp, Mus musculus
tgtgtcacaccagggctttatgcga

SEQ ID NO: 151535 - DNA, 25 bp, Mus musculus
tgtgtcacacgctcccgatgtggac

SEQ ID NO: 151536 - DNA, 25 bp, Mus musculus
tgtgtcacactagggagctggcttt

SEQ ID NO: 151537 - DNA, 25 bp, Mus musculus
tgtgtcaccaccgaactgtatgcag

SEQ ID NO: 151538 - DNA, 25 bp, Mus musculus
tgtgtcaccagcacctcagattctg

SEQ ID NO: 151539 - DNA, 25 bp, Mus musculus
tgtgtcaccgtgagcgcaaaggctg

SEQ ID NO: 151540 - DNA, 25 bp, Mus musculus
tgtgtcacctggaactctaccgagc

SEQ ID NO: 151541 - DNA, 25 bp, Mus musculus
tgtgtcacggcttcagcaggaggcc

SEQ ID NO: 151542 - DNA, 25 bp, Mus musculus
tgtgtcactatggaaacgactactg

SEQ ID NO: 151543 - DNA, 25 bp, Mus musculus
tgtgtcactcagacttcaggaagaa

SEQ ID NO: 151544 - DNA, 25 bp, Mus musculus
tgtgtcaggaaaatagcaagccagg

SEQ ID NO: 151545 - DNA, 25 bp, Mus musculus
tgtgtcaggcaagggtcagactccc

SEQ ID NO: 151546 - DNA, 25 bp, Mus musculus
tgtgtcatcaagagctcagtgggtg

SEQ ID NO: 151547 - DNA, 25 bp, Mus musculus
tgtgtcatcgacaagatcacccgga

SEQ ID NO: 151548 - DNA, 25 bp, Mus musculus
tgtgtcattggcatcaggcggccac

SEQ ID NO: 151549 - DNA, 25 bp, Mus musculus
tgtgtccaaatcagatgccaagtcc

SEQ ID NO: 151550 - DNA, 25 bp, Mus musculus
tgtgtccaacaaataccagtggctg

SEQ ID NO: 151551 - DNA, 25 bp, Mus musculus
tgtgtccaacactagggcctttccc

SEQ ID NO: 151552 - DNA, 25 bp, Mus musculus
tgtgtccaactgtatatagctgcca

SEQ ID NO: 151553 - DNA, 25 bp, Mus musculus
tgtgtccaagaagaaacgcatgtgt

SEQ ID NO: 151554 - DNA, 25 bp, Mus musculus
tgtgtccacaaggatcagtcagcct

SEQ ID NO: 151555 - DNA, 25 bp, Mus musculus
tgtgtccagtggttctatcccagag

SEQ ID NO: 151556 - DNA, 25 bp, Mus musculus
tgtgtccatccctgaagtcctggta

SEQ ID NO: 151557 - DNA, 25 bp, Mus musculus
tgtgtccatgcaaataaagtcaggc

SEQ ID NO: 151558 - DNA, 25 bp, Mus musculus
tgtgtcccagtttgatggccccagc

SEQ ID NO: 151559 - DNA, 25 bp, Mus musculus
tgtgtcccgagttctgtgccgtgcc

SEQ ID NO: 151560 - DNA, 25 bp, Mus musculus
tgtgtcccgctacatggcaggagca

SEQ ID NO: 151561 - DNA, 25 bp, Mus musculus
tgtgtcccgggcaagaaagatacag

SEQ ID NO: 151562 - DNA, 25 bp, Mus musculus
tgtgtccctgctaccaccaaggagg

SEQ ID NO: 151563 - DNA, 25 bp, Mus musculus
tgtgtccctttgaacgagtagcttg

SEQ ID NO: 151564 - DNA, 25 bp, Mus musculus
tgtgtccgacgggaactgcagaaga

SEQ ID NO: 151565 - DNA, 25 bp, Mus musculus
tgtgtcctccgcttatgtcagtaca

SEQ ID NO: 151566 - DNA, 25 bp, Mus musculus
tgtgtcctgagaaggcttagcgcct

SEQ ID NO: 151567 - DNA, 25 bp, Mus musculus
tgtgtcctgatctttggcgtcccca

SEQ ID NO: 151568 - DNA, 25 bp, Mus musculus
tgtgtcctgctttgcccttgtgggc

SEQ ID NO: 151569 - DNA, 25 bp, Mus musculus
tgtgtccttcagcaaaacagtggat

SEQ ID NO: 151570 - DNA, 25 bp, Mus musculus
tgtgtcgactcagataacaaggccg

SEQ ID NO: 151571 - DNA, 25 bp, Mus musculus
tgtgtcgagagtaccagcgtggcaa

SEQ ID NO: 151572 - DNA, 25 bp, Mus musculus
tgtgtcgatgtgaacggaacctctg

SEQ ID NO: 151573 - DNA, 25 bp, Mus musculus
tgtgtcgcagcgctgatcaagtcct

SEQ ID NO: 151574 - DNA, 25 bp, Mus musculus
tgtgtcgcagtccacaaaagaagcg

SEQ ID NO: 151575 - DNA, 25 bp, Mus musculus
tgtgtcgcttggtgactccgtctgt

SEQ ID NO: 151576 - DNA, 25 bp, Mus musculus
tgtgtcggagcctagtgaagcgctt

SEQ ID NO: 151577 - DNA, 25 bp, Mus musculus
tgtgtcgtagccttcaagtgccaga

SEQ ID NO: 151578 - DNA, 25 bp, Mus musculus
tgtgtcgtccaacaccaaaactggg

SEQ ID NO: 151579 - DNA, 25 bp, Mus musculus
tgtgtctaacaagcatctgtcctgg

SEQ ID NO: 151580 - DNA, 25 bp, Mus musculus
tgtgtctaccccaatcttctgagca

SEQ ID NO: 151581 - DNA, 25 bp, Mus musculus
tgtgtctcaactcctagcccagtgc

SEQ ID NO: 151582 - DNA, 25 bp, Mus musculus
tgtgtctcaggtagtggtctcaggc

SEQ ID NO: 151583 - DNA, 25 bp, Mus musculus
tgtgtctcatgaggccccaatgggc

SEQ ID NO: 151584 - DNA, 25 bp, Mus musculus
tgtgtctccaggaagaacctccggt

SEQ ID NO: 151585 - DNA, 25 bp, Mus musculus
tgtgtctccattctggagaggctgc

SEQ ID NO: 151586 - DNA, 25 bp, Mus musculus
tgtgtctctgtcctcagcgttctcg

SEQ ID NO: 151587 - DNA, 25 bp, Mus musculus
tgtgtctgacaccaacgtgatactg

SEQ ID NO: 151588 - DNA, 25 bp, Mus musculus
tgtgtctgacctgcaatcctttggc

SEQ ID NO: 151589 - DNA, 25 bp, Mus musculus
tgtgtctgagaatggcaactgcgtg

SEQ ID NO: 151590 - DNA, 25 bp, Mus musculus
tgtgtctgccaaggaatttgccccg

SEQ ID NO: 151591 - DNA, 25 bp, Mus musculus
tgtgtctgctctgagttcttccgcg

SEQ ID NO: 151592 - DNA, 25 bp, Mus musculus
tgtgtctggccaaaggtatgcctct

SEQ ID NO: 151593 - DNA, 25 bp, Mus musculus
tgtgtctgtgtccagccaggaagac

SEQ ID NO: 151594 - DNA, 25 bp, Mus musculus
tgtgtcttcacatacgactgcagta

SEQ ID NO: 151595 - DNA, 25 bp, Mus musculus
tgtgtcttcctccacggatgctagg

SEQ ID NO: 151596 - DNA, 25 bp, Mus musculus
tgtgtcttcctgcacagtggacttg

SEQ ID NO: 151597 - DNA, 25 bp, Mus musculus
tgtgtcttgcatgccctgcgagctg

SEQ ID NO: 151598 - DNA, 25 bp, Mus musculus
tgtgtgaagaccttggagcagccct

SEQ ID NO: 151599 - DNA, 25 bp, Mus musculus
tgtgtgaagcaaaaggcgaacctca

SEQ ID NO: 151600 - DNA, 25 bp, Mus musculus
tgtgtgaagcccctcaagcagaagc

SEQ ID NO: 151601 - DNA, 25 bp, Mus musculus
tgtgtgaagcccgacgtcagcgtct

SEQ ID NO: 151602 - DNA, 25 bp, Mus musculus
tgtgtgaaggaaagctagttgcccc

SEQ ID NO: 151603 - DNA, 25 bp, Mus musculus
tgtgtgacaagcctcctaaccctgt

SEQ ID NO: 151604 - DNA, 25 bp, Mus musculus
tgtgtgacagcgagtggtacccatc

SEQ ID NO: 151605 - DNA, 25 bp, Mus musculus
tgtgtgacattgatgccccattgct

SEQ ID NO: 151606 - DNA, 25 bp, Mus musculus
tgtgtgacccacagagctactgtcc

SEQ ID NO: 151607 - DNA, 25 bp, Mus musculus
tgtgtgactcatcagaagtttgcca

SEQ ID NO: 151608 - DNA, 25 bp, Mus musculus
tgtgtgagaacattgccggccacct

SEQ ID NO: 151609 - DNA, 25 bp, Mus musculus
tgtgtgagatagtgagatttatgtt

SEQ ID NO: 151610 - DNA, 25 bp, Mus musculus
tgtgtgagcaaagagcgcagctcct

SEQ ID NO: 151611 - DNA, 25 bp, Mus musculus
tgtgtgagccatccttgagtggcaa

SEQ ID NO: 151612 - DNA, 25 bp, Mus musculus
tgtgtgagcctttgactagcctgga

SEQ ID NO: 151613 - DNA, 25 bp, Mus musculus
tgtgtgagctatgcaagcaaaaacc

SEQ ID NO: 151614 - DNA, 25 bp, Mus musculus
tgtgtgatagcacggaaatgtcccg

SEQ ID NO: 151615 - DNA, 25 bp, Mus musculus
tgtgtgatcactcccagcacagacc

SEQ ID NO: 151616 - DNA, 25 bp, Mus musculus
tgtgtgatcccctacttcagagcca

SEQ ID NO: 151617 - DNA, 25 bp, Mus musculus
tgtgtgatctctacccaactgtcca

SEQ ID NO: 151618 - DNA, 25 bp, Mus musculus
tgtgtgcaacggtgccctagagact

SEQ ID NO: 151619 - DNA, 25 bp, Mus musculus
tgtgtgcacagagcgaccaggatct

SEQ ID NO: 151620 - DNA, 25 bp, Mus musculus
tgtgtgcacgcagcaagatggcatt

SEQ ID NO: 151621 - DNA, 25 bp, Mus musculus
tgtgtgcatcctgttatccagggcg

SEQ ID NO: 151622 - DNA, 25 bp, Mus musculus
tgtgtgcatctgttcagccccgtgg

SEQ ID NO: 151623 - DNA, 25 bp, Mus musculus
tgtgtgcattcctgatgaggcagac

SEQ ID NO: 151624 - DNA, 25 bp, Mus musculus
tgtgtgccagaaaaggttccgtcag

SEQ ID NO: 151625 - DNA, 25 bp, Mus musculus
tgtgtgcccaatccctgtgtgaatg

SEQ ID NO: 151626 - DNA, 25 bp, Mus musculus
tgtgtgcccacttcaacagcatcaa

SEQ ID NO: 151627 - DNA, 25 bp, Mus musculus
tgtgtgcccattgccaagcgtgagc

SEQ ID NO: 151628 - DNA, 25 bp, Mus musculus
tgtgtgccctgaattagtaccccaa

SEQ ID NO: 151629 - DNA, 25 bp, Mus musculus
tgtgtgccctggacattgacactgc

SEQ ID NO: 151630 - DNA, 25 bp, Mus musculus
tgtgtgcgctccacagtgcgactgg

SEQ ID NO: 151631 - DNA, 25 bp, Mus musculus
tgtgtgcgtccttcacgccggtgtg

SEQ ID NO: 151632 - DNA, 25 bp, Mus musculus
tgtgtgctaagctgatggcccaccc

SEQ ID NO: 151633 - DNA, 25 bp, Mus musculus
tgtgtgctacgcctgcagaactgcc

SEQ ID NO: 151634 - DNA, 25 bp, Mus musculus
tgtgtgctcatctaccatacggaca

SEQ ID NO: 151635 - DNA, 25 bp, Mus musculus
tgtgtgctgagacagatgccatgct

SEQ ID NO: 151636 - DNA, 25 bp, Mus musculus
tgtgtgctggaagctgccaaacaag

SEQ ID NO: 151637 - DNA, 25 bp, Mus musculus
tgtgtgcttcatcttcatggccggg

SEQ ID NO: 151638 - DNA, 25 bp, Mus musculus
tgtgtgcttggccaccacgaaactg

SEQ ID NO: 151639 - DNA, 25 bp, Mus musculus
tgtgtggaaaacagatcccagacct

SEQ ID NO: 151640 - DNA, 25 bp, Mus musculus
tgtgtggaaatccacccagaggccc

SEQ ID NO: 151641 - DNA, 25 bp, Mus musculus
tgtgtggacattggcgaaaccagag

SEQ ID NO: 151642 - DNA, 25 bp, Mus musculus
tgtgtggacgccaggaccaccgaag

SEQ ID NO: 151643 - DNA, 25 bp, Mus musculus
tgtgtggactgaactcaagctggcc

SEQ ID NO: 151644 - DNA, 25 bp, Mus musculus
tgtgtggatcttttgccgcaccagg

SEQ ID NO: 151645 - DNA, 25 bp, Mus musculus
tgtgtggcaaagctgaagatactat

SEQ ID NO: 151646 - DNA, 25 bp, Mus musculus
tgtgtggcacacatcgcaccaaggt

SEQ ID NO: 151647 - DNA, 25 bp, Mus musculus
tgtgtggcatcctcctctatgagaa

SEQ ID NO: 151648 - DNA, 25 bp, Mus musculus
tgtgtggccaaaaacagcctgggca

SEQ ID NO: 151649 - DNA, 25 bp, Mus musculus
tgtgtggccgagactcccttggtag

SEQ ID NO: 151650 - DNA, 25 bp, Mus musculus
tgtgtggccgatctcactgcgcatt

SEQ ID NO: 151651 - DNA, 25 bp, Mus musculus
tgtgtggccgtgacaaatctcagcg

SEQ ID NO: 151652 - DNA, 25 bp, Mus musculus
tgtgtggctatgttgcggaccctct

SEQ ID NO: 151653 - DNA, 25 bp, Mus musculus
tgtgtggctctacccagaaggcatc

SEQ ID NO: 151654 - DNA, 25 bp, Mus musculus
tgtgtggctctcagtgattacgacc

SEQ ID NO: 151655 - DNA, 25 bp, Mus musculus
tgtgtgggatatttggcagccttca

SEQ ID NO: 151656 - DNA, 25 bp, Mus musculus
tgtgtggtagcagcaaaatcctcat

SEQ ID NO: 151657 - DNA, 25 bp, Mus musculus
tgtgtggtcaacgagagctccctga

SEQ ID NO: 151658 - DNA, 25 bp, Mus musculus
tgtgtggtctaaggcaagccagccg

SEQ ID NO: 151659 - DNA, 25 bp, Mus musculus
tgtgtggtgaccaagcagggttccc

SEQ ID NO: 151660 - DNA, 25 bp, Mus musculus
tgtgtggtgagctgccgccttgcca

SEQ ID NO: 151661 - DNA, 25 bp, Mus musculus
tgtgtggttccttgcttttgacgga

SEQ ID NO: 151662 - DNA, 25 bp, Mus musculus
tgtgtggttgcttttgtcacctcca

SEQ ID NO: 151663 - DNA, 25 bp, Mus musculus
tgtgtgtaacacgaagcaggacaat

SEQ ID NO: 151664 - DNA, 25 bp, Mus musculus
tgtgtgtaccgagcagtcatgagaa

SEQ ID NO: 151665 - DNA, 25 bp, Mus musculus
tgtgtgtacttctctcctaatttga

SEQ ID NO: 151666 - DNA, 25 bp, Mus musculus
tgtgtgtcaatcaggtgctcacggc

SEQ ID NO: 151667 - DNA, 25 bp, Mus musculus
tgtgtgtcacatccggtcaggtcga

SEQ ID NO: 151668 - DNA, 25 bp, Mus musculus
tgtgtgtccacccatggctgagacg

SEQ ID NO: 151669 - DNA, 25 bp, Mus musculus
tgtgtgtgcactaatgaggatccta

SEQ ID NO: 151670 - DNA, 25 bp, Mus musculus
tgtgtgtgccgactgtaacctcaac

SEQ ID NO: 151671 - DNA, 25 bp, Mus musculus
tgtgtgtgcgagaggcaactgcgca

SEQ ID NO: 151672 - DNA, 25 bp, Mus musculus
tgtgtgtgggacagacatagactac

SEQ ID NO: 151673 - DNA, 25 bp, Mus musculus
tgtgtgtgtcaaacatgatgaagtc

SEQ ID NO: 151674 - DNA, 25 bp, Mus musculus
tgtgtgttcacttcccaaatcccag

SEQ ID NO: 151675 - DNA, 25 bp, Mus musculus
tgtgttacactcatggccaagggcc

SEQ ID NO: 151676 - DNA, 25 bp, Mus musculus
tgtgttacggccctgagtcgctcat

SEQ ID NO: 151677 - DNA, 25 bp, Mus musculus
tgtgttactgcagctctctcgtggg

SEQ ID NO: 151678 - DNA, 25 bp, Mus musculus
tgtgttagaagaagatggcggaccc

SEQ ID NO: 151679 - DNA, 25 bp, Mus musculus
tgtgttcaacactcaagctcgggcc

SEQ ID NO: 151680 - DNA, 25 bp, Mus musculus
tgtgttcacggtatacctgggcccc

SEQ ID NO: 151681 - DNA, 25 bp, Mus musculus
tgtgttcagatacttggttcccagc

SEQ ID NO: 151682 - DNA, 25 bp, Mus musculus
tgtgttccacctccattcaccgaaa

SEQ ID NO: 151683 - DNA, 25 bp, Mus musculus
tgtgttccactaaagccggcagtcg

SEQ ID NO: 151684 - DNA, 25 bp, Mus musculus
tgtgttccacttccaagcatgaggg

SEQ ID NO: 151685 - DNA, 25 bp, Mus musculus
tgtgttccagcaaacggttcccagg

SEQ ID NO: 151686 - DNA, 25 bp, Mus musculus
tgtgttccccaaccaggatgagatg

SEQ ID NO: 151687 - DNA, 25 bp, Mus musculus
tgtgttcccggtgcccaaaaggata

SEQ ID NO: 151688 - DNA, 25 bp, Mus musculus
tgtgttcggagaaatagaccgatga

SEQ ID NO: 151689 - DNA, 25 bp, Mus musculus
tgtgttctatgaaaggctgcatgag

SEQ ID NO: 151690 - DNA, 25 bp, Mus musculus
tgtgttctggattgcacctagtgtc

SEQ ID NO: 151691 - DNA, 25 bp, Mus musculus
tgtgttctgtgtaccgctcctgggt

SEQ ID NO: 151692 - DNA, 25 bp, Mus musculus
tgtgttcttcgaggttccggacagg

SEQ ID NO: 151693 - DNA, 25 bp, Mus musculus
tgtgttgacacagcaggagcttgca

SEQ ID NO: 151694 - DNA, 25 bp, Mus musculus
tgtgttgagttccatcctgctgcag

SEQ ID NO: 151695 - DNA, 25 bp, Mus musculus
tgtgttgcatactttctaaggcggt

SEQ ID NO: 151696 - DNA, 25 bp, Mus musculus
tgtgttggatcagtttgacaaacag

SEQ ID NO: 151697 - DNA, 25 bp, Mus musculus
tgtgttgtgcctcttaccgtgtcca

SEQ ID NO: 151698 - DNA, 25 bp, Mus musculus
tgtgtttaatctgtgccgtggctgc

SEQ ID NO: 151699 - DNA, 25 bp, Mus musculus
tgtgtttaccgacgagcaacgccta

SEQ ID NO: 151700 - DNA, 25 bp, Mus musculus
tgtgtttacctgtgagcatctctcg

SEQ ID NO: 151701 - DNA, 25 bp, Mus musculus
tgtgtttcaaaaggacaaaggacag

SEQ ID NO: 151702 - DNA, 25 bp, Mus musculus
tgtgtttcaatagcgccaggatact

SEQ ID NO: 151703 - DNA, 25 bp, Mus musculus
tgtgtttccacacccgaggctgtgt

SEQ ID NO: 151704 - DNA, 25 bp, Mus musculus
tgtgtttccagtagtcatccaggct

SEQ ID NO: 151705 - DNA, 25 bp, Mus musculus
tgtgtttcccaaggcttatgagctg

SEQ ID NO: 151706 - DNA, 25 bp, Mus musculus
tgtgtttcctaaagtacgaaggcgg

SEQ ID NO: 151707 - DNA, 25 bp, Mus musculus
tgtgtttgcagtgtggaccctccag

SEQ ID NO: 151708 - DNA, 25 bp, Mus musculus
tgtgtttgccagaatcgtagctgcg

SEQ ID NO: 151709 - DNA, 25 bp, Mus musculus
tgtgtttgcctggaagtccctcgcc

SEQ ID NO: 151710 - DNA, 25 bp, Mus musculus
tgtgtttgctggaagtgatgacccc

SEQ ID NO: 151711 - DNA, 25 bp, Mus musculus
tgtgtttgcttcctgtgttgttgtc

SEQ ID NO: 151712 - DNA, 25 bp, Mus musculus
tgtgtttgtggacccatcaggccgc

SEQ ID NO: 151713 - DNA, 25 bp, Mus musculus
tgtgttttaatcacctgtcggcaac

SEQ ID NO: 151714 - DNA, 25 bp, Mus musculus
tgtgttttacagcactttgggtgga

SEQ ID NO: 151715 - DNA, 25 bp, Mus musculus
tgtgttttccgaactgcggctggac

SEQ ID NO: 151716 - DNA, 25 bp, Mus musculus
tgtgttttctcgtgaccccaatggc

SEQ ID NO: 151717 - DNA, 25 bp, Mus musculus
tgtgttttctctgtcaagtactgca

SEQ ID NO: 151718 - DNA, 25 bp, Mus musculus
tgttaaaaacatttggccagctgca

SEQ ID NO: 151719 - DNA, 25 bp, Mus musculus
tgttaaaagactcctgaataaactg

SEQ ID NO: 151720 - DNA, 25 bp, Mus musculus
tgttaaaatacactcccaaggaaga

SEQ ID NO: 151721 - DNA, 25 bp, Mus musculus
tgttaaaatcatgaaccaggctgtg

SEQ ID NO: 151722 - DNA, 25 bp, Mus musculus
tgttaaagccatcgtgaatagctgc

SEQ ID NO: 151723 - DNA, 25 bp, Mus musculus
tgttaaaggatcaccacgatgcctg

SEQ ID NO: 151724 - DNA, 25 bp, Mus musculus
tgttaaaggccgtgtccaagcccct

SEQ ID NO: 151725 - DNA, 25 bp, Mus musculus
tgttaaaggcgtggtctgccaggcc

SEQ ID NO: 151726 - DNA, 25 bp, Mus musculus
tgttaaatagcatcccacgagctgc

SEQ ID NO: 151727 - DNA, 25 bp, Mus musculus
tgttaacaacgatggattcctggat

SEQ ID NO: 151728 - DNA, 25 bp, Mus musculus
tgttaacactgcctagggttctgct

SEQ ID NO: 151729 - DNA, 25 bp, Mus musculus
tgttaacatcttggaaaactaccta

SEQ ID NO: 151730 - DNA, 25 bp, Mus musculus
tgttaaccaacctagagagcctctc

SEQ ID NO: 151731 - DNA, 25 bp, Mus musculus
tgttaaccgtggtgtgtccctggga

SEQ ID NO: 151732 - DNA, 25 bp, Mus musculus
tgttaactctttcaggcctcgcgtg

SEQ ID NO: 151733 - DNA, 25 bp, Mus musculus
tgttaactgttgttggcagtgtaat

SEQ ID NO: 151734 - DNA, 25 bp, Mus musculus
tgttaacttgtgtggacgacagcct

SEQ ID NO: 151735 - DNA, 25 bp, Mus musculus
tgttaagaataaccagctccgggct

SEQ ID NO: 151736 - DNA, 25 bp, Mus musculus
tgttaagagaactcaaaaacacacc

SEQ ID NO: 151737 - DNA, 25 bp, Mus musculus
tgttaagcaacaataagaaactgag

SEQ ID NO: 151738 - DNA, 25 bp, Mus musculus
tgttaagcacccatgaccagccatc

SEQ ID NO: 151739 - DNA, 25 bp, Mus musculus
tgttaagcactcatagtcagctggg

SEQ ID NO: 151740 - DNA, 25 bp, Mus musculus
tgttaagcagaagattcacgtccgg

SEQ ID NO: 151741 - DNA, 25 bp, Mus musculus
tgttaaggacttagtgcagcccgtt

SEQ ID NO: 151742 - DNA, 25 bp, Mus musculus
tgttaaggcattatccacaggcaca

SEQ ID NO: 151743 - DNA, 25 bp, Mus musculus
tgttaaggcccaattctagagctgg

SEQ ID NO: 151744 - DNA, 25 bp, Mus musculus
tgttaagggaattcacttttgtcac

SEQ ID NO: 151745 - DNA, 25 bp, Mus musculus
tgttaataagaagcccaaggtcctg

SEQ ID NO: 151746 - DNA, 25 bp, Mus musculus
tgttaatagcacatatgccactttg

SEQ ID NO: 151747 - DNA, 25 bp, Mus musculus
tgttaatccagaccacagcgttctt

SEQ ID NO: 151748 - DNA, 25 bp, Mus musculus
tgttaatgcccacatgtaaagccat

SEQ ID NO: 151749 - DNA, 25 bp, Mus musculus
tgttaatgcgccatcagagagtcca

SEQ ID NO: 151750 - DNA, 25 bp, Mus musculus
tgttaatggaccagtctcatgctcc

SEQ ID NO: 151751 - DNA, 25 bp, Mus musculus
tgttaatggagcaggaacggcagca

SEQ ID NO: 151752 - DNA, 25 bp, Mus musculus
tgttaatgtcatcagctggagccgc

SEQ ID NO: 151753 - DNA, 25 bp, Mus musculus
tgttaattccagaccctcaggctgc

SEQ ID NO: 151754 - DNA, 25 bp, Mus musculus
tgttaattcccatcaggccacagga

SEQ ID NO: 151755 - DNA, 25 bp, Mus musculus
tgttacaatcttgggcttttgctag

SEQ ID NO: 151756 - DNA, 25 bp, Mus musculus
tgttacagaaagatgggctcctcct

SEQ ID NO: 151757 - DNA, 25 bp, Mus musculus
tgttacagaataagctggctctgga

SEQ ID NO: 151758 - DNA, 25 bp, Mus musculus
tgttacagaattcgccttggcccag

SEQ ID NO: 151759 - DNA, 25 bp, Mus musculus
tgttacaggtatgctaagaaggccc

SEQ ID NO: 151760 - DNA, 25 bp, Mus musculus
tgttacataaccacaagggaggcct

SEQ ID NO: 151761 - DNA, 25 bp, Mus musculus
tgttacattctctatctgcgcacgt

SEQ ID NO: 151762 - DNA, 25 bp, Mus musculus
tgttaccaccagagaaagacgccat

SEQ ID NO: 151763 - DNA, 25 bp, Mus musculus
tgttaccactacttaaaactcctgt

SEQ ID NO: 151764 - DNA, 25 bp, Mus musculus
tgttaccagggctattgggacagcc

SEQ ID NO: 151765 - DNA, 25 bp, Mus musculus
tgttaccccagatgtagcagtgtcc

SEQ ID NO: 151766 - DNA, 25 bp, Mus musculus
tgttacctggacactaaacctgaga

SEQ ID NO: 151767 - DNA, 25 bp, Mus musculus
tgttacctgtgggtcctgctctcca

SEQ ID NO: 151768 - DNA, 25 bp, Mus musculus
tgttacggaggtcacggacttcacc

SEQ ID NO: 151769 - DNA, 25 bp, Mus musculus
tgttacgtgcttatggccaggcggc

SEQ ID NO: 151770 - DNA, 25 bp, Mus musculus
tgttacgtttccagctatgcacgcc

SEQ ID NO: 151771 - DNA, 25 bp, Mus musculus
tgttactacagttggaggaacctcc

SEQ ID NO: 151772 - DNA, 25 bp, Mus musculus
tgttactaccgctcaggaaaggctt

SEQ ID NO: 151773 - DNA, 25 bp, Mus musculus
tgttactagaggaggagatcccgtc

SEQ ID NO: 151774 - DNA, 25 bp, Mus musculus
tgttactattcaaggtgtgctccgg

SEQ ID NO: 151775 - DNA, 25 bp, Mus musculus
tgttactcgtgccaagaagcggctc

SEQ ID NO: 151776 - DNA, 25 bp, Mus musculus
tgttactgaaacagcatatagttcc

SEQ ID NO: 151777 - DNA, 25 bp, Mus musculus
tgttactgccaagaagcaccctgat

SEQ ID NO: 151778 - DNA, 25 bp, Mus musculus
tgttactggctctcatcactgtggc

SEQ ID NO: 151779 - DNA, 25 bp, Mus musculus
tgttactgtcccacatcgaggccta

SEQ ID NO: 151780 - DNA, 25 bp, Mus musculus
tgttactgtcttagccgcagagctg

SEQ ID NO: 151781 - DNA, 25 bp, Mus musculus
tgttacttaagaccaggccgctcct

SEQ ID NO: 151782 - DNA, 25 bp, Mus musculus
tgttacttccagattcagcgggaga

SEQ ID NO: 151783 - DNA, 25 bp, Mus musculus
tgttacttcttctctgtggcccaga

SEQ ID NO: 151784 - DNA, 25 bp, Mus musculus
tgttacttctttcaaggacaagcag

SEQ ID NO: 151785 - DNA, 25 bp, Mus musculus
tgttacttgaaacccagcaggaagg

SEQ ID NO: 151786 - DNA, 25 bp, Mus musculus
tgttagaacacctcctagagaagga

SEQ ID NO: 151787 - DNA, 25 bp, Mus musculus
tgttagaagagctcatctctgcccg

SEQ ID NO: 151788 - DNA, 25 bp, Mus musculus
tgttagacaagtgcctcctggtgcc

SEQ ID NO: 151789 - DNA, 25 bp, Mus musculus
tgttagacatggcagagaacgcgtt

SEQ ID NO: 151790 - DNA, 25 bp, Mus musculus
tgttagaccctcatcctgaaggagc

SEQ ID NO: 151791 - DNA, 25 bp, Mus musculus
tgttagagaagtcattgttgtggcc

SEQ ID NO: 151792 - DNA, 25 bp, Mus musculus
tgttagagacaggaagcccaatgcc

SEQ ID NO: 151793 - DNA, 25 bp, Mus musculus
tgttagagttatggaacccgaccct

SEQ ID NO: 151794 - DNA, 25 bp, Mus musculus
tgttagagttcgaccctgctcagcg

SEQ ID NO: 151795 - DNA, 25 bp, Mus musculus
tgttagcaggtcacgtgtgcacagc

SEQ ID NO: 151796 - DNA, 25 bp, Mus musculus
tgttagcatctgaattcctgtggag

SEQ ID NO: 151797 - DNA, 25 bp, Mus musculus
tgttagcccaacagttacccagacg

SEQ ID NO: 151798 - DNA, 25 bp, Mus musculus
tgttagcccagaaagggatcttgcc

SEQ ID NO: 151799 - DNA, 25 bp, Mus musculus
tgttagccggctatgacgacttcaa

SEQ ID NO: 151800 - DNA, 25 bp, Mus musculus
tgttagctcaggctctgctcaggac

SEQ ID NO: 151801 - DNA, 25 bp, Mus musculus
tgttagctctcataccgtccaagtg

SEQ ID NO: 151802 - DNA, 25 bp, Mus musculus
tgttagctgactctcactgggcggc

SEQ ID NO: 151803 - DNA, 25 bp, Mus musculus
tgttaggaccataggcagtgcagct

SEQ ID NO: 151804 - DNA, 25 bp, Mus musculus
tgttaggctgagagcggaacgcttc

SEQ ID NO: 151805 - DNA, 25 bp, Mus musculus
tgttagggagtcttgaaggcacacc

SEQ ID NO: 151806 - DNA, 25 bp, Mus musculus
tgttaggtctcaaaagagccgcgcg

SEQ ID NO: 151807 - DNA, 25 bp, Mus musculus
tgttagtaacctggccgggagcaga

SEQ ID NO: 151808 - DNA, 25 bp, Mus musculus
tgttagtccccacaaaggccaagtt

SEQ ID NO: 151809 - DNA, 25 bp, Mus musculus
tgttagtgactatgaacttcaggac

SEQ ID NO: 151810 - DNA, 25 bp, Mus musculus
tgttagttgacatggctgcgcccgt

SEQ ID NO: 151811 - DNA, 25 bp, Mus musculus
tgttatagcacagacaaccggcctc

SEQ ID NO: 151812 - DNA, 25 bp, Mus musculus
tgttataggacttgaccagccccaa

SEQ ID NO: 151813 - DNA, 25 bp, Mus musculus
tgttatatccagctcagacttgcga

SEQ ID NO: 151814 - DNA, 25 bp, Mus musculus
tgttatatgctgagccacgacaggg

SEQ ID NO: 151815 - DNA, 25 bp, Mus musculus
tgttatcagaaagcccgccaagctt

SEQ ID NO: 151816 - DNA, 25 bp, Mus musculus
tgttatcagactccaagcaatatgg

SEQ ID NO: 151817 - DNA, 25 bp, Mus musculus
tgttatccttactcatcgggtggcc

SEQ ID NO: 151818 - DNA, 25 bp, Mus musculus
tgttatctccctgtggcgttccgga

SEQ ID NO: 151819 - DNA, 25 bp, Mus musculus
tgttatctgccttaagtcgagagcc

SEQ ID NO: 151820 - DNA, 25 bp, Mus musculus
tgttatgcacatccctttggcccct

SEQ ID NO: 151821 - DNA, 25 bp, Mus musculus
tgttatgcagaaaaccgccgagcct

SEQ ID NO: 151822 - DNA, 25 bp, Mus musculus
tgttatgtcacaagttacctgagag

SEQ ID NO: 151823 - DNA, 25 bp, Mus musculus
tgttatgtgatgcattaccagaaga

SEQ ID NO: 151824 - DNA, 25 bp, Mus musculus
tgttattcagtcaaggaggctctcc

SEQ ID NO: 151825 - DNA, 25 bp, Mus musculus
tgttattccctctctgcaacgaagg

SEQ ID NO: 151826 - DNA, 25 bp, Mus musculus
tgttcaaaagcaccggaaaatcctg

SEQ ID NO: 151827 - DNA, 25 bp, Mus musculus
tgttcaaacacaagcggagccgtga

SEQ ID NO: 151828 - DNA, 25 bp, Mus musculus
tgttcaaatgatcgaagctggctgt

SEQ ID NO: 151829 - DNA, 25 bp, Mus musculus
tgttcaacaacgtggacggccatct

SEQ ID NO: 151830 - DNA, 25 bp, Mus musculus
tgttcaacacacataccggactggc

SEQ ID NO: 151831 - DNA, 25 bp, Mus musculus
tgttcaacagactggtgactgaccc

SEQ ID NO: 151832 - DNA, 25 bp, Mus musculus
tgttcaaccagcaaagagagcgtgg

SEQ ID NO: 151833 - DNA, 25 bp, Mus musculus
tgttcaagaactacgacccagaagg

SEQ ID NO: 151834 - DNA, 25 bp, Mus musculus
tgttcaagaagaatccagtcccacg

SEQ ID NO: 151835 - DNA, 25 bp, Mus musculus
tgttcaagcccagaaatgccttatg

SEQ ID NO: 151836 - DNA, 25 bp, Mus musculus
tgttcaaggtatgagggaggcccaa

SEQ ID NO: 151837 - DNA, 25 bp, Mus musculus
tgttcaagtcaaaactgcagctgct

SEQ ID NO: 151838 - DNA, 25 bp, Mus musculus
tgttcaagtcctggatccactgctg

SEQ ID NO: 151839 - DNA, 25 bp, Mus musculus
tgttcaatatgttgcctggagctcc

SEQ ID NO: 151840 - DNA, 25 bp, Mus musculus
tgttcaatgaccagagttcctcgga

SEQ ID NO: 151841 - DNA, 25 bp, Mus musculus
tgttcaatgagttgcggagcgacct

SEQ ID NO: 151842 - DNA, 25 bp, Mus musculus
tgttcacacccgcaaggtcactgga

SEQ ID NO: 151843 - DNA, 25 bp, Mus musculus
tgttcacacgagagtgcatgagcca

SEQ ID NO: 151844 - DNA, 25 bp, Mus musculus
tgttcacacggaagccgtgcaagca

SEQ ID NO: 151845 - DNA, 25 bp, Mus musculus
tgttcacacgtatggacaggcctcg

SEQ ID NO: 151846 - DNA, 25 bp, Mus musculus
tgttcacactgttggctagcctgac

SEQ ID NO: 151847 - DNA, 25 bp, Mus musculus
tgttcacagtgcgacagcaagccgc

SEQ ID NO: 151848 - DNA, 25 bp, Mus musculus
tgttcacatcttccctatagacagg

SEQ ID NO: 151849 - DNA, 25 bp, Mus musculus
tgttcaccagactggtgtctgttgg

SEQ ID NO: 151850 - DNA, 25 bp, Mus musculus
tgttcaccatccataaaagcacggg

SEQ ID NO: 151851 - DNA, 25 bp, Mus musculus
tgttcaccgagcgaggcgttattcc

SEQ ID NO: 151852 - DNA, 25 bp, Mus musculus
tgttcaccgcctttcagacttgtgg

SEQ ID NO: 151853 - DNA, 25 bp, Mus musculus
tgttcaccggcaacaacaagatctg

SEQ ID NO: 151854 - DNA, 25 bp, Mus musculus
tgttcacctaacgtttgctctgagg

SEQ ID NO: 151855 - DNA, 25 bp, Mus musculus
tgttcacctaactgttggagtccca

SEQ ID NO: 151856 - DNA, 25 bp, Mus musculus
tgttcaccttgggtgccgcagcagg

SEQ ID NO: 151857 - DNA, 25 bp, Mus musculus
tgttcacgacacttcccttttttgc

SEQ ID NO: 151858 - DNA, 25 bp, Mus musculus
tgttcacgatgactggataggctgc

SEQ ID NO: 151859 - DNA, 25 bp, Mus musculus
tgttcacggcggaaaagctccttct

SEQ ID NO: 151860 - DNA, 25 bp, Mus musculus
tgttcactgcccgatatctggacct

SEQ ID NO: 151861 - DNA, 25 bp, Mus musculus
tgttcagaaaccaagcagtggcctg

SEQ ID NO: 151862 - DNA, 25 bp, Mus musculus
tgttcagacagaggacgaccagctc

SEQ ID NO: 151863 - DNA, 25 bp, Mus musculus
tgttcagcaaagacaagttccctgg

SEQ ID NO: 151864 - DNA, 25 bp, Mus musculus
tgttcagcacaagctcaaggaggcg

SEQ ID NO: 151865 - DNA, 25 bp, Mus musculus
tgttcagcagggactcggtggacct

SEQ ID NO: 151866 - DNA, 25 bp, Mus musculus
tgttcagccaggtagtgagactgca

SEQ ID NO: 151867 - DNA, 25 bp, Mus musculus
tgttcagcgctctgctcaccaagtg

SEQ ID NO: 151868 - DNA, 25 bp, Mus musculus
tgttcagcgctgagaacgggaagta

SEQ ID NO: 151869 - DNA, 25 bp, Mus musculus
tgttcagctgtacaacggagaaacc

SEQ ID NO: 151870 - DNA, 25 bp, Mus musculus
tgttcaggaacccaactcgcattgt

SEQ ID NO: 151871 - DNA, 25 bp, Mus musculus
tgttcaggccaagtagaaccccaga

SEQ ID NO: 151872 - DNA, 25 bp, Mus musculus
tgttcaggtccagttcagactcttg

SEQ ID NO: 151873 - DNA, 25 bp, Mus musculus
tgttcaggtgcagagcaagcaggcc

SEQ ID NO: 151874 - DNA, 25 bp, Mus musculus
tgttcagtacaaatggccaaggtgg

SEQ ID NO: 151875 - DNA, 25 bp, Mus musculus
tgttcagtctcaccaagaagcagct

SEQ ID NO: 151876 - DNA, 25 bp, Mus musculus
tgttcagtctggacacggaagccct

SEQ ID NO: 151877 - DNA, 25 bp, Mus musculus
tgttcagtcttactagaaggaccgt

SEQ ID NO: 151878 - DNA, 25 bp, Mus musculus
tgttcagttagatcttcaccagcgg

SEQ ID NO: 151879 - DNA, 25 bp, Mus musculus
tgttcagtttcgaggcagagtccgg

SEQ ID NO: 151880 - DNA, 25 bp, Mus musculus
tgttcataacaggaccaggtgcgca

SEQ ID NO: 151881 - DNA, 25 bp, Mus musculus
tgttcataagatctacccaagcgcg

SEQ ID NO: 151882 - DNA, 25 bp, Mus musculus
tgttcatcagataccagcagtgtca

SEQ ID NO: 151883 - DNA, 25 bp, Mus musculus
tgttcatcatcgagggtcatgcgcc

SEQ ID NO: 151884 - DNA, 25 bp, Mus musculus
tgttcatccagtcatctccgctgat

SEQ ID NO: 151885 - DNA, 25 bp, Mus musculus
tgttcatccgtgagctgtctgagga

SEQ ID NO: 151886 - DNA, 25 bp, Mus musculus
tgttcatcgtggttcacagggcaag

SEQ ID NO: 151887 - DNA, 25 bp, Mus musculus
tgttcatctatactacgttggtggg

SEQ ID NO: 151888 - DNA, 25 bp, Mus musculus
tgttcatctggaagccgagaagcct

SEQ ID NO: 151889 - DNA, 25 bp, Mus musculus
tgttcatgaagacgcacaagaccgc

SEQ ID NO: 151890 - DNA, 25 bp, Mus musculus
tgttcatgaagatgacaaaaatggg

SEQ ID NO: 151891 - DNA, 25 bp, Mus musculus
tgttcatgaagccaaaccctcagtg

SEQ ID NO: 151892 - DNA, 25 bp, Mus musculus
tgttcatgacggaccgggaacggct

SEQ ID NO: 151893 - DNA, 25 bp, Mus musculus
tgttcatggctctaacagaccccag

SEQ ID NO: 151894 - DNA, 25 bp, Mus musculus
tgttcatgtcacaccaggacctgcg

SEQ ID NO: 151895 - DNA, 25 bp, Mus musculus
tgttcattgcttgtaaaaactcggg

SEQ ID NO: 151896 - DNA, 25 bp, Mus musculus
tgttcattgtaaagggtcaggccct

SEQ ID NO: 151897 - DNA, 25 bp, Mus musculus
tgttccaaagccaaatgcagagtgt

SEQ ID NO: 151898 - DNA, 25 bp, Mus musculus
tgttccacactcacaagcagcactg

SEQ ID NO: 151899 - DNA, 25 bp, Mus musculus
tgttccacgaacacaagccaggaag

SEQ ID NO: 151900 - DNA, 25 bp, Mus musculus
tgttccacgtgaacaagagcgggtt

SEQ ID NO: 151901 - DNA, 25 bp, Mus musculus
tgttccagaaataccacagtaggcg

SEQ ID NO: 151902 - DNA, 25 bp, Mus musculus
tgttccagaagcacatggacggact

SEQ ID NO: 151903 - DNA, 25 bp, Mus musculus
tgttccagagaaacgaagggcaacg

SEQ ID NO: 151904 - DNA, 25 bp, Mus musculus
tgttccaggaatgcgctgtgcgctc

SEQ ID NO: 151905 - DNA, 25 bp, Mus musculus
tgttccaggtagagggacagcctcc

SEQ ID NO: 151906 - DNA, 25 bp, Mus musculus
tgttccagtaatcaagagggagcct

SEQ ID NO: 151907 - DNA, 25 bp, Mus musculus
tgttccagtgtaaagctcacctcgt

SEQ ID NO: 151908 - DNA, 25 bp, Mus musculus
tgttccattggagcaacaccctgac

SEQ ID NO: 151909 - DNA, 25 bp, Mus musculus
tgttcccaaactgtcgccgtagcaa

SEQ ID NO: 151910 - DNA, 25 bp, Mus musculus
tgttcccaaagcttccagttgcaga

SEQ ID NO: 151911 - DNA, 25 bp, Mus musculus
tgttcccagattgataacaaggctg

SEQ ID NO: 151912 - DNA, 25 bp, Mus musculus
tgttcccagctgacactcataaaag

SEQ ID NO: 151913 - DNA, 25 bp, Mus musculus
tgttcccagggatgaaacgatcgtg

SEQ ID NO: 151914 - DNA, 25 bp, Mus musculus
tgttccccaacagaaagatccggat

SEQ ID NO: 151915 - DNA, 25 bp, Mus musculus
tgttccccgctaagaggctgtgcgt

SEQ ID NO: 151916 - DNA, 25 bp, Mus musculus
tgttccccggataggacatgctgag

SEQ ID NO: 151917 - DNA, 25 bp, Mus musculus
tgttccccgggtagaaatccttgca

SEQ ID NO: 151918 - DNA, 25 bp, Mus musculus
tgttccccgtacatttatctctttg

SEQ ID NO: 151919 - DNA, 25 bp, Mus musculus
tgttcccctagacgaaaaactcctg

SEQ ID NO: 151920 - DNA, 25 bp, Mus musculus
tgttcccgaacatggaggcctatgc

SEQ ID NO: 151921 - DNA, 25 bp, Mus musculus
tgttcccgcgcgtcctcggagttct

SEQ ID NO: 151922 - DNA, 25 bp, Mus musculus
tgttcccgcgtgatgccaaaatgct

SEQ ID NO: 151923 - DNA, 25 bp, Mus musculus
tgttcccggcgttggaaacagaact

SEQ ID NO: 151924 - DNA, 25 bp, Mus musculus
tgttcccgtctacagtcagcaccgt

SEQ ID NO: 151925 - DNA, 25 bp, Mus musculus
tgttccctaaggcagagctccgtac

SEQ ID NO: 151926 - DNA, 25 bp, Mus musculus
tgttccctctggaggttcgtcgtca

SEQ ID NO: 151927 - DNA, 25 bp, Mus musculus
tgttccctcttcaggtagcagcggg

SEQ ID NO: 151928 - DNA, 25 bp, Mus musculus
tgttccctgcagtatcttcacggta

SEQ ID NO: 151929 - DNA, 25 bp, Mus musculus
tgttccctggccatctgaagactag

SEQ ID NO: 151930 - DNA, 25 bp, Mus musculus
tgttccgaatgacacaacgctggcg

SEQ ID NO: 151931 - DNA, 25 bp, Mus musculus
tgttccgcacaggagcaaagtgtgc

SEQ ID NO: 151932 - DNA, 25 bp, Mus musculus
tgttccgcaccgcagtgatgatggc

SEQ ID NO: 151933 - DNA, 25 bp, Mus musculus
tgttccgcagcgacgggacccattt

SEQ ID NO: 151934 - DNA, 25 bp, Mus musculus
tgttccgcccaccactgagaacaag

SEQ ID NO: 151935 - DNA, 25 bp, Mus musculus
tgttccggagcatggcacgacagtt

SEQ ID NO: 151936 - DNA, 25 bp, Mus musculus
tgttccggcagcacagagctttgaa

SEQ ID NO: 151937 - DNA, 25 bp, Mus musculus
tgttccgggcccaaagcaaagatat

SEQ ID NO: 151938 - DNA, 25 bp, Mus musculus
tgttcctaagggacgtgcacctggc

SEQ ID NO: 151939 - DNA, 25 bp, Mus musculus
tgttcctacatgtcttaaggagctg

SEQ ID NO: 151940 - DNA, 25 bp, Mus musculus
tgttcctagccagcgaagcaactct

SEQ ID NO: 151941 - DNA, 25 bp, Mus musculus
tgttcctcaaagtcattcaagctgt

SEQ ID NO: 151942 - DNA, 25 bp, Mus musculus
tgttcctcactatctcgagggctgg

SEQ ID NO: 151943 - DNA, 25 bp, Mus musculus
tgttcctcatgtccttcgccgggat

SEQ ID NO: 151944 - DNA, 25 bp, Mus musculus
tgttcctcctggacccactagaagg

SEQ ID NO: 151945 - DNA, 25 bp, Mus musculus
tgttcctcttggagtgatcagcaga

SEQ ID NO: 151946 - DNA, 25 bp, Mus musculus
tgttcctgaacgaggtggccaagaa

SEQ ID NO: 151947 - DNA, 25 bp, Mus musculus
tgttcctgacgtcacccactgaggt

SEQ ID NO: 151948 - DNA, 25 bp, Mus musculus
tgttcctgagacaaggcctagccag

SEQ ID NO: 151949 - DNA, 25 bp, Mus musculus
tgttcctgcacacttcattggctgg

SEQ ID NO: 151950 - DNA, 25 bp, Mus musculus
tgttcctgcagctgaaacgcaagcg

SEQ ID NO: 151951 - DNA, 25 bp, Mus musculus
tgttcctggcaagaagcacttgtga

SEQ ID NO: 151952 - DNA, 25 bp, Mus musculus
tgttcctggcacttgacagccaagg

SEQ ID NO: 151953 - DNA, 25 bp, Mus musculus
tgttcctggcaggagagatccgaga

SEQ ID NO: 151954 - DNA, 25 bp, Mus musculus
tgttcctggcatctgcatatgcaag

SEQ ID NO: 151955 - DNA, 25 bp, Mus musculus
tgttcctgtggacaaagtggcctct

SEQ ID NO: 151956 - DNA, 25 bp, Mus musculus
tgttcctgtgtaagagcaagcgacc

SEQ ID NO: 151957 - DNA, 25 bp, Mus musculus
tgttcgaacccaatcacagctggca

SEQ ID NO: 151958 - DNA, 25 bp, Mus musculus
tgttcgacaccttcaacgacattga

SEQ ID NO: 151959 - DNA, 25 bp, Mus musculus
tgttcgacctggacaacgtgcgcta

SEQ ID NO: 151960 - DNA, 25 bp, Mus musculus
tgttcgacgagagccttagagcttg

SEQ ID NO: 151961 - DNA, 25 bp, Mus musculus
tgttcgactgaagctagagtgcaga

SEQ ID NO: 151962 - DNA, 25 bp, Mus musculus
tgttcgagcacgatactccatggaa

SEQ ID NO: 151963 - DNA, 25 bp, Mus musculus
tgttcgatgccgaggatggagccac

SEQ ID NO: 151964 - DNA, 25 bp, Mus musculus
tgttcgcacaaagcacaagattgac

SEQ ID NO: 151965 - DNA, 25 bp, Mus musculus
tgttcgccattttctcctgacagag

SEQ ID NO: 151966 - DNA, 25 bp, Mus musculus
tgttcgccgatcgaagcaggcattg

SEQ ID NO: 151967 - DNA, 25 bp, Mus musculus
tgttcgctacaactgcagagtcatc

SEQ ID NO: 151968 - DNA, 25 bp, Mus musculus
tgttcgcttcttgctaggccctgtg

SEQ ID NO: 151969 - DNA, 25 bp, Mus musculus
tgttcggaagccacctggacatcca

SEQ ID NO: 151970 - DNA, 25 bp, Mus musculus
tgttcggaaggaaagatgcccagtg

SEQ ID NO: 151971 - DNA, 25 bp, Mus musculus
tgttcggatgatgtctcggtgagcc

SEQ ID NO: 151972 - DNA, 25 bp, Mus musculus
tgttcggcagcgtcataggtatctc

SEQ ID NO: 151973 - DNA, 25 bp, Mus musculus
tgttcggcctaatgcatgggacctg

SEQ ID NO: 151974 - DNA, 25 bp, Mus musculus
tgttcgtacaggagagcggttacct

SEQ ID NO: 151975 - DNA, 25 bp, Mus musculus
tgttcgtcaagatctcgcagcccaa

SEQ ID NO: 151976 - DNA, 25 bp, Mus musculus
tgttcgtgacctatggagcacggcc

SEQ ID NO: 151977 - DNA, 25 bp, Mus musculus
tgttcgtgcacctgtacttgggcaa

SEQ ID NO: 151978 - DNA, 25 bp, Mus musculus
tgttcgtgggtctgaaaggctctgc

SEQ ID NO: 151979 - DNA, 25 bp, Mus musculus
tgttcgtgtacaagggacaacccca

SEQ ID NO: 151980 - DNA, 25 bp, Mus musculus
tgttcgttacaagcaagttcatgca

SEQ ID NO: 151981 - DNA, 25 bp, Mus musculus
tgttcgttcatttccgaggccgaga

SEQ ID NO: 151982 - DNA, 25 bp, Mus musculus
tgttcgttctcctgaccacagccaa

SEQ ID NO: 151983 - DNA, 25 bp, Mus musculus
tgttctaaatagcacttggctctgg

SEQ ID NO: 151984 - DNA, 25 bp, Mus musculus
tgttctaaccccagacccaaagatg

SEQ ID NO: 151985 - DNA, 25 bp, Mus musculus
tgttctaccagacaccgcagagtga

SEQ ID NO: 151986 - DNA, 25 bp, Mus musculus
tgttctacgtctgagatggagtgtg

SEQ ID NO: 151987 - DNA, 25 bp, Mus musculus
tgttctactgcaagcacgtggagcg

SEQ ID NO: 151988 - DNA, 25 bp, Mus musculus
tgttctatcacgaacacgggcacgt

SEQ ID NO: 151989 - DNA, 25 bp, Mus musculus
tgttctatgacatgggctcgggcag

SEQ ID NO: 151990 - DNA, 25 bp, Mus musculus
tgttctattgttccatcaccggagg

SEQ ID NO: 151991 - DNA, 25 bp, Mus musculus
tgttctcaacatcatgtgcgcggcc

SEQ ID NO: 151992 - DNA, 25 bp, Mus musculus
tgttctcaccagatcagtttcagag

SEQ ID NO: 151993 - DNA, 25 bp, Mus musculus
tgttctcatacatggctgggccctt

SEQ ID NO: 151994 - DNA, 25 bp, Mus musculus
tgttctcatgcgaacgggaaggagc

SEQ ID NO: 151995 - DNA, 25 bp, Mus musculus
tgttctccagacagctcctctgcgg

SEQ ID NO: 151996 - DNA, 25 bp, Mus musculus
tgttctcccacctacggcggattgg

SEQ ID NO: 151997 - DNA, 25 bp, Mus musculus
tgttctcccggatgcgagctctggt

SEQ ID NO: 151998 - DNA, 25 bp, Mus musculus
tgttctccggacatcaggcggaaga

SEQ ID NO: 151999 - DNA, 25 bp, Mus musculus
tgttctcctggcatacgacgttaag

SEQ ID NO: 152000 - DNA, 25 bp, Mus musculus
tgttctcgaatgcagttccctcagg

SEQ ID NO: 152001 - DNA, 25 bp, Mus musculus
tgttctctgagatcacaagtctgtc

SEQ ID NO: 152002 - DNA, 25 bp, Mus musculus
tgttctctggatataagctggcccc

SEQ ID NO: 152003 - DNA, 25 bp, Mus musculus
tgttctctttggcaaccactccaca

SEQ ID NO: 152004 - DNA, 25 bp, Mus musculus
tgttctgaaagcaaattatgagtat

SEQ ID NO: 152005 - DNA, 25 bp, Mus musculus
tgttctgacaaaacacctgaggagc

SEQ ID NO: 152006 - DNA, 25 bp, Mus musculus
tgttctgacagagtctgcggccaag

SEQ ID NO: 152007 - DNA, 25 bp, Mus musculus
tgttctgaggaaggacccagctttc

SEQ ID NO: 152008 - DNA, 25 bp, Mus musculus
tgttctgaggtaagctaatagcccc

SEQ ID NO: 152009 - DNA, 25 bp, Mus musculus
tgttctgataaagctagaggcccaa

SEQ ID NO: 152010 - DNA, 25 bp, Mus musculus
tgttctgccaaaaaccttcgagatg

SEQ ID NO: 152011 - DNA, 25 bp, Mus musculus
tgttctgccgctaccatgatgggaa

SEQ ID NO: 152012 - DNA, 25 bp, Mus musculus
tgttctgcgaaaaagctatggagct

SEQ ID NO: 152013 - DNA, 25 bp, Mus musculus
tgttctgcgaagacgagggaccttg

SEQ ID NO: 152014 - DNA, 25 bp, Mus musculus
tgttctgcgtgtaacagttcggtgg

SEQ ID NO: 152015 - DNA, 25 bp, Mus musculus
tgttctgctaacaagtggcctggtg

SEQ ID NO: 152016 - DNA, 25 bp, Mus musculus
tgttctgctgcgtggcgcgcctgca

SEQ ID NO: 152017 - DNA, 25 bp, Mus musculus
tgttctggacagagatggcaacggc

SEQ ID NO: 152018 - DNA, 25 bp, Mus musculus
tgttctgggaaaaagcaggcctcct

SEQ ID NO: 152019 - DNA, 25 bp, Mus musculus
tgttctgggaaattgctcgacgctg

SEQ ID NO: 152020 - DNA, 25 bp, Mus musculus
tgttctgggaataaagcacttgacc

SEQ ID NO: 152021 - DNA, 25 bp, Mus musculus
tgttctgggagagactccgccctgt

SEQ ID NO: 152022 - DNA, 25 bp, Mus musculus
tgttctggtccaggaaaggcagtac

SEQ ID NO: 152023 - DNA, 25 bp, Mus musculus
tgttctgtctagctccagtggctcc

SEQ ID NO: 152024 - DNA, 25 bp, Mus musculus
tgttctgtgcattttgggcccgcga

SEQ ID NO: 152025 - DNA, 25 bp, Mus musculus
tgttcttaagcaggcatcgcgtggt

SEQ ID NO: 152026 - DNA, 25 bp, Mus musculus
tgttcttaaggtgttccgaggctcc

SEQ ID NO: 152027 - DNA, 25 bp, Mus musculus
tgttcttcaatggaggcctgtgacc

SEQ ID NO: 152028 - DNA, 25 bp, Mus musculus
tgttcttcagcaagtggccactgca

SEQ ID NO: 152029 - DNA, 25 bp, Mus musculus
tgttcttcagcacgtacgacaggga

SEQ ID NO: 152030 - DNA, 25 bp, Mus musculus
tgttcttccacagattcaggccagt

SEQ ID NO: 152031 - DNA, 25 bp, Mus musculus
tgttcttccacccaccctctctttt

SEQ ID NO: 152032 - DNA, 25 bp, Mus musculus
tgttcttccccaagtggtactgccc

SEQ ID NO: 152033 - DNA, 25 bp, Mus musculus
tgttcttcgacacagagcgctactg

SEQ ID NO: 152034 - DNA, 25 bp, Mus musculus
tgttcttcgaggttccggacaggac

SEQ ID NO: 152035 - DNA, 25 bp, Mus musculus
tgttcttgatcctcaacctggagag

SEQ ID NO: 152036 - DNA, 25 bp, Mus musculus
tgttcttgtcttaacattacataga

SEQ ID NO: 152037 - DNA, 25 bp, Mus musculus
tgttctttgaccgaggacacattgc

SEQ ID NO: 152038 - DNA, 25 bp, Mus musculus
tgttgaaaagcgagccaaagccttc

SEQ ID NO: 152039 - DNA, 25 bp, Mus musculus
tgttgaaacacagcgacaaggaagc

SEQ ID NO: 152040 - DNA, 25 bp, Mus musculus
tgttgaaactggtacaagcacagca

SEQ ID NO: 152041 - DNA, 25 bp, Mus musculus
tgttgaaagacatcccacatttagc

SEQ ID NO: 152042 - DNA, 25 bp, Mus musculus
tgttgaaagccacatctggagagtc

SEQ ID NO: 152043 - DNA, 25 bp, Mus musculus
tgttgaacacctcctgaaagagcct

SEQ ID NO: 152044 - DNA, 25 bp, Mus musculus
tgttgaacagcagcgaaaaactatg

SEQ ID NO: 152045 - DNA, 25 bp, Mus musculus
tgttgaacgcaaacccctagtggcc

SEQ ID NO: 152046 - DNA, 25 bp, Mus musculus
tgttgaacgcaaactgctcaccacc

SEQ ID NO: 152047 - DNA, 25 bp, Mus musculus
tgttgaacggttcacaccagtgcct

SEQ ID NO: 152048 - DNA, 25 bp, Mus musculus
tgttgaagagccaggaccaaggccc

SEQ ID NO: 152049 - DNA, 25 bp, Mus musculus
tgttgaagattcagggaccaccgtg

SEQ ID NO: 152050 - DNA, 25 bp, Mus musculus
tgttgaagcaggatccaccagggat

SEQ ID NO: 152051 - DNA, 25 bp, Mus musculus
tgttgaagcctcgagaaaactggcc

SEQ ID NO: 152052 - DNA, 25 bp, Mus musculus
tgttgaagctcgatcctcacctact

SEQ ID NO: 152053 - DNA, 25 bp, Mus musculus
tgttgaagctgcagaagtggactca

SEQ ID NO: 152054 - DNA, 25 bp, Mus musculus
tgttgaagggttccatgacgccatc

SEQ ID NO: 152055 - DNA, 25 bp, Mus musculus
tgttgaatccaataagcctttccgg

SEQ ID NO: 152056 - DNA, 25 bp, Mus musculus
tgttgaatggcaccctcaggacagt

SEQ ID NO: 152057 - DNA, 25 bp, Mus musculus
tgttgacaaatctagaagcagctgc

SEQ ID NO: 152058 - DNA, 25 bp, Mus musculus
tgttgacaagatagttaagcggccc

SEQ ID NO: 152059 - DNA, 25 bp, Mus musculus
tgttgacagccccagagactggtat

SEQ ID NO: 152060 - DNA, 25 bp, Mus musculus
tgttgacagccctgatgactccact

SEQ ID NO: 152061 - DNA, 25 bp, Mus musculus
tgttgacagggatcagactggctcc

SEQ ID NO: 152062 - DNA, 25 bp, Mus musculus
tgttgacatctaaagccagcgtgaa

SEQ ID NO: 152063 - DNA, 25 bp, Mus musculus
tgttgaccatcgaggagcgctacct

SEQ ID NO: 152064 - DNA, 25 bp, Mus musculus
tgttgacctcagacgtggagaagtt

SEQ ID NO: 152065 - DNA, 25 bp, Mus musculus
tgttgacctctggtggagatgccca

SEQ ID NO: 152066 - DNA, 25 bp, Mus musculus
tgttgacctgaaccccatgacaaag

SEQ ID NO: 152067 - DNA, 25 bp, Mus musculus
tgttgacgaggactacgacctccgg

SEQ ID NO: 152068 - DNA, 25 bp, Mus musculus
tgttgacgttactggatgccggctc

SEQ ID NO: 152069 - DNA, 25 bp, Mus musculus
tgttgactccacgtgtgaggaccgt

SEQ ID NO: 152070 - DNA, 25 bp, Mus musculus
tgttgactgaccaaaacaggatgcg

SEQ ID NO: 152071 - DNA, 25 bp, Mus musculus
tgttgactggatcttgtagctaccg

SEQ ID NO: 152072 - DNA, 25 bp, Mus musculus
tgttgacttcacgatcactccggaa

SEQ ID NO: 152073 - DNA, 25 bp, Mus musculus
tgttgactttaagatgaagactatc

SEQ ID NO: 152074 - DNA, 25 bp, Mus musculus
tgttgagaaaaaggagcgacctctt

SEQ ID NO: 152075 - DNA, 25 bp, Mus musculus
tgttgagaaggattcctgttgtccc

SEQ ID NO: 152076 - DNA, 25 bp, Mus musculus
tgttgagatcatccgcatggcgtcc

SEQ ID NO: 152077 - DNA, 25 bp, Mus musculus
tgttgagatgaactccccatgactg

SEQ ID NO: 152078 - DNA, 25 bp, Mus musculus
tgttgagattgcagacaccgtacca

SEQ ID NO: 152079 - DNA, 25 bp, Mus musculus
tgttgagcaacatcagtcttcttgg

SEQ ID NO: 152080 - DNA, 25 bp, Mus musculus
tgttgagcacactaatccttgggac

SEQ ID NO: 152081 - DNA, 25 bp, Mus musculus
tgttgagcccaatgagagatgcccc

SEQ ID NO: 152082 - DNA, 25 bp, Mus musculus
tgttgagcccattcagtagccgagt

SEQ ID NO: 152083 - DNA, 25 bp, Mus musculus
tgttgagctagccttccagactgtc

SEQ ID NO: 152084 - DNA, 25 bp, Mus musculus
tgttgaggacgatccagagctaccg

SEQ ID NO: 152085 - DNA, 25 bp, Mus musculus
tgttgaggcctatcaaaatcgagcc

SEQ ID NO: 152086 - DNA, 25 bp, Mus musculus
tgttgagggctcacaacagtcccct

SEQ ID NO: 152087 - DNA, 25 bp, Mus musculus
tgttgagtctagaccacattctcgc

SEQ ID NO: 152088 - DNA, 25 bp, Mus musculus
tgttgagtgataagaatgactgtaa

SEQ ID NO: 152089 - DNA, 25 bp, Mus musculus
tgttgatagcctcagaaagcctgcc

SEQ ID NO: 152090 - DNA, 25 bp, Mus musculus
tgttgatatgccaagcagagggcag

SEQ ID NO: 152091 - DNA, 25 bp, Mus musculus
tgttgatccacaacttgcggcccag

SEQ ID NO: 152092 - DNA, 25 bp, Mus musculus
tgttgattttcagcctttgcaccaa

SEQ ID NO: 152093 - DNA, 25 bp, Mus musculus
tgttgcaagatgcacctcaggctgc

SEQ ID NO: 152094 - DNA, 25 bp, Mus musculus
tgttgcaatcaagcaagtgcccgtg

SEQ ID NO: 152095 - DNA, 25 bp, Mus musculus
tgttgcacatctccatcgcacagag

SEQ ID NO: 152096 - DNA, 25 bp, Mus musculus
tgttgcaccacatcctcatcgctgt

SEQ ID NO: 152097 - DNA, 25 bp, Mus musculus
tgttgcagaagccacagagcagtgc

SEQ ID NO: 152098 - DNA, 25 bp, Mus musculus
tgttgcagatagcttcagggcctca

SEQ ID NO: 152099 - DNA, 25 bp, Mus musculus
tgttgcagatgtgcctgttcctcca

SEQ ID NO: 152100 - DNA, 25 bp, Mus musculus
tgttgcagatgtgggcccttccata

SEQ ID NO: 152101 - DNA, 25 bp, Mus musculus
tgttgcagccatgctcaaggatcgg

SEQ ID NO: 152102 - DNA, 25 bp, Mus musculus
tgttgcagccttgtccagacctctg

SEQ ID NO: 152103 - DNA, 25 bp, Mus musculus
tgttgcagttagtcaatactttgag

SEQ ID NO: 152104 - DNA, 25 bp, Mus musculus
tgttgcagttccagacatcaccagg

SEQ ID NO: 152105 - DNA, 25 bp, Mus musculus
tgttgcatatgccactggacaggga

SEQ ID NO: 152106 - DNA, 25 bp, Mus musculus
tgttgcatattctaaggacccagac

SEQ ID NO: 152107 - DNA, 25 bp, Mus musculus
tgttgcatcagagccaagaaaactt

SEQ ID NO: 152108 - DNA, 25 bp, Mus musculus
tgttgcatgaacgaaggactggaat

SEQ ID NO: 152109 - DNA, 25 bp, Mus musculus
tgttgcattggctgccgctccgtaa

SEQ ID NO: 152110 - DNA, 25 bp, Mus musculus
tgttgccaataagcgaagcagcgtc

SEQ ID NO: 152111 - DNA, 25 bp, Mus musculus
tgttgccacaacagcagtagaaggg

SEQ ID NO: 152112 - DNA, 25 bp, Mus musculus
tgttgccacttttgactataaccgg

SEQ ID NO: 152113 - DNA, 25 bp, Mus musculus
tgttgccaggcgaagatgagcctct

SEQ ID NO: 152114 - DNA, 25 bp, Mus musculus
tgttgccagtttccagcagcggcgc

SEQ ID NO: 152115 - DNA, 25 bp, Mus musculus
tgttgcccaccgactgtccaggttg

SEQ ID NO: 152116 - DNA, 25 bp, Mus musculus
tgttgcccacttattctacctcggg

SEQ ID NO: 152117 - DNA, 25 bp, Mus musculus
tgttgcccaggattcaccggaagca

SEQ ID NO: 152118 - DNA, 25 bp, Mus musculus
tgttgccggagaatcctctgcagga

SEQ ID NO: 152119 - DNA, 25 bp, Mus musculus
tgttgccgtgcccaaagtaccggat

SEQ ID NO: 152120 - DNA, 25 bp, Mus musculus
tgttgcctcgatcaaagaaactgct

SEQ ID NO: 152121 - DNA, 25 bp, Mus musculus
tgttgcctggctcaggtcctccaca

SEQ ID NO: 152122 - DNA, 25 bp, Mus musculus
tgttgccttccgttacttcagagag

SEQ ID NO: 152123 - DNA, 25 bp, Mus musculus
tgttgctaaaacgatcgatgccggt

SEQ ID NO: 152124 - DNA, 25 bp, Mus musculus
tgttgctatagacaggcccactgct

SEQ ID NO: 152125 - DNA, 25 bp, Mus musculus
tgttgctcacggtacacctcaaggg

SEQ ID NO: 152126 - DNA, 25 bp, Mus musculus
tgttgctcctttcggccgcggcact

SEQ ID NO: 152127 - DNA, 25 bp, Mus musculus
tgttgctgaaacatgaaggcatcca

SEQ ID NO: 152128 - DNA, 25 bp, Mus musculus
tgttgctgaagacactagtgaccac

SEQ ID NO: 152129 - DNA, 25 bp, Mus musculus
tgttgctgacgtggacctcgagagt

SEQ ID NO: 152130 - DNA, 25 bp, Mus musculus
tgttgctgagacatccactggctgc

SEQ ID NO: 152131 - DNA, 25 bp, Mus musculus
tgttgctgatcataagaaaggagca

SEQ ID NO: 152132 - DNA, 25 bp, Mus musculus
tgttgctgccaaagagaaccaggct

SEQ ID NO: 152133 - DNA, 25 bp, Mus musculus
tgttgctggcgcacgttccaaggga

SEQ ID NO: 152134 - DNA, 25 bp, Mus musculus
tgttgctggcgcagttctcggcttt

SEQ ID NO: 152135 - DNA, 25 bp, Mus musculus
tgttgctgggctttactcaaggagg

SEQ ID NO: 152136 - DNA, 25 bp, Mus musculus
tgttgctgtggacgcctcataggcc

SEQ ID NO: 152137 - DNA, 25 bp, Mus musculus
tgttgctgtgtctcaggagcctgcc

SEQ ID NO: 152138 - DNA, 25 bp, Mus musculus
tgttgcttaagagcttggcaagacc

SEQ ID NO: 152139 - DNA, 25 bp, Mus musculus
tgttgcttacaaactaccagtagga

SEQ ID NO: 152140 - DNA, 25 bp, Mus musculus
tgttgcttcacatgggctgggatcc

SEQ ID NO: 152141 - DNA, 25 bp, Mus musculus
tgttgcttcagaatccacagctggc

SEQ ID NO: 152142 - DNA, 25 bp, Mus musculus
tgttgcttcccagcagattcagaca

SEQ ID NO: 152143 - DNA, 25 bp, Mus musculus
tgttgcttctacagaccttggagag

SEQ ID NO: 152144 - DNA, 25 bp, Mus musculus
tgttgcttctgggtgtaattccccg

SEQ ID NO: 152145 - DNA, 25 bp, Mus musculus
tgttggaaatgcacaagctggagcc

SEQ ID NO: 152146 - DNA, 25 bp, Mus musculus
tgttggaacatctggtcagcgccca

SEQ ID NO: 152147 - DNA, 25 bp, Mus musculus
tgttggaagacaaacccgtggcagg

SEQ ID NO: 152148 - DNA, 25 bp, Mus musculus
tgttggaagcaagaagagcccagtg

SEQ ID NO: 152149 - DNA, 25 bp, Mus musculus
tgttggaaggccaggagaactctga

SEQ ID NO: 152150 - DNA, 25 bp, Mus musculus
tgttggaatagcaaaagatctcatc

SEQ ID NO: 152151 - DNA, 25 bp, Mus musculus
tgttggaatgcagtctcagtgacaa

SEQ ID NO: 152152 - DNA, 25 bp, Mus musculus
tgttggacacccatgagaacctgct

SEQ ID NO: 152153 - DNA, 25 bp, Mus musculus
tgttggacacctcactgcgcggttt

SEQ ID NO: 152154 - DNA, 25 bp, Mus musculus
tgttggacctaaaggagaacctggg

SEQ ID NO: 152155 - DNA, 25 bp, Mus musculus
tgttggacgccggaacatacgtgaa

SEQ ID NO: 152156 - DNA, 25 bp, Mus musculus
tgttggagacacgttccccgtgggc

SEQ ID NO: 152157 - DNA, 25 bp, Mus musculus
tgttggagaccccaatccgcatgag

SEQ ID NO: 152158 - DNA, 25 bp, Mus musculus
tgttggagaccccactgcagatcac

SEQ ID NO: 152159 - DNA, 25 bp, Mus musculus
tgttggagatgtttaacacagtcgt

SEQ ID NO: 152160 - DNA, 25 bp, Mus musculus
tgttggagcagtacaaaaccgatgc

SEQ ID NO: 152161 - DNA, 25 bp, Mus musculus
tgttggaggaaaagctggtgtcatc

SEQ ID NO: 152162 - DNA, 25 bp, Mus musculus
tgttggaggaatatggccaggacct

SEQ ID NO: 152163 - DNA, 25 bp, Mus musculus
tgttggaggaccctccccgctgcag

SEQ ID NO: 152164 - DNA, 25 bp, Mus musculus
tgttggaggcccagaccctgatttg

SEQ ID NO: 152165 - DNA, 25 bp, Mus musculus
tgttggagtttcatctcctctctgc

SEQ ID NO: 152166 - DNA, 25 bp, Mus musculus
tgttggatgaacaagcacccctgga

SEQ ID NO: 152167 - DNA, 25 bp, Mus musculus
tgttggatgataaccgaagctgcca

SEQ ID NO: 152168 - DNA, 25 bp, Mus musculus
tgttggcataacgacaggctgtact

SEQ ID NO: 152169 - DNA, 25 bp, Mus musculus
tgttggcatcacctggaaatctctg

SEQ ID NO: 152170 - DNA, 25 bp, Mus musculus
tgttggcattcccaccaataggtag

SEQ ID NO: 152171 - DNA, 25 bp, Mus musculus
tgttggccaatctcctggtcatggt

SEQ ID NO: 152172 - DNA, 25 bp, Mus musculus
tgttggccaccatagagtctccgac

SEQ ID NO: 152173 - DNA, 25 bp, Mus musculus
tgttggccacctgtactgtctggag

SEQ ID NO: 152174 - DNA, 25 bp, Mus musculus
tgttggccagcttgcaatagatctg

SEQ ID NO: 152175 - DNA, 25 bp, Mus musculus
tgttggcccctcctgatgaccataa

SEQ ID NO: 152176 - DNA, 25 bp, Mus musculus
tgttggccctgacaatcactgccag

SEQ ID NO: 152177 - DNA, 25 bp, Mus musculus
tgttggccgagaacagcattagtcc

SEQ ID NO: 152178 - DNA, 25 bp, Mus musculus
tgttggccgcaagatgcagccggat

SEQ ID NO: 152179 - DNA, 25 bp, Mus musculus
tgttggccgccttcgaatactgggt

SEQ ID NO: 152180 - DNA, 25 bp, Mus musculus
tgttggccttcctcgaattcagcag

SEQ ID NO: 152181 - DNA, 25 bp, Mus musculus
tgttggcggcgttgcggctgagctc

SEQ ID NO: 152182 - DNA, 25 bp, Mus musculus
tgttggctgagcactgaaaacaact

SEQ ID NO: 152183 - DNA, 25 bp, Mus musculus
tgttggctgcactcacttctgtagg

SEQ ID NO: 152184 - DNA, 25 bp, Mus musculus
tgttgggaattacagtcctcgctgc

SEQ ID NO: 152185 - DNA, 25 bp, Mus musculus
tgttgggacacagtcggtcagcagc

SEQ ID NO: 152186 - DNA, 25 bp, Mus musculus
tgttgggcagcaagggcttcacatg

SEQ ID NO: 152187 - DNA, 25 bp, Mus musculus
tgttgggcccaaagtagtcctgaat

SEQ ID NO: 152188 - DNA, 25 bp, Mus musculus
tgttgggccgccttgatgcacttcg

SEQ ID NO: 152189 - DNA, 25 bp, Mus musculus
tgttgggtacccagaacgagagcta

SEQ ID NO: 152190 - DNA, 25 bp, Mus musculus
tgttgggtcatagcctcggtgccta

SEQ ID NO: 152191 - DNA, 25 bp, Mus musculus
tgttggtacgaatcaatgcctccgg

SEQ ID NO: 152192 - DNA, 25 bp, Mus musculus
tgttggtacgactgtctaccctctg

SEQ ID NO: 152193 - DNA, 25 bp, Mus musculus
tgttggtcaaccacggctacctagg

SEQ ID NO: 152194 - DNA, 25 bp, Mus musculus
tgttggtggaccatcagctggctcc

SEQ ID NO: 152195 - DNA, 25 bp, Mus musculus
tgttggtggccaggacaaaattaga

SEQ ID NO: 152196 - DNA, 25 bp, Mus musculus
tgttgtaaaacaatccacccatctg

SEQ ID NO: 152197 - DNA, 25 bp, Mus musculus
tgttgtaaagcacaggagccagttt

SEQ ID NO: 152198 - DNA, 25 bp, Mus musculus
tgttgtacaagcaggtgggctcgcc

SEQ ID NO: 152199 - DNA, 25 bp, Mus musculus
tgttgtacacaagcgctgccatgag

SEQ ID NO: 152200 - DNA, 25 bp, Mus musculus
tgttgtactgccattcagcagggca

SEQ ID NO: 152201 - DNA, 25 bp, Mus musculus
tgttgtagcctctcgggaacggaca

SEQ ID NO: 152202 - DNA, 25 bp, Mus musculus
tgttgtcaacactgtggcacgcctg

SEQ ID NO: 152203 - DNA, 25 bp, Mus musculus
tgttgtcaaccagcatgaacctggc

SEQ ID NO: 152204 - DNA, 25 bp, Mus musculus
tgttgtcaagatcaccctacacgtc

SEQ ID NO: 152205 - DNA, 25 bp, Mus musculus
tgttgtcagtgagaacccgggacag

SEQ ID NO: 152206 - DNA, 25 bp, Mus musculus
tgttgtccaacagaacgacctagtg

SEQ ID NO: 152207 - DNA, 25 bp, Mus musculus
tgttgtccaagtcaaaggagcccac

SEQ ID NO: 152208 - DNA, 25 bp, Mus musculus
tgttgtccgaagtgccagtatcagg

SEQ ID NO: 152209 - DNA, 25 bp, Mus musculus
tgttgtccgccatacagaaggctca

SEQ ID NO: 152210 - DNA, 25 bp, Mus musculus
tgttgtccgcctgggggaccctgtc

SEQ ID NO: 152211 - DNA, 25 bp, Mus musculus
tgttgtccgctcacgacggaagtga

SEQ ID NO: 152212 - DNA, 25 bp, Mus musculus
tgttgtcctggagaacggagtcctg

SEQ ID NO: 152213 - DNA, 25 bp, Mus musculus
tgttgtctatgaaacaatgcgccag

SEQ ID NO: 152214 - DNA, 25 bp, Mus musculus
tgttgtctcaggagcccagcaatgg

SEQ ID NO: 152215 - DNA, 25 bp, Mus musculus
tgttgtctccatcccatagcgtagg

SEQ ID NO: 152216 - DNA, 25 bp, Mus musculus
tgttgtctctccagccgttcagtgg

SEQ ID NO: 152217 - DNA, 25 bp, Mus musculus
tgttgtctgactacaccatcggtgg

SEQ ID NO: 152218 - DNA, 25 bp, Mus musculus
tgttgtcttcacgaatccccttgtg

SEQ ID NO: 152219 - DNA, 25 bp, Mus musculus
tgttgtcttcgacactacgttgcaa

SEQ ID NO: 152220 - DNA, 25 bp, Mus musculus
tgttgtgacctaccagatttcagaa

SEQ ID NO: 152221 - DNA, 25 bp, Mus musculus
tgttgtgcaagagaactgtcctcac

SEQ ID NO: 152222 - DNA, 25 bp, Mus musculus
tgttgtgcatgcagggacggacaca

SEQ ID NO: 152223 - DNA, 25 bp, Mus musculus
tgttgtgcatgtgggcatggactct

SEQ ID NO: 152224 - DNA, 25 bp, Mus musculus
tgttgtgccaaagtcaaactgctgc

SEQ ID NO: 152225 - DNA, 25 bp, Mus musculus
tgttgtgcccaaagatccagacaaa

SEQ ID NO: 152226 - DNA, 25 bp, Mus musculus
tgttgtgccccacagtgtagccagg

SEQ ID NO: 152227 - DNA, 25 bp, Mus musculus
tgttgtggattgctgctcatgaccc

SEQ ID NO: 152228 - DNA, 25 bp, Mus musculus
tgttgtggtgtcaagatctacttcc

SEQ ID NO: 152229 - DNA, 25 bp, Mus musculus
tgttgtgtaggactcaatccctcga

SEQ ID NO: 152230 - DNA, 25 bp, Mus musculus
tgttgtgtgcgccaatccgagacga

SEQ ID NO: 152231 - DNA, 25 bp, Mus musculus
tgttgttaacaagggcatgccttct

SEQ ID NO: 152232 - DNA, 25 bp, Mus musculus
tgttgttacactgacgggactggca

SEQ ID NO: 152233 - DNA, 25 bp, Mus musculus
tgttgttctcgtgccacacagggat

SEQ ID NO: 152234 - DNA, 25 bp, Mus musculus
tgttgttgcagtacttgccccggcg

SEQ ID NO: 152235 - DNA, 25 bp, Mus musculus
tgttgttgccacagagtctcgacag

SEQ ID NO: 152236 - DNA, 25 bp, Mus musculus
tgttgttgcctgtgggctcctgctt

SEQ ID NO: 152237 - DNA, 25 bp, Mus musculus
tgttgttgctgcttccgccacgggt

SEQ ID NO: 152238 - DNA, 25 bp, Mus musculus
tgttgtttgaccgagtgtgcgagca

SEQ ID NO: 152239 - DNA, 25 bp, Mus musculus
tgtttaacaagtggtacttccctcg

SEQ ID NO: 152240 - DNA, 25 bp, Mus musculus
tgtttaagccagaaaacctgtccgg

SEQ ID NO: 152241 - DNA, 25 bp, Mus musculus
tgtttaagggcagtggctagagtcc

SEQ ID NO: 152242 - DNA, 25 bp, Mus musculus
tgtttaagtagacgcgtaggccacc

SEQ ID NO: 152243 - DNA, 25 bp, Mus musculus
tgtttaatatcctccaagccgcgta

SEQ ID NO: 152244 - DNA, 25 bp, Mus musculus
tgtttacaacatcaccagtgccacg

SEQ ID NO: 152245 - DNA, 25 bp, Mus musculus
tgtttacacggacgacttcacggac

SEQ ID NO: 152246 - DNA, 25 bp, Mus musculus
tgtttacacttacaggattctgccc

SEQ ID NO: 152247 - DNA, 25 bp, Mus musculus
tgtttacagaaatgagagctgcccc

SEQ ID NO: 152248 - DNA, 25 bp, Mus musculus
tgtttacagccatcctacggaagag

SEQ ID NO: 152249 - DNA, 25 bp, Mus musculus
tgtttacatggaactcaggagtctg

SEQ ID NO: 152250 - DNA, 25 bp, Mus musculus
tgtttacccatgaatcagaactcag

SEQ ID NO: 152251 - DNA, 25 bp, Mus musculus
tgtttaccgagagcaaatgcacggg

SEQ ID NO: 152252 - DNA, 25 bp, Mus musculus
tgtttactgtttgctgccggctgga

SEQ ID NO: 152253 - DNA, 25 bp, Mus musculus
tgtttagcgtgcaagagaccctgcg

SEQ ID NO: 152254 - DNA, 25 bp, Mus musculus
tgtttaggactttcccttgtggcaa

SEQ ID NO: 152255 - DNA, 25 bp, Mus musculus
tgtttaggatgtggtgcctcttgtt

SEQ ID NO: 152256 - DNA, 25 bp, Mus musculus
tgtttagtcacaaaagacggcttgt

SEQ ID NO: 152257 - DNA, 25 bp, Mus musculus
tgtttatatcggaagccacatgcct

SEQ ID NO: 152258 - DNA, 25 bp, Mus musculus
tgtttatcagacaagccaaagctcc

SEQ ID NO: 152259 - DNA, 25 bp, Mus musculus
tgtttatccgaatcatgcccaggct

SEQ ID NO: 152260 - DNA, 25 bp, Mus musculus
tgtttatcgcggcatccctcggtta

SEQ ID NO: 152261 - DNA, 25 bp, Mus musculus
tgtttatctccatgcaggccgtgct

SEQ ID NO: 152262 - DNA, 25 bp, Mus musculus
tgtttatctggacgacctcacggac

SEQ ID NO: 152263 - DNA, 25 bp, Mus musculus
tgtttatgtgtcagctgaagccgcc

SEQ ID NO: 152264 - DNA, 25 bp, Mus musculus
tgtttcacatagaaataaactacag

SEQ ID NO: 152265 - DNA, 25 bp, Mus musculus
tgtttcacatggactgcctcgagcc

SEQ ID NO: 152266 - DNA, 25 bp, Mus musculus
tgtttcacgacgaggtggagatcga

SEQ ID NO: 152267 - DNA, 25 bp, Mus musculus
tgtttcataggatcatggtggagcc

SEQ ID NO: 152268 - DNA, 25 bp, Mus musculus
tgtttcatcactttgctcaggagcc

SEQ ID NO: 152269 - DNA, 25 bp, Mus musculus
tgtttcattcagaggcagcctgccg

SEQ ID NO: 152270 - DNA, 25 bp, Mus musculus
tgtttccaaggcacagctttcccaa

SEQ ID NO: 152271 - DNA, 25 bp, Mus musculus
tgtttccacaggagtcccatgcagg

SEQ ID NO: 152272 - DNA, 25 bp, Mus musculus
tgtttccaccaagatagcagagccc

SEQ ID NO: 152273 - DNA, 25 bp, Mus musculus
tgtttccagcagatgaactccatgg

SEQ ID NO: 152274 - DNA, 25 bp, Mus musculus
tgtttccagtcgtctgaagcccgtg

SEQ ID NO: 152275 - DNA, 25 bp, Mus musculus
tgtttccagtgaaggtgcatcccag

SEQ ID NO: 152276 - DNA, 25 bp, Mus musculus
tgtttcccaagccacggaggtgatg

SEQ ID NO: 152277 - DNA, 25 bp, Mus musculus
tgtttcccaggattagactcagcaa

SEQ ID NO: 152278 - DNA, 25 bp, Mus musculus
tgtttcccatagagatgagctcgga

SEQ ID NO: 152279 - DNA, 25 bp, Mus musculus
tgtttcccgagagaccctgaagagc

SEQ ID NO: 152280 - DNA, 25 bp, Mus musculus
tgtttcccgggtagcaccaggaaca

SEQ ID NO: 152281 - DNA, 25 bp, Mus musculus
tgtttccctgcgatcgtggcctgga

SEQ ID NO: 152282 - DNA, 25 bp, Mus musculus
tgtttccgatgcaatcaagtctgta

SEQ ID NO: 152283 - DNA, 25 bp, Mus musculus
tgtttccgggagatatgcgagtcca

SEQ ID NO: 152284 - DNA, 25 bp, Mus musculus
tgtttcctaggcatggacatatctg

SEQ ID NO: 152285 - DNA, 25 bp, Mus musculus
tgtttcctcttgagtgcaggcttgg

SEQ ID NO: 152286 - DNA, 25 bp, Mus musculus
tgtttcctgagtcagaacggccaga

SEQ ID NO: 152287 - DNA, 25 bp, Mus musculus
tgtttcctgataagtggacagccgc

SEQ ID NO: 152288 - DNA, 25 bp, Mus musculus
tgtttcctgctgtgacactctcatg

SEQ ID NO: 152289 - DNA, 25 bp, Mus musculus
tgtttcctgtgaacgacggcttcca

SEQ ID NO: 152290 - DNA, 25 bp, Mus musculus
tgtttcctgtgcctctggcctctag

SEQ ID NO: 152291 - DNA, 25 bp, Mus musculus
tgtttcgatgtctaccgctgcggct

SEQ ID NO: 152292 - DNA, 25 bp, Mus musculus
tgtttcgctgtgaggcacctgccaa

SEQ ID NO: 152293 - DNA, 25 bp, Mus musculus
tgtttcgtacgttgggatcagccag

SEQ ID NO: 152294 - DNA, 25 bp, Mus musculus
tgtttcgtatctcccattggccaga

SEQ ID NO: 152295 - DNA, 25 bp, Mus musculus
tgtttctacagggtgacctctccag

SEQ ID NO: 152296 - DNA, 25 bp, Mus musculus
tgtttctaggagagttacccgagcc

SEQ ID NO: 152297 - DNA, 25 bp, Mus musculus
tgtttctaggatgcagtacactgct

SEQ ID NO: 152298 - DNA, 25 bp, Mus musculus
tgtttctcaaaacctgagggtcagg

SEQ ID NO: 152299 - DNA, 25 bp, Mus musculus
tgtttctcccttcgtaacacccaca

SEQ ID NO: 152300 - DNA, 25 bp, Mus musculus
tgtttctccgcaaaaaggtctccac

SEQ ID NO: 152301 - DNA, 25 bp, Mus musculus
tgtttctctgtctcgtggatcccgg

SEQ ID NO: 152302 - DNA, 25 bp, Mus musculus
tgtttctgatcacccttagcggctg

SEQ ID NO: 152303 - DNA, 25 bp, Mus musculus
tgtttctgcccctgacctgaagagt

SEQ ID NO: 152304 - DNA, 25 bp, Mus musculus
tgtttctggcagcttctctcctagc

SEQ ID NO: 152305 - DNA, 25 bp, Mus musculus
tgtttcttaactatacctgtctgcc

SEQ ID NO: 152306 - DNA, 25 bp, Mus musculus
tgtttgaaagatcccacacaatgcc

SEQ ID NO: 152307 - DNA, 25 bp, Mus musculus
tgtttgaaagatgtccctccagtcc

SEQ ID NO: 152308 - DNA, 25 bp, Mus musculus
tgtttgaaagtgctaacgggccaca

SEQ ID NO: 152309 - DNA, 25 bp, Mus musculus
tgtttgaagtttcccatgcgtcgcc

SEQ ID NO: 152310 - DNA, 25 bp, Mus musculus
tgtttgacaaagtaaggcagccaga

SEQ ID NO: 152311 - DNA, 25 bp, Mus musculus
tgtttgacatagacctggaccagcc

SEQ ID NO: 152312 - DNA, 25 bp, Mus musculus
tgtttgaccgtgagcgtggagaccc

SEQ ID NO: 152313 - DNA, 25 bp, Mus musculus
tgtttgacctacagcaggagccggc

SEQ ID NO: 152314 - DNA, 25 bp, Mus musculus
tgtttgacgaacaagagccactcca

SEQ ID NO: 152315 - DNA, 25 bp, Mus musculus
tgtttgactgcaggaaaaacgtgct

SEQ ID NO: 152316 - DNA, 25 bp, Mus musculus
tgtttgagcagatgagagcgaacgt

SEQ ID NO: 152317 - DNA, 25 bp, Mus musculus
tgtttgagcccctaaaggagccagg

SEQ ID NO: 152318 - DNA, 25 bp, Mus musculus
tgtttgaggaagtggcgctgggctg

SEQ ID NO: 152319 - DNA, 25 bp, Mus musculus
tgtttgaggccagctcacactaaaa

SEQ ID NO: 152320 - DNA, 25 bp, Mus musculus
tgtttgaggctgaacacagggcgta

SEQ ID NO: 152321 - DNA, 25 bp, Mus musculus
tgtttgaggctgaccaagtgagccc

SEQ ID NO: 152322 - DNA, 25 bp, Mus musculus
tgtttgagtccttgggctctcccag

SEQ ID NO: 152323 - DNA, 25 bp, Mus musculus
tgtttgatcaccctgtccactgcct

SEQ ID NO: 152324 - DNA, 25 bp, Mus musculus
tgtttgcagactggatcccctggca

SEQ ID NO: 152325 - DNA, 25 bp, Mus musculus
tgtttgcagccatactcacgtcagc

SEQ ID NO: 152326 - DNA, 25 bp, Mus musculus
tgtttgccaatagtcacaagagccc

SEQ ID NO: 152327 - DNA, 25 bp, Mus musculus
tgtttgccacacagattaccctggg

SEQ ID NO: 152328 - DNA, 25 bp, Mus musculus
tgtttgccacagaggactccctgga

SEQ ID NO: 152329 - DNA, 25 bp, Mus musculus
tgtttgcccaactcttgtgagcatg

SEQ ID NO: 152330 - DNA, 25 bp, Mus musculus
tgtttgccccaattgcagccgcagt

SEQ ID NO: 152331 - DNA, 25 bp, Mus musculus
tgtttgcctatggtacatacccgga

SEQ ID NO: 152332 - DNA, 25 bp, Mus musculus
tgtttgctaaatacggagaacccgg

SEQ ID NO: 152333 - DNA, 25 bp, Mus musculus
tgtttgctcagtaccagcctctgga

SEQ ID NO: 152334 - DNA, 25 bp, Mus musculus
tgtttgctccagttatccaggccgg

SEQ ID NO: 152335 - DNA, 25 bp, Mus musculus
tgtttgctcccacacagaggacaga

SEQ ID NO: 152336 - DNA, 25 bp, Mus musculus
tgtttgctcttaagcgcggtgcttg

SEQ ID NO: 152337 - DNA, 25 bp, Mus musculus
tgtttgctgccctgatgagccgctg

SEQ ID NO: 152338 - DNA, 25 bp, Mus musculus
tgtttggaaactctggtaagcccct

SEQ ID NO: 152339 - DNA, 25 bp, Mus musculus
tgtttggaatctgcagagtggaccg

SEQ ID NO: 152340 - DNA, 25 bp, Mus musculus
tgtttggaattccttggcacaccag

SEQ ID NO: 152341 - DNA, 25 bp, Mus musculus
tgtttggacccaagaaggcgggctc

SEQ ID NO: 152342 - DNA, 25 bp, Mus musculus
tgtttggaggtatgacagccactgg

SEQ ID NO: 152343 - DNA, 25 bp, Mus musculus
tgtttggcaatgagcccaaggctcc

SEQ ID NO: 152344 - DNA, 25 bp, Mus musculus
tgtttggcacaaaatgtcgaggctg

SEQ ID NO: 152345 - DNA, 25 bp, Mus musculus
tgtttggcctcagcagaccgtcttg

SEQ ID NO: 152346 - DNA, 25 bp, Mus musculus
tgtttggcgcagcacctttggagaa

SEQ ID NO: 152347 - DNA, 25 bp, Mus musculus
tgtttggctgcctgcgtgctcccga

SEQ ID NO: 152348 - DNA, 25 bp, Mus musculus
tgtttgggagcaaggcacattcaag

SEQ ID NO: 152349 - DNA, 25 bp, Mus musculus
tgtttgggagcacaaccacagataa

SEQ ID NO: 152350 - DNA, 25 bp, Mus musculus
tgtttggtatatggagaactgcccc

SEQ ID NO: 152351 - DNA, 25 bp, Mus musculus
tgtttggtcctctccagtgcctgga

SEQ ID NO: 152352 - DNA, 25 bp, Mus musculus
tgtttggtgcgaacttcattaaggg

SEQ ID NO: 152353 - DNA, 25 bp, Mus musculus
tgtttgtacacagtgcgctcctggc

SEQ ID NO: 152354 - DNA, 25 bp, Mus musculus
tgtttgtcccacgagatgtcccaga

SEQ ID NO: 152355 - DNA, 25 bp, Mus musculus
tgtttgtgacaaacgatgcagcgac

SEQ ID NO: 152356 - DNA, 25 bp, Mus musculus
tgtttgtgcacatcagccagtcaag

SEQ ID NO: 152357 - DNA, 25 bp, Mus musculus
tgtttgtgcacgctgtgtgtactcc

SEQ ID NO: 152358 - DNA, 25 bp, Mus musculus
tgtttgtgtgactcagacccaccca

SEQ ID NO: 152359 - DNA, 25 bp, Mus musculus
tgtttgtgtgcatggtggccaccgc

SEQ ID NO: 152360 - DNA, 25 bp, Mus musculus
tgtttgttcaagaggaccgggctca

SEQ ID NO: 152361 - DNA, 25 bp, Mus musculus
tgttttaacgtcacagggacagcga

SEQ ID NO: 152362 - DNA, 25 bp, Mus musculus
tgttttacaaatacggcgccatccg

SEQ ID NO: 152363 - DNA, 25 bp, Mus musculus
tgttttacatttgcccaggacggaa

SEQ ID NO: 152364 - DNA, 25 bp, Mus musculus
tgttttataagttggccgaggccca

SEQ ID NO: 152365 - DNA, 25 bp, Mus musculus
tgttttcaatacaaacgagcaggag

SEQ ID NO: 152366 - DNA, 25 bp, Mus musculus
tgttttcagccatgaggtcgttcct

SEQ ID NO: 152367 - DNA, 25 bp, Mus musculus
tgttttcagtcttcatcaggcgttc

SEQ ID NO: 152368 - DNA, 25 bp, Mus musculus
tgttttccaccgacaagaagtcgct

SEQ ID NO: 152369 - DNA, 25 bp, Mus musculus
tgttttccagcttttggaagccccg

SEQ ID NO: 152370 - DNA, 25 bp, Mus musculus
tgttttccagggttgttgccacgcc

SEQ ID NO: 152371 - DNA, 25 bp, Mus musculus
tgttttccccagatgaggcacttgg

SEQ ID NO: 152372 - DNA, 25 bp, Mus musculus
tgttttcccggctaagagctgttac

SEQ ID NO: 152373 - DNA, 25 bp, Mus musculus
tgttttccgatgaggtgcagcagca

SEQ ID NO: 152374 - DNA, 25 bp, Mus musculus
tgttttccttttggaggacaccgag

SEQ ID NO: 152375 - DNA, 25 bp, Mus musculus
tgttttcggtgcagctgagtcttgg

SEQ ID NO: 152376 - DNA, 25 bp, Mus musculus
tgttttctggacagttgctgggcct

SEQ ID NO: 152377 - DNA, 25 bp, Mus musculus
tgttttctgtcaggactcggctgta

SEQ ID NO: 152378 - DNA, 25 bp, Mus musculus
tgttttcttggacgtggacttggca

SEQ ID NO: 152379 - DNA, 25 bp, Mus musculus
tgttttgacaatggaactgcactac

SEQ ID NO: 152380 - DNA, 25 bp, Mus musculus
tgttttgagacatactgtgtgaccc

SEQ ID NO: 152381 - DNA, 25 bp, Mus musculus
tgttttgagttctagcggcacgcac

SEQ ID NO: 152382 - DNA, 25 bp, Mus musculus
tgttttgcacaccaatgcagcaggg

SEQ ID NO: 152383 - DNA, 25 bp, Mus musculus
tgttttgcatcgaagctcctgagga

SEQ ID NO: 152384 - DNA, 25 bp, Mus musculus
tgttttgcggttggccatgatgcga

SEQ ID NO: 152385 - DNA, 25 bp, Mus musculus
tgttttggacagatacgccttttct

SEQ ID NO: 152386 - DNA, 25 bp, Mus musculus
tgttttggccaggtcagtcgaggcc

SEQ ID NO: 152387 - DNA, 25 bp, Mus musculus
tgttttggccttttctcattctcct

SEQ ID NO: 152388 - DNA, 25 bp, Mus musculus
tgttttgtcaagagaaccggccttc

SEQ ID NO: 152389 - DNA, 25 bp, Mus musculus
tgttttgtgccacaggccagtgcaa

SEQ ID NO: 152390 - DNA, 25 bp, Mus musculus
tgttttgtgcgagaataacatccgg

SEQ ID NO: 152391 - DNA, 25 bp, Mus musculus
tgttttgtgctcattgagctgtggc

SEQ ID NO: 152392 - DNA, 25 bp, Mus musculus
tgtttttaggtaatcaggctgccac

SEQ ID NO: 152393 - DNA, 25 bp, Mus musculus
tgtttttccactggcgacgagcggc

SEQ ID NO: 152394 - DNA, 25 bp, Mus musculus
tgtttttgcgttgcattccactgag

SEQ ID NO: 152395 - DNA, 25 bp, Mus musculus
tgtttttgggatggagaaataaata

SEQ ID NO: 152396 - DNA, 25 bp, Mus musculus
ttaaaaatgagctataaggccgcca

SEQ ID NO: 152397 - DNA, 25 bp, Mus musculus
ttaaaaccaggagcatagtgagacc

SEQ ID NO: 152398 - DNA, 25 bp, Mus musculus
ttaaaaccagggtcaagagccggat

SEQ ID NO: 152399 - DNA, 25 bp, Mus musculus
ttaaaacccacagtatcgtcaggag

SEQ ID NO: 152400 - DNA, 25 bp, Mus musculus
ttaaaacggctagaagaacacaggt

SEQ ID NO: 152401 - DNA, 25 bp, Mus musculus
ttaaaagaatcttgcagcgtagtgc

SEQ ID NO: 152402 - DNA, 25 bp, Mus musculus
ttaaaagcggatctcctcgggaggc

SEQ ID NO: 152403 - DNA, 25 bp, Mus musculus
ttaaaagctgcagaggcctcctcac

SEQ ID NO: 152404 - DNA, 25 bp, Mus musculus
ttaaaaggatcaaaggtagctcgtg

SEQ ID NO: 152405 - DNA, 25 bp, Mus musculus
ttaaaagggaacctccagagggctg

SEQ ID NO: 152406 - DNA, 25 bp, Mus musculus
ttaaaatgagagcttgctgtacact

SEQ ID NO: 152407 - DNA, 25 bp, Mus musculus
ttaaaatggagacctcgggtcctgg

SEQ ID NO: 152408 - DNA, 25 bp, Mus musculus
ttaaaatggcgctccagtgacacag

SEQ ID NO: 152409 - DNA, 25 bp, Mus musculus
ttaaaatgtgatggcccaatccccg

SEQ ID NO: 152410 - DNA, 25 bp, Mus musculus
ttaaacaaccaaagtatctcaacct

SEQ ID NO: 152411 - DNA, 25 bp, Mus musculus
ttaaacaagagcaactgcgcgcggg

SEQ ID NO: 152412 - DNA, 25 bp, Mus musculus
ttaaacactatgtgcaccgggtggg

SEQ ID NO: 152413 - DNA, 25 bp, Mus musculus
ttaaacaggaccacagcatgcccat

SEQ ID NO: 152414 - DNA, 25 bp, Mus musculus
ttaaaccacgggaaggaacactgct

SEQ ID NO: 152415 - DNA, 25 bp, Mus musculus
ttaaaccgagggtggcgacttggca

SEQ ID NO: 152416 - DNA, 25 bp, Mus musculus
ttaaaccgatgatgctctgtcctgg

SEQ ID NO: 152417 - DNA, 25 bp, Mus musculus
ttaaaccggatgagaagtgagttgc

SEQ ID NO: 152418 - DNA, 25 bp, Mus musculus
ttaaacctttactggctgcttggaa

SEQ ID NO: 152419 - DNA, 25 bp, Mus musculus
ttaaacgccaccttccagacagaga

SEQ ID NO: 152420 - DNA, 25 bp, Mus musculus
ttaaacgggctgaaccacgggacag

SEQ ID NO: 152421 - DNA, 25 bp, Mus musculus
ttaaacgtttatggcgagatggcgg

SEQ ID NO: 152422 - DNA, 25 bp, Mus musculus
ttaaactacacagccactgcggagg

SEQ ID NO: 152423 - DNA, 25 bp, Mus musculus
ttaaactaccctggacactgctgag

SEQ ID NO: 152424 - DNA, 25 bp, Mus musculus
ttaaagaaagtgacaaccccaggcg

SEQ ID NO: 152425 - DNA, 25 bp, Mus musculus
ttaaagaagcttccgtctgctgtga

SEQ ID NO: 152426 - DNA, 25 bp, Mus musculus
ttaaagacgcatggaataagagtct

SEQ ID NO: 152427 - DNA, 25 bp, Mus musculus
ttaaagatgccctagagttgctacg

SEQ ID NO: 152428 - DNA, 25 bp, Mus musculus
ttaaagatgccgttgccctctgcga

SEQ ID NO: 152429 - DNA, 25 bp, Mus musculus
ttaaagcagtggacttcagcggcca

SEQ ID NO: 152430 - DNA, 25 bp, Mus musculus
ttaaagcggaccaagtatgaggacc

SEQ ID NO: 152431 - DNA, 25 bp, Mus musculus
ttaaaggaatccaaacgcgcagtga

SEQ ID NO: 152432 - DNA, 25 bp, Mus musculus
ttaaaggaatccctgctttcagaca

SEQ ID NO: 152433 - DNA, 25 bp, Mus musculus
ttaaaggatcttactgtgtgagccc

SEQ ID NO: 152434 - DNA, 25 bp, Mus musculus
ttaaagtggatccaagagtacctgg

SEQ ID NO: 152435 - DNA, 25 bp, Mus musculus
ttaaataaaactacagggcttccag

SEQ ID NO: 152436 - DNA, 25 bp, Mus musculus
ttaaatacagctgtgcacgtggtca

SEQ ID NO: 152437 - DNA, 25 bp, Mus musculus
ttaaatacgctggtggcccgtgtgc

SEQ ID NO: 152438 - DNA, 25 bp, Mus musculus
ttaaatcagccttgaagcagcagga

SEQ ID NO: 152439 - DNA, 25 bp, Mus musculus
ttaaatcctgcctagagggccacag

SEQ ID NO: 152440 - DNA, 25 bp, Mus musculus
ttaaatggcttcttggacacgctca

SEQ ID NO: 152441 - DNA, 25 bp, Mus musculus
ttaaattatggaagccctgagggcc

SEQ ID NO: 152442 - DNA, 25 bp, Mus musculus
ttaaattgaaagctgaagcccggct

SEQ ID NO: 152443 - DNA, 25 bp, Mus musculus
ttaaattgacatggcgtacacctgc

SEQ ID NO: 152444 - DNA, 25 bp, Mus musculus
ttaacaagctgcaggacgccttcag

SEQ ID NO: 152445 - DNA, 25 bp, Mus musculus
ttaacaaggctggtggatttcgtgg

SEQ ID NO: 152446 - DNA, 25 bp, Mus musculus
ttaacaagtctcatcgccgaatcag

SEQ ID NO: 152447 - DNA, 25 bp, Mus musculus
ttaacacagtggttgtccgccctca

SEQ ID NO: 152448 - DNA, 25 bp, Mus musculus
ttaacacggctaaggaagcaggctc

SEQ ID NO: 152449 - DNA, 25 bp, Mus musculus
ttaacacggctgacggagagcagtc

SEQ ID NO: 152450 - DNA, 25 bp, Mus musculus
ttaacactgagcctttgagacccat

SEQ ID NO: 152451 - DNA, 25 bp, Mus musculus
ttaacacttgtgtccggcaaccgga

SEQ ID NO: 152452 - DNA, 25 bp, Mus musculus
ttaacaggagctttctcactgacag

SEQ ID NO: 152453 - DNA, 25 bp, Mus musculus
ttaacataaatgatggacggcctcc

SEQ ID NO: 152454 - DNA, 25 bp, Mus musculus
ttaacatagtcgtggtgtctgtggc

SEQ ID NO: 152455 - DNA, 25 bp, Mus musculus
ttaacatcgacagtacaacacggga

SEQ ID NO: 152456 - DNA, 25 bp, Mus musculus
ttaacattccgtttaggcccagtag

SEQ ID NO: 152457 - DNA, 25 bp, Mus musculus
ttaaccatggaaggaccagggctcg

SEQ ID NO: 152458 - DNA, 25 bp, Mus musculus
ttaaccctctgacaatctgcgcgcg

SEQ ID NO: 152459 - DNA, 25 bp, Mus musculus
ttaaccgccgttgcgggaatcgagc

SEQ ID NO: 152460 - DNA, 25 bp, Mus musculus
ttaaccgcgacaacgaagactcagg

SEQ ID NO: 152461 - DNA, 25 bp, Mus musculus
ttaacctgcctagcttgggctggga

SEQ ID NO: 152462 - DNA, 25 bp, Mus musculus
ttaacctggtgggtgagccctcctt

SEQ ID NO: 152463 - DNA, 25 bp, Mus musculus
ttaacgaaccccagaaagatagcgc

SEQ ID NO: 152464 - DNA, 25 bp, Mus musculus
ttaacgggcagtacagcagcctggc

SEQ ID NO: 152465 - DNA, 25 bp, Mus musculus
ttaacgtatggccacagcatcctgg

SEQ ID NO: 152466 - DNA, 25 bp, Mus musculus
ttaacgtgctcaggactcgacgtgc

SEQ ID NO: 152467 - DNA, 25 bp, Mus musculus
ttaacgtgtgaagccatcgggaagc

SEQ ID NO: 152468 - DNA, 25 bp, Mus musculus
ttaactccatggcacaaaactatgc

SEQ ID NO: 152469 - DNA, 25 bp, Mus musculus
ttaactcgcagctggatgcatcccg

SEQ ID NO: 152470 - DNA, 25 bp, Mus musculus
ttaagaaaacactagggccatcctg

SEQ ID NO: 152471 - DNA, 25 bp, Mus musculus
ttaagaagctcatgaccaagggccg

SEQ ID NO: 152472 - DNA, 25 bp, Mus musculus
ttaagaatggcgagcagcaagcggt

SEQ ID NO: 152473 - DNA, 25 bp, Mus musculus
ttaagacaacagcttcgaatccggg

SEQ ID NO: 152474 - DNA, 25 bp, Mus musculus
ttaagacaaggctgcagagtcccca

SEQ ID NO: 152475 - DNA, 25 bp, Mus musculus
ttaagacagccaaccaggacctgga

SEQ ID NO: 152476 - DNA, 25 bp, Mus musculus
ttaagagcagcgaaattgagcaggc

SEQ ID NO: 152477 - DNA, 25 bp, Mus musculus
ttaagagcagtgactaagagaggcc

SEQ ID NO: 152478 - DNA, 25 bp, Mus musculus
ttaagatcacacaggagacgaggtc

SEQ ID NO: 152479 - DNA, 25 bp, Mus musculus
ttaagatgggatgagacaccgggtc

SEQ ID NO: 152480 - DNA, 25 bp, Mus musculus
ttaagatgggctatcctcgcctgcc

SEQ ID NO: 152481 - DNA, 25 bp, Mus musculus
ttaagcaaggaatgtctgatagcgc

SEQ ID NO: 152482 - DNA, 25 bp, Mus musculus
ttaagcacccatgaccagccatcag

SEQ ID NO: 152483 - DNA, 25 bp, Mus musculus
ttaagcaccggctgtgtagacgtgg

SEQ ID NO: 152484 - DNA, 25 bp, Mus musculus
ttaagcagcggtatctgagtgggcc

SEQ ID NO: 152485 - DNA, 25 bp, Mus musculus
ttaagcaggcatcgcgtggtcccgt

SEQ ID NO: 152486 - DNA, 25 bp, Mus musculus
ttaagccccagaaatgagatccgag

SEQ ID NO: 152487 - DNA, 25 bp, Mus musculus
ttaagccgtagggtctggaactcag

SEQ ID NO: 152488 - DNA, 25 bp, Mus musculus
ttaagcggagcgtgtacaacgagga

SEQ ID NO: 152489 - DNA, 25 bp, Mus musculus
ttaagcttgcgagccagcataggga

SEQ ID NO: 152490 - DNA, 25 bp, Mus musculus
ttaaggacaatgctgctgactggca

SEQ ID NO: 152491 - DNA, 25 bp, Mus musculus
ttaaggagcccaacatccagaccta

SEQ ID NO: 152492 - DNA, 25 bp, Mus musculus
ttaaggagcttaacaaatgccggga

SEQ ID NO: 152493 - DNA, 25 bp, Mus musculus
ttaaggaggtccagctgccttcact

SEQ ID NO: 152494 - DNA, 25 bp, Mus musculus
ttaaggatcagcgagttcccactgc

SEQ ID NO: 152495 - DNA, 25 bp, Mus musculus
ttaaggtccattgcaaagctgttgt

SEQ ID NO: 152496 - DNA, 25 bp, Mus musculus
ttaaggtcctgctagagccctctgc

SEQ ID NO: 152497 - DNA, 25 bp, Mus musculus
ttaaggtgccacaagaacaacagga

SEQ ID NO: 152498 - DNA, 25 bp, Mus musculus
ttaagtagacgcgtaggccaccgga

SEQ ID NO: 152499 - DNA, 25 bp, Mus musculus
ttaagtgtagaaagcccctatgccc

SEQ ID NO: 152500 - DNA, 25 bp, Mus musculus
ttaagtgtgttgtctgaaattcatc

SEQ ID NO: 152501 - DNA, 25 bp, Mus musculus
ttaagttcgaaggtgctcagcagca

SEQ ID NO: 152502 - DNA, 25 bp, Mus musculus
ttaataagctcgagctgccgcgtcc

SEQ ID NO: 152503 - DNA, 25 bp, Mus musculus
ttaataatatggaagcccagctcgc

SEQ ID NO: 152504 - DNA, 25 bp, Mus musculus
ttaatacactgtttgggctggccag

SEQ ID NO: 152505 - DNA, 25 bp, Mus musculus
ttaatacagggcatgggaccgactg

SEQ ID NO: 152506 - DNA, 25 bp, Mus musculus
ttaataccgaaaacaagcagctggc

SEQ ID NO: 152507 - DNA, 25 bp, Mus musculus
ttaatactgaaaccccgttctggag

SEQ ID NO: 152508 - DNA, 25 bp, Mus musculus
ttaatacttaatatcatatccagaa

SEQ ID NO: 152509 - DNA, 25 bp, Mus musculus
ttaatacttggctgaactggaggat

SEQ ID NO: 152510 - DNA, 25 bp, Mus musculus
ttaatagctcgaggcgaaggcggac

SEQ ID NO: 152511 - DNA, 25 bp, Mus musculus
ttaatagctttctacgtcgggccca

SEQ ID NO: 152512 - DNA, 25 bp, Mus musculus
ttaataggacacgaggaggacaatg

SEQ ID NO: 152513 - DNA, 25 bp, Mus musculus
ttaatcccgtggagccgtgatcgcg

SEQ ID NO: 152514 - DNA, 25 bp, Mus musculus
ttaatcttgactttccagctggccc

SEQ ID NO: 152515 - DNA, 25 bp, Mus musculus
ttaatgaagtccagaagccagacgt

SEQ ID NO: 152516 - DNA, 25 bp, Mus musculus
ttaatgaagttccatcaggactggg

SEQ ID NO: 152517 - DNA, 25 bp, Mus musculus
ttaatgagaactcggcagcacctgg

SEQ ID NO: 152518 - DNA, 25 bp, Mus musculus
ttaatgagcacaggaacagccacgc

SEQ ID NO: 152519 - DNA, 25 bp, Mus musculus
ttaatgagccgcgactgtgcatcag

SEQ ID NO: 152520 - DNA, 25 bp, Mus musculus
ttaatgagtgtcgtgcccatgagcc

SEQ ID NO: 152521 - DNA, 25 bp, Mus musculus
ttaatgccagaagataaggtccagc

SEQ ID NO: 152522 - DNA, 25 bp, Mus musculus
ttaatgctgccttaacagttcggcc

SEQ ID NO: 152523 - DNA, 25 bp, Mus musculus
ttaatggatgtgaagcgccacgggc

SEQ ID NO: 152524 - DNA, 25 bp, Mus musculus
ttaatgtcctgcagagccgaagtcc

SEQ ID NO: 152525 - DNA, 25 bp, Mus musculus
ttaatgtggaaacaaggccggcagc

SEQ ID NO: 152526 - DNA, 25 bp, Mus musculus
ttaatgttcatgacgctcttgtgcg

SEQ ID NO: 152527 - DNA, 25 bp, Mus musculus
ttaattaattgacccaagcaaccct

SEQ ID NO: 152528 - DNA, 25 bp, Mus musculus
ttaattatgcgtgggtgggtctgtc

SEQ ID NO: 152529 - DNA, 25 bp, Mus musculus
ttaattgccatagccatagttgcgg

SEQ ID NO: 152530 - DNA, 25 bp, Mus musculus
ttacaaaaagttgcgacagcccctc

SEQ ID NO: 152531 - DNA, 25 bp, Mus musculus
ttacaaagacatgcctgagaccagc

SEQ ID NO: 152532 - DNA, 25 bp, Mus musculus
ttacaaagcctacgaggacgcagct

SEQ ID NO: 152533 - DNA, 25 bp, Mus musculus
ttacaaaggaagctactcgaatggg

SEQ ID NO: 152534 - DNA, 25 bp, Mus musculus
ttacaaagtcagtggtgaagcagct

SEQ ID NO: 152535 - DNA, 25 bp, Mus musculus
ttacaacaacatcaccggaagacgc

SEQ ID NO: 152536 - DNA, 25 bp, Mus musculus
ttacaacaactatggctgctactgt

SEQ ID NO: 152537 - DNA, 25 bp, Mus musculus
ttacaacccactacctgaagagcgg

SEQ ID NO: 152538 - DNA, 25 bp, Mus musculus
ttacaagagatcatgcggagacggc

SEQ ID NO: 152539 - DNA, 25 bp, Mus musculus
ttacaagcagcctcacaagtgtggg

SEQ ID NO: 152540 - DNA, 25 bp, Mus musculus
ttacaagctgctgaagacggccatg

SEQ ID NO: 152541 - DNA, 25 bp, Mus musculus
ttacaaggctactctgaagggcacc

SEQ ID NO: 152542 - DNA, 25 bp, Mus musculus
ttacaaggctatagaggcagcctcc

SEQ ID NO: 152543 - DNA, 25 bp, Mus musculus
ttacaaggttgtgaggccctctccc

SEQ ID NO: 152544 - DNA, 25 bp, Mus musculus
ttacaatggacagcgatgcccttct

SEQ ID NO: 152545 - DNA, 25 bp, Mus musculus
ttacacaaatagagccaacagggcg

SEQ ID NO: 152546 - DNA, 25 bp, Mus musculus
ttacacagcgcgtttcagcagccat

SEQ ID NO: 152547 - DNA, 25 bp, Mus musculus
ttacaccgagtagagaacgtcagcc

SEQ ID NO: 152548 - DNA, 25 bp, Mus musculus
ttacaccgttgagttccggcgcaca

SEQ ID NO: 152549 - DNA, 25 bp, Mus musculus
ttacacgctggacgctacagcacca

SEQ ID NO: 152550 - DNA, 25 bp, Mus musculus
ttacacgtccaacccgggagctaag

SEQ ID NO: 152551 - DNA, 25 bp, Mus musculus
ttacacgtgtggtagacggcagccc

SEQ ID NO: 152552 - DNA, 25 bp, Mus musculus
ttacactgcagctaagcccgtggcg

SEQ ID NO: 152553 - DNA, 25 bp, Mus musculus
ttacactgggcctagatctttcctg

SEQ ID NO: 152554 - DNA, 25 bp, Mus musculus
ttacagaagtgaagacgcagtctcc

SEQ ID NO: 152555 - DNA, 25 bp, Mus musculus
ttacagaatcctcgtggccacaagg

SEQ ID NO: 152556 - DNA, 25 bp, Mus musculus
ttacagacagcaaacataccgggag

SEQ ID NO: 152557 - DNA, 25 bp, Mus musculus
ttacagaggacaagtgggactggcc

SEQ ID NO: 152558 - DNA, 25 bp, Mus musculus
ttacagcaacctaattttacagcat

SEQ ID NO: 152559 - DNA, 25 bp, Mus musculus
ttacagcacctaaccactggtcggg

SEQ ID NO: 152560 - DNA, 25 bp, Mus musculus
ttacagcacctgaacccagtatggg

SEQ ID NO: 152561 - DNA, 25 bp, Mus musculus
ttacagcagacccaggcacaagtgg

SEQ ID NO: 152562 - DNA, 25 bp, Mus musculus
ttacagcatcgagatcccggatcag

SEQ ID NO: 152563 - DNA, 25 bp, Mus musculus
ttacagcatgaagagagagaaacca

SEQ ID NO: 152564 - DNA, 25 bp, Mus musculus
ttacagcatggtatggagagcttcc

SEQ ID NO: 152565 - DNA, 25 bp, Mus musculus
ttacagccagcccagacaaagtgac

SEQ ID NO: 152566 - DNA, 25 bp, Mus musculus
ttacagcgacctgcagaactgcttg

SEQ ID NO: 152567 - DNA, 25 bp, Mus musculus
ttacagctggacgtcatccggatcc

SEQ ID NO: 152568 - DNA, 25 bp, Mus musculus
ttacaggaagaaggcaagagcgcca

SEQ ID NO: 152569 - DNA, 25 bp, Mus musculus
ttacaggcatgcatgaccacacgtg

SEQ ID NO: 152570 - DNA, 25 bp, Mus musculus
ttacagtaacatgaaagatccaggg

SEQ ID NO: 152571 - DNA, 25 bp, Mus musculus
ttacagtattgcttgctgaagagga

SEQ ID NO: 152572 - DNA, 25 bp, Mus musculus
ttacagtgcaaaggaggacacagcc

SEQ ID NO: 152573 - DNA, 25 bp, Mus musculus
ttacatacaataacacttggtggct

SEQ ID NO: 152574 - DNA, 25 bp, Mus musculus
ttacatagaaagtgcctgctcctgg

SEQ ID NO: 152575 - DNA, 25 bp, Mus musculus
ttacatcacaaagaactggaggcgc

SEQ ID NO: 152576 - DNA, 25 bp, Mus musculus
ttacatcagagctaacagggacggc

SEQ ID NO: 152577 - DNA, 25 bp, Mus musculus
ttacatcgatgacccaaatggcctg

SEQ ID NO: 152578 - DNA, 25 bp, Mus musculus
ttacatgttcaacaatggcagcggg

SEQ ID NO: 152579 - DNA, 25 bp, Mus musculus
ttacatgttttccagctaagcccag

SEQ ID NO: 152580 - DNA, 25 bp, Mus musculus
ttacatttctggacaggtaggcctg

SEQ ID NO: 152581 - DNA, 25 bp, Mus musculus
ttacatttgcctcaaggggacttgc

SEQ ID NO: 152582 - DNA, 25 bp, Mus musculus
ttaccaaagaatatgaccgcctgct

SEQ ID NO: 152583 - DNA, 25 bp, Mus musculus
ttaccaacactgcaacctgaggacg

SEQ ID NO: 152584 - DNA, 25 bp, Mus musculus
ttaccaagcccgcaagatgcattac

SEQ ID NO: 152585 - DNA, 25 bp, Mus musculus
ttaccaagtgtgtgccgagaccaga

SEQ ID NO: 152586 - DNA, 25 bp, Mus musculus
ttaccaataaagcaaaagcgggtca

SEQ ID NO: 152587 - DNA, 25 bp, Mus musculus
ttaccacaaggagccggattgcctg

SEQ ID NO: 152588 - DNA, 25 bp, Mus musculus
ttaccaccgcctgaagaacttgcag

SEQ ID NO: 152589 - DNA, 25 bp, Mus musculus
ttaccacgcagatattgggccactg

SEQ ID NO: 152590 - DNA, 25 bp, Mus musculus
ttaccactctggacaatgggcttcg

SEQ ID NO: 152591 - DNA, 25 bp, Mus musculus
ttaccagacacggatgagaactacg

SEQ ID NO: 152592 - DNA, 25 bp, Mus musculus
ttaccagagggaagagcaacaattg

SEQ ID NO: 152593 - DNA, 25 bp, Mus musculus
ttaccagcagggactcacagaactc

SEQ ID NO: 152594 - DNA, 25 bp, Mus musculus
ttaccaggatcagtgcaggcatagc

SEQ ID NO: 152595 - DNA, 25 bp, Mus musculus
ttaccagggagagcagcgaacttct

SEQ ID NO: 152596 - DNA, 25 bp, Mus musculus
ttaccagtgcatcgtggacaacggg

SEQ ID NO: 152597 - DNA, 25 bp, Mus musculus
ttaccatgaaaacatcgccgcagtg

SEQ ID NO: 152598 - DNA, 25 bp, Mus musculus
ttaccatgctaacgaggagggctct

SEQ ID NO: 152599 - DNA, 25 bp, Mus musculus
ttaccatggttgacacagagatgcc

SEQ ID NO: 152600 - DNA, 25 bp, Mus musculus
ttacccacatacatttagaactccg

SEQ ID NO: 152601 - DNA, 25 bp, Mus musculus
ttaccctggcacgaaataaagttgc

SEQ ID NO: 152602 - DNA, 25 bp, Mus musculus
ttaccctgggaaagtgggccatcct

SEQ ID NO: 152603 - DNA, 25 bp, Mus musculus
ttaccgacgggaatcgctgcgtgga

SEQ ID NO: 152604 - DNA, 25 bp, Mus musculus
ttaccgagcagcttggagcctgagc

SEQ ID NO: 152605 - DNA, 25 bp, Mus musculus
ttaccgcaaagtgctgcaggccgtg

SEQ ID NO: 152606 - DNA, 25 bp, Mus musculus
ttaccgcgagggaataatgtcggct

SEQ ID NO: 152607 - DNA, 25 bp, Mus musculus
ttaccgctgtgtcaccgaagagtgc

SEQ ID NO: 152608 - DNA, 25 bp, Mus musculus
ttaccggcgacagcgatgaactcta

SEQ ID NO: 152609 - DNA, 25 bp, Mus musculus
ttaccgggaaaagcaactggacgag

SEQ ID NO: 152610 - DNA, 25 bp, Mus musculus
ttaccgtcagaagtccacgtgaggg

SEQ ID NO: 152611 - DNA, 25 bp, Mus musculus
ttacctaaacatgtggcttgctcag

SEQ ID NO: 152612 - DNA, 25 bp, Mus musculus
ttacctaacaaatacaacttctcct

SEQ ID NO: 152613 - DNA, 25 bp, Mus musculus
ttacctcatgagtgcagttcagccc

SEQ ID NO: 152614 - DNA, 25 bp, Mus musculus
ttacctccttttcccaacagcagtg

SEQ ID NO: 152615 - DNA, 25 bp, Mus musculus
ttacctcgtaagaggagccagcgca

SEQ ID NO: 152616 - DNA, 25 bp, Mus musculus
ttacctctgaccagtacaaggccta

SEQ ID NO: 152617 - DNA, 25 bp, Mus musculus
ttacctgagtccctcccaaagaagg

SEQ ID NO: 152618 - DNA, 25 bp, Mus musculus
ttacctgccaaagggcgagagaacc

SEQ ID NO: 152619 - DNA, 25 bp, Mus musculus
ttacctgggcggatccatggacctc

SEQ ID NO: 152620 - DNA, 25 bp, Mus musculus
ttacctgttgatctcccagctgagg

SEQ ID NO: 152621 - DNA, 25 bp, Mus musculus
ttacctttcctggagcggactgcgc

SEQ ID NO: 152622 - DNA, 25 bp, Mus musculus
ttacgaacccggagaccttgcgtgt

SEQ ID NO: 152623 - DNA, 25 bp, Mus musculus
ttacgagccgcttggatactaccca

SEQ ID NO: 152624 - DNA, 25 bp, Mus musculus
ttacgagcgccacctggaagcccat

SEQ ID NO: 152625 - DNA, 25 bp, Mus musculus
ttacgagggttacaactatggctcc

SEQ ID NO: 152626 - DNA, 25 bp, Mus musculus
ttacgatccccaggcgatggagttg

SEQ ID NO: 152627 - DNA, 25 bp, Mus musculus
ttacgccctgcagtacttcaaggag

SEQ ID NO: 152628 - DNA, 25 bp, Mus musculus
ttacgctgatgtttaccgagatggc

SEQ ID NO: 152629 - DNA, 25 bp, Mus musculus
ttacggccccggagagactctgtgc

SEQ ID NO: 152630 - DNA, 25 bp, Mus musculus
ttacggcttggtatgcggagcaccg

SEQ ID NO: 152631 - DNA, 25 bp, Mus musculus
ttacgggcggtcagcttcccagaag

SEQ ID NO: 152632 - DNA, 25 bp, Mus musculus
ttacgggctagaggatgaccagcgc

SEQ ID NO: 152633 - DNA, 25 bp, Mus musculus
ttacgtagaatgtgtgggcgcctga

SEQ ID NO: 152634 - DNA, 25 bp, Mus musculus
ttacgtcgccggctgtgcccggacc

SEQ ID NO: 152635 - DNA, 25 bp, Mus musculus
ttacgtcttcatcggtgtgggcgcc

SEQ ID NO: 152636 - DNA, 25 bp, Mus musculus
ttacgtcttcgtaggcagtcccagg

SEQ ID NO: 152637 - DNA, 25 bp, Mus musculus
ttacgtgcactctacttgcaggggt

SEQ ID NO: 152638 - DNA, 25 bp, Mus musculus
ttacgtgggtgtgctcttaggctcc

SEQ ID NO: 152639 - DNA, 25 bp, Mus musculus
ttacgttaacagcgctcgggactcg

SEQ ID NO: 152640 - DNA, 25 bp, Mus musculus
ttactaacccagctcgaaaggacgg

SEQ ID NO: 152641 - DNA, 25 bp, Mus musculus
ttactaccactactacagcaggcgc

SEQ ID NO: 152642 - DNA, 25 bp, Mus musculus
ttactagcggaatataacgggcgcc

SEQ ID NO: 152643 - DNA, 25 bp, Mus musculus
ttactatgggcaaggtggaatgagt

SEQ ID NO: 152644 - DNA, 25 bp, Mus musculus
ttactcaacaattaccagcgggcca

SEQ ID NO: 152645 - DNA, 25 bp, Mus musculus
ttactcacagcagcggaaaccatgg

SEQ ID NO: 152646 - DNA, 25 bp, Mus musculus
ttactcacagtaggacacccagacg

SEQ ID NO: 152647 - DNA, 25 bp, Mus musculus
ttactcacccgttgagcgtcgacag

SEQ ID NO: 152648 - DNA, 25 bp, Mus musculus
ttactcactgtggaaccgtcttggg

SEQ ID NO: 152649 - DNA, 25 bp, Mus musculus
ttactcaggggcacgcgcagcgttt

SEQ ID NO: 152650 - DNA, 25 bp, Mus musculus
ttactccaagtcagggccaacaagg

SEQ ID NO: 152651 - DNA, 25 bp, Mus musculus
ttactccagtaaagccggtcgacag

SEQ ID NO: 152652 - DNA, 25 bp, Mus musculus
ttactccgcagtggaacaggcatgc

SEQ ID NO: 152653 - DNA, 25 bp, Mus musculus
ttactccgtacataataagccaggc

SEQ ID NO: 152654 - DNA, 25 bp, Mus musculus
ttactcgtgagtgatcccgtgggcg

SEQ ID NO: 152655 - DNA, 25 bp, Mus musculus
ttactgaaacaggaagcgtgggact

SEQ ID NO: 152656 - DNA, 25 bp, Mus musculus
ttactgagcagtggccataccggac

SEQ ID NO: 152657 - DNA, 25 bp, Mus musculus
ttactgatagttgagagccaccccg

SEQ ID NO: 152658 - DNA, 25 bp, Mus musculus
ttactgatgagaagctagatgaagt

SEQ ID NO: 152659 - DNA, 25 bp, Mus musculus
ttactgcagaaaccattgcccgtcg

SEQ ID NO: 152660 - DNA, 25 bp, Mus musculus
ttactgcaggagaaggcaagccgga

SEQ ID NO: 152661 - DNA, 25 bp, Mus musculus
ttactgcatgcgctgtggagacctg

SEQ ID NO: 152662 - DNA, 25 bp, Mus musculus
ttactgctagggagatgcttgccac

SEQ ID NO: 152663 - DNA, 25 bp, Mus musculus
ttactgctggcaccgtctgatgtgg

SEQ ID NO: 152664 - DNA, 25 bp, Mus musculus
ttactggagaaagcttgggacaccc

SEQ ID NO: 152665 - DNA, 25 bp, Mus musculus
ttactggtggagaaggcaattagca

SEQ ID NO: 152666 - DNA, 25 bp, Mus musculus
ttactgtacttcctgccacaatgtc

SEQ ID NO: 152667 - DNA, 25 bp, Mus musculus
ttactgtcacaagccgccagtacag

SEQ ID NO: 152668 - DNA, 25 bp, Mus musculus
ttactgttgtccagctacggcggga

SEQ ID NO: 152669 - DNA, 25 bp, Mus musculus
ttactgtttaggagagaagacaacc

SEQ ID NO: 152670 - DNA, 25 bp, Mus musculus
ttacttagactgacaaagactctag

SEQ ID NO: 152671 - DNA, 25 bp, Mus musculus
ttacttcaatgctagtggccgtgcc

SEQ ID NO: 152672 - DNA, 25 bp, Mus musculus
ttacttcccagaccaggtgtccggc

SEQ ID NO: 152673 - DNA, 25 bp, Mus musculus
ttacttccgcccggcctagtgtggt

SEQ ID NO: 152674 - DNA, 25 bp, Mus musculus
ttacttgaactcaatataagagcag

SEQ ID NO: 152675 - DNA, 25 bp, Mus musculus
ttactttgctcaggcacgttggcgc

SEQ ID NO: 152676 - DNA, 25 bp, Mus musculus
ttagaaaacaagatcctggctgtgc

SEQ ID NO: 152677 - DNA, 25 bp, Mus musculus
ttagaaaaccagaagactccagccc

SEQ ID NO: 152678 - DNA, 25 bp, Mus musculus
ttagaaaagatccaagaggagctcg

SEQ ID NO: 152679 - DNA, 25 bp, Mus musculus
ttagaaacaagtgcttgaccattgg

SEQ ID NO: 152680 - DNA, 25 bp, Mus musculus
ttagaaaccctacctgactggctgg

SEQ ID NO: 152681 - DNA, 25 bp, Mus musculus
ttagaaacctctacagaaactgcct

SEQ ID NO: 152682 - DNA, 25 bp, Mus musculus
ttagaaaggctacaaaccactgact

SEQ ID NO: 152683 - DNA, 25 bp, Mus musculus
ttagaacaccgacaatcacgtgcgg

SEQ ID NO: 152684 - DNA, 25 bp, Mus musculus
ttagaagactcagctgccaggcaga

SEQ ID NO: 152685 - DNA, 25 bp, Mus musculus
ttagaagagctatgtgtccgtcccc

SEQ ID NO: 152686 - DNA, 25 bp, Mus musculus
ttagaagccggcaatgagccccatc

SEQ ID NO: 152687 - DNA, 25 bp, Mus musculus
ttagaagctggtgtgtacaaaatgc

SEQ ID NO: 152688 - DNA, 25 bp, Mus musculus
ttagaagggctttatggaccacggc

SEQ ID NO: 152689 - DNA, 25 bp, Mus musculus
ttagaagtggctatggaagaagaag

SEQ ID NO: 152690 - DNA, 25 bp, Mus musculus
ttagaatactgtgaagggaatgacc

SEQ ID NO: 152691 - DNA, 25 bp, Mus musculus
ttagaatgggaaagactccgtcggc

SEQ ID NO: 152692 - DNA, 25 bp, Mus musculus
ttagaattcggagccacaagcagtg

SEQ ID NO: 152693 - DNA, 25 bp, Mus musculus
ttagacaaagtgacaaccgtgcccc

SEQ ID NO: 152694 - DNA, 25 bp, Mus musculus
ttagacaatattaaccgggcagccg

SEQ ID NO: 152695 - DNA, 25 bp, Mus musculus
ttagacatgcgtcagccagcgttgg

SEQ ID NO: 152696 - DNA, 25 bp, Mus musculus
ttagaccacttaatcccgggcacca

SEQ ID NO: 152697 - DNA, 25 bp, Mus musculus
ttagaccatgtggtgagcagcacag

SEQ ID NO: 152698 - DNA, 25 bp, Mus musculus
ttagaccccattgcagccaggatga

SEQ ID NO: 152699 - DNA, 25 bp, Mus musculus
ttagaccgattcaaagaaccacctg

SEQ ID NO: 152700 - DNA, 25 bp, Mus musculus
ttagaccggtacttgcccatcactg

SEQ ID NO: 152701 - DNA, 25 bp, Mus musculus
ttagaccgtcatgagcgaggccagt

SEQ ID NO: 152702 - DNA, 25 bp, Mus musculus
ttagacgagagctatcctgtgaggg

SEQ ID NO: 152703 - DNA, 25 bp, Mus musculus
ttagactatagcagaaacatcccag

SEQ ID NO: 152704 - DNA, 25 bp, Mus musculus
ttagagaccaatgaggaccccgaga

SEQ ID NO: 152705 - DNA, 25 bp, Mus musculus
ttagagaccactagccagagctggc

SEQ ID NO: 152706 - DNA, 25 bp, Mus musculus
ttagagacctccaacatgccttcgg

SEQ ID NO: 152707 - DNA, 25 bp, Mus musculus
ttagagagctgacagcgcaccacct

SEQ ID NO: 152708 - DNA, 25 bp, Mus musculus
ttagagatgcacgaccgcatggagc

SEQ ID NO: 152709 - DNA, 25 bp, Mus musculus
ttagagatgtgcgtgaacccagacc

SEQ ID NO: 152710 - DNA, 25 bp, Mus musculus
ttagagcagaagacgctgagccctc

SEQ ID NO: 152711 - DNA, 25 bp, Mus musculus
ttagagctctgtgcaaaggcctttg

SEQ ID NO: 152712 - DNA, 25 bp, Mus musculus
ttagagcttgaactgcccgaatccc

SEQ ID NO: 152713 - DNA, 25 bp, Mus musculus
ttagagtccttgtttggcgccggcc

SEQ ID NO: 152714 - DNA, 25 bp, Mus musculus
ttagagtctgggactggcttgcctc

SEQ ID NO: 152715 - DNA, 25 bp, Mus musculus
ttagagtgtcttccccatgcacagc

SEQ ID NO: 152716 - DNA, 25 bp, Mus musculus
ttagagtttgattcccgaagggcgt

SEQ ID NO: 152717 - DNA, 25 bp, Mus musculus
ttagataatcctacgcagctgggct

SEQ ID NO: 152718 - DNA, 25 bp, Mus musculus
ttagatactcgtcagagggaacccc

SEQ ID NO: 152719 - DNA, 25 bp, Mus musculus
ttagatctgtgtgagcgattccagc

SEQ ID NO: 152720 - DNA, 25 bp, Mus musculus
ttagatgacgatggctccgaattcc

SEQ ID NO: 152721 - DNA, 25 bp, Mus musculus
ttagatgcgccacggcttcggtagc

SEQ ID NO: 152722 - DNA, 25 bp, Mus musculus
ttagatgtcgtgtctgtggccgccc

SEQ ID NO: 152723 - DNA, 25 bp, Mus musculus
ttagattcgcttgggcctagacgcc

SEQ ID NO: 152724 - DNA, 25 bp, Mus musculus
ttagcaacaggctcacaggatcgca

SEQ ID NO: 152725 - DNA, 25 bp, Mus musculus
ttagcaaccattactgccccggagg

SEQ ID NO: 152726 - DNA, 25 bp, Mus musculus
ttagcaagcgagagaaaggactgcg

SEQ ID NO: 152727 - DNA, 25 bp, Mus musculus
ttagcaatgattccctaggcactgg

SEQ ID NO: 152728 - DNA, 25 bp, Mus musculus
ttagcaatgtgtcaccagatgggac

SEQ ID NO: 152729 - DNA, 25 bp, Mus musculus
ttagcacactcatcagaagaatctg

SEQ ID NO: 152730 - DNA, 25 bp, Mus musculus
ttagcacagtaaggacttcagagga

SEQ ID NO: 152731 - DNA, 25 bp, Mus musculus
ttagcaccttgtctcctgagggacg

SEQ ID NO: 152732 - DNA, 25 bp, Mus musculus
ttagcacggaccaatcactgcacgg

SEQ ID NO: 152733 - DNA, 25 bp, Mus musculus
ttagcactcacgaaccatggactgg

SEQ ID NO: 152734 - DNA, 25 bp, Mus musculus
ttagcagaaggacgtgttttcccgc

SEQ ID NO: 152735 - DNA, 25 bp, Mus musculus
ttagcagattatcgatatggccgag

SEQ ID NO: 152736 - DNA, 25 bp, Mus musculus
ttagcagctctgagtcgtgtccgcc

SEQ ID NO: 152737 - DNA, 25 bp, Mus musculus
ttagcatcgtgtccgtggctgcgca

SEQ ID NO: 152738 - DNA, 25 bp, Mus musculus
ttagcatctctccagtgggctgtcc

SEQ ID NO: 152739 - DNA, 25 bp, Mus musculus
ttagcatgagccaaactggaccccg

SEQ ID NO: 152740 - DNA, 25 bp, Mus musculus
ttagcatgagcctctccagacgcct

SEQ ID NO: 152741 - DNA, 25 bp, Mus musculus
ttagcatggcagcaatctcttagtg

SEQ ID NO: 152742 - DNA, 25 bp, Mus musculus
ttagcatggtaccaagaccagtatg

SEQ ID NO: 152743 - DNA, 25 bp, Mus musculus
ttagccaatgccatgatgcccggtg

SEQ ID NO: 152744 - DNA, 25 bp, Mus musculus
ttagccaggtacaaaccaacgggag

SEQ ID NO: 152745 - DNA, 25 bp, Mus musculus
ttagccatcgtgcagatcatccgag

SEQ ID NO: 152746 - DNA, 25 bp, Mus musculus
ttagccatggatttcaccgtggaag

SEQ ID NO: 152747 - DNA, 25 bp, Mus musculus
ttagccattgaaactgaacaccgtc

SEQ ID NO: 152748 - DNA, 25 bp, Mus musculus
ttagcccagacagaagactacgtgg

SEQ ID NO: 152749 - DNA, 25 bp, Mus musculus
ttagcccagcgcatgagtcacggca

SEQ ID NO: 152750 - DNA, 25 bp, Mus musculus
ttagcccagcgtgtgaaggagtctc

SEQ ID NO: 152751 - DNA, 25 bp, Mus musculus
ttagcccgtcgggatgctgtgcgcc

SEQ ID NO: 152752 - DNA, 25 bp, Mus musculus
ttagcctctgtaccctgggccagga

SEQ ID NO: 152753 - DNA, 25 bp, Mus musculus
ttagcctgtcctacggaagcctgcg

SEQ ID NO: 152754 - DNA, 25 bp, Mus musculus
ttagccttgggctctggtaaagctg

SEQ ID NO: 152755 - DNA, 25 bp, Mus musculus
ttagcgagtctcagtcatgtaggcc

SEQ ID NO: 152756 - DNA, 25 bp, Mus musculus
ttagcgtcactatcgtcctctgcgg

SEQ ID NO: 152757 - DNA, 25 bp, Mus musculus
ttagcgtcgttctcagaggcagggc

SEQ ID NO: 152758 - DNA, 25 bp, Mus musculus
ttagcgttggcccagcgaagctcgt

SEQ ID NO: 152759 - DNA, 25 bp, Mus musculus
ttagctacgtccctgtggctgcggc

SEQ ID NO: 152760 - DNA, 25 bp, Mus musculus
ttagctcaatcatgtactgaaatcc

SEQ ID NO: 152761 - DNA, 25 bp, Mus musculus
ttagctctgcagtggagtcccgctg

SEQ ID NO: 152762 - DNA, 25 bp, Mus musculus
ttagctgaccggaatagaagggaag

SEQ ID NO: 152763 - DNA, 25 bp, Mus musculus
ttagctgactatctagggttggccc

SEQ ID NO: 152764 - DNA, 25 bp, Mus musculus
ttagctgccttcattctgccgaatg

SEQ ID NO: 152765 - DNA, 25 bp, Mus musculus
ttagctggatgagaggacacgagtc

SEQ ID NO: 152766 - DNA, 25 bp, Mus musculus
ttagctgtgttttggactccgtgtc

SEQ ID NO: 152767 - DNA, 25 bp, Mus musculus
ttagcttacaaaatgttggccaggg

SEQ ID NO: 152768 - DNA, 25 bp, Mus musculus
ttaggaagactcgacgctgggctcg

SEQ ID NO: 152769 - DNA, 25 bp, Mus musculus
ttaggaccatccatatccgatgagc

SEQ ID NO: 152770 - DNA, 25 bp, Mus musculus
ttaggagaagcagtgacccagcacc

SEQ ID NO: 152771 - DNA, 25 bp, Mus musculus
ttaggagactgcaaaaccatcccag

SEQ ID NO: 152772 - DNA, 25 bp, Mus musculus
ttaggaggtatgacccagagccacc

SEQ ID NO: 152773 - DNA, 25 bp, Mus musculus
ttaggatgtggtgcctcttgttttg

SEQ ID NO: 152774 - DNA, 25 bp, Mus musculus
ttaggcaaaggctcccgtctgttcc

SEQ ID NO: 152775 - DNA, 25 bp, Mus musculus
ttaggcaccacacaagaaacacttg

SEQ ID NO: 152776 - DNA, 25 bp, Mus musculus
ttaggcatgatagaagccacggccc

SEQ ID NO: 152777 - DNA, 25 bp, Mus musculus
ttaggccagccttattccatgtcgg

SEQ ID NO: 152778 - DNA, 25 bp, Mus musculus
ttaggccggacacctgtaatccacg

SEQ ID NO: 152779 - DNA, 25 bp, Mus musculus
ttaggcgctgctcgccttctctgtc

SEQ ID NO: 152780 - DNA, 25 bp, Mus musculus
ttaggctagtgaagctgtgagctgc

SEQ ID NO: 152781 - DNA, 25 bp, Mus musculus
ttaggctcagggttgcgcacagttc

SEQ ID NO: 152782 - DNA, 25 bp, Mus musculus
ttaggctgcgactgaccaagctgca

SEQ ID NO: 152783 - DNA, 25 bp, Mus musculus
ttagggaacatccatcacaagccag

SEQ ID NO: 152784 - DNA, 25 bp, Mus musculus
ttagggcatgtgaaaaccagtatcc

SEQ ID NO: 152785 - DNA, 25 bp, Mus musculus
ttagggccaggcacagactgctttc

SEQ ID NO: 152786 - DNA, 25 bp, Mus musculus
ttagggtcagacaacctcggtggcc

SEQ ID NO: 152787 - DNA, 25 bp, Mus musculus
ttaggtgaggactccatcaagggcc

SEQ ID NO: 152788 - DNA, 25 bp, Mus musculus
ttaggtgggaacagaatcgacagcc

SEQ ID NO: 152789 - DNA, 25 bp, Mus musculus
ttaggttccaactcggagagcgggc

SEQ ID NO: 152790 - DNA, 25 bp, Mus musculus
ttagtaataagcatgtgggccagac

SEQ ID NO: 152791 - DNA, 25 bp, Mus musculus
ttagtagaacaagaggagctgcccg

SEQ ID NO: 152792 - DNA, 25 bp, Mus musculus
ttagtataggtggttcggctgcccc

SEQ ID NO: 152793 - DNA, 25 bp, Mus musculus
ttagtatcctgaatgtagaagacac

SEQ ID NO: 152794 - DNA, 25 bp, Mus musculus
ttagtcacctcgcagcggacaaggg

SEQ ID NO: 152795 - DNA, 25 bp, Mus musculus
ttagtcccactttgcttctactggc

SEQ ID NO: 152796 - DNA, 25 bp, Mus musculus
ttagtccgagatggcgtccctcgcg

SEQ ID NO: 152797 - DNA, 25 bp, Mus musculus
ttagtccgagtggagcgagcgagtc

SEQ ID NO: 152798 - DNA, 25 bp, Mus musculus
ttagtcgagtggctcccaagctacc

SEQ ID NO: 152799 - DNA, 25 bp, Mus musculus
ttagtctggtttgggaacttgttct

SEQ ID NO: 152800 - DNA, 25 bp, Mus musculus
ttagtgaagatgtgcgaccacctgc

SEQ ID NO: 152801 - DNA, 25 bp, Mus musculus
ttagtgtgccgagaatgccgagttc

SEQ ID NO: 152802 - DNA, 25 bp, Mus musculus
ttagttacctgatgtcagagctccg

SEQ ID NO: 152803 - DNA, 25 bp, Mus musculus
ttagttatgtgcagcgcgtggcgct

SEQ ID NO: 152804 - DNA, 25 bp, Mus musculus
ttagttcccggtcacatgagcaccc

SEQ ID NO: 152805 - DNA, 25 bp, Mus musculus
ttagttgaaaacaaaggcctctgcc

SEQ ID NO: 152806 - DNA, 25 bp, Mus musculus
ttagtttcgccggactggatgccac

SEQ ID NO: 152807 - DNA, 25 bp, Mus musculus
ttataacagccaatgcagccgccat

SEQ ID NO: 152808 - DNA, 25 bp, Mus musculus
ttataaggtgtcagatggaaggcct

SEQ ID NO: 152809 - DNA, 25 bp, Mus musculus
ttataatcgttacatcaccaaagga

SEQ ID NO: 152810 - DNA, 25 bp, Mus musculus
ttataattactgacaagaccacttc

SEQ ID NO: 152811 - DNA, 25 bp, Mus musculus
ttatacataaccaccataccaggga

SEQ ID NO: 152812 - DNA, 25 bp, Mus musculus
ttataccaagtcaaagcgaggccac

SEQ ID NO: 152813 - DNA, 25 bp, Mus musculus
ttataccagcggaggagaagccagt

SEQ ID NO: 152814 - DNA, 25 bp, Mus musculus
ttatacgttcacatggacagcccgg

SEQ ID NO: 152815 - DNA, 25 bp, Mus musculus
ttatagtgcaagagtcatggtcggc

SEQ ID NO: 152816 - DNA, 25 bp, Mus musculus
ttatatcaccattgttgaaattaat

SEQ ID NO: 152817 - DNA, 25 bp, Mus musculus
ttatatccggagcacagatgtggac

SEQ ID NO: 152818 - DNA, 25 bp, Mus musculus
ttatatgaggaaagccatggcatcg

SEQ ID NO: 152819 - DNA, 25 bp, Mus musculus
ttatatgcgccttattgggagccca

SEQ ID NO: 152820 - DNA, 25 bp, Mus musculus
ttatatggagacaccctagttacag

SEQ ID NO: 152821 - DNA, 25 bp, Mus musculus
ttatcaaaccaacaacagagatgcc

SEQ ID NO: 152822 - DNA, 25 bp, Mus musculus
ttatcaagaagtgtaggaccagccc

SEQ ID NO: 152823 - DNA, 25 bp, Mus musculus
ttatcaatagaaaagctcctgattg

SEQ ID NO: 152824 - DNA, 25 bp, Mus musculus
ttatcacaacaggacattgggcccc

SEQ ID NO: 152825 - DNA, 25 bp, Mus musculus
ttatcacagcatcctgacccgtggg

SEQ ID NO: 152826 - DNA, 25 bp, Mus musculus
ttatcactggcactggaatcctggc

SEQ ID NO: 152827 - DNA, 25 bp, Mus musculus
ttatcaggcccaagtctgccaaggg

SEQ ID NO: 152828 - DNA, 25 bp, Mus musculus
ttatcagtgcgctcctaaaagggcc

SEQ ID NO: 152829 - DNA, 25 bp, Mus musculus
ttatcatgcgctgttgggatgccca

SEQ ID NO: 152830 - DNA, 25 bp, Mus musculus
ttatcatgggtggaaggatgagtcc

SEQ ID NO: 152831 - DNA, 25 bp, Mus musculus
ttatccacaggttcatcagcgcgag

SEQ ID NO: 152832 - DNA, 25 bp, Mus musculus
ttatccaccaggacgggtattcgct

SEQ ID NO: 152833 - DNA, 25 bp, Mus musculus
ttatccagtgttttgagggccgcca

SEQ ID NO: 152834 - DNA, 25 bp, Mus musculus
ttatcccaagaggaactgacagttg

SEQ ID NO: 152835 - DNA, 25 bp, Mus musculus
ttatccccttggtgcagacattcgg

SEQ ID NO: 152836 - DNA, 25 bp, Mus musculus
ttatcccggaactgcaaggtgttgg

SEQ ID NO: 152837 - DNA, 25 bp, Mus musculus
ttatccggcgtatggtgaaagcaca

SEQ ID NO: 152838 - DNA, 25 bp, Mus musculus
ttatccgggacttaaccttgcgcag

SEQ ID NO: 152839 - DNA, 25 bp, Mus musculus
ttatcctgctgcgatccccagggaa

SEQ ID NO: 152840 - DNA, 25 bp, Mus musculus
ttatcctttacagcaggccctcggg

SEQ ID NO: 152841 - DNA, 25 bp, Mus musculus
ttatcgcaggcgctttccccggaag

SEQ ID NO: 152842 - DNA, 25 bp, Mus musculus
ttatcgccagaagaaatgggcctca

SEQ ID NO: 152843 - DNA, 25 bp, Mus musculus
ttatcgctgggctactgggcacagg

SEQ ID NO: 152844 - DNA, 25 bp, Mus musculus
ttatcggacgagacatgcagcctgc

SEQ ID NO: 152845 - DNA, 25 bp, Mus musculus
ttatctaagttctatatgggccatg

SEQ ID NO: 152846 - DNA, 25 bp, Mus musculus
ttatctcagagacctttcggagccg

SEQ ID NO: 152847 - DNA, 25 bp, Mus musculus
ttatctccagaagaagggctatcct

SEQ ID NO: 152848 - DNA, 25 bp, Mus musculus
ttatctgcacagtatagccatcgac

SEQ ID NO: 152849 - DNA, 25 bp, Mus musculus
ttatctgcgatgtgcacaacccagg

SEQ ID NO: 152850 - DNA, 25 bp, Mus musculus
ttatctgggagtattttggatgtgt

SEQ ID NO: 152851 - DNA, 25 bp, Mus musculus
ttatctgggtgtgcagagacatcca

SEQ ID NO: 152852 - DNA, 25 bp, Mus musculus
ttatctgtgagagcgatcaccccaa

SEQ ID NO: 152853 - DNA, 25 bp, Mus musculus
ttatcttcacccagcaataggcctt

SEQ ID NO: 152854 - DNA, 25 bp, Mus musculus
ttatcttcacgtacacccgagaggg

SEQ ID NO: 152855 - DNA, 25 bp, Mus musculus
ttatcttcatgaatggcaaccgtgc

SEQ ID NO: 152856 - DNA, 25 bp, Mus musculus
ttatcttcggctccctacttggcgg

SEQ ID NO: 152857 - DNA, 25 bp, Mus musculus
ttatcttctgcgtgcgggaggagcc

SEQ ID NO: 152858 - DNA, 25 bp, Mus musculus
ttatcttgacaaactggagcccagc

SEQ ID NO: 152859 - DNA, 25 bp, Mus musculus
ttatgaaacagactacgacaccggc

SEQ ID NO: 152860 - DNA, 25 bp, Mus musculus
ttatgaagagagactgacgtggcac

SEQ ID NO: 152861 - DNA, 25 bp, Mus musculus
ttatgaaggagcgtgaatcaccagg

SEQ ID NO: 152862 - DNA, 25 bp, Mus musculus
ttatgaatgaacagggagaataccc

SEQ ID NO: 152863 - DNA, 25 bp, Mus musculus
ttatgaatgccctgactgcggaagg

SEQ ID NO: 152864 - DNA, 25 bp, Mus musculus
ttatgacccgggaaagcaccctgaa

SEQ ID NO: 152865 - DNA, 25 bp, Mus musculus
ttatgagaatcgagagtccacaccc

SEQ ID NO: 152866 - DNA, 25 bp, Mus musculus
ttatgagagcccataccctggagca

SEQ ID NO: 152867 - DNA, 25 bp, Mus musculus
ttatgagaggatcagatgcaagcca

SEQ ID NO: 152868 - DNA, 25 bp, Mus musculus
ttatgagagggtccaagacagcccg

SEQ ID NO: 152869 - DNA, 25 bp, Mus musculus
ttatgagctgagtgatggagcttcg

SEQ ID NO: 152870 - DNA, 25 bp, Mus musculus
ttatgaggagaatcgtgcagaggcc

SEQ ID NO: 152871 - DNA, 25 bp, Mus musculus
ttatgaggcgtcactggcgtctgga

SEQ ID NO: 152872 - DNA, 25 bp, Mus musculus
ttatgaggtcagcatacgccagcgc

SEQ ID NO: 152873 - DNA, 25 bp, Mus musculus
ttatgagttcggcttctgaaaactc

SEQ ID NO: 152874 - DNA, 25 bp, Mus musculus
ttatgatcctctggctaaagggtgt

SEQ ID NO: 152875 - DNA, 25 bp, Mus musculus
ttatgatgaggtgctaaatagcttc

SEQ ID NO: 152876 - DNA, 25 bp, Mus musculus
ttatgatgggcacctttcccggctg

SEQ ID NO: 152877 - DNA, 25 bp, Mus musculus
ttatgattaccacccaggaagcgga

SEQ ID NO: 152878 - DNA, 25 bp, Mus musculus
ttatgcagacgtacagaaggacgga

SEQ ID NO: 152879 - DNA, 25 bp, Mus musculus
ttatgcaggaggaagataaagccct

SEQ ID NO: 152880 - DNA, 25 bp, Mus musculus
ttatgccaacaagaagagcgctgcg

SEQ ID NO: 152881 - DNA, 25 bp, Mus musculus
ttatgcctaaccacgaatcttcgag

SEQ ID NO: 152882 - DNA, 25 bp, Mus musculus
ttatgctgaatttggtgcccgggtc

SEQ ID NO: 152883 - DNA, 25 bp, Mus musculus
ttatggaagaagagcacacggccct

SEQ ID NO: 152884 - DNA, 25 bp, Mus musculus
ttatggaaggaactttacacctggg

SEQ ID NO: 152885 - DNA, 25 bp, Mus musculus
ttatggaattctgcgctcaaggaca

SEQ ID NO: 152886 - DNA, 25 bp, Mus musculus
ttatggccagccttatcaccgccga

SEQ ID NO: 152887 - DNA, 25 bp, Mus musculus
ttatggccagctgaaccccaagtgg

SEQ ID NO: 152888 - DNA, 25 bp, Mus musculus
ttatggccgcaaatacgactttacg

SEQ ID NO: 152889 - DNA, 25 bp, Mus musculus
ttatggccggaagatcatgaggaag

SEQ ID NO: 152890 - DNA, 25 bp, Mus musculus
ttatggctgataagctggtgcccag

SEQ ID NO: 152891 - DNA, 25 bp, Mus musculus
ttatggctgctacttcgttccagca

SEQ ID NO: 152892 - DNA, 25 bp, Mus musculus
ttatggctgttgacggtgtggctcc

SEQ ID NO: 152893 - DNA, 25 bp, Mus musculus
ttatgggtggatcgcagctcttcgc

SEQ ID NO: 152894 - DNA, 25 bp, Mus musculus
ttatgtcaaggtcaaagtggagccc

SEQ ID NO: 152895 - DNA, 25 bp, Mus musculus
ttatgtcaatgcaaccgcaggcacg

SEQ ID NO: 152896 - DNA, 25 bp, Mus musculus
ttatgtcaccggcagcaccatagtg

SEQ ID NO: 152897 - DNA, 25 bp, Mus musculus
ttatgtccagacgatcagagcccta

SEQ ID NO: 152898 - DNA, 25 bp, Mus musculus
ttatgtgaagttgcctccagagaag

SEQ ID NO: 152899 - DNA, 25 bp, Mus musculus
ttatgtggaccaacccacagtggca

SEQ ID NO: 152900 - DNA, 25 bp, Mus musculus
ttatgtggcaacacccctggctgcc

SEQ ID NO: 152901 - DNA, 25 bp, Mus musculus
ttatgttcggagcatcccagatggg

SEQ ID NO: 152902 - DNA, 25 bp, Mus musculus
ttatgtttgacgtcaccaatgccac

SEQ ID NO: 152903 - DNA, 25 bp, Mus musculus
ttattaaaaatgacccgagcctgcc

SEQ ID NO: 152904 - DNA, 25 bp, Mus musculus
ttattacaaggaaggaccagagggc

SEQ ID NO: 152905 - DNA, 25 bp, Mus musculus
ttattacttctcagacgccaagacg

SEQ ID NO: 152906 - DNA, 25 bp, Mus musculus
ttattatcaggagatgcccacagct

SEQ ID NO: 152907 - DNA, 25 bp, Mus musculus
ttattatcgcaagggtggccggacc

SEQ ID NO: 152908 - DNA, 25 bp, Mus musculus
ttattattcagccatggtccctggg

SEQ ID NO: 152909 - DNA, 25 bp, Mus musculus
ttattcagccaaagacacgccaagc

SEQ ID NO: 152910 - DNA, 25 bp, Mus musculus
ttattcatgtcactgggaccaaagg

SEQ ID NO: 152911 - DNA, 25 bp, Mus musculus
ttattccgaaagacccagggcgctt

SEQ ID NO: 152912 - DNA, 25 bp, Mus musculus
ttattccttttttagattcccatcg

SEQ ID NO: 152913 - DNA, 25 bp, Mus musculus
ttattcgcaggtgtcctcccgagga

SEQ ID NO: 152914 - DNA, 25 bp, Mus musculus
ttattctcaggatgaagcagacaga

SEQ ID NO: 152915 - DNA, 25 bp, Mus musculus
ttattctcgagtgtcctgtccccag

SEQ ID NO: 152916 - DNA, 25 bp, Mus musculus
ttattctggcgatgcacctcactga

SEQ ID NO: 152917 - DNA, 25 bp, Mus musculus
ttattctttagatcctaagtgcgag

SEQ ID NO: 152918 - DNA, 25 bp, Mus musculus
ttattgaccacctggccttacgggc

SEQ ID NO: 152919 - DNA, 25 bp, Mus musculus
ttattgaccccaagatgccacgagt

SEQ ID NO: 152920 - DNA, 25 bp, Mus musculus
ttattgagacccacgaagcaaagcc

SEQ ID NO: 152921 - DNA, 25 bp, Mus musculus
ttattgagagcatccctagggagcc

SEQ ID NO: 152922 - DNA, 25 bp, Mus musculus
ttattgatactgagagctttgccca

SEQ ID NO: 152923 - DNA, 25 bp, Mus musculus
ttattgcatgcagattaaaacgtta

SEQ ID NO: 152924 - DNA, 25 bp, Mus musculus
ttattgccgcagaagctgtcacctg

SEQ ID NO: 152925 - DNA, 25 bp, Mus musculus
ttattggaatgagccagtggagctc

SEQ ID NO: 152926 - DNA, 25 bp, Mus musculus
ttattggctgcaagacagatcttcg

SEQ ID NO: 152927 - DNA, 25 bp, Mus musculus
ttatttaagaagaaggccacctgcc

SEQ ID NO: 152928 - DNA, 25 bp, Mus musculus
ttatttcagcaaaggacgtcatggc

SEQ ID NO: 152929 - DNA, 25 bp, Mus musculus
ttatttcctcaggaacagagaggca

SEQ ID NO: 152930 - DNA, 25 bp, Mus musculus
ttatttctaaggagaggccacagac

SEQ ID NO: 152931 - DNA, 25 bp, Mus musculus
ttatttctgcaaggaggtggcgccg

SEQ ID NO: 152932 - DNA, 25 bp, Mus musculus
ttatttgggatccaaggcccctggc

SEQ ID NO: 152933 - DNA, 25 bp, Mus musculus
ttcaaaaagagatacaagagcaaga

SEQ ID NO: 152934 - DNA, 25 bp, Mus musculus
ttcaaaacaccagcgaaagtgggtc

SEQ ID NO: 152935 - DNA, 25 bp, Mus musculus
ttcaaaagggctgaaagcaaggctg

SEQ ID NO: 152936 - DNA, 25 bp, Mus musculus
ttcaaacaagctcaagtcaaggcct

SEQ ID NO: 152937 - DNA, 25 bp, Mus musculus
ttcaaacagagtcatccgaggcttc

SEQ ID NO: 152938 - DNA, 25 bp, Mus musculus
ttcaaacccggacaggacaggtact

SEQ ID NO: 152939 - DNA, 25 bp, Mus musculus
ttcaaactgactccaaagccctggt

SEQ ID NO: 152940 - DNA, 25 bp, Mus musculus
ttcaaagaccctcgcaatgggaagt

SEQ ID NO: 152941 - DNA, 25 bp, Mus musculus
ttcaaagaggagaaacggccagggc

SEQ ID NO: 152942 - DNA, 25 bp, Mus musculus
ttcaaagagtgaagcccgtgccgtg

SEQ ID NO: 152943 - DNA, 25 bp, Mus musculus
ttcaaagccaaccacccgatggatg

SEQ ID NO: 152944 - DNA, 25 bp, Mus musculus
ttcaaaggcaaaagagtggatgtgt

SEQ ID NO: 152945 - DNA, 25 bp, Mus musculus
ttcaaaggcctcaagacatggatgg

SEQ ID NO: 152946 - DNA, 25 bp, Mus musculus
ttcaaagggtgggacagcatctgcc

SEQ ID NO: 152947 - DNA, 25 bp, Mus musculus
ttcaaagtcacagcacgagcctagg

SEQ ID NO: 152948 - DNA, 25 bp, Mus musculus
ttcaaagtccgatgccaaccgggca

SEQ ID NO: 152949 - DNA, 25 bp, Mus musculus
ttcaaagtgcccttcactctccagt

SEQ ID NO: 152950 - DNA, 25 bp, Mus musculus
ttcaaagtggcctgcagactgtcct

SEQ ID NO: 152951 - DNA, 25 bp, Mus musculus
ttcaaagtgtcctgacccagagcag

SEQ ID NO: 152952 - DNA, 25 bp, Mus musculus
ttcaaatagtaagcgacccctgtca

SEQ ID NO: 152953 - DNA, 25 bp, Mus musculus
ttcaaatggatccagaaggctccca

SEQ ID NO: 152954 - DNA, 25 bp, Mus musculus
ttcaaatgtgtagcgcgttcgttcg

SEQ ID NO: 152955 - DNA, 25 bp, Mus musculus
ttcaacaaagggagacaggcttcca

SEQ ID NO: 152956 - DNA, 25 bp, Mus musculus
ttcaacaactgctctggacacctgg

SEQ ID NO: 152957 - DNA, 25 bp, Mus musculus
ttcaacaagccatagccgagcaggt

SEQ ID NO: 152958 - DNA, 25 bp, Mus musculus
ttcaacaaggtcaacaagcacccgg

SEQ ID NO: 152959 - DNA, 25 bp, Mus musculus
ttcaacacactgatggcggtcacgg

SEQ ID NO: 152960 - DNA, 25 bp, Mus musculus
ttcaacacctttgggccgagaatgc

SEQ ID NO: 152961 - DNA, 25 bp, Mus musculus
ttcaacatcagcgagtgcacacggg

SEQ ID NO: 152962 - DNA, 25 bp, Mus musculus
ttcaacattgccaatcccagcagcg

SEQ ID NO: 152963 - DNA, 25 bp, Mus musculus
ttcaaccgggttttgccagggcctg

SEQ ID NO: 152964 - DNA, 25 bp, Mus musculus
ttcaacctgtgcgaacaagggctcc

SEQ ID NO: 152965 - DNA, 25 bp, Mus musculus
ttcaacgaggtgtactgcaagccct

SEQ ID NO: 152966 - DNA, 25 bp, Mus musculus
ttcaacggattacccggaggccagc

SEQ ID NO: 152967 - DNA, 25 bp, Mus musculus
ttcaacgtccatgactcttgaggga

SEQ ID NO: 152968 - DNA, 25 bp, Mus musculus
ttcaactgccggaaggcggccatgg

SEQ ID NO: 152969 - DNA, 25 bp, Mus musculus
ttcaactgcctggaagacaccgagg

SEQ ID NO: 152970 - DNA, 25 bp, Mus musculus
ttcaactgggacgacgaaacagcca

SEQ ID NO: 152971 - DNA, 25 bp, Mus musculus
ttcaagaagaggttcatgtatcctg

SEQ ID NO: 152972 - DNA, 25 bp, Mus musculus
ttcaagaagtctcaggcccaaagga

SEQ ID NO: 152973 - DNA, 25 bp, Mus musculus
ttcaagacctgttggagggcagcgc

SEQ ID NO: 152974 - DNA, 25 bp, Mus musculus
ttcaagagaatgaagctggaggccc

SEQ ID NO: 152975 - DNA, 25 bp, Mus musculus
ttcaagagatcgtggacaagtcagg

SEQ ID NO: 152976 - DNA, 25 bp, Mus musculus
ttcaagaggacagtacgcaaagacc

SEQ ID NO: 152977 - DNA, 25 bp, Mus musculus
ttcaagatccagaagacccggctgc

SEQ ID NO: 152978 - DNA, 25 bp, Mus musculus
ttcaagatcctggaccgggtcacca

SEQ ID NO: 152979 - DNA, 25 bp, Mus musculus
ttcaagatgctgcaggagaaccgcc

SEQ ID NO: 152980 - DNA, 25 bp, Mus musculus
ttcaagcaagggtccacagagtagc

SEQ ID NO: 152981 - DNA, 25 bp, Mus musculus
ttcaagcagatgtcctacaaggagg

SEQ ID NO: 152982 - DNA, 25 bp, Mus musculus
ttcaagccgctgtctaagaaggtcg

SEQ ID NO: 152983 - DNA, 25 bp, Mus musculus
ttcaagcctgagttgggccagccag

SEQ ID NO: 152984 - DNA, 25 bp, Mus musculus
ttcaagcgcaaatacaaagtgaagc

SEQ ID NO: 152985 - DNA, 25 bp, Mus musculus
ttcaagcgcaggaagaccaagtctc

SEQ ID NO: 152986 - DNA, 25 bp, Mus musculus
ttcaagctccctgaactgagtgagg

SEQ ID NO: 152987 - DNA, 25 bp, Mus musculus
ttcaagctcctgcaactggatgagg

SEQ ID NO: 152988 - DNA, 25 bp, Mus musculus
ttcaagctgagtcggaaccacgtgg

SEQ ID NO: 152989 - DNA, 25 bp, Mus musculus
ttcaagctggtagaaaaagttgtcc

SEQ ID NO: 152990 - DNA, 25 bp, Mus musculus
ttcaagctggtcatcggccaggtcc

SEQ ID NO: 152991 - DNA, 25 bp, Mus musculus
ttcaagctgtactcgccgaaggagc

SEQ ID NO: 152992 - DNA, 25 bp, Mus musculus
ttcaaggacaacttccgccagggca

SEQ ID NO: 152993 - DNA, 25 bp, Mus musculus
ttcaaggatggaggctctaccacgg

SEQ ID NO: 152994 - DNA, 25 bp, Mus musculus
ttcaaggcacggacgccacaacctg

SEQ ID NO: 152995 - DNA, 25 bp, Mus musculus
ttcaaggccaagtcaaaatattctc

SEQ ID NO: 152996 - DNA, 25 bp, Mus musculus
ttcaaggccttatatggagacaccc

SEQ ID NO: 152997 - DNA, 25 bp, Mus musculus
ttcaaggcgaagtacaaactggtca

SEQ ID NO: 152998 - DNA, 25 bp, Mus musculus
ttcaaggctttccttcggaagaatc

SEQ ID NO: 152999 - DNA, 25 bp, Mus musculus
ttcaagggcttcaccatgcagcagg

SEQ ID NO: 153000 - DNA, 25 bp, Mus musculus
ttcaaggttccttgctgcccagcga

SEQ ID NO: 153001 - DNA, 25 bp, Mus musculus
ttcaaggtttcctgcttaaagggct

SEQ ID NO: 153002 - DNA, 25 bp, Mus musculus
ttcaagtatggtgtgcggaacccgc

SEQ ID NO: 153003 - DNA, 25 bp, Mus musculus
ttcaagtcaatctgaaagtcccagc

SEQ ID NO: 153004 - DNA, 25 bp, Mus musculus
ttcaagtcccgcacacaagtggtcc

SEQ ID NO: 153005 - DNA, 25 bp, Mus musculus
ttcaagtgacaggtgacaaggccca

SEQ ID NO: 153006 - DNA, 25 bp, Mus musculus
ttcaagtgcacctactgcagtcggc

SEQ ID NO: 153007 - DNA, 25 bp, Mus musculus
ttcaagttcgcagggacgtcacgtc

SEQ ID NO: 153008 - DNA, 25 bp, Mus musculus
ttcaagttgcatgtgaattctgcca

SEQ ID NO: 153009 - DNA, 25 bp, Mus musculus
ttcaagttgccctccttgggtggac

SEQ ID NO: 153010 - DNA, 25 bp, Mus musculus
ttcaagtttgccatgtacccgccgt

SEQ ID NO: 153011 - DNA, 25 bp, Mus musculus
ttcaataagcacttggaccgcggct

SEQ ID NO: 153012 - DNA, 25 bp, Mus musculus
ttcaatacccggactcaggtcacca

SEQ ID NO: 153013 - DNA, 25 bp, Mus musculus
ttcaatagagttcggacaattcaga

SEQ ID NO: 153014 - DNA, 25 bp, Mus musculus
ttcaatgggcgctatttgatcctgc

SEQ ID NO: 153015 - DNA, 25 bp, Mus musculus
ttcaatgtatcaggcatcttcccag

SEQ ID NO: 153016 - DNA, 25 bp, Mus musculus
ttcaatgtgagaaacaagcctcgct

SEQ ID NO: 153017 - DNA, 25 bp, Mus musculus
ttcaattcggccttgcaggcaggca

SEQ ID NO: 153018 - DNA, 25 bp, Mus musculus
ttcaatttctccgagggaccactag

SEQ ID NO: 153019 - DNA, 25 bp, Mus musculus
ttcacaaatccggtacgatgctgtg

SEQ ID NO: 153020 - DNA, 25 bp, Mus musculus
ttcacaaggccgatgaggtcacact

SEQ ID NO: 153021 - DNA, 25 bp, Mus musculus
ttcacaatgagctggctggcaggcc

SEQ ID NO: 153022 - DNA, 25 bp, Mus musculus
ttcacaccatgtccagagctggagt

SEQ ID NO: 153023 - DNA, 25 bp, Mus musculus
ttcacacccggttcaaggacgacga

SEQ ID NO: 153024 - DNA, 25 bp, Mus musculus
ttcacactccggtttgatgagctca

SEQ ID NO: 153025 - DNA, 25 bp, Mus musculus
ttcacactgggatgtcgagggtcag

SEQ ID NO: 153026 - DNA, 25 bp, Mus musculus
ttcacagaggcccagcgcttttcct

SEQ ID NO: 153027 - DNA, 25 bp, Mus musculus
ttcacagccagtccatgatgggcct

SEQ ID NO: 153028 - DNA, 25 bp, Mus musculus
ttcacagccatgaacgaacaacagt

SEQ ID NO: 153029 - DNA, 25 bp, Mus musculus
ttcacagcctgttggtctcgaacac

SEQ ID NO: 153030 - DNA, 25 bp, Mus musculus
ttcacagcgtctctttatgatcctc

SEQ ID NO: 153031 - DNA, 25 bp, Mus musculus
ttcacagctggagcaattttttcag

SEQ ID NO: 153032 - DNA, 25 bp, Mus musculus
ttcacaggagctatgccagcagcag

SEQ ID NO: 153033 - DNA, 25 bp, Mus musculus
ttcacagtgggagacaagccggtca

SEQ ID NO: 153034 - DNA, 25 bp, Mus musculus
ttcacagtgggcatcgtcacaccaa

SEQ ID NO: 153035 - DNA, 25 bp, Mus musculus
ttcacagtgtgcagtaccagcgaag

SEQ ID NO: 153036 - DNA, 25 bp, Mus musculus
ttcacagttcgaaccagagttggca

SEQ ID NO: 153037 - DNA, 25 bp, Mus musculus
ttcacatcattggaggagtcattgc

SEQ ID NO: 153038 - DNA, 25 bp, Mus musculus
ttcacatggtcgatggcaacgtcac

SEQ ID NO: 153039 - DNA, 25 bp, Mus musculus
ttcaccaaaaaacagcccagcaggc

SEQ ID NO: 153040 - DNA, 25 bp, Mus musculus
ttcaccaaaggcaagcgaggcaagc

SEQ ID NO: 153041 - DNA, 25 bp, Mus musculus
ttcaccaacgagtgcaacatcccag

SEQ ID NO: 153042 - DNA, 25 bp, Mus musculus
ttcaccaagtacattcgtagagctt

SEQ ID NO: 153043 - DNA, 25 bp, Mus musculus
ttcaccacctttagcaaggcccagg

SEQ ID NO: 153044 - DNA, 25 bp, Mus musculus
ttcaccacggttgctgagccagagg

SEQ ID NO: 153045 - DNA, 25 bp, Mus musculus
ttcaccagacaaaggagcagcagca

SEQ ID NO: 153046 - DNA, 25 bp, Mus musculus
ttcaccagcgtacggcagaagattg

SEQ ID NO: 153047 - DNA, 25 bp, Mus musculus
ttcaccatgaagacgctggagatcc

SEQ ID NO: 153048 - DNA, 25 bp, Mus musculus
ttcaccatggaggacaagagacagc

SEQ ID NO: 153049 - DNA, 25 bp, Mus musculus
ttcacccacggccttgaatggcgct

SEQ ID NO: 153050 - DNA, 25 bp, Mus musculus
ttcaccctgcagatgtcttggctca

SEQ ID NO: 153051 - DNA, 25 bp, Mus musculus
ttcaccgaatacatctgccagtgcc

SEQ ID NO: 153052 - DNA, 25 bp, Mus musculus
ttcaccgtatggcagagcttcccag

SEQ ID NO: 153053 - DNA, 25 bp, Mus musculus
ttcacctagcagttatcaacaaccg

SEQ ID NO: 153054 - DNA, 25 bp, Mus musculus
ttcacctagcctcgcacgaacttgg

SEQ ID NO: 153055 - DNA, 25 bp, Mus musculus
ttcacctatgggactcggactcggg

SEQ ID NO: 153056 - DNA, 25 bp, Mus musculus
ttcacctcacggtggacacaggtct

SEQ ID NO: 153057 - DNA, 25 bp, Mus musculus
ttcacctcgtggtcgacatcacctg

SEQ ID NO: 153058 - DNA, 25 bp, Mus musculus
ttcacctgaatcagagaaaagctgc

SEQ ID NO: 153059 - DNA, 25 bp, Mus musculus
ttcacctggaacagcatgtctggtc

SEQ ID NO: 153060 - DNA, 25 bp, Mus musculus
ttcacctggtgccaaacagggacgc

SEQ ID NO: 153061 - DNA, 25 bp, Mus musculus
ttcaccttcgcgtcgtgcctgcgga

SEQ ID NO: 153062 - DNA, 25 bp, Mus musculus
ttcacgcggactcagggagcacatt

SEQ ID NO: 153063 - DNA, 25 bp, Mus musculus
ttcacggagaccattgggaagacct

SEQ ID NO: 153064 - DNA, 25 bp, Mus musculus
ttcacggcgtccatgagcagaacta

SEQ ID NO: 153065 - DNA, 25 bp, Mus musculus
ttcacggtctacaagcttggcagag

SEQ ID NO: 153066 - DNA, 25 bp, Mus musculus
ttcacggtgtacagcggagacctgc

SEQ ID NO: 153067 - DNA, 25 bp, Mus musculus
ttcacgtccggaagctgaagagcta

SEQ ID NO: 153068 - DNA, 25 bp, Mus musculus
ttcacgttactcgtagaaaacagga

SEQ ID NO: 153069 - DNA, 25 bp, Mus musculus
ttcacgttcctcagcgtcatcgtgc

SEQ ID NO: 153070 - DNA, 25 bp, Mus musculus
ttcactacacggtcggctgtctctg

SEQ ID NO: 153071 - DNA, 25 bp, Mus musculus
ttcactagggacacctgggaggcga

SEQ ID NO: 153072 - DNA, 25 bp, Mus musculus
ttcactggagacagaacgcgggttt

SEQ ID NO: 153073 - DNA, 25 bp, Mus musculus
ttcacttaagcaggatgaaaaagca

SEQ ID NO: 153074 - DNA, 25 bp, Mus musculus
ttcacttatcgagacccaatgggac

SEQ ID NO: 153075 - DNA, 25 bp, Mus musculus
ttcacttgacccaggcgaggaagag

SEQ ID NO: 153076 - DNA, 25 bp, Mus musculus
ttcacttgagtggaggcaccagcag

SEQ ID NO: 153077 - DNA, 25 bp, Mus musculus
ttcacttggtgatcttgatccaggg

SEQ ID NO: 153078 - DNA, 25 bp, Mus musculus
ttcacttgttgtcaccaggcaggcc

SEQ ID NO: 153079 - DNA, 25 bp, Mus musculus
ttcactttagtcacagcagctggga

SEQ ID NO: 153080 - DNA, 25 bp, Mus musculus
ttcagaaaacggagacgcgcttggc

SEQ ID NO: 153081 - DNA, 25 bp, Mus musculus
ttcagaaacagagccattggacggg

SEQ ID NO: 153082 - DNA, 25 bp, Mus musculus
ttcagaaagatgattggaaatcgag

SEQ ID NO: 153083 - DNA, 25 bp, Mus musculus
ttcagaaatcttcgtgggccgagcc

SEQ ID NO: 153084 - DNA, 25 bp, Mus musculus
ttcagaacagtacagagccagaccc

SEQ ID NO: 153085 - DNA, 25 bp, Mus musculus
ttcagaagcatctccaaggccatgg

SEQ ID NO: 153086 - DNA, 25 bp, Mus musculus
ttcagaaggctctcgatgtcaccag

SEQ ID NO: 153087 - DNA, 25 bp, Mus musculus
ttcagacacggctggacgagactca

SEQ ID NO: 153088 - DNA, 25 bp, Mus musculus
ttcagacactgaaggcctgcacctc

SEQ ID NO: 153089 - DNA, 25 bp, Mus musculus
ttcagacccagtaaagcttcaaaac

SEQ ID NO: 153090 - DNA, 25 bp, Mus musculus
ttcagacccattgagaataaggagg

SEQ ID NO: 153091 - DNA, 25 bp, Mus musculus
ttcagacgaagtaaaacggatgtgc

SEQ ID NO: 153092 - DNA, 25 bp, Mus musculus
ttcagacgaccatccggaacgagtt

SEQ ID NO: 153093 - DNA, 25 bp, Mus musculus
ttcagacgctatgacacggatcagg

SEQ ID NO: 153094 - DNA, 25 bp, Mus musculus
ttcagactatttccagatttgcaag

SEQ ID NO: 153095 - DNA, 25 bp, Mus musculus
ttcagactcgacaagtggcagcacc

SEQ ID NO: 153096 - DNA, 25 bp, Mus musculus
ttcagactgcaaaaaccacgctggg

SEQ ID NO: 153097 - DNA, 25 bp, Mus musculus
ttcagagaaacagcaaaaaagacac

SEQ ID NO: 153098 - DNA, 25 bp, Mus musculus
ttcagagaaattccaacagctgctc

SEQ ID NO: 153099 - DNA, 25 bp, Mus musculus
ttcagagagcccgagtccggctgag

SEQ ID NO: 153100 - DNA, 25 bp, Mus musculus
ttcagagagcttaagtcccaggacc

SEQ ID NO: 153101 - DNA, 25 bp, Mus musculus
ttcagagaggctgcgcaagaggcct

SEQ ID NO: 153102 - DNA, 25 bp, Mus musculus
ttcagagagtttcctccgagggctc

SEQ ID NO: 153103 - DNA, 25 bp, Mus musculus
ttcagaggacctgctagagctgtct

SEQ ID NO: 153104 - DNA, 25 bp, Mus musculus
ttcagagggaagctgctaagaagca

SEQ ID NO: 153105 - DNA, 25 bp, Mus musculus
ttcagagtaagcagttgggccagcc

SEQ ID NO: 153106 - DNA, 25 bp, Mus musculus
ttcagagttgctgctcctcacaact

SEQ ID NO: 153107 - DNA, 25 bp, Mus musculus
ttcagatcctgggaccacaagcact

SEQ ID NO: 153108 - DNA, 25 bp, Mus musculus
ttcagatgcagattgcccaccagca

SEQ ID NO: 153109 - DNA, 25 bp, Mus musculus
ttcagattttacagccatcagcggg

SEQ ID NO: 153110 - DNA, 25 bp, Mus musculus
ttcagcaaacaacacgagacgtccg

SEQ ID NO: 153111 - DNA, 25 bp, Mus musculus
ttcagcaaagagctattatcccttg

SEQ ID NO: 153112 - DNA, 25 bp, Mus musculus
ttcagcaaagtgcacggcaacagcg

SEQ ID NO: 153113 - DNA, 25 bp, Mus musculus
ttcagcaaatggtggcctcaggagc

SEQ ID NO: 153114 - DNA, 25 bp, Mus musculus
ttcagcaacgacgatgtgggcagcc

SEQ ID NO: 153115 - DNA, 25 bp, Mus musculus
ttcagcacagagttccagatgcggc

SEQ ID NO: 153116 - DNA, 25 bp, Mus musculus
ttcagcaccatcaagttaaaagcag

SEQ ID NO: 153117 - DNA, 25 bp, Mus musculus
ttcagcacgaaaggacgcataccgg

SEQ ID NO: 153118 - DNA, 25 bp, Mus musculus
ttcagcactcgataacattcttggg

SEQ ID NO: 153119 - DNA, 25 bp, Mus musculus
ttcagcactggtagcagcaagccag

SEQ ID NO: 153120 - DNA, 25 bp, Mus musculus
ttcagcaggctgtgggaagctccct

SEQ ID NO: 153121 - DNA, 25 bp, Mus musculus
ttcagcaggtggcagatggcatcac

SEQ ID NO: 153122 - DNA, 25 bp, Mus musculus
ttcagcatgaagaccctcatcgccg

SEQ ID NO: 153123 - DNA, 25 bp, Mus musculus
ttcagcatgatgcactgtggactgc

SEQ ID NO: 153124 - DNA, 25 bp, Mus musculus
ttcagcatgtgaagaatacctcaag

SEQ ID NO: 153125 - DNA, 25 bp, Mus musculus
ttcagcatgtgcctttccgagaaag

SEQ ID NO: 153126 - DNA, 25 bp, Mus musculus
ttcagccatcgggatgccagcggaa

SEQ ID NO: 153127 - DNA, 25 bp, Mus musculus
ttcagcccagaatgggacaggctcc

SEQ ID NO: 153128 - DNA, 25 bp, Mus musculus
ttcagccctcggaaaccgtgtccag

SEQ ID NO: 153129 - DNA, 25 bp, Mus musculus
ttcagccgggatcttgcctggacca

SEQ ID NO: 153130 - DNA, 25 bp, Mus musculus
ttcagccttcagctacaacccagga

SEQ ID NO: 153131 - DNA, 25 bp, Mus musculus
ttcagcgaagaagccaacaggaggt

SEQ ID NO: 153132 - DNA, 25 bp, Mus musculus
ttcagcgccagcaactcgactatgg

SEQ ID NO: 153133 - DNA, 25 bp, Mus musculus
ttcagcgggcgtggaacattggcaa

SEQ ID NO: 153134 - DNA, 25 bp, Mus musculus
ttcagctacagccaggacatcgtgc

SEQ ID NO: 153135 - DNA, 25 bp, Mus musculus
ttcagctagaacagaaccgagcggc

SEQ ID NO: 153136 - DNA, 25 bp, Mus musculus
ttcagctcagatgatgtgctgcgcc

SEQ ID NO: 153137 - DNA, 25 bp, Mus musculus
ttcagctgccgaaagctccgggaga

SEQ ID NO: 153138 - DNA, 25 bp, Mus musculus
ttcagctggagagggcagtgcccat

SEQ ID NO: 153139 - DNA, 25 bp, Mus musculus
ttcagcttcagtgtgtcattcccag

SEQ ID NO: 153140 - DNA, 25 bp, Mus musculus
ttcaggaaaacaggtcaagcgctgc

SEQ ID NO: 153141 - DNA, 25 bp, Mus musculus
ttcaggaaccttgagtactgtgggc

SEQ ID NO: 153142 - DNA, 25 bp, Mus musculus
ttcaggaacgagtggctcatggcca

SEQ ID NO: 153143 - DNA, 25 bp, Mus musculus
ttcaggaattcccacagagggcagt

SEQ ID NO: 153144 - DNA, 25 bp, Mus musculus
ttcaggacagcaaccagaggttggc

SEQ ID NO: 153145 - DNA, 25 bp, Mus musculus
ttcaggacagtccataggcctcagc

SEQ ID NO: 153146 - DNA, 25 bp, Mus musculus
ttcaggaccccgaggtgtcatggcg

SEQ ID NO: 153147 - DNA, 25 bp, Mus musculus
ttcaggaccttctgttcttccccag

SEQ ID NO: 153148 - DNA, 25 bp, Mus musculus
ttcaggactctcagagccaagggca

SEQ ID NO: 153149 - DNA, 25 bp, Mus musculus
ttcaggacttgaaagaggtgaccca

SEQ ID NO: 153150 - DNA, 25 bp, Mus musculus
ttcaggagaccaagatttacagccg

SEQ ID NO: 153151 - DNA, 25 bp, Mus musculus
ttcaggagaccgtgggaatctggct

SEQ ID NO: 153152 - DNA, 25 bp, Mus musculus
ttcaggagatcaacatcgccaccag

SEQ ID NO: 153153 - DNA, 25 bp, Mus musculus
ttcaggagcaggttctgtccaggcc

SEQ ID NO: 153154 - DNA, 25 bp, Mus musculus
ttcaggagccaccatcgcggatagt

SEQ ID NO: 153155 - DNA, 25 bp, Mus musculus
ttcaggaggcggctttcattctctg

SEQ ID NO: 153156 - DNA, 25 bp, Mus musculus
ttcaggatgatggaggcaccgctca

SEQ ID NO: 153157 - DNA, 25 bp, Mus musculus
ttcaggattcagagatcagggccgt

SEQ ID NO: 153158 - DNA, 25 bp, Mus musculus
ttcaggcaacgtcttctaccatggg

SEQ ID NO: 153159 - DNA, 25 bp, Mus musculus
ttcaggcccaaacgcaagttcgagc

SEQ ID NO: 153160 - DNA, 25 bp, Mus musculus
ttcaggccctgattgcggacttcca

SEQ ID NO: 153161 - DNA, 25 bp, Mus musculus
ttcaggcctaaccaacaagtgtctt

SEQ ID NO: 153162 - DNA, 25 bp, Mus musculus
ttcaggcctcaagggagcagtctca

SEQ ID NO: 153163 - DNA, 25 bp, Mus musculus
ttcaggcctttgtaggccgggatgc

SEQ ID NO: 153164 - DNA, 25 bp, Mus musculus
ttcaggcgacgcttaagggagccca

SEQ ID NO: 153165 - DNA, 25 bp, Mus musculus
ttcaggcgcatgctggataaacact

SEQ ID NO: 153166 - DNA, 25 bp, Mus musculus
ttcaggctccttggagaggacacag

SEQ ID NO: 153167 - DNA, 25 bp, Mus musculus
ttcaggctctcctctgtccttcggt

SEQ ID NO: 153168 - DNA, 25 bp, Mus musculus
ttcagggaccagctagattctcaga

SEQ ID NO: 153169 - DNA, 25 bp, Mus musculus
ttcagggaccggacgtctcagggta

SEQ ID NO: 153170 - DNA, 25 bp, Mus musculus
ttcagggccatttacatgccccaga

SEQ ID NO: 153171 - DNA, 25 bp, Mus musculus
ttcagggctcagaggtgcagaaccc

SEQ ID NO: 153172 - DNA, 25 bp, Mus musculus
ttcagggcttctccgccaagtggga

SEQ ID NO: 153173 - DNA, 25 bp, Mus musculus
ttcagggtgccagtagacacaagag

SEQ ID NO: 153174 - DNA, 25 bp, Mus musculus
ttcagggttccacgtcggtagccat

SEQ ID NO: 153175 - DNA, 25 bp, Mus musculus
ttcaggtaaaacagctgcaccccgt

SEQ ID NO: 153176 - DNA, 25 bp, Mus musculus
ttcaggtccctgttgagcatccggc

SEQ ID NO: 153177 - DNA, 25 bp, Mus musculus
ttcaggttagctggatgagccccac

SEQ ID NO: 153178 - DNA, 25 bp, Mus musculus
ttcagtaagtcagccaatagcccag

SEQ ID NO: 153179 - DNA, 25 bp, Mus musculus
ttcagtctgccttccgagctcaggg

SEQ ID NO: 153180 - DNA, 25 bp, Mus musculus
ttcagtctgcggacacgcgtggagc

SEQ ID NO: 153181 - DNA, 25 bp, Mus musculus
ttcagtgaccttcgatgatgtggct

SEQ ID NO: 153182 - DNA, 25 bp, Mus musculus
ttcagtgatgtggatgccctgcgcc

SEQ ID NO: 153183 - DNA, 25 bp, Mus musculus
ttcagtgcatcctatgaccggtccc

SEQ ID NO: 153184 - DNA, 25 bp, Mus musculus
ttcagtgccagagcagctgcccttt

SEQ ID NO: 153185 - DNA, 25 bp, Mus musculus
ttcagtgcccactctactcaggttg

SEQ ID NO: 153186 - DNA, 25 bp, Mus musculus
ttcagtggaaatgtttgccgggccc

SEQ ID NO: 153187 - DNA, 25 bp, Mus musculus
ttcagtggaggcaacagaaacccgg

SEQ ID NO: 153188 - DNA, 25 bp, Mus musculus
ttcagtgtaacagggaagcaggtcc

SEQ ID NO: 153189 - DNA, 25 bp, Mus musculus
ttcagtgtctaatcaaacttctgcc

SEQ ID NO: 153190 - DNA, 25 bp, Mus musculus
ttcagttcttggtcagtgcagggcc

SEQ ID NO: 153191 - DNA, 25 bp, Mus musculus
ttcagtttcttcaggaggtccccag

SEQ ID NO: 153192 - DNA, 25 bp, Mus musculus
ttcataaagctaacgaaagccggca

SEQ ID NO: 153193 - DNA, 25 bp, Mus musculus
ttcataaagttatcctgggctcccc

SEQ ID NO: 153194 - DNA, 25 bp, Mus musculus
ttcataataaagatggcgactggcc

SEQ ID NO: 153195 - DNA, 25 bp, Mus musculus
ttcatacaacagaatttgagtggcc

SEQ ID NO: 153196 - DNA, 25 bp, Mus musculus
ttcatacatgtagctactgggaccc

SEQ ID NO: 153197 - DNA, 25 bp, Mus musculus
ttcatagagagacaaccgtgttggc

SEQ ID NO: 153198 - DNA, 25 bp, Mus musculus
ttcatatgatgatagcactctcccc

SEQ ID NO: 153199 - DNA, 25 bp, Mus musculus
ttcatatgtcacaggctggcccgtc

SEQ ID NO: 153200 - DNA, 25 bp, Mus musculus
ttcatcaacagactgacaagcagcg

SEQ ID NO: 153201 - DNA, 25 bp, Mus musculus
ttcatcaacgacagccccgctgacg

SEQ ID NO: 153202 - DNA, 25 bp, Mus musculus
ttcatcaaggatctttaccaggacg

SEQ ID NO: 153203 - DNA, 25 bp, Mus musculus
ttcatccaacacagccagaacccaa

SEQ ID NO: 153204 - DNA, 25 bp, Mus musculus
ttcatccaagaatcaagcagttgct

SEQ ID NO: 153205 - DNA, 25 bp, Mus musculus
ttcatccccaacctacgagagtgtg

SEQ ID NO: 153206 - DNA, 25 bp, Mus musculus
ttcatccctagaaaaggcctctcgg

SEQ ID NO: 153207 - DNA, 25 bp, Mus musculus
ttcatccgggcacttcacaaaggac

SEQ ID NO: 153208 - DNA, 25 bp, Mus musculus
ttcatcctcgatgggaaggtggctg

SEQ ID NO: 153209 - DNA, 25 bp, Mus musculus
ttcatcctgacattcttccaccaaa

SEQ ID NO: 153210 - DNA, 25 bp, Mus musculus
ttcatcgaacgtgtgtggacccctg

SEQ ID NO: 153211 - DNA, 25 bp, Mus musculus
ttcatcgaatttaccccagcggctg

SEQ ID NO: 153212 - DNA, 25 bp, Mus musculus
ttcatcgacaacaagctgcggcgct

SEQ ID NO: 153213 - DNA, 25 bp, Mus musculus
ttcatcgacaagaatgacctaaggg

SEQ ID NO: 153214 - DNA, 25 bp, Mus musculus
ttcatcgagacatcagcagcactgc

SEQ ID NO: 153215 - DNA, 25 bp, Mus musculus
ttcatcgcggcgcagaacctgggtc

SEQ ID NO: 153216 - DNA, 25 bp, Mus musculus
ttcatcgctgtgacggcctaccaaa

SEQ ID NO: 153217 - DNA, 25 bp, Mus musculus
ttcatcggccaaggcgcggaacgga

SEQ ID NO: 153218 - DNA, 25 bp, Mus musculus
ttcatcggcggaagcaggacaacat

SEQ ID NO: 153219 - DNA, 25 bp, Mus musculus
ttcatcggctgaacctaggatctgg

SEQ ID NO: 153220 - DNA, 25 bp, Mus musculus
ttcatctgtgacgtgggcaaccggg

SEQ ID NO: 153221 - DNA, 25 bp, Mus musculus
ttcatgaagtcccactgagtggcca

SEQ ID NO: 153222 - DNA, 25 bp, Mus musculus
ttcatgacaatgacaggcgactggc

SEQ ID NO: 153223 - DNA, 25 bp, Mus musculus
ttcatgacagaggacacaacggatg

SEQ ID NO: 153224 - DNA, 25 bp, Mus musculus
ttcatgaccactatggaggccggga

SEQ ID NO: 153225 - DNA, 25 bp, Mus musculus
ttcatgacttcaaaagaccacacag

SEQ ID NO: 153226 - DNA, 25 bp, Mus musculus
ttcatgagccacacaagacttccag

SEQ ID NO: 153227 - DNA, 25 bp, Mus musculus
ttcatgaggtcagcaatggcagcgt

SEQ ID NO: 153228 - DNA, 25 bp, Mus musculus
ttcatgaggtgatcacagctggccc

SEQ ID NO: 153229 - DNA, 25 bp, Mus musculus
ttcatggacagtgacggcaaagccc

SEQ ID NO: 153230 - DNA, 25 bp, Mus musculus
ttcatggacgcatctctcgggagga

SEQ ID NO: 153231 - DNA, 25 bp, Mus musculus
ttcatggactggatacttcgtggca

SEQ ID NO: 153232 - DNA, 25 bp, Mus musculus
ttcatggctggaggcaatgactgcc

SEQ ID NO: 153233 - DNA, 25 bp, Mus musculus
ttcatggtccttgctggtgaggtcc

SEQ ID NO: 153234 - DNA, 25 bp, Mus musculus
ttcatgtaattgacgccagcgacga

SEQ ID NO: 153235 - DNA, 25 bp, Mus musculus
ttcatgtcagtacggaagcccacag

SEQ ID NO: 153236 - DNA, 25 bp, Mus musculus
ttcatgtcattgaacggcgtgcgct

SEQ ID NO: 153237 - DNA, 25 bp, Mus musculus
ttcatgtggaacgagcacctgggct

SEQ ID NO: 153238 - DNA, 25 bp, Mus musculus
ttcattaactgggacttcttcccta

SEQ ID NO: 153239 - DNA, 25 bp, Mus musculus
ttcattaccaatccaagggcggtgg

SEQ ID NO: 153240 - DNA, 25 bp, Mus musculus
ttcattacgtgaactggccagacca

SEQ ID NO: 153241 - DNA, 25 bp, Mus musculus
ttcattcaccgtctccaggaaggcg

SEQ ID NO: 153242 - DNA, 25 bp, Mus musculus
ttcattcagaaggatggaagtctct

SEQ ID NO: 153243 - DNA, 25 bp, Mus musculus
ttcattcatagtagctcttccaggg

SEQ ID NO: 153244 - DNA, 25 bp, Mus musculus
ttcattcccacgcccggaagttgct

SEQ ID NO: 153245 - DNA, 25 bp, Mus musculus
ttcattctctgcgtagtggccttgg

SEQ ID NO: 153246 - DNA, 25 bp, Mus musculus
ttcattctgagctgtaggccaggct

SEQ ID NO: 153247 - DNA, 25 bp, Mus musculus
ttcattgcactggatctcggcgggt

SEQ ID NO: 153248 - DNA, 25 bp, Mus musculus
ttcattgcctgggacaagggctcca

SEQ ID NO: 153249 - DNA, 25 bp, Mus musculus
ttcattggagactggttggagtgca

SEQ ID NO: 153250 - DNA, 25 bp, Mus musculus
ttcattggcaccttcaaggcttttg

SEQ ID NO: 153251 - DNA, 25 bp, Mus musculus
ttcattgggtataaggagaggcccg

SEQ ID NO: 153252 - DNA, 25 bp, Mus musculus
ttcattggtccggtggtggcctcag

SEQ ID NO: 153253 - DNA, 25 bp, Mus musculus
ttcattgtaactgcacaaacacggg

SEQ ID NO: 153254 - DNA, 25 bp, Mus musculus
ttcatttacaccacaggaaccgaag

SEQ ID NO: 153255 - DNA, 25 bp, Mus musculus
ttcatttcggactgtatggcctggg

SEQ ID NO: 153256 - DNA, 25 bp, Mus musculus
ttccaaactgtcaagagcctgcggc

SEQ ID NO: 153257 - DNA, 25 bp, Mus musculus
ttccaacaagagctccaagaacggc

SEQ ID NO: 153258 - DNA, 25 bp, Mus musculus
ttccaacagcccatgtgatgccttc

SEQ ID NO: 153259 - DNA, 25 bp, Mus musculus
ttccaaccagggtgctcaagcagga

SEQ ID NO: 153260 - DNA, 25 bp, Mus musculus
ttccaacgagggtttcaggtccgtg

SEQ ID NO: 153261 - DNA, 25 bp, Mus musculus
ttccaactttggactgtggagccgt

SEQ ID NO: 153262 - DNA, 25 bp, Mus musculus
ttccaagagctgagtcgaggtgcct

SEQ ID NO: 153263 - DNA, 25 bp, Mus musculus
ttccaagagcttggccagaaccacg

SEQ ID NO: 153264 - DNA, 25 bp, Mus musculus
ttccaagatggatgatcaggaccct

SEQ ID NO: 153265 - DNA, 25 bp, Mus musculus
ttccaagcagatcccggtcaaggag

SEQ ID NO: 153266 - DNA, 25 bp, Mus musculus
ttccaagcctgcagcatatctgagg

SEQ ID NO: 153267 - DNA, 25 bp, Mus musculus
ttccaagctgaaagagaccatcccg

SEQ ID NO: 153268 - DNA, 25 bp, Mus musculus
ttccaaggacttggccagtgcaaca

SEQ ID NO: 153269 - DNA, 25 bp, Mus musculus
ttccaaggcatggtccggcagaagc

SEQ ID NO: 153270 - DNA, 25 bp, Mus musculus
ttccaagtaaatgcccagaacagct

SEQ ID NO: 153271 - DNA, 25 bp, Mus musculus
ttccaagtgactgttccaaggtgcc

SEQ ID NO: 153272 - DNA, 25 bp, Mus musculus
ttccacaagaaatcgcagcggcggt

SEQ ID NO: 153273 - DNA, 25 bp, Mus musculus
ttccacaagatgaccgatgacccga

SEQ ID NO: 153274 - DNA, 25 bp, Mus musculus
ttccacagccaagtgcgagagtcca

SEQ ID NO: 153275 - DNA, 25 bp, Mus musculus
ttccacatggcagcaaatatgtatg

SEQ ID NO: 153276 - DNA, 25 bp, Mus musculus
ttccacctcgagtacatggacctgg

SEQ ID NO: 153277 - DNA, 25 bp, Mus musculus
ttccacgtgtctgcggatggccaga

SEQ ID NO: 153278 - DNA, 25 bp, Mus musculus
ttccactgggcctaggagatgggca

SEQ ID NO: 153279 - DNA, 25 bp, Mus musculus
ttccagaagagcaaagacggcgact

SEQ ID NO: 153280 - DNA, 25 bp, Mus musculus
ttccagaaggaccaggatatgcccc

SEQ ID NO: 153281 - DNA, 25 bp, Mus musculus
ttccagaatcctttgcgcgcggcta

SEQ ID NO: 153282 - DNA, 25 bp, Mus musculus
ttccagagaatggaagcacaagacc

SEQ ID NO: 153283 - DNA, 25 bp, Mus musculus
ttccagagacaagggaaaccactgt

SEQ ID NO: 153284 - DNA, 25 bp, Mus musculus
ttccagagactgatcccaagcaggg

SEQ ID NO: 153285 - DNA, 25 bp, Mus musculus
ttccagagccatgaacccgagttcg

SEQ ID NO: 153286 - DNA, 25 bp, Mus musculus
ttccagagccatgagagccacagtg

SEQ ID NO: 153287 - DNA, 25 bp, Mus musculus
ttccagagccattaagagaagagcg

SEQ ID NO: 153288 - DNA, 25 bp, Mus musculus
ttccagagggtgagcctgacaagca

SEQ ID NO: 153289 - DNA, 25 bp, Mus musculus
ttccagaggtggatcatctgctgct

SEQ ID NO: 153290 - DNA, 25 bp, Mus musculus
ttccagagtgggagcaaacggagcc

SEQ ID NO: 153291 - DNA, 25 bp, Mus musculus
ttccagagtgggtccgtaatcgtcc

SEQ ID NO: 153292 - DNA, 25 bp, Mus musculus
ttccagatacaagtgcagccggtgc

SEQ ID NO: 153293 - DNA, 25 bp, Mus musculus
ttccagatatggctgaagcagaagg

SEQ ID NO: 153294 - DNA, 25 bp, Mus musculus
ttccagatgcctccgaaaaataggg

SEQ ID NO: 153295 - DNA, 25 bp, Mus musculus
ttccagcaaaagtcccagagtgagc

SEQ ID NO: 153296 - DNA, 25 bp, Mus musculus
ttccagcccaggatgaagtgcgcct

SEQ ID NO: 153297 - DNA, 25 bp, Mus musculus
ttccagcccccatcattacttggga

SEQ ID NO: 153298 - DNA, 25 bp, Mus musculus
ttccagctacggtcatccagtgcca

SEQ ID NO: 153299 - DNA, 25 bp, Mus musculus
ttccagctccagtcggacaggcgcg

SEQ ID NO: 153300 - DNA, 25 bp, Mus musculus
ttccagctggtgacaggacgcacat

SEQ ID NO: 153301 - DNA, 25 bp, Mus musculus
ttccaggaatgtcggcatgaccatc

SEQ ID NO: 153302 - DNA, 25 bp, Mus musculus
ttccaggactcaaagggcaaccagg

SEQ ID NO: 153303 - DNA, 25 bp, Mus musculus
ttccaggacttcttggcccaggacg

SEQ ID NO: 153304 - DNA, 25 bp, Mus musculus
ttccaggagcctcggacagtgctat

SEQ ID NO: 153305 - DNA, 25 bp, Mus musculus
ttccaggagtttgaccgagaccggg

SEQ ID NO: 153306 - DNA, 25 bp, Mus musculus
ttccagggatgcagcaaggcacacg

SEQ ID NO: 153307 - DNA, 25 bp, Mus musculus
ttccagggcgagaacagcaagtcgg

SEQ ID NO: 153308 - DNA, 25 bp, Mus musculus
ttccagtcgttacagaccactaggg

SEQ ID NO: 153309 - DNA, 25 bp, Mus musculus
ttccagtctgagtgggtcgggcctt

SEQ ID NO: 153310 - DNA, 25 bp, Mus musculus
ttccagtctgcggatgcgagagcct

SEQ ID NO: 153311 - DNA, 25 bp, Mus musculus
ttccagtggctttgaccgataccgc

SEQ ID NO: 153312 - DNA, 25 bp, Mus musculus
ttccagtgtgaaggacatgagccca

SEQ ID NO: 153313 - DNA, 25 bp, Mus musculus
ttccataaaggaggcgagcacttgt

SEQ ID NO: 153314 - DNA, 25 bp, Mus musculus
ttccatagaagagtcgctggccctg

SEQ ID NO: 153315 - DNA, 25 bp, Mus musculus
ttccatcagcagtggagcgttgact

SEQ ID NO: 153316 - DNA, 25 bp, Mus musculus
ttccatcaggagagacggcaaacag

SEQ ID NO: 153317 - DNA, 25 bp, Mus musculus
ttccatctacgaggccaggctgcgt

SEQ ID NO: 153318 - DNA, 25 bp, Mus musculus
ttccatgaagctgagatgcatctcc

SEQ ID NO: 153319 - DNA, 25 bp, Mus musculus
ttccatgggcatgctgcagagggca

SEQ ID NO: 153320 - DNA, 25 bp, Mus musculus
ttccattacaaggtgcacagatgct

SEQ ID NO: 153321 - DNA, 25 bp, Mus musculus
ttccattccaggcagcaaaggcgtc

SEQ ID NO: 153322 - DNA, 25 bp, Mus musculus
ttccatttggctccgtcgcctaccg

SEQ ID NO: 153323 - DNA, 25 bp, Mus musculus
ttcccaaagttgagcaagaaaaagg

SEQ ID NO: 153324 - DNA, 25 bp, Mus musculus
ttcccaagggcacatggtcaccgag

SEQ ID NO: 153325 - DNA, 25 bp, Mus musculus
ttcccacgggtggagcagactgaga

SEQ ID NO: 153326 - DNA, 25 bp, Mus musculus
ttcccactggttctccgaataaagc

SEQ ID NO: 153327 - DNA, 25 bp, Mus musculus
ttcccagaacaggtggcggttcctg

SEQ ID NO: 153328 - DNA, 25 bp, Mus musculus
ttcccagaaccagattagaagacgg

SEQ ID NO: 153329 - DNA, 25 bp, Mus musculus
ttcccagaagaagtcgccattgccg

SEQ ID NO: 153330 - DNA, 25 bp, Mus musculus
ttcccagaggatgccaagagaaggg

SEQ ID NO: 153331 - DNA, 25 bp, Mus musculus
ttcccagaggtgaaaggtcgaagct

SEQ ID NO: 153332 - DNA, 25 bp, Mus musculus
ttcccagcccatagttggacaggat

SEQ ID NO: 153333 - DNA, 25 bp, Mus musculus
ttcccagctggcagaagcttatgag

SEQ ID NO: 153334 - DNA, 25 bp, Mus musculus
ttcccagggacctagcaatcaaggc

SEQ ID NO: 153335 - DNA, 25 bp, Mus musculus
ttcccagggagaaacccacgactgt

SEQ ID NO: 153336 - DNA, 25 bp, Mus musculus
ttcccagtgctaacgaggttttcta

SEQ ID NO: 153337 - DNA, 25 bp, Mus musculus
ttcccagtgggaaagtgcgaacttc

SEQ ID NO: 153338 - DNA, 25 bp, Mus musculus
ttcccagtgggctgaagtggccacc

SEQ ID NO: 153339 - DNA, 25 bp, Mus musculus
ttcccatcagggaagagagtttcct

SEQ ID NO: 153340 - DNA, 25 bp, Mus musculus
ttcccatctgacctaggatccctgg

SEQ ID NO: 153341 - DNA, 25 bp, Mus musculus
ttcccattatagagacagcctgcag

SEQ ID NO: 153342 - DNA, 25 bp, Mus musculus
ttccccaacagactggagtggagag

SEQ ID NO: 153343 - DNA, 25 bp, Mus musculus
ttccccaagtgcaaagggtgcctca

SEQ ID NO: 153344 - DNA, 25 bp, Mus musculus
ttccccacgtctacatgaggaagca

SEQ ID NO: 153345 - DNA, 25 bp, Mus musculus
ttccccagagcaaggagacgctgct

SEQ ID NO: 153346 - DNA, 25 bp, Mus musculus
ttccccagcggaaacacgttcgtcg

SEQ ID NO: 153347 - DNA, 25 bp, Mus musculus
ttccccagggctgtgcagagcaaac

SEQ ID NO: 153348 - DNA, 25 bp, Mus musculus
ttccccgacgtggtggttgttcgag

SEQ ID NO: 153349 - DNA, 25 bp, Mus musculus
ttccccgccatgaatgaggaatacg

SEQ ID NO: 153350 - DNA, 25 bp, Mus musculus
ttccccgctcgttggcttcagtgca

SEQ ID NO: 153351 - DNA, 25 bp, Mus musculus
ttcccctcagggtccacatcttgag

SEQ ID NO: 153352 - DNA, 25 bp, Mus musculus
ttccccttactggagagacccgaag

SEQ ID NO: 153353 - DNA, 25 bp, Mus musculus
ttccccttcccgaatctgcagtggg

SEQ ID NO: 153354 - DNA, 25 bp, Mus musculus
ttcccgaggaggtgtggagcatcca

SEQ ID NO: 153355 - DNA, 25 bp, Mus musculus
ttcccgcagcggagatcgcggacgc

SEQ ID NO: 153356 - DNA, 25 bp, Mus musculus
ttcccggttcggtgcagctggcgct

SEQ ID NO: 153357 - DNA, 25 bp, Mus musculus
ttcccgtgacaggaaacgaccttgt

SEQ ID NO: 153358 - DNA, 25 bp, Mus musculus
ttcccgtgttctccatcttcgaaaa

SEQ ID NO: 153359 - DNA, 25 bp, Mus musculus
ttccctacgttaaggtgcacacgga

SEQ ID NO: 153360 - DNA, 25 bp, Mus musculus
ttccctataccaccaggacggacgg

SEQ ID NO: 153361 - DNA, 25 bp, Mus musculus
ttccctccatggagactgcgtggcc

SEQ ID NO: 153362 - DNA, 25 bp, Mus musculus
ttccctcgggacatgatcgacttag

SEQ ID NO: 153363 - DNA, 25 bp, Mus musculus
ttccctcttcggcttccgtagacga

SEQ ID NO: 153364 - DNA, 25 bp, Mus musculus
ttccctgatcctctgtaacgccaag

SEQ ID NO: 153365 - DNA, 25 bp, Mus musculus
ttccctgatgcggtatatctcccat

SEQ ID NO: 153366 - DNA, 25 bp, Mus musculus
ttccctgcctctacttgaccaagag

SEQ ID NO: 153367 - DNA, 25 bp, Mus musculus
ttccctgccttgctctttggactgc

SEQ ID NO: 153368 - DNA, 25 bp, Mus musculus
ttccctgctgggacactgtgtgcca

SEQ ID NO: 153369 - DNA, 25 bp, Mus musculus
ttccctggaactgcaaattggctag

SEQ ID NO: 153370 - DNA, 25 bp, Mus musculus
ttccctggaggtcgaggaaacccag

SEQ ID NO: 153371 - DNA, 25 bp, Mus musculus
ttccctggcgagttagaagctgccc

SEQ ID NO: 153372 - DNA, 25 bp, Mus musculus
ttccctggtgatgaggaagcggtta

SEQ ID NO: 153373 - DNA, 25 bp, Mus musculus
ttccctggtggctattgtaaaagac

SEQ ID NO: 153374 - DNA, 25 bp, Mus musculus
ttccctgtccctacccaagatgtga

SEQ ID NO: 153375 - DNA, 25 bp, Mus musculus
ttccctgtgggacgcatgcttcggt

SEQ ID NO: 153376 - DNA, 25 bp, Mus musculus
ttccctgtgtggtgaacagcgctcc

SEQ ID NO: 153377 - DNA, 25 bp, Mus musculus
ttccctgtgttcactagagccatcc

SEQ ID NO: 153378 - DNA, 25 bp, Mus musculus
ttccctgttaccacagccagaagag

SEQ ID NO: 153379 - DNA, 25 bp, Mus musculus
ttcccttccaggctgcggtcacaaa

SEQ ID NO: 153380 - DNA, 25 bp, Mus musculus
ttcccttctgaagggcacctggtgc

SEQ ID NO: 153381 - DNA, 25 bp, Mus musculus
ttccgaaaacgggaggctcagctcc

SEQ ID NO: 153382 - DNA, 25 bp, Mus musculus
ttccgaaaaggtacccaccagctct

SEQ ID NO: 153383 - DNA, 25 bp, Mus musculus
ttccgaaggctgaccgagtgtttcc

SEQ ID NO: 153384 - DNA, 25 bp, Mus musculus
ttccgaagggatctggtgaagaccc

SEQ ID NO: 153385 - DNA, 25 bp, Mus musculus
ttccgacagggagggactaggcact

SEQ ID NO: 153386 - DNA, 25 bp, Mus musculus
ttccgacaggtccaaggctcagaga

SEQ ID NO: 153387 - DNA, 25 bp, Mus musculus
ttccgagagcgagaaggacgactcc

SEQ ID NO: 153388 - DNA, 25 bp, Mus musculus
ttccgaggaagctagctgaagctgc

SEQ ID NO: 153389 - DNA, 25 bp, Mus musculus
ttccgaggccgtgaagaagcttctg

SEQ ID NO: 153390 - DNA, 25 bp, Mus musculus
ttccgagtcaactggcctggtaccg

SEQ ID NO: 153391 - DNA, 25 bp, Mus musculus
ttccgcccttcgagattgtcactgg

SEQ ID NO: 153392 - DNA, 25 bp, Mus musculus
ttccgcttcccgtctgacattggcg

SEQ ID NO: 153393 - DNA, 25 bp, Mus musculus
ttccggaagaaacaccctctggctg

SEQ ID NO: 153394 - DNA, 25 bp, Mus musculus
ttccggaagacaggccacatcattg

SEQ ID NO: 153395 - DNA, 25 bp, Mus musculus
ttccggaccagagtggcaacgtcac

SEQ ID NO: 153396 - DNA, 25 bp, Mus musculus
ttccggacggcgagccgctgcgaga

SEQ ID NO: 153397 - DNA, 25 bp, Mus musculus
ttccggagcacgaggaggactacct

SEQ ID NO: 153398 - DNA, 25 bp, Mus musculus
ttccgggacagaggtacaagggcca

SEQ ID NO: 153399 - DNA, 25 bp, Mus musculus
ttccgggaccggagtccgagaagca

SEQ ID NO: 153400 - DNA, 25 bp, Mus musculus
ttccgggacgccaaggcctgttccg

SEQ ID NO: 153401 - DNA, 25 bp, Mus musculus
ttccgggatgcaggccctggtgcta

SEQ ID NO: 153402 - DNA, 25 bp, Mus musculus
ttccgggtagccgaccaagatggcg

SEQ ID NO: 153403 - DNA, 25 bp, Mus musculus
ttccgggtgacctcctgtgacgaac

SEQ ID NO: 153404 - DNA, 25 bp, Mus musculus
ttccggtaccagagtgcagcaagct

SEQ ID NO: 153405 - DNA, 25 bp, Mus musculus
ttccgtaaccggcaggagcatctca

SEQ ID NO: 153406 - DNA, 25 bp, Mus musculus
ttccgtaagactaaggcagctccct

SEQ ID NO: 153407 - DNA, 25 bp, Mus musculus
ttccgtatcaaaatctgatgactca

SEQ ID NO: 153408 - DNA, 25 bp, Mus musculus
ttccgtcaccagaatgggatacagt

SEQ ID NO: 153409 - DNA, 25 bp, Mus musculus
ttccgtcatgtctacggcaagcccg

SEQ ID NO: 153410 - DNA, 25 bp, Mus musculus
ttccgtcccgggaagagcctgcggc

SEQ ID NO: 153411 - DNA, 25 bp, Mus musculus
ttccgtcgctttggagattggagag

SEQ ID NO: 153412 - DNA, 25 bp, Mus musculus
ttccgtgacctgaaatggacctgtt

SEQ ID NO: 153413 - DNA, 25 bp, Mus musculus
ttcctaaaggttgaggcccagtcct

SEQ ID NO: 153414 - DNA, 25 bp, Mus musculus
ttcctactccagaggacggactgcc

SEQ ID NO: 153415 - DNA, 25 bp, Mus musculus
ttcctactgagaggcatccagtggc

SEQ ID NO: 153416 - DNA, 25 bp, Mus musculus
ttcctacttggctgaatactcttcc

SEQ ID NO: 153417 - DNA, 25 bp, Mus musculus
ttcctagaagcctgtcggaaaatgg

SEQ ID NO: 153418 - DNA, 25 bp, Mus musculus
ttcctagacctgtagcctacagcag

SEQ ID NO: 153419 - DNA, 25 bp, Mus musculus
ttcctatcctaggtgtggacgcccg

SEQ ID NO: 153420 - DNA, 25 bp, Mus musculus
ttcctatcgccaagaaagagaagag

SEQ ID NO: 153421 - DNA, 25 bp, Mus musculus
ttcctatgaagactgctgtggctcc

SEQ ID NO: 153422 - DNA, 25 bp, Mus musculus
ttcctattctctggagaggcaaatg

SEQ ID NO: 153423 - DNA, 25 bp, Mus musculus
ttcctatttgtgaggcgcgggctgc

SEQ ID NO: 153424 - DNA, 25 bp, Mus musculus
ttcctcaagcagagccgggagaacg

SEQ ID NO: 153425 - DNA, 25 bp, Mus musculus
ttcctcaccggtatagacaagactg

SEQ ID NO: 153426 - DNA, 25 bp, Mus musculus
ttcctcactcgaagccagcgttacg

SEQ ID NO: 153427 - DNA, 25 bp, Mus musculus
ttcctcagaaggtgtccaagcccag

SEQ ID NO: 153428 - DNA, 25 bp, Mus musculus
ttcctcagctcgagatggacagccg

SEQ ID NO: 153429 - DNA, 25 bp, Mus musculus
ttcctcaggtggttccggtggctcc

SEQ ID NO: 153430 - DNA, 25 bp, Mus musculus
ttcctcatatgccaagtgagtaggg

SEQ ID NO: 153431 - DNA, 25 bp, Mus musculus
ttcctcatcgagaacctgctagcag

SEQ ID NO: 153432 - DNA, 25 bp, Mus musculus
ttcctccagacggtgagcagcgaga

SEQ ID NO: 153433 - DNA, 25 bp, Mus musculus
ttcctccgccgccaactagggaagt

SEQ ID NO: 153434 - DNA, 25 bp, Mus musculus
ttcctccgcgcaagtggaccggcgt

SEQ ID NO: 153435 - DNA, 25 bp, Mus musculus
ttcctccggccgagacgaagggcac

SEQ ID NO: 153436 - DNA, 25 bp, Mus musculus
ttcctcgtgaggaaatgctgcagat

SEQ ID NO: 153437 - DNA, 25 bp, Mus musculus
ttcctcgtggataacaaaaaggtct

SEQ ID NO: 153438 - DNA, 25 bp, Mus musculus
ttcctctaggaaaggcacgcctgca

SEQ ID NO: 153439 - DNA, 25 bp, Mus musculus
ttcctctcaagagcgccaaaggcgg

SEQ ID NO: 153440 - DNA, 25 bp, Mus musculus
ttcctctgaagacactggcagccca

SEQ ID NO: 153441 - DNA, 25 bp, Mus musculus
ttcctctgtctcaacagtgcctagg

SEQ ID NO: 153442 - DNA, 25 bp, Mus musculus
ttcctcttgacaggccagcttgctt

SEQ ID NO: 153443 - DNA, 25 bp, Mus musculus
ttcctgaaggacgtgtgctgcccct

SEQ ID NO: 153444 - DNA, 25 bp, Mus musculus
ttcctgaagttgaagccctgctggc

SEQ ID NO: 153445 - DNA, 25 bp, Mus musculus
ttcctgacagaataagatggcggcg

SEQ ID NO: 153446 - DNA, 25 bp, Mus musculus
ttcctgaccaagaaaacccgcggag

SEQ ID NO: 153447 - DNA, 25 bp, Mus musculus
ttcctgacggtcttctggaaggtgc

SEQ ID NO: 153448 - DNA, 25 bp, Mus musculus
ttcctgacttgctgaagatttatca

SEQ ID NO: 153449 - DNA, 25 bp, Mus musculus
ttcctgagacagtaccgagtgggca

SEQ ID NO: 153450 - DNA, 25 bp, Mus musculus
ttcctgagcaggatgcaccactggc

SEQ ID NO: 153451 - DNA, 25 bp, Mus musculus
ttcctgagcccaaaatcattgatgc

SEQ ID NO: 153452 - DNA, 25 bp, Mus musculus
ttcctgagccgtgaggagacgcagc

SEQ ID NO: 153453 - DNA, 25 bp, Mus musculus
ttcctgagggttgctgtaaaactac

SEQ ID NO: 153454 - DNA, 25 bp, Mus musculus
ttcctgagtgaaaacctgatgtggc

SEQ ID NO: 153455 - DNA, 25 bp, Mus musculus
ttcctgagtgtgtcgccttgagcct

SEQ ID NO: 153456 - DNA, 25 bp, Mus musculus
ttcctgcaaaacacggaggccgctt

SEQ ID NO: 153457 - DNA, 25 bp, Mus musculus
ttcctgccactctgtaatgtcctgt

SEQ ID NO: 153458 - DNA, 25 bp, Mus musculus
ttcctgcggaccaaaactcttccgg

SEQ ID NO: 153459 - DNA, 25 bp, Mus musculus
ttcctgcgggcacctaaggaccaga

SEQ ID NO: 153460 - DNA, 25 bp, Mus musculus
ttcctgctgagcaaccggagtggca

SEQ ID NO: 153461 - DNA, 25 bp, Mus musculus
ttcctgctgatgatgggtgtgctgt

SEQ ID NO: 153462 - DNA, 25 bp, Mus musculus
ttcctgctgcagtcggacgaggaga

SEQ ID NO: 153463 - DNA, 25 bp, Mus musculus
ttcctgctgtacaaccaagggccag

SEQ ID NO: 153464 - DNA, 25 bp, Mus musculus
ttcctggcattcctgatactcttca

SEQ ID NO: 153465 - DNA, 25 bp, Mus musculus
ttcctggccatcgtaggctatgtgg

SEQ ID NO: 153466 - DNA, 25 bp, Mus musculus
ttcctggcctggtgataaagaccct

SEQ ID NO: 153467 - DNA, 25 bp, Mus musculus
ttcctgggcgcccttgaagcaccgc

SEQ ID NO: 153468 - DNA, 25 bp, Mus musculus
ttcctgggctatgggagatgtcagc

SEQ ID NO: 153469 - DNA, 25 bp, Mus musculus
ttcctggtacagagaacggtggctc

SEQ ID NO: 153470 - DNA, 25 bp, Mus musculus
ttcctgtaggtctagaatctaatca

SEQ ID NO: 153471 - DNA, 25 bp, Mus musculus
ttcctgtcaagtccctagcacagcg

SEQ ID NO: 153472 - DNA, 25 bp, Mus musculus
ttcctgtgggtatatgtgactgcca

SEQ ID NO: 153473 - DNA, 25 bp, Mus musculus
ttcctgttggatggaaaacccagga

SEQ ID NO: 153474 - DNA, 25 bp, Mus musculus
ttccttacagctcttgcaggccggc

SEQ ID NO: 153475 - DNA, 25 bp, Mus musculus
ttccttacaggacgcccggagaggt

SEQ ID NO: 153476 - DNA, 25 bp, Mus musculus
ttccttcagtgactaagggactggg

SEQ ID NO: 153477 - DNA, 25 bp, Mus musculus
ttccttccaacagccgcatccaagt

SEQ ID NO: 153478 - DNA, 25 bp, Mus musculus
ttccttccgaagaacctgcacttgg

SEQ ID NO: 153479 - DNA, 25 bp, Mus musculus
ttccttcgtgcaacagagaatcaga

SEQ ID NO: 153480 - DNA, 25 bp, Mus musculus
ttccttggtttgttgagaatagcaa

SEQ ID NO: 153481 - DNA, 25 bp, Mus musculus
ttccttgtgggtctgctgcccggcc

SEQ ID NO: 153482 - DNA, 25 bp, Mus musculus
ttcctttaagctggagacagacccg

SEQ ID NO: 153483 - DNA, 25 bp, Mus musculus
ttcctttcaagatcgtggtccagag

SEQ ID NO: 153484 - DNA, 25 bp, Mus musculus
ttcctttcgaatcctgcgggtgcag

SEQ ID NO: 153485 - DNA, 25 bp, Mus musculus
ttcctttgaggaggcgagaaggcac

SEQ ID NO: 153486 - DNA, 25 bp, Mus musculus
ttcctttgatgacgcccctcgatgt

SEQ ID NO: 153487 - DNA, 25 bp, Mus musculus
ttcgaaccagacagcaaggcctttg

SEQ ID NO: 153488 - DNA, 25 bp, Mus musculus
ttcgaacccatttgatgaggacacg

SEQ ID NO: 153489 - DNA, 25 bp, Mus musculus
ttcgaacgcctacctctaacgagga

SEQ ID NO: 153490 - DNA, 25 bp, Mus musculus
ttcgaactgatcagacgcaaggccc

SEQ ID NO: 153491 - DNA, 25 bp, Mus musculus
ttcgaagaggccagttattcagtct

SEQ ID NO: 153492 - DNA, 25 bp, Mus musculus
ttcgaataaaggagacggcgcaggc

SEQ ID NO: 153493 - DNA, 25 bp, Mus musculus
ttcgaatgagaaaccaatcccttgg

SEQ ID NO: 153494 - DNA, 25 bp, Mus musculus
ttcgacaagaaggacgaggagtctg

SEQ ID NO: 153495 - DNA, 25 bp, Mus musculus
ttcgacaagacagaggacgtcggct

SEQ ID NO: 153496 - DNA, 25 bp, Mus musculus
ttcgacacggaccacaatggagctg

SEQ ID NO: 153497 - DNA, 25 bp, Mus musculus
ttcgaccacacaggaatctgcatgg

SEQ ID NO: 153498 - DNA, 25 bp, Mus musculus
ttcgaccaggaggacaacgaagctc

SEQ ID NO: 153499 - DNA, 25 bp, Mus musculus
ttcgacggctgtgccaggagaacca

SEQ ID NO: 153500 - DNA, 25 bp, Mus musculus
ttcgagagcccaaatatcagtgtgc

SEQ ID NO: 153501 - DNA, 25 bp, Mus musculus
ttcgagaggaggcagatccccctct

SEQ ID NO: 153502 - DNA, 25 bp, Mus musculus
ttcgagagggagaagcatgcccaca

SEQ ID NO: 153503 - DNA, 25 bp, Mus musculus
ttcgagatccgcctgagtcagggcc

SEQ ID NO: 153504 - DNA, 25 bp, Mus musculus
ttcgagcagcaatggtaccggcagc

SEQ ID NO: 153505 - DNA, 25 bp, Mus musculus
ttcgagcagccgcagtactacctgg

SEQ ID NO: 153506 - DNA, 25 bp, Mus musculus
ttcgagccagcggagtaattttcca

SEQ ID NO: 153507 - DNA, 25 bp, Mus musculus
ttcgagccgagaccaggagccgggc

SEQ ID NO: 153508 - DNA, 25 bp, Mus musculus
ttcgagcgagcctatcaacagcagc

SEQ ID NO: 153509 - DNA, 25 bp, Mus musculus
ttcgagcgcagagcgacatgaacgc

SEQ ID NO: 153510 - DNA, 25 bp, Mus musculus
ttcgaggaaatcatgaatgcaggca

SEQ ID NO: 153511 - DNA, 25 bp, Mus musculus
ttcgaggcggccagtactgttgagt

SEQ ID NO: 153512 - DNA, 25 bp, Mus musculus
ttcgagggaaccagctggaatccac

SEQ ID NO: 153513 - DNA, 25 bp, Mus musculus
ttcgaggtctttaggcagcttggag

SEQ ID NO: 153514 - DNA, 25 bp, Mus musculus
ttcgaggtgaagagtacagcagacg

SEQ ID NO: 153515 - DNA, 25 bp, Mus musculus
ttcgaggttccggacaggacctcct

SEQ ID NO: 153516 - DNA, 25 bp, Mus musculus
ttcgagtgaccatggagagcgcctt

SEQ ID NO: 153517 - DNA, 25 bp, Mus musculus
ttcgagtgggcacccgtaagagcca

SEQ ID NO: 153518 - DNA, 25 bp, Mus musculus
ttcgatatgataactaccggctgca

SEQ ID NO: 153519 - DNA, 25 bp, Mus musculus
ttcgatcgcgaagatggctgctggc

SEQ ID NO: 153520 - DNA, 25 bp, Mus musculus
ttcgatcgggaataagggcatatcc

SEQ ID NO: 153521 - DNA, 25 bp, Mus musculus
ttcgatcgggagcaacagagtacct

SEQ ID NO: 153522 - DNA, 25 bp, Mus musculus
ttcgatctgaggaaggccgggacat

SEQ ID NO: 153523 - DNA, 25 bp, Mus musculus
ttcgatctggaagacacgatggacg

SEQ ID NO: 153524 - DNA, 25 bp, Mus musculus
ttcgatctgtcgtgtgaccgccctc

SEQ ID NO: 153525 - DNA, 25 bp, Mus musculus
ttcgatgtactgcacccgtatccgg

SEQ ID NO: 153526 - DNA, 25 bp, Mus musculus
ttcgatgtccactatagagttcggc

SEQ ID NO: 153527 - DNA, 25 bp, Mus musculus
ttcgcaaagcggaggaacaagtcca

SEQ ID NO: 153528 - DNA, 25 bp, Mus musculus
ttcgcaagtgtaggcagaacgccag

SEQ ID NO: 153529 - DNA, 25 bp, Mus musculus
ttcgcacaccggatcttcgccgagt

SEQ ID NO: 153530 - DNA, 25 bp, Mus musculus
ttcgcacggacagtttaaaaggccg

SEQ ID NO: 153531 - DNA, 25 bp, Mus musculus
ttcgcagaggcattgaaggaccacc

SEQ ID NO: 153532 - DNA, 25 bp, Mus musculus
ttcgcagggacacctggatacctct

SEQ ID NO: 153533 - DNA, 25 bp, Mus musculus
ttcgcagggcaacagcaacagttct

SEQ ID NO: 153534 - DNA, 25 bp, Mus musculus
ttcgcagggcccaacatagaactgg

SEQ ID NO: 153535 - DNA, 25 bp, Mus musculus
ttcgcagtaaactgccgcatcctga

SEQ ID NO: 153536 - DNA, 25 bp, Mus musculus
ttcgccatggcgtttgccacagagg

SEQ ID NO: 153537 - DNA, 25 bp, Mus musculus
ttcgcccagaagtgaggaacttgga

SEQ ID NO: 153538 - DNA, 25 bp, Mus musculus
ttcgcccgggtgtccatgtatgtgg

SEQ ID NO: 153539 - DNA, 25 bp, Mus musculus
ttcgccctggtgaataggaaacccg

SEQ ID NO: 153540 - DNA, 25 bp, Mus musculus
ttcgccgccctgattgacatgatgt

SEQ ID NO: 153541 - DNA, 25 bp, Mus musculus
ttcgccgtcgccgaggccttctctc

SEQ ID NO: 153542 - DNA, 25 bp, Mus musculus
ttcgcgaagcccgactcgggagagc

SEQ ID NO: 153543 - DNA, 25 bp, Mus musculus
ttcgcgcccggactcagtgttaggt

SEQ ID NO: 153544 - DNA, 25 bp, Mus musculus
ttcgcgcccgtgtatagctggatcc

SEQ ID NO: 153545 - DNA, 25 bp, Mus musculus
ttcgcgctggaggagacactcgagt

SEQ ID NO: 153546 - DNA, 25 bp, Mus musculus
ttcgcggcgcagagacaggtctcta

SEQ ID NO: 153547 - DNA, 25 bp, Mus musculus
ttcgcgtggaattcatggactcagc

SEQ ID NO: 153548 - DNA, 25 bp, Mus musculus
ttcgctagcctagcgccgttccttc

SEQ ID NO: 153549 - DNA, 25 bp, Mus musculus
ttcgctatgtcggatgacgattcga

SEQ ID NO: 153550 - DNA, 25 bp, Mus musculus
ttcgctccggcagtgggatgtccgt

SEQ ID NO: 153551 - DNA, 25 bp, Mus musculus
ttcgctctaggatgctgtggtcccc

SEQ ID NO: 153552 - DNA, 25 bp, Mus musculus
ttcgctctctgacagagctgcagga

SEQ ID NO: 153553 - DNA, 25 bp, Mus musculus
ttcgctgaaggaccgctacaagtag

SEQ ID NO: 153554 - DNA, 25 bp, Mus musculus
ttcgctgctcgtgagagaaggtgcc

SEQ ID NO: 153555 - DNA, 25 bp, Mus musculus
ttcgctttgccaggagatgccgcac

SEQ ID NO: 153556 - DNA, 25 bp, Mus musculus
ttcggaaagtggaaggtgacatctg

SEQ ID NO: 153557 - DNA, 25 bp, Mus musculus
ttcggaaatccctcccgtgagcagg

SEQ ID NO: 153558 - DNA, 25 bp, Mus musculus
ttcggaacgttgtcatggagcagct

SEQ ID NO: 153559 - DNA, 25 bp, Mus musculus
ttcggaagaacctggaagaggcgaa

SEQ ID NO: 153560 - DNA, 25 bp, Mus musculus
ttcggaagccccttggtgctatggg

SEQ ID NO: 153561 - DNA, 25 bp, Mus musculus
ttcggacacttctgggagaccctgt

SEQ ID NO: 153562 - DNA, 25 bp, Mus musculus
ttcggacagcgaccatgaaccttca

SEQ ID NO: 153563 - DNA, 25 bp, Mus musculus
ttcggacatggccaccatgcgggct

SEQ ID NO: 153564 - DNA, 25 bp, Mus musculus
ttcggagcgaccgtcgccattggcg

SEQ ID NO: 153565 - DNA, 25 bp, Mus musculus
ttcggagtcagatgcaaggacccag

SEQ ID NO: 153566 - DNA, 25 bp, Mus musculus
ttcggatcgtgcacaagaacagggc

SEQ ID NO: 153567 - DNA, 25 bp, Mus musculus
ttcggattttaacagctcgggctct

SEQ ID NO: 153568 - DNA, 25 bp, Mus musculus
ttcggcaaaaccagagggccctgaa

SEQ ID NO: 153569 - DNA, 25 bp, Mus musculus
ttcggcctggccaagaagtaccgcg

SEQ ID NO: 153570 - DNA, 25 bp, Mus musculus
ttcggcggctctgccacaggcgcag

SEQ ID NO: 153571 - DNA, 25 bp, Mus musculus
ttcggctacaaaaatggtacctggc

SEQ ID NO: 153572 - DNA, 25 bp, Mus musculus
ttcggctacacgaaggagagcagcc

SEQ ID NO: 153573 - DNA, 25 bp, Mus musculus
ttcggctccgacatggaagatggac

SEQ ID NO: 153574 - DNA, 25 bp, Mus musculus
ttcggcttttctcggttcagtctcc

SEQ ID NO: 153575 - DNA, 25 bp, Mus musculus
ttcgggaacaggatatcatggcgtc

SEQ ID NO: 153576 - DNA, 25 bp, Mus musculus
ttcgggaaccaagaggatgcacacg

SEQ ID NO: 153577 - DNA, 25 bp, Mus musculus
ttcgggaagccaacatgaagcaggc

SEQ ID NO: 153578 - DNA, 25 bp, Mus musculus
ttcgggacatctccagcagcagaca

SEQ ID NO: 153579 - DNA, 25 bp, Mus musculus
ttcgggactcctccaaggcagatgg

SEQ ID NO: 153580 - DNA, 25 bp, Mus musculus
ttcgggagcggctgctgatcacccg

SEQ ID NO: 153581 - DNA, 25 bp, Mus musculus
ttcgggagctggtacccgagtccca

SEQ ID NO: 153582 - DNA, 25 bp, Mus musculus
ttcgggcgaagacaaacggatgcac

SEQ ID NO: 153583 - DNA, 25 bp, Mus musculus
ttcgggcggttgacctcactaaagc

SEQ ID NO: 153584 - DNA, 25 bp, Mus musculus
ttcgggcgttccatgcagctttgcg

SEQ ID NO: 153585 - DNA, 25 bp, Mus musculus
ttcgggttcctgtggtagacgtgca

SEQ ID NO: 153586 - DNA, 25 bp, Mus musculus
ttcgggttcgccaaaagagtcaagg

SEQ ID NO: 153587 - DNA, 25 bp, Mus musculus
ttcggtctgacttgcagccgctgca

SEQ ID NO: 153588 - DNA, 25 bp, Mus musculus
ttcgtaaactctgggcgttcacggg

SEQ ID NO: 153589 - DNA, 25 bp, Mus musculus
ttcgtacatggaccacagtgggcag

SEQ ID NO: 153590 - DNA, 25 bp, Mus musculus
ttcgtactgggactgcctgaaggca

SEQ ID NO: 153591 - DNA, 25 bp, Mus musculus
ttcgtatctagggtgggctttggca

SEQ ID NO: 153592 - DNA, 25 bp, Mus musculus
ttcgtcaatgggaggcgtccccgtg

SEQ ID NO: 153593 - DNA, 25 bp, Mus musculus
ttcgtcattcgaacgcctaggatcc

SEQ ID NO: 153594 - DNA, 25 bp, Mus musculus
ttcgtcggccagtcacccctggtgg

SEQ ID NO: 153595 - DNA, 25 bp, Mus musculus
ttcgtcgtactgtgaacggcctcga

SEQ ID NO: 153596 - DNA, 25 bp, Mus musculus
ttcgtgaatgacagggaggctcccg

SEQ ID NO: 153597 - DNA, 25 bp, Mus musculus
ttcgtgaggtacctgctgcaccgtg

SEQ ID NO: 153598 - DNA, 25 bp, Mus musculus
ttcgtgcactctgcgaagagcctgc

SEQ ID NO: 153599 - DNA, 25 bp, Mus musculus
ttcgtgcagggagtggacatgttct

SEQ ID NO: 153600 - DNA, 25 bp, Mus musculus
ttcgtgcctgatgagtgtccgcgca

SEQ ID NO: 153601 - DNA, 25 bp, Mus musculus
ttcgtggacatcaacgtgggctgcc

SEQ ID NO: 153602 - DNA, 25 bp, Mus musculus
ttcgtggttgacagtaatgaccgag

SEQ ID NO: 153603 - DNA, 25 bp, Mus musculus
ttcgtgtatcctgggccaccttggc

SEQ ID NO: 153604 - DNA, 25 bp, Mus musculus
ttcgttaaagtcgtacgtgaggtcg

SEQ ID NO: 153605 - DNA, 25 bp, Mus musculus
ttcgttcaaaccgacaagtccgtgt

SEQ ID NO: 153606 - DNA, 25 bp, Mus musculus
ttctaaaaccctggcgcatctggct

SEQ ID NO: 153607 - DNA, 25 bp, Mus musculus
ttctaaatcctacaggctggtcggc

SEQ ID NO: 153608 - DNA, 25 bp, Mus musculus
ttctaacacctacgatgggtccggc

SEQ ID NO: 153609 - DNA, 25 bp, Mus musculus
ttctaacagagacggaagactggct

SEQ ID NO: 153610 - DNA, 25 bp, Mus musculus
ttctaaccccgtctgtgatgctgga

SEQ ID NO: 153611 - DNA, 25 bp, Mus musculus
ttctaaccggctgaagcaactggct

SEQ ID NO: 153612 - DNA, 25 bp, Mus musculus
ttctaacttataggacaactccggg

SEQ ID NO: 153613 - DNA, 25 bp, Mus musculus
ttctaagcgcagcagacgaaaagca

SEQ ID NO: 153614 - DNA, 25 bp, Mus musculus
ttctaagtgagcaggagatccagca

SEQ ID NO: 153615 - DNA, 25 bp, Mus musculus
ttctacaccctgaagtgactgaggc

SEQ ID NO: 153616 - DNA, 25 bp, Mus musculus
ttctacacgagaaccagctgaccca

SEQ ID NO: 153617 - DNA, 25 bp, Mus musculus
ttctacagacagtaattccattggg

SEQ ID NO: 153618 - DNA, 25 bp, Mus musculus
ttctacagacatggggtatccatcg

SEQ ID NO: 153619 - DNA, 25 bp, Mus musculus
ttctacagcatgaacaggcctgcct

SEQ ID NO: 153620 - DNA, 25 bp, Mus musculus
ttctacagtgagtcgggcatgccta

SEQ ID NO: 153621 - DNA, 25 bp, Mus musculus
ttctaccacagctttggccgcgtgc

SEQ ID NO: 153622 - DNA, 25 bp, Mus musculus
ttctaccagccgacgtgcatcgtgc

SEQ ID NO: 153623 - DNA, 25 bp, Mus musculus
ttctaccatatattgtactgtgagc

SEQ ID NO: 153624 - DNA, 25 bp, Mus musculus
ttctaccctgggatgcagtgctggg

SEQ ID NO: 153625 - DNA, 25 bp, Mus musculus
ttctacctggcggaatgtgggaagt

SEQ ID NO: 153626 - DNA, 25 bp, Mus musculus
ttctacgactccaaagaaacggtca

SEQ ID NO: 153627 - DNA, 25 bp, Mus musculus
ttctactccaaaagactgatgcggc

SEQ ID NO: 153628 - DNA, 25 bp, Mus musculus
ttctacttacgaaggcagtggctgc

SEQ ID NO: 153629 - DNA, 25 bp, Mus musculus
ttctagaacagtatcccaccaggcc

SEQ ID NO: 153630 - DNA, 25 bp, Mus musculus
ttctagaagaagagctgtcgagcct

SEQ ID NO: 153631 - DNA, 25 bp, Mus musculus
ttctagaaggcaggcccggagatct

SEQ ID NO: 153632 - DNA, 25 bp, Mus musculus
ttctagaaggctcgaggtgctctga

SEQ ID NO: 153633 - DNA, 25 bp, Mus musculus
ttctagccacgtgtagcgcccttgg

SEQ ID NO: 153634 - DNA, 25 bp, Mus musculus
ttctagcggaagacgtagagctcct

SEQ ID NO: 153635 - DNA, 25 bp, Mus musculus
ttctaggacccgtgagaggctcagc

SEQ ID NO: 153636 - DNA, 25 bp, Mus musculus
ttctaggagagccaaggacctcttt

SEQ ID NO: 153637 - DNA, 25 bp, Mus musculus
ttctagtgacaagtaatgggaccgt

SEQ ID NO: 153638 - DNA, 25 bp, Mus musculus
ttctatagacctgcgatgtccgggc

SEQ ID NO: 153639 - DNA, 25 bp, Mus musculus
ttctatataccctggcgccatgcca

SEQ ID NO: 153640 - DNA, 25 bp, Mus musculus
ttctatccaagacccggaactcctg

SEQ ID NO: 153641 - DNA, 25 bp, Mus musculus
ttctatgatggaacacacgctcccc

SEQ ID NO: 153642 - DNA, 25 bp, Mus musculus
ttctatgcattcgagtgtcccaggc

SEQ ID NO: 153643 - DNA, 25 bp, Mus musculus
ttctatgtaaacgaacagtcgggcg

SEQ ID NO: 153644 - DNA, 25 bp, Mus musculus
ttctatgtcttctggcggcgacgcg

SEQ ID NO: 153645 - DNA, 25 bp, Mus musculus
ttctatgtggccatgaatcgcaggg

SEQ ID NO: 153646 - DNA, 25 bp, Mus musculus
ttctatttgaatggcctagctgtgg

SEQ ID NO: 153647 - DNA, 25 bp, Mus musculus
ttctcaaaagactggccttcgccgt

SEQ ID NO: 153648 - DNA, 25 bp, Mus musculus
ttctcaaacgacttcccaagaggga

SEQ ID NO: 153649 - DNA, 25 bp, Mus musculus
ttctcaaagggaaaccatcaggtcg

SEQ ID NO: 153650 - DNA, 25 bp, Mus musculus
ttctcaactgggacagcaggacgct

SEQ ID NO: 153651 - DNA, 25 bp, Mus musculus
ttctcaagactctcagccgagggcg

SEQ ID NO: 153652 - DNA, 25 bp, Mus musculus
ttctcaaggctacgcagagcatgtc

SEQ ID NO: 153653 - DNA, 25 bp, Mus musculus
ttctcaaggtagagcaacagcggct

SEQ ID NO: 153654 - DNA, 25 bp, Mus musculus
ttctcaagtaccgagggacgcaagc

SEQ ID NO: 153655 - DNA, 25 bp, Mus musculus
ttctcacaaggctggcccacttgca

SEQ ID NO: 153656 - DNA, 25 bp, Mus musculus
ttctcacaatgggaaagagttcacg

SEQ ID NO: 153657 - DNA, 25 bp, Mus musculus
ttctcacaccttggaatcagaggca

SEQ ID NO: 153658 - DNA, 25 bp, Mus musculus
ttctcacaggaaaggcttgccccat

SEQ ID NO: 153659 - DNA, 25 bp, Mus musculus
ttctcacctgatggccgacacttag

SEQ ID NO: 153660 - DNA, 25 bp, Mus musculus
ttctcactggactcctcgagggctg

SEQ ID NO: 153661 - DNA, 25 bp, Mus musculus
ttctcagaggcatttggcaaagtga

SEQ ID NO: 153662 - DNA, 25 bp, Mus musculus
ttctcagcagcgacaacttcgaggg

SEQ ID NO: 153663 - DNA, 25 bp, Mus musculus
ttctcagcaggaagcaaggcaatga

SEQ ID NO: 153664 - DNA, 25 bp, Mus musculus
ttctcagctcaaccactcagggagg

SEQ ID NO: 153665 - DNA, 25 bp, Mus musculus
ttctcaggcacacataggcgcacag

SEQ ID NO: 153666 - DNA, 25 bp, Mus musculus
ttctcaggcagattccaagcagcag

SEQ ID NO: 153667 - DNA, 25 bp, Mus musculus
ttctcagtacagtaacgatgtgccc

SEQ ID NO: 153668 - DNA, 25 bp, Mus musculus
ttctcagtgctgatgcgggccatgc

SEQ ID NO: 153669 - DNA, 25 bp, Mus musculus
ttctcagtgctgtgtgtgcaaagtg

SEQ ID NO: 153670 - DNA, 25 bp, Mus musculus
ttctcagttggtgggctgagaagcc

SEQ ID NO: 153671 - DNA, 25 bp, Mus musculus
ttctcagtttgggccttttataaat

SEQ ID NO: 153672 - DNA, 25 bp, Mus musculus
ttctcataggcaccagggacaggct

SEQ ID NO: 153673 - DNA, 25 bp, Mus musculus
ttctcatggcggacttcaacaagga

SEQ ID NO: 153674 - DNA, 25 bp, Mus musculus
ttctccaaaggagtgtacgccatct

SEQ ID NO: 153675 - DNA, 25 bp, Mus musculus
ttctccaacagaggcgaacctaggg

SEQ ID NO: 153676 - DNA, 25 bp, Mus musculus
ttctccaccagaacaagcacacgtg

SEQ ID NO: 153677 - DNA, 25 bp, Mus musculus
ttctccacgctaggcagggtgctgc

SEQ ID NO: 153678 - DNA, 25 bp, Mus musculus
ttctccagcataggtggacagccga

SEQ ID NO: 153679 - DNA, 25 bp, Mus musculus
ttctccagctcctcaaagaagtaat

SEQ ID NO: 153680 - DNA, 25 bp, Mus musculus
ttctccaggccgtcaacaagctgct

SEQ ID NO: 153681 - DNA, 25 bp, Mus musculus
ttctccaggctgtggcggaacaacc

SEQ ID NO: 153682 - DNA, 25 bp, Mus musculus
ttctccatctgatgtggccctggga

SEQ ID NO: 153683 - DNA, 25 bp, Mus musculus
ttctccatggtgatagacaacggca

SEQ ID NO: 153684 - DNA, 25 bp, Mus musculus
ttctcccaccagagcccggaacatg

SEQ ID NO: 153685 - DNA, 25 bp, Mus musculus
ttctccccgagaaagtacacctagg

SEQ ID NO: 153686 - DNA, 25 bp, Mus musculus
ttctccccttgaatggcgtgcctct

SEQ ID NO: 153687 - DNA, 25 bp, Mus musculus
ttctcccggagacgcttgaagctgg

SEQ ID NO: 153688 - DNA, 25 bp, Mus musculus
ttctccctctgtcccatctgagcca

SEQ ID NO: 153689 - DNA, 25 bp, Mus musculus
ttctccctgacccagttcagcgttg

SEQ ID NO: 153690 - DNA, 25 bp, Mus musculus
ttctccgaaaccagaagagccgctg

SEQ ID NO: 153691 - DNA, 25 bp, Mus musculus
ttctccggaagcgagacagcatggc

SEQ ID NO: 153692 - DNA, 25 bp, Mus musculus
ttctccggacatggagccagagccg

SEQ ID NO: 153693 - DNA, 25 bp, Mus musculus
ttctccgtggccgtgatccttgtgg

SEQ ID NO: 153694 - DNA, 25 bp, Mus musculus
ttctcctaggaggtgctggtcccgc

SEQ ID NO: 153695 - DNA, 25 bp, Mus musculus
ttctcctataaaaggcacacgcggg

SEQ ID NO: 153696 - DNA, 25 bp, Mus musculus
ttctcctcagaaatgaaattttgcc

SEQ ID NO: 153697 - DNA, 25 bp, Mus musculus
ttctcctggtaaagatggtgcccgt

SEQ ID NO: 153698 - DNA, 25 bp, Mus musculus
ttctcctggtgcagctgtgaggtca

SEQ ID NO: 153699 - DNA, 25 bp, Mus musculus
ttctccttgacagcagaaacagagg

SEQ ID NO: 153700 - DNA, 25 bp, Mus musculus
ttctcgcgagatgtgcgagcggcca

SEQ ID NO: 153701 - DNA, 25 bp, Mus musculus
ttctcgctcccttctctacggcggc

SEQ ID NO: 153702 - DNA, 25 bp, Mus musculus
ttctcgctttggactgggaccctga

SEQ ID NO: 153703 - DNA, 25 bp, Mus musculus
ttctcggacattttcaacaccagcg

SEQ ID NO: 153704 - DNA, 25 bp, Mus musculus
ttctcgtcgcgcgtccgcaggcctc

SEQ ID NO: 153705 - DNA, 25 bp, Mus musculus
ttctctcagcagaactccagcgggc

SEQ ID NO: 153706 - DNA, 25 bp, Mus musculus
ttctctccagagacagttgtgacct

SEQ ID NO: 153707 - DNA, 25 bp, Mus musculus
ttctctccaggagtcaggcttgcca

SEQ ID NO: 153708 - DNA, 25 bp, Mus musculus
ttctctccggccctgatccctttga

SEQ ID NO: 153709 - DNA, 25 bp, Mus musculus
ttctctcggacttttggtcatgaag

SEQ ID NO: 153710 - DNA, 25 bp, Mus musculus
ttctctgcagtaccttcccagggcg

SEQ ID NO: 153711 - DNA, 25 bp, Mus musculus
ttctctgcagtcaacgaccctcagg

SEQ ID NO: 153712 - DNA, 25 bp, Mus musculus
ttctctgccaatggaaggcctctgg

SEQ ID NO: 153713 - DNA, 25 bp, Mus musculus
ttctctgccctgactccaagcatat

SEQ ID NO: 153714 - DNA, 25 bp, Mus musculus
ttctctggcatggaaggagtcctca

SEQ ID NO: 153715 - DNA, 25 bp, Mus musculus
ttctctggcggctgaccaagaagca

SEQ ID NO: 153716 - DNA, 25 bp, Mus musculus
ttctctgggccgaactgtggacctg

SEQ ID NO: 153717 - DNA, 25 bp, Mus musculus
ttctctgtaaaacatcggatgccgc

SEQ ID NO: 153718 - DNA, 25 bp, Mus musculus
ttctctgtcagctcagcgcggcacg

SEQ ID NO: 153719 - DNA, 25 bp, Mus musculus
ttctctgtgcttgacgctgctggcg

SEQ ID NO: 153720 - DNA, 25 bp, Mus musculus
ttctcttcccgttgaggtggcggcc

SEQ ID NO: 153721 - DNA, 25 bp, Mus musculus
ttctctttgaggtagccagggccgg

SEQ ID NO: 153722 - DNA, 25 bp, Mus musculus
ttctgaaaatcagttgggagctcca

SEQ ID NO: 153723 - DNA, 25 bp, Mus musculus
ttctgaactacccaaaacgtgcctg

SEQ ID NO: 153724 - DNA, 25 bp, Mus musculus
ttctgaagaccagggtgggattgat

SEQ ID NO: 153725 - DNA, 25 bp, Mus musculus
ttctgaaggctggaacgtccccatg

SEQ ID NO: 153726 - DNA, 25 bp, Mus musculus
ttctgaatggagaccataacaagga

SEQ ID NO: 153727 - DNA, 25 bp, Mus musculus
ttctgacactgaggacgtgaccaag

SEQ ID NO: 153728 - DNA, 25 bp, Mus musculus
ttctgaccatgagaccacatcctgg

SEQ ID NO: 153729 - DNA, 25 bp, Mus musculus
ttctgactgtcaatcggagccctgc

SEQ ID NO: 153730 - DNA, 25 bp, Mus musculus
ttctgagagcccttgaaaaccgcca

SEQ ID NO: 153731 - DNA, 25 bp, Mus musculus
ttctgagaggatccaggacaacgcc

SEQ ID NO: 153732 - DNA, 25 bp, Mus musculus
ttctgagcaccttgtgggagtcaca

SEQ ID NO: 153733 - DNA, 25 bp, Mus musculus
ttctgatcaatatggctgcaggcca

SEQ ID NO: 153734 - DNA, 25 bp, Mus musculus
ttctgatcagtttgtctgaagtggg

SEQ ID NO: 153735 - DNA, 25 bp, Mus musculus
ttctgatttagccatgaaagtcctc

SEQ ID NO: 153736 - DNA, 25 bp, Mus musculus
ttctgcaaaggaacggagccctggt

SEQ ID NO: 153737 - DNA, 25 bp, Mus musculus
ttctgcaaatctctcttccccgtgg

SEQ ID NO: 153738 - DNA, 25 bp, Mus musculus
ttctgcaacttctctctaactcaca

SEQ ID NO: 153739 - DNA, 25 bp, Mus musculus
ttctgcacaccgagatggtggcgga

SEQ ID NO: 153740 - DNA, 25 bp, Mus musculus
ttctgcacgagataccacttaccca

SEQ ID NO: 153741 - DNA, 25 bp, Mus musculus
ttctgcacggtatgagctgacactc

SEQ ID NO: 153742 - DNA, 25 bp, Mus musculus
ttctgcagagtcagcgcttcgggac

SEQ ID NO: 153743 - DNA, 25 bp, Mus musculus
ttctgcagcacgtggacagcagctt

SEQ ID NO: 153744 - DNA, 25 bp, Mus musculus
ttctgcagccagtacggtgcccgtc

SEQ ID NO: 153745 - DNA, 25 bp, Mus musculus
ttctgcaggatggacccagccctgt

SEQ ID NO: 153746 - DNA, 25 bp, Mus musculus
ttctgcaggtccctagtgatcccgc

SEQ ID NO: 153747 - DNA, 25 bp, Mus musculus
ttctgcatcagtgttatctcggcca

SEQ ID NO: 153748 - DNA, 25 bp, Mus musculus
ttctgccaaaacgagccatacaatt

SEQ ID NO: 153749 - DNA, 25 bp, Mus musculus
ttctgccaataacatgcgacgcctg

SEQ ID NO: 153750 - DNA, 25 bp, Mus musculus
ttctgccagggatgctgggccccaa

SEQ ID NO: 153751 - DNA, 25 bp, Mus musculus
ttctgccgccgtccctatgaaaggg

SEQ ID NO: 153752 - DNA, 25 bp, Mus musculus
ttctgcggctgcgaaggctccgcgt

SEQ ID NO: 153753 - DNA, 25 bp, Mus musculus
ttctgcgtgctgttccttctggtct

SEQ ID NO: 153754 - DNA, 25 bp, Mus musculus
ttctgcgttgacaatggagccatga

SEQ ID NO: 153755 - DNA, 25 bp, Mus musculus
ttctgcgttttctgaagtttcctcc

SEQ ID NO: 153756 - DNA, 25 bp, Mus musculus
ttctgctcaagatggtggcgtcccg

SEQ ID NO: 153757 - DNA, 25 bp, Mus musculus
ttctgctgcacgaggagaatgggct

SEQ ID NO: 153758 - DNA, 25 bp, Mus musculus
ttctgctgcgggagactgtcaatca

SEQ ID NO: 153759 - DNA, 25 bp, Mus musculus
ttctgctggaccgagtgagctgcct

SEQ ID NO: 153760 - DNA, 25 bp, Mus musculus
ttctgctggatgtctcaggcgcctg

SEQ ID NO: 153761 - DNA, 25 bp, Mus musculus
ttctggaaaacaactacacggccct

SEQ ID NO: 153762 - DNA, 25 bp, Mus musculus
ttctggaaaacatggaagggccgct

SEQ ID NO: 153763 - DNA, 25 bp, Mus musculus
ttctggaaagtgagcctccccatac

SEQ ID NO: 153764 - DNA, 25 bp, Mus musculus
ttctggaagtcgatcgaggagtcgc

SEQ ID NO: 153765 - DNA, 25 bp, Mus musculus
ttctggaattctgccgccaggcggc

SEQ ID NO: 153766 - DNA, 25 bp, Mus musculus
ttctggacggcaaggctaaactcac

SEQ ID NO: 153767 - DNA, 25 bp, Mus musculus
ttctggagacatcgcaaacaagctg

SEQ ID NO: 153768 - DNA, 25 bp, Mus musculus
ttctggaggatcacaaaccacggag

SEQ ID NO: 153769 - DNA, 25 bp, Mus musculus
ttctggataccaacaaagactgcga

SEQ ID NO: 153770 - DNA, 25 bp, Mus musculus
ttctggatgaaatcaccctgtgccg

SEQ ID NO: 153771 - DNA, 25 bp, Mus musculus
ttctggattgggaaagccatccctc

SEQ ID NO: 153772 - DNA, 25 bp, Mus musculus
ttctggcaagaagtcaatggcagcg

SEQ ID NO: 153773 - DNA, 25 bp, Mus musculus
ttctggcattctcccaggaagatgc

SEQ ID NO: 153774 - DNA, 25 bp, Mus musculus
ttctggcccctgtgacagttccaat

SEQ ID NO: 153775 - DNA, 25 bp, Mus musculus
ttctggcccgcagaaagggaaggaa

SEQ ID NO: 153776 - DNA, 25 bp, Mus musculus
ttctggcctccgaagggtttgtgct

SEQ ID NO: 153777 - DNA, 25 bp, Mus musculus
ttctggcctggagaaggaccctgga

SEQ ID NO: 153778 - DNA, 25 bp, Mus musculus
ttctggcctggatccccttggtgag

SEQ ID NO: 153779 - DNA, 25 bp, Mus musculus
ttctggcgagaacctagcagcctgg

SEQ ID NO: 153780 - DNA, 25 bp, Mus musculus
ttctggcggtcactgcctgttggca

SEQ ID NO: 153781 - DNA, 25 bp, Mus musculus
ttctggctcgaaaataaggatgtca

SEQ ID NO: 153782 - DNA, 25 bp, Mus musculus
ttctgggaacgcgaacgcagacagc

SEQ ID NO: 153783 - DNA, 25 bp, Mus musculus
ttctgggacatcaaaaaccggctgc

SEQ ID NO: 153784 - DNA, 25 bp, Mus musculus
ttctgggacttcctgcataagtgca

SEQ ID NO: 153785 - DNA, 25 bp, Mus musculus
ttctgggataactcaaaggagcggt

SEQ ID NO: 153786 - DNA, 25 bp, Mus musculus
ttctgggtacagagcggctacagca

SEQ ID NO: 153787 - DNA, 25 bp, Mus musculus
ttctggtcctcagctgtctcctcac

SEQ ID NO: 153788 - DNA, 25 bp, Mus musculus
ttctggtggacacagaggccatcat

SEQ ID NO: 153789 - DNA, 25 bp, Mus musculus
ttctggtgtccctccttcgggcagc

SEQ ID NO: 153790 - DNA, 25 bp, Mus musculus
ttctggttccctcgcagccatcgtg

SEQ ID NO: 153791 - DNA, 25 bp, Mus musculus
ttctgtacttcctgcctggcacctg

SEQ ID NO: 153792 - DNA, 25 bp, Mus musculus
ttctgtaggctccagaggacacgag

SEQ ID NO: 153793 - DNA, 25 bp, Mus musculus
ttctgtcacagttccaacaacgtga

SEQ ID NO: 153794 - DNA, 25 bp, Mus musculus
ttctgtcaccatgagtgcacttctg

SEQ ID NO: 153795 - DNA, 25 bp, Mus musculus
ttctgtcaggaaccaagctgctgct

SEQ ID NO: 153796 - DNA, 25 bp, Mus musculus
ttctgtccggagaagcatctcgcct

SEQ ID NO: 153797 - DNA, 25 bp, Mus musculus
ttctgtccttggagtcggagcccta

SEQ ID NO: 153798 - DNA, 25 bp, Mus musculus
ttctgtgaaacatggcggtcggctg

SEQ ID NO: 153799 - DNA, 25 bp, Mus musculus
ttctgtgaacagtcgggccagaagg

SEQ ID NO: 153800 - DNA, 25 bp, Mus musculus
ttctgtgaagatggacggctgatag

SEQ ID NO: 153801 - DNA, 25 bp, Mus musculus
ttctgtgactccagagggaggacca

SEQ ID NO: 153802 - DNA, 25 bp, Mus musculus
ttctgtgctgaccttctgcgccatg

SEQ ID NO: 153803 - DNA, 25 bp, Mus musculus
ttctgtggagaatcttcaagagaaa

SEQ ID NO: 153804 - DNA, 25 bp, Mus musculus
ttctgtggcgttcaaacctgcgggc

SEQ ID NO: 153805 - DNA, 25 bp, Mus musculus
ttctgtgggaccctgcaaagcgcac

SEQ ID NO: 153806 - DNA, 25 bp, Mus musculus
ttctgtgtaacttctcttctggatc

SEQ ID NO: 153807 - DNA, 25 bp, Mus musculus
ttctgtgttctttggaggcctctcc

SEQ ID NO: 153808 - DNA, 25 bp, Mus musculus
ttctgttagcgatgccgttaggcca

SEQ ID NO: 153809 - DNA, 25 bp, Mus musculus
ttctgttcactagctctggaggagg

SEQ ID NO: 153810 - DNA, 25 bp, Mus musculus
ttctgttcagaagatggcagcgtcg

SEQ ID NO: 153811 - DNA, 25 bp, Mus musculus
ttctgttccaagctgaaacacctgg

SEQ ID NO: 153812 - DNA, 25 bp, Mus musculus
ttctgttctagctggagggtcccca

SEQ ID NO: 153813 - DNA, 25 bp, Mus musculus
ttctgtttgagaaggcggctcctcc

SEQ ID NO: 153814 - DNA, 25 bp, Mus musculus
ttcttaaagacaccacagtgacggg

SEQ ID NO: 153815 - DNA, 25 bp, Mus musculus
ttcttaaagatagttgggaagcatc

SEQ ID NO: 153816 - DNA, 25 bp, Mus musculus
ttcttaaaggccagagtggactgcg

SEQ ID NO: 153817 - DNA, 25 bp, Mus musculus
ttcttaagcaggcatcgcgtggtcc

SEQ ID NO: 153818 - DNA, 25 bp, Mus musculus
ttcttacaggcaaaactcaaggaga

SEQ ID NO: 153819 - DNA, 25 bp, Mus musculus
ttcttaccggcaacgtggacaggct

SEQ ID NO: 153820 - DNA, 25 bp, Mus musculus
ttcttaggcttgactccatcgggag

SEQ ID NO: 153821 - DNA, 25 bp, Mus musculus
ttcttagtacttgcccaaggtgggc

SEQ ID NO: 153822 - DNA, 25 bp, Mus musculus
ttcttataaatatagccaggtggtc

SEQ ID NO: 153823 - DNA, 25 bp, Mus musculus
ttcttattcggaagagctctggcca

SEQ ID NO: 153824 - DNA, 25 bp, Mus musculus
ttcttcagaaaccacgagcagccag

SEQ ID NO: 153825 - DNA, 25 bp, Mus musculus
ttcttcagagaatcccctgtcggcc

SEQ ID NO: 153826 - DNA, 25 bp, Mus musculus
ttcttcaggctgtcaagcacgggag

SEQ ID NO: 153827 - DNA, 25 bp, Mus musculus
ttcttccaagaaggagccaaggtgg

SEQ ID NO: 153828 - DNA, 25 bp, Mus musculus
ttcttccacctttgagtgattgtta

SEQ ID NO: 153829 - DNA, 25 bp, Mus musculus
ttcttcccaggagcagttacggctg

SEQ ID NO: 153830 - DNA, 25 bp, Mus musculus
ttcttccctggcgagttagaagctg

SEQ ID NO: 153831 - DNA, 25 bp, Mus musculus
ttcttccgatcagaaccaaagtggg

SEQ ID NO: 153832 - DNA, 25 bp, Mus musculus
ttcttcctggaactcgggcgctcag

SEQ ID NO: 153833 - DNA, 25 bp, Mus musculus
ttcttcgaggttccggacaggacct

SEQ ID NO: 153834 - DNA, 25 bp, Mus musculus
ttcttcgggaatgtcaatgactcgg

SEQ ID NO: 153835 - DNA, 25 bp, Mus musculus
ttcttcgtggatggacagtggaccc

SEQ ID NO: 153836 - DNA, 25 bp, Mus musculus
ttcttcttcatcaagccaaactatc

SEQ ID NO: 153837 - DNA, 25 bp, Mus musculus
ttcttgaaaaggctccaggcttcgg

SEQ ID NO: 153838 - DNA, 25 bp, Mus musculus
ttcttgaaccgggaatatgagtcct

SEQ ID NO: 153839 - DNA, 25 bp, Mus musculus
ttcttgaagccaataaaggagccgc

SEQ ID NO: 153840 - DNA, 25 bp, Mus musculus
ttcttgacaagctcctgcggtacga

SEQ ID NO: 153841 - DNA, 25 bp, Mus musculus
ttcttgaccggatacagcctggacc

SEQ ID NO: 153842 - DNA, 25 bp, Mus musculus
ttcttgatggctgtccagggaggcc

SEQ ID NO: 153843 - DNA, 25 bp, Mus musculus
ttcttgcacaaggactcggctgacc

SEQ ID NO: 153844 - DNA, 25 bp, Mus musculus
ttcttgctgcggtcggtggcaccac

SEQ ID NO: 153845 - DNA, 25 bp, Mus musculus
ttcttggaaatcctctgaccccagg

SEQ ID NO: 153846 - DNA, 25 bp, Mus musculus
ttcttggaatgccaggaaacacggg

SEQ ID NO: 153847 - DNA, 25 bp, Mus musculus
ttcttggacactgaggaggccgagc

SEQ ID NO: 153848 - DNA, 25 bp, Mus musculus
ttcttggacctcgagcagagcggga

SEQ ID NO: 153849 - DNA, 25 bp, Mus musculus
ttcttggacgggagctgaaccctcg

SEQ ID NO: 153850 - DNA, 25 bp, Mus musculus
ttcttggagaaacgtggatgcccac

SEQ ID NO: 153851 - DNA, 25 bp, Mus musculus
ttcttggaggaagggacatgcagcc

SEQ ID NO: 153852 - DNA, 25 bp, Mus musculus
ttcttggtacgccagagtgagacaa

SEQ ID NO: 153853 - DNA, 25 bp, Mus musculus
ttcttgtcacctggatcagcaatcc

SEQ ID NO: 153854 - DNA, 25 bp, Mus musculus
ttcttgtcccgtccctaggtccttg

SEQ ID NO: 153855 - DNA, 25 bp, Mus musculus
ttctttagatcctaagtgcgagtag

SEQ ID NO: 153856 - DNA, 25 bp, Mus musculus
ttctttataagcaaccaccttgagc

SEQ ID NO: 153857 - DNA, 25 bp, Mus musculus
ttctttcggacagtgaaaagaggcc

SEQ ID NO: 153858 - DNA, 25 bp, Mus musculus
ttctttctgcacagcagggcactgg

SEQ ID NO: 153859 - DNA, 25 bp, Mus musculus
ttctttgagcgcacgccagtcggga

SEQ ID NO: 153860 - DNA, 25 bp, Mus musculus
ttctttgagcgtacacccagtggga

SEQ ID NO: 153861 - DNA, 25 bp, Mus musculus
ttctttgctggcctgacccctgagg

SEQ ID NO: 153862 - DNA, 25 bp, Mus musculus
ttctttggcgcttggaaatccctgg

SEQ ID NO: 153863 - DNA, 25 bp, Mus musculus
ttctttgtgcacagcgtggcagccg

SEQ ID NO: 153864 - DNA, 25 bp, Mus musculus
ttctttgttctgtgtggtgacctcg

SEQ ID NO: 153865 - DNA, 25 bp, Mus musculus
ttgaaaaaacggatggaagtaccag

SEQ ID NO: 153866 - DNA, 25 bp, Mus musculus
ttgaaaaaagcatgcacctcggccg

SEQ ID NO: 153867 - DNA, 25 bp, Mus musculus
ttgaaaaaccctttggccatgacca

SEQ ID NO: 153868 - DNA, 25 bp, Mus musculus
ttgaaaaaggcaattgtcagtaaca

SEQ ID NO: 153869 - DNA, 25 bp, Mus musculus
ttgaaaacatagatgcctgcttgaa

SEQ ID NO: 153870 - DNA, 25 bp, Mus musculus
ttgaaaacctcctggcatctgatgg

SEQ ID NO: 153871 - DNA, 25 bp, Mus musculus
ttgaaacagtggtcacaggatccct

SEQ ID NO: 153872 - DNA, 25 bp, Mus musculus
ttgaaagacaatgtaaccagggcac

SEQ ID NO: 153873 - DNA, 25 bp, Mus musculus
ttgaaagccagagccaatgctgcct

SEQ ID NO: 153874 - DNA, 25 bp, Mus musculus
ttgaaaggctcgagctacagtggac

SEQ ID NO: 153875 - DNA, 25 bp, Mus musculus
ttgaaaggcttgcacagaaacaggc

SEQ ID NO: 153876 - DNA, 25 bp, Mus musculus
ttgaaagtgacttcctggctgtgct

SEQ ID NO: 153877 - DNA, 25 bp, Mus musculus
ttgaaagtggagtcgcctgtccctg

SEQ ID NO: 153878 - DNA, 25 bp, Mus musculus
ttgaaatacaacaccgagcgcatcc

SEQ ID NO: 153879 - DNA, 25 bp, Mus musculus
ttgaaatggctagggttctctgtaa

SEQ ID NO: 153880 - DNA, 25 bp, Mus musculus
ttgaacaagcgcaagcgagaggccc

SEQ ID NO: 153881 - DNA, 25 bp, Mus musculus
ttgaacaagtcagtggtgccccagt

SEQ ID NO: 153882 - DNA, 25 bp, Mus musculus
ttgaacaatcacatccttaacaggg

SEQ ID NO: 153883 - DNA, 25 bp, Mus musculus
ttgaacagatcgaagcaggaacacc

SEQ ID NO: 153884 - DNA, 25 bp, Mus musculus
ttgaacaggacaggccgaagcattg

SEQ ID NO: 153885 - DNA, 25 bp, Mus musculus
ttgaacatgggcaagcggtgtcctt

SEQ ID NO: 153886 - DNA, 25 bp, Mus musculus
ttgaaccagcctgcaaaccagagtg

SEQ ID NO: 153887 - DNA, 25 bp, Mus musculus
ttgaaccagtatggctgaccctcgc

SEQ ID NO: 153888 - DNA, 25 bp, Mus musculus
ttgaacccatgtacggtcgccagac

SEQ ID NO: 153889 - DNA, 25 bp, Mus musculus
ttgaaccccttggaggactggctgc

SEQ ID NO: 153890 - DNA, 25 bp, Mus musculus
ttgaaccggtcctccaagcgggaat

SEQ ID NO: 153891 - DNA, 25 bp, Mus musculus
ttgaacctcctggaagcaagagtgt

SEQ ID NO: 153892 - DNA, 25 bp, Mus musculus
ttgaacgacagcatgccaagaaccg

SEQ ID NO: 153893 - DNA, 25 bp, Mus musculus
ttgaacgcccttcccctaggtggct

SEQ ID NO: 153894 - DNA, 25 bp, Mus musculus
ttgaacgtaaaggtgctggaagccc

SEQ ID NO: 153895 - DNA, 25 bp, Mus musculus
ttgaactagagaagtccgtccgggc

SEQ ID NO: 153896 - DNA, 25 bp, Mus musculus
ttgaactcattgaagagccctccgg

SEQ ID NO: 153897 - DNA, 25 bp, Mus musculus
ttgaactgggactacctggagcgct

SEQ ID NO: 153898 - DNA, 25 bp, Mus musculus
ttgaacttcccagcactctaaaggg

SEQ ID NO: 153899 - DNA, 25 bp, Mus musculus
ttgaactttccacctgaggactgtg

SEQ ID NO: 153900 - DNA, 25 bp, Mus musculus
ttgaagaaaccgttaaagaaatgat

SEQ ID NO: 153901 - DNA, 25 bp, Mus musculus
ttgaagaaattgaggtgtcccctcc

SEQ ID NO: 153902 - DNA, 25 bp, Mus musculus
ttgaagaacgggacaaaaggccgcg

SEQ ID NO: 153903 - DNA, 25 bp, Mus musculus
ttgaagaacttgaaaagacctatcg

SEQ ID NO: 153904 - DNA, 25 bp, Mus musculus
ttgaagaagttatccggcaggctgg

SEQ ID NO: 153905 - DNA, 25 bp, Mus musculus
ttgaagaccctccatgtgtgcgtgt

SEQ ID NO: 153906 - DNA, 25 bp, Mus musculus
ttgaagagaagagccgaagtactca

SEQ ID NO: 153907 - DNA, 25 bp, Mus musculus
ttgaagagatcctagcagccagagg

SEQ ID NO: 153908 - DNA, 25 bp, Mus musculus
ttgaagagggctccaaaggtgggaa

SEQ ID NO: 153909 - DNA, 25 bp, Mus musculus
ttgaagagttctcagcgccaccagg

SEQ ID NO: 153910 - DNA, 25 bp, Mus musculus
ttgaagatgcagtcctgtcgcctgg

SEQ ID NO: 153911 - DNA, 25 bp, Mus musculus
ttgaagcacctcagcacggactgga

SEQ ID NO: 153912 - DNA, 25 bp, Mus musculus
ttgaagcactacacgacaccgagat

SEQ ID NO: 153913 - DNA, 25 bp, Mus musculus
ttgaagcagcttgcgcaaaagaccg

SEQ ID NO: 153914 - DNA, 25 bp, Mus musculus
ttgaagccatccgaggaagacttgg

SEQ ID NO: 153915 - DNA, 25 bp, Mus musculus
ttgaagccggcaaagcctacgtcac

SEQ ID NO: 153916 - DNA, 25 bp, Mus musculus
ttgaagccgtcgaactgaatcctgg

SEQ ID NO: 153917 - DNA, 25 bp, Mus musculus
ttgaagcctagtgccgcgcgatggc

SEQ ID NO: 153918 - DNA, 25 bp, Mus musculus
ttgaagccttctctgatagcatcag

SEQ ID NO: 153919 - DNA, 25 bp, Mus musculus
ttgaagctaacacacatacctgatg

SEQ ID NO: 153920 - DNA, 25 bp, Mus musculus
ttgaagctgcctctccgttgccatg

SEQ ID NO: 153921 - DNA, 25 bp, Mus musculus
ttgaagctggaactcagtgaagccc

SEQ ID NO: 153922 - DNA, 25 bp, Mus musculus
ttgaagcttttacgccaggaatctg

SEQ ID NO: 153923 - DNA, 25 bp, Mus musculus
ttgaagcttttgatctggagacccg

SEQ ID NO: 153924 - DNA, 25 bp, Mus musculus
ttgaaggaaatctccagcacgctgg

SEQ ID NO: 153925 - DNA, 25 bp, Mus musculus
ttgaaggcaaatggcgtgcaagcac

SEQ ID NO: 153926 - DNA, 25 bp, Mus musculus
ttgaaggcctgaccgtacggcagct

SEQ ID NO: 153927 - DNA, 25 bp, Mus musculus
ttgaaggctgctcccataagaccat

SEQ ID NO: 153928 - DNA, 25 bp, Mus musculus
ttgaagggcatcaacgcagacgacg

SEQ ID NO: 153929 - DNA, 25 bp, Mus musculus
ttgaagtcagtggtaccatagtgac

SEQ ID NO: 153930 - DNA, 25 bp, Mus musculus
ttgaagtccaagtaaacagtaaatg

SEQ ID NO: 153931 - DNA, 25 bp, Mus musculus
ttgaagtgagccttgtcccgtgcct

SEQ ID NO: 153932 - DNA, 25 bp, Mus musculus
ttgaataagaagaatggtggtggtt

SEQ ID NO: 153933 - DNA, 25 bp, Mus musculus
ttgaatccatcggagaggctacccc

SEQ ID NO: 153934 - DNA, 25 bp, Mus musculus
ttgaatcctgtacccgaggaaccct

SEQ ID NO: 153935 - DNA, 25 bp, Mus musculus
ttgaatctcaatctgcctgcgcggc

SEQ ID NO: 153936 - DNA, 25 bp, Mus musculus
ttgaatgactcaaacaggctgctgg

SEQ ID NO: 153937 - DNA, 25 bp, Mus musculus
ttgaatgagtcagcctgtcacctgt

SEQ ID NO: 153938 - DNA, 25 bp, Mus musculus
ttgaatgccccgagaactatcgccg

SEQ ID NO: 153939 - DNA, 25 bp, Mus musculus
ttgaatgccttccaggatagccctg

SEQ ID NO: 153940 - DNA, 25 bp, Mus musculus
ttgaattagcaaccggagcagcgcc

SEQ ID NO: 153941 - DNA, 25 bp, Mus musculus
ttgacaaaaggaacgccaaggccct

SEQ ID NO: 153942 - DNA, 25 bp, Mus musculus
ttgacaaagggtgcgaagcctgcca

SEQ ID NO: 153943 - DNA, 25 bp, Mus musculus
ttgacaacaaaactatcgagctgag

SEQ ID NO: 153944 - DNA, 25 bp, Mus musculus
ttgacaacctgcatgaggacccctg

SEQ ID NO: 153945 - DNA, 25 bp, Mus musculus
ttgacaacctggaggacgaagagca

SEQ ID NO: 153946 - DNA, 25 bp, Mus musculus
ttgacaacggctaaagaaccatggg

SEQ ID NO: 153947 - DNA, 25 bp, Mus musculus
ttgacaagatgtagtgcgacagcac

SEQ ID NO: 153948 - DNA, 25 bp, Mus musculus
ttgacaagcaataaccgcggagcgc

SEQ ID NO: 153949 - DNA, 25 bp, Mus musculus
ttgacaaggccctggcaagcatgga

SEQ ID NO: 153950 - DNA, 25 bp, Mus musculus
ttgacaattactggccaatgagcag

SEQ ID NO: 153951 - DNA, 25 bp, Mus musculus
ttgacacaatggaagaccatgctgg

SEQ ID NO: 153952 - DNA, 25 bp, Mus musculus
ttgacaccggctatggcatcctgga

SEQ ID NO: 153953 - DNA, 25 bp, Mus musculus
ttgacacgctcatgaccaaatggag

SEQ ID NO: 153954 - DNA, 25 bp, Mus musculus
ttgacacgctgctcctgagtgacga

SEQ ID NO: 153955 - DNA, 25 bp, Mus musculus
ttgacacgtacctgctcatcagtga

SEQ ID NO: 153956 - DNA, 25 bp, Mus musculus
ttgacactaaaggagctggaactgg

SEQ ID NO: 153957 - DNA, 25 bp, Mus musculus
ttgacactgaccaggacggctacat

SEQ ID NO: 153958 - DNA, 25 bp, Mus musculus
ttgacagaagagtcccaagcatccg

SEQ ID NO: 153959 - DNA, 25 bp, Mus musculus
ttgacagagaccttccggaatttgg

SEQ ID NO: 153960 - DNA, 25 bp, Mus musculus
ttgacagcgactagcggagtggcat

SEQ ID NO: 153961 - DNA, 25 bp, Mus musculus
ttgacagcttttcgcaagacatacg

SEQ ID NO: 153962 - DNA, 25 bp, Mus musculus
ttgacagtacgcaacgatgggtcct

SEQ ID NO: 153963 - DNA, 25 bp, Mus musculus
ttgacagtatcccagctaagcgcct

SEQ ID NO: 153964 - DNA, 25 bp, Mus musculus
ttgacagtgcatacctggccatgga

SEQ ID NO: 153965 - DNA, 25 bp, Mus musculus
ttgacagtgtacacgcaagagccca

SEQ ID NO: 153966 - DNA, 25 bp, Mus musculus
ttgacatactgatgctgctagcagc

SEQ ID NO: 153967 - DNA, 25 bp, Mus musculus
ttgacatcccaaagccagtcggtct

SEQ ID NO: 153968 - DNA, 25 bp, Mus musculus
ttgacatggctgtcaatgagatctt

SEQ ID NO: 153969 - DNA, 25 bp, Mus musculus
ttgacatggtacatcgtaacagctg

SEQ ID NO: 153970 - DNA, 25 bp, Mus musculus
ttgacattcggcagtacgtgcgcac

SEQ ID NO: 153971 - DNA, 25 bp, Mus musculus
ttgaccaaagaatcgaaggccctga

SEQ ID NO: 153972 - DNA, 25 bp, Mus musculus
ttgaccacgtcccaccagagtctgt

SEQ ID NO: 153973 - DNA, 25 bp, Mus musculus
ttgaccactggaaagaccgctacct

SEQ ID NO: 153974 - DNA, 25 bp, Mus musculus
ttgaccaggcccacaggcagaatgt

SEQ ID NO: 153975 - DNA, 25 bp, Mus musculus
ttgaccagggccagtttgccaagga

SEQ ID NO: 153976 - DNA, 25 bp, Mus musculus
ttgaccagtttactgaggaaagaag

SEQ ID NO: 153977 - DNA, 25 bp, Mus musculus
ttgacccagacaaaaggcccttctg

SEQ ID NO: 153978 - DNA, 25 bp, Mus musculus
ttgacccgcatggttggtgctgcat

SEQ ID NO: 153979 - DNA, 25 bp, Mus musculus
ttgacccggtgaggaccaagaagct

SEQ ID NO: 153980 - DNA, 25 bp, Mus musculus
ttgaccctgggccttttggacacag

SEQ ID NO: 153981 - DNA, 25 bp, Mus musculus
ttgaccggcagagaagggtgctcca

SEQ ID NO: 153982 - DNA, 25 bp, Mus musculus
ttgacctcacagacaaacacaggga

SEQ ID NO: 153983 - DNA, 25 bp, Mus musculus
ttgaccttactaacatgggagcctg

SEQ ID NO: 153984 - DNA, 25 bp, Mus musculus
ttgacgaaagggacaatcctctggg

SEQ ID NO: 153985 - DNA, 25 bp, Mus musculus
ttgacgacgcggattcctcagacag

SEQ ID NO: 153986 - DNA, 25 bp, Mus musculus
ttgacgatgaagaaattgagcggcg

SEQ ID NO: 153987 - DNA, 25 bp, Mus musculus
ttgacgcagacacccatggtcgcat

SEQ ID NO: 153988 - DNA, 25 bp, Mus musculus
ttgacgcaggcagctcgaaggtgac

SEQ ID NO: 153989 - DNA, 25 bp, Mus musculus
ttgacgcagtgaccacgaatcctgg

SEQ ID NO: 153990 - DNA, 25 bp, Mus musculus
ttgacgcgagcggtcaagcagcgaa

SEQ ID NO: 153991 - DNA, 25 bp, Mus musculus
ttgacgcgtcatggacaggccagtg

SEQ ID NO: 153992 - DNA, 25 bp, Mus musculus
ttgacgggtccagagcagtaccgag

SEQ ID NO: 153993 - DNA, 25 bp, Mus musculus
ttgacgtacgcggtcgagacgtgcc

SEQ ID NO: 153994 - DNA, 25 bp, Mus musculus
ttgacgtgggcctgtccaactggag

SEQ ID NO: 153995 - DNA, 25 bp, Mus musculus
ttgactatggaccttgtgacccgcc

SEQ ID NO: 153996 - DNA, 25 bp, Mus musculus
ttgactcagatatcagcggcaccct

SEQ ID NO: 153997 - DNA, 25 bp, Mus musculus
ttgactctgaggacagtaaacttcg

SEQ ID NO: 153998 - DNA, 25 bp, Mus musculus
ttgactgaaaatcagccggcgcttg

SEQ ID NO: 153999 - DNA, 25 bp, Mus musculus
ttgactgacagctgctccgccgtgc

SEQ ID NO: 154000 - DNA, 25 bp, Mus musculus
ttgactggcgtccatcaggtgccca

SEQ ID NO: 154001 - DNA, 25 bp, Mus musculus
ttgactgtgcagctctttgcattcc

SEQ ID NO: 154002 - DNA, 25 bp, Mus musculus
ttgactgtggataagaatggactac

SEQ ID NO: 154003 - DNA, 25 bp, Mus musculus
ttgacttgagtcacacgctgccggg

SEQ ID NO: 154004 - DNA, 25 bp, Mus musculus
ttgacttggacaaccagtctgtggg

SEQ ID NO: 154005 - DNA, 25 bp, Mus musculus
ttgactttgacagagaatgaccctg

SEQ ID NO: 154006 - DNA, 25 bp, Mus musculus
ttgagaaatggcatgtaacgcaccc

SEQ ID NO: 154007 - DNA, 25 bp, Mus musculus
ttgagaacacctctgaaccttacgg

SEQ ID NO: 154008 - DNA, 25 bp, Mus musculus
ttgagaaccccgacacgggctctgt

SEQ ID NO: 154009 - DNA, 25 bp, Mus musculus
ttgagaagcagtttcacccagcggg

SEQ ID NO: 154010 - DNA, 25 bp, Mus musculus
ttgagaatgacagaaataacctgcg

SEQ ID NO: 154011 - DNA, 25 bp, Mus musculus
ttgagaatggccgagcactggtcga

SEQ ID NO: 154012 - DNA, 25 bp, Mus musculus
ttgagacatactgtgtgaccctggc

SEQ ID NO: 154013 - DNA, 25 bp, Mus musculus
ttgagacccaggtgagtaccagccg

SEQ ID NO: 154014 - DNA, 25 bp, Mus musculus
ttgagacccatcaaagcaagatgag

SEQ ID NO: 154015 - DNA, 25 bp, Mus musculus
ttgagacggcgctgcccaggattcc

SEQ ID NO: 154016 - DNA, 25 bp, Mus musculus
ttgagacgttgaggcaaggctaccc

SEQ ID NO: 154017 - DNA, 25 bp, Mus musculus
ttgagagccgctatcctaagctccc

SEQ ID NO: 154018 - DNA, 25 bp, Mus musculus
ttgagaggccgctgccaaaatgcca

SEQ ID NO: 154019 - DNA, 25 bp, Mus musculus
ttgagagggcagagaaattccggca

SEQ ID NO: 154020 - DNA, 25 bp, Mus musculus
ttgagagtctccgtttgccccaggt

SEQ ID NO: 154021 - DNA, 25 bp, Mus musculus
ttgagatggtatcaacatccttccg

SEQ ID NO: 154022 - DNA, 25 bp, Mus musculus
ttgagattccctcctcgaaagcgcc

SEQ ID NO: 154023 - DNA, 25 bp, Mus musculus
ttgagcaacagcagataacagacgc

SEQ ID NO: 154024 - DNA, 25 bp, Mus musculus
ttgagcaccagaaggagtattcagc

SEQ ID NO: 154025 - DNA, 25 bp, Mus musculus
ttgagcagagctacaaccctcggtt

SEQ ID NO: 154026 - DNA, 25 bp, Mus musculus
ttgagccaagccgtaccaaggcaca

SEQ ID NO: 154027 - DNA, 25 bp, Mus musculus
ttgagccacacaaccgacatgcaga

SEQ ID NO: 154028 - DNA, 25 bp, Mus musculus
ttgagccccttgttaaccagagatt

SEQ ID NO: 154029 - DNA, 25 bp, Mus musculus
ttgagccgcctaacactggatgaca

SEQ ID NO: 154030 - DNA, 25 bp, Mus musculus
ttgagcgcaaacaggcacagatccg

SEQ ID NO: 154031 - DNA, 25 bp, Mus musculus
ttgagcgcctcaaagccaacgatgg

SEQ ID NO: 154032 - DNA, 25 bp, Mus musculus
ttgagctggcacataaaactacgag

SEQ ID NO: 154033 - DNA, 25 bp, Mus musculus
ttgagctgtccacctttgatatcgc

SEQ ID NO: 154034 - DNA, 25 bp, Mus musculus
ttgagcttctggaactatgcccgcc

SEQ ID NO: 154035 - DNA, 25 bp, Mus musculus
ttgaggaaaccacaccaagtggccg

SEQ ID NO: 154036 - DNA, 25 bp, Mus musculus
ttgaggaactcaacgtcactcggcc

SEQ ID NO: 154037 - DNA, 25 bp, Mus musculus
ttgaggacctcctaatgcgggacgg

SEQ ID NO: 154038 - DNA, 25 bp, Mus musculus
ttgaggactatagaggaggccagcc

SEQ ID NO: 154039 - DNA, 25 bp, Mus musculus
ttgaggagcccacattcaatgtgtc

SEQ ID NO: 154040 - DNA, 25 bp, Mus musculus
ttgaggagggcttcaacccggtgca

SEQ ID NO: 154041 - DNA, 25 bp, Mus musculus
ttgaggagtatatcagcaagcaagc

SEQ ID NO: 154042 - DNA, 25 bp, Mus musculus
ttgaggatgtacaggaggagaccca

SEQ ID NO: 154043 - DNA, 25 bp, Mus musculus
ttgaggcagcactaagccgaatgcc

SEQ ID NO: 154044 - DNA, 25 bp, Mus musculus
ttgaggcagttacctatgcggccca

SEQ ID NO: 154045 - DNA, 25 bp, Mus musculus
ttgaggccatcaacaagctgaaccc

SEQ ID NO: 154046 - DNA, 25 bp, Mus musculus
ttgaggcctggaagggttaaatgaa

SEQ ID NO: 154047 - DNA, 25 bp, Mus musculus
ttgagggagtccactgaaggcagca

SEQ ID NO: 154048 - DNA, 25 bp, Mus musculus
ttgagggtgctaatggacagccccg

SEQ ID NO: 154049 - DNA, 25 bp, Mus musculus
ttgaggtgtataaggcccgaagcca

SEQ ID NO: 154050 - DNA, 25 bp, Mus musculus
ttgaggtgtggctcaggacagacct

SEQ ID NO: 154051 - DNA, 25 bp, Mus musculus
ttgaggttgcttcacccgctgacca

SEQ ID NO: 154052 - DNA, 25 bp, Mus musculus
ttgaggtttccagctcgagccagaa

SEQ ID NO: 154053 - DNA, 25 bp, Mus musculus
ttgagtaccatcttcgccaagtggg

SEQ ID NO: 154054 - DNA, 25 bp, Mus musculus
ttgagtaccctattgaacccagtgg

SEQ ID NO: 154055 - DNA, 25 bp, Mus musculus
ttgagtcaactcaggatccgggcag

SEQ ID NO: 154056 - DNA, 25 bp, Mus musculus
ttgagtcatagttcttcctctcagc

SEQ ID NO: 154057 - DNA, 25 bp, Mus musculus
ttgagtctgagttctcccaggagca

SEQ ID NO: 154058 - DNA, 25 bp, Mus musculus
ttgagtgactgcacaaccctgggac

SEQ ID NO: 154059 - DNA, 25 bp, Mus musculus
ttgagtgtgagctgatgtacgcccc

SEQ ID NO: 154060 - DNA, 25 bp, Mus musculus
ttgagttcccgaaccacagactcct

SEQ ID NO: 154061 - DNA, 25 bp, Mus musculus
ttgagtttattgagcaagcaaaact

SEQ ID NO: 154062 - DNA, 25 bp, Mus musculus
ttgataacacgcctgcagccttgga

SEQ ID NO: 154063 - DNA, 25 bp, Mus musculus
ttgataaccagagagaaacccgctg

SEQ ID NO: 154064 - DNA, 25 bp, Mus musculus
ttgataagcccaagacgaacagagg

SEQ ID NO: 154065 - DNA, 25 bp, Mus musculus
ttgataaggacgaggccaaggctga

SEQ ID NO: 154066 - DNA, 25 bp, Mus musculus
ttgatatgccaagcagagggcagaa

SEQ ID NO: 154067 - DNA, 25 bp, Mus musculus
ttgatatggaaaggaagaatgaccc

SEQ ID NO: 154068 - DNA, 25 bp, Mus musculus
ttgatcagacaaatacagaccgctg

SEQ ID NO: 154069 - DNA, 25 bp, Mus musculus
ttgatccgcagacccaagttacaag

SEQ ID NO: 154070 - DNA, 25 bp, Mus musculus
ttgatccgcctcttttcccgagatg

SEQ ID NO: 154071 - DNA, 25 bp, Mus musculus
ttgatccttagagaacatgcccacg

SEQ ID NO: 154072 - DNA, 25 bp, Mus musculus
ttgatcgccccgaagaaggaggcct

SEQ ID NO: 154073 - DNA, 25 bp, Mus musculus
ttgatcgtcaggcagagattacccg

SEQ ID NO: 154074 - DNA, 25 bp, Mus musculus
ttgatctgagcctggacaacagccc

SEQ ID NO: 154075 - DNA, 25 bp, Mus musculus
ttgatctggatagaggaagaaaagc

SEQ ID NO: 154076 - DNA, 25 bp, Mus musculus
ttgatgaagagacgaccaacggcga

SEQ ID NO: 154077 - DNA, 25 bp, Mus musculus
ttgatgacagtccaagcactagtgg

SEQ ID NO: 154078 - DNA, 25 bp, Mus musculus
ttgatgaccgagacagtgactaccg

SEQ ID NO: 154079 - DNA, 25 bp, Mus musculus
ttgatgagacccgacctataggccc

SEQ ID NO: 154080 - DNA, 25 bp, Mus musculus
ttgatgatatcacagcagcgcgcct

SEQ ID NO: 154081 - DNA, 25 bp, Mus musculus
ttgatgccagacaaaacagcgttgc

SEQ ID NO: 154082 - DNA, 25 bp, Mus musculus
ttgatgctgaacactaatggtggca

SEQ ID NO: 154083 - DNA, 25 bp, Mus musculus
ttgatggtagtgacgcctcttgcgc

SEQ ID NO: 154084 - DNA, 25 bp, Mus musculus
ttgattatccagagcgtcgggccct

SEQ ID NO: 154085 - DNA, 25 bp, Mus musculus
ttgattgtactgcaagggcgagaca

SEQ ID NO: 154086 - DNA, 25 bp, Mus musculus
ttgattgtccttttaatacccaata

SEQ ID NO: 154087 - DNA, 25 bp, Mus musculus
ttgatttctgcacccaccatgactg

SEQ ID NO: 154088 - DNA, 25 bp, Mus musculus
ttgcaaagcgatacagcaccagcgg

SEQ ID NO: 154089 - DNA, 25 bp, Mus musculus
ttgcaacaagccgaatactcgtggt

SEQ ID NO: 154090 - DNA, 25 bp, Mus musculus
ttgcaactgcgctctcctccagaga

SEQ ID NO: 154091 - DNA, 25 bp, Mus musculus
ttgcaagcagctcgatgaagggacc

SEQ ID NO: 154092 - DNA, 25 bp, Mus musculus
ttgcaaggcgttttcagcaagcaga

SEQ ID NO: 154093 - DNA, 25 bp, Mus musculus
ttgcaaggctcctacatactgaggg

SEQ ID NO: 154094 - DNA, 25 bp, Mus musculus
ttgcaagtggctcaacaactgcgtg

SEQ ID NO: 154095 - DNA, 25 bp, Mus musculus
ttgcacaaaagaagctgacagggcc

SEQ ID NO: 154096 - DNA, 25 bp, Mus musculus
ttgcacaaggtgaagactggcccag

SEQ ID NO: 154097 - DNA, 25 bp, Mus musculus
ttgcacaccttcgagagagacctag

SEQ ID NO: 154098 - DNA, 25 bp, Mus musculus
ttgcacacggacaccatctggagac

SEQ ID NO: 154099 - DNA, 25 bp, Mus musculus
ttgcacagagggatgcatatgcccc

SEQ ID NO: 154100 - DNA, 25 bp, Mus musculus
ttgcaccagcgagatatcactattg

SEQ ID NO: 154101 - DNA, 25 bp, Mus musculus
ttgcacctcagcttcggaccaggag

SEQ ID NO: 154102 - DNA, 25 bp, Mus musculus
ttgcacgcagccacctaggaagatc

SEQ ID NO: 154103 - DNA, 25 bp, Mus musculus
ttgcacggaaatggcaggcagcatc

SEQ ID NO: 154104 - DNA, 25 bp, Mus musculus
ttgcactgggacaacaattttaaag

SEQ ID NO: 154105 - DNA, 25 bp, Mus musculus
ttgcagaactctgatcaagcgggtt

SEQ ID NO: 154106 - DNA, 25 bp, Mus musculus
ttgcagacagaaatcagagggagcc

SEQ ID NO: 154107 - DNA, 25 bp, Mus musculus
ttgcagacagcgacccggaacggcc

SEQ ID NO: 154108 - DNA, 25 bp, Mus musculus
ttgcagagacagttgaagacatggt

SEQ ID NO: 154109 - DNA, 25 bp, Mus musculus
ttgcagagcgaccagcacagtggac

SEQ ID NO: 154110 - DNA, 25 bp, Mus musculus
ttgcagaggactggccgaggaaact

SEQ ID NO: 154111 - DNA, 25 bp, Mus musculus
ttgcagagtgtaagccagtaggacc

SEQ ID NO: 154112 - DNA, 25 bp, Mus musculus
ttgcagcagagatgcgggaagccat

SEQ ID NO: 154113 - DNA, 25 bp, Mus musculus
ttgcagccactaggcagagcgtcgg

SEQ ID NO: 154114 - DNA, 25 bp, Mus musculus
ttgcagccccggaaatcattcttgg

SEQ ID NO: 154115 - DNA, 25 bp, Mus musculus
ttgcagcccctgtttctaatttaaa

SEQ ID NO: 154116 - DNA, 25 bp, Mus musculus
ttgcagcgtggaacacggccattgg

SEQ ID NO: 154117 - DNA, 25 bp, Mus musculus
ttgcagctcagaggagccggaagaa

SEQ ID NO: 154118 - DNA, 25 bp, Mus musculus
ttgcaggaaccctgaagttcaatcc

SEQ ID NO: 154119 - DNA, 25 bp, Mus musculus
ttgcaggcccatacgattcgaaccg

SEQ ID NO: 154120 - DNA, 25 bp, Mus musculus
ttgcaggtgagaagaagtcggccca

SEQ ID NO: 154121 - DNA, 25 bp, Mus musculus
ttgcagtcaccctgctgcggaggga

SEQ ID NO: 154122 - DNA, 25 bp, Mus musculus
ttgcatggctggtgcggaacagact

SEQ ID NO: 154123 - DNA, 25 bp, Mus musculus
ttgcattaaataaggacgggactcc

SEQ ID NO: 154124 - DNA, 25 bp, Mus musculus
ttgcatttatatcaccattgttgaa

SEQ ID NO: 154125 - DNA, 25 bp, Mus musculus
ttgcatttgcagcatggtgacatgg

SEQ ID NO: 154126 - DNA, 25 bp, Mus musculus
ttgcattttgaaccgcgcgactgtc

SEQ ID NO: 154127 - DNA, 25 bp, Mus musculus
ttgccaaaagaaaccctgaggcatg

SEQ ID NO: 154128 - DNA, 25 bp, Mus musculus
ttgccaaacttaggcaacagctaca

SEQ ID NO: 154129 - DNA, 25 bp, Mus musculus
ttgccaaagccgtgaagaactccgc

SEQ ID NO: 154130 - DNA, 25 bp, Mus musculus
ttgccaacaatacaagtgtggagcc

SEQ ID NO: 154131 - DNA, 25 bp, Mus musculus
ttgccaagaaactgaggaagccctt

SEQ ID NO: 154132 - DNA, 25 bp, Mus musculus
ttgccaagacaaggaagcctcacct

SEQ ID NO: 154133 - DNA, 25 bp, Mus musculus
ttgccaatggcttcacggagaccca

SEQ ID NO: 154134 - DNA, 25 bp, Mus musculus
ttgccaatgggctcctgggtgacca

SEQ ID NO: 154135 - DNA, 25 bp, Mus musculus
ttgccacccaggctagccgggagct

SEQ ID NO: 154136 - DNA, 25 bp, Mus musculus
ttgccactgttcagggacctccgag

SEQ ID NO: 154137 - DNA, 25 bp, Mus musculus
ttgccacttggcgaggaacctggga

SEQ ID NO: 154138 - DNA, 25 bp, Mus musculus
ttgccagagacaccgatggacccca

SEQ ID NO: 154139 - DNA, 25 bp, Mus musculus
ttgccagctggcgaaccagctgcgg

SEQ ID NO: 154140 - DNA, 25 bp, Mus musculus
ttgccaggacccaaaagaggagtcg

SEQ ID NO: 154141 - DNA, 25 bp, Mus musculus
ttgccatcaaggacgtcagcagcgt

SEQ ID NO: 154142 - DNA, 25 bp, Mus musculus
ttgccatccagatccttaagacctg

SEQ ID NO: 154143 - DNA, 25 bp, Mus musculus
ttgccatgatgagccaccacgagat

SEQ ID NO: 154144 - DNA, 25 bp, Mus musculus
ttgccatggcaacgagtgaaacccc

SEQ ID NO: 154145 - DNA, 25 bp, Mus musculus
ttgccatgggcagcgtaggtagcct

SEQ ID NO: 154146 - DNA, 25 bp, Mus musculus
ttgccatgtccagcttttaagtggg

SEQ ID NO: 154147 - DNA, 25 bp, Mus musculus
ttgcccaaaggcaggaatttccagg

SEQ ID NO: 154148 - DNA, 25 bp, Mus musculus
ttgcccacacttgtaaacctgagag

SEQ ID NO: 154149 - DNA, 25 bp, Mus musculus
ttgcccacgaccttgcctgagaatg

SEQ ID NO: 154150 - DNA, 25 bp, Mus musculus
ttgccccaagatttccgccaggtgt

SEQ ID NO: 154151 - DNA, 25 bp, Mus musculus
ttgccccaccatgacgagaagacgt

SEQ ID NO: 154152 - DNA, 25 bp, Mus musculus
ttgccccgaggctggtacagttcga

SEQ ID NO: 154153 - DNA, 25 bp, Mus musculus
ttgcccgggctcatgtgcttattga

SEQ ID NO: 154154 - DNA, 25 bp, Mus musculus
ttgccctccgggaagatgaagtgag

SEQ ID NO: 154155 - DNA, 25 bp, Mus musculus
ttgccgcagtacatcagagcttgag

SEQ ID NO: 154156 - DNA, 25 bp, Mus musculus
ttgccgcgtgctggtgttggaggac

SEQ ID NO: 154157 - DNA, 25 bp, Mus musculus
ttgccgggcacctggatggccatct

SEQ ID NO: 154158 - DNA, 25 bp, Mus musculus
ttgccgggccgagacggatcttcgc

SEQ ID NO: 154159 - DNA, 25 bp, Mus musculus
ttgccggtggcttgagaaacatcca

SEQ ID NO: 154160 - DNA, 25 bp, Mus musculus
ttgccgtctgtgtgggataccccgg

SEQ ID NO: 154161 - DNA, 25 bp, Mus musculus
ttgccgtgaaaaccacacagcagct

SEQ ID NO: 154162 - DNA, 25 bp, Mus musculus
ttgcctagtgcgtcacaggagccct

SEQ ID NO: 154163 - DNA, 25 bp, Mus musculus
ttgcctatccgaaaacagtggctgg

SEQ ID NO: 154164 - DNA, 25 bp, Mus musculus
ttgcctccagtactgtgaggaaagg

SEQ ID NO: 154165 - DNA, 25 bp, Mus musculus
ttgcctcccatgtgtacccaagctg

SEQ ID NO: 154166 - DNA, 25 bp, Mus musculus
ttgcctcccggctcagtcagagctg

SEQ ID NO: 154167 - DNA, 25 bp, Mus musculus
ttgcctctgaagtgaaagtccaccg

SEQ ID NO: 154168 - DNA, 25 bp, Mus musculus
ttgcctgccgtcttggcgaaaccca

SEQ ID NO: 154169 - DNA, 25 bp, Mus musculus
ttgcctgctccttcaatgcttcggg

SEQ ID NO: 154170 - DNA, 25 bp, Mus musculus
ttgcctggccgcttcaacggtggac

SEQ ID NO: 154171 - DNA, 25 bp, Mus musculus
ttgcgaagtaaactccccgtgaccg

SEQ ID NO: 154172 - DNA, 25 bp, Mus musculus
ttgcgaatcaacatagacattactg

SEQ ID NO: 154173 - DNA, 25 bp, Mus musculus
ttgcgaatccaaggagaggaagcca

SEQ ID NO: 154174 - DNA, 25 bp, Mus musculus
ttgcgacagcaaaggtgcctacctg

SEQ ID NO: 154175 - DNA, 25 bp, Mus musculus
ttgcgagcgcgcctaacggagaacg

SEQ ID NO: 154176 - DNA, 25 bp, Mus musculus
ttgcgattctggacgtggagcctca

SEQ ID NO: 154177 - DNA, 25 bp, Mus musculus
ttgcgcagccctctgtcatggacga

SEQ ID NO: 154178 - DNA, 25 bp, Mus musculus
ttgcggccacactaaggagcggagt

SEQ ID NO: 154179 - DNA, 25 bp, Mus musculus
ttgcggctgagctcgtgtgcggcag

SEQ ID NO: 154180 - DNA, 25 bp, Mus musculus
ttgcgggctccggagtgaagctaca

SEQ ID NO: 154181 - DNA, 25 bp, Mus musculus
ttgcggtagactcggcgcgggagga

SEQ ID NO: 154182 - DNA, 25 bp, Mus musculus
ttgcgtagagcgcagtccacacgga

SEQ ID NO: 154183 - DNA, 25 bp, Mus musculus
ttgcgtcgaaggagggacatataga

SEQ ID NO: 154184 - DNA, 25 bp, Mus musculus
ttgcgttgcattccactgagccgcc

SEQ ID NO: 154185 - DNA, 25 bp, Mus musculus
ttgctaaccgaggttatatccctgg

SEQ ID NO: 154186 - DNA, 25 bp, Mus musculus
ttgctaagaagcctcggacaccaac

SEQ ID NO: 154187 - DNA, 25 bp, Mus musculus
ttgctaagcatacacaaggcctggt

SEQ ID NO: 154188 - DNA, 25 bp, Mus musculus
ttgctaatgcttgggctgcaggcct

SEQ ID NO: 154189 - DNA, 25 bp, Mus musculus
ttgctaatggccaaaagagtcccct

SEQ ID NO: 154190 - DNA, 25 bp, Mus musculus
ttgctacagcagcacatggcggacc

SEQ ID NO: 154191 - DNA, 25 bp, Mus musculus
ttgctacgcagggaaattggccact

SEQ ID NO: 154192 - DNA, 25 bp, Mus musculus
ttgctagggccaagctgagagctca

SEQ ID NO: 154193 - DNA, 25 bp, Mus musculus
ttgctagtgaccctgaggccattca

SEQ ID NO: 154194 - DNA, 25 bp, Mus musculus
ttgctatggcaacggatgaaatctg

SEQ ID NO: 154195 - DNA, 25 bp, Mus musculus
ttgctcaaaaaaggccgaagtgtgg

SEQ ID NO: 154196 - DNA, 25 bp, Mus musculus
ttgctccaggccagagacgtttagg

SEQ ID NO: 154197 - DNA, 25 bp, Mus musculus
ttgctccccagttctcaggtccagg

SEQ ID NO: 154198 - DNA, 25 bp, Mus musculus
ttgctcttgcgctggcagcaaatga

SEQ ID NO: 154199 - DNA, 25 bp, Mus musculus
ttgctgaacccagacagtcacaggg

SEQ ID NO: 154200 - DNA, 25 bp, Mus musculus
ttgctgacagcaaaagggaacaccc

SEQ ID NO: 154201 - DNA, 25 bp, Mus musculus
ttgctgactacaaaccccaggacgg

SEQ ID NO: 154202 - DNA, 25 bp, Mus musculus
ttgctgagggtagaagccctaaccc

SEQ ID NO: 154203 - DNA, 25 bp, Mus musculus
ttgctgatgagctacgccaacgacg

SEQ ID NO: 154204 - DNA, 25 bp, Mus musculus
ttgctgatggcatgctcactccggg

SEQ ID NO: 154205 - DNA, 25 bp, Mus musculus
ttgctgcacaaagtaccatgtctcg

SEQ ID NO: 154206 - DNA, 25 bp, Mus musculus
ttgctgcaccagatccaagggaacg

SEQ ID NO: 154207 - DNA, 25 bp, Mus musculus
ttgctgcccctgtgctgactgctga

SEQ ID NO: 154208 - DNA, 25 bp, Mus musculus
ttgctgccgatgaaagaagacttgg

SEQ ID NO: 154209 - DNA, 25 bp, Mus musculus
ttgctgccggactcttggaagagct

SEQ ID NO: 154210 - DNA, 25 bp, Mus musculus
ttgctgctgatagatcagcctcctg

SEQ ID NO: 154211 - DNA, 25 bp, Mus musculus
ttgctggaaattgcaggatgtgcct

SEQ ID NO: 154212 - DNA, 25 bp, Mus musculus
ttgctggcagtgtcagaaggcccca

SEQ ID NO: 154213 - DNA, 25 bp, Mus musculus
ttgctggcccttctgtgagatttcc

SEQ ID NO: 154214 - DNA, 25 bp, Mus musculus
ttgctggcctcgaagctcaagggcg

SEQ ID NO: 154215 - DNA, 25 bp, Mus musculus
ttgctgggacagtccttatctgcgc

SEQ ID NO: 154216 - DNA, 25 bp, Mus musculus
ttgctgtaaaagcttccggcgctac

SEQ ID NO: 154217 - DNA, 25 bp, Mus musculus
ttgctgtcacactgcaagggccgga

SEQ ID NO: 154218 - DNA, 25 bp, Mus musculus
ttgctgtccctatgggtgaggccca

SEQ ID NO: 154219 - DNA, 25 bp, Mus musculus
ttgctgtcctgtgaaagaagccaga

SEQ ID NO: 154220 - DNA, 25 bp, Mus musculus
ttgctgtgtcactcaggcggctcgg

SEQ ID NO: 154221 - DNA, 25 bp, Mus musculus
ttgcttacagtgctctgggaagcca

SEQ ID NO: 154222 - DNA, 25 bp, Mus musculus
ttgcttctggaaaccctggacctgg

SEQ ID NO: 154223 - DNA, 25 bp, Mus musculus
ttgcttgccctgaaggagttttgcc

SEQ ID NO: 154224 - DNA, 25 bp, Mus musculus
ttgcttgtgagcaaaacctgctgtc

SEQ ID NO: 154225 - DNA, 25 bp, Mus musculus
ttgctttgccatgactgagcctcag

SEQ ID NO: 154226 - DNA, 25 bp, Mus musculus
ttgctttgggcaccgccttgatcgg

SEQ ID NO: 154227 - DNA, 25 bp, Mus musculus
ttggaaaagccgtctcccgggagct

SEQ ID NO: 154228 - DNA, 25 bp, Mus musculus
ttggaaaaggaaccatggcgcccag

SEQ ID NO: 154229 - DNA, 25 bp, Mus musculus
ttggaaagcaacctagtatagcagc

SEQ ID NO: 154230 - DNA, 25 bp, Mus musculus
ttggaaaggcttgacctgagcaaca

SEQ ID NO: 154231 - DNA, 25 bp, Mus musculus
ttggaacacaaaaggaagctgcttg

SEQ ID NO: 154232 - DNA, 25 bp, Mus musculus
ttggaacagatttgtaatttgtaca

SEQ ID NO: 154233 - DNA, 25 bp, Mus musculus
ttggaacagccatcctaaagccagg

SEQ ID NO: 154234 - DNA, 25 bp, Mus musculus
ttggaacagcccttcgagagcagtc

SEQ ID NO: 154235 - DNA, 25 bp, Mus musculus
ttggaacccaccgagacaccatctt

SEQ ID NO: 154236 - DNA, 25 bp, Mus musculus
ttggaacccgattgcctctctggag

SEQ ID NO: 154237 - DNA, 25 bp, Mus musculus
ttggaaccgaaagagggcgtgcttt

SEQ ID NO: 154238 - DNA, 25 bp, Mus musculus
ttggaactgacggacgaaaacttcg

SEQ ID NO: 154239 - DNA, 25 bp, Mus musculus
ttggaagacatgttcgatgccctcg

SEQ ID NO: 154240 - DNA, 25 bp, Mus musculus
ttggaaggccggcaggagcaggacc

SEQ ID NO: 154241 - DNA, 25 bp, Mus musculus
ttggaagggaaagtaaagcaggatc

SEQ ID NO: 154242 - DNA, 25 bp, Mus musculus
ttggaagtccgcctagcatgctgga

SEQ ID NO: 154243 - DNA, 25 bp, Mus musculus
ttggaagtgctgtccgatccgcaga

SEQ ID NO: 154244 - DNA, 25 bp, Mus musculus
ttggaagtttaccagcatcaggtgg

SEQ ID NO: 154245 - DNA, 25 bp, Mus musculus
ttggaatattaagcccgggagtggc

SEQ ID NO: 154246 - DNA, 25 bp, Mus musculus
ttggaatcagcaaggtgacgcctgc

SEQ ID NO: 154247 - DNA, 25 bp, Mus musculus
ttggaatgagccagtggagctccaa

SEQ ID NO: 154248 - DNA, 25 bp, Mus musculus
ttggaatgggccgttctgaccgaca

SEQ ID NO: 154249 - DNA, 25 bp, Mus musculus
ttggaattggaagcaccactgaaga

SEQ ID NO: 154250 - DNA, 25 bp, Mus musculus
ttggaatttgattttacaggcgtga

SEQ ID NO: 154251 - DNA, 25 bp, Mus musculus
ttggacaaaaacctctagcatgcgt

SEQ ID NO: 154252 - DNA, 25 bp, Mus musculus
ttggacaagcctcccacatgtggca

SEQ ID NO: 154253 - DNA, 25 bp, Mus musculus
ttggacagcccctccatggatgcct

SEQ ID NO: 154254 - DNA, 25 bp, Mus musculus
ttggacatagaaagcacagagtgcc

SEQ ID NO: 154255 - DNA, 25 bp, Mus musculus
ttggaccaaagtcacaattagaggg

SEQ ID NO: 154256 - DNA, 25 bp, Mus musculus
ttggaccaaggagcaaagcattccc

SEQ ID NO: 154257 - DNA, 25 bp, Mus musculus
ttggaccagagtaagagtaaaagca

SEQ ID NO: 154258 - DNA, 25 bp, Mus musculus
ttggacccaccctctgatctgcaga

SEQ ID NO: 154259 - DNA, 25 bp, Mus musculus
ttggacccattggaacaagcaaagg

SEQ ID NO: 154260 - DNA, 25 bp, Mus musculus
ttggaccccgggagaatccgcgttg

SEQ ID NO: 154261 - DNA, 25 bp, Mus musculus
ttggacccggaactaactagcacca

SEQ ID NO: 154262 - DNA, 25 bp, Mus musculus
ttggaccgagcctacagtgatgccc

SEQ ID NO: 154263 - DNA, 25 bp, Mus musculus
ttggacctagatggcctattgcggc

SEQ ID NO: 154264 - DNA, 25 bp, Mus musculus
ttggacctggcctgaagactgattg

SEQ ID NO: 154265 - DNA, 25 bp, Mus musculus
ttggacgtcaccctagcacatgatg

SEQ ID NO: 154266 - DNA, 25 bp, Mus musculus
ttggactgaaagctgcaagactggc

SEQ ID NO: 154267 - DNA, 25 bp, Mus musculus
ttggacttccctgagtacgacggtg

SEQ ID NO: 154268 - DNA, 25 bp, Mus musculus
ttggacttgaatctcccgccacagc

SEQ ID NO: 154269 - DNA, 25 bp, Mus musculus
ttggacttgcttcacgcgctgcagg

SEQ ID NO: 154270 - DNA, 25 bp, Mus musculus
ttggacttttgcaatcagagataac

SEQ ID NO: 154271 - DNA, 25 bp, Mus musculus
ttggagaagagcgtcaggcgcctcc

SEQ ID NO: 154272 - DNA, 25 bp, Mus musculus
ttggagacaccatcagactctgagc

SEQ ID NO: 154273 - DNA, 25 bp, Mus musculus
ttggagaccgtgaaacagctgacag

SEQ ID NO: 154274 - DNA, 25 bp, Mus musculus
ttggagagagaagcgcagagtacct

SEQ ID NO: 154275 - DNA, 25 bp, Mus musculus
ttggagatctagacacagccctgca

SEQ ID NO: 154276 - DNA, 25 bp, Mus musculus
ttggagcaacgcgatccctaggtcg

SEQ ID NO: 154277 - DNA, 25 bp, Mus musculus
ttggagcaatttctcctgggatccc

SEQ ID NO: 154278 - DNA, 25 bp, Mus musculus
ttggagcactcttggaaagcactgg

SEQ ID NO: 154279 - DNA, 25 bp, Mus musculus
ttggagcactttaccgacggcaggg

SEQ ID NO: 154280 - DNA, 25 bp, Mus musculus
ttggagcagctcctgatccaccagc

SEQ ID NO: 154281 - DNA, 25 bp, Mus musculus
ttggagcagtgaagaacccgaggaa

SEQ ID NO: 154282 - DNA, 25 bp, Mus musculus
ttggagccggaaatgacacactggc

SEQ ID NO: 154283 - DNA, 25 bp, Mus musculus
ttggaggaatcctgacaaagccggc

SEQ ID NO: 154284 - DNA, 25 bp, Mus musculus
ttggaggagaacacatgagagaaag

SEQ ID NO: 154285 - DNA, 25 bp, Mus musculus
ttggaggcaaaaactgctgatctgg

SEQ ID NO: 154286 - DNA, 25 bp, Mus musculus
ttggaggcgacaaattgtggcccat

SEQ ID NO: 154287 - DNA, 25 bp, Mus musculus
ttggaggcgaccacaagctcttgtt

SEQ ID NO: 154288 - DNA, 25 bp, Mus musculus
ttggaggcggccttgaccatctcag

SEQ ID NO: 154289 - DNA, 25 bp, Mus musculus
ttggagggcagcacaggacatccta

SEQ ID NO: 154290 - DNA, 25 bp, Mus musculus
ttggagtaaacaagaccgcgcctag

SEQ ID NO: 154291 - DNA, 25 bp, Mus musculus
ttggagttctacaccccagaggcag

SEQ ID NO: 154292 - DNA, 25 bp, Mus musculus
ttggataatccccaggaccgaggtc

SEQ ID NO: 154293 - DNA, 25 bp, Mus musculus
ttggatactgcctacgacgagctgg

SEQ ID NO: 154294 - DNA, 25 bp, Mus musculus
ttggatccctcaacgatgagaacac

SEQ ID NO: 154295 - DNA, 25 bp, Mus musculus
ttggatctcccacaagtcacctgga

SEQ ID NO: 154296 - DNA, 25 bp, Mus musculus
ttggatgcactatgatggcctcaga

SEQ ID NO: 154297 - DNA, 25 bp, Mus musculus
ttggatggacccctagtgcagagac

SEQ ID NO: 154298 - DNA, 25 bp, Mus musculus
ttggatgttacttcgggcctgcagc

SEQ ID NO: 154299 - DNA, 25 bp, Mus musculus
ttggattaccacaggcaggcactgg

SEQ ID NO: 154300 - DNA, 25 bp, Mus musculus
ttggattccacaatgcgacgcctga

SEQ ID NO: 154301 - DNA, 25 bp, Mus musculus
ttggattgacaggtgcccgacttcg

SEQ ID NO: 154302 - DNA, 25 bp, Mus musculus
ttggcaaagacaaagtattttcagt

SEQ ID NO: 154303 - DNA, 25 bp, Mus musculus
ttggcaaatgattcaagctggcccc

SEQ ID NO: 154304 - DNA, 25 bp, Mus musculus
ttggcaacctcctacagagtctcag

SEQ ID NO: 154305 - DNA, 25 bp, Mus musculus
ttggcaaggttggaaaccagaagcg

SEQ ID NO: 154306 - DNA, 25 bp, Mus musculus
ttggcaatgcccatagacctgcggg

SEQ ID NO: 154307 - DNA, 25 bp, Mus musculus
ttggcacccaaatcacaagacgccg

SEQ ID NO: 154308 - DNA, 25 bp, Mus musculus
ttggcacccaatgcagactcctgtt

SEQ ID NO: 154309 - DNA, 25 bp, Mus musculus
ttggcagaacccaagagcctcaggc

SEQ ID NO: 154310 - DNA, 25 bp, Mus musculus
ttggcagcactcatcaggaatgggc

SEQ ID NO: 154311 - DNA, 25 bp, Mus musculus
ttggcagcactgaaagactacgcgc

SEQ ID NO: 154312 - DNA, 25 bp, Mus musculus
ttggcagcaggcaattctggaggct

SEQ ID NO: 154313 - DNA, 25 bp, Mus musculus
ttggcagctatgtcacacacgagac

SEQ ID NO: 154314 - DNA, 25 bp, Mus musculus
ttggcaggaaaaggtagcggcatca

SEQ ID NO: 154315 - DNA, 25 bp, Mus musculus
ttggcaggccctcacctggcgctgt

SEQ ID NO: 154316 - DNA, 25 bp, Mus musculus
ttggcaggctaaaaagagagcgttc

SEQ ID NO: 154317 - DNA, 25 bp, Mus musculus
ttggcagtacccaccgaggaggaac

SEQ ID NO: 154318 - DNA, 25 bp, Mus musculus
ttggcataactaccaggcagcagcg

SEQ ID NO: 154319 - DNA, 25 bp, Mus musculus
ttggcatccaatgaagccctcggtg

SEQ ID NO: 154320 - DNA, 25 bp, Mus musculus
ttggcatgagatcgcaaggcctcag

SEQ ID NO: 154321 - DNA, 25 bp, Mus musculus
ttggcatgagtcacccccatctctt

SEQ ID NO: 154322 - DNA, 25 bp, Mus musculus
ttggcatgcacccagctcaagatgc

SEQ ID NO: 154323 - DNA, 25 bp, Mus musculus
ttggccaaagagaaatgagagataa

SEQ ID NO: 154324 - DNA, 25 bp, Mus musculus
ttggccaacgaaggcaactaccggg

SEQ ID NO: 154325 - DNA, 25 bp, Mus musculus
ttggccaagctacaactgggatcgg

SEQ ID NO: 154326 - DNA, 25 bp, Mus musculus
ttggccactgccacgtgcttctggg

SEQ ID NO: 154327 - DNA, 25 bp, Mus musculus
ttggccaggatcactattgctccca

SEQ ID NO: 154328 - DNA, 25 bp, Mus musculus
ttggccaggcagagaagacagaact

SEQ ID NO: 154329 - DNA, 25 bp, Mus musculus
ttggccaggctgaaactcaaaactc

SEQ ID NO: 154330 - DNA, 25 bp, Mus musculus
ttggccagtgccacgtgtgagcgct

SEQ ID NO: 154331 - DNA, 25 bp, Mus musculus
ttggccatctggaagtcagcagcgg

SEQ ID NO: 154332 - DNA, 25 bp, Mus musculus
ttggcccaccggaactgaagagctt

SEQ ID NO: 154333 - DNA, 25 bp, Mus musculus
ttggcccagctcatgaattcaagcg

SEQ ID NO: 154334 - DNA, 25 bp, Mus musculus
ttggcccaggccgtgaaagcatggc

SEQ ID NO: 154335 - DNA, 25 bp, Mus musculus
ttggcccaggtgctgaaagaaatca

SEQ ID NO: 154336 - DNA, 25 bp, Mus musculus
ttggccccaacgctggagaagtcac

SEQ ID NO: 154337 - DNA, 25 bp, Mus musculus
ttggcccgagacagacagcatacag

SEQ ID NO: 154338 - DNA, 25 bp, Mus musculus
ttggcccgaggatcacacagtcttc

SEQ ID NO: 154339 - DNA, 25 bp, Mus musculus
ttggccctgaaagactccggctggc

SEQ ID NO: 154340 - DNA, 25 bp, Mus musculus
ttggccctgggcctgtctacccgga

SEQ ID NO: 154341 - DNA, 25 bp, Mus musculus
ttggccctgtcacctccacggagta

SEQ ID NO: 154342 - DNA, 25 bp, Mus musculus
ttggccgacaacatagttacctgcg

SEQ ID NO: 154343 - DNA, 25 bp, Mus musculus
ttggccgtgaatgacctgaaacccc

SEQ ID NO: 154344 - DNA, 25 bp, Mus musculus
ttggccgtggctgacctcttcatgg

SEQ ID NO: 154345 - DNA, 25 bp, Mus musculus
ttggcctagctgtgcgcgcaccgcg

SEQ ID NO: 154346 - DNA, 25 bp, Mus musculus
ttggcctaggtctgttcaagcgccg

SEQ ID NO: 154347 - DNA, 25 bp, Mus musculus
ttggcctcggcttcccggccgagag

SEQ ID NO: 154348 - DNA, 25 bp, Mus musculus
ttggcctgctatgtgtatccatgga

SEQ ID NO: 154349 - DNA, 25 bp, Mus musculus
ttggcctggtcaccaacgcttgggt

SEQ ID NO: 154350 - DNA, 25 bp, Mus musculus
ttggccttacggcatccgatgacat

SEQ ID NO: 154351 - DNA, 25 bp, Mus musculus
ttggccttgaatggagaactgactg

SEQ ID NO: 154352 - DNA, 25 bp, Mus musculus
ttggcgagaaactggacatcatccg

SEQ ID NO: 154353 - DNA, 25 bp, Mus musculus
ttggcgagcctaacttctgagcggg

SEQ ID NO: 154354 - DNA, 25 bp, Mus musculus
ttggcggcggttcattcagcactcg

SEQ ID NO: 154355 - DNA, 25 bp, Mus musculus
ttggcgtaactgcaagccttgggac

SEQ ID NO: 154356 - DNA, 25 bp, Mus musculus
ttggctaaaagaataaaacacgtgg

SEQ ID NO: 154357 - DNA, 25 bp, Mus musculus
ttggctaccggcttcacaaagatga

SEQ ID NO: 154358 - DNA, 25 bp, Mus musculus
ttggctagcctgacaatcaccctct

SEQ ID NO: 154359 - DNA, 25 bp, Mus musculus
ttggctcactcttgggcagaccgga

SEQ ID NO: 154360 - DNA, 25 bp, Mus musculus
ttggctcagccaaaaagacatagag

SEQ ID NO: 154361 - DNA, 25 bp, Mus musculus
ttggctccgcggactcgtgttccag

SEQ ID NO: 154362 - DNA, 25 bp, Mus musculus
ttggctctaccaacctagcagggct

SEQ ID NO: 154363 - DNA, 25 bp, Mus musculus
ttggctctggaacccatcagcactc

SEQ ID NO: 154364 - DNA, 25 bp, Mus musculus
ttggctgccaagtgataaaaacgtt

SEQ ID NO: 154365 - DNA, 25 bp, Mus musculus
ttggctgcccacaaataaactgcgg

SEQ ID NO: 154366 - DNA, 25 bp, Mus musculus
ttggctgcgacagcaacgggaagct

SEQ ID NO: 154367 - DNA, 25 bp, Mus musculus
ttggctgctcagttcggacatacct

SEQ ID NO: 154368 - DNA, 25 bp, Mus musculus
ttggctggcagagcgccaaccggca

SEQ ID NO: 154369 - DNA, 25 bp, Mus musculus
ttggctgtcccaagctgccagagcc

SEQ ID NO: 154370 - DNA, 25 bp, Mus musculus
ttggctgtttcgtcctgctcaccgc

SEQ ID NO: 154371 - DNA, 25 bp, Mus musculus
ttggcttaaacacaggacaactggg

SEQ ID NO: 154372 - DNA, 25 bp, Mus musculus
ttggctttagcgaagtaaccgaggc

SEQ ID NO: 154373 - DNA, 25 bp, Mus musculus
ttgggaacaatcaacgagaggccgg

SEQ ID NO: 154374 - DNA, 25 bp, Mus musculus
ttgggaactcctctacaagctgcag

SEQ ID NO: 154375 - DNA, 25 bp, Mus musculus
ttgggaagaagttgctgccctagag

SEQ ID NO: 154376 - DNA, 25 bp, Mus musculus
ttgggaaggacattacggagcgcct

SEQ ID NO: 154377 - DNA, 25 bp, Mus musculus
ttgggaccaagaccatgacctccgt

SEQ ID NO: 154378 - DNA, 25 bp, Mus musculus
ttgggaccagtgtacagagggactc

SEQ ID NO: 154379 - DNA, 25 bp, Mus musculus
ttgggaccgcctgaaggtgcccgct

SEQ ID NO: 154380 - DNA, 25 bp, Mus musculus
ttgggaccggcatgttcccaacagc

SEQ ID NO: 154381 - DNA, 25 bp, Mus musculus
ttgggacctggctacatgtgatgag

SEQ ID NO: 154382 - DNA, 25 bp, Mus musculus
ttgggacgcgctcacctgagacaag

SEQ ID NO: 154383 - DNA, 25 bp, Mus musculus
ttgggacggtttcgcacacatgtga

SEQ ID NO: 154384 - DNA, 25 bp, Mus musculus
ttgggacgtgaagagacaagcagca

SEQ ID NO: 154385 - DNA, 25 bp, Mus musculus
ttgggactgggccacctcaatgact

SEQ ID NO: 154386 - DNA, 25 bp, Mus musculus
ttgggacttctcacaaatacctggg

SEQ ID NO: 154387 - DNA, 25 bp, Mus musculus
ttgggagcacaaccacagataacca

SEQ ID NO: 154388 - DNA, 25 bp, Mus musculus
ttgggagccacaccgtaactatgtg

SEQ ID NO: 154389 - DNA, 25 bp, Mus musculus
ttgggagccaccacaagatcagcca

SEQ ID NO: 154390 - DNA, 25 bp, Mus musculus
ttgggagcgctccaggaactttcct

SEQ ID NO: 154391 - DNA, 25 bp, Mus musculus
ttgggagtggatactgatgaccctc

SEQ ID NO: 154392 - DNA, 25 bp, Mus musculus
ttgggagttggtgcgcaacctgcta

SEQ ID NO: 154393 - DNA, 25 bp, Mus musculus
ttgggatcgggtacaatggcatgcc

SEQ ID NO: 154394 - DNA, 25 bp, Mus musculus
ttgggatgcccagcttgatgtaccg

SEQ ID NO: 154395 - DNA, 25 bp, Mus musculus
ttgggatgtccagcgacaagtttgg

SEQ ID NO: 154396 - DNA, 25 bp, Mus musculus
ttgggattaacatgatggcactgcc

SEQ ID NO: 154397 - DNA, 25 bp, Mus musculus
ttgggcagctttccacaaccggcct

SEQ ID NO: 154398 - DNA, 25 bp, Mus musculus
ttgggcagtgaagaaacttggttcc

SEQ ID NO: 154399 - DNA, 25 bp, Mus musculus
ttgggcattctcctgcggtacctgg

SEQ ID NO: 154400 - DNA, 25 bp, Mus musculus
ttgggccatcgaacgctccttgagt

SEQ ID NO: 154401 - DNA, 25 bp, Mus musculus
ttgggcccgtcggacgcttgttgtt

SEQ ID NO: 154402 - DNA, 25 bp, Mus musculus
ttgggccgacgacaaaggaaatctg

SEQ ID NO: 154403 - DNA, 25 bp, Mus musculus
ttgggcggagtctaccacctggaaa

SEQ ID NO: 154404 - DNA, 25 bp, Mus musculus
ttggggactacctacagacccggct

SEQ ID NO: 154405 - DNA, 25 bp, Mus musculus
ttgggtagaattggaatacagttgc

SEQ ID NO: 154406 - DNA, 25 bp, Mus musculus
ttgggtccaacaagccagaggcatt

SEQ ID NO: 154407 - DNA, 25 bp, Mus musculus
ttgggtcctaccatagcaggcctgg

SEQ ID NO: 154408 - DNA, 25 bp, Mus musculus
ttgggtctagcctactggcaccggc

SEQ ID NO: 154409 - DNA, 25 bp, Mus musculus
ttgggtctccaagaaggcacacacg

SEQ ID NO: 154410 - DNA, 25 bp, Mus musculus
ttgggtctctacactggtcagctgg

SEQ ID NO: 154411 - DNA, 25 bp, Mus musculus
ttgggtgaactgagccgactggact

SEQ ID NO: 154412 - DNA, 25 bp, Mus musculus
ttgggtgagggcaacagctccatca

SEQ ID NO: 154413 - DNA, 25 bp, Mus musculus
ttgggtggcactacacagggacagc

SEQ ID NO: 154414 - DNA, 25 bp, Mus musculus
ttgggtgggactatatcggcataca

SEQ ID NO: 154415 - DNA, 25 bp, Mus musculus
ttgggtgtacgatgccggcctgact

SEQ ID NO: 154416 - DNA, 25 bp, Mus musculus
ttgggtgtcaccacgaagctggtgc

SEQ ID NO: 154417 - DNA, 25 bp, Mus musculus
ttgggtgtctcttgcagtatctggg

SEQ ID NO: 154418 - DNA, 25 bp, Mus musculus
ttgggttacaaaaaacagtatatct

SEQ ID NO: 154419 - DNA, 25 bp, Mus musculus
ttgggttcccactgaagacgctgcg

SEQ ID NO: 154420 - DNA, 25 bp, Mus musculus
ttgggttggcagctcacacaggtcc

SEQ ID NO: 154421 - DNA, 25 bp, Mus musculus
ttggtaaatagtggagactccagcc

SEQ ID NO: 154422 - DNA, 25 bp, Mus musculus
ttggtaattgctagctgctgggaga

SEQ ID NO: 154423 - DNA, 25 bp, Mus musculus
ttggtacagaccactcctgggagga

SEQ ID NO: 154424 - DNA, 25 bp, Mus musculus
ttggtacccgctgaacctgcttgag

SEQ ID NO: 154425 - DNA, 25 bp, Mus musculus
ttggtagcgtacaaagatgggaagc

SEQ ID NO: 154426 - DNA, 25 bp, Mus musculus
ttggtattgtggctgccgaggccgc

SEQ ID NO: 154427 - DNA, 25 bp, Mus musculus
ttggtcagcaccaatggtccaggcg

SEQ ID NO: 154428 - DNA, 25 bp, Mus musculus
ttggtccagagttaatgagcgccct

SEQ ID NO: 154429 - DNA, 25 bp, Mus musculus
ttggtgactgaggaaaggacccaga

SEQ ID NO: 154430 - DNA, 25 bp, Mus musculus
ttggtgagcggcctccacccaaacg

SEQ ID NO: 154431 - DNA, 25 bp, Mus musculus
ttggtgcaaggccacatgggacaca

SEQ ID NO: 154432 - DNA, 25 bp, Mus musculus
ttggtgcccgaaggaaaatgctgct

SEQ ID NO: 154433 - DNA, 25 bp, Mus musculus
ttggtgcctcttctccgtgcagcga

SEQ ID NO: 154434 - DNA, 25 bp, Mus musculus
ttggtgcgcaacctgctagtgctgc

SEQ ID NO: 154435 - DNA, 25 bp, Mus musculus
ttggtgctacactacagatccggac

SEQ ID NO: 154436 - DNA, 25 bp, Mus musculus
ttggtggaagacacaaagctcctcg

SEQ ID NO: 154437 - DNA, 25 bp, Mus musculus
ttggtggacctggacgcatgaagca

SEQ ID NO: 154438 - DNA, 25 bp, Mus musculus
ttggtggccccaaaggacatgacat

SEQ ID NO: 154439 - DNA, 25 bp, Mus musculus
ttggtgggcaccgtattcgcctcta

SEQ ID NO: 154440 - DNA, 25 bp, Mus musculus
ttggtgtacttttcatcgtccagaa

SEQ ID NO: 154441 - DNA, 25 bp, Mus musculus
ttggttctgtcagccggctcctgtg

SEQ ID NO: 154442 - DNA, 25 bp, Mus musculus
ttggttgcaggaaagaccggagccc

SEQ ID NO: 154443 - DNA, 25 bp, Mus musculus
ttggtttgatcttccaggctcaggc

SEQ ID NO: 154444 - DNA, 25 bp, Mus musculus
ttgtacatagtccagcgagctcgtg

SEQ ID NO: 154445 - DNA, 25 bp, Mus musculus
ttgtaccagaagatgcagacgagca

SEQ ID NO: 154446 - DNA, 25 bp, Mus musculus
ttgtacccatgtccaagatcgctga

SEQ ID NO: 154447 - DNA, 25 bp, Mus musculus
ttgtacccgccctttgaagccacag

SEQ ID NO: 154448 - DNA, 25 bp, Mus musculus
ttgtacgtgttttcacaggccaggc

SEQ ID NO: 154449 - DNA, 25 bp, Mus musculus
ttgtactcaacctgaggccaggctg

SEQ ID NO: 154450 - DNA, 25 bp, Mus musculus
ttgtagaacaaagcgtccagaagcc

SEQ ID NO: 154451 - DNA, 25 bp, Mus musculus
ttgtagaaggtacttgggaccctgc

SEQ ID NO: 154452 - DNA, 25 bp, Mus musculus
ttgtagacaacgtccctcaggtggg

SEQ ID NO: 154453 - DNA, 25 bp, Mus musculus
ttgtagcggacagcaaagacaagga

SEQ ID NO: 154454 - DNA, 25 bp, Mus musculus
ttgtagtccccatgacccatattct

SEQ ID NO: 154455 - DNA, 25 bp, Mus musculus
ttgtatacaaaacgccctgagtccc

SEQ ID NO: 154456 - DNA, 25 bp, Mus musculus
ttgtatcaaacaccgaggctcctgg

SEQ ID NO: 154457 - DNA, 25 bp, Mus musculus
ttgtatcagacagatccctccggga

SEQ ID NO: 154458 - DNA, 25 bp, Mus musculus
ttgtatcgattcaaggactggcttc

SEQ ID NO: 154459 - DNA, 25 bp, Mus musculus
ttgtatcggaaatcccggtccccag

SEQ ID NO: 154460 - DNA, 25 bp, Mus musculus
ttgtatctgaccaggctcccagtgg

SEQ ID NO: 154461 - DNA, 25 bp, Mus musculus
ttgtatttgctgagaaaactggccc

SEQ ID NO: 154462 - DNA, 25 bp, Mus musculus
ttgtcaaagactagccagccctcga

SEQ ID NO: 154463 - DNA, 25 bp, Mus musculus
ttgtcaaccacagagcgaggaagcc

SEQ ID NO: 154464 - DNA, 25 bp, Mus musculus
ttgtcaaccggacccctgagacggt

SEQ ID NO: 154465 - DNA, 25 bp, Mus musculus
ttgtcaatggcaaatcgagggaaac

SEQ ID NO: 154466 - DNA, 25 bp, Mus musculus
ttgtcaccaccaggaactacaggag

SEQ ID NO: 154467 - DNA, 25 bp, Mus musculus
ttgtcacctggagcagaatcgggtt

SEQ ID NO: 154468 - DNA, 25 bp, Mus musculus
ttgtcagacgatacacccctggagt

SEQ ID NO: 154469 - DNA, 25 bp, Mus musculus
ttgtcagatcgtaacaggatcccaa

SEQ ID NO: 154470 - DNA, 25 bp, Mus musculus
ttgtcaggaccgcagaaggagcgcc

SEQ ID NO: 154471 - DNA, 25 bp, Mus musculus
ttgtcatccgaagaaacccagctga

SEQ ID NO: 154472 - DNA, 25 bp, Mus musculus
ttgtcatgggcaacctggaccgtga

SEQ ID NO: 154473 - DNA, 25 bp, Mus musculus
ttgtcattccagtcctgctctggat

SEQ ID NO: 154474 - DNA, 25 bp, Mus musculus
ttgtccaagtattctacccatgaga

SEQ ID NO: 154475 - DNA, 25 bp, Mus musculus
ttgtccatccaagaaagagcctcta

SEQ ID NO: 154476 - DNA, 25 bp, Mus musculus
ttgtccatgctgtccaggctgggat

SEQ ID NO: 154477 - DNA, 25 bp, Mus musculus
ttgtcccggcagcactaccagctgt

SEQ ID NO: 154478 - DNA, 25 bp, Mus musculus
ttgtccgacaggaacacccaaggct

SEQ ID NO: 154479 - DNA, 25 bp, Mus musculus
ttgtccgagaggatacacggctggt

SEQ ID NO: 154480 - DNA, 25 bp, Mus musculus
ttgtccggagggagcatgccaacat

SEQ ID NO: 154481 - DNA, 25 bp, Mus musculus
ttgtcctgacctgtgctattgagca

SEQ ID NO: 154482 - DNA, 25 bp, Mus musculus
ttgtcgccatccagtatcgcttggg

SEQ ID NO: 154483 - DNA, 25 bp, Mus musculus
ttgtcgccctgattctgcccagcag

SEQ ID NO: 154484 - DNA, 25 bp, Mus musculus
ttgtcgctccaagcggctgcaacag

SEQ ID NO: 154485 - DNA, 25 bp, Mus musculus
ttgtcgctgcacgagactgattgcc

SEQ ID NO: 154486 - DNA, 25 bp, Mus musculus
ttgtcgctttgacgcctagcccagc

SEQ ID NO: 154487 - DNA, 25 bp, Mus musculus
ttgtcggaggagctcttctgtttcc

SEQ ID NO: 154488 - DNA, 25 bp, Mus musculus
ttgtcggcaggctcttccgaaggac

SEQ ID NO: 154489 - DNA, 25 bp, Mus musculus
ttgtcggcgtcatctacaacaaggg

SEQ ID NO: 154490 - DNA, 25 bp, Mus musculus
ttgtcggctggcgagacacgtcctc

SEQ ID NO: 154491 - DNA, 25 bp, Mus musculus
ttgtcgggggtctcctgctgttctc

SEQ ID NO: 154492 - DNA, 25 bp, Mus musculus
ttgtcggtcacactgggccatcttg

SEQ ID NO: 154493 - DNA, 25 bp, Mus musculus
ttgtctcagagaacagcgtggtggc

SEQ ID NO: 154494 - DNA, 25 bp, Mus musculus
ttgtctctcctttgaccctggtggc

SEQ ID NO: 154495 - DNA, 25 bp, Mus musculus
ttgtctctgcagtgtgctgtccaca

SEQ ID NO: 154496 - DNA, 25 bp, Mus musculus
ttgtctctggcgtgttccctgctcg

SEQ ID NO: 154497 - DNA, 25 bp, Mus musculus
ttgtctgagatggataatgagcccc

SEQ ID NO: 154498 - DNA, 25 bp, Mus musculus
ttgtctgcaagaaatggctcaggag

SEQ ID NO: 154499 - DNA, 25 bp, Mus musculus
ttgtctgtagttgacattagatccc

SEQ ID NO: 154500 - DNA, 25 bp, Mus musculus
ttgtctgtgcatcccaaattctgcc

SEQ ID NO: 154501 - DNA, 25 bp, Mus musculus
ttgtcttctcagatgcggcctggcc

SEQ ID NO: 154502 - DNA, 25 bp, Mus musculus
ttgtcttgcaaattgggagcccagc

SEQ ID NO: 154503 - DNA, 25 bp, Mus musculus
ttgtgaaatccagcggaaccgtcag

SEQ ID NO: 154504 - DNA, 25 bp, Mus musculus
ttgtgaaatcccctctggctggaga

SEQ ID NO: 154505 - DNA, 25 bp, Mus musculus
ttgtgaacacttcaggcggccctga

SEQ ID NO: 154506 - DNA, 25 bp, Mus musculus
ttgtgaacgcgtgtcctcgactgcg

SEQ ID NO: 154507 - DNA, 25 bp, Mus musculus
ttgtgaacggaaagagacgaatccc

SEQ ID NO: 154508 - DNA, 25 bp, Mus musculus
ttgtgaagcgcactaaagaccgtgg

SEQ ID NO: 154509 - DNA, 25 bp, Mus musculus
ttgtgaatagcaccatccctgtggg

SEQ ID NO: 154510 - DNA, 25 bp, Mus musculus
ttgtgaatctcaacaggcccgtggc

SEQ ID NO: 154511 - DNA, 25 bp, Mus musculus
ttgtgacacactcaaaggctttggc

SEQ ID NO: 154512 - DNA, 25 bp, Mus musculus
ttgtgacaccacatcctcgaaggat

SEQ ID NO: 154513 - DNA, 25 bp, Mus musculus
ttgtgacagcctgaagccctgggca

SEQ ID NO: 154514 - DNA, 25 bp, Mus musculus
ttgtgacatttggagaggctctgtg

SEQ ID NO: 154515 - DNA, 25 bp, Mus musculus
ttgtgaccaacgtgccctcagtctg

SEQ ID NO: 154516 - DNA, 25 bp, Mus musculus
ttgtgacggactacaccctggctga

SEQ ID NO: 154517 - DNA, 25 bp, Mus musculus
ttgtgactcagacagcttgggctca

SEQ ID NO: 154518 - DNA, 25 bp, Mus musculus
ttgtgagactttgcaccttgtgcca

SEQ ID NO: 154519 - DNA, 25 bp, Mus musculus
ttgtgagcgtcgttgcctacctggc

SEQ ID NO: 154520 - DNA, 25 bp, Mus musculus
ttgtgatcagcgcactcatggccct

SEQ ID NO: 154521 - DNA, 25 bp, Mus musculus
ttgtgatttggagctctgcccctgg

SEQ ID NO: 154522 - DNA, 25 bp, Mus musculus
ttgtgccacgttgcctgtcttcact

SEQ ID NO: 154523 - DNA, 25 bp, Mus musculus
ttgtgccattggtcgaaaacgttca

SEQ ID NO: 154524 - DNA, 25 bp, Mus musculus
ttgtgccctcctaataaatccatgg

SEQ ID NO: 154525 - DNA, 25 bp, Mus musculus
ttgtgccgttgcgagattgcagctg

SEQ ID NO: 154526 - DNA, 25 bp, Mus musculus
ttgtgcctactccaggctctcctgg

SEQ ID NO: 154527 - DNA, 25 bp, Mus musculus
ttgtgccttctgaagaccagggtgg

SEQ ID NO: 154528 - DNA, 25 bp, Mus musculus
ttgtgcgggccacgctttcagtgcc

SEQ ID NO: 154529 - DNA, 25 bp, Mus musculus
ttgtgcgtagcgttgtcgccctcct

SEQ ID NO: 154530 - DNA, 25 bp, Mus musculus
ttgtgctaaacacgatgactgctgt

SEQ ID NO: 154531 - DNA, 25 bp, Mus musculus
ttgtgctcattgagctgtggctctg

SEQ ID NO: 154532 - DNA, 25 bp, Mus musculus
ttgtgcttctggctccccattgaca

SEQ ID NO: 154533 - DNA, 25 bp, Mus musculus
ttgtggaaatcaccgcgaacggcgt

SEQ ID NO: 154534 - DNA, 25 bp, Mus musculus
ttgtggacagaaacagtggaatgct

SEQ ID NO: 154535 - DNA, 25 bp, Mus musculus
ttgtggcctctaccggagctcccaa

SEQ ID NO: 154536 - DNA, 25 bp, Mus musculus
ttgtggctcaggtcggccctgagat

SEQ ID NO: 154537 - DNA, 25 bp, Mus musculus
ttgtgggaccagagaggaacttacg

SEQ ID NO: 154538 - DNA, 25 bp, Mus musculus
ttgtgggaggaaaccagcagatcac

SEQ ID NO: 154539 - DNA, 25 bp, Mus musculus
ttgtgggtaaacgtgctgggcccct

SEQ ID NO: 154540 - DNA, 25 bp, Mus musculus
ttgtgggtccctgttcagcgcccgg

SEQ ID NO: 154541 - DNA, 25 bp, Mus musculus
ttgtggtaaacaggagcagtcactc

SEQ ID NO: 154542 - DNA, 25 bp, Mus musculus
ttgtggtggtgacggcaggagtccg

SEQ ID NO: 154543 - DNA, 25 bp, Mus musculus
ttgtgtagaacctgcagtggcggcc

SEQ ID NO: 154544 - DNA, 25 bp, Mus musculus
ttgtgtagcctgaccctgaagaagc

SEQ ID NO: 154545 - DNA, 25 bp, Mus musculus
ttgtgtcacgaagaaagcccctcaa

SEQ ID NO: 154546 - DNA, 25 bp, Mus musculus
ttgtgtgaaccaacatagactcgca

SEQ ID NO: 154547 - DNA, 25 bp, Mus musculus
ttgtgtgaatggcacagagccccag

SEQ ID NO: 154548 - DNA, 25 bp, Mus musculus
ttgtgtgagatagtgagatttatgt

SEQ ID NO: 154549 - DNA, 25 bp, Mus musculus
ttgtgtgcactagcggatgggacct

SEQ ID NO: 154550 - DNA, 25 bp, Mus musculus
ttgtgtggctgcactcacgctacgg

SEQ ID NO: 154551 - DNA, 25 bp, Mus musculus
ttgtgtggtttggttactgcacagc

SEQ ID NO: 154552 - DNA, 25 bp, Mus musculus
ttgttaaattaatgcaagactacag

SEQ ID NO: 154553 - DNA, 25 bp, Mus musculus
ttgttaccgtgtgccctatcgcagg

SEQ ID NO: 154554 - DNA, 25 bp, Mus musculus
ttgttagaaagaagactggtcctga

SEQ ID NO: 154555 - DNA, 25 bp, Mus musculus
ttgttatgctgagctcagttagtga

SEQ ID NO: 154556 - DNA, 25 bp, Mus musculus
ttgttcaggacttattgttcaccga

SEQ ID NO: 154557 - DNA, 25 bp, Mus musculus
ttgttcagtcagagcgagaacattc

SEQ ID NO: 154558 - DNA, 25 bp, Mus musculus
ttgttccctcttcggcttccgtaga

SEQ ID NO: 154559 - DNA, 25 bp, Mus musculus
ttgttccgaagtgggcagtacctgc

SEQ ID NO: 154560 - DNA, 25 bp, Mus musculus
ttgttcctggcgtactgcagcagca

SEQ ID NO: 154561 - DNA, 25 bp, Mus musculus
ttgttcgggcccatgagagtgcagt

SEQ ID NO: 154562 - DNA, 25 bp, Mus musculus
ttgttgaaggccaccaagatctgcg

SEQ ID NO: 154563 - DNA, 25 bp, Mus musculus
ttgttgacaggccacgaagactttc

SEQ ID NO: 154564 - DNA, 25 bp, Mus musculus
ttgttgagaacattggctgcccacc

SEQ ID NO: 154565 - DNA, 25 bp, Mus musculus
ttgttgagtgggatgggccggcgac

SEQ ID NO: 154566 - DNA, 25 bp, Mus musculus
ttgttgatctctacggccaggctgc

SEQ ID NO: 154567 - DNA, 25 bp, Mus musculus
ttgttgcagctaagcgtcccttccg

SEQ ID NO: 154568 - DNA, 25 bp, Mus musculus
ttgttgccagcatggaccaccagga

SEQ ID NO: 154569 - DNA, 25 bp, Mus musculus
ttgttgccctgaaagccgaagcgac

SEQ ID NO: 154570 - DNA, 25 bp, Mus musculus
ttgttgctctacatgtgccccacgg

SEQ ID NO: 154571 - DNA, 25 bp, Mus musculus
ttgttggacaaagctgaccagcgct

SEQ ID NO: 154572 - DNA, 25 bp, Mus musculus
ttgttggattctgccctgagggacc

SEQ ID NO: 154573 - DNA, 25 bp, Mus musculus
ttgttggtaccctatatgccgtcta

SEQ ID NO: 154574 - DNA, 25 bp, Mus musculus
ttgttggtagccatgtcggagcccc

SEQ ID NO: 154575 - DNA, 25 bp, Mus musculus
ttgttggtcccaccatgtccaggct

SEQ ID NO: 154576 - DNA, 25 bp, Mus musculus
ttgtttagaagtacacatgcatgtc

SEQ ID NO: 154577 - DNA, 25 bp, Mus musculus
ttgtttagcctccatagagccccag

SEQ ID NO: 154578 - DNA, 25 bp, Mus musculus
ttgtttccagcccaggaggcctcgt

SEQ ID NO: 154579 - DNA, 25 bp, Mus musculus
ttgtttgacctgacacccaccaagg

SEQ ID NO: 154580 - DNA, 25 bp, Mus musculus
ttgtttgagatgagcaagaactccc

SEQ ID NO: 154581 - DNA, 25 bp, Mus musculus
ttgtttgaggacaacggcgctccgc

SEQ ID NO: 154582 - DNA, 25 bp, Mus musculus
ttgtttgtcagtcccggagccggtc

SEQ ID NO: 154583 - DNA, 25 bp, Mus musculus
ttgttttataactcgggccaggtgc

SEQ ID NO: 154584 - DNA, 25 bp, Mus musculus
ttgttttctaaggaaactggaggca

SEQ ID NO: 154585 - DNA, 25 bp, Mus musculus
tttaaaaccgaaggaaagcatctgg

SEQ ID NO: 154586 - DNA, 25 bp, Mus musculus
tttaaacccttgactcctgaccagg

SEQ ID NO: 154587 - DNA, 25 bp, Mus musculus
tttaaaccggtgtgacgagaggctg

SEQ ID NO: 154588 - DNA, 25 bp, Mus musculus
tttaaacctctgaccgtcttgccca

SEQ ID NO: 154589 - DNA, 25 bp, Mus musculus
tttaaacgagtgtggcctgaagcct

SEQ ID NO: 154590 - DNA, 25 bp, Mus musculus
tttaaagagaatgggaaagctccgg

SEQ ID NO: 154591 - DNA, 25 bp, Mus musculus
tttaaagatgctgctcagagggcgg

SEQ ID NO: 154592 - DNA, 25 bp, Mus musculus
tttaaagccaagcaccgtcagacgg

SEQ ID NO: 154593 - DNA, 25 bp, Mus musculus
tttaaagccatgttcaccaacgggc

SEQ ID NO: 154594 - DNA, 25 bp, Mus musculus
tttaaagcccacagcaatgtcctgg

SEQ ID NO: 154595 - DNA, 25 bp, Mus musculus
tttaaagcccatggtcacggccgag

SEQ ID NO: 154596 - DNA, 25 bp, Mus musculus
tttaaagcggaatagggcagtgacc

SEQ ID NO: 154597 - DNA, 25 bp, Mus musculus
tttaaagcggcgactggaacagctg

SEQ ID NO: 154598 - DNA, 25 bp, Mus musculus
tttaaaggtgatcaaggccccaagg

SEQ ID NO: 154599 - DNA, 25 bp, Mus musculus
tttaaaggtgcgcgcccgagccagc

SEQ ID NO: 154600 - DNA, 25 bp, Mus musculus
tttaaagtgcgattcagccctctcc

SEQ ID NO: 154601 - DNA, 25 bp, Mus musculus
tttaaagtgctagcgcctcggttcc

SEQ ID NO: 154602 - DNA, 25 bp, Mus musculus
tttaaatactggctacacggtgccc

SEQ ID NO: 154603 - DNA, 25 bp, Mus musculus
tttaaatatcatgaagcactgtggg

SEQ ID NO: 154604 - DNA, 25 bp, Mus musculus
tttaaatgcaacagatcatttcggg

SEQ ID NO: 154605 - DNA, 25 bp, Mus musculus
tttaaattcgacaacacagacacca

SEQ ID NO: 154606 - DNA, 25 bp, Mus musculus
tttaaattcggtggccactgcgagg

SEQ ID NO: 154607 - DNA, 25 bp, Mus musculus
tttaacaccgcaactaatgagggag

SEQ ID NO: 154608 - DNA, 25 bp, Mus musculus
tttaacagacctgccaagaccagga

SEQ ID NO: 154609 - DNA, 25 bp, Mus musculus
tttaacatcagcaccgatgaccagg

SEQ ID NO: 154610 - DNA, 25 bp, Mus musculus
tttaacatccgcctagaggaactgc

SEQ ID NO: 154611 - DNA, 25 bp, Mus musculus
tttaacatggaaacacagcagcgag

SEQ ID NO: 154612 - DNA, 25 bp, Mus musculus
tttaacatgtaaaaggccccagctc

SEQ ID NO: 154613 - DNA, 25 bp, Mus musculus
tttaaccaaaatagcctggagggcg

SEQ ID NO: 154614 - DNA, 25 bp, Mus musculus
tttaaccacaggacaagagctgccc

SEQ ID NO: 154615 - DNA, 25 bp, Mus musculus
tttaaccagggatacaactttgccg

SEQ ID NO: 154616 - DNA, 25 bp, Mus musculus
tttaaccatgcacacaaggtggcca

SEQ ID NO: 154617 - DNA, 25 bp, Mus musculus
tttaacctggatgagagtggcgtgc

SEQ ID NO: 154618 - DNA, 25 bp, Mus musculus
tttaacgaggtgtcctgccagcagg

SEQ ID NO: 154619 - DNA, 25 bp, Mus musculus
tttaacggtagaccacctggccatg

SEQ ID NO: 154620 - DNA, 25 bp, Mus musculus
tttaactagccagatccgagacgtg

SEQ ID NO: 154621 - DNA, 25 bp, Mus musculus
tttaagactcggtcatctcatcgcc

SEQ ID NO: 154622 - DNA, 25 bp, Mus musculus
tttaagatgtttctgggcagtgcca

SEQ ID NO: 154623 - DNA, 25 bp, Mus musculus
tttaagcagcagtggcagaacccta

SEQ ID NO: 154624 - DNA, 25 bp, Mus musculus
tttaagcaggaaccggaggacgatc

SEQ ID NO: 154625 - DNA, 25 bp, Mus musculus
tttaagcctcatcccagcaacatgg

SEQ ID NO: 154626 - DNA, 25 bp, Mus musculus
tttaagcggtgatcagcatgaagcc

SEQ ID NO: 154627 - DNA, 25 bp, Mus musculus
tttaagctcactgcggacttccggg

SEQ ID NO: 154628 - DNA, 25 bp, Mus musculus
tttaaggaagtgtccgatggcgtcc

SEQ ID NO: 154629 - DNA, 25 bp, Mus musculus
tttaaggcgctctcagtaaagggtc

SEQ ID NO: 154630 - DNA, 25 bp, Mus musculus
tttaagggcatcaaatacctgcggc

SEQ ID NO: 154631 - DNA, 25 bp, Mus musculus
tttaaggtgctggtcatcggcgagc

SEQ ID NO: 154632 - DNA, 25 bp, Mus musculus
tttaagtacttccactccgcagagg

SEQ ID NO: 154633 - DNA, 25 bp, Mus musculus
tttaagtgccccatcaaggaggagg

SEQ ID NO: 154634 - DNA, 25 bp, Mus musculus
tttaagtggcagcagggacatcagc

SEQ ID NO: 154635 - DNA, 25 bp, Mus musculus
tttaagtgtcctgaagcccttccgg

SEQ ID NO: 154636 - DNA, 25 bp, Mus musculus
tttaatactgttggccggctgctca

SEQ ID NO: 154637 - DNA, 25 bp, Mus musculus
tttaatcaagaattcaattcccgcc

SEQ ID NO: 154638 - DNA, 25 bp, Mus musculus
tttaatcatccaaaggcaaacgggt

SEQ ID NO: 154639 - DNA, 25 bp, Mus musculus
tttaatccaccagggaagtgagctg

SEQ ID NO: 154640 - DNA, 25 bp, Mus musculus
tttaatcttgacttcaccttggctg

SEQ ID NO: 154641 - DNA, 25 bp, Mus musculus
tttaatgagccacatgccggcgtca

SEQ ID NO: 154642 - DNA, 25 bp, Mus musculus
tttaatgccgtagccactgcacact

SEQ ID NO: 154643 - DNA, 25 bp, Mus musculus
tttaatgcgccagtttgatgatgcc

SEQ ID NO: 154644 - DNA, 25 bp, Mus musculus
tttaattatgccagggaccaccagc

SEQ ID NO: 154645 - DNA, 25 bp, Mus musculus
tttaattgccacctgcaagacggcg

SEQ ID NO: 154646 - DNA, 25 bp, Mus musculus
tttacaaaagggaagtgctggacct

SEQ ID NO: 154647 - DNA, 25 bp, Mus musculus
tttacaaatgaggaccacctggcag

SEQ ID NO: 154648 - DNA, 25 bp, Mus musculus
tttacaaatgccaagacagccagga

SEQ ID NO: 154649 - DNA, 25 bp, Mus musculus
tttacaacaagaagaggtaccccag

SEQ ID NO: 154650 - DNA, 25 bp, Mus musculus
tttacaacacacacatggtaacggg

SEQ ID NO: 154651 - DNA, 25 bp, Mus musculus
tttacaaccacgacttcaagcccag

SEQ ID NO: 154652 - DNA, 25 bp, Mus musculus
tttacaagagggtaccagcagtgcc

SEQ ID NO: 154653 - DNA, 25 bp, Mus musculus
tttacaagctaagcaacatgcccag

SEQ ID NO: 154654 - DNA, 25 bp, Mus musculus
tttacaagggcagcacgaagcagac

SEQ ID NO: 154655 - DNA, 25 bp, Mus musculus
tttacaagggccaacaatgctccaa

SEQ ID NO: 154656 - DNA, 25 bp, Mus musculus
tttacaagtgtcctgtgcgactcca

SEQ ID NO: 154657 - DNA, 25 bp, Mus musculus
tttacaatgaactttgcacactggg

SEQ ID NO: 154658 - DNA, 25 bp, Mus musculus
tttacacagccgagtacagtgacag

SEQ ID NO: 154659 - DNA, 25 bp, Mus musculus
tttacaccacaggaaccgaagagtg

SEQ ID NO: 154660 - DNA, 25 bp, Mus musculus
tttacaccgtggagccaaaccgact

SEQ ID NO: 154661 - DNA, 25 bp, Mus musculus
tttacactgagggagtgaagccctg

SEQ ID NO: 154662 - DNA, 25 bp, Mus musculus
tttacagaaactcctggaccagaat

SEQ ID NO: 154663 - DNA, 25 bp, Mus musculus
tttacagcagatgtggccccaaagg

SEQ ID NO: 154664 - DNA, 25 bp, Mus musculus
tttacaggaacagacggaccaagtg

SEQ ID NO: 154665 - DNA, 25 bp, Mus musculus
tttacagttcttgtggaccgagcca

SEQ ID NO: 154666 - DNA, 25 bp, Mus musculus
tttacatcgagatctgcagggcggg

SEQ ID NO: 154667 - DNA, 25 bp, Mus musculus
tttacatgatgaggatggctcttct

SEQ ID NO: 154668 - DNA, 25 bp, Mus musculus
tttacatggcatcctacagcttcgg

SEQ ID NO: 154669 - DNA, 25 bp, Mus musculus
tttacattcggagttccgcggactc

SEQ ID NO: 154670 - DNA, 25 bp, Mus musculus
tttaccaaaggtgatggcagcccag

SEQ ID NO: 154671 - DNA, 25 bp, Mus musculus
tttaccaacctgtatgggcgccatg

SEQ ID NO: 154672 - DNA, 25 bp, Mus musculus
tttaccaccaaacctaaagcctgca

SEQ ID NO: 154673 - DNA, 25 bp, Mus musculus
tttaccagaaaatatccaaggccct

SEQ ID NO: 154674 - DNA, 25 bp, Mus musculus
tttaccagaagcgaccacttgagca

SEQ ID NO: 154675 - DNA, 25 bp, Mus musculus
tttaccagcacttaaggtgccgccg

SEQ ID NO: 154676 - DNA, 25 bp, Mus musculus
tttaccagcagcacctcaagggtgt

SEQ ID NO: 154677 - DNA, 25 bp, Mus musculus
tttaccaggctgacgctgtggcgac

SEQ ID NO: 154678 - DNA, 25 bp, Mus musculus
tttaccatccggacaagcacaggga

SEQ ID NO: 154679 - DNA, 25 bp, Mus musculus
tttaccatgaagaacgcagcaacgg

SEQ ID NO: 154680 - DNA, 25 bp, Mus musculus
tttaccccggaagcttgacgtcctg

SEQ ID NO: 154681 - DNA, 25 bp, Mus musculus
tttacccgcagtaaagagcagggtg

SEQ ID NO: 154682 - DNA, 25 bp, Mus musculus
tttacccgggagcagattgcaaggc

SEQ ID NO: 154683 - DNA, 25 bp, Mus musculus
tttaccctcgcactgggctgggaga

SEQ ID NO: 154684 - DNA, 25 bp, Mus musculus
tttaccgagagaacagccatagtgc

SEQ ID NO: 154685 - DNA, 25 bp, Mus musculus
tttaccgagatcttggactgccacc

SEQ ID NO: 154686 - DNA, 25 bp, Mus musculus
tttaccgagctctgtacatccatgc

SEQ ID NO: 154687 - DNA, 25 bp, Mus musculus
tttaccggcccatccttgaggaact

SEQ ID NO: 154688 - DNA, 25 bp, Mus musculus
tttaccgggacatcgtctgggagcc

SEQ ID NO: 154689 - DNA, 25 bp, Mus musculus
tttaccgggatgagaaggacagtgt

SEQ ID NO: 154690 - DNA, 25 bp, Mus musculus
tttacctgcgccgtggacactgaga

SEQ ID NO: 154691 - DNA, 25 bp, Mus musculus
tttaccttcaagactgctgaaattt

SEQ ID NO: 154692 - DNA, 25 bp, Mus musculus
tttaccttgcggagtgccgccctct

SEQ ID NO: 154693 - DNA, 25 bp, Mus musculus
tttacgacttggctgcccttcggga

SEQ ID NO: 154694 - DNA, 25 bp, Mus musculus
tttacgccccgcagaagaagttcgc

SEQ ID NO: 154695 - DNA, 25 bp, Mus musculus
tttacggcaggaaaacacgggcgtg

SEQ ID NO: 154696 - DNA, 25 bp, Mus musculus
tttacggctcgctacatccgcatcg

SEQ ID NO: 154697 - DNA, 25 bp, Mus musculus
tttacgtgcatgaaacggtcctggg

SEQ ID NO: 154698 - DNA, 25 bp, Mus musculus
tttacgttaacagcgctcgggactc

SEQ ID NO: 154699 - DNA, 25 bp, Mus musculus
tttactcacgtaccaaggacacact

SEQ ID NO: 154700 - DNA, 25 bp, Mus musculus
tttactcactatggaactgttcttg

SEQ ID NO: 154701 - DNA, 25 bp, Mus musculus
tttactcagacaggctgaccctaga

SEQ ID NO: 154702 - DNA, 25 bp, Mus musculus
tttactccaagaatggcgtggcctg

SEQ ID NO: 154703 - DNA, 25 bp, Mus musculus
tttactcgcagttttacaaccaacg

SEQ ID NO: 154704 - DNA, 25 bp, Mus musculus
tttactgaggttggaataaacagac

SEQ ID NO: 154705 - DNA, 25 bp, Mus musculus
tttactgcattggaacagggccgcc

SEQ ID NO: 154706 - DNA, 25 bp, Mus musculus
tttactgccctcgagagcaatcagg

SEQ ID NO: 154707 - DNA, 25 bp, Mus musculus
tttactggaaaaccgcatgccctgg

SEQ ID NO: 154708 - DNA, 25 bp, Mus musculus
tttactggaccaatccaaggagggc

SEQ ID NO: 154709 - DNA, 25 bp, Mus musculus
tttacttagcagtcggtcgcggagc

SEQ ID NO: 154710 - DNA, 25 bp, Mus musculus
tttacttcatagaccatgtggcaga

SEQ ID NO: 154711 - DNA, 25 bp, Mus musculus
tttactttgtcctttgctacctgtg

SEQ ID NO: 154712 - DNA, 25 bp, Mus musculus
tttagaagagcagctacgcagggct

SEQ ID NO: 154713 - DNA, 25 bp, Mus musculus
tttagaagtacacatgcatgtcact

SEQ ID NO: 154714 - DNA, 25 bp, Mus musculus
tttagacaagtaacagctgcgcagc

SEQ ID NO: 154715 - DNA, 25 bp, Mus musculus
tttagacacgtgtgccggtccacgc

SEQ ID NO: 154716 - DNA, 25 bp, Mus musculus
tttagacctcacaccaaatcaggag

SEQ ID NO: 154717 - DNA, 25 bp, Mus musculus
tttagagaaatcacctgctgccttg

SEQ ID NO: 154718 - DNA, 25 bp, Mus musculus
tttagagccgctcaatgaggagacg

SEQ ID NO: 154719 - DNA, 25 bp, Mus musculus
tttagagcggcaagcactggcatgg

SEQ ID NO: 154720 - DNA, 25 bp, Mus musculus
tttagagctcacacccctcattggg

SEQ ID NO: 154721 - DNA, 25 bp, Mus musculus
tttagagctctaaccagacattggc

SEQ ID NO: 154722 - DNA, 25 bp, Mus musculus
tttagagttaccaaatgtagtgtgt

SEQ ID NO: 154723 - DNA, 25 bp, Mus musculus
tttagatggtgtgcgctcctccagc

SEQ ID NO: 154724 - DNA, 25 bp, Mus musculus
tttagatgtggacgtaggagacccc

SEQ ID NO: 154725 - DNA, 25 bp, Mus musculus
tttagcagcaaagaaccgcaacggg

SEQ ID NO: 154726 - DNA, 25 bp, Mus musculus
tttagcagcacgttaacttccggga

SEQ ID NO: 154727 - DNA, 25 bp, Mus musculus
tttagcaggtggcaagcttcccgcc

SEQ ID NO: 154728 - DNA, 25 bp, Mus musculus
tttagcatatcaggaggtgtcggcg

SEQ ID NO: 154729 - DNA, 25 bp, Mus musculus
tttagccagaacagaaacccacttc

SEQ ID NO: 154730 - DNA, 25 bp, Mus musculus
tttagccagagctcacagcatgccg

SEQ ID NO: 154731 - DNA, 25 bp, Mus musculus
tttagcccaagaggaattgctcccg

SEQ ID NO: 154732 - DNA, 25 bp, Mus musculus
tttagctcctctcaaaggcagcggc

SEQ ID NO: 154733 - DNA, 25 bp, Mus musculus
tttaggaaactcaatgctcgccgga

SEQ ID NO: 154734 - DNA, 25 bp, Mus musculus
tttaggaacctcgaaaagtgagacg

SEQ ID NO: 154735 - DNA, 25 bp, Mus musculus
tttaggagcccctcaagtgtgctgg

SEQ ID NO: 154736 - DNA, 25 bp, Mus musculus
tttaggagcgatagaacgggttgca

SEQ ID NO: 154737 - DNA, 25 bp, Mus musculus
tttaggaggaagaggcgacatcaca

SEQ ID NO: 154738 - DNA, 25 bp, Mus musculus
tttaggatctcacaatacagggaag

SEQ ID NO: 154739 - DNA, 25 bp, Mus musculus
tttaggatggaagcccaaagtgcca

SEQ ID NO: 154740 - DNA, 25 bp, Mus musculus
tttaggcaaacaccagagagaagca

SEQ ID NO: 154741 - DNA, 25 bp, Mus musculus
tttaggcaaccataggactgtcacc

SEQ ID NO: 154742 - DNA, 25 bp, Mus musculus
tttaggccaaccctaccagaggaag

SEQ ID NO: 154743 - DNA, 25 bp, Mus musculus
tttaggctcagctagcagcatccag

SEQ ID NO: 154744 - DNA, 25 bp, Mus musculus
tttagggaaaccagggctgcccagg

SEQ ID NO: 154745 - DNA, 25 bp, Mus musculus
tttagggacaccacggcttatcagc

SEQ ID NO: 154746 - DNA, 25 bp, Mus musculus
tttagggagccgtacatccacgcgg

SEQ ID NO: 154747 - DNA, 25 bp, Mus musculus
tttagggtactcctgacgtccgcag

SEQ ID NO: 154748 - DNA, 25 bp, Mus musculus
tttaggtcagtcacaaacagctccg

SEQ ID NO: 154749 - DNA, 25 bp, Mus musculus
tttaggttcctgaaaaacgatggca

SEQ ID NO: 154750 - DNA, 25 bp, Mus musculus
tttagtaagcccaccagagggagac

SEQ ID NO: 154751 - DNA, 25 bp, Mus musculus
tttagtccaatgatgccttacggca

SEQ ID NO: 154752 - DNA, 25 bp, Mus musculus
tttagtccccacagcctttctagtc

SEQ ID NO: 154753 - DNA, 25 bp, Mus musculus
tttagtctttcagaaataaaaatgt

SEQ ID NO: 154754 - DNA, 25 bp, Mus musculus
tttagtggaccttgagcaactgtgc

SEQ ID NO: 154755 - DNA, 25 bp, Mus musculus
tttagtggcagtttccagcagcctg

SEQ ID NO: 154756 - DNA, 25 bp, Mus musculus
tttagttcagtagacacttggccgc

SEQ ID NO: 154757 - DNA, 25 bp, Mus musculus
tttagttggagcagtgacaaggcca

SEQ ID NO: 154758 - DNA, 25 bp, Mus musculus
tttagttgtccccaacgtcatgggc

SEQ ID NO: 154759 - DNA, 25 bp, Mus musculus
tttagtttgccactgcacgtccgtc

SEQ ID NO: 154760 - DNA, 25 bp, Mus musculus
tttataaccaaccaagtcaggcagg

SEQ ID NO: 154761 - DNA, 25 bp, Mus musculus
tttataagacgagaggtggcggaca

SEQ ID NO: 154762 - DNA, 25 bp, Mus musculus
tttataaggttgacggaagcaccct

SEQ ID NO: 154763 - DNA, 25 bp, Mus musculus
tttatacaccagaaggtccatgctg

SEQ ID NO: 154764 - DNA, 25 bp, Mus musculus
tttatagaaggagcatccctcgacc

SEQ ID NO: 154765 - DNA, 25 bp, Mus musculus
tttatagacgcttctcctccgaggg

SEQ ID NO: 154766 - DNA, 25 bp, Mus musculus
tttatagccaggaacagaggcaggc

SEQ ID NO: 154767 - DNA, 25 bp, Mus musculus
tttatagctgctgagccgaggccac

SEQ ID NO: 154768 - DNA, 25 bp, Mus musculus
tttatagggtattctcagggcagcg

SEQ ID NO: 154769 - DNA, 25 bp, Mus musculus
tttatatagagacccctcggagcgg

SEQ ID NO: 154770 - DNA, 25 bp, Mus musculus
tttatatcaccattgttgaaattaa

SEQ ID NO: 154771 - DNA, 25 bp, Mus musculus
tttatcaagaatatgcgacagcacg

SEQ ID NO: 154772 - DNA, 25 bp, Mus musculus
tttatcaggcacagagaaccagtcc

SEQ ID NO: 154773 - DNA, 25 bp, Mus musculus
tttatcatgggagcagacgaagccc

SEQ ID NO: 154774 - DNA, 25 bp, Mus musculus
tttatccaaccaaaccagactgaga

SEQ ID NO: 154775 - DNA, 25 bp, Mus musculus
tttatccatgctgcgatgaggccgg

SEQ ID NO: 154776 - DNA, 25 bp, Mus musculus
tttatcctgcgaaaaacccagcagt

SEQ ID NO: 154777 - DNA, 25 bp, Mus musculus
tttatcgccgaaaaaagagatgcca

SEQ ID NO: 154778 - DNA, 25 bp, Mus musculus
tttatcggcagggaaactcagtgcg

SEQ ID NO: 154779 - DNA, 25 bp, Mus musculus
tttatcgtggaaacagctgggccct

SEQ ID NO: 154780 - DNA, 25 bp, Mus musculus
tttatctacgctggaaggaccccga

SEQ ID NO: 154781 - DNA, 25 bp, Mus musculus
tttatctatgagaagaggcggaagc

SEQ ID NO: 154782 - DNA, 25 bp, Mus musculus
tttatctccgtgaggcaccatggcc

SEQ ID NO: 154783 - DNA, 25 bp, Mus musculus
tttatctggaaaacacaccccattc

SEQ ID NO: 154784 - DNA, 25 bp, Mus musculus
tttatcttgtgactgctcgggctgc

SEQ ID NO: 154785 - DNA, 25 bp, Mus musculus
tttatgactatgaagcacggacgga

SEQ ID NO: 154786 - DNA, 25 bp, Mus musculus
tttatgaggcgacggaaagctgact

SEQ ID NO: 154787 - DNA, 25 bp, Mus musculus
tttatgattccaaaagacagtccgg

SEQ ID NO: 154788 - DNA, 25 bp, Mus musculus
tttatgcaaaaaccacacttggacg

SEQ ID NO: 154789 - DNA, 25 bp, Mus musculus
tttatgcgcaagaggatcgaggcca

SEQ ID NO: 154790 - DNA, 25 bp, Mus musculus
tttatgctacacagcgaggacaggc

SEQ ID NO: 154791 - DNA, 25 bp, Mus musculus
tttatggattcaccgggccgcagtg

SEQ ID NO: 154792 - DNA, 25 bp, Mus musculus
tttatggccagagtcccaagtgcgc

SEQ ID NO: 154793 - DNA, 25 bp, Mus musculus
tttatggtggagagagggaccctac

SEQ ID NO: 154794 - DNA, 25 bp, Mus musculus
tttatgtagacaacgcagctccgga

SEQ ID NO: 154795 - DNA, 25 bp, Mus musculus
tttatgtctttatttgacgaaaacg

SEQ ID NO: 154796 - DNA, 25 bp, Mus musculus
tttatgtgtgcgagctgccaaggcc

SEQ ID NO: 154797 - DNA, 25 bp, Mus musculus
tttattacttgatggccaacctggc

SEQ ID NO: 154798 - DNA, 25 bp, Mus musculus
tttattccccaacaaaagcacaggg

SEQ ID NO: 154799 - DNA, 25 bp, Mus musculus
tttattcctgagtgtccgccagacg

SEQ ID NO: 154800 - DNA, 25 bp, Mus musculus
tttattgaagccagggcatgccggc

SEQ ID NO: 154801 - DNA, 25 bp, Mus musculus
tttattgactcagtctccggacggg

SEQ ID NO: 154802 - DNA, 25 bp, Mus musculus
tttatttccaagtcacagcccttgg

SEQ ID NO: 154803 - DNA, 25 bp, Mus musculus
tttcaaaacggagccgggcctgcca

SEQ ID NO: 154804 - DNA, 25 bp, Mus musculus
tttcaaaagtgagcgtgagccaggt

SEQ ID NO: 154805 - DNA, 25 bp, Mus musculus
tttcaaagaatgtccacgcagtgtc

SEQ ID NO: 154806 - DNA, 25 bp, Mus musculus
tttcaaagataacctccatgctgtg

SEQ ID NO: 154807 - DNA, 25 bp, Mus musculus
tttcaaagcccaagacgtttcaggc

SEQ ID NO: 154808 - DNA, 25 bp, Mus musculus
tttcaaaggcatccaggctcgagtc

SEQ ID NO: 154809 - DNA, 25 bp, Mus musculus
tttcaactaatggagaactagctgt

SEQ ID NO: 154810 - DNA, 25 bp, Mus musculus
tttcaagagccaaaggtggccagcg

SEQ ID NO: 154811 - DNA, 25 bp, Mus musculus
tttcaagtggaaggtcgtccgccgg

SEQ ID NO: 154812 - DNA, 25 bp, Mus musculus
tttcaatggaacaaagctggatgct

SEQ ID NO: 154813 - DNA, 25 bp, Mus musculus
tttcaatgtgaaaagcccggccgac

SEQ ID NO: 154814 - DNA, 25 bp, Mus musculus
tttcacacaaagtcggcggagctca

SEQ ID NO: 154815 - DNA, 25 bp, Mus musculus
tttcacacattactctgggccaggg

SEQ ID NO: 154816 - DNA, 25 bp, Mus musculus
tttcacacggacatggcagtggcca

SEQ ID NO: 154817 - DNA, 25 bp, Mus musculus
tttcacatcgaagagcccaagtcgg

SEQ ID NO: 154818 - DNA, 25 bp, Mus musculus
tttcaccaagaagcgaagggacatc

SEQ ID NO: 154819 - DNA, 25 bp, Mus musculus
tttcaccgcgactgaagaggacacc

SEQ ID NO: 154820 - DNA, 25 bp, Mus musculus
tttcacctgtagttctccaactgga

SEQ ID NO: 154821 - DNA, 25 bp, Mus musculus
tttcacgagcggaagatcaagctgg

SEQ ID NO: 154822 - DNA, 25 bp, Mus musculus
tttcacgcgccaagtgcagtcctgg

SEQ ID NO: 154823 - DNA, 25 bp, Mus musculus
tttcacggtgcgatgcagtgcagcg

SEQ ID NO: 154824 - DNA, 25 bp, Mus musculus
tttcactatgccaggactagaggcc

SEQ ID NO: 154825 - DNA, 25 bp, Mus musculus
tttcactcagagagggagcctggct

SEQ ID NO: 154826 - DNA, 25 bp, Mus musculus
tttcactctggtggatacggccagg

SEQ ID NO: 154827 - DNA, 25 bp, Mus musculus
tttcactgaggtgcacgagggacgc

SEQ ID NO: 154828 - DNA, 25 bp, Mus musculus
tttcagaaagcgagggatggcaacc

SEQ ID NO: 154829 - DNA, 25 bp, Mus musculus
tttcagaacgacaggaccgaggacg

SEQ ID NO: 154830 - DNA, 25 bp, Mus musculus
tttcagaacgcaacagggtccggga

SEQ ID NO: 154831 - DNA, 25 bp, Mus musculus
tttcagaagtgtcctagccacaggg

SEQ ID NO: 154832 - DNA, 25 bp, Mus musculus
tttcagaattgccaccctgggaccc

SEQ ID NO: 154833 - DNA, 25 bp, Mus musculus
tttcagaccccgtcgcaaaggagag

SEQ ID NO: 154834 - DNA, 25 bp, Mus musculus
tttcagaccggccggaggagtccat

SEQ ID NO: 154835 - DNA, 25 bp, Mus musculus
tttcagacttcatgaactcccagtg

SEQ ID NO: 154836 - DNA, 25 bp, Mus musculus
tttcagagaaatccttaccaaagca

SEQ ID NO: 154837 - DNA, 25 bp, Mus musculus
tttcagagatactgtccaggtcagc

SEQ ID NO: 154838 - DNA, 25 bp, Mus musculus
tttcagagcctgacctagacgggtc

SEQ ID NO: 154839 - DNA, 25 bp, Mus musculus
tttcagataaacacccagtcagacc

SEQ ID NO: 154840 - DNA, 25 bp, Mus musculus
tttcagatcgagtggagcggcggct

SEQ ID NO: 154841 - DNA, 25 bp, Mus musculus
tttcagattgtgcacgctgatgacc

SEQ ID NO: 154842 - DNA, 25 bp, Mus musculus
tttcagcagagaggagtggcagcat

SEQ ID NO: 154843 - DNA, 25 bp, Mus musculus
tttcagcagagcaactggcacaccg

SEQ ID NO: 154844 - DNA, 25 bp, Mus musculus
tttcagcagctgaactaccagagac

SEQ ID NO: 154845 - DNA, 25 bp, Mus musculus
tttcagccatgcacagactgtggtt

SEQ ID NO: 154846 - DNA, 25 bp, Mus musculus
tttcagccggcttccaaacactggg

SEQ ID NO: 154847 - DNA, 25 bp, Mus musculus
tttcagctcaaagccaatccgggag

SEQ ID NO: 154848 - DNA, 25 bp, Mus musculus
tttcagctcagggtccgtccagatg

SEQ ID NO: 154849 - DNA, 25 bp, Mus musculus
tttcagcttttaacccgcgcgggag

SEQ ID NO: 154850 - DNA, 25 bp, Mus musculus
tttcaggaaacacgagcgggtaact

SEQ ID NO: 154851 - DNA, 25 bp, Mus musculus
tttcaggcataaggctctgctccag

SEQ ID NO: 154852 - DNA, 25 bp, Mus musculus
tttcaggccacaaatgcgttcacag

SEQ ID NO: 154853 - DNA, 25 bp, Mus musculus
tttcaggccagtgaaaacctgccgg

SEQ ID NO: 154854 - DNA, 25 bp, Mus musculus
tttcagggaagagccaagtcctgtt

SEQ ID NO: 154855 - DNA, 25 bp, Mus musculus
tttcagggagctagccgacgctgtc

SEQ ID NO: 154856 - DNA, 25 bp, Mus musculus
tttcagggcaggtattcaggttagg

SEQ ID NO: 154857 - DNA, 25 bp, Mus musculus
tttcagggccctcaaatctagacga

SEQ ID NO: 154858 - DNA, 25 bp, Mus musculus
tttcagtagcatgtggccgtccagg

SEQ ID NO: 154859 - DNA, 25 bp, Mus musculus
tttcagtatgagacacgttatgcag

SEQ ID NO: 154860 - DNA, 25 bp, Mus musculus
tttcagtcacacagtgcccgagctg

SEQ ID NO: 154861 - DNA, 25 bp, Mus musculus
tttcagtctcatcgcccacaacttg

SEQ ID NO: 154862 - DNA, 25 bp, Mus musculus
tttcagtgactctccagtttggccc

SEQ ID NO: 154863 - DNA, 25 bp, Mus musculus
tttcagtgcgcagttttgagggtcc

SEQ ID NO: 154864 - DNA, 25 bp, Mus musculus
tttcagtgctctttgggtgctcccc

SEQ ID NO: 154865 - DNA, 25 bp, Mus musculus
tttcagttggtgagccagtgccctc

SEQ ID NO: 154866 - DNA, 25 bp, Mus musculus
tttcagtttcatttccgcggaccct

SEQ ID NO: 154867 - DNA, 25 bp, Mus musculus
tttcataaggatcctctgaagcccc

SEQ ID NO: 154868 - DNA, 25 bp, Mus musculus
tttcatagcagagcccagtgacggt

SEQ ID NO: 154869 - DNA, 25 bp, Mus musculus
tttcatcagatacaagggccaggag

SEQ ID NO: 154870 - DNA, 25 bp, Mus musculus
tttcatccgggagaagtacatggcc

SEQ ID NO: 154871 - DNA, 25 bp, Mus musculus
tttcatctgcaagggccaaagaccg

SEQ ID NO: 154872 - DNA, 25 bp, Mus musculus
tttcatgaataaccaggcctcacgg

SEQ ID NO: 154873 - DNA, 25 bp, Mus musculus
tttcatggtccataatcggaagggc

SEQ ID NO: 154874 - DNA, 25 bp, Mus musculus
tttcatgtgtgcgtcatcctggcca

SEQ ID NO: 154875 - DNA, 25 bp, Mus musculus
tttcattagcaaggcccaacagagg

SEQ ID NO: 154876 - DNA, 25 bp, Mus musculus
tttcattcaaaagcttcaggtcctc

SEQ ID NO: 154877 - DNA, 25 bp, Mus musculus
tttccaaaaacccatatctgagtgt

SEQ ID NO: 154878 - DNA, 25 bp, Mus musculus
tttccaaaacaaccaggcacttacg

SEQ ID NO: 154879 - DNA, 25 bp, Mus musculus
tttccaaaagtgcaacgacgccaga

SEQ ID NO: 154880 - DNA, 25 bp, Mus musculus
tttccaaatgtaacaagggctccag

SEQ ID NO: 154881 - DNA, 25 bp, Mus musculus
tttccaacagcggagccacagtggt

SEQ ID NO: 154882 - DNA, 25 bp, Mus musculus
tttccaagcctcttcatcaaccagt

SEQ ID NO: 154883 - DNA, 25 bp, Mus musculus
tttccaagtgccaaagagcccagaa

SEQ ID NO: 154884 - DNA, 25 bp, Mus musculus
tttccaatatgaatgcagcccgggc

SEQ ID NO: 154885 - DNA, 25 bp, Mus musculus
tttccaatgtggctctgtcagacga

SEQ ID NO: 154886 - DNA, 25 bp, Mus musculus
tttccacatgtgtgatgtgccctgc

SEQ ID NO: 154887 - DNA, 25 bp, Mus musculus
tttccactactcacaaggacaggtg

SEQ ID NO: 154888 - DNA, 25 bp, Mus musculus
tttccactgggataggcatggcacc

SEQ ID NO: 154889 - DNA, 25 bp, Mus musculus
tttccagaaaggtccccactagagg

SEQ ID NO: 154890 - DNA, 25 bp, Mus musculus
tttccagaagcataggccaggaggc

SEQ ID NO: 154891 - DNA, 25 bp, Mus musculus
tttccagacgagtacttcacctgct

SEQ ID NO: 154892 - DNA, 25 bp, Mus musculus
tttccagagacgagaagagcgtgct

SEQ ID NO: 154893 - DNA, 25 bp, Mus musculus
tttccagaggagataaaagatagga

SEQ ID NO: 154894 - DNA, 25 bp, Mus musculus
tttccagcggatagagacatgcact

SEQ ID NO: 154895 - DNA, 25 bp, Mus musculus
tttccagcgttttgaagagccagcc

SEQ ID NO: 154896 - DNA, 25 bp, Mus musculus
tttccaggagttcgacattagcgga

SEQ ID NO: 154897 - DNA, 25 bp, Mus musculus
tttccaggcagtaatggagtcccca

SEQ ID NO: 154898 - DNA, 25 bp, Mus musculus
tttccagggatacgcgcgctcagcg

SEQ ID NO: 154899 - DNA, 25 bp, Mus musculus
tttccagtaaactccgcggcctgct

SEQ ID NO: 154900 - DNA, 25 bp, Mus musculus
tttccagtcgggacaagtatggtcg

SEQ ID NO: 154901 - DNA, 25 bp, Mus musculus
tttccagtgaaccatggcgccagct

SEQ ID NO: 154902 - DNA, 25 bp, Mus musculus
tttccagttctggtcagggagctct

SEQ ID NO: 154903 - DNA, 25 bp, Mus musculus
tttccatcggccataagcagctgct

SEQ ID NO: 154904 - DNA, 25 bp, Mus musculus
tttccatgaaaacaagccctcgagg

SEQ ID NO: 154905 - DNA, 25 bp, Mus musculus
tttccatgcacaggtcagaagctgc

SEQ ID NO: 154906 - DNA, 25 bp, Mus musculus
tttccatggtgacagtaaacaagcc

SEQ ID NO: 154907 - DNA, 25 bp, Mus musculus
tttccatggtgaggagccacttgcc

SEQ ID NO: 154908 - DNA, 25 bp, Mus musculus
tttcccaagggagtctggagccccg

SEQ ID NO: 154909 - DNA, 25 bp, Mus musculus
tttcccaaggttcctgacagctatg

SEQ ID NO: 154910 - DNA, 25 bp, Mus musculus
tttcccaccaaccatgagaggatga

SEQ ID NO: 154911 - DNA, 25 bp, Mus musculus
tttcccagcgagttttctgccacgg

SEQ ID NO: 154912 - DNA, 25 bp, Mus musculus
tttcccaggagccagtgatgcagat

SEQ ID NO: 154913 - DNA, 25 bp, Mus musculus
tttcccataacctgtgcacggtgct

SEQ ID NO: 154914 - DNA, 25 bp, Mus musculus
tttcccatccctaggcactggcagg

SEQ ID NO: 154915 - DNA, 25 bp, Mus musculus
tttccccaggccagagaaagctgtg

SEQ ID NO: 154916 - DNA, 25 bp, Mus musculus
tttccccggagtgaaactacgctca

SEQ ID NO: 154917 - DNA, 25 bp, Mus musculus
tttcccgagagcgagagtggctcgt

SEQ ID NO: 154918 - DNA, 25 bp, Mus musculus
tttcccgaggcgtgggtgccctcgc

SEQ ID NO: 154919 - DNA, 25 bp, Mus musculus
tttcccgatgacgtggtgcagccag

SEQ ID NO: 154920 - DNA, 25 bp, Mus musculus
tttcccgatggatgtacagacgtgt

SEQ ID NO: 154921 - DNA, 25 bp, Mus musculus
tttcccgctggcttgtatgaggcac

SEQ ID NO: 154922 - DNA, 25 bp, Mus musculus
tttcccggcaggagcgaggcaggga

SEQ ID NO: 154923 - DNA, 25 bp, Mus musculus
tttcccgggatacctgcaactcaag

SEQ ID NO: 154924 - DNA, 25 bp, Mus musculus
tttcccggggacaatgtgggactga

SEQ ID NO: 154925 - DNA, 25 bp, Mus musculus
tttccctacgttaaggtgcacacgg

SEQ ID NO: 154926 - DNA, 25 bp, Mus musculus
tttccctcagatagcagcggccatg

SEQ ID NO: 154927 - DNA, 25 bp, Mus musculus
tttccctggagcacgagatcctcct

SEQ ID NO: 154928 - DNA, 25 bp, Mus musculus
tttccctgtacagcagagactctgg

SEQ ID NO: 154929 - DNA, 25 bp, Mus musculus
tttccctttgcgcagttgaggacct

SEQ ID NO: 154930 - DNA, 25 bp, Mus musculus
tttccgacctccatgcacctggtga

SEQ ID NO: 154931 - DNA, 25 bp, Mus musculus
tttccgacgcgcttggagtgaacta

SEQ ID NO: 154932 - DNA, 25 bp, Mus musculus
tttccgagcgaggactgcgtgacgt

SEQ ID NO: 154933 - DNA, 25 bp, Mus musculus
tttccgaggaggagccatgtaccag

SEQ ID NO: 154934 - DNA, 25 bp, Mus musculus
tttccgcgttcacgccgtcgtgagg

SEQ ID NO: 154935 - DNA, 25 bp, Mus musculus
tttccgcttccctccagggcggtgg

SEQ ID NO: 154936 - DNA, 25 bp, Mus musculus
tttccggaaaagttctgagcagcag

SEQ ID NO: 154937 - DNA, 25 bp, Mus musculus
tttccggaagcgaagccttgtcctc

SEQ ID NO: 154938 - DNA, 25 bp, Mus musculus
tttccggaagtgcatcgggaagccc

SEQ ID NO: 154939 - DNA, 25 bp, Mus musculus
tttccggagctcgcggcctgtgcgt

SEQ ID NO: 154940 - DNA, 25 bp, Mus musculus
tttccggcagcgaacgctgagccct

SEQ ID NO: 154941 - DNA, 25 bp, Mus musculus
tttccggcggtcagaacgaagatgc

SEQ ID NO: 154942 - DNA, 25 bp, Mus musculus
tttccgggcggtgttcctggaccag

SEQ ID NO: 154943 - DNA, 25 bp, Mus musculus
tttccggttgactaagacgtgggcg

SEQ ID NO: 154944 - DNA, 25 bp, Mus musculus
tttccgtagatttccagtggcccca

SEQ ID NO: 154945 - DNA, 25 bp, Mus musculus
tttccgtggcaacaccaagtttact

SEQ ID NO: 154946 - DNA, 25 bp, Mus musculus
tttccgtggctcttgcagcagcagc

SEQ ID NO: 154947 - DNA, 25 bp, Mus musculus
tttccgtgtgcaccaaggcaagggc

SEQ ID NO: 154948 - DNA, 25 bp, Mus musculus
tttcctacgtgggtcataagtgtcc

SEQ ID NO: 154949 - DNA, 25 bp, Mus musculus
tttcctaggaactcgagggccgcgg

SEQ ID NO: 154950 - DNA, 25 bp, Mus musculus
tttcctatgacagttctgatcagac

SEQ ID NO: 154951 - DNA, 25 bp, Mus musculus
tttcctatgagcaaccatacccggg

SEQ ID NO: 154952 - DNA, 25 bp, Mus musculus
tttcctcactagcaaggccagggag

SEQ ID NO: 154953 - DNA, 25 bp, Mus musculus
tttcctccaaagacgagagcatcgg

SEQ ID NO: 154954 - DNA, 25 bp, Mus musculus
tttcctccccaatgacaagtccgtg

SEQ ID NO: 154955 - DNA, 25 bp, Mus musculus
tttcctgaccccaagtagagagtag

SEQ ID NO: 154956 - DNA, 25 bp, Mus musculus
tttcctgacctaggccagaggcatt

SEQ ID NO: 154957 - DNA, 25 bp, Mus musculus
tttcctgagatagagacctgcgtgg

SEQ ID NO: 154958 - DNA, 25 bp, Mus musculus
tttcctgagcccttagacttctgag

SEQ ID NO: 154959 - DNA, 25 bp, Mus musculus
tttcctgataaagtggccctgctgc

SEQ ID NO: 154960 - DNA, 25 bp, Mus musculus
tttcctgcctcttggcattttagca

SEQ ID NO: 154961 - DNA, 25 bp, Mus musculus
tttcctggcacgttcgaatcagcgt

SEQ ID NO: 154962 - DNA, 25 bp, Mus musculus
tttcctggcaggacatcagagcacc

SEQ ID NO: 154963 - DNA, 25 bp, Mus musculus
tttcctgggaaggagaatcacctgc

SEQ ID NO: 154964 - DNA, 25 bp, Mus musculus
tttcctgtactgcaatccgggtgac

SEQ ID NO: 154965 - DNA, 25 bp, Mus musculus
tttcctgtatgaagcggttggcacc

SEQ ID NO: 154966 - DNA, 25 bp, Mus musculus
tttcctgtgaggtgaaggctgtgcc

SEQ ID NO: 154967 - DNA, 25 bp, Mus musculus
tttcctgtttgggagcggcctgcct

SEQ ID NO: 154968 - DNA, 25 bp, Mus musculus
tttccttagagaactgtacacagcc

SEQ ID NO: 154969 - DNA, 25 bp, Mus musculus
tttccttccccattcaccgtagtag

SEQ ID NO: 154970 - DNA, 25 bp, Mus musculus
tttccttggagaggcggaggtccac

SEQ ID NO: 154971 - DNA, 25 bp, Mus musculus
tttcgaaagatgcttgttttgagac

SEQ ID NO: 154972 - DNA, 25 bp, Mus musculus
tttcgaacagcaatcagacacccag

SEQ ID NO: 154973 - DNA, 25 bp, Mus musculus
tttcgaacaggacaacgagagcagc

SEQ ID NO: 154974 - DNA, 25 bp, Mus musculus
tttcgaagattttgtcagtggatgg

SEQ ID NO: 154975 - DNA, 25 bp, Mus musculus
tttcgaaggacggagagctgcttac

SEQ ID NO: 154976 - DNA, 25 bp, Mus musculus
tttcgacccgtttatgcacctaagg

SEQ ID NO: 154977 - DNA, 25 bp, Mus musculus
tttcgagaggaagctggaccagacc

SEQ ID NO: 154978 - DNA, 25 bp, Mus musculus
tttcgagctgtgctttcgctttccc

SEQ ID NO: 154979 - DNA, 25 bp, Mus musculus
tttcgaggcacacacgtaccaggag

SEQ ID NO: 154980 - DNA, 25 bp, Mus musculus
tttcgagggctctgtgcgctggcaa

SEQ ID NO: 154981 - DNA, 25 bp, Mus musculus
tttcgatagcgataggagtggcacc

SEQ ID NO: 154982 - DNA, 25 bp, Mus musculus
tttcgatgctgtgctccacgaccaa

SEQ ID NO: 154983 - DNA, 25 bp, Mus musculus
tttcgattcaagacctatgcgcctg

SEQ ID NO: 154984 - DNA, 25 bp, Mus musculus
tttcgcagatcaaaaagtggtcccg

SEQ ID NO: 154985 - DNA, 25 bp, Mus musculus
tttcgcatcgtgcacgagacagccg

SEQ ID NO: 154986 - DNA, 25 bp, Mus musculus
tttcgccagtggtcggtgcagtcag

SEQ ID NO: 154987 - DNA, 25 bp, Mus musculus
tttcgcctatgcaaaaaacggaaca

SEQ ID NO: 154988 - DNA, 25 bp, Mus musculus
tttcgctacggagaaacgagtccgg

SEQ ID NO: 154989 - DNA, 25 bp, Mus musculus
tttcggaagagtccccaagagctgc

SEQ ID NO: 154990 - DNA, 25 bp, Mus musculus
tttcggaagcactgccacgggtcgt

SEQ ID NO: 154991 - DNA, 25 bp, Mus musculus
tttcggacaccccttgctgctcaga

SEQ ID NO: 154992 - DNA, 25 bp, Mus musculus
tttcggactaaggagaacctcagcc

SEQ ID NO: 154993 - DNA, 25 bp, Mus musculus
tttcggatatcatcgcccttctcac

SEQ ID NO: 154994 - DNA, 25 bp, Mus musculus
tttcggcatggagaccgaggtccca

SEQ ID NO: 154995 - DNA, 25 bp, Mus musculus
tttcggccactctcgagaacaggcc

SEQ ID NO: 154996 - DNA, 25 bp, Mus musculus
tttcgggagaagatccaccacttgg

SEQ ID NO: 154997 - DNA, 25 bp, Mus musculus
tttcgggagcaaagcagttaccacg

SEQ ID NO: 154998 - DNA, 25 bp, Mus musculus
tttcgggaggaaagtattgcagcca

SEQ ID NO: 154999 - DNA, 25 bp, Mus musculus
tttcgggagtgaagctaaagccaga

SEQ ID NO: 155000 - DNA, 25 bp, Mus musculus
tttcggggcctcaaccggatccaga

SEQ ID NO: 155001 - DNA, 25 bp, Mus musculus
tttcggggttcaagtgtcgccgagc

SEQ ID NO: 155002 - DNA, 25 bp, Mus musculus
tttcggtcctgagcaccgagcaggg

SEQ ID NO: 155003 - DNA, 25 bp, Mus musculus
tttcgtaagggcacactgggtaagc

SEQ ID NO: 155004 - DNA, 25 bp, Mus musculus
tttcgtgagatgaccgacccttcgc

SEQ ID NO: 155005 - DNA, 25 bp, Mus musculus
tttcgtgagcagttcctgggcggca

SEQ ID NO: 155006 - DNA, 25 bp, Mus musculus
tttcgttgtggaccagagccaagct

SEQ ID NO: 155007 - DNA, 25 bp, Mus musculus
tttctaacaaactggagatctccct

SEQ ID NO: 155008 - DNA, 25 bp, Mus musculus
tttctaacttcttcactgtgtgccc

SEQ ID NO: 155009 - DNA, 25 bp, Mus musculus
tttctaaggcggtggccaaggcagc

SEQ ID NO: 155010 - DNA, 25 bp, Mus musculus
tttctaatgtggacagctcgaggcc

SEQ ID NO: 155011 - DNA, 25 bp, Mus musculus
tttctacaaaacctggcaccacgtg

SEQ ID NO: 155012 - DNA, 25 bp, Mus musculus
tttctacaaatctcggcaggatccg

SEQ ID NO: 155013 - DNA, 25 bp, Mus musculus
tttctacagacatggggtatccatc

SEQ ID NO: 155014 - DNA, 25 bp, Mus musculus
tttctacagaggctccggctgcagg

SEQ ID NO: 155015 - DNA, 25 bp, Mus musculus
tttctaccctggagtgcgctgctgt

SEQ ID NO: 155016 - DNA, 25 bp, Mus musculus
tttctacctggcactggaggacggt

SEQ ID NO: 155017 - DNA, 25 bp, Mus musculus
tttctagacctgaagcagggacgct

SEQ ID NO: 155018 - DNA, 25 bp, Mus musculus
tttctagagcaataatcagtggtgc

SEQ ID NO: 155019 - DNA, 25 bp, Mus musculus
tttctagaggaaacagtggagcgca

SEQ ID NO: 155020 - DNA, 25 bp, Mus musculus
tttctaggacaaacaaagccacgcc

SEQ ID NO: 155021 - DNA, 25 bp, Mus musculus
tttctagtggcgacaaggaccctgg

SEQ ID NO: 155022 - DNA, 25 bp, Mus musculus
tttctattgtacagaagcaattcgc

SEQ ID NO: 155023 - DNA, 25 bp, Mus musculus
tttctcacacagtggcaaagacgct

SEQ ID NO: 155024 - DNA, 25 bp, Mus musculus
tttctcacacgcagatgaacactgg

SEQ ID NO: 155025 - DNA, 25 bp, Mus musculus
tttctcagaaaaatgcagggctgca

SEQ ID NO: 155026 - DNA, 25 bp, Mus musculus
tttctcagcaatccgtgccaggcgt

SEQ ID NO: 155027 - DNA, 25 bp, Mus musculus
tttctcatcaggaagccacacgctg

SEQ ID NO: 155028 - DNA, 25 bp, Mus musculus
tttctcatccgaaaggggcctggca

SEQ ID NO: 155029 - DNA, 25 bp, Mus musculus
tttctccacctaccagcctagaggt

SEQ ID NO: 155030 - DNA, 25 bp, Mus musculus
tttctcccaccagagcccggaacat

SEQ ID NO: 155031 - DNA, 25 bp, Mus musculus
tttctccgcctctaagttcttgtcc

SEQ ID NO: 155032 - DNA, 25 bp, Mus musculus
tttctccggcctattgggcgccgcg

SEQ ID NO: 155033 - DNA, 25 bp, Mus musculus
tttctcctcttctcgcgatagtggg

SEQ ID NO: 155034 - DNA, 25 bp, Mus musculus
tttctcctttgttccggcgtcagtg

SEQ ID NO: 155035 - DNA, 25 bp, Mus musculus
tttctcggatgaaggcggctggctc

SEQ ID NO: 155036 - DNA, 25 bp, Mus musculus
tttctcgggactgcgaagctctacc

SEQ ID NO: 155037 - DNA, 25 bp, Mus musculus
tttctcgttgcagggatggcggcca

SEQ ID NO: 155038 - DNA, 25 bp, Mus musculus
tttctctaaaggacactcagggtgg

SEQ ID NO: 155039 - DNA, 25 bp, Mus musculus
tttctctcctcttgtccatggccag

SEQ ID NO: 155040 - DNA, 25 bp, Mus musculus
tttctctgaacggtcacggccagtg

SEQ ID NO: 155041 - DNA, 25 bp, Mus musculus
tttctcttaggaccagccacattag

SEQ ID NO: 155042 - DNA, 25 bp, Mus musculus
tttctgaaaaacagcaacctgcggc

SEQ ID NO: 155043 - DNA, 25 bp, Mus musculus
tttctgaagcaaatacctcggtgcc

SEQ ID NO: 155044 - DNA, 25 bp, Mus musculus
tttctgaagcagcttattgctggca

SEQ ID NO: 155045 - DNA, 25 bp, Mus musculus
tttctgacaggtgtgtgcgccatca

SEQ ID NO: 155046 - DNA, 25 bp, Mus musculus
tttctgagaaccctcgaccggtggc

SEQ ID NO: 155047 - DNA, 25 bp, Mus musculus
tttctgagcctctagcatggcgggc

SEQ ID NO: 155048 - DNA, 25 bp, Mus musculus
tttctgagctacaaagtctacgtcc

SEQ ID NO: 155049 - DNA, 25 bp, Mus musculus
tttctgaggcggacaggactcgtgt

SEQ ID NO: 155050 - DNA, 25 bp, Mus musculus
tttctgagtgttgaaaatggatggg

SEQ ID NO: 155051 - DNA, 25 bp, Mus musculus
tttctgcaaataaaagatgggtgga

SEQ ID NO: 155052 - DNA, 25 bp, Mus musculus
tttctgccctgaacgtgcacccagg

SEQ ID NO: 155053 - DNA, 25 bp, Mus musculus
tttctgctgcgccatcgaaggccaa

SEQ ID NO: 155054 - DNA, 25 bp, Mus musculus
tttctggaaagaagggcctgtccca

SEQ ID NO: 155055 - DNA, 25 bp, Mus musculus
tttctggaacaacacccaaatggtg

SEQ ID NO: 155056 - DNA, 25 bp, Mus musculus
tttctggaaccagaaggccggtgcg

SEQ ID NO: 155057 - DNA, 25 bp, Mus musculus
tttctggaggaaccagcctcaggcc

SEQ ID NO: 155058 - DNA, 25 bp, Mus musculus
tttctggagggaatctggcctaggc

SEQ ID NO: 155059 - DNA, 25 bp, Mus musculus
tttctggctactgaccattttgctg

SEQ ID NO: 155060 - DNA, 25 bp, Mus musculus
tttctggctatgaagagctcctggc

SEQ ID NO: 155061 - DNA, 25 bp, Mus musculus
tttctggctctaccctctatcactg

SEQ ID NO: 155062 - DNA, 25 bp, Mus musculus
tttctggcttcaggaggcggctttc

SEQ ID NO: 155063 - DNA, 25 bp, Mus musculus
tttctgggcaaaccctggtcctcct

SEQ ID NO: 155064 - DNA, 25 bp, Mus musculus
tttctgggtccctccgagctttagg

SEQ ID NO: 155065 - DNA, 25 bp, Mus musculus
tttctggtcctcagctgtctcctca

SEQ ID NO: 155066 - DNA, 25 bp, Mus musculus
tttctggtgaacacagcccgtggtg

SEQ ID NO: 155067 - DNA, 25 bp, Mus musculus
tttctggtgggcaatgtggatgaaa

SEQ ID NO: 155068 - DNA, 25 bp, Mus musculus
tttctgtaagcctgtccccgatggg

SEQ ID NO: 155069 - DNA, 25 bp, Mus musculus
tttctgtggcaacgagaggccagct

SEQ ID NO: 155070 - DNA, 25 bp, Mus musculus
tttctgtggcaactcaggtcggctg

SEQ ID NO: 155071 - DNA, 25 bp, Mus musculus
tttcttatccgcaactgcacagtca

SEQ ID NO: 155072 - DNA, 25 bp, Mus musculus
tttcttatccgcgagagcgaaacca

SEQ ID NO: 155073 - DNA, 25 bp, Mus musculus
tttcttcaacggactttcacggaca

SEQ ID NO: 155074 - DNA, 25 bp, Mus musculus
tttcttcaatgaccggccgtggagg

SEQ ID NO: 155075 - DNA, 25 bp, Mus musculus
tttcttcacagtcagatgctctggg

SEQ ID NO: 155076 - DNA, 25 bp, Mus musculus
tttcttcaccaatcacttctttgac

SEQ ID NO: 155077 - DNA, 25 bp, Mus musculus
tttcttcagagcaggcaaccgcact

SEQ ID NO: 155078 - DNA, 25 bp, Mus musculus
tttcttgaccaaattaacagggctt

SEQ ID NO: 155079 - DNA, 25 bp, Mus musculus
tttcttgacgataggagcggctccc

SEQ ID NO: 155080 - DNA, 25 bp, Mus musculus
tttcttgccctccactgatttattg

SEQ ID NO: 155081 - DNA, 25 bp, Mus musculus
tttcttggaagatggccactatgca

SEQ ID NO: 155082 - DNA, 25 bp, Mus musculus
tttcttggaagtagccgatgaggcc

SEQ ID NO: 155083 - DNA, 25 bp, Mus musculus
tttctttggctttgggaacggcata

SEQ ID NO: 155084 - DNA, 25 bp, Mus musculus
tttgaaaacaggagtggtccactgc

SEQ ID NO: 155085 - DNA, 25 bp, Mus musculus
tttgaaaaccaggtggacatgaaag

SEQ ID NO: 155086 - DNA, 25 bp, Mus musculus
tttgaaaaccgtggtcgagtcctgc

SEQ ID NO: 155087 - DNA, 25 bp, Mus musculus
tttgaaaatatacagagccacttgg

SEQ ID NO: 155088 - DNA, 25 bp, Mus musculus
tttgaaaatgcacaccacagagagg

SEQ ID NO: 155089 - DNA, 25 bp, Mus musculus
tttgaaacagatgaacggtaccggc

SEQ ID NO: 155090 - DNA, 25 bp, Mus musculus
tttgaaaccgacaacaacatcgtag

SEQ ID NO: 155091 - DNA, 25 bp, Mus musculus
tttgaaacctacatgtccaaggagg

SEQ ID NO: 155092 - DNA, 25 bp, Mus musculus
tttgaaagacttccaacgcgcagcg

SEQ ID NO: 155093 - DNA, 25 bp, Mus musculus
tttgaaagagcacttcccaacgctg

SEQ ID NO: 155094 - DNA, 25 bp, Mus musculus
tttgaaagcctcatgtacggacaca

SEQ ID NO: 155095 - DNA, 25 bp, Mus musculus
tttgaaaggcaaactctaggaggct

SEQ ID NO: 155096 - DNA, 25 bp, Mus musculus
tttgaaatggtcaccacgctgctgg

SEQ ID NO: 155097 - DNA, 25 bp, Mus musculus
tttgaacagattctttaaactggac

SEQ ID NO: 155098 - DNA, 25 bp, Mus musculus
tttgaacaggatcgtggtgcacccc

SEQ ID NO: 155099 - DNA, 25 bp, Mus musculus
tttgaaccaagtgcagacatagcct

SEQ ID NO: 155100 - DNA, 25 bp, Mus musculus
tttgaacccttcactgctgcccgcc

SEQ ID NO: 155101 - DNA, 25 bp, Mus musculus
tttgaaccgtaccacgacagtgcgc

SEQ ID NO: 155102 - DNA, 25 bp, Mus musculus
tttgaacctgatcaccagcaacagg

SEQ ID NO: 155103 - DNA, 25 bp, Mus musculus
tttgaacctgatccccagccagtgt

SEQ ID NO: 155104 - DNA, 25 bp, Mus musculus
tttgaacgcatcatacagaacctgg

SEQ ID NO: 155105 - DNA, 25 bp, Mus musculus
tttgaactctgggtaaagaggccgt

SEQ ID NO: 155106 - DNA, 25 bp, Mus musculus
tttgaagactcccaatggctgcgag

SEQ ID NO: 155107 - DNA, 25 bp, Mus musculus
tttgaagagccaggcagctacctgc

SEQ ID NO: 155108 - DNA, 25 bp, Mus musculus
tttgaagagcttgtgcgagcctcca

SEQ ID NO: 155109 - DNA, 25 bp, Mus musculus
tttgaagagttaacacaccaggtgc

SEQ ID NO: 155110 - DNA, 25 bp, Mus musculus
tttgaagccactctccagcagctgg

SEQ ID NO: 155111 - DNA, 25 bp, Mus musculus
tttgaagcgctgaccgttgtgatcc

SEQ ID NO: 155112 - DNA, 25 bp, Mus musculus
tttgaagctatgctggacctgcaat

SEQ ID NO: 155113 - DNA, 25 bp, Mus musculus
tttgaagctcgcgtggtgcatggcc

SEQ ID NO: 155114 - DNA, 25 bp, Mus musculus
tttgaaggaccccagcgagctcctg

SEQ ID NO: 155115 - DNA, 25 bp, Mus musculus
tttgaaggcctagagagcagcacgg

SEQ ID NO: 155116 - DNA, 25 bp, Mus musculus
tttgaaggcggcacagaagccacag

SEQ ID NO: 155117 - DNA, 25 bp, Mus musculus
tttgaaggctccattgcaagcaagg

SEQ ID NO: 155118 - DNA, 25 bp, Mus musculus
tttgaagtgatggaaccgacctggc

SEQ ID NO: 155119 - DNA, 25 bp, Mus musculus
tttgaagttttcataagatgtggtc

SEQ ID NO: 155120 - DNA, 25 bp, Mus musculus
tttgaataaagtagacaggctgctg

SEQ ID NO: 155121 - DNA, 25 bp, Mus musculus
tttgaatacgagtggtcaccagtgg

SEQ ID NO: 155122 - DNA, 25 bp, Mus musculus
tttgaatcgccctcccatgggaatc

SEQ ID NO: 155123 - DNA, 25 bp, Mus musculus
tttgaatcgcgcttccgccatcttt

SEQ ID NO: 155124 - DNA, 25 bp, Mus musculus
tttgaatgaggcttgtcgcaccgga

SEQ ID NO: 155125 - DNA, 25 bp, Mus musculus
tttgaatgtaaccttgattgttatc

SEQ ID NO: 155126 - DNA, 25 bp, Mus musculus
tttgaattctgtgaacccgcatttg

SEQ ID NO: 155127 - DNA, 25 bp, Mus musculus
tttgacaaaaggctcaggtacagcg

SEQ ID NO: 155128 - DNA, 25 bp, Mus musculus
tttgacaaacagtattcgaaagaac

SEQ ID NO: 155129 - DNA, 25 bp, Mus musculus
tttgacaaaggtggtagagcctccc

SEQ ID NO: 155130 - DNA, 25 bp, Mus musculus
tttgacaaccatatccacacggcgg

SEQ ID NO: 155131 - DNA, 25 bp, Mus musculus
tttgacaacttaaacgccgcccatg

SEQ ID NO: 155132 - DNA, 25 bp, Mus musculus
tttgacaagggattggcaccaagac

SEQ ID NO: 155133 - DNA, 25 bp, Mus musculus
tttgacaagttctcacccaagctgg

SEQ ID NO: 155134 - DNA, 25 bp, Mus musculus
tttgacacaagatggtccgtccgga

SEQ ID NO: 155135 - DNA, 25 bp, Mus musculus
tttgacacctggattaaaagatgcc

SEQ ID NO: 155136 - DNA, 25 bp, Mus musculus
tttgacacgtacctgctcatcagtg

SEQ ID NO: 155137 - DNA, 25 bp, Mus musculus
tttgacagccgcttccccaaccaga

SEQ ID NO: 155138 - DNA, 25 bp, Mus musculus
tttgacagtgaccacccttctgggt

SEQ ID NO: 155139 - DNA, 25 bp, Mus musculus
tttgacatgaccctgagcagatttg

SEQ ID NO: 155140 - DNA, 25 bp, Mus musculus
tttgacattgggaaggacacctacg

SEQ ID NO: 155141 - DNA, 25 bp, Mus musculus
tttgaccaaggctatgaggcacccg

SEQ ID NO: 155142 - DNA, 25 bp, Mus musculus
tttgaccaggacagctccaatgtgg

SEQ ID NO: 155143 - DNA, 25 bp, Mus musculus
tttgacccatttgagaaaccagcca

SEQ ID NO: 155144 - DNA, 25 bp, Mus musculus
tttgaccgacgactagaggatatcc

SEQ ID NO: 155145 - DNA, 25 bp, Mus musculus
tttgacctcattgggaaaatgttgg

SEQ ID NO: 155146 - DNA, 25 bp, Mus musculus
tttgacctccggataagcgaggcgc

SEQ ID NO: 155147 - DNA, 25 bp, Mus musculus
tttgacctcgaaaatgggcttccgg

SEQ ID NO: 155148 - DNA, 25 bp, Mus musculus
tttgacctgagcagagaacatcctg

SEQ ID NO: 155149 - DNA, 25 bp, Mus musculus
tttgacctgctgatcctgggagtgg

SEQ ID NO: 155150 - DNA, 25 bp, Mus musculus
tttgacctggtgtacggctcgacgc

SEQ ID NO: 155151 - DNA, 25 bp, Mus musculus
tttgacctgtcacaagcgctgcctg

SEQ ID NO: 155152 - DNA, 25 bp, Mus musculus
tttgacgaatatggaggcacagggc

SEQ ID NO: 155153 - DNA, 25 bp, Mus musculus
tttgacgatgacgatcagggcccac

SEQ ID NO: 155154 - DNA, 25 bp, Mus musculus
tttgacgcaggtgctaagccaagcc

SEQ ID NO: 155155 - DNA, 25 bp, Mus musculus
tttgacgccatcagaagtacttgag

SEQ ID NO: 155156 - DNA, 25 bp, Mus musculus
tttgacgccgagttccgacgctttg

SEQ ID NO: 155157 - DNA, 25 bp, Mus musculus
tttgacgggctctcagatgacgagg

SEQ ID NO: 155158 - DNA, 25 bp, Mus musculus
tttgactacgtcatgcacttcctga

SEQ ID NO: 155159 - DNA, 25 bp, Mus musculus
tttgactcaaagcagcaatgggaac

SEQ ID NO: 155160 - DNA, 25 bp, Mus musculus
tttgactcaagacacccaagaggga

SEQ ID NO: 155161 - DNA, 25 bp, Mus musculus
tttgactcatcgcacagaggactgg

SEQ ID NO: 155162 - DNA, 25 bp, Mus musculus
tttgactcccaaatcaatgtgccga

SEQ ID NO: 155163 - DNA, 25 bp, Mus musculus
tttgactccgtgatgcagctgcagg

SEQ ID NO: 155164 - DNA, 25 bp, Mus musculus
tttgactggtcagagggttggatca

SEQ ID NO: 155165 - DNA, 25 bp, Mus musculus
tttgacttccggcaccttgaatgcc

SEQ ID NO: 155166 - DNA, 25 bp, Mus musculus
tttgacttcgtcacggagacgccgc

SEQ ID NO: 155167 - DNA, 25 bp, Mus musculus
tttgacttctgtgagcatgaccttg

SEQ ID NO: 155168 - DNA, 25 bp, Mus musculus
tttgagaagaaaaggcccgtggaga

SEQ ID NO: 155169 - DNA, 25 bp, Mus musculus
tttgagaagacagttcaatatggca

SEQ ID NO: 155170 - DNA, 25 bp, Mus musculus
tttgagaagagcacacagatgaccg

SEQ ID NO: 155171 - DNA, 25 bp, Mus musculus
tttgagaagcggaccatgtcggccc

SEQ ID NO: 155172 - DNA, 25 bp, Mus musculus
tttgagaaggataagcgaggactgc

SEQ ID NO: 155173 - DNA, 25 bp, Mus musculus
tttgagaaggtccatcagtaggcca

SEQ ID NO: 155174 - DNA, 25 bp, Mus musculus
tttgagaagtgagctgcaactggcc

SEQ ID NO: 155175 - DNA, 25 bp, Mus musculus
tttgagacaaactctgggaacccct

SEQ ID NO: 155176 - DNA, 25 bp, Mus musculus
tttgagacactctgctcggagctga

SEQ ID NO: 155177 - DNA, 25 bp, Mus musculus
tttgagaccaacactgaaccagact

SEQ ID NO: 155178 - DNA, 25 bp, Mus musculus
tttgagacggccgagagtttgagcg

SEQ ID NO: 155179 - DNA, 25 bp, Mus musculus
tttgagactctccaagggccaggtc

SEQ ID NO: 155180 - DNA, 25 bp, Mus musculus
tttgagagagcccaagctgctagcc

SEQ ID NO: 155181 - DNA, 25 bp, Mus musculus
tttgagagatcacgagaacaacctc

SEQ ID NO: 155182 - DNA, 25 bp, Mus musculus
tttgagagccatcaacagggcattg

SEQ ID NO: 155183 - DNA, 25 bp, Mus musculus
tttgagaggcatgctgaagggacct

SEQ ID NO: 155184 - DNA, 25 bp, Mus musculus
tttgagagtgcaccagaagatgacc

SEQ ID NO: 155185 - DNA, 25 bp, Mus musculus
tttgagagtgccgagaaagcgtctg

SEQ ID NO: 155186 - DNA, 25 bp, Mus musculus
tttgagatccgaatgtacgacgcgc

SEQ ID NO: 155187 - DNA, 25 bp, Mus musculus
tttgagatccgtgtgtgagatggcc

SEQ ID NO: 155188 - DNA, 25 bp, Mus musculus
tttgagatcttgagcaccttcccgc

SEQ ID NO: 155189 - DNA, 25 bp, Mus musculus
tttgagatggacgatcatgacgccc

SEQ ID NO: 155190 - DNA, 25 bp, Mus musculus
tttgagcaaagccaggatgctgccc

SEQ ID NO: 155191 - DNA, 25 bp, Mus musculus
tttgagcacagtccactctcggagg

SEQ ID NO: 155192 - DNA, 25 bp, Mus musculus
tttgagcaccagatagacagactcc

SEQ ID NO: 155193 - DNA, 25 bp, Mus musculus
tttgagcacgtcatcgaagagctgc

SEQ ID NO: 155194 - DNA, 25 bp, Mus musculus
tttgagcagatcaccctggagtcgg

SEQ ID NO: 155195 - DNA, 25 bp, Mus musculus
tttgagccagaccaagagtcctccg

SEQ ID NO: 155196 - DNA, 25 bp, Mus musculus
tttgagccagcaggatgatctaatg

SEQ ID NO: 155197 - DNA, 25 bp, Mus musculus
tttgagcgaactgaacggcatggcc

SEQ ID NO: 155198 - DNA, 25 bp, Mus musculus
tttgagcttgacagtgagcaggtcc

SEQ ID NO: 155199 - DNA, 25 bp, Mus musculus
tttgaggaccctcaccatggcaacg

SEQ ID NO: 155200 - DNA, 25 bp, Mus musculus
tttgaggacctcacctgcttctggg

SEQ ID NO: 155201 - DNA, 25 bp, Mus musculus
tttgaggaccttatccagcgctgcc

SEQ ID NO: 155202 - DNA, 25 bp, Mus musculus
tttgaggactccctagacccagcct

SEQ ID NO: 155203 - DNA, 25 bp, Mus musculus
tttgaggagatgatacagtggacca

SEQ ID NO: 155204 - DNA, 25 bp, Mus musculus
tttgaggcagtggatggcaacccag

SEQ ID NO: 155205 - DNA, 25 bp, Mus musculus
tttgaggccggtgtgagcacgcaca

SEQ ID NO: 155206 - DNA, 25 bp, Mus musculus
tttgaggcctcaacagcagaagagc

SEQ ID NO: 155207 - DNA, 25 bp, Mus musculus
tttgaggccttctatgcagcggagg

SEQ ID NO: 155208 - DNA, 25 bp, Mus musculus
tttgagggcacgtcgctcgtgaaca

SEQ ID NO: 155209 - DNA, 25 bp, Mus musculus
tttgagtatcaaaccatgtaatagt

SEQ ID NO: 155210 - DNA, 25 bp, Mus musculus
tttgagtccatcgaccaaggccatg

SEQ ID NO: 155211 - DNA, 25 bp, Mus musculus
tttgagtctactgcgcaggcgtcct

SEQ ID NO: 155212 - DNA, 25 bp, Mus musculus
tttgagtgtgactgcatccgatgcc

SEQ ID NO: 155213 - DNA, 25 bp, Mus musculus
tttgagtgtgcctacggaacgccac

SEQ ID NO: 155214 - DNA, 25 bp, Mus musculus
tttgagttcaaaggaccgcaggctg

SEQ ID NO: 155215 - DNA, 25 bp, Mus musculus
tttgagtttgacgtcttcaccaggc

SEQ ID NO: 155216 - DNA, 25 bp, Mus musculus
tttgataagcggttcacggcggtca

SEQ ID NO: 155217 - DNA, 25 bp, Mus musculus
tttgatacatcctgtgagccctgag

SEQ ID NO: 155218 - DNA, 25 bp, Mus musculus
tttgatagctcactccctgaatcgg

SEQ ID NO: 155219 - DNA, 25 bp, Mus musculus
tttgatatggattataccctagccg

SEQ ID NO: 155220 - DNA, 25 bp, Mus musculus
tttgatctcggtgggcatgagcaag

SEQ ID NO: 155221 - DNA, 25 bp, Mus musculus
tttgatctctacacgaagtgccctg

SEQ ID NO: 155222 - DNA, 25 bp, Mus musculus
tttgatgaccacgacccagctgtga

SEQ ID NO: 155223 - DNA, 25 bp, Mus musculus
tttgatgagaccctgcagaagtgcc

SEQ ID NO: 155224 - DNA, 25 bp, Mus musculus
tttgatgagatgatcgccaccgcag

SEQ ID NO: 155225 - DNA, 25 bp, Mus musculus
tttgatgagcaaggacacagcactt

SEQ ID NO: 155226 - DNA, 25 bp, Mus musculus
tttgatgatcactgacgctgcccgc

SEQ ID NO: 155227 - DNA, 25 bp, Mus musculus
tttgatgatggaagacagacccacc

SEQ ID NO: 155228 - DNA, 25 bp, Mus musculus
tttgatgcggaatgccagaggacca

SEQ ID NO: 155229 - DNA, 25 bp, Mus musculus
tttgatgctcgggaaagtcgacggc

SEQ ID NO: 155230 - DNA, 25 bp, Mus musculus
tttgatggagcaagtactggccagc

SEQ ID NO: 155231 - DNA, 25 bp, Mus musculus
tttgatggatgactcagtgaccccg

SEQ ID NO: 155232 - DNA, 25 bp, Mus musculus
tttgatggcatcagcaggacctgcg

SEQ ID NO: 155233 - DNA, 25 bp, Mus musculus
tttgatgggagaaaacgccttgacc

SEQ ID NO: 155234 - DNA, 25 bp, Mus musculus
tttgatggtcaaacgcctctccttg

SEQ ID NO: 155235 - DNA, 25 bp, Mus musculus
tttgattaccgaacaggcagcgaga

SEQ ID NO: 155236 - DNA, 25 bp, Mus musculus
tttgattcagaagtggcaccacggc

SEQ ID NO: 155237 - DNA, 25 bp, Mus musculus
tttgattctgtgtactcccgcctgg

SEQ ID NO: 155238 - DNA, 25 bp, Mus musculus
tttgattcttgaaaagcagcctgct

SEQ ID NO: 155239 - DNA, 25 bp, Mus musculus
tttgattggcatcatcaggcctggg

SEQ ID NO: 155240 - DNA, 25 bp, Mus musculus
tttgatttaatgaacggagggcctt

SEQ ID NO: 155241 - DNA, 25 bp, Mus musculus
tttgcaaaaccagaaacactcccga

SEQ ID NO: 155242 - DNA, 25 bp, Mus musculus
tttgcaaaagcgatggaagggtcca

SEQ ID NO: 155243 - DNA, 25 bp, Mus musculus
tttgcaaacctacagaggaccggac

SEQ ID NO: 155244 - DNA, 25 bp, Mus musculus
tttgcaaagagtagccgaactggac

SEQ ID NO: 155245 - DNA, 25 bp, Mus musculus
tttgcaaagtacgtgcacagctgga

SEQ ID NO: 155246 - DNA, 25 bp, Mus musculus
tttgcaaatggacgctccacaggcc

SEQ ID NO: 155247 - DNA, 25 bp, Mus musculus
tttgcaacacgaagcagaacggaca

SEQ ID NO: 155248 - DNA, 25 bp, Mus musculus
tttgcaacttcgtcgttccgccgct

SEQ ID NO: 155249 - DNA, 25 bp, Mus musculus
tttgcaactttagccctactcgggt

SEQ ID NO: 155250 - DNA, 25 bp, Mus musculus
tttgcaagacaacatcatcgctgag

SEQ ID NO: 155251 - DNA, 25 bp, Mus musculus
tttgcaatcaagaaacatcccgagg

SEQ ID NO: 155252 - DNA, 25 bp, Mus musculus
tttgcaatcagaaccgagacactgg

SEQ ID NO: 155253 - DNA, 25 bp, Mus musculus
tttgcacaagcgttaccaagagacg

SEQ ID NO: 155254 - DNA, 25 bp, Mus musculus
tttgcacacgtttggcgctgggctc

SEQ ID NO: 155255 - DNA, 25 bp, Mus musculus
tttgcacagaactgccggaacattg

SEQ ID NO: 155256 - DNA, 25 bp, Mus musculus
tttgcacatccctcatgcagaagat

SEQ ID NO: 155257 - DNA, 25 bp, Mus musculus
tttgcacctagtccacaaagcaggg

SEQ ID NO: 155258 - DNA, 25 bp, Mus musculus
tttgcacggcaaaatgcgagtgggc

SEQ ID NO: 155259 - DNA, 25 bp, Mus musculus
tttgcacgtgcgcaaagacttccac

SEQ ID NO: 155260 - DNA, 25 bp, Mus musculus
tttgcactgaggcagaacttacacg

SEQ ID NO: 155261 - DNA, 25 bp, Mus musculus
tttgcacttcagacaatggagccgg

SEQ ID NO: 155262 - DNA, 25 bp, Mus musculus
tttgcagaagtcgtgttgtgaccca

SEQ ID NO: 155263 - DNA, 25 bp, Mus musculus
tttgcagacgggagaaccgagcaac

SEQ ID NO: 155264 - DNA, 25 bp, Mus musculus
tttgcagatcaaggagatgccccag

SEQ ID NO: 155265 - DNA, 25 bp, Mus musculus
tttgcagatcctagacatgctcagg

SEQ ID NO: 155266 - DNA, 25 bp, Mus musculus
tttgcagcaaccagcagacgtcagc

SEQ ID NO: 155267 - DNA, 25 bp, Mus musculus
tttgcagccacctggtgcaacggct

SEQ ID NO: 155268 - DNA, 25 bp, Mus musculus
tttgcagggaaaggcctcacgttct

SEQ ID NO: 155269 - DNA, 25 bp, Mus musculus
tttgcagggtgcatcggagcacttc

SEQ ID NO: 155270 - DNA, 25 bp, Mus musculus
tttgcataatgtagagcgagccgtg

SEQ ID NO: 155271 - DNA, 25 bp, Mus musculus
tttgcatagcacagctggacactgg

SEQ ID NO: 155272 - DNA, 25 bp, Mus musculus
tttgcatccggagacgcgggctgtt

SEQ ID NO: 155273 - DNA, 25 bp, Mus musculus
tttgccaaacctaatgacagtcggg

SEQ ID NO: 155274 - DNA, 25 bp, Mus musculus
tttgccaaactcgagaacatgctgc

SEQ ID NO: 155275 - DNA, 25 bp, Mus musculus
tttgccaaatgagcagcacgcggtg

SEQ ID NO: 155276 - DNA, 25 bp, Mus musculus
tttgccaacaaacacggaagacacg

SEQ ID NO: 155277 - DNA, 25 bp, Mus musculus
tttgccaacccagaagactgcgctg

SEQ ID NO: 155278 - DNA, 25 bp, Mus musculus
tttgccaacctgaaagaccgtgact

SEQ ID NO: 155279 - DNA, 25 bp, Mus musculus
tttgccaagatggaccccagctgta

SEQ ID NO: 155280 - DNA, 25 bp, Mus musculus
tttgccaagcagctacgggccgaga

SEQ ID NO: 155281 - DNA, 25 bp, Mus musculus
tttgccaagggcaaagggacctttg

SEQ ID NO: 155282 - DNA, 25 bp, Mus musculus
tttgccacagcattccagaacagga

SEQ ID NO: 155283 - DNA, 25 bp, Mus musculus
tttgccaccagaagaaaagatagct

SEQ ID NO: 155284 - DNA, 25 bp, Mus musculus
tttgccactacctgcggcttaagcg

SEQ ID NO: 155285 - DNA, 25 bp, Mus musculus
tttgccactgcggaaagggtaactg

SEQ ID NO: 155286 - DNA, 25 bp, Mus musculus
tttgccagagaggagattatccccg

SEQ ID NO: 155287 - DNA, 25 bp, Mus musculus
tttgccagggcaccaaggacttgta

SEQ ID NO: 155288 - DNA, 25 bp, Mus musculus
tttgccagtttctgctggaaagtgg

SEQ ID NO: 155289 - DNA, 25 bp, Mus musculus
tttgccatatcaagaaagagggacg

SEQ ID NO: 155290 - DNA, 25 bp, Mus musculus
tttgccatgaccaagctcttccagt

SEQ ID NO: 155291 - DNA, 25 bp, Mus musculus
tttgccatggcagaggacgagctga

SEQ ID NO: 155292 - DNA, 25 bp, Mus musculus
tttgccatttctgagtttattgcca

SEQ ID NO: 155293 - DNA, 25 bp, Mus musculus
tttgcccagcggtactgtcagtgca

SEQ ID NO: 155294 - DNA, 25 bp, Mus musculus
tttgccctacccaggttgacgactg

SEQ ID NO: 155295 - DNA, 25 bp, Mus musculus
tttgccctctgaaggagaccaggag

SEQ ID NO: 155296 - DNA, 25 bp, Mus musculus
tttgccctggagtaacctaagctgc

SEQ ID NO: 155297 - DNA, 25 bp, Mus musculus
tttgccctggatgcacctgaactcg

SEQ ID NO: 155298 - DNA, 25 bp, Mus musculus
tttgccgaagtgaaagaggccctgc

SEQ ID NO: 155299 - DNA, 25 bp, Mus musculus
tttgccgaggccgagtgcctagccg

SEQ ID NO: 155300 - DNA, 25 bp, Mus musculus
tttgcctctgatggacgtaggacca

SEQ ID NO: 155301 - DNA, 25 bp, Mus musculus
tttgcctctgctggagataccacag

SEQ ID NO: 155302 - DNA, 25 bp, Mus musculus
tttgcctgacaagctgaaccatgag

SEQ ID NO: 155303 - DNA, 25 bp, Mus musculus
tttgcctgcatggtgctcacggaga

SEQ ID NO: 155304 - DNA, 25 bp, Mus musculus
tttgccttcgagagggaggccctgc

SEQ ID NO: 155305 - DNA, 25 bp, Mus musculus
tttgcgactagaccgaaacactgga

SEQ ID NO: 155306 - DNA, 25 bp, Mus musculus
tttgcgcaagtgtgagctccggatc

SEQ ID NO: 155307 - DNA, 25 bp, Mus musculus
tttgcgcaggatccggaaggctcat

SEQ ID NO: 155308 - DNA, 25 bp, Mus musculus
tttgcgccttacacctccaatggga

SEQ ID NO: 155309 - DNA, 25 bp, Mus musculus
tttgcgctgatgagccccctcagtt

SEQ ID NO: 155310 - DNA, 25 bp, Mus musculus
tttgcggaccctaaagcacgcagcg

SEQ ID NO: 155311 - DNA, 25 bp, Mus musculus
tttgcggaggaattcacccggctgg

SEQ ID NO: 155312 - DNA, 25 bp, Mus musculus
tttgcggcagagagcgtaacttcct

SEQ ID NO: 155313 - DNA, 25 bp, Mus musculus
tttgcggcccggaagcagagcgctt

SEQ ID NO: 155314 - DNA, 25 bp, Mus musculus
tttgcggcttactttgcggcagcac

SEQ ID NO: 155315 - DNA, 25 bp, Mus musculus
tttgcgtcaagcacgacactctgtg

SEQ ID NO: 155316 - DNA, 25 bp, Mus musculus
tttgcgtcctggtgctaacccgcag

SEQ ID NO: 155317 - DNA, 25 bp, Mus musculus
tttgcgtcggccgaagaggtcgctc

SEQ ID NO: 155318 - DNA, 25 bp, Mus musculus
tttgcgtgtaacaggatctgtgagg

SEQ ID NO: 155319 - DNA, 25 bp, Mus musculus
tttgcgttgcattccactgagccgc

SEQ ID NO: 155320 - DNA, 25 bp, Mus musculus
tttgctaaaccttccactgacgtgt

SEQ ID NO: 155321 - DNA, 25 bp, Mus musculus
tttgctactgtggacccatgggacc

SEQ ID NO: 155322 - DNA, 25 bp, Mus musculus
tttgctagaactgttgggctctgca

SEQ ID NO: 155323 - DNA, 25 bp, Mus musculus
tttgctatcatgaaacacctgggcc

SEQ ID NO: 155324 - DNA, 25 bp, Mus musculus
tttgctattctcatggcccacaggg

SEQ ID NO: 155325 - DNA, 25 bp, Mus musculus
tttgctccgtctagaggaaggacct

SEQ ID NO: 155326 - DNA, 25 bp, Mus musculus
tttgctcggcgaggaatccacgaca

SEQ ID NO: 155327 - DNA, 25 bp, Mus musculus
tttgctctacggagctggcgacctc

SEQ ID NO: 155328 - DNA, 25 bp, Mus musculus
tttgctctgtgggaaacggcacctg

SEQ ID NO: 155329 - DNA, 25 bp, Mus musculus
tttgctgaagcatggaccccaagtg

SEQ ID NO: 155330 - DNA, 25 bp, Mus musculus
tttgctgaccgcctacagtcgtgac

SEQ ID NO: 155331 - DNA, 25 bp, Mus musculus
tttgctgacctgacgggatgacgga

SEQ ID NO: 155332 - DNA, 25 bp, Mus musculus
tttgctgagaaaactggccctccaa

SEQ ID NO: 155333 - DNA, 25 bp, Mus musculus
tttgctgagaacaggattaggtcct

SEQ ID NO: 155334 - DNA, 25 bp, Mus musculus
tttgctgaggagcacaactttgcca

SEQ ID NO: 155335 - DNA, 25 bp, Mus musculus
tttgctgcagatagatcgaagtggc

SEQ ID NO: 155336 - DNA, 25 bp, Mus musculus
tttgctgcaggaggctacatgcccc

SEQ ID NO: 155337 - DNA, 25 bp, Mus musculus
tttgctgcgtgatgaggatcggctc

SEQ ID NO: 155338 - DNA, 25 bp, Mus musculus
tttgctggcatcttccaaagaggtg

SEQ ID NO: 155339 - DNA, 25 bp, Mus musculus
tttgctggtctcaggcacctcagag

SEQ ID NO: 155340 - DNA, 25 bp, Mus musculus
tttgctggtgatccgaagtcgtcca

SEQ ID NO: 155341 - DNA, 25 bp, Mus musculus
tttgctgtgtccctgccgctgtgga

SEQ ID NO: 155342 - DNA, 25 bp, Mus musculus
tttgcttagacgaaaaacactagcc

SEQ ID NO: 155343 - DNA, 25 bp, Mus musculus
tttgcttcaaacttgcgcgctcccg

SEQ ID NO: 155344 - DNA, 25 bp, Mus musculus
tttgcttcatgcaggagcgccagaa

SEQ ID NO: 155345 - DNA, 25 bp, Mus musculus
tttgcttccggcattagacgtgagc

SEQ ID NO: 155346 - DNA, 25 bp, Mus musculus
tttgcttcctggtgcagaggtcaga

SEQ ID NO: 155347 - DNA, 25 bp, Mus musculus
tttgcttgctggagcctgtctcttc

SEQ ID NO: 155348 - DNA, 25 bp, Mus musculus
tttgcttggcgccatcactgctgga

SEQ ID NO: 155349 - DNA, 25 bp, Mus musculus
tttgctttgtgcctgccaaacccgg

SEQ ID NO: 155350 - DNA, 25 bp, Mus musculus
tttggaaaaggcaactcaccactgc

SEQ ID NO: 155351 - DNA, 25 bp, Mus musculus
tttggaaacccctcgctggatgaga

SEQ ID NO: 155352 - DNA, 25 bp, Mus musculus
tttggaaactctggtaagcccctgt

SEQ ID NO: 155353 - DNA, 25 bp, Mus musculus
tttggaacaccctacatctctggag

SEQ ID NO: 155354 - DNA, 25 bp, Mus musculus
tttggaaccacaatctccccgtggg

SEQ ID NO: 155355 - DNA, 25 bp, Mus musculus
tttggaaccatttgaacagcacgtg

SEQ ID NO: 155356 - DNA, 25 bp, Mus musculus
tttggaacgagagcaaggcagctgc

SEQ ID NO: 155357 - DNA, 25 bp, Mus musculus
tttggaagagaaggtcaagagctgc

SEQ ID NO: 155358 - DNA, 25 bp, Mus musculus
tttggaagcagcaccgtcaacgctc

SEQ ID NO: 155359 - DNA, 25 bp, Mus musculus
tttggaagctcgaagaaacctgggt

SEQ ID NO: 155360 - DNA, 25 bp, Mus musculus
tttggaagtgacgaagctgcttatc

SEQ ID NO: 155361 - DNA, 25 bp, Mus musculus
tttggaatcagcaaccattctgagg

SEQ ID NO: 155362 - DNA, 25 bp, Mus musculus
tttggaatccagcagaacagcgcgg

SEQ ID NO: 155363 - DNA, 25 bp, Mus musculus
tttggacaacccagtgcacagacgc

SEQ ID NO: 155364 - DNA, 25 bp, Mus musculus
tttggacacacagcgtggggacatc

SEQ ID NO: 155365 - DNA, 25 bp, Mus musculus
tttggacagatacgccttttctggg

SEQ ID NO: 155366 - DNA, 25 bp, Mus musculus
tttggacatggcaagaggcatggct

SEQ ID NO: 155367 - DNA, 25 bp, Mus musculus
tttggacatgtagccgtaggaacgc

SEQ ID NO: 155368 - DNA, 25 bp, Mus musculus
tttggaccagtggtgaagactcccc

SEQ ID NO: 155369 - DNA, 25 bp, Mus musculus
tttggacccatggaacccgagtact

SEQ ID NO: 155370 - DNA, 25 bp, Mus musculus
tttggaccccagcatagtaggcgag

SEQ ID NO: 155371 - DNA, 25 bp, Mus musculus
tttggaccccgaatatggaattctc

SEQ ID NO: 155372 - DNA, 25 bp, Mus musculus
tttggacccctgaggcctgcactca

SEQ ID NO: 155373 - DNA, 25 bp, Mus musculus
tttggaccgtgcgattaccaccagg

SEQ ID NO: 155374 - DNA, 25 bp, Mus musculus
tttggacctgaagatgggaactgca

SEQ ID NO: 155375 - DNA, 25 bp, Mus musculus
tttggacggacagagaaatgctcct

SEQ ID NO: 155376 - DNA, 25 bp, Mus musculus
tttggactcagcttcaaagaaggca

SEQ ID NO: 155377 - DNA, 25 bp, Mus musculus
tttggactcagtaggagactcagtg

SEQ ID NO: 155378 - DNA, 25 bp, Mus musculus
tttggactggtttcctcggatgcga

SEQ ID NO: 155379 - DNA, 25 bp, Mus musculus
tttggagagaaaggttgaatcgctg

SEQ ID NO: 155380 - DNA, 25 bp, Mus musculus
tttggagccacagattacacctcgt

SEQ ID NO: 155381 - DNA, 25 bp, Mus musculus
tttggagcccctccgcaagttccgt

SEQ ID NO: 155382 - DNA, 25 bp, Mus musculus
tttggagcctccaagctggagtcgg

SEQ ID NO: 155383 - DNA, 25 bp, Mus musculus
tttggagctgaaattgaaccgccga

SEQ ID NO: 155384 - DNA, 25 bp, Mus musculus
tttggaggacagaaagaagggcttc

SEQ ID NO: 155385 - DNA, 25 bp, Mus musculus
tttggaggagttcgcagaaatgaaa

SEQ ID NO: 155386 - DNA, 25 bp, Mus musculus
tttggaggccaagatccgccagaca

SEQ ID NO: 155387 - DNA, 25 bp, Mus musculus
tttggaggctatctcaggtcccgag

SEQ ID NO: 155388 - DNA, 25 bp, Mus musculus
tttggagggaaaacacacttcacgc

SEQ ID NO: 155389 - DNA, 25 bp, Mus musculus
tttggaggtgtcctcacgctcacgc

SEQ ID NO: 155390 - DNA, 25 bp, Mus musculus
tttggagtacccctgtctatgccgc

SEQ ID NO: 155391 - DNA, 25 bp, Mus musculus
tttggatatccggatgcctcagggc

SEQ ID NO: 155392 - DNA, 25 bp, Mus musculus
tttggatcattcagaccagccagac

SEQ ID NO: 155393 - DNA, 25 bp, Mus musculus
tttggatcctcagccactgctacgg

SEQ ID NO: 155394 - DNA, 25 bp, Mus musculus
tttggatctcctgcacacagacggt

SEQ ID NO: 155395 - DNA, 25 bp, Mus musculus
tttggatgaacagcacgggcaagcg

SEQ ID NO: 155396 - DNA, 25 bp, Mus musculus
tttggatgctaagctcgtgtctcct

SEQ ID NO: 155397 - DNA, 25 bp, Mus musculus
tttggatggccaccaccacataggg

SEQ ID NO: 155398 - DNA, 25 bp, Mus musculus
tttggcaaactcatccgctctgtgt

SEQ ID NO: 155399 - DNA, 25 bp, Mus musculus
tttggcaagtctcacaagtctccgg

SEQ ID NO: 155400 - DNA, 25 bp, Mus musculus
tttggcaccaactgcatttgccggg

SEQ ID NO: 155401 - DNA, 25 bp, Mus musculus
tttggcagccagtctgaaccctcag

SEQ ID NO: 155402 - DNA, 25 bp, Mus musculus
tttggcagccatggaaaccccttgt

SEQ ID NO: 155403 - DNA, 25 bp, Mus musculus
tttggcagcctcaacgtgaaagcta

SEQ ID NO: 155404 - DNA, 25 bp, Mus musculus
tttggccacatcatcaggacactgt

SEQ ID NO: 155405 - DNA, 25 bp, Mus musculus
tttggccaccgcaaagcactgtgga

SEQ ID NO: 155406 - DNA, 25 bp, Mus musculus
tttggccattgagctccagggagca

SEQ ID NO: 155407 - DNA, 25 bp, Mus musculus
tttggcccgggcagctaagaagcct

SEQ ID NO: 155408 - DNA, 25 bp, Mus musculus
tttggccctgcggacttgaaagaca

SEQ ID NO: 155409 - DNA, 25 bp, Mus musculus
tttggccgctcacgagaataccagc

SEQ ID NO: 155410 - DNA, 25 bp, Mus musculus
tttggccggacaatacaggaggtct

SEQ ID NO: 155411 - DNA, 25 bp, Mus musculus
tttggccgggacatggagaccatcg

SEQ ID NO: 155412 - DNA, 25 bp, Mus musculus
tttggcgatggagctacactgttag

SEQ ID NO: 155413 - DNA, 25 bp, Mus musculus
tttggcgattttggcatgactcgga

SEQ ID NO: 155414 - DNA, 25 bp, Mus musculus
tttggcgcgggcttccatggtctcg

SEQ ID NO: 155415 - DNA, 25 bp, Mus musculus
tttggctactggagaatgatgaggt

SEQ ID NO: 155416 - DNA, 25 bp, Mus musculus
tttggctagcccgtaagtgaggcgt

SEQ ID NO: 155417 - DNA, 25 bp, Mus musculus
tttggctatctcagcccagctgtag

SEQ ID NO: 155418 - DNA, 25 bp, Mus musculus
tttggctcactggactctctgcggg

SEQ ID NO: 155419 - DNA, 25 bp, Mus musculus
tttggctccagcgtagtgaaccgaa

SEQ ID NO: 155420 - DNA, 25 bp, Mus musculus
tttggctcgcccgtcagtgatctgc

SEQ ID NO: 155421 - DNA, 25 bp, Mus musculus
tttggctctgaggaaatccgaccct

SEQ ID NO: 155422 - DNA, 25 bp, Mus musculus
tttggctgagatgctaccgtccgtc

SEQ ID NO: 155423 - DNA, 25 bp, Mus musculus
tttggctgcgaacagtcacttggga

SEQ ID NO: 155424 - DNA, 25 bp, Mus musculus
tttggctgctacctcccgctattgg

SEQ ID NO: 155425 - DNA, 25 bp, Mus musculus
tttggctggaccgactaatgccatc

SEQ ID NO: 155426 - DNA, 25 bp, Mus musculus
tttggctgggatcattcgctgcaca

SEQ ID NO: 155427 - DNA, 25 bp, Mus musculus
tttggctgtccctaaacgttctact

SEQ ID NO: 155428 - DNA, 25 bp, Mus musculus
tttggcttgctggttctctatgttc

SEQ ID NO: 155429 - DNA, 25 bp, Mus musculus
tttgggaaagcagtgagctgaagcc

SEQ ID NO: 155430 - DNA, 25 bp, Mus musculus
tttgggaacatctctgtgacgggca

SEQ ID NO: 155431 - DNA, 25 bp, Mus musculus
tttgggaattacaccacgttctggg

SEQ ID NO: 155432 - DNA, 25 bp, Mus musculus
tttgggacacttgcttcatctgggt

SEQ ID NO: 155433 - DNA, 25 bp, Mus musculus
tttgggaccagcaatattaaggagc

SEQ ID NO: 155434 - DNA, 25 bp, Mus musculus
tttgggaccccgagcagtggattcg

SEQ ID NO: 155435 - DNA, 25 bp, Mus musculus
tttgggacttttgcacccggagctc

SEQ ID NO: 155436 - DNA, 25 bp, Mus musculus
tttgggagccccaaaaccactgctg

SEQ ID NO: 155437 - DNA, 25 bp, Mus musculus
tttgggagccctggaaacatgagca

SEQ ID NO: 155438 - DNA, 25 bp, Mus musculus
tttgggagccttgggaaagcaccgt

SEQ ID NO: 155439 - DNA, 25 bp, Mus musculus
tttgggagctgcaacactgggttca

SEQ ID NO: 155440 - DNA, 25 bp, Mus musculus
tttgggaggatcaagagagccctgc

SEQ ID NO: 155441 - DNA, 25 bp, Mus musculus
tttgggatagttatggccgcgtgct

SEQ ID NO: 155442 - DNA, 25 bp, Mus musculus
tttgggcaacgtcatcccctggcag

SEQ ID NO: 155443 - DNA, 25 bp, Mus musculus
tttgggcatagtcccgccaccgatt

SEQ ID NO: 155444 - DNA, 25 bp, Mus musculus
tttgggccagacgactaacagcatg

SEQ ID NO: 155445 - DNA, 25 bp, Mus musculus
tttgggccccatgggatccctgtga

SEQ ID NO: 155446 - DNA, 25 bp, Mus musculus
tttgggccccgaatatcgtcggtga

SEQ ID NO: 155447 - DNA, 25 bp, Mus musculus
tttgggcccgagagatcttggactc

SEQ ID NO: 155448 - DNA, 25 bp, Mus musculus
tttgggcgtcccacaagctttgcct

SEQ ID NO: 155449 - DNA, 25 bp, Mus musculus
tttgggctccacaacttaacctggt

SEQ ID NO: 155450 - DNA, 25 bp, Mus musculus
tttgggctgagcaaggagttcctga

SEQ ID NO: 155451 - DNA, 25 bp, Mus musculus
tttgggcttgtctctgaagtgcttc

SEQ ID NO: 155452 - DNA, 25 bp, Mus musculus
tttgggtcgcagcaggtagtcccct

SEQ ID NO: 155453 - DNA, 25 bp, Mus musculus
tttgggtgccataccaatactggga

SEQ ID NO: 155454 - DNA, 25 bp, Mus musculus
tttggtacctcaactgcaatggctg

SEQ ID NO: 155455 - DNA, 25 bp, Mus musculus
tttggtcaccaaaggtttcaacaag

SEQ ID NO: 155456 - DNA, 25 bp, Mus musculus
tttggtctgtggtcaaccgactgcc

SEQ ID NO: 155457 - DNA, 25 bp, Mus musculus
tttggtgccatcgtcagaagacccg

SEQ ID NO: 155458 - DNA, 25 bp, Mus musculus
tttggtggacattcaccctgaagac

SEQ ID NO: 155459 - DNA, 25 bp, Mus musculus
tttggtggataacactagactcctg

SEQ ID NO: 155460 - DNA, 25 bp, Mus musculus
tttggtggccgacagatcactgctc

SEQ ID NO: 155461 - DNA, 25 bp, Mus musculus
tttggtggggagataaaatccatcg

SEQ ID NO: 155462 - DNA, 25 bp, Mus musculus
tttggtgtaggtggctattatcatg

SEQ ID NO: 155463 - DNA, 25 bp, Mus musculus
tttggttacatctaaaatggaacac

SEQ ID NO: 155464 - DNA, 25 bp, Mus musculus
tttggttcgagttaaggacctgaca

SEQ ID NO: 155465 - DNA, 25 bp, Mus musculus
tttggttcgtggagtcccagcggca

SEQ ID NO: 155466 - DNA, 25 bp, Mus musculus
tttggttctggctcaatggcgggta

SEQ ID NO: 155467 - DNA, 25 bp, Mus musculus
tttggtttccgtgtggacaaggaag

SEQ ID NO: 155468 - DNA, 25 bp, Mus musculus
tttgtaaacgtgaattgaggagcca

SEQ ID NO: 155469 - DNA, 25 bp, Mus musculus
tttgtaacctggctgataacgggcc

SEQ ID NO: 155470 - DNA, 25 bp, Mus musculus
tttgtaacgggctcctcaactccta

SEQ ID NO: 155471 - DNA, 25 bp, Mus musculus
tttgtaaggagggtccatggtgtcc

SEQ ID NO: 155472 - DNA, 25 bp, Mus musculus
tttgtaatgactggccctgcgctgg

SEQ ID NO: 155473 - DNA, 25 bp, Mus musculus
tttgtacagtctaggtctccccggc

SEQ ID NO: 155474 - DNA, 25 bp, Mus musculus
tttgtacatccgcaaaagatgcgca

SEQ ID NO: 155475 - DNA, 25 bp, Mus musculus
tttgtaccacttaaaaaatatgaca

SEQ ID NO: 155476 - DNA, 25 bp, Mus musculus
tttgtaccaggaaggagaagtgccc

SEQ ID NO: 155477 - DNA, 25 bp, Mus musculus
tttgtaccatagaggactgtccgta

SEQ ID NO: 155478 - DNA, 25 bp, Mus musculus
tttgtaccctgccaagtctgccgag

SEQ ID NO: 155479 - DNA, 25 bp, Mus musculus
tttgtaccgggtgtggaggccactc

SEQ ID NO: 155480 - DNA, 25 bp, Mus musculus
tttgtacctagatgacgaatcacag

SEQ ID NO: 155481 - DNA, 25 bp, Mus musculus
tttgtactggtgctagggacgccca

SEQ ID NO: 155482 - DNA, 25 bp, Mus musculus
tttgtagccacaaagcaccatgcgg

SEQ ID NO: 155483 - DNA, 25 bp, Mus musculus
tttgtatcacgggaacggattggcc

SEQ ID NO: 155484 - DNA, 25 bp, Mus musculus
tttgtcaaatgaagaatagaacccc

SEQ ID NO: 155485 - DNA, 25 bp, Mus musculus
tttgtcaacctgctggatgtggcca

SEQ ID NO: 155486 - DNA, 25 bp, Mus musculus
tttgtcacaaagagtcctaactgga

SEQ ID NO: 155487 - DNA, 25 bp, Mus musculus
tttgtcacagcgcagtccagcttag

SEQ ID NO: 155488 - DNA, 25 bp, Mus musculus
tttgtcactcctacagatggcttcc

SEQ ID NO: 155489 - DNA, 25 bp, Mus musculus
tttgtcagatcgtaacaggatccca

SEQ ID NO: 155490 - DNA, 25 bp, Mus musculus
tttgtcagcaagatgtccccgctag

SEQ ID NO: 155491 - DNA, 25 bp, Mus musculus
tttgtcagcaggaaaggtggccatt

SEQ ID NO: 155492 - DNA, 25 bp, Mus musculus
tttgtcatctgggagtccacacagt

SEQ ID NO: 155493 - DNA, 25 bp, Mus musculus
tttgtcatgtataactgtgcccgcc

SEQ ID NO: 155494 - DNA, 25 bp, Mus musculus
tttgtcccaagctcccaagaatgag

SEQ ID NO: 155495 - DNA, 25 bp, Mus musculus
tttgtcccagtgcagtcggtctcct

SEQ ID NO: 155496 - DNA, 25 bp, Mus musculus
tttgtcccttcacccgagagctgag

SEQ ID NO: 155497 - DNA, 25 bp, Mus musculus
tttgtccgatactgagctggccgca

SEQ ID NO: 155498 - DNA, 25 bp, Mus musculus
tttgtcgacaaggaggagcatgcgc

SEQ ID NO: 155499 - DNA, 25 bp, Mus musculus
tttgtcgaccgatcaaggatgaccc

SEQ ID NO: 155500 - DNA, 25 bp, Mus musculus
tttgtcgcacagactgagggccctg

SEQ ID NO: 155501 - DNA, 25 bp, Mus musculus
tttgtcggacacaacctgctgctgg

SEQ ID NO: 155502 - DNA, 25 bp, Mus musculus
tttgtcggatagagaagctgtgccc

SEQ ID NO: 155503 - DNA, 25 bp, Mus musculus
tttgtctgatgggaacacagcaagc

SEQ ID NO: 155504 - DNA, 25 bp, Mus musculus
tttgtctgcaagaaatggctcagga

SEQ ID NO: 155505 - DNA, 25 bp, Mus musculus
tttgtgaacagccaggagtggaccc

SEQ ID NO: 155506 - DNA, 25 bp, Mus musculus
tttgtgaagtccgtgcagcgctgca

SEQ ID NO: 155507 - DNA, 25 bp, Mus musculus
tttgtgaagtttgcagacgcacacc

SEQ ID NO: 155508 - DNA, 25 bp, Mus musculus
tttgtgacacctggaaaactgatgg

SEQ ID NO: 155509 - DNA, 25 bp, Mus musculus
tttgtgacccgtgcatcagtggagg

SEQ ID NO: 155510 - DNA, 25 bp, Mus musculus
tttgtgaccctccaggcgaacgtga

SEQ ID NO: 155511 - DNA, 25 bp, Mus musculus
tttgtgaccctctggctgcctactg

SEQ ID NO: 155512 - DNA, 25 bp, Mus musculus
tttgtgagaacctgcggaagctgga

SEQ ID NO: 155513 - DNA, 25 bp, Mus musculus
tttgtgagacaccagctacctctga

SEQ ID NO: 155514 - DNA, 25 bp, Mus musculus
tttgtgatcatccacaagcgctgca

SEQ ID NO: 155515 - DNA, 25 bp, Mus musculus
tttgtgatctttgacagccgggcag

SEQ ID NO: 155516 - DNA, 25 bp, Mus musculus
tttgtgcaggtgctcaaggaccgca

SEQ ID NO: 155517 - DNA, 25 bp, Mus musculus
tttgtgcatgatgagagccgccagc

SEQ ID NO: 155518 - DNA, 25 bp, Mus musculus
tttgtgcatgcaaggatggcaagcc

SEQ ID NO: 155519 - DNA, 25 bp, Mus musculus
tttgtgccacggataaagatgagcc

SEQ ID NO: 155520 - DNA, 25 bp, Mus musculus
tttgtgccagtgtatctgaccgctg

SEQ ID NO: 155521 - DNA, 25 bp, Mus musculus
tttgtgcccaaagaagaactgcagg

SEQ ID NO: 155522 - DNA, 25 bp, Mus musculus
tttgtgccgggcatcctgctgttag

SEQ ID NO: 155523 - DNA, 25 bp, Mus musculus
tttgtgcgctatcactacaatggca

SEQ ID NO: 155524 - DNA, 25 bp, Mus musculus
tttgtgctgctagtcccggaaaggc

SEQ ID NO: 155525 - DNA, 25 bp, Mus musculus
tttgtggaagagacactgcatcccc

SEQ ID NO: 155526 - DNA, 25 bp, Mus musculus
tttgtggacagaatgaaggaaagcc

SEQ ID NO: 155527 - DNA, 25 bp, Mus musculus
tttgtggacgacgagaccaagctca

SEQ ID NO: 155528 - DNA, 25 bp, Mus musculus
tttgtggagtcgcagaacgacccaa

SEQ ID NO: 155529 - DNA, 25 bp, Mus musculus
tttgtggatacccaggcaagcctgc

SEQ ID NO: 155530 - DNA, 25 bp, Mus musculus
tttgtggccatcaaaacagcccagg

SEQ ID NO: 155531 - DNA, 25 bp, Mus musculus
tttgtggcccacaaacagagcggct

SEQ ID NO: 155532 - DNA, 25 bp, Mus musculus
tttgtgggccaggagctgtaccgct

SEQ ID NO: 155533 - DNA, 25 bp, Mus musculus
tttgtgggctcgagagaaggccacc

SEQ ID NO: 155534 - DNA, 25 bp, Mus musculus
tttgtgggctgctggacacctgtgc

SEQ ID NO: 155535 - DNA, 25 bp, Mus musculus
tttgtggtcaacgacaccaagctgg

SEQ ID NO: 155536 - DNA, 25 bp, Mus musculus
tttgtggtgccgacaagctcaagcc

SEQ ID NO: 155537 - DNA, 25 bp, Mus musculus
tttgtggtgctcgacgacactctcc

SEQ ID NO: 155538 - DNA, 25 bp, Mus musculus
tttgtgtccactgccaaagcggaga

SEQ ID NO: 155539 - DNA, 25 bp, Mus musculus
tttgtgttactgaaggacgggaccg

SEQ ID NO: 155540 - DNA, 25 bp, Mus musculus
tttgtgttcctgacgaccatgccgg

SEQ ID NO: 155541 - DNA, 25 bp, Mus musculus
tttgtgtttacagaagcagcgggct

SEQ ID NO: 155542 - DNA, 25 bp, Mus musculus
tttgttaagaaatagacgctgcacg

SEQ ID NO: 155543 - DNA, 25 bp, Mus musculus
tttgttaaggcaagaactgaccacc

SEQ ID NO: 155544 - DNA, 25 bp, Mus musculus
tttgttccaacgaggagcctgccag

SEQ ID NO: 155545 - DNA, 25 bp, Mus musculus
tttgttccacgtggttgcaaccctg

SEQ ID NO: 155546 - DNA, 25 bp, Mus musculus
tttgttctccccaccctgatacttg

SEQ ID NO: 155547 - DNA, 25 bp, Mus musculus
tttgttgcacaaagctggagaatcg

SEQ ID NO: 155548 - DNA, 25 bp, Mus musculus
tttgttgggcacgaataggcttgca

SEQ ID NO: 155549 - DNA, 25 bp, Mus musculus
tttgttgtacctcgcagtgttccgg

SEQ ID NO: 155550 - DNA, 25 bp, Mus musculus
tttgtttgccagaaagtgcagcctg

SEQ ID NO: 155551 - DNA, 25 bp, Mus musculus
tttgttttaagacctcttcttctgg

SEQ ID NO: 155552 - DNA, 25 bp, Mus musculus
ttttaaaaaggtgcaggtcgaggat

SEQ ID NO: 155553 - DNA, 25 bp, Mus musculus
ttttaaaacagaatcggcatgggcc

SEQ ID NO: 155554 - DNA, 25 bp, Mus musculus
ttttaaacctgaatagagcactgcc

SEQ ID NO: 155555 - DNA, 25 bp, Mus musculus
ttttaaagtcagaagcggccacgct

SEQ ID NO: 155556 - DNA, 25 bp, Mus musculus
ttttaaataaggacggcagagcaca

SEQ ID NO: 155557 - DNA, 25 bp, Mus musculus
ttttaaatggccagcccagcacagc

SEQ ID NO: 155558 - DNA, 25 bp, Mus musculus
ttttaaatttcaacacctggataag

SEQ ID NO: 155559 - DNA, 25 bp, Mus musculus
ttttaacaagcgatccaagagcgtc

SEQ ID NO: 155560 - DNA, 25 bp, Mus musculus
ttttaacggcgcctaacggatcctg

SEQ ID NO: 155561 - DNA, 25 bp, Mus musculus
ttttaactaaaagaggcgctgccag

SEQ ID NO: 155562 - DNA, 25 bp, Mus musculus
ttttaagaatacgtgtgacagtccc

SEQ ID NO: 155563 - DNA, 25 bp, Mus musculus
ttttaagaccctgggctgagtgtcc

SEQ ID NO: 155564 - DNA, 25 bp, Mus musculus
ttttaagactcggtcatctcatcgc

SEQ ID NO: 155565 - DNA, 25 bp, Mus musculus
ttttaagagcgagagtggccttggc

SEQ ID NO: 155566 - DNA, 25 bp, Mus musculus
ttttaagagtcgacacatgggtggg

SEQ ID NO: 155567 - DNA, 25 bp, Mus musculus
ttttaagcccgtggcagtgcactgc

SEQ ID NO: 155568 - DNA, 25 bp, Mus musculus
ttttaagggccaccgagatgcagtc

SEQ ID NO: 155569 - DNA, 25 bp, Mus musculus
ttttaatggctggaatctgtcctgc

SEQ ID NO: 155570 - DNA, 25 bp, Mus musculus
ttttaatgggcaggaccgagaccag

SEQ ID NO: 155571 - DNA, 25 bp, Mus musculus
ttttacaggagcgtctatggcagcc

SEQ ID NO: 155572 - DNA, 25 bp, Mus musculus
ttttacatggacttggagacacagg

SEQ ID NO: 155573 - DNA, 25 bp, Mus musculus
ttttaccacccagaagtgacgggcg

SEQ ID NO: 155574 - DNA, 25 bp, Mus musculus
ttttaccacggaacaagtgactgcc

SEQ ID NO: 155575 - DNA, 25 bp, Mus musculus
ttttacccacgggtgtcacgcacat

SEQ ID NO: 155576 - DNA, 25 bp, Mus musculus
ttttacctgtcgacgctggaggagc

SEQ ID NO: 155577 - DNA, 25 bp, Mus musculus
ttttacgacttgagaaagatgaccg

SEQ ID NO: 155578 - DNA, 25 bp, Mus musculus
ttttacgggtgtagcggtcagagcc

SEQ ID NO: 155579 - DNA, 25 bp, Mus musculus
ttttactatttggtacaagacttga

SEQ ID NO: 155580 - DNA, 25 bp, Mus musculus
ttttactgtggaaggactggagccc

SEQ ID NO: 155581 - DNA, 25 bp, Mus musculus
ttttacttggtgagagccctgcagc

SEQ ID NO: 155582 - DNA, 25 bp, Mus musculus
ttttagaaaagttgggaggctctca

SEQ ID NO: 155583 - DNA, 25 bp, Mus musculus
ttttagagcgaaacagagctgcagc

SEQ ID NO: 155584 - DNA, 25 bp, Mus musculus
ttttagatgccaagtggaagccggc

SEQ ID NO: 155585 - DNA, 25 bp, Mus musculus
ttttagcagctaccatgaggccacc

SEQ ID NO: 155586 - DNA, 25 bp, Mus musculus
ttttagccataactcttggaggccc

SEQ ID NO: 155587 - DNA, 25 bp, Mus musculus
ttttaggacagtagaagggacagcc

SEQ ID NO: 155588 - DNA, 25 bp, Mus musculus
ttttaggccagtgccgggacaatgc

SEQ ID NO: 155589 - DNA, 25 bp, Mus musculus
ttttaggctagccaaagcatcagca

SEQ ID NO: 155590 - DNA, 25 bp, Mus musculus
ttttaggtgatagtgcagccggcat

SEQ ID NO: 155591 - DNA, 25 bp, Mus musculus
ttttagtgacgatgagcaaggcgga

SEQ ID NO: 155592 - DNA, 25 bp, Mus musculus
ttttataaccccttgacgcccatga

SEQ ID NO: 155593 - DNA, 25 bp, Mus musculus
ttttataccatgatccgctgcctgc

SEQ ID NO: 155594 - DNA, 25 bp, Mus musculus
ttttatatggcaccgcagagcaccc

SEQ ID NO: 155595 - DNA, 25 bp, Mus musculus
ttttatatgtccgaaaacggccgag

SEQ ID NO: 155596 - DNA, 25 bp, Mus musculus
ttttatcagaggacagagatcccaa

SEQ ID NO: 155597 - DNA, 25 bp, Mus musculus
ttttatcaggccaggaaatgcgttg

SEQ ID NO: 155598 - DNA, 25 bp, Mus musculus
ttttatccgggtaggagccacatcc

SEQ ID NO: 155599 - DNA, 25 bp, Mus musculus
ttttatgccgtcctcgctttccggc

SEQ ID NO: 155600 - DNA, 25 bp, Mus musculus
ttttatgcgggccaggaatgctacc

SEQ ID NO: 155601 - DNA, 25 bp, Mus musculus
ttttatgtccgaggagatggtacca

SEQ ID NO: 155602 - DNA, 25 bp, Mus musculus
ttttattgccttctcaccagctgca

SEQ ID NO: 155603 - DNA, 25 bp, Mus musculus
ttttattgtatctactggaacaagg

SEQ ID NO: 155604 - DNA, 25 bp, Mus musculus
ttttattgtttagaagtacacatgc

SEQ ID NO: 155605 - DNA, 25 bp, Mus musculus
ttttcaacaccagcgagaactcgat

SEQ ID NO: 155606 - DNA, 25 bp, Mus musculus
ttttcaacgacgagtggacgggtct

SEQ ID NO: 155607 - DNA, 25 bp, Mus musculus
ttttcaacgtgttcctttacagacg

SEQ ID NO: 155608 - DNA, 25 bp, Mus musculus
ttttcaactctgctagggcccagtc

SEQ ID NO: 155609 - DNA, 25 bp, Mus musculus
ttttcaagagagattgggcctgccc

SEQ ID NO: 155610 - DNA, 25 bp, Mus musculus
ttttcaagtccggaggaacctggca

SEQ ID NO: 155611 - DNA, 25 bp, Mus musculus
ttttcaagtgctgtccagcggcagg

SEQ ID NO: 155612 - DNA, 25 bp, Mus musculus
ttttcaagttgccaggaagactcgg

SEQ ID NO: 155613 - DNA, 25 bp, Mus musculus
ttttcaattgggtaagcatcaggca

SEQ ID NO: 155614 - DNA, 25 bp, Mus musculus
ttttcacaatggacaccgtgcgagg

SEQ ID NO: 155615 - DNA, 25 bp, Mus musculus
ttttcaccgagacggatgatccgga

SEQ ID NO: 155616 - DNA, 25 bp, Mus musculus
ttttcacgacgctggagtacggacc

SEQ ID NO: 155617 - DNA, 25 bp, Mus musculus
ttttcacgatgacttcagaggaggg

SEQ ID NO: 155618 - DNA, 25 bp, Mus musculus
ttttcacggcaacatgggctcaggc

SEQ ID NO: 155619 - DNA, 25 bp, Mus musculus
ttttcacgtgcaacagaggtctcag

SEQ ID NO: 155620 - DNA, 25 bp, Mus musculus
ttttcactgacagactgggaggcac

SEQ ID NO: 155621 - DNA, 25 bp, Mus musculus
ttttcactgcgcctgggatccgggc

SEQ ID NO: 155622 - DNA, 25 bp, Mus musculus
ttttcagaacagacagagcatctag

SEQ ID NO: 155623 - DNA, 25 bp, Mus musculus
ttttcagaaggaggagggcaccgtc

SEQ ID NO: 155624 - DNA, 25 bp, Mus musculus
ttttcagacgagaatgtccgggcca

SEQ ID NO: 155625 - DNA, 25 bp, Mus musculus
ttttcagcaaagtggtgtggcccct

SEQ ID NO: 155626 - DNA, 25 bp, Mus musculus
ttttcagcaggaagatgccggttca

SEQ ID NO: 155627 - DNA, 25 bp, Mus musculus
ttttcagccctggagtcgaggcacc

SEQ ID NO: 155628 - DNA, 25 bp, Mus musculus
ttttcagctctagaccacacagaag

SEQ ID NO: 155629 - DNA, 25 bp, Mus musculus
ttttcagctttctcgatggacacct

SEQ ID NO: 155630 - DNA, 25 bp, Mus musculus
ttttcaggacaatagcccagacagc

SEQ ID NO: 155631 - DNA, 25 bp, Mus musculus
ttttcaggccaaaaaagagccccag

SEQ ID NO: 155632 - DNA, 25 bp, Mus musculus
ttttcagggatacacttgtccaggg

SEQ ID NO: 155633 - DNA, 25 bp, Mus musculus
ttttcagtactaacgctgccggcgc

SEQ ID NO: 155634 - DNA, 25 bp, Mus musculus
ttttcatacatcgaagggtccaagg

SEQ ID NO: 155635 - DNA, 25 bp, Mus musculus
ttttcatcacgaagacgctgggtgc

SEQ ID NO: 155636 - DNA, 25 bp, Mus musculus
ttttcatcgagatcgcctacaagcg

SEQ ID NO: 155637 - DNA, 25 bp, Mus musculus
ttttcatcgccctgaactggctggg

SEQ ID NO: 155638 - DNA, 25 bp, Mus musculus
ttttcatgtcctcagcgggtgtcgc

SEQ ID NO: 155639 - DNA, 25 bp, Mus musculus
ttttccaacgaaagcacggcagtga

SEQ ID NO: 155640 - DNA, 25 bp, Mus musculus
ttttccaagctacgcaggcacaggg

SEQ ID NO: 155641 - DNA, 25 bp, Mus musculus
ttttccacatatagccagagcccgc

SEQ ID NO: 155642 - DNA, 25 bp, Mus musculus
ttttccacggcgactcagagattga

SEQ ID NO: 155643 - DNA, 25 bp, Mus musculus
ttttccagaagccaagggtccaagt

SEQ ID NO: 155644 - DNA, 25 bp, Mus musculus
ttttccagagcaccccgaagctcac

SEQ ID NO: 155645 - DNA, 25 bp, Mus musculus
ttttccagatgcgagaagcctactg

SEQ ID NO: 155646 - DNA, 25 bp, Mus musculus
ttttccaggcactgaggaccgcagt

SEQ ID NO: 155647 - DNA, 25 bp, Mus musculus
ttttccagggcagaacagcagcaga

SEQ ID NO: 155648 - DNA, 25 bp, Mus musculus
ttttccagggctgacagcagggctt

SEQ ID NO: 155649 - DNA, 25 bp, Mus musculus
ttttcccagacacaaggccaggagc

SEQ ID NO: 155650 - DNA, 25 bp, Mus musculus
ttttcccaggagaatcaattaaggc

SEQ ID NO: 155651 - DNA, 25 bp, Mus musculus
ttttccccaggagacgtcatcatgt

SEQ ID NO: 155652 - DNA, 25 bp, Mus musculus
ttttcccggacacaacctgagatgg

SEQ ID NO: 155653 - DNA, 25 bp, Mus musculus
ttttccctacgttaaggtgcacacg

SEQ ID NO: 155654 - DNA, 25 bp, Mus musculus
ttttccgctttgctgacctgacggg

SEQ ID NO: 155655 - DNA, 25 bp, Mus musculus
ttttccggagtgaggagatgacgct

SEQ ID NO: 155656 - DNA, 25 bp, Mus musculus
ttttcctctgagaagcccaggtggc

SEQ ID NO: 155657 - DNA, 25 bp, Mus musculus
ttttcctgcacgaccggacgagcag

SEQ ID NO: 155658 - DNA, 25 bp, Mus musculus
ttttcctggaccagagggaccctcg

SEQ ID NO: 155659 - DNA, 25 bp, Mus musculus
ttttcctggttcacggacagcggca

SEQ ID NO: 155660 - DNA, 25 bp, Mus musculus
ttttccttaagtggccggctgcccg

SEQ ID NO: 155661 - DNA, 25 bp, Mus musculus
ttttccttctctcaacggagccggg

SEQ ID NO: 155662 - DNA, 25 bp, Mus musculus
ttttcgaggacgctcgcgttcggct

SEQ ID NO: 155663 - DNA, 25 bp, Mus musculus
ttttcgatgccagtgtgagccaggc

SEQ ID NO: 155664 - DNA, 25 bp, Mus musculus
ttttcggagctgacgttgggcaacg

SEQ ID NO: 155665 - DNA, 25 bp, Mus musculus
ttttcgtcgataacacgcacgaggc

SEQ ID NO: 155666 - DNA, 25 bp, Mus musculus
ttttcgtgggcaatgtatcggctgc

SEQ ID NO: 155667 - DNA, 25 bp, Mus musculus
ttttcgtggtgatggaacactgcct

SEQ ID NO: 155668 - DNA, 25 bp, Mus musculus
ttttctaacgcctggactgagctgg

SEQ ID NO: 155669 - DNA, 25 bp, Mus musculus
ttttctacttcgaaagcgactccag

SEQ ID NO: 155670 - DNA, 25 bp, Mus musculus
ttttctaggaaacctagtggaagct

SEQ ID NO: 155671 - DNA, 25 bp, Mus musculus
ttttctagtgttcaccgagcccggg

SEQ ID NO: 155672 - DNA, 25 bp, Mus musculus
ttttctcagacaagaagtccccggg

SEQ ID NO: 155673 - DNA, 25 bp, Mus musculus
ttttctcccgggacaagaagcgcct

SEQ ID NO: 155674 - DNA, 25 bp, Mus musculus
ttttctcggttcagtctccgtgaag

SEQ ID NO: 155675 - DNA, 25 bp, Mus musculus
ttttctcgtcatgccaagccagcag

SEQ ID NO: 155676 - DNA, 25 bp, Mus musculus
ttttctctgcaggatgtagctgagc

SEQ ID NO: 155677 - DNA, 25 bp, Mus musculus
ttttctctgtcaagtactgcagtca

SEQ ID NO: 155678 - DNA, 25 bp, Mus musculus
ttttctgaataccaagctgcaggcg

SEQ ID NO: 155679 - DNA, 25 bp, Mus musculus
ttttctgacaatgagatccggaaac

SEQ ID NO: 155680 - DNA, 25 bp, Mus musculus
ttttctgccataccatgcactgcgg

SEQ ID NO: 155681 - DNA, 25 bp, Mus musculus
ttttctgcgggcgaaccccgtgtgc

SEQ ID NO: 155682 - DNA, 25 bp, Mus musculus
ttttctggccgaacgtggactggac

SEQ ID NO: 155683 - DNA, 25 bp, Mus musculus
ttttctgggttgaattgtcagtatc

SEQ ID NO: 155684 - DNA, 25 bp, Mus musculus
ttttctggtggtctccagcgaagac

SEQ ID NO: 155685 - DNA, 25 bp, Mus musculus
ttttctgtaaaagcaagccctcctg

SEQ ID NO: 155686 - DNA, 25 bp, Mus musculus
ttttcttagcgcgaagcgggcacgg

SEQ ID NO: 155687 - DNA, 25 bp, Mus musculus
ttttcttccggaccaagatcagcgg

SEQ ID NO: 155688 - DNA, 25 bp, Mus musculus
ttttctttaaacatgctggccaggg

SEQ ID NO: 155689 - DNA, 25 bp, Mus musculus
ttttctttgggaaagaaaccatgca

SEQ ID NO: 155690 - DNA, 25 bp, Mus musculus
ttttgaaaaccaccacagtccgatg

SEQ ID NO: 155691 - DNA, 25 bp, Mus musculus
ttttgaaaatgtcccatcctcagga

SEQ ID NO: 155692 - DNA, 25 bp, Mus musculus
ttttgaaaccagtgctgccaacggg

SEQ ID NO: 155693 - DNA, 25 bp, Mus musculus
ttttgaaactgaagccccaggagga

SEQ ID NO: 155694 - DNA, 25 bp, Mus musculus
ttttgaaatgcaactctgtacagag

SEQ ID NO: 155695 - DNA, 25 bp, Mus musculus
ttttgaacgtcgcagagaactcagg

SEQ ID NO: 155696 - DNA, 25 bp, Mus musculus
ttttgaagagctgccaacacccaag

SEQ ID NO: 155697 - DNA, 25 bp, Mus musculus
ttttgaagcagaacctctccctgag

SEQ ID NO: 155698 - DNA, 25 bp, Mus musculus
ttttgaagtcgctgacccggagcag

SEQ ID NO: 155699 - DNA, 25 bp, Mus musculus
ttttgacagtgaccccgtggaaggc

SEQ ID NO: 155700 - DNA, 25 bp, Mus musculus
ttttgacatctggaacagggtcgca

SEQ ID NO: 155701 - DNA, 25 bp, Mus musculus
ttttgacatggtgaaaggcggtgca

SEQ ID NO: 155702 - DNA, 25 bp, Mus musculus
ttttgaccataaaaaagctcatgtg

SEQ ID NO: 155703 - DNA, 25 bp, Mus musculus
ttttgacccaaaggccatgctgcct

SEQ ID NO: 155704 - DNA, 25 bp, Mus musculus
ttttgacggcgacgatgccatctca

SEQ ID NO: 155705 - DNA, 25 bp, Mus musculus
ttttgactaccagcgcaagagccct

SEQ ID NO: 155706 - DNA, 25 bp, Mus musculus
ttttgagaacaaaaggcccctgcgt

SEQ ID NO: 155707 - DNA, 25 bp, Mus musculus
ttttgagatctacttatgctttggg

SEQ ID NO: 155708 - DNA, 25 bp, Mus musculus
ttttgagcactgagcctatgggaca

SEQ ID NO: 155709 - DNA, 25 bp, Mus musculus
ttttgataataactccggctactgg

SEQ ID NO: 155710 - DNA, 25 bp, Mus musculus
ttttgatacgccagatgaggatccc

SEQ ID NO: 155711 - DNA, 25 bp, Mus musculus
ttttgatagtcctgcagccgcacag

SEQ ID NO: 155712 - DNA, 25 bp, Mus musculus
ttttgatcacccacccttgcgagag

SEQ ID NO: 155713 - DNA, 25 bp, Mus musculus
ttttgatgacacgagttctgcccca

SEQ ID NO: 155714 - DNA, 25 bp, Mus musculus
ttttgatgcttcaggattccccacc

SEQ ID NO: 155715 - DNA, 25 bp, Mus musculus
ttttgcacaagaaatcctttttggg

SEQ ID NO: 155716 - DNA, 25 bp, Mus musculus
ttttgcacaagtacgcactgagcgg

SEQ ID NO: 155717 - DNA, 25 bp, Mus musculus
ttttgcaccaaaaaatccatgcccg

SEQ ID NO: 155718 - DNA, 25 bp, Mus musculus
ttttgcaccgaaacagggctgcttg

SEQ ID NO: 155719 - DNA, 25 bp, Mus musculus
ttttgcactcagaccgagatccgat

SEQ ID NO: 155720 - DNA, 25 bp, Mus musculus
ttttgcagacccatctcttgagatc

SEQ ID NO: 155721 - DNA, 25 bp, Mus musculus
ttttgcataaaaagggaactcgtga

SEQ ID NO: 155722 - DNA, 25 bp, Mus musculus
ttttgccatgcaagatgtgcccctg

SEQ ID NO: 155723 - DNA, 25 bp, Mus musculus
ttttgccatgttgaccgcacccaga

SEQ ID NO: 155724 - DNA, 25 bp, Mus musculus
ttttgccctgtaaaagaggcgctag

SEQ ID NO: 155725 - DNA, 25 bp, Mus musculus
ttttgcctgagacaagccaagtgtg

SEQ ID NO: 155726 - DNA, 25 bp, Mus musculus
ttttgccttacgtggcacactggag

SEQ ID NO: 155727 - DNA, 25 bp, Mus musculus
ttttgcgcccttgaccgatgccaag

SEQ ID NO: 155728 - DNA, 25 bp, Mus musculus
ttttgcgcgtgccaaattcacggcg

SEQ ID NO: 155729 - DNA, 25 bp, Mus musculus
ttttgcgtggaagcccagtcctgga

SEQ ID NO: 155730 - DNA, 25 bp, Mus musculus
ttttgcgttgaggacagcaccgacg

SEQ ID NO: 155731 - DNA, 25 bp, Mus musculus
ttttgcgttgcattccactgagccg

SEQ ID NO: 155732 - DNA, 25 bp, Mus musculus
ttttgctaagaccacagccatgtgt

SEQ ID NO: 155733 - DNA, 25 bp, Mus musculus
ttttgctacgaaggatcgcctccga

SEQ ID NO: 155734 - DNA, 25 bp, Mus musculus
ttttgctcagtctccgcaggaaggg

SEQ ID NO: 155735 - DNA, 25 bp, Mus musculus
ttttgctcgagattcctccaggcac

SEQ ID NO: 155736 - DNA, 25 bp, Mus musculus
ttttgctctgcacaggaccacgctg

SEQ ID NO: 155737 - DNA, 25 bp, Mus musculus
ttttgctgaacatcgaagtgggctg

SEQ ID NO: 155738 - DNA, 25 bp, Mus musculus
ttttggaaaatatcagccctgcaga

SEQ ID NO: 155739 - DNA, 25 bp, Mus musculus
ttttggaaatcctcaacgcttggga

SEQ ID NO: 155740 - DNA, 25 bp, Mus musculus
ttttggaatggacagcaagctggca

SEQ ID NO: 155741 - DNA, 25 bp, Mus musculus
ttttggaattggacaaggagcctcg

SEQ ID NO: 155742 - DNA, 25 bp, Mus musculus
ttttggacaagttgaaaccgccagg

SEQ ID NO: 155743 - DNA, 25 bp, Mus musculus
ttttggagcagacaaatggctgagc

SEQ ID NO: 155744 - DNA, 25 bp, Mus musculus
ttttggaggatcagccggaacgacc

SEQ ID NO: 155745 - DNA, 25 bp, Mus musculus
ttttggatgtgtacagtgatgagca

SEQ ID NO: 155746 - DNA, 25 bp, Mus musculus
ttttggcacaaaaggctgcagaggc

SEQ ID NO: 155747 - DNA, 25 bp, Mus musculus
ttttggccggtactcttcacaacgg

SEQ ID NO: 155748 - DNA, 25 bp, Mus musculus
ttttggcgaatacagcgcatgctcg

SEQ ID NO: 155749 - DNA, 25 bp, Mus musculus
ttttgggagagaactatgttcattg

SEQ ID NO: 155750 - DNA, 25 bp, Mus musculus
ttttgggcaccaggaagacctatgc

SEQ ID NO: 155751 - DNA, 25 bp, Mus musculus
ttttgggcagcaagaagacacctcc

SEQ ID NO: 155752 - DNA, 25 bp, Mus musculus
ttttgggcgagatcgatccggacca

SEQ ID NO: 155753 - DNA, 25 bp, Mus musculus
ttttggtgaacctgagtcgctgtcg

SEQ ID NO: 155754 - DNA, 25 bp, Mus musculus
ttttgtagggttctctctgacgcgg

SEQ ID NO: 155755 - DNA, 25 bp, Mus musculus
ttttgtcacaaagagtcctaactgg

SEQ ID NO: 155756 - DNA, 25 bp, Mus musculus
ttttgtcaccaagccctatttggcg

SEQ ID NO: 155757 - DNA, 25 bp, Mus musculus
ttttgtcagagaacgcaggtcacct

SEQ ID NO: 155758 - DNA, 25 bp, Mus musculus
ttttgtcagcagcaagacgcaggtg

SEQ ID NO: 155759 - DNA, 25 bp, Mus musculus
ttttgtcgtaggtgccgtgtcccca

SEQ ID NO: 155760 - DNA, 25 bp, Mus musculus
ttttgtggacccagataagcagcgg

SEQ ID NO: 155761 - DNA, 25 bp, Mus musculus
ttttgtggcttcaagttgccctcct

SEQ ID NO: 155762 - DNA, 25 bp, Mus musculus
ttttgtgtgcactcttgttccatga

SEQ ID NO: 155763 - DNA, 25 bp, Mus musculus
ttttgttcggatcgcccatcagaag

SEQ ID NO: 155764 - DNA, 25 bp, Mus musculus
ttttgttctttgtcctagcacaaca

SEQ ID NO: 155765 - DNA, 25 bp, Mus musculus
ttttgtttgcagtgtcaaccggaca

SEQ ID NO: 155766 - DNA, 25 bp, Mus musculus
tttttaagaccctgacggcagctgg

SEQ ID NO: 155767 - DNA, 25 bp, Mus musculus
tttttaagcaaggtggagtcactcc

SEQ ID NO: 155768 - DNA, 25 bp, Mus musculus
tttttaaggcgagatgcagcacagc

SEQ ID NO: 155769 - DNA, 25 bp, Mus musculus
tttttacaaagatgggaaacggctg

SEQ ID NO: 155770 - DNA, 25 bp, Mus musculus
tttttaccaagaaagggagagcctg

SEQ ID NO: 155771 - DNA, 25 bp, Mus musculus
tttttacctagaccagtggaccctg

SEQ ID NO: 155772 - DNA, 25 bp, Mus musculus
tttttactggtcaaacggtctgatc

SEQ ID NO: 155773 - DNA, 25 bp, Mus musculus
tttttagaccactcgtcacgtccgg

SEQ ID NO: 155774 - DNA, 25 bp, Mus musculus
tttttagcaaccagccagagagggc

SEQ ID NO: 155775 - DNA, 25 bp, Mus musculus
tttttagccaccaattaatgacagg

SEQ ID NO: 155776 - DNA, 25 bp, Mus musculus
tttttcaaaagatagcggcgcagca

SEQ ID NO: 155777 - DNA, 25 bp, Mus musculus
tttttccacccacggactctcggtg

SEQ ID NO: 155778 - DNA, 25 bp, Mus musculus
tttttccactattattgcatgcaga

SEQ ID NO: 155779 - DNA, 25 bp, Mus musculus
tttttccagcacttcattgagtgca

SEQ ID NO: 155780 - DNA, 25 bp, Mus musculus
tttttctaccatggcagcccaaggc

SEQ ID NO: 155781 - DNA, 25 bp, Mus musculus
tttttcttacaatgtttgcaacgtt

SEQ ID NO: 155782 - DNA, 25 bp, Mus musculus
tttttgaccaacacgtggatgaggc

SEQ ID NO: 155783 - DNA, 25 bp, Mus musculus
tttttgactcccctgtggcccggat

SEQ ID NO: 155784 - DNA, 25 bp, Mus musculus
tttttgagtgagcaaccatctgtgg

SEQ ID NO: 155785 - DNA, 25 bp, Mus musculus
tttttgatgctgagggtgctcccca

SEQ ID NO: 155786 - DNA, 25 bp, Mus musculus
tttttgcagggtttgcacaggcccc

SEQ ID NO: 155787 - DNA, 25 bp, Mus musculus
tttttgccagcatcgtacgggtgag

SEQ ID NO: 155788 - DNA, 25 bp, Mus musculus
tttttgctagccaattcttagatcc

SEQ ID NO: 155789 - DNA, 25 bp, Mus musculus
tttttggagagttatgccacagaca

SEQ ID NO: 155790 - DNA, 25 bp, Mus musculus
tttttggagcaaacacagttgtagc

SEQ ID NO: 155791 - DNA, 25 bp, Mus musculus
tttttggctgttgctggccgcgcct

SEQ ID NO: 155792 - DNA, 25 bp, Mus musculus
tttttgggtgggatagcccgaatag

SEQ ID NO: 155793 - DNA, 25 bp, Mus musculus
tttttggtttctgctgctgaggaac

SEQ ID NO: 155794 - DNA, 25 bp, Mus musculus
tttttgtggagaagggcagccttgc

SEQ ID NO: 155795 - DNA, 25 bp, Mus musculus
tttttgttcaagagcgagacgtcca

SEQ ID NO: 155796 - DNA, 25 bp, Mus musculus
tttttgtttttagcaggctgtcctg

SEQ ID NO: 155797 - DNA, 25 bp, Mus musculus
ttttttccgaagaaccatccgattg

SEQ ID NO: 155798 - DNA, 25 bp, Mus musculus
ttttttcgggacacggatgccaagt

SEQ ID NO: 155799 - DNA, 25 bp, Mus musculus
ttttttctgacaacagaatgttctc

SEQ ID NO: 155800 - DNA, 25 bp, Mus musculus
ttttttgaaactcagccctgccgcg

SEQ ID NO: 155801 - DNA, 25 bp, Mus musculus
ttttttgagcgggacggacagccct

SEQ ID NO: 155802 - DNA, 25 bp, Mus musculus
ttttttgcaagccacagacactgag

SEQ ID NO: 155803 - DNA, 25 bp, Mus musculus
ttttttggcaacatcacccgggaag

SEQ ID NO: 155804 - DNA, 25 bp, Mus musculus
ttttttggcattacgcggcatccga

SEQ ID NO: 155805 - DNA, 25 bp, Mus musculus
aaaaaaaaaccagtggagcagcgtg

SEQ ID NO: 155806 - DNA, 25 bp, Mus musculus
aaaaaaaaccagtggagcagcgtga

SEQ ID NO: 155807 - DNA, 25 bp, Mus musculus
aaaaaaaatcaaaagagaagctgct

SEQ ID NO: 155808 - DNA, 25 bp, Mus musculus
aaaaaaacacctggacttctctgag

SEQ ID NO: 155809 - DNA, 25 bp, Mus musculus
aaaaaaaccagtggagcagcgtgac

SEQ ID NO: 155810 - DNA, 25 bp, Mus musculus
aaaaaaactggaagccaagtacaag

SEQ ID NO: 155811 - DNA, 25 bp, Mus musculus
aaaaaaactggaagtcagcaggggg

SEQ ID NO: 155812 - DNA, 25 bp, Mus musculus
aaaaaaagaaatcacaattcacaag

SEQ ID NO: 155813 - DNA, 25 bp, Mus musculus
aaaaaaagaaggtgacacagcatcc

SEQ ID NO: 155814 - DNA, 25 bp, Mus musculus
aaaaaaagctcaggagaaatcaaaa

SEQ ID NO: 155815 - DNA, 25 bp, Mus musculus
aaaaaaaggagctgggggacagctc

SEQ ID NO: 155816 - DNA, 25 bp, Mus musculus
aaaaaaataatggcgcccagagcat

SEQ ID NO: 155817 - DNA, 25 bp, Mus musculus
aaaaaaataatggcggctattgata

SEQ ID NO: 155818 - DNA, 25 bp, Mus musculus
aaaaaaatcaaaagagaagctgctg

SEQ ID NO: 155819 - DNA, 25 bp, Mus musculus
aaaaaaattcagggaatgcagtcgg

SEQ ID NO: 155820 - DNA, 25 bp, Mus musculus
aaaaaaattcatctacaggctctgc

SEQ ID NO: 155821 - DNA, 25 bp, Mus musculus
aaaaaacaacaaggagtacctggag

SEQ ID NO: 155822 - DNA, 25 bp, Mus musculus
aaaaaacacagctgcctgccttgtc

SEQ ID NO: 155823 - DNA, 25 bp, Mus musculus
aaaaaaccagatcatcacctccacc

SEQ ID NO: 155824 - DNA, 25 bp, Mus musculus
aaaaaaccagtgcctccgaagccag

SEQ ID NO: 155825 - DNA, 25 bp, Mus musculus
aaaaaaccagtggagcagcgtgact

SEQ ID NO: 155826 - DNA, 25 bp, Mus musculus
aaaaaaccgaatcgccatctatgag

SEQ ID NO: 155827 - DNA, 25 bp, Mus musculus
aaaaaacgcaaaatagaacaggtag

SEQ ID NO: 155828 - DNA, 25 bp, Mus musculus
aaaaaactggaagccaagtacaaga

SEQ ID NO: 155829 - DNA, 25 bp, Mus musculus
aaaaaactggaagtcagcagggggc

SEQ ID NO: 155830 - DNA, 25 bp, Mus musculus
aaaaaacttgagcccagcgggccca

SEQ ID NO: 155831 - DNA, 25 bp, Mus musculus
aaaaaagactctgtcggggctggtg

SEQ ID NO: 155832 - DNA, 25 bp, Mus musculus
aaaaaagcagtggtttgtattgagg

SEQ ID NO: 155833 - DNA, 25 bp, Mus musculus
aaaaaagccaggcctctgatcctgg

SEQ ID NO: 155834 - DNA, 25 bp, Mus musculus
aaaaaagctcaggagaaatcaaaac

SEQ ID NO: 155835 - DNA, 25 bp, Mus musculus
aaaaaaggaaatctgatctccaaga

SEQ ID NO: 155836 - DNA, 25 bp, Mus musculus
aaaaaaggaaatctgtattatgttc

SEQ ID NO: 155837 - DNA, 25 bp, Mus musculus
aaaaaaggagctgggggacagctct

SEQ ID NO: 155838 - DNA, 25 bp, Mus musculus
aaaaaagtaaaagaattgcggcgag

SEQ ID NO: 155839 - DNA, 25 bp, Mus musculus
aaaaaagtaaaagcacttggtggat

SEQ ID NO: 155840 - DNA, 25 bp, Mus musculus
aaaaaataaggctcatcctaaagta

SEQ ID NO: 155841 - DNA, 25 bp, Mus musculus
aaaaaataatggcgcccagagcata

SEQ ID NO: 155842 - DNA, 25 bp, Mus musculus
aaaaaataatggcggctattgatac

SEQ ID NO: 155843 - DNA, 25 bp, Mus musculus
aaaaaatcaaaagagaagctgctgt

SEQ ID NO: 155844 - DNA, 25 bp, Mus musculus
aaaaaatcagggcttgcggcttatt

SEQ ID NO: 155845 - DNA, 25 bp, Mus musculus
aaaaaatctccaggtcccgtcagga

SEQ ID NO: 155846 - DNA, 25 bp, Mus musculus
aaaaaatctttaaaatcgatcaaat

SEQ ID NO: 155847 - DNA, 25 bp, Mus musculus
aaaaaatggacaggaatctgaattt

SEQ ID NO: 155848 - DNA, 25 bp, Mus musculus
aaaaaatggacagttgtctcaaaag

SEQ ID NO: 155849 - DNA, 25 bp, Mus musculus
aaaaaatgggtggacttggcctgga

SEQ ID NO: 155850 - DNA, 25 bp, Mus musculus
aaaaaatggtgacgccatcttctga

SEQ ID NO: 155851 - DNA, 25 bp, Mus musculus
aaaaaatggtgaggccatcttctga

SEQ ID NO: 155852 - DNA, 25 bp, Mus musculus
aaaaaattacacaaacattacttca

SEQ ID NO: 155853 - DNA, 25 bp, Mus musculus
aaaaaattcagggaatgcagtcgga

SEQ ID NO: 155854 - DNA, 25 bp, Mus musculus
aaaaacaaaaaaaagctgctgatca

SEQ ID NO: 155855 - DNA, 25 bp, Mus musculus
aaaaacaaagggaatgtgactattt

SEQ ID NO: 155856 - DNA, 25 bp, Mus musculus
aaaaacaaatgcaatttcaagttct

SEQ ID NO: 155857 - DNA, 25 bp, Mus musculus
aaaaacaacaaggagtacctggagt

SEQ ID NO: 155858 - DNA, 25 bp, Mus musculus
aaaaacaacagaatcaagacacatt

SEQ ID NO: 155859 - DNA, 25 bp, Mus musculus
aaaaacaacaggctcctcaactttc

SEQ ID NO: 155860 - DNA, 25 bp, Mus musculus
aaaaacaacatcctgcggtattcct

SEQ ID NO: 155861 - DNA, 25 bp, Mus musculus
aaaaacaagagacagaaccctgtgt

SEQ ID NO: 155862 - DNA, 25 bp, Mus musculus
aaaaacaagagagtctcactatgta

SEQ ID NO: 155863 - DNA, 25 bp, Mus musculus
aaaaacaagagcagtcagcacggca

SEQ ID NO: 155864 - DNA, 25 bp, Mus musculus
aaaaacaagagggtggagatggcga

SEQ ID NO: 155865 - DNA, 25 bp, Mus musculus
aaaaacaagcatcagggggtccgcc

SEQ ID NO: 155866 - DNA, 25 bp, Mus musculus
aaaaacaagtggagagattttgggc

SEQ ID NO: 155867 - DNA, 25 bp, Mus musculus
aaaaacacagaatctgctggatgat

SEQ ID NO: 155868 - DNA, 25 bp, Mus musculus
aaaaacacagactgcgatggatcag

SEQ ID NO: 155869 - DNA, 25 bp, Mus musculus
aaaaacacagagcttaccatctagc

SEQ ID NO: 155870 - DNA, 25 bp, Mus musculus
aaaaacacagctgcctgccttgtcc

SEQ ID NO: 155871 - DNA, 25 bp, Mus musculus
aaaaacacaggcagagctcagatag

SEQ ID NO: 155872 - DNA, 25 bp, Mus musculus
aaaaacacagggggaagagggcagc

SEQ ID NO: 155873 - DNA, 25 bp, Mus musculus
aaaaacacagttatgaacatcagaa

SEQ ID NO: 155874 - DNA, 25 bp, Mus musculus
aaaaacacagttatgtatgcaattg

SEQ ID NO: 155875 - DNA, 25 bp, Mus musculus
aaaaacagaaggcgaaggacgaacg

SEQ ID NO: 155876 - DNA, 25 bp, Mus musculus
aaaaacagctagctgcacgagaaac

SEQ ID NO: 155877 - DNA, 25 bp, Mus musculus
aaaaacagtacagattgctaagaag

SEQ ID NO: 155878 - DNA, 25 bp, Mus musculus
aaaaacagtatgtgtgcagttatga

SEQ ID NO: 155879 - DNA, 25 bp, Mus musculus
aaaaacatcctacaggaacttctgg

SEQ ID NO: 155880 - DNA, 25 bp, Mus musculus
aaaaacatcctacaggtatttcgaa

SEQ ID NO: 155881 - DNA, 25 bp, Mus musculus
aaaaacatcgagatcaagaagttgg

SEQ ID NO: 155882 - DNA, 25 bp, Mus musculus
aaaaacattgcaaagaactgacata

SEQ ID NO: 155883 - DNA, 25 bp, Mus musculus
aaaaaccaaagaatgacttcgctcc

SEQ ID NO: 155884 - DNA, 25 bp, Mus musculus
aaaaaccaaaggccagcgtgacggc

SEQ ID NO: 155885 - DNA, 25 bp, Mus musculus
aaaaaccaagaatggattgtcgcca

SEQ ID NO: 155886 - DNA, 25 bp, Mus musculus
aaaaaccaagaggaaagcatagatg

SEQ ID NO: 155887 - DNA, 25 bp, Mus musculus
aaaaaccaatggctccccctgtgat

SEQ ID NO: 155888 - DNA, 25 bp, Mus musculus
aaaaaccagaagcctgtgccatctc

SEQ ID NO: 155889 - DNA, 25 bp, Mus musculus
aaaaaccagtgcctccgaagccaga

SEQ ID NO: 155890 - DNA, 25 bp, Mus musculus
aaaaaccatctttcaggacctgccg

SEQ ID NO: 155891 - DNA, 25 bp, Mus musculus
aaaaacccaaagatgcagacagcct

SEQ ID NO: 155892 - DNA, 25 bp, Mus musculus
aaaaaccgaagcgcagcagcagttt

SEQ ID NO: 155893 - DNA, 25 bp, Mus musculus
aaaaaccgaatcgccatctatgaga

SEQ ID NO: 155894 - DNA, 25 bp, Mus musculus
aaaaaccgcacggccttcaacactg

SEQ ID NO: 155895 - DNA, 25 bp, Mus musculus
aaaaacctgaaatctgcctccaaca

SEQ ID NO: 155896 - DNA, 25 bp, Mus musculus
aaaaacgcaaaatagaacaggtagt

SEQ ID NO: 155897 - DNA, 25 bp, Mus musculus
aaaaactacaaaatccacaggtagc

SEQ ID NO: 155898 - DNA, 25 bp, Mus musculus
aaaaactacagaagttaaatgaagt

SEQ ID NO: 155899 - DNA, 25 bp, Mus musculus
aaaaactacctggatgcccagtact

SEQ ID NO: 155900 - DNA, 25 bp, Mus musculus
aaaaactatgagattaaaacaaggg

SEQ ID NO: 155901 - DNA, 25 bp, Mus musculus
aaaaactatgagttctgaatttcat

SEQ ID NO: 155902 - DNA, 25 bp, Mus musculus
aaaaactcaagatgtggagtacatg

SEQ ID NO: 155903 - DNA, 25 bp, Mus musculus
aaaaactcaggtcctttgcaaacac

SEQ ID NO: 155904 - DNA, 25 bp, Mus musculus
aaaaactcagtcgtgcggggtcctc

SEQ ID NO: 155905 - DNA, 25 bp, Mus musculus
aaaaactgccagttggtggcactaa

SEQ ID NO: 155906 - DNA, 25 bp, Mus musculus
aaaaactgctttgcacgtgacacaa

SEQ ID NO: 155907 - DNA, 25 bp, Mus musculus
aaaaactggagacctcaggaaagtg

SEQ ID NO: 155908 - DNA, 25 bp, Mus musculus
aaaaactgtaataaggatgaggctg

SEQ ID NO: 155909 - DNA, 25 bp, Mus musculus
aaaaacttaagtaaatttgatcctg

SEQ ID NO: 155910 - DNA, 25 bp, Mus musculus
aaaaacttcagtcccagaagccaaa

SEQ ID NO: 155911 - DNA, 25 bp, Mus musculus
aaaaacttccaacaggttgactaca

SEQ ID NO: 155912 - DNA, 25 bp, Mus musculus
aaaaacttcccaaggcactgtgctt

SEQ ID NO: 155913 - DNA, 25 bp, Mus musculus
aaaaacttctggaattattgaagcc

SEQ ID NO: 155914 - DNA, 25 bp, Mus musculus
aaaaagaaaaacatcattccagaaa

SEQ ID NO: 155915 - DNA, 25 bp, Mus musculus
aaaaagaaagactgccctcccggct

SEQ ID NO: 155916 - DNA, 25 bp, Mus musculus
aaaaagaaatggtgacattccaagc

SEQ ID NO: 155917 - DNA, 25 bp, Mus musculus
aaaaagaacaagaccgtggctaccg

SEQ ID NO: 155918 - DNA, 25 bp, Mus musculus
aaaaagaaggctaatgcttctgtga

SEQ ID NO: 155919 - DNA, 25 bp, Mus musculus
aaaaagaatgatggtcgaatcgatg

SEQ ID NO: 155920 - DNA, 25 bp, Mus musculus
aaaaagaatgcggctggcgcattgg

SEQ ID NO: 155921 - DNA, 25 bp, Mus musculus
aaaaagacaagatctccctaggcga

SEQ ID NO: 155922 - DNA, 25 bp, Mus musculus
aaaaagacagacaaggcttcagaag

SEQ ID NO: 155923 - DNA, 25 bp, Mus musculus
aaaaagacaggttagaaagctgtct

SEQ ID NO: 155924 - DNA, 25 bp, Mus musculus
aaaaagaccaaaggccagccttttg

SEQ ID NO: 155925 - DNA, 25 bp, Mus musculus
aaaaagaccacaaatgggcgacttc

SEQ ID NO: 155926 - DNA, 25 bp, Mus musculus
aaaaagaccacaaattgatccagct

SEQ ID NO: 155927 - DNA, 25 bp, Mus musculus
aaaaagactctgtcggggctggtga

SEQ ID NO: 155928 - DNA, 25 bp, Mus musculus
aaaaagacttggtgattgggatact

SEQ ID NO: 155929 - DNA, 25 bp, Mus musculus
aaaaagagactgttgtaacagttgg

SEQ ID NO: 155930 - DNA, 25 bp, Mus musculus
aaaaagagagggagccccgcgcgaa

SEQ ID NO: 155931 - DNA, 25 bp, Mus musculus
aaaaagagtctgtgctgcaggctgt

SEQ ID NO: 155932 - DNA, 25 bp, Mus musculus
aaaaagataaaaaaggctgcctcac

SEQ ID NO: 155933 - DNA, 25 bp, Mus musculus
aaaaagataaaggagcgaatccgta

SEQ ID NO: 155934 - DNA, 25 bp, Mus musculus
aaaaagatacttccaatcacttcca

SEQ ID NO: 155935 - DNA, 25 bp, Mus musculus
aaaaagatatccttttggataagcc

SEQ ID NO: 155936 - DNA, 25 bp, Mus musculus
aaaaagatcaatggacagctcggct

SEQ ID NO: 155937 - DNA, 25 bp, Mus musculus
aaaaagattcaagaacttggggaca

SEQ ID NO: 155938 - DNA, 25 bp, Mus musculus
aaaaagcacaacccaagaggcactc

SEQ ID NO: 155939 - DNA, 25 bp, Mus musculus
aaaaagcacagaacaagcctgccat

SEQ ID NO: 155940 - DNA, 25 bp, Mus musculus
aaaaagcagcagatgttcaagtttg

SEQ ID NO: 155941 - DNA, 25 bp, Mus musculus
aaaaagcagtcaggatgatgcagct

SEQ ID NO: 155942 - DNA, 25 bp, Mus musculus
aaaaagcagtcagggcaatggcagc

SEQ ID NO: 155943 - DNA, 25 bp, Mus musculus
aaaaagcagtggtttgtattgaggg

SEQ ID NO: 155944 - DNA, 25 bp, Mus musculus
aaaaagcattatgtctggatctctt

SEQ ID NO: 155945 - DNA, 25 bp, Mus musculus
aaaaagccagcaccaagtgatctct

SEQ ID NO: 155946 - DNA, 25 bp, Mus musculus
aaaaagccaggcctctgatcctgga

SEQ ID NO: 155947 - DNA, 25 bp, Mus musculus
aaaaagccagggatggctgtgtgag

SEQ ID NO: 155948 - DNA, 25 bp, Mus musculus
aaaaagctagaggagggcatggata

SEQ ID NO: 155949 - DNA, 25 bp, Mus musculus
aaaaagctagtagagctggaggtgg

SEQ ID NO: 155950 - DNA, 25 bp, Mus musculus
aaaaagctagtagagtatatggagg

SEQ ID NO: 155951 - DNA, 25 bp, Mus musculus
aaaaagctcaggagaaatcaaaact

SEQ ID NO: 155952 - DNA, 25 bp, Mus musculus
aaaaagctcgccacccccatcagtc

SEQ ID NO: 155953 - DNA, 25 bp, Mus musculus
aaaaagctgaaggacagactgcgca

SEQ ID NO: 155954 - DNA, 25 bp, Mus musculus
aaaaagctggaggcaagaaaggaaa

SEQ ID NO: 155955 - DNA, 25 bp, Mus musculus
aaaaaggaaatctgatctccaagag

SEQ ID NO: 155956 - DNA, 25 bp, Mus musculus
aaaaaggaaatctgtattatgttcc

SEQ ID NO: 155957 - DNA, 25 bp, Mus musculus
aaaaaggaacagcaggcagttcctg

SEQ ID NO: 155958 - DNA, 25 bp, Mus musculus
aaaaaggaaggtcatcgtggagaag

SEQ ID NO: 155959 - DNA, 25 bp, Mus musculus
aaaaaggacaaagagcatctaaaga

SEQ ID NO: 155960 - DNA, 25 bp, Mus musculus
aaaaaggagagcctgggcccccaga

SEQ ID NO: 155961 - DNA, 25 bp, Mus musculus
aaaaaggagagcctgtgtgctgata

SEQ ID NO: 155962 - DNA, 25 bp, Mus musculus
aaaaaggagctggaggaggtgcgct

SEQ ID NO: 155963 - DNA, 25 bp, Mus musculus
aaaaaggaggggacgcgaggcgagg

SEQ ID NO: 155964 - DNA, 25 bp, Mus musculus
aaaaaggcagagggagcattcctgg

SEQ ID NO: 155965 - DNA, 25 bp, Mus musculus
aaaaaggccaaaactgtacatcatt

SEQ ID NO: 155966 - DNA, 25 bp, Mus musculus
aaaaaggccaagatatttatcaaca

SEQ ID NO: 155967 - DNA, 25 bp, Mus musculus
aaaaaggccacagatgctgaagctg

SEQ ID NO: 155968 - DNA, 25 bp, Mus musculus
aaaaaggggagagcatcactggtct

SEQ ID NO: 155969 - DNA, 25 bp, Mus musculus
aaaaaggtcacaccgaggatgcgtc

SEQ ID NO: 155970 - DNA, 25 bp, Mus musculus
aaaaagtaaaagaattgcggcgagc

SEQ ID NO: 155971 - DNA, 25 bp, Mus musculus
aaaaagtaaaagcacttggtggata

SEQ ID NO: 155972 - DNA, 25 bp, Mus musculus
aaaaagtatcaggaatacatcccag

SEQ ID NO: 155973 - DNA, 25 bp, Mus musculus
aaaaagtcaagccgagatgactgac

SEQ ID NO: 155974 - DNA, 25 bp, Mus musculus
aaaaagtcaaggaactcaacagagg

SEQ ID NO: 155975 - DNA, 25 bp, Mus musculus
aaaaagtccttcagggcaatctctg

SEQ ID NO: 155976 - DNA, 25 bp, Mus musculus
aaaaagtctgcacaggaaatgaaag

SEQ ID NO: 155977 - DNA, 25 bp, Mus musculus
aaaaagtggatgcagctgccatcaa

SEQ ID NO: 155978 - DNA, 25 bp, Mus musculus
aaaaagtggcagaagactcagaggc

SEQ ID NO: 155979 - DNA, 25 bp, Mus musculus
aaaaagtgtgcaggtttcaactctg

SEQ ID NO: 155980 - DNA, 25 bp, Mus musculus
aaaaagtgtgcagttcagaggttca

SEQ ID NO: 155981 - DNA, 25 bp, Mus musculus
aaaaagttagaaaagagtatgctgt

SEQ ID NO: 155982 - DNA, 25 bp, Mus musculus
aaaaagttagaaaagcatccgcaga

SEQ ID NO: 155983 - DNA, 25 bp, Mus musculus
aaaaagttagaaaaggcatctgtgg

SEQ ID NO: 155984 - DNA, 25 bp, Mus musculus
aaaaagttccctccggatggttcag

SEQ ID NO: 155985 - DNA, 25 bp, Mus musculus
aaaaagtttgccttagagcacggca

SEQ ID NO: 155986 - DNA, 25 bp, Mus musculus
aaaaataaattcggagctgtctttg

SEQ ID NO: 155987 - DNA, 25 bp, Mus musculus
aaaaataataaagcatattcaaaag

SEQ ID NO: 155988 - DNA, 25 bp, Mus musculus
aaaaataataaagggacagatatgg

SEQ ID NO: 155989 - DNA, 25 bp, Mus musculus
aaaaataatggcgcccagagcataa

SEQ ID NO: 155990 - DNA, 25 bp, Mus musculus
aaaaataatggcggctattgataca

SEQ ID NO: 155991 - DNA, 25 bp, Mus musculus
aaaaataattggtttggattcagga

SEQ ID NO: 155992 - DNA, 25 bp, Mus musculus
aaaaatacccaaagcacctcattat

SEQ ID NO: 155993 - DNA, 25 bp, Mus musculus
aaaaatacctcaagggtgaggatcc

SEQ ID NO: 155994 - DNA, 25 bp, Mus musculus
aaaaatactgtcttctctgcctccc

SEQ ID NO: 155995 - DNA, 25 bp, Mus musculus
aaaaatacttggagaaactggaggt

SEQ ID NO: 155996 - DNA, 25 bp, Mus musculus
aaaaatagccagccaagtctgaaac

SEQ ID NO: 155997 - DNA, 25 bp, Mus musculus
aaaaatagccagcctgtcaagactc

SEQ ID NO: 155998 - DNA, 25 bp, Mus musculus
aaaaatatgcagaaaatacaacctc

SEQ ID NO: 155999 - DNA, 25 bp, Mus musculus
aaaaatattagcatcaaaaatctct

SEQ ID NO: 156000 - DNA, 25 bp, Mus musculus
aaaaatattgagactggaagtgatt

SEQ ID NO: 156001 - DNA, 25 bp, Mus musculus
aaaaatattgggtatgaaagtgcca

SEQ ID NO: 156002 - DNA, 25 bp, Mus musculus
aaaaatcaaaagaatgctgtgtctg

SEQ ID NO: 156003 - DNA, 25 bp, Mus musculus
aaaaatcaaaagagaagctgctgta

SEQ ID NO: 156004 - DNA, 25 bp, Mus musculus
aaaaatcaagaaatgtgcctgtggc

SEQ ID NO: 156005 - DNA, 25 bp, Mus musculus
aaaaatcaagttgtcactcagccca

SEQ ID NO: 156006 - DNA, 25 bp, Mus musculus
aaaaatcaccacagtttcgttatca

SEQ ID NO: 156007 - DNA, 25 bp, Mus musculus
aaaaatcacggaaggtgtctcagac

SEQ ID NO: 156008 - DNA, 25 bp, Mus musculus
aaaaatcactggctgagaacccttc

SEQ ID NO: 156009 - DNA, 25 bp, Mus musculus
aaaaatcagagttgaaaccgacaga

SEQ ID NO: 156010 - DNA, 25 bp, Mus musculus
aaaaatcagcccccgactctcagta

SEQ ID NO: 156011 - DNA, 25 bp, Mus musculus
aaaaatcagcgcccgactctcagta

SEQ ID NO: 156012 - DNA, 25 bp, Mus musculus
aaaaatccatggtgcctgagttcac

SEQ ID NO: 156013 - DNA, 25 bp, Mus musculus
aaaaatccattaccagtgcttggtt

SEQ ID NO: 156014 - DNA, 25 bp, Mus musculus
aaaaatcgagaatttatagctaaaa

SEQ ID NO: 156015 - DNA, 25 bp, Mus musculus
aaaaatcgagtacaggagttattcc

SEQ ID NO: 156016 - DNA, 25 bp, Mus musculus
aaaaatctaggcatggtctgccgga

SEQ ID NO: 156017 - DNA, 25 bp, Mus musculus
aaaaatctaggtatggtctgccgga

SEQ ID NO: 156018 - DNA, 25 bp, Mus musculus
aaaaatctccaggtcccgtcaggaa

SEQ ID NO: 156019 - DNA, 25 bp, Mus musculus
aaaaatctttaaaatcgatcaaatg

SEQ ID NO: 156020 - DNA, 25 bp, Mus musculus
aaaaatgaagccatgtgcacagccc

SEQ ID NO: 156021 - DNA, 25 bp, Mus musculus
aaaaatgaaggattcagaaaccctg

SEQ ID NO: 156022 - DNA, 25 bp, Mus musculus
aaaaatgactgcaagattatttatg

SEQ ID NO: 156023 - DNA, 25 bp, Mus musculus
aaaaatgactggcatggaggtgcaa

SEQ ID NO: 156024 - DNA, 25 bp, Mus musculus
aaaaatgactgggaaggatttaatg

SEQ ID NO: 156025 - DNA, 25 bp, Mus musculus
aaaaatgacttcgcactgaaaatca

SEQ ID NO: 156026 - DNA, 25 bp, Mus musculus
aaaaatgacttcggagatgatagga

SEQ ID NO: 156027 - DNA, 25 bp, Mus musculus
aaaaatgagaagaattcagggatac

SEQ ID NO: 156028 - DNA, 25 bp, Mus musculus
aaaaatgcatcaaagagatgtctga

SEQ ID NO: 156029 - DNA, 25 bp, Mus musculus
aaaaatgctgctgacatgttctact

SEQ ID NO: 156030 - DNA, 25 bp, Mus musculus
aaaaatggaagaaggtatcaactgg

SEQ ID NO: 156031 - DNA, 25 bp, Mus musculus
aaaaatggacaggaatctgaatttt

SEQ ID NO: 156032 - DNA, 25 bp, Mus musculus
aaaaatggacagttgtctcaaaagg

SEQ ID NO: 156033 - DNA, 25 bp, Mus musculus
aaaaatggagcaaagaactgagatt

SEQ ID NO: 156034 - DNA, 25 bp, Mus musculus
aaaaatggagcaaaggcaccatcgg

SEQ ID NO: 156035 - DNA, 25 bp, Mus musculus
aaaaatggattaaagctatcccctc

SEQ ID NO: 156036 - DNA, 25 bp, Mus musculus
aaaaatgggagattatgtttaatga

SEQ ID NO: 156037 - DNA, 25 bp, Mus musculus
aaaaatgggaggcttactcaattcc

SEQ ID NO: 156038 - DNA, 25 bp, Mus musculus
aaaaatgggagtgggtgaactcatc

SEQ ID NO: 156039 - DNA, 25 bp, Mus musculus
aaaaatgggtggacttggcctggat

SEQ ID NO: 156040 - DNA, 25 bp, Mus musculus
aaaaatggtgagcccatcttctgat

SEQ ID NO: 156041 - DNA, 25 bp, Mus musculus
aaaaatggtgaggccatcttctgat

SEQ ID NO: 156042 - DNA, 25 bp, Mus musculus
aaaaatgtctacgaagagatctcaa

SEQ ID NO: 156043 - DNA, 25 bp, Mus musculus
aaaaatgtgaaggggctctttcctg

SEQ ID NO: 156044 - DNA, 25 bp, Mus musculus
aaaaatgtgaaggttggtacagagg

SEQ ID NO: 156045 - DNA, 25 bp, Mus musculus
aaaaatgtttacaagccaacaacta

SEQ ID NO: 156046 - DNA, 25 bp, Mus musculus
aaaaattaagtgtctctgccaccca

SEQ ID NO: 156047 - DNA, 25 bp, Mus musculus
aaaaattaagttagctgacaaggtg

SEQ ID NO: 156048 - DNA, 25 bp, Mus musculus
aaaaattaatggtatcctaaagttg

SEQ ID NO: 156049 - DNA, 25 bp, Mus musculus
aaaaattaatggttggctgcaggta

SEQ ID NO: 156050 - DNA, 25 bp, Mus musculus
aaaaattacacaaacattacttcat

SEQ ID NO: 156051 - DNA, 25 bp, Mus musculus
aaaaattacagtaccaaagcagtca

SEQ ID NO: 156052 - DNA, 25 bp, Mus musculus
aaaaattataattgcttctacttct

SEQ ID NO: 156053 - DNA, 25 bp, Mus musculus
aaaaattatatggtttgacggatga

SEQ ID NO: 156054 - DNA, 25 bp, Mus musculus
aaaaattcagggaatgcagtcggat

SEQ ID NO: 156055 - DNA, 25 bp, Mus musculus
aaaaattcatgaacgagtttttctt

SEQ ID NO: 156056 - DNA, 25 bp, Mus musculus
aaaaattgaacgagaagtaaacact

SEQ ID NO: 156057 - DNA, 25 bp, Mus musculus
aaaaattgaacgagaagtaaagtct

SEQ ID NO: 156058 - DNA, 25 bp, Mus musculus
aaaaattgagacctctgacagctgg

SEQ ID NO: 156059 - DNA, 25 bp, Mus musculus
aaaaattgagagagagaagattatt

SEQ ID NO: 156060 - DNA, 25 bp, Mus musculus
aaaaatttagaatatgacatctgca

SEQ ID NO: 156061 - DNA, 25 bp, Mus musculus
aaaaatttcaagtactcagactaca

SEQ ID NO: 156062 - DNA, 25 bp, Mus musculus
aaaaatttggagacagaagcttaac

SEQ ID NO: 156063 - DNA, 25 bp, Mus musculus
aaaaatttggagctgacatcaacaa

SEQ ID NO: 156064 - DNA, 25 bp, Mus musculus
aaaacaaaaaaaagctgctgatcac

SEQ ID NO: 156065 - DNA, 25 bp, Mus musculus
aaaacaaaaaatcagtggttagcca

SEQ ID NO: 156066 - DNA, 25 bp, Mus musculus
aaaacaaaaaatcagttcccaagag

SEQ ID NO: 156067 - DNA, 25 bp, Mus musculus
aaaacaaaaacaacatggctgggct

SEQ ID NO: 156068 - DNA, 25 bp, Mus musculus
aaaacaaaacagaccagaaccagcc

SEQ ID NO: 156069 - DNA, 25 bp, Mus musculus
aaaacaaaacgaaccagctgcgatc

SEQ ID NO: 156070 - DNA, 25 bp, Mus musculus
aaaacaaaagagatgtcttctcaca

SEQ ID NO: 156071 - DNA, 25 bp, Mus musculus
aaaacaaacgatacaaggaggcaat

SEQ ID NO: 156072 - DNA, 25 bp, Mus musculus
aaaacaaacggtcctgctgtctctt

SEQ ID NO: 156073 - DNA, 25 bp, Mus musculus
aaaacaaatgcaatttcaagttctt

SEQ ID NO: 156074 - DNA, 25 bp, Mus musculus
aaaacaaatggctccagcccactcc

SEQ ID NO: 156075 - DNA, 25 bp, Mus musculus
aaaacaaattagtgacagatcagtc

SEQ ID NO: 156076 - DNA, 25 bp, Mus musculus
aaaacaaattcaagtgctaaactga

SEQ ID NO: 156077 - DNA, 25 bp, Mus musculus
aaaacaacaaggagtacctggagtt

SEQ ID NO: 156078 - DNA, 25 bp, Mus musculus
aaaacaacagaatcaagacacattt

SEQ ID NO: 156079 - DNA, 25 bp, Mus musculus
aaaacaacaggctcctcaactttca

SEQ ID NO: 156080 - DNA, 25 bp, Mus musculus
aaaacaacagttaatttagagtgcc

SEQ ID NO: 156081 - DNA, 25 bp, Mus musculus
aaaacaacatcctgcggtattcctg

SEQ ID NO: 156082 - DNA, 25 bp, Mus musculus
aaaacaaccaggtattgaccaagaa

SEQ ID NO: 156083 - DNA, 25 bp, Mus musculus
aaaacaagacaggtcgattgagtga

SEQ ID NO: 156084 - DNA, 25 bp, Mus musculus
aaaacaagagacagaaccctgtgtg

SEQ ID NO: 156085 - DNA, 25 bp, Mus musculus
aaaacaagagagtctcactatgtac

SEQ ID NO: 156086 - DNA, 25 bp, Mus musculus
aaaacaagagcagtcagcacggcac

SEQ ID NO: 156087 - DNA, 25 bp, Mus musculus
aaaacaagaggagattaggttgtga

SEQ ID NO: 156088 - DNA, 25 bp, Mus musculus
aaaacaagagggtggagatggcgat

SEQ ID NO: 156089 - DNA, 25 bp, Mus musculus
aaaacaagcatcagggggtccgcct

SEQ ID NO: 156090 - DNA, 25 bp, Mus musculus
aaaacaagctgcaggcttctccagt

SEQ ID NO: 156091 - DNA, 25 bp, Mus musculus
aaaacaagtggagagattttgggct

SEQ ID NO: 156092 - DNA, 25 bp, Mus musculus
aaaacaagttctcaggaacaatcct

SEQ ID NO: 156093 - DNA, 25 bp, Mus musculus
aaaacaatagtaaaggctggacccg

SEQ ID NO: 156094 - DNA, 25 bp, Mus musculus
aaaacaatagtatctttacggacga

SEQ ID NO: 156095 - DNA, 25 bp, Mus musculus
aaaacacaaaaatgggttctctgtc

SEQ ID NO: 156096 - DNA, 25 bp, Mus musculus
aaaacacaaacacgagagtccctga

SEQ ID NO: 156097 - DNA, 25 bp, Mus musculus
aaaacacaaacacgtgagtccctga

SEQ ID NO: 156098 - DNA, 25 bp, Mus musculus
aaaacacacaccaagtttttcaaga

SEQ ID NO: 156099 - DNA, 25 bp, Mus musculus
aaaacacacctgacttatttatttt

SEQ ID NO: 156100 - DNA, 25 bp, Mus musculus
aaaacacacgaattgtcacaatgcc

SEQ ID NO: 156101 - DNA, 25 bp, Mus musculus
aaaacacagaaaaagcctgaaaatg

SEQ ID NO: 156102 - DNA, 25 bp, Mus musculus
aaaacacagaaaaaggtctgcagaa

SEQ ID NO: 156103 - DNA, 25 bp, Mus musculus
aaaacacaggagctccttctggccg

SEQ ID NO: 156104 - DNA, 25 bp, Mus musculus
aaaacacagttatgaacatcagaaa

SEQ ID NO: 156105 - DNA, 25 bp, Mus musculus
aaaacacagttatgtatgcaattgg

SEQ ID NO: 156106 - DNA, 25 bp, Mus musculus
aaaacaccaacaaagggcgagaact

SEQ ID NO: 156107 - DNA, 25 bp, Mus musculus
aaaacaccaggaaagattaattgcc

SEQ ID NO: 156108 - DNA, 25 bp, Mus musculus
aaaacaccaggcagtggtggatgcc

SEQ ID NO: 156109 - DNA, 25 bp, Mus musculus
aaaacacgccttggccggaatgtgt

SEQ ID NO: 156110 - DNA, 25 bp, Mus musculus
aaaacacgccttggggttctctgtg

SEQ ID NO: 156111 - DNA, 25 bp, Mus musculus
aaaacactggaagcaagagaaaaag

SEQ ID NO: 156112 - DNA, 25 bp, Mus musculus
aaaacactggcggaaccagtatttg

SEQ ID NO: 156113 - DNA, 25 bp, Mus musculus
aaaacagaaacgttcctgagactga

SEQ ID NO: 156114 - DNA, 25 bp, Mus musculus
aaaacagaagaggaacaagttgatc

SEQ ID NO: 156115 - DNA, 25 bp, Mus musculus
aaaacagaagaggatgaaacaagtg

SEQ ID NO: 156116 - DNA, 25 bp, Mus musculus
aaaacagaaggcgaaggacgaacgt

SEQ ID NO: 156117 - DNA, 25 bp, Mus musculus
aaaacagaattataacaattgaaat

SEQ ID NO: 156118 - DNA, 25 bp, Mus musculus
aaaacagaattccaggacagagatt

SEQ ID NO: 156119 - DNA, 25 bp, Mus musculus
aaaacagactgagaatgaagccaaa

SEQ ID NO: 156120 - DNA, 25 bp, Mus musculus
aaaacagagacaaaggaacaagttg

SEQ ID NO: 156121 - DNA, 25 bp, Mus musculus
aaaacagatcgaagttaaaattgaa

SEQ ID NO: 156122 - DNA, 25 bp, Mus musculus
aaaacagatgatccagaggagtaga

SEQ ID NO: 156123 - DNA, 25 bp, Mus musculus
aaaacagatggtacaaagaagcgtt

SEQ ID NO: 156124 - DNA, 25 bp, Mus musculus
aaaacagcaagatccaccaatgttt

SEQ ID NO: 156125 - DNA, 25 bp, Mus musculus
aaaacagccagcaagaaaccgaaga

SEQ ID NO: 156126 - DNA, 25 bp, Mus musculus
aaaacagctagctgcacgagaaacc

SEQ ID NO: 156127 - DNA, 25 bp, Mus musculus
aaaacaggatcacgagtttgatttc

SEQ ID NO: 156128 - DNA, 25 bp, Mus musculus
aaaacaggatcaggagtttgatttc

SEQ ID NO: 156129 - DNA, 25 bp, Mus musculus
aaaacaggccacaggaaagcacaga

SEQ ID NO: 156130 - DNA, 25 bp, Mus musculus
aaaacaggccaggtggccttgctaa

SEQ ID NO: 156131 - DNA, 25 bp, Mus musculus
aaaacaggcctaaaggctttgatga

SEQ ID NO: 156132 - DNA, 25 bp, Mus musculus
aaaacaggcctcaaggctttgatga

SEQ ID NO: 156133 - DNA, 25 bp, Mus musculus
aaaacagggcaacaggctgaaccat

SEQ ID NO: 156134 - DNA, 25 bp, Mus musculus
aaaacagtacagattgctaagaagc

SEQ ID NO: 156135 - DNA, 25 bp, Mus musculus
aaaacagtatgtgtgcagttatgag

SEQ ID NO: 156136 - DNA, 25 bp, Mus musculus
aaaacataacaacattcccgtcaat

SEQ ID NO: 156137 - DNA, 25 bp, Mus musculus
aaaacatacatgttgccaggatgca

SEQ ID NO: 156138 - DNA, 25 bp, Mus musculus
aaaacatatggccagaatgaccata

SEQ ID NO: 156139 - DNA, 25 bp, Mus musculus
aaaacatcaaaataaaccaggcgat

SEQ ID NO: 156140 - DNA, 25 bp, Mus musculus
aaaacatcaaggaacaataaaaagg

SEQ ID NO: 156141 - DNA, 25 bp, Mus musculus
aaaacatcaataatgacaccaccta

SEQ ID NO: 156142 - DNA, 25 bp, Mus musculus
aaaacatcactgtcgtcactgcggc

SEQ ID NO: 156143 - DNA, 25 bp, Mus musculus
aaaacatccaatgtctcttcagatg

SEQ ID NO: 156144 - DNA, 25 bp, Mus musculus
aaaacatcctacaggaacttctggg

SEQ ID NO: 156145 - DNA, 25 bp, Mus musculus
aaaacatcctacaggtatttcgaac

SEQ ID NO: 156146 - DNA, 25 bp, Mus musculus
aaaacatcgagatcaagaagttggt

SEQ ID NO: 156147 - DNA, 25 bp, Mus musculus
aaaacatctccattccaacctggtc

SEQ ID NO: 156148 - DNA, 25 bp, Mus musculus
aaaacatgaggaaggacagacgaat

SEQ ID NO: 156149 - DNA, 25 bp, Mus musculus
aaaacatgatccaggcgtctctttt

SEQ ID NO: 156150 - DNA, 25 bp, Mus musculus
aaaacatgtatagactttgatgaat

SEQ ID NO: 156151 - DNA, 25 bp, Mus musculus
aaaacatgtatagctttagatgagc

SEQ ID NO: 156152 - DNA, 25 bp, Mus musculus
aaaacattaagtcttgggtacttgg

SEQ ID NO: 156153 - DNA, 25 bp, Mus musculus
aaaacattaataattaccgtgtttg

SEQ ID NO: 156154 - DNA, 25 bp, Mus musculus
aaaacattatgaactgctgagtgcc

SEQ ID NO: 156155 - DNA, 25 bp, Mus musculus
aaaacattcaaggtgtcaactctgc

SEQ ID NO: 156156 - DNA, 25 bp, Mus musculus
aaaacattgacctggtgatctcctt

SEQ ID NO: 156157 - DNA, 25 bp, Mus musculus
aaaacattgttacagaattgaatta

SEQ ID NO: 156158 - DNA, 25 bp, Mus musculus
aaaacatttaaggagattactttgc

SEQ ID NO: 156159 - DNA, 25 bp, Mus musculus
aaaacattttgagcgttggtgttgt

SEQ ID NO: 156160 - DNA, 25 bp, Mus musculus
aaaacattttgaggactactgttga

SEQ ID NO: 156161 - DNA, 25 bp, Mus musculus
aaaaccaaaactgccttaggattct

SEQ ID NO: 156162 - DNA, 25 bp, Mus musculus
aaaaccaaacaatttgctcctattc

SEQ ID NO: 156163 - DNA, 25 bp, Mus musculus
aaaaccaaagaatgacttcgctccg

SEQ ID NO: 156164 - DNA, 25 bp, Mus musculus
aaaaccaaagcatggagggtgatga

SEQ ID NO: 156165 - DNA, 25 bp, Mus musculus
aaaaccaaaggcagaccgaaggctc

SEQ ID NO: 156166 - DNA, 25 bp, Mus musculus
aaaaccaaaggccagcgtgacggct

SEQ ID NO: 156167 - DNA, 25 bp, Mus musculus
aaaaccaaaggtccagaatagcgtt

SEQ ID NO: 156168 - DNA, 25 bp, Mus musculus
aaaaccaacagggcatgaaagaagt

SEQ ID NO: 156169 - DNA, 25 bp, Mus musculus
aaaaccaagaaaccaagccgcaatg

SEQ ID NO: 156170 - DNA, 25 bp, Mus musculus
aaaaccaagaggaaagcatagatgc

SEQ ID NO: 156171 - DNA, 25 bp, Mus musculus
aaaaccaagcaggagaactactttc

SEQ ID NO: 156172 - DNA, 25 bp, Mus musculus
aaaaccaagcaggaggttgaggtga

SEQ ID NO: 156173 - DNA, 25 bp, Mus musculus
aaaaccaaggctgagccgagctaca

SEQ ID NO: 156174 - DNA, 25 bp, Mus musculus
aaaaccaaggctgaggcgagccacc

SEQ ID NO: 156175 - DNA, 25 bp, Mus musculus
aaaaccaagggctcaccttgtgacc

SEQ ID NO: 156176 - DNA, 25 bp, Mus musculus
aaaaccaatggctcaccctgtgatc

SEQ ID NO: 156177 - DNA, 25 bp, Mus musculus
aaaaccaatggctccccctgtgatc

SEQ ID NO: 156178 - DNA, 25 bp, Mus musculus
aaaaccacagtgtcctgtgcatgtg

SEQ ID NO: 156179 - DNA, 25 bp, Mus musculus
aaaaccacatgttcactatgaggag

SEQ ID NO: 156180 - DNA, 25 bp, Mus musculus
aaaaccactgctaagatttgaattc

SEQ ID NO: 156181 - DNA, 25 bp, Mus musculus
aaaaccagaagaagctcgagtgcat

SEQ ID NO: 156182 - DNA, 25 bp, Mus musculus
aaaaccagaagcctgtgccatctct

SEQ ID NO: 156183 - DNA, 25 bp, Mus musculus
aaaaccagacagaataagaatgagc

SEQ ID NO: 156184 - DNA, 25 bp, Mus musculus
aaaaccagatcaaattgacatcgct

SEQ ID NO: 156185 - DNA, 25 bp, Mus musculus
aaaaccagatcagaaaccagtaaag

SEQ ID NO: 156186 - DNA, 25 bp, Mus musculus
aaaaccagcaaaggaagtggggata

SEQ ID NO: 156187 - DNA, 25 bp, Mus musculus
aaaaccagcaaaggtcctttccagt

SEQ ID NO: 156188 - DNA, 25 bp, Mus musculus
aaaaccagctccaggaagcagtcat

SEQ ID NO: 156189 - DNA, 25 bp, Mus musculus
aaaaccagctgtggttcggggccag

SEQ ID NO: 156190 - DNA, 25 bp, Mus musculus
aaaaccagtgcctccgaagccagag

SEQ ID NO: 156191 - DNA, 25 bp, Mus musculus
aaaaccagttaagagagaacagagt

SEQ ID NO: 156192 - DNA, 25 bp, Mus musculus
aaaaccatcccaggtgacaccgctt

SEQ ID NO: 156193 - DNA, 25 bp, Mus musculus
aaaaccatcttcaaggacctgccgc

SEQ ID NO: 156194 - DNA, 25 bp, Mus musculus
aaaaccatgaggaggaagtcaacac

SEQ ID NO: 156195 - DNA, 25 bp, Mus musculus
aaaaccatgtccagattcggaaact

SEQ ID NO: 156196 - DNA, 25 bp, Mus musculus
aaaacccaaagatgcagacagcctt

SEQ ID NO: 156197 - DNA, 25 bp, Mus musculus
aaaacccaaaggaagagcccagaca

SEQ ID NO: 156198 - DNA, 25 bp, Mus musculus
aaaacccaacagcccactgagtgtt

SEQ ID NO: 156199 - DNA, 25 bp, Mus musculus
aaaacccaaggaatatggttgagcc

SEQ ID NO: 156200 - DNA, 25 bp, Mus musculus
aaaacccaatctctgcgattttatt

SEQ ID NO: 156201 - DNA, 25 bp, Mus musculus
aaaacccagagggccagtaagagct

SEQ ID NO: 156202 - DNA, 25 bp, Mus musculus
aaaacccaggcaagttctgcctgct

SEQ ID NO: 156203 - DNA, 25 bp, Mus musculus
aaaaccccacaaaatcatgcaaatc

SEQ ID NO: 156204 - DNA, 25 bp, Mus musculus
aaaacccctcttatcctactagttg

SEQ ID NO: 156205 - DNA, 25 bp, Mus musculus
aaaacccctcttcagacagagagcc

SEQ ID NO: 156206 - DNA, 25 bp, Mus musculus
aaaacccctcttcaggttatccgtg

SEQ ID NO: 156207 - DNA, 25 bp, Mus musculus
aaaaccgaagcgcagcagcagtttt

SEQ ID NO: 156208 - DNA, 25 bp, Mus musculus
aaaaccgaatcacagctgccttcac

SEQ ID NO: 156209 - DNA, 25 bp, Mus musculus
aaaaccgaatcgccatctatgagaa

SEQ ID NO: 156210 - DNA, 25 bp, Mus musculus
aaaaccgatccagagaaggcctact

SEQ ID NO: 156211 - DNA, 25 bp, Mus musculus
aaaaccgatccagtggaagaggcag

SEQ ID NO: 156212 - DNA, 25 bp, Mus musculus
aaaaccgcacggccttcaacactga

SEQ ID NO: 156213 - DNA, 25 bp, Mus musculus
aaaaccgcagacctgtgttgcgtgg

SEQ ID NO: 156214 - DNA, 25 bp, Mus musculus
aaaaccgcaggtatggcatttcaaa

SEQ ID NO: 156215 - DNA, 25 bp, Mus musculus
aaaaccgcaggtgagaagacaaaat

SEQ ID NO: 156216 - DNA, 25 bp, Mus musculus
aaaaccgctatggcaacgtgatcgc

SEQ ID NO: 156217 - DNA, 25 bp, Mus musculus
aaaacctatgaagggctgcaatttt

SEQ ID NO: 156218 - DNA, 25 bp, Mus musculus
aaaacctcggctctctgctcccctc

SEQ ID NO: 156219 - DNA, 25 bp, Mus musculus
aaaacctgaaatctgcctccaacat

SEQ ID NO: 156220 - DNA, 25 bp, Mus musculus
aaaacctgagaatctgcccgagagc

SEQ ID NO: 156221 - DNA, 25 bp, Mus musculus
aaaacctgaggagccaacagaagtt

SEQ ID NO: 156222 - DNA, 25 bp, Mus musculus
aaaacctgagggtgatttcagactg

SEQ ID NO: 156223 - DNA, 25 bp, Mus musculus
aaaacctgcagtgtcttaaaacata

SEQ ID NO: 156224 - DNA, 25 bp, Mus musculus
aaaaccttcagttggatcctccaga

SEQ ID NO: 156225 - DNA, 25 bp, Mus musculus
aaaacctttggtagatgccagccta

SEQ ID NO: 156226 - DNA, 25 bp, Mus musculus
aaaacgacagacagctattatctgg

SEQ ID NO: 156227 - DNA, 25 bp, Mus musculus
aaaacgagagattaggttccaagga

SEQ ID NO: 156228 - DNA, 25 bp, Mus musculus
aaaacgagtagaagatgaaagtctg

SEQ ID NO: 156229 - DNA, 25 bp, Mus musculus
aaaacgcaaaatagaacaggtagta

SEQ ID NO: 156230 - DNA, 25 bp, Mus musculus
aaaacgctgagagagatgccaaagg

SEQ ID NO: 156231 - DNA, 25 bp, Mus musculus
aaaacgctgtaagccgtgcctcagg

SEQ ID NO: 156232 - DNA, 25 bp, Mus musculus
aaaacgcttccgatccttacctcgt

SEQ ID NO: 156233 - DNA, 25 bp, Mus musculus
aaaacggaaatctagtgttctccag

SEQ ID NO: 156234 - DNA, 25 bp, Mus musculus
aaaacggaaggacctgcaatgacga

SEQ ID NO: 156235 - DNA, 25 bp, Mus musculus
aaaacggagagagcgtcgtatacaa

SEQ ID NO: 156236 - DNA, 25 bp, Mus musculus
aaaacgttctgcagcccacacaccc

SEQ ID NO: 156237 - DNA, 25 bp, Mus musculus
aaaactacaagaaatatgtggaaga

SEQ ID NO: 156238 - DNA, 25 bp, Mus musculus
aaaactacaagagtggatcatgacc

SEQ ID NO: 156239 - DNA, 25 bp, Mus musculus
aaaactacctggatgcccagtacta

SEQ ID NO: 156240 - DNA, 25 bp, Mus musculus
aaaactacgagctcctgcttcctga

SEQ ID NO: 156241 - DNA, 25 bp, Mus musculus
aaaactacgaggtgttctgcccagt

SEQ ID NO: 156242 - DNA, 25 bp, Mus musculus
aaaactacgagtcacaccagaagag

SEQ ID NO: 156243 - DNA, 25 bp, Mus musculus
aaaactacgagtttatagaacaagg

SEQ ID NO: 156244 - DNA, 25 bp, Mus musculus
aaaactatagaggtgccttggagca

SEQ ID NO: 156245 - DNA, 25 bp, Mus musculus
aaaactatgagattaaaacaagggc

SEQ ID NO: 156246 - DNA, 25 bp, Mus musculus
aaaactatgagttctgaatttcatg

SEQ ID NO: 156247 - DNA, 25 bp, Mus musculus
aaaactatgcaggtgtgcattggaa

SEQ ID NO: 156248 - DNA, 25 bp, Mus musculus
aaaactatggtgaaccgtgtgtgtc

SEQ ID NO: 156249 - DNA, 25 bp, Mus musculus
aaaactatggtgaaggctcttgctg

SEQ ID NO: 156250 - DNA, 25 bp, Mus musculus
aaaactatttatgaattcacagaca

SEQ ID NO: 156251 - DNA, 25 bp, Mus musculus
aaaactatttatgatactgcatttt

SEQ ID NO: 156252 - DNA, 25 bp, Mus musculus
aaaactcaaaagattgctttattca

SEQ ID NO: 156253 - DNA, 25 bp, Mus musculus
aaaactcagtcgtgcggggtcctcc

SEQ ID NO: 156254 - DNA, 25 bp, Mus musculus
aaaactccaatgtcacagaaaagaa

SEQ ID NO: 156255 - DNA, 25 bp, Mus musculus
aaaactccaggatgtgtttgaaatg

SEQ ID NO: 156256 - DNA, 25 bp, Mus musculus
aaaactccagttccttctgatgtat

SEQ ID NO: 156257 - DNA, 25 bp, Mus musculus
aaaactcctcgaaagatgttccggc

SEQ ID NO: 156258 - DNA, 25 bp, Mus musculus
aaaactctaccacagtgactcatgt

SEQ ID NO: 156259 - DNA, 25 bp, Mus musculus
aaaactcttgacaggaaggaggggg

SEQ ID NO: 156260 - DNA, 25 bp, Mus musculus
aaaactgaaaaaaggctgtgacctc

SEQ ID NO: 156261 - DNA, 25 bp, Mus musculus
aaaactgaaaatgatacagtgtgac

SEQ ID NO: 156262 - DNA, 25 bp, Mus musculus
aaaactgaaaatggtgttttcgatg

SEQ ID NO: 156263 - DNA, 25 bp, Mus musculus
aaaactgaaggatctgaaccaatga

SEQ ID NO: 156264 - DNA, 25 bp, Mus musculus
aaaactgaaggatggcgtggttctc

SEQ ID NO: 156265 - DNA, 25 bp, Mus musculus
aaaactgacattgggagaatcccgg

SEQ ID NO: 156266 - DNA, 25 bp, Mus musculus
aaaactgactgagactaaaatacaa

SEQ ID NO: 156267 - DNA, 25 bp, Mus musculus
aaaactgagatgtgtctacattggg

SEQ ID NO: 156268 - DNA, 25 bp, Mus musculus
aaaactgcaaagaaccgggtggtgg

SEQ ID NO: 156269 - DNA, 25 bp, Mus musculus
aaaactgcaagttgcacccagctgg

SEQ ID NO: 156270 - DNA, 25 bp, Mus musculus
aaaactgcagaatgtttaccgagag

SEQ ID NO: 156271 - DNA, 25 bp, Mus musculus
aaaactgccaaaacgaaaacagata

SEQ ID NO: 156272 - DNA, 25 bp, Mus musculus
aaaactgccagttggtggcactaag

SEQ ID NO: 156273 - DNA, 25 bp, Mus musculus
aaaactgctttgcacgtgacacaag

SEQ ID NO: 156274 - DNA, 25 bp, Mus musculus
aaaactggaagtgacccagactaca

SEQ ID NO: 156275 - DNA, 25 bp, Mus musculus
aaaactggagacctcaggaaagtgt

SEQ ID NO: 156276 - DNA, 25 bp, Mus musculus
aaaactggagccaccccaaatctgc

SEQ ID NO: 156277 - DNA, 25 bp, Mus musculus
aaaactgtaataaggatgaggctgt

SEQ ID NO: 156278 - DNA, 25 bp, Mus musculus
aaaactgtccggccaggtatcatgt

SEQ ID NO: 156279 - DNA, 25 bp, Mus musculus
aaaactgttcaagctgggaggcacc

SEQ ID NO: 156280 - DNA, 25 bp, Mus musculus
aaaactgttcaagttgtcccccata

SEQ ID NO: 156281 - DNA, 25 bp, Mus musculus
aaaacttaagtaaatttgatcctga

SEQ ID NO: 156282 - DNA, 25 bp, Mus musculus
aaaacttagggatggagcctcccaa

SEQ ID NO: 156283 - DNA, 25 bp, Mus musculus
aaaacttcagtcccagaagccaaac

SEQ ID NO: 156284 - DNA, 25 bp, Mus musculus
aaaacttcagttgttgacctcctgt

SEQ ID NO: 156285 - DNA, 25 bp, Mus musculus
aaaacttccaacaggttgactacag

SEQ ID NO: 156286 - DNA, 25 bp, Mus musculus
aaaacttcccaaggcactgtgcttg

SEQ ID NO: 156287 - DNA, 25 bp, Mus musculus
aaaacttctggaattattgaagccc

SEQ ID NO: 156288 - DNA, 25 bp, Mus musculus
aaaacttcttcaaaggatcccagag

SEQ ID NO: 156289 - DNA, 25 bp, Mus musculus
aaaacttgggtgctgaaggggatgc

SEQ ID NO: 156290 - DNA, 25 bp, Mus musculus
aaaacttgtgaggttctctaatgat

SEQ ID NO: 156291 - DNA, 25 bp, Mus musculus
aaaactttcagtgggtggtgatagt

SEQ ID NO: 156292 - DNA, 25 bp, Mus musculus
aaaactttgtagttggtgatgatga

SEQ ID NO: 156293 - DNA, 25 bp, Mus musculus
aaaacttttcttgagcgttggtgat

SEQ ID NO: 156294 - DNA, 25 bp, Mus musculus
aaaacttttcttgagtgattccaca

SEQ ID NO: 156295 - DNA, 25 bp, Mus musculus
aaaagaaaaacatcattccagaaac

SEQ ID NO: 156296 - DNA, 25 bp, Mus musculus
aaaagaaaagatgagaggctgtaag

SEQ ID NO: 156297 - DNA, 25 bp, Mus musculus
aaaagaaaaggccagcctgccggga

SEQ ID NO: 156298 - DNA, 25 bp, Mus musculus
aaaagaaaataagtaccatgaaagc

SEQ ID NO: 156299 - DNA, 25 bp, Mus musculus
aaaagaaacagcaggtgattcagga

SEQ ID NO: 156300 - DNA, 25 bp, Mus musculus
aaaagaaactaccagagcagaagaa

SEQ ID NO: 156301 - DNA, 25 bp, Mus musculus
aaaagaaactaccagatgctggcat

SEQ ID NO: 156302 - DNA, 25 bp, Mus musculus
aaaagaaactaccaggtgacaaaca

SEQ ID NO: 156303 - DNA, 25 bp, Mus musculus
aaaagaaactaccaggtgcactagg

SEQ ID NO: 156304 - DNA, 25 bp, Mus musculus
aaaagaaagaagacccactgccaca

SEQ ID NO: 156305 - DNA, 25 bp, Mus musculus
aaaagaaagaagagctgctgaatgc

SEQ ID NO: 156306 - DNA, 25 bp, Mus musculus
aaaagaaagaatgctcaaaggtgac

SEQ ID NO: 156307 - DNA, 25 bp, Mus musculus
aaaagaaagaattcctgagacaaac

SEQ ID NO: 156308 - DNA, 25 bp, Mus musculus
aaaagaaagagagttcgatgcccaa

SEQ ID NO: 156309 - DNA, 25 bp, Mus musculus
aaaagaaagctgtattttaaatctt

SEQ ID NO: 156310 - DNA, 25 bp, Mus musculus
aaaagaaagctgtggaaatcagtca

SEQ ID NO: 156311 - DNA, 25 bp, Mus musculus
aaaagaaagctgtggtaattccacc

SEQ ID NO: 156312 - DNA, 25 bp, Mus musculus
aaaagaaatagaggtacaacataag

SEQ ID NO: 156313 - DNA, 25 bp, Mus musculus
aaaagaaatggtgacattccaagcc

SEQ ID NO: 156314 - DNA, 25 bp, Mus musculus
aaaagaaatgtgcaattcctaaatg

SEQ ID NO: 156315 - DNA, 25 bp, Mus musculus
aaaagaaatgtgcacttggatctca

SEQ ID NO: 156316 - DNA, 25 bp, Mus musculus
aaaagaacaagaccgtggctaccga

SEQ ID NO: 156317 - DNA, 25 bp, Mus musculus
aaaagaacacagaacttgtcctttt

SEQ ID NO: 156318 - DNA, 25 bp, Mus musculus
aaaagaacacagtgccctggttccc

SEQ ID NO: 156319 - DNA, 25 bp, Mus musculus
aaaagaacagggcagctgggcacca

SEQ ID NO: 156320 - DNA, 25 bp, Mus musculus
aaaagaaccgacgagctcacctgcg

SEQ ID NO: 156321 - DNA, 25 bp, Mus musculus
aaaagaaccgtggctctccaggctg

SEQ ID NO: 156322 - DNA, 25 bp, Mus musculus
aaaagaacgaaagtcagcgtgggag

SEQ ID NO: 156323 - DNA, 25 bp, Mus musculus
aaaagaactatgtgcaacctcaagc

SEQ ID NO: 156324 - DNA, 25 bp, Mus musculus
aaaagaagagcagggctgtgtctgg

SEQ ID NO: 156325 - DNA, 25 bp, Mus musculus
aaaagaaggaggacattttccgtag

SEQ ID NO: 156326 - DNA, 25 bp, Mus musculus
aaaagaaggaggacgaggatataaa

SEQ ID NO: 156327 - DNA, 25 bp, Mus musculus
aaaagaaggctaatgcttctgtgaa

SEQ ID NO: 156328 - DNA, 25 bp, Mus musculus
aaaagaatgatggtcgaatcgatgc

SEQ ID NO: 156329 - DNA, 25 bp, Mus musculus
aaaagaatgcggctggcgcattgga

SEQ ID NO: 156330 - DNA, 25 bp, Mus musculus
aaaagaatggaggtccgctggggag

SEQ ID NO: 156331 - DNA, 25 bp, Mus musculus
aaaagaatttccattcgagcatcag

SEQ ID NO: 156332 - DNA, 25 bp, Mus musculus
aaaagacaaaggggaagacatcttt

SEQ ID NO: 156333 - DNA, 25 bp, Mus musculus
aaaagacaagatctccctaggcgat

SEQ ID NO: 156334 - DNA, 25 bp, Mus musculus
aaaagacacaagaaatttacccaat

SEQ ID NO: 156335 - DNA, 25 bp, Mus musculus
aaaagacagacaaggcttcagaaga

SEQ ID NO: 156336 - DNA, 25 bp, Mus musculus
aaaagacagctccagtttttcagga

SEQ ID NO: 156337 - DNA, 25 bp, Mus musculus
aaaagacaggagagatgagacacca

SEQ ID NO: 156338 - DNA, 25 bp, Mus musculus
aaaagacatcagaagactcaaatgg

SEQ ID NO: 156339 - DNA, 25 bp, Mus musculus
aaaagacatctgcaagtgcacgttg

SEQ ID NO: 156340 - DNA, 25 bp, Mus musculus
aaaagacatggagatacagaattaa

SEQ ID NO: 156341 - DNA, 25 bp, Mus musculus
aaaagacatggaggaagcaagggca

SEQ ID NO: 156342 - DNA, 25 bp, Mus musculus
aaaagaccaaaggccagccttttga

SEQ ID NO: 156343 - DNA, 25 bp, Mus musculus
aaaagaccacaaatgggcgacttcc

SEQ ID NO: 156344 - DNA, 25 bp, Mus musculus
aaaagaccacaaattgatccagctg

SEQ ID NO: 156345 - DNA, 25 bp, Mus musculus
aaaagaccactaaccatgagtttat

SEQ ID NO: 156346 - DNA, 25 bp, Mus musculus
aaaagaccactgggttatcctatct

SEQ ID NO: 156347 - DNA, 25 bp, Mus musculus
aaaagaccctgtgtcacgaacccct

SEQ ID NO: 156348 - DNA, 25 bp, Mus musculus
aaaagacctccgtctggatttttct

SEQ ID NO: 156349 - DNA, 25 bp, Mus musculus
aaaagacgaactaggtcctgtgcca

SEQ ID NO: 156350 - DNA, 25 bp, Mus musculus
aaaagacggaaagctcatcaagcaa

SEQ ID NO: 156351 - DNA, 25 bp, Mus musculus
aaaagacggaaaggagagatctgta

SEQ ID NO: 156352 - DNA, 25 bp, Mus musculus
aaaagactctgtcggggctggtgag

SEQ ID NO: 156353 - DNA, 25 bp, Mus musculus
aaaagacttggtgattgggatacta

SEQ ID NO: 156354 - DNA, 25 bp, Mus musculus
aaaagagaaaaggaagcagtatggt

SEQ ID NO: 156355 - DNA, 25 bp, Mus musculus
aaaagagaagctgttgcaggaagag

SEQ ID NO: 156356 - DNA, 25 bp, Mus musculus
aaaagagacgggaaaagaaggctgc

SEQ ID NO: 156357 - DNA, 25 bp, Mus musculus
aaaagagacgggatcttatcctgta

SEQ ID NO: 156358 - DNA, 25 bp, Mus musculus
aaaagagactgttgtaacagttgga

SEQ ID NO: 156359 - DNA, 25 bp, Mus musculus
aaaagagagagaggtacctgtgtcg

SEQ ID NO: 156360 - DNA, 25 bp, Mus musculus
aaaagagagggggtccactgcgtct

SEQ ID NO: 156361 - DNA, 25 bp, Mus musculus
aaaagagatttctattctctacatt

SEQ ID NO: 156362 - DNA, 25 bp, Mus musculus
aaaagagatttctgctgaatgtggg

SEQ ID NO: 156363 - DNA, 25 bp, Mus musculus
aaaagagcaccagcacagctgatga

SEQ ID NO: 156364 - DNA, 25 bp, Mus musculus
aaaagagcggagcagattgaggaca

SEQ ID NO: 156365 - DNA, 25 bp, Mus musculus
aaaagagcggagcaggaaggagatg

SEQ ID NO: 156366 - DNA, 25 bp, Mus musculus
aaaagagctggattctaatcccttt

SEQ ID NO: 156367 - DNA, 25 bp, Mus musculus
aaaagaggagagaagcagaaaaaaa

SEQ ID NO: 156368 - DNA, 25 bp, Mus musculus
aaaagaggagcagggcttctatttt

SEQ ID NO: 156369 - DNA, 25 bp, Mus musculus
aaaagaggagcagtaaaagctggca

SEQ ID NO: 156370 - DNA, 25 bp, Mus musculus
aaaagagggagtcggttctggccga

SEQ ID NO: 156371 - DNA, 25 bp, Mus musculus
aaaagagtctgtgctgcaggctgtg

SEQ ID NO: 156372 - DNA, 25 bp, Mus musculus
aaaagataaaaaaggctgcctcacc

SEQ ID NO: 156373 - DNA, 25 bp, Mus musculus
aaaagataaaacagcgtttatttga

SEQ ID NO: 156374 - DNA, 25 bp, Mus musculus
aaaagataaagagggctacacatct

SEQ ID NO: 156375 - DNA, 25 bp, Mus musculus
aaaagataaaggagcgaatccgtaa

SEQ ID NO: 156376 - DNA, 25 bp, Mus musculus
aaaagatacttccaatcacttccat

SEQ ID NO: 156377 - DNA, 25 bp, Mus musculus
aaaagatatccttttggataagcct

SEQ ID NO: 156378 - DNA, 25 bp, Mus musculus
aaaagatcaagggtgacaggaaagc

SEQ ID NO: 156379 - DNA, 25 bp, Mus musculus
aaaagatcaaggtgatctacgttgc

SEQ ID NO: 156380 - DNA, 25 bp, Mus musculus
aaaagatcaatggacagctcggctc

SEQ ID NO: 156381 - DNA, 25 bp, Mus musculus
aaaagatctgcaaaatcatggacca

SEQ ID NO: 156382 - DNA, 25 bp, Mus musculus
aaaagatgaaggagcttcatatggc

SEQ ID NO: 156383 - DNA, 25 bp, Mus musculus
aaaagatgaaggggatggtaataac

SEQ ID NO: 156384 - DNA, 25 bp, Mus musculus
aaaagatgaatatgaaaaggtggac

SEQ ID NO: 156385 - DNA, 25 bp, Mus musculus
aaaagatgatggctgagatccgggg

SEQ ID NO: 156386 - DNA, 25 bp, Mus musculus
aaaagatgtaactgcttggaccctt

SEQ ID NO: 156387 - DNA, 25 bp, Mus musculus
aaaagattcaagaacttggggacat

SEQ ID NO: 156388 - DNA, 25 bp, Mus musculus
aaaagatttgtccataagaacttca

SEQ ID NO: 156389 - DNA, 25 bp, Mus musculus
aaaagcaaaacagggagccacccaa

SEQ ID NO: 156390 - DNA, 25 bp, Mus musculus
aaaagcaaagagtcttatcagctgc

SEQ ID NO: 156391 - DNA, 25 bp, Mus musculus
aaaagcaacagagagtgcactgacc

SEQ ID NO: 156392 - DNA, 25 bp, Mus musculus
aaaagcaacagagttcttgcctctc

SEQ ID NO: 156393 - DNA, 25 bp, Mus musculus
aaaagcaactggatgaactgcttgg

SEQ ID NO: 156394 - DNA, 25 bp, Mus musculus
aaaagcaagaaggacctagaccgcg

SEQ ID NO: 156395 - DNA, 25 bp, Mus musculus
aaaagcaagaagggtcttgttgcag

SEQ ID NO: 156396 - DNA, 25 bp, Mus musculus
aaaagcaagtgccaattcctgaatg

SEQ ID NO: 156397 - DNA, 25 bp, Mus musculus
aaaagcacagaacaagcctgccatc

SEQ ID NO: 156398 - DNA, 25 bp, Mus musculus
aaaagcacagacgagctaaactcag

SEQ ID NO: 156399 - DNA, 25 bp, Mus musculus
aaaagcacagccttcacaggctgct

SEQ ID NO: 156400 - DNA, 25 bp, Mus musculus
aaaagcacaggctgctgaggaacct

SEQ ID NO: 156401 - DNA, 25 bp, Mus musculus
aaaagcagaagaaaagactggacaa

SEQ ID NO: 156402 - DNA, 25 bp, Mus musculus
aaaagcagaagaaaggggctcgctc

SEQ ID NO: 156403 - DNA, 25 bp, Mus musculus
aaaagcagaccagccctagtcgagg

SEQ ID NO: 156404 - DNA, 25 bp, Mus musculus
aaaagcagagaatggagcctgtgac

SEQ ID NO: 156405 - DNA, 25 bp, Mus musculus
aaaagcagagaatgtggacatctcg

SEQ ID NO: 156406 - DNA, 25 bp, Mus musculus
aaaagcagcagatgttcaagtttgg

SEQ ID NO: 156407 - DNA, 25 bp, Mus musculus
aaaagcaggttccagacaatcctcc

SEQ ID NO: 156408 - DNA, 25 bp, Mus musculus
aaaagcaggttccagctctcccagg

SEQ ID NO: 156409 - DNA, 25 bp, Mus musculus
aaaagcagtcaggatgatgcagcta

SEQ ID NO: 156410 - DNA, 25 bp, Mus musculus
aaaagcagtcagggcaatggcagcg

SEQ ID NO: 156411 - DNA, 25 bp, Mus musculus
aaaagcagtggtttgtattgagggc

SEQ ID NO: 156412 - DNA, 25 bp, Mus musculus
aaaagcatcaggcaagaggcaaagt

SEQ ID NO: 156413 - DNA, 25 bp, Mus musculus
aaaagcatcagttgtgactgtgagc

SEQ ID NO: 156414 - DNA, 25 bp, Mus musculus
aaaagcattaaagcccagtgcccct

SEQ ID NO: 156415 - DNA, 25 bp, Mus musculus
aaaagcattatgtctggatctctta

SEQ ID NO: 156416 - DNA, 25 bp, Mus musculus
aaaagccaaagatgtgtgccaaaac

SEQ ID NO: 156417 - DNA, 25 bp, Mus musculus
aaaagccaaaggtgtgtgccaaaac

SEQ ID NO: 156418 - DNA, 25 bp, Mus musculus
aaaagccaagcacggaaataaccag

SEQ ID NO: 156419 - DNA, 25 bp, Mus musculus
aaaagccaatagtaggaattccagg

SEQ ID NO: 156420 - DNA, 25 bp, Mus musculus
aaaagccacaagagataagatgaaa

SEQ ID NO: 156421 - DNA, 25 bp, Mus musculus
aaaagccacccgaatggctgttgat

SEQ ID NO: 156422 - DNA, 25 bp, Mus musculus
aaaagccagaccaggatcaagttac

SEQ ID NO: 156423 - DNA, 25 bp, Mus musculus
aaaagccagaccagttccaagaatt

SEQ ID NO: 156424 - DNA, 25 bp, Mus musculus
aaaagccagagaagtgtgtgacaac

SEQ ID NO: 156425 - DNA, 25 bp, Mus musculus
aaaagccagtgggaagagcatggag

SEQ ID NO: 156426 - DNA, 25 bp, Mus musculus
aaaagccatactatgatccctcaag

SEQ ID NO: 156427 - DNA, 25 bp, Mus musculus
aaaagccatgaaagtatatctcaac

SEQ ID NO: 156428 - DNA, 25 bp, Mus musculus
aaaagccatgcagcaccagcgaatg

SEQ ID NO: 156429 - DNA, 25 bp, Mus musculus
aaaagccatttacagggggtgatgt

SEQ ID NO: 156430 - DNA, 25 bp, Mus musculus
aaaagccatttacagttgtaacagt

SEQ ID NO: 156431 - DNA, 25 bp, Mus musculus
aaaagcccaacaccagctacatcat

SEQ ID NO: 156432 - DNA, 25 bp, Mus musculus
aaaagcccaggtttaattcagaagt

SEQ ID NO: 156433 - DNA, 25 bp, Mus musculus
aaaagcccagtggctttgggtggcg

SEQ ID NO: 156434 - DNA, 25 bp, Mus musculus
aaaagcccagttctaattcagaagt

SEQ ID NO: 156435 - DNA, 25 bp, Mus musculus
aaaagcccatctgggcttttctcca

SEQ ID NO: 156436 - DNA, 25 bp, Mus musculus
aaaagccctccaagaaagataaact

SEQ ID NO: 156437 - DNA, 25 bp, Mus musculus
aaaagccgaggctctgctaaggccg

SEQ ID NO: 156438 - DNA, 25 bp, Mus musculus
aaaagccgggtactggaaattggcg

SEQ ID NO: 156439 - DNA, 25 bp, Mus musculus
aaaagcctcctgctcctgagtcagt

SEQ ID NO: 156440 - DNA, 25 bp, Mus musculus
aaaagcctttccattgtaaatctta

SEQ ID NO: 156441 - DNA, 25 bp, Mus musculus
aaaagcgaggaggcggctcagtggt

SEQ ID NO: 156442 - DNA, 25 bp, Mus musculus
aaaagcgaggccctggtcacaggct

SEQ ID NO: 156443 - DNA, 25 bp, Mus musculus
aaaagcgctgcagctattatctgga

SEQ ID NO: 156444 - DNA, 25 bp, Mus musculus
aaaagcggccataaactgtacattt

SEQ ID NO: 156445 - DNA, 25 bp, Mus musculus
aaaagctaaacaagagcatgaagga

SEQ ID NO: 156446 - DNA, 25 bp, Mus musculus
aaaagctaaggatgaccagactcca

SEQ ID NO: 156447 - DNA, 25 bp, Mus musculus
aaaagctagaggagggcatggataa

SEQ ID NO: 156448 - DNA, 25 bp, Mus musculus
aaaagctagtagagctggaggtgga

SEQ ID NO: 156449 - DNA, 25 bp, Mus musculus
aaaagctagtagagtatatggagga

SEQ ID NO: 156450 - DNA, 25 bp, Mus musculus
aaaagctagtagcagaagctgggag

SEQ ID NO: 156451 - DNA, 25 bp, Mus musculus
aaaagctcaagaagaaagagttcga

SEQ ID NO: 156452 - DNA, 25 bp, Mus musculus
aaaagctcagaaagcctttccctaa

SEQ ID NO: 156453 - DNA, 25 bp, Mus musculus
aaaagctcagaaagctgtgtatgat

SEQ ID NO: 156454 - DNA, 25 bp, Mus musculus
aaaagctcagagggaagctcacaag

SEQ ID NO: 156455 - DNA, 25 bp, Mus musculus
aaaagctcagagggaattgaagtta

SEQ ID NO: 156456 - DNA, 25 bp, Mus musculus
aaaagctcagctcagcacaatcctg

SEQ ID NO: 156457 - DNA, 25 bp, Mus musculus
aaaagctcaggaagtctttaatgag

SEQ ID NO: 156458 - DNA, 25 bp, Mus musculus
aaaagctcaggagaaatcaaaacta

SEQ ID NO: 156459 - DNA, 25 bp, Mus musculus
aaaagctcaggctgcaagcctgagg

SEQ ID NO: 156460 - DNA, 25 bp, Mus musculus
aaaagctcaggctggcaaatgagga

SEQ ID NO: 156461 - DNA, 25 bp, Mus musculus
aaaagctccaagaggtgtgtgatag

SEQ ID NO: 156462 - DNA, 25 bp, Mus musculus
aaaagctctgggggtgaaatgggag

SEQ ID NO: 156463 - DNA, 25 bp, Mus musculus
aaaagctctgggggtgaacatgatg

SEQ ID NO: 156464 - DNA, 25 bp, Mus musculus
aaaagctctggtgatgatgtggccc

SEQ ID NO: 156465 - DNA, 25 bp, Mus musculus
aaaagctctggtgatgtactccaac

SEQ ID NO: 156466 - DNA, 25 bp, Mus musculus
aaaagctgaaggacagactgcgcag

SEQ ID NO: 156467 - DNA, 25 bp, Mus musculus
aaaagctgaagtgaagtctggcaag

SEQ ID NO: 156468 - DNA, 25 bp, Mus musculus
aaaagctgaccaagggactgcacag

SEQ ID NO: 156469 - DNA, 25 bp, Mus musculus
aaaagctgagagaaacgaagtgaga

SEQ ID NO: 156470 - DNA, 25 bp, Mus musculus
aaaagctgcaagctttcagaaagag

SEQ ID NO: 156471 - DNA, 25 bp, Mus musculus
aaaagctgcaagttgcagaattaag

SEQ ID NO: 156472 - DNA, 25 bp, Mus musculus
aaaagcttttacatgaaggtgcatc

SEQ ID NO: 156473 - DNA, 25 bp, Mus musculus
aaaaggaaaaggagctctgtcaggt

SEQ ID NO: 156474 - DNA, 25 bp, Mus musculus
aaaaggaaagaaccagatttctgct

SEQ ID NO: 156475 - DNA, 25 bp, Mus musculus
aaaaggaaagaatcttctcaaaaca

SEQ ID NO: 156476 - DNA, 25 bp, Mus musculus
aaaaggaaaggagtgactggtcaga

SEQ ID NO: 156477 - DNA, 25 bp, Mus musculus
aaaaggaaatctgatctccaagagg

SEQ ID NO: 156478 - DNA, 25 bp, Mus musculus
aaaaggaaatctgtattatgttcca

SEQ ID NO: 156479 - DNA, 25 bp, Mus musculus
aaaaggaacagcaggcagttcctgg

SEQ ID NO: 156480 - DNA, 25 bp, Mus musculus
aaaaggaaccatggcacagcgatgg

SEQ ID NO: 156481 - DNA, 25 bp, Mus musculus
aaaaggaactgcaggggaagcacag

SEQ ID NO: 156482 - DNA, 25 bp, Mus musculus
aaaaggaactgcaggttgacgtgat

SEQ ID NO: 156483 - DNA, 25 bp, Mus musculus
aaaaggaactggtctctcatggaac

SEQ ID NO: 156484 - DNA, 25 bp, Mus musculus
aaaaggaagatgacaagagaagaaa

SEQ ID NO: 156485 - DNA, 25 bp, Mus musculus
aaaaggaagatggaggaaagacaaa

SEQ ID NO: 156486 - DNA, 25 bp, Mus musculus
aaaaggaaggtacaagaggacacca

SEQ ID NO: 156487 - DNA, 25 bp, Mus musculus
aaaaggaaggtgtcttctcgtcccg

SEQ ID NO: 156488 - DNA, 25 bp, Mus musculus
aaaaggaatcaagttactggacagt

SEQ ID NO: 156489 - DNA, 25 bp, Mus musculus
aaaaggacaaagagcatctaaagaa

SEQ ID NO: 156490 - DNA, 25 bp, Mus musculus
aaaaggacaggacctttcctagcaa

SEQ ID NO: 156491 - DNA, 25 bp, Mus musculus
aaaaggacaggacgagtattatata

SEQ ID NO: 156492 - DNA, 25 bp, Mus musculus
aaaaggacaggacggaaaaagagag

SEQ ID NO: 156493 - DNA, 25 bp, Mus musculus
aaaaggacaggatgtagatatgatg

SEQ ID NO: 156494 - DNA, 25 bp, Mus musculus
aaaaggacgacagatctatgtaaga

SEQ ID NO: 156495 - DNA, 25 bp, Mus musculus
aaaaggagaagcccaacaggagggc

SEQ ID NO: 156496 - DNA, 25 bp, Mus musculus
aaaaggagacaagggtgatatggga

SEQ ID NO: 156497 - DNA, 25 bp, Mus musculus
aaaaggagacacgggcttgccaggt

SEQ ID NO: 156498 - DNA, 25 bp, Mus musculus
aaaaggagagcctgggcccccagat

SEQ ID NO: 156499 - DNA, 25 bp, Mus musculus
aaaaggagagcctgtgtgctgatat

SEQ ID NO: 156500 - DNA, 25 bp, Mus musculus
aaaaggagatgtgggagcgagaggc

SEQ ID NO: 156501 - DNA, 25 bp, Mus musculus
aaaaggagcagcagcagcagcagca

SEQ ID NO: 156502 - DNA, 25 bp, Mus musculus
aaaaggagcaggtgcttttggatac

SEQ ID NO: 156503 - DNA, 25 bp, Mus musculus
aaaaggagcgagagtaccccaggct

SEQ ID NO: 156504 - DNA, 25 bp, Mus musculus
aaaaggagcgagagtttccactgta

SEQ ID NO: 156505 - DNA, 25 bp, Mus musculus
aaaaggagctggaggaggtgcgctc

SEQ ID NO: 156506 - DNA, 25 bp, Mus musculus
aaaaggagctgggagactccctgac

SEQ ID NO: 156507 - DNA, 25 bp, Mus musculus
aaaaggaggggacgcgaggcgaggc

SEQ ID NO: 156508 - DNA, 25 bp, Mus musculus
aaaaggagtgttaagcaaaaggaat

SEQ ID NO: 156509 - DNA, 25 bp, Mus musculus
aaaaggatgaaaagcttattcgtct

SEQ ID NO: 156510 - DNA, 25 bp, Mus musculus
aaaaggatgattgatctgatggaac

SEQ ID NO: 156511 - DNA, 25 bp, Mus musculus
aaaaggatgcagaaaatgtaggccg

SEQ ID NO: 156512 - DNA, 25 bp, Mus musculus
aaaaggatgcctggcggaaagcttc

SEQ ID NO: 156513 - DNA, 25 bp, Mus musculus
aaaaggattttgagaacctgggtgt

SEQ ID NO: 156514 - DNA, 25 bp, Mus musculus
aaaaggattttgatcactggaggtg

SEQ ID NO: 156515 - DNA, 25 bp, Mus musculus
aaaaggattttggcaggaagagaaa

SEQ ID NO: 156516 - DNA, 25 bp, Mus musculus
aaaaggattttgttgaccagatata

SEQ ID NO: 156517 - DNA, 25 bp, Mus musculus
aaaaggcaaagatgcagctgtgtcg

SEQ ID NO: 156518 - DNA, 25 bp, Mus musculus
aaaaggcaaatgtccctccacctcc

SEQ ID NO: 156519 - DNA, 25 bp, Mus musculus
aaaaggcacaaagtaagcgcaaagc

SEQ ID NO: 156520 - DNA, 25 bp, Mus musculus
aaaaggcaccaacaggcctgatggg

SEQ ID NO: 156521 - DNA, 25 bp, Mus musculus
aaaaggcaccaacaggggagtatgt

SEQ ID NO: 156522 - DNA, 25 bp, Mus musculus
aaaaggcagaagatgcatattgaag

SEQ ID NO: 156523 - DNA, 25 bp, Mus musculus
aaaaggcagaagcagaaatgctaat

SEQ ID NO: 156524 - DNA, 25 bp, Mus musculus
aaaaggcagagatgctgattctctg

SEQ ID NO: 156525 - DNA, 25 bp, Mus musculus
aaaaggcagagggacagttaaaggt

SEQ ID NO: 156526 - DNA, 25 bp, Mus musculus
aaaaggcagagggagcattcctggc

SEQ ID NO: 156527 - DNA, 25 bp, Mus musculus
aaaaggcagagtatgtttgatgtta

SEQ ID NO: 156528 - DNA, 25 bp, Mus musculus
aaaaggcagcagcagaaggtttgat

SEQ ID NO: 156529 - DNA, 25 bp, Mus musculus
aaaaggccaaaactgtacatcattg

SEQ ID NO: 156530 - DNA, 25 bp, Mus musculus
aaaaggccaaaagcctgatagagga

SEQ ID NO: 156531 - DNA, 25 bp, Mus musculus
aaaaggccaagatatttatcaacaa

SEQ ID NO: 156532 - DNA, 25 bp, Mus musculus
aaaaggccaagattcttcaggagag

SEQ ID NO: 156533 - DNA, 25 bp, Mus musculus
aaaaggccacagatgctgaagctga

SEQ ID NO: 156534 - DNA, 25 bp, Mus musculus
aaaaggccagcctgccgggagtgaa

SEQ ID NO: 156535 - DNA, 25 bp, Mus musculus
aaaaggcctgaagcacgtaacttct

SEQ ID NO: 156536 - DNA, 25 bp, Mus musculus
aaaaggcctgcgaagatataaatga

SEQ ID NO: 156537 - DNA, 25 bp, Mus musculus
aaaaggcggcggtcctttctacaat

SEQ ID NO: 156538 - DNA, 25 bp, Mus musculus
aaaaggctaagagcctgaccaggga

SEQ ID NO: 156539 - DNA, 25 bp, Mus musculus
aaaaggctcaagggctttgctgagc

SEQ ID NO: 156540 - DNA, 25 bp, Mus musculus
aaaaggctctgtggaggaagcaagg

SEQ ID NO: 156541 - DNA, 25 bp, Mus musculus
aaaaggctgtaatttggcctcagta

SEQ ID NO: 156542 - DNA, 25 bp, Mus musculus
aaaaggcttaccaagcccgttctca

SEQ ID NO: 156543 - DNA, 25 bp, Mus musculus
aaaagggaaacaagttctgacagta

SEQ ID NO: 156544 - DNA, 25 bp, Mus musculus
aaaagggacaggttttcctagatat

SEQ ID NO: 156545 - DNA, 25 bp, Mus musculus
aaaagggacagtgatggatgtggga

SEQ ID NO: 156546 - DNA, 25 bp, Mus musculus
aaaagggagtggtgggttcgagtga

SEQ ID NO: 156547 - DNA, 25 bp, Mus musculus
aaaagggccaagaagtctacatgtg

SEQ ID NO: 156548 - DNA, 25 bp, Mus musculus
aaaaggggacacattttagtttctg

SEQ ID NO: 156549 - DNA, 25 bp, Mus musculus
aaaaggggagagcatcactggtctc

SEQ ID NO: 156550 - DNA, 25 bp, Mus musculus
aaaaggggcaggcgggtgattatag

SEQ ID NO: 156551 - DNA, 25 bp, Mus musculus
aaaaggggtctgaagtcaaatacct

SEQ ID NO: 156552 - DNA, 25 bp, Mus musculus
aaaaggtcaaaactctaacacgtga

SEQ ID NO: 156553 - DNA, 25 bp, Mus musculus
aaaaggtcacaccgaggatgcgtcc

SEQ ID NO: 156554 - DNA, 25 bp, Mus musculus
aaaaggtgcagatcctggggcagag

SEQ ID NO: 156555 - DNA, 25 bp, Mus musculus
aaaaggtgcagcaactgctttgctc

SEQ ID NO: 156556 - DNA, 25 bp, Mus musculus
aaaaggttatttgaacacacaggtt

SEQ ID NO: 156557 - DNA, 25 bp, Mus musculus
aaaaggttatttggtacaaaatgca

SEQ ID NO: 156558 - DNA, 25 bp, Mus musculus
aaaaggttgatgggaatgtaaataa

SEQ ID NO: 156559 - DNA, 25 bp, Mus musculus
aaaaggttgatggtccgcagacatc

SEQ ID NO: 156560 - DNA, 25 bp, Mus musculus
aaaagtaaaagaattgcggcgagca

SEQ ID NO: 156561 - DNA, 25 bp, Mus musculus
aaaagtaaaagcacttggtggatat

SEQ ID NO: 156562 - DNA, 25 bp, Mus musculus
aaaagtaaatggaagtacgactgcc

SEQ ID NO: 156563 - DNA, 25 bp, Mus musculus
aaaagtaccaggtgttttcagctgt

SEQ ID NO: 156564 - DNA, 25 bp, Mus musculus
aaaagtacttcctggtgggtgcagg

SEQ ID NO: 156565 - DNA, 25 bp, Mus musculus
aaaagtaggagttaccattgagtgc

SEQ ID NO: 156566 - DNA, 25 bp, Mus musculus
aaaagtatacaaaaggatttactag

SEQ ID NO: 156567 - DNA, 25 bp, Mus musculus
aaaagtatcaggaatacatcccagt

SEQ ID NO: 156568 - DNA, 25 bp, Mus musculus
aaaagtatggcttagacttgtgttt

SEQ ID NO: 156569 - DNA, 25 bp, Mus musculus
aaaagtcaagaagaacaaacaacat

SEQ ID NO: 156570 - DNA, 25 bp, Mus musculus
aaaagtcaagccgagatgactgacc

SEQ ID NO: 156571 - DNA, 25 bp, Mus musculus
aaaagtcaaggaactcaacagaggc

SEQ ID NO: 156572 - DNA, 25 bp, Mus musculus
aaaagtcaaggtgtactttgtgggt

SEQ ID NO: 156573 - DNA, 25 bp, Mus musculus
aaaagtcaagtgatcaaccggaaac

SEQ ID NO: 156574 - DNA, 25 bp, Mus musculus
aaaagtcacaagggaacagcagtgc

SEQ ID NO: 156575 - DNA, 25 bp, Mus musculus
aaaagtcaggctattgaccttctgt

SEQ ID NO: 156576 - DNA, 25 bp, Mus musculus
aaaagtcctggaggcaggcgacaag

SEQ ID NO: 156577 - DNA, 25 bp, Mus musculus
aaaagtcctggaggctggagtcaca

SEQ ID NO: 156578 - DNA, 25 bp, Mus musculus
aaaagtccttcagggcaatctctgt

SEQ ID NO: 156579 - DNA, 25 bp, Mus musculus
aaaagtctaaagggccagtgtcctt

SEQ ID NO: 156580 - DNA, 25 bp, Mus musculus
aaaagtctaagggcagtttagctaa

SEQ ID NO: 156581 - DNA, 25 bp, Mus musculus
aaaagtctattaaaatgaagcattg

SEQ ID NO: 156582 - DNA, 25 bp, Mus musculus
aaaagtctgcacaggaaatgaaagc

SEQ ID NO: 156583 - DNA, 25 bp, Mus musculus
aaaagtgacgtgtgggcttttggcg

SEQ ID NO: 156584 - DNA, 25 bp, Mus musculus
aaaagtgagtggagctcctctgggc

SEQ ID NO: 156585 - DNA, 25 bp, Mus musculus
aaaagtgatgggattcgaagagtct

SEQ ID NO: 156586 - DNA, 25 bp, Mus musculus
aaaagtgcagagactgtgagcaaag

SEQ ID NO: 156587 - DNA, 25 bp, Mus musculus
aaaagtgcagagacttcttccctag

SEQ ID NO: 156588 - DNA, 25 bp, Mus musculus
aaaagtgcatccatgcagtattcaa

SEQ ID NO: 156589 - DNA, 25 bp, Mus musculus
aaaagtggatgcagctgccatcaaa

SEQ ID NO: 156590 - DNA, 25 bp, Mus musculus
aaaagtggcagaagactcagaggcc

SEQ ID NO: 156591 - DNA, 25 bp, Mus musculus
aaaagtgtgcaggtttcaactctga

SEQ ID NO: 156592 - DNA, 25 bp, Mus musculus
aaaagtgtgcagttcagaggttcag

SEQ ID NO: 156593 - DNA, 25 bp, Mus musculus
aaaagttaaccagagtttgagtgac

SEQ ID NO: 156594 - DNA, 25 bp, Mus musculus
aaaagttagaaaagagtatgctgtc

SEQ ID NO: 156595 - DNA, 25 bp, Mus musculus
aaaagttagaaaagcatccgcagac

SEQ ID NO: 156596 - DNA, 25 bp, Mus musculus
aaaagttagaaaaggcatctgtggc

SEQ ID NO: 156597 - DNA, 25 bp, Mus musculus
aaaagttcaaggagtctcatgaaca

SEQ ID NO: 156598 - DNA, 25 bp, Mus musculus
aaaagttccctccggatggttcagc

SEQ ID NO: 156599 - DNA, 25 bp, Mus musculus
aaaagtttgaccccccagacttctg

SEQ ID NO: 156600 - DNA, 25 bp, Mus musculus
aaaagtttgccttagagcacggcat

SEQ ID NO: 156601 - DNA, 25 bp, Mus musculus
aaaagttttggcatacaaatgctct

SEQ ID NO: 156602 - DNA, 25 bp, Mus musculus
aaaataaaaagcagatgcatgttcc

SEQ ID NO: 156603 - DNA, 25 bp, Mus musculus
aaaataaaaagcagatgtcatatgc

SEQ ID NO: 156604 - DNA, 25 bp, Mus musculus
aaaataaaggtgagttcctcagaaa

SEQ ID NO: 156605 - DNA, 25 bp, Mus musculus
aaaataaataaggaagcagtatggt

SEQ ID NO: 156606 - DNA, 25 bp, Mus musculus
aaaataaatagataataccaaacgt

SEQ ID NO: 156607 - DNA, 25 bp, Mus musculus
aaaataaattcggagctgtctttgg

SEQ ID NO: 156608 - DNA, 25 bp, Mus musculus
aaaataacaaagagctactgctttc

SEQ ID NO: 156609 - DNA, 25 bp, Mus musculus
aaaataacaaagcggagtatgtcca

SEQ ID NO: 156610 - DNA, 25 bp, Mus musculus
aaaataagccttgtacactggacac

SEQ ID NO: 156611 - DNA, 25 bp, Mus musculus
aaaataataaagcatattcaaaaga

SEQ ID NO: 156612 - DNA, 25 bp, Mus musculus
aaaataataaagggacagatatggc

SEQ ID NO: 156613 - DNA, 25 bp, Mus musculus
aaaataatccaaggaagaattctgt

SEQ ID NO: 156614 - DNA, 25 bp, Mus musculus
aaaataatcctgtcaaggtattcct

SEQ ID NO: 156615 - DNA, 25 bp, Mus musculus
aaaataatgacttgggacaaaagaa

SEQ ID NO: 156616 - DNA, 25 bp, Mus musculus
aaaataatgcaaaagactaacctaa

SEQ ID NO: 156617 - DNA, 25 bp, Mus musculus
aaaataatggcgcccagagcataaa

SEQ ID NO: 156618 - DNA, 25 bp, Mus musculus
aaaataatggcggctattgatacag

SEQ ID NO: 156619 - DNA, 25 bp, Mus musculus
aaaataatggtgatggtcttctcca

SEQ ID NO: 156620 - DNA, 25 bp, Mus musculus
aaaataattgatgctgtgaaggctg

SEQ ID NO: 156621 - DNA, 25 bp, Mus musculus
aaaataatttcagctgccagtgaag

SEQ ID NO: 156622 - DNA, 25 bp, Mus musculus
aaaatacagagcatacgatgcgacc

SEQ ID NO: 156623 - DNA, 25 bp, Mus musculus
aaaatacagatctgtgtcagcattt

SEQ ID NO: 156624 - DNA, 25 bp, Mus musculus
aaaataccagtgtaagcggtaacca

SEQ ID NO: 156625 - DNA, 25 bp, Mus musculus
aaaatacccaaagcacctcattatg

SEQ ID NO: 156626 - DNA, 25 bp, Mus musculus
aaaataccccccggtgccacattct

SEQ ID NO: 156627 - DNA, 25 bp, Mus musculus
aaaatacctcaagggtgaggatcct

SEQ ID NO: 156628 - DNA, 25 bp, Mus musculus
aaaataccttcaagatgctgggtgc

SEQ ID NO: 156629 - DNA, 25 bp, Mus musculus
aaaataccttcaagccaccttcaag

SEQ ID NO: 156630 - DNA, 25 bp, Mus musculus
aaaataccttcgagatgctgggtgc

SEQ ID NO: 156631 - DNA, 25 bp, Mus musculus
aaaataccttcgagccttcccagag

SEQ ID NO: 156632 - DNA, 25 bp, Mus musculus
aaaatacggaagcaaggaaaatcca

SEQ ID NO: 156633 - DNA, 25 bp, Mus musculus
aaaatacgtcaaagagcagtgactt

SEQ ID NO: 156634 - DNA, 25 bp, Mus musculus
aaaatactacatttttttccagagg

SEQ ID NO: 156635 - DNA, 25 bp, Mus musculus
aaaatactcacagaaagaagaatcc

SEQ ID NO: 156636 - DNA, 25 bp, Mus musculus
aaaatactctcctgggttgtgttat

SEQ ID NO: 156637 - DNA, 25 bp, Mus musculus
aaaatactgtcttctctgcctcccg

SEQ ID NO: 156638 - DNA, 25 bp, Mus musculus
aaaatacttggagaaactggaggta

SEQ ID NO: 156639 - DNA, 25 bp, Mus musculus
aaaatactttccagaacacttcagt

SEQ ID NO: 156640 - DNA, 25 bp, Mus musculus
aaaatactttccgtccagatcgcct

SEQ ID NO: 156641 - DNA, 25 bp, Mus musculus
aaaatagaaaataaaatcttggcaa

SEQ ID NO: 156642 - DNA, 25 bp, Mus musculus
aaaatagaagaggtagtagaagagg

SEQ ID NO: 156643 - DNA, 25 bp, Mus musculus
aaaatagatctaaaggagctgtgaa

SEQ ID NO: 156644 - DNA, 25 bp, Mus musculus
aaaatagattagcattcttgaagta

SEQ ID NO: 156645 - DNA, 25 bp, Mus musculus
aaaatagccagccaagtctgaaact

SEQ ID NO: 156646 - DNA, 25 bp, Mus musculus
aaaatagccagcctgtcaagactct

SEQ ID NO: 156647 - DNA, 25 bp, Mus musculus
aaaatagcgatgtctggaataaaag

SEQ ID NO: 156648 - DNA, 25 bp, Mus musculus
aaaataggccagagtgggtcatctc

SEQ ID NO: 156649 - DNA, 25 bp, Mus musculus
aaaataggccagagtggtggttccc

SEQ ID NO: 156650 - DNA, 25 bp, Mus musculus
aaaatagttggtgtttggcacagac

SEQ ID NO: 156651 - DNA, 25 bp, Mus musculus
aaaatatcaagccgcctgtttctgg

SEQ ID NO: 156652 - DNA, 25 bp, Mus musculus
aaaatatcaagccgcgttttacgat

SEQ ID NO: 156653 - DNA, 25 bp, Mus musculus
aaaatatcagaaatcatgaggtcca

SEQ ID NO: 156654 - DNA, 25 bp, Mus musculus
aaaatatcagaggctaaagaaggca

SEQ ID NO: 156655 - DNA, 25 bp, Mus musculus
aaaatatcagctggtggctggcatc

SEQ ID NO: 156656 - DNA, 25 bp, Mus musculus
aaaatatcaggaagcagtgcattgt

SEQ ID NO: 156657 - DNA, 25 bp, Mus musculus
aaaatatcagtctagccgcagacag

SEQ ID NO: 156658 - DNA, 25 bp, Mus musculus
aaaatatctttgtatcttaaaagat

SEQ ID NO: 156659 - DNA, 25 bp, Mus musculus
aaaatatgcagaaaatacaacctcc

SEQ ID NO: 156660 - DNA, 25 bp, Mus musculus
aaaatatgggccaaatgaaaattct

SEQ ID NO: 156661 - DNA, 25 bp, Mus musculus
aaaatatgtcagatttcaactattg

SEQ ID NO: 156662 - DNA, 25 bp, Mus musculus
aaaatattccataagatcatcttta

SEQ ID NO: 156663 - DNA, 25 bp, Mus musculus
aaaatattgaagtttaccatagttt

SEQ ID NO: 156664 - DNA, 25 bp, Mus musculus
aaaatattggattggaagcctgcgc

SEQ ID NO: 156665 - DNA, 25 bp, Mus musculus
aaaatatttagattgaggatgggta

SEQ ID NO: 156666 - DNA, 25 bp, Mus musculus
aaaatcaaaagaatgctgtgtctgc

SEQ ID NO: 156667 - DNA, 25 bp, Mus musculus
aaaatcaaaagagaagctgctgtat

SEQ ID NO: 156668 - DNA, 25 bp, Mus musculus
aaaatcaaatggcagaggtcacttt

SEQ ID NO: 156669 - DNA, 25 bp, Mus musculus
aaaatcaaatggcagtatatatgtt

SEQ ID NO: 156670 - DNA, 25 bp, Mus musculus
aaaatcaagcaggagccatgcagtg

SEQ ID NO: 156671 - DNA, 25 bp, Mus musculus
aaaatcaaggagcttgtagtgaaga

SEQ ID NO: 156672 - DNA, 25 bp, Mus musculus
aaaatcacagaataccacctcctca

SEQ ID NO: 156673 - DNA, 25 bp, Mus musculus
aaaatcacagactcaccacctccac

SEQ ID NO: 156674 - DNA, 25 bp, Mus musculus
aaaatcacagagaagcagaacaagc

SEQ ID NO: 156675 - DNA, 25 bp, Mus musculus
aaaatcaccacagtttcgttatcag

SEQ ID NO: 156676 - DNA, 25 bp, Mus musculus
aaaatcaccagatggtctcagcact

SEQ ID NO: 156677 - DNA, 25 bp, Mus musculus
aaaatcacggaaggtgtctcagaca

SEQ ID NO: 156678 - DNA, 25 bp, Mus musculus
aaaatcactgacaagcaaggaaaga

SEQ ID NO: 156679 - DNA, 25 bp, Mus musculus
aaaatcactggctgagaacccttct

SEQ ID NO: 156680 - DNA, 25 bp, Mus musculus
aaaatcagacaagaaccctaattcc

SEQ ID NO: 156681 - DNA, 25 bp, Mus musculus
aaaatcagacaagctatggtatctc

SEQ ID NO: 156682 - DNA, 25 bp, Mus musculus
aaaatcagagttgaaaccgacagag

SEQ ID NO: 156683 - DNA, 25 bp, Mus musculus
aaaatcatagagcccatccagtccc

SEQ ID NO: 156684 - DNA, 25 bp, Mus musculus
aaaatcattagataacaactattcc

SEQ ID NO: 156685 - DNA, 25 bp, Mus musculus
aaaatccaaaaggacacatgtatga

SEQ ID NO: 156686 - DNA, 25 bp, Mus musculus
aaaatccaaaaggatctggagactc

SEQ ID NO: 156687 - DNA, 25 bp, Mus musculus
aaaatccaaaatcaggcaccccgtg

SEQ ID NO: 156688 - DNA, 25 bp, Mus musculus
aaaatccaaaatcaggttgctggct

SEQ ID NO: 156689 - DNA, 25 bp, Mus musculus
aaaatccaagaggcggtggtggtgc

SEQ ID NO: 156690 - DNA, 25 bp, Mus musculus
aaaatccacaggcagtgaggaatgg

SEQ ID NO: 156691 - DNA, 25 bp, Mus musculus
aaaatccagaggcagcaagaaaagc

SEQ ID NO: 156692 - DNA, 25 bp, Mus musculus
aaaatccagaggcagttagccttac

SEQ ID NO: 156693 - DNA, 25 bp, Mus musculus
aaaatccagcagacccgagaagccc

SEQ ID NO: 156694 - DNA, 25 bp, Mus musculus
aaaatccataaagaggatggagata

SEQ ID NO: 156695 - DNA, 25 bp, Mus musculus
aaaatcccaagtagcatgctacaaa

SEQ ID NO: 156696 - DNA, 25 bp, Mus musculus
aaaatccccagatcccagcctcctg

SEQ ID NO: 156697 - DNA, 25 bp, Mus musculus
aaaatccccagctattgcagatccc

SEQ ID NO: 156698 - DNA, 25 bp, Mus musculus
aaaatccccaggtgtgactgcacag

SEQ ID NO: 156699 - DNA, 25 bp, Mus musculus
aaaatcccttgctaacagagaagtc

SEQ ID NO: 156700 - DNA, 25 bp, Mus musculus
aaaatccggcagagtgaccgtcttc

SEQ ID NO: 156701 - DNA, 25 bp, Mus musculus
aaaatcctatcaagaggcaggaagc

SEQ ID NO: 156702 - DNA, 25 bp, Mus musculus
aaaatcctatcaaggctcatcagca

SEQ ID NO: 156703 - DNA, 25 bp, Mus musculus
aaaatcctgcaggactacaaatctc

SEQ ID NO: 156704 - DNA, 25 bp, Mus musculus
aaaatcgagaatttatagctaaaag

SEQ ID NO: 156705 - DNA, 25 bp, Mus musculus
aaaatcgagtacaggagttattcct

SEQ ID NO: 156706 - DNA, 25 bp, Mus musculus
aaaatcgataaccagagccaacctt

SEQ ID NO: 156707 - DNA, 25 bp, Mus musculus
aaaatcgataaccaggtgagaaagg

SEQ ID NO: 156708 - DNA, 25 bp, Mus musculus
aaaatctaacaattctctacatttt

SEQ ID NO: 156709 - DNA, 25 bp, Mus musculus
aaaatctaggtatggtctgccggaa

SEQ ID NO: 156710 - DNA, 25 bp, Mus musculus
aaaatctatgaaagccctggtttgg

SEQ ID NO: 156711 - DNA, 25 bp, Mus musculus
aaaatctatgaaatcagcaaccgct

SEQ ID NO: 156712 - DNA, 25 bp, Mus musculus
aaaatctcaaattgctcttaaactc

SEQ ID NO: 156713 - DNA, 25 bp, Mus musculus
aaaatctcaagaaggtggatttttc

SEQ ID NO: 156714 - DNA, 25 bp, Mus musculus
aaaatctcaagacaaaaagatattt

SEQ ID NO: 156715 - DNA, 25 bp, Mus musculus
aaaatctcaagctgcgagcctgcgg

SEQ ID NO: 156716 - DNA, 25 bp, Mus musculus
aaaatctcaaggtctatcctaaagt

SEQ ID NO: 156717 - DNA, 25 bp, Mus musculus
aaaatctcagaactcaagtgattga

SEQ ID NO: 156718 - DNA, 25 bp, Mus musculus
aaaatctcaggctggcctgtgagcc

SEQ ID NO: 156719 - DNA, 25 bp, Mus musculus
aaaatctccaggtcccgtcaggaag

SEQ ID NO: 156720 - DNA, 25 bp, Mus musculus
aaaatctctttccgggtgaacagag

SEQ ID NO: 156721 - DNA, 25 bp, Mus musculus
aaaatctgagagaggtgaaccacca

SEQ ID NO: 156722 - DNA, 25 bp, Mus musculus
aaaatctgctagcatagatattttg

SEQ ID NO: 156723 - DNA, 25 bp, Mus musculus
aaaatcttagattttgtccagacag

SEQ ID NO: 156724 - DNA, 25 bp, Mus musculus
aaaatcttagcaaagagatgtctga

SEQ ID NO: 156725 - DNA, 25 bp, Mus musculus
aaaatctttaaaatcgatcaaatgg

SEQ ID NO: 156726 - DNA, 25 bp, Mus musculus
aaaatctttaagctgggaggaagag

SEQ ID NO: 156727 - DNA, 25 bp, Mus musculus
aaaatctttcaacgccaaccactct

SEQ ID NO: 156728 - DNA, 25 bp, Mus musculus
aaaatgaaaaatatggaattgccat

SEQ ID NO: 156729 - DNA, 25 bp, Mus musculus
aaaatgaaaaatggaatgactgtac

SEQ ID NO: 156730 - DNA, 25 bp, Mus musculus
aaaatgaaaagatgaaaactttatt

SEQ ID NO: 156731 - DNA, 25 bp, Mus musculus
aaaatgaaacttggggaccatgcct

SEQ ID NO: 156732 - DNA, 25 bp, Mus musculus
aaaatgaaagtggatcagcatggag

SEQ ID NO: 156733 - DNA, 25 bp, Mus musculus
aaaatgaacaatcactttttaattc

SEQ ID NO: 156734 - DNA, 25 bp, Mus musculus
aaaatgaagaaagaacatgcatacc

SEQ ID NO: 156735 - DNA, 25 bp, Mus musculus
aaaatgaagaagatgggcttaggtc

SEQ ID NO: 156736 - DNA, 25 bp, Mus musculus
aaaatgaagaagtggaactatggac

SEQ ID NO: 156737 - DNA, 25 bp, Mus musculus
aaaatgaagagataggcgctcacat

SEQ ID NO: 156738 - DNA, 25 bp, Mus musculus
aaaatgaagccatgtgcacagccct

SEQ ID NO: 156739 - DNA, 25 bp, Mus musculus
aaaatgaaggattcagaaaccctga

SEQ ID NO: 156740 - DNA, 25 bp, Mus musculus
aaaatgaatactcagcaatgtgggc

SEQ ID NO: 156741 - DNA, 25 bp, Mus musculus
aaaatgaatactcaggatactggga

SEQ ID NO: 156742 - DNA, 25 bp, Mus musculus
aaaatgaatttcaaggggctgaggc

SEQ ID NO: 156743 - DNA, 25 bp, Mus musculus
aaaatgactgaccgggagagggata

SEQ ID NO: 156744 - DNA, 25 bp, Mus musculus
aaaatgactgcaagattatttatgt

SEQ ID NO: 156745 - DNA, 25 bp, Mus musculus
aaaatgactggcatggaggtgcaat

SEQ ID NO: 156746 - DNA, 25 bp, Mus musculus
aaaatgactgggaaggatttaatgc

SEQ ID NO: 156747 - DNA, 25 bp, Mus musculus
aaaatgacttcgcactgaaaatcaa

SEQ ID NO: 156748 - DNA, 25 bp, Mus musculus
aaaatgacttcggagatgataggag

SEQ ID NO: 156749 - DNA, 25 bp, Mus musculus
aaaatgagaaagaagggagcctagc

SEQ ID NO: 156750 - DNA, 25 bp, Mus musculus
aaaatgagaaagatatagcaggttc

SEQ ID NO: 156751 - DNA, 25 bp, Mus musculus
aaaatgagaaagattctgaagcaag

SEQ ID NO: 156752 - DNA, 25 bp, Mus musculus
aaaatgagaagaattcagggataca

SEQ ID NO: 156753 - DNA, 25 bp, Mus musculus
aaaatgagatatttgtggtagtgtg

SEQ ID NO: 156754 - DNA, 25 bp, Mus musculus
aaaatgagctgaacattatccacaa

SEQ ID NO: 156755 - DNA, 25 bp, Mus musculus
aaaatgagtaagagatttgaaaaat

SEQ ID NO: 156756 - DNA, 25 bp, Mus musculus
aaaatgataacagagcaacccgata

SEQ ID NO: 156757 - DNA, 25 bp, Mus musculus
aaaatgataacagagcatacaagca

SEQ ID NO: 156758 - DNA, 25 bp, Mus musculus
aaaatgataacagagtcaatcccct

SEQ ID NO: 156759 - DNA, 25 bp, Mus musculus
aaaatgataagctgaatgatatgga

SEQ ID NO: 156760 - DNA, 25 bp, Mus musculus
aaaatgataagctgggtaaaactcc

SEQ ID NO: 156761 - DNA, 25 bp, Mus musculus
aaaatgattggacagcctgccgggc

SEQ ID NO: 156762 - DNA, 25 bp, Mus musculus
aaaatgattggacaggcatcaagat

SEQ ID NO: 156763 - DNA, 25 bp, Mus musculus
aaaatgcaaaggcaggaaggagcca

SEQ ID NO: 156764 - DNA, 25 bp, Mus musculus
aaaatgcaaaggtttcatcacttca

SEQ ID NO: 156765 - DNA, 25 bp, Mus musculus
aaaatgcacgagcctggttacctgg

SEQ ID NO: 156766 - DNA, 25 bp, Mus musculus
aaaatgcagagcaggtttgacatgg

SEQ ID NO: 156767 - DNA, 25 bp, Mus musculus
aaaatgccgagctgccacaggcacc

SEQ ID NO: 156768 - DNA, 25 bp, Mus musculus
aaaatgcgactggaagaactaaaga

SEQ ID NO: 156769 - DNA, 25 bp, Mus musculus
aaaatgcgactggtggcaattaaca

SEQ ID NO: 156770 - DNA, 25 bp, Mus musculus
aaaatgctaaggtttatgggaccgt

SEQ ID NO: 156771 - DNA, 25 bp, Mus musculus
aaaatgctacaaagacatccttcta

SEQ ID NO: 156772 - DNA, 25 bp, Mus musculus
aaaatgctatgtgctgagccacctc

SEQ ID NO: 156773 - DNA, 25 bp, Mus musculus
aaaatgctgaaggacgcattcagct

SEQ ID NO: 156774 - DNA, 25 bp, Mus musculus
aaaatgctgcaagcaccttctagca

SEQ ID NO: 156775 - DNA, 25 bp, Mus musculus
aaaatgctgcaagtatagaacattg

SEQ ID NO: 156776 - DNA, 25 bp, Mus musculus
aaaatgctgctgacatgttctactg

SEQ ID NO: 156777 - DNA, 25 bp, Mus musculus
aaaatgcttcagggccgcctttttg

SEQ ID NO: 156778 - DNA, 25 bp, Mus musculus
aaaatgcttcgagaacagaaagagc

SEQ ID NO: 156779 - DNA, 25 bp, Mus musculus
aaaatgcttgggtcaccagtggatt

SEQ ID NO: 156780 - DNA, 25 bp, Mus musculus
aaaatggaacaaggacctctgcttg

SEQ ID NO: 156781 - DNA, 25 bp, Mus musculus
aaaatggaacaagtacaaccctcag

SEQ ID NO: 156782 - DNA, 25 bp, Mus musculus
aaaatggaactagtaacaaggacga

SEQ ID NO: 156783 - DNA, 25 bp, Mus musculus
aaaatggaagaaggtatcaactggc

SEQ ID NO: 156784 - DNA, 25 bp, Mus musculus
aaaatggaagagacctgtgggtcta

SEQ ID NO: 156785 - DNA, 25 bp, Mus musculus
aaaatggaagcttggctgaagagga

SEQ ID NO: 156786 - DNA, 25 bp, Mus musculus
aaaatggaaggtcactacgttcacg

SEQ ID NO: 156787 - DNA, 25 bp, Mus musculus
aaaatggacacgctccccagaggtc

SEQ ID NO: 156788 - DNA, 25 bp, Mus musculus
aaaatggacaggaatctgaattttt

SEQ ID NO: 156789 - DNA, 25 bp, Mus musculus
aaaatggacagttgtctcaaaaggg

SEQ ID NO: 156790 - DNA, 25 bp, Mus musculus
aaaatggacggacaaaggagacaac

SEQ ID NO: 156791 - DNA, 25 bp, Mus musculus
aaaatggacggaggaagtgtgaacg

SEQ ID NO: 156792 - DNA, 25 bp, Mus musculus
aaaatggagacccaggtgataactc

SEQ ID NO: 156793 - DNA, 25 bp, Mus musculus
aaaatggagagaggtaagaagtatg

SEQ ID NO: 156794 - DNA, 25 bp, Mus musculus
aaaatggagagtctggatgtggata

SEQ ID NO: 156795 - DNA, 25 bp, Mus musculus
aaaatggagcaaagaactgagattg

SEQ ID NO: 156796 - DNA, 25 bp, Mus musculus
aaaatggagcaaaggcaccatcggt

SEQ ID NO: 156797 - DNA, 25 bp, Mus musculus
aaaatggatcccactgatgccaagt

SEQ ID NO: 156798 - DNA, 25 bp, Mus musculus
aaaatggattaaagctatcccctct

SEQ ID NO: 156799 - DNA, 25 bp, Mus musculus
aaaatggcaacctcctctgacctct

SEQ ID NO: 156800 - DNA, 25 bp, Mus musculus
aaaatggcaggagctcgacgccatg

SEQ ID NO: 156801 - DNA, 25 bp, Mus musculus
aaaatggccaccaccggccacacct

SEQ ID NO: 156802 - DNA, 25 bp, Mus musculus
aaaatggccatgtcagggatgagag

SEQ ID NO: 156803 - DNA, 25 bp, Mus musculus
aaaatggctcagggggagcaccgtc

SEQ ID NO: 156804 - DNA, 25 bp, Mus musculus
aaaatgggaagacagatgtctgagt

SEQ ID NO: 156805 - DNA, 25 bp, Mus musculus
aaaatgggagattatgtttaatgaa

SEQ ID NO: 156806 - DNA, 25 bp, Mus musculus
aaaatgggaggcttactcaattcca

SEQ ID NO: 156807 - DNA, 25 bp, Mus musculus
aaaatgggagtgggtgaactcatca

SEQ ID NO: 156808 - DNA, 25 bp, Mus musculus
aaaatgggcaaggtgaaattggtgc

SEQ ID NO: 156809 - DNA, 25 bp, Mus musculus
aaaatgggtggacttggcctggatg

SEQ ID NO: 156810 - DNA, 25 bp, Mus musculus
aaaatggttcctcagaacctgggag

SEQ ID NO: 156811 - DNA, 25 bp, Mus musculus
aaaatgtaacagagggaaaacagtt

SEQ ID NO: 156812 - DNA, 25 bp, Mus musculus
aaaatgtaacagagggttcccatct

SEQ ID NO: 156813 - DNA, 25 bp, Mus musculus
aaaatgtaacagagggtttgaagat

SEQ ID NO: 156814 - DNA, 25 bp, Mus musculus
aaaatgtattgaggaaaaggagaag

SEQ ID NO: 156815 - DNA, 25 bp, Mus musculus
aaaatgtcaaggtatacatctattc

SEQ ID NO: 156816 - DNA, 25 bp, Mus musculus
aaaatgtcaggaattagctctgcgc

SEQ ID NO: 156817 - DNA, 25 bp, Mus musculus
aaaatgtcaggttctggcaccccca

SEQ ID NO: 156818 - DNA, 25 bp, Mus musculus
aaaatgtcatcaaagggaatgatga

SEQ ID NO: 156819 - DNA, 25 bp, Mus musculus
aaaatgtcatcaaagggtctgagtg

SEQ ID NO: 156820 - DNA, 25 bp, Mus musculus
aaaatgtccacaccggtgatcctaa

SEQ ID NO: 156821 - DNA, 25 bp, Mus musculus
aaaatgtctacgaagagatctcaag

SEQ ID NO: 156822 - DNA, 25 bp, Mus musculus
aaaatgtctacgagaagatctcaag

SEQ ID NO: 156823 - DNA, 25 bp, Mus musculus
aaaatgtgaaggggctctttcctgc

SEQ ID NO: 156824 - DNA, 25 bp, Mus musculus
aaaatgtgaaggttggtacagagga

SEQ ID NO: 156825 - DNA, 25 bp, Mus musculus
aaaatgtgctggccatgccttttta

SEQ ID NO: 156826 - DNA, 25 bp, Mus musculus
aaaatgtggctaccctggtcatctg

SEQ ID NO: 156827 - DNA, 25 bp, Mus musculus
aaaatgtgggcgaggaatcttatgg

SEQ ID NO: 156828 - DNA, 25 bp, Mus musculus
aaaatgtgtaagcggccatgtattc

SEQ ID NO: 156829 - DNA, 25 bp, Mus musculus
aaaatgtgtaagcggtatttggagg

SEQ ID NO: 156830 - DNA, 25 bp, Mus musculus
aaaatgttaaaatgtgtcccctgca

SEQ ID NO: 156831 - DNA, 25 bp, Mus musculus
aaaatgtttacaagccaacaactat

SEQ ID NO: 156832 - DNA, 25 bp, Mus musculus
aaaatgtttctggtggaacaccagt

SEQ ID NO: 156833 - DNA, 25 bp, Mus musculus
aaaatgtttctgtgtgagtgcatgc

SEQ ID NO: 156834 - DNA, 25 bp, Mus musculus
aaaatgtttgaagcgacagcagtct

SEQ ID NO: 156835 - DNA, 25 bp, Mus musculus
aaaattaaacctaatgcttgcattg

SEQ ID NO: 156836 - DNA, 25 bp, Mus musculus
aaaattaaagatgaactaatgactt

SEQ ID NO: 156837 - DNA, 25 bp, Mus musculus
aaaattaaaggaaattgatcgtgaa

SEQ ID NO: 156838 - DNA, 25 bp, Mus musculus
aaaattaagacgaagatggccaagc

SEQ ID NO: 156839 - DNA, 25 bp, Mus musculus
aaaattaagacgaagggcaaggagg

SEQ ID NO: 156840 - DNA, 25 bp, Mus musculus
aaaattaatatatgatcctgaaaaa

SEQ ID NO: 156841 - DNA, 25 bp, Mus musculus
aaaattaatggtatcctaaagttgc

SEQ ID NO: 156842 - DNA, 25 bp, Mus musculus
aaaattaatggttggctgcaggtat

SEQ ID NO: 156843 - DNA, 25 bp, Mus musculus
aaaattacaagttgatcgtgtcctg

SEQ ID NO: 156844 - DNA, 25 bp, Mus musculus
aaaattacacaaacattacttcata

SEQ ID NO: 156845 - DNA, 25 bp, Mus musculus
aaaattacagagaatgcatcagatg

SEQ ID NO: 156846 - DNA, 25 bp, Mus musculus
aaaattacagctcagtctggaacgg

SEQ ID NO: 156847 - DNA, 25 bp, Mus musculus
aaaattaccccaagcattcttgaag

SEQ ID NO: 156848 - DNA, 25 bp, Mus musculus
aaaattactatagagaataggtcaa

SEQ ID NO: 156849 - DNA, 25 bp, Mus musculus
aaaattactataggctgcagaagag

SEQ ID NO: 156850 - DNA, 25 bp, Mus musculus
aaaattataattgcttctacttctc

SEQ ID NO: 156851 - DNA, 25 bp, Mus musculus
aaaattatatggtttgacggatgaa

SEQ ID NO: 156852 - DNA, 25 bp, Mus musculus
aaaattatgacactatttttgaaga

SEQ ID NO: 156853 - DNA, 25 bp, Mus musculus
aaaattattcaagaacaggacgcgg

SEQ ID NO: 156854 - DNA, 25 bp, Mus musculus
aaaattattcaagagatcatcgatg

SEQ ID NO: 156855 - DNA, 25 bp, Mus musculus
aaaattattggattgcagtgctccc

SEQ ID NO: 156856 - DNA, 25 bp, Mus musculus
aaaattcaagttttttgatttgtct

SEQ ID NO: 156857 - DNA, 25 bp, Mus musculus
aaaattcagaatgggctgtatgggg

SEQ ID NO: 156858 - DNA, 25 bp, Mus musculus
aaaattcatatgggtaactgtgctg

SEQ ID NO: 156859 - DNA, 25 bp, Mus musculus
aaaattcatgaacgagtttttctta

SEQ ID NO: 156860 - DNA, 25 bp, Mus musculus
aaaattcatgcagatgaatgagaac

SEQ ID NO: 156861 - DNA, 25 bp, Mus musculus
aaaattcatgcgagggagaactggt

SEQ ID NO: 156862 - DNA, 25 bp, Mus musculus
aaaattctcaagccagtaaaaaaga

SEQ ID NO: 156863 - DNA, 25 bp, Mus musculus
aaaattctcaagtcacgaacccctg

SEQ ID NO: 156864 - DNA, 25 bp, Mus musculus
aaaattctcagtcaggagagaattc

SEQ ID NO: 156865 - DNA, 25 bp, Mus musculus
aaaattgaacgagaagtaaacactc

SEQ ID NO: 156866 - DNA, 25 bp, Mus musculus
aaaattgaacgagaagtaaagtcta

SEQ ID NO: 156867 - DNA, 25 bp, Mus musculus
aaaattgaagagaatcaaaaggatg

SEQ ID NO: 156868 - DNA, 25 bp, Mus musculus
aaaattgaatcacgtgaactggacc

SEQ ID NO: 156869 - DNA, 25 bp, Mus musculus
aaaattgaatcaggtgaactggacc

SEQ ID NO: 156870 - DNA, 25 bp, Mus musculus
aaaattgacccaaagatcttggcat

SEQ ID NO: 156871 - DNA, 25 bp, Mus musculus
aaaattgaccctgagacgatccaga

SEQ ID NO: 156872 - DNA, 25 bp, Mus musculus
aaaattgactacagaacacaagact

SEQ ID NO: 156873 - DNA, 25 bp, Mus musculus
aaaattgactacagatttcatatat

SEQ ID NO: 156874 - DNA, 25 bp, Mus musculus
aaaattgactacaggaaactataag

SEQ ID NO: 156875 - DNA, 25 bp, Mus musculus
aaaattgagacctctgacagctgga

SEQ ID NO: 156876 - DNA, 25 bp, Mus musculus
aaaattgagagagagaagattattg

SEQ ID NO: 156877 - DNA, 25 bp, Mus musculus
aaaattgatgcatctctgacatttt

SEQ ID NO: 156878 - DNA, 25 bp, Mus musculus
aaaattgcaccaggtgatgttattg

SEQ ID NO: 156879 - DNA, 25 bp, Mus musculus
aaaattgcagaagggagagagtggc

SEQ ID NO: 156880 - DNA, 25 bp, Mus musculus
aaaattgcagaaggtgcacatcagg

SEQ ID NO: 156881 - DNA, 25 bp, Mus musculus
aaaattgccaagcctgtctcgctgc

SEQ ID NO: 156882 - DNA, 25 bp, Mus musculus
aaaattgccaaggcagaagaggagc

SEQ ID NO: 156883 - DNA, 25 bp, Mus musculus
aaaattgcctggaaggttgagattg

SEQ ID NO: 156884 - DNA, 25 bp, Mus musculus
aaaattgcctgtacacagagttctg

SEQ ID NO: 156885 - DNA, 25 bp, Mus musculus
aaaattgctgtggcactcagaaaga

SEQ ID NO: 156886 - DNA, 25 bp, Mus musculus
aaaattggccatgctctgcatgccc

SEQ ID NO: 156887 - DNA, 25 bp, Mus musculus
aaaattgtccgatgccatgaacaca

SEQ ID NO: 156888 - DNA, 25 bp, Mus musculus
aaaattgttaccaaagtgtgcaact

SEQ ID NO: 156889 - DNA, 25 bp, Mus musculus
aaaattgtttatagaaatacaatat

SEQ ID NO: 156890 - DNA, 25 bp, Mus musculus
aaaattgtttatagagatttgaagt

SEQ ID NO: 156891 - DNA, 25 bp, Mus musculus
aaaatttaaaaggttgcagtgtgtg

SEQ ID NO: 156892 - DNA, 25 bp, Mus musculus
aaaatttaaagtaggaggagccaag

SEQ ID NO: 156893 - DNA, 25 bp, Mus musculus
aaaatttcaagtactcagactacac

SEQ ID NO: 156894 - DNA, 25 bp, Mus musculus
aaaatttcaggccctcagtaccgcc

SEQ ID NO: 156895 - DNA, 25 bp, Mus musculus
aaaatttccacctgctgatcttaag

SEQ ID NO: 156896 - DNA, 25 bp, Mus musculus
aaaatttctaaacaggatttggtga

SEQ ID NO: 156897 - DNA, 25 bp, Mus musculus
aaaatttcttgtgaaaatgaacaag

SEQ ID NO: 156898 - DNA, 25 bp, Mus musculus
aaaatttggagacagaagcttaaca

SEQ ID NO: 156899 - DNA, 25 bp, Mus musculus
aaaatttggagctgacatcaacaaa

SEQ ID NO: 156900 - DNA, 25 bp, Mus musculus
aaaatttttataaaggcagctgctg

SEQ ID NO: 156901 - DNA, 25 bp, Mus musculus
aaacaaaaaaaagctgctgatcact

SEQ ID NO: 156902 - DNA, 25 bp, Mus musculus
aaacaaaaaatcagtggttagccag

SEQ ID NO: 156903 - DNA, 25 bp, Mus musculus
aaacaaaaaatcagttcccaagagt

SEQ ID NO: 156904 - DNA, 25 bp, Mus musculus
aaacaaaaacaacatggctgggctc

SEQ ID NO: 156905 - DNA, 25 bp, Mus musculus
aaacaaaaacttctggaattattga

SEQ ID NO: 156906 - DNA, 25 bp, Mus musculus
aaacaaaagaaagatataagcatac

SEQ ID NO: 156907 - DNA, 25 bp, Mus musculus
aaacaaaagagatgtcttctcacag

SEQ ID NO: 156908 - DNA, 25 bp, Mus musculus
aaacaaaataaatggtctactgaaa

SEQ ID NO: 156909 - DNA, 25 bp, Mus musculus
aaacaaaatctaacaattctctaca

SEQ ID NO: 156910 - DNA, 25 bp, Mus musculus
aaacaaacaacatgccctgcctgcc

SEQ ID NO: 156911 - DNA, 25 bp, Mus musculus
aaacaaaccagactgacctcggact

SEQ ID NO: 156912 - DNA, 25 bp, Mus musculus
aaacaaaccagatcccccacctgtg

SEQ ID NO: 156913 - DNA, 25 bp, Mus musculus
aaacaaaccgaagagatacttggag

SEQ ID NO: 156914 - DNA, 25 bp, Mus musculus
aaacaaactttagggactccagcta

SEQ ID NO: 156915 - DNA, 25 bp, Mus musculus
aaacaaactttagggagtatagtca

SEQ ID NO: 156916 - DNA, 25 bp, Mus musculus
aaacaaagagagctggaaagtcttt

SEQ ID NO: 156917 - DNA, 25 bp, Mus musculus
aaacaaagatgcccttagaccacct

SEQ ID NO: 156918 - DNA, 25 bp, Mus musculus
aaacaaagcaattgcctgtacccca

SEQ ID NO: 156919 - DNA, 25 bp, Mus musculus
aaacaaaggattatggtaccaagcg

SEQ ID NO: 156920 - DNA, 25 bp, Mus musculus
aaacaaagggcacaggctcgtcccc

SEQ ID NO: 156921 - DNA, 25 bp, Mus musculus
aaacaaagttcatggagtcgctggg

SEQ ID NO: 156922 - DNA, 25 bp, Mus musculus
aaacaaagttcatgggtgtttgcca

SEQ ID NO: 156923 - DNA, 25 bp, Mus musculus
aaacaaagtttgggggagcattctc

SEQ ID NO: 156924 - DNA, 25 bp, Mus musculus
aaacaaatcatagaggacattaagg

SEQ ID NO: 156925 - DNA, 25 bp, Mus musculus
aaacaaatgaacaggcaccacgccc

SEQ ID NO: 156926 - DNA, 25 bp, Mus musculus
aaacaaatggctccagcccactcct

SEQ ID NO: 156927 - DNA, 25 bp, Mus musculus
aaacaaattagtgacagatcagtca

SEQ ID NO: 156928 - DNA, 25 bp, Mus musculus
aaacaaattcaagtgctaaactgaa

SEQ ID NO: 156929 - DNA, 25 bp, Mus musculus
aaacaaattcccatctcatttgaaa

SEQ ID NO: 156930 - DNA, 25 bp, Mus musculus
aaacaacaagacccctcctcctcga

SEQ ID NO: 156931 - DNA, 25 bp, Mus musculus
aaacaacaagatctgtgatattgcc

SEQ ID NO: 156932 - DNA, 25 bp, Mus musculus
aaacaacaaggagtacctggagttc

SEQ ID NO: 156933 - DNA, 25 bp, Mus musculus
aaacaacacctggagagtgagaaga

SEQ ID NO: 156934 - DNA, 25 bp, Mus musculus
aaacaacatcctgcggtattcctgg

SEQ ID NO: 156935 - DNA, 25 bp, Mus musculus
aaacaacatgccctgcctgccccaa

SEQ ID NO: 156936 - DNA, 25 bp, Mus musculus
aaacaaccaagagaagcaattggaa

SEQ ID NO: 156937 - DNA, 25 bp, Mus musculus
aaacaaccaagcacttgtttcagca

SEQ ID NO: 156938 - DNA, 25 bp, Mus musculus
aaacaaccaggtattgaccaagaag

SEQ ID NO: 156939 - DNA, 25 bp, Mus musculus
aaacaacctagagcttcaggatctc

SEQ ID NO: 156940 - DNA, 25 bp, Mus musculus
aaacaactgtttaaggaatcacgcc

SEQ ID NO: 156941 - DNA, 25 bp, Mus musculus
aaacaactgtttaaggaatccctct

SEQ ID NO: 156942 - DNA, 25 bp, Mus musculus
aaacaagaaactcgggtgccctcca

SEQ ID NO: 156943 - DNA, 25 bp, Mus musculus
aaacaagaagctcaggcgaaaggag

SEQ ID NO: 156944 - DNA, 25 bp, Mus musculus
aaacaagacaggtcgattgagtgat

SEQ ID NO: 156945 - DNA, 25 bp, Mus musculus
aaacaagaccaagagaccacagcag

SEQ ID NO: 156946 - DNA, 25 bp, Mus musculus
aaacaagaccaagaggttgaaagga

SEQ ID NO: 156947 - DNA, 25 bp, Mus musculus
aaacaagagaccaggtgaaaaaact

SEQ ID NO: 156948 - DNA, 25 bp, Mus musculus
aaacaagatgggaggcacctccaag

SEQ ID NO: 156949 - DNA, 25 bp, Mus musculus
aaacaagattacggccgaagactgt

SEQ ID NO: 156950 - DNA, 25 bp, Mus musculus
aaacaagattacggtacagcaaggg

SEQ ID NO: 156951 - DNA, 25 bp, Mus musculus
aaacaagcatagcgggtttggcttg

SEQ ID NO: 156952 - DNA, 25 bp, Mus musculus
aaacaagcatcagggggtccgccta

SEQ ID NO: 156953 - DNA, 25 bp, Mus musculus
aaacaagcattgcaggaagaattct

SEQ ID NO: 156954 - DNA, 25 bp, Mus musculus
aaacaagcccatgaagtgcccccgc

SEQ ID NO: 156955 - DNA, 25 bp, Mus musculus
aaacaagcgcagatattaaactaac

SEQ ID NO: 156956 - DNA, 25 bp, Mus musculus
aaacaagcggagtttggtgaaagtg

SEQ ID NO: 156957 - DNA, 25 bp, Mus musculus
aaacaagctgcaggcttctccagtg

SEQ ID NO: 156958 - DNA, 25 bp, Mus musculus
aaacaaggaagacagaacctctggt

SEQ ID NO: 156959 - DNA, 25 bp, Mus musculus
aaacaagggctacagctccggacca

SEQ ID NO: 156960 - DNA, 25 bp, Mus musculus
aaacaaggggcaggtaccacagaga

SEQ ID NO: 156961 - DNA, 25 bp, Mus musculus
aaacaaggtaggctgtcagccatct

SEQ ID NO: 156962 - DNA, 25 bp, Mus musculus
aaacaagtgcctgctttttctcttc

SEQ ID NO: 156963 - DNA, 25 bp, Mus musculus
aaacaagtgcgctctgaaaacctgg

SEQ ID NO: 156964 - DNA, 25 bp, Mus musculus
aaacaagtgcggtaattaccctctt

SEQ ID NO: 156965 - DNA, 25 bp, Mus musculus
aaacaagtgttcagagccggaaaca

SEQ ID NO: 156966 - DNA, 25 bp, Mus musculus
aaacaagtgttcaggcctccttctt

SEQ ID NO: 156967 - DNA, 25 bp, Mus musculus
aaacaagttctcaggaacaatcctc

SEQ ID NO: 156968 - DNA, 25 bp, Mus musculus
aaacaataatgaagacaactggatt

SEQ ID NO: 156969 - DNA, 25 bp, Mus musculus
aaacaatagtaaaggctggacccga

SEQ ID NO: 156970 - DNA, 25 bp, Mus musculus
aaacaatagtatctttacggacgag

SEQ ID NO: 156971 - DNA, 25 bp, Mus musculus
aaacaatcagcccaggagttaaagt

SEQ ID NO: 156972 - DNA, 25 bp, Mus musculus
aaacaatcctgaggtactgtactga

SEQ ID NO: 156973 - DNA, 25 bp, Mus musculus
aaacaatcttcaggtggctgtgaag

SEQ ID NO: 156974 - DNA, 25 bp, Mus musculus
aaacaatggagtccaacacaatcca

SEQ ID NO: 156975 - DNA, 25 bp, Mus musculus
aaacaatgtcacgaacttgtttcct

SEQ ID NO: 156976 - DNA, 25 bp, Mus musculus
aaacaatgtctttggtttcaacagc

SEQ ID NO: 156977 - DNA, 25 bp, Mus musculus
aaacaatttcagcatctctgagttt

SEQ ID NO: 156978 - DNA, 25 bp, Mus musculus
aaacaatttcagtcatctcctgaag

SEQ ID NO: 156979 - DNA, 25 bp, Mus musculus
aaacacaaaaaatcttctctgatga

SEQ ID NO: 156980 - DNA, 25 bp, Mus musculus
aaacacaaaaatgggttctctgtct

SEQ ID NO: 156981 - DNA, 25 bp, Mus musculus
aaacacaaaggaaagatttctcgaa

SEQ ID NO: 156982 - DNA, 25 bp, Mus musculus
aaacacaaaggaaaggcattagcaa

SEQ ID NO: 156983 - DNA, 25 bp, Mus musculus
aaacacaaaggcagagtcagttgtt

SEQ ID NO: 156984 - DNA, 25 bp, Mus musculus
aaacacaacaaagattatcagagac

SEQ ID NO: 156985 - DNA, 25 bp, Mus musculus
aaacacaagaacaggcaaggccctc

SEQ ID NO: 156986 - DNA, 25 bp, Mus musculus
aaacacaagagaattcatacaggag

SEQ ID NO: 156987 - DNA, 25 bp, Mus musculus
aaacacaagagcaggcaaggccctc

SEQ ID NO: 156988 - DNA, 25 bp, Mus musculus
aaacacaatcagatgtcgtttggtc

SEQ ID NO: 156989 - DNA, 25 bp, Mus musculus
aaacacaatcagccgcataactcat

SEQ ID NO: 156990 - DNA, 25 bp, Mus musculus
aaacacaatcagccgtcattcagtc

SEQ ID NO: 156991 - DNA, 25 bp, Mus musculus
aaacacaatcagtcgaagggggcag

SEQ ID NO: 156992 - DNA, 25 bp, Mus musculus
aaacacacaccaagtttttcaagac

SEQ ID NO: 156993 - DNA, 25 bp, Mus musculus
aaacacacaccagtcatcttcagcc

SEQ ID NO: 156994 - DNA, 25 bp, Mus musculus
aaacacacagcagatgcattacacg

SEQ ID NO: 156995 - DNA, 25 bp, Mus musculus
aaacacacaggcagatgtcatcaat

SEQ ID NO: 156996 - DNA, 25 bp, Mus musculus
aaacacacctgacttatttattttg

SEQ ID NO: 156997 - DNA, 25 bp, Mus musculus
aaacacacgaattgtcacaatgcct

SEQ ID NO: 156998 - DNA, 25 bp, Mus musculus
aaacacacgggggagaggccatttg

SEQ ID NO: 156999 - DNA, 25 bp, Mus musculus
aaacacactggaaggatttgccagt

SEQ ID NO: 157000 - DNA, 25 bp, Mus musculus
aaacacactggaagtatttttgaac

SEQ ID NO: 157001 - DNA, 25 bp, Mus musculus
aaacacagaaaaagcctgaaaatga

SEQ ID NO: 157002 - DNA, 25 bp, Mus musculus
aaacacagaaaaaggtctgcagaat

SEQ ID NO: 157003 - DNA, 25 bp, Mus musculus
aaacacagagagcttctcaggatgg

SEQ ID NO: 157004 - DNA, 25 bp, Mus musculus
aaacacagccggatgttctttggca

SEQ ID NO: 157005 - DNA, 25 bp, Mus musculus
aaacacaggagctccttctggccgc

SEQ ID NO: 157006 - DNA, 25 bp, Mus musculus
aaacacagttatgaacatcagaaag

SEQ ID NO: 157007 - DNA, 25 bp, Mus musculus
aaacacagttatgtatgcaattggc

SEQ ID NO: 157008 - DNA, 25 bp, Mus musculus
aaacacatcccaggcaccccacaca

SEQ ID NO: 157009 - DNA, 25 bp, Mus musculus
aaacacatgaaggttcatgaatctc

SEQ ID NO: 157010 - DNA, 25 bp, Mus musculus
aaacacatgaagtgttgtcctgctt

SEQ ID NO: 157011 - DNA, 25 bp, Mus musculus
aaacacattccaaagtatagcacat

SEQ ID NO: 157012 - DNA, 25 bp, Mus musculus
aaacacattccaaagtttatgtttt

SEQ ID NO: 157013 - DNA, 25 bp, Mus musculus
aaacacattgcaggctgcagatgtg

SEQ ID NO: 157014 - DNA, 25 bp, Mus musculus
aaacacattgcagttggaacaagag

SEQ ID NO: 157015 - DNA, 25 bp, Mus musculus
aaacaccaacaaagggcgagaactt

SEQ ID NO: 157016 - DNA, 25 bp, Mus musculus
aaacaccactgcagcagatccacag

SEQ ID NO: 157017 - DNA, 25 bp, Mus musculus
aaacaccaggaaagattaattgcct

SEQ ID NO: 157018 - DNA, 25 bp, Mus musculus
aaacaccagggtctcctagcccttt

SEQ ID NO: 157019 - DNA, 25 bp, Mus musculus
aaacaccatccagcacgtgcaggct

SEQ ID NO: 157020 - DNA, 25 bp, Mus musculus
aaacaccatgaggcaaaagcaaaag

SEQ ID NO: 157021 - DNA, 25 bp, Mus musculus
aaacacccagagcctctcggccctg

SEQ ID NO: 157022 - DNA, 25 bp, Mus musculus
aaacaccgtgcctaaattgtataga

SEQ ID NO: 157023 - DNA, 25 bp, Mus musculus
aaacacctgctctatgtgctgatgg

SEQ ID NO: 157024 - DNA, 25 bp, Mus musculus
aaacaccttatcaagcactggaggg

SEQ ID NO: 157025 - DNA, 25 bp, Mus musculus
aaacaccttatcaaggctcagaggc

SEQ ID NO: 157026 - DNA, 25 bp, Mus musculus
aaacacgccttggccggaatgtgta

SEQ ID NO: 157027 - DNA, 25 bp, Mus musculus
aaacacgccttggggttctctgtgt

SEQ ID NO: 157028 - DNA, 25 bp, Mus musculus
aaacacggcatagatttcaccgaga

SEQ ID NO: 157029 - DNA, 25 bp, Mus musculus
aaacacggcataggaccactgcaaa

SEQ ID NO: 157030 - DNA, 25 bp, Mus musculus
aaacacggcataggagctggtggcc

SEQ ID NO: 157031 - DNA, 25 bp, Mus musculus
aaacacgtcacaatgatttctatgg

SEQ ID NO: 157032 - DNA, 25 bp, Mus musculus
aaacacgtcggcttctgacgaagac

SEQ ID NO: 157033 - DNA, 25 bp, Mus musculus
aaacactaaggaaacaggtctggaa

SEQ ID NO: 157034 - DNA, 25 bp, Mus musculus
aaacactacaaatcccctagtgagc

SEQ ID NO: 157035 - DNA, 25 bp, Mus musculus
aaacactacatgaagtattacaatg

SEQ ID NO: 157036 - DNA, 25 bp, Mus musculus
aaacactaggattgcgattttctac

SEQ ID NO: 157037 - DNA, 25 bp, Mus musculus
aaacactcagcagcgaatgagcatg

SEQ ID NO: 157038 - DNA, 25 bp, Mus musculus
aaacactcagccctggcaccatcag

SEQ ID NO: 157039 - DNA, 25 bp, Mus musculus
aaacactccaggtcgcagacacttt

SEQ ID NO: 157040 - DNA, 25 bp, Mus musculus
aaacactctactggatgactggaaa

SEQ ID NO: 157041 - DNA, 25 bp, Mus musculus
aaacactctctaatatgtttatgga

SEQ ID NO: 157042 - DNA, 25 bp, Mus musculus
aaacactgacagggatcaagtttgt

SEQ ID NO: 157043 - DNA, 25 bp, Mus musculus
aaacactgtctagcaccatcaaaaa

SEQ ID NO: 157044 - DNA, 25 bp, Mus musculus
aaacacttaaagtatcaagagagcc

SEQ ID NO: 157045 - DNA, 25 bp, Mus musculus
aaacacttcattggccccagagcag

SEQ ID NO: 157046 - DNA, 25 bp, Mus musculus
aaacacttctctcaggcaggcaacc

SEQ ID NO: 157047 - DNA, 25 bp, Mus musculus
aaacacttgaaacagttccctggca

SEQ ID NO: 157048 - DNA, 25 bp, Mus musculus
aaacacttgaaaccagcgtgcaggg

SEQ ID NO: 157049 - DNA, 25 bp, Mus musculus
aaacacttggtgatgaagatgaatg

SEQ ID NO: 157050 - DNA, 25 bp, Mus musculus
aaacacttggtggtgtgaatgagtg

SEQ ID NO: 157051 - DNA, 25 bp, Mus musculus
aaacactttgcaaaggcaaaatcat

SEQ ID NO: 157052 - DNA, 25 bp, Mus musculus
aaacagaaaaaaattgaggagactt

SEQ ID NO: 157053 - DNA, 25 bp, Mus musculus
aaacagaaaacggaggatggacagt

SEQ ID NO: 157054 - DNA, 25 bp, Mus musculus
aaacagaaacgttcctgagactgac

SEQ ID NO: 157055 - DNA, 25 bp, Mus musculus
aaacagaaaggtgtcaactctgccc

SEQ ID NO: 157056 - DNA, 25 bp, Mus musculus
aaacagaaatggtgaggacactcga

SEQ ID NO: 157057 - DNA, 25 bp, Mus musculus
aaacagaacagatgacacttctcaa

SEQ ID NO: 157058 - DNA, 25 bp, Mus musculus
aaacagaaccagccaacagccatca

SEQ ID NO: 157059 - DNA, 25 bp, Mus musculus
aaacagaaccagcccatcattcagg

SEQ ID NO: 157060 - DNA, 25 bp, Mus musculus
aaacagaacgagcagcttttgaaat

SEQ ID NO: 157061 - DNA, 25 bp, Mus musculus
aaacagaacgagcaggcgaaggaga

SEQ ID NO: 157062 - DNA, 25 bp, Mus musculus
aaacagaagaggaacaagttgatct

SEQ ID NO: 157063 - DNA, 25 bp, Mus musculus
aaacagaagaggatgaaacaagtga

SEQ ID NO: 157064 - DNA, 25 bp, Mus musculus
aaacagaagagtctgaggttatgcg

SEQ ID NO: 157065 - DNA, 25 bp, Mus musculus
aaacagaagcaacaggaggctgatc

SEQ ID NO: 157066 - DNA, 25 bp, Mus musculus
aaacagaattataacaattgaaatt

SEQ ID NO: 157067 - DNA, 25 bp, Mus musculus
aaacagaattccaggacagagattt

SEQ ID NO: 157068 - DNA, 25 bp, Mus musculus
aaacagacaactcaacagcacagtc

SEQ ID NO: 157069 - DNA, 25 bp, Mus musculus
aaacagacaactcaattagcaatag

SEQ ID NO: 157070 - DNA, 25 bp, Mus musculus
aaacagacaagagagatgcctcagg

SEQ ID NO: 157071 - DNA, 25 bp, Mus musculus
aaacagacacaagttttgagaaatg

SEQ ID NO: 157072 - DNA, 25 bp, Mus musculus
aaacagacacaggtaccagagagat

SEQ ID NO: 157073 - DNA, 25 bp, Mus musculus
aaacagacacaggtggggtgaactg

SEQ ID NO: 157074 - DNA, 25 bp, Mus musculus
aaacagacagctctgtcttccccgg

SEQ ID NO: 157075 - DNA, 25 bp, Mus musculus
aaacagaccatgcaagtgaacgaag

SEQ ID NO: 157076 - DNA, 25 bp, Mus musculus
aaacagaccatgcaagtggaaagta

SEQ ID NO: 157077 - DNA, 25 bp, Mus musculus
aaacagactaaagactatgctgagt

SEQ ID NO: 157078 - DNA, 25 bp, Mus musculus
aaacagagacaaaggaacaagttga

SEQ ID NO: 157079 - DNA, 25 bp, Mus musculus
aaacagagacaggcatccgtccctg

SEQ ID NO: 157080 - DNA, 25 bp, Mus musculus
aaacagagagaggtgaaacctttgt

SEQ ID NO: 157081 - DNA, 25 bp, Mus musculus
aaacagagctacagaatcatacgat

SEQ ID NO: 157082 - DNA, 25 bp, Mus musculus
aaacagaggatccagcaaccagacc

SEQ ID NO: 157083 - DNA, 25 bp, Mus musculus
aaacagaggatccaggagctcgaac

SEQ ID NO: 157084 - DNA, 25 bp, Mus musculus
aaacagaggtaatctacaaaatggc

SEQ ID NO: 157085 - DNA, 25 bp, Mus musculus
aaacagatagaagaagaaaagcagc

SEQ ID NO: 157086 - DNA, 25 bp, Mus musculus
aaacagatagaagatcaacaacccc

SEQ ID NO: 157087 - DNA, 25 bp, Mus musculus
aaacagataggtaccctactcgctg

SEQ ID NO: 157088 - DNA, 25 bp, Mus musculus
aaacagatcgaagttaaaattgaag

SEQ ID NO: 157089 - DNA, 25 bp, Mus musculus
aaacagcaacgttttacaaacctga

SEQ ID NO: 157090 - DNA, 25 bp, Mus musculus
aaacagcaagatccaccaatgtttc

SEQ ID NO: 157091 - DNA, 25 bp, Mus musculus
aaacagcaagcctgtcattccttag

SEQ ID NO: 157092 - DNA, 25 bp, Mus musculus
aaacagcaagcgcctgtgagagaga

SEQ ID NO: 157093 - DNA, 25 bp, Mus musculus
aaacagcaaggggagatgttgcgta

SEQ ID NO: 157094 - DNA, 25 bp, Mus musculus
aaacagcagaaggtagagcttgaga

SEQ ID NO: 157095 - DNA, 25 bp, Mus musculus
aaacagcaggatgtcgatcagatgt

SEQ ID NO: 157096 - DNA, 25 bp, Mus musculus
aaacagcagtgaccagctcactaag

SEQ ID NO: 157097 - DNA, 25 bp, Mus musculus
aaacagcatgatgcagctgccttgg

SEQ ID NO: 157098 - DNA, 25 bp, Mus musculus
aaacagcatggaactgacccgaggc

SEQ ID NO: 157099 - DNA, 25 bp, Mus musculus
aaacagccaaagaaaactaactgct

SEQ ID NO: 157100 - DNA, 25 bp, Mus musculus
aaacagccaaggaggcaccgagatg

SEQ ID NO: 157101 - DNA, 25 bp, Mus musculus
aaacagccaaggcttccaagcagca

SEQ ID NO: 157102 - DNA, 25 bp, Mus musculus
aaacagccagcaagaaaccgaagaa

SEQ ID NO: 157103 - DNA, 25 bp, Mus musculus
aaacagccatgcggcttctccatga

SEQ ID NO: 157104 - DNA, 25 bp, Mus musculus
aaacagcccagatgttctccgccat

SEQ ID NO: 157105 - DNA, 25 bp, Mus musculus
aaacagccttcaaagaatgtctgta

SEQ ID NO: 157106 - DNA, 25 bp, Mus musculus
aaacagctagagaccaaaaccaaca

SEQ ID NO: 157107 - DNA, 25 bp, Mus musculus
aaacagctagctgcacgagaaaccg

SEQ ID NO: 157108 - DNA, 25 bp, Mus musculus
aaacagctccaagatgagcgtgaag

SEQ ID NO: 157109 - DNA, 25 bp, Mus musculus
aaacagctggaaggtgatttcaatc

SEQ ID NO: 157110 - DNA, 25 bp, Mus musculus
aaacagcttgagcccgcacagccca

SEQ ID NO: 157111 - DNA, 25 bp, Mus musculus
aaacagctttgctcagtatgggtga

SEQ ID NO: 157112 - DNA, 25 bp, Mus musculus
aaacaggaaaatcagtgtctttaca

SEQ ID NO: 157113 - DNA, 25 bp, Mus musculus
aaacaggaaagatcgcaaaagatgc

SEQ ID NO: 157114 - DNA, 25 bp, Mus musculus
aaacaggaaattcagcctcaagtac

SEQ ID NO: 157115 - DNA, 25 bp, Mus musculus
aaacaggaaattcaggcgatgctgg

SEQ ID NO: 157116 - DNA, 25 bp, Mus musculus
aaacaggacaaaaacagtacaacgt

SEQ ID NO: 157117 - DNA, 25 bp, Mus musculus
aaacaggacacagagatgactcgtt

SEQ ID NO: 157118 - DNA, 25 bp, Mus musculus
aaacaggagcaagaagcagcaaagc

SEQ ID NO: 157119 - DNA, 25 bp, Mus musculus
aaacaggaggaggcgaagaggatct

SEQ ID NO: 157120 - DNA, 25 bp, Mus musculus
aaacaggagttgacacatggtttgg

SEQ ID NO: 157121 - DNA, 25 bp, Mus musculus
aaacaggatcagcagtttgatttca

SEQ ID NO: 157122 - DNA, 25 bp, Mus musculus
aaacaggatcaggagtttgatttca

SEQ ID NO: 157123 - DNA, 25 bp, Mus musculus
aaacaggccacaggaaagcacagac

SEQ ID NO: 157124 - DNA, 25 bp, Mus musculus
aaacaggccaggtggccttgctaaa

SEQ ID NO: 157125 - DNA, 25 bp, Mus musculus
aaacaggccctgttggtccccctgg

SEQ ID NO: 157126 - DNA, 25 bp, Mus musculus
aaacaggcctaaaggctttgatgac

SEQ ID NO: 157127 - DNA, 25 bp, Mus musculus
aaacaggcctcaaggctttgatgac

SEQ ID NO: 157128 - DNA, 25 bp, Mus musculus
aaacaggcggaggaaacctatgaga

SEQ ID NO: 157129 - DNA, 25 bp, Mus musculus
aaacaggcggaggctagacaaatgg

SEQ ID NO: 157130 - DNA, 25 bp, Mus musculus
aaacaggctgttgtgcagactacac

SEQ ID NO: 157131 - DNA, 25 bp, Mus musculus
aaacagggcaacaggctgaaccatt

SEQ ID NO: 157132 - DNA, 25 bp, Mus musculus
aaacagggcccagagggtcgttgct

SEQ ID NO: 157133 - DNA, 25 bp, Mus musculus
aaacaggtaagctatgaaaaaagat

SEQ ID NO: 157134 - DNA, 25 bp, Mus musculus
aaacaggtagaaaagagaagcccgt

SEQ ID NO: 157135 - DNA, 25 bp, Mus musculus
aaacaggtcaaggagagtgtcactg

SEQ ID NO: 157136 - DNA, 25 bp, Mus musculus
aaacaggtcttgtcaaacacgctgg

SEQ ID NO: 157137 - DNA, 25 bp, Mus musculus
aaacaggtgatccagagaagagttt

SEQ ID NO: 157138 - DNA, 25 bp, Mus musculus
aaacaggtggaaggtacagttaaag

SEQ ID NO: 157139 - DNA, 25 bp, Mus musculus
aaacagtacagattgctaagaagcc

SEQ ID NO: 157140 - DNA, 25 bp, Mus musculus
aaacagtatccaaaggagtgtgcag

SEQ ID NO: 157141 - DNA, 25 bp, Mus musculus
aaacagtatccaaagttcaattttg

SEQ ID NO: 157142 - DNA, 25 bp, Mus musculus
aaacagtatgtgtgcagttatgagg

SEQ ID NO: 157143 - DNA, 25 bp, Mus musculus
aaacagtcagtgtgaatttgaaaga

SEQ ID NO: 157144 - DNA, 25 bp, Mus musculus
aaacagttcagatttcaactattgc

SEQ ID NO: 157145 - DNA, 25 bp, Mus musculus
aaacagttcagtcattgttctaggt

SEQ ID NO: 157146 - DNA, 25 bp, Mus musculus
aaacagttcagtcttcctgtaagga

SEQ ID NO: 157147 - DNA, 25 bp, Mus musculus
aaacagttccaggaagggaacataa

SEQ ID NO: 157148 - DNA, 25 bp, Mus musculus
aaacagttccagtcactattacctt

SEQ ID NO: 157149 - DNA, 25 bp, Mus musculus
aaacataaaaaagaggacgaggcgg

SEQ ID NO: 157150 - DNA, 25 bp, Mus musculus
aaacataaaaaagcttgcacacaca

SEQ ID NO: 157151 - DNA, 25 bp, Mus musculus
aaacataaaagaaattgcatgtgtg

SEQ ID NO: 157152 - DNA, 25 bp, Mus musculus
aaacataaaggtgactgattttggc

SEQ ID NO: 157153 - DNA, 25 bp, Mus musculus
aaacataacaacattcccgtcaata

SEQ ID NO: 157154 - DNA, 25 bp, Mus musculus
aaacatacagtggatgaatatatcg

SEQ ID NO: 157155 - DNA, 25 bp, Mus musculus
aaacatacatgttgccaggatgcat

SEQ ID NO: 157156 - DNA, 25 bp, Mus musculus
aaacatagagaggaactacaagaat

SEQ ID NO: 157157 - DNA, 25 bp, Mus musculus
aaacatatggaataaatttcaagaa

SEQ ID NO: 157158 - DNA, 25 bp, Mus musculus
aaacatatggaatgcaaattgaaga

SEQ ID NO: 157159 - DNA, 25 bp, Mus musculus
aaacatatggccagaatgaccatac

SEQ ID NO: 157160 - DNA, 25 bp, Mus musculus
aaacatatttttaagtaggaaaatg

SEQ ID NO: 157161 - DNA, 25 bp, Mus musculus
aaacatatttttaagtgtgatccca

SEQ ID NO: 157162 - DNA, 25 bp, Mus musculus
aaacatcaaaataaaccaggcgatg

SEQ ID NO: 157163 - DNA, 25 bp, Mus musculus
aaacatcaaggaacaataaaaagga

SEQ ID NO: 157164 - DNA, 25 bp, Mus musculus
aaacatcaataatgacaccacctac

SEQ ID NO: 157165 - DNA, 25 bp, Mus musculus
aaacatcacgaagaaacttgtggaa

SEQ ID NO: 157166 - DNA, 25 bp, Mus musculus
aaacatcacgaaggctttacaatgt

SEQ ID NO: 157167 - DNA, 25 bp, Mus musculus
aaacatcactgtcgtcactgcggcc

SEQ ID NO: 157168 - DNA, 25 bp, Mus musculus
aaacatcatcacgaaactgaggctc

SEQ ID NO: 157169 - DNA, 25 bp, Mus musculus
aaacatcattgatgggaatccggaa

SEQ ID NO: 157170 - DNA, 25 bp, Mus musculus
aaacatcattgatggtcctgcttgg

SEQ ID NO: 157171 - DNA, 25 bp, Mus musculus
aaacatccaatgtctcttcagatgg

SEQ ID NO: 157172 - DNA, 25 bp, Mus musculus
aaacatccaggtggctctggtccag

SEQ ID NO: 157173 - DNA, 25 bp, Mus musculus
aaacatccccaatacctgtcctagc

SEQ ID NO: 157174 - DNA, 25 bp, Mus musculus
aaacatcccttcagaatacacatgc

SEQ ID NO: 157175 - DNA, 25 bp, Mus musculus
aaacatccgaaaaagccggagcctc

SEQ ID NO: 157176 - DNA, 25 bp, Mus musculus
aaacatccggcatttgtagaaacat

SEQ ID NO: 157177 - DNA, 25 bp, Mus musculus
aaacatcctacaggaacttctgggt

SEQ ID NO: 157178 - DNA, 25 bp, Mus musculus
aaacatcctacaggtatttcgaact

SEQ ID NO: 157179 - DNA, 25 bp, Mus musculus
aaacatcctgccctatgaccactct

SEQ ID NO: 157180 - DNA, 25 bp, Mus musculus
aaacatcctgccctttctctcttta

SEQ ID NO: 157181 - DNA, 25 bp, Mus musculus
aaacatcgagaagcaactgcgctcc

SEQ ID NO: 157182 - DNA, 25 bp, Mus musculus
aaacatcgagaagtatcagcggtgc

SEQ ID NO: 157183 - DNA, 25 bp, Mus musculus
aaacatcgagacctttgccactcaa

SEQ ID NO: 157184 - DNA, 25 bp, Mus musculus
aaacatcgagagatccggggttcta

SEQ ID NO: 157185 - DNA, 25 bp, Mus musculus
aaacatcgagatcaagaagttggtg

SEQ ID NO: 157186 - DNA, 25 bp, Mus musculus
aaacatcggaagaactctcagctgg

SEQ ID NO: 157187 - DNA, 25 bp, Mus musculus
aaacatcggtacaggacagctttgc

SEQ ID NO: 157188 - DNA, 25 bp, Mus musculus
aaacatcggtacagtggcaggacag

SEQ ID NO: 157189 - DNA, 25 bp, Mus musculus
aaacatcgtttatagagacttaaaa

SEQ ID NO: 157190 - DNA, 25 bp, Mus musculus
aaacatctccattccaacctggtct

SEQ ID NO: 157191 - DNA, 25 bp, Mus musculus
aaacatctgaaactgaactcggaga

SEQ ID NO: 157192 - DNA, 25 bp, Mus musculus
aaacatctgaaacttttgttttcct

SEQ ID NO: 157193 - DNA, 25 bp, Mus musculus
aaacatctggaaggtatctcagacg

SEQ ID NO: 157194 - DNA, 25 bp, Mus musculus
aaacatctgggacgttaaaggatca

SEQ ID NO: 157195 - DNA, 25 bp, Mus musculus
aaacatctgtggatggatggatgga

SEQ ID NO: 157196 - DNA, 25 bp, Mus musculus
aaacatcttcaaaaactgcacctac

SEQ ID NO: 157197 - DNA, 25 bp, Mus musculus
aaacatcttgagatcttcaactttc

SEQ ID NO: 157198 - DNA, 25 bp, Mus musculus
aaacatgaactgttggcccttgatt

SEQ ID NO: 157199 - DNA, 25 bp, Mus musculus
aaacatgaagagggtaaatagctgt

SEQ ID NO: 157200 - DNA, 25 bp, Mus musculus
aaacatgaagaggtattgactgaat

SEQ ID NO: 157201 - DNA, 25 bp, Mus musculus
aaacatgaccaggccatgtgaaact

SEQ ID NO: 157202 - DNA, 25 bp, Mus musculus
aaacatgagacccagctttccctgc

SEQ ID NO: 157203 - DNA, 25 bp, Mus musculus
aaacatgagcaaagggccacaatac

SEQ ID NO: 157204 - DNA, 25 bp, Mus musculus
aaacatgatccaggcgtctcttttc

SEQ ID NO: 157205 - DNA, 25 bp, Mus musculus
aaacatgcagaagtcgatgcagaac

SEQ ID NO: 157206 - DNA, 25 bp, Mus musculus
aaacatgcagagagtagcagtgctg

SEQ ID NO: 157207 - DNA, 25 bp, Mus musculus
aaacatgcagagtgctgtgtgttcc

SEQ ID NO: 157208 - DNA, 25 bp, Mus musculus
aaacatgcctctaggttccagcagc

SEQ ID NO: 157209 - DNA, 25 bp, Mus musculus
aaacatgcgtacggctggcctcaaa

SEQ ID NO: 157210 - DNA, 25 bp, Mus musculus
aaacatgctggtggctgggacaacc

SEQ ID NO: 157211 - DNA, 25 bp, Mus musculus
aaacatgctggtggtgtcacaggtg

SEQ ID NO: 157212 - DNA, 25 bp, Mus musculus
aaacatgctggttgtcacaggtggt

SEQ ID NO: 157213 - DNA, 25 bp, Mus musculus
aaacatggcagcagagtcactcggc

SEQ ID NO: 157214 - DNA, 25 bp, Mus musculus
aaacatggcaggctctacacagaga

SEQ ID NO: 157215 - DNA, 25 bp, Mus musculus
aaacatgtatagactttgatgaatg

SEQ ID NO: 157216 - DNA, 25 bp, Mus musculus
aaacatgtatagctttagatgagca

SEQ ID NO: 157217 - DNA, 25 bp, Mus musculus
aaacatgtcccagcttacataattg

SEQ ID NO: 157218 - DNA, 25 bp, Mus musculus
aaacatgtcccagtttgacccattg

SEQ ID NO: 157219 - DNA, 25 bp, Mus musculus
aaacatgtgcagataacaatcgaaa

SEQ ID NO: 157220 - DNA, 25 bp, Mus musculus
aaacattagaaaaacataaatgcag

SEQ ID NO: 157221 - DNA, 25 bp, Mus musculus
aaacattataggatatcgtgctttt

SEQ ID NO: 157222 - DNA, 25 bp, Mus musculus
aaacattatgaactgctgagtgccc

SEQ ID NO: 157223 - DNA, 25 bp, Mus musculus
aaacattcaagctctgcctcacgtg

SEQ ID NO: 157224 - DNA, 25 bp, Mus musculus
aaacattcaagggtatccagaagtt

SEQ ID NO: 157225 - DNA, 25 bp, Mus musculus
aaacattcaaggtgtcaactctgcc

SEQ ID NO: 157226 - DNA, 25 bp, Mus musculus
aaacattcaatagaggatatccatg

SEQ ID NO: 157227 - DNA, 25 bp, Mus musculus
aaacattcgacagggaagaagaaaa

SEQ ID NO: 157228 - DNA, 25 bp, Mus musculus
aaacattcgacagggaagggaacaa

SEQ ID NO: 157229 - DNA, 25 bp, Mus musculus
aaacattgacctggtgatctccttc

SEQ ID NO: 157230 - DNA, 25 bp, Mus musculus
aaacattgcataggtagccaaggag

SEQ ID NO: 157231 - DNA, 25 bp, Mus musculus
aaacattgttacagaattgaattag

SEQ ID NO: 157232 - DNA, 25 bp, Mus musculus
aaacatttaaggagattactttgca

SEQ ID NO: 157233 - DNA, 25 bp, Mus musculus
aaacatttatggtgaagtatttgtt

SEQ ID NO: 157234 - DNA, 25 bp, Mus musculus
aaacatttgtgggagatcaagttct

SEQ ID NO: 157235 - DNA, 25 bp, Mus musculus
aaacatttgtggggaacagacaagt

SEQ ID NO: 157236 - DNA, 25 bp, Mus musculus
aaacattttattcatccaacaacta

SEQ ID NO: 157237 - DNA, 25 bp, Mus musculus
aaacattttattcatgcttaggtgg

SEQ ID NO: 157238 - DNA, 25 bp, Mus musculus
aaacattttattcatttttctggat

SEQ ID NO: 157239 - DNA, 25 bp, Mus musculus
aaacattttgagcgttggtgttgtg

SEQ ID NO: 157240 - DNA, 25 bp, Mus musculus
aaacattttgaggactactgttgaa

SEQ ID NO: 157241 - DNA, 25 bp, Mus musculus
aaaccaaaactgccttaggattctt

SEQ ID NO: 157242 - DNA, 25 bp, Mus musculus
aaaccaaaagctagagacaagcgag

SEQ ID NO: 157243 - DNA, 25 bp, Mus musculus
aaaccaaaagcttgtgggcgaaacg

SEQ ID NO: 157244 - DNA, 25 bp, Mus musculus
aaaccaaaaggcatcatagctgcga

SEQ ID NO: 157245 - DNA, 25 bp, Mus musculus
aaaccaaacaatttgctcctattca

SEQ ID NO: 157246 - DNA, 25 bp, Mus musculus
aaaccaaacaccagtatttctctga

SEQ ID NO: 157247 - DNA, 25 bp, Mus musculus
aaaccaaaccatatggagaagggct

SEQ ID NO: 157248 - DNA, 25 bp, Mus musculus
aaaccaaaccctgtagctccctact

SEQ ID NO: 157249 - DNA, 25 bp, Mus musculus
aaaccaaaccggataagctggaggc

SEQ ID NO: 157250 - DNA, 25 bp, Mus musculus
aaaccaaagcatggagggtgatgag

SEQ ID NO: 157251 - DNA, 25 bp, Mus musculus
aaaccaaatcagatgtcatggcacc

SEQ ID NO: 157252 - DNA, 25 bp, Mus musculus
aaaccaacagaggaattcatcagag

SEQ ID NO: 157253 - DNA, 25 bp, Mus musculus
aaaccaacagggcatgaaagaagtg

SEQ ID NO: 157254 - DNA, 25 bp, Mus musculus
aaaccaacaggtgtgcccaaggtga

SEQ ID NO: 157255 - DNA, 25 bp, Mus musculus
aaaccaagaaaccaagccgcaatga

SEQ ID NO: 157256 - DNA, 25 bp, Mus musculus
aaaccaagacccaaacttactgctc

SEQ ID NO: 157257 - DNA, 25 bp, Mus musculus
aaaccaagaggaaagcatagatgcc

SEQ ID NO: 157258 - DNA, 25 bp, Mus musculus
aaaccaagcaggagaactactttct

SEQ ID NO: 157259 - DNA, 25 bp, Mus musculus
aaaccaagcaggaggttgaggtgag

SEQ ID NO: 157260 - DNA, 25 bp, Mus musculus
aaaccacaagcgagctaatgtctgc

SEQ ID NO: 157261 - DNA, 25 bp, Mus musculus
aaaccacacagcaatgtttgcagag

SEQ ID NO: 157262 - DNA, 25 bp, Mus musculus
aaaccacagaagacagttgctcaga

SEQ ID NO: 157263 - DNA, 25 bp, Mus musculus
aaaccacagaaggccctgacccctc

SEQ ID NO: 157264 - DNA, 25 bp, Mus musculus
aaaccacagaaggtgcagacctctg

SEQ ID NO: 157265 - DNA, 25 bp, Mus musculus
aaaccacatccgtggttttttggca

SEQ ID NO: 157266 - DNA, 25 bp, Mus musculus
aaaccacatccgtttggaaatgatg

SEQ ID NO: 157267 - DNA, 25 bp, Mus musculus
aaaccacatgttcactatgaggaga

SEQ ID NO: 157268 - DNA, 25 bp, Mus musculus
aaaccacattgggtgggtgcaggag

SEQ ID NO: 157269 - DNA, 25 bp, Mus musculus
aaaccacattttgctatgagcttgg

SEQ ID NO: 157270 - DNA, 25 bp, Mus musculus
aaaccacattttggtgtgatggagt

SEQ ID NO: 157271 - DNA, 25 bp, Mus musculus
aaaccaccccttcaggcagagagcc

SEQ ID NO: 157272 - DNA, 25 bp, Mus musculus
aaaccacctcaggagtgaagcgtgt

SEQ ID NO: 157273 - DNA, 25 bp, Mus musculus
aaaccactcaggaccctggaaccct

SEQ ID NO: 157274 - DNA, 25 bp, Mus musculus
aaaccactgctaagatttgaattct

SEQ ID NO: 157275 - DNA, 25 bp, Mus musculus
aaaccactggatatattgggttgga

SEQ ID NO: 157276 - DNA, 25 bp, Mus musculus
aaaccactggggagtagagcaagtc

SEQ ID NO: 157277 - DNA, 25 bp, Mus musculus
aaaccactgtggattacgctcgatt

SEQ ID NO: 157278 - DNA, 25 bp, Mus musculus
aaaccagaagaagctcgagtgcatc

SEQ ID NO: 157279 - DNA, 25 bp, Mus musculus
aaaccagaagcctgtgccatctctg

SEQ ID NO: 157280 - DNA, 25 bp, Mus musculus
aaaccagacagaataagaatgagcg

SEQ ID NO: 157281 - DNA, 25 bp, Mus musculus
aaaccagagaggacctgagctgtcc

SEQ ID NO: 157282 - DNA, 25 bp, Mus musculus
aaaccagagcaaattcagaaatgga

SEQ ID NO: 157283 - DNA, 25 bp, Mus musculus
aaaccagagccatgagggatcttaa

SEQ ID NO: 157284 - DNA, 25 bp, Mus musculus
aaaccagagccatgcggtgctctta

SEQ ID NO: 157285 - DNA, 25 bp, Mus musculus
aaaccagagccatgtggaaccaggc

SEQ ID NO: 157286 - DNA, 25 bp, Mus musculus
aaaccagaggtggtggaatgatgcg

SEQ ID NO: 157287 - DNA, 25 bp, Mus musculus
aaaccagatcaaattgacatcgcta

SEQ ID NO: 157288 - DNA, 25 bp, Mus musculus
aaaccagatcagaaaccagtaaagt

SEQ ID NO: 157289 - DNA, 25 bp, Mus musculus
aaaccagcaaaggaagtggggataa

SEQ ID NO: 157290 - DNA, 25 bp, Mus musculus
aaaccagcaaaggtcctttccagtc

SEQ ID NO: 157291 - DNA, 25 bp, Mus musculus
aaaccagcaagctcctgggcctgct

SEQ ID NO: 157292 - DNA, 25 bp, Mus musculus
aaaccagcaagtgcgactgtatctg

SEQ ID NO: 157293 - DNA, 25 bp, Mus musculus
aaaccagcagaaaaaattcaagcaa

SEQ ID NO: 157294 - DNA, 25 bp, Mus musculus
aaaccagcaggaatccatcagcacc

SEQ ID NO: 157295 - DNA, 25 bp, Mus musculus
aaaccagccaaggactaactacgac

SEQ ID NO: 157296 - DNA, 25 bp, Mus musculus
aaaccagctccaggaagcagtcatg

SEQ ID NO: 157297 - DNA, 25 bp, Mus musculus
aaaccagctgtggttcggggccagg

SEQ ID NO: 157298 - DNA, 25 bp, Mus musculus
aaaccaggaaaaagtttacatgagg

SEQ ID NO: 157299 - DNA, 25 bp, Mus musculus
aaaccaggaaaatgtttacatgagg

SEQ ID NO: 157300 - DNA, 25 bp, Mus musculus
aaaccaggacaggattccccctctg

SEQ ID NO: 157301 - DNA, 25 bp, Mus musculus
aaaccagtaagggcaaagatgacgt

SEQ ID NO: 157302 - DNA, 25 bp, Mus musculus
aaaccagtaccaggaatgggcaccc

SEQ ID NO: 157303 - DNA, 25 bp, Mus musculus
aaaccagtaccagtcctcttctcca

SEQ ID NO: 157304 - DNA, 25 bp, Mus musculus
aaaccagtctggcaggatcttgtgc

SEQ ID NO: 157305 - DNA, 25 bp, Mus musculus
aaaccagttaagagagaacagagtt

SEQ ID NO: 157306 - DNA, 25 bp, Mus musculus
aaaccatagagagacactacgcaca

SEQ ID NO: 157307 - DNA, 25 bp, Mus musculus
aaaccatcccaggtgacaccgcttg

SEQ ID NO: 157308 - DNA, 25 bp, Mus musculus
aaaccatcgatagtgtccggatgcg

SEQ ID NO: 157309 - DNA, 25 bp, Mus musculus
aaaccatctgaaagctgggttgcag

SEQ ID NO: 157310 - DNA, 25 bp, Mus musculus
aaaccatctgatggcctgctggtga

SEQ ID NO: 157311 - DNA, 25 bp, Mus musculus
aaaccatcttcaaggacctgccgct

SEQ ID NO: 157312 - DNA, 25 bp, Mus musculus
aaaccatgaaggggactcctctcga

SEQ ID NO: 157313 - DNA, 25 bp, Mus musculus
aaaccatgaagtttctctgtgctct

SEQ ID NO: 157314 - DNA, 25 bp, Mus musculus
aaaccatgacatgtactatgcgtcg

SEQ ID NO: 157315 - DNA, 25 bp, Mus musculus
aaaccatgaggaggaagtcaacacc

SEQ ID NO: 157316 - DNA, 25 bp, Mus musculus
aaaccatggcagaacaaaaatcaga

SEQ ID NO: 157317 - DNA, 25 bp, Mus musculus
aaaccatggcagaattttctcagcg

SEQ ID NO: 157318 - DNA, 25 bp, Mus musculus
aaaccatggcaggtacagagctatc

SEQ ID NO: 157319 - DNA, 25 bp, Mus musculus
aaaccatggcccgtattcggaaact

SEQ ID NO: 157320 - DNA, 25 bp, Mus musculus
aaaccatggcccgtgatgcttcatt

SEQ ID NO: 157321 - DNA, 25 bp, Mus musculus
aaaccatggcccgtgtgtcagtggt

SEQ ID NO: 157322 - DNA, 25 bp, Mus musculus
aaaccatgtatacacatgccgatga

SEQ ID NO: 157323 - DNA, 25 bp, Mus musculus
aaaccatgtatacagatgccgatga

SEQ ID NO: 157324 - DNA, 25 bp, Mus musculus
aaaccatgtccagattcggaaacta

SEQ ID NO: 157325 - DNA, 25 bp, Mus musculus
aaaccatgttccggcttttccccag

SEQ ID NO: 157326 - DNA, 25 bp, Mus musculus
aaaccattaagttcgagaagctggc

SEQ ID NO: 157327 - DNA, 25 bp, Mus musculus
aaaccattcaaaatacaagtcctgg

SEQ ID NO: 157328 - DNA, 25 bp, Mus musculus
aaaccattcaaatcctggttgaagc

SEQ ID NO: 157329 - DNA, 25 bp, Mus musculus
aaaccattcagtttgcaggagacat

SEQ ID NO: 157330 - DNA, 25 bp, Mus musculus
aaaccattcatctgggaatgatttt

SEQ ID NO: 157331 - DNA, 25 bp, Mus musculus
aaacccaaactggatcctctgaagc

SEQ ID NO: 157332 - DNA, 25 bp, Mus musculus
aaacccaaagagatgtggttgctgt

SEQ ID NO: 157333 - DNA, 25 bp, Mus musculus
aaacccaaagatgcagacagccttt

SEQ ID NO: 157334 - DNA, 25 bp, Mus musculus
aaacccaaaggaagagcccagacac

SEQ ID NO: 157335 - DNA, 25 bp, Mus musculus
aaacccaacagcccactgagtgttt

SEQ ID NO: 157336 - DNA, 25 bp, Mus musculus
aaacccaaccaggtgatgagactat

SEQ ID NO: 157337 - DNA, 25 bp, Mus musculus
aaacccaagaaaatgatctgaattt

SEQ ID NO: 157338 - DNA, 25 bp, Mus musculus
aaacccaagagtgatggaaagaact

SEQ ID NO: 157339 - DNA, 25 bp, Mus musculus
aaacccaagcccaggacaccgtgca

SEQ ID NO: 157340 - DNA, 25 bp, Mus musculus
aaacccaagcccagttccacaagag

SEQ ID NO: 157341 - DNA, 25 bp, Mus musculus
aaacccaaggaatatggttgagccc

SEQ ID NO: 157342 - DNA, 25 bp, Mus musculus
aaacccaaggtgctacagtggggat

SEQ ID NO: 157343 - DNA, 25 bp, Mus musculus
aaacccaatctctgcgattttattg

SEQ ID NO: 157344 - DNA, 25 bp, Mus musculus
aaacccacagcatggtgagacacaa

SEQ ID NO: 157345 - DNA, 25 bp, Mus musculus
aaacccagacacaagcattcccact

SEQ ID NO: 157346 - DNA, 25 bp, Mus musculus
aaacccagagggccagtaagagctc

SEQ ID NO: 157347 - DNA, 25 bp, Mus musculus
aaacccagattccaggataacataa

SEQ ID NO: 157348 - DNA, 25 bp, Mus musculus
aaacccagcagccatccttgcagcc

SEQ ID NO: 157349 - DNA, 25 bp, Mus musculus
aaacccagcagtatgaatattcttt

SEQ ID NO: 157350 - DNA, 25 bp, Mus musculus
aaacccaggcaagttctgcctgctg

SEQ ID NO: 157351 - DNA, 25 bp, Mus musculus
aaacccatcaatcaggtgaatcccc

SEQ ID NO: 157352 - DNA, 25 bp, Mus musculus
aaacccatcaatcaggtgactgtga

SEQ ID NO: 157353 - DNA, 25 bp, Mus musculus
aaaccccaagaatctcgagaagccg

SEQ ID NO: 157354 - DNA, 25 bp, Mus musculus
aaaccccaaggagcggctgcaaagt

SEQ ID NO: 157355 - DNA, 25 bp, Mus musculus
aaaccccacaaaatcatgcaaatca

SEQ ID NO: 157356 - DNA, 25 bp, Mus musculus
aaaccccacagcagaaactgcagtt

SEQ ID NO: 157357 - DNA, 25 bp, Mus musculus
aaaccccacagcaggagtggacagc

SEQ ID NO: 157358 - DNA, 25 bp, Mus musculus
aaaccccacagccaaggcctggcca

SEQ ID NO: 157359 - DNA, 25 bp, Mus musculus
aaaccccagatatccagcttgtcca

SEQ ID NO: 157360 - DNA, 25 bp, Mus musculus
aaacccccagcctccagtgatgcca

SEQ ID NO: 157361 - DNA, 25 bp, Mus musculus
aaaccccgacccagactcattacag

SEQ ID NO: 157362 - DNA, 25 bp, Mus musculus
aaaccccgagaaagggtatatgtat

SEQ ID NO: 157363 - DNA, 25 bp, Mus musculus
aaaccccgccaagctctcggggata

SEQ ID NO: 157364 - DNA, 25 bp, Mus musculus
aaacccctcagcaagccccgcccaa

SEQ ID NO: 157365 - DNA, 25 bp, Mus musculus
aaacccctcatctccccggccgcag

SEQ ID NO: 157366 - DNA, 25 bp, Mus musculus
aaacccctctgtggtttctcagcct

SEQ ID NO: 157367 - DNA, 25 bp, Mus musculus
aaacccctcttatcctactagttgt

SEQ ID NO: 157368 - DNA, 25 bp, Mus musculus
aaacccctcttcagacagagagcct

SEQ ID NO: 157369 - DNA, 25 bp, Mus musculus
aaacccctcttcaggttatccgtgt

SEQ ID NO: 157370 - DNA, 25 bp, Mus musculus
aaacccgactgaatgctcggattgg

SEQ ID NO: 157371 - DNA, 25 bp, Mus musculus
aaaccctacgcacagagtatgatag

SEQ ID NO: 157372 - DNA, 25 bp, Mus musculus
aaaccctgccattctgatgaagttc

SEQ ID NO: 157373 - DNA, 25 bp, Mus musculus
aaaccctgccattcttattctgagg

SEQ ID NO: 157374 - DNA, 25 bp, Mus musculus
aaaccctgtccaggtagctctggct

SEQ ID NO: 157375 - DNA, 25 bp, Mus musculus
aaacccttgtgaactgaagaataat

SEQ ID NO: 157376 - DNA, 25 bp, Mus musculus
aaaccgaagagatacttggagatga

SEQ ID NO: 157377 - DNA, 25 bp, Mus musculus
aaaccgaatcacagctgccttcacc

SEQ ID NO: 157378 - DNA, 25 bp, Mus musculus
aaaccgaatcgccatctatgagaaa

SEQ ID NO: 157379 - DNA, 25 bp, Mus musculus
aaaccgaggaaggtccatgcgaagt

SEQ ID NO: 157380 - DNA, 25 bp, Mus musculus
aaaccgatccagagaaggcctactc

SEQ ID NO: 157381 - DNA, 25 bp, Mus musculus
aaaccgatccagtggaagaggcaga

SEQ ID NO: 157382 - DNA, 25 bp, Mus musculus
aaaccgatcccagctctaccgccca

SEQ ID NO: 157383 - DNA, 25 bp, Mus musculus
aaaccgcacggccttcaacactgac

SEQ ID NO: 157384 - DNA, 25 bp, Mus musculus
aaaccgcaggcttatgatggagcag

SEQ ID NO: 157385 - DNA, 25 bp, Mus musculus
aaaccgcccagcggtcagagtacac

SEQ ID NO: 157386 - DNA, 25 bp, Mus musculus
aaaccgcctcactggaatcccagct

SEQ ID NO: 157387 - DNA, 25 bp, Mus musculus
aaaccgcctgaggcacagaccccac

SEQ ID NO: 157388 - DNA, 25 bp, Mus musculus
aaaccgcctgagtcaaatcagaaaa

SEQ ID NO: 157389 - DNA, 25 bp, Mus musculus
aaaccgctatggcaacgtgatcgcc

SEQ ID NO: 157390 - DNA, 25 bp, Mus musculus
aaaccggagcacgggattcgagttc

SEQ ID NO: 157391 - DNA, 25 bp, Mus musculus
aaaccggcagaagagcctagattca

SEQ ID NO: 157392 - DNA, 25 bp, Mus musculus
aaaccggcagaagcttcaaactctc

SEQ ID NO: 157393 - DNA, 25 bp, Mus musculus
aaaccggccaccagccccttcacag

SEQ ID NO: 157394 - DNA, 25 bp, Mus musculus
aaaccggccaccaggttatcctaca

SEQ ID NO: 157395 - DNA, 25 bp, Mus musculus
aaaccgtaggcctgtagctccctac

SEQ ID NO: 157396 - DNA, 25 bp, Mus musculus
aaaccgtaggtgtggctatttcaat

SEQ ID NO: 157397 - DNA, 25 bp, Mus musculus
aaaccgtcaaggtcacggtctcggt

SEQ ID NO: 157398 - DNA, 25 bp, Mus musculus
aaacctaacggcctatggtgatgaa

SEQ ID NO: 157399 - DNA, 25 bp, Mus musculus
aaacctaacggcctgatgggagcca

SEQ ID NO: 157400 - DNA, 25 bp, Mus musculus
aaacctacatctgataaggaaggaa

SEQ ID NO: 157401 - DNA, 25 bp, Mus musculus
aaacctaccaggagcctgccaccac

SEQ ID NO: 157402 - DNA, 25 bp, Mus musculus
aaacctagaaggaaggtatcatgcc

SEQ ID NO: 157403 - DNA, 25 bp, Mus musculus
aaacctagagagagaaatacaagag

SEQ ID NO: 157404 - DNA, 25 bp, Mus musculus
aaacctagttgctgccttgcgctgg

SEQ ID NO: 157405 - DNA, 25 bp, Mus musculus
aaacctatgaagggctgcaattttg

SEQ ID NO: 157406 - DNA, 25 bp, Mus musculus
aaacctatggggcctcagactcatc

SEQ ID NO: 157407 - DNA, 25 bp, Mus musculus
aaacctccacgctgaatgaaaagtc

SEQ ID NO: 157408 - DNA, 25 bp, Mus musculus
aaacctccgtgaaaaccaggcgact

SEQ ID NO: 157409 - DNA, 25 bp, Mus musculus
aaacctctaaaatggtgcacctccg

SEQ ID NO: 157410 - DNA, 25 bp, Mus musculus
aaacctctcagtgaaaactgaaccg

SEQ ID NO: 157411 - DNA, 25 bp, Mus musculus
aaacctctcccaatcctgtgatagt

SEQ ID NO: 157412 - DNA, 25 bp, Mus musculus
aaacctctgaaactataattttatt

SEQ ID NO: 157413 - DNA, 25 bp, Mus musculus
aaacctctgaacctaacacagaaga

SEQ ID NO: 157414 - DNA, 25 bp, Mus musculus
aaacctctgaacctacactttcctg

SEQ ID NO: 157415 - DNA, 25 bp, Mus musculus
aaacctctgaacctataattttatt

SEQ ID NO: 157416 - DNA, 25 bp, Mus musculus
aaacctctgaactatgcctgtgtct

SEQ ID NO: 157417 - DNA, 25 bp, Mus musculus
aaacctctgaagagttacatgctgc

SEQ ID NO: 157418 - DNA, 25 bp, Mus musculus
aaacctctgcagcttgcactgaggc

SEQ ID NO: 157419 - DNA, 25 bp, Mus musculus
aaacctctgcggcggtatctgacct

SEQ ID NO: 157420 - DNA, 25 bp, Mus musculus
aaacctctgggaggatgttggatgg

SEQ ID NO: 157421 - DNA, 25 bp, Mus musculus
aaacctctgggtgaagggagcagta

SEQ ID NO: 157422 - DNA, 25 bp, Mus musculus
aaacctgaaatctgcctccaacatt

SEQ ID NO: 157423 - DNA, 25 bp, Mus musculus
aaacctgagaatctgcccgagagca

SEQ ID NO: 157424 - DNA, 25 bp, Mus musculus
aaacctgaggagccaacagaagttg

SEQ ID NO: 157425 - DNA, 25 bp, Mus musculus
aaacctgagggtgatttcagactgg

SEQ ID NO: 157426 - DNA, 25 bp, Mus musculus
aaacctgataagaagattatttcca

SEQ ID NO: 157427 - DNA, 25 bp, Mus musculus
aaacctgcaaccaagatgagtcctt

SEQ ID NO: 157428 - DNA, 25 bp, Mus musculus
aaacctgcaaccaagatttaaacga

SEQ ID NO: 157429 - DNA, 25 bp, Mus musculus
aaacctgcagtgtcttaaaacataa

SEQ ID NO: 157430 - DNA, 25 bp, Mus musculus
aaacctgcatgccatgatcaaagct

SEQ ID NO: 157431 - DNA, 25 bp, Mus musculus
aaacctgccatgggaaggagatgcg

SEQ ID NO: 157432 - DNA, 25 bp, Mus musculus
aaacctgccatgggagctggactgt

SEQ ID NO: 157433 - DNA, 25 bp, Mus musculus
aaacctgcgccagcacgcagggatt

SEQ ID NO: 157434 - DNA, 25 bp, Mus musculus
aaacctgcgccaggtgaccatctcg

SEQ ID NO: 157435 - DNA, 25 bp, Mus musculus
aaacctgctgaagattcagatatta

SEQ ID NO: 157436 - DNA, 25 bp, Mus musculus
aaacctgctgaagggagcatttcca

SEQ ID NO: 157437 - DNA, 25 bp, Mus musculus
aaacctggaccaatgggtcctcttg

SEQ ID NO: 157438 - DNA, 25 bp, Mus musculus
aaacctggtaaagtggttcatcgga

SEQ ID NO: 157439 - DNA, 25 bp, Mus musculus
aaacctggtgacgacggtgaagctg

SEQ ID NO: 157440 - DNA, 25 bp, Mus musculus
aaacctgtatagaagtgggaagatg

SEQ ID NO: 157441 - DNA, 25 bp, Mus musculus
aaacctgtgttctgatatagatgag

SEQ ID NO: 157442 - DNA, 25 bp, Mus musculus
aaacctgttgttctgaggactctca

SEQ ID NO: 157443 - DNA, 25 bp, Mus musculus
aaacctgttgttctggattccaccc

SEQ ID NO: 157444 - DNA, 25 bp, Mus musculus
aaaccttaagaccagagtagcttat

SEQ ID NO: 157445 - DNA, 25 bp, Mus musculus
aaaccttacataaactatactatgc

SEQ ID NO: 157446 - DNA, 25 bp, Mus musculus
aaaccttcaactacagccttacctg

SEQ ID NO: 157447 - DNA, 25 bp, Mus musculus
aaaccttcagttggatcctccagat

SEQ ID NO: 157448 - DNA, 25 bp, Mus musculus
aaaccttcccaggaaactccatgga

SEQ ID NO: 157449 - DNA, 25 bp, Mus musculus
aaaccttcccaggcacatctcccta

SEQ ID NO: 157450 - DNA, 25 bp, Mus musculus
aaaccttcctgagtgagctcattgc

SEQ ID NO: 157451 - DNA, 25 bp, Mus musculus
aaaccttgatcaggatcttcccaac

SEQ ID NO: 157452 - DNA, 25 bp, Mus musculus
aaaccttgcaccaagaagttaagtg

SEQ ID NO: 157453 - DNA, 25 bp, Mus musculus
aaaccttggctgggggatgggctct

SEQ ID NO: 157454 - DNA, 25 bp, Mus musculus
aaaccttgtggaactgtaccttcac

SEQ ID NO: 157455 - DNA, 25 bp, Mus musculus
aaacctttccagtatactcctgatc

SEQ ID NO: 157456 - DNA, 25 bp, Mus musculus
aaacctttccatattgtattttagc

SEQ ID NO: 157457 - DNA, 25 bp, Mus musculus
aaacctttgaatggtaaccaatgga

SEQ ID NO: 157458 - DNA, 25 bp, Mus musculus
aaacgaacaagactctgacaccacc

SEQ ID NO: 157459 - DNA, 25 bp, Mus musculus
aaacgaacaagcaggttcaggagat

SEQ ID NO: 157460 - DNA, 25 bp, Mus musculus
aaacgaacaatagtagaaaatgaga

SEQ ID NO: 157461 - DNA, 25 bp, Mus musculus
aaacgaaccaaggagaaagaactga

SEQ ID NO: 157462 - DNA, 25 bp, Mus musculus
aaacgaacggacaaggagatcagca

SEQ ID NO: 157463 - DNA, 25 bp, Mus musculus
aaacgaagaaagacccaggagagca

SEQ ID NO: 157464 - DNA, 25 bp, Mus musculus
aaacgaagacatcaaaggctcttgg

SEQ ID NO: 157465 - DNA, 25 bp, Mus musculus
aaacgaatcgaaggcctggacatac

SEQ ID NO: 157466 - DNA, 25 bp, Mus musculus
aaacgaatgtttcctgcaatcctga

SEQ ID NO: 157467 - DNA, 25 bp, Mus musculus
aaacgacagacagctattatctgga

SEQ ID NO: 157468 - DNA, 25 bp, Mus musculus
aaacgagaaaggtgagatctcaatg

SEQ ID NO: 157469 - DNA, 25 bp, Mus musculus
aaacgagagattaggttccaaggag

SEQ ID NO: 157470 - DNA, 25 bp, Mus musculus
aaacgagcaagcttctacatacaaa

SEQ ID NO: 157471 - DNA, 25 bp, Mus musculus
aaacgaggcttgaagaaagaacaag

SEQ ID NO: 157472 - DNA, 25 bp, Mus musculus
aaacgagggagctagcaaaatcgga

SEQ ID NO: 157473 - DNA, 25 bp, Mus musculus
aaacgagggagctaggaggccacgc

SEQ ID NO: 157474 - DNA, 25 bp, Mus musculus
aaacgagtagaagatgaaagtctgg

SEQ ID NO: 157475 - DNA, 25 bp, Mus musculus
aaacgagtgtagtaggtctgttcct

SEQ ID NO: 157476 - DNA, 25 bp, Mus musculus
aaacgatatcatgcctctgacagct

SEQ ID NO: 157477 - DNA, 25 bp, Mus musculus
aaacgattcagaggatcgacgagaa

SEQ ID NO: 157478 - DNA, 25 bp, Mus musculus
aaacgattccatacctgtgttgcgt

SEQ ID NO: 157479 - DNA, 25 bp, Mus musculus
aaacgattccatgtatggcatttca

SEQ ID NO: 157480 - DNA, 25 bp, Mus musculus
aaacgattccattgtgacaccatca

SEQ ID NO: 157481 - DNA, 25 bp, Mus musculus
aaacgcaaaatagaacaggtagtag

SEQ ID NO: 157482 - DNA, 25 bp, Mus musculus
aaacgcaacgtcatccccgctggca

SEQ ID NO: 157483 - DNA, 25 bp, Mus musculus
aaacgcaccgatggagggtccgaag

SEQ ID NO: 157484 - DNA, 25 bp, Mus musculus
aaacgcaggacatagaaattgcttt

SEQ ID NO: 157485 - DNA, 25 bp, Mus musculus
aaacgcaggacataggttgaatgct

SEQ ID NO: 157486 - DNA, 25 bp, Mus musculus
aaacgcaggagatggacttccagct

SEQ ID NO: 157487 - DNA, 25 bp, Mus musculus
aaacgcattgaagtggtggaagaac

SEQ ID NO: 157488 - DNA, 25 bp, Mus musculus
aaacgccatggctgacaagatcctg

SEQ ID NO: 157489 - DNA, 25 bp, Mus musculus
aaacgcccgttcacgatcctcagcg

SEQ ID NO: 157490 - DNA, 25 bp, Mus musculus
aaacgcgaagatgtgacagcatggg

SEQ ID NO: 157491 - DNA, 25 bp, Mus musculus
aaacgctaagaaaggaccctcaaca

SEQ ID NO: 157492 - DNA, 25 bp, Mus musculus
aaacgctataggtatgtgtatcaca

SEQ ID NO: 157493 - DNA, 25 bp, Mus musculus
aaacgctgagagagatgccaaaggc

SEQ ID NO: 157494 - DNA, 25 bp, Mus musculus
aaacgctgccgccaagttgaagttc

SEQ ID NO: 157495 - DNA, 25 bp, Mus musculus
aaacgctgtcctgtggaggtgtaaa

SEQ ID NO: 157496 - DNA, 25 bp, Mus musculus
aaacgcttccgatccttacctcgtg

SEQ ID NO: 157497 - DNA, 25 bp, Mus musculus
aaacggaaatctagtgttctccagt

SEQ ID NO: 157498 - DNA, 25 bp, Mus musculus
aaacggaaatgatcagcctcagtcc

SEQ ID NO: 157499 - DNA, 25 bp, Mus musculus
aaacggaaggaaaagaatgtggaga

SEQ ID NO: 157500 - DNA, 25 bp, Mus musculus
aaacggagagagcgtcgtatacaac

SEQ ID NO: 157501 - DNA, 25 bp, Mus musculus
aaacggatccagaaggaactgactg

SEQ ID NO: 157502 - DNA, 25 bp, Mus musculus
aaacggatccagaaggttgctttca

SEQ ID NO: 157503 - DNA, 25 bp, Mus musculus
aaacggattttggcaagtcaagcat

SEQ ID NO: 157504 - DNA, 25 bp, Mus musculus
aaacggcagaggattcgtaaacttc

SEQ ID NO: 157505 - DNA, 25 bp, Mus musculus
aaacggcatgtatcctcctccacca

SEQ ID NO: 157506 - DNA, 25 bp, Mus musculus
aaacggcatgtgacctgacctagtt

SEQ ID NO: 157507 - DNA, 25 bp, Mus musculus
aaacggctccaggctgctggcaatg

SEQ ID NO: 157508 - DNA, 25 bp, Mus musculus
aaacggggccatcgatgtgcagaag

SEQ ID NO: 157509 - DNA, 25 bp, Mus musculus
aaacggggccatcgtgattcgagtc

SEQ ID NO: 157510 - DNA, 25 bp, Mus musculus
aaacggtcttccgacatagactgac

SEQ ID NO: 157511 - DNA, 25 bp, Mus musculus
aaacgtaaagagctacaagaaaatc

SEQ ID NO: 157512 - DNA, 25 bp, Mus musculus
aaacgtccagcgtttggagcaggac

SEQ ID NO: 157513 - DNA, 25 bp, Mus musculus
aaacgtccaggagcaggcctcgtgg

SEQ ID NO: 157514 - DNA, 25 bp, Mus musculus
aaacgtcggcaatggctatgacatt

SEQ ID NO: 157515 - DNA, 25 bp, Mus musculus
aaacgtgacaacagcactgtttgaa

SEQ ID NO: 157516 - DNA, 25 bp, Mus musculus
aaacgttctacttttctggaggcat

SEQ ID NO: 157517 - DNA, 25 bp, Mus musculus
aaacgttctgcagcccacacaccct

SEQ ID NO: 157518 - DNA, 25 bp, Mus musculus
aaacgtttcaacgattgtactgcat

SEQ ID NO: 157519 - DNA, 25 bp, Mus musculus
aaacgtttcactgcgcaaaccatgc

SEQ ID NO: 157520 - DNA, 25 bp, Mus musculus
aaacgttttcacactgacttgaatt

SEQ ID NO: 157521 - DNA, 25 bp, Mus musculus
aaacgttttgctggccttcagtggg

SEQ ID NO: 157522 - DNA, 25 bp, Mus musculus
aaacgttttggcaaggagaggccag

SEQ ID NO: 157523 - DNA, 25 bp, Mus musculus
aaactaaaaatgtcccatctgcagg

SEQ ID NO: 157524 - DNA, 25 bp, Mus musculus
aaactaaagatgcagctttgcagaa

SEQ ID NO: 157525 - DNA, 25 bp, Mus musculus
aaactaaagatgcaggaacctcctt

SEQ ID NO: 157526 - DNA, 25 bp, Mus musculus
aaactaaagccaaaaccaacagcag

SEQ ID NO: 157527 - DNA, 25 bp, Mus musculus
aaactaaatcatccatgcatcatca

SEQ ID NO: 157528 - DNA, 25 bp, Mus musculus
aaactaacaaggacaatcagtacct

SEQ ID NO: 157529 - DNA, 25 bp, Mus musculus
aaactaacaaggatattacaaatga

SEQ ID NO: 157530 - DNA, 25 bp, Mus musculus
aaactaacagaaattgatgatgcaa

SEQ ID NO: 157531 - DNA, 25 bp, Mus musculus
aaactaacagagatgattctgacaa

SEQ ID NO: 157532 - DNA, 25 bp, Mus musculus
aaactaacaggtcaaggaaaacgtg

SEQ ID NO: 157533 - DNA, 25 bp, Mus musculus
aaactaaccctacagggtgactaca

SEQ ID NO: 157534 - DNA, 25 bp, Mus musculus
aaactaagcaagaacaatactacaa

SEQ ID NO: 157535 - DNA, 25 bp, Mus musculus
aaactaagcaagaagactaagaaca

SEQ ID NO: 157536 - DNA, 25 bp, Mus musculus
aaactaagcaagaagtggtggtaat

SEQ ID NO: 157537 - DNA, 25 bp, Mus musculus
aaactaagcaagaatgagctgaaga

SEQ ID NO: 157538 - DNA, 25 bp, Mus musculus
aaactaagcagaacaagccatccag

SEQ ID NO: 157539 - DNA, 25 bp, Mus musculus
aaactaagcaggaagcagaacaagc

SEQ ID NO: 157540 - DNA, 25 bp, Mus musculus
aaactaagccgcccagccaccatca

SEQ ID NO: 157541 - DNA, 25 bp, Mus musculus
aaactaatgaaagaggttaggaatt

SEQ ID NO: 157542 - DNA, 25 bp, Mus musculus
aaactaattatagtcctattgtcga

SEQ ID NO: 157543 - DNA, 25 bp, Mus musculus
aaactaattgatgagatggttggta

SEQ ID NO: 157544 - DNA, 25 bp, Mus musculus
aaactacaaaagcagaatgattgaa

SEQ ID NO: 157545 - DNA, 25 bp, Mus musculus
aaactacaaagacaggagcgaatcc

SEQ ID NO: 157546 - DNA, 25 bp, Mus musculus
aaactacaaagacaggtgtaacgtg

SEQ ID NO: 157547 - DNA, 25 bp, Mus musculus
aaactacaaagacagttcagggcga

SEQ ID NO: 157548 - DNA, 25 bp, Mus musculus
aaactacaagaaatatgtggaagaa

SEQ ID NO: 157549 - DNA, 25 bp, Mus musculus
aaactacaagagtggatcatgaccc

SEQ ID NO: 157550 - DNA, 25 bp, Mus musculus
aaactacacggaagaaaagcaacta

SEQ ID NO: 157551 - DNA, 25 bp, Mus musculus
aaactacaggctttttcttacttct

SEQ ID NO: 157552 - DNA, 25 bp, Mus musculus
aaactacattgccaaccgaggtccc

SEQ ID NO: 157553 - DNA, 25 bp, Mus musculus
aaactacattgttttcatcttccac

SEQ ID NO: 157554 - DNA, 25 bp, Mus musculus
aaactaccagagcagaagaatccca

SEQ ID NO: 157555 - DNA, 25 bp, Mus musculus
aaactaccagatgctggcatcgcca

SEQ ID NO: 157556 - DNA, 25 bp, Mus musculus
aaactaccaggtgacaaacagcatg

SEQ ID NO: 157557 - DNA, 25 bp, Mus musculus
aaactaccaggtgcactaggccttc

SEQ ID NO: 157558 - DNA, 25 bp, Mus musculus
aaactacctggatgcccagtactat

SEQ ID NO: 157559 - DNA, 25 bp, Mus musculus
aaactacgagctcctgcttcctgac

SEQ ID NO: 157560 - DNA, 25 bp, Mus musculus
aaactacgaggtgttctgcccagtt

SEQ ID NO: 157561 - DNA, 25 bp, Mus musculus
aaactacgagtcacaccagaagagg

SEQ ID NO: 157562 - DNA, 25 bp, Mus musculus
aaactacgagtttatagaacaagga

SEQ ID NO: 157563 - DNA, 25 bp, Mus musculus
aaactactcacaggatgagcagaag

SEQ ID NO: 157564 - DNA, 25 bp, Mus musculus
aaactactgcggctcaggatacttg

SEQ ID NO: 157565 - DNA, 25 bp, Mus musculus
aaactagaagatgaaatgaagacgt

SEQ ID NO: 157566 - DNA, 25 bp, Mus musculus
aaactagacaagatgtcttgggaag

SEQ ID NO: 157567 - DNA, 25 bp, Mus musculus
aaactagctgggatactaacaaaac

SEQ ID NO: 157568 - DNA, 25 bp, Mus musculus
aaactatactgagatcgccttacag

SEQ ID NO: 157569 - DNA, 25 bp, Mus musculus
aaactatagaggtgccttggagcac

SEQ ID NO: 157570 - DNA, 25 bp, Mus musculus
aaactatattcacagaattggcaga

SEQ ID NO: 157571 - DNA, 25 bp, Mus musculus
aaactatattcacaggagtcgatag

SEQ ID NO: 157572 - DNA, 25 bp, Mus musculus
aaactatcaggtactctatctacaa

SEQ ID NO: 157573 - DNA, 25 bp, Mus musculus
aaactatgagattaaaacaagggct

SEQ ID NO: 157574 - DNA, 25 bp, Mus musculus
aaactatgagttctgaatttcatga

SEQ ID NO: 157575 - DNA, 25 bp, Mus musculus
aaactatgcaggtgtgcattggaat

SEQ ID NO: 157576 - DNA, 25 bp, Mus musculus
aaactatggcatggttacagtacct

SEQ ID NO: 157577 - DNA, 25 bp, Mus musculus
aaactatggtgaaccgtgtgtgtct

SEQ ID NO: 157578 - DNA, 25 bp, Mus musculus
aaactatggtgaactctgtctgcaa

SEQ ID NO: 157579 - DNA, 25 bp, Mus musculus
aaactatggtgaaggctcttgctga

SEQ ID NO: 157580 - DNA, 25 bp, Mus musculus
aaactatttatgaattcacagacac

SEQ ID NO: 157581 - DNA, 25 bp, Mus musculus
aaactatttatgatactgcattttt

SEQ ID NO: 157582 - DNA, 25 bp, Mus musculus
aaactcaaaagattgctttattcac

SEQ ID NO: 157583 - DNA, 25 bp, Mus musculus
aaactcaacatcgacagcatcaata

SEQ ID NO: 157584 - DNA, 25 bp, Mus musculus
aaactcaactctcgatccacactgg

SEQ ID NO: 157585 - DNA, 25 bp, Mus musculus
aaactcaagatgctgatcatatgat

SEQ ID NO: 157586 - DNA, 25 bp, Mus musculus
aaactcaagcagctgttctttggct

SEQ ID NO: 157587 - DNA, 25 bp, Mus musculus
aaactcaagcaggtgttctttggct

SEQ ID NO: 157588 - DNA, 25 bp, Mus musculus
aaactcaaggaggcagagacccgtg

SEQ ID NO: 157589 - DNA, 25 bp, Mus musculus
aaactcaaggccctcatcaaaaaga

SEQ ID NO: 157590 - DNA, 25 bp, Mus musculus
aaactcaaggctcctgactatgata

SEQ ID NO: 157591 - DNA, 25 bp, Mus musculus
aaactcaatgaaaatgtcatggttt

SEQ ID NO: 157592 - DNA, 25 bp, Mus musculus
aaactcacaagaagaaacatgtcat

SEQ ID NO: 157593 - DNA, 25 bp, Mus musculus
aaactcacaagaagacttccaactg

SEQ ID NO: 157594 - DNA, 25 bp, Mus musculus
aaactcacaagaagtcgcaatgtgt

SEQ ID NO: 157595 - DNA, 25 bp, Mus musculus
aaactcacaagagcaaagccaaagt

SEQ ID NO: 157596 - DNA, 25 bp, Mus musculus
aaactcacaaggtatcgaagtgaga

SEQ ID NO: 157597 - DNA, 25 bp, Mus musculus
aaactcacacagagcactggcctga

SEQ ID NO: 157598 - DNA, 25 bp, Mus musculus
aaactcacactcaagaataaatttg

SEQ ID NO: 157599 - DNA, 25 bp, Mus musculus
aaactcacactcaaggataagtttg

SEQ ID NO: 157600 - DNA, 25 bp, Mus musculus
aaactcaccgccataaaaagatgca

SEQ ID NO: 157601 - DNA, 25 bp, Mus musculus
aaactcactaacagcatcaaggtgt

SEQ ID NO: 157602 - DNA, 25 bp, Mus musculus
aaactcactgcccaggtggaagaac

SEQ ID NO: 157603 - DNA, 25 bp, Mus musculus
aaactcactgcccaggtggagcaac

SEQ ID NO: 157604 - DNA, 25 bp, Mus musculus
aaactcagtcgtgcggggtcctcca

SEQ ID NO: 157605 - DNA, 25 bp, Mus musculus
aaactcagtggagagatgaataagt

SEQ ID NO: 157606 - DNA, 25 bp, Mus musculus
aaactcatattactgaagatgagct

SEQ ID NO: 157607 - DNA, 25 bp, Mus musculus
aaactcatattactggtgatgaatc

SEQ ID NO: 157608 - DNA, 25 bp, Mus musculus
aaactcatattactgtatcatccag

SEQ ID NO: 157609 - DNA, 25 bp, Mus musculus
aaactcatcctgactctcactcatg

SEQ ID NO: 157610 - DNA, 25 bp, Mus musculus
aaactccaatgtcacagaaaagaaa

SEQ ID NO: 157611 - DNA, 25 bp, Mus musculus
aaactccatgactacctcatgagca

SEQ ID NO: 157612 - DNA, 25 bp, Mus musculus
aaactccatgcaagtgccaaattta

SEQ ID NO: 157613 - DNA, 25 bp, Mus musculus
aaactccgtcaggcccctgatttct

SEQ ID NO: 157614 - DNA, 25 bp, Mus musculus
aaactccgtcagtacctcttgtgtc

SEQ ID NO: 157615 - DNA, 25 bp, Mus musculus
aaactcctaaaattatttcagctgc

SEQ ID NO: 157616 - DNA, 25 bp, Mus musculus
aaactcctcaagggttggtggtcgg

SEQ ID NO: 157617 - DNA, 25 bp, Mus musculus
aaactcctcgaaagatgttccggca

SEQ ID NO: 157618 - DNA, 25 bp, Mus musculus
aaactcgccacagagctcagcagtc

SEQ ID NO: 157619 - DNA, 25 bp, Mus musculus
aaactcggagcaggcagctggccgt

SEQ ID NO: 157620 - DNA, 25 bp, Mus musculus
aaactcggagcagtgggaccctgaa

SEQ ID NO: 157621 - DNA, 25 bp, Mus musculus
aaactctacaagcacttgcagaagc

SEQ ID NO: 157622 - DNA, 25 bp, Mus musculus
aaactctacaccctagaggagagct

SEQ ID NO: 157623 - DNA, 25 bp, Mus musculus
aaactctacaccctggtggtgtctg

SEQ ID NO: 157624 - DNA, 25 bp, Mus musculus
aaactctaccacagtgactcatgtt

SEQ ID NO: 157625 - DNA, 25 bp, Mus musculus
aaactctcaccaaaatgtgagcgtg

SEQ ID NO: 157626 - DNA, 25 bp, Mus musculus
aaactctcagagaaccgagcccgaa

SEQ ID NO: 157627 - DNA, 25 bp, Mus musculus
aaactctccaaggccgacgtggaaa

SEQ ID NO: 157628 - DNA, 25 bp, Mus musculus
aaactctccccccatcttcatcatc

SEQ ID NO: 157629 - DNA, 25 bp, Mus musculus
aaactctcccctcgtaccagtaatg

SEQ ID NO: 157630 - DNA, 25 bp, Mus musculus
aaactctcccctgtcctggagtggg

SEQ ID NO: 157631 - DNA, 25 bp, Mus musculus
aaactctcccgccatcttcatcatc

SEQ ID NO: 157632 - DNA, 25 bp, Mus musculus
aaactctgcgagcagccaccactgg

SEQ ID NO: 157633 - DNA, 25 bp, Mus musculus
aaactcttccatgtgctccccacac

SEQ ID NO: 157634 - DNA, 25 bp, Mus musculus
aaactcttcccagagaccgtgaaga

SEQ ID NO: 157635 - DNA, 25 bp, Mus musculus
aaactcttcccaggctttgacctag

SEQ ID NO: 157636 - DNA, 25 bp, Mus musculus
aaactcttgacaggaaggaggggga

SEQ ID NO: 157637 - DNA, 25 bp, Mus musculus
aaactcttgatagtgatctttccag

SEQ ID NO: 157638 - DNA, 25 bp, Mus musculus
aaactcttgcaaggtctggttttgc

SEQ ID NO: 157639 - DNA, 25 bp, Mus musculus
aaactcttttttctcctcttgcctc

SEQ ID NO: 157640 - DNA, 25 bp, Mus musculus
aaactgaaaaaaggctgtgacctct

SEQ ID NO: 157641 - DNA, 25 bp, Mus musculus
aaactgaaaatgatacagtgtgaca

SEQ ID NO: 157642 - DNA, 25 bp, Mus musculus
aaactgaaaatggtgttttcgatgt

SEQ ID NO: 157643 - DNA, 25 bp, Mus musculus
aaactgaaactattaggcaggaaca

SEQ ID NO: 157644 - DNA, 25 bp, Mus musculus
aaactgaacagagacactcctgagg

SEQ ID NO: 157645 - DNA, 25 bp, Mus musculus
aaactgaacagagatgatgattctg

SEQ ID NO: 157646 - DNA, 25 bp, Mus musculus
aaactgaacagagtaccatttaggt

SEQ ID NO: 157647 - DNA, 25 bp, Mus musculus
aaactgaacagtaaccgatttcgca

SEQ ID NO: 157648 - DNA, 25 bp, Mus musculus
aaactgaacagtgtaccatctatat

SEQ ID NO: 157649 - DNA, 25 bp, Mus musculus
aaactgaagaagaggttaggaattt

SEQ ID NO: 157650 - DNA, 25 bp, Mus musculus
aaactgaagcaggaggaggagacgc

SEQ ID NO: 157651 - DNA, 25 bp, Mus musculus
aaactgaagcaggtgtccatcctgt

SEQ ID NO: 157652 - DNA, 25 bp, Mus musculus
aaactgacagaaaggaaacatggag

SEQ ID NO: 157653 - DNA, 25 bp, Mus musculus
aaactgacattgggagaatcccggg

SEQ ID NO: 157654 - DNA, 25 bp, Mus musculus
aaactgacccgaagggtcacagacg

SEQ ID NO: 157655 - DNA, 25 bp, Mus musculus
aaactgactgagactaaaatacaaa

SEQ ID NO: 157656 - DNA, 25 bp, Mus musculus
aaactgagatgtgtctacattgggc

SEQ ID NO: 157657 - DNA, 25 bp, Mus musculus
aaactgagcacattaatccagtaac

SEQ ID NO: 157658 - DNA, 25 bp, Mus musculus
aaactgagcaccaaacaacatgtaa

SEQ ID NO: 157659 - DNA, 25 bp, Mus musculus
aaactgagcaccaagcttacaatga

SEQ ID NO: 157660 - DNA, 25 bp, Mus musculus
aaactgagcagcagaataaagatga

SEQ ID NO: 157661 - DNA, 25 bp, Mus musculus
aaactgagcattttgctctgtaaag

SEQ ID NO: 157662 - DNA, 25 bp, Mus musculus
aaactgaggaatcagcttaccaaca

SEQ ID NO: 157663 - DNA, 25 bp, Mus musculus
aaactgaggaatcagtattcgcctg

SEQ ID NO: 157664 - DNA, 25 bp, Mus musculus
aaactgaggagaagtgtgagaaact

SEQ ID NO: 157665 - DNA, 25 bp, Mus musculus
aaactgaggagagatcaggaatctt

SEQ ID NO: 157666 - DNA, 25 bp, Mus musculus
aaactgaggagatctagatccagag

SEQ ID NO: 157667 - DNA, 25 bp, Mus musculus
aaactgaggaggtcccgatcacata

SEQ ID NO: 157668 - DNA, 25 bp, Mus musculus
aaactgcaaagaaccgggtggtggg

SEQ ID NO: 157669 - DNA, 25 bp, Mus musculus
aaactgcaagttgcacccagctggt

SEQ ID NO: 157670 - DNA, 25 bp, Mus musculus
aaactgcacagagatcccaagtgtc

SEQ ID NO: 157671 - DNA, 25 bp, Mus musculus
aaactgcaccttcagcagagcacac

SEQ ID NO: 157672 - DNA, 25 bp, Mus musculus
aaactgcaccttcaggacgccgagg

SEQ ID NO: 157673 - DNA, 25 bp, Mus musculus
aaactgcagaatgtttaccgagaga

SEQ ID NO: 157674 - DNA, 25 bp, Mus musculus
aaactgcagtgaccaacattgatcg

SEQ ID NO: 157675 - DNA, 25 bp, Mus musculus
aaactgcagtgaccaccattcctgc

SEQ ID NO: 157676 - DNA, 25 bp, Mus musculus
aaactgcattatctggtgaccatct

SEQ ID NO: 157677 - DNA, 25 bp, Mus musculus
aaactgccaaaacgaaaacagatac

SEQ ID NO: 157678 - DNA, 25 bp, Mus musculus
aaactgccatgcttcctctaacagc

SEQ ID NO: 157679 - DNA, 25 bp, Mus musculus
aaactgcctggaattacatgaatga

SEQ ID NO: 157680 - DNA, 25 bp, Mus musculus
aaactgcctggccacttcagcatat

SEQ ID NO: 157681 - DNA, 25 bp, Mus musculus
aaactgcctggccagttcagcatat

SEQ ID NO: 157682 - DNA, 25 bp, Mus musculus
aaactgcctgggtagtccatgatgg

SEQ ID NO: 157683 - DNA, 25 bp, Mus musculus
aaactgctcaggaataaagctggct

SEQ ID NO: 157684 - DNA, 25 bp, Mus musculus
aaactgctccacttctatcagcaat

SEQ ID NO: 157685 - DNA, 25 bp, Mus musculus
aaactgctctggatttctttgactt

SEQ ID NO: 157686 - DNA, 25 bp, Mus musculus
aaactgctggatgatcctagcaaac

SEQ ID NO: 157687 - DNA, 25 bp, Mus musculus
aaactgctggatgatgaagttctca

SEQ ID NO: 157688 - DNA, 25 bp, Mus musculus
aaactgctgggcagctccagatgaa

SEQ ID NO: 157689 - DNA, 25 bp, Mus musculus
aaactgcttaaacaaggtgattctg

SEQ ID NO: 157690 - DNA, 25 bp, Mus musculus
aaactgctttgcacgtgacacaagc

SEQ ID NO: 157691 - DNA, 25 bp, Mus musculus
aaactggaagtgacccagactacag

SEQ ID NO: 157692 - DNA, 25 bp, Mus musculus
aaactggacagagccaatgcagaga

SEQ ID NO: 157693 - DNA, 25 bp, Mus musculus
aaactggactctaaactggtcagcc

SEQ ID NO: 157694 - DNA, 25 bp, Mus musculus
aaactggagccaccccaaatctgcc

SEQ ID NO: 157695 - DNA, 25 bp, Mus musculus
aaactggaggagttcaggagggggc

SEQ ID NO: 157696 - DNA, 25 bp, Mus musculus
aaactggagttacagcttcgttacg

SEQ ID NO: 157697 - DNA, 25 bp, Mus musculus
aaactggataacagtgcctccggag

SEQ ID NO: 157698 - DNA, 25 bp, Mus musculus
aaactggccacaatttactggttta

SEQ ID NO: 157699 - DNA, 25 bp, Mus musculus
aaactgggaccgtgcctgcaggtgt

SEQ ID NO: 157700 - DNA, 25 bp, Mus musculus
aaactgggagtgtgtgccgacaaca

SEQ ID NO: 157701 - DNA, 25 bp, Mus musculus
aaactggtacagtacaatatctccc

SEQ ID NO: 157702 - DNA, 25 bp, Mus musculus
aaactggtctctacttggctctgaa

SEQ ID NO: 157703 - DNA, 25 bp, Mus musculus
aaactggtctgtacttggctctgaa

SEQ ID NO: 157704 - DNA, 25 bp, Mus musculus
aaactgtaaataggtttgagtacag

SEQ ID NO: 157705 - DNA, 25 bp, Mus musculus
aaactgtaataaggatgaggctgtg

SEQ ID NO: 157706 - DNA, 25 bp, Mus musculus
aaactgtctccgattttactcctaa

SEQ ID NO: 157707 - DNA, 25 bp, Mus musculus
aaactgtgaacgaagggaacaagtc

SEQ ID NO: 157708 - DNA, 25 bp, Mus musculus
aaactgtgtgcggagactgcggccc

SEQ ID NO: 157709 - DNA, 25 bp, Mus musculus
aaactgttattccagcccaggagga

SEQ ID NO: 157710 - DNA, 25 bp, Mus musculus
aaactgttcaagctgggaggcacca

SEQ ID NO: 157711 - DNA, 25 bp, Mus musculus
aaactgttcaagttgtcccccatat

SEQ ID NO: 157712 - DNA, 25 bp, Mus musculus
aaactgttcaggtagcaacaattgc

SEQ ID NO: 157713 - DNA, 25 bp, Mus musculus
aaactgttctaaaggtgctttccag

SEQ ID NO: 157714 - DNA, 25 bp, Mus musculus
aaactgttctgcggtggagggagac

SEQ ID NO: 157715 - DNA, 25 bp, Mus musculus
aaacttaaagcacatacgtgtaata

SEQ ID NO: 157716 - DNA, 25 bp, Mus musculus
aaacttaaaggggctgatcctgaag

SEQ ID NO: 157717 - DNA, 25 bp, Mus musculus
aaacttaaattgagtaggaagagtg

SEQ ID NO: 157718 - DNA, 25 bp, Mus musculus
aaacttaacagtgaaagatttccga

SEQ ID NO: 157719 - DNA, 25 bp, Mus musculus
aaacttaacagtgaggaatgatatt

SEQ ID NO: 157720 - DNA, 25 bp, Mus musculus
aaacttaagtaccacgtgctggacg

SEQ ID NO: 157721 - DNA, 25 bp, Mus musculus
aaacttaagtaccaggtgctggacg

SEQ ID NO: 157722 - DNA, 25 bp, Mus musculus
aaacttaatgaggacatggcttgca

SEQ ID NO: 157723 - DNA, 25 bp, Mus musculus
aaacttaatgtcagccataacaaac

SEQ ID NO: 157724 - DNA, 25 bp, Mus musculus
aaacttacaggccttacttctctat

SEQ ID NO: 157725 - DNA, 25 bp, Mus musculus
aaacttacaggtgcttttgggtcgc

SEQ ID NO: 157726 - DNA, 25 bp, Mus musculus
aaacttacatcaaaattatattatg

SEQ ID NO: 157727 - DNA, 25 bp, Mus musculus
aaacttacatgtttgaggattgcgt

SEQ ID NO: 157728 - DNA, 25 bp, Mus musculus
aaacttagcacgaatgtgtgagaaa

SEQ ID NO: 157729 - DNA, 25 bp, Mus musculus
aaacttagggatggagcctcccaag

SEQ ID NO: 157730 - DNA, 25 bp, Mus musculus
aaacttagtgagtgtgtcccttctt

SEQ ID NO: 157731 - DNA, 25 bp, Mus musculus
aaacttcaactccaggcctctagac

SEQ ID NO: 157732 - DNA, 25 bp, Mus musculus
aaacttcaactccaggtatctccac

SEQ ID NO: 157733 - DNA, 25 bp, Mus musculus
aaacttcaagaagcatacagtttct

SEQ ID NO: 157734 - DNA, 25 bp, Mus musculus
aaacttcaagaagtaccagtacata

SEQ ID NO: 157735 - DNA, 25 bp, Mus musculus
aaacttcaaggctgtagagaggcat

SEQ ID NO: 157736 - DNA, 25 bp, Mus musculus
aaacttcagtcccagaagccaaaca

SEQ ID NO: 157737 - DNA, 25 bp, Mus musculus
aaacttcattgatgccaaagacccg

SEQ ID NO: 157738 - DNA, 25 bp, Mus musculus
aaacttccaacaggttgactacagt

SEQ ID NO: 157739 - DNA, 25 bp, Mus musculus
aaacttccagacctgaggtccaaca

SEQ ID NO: 157740 - DNA, 25 bp, Mus musculus
aaacttccaggcacatctcaggcgg

SEQ ID NO: 157741 - DNA, 25 bp, Mus musculus
aaacttcccaaggcactgtgcttgc

SEQ ID NO: 157742 - DNA, 25 bp, Mus musculus
aaacttcctccagacagcctggcag

SEQ ID NO: 157743 - DNA, 25 bp, Mus musculus
aaacttcctccaggactggacagta

SEQ ID NO: 157744 - DNA, 25 bp, Mus musculus
aaacttctacaggtttccgtggacg

SEQ ID NO: 157745 - DNA, 25 bp, Mus musculus
aaacttctgaaacttacttacagct

SEQ ID NO: 157746 - DNA, 25 bp, Mus musculus
aaacttctggcagagacttggcagt

SEQ ID NO: 157747 - DNA, 25 bp, Mus musculus
aaacttctggcagaggcattgaaga

SEQ ID NO: 157748 - DNA, 25 bp, Mus musculus
aaacttcttcaaaggatcccagaga

SEQ ID NO: 157749 - DNA, 25 bp, Mus musculus
aaacttcttcagaaggtcgtgaaaa

SEQ ID NO: 157750 - DNA, 25 bp, Mus musculus
aaacttctttcgggaggcagcccgc

SEQ ID NO: 157751 - DNA, 25 bp, Mus musculus
aaacttctttcggtgaagaatgctc

SEQ ID NO: 157752 - DNA, 25 bp, Mus musculus
aaacttgaaaagcaagaacgggaga

SEQ ID NO: 157753 - DNA, 25 bp, Mus musculus
aaacttgaaagatgacagtccccgg

SEQ ID NO: 157754 - DNA, 25 bp, Mus musculus
aaacttgcagatcagacccagcatg

SEQ ID NO: 157755 - DNA, 25 bp, Mus musculus
aaacttgcagtatgatgatggcagt

SEQ ID NO: 157756 - DNA, 25 bp, Mus musculus
aaacttgccaagaacatactaaaag

SEQ ID NO: 157757 - DNA, 25 bp, Mus musculus
aaacttggagagtggacagaaaaca

SEQ ID NO: 157758 - DNA, 25 bp, Mus musculus
aaacttggagcaggcaccgctcctc

SEQ ID NO: 157759 - DNA, 25 bp, Mus musculus
aaacttgggtgctgaaggggatgct

SEQ ID NO: 157760 - DNA, 25 bp, Mus musculus
aaacttgtgaggttctctaatgatc

SEQ ID NO: 157761 - DNA, 25 bp, Mus musculus
aaacttgtgggaagctcccctattt

SEQ ID NO: 157762 - DNA, 25 bp, Mus musculus
aaacttgtgggaagggcatttgtgt

SEQ ID NO: 157763 - DNA, 25 bp, Mus musculus
aaactttagggactccagctaccca

SEQ ID NO: 157764 - DNA, 25 bp, Mus musculus
aaactttagggagtatagtcatggc

SEQ ID NO: 157765 - DNA, 25 bp, Mus musculus
aaactttatgatcctggggcagagt

SEQ ID NO: 157766 - DNA, 25 bp, Mus musculus
aaactttcagtgggtggtgatagtg

SEQ ID NO: 157767 - DNA, 25 bp, Mus musculus
aaactttcttccatgatagagtcta

SEQ ID NO: 157768 - DNA, 25 bp, Mus musculus
aaactttcttccttgatagagtcta

SEQ ID NO: 157769 - DNA, 25 bp, Mus musculus
aaactttgatctgctgttgtgtgta

SEQ ID NO: 157770 - DNA, 25 bp, Mus musculus
aaactttgatgaaacttttttggct

SEQ ID NO: 157771 - DNA, 25 bp, Mus musculus
aaactttgtagttggtgatgatgaa

SEQ ID NO: 157772 - DNA, 25 bp, Mus musculus
aaactttgttatggctgaatcagag

SEQ ID NO: 157773 - DNA, 25 bp, Mus musculus
aaacttttaggtagacatttgggct

SEQ ID NO: 157774 - DNA, 25 bp, Mus musculus
aaacttttatggccttgaactcaga

SEQ ID NO: 157775 - DNA, 25 bp, Mus musculus
aaacttttccagtgtgtccattgtc

SEQ ID NO: 157776 - DNA, 25 bp, Mus musculus
aaacttttcttgagcgttggtgatg

SEQ ID NO: 157777 - DNA, 25 bp, Mus musculus
aaacttttcttgagtgattccacac

SEQ ID NO: 157778 - DNA, 25 bp, Mus musculus
aaagaaaaacaaagggaatgtgact

SEQ ID NO: 157779 - DNA, 25 bp, Mus musculus
aaagaaaaacaaatgcaatttcaag

SEQ ID NO: 157780 - DNA, 25 bp, Mus musculus
aaagaaaaacatcattccagaaact

SEQ ID NO: 157781 - DNA, 25 bp, Mus musculus
aaagaaaaaggaagactccacaaag

SEQ ID NO: 157782 - DNA, 25 bp, Mus musculus
aaagaaaaagtggcccatcctcagg

SEQ ID NO: 157783 - DNA, 25 bp, Mus musculus
aaagaaaacaaaaagtgtgaacatg

SEQ ID NO: 157784 - DNA, 25 bp, Mus musculus
aaagaaaacagagacgaagacatca

SEQ ID NO: 157785 - DNA, 25 bp, Mus musculus
aaagaaaacagatgatccagaggag

SEQ ID NO: 157786 - DNA, 25 bp, Mus musculus
aaagaaaacagatggtacaaagaag

SEQ ID NO: 157787 - DNA, 25 bp, Mus musculus
aaagaaaacagccccttcgaggaat

SEQ ID NO: 157788 - DNA, 25 bp, Mus musculus
aaagaaaacagctttgtttactagc

SEQ ID NO: 157789 - DNA, 25 bp, Mus musculus
aaagaaaacagtgacaacataagat

SEQ ID NO: 157790 - DNA, 25 bp, Mus musculus
aaagaaaacagttgagtggtaccga

SEQ ID NO: 157791 - DNA, 25 bp, Mus musculus
aaagaaaacgagctgtttgacaact

SEQ ID NO: 157792 - DNA, 25 bp, Mus musculus
aaagaaaaggccagcctgccgggag

SEQ ID NO: 157793 - DNA, 25 bp, Mus musculus
aaagaaaagggctgaagaagagaag

SEQ ID NO: 157794 - DNA, 25 bp, Mus musculus
aaagaaaataagtaccatgaaagca

SEQ ID NO: 157795 - DNA, 25 bp, Mus musculus
aaagaaaatagctccggtacctcgc

SEQ ID NO: 157796 - DNA, 25 bp, Mus musculus
aaagaaaatatggccaacagcaggc

SEQ ID NO: 157797 - DNA, 25 bp, Mus musculus
aaagaaaatatggctttacaagatg

SEQ ID NO: 157798 - DNA, 25 bp, Mus musculus
aaagaaaatatttagattgaggatg

SEQ ID NO: 157799 - DNA, 25 bp, Mus musculus
aaagaaaatgtcaaggtatacatct

SEQ ID NO: 157800 - DNA, 25 bp, Mus musculus
aaagaaaattaaagatgaactaatg

SEQ ID NO: 157801 - DNA, 25 bp, Mus musculus
aaagaaaattaaaggaaattgatcg

SEQ ID NO: 157802 - DNA, 25 bp, Mus musculus
aaagaaacacagagagcttctcagg

SEQ ID NO: 157803 - DNA, 25 bp, Mus musculus
aaagaaacacgaagaaaggctttgg

SEQ ID NO: 157804 - DNA, 25 bp, Mus musculus
aaagaaacagaggtcaacagtctgg

SEQ ID NO: 157805 - DNA, 25 bp, Mus musculus
aaagaaacagcaggtgattcaggat

SEQ ID NO: 157806 - DNA, 25 bp, Mus musculus
aaagaaacagcttttaaagacaggt

SEQ ID NO: 157807 - DNA, 25 bp, Mus musculus
aaagaaactaccagagcagaagaat

SEQ ID NO: 157808 - DNA, 25 bp, Mus musculus
aaagaaactaccagatgctggcatc

SEQ ID NO: 157809 - DNA, 25 bp, Mus musculus
aaagaaactaccaggtgacaaacag

SEQ ID NO: 157810 - DNA, 25 bp, Mus musculus
aaagaaactaccaggtgcactaggc

SEQ ID NO: 157811 - DNA, 25 bp, Mus musculus
aaagaaactgctctggatttctttg

SEQ ID NO: 157812 - DNA, 25 bp, Mus musculus
aaagaaagaagacccactgccacag

SEQ ID NO: 157813 - DNA, 25 bp, Mus musculus
aaagaaagaagagctgctgaatgcc

SEQ ID NO: 157814 - DNA, 25 bp, Mus musculus
aaagaaagaagatgtcagcccagcc

SEQ ID NO: 157815 - DNA, 25 bp, Mus musculus
aaagaaagaatccagagaggaagac

SEQ ID NO: 157816 - DNA, 25 bp, Mus musculus
aaagaaagaatgctcaaaggtgaca

SEQ ID NO: 157817 - DNA, 25 bp, Mus musculus
aaagaaagagagaccagagggacaa

SEQ ID NO: 157818 - DNA, 25 bp, Mus musculus
aaagaaagagagatggcagcagcag

SEQ ID NO: 157819 - DNA, 25 bp, Mus musculus
aaagaaagagagttcgatgcccaag

SEQ ID NO: 157820 - DNA, 25 bp, Mus musculus
aaagaaagagtttgacctggtgtgt

SEQ ID NO: 157821 - DNA, 25 bp, Mus musculus
aaagaaagatcaggaaaagactgat

SEQ ID NO: 157822 - DNA, 25 bp, Mus musculus
aaagaaagatcaggcgagtactaac

SEQ ID NO: 157823 - DNA, 25 bp, Mus musculus
aaagaaagcagggtgaaggaggagg

SEQ ID NO: 157824 - DNA, 25 bp, Mus musculus
aaagaaagctgtattttaaatcttc

SEQ ID NO: 157825 - DNA, 25 bp, Mus musculus
aaagaaagctgtggaaatcagtcag

SEQ ID NO: 157826 - DNA, 25 bp, Mus musculus
aaagaaagctgtggtaattccacca

SEQ ID NO: 157827 - DNA, 25 bp, Mus musculus
aaagaaaggaaaaggatgtgaggaa

SEQ ID NO: 157828 - DNA, 25 bp, Mus musculus
aaagaaaggcgagtctacgtgacac

SEQ ID NO: 157829 - DNA, 25 bp, Mus musculus
aaagaaagggttgctgttgcatgtg

SEQ ID NO: 157830 - DNA, 25 bp, Mus musculus
aaagaaagtcaggtatgctgcaaga

SEQ ID NO: 157831 - DNA, 25 bp, Mus musculus
aaagaaagttgcaaaaatcttggca

SEQ ID NO: 157832 - DNA, 25 bp, Mus musculus
aaagaaagttgcaaatgattcattc

SEQ ID NO: 157833 - DNA, 25 bp, Mus musculus
aaagaaatagaggtacaacataaga

SEQ ID NO: 157834 - DNA, 25 bp, Mus musculus
aaagaaatataaggactgaggatct

SEQ ID NO: 157835 - DNA, 25 bp, Mus musculus
aaagaaatcaaagagaaaatggatc

SEQ ID NO: 157836 - DNA, 25 bp, Mus musculus
aaagaaatcaaagatatagatgtca

SEQ ID NO: 157837 - DNA, 25 bp, Mus musculus
aaagaaatcgctcagtcctgcatct

SEQ ID NO: 157838 - DNA, 25 bp, Mus musculus
aaagaaatcgctcagtgccacatat

SEQ ID NO: 157839 - DNA, 25 bp, Mus musculus
aaagaaatgaccaaggaccctctgt

SEQ ID NO: 157840 - DNA, 25 bp, Mus musculus
aaagaaatgatggttcaacttctgt

SEQ ID NO: 157841 - DNA, 25 bp, Mus musculus
aaagaaatgcaaaatccgggaggag

SEQ ID NO: 157842 - DNA, 25 bp, Mus musculus
aaagaaatgtgcaattcctaaatgc

SEQ ID NO: 157843 - DNA, 25 bp, Mus musculus
aaagaaatgtgcacttggatctcag

SEQ ID NO: 157844 - DNA, 25 bp, Mus musculus
aaagaaattaaagtggcagcttgac

SEQ ID NO: 157845 - DNA, 25 bp, Mus musculus
aaagaacaagaccgtggctaccgaa

SEQ ID NO: 157846 - DNA, 25 bp, Mus musculus
aaagaacaagagacatgtttggccc

SEQ ID NO: 157847 - DNA, 25 bp, Mus musculus
aaagaacacagaacttgtccttttc

SEQ ID NO: 157848 - DNA, 25 bp, Mus musculus
aaagaacacagtgccctggttccca

SEQ ID NO: 157849 - DNA, 25 bp, Mus musculus
aaagaacactttgagaagcaccagg

SEQ ID NO: 157850 - DNA, 25 bp, Mus musculus
aaagaacagggcagctgggcaccac

SEQ ID NO: 157851 - DNA, 25 bp, Mus musculus
aaagaacatatagaagattttaaac

SEQ ID NO: 157852 - DNA, 25 bp, Mus musculus
aaagaacattaaaaggagtgcaaga

SEQ ID NO: 157853 - DNA, 25 bp, Mus musculus
aaagaacctaaagaagcatgtcatt

SEQ ID NO: 157854 - DNA, 25 bp, Mus musculus
aaagaaccttgtggagatgggcagc

SEQ ID NO: 157855 - DNA, 25 bp, Mus musculus
aaagaacgaaagtcagcgtgggaga

SEQ ID NO: 157856 - DNA, 25 bp, Mus musculus
aaagaacggcgatgctttccgtcag

SEQ ID NO: 157857 - DNA, 25 bp, Mus musculus
aaagaactactgagactaaagcaag

SEQ ID NO: 157858 - DNA, 25 bp, Mus musculus
aaagaactactgaggcaaggcagca

SEQ ID NO: 157859 - DNA, 25 bp, Mus musculus
aaagaactatgtgcaacctcaagcc

SEQ ID NO: 157860 - DNA, 25 bp, Mus musculus
aaagaactattgagacccgatcctg

SEQ ID NO: 157861 - DNA, 25 bp, Mus musculus
aaagaactattgagaggccctggcc

SEQ ID NO: 157862 - DNA, 25 bp, Mus musculus
aaagaactattgagagtgtatgggc

SEQ ID NO: 157863 - DNA, 25 bp, Mus musculus
aaagaacttgtaaagcttgtagacc

SEQ ID NO: 157864 - DNA, 25 bp, Mus musculus
aaagaagaaaaaagattataagaga

SEQ ID NO: 157865 - DNA, 25 bp, Mus musculus
aaagaagaaaagctcaacagaggca

SEQ ID NO: 157866 - DNA, 25 bp, Mus musculus
aaagaagaaaaggaagagcatggct

SEQ ID NO: 157867 - DNA, 25 bp, Mus musculus
aaagaagaaaaggaatagtctcaag

SEQ ID NO: 157868 - DNA, 25 bp, Mus musculus
aaagaagaaaaggactgcatttacc

SEQ ID NO: 157869 - DNA, 25 bp, Mus musculus
aaagaagaaataaggtttgacaact

SEQ ID NO: 157870 - DNA, 25 bp, Mus musculus
aaagaagaaatatctgccacctctg

SEQ ID NO: 157871 - DNA, 25 bp, Mus musculus
aaagaagaaatctctgtcatagaca

SEQ ID NO: 157872 - DNA, 25 bp, Mus musculus
aaagaagaaatctgtgtactttatt

SEQ ID NO: 157873 - DNA, 25 bp, Mus musculus
aaagaagaagaggcacactggagcg

SEQ ID NO: 157874 - DNA, 25 bp, Mus musculus
aaagaagaagaggtgagtaatctgg

SEQ ID NO: 157875 - DNA, 25 bp, Mus musculus
aaagaagacaaaaagagttcaaaat

SEQ ID NO: 157876 - DNA, 25 bp, Mus musculus
aaagaagacagccaaggacactgcc

SEQ ID NO: 157877 - DNA, 25 bp, Mus musculus
aaagaagagaaataataactgccat

SEQ ID NO: 157878 - DNA, 25 bp, Mus musculus
aaagaagagaaatattacagcgact

SEQ ID NO: 157879 - DNA, 25 bp, Mus musculus
aaagaagagactacaactaaagcaa

SEQ ID NO: 157880 - DNA, 25 bp, Mus musculus
aaagaagagactacggccttatttt

SEQ ID NO: 157881 - DNA, 25 bp, Mus musculus
aaagaagagagagtacctcagccct

SEQ ID NO: 157882 - DNA, 25 bp, Mus musculus
aaagaagagatacaggtctcgttcc

SEQ ID NO: 157883 - DNA, 25 bp, Mus musculus
aaagaagagatacagttctaggtct

SEQ ID NO: 157884 - DNA, 25 bp, Mus musculus
aaagaagagcaggaaccccagaaca

SEQ ID NO: 157885 - DNA, 25 bp, Mus musculus
aaagaagagcagggctgtgtctggc

SEQ ID NO: 157886 - DNA, 25 bp, Mus musculus
aaagaagaggctgggatcagtacct

SEQ ID NO: 157887 - DNA, 25 bp, Mus musculus
aaagaagaggtgagtcctgagttgg

SEQ ID NO: 157888 - DNA, 25 bp, Mus musculus
aaagaagattagttgaagaacagtc

SEQ ID NO: 157889 - DNA, 25 bp, Mus musculus
aaagaagattccagtcctgcaccga

SEQ ID NO: 157890 - DNA, 25 bp, Mus musculus
aaagaagattggatttaccttcaag

SEQ ID NO: 157891 - DNA, 25 bp, Mus musculus
aaagaagcaaagcataaacaagctg

SEQ ID NO: 157892 - DNA, 25 bp, Mus musculus
aaagaagcaaaggaatattttgcag

SEQ ID NO: 157893 - DNA, 25 bp, Mus musculus
aaagaagcaaaggataaacaagctg

SEQ ID NO: 157894 - DNA, 25 bp, Mus musculus
aaagaagcaggaagtgtacttgatg

SEQ ID NO: 157895 - DNA, 25 bp, Mus musculus
aaagaagccagcagggctgtgggac

SEQ ID NO: 157896 - DNA, 25 bp, Mus musculus
aaagaagccatacgaattagtccta

SEQ ID NO: 157897 - DNA, 25 bp, Mus musculus
aaagaagcggcctgcatgacccgcc

SEQ ID NO: 157898 - DNA, 25 bp, Mus musculus
aaagaagctcagagtctacagtgcc

SEQ ID NO: 157899 - DNA, 25 bp, Mus musculus
aaagaagctgtaaagaggatagtgc

SEQ ID NO: 157900 - DNA, 25 bp, Mus musculus
aaagaaggaagaactaggctcctac

SEQ ID NO: 157901 - DNA, 25 bp, Mus musculus
aaagaaggaagaactgactcagatt

SEQ ID NO: 157902 - DNA, 25 bp, Mus musculus
aaagaaggaagatgcaggttttgat

SEQ ID NO: 157903 - DNA, 25 bp, Mus musculus
aaagaaggaaggatccaggccagtg

SEQ ID NO: 157904 - DNA, 25 bp, Mus musculus
aaagaaggacctaagctgcagaatc

SEQ ID NO: 157905 - DNA, 25 bp, Mus musculus
aaagaaggaggacattttccgtaga

SEQ ID NO: 157906 - DNA, 25 bp, Mus musculus
aaagaaggaggacgaggatataaat

SEQ ID NO: 157907 - DNA, 25 bp, Mus musculus
aaagaaggcaaggaggtggatacga

SEQ ID NO: 157908 - DNA, 25 bp, Mus musculus
aaagaaggcacaggaagcatttctt

SEQ ID NO: 157909 - DNA, 25 bp, Mus musculus
aaagaaggcagaggtatgatgatgt

SEQ ID NO: 157910 - DNA, 25 bp, Mus musculus
aaagaaggctaatgcttctgtgaag

SEQ ID NO: 157911 - DNA, 25 bp, Mus musculus
aaagaagggacaggtgccattgaca

SEQ ID NO: 157912 - DNA, 25 bp, Mus musculus
aaagaagggacaggtgtatcatccc

SEQ ID NO: 157913 - DNA, 25 bp, Mus musculus
aaagaaggggctggactgtaacaga

SEQ ID NO: 157914 - DNA, 25 bp, Mus musculus
aaagaaggggctggggaacagaagg

SEQ ID NO: 157915 - DNA, 25 bp, Mus musculus
aaagaagtcatactggtgaacggcc

SEQ ID NO: 157916 - DNA, 25 bp, Mus musculus
aaagaagtgtggtgctgataatact

SEQ ID NO: 157917 - DNA, 25 bp, Mus musculus
aaagaagtgtggtggattgaaccag

SEQ ID NO: 157918 - DNA, 25 bp, Mus musculus
aaagaagttggcatgaaagctgcac

SEQ ID NO: 157919 - DNA, 25 bp, Mus musculus
aaagaagttttcagagattgctggc

SEQ ID NO: 157920 - DNA, 25 bp, Mus musculus
aaagaatacctcaggtgcctgaaaa

SEQ ID NO: 157921 - DNA, 25 bp, Mus musculus
aaagaataggaggcggtaaccatag

SEQ ID NO: 157922 - DNA, 25 bp, Mus musculus
aaagaatattgccaggagttggcat

SEQ ID NO: 157923 - DNA, 25 bp, Mus musculus
aaagaatcagagacaccagagaaga

SEQ ID NO: 157924 - DNA, 25 bp, Mus musculus
aaagaatcagagagacaactggcag

SEQ ID NO: 157925 - DNA, 25 bp, Mus musculus
aaagaatccagaaaatgtaaagcaa

SEQ ID NO: 157926 - DNA, 25 bp, Mus musculus
aaagaatccagaaacttggaaaaga

SEQ ID NO: 157927 - DNA, 25 bp, Mus musculus
aaagaatccagagaggaagacgact

SEQ ID NO: 157928 - DNA, 25 bp, Mus musculus
aaagaatccgcaatgccctggcttt

SEQ ID NO: 157929 - DNA, 25 bp, Mus musculus
aaagaatccgcaatgcttctggaat

SEQ ID NO: 157930 - DNA, 25 bp, Mus musculus
aaagaatgaaaggcgttgcagctca

SEQ ID NO: 157931 - DNA, 25 bp, Mus musculus
aaagaatgaaggaataacagccttg

SEQ ID NO: 157932 - DNA, 25 bp, Mus musculus
aaagaatgatggtcgaatcgatgct

SEQ ID NO: 157933 - DNA, 25 bp, Mus musculus
aaagaatgccacaactgatgcctta

SEQ ID NO: 157934 - DNA, 25 bp, Mus musculus
aaagaatgcggctggcgcattggat

SEQ ID NO: 157935 - DNA, 25 bp, Mus musculus
aaagaatggagagaggaggctgctc

SEQ ID NO: 157936 - DNA, 25 bp, Mus musculus
aaagaatggagagagtttggaagaa

SEQ ID NO: 157937 - DNA, 25 bp, Mus musculus
aaagaatggaggtccgctggggaga

SEQ ID NO: 157938 - DNA, 25 bp, Mus musculus
aaagaatggcgtgcattttctgcag

SEQ ID NO: 157939 - DNA, 25 bp, Mus musculus
aaagaatgggcatgtctacacctgc

SEQ ID NO: 157940 - DNA, 25 bp, Mus musculus
aaagaatggggtaaccatagagatg

SEQ ID NO: 157941 - DNA, 25 bp, Mus musculus
aaagaatgtcgaagcggaggccaaa

SEQ ID NO: 157942 - DNA, 25 bp, Mus musculus
aaagaatgtggagccactgtatggc

SEQ ID NO: 157943 - DNA, 25 bp, Mus musculus
aaagaattccagaattcagtagctt

SEQ ID NO: 157944 - DNA, 25 bp, Mus musculus
aaagaattgaaggtgcctgaaaaag

SEQ ID NO: 157945 - DNA, 25 bp, Mus musculus
aaagaattgcagagggtaattttca

SEQ ID NO: 157946 - DNA, 25 bp, Mus musculus
aaagaattgcagttgcctcttttgt

SEQ ID NO: 157947 - DNA, 25 bp, Mus musculus
aaagaatttccattcgagcatcaga

SEQ ID NO: 157948 - DNA, 25 bp, Mus musculus
aaagaatttgctgtagacattttaa

SEQ ID NO: 157949 - DNA, 25 bp, Mus musculus
aaagaatttgggagggctggagaca

SEQ ID NO: 157950 - DNA, 25 bp, Mus musculus
aaagacaaaggggaagacatctttg

SEQ ID NO: 157951 - DNA, 25 bp, Mus musculus
aaagacaacaaaaatgaaaagaaag

SEQ ID NO: 157952 - DNA, 25 bp, Mus musculus
aaagacaagacagagagtggaggat

SEQ ID NO: 157953 - DNA, 25 bp, Mus musculus
aaagacaagacagggtgttgacgat

SEQ ID NO: 157954 - DNA, 25 bp, Mus musculus
aaagacaagaccggacaatacactg

SEQ ID NO: 157955 - DNA, 25 bp, Mus musculus
aaagacaagacgtggacacgcatcc

SEQ ID NO: 157956 - DNA, 25 bp, Mus musculus
aaagacacaacagagcaggttagga

SEQ ID NO: 157957 - DNA, 25 bp, Mus musculus
aaagacacaagaaatttacccaata

SEQ ID NO: 157958 - DNA, 25 bp, Mus musculus
aaagacactcaggtccctccagcta

SEQ ID NO: 157959 - DNA, 25 bp, Mus musculus
aaagacacttgtgcggaggcccact

SEQ ID NO: 157960 - DNA, 25 bp, Mus musculus
aaagacacttgtgcgggtgactcag

SEQ ID NO: 157961 - DNA, 25 bp, Mus musculus
aaagacagacaaggcttcagaagag

SEQ ID NO: 157962 - DNA, 25 bp, Mus musculus
aaagacagacctgtcaagagaatcc

SEQ ID NO: 157963 - DNA, 25 bp, Mus musculus
aaagacagactaaagaagtttccag

SEQ ID NO: 157964 - DNA, 25 bp, Mus musculus
aaagacagacttaggcgctaactgg

SEQ ID NO: 157965 - DNA, 25 bp, Mus musculus
aaagacagaggttcttgcagccatg

SEQ ID NO: 157966 - DNA, 25 bp, Mus musculus
aaagacagcaggctgcctttgatat

SEQ ID NO: 157967 - DNA, 25 bp, Mus musculus
aaagacagcggcagacactctgggt

SEQ ID NO: 157968 - DNA, 25 bp, Mus musculus
aaagacagcggcattgactcgggac

SEQ ID NO: 157969 - DNA, 25 bp, Mus musculus
aaagacagcggccctggcccagcgc

SEQ ID NO: 157970 - DNA, 25 bp, Mus musculus
aaagacagctccagtttttcaggaa

SEQ ID NO: 157971 - DNA, 25 bp, Mus musculus
aaagacaggagagatgagacaccaa

SEQ ID NO: 157972 - DNA, 25 bp, Mus musculus
aaagacaggagggagaaagagagag

SEQ ID NO: 157973 - DNA, 25 bp, Mus musculus
aaagacatcagaagactcaaatggt

SEQ ID NO: 157974 - DNA, 25 bp, Mus musculus
aaagacatctgcaagtgcacgttgg

SEQ ID NO: 157975 - DNA, 25 bp, Mus musculus
aaagacatgtattcgtaacaataaa

SEQ ID NO: 157976 - DNA, 25 bp, Mus musculus
aaagacattatggaggacactatcg

SEQ ID NO: 157977 - DNA, 25 bp, Mus musculus
aaagacattctggagccagcagggc

SEQ ID NO: 157978 - DNA, 25 bp, Mus musculus
aaagacattctggagggatgagaca

SEQ ID NO: 157979 - DNA, 25 bp, Mus musculus
aaagaccaaaggccagccttttgac

SEQ ID NO: 157980 - DNA, 25 bp, Mus musculus
aaagaccacaaagaaacatggtgaa

SEQ ID NO: 157981 - DNA, 25 bp, Mus musculus
aaagaccacaaatgggcgacttcca

SEQ ID NO: 157982 - DNA, 25 bp, Mus musculus
aaagaccacaaattgatccagctga

SEQ ID NO: 157983 - DNA, 25 bp, Mus musculus
aaagaccacacagagacttgaaaat

SEQ ID NO: 157984 - DNA, 25 bp, Mus musculus
aaagaccacacagagtttatggttc

SEQ ID NO: 157985 - DNA, 25 bp, Mus musculus
aaagaccacgtggatgaaggctgat

SEQ ID NO: 157986 - DNA, 25 bp, Mus musculus
aaagaccactaaccatgagtttatt

SEQ ID NO: 157987 - DNA, 25 bp, Mus musculus
aaagaccactgggttatcctatctt

SEQ ID NO: 157988 - DNA, 25 bp, Mus musculus
aaagacccaggagattagccgtccc

SEQ ID NO: 157989 - DNA, 25 bp, Mus musculus
aaagaccctgcagggagagagaatc

SEQ ID NO: 157990 - DNA, 25 bp, Mus musculus
aaagaccctgggaagactaaaatgt

SEQ ID NO: 157991 - DNA, 25 bp, Mus musculus
aaagaccctgtgtcacgaacccctg

SEQ ID NO: 157992 - DNA, 25 bp, Mus musculus
aaagacccttaaagatgaccttgct

SEQ ID NO: 157993 - DNA, 25 bp, Mus musculus
aaagacctaatgaaagctgcaccgc

SEQ ID NO: 157994 - DNA, 25 bp, Mus musculus
aaagacctaatgcgcctagaaaagg

SEQ ID NO: 157995 - DNA, 25 bp, Mus musculus
aaagacctacagctgcaccaaagcc

SEQ ID NO: 157996 - DNA, 25 bp, Mus musculus
aaagacctacaggaatcacaggttc

SEQ ID NO: 157997 - DNA, 25 bp, Mus musculus
aaagacctccgtctggatttttctt

SEQ ID NO: 157998 - DNA, 25 bp, Mus musculus
aaagacctggaggattacctgttgc

SEQ ID NO: 157999 - DNA, 25 bp, Mus musculus
aaagacctggccaactgtaacagaa

SEQ ID NO: 158000 - DNA, 25 bp, Mus musculus
aaagaccttgagagctgttctgcca

SEQ ID NO: 158001 - DNA, 25 bp, Mus musculus
aaagaccttgagccaaagccctgtt

SEQ ID NO: 158002 - DNA, 25 bp, Mus musculus
aaagaccttgagttgctggaactgt

SEQ ID NO: 158003 - DNA, 25 bp, Mus musculus
aaagaccttgattcagatggtccag

SEQ ID NO: 158004 - DNA, 25 bp, Mus musculus
aaagacgaaagaatcctgtggaaga

SEQ ID NO: 158005 - DNA, 25 bp, Mus musculus
aaagacgaaaggtacctgttgttct

SEQ ID NO: 158006 - DNA, 25 bp, Mus musculus
aaagacgaactaggtcctgtgccat

SEQ ID NO: 158007 - DNA, 25 bp, Mus musculus
aaagacgaattacctattgaagtgg

SEQ ID NO: 158008 - DNA, 25 bp, Mus musculus
aaagacgaggagtggttccgatcta

SEQ ID NO: 158009 - DNA, 25 bp, Mus musculus
aaagacgatgaggagaaagaaaaga

SEQ ID NO: 158010 - DNA, 25 bp, Mus musculus
aaagacgcaggaaaaggaagaagag

SEQ ID NO: 158011 - DNA, 25 bp, Mus musculus
aaagacggaaagctcatcaagcaat

SEQ ID NO: 158012 - DNA, 25 bp, Mus musculus
aaagacggaaaggagagatctgtag

SEQ ID NO: 158013 - DNA, 25 bp, Mus musculus
aaagacggaaggactggaaatggca

SEQ ID NO: 158014 - DNA, 25 bp, Mus musculus
aaagacgtaagttgaagatgtgatg

SEQ ID NO: 158015 - DNA, 25 bp, Mus musculus
aaagactaaggcagggcctagtaac

SEQ ID NO: 158016 - DNA, 25 bp, Mus musculus
aaagactatcatgttccaagatgcc

SEQ ID NO: 158017 - DNA, 25 bp, Mus musculus
aaagactatcatttatttccgagag

SEQ ID NO: 158018 - DNA, 25 bp, Mus musculus
aaagactcaaagagcaacttgattt

SEQ ID NO: 158019 - DNA, 25 bp, Mus musculus
aaagactcccaggagattaccaagg

SEQ ID NO: 158020 - DNA, 25 bp, Mus musculus
aaagactcccaggagttgaccctgg

SEQ ID NO: 158021 - DNA, 25 bp, Mus musculus
aaagactctaggatcaagtgagctg

SEQ ID NO: 158022 - DNA, 25 bp, Mus musculus
aaagactctagtctttcaggttcca

SEQ ID NO: 158023 - DNA, 25 bp, Mus musculus
aaagactctgtcggggctggtgaga

SEQ ID NO: 158024 - DNA, 25 bp, Mus musculus
aaagactgcaaagaggctgatttat

SEQ ID NO: 158025 - DNA, 25 bp, Mus musculus
aaagactgcagagaacttcagagcc

SEQ ID NO: 158026 - DNA, 25 bp, Mus musculus
aaagactgcagcaaatgaagctggt

SEQ ID NO: 158027 - DNA, 25 bp, Mus musculus
aaagactgcaggaagaaagtctgca

SEQ ID NO: 158028 - DNA, 25 bp, Mus musculus
aaagactgcaggaagcttgggatcc

SEQ ID NO: 158029 - DNA, 25 bp, Mus musculus
aaagactggagagaagctgaagaag

SEQ ID NO: 158030 - DNA, 25 bp, Mus musculus
aaagactgtaccaggcccagtctgt

SEQ ID NO: 158031 - DNA, 25 bp, Mus musculus
aaagactgtaccagggccacaccct

SEQ ID NO: 158032 - DNA, 25 bp, Mus musculus
aaagactgtaccagtgacttcaatg

SEQ ID NO: 158033 - DNA, 25 bp, Mus musculus
aaagacttaggaagaagactacgag

SEQ ID NO: 158034 - DNA, 25 bp, Mus musculus
aaagacttaggtgggtcggtgatcg

SEQ ID NO: 158035 - DNA, 25 bp, Mus musculus
aaagagaaaacaggcatgtaatgaa

SEQ ID NO: 158036 - DNA, 25 bp, Mus musculus
aaagagaaaacaggtctcagcatca

SEQ ID NO: 158037 - DNA, 25 bp, Mus musculus
aaagagaaaaggtctttcgcacctt

SEQ ID NO: 158038 - DNA, 25 bp, Mus musculus
aaagagaaaagtgttaatggccagc

SEQ ID NO: 158039 - DNA, 25 bp, Mus musculus
aaagagaaagaaaaatttcctatct

SEQ ID NO: 158040 - DNA, 25 bp, Mus musculus
aaagagaaagggaaaaactctcaca

SEQ ID NO: 158041 - DNA, 25 bp, Mus musculus
aaagagaaaggtattaagtcatgat

SEQ ID NO: 158042 - DNA, 25 bp, Mus musculus
aaagagaaaggtgttgacctgaatg

SEQ ID NO: 158043 - DNA, 25 bp, Mus musculus
aaagagaaagtgtttatgggaccgt

SEQ ID NO: 158044 - DNA, 25 bp, Mus musculus
aaagagaaatcaagggcttaaggaa

SEQ ID NO: 158045 - DNA, 25 bp, Mus musculus
aaagagaaatcaagtttgcttttcc

SEQ ID NO: 158046 - DNA, 25 bp, Mus musculus
aaagagaaatggattccctgctaac

SEQ ID NO: 158047 - DNA, 25 bp, Mus musculus
aaagagaacgcctcaaagagttgct

SEQ ID NO: 158048 - DNA, 25 bp, Mus musculus
aaagagaacggccctacccacaggt

SEQ ID NO: 158049 - DNA, 25 bp, Mus musculus
aaagagaacttggtctctgggccag

SEQ ID NO: 158050 - DNA, 25 bp, Mus musculus
aaagagaagaagaataacccatggc

SEQ ID NO: 158051 - DNA, 25 bp, Mus musculus
aaagagaagaagaattaactctgct

SEQ ID NO: 158052 - DNA, 25 bp, Mus musculus
aaagagaagaagaatttgggcttcc

SEQ ID NO: 158053 - DNA, 25 bp, Mus musculus
aaagagaagatccagggcttggacc

SEQ ID NO: 158054 - DNA, 25 bp, Mus musculus
aaagagaagcagcttgtgaaaaagc

SEQ ID NO: 158055 - DNA, 25 bp, Mus musculus
aaagagaagcagtgaacttatttct

SEQ ID NO: 158056 - DNA, 25 bp, Mus musculus
aaagagaagctgttgcaggaagagg

SEQ ID NO: 158057 - DNA, 25 bp, Mus musculus
aaagagaaggatgcatcttcctggt

SEQ ID NO: 158058 - DNA, 25 bp, Mus musculus
aaagagaaggatggcatccccatca

SEQ ID NO: 158059 - DNA, 25 bp, Mus musculus
aaagagaagggcagtgttgctgaag

SEQ ID NO: 158060 - DNA, 25 bp, Mus musculus
aaagagaataaatggcttgttggca

SEQ ID NO: 158061 - DNA, 25 bp, Mus musculus
aaagagaatgatagcttggagattt

SEQ ID NO: 158062 - DNA, 25 bp, Mus musculus
aaagagacaaaaaagagttgatcaa

SEQ ID NO: 158063 - DNA, 25 bp, Mus musculus
aaagagacaggacctgatagatgag

SEQ ID NO: 158064 - DNA, 25 bp, Mus musculus
aaagagacagtgcattctgtgagtg

SEQ ID NO: 158065 - DNA, 25 bp, Mus musculus
aaagagacagtgtgggacttctgct

SEQ ID NO: 158066 - DNA, 25 bp, Mus musculus
aaagagacgggaaaagaaggctgca

SEQ ID NO: 158067 - DNA, 25 bp, Mus musculus
aaagagacgggatcttatcctgtag

SEQ ID NO: 158068 - DNA, 25 bp, Mus musculus
aaagagactaaaagatatggaggga

SEQ ID NO: 158069 - DNA, 25 bp, Mus musculus
aaagagactaaaagtgctgaagagg

SEQ ID NO: 158070 - DNA, 25 bp, Mus musculus
aaagagactgctggtgacaagggag

SEQ ID NO: 158071 - DNA, 25 bp, Mus musculus
aaagagactgttgtaacagttggag

SEQ ID NO: 158072 - DNA, 25 bp, Mus musculus
aaagagactttcaggctgtggacct

SEQ ID NO: 158073 - DNA, 25 bp, Mus musculus
aaagagactttcaggttccagctgt

SEQ ID NO: 158074 - DNA, 25 bp, Mus musculus
aaagagagaaggggaacagccagag

SEQ ID NO: 158075 - DNA, 25 bp, Mus musculus
aaagagagagaggtacctgtgtcgt

SEQ ID NO: 158076 - DNA, 25 bp, Mus musculus
aaagagagagcaaggttgtagttcc

SEQ ID NO: 158077 - DNA, 25 bp, Mus musculus
aaagagagcaaacctgtcattctgt

SEQ ID NO: 158078 - DNA, 25 bp, Mus musculus
aaagagagcaaagctgtcattctgt

SEQ ID NO: 158079 - DNA, 25 bp, Mus musculus
aaagagagccaaatctgccaaggca

SEQ ID NO: 158080 - DNA, 25 bp, Mus musculus
aaagagaggaagcatcaacaccccc

SEQ ID NO: 158081 - DNA, 25 bp, Mus musculus
aaagagaggaagtaaaactcaaaag

SEQ ID NO: 158082 - DNA, 25 bp, Mus musculus
aaagagaggaggcgcaggcaggggt

SEQ ID NO: 158083 - DNA, 25 bp, Mus musculus
aaagagagggggtccactgcgtctc

SEQ ID NO: 158084 - DNA, 25 bp, Mus musculus
aaagagaggtgaaacggaaggtgga

SEQ ID NO: 158085 - DNA, 25 bp, Mus musculus
aaagagaggtgaggaagaccctgga

SEQ ID NO: 158086 - DNA, 25 bp, Mus musculus
aaagagaggtgccggcctccgccca

SEQ ID NO: 158087 - DNA, 25 bp, Mus musculus
aaagagagtgccaggaaatagcctt

SEQ ID NO: 158088 - DNA, 25 bp, Mus musculus
aaagagagtgccaggctttggggac

SEQ ID NO: 158089 - DNA, 25 bp, Mus musculus
aaagagagtgtaatccacctaactc

SEQ ID NO: 158090 - DNA, 25 bp, Mus musculus
aaagagatacaaacggtctccctgc

SEQ ID NO: 158091 - DNA, 25 bp, Mus musculus
aaagagatatctcagaaagtgtcac

SEQ ID NO: 158092 - DNA, 25 bp, Mus musculus
aaagagatgaaggactcgctggccg

SEQ ID NO: 158093 - DNA, 25 bp, Mus musculus
aaagagatgagtaagctcaatcaga

SEQ ID NO: 158094 - DNA, 25 bp, Mus musculus
aaagagatggagtcatgcacttctg

SEQ ID NO: 158095 - DNA, 25 bp, Mus musculus
aaagagattgagcaggtttaccgac

SEQ ID NO: 158096 - DNA, 25 bp, Mus musculus
aaagagattgcaaggtacaaaagaa

SEQ ID NO: 158097 - DNA, 25 bp, Mus musculus
aaagagattgcaagttctgattcaa

SEQ ID NO: 158098 - DNA, 25 bp, Mus musculus
aaagagatttctattctctacattt

SEQ ID NO: 158099 - DNA, 25 bp, Mus musculus
aaagagatttctgctgaatgtggga

SEQ ID NO: 158100 - DNA, 25 bp, Mus musculus
aaagagcaaaaacatagccaaggac

SEQ ID NO: 158101 - DNA, 25 bp, Mus musculus
aaagagcacttttgagcacaagtgc

SEQ ID NO: 158102 - DNA, 25 bp, Mus musculus
aaagagcacttttggactacattgc

SEQ ID NO: 158103 - DNA, 25 bp, Mus musculus
aaagagcagcaatgttaagtcttct

SEQ ID NO: 158104 - DNA, 25 bp, Mus musculus
aaagagcaggagctgacattcacac

SEQ ID NO: 158105 - DNA, 25 bp, Mus musculus
aaagagcaggagctgtctgaggagg

SEQ ID NO: 158106 - DNA, 25 bp, Mus musculus
aaagagcatgggaagcaaatgaaga

SEQ ID NO: 158107 - DNA, 25 bp, Mus musculus
aaagagccaaacgagccacaatcat

SEQ ID NO: 158108 - DNA, 25 bp, Mus musculus
aaagagccaagaaggtaaggcgagt

SEQ ID NO: 158109 - DNA, 25 bp, Mus musculus
aaagagccaatggaccttgccacca

SEQ ID NO: 158110 - DNA, 25 bp, Mus musculus
aaagagccaatgggtctcataacaa

SEQ ID NO: 158111 - DNA, 25 bp, Mus musculus
aaagagccacctcaggatggtagag

SEQ ID NO: 158112 - DNA, 25 bp, Mus musculus
aaagagccagaaaagagctggacta

SEQ ID NO: 158113 - DNA, 25 bp, Mus musculus
aaagagccagttccaagaattaccc

SEQ ID NO: 158114 - DNA, 25 bp, Mus musculus
aaagagcccagcaaaggaagccacc

SEQ ID NO: 158115 - DNA, 25 bp, Mus musculus
aaagagccgtgagccagcttcacct

SEQ ID NO: 158116 - DNA, 25 bp, Mus musculus
aaagagcctccagggacagtgtctt

SEQ ID NO: 158117 - DNA, 25 bp, Mus musculus
aaagagcctgaaggaagagagatat

SEQ ID NO: 158118 - DNA, 25 bp, Mus musculus
aaagagcctgaaggttaaaatgagc

SEQ ID NO: 158119 - DNA, 25 bp, Mus musculus
aaagagcgagtcgaattggcagagg

SEQ ID NO: 158120 - DNA, 25 bp, Mus musculus
aaagagcgcgcgatttctaacgagc

SEQ ID NO: 158121 - DNA, 25 bp, Mus musculus
aaagagcgcgcgtggaaagaagaaa

SEQ ID NO: 158122 - DNA, 25 bp, Mus musculus
aaagagcggagcagattgaggacat

SEQ ID NO: 158123 - DNA, 25 bp, Mus musculus
aaagagcggagcaggaaggagatga

SEQ ID NO: 158124 - DNA, 25 bp, Mus musculus
aaagagcggaggccaacaccctgca

SEQ ID NO: 158125 - DNA, 25 bp, Mus musculus
aaagagctcaaggatgcaggagctg

SEQ ID NO: 158126 - DNA, 25 bp, Mus musculus
aaagagctgaggatcatctgtccct

SEQ ID NO: 158127 - DNA, 25 bp, Mus musculus
aaagagctgggtctctccagtgttc

SEQ ID NO: 158128 - DNA, 25 bp, Mus musculus
aaagagctgtcagggacggtcaaga

SEQ ID NO: 158129 - DNA, 25 bp, Mus musculus
aaagagcttacataggtccccttcc

SEQ ID NO: 158130 - DNA, 25 bp, Mus musculus
aaagagcttacatagtgcaactaca

SEQ ID NO: 158131 - DNA, 25 bp, Mus musculus
aaagagcttgagttcatcacgctga

SEQ ID NO: 158132 - DNA, 25 bp, Mus musculus
aaagaggaaaagagtgtttgagcac

SEQ ID NO: 158133 - DNA, 25 bp, Mus musculus
aaagaggaaaggagttctctgaacg

SEQ ID NO: 158134 - DNA, 25 bp, Mus musculus
aaagaggaaatcagtgttgaagatg

SEQ ID NO: 158135 - DNA, 25 bp, Mus musculus
aaagaggaaatggagcctgtgacct

SEQ ID NO: 158136 - DNA, 25 bp, Mus musculus
aaagaggagaaagggaagaaggcag

SEQ ID NO: 158137 - DNA, 25 bp, Mus musculus
aaagaggagaagagcagccagcacc

SEQ ID NO: 158138 - DNA, 25 bp, Mus musculus
aaagaggagaagagggtccacctgg

SEQ ID NO: 158139 - DNA, 25 bp, Mus musculus
aaagaggagagaagcagaaaaaaaa

SEQ ID NO: 158140 - DNA, 25 bp, Mus musculus
aaagaggagagccaggttctcgagg

SEQ ID NO: 158141 - DNA, 25 bp, Mus musculus
aaagaggagcagggcttctattttg

SEQ ID NO: 158142 - DNA, 25 bp, Mus musculus
aaagaggagcagtaaaagctggcag

SEQ ID NO: 158143 - DNA, 25 bp, Mus musculus
aaagaggcacagatcttagatgagt

SEQ ID NO: 158144 - DNA, 25 bp, Mus musculus
aaagaggccctggaagaagaaaggc

SEQ ID NO: 158145 - DNA, 25 bp, Mus musculus
aaagagggacgatgggtgatctaca

SEQ ID NO: 158146 - DNA, 25 bp, Mus musculus
aaagagggacggataccaagctaaa

SEQ ID NO: 158147 - DNA, 25 bp, Mus musculus
aaagagggagtagaggaacattgac

SEQ ID NO: 158148 - DNA, 25 bp, Mus musculus
aaagagggagtcggttctggccgag

SEQ ID NO: 158149 - DNA, 25 bp, Mus musculus
aaagagggatatcaagtttgcttgt

SEQ ID NO: 158150 - DNA, 25 bp, Mus musculus
aaagagggtgaagaaactgaaggct

SEQ ID NO: 158151 - DNA, 25 bp, Mus musculus
aaagaggtcttggtccacagatgag

SEQ ID NO: 158152 - DNA, 25 bp, Mus musculus
aaagaggtgaagcagaatgatatgg

SEQ ID NO: 158153 - DNA, 25 bp, Mus musculus
aaagaggtgcaggcggctggaggaa

SEQ ID NO: 158154 - DNA, 25 bp, Mus musculus
aaagaggtgcaggctggttcgagcc

SEQ ID NO: 158155 - DNA, 25 bp, Mus musculus
aaagagtcagacatttacattgttg

SEQ ID NO: 158156 - DNA, 25 bp, Mus musculus
aaagagtctgaggatcctaaacact

SEQ ID NO: 158157 - DNA, 25 bp, Mus musculus
aaagagtctgtgctgcaggctgtga

SEQ ID NO: 158158 - DNA, 25 bp, Mus musculus
aaagagtgaaggcttcagatgctag

SEQ ID NO: 158159 - DNA, 25 bp, Mus musculus
aaagagtgagttggcttcagctgtt

SEQ ID NO: 158160 - DNA, 25 bp, Mus musculus
aaagagtgcagcatcgccctgagca

SEQ ID NO: 158161 - DNA, 25 bp, Mus musculus
aaagagtgcagttttggttctaaca

SEQ ID NO: 158162 - DNA, 25 bp, Mus musculus
aaagagtggcggaacatgaagttcc

SEQ ID NO: 158163 - DNA, 25 bp, Mus musculus
aaagagtggcggtcctggagtttga

SEQ ID NO: 158164 - DNA, 25 bp, Mus musculus
aaagagtgtcctagaatcaataagc

SEQ ID NO: 158165 - DNA, 25 bp, Mus musculus
aaagagtgtcttaggttcttgtagt

SEQ ID NO: 158166 - DNA, 25 bp, Mus musculus
aaagagttggcaggaatagtgggca

SEQ ID NO: 158167 - DNA, 25 bp, Mus musculus
aaagataaaaaaggctgcctcacca

SEQ ID NO: 158168 - DNA, 25 bp, Mus musculus
aaagataaagagggctacacatctt

SEQ ID NO: 158169 - DNA, 25 bp, Mus musculus
aaagataaaggagcgaatccgtaat

SEQ ID NO: 158170 - DNA, 25 bp, Mus musculus
aaagataacccggcactgaatgcac

SEQ ID NO: 158171 - DNA, 25 bp, Mus musculus
aaagataaggagcagaatgagaaga

SEQ ID NO: 158172 - DNA, 25 bp, Mus musculus
aaagataatcagattataccgaaaa

SEQ ID NO: 158173 - DNA, 25 bp, Mus musculus
aaagataatcagccgtggggccaat

SEQ ID NO: 158174 - DNA, 25 bp, Mus musculus
aaagataccaagctaatgagcgagt

SEQ ID NO: 158175 - DNA, 25 bp, Mus musculus
aaagatacccaagagccagaaactc

SEQ ID NO: 158176 - DNA, 25 bp, Mus musculus
aaagatacgaaggaagaagttctaa

SEQ ID NO: 158177 - DNA, 25 bp, Mus musculus
aaagatacgaagtgatgtcctggtg

SEQ ID NO: 158178 - DNA, 25 bp, Mus musculus
aaagatactctcagagatgctggag

SEQ ID NO: 158179 - DNA, 25 bp, Mus musculus
aaagatacttccaatcacttccatg

SEQ ID NO: 158180 - DNA, 25 bp, Mus musculus
aaagatacttgcaagggtgactcag

SEQ ID NO: 158181 - DNA, 25 bp, Mus musculus
aaagataggcctgagacttccttac

SEQ ID NO: 158182 - DNA, 25 bp, Mus musculus
aaagatagtaacaggagactgaagt

SEQ ID NO: 158183 - DNA, 25 bp, Mus musculus
aaagatatccttttggataagcctg

SEQ ID NO: 158184 - DNA, 25 bp, Mus musculus
aaagatattcaggtccttaaaattc

SEQ ID NO: 158185 - DNA, 25 bp, Mus musculus
aaagatattccagcctcactgcagt

SEQ ID NO: 158186 - DNA, 25 bp, Mus musculus
aaagatcaagggtgacaggaaagca

SEQ ID NO: 158187 - DNA, 25 bp, Mus musculus
aaagatcaaggtgatctacgttgcc

SEQ ID NO: 158188 - DNA, 25 bp, Mus musculus
aaagatcaatggacagctcggctcc

SEQ ID NO: 158189 - DNA, 25 bp, Mus musculus
aaagatcaatgggcagcagcaatga

SEQ ID NO: 158190 - DNA, 25 bp, Mus musculus
aaagatcaggggctggaaaacgaga

SEQ ID NO: 158191 - DNA, 25 bp, Mus musculus
aaagatcatgagacagaacttctgt

SEQ ID NO: 158192 - DNA, 25 bp, Mus musculus
aaagatcctttcaggagcccagctc

SEQ ID NO: 158193 - DNA, 25 bp, Mus musculus
aaagatcctttcaggtgctgtagga

SEQ ID NO: 158194 - DNA, 25 bp, Mus musculus
aaagatctctggaagggtttctctg

SEQ ID NO: 158195 - DNA, 25 bp, Mus musculus
aaagatctctggaaggtgagcctca

SEQ ID NO: 158196 - DNA, 25 bp, Mus musculus
aaagatctctgtacgcatgtgacac

SEQ ID NO: 158197 - DNA, 25 bp, Mus musculus
aaagatctgcaaaatcatggaccag

SEQ ID NO: 158198 - DNA, 25 bp, Mus musculus
aaagatctgtgaagttcattcaaaa

SEQ ID NO: 158199 - DNA, 25 bp, Mus musculus
aaagatctgttttagcaatcccaca

SEQ ID NO: 158200 - DNA, 25 bp, Mus musculus
aaagatgaacagcaattatagtgaa

SEQ ID NO: 158201 - DNA, 25 bp, Mus musculus
aaagatgaacatctcagcggttcta

SEQ ID NO: 158202 - DNA, 25 bp, Mus musculus
aaagatgaagacagggaacagacat

SEQ ID NO: 158203 - DNA, 25 bp, Mus musculus
aaagatgaagacagttcagagtgca

SEQ ID NO: 158204 - DNA, 25 bp, Mus musculus
aaagatgaaggagcttcatatggct

SEQ ID NO: 158205 - DNA, 25 bp, Mus musculus
aaagatgaaggggatggtaataacc

SEQ ID NO: 158206 - DNA, 25 bp, Mus musculus
aaagatgaatatgaaaaggtggaca

SEQ ID NO: 158207 - DNA, 25 bp, Mus musculus
aaagatgaatttcagactctgaatt

SEQ ID NO: 158208 - DNA, 25 bp, Mus musculus
aaagatgacaaccccaagcatccaa

SEQ ID NO: 158209 - DNA, 25 bp, Mus musculus
aaagatgacaagttgaccccaaaga

SEQ ID NO: 158210 - DNA, 25 bp, Mus musculus
aaagatgacaatgggggtgaagctt

SEQ ID NO: 158211 - DNA, 25 bp, Mus musculus
aaagatgacagcaaaaatgtatttg

SEQ ID NO: 158212 - DNA, 25 bp, Mus musculus
aaagatgacagcaaacataaaggta

SEQ ID NO: 158213 - DNA, 25 bp, Mus musculus
aaagatgacagtgaacgtcctgttt

SEQ ID NO: 158214 - DNA, 25 bp, Mus musculus
aaagatgacccaggagttgcaagca

SEQ ID NO: 158215 - DNA, 25 bp, Mus musculus
aaagatgacctaggaaacacactgg

SEQ ID NO: 158216 - DNA, 25 bp, Mus musculus
aaagatgactgccttgggctggtga

SEQ ID NO: 158217 - DNA, 25 bp, Mus musculus
aaagatgagaatgcacctgtctgct

SEQ ID NO: 158218 - DNA, 25 bp, Mus musculus
aaagatgagatcctgggcaacttca

SEQ ID NO: 158219 - DNA, 25 bp, Mus musculus
aaagatgagctggatccagccatat

SEQ ID NO: 158220 - DNA, 25 bp, Mus musculus
aaagatgatggctgagatccggggt

SEQ ID NO: 158221 - DNA, 25 bp, Mus musculus
aaagatgcagctttgcagaaacccg

SEQ ID NO: 158222 - DNA, 25 bp, Mus musculus
aaagatgcaggaacctccttctcag

SEQ ID NO: 158223 - DNA, 25 bp, Mus musculus
aaagatggaagaagccctctgggcg

SEQ ID NO: 158224 - DNA, 25 bp, Mus musculus
aaagatgtaactgcttggacccttc

SEQ ID NO: 158225 - DNA, 25 bp, Mus musculus
aaagatgtacagctgggtccttggc

SEQ ID NO: 158226 - DNA, 25 bp, Mus musculus
aaagatgtacaggggtggcaaaata

SEQ ID NO: 158227 - DNA, 25 bp, Mus musculus
aaagatgtcagtgctctcttccctg

SEQ ID NO: 158228 - DNA, 25 bp, Mus musculus
aaagatgtcctcggtgactcagaag

SEQ ID NO: 158229 - DNA, 25 bp, Mus musculus
aaagatgtgccagaaacagaaggga

SEQ ID NO: 158230 - DNA, 25 bp, Mus musculus
aaagatgttaggggagcttctggag

SEQ ID NO: 158231 - DNA, 25 bp, Mus musculus
aaagatgtttccaggagccctgaca

SEQ ID NO: 158232 - DNA, 25 bp, Mus musculus
aaagattaaatttccaaggcccgag

SEQ ID NO: 158233 - DNA, 25 bp, Mus musculus
aaagattaaggagctatcgaagaac

SEQ ID NO: 158234 - DNA, 25 bp, Mus musculus
aaagattaaggtacacaggtttctg

SEQ ID NO: 158235 - DNA, 25 bp, Mus musculus
aaagattaagttgctcaggaaaccg

SEQ ID NO: 158236 - DNA, 25 bp, Mus musculus
aaagattcaagaacttggggacatc

SEQ ID NO: 158237 - DNA, 25 bp, Mus musculus
aaagattcaaggaagcctggggggg

SEQ ID NO: 158238 - DNA, 25 bp, Mus musculus
aaagattcagaaagattccaggttg

SEQ ID NO: 158239 - DNA, 25 bp, Mus musculus
aaagattcaggctggacaatttgct

SEQ ID NO: 158240 - DNA, 25 bp, Mus musculus
aaagattcaggttctccccaatcac

SEQ ID NO: 158241 - DNA, 25 bp, Mus musculus
aaagattcctgccagggtgactctg

SEQ ID NO: 158242 - DNA, 25 bp, Mus musculus
aaagattcctgccaggtgactctgg

SEQ ID NO: 158243 - DNA, 25 bp, Mus musculus
aaagattgctgctagagcatggaaa

SEQ ID NO: 158244 - DNA, 25 bp, Mus musculus
aaagattggaaggagacttcaaaag

SEQ ID NO: 158245 - DNA, 25 bp, Mus musculus
aaagattggaaggtattcccatctg

SEQ ID NO: 158246 - DNA, 25 bp, Mus musculus
aaagattggaagtggttctgtgtat

SEQ ID NO: 158247 - DNA, 25 bp, Mus musculus
aaagattggaagttcctgtggaaga

SEQ ID NO: 158248 - DNA, 25 bp, Mus musculus
aaagattgtgtgctgttccacctcc

SEQ ID NO: 158249 - DNA, 25 bp, Mus musculus
aaagatttctgaaaattaatgagtt

SEQ ID NO: 158250 - DNA, 25 bp, Mus musculus
aaagatttctggggtgatgactaca

SEQ ID NO: 158251 - DNA, 25 bp, Mus musculus
aaagatttctgttttggtcgtgtgg

SEQ ID NO: 158252 - DNA, 25 bp, Mus musculus
aaagattttttcagtattggaaaag

SEQ ID NO: 158253 - DNA, 25 bp, Mus musculus
aaagcaaaaacacagaatctgctgg

SEQ ID NO: 158254 - DNA, 25 bp, Mus musculus
aaagcaaaaacacaggcagagctca

SEQ ID NO: 158255 - DNA, 25 bp, Mus musculus
aaagcaaaaaccatgccttttgcct

SEQ ID NO: 158256 - DNA, 25 bp, Mus musculus
aaagcaaaaaccatgtgtgagtgtt

SEQ ID NO: 158257 - DNA, 25 bp, Mus musculus
aaagcaaaacagggagccacccaag

SEQ ID NO: 158258 - DNA, 25 bp, Mus musculus
aaagcaaaagaggagtggttccatc

SEQ ID NO: 158259 - DNA, 25 bp, Mus musculus
aaagcaaaagggaagaaggatgcag

SEQ ID NO: 158260 - DNA, 25 bp, Mus musculus
aaagcaaagagtcttatcagctgca

SEQ ID NO: 158261 - DNA, 25 bp, Mus musculus
aaagcaaagatcattgcttgtcttt

SEQ ID NO: 158262 - DNA, 25 bp, Mus musculus
aaagcaaagtggccaaagtgaggac

SEQ ID NO: 158263 - DNA, 25 bp, Mus musculus
aaagcaaatatgcaacacagatatg

SEQ ID NO: 158264 - DNA, 25 bp, Mus musculus
aaagcaacagagagtgcactgacct

SEQ ID NO: 158265 - DNA, 25 bp, Mus musculus
aaagcaacagagttcttgcctctcg

SEQ ID NO: 158266 - DNA, 25 bp, Mus musculus
aaagcaacaggaactttgcatcatg

SEQ ID NO: 158267 - DNA, 25 bp, Mus musculus
aaagcaacagggatgaagtacaact

SEQ ID NO: 158268 - DNA, 25 bp, Mus musculus
aaagcaacaggtggaccgtacggat

SEQ ID NO: 158269 - DNA, 25 bp, Mus musculus
aaagcaacaggtttcagatagaaga

SEQ ID NO: 158270 - DNA, 25 bp, Mus musculus
aaagcaacatcacagcaaagtctcg

SEQ ID NO: 158271 - DNA, 25 bp, Mus musculus
aaagcaacatcacaggtggtagcag

SEQ ID NO: 158272 - DNA, 25 bp, Mus musculus
aaagcaacatcacagttcatagcca

SEQ ID NO: 158273 - DNA, 25 bp, Mus musculus
aaagcaacgaaagatgtgatacaaa

SEQ ID NO: 158274 - DNA, 25 bp, Mus musculus
aaagcaacgaaagctcctgcaaagc

SEQ ID NO: 158275 - DNA, 25 bp, Mus musculus
aaagcaacggccctgattgaagata

SEQ ID NO: 158276 - DNA, 25 bp, Mus musculus
aaagcaactggatgaactgcttggt

SEQ ID NO: 158277 - DNA, 25 bp, Mus musculus
aaagcaactgtggaagaatttgagc

SEQ ID NO: 158278 - DNA, 25 bp, Mus musculus
aaagcaactttttctgctaatgcct

SEQ ID NO: 158279 - DNA, 25 bp, Mus musculus
aaagcaagaaggacctagaccgcga

SEQ ID NO: 158280 - DNA, 25 bp, Mus musculus
aaagcaagaagggtcttgttgcagc

SEQ ID NO: 158281 - DNA, 25 bp, Mus musculus
aaagcaagagattcgagtaagagta

SEQ ID NO: 158282 - DNA, 25 bp, Mus musculus
aaagcaagcaagcagacttgtcctt

SEQ ID NO: 158283 - DNA, 25 bp, Mus musculus
aaagcaaggaggggctgagaaaata

SEQ ID NO: 158284 - DNA, 25 bp, Mus musculus
aaagcaagtcagatgaatggaaact

SEQ ID NO: 158285 - DNA, 25 bp, Mus musculus
aaagcaagtgccaattcctgaatgc

SEQ ID NO: 158286 - DNA, 25 bp, Mus musculus
aaagcaattctggatatgctctcca

SEQ ID NO: 158287 - DNA, 25 bp, Mus musculus
aaagcaattgcctgtaccccagtag

SEQ ID NO: 158288 - DNA, 25 bp, Mus musculus
aaagcacagaaggaacagattctgg

SEQ ID NO: 158289 - DNA, 25 bp, Mus musculus
aaagcacagcaactttctccggctg

SEQ ID NO: 158290 - DNA, 25 bp, Mus musculus
aaagcacatgagctgggctgtagca

SEQ ID NO: 158291 - DNA, 25 bp, Mus musculus
aaagcaccaaagcttcgcataagga

SEQ ID NO: 158292 - DNA, 25 bp, Mus musculus
aaagcaccaaagtaccatttaggtc

SEQ ID NO: 158293 - DNA, 25 bp, Mus musculus
aaagcaccagcaccaggtcttcgat

SEQ ID NO: 158294 - DNA, 25 bp, Mus musculus
aaagcaccagcccacctaaaccaac

SEQ ID NO: 158295 - DNA, 25 bp, Mus musculus
aaagcaccaggtccccggcgctact

SEQ ID NO: 158296 - DNA, 25 bp, Mus musculus
aaagcacccagttaaatcatcgggt

SEQ ID NO: 158297 - DNA, 25 bp, Mus musculus
aaagcaccgaggcaaatacctcgct

SEQ ID NO: 158298 - DNA, 25 bp, Mus musculus
aaagcaccgaggcaaatcctggatg

SEQ ID NO: 158299 - DNA, 25 bp, Mus musculus
aaagcaccgaggcaatctacgggct

SEQ ID NO: 158300 - DNA, 25 bp, Mus musculus
aaagcaccgcaggtatcagcctagc

SEQ ID NO: 158301 - DNA, 25 bp, Mus musculus
aaagcacctcctgattccactgtat

SEQ ID NO: 158302 - DNA, 25 bp, Mus musculus
aaagcacctttctcagtacattcgc

SEQ ID NO: 158303 - DNA, 25 bp, Mus musculus
aaagcacgaagcaataagtcctatg

SEQ ID NO: 158304 - DNA, 25 bp, Mus musculus
aaagcacgaggatggatgcgagttc

SEQ ID NO: 158305 - DNA, 25 bp, Mus musculus
aaagcacggggtagtgatccattgt

SEQ ID NO: 158306 - DNA, 25 bp, Mus musculus
aaagcacttatgaaggtccttcagt

SEQ ID NO: 158307 - DNA, 25 bp, Mus musculus
aaagcacttggggccctagagaaac

SEQ ID NO: 158308 - DNA, 25 bp, Mus musculus
aaagcagaaatttacctaaagcctt

SEQ ID NO: 158309 - DNA, 25 bp, Mus musculus
aaagcagaagaaaagactggacaat

SEQ ID NO: 158310 - DNA, 25 bp, Mus musculus
aaagcagaagaaaggggctcgctcc

SEQ ID NO: 158311 - DNA, 25 bp, Mus musculus
aaagcagaagagaatggaagtgagg

SEQ ID NO: 158312 - DNA, 25 bp, Mus musculus
aaagcagaagagtgggacggctgtt

SEQ ID NO: 158313 - DNA, 25 bp, Mus musculus
aaagcagaataccaaccacagccac

SEQ ID NO: 158314 - DNA, 25 bp, Mus musculus
aaagcagacagaatttcagcatatg

SEQ ID NO: 158315 - DNA, 25 bp, Mus musculus
aaagcagacaggttcagctcctaat

SEQ ID NO: 158316 - DNA, 25 bp, Mus musculus
aaagcagaccagccctagtcgaggg

SEQ ID NO: 158317 - DNA, 25 bp, Mus musculus
aaagcagacccgggcagatatcaag

SEQ ID NO: 158318 - DNA, 25 bp, Mus musculus
aaagcagagaagagtgtagctgcaa

SEQ ID NO: 158319 - DNA, 25 bp, Mus musculus
aaagcagagaatggagcctgtgacc

SEQ ID NO: 158320 - DNA, 25 bp, Mus musculus
aaagcagagaatgtggacatctcgt

SEQ ID NO: 158321 - DNA, 25 bp, Mus musculus
aaagcagagacaaattgaacaagaa

SEQ ID NO: 158322 - DNA, 25 bp, Mus musculus
aaagcagaggagactctaacacgtg

SEQ ID NO: 158323 - DNA, 25 bp, Mus musculus
aaagcagatgctcagcaaccagacc

SEQ ID NO: 158324 - DNA, 25 bp, Mus musculus
aaagcagatttaaagaacccaatat

SEQ ID NO: 158325 - DNA, 25 bp, Mus musculus
aaagcagcaaataaccacattttaa

SEQ ID NO: 158326 - DNA, 25 bp, Mus musculus
aaagcagcaatcccatatgacaaga

SEQ ID NO: 158327 - DNA, 25 bp, Mus musculus
aaagcagcaatggagcttggcatgg

SEQ ID NO: 158328 - DNA, 25 bp, Mus musculus
aaagcagcaatggaggaattttgac

SEQ ID NO: 158329 - DNA, 25 bp, Mus musculus
aaagcagcaatggaggcaggtggaa

SEQ ID NO: 158330 - DNA, 25 bp, Mus musculus
aaagcagcaccaaggaaacgtgtcc

SEQ ID NO: 158331 - DNA, 25 bp, Mus musculus
aaagcagcaccaagtgtgggttgtt

SEQ ID NO: 158332 - DNA, 25 bp, Mus musculus
aaagcagcagatgttcaagtttgga

SEQ ID NO: 158333 - DNA, 25 bp, Mus musculus
aaagcagcaggagcagaccccctgg

SEQ ID NO: 158334 - DNA, 25 bp, Mus musculus
aaagcagccccagagctgaactccc

SEQ ID NO: 158335 - DNA, 25 bp, Mus musculus
aaagcagctgcagaggcattgcatt

SEQ ID NO: 158336 - DNA, 25 bp, Mus musculus
aaagcagctggtcaaccctccctga

SEQ ID NO: 158337 - DNA, 25 bp, Mus musculus
aaagcaggagcccaacttgcaggtg

SEQ ID NO: 158338 - DNA, 25 bp, Mus musculus
aaagcaggtactaaaatggatcgta

SEQ ID NO: 158339 - DNA, 25 bp, Mus musculus
aaagcaggtctgggtattggatggc

SEQ ID NO: 158340 - DNA, 25 bp, Mus musculus
aaagcaggttccagacaatcctcct

SEQ ID NO: 158341 - DNA, 25 bp, Mus musculus
aaagcaggttccagctctcccagga

SEQ ID NO: 158342 - DNA, 25 bp, Mus musculus
aaagcagtcaggatgatgcagctag

SEQ ID NO: 158343 - DNA, 25 bp, Mus musculus
aaagcagtcagggcaatggcagcgc

SEQ ID NO: 158344 - DNA, 25 bp, Mus musculus
aaagcagtccggcatgaggatcgtt

SEQ ID NO: 158345 - DNA, 25 bp, Mus musculus
aaagcagtggtccagggatgaactg

SEQ ID NO: 158346 - DNA, 25 bp, Mus musculus
aaagcagttttgaattacctgaaga

SEQ ID NO: 158347 - DNA, 25 bp, Mus musculus
aaagcagttttgttagttttcatgg

SEQ ID NO: 158348 - DNA, 25 bp, Mus musculus
aaagcataaagaccagtttcccaac

SEQ ID NO: 158349 - DNA, 25 bp, Mus musculus
aaagcataaagatctgggcagtgaa

SEQ ID NO: 158350 - DNA, 25 bp, Mus musculus
aaagcataaaggaacatgcctctgg

SEQ ID NO: 158351 - DNA, 25 bp, Mus musculus
aaagcataagaatgttttgagttta

SEQ ID NO: 158352 - DNA, 25 bp, Mus musculus
aaagcataaggtgactcatattctc

SEQ ID NO: 158353 - DNA, 25 bp, Mus musculus
aaagcatcaggcaagaggcaaagtg

SEQ ID NO: 158354 - DNA, 25 bp, Mus musculus
aaagcatcagttgtgactgtgagct

SEQ ID NO: 158355 - DNA, 25 bp, Mus musculus
aaagcatcatacagaccagagggat

SEQ ID NO: 158356 - DNA, 25 bp, Mus musculus
aaagcatccagtttgtgctcgatga

SEQ ID NO: 158357 - DNA, 25 bp, Mus musculus
aaagcatgaagacgtggccattcgt

SEQ ID NO: 158358 - DNA, 25 bp, Mus musculus
aaagcatgaccccgtggcccttggt

SEQ ID NO: 158359 - DNA, 25 bp, Mus musculus
aaagcatggggacattcaatcctgc

SEQ ID NO: 158360 - DNA, 25 bp, Mus musculus
aaagcattaaagcccagtgcccctt

SEQ ID NO: 158361 - DNA, 25 bp, Mus musculus
aaagcattagaagtcttcccagagt

SEQ ID NO: 158362 - DNA, 25 bp, Mus musculus
aaagcattatgtctggatctcttag

SEQ ID NO: 158363 - DNA, 25 bp, Mus musculus
aaagcattgattaatggaccacaga

SEQ ID NO: 158364 - DNA, 25 bp, Mus musculus
aaagccaaagaaggctcggcgcatc

SEQ ID NO: 158365 - DNA, 25 bp, Mus musculus
aaagccaaagaagtatccgagttcc

SEQ ID NO: 158366 - DNA, 25 bp, Mus musculus
aaagccaaagatgtgtgccaaaacc

SEQ ID NO: 158367 - DNA, 25 bp, Mus musculus
aaagccaaaggtgtgtgccaaaacc

SEQ ID NO: 158368 - DNA, 25 bp, Mus musculus
aaagccaagatctccaagccagcac

SEQ ID NO: 158369 - DNA, 25 bp, Mus musculus
aaagccaagatgtttgaagctagtg

SEQ ID NO: 158370 - DNA, 25 bp, Mus musculus
aaagccaagctggagaaattttcct

SEQ ID NO: 158371 - DNA, 25 bp, Mus musculus
aaagccaatagtaggaattccaggc

SEQ ID NO: 158372 - DNA, 25 bp, Mus musculus
aaagccacaagagataagatgaaag

SEQ ID NO: 158373 - DNA, 25 bp, Mus musculus
aaagccacaagtgcctccaaaacca

SEQ ID NO: 158374 - DNA, 25 bp, Mus musculus
aaagccaccaagatcctgagacatt

SEQ ID NO: 158375 - DNA, 25 bp, Mus musculus
aaagccacccgaatggctgttgatg

SEQ ID NO: 158376 - DNA, 25 bp, Mus musculus
aaagccactgtcagaagagaaaact

SEQ ID NO: 158377 - DNA, 25 bp, Mus musculus
aaagccagaaaaaaaatcagttcga

SEQ ID NO: 158378 - DNA, 25 bp, Mus musculus
aaagccagaaaatcactgtgagcct

SEQ ID NO: 158379 - DNA, 25 bp, Mus musculus
aaagccagaccaggatcaagttact

SEQ ID NO: 158380 - DNA, 25 bp, Mus musculus
aaagccagaccagttccaagaatta

SEQ ID NO: 158381 - DNA, 25 bp, Mus musculus
aaagccagagaaggaaaaggaaaca

SEQ ID NO: 158382 - DNA, 25 bp, Mus musculus
aaagccagagaagtgtgtgacaact

SEQ ID NO: 158383 - DNA, 25 bp, Mus musculus
aaagccagagggagccgtgtgccca

SEQ ID NO: 158384 - DNA, 25 bp, Mus musculus
aaagccagcagaaaccacagatgac

SEQ ID NO: 158385 - DNA, 25 bp, Mus musculus
aaagccagcggaaatggtccttctc

SEQ ID NO: 158386 - DNA, 25 bp, Mus musculus
aaagccagggcggttaaactcactt

SEQ ID NO: 158387 - DNA, 25 bp, Mus musculus
aaagccagtgggaagagcatggagg

SEQ ID NO: 158388 - DNA, 25 bp, Mus musculus
aaagccagtgtgaataaatttgtgg

SEQ ID NO: 158389 - DNA, 25 bp, Mus musculus
aaagccataaagaggaaaccactga

SEQ ID NO: 158390 - DNA, 25 bp, Mus musculus
aaagccataaagaggaaccaggcca

SEQ ID NO: 158391 - DNA, 25 bp, Mus musculus
aaagccatactatgatccctcaaga

SEQ ID NO: 158392 - DNA, 25 bp, Mus musculus
aaagccatcaacgacctagacagag

SEQ ID NO: 158393 - DNA, 25 bp, Mus musculus
aaagccatcaagttgcctgcaggag

SEQ ID NO: 158394 - DNA, 25 bp, Mus musculus
aaagccatcaggaagggatgcggta

SEQ ID NO: 158395 - DNA, 25 bp, Mus musculus
aaagccatcccgagcgagaaatgtc

SEQ ID NO: 158396 - DNA, 25 bp, Mus musculus
aaagccatcccgagggagaaatgtc

SEQ ID NO: 158397 - DNA, 25 bp, Mus musculus
aaagccatgcattggaatttgaact

SEQ ID NO: 158398 - DNA, 25 bp, Mus musculus
aaagccatttacagggggtgatgtg

SEQ ID NO: 158399 - DNA, 25 bp, Mus musculus
aaagccatttacagttgtaacagtt

SEQ ID NO: 158400 - DNA, 25 bp, Mus musculus
aaagcccaagaaatagcagacaaga

SEQ ID NO: 158401 - DNA, 25 bp, Mus musculus
aaagcccaaggacatgggagaagga

SEQ ID NO: 158402 - DNA, 25 bp, Mus musculus
aaagcccaagtggccgcacgaggga

SEQ ID NO: 158403 - DNA, 25 bp, Mus musculus
aaagcccactcagtgaatggcatta

SEQ ID NO: 158404 - DNA, 25 bp, Mus musculus
aaagcccagaaagaactagaagaac

SEQ ID NO: 158405 - DNA, 25 bp, Mus musculus
aaagcccagaaaggatgtataataa

SEQ ID NO: 158406 - DNA, 25 bp, Mus musculus
aaagcccaggtcaaactctggttcc

SEQ ID NO: 158407 - DNA, 25 bp, Mus musculus
aaagcccaggtttaattcagaagtg

SEQ ID NO: 158408 - DNA, 25 bp, Mus musculus
aaagcccatctgggcttttctccag

SEQ ID NO: 158409 - DNA, 25 bp, Mus musculus
aaagcccattatctccagcctgcta

SEQ ID NO: 158410 - DNA, 25 bp, Mus musculus
aaagcccattcaaccatggatgtgt

SEQ ID NO: 158411 - DNA, 25 bp, Mus musculus
aaagcccctggggtgtccgatccgt

SEQ ID NO: 158412 - DNA, 25 bp, Mus musculus
aaagcccgggtaacatccggatatg

SEQ ID NO: 158413 - DNA, 25 bp, Mus musculus
aaagccctcaagaaactccggagtg

SEQ ID NO: 158414 - DNA, 25 bp, Mus musculus
aaagccctccaagaaagataaactc

SEQ ID NO: 158415 - DNA, 25 bp, Mus musculus
aaagccctgaaggcactaagtgacc

SEQ ID NO: 158416 - DNA, 25 bp, Mus musculus
aaagccctgggcttgaagaaccagt

SEQ ID NO: 158417 - DNA, 25 bp, Mus musculus
aaagccgaagagtgtaggcttgtga

SEQ ID NO: 158418 - DNA, 25 bp, Mus musculus
aaagccgaaggtcctggttatggct

SEQ ID NO: 158419 - DNA, 25 bp, Mus musculus
aaagccgatgctcaggaaaaggtga

SEQ ID NO: 158420 - DNA, 25 bp, Mus musculus
aaagccgatggcttcgggagcaagt

SEQ ID NO: 158421 - DNA, 25 bp, Mus musculus
aaagccggagactcttcctgatccc

SEQ ID NO: 158422 - DNA, 25 bp, Mus musculus
aaagccggagcgtgtttggtgcttt

SEQ ID NO: 158423 - DNA, 25 bp, Mus musculus
aaagccgggtactggaaattggcga

SEQ ID NO: 158424 - DNA, 25 bp, Mus musculus
aaagccgtgcagagcaagccataca

SEQ ID NO: 158425 - DNA, 25 bp, Mus musculus
aaagccgtgcagagcatctactgcc

SEQ ID NO: 158426 - DNA, 25 bp, Mus musculus
aaagcctacaatctgaatgaagaaa

SEQ ID NO: 158427 - DNA, 25 bp, Mus musculus
aaagcctacagtctgaatgaagaaa

SEQ ID NO: 158428 - DNA, 25 bp, Mus musculus
aaagcctacccatctgacagatcac

SEQ ID NO: 158429 - DNA, 25 bp, Mus musculus
aaagcctatactacctacaataccc

SEQ ID NO: 158430 - DNA, 25 bp, Mus musculus
aaagcctatattggtgctggccaac

SEQ ID NO: 158431 - DNA, 25 bp, Mus musculus
aaagcctcagaaaccttgatttctg

SEQ ID NO: 158432 - DNA, 25 bp, Mus musculus
aaagcctcagagccttttcagctat

SEQ ID NO: 158433 - DNA, 25 bp, Mus musculus
aaagcctccatcaggattccatgga

SEQ ID NO: 158434 - DNA, 25 bp, Mus musculus
aaagcctcctaggcacccgagggac

SEQ ID NO: 158435 - DNA, 25 bp, Mus musculus
aaagcctcctgctcctgagtcagtg

SEQ ID NO: 158436 - DNA, 25 bp, Mus musculus
aaagcctgccaagttctggaaattg

SEQ ID NO: 158437 - DNA, 25 bp, Mus musculus
aaagcctgggctgagatgaggtgcc

SEQ ID NO: 158438 - DNA, 25 bp, Mus musculus
aaagccttcacatggtctcttcaga

SEQ ID NO: 158439 - DNA, 25 bp, Mus musculus
aaagccttgctgattttcagaaaga

SEQ ID NO: 158440 - DNA, 25 bp, Mus musculus
aaagcctttccattgtaaatcttag

SEQ ID NO: 158441 - DNA, 25 bp, Mus musculus
aaagcctttgctgcccagtttgaag

SEQ ID NO: 158442 - DNA, 25 bp, Mus musculus
aaagcctttgctggggacacccaga

SEQ ID NO: 158443 - DNA, 25 bp, Mus musculus
aaagcgaactgacaagttggatggc

SEQ ID NO: 158444 - DNA, 25 bp, Mus musculus
aaagcgaactgggttacattccgaa

SEQ ID NO: 158445 - DNA, 25 bp, Mus musculus
aaagcgaatccccaggcacagaagg

SEQ ID NO: 158446 - DNA, 25 bp, Mus musculus
aaagcgaatccccagtatgcagtgt

SEQ ID NO: 158447 - DNA, 25 bp, Mus musculus
aaagcgaatgaacttttctatcttt

SEQ ID NO: 158448 - DNA, 25 bp, Mus musculus
aaagcgacagaaagatgtccgaccc

SEQ ID NO: 158449 - DNA, 25 bp, Mus musculus
aaagcgacagctctacaacagaaga

SEQ ID NO: 158450 - DNA, 25 bp, Mus musculus
aaagcgagaagactgagaaaagctt

SEQ ID NO: 158451 - DNA, 25 bp, Mus musculus
aaagcgaggatggtcatgaaagtcc

SEQ ID NO: 158452 - DNA, 25 bp, Mus musculus
aaagcgaggcagttgttctccatgg

SEQ ID NO: 158453 - DNA, 25 bp, Mus musculus
aaagcgaggccctggtcacaggctc

SEQ ID NO: 158454 - DNA, 25 bp, Mus musculus
aaagcgatgataactttgtgatgtc

SEQ ID NO: 158455 - DNA, 25 bp, Mus musculus
aaagcgatgattcccccgactcccc

SEQ ID NO: 158456 - DNA, 25 bp, Mus musculus
aaagcgcatttaaatcgttctgatg

SEQ ID NO: 158457 - DNA, 25 bp, Mus musculus
aaagcgcctgctggagttcaacaag

SEQ ID NO: 158458 - DNA, 25 bp, Mus musculus
aaagcgcggatgacaacctcaagtc

SEQ ID NO: 158459 - DNA, 25 bp, Mus musculus
aaagcgcggatgggtaactcgtcct

SEQ ID NO: 158460 - DNA, 25 bp, Mus musculus
aaagcgctgcagctattatctggaa

SEQ ID NO: 158461 - DNA, 25 bp, Mus musculus
aaagcggcagtagagtcagatacag

SEQ ID NO: 158462 - DNA, 25 bp, Mus musculus
aaagcggccataaactgtacatttt

SEQ ID NO: 158463 - DNA, 25 bp, Mus musculus
aaagcgtcaaaccggtgcccaaaca

SEQ ID NO: 158464 - DNA, 25 bp, Mus musculus
aaagcgtcaaactccctgaattcct

SEQ ID NO: 158465 - DNA, 25 bp, Mus musculus
aaagcgtctctcgaatctacactga

SEQ ID NO: 158466 - DNA, 25 bp, Mus musculus
aaagcgtctctcgaggttgcctgat

SEQ ID NO: 158467 - DNA, 25 bp, Mus musculus
aaagcgtctggcagcagaagatgtc

SEQ ID NO: 158468 - DNA, 25 bp, Mus musculus
aaagcgtggttgatctggtggctct

SEQ ID NO: 158469 - DNA, 25 bp, Mus musculus
aaagcgttttcagaaaagatgtctt

SEQ ID NO: 158470 - DNA, 25 bp, Mus musculus
aaagctaaacaagagcatgaaggaa

SEQ ID NO: 158471 - DNA, 25 bp, Mus musculus
aaagctaacagggacagttaaaggt

SEQ ID NO: 158472 - DNA, 25 bp, Mus musculus
aaagctacaggtggtaaagcgggct

SEQ ID NO: 158473 - DNA, 25 bp, Mus musculus
aaagctactccagaaaaatcttcaa

SEQ ID NO: 158474 - DNA, 25 bp, Mus musculus
aaagctagactgggtctatggctat

SEQ ID NO: 158475 - DNA, 25 bp, Mus musculus
aaagctagaggagggcatggataat

SEQ ID NO: 158476 - DNA, 25 bp, Mus musculus
aaagctaggaggactcacacacgag

SEQ ID NO: 158477 - DNA, 25 bp, Mus musculus
aaagctagtagagctggaggtggag

SEQ ID NO: 158478 - DNA, 25 bp, Mus musculus
aaagctagtagagtatatggaggaa

SEQ ID NO: 158479 - DNA, 25 bp, Mus musculus
aaagctagtagcagaagctgggagg

SEQ ID NO: 158480 - DNA, 25 bp, Mus musculus
aaagctatcaactgagacattgtct

SEQ ID NO: 158481 - DNA, 25 bp, Mus musculus
aaagctcaaaagctttgcagccagc

SEQ ID NO: 158482 - DNA, 25 bp, Mus musculus
aaagctcaaaaggcactaagcaaga

SEQ ID NO: 158483 - DNA, 25 bp, Mus musculus
aaagctcaagaagaaagagttcgac

SEQ ID NO: 158484 - DNA, 25 bp, Mus musculus
aaagctcaagttttctacagagatc

SEQ ID NO: 158485 - DNA, 25 bp, Mus musculus
aaagctcacgagaagatgtgtatgt

SEQ ID NO: 158486 - DNA, 25 bp, Mus musculus
aaagctcagaaagcctttccctaac

SEQ ID NO: 158487 - DNA, 25 bp, Mus musculus
aaagctcagaaagctgtgtatgatc

SEQ ID NO: 158488 - DNA, 25 bp, Mus musculus
aaagctcagagggaagctcacaaga

SEQ ID NO: 158489 - DNA, 25 bp, Mus musculus
aaagctcagagggaattgaagttaa

SEQ ID NO: 158490 - DNA, 25 bp, Mus musculus
aaagctcagatcaggtaagggagca

SEQ ID NO: 158491 - DNA, 25 bp, Mus musculus
aaagctcagcagaaaatgaaaattg

SEQ ID NO: 158492 - DNA, 25 bp, Mus musculus
aaagctcagcaggaaataacagtcc

SEQ ID NO: 158493 - DNA, 25 bp, Mus musculus
aaagctcagcccagtgtcgtgtggc

SEQ ID NO: 158494 - DNA, 25 bp, Mus musculus
aaagctcagctcagcacaatcctgg

SEQ ID NO: 158495 - DNA, 25 bp, Mus musculus
aaagctcaggactctcggctctccc

SEQ ID NO: 158496 - DNA, 25 bp, Mus musculus
aaagctcaggctgcaagcctgagga

SEQ ID NO: 158497 - DNA, 25 bp, Mus musculus
aaagctcaggctggcaaatgaggag

SEQ ID NO: 158498 - DNA, 25 bp, Mus musculus
aaagctcatagcgggatcctgccgg

SEQ ID NO: 158499 - DNA, 25 bp, Mus musculus
aaagctccaaaggaccagtccatga

SEQ ID NO: 158500 - DNA, 25 bp, Mus musculus
aaagctccaaaggttgtcgctgctt

SEQ ID NO: 158501 - DNA, 25 bp, Mus musculus
aaagctccaagaggtgtgtgatagc

SEQ ID NO: 158502 - DNA, 25 bp, Mus musculus
aaagctccacaggggatctttccag

SEQ ID NO: 158503 - DNA, 25 bp, Mus musculus
aaagctcccaaagcaaatccagttt

SEQ ID NO: 158504 - DNA, 25 bp, Mus musculus
aaagctctaagttaggcaagagttc

SEQ ID NO: 158505 - DNA, 25 bp, Mus musculus
aaagctctgggggtgaaatgggaga

SEQ ID NO: 158506 - DNA, 25 bp, Mus musculus
aaagctctgggggtgaacatgatga

SEQ ID NO: 158507 - DNA, 25 bp, Mus musculus
aaagctctggtgatgatgtggccct

SEQ ID NO: 158508 - DNA, 25 bp, Mus musculus
aaagctctggtgatgtactccaacc

SEQ ID NO: 158509 - DNA, 25 bp, Mus musculus
aaagctgaagaaaaggccttggcaa

SEQ ID NO: 158510 - DNA, 25 bp, Mus musculus
aaagctgaaggacagactgcgcagt

SEQ ID NO: 158511 - DNA, 25 bp, Mus musculus
aaagctgaaggctccgagtaccagg

SEQ ID NO: 158512 - DNA, 25 bp, Mus musculus
aaagctgaccaagggactgcacagg

SEQ ID NO: 158513 - DNA, 25 bp, Mus musculus
aaagctgacggacgaatgctacaac

SEQ ID NO: 158514 - DNA, 25 bp, Mus musculus
aaagctgactcaggaatttgaagcc

SEQ ID NO: 158515 - DNA, 25 bp, Mus musculus
aaagctgagagaaacgaagtgagaa

SEQ ID NO: 158516 - DNA, 25 bp, Mus musculus
aaagctgatgaatgcacccttgtac

SEQ ID NO: 158517 - DNA, 25 bp, Mus musculus
aaagctgcaagctttcagaaagagt

SEQ ID NO: 158518 - DNA, 25 bp, Mus musculus
aaagctgcaagttgcagaattaaga

SEQ ID NO: 158519 - DNA, 25 bp, Mus musculus
aaagctgcagaggagcaactttcag

SEQ ID NO: 158520 - DNA, 25 bp, Mus musculus
aaagctgcagagtttcatgatggct

SEQ ID NO: 158521 - DNA, 25 bp, Mus musculus
aaagctgccaggctctgggtgctct

SEQ ID NO: 158522 - DNA, 25 bp, Mus musculus
aaagctgccgacacagccacagcat

SEQ ID NO: 158523 - DNA, 25 bp, Mus musculus
aaagctgctatcgggggaggagtgt

SEQ ID NO: 158524 - DNA, 25 bp, Mus musculus
aaagctggacagaactcagcagata

SEQ ID NO: 158525 - DNA, 25 bp, Mus musculus
aaagctggagaagaatatggagaag

SEQ ID NO: 158526 - DNA, 25 bp, Mus musculus
aaagctggagaaggcattcggggca

SEQ ID NO: 158527 - DNA, 25 bp, Mus musculus
aaagctggcaaggcttttgctgttg

SEQ ID NO: 158528 - DNA, 25 bp, Mus musculus
aaagctggcaaggtacggactcgag

SEQ ID NO: 158529 - DNA, 25 bp, Mus musculus
aaagctggcaaggttcgaacctcag

SEQ ID NO: 158530 - DNA, 25 bp, Mus musculus
aaagctggccttgcaggtctctctt

SEQ ID NO: 158531 - DNA, 25 bp, Mus musculus
aaagctggcgagcttctgcagtttg

SEQ ID NO: 158532 - DNA, 25 bp, Mus musculus
aaagctggcgggtagaatcattttg

SEQ ID NO: 158533 - DNA, 25 bp, Mus musculus
aaagctggcggtccccaaccatctg

SEQ ID NO: 158534 - DNA, 25 bp, Mus musculus
aaagctgtgtccaagctgtcagtag

SEQ ID NO: 158535 - DNA, 25 bp, Mus musculus
aaagctgtgttcagccctgacagaa

SEQ ID NO: 158536 - DNA, 25 bp, Mus musculus
aaagctgtgttcaggctcttcaaac

SEQ ID NO: 158537 - DNA, 25 bp, Mus musculus
aaagctgttcccatttatgtacagg

SEQ ID NO: 158538 - DNA, 25 bp, Mus musculus
aaagcttatttggtatgctaacaga

SEQ ID NO: 158539 - DNA, 25 bp, Mus musculus
aaagcttcaacaaaggtgatctgca

SEQ ID NO: 158540 - DNA, 25 bp, Mus musculus
aaagcttccctggcacagaaacatc

SEQ ID NO: 158541 - DNA, 25 bp, Mus musculus
aaagcttcggcaaaaatgagtctca

SEQ ID NO: 158542 - DNA, 25 bp, Mus musculus
aaagcttcttttgggatccgagcac

SEQ ID NO: 158543 - DNA, 25 bp, Mus musculus
aaagcttgagaaaaaccatggtgaa

SEQ ID NO: 158544 - DNA, 25 bp, Mus musculus
aaagcttgcttaaaacatgctaatt

SEQ ID NO: 158545 - DNA, 25 bp, Mus musculus
aaagctttaaacaagaggctcaaga

SEQ ID NO: 158546 - DNA, 25 bp, Mus musculus
aaagctttaaacaaggggcgcagag

SEQ ID NO: 158547 - DNA, 25 bp, Mus musculus
aaagctttcatagtgcctgcagtcc

SEQ ID NO: 158548 - DNA, 25 bp, Mus musculus
aaagctttgctcgaagttgtccagt

SEQ ID NO: 158549 - DNA, 25 bp, Mus musculus
aaagctttggagggctccactctag

SEQ ID NO: 158550 - DNA, 25 bp, Mus musculus
aaagcttttacatgaaggtgcatct

SEQ ID NO: 158551 - DNA, 25 bp, Mus musculus
aaagcttttagagtcgctgactccc

SEQ ID NO: 158552 - DNA, 25 bp, Mus musculus
aaagcttttgaaataggaccaaggt

SEQ ID NO: 158553 - DNA, 25 bp, Mus musculus
aaaggaaaaaagcacctgacgttca

SEQ ID NO: 158554 - DNA, 25 bp, Mus musculus
aaaggaaaaaagtctgatgccaacg

SEQ ID NO: 158555 - DNA, 25 bp, Mus musculus
aaaggaaaaggagctctgtcaggtg

SEQ ID NO: 158556 - DNA, 25 bp, Mus musculus
aaaggaaaaggatgtgaggaagaca

SEQ ID NO: 158557 - DNA, 25 bp, Mus musculus
aaaggaaacgatggatctggggaga

SEQ ID NO: 158558 - DNA, 25 bp, Mus musculus
aaaggaaacggtgcctcctcctgga

SEQ ID NO: 158559 - DNA, 25 bp, Mus musculus
aaaggaaagaaccagatttctgctt

SEQ ID NO: 158560 - DNA, 25 bp, Mus musculus
aaaggaaagaatcttctcaaaacac

SEQ ID NO: 158561 - DNA, 25 bp, Mus musculus
aaaggaaaggagtgactggtcagaa

SEQ ID NO: 158562 - DNA, 25 bp, Mus musculus
aaaggaaataatccctccatattac

SEQ ID NO: 158563 - DNA, 25 bp, Mus musculus
aaaggaaatctgaaaaaagacgaga

SEQ ID NO: 158564 - DNA, 25 bp, Mus musculus
aaaggaaatctgatctccaagaggg

SEQ ID NO: 158565 - DNA, 25 bp, Mus musculus
aaaggaaatctgccttaagaactgt

SEQ ID NO: 158566 - DNA, 25 bp, Mus musculus
aaaggaaatctgtattatgttccac

SEQ ID NO: 158567 - DNA, 25 bp, Mus musculus
aaaggaacaaggacagggagatttg

SEQ ID NO: 158568 - DNA, 25 bp, Mus musculus
aaaggaacagagtgacttaaccact

SEQ ID NO: 158569 - DNA, 25 bp, Mus musculus
aaaggaacagcaggcagttcctggc

SEQ ID NO: 158570 - DNA, 25 bp, Mus musculus
aaaggaacaggtatgtcactggctg

SEQ ID NO: 158571 - DNA, 25 bp, Mus musculus
aaaggaaccatggcacagcgatggc

SEQ ID NO: 158572 - DNA, 25 bp, Mus musculus
aaaggaacgaaataatttgaagagg

SEQ ID NO: 158573 - DNA, 25 bp, Mus musculus
aaaggaacgaattttagatgcacag

SEQ ID NO: 158574 - DNA, 25 bp, Mus musculus
aaaggaacgaattttgttaagagca

SEQ ID NO: 158575 - DNA, 25 bp, Mus musculus
aaaggaacgcagcaactgctgctga

SEQ ID NO: 158576 - DNA, 25 bp, Mus musculus
aaaggaactgaaagtgcctttgaag

SEQ ID NO: 158577 - DNA, 25 bp, Mus musculus
aaaggaactgaagcgcctttcagtg

SEQ ID NO: 158578 - DNA, 25 bp, Mus musculus
aaaggaactgaagcgttctgagaag

SEQ ID NO: 158579 - DNA, 25 bp, Mus musculus
aaaggaactgcaggggaagcacagg

SEQ ID NO: 158580 - DNA, 25 bp, Mus musculus
aaaggaactgcaggttgacgtgatt

SEQ ID NO: 158581 - DNA, 25 bp, Mus musculus
aaaggaactgggcagaatgaacacg

SEQ ID NO: 158582 - DNA, 25 bp, Mus musculus
aaaggaactgggcagagaagaatat

SEQ ID NO: 158583 - DNA, 25 bp, Mus musculus
aaaggaactggtctctcatggaact

SEQ ID NO: 158584 - DNA, 25 bp, Mus musculus
aaaggaacttatccagtgaagaagt

SEQ ID NO: 158585 - DNA, 25 bp, Mus musculus
aaaggaagaagatgtagaatgtggg

SEQ ID NO: 158586 - DNA, 25 bp, Mus musculus
aaaggaagaagttacagattcatgg

SEQ ID NO: 158587 - DNA, 25 bp, Mus musculus
aaaggaagagatcaaagatgagaag

SEQ ID NO: 158588 - DNA, 25 bp, Mus musculus
aaaggaagatgacaagagaagaaag

SEQ ID NO: 158589 - DNA, 25 bp, Mus musculus
aaaggaagatggaggaaagacaaat

SEQ ID NO: 158590 - DNA, 25 bp, Mus musculus
aaaggaagcaagatttcctttcctg

SEQ ID NO: 158591 - DNA, 25 bp, Mus musculus
aaaggaagcagaatcgtatcgaatt

SEQ ID NO: 158592 - DNA, 25 bp, Mus musculus
aaaggaagcagaatcgttttggatc

SEQ ID NO: 158593 - DNA, 25 bp, Mus musculus
aaaggaagccaagatttctcagctg

SEQ ID NO: 158594 - DNA, 25 bp, Mus musculus
aaaggaaggtacaagaggacaccaa

SEQ ID NO: 158595 - DNA, 25 bp, Mus musculus
aaaggaaggtgtcttctcgtcccgg

SEQ ID NO: 158596 - DNA, 25 bp, Mus musculus
aaaggaagtcggtgtgttatctctg

SEQ ID NO: 158597 - DNA, 25 bp, Mus musculus
aaaggaataccaggaaaatagtgat

SEQ ID NO: 158598 - DNA, 25 bp, Mus musculus
aaaggaataccaggaaatgataatg

SEQ ID NO: 158599 - DNA, 25 bp, Mus musculus
aaaggaatatacagctggcagggaa

SEQ ID NO: 158600 - DNA, 25 bp, Mus musculus
aaaggaatcaagttactggacagtg

SEQ ID NO: 158601 - DNA, 25 bp, Mus musculus
aaaggaattcaaaagaattactcag

SEQ ID NO: 158602 - DNA, 25 bp, Mus musculus
aaaggaattcaagatggtcaaataa

SEQ ID NO: 158603 - DNA, 25 bp, Mus musculus
aaaggaattccagatggtcaaataa

SEQ ID NO: 158604 - DNA, 25 bp, Mus musculus
aaaggacaaagagcatctaaagaaa

SEQ ID NO: 158605 - DNA, 25 bp, Mus musculus
aaaggacacgagttgcctagcagag

SEQ ID NO: 158606 - DNA, 25 bp, Mus musculus
aaaggacagaacaactgagattcct

SEQ ID NO: 158607 - DNA, 25 bp, Mus musculus
aaaggacagaagaagaagaaaggac

SEQ ID NO: 158608 - DNA, 25 bp, Mus musculus
aaaggacagaagagatctgctggca

SEQ ID NO: 158609 - DNA, 25 bp, Mus musculus
aaaggacagaagggctctgcgtttg

SEQ ID NO: 158610 - DNA, 25 bp, Mus musculus
aaaggacagaagtcctccacagagc

SEQ ID NO: 158611 - DNA, 25 bp, Mus musculus
aaaggacagacaggctttccagggc

SEQ ID NO: 158612 - DNA, 25 bp, Mus musculus
aaaggacagaggacctgaaggctga

SEQ ID NO: 158613 - DNA, 25 bp, Mus musculus
aaaggacagagggtagacaaacaca

SEQ ID NO: 158614 - DNA, 25 bp, Mus musculus
aaaggacagccctcccacagaattc

SEQ ID NO: 158615 - DNA, 25 bp, Mus musculus
aaaggacaggacctttcctagcaag

SEQ ID NO: 158616 - DNA, 25 bp, Mus musculus
aaaggacaggacgagtattatatag

SEQ ID NO: 158617 - DNA, 25 bp, Mus musculus
aaaggacaggacggaaaaagagaga

SEQ ID NO: 158618 - DNA, 25 bp, Mus musculus
aaaggacatcgtcacgagctgaggt

SEQ ID NO: 158619 - DNA, 25 bp, Mus musculus
aaaggaccatgatgatttctggctc

SEQ ID NO: 158620 - DNA, 25 bp, Mus musculus
aaaggaccatggcatcaaccctagg

SEQ ID NO: 158621 - DNA, 25 bp, Mus musculus
aaaggaccgaggattgaagtgagtg

SEQ ID NO: 158622 - DNA, 25 bp, Mus musculus
aaaggaccgatgtagcaggcctgtt

SEQ ID NO: 158623 - DNA, 25 bp, Mus musculus
aaaggacgacagatctatgtaagag

SEQ ID NO: 158624 - DNA, 25 bp, Mus musculus
aaaggactgaagggagtggaaaatg

SEQ ID NO: 158625 - DNA, 25 bp, Mus musculus
aaaggactgtggtcaatgtgcggaa

SEQ ID NO: 158626 - DNA, 25 bp, Mus musculus
aaaggacttaagggaacgaatggag

SEQ ID NO: 158627 - DNA, 25 bp, Mus musculus
aaaggacttcactggaccttcaggc

SEQ ID NO: 158628 - DNA, 25 bp, Mus musculus
aaaggacttcactggaccttcatct

SEQ ID NO: 158629 - DNA, 25 bp, Mus musculus
aaaggacttcctggcgagaaaggtc

SEQ ID NO: 158630 - DNA, 25 bp, Mus musculus
aaaggagaaaagggtgctcggggat

SEQ ID NO: 158631 - DNA, 25 bp, Mus musculus
aaaggagaaagcagccgtgaagccg

SEQ ID NO: 158632 - DNA, 25 bp, Mus musculus
aaaggagaagcaggtctccctggga

SEQ ID NO: 158633 - DNA, 25 bp, Mus musculus
aaaggagaagcccaacaggagggcc

SEQ ID NO: 158634 - DNA, 25 bp, Mus musculus
aaaggagacaagggtgatatgggac

SEQ ID NO: 158635 - DNA, 25 bp, Mus musculus
aaaggagacacgggcttgccaggtg

SEQ ID NO: 158636 - DNA, 25 bp, Mus musculus
aaaggagacttggagacccagaccc

SEQ ID NO: 158637 - DNA, 25 bp, Mus musculus
aaaggagacttggagctgaccacag

SEQ ID NO: 158638 - DNA, 25 bp, Mus musculus
aaaggagagaaaacggtgtattgag

SEQ ID NO: 158639 - DNA, 25 bp, Mus musculus
aaaggagagaaaagcatctgtccat

SEQ ID NO: 158640 - DNA, 25 bp, Mus musculus
aaaggagagaaagatcagccacaac

SEQ ID NO: 158641 - DNA, 25 bp, Mus musculus
aaaggagagaagggccaatcaggcg

SEQ ID NO: 158642 - DNA, 25 bp, Mus musculus
aaaggagagcctgggcccccagatt

SEQ ID NO: 158643 - DNA, 25 bp, Mus musculus
aaaggagagcctgtgtgctgatatt

SEQ ID NO: 158644 - DNA, 25 bp, Mus musculus
aaaggagatcagggcatcacaggtc

SEQ ID NO: 158645 - DNA, 25 bp, Mus musculus
aaaggagatcaggtaatcacaggtc

SEQ ID NO: 158646 - DNA, 25 bp, Mus musculus
aaaggagatgtgggagcgagaggcg

SEQ ID NO: 158647 - DNA, 25 bp, Mus musculus
aaaggagattccagcctccaccgtc

SEQ ID NO: 158648 - DNA, 25 bp, Mus musculus
aaaggagattccagtactacagagc

SEQ ID NO: 158649 - DNA, 25 bp, Mus musculus
aaaggagcaaggggtcagccagggg

SEQ ID NO: 158650 - DNA, 25 bp, Mus musculus
aaaggagcagcagcagcagcagcat

SEQ ID NO: 158651 - DNA, 25 bp, Mus musculus
aaaggagcaggtgcttttggatact

SEQ ID NO: 158652 - DNA, 25 bp, Mus musculus
aaaggagccagaagcgacttgaaga

SEQ ID NO: 158653 - DNA, 25 bp, Mus musculus
aaaggagccctgcaggtactccctg

SEQ ID NO: 158654 - DNA, 25 bp, Mus musculus
aaaggagcgagagtaccccaggctg

SEQ ID NO: 158655 - DNA, 25 bp, Mus musculus
aaaggagcgagagtttccactgtat

SEQ ID NO: 158656 - DNA, 25 bp, Mus musculus
aaaggagctggaggaggtgcgctcc

SEQ ID NO: 158657 - DNA, 25 bp, Mus musculus
aaaggagctgggagactccctgaca

SEQ ID NO: 158658 - DNA, 25 bp, Mus musculus
aaaggagcttagtgctttgggctcc

SEQ ID NO: 158659 - DNA, 25 bp, Mus musculus
aaaggaggaggatggcttccgcctt

SEQ ID NO: 158660 - DNA, 25 bp, Mus musculus
aaaggagggaagataattatgccac

SEQ ID NO: 158661 - DNA, 25 bp, Mus musculus
aaaggagggcacaggctggcaacat

SEQ ID NO: 158662 - DNA, 25 bp, Mus musculus
aaaggaggggacgcgaggcgaggcc

SEQ ID NO: 158663 - DNA, 25 bp, Mus musculus
aaaggaggtagaagaggaacgtacg

SEQ ID NO: 158664 - DNA, 25 bp, Mus musculus
aaaggagtacaccaccacgcccggc

SEQ ID NO: 158665 - DNA, 25 bp, Mus musculus
aaaggagtatgtttgtcctgggtga

SEQ ID NO: 158666 - DNA, 25 bp, Mus musculus
aaaggagtattgcaagaagaacagg

SEQ ID NO: 158667 - DNA, 25 bp, Mus musculus
aaaggagtcacctctgtctggtagc

SEQ ID NO: 158668 - DNA, 25 bp, Mus musculus
aaaggataactcaattcctctattg

SEQ ID NO: 158669 - DNA, 25 bp, Mus musculus
aaaggatatgttcgcacaactggca

SEQ ID NO: 158670 - DNA, 25 bp, Mus musculus
aaaggatattttcaggtgaaccaga

SEQ ID NO: 158671 - DNA, 25 bp, Mus musculus
aaaggatcaaaagcaggaggagcca

SEQ ID NO: 158672 - DNA, 25 bp, Mus musculus
aaaggatccagatgcagaactctca

SEQ ID NO: 158673 - DNA, 25 bp, Mus musculus
aaaggatccagtttatttatatggt

SEQ ID NO: 158674 - DNA, 25 bp, Mus musculus
aaaggatccgctggtgctcctggaa

SEQ ID NO: 158675 - DNA, 25 bp, Mus musculus
aaaggatctagatgagaatgaagtt

SEQ ID NO: 158676 - DNA, 25 bp, Mus musculus
aaaggatgaaaagcttattcgtctg

SEQ ID NO: 158677 - DNA, 25 bp, Mus musculus
aaaggatgagcaagatgaacgagac

SEQ ID NO: 158678 - DNA, 25 bp, Mus musculus
aaaggatgagttgcttcagaggttc

SEQ ID NO: 158679 - DNA, 25 bp, Mus musculus
aaaggatgatgatggaaaggaagaa

SEQ ID NO: 158680 - DNA, 25 bp, Mus musculus
aaaggatgatgatggtacaaaatgc

SEQ ID NO: 158681 - DNA, 25 bp, Mus musculus
aaaggatgattgatctgatggaaca

SEQ ID NO: 158682 - DNA, 25 bp, Mus musculus
aaaggatgcagaaaatgtaggccgc

SEQ ID NO: 158683 - DNA, 25 bp, Mus musculus
aaaggatgcctggcggaaagcttcc

SEQ ID NO: 158684 - DNA, 25 bp, Mus musculus
aaaggatggaaaggtgaagctggag

SEQ ID NO: 158685 - DNA, 25 bp, Mus musculus
aaaggatggcggtgttagaacaacg

SEQ ID NO: 158686 - DNA, 25 bp, Mus musculus
aaaggatgtagaaaagaagctcaat

SEQ ID NO: 158687 - DNA, 25 bp, Mus musculus
aaaggattagggatcttggcaacca

SEQ ID NO: 158688 - DNA, 25 bp, Mus musculus
aaaggattatggtaccaagcgcctt

SEQ ID NO: 158689 - DNA, 25 bp, Mus musculus
aaaggattctatgacccctcaccat

SEQ ID NO: 158690 - DNA, 25 bp, Mus musculus
aaaggattctatgctgggcacacag

SEQ ID NO: 158691 - DNA, 25 bp, Mus musculus
aaaggattctgctcttgctgtccat

SEQ ID NO: 158692 - DNA, 25 bp, Mus musculus
aaaggattcttccttgaaatttgcc

SEQ ID NO: 158693 - DNA, 25 bp, Mus musculus
aaaggatttcccaggtaagcttcaa

SEQ ID NO: 158694 - DNA, 25 bp, Mus musculus
aaaggattttgagaacctgggtgtg

SEQ ID NO: 158695 - DNA, 25 bp, Mus musculus
aaaggattttgatcactggaggtgc

SEQ ID NO: 158696 - DNA, 25 bp, Mus musculus
aaaggattttggcaggaagagaaat

SEQ ID NO: 158697 - DNA, 25 bp, Mus musculus
aaaggattttgttgaccagatatat

SEQ ID NO: 158698 - DNA, 25 bp, Mus musculus
aaaggcaaacaacagggcagcagaa

SEQ ID NO: 158699 - DNA, 25 bp, Mus musculus
aaaggcaaacaacagggtggcagac

SEQ ID NO: 158700 - DNA, 25 bp, Mus musculus
aaaggcaaacagacagtgattgtat

SEQ ID NO: 158701 - DNA, 25 bp, Mus musculus
aaaggcaaagacaaggaggcagaag

SEQ ID NO: 158702 - DNA, 25 bp, Mus musculus
aaaggcaaagatgcagctgtgtcgg

SEQ ID NO: 158703 - DNA, 25 bp, Mus musculus
aaaggcaaagccatgtcatatccag

SEQ ID NO: 158704 - DNA, 25 bp, Mus musculus
aaaggcaaaggtcagtgtcctggcc

SEQ ID NO: 158705 - DNA, 25 bp, Mus musculus
aaaggcaaatgtccctccacctcct

SEQ ID NO: 158706 - DNA, 25 bp, Mus musculus
aaaggcaaccgcaggactactggtg

SEQ ID NO: 158707 - DNA, 25 bp, Mus musculus
aaaggcaatgaaggaagaagaaaga

SEQ ID NO: 158708 - DNA, 25 bp, Mus musculus
aaaggcaatgaaggctccatatatt

SEQ ID NO: 158709 - DNA, 25 bp, Mus musculus
aaaggcaatgaaggtaaatgatctc

SEQ ID NO: 158710 - DNA, 25 bp, Mus musculus
aaaggcacaaagtaagcgcaaagca

SEQ ID NO: 158711 - DNA, 25 bp, Mus musculus
aaaggcacaggaagcggaacaggaa

SEQ ID NO: 158712 - DNA, 25 bp, Mus musculus
aaaggcacatacttggtacatttga

SEQ ID NO: 158713 - DNA, 25 bp, Mus musculus
aaaggcaccaacaggcctgatggga

SEQ ID NO: 158714 - DNA, 25 bp, Mus musculus
aaaggcaccaacaggggagtatgtg

SEQ ID NO: 158715 - DNA, 25 bp, Mus musculus
aaaggcaccttgaagatccttcgta

SEQ ID NO: 158716 - DNA, 25 bp, Mus musculus
aaaggcacgaaagtgagggaagact

SEQ ID NO: 158717 - DNA, 25 bp, Mus musculus
aaaggcactcatgggtggaggtggg

SEQ ID NO: 158718 - DNA, 25 bp, Mus musculus
aaaggcactccagatgaaagcttgc

SEQ ID NO: 158719 - DNA, 25 bp, Mus musculus
aaaggcactccagtcaatgggtcac

SEQ ID NO: 158720 - DNA, 25 bp, Mus musculus
aaaggcagaagatgcatattgaagc

SEQ ID NO: 158721 - DNA, 25 bp, Mus musculus
aaaggcagaagcagaaatgctaatc

SEQ ID NO: 158722 - DNA, 25 bp, Mus musculus
aaaggcagacgtattgcagactgtg

SEQ ID NO: 158723 - DNA, 25 bp, Mus musculus
aaaggcagagatgctgattctctgg

SEQ ID NO: 158724 - DNA, 25 bp, Mus musculus
aaaggcagagggacagttaaaggta

SEQ ID NO: 158725 - DNA, 25 bp, Mus musculus
aaaggcagagggagcattcctggct

SEQ ID NO: 158726 - DNA, 25 bp, Mus musculus
aaaggcagagtatgtttgatgttat

SEQ ID NO: 158727 - DNA, 25 bp, Mus musculus
aaaggcagcagcagaaggtttgatg

SEQ ID NO: 158728 - DNA, 25 bp, Mus musculus
aaaggcagccctggccctgtgggct

SEQ ID NO: 158729 - DNA, 25 bp, Mus musculus
aaaggcatatttgagggattttata

SEQ ID NO: 158730 - DNA, 25 bp, Mus musculus
aaaggcatcagatttcgtggatatt

SEQ ID NO: 158731 - DNA, 25 bp, Mus musculus
aaaggcatcatggctcacctgtgcc

SEQ ID NO: 158732 - DNA, 25 bp, Mus musculus
aaaggcatgtataatgcctgcgttc

SEQ ID NO: 158733 - DNA, 25 bp, Mus musculus
aaaggcattgcacaagaaaagaagg

SEQ ID NO: 158734 - DNA, 25 bp, Mus musculus
aaaggccaaaactgtacatcattga

SEQ ID NO: 158735 - DNA, 25 bp, Mus musculus
aaaggccaaaagcctgatagaggaa

SEQ ID NO: 158736 - DNA, 25 bp, Mus musculus
aaaggccaaacaaaagccgaaatag

SEQ ID NO: 158737 - DNA, 25 bp, Mus musculus
aaaggccaaacaaagagcacagtca

SEQ ID NO: 158738 - DNA, 25 bp, Mus musculus
aaaggccaaacaagttgtcaagttg

SEQ ID NO: 158739 - DNA, 25 bp, Mus musculus
aaaggccaagatatttatcaacaac

SEQ ID NO: 158740 - DNA, 25 bp, Mus musculus
aaaggccaagattagattgctttat

SEQ ID NO: 158741 - DNA, 25 bp, Mus musculus
aaaggccaagattcttcaggagaga

SEQ ID NO: 158742 - DNA, 25 bp, Mus musculus
aaaggccaagctggccctgcttgtc

SEQ ID NO: 158743 - DNA, 25 bp, Mus musculus
aaaggccaagcttgccctgcttgtc

SEQ ID NO: 158744 - DNA, 25 bp, Mus musculus
aaaggccacagatgctgaagctgac

SEQ ID NO: 158745 - DNA, 25 bp, Mus musculus
aaaggccagctgatcgctggtgttc

SEQ ID NO: 158746 - DNA, 25 bp, Mus musculus
aaaggccaggtaaagcctgccggga

SEQ ID NO: 158747 - DNA, 25 bp, Mus musculus
aaaggccaggtccagaacggaggtt

SEQ ID NO: 158748 - DNA, 25 bp, Mus musculus
aaaggccaggtccagctggaccccc

SEQ ID NO: 158749 - DNA, 25 bp, Mus musculus
aaaggccataaggagctggtgggga

SEQ ID NO: 158750 - DNA, 25 bp, Mus musculus
aaaggcccatgtgaccctgctgaca

SEQ ID NO: 158751 - DNA, 25 bp, Mus musculus
aaaggccccacaggctctgcaggaa

SEQ ID NO: 158752 - DNA, 25 bp, Mus musculus
aaaggccctgagactgccagcaaat

SEQ ID NO: 158753 - DNA, 25 bp, Mus musculus
aaaggccctggggaatgtatcattg

SEQ ID NO: 158754 - DNA, 25 bp, Mus musculus
aaaggccctgttcagagccctgaag

SEQ ID NO: 158755 - DNA, 25 bp, Mus musculus
aaaggccctttatgaacaaaggaag

SEQ ID NO: 158756 - DNA, 25 bp, Mus musculus
aaaggccctttatggaacagacgga

SEQ ID NO: 158757 - DNA, 25 bp, Mus musculus
aaaggccgttttggactacatctga

SEQ ID NO: 158758 - DNA, 25 bp, Mus musculus
aaaggcctaacatttggaaggctaa

SEQ ID NO: 158759 - DNA, 25 bp, Mus musculus
aaaggcctaacctccaaaagtatgt

SEQ ID NO: 158760 - DNA, 25 bp, Mus musculus
aaaggcctgaagcacgtaacttcta

SEQ ID NO: 158761 - DNA, 25 bp, Mus musculus
aaaggcctgaagctgtctccagaca

SEQ ID NO: 158762 - DNA, 25 bp, Mus musculus
aaaggcctgaaggtgcgggagtatg

SEQ ID NO: 158763 - DNA, 25 bp, Mus musculus
aaaggcctgaatcaggtctgctggc

SEQ ID NO: 158764 - DNA, 25 bp, Mus musculus
aaaggcctgactcaggtctgctggc

SEQ ID NO: 158765 - DNA, 25 bp, Mus musculus
aaaggcctgcgaagatataaatgag

SEQ ID NO: 158766 - DNA, 25 bp, Mus musculus
aaaggccttaaagactattaagata

SEQ ID NO: 158767 - DNA, 25 bp, Mus musculus
aaaggccttaaaggaaatgaaagtg

SEQ ID NO: 158768 - DNA, 25 bp, Mus musculus
aaaggccttcacaatctccagaact

SEQ ID NO: 158769 - DNA, 25 bp, Mus musculus
aaaggccttggcaattatttgtata

SEQ ID NO: 158770 - DNA, 25 bp, Mus musculus
aaaggcgacgacctgctgccgtctc

SEQ ID NO: 158771 - DNA, 25 bp, Mus musculus
aaaggcgacgatagggccagtgttg

SEQ ID NO: 158772 - DNA, 25 bp, Mus musculus
aaaggcgagaaatgagagaaacgca

SEQ ID NO: 158773 - DNA, 25 bp, Mus musculus
aaaggcgagaaatggaaacagctgc

SEQ ID NO: 158774 - DNA, 25 bp, Mus musculus
aaaggcgagaagatccttatccttc

SEQ ID NO: 158775 - DNA, 25 bp, Mus musculus
aaaggcgagaagatgggctgcatct

SEQ ID NO: 158776 - DNA, 25 bp, Mus musculus
aaaggcgagcagggtcctcctgggc

SEQ ID NO: 158777 - DNA, 25 bp, Mus musculus
aaaggcgatcttgagcaaaagagcc

SEQ ID NO: 158778 - DNA, 25 bp, Mus musculus
aaaggcgatcttgaggtggctaccg

SEQ ID NO: 158779 - DNA, 25 bp, Mus musculus
aaaggcggcggtcctttctacaata

SEQ ID NO: 158780 - DNA, 25 bp, Mus musculus
aaaggctaaaggtctgtacacatga

SEQ ID NO: 158781 - DNA, 25 bp, Mus musculus
aaaggctaagagcctgaccagggat

SEQ ID NO: 158782 - DNA, 25 bp, Mus musculus
aaaggctatagggtcggtgatggag

SEQ ID NO: 158783 - DNA, 25 bp, Mus musculus
aaaggctcaagggctttgctgagcg

SEQ ID NO: 158784 - DNA, 25 bp, Mus musculus
aaaggctcatcagatgtaaacagaa

SEQ ID NO: 158785 - DNA, 25 bp, Mus musculus
aaaggctccacaggagatggctttc

SEQ ID NO: 158786 - DNA, 25 bp, Mus musculus
aaaggctccaccgcggtctgacagc

SEQ ID NO: 158787 - DNA, 25 bp, Mus musculus
aaaggctccaccgcggttggaattc

SEQ ID NO: 158788 - DNA, 25 bp, Mus musculus
aaaggctccaggggtgatggacaac

SEQ ID NO: 158789 - DNA, 25 bp, Mus musculus
aaaggctccgagcaaggccgtgcag

SEQ ID NO: 158790 - DNA, 25 bp, Mus musculus
aaaggctctccaggcagtgctttta

SEQ ID NO: 158791 - DNA, 25 bp, Mus musculus
aaaggctctccaggtagcctttcca

SEQ ID NO: 158792 - DNA, 25 bp, Mus musculus
aaaggctctccaggtttgtgtaagt

SEQ ID NO: 158793 - DNA, 25 bp, Mus musculus
aaaggctctccgggttcaataggat

SEQ ID NO: 158794 - DNA, 25 bp, Mus musculus
aaaggctctgtggaggaagcaaggg

SEQ ID NO: 158795 - DNA, 25 bp, Mus musculus
aaaggctgcagaacatgaagttcct

SEQ ID NO: 158796 - DNA, 25 bp, Mus musculus
aaaggctgcagatgcagccggtgga

SEQ ID NO: 158797 - DNA, 25 bp, Mus musculus
aaaggctgcagctcttaaccggctc

SEQ ID NO: 158798 - DNA, 25 bp, Mus musculus
aaaggctgccccaggttgccactga

SEQ ID NO: 158799 - DNA, 25 bp, Mus musculus
aaaggctgtccaacaggtgcgccag

SEQ ID NO: 158800 - DNA, 25 bp, Mus musculus
aaaggctgtctcaggtggcccctgt

SEQ ID NO: 158801 - DNA, 25 bp, Mus musculus
aaaggcttaccaagcccgttctcaa

SEQ ID NO: 158802 - DNA, 25 bp, Mus musculus
aaaggcttacccaggtttggcatag

SEQ ID NO: 158803 - DNA, 25 bp, Mus musculus
aaaggcttcaaagattacatgaaag

SEQ ID NO: 158804 - DNA, 25 bp, Mus musculus
aaaggcttcaaagttgcacctgctt

SEQ ID NO: 158805 - DNA, 25 bp, Mus musculus
aaaggcttgctcaggtagctaaagc

SEQ ID NO: 158806 - DNA, 25 bp, Mus musculus
aaaggctttaagctctggtgcaagt

SEQ ID NO: 158807 - DNA, 25 bp, Mus musculus
aaaggcttttggggcaggggctgac

SEQ ID NO: 158808 - DNA, 25 bp, Mus musculus
aaaggcttttggggctgactttgtg

SEQ ID NO: 158809 - DNA, 25 bp, Mus musculus
aaaggctttttactatgcagtcaca

SEQ ID NO: 158810 - DNA, 25 bp, Mus musculus
aaagggaaacaagttctgacagtat

SEQ ID NO: 158811 - DNA, 25 bp, Mus musculus
aaagggaaagaccagacatcatccc

SEQ ID NO: 158812 - DNA, 25 bp, Mus musculus
aaagggaaagaccaggacctcacca

SEQ ID NO: 158813 - DNA, 25 bp, Mus musculus
aaagggaaagccaagatgccagacc

SEQ ID NO: 158814 - DNA, 25 bp, Mus musculus
aaagggacaggttttcctagatatg

SEQ ID NO: 158815 - DNA, 25 bp, Mus musculus
aaagggacagtgatggatgtgggag

SEQ ID NO: 158816 - DNA, 25 bp, Mus musculus
aaagggacgctgtgctttcatggat

SEQ ID NO: 158817 - DNA, 25 bp, Mus musculus
aaagggactcggagaatcatcattc

SEQ ID NO: 158818 - DNA, 25 bp, Mus musculus
aaagggacttcaggccttctcccaa

SEQ ID NO: 158819 - DNA, 25 bp, Mus musculus
aaagggagctagtgaaactgacgtc

SEQ ID NO: 158820 - DNA, 25 bp, Mus musculus
aaagggagctagtggcccacgcttg

SEQ ID NO: 158821 - DNA, 25 bp, Mus musculus
aaagggagctagtggtttaggtaat

SEQ ID NO: 158822 - DNA, 25 bp, Mus musculus
aaagggagtggtgggttcgagtgac

SEQ ID NO: 158823 - DNA, 25 bp, Mus musculus
aaagggatctttgagagaaatacaa

SEQ ID NO: 158824 - DNA, 25 bp, Mus musculus
aaagggatgatgcaatgagttcctt

SEQ ID NO: 158825 - DNA, 25 bp, Mus musculus
aaagggatttctggacttggcagtg

SEQ ID NO: 158826 - DNA, 25 bp, Mus musculus
aaagggcaagaccaaaaacctcatc

SEQ ID NO: 158827 - DNA, 25 bp, Mus musculus
aaagggcaagcttctactcagaccc

SEQ ID NO: 158828 - DNA, 25 bp, Mus musculus
aaagggcacaatgcgaccttcttcg

SEQ ID NO: 158829 - DNA, 25 bp, Mus musculus
aaagggcacaggctcgtcccctgac

SEQ ID NO: 158830 - DNA, 25 bp, Mus musculus
aaagggcatcagcgagggctgccgg

SEQ ID NO: 158831 - DNA, 25 bp, Mus musculus
aaagggcatcaggaggctgcacagg

SEQ ID NO: 158832 - DNA, 25 bp, Mus musculus
aaagggccaagaagtctacatgtgg

SEQ ID NO: 158833 - DNA, 25 bp, Mus musculus
aaagggcccatgatctccatctttc

SEQ ID NO: 158834 - DNA, 25 bp, Mus musculus
aaagggccgaggcgaagcccgacat

SEQ ID NO: 158835 - DNA, 25 bp, Mus musculus
aaagggcctagcagagctcctcaga

SEQ ID NO: 158836 - DNA, 25 bp, Mus musculus
aaagggcctagcgccagccagagct

SEQ ID NO: 158837 - DNA, 25 bp, Mus musculus
aaagggcctcacaccaagcctgaag

SEQ ID NO: 158838 - DNA, 25 bp, Mus musculus
aaaggggaagaaaagacatgctcac

SEQ ID NO: 158839 - DNA, 25 bp, Mus musculus
aaaggggaagtgaaatcttgtgaat

SEQ ID NO: 158840 - DNA, 25 bp, Mus musculus
aaaggggacacattttagtttctgg

SEQ ID NO: 158841 - DNA, 25 bp, Mus musculus
aaaggggcaggcgggtgattataga

SEQ ID NO: 158842 - DNA, 25 bp, Mus musculus
aaagggggcctggtccatcccgtgg

SEQ ID NO: 158843 - DNA, 25 bp, Mus musculus
aaagggggtgtcgagcccagccagt

SEQ ID NO: 158844 - DNA, 25 bp, Mus musculus
aaaggggtcaaaattgacaagactg

SEQ ID NO: 158845 - DNA, 25 bp, Mus musculus
aaaggggtctgaagtcaaatacctt

SEQ ID NO: 158846 - DNA, 25 bp, Mus musculus
aaaggggtgaagactgaaccaataa

SEQ ID NO: 158847 - DNA, 25 bp, Mus musculus
aaaggggtgaagagggtcaacagga

SEQ ID NO: 158848 - DNA, 25 bp, Mus musculus
aaagggtcacggacctcttcactgg

SEQ ID NO: 158849 - DNA, 25 bp, Mus musculus
aaagggtcacggttgcatctgatgc

SEQ ID NO: 158850 - DNA, 25 bp, Mus musculus
aaagggtcataggcacagaccaagc

SEQ ID NO: 158851 - DNA, 25 bp, Mus musculus
aaagggtgaggtgtgccaaagaatc

SEQ ID NO: 158852 - DNA, 25 bp, Mus musculus
aaagggtgagttttatgtgatagaa

SEQ ID NO: 158853 - DNA, 25 bp, Mus musculus
aaagggtgcagaagttccctcaacc

SEQ ID NO: 158854 - DNA, 25 bp, Mus musculus
aaagggtgcccgtgacaaatgaaga

SEQ ID NO: 158855 - DNA, 25 bp, Mus musculus
aaagggtgttgtagcatcttggttg

SEQ ID NO: 158856 - DNA, 25 bp, Mus musculus
aaagggtgttgtagctgctcctcac

SEQ ID NO: 158857 - DNA, 25 bp, Mus musculus
aaaggtacaagacaacactgcttat

SEQ ID NO: 158858 - DNA, 25 bp, Mus musculus
aaaggtaccagtggctacctccctc

SEQ ID NO: 158859 - DNA, 25 bp, Mus musculus
aaaggtagcatcaccaccgcctccg

SEQ ID NO: 158860 - DNA, 25 bp, Mus musculus
aaaggtcaaaactctaacacgtgaa

SEQ ID NO: 158861 - DNA, 25 bp, Mus musculus
aaaggtcaaggcaccaatgaggaaa

SEQ ID NO: 158862 - DNA, 25 bp, Mus musculus
aaaggtcaaggctccaatgaggaaa

SEQ ID NO: 158863 - DNA, 25 bp, Mus musculus
aaaggtcacaccgaggatgcgtccg

SEQ ID NO: 158864 - DNA, 25 bp, Mus musculus
aaaggtcacagaggacacaaaggtc

SEQ ID NO: 158865 - DNA, 25 bp, Mus musculus
aaaggtcagaaagcctctccgacca

SEQ ID NO: 158866 - DNA, 25 bp, Mus musculus
aaaggtcaggcgggtgaacctggca

SEQ ID NO: 158867 - DNA, 25 bp, Mus musculus
aaaggtcatataagtgacattgaaa

SEQ ID NO: 158868 - DNA, 25 bp, Mus musculus
aaaggtcatataatgtcatatttga

SEQ ID NO: 158869 - DNA, 25 bp, Mus musculus
aaaggtcgaggaccaaactcttact

SEQ ID NO: 158870 - DNA, 25 bp, Mus musculus
aaaggtctcctggtcttatatccag

SEQ ID NO: 158871 - DNA, 25 bp, Mus musculus
aaaggtgaaattggaactcctggcc

SEQ ID NO: 158872 - DNA, 25 bp, Mus musculus
aaaggtgaacgctgctggttgtcta

SEQ ID NO: 158873 - DNA, 25 bp, Mus musculus
aaaggtgcagatcctggggcagagt

SEQ ID NO: 158874 - DNA, 25 bp, Mus musculus
aaaggtgcagcaactgctttgctct

SEQ ID NO: 158875 - DNA, 25 bp, Mus musculus
aaaggtgccaacatctatttcaagg

SEQ ID NO: 158876 - DNA, 25 bp, Mus musculus
aaaggtgccaacggcgagcctggca

SEQ ID NO: 158877 - DNA, 25 bp, Mus musculus
aaaggtggatatgtccgaccccgga

SEQ ID NO: 158878 - DNA, 25 bp, Mus musculus
aaaggtggcgggcgagaactttgga

SEQ ID NO: 158879 - DNA, 25 bp, Mus musculus
aaaggtgtattcagacttcaagacc

SEQ ID NO: 158880 - DNA, 25 bp, Mus musculus
aaaggtgtattcgggttcctggact

SEQ ID NO: 158881 - DNA, 25 bp, Mus musculus
aaaggtgtgctggtgcgatgcatgc

SEQ ID NO: 158882 - DNA, 25 bp, Mus musculus
aaaggttacaagagtgaaacatctt

SEQ ID NO: 158883 - DNA, 25 bp, Mus musculus
aaaggttacaccaggcttgtgaaga

SEQ ID NO: 158884 - DNA, 25 bp, Mus musculus
aaaggttatttgaacacacaggttt

SEQ ID NO: 158885 - DNA, 25 bp, Mus musculus
aaaggttatttggtacaaaatgcag

SEQ ID NO: 158886 - DNA, 25 bp, Mus musculus
aaaggttcaaaccagtaggtgcaaa

SEQ ID NO: 158887 - DNA, 25 bp, Mus musculus
aaaggttgatgggaatgtaaataaa

SEQ ID NO: 158888 - DNA, 25 bp, Mus musculus
aaaggttgatggtccgcagacatct

SEQ ID NO: 158889 - DNA, 25 bp, Mus musculus
aaaggttgtccggtccttcagacca

SEQ ID NO: 158890 - DNA, 25 bp, Mus musculus
aaaggtttaatgaaatgatgaaagt

SEQ ID NO: 158891 - DNA, 25 bp, Mus musculus
aaaggtttaatgaaggtgattcaga

SEQ ID NO: 158892 - DNA, 25 bp, Mus musculus
aaaggtttcaagaattggaggccac

SEQ ID NO: 158893 - DNA, 25 bp, Mus musculus
aaaggtttctgacaggtaaccaatg

SEQ ID NO: 158894 - DNA, 25 bp, Mus musculus
aaaggtttggcttctccagttggca

SEQ ID NO: 158895 - DNA, 25 bp, Mus musculus
aaagtaaaaactggcattgcttcac

SEQ ID NO: 158896 - DNA, 25 bp, Mus musculus
aaagtaaaagaattgcggcgagcaa

SEQ ID NO: 158897 - DNA, 25 bp, Mus musculus
aaagtaaaagcacttggtggatatg

SEQ ID NO: 158898 - DNA, 25 bp, Mus musculus
aaagtaaacaaacatggaagatggg

SEQ ID NO: 158899 - DNA, 25 bp, Mus musculus
aaagtaaacattttctatttaaatg

SEQ ID NO: 158900 - DNA, 25 bp, Mus musculus
aaagtaaataaaggaatgtgtttct

SEQ ID NO: 158901 - DNA, 25 bp, Mus musculus
aaagtaaatggaaggcatacgatgc

SEQ ID NO: 158902 - DNA, 25 bp, Mus musculus
aaagtaacactgagtaccagtgatg

SEQ ID NO: 158903 - DNA, 25 bp, Mus musculus
aaagtaaccgctcaggtagtagtct

SEQ ID NO: 158904 - DNA, 25 bp, Mus musculus
aaagtaaccgctcagttcatctcaa

SEQ ID NO: 158905 - DNA, 25 bp, Mus musculus
aaagtaatgccaatcccatcttcat

SEQ ID NO: 158906 - DNA, 25 bp, Mus musculus
aaagtacacaagaaactaacactaa

SEQ ID NO: 158907 - DNA, 25 bp, Mus musculus
aaagtacagcagggcttcctgaaag

SEQ ID NO: 158908 - DNA, 25 bp, Mus musculus
aaagtacaggtagagatctgcctgc

SEQ ID NO: 158909 - DNA, 25 bp, Mus musculus
aaagtaccaatacacgagaccagca

SEQ ID NO: 158910 - DNA, 25 bp, Mus musculus
aaagtaccaggaaaggacacagtta

SEQ ID NO: 158911 - DNA, 25 bp, Mus musculus
aaagtaccaggtgttttcagctgtg

SEQ ID NO: 158912 - DNA, 25 bp, Mus musculus
aaagtacccacacacccaaaccagg

SEQ ID NO: 158913 - DNA, 25 bp, Mus musculus
aaagtacgcaagatgaacactacca

SEQ ID NO: 158914 - DNA, 25 bp, Mus musculus
aaagtacttcctggtgggtgcaggg

SEQ ID NO: 158915 - DNA, 25 bp, Mus musculus
aaagtacttgaaaactggtggtcag

SEQ ID NO: 158916 - DNA, 25 bp, Mus musculus
aaagtagaaggttacatccaggcat

SEQ ID NO: 158917 - DNA, 25 bp, Mus musculus
aaagtagcgtgaaggttcttcatga

SEQ ID NO: 158918 - DNA, 25 bp, Mus musculus
aaagtagttaccgtggtcaagaaga

SEQ ID NO: 158919 - DNA, 25 bp, Mus musculus
aaagtataaacactggaacttagca

SEQ ID NO: 158920 - DNA, 25 bp, Mus musculus
aaagtataaacactgtaaaggatct

SEQ ID NO: 158921 - DNA, 25 bp, Mus musculus
aaagtatacaaaaggatttactagg

SEQ ID NO: 158922 - DNA, 25 bp, Mus musculus
aaagtatcagaaatccacttctctt

SEQ ID NO: 158923 - DNA, 25 bp, Mus musculus
aaagtatcagatgtctttattccat

SEQ ID NO: 158924 - DNA, 25 bp, Mus musculus
aaagtatcaggaatacatcccagtt

SEQ ID NO: 158925 - DNA, 25 bp, Mus musculus
aaagtatcagggctggcagtctggc

SEQ ID NO: 158926 - DNA, 25 bp, Mus musculus
aaagtatcctgaaggaaagaccgta

SEQ ID NO: 158927 - DNA, 25 bp, Mus musculus
aaagtatgatgatataagcttacca

SEQ ID NO: 158928 - DNA, 25 bp, Mus musculus
aaagtatgtgggctggaaaaaggaa

SEQ ID NO: 158929 - DNA, 25 bp, Mus musculus
aaagtatgtggttctgctcattaat

SEQ ID NO: 158930 - DNA, 25 bp, Mus musculus
aaagtattccaggctctgtgcaagg

SEQ ID NO: 158931 - DNA, 25 bp, Mus musculus
aaagtattctgtatctgcagtgggt

SEQ ID NO: 158932 - DNA, 25 bp, Mus musculus
aaagtcaaaaggtctccagatgagg

SEQ ID NO: 158933 - DNA, 25 bp, Mus musculus
aaagtcaaaggtggcagggctgaga

SEQ ID NO: 158934 - DNA, 25 bp, Mus musculus
aaagtcaagtgatcaaccggaaact

SEQ ID NO: 158935 - DNA, 25 bp, Mus musculus
aaagtcacaagggaacagcagtgca

SEQ ID NO: 158936 - DNA, 25 bp, Mus musculus
aaagtcacacagcgacatgtgaggg

SEQ ID NO: 158937 - DNA, 25 bp, Mus musculus
aaagtcacagctttctcagggcctc

SEQ ID NO: 158938 - DNA, 25 bp, Mus musculus
aaagtcactggggacccctgtgcag

SEQ ID NO: 158939 - DNA, 25 bp, Mus musculus
aaagtcagaaaagtgttacatgtag

SEQ ID NO: 158940 - DNA, 25 bp, Mus musculus
aaagtcagaagggcatcctggccca

SEQ ID NO: 158941 - DNA, 25 bp, Mus musculus
aaagtcagatactccatatcatagc

SEQ ID NO: 158942 - DNA, 25 bp, Mus musculus
aaagtcagatgcaggatgccaggca

SEQ ID NO: 158943 - DNA, 25 bp, Mus musculus
aaagtcagcctttagttcctctttc

SEQ ID NO: 158944 - DNA, 25 bp, Mus musculus
aaagtcaggcagatgatgtgtgtta

SEQ ID NO: 158945 - DNA, 25 bp, Mus musculus
aaagtcattaagggtgatgtttata

SEQ ID NO: 158946 - DNA, 25 bp, Mus musculus
aaagtccaagaactgatgtctactc

SEQ ID NO: 158947 - DNA, 25 bp, Mus musculus
aaagtccaagattgcgctggctcca

SEQ ID NO: 158948 - DNA, 25 bp, Mus musculus
aaagtccaaggtgccccgagccctc

SEQ ID NO: 158949 - DNA, 25 bp, Mus musculus
aaagtccaagtgcgatatgatgaat

SEQ ID NO: 158950 - DNA, 25 bp, Mus musculus
aaagtccagcactagggctccttct

SEQ ID NO: 158951 - DNA, 25 bp, Mus musculus
aaagtccatcacgattcaggctctt

SEQ ID NO: 158952 - DNA, 25 bp, Mus musculus
aaagtcccacacctacttcattata

SEQ ID NO: 158953 - DNA, 25 bp, Mus musculus
aaagtcccagacagcagctgcagta

SEQ ID NO: 158954 - DNA, 25 bp, Mus musculus
aaagtcccagacagcttgcttgcct

SEQ ID NO: 158955 - DNA, 25 bp, Mus musculus
aaagtcccagcactccgtcctctcc

SEQ ID NO: 158956 - DNA, 25 bp, Mus musculus
aaagtcccagctgagactggctggt

SEQ ID NO: 158957 - DNA, 25 bp, Mus musculus
aaagtccctcacacacctgcacgtt

SEQ ID NO: 158958 - DNA, 25 bp, Mus musculus
aaagtccgactggaactggaaaagg

SEQ ID NO: 158959 - DNA, 25 bp, Mus musculus
aaagtccgctacgtgaaaaatgaag

SEQ ID NO: 158960 - DNA, 25 bp, Mus musculus
aaagtccgggaaaggattcagatat

SEQ ID NO: 158961 - DNA, 25 bp, Mus musculus
aaagtcctggaggcaggcgacaagc

SEQ ID NO: 158962 - DNA, 25 bp, Mus musculus
aaagtcctggaggctggagtcacag

SEQ ID NO: 158963 - DNA, 25 bp, Mus musculus
aaagtcctgggaatcaacaagcaag

SEQ ID NO: 158964 - DNA, 25 bp, Mus musculus
aaagtccttcagggcaatctctgtg

SEQ ID NO: 158965 - DNA, 25 bp, Mus musculus
aaagtcgccaaggtgaccccaggct

SEQ ID NO: 158966 - DNA, 25 bp, Mus musculus
aaagtcggagaggtacagattcctc

SEQ ID NO: 158967 - DNA, 25 bp, Mus musculus
aaagtcggagaggttgacgtcgagc

SEQ ID NO: 158968 - DNA, 25 bp, Mus musculus
aaagtctaaagggccagtgtcctta

SEQ ID NO: 158969 - DNA, 25 bp, Mus musculus
aaagtctattaaaatgaagcattgg

SEQ ID NO: 158970 - DNA, 25 bp, Mus musculus
aaagtctcaatcgtcctttttcttc

SEQ ID NO: 158971 - DNA, 25 bp, Mus musculus
aaagtctctgaaactcaagtcaagg

SEQ ID NO: 158972 - DNA, 25 bp, Mus musculus
aaagtctctgcaggtgcccaaaact

SEQ ID NO: 158973 - DNA, 25 bp, Mus musculus
aaagtctgcacaggaaatgaaagct

SEQ ID NO: 158974 - DNA, 25 bp, Mus musculus
aaagtctgtctagagtttcaagaac

SEQ ID NO: 158975 - DNA, 25 bp, Mus musculus
aaagtcttacagcctttgtttctgt

SEQ ID NO: 158976 - DNA, 25 bp, Mus musculus
aaagtcttacagcttgggcaatagg

SEQ ID NO: 158977 - DNA, 25 bp, Mus musculus
aaagtcttacaggagttaggatctg

SEQ ID NO: 158978 - DNA, 25 bp, Mus musculus
aaagtcttacagtattaccaggagt

SEQ ID NO: 158979 - DNA, 25 bp, Mus musculus
aaagtcttacagtccattttgaatc

SEQ ID NO: 158980 - DNA, 25 bp, Mus musculus
aaagtcttagcacctccgcacctgt

SEQ ID NO: 158981 - DNA, 25 bp, Mus musculus
aaagtcttagtgtcgagcacagcgc

SEQ ID NO: 158982 - DNA, 25 bp, Mus musculus
aaagtcttcatagagacacaccaga

SEQ ID NO: 158983 - DNA, 25 bp, Mus musculus
aaagtcttcatagagatctccttgt

SEQ ID NO: 158984 - DNA, 25 bp, Mus musculus
aaagtcttgtaatttgaactgtgaa

SEQ ID NO: 158985 - DNA, 25 bp, Mus musculus
aaagtgaaaaagtactgtctgatga

SEQ ID NO: 158986 - DNA, 25 bp, Mus musculus
aaagtgaaaaggttgtccaggaagc

SEQ ID NO: 158987 - DNA, 25 bp, Mus musculus
aaagtgaaactcaaagagcgtcagg

SEQ ID NO: 158988 - DNA, 25 bp, Mus musculus
aaagtgaaactcaaattttaatcca

SEQ ID NO: 158989 - DNA, 25 bp, Mus musculus
aaagtgaaagaccattgcagcaaac

SEQ ID NO: 158990 - DNA, 25 bp, Mus musculus
aaagtgaaagttaatgaaatcatca

SEQ ID NO: 158991 - DNA, 25 bp, Mus musculus
aaagtgaacaggccatggcgcaggc

SEQ ID NO: 158992 - DNA, 25 bp, Mus musculus
aaagtgaacaggtgccttcttcaca

SEQ ID NO: 158993 - DNA, 25 bp, Mus musculus
aaagtgaacagtaggtgagcttagc

SEQ ID NO: 158994 - DNA, 25 bp, Mus musculus
aaagtgaagatcatgtgagcatcgt

SEQ ID NO: 158995 - DNA, 25 bp, Mus musculus
aaagtgaaggtgacaggtctatttt

SEQ ID NO: 158996 - DNA, 25 bp, Mus musculus
aaagtgaatgtactctattcttcat

SEQ ID NO: 158997 - DNA, 25 bp, Mus musculus
aaagtgacagagaaagtgatctttc

SEQ ID NO: 158998 - DNA, 25 bp, Mus musculus
aaagtgacagagagtcagtgggccc

SEQ ID NO: 158999 - DNA, 25 bp, Mus musculus
aaagtgaccagccgagaacgaggcc

SEQ ID NO: 159000 - DNA, 25 bp, Mus musculus
aaagtgaccagcgtgtccaccctga

SEQ ID NO: 159001 - DNA, 25 bp, Mus musculus
aaagtgacgtgtgggcttttggcgt

SEQ ID NO: 159002 - DNA, 25 bp, Mus musculus
aaagtgagaggttcagacagtaact

SEQ ID NO: 159003 - DNA, 25 bp, Mus musculus
aaagtgagcaagcaggaggaggcct

SEQ ID NO: 159004 - DNA, 25 bp, Mus musculus
aaagtgatagaaaagcttggctttc

SEQ ID NO: 159005 - DNA, 25 bp, Mus musculus
aaagtgatagtggcaatccagatca

SEQ ID NO: 159006 - DNA, 25 bp, Mus musculus
aaagtgatcctatcccatcaccctc

SEQ ID NO: 159007 - DNA, 25 bp, Mus musculus
aaagtgatggagatgagaagaagcc

SEQ ID NO: 159008 - DNA, 25 bp, Mus musculus
aaagtgatggagatgcgctccctcc

SEQ ID NO: 159009 - DNA, 25 bp, Mus musculus
aaagtgatggagatggggtcctaaa

SEQ ID NO: 159010 - DNA, 25 bp, Mus musculus
aaagtgatgggattcgaagagtctg

SEQ ID NO: 159011 - DNA, 25 bp, Mus musculus
aaagtgcaaaacagatggagaatag

SEQ ID NO: 159012 - DNA, 25 bp, Mus musculus
aaagtgcaaaacaggatatcctgta

SEQ ID NO: 159013 - DNA, 25 bp, Mus musculus
aaagtgcagagactgtgagcaaaga

SEQ ID NO: 159014 - DNA, 25 bp, Mus musculus
aaagtgcagagacttcttccctagg

SEQ ID NO: 159015 - DNA, 25 bp, Mus musculus
aaagtgcagagatccgtggacagct

SEQ ID NO: 159016 - DNA, 25 bp, Mus musculus
aaagtgcagaggattcctacgaggc

SEQ ID NO: 159017 - DNA, 25 bp, Mus musculus
aaagtgcagaggttcaaggcaacac

SEQ ID NO: 159018 - DNA, 25 bp, Mus musculus
aaagtgcatccatgcagtattcaag

SEQ ID NO: 159019 - DNA, 25 bp, Mus musculus
aaagtgcgagacggtcgcagagggt

SEQ ID NO: 159020 - DNA, 25 bp, Mus musculus
aaagtgcgaggagatgctcacgtag

SEQ ID NO: 159021 - DNA, 25 bp, Mus musculus
aaagtgcgatgcgctgttcctgggc

SEQ ID NO: 159022 - DNA, 25 bp, Mus musculus
aaagtgcgatgcgtcgtcccccaga

SEQ ID NO: 159023 - DNA, 25 bp, Mus musculus
aaagtgcgcaaatgaagaagccggc

SEQ ID NO: 159024 - DNA, 25 bp, Mus musculus
aaagtgcgcaaatgggagaagaaat

SEQ ID NO: 159025 - DNA, 25 bp, Mus musculus
aaagtgcgcgacaggctgtttggtc

SEQ ID NO: 159026 - DNA, 25 bp, Mus musculus
aaagtgcgcgacaggttctggatgg

SEQ ID NO: 159027 - DNA, 25 bp, Mus musculus
aaagtgcggaaatgggagaagaaat

SEQ ID NO: 159028 - DNA, 25 bp, Mus musculus
aaagtgcggccggatgagattatgc

SEQ ID NO: 159029 - DNA, 25 bp, Mus musculus
aaagtgcggccggatgccactacga

SEQ ID NO: 159030 - DNA, 25 bp, Mus musculus
aaagtgctcaggaagtctaaagcta

SEQ ID NO: 159031 - DNA, 25 bp, Mus musculus
aaagtgctcatccagctcagcacat

SEQ ID NO: 159032 - DNA, 25 bp, Mus musculus
aaagtgctcatccaggaacaacttc

SEQ ID NO: 159033 - DNA, 25 bp, Mus musculus
aaagtgctcatccaggtgggatatg

SEQ ID NO: 159034 - DNA, 25 bp, Mus musculus
aaagtgctgaggctgcctgctgtct

SEQ ID NO: 159035 - DNA, 25 bp, Mus musculus
aaagtgctgatggagtttgtggaaa

SEQ ID NO: 159036 - DNA, 25 bp, Mus musculus
aaagtgctgcacaatgccttaggat

SEQ ID NO: 159037 - DNA, 25 bp, Mus musculus
aaagtggaagcgaaggcaaacttaa

SEQ ID NO: 159038 - DNA, 25 bp, Mus musculus
aaagtggaagctaaaagagcatgaa

SEQ ID NO: 159039 - DNA, 25 bp, Mus musculus
aaagtggacagtcccaccgtcacaa

SEQ ID NO: 159040 - DNA, 25 bp, Mus musculus
aaagtggagaataagcgtgaagtgc

SEQ ID NO: 159041 - DNA, 25 bp, Mus musculus
aaagtggagaataagtggtacaggg

SEQ ID NO: 159042 - DNA, 25 bp, Mus musculus
aaagtggatgcagctgccatcaaac

SEQ ID NO: 159043 - DNA, 25 bp, Mus musculus
aaagtggcaagaaggaaaacaaatt

SEQ ID NO: 159044 - DNA, 25 bp, Mus musculus
aaagtggcaagagagatctccagtc

SEQ ID NO: 159045 - DNA, 25 bp, Mus musculus
aaagtggcaagatcttagggttgga

SEQ ID NO: 159046 - DNA, 25 bp, Mus musculus
aaagtggcaagtcagtacaggctac

SEQ ID NO: 159047 - DNA, 25 bp, Mus musculus
aaagtggcagaagactcagaggcct

SEQ ID NO: 159048 - DNA, 25 bp, Mus musculus
aaagtggcaggccgcatccacgcca

SEQ ID NO: 159049 - DNA, 25 bp, Mus musculus
aaagtggccaagctgaacatccaga

SEQ ID NO: 159050 - DNA, 25 bp, Mus musculus
aaagtggccaggagcttgcaagtgt

SEQ ID NO: 159051 - DNA, 25 bp, Mus musculus
aaagtggccgaggaggtccagatta

SEQ ID NO: 159052 - DNA, 25 bp, Mus musculus
aaagtggcctcagataatgattttt

SEQ ID NO: 159053 - DNA, 25 bp, Mus musculus
aaagtggcctcaggtgcgttcattc

SEQ ID NO: 159054 - DNA, 25 bp, Mus musculus
aaagtggcgaaggtcttccatgttt

SEQ ID NO: 159055 - DNA, 25 bp, Mus musculus
aaagtggcgcagatgggatacagat

SEQ ID NO: 159056 - DNA, 25 bp, Mus musculus
aaagtggcgcagatggtcaccctgc

SEQ ID NO: 159057 - DNA, 25 bp, Mus musculus
aaagtgggacaagatgcagcaccga

SEQ ID NO: 159058 - DNA, 25 bp, Mus musculus
aaagtggggcatgagtgtaatgttc

SEQ ID NO: 159059 - DNA, 25 bp, Mus musculus
aaagtgggggatcctgcagaggact

SEQ ID NO: 159060 - DNA, 25 bp, Mus musculus
aaagtggtggaggggatcctggaca

SEQ ID NO: 159061 - DNA, 25 bp, Mus musculus
aaagtgtcaaatatggacctgggtc

SEQ ID NO: 159062 - DNA, 25 bp, Mus musculus
aaagtgtcaaatatggccaccaggc

SEQ ID NO: 159063 - DNA, 25 bp, Mus musculus
aaagtgtccgtgcatgaccatgtaa

SEQ ID NO: 159064 - DNA, 25 bp, Mus musculus
aaagtgtccgtgctgaaccccacag

SEQ ID NO: 159065 - DNA, 25 bp, Mus musculus
aaagtgtccgtggatgaccatgtaa

SEQ ID NO: 159066 - DNA, 25 bp, Mus musculus
aaagtgtccgtggtgaaccccacag

SEQ ID NO: 159067 - DNA, 25 bp, Mus musculus
aaagtgtctcagaatgcaaagtatg

SEQ ID NO: 159068 - DNA, 25 bp, Mus musculus
aaagtgtctcagccttcgtagtgca

SEQ ID NO: 159069 - DNA, 25 bp, Mus musculus
aaagtgtctgcttttcagaaaggcg

SEQ ID NO: 159070 - DNA, 25 bp, Mus musculus
aaagtgtgagaccatccatgtggcc

SEQ ID NO: 159071 - DNA, 25 bp, Mus musculus
aaagtgtgagtccatccatgtggcc

SEQ ID NO: 159072 - DNA, 25 bp, Mus musculus
aaagtgtgcaggtttcaactctgag

SEQ ID NO: 159073 - DNA, 25 bp, Mus musculus
aaagtgtgcagttcagaggttcagt

SEQ ID NO: 159074 - DNA, 25 bp, Mus musculus
aaagtgtgccaccaggatccaagcc
